United States Patent 7,655,785 (BIOINFORMATICALLY DETECTABLE GROUP OF NOVEL REGULATORY OLIGONUCLEOTIDES AND USES THEREOF) - sequence listing, part 30

SEQ ID NO: 1224943 - RNA, 12 nt, Homo sapiens
aguugccaaagu

SEQ ID NO: 1224944 - RNA, 15 nt, Homo sapiens
aguugccacauuuag

SEQ ID NO: 1224945 - RNA, 21 nt, Homo sapiens
aguugccuuuauuugcuguua

SEQ ID NO: 1224946 - RNA, 23 nt, Homo sapiens
aguugcgacggagagaaaaaaga

SEQ ID NO: 1224947 - RNA, 19 nt, Homo sapiens
aguugcguggacucugcac

SEQ ID NO: 1224948 - RNA, 20 nt, Homo sapiens
aguugcguggacucugcaca

SEQ ID NO: 1224949 - RNA, 14 nt, Homo sapiens
aguuggaauguugu

SEQ ID NO: 1224950 - RNA, 13 nt, Homo sapiens
aguuggagaccag

SEQ ID NO: 1224951 - RNA, 17 nt, Homo sapiens
aguugguuuaaugauug

SEQ ID NO: 1224952 - RNA, 14 nt, Homo sapiens
aguuguacacugug

SEQ ID NO: 1224953 - RNA, 16 nt, Homo sapiens
aguuguuuugcuucuu

SEQ ID NO: 1224954 - RNA, 23 nt, Homo sapiens
aguuuaauuuuugaaaacuggcu

SEQ ID NO: 1224955 - RNA, 16 nt, Homo sapiens
aguuuacaaucagcca

SEQ ID NO: 1224956 - RNA, 16 nt, Homo sapiens
aguuuacugaagcaaa

SEQ ID NO: 1224957 - RNA, 13 nt, Homo sapiens
aguuuaucuuuca

SEQ ID NO: 1224958 - RNA, 22 nt, Homo sapiens
aguuucaaugugauucuaaugu

SEQ ID NO: 1224959 - RNA, 15 nt, Homo sapiens
aguuucacaugagcu

SEQ ID NO: 1224960 - RNA, 22 nt, Homo sapiens
aguuucacaugagcuauuucca

SEQ ID NO: 1224961 - RNA, 15 nt, Homo sapiens
aguuucagacuugga

SEQ ID NO: 1224962 - RNA, 14 nt, Homo sapiens
aguuucaggugaca

SEQ ID NO: 1224963 - RNA, 21 nt, Homo sapiens
aguuucauguacaagaugaag

SEQ ID NO: 1224964 - RNA, 15 nt, Homo sapiens
aguuuccauauguua

SEQ ID NO: 1224965 - RNA, 23 nt, Homo sapiens
aguuuccuauguuucacugugca

SEQ ID NO: 1224966 - RNA, 16 nt, Homo sapiens
aguuucuaagauucua

SEQ ID NO: 1224967 - RNA, 17 nt, Homo sapiens
aguuucuggcucuugag

SEQ ID NO: 1224968 - RNA, 23 nt, Homo sapiens
aguuugaacucuguaaaaccuca

SEQ ID NO: 1224969 - RNA, 18 nt, Homo sapiens
aguuugaccucacaguga

SEQ ID NO: 1224970 - RNA, 14 nt, Homo sapiens
aguuugacugugcu

SEQ ID NO: 1224971 - RNA, 20 nt, Homo sapiens
aguuugagaccagccucauc

SEQ ID NO: 1224972 - RNA, 16 nt, Homo sapiens
aguuugauaccugcac

SEQ ID NO: 1224973 - RNA, 18 nt, Homo sapiens
aguuugauaccugcacug

SEQ ID NO: 1224974 - RNA, 11 nt, Homo sapiens
aguuugcaguu

SEQ ID NO: 1224975 - RNA, 16 nt, Homo sapiens
aguuugccuuccuuuc

SEQ ID NO: 1224976 - RNA, 22 nt, Homo sapiens
aguuugggguguauacuucuau

SEQ ID NO: 1224977 - RNA, 16 nt, Homo sapiens
aguuuggguaaaauac

SEQ ID NO: 1224978 - RNA, 17 nt, Homo sapiens
aguuuguagguaaaaug

SEQ ID NO: 1224979 - RNA, 22 nt, Homo sapiens
aguuuuaccucuucucucucag

SEQ ID NO: 1224980 - RNA, 13 nt, Homo sapiens
aguuuucaaguca

SEQ ID NO: 1224981 - RNA, 13 nt, Homo sapiens
aguuuuccaugaa

SEQ ID NO: 1224982 - RNA, 18 nt, Homo sapiens
aguuuuccccuggccuca

SEQ ID NO: 1224983 - RNA, 13 nt, Homo sapiens
aguuuugaugaaa

SEQ ID NO: 1224984 - RNA, 19 nt, Homo sapiens
aguuuuggaaacguauuca

SEQ ID NO: 1224985 - RNA, 14 nt, Homo sapiens
aguuuuguacaaag

SEQ ID NO: 1224986 - RNA, 15 nt, Homo sapiens
auaaaaaagucucua

SEQ ID NO: 1224987 - RNA, 23 nt, Homo sapiens
auaaaaaaugguucagaauuaaa

SEQ ID NO: 1224988 - RNA, 23 nt, Homo sapiens
auaaaaacuaaauuguaaacucc

SEQ ID NO: 1224989 - RNA, 19 nt, Homo sapiens
auaaaaacucauccauggc

SEQ ID NO: 1224990 - RNA, 14 nt, Homo sapiens
auaaaaagcagaau

SEQ ID NO: 1224991 - RNA, 15 nt, Homo sapiens
auaaaaagugacaca

SEQ ID NO: 1224992 - RNA, 14 nt, Homo sapiens
auuuacaugugauu

SEQ ID NO: 1224993 - RNA, 19 nt, Homo sapiens
auuuacuuaacagaacagu

SEQ ID NO: 1224994 - RNA, 21 nt, Homo sapiens
auuuagaaacugauuucuuca

SEQ ID NO: 1224995 - RNA, 21 nt, Homo sapiens
auuuagacucaucuuacugua

SEQ ID NO: 1224996 - RNA, 18 nt, Homo sapiens
auuuagauauaacacuau

SEQ ID NO: 1224997 - RNA, 13 nt, Homo sapiens
auuuaguccugua

SEQ ID NO: 1224998 - RNA, 16 nt, Homo sapiens
auuuagucuugccagg

SEQ ID NO: 1224999 - RNA, 17 nt, Homo sapiens
auuuaguucaacuguau

SEQ ID NO: 1225000 - RNA, 15 nt, Homo sapiens
auuuaguuggaauau

SEQ ID NO: 1225001 - RNA, 21 nt, Homo sapiens
auuuaguuuguagcucauuaa

SEQ ID NO: 1225002 - RNA, 21 nt, Homo sapiens
auuuauaaaacuucucaagau

SEQ ID NO: 1225003 - RNA, 21 nt, Homo sapiens
auuuauacucacugagucuua

SEQ ID NO: 1225004 - RNA, 21 nt, Homo sapiens
auuuauacuuugcaauccaaa

SEQ ID NO: 1225005 - RNA, 15 nt, Homo sapiens
auuuauagcuaugaa

SEQ ID NO: 1225006 - RNA, 18 nt, Homo sapiens
auuuauagcuaugaaacc

SEQ ID NO: 1225007 - RNA, 12 nt, Homo sapiens
auuuauauaugu

SEQ ID NO: 1225008 - RNA, 22 nt, Homo sapiens
auuuauaucuaauuauuuccac

SEQ ID NO: 1225009 - RNA, 16 nt, Homo sapiens
auuuauauuacugucu

SEQ ID NO: 1225010 - RNA, 12 nt, Homo sapiens
auuuaucaagga

SEQ ID NO: 1225011 - RNA, 13 nt, Homo sapiens
auuuaucacugaa

SEQ ID NO: 1225012 - RNA, 16 nt, Homo sapiens
auuuaucauuuaguua

SEQ ID NO: 1225013 - RNA, 15 nt, Homo sapiens
auuuaucugaucaag

SEQ ID NO: 1225014 - RNA, 16 nt, Homo sapiens
auuuaugaaucacagu

SEQ ID NO: 1225015 - RNA, 19 nt, Homo sapiens
auuuaugagaaaguucuca

SEQ ID NO: 1225016 - RNA, 20 nt, Homo sapiens
auuuaugccucuguauuuaa

SEQ ID NO: 1225017 - RNA, 20 nt, Homo sapiens
auuuauggucaacacuuaag

SEQ ID NO: 1225018 - RNA, 22 nt, Homo sapiens
auuuaugugaguguguguuugu

SEQ ID NO: 1225019 - RNA, 13 nt, Homo sapiens
auuuauuaaucua

SEQ ID NO: 1225020 - RNA, 17 nt, Homo sapiens
auuuauuaccucugaua

SEQ ID NO: 1225021 - RNA, 19 nt, Homo sapiens
auuuauucacauauaucaa

SEQ ID NO: 1225022 - RNA, 12 nt, Homo sapiens
auuuauucugau

SEQ ID NO: 1225023 - RNA, 16 nt, Homo sapiens
auuuauuuacauguga

SEQ ID NO: 1225024 - RNA, 16 nt, Homo sapiens
auuuauuucauccagu

SEQ ID NO: 1225025 - RNA, 15 nt, Homo sapiens
auuucaacauaucau

SEQ ID NO: 1225026 - RNA, 13 nt, Homo sapiens
auuucaacugaag

SEQ ID NO: 1225027 - RNA, 13 nt, Homo sapiens
auuucacaagcua

SEQ ID NO: 1225028 - RNA, 14 nt, Homo sapiens
auuucacaagcuau

SEQ ID NO: 1225029 - RNA, 15 nt, Homo sapiens
auuucacaagcuauu

SEQ ID NO: 1225030 - RNA, 15 nt, Homo sapiens
auuucaccaccaaau

SEQ ID NO: 1225031 - RNA, 21 nt, Homo sapiens
auuucaccccacagacacuua

SEQ ID NO: 1225032 - RNA, 23 nt, Homo sapiens
auuucacuggccuaaugagauaa

SEQ ID NO: 1225033 - RNA, 23 nt, Homo sapiens
auuucacuugaugauacaaugaa

SEQ ID NO: 1225034 - RNA, 22 nt, Homo sapiens
auuucagauaaacaacaaauaa

SEQ ID NO: 1225035 - RNA, 13 nt, Homo sapiens
auuucagcauuau

SEQ ID NO: 1225036 - RNA, 14 nt, Homo sapiens
auuucagcauuauu

SEQ ID NO: 1225037 - RNA, 12 nt, Homo sapiens
auuucaggcaua

SEQ ID NO: 1225038 - RNA, 15 nt, Homo sapiens
auuucauaaacaacu

SEQ ID NO: 1225039 - RNA, 22 nt, Homo sapiens
auuucauacaacagaaaccaga

SEQ ID NO: 1225040 - RNA, 14 nt, Homo sapiens
auuucauacuguaa

SEQ ID NO: 1225041 - RNA, 18 nt, Homo sapiens
auuuccaaaccuccacug

SEQ ID NO: 1225042 - RNA, 15 nt, Homo sapiens
auuuccaacaccaca

SEQ ID NO: 1225043 - RNA, 21 nt, Homo sapiens
auuuccacuaaaaaauuaaau

SEQ ID NO: 1225044 - RNA, 19 nt, Homo sapiens
auuuccagagccagcucaa

SEQ ID NO: 1225045 - RNA, 22 nt, Homo sapiens
auuuccagcuuucuccccgcua

SEQ ID NO: 1225046 - RNA, 15 nt, Homo sapiens
auuuccuccucaucu

SEQ ID NO: 1225047 - RNA, 13 nt, Homo sapiens
auuuccugacaga

SEQ ID NO: 1225048 - RNA, 17 nt, Homo sapiens
auuuccuugacuucuuu

SEQ ID NO: 1225049 - RNA, 21 nt, Homo sapiens
auuuccuuggcuucgugaaug

SEQ ID NO: 1225050 - RNA, 16 nt, Homo sapiens
auuucuaccugaguga

SEQ ID NO: 1225051 - RNA, 20 nt, Homo sapiens
auuucuacuaugagggccuu

SEQ ID NO: 1225052 - RNA, 23 nt, Homo sapiens
auuucuacuucuggaagucaucu

SEQ ID NO: 1225053 - RNA, 20 nt, Homo sapiens
auuucuagcagugaugaaaa

SEQ ID NO: 1225054 - RNA, 16 nt, Homo sapiens
auuucucaaaaaccac

SEQ ID NO: 1225055 - RNA, 18 nt, Homo sapiens
auuucucacacacuggcu

SEQ ID NO: 1225056 - RNA, 20 nt, Homo sapiens
auuucuccguugagucaucu

SEQ ID NO: 1225057 - RNA, 19 nt, Homo sapiens
auuucucuaacuccugcca

SEQ ID NO: 1225058 - RNA, 16 nt, Homo sapiens
auuucugaauucaaag

SEQ ID NO: 1225059 - RNA, 14 nt, Homo sapiens
auuucugacucuau

SEQ ID NO: 1225060 - RNA, 17 nt, Homo sapiens
auuucugacucuaucau

SEQ ID NO: 1225061 - RNA, 20 nt, Homo sapiens
auuucugagagugaaaccau

SEQ ID NO: 1225062 - RNA, 21 nt, Homo sapiens
auuucugauauaacaaacuac

SEQ ID NO: 1225063 - RNA, 16 nt, Homo sapiens
auuucugccaggcaug

SEQ ID NO: 1225064 - RNA, 14 nt, Homo sapiens
auuucugcuuucuu

SEQ ID NO: 1225065 - RNA, 19 nt, Homo sapiens
auuucugguucugaugcca

SEQ ID NO: 1225066 - RNA, 16 nt, Homo sapiens
auuucugucacucaca

SEQ ID NO: 1225067 - RNA, 20 nt, Homo sapiens
auuucugucagaaugcuauu

SEQ ID NO: 1225068 - RNA, 18 nt, Homo sapiens
auuucuguucacuuugua

SEQ ID NO: 1225069 - RNA, 11 nt, Homo sapiens
auuucuuaggg

SEQ ID NO: 1225070 - RNA, 17 nt, Homo sapiens
auuucuucuacugcuau

SEQ ID NO: 1225071 - RNA, 13 nt, Homo sapiens
auuucuugugaug

SEQ ID NO: 1225072 - RNA, 19 nt, Homo sapiens
auuucuuucuuuccuuaau

SEQ ID NO: 1225073 - RNA, 18 nt, Homo sapiens
auuucuuuuauguuaacu

SEQ ID NO: 1225074 - RNA, 21 nt, Homo sapiens
auuugaaaccaggacauuaaa

SEQ ID NO: 1225075 - RNA, 13 nt, Homo sapiens
auuugaacacugg

SEQ ID NO: 1225076 - RNA, 19 nt, Homo sapiens
auuugaacucuucaaucuc

SEQ ID NO: 1225077 - RNA, 19 nt, Homo sapiens
auuugaagcaucacauaaa

SEQ ID NO: 1225078 - RNA, 22 nt, Homo sapiens
auuugaaugugguuacuuccua

SEQ ID NO: 1225079 - RNA, 18 nt, Homo sapiens
auuugacauacaaaaagg

SEQ ID NO: 1225080 - RNA, 12 nt, Homo sapiens
auuugauaccau

SEQ ID NO: 1225081 - RNA, 18 nt, Homo sapiens
auuugauaccauggcacu

SEQ ID NO: 1225082 - RNA, 13 nt, Homo sapiens
auuugauacuuau

SEQ ID NO: 1225083 - RNA, 16 nt, Homo sapiens
auuugaucacuacaag

SEQ ID NO: 1225084 - RNA, 16 nt, Homo sapiens
auuugauuaacaaaua

SEQ ID NO: 1225085 - RNA, 15 nt, Homo sapiens
auuugcaacauuuac

SEQ ID NO: 1225086 - RNA, 21 nt, Homo sapiens
auuugcaacucacugauucuc

SEQ ID NO: 1225087 - RNA, 17 nt, Homo sapiens
auuugcacacugcacug

SEQ ID NO: 1225088 - RNA, 14 nt, Homo sapiens
auuugcaguauuca

SEQ ID NO: 1225089 - RNA, 16 nt, Homo sapiens
auuugcauaaagugaa

SEQ ID NO: 1225090 - RNA, 21 nt, Homo sapiens
auuugcauugaggaaauauua

SEQ ID NO: 1225091 - RNA, 23 nt, Homo sapiens
auuugcauugaggaaauauuaau

SEQ ID NO: 1225092 - RNA, 23 nt, Homo sapiens
auuugcauuugcucuuucaucuc

SEQ ID NO: 1225093 - RNA, 18 nt, Homo sapiens
auuugcuacugucauuuc

SEQ ID NO: 1225094 - RNA, 18 nt, Homo sapiens
auuugcucuuucaucucu

SEQ ID NO: 1225095 - RNA, 15 nt, Homo sapiens
auuugcucuuugaca

SEQ ID NO: 1225096 - RNA, 19 nt, Homo sapiens
auuugcugagcauguacug

SEQ ID NO: 1225097 - RNA, 15 nt, Homo sapiens
auuugcuuuuugcua

SEQ ID NO: 1225098 - RNA, 14 nt, Homo sapiens
auuuggagugacca

SEQ ID NO: 1225099 - RNA, 15 nt, Homo sapiens
auuuggauugcuaau

SEQ ID NO: 1225100 - RNA, 17 nt, Homo sapiens
auuuggcucacuugccu

SEQ ID NO: 1225101 - RNA, 21 nt, Homo sapiens
auuugggggaacuggacacaa

SEQ ID NO: 1225102 - RNA, 15 nt, Homo sapiens
auuugggugaacaaa

SEQ ID NO: 1225103 - RNA, 20 nt, Homo sapiens
auuugguaaaaaugcugcuc

SEQ ID NO: 1225104 - RNA, 21 nt, Homo sapiens
auuugguaauucuguguaaca

SEQ ID NO: 1225105 - RNA, 18 nt, Homo sapiens
auuugguuauuuaaucac

SEQ ID NO: 1225106 - RNA, 17 nt, Homo sapiens
auuuguaaaucugccac

SEQ ID NO: 1225107 - RNA, 21 nt, Homo sapiens
auuuguaauuccuuacuguaa

SEQ ID NO: 1225108 - RNA, 19 nt, Homo sapiens
auuuguagauuaggauuaa

SEQ ID NO: 1225109 - RNA, 22 nt, Homo sapiens
auuuguagguaauguuccugaa

SEQ ID NO: 1225110 - RNA, 20 nt, Homo sapiens
auuuguaugcucauugaacu

SEQ ID NO: 1225111 - RNA, 17 nt, Homo sapiens
auuuguauuaauaaagc

SEQ ID NO: 1225112 - RNA, 23 nt, Homo sapiens
auuugucaggacaagggcucaga

SEQ ID NO: 1225113 - RNA, 15 nt, Homo sapiens
auuugugccacuuua

SEQ ID NO: 1225114 - RNA, 19 nt, Homo sapiens
auuuguguauaucauacau

SEQ ID NO: 1225115 - RNA, 14 nt, Homo sapiens
auuuguguauuaua

SEQ ID NO: 1225116 - RNA, 17 nt, Homo sapiens
auuuguuauacuucaaa

SEQ ID NO: 1225117 - RNA, 14 nt, Homo sapiens
auuuguucagagag

SEQ ID NO: 1225118 - RNA, 23 nt, Homo sapiens
auuuguuccugccacuguguacu

SEQ ID NO: 1225119 - RNA, 16 nt, Homo sapiens
caacagagcacuugag

SEQ ID NO: 1225120 - RNA, 16 nt, Homo sapiens
caacagauguuuuauu

SEQ ID NO: 1225121 - RNA, 21 nt, Homo sapiens
caacaggcuguucugcacuga

SEQ ID NO: 1225122 - RNA, 13 nt, Homo sapiens
caacagggaaccg

SEQ ID NO: 1225123 - RNA, 16 nt, Homo sapiens
caacaggucacuugau

SEQ ID NO: 1225124 - RNA, 18 nt, Homo sapiens
caacaguggaauucaccu

SEQ ID NO: 1225125 - RNA, 15 nt, Homo sapiens
caacauaccaagacc

SEQ ID NO: 1225126 - RNA, 14 nt, Homo sapiens
caacaucuggucuu

SEQ ID NO: 1225127 - RNA, 16 nt, Homo sapiens
caacaugcacugaugu

SEQ ID NO: 1225128 - RNA, 16 nt, Homo sapiens
caacaugcgaccguga

SEQ ID NO: 1225129 - RNA, 17 nt, Homo sapiens
caacaugcgaccgugac

SEQ ID NO: 1225130 - RNA, 21 nt, Homo sapiens
caacaugguaaaaccccaucu

SEQ ID NO: 1225131 - RNA, 18 nt, Homo sapiens
caacauugcuugugccac

SEQ ID NO: 1225132 - RNA, 13 nt, Homo sapiens
caaccacaugcag

SEQ ID NO: 1225133 - RNA, 13 nt, Homo sapiens
caaccagaccacu

SEQ ID NO: 1225134 - RNA, 21 nt, Homo sapiens
caacccaauaaaacugauguu

SEQ ID NO: 1225135 - RNA, 19 nt, Homo sapiens
caacccacucccuguagug

SEQ ID NO: 1225136 - RNA, 20 nt, Homo sapiens
caaccccuccccuccauccc

SEQ ID NO: 1225137 - RNA, 20 nt, Homo sapiens
caaccccuucgcuccugugu

SEQ ID NO: 1225138 - RNA, 14 nt, Homo sapiens
caacccggcacugc

SEQ ID NO: 1225139 - RNA, 12 nt, Homo sapiens
caaccucaucca

SEQ ID NO: 1225140 - RNA, 15 nt, Homo sapiens
caaccucaucugcac

SEQ ID NO: 1225141 - RNA, 19 nt, Homo sapiens
caaccucauugacaagaac

SEQ ID NO: 1225142 - RNA, 19 nt, Homo sapiens
ccacauauuuuagacacuu

SEQ ID NO: 1225143 - RNA, 21 nt, Homo sapiens
ccacauauuuuagacacuucc

SEQ ID NO: 1225144 - RNA, 15 nt, Homo sapiens
ccacauccuguguca

SEQ ID NO: 1225145 - RNA, 23 nt, Homo sapiens
ccacauccugugucagaaacccu

SEQ ID NO: 1225146 - RNA, 22 nt, Homo sapiens
ccagauuggauauggacucuuu

SEQ ID NO: 1225147 - RNA, 21 nt, Homo sapiens
ccagauuggcaccccuuucua

SEQ ID NO: 1225148 - RNA, 23 nt, Homo sapiens
ccagcaaagaggacucgcuugua

SEQ ID NO: 1225149 - RNA, 19 nt, Homo sapiens
ccagcaagcacuguggucu

SEQ ID NO: 1225150 - RNA, 19 nt, Homo sapiens
ccagcaauaggguggcaca

SEQ ID NO: 1225151 - RNA, 16 nt, Homo sapiens
ccagcaaucugcauuu

SEQ ID NO: 1225152 - RNA, 21 nt, Homo sapiens
ccagcacagcuuagauuucau

SEQ ID NO: 1225153 - RNA, 12 nt, Homo sapiens
ccagcacccucu

SEQ ID NO: 1225154 - RNA, 12 nt, Homo sapiens
ccagcaccugcc

SEQ ID NO: 1225155 - RNA, 12 nt, Homo sapiens
ccagcacuucca

SEQ ID NO: 1225156 - RNA, 15 nt, Homo sapiens
ccagcacuuggcuga

SEQ ID NO: 1225157 - RNA, 16 nt, Homo sapiens
ccagcacuuugggagg

SEQ ID NO: 1225158 - RNA, 19 nt, Homo sapiens
ccagcagaagcaggguacc

SEQ ID NO: 1225159 - RNA, 16 nt, Homo sapiens
ccagcaggacagugac

SEQ ID NO: 1225160 - RNA, 17 nt, Homo sapiens
ccagcaguucuguuaua

SEQ ID NO: 1225161 - RNA, 15 nt, Homo sapiens
ccagcaucuggagac

SEQ ID NO: 1225162 - RNA, 12 nt, Homo sapiens
ccagcauuccag

SEQ ID NO: 1225163 - RNA, 12 nt, Homo sapiens
ccagccaugcau

SEQ ID NO: 1225164 - RNA, 16 nt, Homo sapiens
ccagccaugugccuua

SEQ ID NO: 1225165 - RNA, 17 nt, Homo sapiens
ccagcccagacccagug

SEQ ID NO: 1225166 - RNA, 15 nt, Homo sapiens
ccagccccacacagc

SEQ ID NO: 1225167 - RNA, 17 nt, Homo sapiens
ccagccccacugccagc

SEQ ID NO: 1225168 - RNA, 22 nt, Homo sapiens
ccagccccucccccaucuccca

SEQ ID NO: 1225169 - RNA, 22 nt, Homo sapiens
ccagcccggggcaggugcagcc

SEQ ID NO: 1225170 - RNA, 20 nt, Homo sapiens
ccagccguauuuuacaugaa

SEQ ID NO: 1225171 - RNA, 20 nt, Homo sapiens
ccagccgugaugcucaggcu

SEQ ID NO: 1225172 - RNA, 14 nt, Homo sapiens
ccagccuccaugcu

SEQ ID NO: 1225173 - RNA, 16 nt, Homo sapiens
ccagccuccaugcugc

SEQ ID NO: 1225174 - RNA, 13 nt, Homo sapiens
ccagccuccugcu

SEQ ID NO: 1225175 - RNA, 19 nt, Homo sapiens
ccagccugaggcagccacu

SEQ ID NO: 1225176 - RNA, 13 nt, Homo sapiens
ccagccuggaucu

SEQ ID NO: 1225177 - RNA, 15 nt, Homo sapiens
ccagccuggccaaca

SEQ ID NO: 1225178 - RNA, 20 nt, Homo sapiens
ccagccugggcagccaggcu

SEQ ID NO: 1225179 - RNA, 23 nt, Homo sapiens
ccagccuucuccaggacaaccug

SEQ ID NO: 1225180 - RNA, 14 nt, Homo sapiens
ccagcgcaccuguu

SEQ ID NO: 1225181 - RNA, 17 nt, Homo sapiens
ccagcgggcacagggca

SEQ ID NO: 1225182 - RNA, 21 nt, Homo sapiens
ccagcuacuugggaggcugag

SEQ ID NO: 1225183 - RNA, 19 nt, Homo sapiens
ccagcucauucucaccaau

SEQ ID NO: 1225184 - RNA, 11 nt, Homo sapiens
ccagcucugac

SEQ ID NO: 1225185 - RNA, 18 nt, Homo sapiens
ccagcucugacaucccuu

SEQ ID NO: 1225186 - RNA, 13 nt, Homo sapiens
ccagcugcagcug

SEQ ID NO: 1225187 - RNA, 17 nt, Homo sapiens
ccagcugccaggcugaa

SEQ ID NO: 1225188 - RNA, 20 nt, Homo sapiens
ccagcugccuuggacugugu

SEQ ID NO: 1225189 - RNA, 13 nt, Homo sapiens
ccagcugcuccca

SEQ ID NO: 1225190 - RNA, 12 nt, Homo sapiens
ccagcuggagaa

SEQ ID NO: 1225191 - RNA, 16 nt, Homo sapiens
ccagcuguagccaugg

SEQ ID NO: 1225192 - RNA, 14 nt, Homo sapiens
ccagcugugcugug

SEQ ID NO: 1225193 - RNA, 21 nt, Homo sapiens
ccagcuuaugagcucaaagua

SEQ ID NO: 1225194 - RNA, 21 nt, Homo sapiens
ccagcuugcgaauaacagucc

SEQ ID NO: 1225195 - RNA, 19 nt, Homo sapiens
ccagcuuucccugccucuc

SEQ ID NO: 1225196 - RNA, 14 nt, Homo sapiens
ccagcuuugcagug

SEQ ID NO: 1225197 - RNA, 15 nt, Homo sapiens
ccagcuuugcccaac

SEQ ID NO: 1225198 - RNA, 14 nt, Homo sapiens
ccaggaaaggccca

SEQ ID NO: 1225199 - RNA, 20 nt, Homo sapiens
ccaggaaagguuuuccuuau

SEQ ID NO: 1225200 - RNA, 14 nt, Homo sapiens
ccaggaagagcuga

SEQ ID NO: 1225201 - RNA, 17 nt, Homo sapiens
ccaggaagcccacacua

SEQ ID NO: 1225202 - RNA, 19 nt, Homo sapiens
ccaggaauuagagaagcug

SEQ ID NO: 1225203 - RNA, 21 nt, Homo sapiens
ccaggaauuagagaagcugaa

SEQ ID NO: 1225204 - RNA, 13 nt, Homo sapiens
ccaggacaucucu

SEQ ID NO: 1225205 - RNA, 13 nt, Homo sapiens
ccaggaccacaga

SEQ ID NO: 1225206 - RNA, 14 nt, Homo sapiens
ccaggaccagcugg

SEQ ID NO: 1225207 - RNA, 12 nt, Homo sapiens
ccaggacugagc

SEQ ID NO: 1225208 - RNA, 22 nt, Homo sapiens
ccaggaggagaaagcagccauu

SEQ ID NO: 1225209 - RNA, 18 nt, Homo sapiens
ccaggauaaggagacuga

SEQ ID NO: 1225210 - RNA, 15 nt, Homo sapiens
ccaggauagugggca

SEQ ID NO: 1225211 - RNA, 23 nt, Homo sapiens
ccaggauauugacaagaauacac

SEQ ID NO: 1225212 - RNA, 19 nt, Homo sapiens
ccaggaucaugguguaaua

SEQ ID NO: 1225213 - RNA, 19 nt, Homo sapiens
ccaggaugaguuacuugaa

SEQ ID NO: 1225214 - RNA, 14 nt, Homo sapiens
ccaggauucagcua

SEQ ID NO: 1225215 - RNA, 18 nt, Homo sapiens
ccaggcaggucuugaacu

SEQ ID NO: 1225216 - RNA, 17 nt, Homo sapiens
ccaggccaacagcaccu

SEQ ID NO: 1225217 - RNA, 21 nt, Homo sapiens
ccaggccacccaaaggagcuc

SEQ ID NO: 1225218 - RNA, 18 nt, Homo sapiens
ccaggccagagggcagug

SEQ ID NO: 1225219 - RNA, 19 nt, Homo sapiens
ccaggcccaccaucaccac

SEQ ID NO: 1225220 - RNA, 18 nt, Homo sapiens
ccaggcccgagaugugac

SEQ ID NO: 1225221 - RNA, 18 nt, Homo sapiens
ccaggccggccagccuca

SEQ ID NO: 1225222 - RNA, 16 nt, Homo sapiens
ccaggccucuuggcag

SEQ ID NO: 1225223 - RNA, 15 nt, Homo sapiens
ccaggccugagcaac

SEQ ID NO: 1225224 - RNA, 19 nt, Homo sapiens
ccaggcuaguccggaccca

SEQ ID NO: 1225225 - RNA, 20 nt, Homo sapiens
ccaggcugaauuacagugaa

SEQ ID NO: 1225226 - RNA, 17 nt, Homo sapiens
ccaggcugcacugcagu

SEQ ID NO: 1225227 - RNA, 18 nt, Homo sapiens
ccaggcuggagugcaaug

SEQ ID NO: 1225228 - RNA, 19 nt, Homo sapiens
ccaggcuggagugcaaugg

SEQ ID NO: 1225229 - RNA, 23 nt, Homo sapiens
ccaggcuggagugcaguggugca

SEQ ID NO: 1225230 - RNA, 12 nt, Homo sapiens
ccaggcuguagg

SEQ ID NO: 1225231 - RNA, 16 nt, Homo sapiens
ccagggagggaagugu

SEQ ID NO: 1225232 - RNA, 23 nt, Homo sapiens
ccagggaugggggaugggccagg

SEQ ID NO: 1225233 - RNA, 15 nt, Homo sapiens
ccagggcauguguau

SEQ ID NO: 1225234 - RNA, 18 nt, Homo sapiens
ccagggcccuuguacaac

SEQ ID NO: 1225235 - RNA, 22 nt, Homo sapiens
ccagggcucccuuauguccacc

SEQ ID NO: 1225236 - RNA, 22 nt, Homo sapiens
ccagggucuugggcuacuggca

SEQ ID NO: 1225237 - RNA, 20 nt, Homo sapiens
ccagggugggagggcuaggg

SEQ ID NO: 1225238 - RNA, 18 nt, Homo sapiens
ccagguacaggagaggca

SEQ ID NO: 1225239 - RNA, 22 nt, Homo sapiens
ccaggucagcuguuacuuucuu

SEQ ID NO: 1225240 - RNA, 16 nt, Homo sapiens
ccaggugagaagugag

SEQ ID NO: 1225241 - RNA, 14 nt, Homo sapiens
ccagguguucuaca

SEQ ID NO: 1225242 - RNA, 19 nt, Homo sapiens
ccagguguucuacacucau

SEQ ID NO: 1225243 - RNA, 14 nt, Homo sapiens
ccagguuagccuuu

SEQ ID NO: 1225244 - RNA, 18 nt, Homo sapiens
ccaguauaagacuacuga

SEQ ID NO: 1225245 - RNA, 14 nt, Homo sapiens
ccaguauaccucau

SEQ ID NO: 1225246 - RNA, 19 nt, Homo sapiens
ccaguauaugcugauggac

SEQ ID NO: 1225247 - RNA, 20 nt, Homo sapiens
ccaguauugaaaacuucaaa

SEQ ID NO: 1225248 - RNA, 12 nt, Homo sapiens
ccaguccaugag

SEQ ID NO: 1225249 - RNA, 12 nt, Homo sapiens
ccaguccaugcu

SEQ ID NO: 1225250 - RNA, 21 nt, Homo sapiens
ccaguccccgaggagcugggc

SEQ ID NO: 1225251 - RNA, 14 nt, Homo sapiens
ccaguccuguccua

SEQ ID NO: 1225252 - RNA, 19 nt, Homo sapiens
ccagucucaaaaauacaaa

SEQ ID NO: 1225253 - RNA, 18 nt, Homo sapiens
ccagucugucuacugugg

SEQ ID NO: 1225254 - RNA, 13 nt, Homo sapiens
ccagugaaucugu

SEQ ID NO: 1225255 - RNA, 13 nt, Homo sapiens
ccagugacaaaga

SEQ ID NO: 1225256 - RNA, 14 nt, Homo sapiens
ccagugacaacauc

SEQ ID NO: 1225257 - RNA, 13 nt, Homo sapiens
ccagugacacuuc

SEQ ID NO: 1225258 - RNA, 15 nt, Homo sapiens
ccagugagacugugu

SEQ ID NO: 1225259 - RNA, 14 nt, Homo sapiens
ccagugagggcagu

SEQ ID NO: 1225260 - RNA, 14 nt, Homo sapiens
ccagugcaacagca

SEQ ID NO: 1225261 - RNA, 18 nt, Homo sapiens
ccagugcagaaaugaaau

SEQ ID NO: 1225262 - RNA, 12 nt, Homo sapiens
ccagugccauuc

SEQ ID NO: 1225263 - RNA, 23 nt, Homo sapiens
ccagugcuccaggcacccagcuu

SEQ ID NO: 1225264 - RNA, 15 nt, Homo sapiens
guuuacagcacuacu

SEQ ID NO: 1225265 - RNA, 23 nt, Homo sapiens
guuuacauuguaaauaguauuug

SEQ ID NO: 1225266 - RNA, 23 nt, Homo sapiens
guuuaccaugaagauaaacuguu

SEQ ID NO: 1225267 - RNA, 19 nt, Homo sapiens
guuuaccuuguauacugua

SEQ ID NO: 1225268 - RNA, 21 nt, Homo sapiens
guuuagacaguaugagucaau

SEQ ID NO: 1225269 - RNA, 14 nt, Homo sapiens
guuuaguugcacaa

SEQ ID NO: 1225270 - RNA, 20 nt, Homo sapiens
guuuauccaaaucuugaauu

SEQ ID NO: 1225271 - RNA, 20 nt, Homo sapiens
guuuauguaagagcaccuuc

SEQ ID NO: 1225272 - RNA, 14 nt, Homo sapiens
guuuauuacaauuu

SEQ ID NO: 1225273 - RNA, 17 nt, Homo sapiens
guuuauugaaugugauu

SEQ ID NO: 1225274 - RNA, 19 nt, Homo sapiens
guuuauuguauacugccuu

SEQ ID NO: 1225275 - RNA, 22 nt, Homo sapiens
guuuauuucaggcauuggauau

SEQ ID NO: 1225276 - RNA, 21 nt, Homo sapiens
guuuauuuccuagacuguuau

SEQ ID NO: 1225277 - RNA, 20 nt, Homo sapiens
guuuauuuuuauacuuucag

SEQ ID NO: 1225278 - RNA, 17 nt, Homo sapiens
guuucaacugugcucuu

SEQ ID NO: 1225279 - RNA, 19 nt, Homo sapiens
guuucaccauguuagccag

SEQ ID NO: 1225280 - RNA, 19 nt, Homo sapiens
guuucaccguguuagccag

SEQ ID NO: 1225281 - RNA, 20 nt, Homo sapiens
guuucauggguuauguguau

SEQ ID NO: 1225282 - RNA, 20 nt, Homo sapiens
guuucauuuagucaugugac

SEQ ID NO: 1225283 - RNA, 21 nt, Homo sapiens
guuuccacugccuccugugac

SEQ ID NO: 1225284 - RNA, 20 nt, Homo sapiens
guuuccauauuuuuugcaca

SEQ ID NO: 1225285 - RNA, 16 nt, Homo sapiens
guuucccuuucacugg

SEQ ID NO: 1225286 - RNA, 23 nt, Homo sapiens
guuuccgaaggguuuugcuacau

SEQ ID NO: 1225287 - RNA, 19 nt, Homo sapiens
guuuccuagcugugugaau

SEQ ID NO: 1225288 - RNA, 13 nt, Homo sapiens
guuuccuggucag

SEQ ID NO: 1225289 - RNA, 16 nt, Homo sapiens
guuucgacugguccag

SEQ ID NO: 1225290 - RNA, 21 nt, Homo sapiens
guuucguaacacagcauugua

SEQ ID NO: 1225291 - RNA, 19 nt, Homo sapiens
guuucuagagaacaguuga

SEQ ID NO: 1225292 - RNA, 20 nt, Homo sapiens
guuucuagcuagaaauauga

SEQ ID NO: 1225293 - RNA, 17 nt, Homo sapiens
guuucugauaccacugc

SEQ ID NO: 1225294 - RNA, 14 nt, Homo sapiens
guuucugcagcccu

SEQ ID NO: 1225295 - RNA, 14 nt, Homo sapiens
guuucuggcucuug

SEQ ID NO: 1225296 - RNA, 19 nt, Homo sapiens
guuucuggggaugucccag

SEQ ID NO: 1225297 - RNA, 16 nt, Homo sapiens
guuucuuaacuauaaa

SEQ ID NO: 1225298 - RNA, 15 nt, Homo sapiens
guuucuuccacaaca

SEQ ID NO: 1225299 - RNA, 15 nt, Homo sapiens
guuucuugugggcua

SEQ ID NO: 1225300 - RNA, 18 nt, Homo sapiens
guuugaaaauaugccugc

SEQ ID NO: 1225301 - RNA, 22 nt, Homo sapiens
guuugaagaugccgcauuugga

SEQ ID NO: 1225302 - RNA, 17 nt, Homo sapiens
guuugagcucaggcauu

SEQ ID NO: 1225303 - RNA, 18 nt, Homo sapiens
guuugauaccugcacugu

SEQ ID NO: 1225304 - RNA, 16 nt, Homo sapiens
guuugauauaccaaau

SEQ ID NO: 1225305 - RNA, 21 nt, Homo sapiens
guuugcuauugacaagucauu

SEQ ID NO: 1225306 - RNA, 16 nt, Homo sapiens
guuugcuuagcauucc

SEQ ID NO: 1225307 - RNA, 14 nt, Homo sapiens
guuugcuuauaugu

SEQ ID NO: 1225308 - RNA, 17 nt, Homo sapiens
guuugcuuauuguucca

SEQ ID NO: 1225309 - RNA, 17 nt, Homo sapiens
guuuggaaaaguggcgu

SEQ ID NO: 1225310 - RNA, 14 nt, Homo sapiens
guuuggaagaccag

SEQ ID NO: 1225311 - RNA, 17 nt, Homo sapiens
guuuggagucacuguag

SEQ ID NO: 1225312 - RNA, 18 nt, Homo sapiens
guuugggccccucagagc

SEQ ID NO: 1225313 - RNA, 15 nt, Homo sapiens
guuuggucagacuau

SEQ ID NO: 1225314 - RNA, 21 nt, Homo sapiens
guuuguauagaguucauccca

SEQ ID NO: 1225315 - RNA, 22 nt, Homo sapiens
guuugucccagcgauggugccu

SEQ ID NO: 1225316 - RNA, 14 nt, Homo sapiens
guuuguggccucag

SEQ ID NO: 1225317 - RNA, 12 nt, Homo sapiens
guuuguguuacc

SEQ ID NO: 1225318 - RNA, 22 nt, Homo sapiens
guuuguuggaaaguaacuguga

SEQ ID NO: 1225319 - RNA, 16 nt, Homo sapiens
guuuguuucauauaua

SEQ ID NO: 1225320 - RNA, 17 nt, Homo sapiens
guuuuaaaaaaucucaa

SEQ ID NO: 1225321 - RNA, 14 nt, Homo sapiens
guuuuaaauugaua

SEQ ID NO: 1225322 - RNA, 21 nt, Homo sapiens
guuuuacuguccaaagacaug

SEQ ID NO: 1225323 - RNA, 15 nt, Homo sapiens
guuuuagaaccagcc

SEQ ID NO: 1225324 - RNA, 21 nt, Homo sapiens
guuuuagcggucaauuugccu

SEQ ID NO: 1225325 - RNA, 23 nt, Homo sapiens
guuuuaggaugucauucuuugca

SEQ ID NO: 1225326 - RNA, 17 nt, Homo sapiens
guuuuauaaaagccuug

SEQ ID NO: 1225327 - RNA, 18 nt, Homo sapiens
guuuuauaaguucacaaa

SEQ ID NO: 1225328 - RNA, 15 nt, Homo sapiens
guuuuauauguugcu

SEQ ID NO: 1225329 - RNA, 18 nt, Homo sapiens
guuuuaucuccugugauc

SEQ ID NO: 1225330 - RNA, 19 nt, Homo sapiens
guuuucaagucaaauuaau

SEQ ID NO: 1225331 - RNA, 11 nt, Homo sapiens
guuuucagugu

SEQ ID NO: 1225332 - RNA, 17 nt, Homo sapiens
guuuucauggugaaaau

SEQ ID NO: 1225333 - RNA, 18 nt, Homo sapiens
guuuuccaaauaacauca

SEQ ID NO: 1225334 - RNA, 18 nt, Homo sapiens
guuuuccccaaaccauaa

SEQ ID NO: 1225335 - RNA, 21 nt, Homo sapiens
guuuucccugaccucccucua

SEQ ID NO: 1225336 - RNA, 19 nt, Homo sapiens
guuuuccuaaaugcaguga

SEQ ID NO: 1225337 - RNA, 12 nt, Homo sapiens
guuuuccuuugu

SEQ ID NO: 1225338 - RNA, 13 nt, Homo sapiens
guuuucugacuaa

SEQ ID NO: 1225339 - RNA, 21 nt, Homo sapiens
guuuucugagcccgggcugcc

SEQ ID NO: 1225340 - RNA, 14 nt, Homo sapiens
guuuucuucacuau

SEQ ID NO: 1225341 - RNA, 20 nt, Homo sapiens
guuuugaaggcaaaauugca

SEQ ID NO: 1225342 - RNA, 23 nt, Homo sapiens
guuuugauauuuauuuuuugcca

SEQ ID NO: 1225343 - RNA, 15 nt, Homo sapiens
guuuugcuuaggcac

SEQ ID NO: 1225344 - RNA, 18 nt, Homo sapiens
guuuuggagaguuugccu

SEQ ID NO: 1225345 - RNA, 13 nt, Homo sapiens
guuuugggccaga

SEQ ID NO: 1225346 - RNA, 15 nt, Homo sapiens
guuuuuaacauguca

SEQ ID NO: 1225347 - RNA, 15 nt, Homo sapiens
guuuuuaagcuguuu

SEQ ID NO: 1225348 - RNA, 21 nt, Homo sapiens
guuuuucaccacuucacugaa

SEQ ID NO: 1225349 - RNA, 14 nt, Homo sapiens
guuuuucagcaccc

SEQ ID NO: 1225350 - RNA, 13 nt, Homo sapiens
guuuuuccuccau

SEQ ID NO: 1225351 - RNA, 16 nt, Homo sapiens
guuuuuuauuaugcau

SEQ ID NO: 1225352 - RNA, 23 nt, Homo sapiens
uaaaaaaaaaaaaaacauugugu

SEQ ID NO: 1225353 - RNA, 18 nt, Homo sapiens
uaaaaaaagaacauaaaa

SEQ ID NO: 1225354 - RNA, 11 nt, Homo sapiens
uaaaaaaagca

SEQ ID NO: 1225355 - RNA, 19 nt, Homo sapiens
uaaaaaaauaaaaaagauc

SEQ ID NO: 1225356 - RNA, 16 nt, Homo sapiens
uaaaaaacuucaugua

SEQ ID NO: 1225357 - RNA, 13 nt, Homo sapiens
uaaaaaagcauac

SEQ ID NO: 1225358 - RNA, 14 nt, Homo sapiens
uaaaaaauagacau

SEQ ID NO: 1225359 - RNA, 13 nt, Homo sapiens
uaaaaacaaacag

SEQ ID NO: 1225360 - RNA, 19 nt, Homo sapiens
uaaaaacaaacagaacaaa

SEQ ID NO: 1225361 - RNA, 14 nt, Homo sapiens
uaaaaagcauuauu

SEQ ID NO: 1225362 - RNA, 14 nt, Homo sapiens
uaaaaagcuuccau

SEQ ID NO: 1225363 - RNA, 21 nt, Homo sapiens
uaaaaaggaaacuucaguuga

SEQ ID NO: 1225364 - RNA, 17 nt, Homo sapiens
uaaaaaggaaguacugc

SEQ ID NO: 1225365 - RNA, 23 nt, Homo sapiens
uaaaaaggaccagagaauucuua

SEQ ID NO: 1225366 - RNA, 22 nt, Homo sapiens
uaaaaagggcagggcaucuccu

SEQ ID NO: 1225367 - RNA, 18 nt, Homo sapiens
uaaaaaguaauaaaugag

SEQ ID NO: 1225368 - RNA, 19 nt, Homo sapiens
uaaaaagugacacagcagc

SEQ ID NO: 1225369 - RNA, 12 nt, Homo sapiens
uaaaaaguucca

SEQ ID NO: 1225370 - RNA, 15 nt, Homo sapiens
uaaaaauaaagggaa

SEQ ID NO: 1225371 - RNA, 17 nt, Homo sapiens
uaaaaauagucuuccac

SEQ ID NO: 1225372 - RNA, 15 nt, Homo sapiens
uaaaaaucacacugu

SEQ ID NO: 1225373 - RNA, 18 nt, Homo sapiens
uaaaaaucacuuucauaa

SEQ ID NO: 1225374 - RNA, 15 nt, Homo sapiens
uaaaaaugagugcuu

SEQ ID NO: 1225375 - RNA, 16 nt, Homo sapiens
uaaaaaugagugcuua

SEQ ID NO: 1225376 - RNA, 17 nt, Homo sapiens
uaaaaaugagugcuuaa

SEQ ID NO: 1225377 - RNA, 18 nt, Homo sapiens
uaaaaauggauacuggug

SEQ ID NO: 1225378 - RNA, 16 nt, Homo sapiens
uaaaaaugucaucuca

SEQ ID NO: 1225379 - RNA, 16 nt, Homo sapiens
uaaaaauguccugccu

SEQ ID NO: 1225380 - RNA, 22 nt, Homo sapiens
uaaaacaggaccguacugcuug

SEQ ID NO: 1225381 - RNA, 21 nt, Homo sapiens
uaaaacagguagaauuaucua

SEQ ID NO: 1225382 - RNA, 21 nt, Homo sapiens
uaaaacagguuauaacagugu

SEQ ID NO: 1225383 - RNA, 22 nt, Homo sapiens
uaaaacagguuauaacaguguu

SEQ ID NO: 1225384 - RNA, 21 nt, Homo sapiens
uaaaacaugcugaaaacuaca

SEQ ID NO: 1225385 - RNA, 17 nt, Homo sapiens
uaaaacaugcuggugaa

SEQ ID NO: 1225386 - RNA, 12 nt, Homo sapiens
uaaaacauuccc

SEQ ID NO: 1225387 - RNA, 19 nt, Homo sapiens
uaaaacauugaaugaaacu

SEQ ID NO: 1225388 - RNA, 22 nt, Homo sapiens
uaaaacauuugguugcuacugu

SEQ ID NO: 1225389 - RNA, 12 nt, Homo sapiens
uaaaaccaaaga

SEQ ID NO: 1225390 - RNA, 15 nt, Homo sapiens
uaaaaccacuguaca

SEQ ID NO: 1225391 - RNA, 15 nt, Homo sapiens
uaaauaucugucaua

SEQ ID NO: 1225392 - RNA, 16 nt, Homo sapiens
uaaauauuucaggcau

SEQ ID NO: 1225393 - RNA, 17 nt, Homo sapiens
uaaauauuucaggcaua

SEQ ID NO: 1225394 - RNA, 17 nt, Homo sapiens
uaaauauuuuucaucaa

SEQ ID NO: 1225395 - RNA, 12 nt, Homo sapiens
uaaaucaagucc

SEQ ID NO: 1225396 - RNA, 16 nt, Homo sapiens
uaaaucaaguccuuua

SEQ ID NO: 1225397 - RNA, 23 nt, Homo sapiens
uaaaucauguugaucauguacuu

SEQ ID NO: 1225398 - RNA, 16 nt, Homo sapiens
uaaaucauuaagacaa

SEQ ID NO: 1225399 - RNA, 12 nt, Homo sapiens
uaaaucuaacaa

SEQ ID NO: 1225400 - RNA, 20 nt, Homo sapiens
uaaaucugugaugauccuca

SEQ ID NO: 1225401 - RNA, 14 nt, Homo sapiens
uaaaugaagccaag

SEQ ID NO: 1225402 - RNA, 15 nt, Homo sapiens
uaaaugaagccaagu

SEQ ID NO: 1225403 - RNA, 20 nt, Homo sapiens
uaaaugaauuaaauauugaa

SEQ ID NO: 1225404 - RNA, 19 nt, Homo sapiens
uaaaugacaaauguauuaa

SEQ ID NO: 1225405 - RNA, 16 nt, Homo sapiens
uaaaugauaguuuuca

SEQ ID NO: 1225406 - RNA, 22 nt, Homo sapiens
uaaaugauuaaaaaaucagaga

SEQ ID NO: 1225407 - RNA, 21 nt, Homo sapiens
uaaaugauucuuagugacuuu

SEQ ID NO: 1225408 - RNA, 22 nt, Homo sapiens
uaaaugcaaucucuuuucuaca

SEQ ID NO: 1225409 - RNA, 19 nt, Homo sapiens
uaaaugccaggccuggcaa

SEQ ID NO: 1225410 - RNA, 11 nt, Homo sapiens
uaaauguaaua

SEQ ID NO: 1225411 - RNA, 19 nt, Homo sapiens
uaaauguaucuuauucaca

SEQ ID NO: 1225412 - RNA, 22 nt, Homo sapiens
uaaauguauuuaauuaaaucuc

SEQ ID NO: 1225413 - RNA, 22 nt, Homo sapiens
uaaaugucucuuuaaugucaca

SEQ ID NO: 1225414 - RNA, 22 nt, Homo sapiens
uaaaugucuuguuucccagauu

SEQ ID NO: 1225415 - RNA, 14 nt, Homo sapiens
uaaaugugcuuaug

SEQ ID NO: 1225416 - RNA, 18 nt, Homo sapiens
uaaauguugcaaugcaug

SEQ ID NO: 1225417 - RNA, 19 nt, Homo sapiens
uaaauguuuauacuguauu

SEQ ID NO: 1225418 - RNA, 17 nt, Homo sapiens
uaaauguuuuacucaga

SEQ ID NO: 1225419 - RNA, 16 nt, Homo sapiens
uaaauuaugguauuaa

SEQ ID NO: 1225420 - RNA, 22 nt, Homo sapiens
uaaauuauuuauuuauggagga

SEQ ID NO: 1225421 - RNA, 16 nt, Homo sapiens
uaaauucacuuucaau

SEQ ID NO: 1225422 - RNA, 14 nt, Homo sapiens
uaaauucagaucaa

SEQ ID NO: 1225423 - RNA, 16 nt, Homo sapiens
uaaauugcaucacugu

SEQ ID NO: 1225424 - RNA, 18 nt, Homo sapiens
uaaauugggaaaacucca

SEQ ID NO: 1225425 - RNA, 14 nt, Homo sapiens
uaaauuuaacucug

SEQ ID NO: 1225426 - RNA, 17 nt, Homo sapiens
uaaauuugguucuaggc

SEQ ID NO: 1225427 - RNA, 17 nt, Homo sapiens
uaaauuuugaguucuac

SEQ ID NO: 1225428 - RNA, 17 nt, Homo sapiens
uaaauuuugugaugaau

SEQ ID NO: 1225429 - RNA, 15 nt, Homo sapiens
uaacaaaauccucag

SEQ ID NO: 1225430 - RNA, 13 nt, Homo sapiens
uaacaaacaucac

SEQ ID NO: 1225431 - RNA, 15 nt, Homo sapiens
uaacaaacuagucag

SEQ ID NO: 1225432 - RNA, 13 nt, Homo sapiens
uaacaaauaaaua

SEQ ID NO: 1225433 - RNA, 18 nt, Homo sapiens
uaacaaauaugcuaauuu

SEQ ID NO: 1225434 - RNA, 17 nt, Homo sapiens
uaacaagaccucagugc

SEQ ID NO: 1225435 - RNA, 23 nt, Homo sapiens
uaacaagaccucagugccuuccu

SEQ ID NO: 1225436 - RNA, 14 nt, Homo sapiens
uaacaagauuugua

SEQ ID NO: 1225437 - RNA, 16 nt, Homo sapiens
uaacaaguaccaaagu

SEQ ID NO: 1225438 - RNA, 14 nt, Homo sapiens
uaacaaguggguga

SEQ ID NO: 1225439 - RNA, 16 nt, Homo sapiens
uaacaaugacuuguac

SEQ ID NO: 1225440 - RNA, 21 nt, Homo sapiens
uaacaauguaugugaaagugu

SEQ ID NO: 1225441 - RNA, 18 nt, Homo sapiens
uaacaauuguguagccuu

SEQ ID NO: 1225442 - RNA, 20 nt, Homo sapiens
uaacaccaucgaucaugaug

SEQ ID NO: 1225443 - RNA, 13 nt, Homo sapiens
uaacaccugccua

SEQ ID NO: 1225444 - RNA, 14 nt, Homo sapiens
uaacacggugcuca

SEQ ID NO: 1225445 - RNA, 15 nt, Homo sapiens
uaacacuaauuauca

SEQ ID NO: 1225446 - RNA, 17 nt, Homo sapiens
uaacacuguuaagagag

SEQ ID NO: 1225447 - RNA, 16 nt, Homo sapiens
uaacagaaacuuucaa

SEQ ID NO: 1225448 - RNA, 23 nt, Homo sapiens
uaacagaaagccugggugacauu

SEQ ID NO: 1225449 - RNA, 14 nt, Homo sapiens
uaacagaacagaca

SEQ ID NO: 1225450 - RNA, 15 nt, Homo sapiens
uaacagaacagucac

SEQ ID NO: 1225451 - RNA, 15 nt, Homo sapiens
uaacagaauacauag

SEQ ID NO: 1225452 - RNA, 23 nt, Homo sapiens
uaacagaccacuguauguuuacu

SEQ ID NO: 1225453 - RNA, 21 nt, Homo sapiens
uaacagauggaaaaacugagg

SEQ ID NO: 1225454 - RNA, 15 nt, Homo sapiens
uaacagccucuguga

SEQ ID NO: 1225455 - RNA, 21 nt, Homo sapiens
uaacagcggcaggguguccca

SEQ ID NO: 1225456 - RNA, 15 nt, Homo sapiens
uaacaggcacuuuga

SEQ ID NO: 1225457 - RNA, 22 nt, Homo sapiens
uaacaggcucaauauuccugaa

SEQ ID NO: 1225458 - RNA, 14 nt, Homo sapiens
uaacaguucacuuu

SEQ ID NO: 1225459 - RNA, 21 nt, Homo sapiens
uaacaguucauguuugcuuca

SEQ ID NO: 1225460 - RNA, 20 nt, Homo sapiens
uaacauaaaauaaucgucuc

SEQ ID NO: 1225461 - RNA, 14 nt, Homo sapiens
uaacaucaacaaca

SEQ ID NO: 1225462 - RNA, 19 nt, Homo sapiens
uaacaucaacaacacagca

SEQ ID NO: 1225463 - RNA, 10 nt, Homo sapiens
uaacaucccu

SEQ ID NO: 1225464 - RNA, 21 nt, Homo sapiens
uaacaucuauuauaaaaccau

SEQ ID NO: 1225465 - RNA, 14 nt, Homo sapiens
uaacaucugaccug

SEQ ID NO: 1225466 - RNA, 19 nt, Homo sapiens
uaacauggacugcuucauc

SEQ ID NO: 1225467 - RNA, 15 nt, Homo sapiens
uaacauguauacaaa

SEQ ID NO: 1225468 - RNA, 13 nt, Homo sapiens
uaacauuaccuua

SEQ ID NO: 1225469 - RNA, 16 nt, Homo sapiens
uaacauuuccucuuuc

SEQ ID NO: 1225470 - RNA, 16 nt, Homo sapiens
uaacauuucuguucuc

SEQ ID NO: 1225471 - RNA, 12 nt, Homo sapiens
uaacauuugccu

SEQ ID NO: 1225472 - RNA, 21 nt, Homo sapiens
uaacauuuuguucuuacacau

SEQ ID NO: 1225473 - RNA, 14 nt, Homo sapiens
uaaccacagugaaa

SEQ ID NO: 1225474 - RNA, 23 nt, Homo sapiens
uaaccaguccacaccacuguugc

SEQ ID NO: 1225475 - RNA, 13 nt, Homo sapiens
uaaccagugcaga

SEQ ID NO: 1225476 - RNA, 15 nt, Homo sapiens
uaaccccauucuuug

SEQ ID NO: 1225477 - RNA, 21 nt, Homo sapiens
uaacccccaguucaagacuua

SEQ ID NO: 1225478 - RNA, 21 nt, Homo sapiens
uaaccccgggaugcaagguag

SEQ ID NO: 1225479 - RNA, 16 nt, Homo sapiens
uaacccucccauggca

SEQ ID NO: 1225480 - RNA, 16 nt, Homo sapiens
uaaccuggaacuggag

SEQ ID NO: 1225481 - RNA, 12 nt, Homo sapiens
uaaccuggugcu

SEQ ID NO: 1225482 - RNA, 13 nt, Homo sapiens
uaaccuugccuua

SEQ ID NO: 1225483 - RNA, 19 nt, Homo sapiens
uaacgacuucuccaucucc

SEQ ID NO: 1225484 - RNA, 14 nt, Homo sapiens
uaacgcgucuuccu

SEQ ID NO: 1225485 - RNA, 14 nt, Homo sapiens
uaacguggcacugg

SEQ ID NO: 1225486 - RNA, 15 nt, Homo sapiens
uaacuaaucaagaaa

SEQ ID NO: 1225487 - RNA, 12 nt, Homo sapiens
uaacuacauuua

SEQ ID NO: 1225488 - RNA, 18 nt, Homo sapiens
uaacuagaggagaauuua

SEQ ID NO: 1225489 - RNA, 21 nt, Homo sapiens
ucaauuuucacaucaaagaca

SEQ ID NO: 1225490 - RNA, 15 nt, Homo sapiens
ucaauuuugacuuaa

SEQ ID NO: 1225491 - RNA, 18 nt, Homo sapiens
ucaauuuugucuguacuc

SEQ ID NO: 1225492 - RNA, 15 nt, Homo sapiens
ucacaaaaauuugaa

SEQ ID NO: 1225493 - RNA, 23 nt, Homo sapiens
ucacaaaacacuucgagcacugu

SEQ ID NO: 1225494 - RNA, 13 nt, Homo sapiens
ucacaaacaguug

SEQ ID NO: 1225495 - RNA, 13 nt, Homo sapiens
ucacaaagaucau

SEQ ID NO: 1225496 - RNA, 16 nt, Homo sapiens
ucacaaaguccacuuu

SEQ ID NO: 1225497 - RNA, 14 nt, Homo sapiens
ucacaacagaucaa

SEQ ID NO: 1225498 - RNA, 17 nt, Homo sapiens
ucacaacauuuacuuaa

SEQ ID NO: 1225499 - RNA, 20 nt, Homo sapiens
ucacaacauuuacuuaacag

SEQ ID NO: 1225500 - RNA, 17 nt, Homo sapiens
ucacaaccucucugauc

SEQ ID NO: 1225501 - RNA, 19 nt, Homo sapiens
ucacaaccucucugaucuu

SEQ ID NO: 1225502 - RNA, 15 nt, Homo sapiens
ucacaagauggaauu

SEQ ID NO: 1225503 - RNA, 13 nt, Homo sapiens
ucacaagcaugaa

SEQ ID NO: 1225504 - RNA, 20 nt, Homo sapiens
ucacaagcaugaagugcugu

SEQ ID NO: 1225505 - RNA, 12 nt, Homo sapiens
ucacaagcuauu

SEQ ID NO: 1225506 - RNA, 15 nt, Homo sapiens
ucacacacacagcug

SEQ ID NO: 1225507 - RNA, 13 nt, Homo sapiens
ucacaccaaggaa

SEQ ID NO: 1225508 - RNA, 17 nt, Homo sapiens
ucacacgauaaagggau

SEQ ID NO: 1225509 - RNA, 22 nt, Homo sapiens
ucacacuccccuagggggagaa

SEQ ID NO: 1225510 - RNA, 16 nt, Homo sapiens
ucacacugaagccaca

SEQ ID NO: 1225511 - RNA, 17 nt, Homo sapiens
ucacacugaagccacag

SEQ ID NO: 1225512 - RNA, 24 nt, Homo sapiens
ucacacugguuuggucaguuacaa

SEQ ID NO: 1225513 - RNA, 12 nt, Homo sapiens
ucacacuguaaa

SEQ ID NO: 1225514 - RNA, 21 nt, Homo sapiens
ucacacuguauauaaacauau

SEQ ID NO: 1225515 - RNA, 16 nt, Homo sapiens
ucacacugucuucuga

SEQ ID NO: 1225516 - RNA, 16 nt, Homo sapiens
ucacagaauagcacaa

SEQ ID NO: 1225517 - RNA, 17 nt, Homo sapiens
ucacagaauagcacaaa

SEQ ID NO: 1225518 - RNA, 18 nt, Homo sapiens
ucacagaguagaaacuca

SEQ ID NO: 1225519 - RNA, 21 nt, Homo sapiens
ucacagcaauauuuaacaauu

SEQ ID NO: 1225520 - RNA, 16 nt, Homo sapiens
ucacagcuccucccac

SEQ ID NO: 1225521 - RNA, 22 nt, Homo sapiens
ucacagcugauugggcaccuga

SEQ ID NO: 1225522 - RNA, 14 nt, Homo sapiens
ucacagcugcagcu

SEQ ID NO: 1225523 - RNA, 21 nt, Homo sapiens
ucacagcuggacccugcuuca

SEQ ID NO: 1225524 - RNA, 18 nt, Homo sapiens
ucacagcuguaauaacaa

SEQ ID NO: 1225525 - RNA, 20 nt, Homo sapiens
ucacagggccccagaaggca

SEQ ID NO: 1225526 - RNA, 22 nt, Homo sapiens
ucacagggguucccuucucuca

SEQ ID NO: 1225527 - RNA, 16 nt, Homo sapiens
ucacaguguugcccag

SEQ ID NO: 1225528 - RNA, 14 nt, Homo sapiens
ucacauaaccuuaa

SEQ ID NO: 1225529 - RNA, 16 nt, Homo sapiens
ucacaucugcaucuua

SEQ ID NO: 1225530 - RNA, 17 nt, Homo sapiens
ucacaugaccugaucac

SEQ ID NO: 1225531 - RNA, 18 nt, Homo sapiens
ucacaugagcuauuucca

SEQ ID NO: 1225532 - RNA, 20 nt, Homo sapiens
ucacauggccuaugcacaua

SEQ ID NO: 1225533 - RNA, 20 nt, Homo sapiens
ucacaugggcagaaaaaugg

SEQ ID NO: 1225534 - RNA, 14 nt, Homo sapiens
ucacaugugacaaa

SEQ ID NO: 1225535 - RNA, 16 nt, Homo sapiens
ucacauuaucaucuga

SEQ ID NO: 1225536 - RNA, 17 nt, Homo sapiens
ucacauuaucaucugaa

SEQ ID NO: 1225537 - RNA, 18 nt, Homo sapiens
ucacauugagcugauaua

SEQ ID NO: 1225538 - RNA, 14 nt, Homo sapiens
ucacauugugccuu

SEQ ID NO: 1225539 - RNA, 19 nt, Homo sapiens
ucacauuuaccauaauuua

SEQ ID NO: 1225540 - RNA, 16 nt, Homo sapiens
ucacauuucuaugcca

SEQ ID NO: 1225541 - RNA, 20 nt, Homo sapiens
ucacauuuuucuacagugaa

SEQ ID NO: 1225542 - RNA, 23 nt, Homo sapiens
ucaccaacacaguugggacccaa

SEQ ID NO: 1225543 - RNA, 12 nt, Homo sapiens
ucaccaagccca

SEQ ID NO: 1225544 - RNA, 18 nt, Homo sapiens
ucaccacguggggcucac

SEQ ID NO: 1225545 - RNA, 20 nt, Homo sapiens
ucaccacguggggcucacuu

SEQ ID NO: 1225546 - RNA, 14 nt, Homo sapiens
ucaccagaucucag

SEQ ID NO: 1225547 - RNA, 17 nt, Homo sapiens
ucaccaggggugcucac

SEQ ID NO: 1225548 - RNA, 12 nt, Homo sapiens
ucaccagugucc

SEQ ID NO: 1225549 - RNA, 14 nt, Homo sapiens
ucaccauaaccucu

SEQ ID NO: 1225550 - RNA, 16 nt, Homo sapiens
ucaccaucuacaccag

SEQ ID NO: 1225551 - RNA, 15 nt, Homo sapiens
ucacccacugucagc

SEQ ID NO: 1225552 - RNA, 21 nt, Homo sapiens
ucacccagcuaaucuguaggg

SEQ ID NO: 1225553 - RNA, 17 nt, Homo sapiens
ucacccaucagauaccu

SEQ ID NO: 1225554 - RNA, 16 nt, Homo sapiens
ucaccccguuacagcu

SEQ ID NO: 1225555 - RNA, 17 nt, Homo sapiens
ucacccgacccgugcac

SEQ ID NO: 1225556 - RNA, 21 nt, Homo sapiens
ucacccucuccagcaagagaa

SEQ ID NO: 1225557 - RNA, 20 nt, Homo sapiens
ucacccuugcaccguccuca

SEQ ID NO: 1225558 - RNA, 14 nt, Homo sapiens
ucaccggagcuuuc

SEQ ID NO: 1225559 - RNA, 22 nt, Homo sapiens
ucaccggagcuuucaaagaagg

SEQ ID NO: 1225560 - RNA, 16 nt, Homo sapiens
ucaccuacauuaucuc

SEQ ID NO: 1225561 - RNA, 18 nt, Homo sapiens
ucaccucccgaagccacc

SEQ ID NO: 1225562 - RNA, 18 nt, Homo sapiens
ucaccuccucugugauuu

SEQ ID NO: 1225563 - RNA, 16 nt, Homo sapiens
ucaccucuugccuucu

SEQ ID NO: 1225564 - RNA, 19 nt, Homo sapiens
ucaccuggccugguugugu

SEQ ID NO: 1225565 - RNA, 15 nt, Homo sapiens
ucaccuguuauguau

SEQ ID NO: 1225566 - RNA, 21 nt, Homo sapiens
ucaccuugaaagcaguagcau

SEQ ID NO: 1225567 - RNA, 17 nt, Homo sapiens
ucaccuuuguaagacau

SEQ ID NO: 1225568 - RNA, 15 nt, Homo sapiens
ucacgcaggagccau

SEQ ID NO: 1225569 - RNA, 19 nt, Homo sapiens
ucacuaaacucucauuucu

SEQ ID NO: 1225570 - RNA, 21 nt, Homo sapiens
ucacuaagcuguggcuggaau

SEQ ID NO: 1225571 - RNA, 12 nt, Homo sapiens
ucacuacaggug

SEQ ID NO: 1225572 - RNA, 15 nt, Homo sapiens
ucacuacuacaucug

SEQ ID NO: 1225573 - RNA, 18 nt, Homo sapiens
ucacuacuuuaauaaaga

SEQ ID NO: 1225574 - RNA, 21 nt, Homo sapiens
ucacuagaaaagcugaucaua

SEQ ID NO: 1225575 - RNA, 20 nt, Homo sapiens
ucacuccaggauauugacaa

SEQ ID NO: 1225576 - RNA, 16 nt, Homo sapiens
ucacucccaccugcau

SEQ ID NO: 1225577 - RNA, 16 nt, Homo sapiens
ucacucccuccaucaa

SEQ ID NO: 1225578 - RNA, 21 nt, Homo sapiens
ucacucccucugccuucaggc

SEQ ID NO: 1225579 - RNA, 16 nt, Homo sapiens
ucacucucaaacuuca

SEQ ID NO: 1225580 - RNA, 23 nt, Homo sapiens
ucacucucugaagaugaucauuu

SEQ ID NO: 1225581 - RNA, 12 nt, Homo sapiens
ucacucugaauc

SEQ ID NO: 1225582 - RNA, 18 nt, Homo sapiens
ucacucuguaguuacugu

SEQ ID NO: 1225583 - RNA, 12 nt, Homo sapiens
ucacucugucag

SEQ ID NO: 1225584 - RNA, 17 nt, Homo sapiens
ucacucugucagccagc

SEQ ID NO: 1225585 - RNA, 17 nt, Homo sapiens
ucacucuuauugcccac

SEQ ID NO: 1225586 - RNA, 18 nt, Homo sapiens
ucacugaaagacaccauu

SEQ ID NO: 1225587 - RNA, 22 nt, Homo sapiens
ucacugacucaagacacugaga

SEQ ID NO: 1225588 - RNA, 9 nt, Homo sapiens
ucacugaga

SEQ ID NO: 1225589 - RNA, 12 nt, Homo sapiens
ucacugagcucc

SEQ ID NO: 1225590 - RNA, 23 nt, Homo sapiens
ucacugaugggaaaacugccaau

SEQ ID NO: 1225591 - RNA, 23 nt, Homo sapiens
ucacugauucucuacaugcucuu

SEQ ID NO: 1225592 - RNA, 18 nt, Homo sapiens
ucacugcaacuucugccu

SEQ ID NO: 1225593 - RNA, 15 nt, Homo sapiens
ucacugcagccucaa

SEQ ID NO: 1225594 - RNA, 21 nt, Homo sapiens
ucacugccccagacacagugc

SEQ ID NO: 1225595 - RNA, 19 nt, Homo sapiens
ucaguaauaaaaccgguca

SEQ ID NO: 1225596 - RNA, 15 nt, Homo sapiens
ucaguaauaacucua

SEQ ID NO: 1225597 - RNA, 14 nt, Homo sapiens
ucaguaccccaugg

SEQ ID NO: 1225598 - RNA, 22 nt, Homo sapiens
ucaguaccccugguaaaccaag

SEQ ID NO: 1225599 - RNA, 22 nt, Homo sapiens
ucaguacugacuuucugauuac

SEQ ID NO: 1225600 - RNA, 18 nt, Homo sapiens
ucaguauaauuuaacuuc

SEQ ID NO: 1225601 - RNA, 18 nt, Homo sapiens
ucaguccaacaaaccaca

SEQ ID NO: 1225602 - RNA, 15 nt, Homo sapiens
ucaguccaugucucg

SEQ ID NO: 1225603 - RNA, 23 nt, Homo sapiens
ucagucuaaggucucaugcuguu

SEQ ID NO: 1225604 - RNA, 15 nt, Homo sapiens
ucagucuauccacag

SEQ ID NO: 1225605 - RNA, 20 nt, Homo sapiens
ucagugaaagccagauucaa

SEQ ID NO: 1225606 - RNA, 19 nt, Homo sapiens
ucagugaagccaaagggac

SEQ ID NO: 1225607 - RNA, 16 nt, Homo sapiens
ucagugaccuguuuua

SEQ ID NO: 1225608 - RNA, 23 nt, Homo sapiens
ucagugcauagcgaagaccagua

SEQ ID NO: 1225609 - RNA, 12 nt, Homo sapiens
ucaguggugguc

SEQ ID NO: 1225610 - RNA, 19 nt, Homo sapiens
ucaguguccucuugcucaa

SEQ ID NO: 1225611 - RNA, 15 nt, Homo sapiens
ucaguuauuacaugu

SEQ ID NO: 1225612 - RNA, 16 nt, Homo sapiens
ucaguucuacacugau

SEQ ID NO: 1225613 - RNA, 15 nt, Homo sapiens
ucaguugacagugua

SEQ ID NO: 1225614 - RNA, 16 nt, Homo sapiens
ucaguuucacuuucac

SEQ ID NO: 1225615 - RNA, 17 nt, Homo sapiens
ucaguuucuaggcaccu

SEQ ID NO: 1225616 - RNA, 22 nt, Homo sapiens
ucaguuuuaucuuuaaucuccu

SEQ ID NO: 1225617 - RNA, 15 nt, Homo sapiens
ucauaaguaaaccua

SEQ ID NO: 1225618 - RNA, 14 nt, Homo sapiens
ucauaaugugcaaa

SEQ ID NO: 1225619 - RNA, 16 nt, Homo sapiens
ucauaauucagcacuu

SEQ ID NO: 1225620 - RNA, 13 nt, Homo sapiens
ucauacacuuauu

SEQ ID NO: 1225621 - RNA, 21 nt, Homo sapiens
ucauaccaauuccaacuuuca

SEQ ID NO: 1225622 - RNA, 24 nt, Homo sapiens
ucauaccguguaccucaguucccu

SEQ ID NO: 1225623 - RNA, 19 nt, Homo sapiens
ucauaccucagaauguaaa

SEQ ID NO: 1225624 - RNA, 14 nt, Homo sapiens
ucauaccucagugg

SEQ ID NO: 1225625 - RNA, 20 nt, Homo sapiens
ucauaccucugaccaacagg

SEQ ID NO: 1225626 - RNA, 14 nt, Homo sapiens
ucauacuacugaaa

SEQ ID NO: 1225627 - RNA, 14 nt, Homo sapiens
ucauacuagaauuc

SEQ ID NO: 1225628 - RNA, 12 nt, Homo sapiens
ucauacuguaac

SEQ ID NO: 1225629 - RNA, 15 nt, Homo sapiens
ucauacugucuggga

SEQ ID NO: 1225630 - RNA, 22 nt, Homo sapiens
ucauacugucugggauuaaggg

SEQ ID NO: 1225631 - RNA, 14 nt, Homo sapiens
ucauagcugagauu

SEQ ID NO: 1225632 - RNA, 14 nt, Homo sapiens
ucauauaccagcaa

SEQ ID NO: 1225633 - RNA, 15 nt, Homo sapiens
ucauauacugccaug

SEQ ID NO: 1225634 - RNA, 20 nt, Homo sapiens
ucauauaggccagaguugca

SEQ ID NO: 1225635 - RNA, 23 nt, Homo sapiens
ucauauauuuuuaccaucugcug

SEQ ID NO: 1225636 - RNA, 20 nt, Homo sapiens
ucauaucaucacauugagcu

SEQ ID NO: 1225637 - RNA, 18 nt, Homo sapiens
ucauauggcccaguguca

SEQ ID NO: 1225638 - RNA, 14 nt, Homo sapiens
ucauauuggacuga

SEQ ID NO: 1225639 - RNA, 15 nt, Homo sapiens
ucauauugugccaau

SEQ ID NO: 1225640 - RNA, 21 nt, Homo sapiens
ucauauuucuaccugagugaa

SEQ ID NO: 1225641 - RNA, 21 nt, Homo sapiens
ucaucaaagcucacaccaaau

SEQ ID NO: 1225642 - RNA, 18 nt, Homo sapiens
ucaucaagcaggaauuau

SEQ ID NO: 1225643 - RNA, 23 nt, Homo sapiens
ucaucagagcuccucuguccugc

SEQ ID NO: 1225644 - RNA, 23 nt, Homo sapiens
ucaucagcuaucguuaguguauu

SEQ ID NO: 1225645 - RNA, 23 nt, Homo sapiens
ucaucaguguccucuugcucaaa

SEQ ID NO: 1225646 - RNA, 14 nt, Homo sapiens
ucaucaugagacaa

SEQ ID NO: 1225647 - RNA, 19 nt, Homo sapiens
ucaucauggaggucauaca

SEQ ID NO: 1225648 - RNA, 14 nt, Homo sapiens
ucauccaacuuaug

SEQ ID NO: 1225649 - RNA, 14 nt, Homo sapiens
ucaucccagugcac

SEQ ID NO: 1225650 - RNA, 14 nt, Homo sapiens
ucaucccuuucucc

SEQ ID NO: 1225651 - RNA, 22 nt, Homo sapiens
ucauccuaaaaaguuccaugaa

SEQ ID NO: 1225652 - RNA, 17 nt, Homo sapiens
ucauccuuggucuuugu

SEQ ID NO: 1225653 - RNA, 16 nt, Homo sapiens
ucaucuacccugcuga

SEQ ID NO: 1225654 - RNA, 20 nt, Homo sapiens
ucaucuauucaagcacuuac

SEQ ID NO: 1225655 - RNA, 21 nt, Homo sapiens
ucaucuauuuuuggcagucug

SEQ ID NO: 1225656 - RNA, 17 nt, Homo sapiens
ucaucucacauuuuccc

SEQ ID NO: 1225657 - RNA, 13 nt, Homo sapiens
ucaucucauucca

SEQ ID NO: 1225658 - RNA, 16 nt, Homo sapiens
ucaucugaaaaucugg

SEQ ID NO: 1225659 - RNA, 13 nt, Homo sapiens
ucaucugggcaaa

SEQ ID NO: 1225660 - RNA, 13 nt, Homo sapiens
ucaucuguuguuu

SEQ ID NO: 1225661 - RNA, 15 nt, Homo sapiens
ucaucuuaggaccua

SEQ ID NO: 1225662 - RNA, 23 nt, Homo sapiens
ucaucuuagugccugagaguauu

SEQ ID NO: 1225663 - RNA, 14 nt, Homo sapiens
ucaucuucacugca

SEQ ID NO: 1225664 - RNA, 15 nt, Homo sapiens
ucaucuucacugcaa

SEQ ID NO: 1225665 - RNA, 18 nt, Homo sapiens
ucaucuucacugcaauuu

SEQ ID NO: 1225666 - RNA, 19 nt, Homo sapiens
ucaucuucuagaaucucgu

SEQ ID NO: 1225667 - RNA, 15 nt, Homo sapiens
ucaugaaacugucca

SEQ ID NO: 1225668 - RNA, 13 nt, Homo sapiens
ucaugaaaucagc

SEQ ID NO: 1225669 - RNA, 21 nt, Homo sapiens
ucaugaagcagauuugcacug

SEQ ID NO: 1225670 - RNA, 16 nt, Homo sapiens
ucaugaauuccuuaaa

SEQ ID NO: 1225671 - RNA, 13 nt, Homo sapiens
ucaugacauauga

SEQ ID NO: 1225672 - RNA, 13 nt, Homo sapiens
ucaugagcuugaa

SEQ ID NO: 1225673 - RNA, 14 nt, Homo sapiens
ucaugagugaauaa

SEQ ID NO: 1225674 - RNA, 13 nt, Homo sapiens
ucaugaugugcaa

SEQ ID NO: 1225675 - RNA, 16 nt, Homo sapiens
ucaugauuucauuuca

SEQ ID NO: 1225676 - RNA, 19 nt, Homo sapiens
ucaugcauguccuguaaag

SEQ ID NO: 1225677 - RNA, 22 nt, Homo sapiens
ucaugcauuucaagcagcugaa

SEQ ID NO: 1225678 - RNA, 22 nt, Homo sapiens
ucaugccuggagaaaccuucag

SEQ ID NO: 1225679 - RNA, 21 nt, Homo sapiens
ucaugccuucacgugucuguu

SEQ ID NO: 1225680 - RNA, 17 nt, Homo sapiens
ucaugcguguguguugu

SEQ ID NO: 1225681 - RNA, 14 nt, Homo sapiens
ucaugcuucacuua

SEQ ID NO: 1225682 - RNA, 20 nt, Homo sapiens
ucaugcuuuaaaguguaaua

SEQ ID NO: 1225683 - RNA, 19 nt, Homo sapiens
ucauggauucauuacagcu

SEQ ID NO: 1225684 - RNA, 20 nt, Homo sapiens
ucaugggagggggcuugaag

SEQ ID NO: 1225685 - RNA, 19 nt, Homo sapiens
ucaugguacauuuaucacu

SEQ ID NO: 1225686 - RNA, 20 nt, Homo sapiens
ucauguagaacucagcaguu

SEQ ID NO: 1225687 - RNA, 13 nt, Homo sapiens
ucauguauguuau

SEQ ID NO: 1225688 - RNA, 14 nt, Homo sapiens
ucaugugaacccgg

SEQ ID NO: 1225689 - RNA, 19 nt, Homo sapiens
ucaugugcugccugcaagc

SEQ ID NO: 1225690 - RNA, 19 nt, Homo sapiens
ucauguguaauaugcacaa

SEQ ID NO: 1225691 - RNA, 13 nt, Homo sapiens
ucauguuacucag

SEQ ID NO: 1225692 - RNA, 20 nt, Homo sapiens
ucauguucacugugagugaa

SEQ ID NO: 1225693 - RNA, 18 nt, Homo sapiens
ucauguugaucauguacu

SEQ ID NO: 1225694 - RNA, 22 nt, Homo sapiens
ucauguuguugaggcugucaca

SEQ ID NO: 1225695 - RNA, 12 nt, Homo sapiens
ucauuacagcuu

SEQ ID NO: 1225696 - RNA, 22 nt, Homo sapiens
ucauuacuguuccagauuccua

SEQ ID NO: 1225697 - RNA, 20 nt, Homo sapiens
ucauuauaaacgugaugauc

SEQ ID NO: 1225698 - RNA, 17 nt, Homo sapiens
ucauuauaucauuggaa

SEQ ID NO: 1225699 - RNA, 19 nt, Homo sapiens
ucauuauuuuucacugccc

SEQ ID NO: 1225700 - RNA, 20 nt, Homo sapiens
ucauuauuuuuccacuuugu

SEQ ID NO: 1225701 - RNA, 23 nt, Homo sapiens
ucauucaacucuccaauguucua

SEQ ID NO: 1225702 - RNA, 23 nt, Homo sapiens
ucauucccauuuuguuacauuuc

SEQ ID NO: 1225703 - RNA, 17 nt, Homo sapiens
ucauucccucucaucuc

SEQ ID NO: 1225704 - RNA, 22 nt, Homo sapiens
ucauucccucucaucucaggua

SEQ ID NO: 1225705 - RNA, 15 nt, Homo sapiens
ucauuccuaacacag

SEQ ID NO: 1225706 - RNA, 21 nt, Homo sapiens
ucauuccugaaagaaacaguu

SEQ ID NO: 1225707 - RNA, 15 nt, Homo sapiens
ucauuccuucacuca

SEQ ID NO: 1225708 - RNA, 12 nt, Homo sapiens
ucauucuaucaa

SEQ ID NO: 1225709 - RNA, 19 nt, Homo sapiens
ucauucuuuuaacaaaagg

SEQ ID NO: 1225710 - RNA, 23 nt, Homo sapiens
ucauugacuuaggggaguucagu

SEQ ID NO: 1225711 - RNA, 21 nt, Homo sapiens
ucauugacuuccugaacaacc

SEQ ID NO: 1225712 - RNA, 14 nt, Homo sapiens
ucauugauugaaua

SEQ ID NO: 1225713 - RNA, 14 nt, Homo sapiens
ucauugcacuuuga

SEQ ID NO: 1225714 - RNA, 15 nt, Homo sapiens
ucauugccacacuug

SEQ ID NO: 1225715 - RNA, 13 nt, Homo sapiens
ucauugcuaauau

SEQ ID NO: 1225716 - RNA, 11 nt, Homo sapiens
ucauugcugag

SEQ ID NO: 1225717 - RNA, 20 nt, Homo sapiens
ucauuggccagcucauaaaa

SEQ ID NO: 1225718 - RNA, 16 nt, Homo sapiens
ucauuguaaaaagccc

SEQ ID NO: 1225719 - RNA, 23 nt, Homo sapiens
ucauuguauuuuuaacaccagaa

SEQ ID NO: 1225720 - RNA, 22 nt, Homo sapiens
ucauugucuacauagugacaug

SEQ ID NO: 1225721 - RNA, 23 nt, Homo sapiens
ucauugucuguuuggaagaccag

SEQ ID NO: 1225722 - RNA, 14 nt, Homo sapiens
uccucuugcucaaa

SEQ ID NO: 1225723 - RNA, 14 nt, Homo sapiens
uccucuugugauuu

SEQ ID NO: 1225724 - RNA, 23 nt, Homo sapiens
uccucuuuguaauuuaaugaaaa

SEQ ID NO: 1225725 - RNA, 18 nt, Homo sapiens
uccugaaauaaacacugg

SEQ ID NO: 1225726 - RNA, 20 nt, Homo sapiens
uccugaaauaaacacuggug

SEQ ID NO: 1225727 - RNA, 19 nt, Homo sapiens
uccugaaauacguggcauu

SEQ ID NO: 1225728 - RNA, 19 nt, Homo sapiens
uccugaacucuucugcaaa

SEQ ID NO: 1225729 - RNA, 14 nt, Homo sapiens
uccugacacuauuc

SEQ ID NO: 1225730 - RNA, 19 nt, Homo sapiens
uccugacagaaggacucag

SEQ ID NO: 1225731 - RNA, 14 nt, Homo sapiens
uccugacagcaaua

SEQ ID NO: 1225732 - RNA, 13 nt, Homo sapiens
uccugacaucaca

SEQ ID NO: 1225733 - RNA, 20 nt, Homo sapiens
uccugacugaaaguaggggg

SEQ ID NO: 1225734 - RNA, 23 nt, Homo sapiens
uccugaggcaaaguagugaauau

SEQ ID NO: 1225735 - RNA, 23 nt, Homo sapiens
uccugaggcuuuggauuugacau

SEQ ID NO: 1225736 - RNA, 19 nt, Homo sapiens
uccugaggggcaucugccc

SEQ ID NO: 1225737 - RNA, 20 nt, Homo sapiens
uccugauauaucaaacugaa

SEQ ID NO: 1225738 - RNA, 20 nt, Homo sapiens
uccugaucgccaaccuuucc

SEQ ID NO: 1225739 - RNA, 15 nt, Homo sapiens
uccugaucugugaua

SEQ ID NO: 1225740 - RNA, 19 nt, Homo sapiens
uccugcagcaaacacucca

SEQ ID NO: 1225741 - RNA, 10 nt, Homo sapiens
uccugccaca

SEQ ID NO: 1225742 - RNA, 15 nt, Homo sapiens
uccugccacaacaga

SEQ ID NO: 1225743 - RNA, 20 nt, Homo sapiens
uccugccaccagcauccaca

SEQ ID NO: 1225744 - RNA, 16 nt, Homo sapiens
uccugcccaagcacuu

SEQ ID NO: 1225745 - RNA, 17 nt, Homo sapiens
uccugcccaagcacuuc

SEQ ID NO: 1225746 - RNA, 18 nt, Homo sapiens
uccugcccaagcacuuca

SEQ ID NO: 1225747 - RNA, 19 nt, Homo sapiens
uccugcccuuccugaagaa

SEQ ID NO: 1225748 - RNA, 18 nt, Homo sapiens
uccugccuguagcaguga

SEQ ID NO: 1225749 - RNA, 22 nt, Homo sapiens
uccugcuacaacuucagcagua

SEQ ID NO: 1225750 - RNA, 16 nt, Homo sapiens
uccuggaaacagcaug

SEQ ID NO: 1225751 - RNA, 19 nt, Homo sapiens
uccuggcacuaacguugag

SEQ ID NO: 1225752 - RNA, 21 nt, Homo sapiens
uccuggcagcccagagacuuu

SEQ ID NO: 1225753 - RNA, 22 nt, Homo sapiens
uccuggcaucaguagcaucugu

SEQ ID NO: 1225754 - RNA, 18 nt, Homo sapiens
uccuggccucaagugauc

SEQ ID NO: 1225755 - RNA, 15 nt, Homo sapiens
uccuggcgacaucuu

SEQ ID NO: 1225756 - RNA, 13 nt, Homo sapiens
uccuggcugauca

SEQ ID NO: 1225757 - RNA, 20 nt, Homo sapiens
uccugggagcccccaccaca

SEQ ID NO: 1225758 - RNA, 21 nt, Homo sapiens
uccugggcagcauacugagac

SEQ ID NO: 1225759 - RNA, 14 nt, Homo sapiens
uccuggucugugaa

SEQ ID NO: 1225760 - RNA, 17 nt, Homo sapiens
uccugguggauacugua

SEQ ID NO: 1225761 - RNA, 15 nt, Homo sapiens
uccuguaaauggugu

SEQ ID NO: 1225762 - RNA, 19 nt, Homo sapiens
uccuguacaaucaugaaca

SEQ ID NO: 1225763 - RNA, 19 nt, Homo sapiens
uccuguacauugugggaug

SEQ ID NO: 1225764 - RNA, 20 nt, Homo sapiens
uccuguauaagcacugaaaa

SEQ ID NO: 1225765 - RNA, 16 nt, Homo sapiens
uccugucagaugacac

SEQ ID NO: 1225766 - RNA, 16 nt, Homo sapiens
uccugugaaaauauga

SEQ ID NO: 1225767 - RNA, 20 nt, Homo sapiens
uccugugaaugccacugccu

SEQ ID NO: 1225768 - RNA, 14 nt, Homo sapiens
uccugugaauuucu

SEQ ID NO: 1225769 - RNA, 18 nt, Homo sapiens
uccugugacauguaacag

SEQ ID NO: 1225770 - RNA, 23 nt, Homo sapiens
uccuguggaacccagcaguucug

SEQ ID NO: 1225771 - RNA, 15 nt, Homo sapiens
uccuguguauguaua

SEQ ID NO: 1225772 - RNA, 15 nt, Homo sapiens
uccugugucagaaac

SEQ ID NO: 1225773 - RNA, 20 nt, Homo sapiens
uccugugucuugcaauggca

SEQ ID NO: 1225774 - RNA, 22 nt, Homo sapiens
uccugugugugcgccuacagga

SEQ ID NO: 1225775 - RNA, 23 nt, Homo sapiens
uccuguugccuuuauauccaaaa

SEQ ID NO: 1225776 - RNA, 14 nt, Homo sapiens
uccuguugucuaca

SEQ ID NO: 1225777 - RNA, 17 nt, Homo sapiens
uccuguuuuucugggug

SEQ ID NO: 1225778 - RNA, 21 nt, Homo sapiens
uccuuaaaaaucacacuguaa

SEQ ID NO: 1225779 - RNA, 23 nt, Homo sapiens
uccuuaaagcauuugcaacagcu

SEQ ID NO: 1225780 - RNA, 14 nt, Homo sapiens
uccuuaagggacaa

SEQ ID NO: 1225781 - RNA, 20 nt, Homo sapiens
uccuuacaacugcucuagau

SEQ ID NO: 1225782 - RNA, 20 nt, Homo sapiens
uccuuacgcuuugucacaca

SEQ ID NO: 1225783 - RNA, 15 nt, Homo sapiens
uccuuaucugucaca

SEQ ID NO: 1225784 - RNA, 14 nt, Homo sapiens
uccuucagaucucu

SEQ ID NO: 1225785 - RNA, 16 nt, Homo sapiens
uccuuccacauguaca

SEQ ID NO: 1225786 - RNA, 18 nt, Homo sapiens
uccuuccaguguccuuag

SEQ ID NO: 1225787 - RNA, 12 nt, Homo sapiens
uccuuccaucaa

SEQ ID NO: 1225788 - RNA, 16 nt, Homo sapiens
uccuuccaucccuacc

SEQ ID NO: 1225789 - RNA, 22 nt, Homo sapiens
uccuucccacccccaguccugu

SEQ ID NO: 1225790 - RNA, 19 nt, Homo sapiens
uccuucccauuucucuaca

SEQ ID NO: 1225791 - RNA, 22 nt, Homo sapiens
uccuucccucaaagaggccuua

SEQ ID NO: 1225792 - RNA, 19 nt, Homo sapiens
uccuucccucucaugacuu

SEQ ID NO: 1225793 - RNA, 21 nt, Homo sapiens
uccuuccuaaacccaaugacu

SEQ ID NO: 1225794 - RNA, 19 nt, Homo sapiens
uccuuccuauaacuugaug

SEQ ID NO: 1225795 - RNA, 12 nt, Homo sapiens
uccuuccugacc

SEQ ID NO: 1225796 - RNA, 13 nt, Homo sapiens
uccuucuggccuu

SEQ ID NO: 1225797 - RNA, 22 nt, Homo sapiens
uccuucuucaacgccaucucca

SEQ ID NO: 1225798 - RNA, 21 nt, Homo sapiens
uccuucuuguaguagucucau

SEQ ID NO: 1225799 - RNA, 17 nt, Homo sapiens
uccuugaaaguaggaua

SEQ ID NO: 1225800 - RNA, 18 nt, Homo sapiens
uccuugaagcugcccuug

SEQ ID NO: 1225801 - RNA, 19 nt, Homo sapiens
uccuugacuucuuugagaa

SEQ ID NO: 1225802 - RNA, 19 nt, Homo sapiens
uccuugauacuaaaaguuc

SEQ ID NO: 1225803 - RNA, 20 nt, Homo sapiens
uccuugauguacagauuuua

SEQ ID NO: 1225804 - RNA, 16 nt, Homo sapiens
uccuuggcaccaaaga

SEQ ID NO: 1225805 - RNA, 15 nt, Homo sapiens
uccuuggcuuaccug

SEQ ID NO: 1225806 - RNA, 18 nt, Homo sapiens
uccuuggggagcacuugu

SEQ ID NO: 1225807 - RNA, 17 nt, Homo sapiens
uccuugucuauccuucc

SEQ ID NO: 1225808 - RNA, 20 nt, Homo sapiens
uccuugucucugcuaagaaa

SEQ ID NO: 1225809 - RNA, 23 nt, Homo sapiens
uccuugugcaaaauauuugacua

SEQ ID NO: 1225810 - RNA, 23 nt, Homo sapiens
uccuuguggcagaggaugucuca

SEQ ID NO: 1225811 - RNA, 19 nt, Homo sapiens
uccuuuaaaccaucagccg

SEQ ID NO: 1225812 - RNA, 19 nt, Homo sapiens
uccuuuaccccucauccaa

SEQ ID NO: 1225813 - RNA, 18 nt, Homo sapiens
uccuuuaguaccugaaaa

SEQ ID NO: 1225814 - RNA, 22 nt, Homo sapiens
uccuuuccccagcccagggugg

SEQ ID NO: 1225815 - RNA, 15 nt, Homo sapiens
uccuuucuccuguga

SEQ ID NO: 1225816 - RNA, 17 nt, Homo sapiens
uccuuugaucccagaaa

SEQ ID NO: 1225817 - RNA, 17 nt, Homo sapiens
uccuuugguccuucaaa

SEQ ID NO: 1225818 - RNA, 13 nt, Homo sapiens
uccuuugugcuua

SEQ ID NO: 1225819 - RNA, 18 nt, Homo sapiens
uccuuuuaguauucuuag

SEQ ID NO: 1225820 - RNA, 19 nt, Homo sapiens
uccuuuucuuuuguuacug

SEQ ID NO: 1225821 - RNA, 23 nt, Homo sapiens
uccuuuuggaacccccacuuuua

SEQ ID NO: 1225822 - RNA, 15 nt, Homo sapiens
uccuuuugguuuugg

SEQ ID NO: 1225823 - RNA, 19 nt, Homo sapiens
uccuuuuuuauacaggaaa

SEQ ID NO: 1225824 - RNA, 22 nt, Homo sapiens
uccuuuuuuuuuuauccuaguc

SEQ ID NO: 1225825 - RNA, 20 nt, Homo sapiens
ucgaaaccuacaagauuucc

SEQ ID NO: 1225826 - RNA, 16 nt, Homo sapiens
ucgaaagaaaaugggc

SEQ ID NO: 1225827 - RNA, 20 nt, Homo sapiens
ggacucugcuucaguccacu

SEQ ID NO: 1225828 - RNA, 17 nt, Homo sapiens
ggacucuggauauuugc

SEQ ID NO: 1225829 - RNA, 13 nt, Homo sapiens
ggacucuugcucu

SEQ ID NO: 1225830 - RNA, 14 nt, Homo sapiens
ggacucuugcucuu

SEQ ID NO: 1225831 - RNA, 15 nt, Homo sapiens
ggacugaaaagggaa

SEQ ID NO: 1225832 - RNA, 17 nt, Homo sapiens
ggacugaaugugccuaa

SEQ ID NO: 1225833 - RNA, 21 nt, Homo sapiens
ggacuggacgugcucagacau

SEQ ID NO: 1225834 - RNA, 10 nt, Homo sapiens
ggacugggag

SEQ ID NO: 1225835 - RNA, 13 nt, Homo sapiens
ggacugugccuga

SEQ ID NO: 1225836 - RNA, 11 nt, Homo sapiens
ggacuguguug

SEQ ID NO: 1225837 - RNA, 23 nt, Homo sapiens
ggacuguuccaggcccuccagug

SEQ ID NO: 1225838 - RNA, 18 nt, Homo sapiens
ggacuuccuugcucuccc

SEQ ID NO: 1225839 - RNA, 23 nt, Homo sapiens
ggacuugauagcaaacacugggg

SEQ ID NO: 1225840 - RNA, 15 nt, Homo sapiens
ggacuuggaagcucc

SEQ ID NO: 1225841 - RNA, 17 nt, Homo sapiens
ggagaaaucacauaacc

SEQ ID NO: 1225842 - RNA, 17 nt, Homo sapiens
ggagaagcaugaaaaag

SEQ ID NO: 1225843 - RNA, 14 nt, Homo sapiens
ggagaaugaugucc

SEQ ID NO: 1225844 - RNA, 18 nt, Homo sapiens
ggagacugaagacucagc

SEQ ID NO: 1225845 - RNA, 12 nt, Homo sapiens
ggagacuggaaa

SEQ ID NO: 1225846 - RNA, 16 nt, Homo sapiens
ggagacugucucaaga

SEQ ID NO: 1225847 - RNA, 23 nt, Homo sapiens
ggagagcaugcuaucccacggga

SEQ ID NO: 1225848 - RNA, 15 nt, Homo sapiens
ggagagcccagccau

SEQ ID NO: 1225849 - RNA, 13 nt, Homo sapiens
ggagagcccaguc

SEQ ID NO: 1225850 - RNA, 14 nt, Homo sapiens
ggagaggggggcca

SEQ ID NO: 1225851 - RNA, 14 nt, Homo sapiens
ggagauccacuggg

SEQ ID NO: 1225852 - RNA, 21 nt, Homo sapiens
ggagaucgcaucauugcacuc

SEQ ID NO: 1225853 - RNA, 19 nt, Homo sapiens
ggagcaaaaggcagcucac

SEQ ID NO: 1225854 - RNA, 20 nt, Homo sapiens
ggagcaaaaucgaugcagug

SEQ ID NO: 1225855 - RNA, 18 nt, Homo sapiens
ggagcaaaucgugccuug

SEQ ID NO: 1225856 - RNA, 17 nt, Homo sapiens
ggagcaacaggccaagg

SEQ ID NO: 1225857 - RNA, 16 nt, Homo sapiens
ggagcacuuguccacg

SEQ ID NO: 1225858 - RNA, 19 nt, Homo sapiens
ggagcagaguguucccuga

SEQ ID NO: 1225859 - RNA, 17 nt, Homo sapiens
ggagcaugguguuuuca

SEQ ID NO: 1225860 - RNA, 17 nt, Homo sapiens
ggagccaacugcugcuu

SEQ ID NO: 1225861 - RNA, 18 nt, Homo sapiens
ggagccucccccucagau

SEQ ID NO: 1225862 - RNA, 16 nt, Homo sapiens
ggagccuggccucuca

SEQ ID NO: 1225863 - RNA, 13 nt, Homo sapiens
ggagcgcaccugc

SEQ ID NO: 1225864 - RNA, 16 nt, Homo sapiens
ggagcucaagcccuug

SEQ ID NO: 1225865 - RNA, 23 nt, Homo sapiens
ggagcucuucaggccucccucuc

SEQ ID NO: 1225866 - RNA, 21 nt, Homo sapiens
ggagcugccuuggcucagaca

SEQ ID NO: 1225867 - RNA, 15 nt, Homo sapiens
ggagcugcggccacu

SEQ ID NO: 1225868 - RNA, 17 nt, Homo sapiens
ggagcuggggaaacuca

SEQ ID NO: 1225869 - RNA, 15 nt, Homo sapiens
ggaggaccagagcua

SEQ ID NO: 1225870 - RNA, 21 nt, Homo sapiens
ggaggacccuggaaauggacu

SEQ ID NO: 1225871 - RNA, 20 nt, Homo sapiens
ggaggagcucugcagccucc

SEQ ID NO: 1225872 - RNA, 19 nt, Homo sapiens
ggaggagggcucagggagc

SEQ ID NO: 1225873 - RNA, 20 nt, Homo sapiens
ggaggaguuccaccaugagc

SEQ ID NO: 1225874 - RNA, 12 nt, Homo sapiens
ggaggcaccugg

SEQ ID NO: 1225875 - RNA, 15 nt, Homo sapiens
ggaggccaaccagcc

SEQ ID NO: 1225876 - RNA, 14 nt, Homo sapiens
ggaggccaauaaaa

SEQ ID NO: 1225877 - RNA, 14 nt, Homo sapiens
ggaggccauugugu

SEQ ID NO: 1225878 - RNA, 21 nt, Homo sapiens
ggaggcccaaaugauggauca

SEQ ID NO: 1225879 - RNA, 19 nt, Homo sapiens
ggaggcccgcagagcacag

SEQ ID NO: 1225880 - RNA, 15 nt, Homo sapiens
ggaggcccugcacug

SEQ ID NO: 1225881 - RNA, 14 nt, Homo sapiens
ggaggccugaugcu

SEQ ID NO: 1225882 - RNA, 15 nt, Homo sapiens
ggaggcugaggcaag

SEQ ID NO: 1225883 - RNA, 11 nt, Homo sapiens
ggaggcuuccu

SEQ ID NO: 1225884 - RNA, 15 nt, Homo sapiens
ggagggaagugugag

SEQ ID NO: 1225885 - RNA, 17 nt, Homo sapiens
ggagggagguaacgggu

SEQ ID NO: 1225886 - RNA, 14 nt, Homo sapiens
ggagggcaguuuuc

SEQ ID NO: 1225887 - RNA, 20 nt, Homo sapiens
ggagggugguucaacaaaga

SEQ ID NO: 1225888 - RNA, 16 nt, Homo sapiens
ggaaguaaagccucaa

SEQ ID NO: 1225889 - RNA, 16 nt, Homo sapiens
ggaaguaacauuugcc

SEQ ID NO: 1225890 - RNA, 17 nt, Homo sapiens
ggaaguaacauuugccu

SEQ ID NO: 1225891 - RNA, 23 nt, Homo sapiens
ggaagucaucucauuccacuguu

SEQ ID NO: 1225892 - RNA, 15 nt, Homo sapiens
ggaaguguaacagcu

SEQ ID NO: 1225893 - RNA, 16 nt, Homo sapiens
ggaaguuaaagggcau

SEQ ID NO: 1225894 - RNA, 17 nt, Homo sapiens
ggaauaaaaacauuucu

SEQ ID NO: 1225895 - RNA, 22 nt, Homo sapiens
ggaauaaaauccuaagacacaa

SEQ ID NO: 1225896 - RNA, 14 nt, Homo sapiens
ggaauaaccuucca

SEQ ID NO: 1225897 - RNA, 15 nt, Homo sapiens
ggaauaaggccuuaa

SEQ ID NO: 1225898 - RNA, 15 nt, Homo sapiens
ggaauacugugcaua

SEQ ID NO: 1225899 - RNA, 19 nt, Homo sapiens
ggaauaucaucugucauua

SEQ ID NO: 1225900 - RNA, 20 nt, Homo sapiens
ggaaucagggaccagcuuua

SEQ ID NO: 1225901 - RNA, 15 nt, Homo sapiens
ggaauccucagagaa

SEQ ID NO: 1225902 - RNA, 21 nt, Homo sapiens
ggaauccuuggggagcacuug

SEQ ID NO: 1225903 - RNA, 14 nt, Homo sapiens
ggaaucgacuguau

SEQ ID NO: 1225904 - RNA, 19 nt, Homo sapiens
ggaaugaauacagcauuua

SEQ ID NO: 1225905 - RNA, 21 nt, Homo sapiens
ggaauggaaagcggaguuccu

SEQ ID NO: 1225906 - RNA, 23 nt, Homo sapiens
ggaaugggcacagcacagccagg

SEQ ID NO: 1225907 - RNA, 22 nt, Homo sapiens
ggaauuagaaaugaauuuggag

SEQ ID NO: 1225908 - RNA, 17 nt, Homo sapiens
ggaauuauuguaccauu

SEQ ID NO: 1225909 - RNA, 23 nt, Homo sapiens
ggaauucauuuucaucacuggga

SEQ ID NO: 1225910 - RNA, 22 nt, Homo sapiens
ggaauuccagugccaggccagu

SEQ ID NO: 1225911 - RNA, 23 nt, Homo sapiens
ggaauugcuuuuaaaauacauuu

SEQ ID NO: 1225912 - RNA, 18 nt, Homo sapiens
ggaauuucuuaacuucuu

SEQ ID NO: 1225913 - RNA, 19 nt, Homo sapiens
ggacaaaacuucuugucag

SEQ ID NO: 1225914 - RNA, 15 nt, Homo sapiens
ggacaaaugaugcca

SEQ ID NO: 1225915 - RNA, 20 nt, Homo sapiens
ggacaaaugaugccauggca

SEQ ID NO: 1225916 - RNA, 14 nt, Homo sapiens
ggacaacacuucau

SEQ ID NO: 1225917 - RNA, 14 nt, Homo sapiens
ggacaagacacuga

SEQ ID NO: 1225918 - RNA, 14 nt, Homo sapiens
ggacaagaccccca

SEQ ID NO: 1225919 - RNA, 22 nt, Homo sapiens
ggacaaggagugugaccacuga

SEQ ID NO: 1225920 - RNA, 15 nt, Homo sapiens
ggacacaguggagcc

SEQ ID NO: 1225921 - RNA, 14 nt, Homo sapiens
ggacacuccagugc

SEQ ID NO: 1225922 - RNA, 11 nt, Homo sapiens
ggacacuguac

SEQ ID NO: 1225923 - RNA, 19 nt, Homo sapiens
ggacagacuggccgggcag

SEQ ID NO: 1225924 - RNA, 13 nt, Homo sapiens
ggacagcauauaa

SEQ ID NO: 1225925 - RNA, 15 nt, Homo sapiens
ggacaggcaggccag

SEQ ID NO: 1225926 - RNA, 15 nt, Homo sapiens
ggacaggcauguucu

SEQ ID NO: 1225927 - RNA, 18 nt, Homo sapiens
ggacauugcggacagcca

SEQ ID NO: 1225928 - RNA, 17 nt, Homo sapiens
ggaccaaugaggugagg

SEQ ID NO: 1225929 - RNA, 12 nt, Homo sapiens
ggaccacugcau

SEQ ID NO: 1225930 - RNA, 14 nt, Homo sapiens
ggaccaggaugaca

SEQ ID NO: 1225931 - RNA, 12 nt, Homo sapiens
ggaccagggaug

SEQ ID NO: 1225932 - RNA, 15 nt, Homo sapiens
ggaccaguggugccu

SEQ ID NO: 1225933 - RNA, 17 nt, Homo sapiens
ggaccauucauacccac

SEQ ID NO: 1225934 - RNA, 18 nt, Homo sapiens
ggacccagccuucaguca

SEQ ID NO: 1225935 - RNA, 17 nt, Homo sapiens
ggacccuggaaauggac

SEQ ID NO: 1225936 - RNA, 20 nt, Homo sapiens
ggacccuguugaggguccuc

SEQ ID NO: 1225937 - RNA, 14 nt, Homo sapiens
ggaccucaguuuua

SEQ ID NO: 1225938 - RNA, 22 nt, Homo sapiens
ggaccugccccccacucugcac

SEQ ID NO: 1225939 - RNA, 23 nt, Homo sapiens
ggacgcacgcucgcugccaucac

SEQ ID NO: 1225940 - RNA, 15 nt, Homo sapiens
ggacggcaggcucac

SEQ ID NO: 1225941 - RNA, 23 nt, Homo sapiens
ggacggcuguggaccguggacag

SEQ ID NO: 1225942 - RNA, 18 nt, Homo sapiens
ggacgugcgcgaugccug

SEQ ID NO: 1225943 - RNA, 13 nt, Homo sapiens
ggacgugcucaga

SEQ ID NO: 1225944 - RNA, 23 nt, Homo sapiens
ggacuaucaacaccacuaggaau

SEQ ID NO: 1225945 - RNA, 19 nt, Homo sapiens
ggacuauuuaugaaggcaa

SEQ ID NO: 1225946 - RNA, 22 nt, Homo sapiens
ggacucaaugcacugacauugu

SEQ ID NO: 1225947 - RNA, 17 nt, Homo sapiens
ggacucaucaaagccuu

SEQ ID NO: 1225948 - RNA, 22 nt, Homo sapiens
ggacuccaucucucauccucca

SEQ ID NO: 1225949 - RNA, 17 nt, Homo sapiens
ggacucccgggccacgc

SEQ ID NO: 1225950 - RNA, 15 nt, Homo sapiens
ggacuccuggugccc

SEQ ID NO: 1225951 - RNA, 21 nt, Homo sapiens
ggacucugcaucccagcaccu

SEQ ID NO: 1225952 - RNA, 17 nt, Homo sapiens
ccaguuuauuacauuua

SEQ ID NO: 1225953 - RNA, 13 nt, Homo sapiens
ccauaaaggcaua

SEQ ID NO: 1225954 - RNA, 14 nt, Homo sapiens
ccauaaauguguuc

SEQ ID NO: 1225955 - RNA, 22 nt, Homo sapiens
ccauaaccauuaugcaaguguu

SEQ ID NO: 1225956 - RNA, 15 nt, Homo sapiens
ccauaagaaagcacu

SEQ ID NO: 1225957 - RNA, 16 nt, Homo sapiens
ccauaagaaagcacua

SEQ ID NO: 1225958 - RNA, 15 nt, Homo sapiens
ccauaagaggugauc

SEQ ID NO: 1225959 - RNA, 13 nt, Homo sapiens
ccauaaugcauuc

SEQ ID NO: 1225960 - RNA, 22 nt, Homo sapiens
ccauaauuauuauuuccagugu

SEQ ID NO: 1225961 - RNA, 21 nt, Homo sapiens
ccauagggacccauucuacac

SEQ ID NO: 1225962 - RNA, 15 nt, Homo sapiens
ccauagucacauggc

SEQ ID NO: 1225963 - RNA, 16 nt, Homo sapiens
ccauagucacauggcc

SEQ ID NO: 1225964 - RNA, 19 nt, Homo sapiens
ccauauaucuuauguuaaa

SEQ ID NO: 1225965 - RNA, 18 nt, Homo sapiens
ccauauuuauacagcaga

SEQ ID NO: 1225966 - RNA, 22 nt, Homo sapiens
ccauauuuuauuguauuuugau

SEQ ID NO: 1225967 - RNA, 12 nt, Homo sapiens
ccaucagacugu

SEQ ID NO: 1225968 - RNA, 15 nt, Homo sapiens
ccaucagacugucaa

SEQ ID NO: 1225969 - RNA, 18 nt, Homo sapiens
ccaucagugaauccugaa

SEQ ID NO: 1225970 - RNA, 23 nt, Homo sapiens
ccaucagugaauccugaaacugg

SEQ ID NO: 1225971 - RNA, 19 nt, Homo sapiens
ccaucagugguaacugcuu

SEQ ID NO: 1225972 - RNA, 22 nt, Homo sapiens
ccaucauaauucuaaucuaaca

SEQ ID NO: 1225973 - RNA, 15 nt, Homo sapiens
ccaucauuuacuuuu

SEQ ID NO: 1225974 - RNA, 22 nt, Homo sapiens
ccauccagccgcugcacaucac

SEQ ID NO: 1225975 - RNA, 13 nt, Homo sapiens
ccauccaguggag

SEQ ID NO: 1225976 - RNA, 18 nt, Homo sapiens
ccauccccuggacuggga

SEQ ID NO: 1225977 - RNA, 15 nt, Homo sapiens
ccauccugaaagcca

SEQ ID NO: 1225978 - RNA, 19 nt, Homo sapiens
ccaucgggagagcucugac

SEQ ID NO: 1225979 - RNA, 14 nt, Homo sapiens
ccaucguucucugc

SEQ ID NO: 1225980 - RNA, 14 nt, Homo sapiens
ccaucuacaccagu

SEQ ID NO: 1225981 - RNA, 20 nt, Homo sapiens
ccaucuccuauaaucuguca

SEQ ID NO: 1225982 - RNA, 17 nt, Homo sapiens
ccaucuccuuucaggga

SEQ ID NO: 1225983 - RNA, 22 nt, Homo sapiens
ccaucucgggcacaggcccacc

SEQ ID NO: 1225984 - RNA, 19 nt, Homo sapiens
ccaucugaagaaacuuccc

SEQ ID NO: 1225985 - RNA, 18 nt, Homo sapiens
ccaucugcuugguuggcu

SEQ ID NO: 1225986 - RNA, 11 nt, Homo sapiens
ccaucuuuaca

SEQ ID NO: 1225987 - RNA, 22 nt, Homo sapiens
ccaucuuuaucaugaagcacau

SEQ ID NO: 1225988 - RNA, 13 nt, Homo sapiens
ccaucuuucacua

SEQ ID NO: 1225989 - RNA, 17 nt, Homo sapiens
ccaugaaacugacucau

SEQ ID NO: 1225990 - RNA, 19 nt, Homo sapiens
ccaugaaacugacucauca

SEQ ID NO: 1225991 - RNA, 21 nt, Homo sapiens
ccaugaagcgaaacacagaga

SEQ ID NO: 1225992 - RNA, 17 nt, Homo sapiens
ccaugaauuaguucucc

SEQ ID NO: 1225993 - RNA, 18 nt, Homo sapiens
ccaugaccuaguuuucca

SEQ ID NO: 1225994 - RNA, 20 nt, Homo sapiens
ccaugacgacauacaugcua

SEQ ID NO: 1225995 - RNA, 22 nt, Homo sapiens
ccaugagccugcccgcugcaau

SEQ ID NO: 1225996 - RNA, 12 nt, Homo sapiens
ccaugagcucac

SEQ ID NO: 1225997 - RNA, 21 nt, Homo sapiens
ccaugagcucacccgugucua

SEQ ID NO: 1225998 - RNA, 19 nt, Homo sapiens
ccaugaggaaggaacagca

SEQ ID NO: 1225999 - RNA, 20 nt, Homo sapiens
ccaugaggaaggaacagcaa

SEQ ID NO: 1226000 - RNA, 16 nt, Homo sapiens
ccaugagggacagggu

SEQ ID NO: 1226001 - RNA, 19 nt, Homo sapiens
ccaugauaacugcaauuuu

SEQ ID NO: 1226002 - RNA, 13 nt, Homo sapiens
ccaugcaauucau

SEQ ID NO: 1226003 - RNA, 19 nt, Homo sapiens
ccaugcagagcgccgugag

SEQ ID NO: 1226004 - RNA, 17 nt, Homo sapiens
ccaugcauggugcauca

SEQ ID NO: 1226005 - RNA, 21 nt, Homo sapiens
ccaugcauggugcaucagcag

SEQ ID NO: 1226006 - RNA, 17 nt, Homo sapiens
ccaugcguccuggucaa

SEQ ID NO: 1226007 - RNA, 15 nt, Homo sapiens
ccaugcuaacaaaga

SEQ ID NO: 1226008 - RNA, 20 nt, Homo sapiens
ccaugcugggccacugggga

SEQ ID NO: 1226009 - RNA, 13 nt, Homo sapiens
ccaugcugugcug

SEQ ID NO: 1226010 - RNA, 16 nt, Homo sapiens
ccauggaggcaugcca

SEQ ID NO: 1226011 - RNA, 22 nt, Homo sapiens
ccauggauuucauggugauucc

SEQ ID NO: 1226012 - RNA, 23 nt, Homo sapiens
ccauggcccccaauaaaggcagc

SEQ ID NO: 1226013 - RNA, 14 nt, Homo sapiens
ccaugggacaggga

SEQ ID NO: 1226014 - RNA, 13 nt, Homo sapiens
ccaugggauacaa

SEQ ID NO: 1226015 - RNA, 17 nt, Homo sapiens
ccaugggccugggccug

SEQ ID NO: 1226016 - RNA, 23 nt, Homo sapiens
ccaugggcuagugugaguggcag

SEQ ID NO: 1226017 - RNA, 20 nt, Homo sapiens
ccauggucuuuccacuuuca

SEQ ID NO: 1226018 - RNA, 21 nt, Homo sapiens
ccauguacauaauucuugcua

SEQ ID NO: 1226019 - RNA, 14 nt, Homo sapiens
ccauguccaaagag

SEQ ID NO: 1226020 - RNA, 21 nt, Homo sapiens
ccauguccaaagaggcugccc

SEQ ID NO: 1226021 - RNA, 17 nt, Homo sapiens
ccauguccauagccaua

SEQ ID NO: 1226022 - RNA, 15 nt, Homo sapiens
ccaugugcaccugcc

SEQ ID NO: 1226023 - RNA, 20 nt, Homo sapiens
ccaugugccugcaccaggag

SEQ ID NO: 1226024 - RNA, 15 nt, Homo sapiens
ccauguucuccauga

SEQ ID NO: 1226025 - RNA, 17 nt, Homo sapiens
ccauguuggccaggcug

SEQ ID NO: 1226026 - RNA, 22 nt, Homo sapiens
ccauguuuucccuuuauucauc

SEQ ID NO: 1226027 - RNA, 10 nt, Homo sapiens
ccauuauuca

SEQ ID NO: 1226028 - RNA, 13 nt, Homo sapiens
ccauucacaauaa

SEQ ID NO: 1226029 - RNA, 15 nt, Homo sapiens
ccauucacuacaggu

SEQ ID NO: 1226030 - RNA, 21 nt, Homo sapiens
ccauucauacccacacaccca

SEQ ID NO: 1226031 - RNA, 22 nt, Homo sapiens
ccauucauauuaagacagugua

SEQ ID NO: 1226032 - RNA, 22 nt, Homo sapiens
ccauucugcguaugagucccau

SEQ ID NO: 1226033 - RNA, 16 nt, Homo sapiens
ccauucuggacaccag

SEQ ID NO: 1226034 - RNA, 23 nt, Homo sapiens
ccauucuguuuggaucuauagaa

SEQ ID NO: 1226035 - RNA, 11 nt, Homo sapiens
ccauugcauca

SEQ ID NO: 1226036 - RNA, 15 nt, Homo sapiens
ccauugguccaagau

SEQ ID NO: 1226037 - RNA, 22 nt, Homo sapiens
ccauugucgucuuuauguccgc

SEQ ID NO: 1226038 - RNA, 12 nt, Homo sapiens
ccauuguucacc

SEQ ID NO: 1226039 - RNA, 12 nt, Homo sapiens
ccauuuacacuu

SEQ ID NO: 1226040 - RNA, 13 nt, Homo sapiens
ccauuuacacuuu

SEQ ID NO: 1226041 - RNA, 22 nt, Homo sapiens
ccauuucacucucaaacuucac

SEQ ID NO: 1226042 - RNA, 16 nt, Homo sapiens
ccauuugccuugcaau

SEQ ID NO: 1226043 - RNA, 13 nt, Homo sapiens
ccauuuguaauaa

SEQ ID NO: 1226044 - RNA, 17 nt, Homo sapiens
ccauuuguaaugaauuu

SEQ ID NO: 1226045 - RNA, 15 nt, Homo sapiens
ccauuugugccagag

SEQ ID NO: 1226046 - RNA, 14 nt, Homo sapiens
ccauuuugcaaaau

SEQ ID NO: 1226047 - RNA, 11 nt, Homo sapiens
ccauuuugccu

SEQ ID NO: 1226048 - RNA, 14 nt, Homo sapiens
ccauuuugugaaug

SEQ ID NO: 1226049 - RNA, 20 nt, Homo sapiens
ccauuuuuccucuguucaca

SEQ ID NO: 1226050 - RNA, 23 nt, Homo sapiens
ccauuuuuuucauuguguucucu

SEQ ID NO: 1226051 - RNA, 18 nt, Homo sapiens
cccaaaaaagaaugugcu

SEQ ID NO: 1226052 - RNA, 20 nt, Homo sapiens
cccaaacccuuaacugacau

SEQ ID NO: 1226053 - RNA, 23 nt, Homo sapiens
cccaaagcacaugcuuagcuuau

SEQ ID NO: 1226054 - RNA, 18 nt, Homo sapiens
cccaaauucuuucagugg

SEQ ID NO: 1226055 - RNA, 16 nt, Homo sapiens
cccaacaaaccaucca

SEQ ID NO: 1226056 - RNA, 14 nt, Homo sapiens
cccaacaugcacug

SEQ ID NO: 1226057 - RNA, 16 nt, Homo sapiens
cccaaccccaguggau

SEQ ID NO: 1226058 - RNA, 22 nt, Homo sapiens
cccaaccuucacaucugucacg

SEQ ID NO: 1226059 - RNA, 14 nt, Homo sapiens
cccaacgcacagga

SEQ ID NO: 1226060 - RNA, 22 nt, Homo sapiens
cccaacucuccuggccuggcca

SEQ ID NO: 1226061 - RNA, 23 nt, Homo sapiens
cccaacugaguguuauuugcaca

SEQ ID NO: 1226062 - RNA, 18 nt, Homo sapiens
cccaacuucauacuggca

SEQ ID NO: 1226063 - RNA, 19 nt, Homo sapiens
cccaacuucauacuggcag

SEQ ID NO: 1226064 - RNA, 23 nt, Homo sapiens
cccaagaggucaaggcugcagug

SEQ ID NO: 1226065 - RNA, 16 nt, Homo sapiens
cccaaggaagagccaa

SEQ ID NO: 1226066 - RNA, 19 nt, Homo sapiens
cccaagguucugguuccau

SEQ ID NO: 1226067 - RNA, 15 nt, Homo sapiens
uggaauggagauuca

SEQ ID NO: 1226068 - RNA, 13 nt, Homo sapiens
uggaauguaauca

SEQ ID NO: 1226069 - RNA, 21 nt, Homo sapiens
uggaauuccagugccaggcca

SEQ ID NO: 1226070 - RNA, 14 nt, Homo sapiens
uggaauugcucaag

SEQ ID NO: 1226071 - RNA, 20 nt, Homo sapiens
uggacaaaccgagugcaaug

SEQ ID NO: 1226072 - RNA, 17 nt, Homo sapiens
uggacaaggagugugac

SEQ ID NO: 1226073 - RNA, 20 nt, Homo sapiens
uggacaaggagugugaccac

SEQ ID NO: 1226074 - RNA, 13 nt, Homo sapiens
uggacacaaacag

SEQ ID NO: 1226075 - RNA, 13 nt, Homo sapiens
uggacacugagag

SEQ ID NO: 1226076 - RNA, 22 nt, Homo sapiens
uggacacuucacgcccuuggcc

SEQ ID NO: 1226077 - RNA, 16 nt, Homo sapiens
uggacacuugguuaga

SEQ ID NO: 1226078 - RNA, 15 nt, Homo sapiens
uggacagcaaggugg

SEQ ID NO: 1226079 - RNA, 16 nt, Homo sapiens
uggacagccugaguca

SEQ ID NO: 1226080 - RNA, 17 nt, Homo sapiens
uggacaggagucagugu

SEQ ID NO: 1226081 - RNA, 22 nt, Homo sapiens
uggacagucacugccacuuugc

SEQ ID NO: 1226082 - RNA, 15 nt, Homo sapiens
uggaccacugcauga

SEQ ID NO: 1226083 - RNA, 14 nt, Homo sapiens
uggacgugcucaga

SEQ ID NO: 1226084 - RNA, 15 nt, Homo sapiens
uggacucucagggau

SEQ ID NO: 1226085 - RNA, 16 nt, Homo sapiens
uggacugauaaucucu

SEQ ID NO: 1226086 - RNA, 19 nt, Homo sapiens
uggacuggugugcucucuu

SEQ ID NO: 1226087 - RNA, 15 nt, Homo sapiens
uggacugucauagaa

SEQ ID NO: 1226088 - RNA, 15 nt, Homo sapiens
uggacugugugcaac

SEQ ID NO: 1226089 - RNA, 19 nt, Homo sapiens
uggacuuccacugccaucc

SEQ ID NO: 1226090 - RNA, 11 nt, Homo sapiens
uggacuuccag

SEQ ID NO: 1226091 - RNA, 17 nt, Homo sapiens
uggacuuccagugcuca

SEQ ID NO: 1226092 - RNA, 12 nt, Homo sapiens
ugggcugcugca

SEQ ID NO: 1226093 - RNA, 21 nt, Homo sapiens
ugggcugguaucucagaaagu

SEQ ID NO: 1226094 - RNA, 14 nt, Homo sapiens
ugggcugugcugcu

SEQ ID NO: 1226095 - RNA, 13 nt, Homo sapiens
ugggcuugaccag

SEQ ID NO: 1226096 - RNA, 15 nt, Homo sapiens
ugggcuuuggagcug

SEQ ID NO: 1226097 - RNA, 15 nt, Homo sapiens
uggggaaaaaacugu

SEQ ID NO: 1226098 - RNA, 15 nt, Homo sapiens
uggggaaaaaagcac

SEQ ID NO: 1226099 - RNA, 19 nt, Homo sapiens
uggggaacugcguggugcu

SEQ ID NO: 1226100 - RNA, 19 nt, Homo sapiens
uggggaagaguggucuuga

SEQ ID NO: 1226101 - RNA, 16 nt, Homo sapiens
uggggaaugcucccag

SEQ ID NO: 1226102 - RNA, 23 nt, Homo sapiens
uggggaaugcucccagcugugcu

SEQ ID NO: 1226103 - RNA, 15 nt, Homo sapiens
uggggacacagauca

SEQ ID NO: 1226104 - RNA, 15 nt, Homo sapiens
uggggacauugcucu

SEQ ID NO: 1226105 - RNA, 20 nt, Homo sapiens
uggggacccaggcuccgccc

SEQ ID NO: 1226106 - RNA, 19 nt, Homo sapiens
uggggaccccaaccucaga

SEQ ID NO: 1226107 - RNA, 21 nt, Homo sapiens
uggggauccccgccuggccag

SEQ ID NO: 1226108 - RNA, 16 nt, Homo sapiens
uggggcaggucacuuu

SEQ ID NO: 1226109 - RNA, 11 nt, Homo sapiens
uggggccauaa

SEQ ID NO: 1226110 - RNA, 22 nt, Homo sapiens
uggggccucuccuacuaugcaa

SEQ ID NO: 1226111 - RNA, 18 nt, Homo sapiens
uggggcgagcacugugag

SEQ ID NO: 1226112 - RNA, 22 nt, Homo sapiens
uggggcgagccaggaccacaga

SEQ ID NO: 1226113 - RNA, 18 nt, Homo sapiens
uggggcuccuuucuccag

SEQ ID NO: 1226114 - RNA, 17 nt, Homo sapiens
uggggcugcuccccuaa

SEQ ID NO: 1226115 - RNA, 14 nt, Homo sapiens
uggccagagccagc

SEQ ID NO: 1226116 - RNA, 15 nt, Homo sapiens
uggccagcacucuga

SEQ ID NO: 1226117 - RNA, 17 nt, Homo sapiens
uggccagccagugccau

SEQ ID NO: 1226118 - RNA, 19 nt, Homo sapiens
uggccagcccggcugguuu

SEQ ID NO: 1226119 - RNA, 14 nt, Homo sapiens
uggccagcccuucc

SEQ ID NO: 1226120 - RNA, 21 nt, Homo sapiens
uggccaggccucuuggcaguc

SEQ ID NO: 1226121 - RNA, 23 nt, Homo sapiens
uggccaggcuggucuaaaacucc

SEQ ID NO: 1226122 - RNA, 17 nt, Homo sapiens
uggccagugugauccca

SEQ ID NO: 1226123 - RNA, 13 nt, Homo sapiens
uggccaguucauu

SEQ ID NO: 1226124 - RNA, 22 nt, Homo sapiens
uggccaguugcccagagcacuu

SEQ ID NO: 1226125 - RNA, 16 nt, Homo sapiens
uggccaucccugugag

SEQ ID NO: 1226126 - RNA, 17 nt, Homo sapiens
uggccaugggucccauu

SEQ ID NO: 1226127 - RNA, 17 nt, Homo sapiens
uggccauuaccaucucu

SEQ ID NO: 1226128 - RNA, 22 nt, Homo sapiens
uggcccaagugguuugugcuaa

SEQ ID NO: 1226129 - RNA, 23 nt, Homo sapiens
uggcccagcuuuuagaaaaugca

SEQ ID NO: 1226130 - RNA, 19 nt, Homo sapiens
uggcccauagaaacaugac

SEQ ID NO: 1226131 - RNA, 22 nt, Homo sapiens
uggcccauagaaacaugacacu

SEQ ID NO: 1226132 - RNA, 23 nt, Homo sapiens
uggccccucaaccuccuguggaa

SEQ ID NO: 1226133 - RNA, 13 nt, Homo sapiens
uggcccuaaagga

SEQ ID NO: 1226134 - RNA, 16 nt, Homo sapiens
uggcccucgacacuca

SEQ ID NO: 1226135 - RNA, 18 nt, Homo sapiens
uggcccugcccugaggaa

SEQ ID NO: 1226136 - RNA, 14 nt, Homo sapiens
uggcccugccucau

SEQ ID NO: 1226137 - RNA, 14 nt, Homo sapiens
uggcccuucuugcc

SEQ ID NO: 1226138 - RNA, 14 nt, Homo sapiens
uggcccuuggaaua

SEQ ID NO: 1226139 - RNA, 21 nt, Homo sapiens
uucuguuggaugacuuugaga

SEQ ID NO: 1226140 - RNA, 20 nt, Homo sapiens
uucuguuuggcacuuguauu

SEQ ID NO: 1226141 - RNA, 16 nt, Homo sapiens
uucuuaaccuuugcua

SEQ ID NO: 1226142 - RNA, 17 nt, Homo sapiens
uucuuaagggcacacac

SEQ ID NO: 1226143 - RNA, 18 nt, Homo sapiens
uucuuacacugugucauu

SEQ ID NO: 1226144 - RNA, 14 nt, Homo sapiens
uucuuacaugcauu

SEQ ID NO: 1226145 - RNA, 21 nt, Homo sapiens
uucuuagagauuaaaccaauu

SEQ ID NO: 1226146 - RNA, 13 nt, Homo sapiens
uucuuauaacaua

SEQ ID NO: 1226147 - RNA, 11 nt, Homo sapiens
uucuucagggc

SEQ ID NO: 1226148 - RNA, 14 nt, Homo sapiens
uucuucagggccag

SEQ ID NO: 1226149 - RNA, 12 nt, Homo sapiens
uucuucauuuca

SEQ ID NO: 1226150 - RNA, 23 nt, Homo sapiens
uucuucccccacuuccccuccaa

SEQ ID NO: 1226151 - RNA, 21 nt, Homo sapiens
uucuuccuuaaagcauuugca

SEQ ID NO: 1226152 - RNA, 16 nt, Homo sapiens
uucuucuguauguuag

SEQ ID NO: 1226153 - RNA, 19 nt, Homo sapiens
uucuugaguugucuuuugc

SEQ ID NO: 1226154 - RNA, 20 nt, Homo sapiens
uucuugcuuucaauuacaaa

SEQ ID NO: 1226155 - RNA, 21 nt, Homo sapiens
uucuuggagggcccacuugua

SEQ ID NO: 1226156 - RNA, 15 nt, Homo sapiens
uucuuggcccaggau

SEQ ID NO: 1226157 - RNA, 21 nt, Homo sapiens
uucuuggcccccuucccaagg

SEQ ID NO: 1226158 - RNA, 13 nt, Homo sapiens
uucuuguauucau

SEQ ID NO: 1226159 - RNA, 15 nt, Homo sapiens
ggcaagagaauuacu

SEQ ID NO: 1226160 - RNA, 21 nt, Homo sapiens
ggcaagccugucuucagagaa

SEQ ID NO: 1226161 - RNA, 14 nt, Homo sapiens
ggcaaggaugucug

SEQ ID NO: 1226162 - RNA, 18 nt, Homo sapiens
ggcaagucuagagucuca

SEQ ID NO: 1226163 - RNA, 20 nt, Homo sapiens
ggcaagucuagagucucaga

SEQ ID NO: 1226164 - RNA, 18 nt, Homo sapiens
ggcaagucuuccaugacc

SEQ ID NO: 1226165 - RNA, 19 nt, Homo sapiens
ggcaagugugggggguccu

SEQ ID NO: 1226166 - RNA, 19 nt, Homo sapiens
ggcaaucaauacagcuuca

SEQ ID NO: 1226167 - RNA, 22 nt, Homo sapiens
ggcaauuucaccaccaaaugcc

SEQ ID NO: 1226168 - RNA, 21 nt, Homo sapiens
ggcacaagguugguugcuaag

SEQ ID NO: 1226169 - RNA, 12 nt, Homo sapiens
ggcacacagcua

SEQ ID NO: 1226170 - RNA, 20 nt, Homo sapiens
ggcacagggucugcucuuuc

SEQ ID NO: 1226171 - RNA, 19 nt, Homo sapiens
ggcacaguaggaauuggaa

SEQ ID NO: 1226172 - RNA, 13 nt, Homo sapiens
ggcacaguggacu

SEQ ID NO: 1226173 - RNA, 17 nt, Homo sapiens
ggcaccaaccugcauuu

SEQ ID NO: 1226174 - RNA, 13 nt, Homo sapiens
ggcaccaacucca

SEQ ID NO: 1226175 - RNA, 23 nt, Homo sapiens
ggcaccuuaagauuuugcaccug

SEQ ID NO: 1226176 - RNA, 14 nt, Homo sapiens
ggcacucagucucu

SEQ ID NO: 1226177 - RNA, 14 nt, Homo sapiens
ggcacucccaucca

SEQ ID NO: 1226178 - RNA, 19 nt, Homo sapiens
ggcacucugugggugcuac

SEQ ID NO: 1226179 - RNA, 11 nt, Homo sapiens
ggcacugggau

SEQ ID NO: 1226180 - RNA, 13 nt, Homo sapiens
ggcacuguucaau

SEQ ID NO: 1226181 - RNA, 13 nt, Homo sapiens
ggcacuucauuga

SEQ ID NO: 1226182 - RNA, 11 nt, Homo sapiens
ggcacuuguau

SEQ ID NO: 1226183 - RNA, 18 nt, Homo sapiens
ggcacuuuaagucaguga

SEQ ID NO: 1226184 - RNA, 21 nt, Homo sapiens
ggcacuuuaagucagugacag

SEQ ID NO: 1226185 - RNA, 16 nt, Homo sapiens
ggcagaaaaaugucau

SEQ ID NO: 1226186 - RNA, 16 nt, Homo sapiens
ggcagacuuucuucuc

SEQ ID NO: 1226187 - RNA, 21 nt, Homo sapiens
ggcagagucguuggagacuga

SEQ ID NO: 1226188 - RNA, 15 nt, Homo sapiens
ggcagaucaugaagc

SEQ ID NO: 1226189 - RNA, 12 nt, Homo sapiens
ggcagauuugag

SEQ ID NO: 1226190 - RNA, 22 nt, Homo sapiens
ggcagcaaccccugcaugccau

SEQ ID NO: 1226191 - RNA, 20 nt, Homo sapiens
ggcagcagaauugcuugaac

SEQ ID NO: 1226192 - RNA, 16 nt, Homo sapiens
ggcagccacccaagcc

SEQ ID NO: 1226193 - RNA, 17 nt, Homo sapiens
ggcagccaggacaucuc

SEQ ID NO: 1226194 - RNA, 16 nt, Homo sapiens
ggcagccauagugcau

SEQ ID NO: 1226195 - RNA, 15 nt, Homo sapiens
ggcagccauggccau

SEQ ID NO: 1226196 - RNA, 14 nt, Homo sapiens
ggcagcgccaagug

SEQ ID NO: 1226197 - RNA, 15 nt, Homo sapiens
ggcagcggguggcau

SEQ ID NO: 1226198 - RNA, 14 nt, Homo sapiens
ggcagcggugggcu

SEQ ID NO: 1226199 - RNA, 14 nt, Homo sapiens
ggcagcuacucaga

SEQ ID NO: 1226200 - RNA, 17 nt, Homo sapiens
ggcagcuccagugccag

SEQ ID NO: 1226201 - RNA, 22 nt, Homo sapiens
ggcagcugccucugcucccucu

SEQ ID NO: 1226202 - RNA, 21 nt, Homo sapiens
ggcaggaggggugaguccccu

SEQ ID NO: 1226203 - RNA, 13 nt, Homo sapiens
ggcaggccagugu

SEQ ID NO: 1226204 - RNA, 21 nt, Homo sapiens
ggcaggccuggacuuccagug

SEQ ID NO: 1226205 - RNA, 18 nt, Homo sapiens
ggcaggcugggccauguc

SEQ ID NO: 1226206 - RNA, 21 nt, Homo sapiens
ggcaggcuuagagucaggcau

SEQ ID NO: 1226207 - RNA, 21 nt, Homo sapiens
ggcagggaauggggacggugu

SEQ ID NO: 1226208 - RNA, 15 nt, Homo sapiens
ggcagggagugauga

SEQ ID NO: 1226209 - RNA, 17 nt, Homo sapiens
ggcagggcccacgugua

SEQ ID NO: 1226210 - RNA, 14 nt, Homo sapiens
ggcagggucucacu

SEQ ID NO: 1226211 - RNA, 22 nt, Homo sapiens
ggcagguaggucggcacuugga

SEQ ID NO: 1226212 - RNA, 16 nt, Homo sapiens
ggcaggugucauauga

SEQ ID NO: 1226213 - RNA, 16 nt, Homo sapiens
ggcaguagaacuccag

SEQ ID NO: 1226214 - RNA, 16 nt, Homo sapiens
ggcauacagacugggg

SEQ ID NO: 1226215 - RNA, 17 nt, Homo sapiens
ggcauauccaccaccuc

SEQ ID NO: 1226216 - RNA, 18 nt, Homo sapiens
ggcaucaguagcaucugu

SEQ ID NO: 1226217 - RNA, 17 nt, Homo sapiens
ggcauccaaggcaaaca

SEQ ID NO: 1226218 - RNA, 21 nt, Homo sapiens
ggcaucuccugugcaugggug

SEQ ID NO: 1226219 - RNA, 11 nt, Homo sapiens
aaaaaaagaga

SEQ ID NO: 1226220 - RNA, 12 nt, Homo sapiens
aaaaaaauuacu

SEQ ID NO: 1226221 - RNA, 12 nt, Homo sapiens
aaaaaacagugg

SEQ ID NO: 1226222 - RNA, 12 nt, Homo sapiens
aaaaaaccacag

SEQ ID NO: 1226223 - RNA, 19 nt, Homo sapiens
aaaaaagaacaacugccaa

SEQ ID NO: 1226224 - RNA, 21 nt, Homo sapiens
aaaaaaugauaaggcucugaa

SEQ ID NO: 1226225 - RNA, 17 nt, Homo sapiens
aaaaaauuaauacugaa

SEQ ID NO: 1226226 - RNA, 12 nt, Homo sapiens
aaaaaccaauga

SEQ ID NO: 1226227 - RNA, 14 nt, Homo sapiens
aaaaaccagccacu

SEQ ID NO: 1226228 - RNA, 23 nt, Homo sapiens
aaaaaccucuaugcaaucugagu

SEQ ID NO: 1226229 - RNA, 13 nt, Homo sapiens
aaaaacucuucag

SEQ ID NO: 1226230 - RNA, 13 nt, Homo sapiens
aaaaagaaaugca

SEQ ID NO: 1226231 - RNA, 14 nt, Homo sapiens
aaaaagaaccaaaa

SEQ ID NO: 1226232 - RNA, 21 nt, Homo sapiens
aaaaagauucucaucacucaa

SEQ ID NO: 1226233 - RNA, 14 nt, Homo sapiens
aaaaagcauuauua

SEQ ID NO: 1226234 - RNA, 16 nt, Homo sapiens
aaaaagccacaaugaa

SEQ ID NO: 1226235 - RNA, 15 nt, Homo sapiens
aaaaagccugucauu

SEQ ID NO: 1226236 - RNA, 14 nt, Homo sapiens
aaaaaggccaaaga

SEQ ID NO: 1226237 - RNA, 21 nt, Homo sapiens
aaaaagucaccaaauagugug

SEQ ID NO: 1226238 - RNA, 16 nt, Homo sapiens
aaaaauaaaaaagauc

SEQ ID NO: 1226239 - RNA, 14 nt, Homo sapiens
aaaaauaaagggaa

SEQ ID NO: 1226240 - RNA, 15 nt, Homo sapiens
aaaaauaaaguacca

SEQ ID NO: 1226241 - RNA, 18 nt, Homo sapiens
aaaaauaaaucuguucug

SEQ ID NO: 1226242 - RNA, 12 nt, Homo sapiens
aaaaauaaugug

SEQ ID NO: 1226243 - RNA, 13 nt, Homo sapiens
aaaaauaaugugc

SEQ ID NO: 1226244 - RNA, 12 nt, Homo sapiens
aaaaauacaugu

SEQ ID NO: 1226245 - RNA, 21 nt, Homo sapiens
aaaaauauauaugcauaccug

SEQ ID NO: 1226246 - RNA, 21 nt, Homo sapiens
aaaaauauguugaguguucau

SEQ ID NO: 1226247 - RNA, 20 nt, Homo sapiens
aaaaauauuugcugagugaa

SEQ ID NO: 1226248 - RNA, 17 nt, Homo sapiens
aaaaaucagcuggguac

SEQ ID NO: 1226249 - RNA, 24 nt, Homo sapiens
aaaaauccgcuuuucugccacaga

SEQ ID NO: 1226250 - RNA, 17 nt, Homo sapiens
aaaaaucuuuucauuaa

SEQ ID NO: 1226251 - RNA, 14 nt, Homo sapiens
aaaaaugacuaaaa

SEQ ID NO: 1226252 - RNA, 17 nt, Homo sapiens
aaaaaugaugggacaau

SEQ ID NO: 1226253 - RNA, 20 nt, Homo sapiens
aaaaaugcaagccaucucua

SEQ ID NO: 1226254 - RNA, 11 nt, Homo sapiens
aaaaaugcacc

SEQ ID NO: 1226255 - RNA, 18 nt, Homo sapiens
aaaaaugcccauuugccu

SEQ ID NO: 1226256 - RNA, 13 nt, Homo sapiens
aaaaaugcugcuc

SEQ ID NO: 1226257 - RNA, 14 nt, Homo sapiens
aaaaaugcugcuuc

SEQ ID NO: 1226258 - RNA, 16 nt, Homo sapiens
aaaaaugcugcuucuc

SEQ ID NO: 1226259 - RNA, 15 nt, Homo sapiens
aaaaaugggaaaaau

SEQ ID NO: 1226260 - RNA, 14 nt, Homo sapiens
aaaaaugggaacau

SEQ ID NO: 1226261 - RNA, 19 nt, Homo sapiens
aaaaaugggaacauacaga

SEQ ID NO: 1226262 - RNA, 15 nt, Homo sapiens
aaaaaugucaucuca

SEQ ID NO: 1226263 - RNA, 12 nt, Homo sapiens
aaaaauguucuu

SEQ ID NO: 1226264 - RNA, 16 nt, Homo sapiens
aaaaauguuugucuca

SEQ ID NO: 1226265 - RNA, 16 nt, Homo sapiens
aaaaauugagacauuu

SEQ ID NO: 1226266 - RNA, 18 nt, Homo sapiens
aaaaauugcucuguguau

SEQ ID NO: 1226267 - RNA, 20 nt, Homo sapiens
aaaacaaagaaauaaugguc

SEQ ID NO: 1226268 - RNA, 13 nt, Homo sapiens
aaaacaaauucau

SEQ ID NO: 1226269 - RNA, 19 nt, Homo sapiens
aaaacaacuuggcauuucu

SEQ ID NO: 1226270 - RNA, 20 nt, Homo sapiens
aaaacaaguuuagaaagcug

SEQ ID NO: 1226271 - RNA, 14 nt, Homo sapiens
aaaacaauacucaa

SEQ ID NO: 1226272 - RNA, 17 nt, Homo sapiens
aaaacaauucugugaca

SEQ ID NO: 1226273 - RNA, 13 nt, Homo sapiens
aaaacacacauac

SEQ ID NO: 1226274 - RNA, 19 nt, Homo sapiens
aaaacaccgcuucugccuu

SEQ ID NO: 1226275 - RNA, 17 nt, Homo sapiens
aaaacaccuagcuuuau

SEQ ID NO: 1226276 - RNA, 12 nt, Homo sapiens
aaaacacugugu

SEQ ID NO: 1226277 - RNA, 13 nt, Homo sapiens
aaaacagaaagca

SEQ ID NO: 1226278 - RNA, 20 nt, Homo sapiens
aaaacagggugggcaaacuc

SEQ ID NO: 1226279 - RNA, 20 nt, Homo sapiens
aaaacauaugaccauugagu

SEQ ID NO: 1226280 - RNA, 10 nt, Homo sapiens
aaaacaugca

SEQ ID NO: 1226281 - RNA, 12 nt, Homo sapiens
aaaacauguaug

SEQ ID NO: 1226282 - RNA, 22 nt, Homo sapiens
aaaaccacugggaggagucuau

SEQ ID NO: 1226283 - RNA, 14 nt, Homo sapiens
aaaaccauguugau

SEQ ID NO: 1226284 - RNA, 22 nt, Homo sapiens
aaaaccugaagacugaggacaa

SEQ ID NO: 1226285 - RNA, 23 nt, Homo sapiens
aaaaccugaagacugaggacaaa

SEQ ID NO: 1226286 - RNA, 18 nt, Homo sapiens
aaaaccuucaagaucuca

SEQ ID NO: 1226287 - RNA, 19 nt, Homo sapiens
aaaaccuuguaaaaaaagc

SEQ ID NO: 1226288 - RNA, 21 nt, Homo sapiens
aaaacgaugaaguuaugcugu

SEQ ID NO: 1226289 - RNA, 15 nt, Homo sapiens
aaaacuaaccaucug

SEQ ID NO: 1226290 - RNA, 17 nt, Homo sapiens
aaaacuaaccaucugaa

SEQ ID NO: 1226291 - RNA, 14 nt, Homo sapiens
aaaacuaccacaug

SEQ ID NO: 1226292 - RNA, 20 nt, Homo sapiens
aaaacuauauucauuuccac

SEQ ID NO: 1226293 - RNA, 14 nt, Homo sapiens
aaaacucaacauua

SEQ ID NO: 1226294 - RNA, 14 nt, Homo sapiens
aaaacucacuguga

SEQ ID NO: 1226295 - RNA, 21 nt, Homo sapiens
aaaacuccacagucaauauua

SEQ ID NO: 1226296 - RNA, 21 nt, Homo sapiens
aaaacucucugguuuacuuca

SEQ ID NO: 1226297 - RNA, 21 nt, Homo sapiens
aaaacucuucagugcaaauug

SEQ ID NO: 1226298 - RNA, 15 nt, Homo sapiens
aaaacugaaccacaa

SEQ ID NO: 1226299 - RNA, 20 nt, Homo sapiens
aaaacugauuuuuagcuuua

SEQ ID NO: 1226300 - RNA, 21 nt, Homo sapiens
aaaacugcuuacuuaugccau

SEQ ID NO: 1226301 - RNA, 15 nt, Homo sapiens
aaaacuggacaguca

SEQ ID NO: 1226302 - RNA, 18 nt, Homo sapiens
aaaacuggcuacugcucu

SEQ ID NO: 1226303 - RNA, 15 nt, Homo sapiens
aaaacugugccuugu

SEQ ID NO: 1226304 - RNA, 16 nt, Homo sapiens
aaaacuuaugaccucu

SEQ ID NO: 1226305 - RNA, 15 nt, Homo sapiens
aaaacuucaaagcug

SEQ ID NO: 1226306 - RNA, 22 nt, Homo sapiens
aaaacuugauguguuaucucuu

SEQ ID NO: 1226307 - RNA, 15 nt, Homo sapiens
aaaacuuuaaggaag

SEQ ID NO: 1226308 - RNA, 20 nt, Homo sapiens
aaaacuuuccugacuuacaa

SEQ ID NO: 1226309 - RNA, 17 nt, Homo sapiens
aaaagaacaacugccaa

SEQ ID NO: 1226310 - RNA, 21 nt, Homo sapiens
aaaagaagacaacauuucuca

SEQ ID NO: 1226311 - RNA, 15 nt, Homo sapiens
aaaagaaugacuaua

SEQ ID NO: 1226312 - RNA, 18 nt, Homo sapiens
aaaagacaacauaacuca

SEQ ID NO: 1226313 - RNA, 16 nt, Homo sapiens
aaaagacauucuucca

SEQ ID NO: 1226314 - RNA, 19 nt, Homo sapiens
aaaagcaagggaccuucau

SEQ ID NO: 1226315 - RNA, 11 nt, Homo sapiens
aaaagcagcuc

SEQ ID NO: 1226316 - RNA, 12 nt, Homo sapiens
aaaagcagcuca

SEQ ID NO: 1226317 - RNA, 17 nt, Homo sapiens
aaaagcauaaggccgga

SEQ ID NO: 1226318 - RNA, 15 nt, Homo sapiens
aaaagccacaaugaa

SEQ ID NO: 1226319 - RNA, 13 nt, Homo sapiens
aaaagccagccag

SEQ ID NO: 1226320 - RNA, 18 nt, Homo sapiens
aaaagccauaacuugaaa

SEQ ID NO: 1226321 - RNA, 16 nt, Homo sapiens
aaaagccuuuuccaga

SEQ ID NO: 1226322 - RNA, 16 nt, Homo sapiens
aaaagcgacccauuca

SEQ ID NO: 1226323 - RNA, 23 nt, Homo sapiens
aaaagcugaucauaagugaauuu

SEQ ID NO: 1226324 - RNA, 21 nt, Homo sapiens
aaaaggaaacuguacuacauc

SEQ ID NO: 1226325 - RNA, 20 nt, Homo sapiens
aaaaggaaagcuguguuuau

SEQ ID NO: 1226326 - RNA, 13 nt, Homo sapiens
aaaaggaaauuug

SEQ ID NO: 1226327 - RNA, 22 nt, Homo sapiens
aaaaggacucugcuucagucca

SEQ ID NO: 1226328 - RNA, 14 nt, Homo sapiens
aaaaggcagaguac

SEQ ID NO: 1226329 - RNA, 16 nt, Homo sapiens
aaaagggaaguaagca

SEQ ID NO: 1226330 - RNA, 18 nt, Homo sapiens
aaaagggaaguugugccu

SEQ ID NO: 1226331 - RNA, 18 nt, Homo sapiens
aaaagggcagggcaucuc

SEQ ID NO: 1226332 - RNA, 20 nt, Homo sapiens
aaaaggucauagcugagauu

SEQ ID NO: 1226333 - RNA, 20 nt, Homo sapiens
aaaaggucuguuaaugucau

SEQ ID NO: 1226334 - RNA, 17 nt, Homo sapiens
aaaaguaaggugcaguu

SEQ ID NO: 1226335 - RNA, 18 nt, Homo sapiens
aaaaguaaguaccacuca

SEQ ID NO: 1226336 - RNA, 22 nt, Homo sapiens
aaaaguaaguaccacucaggcc

SEQ ID NO: 1226337 - RNA, 22 nt, Homo sapiens
aaaaguaaugaagaaaauugag

SEQ ID NO: 1226338 - RNA, 13 nt, Homo sapiens
aaaagucaaguuu

SEQ ID NO: 1226339 - RNA, 18 nt, Homo sapiens
aaaagucguuuuccaaac

SEQ ID NO: 1226340 - RNA, 13 nt, Homo sapiens
aaaagucuucacu

SEQ ID NO: 1226341 - RNA, 14 nt, Homo sapiens
aaaagucuucacuc

SEQ ID NO: 1226342 - RNA, 13 nt, Homo sapiens
aaaaguuacuuau

SEQ ID NO: 1226343 - RNA, 11 nt, Homo sapiens
aaaaguuauua

SEQ ID NO: 1226344 - RNA, 16 nt, Homo sapiens
aaaaguuauugugaua

SEQ ID NO: 1226345 - RNA, 19 nt, Homo sapiens
aaaaguuguucaacuauuu

SEQ ID NO: 1226346 - RNA, 22 nt, Homo sapiens
aaaauaaaaaagaucuccaagc

SEQ ID NO: 1226347 - RNA, 17 nt, Homo sapiens
aaaauaaaacugucacu

SEQ ID NO: 1226348 - RNA, 13 nt, Homo sapiens
aaaauaaaccaaa

SEQ ID NO: 1226349 - RNA, 15 nt, Homo sapiens
aaaauaaaccaaaua

SEQ ID NO: 1226350 - RNA, 22 nt, Homo sapiens
aaaauaaauauaucuaccccag

SEQ ID NO: 1226351 - RNA, 17 nt, Homo sapiens
aaaauaacugaaccaaa

SEQ ID NO: 1226352 - RNA, 18 nt, Homo sapiens
aaaauaagcacugugcua

SEQ ID NO: 1226353 - RNA, 12 nt, Homo sapiens
aaaauaaucaug

SEQ ID NO: 1226354 - RNA, 13 nt, Homo sapiens
aaaauacacuaau

SEQ ID NO: 1226355 - RNA, 17 nt, Homo sapiens
aaaauacauaucgcuga

SEQ ID NO: 1226356 - RNA, 17 nt, Homo sapiens
aaaauacaugcaucuca

SEQ ID NO: 1226357 - RNA, 21 nt, Homo sapiens
aaaauacggacguacuuugug

SEQ ID NO: 1226358 - RNA, 16 nt, Homo sapiens
aaaauagaaacuugcu

SEQ ID NO: 1226359 - RNA, 22 nt, Homo sapiens
aaaauaguuuggauuacuuaaa

SEQ ID NO: 1226360 - RNA, 20 nt, Homo sapiens
aaaauauacuggggcuuccu

SEQ ID NO: 1226361 - RNA, 22 nt, Homo sapiens
aaaauaucagacaagcacuauu

SEQ ID NO: 1226362 - RNA, 10 nt, Homo sapiens
aaaauaugcc

SEQ ID NO: 1226363 - RNA, 21 nt, Homo sapiens
aaaauaugggaaagacaugca

SEQ ID NO: 1226364 - RNA, 13 nt, Homo sapiens
aaaauauugcuuc

SEQ ID NO: 1226365 - RNA, 15 nt, Homo sapiens
aaaauauuguuucug

SEQ ID NO: 1226366 - RNA, 21 nt, Homo sapiens
aaaauauuuccugacuugagu

SEQ ID NO: 1226367 - RNA, 15 nt, Homo sapiens
aaaaucacacugucu

SEQ ID NO: 1226368 - RNA, 18 nt, Homo sapiens
aaaaucacaggacauuaa

SEQ ID NO: 1226369 - RNA, 15 nt, Homo sapiens
aaaaucacaucucca

SEQ ID NO: 1226370 - RNA, 19 nt, Homo sapiens
aaaaucagagucuauaaca

SEQ ID NO: 1226371 - RNA, 16 nt, Homo sapiens
aaaauccaauaaucag

SEQ ID NO: 1226372 - RNA, 11 nt, Homo sapiens
aaaauccauuu

SEQ ID NO: 1226373 - RNA, 14 nt, Homo sapiens
aaaaucguuuugcc

SEQ ID NO: 1226374 - RNA, 21 nt, Homo sapiens
aaaaucucccagugacaacau

SEQ ID NO: 1226375 - RNA, 22 nt, Homo sapiens
aaaaucugcucuuuguaugaca

SEQ ID NO: 1226376 - RNA, 16 nt, Homo sapiens
aaaaucuguguaacug

SEQ ID NO: 1226377 - RNA, 16 nt, Homo sapiens
aaaaucuuggaaguac

SEQ ID NO: 1226378 - RNA, 12 nt, Homo sapiens
aaaaucuuggau

SEQ ID NO: 1226379 - RNA, 17 nt, Homo sapiens
aaaaucuugugcuagaa

SEQ ID NO: 1226380 - RNA, 19 nt, Homo sapiens
aaaaugaaaaacaaccaag

SEQ ID NO: 1226381 - RNA, 20 nt, Homo sapiens
aaaaugaaaggaaguuucag

SEQ ID NO: 1226382 - RNA, 24 nt, Homo sapiens
aaaaugaacugaaguuucacauga

SEQ ID NO: 1226383 - RNA, 17 nt, Homo sapiens
aaaaugaaucuucacaa

SEQ ID NO: 1226384 - RNA, 17 nt, Homo sapiens
aaaaugacaaugaugau

SEQ ID NO: 1226385 - RNA, 18 nt, Homo sapiens
aaaaugaugggacaauaa

SEQ ID NO: 1226386 - RNA, 14 nt, Homo sapiens
aaaaugcaaaagca

SEQ ID NO: 1226387 - RNA, 17 nt, Homo sapiens
aaaaugcaaaagcacau

SEQ ID NO: 1226388 - RNA, 21 nt, Homo sapiens
aaaaugcaauuggcauuaaca

SEQ ID NO: 1226389 - RNA, 17 nt, Homo sapiens
aaaaugcaccacuuuuu

SEQ ID NO: 1226390 - RNA, 14 nt, Homo sapiens
aaaaugcaguaaca

SEQ ID NO: 1226391 - RNA, 17 nt, Homo sapiens
aaaaugcaguccugagg

SEQ ID NO: 1226392 - RNA, 19 nt, Homo sapiens
aaaaugcaguccugaggag

SEQ ID NO: 1226393 - RNA, 13 nt, Homo sapiens
aaaaugcugcuuc

SEQ ID NO: 1226394 - RNA, 22 nt, Homo sapiens
aaaauggcaucaaccaccaugg

SEQ ID NO: 1226395 - RNA, 16 nt, Homo sapiens
aaaauggccauuugcu

SEQ ID NO: 1226396 - RNA, 22 nt, Homo sapiens
aaaauggucauccaaacucaaa

SEQ ID NO: 1226397 - RNA, 22 nt, Homo sapiens
aaaauguaacaucauaauuaca

SEQ ID NO: 1226398 - RNA, 13 nt, Homo sapiens
aaaauguacucag

SEQ ID NO: 1226399 - RNA, 14 nt, Homo sapiens
aaaauguacucagc

SEQ ID NO: 1226400 - RNA, 14 nt, Homo sapiens
aaaaugucaucuca

SEQ ID NO: 1226401 - RNA, 15 nt, Homo sapiens
aaaauguccugccuu

SEQ ID NO: 1226402 - RNA, 20 nt, Homo sapiens
aaaaugucuguuaacuuaau

SEQ ID NO: 1226403 - RNA, 17 nt, Homo sapiens
aaaaugugauguucuaa

SEQ ID NO: 1226404 - RNA, 18 nt, Homo sapiens
aaaauguguccuaucuau

SEQ ID NO: 1226405 - RNA, 22 nt, Homo sapiens
aaaauguguuccauugccauag

SEQ ID NO: 1226406 - RNA, 17 nt, Homo sapiens
aaaauguugaaccaaac

SEQ ID NO: 1226407 - RNA, 19 nt, Homo sapiens
aaaauuaaacaaauaugca

SEQ ID NO: 1226408 - RNA, 13 nt, Homo sapiens
aaaauuacaaaga

SEQ ID NO: 1226409 - RNA, 16 nt, Homo sapiens
aaaauuagacugugau

SEQ ID NO: 1226410 - RNA, 18 nt, Homo sapiens
aaaauuauuauaagcauu

SEQ ID NO: 1226411 - RNA, 14 nt, Homo sapiens
aaaauucagaugcu

SEQ ID NO: 1226412 - RNA, 20 nt, Homo sapiens
aaaauucuauuacaguaugu

SEQ ID NO: 1226413 - RNA, 21 nt, Homo sapiens
aaaauucuauuacaguauguc

SEQ ID NO: 1226414 - RNA, 17 nt, Homo sapiens
aaaauucuuaaguaugu

SEQ ID NO: 1226415 - RNA, 15 nt, Homo sapiens
aaaauugacaaugau

SEQ ID NO: 1226416 - RNA, 11 nt, Homo sapiens
aaaauugcucc

SEQ ID NO: 1226417 - RNA, 20 nt, Homo sapiens
aaaauuuaaaggguguacuu

SEQ ID NO: 1226418 - RNA, 15 nt, Homo sapiens
aaaauuuaaaucaua

SEQ ID NO: 1226419 - RNA, 21 nt, Homo sapiens
aaaauuuacaauuugacauac

SEQ ID NO: 1226420 - RNA, 12 nt, Homo sapiens
aaaauuuauuuc

SEQ ID NO: 1226421 - RNA, 17 nt, Homo sapiens
aaaauuucauagcugua

SEQ ID NO: 1226422 - RNA, 18 nt, Homo sapiens
aaaauuugaaauuuagcu

SEQ ID NO: 1226423 - RNA, 18 nt, Homo sapiens
aaaauuuguuuugacgga

SEQ ID NO: 1226424 - RNA, 17 nt, Homo sapiens
aaacaaaacaccaggga

SEQ ID NO: 1226425 - RNA, 13 nt, Homo sapiens
aaacaaauucauu

SEQ ID NO: 1226426 - RNA, 20 nt, Homo sapiens
aaacaacagcucgauccaaa

SEQ ID NO: 1226427 - RNA, 17 nt, Homo sapiens
aaacaacuuggcauuuc

SEQ ID NO: 1226428 - RNA, 23 nt, Homo sapiens
aaacaacuuucuccuacucuucc

SEQ ID NO: 1226429 - RNA, 19 nt, Homo sapiens
aaacaagaggacuguguug

SEQ ID NO: 1226430 - RNA, 19 nt, Homo sapiens
aaacaaguuuuucugucaa

SEQ ID NO: 1226431 - RNA, 20 nt, Homo sapiens
aaacaauggccugguucaau

SEQ ID NO: 1226432 - RNA, 15 nt, Homo sapiens
aaacaauucugugac

SEQ ID NO: 1226433 - RNA, 15 nt, Homo sapiens
aaacacacagucaca

SEQ ID NO: 1226434 - RNA, 16 nt, Homo sapiens
aaacacaugccuuaaa

SEQ ID NO: 1226435 - RNA, 20 nt, Homo sapiens
aaacacccuuucaucucaga

SEQ ID NO: 1226436 - RNA, 22 nt, Homo sapiens
aaacaccuagcuuuauucuuca

SEQ ID NO: 1226437 - RNA, 14 nt, Homo sapiens
aaacaccuccucau

SEQ ID NO: 1226438 - RNA, 21 nt, Homo sapiens
aaacaccuuaagaagucuaua

SEQ ID NO: 1226439 - RNA, 18 nt, Homo sapiens
aaacacuggcucugggac

SEQ ID NO: 1226440 - RNA, 19 nt, Homo sapiens
aaacacugggggcaccuua

SEQ ID NO: 1226441 - RNA, 15 nt, Homo sapiens
aaacacuggugccaa

SEQ ID NO: 1226442 - RNA, 22 nt, Homo sapiens
aaacacuuugccuccuguguac

SEQ ID NO: 1226443 - RNA, 16 nt, Homo sapiens
aaacagaacaggguca

SEQ ID NO: 1226444 - RNA, 23 nt, Homo sapiens
aaacagaacugcagucagcauga

SEQ ID NO: 1226445 - RNA, 22 nt, Homo sapiens
aaacagagacaggcccaagaga

SEQ ID NO: 1226446 - RNA, 16 nt, Homo sapiens
aaacagaugaugagaa

SEQ ID NO: 1226447 - RNA, 20 nt, Homo sapiens
aaacagcagauuucagauca

SEQ ID NO: 1226448 - RNA, 14 nt, Homo sapiens
aaacagcaguccca

SEQ ID NO: 1226449 - RNA, 20 nt, Homo sapiens
aaacagccaagauuuuccuc

SEQ ID NO: 1226450 - RNA, 10 nt, Homo sapiens
aaacagccac

SEQ ID NO: 1226451 - RNA, 16 nt, Homo sapiens
aaacaggaccacaaaa

SEQ ID NO: 1226452 - RNA, 15 nt, Homo sapiens
aaacagggugggcaa

SEQ ID NO: 1226453 - RNA, 18 nt, Homo sapiens
aaacagguauauacuuug

SEQ ID NO: 1226454 - RNA, 19 nt, Homo sapiens
aaacaguccaaacuguucu

SEQ ID NO: 1226455 - RNA, 14 nt, Homo sapiens
aaacagugugcaug

SEQ ID NO: 1226456 - RNA, 16 nt, Homo sapiens
aaacauacgacuuauu

SEQ ID NO: 1226457 - RNA, 13 nt, Homo sapiens
aaacauacguucu

SEQ ID NO: 1226458 - RNA, 15 nt, Homo sapiens
aaacaugcaguacuu

SEQ ID NO: 1226459 - RNA, 24 nt, Homo sapiens
aaacaugcuaaauaguucuaucag

SEQ ID NO: 1226460 - RNA, 19 nt, Homo sapiens
aaacauguuaaugacaaua

SEQ ID NO: 1226461 - RNA, 17 nt, Homo sapiens
aaacauucaaagagaca

SEQ ID NO: 1226462 - RNA, 11 nt, Homo sapiens
aaacauuccaa

SEQ ID NO: 1226463 - RNA, 12 nt, Homo sapiens
aaacauuccaag

SEQ ID NO: 1226464 - RNA, 18 nt, Homo sapiens
aaacauuccccuccccac

SEQ ID NO: 1226465 - RNA, 18 nt, Homo sapiens
aaacauucugauuuggaa

SEQ ID NO: 1226466 - RNA, 15 nt, Homo sapiens
aaaccaauucaccaa

SEQ ID NO: 1226467 - RNA, 21 nt, Homo sapiens
aaaccacaacugacacaggaa

SEQ ID NO: 1226468 - RNA, 15 nt, Homo sapiens
aaaccagaaaagcaa

SEQ ID NO: 1226469 - RNA, 16 nt, Homo sapiens
aaaccaggauuuccuu

SEQ ID NO: 1226470 - RNA, 22 nt, Homo sapiens
aaaccauaaaacccuauacaag

SEQ ID NO: 1226471 - RNA, 18 nt, Homo sapiens
aaaccaucaaaaauauuc

SEQ ID NO: 1226472 - RNA, 14 nt, Homo sapiens
aaaccaucuggccu

SEQ ID NO: 1226473 - RNA, 15 nt, Homo sapiens
aaaccaugagaauuu

SEQ ID NO: 1226474 - RNA, 13 nt, Homo sapiens
aaacccaauccaa

SEQ ID NO: 1226475 - RNA, 17 nt, Homo sapiens
aaacccaauucagucuc

SEQ ID NO: 1226476 - RNA, 13 nt, Homo sapiens
aaacccacaguuu

SEQ ID NO: 1226477 - RNA, 21 nt, Homo sapiens
aaacccaccaaucuacuuugu

SEQ ID NO: 1226478 - RNA, 17 nt, Homo sapiens
aaacccagucucagaca

SEQ ID NO: 1226479 - RNA, 19 nt, Homo sapiens
aaacccauucccucuccag

SEQ ID NO: 1226480 - RNA, 12 nt, Homo sapiens
aaacccauuuug

SEQ ID NO: 1226481 - RNA, 19 nt, Homo sapiens
aaaccccaucucuacuaaa

SEQ ID NO: 1226482 - RNA, 20 nt, Homo sapiens
aaacccccacccuucugccu

SEQ ID NO: 1226483 - RNA, 18 nt, Homo sapiens
aaacccuagaccauguca

SEQ ID NO: 1226484 - RNA, 13 nt, Homo sapiens
aaaccuaccaaaa

SEQ ID NO: 1226485 - RNA, 15 nt, Homo sapiens
aaaccuaguacugcc

SEQ ID NO: 1226486 - RNA, 13 nt, Homo sapiens
aaaccuccacugc

SEQ ID NO: 1226487 - RNA, 12 nt, Homo sapiens
aaaccucugccu

SEQ ID NO: 1226488 - RNA, 21 nt, Homo sapiens
aaaccugaccccugcucagua

SEQ ID NO: 1226489 - RNA, 19 nt, Homo sapiens
aaaccuguucaucuugcca

SEQ ID NO: 1226490 - RNA, 21 nt, Homo sapiens
aaaccuugcuaauuuucucaa

SEQ ID NO: 1226491 - RNA, 22 nt, Homo sapiens
aaacgauaaaauguggauuaaa

SEQ ID NO: 1226492 - RNA, 22 nt, Homo sapiens
aaacgauucugagccauucaca

SEQ ID NO: 1226493 - RNA, 22 nt, Homo sapiens
aaacgccccgggcaaagggucu

SEQ ID NO: 1226494 - RNA, 19 nt, Homo sapiens
aaacgucuucuaaacuucc

SEQ ID NO: 1226495 - RNA, 20 nt, Homo sapiens
aaacgucuucuaaacuuccc

SEQ ID NO: 1226496 - RNA, 21 nt, Homo sapiens
aaacuaaaggugcacugcuuu

SEQ ID NO: 1226497 - RNA, 16 nt, Homo sapiens
aaacuaaaucucuaau

SEQ ID NO: 1226498 - RNA, 14 nt, Homo sapiens
aaacuauauucuca

SEQ ID NO: 1226499 - RNA, 17 nt, Homo sapiens
aaacuaucuguauuuau

SEQ ID NO: 1226500 - RNA, 16 nt, Homo sapiens
aaacucauuuuugcca

SEQ ID NO: 1226501 - RNA, 19 nt, Homo sapiens
aaacuccacaucugccuua

SEQ ID NO: 1226502 - RNA, 13 nt, Homo sapiens
aaacuccaucuca

SEQ ID NO: 1226503 - RNA, 20 nt, Homo sapiens
aaacuccugaccucagguga

SEQ ID NO: 1226504 - RNA, 18 nt, Homo sapiens
aaacuccugggcucaggc

SEQ ID NO: 1226505 - RNA, 18 nt, Homo sapiens
aaacuccuuaacuucagg

SEQ ID NO: 1226506 - RNA, 14 nt, Homo sapiens
aaacugaaccacaa

SEQ ID NO: 1226507 - RNA, 21 nt, Homo sapiens
aaacugacaguaaaucucaca

SEQ ID NO: 1226508 - RNA, 21 nt, Homo sapiens
aaacugaggaauuucaccugu

SEQ ID NO: 1226509 - RNA, 14 nt, Homo sapiens
aaacugcugugaau

SEQ ID NO: 1226510 - RNA, 17 nt, Homo sapiens
aaacugcuuacuuaugc

SEQ ID NO: 1226511 - RNA, 23 nt, Homo sapiens
aaacugcuuuuuuuuuuccagca

SEQ ID NO: 1226512 - RNA, 16 nt, Homo sapiens
aaacuggagaugcauc

SEQ ID NO: 1226513 - RNA, 22 nt, Homo sapiens
aaacuggcugcuuuguucaaug

SEQ ID NO: 1226514 - RNA, 14 nt, Homo sapiens
aaacuguacuacau

SEQ ID NO: 1226515 - RNA, 22 nt, Homo sapiens
aaacugucucccccauugcucu

SEQ ID NO: 1226516 - RNA, 16 nt, Homo sapiens
aaacuguuaucacuua

SEQ ID NO: 1226517 - RNA, 23 nt, Homo sapiens
aaacuguucuuuugcauuuugcc

SEQ ID NO: 1226518 - RNA, 15 nt, Homo sapiens
aaacuuaacauucau

SEQ ID NO: 1226519 - RNA, 22 nt, Homo sapiens
aaacuuaucacgccuacuuaag

SEQ ID NO: 1226520 - RNA, 13 nt, Homo sapiens
aaacuucagggau

SEQ ID NO: 1226521 - RNA, 23 nt, Homo sapiens
aaacuugaaguagguagcaacgu

SEQ ID NO: 1226522 - RNA, 23 nt, Homo sapiens
aaacuuggcucgaaucucugugc

SEQ ID NO: 1226523 - RNA, 20 nt, Homo sapiens
aaacuugugaaugcuucuca

SEQ ID NO: 1226524 - RNA, 22 nt, Homo sapiens
aaacuuguuagaucaaccucca

SEQ ID NO: 1226525 - RNA, 17 nt, Homo sapiens
aaacuuuaagaacaaac

SEQ ID NO: 1226526 - RNA, 23 nt, Homo sapiens
aaacuuuaggguaaaaauugcca

SEQ ID NO: 1226527 - RNA, 22 nt, Homo sapiens
aaacuuuauuuguaaaccauug

SEQ ID NO: 1226528 - RNA, 17 nt, Homo sapiens
aaacuuuggcuuauaaa

SEQ ID NO: 1226529 - RNA, 16 nt, Homo sapiens
aaacuuuuaacugaga

SEQ ID NO: 1226530 - RNA, 17 nt, Homo sapiens
aaacuuuucugcugaua

SEQ ID NO: 1226531 - RNA, 20 nt, Homo sapiens
aaagaaauccauaucuuaaa

SEQ ID NO: 1226532 - RNA, 16 nt, Homo sapiens
aaagaaaucuugucuu

SEQ ID NO: 1226533 - RNA, 18 nt, Homo sapiens
aaagaagcaaucuccuua

SEQ ID NO: 1226534 - RNA, 21 nt, Homo sapiens
aaagaagcaaucuccuuacug

SEQ ID NO: 1226535 - RNA, 17 nt, Homo sapiens
aaagaagccucagcucc

SEQ ID NO: 1226536 - RNA, 23 nt, Homo sapiens
aaagaaggcauuugcaggguccu

SEQ ID NO: 1226537 - RNA, 18 nt, Homo sapiens
aaagaagggggcuuucuu

SEQ ID NO: 1226538 - RNA, 15 nt, Homo sapiens
aaagaagugaaacua

SEQ ID NO: 1226539 - RNA, 14 nt, Homo sapiens
aaagaauaguagua

SEQ ID NO: 1226540 - RNA, 14 nt, Homo sapiens
aaagaauccauaaa

SEQ ID NO: 1226541 - RNA, 17 nt, Homo sapiens
aaagaauugcacguaug

SEQ ID NO: 1226542 - RNA, 15 nt, Homo sapiens
aaagaauuguuguaa

SEQ ID NO: 1226543 - RNA, 13 nt, Homo sapiens
aaagaauuugcac

SEQ ID NO: 1226544 - RNA, 13 nt, Homo sapiens
aaagacaccauuu

SEQ ID NO: 1226545 - RNA, 19 nt, Homo sapiens
aaagacauucuuccaaaaa

SEQ ID NO: 1226546 - RNA, 14 nt, Homo sapiens
aaagaccuugcuua

SEQ ID NO: 1226547 - RNA, 22 nt, Homo sapiens
aaagaccuuuuccaugcacccu

SEQ ID NO: 1226548 - RNA, 21 nt, Homo sapiens
aaagacguucuuuugcauaaa

SEQ ID NO: 1226549 - RNA, 20 nt, Homo sapiens
aaagacugauuuugcuuuuu

SEQ ID NO: 1226550 - RNA, 14 nt, Homo sapiens
aaagacugcauuua

SEQ ID NO: 1226551 - RNA, 15 nt, Homo sapiens
aaagacuguacuggc

SEQ ID NO: 1226552 - RNA, 11 nt, Homo sapiens
aaagacuguag

SEQ ID NO: 1226553 - RNA, 14 nt, Homo sapiens
aaagacuguagaag

SEQ ID NO: 1226554 - RNA, 22 nt, Homo sapiens
aaagacuuuuuuuuaacacuuu

SEQ ID NO: 1226555 - RNA, 14 nt, Homo sapiens
aaagagaaacuuug

SEQ ID NO: 1226556 - RNA, 15 nt, Homo sapiens
aaagagaacaccucc

SEQ ID NO: 1226557 - RNA, 16 nt, Homo sapiens
aaagagagaagccagc

SEQ ID NO: 1226558 - RNA, 20 nt, Homo sapiens
aaagagagcaggacucacag

SEQ ID NO: 1226559 - RNA, 19 nt, Homo sapiens
aaagagagucgcaucucag

SEQ ID NO: 1226560 - RNA, 22 nt, Homo sapiens
aaagagaguggaaauuacccac

SEQ ID NO: 1226561 - RNA, 19 nt, Homo sapiens
aaagagauuagaacauuua

SEQ ID NO: 1226562 - RNA, 18 nt, Homo sapiens
aaagagcuuugugauaua

SEQ ID NO: 1226563 - RNA, 17 nt, Homo sapiens
aaagagggcuuccucua

SEQ ID NO: 1226564 - RNA, 14 nt, Homo sapiens
aaagauacggccca

SEQ ID NO: 1226565 - RNA, 16 nt, Homo sapiens
aaagauagacaucaga

SEQ ID NO: 1226566 - RNA, 16 nt, Homo sapiens
aaagauaucagagcuc

SEQ ID NO: 1226567 - RNA, 16 nt, Homo sapiens
aaagaucaccagccau

SEQ ID NO: 1226568 - RNA, 23 nt, Homo sapiens
aaagauccccaaaacaggccagg

SEQ ID NO: 1226569 - RNA, 21 nt, Homo sapiens
aaagaucuuucaggacucuac

SEQ ID NO: 1226570 - RNA, 20 nt, Homo sapiens
aaagaugcagccgccuuccu

SEQ ID NO: 1226571 - RNA, 23 nt, Homo sapiens
aaagauggccauauuaccccuuu

SEQ ID NO: 1226572 - RNA, 14 nt, Homo sapiens
aaagauuaaaugug

SEQ ID NO: 1226573 - RNA, 19 nt, Homo sapiens
aaagauuaaaugugucauu

SEQ ID NO: 1226574 - RNA, 20 nt, Homo sapiens
aaagauugauuaaugaacua

SEQ ID NO: 1226575 - RNA, 19 nt, Homo sapiens
aaagauugauuuguguguu

SEQ ID NO: 1226576 - RNA, 18 nt, Homo sapiens
aaagauugcagcauuuau

SEQ ID NO: 1226577 - RNA, 14 nt, Homo sapiens
aaagauuguacuua

SEQ ID NO: 1226578 - RNA, 19 nt, Homo sapiens
aaagcaaacuuaagaaaca

SEQ ID NO: 1226579 - RNA, 15 nt, Homo sapiens
aaagcaacaucuuca

SEQ ID NO: 1226580 - RNA, 16 nt, Homo sapiens
aaagcaaugugguagu

SEQ ID NO: 1226581 - RNA, 22 nt, Homo sapiens
aaagcacuccugcuuaaucuuc

SEQ ID NO: 1226582 - RNA, 11 nt, Homo sapiens
aaagcacugac

SEQ ID NO: 1226583 - RNA, 16 nt, Homo sapiens
aaagcagcucaagaac

SEQ ID NO: 1226584 - RNA, 22 nt, Homo sapiens
aaagcaguuacuaauaugccua

SEQ ID NO: 1226585 - RNA, 17 nt, Homo sapiens
aaagcauaacaaaaaga

SEQ ID NO: 1226586 - RNA, 13 nt, Homo sapiens
aaagcaucaccuc

SEQ ID NO: 1226587 - RNA, 16 nt, Homo sapiens
aaagcaucaccucagg

SEQ ID NO: 1226588 - RNA, 22 nt, Homo sapiens
aaagcauccauguguggacuca

SEQ ID NO: 1226589 - RNA, 13 nt, Homo sapiens
aaagcaugucuca

SEQ ID NO: 1226590 - RNA, 20 nt, Homo sapiens
aaagcauguggcauguucau

SEQ ID NO: 1226591 - RNA, 18 nt, Homo sapiens
aaagcauuugcaacagcu

SEQ ID NO: 1226592 - RNA, 19 nt, Homo sapiens
aaagccaauaaaugaacug

SEQ ID NO: 1226593 - RNA, 16 nt, Homo sapiens
aaagccauaacuugaa

SEQ ID NO: 1226594 - RNA, 12 nt, Homo sapiens
aaagcccagacu

SEQ ID NO: 1226595 - RNA, 17 nt, Homo sapiens
aaagcccagacuuuagu

SEQ ID NO: 1226596 - RNA, 15 nt, Homo sapiens
aaagcccgccugaca

SEQ ID NO: 1226597 - RNA, 20 nt, Homo sapiens
aaagcccugguaaaagggau

SEQ ID NO: 1226598 - RNA, 16 nt, Homo sapiens
aaagccucgggccaca

SEQ ID NO: 1226599 - RNA, 17 nt, Homo sapiens
aaagccucuucaaaaag

SEQ ID NO: 1226600 - RNA, 16 nt, Homo sapiens
aaagccugcaauuuca

SEQ ID NO: 1226601 - RNA, 22 nt, Homo sapiens
aaagccuugugugaacucacca

SEQ ID NO: 1226602 - RNA, 19 nt, Homo sapiens
aaagcuaaauguacauguu

SEQ ID NO: 1226603 - RNA, 21 nt, Homo sapiens
aaagcuacuauguacugccuu

SEQ ID NO: 1226604 - RNA, 19 nt, Homo sapiens
aaagcuaguguaccuccuc

SEQ ID NO: 1226605 - RNA, 16 nt, Homo sapiens
aaagcucauaauggaa

SEQ ID NO: 1226606 - RNA, 22 nt, Homo sapiens
aaagcucaugcauuucaagcag

SEQ ID NO: 1226607 - RNA, 20 nt, Homo sapiens
aaagcucuauuaagauuucc

SEQ ID NO: 1226608 - RNA, 14 nt, Homo sapiens
aaagcucuguugca

SEQ ID NO: 1226609 - RNA, 20 nt, Homo sapiens
aaagcugagaacuccugacu

SEQ ID NO: 1226610 - RNA, 23 nt, Homo sapiens
aaagcugagaagaaugaaaaugc

SEQ ID NO: 1226611 - RNA, 17 nt, Homo sapiens
aaagcugaggacagggu

SEQ ID NO: 1226612 - RNA, 17 nt, Homo sapiens
aaagcugaguguuucac

SEQ ID NO: 1226613 - RNA, 18 nt, Homo sapiens
aaagcugaguguuucaca

SEQ ID NO: 1226614 - RNA, 11 nt, Homo sapiens
aaagcugccau

SEQ ID NO: 1226615 - RNA, 23 nt, Homo sapiens
aaagcuguaagaaaaugcuguca

SEQ ID NO: 1226616 - RNA, 18 nt, Homo sapiens
aaagcuucuaucccagga

SEQ ID NO: 1226617 - RNA, 17 nt, Homo sapiens
aaaggaaaaauaaucaa

SEQ ID NO: 1226618 - RNA, 15 nt, Homo sapiens
aaaggaaaccaagug

SEQ ID NO: 1226619 - RNA, 16 nt, Homo sapiens
aaaggaagacagauuu

SEQ ID NO: 1226620 - RNA, 20 nt, Homo sapiens
aaaggaagcuccacugucac

SEQ ID NO: 1226621 - RNA, 21 nt, Homo sapiens
aaaggacaccuuuuaacucac

SEQ ID NO: 1226622 - RNA, 19 nt, Homo sapiens
aaaggacagaguaugaaca

SEQ ID NO: 1226623 - RNA, 15 nt, Homo sapiens
aaaggacaggccaca

SEQ ID NO: 1226624 - RNA, 22 nt, Homo sapiens
aaaggacucugcuucaguccac

SEQ ID NO: 1226625 - RNA, 18 nt, Homo sapiens
aaaggagaacuauccaaa

SEQ ID NO: 1226626 - RNA, 22 nt, Homo sapiens
aaaggagacaaguuccauggga

SEQ ID NO: 1226627 - RNA, 12 nt, Homo sapiens
aaaggagcugcu

SEQ ID NO: 1226628 - RNA, 12 nt, Homo sapiens
aaaggagggaga

SEQ ID NO: 1226629 - RNA, 13 nt, Homo sapiens
aaaggaggggaua

SEQ ID NO: 1226630 - RNA, 13 nt, Homo sapiens
aaaggcagcugcc

SEQ ID NO: 1226631 - RNA, 23 nt, Homo sapiens
aaaggcagcugccucugcucccu

SEQ ID NO: 1226632 - RNA, 13 nt, Homo sapiens
aaaggcagguggg

SEQ ID NO: 1226633 - RNA, 22 nt, Homo sapiens
aaaggccauuaaagcucaaggu

SEQ ID NO: 1226634 - RNA, 15 nt, Homo sapiens
aaaggcccucaguga

SEQ ID NO: 1226635 - RNA, 15 nt, Homo sapiens
aaaggccucuuguaa

SEQ ID NO: 1226636 - RNA, 19 nt, Homo sapiens
aaaggcgguacuaguucag

SEQ ID NO: 1226637 - RNA, 16 nt, Homo sapiens
aaaggcuaaaagggaa

SEQ ID NO: 1226638 - RNA, 20 nt, Homo sapiens
aaaggggcccaagccccauc

SEQ ID NO: 1226639 - RNA, 11 nt, Homo sapiens
aaaggguccca

SEQ ID NO: 1226640 - RNA, 22 nt, Homo sapiens
aaaggguugggagcugaugaaa

SEQ ID NO: 1226641 - RNA, 14 nt, Homo sapiens
aaaggucuguuaau

SEQ ID NO: 1226642 - RNA, 16 nt, Homo sapiens
aaaggugacaguauua

SEQ ID NO: 1226643 - RNA, 13 nt, Homo sapiens
aaagguucacagg

SEQ ID NO: 1226644 - RNA, 13 nt, Homo sapiens
aaagguucuucau

SEQ ID NO: 1226645 - RNA, 22 nt, Homo sapiens
aaagguugacaauaaaugugcu

SEQ ID NO: 1226646 - RNA, 16 nt, Homo sapiens
aaagguugagauguaa

SEQ ID NO: 1226647 - RNA, 22 nt, Homo sapiens
aaagguuucauguucacuguga

SEQ ID NO: 1226648 - RNA, 23 nt, Homo sapiens
aaagguuucauguucacugugag

SEQ ID NO: 1226649 - RNA, 22 nt, Homo sapiens
aaagguuuuaaccgcacaugca

SEQ ID NO: 1226650 - RNA, 16 nt, Homo sapiens
aaagguuuuacuauua

SEQ ID NO: 1226651 - RNA, 13 nt, Homo sapiens
aaaguaaggugca

SEQ ID NO: 1226652 - RNA, 18 nt, Homo sapiens
aaaguaauaaaugaguuc

SEQ ID NO: 1226653 - RNA, 20 nt, Homo sapiens
aaaguaccacacauauugca

SEQ ID NO: 1226654 - RNA, 12 nt, Homo sapiens
aaaguagcaauu

SEQ ID NO: 1226655 - RNA, 13 nt, Homo sapiens
aaaguagccacgu

SEQ ID NO: 1226656 - RNA, 17 nt, Homo sapiens
aaaguagggaccucaga

SEQ ID NO: 1226657 - RNA, 12 nt, Homo sapiens
aaaguagggaug

SEQ ID NO: 1226658 - RNA, 21 nt, Homo sapiens
aaaguaucccggaagcucaca

SEQ ID NO: 1226659 - RNA, 21 nt, Homo sapiens
aaagucaccacuccauuccca

SEQ ID NO: 1226660 - RNA, 17 nt, Homo sapiens
acauuccaggaaaccau

SEQ ID NO: 1226661 - RNA, 15 nt, Homo sapiens
acauuccugcauuca

SEQ ID NO: 1226662 - RNA, 19 nt, Homo sapiens
acauucuggaaaagcaaaa

SEQ ID NO: 1226663 - RNA, 21 nt, Homo sapiens
acauucuuguuuuaagugccu

SEQ ID NO: 1226664 - RNA, 22 nt, Homo sapiens
acauucuuguuuuaagugccuu

SEQ ID NO: 1226665 - RNA, 15 nt, Homo sapiens
acauucuuuuccacu

SEQ ID NO: 1226666 - RNA, 19 nt, Homo sapiens
acauugaaagagaaccagu

SEQ ID NO: 1226667 - RNA, 20 nt, Homo sapiens
acauugaccaagaacugcau

SEQ ID NO: 1226668 - RNA, 19 nt, Homo sapiens
acauugagaucacuacuca

SEQ ID NO: 1226669 - RNA, 13 nt, Homo sapiens
acauugagguucc

SEQ ID NO: 1226670 - RNA, 22 nt, Homo sapiens
acauugcuuccuaaacuuucaa

SEQ ID NO: 1226671 - RNA, 16 nt, Homo sapiens
acauugcuugugccac

SEQ ID NO: 1226672 - RNA, 17 nt, Homo sapiens
acauuggagcugacugu

SEQ ID NO: 1226673 - RNA, 16 nt, Homo sapiens
acauugggagucugua

SEQ ID NO: 1226674 - RNA, 13 nt, Homo sapiens
acauugugaaaag

SEQ ID NO: 1226675 - RNA, 18 nt, Homo sapiens
acauugugaaaaggcaaa

SEQ ID NO: 1226676 - RNA, 20 nt, Homo sapiens
acauugugggauguucagca

SEQ ID NO: 1226677 - RNA, 23 nt, Homo sapiens
acauuguguucccauuucagcug

SEQ ID NO: 1226678 - RNA, 18 nt, Homo sapiens
acauuuagcuuguucaca

SEQ ID NO: 1226679 - RNA, 13 nt, Homo sapiens
acauuuaucacug

SEQ ID NO: 1226680 - RNA, 18 nt, Homo sapiens
acauuuauccaagaccug

SEQ ID NO: 1226681 - RNA, 22 nt, Homo sapiens
acauuucauugucuuagucaaa

SEQ ID NO: 1226682 - RNA, 17 nt, Homo sapiens
acauuucuaugccaaac

SEQ ID NO: 1226683 - RNA, 22 nt, Homo sapiens
acauuucucauaccuuccccac

SEQ ID NO: 1226684 - RNA, 21 nt, Homo sapiens
acauuucucuaacuccugcca

SEQ ID NO: 1226685 - RNA, 22 nt, Homo sapiens
acauuucuguucucauuugauc

SEQ ID NO: 1226686 - RNA, 16 nt, Homo sapiens
acauuucuucuaguga

SEQ ID NO: 1226687 - RNA, 15 nt, Homo sapiens
acauuugcuacuguu

SEQ ID NO: 1226688 - RNA, 14 nt, Homo sapiens
acauuuggcauuug

SEQ ID NO: 1226689 - RNA, 13 nt, Homo sapiens
acauuugggagac

SEQ ID NO: 1226690 - RNA, 21 nt, Homo sapiens
acauuuggugagagaaguaca

SEQ ID NO: 1226691 - RNA, 13 nt, Homo sapiens
acauuuggugggc

SEQ ID NO: 1226692 - RNA, 19 nt, Homo sapiens
acauuugguuucugaauaa

SEQ ID NO: 1226693 - RNA, 16 nt, Homo sapiens
acauuuguaaaucuau

SEQ ID NO: 1226694 - RNA, 12 nt, Homo sapiens
acauuugugcuc

SEQ ID NO: 1226695 - RNA, 20 nt, Homo sapiens
acauuuuaauuuuaguuuca

SEQ ID NO: 1226696 - RNA, 21 nt, Homo sapiens
acauuuuaauuuuaguuucau

SEQ ID NO: 1226697 - RNA, 23 nt, Homo sapiens
acauuuuaauuuuaguuucauga

SEQ ID NO: 1226698 - RNA, 16 nt, Homo sapiens
acauuuucauaucauc

SEQ ID NO: 1226699 - RNA, 16 nt, Homo sapiens
acauuuugacacaaaa

SEQ ID NO: 1226700 - RNA, 14 nt, Homo sapiens
acauuuuguuauag

SEQ ID NO: 1226701 - RNA, 21 nt, Homo sapiens
acauuuuuuaugggcauugac

SEQ ID NO: 1226702 - RNA, 16 nt, Homo sapiens
acauuuuuuuguucuc

SEQ ID NO: 1226703 - RNA, 13 nt, Homo sapiens
accaaaaccacag

SEQ ID NO: 1226704 - RNA, 16 nt, Homo sapiens
accaaaaccacagugc

SEQ ID NO: 1226705 - RNA, 15 nt, Homo sapiens
accaaaauccgacug

SEQ ID NO: 1226706 - RNA, 14 nt, Homo sapiens
accaaagacaucag

SEQ ID NO: 1226707 - RNA, 16 nt, Homo sapiens
accaaagacaucaguc

SEQ ID NO: 1226708 - RNA, 16 nt, Homo sapiens
accaaagagggcuucc

SEQ ID NO: 1226709 - RNA, 12 nt, Homo sapiens
accaaagcagaa

SEQ ID NO: 1226710 - RNA, 15 nt, Homo sapiens
accaaagcugcccac

SEQ ID NO: 1226711 - RNA, 16 nt, Homo sapiens
accaaagcugcccacu

SEQ ID NO: 1226712 - RNA, 21 nt, Homo sapiens
accaaaggacauuaugugugc

SEQ ID NO: 1226713 - RNA, 18 nt, Homo sapiens
accaaaggauagugcgau

SEQ ID NO: 1226714 - RNA, 17 nt, Homo sapiens
accaaaucugacauauu

SEQ ID NO: 1226715 - RNA, 19 nt, Homo sapiens
accaaaucuggaagccaaa

SEQ ID NO: 1226716 - RNA, 15 nt, Homo sapiens
accaacacugcucac

SEQ ID NO: 1226717 - RNA, 15 nt, Homo sapiens
accaaccacagcauc

SEQ ID NO: 1226718 - RNA, 15 nt, Homo sapiens
accaacccucagagc

SEQ ID NO: 1226719 - RNA, 23 nt, Homo sapiens
accaaccuuccauucacaccagc

SEQ ID NO: 1226720 - RNA, 17 nt, Homo sapiens
accaacuggagcacuga

SEQ ID NO: 1226721 - RNA, 15 nt, Homo sapiens
accaacuuuacuguc

SEQ ID NO: 1226722 - RNA, 15 nt, Homo sapiens
accaagacucugaaa

SEQ ID NO: 1226723 - RNA, 21 nt, Homo sapiens
accaagccucccacacugaaa

SEQ ID NO: 1226724 - RNA, 20 nt, Homo sapiens
accaaggcaaacccuagauu

SEQ ID NO: 1226725 - RNA, 16 nt, Homo sapiens
accaagggcaccugga

SEQ ID NO: 1226726 - RNA, 23 nt, Homo sapiens
accaaggggugggccacagccau

SEQ ID NO: 1226727 - RNA, 19 nt, Homo sapiens
accaagucggaacagcaga

SEQ ID NO: 1226728 - RNA, 19 nt, Homo sapiens
accaauagggcugagcucu

SEQ ID NO: 1226729 - RNA, 17 nt, Homo sapiens
accaaugauucauaaca

SEQ ID NO: 1226730 - RNA, 20 nt, Homo sapiens
accaauuccugacacuugau

SEQ ID NO: 1226731 - RNA, 14 nt, Homo sapiens
accacaaacaauuc

SEQ ID NO: 1226732 - RNA, 22 nt, Homo sapiens
accacaaagcacaguuugaaca

SEQ ID NO: 1226733 - RNA, 15 nt, Homo sapiens
accacaacugacaca

SEQ ID NO: 1226734 - RNA, 21 nt, Homo sapiens
accacaagggcucucuuaggc

SEQ ID NO: 1226735 - RNA, 22 nt, Homo sapiens
accacaagggcucucuuaggca

SEQ ID NO: 1226736 - RNA, 10 nt, Homo sapiens
accacacagu

SEQ ID NO: 1226737 - RNA, 21 nt, Homo sapiens
accacaccuggcccuugcaau

SEQ ID NO: 1226738 - RNA, 20 nt, Homo sapiens
accacagagcugucacuuuu

SEQ ID NO: 1226739 - RNA, 13 nt, Homo sapiens
accacagcugcag

SEQ ID NO: 1226740 - RNA, 13 nt, Homo sapiens
accacagggccag

SEQ ID NO: 1226741 - RNA, 14 nt, Homo sapiens
accacagggccaga

SEQ ID NO: 1226742 - RNA, 22 nt, Homo sapiens
accacagugaauccagaccaac

SEQ ID NO: 1226743 - RNA, 13 nt, Homo sapiens
accacagugucug

SEQ ID NO: 1226744 - RNA, 13 nt, Homo sapiens
accacaucugcca

SEQ ID NO: 1226745 - RNA, 14 nt, Homo sapiens
accacaucugccag

SEQ ID NO: 1226746 - RNA, 15 nt, Homo sapiens
accacaugugcacau

SEQ ID NO: 1226747 - RNA, 17 nt, Homo sapiens
accacauugagaucacu

SEQ ID NO: 1226748 - RNA, 16 nt, Homo sapiens
accacccuagucccuu

SEQ ID NO: 1226749 - RNA, 14 nt, Homo sapiens
accaccuaauauca

SEQ ID NO: 1226750 - RNA, 15 nt, Homo sapiens
accaccuaauaucaa

SEQ ID NO: 1226751 - RNA, 15 nt, Homo sapiens
accaccucaccaguu

SEQ ID NO: 1226752 - RNA, 13 nt, Homo sapiens
accaccucagaaa

SEQ ID NO: 1226753 - RNA, 19 nt, Homo sapiens
accaccucccucaccaaca

SEQ ID NO: 1226754 - RNA, 20 nt, Homo sapiens
accacgaggaaaagaacaaa

SEQ ID NO: 1226755 - RNA, 21 nt, Homo sapiens
accacguugcugccugugaau

SEQ ID NO: 1226756 - RNA, 15 nt, Homo sapiens
accacuaacuccuga

SEQ ID NO: 1226757 - RNA, 23 nt, Homo sapiens
accacuacaugcagcccaugccc

SEQ ID NO: 1226758 - RNA, 15 nt, Homo sapiens
accacucccaccaca

SEQ ID NO: 1226759 - RNA, 20 nt, Homo sapiens
accacucgaggccugcaaac

SEQ ID NO: 1226760 - RNA, 12 nt, Homo sapiens
accacucugucu

SEQ ID NO: 1226761 - RNA, 17 nt, Homo sapiens
accacugcacuccaguc

SEQ ID NO: 1226762 - RNA, 14 nt, Homo sapiens
accacuuaccucaa

SEQ ID NO: 1226763 - RNA, 12 nt, Homo sapiens
accacuuccagg

SEQ ID NO: 1226764 - RNA, 17 nt, Homo sapiens
accacuucgaaaccugg

SEQ ID NO: 1226765 - RNA, 16 nt, Homo sapiens
accagaaaagcaauac

SEQ ID NO: 1226766 - RNA, 17 nt, Homo sapiens
accagaaaagcaauacu

SEQ ID NO: 1226767 - RNA, 13 nt, Homo sapiens
accagaaguggac

SEQ ID NO: 1226768 - RNA, 13 nt, Homo sapiens
accagacacugcc

SEQ ID NO: 1226769 - RNA, 17 nt, Homo sapiens
accagacagcacagggc

SEQ ID NO: 1226770 - RNA, 14 nt, Homo sapiens
accagagcauuucc

SEQ ID NO: 1226771 - RNA, 18 nt, Homo sapiens
accagagcccacuuccau

SEQ ID NO: 1226772 - RNA, 13 nt, Homo sapiens
accagagcugccg

SEQ ID NO: 1226773 - RNA, 17 nt, Homo sapiens
accagaucugucuccaa

SEQ ID NO: 1226774 - RNA, 18 nt, Homo sapiens
accagaugcuacuggacu

SEQ ID NO: 1226775 - RNA, 20 nt, Homo sapiens
accagaugucgcccuacuca

SEQ ID NO: 1226776 - RNA, 12 nt, Homo sapiens
accagauuugcu

SEQ ID NO: 1226777 - RNA, 20 nt, Homo sapiens
accagcagaaaaccuguuca

SEQ ID NO: 1226778 - RNA, 20 nt, Homo sapiens
accagcccugaccccagugu

SEQ ID NO: 1226779 - RNA, 17 nt, Homo sapiens
accagccguauuuuaca

SEQ ID NO: 1226780 - RNA, 20 nt, Homo sapiens
accagccguauuuuacauga

SEQ ID NO: 1226781 - RNA, 16 nt, Homo sapiens
accaggacuagggcug

SEQ ID NO: 1226782 - RNA, 20 nt, Homo sapiens
accaggacucccuccucacc

SEQ ID NO: 1226783 - RNA, 16 nt, Homo sapiens
accaggagacagacag

SEQ ID NO: 1226784 - RNA, 15 nt, Homo sapiens
accaggaggacaaga

SEQ ID NO: 1226785 - RNA, 21 nt, Homo sapiens
accaggcucuuccccugcucc

SEQ ID NO: 1226786 - RNA, 11 nt, Homo sapiens
accagggaugg

SEQ ID NO: 1226787 - RNA, 22 nt, Homo sapiens
accaguaucgcucauagaucag

SEQ ID NO: 1226788 - RNA, 22 nt, Homo sapiens
accaguccuguuugcagggaag

SEQ ID NO: 1226789 - RNA, 13 nt, Homo sapiens
accaguguagccu

SEQ ID NO: 1226790 - RNA, 21 nt, Homo sapiens
accaguguuauuaaugacaaa

SEQ ID NO: 1226791 - RNA, 17 nt, Homo sapiens
accaguuaaaagcauuu

SEQ ID NO: 1226792 - RNA, 19 nt, Homo sapiens
accaguuaaaagcauuuua

SEQ ID NO: 1226793 - RNA, 19 nt, Homo sapiens
accaguugggagcacugga

SEQ ID NO: 1226794 - RNA, 21 nt, Homo sapiens
accauaagggacugugccaga

SEQ ID NO: 1226795 - RNA, 15 nt, Homo sapiens
accauacaauuucau

SEQ ID NO: 1226796 - RNA, 22 nt, Homo sapiens
accauauagagguguaacacuu

SEQ ID NO: 1226797 - RNA, 16 nt, Homo sapiens
accauaugaacauaua

SEQ ID NO: 1226798 - RNA, 23 nt, Homo sapiens
accauauugugcuucacaguaga

SEQ ID NO: 1226799 - RNA, 17 nt, Homo sapiens
accauauuuuuuguaaa

SEQ ID NO: 1226800 - RNA, 17 nt, Homo sapiens
accaucagggacaggau

SEQ ID NO: 1226801 - RNA, 16 nt, Homo sapiens
accaucccugccacau

SEQ ID NO: 1226802 - RNA, 21 nt, Homo sapiens
accauccuggcuaacacguga

SEQ ID NO: 1226803 - RNA, 14 nt, Homo sapiens
accauccuguauuc

SEQ ID NO: 1226804 - RNA, 21 nt, Homo sapiens
accaucugaagaaacuuccca

SEQ ID NO: 1226805 - RNA, 16 nt, Homo sapiens
accaugaaauauccag

SEQ ID NO: 1226806 - RNA, 14 nt, Homo sapiens
accaugacugugac

SEQ ID NO: 1226807 - RNA, 13 nt, Homo sapiens
accaugagcucac

SEQ ID NO: 1226808 - RNA, 12 nt, Homo sapiens
accaugcauggu

SEQ ID NO: 1226809 - RNA, 18 nt, Homo sapiens
accauggcacugacaaug

SEQ ID NO: 1226810 - RNA, 13 nt, Homo sapiens
accauguacauaa

SEQ ID NO: 1226811 - RNA, 23 nt, Homo sapiens
accauguacauaauucuugcuau

SEQ ID NO: 1226812 - RNA, 18 nt, Homo sapiens
accaugugccaucuguac

SEQ ID NO: 1226813 - RNA, 20 nt, Homo sapiens
accauguucauuauaaucuc

SEQ ID NO: 1226814 - RNA, 13 nt, Homo sapiens
accauuaccaaaa

SEQ ID NO: 1226815 - RNA, 12 nt, Homo sapiens
accauuagcaua

SEQ ID NO: 1226816 - RNA, 22 nt, Homo sapiens
accauuccauuuccaagcacuu

SEQ ID NO: 1226817 - RNA, 12 nt, Homo sapiens
accauuugcacu

SEQ ID NO: 1226818 - RNA, 21 nt, Homo sapiens
accauuuggucaggauuccug

SEQ ID NO: 1226819 - RNA, 21 nt, Homo sapiens
accauuuuauagacuaccaau

SEQ ID NO: 1226820 - RNA, 21 nt, Homo sapiens
accauuuugggguacccacug

SEQ ID NO: 1226821 - RNA, 11 nt, Homo sapiens
acccaaaacac

SEQ ID NO: 1226822 - RNA, 22 nt, Homo sapiens
acccaaaacacaggaagucagu

SEQ ID NO: 1226823 - RNA, 23 nt, Homo sapiens
acccaaaacacgcacacccugcc

SEQ ID NO: 1226824 - RNA, 13 nt, Homo sapiens
acccaagggcaga

SEQ ID NO: 1226825 - RNA, 16 nt, Homo sapiens
acccaaucagaugccu

SEQ ID NO: 1226826 - RNA, 20 nt, Homo sapiens
acccacaaauaaaugacaag

SEQ ID NO: 1226827 - RNA, 17 nt, Homo sapiens
acccacaccgucuuccu

SEQ ID NO: 1226828 - RNA, 12 nt, Homo sapiens
acccacagaugu

SEQ ID NO: 1226829 - RNA, 21 nt, Homo sapiens
acccacaugugacacauaugc

SEQ ID NO: 1226830 - RNA, 16 nt, Homo sapiens
acccaccaucaugucu

SEQ ID NO: 1226831 - RNA, 11 nt, Homo sapiens
acccaccauug

SEQ ID NO: 1226832 - RNA, 23 nt, Homo sapiens
acccacccccaugcacucaaaga

SEQ ID NO: 1226833 - RNA, 16 nt, Homo sapiens
acccacccugugccau

SEQ ID NO: 1226834 - RNA, 21 nt, Homo sapiens
acccacgaggauggccuggaa

SEQ ID NO: 1226835 - RNA, 17 nt, Homo sapiens
acccagacaaccaaaac

SEQ ID NO: 1226836 - RNA, 16 nt, Homo sapiens
acccagaguggcccaa

SEQ ID NO: 1226837 - RNA, 18 nt, Homo sapiens
acccagcagugucacucu

SEQ ID NO: 1226838 - RNA, 15 nt, Homo sapiens
acccagcaucuccca

SEQ ID NO: 1226839 - RNA, 21 nt, Homo sapiens
acccagcccuuguuagauuca

SEQ ID NO: 1226840 - RNA, 21 nt, Homo sapiens
acccagcuacucuguccaggc

SEQ ID NO: 1226841 - RNA, 15 nt, Homo sapiens
acccagcuccagggg

SEQ ID NO: 1226842 - RNA, 15 nt, Homo sapiens
acccaggacagccac

SEQ ID NO: 1226843 - RNA, 21 nt, Homo sapiens
acccaggauucccccaacaca

SEQ ID NO: 1226844 - RNA, 15 nt, Homo sapiens
acccaggucuuccag

SEQ ID NO: 1226845 - RNA, 17 nt, Homo sapiens
acccaguggacucuucc

SEQ ID NO: 1226846 - RNA, 14 nt, Homo sapiens
acccaguucaguga

SEQ ID NO: 1226847 - RNA, 14 nt, Homo sapiens
acccauauuacaga

SEQ ID NO: 1226848 - RNA, 19 nt, Homo sapiens
acccaucaaaagcaccagc

SEQ ID NO: 1226849 - RNA, 21 nt, Homo sapiens
acccauccgguuugccauguu

SEQ ID NO: 1226850 - RNA, 19 nt, Homo sapiens
acccaucuaguacuugaaa

SEQ ID NO: 1226851 - RNA, 13 nt, Homo sapiens
acccaugacuuua

SEQ ID NO: 1226852 - RNA, 18 nt, Homo sapiens
acccaugagauucauuca

SEQ ID NO: 1226853 - RNA, 20 nt, Homo sapiens
acccauucguggugaucaau

SEQ ID NO: 1226854 - RNA, 16 nt, Homo sapiens
accccaacccaauaaa

SEQ ID NO: 1226855 - RNA, 12 nt, Homo sapiens
accccaaccuca

SEQ ID NO: 1226856 - RNA, 17 nt, Homo sapiens
accccacagacacuuac

SEQ ID NO: 1226857 - RNA, 16 nt, Homo sapiens
accccaccagcaauac

SEQ ID NO: 1226858 - RNA, 13 nt, Homo sapiens
accccaccuugcc

SEQ ID NO: 1226859 - RNA, 21 nt, Homo sapiens
accccaggcaaggaugucuga

SEQ ID NO: 1226860 - RNA, 19 nt, Homo sapiens
accccagucccagcuaacu

SEQ ID NO: 1226861 - RNA, 17 nt, Homo sapiens
accccaguggauucuca

SEQ ID NO: 1226862 - RNA, 17 nt, Homo sapiens
accccauuucuacuaaa

SEQ ID NO: 1226863 - RNA, 17 nt, Homo sapiens
accccauuuguggucac

SEQ ID NO: 1226864 - RNA, 23 nt, Homo sapiens
acccccagaccauacugacucaa

SEQ ID NO: 1226865 - RNA, 14 nt, Homo sapiens
acccccagcacuug

SEQ ID NO: 1226866 - RNA, 14 nt, Homo sapiens
acccccagcucaau

SEQ ID NO: 1226867 - RNA, 15 nt, Homo sapiens
acccccagcucaaug

SEQ ID NO: 1226868 - RNA, 20 nt, Homo sapiens
acccccagguggaaggcaga

SEQ ID NO: 1226869 - RNA, 21 nt, Homo sapiens
acccccaucaccuacuccagc

SEQ ID NO: 1226870 - RNA, 14 nt, Homo sapiens
acccccaucccucg

SEQ ID NO: 1226871 - RNA, 16 nt, Homo sapiens
acccccaucucuacua

SEQ ID NO: 1226872 - RNA, 15 nt, Homo sapiens
acccccaugcacuca

SEQ ID NO: 1226873 - RNA, 19 nt, Homo sapiens
acccccauuaaauucacuu

SEQ ID NO: 1226874 - RNA, 22 nt, Homo sapiens
acccccccucccucucucugaa

SEQ ID NO: 1226875 - RNA, 18 nt, Homo sapiens
accccccuccugcuccuc

SEQ ID NO: 1226876 - RNA, 17 nt, Homo sapiens
acccccuuccacaaugg

SEQ ID NO: 1226877 - RNA, 21 nt, Homo sapiens
accccgacaaggagacugccu

SEQ ID NO: 1226878 - RNA, 23 nt, Homo sapiens
accccgauauauuuuagcauuuu

SEQ ID NO: 1226879 - RNA, 17 nt, Homo sapiens
accccgcggugcucugg

SEQ ID NO: 1226880 - RNA, 16 nt, Homo sapiens
accccuaggaacucag

SEQ ID NO: 1226881 - RNA, 18 nt, Homo sapiens
accccucagggguuucau

SEQ ID NO: 1226882 - RNA, 12 nt, Homo sapiens
accccucuggcc

SEQ ID NO: 1226883 - RNA, 14 nt, Homo sapiens
accccugacucauc

SEQ ID NO: 1226884 - RNA, 14 nt, Homo sapiens
accccugcacaguu

SEQ ID NO: 1226885 - RNA, 23 nt, Homo sapiens
accccugucccaaccccagugga

SEQ ID NO: 1226886 - RNA, 19 nt, Homo sapiens
accccugucucccaaaaau

SEQ ID NO: 1226887 - RNA, 15 nt, Homo sapiens
accccuuagccuccc

SEQ ID NO: 1226888 - RNA, 14 nt, Homo sapiens
accccuuugcccuu

SEQ ID NO: 1226889 - RNA, 14 nt, Homo sapiens
acccgacaugugua

SEQ ID NO: 1226890 - RNA, 21 nt, Homo sapiens
acccgaccggugcaugaugcu

SEQ ID NO: 1226891 - RNA, 20 nt, Homo sapiens
acccggcugcagaggccaga

SEQ ID NO: 1226892 - RNA, 22 nt, Homo sapiens
acccgguccugcccuuccugaa

SEQ ID NO: 1226893 - RNA, 18 nt, Homo sapiens
acccguacaggcaauucc

SEQ ID NO: 1226894 - RNA, 16 nt, Homo sapiens
acccuacacccagacc

SEQ ID NO: 1226895 - RNA, 17 nt, Homo sapiens
acccuagucuuuuaaac

SEQ ID NO: 1226896 - RNA, 20 nt, Homo sapiens
acccuaguucuaccucaggc

SEQ ID NO: 1226897 - RNA, 13 nt, Homo sapiens
acccucacauggg

SEQ ID NO: 1226898 - RNA, 20 nt, Homo sapiens
acccucacccccuccuggca

SEQ ID NO: 1226899 - RNA, 15 nt, Homo sapiens
acccucacucugcca

SEQ ID NO: 1226900 - RNA, 16 nt, Homo sapiens
acccucacucugccag

SEQ ID NO: 1226901 - RNA, 19 nt, Homo sapiens
acccuccacucagcugucc

SEQ ID NO: 1226902 - RNA, 19 nt, Homo sapiens
acccucccaaaacagggaa

SEQ ID NO: 1226903 - RNA, 19 nt, Homo sapiens
acccuccccuagucacuca

SEQ ID NO: 1226904 - RNA, 20 nt, Homo sapiens
acccuccccuagucacucau

SEQ ID NO: 1226905 - RNA, 14 nt, Homo sapiens
acccuccucaagaa

SEQ ID NO: 1226906 - RNA, 15 nt, Homo sapiens
acccuccucaagaag

SEQ ID NO: 1226907 - RNA, 13 nt, Homo sapiens
acccuccugccuc

SEQ ID NO: 1226908 - RNA, 14 nt, Homo sapiens
acccuccuguaaau

SEQ ID NO: 1226909 - RNA, 18 nt, Homo sapiens
acccucgcccaacuccac

SEQ ID NO: 1226910 - RNA, 13 nt, Homo sapiens
acccucucagcuc

SEQ ID NO: 1226911 - RNA, 19 nt, Homo sapiens
acccucugggaaccuccca

SEQ ID NO: 1226912 - RNA, 16 nt, Homo sapiens
acccucuuccugugau

SEQ ID NO: 1226913 - RNA, 23 nt, Homo sapiens
acccugaagcuuaggacuaccag

SEQ ID NO: 1226914 - RNA, 18 nt, Homo sapiens
acccugagagucugagaa

SEQ ID NO: 1226915 - RNA, 18 nt, Homo sapiens
acccugccacucuugaca

SEQ ID NO: 1226916 - RNA, 16 nt, Homo sapiens
acccugcuucaaauau

SEQ ID NO: 1226917 - RNA, 21 nt, Homo sapiens
acccuggagcccauccagucu

SEQ ID NO: 1226918 - RNA, 17 nt, Homo sapiens
acccugggagacagacc

SEQ ID NO: 1226919 - RNA, 17 nt, Homo sapiens
acccuggucucaucagu

SEQ ID NO: 1226920 - RNA, 12 nt, Homo sapiens
acccuguaccuc

SEQ ID NO: 1226921 - RNA, 19 nt, Homo sapiens
acccuguagguucuugaua

SEQ ID NO: 1226922 - RNA, 19 nt, Homo sapiens
acccugucuaaaaaacaua

SEQ ID NO: 1226923 - RNA, 18 nt, Homo sapiens
acccuuagcgggacaaag

SEQ ID NO: 1226924 - RNA, 22 nt, Homo sapiens
acccuucccugcacuaaagcca

SEQ ID NO: 1226925 - RNA, 21 nt, Homo sapiens
acccuucuuuuaugagcagaa

SEQ ID NO: 1226926 - RNA, 17 nt, Homo sapiens
acccuucuuuugaagga

SEQ ID NO: 1226927 - RNA, 13 nt, Homo sapiens
acccuugaaccaa

SEQ ID NO: 1226928 - RNA, 19 nt, Homo sapiens
acccuuggagccaauggag

SEQ ID NO: 1226929 - RNA, 23 nt, Homo sapiens
acccuuuaagauauccaucuuuu

SEQ ID NO: 1226930 - RNA, 20 nt, Homo sapiens
acccuuuccggcacacugcc

SEQ ID NO: 1226931 - RNA, 14 nt, Homo sapiens
acccuuugcuguga

SEQ ID NO: 1226932 - RNA, 14 nt, Homo sapiens
accgaaaccuugcc

SEQ ID NO: 1226933 - RNA, 16 nt, Homo sapiens
accgaaaccuugccuu

SEQ ID NO: 1226934 - RNA, 22 nt, Homo sapiens
accgacuagccaggaaguacuu

SEQ ID NO: 1226935 - RNA, 13 nt, Homo sapiens
accgagacaccac

SEQ ID NO: 1226936 - RNA, 13 nt, Homo sapiens
accgagcaauuuu

SEQ ID NO: 1226937 - RNA, 16 nt, Homo sapiens
accgaggcgaugccac

SEQ ID NO: 1226938 - RNA, 17 nt, Homo sapiens
accgagucuugcucugu

SEQ ID NO: 1226939 - RNA, 17 nt, Homo sapiens
accgaugguugagggau

SEQ ID NO: 1226940 - RNA, 14 nt, Homo sapiens
accgcgacguugca

SEQ ID NO: 1226941 - RNA, 23 nt, Homo sapiens
accgcuucugccuuuucacugug

SEQ ID NO: 1226942 - RNA, 21 nt, Homo sapiens
accgcuuguggggacccaggc

SEQ ID NO: 1226943 - RNA, 19 nt, Homo sapiens
accggagaaccccaggacg

SEQ ID NO: 1226944 - RNA, 14 nt, Homo sapiens
accggcgcgcucuu

SEQ ID NO: 1226945 - RNA, 16 nt, Homo sapiens
accggcugguggagcu

SEQ ID NO: 1226946 - RNA, 19 nt, Homo sapiens
accggcugguggagcugcu

SEQ ID NO: 1226947 - RNA, 22 nt, Homo sapiens
accgggagccucccccucagau

SEQ ID NO: 1226948 - RNA, 18 nt, Homo sapiens
accggggccagcaccacu

SEQ ID NO: 1226949 - RNA, 22 nt, Homo sapiens
accggggccagcaccacuuccu

SEQ ID NO: 1226950 - RNA, 23 nt, Homo sapiens
accggggccuacuagagucugaa

SEQ ID NO: 1226951 - RNA, 22 nt, Homo sapiens
accguccucaccccuguccuca

SEQ ID NO: 1226952 - RNA, 15 nt, Homo sapiens
accgugaccaggaac

SEQ ID NO: 1226953 - RNA, 22 nt, Homo sapiens
accguggaggaggaaggcaaga

SEQ ID NO: 1226954 - RNA, 19 nt, Homo sapiens
accguuauuauaauuguau

SEQ ID NO: 1226955 - RNA, 21 nt, Homo sapiens
accguucagugucccaggcag

SEQ ID NO: 1226956 - RNA, 11 nt, Homo sapiens
accguuuccaa

SEQ ID NO: 1226957 - RNA, 22 nt, Homo sapiens
accuaaaagacagcagggacaa

SEQ ID NO: 1226958 - RNA, 16 nt, Homo sapiens
accuaaacguauuuca

SEQ ID NO: 1226959 - RNA, 20 nt, Homo sapiens
accuaaauggccucaugugg

SEQ ID NO: 1226960 - RNA, 15 nt, Homo sapiens
accuaaguacuguaa

SEQ ID NO: 1226961 - RNA, 17 nt, Homo sapiens
accuaaguacuguaaua

SEQ ID NO: 1226962 - RNA, 15 nt, Homo sapiens
accuaccacaguguc

SEQ ID NO: 1226963 - RNA, 13 nt, Homo sapiens
accuaccaucagg

SEQ ID NO: 1226964 - RNA, 13 nt, Homo sapiens
accuacgugccac

SEQ ID NO: 1226965 - RNA, 22 nt, Homo sapiens
accuacuaauccucucugcaag

SEQ ID NO: 1226966 - RNA, 21 nt, Homo sapiens
accuacuccagcucccaacuu

SEQ ID NO: 1226967 - RNA, 22 nt, Homo sapiens
accuacugauaaccacuccuaa

SEQ ID NO: 1226968 - RNA, 20 nt, Homo sapiens
accuacuuugguaguggaau

SEQ ID NO: 1226969 - RNA, 12 nt, Homo sapiens
accuacuuugua

SEQ ID NO: 1226970 - RNA, 14 nt, Homo sapiens
accuagaagaagcu

SEQ ID NO: 1226971 - RNA, 17 nt, Homo sapiens
accuagaccuaaacggc

SEQ ID NO: 1226972 - RNA, 14 nt, Homo sapiens
accuagacuguaaa

SEQ ID NO: 1226973 - RNA, 16 nt, Homo sapiens
accuagaguuuuauca

SEQ ID NO: 1226974 - RNA, 21 nt, Homo sapiens
accuagccuuagaagucacac

SEQ ID NO: 1226975 - RNA, 13 nt, Homo sapiens
accuaggauuuca

SEQ ID NO: 1226976 - RNA, 23 nt, Homo sapiens
accuaguacugccccccaugagg

SEQ ID NO: 1226977 - RNA, 16 nt, Homo sapiens
accuauaagaagccuu

SEQ ID NO: 1226978 - RNA, 14 nt, Homo sapiens
accuauaccaauau

SEQ ID NO: 1226979 - RNA, 15 nt, Homo sapiens
accuauccucacugc

SEQ ID NO: 1226980 - RNA, 19 nt, Homo sapiens
accuauggcaauuuagcuc

SEQ ID NO: 1226981 - RNA, 14 nt, Homo sapiens
accucaagcccuga

SEQ ID NO: 1226982 - RNA, 13 nt, Homo sapiens
accucacagccag

SEQ ID NO: 1226983 - RNA, 13 nt, Homo sapiens
accucaccaaaac

SEQ ID NO: 1226984 - RNA, 16 nt, Homo sapiens
accucaccaguuucca

SEQ ID NO: 1226985 - RNA, 16 nt, Homo sapiens
accucacuaugcugcu

SEQ ID NO: 1226986 - RNA, 17 nt, Homo sapiens
accucacuuuugaaucu

SEQ ID NO: 1226987 - RNA, 16 nt, Homo sapiens
accucagaaagucacc

SEQ ID NO: 1226988 - RNA, 21 nt, Homo sapiens
accucaggugauccaccugcc

SEQ ID NO: 1226989 - RNA, 22 nt, Homo sapiens
accucagugguuagaagcaugu

SEQ ID NO: 1226990 - RNA, 22 nt, Homo sapiens
accucauagcuaauuuuugcaa

SEQ ID NO: 1226991 - RNA, 17 nt, Homo sapiens
accucaucagcugccua

SEQ ID NO: 1226992 - RNA, 18 nt, Homo sapiens
accucaucagcugccuaa

SEQ ID NO: 1226993 - RNA, 21 nt, Homo sapiens
accucauuuuucauacugaaa

SEQ ID NO: 1226994 - RNA, 20 nt, Homo sapiens
accuccaccacaucugccag

SEQ ID NO: 1226995 - RNA, 19 nt, Homo sapiens
accuccagucccccuaucc

SEQ ID NO: 1226996 - RNA, 18 nt, Homo sapiens
accuccauuucucuccag

SEQ ID NO: 1226997 - RNA, 12 nt, Homo sapiens
accucccacugc

SEQ ID NO: 1226998 - RNA, 12 nt, Homo sapiens
accucccaguga

SEQ ID NO: 1226999 - RNA, 14 nt, Homo sapiens
accucccauuacuu

SEQ ID NO: 1227000 - RNA, 16 nt, Homo sapiens
accuccgccaaugcac

SEQ ID NO: 1227001 - RNA, 17 nt, Homo sapiens
accuccgccccugcccc

SEQ ID NO: 1227002 - RNA, 11 nt, Homo sapiens
accuccucaug

SEQ ID NO: 1227003 - RNA, 13 nt, Homo sapiens
accuccucauggc

SEQ ID NO: 1227004 - RNA, 17 nt, Homo sapiens
accuccuggugguacca

SEQ ID NO: 1227005 - RNA, 17 nt, Homo sapiens
accuccuguggaaccca

SEQ ID NO: 1227006 - RNA, 16 nt, Homo sapiens
accuccuucagaucuc

SEQ ID NO: 1227007 - RNA, 14 nt, Homo sapiens
accuccuuuaccag

SEQ ID NO: 1227008 - RNA, 18 nt, Homo sapiens
accuccuuuucucuuuca

SEQ ID NO: 1227009 - RNA, 20 nt, Homo sapiens
accucgugauccaccugccu

SEQ ID NO: 1227010 - RNA, 19 nt, Homo sapiens
accucuaacauccuugucu

SEQ ID NO: 1227011 - RNA, 15 nt, Homo sapiens
accucuagagucacu

SEQ ID NO: 1227012 - RNA, 13 nt, Homo sapiens
accucuaugcaau

SEQ ID NO: 1227013 - RNA, 23 nt, Homo sapiens
accucucagcagaaacacacagu

SEQ ID NO: 1227014 - RNA, 18 nt, Homo sapiens
accucucucagagcaucu

SEQ ID NO: 1227015 - RNA, 13 nt, Homo sapiens
accucucugggcc

SEQ ID NO: 1227016 - RNA, 19 nt, Homo sapiens
accucugagaagacacaag

SEQ ID NO: 1227017 - RNA, 14 nt, Homo sapiens
accucugcacuacu

SEQ ID NO: 1227018 - RNA, 20 nt, Homo sapiens
accucugccuccuaaguuca

SEQ ID NO: 1227019 - RNA, 22 nt, Homo sapiens
accucugccugaagucacacag

SEQ ID NO: 1227020 - RNA, 19 nt, Homo sapiens
accucuguauagaaaucua

SEQ ID NO: 1227021 - RNA, 16 nt, Homo sapiens
accucugugaccucag

SEQ ID NO: 1227022 - RNA, 12 nt, Homo sapiens
accucuguggac

SEQ ID NO: 1227023 - RNA, 14 nt, Homo sapiens
accucuuauugcaa

SEQ ID NO: 1227024 - RNA, 19 nt, Homo sapiens
accucuucaugagcuugaa

SEQ ID NO: 1227025 - RNA, 16 nt, Homo sapiens
accucuucccaugacu

SEQ ID NO: 1227026 - RNA, 18 nt, Homo sapiens
accucuucccaugacugc

SEQ ID NO: 1227027 - RNA, 14 nt, Homo sapiens
accucuuccuugau

SEQ ID NO: 1227028 - RNA, 15 nt, Homo sapiens
accucuugaaaauag

SEQ ID NO: 1227029 - RNA, 20 nt, Homo sapiens
accugaaaaaaaguuuacaa

SEQ ID NO: 1227030 - RNA, 14 nt, Homo sapiens
accugaaauuccaa

SEQ ID NO: 1227031 - RNA, 16 nt, Homo sapiens
accugacagcuuuauc

SEQ ID NO: 1227032 - RNA, 14 nt, Homo sapiens
accugacucuugca

SEQ ID NO: 1227033 - RNA, 15 nt, Homo sapiens
accugacucuugcag

SEQ ID NO: 1227034 - RNA, 12 nt, Homo sapiens
accugagcauga

SEQ ID NO: 1227035 - RNA, 21 nt, Homo sapiens
accugaggauaacucaauaua

SEQ ID NO: 1227036 - RNA, 20 nt, Homo sapiens
accugauggaaguaaagccu

SEQ ID NO: 1227037 - RNA, 21 nt, Homo sapiens
accugauguaccugaugcuau

SEQ ID NO: 1227038 - RNA, 20 nt, Homo sapiens
accugcagccccucaugccu

SEQ ID NO: 1227039 - RNA, 17 nt, Homo sapiens
accugcaugaacacagu

SEQ ID NO: 1227040 - RNA, 18 nt, Homo sapiens
accugcaugugcugucac

SEQ ID NO: 1227041 - RNA, 19 nt, Homo sapiens
accugccaggcaggggugg

SEQ ID NO: 1227042 - RNA, 19 nt, Homo sapiens
accugccccccagccuuca

SEQ ID NO: 1227043 - RNA, 16 nt, Homo sapiens
accugcccugggccac

SEQ ID NO: 1227044 - RNA, 17 nt, Homo sapiens
accugccgucuucacuu

SEQ ID NO: 1227045 - RNA, 23 nt, Homo sapiens
accugcugccggaagucauccca

SEQ ID NO: 1227046 - RNA, 21 nt, Homo sapiens
accugcugcguccccacuccc

SEQ ID NO: 1227047 - RNA, 16 nt, Homo sapiens
accugcuuagcugccu

SEQ ID NO: 1227048 - RNA, 17 nt, Homo sapiens
accugcuuagcugccuu

SEQ ID NO: 1227049 - RNA, 17 nt, Homo sapiens
accugcuuccugaaaua

SEQ ID NO: 1227050 - RNA, 18 nt, Homo sapiens
accugcuuccugaaauaa

SEQ ID NO: 1227051 - RNA, 20 nt, Homo sapiens
accugcuuugugagccagca

SEQ ID NO: 1227052 - RNA, 14 nt, Homo sapiens
accuggaacuggag

SEQ ID NO: 1227053 - RNA, 17 nt, Homo sapiens
accuggaaucagugaag

SEQ ID NO: 1227054 - RNA, 14 nt, Homo sapiens
accuggacugagcc

SEQ ID NO: 1227055 - RNA, 16 nt, Homo sapiens
accuggagaugcugcc

SEQ ID NO: 1227056 - RNA, 12 nt, Homo sapiens
accuggauccag

SEQ ID NO: 1227057 - RNA, 16 nt, Homo sapiens
accuggcccuugcaau

SEQ ID NO: 1227058 - RNA, 14 nt, Homo sapiens
accuggcuuuuacu

SEQ ID NO: 1227059 - RNA, 18 nt, Homo sapiens
accuggggugaauacuua

SEQ ID NO: 1227060 - RNA, 19 nt, Homo sapiens
accugguacccuccuggcu

SEQ ID NO: 1227061 - RNA, 19 nt, Homo sapiens
accuggucugguugggcag

SEQ ID NO: 1227062 - RNA, 13 nt, Homo sapiens
accuggugcacuu

SEQ ID NO: 1227063 - RNA, 16 nt, Homo sapiens
accuguaaagugccuu

SEQ ID NO: 1227064 - RNA, 14 nt, Homo sapiens
accugucaucucac

SEQ ID NO: 1227065 - RNA, 17 nt, Homo sapiens
accuguccccacccucc

SEQ ID NO: 1227066 - RNA, 14 nt, Homo sapiens
accugucucagcug

SEQ ID NO: 1227067 - RNA, 15 nt, Homo sapiens
accugucuccacugu

SEQ ID NO: 1227068 - RNA, 19 nt, Homo sapiens
accugugacaaaggaugaa

SEQ ID NO: 1227069 - RNA, 15 nt, Homo sapiens
accugugcaauauga

SEQ ID NO: 1227070 - RNA, 17 nt, Homo sapiens
accugugccuccucaga

SEQ ID NO: 1227071 - RNA, 20 nt, Homo sapiens
accugugggggaagaucagc

SEQ ID NO: 1227072 - RNA, 23 nt, Homo sapiens
accugugugagagaauuuaucac

SEQ ID NO: 1227073 - RNA, 17 nt, Homo sapiens
accuguuuuauagaauu

SEQ ID NO: 1227074 - RNA, 21 nt, Homo sapiens
accuguuuuuuuuucauuuau

SEQ ID NO: 1227075 - RNA, 14 nt, Homo sapiens
accuuaaacaagcu

SEQ ID NO: 1227076 - RNA, 17 nt, Homo sapiens
accuuaagagacacucc

SEQ ID NO: 1227077 - RNA, 21 nt, Homo sapiens
accuuaagauuuugcaccugu

SEQ ID NO: 1227078 - RNA, 18 nt, Homo sapiens
accuuaaugacaacacuu

SEQ ID NO: 1227079 - RNA, 17 nt, Homo sapiens
accuuacauguguaaag

SEQ ID NO: 1227080 - RNA, 16 nt, Homo sapiens
accuucaaaagcacug

SEQ ID NO: 1227081 - RNA, 13 nt, Homo sapiens
accuucaauacuu

SEQ ID NO: 1227082 - RNA, 15 nt, Homo sapiens
accuucaauuccugg

SEQ ID NO: 1227083 - RNA, 15 nt, Homo sapiens
accuucacucuccag

SEQ ID NO: 1227084 - RNA, 18 nt, Homo sapiens
accuuccauucacaccag

SEQ ID NO: 1227085 - RNA, 22 nt, Homo sapiens
accuuccuccuccucuucacuu

SEQ ID NO: 1227086 - RNA, 16 nt, Homo sapiens
accuucguccuuuuaa

SEQ ID NO: 1227087 - RNA, 19 nt, Homo sapiens
accuucugguaucuuguua

SEQ ID NO: 1227088 - RNA, 20 nt, Homo sapiens
accuucuguggcucacagaa

SEQ ID NO: 1227089 - RNA, 12 nt, Homo sapiens
accuucuuucac

SEQ ID NO: 1227090 - RNA, 19 nt, Homo sapiens
accuuggaucagaugaacu

SEQ ID NO: 1227091 - RNA, 15 nt, Homo sapiens
accuuggcucugcca

SEQ ID NO: 1227092 - RNA, 19 nt, Homo sapiens
accuuggcucugccagugg

SEQ ID NO: 1227093 - RNA, 16 nt, Homo sapiens
accuuggggucccucc

SEQ ID NO: 1227094 - RNA, 22 nt, Homo sapiens
accuugugacaauacaccuucc

SEQ ID NO: 1227095 - RNA, 14 nt, Homo sapiens
accuugugccuugg

SEQ ID NO: 1227096 - RNA, 21 nt, Homo sapiens
accuuuaggccaucucagcuu

SEQ ID NO: 1227097 - RNA, 17 nt, Homo sapiens
accuuucacccucauga

SEQ ID NO: 1227098 - RNA, 14 nt, Homo sapiens
accuuuggaaguca

SEQ ID NO: 1227099 - RNA, 22 nt, Homo sapiens
accuuugggucuacaaguauau

SEQ ID NO: 1227100 - RNA, 20 nt, Homo sapiens
accuuuugggaauguuuuaa

SEQ ID NO: 1227101 - RNA, 22 nt, Homo sapiens
accuuuuggugaaagcugagaa

SEQ ID NO: 1227102 - RNA, 16 nt, Homo sapiens
accuuuuuauuugcau

SEQ ID NO: 1227103 - RNA, 17 nt, Homo sapiens
accuuuuuuaagauuuu

SEQ ID NO: 1227104 - RNA, 19 nt, Homo sapiens
acgaagaguucccuugaaa

SEQ ID NO: 1227105 - RNA, 18 nt, Homo sapiens
acgaagccuuaagccaua

SEQ ID NO: 1227106 - RNA, 13 nt, Homo sapiens
acgaaggggcccc

SEQ ID NO: 1227107 - RNA, 22 nt, Homo sapiens
acgaauauagaggguuuugcuc

SEQ ID NO: 1227108 - RNA, 22 nt, Homo sapiens
acgacaaagccaaacucugcca

SEQ ID NO: 1227109 - RNA, 17 nt, Homo sapiens
acgacagugcauuugcc

SEQ ID NO: 1227110 - RNA, 21 nt, Homo sapiens
acgacagugcauuugccuugu

SEQ ID NO: 1227111 - RNA, 16 nt, Homo sapiens
acgacauacaugcuac

SEQ ID NO: 1227112 - RNA, 14 nt, Homo sapiens
acgagcacgagcug

SEQ ID NO: 1227113 - RNA, 22 nt, Homo sapiens
acgagccuauuucucuuugcac

SEQ ID NO: 1227114 - RNA, 14 nt, Homo sapiens
acgaggucuuguug

SEQ ID NO: 1227115 - RNA, 18 nt, Homo sapiens
acgaugccgagaccucaa

SEQ ID NO: 1227116 - RNA, 12 nt, Homo sapiens
acgauuagcuuu

SEQ ID NO: 1227117 - RNA, 13 nt, Homo sapiens
acgauuucagcua

SEQ ID NO: 1227118 - RNA, 21 nt, Homo sapiens
acgcacacccugccccuggug

SEQ ID NO: 1227119 - RNA, 20 nt, Homo sapiens
acgcacgcucgcugccauca

SEQ ID NO: 1227120 - RNA, 15 nt, Homo sapiens
acgcaugugcagcua

SEQ ID NO: 1227121 - RNA, 17 nt, Homo sapiens
acgcaugugugcugcag

SEQ ID NO: 1227122 - RNA, 16 nt, Homo sapiens
acgccaucuccacucu

SEQ ID NO: 1227123 - RNA, 21 nt, Homo sapiens
acgcccuugagcuacuucaaa

SEQ ID NO: 1227124 - RNA, 15 nt, Homo sapiens
acgccuaugauccca

SEQ ID NO: 1227125 - RNA, 14 nt, Homo sapiens
acgccugagcucac

SEQ ID NO: 1227126 - RNA, 14 nt, Homo sapiens
acgccugcccuccc

SEQ ID NO: 1227127 - RNA, 23 nt, Homo sapiens
acgccuggugccccagcaccaac

SEQ ID NO: 1227128 - RNA, 15 nt, Homo sapiens
acgccuguaauccca

SEQ ID NO: 1227129 - RNA, 16 nt, Homo sapiens
acgcgcgcgugcacac

SEQ ID NO: 1227130 - RNA, 18 nt, Homo sapiens
acgcgcguacagaucucu

SEQ ID NO: 1227131 - RNA, 14 nt, Homo sapiens
acgcuacugaguca

SEQ ID NO: 1227132 - RNA, 20 nt, Homo sapiens
acgcucccccgcagucccca

SEQ ID NO: 1227133 - RNA, 18 nt, Homo sapiens
acgcucgcugccaucacc

SEQ ID NO: 1227134 - RNA, 21 nt, Homo sapiens
acgcuggggcucucugagacu

SEQ ID NO: 1227135 - RNA, 20 nt, Homo sapiens
acgcuuguagaacucacucu

SEQ ID NO: 1227136 - RNA, 19 nt, Homo sapiens
acgcuuuucuuuguuauac

SEQ ID NO: 1227137 - RNA, 17 nt, Homo sapiens
acggagaucuccuugcc

SEQ ID NO: 1227138 - RNA, 19 nt, Homo sapiens
acggagguccuuuggacag

SEQ ID NO: 1227139 - RNA, 23 nt, Homo sapiens
acggaugauuggauuauucauuu

SEQ ID NO: 1227140 - RNA, 16 nt, Homo sapiens
acggaugguugaauga

SEQ ID NO: 1227141 - RNA, 18 nt, Homo sapiens
acggcaacugaagcggcu

SEQ ID NO: 1227142 - RNA, 21 nt, Homo sapiens
acggcaccauccagcaccucc

SEQ ID NO: 1227143 - RNA, 15 nt, Homo sapiens
acggcccaugcaauu

SEQ ID NO: 1227144 - RNA, 16 nt, Homo sapiens
acggcgcccccagugu

SEQ ID NO: 1227145 - RNA, 20 nt, Homo sapiens
acggcucacgcuuaccucaa

SEQ ID NO: 1227146 - RNA, 14 nt, Homo sapiens
acggcucacugcag

SEQ ID NO: 1227147 - RNA, 20 nt, Homo sapiens
acggcugccugacacugagc

SEQ ID NO: 1227148 - RNA, 23 nt, Homo sapiens
acgggaaaggaaacgccccgggc

SEQ ID NO: 1227149 - RNA, 17 nt, Homo sapiens
acgggaaaggagcugcu

SEQ ID NO: 1227150 - RNA, 19 nt, Homo sapiens
acgggaauucagacaagcu

SEQ ID NO: 1227151 - RNA, 16 nt, Homo sapiens
acgggaggcugggcac

SEQ ID NO: 1227152 - RNA, 17 nt, Homo sapiens
acggucaggaaaacugu

SEQ ID NO: 1227153 - RNA, 20 nt, Homo sapiens
acgguggcucacgccuguaa

SEQ ID NO: 1227154 - RNA, 18 nt, Homo sapiens
acggugggagaccugcug

SEQ ID NO: 1227155 - RNA, 14 nt, Homo sapiens
acgguuaacuguaa

SEQ ID NO: 1227156 - RNA, 21 nt, Homo sapiens
acguaaaaagaaaaaaaccau

SEQ ID NO: 1227157 - RNA, 17 nt, Homo sapiens
acguaauaaaauuaacu

SEQ ID NO: 1227158 - RNA, 23 nt, Homo sapiens
acguacaaaauccagcuaugaau

SEQ ID NO: 1227159 - RNA, 20 nt, Homo sapiens
acguaugcaagucugugagu

SEQ ID NO: 1227160 - RNA, 22 nt, Homo sapiens
acguauuuuuucuaaugugcau

SEQ ID NO: 1227161 - RNA, 14 nt, Homo sapiens
acgucucagcccuu

SEQ ID NO: 1227162 - RNA, 20 nt, Homo sapiens
acgugauccucucaccucag

SEQ ID NO: 1227163 - RNA, 15 nt, Homo sapiens
acgugaugagacaaa

SEQ ID NO: 1227164 - RNA, 13 nt, Homo sapiens
acgugggcauuuu

SEQ ID NO: 1227165 - RNA, 20 nt, Homo sapiens
acguggucacugugcacugc

SEQ ID NO: 1227166 - RNA, 18 nt, Homo sapiens
acgugucugcacaggguc

SEQ ID NO: 1227167 - RNA, 16 nt, Homo sapiens
acgugugcaguuguag

SEQ ID NO: 1227168 - RNA, 20 nt, Homo sapiens
acgugugugcacguacacac

SEQ ID NO: 1227169 - RNA, 14 nt, Homo sapiens
acguguuuaauuaa

SEQ ID NO: 1227170 - RNA, 20 nt, Homo sapiens
acguucgauuucuaccucag

SEQ ID NO: 1227171 - RNA, 19 nt, Homo sapiens
acguuggccucagggccag

SEQ ID NO: 1227172 - RNA, 22 nt, Homo sapiens
acguuuuucuggaccaagguga

SEQ ID NO: 1227173 - RNA, 14 nt, Homo sapiens
acuaaaaauauuau

SEQ ID NO: 1227174 - RNA, 19 nt, Homo sapiens
acuaaaauuaggacuguau

SEQ ID NO: 1227175 - RNA, 20 nt, Homo sapiens
acuaaaauuuuaggcacucu

SEQ ID NO: 1227176 - RNA, 22 nt, Homo sapiens
acuaaaauuuuaggcacucuua

SEQ ID NO: 1227177 - RNA, 14 nt, Homo sapiens
acuaaagauaucag

SEQ ID NO: 1227178 - RNA, 19 nt, Homo sapiens
acuaaagguuuuacuauua

SEQ ID NO: 1227179 - RNA, 13 nt, Homo sapiens
acuaaaucccucc

SEQ ID NO: 1227180 - RNA, 20 nt, Homo sapiens
acuaaauuacaaaugcaauu

SEQ ID NO: 1227181 - RNA, 22 nt, Homo sapiens
acuaacaagaauguaacuccag

SEQ ID NO: 1227182 - RNA, 12 nt, Homo sapiens
acuaacauuucc

SEQ ID NO: 1227183 - RNA, 20 nt, Homo sapiens
acuaaccccaacgcacagga

SEQ ID NO: 1227184 - RNA, 21 nt, Homo sapiens
acuaaccccaacgcacaggaa

SEQ ID NO: 1227185 - RNA, 16 nt, Homo sapiens
acuaacuccugagaaa

SEQ ID NO: 1227186 - RNA, 21 nt, Homo sapiens
acuaacuccugagaaauguua

SEQ ID NO: 1227187 - RNA, 18 nt, Homo sapiens
acuaagagaaugugcuca

SEQ ID NO: 1227188 - RNA, 19 nt, Homo sapiens
acuaagauaaauucaugca

SEQ ID NO: 1227189 - RNA, 14 nt, Homo sapiens
acuaagcaauuucc

SEQ ID NO: 1227190 - RNA, 20 nt, Homo sapiens
acuaagcaguaagcuaucuu

SEQ ID NO: 1227191 - RNA, 17 nt, Homo sapiens
acuaaggugugcucuga

SEQ ID NO: 1227192 - RNA, 22 nt, Homo sapiens
acuaauagaauaaaggcaguuu

SEQ ID NO: 1227193 - RNA, 23 nt, Homo sapiens
acuaauagaauaaaggcaguuuu

SEQ ID NO: 1227194 - RNA, 13 nt, Homo sapiens
acuaaucaagaaa

SEQ ID NO: 1227195 - RNA, 15 nt, Homo sapiens
acuaaugaggauugc

SEQ ID NO: 1227196 - RNA, 14 nt, Homo sapiens
acuaauggaaauau

SEQ ID NO: 1227197 - RNA, 23 nt, Homo sapiens
acuaauuaggcaaggcuauguga

SEQ ID NO: 1227198 - RNA, 19 nt, Homo sapiens
acuaauuauacuacuuugu

SEQ ID NO: 1227199 - RNA, 16 nt, Homo sapiens
acuaauugacuugcaa

SEQ ID NO: 1227200 - RNA, 22 nt, Homo sapiens
acuaauugacuugcaaagaccu

SEQ ID NO: 1227201 - RNA, 19 nt, Homo sapiens
acuaauuuauaacuauuau

SEQ ID NO: 1227202 - RNA, 16 nt, Homo sapiens
acuacaaagcuucuau

SEQ ID NO: 1227203 - RNA, 14 nt, Homo sapiens
acuacacacuaaaa

SEQ ID NO: 1227204 - RNA, 19 nt, Homo sapiens
acuacacacuaaaacuuuc

SEQ ID NO: 1227205 - RNA, 13 nt, Homo sapiens
acuacacuccagc

SEQ ID NO: 1227206 - RNA, 14 nt, Homo sapiens
acuacagaauuuca

SEQ ID NO: 1227207 - RNA, 22 nt, Homo sapiens
acuacagcaugacguaguauua

SEQ ID NO: 1227208 - RNA, 16 nt, Homo sapiens
acuacaggcaccugcc

SEQ ID NO: 1227209 - RNA, 17 nt, Homo sapiens
acuacaggcaccugcca

SEQ ID NO: 1227210 - RNA, 23 nt, Homo sapiens
acuacaugugacuggcaguauua

SEQ ID NO: 1227211 - RNA, 16 nt, Homo sapiens
acuaccaagcagcuca

SEQ ID NO: 1227212 - RNA, 17 nt, Homo sapiens
acuaccaauuucuuuua

SEQ ID NO: 1227213 - RNA, 21 nt, Homo sapiens
acuacugacauguggggccag

SEQ ID NO: 1227214 - RNA, 18 nt, Homo sapiens
acuacugcccacaccaac

SEQ ID NO: 1227215 - RNA, 21 nt, Homo sapiens
acuacugcuggaaaaagcccu

SEQ ID NO: 1227216 - RNA, 17 nt, Homo sapiens
acuacuuaaacaguauu

SEQ ID NO: 1227217 - RNA, 22 nt, Homo sapiens
acuacuuccggcuuauggucuc

SEQ ID NO: 1227218 - RNA, 14 nt, Homo sapiens
acuacuucuauuca

SEQ ID NO: 1227219 - RNA, 21 nt, Homo sapiens
acuagagaucugguuuugcua

SEQ ID NO: 1227220 - RNA, 15 nt, Homo sapiens
acuagagaugugcaa

SEQ ID NO: 1227221 - RNA, 19 nt, Homo sapiens
acuagagucugaacagcug

SEQ ID NO: 1227222 - RNA, 23 nt, Homo sapiens
acuagagucugaacagcuguaau

SEQ ID NO: 1227223 - RNA, 19 nt, Homo sapiens
acuagcaggcaaugcugua

SEQ ID NO: 1227224 - RNA, 21 nt, Homo sapiens
acuagccaggaaguacuucca

SEQ ID NO: 1227225 - RNA, 20 nt, Homo sapiens
acuagccuuuggcucuggag

SEQ ID NO: 1227226 - RNA, 23 nt, Homo sapiens
acuaggcacuguggcucugcaug

SEQ ID NO: 1227227 - RNA, 20 nt, Homo sapiens
acuaggcccccacuugccuc

SEQ ID NO: 1227228 - RNA, 16 nt, Homo sapiens
acuagggagccauuug

SEQ ID NO: 1227229 - RNA, 14 nt, Homo sapiens
acuaguagauuucu

SEQ ID NO: 1227230 - RNA, 19 nt, Homo sapiens
acuaguaguuccugcuaca

SEQ ID NO: 1227231 - RNA, 16 nt, Homo sapiens
acuagucucaccagcc

SEQ ID NO: 1227232 - RNA, 21 nt, Homo sapiens
acuaguucagacacuuuggaa

SEQ ID NO: 1227233 - RNA, 15 nt, Homo sapiens
acuauaaacauuaaa

SEQ ID NO: 1227234 - RNA, 13 nt, Homo sapiens
acuauaaacauuu

SEQ ID NO: 1227235 - RNA, 18 nt, Homo sapiens
acuauaauguaagcucua

SEQ ID NO: 1227236 - RNA, 18 nt, Homo sapiens
acuauauguuuacacaau

SEQ ID NO: 1227237 - RNA, 15 nt, Homo sapiens
acuaucacugaacaa

SEQ ID NO: 1227238 - RNA, 17 nt, Homo sapiens
acuaucauucucagugg

SEQ ID NO: 1227239 - RNA, 14 nt, Homo sapiens
acuauccaauaugg

SEQ ID NO: 1227240 - RNA, 22 nt, Homo sapiens
acuaucccaaucaaagaauuac

SEQ ID NO: 1227241 - RNA, 23 nt, Homo sapiens
acuaucuguaaugccuuuucuca

SEQ ID NO: 1227242 - RNA, 20 nt, Homo sapiens
acuaucugugccagagguaa

SEQ ID NO: 1227243 - RNA, 23 nt, Homo sapiens
acuaugagccaggcaucauacua

SEQ ID NO: 1227244 - RNA, 14 nt, Homo sapiens
acuaugauuauuaa

SEQ ID NO: 1227245 - RNA, 21 nt, Homo sapiens
acuaugauuuaccuauacauu

SEQ ID NO: 1227246 - RNA, 15 nt, Homo sapiens
acuauggagugcuca

SEQ ID NO: 1227247 - RNA, 13 nt, Homo sapiens
acuauggcuccaa

SEQ ID NO: 1227248 - RNA, 15 nt, Homo sapiens
acuauguaaaccaca

SEQ ID NO: 1227249 - RNA, 15 nt, Homo sapiens
acuauguacugccuu

SEQ ID NO: 1227250 - RNA, 21 nt, Homo sapiens
acuauguggcugaaaaugcaa

SEQ ID NO: 1227251 - RNA, 18 nt, Homo sapiens
acuauguugcccaggcag

SEQ ID NO: 1227252 - RNA, 15 nt, Homo sapiens
acuauguuucuauuc

SEQ ID NO: 1227253 - RNA, 16 nt, Homo sapiens
acuauuaaaacagcca

SEQ ID NO: 1227254 - RNA, 15 nt, Homo sapiens
acuauuaccaugaga

SEQ ID NO: 1227255 - RNA, 14 nt, Homo sapiens
acuauucacuaaaa

SEQ ID NO: 1227256 - RNA, 16 nt, Homo sapiens
acuauugagugaaaca

SEQ ID NO: 1227257 - RNA, 19 nt, Homo sapiens
acuauugugaccacaggcu

SEQ ID NO: 1227258 - RNA, 18 nt, Homo sapiens
acuauuuaaagccuccuc

SEQ ID NO: 1227259 - RNA, 21 nt, Homo sapiens
acuauuuaaagccuccucauc

SEQ ID NO: 1227260 - RNA, 22 nt, Homo sapiens
acuauuuagauauaacacuaug

SEQ ID NO: 1227261 - RNA, 17 nt, Homo sapiens
acuauuuaugaaggcaa

SEQ ID NO: 1227262 - RNA, 21 nt, Homo sapiens
acucaaaaauccuaacauuca

SEQ ID NO: 1227263 - RNA, 16 nt, Homo sapiens
acucaaaagacaaaca

SEQ ID NO: 1227264 - RNA, 24 nt, Homo sapiens
acucaaauuggugaacaguguaua

SEQ ID NO: 1227265 - RNA, 13 nt, Homo sapiens
acucaagcacuga

SEQ ID NO: 1227266 - RNA, 17 nt, Homo sapiens
acucaaggaauuugcau

SEQ ID NO: 1227267 - RNA, 17 nt, Homo sapiens
acucaaguaccaccaag

SEQ ID NO: 1227268 - RNA, 17 nt, Homo sapiens
acucaauacuaccucug

SEQ ID NO: 1227269 - RNA, 14 nt, Homo sapiens
acucaaucauuucu

SEQ ID NO: 1227270 - RNA, 18 nt, Homo sapiens
acucaaugagcucuucca

SEQ ID NO: 1227271 - RNA, 11 nt, Homo sapiens
acucaauggag

SEQ ID NO: 1227272 - RNA, 17 nt, Homo sapiens
acucaauggaguauguc

SEQ ID NO: 1227273 - RNA, 23 nt, Homo sapiens
acucaauggaguaugucugaugg

SEQ ID NO: 1227274 - RNA, 18 nt, Homo sapiens
acucacauggacccaaga

SEQ ID NO: 1227275 - RNA, 15 nt, Homo sapiens
acucaccaaacacaa

SEQ ID NO: 1227276 - RNA, 15 nt, Homo sapiens
acucaccugcacuaa

SEQ ID NO: 1227277 - RNA, 16 nt, Homo sapiens
acucaccugcacuaac

SEQ ID NO: 1227278 - RNA, 22 nt, Homo sapiens
acucaccuucuagucuuggcca

SEQ ID NO: 1227279 - RNA, 15 nt, Homo sapiens
acucaccuugucuca

SEQ ID NO: 1227280 - RNA, 21 nt, Homo sapiens
acucacucucccccuccucuu

SEQ ID NO: 1227281 - RNA, 13 nt, Homo sapiens
acucacugugauc

SEQ ID NO: 1227282 - RNA, 21 nt, Homo sapiens
acucacuuucccuugugucaa

SEQ ID NO: 1227283 - RNA, 15 nt, Homo sapiens
acucagaaccugcuc

SEQ ID NO: 1227284 - RNA, 15 nt, Homo sapiens
acucagcaguugaca

SEQ ID NO: 1227285 - RNA, 16 nt, Homo sapiens
acucagcaguugacau

SEQ ID NO: 1227286 - RNA, 21 nt, Homo sapiens
acucagcuggaagucuaccug

SEQ ID NO: 1227287 - RNA, 19 nt, Homo sapiens
acucagcuguccagcugca

SEQ ID NO: 1227288 - RNA, 13 nt, Homo sapiens
acucaggccagug

SEQ ID NO: 1227289 - RNA, 16 nt, Homo sapiens
acucagggagcauuua

SEQ ID NO: 1227290 - RNA, 20 nt, Homo sapiens
acucagggcuccucccagcu

SEQ ID NO: 1227291 - RNA, 22 nt, Homo sapiens
acucagguaccucuuucagggu

SEQ ID NO: 1227292 - RNA, 14 nt, Homo sapiens
acucagguggugcc

SEQ ID NO: 1227293 - RNA, 23 nt, Homo sapiens
acucagguucuucagggccaguc

SEQ ID NO: 1227294 - RNA, 13 nt, Homo sapiens
acucaguagagau

SEQ ID NO: 1227295 - RNA, 23 nt, Homo sapiens
acucauagcgggggccuaaaaaa

SEQ ID NO: 1227296 - RNA, 20 nt, Homo sapiens
acucauaggcuuauuuccaa

SEQ ID NO: 1227297 - RNA, 15 nt, Homo sapiens
acucaucagagcagc

SEQ ID NO: 1227298 - RNA, 15 nt, Homo sapiens
acucaugaagcauac

SEQ ID NO: 1227299 - RNA, 18 nt, Homo sapiens
acucaugaagcauacccc

SEQ ID NO: 1227300 - RNA, 16 nt, Homo sapiens
acucauuagugacuuc

SEQ ID NO: 1227301 - RNA, 15 nt, Homo sapiens
acucauuaucacagu

SEQ ID NO: 1227302 - RNA, 13 nt, Homo sapiens
acuccacuggaca

SEQ ID NO: 1227303 - RNA, 20 nt, Homo sapiens
acuccagcugggagacacag

SEQ ID NO: 1227304 - RNA, 18 nt, Homo sapiens
acuccaggcccaaggcuc

SEQ ID NO: 1227305 - RNA, 20 nt, Homo sapiens
acucccacgccuguccuccu

SEQ ID NO: 1227306 - RNA, 13 nt, Homo sapiens
acucccagcacuc

SEQ ID NO: 1227307 - RNA, 13 nt, Homo sapiens
acucccaguuugc

SEQ ID NO: 1227308 - RNA, 17 nt, Homo sapiens
acuccccagagcugugc

SEQ ID NO: 1227309 - RNA, 14 nt, Homo sapiens
acucccucuuccaa

SEQ ID NO: 1227310 - RNA, 17 nt, Homo sapiens
acucccuugguggcaag

SEQ ID NO: 1227311 - RNA, 17 nt, Homo sapiens
acucccuuugccagugc

SEQ ID NO: 1227312 - RNA, 18 nt, Homo sapiens
acuccuaagacuuaugua

SEQ ID NO: 1227313 - RNA, 13 nt, Homo sapiens
acuccuacuaaau

SEQ ID NO: 1227314 - RNA, 13 nt, Homo sapiens
acuccuagacuuu

SEQ ID NO: 1227315 - RNA, 20 nt, Homo sapiens
acuccuauaaggagaguuca

SEQ ID NO: 1227316 - RNA, 14 nt, Homo sapiens
acuccuccaaggca

SEQ ID NO: 1227317 - RNA, 17 nt, Homo sapiens
acuccuccucacuaaaa

SEQ ID NO: 1227318 - RNA, 23 nt, Homo sapiens
acuccugacgucugaagcuugac

SEQ ID NO: 1227319 - RNA, 14 nt, Homo sapiens
acuccugcuuaauc

SEQ ID NO: 1227320 - RNA, 22 nt, Homo sapiens
acuccuggccucaagugaucug

SEQ ID NO: 1227321 - RNA, 12 nt, Homo sapiens
acuccuggugcc

SEQ ID NO: 1227322 - RNA, 12 nt, Homo sapiens
acuccuguuacu

SEQ ID NO: 1227323 - RNA, 13 nt, Homo sapiens
acuccuuccauca

SEQ ID NO: 1227324 - RNA, 23 nt, Homo sapiens
acuccuuucucuaaaacugccuu

SEQ ID NO: 1227325 - RNA, 12 nt, Homo sapiens
acucgacccaga

SEQ ID NO: 1227326 - RNA, 21 nt, Homo sapiens
acucgcuucccccauagccac

SEQ ID NO: 1227327 - RNA, 21 nt, Homo sapiens
acucgcuuguaaauaccagga

SEQ ID NO: 1227328 - RNA, 14 nt, Homo sapiens
acucgggaagggaa

SEQ ID NO: 1227329 - RNA, 15 nt, Homo sapiens
acucuaagcugugug

SEQ ID NO: 1227330 - RNA, 19 nt, Homo sapiens
acucuaagcugugugcagg

SEQ ID NO: 1227331 - RNA, 19 nt, Homo sapiens
acucuaauaugauuauaca

SEQ ID NO: 1227332 - RNA, 20 nt, Homo sapiens
acucuaggggucaggcucca

SEQ ID NO: 1227333 - RNA, 23 nt, Homo sapiens
acucucacaagauggaaaucaca

SEQ ID NO: 1227334 - RNA, 13 nt, Homo sapiens
acucucauguggc

SEQ ID NO: 1227335 - RNA, 16 nt, Homo sapiens
acucuccaauguucua

SEQ ID NO: 1227336 - RNA, 18 nt, Homo sapiens
acucucccuggagcugcu

SEQ ID NO: 1227337 - RNA, 18 nt, Homo sapiens
acucucugguuuacuuca

SEQ ID NO: 1227338 - RNA, 19 nt, Homo sapiens
acucugaaacacacugaaa

SEQ ID NO: 1227339 - RNA, 18 nt, Homo sapiens
acucugaaaucucagaau

SEQ ID NO: 1227340 - RNA, 17 nt, Homo sapiens
acucugaauccucauga

SEQ ID NO: 1227341 - RNA, 14 nt, Homo sapiens
acucugaccuguac

SEQ ID NO: 1227342 - RNA, 18 nt, Homo sapiens
acucugacgcaaaaccac

SEQ ID NO: 1227343 - RNA, 23 nt, Homo sapiens
acucugacguugaucccagagag

SEQ ID NO: 1227344 - RNA, 13 nt, Homo sapiens
acucugagcugcu

SEQ ID NO: 1227345 - RNA, 23 nt, Homo sapiens
acucugaggcucuuucugggcca

SEQ ID NO: 1227346 - RNA, 16 nt, Homo sapiens
acucugcaaaggccug

SEQ ID NO: 1227347 - RNA, 16 nt, Homo sapiens
acucugcacagccuag

SEQ ID NO: 1227348 - RNA, 12 nt, Homo sapiens
acucugcacaug

SEQ ID NO: 1227349 - RNA, 18 nt, Homo sapiens
acucugcacaugucuugu

SEQ ID NO: 1227350 - RNA, 19 nt, Homo sapiens
acucugcagugauuagaag

SEQ ID NO: 1227351 - RNA, 14 nt, Homo sapiens
acucugccauuaaa

SEQ ID NO: 1227352 - RNA, 19 nt, Homo sapiens
acucugccuacagaacuuc

SEQ ID NO: 1227353 - RNA, 18 nt, Homo sapiens
acucuggcaaagcuuuua

SEQ ID NO: 1227354 - RNA, 19 nt, Homo sapiens
acucuggcugcucccugac

SEQ ID NO: 1227355 - RNA, 18 nt, Homo sapiens
acucugguaaaugaucac

SEQ ID NO: 1227356 - RNA, 19 nt, Homo sapiens
acucuguaauugaauauaa

SEQ ID NO: 1227357 - RNA, 22 nt, Homo sapiens
acucuguaguuacuguggucac

SEQ ID NO: 1227358 - RNA, 17 nt, Homo sapiens
acucuguccaggccacu

SEQ ID NO: 1227359 - RNA, 15 nt, Homo sapiens
acucugucucaaaaa

SEQ ID NO: 1227360 - RNA, 12 nt, Homo sapiens
acucugugucag

SEQ ID NO: 1227361 - RNA, 14 nt, Homo sapiens
acucuuaucuacau

SEQ ID NO: 1227362 - RNA, 18 nt, Homo sapiens
acucuucgaagccuugcc

SEQ ID NO: 1227363 - RNA, 15 nt, Homo sapiens
acucuucucggcuca

SEQ ID NO: 1227364 - RNA, 20 nt, Homo sapiens
acucuucuuacuggugcuau

SEQ ID NO: 1227365 - RNA, 22 nt, Homo sapiens
acucuugagaaaugaauaagcu

SEQ ID NO: 1227366 - RNA, 15 nt, Homo sapiens
acucuugaugugaag

SEQ ID NO: 1227367 - RNA, 12 nt, Homo sapiens
acucuugcaggg

SEQ ID NO: 1227368 - RNA, 18 nt, Homo sapiens
acucuuguggucaucaug

SEQ ID NO: 1227369 - RNA, 22 nt, Homo sapiens
acucuuucauaaaaacacucaa

SEQ ID NO: 1227370 - RNA, 21 nt, Homo sapiens
acucuuuuuuaugccuauucu

SEQ ID NO: 1227371 - RNA, 20 nt, Homo sapiens
acugaaaaaucuaagugaua

SEQ ID NO: 1227372 - RNA, 13 nt, Homo sapiens
acugaaacauuca

SEQ ID NO: 1227373 - RNA, 14 nt, Homo sapiens
acugaaacauuuaa

SEQ ID NO: 1227374 - RNA, 15 nt, Homo sapiens
acugaaaccaaaaca

SEQ ID NO: 1227375 - RNA, 14 nt, Homo sapiens
acugaacauuugcu

SEQ ID NO: 1227376 - RNA, 14 nt, Homo sapiens
acugaaggggcaca

SEQ ID NO: 1227377 - RNA, 16 nt, Homo sapiens
acugaaggugauggag

SEQ ID NO: 1227378 - RNA, 21 nt, Homo sapiens
acugaaguuuuugaaauaccu

SEQ ID NO: 1227379 - RNA, 22 nt, Homo sapiens
acugaauagauaugaaagcuga

SEQ ID NO: 1227380 - RNA, 16 nt, Homo sapiens
acugaauuuugggacu

SEQ ID NO: 1227381 - RNA, 16 nt, Homo sapiens
acugacaaccucaucc

SEQ ID NO: 1227382 - RNA, 21 nt, Homo sapiens
acugacaaccucauccaggcu

SEQ ID NO: 1227383 - RNA, 14 nt, Homo sapiens
acugacaaugggca

SEQ ID NO: 1227384 - RNA, 15 nt, Homo sapiens
acugacaaugggcac

SEQ ID NO: 1227385 - RNA, 16 nt, Homo sapiens
acugacccuaacugca

SEQ ID NO: 1227386 - RNA, 19 nt, Homo sapiens
acugacgcaggcaccuucu

SEQ ID NO: 1227387 - RNA, 12 nt, Homo sapiens
acugacuacugg

SEQ ID NO: 1227388 - RNA, 12 nt, Homo sapiens
acugacugagac

SEQ ID NO: 1227389 - RNA, 12 nt, Homo sapiens
acugacuugagg

SEQ ID NO: 1227390 - RNA, 21 nt, Homo sapiens
acugacuuguuugucuuccau

SEQ ID NO: 1227391 - RNA, 12 nt, Homo sapiens
acugacuuucuc

SEQ ID NO: 1227392 - RNA, 17 nt, Homo sapiens
acugacuuucugauuac

SEQ ID NO: 1227393 - RNA, 16 nt, Homo sapiens
acugagcauuugcacc

SEQ ID NO: 1227394 - RNA, 13 nt, Homo sapiens
acugagcugagac

SEQ ID NO: 1227395 - RNA, 15 nt, Homo sapiens
acugauacacuugaa

SEQ ID NO: 1227396 - RNA, 15 nt, Homo sapiens
acugauaucuggccu

SEQ ID NO: 1227397 - RNA, 16 nt, Homo sapiens
acugaucucauuucua

SEQ ID NO: 1227398 - RNA, 19 nt, Homo sapiens
acugaugaaggcaugccua

SEQ ID NO: 1227399 - RNA, 12 nt, Homo sapiens
acugaugguuca

SEQ ID NO: 1227400 - RNA, 14 nt, Homo sapiens
acugauguacaauu

SEQ ID NO: 1227401 - RNA, 20 nt, Homo sapiens
acugauguccggagagacag

SEQ ID NO: 1227402 - RNA, 17 nt, Homo sapiens
acugauuaccugccaau

SEQ ID NO: 1227403 - RNA, 15 nt, Homo sapiens
acugauuaugucuuu

SEQ ID NO: 1227404 - RNA, 15 nt, Homo sapiens
acugauucacugcau

SEQ ID NO: 1227405 - RNA, 22 nt, Homo sapiens
acugauuuagaaaaacaaauga

SEQ ID NO: 1227406 - RNA, 20 nt, Homo sapiens
acugauuugauaccauggca

SEQ ID NO: 1227407 - RNA, 17 nt, Homo sapiens
acugauuuuuagcuuua

SEQ ID NO: 1227408 - RNA, 19 nt, Homo sapiens
acugcaaagcucggugcuc

SEQ ID NO: 1227409 - RNA, 20 nt, Homo sapiens
acugcaaagcucggugcucc

SEQ ID NO: 1227410 - RNA, 16 nt, Homo sapiens
acugcaagcucugccu

SEQ ID NO: 1227411 - RNA, 15 nt, Homo sapiens
acugcacaaacaaua

SEQ ID NO: 1227412 - RNA, 16 nt, Homo sapiens
acugcaccaagucuca

SEQ ID NO: 1227413 - RNA, 20 nt, Homo sapiens
acugcacuccaaucugggug

SEQ ID NO: 1227414 - RNA, 20 nt, Homo sapiens
acugcacuccagccugggca

SEQ ID NO: 1227415 - RNA, 23 nt, Homo sapiens
acugcagggguccacugugagag

SEQ ID NO: 1227416 - RNA, 18 nt, Homo sapiens
acugcagguuggacccca

SEQ ID NO: 1227417 - RNA, 14 nt, Homo sapiens
acugcagucagcau

SEQ ID NO: 1227418 - RNA, 22 nt, Homo sapiens
acugcagucagcaugaauccag

SEQ ID NO: 1227419 - RNA, 14 nt, Homo sapiens
acugcagugagaau

SEQ ID NO: 1227420 - RNA, 16 nt, Homo sapiens
acugcaugaaugaaac

SEQ ID NO: 1227421 - RNA, 16 nt, Homo sapiens
acugcauguaagccaa

SEQ ID NO: 1227422 - RNA, 20 nt, Homo sapiens
acugccaaauaaacagcuau

SEQ ID NO: 1227423 - RNA, 19 nt, Homo sapiens
acugccaucuuuaucauga

SEQ ID NO: 1227424 - RNA, 16 nt, Homo sapiens
acugccgacaucagca

SEQ ID NO: 1227425 - RNA, 16 nt, Homo sapiens
acugccuccugugacg

SEQ ID NO: 1227426 - RNA, 22 nt, Homo sapiens
acugccucugccacacucugac

SEQ ID NO: 1227427 - RNA, 17 nt, Homo sapiens
acugccucugccuuaga

SEQ ID NO: 1227428 - RNA, 13 nt, Homo sapiens
acugccuuugcag

SEQ ID NO: 1227429 - RNA, 19 nt, Homo sapiens
acugcgccgaccccgccac

SEQ ID NO: 1227430 - RNA, 20 nt, Homo sapiens
acugcuaggaugaagcccua

SEQ ID NO: 1227431 - RNA, 22 nt, Homo sapiens
acugcuccauuuauaaccccag

SEQ ID NO: 1227432 - RNA, 19 nt, Homo sapiens
acugcucccugaagccagc

SEQ ID NO: 1227433 - RNA, 19 nt, Homo sapiens
acugcugcaaauacuguau

SEQ ID NO: 1227434 - RNA, 19 nt, Homo sapiens
acugcugcccagccuccaa

SEQ ID NO: 1227435 - RNA, 17 nt, Homo sapiens
acugcugcuccagugca

SEQ ID NO: 1227436 - RNA, 15 nt, Homo sapiens
acugcuguacccaga

SEQ ID NO: 1227437 - RNA, 14 nt, Homo sapiens
acugcugucuucca

SEQ ID NO: 1227438 - RNA, 22 nt, Homo sapiens
acugcuugcuuacaaucuuuau

SEQ ID NO: 1227439 - RNA, 15 nt, Homo sapiens
acugcuuuuggucug

SEQ ID NO: 1227440 - RNA, 17 nt, Homo sapiens
acuggaaagacauagcc

SEQ ID NO: 1227441 - RNA, 16 nt, Homo sapiens
acuggaagacacuuca

SEQ ID NO: 1227442 - RNA, 18 nt, Homo sapiens
acuggaaguucauaccua

SEQ ID NO: 1227443 - RNA, 16 nt, Homo sapiens
acuggacaagauuucc

SEQ ID NO: 1227444 - RNA, 12 nt, Homo sapiens
acuggacacaaa

SEQ ID NO: 1227445 - RNA, 17 nt, Homo sapiens
acuggacagacccaggu

SEQ ID NO: 1227446 - RNA, 23 nt, Homo sapiens
acuggacagacccaggucuucca

SEQ ID NO: 1227447 - RNA, 19 nt, Homo sapiens
acuggacagucacugccac

SEQ ID NO: 1227448 - RNA, 13 nt, Homo sapiens
acuggaccuggug

SEQ ID NO: 1227449 - RNA, 14 nt, Homo sapiens
acuggaggugggca

SEQ ID NO: 1227450 - RNA, 15 nt, Homo sapiens
acuggaggugggcau

SEQ ID NO: 1227451 - RNA, 16 nt, Homo sapiens
acuggaugucaaacag

SEQ ID NO: 1227452 - RNA, 20 nt, Homo sapiens
acuggauuguguuugugcca

SEQ ID NO: 1227453 - RNA, 13 nt, Homo sapiens
acuggcagaucau

SEQ ID NO: 1227454 - RNA, 14 nt, Homo sapiens
acuggcagcuccuc

SEQ ID NO: 1227455 - RNA, 18 nt, Homo sapiens
acuggcaguaaccuagug

SEQ ID NO: 1227456 - RNA, 21 nt, Homo sapiens
acuggcaguaaccuagugaau

SEQ ID NO: 1227457 - RNA, 14 nt, Homo sapiens
acuggcccaagugg

SEQ ID NO: 1227458 - RNA, 18 nt, Homo sapiens
acuggccuauuuaucuga

SEQ ID NO: 1227459 - RNA, 18 nt, Homo sapiens
acuggcuccaacacugca

SEQ ID NO: 1227460 - RNA, 13 nt, Homo sapiens
acuggcucuccaa

SEQ ID NO: 1227461 - RNA, 22 nt, Homo sapiens
acuggcuggcccucucauucuc

SEQ ID NO: 1227462 - RNA, 17 nt, Homo sapiens
acuggcugucaguauga

SEQ ID NO: 1227463 - RNA, 21 nt, Homo sapiens
acuggcuucucuugagucaca

SEQ ID NO: 1227464 - RNA, 16 nt, Homo sapiens
acugggacgccuucag

SEQ ID NO: 1227465 - RNA, 22 nt, Homo sapiens
acugggaugagccgcugugagc

SEQ ID NO: 1227466 - RNA, 19 nt, Homo sapiens
acugggcaaugauggcaau

SEQ ID NO: 1227467 - RNA, 20 nt, Homo sapiens
acugggccuuagugggccag

SEQ ID NO: 1227468 - RNA, 16 nt, Homo sapiens
acuggggcaagcuccu

SEQ ID NO: 1227469 - RNA, 23 nt, Homo sapiens
acuggggccuccagaacucacug

SEQ ID NO: 1227470 - RNA, 17 nt, Homo sapiens
acuggggcugggagcag

SEQ ID NO: 1227471 - RNA, 18 nt, Homo sapiens
acugggugguccaaagaa

SEQ ID NO: 1227472 - RNA, 12 nt, Homo sapiens
acugguccaaaa

SEQ ID NO: 1227473 - RNA, 16 nt, Homo sapiens
acuggugugcucucuu

SEQ ID NO: 1227474 - RNA, 16 nt, Homo sapiens
acugguucacauccua

SEQ ID NO: 1227475 - RNA, 19 nt, Homo sapiens
acugguuuggucaguuaca

SEQ ID NO: 1227476 - RNA, 20 nt, Homo sapiens
acugguuuggucaguuacaa

SEQ ID NO: 1227477 - RNA, 19 nt, Homo sapiens
acuguaacuacuuccugau

SEQ ID NO: 1227478 - RNA, 13 nt, Homo sapiens
acuguaagggauu

SEQ ID NO: 1227479 - RNA, 17 nt, Homo sapiens
acuguacacacuuuauu

SEQ ID NO: 1227480 - RNA, 22 nt, Homo sapiens
acuguacacagaauuguuccag

SEQ ID NO: 1227481 - RNA, 12 nt, Homo sapiens
acuguacauuua

SEQ ID NO: 1227482 - RNA, 23 nt, Homo sapiens
acuguagaaaugaugauguggaa

SEQ ID NO: 1227483 - RNA, 15 nt, Homo sapiens
acuguauaaacaaaa

SEQ ID NO: 1227484 - RNA, 17 nt, Homo sapiens
acuguauaaacaaaaga

SEQ ID NO: 1227485 - RNA, 17 nt, Homo sapiens
acuguaucaagucaugg

SEQ ID NO: 1227486 - RNA, 16 nt, Homo sapiens
acuguauucgugcauu

SEQ ID NO: 1227487 - RNA, 12 nt, Homo sapiens
acugucacauaa

SEQ ID NO: 1227488 - RNA, 18 nt, Homo sapiens
acugucacuguuucucug

SEQ ID NO: 1227489 - RNA, 13 nt, Homo sapiens
acugucacuuugc

SEQ ID NO: 1227490 - RNA, 14 nt, Homo sapiens
acugucaucuucaa

SEQ ID NO: 1227491 - RNA, 20 nt, Homo sapiens
acuguccagcuuauagucuu

SEQ ID NO: 1227492 - RNA, 16 nt, Homo sapiens
acuguccuacccaccc

SEQ ID NO: 1227493 - RNA, 21 nt, Homo sapiens
acugucugugaacagagagac

SEQ ID NO: 1227494 - RNA, 21 nt, Homo sapiens
acugucuuucagauacauggu

SEQ ID NO: 1227495 - RNA, 13 nt, Homo sapiens
acugugaaacugg

SEQ ID NO: 1227496 - RNA, 20 nt, Homo sapiens
acugugagaggugacacugu

SEQ ID NO: 1227497 - RNA, 19 nt, Homo sapiens
acugugcuaauaacagugc

SEQ ID NO: 1227498 - RNA, 18 nt, Homo sapiens
acuguggagcucagugug

SEQ ID NO: 1227499 - RNA, 21 nt, Homo sapiens
acuguguaauuagugccacuu

SEQ ID NO: 1227500 - RNA, 17 nt, Homo sapiens
acuguguacaccucaaa

SEQ ID NO: 1227501 - RNA, 18 nt, Homo sapiens
acuguguacauaacugaa

SEQ ID NO: 1227502 - RNA, 15 nt, Homo sapiens
acuguguacugugga

SEQ ID NO: 1227503 - RNA, 16 nt, Homo sapiens
acuguguauuccaaga

SEQ ID NO: 1227504 - RNA, 22 nt, Homo sapiens
acugugucacccagacuggaau

SEQ ID NO: 1227505 - RNA, 11 nt, Homo sapiens
acugugucagg

SEQ ID NO: 1227506 - RNA, 15 nt, Homo sapiens
acugugucucaugga

SEQ ID NO: 1227507 - RNA, 16 nt, Homo sapiens
acuguguggacuguga

SEQ ID NO: 1227508 - RNA, 23 nt, Homo sapiens
acuguuacaacuuguauuuccaa

SEQ ID NO: 1227509 - RNA, 17 nt, Homo sapiens
acuguuagcacuguuga

SEQ ID NO: 1227510 - RNA, 15 nt, Homo sapiens
acuguuccaaagcca

SEQ ID NO: 1227511 - RNA, 13 nt, Homo sapiens
acuguucuguccu

SEQ ID NO: 1227512 - RNA, 16 nt, Homo sapiens
acuguucuugcugcua

SEQ ID NO: 1227513 - RNA, 15 nt, Homo sapiens
acuguugauguaucu

SEQ ID NO: 1227514 - RNA, 16 nt, Homo sapiens
acuguugcaaacucag

SEQ ID NO: 1227515 - RNA, 18 nt, Homo sapiens
acuguugcccauugcacu

SEQ ID NO: 1227516 - RNA, 19 nt, Homo sapiens
acuguuuauuugcacuaug

SEQ ID NO: 1227517 - RNA, 21 nt, Homo sapiens
acuguuuccccagagcaggag

SEQ ID NO: 1227518 - RNA, 19 nt, Homo sapiens
acuguuugauauaccaaau

SEQ ID NO: 1227519 - RNA, 15 nt, Homo sapiens
acuguuuuuaaucuc

SEQ ID NO: 1227520 - RNA, 19 nt, Homo sapiens
acuguuuuucucuaaugcu

SEQ ID NO: 1227521 - RNA, 22 nt, Homo sapiens
acuuaaaaaauacuugcaugaa

SEQ ID NO: 1227522 - RNA, 20 nt, Homo sapiens
acuuaaaaaauguccaugau

SEQ ID NO: 1227523 - RNA, 15 nt, Homo sapiens
acuuaaaaacucuau

SEQ ID NO: 1227524 - RNA, 19 nt, Homo sapiens
acuuaaaugguaauaagca

SEQ ID NO: 1227525 - RNA, 12 nt, Homo sapiens
acuuaacagguu

SEQ ID NO: 1227526 - RNA, 13 nt, Homo sapiens
acuuaacauucug

SEQ ID NO: 1227527 - RNA, 14 nt, Homo sapiens
acuuaaccuugcaa

SEQ ID NO: 1227528 - RNA, 15 nt, Homo sapiens
acuuaagcacaagca

SEQ ID NO: 1227529 - RNA, 20 nt, Homo sapiens
acuuaagggaaaaguucucc

SEQ ID NO: 1227530 - RNA, 22 nt, Homo sapiens
acuuaauaaauauuacagugaa

SEQ ID NO: 1227531 - RNA, 23 nt, Homo sapiens
acuuaauacucaaaugaguaaca

SEQ ID NO: 1227532 - RNA, 11 nt, Homo sapiens
acuuaaugucu

SEQ ID NO: 1227533 - RNA, 21 nt, Homo sapiens
acuuaauguuuguaagacuua

SEQ ID NO: 1227534 - RNA, 23 nt, Homo sapiens
acuuaauguuuguaagacuuaca

SEQ ID NO: 1227535 - RNA, 15 nt, Homo sapiens
acuuacagaucuauc

SEQ ID NO: 1227536 - RNA, 23 nt, Homo sapiens
acuuacuauaauuugacuugaau

SEQ ID NO: 1227537 - RNA, 22 nt, Homo sapiens
acuuagaaauugcauuuccuga

SEQ ID NO: 1227538 - RNA, 17 nt, Homo sapiens
acuuagaagaaaucauu

SEQ ID NO: 1227539 - RNA, 23 nt, Homo sapiens
acuuagaucaucagucaccgaag

SEQ ID NO: 1227540 - RNA, 21 nt, Homo sapiens
acuuagguggcaagcugugac

SEQ ID NO: 1227541 - RNA, 23 nt, Homo sapiens
acuuaguccuuuaucauccuuaa

SEQ ID NO: 1227542 - RNA, 18 nt, Homo sapiens
acuuagucuguacuucau

SEQ ID NO: 1227543 - RNA, 12 nt, Homo sapiens
acuuagugacaa

SEQ ID NO: 1227544 - RNA, 21 nt, Homo sapiens
acuuauauuaaauaaaugugc

SEQ ID NO: 1227545 - RNA, 17 nt, Homo sapiens
acuuauccaucuuugaa

SEQ ID NO: 1227546 - RNA, 22 nt, Homo sapiens
acuuaucccaagagaaugaaau

SEQ ID NO: 1227547 - RNA, 22 nt, Homo sapiens
acuuauguacuugauacugaau

SEQ ID NO: 1227548 - RNA, 15 nt, Homo sapiens
acuuauuaacuaaga

SEQ ID NO: 1227549 - RNA, 22 nt, Homo sapiens
acuucaaaagccauaacuugaa

SEQ ID NO: 1227550 - RNA, 19 nt, Homo sapiens
acuucaaguuaaagugaau

SEQ ID NO: 1227551 - RNA, 15 nt, Homo sapiens
acuucaaugugucau

SEQ ID NO: 1227552 - RNA, 14 nt, Homo sapiens
acuucaccuacauu

SEQ ID NO: 1227553 - RNA, 18 nt, Homo sapiens
acuucacgcccuuggcca

SEQ ID NO: 1227554 - RNA, 21 nt, Homo sapiens
acuucacgggcaaucaugagc

SEQ ID NO: 1227555 - RNA, 22 nt, Homo sapiens
acuucacgggcaaucaugagca

SEQ ID NO: 1227556 - RNA, 20 nt, Homo sapiens
acuucacuaccaagcagcuc

SEQ ID NO: 1227557 - RNA, 21 nt, Homo sapiens
acuucacuaccaagcagcuca

SEQ ID NO: 1227558 - RNA, 20 nt, Homo sapiens
acuucagagacuaucugauu

SEQ ID NO: 1227559 - RNA, 17 nt, Homo sapiens
acuucaggggcacuuca

SEQ ID NO: 1227560 - RNA, 18 nt, Homo sapiens
acuucaguugcuuugcag

SEQ ID NO: 1227561 - RNA, 23 nt, Homo sapiens
acuucaguuuuauuuuugccaag

SEQ ID NO: 1227562 - RNA, 22 nt, Homo sapiens
acuucauacgauuugagccuga

SEQ ID NO: 1227563 - RNA, 18 nt, Homo sapiens
acuucauauugcugagag

SEQ ID NO: 1227564 - RNA, 22 nt, Homo sapiens
acuucauauuguugcauugcuu

SEQ ID NO: 1227565 - RNA, 18 nt, Homo sapiens
acuuccacaagagugaau

SEQ ID NO: 1227566 - RNA, 13 nt, Homo sapiens
acuuccacauuau

SEQ ID NO: 1227567 - RNA, 16 nt, Homo sapiens
acuuccacucgaugau

SEQ ID NO: 1227568 - RNA, 11 nt, Homo sapiens
acuuccagugg

SEQ ID NO: 1227569 - RNA, 21 nt, Homo sapiens
acuuccaucuagucacaaaga

SEQ ID NO: 1227570 - RNA, 14 nt, Homo sapiens
acuucccagugaau

SEQ ID NO: 1227571 - RNA, 19 nt, Homo sapiens
acuuccccacugcucucug

SEQ ID NO: 1227572 - RNA, 15 nt, Homo sapiens
acuucccuuaagagu

SEQ ID NO: 1227573 - RNA, 16 nt, Homo sapiens
acuuccucaugaaucu

SEQ ID NO: 1227574 - RNA, 13 nt, Homo sapiens
acuuccugcagua

SEQ ID NO: 1227575 - RNA, 19 nt, Homo sapiens
acuuccugugacuucagcu

SEQ ID NO: 1227576 - RNA, 18 nt, Homo sapiens
acuuccuucaaucuucau

SEQ ID NO: 1227577 - RNA, 16 nt, Homo sapiens
acuuccuugcucuccc

SEQ ID NO: 1227578 - RNA, 19 nt, Homo sapiens
acuucucucagacuuacuu

SEQ ID NO: 1227579 - RNA, 14 nt, Homo sapiens
acuucugcagcuau

SEQ ID NO: 1227580 - RNA, 20 nt, Homo sapiens
acuucuuacccaaagcacau

SEQ ID NO: 1227581 - RNA, 18 nt, Homo sapiens
acuucuuauacauuugau

SEQ ID NO: 1227582 - RNA, 19 nt, Homo sapiens
acuucuuauacauuugaua

SEQ ID NO: 1227583 - RNA, 13 nt, Homo sapiens
acuucuugaauau

SEQ ID NO: 1227584 - RNA, 19 nt, Homo sapiens
acuucuugcuucuuucuag

SEQ ID NO: 1227585 - RNA, 22 nt, Homo sapiens
acuugaaacagauucaggccag

SEQ ID NO: 1227586 - RNA, 19 nt, Homo sapiens
acuugaaagcauccaugug

SEQ ID NO: 1227587 - RNA, 20 nt, Homo sapiens
acuugaaauucucaucaguc

SEQ ID NO: 1227588 - RNA, 17 nt, Homo sapiens
acuugaaauuugccuug

SEQ ID NO: 1227589 - RNA, 16 nt, Homo sapiens
acuugaagacugugaa

SEQ ID NO: 1227590 - RNA, 16 nt, Homo sapiens
acuugaaugguuaaua

SEQ ID NO: 1227591 - RNA, 22 nt, Homo sapiens
acuugacaacuguggacuccag

SEQ ID NO: 1227592 - RNA, 20 nt, Homo sapiens
acuugagguaccaguuguau

SEQ ID NO: 1227593 - RNA, 17 nt, Homo sapiens
acuugauacugaaugca

SEQ ID NO: 1227594 - RNA, 20 nt, Homo sapiens
acuugaugacccccaaccaa

SEQ ID NO: 1227595 - RNA, 15 nt, Homo sapiens
acuugaugauacaau

SEQ ID NO: 1227596 - RNA, 19 nt, Homo sapiens
acuugauguguuaucucuu

SEQ ID NO: 1227597 - RNA, 19 nt, Homo sapiens
acuugauguuuguuugcau

SEQ ID NO: 1227598 - RNA, 13 nt, Homo sapiens
acuugauuccuug

SEQ ID NO: 1227599 - RNA, 15 nt, Homo sapiens
acuugauugucuccu

SEQ ID NO: 1227600 - RNA, 18 nt, Homo sapiens
acuugauuugcauggauu

SEQ ID NO: 1227601 - RNA, 15 nt, Homo sapiens
acuugcauugugauu

SEQ ID NO: 1227602 - RNA, 12 nt, Homo sapiens
acuugccaagaa

SEQ ID NO: 1227603 - RNA, 19 nt, Homo sapiens
acuugccaggcucccuuuc

SEQ ID NO: 1227604 - RNA, 19 nt, Homo sapiens
acuugcuuauuacauuuaa

SEQ ID NO: 1227605 - RNA, 16 nt, Homo sapiens
acuugcuucucuagcu

SEQ ID NO: 1227606 - RNA, 22 nt, Homo sapiens
acuugcuugccaacugccaagc

SEQ ID NO: 1227607 - RNA, 16 nt, Homo sapiens
acuugcuuuaugccuu

SEQ ID NO: 1227608 - RNA, 21 nt, Homo sapiens
acuugcuuuaugccuucuuau

SEQ ID NO: 1227609 - RNA, 14 nt, Homo sapiens
acuuggagauuuau

SEQ ID NO: 1227610 - RNA, 21 nt, Homo sapiens
acuuggccaguuucagcucac

SEQ ID NO: 1227611 - RNA, 17 nt, Homo sapiens
acuuggucagagccacu

SEQ ID NO: 1227612 - RNA, 21 nt, Homo sapiens
acuuggucagagccacucuau

SEQ ID NO: 1227613 - RNA, 15 nt, Homo sapiens
acuuggucugugaga

SEQ ID NO: 1227614 - RNA, 16 nt, Homo sapiens
acuugguguacugggu

SEQ ID NO: 1227615 - RNA, 17 nt, Homo sapiens
acuugguugguccuugu

SEQ ID NO: 1227616 - RNA, 18 nt, Homo sapiens
acuugguuuuuggcucuu

SEQ ID NO: 1227617 - RNA, 18 nt, Homo sapiens
acuugucacugacacaaa

SEQ ID NO: 1227618 - RNA, 21 nt, Homo sapiens
acuugucacugacacaaagga

SEQ ID NO: 1227619 - RNA, 13 nt, Homo sapiens
acuuguccugacu

SEQ ID NO: 1227620 - RNA, 18 nt, Homo sapiens
acuuguccuuuuguacca

SEQ ID NO: 1227621 - RNA, 22 nt, Homo sapiens
acuugugcugaucgugcuaaau

SEQ ID NO: 1227622 - RNA, 14 nt, Homo sapiens
acuuguggacacag

SEQ ID NO: 1227623 - RNA, 22 nt, Homo sapiens
acuuguguauauuuuaaugaau

SEQ ID NO: 1227624 - RNA, 18 nt, Homo sapiens
acuugugucaaccacuaa

SEQ ID NO: 1227625 - RNA, 22 nt, Homo sapiens
acuugugugugggcugugagug

SEQ ID NO: 1227626 - RNA, 19 nt, Homo sapiens
acuuguuuuaaacuugccu

SEQ ID NO: 1227627 - RNA, 13 nt, Homo sapiens
acuuuaagcacua

SEQ ID NO: 1227628 - RNA, 22 nt, Homo sapiens
acuuuaauccuuccacuaucau

SEQ ID NO: 1227629 - RNA, 17 nt, Homo sapiens
acuuuaccucuguggac

SEQ ID NO: 1227630 - RNA, 16 nt, Homo sapiens
acuuuauaaauaucaa

SEQ ID NO: 1227631 - RNA, 23 nt, Homo sapiens
acuuucccagaaaaaaaaaaacu

SEQ ID NO: 1227632 - RNA, 22 nt, Homo sapiens
acuuucuaaguaggaugaauca

SEQ ID NO: 1227633 - RNA, 19 nt, Homo sapiens
acuuucucuucauacuuuu

SEQ ID NO: 1227634 - RNA, 23 nt, Homo sapiens
acuuucuugaaaagaagcaagga

SEQ ID NO: 1227635 - RNA, 16 nt, Homo sapiens
acuuucuuuacuccau

SEQ ID NO: 1227636 - RNA, 23 nt, Homo sapiens
acuuugagauguugaaauuacau

SEQ ID NO: 1227637 - RNA, 15 nt, Homo sapiens
acuuugauaucugau

SEQ ID NO: 1227638 - RNA, 19 nt, Homo sapiens
acuuugauugaaguauuca

SEQ ID NO: 1227639 - RNA, 15 nt, Homo sapiens
acuuugcacauuuug

SEQ ID NO: 1227640 - RNA, 12 nt, Homo sapiens
acuuugcugauu

SEQ ID NO: 1227641 - RNA, 22 nt, Homo sapiens
acuuuggaauguacucuguuca

SEQ ID NO: 1227642 - RNA, 11 nt, Homo sapiens
acuuugggacg

SEQ ID NO: 1227643 - RNA, 17 nt, Homo sapiens
acuuugggauucuuucc

SEQ ID NO: 1227644 - RNA, 17 nt, Homo sapiens
acuuugguacauggcca

SEQ ID NO: 1227645 - RNA, 16 nt, Homo sapiens
acuuuuauaccuaucu

SEQ ID NO: 1227646 - RNA, 23 nt, Homo sapiens
acuuuucaccaggggugcucacc

SEQ ID NO: 1227647 - RNA, 16 nt, Homo sapiens
acuuuuccacauucca

SEQ ID NO: 1227648 - RNA, 18 nt, Homo sapiens
acuuuuggcuccucuagu

SEQ ID NO: 1227649 - RNA, 19 nt, Homo sapiens
acuuuuuaaaauaauaaca

SEQ ID NO: 1227650 - RNA, 13 nt, Homo sapiens
acuuuuuggugga

SEQ ID NO: 1227651 - RNA, 21 nt, Homo sapiens
acuuuuuuagaaaugcaaaau

SEQ ID NO: 1227652 - RNA, 18 nt, Homo sapiens
acuuuuuuuuaacacuuu

SEQ ID NO: 1227653 - RNA, 24 nt, Homo sapiens
agaaaaaaguuuacaacauaaucu

SEQ ID NO: 1227654 - RNA, 16 nt, Homo sapiens
agaaaaaauucccuca

SEQ ID NO: 1227655 - RNA, 21 nt, Homo sapiens
agaaaaacaccgcuucugccu

SEQ ID NO: 1227656 - RNA, 12 nt, Homo sapiens
agaaaaaccacu

SEQ ID NO: 1227657 - RNA, 17 nt, Homo sapiens
agaaaaagacaccgucc

SEQ ID NO: 1227658 - RNA, 15 nt, Homo sapiens
agaaaaauagcugug

SEQ ID NO: 1227659 - RNA, 17 nt, Homo sapiens
agaaaaauaucuuggcc

SEQ ID NO: 1227660 - RNA, 22 nt, Homo sapiens
agaaaaauccgcuuuucugcca

SEQ ID NO: 1227661 - RNA, 23 nt, Homo sapiens
agaaaaaucuuuguuacucugua

SEQ ID NO: 1227662 - RNA, 13 nt, Homo sapiens
agaaaaaugucau

SEQ ID NO: 1227663 - RNA, 13 nt, Homo sapiens
agaaaaauuaauu

SEQ ID NO: 1227664 - RNA, 13 nt, Homo sapiens
agaaaacaacuuc

SEQ ID NO: 1227665 - RNA, 20 nt, Homo sapiens
agaaaacagagccugccuaa

SEQ ID NO: 1227666 - RNA, 21 nt, Homo sapiens
auagagugacuccaagaacaa

SEQ ID NO: 1227667 - RNA, 22 nt, Homo sapiens
auagaugccgcggaaggucccu

SEQ ID NO: 1227668 - RNA, 20 nt, Homo sapiens
auagaugucuagguacuuca

SEQ ID NO: 1227669 - RNA, 16 nt, Homo sapiens
auagaugugaucacug

SEQ ID NO: 1227670 - RNA, 19 nt, Homo sapiens
auagcaaacuucaggacuu

SEQ ID NO: 1227671 - RNA, 14 nt, Homo sapiens
auagcaagugaaag

SEQ ID NO: 1227672 - RNA, 13 nt, Homo sapiens
auagcaccuuuca

SEQ ID NO: 1227673 - RNA, 21 nt, Homo sapiens
auagcagaaauaaacauugag

SEQ ID NO: 1227674 - RNA, 15 nt, Homo sapiens
auagcauguaauggu

SEQ ID NO: 1227675 - RNA, 16 nt, Homo sapiens
auagcauuuguuuaag

SEQ ID NO: 1227676 - RNA, 12 nt, Homo sapiens
auagccaaaaau

SEQ ID NO: 1227677 - RNA, 14 nt, Homo sapiens
auagccaacugcug

SEQ ID NO: 1227678 - RNA, 17 nt, Homo sapiens
auagccacaaaugccuu

SEQ ID NO: 1227679 - RNA, 23 nt, Homo sapiens
auagccaccccagaaauggugaa

SEQ ID NO: 1227680 - RNA, 22 nt, Homo sapiens
auagcgaagaccaguauggcaa

SEQ ID NO: 1227681 - RNA, 13 nt, Homo sapiens
auagcgacaggaa

SEQ ID NO: 1227682 - RNA, 17 nt, Homo sapiens
auagcuacaguguaaua

SEQ ID NO: 1227683 - RNA, 18 nt, Homo sapiens
auagcuacaucaguuuga

SEQ ID NO: 1227684 - RNA, 16 nt, Homo sapiens
auagcuacccaaaaga

SEQ ID NO: 1227685 - RNA, 23 nt, Homo sapiens
auagcucuggggugggcaguuuu

SEQ ID NO: 1227686 - RNA, 20 nt, Homo sapiens
auagcuggggcuucaccagu

SEQ ID NO: 1227687 - RNA, 19 nt, Homo sapiens
auaggcauuugauuuugcc

SEQ ID NO: 1227688 - RNA, 18 nt, Homo sapiens
auaggccugcucagccuc

SEQ ID NO: 1227689 - RNA, 15 nt, Homo sapiens
auaggccugggugcu

SEQ ID NO: 1227690 - RNA, 22 nt, Homo sapiens
auagggagacccccaucuuuac

SEQ ID NO: 1227691 - RNA, 19 nt, Homo sapiens
auaguaccauuuauacaaa

SEQ ID NO: 1227692 - RNA, 17 nt, Homo sapiens
auaguaugaaugcagug

SEQ ID NO: 1227693 - RNA, 23 nt, Homo sapiens
auagucacauggccuaugcacau

SEQ ID NO: 1227694 - RNA, 16 nt, Homo sapiens
auaguccagacacuua

SEQ ID NO: 1227695 - RNA, 14 nt, Homo sapiens
auagugccuaaaau

SEQ ID NO: 1227696 - RNA, 20 nt, Homo sapiens
auagugggcaccccacugca

SEQ ID NO: 1227697 - RNA, 21 nt, Homo sapiens
auagugggguuccaugaguua

SEQ ID NO: 1227698 - RNA, 21 nt, Homo sapiens
auaguucuagacauggagguu

SEQ ID NO: 1227699 - RNA, 15 nt, Homo sapiens
auaguuuaaauucaa

SEQ ID NO: 1227700 - RNA, 22 nt, Homo sapiens
auaguuuaggagaaaccagcuu

SEQ ID NO: 1227701 - RNA, 17 nt, Homo sapiens
auaguuuuuuacuucuc

SEQ ID NO: 1227702 - RNA, 13 nt, Homo sapiens
auauaaaugggaa

SEQ ID NO: 1227703 - RNA, 13 nt, Homo sapiens
auauaaauucugu

SEQ ID NO: 1227704 - RNA, 15 nt, Homo sapiens
auauaacaaguauaa

SEQ ID NO: 1227705 - RNA, 20 nt, Homo sapiens
auauaacaagugggugaaug

SEQ ID NO: 1227706 - RNA, 16 nt, Homo sapiens
auauaaggaaagcaau

SEQ ID NO: 1227707 - RNA, 22 nt, Homo sapiens
auauaaggaaagugauccaaaa

SEQ ID NO: 1227708 - RNA, 18 nt, Homo sapiens
auauaaguuugaaggaaa

SEQ ID NO: 1227709 - RNA, 16 nt, Homo sapiens
auauaauguugccagc

SEQ ID NO: 1227710 - RNA, 21 nt, Homo sapiens
auauaauucacucaagcacug

SEQ ID NO: 1227711 - RNA, 15 nt, Homo sapiens
auauaauucuguaca

SEQ ID NO: 1227712 - RNA, 17 nt, Homo sapiens
auauacaaaacuuuauc

SEQ ID NO: 1227713 - RNA, 12 nt, Homo sapiens
auauacaaauag

SEQ ID NO: 1227714 - RNA, 19 nt, Homo sapiens
auauacacauauaccuaua

SEQ ID NO: 1227715 - RNA, 19 nt, Homo sapiens
auauacagcaggugcucaa

SEQ ID NO: 1227716 - RNA, 12 nt, Homo sapiens
auauaccaagcu

SEQ ID NO: 1227717 - RNA, 17 nt, Homo sapiens
auauaccuauaaugugu

SEQ ID NO: 1227718 - RNA, 19 nt, Homo sapiens
auauaccuuuuugugucaa

SEQ ID NO: 1227719 - RNA, 22 nt, Homo sapiens
auauacuaaaccaacucuaaua

SEQ ID NO: 1227720 - RNA, 13 nt, Homo sapiens
auauacuaugaaa

SEQ ID NO: 1227721 - RNA, 23 nt, Homo sapiens
auauacugcagcuuuacugccuu

SEQ ID NO: 1227722 - RNA, 18 nt, Homo sapiens
auauacugguucacaucc

SEQ ID NO: 1227723 - RNA, 15 nt, Homo sapiens
auauacugugugcuu

SEQ ID NO: 1227724 - RNA, 12 nt, Homo sapiens
auauacuuugaa

SEQ ID NO: 1227725 - RNA, 18 nt, Homo sapiens
auauagcuugaaacauag

SEQ ID NO: 1227726 - RNA, 16 nt, Homo sapiens
auauauaaguguacau

SEQ ID NO: 1227727 - RNA, 19 nt, Homo sapiens
auauauacagauacauauc

SEQ ID NO: 1227728 - RNA, 16 nt, Homo sapiens
auauaucaaacugaaa

SEQ ID NO: 1227729 - RNA, 19 nt, Homo sapiens
auauauguguauauauaca

SEQ ID NO: 1227730 - RNA, 21 nt, Homo sapiens
auauauuguguugacuuuaua

SEQ ID NO: 1227731 - RNA, 16 nt, Homo sapiens
auauauuuauaacuca

SEQ ID NO: 1227732 - RNA, 19 nt, Homo sapiens
auauauuuccuuauucaga

SEQ ID NO: 1227733 - RNA, 17 nt, Homo sapiens
auauauuuuuaccaucu

SEQ ID NO: 1227734 - RNA, 14 nt, Homo sapiens
auaucaaacugaaa

SEQ ID NO: 1227735 - RNA, 13 nt, Homo sapiens
auaucaacacuug

SEQ ID NO: 1227736 - RNA, 22 nt, Homo sapiens
auaucaauguuuguccuguaua

SEQ ID NO: 1227737 - RNA, 22 nt, Homo sapiens
auaucaauuaauuugaaaacau

SEQ ID NO: 1227738 - RNA, 17 nt, Homo sapiens
auaucacuuccaugaca

SEQ ID NO: 1227739 - RNA, 19 nt, Homo sapiens
auaucagacaagcacuauu

SEQ ID NO: 1227740 - RNA, 14 nt, Homo sapiens
auaucagagcucuu

SEQ ID NO: 1227741 - RNA, 11 nt, Homo sapiens
auaucagggaa

SEQ ID NO: 1227742 - RNA, 16 nt, Homo sapiens
auaucauacuguucaa

SEQ ID NO: 1227743 - RNA, 17 nt, Homo sapiens
auaucauacuguucaau

SEQ ID NO: 1227744 - RNA, 16 nt, Homo sapiens
auaucaugaugugcaa

SEQ ID NO: 1227745 - RNA, 22 nt, Homo sapiens
auaucaugcuuuaaaguguaau

SEQ ID NO: 1227746 - RNA, 22 nt, Homo sapiens
auaucauuggaacaacugauac

SEQ ID NO: 1227747 - RNA, 22 nt, Homo sapiens
auaucauuuauuuuuuacauua

SEQ ID NO: 1227748 - RNA, 12 nt, Homo sapiens
auaucauuuuaa

SEQ ID NO: 1227749 - RNA, 16 nt, Homo sapiens
auauccaaaccaaaua

SEQ ID NO: 1227750 - RNA, 14 nt, Homo sapiens
auauccaagacuua

SEQ ID NO: 1227751 - RNA, 18 nt, Homo sapiens
auaucccaagugcacuuu

SEQ ID NO: 1227752 - RNA, 16 nt, Homo sapiens
auauccccacuacuca

SEQ ID NO: 1227753 - RNA, 18 nt, Homo sapiens
auauccccugugcccugc

SEQ ID NO: 1227754 - RNA, 22 nt, Homo sapiens
auauccugcggggaugcugggc

SEQ ID NO: 1227755 - RNA, 17 nt, Homo sapiens
auauccuugauguacag

SEQ ID NO: 1227756 - RNA, 17 nt, Homo sapiens
auauccuuucaagacag

SEQ ID NO: 1227757 - RNA, 19 nt, Homo sapiens
auauccuuucuaacaaaaa

SEQ ID NO: 1227758 - RNA, 18 nt, Homo sapiens
auaucuaauauauaugaa

SEQ ID NO: 1227759 - RNA, 17 nt, Homo sapiens
auaucuguaaugauacu

SEQ ID NO: 1227760 - RNA, 15 nt, Homo sapiens
auaucugucauauag

SEQ ID NO: 1227761 - RNA, 19 nt, Homo sapiens
auaucuuaaagaaacagcu

SEQ ID NO: 1227762 - RNA, 15 nt, Homo sapiens
auaucuuauguuaaa

SEQ ID NO: 1227763 - RNA, 16 nt, Homo sapiens
auaucuuuauuaauca

SEQ ID NO: 1227764 - RNA, 15 nt, Homo sapiens
auaugaaaaucucca

SEQ ID NO: 1227765 - RNA, 15 nt, Homo sapiens
auaugaaacauuuaa

SEQ ID NO: 1227766 - RNA, 20 nt, Homo sapiens
auaugaaacucuacauuuaa

SEQ ID NO: 1227767 - RNA, 13 nt, Homo sapiens
auaugaacauaua

SEQ ID NO: 1227768 - RNA, 17 nt, Homo sapiens
auaugaagugaaaaaag

SEQ ID NO: 1227769 - RNA, 14 nt, Homo sapiens
auaugaaguguuag

SEQ ID NO: 1227770 - RNA, 16 nt, Homo sapiens
auaugaaucugcucac

SEQ ID NO: 1227771 - RNA, 19 nt, Homo sapiens
auaugaaucugcucacuuu

SEQ ID NO: 1227772 - RNA, 18 nt, Homo sapiens
auaugaguaauacaucaa

SEQ ID NO: 1227773 - RNA, 21 nt, Homo sapiens
auaugaguaauacaucaaaga

SEQ ID NO: 1227774 - RNA, 17 nt, Homo sapiens
auaugauagaugacaaa

SEQ ID NO: 1227775 - RNA, 16 nt, Homo sapiens
auaugauauguaaaca

SEQ ID NO: 1227776 - RNA, 23 nt, Homo sapiens
auaugauccagagcagaguuuac

SEQ ID NO: 1227777 - RNA, 20 nt, Homo sapiens
auaugaugaucuggauccac

SEQ ID NO: 1227778 - RNA, 21 nt, Homo sapiens
auaugauuuauauuacugucu

SEQ ID NO: 1227779 - RNA, 15 nt, Homo sapiens
auaugauuuguguau

SEQ ID NO: 1227780 - RNA, 19 nt, Homo sapiens
auaugcaaaccaggauuuc

SEQ ID NO: 1227781 - RNA, 14 nt, Homo sapiens
auaugcaagcagcu

SEQ ID NO: 1227782 - RNA, 21 nt, Homo sapiens
auaugcacaauagcaguugaa

SEQ ID NO: 1227783 - RNA, 20 nt, Homo sapiens
auaugcauaccuggauuucc

SEQ ID NO: 1227784 - RNA, 17 nt, Homo sapiens
auaugccugcaaucuga

SEQ ID NO: 1227785 - RNA, 18 nt, Homo sapiens
auaugcugaacgcagaag

SEQ ID NO: 1227786 - RNA, 21 nt, Homo sapiens
auauggacucugcacaugaau

SEQ ID NO: 1227787 - RNA, 19 nt, Homo sapiens
auauggaguucuuacuuga

SEQ ID NO: 1227788 - RNA, 15 nt, Homo sapiens
auauguaaagcacau

SEQ ID NO: 1227789 - RNA, 19 nt, Homo sapiens
auauguaaauagugcagaa

SEQ ID NO: 1227790 - RNA, 18 nt, Homo sapiens
auauguaaguacuuccac

SEQ ID NO: 1227791 - RNA, 17 nt, Homo sapiens
auauguauauagacaug

SEQ ID NO: 1227792 - RNA, 14 nt, Homo sapiens
auaugucugauaau

SEQ ID NO: 1227793 - RNA, 21 nt, Homo sapiens
auauuaaaauaagcacugugc

SEQ ID NO: 1227794 - RNA, 17 nt, Homo sapiens
auauuaaaauauggcua

SEQ ID NO: 1227795 - RNA, 22 nt, Homo sapiens
auauuaaauaaaugugcaugcu

SEQ ID NO: 1227796 - RNA, 21 nt, Homo sapiens
auauuaacaacaauaacacug

SEQ ID NO: 1227797 - RNA, 21 nt, Homo sapiens
auauuaagaaagacuaucuaa

SEQ ID NO: 1227798 - RNA, 19 nt, Homo sapiens
auauuaagacaauagcacu

SEQ ID NO: 1227799 - RNA, 14 nt, Homo sapiens
auauuaagcacuuu

SEQ ID NO: 1227800 - RNA, 22 nt, Homo sapiens
auauuaauaaaacuuuauguac

SEQ ID NO: 1227801 - RNA, 17 nt, Homo sapiens
auauuaauaugcaugcu

SEQ ID NO: 1227802 - RNA, 12 nt, Homo sapiens
auauuaaucacc

SEQ ID NO: 1227803 - RNA, 22 nt, Homo sapiens
auauuaauuuuccaaugcacag

SEQ ID NO: 1227804 - RNA, 13 nt, Homo sapiens
auauuacagugaa

SEQ ID NO: 1227805 - RNA, 19 nt, Homo sapiens
auauuacugucuuuauucu

SEQ ID NO: 1227806 - RNA, 11 nt, Homo sapiens
auauuacuuua

SEQ ID NO: 1227807 - RNA, 12 nt, Homo sapiens
auauuagcauug

SEQ ID NO: 1227808 - RNA, 15 nt, Homo sapiens
auauuagcauugcca

SEQ ID NO: 1227809 - RNA, 22 nt, Homo sapiens
auauuaggcuauaaauguccua

SEQ ID NO: 1227810 - RNA, 21 nt, Homo sapiens
auauuaucuacaaacacugca

SEQ ID NO: 1227811 - RNA, 13 nt, Homo sapiens
auauuaugccuga

SEQ ID NO: 1227812 - RNA, 20 nt, Homo sapiens
auauuauguuuccuaauuaa

SEQ ID NO: 1227813 - RNA, 18 nt, Homo sapiens
auauuauuguaaccaaua

SEQ ID NO: 1227814 - RNA, 16 nt, Homo sapiens
auauucaggacuugaa

SEQ ID NO: 1227815 - RNA, 18 nt, Homo sapiens
auauuccauccauauacu

SEQ ID NO: 1227816 - RNA, 13 nt, Homo sapiens
auauuccugcauu

SEQ ID NO: 1227817 - RNA, 13 nt, Homo sapiens
auauucuugucaa

SEQ ID NO: 1227818 - RNA, 16 nt, Homo sapiens
auauucuuugguugug

SEQ ID NO: 1227819 - RNA, 22 nt, Homo sapiens
auauugaauaaaaaauagacau

SEQ ID NO: 1227820 - RNA, 14 nt, Homo sapiens
auauugacuuguau

SEQ ID NO: 1227821 - RNA, 16 nt, Homo sapiens
auauugagggagacag

SEQ ID NO: 1227822 - RNA, 15 nt, Homo sapiens
auauugauuccucac

SEQ ID NO: 1227823 - RNA, 20 nt, Homo sapiens
auauugcaggagacauuuuc

SEQ ID NO: 1227824 - RNA, 18 nt, Homo sapiens
auauugcagucaaucucu

SEQ ID NO: 1227825 - RNA, 21 nt, Homo sapiens
auauuguugacaacugugacu

SEQ ID NO: 1227826 - RNA, 15 nt, Homo sapiens
auauuuaaaacauca

SEQ ID NO: 1227827 - RNA, 16 nt, Homo sapiens
auauuuaaauaaagga

SEQ ID NO: 1227828 - RNA, 15 nt, Homo sapiens
auauuuaaugcauua

SEQ ID NO: 1227829 - RNA, 15 nt, Homo sapiens
auauuuauagcaauc

SEQ ID NO: 1227830 - RNA, 18 nt, Homo sapiens
auauuuaugucuauuuaa

SEQ ID NO: 1227831 - RNA, 19 nt, Homo sapiens
auauuuauuuaaagcauug

SEQ ID NO: 1227832 - RNA, 16 nt, Homo sapiens
auauuucaagugccua

SEQ ID NO: 1227833 - RNA, 14 nt, Homo sapiens
auauuucaggcaua

SEQ ID NO: 1227834 - RNA, 14 nt, Homo sapiens
auauuucccauuug

SEQ ID NO: 1227835 - RNA, 17 nt, Homo sapiens
auauuuccugacuugag

SEQ ID NO: 1227836 - RNA, 15 nt, Homo sapiens
auauuucuaacuaua

SEQ ID NO: 1227837 - RNA, 16 nt, Homo sapiens
auauuucuaacuauau

SEQ ID NO: 1227838 - RNA, 14 nt, Homo sapiens
auauuucugauacu

SEQ ID NO: 1227839 - RNA, 17 nt, Homo sapiens
auauuucugauacugcu

SEQ ID NO: 1227840 - RNA, 19 nt, Homo sapiens
auauuucugauacugcuga

SEQ ID NO: 1227841 - RNA, 16 nt, Homo sapiens
auauuugaauaucauu

SEQ ID NO: 1227842 - RNA, 13 nt, Homo sapiens
auauuugaaugaa

SEQ ID NO: 1227843 - RNA, 21 nt, Homo sapiens
auauuugaauuuuaaaucuaa

SEQ ID NO: 1227844 - RNA, 19 nt, Homo sapiens
auauuugcacuuauguacu

SEQ ID NO: 1227845 - RNA, 18 nt, Homo sapiens
auauuugcugagugaaug

SEQ ID NO: 1227846 - RNA, 22 nt, Homo sapiens
auauuuggauugucauucuuac

SEQ ID NO: 1227847 - RNA, 14 nt, Homo sapiens
auauuuucugugcc

SEQ ID NO: 1227848 - RNA, 16 nt, Homo sapiens
auauuuugcauaguac

SEQ ID NO: 1227849 - RNA, 18 nt, Homo sapiens
auauuuuuagauaguuag

SEQ ID NO: 1227850 - RNA, 16 nt, Homo sapiens
auauuuuuccacuuaa

SEQ ID NO: 1227851 - RNA, 19 nt, Homo sapiens
auauuuuugccauaaugac

SEQ ID NO: 1227852 - RNA, 19 nt, Homo sapiens
auauuuuuugcacagcuag

SEQ ID NO: 1227853 - RNA, 19 nt, Homo sapiens
aucaaaaauauuccaucca

SEQ ID NO: 1227854 - RNA, 22 nt, Homo sapiens
aucaaaacacacuacuaccucu

SEQ ID NO: 1227855 - RNA, 20 nt, Homo sapiens
aucaaaacuaaccaucugaa

SEQ ID NO: 1227856 - RNA, 23 nt, Homo sapiens
aucaaacauuggauuuuuccuua

SEQ ID NO: 1227857 - RNA, 13 nt, Homo sapiens
aucaaacccacga

SEQ ID NO: 1227858 - RNA, 20 nt, Homo sapiens
aucaaacccacgauuuucuc

SEQ ID NO: 1227859 - RNA, 14 nt, Homo sapiens
aucaaauaagcuaa

SEQ ID NO: 1227860 - RNA, 22 nt, Homo sapiens
aucaaauaagcuaauauacagu

SEQ ID NO: 1227861 - RNA, 23 nt, Homo sapiens
aucaaaucugcuuuuuaaagaau

SEQ ID NO: 1227862 - RNA, 12 nt, Homo sapiens
aucaacaaacca

SEQ ID NO: 1227863 - RNA, 20 nt, Homo sapiens
aucaacgccucacugaaaca

SEQ ID NO: 1227864 - RNA, 14 nt, Homo sapiens
aucaacucuaauag

SEQ ID NO: 1227865 - RNA, 20 nt, Homo sapiens
aucaagaacaugucagcaau

SEQ ID NO: 1227866 - RNA, 14 nt, Homo sapiens
aucaaguccuacaa

SEQ ID NO: 1227867 - RNA, 18 nt, Homo sapiens
aucaagugucuuccauca

SEQ ID NO: 1227868 - RNA, 21 nt, Homo sapiens
aucaauaaauguugcaaugca

SEQ ID NO: 1227869 - RNA, 16 nt, Homo sapiens
aucaauacaaccagcc

SEQ ID NO: 1227870 - RNA, 13 nt, Homo sapiens
aucaauacagcuu

SEQ ID NO: 1227871 - RNA, 16 nt, Homo sapiens
aucaauacagcuucau

SEQ ID NO: 1227872 - RNA, 24 nt, Homo sapiens
aucaauauuuuuauaucaugcaaa

SEQ ID NO: 1227873 - RNA, 15 nt, Homo sapiens
aucaauguaauguca

SEQ ID NO: 1227874 - RNA, 15 nt, Homo sapiens
aucaaugucacuuaa

SEQ ID NO: 1227875 - RNA, 10 nt, Homo sapiens
aucaaugugu

SEQ ID NO: 1227876 - RNA, 17 nt, Homo sapiens
aucaauuuguaauugcu

SEQ ID NO: 1227877 - RNA, 12 nt, Homo sapiens
aucacaacaaac

SEQ ID NO: 1227878 - RNA, 19 nt, Homo sapiens
aucacaacauuuacuuaac

SEQ ID NO: 1227879 - RNA, 12 nt, Homo sapiens
aucacacuguaa

SEQ ID NO: 1227880 - RNA, 18 nt, Homo sapiens
aucacagagacauuccuc

SEQ ID NO: 1227881 - RNA, 16 nt, Homo sapiens
aucacaggacauuaag

SEQ ID NO: 1227882 - RNA, 18 nt, Homo sapiens
aucacauuaucaucugaa

SEQ ID NO: 1227883 - RNA, 17 nt, Homo sapiens
aucacauuccucugccc

SEQ ID NO: 1227884 - RNA, 19 nt, Homo sapiens
aucaccaccgccucuggcc

SEQ ID NO: 1227885 - RNA, 19 nt, Homo sapiens
aucaccccaaaagcaagac

SEQ ID NO: 1227886 - RNA, 14 nt, Homo sapiens
aucacccucugggu

SEQ ID NO: 1227887 - RNA, 14 nt, Homo sapiens
aucacccucuuccu

SEQ ID NO: 1227888 - RNA, 22 nt, Homo sapiens
aucacccuuuccggcacacugc

SEQ ID NO: 1227889 - RNA, 17 nt, Homo sapiens
aucacgacgcugcagag

SEQ ID NO: 1227890 - RNA, 19 nt, Homo sapiens
aucacuagguaacuuauua

SEQ ID NO: 1227891 - RNA, 23 nt, Homo sapiens
aucacucaagaugccuccuguca

SEQ ID NO: 1227892 - RNA, 13 nt, Homo sapiens
aucacuccagugc

SEQ ID NO: 1227893 - RNA, 22 nt, Homo sapiens
aucacucuaauuaauuguaauc

SEQ ID NO: 1227894 - RNA, 18 nt, Homo sapiens
aucacugaacaaacuaaa

SEQ ID NO: 1227895 - RNA, 12 nt, Homo sapiens
aucacugaauuu

SEQ ID NO: 1227896 - RNA, 14 nt, Homo sapiens
aucacugcauuuca

SEQ ID NO: 1227897 - RNA, 16 nt, Homo sapiens
aucacugccacacucu

SEQ ID NO: 1227898 - RNA, 15 nt, Homo sapiens
aucagaacauucagc

SEQ ID NO: 1227899 - RNA, 17 nt, Homo sapiens
aucagaaggacauggug

SEQ ID NO: 1227900 - RNA, 22 nt, Homo sapiens
aucagaggccuauaaugaagcu

SEQ ID NO: 1227901 - RNA, 14 nt, Homo sapiens
aucagauacaucac

SEQ ID NO: 1227902 - RNA, 15 nt, Homo sapiens
aucagcaucacccgg

SEQ ID NO: 1227903 - RNA, 22 nt, Homo sapiens
aucagcaucacccgggaacuuu

SEQ ID NO: 1227904 - RNA, 15 nt, Homo sapiens
aucagcauugucucg

SEQ ID NO: 1227905 - RNA, 22 nt, Homo sapiens
aucagccauaagaaagcacuau

SEQ ID NO: 1227906 - RNA, 19 nt, Homo sapiens
aucagccccgcuccucccc

SEQ ID NO: 1227907 - RNA, 19 nt, Homo sapiens
aucagcccugccagguggg

SEQ ID NO: 1227908 - RNA, 16 nt, Homo sapiens
aucagccgcaaggauc

SEQ ID NO: 1227909 - RNA, 18 nt, Homo sapiens
aucagcuuucagggccau

SEQ ID NO: 1227910 - RNA, 15 nt, Homo sapiens
aucagggaccagcuu

SEQ ID NO: 1227911 - RNA, 22 nt, Homo sapiens
aucaggguagcugaaggaaauc

SEQ ID NO: 1227912 - RNA, 18 nt, Homo sapiens
aucaguaaucacuuuuca

SEQ ID NO: 1227913 - RNA, 20 nt, Homo sapiens
aucaguucccccaguaccuc

SEQ ID NO: 1227914 - RNA, 21 nt, Homo sapiens
aucaguucuacggaucaucaa

SEQ ID NO: 1227915 - RNA, 16 nt, Homo sapiens
aucauaauuacauucc

SEQ ID NO: 1227916 - RNA, 23 nt, Homo sapiens
aucauauaauaaauguacauuaa

SEQ ID NO: 1227917 - RNA, 23 nt, Homo sapiens
aucuaacgcuuuaaauggcuacu

SEQ ID NO: 1227918 - RNA, 18 nt, Homo sapiens
aucuaagccuuuccauaa

SEQ ID NO: 1227919 - RNA, 20 nt, Homo sapiens
aucuaaggaugucacagggc

SEQ ID NO: 1227920 - RNA, 16 nt, Homo sapiens
aucuaauauauaugaa

SEQ ID NO: 1227921 - RNA, 22 nt, Homo sapiens
aucuaauauggccacaguaguc

SEQ ID NO: 1227922 - RNA, 20 nt, Homo sapiens
aucuaauguugaguuauuaa

SEQ ID NO: 1227923 - RNA, 14 nt, Homo sapiens
aucuacaacuccaa

SEQ ID NO: 1227924 - RNA, 21 nt, Homo sapiens
aucuacaagauccuccugcug

SEQ ID NO: 1227925 - RNA, 14 nt, Homo sapiens
aucuaccacuguau

SEQ ID NO: 1227926 - RNA, 16 nt, Homo sapiens
aucuacuaauuccaca

SEQ ID NO: 1227927 - RNA, 18 nt, Homo sapiens
aucuacuucaacacuuca

SEQ ID NO: 1227928 - RNA, 13 nt, Homo sapiens
aucuaguuuacag

SEQ ID NO: 1227929 - RNA, 15 nt, Homo sapiens
aucuaucaacuauaa

SEQ ID NO: 1227930 - RNA, 20 nt, Homo sapiens
aucuauuaaaauugccauuu

SEQ ID NO: 1227931 - RNA, 14 nt, Homo sapiens
aucuauuaucucaa

SEQ ID NO: 1227932 - RNA, 15 nt, Homo sapiens
aucuauucuguguug

SEQ ID NO: 1227933 - RNA, 15 nt, Homo sapiens
aucucaauaacaaac

SEQ ID NO: 1227934 - RNA, 12 nt, Homo sapiens
aucucacuuuau

SEQ ID NO: 1227935 - RNA, 15 nt, Homo sapiens
aucucagaguccacu

SEQ ID NO: 1227936 - RNA, 14 nt, Homo sapiens
aucucagcacuuug

SEQ ID NO: 1227937 - RNA, 13 nt, Homo sapiens
aucucagcuuuga

SEQ ID NO: 1227938 - RNA, 15 nt, Homo sapiens
aucucagcuuugaga

SEQ ID NO: 1227939 - RNA, 17 nt, Homo sapiens
aucucagucauccugca

SEQ ID NO: 1227940 - RNA, 19 nt, Homo sapiens
aucucauaccucugaccaa

SEQ ID NO: 1227941 - RNA, 17 nt, Homo sapiens
aucucauagguugccaa

SEQ ID NO: 1227942 - RNA, 15 nt, Homo sapiens
aucuccacugauaag

SEQ ID NO: 1227943 - RNA, 17 nt, Homo sapiens
aucuccaggcuuucaau

SEQ ID NO: 1227944 - RNA, 19 nt, Homo sapiens
aucuccaucauaugccuga

SEQ ID NO: 1227945 - RNA, 13 nt, Homo sapiens
aucuccugacaga

SEQ ID NO: 1227946 - RNA, 17 nt, Homo sapiens
aucuccugcgcccuuca

SEQ ID NO: 1227947 - RNA, 14 nt, Homo sapiens
aucuccugcugauu

SEQ ID NO: 1227948 - RNA, 20 nt, Homo sapiens
aucuccuucaccccuauggu

SEQ ID NO: 1227949 - RNA, 17 nt, Homo sapiens
aucucggcucacugcaa

SEQ ID NO: 1227950 - RNA, 20 nt, Homo sapiens
aucucuacuaaaaacacaaa

SEQ ID NO: 1227951 - RNA, 20 nt, Homo sapiens
aucucuacuaccacaaggaa

SEQ ID NO: 1227952 - RNA, 22 nt, Homo sapiens
aucucucccuccccugccauuu

SEQ ID NO: 1227953 - RNA, 20 nt, Homo sapiens
aucucugaagcauguuucau

SEQ ID NO: 1227954 - RNA, 22 nt, Homo sapiens
aucucugggaguuauaggucau

SEQ ID NO: 1227955 - RNA, 19 nt, Homo sapiens
aucucugguugucuaguca

SEQ ID NO: 1227956 - RNA, 20 nt, Homo sapiens
aucucuguuauguacuguac

SEQ ID NO: 1227957 - RNA, 22 nt, Homo sapiens
aucucuuaaaguggucauauua

SEQ ID NO: 1227958 - RNA, 18 nt, Homo sapiens
aucucuucagguucucau

SEQ ID NO: 1227959 - RNA, 22 nt, Homo sapiens
aucucuucuuugcugcagucau

SEQ ID NO: 1227960 - RNA, 14 nt, Homo sapiens
aucucuugugcuuu

SEQ ID NO: 1227961 - RNA, 13 nt, Homo sapiens
aucugaacucuca

SEQ ID NO: 1227962 - RNA, 16 nt, Homo sapiens
aucugagguuggauuu

SEQ ID NO: 1227963 - RNA, 23 nt, Homo sapiens
aucugaucgggggcguagcauca

SEQ ID NO: 1227964 - RNA, 15 nt, Homo sapiens
aucugaucugaguga

SEQ ID NO: 1227965 - RNA, 20 nt, Homo sapiens
aucugauguuucauauuuaa

SEQ ID NO: 1227966 - RNA, 14 nt, Homo sapiens
aucugcagcuaacu

SEQ ID NO: 1227967 - RNA, 15 nt, Homo sapiens
aucugcaguuuaaca

SEQ ID NO: 1227968 - RNA, 18 nt, Homo sapiens
aucugcauuuucacccca

SEQ ID NO: 1227969 - RNA, 15 nt, Homo sapiens
aucugccacaaaaac

SEQ ID NO: 1227970 - RNA, 22 nt, Homo sapiens
aucuggaaguaaccauuugcac

SEQ ID NO: 1227971 - RNA, 18 nt, Homo sapiens
aucuggcccucgacacuc

SEQ ID NO: 1227972 - RNA, 17 nt, Homo sapiens
aucuggcuuagugccac

SEQ ID NO: 1227973 - RNA, 22 nt, Homo sapiens
aucuggcuuagugccacccacc

SEQ ID NO: 1227974 - RNA, 17 nt, Homo sapiens
aucugggcaaaugaaaa

SEQ ID NO: 1227975 - RNA, 22 nt, Homo sapiens
aucugguauauguaaguguuca

SEQ ID NO: 1227976 - RNA, 16 nt, Homo sapiens
aucuggucccuugcag

SEQ ID NO: 1227977 - RNA, 14 nt, Homo sapiens
aucuggucuuccag

SEQ ID NO: 1227978 - RNA, 16 nt, Homo sapiens
aucugguuuugcuauu

SEQ ID NO: 1227979 - RNA, 11 nt, Homo sapiens
aucuguacaau

SEQ ID NO: 1227980 - RNA, 14 nt, Homo sapiens
aucuguacauauua

SEQ ID NO: 1227981 - RNA, 18 nt, Homo sapiens
aucuguacccuuuuccau

SEQ ID NO: 1227982 - RNA, 15 nt, Homo sapiens
aucugucaucucucu

SEQ ID NO: 1227983 - RNA, 20 nt, Homo sapiens
aucuguccguucacaugugu

SEQ ID NO: 1227984 - RNA, 18 nt, Homo sapiens
aucugugccagagguaau

SEQ ID NO: 1227985 - RNA, 17 nt, Homo sapiens
aucugugccccaugccu

SEQ ID NO: 1227986 - RNA, 15 nt, Homo sapiens
aucuguucacuuuuc

SEQ ID NO: 1227987 - RNA, 13 nt, Homo sapiens
aucuuaaaacuaa

SEQ ID NO: 1227988 - RNA, 15 nt, Homo sapiens
aucuuaaacauaaua

SEQ ID NO: 1227989 - RNA, 15 nt, Homo sapiens
aucuuaaagcauucc

SEQ ID NO: 1227990 - RNA, 14 nt, Homo sapiens
aucuuaagauccac

SEQ ID NO: 1227991 - RNA, 23 nt, Homo sapiens
aucuuaccagaugcuacuggacu

SEQ ID NO: 1227992 - RNA, 12 nt, Homo sapiens
aucuuacuguac

SEQ ID NO: 1227993 - RNA, 20 nt, Homo sapiens
aucuuagagacaaaccuuaa

SEQ ID NO: 1227994 - RNA, 17 nt, Homo sapiens
aucuuagauguuucaca

SEQ ID NO: 1227995 - RNA, 22 nt, Homo sapiens
aucuuaugcuauuauucuguaa

SEQ ID NO: 1227996 - RNA, 14 nt, Homo sapiens
aucuucaaagccuu

SEQ ID NO: 1227997 - RNA, 21 nt, Homo sapiens
aucuucaauuuauuacugaaa

SEQ ID NO: 1227998 - RNA, 23 nt, Homo sapiens
aucuucacuucuaaaugcauauc

SEQ ID NO: 1227999 - RNA, 21 nt, Homo sapiens
aucuucagggaacugcauaga

SEQ ID NO: 1228000 - RNA, 19 nt, Homo sapiens
aucuucaggugaacacuua

SEQ ID NO: 1228001 - RNA, 18 nt, Homo sapiens
aucuucauagaugaauga

SEQ ID NO: 1228002 - RNA, 22 nt, Homo sapiens
aucuucccuuuauuacaagaag

SEQ ID NO: 1228003 - RNA, 21 nt, Homo sapiens
aucuucugggagcaggaacaa

SEQ ID NO: 1228004 - RNA, 15 nt, Homo sapiens
aucuucuuaugcaau

SEQ ID NO: 1228005 - RNA, 21 nt, Homo sapiens
aucuucuucauccaacuucca

SEQ ID NO: 1228006 - RNA, 22 nt, Homo sapiens
aucuugaaauuaagaaggcaaa

SEQ ID NO: 1228007 - RNA, 14 nt, Homo sapiens
aucuugaguauuua

SEQ ID NO: 1228008 - RNA, 14 nt, Homo sapiens
aucuugaucugugu

SEQ ID NO: 1228009 - RNA, 16 nt, Homo sapiens
aucuugaucuguguuu

SEQ ID NO: 1228010 - RNA, 18 nt, Homo sapiens
aucuugaucuguguuuua

SEQ ID NO: 1228011 - RNA, 19 nt, Homo sapiens
aucuugcuaccaguauuua

SEQ ID NO: 1228012 - RNA, 20 nt, Homo sapiens
aucuuggagacccugcaaac

SEQ ID NO: 1228013 - RNA, 19 nt, Homo sapiens
aucuuggauuaugaaguga

SEQ ID NO: 1228014 - RNA, 13 nt, Homo sapiens
aucuugugcucag

SEQ ID NO: 1228015 - RNA, 13 nt, Homo sapiens
aucuugugugauu

SEQ ID NO: 1228016 - RNA, 22 nt, Homo sapiens
aucuuguuuugaaaauaaccua

SEQ ID NO: 1228017 - RNA, 17 nt, Homo sapiens
aucuuuaacaaccucug

SEQ ID NO: 1228018 - RNA, 14 nt, Homo sapiens
aucuuuaagaauag

SEQ ID NO: 1228019 - RNA, 20 nt, Homo sapiens
aucuuuacaaaacuacauga

SEQ ID NO: 1228020 - RNA, 17 nt, Homo sapiens
aucuuuagagaaguaua

SEQ ID NO: 1228021 - RNA, 22 nt, Homo sapiens
aucuuuaucaugaagcacauca

SEQ ID NO: 1228022 - RNA, 16 nt, Homo sapiens
aucuuucacuaucugu

SEQ ID NO: 1228023 - RNA, 17 nt, Homo sapiens
aucuuucauccuugacu

SEQ ID NO: 1228024 - RNA, 19 nt, Homo sapiens
aucuuuccuaggcagauca

SEQ ID NO: 1228025 - RNA, 10 nt, Homo sapiens
aucuuucuac

SEQ ID NO: 1228026 - RNA, 13 nt, Homo sapiens
aucuuucuaggag

SEQ ID NO: 1228027 - RNA, 19 nt, Homo sapiens
aucuuucugcacacaaaua

SEQ ID NO: 1228028 - RNA, 18 nt, Homo sapiens
aucuuucuuuaccugaga

SEQ ID NO: 1228029 - RNA, 20 nt, Homo sapiens
aucuuugcucccugcaagaa

SEQ ID NO: 1228030 - RNA, 23 nt, Homo sapiens
aucuuuguacagaagaggauuca

SEQ ID NO: 1228031 - RNA, 15 nt, Homo sapiens
aucuuuucauucuca

SEQ ID NO: 1228032 - RNA, 16 nt, Homo sapiens
aucuuuuuuagcauaa

SEQ ID NO: 1228033 - RNA, 12 nt, Homo sapiens
augaaaaauugg

SEQ ID NO: 1228034 - RNA, 23 nt, Homo sapiens
augaaaagucguuuuccaaacug

SEQ ID NO: 1228035 - RNA, 22 nt, Homo sapiens
augaaaauaacugaaccaaauu

SEQ ID NO: 1228036 - RNA, 16 nt, Homo sapiens
augaaaauuaggauuu

SEQ ID NO: 1228037 - RNA, 15 nt, Homo sapiens
augaaacaauuugag

SEQ ID NO: 1228038 - RNA, 20 nt, Homo sapiens
augaaaccccguuucuacua

SEQ ID NO: 1228039 - RNA, 22 nt, Homo sapiens
augaaacuccugauuuuguagu

SEQ ID NO: 1228040 - RNA, 18 nt, Homo sapiens
augaaacucuacauuuaa

SEQ ID NO: 1228041 - RNA, 18 nt, Homo sapiens
augaaacugacucaucag

SEQ ID NO: 1228042 - RNA, 18 nt, Homo sapiens
augaaagaaaauugaguu

SEQ ID NO: 1228043 - RNA, 15 nt, Homo sapiens
augugugaggagcug

SEQ ID NO: 1228044 - RNA, 14 nt, Homo sapiens
augugugauuucac

SEQ ID NO: 1228045 - RNA, 22 nt, Homo sapiens
auguguggcucagugccuggac

SEQ ID NO: 1228046 - RNA, 18 nt, Homo sapiens
auguguucauucaagcua

SEQ ID NO: 1228047 - RNA, 14 nt, Homo sapiens
auguguuccuccug

SEQ ID NO: 1228048 - RNA, 14 nt, Homo sapiens
auguguugugauag

SEQ ID NO: 1228049 - RNA, 17 nt, Homo sapiens
auguguuuuaauuccaa

SEQ ID NO: 1228050 - RNA, 20 nt, Homo sapiens
auguguuuuucuccagugcu

SEQ ID NO: 1228051 - RNA, 18 nt, Homo sapiens
auguuaaagagaaugagu

SEQ ID NO: 1228052 - RNA, 16 nt, Homo sapiens
auguuaaccucagugu

SEQ ID NO: 1228053 - RNA, 18 nt, Homo sapiens
auguuaaggaaacucuua

SEQ ID NO: 1228054 - RNA, 18 nt, Homo sapiens
auguuaauguuauaucau

SEQ ID NO: 1228055 - RNA, 13 nt, Homo sapiens
auguuacugacca

SEQ ID NO: 1228056 - RNA, 16 nt, Homo sapiens
auguuacugaccagca

SEQ ID NO: 1228057 - RNA, 20 nt, Homo sapiens
auguuaggccuaagaggcuu

SEQ ID NO: 1228058 - RNA, 22 nt, Homo sapiens
auguuaguauuuuaauccugua

SEQ ID NO: 1228059 - RNA, 15 nt, Homo sapiens
auguucacugugagu

SEQ ID NO: 1228060 - RNA, 20 nt, Homo sapiens
auguucaguccaacaaacca

SEQ ID NO: 1228061 - RNA, 17 nt, Homo sapiens
auguuccgagaagaaca

SEQ ID NO: 1228062 - RNA, 15 nt, Homo sapiens
auguucuaaggcucu

SEQ ID NO: 1228063 - RNA, 21 nt, Homo sapiens
auguucuacagaauauucucc

SEQ ID NO: 1228064 - RNA, 20 nt, Homo sapiens
auguucugggacacaguuca

SEQ ID NO: 1228065 - RNA, 17 nt, Homo sapiens
auguugaaagaucaaaa

SEQ ID NO: 1228066 - RNA, 20 nt, Homo sapiens
auguugaguuauuaauaugu

SEQ ID NO: 1228067 - RNA, 15 nt, Homo sapiens
auguugaucauguac

SEQ ID NO: 1228068 - RNA, 14 nt, Homo sapiens
auguugcaauguga

SEQ ID NO: 1228069 - RNA, 14 nt, Homo sapiens
auguugcacaauga

SEQ ID NO: 1228070 - RNA, 12 nt, Homo sapiens
auguugcuuaga

SEQ ID NO: 1228071 - RNA, 16 nt, Homo sapiens
auguuguacaaucaaa

SEQ ID NO: 1228072 - RNA, 22 nt, Homo sapiens
auguuguguuuuuaacauguca

SEQ ID NO: 1228073 - RNA, 12 nt, Homo sapiens
auguuuacuucu

SEQ ID NO: 1228074 - RNA, 16 nt, Homo sapiens
auguuuauacuguauu

SEQ ID NO: 1228075 - RNA, 17 nt, Homo sapiens
auguuuauuuacuaauu

SEQ ID NO: 1228076 - RNA, 17 nt, Homo sapiens
auguuucacugugcaaa

SEQ ID NO: 1228077 - RNA, 19 nt, Homo sapiens
auguuugacacaauuggaa

SEQ ID NO: 1228078 - RNA, 15 nt, Homo sapiens
auguuugcaaacuug

SEQ ID NO: 1228079 - RNA, 18 nt, Homo sapiens
auguuugcacacuugugu

SEQ ID NO: 1228080 - RNA, 11 nt, Homo sapiens
auguuugcacu

SEQ ID NO: 1228081 - RNA, 16 nt, Homo sapiens
auguuugcacuuguga

SEQ ID NO: 1228082 - RNA, 22 nt, Homo sapiens
auguuugccgcuuaagcuuuca

SEQ ID NO: 1228083 - RNA, 18 nt, Homo sapiens
auguuuguaagacuuaca

SEQ ID NO: 1228084 - RNA, 23 nt, Homo sapiens
auguuuguaauaauugcucauaa

SEQ ID NO: 1228085 - RNA, 16 nt, Homo sapiens
auguuuguccugaaca

SEQ ID NO: 1228086 - RNA, 19 nt, Homo sapiens
auguuuuaaacacaugccu

SEQ ID NO: 1228087 - RNA, 12 nt, Homo sapiens
auguuuuccacc

SEQ ID NO: 1228088 - RNA, 18 nt, Homo sapiens
auguuuucccuuuauuca

SEQ ID NO: 1228089 - RNA, 21 nt, Homo sapiens
auguuuugguguauugucagc

SEQ ID NO: 1228090 - RNA, 19 nt, Homo sapiens
auguuuuuaugauaucccu

SEQ ID NO: 1228091 - RNA, 18 nt, Homo sapiens
auguuuuuugccacagcu

SEQ ID NO: 1228092 - RNA, 21 nt, Homo sapiens
auguuuuuugccacagcuuuu

SEQ ID NO: 1228093 - RNA, 22 nt, Homo sapiens
auuaaaaaagcucaaugcauug

SEQ ID NO: 1228094 - RNA, 15 nt, Homo sapiens
auuaaaaaccacuga

SEQ ID NO: 1228095 - RNA, 13 nt, Homo sapiens
auuaaaacaaauc

SEQ ID NO: 1228096 - RNA, 18 nt, Homo sapiens
auuaaaagugacauuugu

SEQ ID NO: 1228097 - RNA, 14 nt, Homo sapiens
auuaaagacagagg

SEQ ID NO: 1228098 - RNA, 13 nt, Homo sapiens
auuaaauagagaa

SEQ ID NO: 1228099 - RNA, 19 nt, Homo sapiens
auuaaauaguuauauaauu

SEQ ID NO: 1228100 - RNA, 14 nt, Homo sapiens
auuaaaugugucau

SEQ ID NO: 1228101 - RNA, 13 nt, Homo sapiens
auuaaauuaggaa

SEQ ID NO: 1228102 - RNA, 15 nt, Homo sapiens
auuaaauuuaacucu

SEQ ID NO: 1228103 - RNA, 13 nt, Homo sapiens
auuaaauuuggcu

SEQ ID NO: 1228104 - RNA, 16 nt, Homo sapiens
auuaacauaagaaaag

SEQ ID NO: 1228105 - RNA, 14 nt, Homo sapiens
auuaaccuggugcu

SEQ ID NO: 1228106 - RNA, 11 nt, Homo sapiens
auuaacuaauc

SEQ ID NO: 1228107 - RNA, 15 nt, Homo sapiens
auuaacuacauuuau

SEQ ID NO: 1228108 - RNA, 23 nt, Homo sapiens
auuaacuuuaauguuuuuugcca

SEQ ID NO: 1228109 - RNA, 18 nt, Homo sapiens
auuaacuuuaauucucuu

SEQ ID NO: 1228110 - RNA, 15 nt, Homo sapiens
auuaagacaguguac

SEQ ID NO: 1228111 - RNA, 15 nt, Homo sapiens
auuaagacaugcacu

SEQ ID NO: 1228112 - RNA, 17 nt, Homo sapiens
auuaagcaaauguuaaa

SEQ ID NO: 1228113 - RNA, 14 nt, Homo sapiens
auuaagcacuuuaa

SEQ ID NO: 1228114 - RNA, 17 nt, Homo sapiens
auuaaguacaugugcca

SEQ ID NO: 1228115 - RNA, 13 nt, Homo sapiens
auuaagugccuga

SEQ ID NO: 1228116 - RNA, 20 nt, Homo sapiens
auuaauaaaagaguuaacau

SEQ ID NO: 1228117 - RNA, 14 nt, Homo sapiens
auuaauaaagcauu

SEQ ID NO: 1228118 - RNA, 23 nt, Homo sapiens
auuaauacucugcagugauuaga

SEQ ID NO: 1228119 - RNA, 13 nt, Homo sapiens
auuaauacugaag

SEQ ID NO: 1228120 - RNA, 24 nt, Homo sapiens
auuaauauauaguccagacacuua

SEQ ID NO: 1228121 - RNA, 18 nt, Homo sapiens
auuaauauccaagacuua

SEQ ID NO: 1228122 - RNA, 17 nt, Homo sapiens
auuaaucaucuauaaag

SEQ ID NO: 1228123 - RNA, 22 nt, Homo sapiens
auuaaugacaaaggcacugagg

SEQ ID NO: 1228124 - RNA, 20 nt, Homo sapiens
auuaauuaagucaccuguau

SEQ ID NO: 1228125 - RNA, 16 nt, Homo sapiens
auuaauuaauauucau

SEQ ID NO: 1228126 - RNA, 12 nt, Homo sapiens
auuaauucaccu

SEQ ID NO: 1228127 - RNA, 16 nt, Homo sapiens
auuaauugugugucac

SEQ ID NO: 1228128 - RNA, 16 nt, Homo sapiens
auuaauuuccacuaaa

SEQ ID NO: 1228129 - RNA, 14 nt, Homo sapiens
auuacaaaauccaa

SEQ ID NO: 1228130 - RNA, 15 nt, Homo sapiens
auuacaaaugcaauu

SEQ ID NO: 1228131 - RNA, 21 nt, Homo sapiens
auuacaaggcuuuaucucagg

SEQ ID NO: 1228132 - RNA, 12 nt, Homo sapiens
auuacacugugc

SEQ ID NO: 1228133 - RNA, 17 nt, Homo sapiens
auuacagaaacugaugc

SEQ ID NO: 1228134 - RNA, 19 nt, Homo sapiens
auuacagaaacugaugcca

SEQ ID NO: 1228135 - RNA, 15 nt, Homo sapiens
auuacagacaaccua

SEQ ID NO: 1228136 - RNA, 17 nt, Homo sapiens
auuacagacaugaacug

SEQ ID NO: 1228137 - RNA, 16 nt, Homo sapiens
auuacaggcacccacc

SEQ ID NO: 1228138 - RNA, 17 nt, Homo sapiens
auuacaggcgugaucca

SEQ ID NO: 1228139 - RNA, 12 nt, Homo sapiens
auuacaggugug

SEQ ID NO: 1228140 - RNA, 12 nt, Homo sapiens
auuacauuuuaa

SEQ ID NO: 1228141 - RNA, 15 nt, Homo sapiens
auuacccugauacua

SEQ ID NO: 1228142 - RNA, 22 nt, Homo sapiens
auuaccgucauuggccugugaa

SEQ ID NO: 1228143 - RNA, 17 nt, Homo sapiens
auuaccucugauaccuc

SEQ ID NO: 1228144 - RNA, 12 nt, Homo sapiens
auuaccuucuau

SEQ ID NO: 1228145 - RNA, 13 nt, Homo sapiens
auuacuaucauaa

SEQ ID NO: 1228146 - RNA, 15 nt, Homo sapiens
auuacuaucauggca

SEQ ID NO: 1228147 - RNA, 14 nt, Homo sapiens
auuacugauuuugu

SEQ ID NO: 1228148 - RNA, 20 nt, Homo sapiens
auuacuggaaggcuuccacu

SEQ ID NO: 1228149 - RNA, 21 nt, Homo sapiens
auuacuggccuuuuucauuua

SEQ ID NO: 1228150 - RNA, 16 nt, Homo sapiens
auuacugguccaaaag

SEQ ID NO: 1228151 - RNA, 12 nt, Homo sapiens
auuacuguguaa

SEQ ID NO: 1228152 - RNA, 21 nt, Homo sapiens
auuacuguugcauuuacuuuu

SEQ ID NO: 1228153 - RNA, 17 nt, Homo sapiens
auuagaauauccaugac

SEQ ID NO: 1228154 - RNA, 16 nt, Homo sapiens
auuagaguauuuucca

SEQ ID NO: 1228155 - RNA, 16 nt, Homo sapiens
auuagaugaacucaac

SEQ ID NO: 1228156 - RNA, 19 nt, Homo sapiens
auuagcaauugacugucac

SEQ ID NO: 1228157 - RNA, 22 nt, Homo sapiens
auuagcaugcugcuuuuuguac

SEQ ID NO: 1228158 - RNA, 18 nt, Homo sapiens
auuagcugggaagaccaa

SEQ ID NO: 1228159 - RNA, 13 nt, Homo sapiens
auuaggugcaauu

SEQ ID NO: 1228160 - RNA, 14 nt, Homo sapiens
auuagugacuucaa

SEQ ID NO: 1228161 - RNA, 13 nt, Homo sapiens
auuaguuaaucuc

SEQ ID NO: 1228162 - RNA, 23 nt, Homo sapiens
auuaguuaaugagccaucacuag

SEQ ID NO: 1228163 - RNA, 16 nt, Homo sapiens
auuauaaaauggacac

SEQ ID NO: 1228164 - RNA, 19 nt, Homo sapiens
auuauaaaugacaaccuga

SEQ ID NO: 1228165 - RNA, 12 nt, Homo sapiens
auuauaacuuaa

SEQ ID NO: 1228166 - RNA, 14 nt, Homo sapiens
auuauaagcauaca

SEQ ID NO: 1228167 - RNA, 18 nt, Homo sapiens
auuauaauuuauggaauu

SEQ ID NO: 1228168 - RNA, 21 nt, Homo sapiens
auuauagaauucuguacuuga

SEQ ID NO: 1228169 - RNA, 14 nt, Homo sapiens
auuaucaauguucu

SEQ ID NO: 1228170 - RNA, 15 nt, Homo sapiens
cauacacagaaacca

SEQ ID NO: 1228171 - RNA, 12 nt, Homo sapiens
cauacagacugg

SEQ ID NO: 1228172 - RNA, 12 nt, Homo sapiens
cauacaggccau

SEQ ID NO: 1228173 - RNA, 23 nt, Homo sapiens
cauacauauguagaaacauuuag

SEQ ID NO: 1228174 - RNA, 15 nt, Homo sapiens
cauacauuuaugcac

SEQ ID NO: 1228175 - RNA, 17 nt, Homo sapiens
cauacauuuaugcacau

SEQ ID NO: 1228176 - RNA, 15 nt, Homo sapiens
cauaccacagcaucc

SEQ ID NO: 1228177 - RNA, 23 nt, Homo sapiens
cauacccuuacucugccagagua

SEQ ID NO: 1228178 - RNA, 16 nt, Homo sapiens
cauaccuaaguacugu

SEQ ID NO: 1228179 - RNA, 15 nt, Homo sapiens
cauaccucugaccaa

SEQ ID NO: 1228180 - RNA, 20 nt, Homo sapiens
cauaccuuuggauuuagugu

SEQ ID NO: 1228181 - RNA, 19 nt, Homo sapiens
cauacgauuugagccugaa

SEQ ID NO: 1228182 - RNA, 14 nt, Homo sapiens
cauacgucagcauu

SEQ ID NO: 1228183 - RNA, 14 nt, Homo sapiens
cauacuguucaaug

SEQ ID NO: 1228184 - RNA, 23 nt, Homo sapiens
cauagaaaaauucagcaaaccau

SEQ ID NO: 1228185 - RNA, 23 nt, Homo sapiens
cauagaaaauuaaacacaaagug

SEQ ID NO: 1228186 - RNA, 17 nt, Homo sapiens
cauagaaacaugacacu

SEQ ID NO: 1228187 - RNA, 19 nt, Homo sapiens
cauagaaacaugacacuga

SEQ ID NO: 1228188 - RNA, 18 nt, Homo sapiens
cauagaaaccacuagaaa

SEQ ID NO: 1228189 - RNA, 19 nt, Homo sapiens
cauagaaauuacacccaaa

SEQ ID NO: 1228190 - RNA, 22 nt, Homo sapiens
cauagaacuggguaaaugcaaa

SEQ ID NO: 1228191 - RNA, 16 nt, Homo sapiens
cauagacauggaugcg

SEQ ID NO: 1228192 - RNA, 20 nt, Homo sapiens
cauagagauagcuacagugu

SEQ ID NO: 1228193 - RNA, 18 nt, Homo sapiens
cauagcagaugguuucca

SEQ ID NO: 1228194 - RNA, 19 nt, Homo sapiens
cauagcgccgugcuguaaa

SEQ ID NO: 1228195 - RNA, 14 nt, Homo sapiens
cauagcugaucaug

SEQ ID NO: 1228196 - RNA, 22 nt, Homo sapiens
cauagcugucuagaguagcuua

SEQ ID NO: 1228197 - RNA, 18 nt, Homo sapiens
cauaggcgcaggugcaca

SEQ ID NO: 1228198 - RNA, 14 nt, Homo sapiens
cauaggcucuuaag

SEQ ID NO: 1228199 - RNA, 20 nt, Homo sapiens
cauagguauauauaugccau

SEQ ID NO: 1228200 - RNA, 19 nt, Homo sapiens
cauaguaccucugcuauuu

SEQ ID NO: 1228201 - RNA, 22 nt, Homo sapiens
cauaguagguacccaauucaau

SEQ ID NO: 1228202 - RNA, 21 nt, Homo sapiens
cauaguaugguggcuggguug

SEQ ID NO: 1228203 - RNA, 22 nt, Homo sapiens
cauagucacauggccuaugcac

SEQ ID NO: 1228204 - RNA, 14 nt, Homo sapiens
cauagugacaugca

SEQ ID NO: 1228205 - RNA, 17 nt, Homo sapiens
cauagugacaugcacac

SEQ ID NO: 1228206 - RNA, 22 nt, Homo sapiens
cauaguggguggauuuguugcc

SEQ ID NO: 1228207 - RNA, 18 nt, Homo sapiens
cauaguuuaaacugcauu

SEQ ID NO: 1228208 - RNA, 15 nt, Homo sapiens
cauauaaauguaaua

SEQ ID NO: 1228209 - RNA, 18 nt, Homo sapiens
cauauaaauucugauuua

SEQ ID NO: 1228210 - RNA, 18 nt, Homo sapiens
cauauaaccuaugccaau

SEQ ID NO: 1228211 - RNA, 19 nt, Homo sapiens
cauauaauguuguuauuua

SEQ ID NO: 1228212 - RNA, 16 nt, Homo sapiens
cauauaccaucuccag

SEQ ID NO: 1228213 - RNA, 15 nt, Homo sapiens
cauauaccuauaaug

SEQ ID NO: 1228214 - RNA, 23 nt, Homo sapiens
cauauacugccauguacuaguuu

SEQ ID NO: 1228215 - RNA, 21 nt, Homo sapiens
cauauacuuuggggacuugua

SEQ ID NO: 1228216 - RNA, 17 nt, Homo sapiens
cauauauaaguuuacac

SEQ ID NO: 1228217 - RNA, 19 nt, Homo sapiens
cauauauacccacauguac

SEQ ID NO: 1228218 - RNA, 13 nt, Homo sapiens
cauauauauguca

SEQ ID NO: 1228219 - RNA, 14 nt, Homo sapiens
cauauauaugucag

SEQ ID NO: 1228220 - RNA, 12 nt, Homo sapiens
cauauaucacua

SEQ ID NO: 1228221 - RNA, 15 nt, Homo sapiens
cauauccaccaccuc

SEQ ID NO: 1228222 - RNA, 19 nt, Homo sapiens
cauauccaggcaccaggac

SEQ ID NO: 1228223 - RNA, 16 nt, Homo sapiens
cauaucccuuccucuc

SEQ ID NO: 1228224 - RNA, 21 nt, Homo sapiens
cauaucccuuccucucaggcu

SEQ ID NO: 1228225 - RNA, 15 nt, Homo sapiens
cauauccugagccau

SEQ ID NO: 1228226 - RNA, 21 nt, Homo sapiens
cauaucgcugacuucauggaa

SEQ ID NO: 1228227 - RNA, 20 nt, Homo sapiens
cauaucuaaagcuuuggaca

SEQ ID NO: 1228228 - RNA, 21 nt, Homo sapiens
cauaucuguguauuaucucaa

SEQ ID NO: 1228229 - RNA, 14 nt, Homo sapiens
cauaucuucuauau

SEQ ID NO: 1228230 - RNA, 18 nt, Homo sapiens
cauaugacaauaagccac

SEQ ID NO: 1228231 - RNA, 16 nt, Homo sapiens
cauaugacuugaucuu

SEQ ID NO: 1228232 - RNA, 22 nt, Homo sapiens
cauaugagcuuccuucugugaa

SEQ ID NO: 1228233 - RNA, 12 nt, Homo sapiens
cauaugccuugg

SEQ ID NO: 1228234 - RNA, 16 nt, Homo sapiens
cauauggacucugcac

SEQ ID NO: 1228235 - RNA, 23 nt, Homo sapiens
cauauggaggaggcucuggaguc

SEQ ID NO: 1228236 - RNA, 16 nt, Homo sapiens
cauauguaaagcacau

SEQ ID NO: 1228237 - RNA, 19 nt, Homo sapiens
cauauguagacuauauaca

SEQ ID NO: 1228238 - RNA, 17 nt, Homo sapiens
cauauguguuacuucaa

SEQ ID NO: 1228239 - RNA, 16 nt, Homo sapiens
cauauguuuaucucac

SEQ ID NO: 1228240 - RNA, 23 nt, Homo sapiens
cauauguuugcuuauauguuaaa

SEQ ID NO: 1228241 - RNA, 17 nt, Homo sapiens
cauauuaaaauuacaga

SEQ ID NO: 1228242 - RNA, 15 nt, Homo sapiens
cauauuaacaugcuu

SEQ ID NO: 1228243 - RNA, 22 nt, Homo sapiens
cauauuauuauuaauuuugcca

SEQ ID NO: 1228244 - RNA, 15 nt, Homo sapiens
cauauucuaaaacca

SEQ ID NO: 1228245 - RNA, 22 nt, Homo sapiens
cauauuggaauguacaugucaa

SEQ ID NO: 1228246 - RNA, 23 nt, Homo sapiens
cauauuuucacagguguggugua

SEQ ID NO: 1228247 - RNA, 20 nt, Homo sapiens
caucaaaaaaaaaaauggau

SEQ ID NO: 1228248 - RNA, 17 nt, Homo sapiens
caucaaaagacuuaaaa

SEQ ID NO: 1228249 - RNA, 19 nt, Homo sapiens
caucaaauauuaccaaaaa

SEQ ID NO: 1228250 - RNA, 20 nt, Homo sapiens
caucaaauauuaccaaaaaa

SEQ ID NO: 1228251 - RNA, 12 nt, Homo sapiens
caucaacaacac

SEQ ID NO: 1228252 - RNA, 14 nt, Homo sapiens
caucaacaacacag

SEQ ID NO: 1228253 - RNA, 12 nt, Homo sapiens
caucaaggucag

SEQ ID NO: 1228254 - RNA, 18 nt, Homo sapiens
caucacaggcugugccaa

SEQ ID NO: 1228255 - RNA, 20 nt, Homo sapiens
caucacccucuuccugugau

SEQ ID NO: 1228256 - RNA, 22 nt, Homo sapiens
caucacuagaagaaaagcccau

SEQ ID NO: 1228257 - RNA, 20 nt, Homo sapiens
caucacuagccaugauaacu

SEQ ID NO: 1228258 - RNA, 20 nt, Homo sapiens
caucacuggguguugaucuu

SEQ ID NO: 1228259 - RNA, 17 nt, Homo sapiens
caucacuucccuacaug

SEQ ID NO: 1228260 - RNA, 14 nt, Homo sapiens
caucagaacugaaa

SEQ ID NO: 1228261 - RNA, 15 nt, Homo sapiens
caucagaacugaaau

SEQ ID NO: 1228262 - RNA, 18 nt, Homo sapiens
caucagagccagucucac

SEQ ID NO: 1228263 - RNA, 15 nt, Homo sapiens
caucagauaagacau

SEQ ID NO: 1228264 - RNA, 12 nt, Homo sapiens
caucagcauuug

SEQ ID NO: 1228265 - RNA, 14 nt, Homo sapiens
caucagccagugaa

SEQ ID NO: 1228266 - RNA, 23 nt, Homo sapiens
caucagcucccugaggaccaccu

SEQ ID NO: 1228267 - RNA, 12 nt, Homo sapiens
caucagggacag

SEQ ID NO: 1228268 - RNA, 15 nt, Homo sapiens
caucagggacaggau

SEQ ID NO: 1228269 - RNA, 21 nt, Homo sapiens
caucaggugaggugugcucca

SEQ ID NO: 1228270 - RNA, 15 nt, Homo sapiens
caucagucaacaacu

SEQ ID NO: 1228271 - RNA, 16 nt, Homo sapiens
caucagucaacaacuu

SEQ ID NO: 1228272 - RNA, 22 nt, Homo sapiens
caucaguguccucuugcucaaa

SEQ ID NO: 1228273 - RNA, 14 nt, Homo sapiens
caucaguguuaaaa

SEQ ID NO: 1228274 - RNA, 21 nt, Homo sapiens
caucauaauuacauuccuaac

SEQ ID NO: 1228275 - RNA, 12 nt, Homo sapiens
caucaucuaugg

SEQ ID NO: 1228276 - RNA, 13 nt, Homo sapiens
caucaucuauggc

SEQ ID NO: 1228277 - RNA, 15 nt, Homo sapiens
caucaucuuguucag

SEQ ID NO: 1228278 - RNA, 23 nt, Homo sapiens
caucauggaggucauacaugcau

SEQ ID NO: 1228279 - RNA, 18 nt, Homo sapiens
caucauuccaaagcuaaa

SEQ ID NO: 1228280 - RNA, 11 nt, Homo sapiens
cauccaaauaa

SEQ ID NO: 1228281 - RNA, 12 nt, Homo sapiens
cauccaacacug

SEQ ID NO: 1228282 - RNA, 13 nt, Homo sapiens
cauccaacacugg

SEQ ID NO: 1228283 - RNA, 15 nt, Homo sapiens
cauccaacacuggau

SEQ ID NO: 1228284 - RNA, 18 nt, Homo sapiens
cauccaaggcuguuacca

SEQ ID NO: 1228285 - RNA, 23 nt, Homo sapiens
cauccaaggcuguuaccauuuua

SEQ ID NO: 1228286 - RNA, 17 nt, Homo sapiens
cauccagaaguuccuca

SEQ ID NO: 1228287 - RNA, 17 nt, Homo sapiens
cauccaggcccaacugu

SEQ ID NO: 1228288 - RNA, 21 nt, Homo sapiens
cauccagggguucauuuucau

SEQ ID NO: 1228289 - RNA, 13 nt, Homo sapiens
cauccagugacaa

SEQ ID NO: 1228290 - RNA, 21 nt, Homo sapiens
cauccauaguaacugacauga

SEQ ID NO: 1228291 - RNA, 14 nt, Homo sapiens
cauccauuccucuu

SEQ ID NO: 1228292 - RNA, 18 nt, Homo sapiens
caucccaaccagugccaa

SEQ ID NO: 1228293 - RNA, 18 nt, Homo sapiens
caucccacgcuugcuuua

SEQ ID NO: 1228294 - RNA, 17 nt, Homo sapiens
caucccagcugcuccca

SEQ ID NO: 1228295 - RNA, 15 nt, Homo sapiens
caucccaucaucuug

SEQ ID NO: 1228296 - RNA, 12 nt, Homo sapiens
cauuccuaacac

SEQ ID NO: 1228297 - RNA, 22 nt, Homo sapiens
cauuccucagcuucuucacagg

SEQ ID NO: 1228298 - RNA, 13 nt, Homo sapiens
cauuccuguaacu

SEQ ID NO: 1228299 - RNA, 17 nt, Homo sapiens
cauucgggccacagggc

SEQ ID NO: 1228300 - RNA, 21 nt, Homo sapiens
cauucuauccccaaucagcuc

SEQ ID NO: 1228301 - RNA, 21 nt, Homo sapiens
cauucuauuccauguuugcac

SEQ ID NO: 1228302 - RNA, 15 nt, Homo sapiens
cauucuccugccuca

SEQ ID NO: 1228303 - RNA, 23 nt, Homo sapiens
cauucugccgcccccuccugaac

SEQ ID NO: 1228304 - RNA, 20 nt, Homo sapiens
cauucuguggccagccaaaa

SEQ ID NO: 1228305 - RNA, 17 nt, Homo sapiens
cauucuguuagauacua

SEQ ID NO: 1228306 - RNA, 14 nt, Homo sapiens
cauucuuccaaaaa

SEQ ID NO: 1228307 - RNA, 20 nt, Homo sapiens
cauugaaagagaaccaguuu

SEQ ID NO: 1228308 - RNA, 16 nt, Homo sapiens
cauugaacacaaacug

SEQ ID NO: 1228309 - RNA, 18 nt, Homo sapiens
cauugaaguaaugaauuu

SEQ ID NO: 1228310 - RNA, 16 nt, Homo sapiens
cauugacaagaacuga

SEQ ID NO: 1228311 - RNA, 20 nt, Homo sapiens
cauugaccaagaacugcaug

SEQ ID NO: 1228312 - RNA, 14 nt, Homo sapiens
cauugacugucaca

SEQ ID NO: 1228313 - RNA, 12 nt, Homo sapiens
cauugagaucac

SEQ ID NO: 1228314 - RNA, 14 nt, Homo sapiens
cauugagucccugc

SEQ ID NO: 1228315 - RNA, 17 nt, Homo sapiens
cauugauaaucuucagg

SEQ ID NO: 1228316 - RNA, 13 nt, Homo sapiens
cauugcacuccag

SEQ ID NO: 1228317 - RNA, 17 nt, Homo sapiens
cauugccaauauccugu

SEQ ID NO: 1228318 - RNA, 16 nt, Homo sapiens
cauugccagugucuuu

SEQ ID NO: 1228319 - RNA, 19 nt, Homo sapiens
cauugcccccaccucuggu

SEQ ID NO: 1228320 - RNA, 21 nt, Homo sapiens
cauugcuaaacugaugacuua

SEQ ID NO: 1228321 - RNA, 15 nt, Homo sapiens
cauugcuuuccacug

SEQ ID NO: 1228322 - RNA, 17 nt, Homo sapiens
cauugcuuuccacugag

SEQ ID NO: 1228323 - RNA, 13 nt, Homo sapiens
cauuggaagccau

SEQ ID NO: 1228324 - RNA, 19 nt, Homo sapiens
cauuggaauaaaacugucu

SEQ ID NO: 1228325 - RNA, 21 nt, Homo sapiens
cauuggauucaucagcauuug

SEQ ID NO: 1228326 - RNA, 14 nt, Homo sapiens
cauugggauauucu

SEQ ID NO: 1228327 - RNA, 19 nt, Homo sapiens
cauuggguuguagccaaag

SEQ ID NO: 1228328 - RNA, 14 nt, Homo sapiens
cauugguccaagau

SEQ ID NO: 1228329 - RNA, 13 nt, Homo sapiens
cauuggugacuca

SEQ ID NO: 1228330 - RNA, 13 nt, Homo sapiens
cauugguguuguc

SEQ ID NO: 1228331 - RNA, 18 nt, Homo sapiens
cauuguacuaccugugua

SEQ ID NO: 1228332 - RNA, 14 nt, Homo sapiens
cauuguacuugaag

SEQ ID NO: 1228333 - RNA, 22 nt, Homo sapiens
cauuguaugauguguugugaua

SEQ ID NO: 1228334 - RNA, 20 nt, Homo sapiens
cauugucuacauagugacau

SEQ ID NO: 1228335 - RNA, 15 nt, Homo sapiens
cauugugaggguuaa

SEQ ID NO: 1228336 - RNA, 14 nt, Homo sapiens
cauugugauuuauu

SEQ ID NO: 1228337 - RNA, 12 nt, Homo sapiens
cauuguuuauug

SEQ ID NO: 1228338 - RNA, 15 nt, Homo sapiens
cauuuacguaaaaag

SEQ ID NO: 1228339 - RNA, 12 nt, Homo sapiens
cauuuacuuaac

SEQ ID NO: 1228340 - RNA, 20 nt, Homo sapiens
cauuuacuuagcagaaccac

SEQ ID NO: 1228341 - RNA, 22 nt, Homo sapiens
cauuuagaggacauucuggaaa

SEQ ID NO: 1228342 - RNA, 14 nt, Homo sapiens
cauuuagcacaaaa

SEQ ID NO: 1228343 - RNA, 23 nt, Homo sapiens
cauuuagcuuguucacacuuugc

SEQ ID NO: 1228344 - RNA, 17 nt, Homo sapiens
cauuuauccacaggaaa

SEQ ID NO: 1228345 - RNA, 21 nt, Homo sapiens
cauuuaugauuuaauaaaaua

SEQ ID NO: 1228346 - RNA, 19 nt, Homo sapiens
cauuuauuuacaugugauu

SEQ ID NO: 1228347 - RNA, 19 nt, Homo sapiens
cauuuauuuauacagugcc

SEQ ID NO: 1228348 - RNA, 16 nt, Homo sapiens
cauuuauuuuuaguua

SEQ ID NO: 1228349 - RNA, 14 nt, Homo sapiens
cauuucaaaaccca

SEQ ID NO: 1228350 - RNA, 22 nt, Homo sapiens
cauuucaaaacccaaauggcua

SEQ ID NO: 1228351 - RNA, 15 nt, Homo sapiens
cauuucaaacagucu

SEQ ID NO: 1228352 - RNA, 15 nt, Homo sapiens
cauuucacacaguga

SEQ ID NO: 1228353 - RNA, 17 nt, Homo sapiens
cauuucacacauaagaa

SEQ ID NO: 1228354 - RNA, 20 nt, Homo sapiens
cauuucaccugugacaaagg

SEQ ID NO: 1228355 - RNA, 15 nt, Homo sapiens
cauuucacucucaaa

SEQ ID NO: 1228356 - RNA, 13 nt, Homo sapiens
cauuucaguauca

SEQ ID NO: 1228357 - RNA, 18 nt, Homo sapiens
cauuucauacaacagaaa

SEQ ID NO: 1228358 - RNA, 20 nt, Homo sapiens
cauuucauuaagguuccagu

SEQ ID NO: 1228359 - RNA, 18 nt, Homo sapiens
cauuuccaacaccacaga

SEQ ID NO: 1228360 - RNA, 14 nt, Homo sapiens
cauuucccacaucu

SEQ ID NO: 1228361 - RNA, 18 nt, Homo sapiens
cauuucccccgagcucuu

SEQ ID NO: 1228362 - RNA, 19 nt, Homo sapiens
cauuuccugacagaaggac

SEQ ID NO: 1228363 - RNA, 16 nt, Homo sapiens
cauuuccuuccuucca

SEQ ID NO: 1228364 - RNA, 23 nt, Homo sapiens
cauuucuagagagccccugacaa

SEQ ID NO: 1228365 - RNA, 15 nt, Homo sapiens
cauuucuagcaguga

SEQ ID NO: 1228366 - RNA, 21 nt, Homo sapiens
cauuucuauacuuuacaggaa

SEQ ID NO: 1228367 - RNA, 21 nt, Homo sapiens
cauuucuauuuauuuacugag

SEQ ID NO: 1228368 - RNA, 23 nt, Homo sapiens
cauuucucaaaugcacaucucau

SEQ ID NO: 1228369 - RNA, 19 nt, Homo sapiens
cauuugaggggaaaacacc

SEQ ID NO: 1228370 - RNA, 22 nt, Homo sapiens
cauuugcaaaggcgacaauaaa

SEQ ID NO: 1228371 - RNA, 14 nt, Homo sapiens
cauuugcaauaugg

SEQ ID NO: 1228372 - RNA, 15 nt, Homo sapiens
cauuugcaccuaccu

SEQ ID NO: 1228373 - RNA, 15 nt, Homo sapiens
cauuugcauuugcuc

SEQ ID NO: 1228374 - RNA, 14 nt, Homo sapiens
cauuugcuuugucc

SEQ ID NO: 1228375 - RNA, 19 nt, Homo sapiens
cauuuggaaugaauacagc

SEQ ID NO: 1228376 - RNA, 21 nt, Homo sapiens
cauuuguagcucuggaccugu

SEQ ID NO: 1228377 - RNA, 22 nt, Homo sapiens
cauuuguggucacagccaugaa

SEQ ID NO: 1228378 - RNA, 13 nt, Homo sapiens
cauuuguuuucac

SEQ ID NO: 1228379 - RNA, 15 nt, Homo sapiens
cauuuuaagaguuac

SEQ ID NO: 1228380 - RNA, 14 nt, Homo sapiens
cauuuuacacaaag

SEQ ID NO: 1228381 - RNA, 17 nt, Homo sapiens
cauuuuaugucauuaaa

SEQ ID NO: 1228382 - RNA, 16 nt, Homo sapiens
cauuuucaucacuggg

SEQ ID NO: 1228383 - RNA, 15 nt, Homo sapiens
cauuuucauugauga

SEQ ID NO: 1228384 - RNA, 14 nt, Homo sapiens
cauuuucugccuau

SEQ ID NO: 1228385 - RNA, 15 nt, Homo sapiens
cauuuugacacaaaa

SEQ ID NO: 1228386 - RNA, 18 nt, Homo sapiens
cauuuugcccuuccauag

SEQ ID NO: 1228387 - RNA, 22 nt, Homo sapiens
cauuuuuagagaaguaaaacau

SEQ ID NO: 1228388 - RNA, 21 nt, Homo sapiens
cauuuuuauaaaaaugagugc

SEQ ID NO: 1228389 - RNA, 19 nt, Homo sapiens
cauuuuuauacagugauaa

SEQ ID NO: 1228390 - RNA, 14 nt, Homo sapiens
cauuuuucugggag

SEQ ID NO: 1228391 - RNA, 11 nt, Homo sapiens
cauuuuugcug

SEQ ID NO: 1228392 - RNA, 22 nt, Homo sapiens
cauuuuuuucacuggaguuaca

SEQ ID NO: 1228393 - RNA, 21 nt, Homo sapiens
cauuuuuuuuauauugccuua

SEQ ID NO: 1228394 - RNA, 22 nt, Homo sapiens
ccaaaaaaaaaagaaguuacuu

SEQ ID NO: 1228395 - RNA, 13 nt, Homo sapiens
ccaaaaacuaaau

SEQ ID NO: 1228396 - RNA, 17 nt, Homo sapiens
ccaaaaauaugguugau

SEQ ID NO: 1228397 - RNA, 15 nt, Homo sapiens
ccaaaaauuacuuug

SEQ ID NO: 1228398 - RNA, 16 nt, Homo sapiens
ccaaaaauuacuuugg

SEQ ID NO: 1228399 - RNA, 14 nt, Homo sapiens
ccaaaacaauuucu

SEQ ID NO: 1228400 - RNA, 12 nt, Homo sapiens
ccaaaacagccu

SEQ ID NO: 1228401 - RNA, 14 nt, Homo sapiens
ccaaaacaguuaau

SEQ ID NO: 1228402 - RNA, 15 nt, Homo sapiens
ccaaaauaaugcacc

SEQ ID NO: 1228403 - RNA, 17 nt, Homo sapiens
ccaaaauaccagagccu

SEQ ID NO: 1228404 - RNA, 19 nt, Homo sapiens
ccaaaauaguuaagacaug

SEQ ID NO: 1228405 - RNA, 13 nt, Homo sapiens
ccaaaauccgacu

SEQ ID NO: 1228406 - RNA, 15 nt, Homo sapiens
ccaaaauucauuucu

SEQ ID NO: 1228407 - RNA, 22 nt, Homo sapiens
ccaaacaaaacugaaccacaaa

SEQ ID NO: 1228408 - RNA, 14 nt, Homo sapiens
ccaaacaagccuua

SEQ ID NO: 1228409 - RNA, 17 nt, Homo sapiens
ccaaaccaaauuuuaau

SEQ ID NO: 1228410 - RNA, 18 nt, Homo sapiens
ccaaacccuuaacugaca

SEQ ID NO: 1228411 - RNA, 19 nt, Homo sapiens
ccaaacucauucaccaaau

SEQ ID NO: 1228412 - RNA, 14 nt, Homo sapiens
ccaaacucugccag

SEQ ID NO: 1228413 - RNA, 15 nt, Homo sapiens
ccaaacugucuuugu

SEQ ID NO: 1228414 - RNA, 13 nt, Homo sapiens
ccaaagaaaugaa

SEQ ID NO: 1228415 - RNA, 16 nt, Homo sapiens
ccaaagacuguacugg

SEQ ID NO: 1228416 - RNA, 22 nt, Homo sapiens
ccaaagcacaugcuuagcuuau

SEQ ID NO: 1228417 - RNA, 22 nt, Homo sapiens
ccaaagcaucaauacaaccagc

SEQ ID NO: 1228418 - RNA, 22 nt, Homo sapiens
ccaaagcauggacuaaccccaa

SEQ ID NO: 1228419 - RNA, 20 nt, Homo sapiens
ccaaagccaauaaaugaacu

SEQ ID NO: 1228420 - RNA, 18 nt, Homo sapiens
ccaaagccagaccagaag

SEQ ID NO: 1228421 - RNA, 13 nt, Homo sapiens
ccaaagccaguga

SEQ ID NO: 1228422 - RNA, 16 nt, Homo sapiens
ccagaguugcaaagau

SEQ ID NO: 1228423 - RNA, 21 nt, Homo sapiens
ccagauacacuaaaguuacaa

SEQ ID NO: 1228424 - RNA, 15 nt, Homo sapiens
ccagauacaugguga

SEQ ID NO: 1228425 - RNA, 15 nt, Homo sapiens
ccagauauuucacau

SEQ ID NO: 1228426 - RNA, 15 nt, Homo sapiens
ccagauccagacugu

SEQ ID NO: 1228427 - RNA, 14 nt, Homo sapiens
ccagaucucaggca

SEQ ID NO: 1228428 - RNA, 12 nt, Homo sapiens
ccagaucugccu

SEQ ID NO: 1228429 - RNA, 21 nt, Homo sapiens
ccagaugaacugacugaagga

SEQ ID NO: 1228430 - RNA, 15 nt, Homo sapiens
ccagauggacuccag

SEQ ID NO: 1228431 - RNA, 19 nt, Homo sapiens
ccagaugucgcccuacuca

SEQ ID NO: 1228432 - RNA, 22 nt, Homo sapiens
ccagauugacgacaagugcuga

SEQ ID NO: 1228433 - RNA, 22 nt, Homo sapiens
ccagcaaugacaucucaggggc

SEQ ID NO: 1228434 - RNA, 12 nt, Homo sapiens
ccagcacagggg

SEQ ID NO: 1228435 - RNA, 19 nt, Homo sapiens
ccagcacgaguggccaguu

SEQ ID NO: 1228436 - RNA, 14 nt, Homo sapiens
ccagcacuggugaa

SEQ ID NO: 1228437 - RNA, 22 nt, Homo sapiens
ccagcacuucauacgauuugag

SEQ ID NO: 1228438 - RNA, 15 nt, Homo sapiens
ccagcaggacaguga

SEQ ID NO: 1228439 - RNA, 13 nt, Homo sapiens
ccagcaggagcca

SEQ ID NO: 1228440 - RNA, 18 nt, Homo sapiens
ccagcagggccucaaagu

SEQ ID NO: 1228441 - RNA, 13 nt, Homo sapiens
ccagcauccagcu

SEQ ID NO: 1228442 - RNA, 17 nt, Homo sapiens
ccagcaucuggagaccg

SEQ ID NO: 1228443 - RNA, 19 nt, Homo sapiens
ccagccagacccuggagag

SEQ ID NO: 1228444 - RNA, 22 nt, Homo sapiens
ccagccagaggguagggcacaa

SEQ ID NO: 1228445 - RNA, 13 nt, Homo sapiens
ccagccaggcuau

SEQ ID NO: 1228446 - RNA, 20 nt, Homo sapiens
ccagccaucaaaaugcuuuu

SEQ ID NO: 1228447 - RNA, 17 nt, Homo sapiens
ccagcccaaaggggaca

SEQ ID NO: 1228448 - RNA, 17 nt, Homo sapiens
ccagcccauggcuuuag

SEQ ID NO: 1228449 - RNA, 16 nt, Homo sapiens
ccagccccacugccag

SEQ ID NO: 1228450 - RNA, 21 nt, Homo sapiens
ccagccccacugccagcagca

SEQ ID NO: 1228451 - RNA, 23 nt, Homo sapiens
ccagccccuuccuggguauuuau

SEQ ID NO: 1228452 - RNA, 15 nt, Homo sapiens
ccagcccugcugcag

SEQ ID NO: 1228453 - RNA, 18 nt, Homo sapiens
ccagccugggcaacagau

SEQ ID NO: 1228454 - RNA, 19 nt, Homo sapiens
ccagccuguccaacagagg

SEQ ID NO: 1228455 - RNA, 23 nt, Homo sapiens
ccagccugugguuacagugcaga

SEQ ID NO: 1228456 - RNA, 13 nt, Homo sapiens
ccagcgggcacag

SEQ ID NO: 1228457 - RNA, 16 nt, Homo sapiens
ccagcgguccaaaguu

SEQ ID NO: 1228458 - RNA, 20 nt, Homo sapiens
ccagcguagucaagggugga

SEQ ID NO: 1228459 - RNA, 14 nt, Homo sapiens
ccagcuaucuguca

SEQ ID NO: 1228460 - RNA, 12 nt, Homo sapiens
ccagcuaugaau

SEQ ID NO: 1228461 - RNA, 13 nt, Homo sapiens
ccagcucaucucc

SEQ ID NO: 1228462 - RNA, 17 nt, Homo sapiens
ccagcucccagccacau

SEQ ID NO: 1228463 - RNA, 12 nt, Homo sapiens
ccagcugcaaag

SEQ ID NO: 1228464 - RNA, 14 nt, Homo sapiens
ccagcugcaaagga

SEQ ID NO: 1228465 - RNA, 16 nt, Homo sapiens
ccagcugcaccugcca

SEQ ID NO: 1228466 - RNA, 15 nt, Homo sapiens
ccagcugccuuggac

SEQ ID NO: 1228467 - RNA, 20 nt, Homo sapiens
ccagcugcuuuuugugauuu

SEQ ID NO: 1228468 - RNA, 18 nt, Homo sapiens
ccagcugggaagcccuuu

SEQ ID NO: 1228469 - RNA, 18 nt, Homo sapiens
ccagcuggggcgugggga

SEQ ID NO: 1228470 - RNA, 19 nt, Homo sapiens
ccagcuggguggacuuugg

SEQ ID NO: 1228471 - RNA, 16 nt, Homo sapiens
ccagcugugcacuuuc

SEQ ID NO: 1228472 - RNA, 19 nt, Homo sapiens
ccagcugugcacuuucuuc

SEQ ID NO: 1228473 - RNA, 13 nt, Homo sapiens
ccagcuuacuagc

SEQ ID NO: 1228474 - RNA, 18 nt, Homo sapiens
ccagcuuacuagcacuuu

SEQ ID NO: 1228475 - RNA, 22 nt, Homo sapiens
ccagcuugcgaauaacaguccc

SEQ ID NO: 1228476 - RNA, 16 nt, Homo sapiens
ccagcuuguaggagcu

SEQ ID NO: 1228477 - RNA, 15 nt, Homo sapiens
ccagcuuugcaguga

SEQ ID NO: 1228478 - RNA, 15 nt, Homo sapiens
ccaggaaucaugaag

SEQ ID NO: 1228479 - RNA, 18 nt, Homo sapiens
ccaggacaauuagaaaaa

SEQ ID NO: 1228480 - RNA, 19 nt, Homo sapiens
ccaggaccacagagcuccu

SEQ ID NO: 1228481 - RNA, 22 nt, Homo sapiens
ccaggacgcuucugaaugcugc

SEQ ID NO: 1228482 - RNA, 14 nt, Homo sapiens
ccaggacucaguga

SEQ ID NO: 1228483 - RNA, 17 nt, Homo sapiens
ccaggacugaccucuuc

SEQ ID NO: 1228484 - RNA, 22 nt, Homo sapiens
ccaggagacagaccacuugcca

SEQ ID NO: 1228485 - RNA, 13 nt, Homo sapiens
ccaggagacaguu

SEQ ID NO: 1228486 - RNA, 14 nt, Homo sapiens
ccaggagagacaga

SEQ ID NO: 1228487 - RNA, 23 nt, Homo sapiens
ccaggagcaggaccuacuaggag

SEQ ID NO: 1228488 - RNA, 15 nt, Homo sapiens
ccaggagcccggcuu

SEQ ID NO: 1228489 - RNA, 11 nt, Homo sapiens
ccaggagcuca

SEQ ID NO: 1228490 - RNA, 23 nt, Homo sapiens
ccaggaggcagagguugcaguga

SEQ ID NO: 1228491 - RNA, 23 nt, Homo sapiens
ccaggagguuugcagggagcuca

SEQ ID NO: 1228492 - RNA, 18 nt, Homo sapiens
ccaggaguagugagcugu

SEQ ID NO: 1228493 - RNA, 17 nt, Homo sapiens
ccaggauccugcaggaa

SEQ ID NO: 1228494 - RNA, 14 nt, Homo sapiens
ccaggcacagggcc

SEQ ID NO: 1228495 - RNA, 18 nt, Homo sapiens
ccaggcaccaucucccuu

SEQ ID NO: 1228496 - RNA, 16 nt, Homo sapiens
ccaggcacugcugcac

SEQ ID NO: 1228497 - RNA, 14 nt, Homo sapiens
ccaggcaggggugg

SEQ ID NO: 1228498 - RNA, 21 nt, Homo sapiens
ccaggccaccuccccagcauu

SEQ ID NO: 1228499 - RNA, 16 nt, Homo sapiens
ccaggcccuccagugg

SEQ ID NO: 1228500 - RNA, 21 nt, Homo sapiens
ccaggcccugcucuuccucag

SEQ ID NO: 1228501 - RNA, 16 nt, Homo sapiens
ccaggccugagcaaca

SEQ ID NO: 1228502 - RNA, 18 nt, Homo sapiens
ccaggccugagcaacaaa

SEQ ID NO: 1228503 - RNA, 14 nt, Homo sapiens
ccaggcgggcucaa

SEQ ID NO: 1228504 - RNA, 13 nt, Homo sapiens
ccaggcuaccauc

SEQ ID NO: 1228505 - RNA, 13 nt, Homo sapiens
ccaggcugaaaag

SEQ ID NO: 1228506 - RNA, 15 nt, Homo sapiens
ccaggcugaaaagaa

SEQ ID NO: 1228507 - RNA, 22 nt, Homo sapiens
ccaggcugcccccaacacucca

SEQ ID NO: 1228508 - RNA, 17 nt, Homo sapiens
ccaggcuggagugcagu

SEQ ID NO: 1228509 - RNA, 16 nt, Homo sapiens
ccaggcugucaggggc

SEQ ID NO: 1228510 - RNA, 14 nt, Homo sapiens
ccaggcuuuguaca

SEQ ID NO: 1228511 - RNA, 20 nt, Homo sapiens
ccagggaagaagaucaacgc

SEQ ID NO: 1228512 - RNA, 12 nt, Homo sapiens
ccagggagaccc

SEQ ID NO: 1228513 - RNA, 16 nt, Homo sapiens
ccagggaggagucagu

SEQ ID NO: 1228514 - RNA, 17 nt, Homo sapiens
ccagggaggagucagua

SEQ ID NO: 1228515 - RNA, 16 nt, Homo sapiens
ccagggagugguuugg

SEQ ID NO: 1228516 - RNA, 13 nt, Homo sapiens
ccagggccaagag

SEQ ID NO: 1228517 - RNA, 17 nt, Homo sapiens
ccagggcucugccccag

SEQ ID NO: 1228518 - RNA, 18 nt, Homo sapiens
ccaggggaaccugccaug

SEQ ID NO: 1228519 - RNA, 15 nt, Homo sapiens
ccaggggcccgggaa

SEQ ID NO: 1228520 - RNA, 22 nt, Homo sapiens
ccaggggcccuugggacagcca

SEQ ID NO: 1228521 - RNA, 23 nt, Homo sapiens
ccaggguccacugaagggacccu

SEQ ID NO: 1228522 - RNA, 19 nt, Homo sapiens
ccaggucaggaugcacauu

SEQ ID NO: 1228523 - RNA, 22 nt, Homo sapiens
ccaggucaggaugcacauuucu

SEQ ID NO: 1228524 - RNA, 11 nt, Homo sapiens
ccagguccuuu

SEQ ID NO: 1228525 - RNA, 17 nt, Homo sapiens
ccaggucuuccagaccu

SEQ ID NO: 1228526 - RNA, 18 nt, Homo sapiens
ccagguguggugacucac

SEQ ID NO: 1228527 - RNA, 15 nt, Homo sapiens
ccagguuacauucua

SEQ ID NO: 1228528 - RNA, 21 nt, Homo sapiens
ccagguucaagcuauucucau

SEQ ID NO: 1228529 - RNA, 22 nt, Homo sapiens
ccagguuuaaccguugcgucac

SEQ ID NO: 1228530 - RNA, 23 nt, Homo sapiens
ccagguuuuacacuugcaucucu

SEQ ID NO: 1228531 - RNA, 16 nt, Homo sapiens
ccaguacgugcuaaca

SEQ ID NO: 1228532 - RNA, 15 nt, Homo sapiens
ccaguaugacaguau

SEQ ID NO: 1228533 - RNA, 22 nt, Homo sapiens
ccaguauuuuuauuucuuuaau

SEQ ID NO: 1228534 - RNA, 17 nt, Homo sapiens
ccagucacuuugccaga

SEQ ID NO: 1228535 - RNA, 15 nt, Homo sapiens
ccagucccaaugcac

SEQ ID NO: 1228536 - RNA, 19 nt, Homo sapiens
ccagucccagcuaacucug

SEQ ID NO: 1228537 - RNA, 18 nt, Homo sapiens
ccagucggccccaucucu

SEQ ID NO: 1228538 - RNA, 14 nt, Homo sapiens
ccagucucagacac

SEQ ID NO: 1228539 - RNA, 18 nt, Homo sapiens
ccagugaaucuguuucag

SEQ ID NO: 1228540 - RNA, 13 nt, Homo sapiens
ccagugaccccag

SEQ ID NO: 1228541 - RNA, 14 nt, Homo sapiens
ccagugagacugug

SEQ ID NO: 1228542 - RNA, 18 nt, Homo sapiens
ccagugcaacagcacugg

SEQ ID NO: 1228543 - RNA, 13 nt, Homo sapiens
ccagugccaagga

SEQ ID NO: 1228544 - RNA, 16 nt, Homo sapiens
ccagugccagcaauag

SEQ ID NO: 1228545 - RNA, 20 nt, Homo sapiens
ccagugccauuccacuccac

SEQ ID NO: 1228546 - RNA, 19 nt, Homo sapiens
ccagugccuucugucugcu

SEQ ID NO: 1228547 - RNA, 22 nt, Homo sapiens
ccaguguccccuccacugucac

SEQ ID NO: 1228548 - RNA, 22 nt, Homo sapiens
cuggguaagaagaaagcaaaag

SEQ ID NO: 1228549 - RNA, 18 nt, Homo sapiens
cuggguauguuccuaagg

SEQ ID NO: 1228550 - RNA, 19 nt, Homo sapiens
cugggugaccucacuuuag

SEQ ID NO: 1228551 - RNA, 12 nt, Homo sapiens
cuggguggugga

SEQ ID NO: 1228552 - RNA, 20 nt, Homo sapiens
cuggguuaauggcuaguacu

SEQ ID NO: 1228553 - RNA, 20 nt, Homo sapiens
cuggguuuggaccccagcug

SEQ ID NO: 1228554 - RNA, 20 nt, Homo sapiens
cugguagaaaggcaguucag

SEQ ID NO: 1228555 - RNA, 15 nt, Homo sapiens
cugguauauacauau

SEQ ID NO: 1228556 - RNA, 16 nt, Homo sapiens
cugguauauccaaaag

SEQ ID NO: 1228557 - RNA, 15 nt, Homo sapiens
cugguauguguggau

SEQ ID NO: 1228558 - RNA, 16 nt, Homo sapiens
cugguauuguucucac

SEQ ID NO: 1228559 - RNA, 16 nt, Homo sapiens
cuggucagcauguacu

SEQ ID NO: 1228560 - RNA, 21 nt, Homo sapiens
cuggucagcauguacuccccu

SEQ ID NO: 1228561 - RNA, 16 nt, Homo sapiens
cuggucccaagacagu

SEQ ID NO: 1228562 - RNA, 19 nt, Homo sapiens
cugguccccuccucaguga

SEQ ID NO: 1228563 - RNA, 22 nt, Homo sapiens
cuggucccggggccagcacuuc

SEQ ID NO: 1228564 - RNA, 15 nt, Homo sapiens
cuggucccucugagg

SEQ ID NO: 1228565 - RNA, 16 nt, Homo sapiens
cuggucccucugaggc

SEQ ID NO: 1228566 - RNA, 16 nt, Homo sapiens
cugguccugaucccag

SEQ ID NO: 1228567 - RNA, 21 nt, Homo sapiens
cuggucuccguggcacuugua

SEQ ID NO: 1228568 - RNA, 16 nt, Homo sapiens
cuggucuuggugaaca

SEQ ID NO: 1228569 - RNA, 16 nt, Homo sapiens
cuggugacaggccaaa

SEQ ID NO: 1228570 - RNA, 13 nt, Homo sapiens
cuggugccauuuc

SEQ ID NO: 1228571 - RNA, 12 nt, Homo sapiens
cugguggagcug

SEQ ID NO: 1228572 - RNA, 23 nt, Homo sapiens
cuggugggccuuucuguguccua

SEQ ID NO: 1228573 - RNA, 16 nt, Homo sapiens
cuggugggcggggcca

SEQ ID NO: 1228574 - RNA, 19 nt, Homo sapiens
cugguggggaucagacaga

SEQ ID NO: 1228575 - RNA, 21 nt, Homo sapiens
cuggugugcagggugaagcag

SEQ ID NO: 1228576 - RNA, 15 nt, Homo sapiens
cugguguuggggaaa

SEQ ID NO: 1228577 - RNA, 19 nt, Homo sapiens
cugguguuuuaugggccac

SEQ ID NO: 1228578 - RNA, 19 nt, Homo sapiens
cugguugucauuuuugcag

SEQ ID NO: 1228579 - RNA, 14 nt, Homo sapiens
cugguuuacuucaa

SEQ ID NO: 1228580 - RNA, 19 nt, Homo sapiens
cugguuugaaagauuauga

SEQ ID NO: 1228581 - RNA, 17 nt, Homo sapiens
cuguaaaaacacugaaa

SEQ ID NO: 1228582 - RNA, 16 nt, Homo sapiens
cuguaaaacagguuau

SEQ ID NO: 1228583 - RNA, 19 nt, Homo sapiens
cuguaaaauuaaacaaaua

SEQ ID NO: 1228584 - RNA, 23 nt, Homo sapiens
cuguaaacuguguauuccaagac

SEQ ID NO: 1228585 - RNA, 21 nt, Homo sapiens
cuguaaagauguuuauuucag

SEQ ID NO: 1228586 - RNA, 14 nt, Homo sapiens
cuguaaauaccauu

SEQ ID NO: 1228587 - RNA, 21 nt, Homo sapiens
cuguaaauacuguaaaugcau

SEQ ID NO: 1228588 - RNA, 23 nt, Homo sapiens
cuguaacccuggcacuuaagggg

SEQ ID NO: 1228589 - RNA, 16 nt, Homo sapiens
cuguaagcucuuugaa

SEQ ID NO: 1228590 - RNA, 18 nt, Homo sapiens
cuguaagguggacuucca

SEQ ID NO: 1228591 - RNA, 19 nt, Homo sapiens
cuguaagguggacuuccag

SEQ ID NO: 1228592 - RNA, 21 nt, Homo sapiens
cuguaagguggacuuccagcu

SEQ ID NO: 1228593 - RNA, 20 nt, Homo sapiens
cuguaaucagcucuccuggc

SEQ ID NO: 1228594 - RNA, 18 nt, Homo sapiens
cuguaaucccagcacuuu

SEQ ID NO: 1228595 - RNA, 21 nt, Homo sapiens
cuguaaucccagcacuuugau

SEQ ID NO: 1228596 - RNA, 21 nt, Homo sapiens
cuguaaucccagcacuuuggg

SEQ ID NO: 1228597 - RNA, 23 nt, Homo sapiens
cuguaaucccagcacuuugggag

SEQ ID NO: 1228598 - RNA, 21 nt, Homo sapiens
cuguaaucccagcuacuuggg

SEQ ID NO: 1228599 - RNA, 17 nt, Homo sapiens
cuguaaucucagcacuu

SEQ ID NO: 1228600 - RNA, 12 nt, Homo sapiens
cuguaaugacaa

SEQ ID NO: 1228601 - RNA, 16 nt, Homo sapiens
cuguaauugaauauaa

SEQ ID NO: 1228602 - RNA, 15 nt, Homo sapiens
cuguacacacuuuau

SEQ ID NO: 1228603 - RNA, 15 nt, Homo sapiens
cuguacacagaauug

SEQ ID NO: 1228604 - RNA, 12 nt, Homo sapiens
cuguaccaguua

SEQ ID NO: 1228605 - RNA, 13 nt, Homo sapiens
cuguaccauuuau

SEQ ID NO: 1228606 - RNA, 14 nt, Homo sapiens
cuguagaaaugaug

SEQ ID NO: 1228607 - RNA, 20 nt, Homo sapiens
cuguagcgccaguguaaucc

SEQ ID NO: 1228608 - RNA, 19 nt, Homo sapiens
cuguaggcacacuuugcac

SEQ ID NO: 1228609 - RNA, 15 nt, Homo sapiens
cuguagguucuugau

SEQ ID NO: 1228610 - RNA, 13 nt, Homo sapiens
cuguauacuuuag

SEQ ID NO: 1228611 - RNA, 20 nt, Homo sapiens
cuguauacuuuaguaugacg

SEQ ID NO: 1228612 - RNA, 18 nt, Homo sapiens
cuguauuccgauacaaag

SEQ ID NO: 1228613 - RNA, 21 nt, Homo sapiens
cuguauuccgauacaaagugu

SEQ ID NO: 1228614 - RNA, 12 nt, Homo sapiens
cuguauugccau

SEQ ID NO: 1228615 - RNA, 22 nt, Homo sapiens
cuguauugucugaacuugcauu

SEQ ID NO: 1228616 - RNA, 23 nt, Homo sapiens
cuguauuuguaucucugaagcau

SEQ ID NO: 1228617 - RNA, 21 nt, Homo sapiens
cuguauuuucgggauucuuug

SEQ ID NO: 1228618 - RNA, 22 nt, Homo sapiens
cugucaagaagaggaaagggag

SEQ ID NO: 1228619 - RNA, 23 nt, Homo sapiens
cugucaagcaccugcaugugcug

SEQ ID NO: 1228620 - RNA, 18 nt, Homo sapiens
cugucaauaaacagcuuc

SEQ ID NO: 1228621 - RNA, 19 nt, Homo sapiens
cugucaauacuauggagua

SEQ ID NO: 1228622 - RNA, 16 nt, Homo sapiens
cugucacagaguagaa

SEQ ID NO: 1228623 - RNA, 18 nt, Homo sapiens
cugucacauaaugcucau

SEQ ID NO: 1228624 - RNA, 13 nt, Homo sapiens
cugucacccaggc

SEQ ID NO: 1228625 - RNA, 21 nt, Homo sapiens
cugucacguucuccacacggg

SEQ ID NO: 1228626 - RNA, 18 nt, Homo sapiens
cugucacuagucucacca

SEQ ID NO: 1228627 - RNA, 12 nt, Homo sapiens
cugucacucuag

SEQ ID NO: 1228628 - RNA, 23 nt, Homo sapiens
cugucagaaaaagcuagcacuaa

SEQ ID NO: 1228629 - RNA, 18 nt, Homo sapiens
cugucagcuuccaaacau

SEQ ID NO: 1228630 - RNA, 11 nt, Homo sapiens
cugucagggac

SEQ ID NO: 1228631 - RNA, 24 nt, Homo sapiens
cugucaugaaaucagcaagagagg

SEQ ID NO: 1228632 - RNA, 16 nt, Homo sapiens
cugucauuuguuguga

SEQ ID NO: 1228633 - RNA, 12 nt, Homo sapiens
cuguccaaagac

SEQ ID NO: 1228634 - RNA, 18 nt, Homo sapiens
cuguccagcuuauagucu

SEQ ID NO: 1228635 - RNA, 22 nt, Homo sapiens
cuguccaucagccaggacaguc

SEQ ID NO: 1228636 - RNA, 13 nt, Homo sapiens
cugucccagagag

SEQ ID NO: 1228637 - RNA, 20 nt, Homo sapiens
cugucccccuacccaccgau

SEQ ID NO: 1228638 - RNA, 16 nt, Homo sapiens
cuguccguucacaugu

SEQ ID NO: 1228639 - RNA, 22 nt, Homo sapiens
cuguccguucacauguguggua

SEQ ID NO: 1228640 - RNA, 15 nt, Homo sapiens
cuguccuaagcacuu

SEQ ID NO: 1228641 - RNA, 19 nt, Homo sapiens
cuguccuaaggaaccuucc

SEQ ID NO: 1228642 - RNA, 20 nt, Homo sapiens
cuguccucucccaacucaag

SEQ ID NO: 1228643 - RNA, 17 nt, Homo sapiens
cuguccugaccaucgca

SEQ ID NO: 1228644 - RNA, 18 nt, Homo sapiens
cuguccugaucugugaua

SEQ ID NO: 1228645 - RNA, 12 nt, Homo sapiens
cuguccuugccc

SEQ ID NO: 1228646 - RNA, 22 nt, Homo sapiens
cuguccuuuuggcacugagaua

SEQ ID NO: 1228647 - RNA, 14 nt, Homo sapiens
cugucgcccagucu

SEQ ID NO: 1228648 - RNA, 16 nt, Homo sapiens
cugucuacccagugcu

SEQ ID NO: 1228649 - RNA, 20 nt, Homo sapiens
cugucugagaauuuccaaaa

SEQ ID NO: 1228650 - RNA, 19 nt, Homo sapiens
cugucugagacucacagga

SEQ ID NO: 1228651 - RNA, 15 nt, Homo sapiens
cugucugcccuaggg

SEQ ID NO: 1228652 - RNA, 16 nt, Homo sapiens
cugucuggcugaggau

SEQ ID NO: 1228653 - RNA, 20 nt, Homo sapiens
cugucugggauuaagggcaa

SEQ ID NO: 1228654 - RNA, 23 nt, Homo sapiens
cugucuuaaaugagaaguacuug

SEQ ID NO: 1228655 - RNA, 19 nt, Homo sapiens
cugucuuacuauuauagca

SEQ ID NO: 1228656 - RNA, 16 nt, Homo sapiens
cugucuugaugacugc

SEQ ID NO: 1228657 - RNA, 13 nt, Homo sapiens
cugugaaauacca

SEQ ID NO: 1228658 - RNA, 16 nt, Homo sapiens
cugugaaauaccacaa

SEQ ID NO: 1228659 - RNA, 20 nt, Homo sapiens
cugugaaauucacaguaaua

SEQ ID NO: 1228660 - RNA, 14 nt, Homo sapiens
cugugaaugcugag

SEQ ID NO: 1228661 - RNA, 22 nt, Homo sapiens
cugugacauacauauuaucuca

SEQ ID NO: 1228662 - RNA, 16 nt, Homo sapiens
cugugacccaucugua

SEQ ID NO: 1228663 - RNA, 18 nt, Homo sapiens
cugugacuucuccagguc

SEQ ID NO: 1228664 - RNA, 22 nt, Homo sapiens
cugugaggguagaaaaccucac

SEQ ID NO: 1228665 - RNA, 12 nt, Homo sapiens
cugugaucccag

SEQ ID NO: 1228666 - RNA, 21 nt, Homo sapiens
cugugauuucuuucuuugcac

SEQ ID NO: 1228667 - RNA, 22 nt, Homo sapiens
cugugcacgcgcgcgugcacac

SEQ ID NO: 1228668 - RNA, 18 nt, Homo sapiens
cugugcagagaugacugu

SEQ ID NO: 1228669 - RNA, 18 nt, Homo sapiens
cugugcaucuagccucaa

SEQ ID NO: 1228670 - RNA, 13 nt, Homo sapiens
cugugccacuuug

SEQ ID NO: 1228671 - RNA, 18 nt, Homo sapiens
cugugccagagauguacu

SEQ ID NO: 1228672 - RNA, 23 nt, Homo sapiens
cugugcccagcacagugccugac

SEQ ID NO: 1228673 - RNA, 21 nt, Homo sapiens
cuuucccagucccauuccuca

SEQ ID NO: 1228674 - RNA, 22 nt, Homo sapiens
cuuucccagucccauuccucag

SEQ ID NO: 1228675 - RNA, 23 nt, Homo sapiens
cuuucccauucuguuuggaucua

SEQ ID NO: 1228676 - RNA, 18 nt, Homo sapiens
cuuucccucauccaugcu

SEQ ID NO: 1228677 - RNA, 18 nt, Homo sapiens
cuuucccuucuuggugcu

SEQ ID NO: 1228678 - RNA, 15 nt, Homo sapiens
cuuucccuuuaucag

SEQ ID NO: 1228679 - RNA, 18 nt, Homo sapiens
cuuuccuacacacucuga

SEQ ID NO: 1228680 - RNA, 16 nt, Homo sapiens
cuuuccucagaucauc

SEQ ID NO: 1228681 - RNA, 20 nt, Homo sapiens
cuuuccucgccugacaacca

SEQ ID NO: 1228682 - RNA, 20 nt, Homo sapiens
cuuuccucucuuuguucuca

SEQ ID NO: 1228683 - RNA, 10 nt, Homo sapiens
cuuuccugcc

SEQ ID NO: 1228684 - RNA, 23 nt, Homo sapiens
cuuuccuguuucuaucuuucauu

SEQ ID NO: 1228685 - RNA, 12 nt, Homo sapiens
cuuuccuuccau

SEQ ID NO: 1228686 - RNA, 15 nt, Homo sapiens
cuuucuaaacuacaa

SEQ ID NO: 1228687 - RNA, 17 nt, Homo sapiens
cuuucuaaauugcauga

SEQ ID NO: 1228688 - RNA, 19 nt, Homo sapiens
cuuucucaguucagaguug

SEQ ID NO: 1228689 - RNA, 17 nt, Homo sapiens
cuuucuccaggaccaau

SEQ ID NO: 1228690 - RNA, 18 nt, Homo sapiens
cuuucuccaggaccaaua

SEQ ID NO: 1228691 - RNA, 14 nt, Homo sapiens
cuuucucccaguga

SEQ ID NO: 1228692 - RNA, 14 nt, Homo sapiens
cuuucucucucuaa

SEQ ID NO: 1228693 - RNA, 17 nt, Homo sapiens
cuuucugcacacaaaua

SEQ ID NO: 1228694 - RNA, 15 nt, Homo sapiens
cuuucugggccaagu

SEQ ID NO: 1228695 - RNA, 22 nt, Homo sapiens
cuuucugugcagagaugacugu

SEQ ID NO: 1228696 - RNA, 15 nt, Homo sapiens
cuuucuguugaauga

SEQ ID NO: 1228697 - RNA, 15 nt, Homo sapiens
cuuucuuccuuucua

SEQ ID NO: 1228698 - RNA, 20 nt, Homo sapiens
cuuucuugaaaagaagcaag

SEQ ID NO: 1228699 - RNA, 11 nt, Homo sapiens
cuuucuugucu

SEQ ID NO: 1228700 - RNA, 17 nt, Homo sapiens
cuuucuuuaccugagac

SEQ ID NO: 1228701 - RNA, 18 nt, Homo sapiens
cuuucuuugcaccaaaga

SEQ ID NO: 1228702 - RNA, 17 nt, Homo sapiens
cuuucuuuggugccuuu

SEQ ID NO: 1228703 - RNA, 15 nt, Homo sapiens
cuuugaaauaccuca

SEQ ID NO: 1228704 - RNA, 17 nt, Homo sapiens
cuuugaaccugugcaau

SEQ ID NO: 1228705 - RNA, 17 nt, Homo sapiens
cuuugaagaccaguccu

SEQ ID NO: 1228706 - RNA, 22 nt, Homo sapiens
cuuugacaauuacucagguuug

SEQ ID NO: 1228707 - RNA, 13 nt, Homo sapiens
cuuugacauauug

SEQ ID NO: 1228708 - RNA, 22 nt, Homo sapiens
cuuugaggugucucaaucugau

SEQ ID NO: 1228709 - RNA, 22 nt, Homo sapiens
cuuugaucccugacaucuggaa

SEQ ID NO: 1228710 - RNA, 20 nt, Homo sapiens
cuuugauucuccaguauucc

SEQ ID NO: 1228711 - RNA, 11 nt, Homo sapiens
cuuugcacuug

SEQ ID NO: 1228712 - RNA, 16 nt, Homo sapiens
cuuugccaauucauuu

SEQ ID NO: 1228713 - RNA, 14 nt, Homo sapiens
cuuugccacacaca

SEQ ID NO: 1228714 - RNA, 20 nt, Homo sapiens
cuuuggaaacaggaccacaa

SEQ ID NO: 1228715 - RNA, 18 nt, Homo sapiens
cuuuggaagauggcauaa

SEQ ID NO: 1228716 - RNA, 17 nt, Homo sapiens
cuuuggaagucaugagc

SEQ ID NO: 1228717 - RNA, 14 nt, Homo sapiens
cuuuggaaguccag

SEQ ID NO: 1228718 - RNA, 20 nt, Homo sapiens
cuuuggauccugggucaaaa

SEQ ID NO: 1228719 - RNA, 14 nt, Homo sapiens
cuuuggccauucca

SEQ ID NO: 1228720 - RNA, 14 nt, Homo sapiens
cuuugggaccugcu

SEQ ID NO: 1228721 - RNA, 18 nt, Homo sapiens
cuuugggauucuuuccau

SEQ ID NO: 1228722 - RNA, 19 nt, Homo sapiens
cuuuggggacaguuggcag

SEQ ID NO: 1228723 - RNA, 21 nt, Homo sapiens
cuuuggggagguguucacuga

SEQ ID NO: 1228724 - RNA, 23 nt, Homo sapiens
cuuuggggcauagaucagaagac

SEQ ID NO: 1228725 - RNA, 21 nt, Homo sapiens
cuuugguaaucucugugaaau

SEQ ID NO: 1228726 - RNA, 18 nt, Homo sapiens
cuuuggucauaugagcuu

SEQ ID NO: 1228727 - RNA, 18 nt, Homo sapiens
cuuuguaagaguguagaa

SEQ ID NO: 1228728 - RNA, 15 nt, Homo sapiens
cuuuguaauaccaga

SEQ ID NO: 1228729 - RNA, 19 nt, Homo sapiens
cuuuguaaucacucccauu

SEQ ID NO: 1228730 - RNA, 14 nt, Homo sapiens
cuuuguacccccca

SEQ ID NO: 1228731 - RNA, 15 nt, Homo sapiens
cuuuguaugcacuuu

SEQ ID NO: 1228732 - RNA, 17 nt, Homo sapiens
cuuugucccggggcucc

SEQ ID NO: 1228733 - RNA, 12 nt, Homo sapiens
cuuugucugugg

SEQ ID NO: 1228734 - RNA, 20 nt, Homo sapiens
cuuugugagccuaugauauu

SEQ ID NO: 1228735 - RNA, 19 nt, Homo sapiens
cuuuguguagaaagccaaa

SEQ ID NO: 1228736 - RNA, 20 nt, Homo sapiens
cuuuguguagaaagccaaau

SEQ ID NO: 1228737 - RNA, 16 nt, Homo sapiens
cuuugugugauugaau

SEQ ID NO: 1228738 - RNA, 16 nt, Homo sapiens
cuuuguuaucuuccac

SEQ ID NO: 1228739 - RNA, 15 nt, Homo sapiens
cuuuguuuauuguaa

SEQ ID NO: 1228740 - RNA, 20 nt, Homo sapiens
cuuuguuuggauguaauuua

SEQ ID NO: 1228741 - RNA, 20 nt, Homo sapiens
cuuuuaaaaaauacucugcu

SEQ ID NO: 1228742 - RNA, 16 nt, Homo sapiens
cuuuuaaaauacauuu

SEQ ID NO: 1228743 - RNA, 23 nt, Homo sapiens
cuuuuaaagaaaaauaugauacu

SEQ ID NO: 1228744 - RNA, 18 nt, Homo sapiens
cuuuuaacagaacagaca

SEQ ID NO: 1228745 - RNA, 15 nt, Homo sapiens
cuuuuaacauaauau

SEQ ID NO: 1228746 - RNA, 18 nt, Homo sapiens
cuuuuaagaaacauucuu

SEQ ID NO: 1228747 - RNA, 23 nt, Homo sapiens
cuuuuaagccagguuacauucua

SEQ ID NO: 1228748 - RNA, 17 nt, Homo sapiens
cuuuuacagacuagcag

SEQ ID NO: 1228749 - RNA, 18 nt, Homo sapiens
cuuuuacagguuaagaca

SEQ ID NO: 1228750 - RNA, 12 nt, Homo sapiens
cuuuuacauucu

SEQ ID NO: 1228751 - RNA, 21 nt, Homo sapiens
cuuuuacccggcacauucccc

SEQ ID NO: 1228752 - RNA, 17 nt, Homo sapiens
cuuuuagaaauacugca

SEQ ID NO: 1228753 - RNA, 14 nt, Homo sapiens
cuuuuauagaggcu

SEQ ID NO: 1228754 - RNA, 21 nt, Homo sapiens
cuuuuaugauauauauaugcu

SEQ ID NO: 1228755 - RNA, 14 nt, Homo sapiens
cuuuuaugccuuca

SEQ ID NO: 1228756 - RNA, 14 nt, Homo sapiens
cuuuuauguagcac

SEQ ID NO: 1228757 - RNA, 21 nt, Homo sapiens
cuuuuauguaguaauugacau

SEQ ID NO: 1228758 - RNA, 12 nt, Homo sapiens
cuuuuauuacau

SEQ ID NO: 1228759 - RNA, 16 nt, Homo sapiens
cuuuuauuugcaacau

SEQ ID NO: 1228760 - RNA, 21 nt, Homo sapiens
cuuuucaaggaaaaaugcugc

SEQ ID NO: 1228761 - RNA, 16 nt, Homo sapiens
cuuuucaccaggggug

SEQ ID NO: 1228762 - RNA, 13 nt, Homo sapiens
cuuuucaggguuu

SEQ ID NO: 1228763 - RNA, 16 nt, Homo sapiens
cuuuucauuuggaaug

SEQ ID NO: 1228764 - RNA, 12 nt, Homo sapiens
cuuuuccagaag

SEQ ID NO: 1228765 - RNA, 14 nt, Homo sapiens
cuuuuccagaguau

SEQ ID NO: 1228766 - RNA, 22 nt, Homo sapiens
cuuuuccaugcacccucauaca

SEQ ID NO: 1228767 - RNA, 17 nt, Homo sapiens
cuuuucccauugccaug

SEQ ID NO: 1228768 - RNA, 18 nt, Homo sapiens
cuuuucccauugccaugc

SEQ ID NO: 1228769 - RNA, 15 nt, Homo sapiens
cuuuuccccaaccac

SEQ ID NO: 1228770 - RNA, 22 nt, Homo sapiens
cuuuuccugaauuggaaaggaa

SEQ ID NO: 1228771 - RNA, 19 nt, Homo sapiens
cuuuuccugauaaagcaca

SEQ ID NO: 1228772 - RNA, 15 nt, Homo sapiens
cuuuucuacauacau

SEQ ID NO: 1228773 - RNA, 22 nt, Homo sapiens
cuuuucucugagacauuccacc

SEQ ID NO: 1228774 - RNA, 13 nt, Homo sapiens
cuuuucugaauua

SEQ ID NO: 1228775 - RNA, 12 nt, Homo sapiens
cuuuucugccac

SEQ ID NO: 1228776 - RNA, 14 nt, Homo sapiens
cuuuucugccacag

SEQ ID NO: 1228777 - RNA, 17 nt, Homo sapiens
cuuuucugccacuccau

SEQ ID NO: 1228778 - RNA, 14 nt, Homo sapiens
cuuuucuuggcaaa

SEQ ID NO: 1228779 - RNA, 15 nt, Homo sapiens
cuuuucuuuccucag

SEQ ID NO: 1228780 - RNA, 16 nt, Homo sapiens
cuuuugaaauccagaa

SEQ ID NO: 1228781 - RNA, 20 nt, Homo sapiens
cuuuugacacugcucuaaca

SEQ ID NO: 1228782 - RNA, 19 nt, Homo sapiens
cuuuugcaugucgcacaau

SEQ ID NO: 1228783 - RNA, 13 nt, Homo sapiens
cuuuugcauuaaa

SEQ ID NO: 1228784 - RNA, 16 nt, Homo sapiens
cuuuugccaguauuau

SEQ ID NO: 1228785 - RNA, 23 nt, Homo sapiens
cuuuugcugcgcaccaaugccca

SEQ ID NO: 1228786 - RNA, 13 nt, Homo sapiens
cuuuugcugugau

SEQ ID NO: 1228787 - RNA, 20 nt, Homo sapiens
cuuuugcuucaguugcauau

SEQ ID NO: 1228788 - RNA, 13 nt, Homo sapiens
cuuuugcuugcaa

SEQ ID NO: 1228789 - RNA, 16 nt, Homo sapiens
cuuuuggcaguucuga

SEQ ID NO: 1228790 - RNA, 20 nt, Homo sapiens
cuuuuggugaaagcugagaa

SEQ ID NO: 1228791 - RNA, 14 nt, Homo sapiens
cuuuugucugcaau

SEQ ID NO: 1228792 - RNA, 16 nt, Homo sapiens
cuuuugugugaugcgc

SEQ ID NO: 1228793 - RNA, 18 nt, Homo sapiens
cuuuuguuuugaguuacu

SEQ ID NO: 1228794 - RNA, 16 nt, Homo sapiens
cuuuuuacucaaagag

SEQ ID NO: 1228795 - RNA, 16 nt, Homo sapiens
cuuuuuauuagagcuc

SEQ ID NO: 1228796 - RNA, 19 nt, Homo sapiens
cuuuuuauucccugcccaa

SEQ ID NO: 1228797 - RNA, 17 nt, Homo sapiens
cuuuuucauauguugcu

SEQ ID NO: 1228798 - RNA, 18 nt, Homo sapiens
cuuuuucauauuucuacc

SEQ ID NO: 1228799 - RNA, 18 nt, Homo sapiens
ggccaugagggacagggu

SEQ ID NO: 1228800 - RNA, 15 nt, Homo sapiens
ggccaugauggccuu

SEQ ID NO: 1228801 - RNA, 14 nt, Homo sapiens
ggccauggugcaca

SEQ ID NO: 1228802 - RNA, 23 nt, Homo sapiens
ggccauuccaacagcucaagucu

SEQ ID NO: 1228803 - RNA, 21 nt, Homo sapiens
ggcccaagugaggagugccag

SEQ ID NO: 1228804 - RNA, 16 nt, Homo sapiens
ggcccaccgaggugcu

SEQ ID NO: 1228805 - RNA, 17 nt, Homo sapiens
ggcccagagcaggaagc

SEQ ID NO: 1228806 - RNA, 13 nt, Homo sapiens
ggcccagccuugu

SEQ ID NO: 1228807 - RNA, 18 nt, Homo sapiens
ggcccaggaauuagagaa

SEQ ID NO: 1228808 - RNA, 20 nt, Homo sapiens
ggcccaggagaccacgggga

SEQ ID NO: 1228809 - RNA, 13 nt, Homo sapiens
ggcccagugacaa

SEQ ID NO: 1228810 - RNA, 16 nt, Homo sapiens
ggcccauaucugugaa

SEQ ID NO: 1228811 - RNA, 16 nt, Homo sapiens
ggccccagaucugccu

SEQ ID NO: 1228812 - RNA, 13 nt, Homo sapiens
ggccccaucccag

SEQ ID NO: 1228813 - RNA, 23 nt, Homo sapiens
ggccccguggugacauuucccaa

SEQ ID NO: 1228814 - RNA, 16 nt, Homo sapiens
ggccccugcccggcug

SEQ ID NO: 1228815 - RNA, 23 nt, Homo sapiens
ggcccgcaccgcugggagucuga

SEQ ID NO: 1228816 - RNA, 23 nt, Homo sapiens
ggcccggccagcgggcacagggc

SEQ ID NO: 1228817 - RNA, 20 nt, Homo sapiens
ggcccuggagaccuccaggc

SEQ ID NO: 1228818 - RNA, 18 nt, Homo sapiens
ggcccuguuccccaagga

SEQ ID NO: 1228819 - RNA, 23 nt, Homo sapiens
ggcccuuccucuccacugccuuc

SEQ ID NO: 1228820 - RNA, 21 nt, Homo sapiens
ggcccuucuugccuacuaugc

SEQ ID NO: 1228821 - RNA, 13 nt, Homo sapiens
ggccgagagcaga

SEQ ID NO: 1228822 - RNA, 19 nt, Homo sapiens
ggccgcagcucuugcccuu

SEQ ID NO: 1228823 - RNA, 17 nt, Homo sapiens
ggccggcugugcucaga

SEQ ID NO: 1228824 - RNA, 20 nt, Homo sapiens
ggccggcugugcucagagac

SEQ ID NO: 1228825 - RNA, 22 nt, Homo sapiens
ggccgggccuagaccuggugcu

SEQ ID NO: 1228826 - RNA, 13 nt, Homo sapiens
ggccgugcagugg

SEQ ID NO: 1228827 - RNA, 22 nt, Homo sapiens
ggccucaagagcacacagagaa

SEQ ID NO: 1228828 - RNA, 17 nt, Homo sapiens
ggccuccaaacacagau

SEQ ID NO: 1228829 - RNA, 13 nt, Homo sapiens
ggccuccaugacc

SEQ ID NO: 1228830 - RNA, 14 nt, Homo sapiens
ggccuccaugaccu

SEQ ID NO: 1228831 - RNA, 16 nt, Homo sapiens
ggccuccugugugugc

SEQ ID NO: 1228832 - RNA, 16 nt, Homo sapiens
ggccucucucaaaaga

SEQ ID NO: 1228833 - RNA, 16 nt, Homo sapiens
ggccucugagaagcuc

SEQ ID NO: 1228834 - RNA, 15 nt, Homo sapiens
ggccugaacaaaaua

SEQ ID NO: 1228835 - RNA, 15 nt, Homo sapiens
ggccugcacacaagc

SEQ ID NO: 1228836 - RNA, 17 nt, Homo sapiens
ggccuggcaagugggug

SEQ ID NO: 1228837 - RNA, 21 nt, Homo sapiens
ggccuggggcgagcacuguga

SEQ ID NO: 1228838 - RNA, 17 nt, Homo sapiens
ggccuggguuuguacuu

SEQ ID NO: 1228839 - RNA, 16 nt, Homo sapiens
ggccuugcuaccucaa

SEQ ID NO: 1228840 - RNA, 13 nt, Homo sapiens
ggccuugcugagu

SEQ ID NO: 1228841 - RNA, 13 nt, Homo sapiens
ggccuuguaagac

SEQ ID NO: 1228842 - RNA, 16 nt, Homo sapiens
ggccuuuaagaaccuu

SEQ ID NO: 1228843 - RNA, 21 nt, Homo sapiens
ggccuuuccuggcugaucaga

SEQ ID NO: 1228844 - RNA, 19 nt, Homo sapiens
ggcgacagagcgagacucc

SEQ ID NO: 1228845 - RNA, 15 nt, Homo sapiens
ggcgacuccaucuca

SEQ ID NO: 1228846 - RNA, 21 nt, Homo sapiens
ggcgagagguggagugucaca

SEQ ID NO: 1228847 - RNA, 16 nt, Homo sapiens
ggcggcugugcaucag

SEQ ID NO: 1228848 - RNA, 18 nt, Homo sapiens
ggcuaagaggcugcugaa

SEQ ID NO: 1228849 - RNA, 13 nt, Homo sapiens
ggcuaccuacaua

SEQ ID NO: 1228850 - RNA, 21 nt, Homo sapiens
ggcuacuaccuagggcacuuu

SEQ ID NO: 1228851 - RNA, 22 nt, Homo sapiens
ggcuacuaccuagggcacuuua

SEQ ID NO: 1228852 - RNA, 16 nt, Homo sapiens
ggcuagguaucauuca

SEQ ID NO: 1228853 - RNA, 17 nt, Homo sapiens
ggcuauggaggguccuc

SEQ ID NO: 1228854 - RNA, 22 nt, Homo sapiens
ggcuauguugagcugagaucac

SEQ ID NO: 1228855 - RNA, 17 nt, Homo sapiens
ggcuauuuggacucagg

SEQ ID NO: 1228856 - RNA, 15 nt, Homo sapiens
ggcucaacauugugu

SEQ ID NO: 1228857 - RNA, 19 nt, Homo sapiens
ggcucacacugugcucaga

SEQ ID NO: 1228858 - RNA, 16 nt, Homo sapiens
ggcucagucucaggag

SEQ ID NO: 1228859 - RNA, 23 nt, Homo sapiens
ggcuccaacacugcaacaugggg

SEQ ID NO: 1228860 - RNA, 18 nt, Homo sapiens
ggcucccacuucuuggga

SEQ ID NO: 1228861 - RNA, 17 nt, Homo sapiens
ggcuccuuuacaaaaga

SEQ ID NO: 1228862 - RNA, 15 nt, Homo sapiens
ggcucuaauguacaa

SEQ ID NO: 1228863 - RNA, 21 nt, Homo sapiens
ggcucuaauguacaauaaagc

SEQ ID NO: 1228864 - RNA, 15 nt, Homo sapiens
ggcucuaucuuccuc

SEQ ID NO: 1228865 - RNA, 17 nt, Homo sapiens
ggcucucauggggucca

SEQ ID NO: 1228866 - RNA, 19 nt, Homo sapiens
ggcucugggaccaugguga

SEQ ID NO: 1228867 - RNA, 22 nt, Homo sapiens
ggcucugggagacuuugaagac

SEQ ID NO: 1228868 - RNA, 19 nt, Homo sapiens
ggcucugucuacccagugc

SEQ ID NO: 1228869 - RNA, 11 nt, Homo sapiens
ggcucuuccaa

SEQ ID NO: 1228870 - RNA, 15 nt, Homo sapiens
ggcucuuucagagag

SEQ ID NO: 1228871 - RNA, 13 nt, Homo sapiens
ggcucuuuccuug

SEQ ID NO: 1228872 - RNA, 14 nt, Homo sapiens
ggcucuuuccuugc

SEQ ID NO: 1228873 - RNA, 18 nt, Homo sapiens
ggcucuuuccuugcucaa

SEQ ID NO: 1228874 - RNA, 19 nt, Homo sapiens
ggcugaaggaaaccagugc

SEQ ID NO: 1228875 - RNA, 23 nt, Homo sapiens
ggcugacaccuaccaugcugcuu

SEQ ID NO: 1228876 - RNA, 15 nt, Homo sapiens
ggcugaccaugcuca

SEQ ID NO: 1228877 - RNA, 21 nt, Homo sapiens
ggcugacccagauucccuucc

SEQ ID NO: 1228878 - RNA, 18 nt, Homo sapiens
ggcugaugcugggacccu

SEQ ID NO: 1228879 - RNA, 21 nt, Homo sapiens
ggcugauuauuaaaguccuuu

SEQ ID NO: 1228880 - RNA, 17 nt, Homo sapiens
ggcugcccccaacacuc

SEQ ID NO: 1228881 - RNA, 17 nt, Homo sapiens
ggcugccccucucacca

SEQ ID NO: 1228882 - RNA, 18 nt, Homo sapiens
ggcugccccucucaccaa

SEQ ID NO: 1228883 - RNA, 11 nt, Homo sapiens
ggcugcucccc

SEQ ID NO: 1228884 - RNA, 13 nt, Homo sapiens
ggcugcugaccau

SEQ ID NO: 1228885 - RNA, 12 nt, Homo sapiens
ggcugcugagaa

SEQ ID NO: 1228886 - RNA, 16 nt, Homo sapiens
ggcugcuuuguucaau

SEQ ID NO: 1228887 - RNA, 16 nt, Homo sapiens
ggcuggaaggggucca

SEQ ID NO: 1228888 - RNA, 22 nt, Homo sapiens
ggcuggacuggaggugggcaug

SEQ ID NO: 1228889 - RNA, 15 nt, Homo sapiens
ggcuggagugcaaug

SEQ ID NO: 1228890 - RNA, 20 nt, Homo sapiens
ggcuggagugcaguggugca

SEQ ID NO: 1228891 - RNA, 23 nt, Homo sapiens
ggcuggagugcaguggugcaauc

SEQ ID NO: 1228892 - RNA, 19 nt, Homo sapiens
ggcuggcccucucauucuc

SEQ ID NO: 1228893 - RNA, 20 nt, Homo sapiens
ggcuggcccucucauucuca

SEQ ID NO: 1228894 - RNA, 22 nt, Homo sapiens
ggcuggcccucucauucucacu

SEQ ID NO: 1228895 - RNA, 11 nt, Homo sapiens
ggcugggagac

SEQ ID NO: 1228896 - RNA, 11 nt, Homo sapiens
ggcugggcuac

SEQ ID NO: 1228897 - RNA, 20 nt, Homo sapiens
ggcuggguaccaaugcugca

SEQ ID NO: 1228898 - RNA, 22 nt, Homo sapiens
ggcugguccagggcuagugacu

SEQ ID NO: 1228899 - RNA, 18 nt, Homo sapiens
ggcuggucuuggugaaca

SEQ ID NO: 1228900 - RNA, 13 nt, Homo sapiens
ggcuggugacaga

SEQ ID NO: 1228901 - RNA, 21 nt, Homo sapiens
ggcugucugucaccagcuauc

SEQ ID NO: 1228902 - RNA, 10 nt, Homo sapiens
ggcugugagg

SEQ ID NO: 1228903 - RNA, 18 nt, Homo sapiens
ggcuguggaccguggaca

SEQ ID NO: 1228904 - RNA, 22 nt, Homo sapiens
ggcuguggagagggucaaggag

SEQ ID NO: 1228905 - RNA, 13 nt, Homo sapiens
ggcuguucugcac

SEQ ID NO: 1228906 - RNA, 21 nt, Homo sapiens
ggcuguugagggccacuuuuu

SEQ ID NO: 1228907 - RNA, 21 nt, Homo sapiens
ggcuuagacuucgacucagga

SEQ ID NO: 1228908 - RNA, 18 nt, Homo sapiens
ggcuuaggaaagugauau

SEQ ID NO: 1228909 - RNA, 16 nt, Homo sapiens
ggcuugacaugugcaa

SEQ ID NO: 1228910 - RNA, 19 nt, Homo sapiens
ggcuuggccugcugugauu

SEQ ID NO: 1228911 - RNA, 21 nt, Homo sapiens
ggcuuguguguuucacuuuua

SEQ ID NO: 1228912 - RNA, 22 nt, Homo sapiens
ggcuuucuggagaggagggaug

SEQ ID NO: 1228913 - RNA, 13 nt, Homo sapiens
ggcuuucuguuga

SEQ ID NO: 1228914 - RNA, 20 nt, Homo sapiens
ggcuuugccgccaugggaug

SEQ ID NO: 1228915 - RNA, 15 nt, Homo sapiens
ggcuuuucacauggg

SEQ ID NO: 1228916 - RNA, 14 nt, Homo sapiens
gggaaacgggguga

SEQ ID NO: 1228917 - RNA, 22 nt, Homo sapiens
gggaaacuuagaucaucaguca

SEQ ID NO: 1228918 - RNA, 21 nt, Homo sapiens
gggaaccaugaagacaggaug

SEQ ID NO: 1228919 - RNA, 20 nt, Homo sapiens
gggaaccggcagcaucccag

SEQ ID NO: 1228920 - RNA, 14 nt, Homo sapiens
gggaagaaacacuc

SEQ ID NO: 1228921 - RNA, 16 nt, Homo sapiens
gggaagcagccagcuc

SEQ ID NO: 1228922 - RNA, 13 nt, Homo sapiens
gggaagccacugc

SEQ ID NO: 1228923 - RNA, 19 nt, Homo sapiens
gggaagcccugugggccac

SEQ ID NO: 1228924 - RNA, 20 nt, Homo sapiens
gggaagcggagcuugcagug

SEQ ID NO: 1228925 - RNA, 20 nt, Homo sapiens
gguuagaaaaaggacucugc

SEQ ID NO: 1228926 - RNA, 17 nt, Homo sapiens
gguuagccuuugcccug

SEQ ID NO: 1228927 - RNA, 17 nt, Homo sapiens
gguuauagcuucaggag

SEQ ID NO: 1228928 - RNA, 16 nt, Homo sapiens
gguuauguaucagaag

SEQ ID NO: 1228929 - RNA, 18 nt, Homo sapiens
gguuauucuaagcccuuu

SEQ ID NO: 1228930 - RNA, 13 nt, Homo sapiens
gguucaacaaagg

SEQ ID NO: 1228931 - RNA, 20 nt, Homo sapiens
gguucaagcuauucucaugc

SEQ ID NO: 1228932 - RNA, 11 nt, Homo sapiens
gguucacugag

SEQ ID NO: 1228933 - RNA, 22 nt, Homo sapiens
gguuccauuuuuccucuguuca

SEQ ID NO: 1228934 - RNA, 21 nt, Homo sapiens
gguucccaaaucccucucaca

SEQ ID NO: 1228935 - RNA, 19 nt, Homo sapiens
gguucucagguguugccaa

SEQ ID NO: 1228936 - RNA, 21 nt, Homo sapiens
gguucugcgccacuuccuuug

SEQ ID NO: 1228937 - RNA, 15 nt, Homo sapiens
gguucugucauguaa

SEQ ID NO: 1228938 - RNA, 16 nt, Homo sapiens
gguucuucagggccag

SEQ ID NO: 1228939 - RNA, 16 nt, Homo sapiens
gguucuuugcugcauu

SEQ ID NO: 1228940 - RNA, 12 nt, Homo sapiens
gguugaaggcag

SEQ ID NO: 1228941 - RNA, 11 nt, Homo sapiens
gguugcaguga

SEQ ID NO: 1228942 - RNA, 22 nt, Homo sapiens
gguugcagugcugagcuguggg

SEQ ID NO: 1228943 - RNA, 18 nt, Homo sapiens
gguuggcccccacguggg

SEQ ID NO: 1228944 - RNA, 19 nt, Homo sapiens
gguugggagcagagcuaag

SEQ ID NO: 1228945 - RNA, 15 nt, Homo sapiens
gguugggcagccaga

SEQ ID NO: 1228946 - RNA, 19 nt, Homo sapiens
gguuguagaaggagccuug

SEQ ID NO: 1228947 - RNA, 17 nt, Homo sapiens
gguuuacucucccggac

SEQ ID NO: 1228948 - RNA, 14 nt, Homo sapiens
gguuucaccugggc

SEQ ID NO: 1228949 - RNA, 16 nt, Homo sapiens
gguuucggagcacgua

SEQ ID NO: 1228950 - RNA, 19 nt, Homo sapiens
gguuugaaagaugcagugg

SEQ ID NO: 1228951 - RNA, 20 nt, Homo sapiens
gguuugacuuguuugugcau

SEQ ID NO: 1228952 - RNA, 22 nt, Homo sapiens
gguuugagaauguuuuuagcug

SEQ ID NO: 1228953 - RNA, 23 nt, Homo sapiens
gguuugucacacgauaaagggau

SEQ ID NO: 1228954 - RNA, 15 nt, Homo sapiens
gguuugucaguucuu

SEQ ID NO: 1228955 - RNA, 19 nt, Homo sapiens
gguuuguguuugaguuuua

SEQ ID NO: 1228956 - RNA, 17 nt, Homo sapiens
gguuuguugcagccaaa

SEQ ID NO: 1228957 - RNA, 20 nt, Homo sapiens
gguuuuaaccgcacaugcac

SEQ ID NO: 1228958 - RNA, 21 nt, Homo sapiens
gguuuuuaauuuuguguugcu

SEQ ID NO: 1228959 - RNA, 12 nt, Homo sapiens
guaaaacaugcu

SEQ ID NO: 1228960 - RNA, 12 nt, Homo sapiens
guaaaagccauc

SEQ ID NO: 1228961 - RNA, 18 nt, Homo sapiens
guaaaaggauaguaagca

SEQ ID NO: 1228962 - RNA, 17 nt, Homo sapiens
guaaaauguacaaguuu

SEQ ID NO: 1228963 - RNA, 12 nt, Homo sapiens
guaaacaaugaa

SEQ ID NO: 1228964 - RNA, 13 nt, Homo sapiens
guaaacauaauuc

SEQ ID NO: 1228965 - RNA, 12 nt, Homo sapiens
guaaaccaaaaa

SEQ ID NO: 1228966 - RNA, 14 nt, Homo sapiens
guaaacgacacucu

SEQ ID NO: 1228967 - RNA, 15 nt, Homo sapiens
guaaacuguaucaaa

SEQ ID NO: 1228968 - RNA, 20 nt, Homo sapiens
guaaagauccuauagcucuu

SEQ ID NO: 1228969 - RNA, 15 nt, Homo sapiens
guaaaguugccuuua

SEQ ID NO: 1228970 - RNA, 21 nt, Homo sapiens
guaaauaaccccauucuuugc

SEQ ID NO: 1228971 - RNA, 20 nt, Homo sapiens
guaaauacuguaaaugcauu

SEQ ID NO: 1228972 - RNA, 21 nt, Homo sapiens
guaaaucauguugaucaugua

SEQ ID NO: 1228973 - RNA, 22 nt, Homo sapiens
guaaaugaucacuccaggauau

SEQ ID NO: 1228974 - RNA, 12 nt, Homo sapiens
guaaauugaacu

SEQ ID NO: 1228975 - RNA, 13 nt, Homo sapiens
guaaauugcaaau

SEQ ID NO: 1228976 - RNA, 14 nt, Homo sapiens
guaaauugcaaaua

SEQ ID NO: 1228977 - RNA, 18 nt, Homo sapiens
guaaauuuugugaugaau

SEQ ID NO: 1228978 - RNA, 13 nt, Homo sapiens
guaacaacugugg

SEQ ID NO: 1228979 - RNA, 14 nt, Homo sapiens
guaacaacuguggu

SEQ ID NO: 1228980 - RNA, 18 nt, Homo sapiens
guaacaauacaugagaaa

SEQ ID NO: 1228981 - RNA, 18 nt, Homo sapiens
guaacagcauuaacuguc

SEQ ID NO: 1228982 - RNA, 23 nt, Homo sapiens
guaacagcauuaacugucuuaaa

SEQ ID NO: 1228983 - RNA, 16 nt, Homo sapiens
guaacaguucauguuu

SEQ ID NO: 1228984 - RNA, 13 nt, Homo sapiens
guaacauauuuau

SEQ ID NO: 1228985 - RNA, 18 nt, Homo sapiens
guaacaucauaauuacau

SEQ ID NO: 1228986 - RNA, 21 nt, Homo sapiens
guaacaugaggggacauuuug

SEQ ID NO: 1228987 - RNA, 17 nt, Homo sapiens
guaacauuucuguucuc

SEQ ID NO: 1228988 - RNA, 14 nt, Homo sapiens
guaaccagugcaga

SEQ ID NO: 1228989 - RNA, 15 nt, Homo sapiens
guaacccaaaccuca

SEQ ID NO: 1228990 - RNA, 20 nt, Homo sapiens
guaacccgcucaucacugga

SEQ ID NO: 1228991 - RNA, 17 nt, Homo sapiens
guaacccuggcacuuaa

SEQ ID NO: 1228992 - RNA, 19 nt, Homo sapiens
guaacuccccucagggaua

SEQ ID NO: 1228993 - RNA, 20 nt, Homo sapiens
guaacuuauuuuaaauaugc

SEQ ID NO: 1228994 - RNA, 14 nt, Homo sapiens
guaagacauuugua

SEQ ID NO: 1228995 - RNA, 16 nt, Homo sapiens
guaagacuaaaucugu

SEQ ID NO: 1228996 - RNA, 14 nt, Homo sapiens
guaagagguguuau

SEQ ID NO: 1228997 - RNA, 14 nt, Homo sapiens
guaagaugcacuga

SEQ ID NO: 1228998 - RNA, 15 nt, Homo sapiens
guaagccaagucaug

SEQ ID NO: 1228999 - RNA, 14 nt, Homo sapiens
guaagcuaucugug

SEQ ID NO: 1229000 - RNA, 17 nt, Homo sapiens
guaagcuaucugugcag

SEQ ID NO: 1229001 - RNA, 14 nt, Homo sapiens
guaaggcucuagau

SEQ ID NO: 1229002 - RNA, 18 nt, Homo sapiens
guaaguaaggugcaauga

SEQ ID NO: 1229003 - RNA, 20 nt, Homo sapiens
guaaguaccacucaggccaa

SEQ ID NO: 1229004 - RNA, 17 nt, Homo sapiens
guaaguauaaaugaauu

SEQ ID NO: 1229005 - RNA, 14 nt, Homo sapiens
guaagugcugcuau

SEQ ID NO: 1229006 - RNA, 15 nt, Homo sapiens
guaagugcugcuaua

SEQ ID NO: 1229007 - RNA, 15 nt, Homo sapiens
guaauaacugugaag

SEQ ID NO: 1229008 - RNA, 22 nt, Homo sapiens
guaauauagugacuaugaacuu

SEQ ID NO: 1229009 - RNA, 20 nt, Homo sapiens
guaauauucuccccacccac

SEQ ID NO: 1229010 - RNA, 16 nt, Homo sapiens
guaaucaagggucauu

SEQ ID NO: 1229011 - RNA, 15 nt, Homo sapiens
guaaucccagcacuu

SEQ ID NO: 1229012 - RNA, 18 nt, Homo sapiens
guaaucccagcacuuugg

SEQ ID NO: 1229013 - RNA, 16 nt, Homo sapiens
guaaucccagcuacuu

SEQ ID NO: 1229014 - RNA, 23 nt, Homo sapiens
guaaucccccaggagaacaucuu

SEQ ID NO: 1229015 - RNA, 16 nt, Homo sapiens
guaaucucagcacuuu

SEQ ID NO: 1229016 - RNA, 14 nt, Homo sapiens
guaaucucugugaa

SEQ ID NO: 1229017 - RNA, 16 nt, Homo sapiens
guaaucuguacauuuu

SEQ ID NO: 1229018 - RNA, 14 nt, Homo sapiens
guaaugauacugau

SEQ ID NO: 1229019 - RNA, 19 nt, Homo sapiens
guaauuggcccaagucauu

SEQ ID NO: 1229020 - RNA, 19 nt, Homo sapiens
guaauuuauuaacuaauca

SEQ ID NO: 1229021 - RNA, 19 nt, Homo sapiens
guacaaaaaaaaaguuuua

SEQ ID NO: 1229022 - RNA, 21 nt, Homo sapiens
guacaaaagaagggcugguau

SEQ ID NO: 1229023 - RNA, 17 nt, Homo sapiens
guacaaagguugcagug

SEQ ID NO: 1229024 - RNA, 21 nt, Homo sapiens
guacaaggcccccacugccug

SEQ ID NO: 1229025 - RNA, 16 nt, Homo sapiens
guacaauaaagcaaug

SEQ ID NO: 1229026 - RNA, 19 nt, Homo sapiens
guacaauaaagcaaugugg

SEQ ID NO: 1229027 - RNA, 21 nt, Homo sapiens
guacaauaaagcaauguggua

SEQ ID NO: 1229028 - RNA, 16 nt, Homo sapiens
guacacuaacauuucc

SEQ ID NO: 1229029 - RNA, 19 nt, Homo sapiens
guacagaccaccuuucaca

SEQ ID NO: 1229030 - RNA, 15 nt, Homo sapiens
guacagauucuuuca

SEQ ID NO: 1229031 - RNA, 16 nt, Homo sapiens
guacaggaaugaaccu

SEQ ID NO: 1229032 - RNA, 21 nt, Homo sapiens
guacaguauguuuuacaugua

SEQ ID NO: 1229033 - RNA, 15 nt, Homo sapiens
guacagucuuaucaa

SEQ ID NO: 1229034 - RNA, 22 nt, Homo sapiens
guacauaauucuugcuaugaaa

SEQ ID NO: 1229035 - RNA, 10 nt, Homo sapiens
guacauguau

SEQ ID NO: 1229036 - RNA, 17 nt, Homo sapiens
guacauuuggcauuugu

SEQ ID NO: 1229037 - RNA, 22 nt, Homo sapiens
guacauuuggcauuuguguuau

SEQ ID NO: 1229038 - RNA, 16 nt, Homo sapiens
guacauuugugcucca

SEQ ID NO: 1229039 - RNA, 11 nt, Homo sapiens
guacauuuuaa

SEQ ID NO: 1229040 - RNA, 21 nt, Homo sapiens
guaccauagcgcugcucuuau

SEQ ID NO: 1229041 - RNA, 15 nt, Homo sapiens
guaccccauggagcu

SEQ ID NO: 1229042 - RNA, 17 nt, Homo sapiens
guaccccccuaccacac

SEQ ID NO: 1229043 - RNA, 14 nt, Homo sapiens
guacccuuccaccu

SEQ ID NO: 1229044 - RNA, 18 nt, Homo sapiens
guacccuuuggggagcag

SEQ ID NO: 1229045 - RNA, 14 nt, Homo sapiens
guaccucaucccau

SEQ ID NO: 1229046 - RNA, 18 nt, Homo sapiens
guaccuccucucaguguu

SEQ ID NO: 1229047 - RNA, 14 nt, Homo sapiens
guaccugaugcuau

SEQ ID NO: 1229048 - RNA, 20 nt, Homo sapiens
guaccuguacuaaaccaccu

SEQ ID NO: 1229049 - RNA, 15 nt, Homo sapiens
guacgaugacagugu

SEQ ID NO: 1229050 - RNA, 16 nt, Homo sapiens
guacgguggcacgugc

SEQ ID NO: 1229051 - RNA, 23 nt, Homo sapiens
guacuauccaaucugugaugaca

SEQ ID NO: 1229052 - RNA, 19 nt, Homo sapiens
ugguuuuguacacugcugu

SEQ ID NO: 1229053 - RNA, 19 nt, Homo sapiens
ugguuuuuggcucuuucag

SEQ ID NO: 1229054 - RNA, 19 nt, Homo sapiens
uguaaaaagaaaaaccacu

SEQ ID NO: 1229055 - RNA, 17 nt, Homo sapiens
uguaaaacgcugucaaa

SEQ ID NO: 1229056 - RNA, 22 nt, Homo sapiens
uguaaaauggaggccauugugu

SEQ ID NO: 1229057 - RNA, 15 nt, Homo sapiens
uguaaacacauguuc

SEQ ID NO: 1229058 - RNA, 19 nt, Homo sapiens
uguaaacauaauucuugua

SEQ ID NO: 1229059 - RNA, 12 nt, Homo sapiens
uguaaacugcca

SEQ ID NO: 1229060 - RNA, 11 nt, Homo sapiens
uguaaacugga

SEQ ID NO: 1229061 - RNA, 15 nt, Homo sapiens
uguaaagaaugucua

SEQ ID NO: 1229062 - RNA, 23 nt, Homo sapiens
uguaaagugugggagaccgagga

SEQ ID NO: 1229063 - RNA, 22 nt, Homo sapiens
uguaaauaagcccagugcugcu

SEQ ID NO: 1229064 - RNA, 19 nt, Homo sapiens
uguaaauacuguaaaugca

SEQ ID NO: 1229065 - RNA, 20 nt, Homo sapiens
uguaaauaugaaucugcuca

SEQ ID NO: 1229066 - RNA, 21 nt, Homo sapiens
uguaaauccuagacuugaaag

SEQ ID NO: 1229067 - RNA, 16 nt, Homo sapiens
uguaaauuaauacuuc

SEQ ID NO: 1229068 - RNA, 11 nt, Homo sapiens
uguaaauugca

SEQ ID NO: 1229069 - RNA, 22 nt, Homo sapiens
uguaaauugcaaauaaaccacu

SEQ ID NO: 1229070 - RNA, 21 nt, Homo sapiens
uguaacaauuguguagccuuu

SEQ ID NO: 1229071 - RNA, 23 nt, Homo sapiens
uguaacacagcugagagacuuuu

SEQ ID NO: 1229072 - RNA, 15 nt, Homo sapiens
uguaacauaaugcac

SEQ ID NO: 1229073 - RNA, 16 nt, Homo sapiens
uguaaccugcugugau

SEQ ID NO: 1229074 - RNA, 19 nt, Homo sapiens
uguaacuguuuucaaggag

SEQ ID NO: 1229075 - RNA, 23 nt, Homo sapiens
uguaacuuauguagauauuuggc

SEQ ID NO: 1229076 - RNA, 19 nt, Homo sapiens
uguaagacauuuguauauu

SEQ ID NO: 1229077 - RNA, 16 nt, Homo sapiens
uguaagacucauuccc

SEQ ID NO: 1229078 - RNA, 15 nt, Homo sapiens
uguaagaggugcucu

SEQ ID NO: 1229079 - RNA, 14 nt, Homo sapiens
uguaagauuuucca

SEQ ID NO: 1229080 - RNA, 22 nt, Homo sapiens
uguaagcucuacugaggugcua

SEQ ID NO: 1229081 - RNA, 19 nt, Homo sapiens
uguaagggcagugcccaug

SEQ ID NO: 1229082 - RNA, 16 nt, Homo sapiens
uguaauagugaacaua

SEQ ID NO: 1229083 - RNA, 19 nt, Homo sapiens
uguaauagugaacauaugg

SEQ ID NO: 1229084 - RNA, 20 nt, Homo sapiens
uguaaucccagcacuuugau

SEQ ID NO: 1229085 - RNA, 19 nt, Homo sapiens
uguaaucccagcacuuugg

SEQ ID NO: 1229086 - RNA, 19 nt, Homo sapiens
uguaaucccagcuacuugg

SEQ ID NO: 1229087 - RNA, 18 nt, Homo sapiens
uguaaucccaguacuugg

SEQ ID NO: 1229088 - RNA, 14 nt, Homo sapiens
uguaauccuguaca

SEQ ID NO: 1229089 - RNA, 22 nt, Homo sapiens
uguaauccuguacaauugcauc

SEQ ID NO: 1229090 - RNA, 16 nt, Homo sapiens
uguaaugacagugcua

SEQ ID NO: 1229091 - RNA, 13 nt, Homo sapiens
uguaaugauacug

SEQ ID NO: 1229092 - RNA, 12 nt, Homo sapiens
uguaaugaucau

SEQ ID NO: 1229093 - RNA, 22 nt, Homo sapiens
uguaaugguaucuuaaagugug

SEQ ID NO: 1229094 - RNA, 22 nt, Homo sapiens
uguaauuaaguaaaccaaaaag

SEQ ID NO: 1229095 - RNA, 15 nt, Homo sapiens
uguaauuagcucugg

SEQ ID NO: 1229096 - RNA, 18 nt, Homo sapiens
uguacaauaaagcaaugu

SEQ ID NO: 1229097 - RNA, 23 nt, Homo sapiens
uguacaauaaagcaaugugguag

SEQ ID NO: 1229098 - RNA, 20 nt, Homo sapiens
uguacacacuuuauuuacuu

SEQ ID NO: 1229099 - RNA, 19 nt, Homo sapiens
uguacacagaauuguucca

SEQ ID NO: 1229100 - RNA, 11 nt, Homo sapiens
uguacacugug

SEQ ID NO: 1229101 - RNA, 11 nt, Homo sapiens
uguacagguac

SEQ ID NO: 1229102 - RNA, 13 nt, Homo sapiens
uguacagugaauu

SEQ ID NO: 1229103 - RNA, 22 nt, Homo sapiens
uguacauuauaaaccuucagaa

SEQ ID NO: 1229104 - RNA, 13 nt, Homo sapiens
uguaccaguuugu

SEQ ID NO: 1229105 - RNA, 14 nt, Homo sapiens
uguaccauuugccu

SEQ ID NO: 1229106 - RNA, 15 nt, Homo sapiens
uguaccguuuccuua

SEQ ID NO: 1229107 - RNA, 13 nt, Homo sapiens
uguaccuguguac

SEQ ID NO: 1229108 - RNA, 12 nt, Homo sapiens
uguaccuugaua

SEQ ID NO: 1229109 - RNA, 18 nt, Homo sapiens
uguacgucugacaggcaa

SEQ ID NO: 1229110 - RNA, 16 nt, Homo sapiens
uguacuaccuguguau

SEQ ID NO: 1229111 - RNA, 15 nt, Homo sapiens
uguacucaaguacca

SEQ ID NO: 1229112 - RNA, 18 nt, Homo sapiens
uguacucaauggauuuga

SEQ ID NO: 1229113 - RNA, 17 nt, Homo sapiens
uguacucuuaggauauu

SEQ ID NO: 1229114 - RNA, 18 nt, Homo sapiens
uguacugcauguuaccau

SEQ ID NO: 1229115 - RNA, 18 nt, Homo sapiens
uguacugugucucaugga

SEQ ID NO: 1229116 - RNA, 20 nt, Homo sapiens
uguacuuagcuguacuauaa

SEQ ID NO: 1229117 - RNA, 22 nt, Homo sapiens
uguacuuauauccacacugcac

SEQ ID NO: 1229118 - RNA, 10 nt, Homo sapiens
uguacuugug

SEQ ID NO: 1229119 - RNA, 17 nt, Homo sapiens
uguagaacacuaauuca

SEQ ID NO: 1229120 - RNA, 21 nt, Homo sapiens
uguagaacucagcaguugaca

SEQ ID NO: 1229121 - RNA, 15 nt, Homo sapiens
uguagaagauggacu

SEQ ID NO: 1229122 - RNA, 15 nt, Homo sapiens
uguagaaugauuuca

SEQ ID NO: 1229123 - RNA, 13 nt, Homo sapiens
uguagacacuuac

SEQ ID NO: 1229124 - RNA, 22 nt, Homo sapiens
uguagacuguggcuagugacaa

SEQ ID NO: 1229125 - RNA, 15 nt, Homo sapiens
uguagagaaaagcac

SEQ ID NO: 1229126 - RNA, 20 nt, Homo sapiens
uguagagauggggucucaca

SEQ ID NO: 1229127 - RNA, 18 nt, Homo sapiens
uguagaguuguuucuuaa

SEQ ID NO: 1229128 - RNA, 15 nt, Homo sapiens
uguagauacuagcua

SEQ ID NO: 1229129 - RNA, 20 nt, Homo sapiens
uguagaugggggaacuguga

SEQ ID NO: 1229130 - RNA, 16 nt, Homo sapiens
uguagcaauggcacug

SEQ ID NO: 1229131 - RNA, 16 nt, Homo sapiens
uguagcauaacuguag

SEQ ID NO: 1229132 - RNA, 21 nt, Homo sapiens
uguagcauauucuuuucugca

SEQ ID NO: 1229133 - RNA, 16 nt, Homo sapiens
uguagcauuggaucaa

SEQ ID NO: 1229134 - RNA, 22 nt, Homo sapiens
uguagcauuucuugauguugcu

SEQ ID NO: 1229135 - RNA, 13 nt, Homo sapiens
uguagccagcaga

SEQ ID NO: 1229136 - RNA, 15 nt, Homo sapiens
uguagccugggacca

SEQ ID NO: 1229137 - RNA, 14 nt, Homo sapiens
uguagccugugcau

SEQ ID NO: 1229138 - RNA, 15 nt, Homo sapiens
uguagcugugucaug

SEQ ID NO: 1229139 - RNA, 15 nt, Homo sapiens
uguagcuuugcucuu

SEQ ID NO: 1229140 - RNA, 13 nt, Homo sapiens
uguaggacuguau

SEQ ID NO: 1229141 - RNA, 13 nt, Homo sapiens
uguagggaacucu

SEQ ID NO: 1229142 - RNA, 14 nt, Homo sapiens
uguaguuacugugg

SEQ ID NO: 1229143 - RNA, 16 nt, Homo sapiens
uguaguuccuaaugga

SEQ ID NO: 1229144 - RNA, 18 nt, Homo sapiens
uguaguucugccaggcaa

SEQ ID NO: 1229145 - RNA, 21 nt, Homo sapiens
uguaguuuuucuucaacauca

SEQ ID NO: 1229146 - RNA, 15 nt, Homo sapiens
uguauaaacuaucag

SEQ ID NO: 1229147 - RNA, 18 nt, Homo sapiens
uguauaaagauuguacuu

SEQ ID NO: 1229148 - RNA, 14 nt, Homo sapiens
uguauaagaauuac

SEQ ID NO: 1229149 - RNA, 14 nt, Homo sapiens
uguauaagcacuga

SEQ ID NO: 1229150 - RNA, 22 nt, Homo sapiens
uguauaagcacugaaaaacaac

SEQ ID NO: 1229151 - RNA, 20 nt, Homo sapiens
uguauaauuggaguagauau

SEQ ID NO: 1229152 - RNA, 22 nt, Homo sapiens
uguauaguuuuauuuacuucug

SEQ ID NO: 1229153 - RNA, 18 nt, Homo sapiens
uguauauaaacauaucaa

SEQ ID NO: 1229154 - RNA, 19 nt, Homo sapiens
uguauauaaacauaucaau

SEQ ID NO: 1229155 - RNA, 15 nt, Homo sapiens
uguauauccuauaua

SEQ ID NO: 1229156 - RNA, 15 nt, Homo sapiens
uguauauuuguacaa

SEQ ID NO: 1229157 - RNA, 17 nt, Homo sapiens
uguauauuuguacaaaa

SEQ ID NO: 1229158 - RNA, 18 nt, Homo sapiens
uguauauuuuuauauugu

SEQ ID NO: 1229159 - RNA, 13 nt, Homo sapiens
uguauccaugcac

SEQ ID NO: 1229160 - RNA, 23 nt, Homo sapiens
uguauccccccccuguauaguua

SEQ ID NO: 1229161 - RNA, 15 nt, Homo sapiens
uguauccgacucuaa

SEQ ID NO: 1229162 - RNA, 15 nt, Homo sapiens
uguaucgggcaaaaa

SEQ ID NO: 1229163 - RNA, 16 nt, Homo sapiens
uguaucuuauucacau

SEQ ID NO: 1229164 - RNA, 18 nt, Homo sapiens
uguaugaaaaauugggga

SEQ ID NO: 1229165 - RNA, 18 nt, Homo sapiens
uguaugaaagauuguggg

SEQ ID NO: 1229166 - RNA, 15 nt, Homo sapiens
uguaugaccacuggg

SEQ ID NO: 1229167 - RNA, 15 nt, Homo sapiens
uguaugaugagcaua

SEQ ID NO: 1229168 - RNA, 14 nt, Homo sapiens
uguaugauguguug

SEQ ID NO: 1229169 - RNA, 16 nt, Homo sapiens
uguauggaaaaaccau

SEQ ID NO: 1229170 - RNA, 20 nt, Homo sapiens
uguauggaaucccacuguau

SEQ ID NO: 1229171 - RNA, 15 nt, Homo sapiens
uguauggcacuggca

SEQ ID NO: 1229172 - RNA, 13 nt, Homo sapiens
uguaugugugaau

SEQ ID NO: 1229173 - RNA, 11 nt, Homo sapiens
uguauguuaaa

SEQ ID NO: 1229174 - RNA, 17 nt, Homo sapiens
uguauguuccucuauga

SEQ ID NO: 1229175 - RNA, 18 nt, Homo sapiens
uguauguuccucuaugaa

SEQ ID NO: 1229176 - RNA, 18 nt, Homo sapiens
uguauuaaacucuucaca

SEQ ID NO: 1229177 - RNA, 18 nt, Homo sapiens
uguauuacaaauggugaa

SEQ ID NO: 1229178 - RNA, 19 nt, Homo sapiens
uuaacuuuuauaccuaucu

SEQ ID NO: 1229179 - RNA, 21 nt, Homo sapiens
uuaagaagucuauaaugcaau

SEQ ID NO: 1229180 - RNA, 17 nt, Homo sapiens
uuaagaaugucgauuaa

SEQ ID NO: 1229181 - RNA, 11 nt, Homo sapiens
uuaagaauucu

SEQ ID NO: 1229182 - RNA, 22 nt, Homo sapiens
uuaagaauugaguaauggugua

SEQ ID NO: 1229183 - RNA, 14 nt, Homo sapiens
uuaagaauuucaca

SEQ ID NO: 1229184 - RNA, 22 nt, Homo sapiens
uuaagacgguuaaauacugugu

SEQ ID NO: 1229185 - RNA, 15 nt, Homo sapiens
uuaagagacacucca

SEQ ID NO: 1229186 - RNA, 16 nt, Homo sapiens
uuaagagaccaggucu

SEQ ID NO: 1229187 - RNA, 16 nt, Homo sapiens
uuaagagaucccuuaa

SEQ ID NO: 1229188 - RNA, 22 nt, Homo sapiens
uuaagagggaacuuagcagaga

SEQ ID NO: 1229189 - RNA, 17 nt, Homo sapiens
uuaagagugaagucaug

SEQ ID NO: 1229190 - RNA, 15 nt, Homo sapiens
uuaagaguuacuuaa

SEQ ID NO: 1229191 - RNA, 17 nt, Homo sapiens
uuaagauacaaauuaau

SEQ ID NO: 1229192 - RNA, 20 nt, Homo sapiens
uuaagauguggaacaacagc

SEQ ID NO: 1229193 - RNA, 21 nt, Homo sapiens
uuaagauuguaaaaauaauca

SEQ ID NO: 1229194 - RNA, 19 nt, Homo sapiens
uuaagauuuuacaaaagag

SEQ ID NO: 1229195 - RNA, 13 nt, Homo sapiens
uuaagcacaagca

SEQ ID NO: 1229196 - RNA, 14 nt, Homo sapiens
uuaagcacuacaua

SEQ ID NO: 1229197 - RNA, 12 nt, Homo sapiens
uuaagcauuguu

SEQ ID NO: 1229198 - RNA, 16 nt, Homo sapiens
uuaagcgugucuguau

SEQ ID NO: 1229199 - RNA, 23 nt, Homo sapiens
uuaagcugggauaaucacauuau

SEQ ID NO: 1229200 - RNA, 21 nt, Homo sapiens
uuaaggaaacucuuaucucag

SEQ ID NO: 1229201 - RNA, 12 nt, Homo sapiens
uuaaggagccua

SEQ ID NO: 1229202 - RNA, 14 nt, Homo sapiens
uuaaggauguugcc

SEQ ID NO: 1229203 - RNA, 22 nt, Homo sapiens
uuaaguaacauaacuaguggcu

SEQ ID NO: 1229204 - RNA, 23 nt, Homo sapiens
uuaaguaucuuuuuucaaaaaca

SEQ ID NO: 1229205 - RNA, 14 nt, Homo sapiens
uuaagucagugaca

SEQ ID NO: 1229206 - RNA, 21 nt, Homo sapiens
uuaagucccaguauaccucau

SEQ ID NO: 1229207 - RNA, 13 nt, Homo sapiens
uuaagugugcuua

SEQ ID NO: 1229208 - RNA, 23 nt, Homo sapiens
uuaaguuacaauuacaucucuaa

SEQ ID NO: 1229209 - RNA, 21 nt, Homo sapiens
uuaauaaaacuuuauguacug

SEQ ID NO: 1229210 - RNA, 17 nt, Homo sapiens
uuaauaaagaauuaaca

SEQ ID NO: 1229211 - RNA, 21 nt, Homo sapiens
uuaauaaagaauuaacagaga

SEQ ID NO: 1229212 - RNA, 16 nt, Homo sapiens
uuaauaaagcauucuu

SEQ ID NO: 1229213 - RNA, 20 nt, Homo sapiens
uuaauaaagcauucuuuaac

SEQ ID NO: 1229214 - RNA, 23 nt, Homo sapiens
uuaauaaucagcaagaauuugau

SEQ ID NO: 1229215 - RNA, 21 nt, Homo sapiens
uuaauacagugagcucuagca

SEQ ID NO: 1229216 - RNA, 19 nt, Homo sapiens
uuaauagaaauaaauuccu

SEQ ID NO: 1229217 - RNA, 18 nt, Homo sapiens
uuaauagacugagucaga

SEQ ID NO: 1229218 - RNA, 17 nt, Homo sapiens
uuaauagcuauggaauc

SEQ ID NO: 1229219 - RNA, 18 nt, Homo sapiens
uuaauaggaaaaacggaa

SEQ ID NO: 1229220 - RNA, 20 nt, Homo sapiens
uuaauaggguaaauucucua

SEQ ID NO: 1229221 - RNA, 14 nt, Homo sapiens
uuaauaguauuuau

SEQ ID NO: 1229222 - RNA, 16 nt, Homo sapiens
uuaauauauccuaaau

SEQ ID NO: 1229223 - RNA, 13 nt, Homo sapiens
uuaauauugcagu

SEQ ID NO: 1229224 - RNA, 22 nt, Homo sapiens
uuaauauuuaaacagcaguguu

SEQ ID NO: 1229225 - RNA, 20 nt, Homo sapiens
uuaaucacaggaucccacga

SEQ ID NO: 1229226 - RNA, 12 nt, Homo sapiens
uuaauccagcug

SEQ ID NO: 1229227 - RNA, 20 nt, Homo sapiens
uuaauccugaggcaaaguag

SEQ ID NO: 1229228 - RNA, 20 nt, Homo sapiens
uuaaucuccucagacaguaa

SEQ ID NO: 1229229 - RNA, 20 nt, Homo sapiens
uuaaugaacaugugaaguua

SEQ ID NO: 1229230 - RNA, 16 nt, Homo sapiens
uuaaugaagugcaaua

SEQ ID NO: 1229231 - RNA, 15 nt, Homo sapiens
uuaaugagacaugaa

SEQ ID NO: 1229232 - RNA, 22 nt, Homo sapiens
uuaaugcagagcuagaggacuu

SEQ ID NO: 1229233 - RNA, 23 nt, Homo sapiens
uuaauggguuucccuugcccuuu

SEQ ID NO: 1229234 - RNA, 20 nt, Homo sapiens
uuaauuaagucaccuguaua

SEQ ID NO: 1229235 - RNA, 21 nt, Homo sapiens
uuaauuaguugauugcuguug

SEQ ID NO: 1229236 - RNA, 22 nt, Homo sapiens
uuaauucacagaauagcacaaa

SEQ ID NO: 1229237 - RNA, 19 nt, Homo sapiens
uuaauuccaauaugaugac

SEQ ID NO: 1229238 - RNA, 18 nt, Homo sapiens
uuaauuguuuugcacuuu

SEQ ID NO: 1229239 - RNA, 16 nt, Homo sapiens
uuaauuuccacuaaaa

SEQ ID NO: 1229240 - RNA, 17 nt, Homo sapiens
uuaauuuucaguauaau

SEQ ID NO: 1229241 - RNA, 17 nt, Homo sapiens
uuaauuuuuccugauga

SEQ ID NO: 1229242 - RNA, 20 nt, Homo sapiens
uuaauuuuuuuuacuauaaa

SEQ ID NO: 1229243 - RNA, 19 nt, Homo sapiens
uuacaaaauccaacucucu

SEQ ID NO: 1229244 - RNA, 12 nt, Homo sapiens
uuacaaacagac

SEQ ID NO: 1229245 - RNA, 15 nt, Homo sapiens
uuacaacagugagaa

SEQ ID NO: 1229246 - RNA, 12 nt, Homo sapiens
uuacaagccuaa

SEQ ID NO: 1229247 - RNA, 16 nt, Homo sapiens
uuacacggagugugcu

SEQ ID NO: 1229248 - RNA, 17 nt, Homo sapiens
uuacagacaaccuauca

SEQ ID NO: 1229249 - RNA, 11 nt, Homo sapiens
uuacagacaga

SEQ ID NO: 1229250 - RNA, 13 nt, Homo sapiens
uuacagacaugaa

SEQ ID NO: 1229251 - RNA, 20 nt, Homo sapiens
uuacagagaggagaaacaca

SEQ ID NO: 1229252 - RNA, 23 nt, Homo sapiens
uuacagagaggagaaacacaucu

SEQ ID NO: 1229253 - RNA, 12 nt, Homo sapiens
uuacagcaagaa

SEQ ID NO: 1229254 - RNA, 14 nt, Homo sapiens
uuacagcuuucaca

SEQ ID NO: 1229255 - RNA, 12 nt, Homo sapiens
uuacagcuuucu

SEQ ID NO: 1229256 - RNA, 13 nt, Homo sapiens
uuacagcuuucug

SEQ ID NO: 1229257 - RNA, 18 nt, Homo sapiens
uuacagcuuucugugcag

SEQ ID NO: 1229258 - RNA, 18 nt, Homo sapiens
uuacagggagcugggaca

SEQ ID NO: 1229259 - RNA, 12 nt, Homo sapiens
uuacagugcaga

SEQ ID NO: 1229260 - RNA, 16 nt, Homo sapiens
uuacagugcagacagg

SEQ ID NO: 1229261 - RNA, 16 nt, Homo sapiens
uuacaguguuuggaca

SEQ ID NO: 1229262 - RNA, 16 nt, Homo sapiens
uuacaguuugagacuu

SEQ ID NO: 1229263 - RNA, 14 nt, Homo sapiens
uuacauaaagugag

SEQ ID NO: 1229264 - RNA, 14 nt, Homo sapiens
uuacauacuuuauc

SEQ ID NO: 1229265 - RNA, 14 nt, Homo sapiens
uuacauaucaccuc

SEQ ID NO: 1229266 - RNA, 17 nt, Homo sapiens
uuacaugaagcuguaua

SEQ ID NO: 1229267 - RNA, 14 nt, Homo sapiens
uuacaugcauuuga

SEQ ID NO: 1229268 - RNA, 19 nt, Homo sapiens
uuacaugcugcuauacaca

SEQ ID NO: 1229269 - RNA, 22 nt, Homo sapiens
uuacauguaguaguacuugaaa

SEQ ID NO: 1229270 - RNA, 20 nt, Homo sapiens
uuacauguaugguuacuaaa

SEQ ID NO: 1229271 - RNA, 12 nt, Homo sapiens
uuacaugugauu

SEQ ID NO: 1229272 - RNA, 22 nt, Homo sapiens
uuacauuaaaauaaaccaaaua

SEQ ID NO: 1229273 - RNA, 12 nt, Homo sapiens
uuacauugccuu

SEQ ID NO: 1229274 - RNA, 10 nt, Homo sapiens
uuaccaaagc

SEQ ID NO: 1229275 - RNA, 18 nt, Homo sapiens
uuaccaucuuacuugagc

SEQ ID NO: 1229276 - RNA, 16 nt, Homo sapiens
uuacccaguauuccau

SEQ ID NO: 1229277 - RNA, 12 nt, Homo sapiens
uuacccauauau

SEQ ID NO: 1229278 - RNA, 15 nt, Homo sapiens
uuaccccucacaauc

SEQ ID NO: 1229279 - RNA, 20 nt, Homo sapiens
uuaccccucacaauccuugc

SEQ ID NO: 1229280 - RNA, 17 nt, Homo sapiens
uuacccuaguucucuua

SEQ ID NO: 1229281 - RNA, 20 nt, Homo sapiens
uuaccgccugucucuuuaag

SEQ ID NO: 1229282 - RNA, 13 nt, Homo sapiens
uuaccuauacauu

SEQ ID NO: 1229283 - RNA, 15 nt, Homo sapiens
uuaccuccucauggc

SEQ ID NO: 1229284 - RNA, 22 nt, Homo sapiens
uuaccucugaguuguguuccac

SEQ ID NO: 1229285 - RNA, 23 nt, Homo sapiens
uuaccucuuuaaaaacaaaacaa

SEQ ID NO: 1229286 - RNA, 14 nt, Homo sapiens
uuaccugaccucuu

SEQ ID NO: 1229287 - RNA, 21 nt, Homo sapiens
uuaccugauuugaugauacau

SEQ ID NO: 1229288 - RNA, 22 nt, Homo sapiens
uuaccugauuugaugauacauu

SEQ ID NO: 1229289 - RNA, 14 nt, Homo sapiens
uuaccuggggaucc

SEQ ID NO: 1229290 - RNA, 20 nt, Homo sapiens
uuaccuguuuucgcaccuac

SEQ ID NO: 1229291 - RNA, 16 nt, Homo sapiens
uuacggacucuggaua

SEQ ID NO: 1229292 - RNA, 22 nt, Homo sapiens
uuacuaaauuacaaaugcaauu

SEQ ID NO: 1229293 - RNA, 16 nt, Homo sapiens
uuacuaagcauagcaa

SEQ ID NO: 1229294 - RNA, 17 nt, Homo sapiens
uuacuaauuauacuacu

SEQ ID NO: 1229295 - RNA, 15 nt, Homo sapiens
uuacuaucauucuca

SEQ ID NO: 1229296 - RNA, 23 nt, Homo sapiens
uuacuauucacugaugcagaaag

SEQ ID NO: 1229297 - RNA, 21 nt, Homo sapiens
uuacucaugugcagguuuuga

SEQ ID NO: 1229298 - RNA, 23 nt, Homo sapiens
uuacucuaagaucuuagauucuc

SEQ ID NO: 1229299 - RNA, 21 nt, Homo sapiens
uuacugaaagaaaaagaccua

SEQ ID NO: 1229300 - RNA, 12 nt, Homo sapiens
uuacugaaguua

SEQ ID NO: 1229301 - RNA, 12 nt, Homo sapiens
uuacugaaucuu

SEQ ID NO: 1229302 - RNA, 15 nt, Homo sapiens
uuacugaaucuucaa

SEQ ID NO: 1229303 - RNA, 19 nt, Homo sapiens
uuacugaucucuuuaagua

SEQ ID NO: 1229304 - RNA, 23 nt, Homo sapiens
aaagucuuugaagugacuucaca

SEQ ID NO: 1229305 - RNA, 14 nt, Homo sapiens
aaagugacuauuca

SEQ ID NO: 1229306 - RNA, 15 nt, Homo sapiens
aaagugacuauucag

SEQ ID NO: 1229307 - RNA, 21 nt, Homo sapiens
aaagugacucacuuaucccaa

SEQ ID NO: 1229308 - RNA, 20 nt, Homo sapiens
aaagugcugcuggaaguaga

SEQ ID NO: 1229309 - RNA, 17 nt, Homo sapiens
aaagugcuggaauuaca

SEQ ID NO: 1229310 - RNA, 21 nt, Homo sapiens
aaagugcuggaauuacaggcg

SEQ ID NO: 1229311 - RNA, 14 nt, Homo sapiens
aaagugguuuuagg

SEQ ID NO: 1229312 - RNA, 17 nt, Homo sapiens
aaagugugucacccuuu

SEQ ID NO: 1229313 - RNA, 15 nt, Homo sapiens
aaaguuaaaagcaaa

SEQ ID NO: 1229314 - RNA, 15 nt, Homo sapiens
aaaguuaaacauuga

SEQ ID NO: 1229315 - RNA, 15 nt, Homo sapiens
aaaguuacaaacaga

SEQ ID NO: 1229316 - RNA, 13 nt, Homo sapiens
aaaguuacacuuu

SEQ ID NO: 1229317 - RNA, 20 nt, Homo sapiens
aaaguuacugauucacugca

SEQ ID NO: 1229318 - RNA, 13 nt, Homo sapiens
aaaguuccagaaa

SEQ ID NO: 1229319 - RNA, 19 nt, Homo sapiens
aaaguuccagaaacuuuaa

SEQ ID NO: 1229320 - RNA, 16 nt, Homo sapiens
aaaguuccaugaauuc

SEQ ID NO: 1229321 - RNA, 12 nt, Homo sapiens
aaaguucccuga

SEQ ID NO: 1229322 - RNA, 18 nt, Homo sapiens
aaaguucuugguggugga

SEQ ID NO: 1229323 - RNA, 16 nt, Homo sapiens
aaaguugcagauguau

SEQ ID NO: 1229324 - RNA, 13 nt, Homo sapiens
aaaguugccuuua

SEQ ID NO: 1229325 - RNA, 14 nt, Homo sapiens
aaaguuugcucaag

SEQ ID NO: 1229326 - RNA, 18 nt, Homo sapiens
aaauaaaaaggaaguacu

SEQ ID NO: 1229327 - RNA, 22 nt, Homo sapiens
aaauaaaaagugacacagcagc

SEQ ID NO: 1229328 - RNA, 16 nt, Homo sapiens
aaauaaaauacuaaac

SEQ ID NO: 1229329 - RNA, 14 nt, Homo sapiens
aaauaaaaucacca

SEQ ID NO: 1229330 - RNA, 14 nt, Homo sapiens
aaauaaacacuggu

SEQ ID NO: 1229331 - RNA, 13 nt, Homo sapiens
aaauaaaccaaau

SEQ ID NO: 1229332 - RNA, 17 nt, Homo sapiens
aaauaaagauauuguuc

SEQ ID NO: 1229333 - RNA, 17 nt, Homo sapiens
aaauaaagcagaagcaa

SEQ ID NO: 1229334 - RNA, 16 nt, Homo sapiens
aaauaaaguaccacac

SEQ ID NO: 1229335 - RNA, 18 nt, Homo sapiens
aaauaaaguaccacacau

SEQ ID NO: 1229336 - RNA, 24 nt, Homo sapiens
aaauaaaguaccacacauauugca

SEQ ID NO: 1229337 - RNA, 16 nt, Homo sapiens
aaauaaauauaccacu

SEQ ID NO: 1229338 - RNA, 16 nt, Homo sapiens
aaauaaaucaguucau

SEQ ID NO: 1229339 - RNA, 13 nt, Homo sapiens
aaauaaaugacaa

SEQ ID NO: 1229340 - RNA, 13 nt, Homo sapiens
aaauaaaugugca

SEQ ID NO: 1229341 - RNA, 17 nt, Homo sapiens
aaauaagacuuccacuc

SEQ ID NO: 1229342 - RNA, 17 nt, Homo sapiens
aaauaagaucagacucu

SEQ ID NO: 1229343 - RNA, 18 nt, Homo sapiens
aaauaagcucuccccaaa

SEQ ID NO: 1229344 - RNA, 19 nt, Homo sapiens
aaauaaguggaaaccgugu

SEQ ID NO: 1229345 - RNA, 14 nt, Homo sapiens
aaauaaguggguca

SEQ ID NO: 1229346 - RNA, 14 nt, Homo sapiens
aaauaaguguuuua

SEQ ID NO: 1229347 - RNA, 13 nt, Homo sapiens
aaauaaucaagau

SEQ ID NO: 1229348 - RNA, 13 nt, Homo sapiens
aaauaauugccac

SEQ ID NO: 1229349 - RNA, 23 nt, Homo sapiens
aaauacacagugcugaccagaca

SEQ ID NO: 1229350 - RNA, 15 nt, Homo sapiens
aaauacacauuugcu

SEQ ID NO: 1229351 - RNA, 14 nt, Homo sapiens
aaauacagcacuuu

SEQ ID NO: 1229352 - RNA, 16 nt, Homo sapiens
aaauacauacggucag

SEQ ID NO: 1229353 - RNA, 16 nt, Homo sapiens
aaauaccaaguauuua

SEQ ID NO: 1229354 - RNA, 17 nt, Homo sapiens
aaauaccacaagccuga

SEQ ID NO: 1229355 - RNA, 20 nt, Homo sapiens
aaauacgguaaggauacuuu

SEQ ID NO: 1229356 - RNA, 20 nt, Homo sapiens
aaauacuguguggaacuuuu

SEQ ID NO: 1229357 - RNA, 15 nt, Homo sapiens
aaauacuucuugaag

SEQ ID NO: 1229358 - RNA, 13 nt, Homo sapiens
aaauacuugcaug

SEQ ID NO: 1229359 - RNA, 15 nt, Homo sapiens
aaauacuuuuacucu

SEQ ID NO: 1229360 - RNA, 22 nt, Homo sapiens
aaauagagcuuuuaaaaauguc

SEQ ID NO: 1229361 - RNA, 22 nt, Homo sapiens
aaauagaugugucuuaacauaa

SEQ ID NO: 1229362 - RNA, 14 nt, Homo sapiens
aaauaggugagaua

SEQ ID NO: 1229363 - RNA, 22 nt, Homo sapiens
aaauagugacaagugaagaaca

SEQ ID NO: 1229364 - RNA, 14 nt, Homo sapiens
aaauauaauugaca

SEQ ID NO: 1229365 - RNA, 14 nt, Homo sapiens
aaauauacauucaa

SEQ ID NO: 1229366 - RNA, 22 nt, Homo sapiens
aaauauauacccccccaugcag

SEQ ID NO: 1229367 - RNA, 19 nt, Homo sapiens
aaauauauauagugcuaua

SEQ ID NO: 1229368 - RNA, 14 nt, Homo sapiens
aaauauauaugugu

SEQ ID NO: 1229369 - RNA, 14 nt, Homo sapiens
aaauauaucugcua

SEQ ID NO: 1229370 - RNA, 15 nt, Homo sapiens
aaauauaucugcuau

SEQ ID NO: 1229371 - RNA, 14 nt, Homo sapiens
aaauaugauuugug

SEQ ID NO: 1229372 - RNA, 21 nt, Homo sapiens
aaauaugauuuuauuugacaa

SEQ ID NO: 1229373 - RNA, 12 nt, Homo sapiens
aaauaugcagug

SEQ ID NO: 1229374 - RNA, 16 nt, Homo sapiens
aaauauggaacuuaca

SEQ ID NO: 1229375 - RNA, 20 nt, Homo sapiens
aaauauggaacuucuaauau

SEQ ID NO: 1229376 - RNA, 22 nt, Homo sapiens
aaauauguccgcagaauggacu

SEQ ID NO: 1229377 - RNA, 16 nt, Homo sapiens
aaauauuauugguguu

SEQ ID NO: 1229378 - RNA, 18 nt, Homo sapiens
aaauauugcuucaauaau

SEQ ID NO: 1229379 - RNA, 23 nt, Homo sapiens
aaauauuguugacaacugugacu

SEQ ID NO: 1229380 - RNA, 19 nt, Homo sapiens
aaauauuuacucuuugcaa

SEQ ID NO: 1229381 - RNA, 15 nt, Homo sapiens
aaauauuuaugagaa

SEQ ID NO: 1229382 - RNA, 23 nt, Homo sapiens
aaauauuucauuuugauggaggu

SEQ ID NO: 1229383 - RNA, 13 nt, Homo sapiens
aaauauuucccau

SEQ ID NO: 1229384 - RNA, 10 nt, Homo sapiens
aaauauuugc

SEQ ID NO: 1229385 - RNA, 13 nt, Homo sapiens
aaaucaaguccuu

SEQ ID NO: 1229386 - RNA, 20 nt, Homo sapiens
aaaucagcugcuacuacucc

SEQ ID NO: 1229387 - RNA, 13 nt, Homo sapiens
aaaugaucuuuac

SEQ ID NO: 1229388 - RNA, 14 nt, Homo sapiens
aaaugauucagcuc

SEQ ID NO: 1229389 - RNA, 12 nt, Homo sapiens
aaaugauuucag

SEQ ID NO: 1229390 - RNA, 17 nt, Homo sapiens
aaaugcaagccaucucu

SEQ ID NO: 1229391 - RNA, 17 nt, Homo sapiens
aaaugcaguccugagga

SEQ ID NO: 1229392 - RNA, 20 nt, Homo sapiens
aaaugcauauccugagccau

SEQ ID NO: 1229393 - RNA, 14 nt, Homo sapiens
aaaugcccaaaaga

SEQ ID NO: 1229394 - RNA, 18 nt, Homo sapiens
aaaugccucaauucacau

SEQ ID NO: 1229395 - RNA, 20 nt, Homo sapiens
aaaugccuccaagccauuca

SEQ ID NO: 1229396 - RNA, 19 nt, Homo sapiens
aaaugcuagguuaauucca

SEQ ID NO: 1229397 - RNA, 11 nt, Homo sapiens
aaaugcugcuc

SEQ ID NO: 1229398 - RNA, 11 nt, Homo sapiens
aaaugcugcuu

SEQ ID NO: 1229399 - RNA, 14 nt, Homo sapiens
aaaugcuucugcac

SEQ ID NO: 1229400 - RNA, 18 nt, Homo sapiens
aaaugggaaaaccagacu

SEQ ID NO: 1229401 - RNA, 17 nt, Homo sapiens
aaaugggcagugaaggc

SEQ ID NO: 1229402 - RNA, 16 nt, Homo sapiens
aaaugggccauuccag

SEQ ID NO: 1229403 - RNA, 18 nt, Homo sapiens
aaaugguaggcauuuccu

SEQ ID NO: 1229404 - RNA, 16 nt, Homo sapiens
aaaugguauuuugaua

SEQ ID NO: 1229405 - RNA, 15 nt, Homo sapiens
aaauguaaagccagc

SEQ ID NO: 1229406 - RNA, 19 nt, Homo sapiens
aaauguaacugugccaguu

SEQ ID NO: 1229407 - RNA, 17 nt, Homo sapiens
aaauguagguaugaaua

SEQ ID NO: 1229408 - RNA, 14 nt, Homo sapiens
aaauguaugugcuc

SEQ ID NO: 1229409 - RNA, 19 nt, Homo sapiens
aaaugucuaagguaguaac

SEQ ID NO: 1229410 - RNA, 21 nt, Homo sapiens
aaaugucucuuuaaugucaca

SEQ ID NO: 1229411 - RNA, 11 nt, Homo sapiens
aaaugucuugc

SEQ ID NO: 1229412 - RNA, 22 nt, Homo sapiens
aaauguggaggcuaucaacaaa

SEQ ID NO: 1229413 - RNA, 22 nt, Homo sapiens
aaauguguaauuuuguuuauau

SEQ ID NO: 1229414 - RNA, 21 nt, Homo sapiens
aaaugugucauuggaagccau

SEQ ID NO: 1229415 - RNA, 17 nt, Homo sapiens
aaauguuauuguccuca

SEQ ID NO: 1229416 - RNA, 16 nt, Homo sapiens
aaauguucaagucaug

SEQ ID NO: 1229417 - RNA, 19 nt, Homo sapiens
aaauguucaagucaugccu

SEQ ID NO: 1229418 - RNA, 19 nt, Homo sapiens
aaauguucuaaguuucuaa

SEQ ID NO: 1229419 - RNA, 16 nt, Homo sapiens
aaauguuuaccagugu

SEQ ID NO: 1229420 - RNA, 17 nt, Homo sapiens
aaauguuuauacuguau

SEQ ID NO: 1229421 - RNA, 18 nt, Homo sapiens
aaauguuuauacuguauu

SEQ ID NO: 1229422 - RNA, 17 nt, Homo sapiens
aaauuaaaccaacaaca

SEQ ID NO: 1229423 - RNA, 14 nt, Homo sapiens
aaauuaacuuuaca

SEQ ID NO: 1229424 - RNA, 21 nt, Homo sapiens
aaauuaauaucuuucugcaca

SEQ ID NO: 1229425 - RNA, 15 nt, Homo sapiens
aaauuacaauuguca

SEQ ID NO: 1229426 - RNA, 17 nt, Homo sapiens
aaauuaccucucuugcu

SEQ ID NO: 1229427 - RNA, 14 nt, Homo sapiens
aaauuaccugugga

SEQ ID NO: 1229428 - RNA, 20 nt, Homo sapiens
aaauuagaaagcaacuuauc

SEQ ID NO: 1229429 - RNA, 18 nt, Homo sapiens
aaauuagccauuucacuc

SEQ ID NO: 1229430 - RNA, 16 nt, Homo sapiens
aaauuaggacuguaua

SEQ ID NO: 1229431 - RNA, 17 nt, Homo sapiens
aaauuaguaauguacua

SEQ ID NO: 1229432 - RNA, 22 nt, Homo sapiens
aaauuaguauagcuacuuugga

SEQ ID NO: 1229433 - RNA, 23 nt, Homo sapiens
aaauuauaagcauacaacuggac

SEQ ID NO: 1229434 - RNA, 16 nt, Homo sapiens
aaauuauaucucagua

SEQ ID NO: 1229435 - RNA, 17 nt, Homo sapiens
aaauuauguauguuuac

SEQ ID NO: 1229436 - RNA, 20 nt, Homo sapiens
aaauuaugucuuaguuauaa

SEQ ID NO: 1229437 - RNA, 15 nt, Homo sapiens
aaauuauucugcccu

SEQ ID NO: 1229438 - RNA, 22 nt, Homo sapiens
aaauuauugacgcuuaaccuuu

SEQ ID NO: 1229439 - RNA, 22 nt, Homo sapiens
aaauuauuguuaaagaauacac

SEQ ID NO: 1229440 - RNA, 17 nt, Homo sapiens
aaauucaaccacuguaa

SEQ ID NO: 1229441 - RNA, 14 nt, Homo sapiens
aaauucagaacaag

SEQ ID NO: 1229442 - RNA, 22 nt, Homo sapiens
aaauucaggugaaaauguucau

SEQ ID NO: 1229443 - RNA, 19 nt, Homo sapiens
aaauuccaaauucauggca

SEQ ID NO: 1229444 - RNA, 20 nt, Homo sapiens
aaauuccacacuaccacauu

SEQ ID NO: 1229445 - RNA, 22 nt, Homo sapiens
aaauuccccaagcaccuucccc

SEQ ID NO: 1229446 - RNA, 21 nt, Homo sapiens
aaauuccuacucccucuucca

SEQ ID NO: 1229447 - RNA, 19 nt, Homo sapiens
aaauucuaaagagcacuua

SEQ ID NO: 1229448 - RNA, 13 nt, Homo sapiens
aaauucuaccuua

SEQ ID NO: 1229449 - RNA, 20 nt, Homo sapiens
aaauucuauaggaacauaug

SEQ ID NO: 1229450 - RNA, 14 nt, Homo sapiens
aaauucucugcgau

SEQ ID NO: 1229451 - RNA, 12 nt, Homo sapiens
aaauucugauga

SEQ ID NO: 1229452 - RNA, 24 nt, Homo sapiens
aaauucugaugagcauuacuauuc

SEQ ID NO: 1229453 - RNA, 16 nt, Homo sapiens
aaauugcagaagcagg

SEQ ID NO: 1229454 - RNA, 20 nt, Homo sapiens
aaauugcauauauguauaua

SEQ ID NO: 1229455 - RNA, 19 nt, Homo sapiens
aaauugcuccuaacuccac

SEQ ID NO: 1229456 - RNA, 15 nt, Homo sapiens
aaauugcuccuugac

SEQ ID NO: 1229457 - RNA, 17 nt, Homo sapiens
aaauugcuuacugauau

SEQ ID NO: 1229458 - RNA, 20 nt, Homo sapiens
aaauuggaauuuucuuaccc

SEQ ID NO: 1229459 - RNA, 16 nt, Homo sapiens
aaauugggcaugccau

SEQ ID NO: 1229460 - RNA, 17 nt, Homo sapiens
aaauuggucacuuuccu

SEQ ID NO: 1229461 - RNA, 24 nt, Homo sapiens
aaauuuaagugcguguguagaguu

SEQ ID NO: 1229462 - RNA, 15 nt, Homo sapiens
aaauuuaucuuucaa

SEQ ID NO: 1229463 - RNA, 16 nt, Homo sapiens
aaauuuaugcauuuca

SEQ ID NO: 1229464 - RNA, 22 nt, Homo sapiens
aaauuuaugcauuucauucaaa

SEQ ID NO: 1229465 - RNA, 19 nt, Homo sapiens
aaauuucaaaagacauguu

SEQ ID NO: 1229466 - RNA, 19 nt, Homo sapiens
aacacaugugcagucacug

SEQ ID NO: 1229467 - RNA, 23 nt, Homo sapiens
aacacauucuuauuaauucuuca

SEQ ID NO: 1229468 - RNA, 20 nt, Homo sapiens
aacacauugccuaacuacua

SEQ ID NO: 1229469 - RNA, 18 nt, Homo sapiens
aacaccaacauguuggga

SEQ ID NO: 1229470 - RNA, 15 nt, Homo sapiens
aacaccauuucauca

SEQ ID NO: 1229471 - RNA, 19 nt, Homo sapiens
aacacccaaagcauggacu

SEQ ID NO: 1229472 - RNA, 22 nt, Homo sapiens
aacacccuguagguucuugaua

SEQ ID NO: 1229473 - RNA, 17 nt, Homo sapiens
aacacccuuucaucuca

SEQ ID NO: 1229474 - RNA, 22 nt, Homo sapiens
aacacccuuucaucucagaguc

SEQ ID NO: 1229475 - RNA, 18 nt, Homo sapiens
aacaccgcuucugccuuu

SEQ ID NO: 1229476 - RNA, 17 nt, Homo sapiens
aacaccucacuuuugaa

SEQ ID NO: 1229477 - RNA, 14 nt, Homo sapiens
aacacggugcucau

SEQ ID NO: 1229478 - RNA, 14 nt, Homo sapiens
aacacuaauuauca

SEQ ID NO: 1229479 - RNA, 14 nt, Homo sapiens
aacacuacagggga

SEQ ID NO: 1229480 - RNA, 22 nt, Homo sapiens
aacacuacugcuaaauccucau

SEQ ID NO: 1229481 - RNA, 12 nt, Homo sapiens
aacacucaugaa

SEQ ID NO: 1229482 - RNA, 14 nt, Homo sapiens
aacacugcccucuu

SEQ ID NO: 1229483 - RNA, 23 nt, Homo sapiens
aacacugcuggguuuuacaucca

SEQ ID NO: 1229484 - RNA, 13 nt, Homo sapiens
aacacuggugcca

SEQ ID NO: 1229485 - RNA, 15 nt, Homo sapiens
aacacuggugccaac

SEQ ID NO: 1229486 - RNA, 16 nt, Homo sapiens
aacacuuagugaucau

SEQ ID NO: 1229487 - RNA, 14 nt, Homo sapiens
aacacuugucaaga

SEQ ID NO: 1229488 - RNA, 22 nt, Homo sapiens
aacacuuuggacuucucugaaa

SEQ ID NO: 1229489 - RNA, 18 nt, Homo sapiens
aacagaaagcauccuaaa

SEQ ID NO: 1229490 - RNA, 22 nt, Homo sapiens
aacagaaagccugggugacauu

SEQ ID NO: 1229491 - RNA, 13 nt, Homo sapiens
aacagaacagaca

SEQ ID NO: 1229492 - RNA, 18 nt, Homo sapiens
aacagaacaucauuagaa

SEQ ID NO: 1229493 - RNA, 23 nt, Homo sapiens
aacagacagaugaggacagagcu

SEQ ID NO: 1229494 - RNA, 18 nt, Homo sapiens
aacagaccagugacccca

SEQ ID NO: 1229495 - RNA, 22 nt, Homo sapiens
aacagacucaaaccacauggac

SEQ ID NO: 1229496 - RNA, 12 nt, Homo sapiens
aacagacuugaa

SEQ ID NO: 1229497 - RNA, 19 nt, Homo sapiens
aacagagcaagacuccauc

SEQ ID NO: 1229498 - RNA, 22 nt, Homo sapiens
aacagaggaagaauuuguuauc

SEQ ID NO: 1229499 - RNA, 22 nt, Homo sapiens
aacagauaaucccuguauuuca

SEQ ID NO: 1229500 - RNA, 18 nt, Homo sapiens
aacagauaucagugucuc

SEQ ID NO: 1229501 - RNA, 13 nt, Homo sapiens
aacagaugaauaa

SEQ ID NO: 1229502 - RNA, 17 nt, Homo sapiens
aacagauggcacuuuga

SEQ ID NO: 1229503 - RNA, 20 nt, Homo sapiens
aacagauucaggccagccca

SEQ ID NO: 1229504 - RNA, 20 nt, Homo sapiens
aacagauuuuguuggcauag

SEQ ID NO: 1229505 - RNA, 22 nt, Homo sapiens
aacagcagucccaguauucuca

SEQ ID NO: 1229506 - RNA, 21 nt, Homo sapiens
aacagcauucuugucacaaua

SEQ ID NO: 1229507 - RNA, 17 nt, Homo sapiens
aacagcucgauccaaau

SEQ ID NO: 1229508 - RNA, 20 nt, Homo sapiens
aacagcuguaaucuaugaau

SEQ ID NO: 1229509 - RNA, 19 nt, Homo sapiens
aacaggaauucuauaguaa

SEQ ID NO: 1229510 - RNA, 21 nt, Homo sapiens
aacaggcuguucugcacugaa

SEQ ID NO: 1229511 - RNA, 21 nt, Homo sapiens
aacagggcugccuucuggccu

SEQ ID NO: 1229512 - RNA, 18 nt, Homo sapiens
aacagguaaaacagggcc

SEQ ID NO: 1229513 - RNA, 18 nt, Homo sapiens
aacagguauauacuuuga

SEQ ID NO: 1229514 - RNA, 15 nt, Homo sapiens
aacaguaaucugcau

SEQ ID NO: 1229515 - RNA, 20 nt, Homo sapiens
aacaguccaaacuguucuga

SEQ ID NO: 1229516 - RNA, 12 nt, Homo sapiens
aacagugaaagg

SEQ ID NO: 1229517 - RNA, 13 nt, Homo sapiens
aacagugccauug

SEQ ID NO: 1229518 - RNA, 11 nt, Homo sapiens
aacaguggcug

SEQ ID NO: 1229519 - RNA, 23 nt, Homo sapiens
aacagugggcguugggagccuag

SEQ ID NO: 1229520 - RNA, 22 nt, Homo sapiens
aacaguugcauugacugucaca

SEQ ID NO: 1229521 - RNA, 13 nt, Homo sapiens
aacaguuuuccaa

SEQ ID NO: 1229522 - RNA, 15 nt, Homo sapiens
aacaguuuuccauga

SEQ ID NO: 1229523 - RNA, 22 nt, Homo sapiens
aacauaaguguugguagcacuu

SEQ ID NO: 1229524 - RNA, 22 nt, Homo sapiens
aacauaauaaaucacacauuca

SEQ ID NO: 1229525 - RNA, 23 nt, Homo sapiens
aacauaauaaaucacacauucag

SEQ ID NO: 1229526 - RNA, 17 nt, Homo sapiens
aacauaaugcacuuuag

SEQ ID NO: 1229527 - RNA, 20 nt, Homo sapiens
aacauacuggccuggacugu

SEQ ID NO: 1229528 - RNA, 15 nt, Homo sapiens
aacauagcaucucag

SEQ ID NO: 1229529 - RNA, 23 nt, Homo sapiens
aacauccauguccuaugugugac

SEQ ID NO: 1229530 - RNA, 18 nt, Homo sapiens
aacaucgucuaaacuuua

SEQ ID NO: 1229531 - RNA, 20 nt, Homo sapiens
aacaucuauuauaaaaccau

SEQ ID NO: 1229532 - RNA, 16 nt, Homo sapiens
aacaucucaauaacaa

SEQ ID NO: 1229533 - RNA, 17 nt, Homo sapiens
aacaucuuuuacauucu

SEQ ID NO: 1229534 - RNA, 18 nt, Homo sapiens
aacaucuuuuacauucug

SEQ ID NO: 1229535 - RNA, 18 nt, Homo sapiens
aacaugaagaaugcauuc

SEQ ID NO: 1229536 - RNA, 12 nt, Homo sapiens
aacaugaugaaa

SEQ ID NO: 1229537 - RNA, 12 nt, Homo sapiens
aacaugauuuca

SEQ ID NO: 1229538 - RNA, 18 nt, Homo sapiens
aacaugcaguucauuauu

SEQ ID NO: 1229539 - RNA, 13 nt, Homo sapiens
aacaugccagaag

SEQ ID NO: 1229540 - RNA, 20 nt, Homo sapiens
aacaugcuaaauaguucuau

SEQ ID NO: 1229541 - RNA, 21 nt, Homo sapiens
aacccacuugucacugacaca

SEQ ID NO: 1229542 - RNA, 18 nt, Homo sapiens
aacccaucgguaggcaaa

SEQ ID NO: 1229543 - RNA, 19 nt, Homo sapiens
aacccauguugaucuuucu

SEQ ID NO: 1229544 - RNA, 16 nt, Homo sapiens
aaccccaaacuguuga

SEQ ID NO: 1229545 - RNA, 13 nt, Homo sapiens
aaccccaguggau

SEQ ID NO: 1229546 - RNA, 23 nt, Homo sapiens
aacccccagaccauacugacuca

SEQ ID NO: 1229547 - RNA, 13 nt, Homo sapiens
aacccccaucucu

SEQ ID NO: 1229548 - RNA, 19 nt, Homo sapiens
aaccccccuccugcuccuc

SEQ ID NO: 1229549 - RNA, 17 nt, Homo sapiens
aaccccgcggugcucug

SEQ ID NO: 1229550 - RNA, 12 nt, Homo sapiens
aaccccuuccag

SEQ ID NO: 1229551 - RNA, 21 nt, Homo sapiens
aaccccuuccagaucacugcc

SEQ ID NO: 1229552 - RNA, 22 nt, Homo sapiens
aaccccuuccagaucacugcca

SEQ ID NO: 1229553 - RNA, 18 nt, Homo sapiens
aaccccuugguacugaaa

SEQ ID NO: 1229554 - RNA, 20 nt, Homo sapiens
aacccggcuaugggacugca

SEQ ID NO: 1229555 - RNA, 19 nt, Homo sapiens
aacccuaaucuuucacuug

SEQ ID NO: 1229556 - RNA, 23 nt, Homo sapiens
aacccuagauugggguagaggga

SEQ ID NO: 1229557 - RNA, 20 nt, Homo sapiens
aacccuagucaaaacuauuu

SEQ ID NO: 1229558 - RNA, 19 nt, Homo sapiens
aacccuaucuccugacaga

SEQ ID NO: 1229559 - RNA, 22 nt, Homo sapiens
aacccuggaucaguccuuugau

SEQ ID NO: 1229560 - RNA, 16 nt, Homo sapiens
aacccuucacacccca

SEQ ID NO: 1229561 - RNA, 14 nt, Homo sapiens
aacccuugcuugca

SEQ ID NO: 1229562 - RNA, 12 nt, Homo sapiens
aaccgacaggcc

SEQ ID NO: 1229563 - RNA, 13 nt, Homo sapiens
aaccuacaguuuu

SEQ ID NO: 1229564 - RNA, 22 nt, Homo sapiens
aaccuagucagguuagcugaac

SEQ ID NO: 1229565 - RNA, 12 nt, Homo sapiens
aaccuauuuuca

SEQ ID NO: 1229566 - RNA, 13 nt, Homo sapiens
aaccucaaaaugu

SEQ ID NO: 1229567 - RNA, 16 nt, Homo sapiens
aaccucaaagugacua

SEQ ID NO: 1229568 - RNA, 14 nt, Homo sapiens
aaccucacaaagua

SEQ ID NO: 1229569 - RNA, 22 nt, Homo sapiens
aaccucacaaaguagaggaauc

SEQ ID NO: 1229570 - RNA, 23 nt, Homo sapiens
aaccucagguacggagaagaaua

SEQ ID NO: 1229571 - RNA, 21 nt, Homo sapiens
aaccucaguuauuacauguaa

SEQ ID NO: 1229572 - RNA, 12 nt, Homo sapiens
aaccucauuaau

SEQ ID NO: 1229573 - RNA, 15 nt, Homo sapiens
aaccucauuccccaa

SEQ ID NO: 1229574 - RNA, 15 nt, Homo sapiens
aaccuccuguggaac

SEQ ID NO: 1229575 - RNA, 22 nt, Homo sapiens
aaccuccuguggaacccagcag

SEQ ID NO: 1229576 - RNA, 17 nt, Homo sapiens
aaccucuagagucacug

SEQ ID NO: 1229577 - RNA, 13 nt, Homo sapiens
aaccucuaugcaa

SEQ ID NO: 1229578 - RNA, 22 nt, Homo sapiens
aaccucucugaucuugugcuca

SEQ ID NO: 1229579 - RNA, 17 nt, Homo sapiens
aaccucuucuggcucaa

SEQ ID NO: 1229580 - RNA, 19 nt, Homo sapiens
aaccucuuuucugcaucau

SEQ ID NO: 1229581 - RNA, 15 nt, Homo sapiens
aaccugaacuuucau

SEQ ID NO: 1229582 - RNA, 22 nt, Homo sapiens
aaccugcaguacaacaguuuua

SEQ ID NO: 1229583 - RNA, 18 nt, Homo sapiens
aaccugccaugccaggaa

SEQ ID NO: 1229584 - RNA, 19 nt, Homo sapiens
aaccuggggugaauacuua

SEQ ID NO: 1229585 - RNA, 23 nt, Homo sapiens
aaccuguccuaaggaaccuuccu

SEQ ID NO: 1229586 - RNA, 19 nt, Homo sapiens
aaccugugaagcugaaaag

SEQ ID NO: 1229587 - RNA, 21 nt, Homo sapiens
aaccuuaaagaaccaucagca

SEQ ID NO: 1229588 - RNA, 18 nt, Homo sapiens
aaccuuauuguaccucuc

SEQ ID NO: 1229589 - RNA, 22 nt, Homo sapiens
aaccuugaaaaaaaacagugga

SEQ ID NO: 1229590 - RNA, 21 nt, Homo sapiens
aaccuugcuguccugaucugu

SEQ ID NO: 1229591 - RNA, 21 nt, Homo sapiens
aaccuuguuuggggcacagua

SEQ ID NO: 1229592 - RNA, 19 nt, Homo sapiens
aacgauuuuaugaaaugac

SEQ ID NO: 1229593 - RNA, 17 nt, Homo sapiens
aacgcacacaguaucua

SEQ ID NO: 1229594 - RNA, 21 nt, Homo sapiens
aacgcacacaguaucuaguca

SEQ ID NO: 1229595 - RNA, 16 nt, Homo sapiens
aacgcacuaacccagc

SEQ ID NO: 1229596 - RNA, 19 nt, Homo sapiens
aacgccccgggcaaagggu

SEQ ID NO: 1229597 - RNA, 18 nt, Homo sapiens
aacgcuaacaauuucuca

SEQ ID NO: 1229598 - RNA, 12 nt, Homo sapiens
aacgcuugugaa

SEQ ID NO: 1229599 - RNA, 15 nt, Homo sapiens
aacggagagugcuug

SEQ ID NO: 1229600 - RNA, 22 nt, Homo sapiens
aacgggacccccuggcccugcc

SEQ ID NO: 1229601 - RNA, 19 nt, Homo sapiens
aacgguuccuggugacucc

SEQ ID NO: 1229602 - RNA, 21 nt, Homo sapiens
aacguagcuucuaccaugaac

SEQ ID NO: 1229603 - RNA, 15 nt, Homo sapiens
aacgucagccagcuc

SEQ ID NO: 1229604 - RNA, 16 nt, Homo sapiens
aacgucuuuuuauauc

SEQ ID NO: 1229605 - RNA, 15 nt, Homo sapiens
aacguggcacuggua

SEQ ID NO: 1229606 - RNA, 20 nt, Homo sapiens
aacguucgauuucuaccuca

SEQ ID NO: 1229607 - RNA, 15 nt, Homo sapiens
aacuaaacagauaaa

SEQ ID NO: 1229608 - RNA, 13 nt, Homo sapiens
aacuaagcacaaa

SEQ ID NO: 1229609 - RNA, 18 nt, Homo sapiens
aacuaauaaaacuuugac

SEQ ID NO: 1229610 - RNA, 22 nt, Homo sapiens
aacuaaucaagaaaaacaucuu

SEQ ID NO: 1229611 - RNA, 18 nt, Homo sapiens
aacuacaacgaacacaag

SEQ ID NO: 1229612 - RNA, 19 nt, Homo sapiens
aacugguauauacauauau

SEQ ID NO: 1229613 - RNA, 13 nt, Homo sapiens
aacugguuguaua

SEQ ID NO: 1229614 - RNA, 23 nt, Homo sapiens
aacuguacauuuaaaauugcuau

SEQ ID NO: 1229615 - RNA, 14 nt, Homo sapiens
aacuguacuacauc

SEQ ID NO: 1229616 - RNA, 15 nt, Homo sapiens
aacuguagggccagg

SEQ ID NO: 1229617 - RNA, 17 nt, Homo sapiens
aacuguauauauuccca

SEQ ID NO: 1229618 - RNA, 17 nt, Homo sapiens
aacugucaccagccgca

SEQ ID NO: 1229619 - RNA, 14 nt, Homo sapiens
aacugucacucauu

SEQ ID NO: 1229620 - RNA, 17 nt, Homo sapiens
aacugucucaaaaggau

SEQ ID NO: 1229621 - RNA, 22 nt, Homo sapiens
aacugugaaauaccacaagccu

SEQ ID NO: 1229622 - RNA, 20 nt, Homo sapiens
aacugugaauacuugaacuc

SEQ ID NO: 1229623 - RNA, 17 nt, Homo sapiens
aacuguguauguacaua

SEQ ID NO: 1229624 - RNA, 18 nt, Homo sapiens
aacuguguauguacauau

SEQ ID NO: 1229625 - RNA, 17 nt, Homo sapiens
aacuguguggacuguga

SEQ ID NO: 1229626 - RNA, 13 nt, Homo sapiens
aacuguuaugaaa

SEQ ID NO: 1229627 - RNA, 18 nt, Homo sapiens
aacuguuccugacuuuau

SEQ ID NO: 1229628 - RNA, 11 nt, Homo sapiens
aacuguugcuc

SEQ ID NO: 1229629 - RNA, 23 nt, Homo sapiens
aacuguuuuguaagugcugcuau

SEQ ID NO: 1229630 - RNA, 12 nt, Homo sapiens
aacuuaauguuc

SEQ ID NO: 1229631 - RNA, 18 nt, Homo sapiens
aacuuacuguauauguau

SEQ ID NO: 1229632 - RNA, 22 nt, Homo sapiens
aacuuagaggaaaagggcacag

SEQ ID NO: 1229633 - RNA, 16 nt, Homo sapiens
aacuuaggcaugcaca

SEQ ID NO: 1229634 - RNA, 23 nt, Homo sapiens
aacuuaggcccuagcggcagaaa

SEQ ID NO: 1229635 - RNA, 15 nt, Homo sapiens
aacuucaaagaggaa

SEQ ID NO: 1229636 - RNA, 16 nt, Homo sapiens
aacuucaccuacauua

SEQ ID NO: 1229637 - RNA, 20 nt, Homo sapiens
aacuucacuaccaagcagcu

SEQ ID NO: 1229638 - RNA, 19 nt, Homo sapiens
aacuucagaugggaggaaa

SEQ ID NO: 1229639 - RNA, 13 nt, Homo sapiens
aacuucagggauc

SEQ ID NO: 1229640 - RNA, 12 nt, Homo sapiens
aacuuccaguca

SEQ ID NO: 1229641 - RNA, 16 nt, Homo sapiens
aacuucccagugaauu

SEQ ID NO: 1229642 - RNA, 19 nt, Homo sapiens
aacuuccgcugaggggucu

SEQ ID NO: 1229643 - RNA, 12 nt, Homo sapiens
aacuucuuguca

SEQ ID NO: 1229644 - RNA, 18 nt, Homo sapiens
aacuucuuuuaaaccuca

SEQ ID NO: 1229645 - RNA, 11 nt, Homo sapiens
aacuuggcacu

SEQ ID NO: 1229646 - RNA, 22 nt, Homo sapiens
aacuugguucugcuucaauaaa

SEQ ID NO: 1229647 - RNA, 15 nt, Homo sapiens
aacuuguagcuguaa

SEQ ID NO: 1229648 - RNA, 16 nt, Homo sapiens
aacuuguagcuguaaa

SEQ ID NO: 1229649 - RNA, 14 nt, Homo sapiens
aacuuguccugacu

SEQ ID NO: 1229650 - RNA, 22 nt, Homo sapiens
aacuuucagaggcaauagguaa

SEQ ID NO: 1229651 - RNA, 19 nt, Homo sapiens
aacuuuccucgccugacaa

SEQ ID NO: 1229652 - RNA, 23 nt, Homo sapiens
aacuuuccugacuuacaauacca

SEQ ID NO: 1229653 - RNA, 23 nt, Homo sapiens
aacuuugacgagucaccuuccag

SEQ ID NO: 1229654 - RNA, 14 nt, Homo sapiens
aacuuugccaaaaa

SEQ ID NO: 1229655 - RNA, 20 nt, Homo sapiens
aacuuuguggaugucuuccu

SEQ ID NO: 1229656 - RNA, 17 nt, Homo sapiens
aacuuuuugcaugcuua

SEQ ID NO: 1229657 - RNA, 16 nt, Homo sapiens
aagaaaaaauaucuug

SEQ ID NO: 1229658 - RNA, 21 nt, Homo sapiens
aagaaaaacaccgcuucugcc

SEQ ID NO: 1229659 - RNA, 14 nt, Homo sapiens
aagaaaaacaucuu

SEQ ID NO: 1229660 - RNA, 18 nt, Homo sapiens
aagaaaaacaucuuuggc

SEQ ID NO: 1229661 - RNA, 13 nt, Homo sapiens
aagaaaaaccacu

SEQ ID NO: 1229662 - RNA, 14 nt, Homo sapiens
aagaaaaauaucuu

SEQ ID NO: 1229663 - RNA, 15 nt, Homo sapiens
aagaaaagcugccau

SEQ ID NO: 1229664 - RNA, 15 nt, Homo sapiens
aagaaaauagucagu

SEQ ID NO: 1229665 - RNA, 13 nt, Homo sapiens
aagaaaaucacuu

SEQ ID NO: 1229666 - RNA, 14 nt, Homo sapiens
aagaaaaugagaca

SEQ ID NO: 1229667 - RNA, 16 nt, Homo sapiens
aagaaaaugcuugaca

SEQ ID NO: 1229668 - RNA, 13 nt, Homo sapiens
aagaaaauggauu

SEQ ID NO: 1229669 - RNA, 21 nt, Homo sapiens
aagaaacacagcaacaaugac

SEQ ID NO: 1229670 - RNA, 17 nt, Homo sapiens
aagaaacagaguggccu

SEQ ID NO: 1229671 - RNA, 22 nt, Homo sapiens
aagaaaccuucagauuuguguu

SEQ ID NO: 1229672 - RNA, 20 nt, Homo sapiens
aagaaacugaugaaugauga

SEQ ID NO: 1229673 - RNA, 14 nt, Homo sapiens
aagaaagacuaucu

SEQ ID NO: 1229674 - RNA, 20 nt, Homo sapiens
aagaaagacucuauucucaa

SEQ ID NO: 1229675 - RNA, 14 nt, Homo sapiens
aagaaagaucaaag

SEQ ID NO: 1229676 - RNA, 11 nt, Homo sapiens
aagaaagcaaa

SEQ ID NO: 1229677 - RNA, 22 nt, Homo sapiens
aagaaagcaaugccaaucuuca

SEQ ID NO: 1229678 - RNA, 14 nt, Homo sapiens
aagaaauauuccuu

SEQ ID NO: 1229679 - RNA, 14 nt, Homo sapiens
aagaaaucuugucu

SEQ ID NO: 1229680 - RNA, 11 nt, Homo sapiens
aagaaaugcaa

SEQ ID NO: 1229681 - RNA, 12 nt, Homo sapiens
aagaaaugcaaa

SEQ ID NO: 1229682 - RNA, 19 nt, Homo sapiens
aagaacacaugugcaguca

SEQ ID NO: 1229683 - RNA, 12 nt, Homo sapiens
aagaacaccauc

SEQ ID NO: 1229684 - RNA, 16 nt, Homo sapiens
aagaaccagacugugu

SEQ ID NO: 1229685 - RNA, 12 nt, Homo sapiens
aagaaccagaga

SEQ ID NO: 1229686 - RNA, 21 nt, Homo sapiens
aagaagacuguugccacuuaa

SEQ ID NO: 1229687 - RNA, 18 nt, Homo sapiens
aagaagagacucuuugca

SEQ ID NO: 1229688 - RNA, 18 nt, Homo sapiens
aagaagcccauaucacau

SEQ ID NO: 1229689 - RNA, 20 nt, Homo sapiens
aagaagcucgccccaccucc

SEQ ID NO: 1229690 - RNA, 16 nt, Homo sapiens
aagaagcuuuaauauu

SEQ ID NO: 1229691 - RNA, 15 nt, Homo sapiens
aagaagcuuuauuuc

SEQ ID NO: 1229692 - RNA, 13 nt, Homo sapiens
aagaaggaacaau

SEQ ID NO: 1229693 - RNA, 14 nt, Homo sapiens
aagaaggauaccaa

SEQ ID NO: 1229694 - RNA, 20 nt, Homo sapiens
aagaaggauaccaaauacca

SEQ ID NO: 1229695 - RNA, 17 nt, Homo sapiens
aagaaggguguuuaaua

SEQ ID NO: 1229696 - RNA, 18 nt, Homo sapiens
aagaagugaaaauagcca

SEQ ID NO: 1229697 - RNA, 16 nt, Homo sapiens
aagaaguuacuuugua

SEQ ID NO: 1229698 - RNA, 16 nt, Homo sapiens
aagaaguuauauucug

SEQ ID NO: 1229699 - RNA, 21 nt, Homo sapiens
aagaaguuguuugaggcaaau

SEQ ID NO: 1229700 - RNA, 17 nt, Homo sapiens
aagaauaaaauugcacu

SEQ ID NO: 1229701 - RNA, 13 nt, Homo sapiens
aagaauacacaau

SEQ ID NO: 1229702 - RNA, 13 nt, Homo sapiens
aagaaugaucagc

SEQ ID NO: 1229703 - RNA, 14 nt, Homo sapiens
aagaaugcauucaa

SEQ ID NO: 1229704 - RNA, 12 nt, Homo sapiens
aagaaugcucuu

SEQ ID NO: 1229705 - RNA, 19 nt, Homo sapiens
aagaaugugcuaugaagcu

SEQ ID NO: 1229706 - RNA, 20 nt, Homo sapiens
aagaauguugguuuacuuuc

SEQ ID NO: 1229707 - RNA, 20 nt, Homo sapiens
aagaauucuguacuuccaau

SEQ ID NO: 1229708 - RNA, 12 nt, Homo sapiens
aagaauugcacg

SEQ ID NO: 1229709 - RNA, 22 nt, Homo sapiens
aagaauuuaaaacgcaugugca

SEQ ID NO: 1229710 - RNA, 17 nt, Homo sapiens
aagaauuucacaagcua

SEQ ID NO: 1229711 - RNA, 20 nt, Homo sapiens
aagacaaaauaaacauuuua

SEQ ID NO: 1229712 - RNA, 23 nt, Homo sapiens
aagacaaauuagccauuucacuc

SEQ ID NO: 1229713 - RNA, 14 nt, Homo sapiens
aagacaacauuucu

SEQ ID NO: 1229714 - RNA, 17 nt, Homo sapiens
aagacaccagagcagau

SEQ ID NO: 1229715 - RNA, 17 nt, Homo sapiens
aagacaccguucauuca

SEQ ID NO: 1229716 - RNA, 16 nt, Homo sapiens
aagacagcugcugggu

SEQ ID NO: 1229717 - RNA, 22 nt, Homo sapiens
aagacauaacguuuuuccuuua

SEQ ID NO: 1229718 - RNA, 20 nt, Homo sapiens
aagacauacuccuuccauca

SEQ ID NO: 1229719 - RNA, 15 nt, Homo sapiens
aagaccaaaaugaca

SEQ ID NO: 1229720 - RNA, 14 nt, Homo sapiens
aagaccaaagcaga

SEQ ID NO: 1229721 - RNA, 15 nt, Homo sapiens
aagaccaaagcauug

SEQ ID NO: 1229722 - RNA, 21 nt, Homo sapiens
aagaccacacuugguguuacc

SEQ ID NO: 1229723 - RNA, 11 nt, Homo sapiens
aagaccagcuu

SEQ ID NO: 1229724 - RNA, 21 nt, Homo sapiens
aagaccagcuuugcagugaca

SEQ ID NO: 1229725 - RNA, 16 nt, Homo sapiens
aagaccaguauuucag

SEQ ID NO: 1229726 - RNA, 16 nt, Homo sapiens
aagacccccagcacuu

SEQ ID NO: 1229727 - RNA, 14 nt, Homo sapiens
aagaccgauugcau

SEQ ID NO: 1229728 - RNA, 13 nt, Homo sapiens
aagaccuaccucc

SEQ ID NO: 1229729 - RNA, 17 nt, Homo sapiens
aagaccuagugcucuua

SEQ ID NO: 1229730 - RNA, 18 nt, Homo sapiens
aagaccuauaaaucauua

SEQ ID NO: 1229731 - RNA, 23 nt, Homo sapiens
aagaccuggagcggcuauuccag

SEQ ID NO: 1229732 - RNA, 16 nt, Homo sapiens
aagacgccuucaucug

SEQ ID NO: 1229733 - RNA, 13 nt, Homo sapiens
aagacuacugaau

SEQ ID NO: 1229734 - RNA, 13 nt, Homo sapiens
aagacucaccuca

SEQ ID NO: 1229735 - RNA, 21 nt, Homo sapiens
aagacucaccucauccuuacc

SEQ ID NO: 1229736 - RNA, 14 nt, Homo sapiens
aagacuccaucuca

SEQ ID NO: 1229737 - RNA, 15 nt, Homo sapiens
aagacuccucugggc

SEQ ID NO: 1229738 - RNA, 17 nt, Homo sapiens
aagacugaaucuaccug

SEQ ID NO: 1229739 - RNA, 18 nt, Homo sapiens
aagacugucagcuuccaa

SEQ ID NO: 1229740 - RNA, 15 nt, Homo sapiens
aagacuuaacugguu

SEQ ID NO: 1229741 - RNA, 23 nt, Homo sapiens
aagccucagcuacccacuauccu

SEQ ID NO: 1229742 - RNA, 16 nt, Homo sapiens
aagccugagaacugaa

SEQ ID NO: 1229743 - RNA, 20 nt, Homo sapiens
aagccugggcuugagcugca

SEQ ID NO: 1229744 - RNA, 18 nt, Homo sapiens
aagccuuaaaaugcauug

SEQ ID NO: 1229745 - RNA, 23 nt, Homo sapiens
aagccuuauuucuagaagcacau

SEQ ID NO: 1229746 - RNA, 13 nt, Homo sapiens
aagccuugccuaa

SEQ ID NO: 1229747 - RNA, 22 nt, Homo sapiens
aagccuuuuguuucccuugcuu

SEQ ID NO: 1229748 - RNA, 17 nt, Homo sapiens
aagcgaauguguacaaa

SEQ ID NO: 1229749 - RNA, 22 nt, Homo sapiens
aagcgacccauucagagacugu

SEQ ID NO: 1229750 - RNA, 22 nt, Homo sapiens
aagcgagucauuucguucccug

SEQ ID NO: 1229751 - RNA, 17 nt, Homo sapiens
aagcgcacauucaugug

SEQ ID NO: 1229752 - RNA, 17 nt, Homo sapiens
aagcggauuuccaggga

SEQ ID NO: 1229753 - RNA, 21 nt, Homo sapiens
aagcguaauuuugccaaauaa

SEQ ID NO: 1229754 - RNA, 21 nt, Homo sapiens
aagcuacuauguacugccuua

SEQ ID NO: 1229755 - RNA, 13 nt, Homo sapiens
aagcuaggauggu

SEQ ID NO: 1229756 - RNA, 14 nt, Homo sapiens
aagcuaggucgugg

SEQ ID NO: 1229757 - RNA, 14 nt, Homo sapiens
aagcuagguguuua

SEQ ID NO: 1229758 - RNA, 18 nt, Homo sapiens
aagcuaguguaccuccuc

SEQ ID NO: 1229759 - RNA, 21 nt, Homo sapiens
aagcucacucuggauuccaca

SEQ ID NO: 1229760 - RNA, 14 nt, Homo sapiens
aagcuccacuguca

SEQ ID NO: 1229761 - RNA, 15 nt, Homo sapiens
aagcucccagcugac

SEQ ID NO: 1229762 - RNA, 13 nt, Homo sapiens
aagcuccucguga

SEQ ID NO: 1229763 - RNA, 14 nt, Homo sapiens
aagcucgagugaau

SEQ ID NO: 1229764 - RNA, 14 nt, Homo sapiens
aagcucuagaaucu

SEQ ID NO: 1229765 - RNA, 17 nt, Homo sapiens
aagcucuguugcaauua

SEQ ID NO: 1229766 - RNA, 13 nt, Homo sapiens
aagcucuucuaaa

SEQ ID NO: 1229767 - RNA, 16 nt, Homo sapiens
aagcugaaaggaugau

SEQ ID NO: 1229768 - RNA, 16 nt, Homo sapiens
aagcugacuuggcacu

SEQ ID NO: 1229769 - RNA, 20 nt, Homo sapiens
aagcugaugacaacuuccca

SEQ ID NO: 1229770 - RNA, 15 nt, Homo sapiens
aagcugcacaugugc

SEQ ID NO: 1229771 - RNA, 17 nt, Homo sapiens
aagcugccgguucuuaa

SEQ ID NO: 1229772 - RNA, 20 nt, Homo sapiens
aagcugcuccaggccugcag

SEQ ID NO: 1229773 - RNA, 21 nt, Homo sapiens
aagcuggauuauuuagaucua

SEQ ID NO: 1229774 - RNA, 14 nt, Homo sapiens
aagcuggcccugcc

SEQ ID NO: 1229775 - RNA, 21 nt, Homo sapiens
aagcugggauaaucacauuau

SEQ ID NO: 1229776 - RNA, 23 nt, Homo sapiens
aagcugguugucuuuacaugaaa

SEQ ID NO: 1229777 - RNA, 21 nt, Homo sapiens
aagcuguacucagagcagagc

SEQ ID NO: 1229778 - RNA, 14 nt, Homo sapiens
aagcugucagggac

SEQ ID NO: 1229779 - RNA, 14 nt, Homo sapiens
aagcugucuuagag

SEQ ID NO: 1229780 - RNA, 15 nt, Homo sapiens
aagcugugacuucuc

SEQ ID NO: 1229781 - RNA, 19 nt, Homo sapiens
aagcuguuuccauagggug

SEQ ID NO: 1229782 - RNA, 17 nt, Homo sapiens
aagcuugaagcugugga

SEQ ID NO: 1229783 - RNA, 20 nt, Homo sapiens
aagcuuggggaacccaugag

SEQ ID NO: 1229784 - RNA, 14 nt, Homo sapiens
aagcuuuggacaag

SEQ ID NO: 1229785 - RNA, 19 nt, Homo sapiens
aagcuuuuuacucaaagag

SEQ ID NO: 1229786 - RNA, 21 nt, Homo sapiens
aagcuuuuuauuccuccugcu

SEQ ID NO: 1229787 - RNA, 21 nt, Homo sapiens
aagcuuuuuccuccuggaaca

SEQ ID NO: 1229788 - RNA, 13 nt, Homo sapiens
aaggaaaaauaau

SEQ ID NO: 1229789 - RNA, 20 nt, Homo sapiens
aaggaaaaaugcugcuucuc

SEQ ID NO: 1229790 - RNA, 14 nt, Homo sapiens
aaggaaaagcaaga

SEQ ID NO: 1229791 - RNA, 18 nt, Homo sapiens
aaggaaaccaagugguca

SEQ ID NO: 1229792 - RNA, 19 nt, Homo sapiens
aaggaaagauuugugaacu

SEQ ID NO: 1229793 - RNA, 12 nt, Homo sapiens
aaggaaagcuca

SEQ ID NO: 1229794 - RNA, 12 nt, Homo sapiens
aaggaaagugau

SEQ ID NO: 1229795 - RNA, 18 nt, Homo sapiens
aaggaaauacccuucuuu

SEQ ID NO: 1229796 - RNA, 21 nt, Homo sapiens
aaggaaauaguaccuucaaua

SEQ ID NO: 1229797 - RNA, 15 nt, Homo sapiens
aaggaacugucacca

SEQ ID NO: 1229798 - RNA, 12 nt, Homo sapiens
aaggaacuucca

SEQ ID NO: 1229799 - RNA, 23 nt, Homo sapiens
aaggaagaaaagcugccauuucc

SEQ ID NO: 1229800 - RNA, 19 nt, Homo sapiens
aaggaagcuccacugucac

SEQ ID NO: 1229801 - RNA, 17 nt, Homo sapiens
aaggaagcuguguugaa

SEQ ID NO: 1229802 - RNA, 15 nt, Homo sapiens
aaguggcaagaccaa

SEQ ID NO: 1229803 - RNA, 12 nt, Homo sapiens
aaguggcagcuu

SEQ ID NO: 1229804 - RNA, 19 nt, Homo sapiens
aaguggcagcuucacucga

SEQ ID NO: 1229805 - RNA, 16 nt, Homo sapiens
aaguguaccuguguac

SEQ ID NO: 1229806 - RNA, 18 nt, Homo sapiens
aaguguauuagauguggu

SEQ ID NO: 1229807 - RNA, 16 nt, Homo sapiens
aaguguccuucuugcu

SEQ ID NO: 1229808 - RNA, 18 nt, Homo sapiens
aagugugaccccacugcc

SEQ ID NO: 1229809 - RNA, 23 nt, Homo sapiens
aaguguguacaagcauucaagaa

SEQ ID NO: 1229810 - RNA, 18 nt, Homo sapiens
aaguguugcucuuggaaa

SEQ ID NO: 1229811 - RNA, 18 nt, Homo sapiens
aaguguuugauggugcca

SEQ ID NO: 1229812 - RNA, 20 nt, Homo sapiens
aaguguuuucucagaacagc

SEQ ID NO: 1229813 - RNA, 16 nt, Homo sapiens
aaguguuuuuuauuga

SEQ ID NO: 1229814 - RNA, 14 nt, Homo sapiens
aaguuacacuuuua

SEQ ID NO: 1229815 - RNA, 20 nt, Homo sapiens
aaguuacuagguaacuucau

SEQ ID NO: 1229816 - RNA, 15 nt, Homo sapiens
aaguuacucugccuu

SEQ ID NO: 1229817 - RNA, 14 nt, Homo sapiens
aaguuacuuuguaa

SEQ ID NO: 1229818 - RNA, 23 nt, Homo sapiens
aaguuaggguuuaggcaucauuu

SEQ ID NO: 1229819 - RNA, 12 nt, Homo sapiens
aaguuauagcuu

SEQ ID NO: 1229820 - RNA, 21 nt, Homo sapiens
aaguuauaguauaucuggaca

SEQ ID NO: 1229821 - RNA, 16 nt, Homo sapiens
aaguuauugauguuuu

SEQ ID NO: 1229822 - RNA, 23 nt, Homo sapiens
aaguuauuuacuuuuaccacuau

SEQ ID NO: 1229823 - RNA, 17 nt, Homo sapiens
aaguucaacuuccagaa

SEQ ID NO: 1229824 - RNA, 13 nt, Homo sapiens
aaguucaugucua

SEQ ID NO: 1229825 - RNA, 21 nt, Homo sapiens
aaguuccaagagucuaaagau

SEQ ID NO: 1229826 - RNA, 22 nt, Homo sapiens
aaguucgaagcuccgugaguga

SEQ ID NO: 1229827 - RNA, 15 nt, Homo sapiens
aaguucuaaguucau

SEQ ID NO: 1229828 - RNA, 14 nt, Homo sapiens
aaguugcuaauaca

SEQ ID NO: 1229829 - RNA, 15 nt, Homo sapiens
aaguugcuccauaca

SEQ ID NO: 1229830 - RNA, 17 nt, Homo sapiens
aaguugcugaugaacuc

SEQ ID NO: 1229831 - RNA, 20 nt, Homo sapiens
aaguugcugaugaacucuua

SEQ ID NO: 1229832 - RNA, 14 nt, Homo sapiens
aaguugugauuuga

SEQ ID NO: 1229833 - RNA, 19 nt, Homo sapiens
aaguuuacaaucaaaggaa

SEQ ID NO: 1229834 - RNA, 15 nt, Homo sapiens
aaguuuacacuucau

SEQ ID NO: 1229835 - RNA, 11 nt, Homo sapiens
aaguuucacau

SEQ ID NO: 1229836 - RNA, 18 nt, Homo sapiens
aaguuucugauaccacug

SEQ ID NO: 1229837 - RNA, 17 nt, Homo sapiens
aaguuugcacucuuuga

SEQ ID NO: 1229838 - RNA, 23 nt, Homo sapiens
aaguuugggccagugaacagggu

SEQ ID NO: 1229839 - RNA, 21 nt, Homo sapiens
aaguuugucacuaaacucuca

SEQ ID NO: 1229840 - RNA, 14 nt, Homo sapiens
aaguuuuacauugu

SEQ ID NO: 1229841 - RNA, 14 nt, Homo sapiens
aaguuuugaugaaa

SEQ ID NO: 1229842 - RNA, 23 nt, Homo sapiens
aauaaaaaaugggaacauacaga

SEQ ID NO: 1229843 - RNA, 16 nt, Homo sapiens
aauaaaaagaucacuu

SEQ ID NO: 1229844 - RNA, 20 nt, Homo sapiens
aauaaaaagugacacagcag

SEQ ID NO: 1229845 - RNA, 14 nt, Homo sapiens
aauaaaaaugcacg

SEQ ID NO: 1229846 - RNA, 20 nt, Homo sapiens
aauaaaacagcugucucuaa

SEQ ID NO: 1229847 - RNA, 12 nt, Homo sapiens
aauaaaacugaa

SEQ ID NO: 1229848 - RNA, 14 nt, Homo sapiens
aauaaaacugcaca

SEQ ID NO: 1229849 - RNA, 18 nt, Homo sapiens
aauaaaacugcacagugc

SEQ ID NO: 1229850 - RNA, 18 nt, Homo sapiens
aauaaaaggaaucuuccu

SEQ ID NO: 1229851 - RNA, 13 nt, Homo sapiens
aauaaaauaauuc

SEQ ID NO: 1229852 - RNA, 15 nt, Homo sapiens
aauaaaauguguaca

SEQ ID NO: 1229853 - RNA, 13 nt, Homo sapiens
aauaaacaucagu

SEQ ID NO: 1229854 - RNA, 13 nt, Homo sapiens
aauaaaccaaaua

SEQ ID NO: 1229855 - RNA, 12 nt, Homo sapiens
aauaaaccuccu

SEQ ID NO: 1229856 - RNA, 16 nt, Homo sapiens
aauaaacgcauuauca

SEQ ID NO: 1229857 - RNA, 16 nt, Homo sapiens
aauaaacuccuacuaa

SEQ ID NO: 1229858 - RNA, 18 nt, Homo sapiens
aauaaacuccuacuaaau

SEQ ID NO: 1229859 - RNA, 17 nt, Homo sapiens
aauaaacugguaugaau

SEQ ID NO: 1229860 - RNA, 14 nt, Homo sapiens
aauaaacugugcaa

SEQ ID NO: 1229861 - RNA, 20 nt, Homo sapiens
aauaaagaauuaacagagau

SEQ ID NO: 1229862 - RNA, 15 nt, Homo sapiens
aauaaagcaaugugg

SEQ ID NO: 1229863 - RNA, 13 nt, Homo sapiens
aauaaaggaagca

SEQ ID NO: 1229864 - RNA, 18 nt, Homo sapiens
aauaaaggcagcugccuc

SEQ ID NO: 1229865 - RNA, 15 nt, Homo sapiens
aauaaaguaccacac

SEQ ID NO: 1229866 - RNA, 17 nt, Homo sapiens
aauaaauaauucuuccu

SEQ ID NO: 1229867 - RNA, 15 nt, Homo sapiens
aauaaaucuuuggaa

SEQ ID NO: 1229868 - RNA, 12 nt, Homo sapiens
aauaaaugacaa

SEQ ID NO: 1229869 - RNA, 14 nt, Homo sapiens
aauaaaugacaaau

SEQ ID NO: 1229870 - RNA, 22 nt, Homo sapiens
aauaaaugacaagugagacaaa

SEQ ID NO: 1229871 - RNA, 20 nt, Homo sapiens
accaacugcugcugugcaca

SEQ ID NO: 1229872 - RNA, 19 nt, Homo sapiens
accaagcauuccugcucaa

SEQ ID NO: 1229873 - RNA, 17 nt, Homo sapiens
accaaggauauuuacag

SEQ ID NO: 1229874 - RNA, 11 nt, Homo sapiens
accaaggugac

SEQ ID NO: 1229875 - RNA, 17 nt, Homo sapiens
accaaguaccaguauaa

SEQ ID NO: 1229876 - RNA, 17 nt, Homo sapiens
accaagucaaacuugga

SEQ ID NO: 1229877 - RNA, 23 nt, Homo sapiens
accaagugucuagagucauguga

SEQ ID NO: 1229878 - RNA, 15 nt, Homo sapiens
accaauagcaucugu

SEQ ID NO: 1229879 - RNA, 13 nt, Homo sapiens
accaauagcuuua

SEQ ID NO: 1229880 - RNA, 12 nt, Homo sapiens
accaaucucuaa

SEQ ID NO: 1229881 - RNA, 22 nt, Homo sapiens
accaaugguccuagaacuuugu

SEQ ID NO: 1229882 - RNA, 23 nt, Homo sapiens
accaauuugguaaaaaugcugcu

SEQ ID NO: 1229883 - RNA, 22 nt, Homo sapiens
accacaaccaccuucaccugga

SEQ ID NO: 1229884 - RNA, 19 nt, Homo sapiens
accacaacugacacaggaa

SEQ ID NO: 1229885 - RNA, 20 nt, Homo sapiens
accacaacugacacaggaaa

SEQ ID NO: 1229886 - RNA, 16 nt, Homo sapiens
accacaaggggcucca

SEQ ID NO: 1229887 - RNA, 11 nt, Homo sapiens
accacacaaag

SEQ ID NO: 1229888 - RNA, 15 nt, Homo sapiens
accacacauauugca

SEQ ID NO: 1229889 - RNA, 16 nt, Homo sapiens
accacacauauugcac

SEQ ID NO: 1229890 - RNA, 14 nt, Homo sapiens
accacaccaucagg

SEQ ID NO: 1229891 - RNA, 19 nt, Homo sapiens
accacacgcccccacaggc

SEQ ID NO: 1229892 - RNA, 13 nt, Homo sapiens
accacacugaguu

SEQ ID NO: 1229893 - RNA, 12 nt, Homo sapiens
accacagacugu

SEQ ID NO: 1229894 - RNA, 14 nt, Homo sapiens
accacagcacuauu

SEQ ID NO: 1229895 - RNA, 17 nt, Homo sapiens
accacagcagagaccac

SEQ ID NO: 1229896 - RNA, 18 nt, Homo sapiens
accacagggccagaggga

SEQ ID NO: 1229897 - RNA, 17 nt, Homo sapiens
accacagguucaugcca

SEQ ID NO: 1229898 - RNA, 15 nt, Homo sapiens
accacagugucugua

SEQ ID NO: 1229899 - RNA, 18 nt, Homo sapiens
accacaucuugcucugcu

SEQ ID NO: 1229900 - RNA, 13 nt, Homo sapiens
accacauggacca

SEQ ID NO: 1229901 - RNA, 20 nt, Homo sapiens
accaccaagaaagccuucaa

SEQ ID NO: 1229902 - RNA, 17 nt, Homo sapiens
accaccauccaccgcug

SEQ ID NO: 1229903 - RNA, 16 nt, Homo sapiens
accacccacaaucaca

SEQ ID NO: 1229904 - RNA, 21 nt, Homo sapiens
accaccccaacaaaccaucca

SEQ ID NO: 1229905 - RNA, 14 nt, Homo sapiens
accaccuaauccuu

SEQ ID NO: 1229906 - RNA, 13 nt, Homo sapiens
accacgacuggcc

SEQ ID NO: 1229907 - RNA, 18 nt, Homo sapiens
accacuaaaguauagaga

SEQ ID NO: 1229908 - RNA, 23 nt, Homo sapiens
accacuagaaagugggcuuaaug

SEQ ID NO: 1229909 - RNA, 21 nt, Homo sapiens
accacucaggccaacaagcca

SEQ ID NO: 1229910 - RNA, 17 nt, Homo sapiens
accacuccauucccaac

SEQ ID NO: 1229911 - RNA, 13 nt, Homo sapiens
accacuucacuga

SEQ ID NO: 1229912 - RNA, 14 nt, Homo sapiens
accacuuccugcua

SEQ ID NO: 1229913 - RNA, 19 nt, Homo sapiens
accacuuuuaacagaacag

SEQ ID NO: 1229914 - RNA, 13 nt, Homo sapiens
accagacaaggaa

SEQ ID NO: 1229915 - RNA, 16 nt, Homo sapiens
accagacacguacaaa

SEQ ID NO: 1229916 - RNA, 21 nt, Homo sapiens
accagagccuucaagugccaa

SEQ ID NO: 1229917 - RNA, 17 nt, Homo sapiens
accagagucaaauuuga

SEQ ID NO: 1229918 - RNA, 21 nt, Homo sapiens
accagaucugucuccaagacc

SEQ ID NO: 1229919 - RNA, 18 nt, Homo sapiens
accagcagcccugucacg

SEQ ID NO: 1229920 - RNA, 21 nt, Homo sapiens
accagccguauuuuacaugaa

SEQ ID NO: 1229921 - RNA, 22 nt, Homo sapiens
accagccuggccaucaugguga

SEQ ID NO: 1229922 - RNA, 21 nt, Homo sapiens
accagcuaucugucaucucuc

SEQ ID NO: 1229923 - RNA, 21 nt, Homo sapiens
accagcuucugauaaacacaa

SEQ ID NO: 1229924 - RNA, 14 nt, Homo sapiens
accaggauuuccuu

SEQ ID NO: 1229925 - RNA, 22 nt, Homo sapiens
accaggcaccucuuccuugaug

SEQ ID NO: 1229926 - RNA, 19 nt, Homo sapiens
accaggcugugggccucaa

SEQ ID NO: 1229927 - RNA, 13 nt, Homo sapiens
accagggaugcug

SEQ ID NO: 1229928 - RNA, 22 nt, Homo sapiens
accagggccgaggaggugccug

SEQ ID NO: 1229929 - RNA, 22 nt, Homo sapiens
accaggguccgcaccagcugcu

SEQ ID NO: 1229930 - RNA, 19 nt, Homo sapiens
accagguaguuuguugcau

SEQ ID NO: 1229931 - RNA, 17 nt, Homo sapiens
accagguccauuuugcc

SEQ ID NO: 1229932 - RNA, 20 nt, Homo sapiens
accagguccauuuugccuga

SEQ ID NO: 1229933 - RNA, 15 nt, Homo sapiens
accaguauaagcauc

SEQ ID NO: 1229934 - RNA, 18 nt, Homo sapiens
accagugaaucuuuguca

SEQ ID NO: 1229935 - RNA, 19 nt, Homo sapiens
accagugcaacagcacugg

SEQ ID NO: 1229936 - RNA, 15 nt, Homo sapiens
accaguggugccuug

SEQ ID NO: 1229937 - RNA, 22 nt, Homo sapiens
accaguguccccuccacuguca

SEQ ID NO: 1229938 - RNA, 16 nt, Homo sapiens
accaguuucagagaaa

SEQ ID NO: 1229939 - RNA, 14 nt, Homo sapiens
accauaauguuaca

SEQ ID NO: 1229940 - RNA, 14 nt, Homo sapiens
accauacacacugu

SEQ ID NO: 1229941 - RNA, 14 nt, Homo sapiens
accauacugaggga

SEQ ID NO: 1229942 - RNA, 15 nt, Homo sapiens
accauagcuacauca

SEQ ID NO: 1229943 - RNA, 16 nt, Homo sapiens
accauauaccaucucc

SEQ ID NO: 1229944 - RNA, 20 nt, Homo sapiens
accauauaccaucuccagcu

SEQ ID NO: 1229945 - RNA, 14 nt, Homo sapiens
accaucguccuucc

SEQ ID NO: 1229946 - RNA, 15 nt, Homo sapiens
accaucuacaccagu

SEQ ID NO: 1229947 - RNA, 18 nt, Homo sapiens
accaucuccccaggcuau

SEQ ID NO: 1229948 - RNA, 13 nt, Homo sapiens
accaucugauguu

SEQ ID NO: 1229949 - RNA, 11 nt, Homo sapiens
accaucugcau

SEQ ID NO: 1229950 - RNA, 21 nt, Homo sapiens
accaucuggaaggacaucuac

SEQ ID NO: 1229951 - RNA, 22 nt, Homo sapiens
accaucuggaaggacaucuaca

SEQ ID NO: 1229952 - RNA, 11 nt, Homo sapiens
accaugaagcg

SEQ ID NO: 1229953 - RNA, 21 nt, Homo sapiens
accaugagaccacuguuauca

SEQ ID NO: 1229954 - RNA, 22 nt, Homo sapiens
accaugcagccgcaccagagag

SEQ ID NO: 1229955 - RNA, 18 nt, Homo sapiens
accaugcauggugcauca

SEQ ID NO: 1229956 - RNA, 14 nt, Homo sapiens
accaugcuucacaa

SEQ ID NO: 1229957 - RNA, 20 nt, Homo sapiens
accauggcacugacaauggg

SEQ ID NO: 1229958 - RNA, 14 nt, Homo sapiens
accauggcacuuaa

SEQ ID NO: 1229959 - RNA, 23 nt, Homo sapiens
accauggggaagaaaucuggucu

SEQ ID NO: 1229960 - RNA, 22 nt, Homo sapiens
accauggguuauuuaugcuugu

SEQ ID NO: 1229961 - RNA, 13 nt, Homo sapiens
accauguacauga

SEQ ID NO: 1229962 - RNA, 12 nt, Homo sapiens
accauguggcaa

SEQ ID NO: 1229963 - RNA, 20 nt, Homo sapiens
accauuccuggaaaccacag

SEQ ID NO: 1229964 - RNA, 14 nt, Homo sapiens
accauuucagagag

SEQ ID NO: 1229965 - RNA, 23 nt, Homo sapiens
accauuuguaauaaaguauauaa

SEQ ID NO: 1229966 - RNA, 23 nt, Homo sapiens
accauuuguguuuugaaagccca

SEQ ID NO: 1229967 - RNA, 17 nt, Homo sapiens
acccauucuacacagag

SEQ ID NO: 1229968 - RNA, 18 nt, Homo sapiens
acccauucuacacagagc

SEQ ID NO: 1229969 - RNA, 22 nt, Homo sapiens
acccauuuucgcuauaaauaaa

SEQ ID NO: 1229970 - RNA, 15 nt, Homo sapiens
acccauuuugaauau

SEQ ID NO: 1229971 - RNA, 18 nt, Homo sapiens
accccaaacuguugauua

SEQ ID NO: 1229972 - RNA, 14 nt, Homo sapiens
accccaaccucaga

SEQ ID NO: 1229973 - RNA, 14 nt, Homo sapiens
accccaagcugccu

SEQ ID NO: 1229974 - RNA, 20 nt, Homo sapiens
accccacaccccagcccacc

SEQ ID NO: 1229975 - RNA, 18 nt, Homo sapiens
accccacagacacuuaca

SEQ ID NO: 1229976 - RNA, 19 nt, Homo sapiens
accccagccucuugagcug

SEQ ID NO: 1229977 - RNA, 11 nt, Homo sapiens
accccagcugg

SEQ ID NO: 1229978 - RNA, 22 nt, Homo sapiens
accccaggacgcccucacugca

SEQ ID NO: 1229979 - RNA, 19 nt, Homo sapiens
accccagggccagcuuuuc

SEQ ID NO: 1229980 - RNA, 11 nt, Homo sapiens
accccaucucu

SEQ ID NO: 1229981 - RNA, 15 nt, Homo sapiens
accccaucucuacua

SEQ ID NO: 1229982 - RNA, 16 nt, Homo sapiens
accccaucucuacuga

SEQ ID NO: 1229983 - RNA, 16 nt, Homo sapiens
accccaugugccuuua

SEQ ID NO: 1229984 - RNA, 13 nt, Homo sapiens
acccccagcucaa

SEQ ID NO: 1229985 - RNA, 21 nt, Homo sapiens
acccccaucuuuacaaagaaa

SEQ ID NO: 1229986 - RNA, 15 nt, Homo sapiens
accccccuaccacac

SEQ ID NO: 1229987 - RNA, 18 nt, Homo sapiens
acccccgcaaguuugcac

SEQ ID NO: 1229988 - RNA, 17 nt, Homo sapiens
acccccgcacccuuaag

SEQ ID NO: 1229989 - RNA, 22 nt, Homo sapiens
acccccucccccccagcacaac

SEQ ID NO: 1229990 - RNA, 19 nt, Homo sapiens
acccccugugagcagggau

SEQ ID NO: 1229991 - RNA, 18 nt, Homo sapiens
accccgcuguaagcuccu

SEQ ID NO: 1229992 - RNA, 21 nt, Homo sapiens
accccggcugcuuggcaguug

SEQ ID NO: 1229993 - RNA, 21 nt, Homo sapiens
accccgucgaggggcucucag

SEQ ID NO: 1229994 - RNA, 13 nt, Homo sapiens
accccuacaugaa

SEQ ID NO: 1229995 - RNA, 14 nt, Homo sapiens
accccuccaggaau

SEQ ID NO: 1229996 - RNA, 20 nt, Homo sapiens
accccugcucuacccaugag

SEQ ID NO: 1229997 - RNA, 15 nt, Homo sapiens
accccugucccaugc

SEQ ID NO: 1229998 - RNA, 20 nt, Homo sapiens
accccuugccggugaaggau

SEQ ID NO: 1229999 - RNA, 17 nt, Homo sapiens
accccuuucuaguucaa

SEQ ID NO: 1230000 - RNA, 13 nt, Homo sapiens
accccuuugcacu

SEQ ID NO: 1230001 - RNA, 15 nt, Homo sapiens
acccgacauguguac

SEQ ID NO: 1230002 - RNA, 18 nt, Homo sapiens
acccgagggccagguuag

SEQ ID NO: 1230003 - RNA, 20 nt, Homo sapiens
acccgggggagcccagugaa

SEQ ID NO: 1230004 - RNA, 21 nt, Homo sapiens
acccgguuaccuuggccguga

SEQ ID NO: 1230005 - RNA, 14 nt, Homo sapiens
acccguagaugcca

SEQ ID NO: 1230006 - RNA, 13 nt, Homo sapiens
acccuaacugauc

SEQ ID NO: 1230007 - RNA, 15 nt, Homo sapiens
acccuaccaugaauc

SEQ ID NO: 1230008 - RNA, 13 nt, Homo sapiens
acccuacucugga

SEQ ID NO: 1230009 - RNA, 12 nt, Homo sapiens
acccuacuuugc

SEQ ID NO: 1230010 - RNA, 20 nt, Homo sapiens
acccuauacuguaguauucu

SEQ ID NO: 1230011 - RNA, 10 nt, Homo sapiens
acccucacaa

SEQ ID NO: 1230012 - RNA, 17 nt, Homo sapiens
acccucaggaauucagu

SEQ ID NO: 1230013 - RNA, 16 nt, Homo sapiens
acccucaucacuagga

SEQ ID NO: 1230014 - RNA, 22 nt, Homo sapiens
acccuccaagucuguaccucaa

SEQ ID NO: 1230015 - RNA, 15 nt, Homo sapiens
acccuccacucagcu

SEQ ID NO: 1230016 - RNA, 22 nt, Homo sapiens
acccuccagagacaacagguaa

SEQ ID NO: 1230017 - RNA, 20 nt, Homo sapiens
acccuccccacccugaacaa

SEQ ID NO: 1230018 - RNA, 19 nt, Homo sapiens
acccucccccgccacuccu

SEQ ID NO: 1230019 - RNA, 15 nt, Homo sapiens
acccuccccuaguca

SEQ ID NO: 1230020 - RNA, 13 nt, Homo sapiens
acccuccuugaga

SEQ ID NO: 1230021 - RNA, 17 nt, Homo sapiens
acccucuuccugugauc

SEQ ID NO: 1230022 - RNA, 13 nt, Homo sapiens
acccugaaccuau

SEQ ID NO: 1230023 - RNA, 17 nt, Homo sapiens
acccugaaccuaugugu

SEQ ID NO: 1230024 - RNA, 16 nt, Homo sapiens
acccugaguucaucca

SEQ ID NO: 1230025 - RNA, 24 nt, Homo sapiens
acccugcaaaauuugaugccagga

SEQ ID NO: 1230026 - RNA, 18 nt, Homo sapiens
acccugccuuaucuugca

SEQ ID NO: 1230027 - RNA, 19 nt, Homo sapiens
acccugccuuaucuugcac

SEQ ID NO: 1230028 - RNA, 17 nt, Homo sapiens
acccugcucuccgacca

SEQ ID NO: 1230029 - RNA, 15 nt, Homo sapiens
acccugcugaccucc

SEQ ID NO: 1230030 - RNA, 16 nt, Homo sapiens
acccugcugaccuccc

SEQ ID NO: 1230031 - RNA, 18 nt, Homo sapiens
acccuggaauucagcacc

SEQ ID NO: 1230032 - RNA, 23 nt, Homo sapiens
acccuggagcccauccagucucc

SEQ ID NO: 1230033 - RNA, 16 nt, Homo sapiens
acccuggauaggcaag

SEQ ID NO: 1230034 - RNA, 20 nt, Homo sapiens
acccuggaucaguccuuuga

SEQ ID NO: 1230035 - RNA, 14 nt, Homo sapiens
acccugggugccau

SEQ ID NO: 1230036 - RNA, 21 nt, Homo sapiens
acccuggucuccguggcacuu

SEQ ID NO: 1230037 - RNA, 18 nt, Homo sapiens
acccuguaccucauccca

SEQ ID NO: 1230038 - RNA, 19 nt, Homo sapiens
acccuguagcgccagugua

SEQ ID NO: 1230039 - RNA, 17 nt, Homo sapiens
acccuucacaccccagg

SEQ ID NO: 1230040 - RNA, 17 nt, Homo sapiens
acccuucagaccccagu

SEQ ID NO: 1230041 - RNA, 21 nt, Homo sapiens
acccuucccaaucagcacuga

SEQ ID NO: 1230042 - RNA, 22 nt, Homo sapiens
acccuucccaaucagcacugaa

SEQ ID NO: 1230043 - RNA, 21 nt, Homo sapiens
acccuugacaccugcugagaa

SEQ ID NO: 1230044 - RNA, 17 nt, Homo sapiens
acccuuggacaagacaa

SEQ ID NO: 1230045 - RNA, 19 nt, Homo sapiens
acccuuuccggcacacugc

SEQ ID NO: 1230046 - RNA, 23 nt, Homo sapiens
acccuuuccggcacacugccaaa

SEQ ID NO: 1230047 - RNA, 15 nt, Homo sapiens
acccuuugcugugag

SEQ ID NO: 1230048 - RNA, 16 nt, Homo sapiens
accgaggacacagugg

SEQ ID NO: 1230049 - RNA, 21 nt, Homo sapiens
accgagucucuucuccacugg

SEQ ID NO: 1230050 - RNA, 15 nt, Homo sapiens
accgcagggacaagc

SEQ ID NO: 1230051 - RNA, 17 nt, Homo sapiens
accgcagucgucgcaca

SEQ ID NO: 1230052 - RNA, 18 nt, Homo sapiens
accgccacgucccagcau

SEQ ID NO: 1230053 - RNA, 22 nt, Homo sapiens
accgcccaucaggguucucuua

SEQ ID NO: 1230054 - RNA, 22 nt, Homo sapiens
accgccccuugugcucgccuca

SEQ ID NO: 1230055 - RNA, 22 nt, Homo sapiens
accggaaggaggccaaccagcc

SEQ ID NO: 1230056 - RNA, 18 nt, Homo sapiens
accggcuggcagggcugg

SEQ ID NO: 1230057 - RNA, 15 nt, Homo sapiens
accgggcaagcuuuc

SEQ ID NO: 1230058 - RNA, 21 nt, Homo sapiens
accgggcacucagaagacacu

SEQ ID NO: 1230059 - RNA, 20 nt, Homo sapiens
accgggccuccccuccaugg

SEQ ID NO: 1230060 - RNA, 21 nt, Homo sapiens
accgggcuggccugugccuau

SEQ ID NO: 1230061 - RNA, 15 nt, Homo sapiens
accgggcugggagcu

SEQ ID NO: 1230062 - RNA, 14 nt, Homo sapiens
accgguccagcugg

SEQ ID NO: 1230063 - RNA, 15 nt, Homo sapiens
accguaaauguccau

SEQ ID NO: 1230064 - RNA, 13 nt, Homo sapiens
accguaucucagg

SEQ ID NO: 1230065 - RNA, 20 nt, Homo sapiens
accgucacacucuucaguga

SEQ ID NO: 1230066 - RNA, 16 nt, Homo sapiens
accuagggcacuuuaa

SEQ ID NO: 1230067 - RNA, 13 nt, Homo sapiens
accuaguuugcac

SEQ ID NO: 1230068 - RNA, 15 nt, Homo sapiens
accuaguuugcacua

SEQ ID NO: 1230069 - RNA, 23 nt, Homo sapiens
accuauaauguguguauguguau

SEQ ID NO: 1230070 - RNA, 13 nt, Homo sapiens
accuauacauuau

SEQ ID NO: 1230071 - RNA, 18 nt, Homo sapiens
accucaaacuuccaguca

SEQ ID NO: 1230072 - RNA, 15 nt, Homo sapiens
accucaaaugaauuc

SEQ ID NO: 1230073 - RNA, 22 nt, Homo sapiens
accucaacugccuacuccaaaa

SEQ ID NO: 1230074 - RNA, 12 nt, Homo sapiens
accucacaguga

SEQ ID NO: 1230075 - RNA, 15 nt, Homo sapiens
accucaccaacugca

SEQ ID NO: 1230076 - RNA, 16 nt, Homo sapiens
accucacuccuguuac

SEQ ID NO: 1230077 - RNA, 12 nt, Homo sapiens
accucacuguga

SEQ ID NO: 1230078 - RNA, 12 nt, Homo sapiens
accucacuuuag

SEQ ID NO: 1230079 - RNA, 19 nt, Homo sapiens
accucagccucccaaagug

SEQ ID NO: 1230080 - RNA, 16 nt, Homo sapiens
accucaggcacuagcc

SEQ ID NO: 1230081 - RNA, 22 nt, Homo sapiens
accucagguugaaauaccaggg

SEQ ID NO: 1230082 - RNA, 12 nt, Homo sapiens
accucaguuuua

SEQ ID NO: 1230083 - RNA, 22 nt, Homo sapiens
accucaguuuuaucauuuucaa

SEQ ID NO: 1230084 - RNA, 22 nt, Homo sapiens
accucauaucaguuugcuagca

SEQ ID NO: 1230085 - RNA, 22 nt, Homo sapiens
accucaucagcugccuaacuua

SEQ ID NO: 1230086 - RNA, 16 nt, Homo sapiens
accucauccaggcuac

SEQ ID NO: 1230087 - RNA, 12 nt, Homo sapiens
accucaucuuuc

SEQ ID NO: 1230088 - RNA, 12 nt, Homo sapiens
accuccacaccc

SEQ ID NO: 1230089 - RNA, 19 nt, Homo sapiens
accuccaucgccuugcagg

SEQ ID NO: 1230090 - RNA, 23 nt, Homo sapiens
accucccacugcccccuccacug

SEQ ID NO: 1230091 - RNA, 15 nt, Homo sapiens
accucccagcccuau

SEQ ID NO: 1230092 - RNA, 21 nt, Homo sapiens
accucccauuacuuugauauc

SEQ ID NO: 1230093 - RNA, 18 nt, Homo sapiens
accucccuccccgucuca

SEQ ID NO: 1230094 - RNA, 19 nt, Homo sapiens
accuccgccagauccugca

SEQ ID NO: 1230095 - RNA, 17 nt, Homo sapiens
accuccgccucccgggu

SEQ ID NO: 1230096 - RNA, 22 nt, Homo sapiens
accuccuagaggugggcagcug

SEQ ID NO: 1230097 - RNA, 13 nt, Homo sapiens
accuccucuguga

SEQ ID NO: 1230098 - RNA, 23 nt, Homo sapiens
accuccugaccugucaccgugag

SEQ ID NO: 1230099 - RNA, 15 nt, Homo sapiens
accuccuuagcccug

SEQ ID NO: 1230100 - RNA, 22 nt, Homo sapiens
accuccuuagcccugucugcua

SEQ ID NO: 1230101 - RNA, 15 nt, Homo sapiens
accuccuugcacaaa

SEQ ID NO: 1230102 - RNA, 22 nt, Homo sapiens
accuccuuucaucacacugggu

SEQ ID NO: 1230103 - RNA, 17 nt, Homo sapiens
accucgaccugaugcag

SEQ ID NO: 1230104 - RNA, 19 nt, Homo sapiens
accucgagcagaugaugcc

SEQ ID NO: 1230105 - RNA, 21 nt, Homo sapiens
accucggccucccaaagugcu

SEQ ID NO: 1230106 - RNA, 13 nt, Homo sapiens
accucgugaucca

SEQ ID NO: 1230107 - RNA, 19 nt, Homo sapiens
accucgugauccaccugcc

SEQ ID NO: 1230108 - RNA, 14 nt, Homo sapiens
accucuacuuucca

SEQ ID NO: 1230109 - RNA, 12 nt, Homo sapiens
accucucagggc

SEQ ID NO: 1230110 - RNA, 18 nt, Homo sapiens
accucugagaagacacaa

SEQ ID NO: 1230111 - RNA, 16 nt, Homo sapiens
accucugggagcucaa

SEQ ID NO: 1230112 - RNA, 17 nt, Homo sapiens
accucugggcagcuccu

SEQ ID NO: 1230113 - RNA, 18 nt, Homo sapiens
accucugggcagcuccug

SEQ ID NO: 1230114 - RNA, 17 nt, Homo sapiens
accucuggggaccccaa

SEQ ID NO: 1230115 - RNA, 20 nt, Homo sapiens
accucugucauuuguuguga

SEQ ID NO: 1230116 - RNA, 20 nt, Homo sapiens
accucugugaggaaagcaca

SEQ ID NO: 1230117 - RNA, 19 nt, Homo sapiens
accucuguucauuucacac

SEQ ID NO: 1230118 - RNA, 22 nt, Homo sapiens
accucuucaugagcuugaacaa

SEQ ID NO: 1230119 - RNA, 20 nt, Homo sapiens
accucuucccaugacugcac

SEQ ID NO: 1230120 - RNA, 20 nt, Homo sapiens
accucuucugggaacuuccu

SEQ ID NO: 1230121 - RNA, 18 nt, Homo sapiens
accugaaagaagcccagg

SEQ ID NO: 1230122 - RNA, 22 nt, Homo sapiens
accugaaauuccaaagucucua

SEQ ID NO: 1230123 - RNA, 21 nt, Homo sapiens
accugaaauuuauucacauau

SEQ ID NO: 1230124 - RNA, 15 nt, Homo sapiens
accugaauaccacuu

SEQ ID NO: 1230125 - RNA, 22 nt, Homo sapiens
accugaauaccacuuaccucaa

SEQ ID NO: 1230126 - RNA, 14 nt, Homo sapiens
accugacacaagag

SEQ ID NO: 1230127 - RNA, 23 nt, Homo sapiens
accugacaggugaggucuguucc

SEQ ID NO: 1230128 - RNA, 19 nt, Homo sapiens
accugagcgggugccgaag

SEQ ID NO: 1230129 - RNA, 15 nt, Homo sapiens
accugaggauaacuc

SEQ ID NO: 1230130 - RNA, 13 nt, Homo sapiens
accugcacugucc

SEQ ID NO: 1230131 - RNA, 18 nt, Homo sapiens
accugcacuuaaggcacu

SEQ ID NO: 1230132 - RNA, 17 nt, Homo sapiens
accugcagcccauggug

SEQ ID NO: 1230133 - RNA, 21 nt, Homo sapiens
accugcagggacuccaugcug

SEQ ID NO: 1230134 - RNA, 17 nt, Homo sapiens
accugcaugugcuguca

SEQ ID NO: 1230135 - RNA, 17 nt, Homo sapiens
accugcccaaggaugcu

SEQ ID NO: 1230136 - RNA, 22 nt, Homo sapiens
accugcccacaacucccuugca

SEQ ID NO: 1230137 - RNA, 21 nt, Homo sapiens
accugcgcucucagcugacca

SEQ ID NO: 1230138 - RNA, 23 nt, Homo sapiens
accugcugagaaaacaugccucu

SEQ ID NO: 1230139 - RNA, 14 nt, Homo sapiens
accugcugugauac

SEQ ID NO: 1230140 - RNA, 21 nt, Homo sapiens
accuggagcggcuauuccagg

SEQ ID NO: 1230141 - RNA, 20 nt, Homo sapiens
accuggauccagcacuggug

SEQ ID NO: 1230142 - RNA, 17 nt, Homo sapiens
accuggauguacuuaag

SEQ ID NO: 1230143 - RNA, 20 nt, Homo sapiens
accuggccugguugugugca

SEQ ID NO: 1230144 - RNA, 17 nt, Homo sapiens
accuggcuuuuacuuua

SEQ ID NO: 1230145 - RNA, 22 nt, Homo sapiens
accugggcugugcugcuuuuga

SEQ ID NO: 1230146 - RNA, 23 nt, Homo sapiens
accuggggauccaauugauguau

SEQ ID NO: 1230147 - RNA, 18 nt, Homo sapiens
accuguaaagugccuuac

SEQ ID NO: 1230148 - RNA, 11 nt, Homo sapiens
accugucaaug

SEQ ID NO: 1230149 - RNA, 17 nt, Homo sapiens
accugugcccucaccac

SEQ ID NO: 1230150 - RNA, 19 nt, Homo sapiens
accuguuuucgcaccuacc

SEQ ID NO: 1230151 - RNA, 14 nt, Homo sapiens
accuuaaaauguaa

SEQ ID NO: 1230152 - RNA, 18 nt, Homo sapiens
accuuaagagacacucca

SEQ ID NO: 1230153 - RNA, 17 nt, Homo sapiens
accuuaagauuuugcac

SEQ ID NO: 1230154 - RNA, 16 nt, Homo sapiens
accuuauuuuacagaa

SEQ ID NO: 1230155 - RNA, 17 nt, Homo sapiens
accuucaaaagcacuga

SEQ ID NO: 1230156 - RNA, 14 nt, Homo sapiens
accuucagugaaag

SEQ ID NO: 1230157 - RNA, 20 nt, Homo sapiens
accuucaugcccuucugauu

SEQ ID NO: 1230158 - RNA, 18 nt, Homo sapiens
accuuccaaggacauauu

SEQ ID NO: 1230159 - RNA, 22 nt, Homo sapiens
accuuccggggccgcaucccuu

SEQ ID NO: 1230160 - RNA, 17 nt, Homo sapiens
accuucuuucuggacug

SEQ ID NO: 1230161 - RNA, 15 nt, Homo sapiens
accuugaccaaaauc

SEQ ID NO: 1230162 - RNA, 17 nt, Homo sapiens
accuugaccgacaugaa

SEQ ID NO: 1230163 - RNA, 22 nt, Homo sapiens
accuugaccgacaugaacugua

SEQ ID NO: 1230164 - RNA, 19 nt, Homo sapiens
accuuguaaccagugcaga

SEQ ID NO: 1230165 - RNA, 23 nt, Homo sapiens
accuuguguguuccaaguuucca

SEQ ID NO: 1230166 - RNA, 15 nt, Homo sapiens
accuuuaucuuucca

SEQ ID NO: 1230167 - RNA, 17 nt, Homo sapiens
accuuucaaauuucaca

SEQ ID NO: 1230168 - RNA, 15 nt, Homo sapiens
accuuuggagcaaag

SEQ ID NO: 1230169 - RNA, 16 nt, Homo sapiens
accuuuucaccuccaa

SEQ ID NO: 1230170 - RNA, 22 nt, Homo sapiens
accuuuucaccuccaacuggau

SEQ ID NO: 1230171 - RNA, 20 nt, Homo sapiens
accuuuuccccaaccacaga

SEQ ID NO: 1230172 - RNA, 21 nt, Homo sapiens
accuuuuccccaaccacagag

SEQ ID NO: 1230173 - RNA, 23 nt, Homo sapiens
accuuuuuuccuucuugacauuu

SEQ ID NO: 1230174 - RNA, 15 nt, Homo sapiens
acgaaacacaaacca

SEQ ID NO: 1230175 - RNA, 23 nt, Homo sapiens
acgaaacacaaaccacaacugac

SEQ ID NO: 1230176 - RNA, 22 nt, Homo sapiens
acgaacacaagaauugaauagu

SEQ ID NO: 1230177 - RNA, 13 nt, Homo sapiens
acgacaacgauga

SEQ ID NO: 1230178 - RNA, 14 nt, Homo sapiens
acgacauacaugcu

SEQ ID NO: 1230179 - RNA, 22 nt, Homo sapiens
acgaccggggccagcaccacuu

SEQ ID NO: 1230180 - RNA, 16 nt, Homo sapiens
acgacgauuucagcua

SEQ ID NO: 1230181 - RNA, 13 nt, Homo sapiens
acgacuucagggc

SEQ ID NO: 1230182 - RNA, 23 nt, Homo sapiens
acgaguugcagccagggccagug

SEQ ID NO: 1230183 - RNA, 13 nt, Homo sapiens
acgauaaagggau

SEQ ID NO: 1230184 - RNA, 22 nt, Homo sapiens
acgaugccgagaccucaagccc

SEQ ID NO: 1230185 - RNA, 22 nt, Homo sapiens
acgauugaaaugaaaacucuau

SEQ ID NO: 1230186 - RNA, 22 nt, Homo sapiens
acgcaauuuuaccuaguuugca

SEQ ID NO: 1230187 - RNA, 15 nt, Homo sapiens
acgcacuaacccagc

SEQ ID NO: 1230188 - RNA, 18 nt, Homo sapiens
acgcacuaacccagccuc

SEQ ID NO: 1230189 - RNA, 16 nt, Homo sapiens
acgcacugguaugugu

SEQ ID NO: 1230190 - RNA, 18 nt, Homo sapiens
acgcacuuggaguaauuu

SEQ ID NO: 1230191 - RNA, 16 nt, Homo sapiens
acgcaggagaaucacu

SEQ ID NO: 1230192 - RNA, 17 nt, Homo sapiens
acgcauggaaaaguuuc

SEQ ID NO: 1230193 - RNA, 21 nt, Homo sapiens
acgccacugcacuauagccua

SEQ ID NO: 1230194 - RNA, 21 nt, Homo sapiens
acgccucacugaaacauggcu

SEQ ID NO: 1230195 - RNA, 15 nt, Homo sapiens
acgccuccuggccag

SEQ ID NO: 1230196 - RNA, 22 nt, Homo sapiens
acgccucuucccacaccuguca

SEQ ID NO: 1230197 - RNA, 17 nt, Homo sapiens
acgccucuuuucccucu

SEQ ID NO: 1230198 - RNA, 16 nt, Homo sapiens
acgcgcgcgcacacac

SEQ ID NO: 1230199 - RNA, 12 nt, Homo sapiens
acgcgugcacac

SEQ ID NO: 1230200 - RNA, 16 nt, Homo sapiens
acgcuggcaacacaga

SEQ ID NO: 1230201 - RNA, 22 nt, Homo sapiens
acgcuggguccuaauuaccagu

SEQ ID NO: 1230202 - RNA, 21 nt, Homo sapiens
acgcuuugucacacaaaaagu

SEQ ID NO: 1230203 - RNA, 13 nt, Homo sapiens
acggcaccucggg

SEQ ID NO: 1230204 - RNA, 21 nt, Homo sapiens
acggcccucaucuaugaggaa

SEQ ID NO: 1230205 - RNA, 17 nt, Homo sapiens
acggcuaagaggcugcu

SEQ ID NO: 1230206 - RNA, 14 nt, Homo sapiens
acggcucuuagcac

SEQ ID NO: 1230207 - RNA, 17 nt, Homo sapiens
acggcugccccuuccac

SEQ ID NO: 1230208 - RNA, 14 nt, Homo sapiens
acgggaagcaagau

SEQ ID NO: 1230209 - RNA, 13 nt, Homo sapiens
acggggacugggg

SEQ ID NO: 1230210 - RNA, 15 nt, Homo sapiens
acggggcuuacagga

SEQ ID NO: 1230211 - RNA, 14 nt, Homo sapiens
acggugggcauuug

SEQ ID NO: 1230212 - RNA, 20 nt, Homo sapiens
acgguggugcaugccuguaa

SEQ ID NO: 1230213 - RNA, 22 nt, Homo sapiens
acgguuaaauacuguguggaac

SEQ ID NO: 1230214 - RNA, 20 nt, Homo sapiens
acgguuuuauaaaagccuug

SEQ ID NO: 1230215 - RNA, 16 nt, Homo sapiens
acguaccccacugggc

SEQ ID NO: 1230216 - RNA, 18 nt, Homo sapiens
acgucgcccgcugagcug

SEQ ID NO: 1230217 - RNA, 14 nt, Homo sapiens
acgucugacaggca

SEQ ID NO: 1230218 - RNA, 18 nt, Homo sapiens
acgugaggccugcacagc

SEQ ID NO: 1230219 - RNA, 16 nt, Homo sapiens
acgugauuuccaguga

SEQ ID NO: 1230220 - RNA, 14 nt, Homo sapiens
acgugccugugauc

SEQ ID NO: 1230221 - RNA, 17 nt, Homo sapiens
acgugccugugauccca

SEQ ID NO: 1230222 - RNA, 18 nt, Homo sapiens
acgugcgugcgagcacac

SEQ ID NO: 1230223 - RNA, 13 nt, Homo sapiens
acguggcacuggu

SEQ ID NO: 1230224 - RNA, 12 nt, Homo sapiens
acguggccucuu

SEQ ID NO: 1230225 - RNA, 14 nt, Homo sapiens
acguguagcuauau

SEQ ID NO: 1230226 - RNA, 15 nt, Homo sapiens
acgugucuuccacuu

SEQ ID NO: 1230227 - RNA, 19 nt, Homo sapiens
acgugucuuccacuuugca

SEQ ID NO: 1230228 - RNA, 22 nt, Homo sapiens
acguuagauuugccguaccaau

SEQ ID NO: 1230229 - RNA, 13 nt, Homo sapiens
acguuaugaugac

SEQ ID NO: 1230230 - RNA, 23 nt, Homo sapiens
acguugaucccagagagcagcuu

SEQ ID NO: 1230231 - RNA, 23 nt, Homo sapiens
acguuguuuugguuguacuuugg

SEQ ID NO: 1230232 - RNA, 17 nt, Homo sapiens
acguuuuggucacauau

SEQ ID NO: 1230233 - RNA, 16 nt, Homo sapiens
acuaaaaaaaagauga

SEQ ID NO: 1230234 - RNA, 18 nt, Homo sapiens
acuaaaaaggaaacuuca

SEQ ID NO: 1230235 - RNA, 17 nt, Homo sapiens
acuaaaaaguauugcau

SEQ ID NO: 1230236 - RNA, 16 nt, Homo sapiens
acuaaaaggugaccaa

SEQ ID NO: 1230237 - RNA, 14 nt, Homo sapiens
acuaaacaguaaga

SEQ ID NO: 1230238 - RNA, 16 nt, Homo sapiens
acuaaacauaugauuu

SEQ ID NO: 1230239 - RNA, 17 nt, Homo sapiens
acuaaacuucaccuaca

SEQ ID NO: 1230240 - RNA, 12 nt, Homo sapiens
acuaaacuuuca

SEQ ID NO: 1230241 - RNA, 22 nt, Homo sapiens
acuaaagcaaauuuuagaacuu

SEQ ID NO: 1230242 - RNA, 11 nt, Homo sapiens
acuaaagccag

SEQ ID NO: 1230243 - RNA, 17 nt, Homo sapiens
acuaaaguauaucuuua

SEQ ID NO: 1230244 - RNA, 23 nt, Homo sapiens
acuaaaucaaucugcaguuuaac

SEQ ID NO: 1230245 - RNA, 13 nt, Homo sapiens
acuaaaugaacau

SEQ ID NO: 1230246 - RNA, 14 nt, Homo sapiens
acuaaauuugauac

SEQ ID NO: 1230247 - RNA, 15 nt, Homo sapiens
acuaaauuugauacu

SEQ ID NO: 1230248 - RNA, 17 nt, Homo sapiens
acuaaauuugauacuua

SEQ ID NO: 1230249 - RNA, 18 nt, Homo sapiens
acuaaauuugauacuuau

SEQ ID NO: 1230250 - RNA, 15 nt, Homo sapiens
acuaacagauaagca

SEQ ID NO: 1230251 - RNA, 20 nt, Homo sapiens
acuaaccaguaccucuguau

SEQ ID NO: 1230252 - RNA, 22 nt, Homo sapiens
acuaacgcaaccaagugugcua

SEQ ID NO: 1230253 - RNA, 23 nt, Homo sapiens
acuaacucaaauacacauuugcu

SEQ ID NO: 1230254 - RNA, 15 nt, Homo sapiens
acuaagaaauaugca

SEQ ID NO: 1230255 - RNA, 14 nt, Homo sapiens
acuaagaagcagau

SEQ ID NO: 1230256 - RNA, 13 nt, Homo sapiens
acuaagauguuca

SEQ ID NO: 1230257 - RNA, 18 nt, Homo sapiens
acuaagggguauguuccc

SEQ ID NO: 1230258 - RNA, 17 nt, Homo sapiens
acuaauugacuugcaaa

SEQ ID NO: 1230259 - RNA, 14 nt, Homo sapiens
acuacagcucuuaa

SEQ ID NO: 1230260 - RNA, 21 nt, Homo sapiens
acuaccccaaaguuugcucaa

SEQ ID NO: 1230261 - RNA, 16 nt, Homo sapiens
acuaccucaaaggcca

SEQ ID NO: 1230262 - RNA, 15 nt, Homo sapiens
acuacgcuugcucau

SEQ ID NO: 1230263 - RNA, 21 nt, Homo sapiens
acuacuaaagugccuacccca

SEQ ID NO: 1230264 - RNA, 22 nt, Homo sapiens
acuacuaaagugccuaccccag

SEQ ID NO: 1230265 - RNA, 23 nt, Homo sapiens
acuacucagccuagcacaggcug

SEQ ID NO: 1230266 - RNA, 21 nt, Homo sapiens
acuacuuggaacuaggcucuu

SEQ ID NO: 1230267 - RNA, 17 nt, Homo sapiens
acuacuuuuggugcuua

SEQ ID NO: 1230268 - RNA, 20 nt, Homo sapiens
acuagaaaauuagacuguga

SEQ ID NO: 1230269 - RNA, 23 nt, Homo sapiens
acuagaagaaaagcccauuuuca

SEQ ID NO: 1230270 - RNA, 16 nt, Homo sapiens
acuagaagggccaguc

SEQ ID NO: 1230271 - RNA, 13 nt, Homo sapiens
acuagacauuacc

SEQ ID NO: 1230272 - RNA, 18 nt, Homo sapiens
acuagaccuguaacuuuu

SEQ ID NO: 1230273 - RNA, 20 nt, Homo sapiens
acuagacuacucaauauuaa

SEQ ID NO: 1230274 - RNA, 18 nt, Homo sapiens
acuagaggcuugcauaau

SEQ ID NO: 1230275 - RNA, 17 nt, Homo sapiens
acuagauucuugucaca

SEQ ID NO: 1230276 - RNA, 19 nt, Homo sapiens
acuaggaaaaucaugugcu

SEQ ID NO: 1230277 - RNA, 14 nt, Homo sapiens
acuaggcacugugg

SEQ ID NO: 1230278 - RNA, 16 nt, Homo sapiens
acuaguaaacaugugg

SEQ ID NO: 1230279 - RNA, 19 nt, Homo sapiens
acuagucacauucuuguuu

SEQ ID NO: 1230280 - RNA, 19 nt, Homo sapiens
acuagugacacauuguaca

SEQ ID NO: 1230281 - RNA, 16 nt, Homo sapiens
acuagugacagcuugu

SEQ ID NO: 1230282 - RNA, 16 nt, Homo sapiens
acuaguuuucaaucau

SEQ ID NO: 1230283 - RNA, 23 nt, Homo sapiens
acuaguuuuuccuaucauguuaa

SEQ ID NO: 1230284 - RNA, 22 nt, Homo sapiens
acuauaaauaauauucuauuca

SEQ ID NO: 1230285 - RNA, 17 nt, Homo sapiens
acuauaagcccacuguu

SEQ ID NO: 1230286 - RNA, 20 nt, Homo sapiens
acuauagaaugcaacuccau

SEQ ID NO: 1230287 - RNA, 13 nt, Homo sapiens
acuauaugaucag

SEQ ID NO: 1230288 - RNA, 16 nt, Homo sapiens
acuauauucucagugu

SEQ ID NO: 1230289 - RNA, 17 nt, Homo sapiens
acuaucaaaauugccuu

SEQ ID NO: 1230290 - RNA, 13 nt, Homo sapiens
acuaucaguuccc

SEQ ID NO: 1230291 - RNA, 14 nt, Homo sapiens
acuaucauucucag

SEQ ID NO: 1230292 - RNA, 16 nt, Homo sapiens
acuaucugauuuccua

SEQ ID NO: 1230293 - RNA, 13 nt, Homo sapiens
acuaucugugcca

SEQ ID NO: 1230294 - RNA, 22 nt, Homo sapiens
agaagggcagcuccacagggca

SEQ ID NO: 1230295 - RNA, 22 nt, Homo sapiens
agaaggguuuuccacccuggaa

SEQ ID NO: 1230296 - RNA, 13 nt, Homo sapiens
agaaggugccacu

SEQ ID NO: 1230297 - RNA, 19 nt, Homo sapiens
agaaguaaauauagcucag

SEQ ID NO: 1230298 - RNA, 23 nt, Homo sapiens
agaagucugucugucugaugaug

SEQ ID NO: 1230299 - RNA, 22 nt, Homo sapiens
agaagugccuuuaauuugcuac

SEQ ID NO: 1230300 - RNA, 19 nt, Homo sapiens
agaaguuguuugaggcaaa

SEQ ID NO: 1230301 - RNA, 18 nt, Homo sapiens
agaauaaaaacuuccuuc

SEQ ID NO: 1230302 - RNA, 18 nt, Homo sapiens
agaauaaggaacaacguu

SEQ ID NO: 1230303 - RNA, 17 nt, Homo sapiens
agaauaaggcaggcauu

SEQ ID NO: 1230304 - RNA, 14 nt, Homo sapiens
agaauagaaaacug

SEQ ID NO: 1230305 - RNA, 14 nt, Homo sapiens
agaauagcacaaac

SEQ ID NO: 1230306 - RNA, 14 nt, Homo sapiens
agaauagcuuugaa

SEQ ID NO: 1230307 - RNA, 18 nt, Homo sapiens
agaauaguaguaacuguu

SEQ ID NO: 1230308 - RNA, 13 nt, Homo sapiens
agaauauacuaaa

SEQ ID NO: 1230309 - RNA, 13 nt, Homo sapiens
agaauauauuucc

SEQ ID NO: 1230310 - RNA, 14 nt, Homo sapiens
agaauaucugggau

SEQ ID NO: 1230311 - RNA, 13 nt, Homo sapiens
agaauaugacuuu

SEQ ID NO: 1230312 - RNA, 20 nt, Homo sapiens
agaauauucucccauaaaca

SEQ ID NO: 1230313 - RNA, 21 nt, Homo sapiens
agaauauuuuaagaauuucac

SEQ ID NO: 1230314 - RNA, 23 nt, Homo sapiens
agaaucagcauuuagucuugcca

SEQ ID NO: 1230315 - RNA, 16 nt, Homo sapiens
agaaucagucuaucca

SEQ ID NO: 1230316 - RNA, 22 nt, Homo sapiens
agaaucagucuauccacagaga

SEQ ID NO: 1230317 - RNA, 18 nt, Homo sapiens
agaaucaugugaacccgg

SEQ ID NO: 1230318 - RNA, 18 nt, Homo sapiens
agaaucauuaauacaaag

SEQ ID NO: 1230319 - RNA, 19 nt, Homo sapiens
agaaucauugaaguauuuu

SEQ ID NO: 1230320 - RNA, 21 nt, Homo sapiens
agaauccagcuacgaauauag

SEQ ID NO: 1230321 - RNA, 23 nt, Homo sapiens
agaaucuguugaguugcugccac

SEQ ID NO: 1230322 - RNA, 19 nt, Homo sapiens
agaaucuuguuuugaaaau

SEQ ID NO: 1230323 - RNA, 20 nt, Homo sapiens
agaaugcaagaguggacuga

SEQ ID NO: 1230324 - RNA, 22 nt, Homo sapiens
agaaugcacaagaauggaucac

SEQ ID NO: 1230325 - RNA, 24 nt, Homo sapiens
agaaugcacaagaauggaucacaa

SEQ ID NO: 1230326 - RNA, 20 nt, Homo sapiens
agaaugccgguuaaauucca

SEQ ID NO: 1230327 - RNA, 12 nt, Homo sapiens
agaauggaucac

SEQ ID NO: 1230328 - RNA, 17 nt, Homo sapiens
agaauguaucugugaag

SEQ ID NO: 1230329 - RNA, 15 nt, Homo sapiens
agaaugugcuuugua

SEQ ID NO: 1230330 - RNA, 15 nt, Homo sapiens
agaauuaacagagau

SEQ ID NO: 1230331 - RNA, 18 nt, Homo sapiens
agaauuaagauacaaauu

SEQ ID NO: 1230332 - RNA, 15 nt, Homo sapiens
agaauuauaacugua

SEQ ID NO: 1230333 - RNA, 19 nt, Homo sapiens
agaauucuguacuuccaau

SEQ ID NO: 1230334 - RNA, 16 nt, Homo sapiens
agaauucuuauacaca

SEQ ID NO: 1230335 - RNA, 19 nt, Homo sapiens
agaauugaaugucaauaug

SEQ ID NO: 1230336 - RNA, 19 nt, Homo sapiens
agaauugcuugaacccagg

SEQ ID NO: 1230337 - RNA, 14 nt, Homo sapiens
agaauuguaucauu

SEQ ID NO: 1230338 - RNA, 23 nt, Homo sapiens
agaauuguaucucauacugucug

SEQ ID NO: 1230339 - RNA, 21 nt, Homo sapiens
agaauuuauucaauuccucug

SEQ ID NO: 1230340 - RNA, 12 nt, Homo sapiens
agaauuucacaa

SEQ ID NO: 1230341 - RNA, 18 nt, Homo sapiens
agaauuucacaagcuauu

SEQ ID NO: 1230342 - RNA, 11 nt, Homo sapiens
agaauuugcac

SEQ ID NO: 1230343 - RNA, 23 nt, Homo sapiens
agaauuugguaaauuaguauuua

SEQ ID NO: 1230344 - RNA, 15 nt, Homo sapiens
agaauuugucagaaa

SEQ ID NO: 1230345 - RNA, 13 nt, Homo sapiens
agacaaacaugca

SEQ ID NO: 1230346 - RNA, 15 nt, Homo sapiens
agacaacuagauuug

SEQ ID NO: 1230347 - RNA, 12 nt, Homo sapiens
agacaagcacua

SEQ ID NO: 1230348 - RNA, 14 nt, Homo sapiens
agacaagcacuauu

SEQ ID NO: 1230349 - RNA, 13 nt, Homo sapiens
agacaagcacuuu

SEQ ID NO: 1230350 - RNA, 22 nt, Homo sapiens
agacaaggaggaguuccaccau

SEQ ID NO: 1230351 - RNA, 21 nt, Homo sapiens
agacaaguauggcuccuccau

SEQ ID NO: 1230352 - RNA, 13 nt, Homo sapiens
agacaaguuccau

SEQ ID NO: 1230353 - RNA, 20 nt, Homo sapiens
agacaauauacaagccaaag

SEQ ID NO: 1230354 - RNA, 17 nt, Homo sapiens
agacaaucacugaaaca

SEQ ID NO: 1230355 - RNA, 20 nt, Homo sapiens
agacaaugcaccuagcugug

SEQ ID NO: 1230356 - RNA, 13 nt, Homo sapiens
agacaauuugcac

SEQ ID NO: 1230357 - RNA, 18 nt, Homo sapiens
agacaccuguucacagaa

SEQ ID NO: 1230358 - RNA, 23 nt, Homo sapiens
agacaccuucugaguauucucau

SEQ ID NO: 1230359 - RNA, 17 nt, Homo sapiens
agacaccuugacagggc

SEQ ID NO: 1230360 - RNA, 22 nt, Homo sapiens
agacacgaugccgagaccucaa

SEQ ID NO: 1230361 - RNA, 22 nt, Homo sapiens
agacacggagcccagcccuccc

SEQ ID NO: 1230362 - RNA, 20 nt, Homo sapiens
agacacuggcguuacugcuu

SEQ ID NO: 1230363 - RNA, 18 nt, Homo sapiens
agacacuucccugcauua

SEQ ID NO: 1230364 - RNA, 14 nt, Homo sapiens
agacagaagccugg

SEQ ID NO: 1230365 - RNA, 14 nt, Homo sapiens
agacagaagcuuaa

SEQ ID NO: 1230366 - RNA, 16 nt, Homo sapiens
agacagacuugagaac

SEQ ID NO: 1230367 - RNA, 18 nt, Homo sapiens
agacagacuugagaacuu

SEQ ID NO: 1230368 - RNA, 13 nt, Homo sapiens
agacagaugucag

SEQ ID NO: 1230369 - RNA, 18 nt, Homo sapiens
agacaggguuucgccaug

SEQ ID NO: 1230370 - RNA, 23 nt, Homo sapiens
agacaguaugagucaaugugcag

SEQ ID NO: 1230371 - RNA, 20 nt, Homo sapiens
agacaguccuuucccaccau

SEQ ID NO: 1230372 - RNA, 14 nt, Homo sapiens
agacagugacuggu

SEQ ID NO: 1230373 - RNA, 15 nt, Homo sapiens
agacagugacuggug

SEQ ID NO: 1230374 - RNA, 14 nt, Homo sapiens
agacagugagacag

SEQ ID NO: 1230375 - RNA, 13 nt, Homo sapiens
agacagugcggau

SEQ ID NO: 1230376 - RNA, 15 nt, Homo sapiens
agacaguucaagaaa

SEQ ID NO: 1230377 - RNA, 13 nt, Homo sapiens
agacauacauuuc

SEQ ID NO: 1230378 - RNA, 21 nt, Homo sapiens
agacauauaacgcagucuaau

SEQ ID NO: 1230379 - RNA, 15 nt, Homo sapiens
agacauccugagcag

SEQ ID NO: 1230380 - RNA, 20 nt, Homo sapiens
agacaucggccuccaugacc

SEQ ID NO: 1230381 - RNA, 11 nt, Homo sapiens
agacaugaacu

SEQ ID NO: 1230382 - RNA, 16 nt, Homo sapiens
agacaugaaugcacac

SEQ ID NO: 1230383 - RNA, 17 nt, Homo sapiens
agacaugauuuccuuga

SEQ ID NO: 1230384 - RNA, 21 nt, Homo sapiens
agacaugauuuccuugaaugu

SEQ ID NO: 1230385 - RNA, 20 nt, Homo sapiens
agacaugcacuaugaggaau

SEQ ID NO: 1230386 - RNA, 22 nt, Homo sapiens
agacauggaugcgaggaccacu

SEQ ID NO: 1230387 - RNA, 16 nt, Homo sapiens
agacauguaucacugu

SEQ ID NO: 1230388 - RNA, 19 nt, Homo sapiens
agacauucuuccaaaaaga

SEQ ID NO: 1230389 - RNA, 22 nt, Homo sapiens
agaccaacguuacucagggcuc

SEQ ID NO: 1230390 - RNA, 23 nt, Homo sapiens
agaccaaggaacaaaaaaaccac

SEQ ID NO: 1230391 - RNA, 22 nt, Homo sapiens
agaccacgcccguccugccugu

SEQ ID NO: 1230392 - RNA, 18 nt, Homo sapiens
agaccagaaugugaagac

SEQ ID NO: 1230393 - RNA, 22 nt, Homo sapiens
agaccagccaaggguccucacc

SEQ ID NO: 1230394 - RNA, 11 nt, Homo sapiens
agaccagugac

SEQ ID NO: 1230395 - RNA, 18 nt, Homo sapiens
agaccaguugggagcacu

SEQ ID NO: 1230396 - RNA, 16 nt, Homo sapiens
agaccauaauguuaca

SEQ ID NO: 1230397 - RNA, 17 nt, Homo sapiens
agaccauccuggacuga

SEQ ID NO: 1230398 - RNA, 13 nt, Homo sapiens
agacccacagacu

SEQ ID NO: 1230399 - RNA, 19 nt, Homo sapiens
agacccaccccaccugcag

SEQ ID NO: 1230400 - RNA, 18 nt, Homo sapiens
agacccaggagagacaga

SEQ ID NO: 1230401 - RNA, 11 nt, Homo sapiens
agacccagugg

SEQ ID NO: 1230402 - RNA, 21 nt, Homo sapiens
agacccaguggacucuuccac

SEQ ID NO: 1230403 - RNA, 16 nt, Homo sapiens
agacccauaaccauua

SEQ ID NO: 1230404 - RNA, 15 nt, Homo sapiens
agacccccagcacuu

SEQ ID NO: 1230405 - RNA, 16 nt, Homo sapiens
agacccccagcacuug

SEQ ID NO: 1230406 - RNA, 19 nt, Homo sapiens
agacccguagaugccaggg

SEQ ID NO: 1230407 - RNA, 20 nt, Homo sapiens
agacccuccuauucuauaaa

SEQ ID NO: 1230408 - RNA, 19 nt, Homo sapiens
agaccggcugguggagcug

SEQ ID NO: 1230409 - RNA, 20 nt, Homo sapiens
agaccuaccucagguugcug

SEQ ID NO: 1230410 - RNA, 21 nt, Homo sapiens
agaccuaccucagguugcugg

SEQ ID NO: 1230411 - RNA, 15 nt, Homo sapiens
agaccucaucugugg

SEQ ID NO: 1230412 - RNA, 23 nt, Homo sapiens
agaccucugugaggaaagcacac

SEQ ID NO: 1230413 - RNA, 15 nt, Homo sapiens
agaccugaaguaggc

SEQ ID NO: 1230414 - RNA, 20 nt, Homo sapiens
agaccugaagugugcacguu

SEQ ID NO: 1230415 - RNA, 22 nt, Homo sapiens
agaccugagucugcaugugcac

SEQ ID NO: 1230416 - RNA, 17 nt, Homo sapiens
agacgaaauagugacau

SEQ ID NO: 1230417 - RNA, 19 nt, Homo sapiens
agacgcauuucgguugaga

SEQ ID NO: 1230418 - RNA, 14 nt, Homo sapiens
agacgcugcacuug

SEQ ID NO: 1230419 - RNA, 17 nt, Homo sapiens
agacgguguuuugccau

SEQ ID NO: 1230420 - RNA, 18 nt, Homo sapiens
agacgugcgcgaugugac

SEQ ID NO: 1230421 - RNA, 23 nt, Homo sapiens
agacuagaaaauuagacugugau

SEQ ID NO: 1230422 - RNA, 14 nt, Homo sapiens
agacuagugccgua

SEQ ID NO: 1230423 - RNA, 13 nt, Homo sapiens
agacuauggagcc

SEQ ID NO: 1230424 - RNA, 22 nt, Homo sapiens
agacucaccucauccuuaccgc

SEQ ID NO: 1230425 - RNA, 18 nt, Homo sapiens
agacuccgucucaaaaga

SEQ ID NO: 1230426 - RNA, 19 nt, Homo sapiens
agacucguuuuuaaggugg

SEQ ID NO: 1230427 - RNA, 15 nt, Homo sapiens
agacucuagagucca

SEQ ID NO: 1230428 - RNA, 10 nt, Homo sapiens
agacucugac

SEQ ID NO: 1230429 - RNA, 18 nt, Homo sapiens
agacucugucuaccuggu

SEQ ID NO: 1230430 - RNA, 18 nt, Homo sapiens
agacugaaagcagcagcu

SEQ ID NO: 1230431 - RNA, 14 nt, Homo sapiens
agacugaagaccag

SEQ ID NO: 1230432 - RNA, 15 nt, Homo sapiens
agacugacaaccuca

SEQ ID NO: 1230433 - RNA, 13 nt, Homo sapiens
agacugacugcaa

SEQ ID NO: 1230434 - RNA, 22 nt, Homo sapiens
agacugacuuguuugucuucca

SEQ ID NO: 1230435 - RNA, 19 nt, Homo sapiens
agacugcugggacuggcca

SEQ ID NO: 1230436 - RNA, 18 nt, Homo sapiens
agacuggcaauaaacucc

SEQ ID NO: 1230437 - RNA, 17 nt, Homo sapiens
agacuggggacccugga

SEQ ID NO: 1230438 - RNA, 17 nt, Homo sapiens
agacugggggcaggaug

SEQ ID NO: 1230439 - RNA, 22 nt, Homo sapiens
agacuguacuggccagugucau

SEQ ID NO: 1230440 - RNA, 18 nt, Homo sapiens
agacuguucuuacuguaa

SEQ ID NO: 1230441 - RNA, 19 nt, Homo sapiens
agacuuacucuaagaucuu

SEQ ID NO: 1230442 - RNA, 11 nt, Homo sapiens
agacuucccag

SEQ ID NO: 1230443 - RNA, 15 nt, Homo sapiens
agacuucguaauuaa

SEQ ID NO: 1230444 - RNA, 13 nt, Homo sapiens
agacuuguuguga

SEQ ID NO: 1230445 - RNA, 16 nt, Homo sapiens
agagaaaaauugccuu

SEQ ID NO: 1230446 - RNA, 17 nt, Homo sapiens
agagaaagagaacuacu

SEQ ID NO: 1230447 - RNA, 23 nt, Homo sapiens
agagaaaggccugcacacaagcc

SEQ ID NO: 1230448 - RNA, 20 nt, Homo sapiens
agagaaaggguaauuuccuu

SEQ ID NO: 1230449 - RNA, 14 nt, Homo sapiens
agagaaauacuuuc

SEQ ID NO: 1230450 - RNA, 18 nt, Homo sapiens
agagaaauccuuccuaaa

SEQ ID NO: 1230451 - RNA, 15 nt, Homo sapiens
agagaaccucagauc

SEQ ID NO: 1230452 - RNA, 16 nt, Homo sapiens
agagaaccucagauca

SEQ ID NO: 1230453 - RNA, 22 nt, Homo sapiens
agagaaccucagaucaggugca

SEQ ID NO: 1230454 - RNA, 20 nt, Homo sapiens
agagaaccucagguacggag

SEQ ID NO: 1230455 - RNA, 23 nt, Homo sapiens
agagaagaccaaagcauugccug

SEQ ID NO: 1230456 - RNA, 22 nt, Homo sapiens
agagaagggaagaaggggccau

SEQ ID NO: 1230457 - RNA, 22 nt, Homo sapiens
agagaaguaaaacaugcugaaa

SEQ ID NO: 1230458 - RNA, 13 nt, Homo sapiens
agagacacuccaa

SEQ ID NO: 1230459 - RNA, 19 nt, Homo sapiens
agagacagauaacucuccu

SEQ ID NO: 1230460 - RNA, 21 nt, Homo sapiens
agagacaggguuucacugugu

SEQ ID NO: 1230461 - RNA, 21 nt, Homo sapiens
agagacaggguuuugccaugu

SEQ ID NO: 1230462 - RNA, 16 nt, Homo sapiens
agagacccaagcugcc

SEQ ID NO: 1230463 - RNA, 22 nt, Homo sapiens
agagaccugagucugcaugugc

SEQ ID NO: 1230464 - RNA, 21 nt, Homo sapiens
agagacgggguuucuccaugu

SEQ ID NO: 1230465 - RNA, 18 nt, Homo sapiens
agagacgguguuuugcca

SEQ ID NO: 1230466 - RNA, 18 nt, Homo sapiens
agagacuaucugauuucc

SEQ ID NO: 1230467 - RNA, 14 nt, Homo sapiens
agagacuccgucuc

SEQ ID NO: 1230468 - RNA, 15 nt, Homo sapiens
agagacuccgucuca

SEQ ID NO: 1230469 - RNA, 12 nt, Homo sapiens
agagacuguaga

SEQ ID NO: 1230470 - RNA, 20 nt, Homo sapiens
agagagaaccaccacugccu

SEQ ID NO: 1230471 - RNA, 21 nt, Homo sapiens
agagagcagcuuuaaacucag

SEQ ID NO: 1230472 - RNA, 20 nt, Homo sapiens
agagagccauuuugugaaug

SEQ ID NO: 1230473 - RNA, 18 nt, Homo sapiens
agagagccccugacaauc

SEQ ID NO: 1230474 - RNA, 14 nt, Homo sapiens
agagaggaugugca

SEQ ID NO: 1230475 - RNA, 18 nt, Homo sapiens
agagagggaccauguguc

SEQ ID NO: 1230476 - RNA, 20 nt, Homo sapiens
agagagggccuuuccuggcu

SEQ ID NO: 1230477 - RNA, 18 nt, Homo sapiens
agagagucccacugccuc

SEQ ID NO: 1230478 - RNA, 19 nt, Homo sapiens
agagaucugguuuugcuau

SEQ ID NO: 1230479 - RNA, 21 nt, Homo sapiens
agagaucuuucuuuccaaaac

SEQ ID NO: 1230480 - RNA, 15 nt, Homo sapiens
agagaugaaccacau

SEQ ID NO: 1230481 - RNA, 20 nt, Homo sapiens
agagaugacacuagucagaa

SEQ ID NO: 1230482 - RNA, 17 nt, Homo sapiens
agagaugccagcccuuc

SEQ ID NO: 1230483 - RNA, 22 nt, Homo sapiens
agagaugcgaaccacccaaaac

SEQ ID NO: 1230484 - RNA, 21 nt, Homo sapiens
agagaugggguuucaccaugu

SEQ ID NO: 1230485 - RNA, 15 nt, Homo sapiens
agagaugucaucaga

SEQ ID NO: 1230486 - RNA, 13 nt, Homo sapiens
agagaugugcaau

SEQ ID NO: 1230487 - RNA, 14 nt, Homo sapiens
agagauucauuauu

SEQ ID NO: 1230488 - RNA, 15 nt, Homo sapiens
agagcaagacuccau

SEQ ID NO: 1230489 - RNA, 10 nt, Homo sapiens
agagcacaga

SEQ ID NO: 1230490 - RNA, 18 nt, Homo sapiens
agagcagaacccuagucu

SEQ ID NO: 1230491 - RNA, 22 nt, Homo sapiens
agagcagauggccuggcugcug

SEQ ID NO: 1230492 - RNA, 12 nt, Homo sapiens
agagcagcagca

SEQ ID NO: 1230493 - RNA, 15 nt, Homo sapiens
agagcagcuagcucu

SEQ ID NO: 1230494 - RNA, 17 nt, Homo sapiens
agagcaggaagcauuca

SEQ ID NO: 1230495 - RNA, 16 nt, Homo sapiens
agagcaggacugcaca

SEQ ID NO: 1230496 - RNA, 15 nt, Homo sapiens
agagcaggggcucca

SEQ ID NO: 1230497 - RNA, 17 nt, Homo sapiens
agagcaggggcuccagc

SEQ ID NO: 1230498 - RNA, 22 nt, Homo sapiens
agagcaggggcuccagcaccuu

SEQ ID NO: 1230499 - RNA, 22 nt, Homo sapiens
agagcaugaaaaucacacuguc

SEQ ID NO: 1230500 - RNA, 17 nt, Homo sapiens
agagcaugauacaaauu

SEQ ID NO: 1230501 - RNA, 21 nt, Homo sapiens
agagccaauguuuuccaccca

SEQ ID NO: 1230502 - RNA, 17 nt, Homo sapiens
agagccaggaugcccag

SEQ ID NO: 1230503 - RNA, 13 nt, Homo sapiens
agagccagugaag

SEQ ID NO: 1230504 - RNA, 18 nt, Homo sapiens
agagccccuacagcauug

SEQ ID NO: 1230505 - RNA, 20 nt, Homo sapiens
agagcccuucacugccauga

SEQ ID NO: 1230506 - RNA, 21 nt, Homo sapiens
agagccucggcccuagcauug

SEQ ID NO: 1230507 - RNA, 19 nt, Homo sapiens
agagccugagucacugguc

SEQ ID NO: 1230508 - RNA, 17 nt, Homo sapiens
agagccuuuugugcaaa

SEQ ID NO: 1230509 - RNA, 19 nt, Homo sapiens
agagcggcugcccgacuca

SEQ ID NO: 1230510 - RNA, 10 nt, Homo sapiens
agagcucuau

SEQ ID NO: 1230511 - RNA, 11 nt, Homo sapiens
agagcucuuaa

SEQ ID NO: 1230512 - RNA, 16 nt, Homo sapiens
agagcuucucccaaac

SEQ ID NO: 1230513 - RNA, 23 nt, Homo sapiens
agagcuuguaauaaauacugcag

SEQ ID NO: 1230514 - RNA, 13 nt, Homo sapiens
agaggaaagggau

SEQ ID NO: 1230515 - RNA, 22 nt, Homo sapiens
agaggaacuccuuggccuagcc

SEQ ID NO: 1230516 - RNA, 19 nt, Homo sapiens
agaggaauaagaauggagc

SEQ ID NO: 1230517 - RNA, 22 nt, Homo sapiens
agaggacgcacgcucgcugcca

SEQ ID NO: 1230518 - RNA, 14 nt, Homo sapiens
agaggacgugggac

SEQ ID NO: 1230519 - RNA, 13 nt, Homo sapiens
agaggacugagac

SEQ ID NO: 1230520 - RNA, 21 nt, Homo sapiens
agaggagaagagacauguacc

SEQ ID NO: 1230521 - RNA, 13 nt, Homo sapiens
agaggagccagac

SEQ ID NO: 1230522 - RNA, 15 nt, Homo sapiens
agaggaggaggagaa

SEQ ID NO: 1230523 - RNA, 19 nt, Homo sapiens
agaggaggggacccaugua

SEQ ID NO: 1230524 - RNA, 23 nt, Homo sapiens
agaggaggggacccauguaaucc

SEQ ID NO: 1230525 - RNA, 22 nt, Homo sapiens
agaggagugauugaaccagcuc

SEQ ID NO: 1230526 - RNA, 20 nt, Homo sapiens
agaggaucuccuguccauca

SEQ ID NO: 1230527 - RNA, 13 nt, Homo sapiens
agaggcagcuuca

SEQ ID NO: 1230528 - RNA, 14 nt, Homo sapiens
agaggcagugacag

SEQ ID NO: 1230529 - RNA, 22 nt, Homo sapiens
agaggccuggagcccacaaccu

SEQ ID NO: 1230530 - RNA, 16 nt, Homo sapiens
agaggcgagaugagcc

SEQ ID NO: 1230531 - RNA, 15 nt, Homo sapiens
agaggcucagcacuu

SEQ ID NO: 1230532 - RNA, 16 nt, Homo sapiens
agaggcucagcacuuu

SEQ ID NO: 1230533 - RNA, 20 nt, Homo sapiens
agaggcucuaauguacaaua

SEQ ID NO: 1230534 - RNA, 13 nt, Homo sapiens
agaggcucugaga

SEQ ID NO: 1230535 - RNA, 16 nt, Homo sapiens
agaggcugcaaggauu

SEQ ID NO: 1230536 - RNA, 18 nt, Homo sapiens
agaggcugccccucucac

SEQ ID NO: 1230537 - RNA, 21 nt, Homo sapiens
agaggcugccccucucaccaa

SEQ ID NO: 1230538 - RNA, 19 nt, Homo sapiens
agaggcugcugaaaaccau

SEQ ID NO: 1230539 - RNA, 13 nt, Homo sapiens
agaggcugcugca

SEQ ID NO: 1230540 - RNA, 15 nt, Homo sapiens
agaggcugggagcau

SEQ ID NO: 1230541 - RNA, 18 nt, Homo sapiens
agagggacagaugaccaa

SEQ ID NO: 1230542 - RNA, 18 nt, Homo sapiens
agagggaccagagcuugg

SEQ ID NO: 1230543 - RNA, 16 nt, Homo sapiens
agagggagagcagaga

SEQ ID NO: 1230544 - RNA, 21 nt, Homo sapiens
acauauuuguggaauaaugua

SEQ ID NO: 1230545 - RNA, 12 nt, Homo sapiens
acauauuuuaga

SEQ ID NO: 1230546 - RNA, 16 nt, Homo sapiens
acaucaaaacuaacca

SEQ ID NO: 1230547 - RNA, 19 nt, Homo sapiens
acaucaaagccuggccuaa

SEQ ID NO: 1230548 - RNA, 19 nt, Homo sapiens
acaucaaauaaacugacuu

SEQ ID NO: 1230549 - RNA, 18 nt, Homo sapiens
acaucaauccuuuaccac

SEQ ID NO: 1230550 - RNA, 15 nt, Homo sapiens
acaucacucugcugc

SEQ ID NO: 1230551 - RNA, 20 nt, Homo sapiens
acaucacuuguacaaaauaa

SEQ ID NO: 1230552 - RNA, 20 nt, Homo sapiens
acaucagcagagaacuggaa

SEQ ID NO: 1230553 - RNA, 15 nt, Homo sapiens
acaucaggaguucaa

SEQ ID NO: 1230554 - RNA, 11 nt, Homo sapiens
acaucauaaaa

SEQ ID NO: 1230555 - RNA, 22 nt, Homo sapiens
acaucauuagaacaaaggacag

SEQ ID NO: 1230556 - RNA, 15 nt, Homo sapiens
acauccagucacuuu

SEQ ID NO: 1230557 - RNA, 13 nt, Homo sapiens
acauccauuccca

SEQ ID NO: 1230558 - RNA, 16 nt, Homo sapiens
acauccccuucugcaa

SEQ ID NO: 1230559 - RNA, 17 nt, Homo sapiens
acauccccuucugcaau

SEQ ID NO: 1230560 - RNA, 20 nt, Homo sapiens
acauccccuuuguguagaaa

SEQ ID NO: 1230561 - RNA, 22 nt, Homo sapiens
acauccuaccccuuugcacuug

SEQ ID NO: 1230562 - RNA, 23 nt, Homo sapiens
acauccuugucugggucuaccag

SEQ ID NO: 1230563 - RNA, 17 nt, Homo sapiens
acaucgccaaggacuga

SEQ ID NO: 1230564 - RNA, 21 nt, Homo sapiens
acaucgccaaggacugacuga

SEQ ID NO: 1230565 - RNA, 17 nt, Homo sapiens
acaucggccuccaugac

SEQ ID NO: 1230566 - RNA, 17 nt, Homo sapiens
acaucuacaaucaggag

SEQ ID NO: 1230567 - RNA, 17 nt, Homo sapiens
acaucuaguuaaucaua

SEQ ID NO: 1230568 - RNA, 20 nt, Homo sapiens
acaucuauuauaaaaccaug

SEQ ID NO: 1230569 - RNA, 22 nt, Homo sapiens
acaucuauuuuggauuguauau

SEQ ID NO: 1230570 - RNA, 19 nt, Homo sapiens
acaucucagaaaacucugg

SEQ ID NO: 1230571 - RNA, 12 nt, Homo sapiens
acaucucagggg

SEQ ID NO: 1230572 - RNA, 22 nt, Homo sapiens
acaucuccaggcuuucaauguu

SEQ ID NO: 1230573 - RNA, 13 nt, Homo sapiens
acaucugcaauau

SEQ ID NO: 1230574 - RNA, 23 nt, Homo sapiens
acaucugccuuaaaaccaaagag

SEQ ID NO: 1230575 - RNA, 13 nt, Homo sapiens
acaucuucuaucu

SEQ ID NO: 1230576 - RNA, 18 nt, Homo sapiens
acaucuuggucagauuug

SEQ ID NO: 1230577 - RNA, 22 nt, Homo sapiens
acaucuuuccaguccuugguca

SEQ ID NO: 1230578 - RNA, 16 nt, Homo sapiens
acaugaaaaacaggug

SEQ ID NO: 1230579 - RNA, 19 nt, Homo sapiens
acaugaacagaaacaauaa

SEQ ID NO: 1230580 - RNA, 17 nt, Homo sapiens
acaugaagaaugcauuc

SEQ ID NO: 1230581 - RNA, 22 nt, Homo sapiens
acaugaagcuguugugugaggu

SEQ ID NO: 1230582 - RNA, 18 nt, Homo sapiens
acaugaaucccacccaca

SEQ ID NO: 1230583 - RNA, 23 nt, Homo sapiens
acaugaauugcauuuuacuuuaa

SEQ ID NO: 1230584 - RNA, 20 nt, Homo sapiens
acaugacacaguuggauuua

SEQ ID NO: 1230585 - RNA, 21 nt, Homo sapiens
acaugacacaguuggauuuau

SEQ ID NO: 1230586 - RNA, 19 nt, Homo sapiens
acaugacacccgaagggac

SEQ ID NO: 1230587 - RNA, 10 nt, Homo sapiens
acaugacugg

SEQ ID NO: 1230588 - RNA, 19 nt, Homo sapiens
acaugagaacaaacagauc

SEQ ID NO: 1230589 - RNA, 17 nt, Homo sapiens
acaugagaagugauaaa

SEQ ID NO: 1230590 - RNA, 15 nt, Homo sapiens
acaugagacuuuccg

SEQ ID NO: 1230591 - RNA, 20 nt, Homo sapiens
acaugaucuguuuuucacca

SEQ ID NO: 1230592 - RNA, 22 nt, Homo sapiens
acaugcaaaaagaaaugacuaa

SEQ ID NO: 1230593 - RNA, 23 nt, Homo sapiens
acaugcaaagauccccaaaacag

SEQ ID NO: 1230594 - RNA, 15 nt, Homo sapiens
acaugcacgugugug

SEQ ID NO: 1230595 - RNA, 17 nt, Homo sapiens
acaugcccuccuggaca

SEQ ID NO: 1230596 - RNA, 15 nt, Homo sapiens
acaugcgaccgugac

SEQ ID NO: 1230597 - RNA, 15 nt, Homo sapiens
acaugcgcacucuca

SEQ ID NO: 1230598 - RNA, 15 nt, Homo sapiens
acaugcugugcucuu

SEQ ID NO: 1230599 - RNA, 23 nt, Homo sapiens
acaugcuugaauaacugagcuua

SEQ ID NO: 1230600 - RNA, 18 nt, Homo sapiens
acauggaauaacauguaa

SEQ ID NO: 1230601 - RNA, 22 nt, Homo sapiens
acauggaugcgaggaccacuuu

SEQ ID NO: 1230602 - RNA, 14 nt, Homo sapiens
acauggccuaugca

SEQ ID NO: 1230603 - RNA, 16 nt, Homo sapiens
acauggccuaugcaca

SEQ ID NO: 1230604 - RNA, 19 nt, Homo sapiens
acauggccuaugcacauau

SEQ ID NO: 1230605 - RNA, 17 nt, Homo sapiens
acaugggcucuucacua

SEQ ID NO: 1230606 - RNA, 15 nt, Homo sapiens
acauguaauuugaug

SEQ ID NO: 1230607 - RNA, 19 nt, Homo sapiens
acauguagaaaaauacuga

SEQ ID NO: 1230608 - RNA, 19 nt, Homo sapiens
acauguaugugcauuucaa

SEQ ID NO: 1230609 - RNA, 17 nt, Homo sapiens
acauguauugcacauug

SEQ ID NO: 1230610 - RNA, 19 nt, Homo sapiens
acauguauugcacauugua

SEQ ID NO: 1230611 - RNA, 13 nt, Homo sapiens
acaugucuuucag

SEQ ID NO: 1230612 - RNA, 21 nt, Homo sapiens
acaugucuuuucuuccacugc

SEQ ID NO: 1230613 - RNA, 15 nt, Homo sapiens
acaugugacacauau

SEQ ID NO: 1230614 - RNA, 17 nt, Homo sapiens
acaugugacacauaugc

SEQ ID NO: 1230615 - RNA, 12 nt, Homo sapiens
acaugugcacau

SEQ ID NO: 1230616 - RNA, 19 nt, Homo sapiens
acauguguagccugugcau

SEQ ID NO: 1230617 - RNA, 23 nt, Homo sapiens
acauguuaaugacaauauuccag

SEQ ID NO: 1230618 - RNA, 15 nt, Homo sapiens
acauguuaucaaauc

SEQ ID NO: 1230619 - RNA, 14 nt, Homo sapiens
acauguugccucac

SEQ ID NO: 1230620 - RNA, 13 nt, Homo sapiens
acauguugucaca

SEQ ID NO: 1230621 - RNA, 14 nt, Homo sapiens
acauuaaacacaaa

SEQ ID NO: 1230622 - RNA, 15 nt, Homo sapiens
acauuauacauuuga

SEQ ID NO: 1230623 - RNA, 15 nt, Homo sapiens
acauuaucaucugaa

SEQ ID NO: 1230624 - RNA, 12 nt, Homo sapiens
acauuaugugga

SEQ ID NO: 1230625 - RNA, 13 nt, Homo sapiens
acauuaugugguu

SEQ ID NO: 1230626 - RNA, 19 nt, Homo sapiens
acauuaugugugcaugugu

SEQ ID NO: 1230627 - RNA, 19 nt, Homo sapiens
acauuauuucuaguccaaa

SEQ ID NO: 1230628 - RNA, 20 nt, Homo sapiens
acauuauuucuaguccaaaa

SEQ ID NO: 1230629 - RNA, 15 nt, Homo sapiens
acauucaucaauauc

SEQ ID NO: 1230630 - RNA, 20 nt, Homo sapiens
acauuccaaugcauugcuaa

SEQ ID NO: 1230631 - RNA, 13 nt, Homo sapiens
acauuccacccca

SEQ ID NO: 1230632 - RNA, 20 nt, Homo sapiens
acauucccuugauggucuca

SEQ ID NO: 1230633 - RNA, 15 nt, Homo sapiens
acauucgaccuccau

SEQ ID NO: 1230634 - RNA, 20 nt, Homo sapiens
acauucugcaagcacaucug

SEQ ID NO: 1230635 - RNA, 21 nt, Homo sapiens
cagcagaauacugcuugcuua

SEQ ID NO: 1230636 - RNA, 18 nt, Homo sapiens
cagcagagaagcuguagg

SEQ ID NO: 1230637 - RNA, 23 nt, Homo sapiens
cagcagaggcggucuucaacauc

SEQ ID NO: 1230638 - RNA, 23 nt, Homo sapiens
cagcagcacagucacccauggaa

SEQ ID NO: 1230639 - RNA, 15 nt, Homo sapiens
cagcagcacuguucu

SEQ ID NO: 1230640 - RNA, 23 nt, Homo sapiens
cagcagcccuaaggaucucucag

SEQ ID NO: 1230641 - RNA, 17 nt, Homo sapiens
cagcaggagcucugacu

SEQ ID NO: 1230642 - RNA, 20 nt, Homo sapiens
cagcaggcacguuaacucga

SEQ ID NO: 1230643 - RNA, 17 nt, Homo sapiens
cagcaggggggcugugc

SEQ ID NO: 1230644 - RNA, 14 nt, Homo sapiens
cagcaguaccaucu

SEQ ID NO: 1230645 - RNA, 19 nt, Homo sapiens
cagcaguccacaaagcauu

SEQ ID NO: 1230646 - RNA, 20 nt, Homo sapiens
cagcagugccuugugcaaug

SEQ ID NO: 1230647 - RNA, 17 nt, Homo sapiens
cagcagugucacucugu

SEQ ID NO: 1230648 - RNA, 19 nt, Homo sapiens
cagcaucacuccccaagga

SEQ ID NO: 1230649 - RNA, 16 nt, Homo sapiens
cagcauccacacugcc

SEQ ID NO: 1230650 - RNA, 22 nt, Homo sapiens
cagcauccaccuuggcucugcc

SEQ ID NO: 1230651 - RNA, 14 nt, Homo sapiens
cagcaucugugaug

SEQ ID NO: 1230652 - RNA, 15 nt, Homo sapiens
cagcaugauguguug

SEQ ID NO: 1230653 - RNA, 15 nt, Homo sapiens
cagcauguccaacau

SEQ ID NO: 1230654 - RNA, 14 nt, Homo sapiens
cagcauuauugaaa

SEQ ID NO: 1230655 - RNA, 18 nt, Homo sapiens
cagcauucuuagccugug

SEQ ID NO: 1230656 - RNA, 15 nt, Homo sapiens
cagcauugcugguuc

SEQ ID NO: 1230657 - RNA, 20 nt, Homo sapiens
cagcauuugauaaaauccaa

SEQ ID NO: 1230658 - RNA, 18 nt, Homo sapiens
cagccaaacccugucuga

SEQ ID NO: 1230659 - RNA, 18 nt, Homo sapiens
cagccaaccucauugcag

SEQ ID NO: 1230660 - RNA, 13 nt, Homo sapiens
cagccaaguguga

SEQ ID NO: 1230661 - RNA, 12 nt, Homo sapiens
cagccacaacca

SEQ ID NO: 1230662 - RNA, 16 nt, Homo sapiens
cagccacaaccaaaaa

SEQ ID NO: 1230663 - RNA, 12 nt, Homo sapiens
cagccacaggca

SEQ ID NO: 1230664 - RNA, 21 nt, Homo sapiens
cagccacaguggccaaagagg

SEQ ID NO: 1230665 - RNA, 13 nt, Homo sapiens
cagccacauucua

SEQ ID NO: 1230666 - RNA, 20 nt, Homo sapiens
cagccaccauccuauugcaa

SEQ ID NO: 1230667 - RNA, 22 nt, Homo sapiens
cagccaccguuucuuccugcca

SEQ ID NO: 1230668 - RNA, 22 nt, Homo sapiens
cagccacuucggccaggucaca

SEQ ID NO: 1230669 - RNA, 18 nt, Homo sapiens
cagccagacccuggagag

SEQ ID NO: 1230670 - RNA, 20 nt, Homo sapiens
cagccagaggguagggcaca

SEQ ID NO: 1230671 - RNA, 18 nt, Homo sapiens
cagccagugccauuccac

SEQ ID NO: 1230672 - RNA, 17 nt, Homo sapiens
cagccaucacaugaucu

SEQ ID NO: 1230673 - RNA, 18 nt, Homo sapiens
cagccaugccucaugcca

SEQ ID NO: 1230674 - RNA, 14 nt, Homo sapiens
cagcccaaccuuca

SEQ ID NO: 1230675 - RNA, 21 nt, Homo sapiens
cagcccaagaggacugagacu

SEQ ID NO: 1230676 - RNA, 13 nt, Homo sapiens
cagcccagagcca

SEQ ID NO: 1230677 - RNA, 16 nt, Homo sapiens
cagcccaggacucuaa

SEQ ID NO: 1230678 - RNA, 23 nt, Homo sapiens
cagcccaggucccuccgcggcug

SEQ ID NO: 1230679 - RNA, 20 nt, Homo sapiens
cagcccauggcccugugcua

SEQ ID NO: 1230680 - RNA, 23 nt, Homo sapiens
cagcccauggugagcucugggaa

SEQ ID NO: 1230681 - RNA, 15 nt, Homo sapiens
cagcccaugugcacc

SEQ ID NO: 1230682 - RNA, 15 nt, Homo sapiens
cagccccacugccag

SEQ ID NO: 1230683 - RNA, 20 nt, Homo sapiens
cagccccuagaaacccaagc

SEQ ID NO: 1230684 - RNA, 14 nt, Homo sapiens
cagccccuagccca

SEQ ID NO: 1230685 - RNA, 15 nt, Homo sapiens
cagccccucaugccu

SEQ ID NO: 1230686 - RNA, 13 nt, Homo sapiens
cagcccuauggau

SEQ ID NO: 1230687 - RNA, 20 nt, Homo sapiens
cagcccugaccccaguguac

SEQ ID NO: 1230688 - RNA, 23 nt, Homo sapiens
cagccgccagcugggagcacugg

SEQ ID NO: 1230689 - RNA, 15 nt, Homo sapiens
cagccguauuuuaca

SEQ ID NO: 1230690 - RNA, 23 nt, Homo sapiens
cagccucacuugaaugugucacu

SEQ ID NO: 1230691 - RNA, 18 nt, Homo sapiens
cagccucagcaacccagg

SEQ ID NO: 1230692 - RNA, 21 nt, Homo sapiens
cagccuccacaccuaccacga

SEQ ID NO: 1230693 - RNA, 19 nt, Homo sapiens
cagccuccccgugccaaaa

SEQ ID NO: 1230694 - RNA, 20 nt, Homo sapiens
cagccucccgaauagcuggg

SEQ ID NO: 1230695 - RNA, 20 nt, Homo sapiens
cagccucccgaguagcugga

SEQ ID NO: 1230696 - RNA, 22 nt, Homo sapiens
cagccuccgccaagaucuacag

SEQ ID NO: 1230697 - RNA, 17 nt, Homo sapiens
cagccuccuccugacca

SEQ ID NO: 1230698 - RNA, 14 nt, Homo sapiens
cagccuccugcuaa

SEQ ID NO: 1230699 - RNA, 21 nt, Homo sapiens
cagccucucccugugucccac

SEQ ID NO: 1230700 - RNA, 22 nt, Homo sapiens
cagccucugaccccuccucacu

SEQ ID NO: 1230701 - RNA, 17 nt, Homo sapiens
cagccucuugagcugaa

SEQ ID NO: 1230702 - RNA, 22 nt, Homo sapiens
cagccugagcaacagagugaga

SEQ ID NO: 1230703 - RNA, 14 nt, Homo sapiens
cagccuggagaccc

SEQ ID NO: 1230704 - RNA, 21 nt, Homo sapiens
cagccuggccaucauggugaa

SEQ ID NO: 1230705 - RNA, 20 nt, Homo sapiens
cagccuggccccugugcacc

SEQ ID NO: 1230706 - RNA, 22 nt, Homo sapiens
cagccuggggggucguggcaga

SEQ ID NO: 1230707 - RNA, 20 nt, Homo sapiens
cagccugguuuucacauaca

SEQ ID NO: 1230708 - RNA, 23 nt, Homo sapiens
cagccugucccauggacacucca

SEQ ID NO: 1230709 - RNA, 19 nt, Homo sapiens
cagccugugcuguggcaua

SEQ ID NO: 1230710 - RNA, 22 nt, Homo sapiens
cagccugugguuacagugcaga

SEQ ID NO: 1230711 - RNA, 24 nt, Homo sapiens
cagccuuaugauuaaacuuccuuc

SEQ ID NO: 1230712 - RNA, 17 nt, Homo sapiens
cagccuuuccagccucc

SEQ ID NO: 1230713 - RNA, 20 nt, Homo sapiens
cagccuuucugaggacacca

SEQ ID NO: 1230714 - RNA, 13 nt, Homo sapiens
cagcgacugccac

SEQ ID NO: 1230715 - RNA, 16 nt, Homo sapiens
cagcgauucccugugu

SEQ ID NO: 1230716 - RNA, 21 nt, Homo sapiens
cagcgauucccuguguagcuc

SEQ ID NO: 1230717 - RNA, 18 nt, Homo sapiens
cagcgucacucuaccuaa

SEQ ID NO: 1230718 - RNA, 18 nt, Homo sapiens
cagcgucccuagcaguga

SEQ ID NO: 1230719 - RNA, 13 nt, Homo sapiens
cagcguguguauc

SEQ ID NO: 1230720 - RNA, 20 nt, Homo sapiens
cagcuaccacgggucugcca

SEQ ID NO: 1230721 - RNA, 22 nt, Homo sapiens
cagcuacccaggaggcugaggu

SEQ ID NO: 1230722 - RNA, 12 nt, Homo sapiens
cagcuacucaga

SEQ ID NO: 1230723 - RNA, 19 nt, Homo sapiens
cagcuagaaauaagcccaa

SEQ ID NO: 1230724 - RNA, 14 nt, Homo sapiens
cagcuaucagcucu

SEQ ID NO: 1230725 - RNA, 15 nt, Homo sapiens
cagcucaaccacagu

SEQ ID NO: 1230726 - RNA, 22 nt, Homo sapiens
cagcucaaugcaguuagcugaa

SEQ ID NO: 1230727 - RNA, 22 nt, Homo sapiens
cagcucagcuucuuccuagguc

SEQ ID NO: 1230728 - RNA, 11 nt, Homo sapiens
cagcucaggga

SEQ ID NO: 1230729 - RNA, 12 nt, Homo sapiens
cagcucagggac

SEQ ID NO: 1230730 - RNA, 13 nt, Homo sapiens
cagcucauaaaau

SEQ ID NO: 1230731 - RNA, 23 nt, Homo sapiens
cagcucauaaaauggaagcaauu

SEQ ID NO: 1230732 - RNA, 17 nt, Homo sapiens
cagcuccagugccagca

SEQ ID NO: 1230733 - RNA, 18 nt, Homo sapiens
cagcucccuuauaccccc

SEQ ID NO: 1230734 - RNA, 15 nt, Homo sapiens
cagcucccuucucug

SEQ ID NO: 1230735 - RNA, 14 nt, Homo sapiens
cagcuccuguaaca

SEQ ID NO: 1230736 - RNA, 15 nt, Homo sapiens
cagcuccuucugucc

SEQ ID NO: 1230737 - RNA, 20 nt, Homo sapiens
cagcuccuuuauuauaauca

SEQ ID NO: 1230738 - RNA, 12 nt, Homo sapiens
cagcucugagau

SEQ ID NO: 1230739 - RNA, 19 nt, Homo sapiens
cagcucugagccagauuac

SEQ ID NO: 1230740 - RNA, 21 nt, Homo sapiens
cagcucugcauuaucugaggu

SEQ ID NO: 1230741 - RNA, 13 nt, Homo sapiens
cagcucuggagaa

SEQ ID NO: 1230742 - RNA, 17 nt, Homo sapiens
cagcucugggagaggau

SEQ ID NO: 1230743 - RNA, 18 nt, Homo sapiens
cagcucuguaucugccau

SEQ ID NO: 1230744 - RNA, 21 nt, Homo sapiens
cagcucuguaucugccaugug

SEQ ID NO: 1230745 - RNA, 16 nt, Homo sapiens
cagcucuucacagucc

SEQ ID NO: 1230746 - RNA, 24 nt, Homo sapiens
cagcucuugcuaaucagugucuca

SEQ ID NO: 1230747 - RNA, 15 nt, Homo sapiens
cagcugagacaggcc

SEQ ID NO: 1230748 - RNA, 20 nt, Homo sapiens
cagcugaggccuugccuuga

SEQ ID NO: 1230749 - RNA, 22 nt, Homo sapiens
cagcugcucagaauucaucuga

SEQ ID NO: 1230750 - RNA, 21 nt, Homo sapiens
cagcuggaagggucaacaucu

SEQ ID NO: 1230751 - RNA, 23 nt, Homo sapiens
cagcuggaagguacuaugccagu

SEQ ID NO: 1230752 - RNA, 17 nt, Homo sapiens
cagcuggcgaacccugg

SEQ ID NO: 1230753 - RNA, 22 nt, Homo sapiens
cagcuggcgaacccugggccau

SEQ ID NO: 1230754 - RNA, 16 nt, Homo sapiens
cagcugggcaaagcca

SEQ ID NO: 1230755 - RNA, 14 nt, Homo sapiens
cagcuggugcucca

SEQ ID NO: 1230756 - RNA, 20 nt, Homo sapiens
caggguccucuucugggccu

SEQ ID NO: 1230757 - RNA, 20 nt, Homo sapiens
caaaucugagggagcugagu

SEQ ID NO: 1230758 - RNA, 20 nt, Homo sapiens
caaaucuugaauuucugcca

SEQ ID NO: 1230759 - RNA, 15 nt, Homo sapiens
caaaugaaauguaug

SEQ ID NO: 1230760 - RNA, 15 nt, Homo sapiens
caaaugacaaaaagc

SEQ ID NO: 1230761 - RNA, 15 nt, Homo sapiens
caaaugcaugaacaa

SEQ ID NO: 1230762 - RNA, 20 nt, Homo sapiens
caaaugccaaaauucauuca

SEQ ID NO: 1230763 - RNA, 21 nt, Homo sapiens
caaaugccuccaagccauuca

SEQ ID NO: 1230764 - RNA, 16 nt, Homo sapiens
caaaugccuugaacug

SEQ ID NO: 1230765 - RNA, 16 nt, Homo sapiens
caaaugcuauuugaua

SEQ ID NO: 1230766 - RNA, 18 nt, Homo sapiens
caaaugggaaaaccagac

SEQ ID NO: 1230767 - RNA, 15 nt, Homo sapiens
caaauggugcugaau

SEQ ID NO: 1230768 - RNA, 20 nt, Homo sapiens
caaaugguggguacaaaaag

SEQ ID NO: 1230769 - RNA, 15 nt, Homo sapiens
caaauuaacuguaug

SEQ ID NO: 1230770 - RNA, 16 nt, Homo sapiens
caaauuagccauuuca

SEQ ID NO: 1230771 - RNA, 22 nt, Homo sapiens
caaauucauuuuuuucacugga

SEQ ID NO: 1230772 - RNA, 23 nt, Homo sapiens
caaauucauuuuuuucacuggag

SEQ ID NO: 1230773 - RNA, 14 nt, Homo sapiens
caaauugccugcaa

SEQ ID NO: 1230774 - RNA, 13 nt, Homo sapiens
caaauugcugcuu

SEQ ID NO: 1230775 - RNA, 23 nt, Homo sapiens
caaauuggaauggaacuacugua

SEQ ID NO: 1230776 - RNA, 20 nt, Homo sapiens
caaauugggaaauccauucc

SEQ ID NO: 1230777 - RNA, 21 nt, Homo sapiens
caaauugggaaauccauucca

SEQ ID NO: 1230778 - RNA, 23 nt, Homo sapiens
caaauugggaaauccauuccauu

SEQ ID NO: 1230779 - RNA, 20 nt, Homo sapiens
caaauuuuagaacuuuaccu

SEQ ID NO: 1230780 - RNA, 23 nt, Homo sapiens
caaauuuuucacccauuuacaca

SEQ ID NO: 1230781 - RNA, 11 nt, Homo sapiens
caacaaaccau

SEQ ID NO: 1230782 - RNA, 19 nt, Homo sapiens
caacaaaccauccagugac

SEQ ID NO: 1230783 - RNA, 19 nt, Homo sapiens
caacaaagccaacagucaa

SEQ ID NO: 1230784 - RNA, 21 nt, Homo sapiens
caacaaaggcugaacuggauu

SEQ ID NO: 1230785 - RNA, 19 nt, Homo sapiens
caacaauacaugcugcuaa

SEQ ID NO: 1230786 - RNA, 17 nt, Homo sapiens
caacaauccaucucuca

SEQ ID NO: 1230787 - RNA, 21 nt, Homo sapiens
caacaauccaucucucaagua

SEQ ID NO: 1230788 - RNA, 14 nt, Homo sapiens
caacacaaauauca

SEQ ID NO: 1230789 - RNA, 13 nt, Homo sapiens
caacacacacugu

SEQ ID NO: 1230790 - RNA, 21 nt, Homo sapiens
caacacaguugggacccaaaa

SEQ ID NO: 1230791 - RNA, 20 nt, Homo sapiens
caacacaugucuagcuuuca

SEQ ID NO: 1230792 - RNA, 17 nt, Homo sapiens
caacacccaaagcaugg

SEQ ID NO: 1230793 - RNA, 24 nt, Homo sapiens
caacacucacauuuauucugcuca

SEQ ID NO: 1230794 - RNA, 13 nt, Homo sapiens
caacacugcucac

SEQ ID NO: 1230795 - RNA, 14 nt, Homo sapiens
caacacugcugcuc

SEQ ID NO: 1230796 - RNA, 17 nt, Homo sapiens
caacacuguacacauaa

SEQ ID NO: 1230797 - RNA, 22 nt, Homo sapiens
caacacugugcccugguggaga

SEQ ID NO: 1230798 - RNA, 11 nt, Homo sapiens
caacacuuaag

SEQ ID NO: 1230799 - RNA, 18 nt, Homo sapiens
caacagaaacaugccaga

SEQ ID NO: 1230800 - RNA, 18 nt, Homo sapiens
caacagaaaccagaaaag

SEQ ID NO: 1230801 - RNA, 21 nt, Homo sapiens
caacagaaguauuucugugga

SEQ ID NO: 1230802 - RNA, 21 nt, Homo sapiens
caacagagcaagacuccaucu

SEQ ID NO: 1230803 - RNA, 14 nt, Homo sapiens
caacagaucugcag

SEQ ID NO: 1230804 - RNA, 17 nt, Homo sapiens
caacagcaaaucacgac

SEQ ID NO: 1230805 - RNA, 23 nt, Homo sapiens
caacagcaccuccccgcugggaa

SEQ ID NO: 1230806 - RNA, 22 nt, Homo sapiens
caacagccaugcccgcauuagc

SEQ ID NO: 1230807 - RNA, 19 nt, Homo sapiens
caacagcuacagucuaaaa

SEQ ID NO: 1230808 - RNA, 11 nt, Homo sapiens
caacaggaaau

SEQ ID NO: 1230809 - RNA, 16 nt, Homo sapiens
caacaggcccagggag

SEQ ID NO: 1230810 - RNA, 12 nt, Homo sapiens
caacauaacuga

SEQ ID NO: 1230811 - RNA, 20 nt, Homo sapiens
caacauaacugaaggcauau

SEQ ID NO: 1230812 - RNA, 15 nt, Homo sapiens
caacauaggccugcu

SEQ ID NO: 1230813 - RNA, 16 nt, Homo sapiens
caacauccuuaaguca

SEQ ID NO: 1230814 - RNA, 16 nt, Homo sapiens
caacaucgcaauaguu

SEQ ID NO: 1230815 - RNA, 24 nt, Homo sapiens
caacaucgugaaaccccaucucua

SEQ ID NO: 1230816 - RNA, 22 nt, Homo sapiens
caacaucuucauagaugaauga

SEQ ID NO: 1230817 - RNA, 13 nt, Homo sapiens
caacaugcugccc

SEQ ID NO: 1230818 - RNA, 16 nt, Homo sapiens
caacaugcugccccag

SEQ ID NO: 1230819 - RNA, 20 nt, Homo sapiens
caacauugcuuccuaaacuu

SEQ ID NO: 1230820 - RNA, 16 nt, Homo sapiens
caacauuucucacuga

SEQ ID NO: 1230821 - RNA, 19 nt, Homo sapiens
caacauuucucacugaaag

SEQ ID NO: 1230822 - RNA, 18 nt, Homo sapiens
caaccaagucaugugcau

SEQ ID NO: 1230823 - RNA, 15 nt, Homo sapiens
caaccaauuuacacu

SEQ ID NO: 1230824 - RNA, 18 nt, Homo sapiens
caaccaauuuacacugcc

SEQ ID NO: 1230825 - RNA, 13 nt, Homo sapiens
caacccaaaccau

SEQ ID NO: 1230826 - RNA, 12 nt, Homo sapiens
caaccccagugg

SEQ ID NO: 1230827 - RNA, 22 nt, Homo sapiens
caaccccuguacccagcuccuu

SEQ ID NO: 1230828 - RNA, 13 nt, Homo sapiens
caacccuaucucc

SEQ ID NO: 1230829 - RNA, 22 nt, Homo sapiens
caaccgcuucccuauuuauuua

SEQ ID NO: 1230830 - RNA, 18 nt, Homo sapiens
caaccggucacccaggag

SEQ ID NO: 1230831 - RNA, 13 nt, Homo sapiens
caaccucauccag

SEQ ID NO: 1230832 - RNA, 21 nt, Homo sapiens
caaccugcucuccucuugcca

SEQ ID NO: 1230833 - RNA, 16 nt, Homo sapiens
caaccuguuaccuacu

SEQ ID NO: 1230834 - RNA, 14 nt, Homo sapiens
caaccuuccauuca

SEQ ID NO: 1230835 - RNA, 14 nt, Homo sapiens
caacgcucccagac

SEQ ID NO: 1230836 - RNA, 22 nt, Homo sapiens
caacguagcuucuaccaugaac

SEQ ID NO: 1230837 - RNA, 14 nt, Homo sapiens
caacuacagaauuu

SEQ ID NO: 1230838 - RNA, 21 nt, Homo sapiens
caacuacagaauuucauucau

SEQ ID NO: 1230839 - RNA, 15 nt, Homo sapiens
caacuacugugauca

SEQ ID NO: 1230840 - RNA, 15 nt, Homo sapiens
caacuagauaucaug

SEQ ID NO: 1230841 - RNA, 13 nt, Homo sapiens
caacuaugauuau

SEQ ID NO: 1230842 - RNA, 16 nt, Homo sapiens
caacucuccaauguuc

SEQ ID NO: 1230843 - RNA, 18 nt, Homo sapiens
caacucuccaauguucua

SEQ ID NO: 1230844 - RNA, 18 nt, Homo sapiens
caacucugagaucuaagg

SEQ ID NO: 1230845 - RNA, 16 nt, Homo sapiens
caacucuucgaagccu

SEQ ID NO: 1230846 - RNA, 12 nt, Homo sapiens
caacucuugauu

SEQ ID NO: 1230847 - RNA, 22 nt, Homo sapiens
caacucuugugaauuauucuga

SEQ ID NO: 1230848 - RNA, 20 nt, Homo sapiens
caacugaaaagacucagugu

SEQ ID NO: 1230849 - RNA, 20 nt, Homo sapiens
caacugaagauccacaaaag

SEQ ID NO: 1230850 - RNA, 22 nt, Homo sapiens
caacugaagauccacaaaagaa

SEQ ID NO: 1230851 - RNA, 10 nt, Homo sapiens
caacugacca

SEQ ID NO: 1230852 - RNA, 15 nt, Homo sapiens
caacugaucucauuu

SEQ ID NO: 1230853 - RNA, 15 nt, Homo sapiens
caacugcaccaguga

SEQ ID NO: 1230854 - RNA, 21 nt, Homo sapiens
caacugcugcaugucccugug

SEQ ID NO: 1230855 - RNA, 23 nt, Homo sapiens
caacugcugcugugcacauuuau

SEQ ID NO: 1230856 - RNA, 15 nt, Homo sapiens
caacuguggacucca

SEQ ID NO: 1230857 - RNA, 16 nt, Homo sapiens
caacuguggacuccag

SEQ ID NO: 1230858 - RNA, 21 nt, Homo sapiens
caacuuaagcugggauaauca

SEQ ID NO: 1230859 - RNA, 16 nt, Homo sapiens
caacuuggcauuucua

SEQ ID NO: 1230860 - RNA, 16 nt, Homo sapiens
caacuuguauuuccaa

SEQ ID NO: 1230861 - RNA, 13 nt, Homo sapiens
caacuuucuguaa

SEQ ID NO: 1230862 - RNA, 19 nt, Homo sapiens
caacuuugaaacuggaaua

SEQ ID NO: 1230863 - RNA, 21 nt, Homo sapiens
caacuuuguggaugucuuccu

SEQ ID NO: 1230864 - RNA, 18 nt, Homo sapiens
caacuuuuaauuacuguu

SEQ ID NO: 1230865 - RNA, 11 nt, Homo sapiens
caacuuuucaa

SEQ ID NO: 1230866 - RNA, 22 nt, Homo sapiens
caacuuuucuaagaaaagcauu

SEQ ID NO: 1230867 - RNA, 15 nt, Homo sapiens
caagaaaacaacuuc

SEQ ID NO: 1230868 - RNA, 22 nt, Homo sapiens
caagaaaagggcugacauuuuc

SEQ ID NO: 1230869 - RNA, 14 nt, Homo sapiens
caagaaagcucacu

SEQ ID NO: 1230870 - RNA, 19 nt, Homo sapiens
caagaaauaaaaaucaacu

SEQ ID NO: 1230871 - RNA, 15 nt, Homo sapiens
caagaaaucagccau

SEQ ID NO: 1230872 - RNA, 15 nt, Homo sapiens
caagaacugaaacca

SEQ ID NO: 1230873 - RNA, 18 nt, Homo sapiens
caagaagaggaaagggag

SEQ ID NO: 1230874 - RNA, 20 nt, Homo sapiens
caagaaguagcagugucugu

SEQ ID NO: 1230875 - RNA, 15 nt, Homo sapiens
caagaagugccaguu

SEQ ID NO: 1230876 - RNA, 14 nt, Homo sapiens
caagaaucagucua

SEQ ID NO: 1230877 - RNA, 18 nt, Homo sapiens
caagaaucagucuaucca

SEQ ID NO: 1230878 - RNA, 21 nt, Homo sapiens
caagaaucagucuauccacag

SEQ ID NO: 1230879 - RNA, 20 nt, Homo sapiens
caagaauuagaagucuuuca

SEQ ID NO: 1230880 - RNA, 20 nt, Homo sapiens
caagacaagacuauaccuua

SEQ ID NO: 1230881 - RNA, 17 nt, Homo sapiens
caagacauagcauccaa

SEQ ID NO: 1230882 - RNA, 11 nt, Homo sapiens
caagaccaaag

SEQ ID NO: 1230883 - RNA, 18 nt, Homo sapiens
caagacccauaaccauua

SEQ ID NO: 1230884 - RNA, 19 nt, Homo sapiens
cauauccuuucaagacaga

SEQ ID NO: 1230885 - RNA, 20 nt, Homo sapiens
cauaucuccuuccccuacac

SEQ ID NO: 1230886 - RNA, 13 nt, Homo sapiens
cauaugaacauau

SEQ ID NO: 1230887 - RNA, 14 nt, Homo sapiens
cauaugcccucauc

SEQ ID NO: 1230888 - RNA, 20 nt, Homo sapiens
cauaugcccucaucauccca

SEQ ID NO: 1230889 - RNA, 22 nt, Homo sapiens
cauaugccuuggggaggacaaa

SEQ ID NO: 1230890 - RNA, 19 nt, Homo sapiens
cauauggacucugcacaug

SEQ ID NO: 1230891 - RNA, 17 nt, Homo sapiens
cauauguaccauguaca

SEQ ID NO: 1230892 - RNA, 19 nt, Homo sapiens
cauauguagaaacauuuag

SEQ ID NO: 1230893 - RNA, 16 nt, Homo sapiens
cauauguaucuauaca

SEQ ID NO: 1230894 - RNA, 13 nt, Homo sapiens
cauauuaaaacaa

SEQ ID NO: 1230895 - RNA, 17 nt, Homo sapiens
cauauuaacaugcuuau

SEQ ID NO: 1230896 - RNA, 12 nt, Homo sapiens
cauauuaucuca

SEQ ID NO: 1230897 - RNA, 15 nt, Homo sapiens
cauauugucuggaaa

SEQ ID NO: 1230898 - RNA, 18 nt, Homo sapiens
cauauuguugcauugcuu

SEQ ID NO: 1230899 - RNA, 23 nt, Homo sapiens
cauauuuuuauauuauguuaaag

SEQ ID NO: 1230900 - RNA, 12 nt, Homo sapiens
caucaacacagu

SEQ ID NO: 1230901 - RNA, 20 nt, Homo sapiens
caucaagaauggggaucaca

SEQ ID NO: 1230902 - RNA, 11 nt, Homo sapiens
caucacacaag

SEQ ID NO: 1230903 - RNA, 17 nt, Homo sapiens
caucacaggcugugcca

SEQ ID NO: 1230904 - RNA, 11 nt, Homo sapiens
caucaccgcug

SEQ ID NO: 1230905 - RNA, 16 nt, Homo sapiens
caucacguuagcuguc

SEQ ID NO: 1230906 - RNA, 12 nt, Homo sapiens
caucacuuugac

SEQ ID NO: 1230907 - RNA, 19 nt, Homo sapiens
caucagaccugucuuccaa

SEQ ID NO: 1230908 - RNA, 19 nt, Homo sapiens
caucagacugucaagaaga

SEQ ID NO: 1230909 - RNA, 14 nt, Homo sapiens
caucagagcagcua

SEQ ID NO: 1230910 - RNA, 19 nt, Homo sapiens
caucagcagagaacuggaa

SEQ ID NO: 1230911 - RNA, 13 nt, Homo sapiens
caucagccaguga

SEQ ID NO: 1230912 - RNA, 19 nt, Homo sapiens
caucagcuguuuuuaguua

SEQ ID NO: 1230913 - RNA, 18 nt, Homo sapiens
caucagggacaggaugac

SEQ ID NO: 1230914 - RNA, 16 nt, Homo sapiens
caucaguagcaucugu

SEQ ID NO: 1230915 - RNA, 11 nt, Homo sapiens
caucaguccau

SEQ ID NO: 1230916 - RNA, 13 nt, Homo sapiens
caucagugaaaga

SEQ ID NO: 1230917 - RNA, 20 nt, Homo sapiens
caucauaagcugauuugaua

SEQ ID NO: 1230918 - RNA, 21 nt, Homo sapiens
caucauaagcugauuugauac

SEQ ID NO: 1230919 - RNA, 16 nt, Homo sapiens
caucauaugccugacc

SEQ ID NO: 1230920 - RNA, 11 nt, Homo sapiens
caucaucccag

SEQ ID NO: 1230921 - RNA, 22 nt, Homo sapiens
caucauggaggucauacaugca

SEQ ID NO: 1230922 - RNA, 22 nt, Homo sapiens
caucaugggaguaaguucuuca

SEQ ID NO: 1230923 - RNA, 16 nt, Homo sapiens
caucaugggcuggaca

SEQ ID NO: 1230924 - RNA, 20 nt, Homo sapiens
caucauuacccuucccugca

SEQ ID NO: 1230925 - RNA, 15 nt, Homo sapiens
caucauuacugccau

SEQ ID NO: 1230926 - RNA, 15 nt, Homo sapiens
caucauuagaacaaa

SEQ ID NO: 1230927 - RNA, 19 nt, Homo sapiens
caucauuggaaaugaaacu

SEQ ID NO: 1230928 - RNA, 18 nt, Homo sapiens
caucauuuugacagcauc

SEQ ID NO: 1230929 - RNA, 20 nt, Homo sapiens
cauccaaaguucccuaugaa

SEQ ID NO: 1230930 - RNA, 18 nt, Homo sapiens
cauccaaaucuagccaga

SEQ ID NO: 1230931 - RNA, 18 nt, Homo sapiens
cauccaaggagaaacaga

SEQ ID NO: 1230932 - RNA, 21 nt, Homo sapiens
cauccaaggagaaacagagac

SEQ ID NO: 1230933 - RNA, 16 nt, Homo sapiens
cauccaaggcuguuac

SEQ ID NO: 1230934 - RNA, 19 nt, Homo sapiens
cauccaauuuaucaaggaa

SEQ ID NO: 1230935 - RNA, 16 nt, Homo sapiens
cauccacugugccaug

SEQ ID NO: 1230936 - RNA, 13 nt, Homo sapiens
cauccaggcugcc

SEQ ID NO: 1230937 - RNA, 14 nt, Homo sapiens
cauccaggcugccc

SEQ ID NO: 1230938 - RNA, 20 nt, Homo sapiens
cauccagguggagacccuga

SEQ ID NO: 1230939 - RNA, 17 nt, Homo sapiens
cauccagugacaaacca

SEQ ID NO: 1230940 - RNA, 17 nt, Homo sapiens
cauccaguucaugagaa

SEQ ID NO: 1230941 - RNA, 24 nt, Homo sapiens
cauccauguuccgagaagaacaga

SEQ ID NO: 1230942 - RNA, 17 nt, Homo sapiens
caucccaggacaccaca

SEQ ID NO: 1230943 - RNA, 14 nt, Homo sapiens
caucccagugcaca

SEQ ID NO: 1230944 - RNA, 15 nt, Homo sapiens
caucccugcagcuca

SEQ ID NO: 1230945 - RNA, 16 nt, Homo sapiens
caucccuuuuuuuaca

SEQ ID NO: 1230946 - RNA, 14 nt, Homo sapiens
cauccgacugcccc

SEQ ID NO: 1230947 - RNA, 19 nt, Homo sapiens
cauccgguuugccauguug

SEQ ID NO: 1230948 - RNA, 14 nt, Homo sapiens
cauccucacugugg

SEQ ID NO: 1230949 - RNA, 17 nt, Homo sapiens
cauccucaugcugcuca

SEQ ID NO: 1230950 - RNA, 17 nt, Homo sapiens
cauccuccacaauagca

SEQ ID NO: 1230951 - RNA, 16 nt, Homo sapiens
cauccugaacugcuuc

SEQ ID NO: 1230952 - RNA, 12 nt, Homo sapiens
cauccuugaugc

SEQ ID NO: 1230953 - RNA, 21 nt, Homo sapiens
cauccuugaugcaagugcaac

SEQ ID NO: 1230954 - RNA, 24 nt, Homo sapiens
cauccuuggaaauuggaagagcac

SEQ ID NO: 1230955 - RNA, 22 nt, Homo sapiens
cauccuugucugggucuaccag

SEQ ID NO: 1230956 - RNA, 15 nt, Homo sapiens
cauccuuuacguguu

SEQ ID NO: 1230957 - RNA, 21 nt, Homo sapiens
cauccuuuuuccuacuuguua

SEQ ID NO: 1230958 - RNA, 21 nt, Homo sapiens
caucgauauguauaucauucu

SEQ ID NO: 1230959 - RNA, 15 nt, Homo sapiens
caucgcgaugucgca

SEQ ID NO: 1230960 - RNA, 20 nt, Homo sapiens
caucuacccugcugaccucc

SEQ ID NO: 1230961 - RNA, 22 nt, Homo sapiens
caucuacuuuuuuuuuaauuaa

SEQ ID NO: 1230962 - RNA, 14 nt, Homo sapiens
caucuagcaauuuc

SEQ ID NO: 1230963 - RNA, 22 nt, Homo sapiens
caucuauaaagaagaacuugca

SEQ ID NO: 1230964 - RNA, 19 nt, Homo sapiens
caucuauuauaaaaccaug

SEQ ID NO: 1230965 - RNA, 13 nt, Homo sapiens
caucuauucaagc

SEQ ID NO: 1230966 - RNA, 21 nt, Homo sapiens
caucucaaaaauaaugcauaa

SEQ ID NO: 1230967 - RNA, 15 nt, Homo sapiens
caucucaauaacaaa

SEQ ID NO: 1230968 - RNA, 12 nt, Homo sapiens
caucucagccua

SEQ ID NO: 1230969 - RNA, 23 nt, Homo sapiens
caucucagcgccagcucuaccag

SEQ ID NO: 1230970 - RNA, 18 nt, Homo sapiens
caucucagucauccugca

SEQ ID NO: 1230971 - RNA, 20 nt, Homo sapiens
caucuccacucuugugguca

SEQ ID NO: 1230972 - RNA, 13 nt, Homo sapiens
caucuccagcuau

SEQ ID NO: 1230973 - RNA, 22 nt, Homo sapiens
caucuccagggagcaagacaga

SEQ ID NO: 1230974 - RNA, 19 nt, Homo sapiens
caucucggaguucagacuc

SEQ ID NO: 1230975 - RNA, 23 nt, Homo sapiens
caucugaaugaaaauaacugaac

SEQ ID NO: 1230976 - RNA, 20 nt, Homo sapiens
caucugacugccaagccaga

SEQ ID NO: 1230977 - RNA, 19 nt, Homo sapiens
caucugcaguacagucuua

SEQ ID NO: 1230978 - RNA, 23 nt, Homo sapiens
caucugggcaaaacccacagaag

SEQ ID NO: 1230979 - RNA, 14 nt, Homo sapiens
caucuguccagagg

SEQ ID NO: 1230980 - RNA, 13 nt, Homo sapiens
caucugugccaga

SEQ ID NO: 1230981 - RNA, 16 nt, Homo sapiens
caucugugccagagau

SEQ ID NO: 1230982 - RNA, 15 nt, Homo sapiens
caucuuagaccucca

SEQ ID NO: 1230983 - RNA, 19 nt, Homo sapiens
caucuuauagcacuuugaa

SEQ ID NO: 1230984 - RNA, 21 nt, Homo sapiens
caucuuccaacccacuggccc

SEQ ID NO: 1230985 - RNA, 15 nt, Homo sapiens
caucuuccacagaga

SEQ ID NO: 1230986 - RNA, 14 nt, Homo sapiens
caucuuccauugcc

SEQ ID NO: 1230987 - RNA, 14 nt, Homo sapiens
caucuugaguauuu

SEQ ID NO: 1230988 - RNA, 21 nt, Homo sapiens
caucuugcuaugagguuugcu

SEQ ID NO: 1230989 - RNA, 22 nt, Homo sapiens
caucuugcucugcugacagaca

SEQ ID NO: 1230990 - RNA, 22 nt, Homo sapiens
caucuuuacaaaacuacaugag

SEQ ID NO: 1230991 - RNA, 22 nt, Homo sapiens
caucuuuggggagguguucacu

SEQ ID NO: 1230992 - RNA, 21 nt, Homo sapiens
caugaaaaaauacaggugucu

SEQ ID NO: 1230993 - RNA, 18 nt, Homo sapiens
caugaaaaacaggugaca

SEQ ID NO: 1230994 - RNA, 19 nt, Homo sapiens
caugaaaaugaaccauuca

SEQ ID NO: 1230995 - RNA, 14 nt, Homo sapiens
caugaaacugucca

SEQ ID NO: 1230996 - RNA, 19 nt, Homo sapiens
caugaaaguggacaaggag

SEQ ID NO: 1230997 - RNA, 14 nt, Homo sapiens
caugaaauaugcau

SEQ ID NO: 1230998 - RNA, 16 nt, Homo sapiens
cauuauccaucuuuca

SEQ ID NO: 1230999 - RNA, 19 nt, Homo sapiens
cauuauccaucuuucacua

SEQ ID NO: 1231000 - RNA, 17 nt, Homo sapiens
cauuaucugaguugcau

SEQ ID NO: 1231001 - RNA, 13 nt, Homo sapiens
cauuaucuugcag

SEQ ID NO: 1231002 - RNA, 16 nt, Homo sapiens
cauuaugagaggcaau

SEQ ID NO: 1231003 - RNA, 15 nt, Homo sapiens
cauuauggaaucaug

SEQ ID NO: 1231004 - RNA, 12 nt, Homo sapiens
cauuauguauga

SEQ ID NO: 1231005 - RNA, 22 nt, Homo sapiens
cauuauuuuuguuagcaaagau

SEQ ID NO: 1231006 - RNA, 15 nt, Homo sapiens
cauucacaccagcua

SEQ ID NO: 1231007 - RNA, 17 nt, Homo sapiens
cauucacuacaggugaa

SEQ ID NO: 1231008 - RNA, 19 nt, Homo sapiens
cauucaggcaacgcacaaa

SEQ ID NO: 1231009 - RNA, 19 nt, Homo sapiens
cauucaguuaaaaauccag

SEQ ID NO: 1231010 - RNA, 19 nt, Homo sapiens
cauucaugugggcauuucu

SEQ ID NO: 1231011 - RNA, 22 nt, Homo sapiens
cauucauuuggauaaguuguga

SEQ ID NO: 1231012 - RNA, 14 nt, Homo sapiens
cauuccaccuuccc

SEQ ID NO: 1231013 - RNA, 18 nt, Homo sapiens
cauuccagacugcuucca

SEQ ID NO: 1231014 - RNA, 21 nt, Homo sapiens
cauuuuuaguagagacagggu

SEQ ID NO: 1231015 - RNA, 16 nt, Homo sapiens
cauuuuucacuguaca

SEQ ID NO: 1231016 - RNA, 14 nt, Homo sapiens
cauuuuugcaaauc

SEQ ID NO: 1231017 - RNA, 23 nt, Homo sapiens
cauuuuuuucacuggaguuacau

SEQ ID NO: 1231018 - RNA, 13 nt, Homo sapiens
ccaaaagcacuua

SEQ ID NO: 1231019 - RNA, 22 nt, Homo sapiens
ccaaaagggccauguuucaaga

SEQ ID NO: 1231020 - RNA, 19 nt, Homo sapiens
ccaaaauauuuuuugcaag

SEQ ID NO: 1231021 - RNA, 21 nt, Homo sapiens
ccaaaauuaguuuguguuacu

SEQ ID NO: 1231022 - RNA, 17 nt, Homo sapiens
ccaaaccuccacugcug

SEQ ID NO: 1231023 - RNA, 15 nt, Homo sapiens
ccaaacuuguucauu

SEQ ID NO: 1231024 - RNA, 19 nt, Homo sapiens
ccaaagaaaauuauaguuu

SEQ ID NO: 1231025 - RNA, 21 nt, Homo sapiens
ccaaagaaaauuauaguuuaa

SEQ ID NO: 1231026 - RNA, 18 nt, Homo sapiens
ccaaagaaacauugccuu

SEQ ID NO: 1231027 - RNA, 15 nt, Homo sapiens
ccaaagcagaaaaga

SEQ ID NO: 1231028 - RNA, 17 nt, Homo sapiens
ccaaaggaaaaagcaca

SEQ ID NO: 1231029 - RNA, 10 nt, Homo sapiens
ccaaagggac

SEQ ID NO: 1231030 - RNA, 18 nt, Homo sapiens
ccaaagggucccaggcug

SEQ ID NO: 1231031 - RNA, 20 nt, Homo sapiens
ccaaagugaccuacccagag

SEQ ID NO: 1231032 - RNA, 13 nt, Homo sapiens
ccaaagugcugcg

SEQ ID NO: 1231033 - RNA, 21 nt, Homo sapiens
cccaggcccugcucuuccuca

SEQ ID NO: 1231034 - RNA, 18 nt, Homo sapiens
cccaggcuggagugcagu

SEQ ID NO: 1231035 - RNA, 15 nt, Homo sapiens
cccaggcugggaacu

SEQ ID NO: 1231036 - RNA, 17 nt, Homo sapiens
cccaggcugggaacuca

SEQ ID NO: 1231037 - RNA, 22 nt, Homo sapiens
cccaggcuucacccugaauggu

SEQ ID NO: 1231038 - RNA, 17 nt, Homo sapiens
cccagggcacuacauaa

SEQ ID NO: 1231039 - RNA, 15 nt, Homo sapiens
cccagggcagggugg

SEQ ID NO: 1231040 - RNA, 12 nt, Homo sapiens
cccagggggaga

SEQ ID NO: 1231041 - RNA, 15 nt, Homo sapiens
cccagguaccacccu

SEQ ID NO: 1231042 - RNA, 18 nt, Homo sapiens
cccaggucagcuguuacu

SEQ ID NO: 1231043 - RNA, 14 nt, Homo sapiens
cccaggucuuccag

SEQ ID NO: 1231044 - RNA, 13 nt, Homo sapiens
cccaguccaugcu

SEQ ID NO: 1231045 - RNA, 11 nt, Homo sapiens
cccagucccau

SEQ ID NO: 1231046 - RNA, 22 nt, Homo sapiens
cccaguccccagcccuucacau

SEQ ID NO: 1231047 - RNA, 15 nt, Homo sapiens
cccaguccuccagac

SEQ ID NO: 1231048 - RNA, 19 nt, Homo sapiens
cccagucuggaaugcagug

SEQ ID NO: 1231049 - RNA, 12 nt, Homo sapiens
cccagucuuccu

SEQ ID NO: 1231050 - RNA, 17 nt, Homo sapiens
cccagugacaacaucgc

SEQ ID NO: 1231051 - RNA, 15 nt, Homo sapiens
cccagugcugcugua

SEQ ID NO: 1231052 - RNA, 18 nt, Homo sapiens
cccagugcugcuguaaau

SEQ ID NO: 1231053 - RNA, 19 nt, Homo sapiens
cccaguguaugucuuguau

SEQ ID NO: 1231054 - RNA, 13 nt, Homo sapiens
cccaguguucucc

SEQ ID NO: 1231055 - RNA, 12 nt, Homo sapiens
cccaguucugcu

SEQ ID NO: 1231056 - RNA, 18 nt, Homo sapiens
cccauaauugcuuugcca

SEQ ID NO: 1231057 - RNA, 17 nt, Homo sapiens
cccauagaaacaugaca

SEQ ID NO: 1231058 - RNA, 21 nt, Homo sapiens
cccauagaaacaugacacuga

SEQ ID NO: 1231059 - RNA, 23 nt, Homo sapiens
cccauagaaacaugacacugacc

SEQ ID NO: 1231060 - RNA, 16 nt, Homo sapiens
cccauagcccuuaccu

SEQ ID NO: 1231061 - RNA, 14 nt, Homo sapiens
cccauagcuuccau

SEQ ID NO: 1231062 - RNA, 17 nt, Homo sapiens
cccauaucugugaaaug

SEQ ID NO: 1231063 - RNA, 15 nt, Homo sapiens
cccauaucuugccuu

SEQ ID NO: 1231064 - RNA, 16 nt, Homo sapiens
cccaucauguggccca

SEQ ID NO: 1231065 - RNA, 23 nt, Homo sapiens
cccauccauuaggccagcaacgc

SEQ ID NO: 1231066 - RNA, 24 nt, Homo sapiens
cccauccccuuccuaaauauccaa

SEQ ID NO: 1231067 - RNA, 18 nt, Homo sapiens
cccaucccugccugguca

SEQ ID NO: 1231068 - RNA, 13 nt, Homo sapiens
cccaucugggagu

SEQ ID NO: 1231069 - RNA, 16 nt, Homo sapiens
cccaucuuuacaaaga

SEQ ID NO: 1231070 - RNA, 19 nt, Homo sapiens
cccaugcaggcccuuugaa

SEQ ID NO: 1231071 - RNA, 15 nt, Homo sapiens
cccauggacacucca

SEQ ID NO: 1231072 - RNA, 23 nt, Homo sapiens
cccauguauuuaucucuauuuaa

SEQ ID NO: 1231073 - RNA, 18 nt, Homo sapiens
cccauguuggccaggcug

SEQ ID NO: 1231074 - RNA, 14 nt, Homo sapiens
cccauuacuuugau

SEQ ID NO: 1231075 - RNA, 19 nt, Homo sapiens
cccauucuacacagagcag

SEQ ID NO: 1231076 - RNA, 16 nt, Homo sapiens
cccauucuucacucuu

SEQ ID NO: 1231077 - RNA, 18 nt, Homo sapiens
cccauuuccuguacaauc

SEQ ID NO: 1231078 - RNA, 9 nt, Homo sapiens
cccauuucu

SEQ ID NO: 1231079 - RNA, 21 nt, Homo sapiens
cccauuucuauacaacaggca

SEQ ID NO: 1231080 - RNA, 15 nt, Homo sapiens
cccauuucuauuuau

SEQ ID NO: 1231081 - RNA, 14 nt, Homo sapiens
cccauuugccuugc

SEQ ID NO: 1231082 - RNA, 16 nt, Homo sapiens
ccccaaagcaauguga

SEQ ID NO: 1231083 - RNA, 21 nt, Homo sapiens
ccccaacagcgacauagccca

SEQ ID NO: 1231084 - RNA, 17 nt, Homo sapiens
ccccaacaugcacugau

SEQ ID NO: 1231085 - RNA, 15 nt, Homo sapiens
ccccaaccaggcuaa

SEQ ID NO: 1231086 - RNA, 21 nt, Homo sapiens
ccccaauuacagggugacuca

SEQ ID NO: 1231087 - RNA, 22 nt, Homo sapiens
ccccaauuacagggugacucac

SEQ ID NO: 1231088 - RNA, 14 nt, Homo sapiens
ccccacaacuuuaa

SEQ ID NO: 1231089 - RNA, 23 nt, Homo sapiens
ccccacaauuccauuacuaagaa

SEQ ID NO: 1231090 - RNA, 13 nt, Homo sapiens
ccccacacagcua

SEQ ID NO: 1231091 - RNA, 16 nt, Homo sapiens
ccccaccaccacuuac

SEQ ID NO: 1231092 - RNA, 19 nt, Homo sapiens
ccccaccauccagguggag

SEQ ID NO: 1231093 - RNA, 21 nt, Homo sapiens
ccccaccugggacccuugaga

SEQ ID NO: 1231094 - RNA, 18 nt, Homo sapiens
ccccacuaggcacugugg

SEQ ID NO: 1231095 - RNA, 11 nt, Homo sapiens
ccccacugaca

SEQ ID NO: 1231096 - RNA, 21 nt, Homo sapiens
ccccacugccugucccagaga

SEQ ID NO: 1231097 - RNA, 11 nt, Homo sapiens
ccccagcacuu

SEQ ID NO: 1231098 - RNA, 17 nt, Homo sapiens
ccccagcccuaaucuca

SEQ ID NO: 1231099 - RNA, 22 nt, Homo sapiens
ccccagccugcucccuagccag

SEQ ID NO: 1231100 - RNA, 22 nt, Homo sapiens
ccccagcucuggcuuccagaaa

SEQ ID NO: 1231101 - RNA, 23 nt, Homo sapiens
ccccaggcccaccaucaccaccg

SEQ ID NO: 1231102 - RNA, 14 nt, Homo sapiens
ccccaggcccuuca

SEQ ID NO: 1231103 - RNA, 16 nt, Homo sapiens
ccccagggacugcaag

SEQ ID NO: 1231104 - RNA, 23 nt, Homo sapiens
ccccagggacugcaaguggccau

SEQ ID NO: 1231105 - RNA, 12 nt, Homo sapiens
ccccagucccag

SEQ ID NO: 1231106 - RNA, 15 nt, Homo sapiens
ccccagugcccacag

SEQ ID NO: 1231107 - RNA, 16 nt, Homo sapiens
ccccaguggauucuca

SEQ ID NO: 1231108 - RNA, 15 nt, Homo sapiens
ccccaguucugcucc

SEQ ID NO: 1231109 - RNA, 17 nt, Homo sapiens
ccccauccccaccagcu

SEQ ID NO: 1231110 - RNA, 11 nt, Homo sapiens
cccccaaaauu

SEQ ID NO: 1231111 - RNA, 15 nt, Homo sapiens
cccccaagccugggc

SEQ ID NO: 1231112 - RNA, 17 nt, Homo sapiens
cccccaaugucuucaag

SEQ ID NO: 1231113 - RNA, 22 nt, Homo sapiens
cccccaguccuguccuaucacu

SEQ ID NO: 1231114 - RNA, 17 nt, Homo sapiens
ccccccaacacugugcc

SEQ ID NO: 1231115 - RNA, 19 nt, Homo sapiens
cccccguguggacacagau

SEQ ID NO: 1231116 - RNA, 13 nt, Homo sapiens
cccccucccugga

SEQ ID NO: 1231117 - RNA, 14 nt, Homo sapiens
cccccuccugcaag

SEQ ID NO: 1231118 - RNA, 19 nt, Homo sapiens
cccccuguagacuagugcc

SEQ ID NO: 1231119 - RNA, 21 nt, Homo sapiens
ccccguuccugacaucacagc

SEQ ID NO: 1231120 - RNA, 16 nt, Homo sapiens
ccccucaaagucugca

SEQ ID NO: 1231121 - RNA, 18 nt, Homo sapiens
ccccucacucuguuuccu

SEQ ID NO: 1231122 - RNA, 17 nt, Homo sapiens
ccccuccacuggggaau

SEQ ID NO: 1231123 - RNA, 15 nt, Homo sapiens
ccccuccacugucac

SEQ ID NO: 1231124 - RNA, 15 nt, Homo sapiens
ccccuccaggaauga

SEQ ID NO: 1231125 - RNA, 16 nt, Homo sapiens
ccccuccccugcugca

SEQ ID NO: 1231126 - RNA, 17 nt, Homo sapiens
ccccuccucacuggcca

SEQ ID NO: 1231127 - RNA, 14 nt, Homo sapiens
ccccuccuggcaau

SEQ ID NO: 1231128 - RNA, 16 nt, Homo sapiens
ccccuccuugggcacu

SEQ ID NO: 1231129 - RNA, 19 nt, Homo sapiens
ccccucggccccagcacau

SEQ ID NO: 1231130 - RNA, 17 nt, Homo sapiens
ccccucugucuugugaa

SEQ ID NO: 1231131 - RNA, 15 nt, Homo sapiens
ccccugauguuugaa

SEQ ID NO: 1231132 - RNA, 17 nt, Homo sapiens
ccccugcgggcgcgggc

SEQ ID NO: 1231133 - RNA, 20 nt, Homo sapiens
ccccugcggucaggcugggc

SEQ ID NO: 1231134 - RNA, 17 nt, Homo sapiens
ccccuggacugggaggu

SEQ ID NO: 1231135 - RNA, 15 nt, Homo sapiens
ccccuggccacagua

SEQ ID NO: 1231136 - RNA, 12 nt, Homo sapiens
ccccuggccuca

SEQ ID NO: 1231137 - RNA, 17 nt, Homo sapiens
ccccuggcugugcucua

SEQ ID NO: 1231138 - RNA, 14 nt, Homo sapiens
ccccuggcuuuuca

SEQ ID NO: 1231139 - RNA, 18 nt, Homo sapiens
ccccugguaaaccaagcc

SEQ ID NO: 1231140 - RNA, 16 nt, Homo sapiens
ccccuguagcagucac

SEQ ID NO: 1231141 - RNA, 22 nt, Homo sapiens
ccccuuaaggguugaaggcagu

SEQ ID NO: 1231142 - RNA, 23 nt, Homo sapiens
ccccuucccuguccuugcccuuu

SEQ ID NO: 1231143 - RNA, 15 nt, Homo sapiens
ccccuuccuagugaa

SEQ ID NO: 1231144 - RNA, 15 nt, Homo sapiens
ccccuucggcagcua

SEQ ID NO: 1231145 - RNA, 14 nt, Homo sapiens
ccccuuggcuguga

SEQ ID NO: 1231146 - RNA, 12 nt, Homo sapiens
ccccuuugcccu

SEQ ID NO: 1231147 - RNA, 16 nt, Homo sapiens
cccgacuccucaaaag

SEQ ID NO: 1231148 - RNA, 15 nt, Homo sapiens
cccgcaucaagguca

SEQ ID NO: 1231149 - RNA, 20 nt, Homo sapiens
cccgccagagggcuugugaa

SEQ ID NO: 1231150 - RNA, 15 nt, Homo sapiens
cccgcggugcucugg

SEQ ID NO: 1231151 - RNA, 20 nt, Homo sapiens
cccgcuuuuccuuucugcca

SEQ ID NO: 1231152 - RNA, 22 nt, Homo sapiens
cccggccagcgggcacagggca

SEQ ID NO: 1231153 - RNA, 19 nt, Homo sapiens
cccgggacccacggagccc

SEQ ID NO: 1231154 - RNA, 19 nt, Homo sapiens
cccgggcugccugggcugu

SEQ ID NO: 1231155 - RNA, 17 nt, Homo sapiens
cccggggccagcacuuc

SEQ ID NO: 1231156 - RNA, 19 nt, Homo sapiens
cccggguggggcugcagaa

SEQ ID NO: 1231157 - RNA, 20 nt, Homo sapiens
cccgucauguuccucaaaag

SEQ ID NO: 1231158 - RNA, 22 nt, Homo sapiens
cccgucauguuccucaaaagca

SEQ ID NO: 1231159 - RNA, 19 nt, Homo sapiens
cccgugagcgccugugcac

SEQ ID NO: 1231160 - RNA, 13 nt, Homo sapiens
cccgugccaaaaa

SEQ ID NO: 1231161 - RNA, 12 nt, Homo sapiens
ccguggagccuu

SEQ ID NO: 1231162 - RNA, 20 nt, Homo sapiens
ccgugugagugugacagggc

SEQ ID NO: 1231163 - RNA, 15 nt, Homo sapiens
ccguuaaaaaaucaa

SEQ ID NO: 1231164 - RNA, 20 nt, Homo sapiens
ccguuauuauaauuguauca

SEQ ID NO: 1231165 - RNA, 15 nt, Homo sapiens
ccguuccugacauca

SEQ ID NO: 1231166 - RNA, 21 nt, Homo sapiens
ccguugaggcgguuuccugaa

SEQ ID NO: 1231167 - RNA, 17 nt, Homo sapiens
ccguuuaccuagaagaa

SEQ ID NO: 1231168 - RNA, 23 nt, Homo sapiens
ccguuucauuuagucaugugacc

SEQ ID NO: 1231169 - RNA, 14 nt, Homo sapiens
ccguuuccauacag

SEQ ID NO: 1231170 - RNA, 15 nt, Homo sapiens
ccuaaaaaguuccau

SEQ ID NO: 1231171 - RNA, 20 nt, Homo sapiens
ccuaaaacaccugguaggag

SEQ ID NO: 1231172 - RNA, 15 nt, Homo sapiens
ccuaaaagcacuccu

SEQ ID NO: 1231173 - RNA, 14 nt, Homo sapiens
ccuaaaaguauuau

SEQ ID NO: 1231174 - RNA, 19 nt, Homo sapiens
ccuaaaagugggcuugauu

SEQ ID NO: 1231175 - RNA, 13 nt, Homo sapiens
ccuaaaaucacag

SEQ ID NO: 1231176 - RNA, 11 nt, Homo sapiens
ccuaacacagu

SEQ ID NO: 1231177 - RNA, 23 nt, Homo sapiens
ccuaaccucuuuucugcaucauc

SEQ ID NO: 1231178 - RNA, 13 nt, Homo sapiens
ccuaagcacuuua

SEQ ID NO: 1231179 - RNA, 14 nt, Homo sapiens
ccuaagcacuuuau

SEQ ID NO: 1231180 - RNA, 15 nt, Homo sapiens
ccuaaggaucucuca

SEQ ID NO: 1231181 - RNA, 19 nt, Homo sapiens
ccuaaggcacccacaaaua

SEQ ID NO: 1231182 - RNA, 16 nt, Homo sapiens
ccuaaggucacagcua

SEQ ID NO: 1231183 - RNA, 13 nt, Homo sapiens
ccuaaguacugua

SEQ ID NO: 1231184 - RNA, 15 nt, Homo sapiens
ccuaauaacgugaaa

SEQ ID NO: 1231185 - RNA, 16 nt, Homo sapiens
ccuaauaacgugaaac

SEQ ID NO: 1231186 - RNA, 16 nt, Homo sapiens
ccuaauuuaugugcua

SEQ ID NO: 1231187 - RNA, 22 nt, Homo sapiens
ccuacaaccaucccugccacau

SEQ ID NO: 1231188 - RNA, 14 nt, Homo sapiens
ccuacacugaugca

SEQ ID NO: 1231189 - RNA, 12 nt, Homo sapiens
ccuacagagcag

SEQ ID NO: 1231190 - RNA, 20 nt, Homo sapiens
ccuacagagcagccaggugg

SEQ ID NO: 1231191 - RNA, 12 nt, Homo sapiens
ccuacagccagc

SEQ ID NO: 1231192 - RNA, 15 nt, Homo sapiens
ccuacagggccacaa

SEQ ID NO: 1231193 - RNA, 16 nt, Homo sapiens
ccuacaugacacaguu

SEQ ID NO: 1231194 - RNA, 13 nt, Homo sapiens
ccuacauuaucuc

SEQ ID NO: 1231195 - RNA, 14 nt, Homo sapiens
ccuacauuaucuca

SEQ ID NO: 1231196 - RNA, 20 nt, Homo sapiens
ccuacauuaucucacuuagu

SEQ ID NO: 1231197 - RNA, 23 nt, Homo sapiens
ccuacauugugcugcaccugguc

SEQ ID NO: 1231198 - RNA, 14 nt, Homo sapiens
ccuaccacaguguc

SEQ ID NO: 1231199 - RNA, 14 nt, Homo sapiens
ccuaccagcagcug

SEQ ID NO: 1231200 - RNA, 21 nt, Homo sapiens
ccuaccucacagagugcauug

SEQ ID NO: 1231201 - RNA, 15 nt, Homo sapiens
ccuaccuucauuuca

SEQ ID NO: 1231202 - RNA, 11 nt, Homo sapiens
ccuaccuuuau

SEQ ID NO: 1231203 - RNA, 15 nt, Homo sapiens
ccuacguauccugca

SEQ ID NO: 1231204 - RNA, 16 nt, Homo sapiens
ccuacucuucaggguc

SEQ ID NO: 1231205 - RNA, 19 nt, Homo sapiens
ccuacugagcauuugcacc

SEQ ID NO: 1231206 - RNA, 16 nt, Homo sapiens
ccuacuucuuuugcuc

SEQ ID NO: 1231207 - RNA, 22 nt, Homo sapiens
ccuacuuucuccugaaacccaa

SEQ ID NO: 1231208 - RNA, 19 nt, Homo sapiens
ccuacuuuucuuuccucag

SEQ ID NO: 1231209 - RNA, 20 nt, Homo sapiens
ccuacuuuucuuuccucaga

SEQ ID NO: 1231210 - RNA, 16 nt, Homo sapiens
ccuagaacugugccua

SEQ ID NO: 1231211 - RNA, 23 nt, Homo sapiens
ccuagaacuuuguuaacgcacuu

SEQ ID NO: 1231212 - RNA, 15 nt, Homo sapiens
ccuagagcuccaguu

SEQ ID NO: 1231213 - RNA, 16 nt, Homo sapiens
ccuagauagcuauuaa

SEQ ID NO: 1231214 - RNA, 20 nt, Homo sapiens
ccuagauguuuaacaaaucu

SEQ ID NO: 1231215 - RNA, 23 nt, Homo sapiens
ccuagcaaggcaugauguuaacc

SEQ ID NO: 1231216 - RNA, 20 nt, Homo sapiens
ccuagcagaggaaaguguaa

SEQ ID NO: 1231217 - RNA, 17 nt, Homo sapiens
ccuagcagccucaaaac

SEQ ID NO: 1231218 - RNA, 15 nt, Homo sapiens
ccuagcauugcacuu

SEQ ID NO: 1231219 - RNA, 13 nt, Homo sapiens
ccuagcauuucaa

SEQ ID NO: 1231220 - RNA, 18 nt, Homo sapiens
ccuagccaaugucuccuc

SEQ ID NO: 1231221 - RNA, 19 nt, Homo sapiens
ccuagccagcacuuguaua

SEQ ID NO: 1231222 - RNA, 17 nt, Homo sapiens
ccuagccugcauaucau

SEQ ID NO: 1231223 - RNA, 21 nt, Homo sapiens
ccuagccuuagaagucacaca

SEQ ID NO: 1231224 - RNA, 17 nt, Homo sapiens
ccuagcucuuacacaua

SEQ ID NO: 1231225 - RNA, 21 nt, Homo sapiens
ccuagcugcccacagagggca

SEQ ID NO: 1231226 - RNA, 15 nt, Homo sapiens
ccuaggaacucaguc

SEQ ID NO: 1231227 - RNA, 20 nt, Homo sapiens
ccuaggauuucaugauuuca

SEQ ID NO: 1231228 - RNA, 18 nt, Homo sapiens
ccuaggccaaaugcacaa

SEQ ID NO: 1231229 - RNA, 23 nt, Homo sapiens
ccuagggaauggucccagcacga

SEQ ID NO: 1231230 - RNA, 19 nt, Homo sapiens
ccuaggggaacagaccagu

SEQ ID NO: 1231231 - RNA, 17 nt, Homo sapiens
ccuaguggaugacuguu

SEQ ID NO: 1231232 - RNA, 21 nt, Homo sapiens
ccuaguuaguguuuugccuca

SEQ ID NO: 1231233 - RNA, 18 nt, Homo sapiens
ccuaguucccucugcuca

SEQ ID NO: 1231234 - RNA, 12 nt, Homo sapiens
ccuauaagcuua

SEQ ID NO: 1231235 - RNA, 18 nt, Homo sapiens
ccuauaaggagaguucaa

SEQ ID NO: 1231236 - RNA, 15 nt, Homo sapiens
ccuauacauccacag

SEQ ID NO: 1231237 - RNA, 20 nt, Homo sapiens
ccuauagucccagcuacuca

SEQ ID NO: 1231238 - RNA, 16 nt, Homo sapiens
ccuauauuguuuucag

SEQ ID NO: 1231239 - RNA, 23 nt, Homo sapiens
ccuaucagaaguuucucagcucc

SEQ ID NO: 1231240 - RNA, 18 nt, Homo sapiens
ccuaucaguuauuaauuu

SEQ ID NO: 1231241 - RNA, 22 nt, Homo sapiens
ccuaugauggauggcagacucu

SEQ ID NO: 1231242 - RNA, 14 nt, Homo sapiens
ccuaugcacauaug

SEQ ID NO: 1231243 - RNA, 16 nt, Homo sapiens
ccuaugcacauaugga

SEQ ID NO: 1231244 - RNA, 20 nt, Homo sapiens
ccuauguagcucugcaucuc

SEQ ID NO: 1231245 - RNA, 15 nt, Homo sapiens
ccuauguccuaagga

SEQ ID NO: 1231246 - RNA, 17 nt, Homo sapiens
ccuauguugugguccau

SEQ ID NO: 1231247 - RNA, 19 nt, Homo sapiens
ccuauuuaucugaucaaga

SEQ ID NO: 1231248 - RNA, 22 nt, Homo sapiens
ccuauuuccugaacucagcuga

SEQ ID NO: 1231249 - RNA, 15 nt, Homo sapiens
ccuauuuguuuucau

SEQ ID NO: 1231250 - RNA, 18 nt, Homo sapiens
ccuauuuucauuuguaca

SEQ ID NO: 1231251 - RNA, 22 nt, Homo sapiens
ccucaaaacgggucaguauuaa

SEQ ID NO: 1231252 - RNA, 16 nt, Homo sapiens
ccucaaagaggccuua

SEQ ID NO: 1231253 - RNA, 22 nt, Homo sapiens
ccucaaaguuggggcaggcugg

SEQ ID NO: 1231254 - RNA, 16 nt, Homo sapiens
ccucaacagccaagug

SEQ ID NO: 1231255 - RNA, 19 nt, Homo sapiens
ccucaagaaguaauaauuu

SEQ ID NO: 1231256 - RNA, 20 nt, Homo sapiens
ccucaagccccauuuccuca

SEQ ID NO: 1231257 - RNA, 12 nt, Homo sapiens
ccucacagccag

SEQ ID NO: 1231258 - RNA, 18 nt, Homo sapiens
ccucacccaucaaaagca

SEQ ID NO: 1231259 - RNA, 22 nt, Homo sapiens
ccucaccucccgaagccaccau

SEQ ID NO: 1231260 - RNA, 15 nt, Homo sapiens
ccucaccuucaaaaa

SEQ ID NO: 1231261 - RNA, 11 nt, Homo sapiens
ccucacugaga

SEQ ID NO: 1231262 - RNA, 14 nt, Homo sapiens
ccucacuguggaau

SEQ ID NO: 1231263 - RNA, 20 nt, Homo sapiens
ccucagaaaagugacagugg

SEQ ID NO: 1231264 - RNA, 19 nt, Homo sapiens
ccucagacuucaagaccau

SEQ ID NO: 1231265 - RNA, 20 nt, Homo sapiens
ccucagacuucaagaccauc

SEQ ID NO: 1231266 - RNA, 11 nt, Homo sapiens
ccucagaugau

SEQ ID NO: 1231267 - RNA, 22 nt, Homo sapiens
ccucagccucccaaagugcugg

SEQ ID NO: 1231268 - RNA, 18 nt, Homo sapiens
ccucagcucucugggacc

SEQ ID NO: 1231269 - RNA, 18 nt, Homo sapiens
ccucagcuucuucacagg

SEQ ID NO: 1231270 - RNA, 21 nt, Homo sapiens
ccucagucuggugcuccaguu

SEQ ID NO: 1231271 - RNA, 14 nt, Homo sapiens
ccucagugacauca

SEQ ID NO: 1231272 - RNA, 12 nt, Homo sapiens
ccucagugcauu

SEQ ID NO: 1231273 - RNA, 13 nt, Homo sapiens
ccucagugccuuc

SEQ ID NO: 1231274 - RNA, 20 nt, Homo sapiens
ccucaguucccucuugcuca

SEQ ID NO: 1231275 - RNA, 17 nt, Homo sapiens
ccucaguuuuaucauuu

SEQ ID NO: 1231276 - RNA, 14 nt, Homo sapiens
ccucauacacagaa

SEQ ID NO: 1231277 - RNA, 18 nt, Homo sapiens
ccucaucaacacagugaa

SEQ ID NO: 1231278 - RNA, 14 nt, Homo sapiens
ccucauccaaaguu

SEQ ID NO: 1231279 - RNA, 19 nt, Homo sapiens
ccucaugaaaacacacaua

SEQ ID NO: 1231280 - RNA, 16 nt, Homo sapiens
ccucaugauauguccu

SEQ ID NO: 1231281 - RNA, 18 nt, Homo sapiens
ccucaugauauguccuca

SEQ ID NO: 1231282 - RNA, 18 nt, Homo sapiens
ccucauggcucuggcaca

SEQ ID NO: 1231283 - RNA, 13 nt, Homo sapiens
ccucauuccugaa

SEQ ID NO: 1231284 - RNA, 16 nt, Homo sapiens
ccuccaaaagcacuua

SEQ ID NO: 1231285 - RNA, 14 nt, Homo sapiens
ccuccaacacaagg

SEQ ID NO: 1231286 - RNA, 22 nt, Homo sapiens
ccuccaacgccccuguggccaa

SEQ ID NO: 1231287 - RNA, 22 nt, Homo sapiens
ccuccaaggaggggcuguaaaa

SEQ ID NO: 1231288 - RNA, 20 nt, Homo sapiens
ccuccaagucuguaccucaa

SEQ ID NO: 1231289 - RNA, 16 nt, Homo sapiens
cagugcugcuguaaau

SEQ ID NO: 1231290 - RNA, 14 nt, Homo sapiens
cagugcuggauuug

SEQ ID NO: 1231291 - RNA, 17 nt, Homo sapiens
cagugcuucagccugag

SEQ ID NO: 1231292 - RNA, 14 nt, Homo sapiens
caguggagcccacg

SEQ ID NO: 1231293 - RNA, 22 nt, Homo sapiens
caguggaugccacagcccagcu

SEQ ID NO: 1231294 - RNA, 21 nt, Homo sapiens
auaccccuuacuuagcaugca

SEQ ID NO: 1231295 - RNA, 15 nt, Homo sapiens
auaccucaguuugca

SEQ ID NO: 1231296 - RNA, 13 nt, Homo sapiens
auaccugcacugu

SEQ ID NO: 1231297 - RNA, 14 nt, Homo sapiens
auaccugcacuguc

SEQ ID NO: 1231298 - RNA, 12 nt, Homo sapiens
auaccuuaucca

SEQ ID NO: 1231299 - RNA, 19 nt, Homo sapiens
auaccuuccccacaucuga

SEQ ID NO: 1231300 - RNA, 19 nt, Homo sapiens
auacgaaacacaaaccaca

SEQ ID NO: 1231301 - RNA, 21 nt, Homo sapiens
auacggcccaugcaauuuuau

SEQ ID NO: 1231302 - RNA, 20 nt, Homo sapiens
auacguuugaaauaguugau

SEQ ID NO: 1231303 - RNA, 19 nt, Homo sapiens
auacuaacauuuucauuga

SEQ ID NO: 1231304 - RNA, 11 nt, Homo sapiens
auacuaccucu

SEQ ID NO: 1231305 - RNA, 20 nt, Homo sapiens
auacuauuuaauuauuucac

SEQ ID NO: 1231306 - RNA, 13 nt, Homo sapiens
auacucagguuaa

SEQ ID NO: 1231307 - RNA, 18 nt, Homo sapiens
auacucauuucuaaaaga

SEQ ID NO: 1231308 - RNA, 15 nt, Homo sapiens
auacugccuuugcag

SEQ ID NO: 1231309 - RNA, 18 nt, Homo sapiens
auacuguucaaugguucu

SEQ ID NO: 1231310 - RNA, 15 nt, Homo sapiens
auacuuaaugcauau

SEQ ID NO: 1231311 - RNA, 18 nt, Homo sapiens
auacuuugcaauccaaau

SEQ ID NO: 1231312 - RNA, 15 nt, Homo sapiens
auacuuuugugaaca

SEQ ID NO: 1231313 - RNA, 13 nt, Homo sapiens
auacuuuuuacaa

SEQ ID NO: 1231314 - RNA, 14 nt, Homo sapiens
auagaaaacugaaa

SEQ ID NO: 1231315 - RNA, 16 nt, Homo sapiens
auagaaacaugacacu

SEQ ID NO: 1231316 - RNA, 17 nt, Homo sapiens
auagaaacaugacacug

SEQ ID NO: 1231317 - RNA, 23 nt, Homo sapiens
auagaaauguaaaaguacucuga

SEQ ID NO: 1231318 - RNA, 12 nt, Homo sapiens
auagaacaucca

SEQ ID NO: 1231319 - RNA, 14 nt, Homo sapiens
auagaacauccaga

SEQ ID NO: 1231320 - RNA, 16 nt, Homo sapiens
auagaaccaacccaaa

SEQ ID NO: 1231321 - RNA, 15 nt, Homo sapiens
auagaaccacuauga

SEQ ID NO: 1231322 - RNA, 13 nt, Homo sapiens
auagaagauccua

SEQ ID NO: 1231323 - RNA, 18 nt, Homo sapiens
auagaagcaaaugacaaa

SEQ ID NO: 1231324 - RNA, 21 nt, Homo sapiens
auagaagggcaauauuuuauc

SEQ ID NO: 1231325 - RNA, 15 nt, Homo sapiens
auagaaguagcaaaa

SEQ ID NO: 1231326 - RNA, 15 nt, Homo sapiens
auagacaucagaaau

SEQ ID NO: 1231327 - RNA, 15 nt, Homo sapiens
auagagauuaaguca

SEQ ID NO: 1231328 - RNA, 14 nt, Homo sapiens
auagagcccaguga

SEQ ID NO: 1231329 - RNA, 22 nt, Homo sapiens
auagagccccuccugguugaua

SEQ ID NO: 1231330 - RNA, 15 nt, Homo sapiens
auagaggaaagggau

SEQ ID NO: 1231331 - RNA, 21 nt, Homo sapiens
auagaggcaagaaagagauac

SEQ ID NO: 1231332 - RNA, 15 nt, Homo sapiens
auagaguauaugcac

SEQ ID NO: 1231333 - RNA, 18 nt, Homo sapiens
auagagucucacuguguc

SEQ ID NO: 1231334 - RNA, 12 nt, Homo sapiens
auagagugaaau

SEQ ID NO: 1231335 - RNA, 21 nt, Homo sapiens
auagagugguacagcacuguu

SEQ ID NO: 1231336 - RNA, 17 nt, Homo sapiens
auagagugucucagggu

SEQ ID NO: 1231337 - RNA, 23 nt, Homo sapiens
auagaucagcaaaccggggccua

SEQ ID NO: 1231338 - RNA, 16 nt, Homo sapiens
auagauuaauggcacu

SEQ ID NO: 1231339 - RNA, 19 nt, Homo sapiens
auagauuaauggcacugau

SEQ ID NO: 1231340 - RNA, 15 nt, Homo sapiens
auagcaagugaaagc

SEQ ID NO: 1231341 - RNA, 17 nt, Homo sapiens
auagcacacacauacac

SEQ ID NO: 1231342 - RNA, 15 nt, Homo sapiens
auagcaccauugcac

SEQ ID NO: 1231343 - RNA, 16 nt, Homo sapiens
auagcaccauugcacu

SEQ ID NO: 1231344 - RNA, 12 nt, Homo sapiens
auagcacuuuga

SEQ ID NO: 1231345 - RNA, 18 nt, Homo sapiens
auagcaguugaaacaaga

SEQ ID NO: 1231346 - RNA, 23 nt, Homo sapiens
auagccaacugcuguucauguua

SEQ ID NO: 1231347 - RNA, 19 nt, Homo sapiens
auagcgaagaccaguaugg

SEQ ID NO: 1231348 - RNA, 17 nt, Homo sapiens
auagcuaauuuuugcaa

SEQ ID NO: 1231349 - RNA, 19 nt, Homo sapiens
auagcuaauuuuugcaaau

SEQ ID NO: 1231350 - RNA, 18 nt, Homo sapiens
auagcuauauccauguac

SEQ ID NO: 1231351 - RNA, 21 nt, Homo sapiens
auagcuauggaaucaauucaa

SEQ ID NO: 1231352 - RNA, 16 nt, Homo sapiens
auagcuauuaagauac

SEQ ID NO: 1231353 - RNA, 19 nt, Homo sapiens
auagcuauuaagauacuua

SEQ ID NO: 1231354 - RNA, 21 nt, Homo sapiens
auagcugcaaguguaucuccu

SEQ ID NO: 1231355 - RNA, 12 nt, Homo sapiens
auagcuucagga

SEQ ID NO: 1231356 - RNA, 14 nt, Homo sapiens
auagcuuccaugag

SEQ ID NO: 1231357 - RNA, 21 nt, Homo sapiens
auaggaacaaucuuugcugua

SEQ ID NO: 1231358 - RNA, 16 nt, Homo sapiens
auaggacauacugcau

SEQ ID NO: 1231359 - RNA, 20 nt, Homo sapiens
auaggacucuagacggcauc

SEQ ID NO: 1231360 - RNA, 15 nt, Homo sapiens
auaggagaggaugag

SEQ ID NO: 1231361 - RNA, 15 nt, Homo sapiens
auaggagugaauaca

SEQ ID NO: 1231362 - RNA, 21 nt, Homo sapiens
auaggccagggcauguguaug

SEQ ID NO: 1231363 - RNA, 18 nt, Homo sapiens
auaggcgcaggugcacag

SEQ ID NO: 1231364 - RNA, 22 nt, Homo sapiens
auaggcugacuuuugcagaugg

SEQ ID NO: 1231365 - RNA, 21 nt, Homo sapiens
auaggguggcacagaagcuca

SEQ ID NO: 1231366 - RNA, 17 nt, Homo sapiens
auagguaaaaacuggaa

SEQ ID NO: 1231367 - RNA, 17 nt, Homo sapiens
auagguagauccagauc

SEQ ID NO: 1231368 - RNA, 14 nt, Homo sapiens
auaggucacuccug

SEQ ID NO: 1231369 - RNA, 18 nt, Homo sapiens
auaggugagauaaauuaa

SEQ ID NO: 1231370 - RNA, 21 nt, Homo sapiens
auagguguugguuuugggggu

SEQ ID NO: 1231371 - RNA, 20 nt, Homo sapiens
auagguuuuucucauguauc

SEQ ID NO: 1231372 - RNA, 20 nt, Homo sapiens
auaguaauaaacaccauuuc

SEQ ID NO: 1231373 - RNA, 15 nt, Homo sapiens
auaguacaguuacaa

SEQ ID NO: 1231374 - RNA, 20 nt, Homo sapiens
agaggggaaaccaguguagc

SEQ ID NO: 1231375 - RNA, 20 nt, Homo sapiens
agaggggaacagacuggaag

SEQ ID NO: 1231376 - RNA, 18 nt, Homo sapiens
agaggggauucacaaggu

SEQ ID NO: 1231377 - RNA, 15 nt, Homo sapiens
agaggggcagccgcu

SEQ ID NO: 1231378 - RNA, 12 nt, Homo sapiens
agaggggccagg

SEQ ID NO: 1231379 - RNA, 18 nt, Homo sapiens
agagggucucgcugucac

SEQ ID NO: 1231380 - RNA, 14 nt, Homo sapiens
agaggguguuugca

SEQ ID NO: 1231381 - RNA, 22 nt, Homo sapiens
agagguagguaggaucauccca

SEQ ID NO: 1231382 - RNA, 20 nt, Homo sapiens
agaggucaaggcugcaguga

SEQ ID NO: 1231383 - RNA, 22 nt, Homo sapiens
agagguccuaaagaugcugacu

SEQ ID NO: 1231384 - RNA, 12 nt, Homo sapiens
agagguccucau

SEQ ID NO: 1231385 - RNA, 21 nt, Homo sapiens
agagguggagugucacaucuc

SEQ ID NO: 1231386 - RNA, 19 nt, Homo sapiens
agagguguaacacuuguca

SEQ ID NO: 1231387 - RNA, 14 nt, Homo sapiens
agagguuaucugcc

SEQ ID NO: 1231388 - RNA, 17 nt, Homo sapiens
agaguagaacagauaau

SEQ ID NO: 1231389 - RNA, 18 nt, Homo sapiens
agaguagaauugcauuga

SEQ ID NO: 1231390 - RNA, 14 nt, Homo sapiens
agaguaucacuccc

SEQ ID NO: 1231391 - RNA, 22 nt, Homo sapiens
agagucaaugccuucaugggaa

SEQ ID NO: 1231392 - RNA, 14 nt, Homo sapiens
agagucacugauac

SEQ ID NO: 1231393 - RNA, 23 nt, Homo sapiens
agagucaugugagccucguguca

SEQ ID NO: 1231394 - RNA, 21 nt, Homo sapiens
agagucccacugccucagguu

SEQ ID NO: 1231395 - RNA, 23 nt, Homo sapiens
agagugaaauaauuaaaaaccac

SEQ ID NO: 1231396 - RNA, 20 nt, Homo sapiens
agagugagagacaucaucaa

SEQ ID NO: 1231397 - RNA, 21 nt, Homo sapiens
agagugagcaaccagcuggaa

SEQ ID NO: 1231398 - RNA, 20 nt, Homo sapiens
agagugagcaagggggccca

SEQ ID NO: 1231399 - RNA, 22 nt, Homo sapiens
agagugagcaagggggcccaaa

SEQ ID NO: 1231400 - RNA, 22 nt, Homo sapiens
agagugccguaacaacuguggu

SEQ ID NO: 1231401 - RNA, 22 nt, Homo sapiens
agaguggaaccaacacuaacau

SEQ ID NO: 1231402 - RNA, 16 nt, Homo sapiens
agaguggagucugagu

SEQ ID NO: 1231403 - RNA, 21 nt, Homo sapiens
agaguggccuggccaggagcu

SEQ ID NO: 1231404 - RNA, 20 nt, Homo sapiens
agaguggcugcaccacuucc

SEQ ID NO: 1231405 - RNA, 16 nt, Homo sapiens
agaguggguacuagaa

SEQ ID NO: 1231406 - RNA, 17 nt, Homo sapiens
agagugucucugauaaa

SEQ ID NO: 1231407 - RNA, 19 nt, Homo sapiens
agaguugagauuuugcaau

SEQ ID NO: 1231408 - RNA, 18 nt, Homo sapiens
agaguuugccuguucuau

SEQ ID NO: 1231409 - RNA, 14 nt, Homo sapiens
agaguuuuaucaac

SEQ ID NO: 1231410 - RNA, 15 nt, Homo sapiens
agauaaaauguguaa

SEQ ID NO: 1231411 - RNA, 17 nt, Homo sapiens
agauaaacaacaaauaa

SEQ ID NO: 1231412 - RNA, 23 nt, Homo sapiens
agauaacaagaucuuucaggaaa

SEQ ID NO: 1231413 - RNA, 14 nt, Homo sapiens
agauaagacauauc

SEQ ID NO: 1231414 - RNA, 13 nt, Homo sapiens
agauaagcaagag

SEQ ID NO: 1231415 - RNA, 22 nt, Homo sapiens
agauaaguuugcaguuggcuaa

SEQ ID NO: 1231416 - RNA, 21 nt, Homo sapiens
agauacccuacgcuguccaga

SEQ ID NO: 1231417 - RNA, 15 nt, Homo sapiens
agauacuuaauuccc

SEQ ID NO: 1231418 - RNA, 15 nt, Homo sapiens
agauagcuacagugu

SEQ ID NO: 1231419 - RNA, 16 nt, Homo sapiens
agauagcuacagugua

SEQ ID NO: 1231420 - RNA, 23 nt, Homo sapiens
agauaguuguguuuuuauuguua

SEQ ID NO: 1231421 - RNA, 14 nt, Homo sapiens
agauauacauauca

SEQ ID NO: 1231422 - RNA, 13 nt, Homo sapiens
agauauaugcucu

SEQ ID NO: 1231423 - RNA, 15 nt, Homo sapiens
agauaucagugucuc

SEQ ID NO: 1231424 - RNA, 22 nt, Homo sapiens
agauauuaauagauaauaugaa

SEQ ID NO: 1231425 - RNA, 13 nt, Homo sapiens
agauauuacuuua

SEQ ID NO: 1231426 - RNA, 14 nt, Homo sapiens
agauauuacuuuau

SEQ ID NO: 1231427 - RNA, 17 nt, Homo sapiens
agauauuaggggggaaa

SEQ ID NO: 1231428 - RNA, 17 nt, Homo sapiens
agauauucagaaguaua

SEQ ID NO: 1231429 - RNA, 17 nt, Homo sapiens
agauauugauuacuauc

SEQ ID NO: 1231430 - RNA, 17 nt, Homo sapiens
agauauugcuacuauaa

SEQ ID NO: 1231431 - RNA, 14 nt, Homo sapiens
agauauuucacauu

SEQ ID NO: 1231432 - RNA, 16 nt, Homo sapiens
agauauuugguaccau

SEQ ID NO: 1231433 - RNA, 12 nt, Homo sapiens
agaucacgccac

SEQ ID NO: 1231434 - RNA, 17 nt, Homo sapiens
agaucacgccacugcac

SEQ ID NO: 1231435 - RNA, 12 nt, Homo sapiens
agaucacugcca

SEQ ID NO: 1231436 - RNA, 22 nt, Homo sapiens
agaucagccugaccaacauggu

SEQ ID NO: 1231437 - RNA, 15 nt, Homo sapiens
agaucauauuucaca

SEQ ID NO: 1231438 - RNA, 15 nt, Homo sapiens
agaucaucagucacc

SEQ ID NO: 1231439 - RNA, 15 nt, Homo sapiens
agauccagacuguaa

SEQ ID NO: 1231440 - RNA, 14 nt, Homo sapiens
agaucccagaggau

SEQ ID NO: 1231441 - RNA, 19 nt, Homo sapiens
agauccccccacaaagugg

SEQ ID NO: 1231442 - RNA, 17 nt, Homo sapiens
agauccgagucuaccca

SEQ ID NO: 1231443 - RNA, 23 nt, Homo sapiens
agauccuuuuuccaucauuuuac

SEQ ID NO: 1231444 - RNA, 20 nt, Homo sapiens
agaucgauccuggauucacu

SEQ ID NO: 1231445 - RNA, 14 nt, Homo sapiens
agaucgcaccacug

SEQ ID NO: 1231446 - RNA, 17 nt, Homo sapiens
agaucgcaccacugcac

SEQ ID NO: 1231447 - RNA, 19 nt, Homo sapiens
agaucgcaccacugcacuc

SEQ ID NO: 1231448 - RNA, 13 nt, Homo sapiens
agaucgcaucauu

SEQ ID NO: 1231449 - RNA, 19 nt, Homo sapiens
agaucgcaucauugcacuc

SEQ ID NO: 1231450 - RNA, 15 nt, Homo sapiens
agaucguuguuuaca

SEQ ID NO: 1231451 - RNA, 22 nt, Homo sapiens
agaucucucgaaugcugagaag

SEQ ID NO: 1231452 - RNA, 14 nt, Homo sapiens
agaucuggcugugg

SEQ ID NO: 1231453 - RNA, 22 nt, Homo sapiens
agaucuggucccuugcagcuag

SEQ ID NO: 1231454 - RNA, 22 nt, Homo sapiens
agaucuguaaguaacuucacau

SEQ ID NO: 1231455 - RNA, 20 nt, Homo sapiens
agaucuuucaggaaagacgg

SEQ ID NO: 1231456 - RNA, 14 nt, Homo sapiens
agaugaacucugaa

SEQ ID NO: 1231457 - RNA, 17 nt, Homo sapiens
agaugaagaagccuuug

SEQ ID NO: 1231458 - RNA, 16 nt, Homo sapiens
agaugaauaaacugaa

SEQ ID NO: 1231459 - RNA, 16 nt, Homo sapiens
agaugagaacaaagcu

SEQ ID NO: 1231460 - RNA, 20 nt, Homo sapiens
agaugagcccacagaggcau

SEQ ID NO: 1231461 - RNA, 16 nt, Homo sapiens
agaugaggcacuggaa

SEQ ID NO: 1231462 - RNA, 13 nt, Homo sapiens
agaugaucucucc

SEQ ID NO: 1231463 - RNA, 19 nt, Homo sapiens
agaugauuaaacagacuuu

SEQ ID NO: 1231464 - RNA, 16 nt, Homo sapiens
agaugcaaugugcuac

SEQ ID NO: 1231465 - RNA, 18 nt, Homo sapiens
agaugcacuuaugcagua

SEQ ID NO: 1231466 - RNA, 16 nt, Homo sapiens
agaugcaucacugggu

SEQ ID NO: 1231467 - RNA, 13 nt, Homo sapiens
agaugccacugcc

SEQ ID NO: 1231468 - RNA, 18 nt, Homo sapiens
agaugccccagagcuguu

SEQ ID NO: 1231469 - RNA, 16 nt, Homo sapiens
agaugcccuuuggaaa

SEQ ID NO: 1231470 - RNA, 23 nt, Homo sapiens
agaugccgcggaaggucccucag

SEQ ID NO: 1231471 - RNA, 22 nt, Homo sapiens
agaugcgugcccagcucuucac

SEQ ID NO: 1231472 - RNA, 16 nt, Homo sapiens
agaugcuacuggacuu

SEQ ID NO: 1231473 - RNA, 21 nt, Homo sapiens
agaugcuagaaaaauguucuu

SEQ ID NO: 1231474 - RNA, 21 nt, Homo sapiens
agaugcuguaguaacugccuc

SEQ ID NO: 1231475 - RNA, 15 nt, Homo sapiens
agauggaaaaacuga

SEQ ID NO: 1231476 - RNA, 16 nt, Homo sapiens
agauggacagcgauga

SEQ ID NO: 1231477 - RNA, 16 nt, Homo sapiens
agauggacuccagccu

SEQ ID NO: 1231478 - RNA, 14 nt, Homo sapiens
agauggaguucuug

SEQ ID NO: 1231479 - RNA, 12 nt, Homo sapiens
agauggccauau

SEQ ID NO: 1231480 - RNA, 20 nt, Homo sapiens
agauggccuggcugcugcug

SEQ ID NO: 1231481 - RNA, 22 nt, Homo sapiens
agauggcugugccucugccugu

SEQ ID NO: 1231482 - RNA, 14 nt, Homo sapiens
agauggggcacuga

SEQ ID NO: 1231483 - RNA, 16 nt, Homo sapiens
agauggggcacugacc

SEQ ID NO: 1231484 - RNA, 17 nt, Homo sapiens
agaugggggaacuguga

SEQ ID NO: 1231485 - RNA, 12 nt, Homo sapiens
agauguacuugu

SEQ ID NO: 1231486 - RNA, 18 nt, Homo sapiens
agauguauaaaucuuucu

SEQ ID NO: 1231487 - RNA, 18 nt, Homo sapiens
agaugucuuggaacauug

SEQ ID NO: 1231488 - RNA, 20 nt, Homo sapiens
agauguggcaaagugcugua

SEQ ID NO: 1231489 - RNA, 16 nt, Homo sapiens
agauguugucuuggcu

SEQ ID NO: 1231490 - RNA, 20 nt, Homo sapiens
agauguuguguuuacguuac

SEQ ID NO: 1231491 - RNA, 17 nt, Homo sapiens
agauguuuaugauguaa

SEQ ID NO: 1231492 - RNA, 16 nt, Homo sapiens
agauuaaacaaacaaa

SEQ ID NO: 1231493 - RNA, 21 nt, Homo sapiens
agauuaaauuacagcuuuuau

SEQ ID NO: 1231494 - RNA, 12 nt, Homo sapiens
agauuaacaaca

SEQ ID NO: 1231495 - RNA, 12 nt, Homo sapiens
agauuacccaaa

SEQ ID NO: 1231496 - RNA, 12 nt, Homo sapiens
agauuaucuggg

SEQ ID NO: 1231497 - RNA, 18 nt, Homo sapiens
auauuuuguuuugugcag

SEQ ID NO: 1231498 - RNA, 16 nt, Homo sapiens
auauuuuuagccuaaa

SEQ ID NO: 1231499 - RNA, 22 nt, Homo sapiens
auauuuuuaguagagacagggu

SEQ ID NO: 1231500 - RNA, 14 nt, Homo sapiens
auauuuuugccaua

SEQ ID NO: 1231501 - RNA, 22 nt, Homo sapiens
auauuuuuguacugaaucucau

SEQ ID NO: 1231502 - RNA, 14 nt, Homo sapiens
aucaaaaaguaauu

SEQ ID NO: 1231503 - RNA, 14 nt, Homo sapiens
aucaaaaaguuuau

SEQ ID NO: 1231504 - RNA, 23 nt, Homo sapiens
aucaaaacacacuacuaccucuu

SEQ ID NO: 1231505 - RNA, 19 nt, Homo sapiens
aucaaaacuaaccaucuga

SEQ ID NO: 1231506 - RNA, 18 nt, Homo sapiens
aucaaaagcuuauucauc

SEQ ID NO: 1231507 - RNA, 20 nt, Homo sapiens
aucaaaagggagagaacaaa

SEQ ID NO: 1231508 - RNA, 12 nt, Homo sapiens
aucaaacauaau

SEQ ID NO: 1231509 - RNA, 12 nt, Homo sapiens
aucaaagcacuu

SEQ ID NO: 1231510 - RNA, 17 nt, Homo sapiens
aucaaagccuggccuaa

SEQ ID NO: 1231511 - RNA, 22 nt, Homo sapiens
aucaaaucucuuccacaugggu

SEQ ID NO: 1231512 - RNA, 12 nt, Homo sapiens
aucaacaaagaa

SEQ ID NO: 1231513 - RNA, 20 nt, Homo sapiens
aucaacagaagcauuuguau

SEQ ID NO: 1231514 - RNA, 15 nt, Homo sapiens
aucaacuaaugauuu

SEQ ID NO: 1231515 - RNA, 20 nt, Homo sapiens
aucaacuuguguacugauaa

SEQ ID NO: 1231516 - RNA, 24 nt, Homo sapiens
aucaacuuuagcuaguaucuucaa

SEQ ID NO: 1231517 - RNA, 18 nt, Homo sapiens
aucaagaaauacuuucga

SEQ ID NO: 1231518 - RNA, 13 nt, Homo sapiens
aucaagcaaaaug

SEQ ID NO: 1231519 - RNA, 17 nt, Homo sapiens
aucaagcccuuuacuug

SEQ ID NO: 1231520 - RNA, 22 nt, Homo sapiens
aucaaggaguacaaugcccaga

SEQ ID NO: 1231521 - RNA, 13 nt, Homo sapiens
aucaagguucagc

SEQ ID NO: 1231522 - RNA, 23 nt, Homo sapiens
aucaagugugcuuuagcuugaaa

SEQ ID NO: 1231523 - RNA, 23 nt, Homo sapiens
aucaauaguugaauuagugagua

SEQ ID NO: 1231524 - RNA, 18 nt, Homo sapiens
aucaaugaagcaaguaca

SEQ ID NO: 1231525 - RNA, 19 nt, Homo sapiens
aucaaugcauguuacccau

SEQ ID NO: 1231526 - RNA, 13 nt, Homo sapiens
aucaaugucacuu

SEQ ID NO: 1231527 - RNA, 12 nt, Homo sapiens
aucaauguuucu

SEQ ID NO: 1231528 - RNA, 19 nt, Homo sapiens
aucaauuggcagugacuuu

SEQ ID NO: 1231529 - RNA, 22 nt, Homo sapiens
aucacaaaggaaagauuugcca

SEQ ID NO: 1231530 - RNA, 11 nt, Homo sapiens
aucacaacauu

SEQ ID NO: 1231531 - RNA, 17 nt, Homo sapiens
aucacaagaaaacuaua

SEQ ID NO: 1231532 - RNA, 13 nt, Homo sapiens
aucacacauauca

SEQ ID NO: 1231533 - RNA, 14 nt, Homo sapiens
aucacacucuccau

SEQ ID NO: 1231534 - RNA, 21 nt, Homo sapiens
aucacacugaagccacagcug

SEQ ID NO: 1231535 - RNA, 23 nt, Homo sapiens
aucacaugaauauaaaugggaaa

SEQ ID NO: 1231536 - RNA, 16 nt, Homo sapiens
aucaccagccaugugc

SEQ ID NO: 1231537 - RNA, 22 nt, Homo sapiens
aucaccucuuaugcacaccucc

SEQ ID NO: 1231538 - RNA, 15 nt, Homo sapiens
aucacgccacugcac

SEQ ID NO: 1231539 - RNA, 17 nt, Homo sapiens
aucacggcucacugcag

SEQ ID NO: 1231540 - RNA, 22 nt, Homo sapiens
aucacggcucacugcagccuca

SEQ ID NO: 1231541 - RNA, 17 nt, Homo sapiens
aucacuacucagugcau

SEQ ID NO: 1231542 - RNA, 21 nt, Homo sapiens
aucacuagaagaaaagcccau

SEQ ID NO: 1231543 - RNA, 16 nt, Homo sapiens
aucacuagccugucau

SEQ ID NO: 1231544 - RNA, 23 nt, Homo sapiens
aucacuccccaaggaagagccaa

SEQ ID NO: 1231545 - RNA, 12 nt, Homo sapiens
aucacugaacaa

SEQ ID NO: 1231546 - RNA, 19 nt, Homo sapiens
aucacugccacacucucca

SEQ ID NO: 1231547 - RNA, 22 nt, Homo sapiens
aucacugccacacucuccauca

SEQ ID NO: 1231548 - RNA, 18 nt, Homo sapiens
auccagaguucugugaca

SEQ ID NO: 1231549 - RNA, 15 nt, Homo sapiens
auccagauccagacu

SEQ ID NO: 1231550 - RNA, 15 nt, Homo sapiens
auccagcaaccuaua

SEQ ID NO: 1231551 - RNA, 16 nt, Homo sapiens
auccagcaauuccuga

SEQ ID NO: 1231552 - RNA, 13 nt, Homo sapiens
auccagcacuggu

SEQ ID NO: 1231553 - RNA, 17 nt, Homo sapiens
auccaggcaccaggacu

SEQ ID NO: 1231554 - RNA, 13 nt, Homo sapiens
auccaggugccaa

SEQ ID NO: 1231555 - RNA, 20 nt, Homo sapiens
auccagguuuaugaaugaca

SEQ ID NO: 1231556 - RNA, 17 nt, Homo sapiens
auccauaacuuuagucu

SEQ ID NO: 1231557 - RNA, 15 nt, Homo sapiens
auccauaaugcauuc

SEQ ID NO: 1231558 - RNA, 15 nt, Homo sapiens
auccauaauuauuaa

SEQ ID NO: 1231559 - RNA, 17 nt, Homo sapiens
auccaugaacagcauua

SEQ ID NO: 1231560 - RNA, 18 nt, Homo sapiens
auccaugcaccuaccuua

SEQ ID NO: 1231561 - RNA, 22 nt, Homo sapiens
auccaugcggccuggguguccu

SEQ ID NO: 1231562 - RNA, 16 nt, Homo sapiens
auccaugcuucucauc

SEQ ID NO: 1231563 - RNA, 23 nt, Homo sapiens
auccaugugauuaauguuuucau

SEQ ID NO: 1231564 - RNA, 18 nt, Homo sapiens
auccauguguggacucaa

SEQ ID NO: 1231565 - RNA, 16 nt, Homo sapiens
auccauuccucuuacu

SEQ ID NO: 1231566 - RNA, 22 nt, Homo sapiens
auccauuugccuuucugggagc

SEQ ID NO: 1231567 - RNA, 15 nt, Homo sapiens
aucccaacacuuugg

SEQ ID NO: 1231568 - RNA, 12 nt, Homo sapiens
aucccaaccagu

SEQ ID NO: 1231569 - RNA, 19 nt, Homo sapiens
aucccaaccagugccaagg

SEQ ID NO: 1231570 - RNA, 14 nt, Homo sapiens
aucccaacuacuca

SEQ ID NO: 1231571 - RNA, 16 nt, Homo sapiens
aucccaacuacucaga

SEQ ID NO: 1231572 - RNA, 16 nt, Homo sapiens
aucccaagugcacuuu

SEQ ID NO: 1231573 - RNA, 15 nt, Homo sapiens
aucccagcacuuuga

SEQ ID NO: 1231574 - RNA, 14 nt, Homo sapiens
aucccagcuacuca

SEQ ID NO: 1231575 - RNA, 16 nt, Homo sapiens
aucccagucucugcca

SEQ ID NO: 1231576 - RNA, 14 nt, Homo sapiens
aucccauucacuuc

SEQ ID NO: 1231577 - RNA, 14 nt, Homo sapiens
auccccacccaguc

SEQ ID NO: 1231578 - RNA, 18 nt, Homo sapiens
auccccacccagucucau

SEQ ID NO: 1231579 - RNA, 15 nt, Homo sapiens
aucccccagccucaa

SEQ ID NO: 1231580 - RNA, 22 nt, Homo sapiens
auccccggugguuuugugcuca

SEQ ID NO: 1231581 - RNA, 17 nt, Homo sapiens
auccccugcuacccuag

SEQ ID NO: 1231582 - RNA, 16 nt, Homo sapiens
auccccuggacuggga

SEQ ID NO: 1231583 - RNA, 18 nt, Homo sapiens
auccccugugcccugcac

SEQ ID NO: 1231584 - RNA, 16 nt, Homo sapiens
auccccuucugcaauc

SEQ ID NO: 1231585 - RNA, 17 nt, Homo sapiens
auccccuuggcugugag

SEQ ID NO: 1231586 - RNA, 23 nt, Homo sapiens
aucccguaccucuucccaugacu

SEQ ID NO: 1231587 - RNA, 18 nt, Homo sapiens
aucccuaacuaaagggga

SEQ ID NO: 1231588 - RNA, 14 nt, Homo sapiens
aucccuacauguau

SEQ ID NO: 1231589 - RNA, 20 nt, Homo sapiens
aucccuacauguauugcaca

SEQ ID NO: 1231590 - RNA, 12 nt, Homo sapiens
aucccuaccccc

SEQ ID NO: 1231591 - RNA, 15 nt, Homo sapiens
aucccucaccuguag

SEQ ID NO: 1231592 - RNA, 22 nt, Homo sapiens
aucccugacaucuggaaucugg

SEQ ID NO: 1231593 - RNA, 15 nt, Homo sapiens
aucccuggaaggaca

SEQ ID NO: 1231594 - RNA, 19 nt, Homo sapiens
aucccugucauuuuuaaca

SEQ ID NO: 1231595 - RNA, 12 nt, Homo sapiens
aucccuuuccag

SEQ ID NO: 1231596 - RNA, 20 nt, Homo sapiens
aucccuuuuucaaugaauuu

SEQ ID NO: 1231597 - RNA, 17 nt, Homo sapiens
auccgcugccagccuug

SEQ ID NO: 1231598 - RNA, 15 nt, Homo sapiens
auccuaacacauuau

SEQ ID NO: 1231599 - RNA, 21 nt, Homo sapiens
auccuaccccuuugcacuugu

SEQ ID NO: 1231600 - RNA, 20 nt, Homo sapiens
auccuacugagcauuugcac

SEQ ID NO: 1231601 - RNA, 18 nt, Homo sapiens
auccuagaucaccacugg

SEQ ID NO: 1231602 - RNA, 19 nt, Homo sapiens
auccuagauuauaucaaag

SEQ ID NO: 1231603 - RNA, 17 nt, Homo sapiens
auccuagucauucuucc

SEQ ID NO: 1231604 - RNA, 21 nt, Homo sapiens
augaaucucaagauucaguag

SEQ ID NO: 1231605 - RNA, 18 nt, Homo sapiens
augaaucucguucccaaa

SEQ ID NO: 1231606 - RNA, 17 nt, Homo sapiens
augaaugacauugaacu

SEQ ID NO: 1231607 - RNA, 12 nt, Homo sapiens
augaaugcacac

SEQ ID NO: 1231608 - RNA, 13 nt, Homo sapiens
augaauuauuaua

SEQ ID NO: 1231609 - RNA, 22 nt, Homo sapiens
augaauuccuauauaccuaaua

SEQ ID NO: 1231610 - RNA, 11 nt, Homo sapiens
augaauucuua

SEQ ID NO: 1231611 - RNA, 23 nt, Homo sapiens
augaauucuugauuuccuuucag

SEQ ID NO: 1231612 - RNA, 19 nt, Homo sapiens
augaauuugucgcaaagac

SEQ ID NO: 1231613 - RNA, 16 nt, Homo sapiens
augacaaaaagccuuu

SEQ ID NO: 1231614 - RNA, 16 nt, Homo sapiens
augacaaaggcacuga

SEQ ID NO: 1231615 - RNA, 21 nt, Homo sapiens
augacaaggagcacaagaagu

SEQ ID NO: 1231616 - RNA, 17 nt, Homo sapiens
augacaaucaccuucag

SEQ ID NO: 1231617 - RNA, 19 nt, Homo sapiens
augacaaugaugaugauaa

SEQ ID NO: 1231618 - RNA, 18 nt, Homo sapiens
augacaauuaaugauuaa

SEQ ID NO: 1231619 - RNA, 18 nt, Homo sapiens
augacaccaaauaugucc

SEQ ID NO: 1231620 - RNA, 11 nt, Homo sapiens
augacacugac

SEQ ID NO: 1231621 - RNA, 13 nt, Homo sapiens
augacacugaccu

SEQ ID NO: 1231622 - RNA, 21 nt, Homo sapiens
augacaguauuauacgcuggc

SEQ ID NO: 1231623 - RNA, 22 nt, Homo sapiens
augacagucacagacucgccuc

SEQ ID NO: 1231624 - RNA, 20 nt, Homo sapiens
augacaucacuuguacaaaa

SEQ ID NO: 1231625 - RNA, 14 nt, Homo sapiens
augacaucucaggg

SEQ ID NO: 1231626 - RNA, 14 nt, Homo sapiens
augacaugcacuga

SEQ ID NO: 1231627 - RNA, 15 nt, Homo sapiens
augacauugaacuga

SEQ ID NO: 1231628 - RNA, 14 nt, Homo sapiens
augacccacccagu

SEQ ID NO: 1231629 - RNA, 17 nt, Homo sapiens
augacccaccccugugc

SEQ ID NO: 1231630 - RNA, 16 nt, Homo sapiens
augaccuugggguaca

SEQ ID NO: 1231631 - RNA, 19 nt, Homo sapiens
augaccuugggguacaauu

SEQ ID NO: 1231632 - RNA, 15 nt, Homo sapiens
augacgucaucauca

SEQ ID NO: 1231633 - RNA, 16 nt, Homo sapiens
augacugcuuaacucc

SEQ ID NO: 1231634 - RNA, 10 nt, Homo sapiens
augacugggc

SEQ ID NO: 1231635 - RNA, 16 nt, Homo sapiens
augacugguuguucaa

SEQ ID NO: 1231636 - RNA, 19 nt, Homo sapiens
augacuguuacagcuuucu

SEQ ID NO: 1231637 - RNA, 21 nt, Homo sapiens
augacuuggagauuuaucucu

SEQ ID NO: 1231638 - RNA, 13 nt, Homo sapiens
augacuuguagca

SEQ ID NO: 1231639 - RNA, 17 nt, Homo sapiens
augagaccacuguuauc

SEQ ID NO: 1231640 - RNA, 20 nt, Homo sapiens
augagagaaggaggggagca

SEQ ID NO: 1231641 - RNA, 21 nt, Homo sapiens
augagcaagaggcuaacucag

SEQ ID NO: 1231642 - RNA, 18 nt, Homo sapiens
augagcauccucucucac

SEQ ID NO: 1231643 - RNA, 15 nt, Homo sapiens
augagcauuacuauu

SEQ ID NO: 1231644 - RNA, 18 nt, Homo sapiens
augagcauuacuauucac

SEQ ID NO: 1231645 - RNA, 13 nt, Homo sapiens
augagcuuccuuc

SEQ ID NO: 1231646 - RNA, 21 nt, Homo sapiens
augagcuuucuuugcacuuaa

SEQ ID NO: 1231647 - RNA, 17 nt, Homo sapiens
augaggaaaaaacccag

SEQ ID NO: 1231648 - RNA, 16 nt, Homo sapiens
augagggaaaaugagu

SEQ ID NO: 1231649 - RNA, 16 nt, Homo sapiens
augagggugacuguca

SEQ ID NO: 1231650 - RNA, 21 nt, Homo sapiens
augaguaacauuugcuguuuu

SEQ ID NO: 1231651 - RNA, 17 nt, Homo sapiens
augaguaauacaucaaa

SEQ ID NO: 1231652 - RNA, 15 nt, Homo sapiens
augagugauccugcc

SEQ ID NO: 1231653 - RNA, 13 nt, Homo sapiens
augagugcuuaaa

SEQ ID NO: 1231654 - RNA, 16 nt, Homo sapiens
augaguuggacuucag

SEQ ID NO: 1231655 - RNA, 21 nt, Homo sapiens
augauaaaccugccaagaguc

SEQ ID NO: 1231656 - RNA, 16 nt, Homo sapiens
augauaacugcaauuu

SEQ ID NO: 1231657 - RNA, 13 nt, Homo sapiens
augauacaaugaa

SEQ ID NO: 1231658 - RNA, 15 nt, Homo sapiens
augauacacuaugaa

SEQ ID NO: 1231659 - RNA, 13 nt, Homo sapiens
augauacaguauu

SEQ ID NO: 1231660 - RNA, 17 nt, Homo sapiens
augauacugauuaugaa

SEQ ID NO: 1231661 - RNA, 13 nt, Homo sapiens
augauacuuccaa

SEQ ID NO: 1231662 - RNA, 12 nt, Homo sapiens
augauacuugag

SEQ ID NO: 1231663 - RNA, 19 nt, Homo sapiens
augauacuuggaugcagcu

SEQ ID NO: 1231664 - RNA, 13 nt, Homo sapiens
augauaugaccag

SEQ ID NO: 1231665 - RNA, 20 nt, Homo sapiens
augaucacggcucacugcag

SEQ ID NO: 1231666 - RNA, 20 nt, Homo sapiens
augaucagcuguuugucaua

SEQ ID NO: 1231667 - RNA, 20 nt, Homo sapiens
augaucaguguuacugccua

SEQ ID NO: 1231668 - RNA, 18 nt, Homo sapiens
augauccccaagugguga

SEQ ID NO: 1231669 - RNA, 19 nt, Homo sapiens
augauccccaaguggugaa

SEQ ID NO: 1231670 - RNA, 22 nt, Homo sapiens
augaucgcgccacuacacucca

SEQ ID NO: 1231671 - RNA, 17 nt, Homo sapiens
augaucuggauccacca

SEQ ID NO: 1231672 - RNA, 12 nt, Homo sapiens
augaucuuggcu

SEQ ID NO: 1231673 - RNA, 20 nt, Homo sapiens
augaugaaaacuaaggauuu

SEQ ID NO: 1231674 - RNA, 19 nt, Homo sapiens
augaugacugcuuaacucc

SEQ ID NO: 1231675 - RNA, 16 nt, Homo sapiens
augaugagaagcagaa

SEQ ID NO: 1231676 - RNA, 19 nt, Homo sapiens
augaugagaguuucuguua

SEQ ID NO: 1231677 - RNA, 12 nt, Homo sapiens
augaugaucugg

SEQ ID NO: 1231678 - RNA, 15 nt, Homo sapiens
augaugccacuuccc

SEQ ID NO: 1231679 - RNA, 20 nt, Homo sapiens
augaugcccugcuccaggga

SEQ ID NO: 1231680 - RNA, 18 nt, Homo sapiens
augauggggcaugugcca

SEQ ID NO: 1231681 - RNA, 23 nt, Homo sapiens
augaugggggaaaaaaaguaauc

SEQ ID NO: 1231682 - RNA, 23 nt, Homo sapiens
augauggucugcauuagucucau

SEQ ID NO: 1231683 - RNA, 17 nt, Homo sapiens
augaugucuaccucaga

SEQ ID NO: 1231684 - RNA, 17 nt, Homo sapiens
augaugugaguauuuag

SEQ ID NO: 1231685 - RNA, 15 nt, Homo sapiens
augauuaaacuuccu

SEQ ID NO: 1231686 - RNA, 20 nt, Homo sapiens
augauuaaauaagauucuaa

SEQ ID NO: 1231687 - RNA, 19 nt, Homo sapiens
augauucaaauugcugcuu

SEQ ID NO: 1231688 - RNA, 18 nt, Homo sapiens
augauuggaauauuacaa

SEQ ID NO: 1231689 - RNA, 16 nt, Homo sapiens
augauuguacuuugaa

SEQ ID NO: 1231690 - RNA, 13 nt, Homo sapiens
augauuguucaaa

SEQ ID NO: 1231691 - RNA, 18 nt, Homo sapiens
augauuuagguacgucaa

SEQ ID NO: 1231692 - RNA, 19 nt, Homo sapiens
augauuucaugcuaucucu

SEQ ID NO: 1231693 - RNA, 19 nt, Homo sapiens
augauuuguaacauucaca

SEQ ID NO: 1231694 - RNA, 19 nt, Homo sapiens
augauuuuuuuuucauaca

SEQ ID NO: 1231695 - RNA, 14 nt, Homo sapiens
augcaaaagcacau

SEQ ID NO: 1231696 - RNA, 18 nt, Homo sapiens
augcaaaguagcaauuuc

SEQ ID NO: 1231697 - RNA, 15 nt, Homo sapiens
augcaaaucaauuac

SEQ ID NO: 1231698 - RNA, 14 nt, Homo sapiens
augcaagccagcuu

SEQ ID NO: 1231699 - RNA, 14 nt, Homo sapiens
augcaagucuguga

SEQ ID NO: 1231700 - RNA, 16 nt, Homo sapiens
augcaagucugugagu

SEQ ID NO: 1231701 - RNA, 12 nt, Homo sapiens
augcaagugcaa

SEQ ID NO: 1231702 - RNA, 18 nt, Homo sapiens
augcaauuggcauuaaca

SEQ ID NO: 1231703 - RNA, 19 nt, Homo sapiens
augcaauuggcauuaacaa

SEQ ID NO: 1231704 - RNA, 17 nt, Homo sapiens
augcaauuuuucaagag

SEQ ID NO: 1231705 - RNA, 17 nt, Homo sapiens
augcacaaaguguauuc

SEQ ID NO: 1231706 - RNA, 17 nt, Homo sapiens
augcacaagaauggauc

SEQ ID NO: 1231707 - RNA, 15 nt, Homo sapiens
augcacacgugugca

SEQ ID NO: 1231708 - RNA, 15 nt, Homo sapiens
augcacaggggccca

SEQ ID NO: 1231709 - RNA, 22 nt, Homo sapiens
augcacaguaucuuuucuuuca

SEQ ID NO: 1231710 - RNA, 14 nt, Homo sapiens
augcacgaucucag

SEQ ID NO: 1231711 - RNA, 14 nt, Homo sapiens
augcacguagcuga

SEQ ID NO: 1231712 - RNA, 19 nt, Homo sapiens
augcacugaaaacuuagcc

SEQ ID NO: 1231713 - RNA, 18 nt, Homo sapiens
augcacugacccuuccag

SEQ ID NO: 1231714 - RNA, 15 nt, Homo sapiens
augcacugauguugu

SEQ ID NO: 1231715 - RNA, 21 nt, Homo sapiens
augcacuuaaguuagccucca

SEQ ID NO: 1231716 - RNA, 17 nt, Homo sapiens
augcagaaccacaaaca

SEQ ID NO: 1231717 - RNA, 16 nt, Homo sapiens
augcagacaacaccuu

SEQ ID NO: 1231718 - RNA, 16 nt, Homo sapiens
augcagccugcucuug

SEQ ID NO: 1231719 - RNA, 23 nt, Homo sapiens
augcaggcccuuugaagccucag

SEQ ID NO: 1231720 - RNA, 18 nt, Homo sapiens
augcagugguaugaucac

SEQ ID NO: 1231721 - RNA, 18 nt, Homo sapiens
augcaucuggcccaggaa

SEQ ID NO: 1231722 - RNA, 13 nt, Homo sapiens
augcaugaacaag

SEQ ID NO: 1231723 - RNA, 18 nt, Homo sapiens
augcauuucaagcagcug

SEQ ID NO: 1231724 - RNA, 16 nt, Homo sapiens
augccaauacuaguca

SEQ ID NO: 1231725 - RNA, 23 nt, Homo sapiens
augccaauacuagucaccccaag

SEQ ID NO: 1231726 - RNA, 22 nt, Homo sapiens
augccaccccaugugccuuuag

SEQ ID NO: 1231727 - RNA, 12 nt, Homo sapiens
augccacuccuc

SEQ ID NO: 1231728 - RNA, 11 nt, Homo sapiens
augccacugcu

SEQ ID NO: 1231729 - RNA, 20 nt, Homo sapiens
auuugcggcgucagucuuuu

SEQ ID NO: 1231730 - RNA, 22 nt, Homo sapiens
auuuggacuggugugcucucuu

SEQ ID NO: 1231731 - RNA, 18 nt, Homo sapiens
auuugggagacaugugac

SEQ ID NO: 1231732 - RNA, 15 nt, Homo sapiens
auuuguaaaucugcc

SEQ ID NO: 1231733 - RNA, 20 nt, Homo sapiens
auuuguaauugaacuuaucc

SEQ ID NO: 1231734 - RNA, 15 nt, Homo sapiens
auuuguagcaauuua

SEQ ID NO: 1231735 - RNA, 16 nt, Homo sapiens
auuuguagcaauuuaa

SEQ ID NO: 1231736 - RNA, 21 nt, Homo sapiens
auuuguauuaauaaagcauuc

SEQ ID NO: 1231737 - RNA, 17 nt, Homo sapiens
auuuguauuuugcuuaa

SEQ ID NO: 1231738 - RNA, 23 nt, Homo sapiens
auuugucccagccuggggcuccc

SEQ ID NO: 1231739 - RNA, 19 nt, Homo sapiens
auuugucugaaacauuuca

SEQ ID NO: 1231740 - RNA, 20 nt, Homo sapiens
auuugugaaaagaguaugua

SEQ ID NO: 1231741 - RNA, 15 nt, Homo sapiens
auuugugagacugua

SEQ ID NO: 1231742 - RNA, 20 nt, Homo sapiens
auuugugcuaccccuuugau

SEQ ID NO: 1231743 - RNA, 21 nt, Homo sapiens
auuuguggucacagccaugaa

SEQ ID NO: 1231744 - RNA, 19 nt, Homo sapiens
auuugugugaaaaugugac

SEQ ID NO: 1231745 - RNA, 16 nt, Homo sapiens
auuuguuauacuucaa

SEQ ID NO: 1231746 - RNA, 21 nt, Homo sapiens
auuuguucauuauuugugcua

SEQ ID NO: 1231747 - RNA, 20 nt, Homo sapiens
auuuguucguauuuagaaug

SEQ ID NO: 1231748 - RNA, 21 nt, Homo sapiens
auuuguuuaugaaauguuaca

SEQ ID NO: 1231749 - RNA, 14 nt, Homo sapiens
auuuuaaaaacaua

SEQ ID NO: 1231750 - RNA, 17 nt, Homo sapiens
auuuuaaaaagucuuca

SEQ ID NO: 1231751 - RNA, 21 nt, Homo sapiens
auuuuaaaggcagagaaguuc

SEQ ID NO: 1231752 - RNA, 17 nt, Homo sapiens
auuuuaagaauuucaca

SEQ ID NO: 1231753 - RNA, 19 nt, Homo sapiens
auuuuaaguaucagagguc

SEQ ID NO: 1231754 - RNA, 13 nt, Homo sapiens
auuuuaagugcuu

SEQ ID NO: 1231755 - RNA, 18 nt, Homo sapiens
auuuuaaugaagugcaau

SEQ ID NO: 1231756 - RNA, 20 nt, Homo sapiens
auuuuaauugauuauucuga

SEQ ID NO: 1231757 - RNA, 12 nt, Homo sapiens
auuuuacagcua

SEQ ID NO: 1231758 - RNA, 20 nt, Homo sapiens
auuuuacagcuacuugcaau

SEQ ID NO: 1231759 - RNA, 13 nt, Homo sapiens
auuuuaccaaagc

SEQ ID NO: 1231760 - RNA, 18 nt, Homo sapiens
auuuuaccaaagcaucaa

SEQ ID NO: 1231761 - RNA, 17 nt, Homo sapiens
auuuuacccuuuagacu

SEQ ID NO: 1231762 - RNA, 18 nt, Homo sapiens
auuuuaccuagcauuuca

SEQ ID NO: 1231763 - RNA, 19 nt, Homo sapiens
auuuuaccuagcauuucaa

SEQ ID NO: 1231764 - RNA, 20 nt, Homo sapiens
auuuuaccuaguuugcacua

SEQ ID NO: 1231765 - RNA, 14 nt, Homo sapiens
auuuuagaugccug

SEQ ID NO: 1231766 - RNA, 14 nt, Homo sapiens
auuuuauacugaca

SEQ ID NO: 1231767 - RNA, 22 nt, Homo sapiens
auuuuauaugcuuacugauaua

SEQ ID NO: 1231768 - RNA, 16 nt, Homo sapiens
auuuuauuuuacuauu

SEQ ID NO: 1231769 - RNA, 23 nt, Homo sapiens
auuuuauuuuuucccuccugaca

SEQ ID NO: 1231770 - RNA, 19 nt, Homo sapiens
caaaagagaaaaacaaaac

SEQ ID NO: 1231771 - RNA, 21 nt, Homo sapiens
caaaagauacggcccaugcaa

SEQ ID NO: 1231772 - RNA, 14 nt, Homo sapiens
caaaagaugccauu

SEQ ID NO: 1231773 - RNA, 17 nt, Homo sapiens
caaaagaugccauucau

SEQ ID NO: 1231774 - RNA, 13 nt, Homo sapiens
caaaagcaaggga

SEQ ID NO: 1231775 - RNA, 15 nt, Homo sapiens
caaaagcacauauau

SEQ ID NO: 1231776 - RNA, 19 nt, Homo sapiens
caaaagccauaacuugaaa

SEQ ID NO: 1231777 - RNA, 13 nt, Homo sapiens
caaaagcccaaug

SEQ ID NO: 1231778 - RNA, 21 nt, Homo sapiens
caaaagcccaauguaaugcau

SEQ ID NO: 1231779 - RNA, 18 nt, Homo sapiens
caaaagcuagacagaucc

SEQ ID NO: 1231780 - RNA, 22 nt, Homo sapiens
caaaagcugggaaccagcaucu

SEQ ID NO: 1231781 - RNA, 20 nt, Homo sapiens
caaaagcuguaaauuacuau

SEQ ID NO: 1231782 - RNA, 20 nt, Homo sapiens
caaaagcuuauucaucuguu

SEQ ID NO: 1231783 - RNA, 15 nt, Homo sapiens
caaaagcuuuuuacu

SEQ ID NO: 1231784 - RNA, 17 nt, Homo sapiens
caaaaggaaaccaagug

SEQ ID NO: 1231785 - RNA, 18 nt, Homo sapiens
caaaaggccucuuguaaa

SEQ ID NO: 1231786 - RNA, 22 nt, Homo sapiens
caaaagucaccacuccauuccc

SEQ ID NO: 1231787 - RNA, 14 nt, Homo sapiens
caaaaguucccuga

SEQ ID NO: 1231788 - RNA, 21 nt, Homo sapiens
caaaaguuucuuacucaagga

SEQ ID NO: 1231789 - RNA, 22 nt, Homo sapiens
caaaaguuucuuacucaaggaa

SEQ ID NO: 1231790 - RNA, 20 nt, Homo sapiens
caaaauaaaaagugacacag

SEQ ID NO: 1231791 - RNA, 18 nt, Homo sapiens
caaaauacagcacuuuga

SEQ ID NO: 1231792 - RNA, 18 nt, Homo sapiens
caaaauagacaauuugca

SEQ ID NO: 1231793 - RNA, 16 nt, Homo sapiens
caaaauauguuuaaaa

SEQ ID NO: 1231794 - RNA, 16 nt, Homo sapiens
caaaauauuuuuugca

SEQ ID NO: 1231795 - RNA, 17 nt, Homo sapiens
caaaaucccuauuuaau

SEQ ID NO: 1231796 - RNA, 12 nt, Homo sapiens
caaaaucucuac

SEQ ID NO: 1231797 - RNA, 20 nt, Homo sapiens
caaaaugaacacaucuugag

SEQ ID NO: 1231798 - RNA, 18 nt, Homo sapiens
caaaaugaauucugggaa

SEQ ID NO: 1231799 - RNA, 19 nt, Homo sapiens
caaaaugucuaagauagua

SEQ ID NO: 1231800 - RNA, 15 nt, Homo sapiens
caaaauuaauaugau

SEQ ID NO: 1231801 - RNA, 16 nt, Homo sapiens
caaaauuacacaguua

SEQ ID NO: 1231802 - RNA, 22 nt, Homo sapiens
caaaauuacauguuaauuucca

SEQ ID NO: 1231803 - RNA, 15 nt, Homo sapiens
caaaauuuccaguac

SEQ ID NO: 1231804 - RNA, 14 nt, Homo sapiens
caaacaaccugccc

SEQ ID NO: 1231805 - RNA, 12 nt, Homo sapiens
caaacaaugaaa

SEQ ID NO: 1231806 - RNA, 17 nt, Homo sapiens
caaacacuccacccucc

SEQ ID NO: 1231807 - RNA, 23 nt, Homo sapiens
caaacacugcagaacagcaucau

SEQ ID NO: 1231808 - RNA, 17 nt, Homo sapiens
caaacagaacugcaguc

SEQ ID NO: 1231809 - RNA, 18 nt, Homo sapiens
caaacagggcaaaguguu

SEQ ID NO: 1231810 - RNA, 15 nt, Homo sapiens
caaacaggguuugau

SEQ ID NO: 1231811 - RNA, 20 nt, Homo sapiens
caaacaggguuugauagcac

SEQ ID NO: 1231812 - RNA, 22 nt, Homo sapiens
caaacauauccuuucaagacag

SEQ ID NO: 1231813 - RNA, 10 nt, Homo sapiens
caaaccacaa

SEQ ID NO: 1231814 - RNA, 15 nt, Homo sapiens
caaaccacaacugac

SEQ ID NO: 1231815 - RNA, 15 nt, Homo sapiens
caaaccagacaccug

SEQ ID NO: 1231816 - RNA, 14 nt, Homo sapiens
caaacccagucuca

SEQ ID NO: 1231817 - RNA, 16 nt, Homo sapiens
caaaccccgaccaccu

SEQ ID NO: 1231818 - RNA, 16 nt, Homo sapiens
caaaccgagugcaaug

SEQ ID NO: 1231819 - RNA, 15 nt, Homo sapiens
caaaccuaccaaaau

SEQ ID NO: 1231820 - RNA, 14 nt, Homo sapiens
caaaccucaucuuu

SEQ ID NO: 1231821 - RNA, 21 nt, Homo sapiens
caaaccucuaaccgacauucc

SEQ ID NO: 1231822 - RNA, 23 nt, Homo sapiens
caaaccuguucaucuugccaaga

SEQ ID NO: 1231823 - RNA, 19 nt, Homo sapiens
caaacuaacaggaacaaaa

SEQ ID NO: 1231824 - RNA, 18 nt, Homo sapiens
caaacuacagaauaaugu

SEQ ID NO: 1231825 - RNA, 16 nt, Homo sapiens
caaacuacauguaauc

SEQ ID NO: 1231826 - RNA, 18 nt, Homo sapiens
caaacucacugcucaaga

SEQ ID NO: 1231827 - RNA, 22 nt, Homo sapiens
caaacuccuagguucacuuugg

SEQ ID NO: 1231828 - RNA, 12 nt, Homo sapiens
caaacugcaaua

SEQ ID NO: 1231829 - RNA, 15 nt, Homo sapiens
caaacugcuucccuu

SEQ ID NO: 1231830 - RNA, 23 nt, Homo sapiens
caaacuggggccuccagaacuca

SEQ ID NO: 1231831 - RNA, 21 nt, Homo sapiens
caaacuggggccucccugguc

SEQ ID NO: 1231832 - RNA, 20 nt, Homo sapiens
caaagaaaaauaacccuuug

SEQ ID NO: 1231833 - RNA, 14 nt, Homo sapiens
caaagaaaguguau

SEQ ID NO: 1231834 - RNA, 18 nt, Homo sapiens
caaagaaaugcugaugga

SEQ ID NO: 1231835 - RNA, 14 nt, Homo sapiens
caaagaacuacccc

SEQ ID NO: 1231836 - RNA, 20 nt, Homo sapiens
caaagaaggaauucuaggca

SEQ ID NO: 1231837 - RNA, 21 nt, Homo sapiens
caaagaauuucuucaguccag

SEQ ID NO: 1231838 - RNA, 16 nt, Homo sapiens
caaagaccgauugcau

SEQ ID NO: 1231839 - RNA, 15 nt, Homo sapiens
caaagaccuaccucc

SEQ ID NO: 1231840 - RNA, 20 nt, Homo sapiens
caaagaugcccccuccagga

SEQ ID NO: 1231841 - RNA, 23 nt, Homo sapiens
caaagcaaguuucaucagucaau

SEQ ID NO: 1231842 - RNA, 18 nt, Homo sapiens
caaagcacaguuugaaca

SEQ ID NO: 1231843 - RNA, 18 nt, Homo sapiens
caaagcacgaaauguuau

SEQ ID NO: 1231844 - RNA, 19 nt, Homo sapiens
caaagcaguagucaaggag

SEQ ID NO: 1231845 - RNA, 19 nt, Homo sapiens
caaagcauuuucauuucua

SEQ ID NO: 1231846 - RNA, 18 nt, Homo sapiens
caaagccaccacauuuag

SEQ ID NO: 1231847 - RNA, 14 nt, Homo sapiens
caaagccuuuccag

SEQ ID NO: 1231848 - RNA, 22 nt, Homo sapiens
caaagcggucccugucccucua

SEQ ID NO: 1231849 - RNA, 23 nt, Homo sapiens
caaagcguuucuuuacuucucac

SEQ ID NO: 1231850 - RNA, 22 nt, Homo sapiens
caaagcugaugacaacuuccca

SEQ ID NO: 1231851 - RNA, 16 nt, Homo sapiens
caaagcuuaugugaca

SEQ ID NO: 1231852 - RNA, 17 nt, Homo sapiens
caaagcuugucaaagau

SEQ ID NO: 1231853 - RNA, 23 nt, Homo sapiens
caaagcuuuccuguuuccagggu

SEQ ID NO: 1231854 - RNA, 20 nt, Homo sapiens
caaaggacagaguaugaaca

SEQ ID NO: 1231855 - RNA, 15 nt, Homo sapiens
caaaggagucaggac

SEQ ID NO: 1231856 - RNA, 23 nt, Homo sapiens
caaaggcacugaggcccagggag

SEQ ID NO: 1231857 - RNA, 16 nt, Homo sapiens
caaaggcccucaguga

SEQ ID NO: 1231858 - RNA, 16 nt, Homo sapiens
caaaggcgacaauaaa

SEQ ID NO: 1231859 - RNA, 20 nt, Homo sapiens
caaagggccagcagucuacc

SEQ ID NO: 1231860 - RNA, 20 nt, Homo sapiens
caaaguaaaggccuccuccc

SEQ ID NO: 1231861 - RNA, 11 nt, Homo sapiens
caaaguaauag

SEQ ID NO: 1231862 - RNA, 20 nt, Homo sapiens
caaaguaccacacugaguuc

SEQ ID NO: 1231863 - RNA, 15 nt, Homo sapiens
caaaguagcaauuuc

SEQ ID NO: 1231864 - RNA, 16 nt, Homo sapiens
caaagucaaaaauagc

SEQ ID NO: 1231865 - RNA, 15 nt, Homo sapiens
caaagucaucaaaga

SEQ ID NO: 1231866 - RNA, 17 nt, Homo sapiens
caaaguccacacaaaga

SEQ ID NO: 1231867 - RNA, 20 nt, Homo sapiens
caaaguccuuuuuuuccauc

SEQ ID NO: 1231868 - RNA, 18 nt, Homo sapiens
caaagucugugugaugaa

SEQ ID NO: 1231869 - RNA, 17 nt, Homo sapiens
caaagugcggcugccau

SEQ ID NO: 1231870 - RNA, 17 nt, Homo sapiens
caaagugcugcgauuac

SEQ ID NO: 1231871 - RNA, 21 nt, Homo sapiens
caaagugcugcuggaaguaga

SEQ ID NO: 1231872 - RNA, 17 nt, Homo sapiens
caaagugcuggaauuac

SEQ ID NO: 1231873 - RNA, 15 nt, Homo sapiens
caaaguguauacaug

SEQ ID NO: 1231874 - RNA, 13 nt, Homo sapiens
caaauaaacucca

SEQ ID NO: 1231875 - RNA, 16 nt, Homo sapiens
caaauaaagauaaccc

SEQ ID NO: 1231876 - RNA, 15 nt, Homo sapiens
caaauaaagugcagu

SEQ ID NO: 1231877 - RNA, 16 nt, Homo sapiens
caaauaaagugcaguu

SEQ ID NO: 1231878 - RNA, 15 nt, Homo sapiens
caaauaaaugagccc

SEQ ID NO: 1231879 - RNA, 18 nt, Homo sapiens
caaauaaaugagcccaca

SEQ ID NO: 1231880 - RNA, 12 nt, Homo sapiens
caaauaauagca

SEQ ID NO: 1231881 - RNA, 21 nt, Homo sapiens
caaauaauagcaaugguggug

SEQ ID NO: 1231882 - RNA, 21 nt, Homo sapiens
caaauacuguauauucaggac

SEQ ID NO: 1231883 - RNA, 21 nt, Homo sapiens
caaauacuuagagcagugaag

SEQ ID NO: 1231884 - RNA, 22 nt, Homo sapiens
caaauagaaccacuaugaagcu

SEQ ID NO: 1231885 - RNA, 18 nt, Homo sapiens
caaauagugcaacuauga

SEQ ID NO: 1231886 - RNA, 14 nt, Homo sapiens
caaauauaucugcu

SEQ ID NO: 1231887 - RNA, 16 nt, Homo sapiens
caaauauauuuuggaa

SEQ ID NO: 1231888 - RNA, 16 nt, Homo sapiens
caaauauuaccaaaaa

SEQ ID NO: 1231889 - RNA, 17 nt, Homo sapiens
caaaucacgaccacuga

SEQ ID NO: 1231890 - RNA, 18 nt, Homo sapiens
caaaucagaaacuuguga

SEQ ID NO: 1231891 - RNA, 15 nt, Homo sapiens
caaaucagcugcuac

SEQ ID NO: 1231892 - RNA, 21 nt, Homo sapiens
caaaucagcugcuacuacucc

SEQ ID NO: 1231893 - RNA, 15 nt, Homo sapiens
caaauccuuccaaaa

SEQ ID NO: 1231894 - RNA, 22 nt, Homo sapiens
caaaucuaaaguugcuccauac

SEQ ID NO: 1231895 - RNA, 22 nt, Homo sapiens
caaaucuccaguauucuuguca

SEQ ID NO: 1231896 - RNA, 13 nt, Homo sapiens
caaaucugaggga

SEQ ID NO: 1231897 - RNA, 16 nt, Homo sapiens
ucuguaaacuguguau

SEQ ID NO: 1231898 - RNA, 10 nt, Homo sapiens
ucuguacaau

SEQ ID NO: 1231899 - RNA, 12 nt, Homo sapiens
ucuguacuucca

SEQ ID NO: 1231900 - RNA, 14 nt, Homo sapiens
ucuguacuuccaau

SEQ ID NO: 1231901 - RNA, 19 nt, Homo sapiens
ucuguagcuuguucccugu

SEQ ID NO: 1231902 - RNA, 17 nt, Homo sapiens
ucuguaggaaacccaac

SEQ ID NO: 1231903 - RNA, 21 nt, Homo sapiens
ucuguaucauugauucaucaa

SEQ ID NO: 1231904 - RNA, 23 nt, Homo sapiens
ucuguauuuuaauggaguggaua

SEQ ID NO: 1231905 - RNA, 12 nt, Homo sapiens
ucugucaccagc

SEQ ID NO: 1231906 - RNA, 20 nt, Homo sapiens
ucugucacccuuguccuuga

SEQ ID NO: 1231907 - RNA, 18 nt, Homo sapiens
ucugucacguucuccaca

SEQ ID NO: 1231908 - RNA, 14 nt, Homo sapiens
ucugucagcugcaa

SEQ ID NO: 1231909 - RNA, 19 nt, Homo sapiens
ucugucauuuguugugaug

SEQ ID NO: 1231910 - RNA, 12 nt, Homo sapiens
ucuguccaggcc

SEQ ID NO: 1231911 - RNA, 14 nt, Homo sapiens
ucugucuacugugg

SEQ ID NO: 1231912 - RNA, 13 nt, Homo sapiens
ucugucuggcuga

SEQ ID NO: 1231913 - RNA, 21 nt, Homo sapiens
ucugucuucagcuguacauac

SEQ ID NO: 1231914 - RNA, 14 nt, Homo sapiens
ucugugaaaguaca

SEQ ID NO: 1231915 - RNA, 14 nt, Homo sapiens
ucugugaagaaaga

SEQ ID NO: 1231916 - RNA, 19 nt, Homo sapiens
ucugugaagacagguacca

SEQ ID NO: 1231917 - RNA, 14 nt, Homo sapiens
ucugugaaugcuaa

SEQ ID NO: 1231918 - RNA, 15 nt, Homo sapiens
ucugugacauacaua

SEQ ID NO: 1231919 - RNA, 21 nt, Homo sapiens
ucugugagacccccacaccuc

SEQ ID NO: 1231920 - RNA, 16 nt, Homo sapiens
ucugugcagucacugg

SEQ ID NO: 1231921 - RNA, 18 nt, Homo sapiens
ucugugcagucacuggag

SEQ ID NO: 1231922 - RNA, 14 nt, Homo sapiens
ucugugccccaugc

SEQ ID NO: 1231923 - RNA, 16 nt, Homo sapiens
ucugugccccaugccu

SEQ ID NO: 1231924 - RNA, 17 nt, Homo sapiens
ucaaaaaaucugaccaa

SEQ ID NO: 1231925 - RNA, 21 nt, Homo sapiens
ucaaaaagggaaguaagcaaa

SEQ ID NO: 1231926 - RNA, 19 nt, Homo sapiens
ucaaaacacacuacuaccu

SEQ ID NO: 1231927 - RNA, 12 nt, Homo sapiens
ucaaaacacugu

SEQ ID NO: 1231928 - RNA, 14 nt, Homo sapiens
ucaaaacacugugg

SEQ ID NO: 1231929 - RNA, 19 nt, Homo sapiens
ucaaaacagagaugugaua

SEQ ID NO: 1231930 - RNA, 14 nt, Homo sapiens
ucaaaacauuccaa

SEQ ID NO: 1231931 - RNA, 15 nt, Homo sapiens
ucaaaacauuccaag

SEQ ID NO: 1231932 - RNA, 17 nt, Homo sapiens
ucaaaacucaaauguga

SEQ ID NO: 1231933 - RNA, 23 nt, Homo sapiens
ucaaaacuggacagucacugcca

SEQ ID NO: 1231934 - RNA, 13 nt, Homo sapiens
ucaaaagaucaaa

SEQ ID NO: 1231935 - RNA, 17 nt, Homo sapiens
ucaaaagccagauguga

SEQ ID NO: 1231936 - RNA, 18 nt, Homo sapiens
ucaaaagccagaugugaa

SEQ ID NO: 1231937 - RNA, 16 nt, Homo sapiens
ucaaaagguagauccu

SEQ ID NO: 1231938 - RNA, 22 nt, Homo sapiens
ucaaaagguuaauaaaguaauu

SEQ ID NO: 1231939 - RNA, 18 nt, Homo sapiens
ucaaaauaaaaagugaca

SEQ ID NO: 1231940 - RNA, 22 nt, Homo sapiens
ucaaaauaaaaagugacacagc

SEQ ID NO: 1231941 - RNA, 16 nt, Homo sapiens
ucaaaauauacauuca

SEQ ID NO: 1231942 - RNA, 17 nt, Homo sapiens
ucaaaauauacauucaa

SEQ ID NO: 1231943 - RNA, 19 nt, Homo sapiens
ucaaaauccuuccaaagaa

SEQ ID NO: 1231944 - RNA, 24 nt, Homo sapiens
ucaaaaugucuaagauaguaacaa

SEQ ID NO: 1231945 - RNA, 14 nt, Homo sapiens
ucaaacauuucaaa

SEQ ID NO: 1231946 - RNA, 12 nt, Homo sapiens
ucaaacucccua

SEQ ID NO: 1231947 - RNA, 17 nt, Homo sapiens
ucaaacugcaugauuca

SEQ ID NO: 1231948 - RNA, 21 nt, Homo sapiens
ucaaacugcaugauucaugcc

SEQ ID NO: 1231949 - RNA, 14 nt, Homo sapiens
ucaaagaaagugua

SEQ ID NO: 1231950 - RNA, 22 nt, Homo sapiens
ucaaagaaaguguauugguuua

SEQ ID NO: 1231951 - RNA, 13 nt, Homo sapiens
ucaaagacagaga

SEQ ID NO: 1231952 - RNA, 14 nt, Homo sapiens
ucaaagacuguauu

SEQ ID NO: 1231953 - RNA, 14 nt, Homo sapiens
ucaaagaggccuua

SEQ ID NO: 1231954 - RNA, 23 nt, Homo sapiens
ucaaagauguguugcuauccuga

SEQ ID NO: 1231955 - RNA, 20 nt, Homo sapiens
ucaaagcacagaauuuguca

SEQ ID NO: 1231956 - RNA, 22 nt, Homo sapiens
ucaaagcaggaauugguggcag

SEQ ID NO: 1231957 - RNA, 12 nt, Homo sapiens
ucaaagcaguag

SEQ ID NO: 1231958 - RNA, 13 nt, Homo sapiens
ucaaagccuucuc

SEQ ID NO: 1231959 - RNA, 16 nt, Homo sapiens
ucaaagccuugguuua

SEQ ID NO: 1231960 - RNA, 21 nt, Homo sapiens
ucaaagcuaaauuccacacua

SEQ ID NO: 1231961 - RNA, 15 nt, Homo sapiens
ucaaaggaagacuug

SEQ ID NO: 1231962 - RNA, 15 nt, Homo sapiens
ugaaauuacugugua

SEQ ID NO: 1231963 - RNA, 20 nt, Homo sapiens
ugaaauuauguauguuuaca

SEQ ID NO: 1231964 - RNA, 15 nt, Homo sapiens
ugaaauuguaucuca

SEQ ID NO: 1231965 - RNA, 14 nt, Homo sapiens
ugaaauugucaaag

SEQ ID NO: 1231966 - RNA, 16 nt, Homo sapiens
ugaaauuuauucacau

SEQ ID NO: 1231967 - RNA, 18 nt, Homo sapiens
ugaaauuucuuguucaua

SEQ ID NO: 1231968 - RNA, 13 nt, Homo sapiens
ugaaauuuuaccg

SEQ ID NO: 1231969 - RNA, 21 nt, Homo sapiens
ugaacaaaauguaaagccagc

SEQ ID NO: 1231970 - RNA, 21 nt, Homo sapiens
ugaacaaagugaggagaauga

SEQ ID NO: 1231971 - RNA, 22 nt, Homo sapiens
ugaacaaaucaaauugcuuaaa

SEQ ID NO: 1231972 - RNA, 20 nt, Homo sapiens
ugaacaaucaaagcacuugg

SEQ ID NO: 1231973 - RNA, 17 nt, Homo sapiens
ugaacacaggcagcuuu

SEQ ID NO: 1231974 - RNA, 20 nt, Homo sapiens
ugaacacucuuuugcuuuau

SEQ ID NO: 1231975 - RNA, 11 nt, Homo sapiens
ugaacagaauu

SEQ ID NO: 1231976 - RNA, 21 nt, Homo sapiens
ugaacagaccggagaggacag

SEQ ID NO: 1231977 - RNA, 20 nt, Homo sapiens
ugaacagcucaccacugugc

SEQ ID NO: 1231978 - RNA, 22 nt, Homo sapiens
ugaacaucccuuuuucaaugaa

SEQ ID NO: 1231979 - RNA, 18 nt, Homo sapiens
ugaacaugugaaguuaua

SEQ ID NO: 1231980 - RNA, 19 nt, Homo sapiens
ugaacauucgaccuccauu

SEQ ID NO: 1231981 - RNA, 12 nt, Homo sapiens
ugaacauuugcu

SEQ ID NO: 1231982 - RNA, 12 nt, Homo sapiens
ugaaccaaagaa

SEQ ID NO: 1231983 - RNA, 17 nt, Homo sapiens
ugaaccauguguggcaa

SEQ ID NO: 1231984 - RNA, 15 nt, Homo sapiens
ugaacccuugugcuu

SEQ ID NO: 1231985 - RNA, 14 nt, Homo sapiens
ugaaccgcacagcu

SEQ ID NO: 1231986 - RNA, 16 nt, Homo sapiens
ugaaccgcacagcuca

SEQ ID NO: 1231987 - RNA, 13 nt, Homo sapiens
ugaaccuguauaa

SEQ ID NO: 1231988 - RNA, 10 nt, Homo sapiens
ugaaccugug

SEQ ID NO: 1231989 - RNA, 14 nt, Homo sapiens
ugaaccuuguuuaa

SEQ ID NO: 1231990 - RNA, 19 nt, Homo sapiens
ugaacuacauaacuuccua

SEQ ID NO: 1231991 - RNA, 14 nt, Homo sapiens
ugaacuaccaucug

SEQ ID NO: 1231992 - RNA, 16 nt, Homo sapiens
ugaacuagccaaucag

SEQ ID NO: 1231993 - RNA, 14 nt, Homo sapiens
ugaacuaugagucu

SEQ ID NO: 1231994 - RNA, 16 nt, Homo sapiens
ugaacucacccuggga

SEQ ID NO: 1231995 - RNA, 21 nt, Homo sapiens
ugaacuccuggccucaaguga

SEQ ID NO: 1231996 - RNA, 21 nt, Homo sapiens
ugaacucugguggcacaggag

SEQ ID NO: 1231997 - RNA, 12 nt, Homo sapiens
ugaacucuuaga

SEQ ID NO: 1231998 - RNA, 22 nt, Homo sapiens
ugaacucuuucuggccugccuu

SEQ ID NO: 1231999 - RNA, 21 nt, Homo sapiens
ugaacugcuucuccaaggaca

SEQ ID NO: 1232000 - RNA, 11 nt, Homo sapiens
ugaacuggaag

SEQ ID NO: 1232001 - RNA, 13 nt, Homo sapiens
ugaacuugccuua

SEQ ID NO: 1232002 - RNA, 21 nt, Homo sapiens
ugaacuuuuuaagaugaggca

SEQ ID NO: 1232003 - RNA, 15 nt, Homo sapiens
ugaagaaaagcacuu

SEQ ID NO: 1232004 - RNA, 22 nt, Homo sapiens
ugaagaacuggaaccccagcuu

SEQ ID NO: 1232005 - RNA, 21 nt, Homo sapiens
ugaagaacuuggcacacucuc

SEQ ID NO: 1232006 - RNA, 17 nt, Homo sapiens
ugaagaagauaugugaa

SEQ ID NO: 1232007 - RNA, 17 nt, Homo sapiens
ugaagacugaggacaaa

SEQ ID NO: 1232008 - RNA, 12 nt, Homo sapiens
ugaagacugggu

SEQ ID NO: 1232009 - RNA, 14 nt, Homo sapiens
ugaagagauuucaa

SEQ ID NO: 1232010 - RNA, 19 nt, Homo sapiens
ugaagagauuucaacaaga

SEQ ID NO: 1232011 - RNA, 15 nt, Homo sapiens
ugaagagcuauuaua

SEQ ID NO: 1232012 - RNA, 17 nt, Homo sapiens
ugaagaguaguuuacua

SEQ ID NO: 1232013 - RNA, 20 nt, Homo sapiens
ugaagagugacuaguacaaa

SEQ ID NO: 1232014 - RNA, 19 nt, Homo sapiens
ugaagagugagagggcaug

SEQ ID NO: 1232015 - RNA, 19 nt, Homo sapiens
ugaagaugaagaagccuuu

SEQ ID NO: 1232016 - RNA, 16 nt, Homo sapiens
ugaagcaaaucagaaa

SEQ ID NO: 1232017 - RNA, 13 nt, Homo sapiens
ugaagcacaucaa

SEQ ID NO: 1232018 - RNA, 21 nt, Homo sapiens
ugaagcagguggagggcauca

SEQ ID NO: 1232019 - RNA, 16 nt, Homo sapiens
ugaagcagucuugcuc

SEQ ID NO: 1232020 - RNA, 17 nt, Homo sapiens
ugaagcagucuugcucu

SEQ ID NO: 1232021 - RNA, 15 nt, Homo sapiens
ugaagccaaagggac

SEQ ID NO: 1232022 - RNA, 22 nt, Homo sapiens
ugaagcccaggcugaugcuuga

SEQ ID NO: 1232023 - RNA, 22 nt, Homo sapiens
ugaagcccuccaaaagcacuua

SEQ ID NO: 1232024 - RNA, 17 nt, Homo sapiens
ugaagccucagcuaccc

SEQ ID NO: 1232025 - RNA, 18 nt, Homo sapiens
ugaagcguuuuucucaaa

SEQ ID NO: 1232026 - RNA, 20 nt, Homo sapiens
ugaagcuuucuuuccuacac

SEQ ID NO: 1232027 - RNA, 22 nt, Homo sapiens
ugaaggaagagaagacauuugc

SEQ ID NO: 1232028 - RNA, 16 nt, Homo sapiens
ugaaggagcagcauug

SEQ ID NO: 1232029 - RNA, 23 nt, Homo sapiens
ugaaggaggggguucuuccucac

SEQ ID NO: 1232030 - RNA, 16 nt, Homo sapiens
ugaaggauuacucucc

SEQ ID NO: 1232031 - RNA, 14 nt, Homo sapiens
ugaaggcauaugca

SEQ ID NO: 1232032 - RNA, 13 nt, Homo sapiens
ugaaggcugagug

SEQ ID NO: 1232033 - RNA, 15 nt, Homo sapiens
ugaaggcuuacuuca

SEQ ID NO: 1232034 - RNA, 20 nt, Homo sapiens
ugaagguuuuaagugguuug

SEQ ID NO: 1232035 - RNA, 14 nt, Homo sapiens
ugaaguacauauua

SEQ ID NO: 1232036 - RNA, 18 nt, Homo sapiens
ugaaguaggcauauauca

SEQ ID NO: 1232037 - RNA, 20 nt, Homo sapiens
ugaaguaggugugacuugaa

SEQ ID NO: 1232038 - RNA, 18 nt, Homo sapiens
ugaagucaccgggaugaa

SEQ ID NO: 1232039 - RNA, 15 nt, Homo sapiens
ugaagugcgugaaug

SEQ ID NO: 1232040 - RNA, 16 nt, Homo sapiens
ugaagugcuguggcug

SEQ ID NO: 1232041 - RNA, 12 nt, Homo sapiens
ugaagugucaca

SEQ ID NO: 1232042 - RNA, 16 nt, Homo sapiens
ugaaguuaugcuguca

SEQ ID NO: 1232043 - RNA, 15 nt, Homo sapiens
ugaaguuuaaacucu

SEQ ID NO: 1232044 - RNA, 15 nt, Homo sapiens
ugaaguuucacauga

SEQ ID NO: 1232045 - RNA, 18 nt, Homo sapiens
ugaaguuugugggggcca

SEQ ID NO: 1232046 - RNA, 14 nt, Homo sapiens
ugaaguuuuacugu

SEQ ID NO: 1232047 - RNA, 17 nt, Homo sapiens
ugaauaaauccaaaaca

SEQ ID NO: 1232048 - RNA, 19 nt, Homo sapiens
ugaauaagcuuucucucag

SEQ ID NO: 1232049 - RNA, 19 nt, Homo sapiens
ugaauaccacuuaccucaa

SEQ ID NO: 1232050 - RNA, 13 nt, Homo sapiens
ugaauacugggaa

SEQ ID NO: 1232051 - RNA, 22 nt, Homo sapiens
ugaauagcacaggugaccccua

SEQ ID NO: 1232052 - RNA, 21 nt, Homo sapiens
ugaauauaaauguuuuacuca

SEQ ID NO: 1232053 - RNA, 14 nt, Homo sapiens
ugaauaugccacuu

SEQ ID NO: 1232054 - RNA, 21 nt, Homo sapiens
ugaauauuuuuuuuuugccaa

SEQ ID NO: 1232055 - RNA, 12 nt, Homo sapiens
ugaaucaaugaa

SEQ ID NO: 1232056 - RNA, 20 nt, Homo sapiens
ugaaucauauucauaugcag

SEQ ID NO: 1232057 - RNA, 18 nt, Homo sapiens
ugaauccucaugaggcuu

SEQ ID NO: 1232058 - RNA, 18 nt, Homo sapiens
ugaauccucuucuuuaua

SEQ ID NO: 1232059 - RNA, 12 nt, Homo sapiens
ugaaucuucaca

SEQ ID NO: 1232060 - RNA, 16 nt, Homo sapiens
ugaaugaacaaaugaa

SEQ ID NO: 1232061 - RNA, 20 nt, Homo sapiens
ugaaugaacacucuuuugcu

SEQ ID NO: 1232062 - RNA, 15 nt, Homo sapiens
ugaaugaaugagcca

SEQ ID NO: 1232063 - RNA, 21 nt, Homo sapiens
ugaaugacacgccuaagguca

SEQ ID NO: 1232064 - RNA, 16 nt, Homo sapiens
ugaaugagagguuccu

SEQ ID NO: 1232065 - RNA, 16 nt, Homo sapiens
ugaaugagccaaagaa

SEQ ID NO: 1232066 - RNA, 20 nt, Homo sapiens
ugaaugagccaaagaacaaa

SEQ ID NO: 1232067 - RNA, 12 nt, Homo sapiens
ugaaugaugcuu

SEQ ID NO: 1232068 - RNA, 22 nt, Homo sapiens
guuuacccucaacccuauucau

SEQ ID NO: 1232069 - RNA, 21 nt, Homo sapiens
guuuacuucaaauuaacucua

SEQ ID NO: 1232070 - RNA, 17 nt, Homo sapiens
guuuagauuucaagaaa

SEQ ID NO: 1232071 - RNA, 15 nt, Homo sapiens
guuuagcagaacuca

SEQ ID NO: 1232072 - RNA, 18 nt, Homo sapiens
guuuagccaaaggauaag

SEQ ID NO: 1232073 - RNA, 19 nt, Homo sapiens
guuuauacccguuucacau

SEQ ID NO: 1232074 - RNA, 13 nt, Homo sapiens
guuuaucacacag

SEQ ID NO: 1232075 - RNA, 14 nt, Homo sapiens
guuuaucacacagu

SEQ ID NO: 1232076 - RNA, 13 nt, Homo sapiens
guuuaugaaugac

SEQ ID NO: 1232077 - RNA, 19 nt, Homo sapiens
guuuauuaaaaaaauggaa

SEQ ID NO: 1232078 - RNA, 18 nt, Homo sapiens
guuuauuaaauugcaaga

SEQ ID NO: 1232079 - RNA, 16 nt, Homo sapiens
guuuauugaaugugau

SEQ ID NO: 1232080 - RNA, 14 nt, Homo sapiens
guuuauuugcacua

SEQ ID NO: 1232081 - RNA, 19 nt, Homo sapiens
guuuauuuuuauacuuuca

SEQ ID NO: 1232082 - RNA, 23 nt, Homo sapiens
guuucaaaaaaucugaccaaaac

SEQ ID NO: 1232083 - RNA, 23 nt, Homo sapiens
guuucaaguuauucaaauuugua

SEQ ID NO: 1232084 - RNA, 17 nt, Homo sapiens
guuucacacuagucaca

SEQ ID NO: 1232085 - RNA, 17 nt, Homo sapiens
guuucaccguguuagcc

SEQ ID NO: 1232086 - RNA, 14 nt, Homo sapiens
guuucaugaaauga

SEQ ID NO: 1232087 - RNA, 21 nt, Homo sapiens
guuucauuuagucaugugacc

SEQ ID NO: 1232088 - RNA, 19 nt, Homo sapiens
guuuccaauaaacgcaagc

SEQ ID NO: 1232089 - RNA, 19 nt, Homo sapiens
guuuccaucagguuccauc

SEQ ID NO: 1232090 - RNA, 17 nt, Homo sapiens
guuucccauaauuuucu

SEQ ID NO: 1232091 - RNA, 20 nt, Homo sapiens
guuucccccuucuacauuuc

SEQ ID NO: 1232092 - RNA, 21 nt, Homo sapiens
guuuccuauuugcaguuacuu

SEQ ID NO: 1232093 - RNA, 16 nt, Homo sapiens
guuuccucauuccuga

SEQ ID NO: 1232094 - RNA, 12 nt, Homo sapiens
guuuccugguca

SEQ ID NO: 1232095 - RNA, 17 nt, Homo sapiens
guuuccuucugacuuaa

SEQ ID NO: 1232096 - RNA, 21 nt, Homo sapiens
guuuccuuuuggaacauuucu

SEQ ID NO: 1232097 - RNA, 19 nt, Homo sapiens
guuucuaaaguguuggcaa

SEQ ID NO: 1232098 - RNA, 17 nt, Homo sapiens
guuucuaggcaccucag

SEQ ID NO: 1232099 - RNA, 14 nt, Homo sapiens
guuucuauacaaau

SEQ ID NO: 1232100 - RNA, 20 nt, Homo sapiens
guuucuauucuaaguaauuc

SEQ ID NO: 1232101 - RNA, 17 nt, Homo sapiens
guuucugguggucuguu

SEQ ID NO: 1232102 - RNA, 16 nt, Homo sapiens
guuucuuaaauggaau

SEQ ID NO: 1232103 - RNA, 15 nt, Homo sapiens
guuucuugacaagcu

SEQ ID NO: 1232104 - RNA, 10 nt, Homo sapiens
guuucuugcc

SEQ ID NO: 1232105 - RNA, 20 nt, Homo sapiens
guuucuugcuuggaagccag

SEQ ID NO: 1232106 - RNA, 12 nt, Homo sapiens
guuucuuucuag

SEQ ID NO: 1232107 - RNA, 23 nt, Homo sapiens
guuucuuucuaguggucuuugua

SEQ ID NO: 1232108 - RNA, 20 nt, Homo sapiens
guuugaaaaagcagacagaa

SEQ ID NO: 1232109 - RNA, 21 nt, Homo sapiens
guuugaaaauauuuuguugcc

SEQ ID NO: 1232110 - RNA, 15 nt, Homo sapiens
guuugaacucuguaa

SEQ ID NO: 1232111 - RNA, 22 nt, Homo sapiens
guuugacccaggggucagccuu

SEQ ID NO: 1232112 - RNA, 18 nt, Homo sapiens
guuugaccucauuuguaa

SEQ ID NO: 1232113 - RNA, 18 nt, Homo sapiens
guuugacgacagugcauu

SEQ ID NO: 1232114 - RNA, 21 nt, Homo sapiens
guuugaucauuucuugugaug

SEQ ID NO: 1232115 - RNA, 23 nt, Homo sapiens
guuugaucccuguuacccagaga

SEQ ID NO: 1232116 - RNA, 12 nt, Homo sapiens
guuugauguaug

SEQ ID NO: 1232117 - RNA, 15 nt, Homo sapiens
guuugauucagcaaa

SEQ ID NO: 1232118 - RNA, 14 nt, Homo sapiens
guuugcuagcagaa

SEQ ID NO: 1232119 - RNA, 23 nt, Homo sapiens
guuugcucuuuuaagcagucuca

SEQ ID NO: 1232120 - RNA, 21 nt, Homo sapiens
guuuggcuagguaucauucaa

SEQ ID NO: 1232121 - RNA, 21 nt, Homo sapiens
guuugguaguuagccaucuaa

SEQ ID NO: 1232122 - RNA, 15 nt, Homo sapiens
guuugguguguuccc

SEQ ID NO: 1232123 - RNA, 17 nt, Homo sapiens
guuuguaagacuuacaa

SEQ ID NO: 1232124 - RNA, 14 nt, Homo sapiens
guuuguaugagaug

SEQ ID NO: 1232125 - RNA, 22 nt, Homo sapiens
guuugucacacgauaaagggau

SEQ ID NO: 1232126 - RNA, 16 nt, Homo sapiens
guuugucagacuuuaa

SEQ ID NO: 1232127 - RNA, 17 nt, Homo sapiens
guuuguuauaucaggga

SEQ ID NO: 1232128 - RNA, 22 nt, Homo sapiens
guuuguugaugugaaacauuau

SEQ ID NO: 1232129 - RNA, 17 nt, Homo sapiens
guuuguuucauauauac

SEQ ID NO: 1232130 - RNA, 15 nt, Homo sapiens
guuuuaaacauuaau

SEQ ID NO: 1232131 - RNA, 15 nt, Homo sapiens
guuuuaaacuugccu

SEQ ID NO: 1232132 - RNA, 12 nt, Homo sapiens
guuuuaacugua

SEQ ID NO: 1232133 - RNA, 17 nt, Homo sapiens
guuuuaacuuccagugg

SEQ ID NO: 1232134 - RNA, 22 nt, Homo sapiens
guuuuaagaggcagggucucac

SEQ ID NO: 1232135 - RNA, 20 nt, Homo sapiens
guuuuaauuugucacucgga

SEQ ID NO: 1232136 - RNA, 18 nt, Homo sapiens
guuuuacaaugucauaua

SEQ ID NO: 1232137 - RNA, 23 nt, Homo sapiens
guuuuaccaucugcauccagccu

SEQ ID NO: 1232138 - RNA, 13 nt, Homo sapiens
guuuuacuuuuaa

SEQ ID NO: 1232139 - RNA, 18 nt, Homo sapiens
guuuuagcacccccaugg

SEQ ID NO: 1232140 - RNA, 21 nt, Homo sapiens
guuuuauucugacuuccucug

SEQ ID NO: 1232141 - RNA, 19 nt, Homo sapiens
guuuucaggacaacacuuc

SEQ ID NO: 1232142 - RNA, 23 nt, Homo sapiens
guuuuccaguucaucgauuuucu

SEQ ID NO: 1232143 - RNA, 14 nt, Homo sapiens
guuuucccaaagag

SEQ ID NO: 1232144 - RNA, 16 nt, Homo sapiens
guuuugaaaugcagaa

SEQ ID NO: 1232145 - RNA, 20 nt, Homo sapiens
guuuugauuuguagcacuga

SEQ ID NO: 1232146 - RNA, 16 nt, Homo sapiens
guuuuguacacugcug

SEQ ID NO: 1232147 - RNA, 15 nt, Homo sapiens
uauccaaaccaaaua

SEQ ID NO: 1232148 - RNA, 14 nt, Homo sapiens
uauccaaguuggac

SEQ ID NO: 1232149 - RNA, 18 nt, Homo sapiens
uauccaauaggcauuuga

SEQ ID NO: 1232150 - RNA, 19 nt, Homo sapiens
uauccaauaggcauuugau

SEQ ID NO: 1232151 - RNA, 18 nt, Homo sapiens
uauccagcagaucauuua

SEQ ID NO: 1232152 - RNA, 17 nt, Homo sapiens
uauccauccucugagau

SEQ ID NO: 1232153 - RNA, 16 nt, Homo sapiens
uauccccacuacucaa

SEQ ID NO: 1232154 - RNA, 17 nt, Homo sapiens
uaucccgagucugggac

SEQ ID NO: 1232155 - RNA, 19 nt, Homo sapiens
uauccuagucauucuuccc

SEQ ID NO: 1232156 - RNA, 18 nt, Homo sapiens
uauccugacuucuaauau

SEQ ID NO: 1232157 - RNA, 15 nt, Homo sapiens
uauccuguauucuug

SEQ ID NO: 1232158 - RNA, 14 nt, Homo sapiens
uauccugugcuuga

SEQ ID NO: 1232159 - RNA, 14 nt, Homo sapiens
uauccuugucugaa

SEQ ID NO: 1232160 - RNA, 15 nt, Homo sapiens
uauccuuucuaacaa

SEQ ID NO: 1232161 - RNA, 18 nt, Homo sapiens
uauccuuucuaacaaaaa

SEQ ID NO: 1232162 - RNA, 22 nt, Homo sapiens
uaucggagacagugaucuccau

SEQ ID NO: 1232163 - RNA, 15 nt, Homo sapiens
uaucgggaacagugu

SEQ ID NO: 1232164 - RNA, 17 nt, Homo sapiens
uaucgggaacaguguuu

SEQ ID NO: 1232165 - RNA, 12 nt, Homo sapiens
uaucuacuacaa

SEQ ID NO: 1232166 - RNA, 16 nt, Homo sapiens
uaucuauguagaauau

SEQ ID NO: 1232167 - RNA, 23 nt, Homo sapiens
uaucuauuugagauugaugacaa

SEQ ID NO: 1232168 - RNA, 23 nt, Homo sapiens
uaucucauuuuacacaaagggaa

SEQ ID NO: 1232169 - RNA, 14 nt, Homo sapiens
uaucugaggucaca

SEQ ID NO: 1232170 - RNA, 21 nt, Homo sapiens
uaucuggccuaaaaucuugga

SEQ ID NO: 1232171 - RNA, 19 nt, Homo sapiens
uaucugugucaaaagccag

SEQ ID NO: 1232172 - RNA, 14 nt, Homo sapiens
uaucuguucuugcu

SEQ ID NO: 1232173 - RNA, 16 nt, Homo sapiens
uaucuguuuacaucca

SEQ ID NO: 1232174 - RNA, 11 nt, Homo sapiens
uaucuuaccug

SEQ ID NO: 1232175 - RNA, 15 nt, Homo sapiens
uaucuucacuuuuau

SEQ ID NO: 1232176 - RNA, 17 nt, Homo sapiens
uaucuucuuuugaacaa

SEQ ID NO: 1232177 - RNA, 14 nt, Homo sapiens
uaucuuugugauaa

SEQ ID NO: 1232178 - RNA, 20 nt, Homo sapiens
uaugaaaacagcuaucucac

SEQ ID NO: 1232179 - RNA, 15 nt, Homo sapiens
uaugaaaaucuccau

SEQ ID NO: 1232180 - RNA, 16 nt, Homo sapiens
uaugaaauccuugacu

SEQ ID NO: 1232181 - RNA, 13 nt, Homo sapiens
uaugaacuuuaua

SEQ ID NO: 1232182 - RNA, 19 nt, Homo sapiens
uaugaagcuuucuuuccua

SEQ ID NO: 1232183 - RNA, 20 nt, Homo sapiens
uaugaagugacucucacaag

SEQ ID NO: 1232184 - RNA, 15 nt, Homo sapiens
uaugaauaauugcau

SEQ ID NO: 1232185 - RNA, 14 nt, Homo sapiens
uaugaauauuacuc

SEQ ID NO: 1232186 - RNA, 22 nt, Homo sapiens
uaugaauauuuauaacagcauu

SEQ ID NO: 1232187 - RNA, 18 nt, Homo sapiens
ucacauuuauucugcuca

SEQ ID NO: 1232188 - RNA, 19 nt, Homo sapiens
ucacauuuauucugcucac

SEQ ID NO: 1232189 - RNA, 16 nt, Homo sapiens
ucaccacaugugcaca

SEQ ID NO: 1232190 - RNA, 14 nt, Homo sapiens
ucaccagagcauuu

SEQ ID NO: 1232191 - RNA, 18 nt, Homo sapiens
ucaccagccccacugcca

SEQ ID NO: 1232192 - RNA, 18 nt, Homo sapiens
ucaccagcuaucugucau

SEQ ID NO: 1232193 - RNA, 21 nt, Homo sapiens
ucaccaggagcccggcuucca

SEQ ID NO: 1232194 - RNA, 14 nt, Homo sapiens
ucaccaggggagga

SEQ ID NO: 1232195 - RNA, 19 nt, Homo sapiens
ucaccaggggaggagccug

SEQ ID NO: 1232196 - RNA, 21 nt, Homo sapiens
ucaccagucugucuacugugg

SEQ ID NO: 1232197 - RNA, 19 nt, Homo sapiens
ucaccaguguccccuccac

SEQ ID NO: 1232198 - RNA, 19 nt, Homo sapiens
ucaccaguuaaaagcauuu

SEQ ID NO: 1232199 - RNA, 13 nt, Homo sapiens
ucaccauguugcc

SEQ ID NO: 1232200 - RNA, 15 nt, Homo sapiens
ucaccauugugaagc

SEQ ID NO: 1232201 - RNA, 19 nt, Homo sapiens
ucaccauugugaagcaccu

SEQ ID NO: 1232202 - RNA, 20 nt, Homo sapiens
ucaccauugugaagcaccua

SEQ ID NO: 1232203 - RNA, 23 nt, Homo sapiens
ucacccaaugcaucacguacccc

SEQ ID NO: 1232204 - RNA, 22 nt, Homo sapiens
ucacccaccccugcacaguuga

SEQ ID NO: 1232205 - RNA, 14 nt, Homo sapiens
ucacccaggaggau

SEQ ID NO: 1232206 - RNA, 19 nt, Homo sapiens
ucacccaucaaaagcacca

SEQ ID NO: 1232207 - RNA, 22 nt, Homo sapiens
ucaccccaaguagucugcucac

SEQ ID NO: 1232208 - RNA, 17 nt, Homo sapiens
ucaccccacagacacuu

SEQ ID NO: 1232209 - RNA, 14 nt, Homo sapiens
ucacccccugagau

SEQ ID NO: 1232210 - RNA, 23 nt, Homo sapiens
ucaccccggcaggcccugcagug

SEQ ID NO: 1232211 - RNA, 14 nt, Homo sapiens
ucaccccugcacuu

SEQ ID NO: 1232212 - RNA, 18 nt, Homo sapiens
ucacccuaccaacuuuac

SEQ ID NO: 1232213 - RNA, 19 nt, Homo sapiens
ucacccucuuccugugauc

SEQ ID NO: 1232214 - RNA, 20 nt, Homo sapiens
ucacccugccuuaucuugca

SEQ ID NO: 1232215 - RNA, 17 nt, Homo sapiens
ucacccugucaaguuaa

SEQ ID NO: 1232216 - RNA, 18 nt, Homo sapiens
ucaccgcugggugguuuu

SEQ ID NO: 1232217 - RNA, 18 nt, Homo sapiens
ucaccggccgauggagac

SEQ ID NO: 1232218 - RNA, 16 nt, Homo sapiens
ucaccuaaaaaaagag

SEQ ID NO: 1232219 - RNA, 17 nt, Homo sapiens
ucaccuacauuaucuca

SEQ ID NO: 1232220 - RNA, 18 nt, Homo sapiens
ucaccuacauuaucucac

SEQ ID NO: 1232221 - RNA, 23 nt, Homo sapiens
ucaccuauguuauuuuguguaca

SEQ ID NO: 1232222 - RNA, 18 nt, Homo sapiens
ucaccucacacuccucca

SEQ ID NO: 1232223 - RNA, 12 nt, Homo sapiens
ucaccucaggcc

SEQ ID NO: 1232224 - RNA, 21 nt, Homo sapiens
ucaccucuacccaaacccuag

SEQ ID NO: 1232225 - RNA, 14 nt, Homo sapiens
ucaccucuugccuu

SEQ ID NO: 1232226 - RNA, 16 nt, Homo sapiens
ucaccuguaaaccuga

SEQ ID NO: 1232227 - RNA, 16 nt, Homo sapiens
ucaccuguuggcuaca

SEQ ID NO: 1232228 - RNA, 14 nt, Homo sapiens
ucaccuuccagugu

SEQ ID NO: 1232229 - RNA, 21 nt, Homo sapiens
ucaccuucuagucuuggccag

SEQ ID NO: 1232230 - RNA, 21 nt, Homo sapiens
ucacgaggaaaagagaaggaa

SEQ ID NO: 1232231 - RNA, 16 nt, Homo sapiens
ucacgcccccaggaau

SEQ ID NO: 1232232 - RNA, 14 nt, Homo sapiens
ucacgccuacuuaa

SEQ ID NO: 1232233 - RNA, 18 nt, Homo sapiens
ucacggaccacucgaggc

SEQ ID NO: 1232234 - RNA, 20 nt, Homo sapiens
ucacggaggguccagacugu

SEQ ID NO: 1232235 - RNA, 16 nt, Homo sapiens
ucacggcucacugcag

SEQ ID NO: 1232236 - RNA, 16 nt, Homo sapiens
ucacguaagacuuuuu

SEQ ID NO: 1232237 - RNA, 19 nt, Homo sapiens
ucacuaaaguauaucuuua

SEQ ID NO: 1232238 - RNA, 17 nt, Homo sapiens
ucacuaauacuaauuca

SEQ ID NO: 1232239 - RNA, 20 nt, Homo sapiens
ucacuacagggagaaaaucc

SEQ ID NO: 1232240 - RNA, 22 nt, Homo sapiens
ucacuagagacaaaucuuuaag

SEQ ID NO: 1232241 - RNA, 13 nt, Homo sapiens
ucacuagucucac

SEQ ID NO: 1232242 - RNA, 17 nt, Homo sapiens
ucacuaucuguaaugcc

SEQ ID NO: 1232243 - RNA, 14 nt, Homo sapiens
ucacuauucccgac

SEQ ID NO: 1232244 - RNA, 16 nt, Homo sapiens
ucacucaagcacugau

SEQ ID NO: 1232245 - RNA, 19 nt, Homo sapiens
ucacucaagcacugauauc

SEQ ID NO: 1232246 - RNA, 17 nt, Homo sapiens
ucacucacauuuucuca

SEQ ID NO: 1232247 - RNA, 14 nt, Homo sapiens
ucacucauccaucc

SEQ ID NO: 1232248 - RNA, 20 nt, Homo sapiens
ucacucauuccuucacucau

SEQ ID NO: 1232249 - RNA, 14 nt, Homo sapiens
ucacucauugcuga

SEQ ID NO: 1232250 - RNA, 14 nt, Homo sapiens
ucacucccagucca

SEQ ID NO: 1232251 - RNA, 22 nt, Homo sapiens
ucacuccccaaggaagagccaa

SEQ ID NO: 1232252 - RNA, 19 nt, Homo sapiens
ucacucucaaacuucacua

SEQ ID NO: 1232253 - RNA, 16 nt, Homo sapiens
ucacucuuaggcacuu

SEQ ID NO: 1232254 - RNA, 18 nt, Homo sapiens
ucacugaacaaacuaaag

SEQ ID NO: 1232255 - RNA, 14 nt, Homo sapiens
ucacugacaguuaa

SEQ ID NO: 1232256 - RNA, 14 nt, Homo sapiens
ucacugagaagauu

SEQ ID NO: 1232257 - RNA, 18 nt, Homo sapiens
ucacugagaagauuguga

SEQ ID NO: 1232258 - RNA, 19 nt, Homo sapiens
ucacugagcuccccagauc

SEQ ID NO: 1232259 - RNA, 14 nt, Homo sapiens
ucacugcucaagaa

SEQ ID NO: 1232260 - RNA, 21 nt, Homo sapiens
ucacugcugcaaauacuguau

SEQ ID NO: 1232261 - RNA, 22 nt, Homo sapiens
ucacugcugcaaauacuguaua

SEQ ID NO: 1232262 - RNA, 17 nt, Homo sapiens
ucacuggaccacugggc

SEQ ID NO: 1232263 - RNA, 21 nt, Homo sapiens
ucacuggagguugaagccaag

SEQ ID NO: 1232264 - RNA, 22 nt, Homo sapiens
ucacuggaugucaaacaguaau

SEQ ID NO: 1232265 - RNA, 23 nt, Homo sapiens
ucacuggccaagaaaauugccuu

SEQ ID NO: 1232266 - RNA, 15 nt, Homo sapiens
ucacuggcuguuaau

SEQ ID NO: 1232267 - RNA, 23 nt, Homo sapiens
ucacuguagaaugauuucaugcu

SEQ ID NO: 1232268 - RNA, 19 nt, Homo sapiens
ucacugugcaaauauaucu

SEQ ID NO: 1232269 - RNA, 24 nt, Homo sapiens
ucacugugcuuauuuuguuucaau

SEQ ID NO: 1232270 - RNA, 13 nt, Homo sapiens
ucacuguggucau

SEQ ID NO: 1232271 - RNA, 13 nt, Homo sapiens
ucacugugucacc

SEQ ID NO: 1232272 - RNA, 16 nt, Homo sapiens
ucacuguuucucugcu

SEQ ID NO: 1232273 - RNA, 14 nt, Homo sapiens
ucacuuauuucaua

SEQ ID NO: 1232274 - RNA, 20 nt, Homo sapiens
ucacuuauuucauaaacaac

SEQ ID NO: 1232275 - RNA, 18 nt, Homo sapiens
ucacuucucacaaugucc

SEQ ID NO: 1232276 - RNA, 13 nt, Homo sapiens
ucacuucucuuaa

SEQ ID NO: 1232277 - RNA, 17 nt, Homo sapiens
ucacuugaucaugcugc

SEQ ID NO: 1232278 - RNA, 14 nt, Homo sapiens
ucaguguacaugga

SEQ ID NO: 1232279 - RNA, 17 nt, Homo sapiens
ucaguguaccauuugcc

SEQ ID NO: 1232280 - RNA, 13 nt, Homo sapiens
ucagugucacugg

SEQ ID NO: 1232281 - RNA, 13 nt, Homo sapiens
ucagugugucuaa

SEQ ID NO: 1232282 - RNA, 15 nt, Homo sapiens
ucaguguuugggaaa

SEQ ID NO: 1232283 - RNA, 22 nt, Homo sapiens
ucaguuaugauuuuuuuuucau

SEQ ID NO: 1232284 - RNA, 21 nt, Homo sapiens
ucaguuauucauucugugauc

SEQ ID NO: 1232285 - RNA, 15 nt, Homo sapiens
ucaguuccauggcaa

SEQ ID NO: 1232286 - RNA, 17 nt, Homo sapiens
ucaguucuuggugcucu

SEQ ID NO: 1232287 - RNA, 23 nt, Homo sapiens
ucaguuuuauuuuugccaaggca

SEQ ID NO: 1232288 - RNA, 18 nt, Homo sapiens
ucauaaaauggaagcaau

SEQ ID NO: 1232289 - RNA, 23 nt, Homo sapiens
ucauaaagucuuugaagugacuu

SEQ ID NO: 1232290 - RNA, 21 nt, Homo sapiens
ucauaacaauguaugugaaag

SEQ ID NO: 1232291 - RNA, 14 nt, Homo sapiens
ucauaauucuaauc

SEQ ID NO: 1232292 - RNA, 15 nt, Homo sapiens
ucauaccuaaguacu

SEQ ID NO: 1232293 - RNA, 12 nt, Homo sapiens
ucauacugaaaa

SEQ ID NO: 1232294 - RNA, 13 nt, Homo sapiens
ucauacuuaucua

SEQ ID NO: 1232295 - RNA, 22 nt, Homo sapiens
ucauagcuaauuuuugcaaaua

SEQ ID NO: 1232296 - RNA, 15 nt, Homo sapiens
ucauagcugagauuc

SEQ ID NO: 1232297 - RNA, 15 nt, Homo sapiens
ucauagggucucuuc

SEQ ID NO: 1232298 - RNA, 16 nt, Homo sapiens
ucauauaccagcaaua

SEQ ID NO: 1232299 - RNA, 20 nt, Homo sapiens
ucauauaccagcaauauauc

SEQ ID NO: 1232300 - RNA, 16 nt, Homo sapiens
ucauaucaaaggguaa

SEQ ID NO: 1232301 - RNA, 19 nt, Homo sapiens
ucauaucaugguagucacu

SEQ ID NO: 1232302 - RNA, 17 nt, Homo sapiens
ucauauguucuaaaaga

SEQ ID NO: 1232303 - RNA, 15 nt, Homo sapiens
ucauauuauuauuaa

SEQ ID NO: 1232304 - RNA, 22 nt, Homo sapiens
ucauauuggacugauaaucucu

SEQ ID NO: 1232305 - RNA, 17 nt, Homo sapiens
ucauauuguugcauugc

SEQ ID NO: 1232306 - RNA, 16 nt, Homo sapiens
ucauauuucauuucca

SEQ ID NO: 1232307 - RNA, 20 nt, Homo sapiens
ucaucaaauauuaccaaaaa

SEQ ID NO: 1232308 - RNA, 19 nt, Homo sapiens
ucaucaacuaccauucuau

SEQ ID NO: 1232309 - RNA, 19 nt, Homo sapiens
ucaucaauucccauugcau

SEQ ID NO: 1232310 - RNA, 15 nt, Homo sapiens
ucaucacauucaggg

SEQ ID NO: 1232311 - RNA, 20 nt, Homo sapiens
ucaucacauuucuaugccaa

SEQ ID NO: 1232312 - RNA, 18 nt, Homo sapiens
ugacaaucaacucuaaua

SEQ ID NO: 1232313 - RNA, 16 nt, Homo sapiens
ugacaauccugaggcu

SEQ ID NO: 1232314 - RNA, 16 nt, Homo sapiens
ugacaauggaccucuc

SEQ ID NO: 1232315 - RNA, 13 nt, Homo sapiens
ugacaaugggcac

SEQ ID NO: 1232316 - RNA, 12 nt, Homo sapiens
ugacacagcagc

SEQ ID NO: 1232317 - RNA, 13 nt, Homo sapiens
ugacacauaugca

SEQ ID NO: 1232318 - RNA, 19 nt, Homo sapiens
ugacaccauuuuccugccu

SEQ ID NO: 1232319 - RNA, 23 nt, Homo sapiens
ugacacccacccugugccaucac

SEQ ID NO: 1232320 - RNA, 19 nt, Homo sapiens
ugacacgccuaaggucaca

SEQ ID NO: 1232321 - RNA, 12 nt, Homo sapiens
ugacacuauuca

SEQ ID NO: 1232322 - RNA, 17 nt, Homo sapiens
ugacagaaggugccacu

SEQ ID NO: 1232323 - RNA, 11 nt, Homo sapiens
ugacagcaaua

SEQ ID NO: 1232324 - RNA, 23 nt, Homo sapiens
ugacagccccuuauuugcacuuc

SEQ ID NO: 1232325 - RNA, 12 nt, Homo sapiens
ugacagccuccc

SEQ ID NO: 1232326 - RNA, 14 nt, Homo sapiens
ugacaggcaaugcu

SEQ ID NO: 1232327 - RNA, 19 nt, Homo sapiens
ugacaggccugaagauauu

SEQ ID NO: 1232328 - RNA, 17 nt, Homo sapiens
ugacagggaaaacugca

SEQ ID NO: 1232329 - RNA, 17 nt, Homo sapiens
ugacaguaaaucucaca

SEQ ID NO: 1232330 - RNA, 15 nt, Homo sapiens
ugacagucuccccca

SEQ ID NO: 1232331 - RNA, 17 nt, Homo sapiens
ugacagugccugggaau

SEQ ID NO: 1232332 - RNA, 18 nt, Homo sapiens
ugacaguggucccagaac

SEQ ID NO: 1232333 - RNA, 11 nt, Homo sapiens
ugacauaaaaa

SEQ ID NO: 1232334 - RNA, 16 nt, Homo sapiens
ugacauaagugcuauu

SEQ ID NO: 1232335 - RNA, 16 nt, Homo sapiens
ugacauaauauauucu

SEQ ID NO: 1232336 - RNA, 14 nt, Homo sapiens
ugacaucacagcag

SEQ ID NO: 1232337 - RNA, 19 nt, Homo sapiens
ugacaucccuuccuggaaa

SEQ ID NO: 1232338 - RNA, 19 nt, Homo sapiens
ugacaucucaggggccaga

SEQ ID NO: 1232339 - RNA, 14 nt, Homo sapiens
ugacaugcacugac

SEQ ID NO: 1232340 - RNA, 14 nt, Homo sapiens
ugacaugcauuguu

SEQ ID NO: 1232341 - RNA, 21 nt, Homo sapiens
ugacauggcucuggacucuaa

SEQ ID NO: 1232342 - RNA, 15 nt, Homo sapiens
ugacauguggggcca

SEQ ID NO: 1232343 - RNA, 18 nt, Homo sapiens
ugacauuagcauuguggu

SEQ ID NO: 1232344 - RNA, 13 nt, Homo sapiens
ugacauuccaggg

SEQ ID NO: 1232345 - RNA, 14 nt, Homo sapiens
ugacauuguuggcc

SEQ ID NO: 1232346 - RNA, 18 nt, Homo sapiens
ugacauuuauauauugaa

SEQ ID NO: 1232347 - RNA, 20 nt, Homo sapiens
ugaccaaaaucagcuuugua

SEQ ID NO: 1232348 - RNA, 13 nt, Homo sapiens
ugaccaacugugu

SEQ ID NO: 1232349 - RNA, 20 nt, Homo sapiens
ugaccaagagagaaagaagu

SEQ ID NO: 1232350 - RNA, 24 nt, Homo sapiens
ugaccaaguuauaaaucaauguca

SEQ ID NO: 1232351 - RNA, 19 nt, Homo sapiens
ugaccaucccaacuuuggu

SEQ ID NO: 1232352 - RNA, 17 nt, Homo sapiens
ugaccauuugacuguuc

SEQ ID NO: 1232353 - RNA, 15 nt, Homo sapiens
ugacccacugaucuc

SEQ ID NO: 1232354 - RNA, 12 nt, Homo sapiens
ugaccccagugu

SEQ ID NO: 1232355 - RNA, 16 nt, Homo sapiens
ugaccccugaccucac

SEQ ID NO: 1232356 - RNA, 14 nt, Homo sapiens
ugaccccugcucag

SEQ ID NO: 1232357 - RNA, 21 nt, Homo sapiens
ugaccccuucccuguccuugc

SEQ ID NO: 1232358 - RNA, 17 nt, Homo sapiens
ugacccuccccuaguca

SEQ ID NO: 1232359 - RNA, 23 nt, Homo sapiens
ugaccuaaauuauuuacugcaaa

SEQ ID NO: 1232360 - RNA, 22 nt, Homo sapiens
ugaccuacuuugguaguggaau

SEQ ID NO: 1232361 - RNA, 13 nt, Homo sapiens
ugaccucuugcug

SEQ ID NO: 1232362 - RNA, 23 nt, Homo sapiens
ugaccugcggcaguauguacuuc

SEQ ID NO: 1232363 - RNA, 21 nt, Homo sapiens
ugaccugucaccgugagcagc

SEQ ID NO: 1232364 - RNA, 14 nt, Homo sapiens
ugaccugugaccag

SEQ ID NO: 1232365 - RNA, 21 nt, Homo sapiens
ugaccuuccuccuccucuuca

SEQ ID NO: 1232366 - RNA, 20 nt, Homo sapiens
ugaccuuccuucaagaggac

SEQ ID NO: 1232367 - RNA, 18 nt, Homo sapiens
ugaccuugggguacaauu

SEQ ID NO: 1232368 - RNA, 18 nt, Homo sapiens
ugaccuugugacaauaca

SEQ ID NO: 1232369 - RNA, 14 nt, Homo sapiens
ugacgacagugcau

SEQ ID NO: 1232370 - RNA, 18 nt, Homo sapiens
ugacgcggcucaaaagga

SEQ ID NO: 1232371 - RNA, 15 nt, Homo sapiens
ugacggcaccaucug

SEQ ID NO: 1232372 - RNA, 21 nt, Homo sapiens
ugacggcccucaucuaugagg

SEQ ID NO: 1232373 - RNA, 18 nt, Homo sapiens
ugacggcgcccccagugu

SEQ ID NO: 1232374 - RNA, 20 nt, Homo sapiens
ugacgucaucaucacauuca

SEQ ID NO: 1232375 - RNA, 11 nt, Homo sapiens
ugacuaaagag

SEQ ID NO: 1232376 - RNA, 12 nt, Homo sapiens
ugacuaaagcua

SEQ ID NO: 1232377 - RNA, 19 nt, Homo sapiens
ugacuagaauuuagucucu

SEQ ID NO: 1232378 - RNA, 13 nt, Homo sapiens
ugacuaguacaaa

SEQ ID NO: 1232379 - RNA, 19 nt, Homo sapiens
ugacucaacauguuacuga

SEQ ID NO: 1232380 - RNA, 18 nt, Homo sapiens
ugacucagaggcugggag

SEQ ID NO: 1232381 - RNA, 22 nt, Homo sapiens
ugacucagcauagauuguauaa

SEQ ID NO: 1232382 - RNA, 22 nt, Homo sapiens
ugacuccacgauccugccaccc

SEQ ID NO: 1232383 - RNA, 19 nt, Homo sapiens
ugacucccagaucagucag

SEQ ID NO: 1232384 - RNA, 21 nt, Homo sapiens
ugacuccuccaaggaaaggga

SEQ ID NO: 1232385 - RNA, 20 nt, Homo sapiens
ugacucgacaccgugucacc

SEQ ID NO: 1232386 - RNA, 19 nt, Homo sapiens
ugacugaagugaacuauga

SEQ ID NO: 1232387 - RNA, 17 nt, Homo sapiens
ugacugcacccagcucc

SEQ ID NO: 1232388 - RNA, 22 nt, Homo sapiens
ugacugcuaguuuauauagaaa

SEQ ID NO: 1232389 - RNA, 15 nt, Homo sapiens
ugacuggcaaaggac

SEQ ID NO: 1232390 - RNA, 14 nt, Homo sapiens
ugacuguaucuuga

SEQ ID NO: 1232391 - RNA, 19 nt, Homo sapiens
ugacuguccaagugccaca

SEQ ID NO: 1232392 - RNA, 16 nt, Homo sapiens
ugacugugaccaccuu

SEQ ID NO: 1232393 - RNA, 18 nt, Homo sapiens
ugacuucagcugccugaa

SEQ ID NO: 1232394 - RNA, 16 nt, Homo sapiens
ugacuugugucccaug

SEQ ID NO: 1232395 - RNA, 19 nt, Homo sapiens
ugacuuguuugucuuccau

SEQ ID NO: 1232396 - RNA, 15 nt, Homo sapiens
ugacuuucugauuac

SEQ ID NO: 1232397 - RNA, 20 nt, Homo sapiens
ugacuuugcuugcuuugaag

SEQ ID NO: 1232398 - RNA, 22 nt, Homo sapiens
ugagaaaagaaauuaguuucaa

SEQ ID NO: 1232399 - RNA, 13 nt, Homo sapiens
ugagaaacagcuc

SEQ ID NO: 1232400 - RNA, 17 nt, Homo sapiens
ugagaaagaaacuaaua

SEQ ID NO: 1232401 - RNA, 15 nt, Homo sapiens
ugagaaauggccaaa

SEQ ID NO: 1232402 - RNA, 23 nt, Homo sapiens
ugagaaaugggacuuaacuccuu

SEQ ID NO: 1232403 - RNA, 17 nt, Homo sapiens
ugagaaauuugccuugu

SEQ ID NO: 1232404 - RNA, 21 nt, Homo sapiens
ugagaacaagucacagcugca

SEQ ID NO: 1232405 - RNA, 16 nt, Homo sapiens
ugagaaccauuuacuu

SEQ ID NO: 1232406 - RNA, 13 nt, Homo sapiens
ugagaacuccuga

SEQ ID NO: 1232407 - RNA, 14 nt, Homo sapiens
ugagaacuugacaa

SEQ ID NO: 1232408 - RNA, 16 nt, Homo sapiens
ugagaaggaacuucca

SEQ ID NO: 1232409 - RNA, 15 nt, Homo sapiens
ugagaaggugcuuug

SEQ ID NO: 1232410 - RNA, 17 nt, Homo sapiens
ugagaaucaugcacuuu

SEQ ID NO: 1232411 - RNA, 19 nt, Homo sapiens
ugagaaugagggccaagaa

SEQ ID NO: 1232412 - RNA, 16 nt, Homo sapiens
ugagaauuguauguca

SEQ ID NO: 1232413 - RNA, 20 nt, Homo sapiens
ugagacaggaggauugccug

SEQ ID NO: 1232414 - RNA, 15 nt, Homo sapiens
ugagacagucuugcu

SEQ ID NO: 1232415 - RNA, 20 nt, Homo sapiens
ugagacaguuucuuagcuuu

SEQ ID NO: 1232416 - RNA, 23 nt, Homo sapiens
ugagacucuaggguccaguggau

SEQ ID NO: 1232417 - RNA, 15 nt, Homo sapiens
ugagagaaguacaaa

SEQ ID NO: 1232418 - RNA, 19 nt, Homo sapiens
ugagagcuauugcuuuguu

SEQ ID NO: 1232419 - RNA, 19 nt, Homo sapiens
ugagaggugacacuguugg

SEQ ID NO: 1232420 - RNA, 22 nt, Homo sapiens
ugagaguaucaggucucccacg

SEQ ID NO: 1232421 - RNA, 14 nt, Homo sapiens
ugagagucaaagcu

SEQ ID NO: 1232422 - RNA, 18 nt, Homo sapiens
ugagagugucucugauaa

SEQ ID NO: 1232423 - RNA, 20 nt, Homo sapiens
ugagauauuugguaccaugg

SEQ ID NO: 1232424 - RNA, 15 nt, Homo sapiens
ugagaucacuacuca

SEQ ID NO: 1232425 - RNA, 12 nt, Homo sapiens
ugagauccugca

SEQ ID NO: 1232426 - RNA, 17 nt, Homo sapiens
ugagaucguuguuuaca

SEQ ID NO: 1232427 - RNA, 12 nt, Homo sapiens
ugagauggaguu

SEQ ID NO: 1232428 - RNA, 18 nt, Homo sapiens
ugagauguaacucaugaa

SEQ ID NO: 1232429 - RNA, 16 nt, Homo sapiens
ugagauuacaggcacc

SEQ ID NO: 1232430 - RNA, 18 nt, Homo sapiens
ugagauuucuuaaauaau

SEQ ID NO: 1232431 - RNA, 14 nt, Homo sapiens
ugagcaaauaucau

SEQ ID NO: 1232432 - RNA, 13 nt, Homo sapiens
ugagcaaccagcu

SEQ ID NO: 1232433 - RNA, 17 nt, Homo sapiens
ugagcaaccgcuucccu

SEQ ID NO: 1232434 - RNA, 18 nt, Homo sapiens
ugagcaagacauacuuaa

SEQ ID NO: 1232435 - RNA, 18 nt, Homo sapiens
ugagcaagggggcccaaa

SEQ ID NO: 1232436 - RNA, 17 nt, Homo sapiens
ugagcacccaagccagg

SEQ ID NO: 1232437 - RNA, 16 nt, Homo sapiens
ugagcagaagaucaag

SEQ ID NO: 1232438 - RNA, 19 nt, Homo sapiens
ugagccaaagaacaaauaa

SEQ ID NO: 1232439 - RNA, 15 nt, Homo sapiens
ugagccacucagagc

SEQ ID NO: 1232440 - RNA, 12 nt, Homo sapiens
ugguucuaagaa

SEQ ID NO: 1232441 - RNA, 22 nt, Homo sapiens
ugguucugaaauaaacuucacu

SEQ ID NO: 1232442 - RNA, 16 nt, Homo sapiens
ugguuuaaaugauaca

SEQ ID NO: 1232443 - RNA, 20 nt, Homo sapiens
ugguuuaaaugauacaguau

SEQ ID NO: 1232444 - RNA, 20 nt, Homo sapiens
ugguuuccuggugcuuccca

SEQ ID NO: 1232445 - RNA, 16 nt, Homo sapiens
ugguuucucucuacag

SEQ ID NO: 1232446 - RNA, 12 nt, Homo sapiens
ugguuuuggaca

SEQ ID NO: 1232447 - RNA, 19 nt, Homo sapiens
uguaaaaucccaucugcua

SEQ ID NO: 1232448 - RNA, 23 nt, Homo sapiens
uguaaaaugucuguuaacuuaau

SEQ ID NO: 1232449 - RNA, 20 nt, Homo sapiens
uguaaaaugugaagugaaug

SEQ ID NO: 1232450 - RNA, 23 nt, Homo sapiens
uguaaaauuuaaaucauauccua

SEQ ID NO: 1232451 - RNA, 21 nt, Homo sapiens
uguaaaccuagaguuuuauca

SEQ ID NO: 1232452 - RNA, 13 nt, Homo sapiens
uguaaacugugua

SEQ ID NO: 1232453 - RNA, 13 nt, Homo sapiens
uguaaagcuuuaa

SEQ ID NO: 1232454 - RNA, 20 nt, Homo sapiens
uguaaauaccagacugcagg

SEQ ID NO: 1232455 - RNA, 23 nt, Homo sapiens
uguaaauauuuauuuauguguuc

SEQ ID NO: 1232456 - RNA, 23 nt, Homo sapiens
uguaaauugcaaauaaaccacuu

SEQ ID NO: 1232457 - RNA, 15 nt, Homo sapiens
uguaaauuucucaaa

SEQ ID NO: 1232458 - RNA, 21 nt, Homo sapiens
uguaacacuguguacaccuca

SEQ ID NO: 1232459 - RNA, 13 nt, Homo sapiens
uguaacacuuguc

SEQ ID NO: 1232460 - RNA, 15 nt, Homo sapiens
uguaacacuugucaa

SEQ ID NO: 1232461 - RNA, 13 nt, Homo sapiens
uguaacagcauua

SEQ ID NO: 1232462 - RNA, 23 nt, Homo sapiens
uguaacaguugcauugacuguca

SEQ ID NO: 1232463 - RNA, 21 nt, Homo sapiens
uguaacaucacuauccaugca

SEQ ID NO: 1232464 - RNA, 14 nt, Homo sapiens
uguaacccgcucau

SEQ ID NO: 1232465 - RNA, 20 nt, Homo sapiens
uguaaccuguugcuguguuu

SEQ ID NO: 1232466 - RNA, 23 nt, Homo sapiens
uguaacguuuucuuucacacaca

SEQ ID NO: 1232467 - RNA, 18 nt, Homo sapiens
uguaagauuuuccauugu

SEQ ID NO: 1232468 - RNA, 14 nt, Homo sapiens
uguaaggugcuaca

SEQ ID NO: 1232469 - RNA, 21 nt, Homo sapiens
uguaagguggacuuccagcuu

SEQ ID NO: 1232470 - RNA, 13 nt, Homo sapiens
uguaagugcugcu

SEQ ID NO: 1232471 - RNA, 16 nt, Homo sapiens
uguaagugcugcuaua

SEQ ID NO: 1232472 - RNA, 12 nt, Homo sapiens
uguaauaccaga

SEQ ID NO: 1232473 - RNA, 15 nt, Homo sapiens
uguaauagcauacau

SEQ ID NO: 1232474 - RNA, 14 nt, Homo sapiens
uguaauaugcacaa

SEQ ID NO: 1232475 - RNA, 22 nt, Homo sapiens
uguaaucaaggccagugcuaaa

SEQ ID NO: 1232476 - RNA, 20 nt, Homo sapiens
uguaaucccaacauuuuggg

SEQ ID NO: 1232477 - RNA, 18 nt, Homo sapiens
uguaaucccagcacuuug

SEQ ID NO: 1232478 - RNA, 21 nt, Homo sapiens
uguaaucgcccuacuauucag

SEQ ID NO: 1232479 - RNA, 12 nt, Homo sapiens
uguaaucucagc

SEQ ID NO: 1232480 - RNA, 24 nt, Homo sapiens
uguaaugccuuuucucaccuguca

SEQ ID NO: 1232481 - RNA, 12 nt, Homo sapiens
uguaaugcugca

SEQ ID NO: 1232482 - RNA, 21 nt, Homo sapiens
uguaauuuauuaacuaaucaa

SEQ ID NO: 1232483 - RNA, 23 nt, Homo sapiens
uguaauuuuaaauaaaagugauc

SEQ ID NO: 1232484 - RNA, 13 nt, Homo sapiens
uguacaauaaagc

SEQ ID NO: 1232485 - RNA, 20 nt, Homo sapiens
uguacaauaaagcaaugugg

SEQ ID NO: 1232486 - RNA, 15 nt, Homo sapiens
uguacacaacaaucc

SEQ ID NO: 1232487 - RNA, 17 nt, Homo sapiens
uguacacugauuccuuu

SEQ ID NO: 1232488 - RNA, 15 nt, Homo sapiens
uguacagacauacau

SEQ ID NO: 1232489 - RNA, 15 nt, Homo sapiens
uguacagagugcuuu

SEQ ID NO: 1232490 - RNA, 20 nt, Homo sapiens
uguacaguagauuuuccaaa

SEQ ID NO: 1232491 - RNA, 19 nt, Homo sapiens
uguacaguguguaaagugu

SEQ ID NO: 1232492 - RNA, 22 nt, Homo sapiens
uguacauguguagccugugcau

SEQ ID NO: 1232493 - RNA, 19 nt, Homo sapiens
uguaccaaaaaauauugcu

SEQ ID NO: 1232494 - RNA, 14 nt, Homo sapiens
uguaccacaucugc

SEQ ID NO: 1232495 - RNA, 17 nt, Homo sapiens
uguacccccagguggaa

SEQ ID NO: 1232496 - RNA, 22 nt, Homo sapiens
uguacccuccuccccacacaga

SEQ ID NO: 1232497 - RNA, 23 nt, Homo sapiens
uguaccgggcuggccugugccua

SEQ ID NO: 1232498 - RNA, 17 nt, Homo sapiens
uguaccuaauccaaaua

SEQ ID NO: 1232499 - RNA, 17 nt, Homo sapiens
uguaccuauggcaauuu

SEQ ID NO: 1232500 - RNA, 13 nt, Homo sapiens
uguaccucagugg

SEQ ID NO: 1232501 - RNA, 17 nt, Homo sapiens
uguacuaaaccaccuca

SEQ ID NO: 1232502 - RNA, 21 nt, Homo sapiens
uguacuacaucuaguuaauca

SEQ ID NO: 1232503 - RNA, 18 nt, Homo sapiens
uguacucugaaaguuuug

SEQ ID NO: 1232504 - RNA, 21 nt, Homo sapiens
uguacucuuaggauauuugag

SEQ ID NO: 1232505 - RNA, 13 nt, Homo sapiens
uguacugccuuag

SEQ ID NO: 1232506 - RNA, 12 nt, Homo sapiens
uguacuguacua

SEQ ID NO: 1232507 - RNA, 20 nt, Homo sapiens
uguagaaaauaaaacugagc

SEQ ID NO: 1232508 - RNA, 13 nt, Homo sapiens
uguagaacuucaa

SEQ ID NO: 1232509 - RNA, 19 nt, Homo sapiens
uguagaauauauuuccuua

SEQ ID NO: 1232510 - RNA, 17 nt, Homo sapiens
uguagacacuuacuuga

SEQ ID NO: 1232511 - RNA, 12 nt, Homo sapiens
uguagauauugu

SEQ ID NO: 1232512 - RNA, 13 nt, Homo sapiens
uguagaugugcau

SEQ ID NO: 1232513 - RNA, 20 nt, Homo sapiens
uguagcauuucuugauguug

SEQ ID NO: 1232514 - RNA, 16 nt, Homo sapiens
uguagcguguuuacau

SEQ ID NO: 1232515 - RNA, 17 nt, Homo sapiens
uguagcuccucaacuca

SEQ ID NO: 1232516 - RNA, 18 nt, Homo sapiens
uguagcugaaacaaaaau

SEQ ID NO: 1232517 - RNA, 23 nt, Homo sapiens
uguagcuuugcucuuugguagaa

SEQ ID NO: 1232518 - RNA, 21 nt, Homo sapiens
uguaggcuggggcggggccca

SEQ ID NO: 1232519 - RNA, 13 nt, Homo sapiens
uguaguacuccuu

SEQ ID NO: 1232520 - RNA, 13 nt, Homo sapiens
uguaguagucuca

SEQ ID NO: 1232521 - RNA, 14 nt, Homo sapiens
uguaguagucucau

SEQ ID NO: 1232522 - RNA, 21 nt, Homo sapiens
uguagucccagcuacuuggga

SEQ ID NO: 1232523 - RNA, 15 nt, Homo sapiens
uguaguuaaugaugg

SEQ ID NO: 1232524 - RNA, 13 nt, Homo sapiens
uguaguuacucaa

SEQ ID NO: 1232525 - RNA, 15 nt, Homo sapiens
uguaguuacuguggu

SEQ ID NO: 1232526 - RNA, 16 nt, Homo sapiens
uguauaaaauagacaa

SEQ ID NO: 1232527 - RNA, 15 nt, Homo sapiens
uguauaaacugucaa

SEQ ID NO: 1232528 - RNA, 13 nt, Homo sapiens
uguauacuucuau

SEQ ID NO: 1232529 - RNA, 13 nt, Homo sapiens
uguauauguauuc

SEQ ID NO: 1232530 - RNA, 15 nt, Homo sapiens
uguauauuauuuggc

SEQ ID NO: 1232531 - RNA, 22 nt, Homo sapiens
uguauauugguugaaacuguua

SEQ ID NO: 1232532 - RNA, 20 nt, Homo sapiens
uguauauuguggauguguuc

SEQ ID NO: 1232533 - RNA, 14 nt, Homo sapiens
uguaucaucagugc

SEQ ID NO: 1232534 - RNA, 19 nt, Homo sapiens
uguaucccaacuccuauaa

SEQ ID NO: 1232535 - RNA, 14 nt, Homo sapiens
uguauccgacucua

SEQ ID NO: 1232536 - RNA, 17 nt, Homo sapiens
uguauccgacucuaagc

SEQ ID NO: 1232537 - RNA, 18 nt, Homo sapiens
uguaucggagacagugau

SEQ ID NO: 1232538 - RNA, 13 nt, Homo sapiens
uguaucucaggaa

SEQ ID NO: 1232539 - RNA, 17 nt, Homo sapiens
uguaugaaaaguaacug

SEQ ID NO: 1232540 - RNA, 19 nt, Homo sapiens
uguaugaaagagcaaguga

SEQ ID NO: 1232541 - RNA, 14 nt, Homo sapiens
uguaugacuaaaga

SEQ ID NO: 1232542 - RNA, 22 nt, Homo sapiens
uguauggaaucccacuguauga

SEQ ID NO: 1232543 - RNA, 14 nt, Homo sapiens
uguaugugaacaaa

SEQ ID NO: 1232544 - RNA, 19 nt, Homo sapiens
uguauguuaugaacaugca

SEQ ID NO: 1232545 - RNA, 22 nt, Homo sapiens
uguauguuuacauaucaccuca

SEQ ID NO: 1232546 - RNA, 18 nt, Homo sapiens
uguauuaaagacagaggc

SEQ ID NO: 1232547 - RNA, 14 nt, Homo sapiens
uguauuaaugcuau

SEQ ID NO: 1232548 - RNA, 12 nt, Homo sapiens
uguauuacaaau

SEQ ID NO: 1232549 - RNA, 15 nt, Homo sapiens
uguauucgugcauuu

SEQ ID NO: 1232550 - RNA, 17 nt, Homo sapiens
uguauucuucaaccuca

SEQ ID NO: 1232551 - RNA, 17 nt, Homo sapiens
uguauuuccagugcaau

SEQ ID NO: 1232552 - RNA, 22 nt, Homo sapiens
uguauuuucagcucaauuguua

SEQ ID NO: 1232553 - RNA, 22 nt, Homo sapiens
uguauuuuuaacaccagaaaga

SEQ ID NO: 1232554 - RNA, 18 nt, Homo sapiens
uguauuuuuaaugggggu

SEQ ID NO: 1232555 - RNA, 19 nt, Homo sapiens
uguauuuuucuguuagcug

SEQ ID NO: 1232556 - RNA, 14 nt, Homo sapiens
ugucaaaagccaga

SEQ ID NO: 1232557 - RNA, 14 nt, Homo sapiens
ugucaacagaauuu

SEQ ID NO: 1232558 - RNA, 21 nt, Homo sapiens
ugucaauaaaaccacuguaca

SEQ ID NO: 1232559 - RNA, 19 nt, Homo sapiens
ugucaauguaaagccaaaa

SEQ ID NO: 1232560 - RNA, 13 nt, Homo sapiens
ugucaaugugaac

SEQ ID NO: 1232561 - RNA, 12 nt, Homo sapiens
ugucacacaaaa

SEQ ID NO: 1232562 - RNA, 12 nt, Homo sapiens
ugucacaucucu

SEQ ID NO: 1232563 - RNA, 15 nt, Homo sapiens
ugucacccauuggug

SEQ ID NO: 1232564 - RNA, 19 nt, Homo sapiens
ugucacccuggauaggcaa

SEQ ID NO: 1232565 - RNA, 22 nt, Homo sapiens
ugucacccuuguccuugagugc

SEQ ID NO: 1232566 - RNA, 22 nt, Homo sapiens
ugucaccucccugaaauugcau

SEQ ID NO: 1232567 - RNA, 12 nt, Homo sapiens
ugggaguacuga

SEQ ID NO: 1232568 - RNA, 18 nt, Homo sapiens
ugggagucugaggccuga

SEQ ID NO: 1232569 - RNA, 18 nt, Homo sapiens
ugggauaacugauuucua

SEQ ID NO: 1232570 - RNA, 23 nt, Homo sapiens
ugggauacuauuuaauuauuuca

SEQ ID NO: 1232571 - RNA, 17 nt, Homo sapiens
ugggauaucacuuccau

SEQ ID NO: 1232572 - RNA, 23 nt, Homo sapiens
ugggauaucacuuccaugacaua

SEQ ID NO: 1232573 - RNA, 15 nt, Homo sapiens
ugggaucaaauaacu

SEQ ID NO: 1232574 - RNA, 17 nt, Homo sapiens
ugggauggcucaaagga

SEQ ID NO: 1232575 - RNA, 19 nt, Homo sapiens
ugggauguccuacuaucac

SEQ ID NO: 1232576 - RNA, 15 nt, Homo sapiens
ugggauguucagcac

SEQ ID NO: 1232577 - RNA, 14 nt, Homo sapiens
ugggauuccugacc

SEQ ID NO: 1232578 - RNA, 16 nt, Homo sapiens
ugggauuuaauuucca

SEQ ID NO: 1232579 - RNA, 17 nt, Homo sapiens
ugggcaacauagugaga

SEQ ID NO: 1232580 - RNA, 18 nt, Homo sapiens
ugggcacagcacagccag

SEQ ID NO: 1232581 - RNA, 11 nt, Homo sapiens
ugggcacagug

SEQ ID NO: 1232582 - RNA, 16 nt, Homo sapiens
uguugaaauugucaaa

SEQ ID NO: 1232583 - RNA, 23 nt, Homo sapiens
uguugacagcaaaauguugaaga

SEQ ID NO: 1232584 - RNA, 21 nt, Homo sapiens
uguugagccaggccugggucu

SEQ ID NO: 1232585 - RNA, 16 nt, Homo sapiens
uguugauaaaugacac

SEQ ID NO: 1232586 - RNA, 13 nt, Homo sapiens
uguugcaaacuca

SEQ ID NO: 1232587 - RNA, 21 nt, Homo sapiens
uguugcccaggcuggucucaa

SEQ ID NO: 1232588 - RNA, 16 nt, Homo sapiens
uguuggcauagcucug

SEQ ID NO: 1232589 - RNA, 17 nt, Homo sapiens
uguugguauuauauaau

SEQ ID NO: 1232590 - RNA, 22 nt, Homo sapiens
uguuguaaaaagaaaaaccacu

SEQ ID NO: 1232591 - RNA, 21 nt, Homo sapiens
uguuguacuuaaaugguaaua

SEQ ID NO: 1232592 - RNA, 14 nt, Homo sapiens
uguuguccaggaaa

SEQ ID NO: 1232593 - RNA, 14 nt, Homo sapiens
uguuguguagucaa

SEQ ID NO: 1232594 - RNA, 17 nt, Homo sapiens
uguuuacaaggugacaa

SEQ ID NO: 1232595 - RNA, 23 nt, Homo sapiens
uguuuacauaucaccucauggcc

SEQ ID NO: 1232596 - RNA, 17 nt, Homo sapiens
uuaagcuuaugucagac

SEQ ID NO: 1232597 - RNA, 20 nt, Homo sapiens
uuaaggaaaugugcaggaua

SEQ ID NO: 1232598 - RNA, 15 nt, Homo sapiens
uuaaggauugugaua

SEQ ID NO: 1232599 - RNA, 13 nt, Homo sapiens
uuaagggggaaaa

SEQ ID NO: 1232600 - RNA, 17 nt, Homo sapiens
uuaaguaaaccaaaaag

SEQ ID NO: 1232601 - RNA, 20 nt, Homo sapiens
uuaagugacuauagaaugca

SEQ ID NO: 1232602 - RNA, 12 nt, Homo sapiens
uuaagugauuau

SEQ ID NO: 1232603 - RNA, 12 nt, Homo sapiens
uuaagugccuuu

SEQ ID NO: 1232604 - RNA, 16 nt, Homo sapiens
uuaauaaaccuuugca

SEQ ID NO: 1232605 - RNA, 14 nt, Homo sapiens
uuaauaaagcauuc

SEQ ID NO: 1232606 - RNA, 20 nt, Homo sapiens
uuaauaaauauuacagugaa

SEQ ID NO: 1232607 - RNA, 16 nt, Homo sapiens
uuaauaaauucagaua

SEQ ID NO: 1232608 - RNA, 13 nt, Homo sapiens
uuaauacaaagaa

SEQ ID NO: 1232609 - RNA, 20 nt, Homo sapiens
uuaauacagggcauuuuggu

SEQ ID NO: 1232610 - RNA, 20 nt, Homo sapiens
uuaauagcaacagagcacuu

SEQ ID NO: 1232611 - RNA, 22 nt, Homo sapiens
uuaauagcaacagagcacuuga

SEQ ID NO: 1232612 - RNA, 12 nt, Homo sapiens
uuaguaauuucu

SEQ ID NO: 1232613 - RNA, 21 nt, Homo sapiens
uuaguagagacgggauuuccc

SEQ ID NO: 1232614 - RNA, 22 nt, Homo sapiens
uuaguauagccacaaaugccuu

SEQ ID NO: 1232615 - RNA, 15 nt, Homo sapiens
uuagucaaucacugc

SEQ ID NO: 1232616 - RNA, 13 nt, Homo sapiens
uuagucaugugac

SEQ ID NO: 1232617 - RNA, 22 nt, Homo sapiens
uuagucccgauaggguauuuga

SEQ ID NO: 1232618 - RNA, 15 nt, Homo sapiens
uuagucucaugugaa

SEQ ID NO: 1232619 - RNA, 13 nt, Homo sapiens
uuagucucuggaa

SEQ ID NO: 1232620 - RNA, 19 nt, Homo sapiens
uuagucuuaauguacacau

SEQ ID NO: 1232621 - RNA, 21 nt, Homo sapiens
uuagucuuggaaaaaaaccac

SEQ ID NO: 1232622 - RNA, 11 nt, Homo sapiens
uuagugcuugu

SEQ ID NO: 1232623 - RNA, 15 nt, Homo sapiens
uuagugguacucuga

SEQ ID NO: 1232624 - RNA, 15 nt, Homo sapiens
uuaguuacaaaguua

SEQ ID NO: 1232625 - RNA, 19 nt, Homo sapiens
uuaguucaauacagugaag

SEQ ID NO: 1232626 - RNA, 13 nt, Homo sapiens
uuaguuccacaaa

SEQ ID NO: 1232627 - RNA, 15 nt, Homo sapiens
uuaguuuacuccuga

SEQ ID NO: 1232628 - RNA, 11 nt, Homo sapiens
uuaguuucaug

SEQ ID NO: 1232629 - RNA, 18 nt, Homo sapiens
uuaguuuuuaacaaucua

SEQ ID NO: 1232630 - RNA, 16 nt, Homo sapiens
uuauaaaauuaagcaa

SEQ ID NO: 1232631 - RNA, 16 nt, Homo sapiens
uuauaaaccaaucuua

SEQ ID NO: 1232632 - RNA, 14 nt, Homo sapiens
uuauaaaugagcaa

SEQ ID NO: 1232633 - RNA, 21 nt, Homo sapiens
uuauaaauuuuauaacagaau

SEQ ID NO: 1232634 - RNA, 22 nt, Homo sapiens
uuauaacagaauuaaaguagau

SEQ ID NO: 1232635 - RNA, 12 nt, Homo sapiens
uuauaacuuuaa

SEQ ID NO: 1232636 - RNA, 20 nt, Homo sapiens
uuauaagaaagaucaaagac

SEQ ID NO: 1232637 - RNA, 23 nt, Homo sapiens
uuauaagagugccguaacaacug

SEQ ID NO: 1232638 - RNA, 17 nt, Homo sapiens
uuauaagucuuacauaa

SEQ ID NO: 1232639 - RNA, 12 nt, Homo sapiens
uuauaaucaaaa

SEQ ID NO: 1232640 - RNA, 12 nt, Homo sapiens
uuauaaucuacu

SEQ ID NO: 1232641 - RNA, 21 nt, Homo sapiens
uuauaauucuugaaugaggca

SEQ ID NO: 1232642 - RNA, 14 nt, Homo sapiens
uuauaauugcaucu

SEQ ID NO: 1232643 - RNA, 20 nt, Homo sapiens
uuauacagauagaguuccau

SEQ ID NO: 1232644 - RNA, 16 nt, Homo sapiens
uuauacgcuggcaaca

SEQ ID NO: 1232645 - RNA, 19 nt, Homo sapiens
uuauacucacugagucuua

SEQ ID NO: 1232646 - RNA, 12 nt, Homo sapiens
uuauacuuucag

SEQ ID NO: 1232647 - RNA, 23 nt, Homo sapiens
uuauagaguguacuuaacuauuc

SEQ ID NO: 1232648 - RNA, 15 nt, Homo sapiens
uuauagcaacuuuaa

SEQ ID NO: 1232649 - RNA, 21 nt, Homo sapiens
uuauagcacuuugaaauaccu

SEQ ID NO: 1232650 - RNA, 15 nt, Homo sapiens
uuauaguuacugugu

SEQ ID NO: 1232651 - RNA, 22 nt, Homo sapiens
uuauaguuucagauauauauca

SEQ ID NO: 1232652 - RNA, 14 nt, Homo sapiens
uuauaucagccuga

SEQ ID NO: 1232653 - RNA, 19 nt, Homo sapiens
uuauaucuguaaugauacu

SEQ ID NO: 1232654 - RNA, 12 nt, Homo sapiens
uuauaugauuca

SEQ ID NO: 1232655 - RNA, 18 nt, Homo sapiens
uuauaugauucacaugcu

SEQ ID NO: 1232656 - RNA, 16 nt, Homo sapiens
uuauauuaaaauaugg

SEQ ID NO: 1232657 - RNA, 16 nt, Homo sapiens
uuauauuuuuagccua

SEQ ID NO: 1232658 - RNA, 17 nt, Homo sapiens
uuaucaagugucuucca

SEQ ID NO: 1232659 - RNA, 20 nt, Homo sapiens
uuaucaauguucuaguucug

SEQ ID NO: 1232660 - RNA, 21 nt, Homo sapiens
uuaucacuuuuugaacuaaga

SEQ ID NO: 1232661 - RNA, 13 nt, Homo sapiens
uuaucauauccuu

SEQ ID NO: 1232662 - RNA, 21 nt, Homo sapiens
uuaucaugcauguccuguaaa

SEQ ID NO: 1232663 - RNA, 18 nt, Homo sapiens
uuauccauccucugagau

SEQ ID NO: 1232664 - RNA, 22 nt, Homo sapiens
uuaucccuuuacaaugugaaua

SEQ ID NO: 1232665 - RNA, 23 nt, Homo sapiens
uuauccuagauuauaucaaagua

SEQ ID NO: 1232666 - RNA, 18 nt, Homo sapiens
uuauccuagucauucuuc

SEQ ID NO: 1232667 - RNA, 18 nt, Homo sapiens
uuaucuacaaacacugca

SEQ ID NO: 1232668 - RNA, 20 nt, Homo sapiens
uuaucugcuaugcuauugaa

SEQ ID NO: 1232669 - RNA, 18 nt, Homo sapiens
uuaucugucacaccugug

SEQ ID NO: 1232670 - RNA, 15 nt, Homo sapiens
uuaucuuuauaugaa

SEQ ID NO: 1232671 - RNA, 15 nt, Homo sapiens
uuaugaagcagauuu

SEQ ID NO: 1232672 - RNA, 13 nt, Homo sapiens
uuaugacagugaa

SEQ ID NO: 1232673 - RNA, 16 nt, Homo sapiens
uuaugacagugaacau

SEQ ID NO: 1232674 - RNA, 22 nt, Homo sapiens
uuaugaggcaaccugauuguaa

SEQ ID NO: 1232675 - RNA, 13 nt, Homo sapiens
uuaugaucuuggc

SEQ ID NO: 1232676 - RNA, 15 nt, Homo sapiens
uuaugccuucacuuu

SEQ ID NO: 1232677 - RNA, 23 nt, Homo sapiens
uuaugcuccaucccauucacuuc

SEQ ID NO: 1232678 - RNA, 23 nt, Homo sapiens
uuauggcagaagggaauugcuca

SEQ ID NO: 1232679 - RNA, 19 nt, Homo sapiens
uuauggcauuuuucuggga

SEQ ID NO: 1232680 - RNA, 14 nt, Homo sapiens
uuauguacuugaua

SEQ ID NO: 1232681 - RNA, 18 nt, Homo sapiens
uuauguaguaauugacau

SEQ ID NO: 1232682 - RNA, 20 nt, Homo sapiens
uuauguaugaaaauuauucu

SEQ ID NO: 1232683 - RNA, 23 nt, Homo sapiens
uuauguauuugaaaacucacaga

SEQ ID NO: 1232684 - RNA, 20 nt, Homo sapiens
uuaugucccugacuguaaau

SEQ ID NO: 1232685 - RNA, 14 nt, Homo sapiens
uuaugucucaaaau

SEQ ID NO: 1232686 - RNA, 19 nt, Homo sapiens
uuaugucucuucugagcua

SEQ ID NO: 1232687 - RNA, 12 nt, Homo sapiens
uuaugugaagaa

SEQ ID NO: 1232688 - RNA, 23 nt, Homo sapiens
uuaugugaguguguguuugugcu

SEQ ID NO: 1232689 - RNA, 14 nt, Homo sapiens
uuauuaaauacaaa

SEQ ID NO: 1232690 - RNA, 14 nt, Homo sapiens
uuauuaacuuuaau

SEQ ID NO: 1232691 - RNA, 18 nt, Homo sapiens
uuauuaauauuauuauga

SEQ ID NO: 1232692 - RNA, 13 nt, Homo sapiens
uuauuaauuugaa

SEQ ID NO: 1232693 - RNA, 15 nt, Homo sapiens
uuauuacucuauaca

SEQ ID NO: 1232694 - RNA, 15 nt, Homo sapiens
uuauuacuguuccca

SEQ ID NO: 1232695 - RNA, 19 nt, Homo sapiens
uuauucaaugugacaccua

SEQ ID NO: 1232696 - RNA, 15 nt, Homo sapiens
uuauucagauuggga

SEQ ID NO: 1232697 - RNA, 17 nt, Homo sapiens
uuauuccuccugcucau

SEQ ID NO: 1232698 - RNA, 12 nt, Homo sapiens
uuauucuaaggu

SEQ ID NO: 1232699 - RNA, 23 nt, Homo sapiens
uuauucuaauaaauauacuauga

SEQ ID NO: 1232700 - RNA, 14 nt, Homo sapiens
uuauucugauucca

SEQ ID NO: 1232701 - RNA, 14 nt, Homo sapiens
uuauucugugcgcu

SEQ ID NO: 1232702 - RNA, 22 nt, Homo sapiens
uuauugcaagcauugacuauaa

SEQ ID NO: 1232703 - RNA, 13 nt, Homo sapiens
uuauugcuauuaa

SEQ ID NO: 1232704 - RNA, 16 nt, Homo sapiens
uuauuggauauuugau

SEQ ID NO: 1232705 - RNA, 14 nt, Homo sapiens
uuauuguaccucuc

SEQ ID NO: 1232706 - RNA, 15 nt, Homo sapiens
uuauugucuguaaau

SEQ ID NO: 1232707 - RNA, 12 nt, Homo sapiens
uuauuguuccaa

SEQ ID NO: 1232708 - RNA, 23 nt, Homo sapiens
uuauuguuuauuuaucagugaca

SEQ ID NO: 1232709 - RNA, 13 nt, Homo sapiens
uuauuuaugcuau

SEQ ID NO: 1232710 - RNA, 13 nt, Homo sapiens
uuauuuccacuua

SEQ ID NO: 1232711 - RNA, 17 nt, Homo sapiens
uuauuuccacuugcccu

SEQ ID NO: 1232712 - RNA, 14 nt, Homo sapiens
uuauuucuacuaua

SEQ ID NO: 1232713 - RNA, 15 nt, Homo sapiens
uuauuucuacuauga

SEQ ID NO: 1232714 - RNA, 20 nt, Homo sapiens
uuauuucugaucuauacaaa

SEQ ID NO: 1232715 - RNA, 21 nt, Homo sapiens
uuauuugcacuaugagccuau

SEQ ID NO: 1232716 - RNA, 21 nt, Homo sapiens
uuauuugcuaaucaaagccag

SEQ ID NO: 1232717 - RNA, 15 nt, Homo sapiens
uuauuuuaucugcua

SEQ ID NO: 1232718 - RNA, 13 nt, Homo sapiens
uuauuuuguugaa

SEQ ID NO: 1232719 - RNA, 14 nt, Homo sapiens
uuauuuuucuuguc

SEQ ID NO: 1232720 - RNA, 12 nt, Homo sapiens
uuauuuuugcaa

SEQ ID NO: 1232721 - RNA, 24 nt, Homo sapiens
uucaaaaauauuuauauugucacu

SEQ ID NO: 1232722 - RNA, 14 nt, Homo sapiens
uucaaaacauucau

SEQ ID NO: 1232723 - RNA, 19 nt, Homo sapiens
uucaaaacauuccaagaaa

SEQ ID NO: 1232724 - RNA, 18 nt, Homo sapiens
gcuaauguaggacuguau

SEQ ID NO: 1232725 - RNA, 13 nt, Homo sapiens
gcuacaagggaag

SEQ ID NO: 1232726 - RNA, 23 nt, Homo sapiens
gcuaccagguguucuacacucau

SEQ ID NO: 1232727 - RNA, 13 nt, Homo sapiens
gcuaccccuuuga

SEQ ID NO: 1232728 - RNA, 18 nt, Homo sapiens
gcuacccuuuuccuuugu

SEQ ID NO: 1232729 - RNA, 21 nt, Homo sapiens
gcuaccuguucuugggccuca

SEQ ID NO: 1232730 - RNA, 22 nt, Homo sapiens
gcuacuaccuagggcacuuuaa

SEQ ID NO: 1232731 - RNA, 17 nt, Homo sapiens
gcuacuauaaucaaaug

SEQ ID NO: 1232732 - RNA, 18 nt, Homo sapiens
gcuacucagaagccugag

SEQ ID NO: 1232733 - RNA, 19 nt, Homo sapiens
gcuagaacacuacagggga

SEQ ID NO: 1232734 - RNA, 15 nt, Homo sapiens
gcuagaaggcaaagu

SEQ ID NO: 1232735 - RNA, 18 nt, Homo sapiens
gcuagagcugacagcuuu

SEQ ID NO: 1232736 - RNA, 13 nt, Homo sapiens
gcuagcacuaacu

SEQ ID NO: 1232737 - RNA, 13 nt, Homo sapiens
gcuagcaguacua

SEQ ID NO: 1232738 - RNA, 20 nt, Homo sapiens
gcuaggguggcccuugcagu

SEQ ID NO: 1232739 - RNA, 21 nt, Homo sapiens
gcuaguccggacccaccucac

SEQ ID NO: 1232740 - RNA, 15 nt, Homo sapiens
gcuaguguaccuccu

SEQ ID NO: 1232741 - RNA, 19 nt, Homo sapiens
gcuaguguaccuccucuca

SEQ ID NO: 1232742 - RNA, 18 nt, Homo sapiens
gcuaguucguagcuuucc

SEQ ID NO: 1232743 - RNA, 22 nt, Homo sapiens
gcuaguuuauuggaaguguuca

SEQ ID NO: 1232744 - RNA, 18 nt, Homo sapiens
gcuauaauaaagaagugu

SEQ ID NO: 1232745 - RNA, 17 nt, Homo sapiens
gcuauauccauguacug

SEQ ID NO: 1232746 - RNA, 17 nt, Homo sapiens
gcuaucgcaccacugug

SEQ ID NO: 1232747 - RNA, 13 nt, Homo sapiens
gcuaucugugcag

SEQ ID NO: 1232748 - RNA, 22 nt, Homo sapiens
gcuaugaaaacagcuaucucac

SEQ ID NO: 1232749 - RNA, 12 nt, Homo sapiens
gcuaugacugua

SEQ ID NO: 1232750 - RNA, 21 nt, Homo sapiens
gcuauggaggguccuccucca

SEQ ID NO: 1232751 - RNA, 23 nt, Homo sapiens
gcuauggucagguuauacuccuc

SEQ ID NO: 1232752 - RNA, 17 nt, Homo sapiens
gcuauguaaauauacaa

SEQ ID NO: 1232753 - RNA, 11 nt, Homo sapiens
gcuaugugcac

SEQ ID NO: 1232754 - RNA, 21 nt, Homo sapiens
gcuauuaggaaauucugauga

SEQ ID NO: 1232755 - RNA, 19 nt, Homo sapiens
gcuauucccuggggcugcu

SEQ ID NO: 1232756 - RNA, 15 nt, Homo sapiens
gcuauucuccauacu

SEQ ID NO: 1232757 - RNA, 16 nt, Homo sapiens
gcuauugccaaccagu

SEQ ID NO: 1232758 - RNA, 21 nt, Homo sapiens
gcuauuuaauaucuggcacug

SEQ ID NO: 1232759 - RNA, 11 nt, Homo sapiens
gcuauuugccu

SEQ ID NO: 1232760 - RNA, 20 nt, Homo sapiens
gcuauuuguguguaugcuga

SEQ ID NO: 1232761 - RNA, 15 nt, Homo sapiens
gcucaauauuccuga

SEQ ID NO: 1232762 - RNA, 19 nt, Homo sapiens
gcucaauauuccugaauga

SEQ ID NO: 1232763 - RNA, 21 nt, Homo sapiens
gcucaauuuugucuguacuca

SEQ ID NO: 1232764 - RNA, 13 nt, Homo sapiens
gcucacaccaaau

SEQ ID NO: 1232765 - RNA, 16 nt, Homo sapiens
gcucacggcacgcuug

SEQ ID NO: 1232766 - RNA, 20 nt, Homo sapiens
gcucacucuggauuccacac

SEQ ID NO: 1232767 - RNA, 14 nt, Homo sapiens
gcucacugcagccu

SEQ ID NO: 1232768 - RNA, 15 nt, Homo sapiens
gcucacuugccuuag

SEQ ID NO: 1232769 - RNA, 16 nt, Homo sapiens
gcucagacuugccagg

SEQ ID NO: 1232770 - RNA, 14 nt, Homo sapiens
gcucagcacuuugg

SEQ ID NO: 1232771 - RNA, 20 nt, Homo sapiens
gcucagcaugcauccuuugc

SEQ ID NO: 1232772 - RNA, 19 nt, Homo sapiens
gcucagcggggacagcucc

SEQ ID NO: 1232773 - RNA, 13 nt, Homo sapiens
gcucaggcagcuc

SEQ ID NO: 1232774 - RNA, 23 nt, Homo sapiens
gcucaguaaacgggaacaugccc

SEQ ID NO: 1232775 - RNA, 15 nt, Homo sapiens
gcucagucucaggag

SEQ ID NO: 1232776 - RNA, 16 nt, Homo sapiens
gcucauagaucagcaa

SEQ ID NO: 1232777 - RNA, 15 nt, Homo sapiens
gcucauugaacuuua

SEQ ID NO: 1232778 - RNA, 19 nt, Homo sapiens
gcucauugcuguaccacau

SEQ ID NO: 1232779 - RNA, 16 nt, Homo sapiens
gcucauuuuugcuguu

SEQ ID NO: 1232780 - RNA, 17 nt, Homo sapiens
gcucauuuuuucuuaca

SEQ ID NO: 1232781 - RNA, 22 nt, Homo sapiens
gcucauuuuuucuucuccuaaa

SEQ ID NO: 1232782 - RNA, 13 nt, Homo sapiens
gcuccaccccagg

SEQ ID NO: 1232783 - RNA, 16 nt, Homo sapiens
gcuccaccgucagggg

SEQ ID NO: 1232784 - RNA, 21 nt, Homo sapiens
gcuccacuuggucugugagau

SEQ ID NO: 1232785 - RNA, 14 nt, Homo sapiens
gcuccagaaauguc

SEQ ID NO: 1232786 - RNA, 15 nt, Homo sapiens
gcuccaggacuccac

SEQ ID NO: 1232787 - RNA, 18 nt, Homo sapiens
gcuccagugccagcaaua

SEQ ID NO: 1232788 - RNA, 13 nt, Homo sapiens
gcuccaguuccag

SEQ ID NO: 1232789 - RNA, 22 nt, Homo sapiens
gcuccaucccaaccaggcaccu

SEQ ID NO: 1232790 - RNA, 14 nt, Homo sapiens
gcuucugcacacaa

SEQ ID NO: 1232791 - RNA, 23 nt, Homo sapiens
gcuucuggaauuuguucaaguuu

SEQ ID NO: 1232792 - RNA, 21 nt, Homo sapiens
gcuucuggggguagaucucaa

SEQ ID NO: 1232793 - RNA, 18 nt, Homo sapiens
gcuucuguaguacuccuu

SEQ ID NO: 1232794 - RNA, 14 nt, Homo sapiens
gcuucuuucucuca

SEQ ID NO: 1232795 - RNA, 19 nt, Homo sapiens
gcuucuuugaaacuuguau

SEQ ID NO: 1232796 - RNA, 13 nt, Homo sapiens
gcuugaagccaaa

SEQ ID NO: 1232797 - RNA, 15 nt, Homo sapiens
gcuugaagccaaaga

SEQ ID NO: 1232798 - RNA, 16 nt, Homo sapiens
gcuugaagccaaagaa

SEQ ID NO: 1232799 - RNA, 22 nt, Homo sapiens
gcuugaucaauucccuugaaua

SEQ ID NO: 1232800 - RNA, 17 nt, Homo sapiens
gcuuggaaauuccuugc

SEQ ID NO: 1232801 - RNA, 14 nt, Homo sapiens
gcuuggaagccagg

SEQ ID NO: 1232802 - RNA, 17 nt, Homo sapiens
gcuuggaagccagguac

SEQ ID NO: 1232803 - RNA, 23 nt, Homo sapiens
gcuuggccuacagucaucugcca

SEQ ID NO: 1232804 - RNA, 16 nt, Homo sapiens
gcuugggugugcugac

SEQ ID NO: 1232805 - RNA, 13 nt, Homo sapiens
gcuugugaacugc

SEQ ID NO: 1232806 - RNA, 22 nt, Homo sapiens
gcuuguuuuccagucucuugua

SEQ ID NO: 1232807 - RNA, 22 nt, Homo sapiens
gcuuuaccuuuuuguaugugaa

SEQ ID NO: 1232808 - RNA, 13 nt, Homo sapiens
gcuuuaugcacau

SEQ ID NO: 1232809 - RNA, 20 nt, Homo sapiens
gcuuuauuauggcuugugaa

SEQ ID NO: 1232810 - RNA, 20 nt, Homo sapiens
gcuuuccacauuugucacag

SEQ ID NO: 1232811 - RNA, 13 nt, Homo sapiens
gcuuucucucaga

SEQ ID NO: 1232812 - RNA, 18 nt, Homo sapiens
gcuuugaaacuugccugg

SEQ ID NO: 1232813 - RNA, 13 nt, Homo sapiens
gcuuugcaggcuc

SEQ ID NO: 1232814 - RNA, 14 nt, Homo sapiens
gcuuugccuugcag

SEQ ID NO: 1232815 - RNA, 17 nt, Homo sapiens
gcuuugcugcuaugaaa

SEQ ID NO: 1232816 - RNA, 13 nt, Homo sapiens
gcuuuguaauauu

SEQ ID NO: 1232817 - RNA, 15 nt, Homo sapiens
gcuuugucauugggc

SEQ ID NO: 1232818 - RNA, 17 nt, Homo sapiens
gcuuuguccugaaggaa

SEQ ID NO: 1232819 - RNA, 16 nt, Homo sapiens
gcuuugugagccagca

SEQ ID NO: 1232820 - RNA, 15 nt, Homo sapiens
gcuuuguguaauaua

SEQ ID NO: 1232821 - RNA, 18 nt, Homo sapiens
gcuuuuaagaaacacagg

SEQ ID NO: 1232822 - RNA, 21 nt, Homo sapiens
gcuuuuaugauauauauaugc

SEQ ID NO: 1232823 - RNA, 19 nt, Homo sapiens
gcuuuucaaacugcaguuu

SEQ ID NO: 1232824 - RNA, 14 nt, Homo sapiens
gcuuuucacaucca

SEQ ID NO: 1232825 - RNA, 12 nt, Homo sapiens
gcuuuucagggu

SEQ ID NO: 1232826 - RNA, 15 nt, Homo sapiens
gcuuuucauuucuca

SEQ ID NO: 1232827 - RNA, 13 nt, Homo sapiens
gcuuuuccucacc

SEQ ID NO: 1232828 - RNA, 17 nt, Homo sapiens
gcuuuucuaacuaagag

SEQ ID NO: 1232829 - RNA, 16 nt, Homo sapiens
gcuuuuguuugcucuu

SEQ ID NO: 1232830 - RNA, 23 nt, Homo sapiens
gcuuuuucacagucacugaugua

SEQ ID NO: 1232831 - RNA, 15 nt, Homo sapiens
ggaaaaaaagcaaaa

SEQ ID NO: 1232832 - RNA, 21 nt, Homo sapiens
ggaaaaaaauaguaaagccaa

SEQ ID NO: 1232833 - RNA, 20 nt, Homo sapiens
ggaaaaaaguuuugaugaaa

SEQ ID NO: 1232834 - RNA, 21 nt, Homo sapiens
ggaaaaaucuuggauuaugaa

SEQ ID NO: 1232835 - RNA, 14 nt, Homo sapiens
ggaaaaaugcugcu

SEQ ID NO: 1232836 - RNA, 14 nt, Homo sapiens
ggaaaacgugcuuu

SEQ ID NO: 1232837 - RNA, 22 nt, Homo sapiens
ggaaaacuguguugccacagua

SEQ ID NO: 1232838 - RNA, 15 nt, Homo sapiens
ggaaaagcagcucaa

SEQ ID NO: 1232839 - RNA, 20 nt, Homo sapiens
ggaaaagcugcugacagugu

SEQ ID NO: 1232840 - RNA, 21 nt, Homo sapiens
ggaaaaggaaaaaaagcaaaa

SEQ ID NO: 1232841 - RNA, 24 nt, Homo sapiens
ggaaaauaaacugacacuuauuaa

SEQ ID NO: 1232842 - RNA, 19 nt, Homo sapiens
ggaaaaugccuccauggca

SEQ ID NO: 1232843 - RNA, 18 nt, Homo sapiens
ggaaacagcaugaauaaa

SEQ ID NO: 1232844 - RNA, 14 nt, Homo sapiens
ggaaacugcuaaau

SEQ ID NO: 1232845 - RNA, 17 nt, Homo sapiens
ggaaagaaaaagcaaua

SEQ ID NO: 1232846 - RNA, 11 nt, Homo sapiens
ggaaagcacag

SEQ ID NO: 1232847 - RNA, 16 nt, Homo sapiens
ggaaaggcaggugggc

SEQ ID NO: 1232848 - RNA, 20 nt, Homo sapiens
ggaaagggagauuccaggga

SEQ ID NO: 1232849 - RNA, 17 nt, Homo sapiens
ggaaagggauaguccaa

SEQ ID NO: 1232850 - RNA, 15 nt, Homo sapiens
ggaaaggggguccca

SEQ ID NO: 1232851 - RNA, 18 nt, Homo sapiens
ggaaaggugacaguauua

SEQ ID NO: 1232852 - RNA, 18 nt, Homo sapiens
ggaaaguaaauauuucag

SEQ ID NO: 1232853 - RNA, 23 nt, Homo sapiens
ggaaaguaaauauuucaggcaua

SEQ ID NO: 1232854 - RNA, 12 nt, Homo sapiens
ggaaagugaaac

SEQ ID NO: 1232855 - RNA, 17 nt, Homo sapiens
ggaaagugauaugcauu

SEQ ID NO: 1232856 - RNA, 12 nt, Homo sapiens
ggagaugcugcc

SEQ ID NO: 1232857 - RNA, 16 nt, Homo sapiens
ggagauuccacacagg

SEQ ID NO: 1232858 - RNA, 19 nt, Homo sapiens
ggagcaucagccagugaau

SEQ ID NO: 1232859 - RNA, 13 nt, Homo sapiens
ggagcccagugaa

SEQ ID NO: 1232860 - RNA, 22 nt, Homo sapiens
ggagcccggcuuccacucccca

SEQ ID NO: 1232861 - RNA, 14 nt, Homo sapiens
ggagcccucaucuu

SEQ ID NO: 1232862 - RNA, 22 nt, Homo sapiens
ggagccggccaccagaugcuga

SEQ ID NO: 1232863 - RNA, 18 nt, Homo sapiens
ggagcucaucugcaaaag

SEQ ID NO: 1232864 - RNA, 13 nt, Homo sapiens
ggagcugcaaauu

SEQ ID NO: 1232865 - RNA, 18 nt, Homo sapiens
ggagcugucccaccugca

SEQ ID NO: 1232866 - RNA, 14 nt, Homo sapiens
ggaggacauuuggu

SEQ ID NO: 1232867 - RNA, 14 nt, Homo sapiens
ggaggaucaaagaa

SEQ ID NO: 1232868 - RNA, 23 nt, Homo sapiens
ggaggaugucccugggccagggu

SEQ ID NO: 1232869 - RNA, 20 nt, Homo sapiens
ggaggauguucugggacaca

SEQ ID NO: 1232870 - RNA, 12 nt, Homo sapiens
ggaggcacuuua

SEQ ID NO: 1232871 - RNA, 20 nt, Homo sapiens
ggaggcagagguugcaguga

SEQ ID NO: 1232872 - RNA, 15 nt, Homo sapiens
ggaggcccuccugug

SEQ ID NO: 1232873 - RNA, 19 nt, Homo sapiens
ggaggccuggggaggcccu

SEQ ID NO: 1232874 - RNA, 14 nt, Homo sapiens
ggaggccuuucauc

SEQ ID NO: 1232875 - RNA, 20 nt, Homo sapiens
ggaggcgcugcugguguucu

SEQ ID NO: 1232876 - RNA, 23 nt, Homo sapiens
ggaggcuccaggacuccacugga

SEQ ID NO: 1232877 - RNA, 20 nt, Homo sapiens
ggaggcugcagugagccaag

SEQ ID NO: 1232878 - RNA, 15 nt, Homo sapiens
ggagggagaucuuuc

SEQ ID NO: 1232879 - RNA, 19 nt, Homo sapiens
ggagggagggcgguggaca

SEQ ID NO: 1232880 - RNA, 21 nt, Homo sapiens
ggagggcccuccgaccacuuc

SEQ ID NO: 1232881 - RNA, 11 nt, Homo sapiens
ggaggggcccc

SEQ ID NO: 1232882 - RNA, 18 nt, Homo sapiens
ggagggguauuuuugccc

SEQ ID NO: 1232883 - RNA, 14 nt, Homo sapiens
ggaggggugguccu

SEQ ID NO: 1232884 - RNA, 13 nt, Homo sapiens
ggagguaacgggu

SEQ ID NO: 1232885 - RNA, 16 nt, Homo sapiens
ggaggucauacaugca

SEQ ID NO: 1232886 - RNA, 23 nt, Homo sapiens
ggaggucuaccugaugaaccuga

SEQ ID NO: 1232887 - RNA, 18 nt, Homo sapiens
ggaguaucauucuuuaca

SEQ ID NO: 1232888 - RNA, 18 nt, Homo sapiens
ggagucccugcaggugaa

SEQ ID NO: 1232889 - RNA, 14 nt, Homo sapiens
ggagucucugccac

SEQ ID NO: 1232890 - RNA, 14 nt, Homo sapiens
ggagugagacugac

SEQ ID NO: 1232891 - RNA, 20 nt, Homo sapiens
ggagugccugcuguggaccc

SEQ ID NO: 1232892 - RNA, 22 nt, Homo sapiens
ggagugcucaccgccucacuca

SEQ ID NO: 1232893 - RNA, 22 nt, Homo sapiens
ggaguguucaaaauacuacuga

SEQ ID NO: 1232894 - RNA, 18 nt, Homo sapiens
ggaguucucccaccaccu

SEQ ID NO: 1232895 - RNA, 19 nt, Homo sapiens
ggaguuugagaccagccuc

SEQ ID NO: 1232896 - RNA, 21 nt, Homo sapiens
ggaguuuucuggagugagcac

SEQ ID NO: 1232897 - RNA, 18 nt, Homo sapiens
ggauaacccuacacccag

SEQ ID NO: 1232898 - RNA, 18 nt, Homo sapiens
ggauaaccuugugccuug

SEQ ID NO: 1232899 - RNA, 19 nt, Homo sapiens
ggauaacuuagguggcaag

SEQ ID NO: 1232900 - RNA, 23 nt, Homo sapiens
ggauaaucacauuaucaucugaa

SEQ ID NO: 1232901 - RNA, 23 nt, Homo sapiens
ggauagugggcaccccacugcaa

SEQ ID NO: 1232902 - RNA, 21 nt, Homo sapiens
ggauauacugcagcuuuacug

SEQ ID NO: 1232903 - RNA, 20 nt, Homo sapiens
ggauaucaauuaauuugaaa

SEQ ID NO: 1232904 - RNA, 14 nt, Homo sapiens
ggauauugaugaaa

SEQ ID NO: 1232905 - RNA, 13 nt, Homo sapiens
ggauauuugcacu

SEQ ID NO: 1232906 - RNA, 15 nt, Homo sapiens
ggauauuuucuucca

SEQ ID NO: 1232907 - RNA, 17 nt, Homo sapiens
ggauauuuuuuacuuua

SEQ ID NO: 1232908 - RNA, 19 nt, Homo sapiens
ggaucacuugaguucagga

SEQ ID NO: 1232909 - RNA, 16 nt, Homo sapiens
ggaucaugguacauuu

SEQ ID NO: 1232910 - RNA, 19 nt, Homo sapiens
ggaucccgaagaauggaga

SEQ ID NO: 1232911 - RNA, 14 nt, Homo sapiens
ggauccgcugccac

SEQ ID NO: 1232912 - RNA, 21 nt, Homo sapiens
ggaucgugggccgcacugggg

SEQ ID NO: 1232913 - RNA, 14 nt, Homo sapiens
ggaucuccugucca

SEQ ID NO: 1232914 - RNA, 17 nt, Homo sapiens
ggaucucucuagugaug

SEQ ID NO: 1232915 - RNA, 22 nt, Homo sapiens
ggaucuuguaauccagugcccu

SEQ ID NO: 1232916 - RNA, 17 nt, Homo sapiens
ggaucuuuucauucuca

SEQ ID NO: 1232917 - RNA, 15 nt, Homo sapiens
ggaugaacaauuaua

SEQ ID NO: 1232918 - RNA, 20 nt, Homo sapiens
ggaugaagauucuccugugc

SEQ ID NO: 1232919 - RNA, 22 nt, Homo sapiens
gggccgugacagugacgccuuu

SEQ ID NO: 1232920 - RNA, 13 nt, Homo sapiens
gggccuacugcca

SEQ ID NO: 1232921 - RNA, 20 nt, Homo sapiens
gggccuagaccuggugcuga

SEQ ID NO: 1232922 - RNA, 20 nt, Homo sapiens
gggccucugccccucccaac

SEQ ID NO: 1232923 - RNA, 16 nt, Homo sapiens
gggccugaccaaacag

SEQ ID NO: 1232924 - RNA, 16 nt, Homo sapiens
gggcgaguacugggac

SEQ ID NO: 1232925 - RNA, 17 nt, Homo sapiens
gggcggcccacacccag

SEQ ID NO: 1232926 - RNA, 18 nt, Homo sapiens
gggcuaggggacaucaga

SEQ ID NO: 1232927 - RNA, 18 nt, Homo sapiens
gggcucagggagcugaga

SEQ ID NO: 1232928 - RNA, 22 nt, Homo sapiens
gggcuccugcauccucacugug

SEQ ID NO: 1232929 - RNA, 18 nt, Homo sapiens
gggcugaaagaacaugga

SEQ ID NO: 1232930 - RNA, 14 nt, Homo sapiens
gggcugagcuggga

SEQ ID NO: 1232931 - RNA, 15 nt, Homo sapiens
gggcugcccuggugc

SEQ ID NO: 1232932 - RNA, 17 nt, Homo sapiens
gggcuggguaccaaugc

SEQ ID NO: 1232933 - RNA, 19 nt, Homo sapiens
gggcugugucguagccaag

SEQ ID NO: 1232934 - RNA, 21 nt, Homo sapiens
gggcuugugauuuccauuucu

SEQ ID NO: 1232935 - RNA, 18 nt, Homo sapiens
ggggaacugcguggugcu

SEQ ID NO: 1232936 - RNA, 18 nt, Homo sapiens
ggggaagaaacacuuucu

SEQ ID NO: 1232937 - RNA, 18 nt, Homo sapiens
ggggaagaguggucuuga

SEQ ID NO: 1232938 - RNA, 20 nt, Homo sapiens
ggggaagcggcccuaaggga

SEQ ID NO: 1232939 - RNA, 17 nt, Homo sapiens
ggggacaagggauuuga

SEQ ID NO: 1232940 - RNA, 16 nt, Homo sapiens
ggggagaauguaauca

SEQ ID NO: 1232941 - RNA, 23 nt, Homo sapiens
ggggcaccuuaagauuuugcacc

SEQ ID NO: 1232942 - RNA, 18 nt, Homo sapiens
ggggcaggcugggccaug

SEQ ID NO: 1232943 - RNA, 14 nt, Homo sapiens
ggggcagggccuuc

SEQ ID NO: 1232944 - RNA, 18 nt, Homo sapiens
ggggccacauuucaccuc

SEQ ID NO: 1232945 - RNA, 20 nt, Homo sapiens
ggggccacauuucaccuccu

SEQ ID NO: 1232946 - RNA, 13 nt, Homo sapiens
ggggccaggccag

SEQ ID NO: 1232947 - RNA, 20 nt, Homo sapiens
ggggcccugcaccugugcag

SEQ ID NO: 1232948 - RNA, 16 nt, Homo sapiens
ggggccuagacucugu

SEQ ID NO: 1232949 - RNA, 13 nt, Homo sapiens
ggggccuccagaa

SEQ ID NO: 1232950 - RNA, 18 nt, Homo sapiens
ggggccuugggugagugg

SEQ ID NO: 1232951 - RNA, 16 nt, Homo sapiens
ggggcucucagcucag

SEQ ID NO: 1232952 - RNA, 15 nt, Homo sapiens
ggggcuuugggccga

SEQ ID NO: 1232953 - RNA, 19 nt, Homo sapiens
gggggaaaaaaaaaaaaga

SEQ ID NO: 1232954 - RNA, 12 nt, Homo sapiens
gggggaaggugg

SEQ ID NO: 1232955 - RNA, 13 nt, Homo sapiens
gggggaugccuuc

SEQ ID NO: 1232956 - RNA, 22 nt, Homo sapiens
gggggcacucagccacgaccag

SEQ ID NO: 1232957 - RNA, 17 nt, Homo sapiens
gggggcaggcucugcca

SEQ ID NO: 1232958 - RNA, 20 nt, Homo sapiens
gggggccaggcgguggcuuc

SEQ ID NO: 1232959 - RNA, 14 nt, Homo sapiens
gggggucaccaggu

SEQ ID NO: 1232960 - RNA, 23 nt, Homo sapiens
gggguaccuuaagagacacucca

SEQ ID NO: 1232961 - RNA, 13 nt, Homo sapiens
gggguagccugag

SEQ ID NO: 1232962 - RNA, 17 nt, Homo sapiens
ggggucccaucagugaa

SEQ ID NO: 1232963 - RNA, 11 nt, Homo sapiens
ggggucucaga

SEQ ID NO: 1232964 - RNA, 11 nt, Homo sapiens
ggggugcugcc

SEQ ID NO: 1232965 - RNA, 14 nt, Homo sapiens
gggguuagaccacu

SEQ ID NO: 1232966 - RNA, 15 nt, Homo sapiens
gggguucuuccucac

SEQ ID NO: 1232967 - RNA, 20 nt, Homo sapiens
ggguaaaugcaaaguucugu

SEQ ID NO: 1232968 - RNA, 13 nt, Homo sapiens
ggguaaauucucu

SEQ ID NO: 1232969 - RNA, 19 nt, Homo sapiens
ggguaagaagaaagcaaaa

SEQ ID NO: 1232970 - RNA, 16 nt, Homo sapiens
ggguacaaaaagucaa

SEQ ID NO: 1232971 - RNA, 22 nt, Homo sapiens
ggguaccuuaagagacacucca

SEQ ID NO: 1232972 - RNA, 17 nt, Homo sapiens
ggguacucaauggagua

SEQ ID NO: 1232973 - RNA, 16 nt, Homo sapiens
gggucagccauuuuua

SEQ ID NO: 1232974 - RNA, 17 nt, Homo sapiens
ggguccacacaucuccc

SEQ ID NO: 1232975 - RNA, 13 nt, Homo sapiens
gggucgucugccc

SEQ ID NO: 1232976 - RNA, 21 nt, Homo sapiens
gggucucgcugucacuggcug

SEQ ID NO: 1232977 - RNA, 18 nt, Homo sapiens
gggucugggccagugcac

SEQ ID NO: 1232978 - RNA, 18 nt, Homo sapiens
gggucuucuaccucagac

SEQ ID NO: 1232979 - RNA, 12 nt, Homo sapiens
gggucuuugugg

SEQ ID NO: 1232980 - RNA, 11 nt, Homo sapiens
gggugagccag

SEQ ID NO: 1232981 - RNA, 22 nt, Homo sapiens
gggugauuuuaugaucaguguu

SEQ ID NO: 1232982 - RNA, 18 nt, Homo sapiens
gggugcagggcucagggg

SEQ ID NO: 1232983 - RNA, 21 nt, Homo sapiens
ggguggacauucagcagagug

SEQ ID NO: 1232984 - RNA, 15 nt, Homo sapiens
ggguggaucaccuga

SEQ ID NO: 1232985 - RNA, 20 nt, Homo sapiens
ggguggaucaccugugguca

SEQ ID NO: 1232986 - RNA, 14 nt, Homo sapiens
ggguggcauccagg

SEQ ID NO: 1232987 - RNA, 21 nt, Homo sapiens
ggguggcccuugcaguucagc

SEQ ID NO: 1232988 - RNA, 22 nt, Homo sapiens
gugagagugggagggagguaac

SEQ ID NO: 1232989 - RNA, 15 nt, Homo sapiens
gugagcacuaaggug

SEQ ID NO: 1232990 - RNA, 21 nt, Homo sapiens
gugagcacuaaggugugcucu

SEQ ID NO: 1232991 - RNA, 11 nt, Homo sapiens
gugagcacuag

SEQ ID NO: 1232992 - RNA, 14 nt, Homo sapiens
gugagcaguggaca

SEQ ID NO: 1232993 - RNA, 22 nt, Homo sapiens
gugagccaaagcuuaugugaca

SEQ ID NO: 1232994 - RNA, 15 nt, Homo sapiens
gugagcugagauugc

SEQ ID NO: 1232995 - RNA, 13 nt, Homo sapiens
gugagcuggugac

SEQ ID NO: 1232996 - RNA, 17 nt, Homo sapiens
gugagcuggugaccacc

SEQ ID NO: 1232997 - RNA, 16 nt, Homo sapiens
gugaggaagaacuaca

SEQ ID NO: 1232998 - RNA, 14 nt, Homo sapiens
gugaggagcacagc

SEQ ID NO: 1232999 - RNA, 14 nt, Homo sapiens
gugaggagggcagu

SEQ ID NO: 1233000 - RNA, 17 nt, Homo sapiens
gugaggagguucacuga

SEQ ID NO: 1233001 - RNA, 15 nt, Homo sapiens
gugaggcccauucuu

SEQ ID NO: 1233002 - RNA, 19 nt, Homo sapiens
gugauauacugguucacau

SEQ ID NO: 1233003 - RNA, 15 nt, Homo sapiens
gugauauauauuugu

SEQ ID NO: 1233004 - RNA, 22 nt, Homo sapiens
gugaucagaccauaauguuaca

SEQ ID NO: 1233005 - RNA, 18 nt, Homo sapiens
gugaucgucccaucccca

SEQ ID NO: 1233006 - RNA, 17 nt, Homo sapiens
gugaucugccgccucag

SEQ ID NO: 1233007 - RNA, 21 nt, Homo sapiens
gugaugaugaaaugaggucag

SEQ ID NO: 1233008 - RNA, 17 nt, Homo sapiens
gugaugaugcugugaca

SEQ ID NO: 1233009 - RNA, 23 nt, Homo sapiens
gugauggcgcgggaggcaccagc

SEQ ID NO: 1233010 - RNA, 21 nt, Homo sapiens
gugauguaccaguuuguccau

SEQ ID NO: 1233011 - RNA, 14 nt, Homo sapiens
gugauugcugccau

SEQ ID NO: 1233012 - RNA, 15 nt, Homo sapiens
gugauuuccagugag

SEQ ID NO: 1233013 - RNA, 18 nt, Homo sapiens
gugcaaaugugcugguca

SEQ ID NO: 1233014 - RNA, 12 nt, Homo sapiens
gugcacauuuau

SEQ ID NO: 1233015 - RNA, 18 nt, Homo sapiens
gugcaccacuucaaguga

SEQ ID NO: 1233016 - RNA, 15 nt, Homo sapiens
gugcaccugggagaa

SEQ ID NO: 1233017 - RNA, 19 nt, Homo sapiens
gugcagccccuuccuggug

SEQ ID NO: 1233018 - RNA, 21 nt, Homo sapiens
gugcagccccuuccuggugac

SEQ ID NO: 1233019 - RNA, 18 nt, Homo sapiens
gugcagcccuuccucccu

SEQ ID NO: 1233020 - RNA, 23 nt, Homo sapiens
gugcagcgcagcuggacucugca

SEQ ID NO: 1233021 - RNA, 17 nt, Homo sapiens
gugcagcgggugcugcu

SEQ ID NO: 1233022 - RNA, 19 nt, Homo sapiens
gugcaggauauuugcacua

SEQ ID NO: 1233023 - RNA, 21 nt, Homo sapiens
gugcaggauauuugcacuauu

SEQ ID NO: 1233024 - RNA, 15 nt, Homo sapiens
gugcaggccaccagu

SEQ ID NO: 1233025 - RNA, 22 nt, Homo sapiens
gugcaguacuuugugcauucug

SEQ ID NO: 1233026 - RNA, 19 nt, Homo sapiens
gugcaguggcgugaucucg

SEQ ID NO: 1233027 - RNA, 18 nt, Homo sapiens
gugcauuuguuuguauac

SEQ ID NO: 1233028 - RNA, 12 nt, Homo sapiens
gugccacccgca

SEQ ID NO: 1233029 - RNA, 14 nt, Homo sapiens
gugccacucauucc

SEQ ID NO: 1233030 - RNA, 13 nt, Homo sapiens
gugccauauuugu

SEQ ID NO: 1233031 - RNA, 13 nt, Homo sapiens
gugcccaugugua

SEQ ID NO: 1233032 - RNA, 22 nt, Homo sapiens
gugcccauguguacauucugcc

SEQ ID NO: 1233033 - RNA, 22 nt, Homo sapiens
gugccccacagcuaccugagac

SEQ ID NO: 1233034 - RNA, 19 nt, Homo sapiens
gugccccaugccuguccag

SEQ ID NO: 1233035 - RNA, 18 nt, Homo sapiens
gugcccccaggcucucau

SEQ ID NO: 1233036 - RNA, 15 nt, Homo sapiens
gugcccuccaaagag

SEQ ID NO: 1233037 - RNA, 17 nt, Homo sapiens
gugcccuuugggguccc

SEQ ID NO: 1233038 - RNA, 15 nt, Homo sapiens
gugccgaaugugcag

SEQ ID NO: 1233039 - RNA, 14 nt, Homo sapiens
gugccgccugcucc

SEQ ID NO: 1233040 - RNA, 14 nt, Homo sapiens
gugccuaacaccag

SEQ ID NO: 1233041 - RNA, 23 nt, Homo sapiens
gugccuagacuguuacuuuggca

SEQ ID NO: 1233042 - RNA, 21 nt, Homo sapiens
gugccuccaccaccacuggcc

SEQ ID NO: 1233043 - RNA, 22 nt, Homo sapiens
gugccuccaggugugcacgugg

SEQ ID NO: 1233044 - RNA, 11 nt, Homo sapiens
gugccugagac

SEQ ID NO: 1233045 - RNA, 15 nt, Homo sapiens
gugccuggacauuug

SEQ ID NO: 1233046 - RNA, 13 nt, Homo sapiens
gugccuggagcua

SEQ ID NO: 1233047 - RNA, 21 nt, Homo sapiens
gugccuuuaauuugcuacugu

SEQ ID NO: 1233048 - RNA, 16 nt, Homo sapiens
gugcgcgaugugacag

SEQ ID NO: 1233049 - RNA, 15 nt, Homo sapiens
gugcgcgcgugcaug

SEQ ID NO: 1233050 - RNA, 15 nt, Homo sapiens
gugcuagaugugcaa

SEQ ID NO: 1233051 - RNA, 14 nt, Homo sapiens
gugcuaugaagcuu

SEQ ID NO: 1233052 - RNA, 21 nt, Homo sapiens
gugcuaugaauuuucaaguaa

SEQ ID NO: 1233053 - RNA, 14 nt, Homo sapiens
gugcucacaaagga

SEQ ID NO: 1233054 - RNA, 20 nt, Homo sapiens
gugcuccuccuuggugccug

SEQ ID NO: 1233055 - RNA, 16 nt, Homo sapiens
gugcucugaugcaaua

SEQ ID NO: 1233056 - RNA, 12 nt, Homo sapiens
gugcucuuugcu

SEQ ID NO: 1233057 - RNA, 12 nt, Homo sapiens
gugcugcaccug

SEQ ID NO: 1233058 - RNA, 15 nt, Homo sapiens
gugcuggagacacuc

SEQ ID NO: 1233059 - RNA, 12 nt, Homo sapiens
gugcugugacaa

SEQ ID NO: 1233060 - RNA, 13 nt, Homo sapiens
gugcuguggcaua

SEQ ID NO: 1233061 - RNA, 18 nt, Homo sapiens
gugcugugggcagcaccc

SEQ ID NO: 1233062 - RNA, 22 nt, Homo sapiens
gugcuuccacuucuaugcaaau

SEQ ID NO: 1233063 - RNA, 19 nt, Homo sapiens
gugcuuccgagcugggaug

SEQ ID NO: 1233064 - RNA, 15 nt, Homo sapiens
gugcuugagccagga

SEQ ID NO: 1233065 - RNA, 13 nt, Homo sapiens
guuaugugaauga

SEQ ID NO: 1233066 - RNA, 15 nt, Homo sapiens
guuauguucagucac

SEQ ID NO: 1233067 - RNA, 15 nt, Homo sapiens
guuauguuugcacuu

SEQ ID NO: 1233068 - RNA, 22 nt, Homo sapiens
guuauuaguccaaaugugauca

SEQ ID NO: 1233069 - RNA, 18 nt, Homo sapiens
guuauuauuuugcacugu

SEQ ID NO: 1233070 - RNA, 15 nt, Homo sapiens
guuauucagaaccua

SEQ ID NO: 1233071 - RNA, 15 nt, Homo sapiens
guuauuuuaauuauc

SEQ ID NO: 1233072 - RNA, 20 nt, Homo sapiens
guucaaaacauucauaggca

SEQ ID NO: 1233073 - RNA, 16 nt, Homo sapiens
guucaaaacauuccaa

SEQ ID NO: 1233074 - RNA, 13 nt, Homo sapiens
guucaaagcacag

SEQ ID NO: 1233075 - RNA, 16 nt, Homo sapiens
guucaaauucuucuga

SEQ ID NO: 1233076 - RNA, 12 nt, Homo sapiens
guucaacaaagg

SEQ ID NO: 1233077 - RNA, 13 nt, Homo sapiens
guucaacaucuaa

SEQ ID NO: 1233078 - RNA, 15 nt, Homo sapiens
guucaagaccagccu

SEQ ID NO: 1233079 - RNA, 15 nt, Homo sapiens
guucaauacagugaa

SEQ ID NO: 1233080 - RNA, 13 nt, Homo sapiens
guucaaucauuga

SEQ ID NO: 1233081 - RNA, 13 nt, Homo sapiens
guucaauguucca

SEQ ID NO: 1233082 - RNA, 17 nt, Homo sapiens
guucaccucugccuugg

SEQ ID NO: 1233083 - RNA, 18 nt, Homo sapiens
guucacucggcacuacuu

SEQ ID NO: 1233084 - RNA, 17 nt, Homo sapiens
guucacucuacuuagca

SEQ ID NO: 1233085 - RNA, 24 nt, Homo sapiens
guucacugagcuccccagaucucc

SEQ ID NO: 1233086 - RNA, 18 nt, Homo sapiens
guucacuggacacuucac

SEQ ID NO: 1233087 - RNA, 16 nt, Homo sapiens
guucacuuucuaucuu

SEQ ID NO: 1233088 - RNA, 24 nt, Homo sapiens
guucagcacugucccuugccucaa

SEQ ID NO: 1233089 - RNA, 17 nt, Homo sapiens
guucagcauucuuagcc

SEQ ID NO: 1233090 - RNA, 12 nt, Homo sapiens
guucaggccagu

SEQ ID NO: 1233091 - RNA, 13 nt, Homo sapiens
guucaggguccuu

SEQ ID NO: 1233092 - RNA, 21 nt, Homo sapiens
guucaguggcagggcucagga

SEQ ID NO: 1233093 - RNA, 13 nt, Homo sapiens
guucaguucuguu

SEQ ID NO: 1233094 - RNA, 19 nt, Homo sapiens
guucauauuggacugauaa

SEQ ID NO: 1233095 - RNA, 20 nt, Homo sapiens
guucauauuuauacuuugca

SEQ ID NO: 1233096 - RNA, 21 nt, Homo sapiens
guucauauuuauacuuugcaa

SEQ ID NO: 1233097 - RNA, 17 nt, Homo sapiens
guucauccaggcccaac

SEQ ID NO: 1233098 - RNA, 21 nt, Homo sapiens
guucauuuagauaauuugaaa

SEQ ID NO: 1233099 - RNA, 15 nt, Homo sapiens
guuccaaaagcacag

SEQ ID NO: 1233100 - RNA, 17 nt, Homo sapiens
guuccaaugucaaugug

SEQ ID NO: 1233101 - RNA, 20 nt, Homo sapiens
guuccacacccaaugcugcu

SEQ ID NO: 1233102 - RNA, 20 nt, Homo sapiens
guuccaccuggggcuucccu

SEQ ID NO: 1233103 - RNA, 15 nt, Homo sapiens
guuccagauguggau

SEQ ID NO: 1233104 - RNA, 21 nt, Homo sapiens
guuccaguaccgcccucgggg

SEQ ID NO: 1233105 - RNA, 14 nt, Homo sapiens
guuccaguacuaug

SEQ ID NO: 1233106 - RNA, 22 nt, Homo sapiens
guuccauuuuuccucuguucac

SEQ ID NO: 1233107 - RNA, 23 nt, Homo sapiens
guuccauuuuuccucuguucaca

SEQ ID NO: 1233108 - RNA, 15 nt, Homo sapiens
guucccacuccuuca

SEQ ID NO: 1233109 - RNA, 14 nt, Homo sapiens
guucccccaaccuc

SEQ ID NO: 1233110 - RNA, 18 nt, Homo sapiens
guuccccgauaccaugcu

SEQ ID NO: 1233111 - RNA, 20 nt, Homo sapiens
guuccccuaguucuacauga

SEQ ID NO: 1233112 - RNA, 15 nt, Homo sapiens
guuccccuucaguac

SEQ ID NO: 1233113 - RNA, 22 nt, Homo sapiens
guucccugacuccuccaaggaa

SEQ ID NO: 1233114 - RNA, 14 nt, Homo sapiens
guucccugugucau

SEQ ID NO: 1233115 - RNA, 15 nt, Homo sapiens
guucccuguucuucc

SEQ ID NO: 1233116 - RNA, 19 nt, Homo sapiens
guucccuugcagggguccc

SEQ ID NO: 1233117 - RNA, 17 nt, Homo sapiens
guuccucaagguccauu

SEQ ID NO: 1233118 - RNA, 19 nt, Homo sapiens
guuccugaaaauugcaaua

SEQ ID NO: 1233119 - RNA, 12 nt, Homo sapiens
guuccuggugac

SEQ ID NO: 1233120 - RNA, 16 nt, Homo sapiens
guuccuggugacuccu

SEQ ID NO: 1233121 - RNA, 20 nt, Homo sapiens
guuccuuuuaacggaugguu

SEQ ID NO: 1233122 - RNA, 19 nt, Homo sapiens
guucgauguuagcguuuac

SEQ ID NO: 1233123 - RNA, 13 nt, Homo sapiens
guucgcuuaucaa

SEQ ID NO: 1233124 - RNA, 19 nt, Homo sapiens
guucuaagcccccacacag

SEQ ID NO: 1233125 - RNA, 17 nt, Homo sapiens
guucuacacucaucuua

SEQ ID NO: 1233126 - RNA, 18 nt, Homo sapiens
guucuacauaaguaauuc

SEQ ID NO: 1233127 - RNA, 15 nt, Homo sapiens
guucuagucaugugu

SEQ ID NO: 1233128 - RNA, 21 nt, Homo sapiens
guucuauauaaaaaacauaau

SEQ ID NO: 1233129 - RNA, 15 nt, Homo sapiens
guucucuucuucauu

SEQ ID NO: 1233130 - RNA, 19 nt, Homo sapiens
guucucuucuucauucuau

SEQ ID NO: 1233131 - RNA, 17 nt, Homo sapiens
guucugagaccagugua

SEQ ID NO: 1233132 - RNA, 15 nt, Homo sapiens
guucugcccauggga

SEQ ID NO: 1233133 - RNA, 24 nt, Homo sapiens
guucugcuucaauaaaucuuugga

SEQ ID NO: 1233134 - RNA, 15 nt, Homo sapiens
guucugggacacagu

SEQ ID NO: 1233135 - RNA, 20 nt, Homo sapiens
guucugggcucuuuccucug

SEQ ID NO: 1233136 - RNA, 16 nt, Homo sapiens
guucugggugcagcug

SEQ ID NO: 1233137 - RNA, 13 nt, Homo sapiens
guucuuacuugac

SEQ ID NO: 1233138 - RNA, 13 nt, Homo sapiens
guucuuaguguca

SEQ ID NO: 1233139 - RNA, 16 nt, Homo sapiens
guucuuagugucacuu

SEQ ID NO: 1233140 - RNA, 17 nt, Homo sapiens
guucuucagggccaguc

SEQ ID NO: 1233141 - RNA, 21 nt, Homo sapiens
guucuucuucccaguucuuga

SEQ ID NO: 1233142 - RNA, 13 nt, Homo sapiens
guucuugcugcua

SEQ ID NO: 1233143 - RNA, 14 nt, Homo sapiens
guucuugcugcuag

SEQ ID NO: 1233144 - RNA, 22 nt, Homo sapiens
guucuuguuuuauauaccuggc

SEQ ID NO: 1233145 - RNA, 23 nt, Homo sapiens
uugcuaaauauaaaaacauaaau

SEQ ID NO: 1233146 - RNA, 22 nt, Homo sapiens
uugcuaguauucgcuguguuca

SEQ ID NO: 1233147 - RNA, 15 nt, Homo sapiens
uugcuauagagccua

SEQ ID NO: 1233148 - RNA, 18 nt, Homo sapiens
uugcuaugagguuugcuu

SEQ ID NO: 1233149 - RNA, 16 nt, Homo sapiens
uugcuccuaacuccac

SEQ ID NO: 1233150 - RNA, 19 nt, Homo sapiens
uugcucuacaaugacacac

SEQ ID NO: 1233151 - RNA, 19 nt, Homo sapiens
uugcucucgacaguaucca

SEQ ID NO: 1233152 - RNA, 20 nt, Homo sapiens
uugcugaagugguugcauuc

SEQ ID NO: 1233153 - RNA, 19 nt, Homo sapiens
uugcuggagccugagucag

SEQ ID NO: 1233154 - RNA, 21 nt, Homo sapiens
uugcugucauaagaaugaaua

SEQ ID NO: 1233155 - RNA, 13 nt, Homo sapiens
uugcuguguuuaa

SEQ ID NO: 1233156 - RNA, 17 nt, Homo sapiens
uugcuuaaaauugugag

SEQ ID NO: 1233157 - RNA, 16 nt, Homo sapiens
uugcuuauuacauuua

SEQ ID NO: 1233158 - RNA, 14 nt, Homo sapiens
uugcuuauugcuua

SEQ ID NO: 1233159 - RNA, 20 nt, Homo sapiens
uugcuucuguaguacuccuu

SEQ ID NO: 1233160 - RNA, 13 nt, Homo sapiens
uugcuugcaaugu

SEQ ID NO: 1233161 - RNA, 15 nt, Homo sapiens
uugcuuuauuccaga

SEQ ID NO: 1233162 - RNA, 19 nt, Homo sapiens
uugcuuugauuuacagcaa

SEQ ID NO: 1233163 - RNA, 18 nt, Homo sapiens
uugcuuuucacauccauu

SEQ ID NO: 1233164 - RNA, 18 nt, Homo sapiens
uuggaaaaaaaccacagc

SEQ ID NO: 1233165 - RNA, 18 nt, Homo sapiens
uuggaaaaaauguuguaa

SEQ ID NO: 1233166 - RNA, 18 nt, Homo sapiens
uuggaaaaagccugugaa

SEQ ID NO: 1233167 - RNA, 17 nt, Homo sapiens
uuggaaagcaucaccuc

SEQ ID NO: 1233168 - RNA, 23 nt, Homo sapiens
uuggaaagcaucaccucaggcca

SEQ ID NO: 1233169 - RNA, 12 nt, Homo sapiens
uuggaaauggau

SEQ ID NO: 1233170 - RNA, 19 nt, Homo sapiens
uuggaagaggcugagacau

SEQ ID NO: 1233171 - RNA, 14 nt, Homo sapiens
uuggaagauggcau

SEQ ID NO: 1233172 - RNA, 23 nt, Homo sapiens
uuggaagcauacaaagcaguuua

SEQ ID NO: 1233173 - RNA, 15 nt, Homo sapiens
uuggaaggggccuug

SEQ ID NO: 1233174 - RNA, 14 nt, Homo sapiens
uuggaauauuacaa

SEQ ID NO: 1233175 - RNA, 13 nt, Homo sapiens
uuggaauuuguaa

SEQ ID NO: 1233176 - RNA, 16 nt, Homo sapiens
uuggacauuuucuuca

SEQ ID NO: 1233177 - RNA, 20 nt, Homo sapiens
uuggaccgauaagugugcuu

SEQ ID NO: 1233178 - RNA, 21 nt, Homo sapiens
uuggagacugggguggccuca

SEQ ID NO: 1233179 - RNA, 16 nt, Homo sapiens
uuggagaguuugccug

SEQ ID NO: 1233180 - RNA, 15 nt, Homo sapiens
uuggagcaaaccauu

SEQ ID NO: 1233181 - RNA, 18 nt, Homo sapiens
uuggagcagcuucuggga

SEQ ID NO: 1233182 - RNA, 22 nt, Homo sapiens
uuggagcucauucugucucuuu

SEQ ID NO: 1233183 - RNA, 15 nt, Homo sapiens
uuggaggaucaaaga

SEQ ID NO: 1233184 - RNA, 12 nt, Homo sapiens
uuggagggauaa

SEQ ID NO: 1233185 - RNA, 17 nt, Homo sapiens
uuggagggugucccaaa

SEQ ID NO: 1233186 - RNA, 17 nt, Homo sapiens
uuggagguuaaggcaua

SEQ ID NO: 1233187 - RNA, 12 nt, Homo sapiens
uuggaguuuucu

SEQ ID NO: 1233188 - RNA, 18 nt, Homo sapiens
uuggauaaguuucuauuc

SEQ ID NO: 1233189 - RNA, 20 nt, Homo sapiens
uuggauaucaaaagcaaaua

SEQ ID NO: 1233190 - RNA, 21 nt, Homo sapiens
uuggauuaugaagugacucuc

SEQ ID NO: 1233191 - RNA, 13 nt, Homo sapiens
uuggauuccucac

SEQ ID NO: 1233192 - RNA, 12 nt, Homo sapiens
uuggcaaugcau

SEQ ID NO: 1233193 - RNA, 13 nt, Homo sapiens
uuggcacacagca

SEQ ID NO: 1233194 - RNA, 23 nt, Homo sapiens
uuggcaccccuuucuaguucaau

SEQ ID NO: 1233195 - RNA, 18 nt, Homo sapiens
uuggcaggcuggccaguc

SEQ ID NO: 1233196 - RNA, 18 nt, Homo sapiens
uuggcauggauuucuguc

SEQ ID NO: 1233197 - RNA, 22 nt, Homo sapiens
uuggcccugggccccuggccau

SEQ ID NO: 1233198 - RNA, 14 nt, Homo sapiens
uuggccggcugugc

SEQ ID NO: 1233199 - RNA, 16 nt, Homo sapiens
uuggccgugaggacac

SEQ ID NO: 1233200 - RNA, 20 nt, Homo sapiens
uuggccucagcuggcuguau

SEQ ID NO: 1233201 - RNA, 19 nt, Homo sapiens
uuggcuaguaaaagccauc

SEQ ID NO: 1233202 - RNA, 14 nt, Homo sapiens
uuggcucaccauaa

SEQ ID NO: 1233203 - RNA, 16 nt, Homo sapiens
uuggcucaccauaacc

SEQ ID NO: 1233204 - RNA, 15 nt, Homo sapiens
uuggcuuccaugaug

SEQ ID NO: 1233205 - RNA, 19 nt, Homo sapiens
uuggcuuguguguuucacu

SEQ ID NO: 1233206 - RNA, 21 nt, Homo sapiens
uugggaaaaaaacuuggcacu

SEQ ID NO: 1233207 - RNA, 21 nt, Homo sapiens
uugggaaaaaggccucugucc

SEQ ID NO: 1233208 - RNA, 17 nt, Homo sapiens
uugggaaaacauuugcu

SEQ ID NO: 1233209 - RNA, 17 nt, Homo sapiens
uugggaaagcucuuguc

SEQ ID NO: 1233210 - RNA, 21 nt, Homo sapiens
uugggaacggacugguaugua

SEQ ID NO: 1233211 - RNA, 15 nt, Homo sapiens
uugggacucaggaua

SEQ ID NO: 1233212 - RNA, 17 nt, Homo sapiens
uugggagacaugugaca

SEQ ID NO: 1233213 - RNA, 21 nt, Homo sapiens
uugggagcaccgccugugaaa

SEQ ID NO: 1233214 - RNA, 13 nt, Homo sapiens
uugggauuuuucu

SEQ ID NO: 1233215 - RNA, 14 nt, Homo sapiens
uugggcaugccauu

SEQ ID NO: 1233216 - RNA, 21 nt, Homo sapiens
uugggccagugaacaggguaa

SEQ ID NO: 1233217 - RNA, 21 nt, Homo sapiens
uugggcguuugaacucaggga

SEQ ID NO: 1233218 - RNA, 18 nt, Homo sapiens
uugggcuauuuggacuca

SEQ ID NO: 1233219 - RNA, 20 nt, Homo sapiens
uugggcuggaugccgaggua

SEQ ID NO: 1233220 - RNA, 16 nt, Homo sapiens
uugggcuggugucacc

SEQ ID NO: 1233221 - RNA, 10 nt, Homo sapiens
uuggggacuc

SEQ ID NO: 1233222 - RNA, 19 nt, Homo sapiens
uuggggagcaggaggccaa

SEQ ID NO: 1233223 - RNA, 13 nt, Homo sapiens
uuggggucaggaa

SEQ ID NO: 1233224 - RNA, 13 nt, Homo sapiens
uugggugugcuga

SEQ ID NO: 1233225 - RNA, 19 nt, Homo sapiens
uugguaaaaugcaucaaaa

SEQ ID NO: 1233226 - RNA, 21 nt, Homo sapiens
uugguacuacuagaugucuuu

SEQ ID NO: 1233227 - RNA, 17 nt, Homo sapiens
uugguagaaggacugaa

SEQ ID NO: 1233228 - RNA, 16 nt, Homo sapiens
uugguauaauguuuaa

SEQ ID NO: 1233229 - RNA, 23 nt, Homo sapiens
uugguccagagcggaggcugugu

SEQ ID NO: 1233230 - RNA, 15 nt, Homo sapiens
uuggugaauuucaca

SEQ ID NO: 1233231 - RNA, 22 nt, Homo sapiens
uuggugaauuucacaagcuauu

SEQ ID NO: 1233232 - RNA, 11 nt, Homo sapiens
uuggugccacu

SEQ ID NO: 1233233 - RNA, 13 nt, Homo sapiens
uuggugcuagaaa

SEQ ID NO: 1233234 - RNA, 20 nt, Homo sapiens
uugguggcgcgcaccuguag

SEQ ID NO: 1233235 - RNA, 18 nt, Homo sapiens
uugguggggccaggccag

SEQ ID NO: 1233236 - RNA, 22 nt, Homo sapiens
uugguguauguaugaguaucug

SEQ ID NO: 1233237 - RNA, 16 nt, Homo sapiens
uugguuccuucugccc

SEQ ID NO: 1233238 - RNA, 12 nt, Homo sapiens
uugguugugaau

SEQ ID NO: 1233239 - RNA, 18 nt, Homo sapiens
uugguuuaaagaaagugu

SEQ ID NO: 1233240 - RNA, 14 nt, Homo sapiens
uugguuugacccag

SEQ ID NO: 1233241 - RNA, 18 nt, Homo sapiens
uugguuuuggggguguga

SEQ ID NO: 1233242 - RNA, 20 nt, Homo sapiens
uuguaaaacaaaauuugacu

SEQ ID NO: 1233243 - RNA, 17 nt, Homo sapiens
uuguaaauagcucaggu

SEQ ID NO: 1233244 - RNA, 16 nt, Homo sapiens
uuguaacauucacaca

SEQ ID NO: 1233245 - RNA, 15 nt, Homo sapiens
uuguaagacuuacaa

SEQ ID NO: 1233246 - RNA, 23 nt, Homo sapiens
uuguaaguggucgcuuacuuuga

SEQ ID NO: 1233247 - RNA, 13 nt, Homo sapiens
uuguaaugcugca

SEQ ID NO: 1233248 - RNA, 19 nt, Homo sapiens
uuguacaaaauuaagcaaa

SEQ ID NO: 1233249 - RNA, 14 nt, Homo sapiens
uuguacacugcugu

SEQ ID NO: 1233250 - RNA, 14 nt, Homo sapiens
uuguaccauauaga

SEQ ID NO: 1233251 - RNA, 21 nt, Homo sapiens
uuguaccauauagagguguaa

SEQ ID NO: 1233252 - RNA, 17 nt, Homo sapiens
uuguagacaaaguacau

SEQ ID NO: 1233253 - RNA, 19 nt, Homo sapiens
uuguagagauggggucuca

SEQ ID NO: 1233254 - RNA, 21 nt, Homo sapiens
uuguagagauggggucucaca

SEQ ID NO: 1233255 - RNA, 12 nt, Homo sapiens
uuuccaggguug

SEQ ID NO: 1233256 - RNA, 17 nt, Homo sapiens
uuuccaggguugcuuga

SEQ ID NO: 1233257 - RNA, 23 nt, Homo sapiens
uuuccaguuuauaagacuggaau

SEQ ID NO: 1233258 - RNA, 11 nt, Homo sapiens
uuuccauacag

SEQ ID NO: 1233259 - RNA, 18 nt, Homo sapiens
uuuccauauggauuuucu

SEQ ID NO: 1233260 - RNA, 16 nt, Homo sapiens
uuuccauccaguuccu

SEQ ID NO: 1233261 - RNA, 22 nt, Homo sapiens
uuuccaugcacccucauacaca

SEQ ID NO: 1233262 - RNA, 22 nt, Homo sapiens
uuucccacgaggaaucuguggg

SEQ ID NO: 1233263 - RNA, 16 nt, Homo sapiens
uuucccucgcuaugug

SEQ ID NO: 1233264 - RNA, 16 nt, Homo sapiens
uuuccuaggcagauca

SEQ ID NO: 1233265 - RNA, 22 nt, Homo sapiens
uuuccuaucauguuaaccucug

SEQ ID NO: 1233266 - RNA, 22 nt, Homo sapiens
uuuccuauguuucacugugcaa

SEQ ID NO: 1233267 - RNA, 22 nt, Homo sapiens
uuuccucagccuuaagaaccau

SEQ ID NO: 1233268 - RNA, 15 nt, Homo sapiens
uuuccuccucaggca

SEQ ID NO: 1233269 - RNA, 21 nt, Homo sapiens
uuuccucuuccccuugcccuu

SEQ ID NO: 1233270 - RNA, 20 nt, Homo sapiens
uuuccuggucagcauguacu

SEQ ID NO: 1233271 - RNA, 17 nt, Homo sapiens
uuuccuggucccucacc

SEQ ID NO: 1233272 - RNA, 23 nt, Homo sapiens
uuuccuuauucaggaagauaaaa

SEQ ID NO: 1233273 - RNA, 14 nt, Homo sapiens
uuuccuucauucau

SEQ ID NO: 1233274 - RNA, 20 nt, Homo sapiens
uuuccuucggguuggcaaaa

SEQ ID NO: 1233275 - RNA, 18 nt, Homo sapiens
uuuccuugacuucuuuga

SEQ ID NO: 1233276 - RNA, 12 nt, Homo sapiens
uuuccuugcuca

SEQ ID NO: 1233277 - RNA, 15 nt, Homo sapiens
uuuccuuucugccac

SEQ ID NO: 1233278 - RNA, 18 nt, Homo sapiens
uuuccuuugguccuucaa

SEQ ID NO: 1233279 - RNA, 16 nt, Homo sapiens
uuucgugcacucugcu

SEQ ID NO: 1233280 - RNA, 14 nt, Homo sapiens
uuucuaagauucua

SEQ ID NO: 1233281 - RNA, 21 nt, Homo sapiens
uuucuaaguguucgucuuuag

SEQ ID NO: 1233282 - RNA, 22 nt, Homo sapiens
uuucuacuaaaaauacaaaaau

SEQ ID NO: 1233283 - RNA, 14 nt, Homo sapiens
uuucuaugugacaa

SEQ ID NO: 1233284 - RNA, 21 nt, Homo sapiens
uuucucaaaauggaagcccuu

SEQ ID NO: 1233285 - RNA, 23 nt, Homo sapiens
uuucucaaaggcccucagugaga

SEQ ID NO: 1233286 - RNA, 14 nt, Homo sapiens
uuucucaaaugcac

SEQ ID NO: 1233287 - RNA, 19 nt, Homo sapiens
uuucucaccugucaucuca

SEQ ID NO: 1233288 - RNA, 14 nt, Homo sapiens
uuucucauacuuag

SEQ ID NO: 1233289 - RNA, 13 nt, Homo sapiens
uuucuccagugcu

SEQ ID NO: 1233290 - RNA, 15 nt, Homo sapiens
uuucuccauaucaaa

SEQ ID NO: 1233291 - RNA, 16 nt, Homo sapiens
uuucuccguugaguca

SEQ ID NO: 1233292 - RNA, 15 nt, Homo sapiens
uuucuccuuagucuu

SEQ ID NO: 1233293 - RNA, 18 nt, Homo sapiens
uuucucgccucacuuucc

SEQ ID NO: 1233294 - RNA, 15 nt, Homo sapiens
uuucucgggugcauu

SEQ ID NO: 1233295 - RNA, 20 nt, Homo sapiens
uuucucuaacuccugccauu

SEQ ID NO: 1233296 - RNA, 21 nt, Homo sapiens
uuucucugagcagucagggug

SEQ ID NO: 1233297 - RNA, 23 nt, Homo sapiens
uuucucuugcuggaacuguugaa

SEQ ID NO: 1233298 - RNA, 21 nt, Homo sapiens
uuucugauaaaagauggccau

SEQ ID NO: 1233299 - RNA, 15 nt, Homo sapiens
uuucugauaccacug

SEQ ID NO: 1233300 - RNA, 16 nt, Homo sapiens
uuucugauacugcuga

SEQ ID NO: 1233301 - RNA, 17 nt, Homo sapiens
uuucugcauagagucuu

SEQ ID NO: 1233302 - RNA, 19 nt, Homo sapiens
uuucugcuaaaaaguccuu

SEQ ID NO: 1233303 - RNA, 22 nt, Homo sapiens
uuucugcuaaaaaguccuugau

SEQ ID NO: 1233304 - RNA, 23 nt, Homo sapiens
uuucuggacaguaccugauugua

SEQ ID NO: 1233305 - RNA, 22 nt, Homo sapiens
uuucuggggaugucccagggug

SEQ ID NO: 1233306 - RNA, 13 nt, Homo sapiens
uuucuggugccau

SEQ ID NO: 1233307 - RNA, 18 nt, Homo sapiens
uuucuguagcaccagaga

SEQ ID NO: 1233308 - RNA, 16 nt, Homo sapiens
uuucuguauauacuca

SEQ ID NO: 1233309 - RNA, 15 nt, Homo sapiens
uuucugugcagagau

SEQ ID NO: 1233310 - RNA, 16 nt, Homo sapiens
uuucuuaccaccucuu

SEQ ID NO: 1233311 - RNA, 16 nt, Homo sapiens
uuucuuagugugccaa

SEQ ID NO: 1233312 - RNA, 18 nt, Homo sapiens
uuucuucaguccagagaa

SEQ ID NO: 1233313 - RNA, 15 nt, Homo sapiens
uuucuucuuaaccua

SEQ ID NO: 1233314 - RNA, 22 nt, Homo sapiens
uuucuucuugugauugcugcca

SEQ ID NO: 1233315 - RNA, 22 nt, Homo sapiens
uuucuuggcaaaagccuugugu

SEQ ID NO: 1233316 - RNA, 14 nt, Homo sapiens
uuucuuuaucauug

SEQ ID NO: 1233317 - RNA, 13 nt, Homo sapiens
uuucuuucugcca

SEQ ID NO: 1233318 - RNA, 17 nt, Homo sapiens
uuucuuugcaccaaaga

SEQ ID NO: 1233319 - RNA, 16 nt, Homo sapiens
uuucuuuuacagacua

SEQ ID NO: 1233320 - RNA, 18 nt, Homo sapiens
uuucuuuuuuauacucaa

SEQ ID NO: 1233321 - RNA, 13 nt, Homo sapiens
uuugaaauaccuu

SEQ ID NO: 1233322 - RNA, 20 nt, Homo sapiens
uuugaaauagucugugugaa

SEQ ID NO: 1233323 - RNA, 21 nt, Homo sapiens
uuugaaaugaaauuuaaacau

SEQ ID NO: 1233324 - RNA, 19 nt, Homo sapiens
uuugaacccuugcuugcaa

SEQ ID NO: 1233325 - RNA, 19 nt, Homo sapiens
uuugaagcugcagugagcu

SEQ ID NO: 1233326 - RNA, 23 nt, Homo sapiens
uuugaagguuuuaagugguuuga

SEQ ID NO: 1233327 - RNA, 14 nt, Homo sapiens
uuugacaaccauga

SEQ ID NO: 1233328 - RNA, 14 nt, Homo sapiens
uuugacacugcucu

SEQ ID NO: 1233329 - RNA, 22 nt, Homo sapiens
uuugacugaauguuuuauggaa

SEQ ID NO: 1233330 - RNA, 14 nt, Homo sapiens
uuugacuugaauau

SEQ ID NO: 1233331 - RNA, 20 nt, Homo sapiens
uuugacuugcaugaagagaa

SEQ ID NO: 1233332 - RNA, 13 nt, Homo sapiens
uuugagaauguuu

SEQ ID NO: 1233333 - RNA, 19 nt, Homo sapiens
uuugagaucaucagugaua

SEQ ID NO: 1233334 - RNA, 21 nt, Homo sapiens
uuugagcccacaaagccuuau

SEQ ID NO: 1233335 - RNA, 14 nt, Homo sapiens
uuugaggagcaugu

SEQ ID NO: 1233336 - RNA, 21 nt, Homo sapiens
uuugaggcaaauuaacuguau

SEQ ID NO: 1233337 - RNA, 20 nt, Homo sapiens
uuugaggccuuuuuugccag

SEQ ID NO: 1233338 - RNA, 17 nt, Homo sapiens
uuugagguaaagauaug

SEQ ID NO: 1233339 - RNA, 17 nt, Homo sapiens
uuugaggugaggguugg

SEQ ID NO: 1233340 - RNA, 20 nt, Homo sapiens
uuugaguagauauuacuuua

SEQ ID NO: 1233341 - RNA, 13 nt, Homo sapiens
uuugagugauccu

SEQ ID NO: 1233342 - RNA, 15 nt, Homo sapiens
uuugaguugaauuua

SEQ ID NO: 1233343 - RNA, 15 nt, Homo sapiens
uuugaguuucucucc

SEQ ID NO: 1233344 - RNA, 19 nt, Homo sapiens
uuugauacaagaaagcaau

SEQ ID NO: 1233345 - RNA, 23 nt, Homo sapiens
uuugauaccauggcacugacaau

SEQ ID NO: 1233346 - RNA, 17 nt, Homo sapiens
uuugauaccugcacugu

SEQ ID NO: 1233347 - RNA, 21 nt, Homo sapiens
uuugauaccuguaguggaacu

SEQ ID NO: 1233348 - RNA, 20 nt, Homo sapiens
uuugauacucccagucuugu

SEQ ID NO: 1233349 - RNA, 12 nt, Homo sapiens
uuugauacuuau

SEQ ID NO: 1233350 - RNA, 19 nt, Homo sapiens
uuugauagggaacugggga

SEQ ID NO: 1233351 - RNA, 16 nt, Homo sapiens
uuugauauacauugug

SEQ ID NO: 1233352 - RNA, 17 nt, Homo sapiens
uuugauauuugcauuga

SEQ ID NO: 1233353 - RNA, 18 nt, Homo sapiens
uuugauccugggggacca

SEQ ID NO: 1233354 - RNA, 12 nt, Homo sapiens
uuugaugccauu

SEQ ID NO: 1233355 - RNA, 21 nt, Homo sapiens
uuugauuaacaaauaugcuaa

SEQ ID NO: 1233356 - RNA, 13 nt, Homo sapiens
uuugcaaacguuc

SEQ ID NO: 1233357 - RNA, 18 nt, Homo sapiens
uuugcacacuugugugug

SEQ ID NO: 1233358 - RNA, 20 nt, Homo sapiens
uuugcacaggaaagagucac

SEQ ID NO: 1233359 - RNA, 21 nt, Homo sapiens
uuugcaggguccucuucuggg

SEQ ID NO: 1233360 - RNA, 18 nt, Homo sapiens
uuugcauauuucaauguc

SEQ ID NO: 1233361 - RNA, 19 nt, Homo sapiens
uuugccaaaauaccagagc

SEQ ID NO: 1233362 - RNA, 10 nt, Homo sapiens
uuugccauuu

SEQ ID NO: 1233363 - RNA, 10 nt, Homo sapiens
uuugccuucc

SEQ ID NO: 1233364 - RNA, 14 nt, Homo sapiens
uuugcuacauucua

SEQ ID NO: 1233365 - RNA, 21 nt, Homo sapiens
uuugcuauaguuauacaucaa

SEQ ID NO: 1233366 - RNA, 15 nt, Homo sapiens
uuugcuaucugggcu

SEQ ID NO: 1233367 - RNA, 15 nt, Homo sapiens
uuugcugacuuuaaa

SEQ ID NO: 1233368 - RNA, 17 nt, Homo sapiens
uuugcugaguuguucua

SEQ ID NO: 1233369 - RNA, 16 nt, Homo sapiens
uuugcuguacucuugc

SEQ ID NO: 1233370 - RNA, 18 nt, Homo sapiens
uuugcuguggaacuacau

SEQ ID NO: 1233371 - RNA, 17 nt, Homo sapiens
uuugcuguuaacuguua

SEQ ID NO: 1233372 - RNA, 21 nt, Homo sapiens
uuugcuguuguuucuaaacaa

SEQ ID NO: 1233373 - RNA, 22 nt, Homo sapiens
uuugcuucaaauucaaggccuu

SEQ ID NO: 1233374 - RNA, 16 nt, Homo sapiens
uuugcuuuucaggguu

SEQ ID NO: 1233375 - RNA, 14 nt, Homo sapiens
uuuggaaagccauu

SEQ ID NO: 1233376 - RNA, 17 nt, Homo sapiens
uuuggacuguaacugac

SEQ ID NO: 1233377 - RNA, 15 nt, Homo sapiens
uuuggagagugcuau

SEQ ID NO: 1233378 - RNA, 21 nt, Homo sapiens
uuuggauaucaaaagcaaaua

SEQ ID NO: 1233379 - RNA, 16 nt, Homo sapiens
uuuggauaugaucuuu

SEQ ID NO: 1233380 - RNA, 13 nt, Homo sapiens
uuuggauuccuca

SEQ ID NO: 1233381 - RNA, 17 nt, Homo sapiens
uuugggacuugggagcu

SEQ ID NO: 1233382 - RNA, 21 nt, Homo sapiens
uuugggagacugugcucucug

SEQ ID NO: 1233383 - RNA, 23 nt, Homo sapiens
uuuggguggaauggacuacucca

SEQ ID NO: 1233384 - RNA, 19 nt, Homo sapiens
uuugguaaaaaugcugcuc

SEQ ID NO: 1233385 - RNA, 18 nt, Homo sapiens
uuugguaggcuuaucaaa

SEQ ID NO: 1233386 - RNA, 19 nt, Homo sapiens
uuuggugggcuuuggagcu

SEQ ID NO: 1233387 - RNA, 15 nt, Homo sapiens
uuuguaagaugcugg

SEQ ID NO: 1233388 - RNA, 15 nt, Homo sapiens
uuuguaauauucucc

SEQ ID NO: 1233389 - RNA, 16 nt, Homo sapiens
uuuguaauauucucuc

SEQ ID NO: 1233390 - RNA, 14 nt, Homo sapiens
uuuguaaugcugca

SEQ ID NO: 1233391 - RNA, 15 nt, Homo sapiens
uuuguaaugcugcac

SEQ ID NO: 1233392 - RNA, 20 nt, Homo sapiens
uuuguaaugcugcacagaaa

SEQ ID NO: 1233393 - RNA, 18 nt, Homo sapiens
uuuguacaauuacuaaau

SEQ ID NO: 1233394 - RNA, 19 nt, Homo sapiens
uuuguagcucuggaccugu

SEQ ID NO: 1233395 - RNA, 17 nt, Homo sapiens
uuuguauaaaaguguga

SEQ ID NO: 1233396 - RNA, 19 nt, Homo sapiens
uuuguauaaaauagacaaa

SEQ ID NO: 1233397 - RNA, 21 nt, Homo sapiens
uuuguaucacacaguauauga

SEQ ID NO: 1233398 - RNA, 14 nt, Homo sapiens
uuuguaugugaaca

SEQ ID NO: 1233399 - RNA, 19 nt, Homo sapiens
uuuguauuaauaaagcauu

SEQ ID NO: 1233400 - RNA, 15 nt, Homo sapiens
uuuguauuuauuaau

SEQ ID NO: 1233401 - RNA, 12 nt, Homo sapiens
uuugucagaaac

SEQ ID NO: 1233402 - RNA, 21 nt, Homo sapiens
uuugucauauaagauucauau

SEQ ID NO: 1233403 - RNA, 22 nt, Homo sapiens
uuuguccaucuugagaugguga

SEQ ID NO: 1233404 - RNA, 19 nt, Homo sapiens
uuugucccagccuggggcu

SEQ ID NO: 1233405 - RNA, 14 nt, Homo sapiens
uuuguccuacauuc

SEQ ID NO: 1233406 - RNA, 18 nt, Homo sapiens
uuuguccuucguauagca

SEQ ID NO: 1233407 - RNA, 22 nt, Homo sapiens
uuugucuguacucaugucauuc

SEQ ID NO: 1233408 - RNA, 23 nt, Homo sapiens
uuugugaaaugaaaacauguaau

SEQ ID NO: 1233409 - RNA, 12 nt, Homo sapiens
uuugugaacugg

SEQ ID NO: 1233410 - RNA, 18 nt, Homo sapiens
uuugugaaguauucacaa

SEQ ID NO: 1233411 - RNA, 13 nt, Homo sapiens
uuuguggccucag

SEQ ID NO: 1233412 - RNA, 22 nt, Homo sapiens
uuuguggccuuggcugacauga

SEQ ID NO: 1233413 - RNA, 16 nt, Homo sapiens
uuuguggucacagcca

SEQ ID NO: 1233414 - RNA, 14 nt, Homo sapiens
uuuguguauucuuc

SEQ ID NO: 1233415 - RNA, 13 nt, Homo sapiens
uuugugugauuga

SEQ ID NO: 1233416 - RNA, 15 nt, Homo sapiens
uuuguuagcaaagau

SEQ ID NO: 1233417 - RNA, 20 nt, Homo sapiens
uuuguuauagagaucucagc

SEQ ID NO: 1233418 - RNA, 21 nt, Homo sapiens
uuuguucuccggguguggccu

SEQ ID NO: 1233419 - RNA, 15 nt, Homo sapiens
uuuguugccaugugc

SEQ ID NO: 1233420 - RNA, 12 nt, Homo sapiens
uuuguugcccag

SEQ ID NO: 1233421 - RNA, 22 nt, Homo sapiens
uuuguugcuauggcuuuaccua

SEQ ID NO: 1233422 - RNA, 23 nt, Homo sapiens
uuuguugcuauggcuuuaccuau

SEQ ID NO: 1233423 - RNA, 12 nt, Homo sapiens
uuuguugcucag

SEQ ID NO: 1233424 - RNA, 23 nt, Homo sapiens
uuuguuguaaaaagaaaaaccac

SEQ ID NO: 1233425 - RNA, 22 nt, Homo sapiens
uuuguuguuugauucagcaaaa

SEQ ID NO: 1233426 - RNA, 13 nt, Homo sapiens
uuuguuugcauga

SEQ ID NO: 1233427 - RNA, 17 nt, Homo sapiens
uuuuaaaacccauuuaa

SEQ ID NO: 1233428 - RNA, 23 nt, Homo sapiens
uuuuaaaagguagagucuuacaa

SEQ ID NO: 1233429 - RNA, 14 nt, Homo sapiens
uuuuaaacuuugau

SEQ ID NO: 1233430 - RNA, 12 nt, Homo sapiens
uuuuaaaguaau

SEQ ID NO: 1233431 - RNA, 22 nt, Homo sapiens
uuuuaaaguauguuauugcaua

SEQ ID NO: 1233432 - RNA, 17 nt, Homo sapiens
uuuuaacaaaucuaaaa

SEQ ID NO: 1233433 - RNA, 13 nt, Homo sapiens
uuuuaaccaguuc

SEQ ID NO: 1233434 - RNA, 17 nt, Homo sapiens
uuuuaaccccauuugca

SEQ ID NO: 1233435 - RNA, 20 nt, Homo sapiens
uuuuaaggcuaaaacuuaac

SEQ ID NO: 1233436 - RNA, 21 nt, Homo sapiens
uuuuaauaacuuaucuauaaa

SEQ ID NO: 1233437 - RNA, 19 nt, Homo sapiens
uuuuaaugaagugcaauac

SEQ ID NO: 1233438 - RNA, 17 nt, Homo sapiens
uuuuaaugcuauuugaa

SEQ ID NO: 1233439 - RNA, 19 nt, Homo sapiens
uuuuaauuuauuucaucca

SEQ ID NO: 1233440 - RNA, 12 nt, Homo sapiens
uuuuacacugau

SEQ ID NO: 1233441 - RNA, 23 nt, Homo sapiens
uuuuacagaagugaaagugaggu

SEQ ID NO: 1233442 - RNA, 12 nt, Homo sapiens
uuuuacauuuca

SEQ ID NO: 1233443 - RNA, 17 nt, Homo sapiens
uuuuacauuucauacaa

SEQ ID NO: 1233444 - RNA, 21 nt, Homo sapiens
uuuuaccaaagcaucaauaca

SEQ ID NO: 1233445 - RNA, 22 nt, Homo sapiens
uuuuaccaaagcaucaauacaa

SEQ ID NO: 1233446 - RNA, 18 nt, Homo sapiens
uuuuaccugcccaaggau

SEQ ID NO: 1233447 - RNA, 12 nt, Homo sapiens
uuuuacuauaaa

SEQ ID NO: 1233448 - RNA, 16 nt, Homo sapiens
uuuuacucugccuaca

SEQ ID NO: 1233449 - RNA, 12 nt, Homo sapiens
uuuuacuuucag

SEQ ID NO: 1233450 - RNA, 21 nt, Homo sapiens
uuuuaggaugucauucuuugc

SEQ ID NO: 1233451 - RNA, 23 nt, Homo sapiens
uuuuagguagaaaaacauauucu

SEQ ID NO: 1233452 - RNA, 18 nt, Homo sapiens
uuuuaguagagacagggu

SEQ ID NO: 1233453 - RNA, 20 nt, Homo sapiens
uuuuaguagagacaggguuu

SEQ ID NO: 1233454 - RNA, 15 nt, Homo sapiens
uuuuaguggaagcuu

SEQ ID NO: 1233455 - RNA, 19 nt, Homo sapiens
uuuuaguucaauacaguga

SEQ ID NO: 1233456 - RNA, 20 nt, Homo sapiens
uuuuaguucaauacagugaa

SEQ ID NO: 1233457 - RNA, 20 nt, Homo sapiens
uuuuauaaaauuaagcaaug

SEQ ID NO: 1233458 - RNA, 22 nt, Homo sapiens
uuuuauacugcacaguggcaca

SEQ ID NO: 1233459 - RNA, 14 nt, Homo sapiens
uuuuauacuuucag

SEQ ID NO: 1233460 - RNA, 14 nt, Homo sapiens
uuuuauauugccuu

SEQ ID NO: 1233461 - RNA, 21 nt, Homo sapiens
uuuuaucuuuaaucuccucuu

SEQ ID NO: 1233462 - RNA, 11 nt, Homo sapiens
uuuuaugcugg

SEQ ID NO: 1233463 - RNA, 13 nt, Homo sapiens
uuuuaugucuuaa

SEQ ID NO: 1233464 - RNA, 19 nt, Homo sapiens
uuuuauucaaagacagaga

SEQ ID NO: 1233465 - RNA, 22 nt, Homo sapiens
uuuuauugcuucuuuuuggaga

SEQ ID NO: 1233466 - RNA, 18 nt, Homo sapiens
uuuucaaagauguguugc

SEQ ID NO: 1233467 - RNA, 15 nt, Homo sapiens
uuuucaagagcuccu

SEQ ID NO: 1233468 - RNA, 14 nt, Homo sapiens
uuuucaagucuccu

SEQ ID NO: 1233469 - RNA, 21 nt, Homo sapiens
uuuucaaucauaauaccugcu

SEQ ID NO: 1233470 - RNA, 22 nt, Homo sapiens
uuuucaaucaucaaaaaguaau

SEQ ID NO: 1233471 - RNA, 20 nt, Homo sapiens
uuuucaccaggggugcucac

SEQ ID NO: 1233472 - RNA, 10 nt, Homo sapiens
uuuucacuga

SEQ ID NO: 1233473 - RNA, 10 nt, Homo sapiens
uuuucacugc

SEQ ID NO: 1233474 - RNA, 22 nt, Homo sapiens
uuuucagaaaauauuauguguu

SEQ ID NO: 1233475 - RNA, 15 nt, Homo sapiens
uuuucagauccugaa

SEQ ID NO: 1233476 - RNA, 17 nt, Homo sapiens
uuuucaguauacugugu

SEQ ID NO: 1233477 - RNA, 12 nt, Homo sapiens
uuuuccaaauaa

SEQ ID NO: 1233478 - RNA, 13 nt, Homo sapiens
uuuuccacuuaga

SEQ ID NO: 1233479 - RNA, 18 nt, Homo sapiens
uuuuccccaaaccauaaa

SEQ ID NO: 1233480 - RNA, 19 nt, Homo sapiens
uuuucccucacuugcauca

SEQ ID NO: 1233481 - RNA, 17 nt, Homo sapiens
uuuucccuuugccuuca

SEQ ID NO: 1233482 - RNA, 13 nt, Homo sapiens
uuuuccuuaccau

SEQ ID NO: 1233483 - RNA, 13 nt, Homo sapiens
uuuucgaacauuc

SEQ ID NO: 1233484 - RNA, 23 nt, Homo sapiens
uuuucggccccauguaucucagu

SEQ ID NO: 1233485 - RNA, 14 nt, Homo sapiens
uuuucuaagcaauu

SEQ ID NO: 1233486 - RNA, 12 nt, Homo sapiens
uuuucuacugua

SEQ ID NO: 1233487 - RNA, 14 nt, Homo sapiens
uuuucucaauugua

SEQ ID NO: 1233488 - RNA, 21 nt, Homo sapiens
uuuucucaccugucaucucac

SEQ ID NO: 1233489 - RNA, 12 nt, Homo sapiens
uuuucucaguca

SEQ ID NO: 1233490 - RNA, 19 nt, Homo sapiens
uuuucucaguguugguaua

SEQ ID NO: 1233491 - RNA, 15 nt, Homo sapiens
uuuucucugugcuuc

SEQ ID NO: 1233492 - RNA, 16 nt, Homo sapiens
uuuucucugugcuuca

SEQ ID NO: 1233493 - RNA, 14 nt, Homo sapiens
uuuucugccacaga

SEQ ID NO: 1233494 - RNA, 11 nt, Homo sapiens
uuuucugcuaa

SEQ ID NO: 1233495 - RNA, 22 nt, Homo sapiens
uuuucugcuaaaaaguccuuga

SEQ ID NO: 1233496 - RNA, 23 nt, Homo sapiens
uuuucuggaagggcagcauauaa

SEQ ID NO: 1233497 - RNA, 20 nt, Homo sapiens
uuuucuguagcaccagagaa

SEQ ID NO: 1233498 - RNA, 11 nt, Homo sapiens
uuuucuuacca

SEQ ID NO: 1233499 - RNA, 16 nt, Homo sapiens
uuuucuucuugggaua

SEQ ID NO: 1233500 - RNA, 22 nt, Homo sapiens
uuuucuuuuguucaacauugua

SEQ ID NO: 1233501 - RNA, 18 nt, Homo sapiens
uuuugaaacccacaguuu

SEQ ID NO: 1233502 - RNA, 13 nt, Homo sapiens
uuuugaaagaagc

SEQ ID NO: 1233503 - RNA, 16 nt, Homo sapiens
uuuugaaauccaaaga

SEQ ID NO: 1233504 - RNA, 13 nt, Homo sapiens
uuuugaagaauau

SEQ ID NO: 1233505 - RNA, 15 nt, Homo sapiens
uuuugaaucuauaaa

SEQ ID NO: 1233506 - RNA, 20 nt, Homo sapiens
uuuugagggguucuucuggg

SEQ ID NO: 1233507 - RNA, 20 nt, Homo sapiens
uuuugagucauugacuucau

SEQ ID NO: 1233508 - RNA, 14 nt, Homo sapiens
uuuugauagcuuua

SEQ ID NO: 1233509 - RNA, 14 nt, Homo sapiens
gaaauaaaugacaa

SEQ ID NO: 1233510 - RNA, 22 nt, Homo sapiens
gaaauaccacagcucagccacu

SEQ ID NO: 1233511 - RNA, 15 nt, Homo sapiens
gaaauacguggcauu

SEQ ID NO: 1233512 - RNA, 16 nt, Homo sapiens
gaaauacuauaacaua

SEQ ID NO: 1233513 - RNA, 14 nt, Homo sapiens
gaaauagaagcaaa

SEQ ID NO: 1233514 - RNA, 15 nt, Homo sapiens
gaaauagacaguaua

SEQ ID NO: 1233515 - RNA, 16 nt, Homo sapiens
gaaauagacaguauau

SEQ ID NO: 1233516 - RNA, 13 nt, Homo sapiens
gaaauaggaaaua

SEQ ID NO: 1233517 - RNA, 13 nt, Homo sapiens
gaaauagugacau

SEQ ID NO: 1233518 - RNA, 20 nt, Homo sapiens
gaaauauaacaaguggguga

SEQ ID NO: 1233519 - RNA, 15 nt, Homo sapiens
gaaauaucaaagugu

SEQ ID NO: 1233520 - RNA, 17 nt, Homo sapiens
gaaauaugaagcacuuu

SEQ ID NO: 1233521 - RNA, 20 nt, Homo sapiens
gaaauauggaacuuacauug

SEQ ID NO: 1233522 - RNA, 14 nt, Homo sapiens
gaaauauuccuuaa

SEQ ID NO: 1233523 - RNA, 20 nt, Homo sapiens
gaaauauuuagaagugcuaa

SEQ ID NO: 1233524 - RNA, 14 nt, Homo sapiens
gaaauauuuggaaa

SEQ ID NO: 1233525 - RNA, 16 nt, Homo sapiens
gaaaucaaaaagggaa

SEQ ID NO: 1233526 - RNA, 17 nt, Homo sapiens
gaaaucaaaaagggaau

SEQ ID NO: 1233527 - RNA, 21 nt, Homo sapiens
gaaauccuuccuaaacccaau

SEQ ID NO: 1233528 - RNA, 21 nt, Homo sapiens
gaaauccuuucuaaauugcau

SEQ ID NO: 1233529 - RNA, 22 nt, Homo sapiens
gaaaucuaccaagcuugcaaga

SEQ ID NO: 1233530 - RNA, 17 nt, Homo sapiens
gaaaucuagaagacugu

SEQ ID NO: 1233531 - RNA, 19 nt, Homo sapiens
gaaaugaauaagcuuucuc

SEQ ID NO: 1233532 - RNA, 22 nt, Homo sapiens
gaaaugaugaaaagguugccug

SEQ ID NO: 1233533 - RNA, 14 nt, Homo sapiens
gaaaugaugagaaa

SEQ ID NO: 1233534 - RNA, 9 nt, Homo sapiens
gaaaugcaa

SEQ ID NO: 1233535 - RNA, 21 nt, Homo sapiens
gaaaugcacccucccuccugc

SEQ ID NO: 1233536 - RNA, 15 nt, Homo sapiens
gaaauggaugcaaag

SEQ ID NO: 1233537 - RNA, 21 nt, Homo sapiens
gaaauggaugcaaaguacaau

SEQ ID NO: 1233538 - RNA, 20 nt, Homo sapiens
gaaauggccaggauccucuc

SEQ ID NO: 1233539 - RNA, 18 nt, Homo sapiens
gaaaugguggugcuuuaa

SEQ ID NO: 1233540 - RNA, 22 nt, Homo sapiens
gaaaugucacguacugucugau

SEQ ID NO: 1233541 - RNA, 15 nt, Homo sapiens
gaaaugucaguugcu

SEQ ID NO: 1233542 - RNA, 19 nt, Homo sapiens
gaaauguuacauguagaaa

SEQ ID NO: 1233543 - RNA, 21 nt, Homo sapiens
gaaauguuccuuuuaauggau

SEQ ID NO: 1233544 - RNA, 15 nt, Homo sapiens
gaaauuaagacuuua

SEQ ID NO: 1233545 - RNA, 13 nt, Homo sapiens
gaaauuacugugu

SEQ ID NO: 1233546 - RNA, 16 nt, Homo sapiens
gaaauuccaaagucuc

SEQ ID NO: 1233547 - RNA, 19 nt, Homo sapiens
gaaauucucaucaguccau

SEQ ID NO: 1233548 - RNA, 11 nt, Homo sapiens
gaaauugcaau

SEQ ID NO: 1233549 - RNA, 17 nt, Homo sapiens
gaaauugcauauaugua

SEQ ID NO: 1233550 - RNA, 20 nt, Homo sapiens
gaaauugcauauauguauau

SEQ ID NO: 1233551 - RNA, 15 nt, Homo sapiens
gaaauuguacauauu

SEQ ID NO: 1233552 - RNA, 15 nt, Homo sapiens
gaaauuguaucucag

SEQ ID NO: 1233553 - RNA, 20 nt, Homo sapiens
gaaauugucaaagacuguau

SEQ ID NO: 1233554 - RNA, 23 nt, Homo sapiens
gaaauuuauaucagauucuuggc

SEQ ID NO: 1233555 - RNA, 16 nt, Homo sapiens
gaaauuuauucacaua

SEQ ID NO: 1233556 - RNA, 17 nt, Homo sapiens
gaaauuuggcuauaauc

SEQ ID NO: 1233557 - RNA, 23 nt, Homo sapiens
gaaauuuucaauuugagauucua

SEQ ID NO: 1233558 - RNA, 19 nt, Homo sapiens
gaaauuuuggugaaugugg

SEQ ID NO: 1233559 - RNA, 14 nt, Homo sapiens
gaacaaacaaugaa

SEQ ID NO: 1233560 - RNA, 14 nt, Homo sapiens
gaacaaaugaauaa

SEQ ID NO: 1233561 - RNA, 14 nt, Homo sapiens
gaacaacuaccuga

SEQ ID NO: 1233562 - RNA, 22 nt, Homo sapiens
gaacaacuaggcuucagcauau

SEQ ID NO: 1233563 - RNA, 18 nt, Homo sapiens
cugugaaauucacaguaa

SEQ ID NO: 1233564 - RNA, 15 nt, Homo sapiens
cugugaccucaggca

SEQ ID NO: 1233565 - RNA, 16 nt, Homo sapiens
cugugaccuuugucua

SEQ ID NO: 1233566 - RNA, 15 nt, Homo sapiens
cugugacuaccucaa

SEQ ID NO: 1233567 - RNA, 19 nt, Homo sapiens
cugugagugcgucugaggg

SEQ ID NO: 1233568 - RNA, 15 nt, Homo sapiens
cugugaucccagcua

SEQ ID NO: 1233569 - RNA, 18 nt, Homo sapiens
cugugcagcgggugcugc

SEQ ID NO: 1233570 - RNA, 18 nt, Homo sapiens
cugugcaggauauuugca

SEQ ID NO: 1233571 - RNA, 21 nt, Homo sapiens
cugugcaggcauggucccuua

SEQ ID NO: 1233572 - RNA, 16 nt, Homo sapiens
cugugcaucaguggga

SEQ ID NO: 1233573 - RNA, 10 nt, Homo sapiens
cugugccaac

SEQ ID NO: 1233574 - RNA, 22 nt, Homo sapiens
cugugccaucaccauaaccucu

SEQ ID NO: 1233575 - RNA, 22 nt, Homo sapiens
cugugccccagcagugccuugu

SEQ ID NO: 1233576 - RNA, 20 nt, Homo sapiens
cugugcccggggaaaggcaa

SEQ ID NO: 1233577 - RNA, 17 nt, Homo sapiens
cugugccuaacaccagc

SEQ ID NO: 1233578 - RNA, 17 nt, Homo sapiens
cugugccuaucaccucu

SEQ ID NO: 1233579 - RNA, 15 nt, Homo sapiens
cugugcuaguuuuac

SEQ ID NO: 1233580 - RNA, 16 nt, Homo sapiens
cugugcugguguccug

SEQ ID NO: 1233581 - RNA, 18 nt, Homo sapiens
cugugcuguggcauagac

SEQ ID NO: 1233582 - RNA, 22 nt, Homo sapiens
cuguggaacccagcaguucugu

SEQ ID NO: 1233583 - RNA, 21 nt, Homo sapiens
cuguggaacuacauuacugua

SEQ ID NO: 1233584 - RNA, 20 nt, Homo sapiens
cuguggaaugagugugcaug

SEQ ID NO: 1233585 - RNA, 17 nt, Homo sapiens
cuguggaccacugcaug

SEQ ID NO: 1233586 - RNA, 21 nt, Homo sapiens
cuguggaggccugaugcugcc

SEQ ID NO: 1233587 - RNA, 17 nt, Homo sapiens
cuguggccaacugcaaa

SEQ ID NO: 1233588 - RNA, 17 nt, Homo sapiens
cuguggccuguguccca

SEQ ID NO: 1233589 - RNA, 20 nt, Homo sapiens
cuguggccugugucccauga

SEQ ID NO: 1233590 - RNA, 18 nt, Homo sapiens
cuguggccuguuaacugg

SEQ ID NO: 1233591 - RNA, 21 nt, Homo sapiens
cugugggccccucaacagcca

SEQ ID NO: 1233592 - RNA, 22 nt, Homo sapiens
cugugggccccucaacagccaa

SEQ ID NO: 1233593 - RNA, 19 nt, Homo sapiens
cuguggggaucucaggggc

SEQ ID NO: 1233594 - RNA, 16 nt, Homo sapiens
cugugggggugagggu

SEQ ID NO: 1233595 - RNA, 19 nt, Homo sapiens
cugugguacugauggacuu

SEQ ID NO: 1233596 - RNA, 16 nt, Homo sapiens
cugugguuaacaucuc

SEQ ID NO: 1233597 - RNA, 16 nt, Homo sapiens
cuguguacauaacuga

SEQ ID NO: 1233598 - RNA, 12 nt, Homo sapiens
cuguguacugug

SEQ ID NO: 1233599 - RNA, 14 nt, Homo sapiens
cuguguagcucuca

SEQ ID NO: 1233600 - RNA, 23 nt, Homo sapiens
cuguguagcucucacaugcacag

SEQ ID NO: 1233601 - RNA, 21 nt, Homo sapiens
cuguguauuuaacugccuugu

SEQ ID NO: 1233602 - RNA, 22 nt, Homo sapiens
cuguguauuuacaugaauguau

SEQ ID NO: 1233603 - RNA, 22 nt, Homo sapiens
cuguguauuuucagucaaaacu

SEQ ID NO: 1233604 - RNA, 16 nt, Homo sapiens
cugugucaaugccugu

SEQ ID NO: 1233605 - RNA, 22 nt, Homo sapiens
cugugucauucuguuagauacu

SEQ ID NO: 1233606 - RNA, 16 nt, Homo sapiens
cugugucccacaggga

SEQ ID NO: 1233607 - RNA, 13 nt, Homo sapiens
cugugucugugua

SEQ ID NO: 1233608 - RNA, 20 nt, Homo sapiens
cugugucuuuuuucacuaca

SEQ ID NO: 1233609 - RNA, 23 nt, Homo sapiens
cugugugaccucaggccagugug

SEQ ID NO: 1233610 - RNA, 19 nt, Homo sapiens
cugugugaugaacuuucuc

SEQ ID NO: 1233611 - RNA, 18 nt, Homo sapiens
cuguguguccuugcaugg

SEQ ID NO: 1233612 - RNA, 15 nt, Homo sapiens
cugugugugugaaug

SEQ ID NO: 1233613 - RNA, 16 nt, Homo sapiens
cuguguuccuggcaau

SEQ ID NO: 1233614 - RNA, 17 nt, Homo sapiens
cuguguuccuggcaaua

SEQ ID NO: 1233615 - RNA, 14 nt, Homo sapiens
cuguguugccacag

SEQ ID NO: 1233616 - RNA, 13 nt, Homo sapiens
cuguguuuacaga

SEQ ID NO: 1233617 - RNA, 15 nt, Homo sapiens
cuguguuuccaucuc

SEQ ID NO: 1233618 - RNA, 20 nt, Homo sapiens
cuguguuuuuccuccauaaa

SEQ ID NO: 1233619 - RNA, 21 nt, Homo sapiens
cuguuaauacacaguacuuua

SEQ ID NO: 1233620 - RNA, 13 nt, Homo sapiens
cuguuaauaguca

SEQ ID NO: 1233621 - RNA, 14 nt, Homo sapiens
cuguuaauagucau

SEQ ID NO: 1233622 - RNA, 15 nt, Homo sapiens
cuguuaauauucuau

SEQ ID NO: 1233623 - RNA, 22 nt, Homo sapiens
cuguuacagcuuucugugcaga

SEQ ID NO: 1233624 - RNA, 18 nt, Homo sapiens
cuguuaucuucacuuuua

SEQ ID NO: 1233625 - RNA, 16 nt, Homo sapiens
cuguuauguacuguac

SEQ ID NO: 1233626 - RNA, 20 nt, Homo sapiens
cuguuauuaacaaacaucac

SEQ ID NO: 1233627 - RNA, 16 nt, Homo sapiens
cuguucaucuugccaa

SEQ ID NO: 1233628 - RNA, 13 nt, Homo sapiens
cuguucauuucac

SEQ ID NO: 1233629 - RNA, 19 nt, Homo sapiens
cuguucauuucacacagug

SEQ ID NO: 1233630 - RNA, 19 nt, Homo sapiens
cuguuccacacccaaugcu

SEQ ID NO: 1233631 - RNA, 21 nt, Homo sapiens
cuguuccaggcccuccagugg

SEQ ID NO: 1233632 - RNA, 23 nt, Homo sapiens
cuguuccccaaggacucuuccac

SEQ ID NO: 1233633 - RNA, 15 nt, Homo sapiens
cuguucugcacugaa

SEQ ID NO: 1233634 - RNA, 16 nt, Homo sapiens
cuguucugcacugaaa

SEQ ID NO: 1233635 - RNA, 15 nt, Homo sapiens
cuguucuuacuguaa

SEQ ID NO: 1233636 - RNA, 22 nt, Homo sapiens
cuguucuugcuacccaugacuu

SEQ ID NO: 1233637 - RNA, 18 nt, Homo sapiens
cuguucuugcugcuagaa

SEQ ID NO: 1233638 - RNA, 18 nt, Homo sapiens
cuguugaguugcugccac

SEQ ID NO: 1233639 - RNA, 15 nt, Homo sapiens
cuguugcccauugca

SEQ ID NO: 1233640 - RNA, 16 nt, Homo sapiens
cuguugcccauugcac

SEQ ID NO: 1233641 - RNA, 14 nt, Homo sapiens
cuguuggaugacuu

SEQ ID NO: 1233642 - RNA, 19 nt, Homo sapiens
cuguuggccagugugacaa

SEQ ID NO: 1233643 - RNA, 14 nt, Homo sapiens
cuguuggucugucc

SEQ ID NO: 1233644 - RNA, 15 nt, Homo sapiens
cuguuguacuaugga

SEQ ID NO: 1233645 - RNA, 20 nt, Homo sapiens
cuguugucaaaaaguuccau

SEQ ID NO: 1233646 - RNA, 18 nt, Homo sapiens
cuguugugaaucaccaaa

SEQ ID NO: 1233647 - RNA, 14 nt, Homo sapiens
cuguuuaacauuuc

SEQ ID NO: 1233648 - RNA, 15 nt, Homo sapiens
cuguuuaacauuucc

SEQ ID NO: 1233649 - RNA, 22 nt, Homo sapiens
cuguuuacauccagaguucugu

SEQ ID NO: 1233650 - RNA, 17 nt, Homo sapiens
cuguuuagaacaccaaa

SEQ ID NO: 1233651 - RNA, 16 nt, Homo sapiens
cuguuucaaucacugu

SEQ ID NO: 1233652 - RNA, 15 nt, Homo sapiens
cuguuucauagcaaa

SEQ ID NO: 1233653 - RNA, 15 nt, Homo sapiens
cuguuuccauccagu

SEQ ID NO: 1233654 - RNA, 20 nt, Homo sapiens
cuguuucccuuucacuggca

SEQ ID NO: 1233655 - RNA, 21 nt, Homo sapiens
cuguuucuuaagggcacacac

SEQ ID NO: 1233656 - RNA, 16 nt, Homo sapiens
cuguuugaagaaaaua

SEQ ID NO: 1233657 - RNA, 17 nt, Homo sapiens
cuguuuggaagaccaga

SEQ ID NO: 1233658 - RNA, 22 nt, Homo sapiens
cuguuuuguaagugcugcuaua

SEQ ID NO: 1233659 - RNA, 19 nt, Homo sapiens
cuguuuuugucuacacucu

SEQ ID NO: 1233660 - RNA, 20 nt, Homo sapiens
cuguuuuuuucccagguguu

SEQ ID NO: 1233661 - RNA, 14 nt, Homo sapiens
cuuaaaacuaaaug

SEQ ID NO: 1233662 - RNA, 16 nt, Homo sapiens
cccguguguugcacca

SEQ ID NO: 1233663 - RNA, 12 nt, Homo sapiens
cccuaaagggag

SEQ ID NO: 1233664 - RNA, 18 nt, Homo sapiens
cccuaagcgcacauucau

SEQ ID NO: 1233665 - RNA, 20 nt, Homo sapiens
cccuaaguaaguuucuuccu

SEQ ID NO: 1233666 - RNA, 13 nt, Homo sapiens
cccuaagugccca

SEQ ID NO: 1233667 - RNA, 17 nt, Homo sapiens
cccuagccagaggcucu

SEQ ID NO: 1233668 - RNA, 17 nt, Homo sapiens
cccuagucuuuuaaaca

SEQ ID NO: 1233669 - RNA, 16 nt, Homo sapiens
cccuaguucucuuauc

SEQ ID NO: 1233670 - RNA, 20 nt, Homo sapiens
cccuauuugauaugcugucc

SEQ ID NO: 1233671 - RNA, 17 nt, Homo sapiens
cccucaaaucugaggga

SEQ ID NO: 1233672 - RNA, 21 nt, Homo sapiens
cccucacaagcgcucccagcc

SEQ ID NO: 1233673 - RNA, 22 nt, Homo sapiens
cccucacuccugccaguugaaa

SEQ ID NO: 1233674 - RNA, 14 nt, Homo sapiens
cccucagugagaua

SEQ ID NO: 1233675 - RNA, 17 nt, Homo sapiens
cccucaucuaugaggaa

SEQ ID NO: 1233676 - RNA, 18 nt, Homo sapiens
cccucaugaaaacacaca

SEQ ID NO: 1233677 - RNA, 11 nt, Homo sapiens
cccuccaaaga

SEQ ID NO: 1233678 - RNA, 23 nt, Homo sapiens
cccuccacgugauuuccagugag

SEQ ID NO: 1233679 - RNA, 13 nt, Homo sapiens
cccucccauggca

SEQ ID NO: 1233680 - RNA, 15 nt, Homo sapiens
cccucccuggaugac

SEQ ID NO: 1233681 - RNA, 21 nt, Homo sapiens
cccuccucagauggggcacca

SEQ ID NO: 1233682 - RNA, 14 nt, Homo sapiens
cccuccucuuggaa

SEQ ID NO: 1233683 - RNA, 15 nt, Homo sapiens
cccucgcaugacugu

SEQ ID NO: 1233684 - RNA, 22 nt, Homo sapiens
cccucggacagcccaucugccu

SEQ ID NO: 1233685 - RNA, 20 nt, Homo sapiens
cccucguuaaucacaggauc

SEQ ID NO: 1233686 - RNA, 16 nt, Homo sapiens
cccucuuccugugauc

SEQ ID NO: 1233687 - RNA, 19 nt, Homo sapiens
cccugaccucacugugacc

SEQ ID NO: 1233688 - RNA, 20 nt, Homo sapiens
cccugaccucacugugaccu

SEQ ID NO: 1233689 - RNA, 16 nt, Homo sapiens
cccugaccucccagcc

SEQ ID NO: 1233690 - RNA, 23 nt, Homo sapiens
cccugagcuuuguccugaaggaa

SEQ ID NO: 1233691 - RNA, 17 nt, Homo sapiens
cccugauacaggcaugg

SEQ ID NO: 1233692 - RNA, 15 nt, Homo sapiens
cccugaugacaccca

SEQ ID NO: 1233693 - RNA, 19 nt, Homo sapiens
cccugauuguguauauuca

SEQ ID NO: 1233694 - RNA, 17 nt, Homo sapiens
cccugcacaggcacaca

SEQ ID NO: 1233695 - RNA, 20 nt, Homo sapiens
cccugcacccaucugcucac

SEQ ID NO: 1233696 - RNA, 21 nt, Homo sapiens
cccugcacguauacacccaga

SEQ ID NO: 1233697 - RNA, 23 nt, Homo sapiens
cccugccaagacuccucaggcag

SEQ ID NO: 1233698 - RNA, 22 nt, Homo sapiens
cccugccacauacaggugcuca

SEQ ID NO: 1233699 - RNA, 15 nt, Homo sapiens
cccugcccugaccuc

SEQ ID NO: 1233700 - RNA, 16 nt, Homo sapiens
cccugcuaugcagaug

SEQ ID NO: 1233701 - RNA, 15 nt, Homo sapiens
cccugcucagugcuu

SEQ ID NO: 1233702 - RNA, 16 nt, Homo sapiens
cccugcucccauuccu

SEQ ID NO: 1233703 - RNA, 13 nt, Homo sapiens
cccugcugaccuc

SEQ ID NO: 1233704 - RNA, 17 nt, Homo sapiens
cccugcugucccggcuc

SEQ ID NO: 1233705 - RNA, 18 nt, Homo sapiens
cccuggaaggacauccau

SEQ ID NO: 1233706 - RNA, 17 nt, Homo sapiens
cccuggagcaagaccug

SEQ ID NO: 1233707 - RNA, 20 nt, Homo sapiens
cccuggagcccauccagucu

SEQ ID NO: 1233708 - RNA, 21 nt, Homo sapiens
cccuggaugacauuaaagaag

SEQ ID NO: 1233709 - RNA, 19 nt, Homo sapiens
cccuggccuccccugccac

SEQ ID NO: 1233710 - RNA, 23 nt, Homo sapiens
cccuggccuuaaaaggggcccaa

SEQ ID NO: 1233711 - RNA, 14 nt, Homo sapiens
cccugggaaccacu

SEQ ID NO: 1233712 - RNA, 22 nt, Homo sapiens
cccuggggcuucuccugaccca

SEQ ID NO: 1233713 - RNA, 16 nt, Homo sapiens
cccuguccuugcccuu

SEQ ID NO: 1233714 - RNA, 16 nt, Homo sapiens
cccugucucuuaaaaa

SEQ ID NO: 1233715 - RNA, 12 nt, Homo sapiens
cccugucuugcu

SEQ ID NO: 1233716 - RNA, 22 nt, Homo sapiens
cccuguggccaacugcaaaaaa

SEQ ID NO: 1233717 - RNA, 20 nt, Homo sapiens
cccuguguauucuagugaau

SEQ ID NO: 1233718 - RNA, 15 nt, Homo sapiens
cccugugucauuuca

SEQ ID NO: 1233719 - RNA, 14 nt, Homo sapiens
cccugugucccaca

SEQ ID NO: 1233720 - RNA, 15 nt, Homo sapiens
cccuguuggcagcuc

SEQ ID NO: 1233721 - RNA, 13 nt, Homo sapiens
cccuuaacccaag

SEQ ID NO: 1233722 - RNA, 17 nt, Homo sapiens
cccuuaagagucaucca

SEQ ID NO: 1233723 - RNA, 19 nt, Homo sapiens
cccuuaguuuccacugccu

SEQ ID NO: 1233724 - RNA, 16 nt, Homo sapiens
cccuuauuuucaagaa

SEQ ID NO: 1233725 - RNA, 22 nt, Homo sapiens
cccuucaaccauuccccauggg

SEQ ID NO: 1233726 - RNA, 21 nt, Homo sapiens
cccuuccacugccucugccuu

SEQ ID NO: 1233727 - RNA, 13 nt, Homo sapiens
cccuuccagauca

SEQ ID NO: 1233728 - RNA, 21 nt, Homo sapiens
cccuuccaugucgccucugca

SEQ ID NO: 1233729 - RNA, 19 nt, Homo sapiens
cccuuccggagucuuugaa

SEQ ID NO: 1233730 - RNA, 16 nt, Homo sapiens
cccuuccuaagucugu

SEQ ID NO: 1233731 - RNA, 19 nt, Homo sapiens
cccuuccugaagaagaucc

SEQ ID NO: 1233732 - RNA, 13 nt, Homo sapiens
cccuucuuugcag

SEQ ID NO: 1233733 - RNA, 20 nt, Homo sapiens
cccuugauuuaaacacacag

SEQ ID NO: 1233734 - RNA, 21 nt, Homo sapiens
cccuugcaaucuucuacuuua

SEQ ID NO: 1233735 - RNA, 18 nt, Homo sapiens
cccuugcuuguugggauu

SEQ ID NO: 1233736 - RNA, 22 nt, Homo sapiens
cccuuggaauaaaaacauuucu

SEQ ID NO: 1233737 - RNA, 16 nt, Homo sapiens
cccuuggagccaaugg

SEQ ID NO: 1233738 - RNA, 15 nt, Homo sapiens
cccuuggcugugagg

SEQ ID NO: 1233739 - RNA, 17 nt, Homo sapiens
cccuuggcuucugugau

SEQ ID NO: 1233740 - RNA, 16 nt, Homo sapiens
cccuugguacugaaaa

SEQ ID NO: 1233741 - RNA, 13 nt, Homo sapiens
cccuuguacaacc

SEQ ID NO: 1233742 - RNA, 14 nt, Homo sapiens
cccuuuauguaucu

SEQ ID NO: 1233743 - RNA, 17 nt, Homo sapiens
cccuuucagaugucuuc

SEQ ID NO: 1233744 - RNA, 20 nt, Homo sapiens
cccuuuccccagcaucacuc

SEQ ID NO: 1233745 - RNA, 19 nt, Homo sapiens
cccuuuccuacucucagga

SEQ ID NO: 1233746 - RNA, 15 nt, Homo sapiens
cccuuugccaacaga

SEQ ID NO: 1233747 - RNA, 21 nt, Homo sapiens
cccuuuggagaacgccagucu

SEQ ID NO: 1233748 - RNA, 18 nt, Homo sapiens
cccuuugggaaagcucuu

SEQ ID NO: 1233749 - RNA, 13 nt, Homo sapiens
cccuuuuacuuuu

SEQ ID NO: 1233750 - RNA, 23 nt, Homo sapiens
cccuuuuucuaacgggcauuucu

SEQ ID NO: 1233751 - RNA, 19 nt, Homo sapiens
cccuuuuucuccagcuggg

SEQ ID NO: 1233752 - RNA, 18 nt, Homo sapiens
ccgaaggguuuugcuaca

SEQ ID NO: 1233753 - RNA, 17 nt, Homo sapiens
ccgaauagcugggacua

SEQ ID NO: 1233754 - RNA, 17 nt, Homo sapiens
ccgacuccucaaaagca

SEQ ID NO: 1233755 - RNA, 19 nt, Homo sapiens
ccgacuuuccauugauuca

SEQ ID NO: 1233756 - RNA, 23 nt, Homo sapiens
ccuguccaucagccaggacaguc

SEQ ID NO: 1233757 - RNA, 17 nt, Homo sapiens
ccugucccaaccccagu

SEQ ID NO: 1233758 - RNA, 14 nt, Homo sapiens
ccugucccaugcag

SEQ ID NO: 1233759 - RNA, 17 nt, Homo sapiens
ccuguccccucagcucc

SEQ ID NO: 1233760 - RNA, 17 nt, Homo sapiens
ccuguccuaagcacuuu

SEQ ID NO: 1233761 - RNA, 22 nt, Homo sapiens
ccugucuaggucuccucagggu

SEQ ID NO: 1233762 - RNA, 14 nt, Homo sapiens
ccugugaaauacca

SEQ ID NO: 1233763 - RNA, 13 nt, Homo sapiens
ccugugaaugcca

SEQ ID NO: 1233764 - RNA, 12 nt, Homo sapiens
ccugugacaugg

SEQ ID NO: 1233765 - RNA, 20 nt, Homo sapiens
ccugugacauguaacagcca

SEQ ID NO: 1233766 - RNA, 17 nt, Homo sapiens
ccugugaccagcacugu

SEQ ID NO: 1233767 - RNA, 15 nt, Homo sapiens
ccugugccacuuuga

SEQ ID NO: 1233768 - RNA, 17 nt, Homo sapiens
ccugugccaucaccaua

SEQ ID NO: 1233769 - RNA, 16 nt, Homo sapiens
ccugugcccaccaguu

SEQ ID NO: 1233770 - RNA, 16 nt, Homo sapiens
ccugugccuaacacca

SEQ ID NO: 1233771 - RNA, 19 nt, Homo sapiens
ccugugccuaacaccagcg

SEQ ID NO: 1233772 - RNA, 22 nt, Homo sapiens
ccugugucagaaacccuggucu

SEQ ID NO: 1233773 - RNA, 21 nt, Homo sapiens
ccuguguccaccugugggugu

SEQ ID NO: 1233774 - RNA, 14 nt, Homo sapiens
ccuguguguaggcu

SEQ ID NO: 1233775 - RNA, 21 nt, Homo sapiens
ccuguguguccaaaacugccu

SEQ ID NO: 1233776 - RNA, 20 nt, Homo sapiens
ccuguguuccucaaucacac

SEQ ID NO: 1233777 - RNA, 14 nt, Homo sapiens
ccuguucaaaaagg

SEQ ID NO: 1233778 - RNA, 14 nt, Homo sapiens
ccuguucacucuac

SEQ ID NO: 1233779 - RNA, 16 nt, Homo sapiens
ccuguucuaugccuuu

SEQ ID NO: 1233780 - RNA, 22 nt, Homo sapiens
ccuguugcuguguuuaauuuga

SEQ ID NO: 1233781 - RNA, 14 nt, Homo sapiens
ccuguugguucuga

SEQ ID NO: 1233782 - RNA, 14 nt, Homo sapiens
ccuguuuccagggu

SEQ ID NO: 1233783 - RNA, 18 nt, Homo sapiens
ccuguuuucgcaccuacc

SEQ ID NO: 1233784 - RNA, 22 nt, Homo sapiens
ccuguuuucgcaccuaccauca

SEQ ID NO: 1233785 - RNA, 15 nt, Homo sapiens
ccuuaaaaagcacac

SEQ ID NO: 1233786 - RNA, 17 nt, Homo sapiens
ccuuaaaaugcauugaa

SEQ ID NO: 1233787 - RNA, 17 nt, Homo sapiens
ccuuaacccaaggagca

SEQ ID NO: 1233788 - RNA, 12 nt, Homo sapiens
ccuuaagccagg

SEQ ID NO: 1233789 - RNA, 18 nt, Homo sapiens
ccuuaagggguaucaugu

SEQ ID NO: 1233790 - RNA, 19 nt, Homo sapiens
ccuuaagggguaucaugua

SEQ ID NO: 1233791 - RNA, 17 nt, Homo sapiens
ccuuaaggucuccaaac

SEQ ID NO: 1233792 - RNA, 21 nt, Homo sapiens
ccuuaggagacgcugcacuug

SEQ ID NO: 1233793 - RNA, 21 nt, Homo sapiens
ccuuagggugcugagugccug

SEQ ID NO: 1233794 - RNA, 21 nt, Homo sapiens
uuuguuuuaauaaacaguaua

SEQ ID NO: 1233795 - RNA, 23 nt, Homo sapiens
uuuuaaaaacuccuuuugguuua

SEQ ID NO: 1233796 - RNA, 18 nt, Homo sapiens
uuuuaaaagucucacaaa

SEQ ID NO: 1233797 - RNA, 22 nt, Homo sapiens
uuuuaaaaguuucaaugugauu

SEQ ID NO: 1233798 - RNA, 22 nt, Homo sapiens
uuuuaaaguacuuucuuauaaa

SEQ ID NO: 1233799 - RNA, 14 nt, Homo sapiens
uuuuaaaugacuug

SEQ ID NO: 1233800 - RNA, 17 nt, Homo sapiens
uuuuaaauuuucuucag

SEQ ID NO: 1233801 - RNA, 17 nt, Homo sapiens
uuucuccuuuuacuuca

SEQ ID NO: 1233802 - RNA, 16 nt, Homo sapiens
uuucucuaaaacugcc

SEQ ID NO: 1233803 - RNA, 13 nt, Homo sapiens
uuucucuaaugcu

SEQ ID NO: 1233804 - RNA, 17 nt, Homo sapiens
uuucucuagggagaaaa

SEQ ID NO: 1233805 - RNA, 23 nt, Homo sapiens
uugaagcccuccaaaagcacuua

SEQ ID NO: 1233806 - RNA, 22 nt, Homo sapiens
uugaaggaagagggaccagggu

SEQ ID NO: 1233807 - RNA, 19 nt, Homo sapiens
uugaaguaggacuuuccua

SEQ ID NO: 1233808 - RNA, 18 nt, Homo sapiens
uugaaguauucaaucaag

SEQ ID NO: 1233809 - RNA, 18 nt, Homo sapiens
uugaagugacuucacaga

SEQ ID NO: 1233810 - RNA, 20 nt, Homo sapiens
uugaauaguucuauacaaau

SEQ ID NO: 1233811 - RNA, 18 nt, Homo sapiens
uugaaucuacaacucuga

SEQ ID NO: 1233812 - RNA, 21 nt, Homo sapiens
uugaauggguccauuuugccc

SEQ ID NO: 1233813 - RNA, 12 nt, Homo sapiens
uugaaugugauu

SEQ ID NO: 1233814 - RNA, 22 nt, Homo sapiens
ugaagagauuucaacaagaaua

SEQ ID NO: 1233815 - RNA, 18 nt, Homo sapiens
ugaagagcaaaaauaucc

SEQ ID NO: 1233816 - RNA, 14 nt, Homo sapiens
ugaagagcuucauu

SEQ ID NO: 1233817 - RNA, 19 nt, Homo sapiens
ugaagagcuugcuuugauu

SEQ ID NO: 1233818 - RNA, 18 nt, Homo sapiens
ugaagaggguugguauaa

SEQ ID NO: 1233819 - RNA, 20 nt, Homo sapiens
ugaagaguuuacugaagcaa

SEQ ID NO: 1233820 - RNA, 19 nt, Homo sapiens
ugaagauaauaaucuuggc

SEQ ID NO: 1233821 - RNA, 21 nt, Homo sapiens
ugaagaugccagugaaacuuc

SEQ ID NO: 1233822 - RNA, 17 nt, Homo sapiens
ugaagcacaacucccuu

SEQ ID NO: 1233823 - RNA, 21 nt, Homo sapiens
ugaagccaaaugaaacucaaa

SEQ ID NO: 1233824 - RNA, 13 nt, Homo sapiens
ugaagccacugaa

SEQ ID NO: 1233825 - RNA, 21 nt, Homo sapiens
ugaagcccuccaaaagcacuu

SEQ ID NO: 1233826 - RNA, 16 nt, Homo sapiens
ugaagcgaaacacaga

SEQ ID NO: 1233827 - RNA, 20 nt, Homo sapiens
ugaagcguuuuucucaaagg

SEQ ID NO: 1233828 - RNA, 14 nt, Homo sapiens
ugaaggcaugccua

SEQ ID NO: 1233829 - RNA, 16 nt, Homo sapiens
ugaaggcuuacuucag

SEQ ID NO: 1233830 - RNA, 16 nt, Homo sapiens
ugaaggggaggucaca

SEQ ID NO: 1233831 - RNA, 19 nt, Homo sapiens
ugaagguggaacaagcaca

SEQ ID NO: 1233832 - RNA, 15 nt, Homo sapiens
ugaaguaacugugga

SEQ ID NO: 1233833 - RNA, 15 nt, Homo sapiens
ugaaguauugcuaau

SEQ ID NO: 1233834 - RNA, 14 nt, Homo sapiens
ugaagucacacagu

SEQ ID NO: 1233835 - RNA, 21 nt, Homo sapiens
ugaagugaaugaaacacucag

SEQ ID NO: 1233836 - RNA, 19 nt, Homo sapiens
ugaagugcuuaguguacuu

SEQ ID NO: 1233837 - RNA, 15 nt, Homo sapiens
ugaagugugcuguga

SEQ ID NO: 1233838 - RNA, 17 nt, Homo sapiens
ugaagugugcugugaca

SEQ ID NO: 1233839 - RNA, 21 nt, Homo sapiens
ugaaguuuaaacucugcucag

SEQ ID NO: 1233840 - RNA, 22 nt, Homo sapiens
ugaauaaacugaaaauggaccu

SEQ ID NO: 1233841 - RNA, 23 nt, Homo sapiens
ugaauaaaugauuaaaaaaucag

SEQ ID NO: 1233842 - RNA, 20 nt, Homo sapiens
ugaauaagcuuucucucaga

SEQ ID NO: 1233843 - RNA, 22 nt, Homo sapiens
ugaauacaugcguguaccucac

SEQ ID NO: 1233844 - RNA, 18 nt, Homo sapiens
ugaauaccacuuaccuca

SEQ ID NO: 1233845 - RNA, 17 nt, Homo sapiens
ugaauacugggaaucaa

SEQ ID NO: 1233846 - RNA, 18 nt, Homo sapiens
ugaauagggaaguaacau

SEQ ID NO: 1233847 - RNA, 15 nt, Homo sapiens
ugaauagugaggcug

SEQ ID NO: 1233848 - RNA, 12 nt, Homo sapiens
ugaauaucgaga

SEQ ID NO: 1233849 - RNA, 19 nt, Homo sapiens
ugaauaugaugacaaucag

SEQ ID NO: 1233850 - RNA, 13 nt, Homo sapiens
ugaauauguagcu

SEQ ID NO: 1233851 - RNA, 14 nt, Homo sapiens
ugaauauuacuccu

SEQ ID NO: 1233852 - RNA, 17 nt, Homo sapiens
ugaauauuagcauugcc

SEQ ID NO: 1233853 - RNA, 13 nt, Homo sapiens
ugaauauucccaa

SEQ ID NO: 1233854 - RNA, 18 nt, Homo sapiens
ugaaucaaaucucuucca

SEQ ID NO: 1233855 - RNA, 22 nt, Homo sapiens
ugaaucaaugaaaaauguaauu

SEQ ID NO: 1233856 - RNA, 18 nt, Homo sapiens
ugaauccaaacuaaucca

SEQ ID NO: 1233857 - RNA, 18 nt, Homo sapiens
ugaaucgagugagacaaa

SEQ ID NO: 1233858 - RNA, 20 nt, Homo sapiens
ugaaugacacgccuaagguc

SEQ ID NO: 1233859 - RNA, 15 nt, Homo sapiens
ugaaugacauugaac

SEQ ID NO: 1233860 - RNA, 13 nt, Homo sapiens
uugcugaugguga

SEQ ID NO: 1233861 - RNA, 11 nt, Homo sapiens
uugcugcaaag

SEQ ID NO: 1233862 - RNA, 16 nt, Homo sapiens
uugcugccacaaacaa

SEQ ID NO: 1233863 - RNA, 17 nt, Homo sapiens
uugcugugugucugucc

SEQ ID NO: 1233864 - RNA, 15 nt, Homo sapiens
uugcuguuugcaauu

SEQ ID NO: 1233865 - RNA, 16 nt, Homo sapiens
ccagggacacauuucu

SEQ ID NO: 1233866 - RNA, 14 nt, Homo sapiens
ccagggaucacugg

SEQ ID NO: 1233867 - RNA, 22 nt, Homo sapiens
ccagggauuaggagcagcucuu

SEQ ID NO: 1233868 - RNA, 21 nt, Homo sapiens
ccagggccugggggcagugac

SEQ ID NO: 1233869 - RNA, 15 nt, Homo sapiens
ccagggguguagaug

SEQ ID NO: 1233870 - RNA, 18 nt, Homo sapiens
gaaacuauauguauucac

SEQ ID NO: 1233871 - RNA, 15 nt, Homo sapiens
gaaacuauucaugaa

SEQ ID NO: 1233872 - RNA, 16 nt, Homo sapiens
gaaacucacacucccc

SEQ ID NO: 1233873 - RNA, 21 nt, Homo sapiens
gaaacucaguaugcugccccu

SEQ ID NO: 1233874 - RNA, 16 nt, Homo sapiens
gaaacucagugcaaaa

SEQ ID NO: 1233875 - RNA, 21 nt, Homo sapiens
gaaacucuuaucucagucaug

SEQ ID NO: 1233876 - RNA, 12 nt, Homo sapiens
gaaacugaugcc

SEQ ID NO: 1233877 - RNA, 14 nt, Homo sapiens
gaaacuuagaucau

SEQ ID NO: 1233878 - RNA, 23 nt, Homo sapiens
gaaagaaguccuuucucuuuauu

SEQ ID NO: 1233879 - RNA, 21 nt, Homo sapiens
gaaagacauagccaacugcug

SEQ ID NO: 1233880 - RNA, 21 nt, Homo sapiens
gaaagaccaucuccccaggcu

SEQ ID NO: 1233881 - RNA, 23 nt, Homo sapiens
gaaagacgccuucaucugggaca

SEQ ID NO: 1233882 - RNA, 18 nt, Homo sapiens
gaaagagacuccgucuca

SEQ ID NO: 1233883 - RNA, 14 nt, Homo sapiens
gaaagagcaaguga

SEQ ID NO: 1233884 - RNA, 14 nt, Homo sapiens
gaaagaucaaagac

SEQ ID NO: 1233885 - RNA, 13 nt, Homo sapiens
gaaagaugcagug

SEQ ID NO: 1233886 - RNA, 15 nt, Homo sapiens
gaaagauuugugaac

SEQ ID NO: 1233887 - RNA, 21 nt, Homo sapiens
gaaagcaaguguucacaacag

SEQ ID NO: 1233888 - RNA, 11 nt, Homo sapiens
gaaagcacuau

SEQ ID NO: 1233889 - RNA, 22 nt, Homo sapiens
gaaagcacuauuaauacucugc

SEQ ID NO: 1233890 - RNA, 18 nt, Homo sapiens
gaaagcaucaccucaggc

SEQ ID NO: 1233891 - RNA, 20 nt, Homo sapiens
gaaagcccucaugugcagua

SEQ ID NO: 1233892 - RNA, 19 nt, Homo sapiens
gaaagccugggugacauuu

SEQ ID NO: 1233893 - RNA, 14 nt, Homo sapiens
gaaagcucacucug

SEQ ID NO: 1233894 - RNA, 19 nt, Homo sapiens
gaaagcugagaacuccuga

SEQ ID NO: 1233895 - RNA, 17 nt, Homo sapiens
gaaagcugaguguuuca

SEQ ID NO: 1233896 - RNA, 23 nt, Homo sapiens
gaaaggaaaaccugaagacugag

SEQ ID NO: 1233897 - RNA, 17 nt, Homo sapiens
gaaaggaagcuccacug

SEQ ID NO: 1233898 - RNA, 17 nt, Homo sapiens
gaaaggauuuuaccaaa

SEQ ID NO: 1233899 - RNA, 19 nt, Homo sapiens
gaaaggauuuuaccaaagc

SEQ ID NO: 1233900 - RNA, 19 nt, Homo sapiens
gaaaggccugcacacaagc

SEQ ID NO: 1233901 - RNA, 23 nt, Homo sapiens
gaaaggcgcuuggcaucacacau

SEQ ID NO: 1233902 - RNA, 13 nt, Homo sapiens
gaaaggcucaguc

SEQ ID NO: 1233903 - RNA, 22 nt, Homo sapiens
gaaaguaaauauuucaggcaua

SEQ ID NO: 1233904 - RNA, 18 nt, Homo sapiens
gaaaguccagcacuggaa

SEQ ID NO: 1233905 - RNA, 12 nt, Homo sapiens
gaaagugauauc

SEQ ID NO: 1233906 - RNA, 18 nt, Homo sapiens
gaaagugcgaguccucca

SEQ ID NO: 1233907 - RNA, 23 nt, Homo sapiens
gaaaguggccaugccacccuguu

SEQ ID NO: 1233908 - RNA, 16 nt, Homo sapiens
gaaauaaaaaagucuc

SEQ ID NO: 1233909 - RNA, 20 nt, Homo sapiens
gaaauaaaaaaugaaaaaca

SEQ ID NO: 1233910 - RNA, 21 nt, Homo sapiens
gaaauaaacacuggugccaac

SEQ ID NO: 1233911 - RNA, 22 nt, Homo sapiens
gaaauaagucagguucuuuaca

SEQ ID NO: 1233912 - RNA, 23 nt, Homo sapiens
gaaauacacagugcugaccagac

SEQ ID NO: 1233913 - RNA, 20 nt, Homo sapiens
gagccaaagagaaugccauu

SEQ ID NO: 1233914 - RNA, 18 nt, Homo sapiens
gagccaccagcaaagcgc

SEQ ID NO: 1233915 - RNA, 19 nt, Homo sapiens
gagccaccgcguccggccu

SEQ ID NO: 1233916 - RNA, 13 nt, Homo sapiens
gagccagcagcga

SEQ ID NO: 1233917 - RNA, 18 nt, Homo sapiens
gagccauauaaguuugaa

SEQ ID NO: 1233918 - RNA, 21 nt, Homo sapiens
gagcccauuucaauucucaaa

SEQ ID NO: 1233919 - RNA, 14 nt, Homo sapiens
gagccccacacgga

SEQ ID NO: 1233920 - RNA, 14 nt, Homo sapiens
gagcccccuugaca

SEQ ID NO: 1233921 - RNA, 17 nt, Homo sapiens
gagccccgcagaccucc

SEQ ID NO: 1233922 - RNA, 20 nt, Homo sapiens
gagccgugaacugugcauag

SEQ ID NO: 1233923 - RNA, 17 nt, Homo sapiens
gagccuagcuccugcca

SEQ ID NO: 1233924 - RNA, 17 nt, Homo sapiens
gagccuccacugccucu

SEQ ID NO: 1233925 - RNA, 23 nt, Homo sapiens
gagccucccccucagaugaucuc

SEQ ID NO: 1233926 - RNA, 17 nt, Homo sapiens
gagccugcaaacucacu

SEQ ID NO: 1233927 - RNA, 12 nt, Homo sapiens
gagccugcaguu

SEQ ID NO: 1233928 - RNA, 18 nt, Homo sapiens
gagccuggggcacuccuc

SEQ ID NO: 1233929 - RNA, 17 nt, Homo sapiens
gagccuuccacagcccg

SEQ ID NO: 1233930 - RNA, 16 nt, Homo sapiens
gagccuuccacaguga

SEQ ID NO: 1233931 - RNA, 16 nt, Homo sapiens
gagccuugguguacag

SEQ ID NO: 1233932 - RNA, 19 nt, Homo sapiens
gagcgagacuccgucucaa

SEQ ID NO: 1233933 - RNA, 18 nt, Homo sapiens
gagcggcugcccgacuca

SEQ ID NO: 1233934 - RNA, 21 nt, Homo sapiens
gagcggcugcucgcccaggaa

SEQ ID NO: 1233935 - RNA, 21 nt, Homo sapiens
gagcucaggucccaggccagc

SEQ ID NO: 1233936 - RNA, 21 nt, Homo sapiens
gagcuccccagaucucccacu

SEQ ID NO: 1233937 - RNA, 11 nt, Homo sapiens
gagcuccgccu

SEQ ID NO: 1233938 - RNA, 12 nt, Homo sapiens
gagcucuuggcc

SEQ ID NO: 1233939 - RNA, 21 nt, Homo sapiens
gagcugaauuaccuuucacuu

SEQ ID NO: 1233940 - RNA, 14 nt, Homo sapiens
gagcugagcuggaa

SEQ ID NO: 1233941 - RNA, 22 nt, Homo sapiens
gagcugcacugaucacccaaug

SEQ ID NO: 1233942 - RNA, 14 nt, Homo sapiens
gagcugcagggugg

SEQ ID NO: 1233943 - RNA, 17 nt, Homo sapiens
gagcugcucucucauga

SEQ ID NO: 1233944 - RNA, 22 nt, Homo sapiens
gagcuggggguccacacaucuc

SEQ ID NO: 1233945 - RNA, 19 nt, Homo sapiens
gagcuuagccuugugcccu

SEQ ID NO: 1233946 - RNA, 18 nt, Homo sapiens
gagcuucauauaccagca

SEQ ID NO: 1233947 - RNA, 19 nt, Homo sapiens
gagcuuucuuugcacuuaa

SEQ ID NO: 1233948 - RNA, 22 nt, Homo sapiens
gagcuuugguaaucucugugaa

SEQ ID NO: 1233949 - RNA, 18 nt, Homo sapiens
gagcuuuguccugaagga

SEQ ID NO: 1233950 - RNA, 20 nt, Homo sapiens
gagcuuuuaaaaauguccug

SEQ ID NO: 1233951 - RNA, 21 nt, Homo sapiens
gaggaaaaaacccagccccac

SEQ ID NO: 1233952 - RNA, 18 nt, Homo sapiens
gaggaaaaaagaaccaaa

SEQ ID NO: 1233953 - RNA, 21 nt, Homo sapiens
gaggaaagggaaggcuggcag

SEQ ID NO: 1233954 - RNA, 12 nt, Homo sapiens
gaggaaagggag

SEQ ID NO: 1233955 - RNA, 17 nt, Homo sapiens
gaggaacuguccagaga

SEQ ID NO: 1233956 - RNA, 20 nt, Homo sapiens
gaggaaucuaaacaaacagg

SEQ ID NO: 1233957 - RNA, 20 nt, Homo sapiens
gaggaaugcuggacuggagg

SEQ ID NO: 1233958 - RNA, 16 nt, Homo sapiens
gaggaauuaugaacug

SEQ ID NO: 1233959 - RNA, 15 nt, Homo sapiens
gaggaauuggccgcu

SEQ ID NO: 1233960 - RNA, 21 nt, Homo sapiens
gaggacaaaacuucuugucag

SEQ ID NO: 1233961 - RNA, 19 nt, Homo sapiens
gaggacuucuggcagggaa

SEQ ID NO: 1233962 - RNA, 19 nt, Homo sapiens
gaggacuugugucucugug

SEQ ID NO: 1233963 - RNA, 14 nt, Homo sapiens
gaggagauggccau

SEQ ID NO: 1233964 - RNA, 14 nt, Homo sapiens
gaggagcccucauc

SEQ ID NO: 1233965 - RNA, 14 nt, Homo sapiens
gaggagguucacug

SEQ ID NO: 1233966 - RNA, 17 nt, Homo sapiens
gaggagguucacugagc

SEQ ID NO: 1233967 - RNA, 13 nt, Homo sapiens
gaggaguaacaau

SEQ ID NO: 1233968 - RNA, 17 nt, Homo sapiens
gaggaucuccuguccau

SEQ ID NO: 1233969 - RNA, 19 nt, Homo sapiens
gaggaugguuugagcucag

SEQ ID NO: 1233970 - RNA, 16 nt, Homo sapiens
gaggaugugucucccu

SEQ ID NO: 1233971 - RNA, 15 nt, Homo sapiens
gaggcaagaaaagga

SEQ ID NO: 1233972 - RNA, 19 nt, Homo sapiens
gaggcaagugugggccacu

SEQ ID NO: 1233973 - RNA, 15 nt, Homo sapiens
gaggcagaacaggcu

SEQ ID NO: 1233974 - RNA, 20 nt, Homo sapiens
gaggcagagguugcagugag

SEQ ID NO: 1233975 - RNA, 18 nt, Homo sapiens
gaggcaggagaauugcuu

SEQ ID NO: 1233976 - RNA, 16 nt, Homo sapiens
gaggccaccucuccaa

SEQ ID NO: 1233977 - RNA, 21 nt, Homo sapiens
gaggcccccuggugugucuga

SEQ ID NO: 1233978 - RNA, 19 nt, Homo sapiens
gaggcccugagacagggau

SEQ ID NO: 1233979 - RNA, 21 nt, Homo sapiens
gaggccuauaaugaagcuuua

SEQ ID NO: 1233980 - RNA, 13 nt, Homo sapiens
gaggccugugcua

SEQ ID NO: 1233981 - RNA, 19 nt, Homo sapiens
gaggcggagaauugcuuga

SEQ ID NO: 1233982 - RNA, 22 nt, Homo sapiens
gaggcuauggaggguccuccuc

SEQ ID NO: 1233983 - RNA, 20 nt, Homo sapiens
gaggcucccacuucuuggga

SEQ ID NO: 1233984 - RNA, 21 nt, Homo sapiens
gaggcugagccuacagaugaa

SEQ ID NO: 1233985 - RNA, 16 nt, Homo sapiens
gaggcugaggcaagag

SEQ ID NO: 1233986 - RNA, 22 nt, Homo sapiens
gaggcugaggcagaaggauuac

SEQ ID NO: 1233987 - RNA, 18 nt, Homo sapiens
gaggcugaggcgggugga

SEQ ID NO: 1233988 - RNA, 17 nt, Homo sapiens
gaggcugauuucucaca

SEQ ID NO: 1233989 - RNA, 12 nt, Homo sapiens
gaggcuggccaa

SEQ ID NO: 1233990 - RNA, 20 nt, Homo sapiens
gaggcugggccccugggaug

SEQ ID NO: 1233991 - RNA, 18 nt, Homo sapiens
gaggcuggugacaggcca

SEQ ID NO: 1233992 - RNA, 19 nt, Homo sapiens
gacuuccucagagcgagaa

SEQ ID NO: 1233993 - RNA, 17 nt, Homo sapiens
gacuuccuuacuaagca

SEQ ID NO: 1233994 - RNA, 10 nt, Homo sapiens
gacuuccuug

SEQ ID NO: 1233995 - RNA, 16 nt, Homo sapiens
gacuugaaauucucau

SEQ ID NO: 1233996 - RNA, 23 nt, Homo sapiens
gacuugaaauucucaucagucca

SEQ ID NO: 1233997 - RNA, 16 nt, Homo sapiens
gacuugagcuuggcag

SEQ ID NO: 1233998 - RNA, 18 nt, Homo sapiens
gacuugauuagugccuuc

SEQ ID NO: 1233999 - RNA, 15 nt, Homo sapiens
gacuuggagacuccu

SEQ ID NO: 1234000 - RNA, 19 nt, Homo sapiens
gacuuggagccccuuggag

SEQ ID NO: 1234001 - RNA, 12 nt, Homo sapiens
gacuuggcacuu

SEQ ID NO: 1234002 - RNA, 23 nt, Homo sapiens
gacuuggcaggugccuguugaau

SEQ ID NO: 1234003 - RNA, 15 nt, Homo sapiens
gacuugguugaacuu

SEQ ID NO: 1234004 - RNA, 13 nt, Homo sapiens
gacuuugcugauu

SEQ ID NO: 1234005 - RNA, 17 nt, Homo sapiens
gacuuuucugauuaaua

SEQ ID NO: 1234006 - RNA, 23 nt, Homo sapiens
gagaaaaaacauugcccagggau

SEQ ID NO: 1234007 - RNA, 17 nt, Homo sapiens
gagaaaagaaaccagag

SEQ ID NO: 1234008 - RNA, 15 nt, Homo sapiens
gagaaacaauggcua

SEQ ID NO: 1234009 - RNA, 12 nt, Homo sapiens
gagaaacaggcc

SEQ ID NO: 1234010 - RNA, 22 nt, Homo sapiens
gagaaaccuuauuguaccucuc

SEQ ID NO: 1234011 - RNA, 17 nt, Homo sapiens
gagaaagggagugcaug

SEQ ID NO: 1234012 - RNA, 21 nt, Homo sapiens
gagaaagggagugcaugugcg

SEQ ID NO: 1234013 - RNA, 17 nt, Homo sapiens
gagaaaguucucauuua

SEQ ID NO: 1234014 - RNA, 17 nt, Homo sapiens
gagaaauccuuccuaaa

SEQ ID NO: 1234015 - RNA, 22 nt, Homo sapiens
gagaaauccuuccuaaacccaa

SEQ ID NO: 1234016 - RNA, 14 nt, Homo sapiens
gagaaauugaggau

SEQ ID NO: 1234017 - RNA, 16 nt, Homo sapiens
gagaaauuucugugaa

SEQ ID NO: 1234018 - RNA, 17 nt, Homo sapiens
gagaacaugcuggugaa

SEQ ID NO: 1234019 - RNA, 13 nt, Homo sapiens
gagaaccucaggc

SEQ ID NO: 1234020 - RNA, 17 nt, Homo sapiens
gagaacuugaaacagau

SEQ ID NO: 1234021 - RNA, 20 nt, Homo sapiens
gagaagagaugcugccauuu

SEQ ID NO: 1234022 - RNA, 17 nt, Homo sapiens
gagaagaggcugcugca

SEQ ID NO: 1234023 - RNA, 21 nt, Homo sapiens
gagaagaggcugcugcagaca

SEQ ID NO: 1234024 - RNA, 19 nt, Homo sapiens
gagaagauucuuguauuua

SEQ ID NO: 1234025 - RNA, 18 nt, Homo sapiens
gagaagcuguaggacugu

SEQ ID NO: 1234026 - RNA, 17 nt, Homo sapiens
gagaagcugucagggac

SEQ ID NO: 1234027 - RNA, 16 nt, Homo sapiens
gagaaggaaagugauu

SEQ ID NO: 1234028 - RNA, 22 nt, Homo sapiens
gagaaguacaaagguugcagug

SEQ ID NO: 1234029 - RNA, 13 nt, Homo sapiens
gagaaguauacau

SEQ ID NO: 1234030 - RNA, 21 nt, Homo sapiens
gagaagugccuucuccuuccc

SEQ ID NO: 1234031 - RNA, 14 nt, Homo sapiens
gagaaucacuggaa

SEQ ID NO: 1234032 - RNA, 12 nt, Homo sapiens
gagaaugccauu

SEQ ID NO: 1234033 - RNA, 18 nt, Homo sapiens
gagaaugguguuccauug

SEQ ID NO: 1234034 - RNA, 21 nt, Homo sapiens
gagaauuuccaaaacuuuaau

SEQ ID NO: 1234035 - RNA, 21 nt, Homo sapiens
gagacaaaaucuuaaaugcca

SEQ ID NO: 1234036 - RNA, 21 nt, Homo sapiens
gagacaccaaccgacaggccc

SEQ ID NO: 1234037 - RNA, 12 nt, Homo sapiens
gagacagaauag

SEQ ID NO: 1234038 - RNA, 20 nt, Homo sapiens
gagacagaauagagugauag

SEQ ID NO: 1234039 - RNA, 16 nt, Homo sapiens
gagacagaccacuugc

SEQ ID NO: 1234040 - RNA, 19 nt, Homo sapiens
gagacagaguuuucacucu

SEQ ID NO: 1234041 - RNA, 18 nt, Homo sapiens
gagacagcgcuaaggaug

SEQ ID NO: 1234042 - RNA, 19 nt, Homo sapiens
gagacagcugauacuucau

SEQ ID NO: 1234043 - RNA, 21 nt, Homo sapiens
gagacagucuggaaagugaug

SEQ ID NO: 1234044 - RNA, 19 nt, Homo sapiens
gagacagugacuggugcca

SEQ ID NO: 1234045 - RNA, 14 nt, Homo sapiens
gagacaguucaaga

SEQ ID NO: 1234046 - RNA, 17 nt, Homo sapiens
gagacccaagcugccuc

SEQ ID NO: 1234047 - RNA, 23 nt, Homo sapiens
gagacccguagaugccagggcug

SEQ ID NO: 1234048 - RNA, 15 nt, Homo sapiens
gagaccguccucacc

SEQ ID NO: 1234049 - RNA, 15 nt, Homo sapiens
gagacgcacacagcu

SEQ ID NO: 1234050 - RNA, 17 nt, Homo sapiens
gagacgggguuucucca

SEQ ID NO: 1234051 - RNA, 14 nt, Homo sapiens
gagacucacaggaa

SEQ ID NO: 1234052 - RNA, 17 nt, Homo sapiens
gagacugcaggggucca

SEQ ID NO: 1234053 - RNA, 13 nt, Homo sapiens
gagacugggucuc

SEQ ID NO: 1234054 - RNA, 17 nt, Homo sapiens
gagacuguagauugcuu

SEQ ID NO: 1234055 - RNA, 17 nt, Homo sapiens
gagacuuuacauggaug

SEQ ID NO: 1234056 - RNA, 21 nt, Homo sapiens
gagagaacaacuacugugauc

SEQ ID NO: 1234057 - RNA, 14 nt, Homo sapiens
gagagagaugacaa

SEQ ID NO: 1234058 - RNA, 15 nt, Homo sapiens
gagagauucuucccc

SEQ ID NO: 1234059 - RNA, 16 nt, Homo sapiens
gagagcaaaugcuauu

SEQ ID NO: 1234060 - RNA, 13 nt, Homo sapiens
gagagcagcagca

SEQ ID NO: 1234061 - RNA, 22 nt, Homo sapiens
gagagcagcuuuaaacucaggg

SEQ ID NO: 1234062 - RNA, 18 nt, Homo sapiens
gagagcuuuucacuguga

SEQ ID NO: 1234063 - RNA, 23 nt, Homo sapiens
gagaggaaaaguaaggugcaguu

SEQ ID NO: 1234064 - RNA, 15 nt, Homo sapiens
gagaggaacgggcag

SEQ ID NO: 1234065 - RNA, 21 nt, Homo sapiens
gagaggagggaugcugccuga

SEQ ID NO: 1234066 - RNA, 18 nt, Homo sapiens
gagagggaagagugcauu

SEQ ID NO: 1234067 - RNA, 18 nt, Homo sapiens
gagagggaggucacugga

SEQ ID NO: 1234068 - RNA, 12 nt, Homo sapiens
gagagggcugcu

SEQ ID NO: 1234069 - RNA, 20 nt, Homo sapiens
gagagggggcucuccaaagg

SEQ ID NO: 1234070 - RNA, 22 nt, Homo sapiens
gagagucccacugccucagguu

SEQ ID NO: 1234071 - RNA, 22 nt, Homo sapiens
gagagucgcaucucagugcagg

SEQ ID NO: 1234072 - RNA, 16 nt, Homo sapiens
gagaguuuugucuuga

SEQ ID NO: 1234073 - RNA, 18 nt, Homo sapiens
gccccugccccauuuccu

SEQ ID NO: 1234074 - RNA, 14 nt, Homo sapiens
gccccugucauccu

SEQ ID NO: 1234075 - RNA, 21 nt, Homo sapiens
gcccgaguccccgggcaucuu

SEQ ID NO: 1234076 - RNA, 22 nt, Homo sapiens
gcccgcagugcugggaccagag

SEQ ID NO: 1234077 - RNA, 14 nt, Homo sapiens
gcccggcaauggga

SEQ ID NO: 1234078 - RNA, 17 nt, Homo sapiens
gcccuaaccccuuccag

SEQ ID NO: 1234079 - RNA, 14 nt, Homo sapiens
gcccuaauagcaga

SEQ ID NO: 1234080 - RNA, 19 nt, Homo sapiens
gcccuagcccagacucuga

SEQ ID NO: 1234081 - RNA, 13 nt, Homo sapiens
gcccuauucugcc

SEQ ID NO: 1234082 - RNA, 21 nt, Homo sapiens
gcccucagccccacuucucag

SEQ ID NO: 1234083 - RNA, 20 nt, Homo sapiens
gcccuccccagagcacuggg

SEQ ID NO: 1234084 - RNA, 21 nt, Homo sapiens
gcccuccccuccggacuggug

SEQ ID NO: 1234085 - RNA, 20 nt, Homo sapiens
gcccuccucaccgcccuucc

SEQ ID NO: 1234086 - RNA, 18 nt, Homo sapiens
gcccuccucugcacuccc

SEQ ID NO: 1234087 - RNA, 15 nt, Homo sapiens
gcccucgacacucac

SEQ ID NO: 1234088 - RNA, 23 nt, Homo sapiens
gcccucuggauccagccaugccu

SEQ ID NO: 1234089 - RNA, 16 nt, Homo sapiens
gcccugaguccaagag

SEQ ID NO: 1234090 - RNA, 21 nt, Homo sapiens
gcccugauguguccucaggga

SEQ ID NO: 1234091 - RNA, 16 nt, Homo sapiens
gcccugcaccugugca

SEQ ID NO: 1234092 - RNA, 15 nt, Homo sapiens
gcccugcagccagcu

SEQ ID NO: 1234093 - RNA, 16 nt, Homo sapiens
gcccugccuugcugca

SEQ ID NO: 1234094 - RNA, 23 nt, Homo sapiens
gcccugcuuuugcauaaugcaau

SEQ ID NO: 1234095 - RNA, 17 nt, Homo sapiens
gcccuggagccaacugc

SEQ ID NO: 1234096 - RNA, 14 nt, Homo sapiens
gcccuggauccauc

SEQ ID NO: 1234097 - RNA, 16 nt, Homo sapiens
gcccuggcucugcugu

SEQ ID NO: 1234098 - RNA, 19 nt, Homo sapiens
gcccugggaaccacuccca

SEQ ID NO: 1234099 - RNA, 23 nt, Homo sapiens
gcccuggggacuguuccaaagcc

SEQ ID NO: 1234100 - RNA, 19 nt, Homo sapiens
gcccugguguguuuccaga

SEQ ID NO: 1234101 - RNA, 17 nt, Homo sapiens
gcccuguguacauauaa

SEQ ID NO: 1234102 - RNA, 22 nt, Homo sapiens
gcccuuacuugcuucucuagcu

SEQ ID NO: 1234103 - RNA, 20 nt, Homo sapiens
gcccuucagucuuaauacuu

SEQ ID NO: 1234104 - RNA, 16 nt, Homo sapiens
gcccuucauugccaca

SEQ ID NO: 1234105 - RNA, 13 nt, Homo sapiens
gcccuucugggac

SEQ ID NO: 1234106 - RNA, 17 nt, Homo sapiens
gcccuugagcuacuuca

SEQ ID NO: 1234107 - RNA, 13 nt, Homo sapiens
gcccuugagggag

SEQ ID NO: 1234108 - RNA, 21 nt, Homo sapiens
gcccuugcccugaccucccag

SEQ ID NO: 1234109 - RNA, 20 nt, Homo sapiens
gcccuugggguaagccagag

SEQ ID NO: 1234110 - RNA, 20 nt, Homo sapiens
gcccuugucugagaugcugg

SEQ ID NO: 1234111 - RNA, 23 nt, Homo sapiens
gcccuuuaacuuucagaggcaau

SEQ ID NO: 1234112 - RNA, 15 nt, Homo sapiens
gcccuuuccuuccag

SEQ ID NO: 1234113 - RNA, 17 nt, Homo sapiens
gcccuuuggaaagccau

SEQ ID NO: 1234114 - RNA, 14 nt, Homo sapiens
gccgaaugugcagg

SEQ ID NO: 1234115 - RNA, 16 nt, Homo sapiens
gccgacagcucuccaa

SEQ ID NO: 1234116 - RNA, 19 nt, Homo sapiens
gccgagccugcacuggggc

SEQ ID NO: 1234117 - RNA, 23 nt, Homo sapiens
gccgagcguucccagcaggggga

SEQ ID NO: 1234118 - RNA, 19 nt, Homo sapiens
gccgauccggggcccucuc

SEQ ID NO: 1234119 - RNA, 19 nt, Homo sapiens
gccgcacccugcaccugcu

SEQ ID NO: 1234120 - RNA, 16 nt, Homo sapiens
gccgcagccaacccgg

SEQ ID NO: 1234121 - RNA, 16 nt, Homo sapiens
gccgcaugcauaaagu

SEQ ID NO: 1234122 - RNA, 14 nt, Homo sapiens
gccgccugcuccuc

SEQ ID NO: 1234123 - RNA, 14 nt, Homo sapiens
gccggaaucucagc

SEQ ID NO: 1234124 - RNA, 17 nt, Homo sapiens
gccggaggcugcaguga

SEQ ID NO: 1234125 - RNA, 17 nt, Homo sapiens
gccggcaggccuggacu

SEQ ID NO: 1234126 - RNA, 12 nt, Homo sapiens
gccggcucuuuc

SEQ ID NO: 1234127 - RNA, 17 nt, Homo sapiens
gccggcugugcucagag

SEQ ID NO: 1234128 - RNA, 16 nt, Homo sapiens
gccgggaaccaagcag

SEQ ID NO: 1234129 - RNA, 19 nt, Homo sapiens
gccgggccuagaccuggug

SEQ ID NO: 1234130 - RNA, 18 nt, Homo sapiens
gccguccauggcaccagc

SEQ ID NO: 1234131 - RNA, 17 nt, Homo sapiens
gccgucuccucccucag

SEQ ID NO: 1234132 - RNA, 22 nt, Homo sapiens
gccguggggccgccgccucuuu

SEQ ID NO: 1234133 - RNA, 19 nt, Homo sapiens
gccgugugagugugacagg

SEQ ID NO: 1234134 - RNA, 19 nt, Homo sapiens
gccuaaaauauauuccuga

SEQ ID NO: 1234135 - RNA, 14 nt, Homo sapiens
gccuaaaugccuua

SEQ ID NO: 1234136 - RNA, 19 nt, Homo sapiens
gccuaaauuuaaugcugcc

SEQ ID NO: 1234137 - RNA, 19 nt, Homo sapiens
gccuacaggagugagcacu

SEQ ID NO: 1234138 - RNA, 16 nt, Homo sapiens
gccuaccucagccucc

SEQ ID NO: 1234139 - RNA, 23 nt, Homo sapiens
gccuagacuucccaacagccuua

SEQ ID NO: 1234140 - RNA, 14 nt, Homo sapiens
gccuagcgaucucu

SEQ ID NO: 1234141 - RNA, 15 nt, Homo sapiens
gcagcauacacagau

SEQ ID NO: 1234142 - RNA, 14 nt, Homo sapiens
gcagccaacccggc

SEQ ID NO: 1234143 - RNA, 13 nt, Homo sapiens
gcagcccagagac

SEQ ID NO: 1234144 - RNA, 14 nt, Homo sapiens
gcagcccagagacu

SEQ ID NO: 1234145 - RNA, 23 nt, Homo sapiens
gcagcccaugcccaccugcccau

SEQ ID NO: 1234146 - RNA, 19 nt, Homo sapiens
gcagccccacaacuuuaaa

SEQ ID NO: 1234147 - RNA, 22 nt, Homo sapiens
gcagccccgaguuguuuccucg

SEQ ID NO: 1234148 - RNA, 18 nt, Homo sapiens
gcagcccuguguguguca

SEQ ID NO: 1234149 - RNA, 21 nt, Homo sapiens
gcagcccuugggcaguucuca

SEQ ID NO: 1234150 - RNA, 15 nt, Homo sapiens
gcagccgccuuccuu

SEQ ID NO: 1234151 - RNA, 17 nt, Homo sapiens
gcagccuccaacacaag

SEQ ID NO: 1234152 - RNA, 19 nt, Homo sapiens
gcagccugagcaacucuug

SEQ ID NO: 1234153 - RNA, 16 nt, Homo sapiens
gcagcgaaaacugcca

SEQ ID NO: 1234154 - RNA, 18 nt, Homo sapiens
gcagcggaggcgugcguu

SEQ ID NO: 1234155 - RNA, 17 nt, Homo sapiens
gcagcgggcuaacggga

SEQ ID NO: 1234156 - RNA, 22 nt, Homo sapiens
gcagcuaccagguguucuacac

SEQ ID NO: 1234157 - RNA, 15 nt, Homo sapiens
gcagcuagugccuuu

SEQ ID NO: 1234158 - RNA, 14 nt, Homo sapiens
gcagcucaacgaga

SEQ ID NO: 1234159 - RNA, 12 nt, Homo sapiens
gcagcuccagug

SEQ ID NO: 1234160 - RNA, 21 nt, Homo sapiens
gcagcucccauuucaucagca

SEQ ID NO: 1234161 - RNA, 23 nt, Homo sapiens
gcagcucccauuucaucagcaag

SEQ ID NO: 1234162 - RNA, 24 nt, Homo sapiens
gcagcucuugcuaaucagugucuc

SEQ ID NO: 1234163 - RNA, 13 nt, Homo sapiens
gcagcucuuggga

SEQ ID NO: 1234164 - RNA, 13 nt, Homo sapiens
gcagcuggugcuc

SEQ ID NO: 1234165 - RNA, 21 nt, Homo sapiens
gcagcuuuaaacucagggaca

SEQ ID NO: 1234166 - RNA, 18 nt, Homo sapiens
gcaggaagcauucagaga

SEQ ID NO: 1234167 - RNA, 23 nt, Homo sapiens
gcaggaagcauucagagagcagc

SEQ ID NO: 1234168 - RNA, 17 nt, Homo sapiens
gcaggagaaucgcuuga

SEQ ID NO: 1234169 - RNA, 17 nt, Homo sapiens
gcaggagaauugcuuga

SEQ ID NO: 1234170 - RNA, 12 nt, Homo sapiens
gcaggagccagc

SEQ ID NO: 1234171 - RNA, 13 nt, Homo sapiens
gcaggagcuugug

SEQ ID NO: 1234172 - RNA, 17 nt, Homo sapiens
gcaggaggauugcuuga

SEQ ID NO: 1234173 - RNA, 14 nt, Homo sapiens
gcaggaguggugca

SEQ ID NO: 1234174 - RNA, 20 nt, Homo sapiens
gcaggaguggugcagacaga

SEQ ID NO: 1234175 - RNA, 19 nt, Homo sapiens
gcaggauacuacaugcuuu

SEQ ID NO: 1234176 - RNA, 22 nt, Homo sapiens
gcaggauccgcugccaccacgu

SEQ ID NO: 1234177 - RNA, 23 nt, Homo sapiens
gcaggcaagugggauaaaggccc

SEQ ID NO: 1234178 - RNA, 20 nt, Homo sapiens
gcaggcccguggcaggagga

SEQ ID NO: 1234179 - RNA, 21 nt, Homo sapiens
gcaggcccuuugaagccucag

SEQ ID NO: 1234180 - RNA, 21 nt, Homo sapiens
gcaggcuauuuguucagagag

SEQ ID NO: 1234181 - RNA, 15 nt, Homo sapiens
gcaggcugggccaug

SEQ ID NO: 1234182 - RNA, 19 nt, Homo sapiens
gcaggcugggccaugucca

SEQ ID NO: 1234183 - RNA, 18 nt, Homo sapiens
gcagggauuagguguuca

SEQ ID NO: 1234184 - RNA, 19 nt, Homo sapiens
gcagggcaaaugacaugca

SEQ ID NO: 1234185 - RNA, 23 nt, Homo sapiens
gcagggcaaaugacaugcacuga

SEQ ID NO: 1234186 - RNA, 19 nt, Homo sapiens
gcagggcccacccauguca

SEQ ID NO: 1234187 - RNA, 18 nt, Homo sapiens
gcagggcccagugacaag

SEQ ID NO: 1234188 - RNA, 13 nt, Homo sapiens
gcagggcucugau

SEQ ID NO: 1234189 - RNA, 23 nt, Homo sapiens
gcagggcuggcaggaugccgugg

SEQ ID NO: 1234190 - RNA, 20 nt, Homo sapiens
gcagggggugugucugcuca

SEQ ID NO: 1234191 - RNA, 17 nt, Homo sapiens
gcagguaggucggcacu

SEQ ID NO: 1234192 - RNA, 15 nt, Homo sapiens
gcagguauggaaggg

SEQ ID NO: 1234193 - RNA, 16 nt, Homo sapiens
gcaggugcuacaacau

SEQ ID NO: 1234194 - RNA, 16 nt, Homo sapiens
gcaggugggcacugga

SEQ ID NO: 1234195 - RNA, 22 nt, Homo sapiens
gcagguuccuuaucugucacac

SEQ ID NO: 1234196 - RNA, 20 nt, Homo sapiens
gcaguaccaaaguaacugaa

SEQ ID NO: 1234197 - RNA, 20 nt, Homo sapiens
gcaguaggggcuacugugac

SEQ ID NO: 1234198 - RNA, 23 nt, Homo sapiens
gcaguauggaauuccagugccag

SEQ ID NO: 1234199 - RNA, 20 nt, Homo sapiens
gcaguauguacuucagugca

SEQ ID NO: 1234200 - RNA, 13 nt, Homo sapiens
gcagucacuggag

SEQ ID NO: 1234201 - RNA, 13 nt, Homo sapiens
gcagucacuucca

SEQ ID NO: 1234202 - RNA, 17 nt, Homo sapiens
gcagucagcaugaaucc

SEQ ID NO: 1234203 - RNA, 16 nt, Homo sapiens
gcagucccaaaacccu

SEQ ID NO: 1234204 - RNA, 19 nt, Homo sapiens
gcaguccgcagucuggccu

SEQ ID NO: 1234205 - RNA, 20 nt, Homo sapiens
gcagucggugguaccugaga

SEQ ID NO: 1234206 - RNA, 21 nt, Homo sapiens
gcagucggugguaccugagau

SEQ ID NO: 1234207 - RNA, 20 nt, Homo sapiens
gccaccuccagacaccagug

SEQ ID NO: 1234208 - RNA, 14 nt, Homo sapiens
gccacgugggcaaa

SEQ ID NO: 1234209 - RNA, 16 nt, Homo sapiens
gccacucauuccugua

SEQ ID NO: 1234210 - RNA, 20 nt, Homo sapiens
gccacuccagaccccuggcu

SEQ ID NO: 1234211 - RNA, 16 nt, Homo sapiens
gccacucuuagcuaaa

SEQ ID NO: 1234212 - RNA, 22 nt, Homo sapiens
gccacugagaagugcacuuuaa

SEQ ID NO: 1234213 - RNA, 12 nt, Homo sapiens
gccacuuccuuu

SEQ ID NO: 1234214 - RNA, 15 nt, Homo sapiens
gccacuucggccagg

SEQ ID NO: 1234215 - RNA, 19 nt, Homo sapiens
gccagaaggauaauauuga

SEQ ID NO: 1234216 - RNA, 18 nt, Homo sapiens
gccagacucuagguuaua

SEQ ID NO: 1234217 - RNA, 17 nt, Homo sapiens
gccagagaugcuggacu

SEQ ID NO: 1234218 - RNA, 18 nt, Homo sapiens
gccagaggcucuaaugua

SEQ ID NO: 1234219 - RNA, 17 nt, Homo sapiens
gccagauggacuccagc

SEQ ID NO: 1234220 - RNA, 20 nt, Homo sapiens
gccagaugugaaaacaucuc

SEQ ID NO: 1234221 - RNA, 16 nt, Homo sapiens
gccagcaaggcagguu

SEQ ID NO: 1234222 - RNA, 18 nt, Homo sapiens
gccagcaaugacaucuca

SEQ ID NO: 1234223 - RNA, 11 nt, Homo sapiens
gccagcacuuc

SEQ ID NO: 1234224 - RNA, 16 nt, Homo sapiens
gccagcagaacugaag

SEQ ID NO: 1234225 - RNA, 21 nt, Homo sapiens
gccagcagcacagucacccau

SEQ ID NO: 1234226 - RNA, 16 nt, Homo sapiens
gccagcaggagccagc

SEQ ID NO: 1234227 - RNA, 17 nt, Homo sapiens
gccagccagugccauuc

SEQ ID NO: 1234228 - RNA, 21 nt, Homo sapiens
gccagccugucccauggacac

SEQ ID NO: 1234229 - RNA, 14 nt, Homo sapiens
gccagcugcagcug

SEQ ID NO: 1234230 - RNA, 20 nt, Homo sapiens
gccagcugggagcacuggug

SEQ ID NO: 1234231 - RNA, 15 nt, Homo sapiens
gccaggagcaggcac

SEQ ID NO: 1234232 - RNA, 19 nt, Homo sapiens
gccaggagucugugcucuu

SEQ ID NO: 1234233 - RNA, 20 nt, Homo sapiens
gccaggauccucuccuuuga

SEQ ID NO: 1234234 - RNA, 18 nt, Homo sapiens
gccaggccagagggcagu

SEQ ID NO: 1234235 - RNA, 23 nt, Homo sapiens
gccagggaaagcccgugucaaug

SEQ ID NO: 1234236 - RNA, 18 nt, Homo sapiens
gccagggcccugcagagg

SEQ ID NO: 1234237 - RNA, 16 nt, Homo sapiens
gccagggcugcccuga

SEQ ID NO: 1234238 - RNA, 21 nt, Homo sapiens
gccaggguggucuugaucucc

SEQ ID NO: 1234239 - RNA, 11 nt, Homo sapiens
gccaguauuuu

SEQ ID NO: 1234240 - RNA, 19 nt, Homo sapiens
gccaguccugccuggccag

SEQ ID NO: 1234241 - RNA, 11 nt, Homo sapiens
gccagugacag

SEQ ID NO: 1234242 - RNA, 11 nt, Homo sapiens
gccagugacuu

SEQ ID NO: 1234243 - RNA, 11 nt, Homo sapiens
gccagugcacc

SEQ ID NO: 1234244 - RNA, 15 nt, Homo sapiens
gccagugccauucca

SEQ ID NO: 1234245 - RNA, 16 nt, Homo sapiens
gccagugccauuccac

SEQ ID NO: 1234246 - RNA, 22 nt, Homo sapiens
gccaguuucagcucacuuccuc

SEQ ID NO: 1234247 - RNA, 16 nt, Homo sapiens
gccauaagaaagcacu

SEQ ID NO: 1234248 - RNA, 14 nt, Homo sapiens
gccauaagagguga

SEQ ID NO: 1234249 - RNA, 13 nt, Homo sapiens
gccauacugccuu

SEQ ID NO: 1234250 - RNA, 16 nt, Homo sapiens
gccauauaaguuugaa

SEQ ID NO: 1234251 - RNA, 12 nt, Homo sapiens
gccauaugcccu

SEQ ID NO: 1234252 - RNA, 11 nt, Homo sapiens
gccauaugccu

SEQ ID NO: 1234253 - RNA, 18 nt, Homo sapiens
gccaucaaaaugcuuuuu

SEQ ID NO: 1234254 - RNA, 18 nt, Homo sapiens
gccaucacaugaucuguu

SEQ ID NO: 1234255 - RNA, 18 nt, Homo sapiens
gccaucaccauaaccucu

SEQ ID NO: 1234256 - RNA, 17 nt, Homo sapiens
gccaucaccgcugggug

SEQ ID NO: 1234257 - RNA, 21 nt, Homo sapiens
gccauccccaccuucaccucg

SEQ ID NO: 1234258 - RNA, 23 nt, Homo sapiens
gccaucccuuuuuuuacauuuca

SEQ ID NO: 1234259 - RNA, 14 nt, Homo sapiens
gccauccucaccca

SEQ ID NO: 1234260 - RNA, 15 nt, Homo sapiens
gccaucgaccuggag

SEQ ID NO: 1234261 - RNA, 17 nt, Homo sapiens
gccaucguccugggacu

SEQ ID NO: 1234262 - RNA, 22 nt, Homo sapiens
gccaucugacugccaagccaga

SEQ ID NO: 1234263 - RNA, 21 nt, Homo sapiens
gccaugagguucggcacccag

SEQ ID NO: 1234264 - RNA, 21 nt, Homo sapiens
gccaugaucgagccacugcac

SEQ ID NO: 1234265 - RNA, 21 nt, Homo sapiens
gccaugcaacgggauugaagg

SEQ ID NO: 1234266 - RNA, 23 nt, Homo sapiens
gccaugccaggccagagggcagu

SEQ ID NO: 1234267 - RNA, 14 nt, Homo sapiens
gccaugcccuugag

SEQ ID NO: 1234268 - RNA, 20 nt, Homo sapiens
gccaugcucaggagccacca

SEQ ID NO: 1234269 - RNA, 22 nt, Homo sapiens
gccauuccacuccacucagguu

SEQ ID NO: 1234270 - RNA, 13 nt, Homo sapiens
gccauugaccacc

SEQ ID NO: 1234271 - RNA, 19 nt, Homo sapiens
gcccaaacuggagugcagu

SEQ ID NO: 1234272 - RNA, 20 nt, Homo sapiens
ggaagccccugggcccagua

SEQ ID NO: 1234273 - RNA, 20 nt, Homo sapiens
ggaagccggaggguguuuau

SEQ ID NO: 1234274 - RNA, 18 nt, Homo sapiens
ggaagcggcccuaaggga

SEQ ID NO: 1234275 - RNA, 14 nt, Homo sapiens
ggaagcuccacugu

SEQ ID NO: 1234276 - RNA, 21 nt, Homo sapiens
ggaaggaacagcaaugguguc

SEQ ID NO: 1234277 - RNA, 17 nt, Homo sapiens
ggaaggacauccauguu

SEQ ID NO: 1234278 - RNA, 19 nt, Homo sapiens
ggaagggccuacagcccau

SEQ ID NO: 1234279 - RNA, 19 nt, Homo sapiens
ggaaggggugcccccaggc

SEQ ID NO: 1234280 - RNA, 18 nt, Homo sapiens
ggaaggugccucuggaug

SEQ ID NO: 1234281 - RNA, 17 nt, Homo sapiens
ggaaggugugcucggug

SEQ ID NO: 1234282 - RNA, 22 nt, Homo sapiens
ggaaguacugcacccagcagug

SEQ ID NO: 1234283 - RNA, 18 nt, Homo sapiens
ggaaguuucuggugccau

SEQ ID NO: 1234284 - RNA, 20 nt, Homo sapiens
ggaaguuucuggugccauuu

SEQ ID NO: 1234285 - RNA, 12 nt, Homo sapiens
ggaaguuuucag

SEQ ID NO: 1234286 - RNA, 20 nt, Homo sapiens
ggaauaaccuuccauacauu

SEQ ID NO: 1234287 - RNA, 23 nt, Homo sapiens
ggaauaagcucuaguucuuaaca

SEQ ID NO: 1234288 - RNA, 21 nt, Homo sapiens
ggaauacacuugcauguacag

SEQ ID NO: 1234289 - RNA, 16 nt, Homo sapiens
ggaauagugaauacuu

SEQ ID NO: 1234290 - RNA, 21 nt, Homo sapiens
ggaauauaaggaaagcaauaa

SEQ ID NO: 1234291 - RNA, 22 nt, Homo sapiens
ggaauaugaccauuugacuguu

SEQ ID NO: 1234292 - RNA, 13 nt, Homo sapiens
ggaauauuugaau

SEQ ID NO: 1234293 - RNA, 22 nt, Homo sapiens
ggaaucaauucaauuuggacug

SEQ ID NO: 1234294 - RNA, 13 nt, Homo sapiens
ggaaucagucagc

SEQ ID NO: 1234295 - RNA, 23 nt, Homo sapiens
ggaaucagugaagccaaagggac

SEQ ID NO: 1234296 - RNA, 17 nt, Homo sapiens
ggaauccagacccggcu

SEQ ID NO: 1234297 - RNA, 16 nt, Homo sapiens
ggaaucuucugaauuu

SEQ ID NO: 1234298 - RNA, 18 nt, Homo sapiens
ggaaugaauacagcauuu

SEQ ID NO: 1234299 - RNA, 21 nt, Homo sapiens
ggaauggcugcaccuuuuugc

SEQ ID NO: 1234300 - RNA, 11 nt, Homo sapiens
ggaauggugua

SEQ ID NO: 1234301 - RNA, 13 nt, Homo sapiens
ggaauucagccau

SEQ ID NO: 1234302 - RNA, 16 nt, Homo sapiens
ggaauuccagugccag

SEQ ID NO: 1234303 - RNA, 20 nt, Homo sapiens
ggaauuuccucuauugaugu

SEQ ID NO: 1234304 - RNA, 17 nt, Homo sapiens
ggacaaaacacuguguc

SEQ ID NO: 1234305 - RNA, 18 nt, Homo sapiens
ggacaaaacacugugucc

SEQ ID NO: 1234306 - RNA, 14 nt, Homo sapiens
ggacaaaacuggag

SEQ ID NO: 1234307 - RNA, 21 nt, Homo sapiens
ggacaaaccgagugcaaugaa

SEQ ID NO: 1234308 - RNA, 15 nt, Homo sapiens
ggacaacauccuuaa

SEQ ID NO: 1234309 - RNA, 21 nt, Homo sapiens
ggacaagacccccagcacuug

SEQ ID NO: 1234310 - RNA, 22 nt, Homo sapiens
ggacaagauuuccuacuuucuc

SEQ ID NO: 1234311 - RNA, 18 nt, Homo sapiens
ggacaauuaucuguguca

SEQ ID NO: 1234312 - RNA, 15 nt, Homo sapiens
ggacaccacacccag

SEQ ID NO: 1234313 - RNA, 17 nt, Homo sapiens
ggacaccauuaccaaaa

SEQ ID NO: 1234314 - RNA, 16 nt, Homo sapiens
ggacacuaucacucau

SEQ ID NO: 1234315 - RNA, 11 nt, Homo sapiens
ggacacugaga

SEQ ID NO: 1234316 - RNA, 23 nt, Homo sapiens
ggacagaaagagacuccgucuca

SEQ ID NO: 1234317 - RNA, 15 nt, Homo sapiens
ggacagaccacagag

SEQ ID NO: 1234318 - RNA, 20 nt, Homo sapiens
ggacagaugaaugccgugga

SEQ ID NO: 1234319 - RNA, 15 nt, Homo sapiens
ggacagccacagcca

SEQ ID NO: 1234320 - RNA, 16 nt, Homo sapiens
ggacaggagucagugu

SEQ ID NO: 1234321 - RNA, 15 nt, Homo sapiens
ggacagggaggugac

SEQ ID NO: 1234322 - RNA, 16 nt, Homo sapiens
ggacaguaucccacau

SEQ ID NO: 1234323 - RNA, 23 nt, Homo sapiens
ggacaguaucccacauccaacuc

SEQ ID NO: 1234324 - RNA, 13 nt, Homo sapiens
gcuaguacuguau

SEQ ID NO: 1234325 - RNA, 16 nt, Homo sapiens
gcuaguccggacccac

SEQ ID NO: 1234326 - RNA, 16 nt, Homo sapiens
gcuaguuugaccucau

SEQ ID NO: 1234327 - RNA, 15 nt, Homo sapiens
gcuauaauaaagaag

SEQ ID NO: 1234328 - RNA, 16 nt, Homo sapiens
gcuauaccagcagaaa

SEQ ID NO: 1234329 - RNA, 20 nt, Homo sapiens
gcuauaguuauacaucaauu

SEQ ID NO: 1234330 - RNA, 15 nt, Homo sapiens
gcuauauccauguac

SEQ ID NO: 1234331 - RNA, 15 nt, Homo sapiens
gcuauccaaauaacu

SEQ ID NO: 1234332 - RNA, 15 nt, Homo sapiens
gcuauccacagcuua

SEQ ID NO: 1234333 - RNA, 17 nt, Homo sapiens
gcuauccagcagaucau

SEQ ID NO: 1234334 - RNA, 20 nt, Homo sapiens
gcuaugaucagaagacuuua

SEQ ID NO: 1234335 - RNA, 13 nt, Homo sapiens
gcuaugcuauuga

SEQ ID NO: 1234336 - RNA, 15 nt, Homo sapiens
gcuaugguugccacc

SEQ ID NO: 1234337 - RNA, 14 nt, Homo sapiens
gcuaugugcacuga

SEQ ID NO: 1234338 - RNA, 14 nt, Homo sapiens
gcuauuacugucug

SEQ ID NO: 1234339 - RNA, 14 nt, Homo sapiens
gcuauucaccaaua

SEQ ID NO: 1234340 - RNA, 19 nt, Homo sapiens
gcuauucuaacuaaugaca

SEQ ID NO: 1234341 - RNA, 19 nt, Homo sapiens
gcuauuggcccagcuuuua

SEQ ID NO: 1234342 - RNA, 13 nt, Homo sapiens
gcuauuuaugcaa

SEQ ID NO: 1234343 - RNA, 22 nt, Homo sapiens
gcuauuucaucuauuuuuggca

SEQ ID NO: 1234344 - RNA, 22 nt, Homo sapiens
gcuauuuccagagccagcucaa

SEQ ID NO: 1234345 - RNA, 15 nt, Homo sapiens
gcuauuuccauucca

SEQ ID NO: 1234346 - RNA, 14 nt, Homo sapiens
gcuauuuucauuua

SEQ ID NO: 1234347 - RNA, 16 nt, Homo sapiens
gcucaaaucuauucag

SEQ ID NO: 1234348 - RNA, 14 nt, Homo sapiens
gcucaacauugugu

SEQ ID NO: 1234349 - RNA, 11 nt, Homo sapiens
gcucaagaaca

SEQ ID NO: 1234350 - RNA, 18 nt, Homo sapiens
gcucaagaacacaugugc

SEQ ID NO: 1234351 - RNA, 23 nt, Homo sapiens
gcucaauauuccugaaugaaaua

SEQ ID NO: 1234352 - RNA, 17 nt, Homo sapiens
gcucaccgcccaucagg

SEQ ID NO: 1234353 - RNA, 20 nt, Homo sapiens
gcucacgccuguaaucccag

SEQ ID NO: 1234354 - RNA, 13 nt, Homo sapiens
gcucacugcugau

SEQ ID NO: 1234355 - RNA, 13 nt, Homo sapiens
gcucacuugccuu

SEQ ID NO: 1234356 - RNA, 21 nt, Homo sapiens
gcucagaaugucugguccugg

SEQ ID NO: 1234357 - RNA, 23 nt, Homo sapiens
gcucagauuauuuaaaugggaau

SEQ ID NO: 1234358 - RNA, 14 nt, Homo sapiens
gcucagccaagcuu

SEQ ID NO: 1234359 - RNA, 21 nt, Homo sapiens
gcucagcuucuuccuaggucc

SEQ ID NO: 1234360 - RNA, 21 nt, Homo sapiens
gcucaggaaggggugugcuga

SEQ ID NO: 1234361 - RNA, 14 nt, Homo sapiens
gcucaggcauuuga

SEQ ID NO: 1234362 - RNA, 21 nt, Homo sapiens
gcucauaaaauggaagcaauu

SEQ ID NO: 1234363 - RNA, 21 nt, Homo sapiens
gcucauaagcaauaccagcaa

SEQ ID NO: 1234364 - RNA, 21 nt, Homo sapiens
gcucauaugcauguagucacu

SEQ ID NO: 1234365 - RNA, 10 nt, Homo sapiens
gcucaugccc

SEQ ID NO: 1234366 - RNA, 19 nt, Homo sapiens
gcucaugccuguaaucuca

SEQ ID NO: 1234367 - RNA, 22 nt, Homo sapiens
gcuccaacacuuugagcauuuu

SEQ ID NO: 1234368 - RNA, 22 nt, Homo sapiens
gcuccaagaccuguugguucca

SEQ ID NO: 1234369 - RNA, 12 nt, Homo sapiens
gcuccaagcaca

SEQ ID NO: 1234370 - RNA, 20 nt, Homo sapiens
gcuccaccagcagcauggca

SEQ ID NO: 1234371 - RNA, 23 nt, Homo sapiens
gcuccacgaagccuuaagccaua

SEQ ID NO: 1234372 - RNA, 11 nt, Homo sapiens
gcuccacugaa

SEQ ID NO: 1234373 - RNA, 15 nt, Homo sapiens
gcuccagauggugcu

SEQ ID NO: 1234374 - RNA, 16 nt, Homo sapiens
gcuccagauggugcua

SEQ ID NO: 1234375 - RNA, 14 nt, Homo sapiens
gcuccagcaccuuc

SEQ ID NO: 1234376 - RNA, 19 nt, Homo sapiens
gcuccaggacuccacugga

SEQ ID NO: 1234377 - RNA, 20 nt, Homo sapiens
gcuccaggacuccacuggac

SEQ ID NO: 1234378 - RNA, 22 nt, Homo sapiens
gcuccaggaucuuugacugaaa

SEQ ID NO: 1234379 - RNA, 17 nt, Homo sapiens
gcuccaggccugcagca

SEQ ID NO: 1234380 - RNA, 17 nt, Homo sapiens
gcuccagugcaggagac

SEQ ID NO: 1234381 - RNA, 18 nt, Homo sapiens
gcuccccggacauacucu

SEQ ID NO: 1234382 - RNA, 14 nt, Homo sapiens
gcucccggguccug

SEQ ID NO: 1234383 - RNA, 16 nt, Homo sapiens
gcucccuagacugcau

SEQ ID NO: 1234384 - RNA, 20 nt, Homo sapiens
gcucccuagccagaggcucu

SEQ ID NO: 1234385 - RNA, 14 nt, Homo sapiens
gcucccuccuccag

SEQ ID NO: 1234386 - RNA, 22 nt, Homo sapiens
gcucccucuauuuauguuugca

SEQ ID NO: 1234387 - RNA, 19 nt, Homo sapiens
gcuccgccccagcccucag

SEQ ID NO: 1234388 - RNA, 14 nt, Homo sapiens
gcuccuaucugugu

SEQ ID NO: 1234389 - RNA, 14 nt, Homo sapiens
gcuccuccacgccu

SEQ ID NO: 1234390 - RNA, 16 nt, Homo sapiens
gcuccuccccucuuga

SEQ ID NO: 1234391 - RNA, 15 nt, Homo sapiens
gcuccuccuccaugc

SEQ ID NO: 1234392 - RNA, 20 nt, Homo sapiens
gcuccuccuugcccagacua

SEQ ID NO: 1234393 - RNA, 23 nt, Homo sapiens
gcuccugcagcauggucccugcc

SEQ ID NO: 1234394 - RNA, 15 nt, Homo sapiens
gcuccuggggcaaug

SEQ ID NO: 1234395 - RNA, 21 nt, Homo sapiens
ggaggcagaggguugcaguga

SEQ ID NO: 1234396 - RNA, 16 nt, Homo sapiens
ggaggcaugccucuga

SEQ ID NO: 1234397 - RNA, 17 nt, Homo sapiens
ggaggccaccucuccaa

SEQ ID NO: 1234398 - RNA, 19 nt, Homo sapiens
ggaggcgcggccucccgag

SEQ ID NO: 1234399 - RNA, 22 nt, Homo sapiens
ggaggcuccaggacuccacugg

SEQ ID NO: 1234400 - RNA, 14 nt, Homo sapiens
ggagggcagguagc

SEQ ID NO: 1234401 - RNA, 19 nt, Homo sapiens
ggagguagagguugcacug

SEQ ID NO: 1234402 - RNA, 14 nt, Homo sapiens
ggaggucgacccca

SEQ ID NO: 1234403 - RNA, 22 nt, Homo sapiens
ggaggugcuuaagcagaagcau

SEQ ID NO: 1234404 - RNA, 20 nt, Homo sapiens
ggagguggagauugcaguga

SEQ ID NO: 1234405 - RNA, 21 nt, Homo sapiens
ggaggugggcaugccacccuc

SEQ ID NO: 1234406 - RNA, 19 nt, Homo sapiens
ggaggugggguacauuucu

SEQ ID NO: 1234407 - RNA, 15 nt, Homo sapiens
ggagguucucagagc

SEQ ID NO: 1234408 - RNA, 14 nt, Homo sapiens
ggagguugcaguga

SEQ ID NO: 1234409 - RNA, 13 nt, Homo sapiens
ggaguaaaauuca

SEQ ID NO: 1234410 - RNA, 22 nt, Homo sapiens
ggaguaacaauacaaauggauu

SEQ ID NO: 1234411 - RNA, 18 nt, Homo sapiens
ggaguagaaaaaucucau

SEQ ID NO: 1234412 - RNA, 16 nt, Homo sapiens
ggaguaggacauacca

SEQ ID NO: 1234413 - RNA, 14 nt, Homo sapiens
ggagucacacagug

SEQ ID NO: 1234414 - RNA, 16 nt, Homo sapiens
ggagucccuuuggcaa

SEQ ID NO: 1234415 - RNA, 22 nt, Homo sapiens
ggagucucugccacccacucag

SEQ ID NO: 1234416 - RNA, 21 nt, Homo sapiens
ggagugaaaccuuuagggcag

SEQ ID NO: 1234417 - RNA, 17 nt, Homo sapiens
ggagugaagaggggcag

SEQ ID NO: 1234418 - RNA, 22 nt, Homo sapiens
ggagugcaguggcgugaucucg

SEQ ID NO: 1234419 - RNA, 22 nt, Homo sapiens
ggaguguugggcaugugaucac

SEQ ID NO: 1234420 - RNA, 14 nt, Homo sapiens
ggaguuccacagau

SEQ ID NO: 1234421 - RNA, 20 nt, Homo sapiens
ggaguucuagaaccacuucc

SEQ ID NO: 1234422 - RNA, 16 nt, Homo sapiens
ggaguugacugcucau

SEQ ID NO: 1234423 - RNA, 21 nt, Homo sapiens
ggaguuggaauguuguaguua

SEQ ID NO: 1234424 - RNA, 14 nt, Homo sapiens
ggaguuggagacca

SEQ ID NO: 1234425 - RNA, 16 nt, Homo sapiens
ggauaacacauuugau

SEQ ID NO: 1234426 - RNA, 17 nt, Homo sapiens
ggauaaccuugugccuu

SEQ ID NO: 1234427 - RNA, 15 nt, Homo sapiens
ggauaaggaggcacu

SEQ ID NO: 1234428 - RNA, 18 nt, Homo sapiens
ggauacagaaaugcaaaa

SEQ ID NO: 1234429 - RNA, 19 nt, Homo sapiens
ggauacccuggagcaagac

SEQ ID NO: 1234430 - RNA, 22 nt, Homo sapiens
ggauagaagggcaauauuuuau

SEQ ID NO: 1234431 - RNA, 16 nt, Homo sapiens
ggauagaggaaaggga

SEQ ID NO: 1234432 - RNA, 19 nt, Homo sapiens
ggauagaucaaagucaaaa

SEQ ID NO: 1234433 - RNA, 20 nt, Homo sapiens
ggauaguccaaagacuuaac

SEQ ID NO: 1234434 - RNA, 19 nt, Homo sapiens
ggauaucacuuccaugaca

SEQ ID NO: 1234435 - RNA, 15 nt, Homo sapiens
ggauauuuaguucaa

SEQ ID NO: 1234436 - RNA, 16 nt, Homo sapiens
ggauauuugcacuuau

SEQ ID NO: 1234437 - RNA, 17 nt, Homo sapiens
ggauauuugcacuuaug

SEQ ID NO: 1234438 - RNA, 11 nt, Homo sapiens
ggaucagagau

SEQ ID NO: 1234439 - RNA, 22 nt, Homo sapiens
ggaucccaagcccugcauugua

SEQ ID NO: 1234440 - RNA, 19 nt, Homo sapiens
ggauccccccacagccccu

SEQ ID NO: 1234441 - RNA, 13 nt, Homo sapiens
ggauccucuccuu

SEQ ID NO: 1234442 - RNA, 19 nt, Homo sapiens
ggaucuuguaauccagugc

SEQ ID NO: 1234443 - RNA, 17 nt, Homo sapiens
ggaugaagcccuaaaga

SEQ ID NO: 1234444 - RNA, 20 nt, Homo sapiens
ggaugauuauuuucuguucu

SEQ ID NO: 1234445 - RNA, 22 nt, Homo sapiens
ggaugauuauuuucuguucuau

SEQ ID NO: 1234446 - RNA, 20 nt, Homo sapiens
guagugugugcuuacaguaa

SEQ ID NO: 1234447 - RNA, 17 nt, Homo sapiens
guaguuacuguggucac

SEQ ID NO: 1234448 - RNA, 21 nt, Homo sapiens
guaguuuuuacagcuguguua

SEQ ID NO: 1234449 - RNA, 15 nt, Homo sapiens
guauaaacuaucagu

SEQ ID NO: 1234450 - RNA, 14 nt, Homo sapiens
guauaaagauugua

SEQ ID NO: 1234451 - RNA, 14 nt, Homo sapiens
guauaacaacuuug

SEQ ID NO: 1234452 - RNA, 19 nt, Homo sapiens
guauaacacaauaugaaua

SEQ ID NO: 1234453 - RNA, 14 nt, Homo sapiens
guauaagcaucugc

SEQ ID NO: 1234454 - RNA, 21 nt, Homo sapiens
guauaaguggaggcacuuuag

SEQ ID NO: 1234455 - RNA, 15 nt, Homo sapiens
guauaauagagauaa

SEQ ID NO: 1234456 - RNA, 22 nt, Homo sapiens
guauaauagagauaaguccauu

SEQ ID NO: 1234457 - RNA, 14 nt, Homo sapiens
guauaauugaccua

SEQ ID NO: 1234458 - RNA, 16 nt, Homo sapiens
guauauaaacauauca

SEQ ID NO: 1234459 - RNA, 15 nt, Homo sapiens
guauauauacauaca

SEQ ID NO: 1234460 - RNA, 18 nt, Homo sapiens
guauauauuuagugcugc

SEQ ID NO: 1234461 - RNA, 10 nt, Homo sapiens
guauaugcac

SEQ ID NO: 1234462 - RNA, 17 nt, Homo sapiens
guauaugucuuuuaccc

SEQ ID NO: 1234463 - RNA, 20 nt, Homo sapiens
guauauucugguuacugugg

SEQ ID NO: 1234464 - RNA, 14 nt, Homo sapiens
guaucaacacuguu

SEQ ID NO: 1234465 - RNA, 15 nt, Homo sapiens
guaucaacacuguua

SEQ ID NO: 1234466 - RNA, 16 nt, Homo sapiens
guaucaacacuguuac

SEQ ID NO: 1234467 - RNA, 16 nt, Homo sapiens
guaucaggugcugcca

SEQ ID NO: 1234468 - RNA, 20 nt, Homo sapiens
guauccagucugaagauguu

SEQ ID NO: 1234469 - RNA, 23 nt, Homo sapiens
guauccaugcaccuaccuuagaa

SEQ ID NO: 1234470 - RNA, 18 nt, Homo sapiens
guaucccacauccaacuc

SEQ ID NO: 1234471 - RNA, 18 nt, Homo sapiens
guaucccgagucugggac

SEQ ID NO: 1234472 - RNA, 16 nt, Homo sapiens
guauccugcccagugu

SEQ ID NO: 1234473 - RNA, 17 nt, Homo sapiens
guaucucaguaccccau

SEQ ID NO: 1234474 - RNA, 21 nt, Homo sapiens
guaucuguuuacauccagagu

SEQ ID NO: 1234475 - RNA, 18 nt, Homo sapiens
guaucuuccauauuugga

SEQ ID NO: 1234476 - RNA, 20 nt, Homo sapiens
guaucuuccuuucuugucuu

SEQ ID NO: 1234477 - RNA, 14 nt, Homo sapiens
guaugacuaaagag

SEQ ID NO: 1234478 - RNA, 17 nt, Homo sapiens
guaugaucacggcucac

SEQ ID NO: 1234479 - RNA, 16 nt, Homo sapiens
guaugaucaguacuga

SEQ ID NO: 1234480 - RNA, 20 nt, Homo sapiens
guaugaugcuaaucuugucc

SEQ ID NO: 1234481 - RNA, 21 nt, Homo sapiens
guaugcaaaccucaucuuucu

SEQ ID NO: 1234482 - RNA, 16 nt, Homo sapiens
guaugcaagucuguga

SEQ ID NO: 1234483 - RNA, 22 nt, Homo sapiens
guaugccaccaacacugcucac

SEQ ID NO: 1234484 - RNA, 18 nt, Homo sapiens
guaugcuggccagcaccc

SEQ ID NO: 1234485 - RNA, 15 nt, Homo sapiens
guauggaaacacuga

SEQ ID NO: 1234486 - RNA, 18 nt, Homo sapiens
guauggaauacaguguua

SEQ ID NO: 1234487 - RNA, 13 nt, Homo sapiens
guauggcucugca

SEQ ID NO: 1234488 - RNA, 21 nt, Homo sapiens
guauggggaggcaaguguggg

SEQ ID NO: 1234489 - RNA, 22 nt, Homo sapiens
guaugguuacuaaaaaguacca

SEQ ID NO: 1234490 - RNA, 17 nt, Homo sapiens
guauguaauuuaugcaa

SEQ ID NO: 1234491 - RNA, 16 nt, Homo sapiens
guaugucagugucacu

SEQ ID NO: 1234492 - RNA, 14 nt, Homo sapiens
guaugucuaccucu

SEQ ID NO: 1234493 - RNA, 17 nt, Homo sapiens
guaugugacaccaaagc

SEQ ID NO: 1234494 - RNA, 13 nt, Homo sapiens
guaugugccauuu

SEQ ID NO: 1234495 - RNA, 14 nt, Homo sapiens
guauguguguauau

SEQ ID NO: 1234496 - RNA, 21 nt, Homo sapiens
guauguucccucuugucccuu

SEQ ID NO: 1234497 - RNA, 18 nt, Homo sapiens
guauuaauaaagcauucu

SEQ ID NO: 1234498 - RNA, 17 nt, Homo sapiens
guauuacagcuuucaca

SEQ ID NO: 1234499 - RNA, 20 nt, Homo sapiens
guauuaggugucauuuccau

SEQ ID NO: 1234500 - RNA, 17 nt, Homo sapiens
guauuauauaauucaag

SEQ ID NO: 1234501 - RNA, 18 nt, Homo sapiens
guauuaugucucuucuga

SEQ ID NO: 1234502 - RNA, 18 nt, Homo sapiens
guauuauucuguuuugca

SEQ ID NO: 1234503 - RNA, 21 nt, Homo sapiens
guauuauucuguuuugcacag

SEQ ID NO: 1234504 - RNA, 18 nt, Homo sapiens
guauucaaacaauuugaa

SEQ ID NO: 1234505 - RNA, 15 nt, Homo sapiens
guauucaagcaaaca

SEQ ID NO: 1234506 - RNA, 13 nt, Homo sapiens
guauuccacuuag

SEQ ID NO: 1234507 - RNA, 21 nt, Homo sapiens
guauuccuuuauacacagugg

SEQ ID NO: 1234508 - RNA, 16 nt, Homo sapiens
guauugaaaacuucaa

SEQ ID NO: 1234509 - RNA, 16 nt, Homo sapiens
guauuggaaauggaug

SEQ ID NO: 1234510 - RNA, 12 nt, Homo sapiens
guauugucuacc

SEQ ID NO: 1234511 - RNA, 17 nt, Homo sapiens
guauuuaggcagauuga

SEQ ID NO: 1234512 - RNA, 17 nt, Homo sapiens
guauuucagaacuuuga

SEQ ID NO: 1234513 - RNA, 19 nt, Homo sapiens
guauuuccagugcaauugu

SEQ ID NO: 1234514 - RNA, 19 nt, Homo sapiens
guauuugaaaacucacaga

SEQ ID NO: 1234515 - RNA, 21 nt, Homo sapiens
guauuuggaaauaaagucaga

SEQ ID NO: 1234516 - RNA, 22 nt, Homo sapiens
guauuuguucauguuuggugca

SEQ ID NO: 1234517 - RNA, 19 nt, Homo sapiens
guauuuuccuggauuuaua

SEQ ID NO: 1234518 - RNA, 18 nt, Homo sapiens
guauuuugcuagugcauu

SEQ ID NO: 1234519 - RNA, 16 nt, Homo sapiens
guauuuuuaaaggcau

SEQ ID NO: 1234520 - RNA, 16 nt, Homo sapiens
guauuuuuaguagaga

SEQ ID NO: 1234521 - RNA, 12 nt, Homo sapiens
guauuuuuggca

SEQ ID NO: 1234522 - RNA, 13 nt, Homo sapiens
gucaaaaaucugu

SEQ ID NO: 1234523 - RNA, 21 nt, Homo sapiens
gucaaaacacuguggaacuaa

SEQ ID NO: 1234524 - RNA, 16 nt, Homo sapiens
gucaaagcaaguuuca

SEQ ID NO: 1234525 - RNA, 21 nt, Homo sapiens
gucaacaucuuuuacauucug

SEQ ID NO: 1234526 - RNA, 22 nt, Homo sapiens
gucacaagggauuggcaauugu

SEQ ID NO: 1234527 - RNA, 21 nt, Homo sapiens
gucacaauccuaacacauuau

SEQ ID NO: 1234528 - RNA, 13 nt, Homo sapiens
gucacagggccaa

SEQ ID NO: 1234529 - RNA, 19 nt, Homo sapiens
gucacaucucugccuggaa

SEQ ID NO: 1234530 - RNA, 14 nt, Homo sapiens
gucauuuccucuag

SEQ ID NO: 1234531 - RNA, 22 nt, Homo sapiens
gucauuucucaaaaaccacagu

SEQ ID NO: 1234532 - RNA, 17 nt, Homo sapiens
gucauuugacugucuca

SEQ ID NO: 1234533 - RNA, 17 nt, Homo sapiens
guccaaagaacaagaaa

SEQ ID NO: 1234534 - RNA, 13 nt, Homo sapiens
guccaacugucaa

SEQ ID NO: 1234535 - RNA, 21 nt, Homo sapiens
guccaagucuucucaagaucc

SEQ ID NO: 1234536 - RNA, 13 nt, Homo sapiens
guccacaaagcau

SEQ ID NO: 1234537 - RNA, 13 nt, Homo sapiens
guccacaggucua

SEQ ID NO: 1234538 - RNA, 19 nt, Homo sapiens
guccacuccuccuacugua

SEQ ID NO: 1234539 - RNA, 23 nt, Homo sapiens
guccacugugagaggugacacug

SEQ ID NO: 1234540 - RNA, 22 nt, Homo sapiens
guccagaagggcuacuuuccac

SEQ ID NO: 1234541 - RNA, 20 nt, Homo sapiens
guccagagcuggaucucuca

SEQ ID NO: 1234542 - RNA, 22 nt, Homo sapiens
guccagcccugccuugcugcag

SEQ ID NO: 1234543 - RNA, 11 nt, Homo sapiens
guccaggaaac

SEQ ID NO: 1234544 - RNA, 16 nt, Homo sapiens
guccagguuaguuuac

SEQ ID NO: 1234545 - RNA, 19 nt, Homo sapiens
guccaugugguucuucaaa

SEQ ID NO: 1234546 - RNA, 21 nt, Homo sapiens
guccauugauuuuaaccaaug

SEQ ID NO: 1234547 - RNA, 19 nt, Homo sapiens
guccauuuauccacaggaa

SEQ ID NO: 1234548 - RNA, 13 nt, Homo sapiens
gucccacagggag

SEQ ID NO: 1234549 - RNA, 15 nt, Homo sapiens
gucccagacaauucc

SEQ ID NO: 1234550 - RNA, 11 nt, Homo sapiens
gucccagagag

SEQ ID NO: 1234551 - RNA, 15 nt, Homo sapiens
gucccagaguggcug

SEQ ID NO: 1234552 - RNA, 16 nt, Homo sapiens
gucccaggagcaggac

SEQ ID NO: 1234553 - RNA, 13 nt, Homo sapiens
gucccaugaccca

SEQ ID NO: 1234554 - RNA, 17 nt, Homo sapiens
guccccacccuccacuc

SEQ ID NO: 1234555 - RNA, 21 nt, Homo sapiens
guccccacccuccacucagcu

SEQ ID NO: 1234556 - RNA, 12 nt, Homo sapiens
gucccccaaccc

SEQ ID NO: 1234557 - RNA, 18 nt, Homo sapiens
guccccucacucugucag

SEQ ID NO: 1234558 - RNA, 17 nt, Homo sapiens
guccccuccacugucac

SEQ ID NO: 1234559 - RNA, 23 nt, Homo sapiens
guccccuccacugucacauugua

SEQ ID NO: 1234560 - RNA, 14 nt, Homo sapiens
guccccuccaggaa

SEQ ID NO: 1234561 - RNA, 18 nt, Homo sapiens
gucccggggccagcacuu

SEQ ID NO: 1234562 - RNA, 20 nt, Homo sapiens
gucccggggccagcacuucc

SEQ ID NO: 1234563 - RNA, 16 nt, Homo sapiens
gucccggguguguaca

SEQ ID NO: 1234564 - RNA, 19 nt, Homo sapiens
gucccucccaccucuguga

SEQ ID NO: 1234565 - RNA, 16 nt, Homo sapiens
gucccugcugcugcca

SEQ ID NO: 1234566 - RNA, 15 nt, Homo sapiens
gucccuggacacagc

SEQ ID NO: 1234567 - RNA, 22 nt, Homo sapiens
gucccugguucauugauggaug

SEQ ID NO: 1234568 - RNA, 22 nt, Homo sapiens
gucccuguccuucccuguucuc

SEQ ID NO: 1234569 - RNA, 17 nt, Homo sapiens
guccuacuaucacugaa

SEQ ID NO: 1234570 - RNA, 18 nt, Homo sapiens
guccucaccuucaaaaau

SEQ ID NO: 1234571 - RNA, 18 nt, Homo sapiens
guccucacgcagacacac

SEQ ID NO: 1234572 - RNA, 20 nt, Homo sapiens
guccucaugggucccuugaa

SEQ ID NO: 1234573 - RNA, 14 nt, Homo sapiens
guccuccccucaca

SEQ ID NO: 1234574 - RNA, 19 nt, Homo sapiens
guccucuacuuaaugagau

SEQ ID NO: 1234575 - RNA, 15 nt, Homo sapiens
guccucuucugggcc

SEQ ID NO: 1234576 - RNA, 20 nt, Homo sapiens
guccugaaggaaaaugacuc

SEQ ID NO: 1234577 - RNA, 21 nt, Homo sapiens
guccugacacuauucauuuga

SEQ ID NO: 1234578 - RNA, 16 nt, Homo sapiens
guccugaccaucgcac

SEQ ID NO: 1234579 - RNA, 15 nt, Homo sapiens
guccugaucugugau

SEQ ID NO: 1234580 - RNA, 16 nt, Homo sapiens
guccugaucugugaua

SEQ ID NO: 1234581 - RNA, 18 nt, Homo sapiens
guccugaugcugugcuca

SEQ ID NO: 1234582 - RNA, 13 nt, Homo sapiens
guccugccggugg

SEQ ID NO: 1234583 - RNA, 18 nt, Homo sapiens
guccugggccuccugaca

SEQ ID NO: 1234584 - RNA, 17 nt, Homo sapiens
guccuggggaccauuca

SEQ ID NO: 1234585 - RNA, 15 nt, Homo sapiens
guccuggugucucca

SEQ ID NO: 1234586 - RNA, 23 nt, Homo sapiens
guccuguauaagaauuacuaaau

SEQ ID NO: 1234587 - RNA, 14 nt, Homo sapiens
guccuuaaagccau

SEQ ID NO: 1234588 - RNA, 13 nt, Homo sapiens
guccuuccugacc

SEQ ID NO: 1234589 - RNA, 21 nt, Homo sapiens
guccuugugaguccaucuaac

SEQ ID NO: 1234590 - RNA, 16 nt, Homo sapiens
guccuuugggacucau

SEQ ID NO: 1234591 - RNA, 21 nt, Homo sapiens
guccuuuuuuauacaggaaaa

SEQ ID NO: 1234592 - RNA, 16 nt, Homo sapiens
gucgaaagcucuagaa

SEQ ID NO: 1234593 - RNA, 20 nt, Homo sapiens
gucgauccuggggcccucag

SEQ ID NO: 1234594 - RNA, 18 nt, Homo sapiens
gucgaugcguucacucca

SEQ ID NO: 1234595 - RNA, 14 nt, Homo sapiens
gucgcaucucagug

SEQ ID NO: 1234596 - RNA, 16 nt, Homo sapiens
gucgggggcuguggau

SEQ ID NO: 1234597 - RNA, 23 nt, Homo sapiens
gucguguaauuggcccaagucau

SEQ ID NO: 1234598 - RNA, 14 nt, Homo sapiens
gucuaaaagcagaa

SEQ ID NO: 1234599 - RNA, 19 nt, Homo sapiens
gucuaaacuuuagaauuaa

SEQ ID NO: 1234600 - RNA, 20 nt, Homo sapiens
gucuaaacuuuagaauuaau

SEQ ID NO: 1234601 - RNA, 19 nt, Homo sapiens
gucuaagguucagccugaa

SEQ ID NO: 1234602 - RNA, 15 nt, Homo sapiens
gucuaauuuauucaa

SEQ ID NO: 1234603 - RNA, 17 nt, Homo sapiens
gucuacuguggugaucu

SEQ ID NO: 1234604 - RNA, 22 nt, Homo sapiens
gucuagacuauuaggugcaauu

SEQ ID NO: 1234605 - RNA, 17 nt, Homo sapiens
gucuagacugccaggga

SEQ ID NO: 1234606 - RNA, 14 nt, Homo sapiens
gucuagccacugau

SEQ ID NO: 1234607 - RNA, 19 nt, Homo sapiens
gucuaggucuccucagggu

SEQ ID NO: 1234608 - RNA, 18 nt, Homo sapiens
gucuaugggacucaaugc

SEQ ID NO: 1234609 - RNA, 16 nt, Homo sapiens
gucuauuaauauucag

SEQ ID NO: 1234610 - RNA, 15 nt, Homo sapiens
gucuauuuucagagc

SEQ ID NO: 1234611 - RNA, 20 nt, Homo sapiens
gucuauuuuuuuaacugaaa

SEQ ID NO: 1234612 - RNA, 15 nt, Homo sapiens
gucucaaacuccuga

SEQ ID NO: 1234613 - RNA, 13 nt, Homo sapiens
gucucaaucugau

SEQ ID NO: 1234614 - RNA, 18 nt, Homo sapiens
gcugauggguaguaccug

SEQ ID NO: 1234615 - RNA, 15 nt, Homo sapiens
gcugauggugacauu

SEQ ID NO: 1234616 - RNA, 20 nt, Homo sapiens
gcugauuuccaggccccuga

SEQ ID NO: 1234617 - RNA, 17 nt, Homo sapiens
gcugcaaagccuuucca

SEQ ID NO: 1234618 - RNA, 19 nt, Homo sapiens
gcugcaaaggaaaagccaa

SEQ ID NO: 1234619 - RNA, 16 nt, Homo sapiens
gcugcaagguacucug

SEQ ID NO: 1234620 - RNA, 15 nt, Homo sapiens
gcugcaccacuucca

SEQ ID NO: 1234621 - RNA, 17 nt, Homo sapiens
gcugcacccacccagga

SEQ ID NO: 1234622 - RNA, 18 nt, Homo sapiens
gcugcacugaucacccaa

SEQ ID NO: 1234623 - RNA, 19 nt, Homo sapiens
gcugcagacaaguggacag

SEQ ID NO: 1234624 - RNA, 20 nt, Homo sapiens
gcugcagcugggccccaugc

SEQ ID NO: 1234625 - RNA, 21 nt, Homo sapiens
gcugccaccacgucugccagg

SEQ ID NO: 1234626 - RNA, 20 nt, Homo sapiens
gcugccagaugauuguucaa

SEQ ID NO: 1234627 - RNA, 20 nt, Homo sapiens
gcugccaugccacugccagg

SEQ ID NO: 1234628 - RNA, 24 nt, Homo sapiens
gcugccauuucccuucuggacacu

SEQ ID NO: 1234629 - RNA, 13 nt, Homo sapiens
gcugcccacuguu

SEQ ID NO: 1234630 - RNA, 22 nt, Homo sapiens
gcugcccuggcccugaggugug

SEQ ID NO: 1234631 - RNA, 15 nt, Homo sapiens
gcugccucacuuccu

SEQ ID NO: 1234632 - RNA, 23 nt, Homo sapiens
gcugccuucccuagcuuuagacc

SEQ ID NO: 1234633 - RNA, 20 nt, Homo sapiens
gcugcggggggcaccagagg

SEQ ID NO: 1234634 - RNA, 18 nt, Homo sapiens
gcugcuacuacuccugua

SEQ ID NO: 1234635 - RNA, 20 nt, Homo sapiens
gcugcuauacacaagcaaug

SEQ ID NO: 1234636 - RNA, 16 nt, Homo sapiens
gcugcuccagugcagg

SEQ ID NO: 1234637 - RNA, 21 nt, Homo sapiens
gcugcugcacccaacuacuga

SEQ ID NO: 1234638 - RNA, 14 nt, Homo sapiens
gcugcugcugcacc

SEQ ID NO: 1234639 - RNA, 21 nt, Homo sapiens
gcugcuggggccucagacgag

SEQ ID NO: 1234640 - RNA, 17 nt, Homo sapiens
gcugcuuagacauaaca

SEQ ID NO: 1234641 - RNA, 22 nt, Homo sapiens
gcugcuucuccucccagcgugu

SEQ ID NO: 1234642 - RNA, 19 nt, Homo sapiens
gcugcuuuaggaauucugc

SEQ ID NO: 1234643 - RNA, 17 nt, Homo sapiens
gcugcuuuguucaaugc

SEQ ID NO: 1234644 - RNA, 23 nt, Homo sapiens
gcuggaaaaccuccuuuaccaga

SEQ ID NO: 1234645 - RNA, 14 nt, Homo sapiens
gcuggaaaugcuga

SEQ ID NO: 1234646 - RNA, 12 nt, Homo sapiens
gcuggaagggaa

SEQ ID NO: 1234647 - RNA, 18 nt, Homo sapiens
gcuggaagucuaccugcu

SEQ ID NO: 1234648 - RNA, 21 nt, Homo sapiens
gcuggaccaguggugccuugg

SEQ ID NO: 1234649 - RNA, 18 nt, Homo sapiens
gcuggacuucuaccugcc

SEQ ID NO: 1234650 - RNA, 17 nt, Homo sapiens
gcuggagagaacccaga

SEQ ID NO: 1234651 - RNA, 19 nt, Homo sapiens
gcuggagugcaaugcacga

SEQ ID NO: 1234652 - RNA, 15 nt, Homo sapiens
gcuggagugcaaugg

SEQ ID NO: 1234653 - RNA, 13 nt, Homo sapiens
gcuggcaaccacu

SEQ ID NO: 1234654 - RNA, 18 nt, Homo sapiens
gcuggcaaccacuaagaa

SEQ ID NO: 1234655 - RNA, 16 nt, Homo sapiens
gcuggcaagcagggaa

SEQ ID NO: 1234656 - RNA, 16 nt, Homo sapiens
gcuggcaagucuucca

SEQ ID NO: 1234657 - RNA, 14 nt, Homo sapiens
gcuggcaguagugc

SEQ ID NO: 1234658 - RNA, 18 nt, Homo sapiens
gcuggccuccuaugccuc

SEQ ID NO: 1234659 - RNA, 18 nt, Homo sapiens
gcuggccucuggcucuca

SEQ ID NO: 1234660 - RNA, 14 nt, Homo sapiens
gcuggcgugcagug

SEQ ID NO: 1234661 - RNA, 16 nt, Homo sapiens
gcuggcuguauggaaa

SEQ ID NO: 1234662 - RNA, 20 nt, Homo sapiens
gcugggaaaaaaguuuugau

SEQ ID NO: 1234663 - RNA, 23 nt, Homo sapiens
gcugggaaaaaaguuuugaugaa

SEQ ID NO: 1234664 - RNA, 14 nt, Homo sapiens
gcugggaaccagca

SEQ ID NO: 1234665 - RNA, 22 nt, Homo sapiens
gcugggaagacgccugagcuca

SEQ ID NO: 1234666 - RNA, 15 nt, Homo sapiens
gcugggacuggccag

SEQ ID NO: 1234667 - RNA, 22 nt, Homo sapiens
gcugggauuacaggugugggcc

SEQ ID NO: 1234668 - RNA, 16 nt, Homo sapiens
gcugggcagaccccuc

SEQ ID NO: 1234669 - RNA, 13 nt, Homo sapiens
gcugggccauguc

SEQ ID NO: 1234670 - RNA, 17 nt, Homo sapiens
gcugggccauguccaaa

SEQ ID NO: 1234671 - RNA, 14 nt, Homo sapiens
gcugggccccaccu

SEQ ID NO: 1234672 - RNA, 15 nt, Homo sapiens
gcugggcucaggaaa

SEQ ID NO: 1234673 - RNA, 15 nt, Homo sapiens
gcugggcuucagugg

SEQ ID NO: 1234674 - RNA, 22 nt, Homo sapiens
gcugggggcagcaguaccaucu

SEQ ID NO: 1234675 - RNA, 21 nt, Homo sapiens
gcugguccccuccucagugac

SEQ ID NO: 1234676 - RNA, 23 nt, Homo sapiens
gcuggucccggggccagcacuuc

SEQ ID NO: 1234677 - RNA, 14 nt, Homo sapiens
gcuguaaauuacau

SEQ ID NO: 1234678 - RNA, 17 nt, Homo sapiens
gcuguauuuaauggcau

SEQ ID NO: 1234679 - RNA, 16 nt, Homo sapiens
gcugucaagcaccugc

SEQ ID NO: 1234680 - RNA, 22 nt, Homo sapiens
gcugucagcccaugugcaccug

SEQ ID NO: 1234681 - RNA, 12 nt, Homo sapiens
gcugucaggggc

SEQ ID NO: 1234682 - RNA, 14 nt, Homo sapiens
gcuguccugcagca

SEQ ID NO: 1234683 - RNA, 12 nt, Homo sapiens
gcugucuuccaa

SEQ ID NO: 1234684 - RNA, 18 nt, Homo sapiens
gcugugacuucuccaggu

SEQ ID NO: 1234685 - RNA, 14 nt, Homo sapiens
gugcacucugcuaa

SEQ ID NO: 1234686 - RNA, 22 nt, Homo sapiens
gugcagcuccucagcggcucca

SEQ ID NO: 1234687 - RNA, 16 nt, Homo sapiens
gugcagcugauuuuaa

SEQ ID NO: 1234688 - RNA, 18 nt, Homo sapiens
gugcagggaaccgugaua

SEQ ID NO: 1234689 - RNA, 15 nt, Homo sapiens
gugcagggcucaggg

SEQ ID NO: 1234690 - RNA, 12 nt, Homo sapiens
gugcagucacug

SEQ ID NO: 1234691 - RNA, 15 nt, Homo sapiens
gugcagucacuggag

SEQ ID NO: 1234692 - RNA, 16 nt, Homo sapiens
gugcauauuaaaacaa

SEQ ID NO: 1234693 - RNA, 13 nt, Homo sapiens
gugcaugaugcug

SEQ ID NO: 1234694 - RNA, 12 nt, Homo sapiens
gugccaaaaauc

SEQ ID NO: 1234695 - RNA, 19 nt, Homo sapiens
gugccaaaaaucuuuucau

SEQ ID NO: 1234696 - RNA, 17 nt, Homo sapiens
gugccaauauuucugau

SEQ ID NO: 1234697 - RNA, 18 nt, Homo sapiens
gugccaauauuucugaua

SEQ ID NO: 1234698 - RNA, 15 nt, Homo sapiens
gugccagcaccugcc

SEQ ID NO: 1234699 - RNA, 20 nt, Homo sapiens
gugccaggccagugaccuca

SEQ ID NO: 1234700 - RNA, 22 nt, Homo sapiens
gugccagugucauccgggccua

SEQ ID NO: 1234701 - RNA, 13 nt, Homo sapiens
gugccaugaucug

SEQ ID NO: 1234702 - RNA, 21 nt, Homo sapiens
gugccauuuuaagaguuacuu

SEQ ID NO: 1234703 - RNA, 18 nt, Homo sapiens
gugcccacccugggagac

SEQ ID NO: 1234704 - RNA, 18 nt, Homo sapiens
gugcccaggguuuugccc

SEQ ID NO: 1234705 - RNA, 19 nt, Homo sapiens
gugccccagcagugccuug

SEQ ID NO: 1234706 - RNA, 19 nt, Homo sapiens
gugcccuacaaaggcuaga

SEQ ID NO: 1234707 - RNA, 15 nt, Homo sapiens
gugcccucaccacca

SEQ ID NO: 1234708 - RNA, 18 nt, Homo sapiens
gugccguaacaacugugg

SEQ ID NO: 1234709 - RNA, 21 nt, Homo sapiens
gugccuagacuguuacuuugg

SEQ ID NO: 1234710 - RNA, 18 nt, Homo sapiens
gugccuccaccaccacug

SEQ ID NO: 1234711 - RNA, 14 nt, Homo sapiens
gugccuccucaaac

SEQ ID NO: 1234712 - RNA, 22 nt, Homo sapiens
gugccucugggacuggacaauu

SEQ ID NO: 1234713 - RNA, 14 nt, Homo sapiens
gugccuuccauaau

SEQ ID NO: 1234714 - RNA, 17 nt, Homo sapiens
gugccuucccagacacu

SEQ ID NO: 1234715 - RNA, 20 nt, Homo sapiens
gugccuucucacaucugucc

SEQ ID NO: 1234716 - RNA, 13 nt, Homo sapiens
gugcgaguccucc

SEQ ID NO: 1234717 - RNA, 15 nt, Homo sapiens
gugcggcugccauug

SEQ ID NO: 1234718 - RNA, 19 nt, Homo sapiens
gugcgugaaguaggcauau

SEQ ID NO: 1234719 - RNA, 23 nt, Homo sapiens
gugcgugcucccgaugcugcuau

SEQ ID NO: 1234720 - RNA, 15 nt, Homo sapiens
gugcuauacacacac

SEQ ID NO: 1234721 - RNA, 20 nt, Homo sapiens
gugcuauccugcccaggcca

SEQ ID NO: 1234722 - RNA, 12 nt, Homo sapiens
gugcucagagac

SEQ ID NO: 1234723 - RNA, 13 nt, Homo sapiens
gugcucagagggc

SEQ ID NO: 1234724 - RNA, 22 nt, Homo sapiens
ucugccuguuauaacucugcac

SEQ ID NO: 1234725 - RNA, 13 nt, Homo sapiens
ucugccuucaggc

SEQ ID NO: 1234726 - RNA, 23 nt, Homo sapiens
ucugcggcuguguaguaaaucuc

SEQ ID NO: 1234727 - RNA, 22 nt, Homo sapiens
ucugcuaauucgagucauggcu

SEQ ID NO: 1234728 - RNA, 10 nt, Homo sapiens
ucugcuccac

SEQ ID NO: 1234729 - RNA, 13 nt, Homo sapiens
ucugcucccucug

SEQ ID NO: 1234730 - RNA, 20 nt, Homo sapiens
ucugcugaaggcagucauau

SEQ ID NO: 1234731 - RNA, 18 nt, Homo sapiens
ucugcugacagacacagg

SEQ ID NO: 1234732 - RNA, 12 nt, Homo sapiens
ucugcugaggag

SEQ ID NO: 1234733 - RNA, 23 nt, Homo sapiens
ucugcuggggauggccacuguga

SEQ ID NO: 1234734 - RNA, 18 nt, Homo sapiens
ucugcuucugaaacugga

SEQ ID NO: 1234735 - RNA, 13 nt, Homo sapiens
ucugcuugaucaa

SEQ ID NO: 1234736 - RNA, 17 nt, Homo sapiens
ucugcuuuucccauugc

SEQ ID NO: 1234737 - RNA, 17 nt, Homo sapiens
ucuggaaagugauguca

SEQ ID NO: 1234738 - RNA, 18 nt, Homo sapiens
ucuggaaagugaugucag

SEQ ID NO: 1234739 - RNA, 15 nt, Homo sapiens
ucuggaaggacaucu

SEQ ID NO: 1234740 - RNA, 13 nt, Homo sapiens
ucuggaaguccaa

SEQ ID NO: 1234741 - RNA, 22 nt, Homo sapiens
ucuggaaguuucuggugccauu

SEQ ID NO: 1234742 - RNA, 16 nt, Homo sapiens
ucuggaauacaugaaa

SEQ ID NO: 1234743 - RNA, 18 nt, Homo sapiens
ucuggaaucuggagacca

SEQ ID NO: 1234744 - RNA, 14 nt, Homo sapiens
ucuggaauugcuca

SEQ ID NO: 1234745 - RNA, 13 nt, Homo sapiens
ucuggacacugag

SEQ ID NO: 1234746 - RNA, 15 nt, Homo sapiens
ucuggacacugagag

SEQ ID NO: 1234747 - RNA, 20 nt, Homo sapiens
ucuggaggacggucagucca

SEQ ID NO: 1234748 - RNA, 15 nt, Homo sapiens
ucuggaugcugugaa

SEQ ID NO: 1234749 - RNA, 16 nt, Homo sapiens
ucuggaugcugugaag

SEQ ID NO: 1234750 - RNA, 20 nt, Homo sapiens
ucuggauuucauacuguaac

SEQ ID NO: 1234751 - RNA, 14 nt, Homo sapiens
ucuggccaggcaug

SEQ ID NO: 1234752 - RNA, 18 nt, Homo sapiens
ucuggcccucgacacuca

SEQ ID NO: 1234753 - RNA, 14 nt, Homo sapiens
ucuggcucuugagg

SEQ ID NO: 1234754 - RNA, 18 nt, Homo sapiens
ucuggcugaacccugugc

SEQ ID NO: 1234755 - RNA, 20 nt, Homo sapiens
ucuggcugaacccugugcug

SEQ ID NO: 1234756 - RNA, 18 nt, Homo sapiens
ucuggcugaggauuucaa

SEQ ID NO: 1234757 - RNA, 17 nt, Homo sapiens
ucuggcuuagugccacc

SEQ ID NO: 1234758 - RNA, 11 nt, Homo sapiens
ucuggcuuuac

SEQ ID NO: 1234759 - RNA, 17 nt, Homo sapiens
ucugggacaaaacugga

SEQ ID NO: 1234760 - RNA, 21 nt, Homo sapiens
ucugggagacuuugaagacca

SEQ ID NO: 1234761 - RNA, 19 nt, Homo sapiens
ucugggauauggcugccca

SEQ ID NO: 1234762 - RNA, 20 nt, Homo sapiens
ucugggauuaagggcaaauc

SEQ ID NO: 1234763 - RNA, 23 nt, Homo sapiens
ucugggauuaagggcaaaucuau

SEQ ID NO: 1234764 - RNA, 17 nt, Homo sapiens
ucugggccaaguuccuc

SEQ ID NO: 1234765 - RNA, 13 nt, Homo sapiens
ucugggccagugc

SEQ ID NO: 1234766 - RNA, 15 nt, Homo sapiens
ucugggccagugcac

SEQ ID NO: 1234767 - RNA, 13 nt, Homo sapiens
ucuggggugcuaa

SEQ ID NO: 1234768 - RNA, 13 nt, Homo sapiens
ucugggucuacca

SEQ ID NO: 1234769 - RNA, 14 nt, Homo sapiens
ucugggugcagcug

SEQ ID NO: 1234770 - RNA, 18 nt, Homo sapiens
ucugguccacacuagaaa

SEQ ID NO: 1234771 - RNA, 12 nt, Homo sapiens
ucuggucuucca

SEQ ID NO: 1234772 - RNA, 13 nt, Homo sapiens
ucuggugccauuu

SEQ ID NO: 1234773 - RNA, 14 nt, Homo sapiens
ucugguucugaugc

SEQ ID NO: 1234774 - RNA, 22 nt, Homo sapiens
ucuguaaaagcagacccaccuc

SEQ ID NO: 1234775 - RNA, 14 nt, Homo sapiens
ucuguaaacucaaa

SEQ ID NO: 1234776 - RNA, 19 nt, Homo sapiens
ucuguaagguggacuucca

SEQ ID NO: 1234777 - RNA, 15 nt, Homo sapiens
ucuguagucauuuac

SEQ ID NO: 1234778 - RNA, 11 nt, Homo sapiens
ucuguaucugc

SEQ ID NO: 1234779 - RNA, 15 nt, Homo sapiens
ucuguaucugccaug

SEQ ID NO: 1234780 - RNA, 13 nt, Homo sapiens
ucuguauguguau

SEQ ID NO: 1234781 - RNA, 20 nt, Homo sapiens
ucuguauugggguacaggaa

SEQ ID NO: 1234782 - RNA, 13 nt, Homo sapiens
ucugucaccaacu

SEQ ID NO: 1234783 - RNA, 12 nt, Homo sapiens
ucugucaggggu

SEQ ID NO: 1234784 - RNA, 12 nt, Homo sapiens
ucugucaugaac

SEQ ID NO: 1234785 - RNA, 15 nt, Homo sapiens
ucugucauguaacac

SEQ ID NO: 1234786 - RNA, 18 nt, Homo sapiens
ucuguccauuuauccaca

SEQ ID NO: 1234787 - RNA, 16 nt, Homo sapiens
ucugucccaaucuuac

SEQ ID NO: 1234788 - RNA, 23 nt, Homo sapiens
ucuguccucuugccuuuuacuua

SEQ ID NO: 1234789 - RNA, 18 nt, Homo sapiens
ucuguccugauuucuaca

SEQ ID NO: 1234790 - RNA, 17 nt, Homo sapiens
ucugucuccaagaccuu

SEQ ID NO: 1234791 - RNA, 20 nt, Homo sapiens
ucugucuuuaagaacuaauu

SEQ ID NO: 1234792 - RNA, 22 nt, Homo sapiens
ucugugaaaagggaucugcucc

SEQ ID NO: 1234793 - RNA, 17 nt, Homo sapiens
ucugugaugacauuccc

SEQ ID NO: 1234794 - RNA, 23 nt, Homo sapiens
ucugugcagagaugacuguccaa

SEQ ID NO: 1234795 - RNA, 19 nt, Homo sapiens
ucuguguauauuauuuggc

SEQ ID NO: 1234796 - RNA, 12 nt, Homo sapiens
ucuguguggcag

SEQ ID NO: 1234797 - RNA, 13 nt, Homo sapiens
ucuguguuuacag

SEQ ID NO: 1234798 - RNA, 18 nt, Homo sapiens
ucuguguuuuauugacau

SEQ ID NO: 1234799 - RNA, 20 nt, Homo sapiens
ucuguuaauagucaucacau

SEQ ID NO: 1234800 - RNA, 15 nt, Homo sapiens
ucuguuaaucaugua

SEQ ID NO: 1234801 - RNA, 12 nt, Homo sapiens
ucuguucacuuu

SEQ ID NO: 1234802 - RNA, 13 nt, Homo sapiens
ucuguucacuuuc

SEQ ID NO: 1234803 - RNA, 16 nt, Homo sapiens
ucuguucagaugugca

SEQ ID NO: 1234804 - RNA, 19 nt, Homo sapiens
ucuguucuguuucaaggca

SEQ ID NO: 1234805 - RNA, 22 nt, Homo sapiens
ucuguuggaugacuuugagauu

SEQ ID NO: 1234806 - RNA, 22 nt, Homo sapiens
ucuguuggcaggcuggccaguc

SEQ ID NO: 1234807 - RNA, 20 nt, Homo sapiens
ucuguuggccagugugacaa

SEQ ID NO: 1234808 - RNA, 21 nt, Homo sapiens
ucuguugucguaaagauuugg

SEQ ID NO: 1234809 - RNA, 13 nt, Homo sapiens
ucuguuuagugaa

SEQ ID NO: 1234810 - RNA, 19 nt, Homo sapiens
ucuguuucuucagcacauu

SEQ ID NO: 1234811 - RNA, 23 nt, Homo sapiens
ucuguuugaaauucuagagccag

SEQ ID NO: 1234812 - RNA, 14 nt, Homo sapiens
ucuguuugagauuu

SEQ ID NO: 1234813 - RNA, 20 nt, Homo sapiens
ucuuucuuugcaccaaagac

SEQ ID NO: 1234814 - RNA, 17 nt, Homo sapiens
ucuuugaaaacagauga

SEQ ID NO: 1234815 - RNA, 19 nt, Homo sapiens
ucuuugacaauuccuagau

SEQ ID NO: 1234816 - RNA, 14 nt, Homo sapiens
ucuuugcaccaaag

SEQ ID NO: 1234817 - RNA, 15 nt, Homo sapiens
ucuuugucauaccuu

SEQ ID NO: 1234818 - RNA, 19 nt, Homo sapiens
ucuuuguuaugacagugaa

SEQ ID NO: 1234819 - RNA, 21 nt, Homo sapiens
ucuuuguuaugacagugaaua

SEQ ID NO: 1234820 - RNA, 16 nt, Homo sapiens
ucuuuuacauucugca

SEQ ID NO: 1234821 - RNA, 22 nt, Homo sapiens
ucuuuuacccggcacauucccc

SEQ ID NO: 1234822 - RNA, 18 nt, Homo sapiens
ucuuuucuacccuagcca

SEQ ID NO: 1234823 - RNA, 18 nt, Homo sapiens
ucuuuucugaucugcagu

SEQ ID NO: 1234824 - RNA, 21 nt, Homo sapiens
ucuuuucuggaauguaaucaa

SEQ ID NO: 1234825 - RNA, 18 nt, Homo sapiens
ucuuuugaaggacuccuu

SEQ ID NO: 1234826 - RNA, 23 nt, Homo sapiens
ucuuuuugguagaugcugggcuc

SEQ ID NO: 1234827 - RNA, 16 nt, Homo sapiens
ucuuuuuuaugcagaa

SEQ ID NO: 1234828 - RNA, 23 nt, Homo sapiens
ucuuuuuuuuuaaggugaaccaa

SEQ ID NO: 1234829 - RNA, 14 nt, Homo sapiens
ugaaaaaaaaaugg

SEQ ID NO: 1234830 - RNA, 17 nt, Homo sapiens
ugaaaaaaaguacaugu

SEQ ID NO: 1234831 - RNA, 18 nt, Homo sapiens
ugaaaaacaaaaauaaca

SEQ ID NO: 1234832 - RNA, 17 nt, Homo sapiens
ugaaaaauaagucacuu

SEQ ID NO: 1234833 - RNA, 14 nt, Homo sapiens
ugaaaaaucuaagu

SEQ ID NO: 1234834 - RNA, 22 nt, Homo sapiens
ugaaaacaaacaagaggacugu

SEQ ID NO: 1234835 - RNA, 17 nt, Homo sapiens
ugaaaacauaaucugca

SEQ ID NO: 1234836 - RNA, 22 nt, Homo sapiens
ugaaaacucacagaacuaugua

SEQ ID NO: 1234837 - RNA, 17 nt, Homo sapiens
ugaaaagcugcauuuaa

SEQ ID NO: 1234838 - RNA, 15 nt, Homo sapiens
ugaaaagguugccug

SEQ ID NO: 1234839 - RNA, 20 nt, Homo sapiens
ugaaaaguaucacucuaaaa

SEQ ID NO: 1234840 - RNA, 18 nt, Homo sapiens
ugaaaauaauuguuccaa

SEQ ID NO: 1234841 - RNA, 15 nt, Homo sapiens
ugaaaauaugauguu

SEQ ID NO: 1234842 - RNA, 20 nt, Homo sapiens
ugaaaauauuuuguugccuu

SEQ ID NO: 1234843 - RNA, 16 nt, Homo sapiens
ugaaaauccaucucau

SEQ ID NO: 1234844 - RNA, 14 nt, Homo sapiens
ugaaaaucuaauau

SEQ ID NO: 1234845 - RNA, 17 nt, Homo sapiens
ugaaaaucuccaucuca

SEQ ID NO: 1234846 - RNA, 19 nt, Homo sapiens
ugaaaaugagcaucagaga

SEQ ID NO: 1234847 - RNA, 16 nt, Homo sapiens
ugaaaaugaguuguga

SEQ ID NO: 1234848 - RNA, 14 nt, Homo sapiens
ugaaaauguacuga

SEQ ID NO: 1234849 - RNA, 12 nt, Homo sapiens
ugaaaaugugac

SEQ ID NO: 1234850 - RNA, 12 nt, Homo sapiens
ugaaaauguuca

SEQ ID NO: 1234851 - RNA, 19 nt, Homo sapiens
ugaaaauguuuuucugcca

SEQ ID NO: 1234852 - RNA, 14 nt, Homo sapiens
ugaaaauugcaaua

SEQ ID NO: 1234853 - RNA, 15 nt, Homo sapiens
ugaaacaaacaugga

SEQ ID NO: 1234854 - RNA, 17 nt, Homo sapiens
ugaaacaaauaaucaca

SEQ ID NO: 1234855 - RNA, 13 nt, Homo sapiens
ugaaacacagcug

SEQ ID NO: 1234856 - RNA, 21 nt, Homo sapiens
ucugagagugaaaccaugacu

SEQ ID NO: 1234857 - RNA, 17 nt, Homo sapiens
ucugagcccagcugccu

SEQ ID NO: 1234858 - RNA, 21 nt, Homo sapiens
ucugagucucugaaugaagcu

SEQ ID NO: 1234859 - RNA, 18 nt, Homo sapiens
ucugauaaaagauggcca

SEQ ID NO: 1234860 - RNA, 22 nt, Homo sapiens
ucugaucuauauuucuggugaa

SEQ ID NO: 1234861 - RNA, 20 nt, Homo sapiens
ucugauggcugaagaaugua

SEQ ID NO: 1234862 - RNA, 13 nt, Homo sapiens
ucugaugugaugu

SEQ ID NO: 1234863 - RNA, 15 nt, Homo sapiens
ucugauuacugucca

SEQ ID NO: 1234864 - RNA, 22 nt, Homo sapiens
ucugauuccccuccaccaaacc

SEQ ID NO: 1234865 - RNA, 19 nt, Homo sapiens
ucugauugcagcacagagc

SEQ ID NO: 1234866 - RNA, 21 nt, Homo sapiens
ucugauuuuuaaaguacuuuc

SEQ ID NO: 1234867 - RNA, 20 nt, Homo sapiens
ucugcaaaaggccucuugua

SEQ ID NO: 1234868 - RNA, 14 nt, Homo sapiens
ucugcaaaggccug

SEQ ID NO: 1234869 - RNA, 14 nt, Homo sapiens
ucugcaacugaaau

SEQ ID NO: 1234870 - RNA, 21 nt, Homo sapiens
ucugcaagcacaucugcauuu

SEQ ID NO: 1234871 - RNA, 10 nt, Homo sapiens
ucugcaaugc

SEQ ID NO: 1234872 - RNA, 15 nt, Homo sapiens
ucugcacaugucuug

SEQ ID NO: 1234873 - RNA, 11 nt, Homo sapiens
ucugcacggga

SEQ ID NO: 1234874 - RNA, 21 nt, Homo sapiens
ucugcagggggugugucugcu

SEQ ID NO: 1234875 - RNA, 23 nt, Homo sapiens
ucugcagggggugugucugcuca

SEQ ID NO: 1234876 - RNA, 17 nt, Homo sapiens
ucugcaguacagucuua

SEQ ID NO: 1234877 - RNA, 14 nt, Homo sapiens
ucugcauacgagag

SEQ ID NO: 1234878 - RNA, 19 nt, Homo sapiens
ucugcaucccagcaccugc

SEQ ID NO: 1234879 - RNA, 19 nt, Homo sapiens
ucugcauggaacagcauua

SEQ ID NO: 1234880 - RNA, 17 nt, Homo sapiens
ucugcauuuagcacaaa

SEQ ID NO: 1234881 - RNA, 19 nt, Homo sapiens
ucugccaaaggaugugaua

SEQ ID NO: 1234882 - RNA, 18 nt, Homo sapiens
ucugccaccacaccuggc

SEQ ID NO: 1234883 - RNA, 23 nt, Homo sapiens
ucugccagggcagugcuagugag

SEQ ID NO: 1234884 - RNA, 15 nt, Homo sapiens
ucugcccaugggaag

SEQ ID NO: 1234885 - RNA, 14 nt, Homo sapiens
ucugccccagucgu

SEQ ID NO: 1234886 - RNA, 18 nt, Homo sapiens
ucugcccuuuccuaggcc

SEQ ID NO: 1234887 - RNA, 14 nt, Homo sapiens
ucugccgcuaccuc

SEQ ID NO: 1234888 - RNA, 21 nt, Homo sapiens
ucugccuagaguguagccuaa

SEQ ID NO: 1234889 - RNA, 22 nt, Homo sapiens
ucugccuagaguguagccuaaa

SEQ ID NO: 1234890 - RNA, 22 nt, Homo sapiens
ucugccugcaccccugcaguuu

SEQ ID NO: 1234891 - RNA, 12 nt, Homo sapiens
ucugccugugga

SEQ ID NO: 1234892 - RNA, 19 nt, Homo sapiens
uauuuggaaauaaagucag

SEQ ID NO: 1234893 - RNA, 19 nt, Homo sapiens
uauuuggacucuaagcucu

SEQ ID NO: 1234894 - RNA, 18 nt, Homo sapiens
uauuugguaccauggugu

SEQ ID NO: 1234895 - RNA, 18 nt, Homo sapiens
uauuuguaaaucugccac

SEQ ID NO: 1234896 - RNA, 21 nt, Homo sapiens
uauuuguauuaauaaagcauu

SEQ ID NO: 1234897 - RNA, 20 nt, Homo sapiens
uauuuguuuggugaauuugu

SEQ ID NO: 1234898 - RNA, 22 nt, Homo sapiens
uauuuuaagaauuucacaagcu

SEQ ID NO: 1234899 - RNA, 15 nt, Homo sapiens
uauuuuacugaucuc

SEQ ID NO: 1234900 - RNA, 16 nt, Homo sapiens
uauuuuaggcacuguu

SEQ ID NO: 1234901 - RNA, 21 nt, Homo sapiens
uauuuuaggcacuguucaaua

SEQ ID NO: 1234902 - RNA, 17 nt, Homo sapiens
uauuuuauagagcagaa

SEQ ID NO: 1234903 - RNA, 16 nt, Homo sapiens
uauuuuaucugcuaug

SEQ ID NO: 1234904 - RNA, 13 nt, Homo sapiens
uauuuucuguuga

SEQ ID NO: 1234905 - RNA, 22 nt, Homo sapiens
uauuuucuuacccaauuuccca

SEQ ID NO: 1234906 - RNA, 14 nt, Homo sapiens
uauuuucuuuauca

SEQ ID NO: 1234907 - RNA, 19 nt, Homo sapiens
uauuuucuuuucuuucaac

SEQ ID NO: 1234908 - RNA, 12 nt, Homo sapiens
uauuuugcacug

SEQ ID NO: 1234909 - RNA, 16 nt, Homo sapiens
uauuuuuagacagagu

SEQ ID NO: 1234910 - RNA, 16 nt, Homo sapiens
uauuuuuauccaugac

SEQ ID NO: 1234911 - RNA, 23 nt, Homo sapiens
uauuuuucaaagauguguugcua

SEQ ID NO: 1234912 - RNA, 20 nt, Homo sapiens
uauuuuuguacugaaucuca

SEQ ID NO: 1234913 - RNA, 20 nt, Homo sapiens
uauuuuuuaaaacacuaaaa

SEQ ID NO: 1234914 - RNA, 16 nt, Homo sapiens
uauuuuuuaaacauac

SEQ ID NO: 1234915 - RNA, 18 nt, Homo sapiens
uauuuuuucccuccugac

SEQ ID NO: 1234916 - RNA, 21 nt, Homo sapiens
uauuuuuuuuuaauuuugaua

SEQ ID NO: 1234917 - RNA, 18 nt, Homo sapiens
ucaaaaaaaaaagcaaca

SEQ ID NO: 1234918 - RNA, 17 nt, Homo sapiens
ucaaaaacgaccaccuc

SEQ ID NO: 1234919 - RNA, 13 nt, Homo sapiens
ucaaaaauacaaa

SEQ ID NO: 1234920 - RNA, 20 nt, Homo sapiens
ucaaaagacaaacaugcaag

SEQ ID NO: 1234921 - RNA, 22 nt, Homo sapiens
ucaaaagcacuuugugcugugu

SEQ ID NO: 1234922 - RNA, 20 nt, Homo sapiens
ucaaaagccauaacuugaaa

SEQ ID NO: 1234923 - RNA, 17 nt, Homo sapiens
ucaaaauaaaaaugagg

SEQ ID NO: 1234924 - RNA, 14 nt, Homo sapiens
ucaaaaugcuuuuu

SEQ ID NO: 1234925 - RNA, 14 nt, Homo sapiens
ucaaaauuacauau

SEQ ID NO: 1234926 - RNA, 18 nt, Homo sapiens
ucaaaauuucagcauuau

SEQ ID NO: 1234927 - RNA, 15 nt, Homo sapiens
ucaaacaacauucca

SEQ ID NO: 1234928 - RNA, 17 nt, Homo sapiens
ucaaacauaauucucuc

SEQ ID NO: 1234929 - RNA, 21 nt, Homo sapiens
ucaaaccaauuucuuccuucc

SEQ ID NO: 1234930 - RNA, 22 nt, Homo sapiens
ucaaacucaccuugucucauga

SEQ ID NO: 1234931 - RNA, 19 nt, Homo sapiens
ucaaacucccuagucucca

SEQ ID NO: 1234932 - RNA, 23 nt, Homo sapiens
ucaaacuccuagguucacuuugg

SEQ ID NO: 1234933 - RNA, 19 nt, Homo sapiens
ucaaacuccugaccucagg

SEQ ID NO: 1234934 - RNA, 19 nt, Homo sapiens
ucaaacucuugaccucagg

SEQ ID NO: 1234935 - RNA, 22 nt, Homo sapiens
ucaaacuugugagguguuugca

SEQ ID NO: 1234936 - RNA, 20 nt, Homo sapiens
ucaaagacaaucacugaaac

SEQ ID NO: 1234937 - RNA, 17 nt, Homo sapiens
ucaaagaggaaccagga

SEQ ID NO: 1234938 - RNA, 12 nt, Homo sapiens
ucaaagcacuug

SEQ ID NO: 1234939 - RNA, 13 nt, Homo sapiens
ucaaagcaguagu

SEQ ID NO: 1234940 - RNA, 20 nt, Homo sapiens
ucaaagcuuugacucuauaa

SEQ ID NO: 1234941 - RNA, 16 nt, Homo sapiens
ucaaaggaagacuuga

SEQ ID NO: 1234942 - RNA, 17 nt, Homo sapiens
ucaaaggcccucaguga

SEQ ID NO: 1234943 - RNA, 17 nt, Homo sapiens
ucaaaguacugggauua

SEQ ID NO: 1234944 - RNA, 22 nt, Homo sapiens
ucaaagugagaaaaugccucaa

SEQ ID NO: 1234945 - RNA, 16 nt, Homo sapiens
ucaaaguguaacagau

SEQ ID NO: 1234946 - RNA, 20 nt, Homo sapiens
ucaaaguuuugaaaagcuau

SEQ ID NO: 1234947 - RNA, 21 nt, Homo sapiens
ucaaauaaaucuaaaucuuca

SEQ ID NO: 1234948 - RNA, 14 nt, Homo sapiens
ucaaauagcauaag

SEQ ID NO: 1234949 - RNA, 18 nt, Homo sapiens
ucaaauaguugcauagca

SEQ ID NO: 1234950 - RNA, 21 nt, Homo sapiens
ucaaaucaggguccaguggga

SEQ ID NO: 1234951 - RNA, 15 nt, Homo sapiens
ucaaaucguccagcg

SEQ ID NO: 1234952 - RNA, 12 nt, Homo sapiens
ucaaaucuccag

SEQ ID NO: 1234953 - RNA, 19 nt, Homo sapiens
ucaaaucuccugcugauuu

SEQ ID NO: 1234954 - RNA, 15 nt, Homo sapiens
ucaaaucugagggag

SEQ ID NO: 1234955 - RNA, 13 nt, Homo sapiens
ucaaaugauuuca

SEQ ID NO: 1234956 - RNA, 16 nt, Homo sapiens
ucaaauguauucagau

SEQ ID NO: 1234957 - RNA, 13 nt, Homo sapiens
ucaaauuaagcau

SEQ ID NO: 1234958 - RNA, 17 nt, Homo sapiens
ucaaauuaagugugcau

SEQ ID NO: 1234959 - RNA, 15 nt, Homo sapiens
ucaaauugcugcuug

SEQ ID NO: 1234960 - RNA, 21 nt, Homo sapiens
ucaaauuuguaaaguuagccu

SEQ ID NO: 1234961 - RNA, 13 nt, Homo sapiens
ucaacaaaccaca

SEQ ID NO: 1234962 - RNA, 21 nt, Homo sapiens
ucaacaacacagcaaaaccau

SEQ ID NO: 1234963 - RNA, 23 nt, Homo sapiens
ucaacacagugaaacuccaucuc

SEQ ID NO: 1234964 - RNA, 12 nt, Homo sapiens
ucaacacuuaag

SEQ ID NO: 1234965 - RNA, 12 nt, Homo sapiens
ucaacagaauug

SEQ ID NO: 1234966 - RNA, 15 nt, Homo sapiens
ucaacagccaagugu

SEQ ID NO: 1234967 - RNA, 23 nt, Homo sapiens
ucaacagccaagugugaccccac

SEQ ID NO: 1234968 - RNA, 14 nt, Homo sapiens
ucaacagcuaugcu

SEQ ID NO: 1234969 - RNA, 16 nt, Homo sapiens
ucaacagcuaugcugg

SEQ ID NO: 1234970 - RNA, 17 nt, Homo sapiens
ucaacaggucacuugau

SEQ ID NO: 1234971 - RNA, 21 nt, Homo sapiens
ucaacauccugccagccccac

SEQ ID NO: 1234972 - RNA, 18 nt, Homo sapiens
ucaacaucuaaaaaucaa

SEQ ID NO: 1234973 - RNA, 19 nt, Homo sapiens
ucaacaucuuuuacauucu

SEQ ID NO: 1234974 - RNA, 21 nt, Homo sapiens
ucaaccccuccccuccauccc

SEQ ID NO: 1234975 - RNA, 22 nt, Homo sapiens
ucaaccccuccccuccaucccu

SEQ ID NO: 1234976 - RNA, 13 nt, Homo sapiens
ucaacuaugauau

SEQ ID NO: 1234977 - RNA, 23 nt, Homo sapiens
ucaacucacugcaaccuccgccu

SEQ ID NO: 1234978 - RNA, 17 nt, Homo sapiens
ucaacugaaaagacuca

SEQ ID NO: 1234979 - RNA, 22 nt, Homo sapiens
ucaacugaaaagacucaguguu

SEQ ID NO: 1234980 - RNA, 16 nt, Homo sapiens
ucaacugcuguaaaau

SEQ ID NO: 1234981 - RNA, 15 nt, Homo sapiens
ucaagaaaaucuuug

SEQ ID NO: 1234982 - RNA, 13 nt, Homo sapiens
ucaagaaacugau

SEQ ID NO: 1234983 - RNA, 13 nt, Homo sapiens
ucaagaacacaug

SEQ ID NO: 1234984 - RNA, 22 nt, Homo sapiens
ucaagaagcguuaugugcagua

SEQ ID NO: 1234985 - RNA, 15 nt, Homo sapiens
ucaagaauaaucacg

SEQ ID NO: 1234986 - RNA, 20 nt, Homo sapiens
ucaagaauggggaucacaga

SEQ ID NO: 1234987 - RNA, 22 nt, Homo sapiens
ucaagaauggggaucacagaga

SEQ ID NO: 1234988 - RNA, 23 nt, Homo sapiens
ucaagaauggggaucacagagac

SEQ ID NO: 1234989 - RNA, 13 nt, Homo sapiens
ucaagacacugag

SEQ ID NO: 1234990 - RNA, 13 nt, Homo sapiens
ucaagacauuucu

SEQ ID NO: 1234991 - RNA, 20 nt, Homo sapiens
ucaagaccagccugggcaac

SEQ ID NO: 1234992 - RNA, 15 nt, Homo sapiens
ucaagacucaccuca

SEQ ID NO: 1234993 - RNA, 18 nt, Homo sapiens
ucaagacuuccucaugaa

SEQ ID NO: 1234994 - RNA, 22 nt, Homo sapiens
ucaagagaucuuucuuuccaaa

SEQ ID NO: 1234995 - RNA, 17 nt, Homo sapiens
ucaagagcacacagaga

SEQ ID NO: 1234996 - RNA, 16 nt, Homo sapiens
ucaagagcuccuugac

SEQ ID NO: 1234997 - RNA, 23 nt, Homo sapiens
ucaagaggcgagaugagcccaca

SEQ ID NO: 1234998 - RNA, 21 nt, Homo sapiens
ucaagauuuucauacuuuuac

SEQ ID NO: 1234999 - RNA, 16 nt, Homo sapiens
ucaagcaaacaucaaa

SEQ ID NO: 1235000 - RNA, 17 nt, Homo sapiens
ucaagcacuuacagcuc

SEQ ID NO: 1235001 - RNA, 19 nt, Homo sapiens
ucaagccaguacgugcuaa

SEQ ID NO: 1235002 - RNA, 20 nt, Homo sapiens
ucaagccccacgaugacugc

SEQ ID NO: 1235003 - RNA, 16 nt, Homo sapiens
ucaagccugugcaaug

SEQ ID NO: 1235004 - RNA, 15 nt, Homo sapiens
ucaagcuccccucac

SEQ ID NO: 1235005 - RNA, 18 nt, Homo sapiens
ucaagcugguggccucug

SEQ ID NO: 1235006 - RNA, 15 nt, Homo sapiens
ucaaggaguacaaug

SEQ ID NO: 1235007 - RNA, 22 nt, Homo sapiens
ucaaggauagaaguauaccuga

SEQ ID NO: 1235008 - RNA, 13 nt, Homo sapiens
ucaaggugggccu

SEQ ID NO: 1235009 - RNA, 22 nt, Homo sapiens
ucaagguguuuugaaaugcaga

SEQ ID NO: 1235010 - RNA, 17 nt, Homo sapiens
ucaagguuuguucaaca

SEQ ID NO: 1235011 - RNA, 19 nt, Homo sapiens
ucaagguuuuagguucuaa

SEQ ID NO: 1235012 - RNA, 16 nt, Homo sapiens
ucaaguaauugugaaa

SEQ ID NO: 1235013 - RNA, 13 nt, Homo sapiens
ucaaguacucaaa

SEQ ID NO: 1235014 - RNA, 13 nt, Homo sapiens
ucaagucucucac

SEQ ID NO: 1235015 - RNA, 16 nt, Homo sapiens
ucaagucucucacccu

SEQ ID NO: 1235016 - RNA, 19 nt, Homo sapiens
ucgagcagaugaugccaac

SEQ ID NO: 1235017 - RNA, 18 nt, Homo sapiens
ucgaggugaaaggcucag

SEQ ID NO: 1235018 - RNA, 19 nt, Homo sapiens
ucgaguccuaaggccuuag

SEQ ID NO: 1235019 - RNA, 21 nt, Homo sapiens
ucgauccaaauugugcuucuc

SEQ ID NO: 1235020 - RNA, 20 nt, Homo sapiens
ucgauccuggauucacucac

SEQ ID NO: 1235021 - RNA, 19 nt, Homo sapiens
ucgauccuggggcccucag

SEQ ID NO: 1235022 - RNA, 19 nt, Homo sapiens
ucgauggcucaaucuaucc

SEQ ID NO: 1235023 - RNA, 20 nt, Homo sapiens
ucgcaaaaacguaucuccua

SEQ ID NO: 1235024 - RNA, 18 nt, Homo sapiens
ucgcaccauugcacucca

SEQ ID NO: 1235025 - RNA, 14 nt, Homo sapiens
ucgcaccuuuccaa

SEQ ID NO: 1235026 - RNA, 17 nt, Homo sapiens
ucgcaucucagugcagg

SEQ ID NO: 1235027 - RNA, 14 nt, Homo sapiens
ucgcauuugucaau

SEQ ID NO: 1235028 - RNA, 18 nt, Homo sapiens
ucgcccuacucaccugag

SEQ ID NO: 1235029 - RNA, 21 nt, Homo sapiens
ucgccucugcuccuguggucc

SEQ ID NO: 1235030 - RNA, 21 nt, Homo sapiens
ucgcuauugauuuuuacuuca

SEQ ID NO: 1235031 - RNA, 22 nt, Homo sapiens
ucgcuauugauuuuuacuucaa

SEQ ID NO: 1235032 - RNA, 23 nt, Homo sapiens
ucgcuauugauuuuuacuucaau

SEQ ID NO: 1235033 - RNA, 18 nt, Homo sapiens
ucgcuccagacuugggaa

SEQ ID NO: 1235034 - RNA, 22 nt, Homo sapiens
ucgcuccugugucuugcaaugg

SEQ ID NO: 1235035 - RNA, 14 nt, Homo sapiens
ucgcuucuugccuc

SEQ ID NO: 1235036 - RNA, 17 nt, Homo sapiens
ucgcuuguaaauaccag

SEQ ID NO: 1235037 - RNA, 19 nt, Homo sapiens
ucgcuuguaaauaccagga

SEQ ID NO: 1235038 - RNA, 16 nt, Homo sapiens
ucgcuuuguugcccag

SEQ ID NO: 1235039 - RNA, 13 nt, Homo sapiens
ucggaucucucca

SEQ ID NO: 1235040 - RNA, 19 nt, Homo sapiens
ucggauuugccauagccuu

SEQ ID NO: 1235041 - RNA, 13 nt, Homo sapiens
ucggcacccugca

SEQ ID NO: 1235042 - RNA, 16 nt, Homo sapiens
ucggcagcuacucaga

SEQ ID NO: 1235043 - RNA, 19 nt, Homo sapiens
ucggccagagucuguuuca

SEQ ID NO: 1235044 - RNA, 18 nt, Homo sapiens
ucggcccuguuccccaag

SEQ ID NO: 1235045 - RNA, 18 nt, Homo sapiens
uagcauuuuuccaacaca

SEQ ID NO: 1235046 - RNA, 14 nt, Homo sapiens
uagccacagcaguu

SEQ ID NO: 1235047 - RNA, 13 nt, Homo sapiens
uagccaccccaga

SEQ ID NO: 1235048 - RNA, 23 nt, Homo sapiens
uagccagaggcucuaauguacaa

SEQ ID NO: 1235049 - RNA, 21 nt, Homo sapiens
uagccagauuugucuuuuugu

SEQ ID NO: 1235050 - RNA, 19 nt, Homo sapiens
uagccagcugugcacuuuc

SEQ ID NO: 1235051 - RNA, 17 nt, Homo sapiens
uagccaggaaguacuuc

SEQ ID NO: 1235052 - RNA, 19 nt, Homo sapiens
uagccaguuccugccuuaa

SEQ ID NO: 1235053 - RNA, 20 nt, Homo sapiens
uagccaguuccugccuuaac

SEQ ID NO: 1235054 - RNA, 15 nt, Homo sapiens
uagccauaauuuugc

SEQ ID NO: 1235055 - RNA, 14 nt, Homo sapiens
uagccaucuugauc

SEQ ID NO: 1235056 - RNA, 19 nt, Homo sapiens
uagccaugauaacugcaau

SEQ ID NO: 1235057 - RNA, 19 nt, Homo sapiens
uagcccagacucugagcug

SEQ ID NO: 1235058 - RNA, 23 nt, Homo sapiens
uagccccagagaugccagcccuu

SEQ ID NO: 1235059 - RNA, 14 nt, Homo sapiens
uagccgccaccugc

SEQ ID NO: 1235060 - RNA, 16 nt, Homo sapiens
uagccuuuuuguauaa

SEQ ID NO: 1235061 - RNA, 20 nt, Homo sapiens
uagcgcugcucuuaugccau

SEQ ID NO: 1235062 - RNA, 19 nt, Homo sapiens
uagcuaauuuuugcaaaua

SEQ ID NO: 1235063 - RNA, 15 nt, Homo sapiens
uagcuauggaaucaa

SEQ ID NO: 1235064 - RNA, 22 nt, Homo sapiens
uagcuauuuauagaaagcuuca

SEQ ID NO: 1235065 - RNA, 20 nt, Homo sapiens
uagcuauuuuucuuguugca

SEQ ID NO: 1235066 - RNA, 17 nt, Homo sapiens
uagcucuggaccugucu

SEQ ID NO: 1235067 - RNA, 16 nt, Homo sapiens
uagcugacuacaaauu

SEQ ID NO: 1235068 - RNA, 19 nt, Homo sapiens
uagcuggauauaauguauu

SEQ ID NO: 1235069 - RNA, 17 nt, Homo sapiens
uagcugggaagaccaau

SEQ ID NO: 1235070 - RNA, 16 nt, Homo sapiens
uagcugggacuacagg

SEQ ID NO: 1235071 - RNA, 19 nt, Homo sapiens
uagcugggauuacaggugu

SEQ ID NO: 1235072 - RNA, 17 nt, Homo sapiens
uagcuggugguuucacg

SEQ ID NO: 1235073 - RNA, 14 nt, Homo sapiens
uagcuuaacuaauu

SEQ ID NO: 1235074 - RNA, 13 nt, Homo sapiens
uagcuuaccugac

SEQ ID NO: 1235075 - RNA, 22 nt, Homo sapiens
uagcuucugcuuuucugcccug

SEQ ID NO: 1235076 - RNA, 20 nt, Homo sapiens
uagcuuguauaguguaaaau

SEQ ID NO: 1235077 - RNA, 15 nt, Homo sapiens
uagcuuuauucuuca

SEQ ID NO: 1235078 - RNA, 20 nt, Homo sapiens
uagcuuucccaaauaaacuc

SEQ ID NO: 1235079 - RNA, 21 nt, Homo sapiens
uagcuuuccuggucccucacc

SEQ ID NO: 1235080 - RNA, 21 nt, Homo sapiens
uaggaaaaguuauugugauaa

SEQ ID NO: 1235081 - RNA, 21 nt, Homo sapiens
uaggaacucaguccuguacuc

SEQ ID NO: 1235082 - RNA, 17 nt, Homo sapiens
uaggaagacgcagagca

SEQ ID NO: 1235083 - RNA, 15 nt, Homo sapiens
uaggaagaguagcau

SEQ ID NO: 1235084 - RNA, 22 nt, Homo sapiens
uaggaaggucucauucuuccaa

SEQ ID NO: 1235085 - RNA, 20 nt, Homo sapiens
uaggaaguauggcaugaaca

SEQ ID NO: 1235086 - RNA, 13 nt, Homo sapiens
uaggaaucccaga

SEQ ID NO: 1235087 - RNA, 18 nt, Homo sapiens
uaggaccuaaugggaccc

SEQ ID NO: 1235088 - RNA, 16 nt, Homo sapiens
uaggacucugaggcuc

SEQ ID NO: 1235089 - RNA, 19 nt, Homo sapiens
uaggagaaaccagcuuuua

SEQ ID NO: 1235090 - RNA, 18 nt, Homo sapiens
uaggagaagggucucaug

SEQ ID NO: 1235091 - RNA, 13 nt, Homo sapiens
uaggagagccaac

SEQ ID NO: 1235092 - RNA, 14 nt, Homo sapiens
uaggauaagcacua

SEQ ID NO: 1235093 - RNA, 15 nt, Homo sapiens
uaggauuaauaaaga

SEQ ID NO: 1235094 - RNA, 14 nt, Homo sapiens
uaggcacuguucaa

SEQ ID NO: 1235095 - RNA, 15 nt, Homo sapiens
uaggcauauaucacu

SEQ ID NO: 1235096 - RNA, 19 nt, Homo sapiens
uaggccagggcauguguau

SEQ ID NO: 1235097 - RNA, 18 nt, Homo sapiens
uaggccaugggacaggga

SEQ ID NO: 1235098 - RNA, 16 nt, Homo sapiens
uaggcgcaggugcaca

SEQ ID NO: 1235099 - RNA, 17 nt, Homo sapiens
uaggcuaccucaagacu

SEQ ID NO: 1235100 - RNA, 13 nt, Homo sapiens
uaggcugcugcug

SEQ ID NO: 1235101 - RNA, 12 nt, Homo sapiens
uaggcuggccag

SEQ ID NO: 1235102 - RNA, 21 nt, Homo sapiens
uaggcuuuaggagcucuguaa

SEQ ID NO: 1235103 - RNA, 20 nt, Homo sapiens
uagggaaguaacauuugccu

SEQ ID NO: 1235104 - RNA, 14 nt, Homo sapiens
uagggacuuggggc

SEQ ID NO: 1235105 - RNA, 24 nt, Homo sapiens
uagggauuuuuggcuacacacaaa

SEQ ID NO: 1235106 - RNA, 19 nt, Homo sapiens
uagggcaauauugccaugg

SEQ ID NO: 1235107 - RNA, 23 nt, Homo sapiens
uagggcacaaagacuucggggaa

SEQ ID NO: 1235108 - RNA, 13 nt, Homo sapiens
uagggcacuuuaa

SEQ ID NO: 1235109 - RNA, 19 nt, Homo sapiens
uagggcacuuuaagucagu

SEQ ID NO: 1235110 - RNA, 13 nt, Homo sapiens
uagggcuguaaaa

SEQ ID NO: 1235111 - RNA, 16 nt, Homo sapiens
uaggggucaggcucca

SEQ ID NO: 1235112 - RNA, 13 nt, Homo sapiens
uagguaaaaacug

SEQ ID NO: 1235113 - RNA, 12 nt, Homo sapiens
uagguagcuuua

SEQ ID NO: 1235114 - RNA, 16 nt, Homo sapiens
uaggucagauggaggu

SEQ ID NO: 1235115 - RNA, 18 nt, Homo sapiens
uaggucucaucucuucag

SEQ ID NO: 1235116 - RNA, 18 nt, Homo sapiens
uaggugacugaaauugca

SEQ ID NO: 1235117 - RNA, 21 nt, Homo sapiens
uaggugacuuguuuacucauu

SEQ ID NO: 1235118 - RNA, 15 nt, Homo sapiens
uaggugcagcuccuc

SEQ ID NO: 1235119 - RNA, 11 nt, Homo sapiens
uagguggcaag

SEQ ID NO: 1235120 - RNA, 16 nt, Homo sapiens
uaggugugacuugaac

SEQ ID NO: 1235121 - RNA, 24 nt, Homo sapiens
uagguuaguagcccuucagucuua

SEQ ID NO: 1235122 - RNA, 19 nt, Homo sapiens
uagguucaggaagaccaca

SEQ ID NO: 1235123 - RNA, 13 nt, Homo sapiens
uagguuggcagua

SEQ ID NO: 1235124 - RNA, 14 nt, Homo sapiens
uaguaaaagccauc

SEQ ID NO: 1235125 - RNA, 23 nt, Homo sapiens
uaguaaaagccaucuauguauau

SEQ ID NO: 1235126 - RNA, 14 nt, Homo sapiens
uaguaaacaugugg

SEQ ID NO: 1235127 - RNA, 14 nt, Homo sapiens
uaguaacauagaca

SEQ ID NO: 1235128 - RNA, 22 nt, Homo sapiens
uaguaacugccucaguguuuca

SEQ ID NO: 1235129 - RNA, 16 nt, Homo sapiens
uaguaagaugcacuga

SEQ ID NO: 1235130 - RNA, 23 nt, Homo sapiens
uaguaaguacuuaauaaacugug

SEQ ID NO: 1235131 - RNA, 20 nt, Homo sapiens
uaguaaucuacaaaggaaau

SEQ ID NO: 1235132 - RNA, 21 nt, Homo sapiens
uaguaauguuuuauacuguuu

SEQ ID NO: 1235133 - RNA, 20 nt, Homo sapiens
uaguacuuauguugcacaau

SEQ ID NO: 1235134 - RNA, 13 nt, Homo sapiens
uaguauacuuugu

SEQ ID NO: 1235135 - RNA, 19 nt, Homo sapiens
uaguauuuuuauccaugac

SEQ ID NO: 1235136 - RNA, 18 nt, Homo sapiens
uagucaaauuauguauug

SEQ ID NO: 1235137 - RNA, 13 nt, Homo sapiens
uagucacaaagac

SEQ ID NO: 1235138 - RNA, 12 nt, Homo sapiens
uagucacauggc

SEQ ID NO: 1235139 - RNA, 19 nt, Homo sapiens
uagucacauggccuaugca

SEQ ID NO: 1235140 - RNA, 20 nt, Homo sapiens
uagucacauggccuaugcac

SEQ ID NO: 1235141 - RNA, 15 nt, Homo sapiens
uagucagaaaauugg

SEQ ID NO: 1235142 - RNA, 12 nt, Homo sapiens
uagucaucuccu

SEQ ID NO: 1235143 - RNA, 20 nt, Homo sapiens
uagucauugucauaaguaaa

SEQ ID NO: 1235144 - RNA, 20 nt, Homo sapiens
uaguccaccucccauuacuu

SEQ ID NO: 1235145 - RNA, 19 nt, Homo sapiens
uaguccagugguccaacua

SEQ ID NO: 1235146 - RNA, 18 nt, Homo sapiens
uagucccagcuacucaga

SEQ ID NO: 1235147 - RNA, 18 nt, Homo sapiens
uaguccggacccaccuca

SEQ ID NO: 1235148 - RNA, 21 nt, Homo sapiens
uagucucuggaaaaagacuga

SEQ ID NO: 1235149 - RNA, 22 nt, Homo sapiens
uagugaagcuaauuaaacacau

SEQ ID NO: 1235150 - RNA, 17 nt, Homo sapiens
uagugacuguaauuaau

SEQ ID NO: 1235151 - RNA, 18 nt, Homo sapiens
uagugauucugauuucag

SEQ ID NO: 1235152 - RNA, 16 nt, Homo sapiens
uagugcagaaucucau

SEQ ID NO: 1235153 - RNA, 16 nt, Homo sapiens
uagugcuucagaguuu

SEQ ID NO: 1235154 - RNA, 16 nt, Homo sapiens
uaguggaagcuucuaa

SEQ ID NO: 1235155 - RNA, 15 nt, Homo sapiens
uagugguaugucucu

SEQ ID NO: 1235156 - RNA, 13 nt, Homo sapiens
uaguggucuuugu

SEQ ID NO: 1235157 - RNA, 13 nt, Homo sapiens
uaguguaccuccu

SEQ ID NO: 1235158 - RNA, 14 nt, Homo sapiens
uaguguacuuggag

SEQ ID NO: 1235159 - RNA, 21 nt, Homo sapiens
uagugugaaauauauuacuua

SEQ ID NO: 1235160 - RNA, 13 nt, Homo sapiens
uaguuaaaguaau

SEQ ID NO: 1235161 - RNA, 18 nt, Homo sapiens
uaguuaccuuauaguuac

SEQ ID NO: 1235162 - RNA, 12 nt, Homo sapiens
uaguuacugugg

SEQ ID NO: 1235163 - RNA, 17 nt, Homo sapiens
uaguuaugacagccauu

SEQ ID NO: 1235164 - RNA, 13 nt, Homo sapiens
uaguucuaccuca

SEQ ID NO: 1235165 - RNA, 21 nt, Homo sapiens
uaguugaauguugcaauguga

SEQ ID NO: 1235166 - RNA, 23 nt, Homo sapiens
uaguugaucuacaaaggccaugg

SEQ ID NO: 1235167 - RNA, 22 nt, Homo sapiens
uaguugcguggacucugcacau

SEQ ID NO: 1235168 - RNA, 17 nt, Homo sapiens
uaguugguuuccuucac

SEQ ID NO: 1235169 - RNA, 13 nt, Homo sapiens
uaguugugcuuuu

SEQ ID NO: 1235170 - RNA, 15 nt, Homo sapiens
uaguuucaugagucu

SEQ ID NO: 1235171 - RNA, 19 nt, Homo sapiens
uaguuugaccucacaguga

SEQ ID NO: 1235172 - RNA, 19 nt, Homo sapiens
uaguuugcaguuacacuaa

SEQ ID NO: 1235173 - RNA, 20 nt, Homo sapiens
uaguuugggguguauacuuc

SEQ ID NO: 1235174 - RNA, 21 nt, Homo sapiens
uaguuuguuuuagaaccagcc

SEQ ID NO: 1235175 - RNA, 16 nt, Homo sapiens
uaguuuuaguugcaga

SEQ ID NO: 1235176 - RNA, 21 nt, Homo sapiens
uaguuuucuccuuuuacuuca

SEQ ID NO: 1235177 - RNA, 13 nt, Homo sapiens
uaguuuuuggacu

SEQ ID NO: 1235178 - RNA, 20 nt, Homo sapiens
uauaaaaauauuaagacaau

SEQ ID NO: 1235179 - RNA, 18 nt, Homo sapiens
uauaaaaaugagugcuua

SEQ ID NO: 1235180 - RNA, 19 nt, Homo sapiens
uauaaaaaugagugcuuaa

SEQ ID NO: 1235181 - RNA, 17 nt, Homo sapiens
uauaaaagaauugcacg

SEQ ID NO: 1235182 - RNA, 13 nt, Homo sapiens
uaucauugcuaaa

SEQ ID NO: 1235183 - RNA, 23 nt, Homo sapiens
uaucauugcuaaacugaugacuu

SEQ ID NO: 1235184 - RNA, 21 nt, Homo sapiens
uaucauuuuaaaaacuuuauu

SEQ ID NO: 1235185 - RNA, 22 nt, Homo sapiens
uaucauuuuuguacaguuugcu

SEQ ID NO: 1235186 - RNA, 16 nt, Homo sapiens
uauccaaagacuguac

SEQ ID NO: 1235187 - RNA, 23 nt, Homo sapiens
uauccaagacuuagagcugggaa

SEQ ID NO: 1235188 - RNA, 15 nt, Homo sapiens
uauccaaucugugau

SEQ ID NO: 1235189 - RNA, 16 nt, Homo sapiens
uauccaaucugugaug

SEQ ID NO: 1235190 - RNA, 23 nt, Homo sapiens
uauccacagcuuacagcaauuug

SEQ ID NO: 1235191 - RNA, 14 nt, Homo sapiens
uauccaccaccucc

SEQ ID NO: 1235192 - RNA, 14 nt, Homo sapiens
uauccagccuccca

SEQ ID NO: 1235193 - RNA, 23 nt, Homo sapiens
uauccauauuuuacugaucucuu

SEQ ID NO: 1235194 - RNA, 21 nt, Homo sapiens
uauccaugcaccaaacuaaua

SEQ ID NO: 1235195 - RNA, 22 nt, Homo sapiens
uaucccacauccaacuccagca

SEQ ID NO: 1235196 - RNA, 18 nt, Homo sapiens
uaucccauugaaacaaaa

SEQ ID NO: 1235197 - RNA, 14 nt, Homo sapiens
uaucccuacaugua

SEQ ID NO: 1235198 - RNA, 21 nt, Homo sapiens
uaucccuagauagcuauuaag

SEQ ID NO: 1235199 - RNA, 18 nt, Homo sapiens
uauccuacugagcauuug

SEQ ID NO: 1235200 - RNA, 23 nt, Homo sapiens
uauccugggaggguguggugcuu

SEQ ID NO: 1235201 - RNA, 15 nt, Homo sapiens
uauccugugacuguc

SEQ ID NO: 1235202 - RNA, 15 nt, Homo sapiens
uauccuuagcucaca

SEQ ID NO: 1235203 - RNA, 15 nt, Homo sapiens
uauccuuucaagaca

SEQ ID NO: 1235204 - RNA, 21 nt, Homo sapiens
uaucgaaauaacaauguuaag

SEQ ID NO: 1235205 - RNA, 21 nt, Homo sapiens
uaucgggagcagugucuucca

SEQ ID NO: 1235206 - RNA, 20 nt, Homo sapiens
uaucuaauauauaugaauaa

SEQ ID NO: 1235207 - RNA, 14 nt, Homo sapiens
uaucuauuaucuca

SEQ ID NO: 1235208 - RNA, 23 nt, Homo sapiens
uaucucaggggccaacuaggcag

SEQ ID NO: 1235209 - RNA, 12 nt, Homo sapiens
uaucuccugaca

SEQ ID NO: 1235210 - RNA, 23 nt, Homo sapiens
uaucuccugacagaaggugccac

SEQ ID NO: 1235211 - RNA, 23 nt, Homo sapiens
uaucucggggagaaaugcaacca

SEQ ID NO: 1235212 - RNA, 16 nt, Homo sapiens
uaucugacaaugcuga

SEQ ID NO: 1235213 - RNA, 23 nt, Homo sapiens
uaucugauuuccuaaugucagag

SEQ ID NO: 1235214 - RNA, 15 nt, Homo sapiens
uaucuggacaagcca

SEQ ID NO: 1235215 - RNA, 20 nt, Homo sapiens
uaucuggcacuguuaauaca

SEQ ID NO: 1235216 - RNA, 15 nt, Homo sapiens
uaucugggauucuac

SEQ ID NO: 1235217 - RNA, 15 nt, Homo sapiens
uaucugucauauagu

SEQ ID NO: 1235218 - RNA, 14 nt, Homo sapiens
uaucugucaucucu

SEQ ID NO: 1235219 - RNA, 16 nt, Homo sapiens
uaucugucaucucucu

SEQ ID NO: 1235220 - RNA, 11 nt, Homo sapiens
uaucugugaaa

SEQ ID NO: 1235221 - RNA, 22 nt, Homo sapiens
uaucugugaaaugcuggcauuu

SEQ ID NO: 1235222 - RNA, 13 nt, Homo sapiens
uaucuuaugccac

SEQ ID NO: 1235223 - RNA, 14 nt, Homo sapiens
uaucuucacuuuua

SEQ ID NO: 1235224 - RNA, 20 nt, Homo sapiens
uaucuuccaaaugcaauuug

SEQ ID NO: 1235225 - RNA, 22 nt, Homo sapiens
uaucuucccuuuauuacaagaa

SEQ ID NO: 1235226 - RNA, 14 nt, Homo sapiens
uaucuucuacugua

SEQ ID NO: 1235227 - RNA, 18 nt, Homo sapiens
uaucuugauuucacugga

SEQ ID NO: 1235228 - RNA, 16 nt, Homo sapiens
uaucuugcaccccaaa

SEQ ID NO: 1235229 - RNA, 23 nt, Homo sapiens
uaucuugcagcuguaaacauauu

SEQ ID NO: 1235230 - RNA, 22 nt, Homo sapiens
uaucuugcgaauccaagcuccc

SEQ ID NO: 1235231 - RNA, 15 nt, Homo sapiens
uaucuuggcuuugcc

SEQ ID NO: 1235232 - RNA, 19 nt, Homo sapiens
uaucuugggauaguuccca

SEQ ID NO: 1235233 - RNA, 19 nt, Homo sapiens
uaucuuuauuaaucacuau

SEQ ID NO: 1235234 - RNA, 20 nt, Homo sapiens
uaucuuuauuaaucacuauu

SEQ ID NO: 1235235 - RNA, 14 nt, Homo sapiens
uaugaaaagaauuu

SEQ ID NO: 1235236 - RNA, 18 nt, Homo sapiens
uaugaaaagaggggacca

SEQ ID NO: 1235237 - RNA, 18 nt, Homo sapiens
uaugaaaaucuccaucuc

SEQ ID NO: 1235238 - RNA, 20 nt, Homo sapiens
uaugaaaaucuccaucucaa

SEQ ID NO: 1235239 - RNA, 21 nt, Homo sapiens
uaugaaaaucuccaucucaaa

SEQ ID NO: 1235240 - RNA, 20 nt, Homo sapiens
uaugaaaccacugcuggcag

SEQ ID NO: 1235241 - RNA, 15 nt, Homo sapiens
uaugaaacugcacau

SEQ ID NO: 1235242 - RNA, 18 nt, Homo sapiens
uaugaaacugcacauugg

SEQ ID NO: 1235243 - RNA, 14 nt, Homo sapiens
uaugaacuacaaag

SEQ ID NO: 1235244 - RNA, 17 nt, Homo sapiens
uaugaagaaaaaguaca

SEQ ID NO: 1235245 - RNA, 17 nt, Homo sapiens
uaugaaggaaucauucc

SEQ ID NO: 1235246 - RNA, 21 nt, Homo sapiens
uaugaagugacucucacaaga

SEQ ID NO: 1235247 - RNA, 21 nt, Homo sapiens
uaugaaugacaguagucacac

SEQ ID NO: 1235248 - RNA, 23 nt, Homo sapiens
uaugacagugaauauugcuuuua

SEQ ID NO: 1235249 - RNA, 23 nt, Homo sapiens
uaugaccucgcccuccacaaaug

SEQ ID NO: 1235250 - RNA, 15 nt, Homo sapiens
uaugacugauuacuc

SEQ ID NO: 1235251 - RNA, 18 nt, Homo sapiens
uaugacugauuacucaga

SEQ ID NO: 1235252 - RNA, 21 nt, Homo sapiens
uaugacuguuuuuguaguggu

SEQ ID NO: 1235253 - RNA, 13 nt, Homo sapiens
uaugagauauuaa

SEQ ID NO: 1235254 - RNA, 22 nt, Homo sapiens
uaugagccgugaacugugcaua

SEQ ID NO: 1235255 - RNA, 24 nt, Homo sapiens
uaugaggggguuuggcaccaagcu

SEQ ID NO: 1235256 - RNA, 17 nt, Homo sapiens
uaugaguaguguggaau

SEQ ID NO: 1235257 - RNA, 21 nt, Homo sapiens
uaugaguuuuugauagcuuua

SEQ ID NO: 1235258 - RNA, 13 nt, Homo sapiens
uaugaucuuggcu

SEQ ID NO: 1235259 - RNA, 19 nt, Homo sapiens
uaugauggggcaugugcca

SEQ ID NO: 1235260 - RNA, 21 nt, Homo sapiens
uaugauggggcaugugccaua

SEQ ID NO: 1235261 - RNA, 15 nt, Homo sapiens
uaugaugggggaaaa

SEQ ID NO: 1235262 - RNA, 13 nt, Homo sapiens
uaugauuauacaa

SEQ ID NO: 1235263 - RNA, 16 nt, Homo sapiens
uaugauugcauuguau

SEQ ID NO: 1235264 - RNA, 13 nt, Homo sapiens
uaugcaaaccuca

SEQ ID NO: 1235265 - RNA, 13 nt, Homo sapiens
uaugcacaaacuu

SEQ ID NO: 1235266 - RNA, 21 nt, Homo sapiens
uaugcaccuugugucuguaca

SEQ ID NO: 1235267 - RNA, 14 nt, Homo sapiens
uaugcagaauguuu

SEQ ID NO: 1235268 - RNA, 12 nt, Homo sapiens
uaugcaguaugc

SEQ ID NO: 1235269 - RNA, 15 nt, Homo sapiens
uaugcauuauaucaa

SEQ ID NO: 1235270 - RNA, 18 nt, Homo sapiens
uaugcauuugcauuugcu

SEQ ID NO: 1235271 - RNA, 20 nt, Homo sapiens
uaugcauuugcauuugcucu

SEQ ID NO: 1235272 - RNA, 23 nt, Homo sapiens
uaugcccggaccuccaucagagc

SEQ ID NO: 1235273 - RNA, 13 nt, Homo sapiens
uaugccuucuuau

SEQ ID NO: 1235274 - RNA, 21 nt, Homo sapiens
uaugccuuuuuccuagccugu

SEQ ID NO: 1235275 - RNA, 17 nt, Homo sapiens
uaugcgcaaaacugccu

SEQ ID NO: 1235276 - RNA, 18 nt, Homo sapiens
uaugcuauugaaguuuug

SEQ ID NO: 1235277 - RNA, 15 nt, Homo sapiens
uaugcucauugaacu

SEQ ID NO: 1235278 - RNA, 21 nt, Homo sapiens
uaugcugaacgcagaagaaag

SEQ ID NO: 1235279 - RNA, 12 nt, Homo sapiens
uauggacucugc

SEQ ID NO: 1235280 - RNA, 14 nt, Homo sapiens
uauggacucugcac

SEQ ID NO: 1235281 - RNA, 15 nt, Homo sapiens
uauggacucugcaca

SEQ ID NO: 1235282 - RNA, 20 nt, Homo sapiens
uauggaguaccauguggcaa

SEQ ID NO: 1235283 - RNA, 23 nt, Homo sapiens
uauggagugccugcuguggaccc

SEQ ID NO: 1235284 - RNA, 16 nt, Homo sapiens
uauggcuccuccauau

SEQ ID NO: 1235285 - RNA, 22 nt, Homo sapiens
uauggcuucaaguuguaaaaau

SEQ ID NO: 1235286 - RNA, 13 nt, Homo sapiens
uaugggaacaauu

SEQ ID NO: 1235287 - RNA, 21 nt, Homo sapiens
uaugggcuuuguuaucuucca

SEQ ID NO: 1235288 - RNA, 20 nt, Homo sapiens
uaugguaaaaguuacuuauu

SEQ ID NO: 1235289 - RNA, 15 nt, Homo sapiens
uaugguuugccauua

SEQ ID NO: 1235290 - RNA, 10 nt, Homo sapiens
uauguaaaac

SEQ ID NO: 1235291 - RNA, 16 nt, Homo sapiens
uauguaagagcaccuu

SEQ ID NO: 1235292 - RNA, 15 nt, Homo sapiens
uauguaauauauugu

SEQ ID NO: 1235293 - RNA, 23 nt, Homo sapiens
uauguaauuuagcaguccaaaga

SEQ ID NO: 1235294 - RNA, 15 nt, Homo sapiens
uauguacaaguguug

SEQ ID NO: 1235295 - RNA, 14 nt, Homo sapiens
uauguacaugagaa

SEQ ID NO: 1235296 - RNA, 16 nt, Homo sapiens
uauguacugccuuagu

SEQ ID NO: 1235297 - RNA, 16 nt, Homo sapiens
uauguacuguacuaau

SEQ ID NO: 1235298 - RNA, 18 nt, Homo sapiens
uauguagacuauauacau

SEQ ID NO: 1235299 - RNA, 16 nt, Homo sapiens
uauguagauauuuggc

SEQ ID NO: 1235300 - RNA, 13 nt, Homo sapiens
uauguauauacau

SEQ ID NO: 1235301 - RNA, 17 nt, Homo sapiens
uauguaugaguaucugu

SEQ ID NO: 1235302 - RNA, 19 nt, Homo sapiens
uacuuaauuccuuucucau

SEQ ID NO: 1235303 - RNA, 19 nt, Homo sapiens
uacuuacuccccacugaug

SEQ ID NO: 1235304 - RNA, 17 nt, Homo sapiens
uacuuagagcagugaag

SEQ ID NO: 1235305 - RNA, 14 nt, Homo sapiens
uacuuagcaugcac

SEQ ID NO: 1235306 - RNA, 22 nt, Homo sapiens
uacuucaacacuucauguauug

SEQ ID NO: 1235307 - RNA, 12 nt, Homo sapiens
uacuucacuacu

SEQ ID NO: 1235308 - RNA, 17 nt, Homo sapiens
uacuucaggggcacuuc

SEQ ID NO: 1235309 - RNA, 22 nt, Homo sapiens
uacuuccaccuccaccacaucu

SEQ ID NO: 1235310 - RNA, 19 nt, Homo sapiens
uacuuccuacagagccaaa

SEQ ID NO: 1235311 - RNA, 23 nt, Homo sapiens
uacuucucacuaauuuguaggaa

SEQ ID NO: 1235312 - RNA, 15 nt, Homo sapiens
uacuucuguguucau

SEQ ID NO: 1235313 - RNA, 16 nt, Homo sapiens
uacuugaaaaaguaaa

SEQ ID NO: 1235314 - RNA, 16 nt, Homo sapiens
uacuugaagacuguga

SEQ ID NO: 1235315 - RNA, 15 nt, Homo sapiens
uacuugacccaugcc

SEQ ID NO: 1235316 - RNA, 15 nt, Homo sapiens
uacuugagccuuuaa

SEQ ID NO: 1235317 - RNA, 20 nt, Homo sapiens
uacuugggaggcugaggcag

SEQ ID NO: 1235318 - RNA, 21 nt, Homo sapiens
uacuugugaaacacagcuguu

SEQ ID NO: 1235319 - RNA, 15 nt, Homo sapiens
uaaacaauaguucac

SEQ ID NO: 1235320 - RNA, 23 nt, Homo sapiens
uaaacaaugaugcccugcuccag

SEQ ID NO: 1235321 - RNA, 19 nt, Homo sapiens
uaaacacaaaguguauaca

SEQ ID NO: 1235322 - RNA, 19 nt, Homo sapiens
uaaacacauguucugugcc

SEQ ID NO: 1235323 - RNA, 16 nt, Homo sapiens
uaaacaccauuauuca

SEQ ID NO: 1235324 - RNA, 16 nt, Homo sapiens
uaaacacuggugccaa

SEQ ID NO: 1235325 - RNA, 16 nt, Homo sapiens
uaaacacuuaucuucu

SEQ ID NO: 1235326 - RNA, 21 nt, Homo sapiens
uaaacagacuuuagcuuacag

SEQ ID NO: 1235327 - RNA, 20 nt, Homo sapiens
uaaacagauggcacuuugaa

SEQ ID NO: 1235328 - RNA, 18 nt, Homo sapiens
uaaacagccucuuuuuga

SEQ ID NO: 1235329 - RNA, 15 nt, Homo sapiens
uaaacccaaucagau

SEQ ID NO: 1235330 - RNA, 22 nt, Homo sapiens
uaaacccaaucagaugccucag

SEQ ID NO: 1235331 - RNA, 19 nt, Homo sapiens
uaaaccuagaguuuuauca

SEQ ID NO: 1235332 - RNA, 20 nt, Homo sapiens
uaaaccuagaguuuuaucaa

SEQ ID NO: 1235333 - RNA, 16 nt, Homo sapiens
uaaaccucaaaauguc

SEQ ID NO: 1235334 - RNA, 22 nt, Homo sapiens
uaaaccucaguuauuacaugua

SEQ ID NO: 1235335 - RNA, 15 nt, Homo sapiens
uaaaccuccgccaau

SEQ ID NO: 1235336 - RNA, 16 nt, Homo sapiens
uaaaccuccuucggga

SEQ ID NO: 1235337 - RNA, 17 nt, Homo sapiens
uaaacgguuccugguga

SEQ ID NO: 1235338 - RNA, 22 nt, Homo sapiens
uaaacuaaaaaaaaaaaggccg

SEQ ID NO: 1235339 - RNA, 18 nt, Homo sapiens
uaaacucaagacaaugca

SEQ ID NO: 1235340 - RNA, 16 nt, Homo sapiens
uaaacugguacaauuu

SEQ ID NO: 1235341 - RNA, 12 nt, Homo sapiens
uaaacuguguau

SEQ ID NO: 1235342 - RNA, 18 nt, Homo sapiens
uaaacuguuagcacuguu

SEQ ID NO: 1235343 - RNA, 23 nt, Homo sapiens
uaaacuguuagcacuguugaugu

SEQ ID NO: 1235344 - RNA, 15 nt, Homo sapiens
uaaacuuaacuuuaa

SEQ ID NO: 1235345 - RNA, 17 nt, Homo sapiens
uaaacuuuauuuguaaa

SEQ ID NO: 1235346 - RNA, 12 nt, Homo sapiens
uaaacuuuuuga

SEQ ID NO: 1235347 - RNA, 23 nt, Homo sapiens
uaaacuuuuuuucuguaccaguu

SEQ ID NO: 1235348 - RNA, 17 nt, Homo sapiens
guguguauuuguauuaa

SEQ ID NO: 1235349 - RNA, 12 nt, Homo sapiens
guguguccaaaa

SEQ ID NO: 1235350 - RNA, 22 nt, Homo sapiens
gugugugcacguacacacacau

SEQ ID NO: 1235351 - RNA, 18 nt, Homo sapiens
guguuaagcguucaguga

SEQ ID NO: 1235352 - RNA, 16 nt, Homo sapiens
guguuacuguugcacu

SEQ ID NO: 1235353 - RNA, 21 nt, Homo sapiens
guguuauuguauuagguguca

SEQ ID NO: 1235354 - RNA, 14 nt, Homo sapiens
guguuauuugcaca

SEQ ID NO: 1235355 - RNA, 18 nt, Homo sapiens
guguucuucaagccagcu

SEQ ID NO: 1235356 - RNA, 20 nt, Homo sapiens
guguugggaaaaaggccucu

SEQ ID NO: 1235357 - RNA, 17 nt, Homo sapiens
guguuggggaaaccuuc

SEQ ID NO: 1235358 - RNA, 23 nt, Homo sapiens
guguuggggaaaccuucaucuga

SEQ ID NO: 1235359 - RNA, 22 nt, Homo sapiens
guguuguaucaaagugugauau

SEQ ID NO: 1235360 - RNA, 16 nt, Homo sapiens
guguuuacagacagaa

SEQ ID NO: 1235361 - RNA, 19 nt, Homo sapiens
guguuucuauugacuucaa

SEQ ID NO: 1235362 - RNA, 21 nt, Homo sapiens
guguuuggaaauaaacugugc

SEQ ID NO: 1235363 - RNA, 19 nt, Homo sapiens
guguuugggaugaccagga

SEQ ID NO: 1235364 - RNA, 13 nt, Homo sapiens
guguuugugcuga

SEQ ID NO: 1235365 - RNA, 17 nt, Homo sapiens
guuaaaaauauuuucug

SEQ ID NO: 1235366 - RNA, 20 nt, Homo sapiens
guuaaaaguuguguuuugaa

SEQ ID NO: 1235367 - RNA, 20 nt, Homo sapiens
guuaaaauuaugaaucugau

SEQ ID NO: 1235368 - RNA, 19 nt, Homo sapiens
guuaaacccacagccaaac

SEQ ID NO: 1235369 - RNA, 19 nt, Homo sapiens
guuaaacuguuagcacugu

SEQ ID NO: 1235370 - RNA, 18 nt, Homo sapiens
guuaaagacagucauaua

SEQ ID NO: 1235371 - RNA, 18 nt, Homo sapiens
guuaaaugaaauuguaaa

SEQ ID NO: 1235372 - RNA, 15 nt, Homo sapiens
guuaaauguuuacaa

SEQ ID NO: 1235373 - RNA, 16 nt, Homo sapiens
guuaaccucaguguca

SEQ ID NO: 1235374 - RNA, 21 nt, Homo sapiens
guuaacgcacuuggaguaauu

SEQ ID NO: 1235375 - RNA, 13 nt, Homo sapiens
guuaauaacucuc

SEQ ID NO: 1235376 - RNA, 17 nt, Homo sapiens
guuaauauugugcaaac

SEQ ID NO: 1235377 - RNA, 21 nt, Homo sapiens
guuaaucauccaucacuuccc

SEQ ID NO: 1235378 - RNA, 16 nt, Homo sapiens
guuaauuauuuugaca

SEQ ID NO: 1235379 - RNA, 19 nt, Homo sapiens
guuaauuuugaagugcugu

SEQ ID NO: 1235380 - RNA, 22 nt, Homo sapiens
guuaauuuuuccuauauugcau

SEQ ID NO: 1235381 - RNA, 21 nt, Homo sapiens
guuacaaaguaauuucuuuga

SEQ ID NO: 1235382 - RNA, 22 nt, Homo sapiens
guuacauaagauaaaugugcug

SEQ ID NO: 1235383 - RNA, 14 nt, Homo sapiens
auuccuguuuccau

SEQ ID NO: 1235384 - RNA, 13 nt, Homo sapiens
auuccuucacuca

SEQ ID NO: 1235385 - RNA, 16 nt, Homo sapiens
auuccuucucugaaca

SEQ ID NO: 1235386 - RNA, 22 nt, Homo sapiens
auucgcccuccucccugucaua

SEQ ID NO: 1235387 - RNA, 15 nt, Homo sapiens
auucggauuugccau

SEQ ID NO: 1235388 - RNA, 16 nt, Homo sapiens
auucgggccacagggc

SEQ ID NO: 1235389 - RNA, 20 nt, Homo sapiens
auucgugcauuuuuggauca

SEQ ID NO: 1235390 - RNA, 14 nt, Homo sapiens
auucuaagcccuuu

SEQ ID NO: 1235391 - RNA, 13 nt, Homo sapiens
auucuaagugaaa

SEQ ID NO: 1235392 - RNA, 18 nt, Homo sapiens
auucuaauggggacacag

SEQ ID NO: 1235393 - RNA, 14 nt, Homo sapiens
auucuaauuugcau

SEQ ID NO: 1235394 - RNA, 18 nt, Homo sapiens
auucuaccugaggccagg

SEQ ID NO: 1235395 - RNA, 16 nt, Homo sapiens
auucuacuagcaggca

SEQ ID NO: 1235396 - RNA, 18 nt, Homo sapiens
auucuacuagcaggcaau

SEQ ID NO: 1235397 - RNA, 16 nt, Homo sapiens
auucuagagccagcug

SEQ ID NO: 1235398 - RNA, 16 nt, Homo sapiens
auucuaucaagcccag

SEQ ID NO: 1235399 - RNA, 22 nt, Homo sapiens
auucuauccccaaucagcuccu

SEQ ID NO: 1235400 - RNA, 21 nt, Homo sapiens
auucuauuacauuuucaguga

SEQ ID NO: 1235401 - RNA, 20 nt, Homo sapiens
auucuauuucugcugugauu

SEQ ID NO: 1235402 - RNA, 16 nt, Homo sapiens
auucucaaagcaggaa

SEQ ID NO: 1235403 - RNA, 14 nt, Homo sapiens
auucucacuccuac

SEQ ID NO: 1235404 - RNA, 17 nt, Homo sapiens
auucucauuugucacac

SEQ ID NO: 1235405 - RNA, 15 nt, Homo sapiens
auucuccugccucac

SEQ ID NO: 1235406 - RNA, 11 nt, Homo sapiens
auucugaccau

SEQ ID NO: 1235407 - RNA, 19 nt, Homo sapiens
auucugauuuuacauguaa

SEQ ID NO: 1235408 - RNA, 19 nt, Homo sapiens
auucugccaaaccugugua

SEQ ID NO: 1235409 - RNA, 18 nt, Homo sapiens
auucugccacuccugaca

SEQ ID NO: 1235410 - RNA, 21 nt, Homo sapiens
auucugccgcccccuccugaa

SEQ ID NO: 1235411 - RNA, 14 nt, Homo sapiens
auucugcuaccaau

SEQ ID NO: 1235412 - RNA, 22 nt, Homo sapiens
auucuggaaaagcaaaacugua

SEQ ID NO: 1235413 - RNA, 14 nt, Homo sapiens
auucugggaaucca

SEQ ID NO: 1235414 - RNA, 15 nt, Homo sapiens
auucuguauugccau

SEQ ID NO: 1235415 - RNA, 15 nt, Homo sapiens
auucugugaccaaaa

SEQ ID NO: 1235416 - RNA, 16 nt, Homo sapiens
auucuuaaccaagaaa

SEQ ID NO: 1235417 - RNA, 22 nt, Homo sapiens
auucuuaaccuggaacuggagu

SEQ ID NO: 1235418 - RNA, 19 nt, Homo sapiens
auucuuaagggaacuucca

SEQ ID NO: 1235419 - RNA, 22 nt, Homo sapiens
auucuuauuaguuccccaaaua

SEQ ID NO: 1235420 - RNA, 14 nt, Homo sapiens
auucuucaaccagu

SEQ ID NO: 1235421 - RNA, 16 nt, Homo sapiens
auucuugaaguucaug

SEQ ID NO: 1235422 - RNA, 15 nt, Homo sapiens
auucuugaguucugg

SEQ ID NO: 1235423 - RNA, 15 nt, Homo sapiens
auucuuguaguuuac

SEQ ID NO: 1235424 - RNA, 20 nt, Homo sapiens
auucuuguaguuuaccucuu

SEQ ID NO: 1235425 - RNA, 17 nt, Homo sapiens
auucuuuggaguuguca

SEQ ID NO: 1235426 - RNA, 15 nt, Homo sapiens
auucuuuguuuccug

SEQ ID NO: 1235427 - RNA, 16 nt, Homo sapiens
auucuuuucucagugu

SEQ ID NO: 1235428 - RNA, 14 nt, Homo sapiens
auugaaaauaugau

SEQ ID NO: 1235429 - RNA, 16 nt, Homo sapiens
auugaaagaaccagag

SEQ ID NO: 1235430 - RNA, 17 nt, Homo sapiens
auugaaagcuuuuguua

SEQ ID NO: 1235431 - RNA, 12 nt, Homo sapiens
auugaagcagau

SEQ ID NO: 1235432 - RNA, 14 nt, Homo sapiens
auugaauaggauca

SEQ ID NO: 1235433 - RNA, 12 nt, Homo sapiens
auugaaugcgcu

SEQ ID NO: 1235434 - RNA, 15 nt, Homo sapiens
auugaaugcgcuuua

SEQ ID NO: 1235435 - RNA, 14 nt, Homo sapiens
auugaaugugauuu

SEQ ID NO: 1235436 - RNA, 21 nt, Homo sapiens
auugacaucucuuuugagcua

SEQ ID NO: 1235437 - RNA, 20 nt, Homo sapiens
caaaagaggagcacuuccaa

SEQ ID NO: 1235438 - RNA, 22 nt, Homo sapiens
caaaagaggagcacuuccaaaa

SEQ ID NO: 1235439 - RNA, 22 nt, Homo sapiens
caaaagauacggcccaugcaau

SEQ ID NO: 1235440 - RNA, 18 nt, Homo sapiens
caaaagaugccauucaua

SEQ ID NO: 1235441 - RNA, 14 nt, Homo sapiens
caaaaggaccccaa

SEQ ID NO: 1235442 - RNA, 21 nt, Homo sapiens
caaaagucaccacuccauucc

SEQ ID NO: 1235443 - RNA, 23 nt, Homo sapiens
caaaagucaccacuccauuccca

SEQ ID NO: 1235444 - RNA, 16 nt, Homo sapiens
caaaauaaacuccccu

SEQ ID NO: 1235445 - RNA, 21 nt, Homo sapiens
caaaauaaugcaccacuuuua

SEQ ID NO: 1235446 - RNA, 19 nt, Homo sapiens
caaaauaggauuucuuaaa

SEQ ID NO: 1235447 - RNA, 17 nt, Homo sapiens
caaaauauuuuuugcaa

SEQ ID NO: 1235448 - RNA, 14 nt, Homo sapiens
caaaauccaaggca

SEQ ID NO: 1235449 - RNA, 18 nt, Homo sapiens
caaaaugacaaugaugau

SEQ ID NO: 1235450 - RNA, 14 nt, Homo sapiens
caaaaugguuuauu

SEQ ID NO: 1235451 - RNA, 17 nt, Homo sapiens
caaaauguaaagccagc

SEQ ID NO: 1235452 - RNA, 17 nt, Homo sapiens
caaaauuacacaguuaa

SEQ ID NO: 1235453 - RNA, 18 nt, Homo sapiens
caaaauuacacaguuaau

SEQ ID NO: 1235454 - RNA, 21 nt, Homo sapiens
caaaauuaucagugcucugcu

SEQ ID NO: 1235455 - RNA, 13 nt, Homo sapiens
caaaauucauuca

SEQ ID NO: 1235456 - RNA, 18 nt, Homo sapiens
caaaauucuuaaguaugu

SEQ ID NO: 1235457 - RNA, 19 nt, Homo sapiens
caaaauugcaaaucuugaa

SEQ ID NO: 1235458 - RNA, 20 nt, Homo sapiens
caaaauuugaugccaggaca

SEQ ID NO: 1235459 - RNA, 18 nt, Homo sapiens
caaacacaaaaaucauua

SEQ ID NO: 1235460 - RNA, 13 nt, Homo sapiens
caaacaccuucca

SEQ ID NO: 1235461 - RNA, 17 nt, Homo sapiens
caaacagaacaggguca

SEQ ID NO: 1235462 - RNA, 17 nt, Homo sapiens
caaaccacaauacuucc

SEQ ID NO: 1235463 - RNA, 21 nt, Homo sapiens
caaaccaggauuuccuugacu

SEQ ID NO: 1235464 - RNA, 20 nt, Homo sapiens
caaaccaugagaauuugcaa

SEQ ID NO: 1235465 - RNA, 21 nt, Homo sapiens
caaacccacgauuuucuccag

SEQ ID NO: 1235466 - RNA, 19 nt, Homo sapiens
caaacccagacaaccaaaa

SEQ ID NO: 1235467 - RNA, 20 nt, Homo sapiens
caaacccuagccuugcuugu

SEQ ID NO: 1235468 - RNA, 17 nt, Homo sapiens
caaacccuggugguauu

SEQ ID NO: 1235469 - RNA, 14 nt, Homo sapiens
caaaccuccacugc

SEQ ID NO: 1235470 - RNA, 22 nt, Homo sapiens
caaaccuucugccuuugauguu

SEQ ID NO: 1235471 - RNA, 13 nt, Homo sapiens
caaacgcugaaaa

SEQ ID NO: 1235472 - RNA, 19 nt, Homo sapiens
caaacguuuugaacuaaua

SEQ ID NO: 1235473 - RNA, 14 nt, Homo sapiens
caaacuacauguaa

SEQ ID NO: 1235474 - RNA, 18 nt, Homo sapiens
caaacucaacaagugcuc

SEQ ID NO: 1235475 - RNA, 19 nt, Homo sapiens
caaacucaccuugucucau

SEQ ID NO: 1235476 - RNA, 12 nt, Homo sapiens
caaacucagugc

SEQ ID NO: 1235477 - RNA, 23 nt, Homo sapiens
caaacucccuagucuccaccuga

SEQ ID NO: 1235478 - RNA, 13 nt, Homo sapiens
caaacuccugacc

SEQ ID NO: 1235479 - RNA, 21 nt, Homo sapiens
caaacugcuuuuuccaacuca

SEQ ID NO: 1235480 - RNA, 18 nt, Homo sapiens
caaacugugaagcauuua

SEQ ID NO: 1235481 - RNA, 19 nt, Homo sapiens
caaacugugaagcauuuac

SEQ ID NO: 1235482 - RNA, 14 nt, Homo sapiens
caaacuguguacau

SEQ ID NO: 1235483 - RNA, 21 nt, Homo sapiens
caaacuuaagaaacacugacu

SEQ ID NO: 1235484 - RNA, 14 nt, Homo sapiens
caaacuucccugac

SEQ ID NO: 1235485 - RNA, 21 nt, Homo sapiens
caaacuucccugacucuucaa

SEQ ID NO: 1235486 - RNA, 14 nt, Homo sapiens
caaacuugcuuuau

SEQ ID NO: 1235487 - RNA, 15 nt, Homo sapiens
caaacuuucacuuug

SEQ ID NO: 1235488 - RNA, 20 nt, Homo sapiens
caaacuuuuuuauaucuuuu

SEQ ID NO: 1235489 - RNA, 13 nt, Homo sapiens
caaagaagccagc

SEQ ID NO: 1235490 - RNA, 13 nt, Homo sapiens
caaagaagguguu

SEQ ID NO: 1235491 - RNA, 14 nt, Homo sapiens
caaagaaugggcuu

SEQ ID NO: 1235492 - RNA, 18 nt, Homo sapiens
caaagaaugggcuugaaa

SEQ ID NO: 1235493 - RNA, 20 nt, Homo sapiens
caaagaauuacaguacacau

SEQ ID NO: 1235494 - RNA, 15 nt, Homo sapiens
caaagacacagacuu

SEQ ID NO: 1235495 - RNA, 18 nt, Homo sapiens
caaagacaucagucucca

SEQ ID NO: 1235496 - RNA, 11 nt, Homo sapiens
caaagacugua

SEQ ID NO: 1235497 - RNA, 14 nt, Homo sapiens
caaagacuguaaau

SEQ ID NO: 1235498 - RNA, 14 nt, Homo sapiens
caaagacuguacug

SEQ ID NO: 1235499 - RNA, 13 nt, Homo sapiens
caaagacuguauu

SEQ ID NO: 1235500 - RNA, 15 nt, Homo sapiens
caaagacuuaacugg

SEQ ID NO: 1235501 - RNA, 19 nt, Homo sapiens
caaagagaaaucacagggg

SEQ ID NO: 1235502 - RNA, 15 nt, Homo sapiens
caaagagaaugccau

SEQ ID NO: 1235503 - RNA, 16 nt, Homo sapiens
caaagagaaugccauu

SEQ ID NO: 1235504 - RNA, 13 nt, Homo sapiens
caaagaggcugcc

SEQ ID NO: 1235505 - RNA, 19 nt, Homo sapiens
caaagaguauauguucccu

SEQ ID NO: 1235506 - RNA, 21 nt, Homo sapiens
caaagaguauguuguaagaaa

SEQ ID NO: 1235507 - RNA, 22 nt, Homo sapiens
caaagaguauguuguaagaaag

SEQ ID NO: 1235508 - RNA, 18 nt, Homo sapiens
caaagaucaccagccaug

SEQ ID NO: 1235509 - RNA, 16 nt, Homo sapiens
caaagauuaaaugugu

SEQ ID NO: 1235510 - RNA, 22 nt, Homo sapiens
caaagauuuuggaggagaagga

SEQ ID NO: 1235511 - RNA, 21 nt, Homo sapiens
caaagcaaguuucaucaguca

SEQ ID NO: 1235512 - RNA, 11 nt, Homo sapiens
caaagcacuug

SEQ ID NO: 1235513 - RNA, 22 nt, Homo sapiens
caaagcaggaauugguggcaga

SEQ ID NO: 1235514 - RNA, 16 nt, Homo sapiens
caaagcaggauuauua

SEQ ID NO: 1235515 - RNA, 20 nt, Homo sapiens
caaagcaguguugguugcuu

SEQ ID NO: 1235516 - RNA, 10 nt, Homo sapiens
caaagccaaa

SEQ ID NO: 1235517 - RNA, 20 nt, Homo sapiens
caaagccacccuaccaugaa

SEQ ID NO: 1235518 - RNA, 21 nt, Homo sapiens
caaagccacccuaccaugaau

SEQ ID NO: 1235519 - RNA, 15 nt, Homo sapiens
caaagccuuuccaga

SEQ ID NO: 1235520 - RNA, 20 nt, Homo sapiens
caaagcgagaucccaucucu

SEQ ID NO: 1235521 - RNA, 21 nt, Homo sapiens
caaagcgguuuaaccacauua

SEQ ID NO: 1235522 - RNA, 22 nt, Homo sapiens
caaagcguuucuuuacuucuca

SEQ ID NO: 1235523 - RNA, 15 nt, Homo sapiens
caaagcuuuccugcc

SEQ ID NO: 1235524 - RNA, 19 nt, Homo sapiens
caaaggaaaaagcacaaga

SEQ ID NO: 1235525 - RNA, 16 nt, Homo sapiens
caaaggaagacuugaa

SEQ ID NO: 1235526 - RNA, 18 nt, Homo sapiens
caaaggacagaguaugaa

SEQ ID NO: 1235527 - RNA, 19 nt, Homo sapiens
caaaggagaaaaaaaaccu

SEQ ID NO: 1235528 - RNA, 15 nt, Homo sapiens
caaaggcacugaggc

SEQ ID NO: 1235529 - RNA, 17 nt, Homo sapiens
caaagggccagcagucu

SEQ ID NO: 1235530 - RNA, 18 nt, Homo sapiens
caaagggccaucguucau

SEQ ID NO: 1235531 - RNA, 17 nt, Homo sapiens
caaaguaaauucuuagc

SEQ ID NO: 1235532 - RNA, 15 nt, Homo sapiens
caaaguagaagucuu

SEQ ID NO: 1235533 - RNA, 22 nt, Homo sapiens
caaaguagggaugcggauccug

SEQ ID NO: 1235534 - RNA, 14 nt, Homo sapiens
caaaguauuugcug

SEQ ID NO: 1235535 - RNA, 18 nt, Homo sapiens
caaaguccuuuuuuucca

SEQ ID NO: 1235536 - RNA, 18 nt, Homo sapiens
caaagucugcaacuuuaa

SEQ ID NO: 1235537 - RNA, 16 nt, Homo sapiens
caaagugacuauucag

SEQ ID NO: 1235538 - RNA, 20 nt, Homo sapiens
caaagugacuguuuggcuua

SEQ ID NO: 1235539 - RNA, 18 nt, Homo sapiens
caaagugcugagauuaca

SEQ ID NO: 1235540 - RNA, 19 nt, Homo sapiens
caaagugcugagauuacag

SEQ ID NO: 1235541 - RNA, 19 nt, Homo sapiens
caaagugcuggaauuacag

SEQ ID NO: 1235542 - RNA, 17 nt, Homo sapiens
caaagugugauauacaa

SEQ ID NO: 1235543 - RNA, 16 nt, Homo sapiens
caaaguuaauucaccu

SEQ ID NO: 1235544 - RNA, 20 nt, Homo sapiens
caaaguuugcucaaggagaa

SEQ ID NO: 1235545 - RNA, 14 nt, Homo sapiens
caaauaaaaaccca

SEQ ID NO: 1235546 - RNA, 15 nt, Homo sapiens
caaauaaaaacccaa

SEQ ID NO: 1235547 - RNA, 22 nt, Homo sapiens
caaauaaaacuagugacagcuu

SEQ ID NO: 1235548 - RNA, 12 nt, Homo sapiens
caaauaaacuca

SEQ ID NO: 1235549 - RNA, 17 nt, Homo sapiens
caaauaaacucuaaaca

SEQ ID NO: 1235550 - RNA, 18 nt, Homo sapiens
caaauaaagugcaguuua

SEQ ID NO: 1235551 - RNA, 22 nt, Homo sapiens
caaauaaauaagaucagacucu

SEQ ID NO: 1235552 - RNA, 14 nt, Homo sapiens
caaauaaaugacaa

SEQ ID NO: 1235553 - RNA, 13 nt, Homo sapiens
caaauaacagucu

SEQ ID NO: 1235554 - RNA, 13 nt, Homo sapiens
caaauaauagcaa

SEQ ID NO: 1235555 - RNA, 14 nt, Homo sapiens
caaauaauagcaau

SEQ ID NO: 1235556 - RNA, 14 nt, Homo sapiens
caaauacacauuuc

SEQ ID NO: 1235557 - RNA, 16 nt, Homo sapiens
caaauacacauuugcu

SEQ ID NO: 1235558 - RNA, 18 nt, Homo sapiens
caaauauaaaucuuaaaa

SEQ ID NO: 1235559 - RNA, 18 nt, Homo sapiens
caaauauaucugcuauuc

SEQ ID NO: 1235560 - RNA, 22 nt, Homo sapiens
caaauaucauacuguucaaugg

SEQ ID NO: 1235561 - RNA, 20 nt, Homo sapiens
caaaucagaccuggcugcuu

SEQ ID NO: 1235562 - RNA, 22 nt, Homo sapiens
caaaucagaggugcaggccacc

SEQ ID NO: 1235563 - RNA, 22 nt, Homo sapiens
caaaucguccagcgaccuuccu

SEQ ID NO: 1235564 - RNA, 22 nt, Homo sapiens
auuaauuuuccaaugcacaguu

SEQ ID NO: 1235565 - RNA, 22 nt, Homo sapiens
auuaauuuuuaaggauguugcc

SEQ ID NO: 1235566 - RNA, 23 nt, Homo sapiens
auuaauuuuuaaggauguugcca

SEQ ID NO: 1235567 - RNA, 13 nt, Homo sapiens
auuacaagcccug

SEQ ID NO: 1235568 - RNA, 17 nt, Homo sapiens
auuacaagccuacauga

SEQ ID NO: 1235569 - RNA, 23 nt, Homo sapiens
auuacaagcgugagccacugcac

SEQ ID NO: 1235570 - RNA, 19 nt, Homo sapiens
auuacaauuuguauuacuu

SEQ ID NO: 1235571 - RNA, 21 nt, Homo sapiens
auuacaggagggaacauuucc

SEQ ID NO: 1235572 - RNA, 21 nt, Homo sapiens
auuacaggcgugauccaccac

SEQ ID NO: 1235573 - RNA, 23 nt, Homo sapiens
auuacaggugugugccaccacac

SEQ ID NO: 1235574 - RNA, 14 nt, Homo sapiens
auuacauacagauu

SEQ ID NO: 1235575 - RNA, 18 nt, Homo sapiens
auuacauggggucuagaa

SEQ ID NO: 1235576 - RNA, 21 nt, Homo sapiens
auuaccaaccuguuaccuacu

SEQ ID NO: 1235577 - RNA, 19 nt, Homo sapiens
auuacccccuccuucagac

SEQ ID NO: 1235578 - RNA, 21 nt, Homo sapiens
auuaccucaaauuccuaauaa

SEQ ID NO: 1235579 - RNA, 15 nt, Homo sapiens
auuaccucucuugcu

SEQ ID NO: 1235580 - RNA, 19 nt, Homo sapiens
auuacggacucuggauauu

SEQ ID NO: 1235581 - RNA, 23 nt, Homo sapiens
auuacuacuuaccauuugcuacu

SEQ ID NO: 1235582 - RNA, 11 nt, Homo sapiens
auuacuuugau

SEQ ID NO: 1235583 - RNA, 21 nt, Homo sapiens
auuacuuugauaucugaucaa

SEQ ID NO: 1235584 - RNA, 24 nt, Homo sapiens
auuagaagacaacaggcauagcaa

SEQ ID NO: 1235585 - RNA, 17 nt, Homo sapiens
auuagaaggcaaguuuc

SEQ ID NO: 1235586 - RNA, 17 nt, Homo sapiens
auuagagaagcugaaag

SEQ ID NO: 1235587 - RNA, 15 nt, Homo sapiens
auuagaugcacuuaa

SEQ ID NO: 1235588 - RNA, 21 nt, Homo sapiens
auuagcauaauuuuguguugu

SEQ ID NO: 1235589 - RNA, 23 nt, Homo sapiens
auuagcauggccccaguccaugc

SEQ ID NO: 1235590 - RNA, 17 nt, Homo sapiens
auuagcuggcgcauauu

SEQ ID NO: 1235591 - RNA, 15 nt, Homo sapiens
auuagcuuuuucuca

SEQ ID NO: 1235592 - RNA, 18 nt, Homo sapiens
auuaggauuuugauguga

SEQ ID NO: 1235593 - RNA, 23 nt, Homo sapiens
auuaggcuuuuaagaaacacagg

SEQ ID NO: 1235594 - RNA, 15 nt, Homo sapiens
auuauaaaggccagc

SEQ ID NO: 1235595 - RNA, 22 nt, Homo sapiens
auuauaaauaaauagauguguc

SEQ ID NO: 1235596 - RNA, 13 nt, Homo sapiens
auuauaaucaaaa

SEQ ID NO: 1235597 - RNA, 24 nt, Homo sapiens
auuauacgcuggcaacacagaggc

SEQ ID NO: 1235598 - RNA, 15 nt, Homo sapiens
auuauacuacaauaa

SEQ ID NO: 1235599 - RNA, 16 nt, Homo sapiens
auuauauuagucuguu

SEQ ID NO: 1235600 - RNA, 23 nt, Homo sapiens
auuauauuugugugaaaauguga

SEQ ID NO: 1235601 - RNA, 16 nt, Homo sapiens
auuaucacgcagauca

SEQ ID NO: 1235602 - RNA, 17 nt, Homo sapiens
auuaucacgcagaucac

SEQ ID NO: 1235603 - RNA, 23 nt, Homo sapiens
auuaugagcuuucuuugcacuua

SEQ ID NO: 1235604 - RNA, 17 nt, Homo sapiens
auuaugauugcauugua

SEQ ID NO: 1235605 - RNA, 16 nt, Homo sapiens
auuaugcagacaaccu

SEQ ID NO: 1235606 - RNA, 21 nt, Homo sapiens
auuauggaaaacuguguugcc

SEQ ID NO: 1235607 - RNA, 11 nt, Homo sapiens
auuauggcauu

SEQ ID NO: 1235608 - RNA, 15 nt, Homo sapiens
auuauguauguuuac

SEQ ID NO: 1235609 - RNA, 20 nt, Homo sapiens
auuaugucucuucugagcua

SEQ ID NO: 1235610 - RNA, 14 nt, Homo sapiens
auuauguuuccuaa

SEQ ID NO: 1235611 - RNA, 21 nt, Homo sapiens
auuauucugauuccacuuuua

SEQ ID NO: 1235612 - RNA, 22 nt, Homo sapiens
auuauucuuguaguuuaccucu

SEQ ID NO: 1235613 - RNA, 17 nt, Homo sapiens
auuauuggacagucuca

SEQ ID NO: 1235614 - RNA, 20 nt, Homo sapiens
auuauugucaaagaagucau

SEQ ID NO: 1235615 - RNA, 15 nt, Homo sapiens
auuauuuaauaacau

SEQ ID NO: 1235616 - RNA, 15 nt, Homo sapiens
auguaucucacaagu

SEQ ID NO: 1235617 - RNA, 12 nt, Homo sapiens
auguaucucagg

SEQ ID NO: 1235618 - RNA, 14 nt, Homo sapiens
auguaucucaggaa

SEQ ID NO: 1235619 - RNA, 17 nt, Homo sapiens
auguaucugaguugcca

SEQ ID NO: 1235620 - RNA, 21 nt, Homo sapiens
auguauggaaucccacuguau

SEQ ID NO: 1235621 - RNA, 19 nt, Homo sapiens
auguauuacaaauggugaa

SEQ ID NO: 1235622 - RNA, 18 nt, Homo sapiens
auguauuuucaguuacaa

SEQ ID NO: 1235623 - RNA, 14 nt, Homo sapiens
augucaaagcuuug

SEQ ID NO: 1235624 - RNA, 20 nt, Homo sapiens
augucaacagagcaaggaga

SEQ ID NO: 1235625 - RNA, 16 nt, Homo sapiens
augucaacagccauaa

SEQ ID NO: 1235626 - RNA, 18 nt, Homo sapiens
augucacaaccucucuga

SEQ ID NO: 1235627 - RNA, 19 nt, Homo sapiens
augucagacagaacuugaa

SEQ ID NO: 1235628 - RNA, 19 nt, Homo sapiens
augucagaguagaagauuu

SEQ ID NO: 1235629 - RNA, 21 nt, Homo sapiens
augucaggcaaagugcugcug

SEQ ID NO: 1235630 - RNA, 14 nt, Homo sapiens
augucaguacuauu

SEQ ID NO: 1235631 - RNA, 21 nt, Homo sapiens
augucaucaaauauuaccaaa

SEQ ID NO: 1235632 - RNA, 14 nt, Homo sapiens
augucaugucugug

SEQ ID NO: 1235633 - RNA, 20 nt, Homo sapiens
auguccccaaaguaccacac

SEQ ID NO: 1235634 - RNA, 17 nt, Homo sapiens
auguccuuuuaugauuu

SEQ ID NO: 1235635 - RNA, 15 nt, Homo sapiens
augucgaugcacagu

SEQ ID NO: 1235636 - RNA, 19 nt, Homo sapiens
augucgaugcacaguaucu

SEQ ID NO: 1235637 - RNA, 17 nt, Homo sapiens
augucuauauguuuauu

SEQ ID NO: 1235638 - RNA, 15 nt, Homo sapiens
augucuauucagcuu

SEQ ID NO: 1235639 - RNA, 21 nt, Homo sapiens
augucucuuugugcucuaaaa

SEQ ID NO: 1235640 - RNA, 20 nt, Homo sapiens
augucugcaaagugauucac

SEQ ID NO: 1235641 - RNA, 16 nt, Homo sapiens
augucuguuaacuuaa

SEQ ID NO: 1235642 - RNA, 19 nt, Homo sapiens
augucuguucuacauagau

SEQ ID NO: 1235643 - RNA, 18 nt, Homo sapiens
augucuuuuaagaaacau

SEQ ID NO: 1235644 - RNA, 22 nt, Homo sapiens
augucuuuuacccggcacauuc

SEQ ID NO: 1235645 - RNA, 14 nt, Homo sapiens
augugaaacacuuu

SEQ ID NO: 1235646 - RNA, 12 nt, Homo sapiens
augugaagacaa

SEQ ID NO: 1235647 - RNA, 19 nt, Homo sapiens
augugacaaagggccagca

SEQ ID NO: 1235648 - RNA, 19 nt, Homo sapiens
augugacacugcagcagaa

SEQ ID NO: 1235649 - RNA, 13 nt, Homo sapiens
augugacuacuga

SEQ ID NO: 1235650 - RNA, 15 nt, Homo sapiens
augugacuggcagua

SEQ ID NO: 1235651 - RNA, 19 nt, Homo sapiens
augugagcucuuccuaucc

SEQ ID NO: 1235652 - RNA, 21 nt, Homo sapiens
augugagcucuuccuaucccu

SEQ ID NO: 1235653 - RNA, 22 nt, Homo sapiens
augugauggauggcacaaugaa

SEQ ID NO: 1235654 - RNA, 15 nt, Homo sapiens
augugauguucuaag

SEQ ID NO: 1235655 - RNA, 17 nt, Homo sapiens
augugauuuacauuuca

SEQ ID NO: 1235656 - RNA, 22 nt, Homo sapiens
augugauuuggaccauggcacu

SEQ ID NO: 1235657 - RNA, 21 nt, Homo sapiens
augugcacucauacauaugua

SEQ ID NO: 1235658 - RNA, 16 nt, Homo sapiens
augugcaguacuuaau

SEQ ID NO: 1235659 - RNA, 13 nt, Homo sapiens
augugcauuucac

SEQ ID NO: 1235660 - RNA, 19 nt, Homo sapiens
augugcuauacacacacac

SEQ ID NO: 1235661 - RNA, 15 nt, Homo sapiens
augugcuaugaagcu

SEQ ID NO: 1235662 - RNA, 16 nt, Homo sapiens
augugcucaugcauug

SEQ ID NO: 1235663 - RNA, 22 nt, Homo sapiens
augugcugaaugguuuucaaaa

SEQ ID NO: 1235664 - RNA, 13 nt, Homo sapiens
augugcuggucac

SEQ ID NO: 1235665 - RNA, 21 nt, Homo sapiens
auguggagcucagcaacaagg

SEQ ID NO: 1235666 - RNA, 19 nt, Homo sapiens
auguggcccucuggaucca

SEQ ID NO: 1235667 - RNA, 17 nt, Homo sapiens
auguggccugcauguac

SEQ ID NO: 1235668 - RNA, 20 nt, Homo sapiens
auguggcuggaagauccugc

SEQ ID NO: 1235669 - RNA, 21 nt, Homo sapiens
augugggguccccaucauccc

SEQ ID NO: 1235670 - RNA, 22 nt, Homo sapiens
augugggguccccaucauccca

SEQ ID NO: 1235671 - RNA, 21 nt, Homo sapiens
auguggguagucauucuuaca

SEQ ID NO: 1235672 - RNA, 18 nt, Homo sapiens
auguguagccugugcaug

SEQ ID NO: 1235673 - RNA, 19 nt, Homo sapiens
auguguauguacguuugua

SEQ ID NO: 1235674 - RNA, 21 nt, Homo sapiens
auguguccccucacucuguca

SEQ ID NO: 1235675 - RNA, 23 nt, Homo sapiens
auguguggaaguuauuaacuuua

SEQ ID NO: 1235676 - RNA, 14 nt, Homo sapiens
auguguggacucaa

SEQ ID NO: 1235677 - RNA, 21 nt, Homo sapiens
auguguggcucagugccugga

SEQ ID NO: 1235678 - RNA, 20 nt, Homo sapiens
augugugguggccucagcug

SEQ ID NO: 1235679 - RNA, 13 nt, Homo sapiens
auguuaacacuca

SEQ ID NO: 1235680 - RNA, 22 nt, Homo sapiens
auguuaacacucaugaagcaua

SEQ ID NO: 1235681 - RNA, 18 nt, Homo sapiens
auguuaagcucuuuauga

SEQ ID NO: 1235682 - RNA, 19 nt, Homo sapiens
auguuaauauugugcaaac

SEQ ID NO: 1235683 - RNA, 12 nt, Homo sapiens
auguuauaucau

SEQ ID NO: 1235684 - RNA, 21 nt, Homo sapiens
auguuaucuucucaaguucua

SEQ ID NO: 1235685 - RNA, 16 nt, Homo sapiens
auguucacuguggcau

SEQ ID NO: 1235686 - RNA, 12 nt, Homo sapiens
auguucagucac

SEQ ID NO: 1235687 - RNA, 22 nt, Homo sapiens
auguucaguccaacaaaccaca

SEQ ID NO: 1235688 - RNA, 22 nt, Homo sapiens
auguuccccaggauucagcuau

SEQ ID NO: 1235689 - RNA, 19 nt, Homo sapiens
auguuccucugucaaugaa

SEQ ID NO: 1235690 - RNA, 15 nt, Homo sapiens
auguucuaacagauc

SEQ ID NO: 1235691 - RNA, 16 nt, Homo sapiens
auguucuaaguuucua

SEQ ID NO: 1235692 - RNA, 15 nt, Homo sapiens
auguucuauuguggg

SEQ ID NO: 1235693 - RNA, 14 nt, Homo sapiens
auguucugggacac

SEQ ID NO: 1235694 - RNA, 13 nt, Homo sapiens
auguucuuuggaa

SEQ ID NO: 1235695 - RNA, 17 nt, Homo sapiens
auguugaucuuucucaa

SEQ ID NO: 1235696 - RNA, 13 nt, Homo sapiens
auguugcaaagaa

SEQ ID NO: 1235697 - RNA, 23 nt, Homo sapiens
auguugcaaagaacuccagaguc

SEQ ID NO: 1235698 - RNA, 23 nt, Homo sapiens
auguugguguuccacguguuuua

SEQ ID NO: 1235699 - RNA, 16 nt, Homo sapiens
auguuguaaugcugca

SEQ ID NO: 1235700 - RNA, 22 nt, Homo sapiens
auguuguacaggcuggucucaa

SEQ ID NO: 1235701 - RNA, 22 nt, Homo sapiens
auguuguguggcaaugggauuu

SEQ ID NO: 1235702 - RNA, 22 nt, Homo sapiens
auguuuaaggaaaugugcagga

SEQ ID NO: 1235703 - RNA, 19 nt, Homo sapiens
auguuuauuuuucuugucu

SEQ ID NO: 1235704 - RNA, 21 nt, Homo sapiens
auguuucaagaaaauggauuu

SEQ ID NO: 1235705 - RNA, 12 nt, Homo sapiens
auguuucacugu

SEQ ID NO: 1235706 - RNA, 13 nt, Homo sapiens
auguuucuauucu

SEQ ID NO: 1235707 - RNA, 12 nt, Homo sapiens
auguuugcacac

SEQ ID NO: 1235708 - RNA, 17 nt, Homo sapiens
auguuugcuauugacaa

SEQ ID NO: 1235709 - RNA, 18 nt, Homo sapiens
auguuuggaauaaaguca

SEQ ID NO: 1235710 - RNA, 19 nt, Homo sapiens
auguuuggaauaaagucaa

SEQ ID NO: 1235711 - RNA, 13 nt, Homo sapiens
auguuuuugacuc

SEQ ID NO: 1235712 - RNA, 15 nt, Homo sapiens
auguuuuugacucuu

SEQ ID NO: 1235713 - RNA, 15 nt, Homo sapiens
auuaaaaaccugaug

SEQ ID NO: 1235714 - RNA, 20 nt, Homo sapiens
auuaaaaagaauucuuccac

SEQ ID NO: 1235715 - RNA, 22 nt, Homo sapiens
auuaaaacauauuucauuuuaa

SEQ ID NO: 1235716 - RNA, 12 nt, Homo sapiens
auuaaaacauua

SEQ ID NO: 1235717 - RNA, 17 nt, Homo sapiens
auuaaaacuaagcacaa

SEQ ID NO: 1235718 - RNA, 16 nt, Homo sapiens
auuaaaauaaaccaaa

SEQ ID NO: 1235719 - RNA, 18 nt, Homo sapiens
auuaaaaucacucucagu

SEQ ID NO: 1235720 - RNA, 22 nt, Homo sapiens
auuaaaaugucggauuuaucuu

SEQ ID NO: 1235721 - RNA, 18 nt, Homo sapiens
auuaaaauuccaaauuca

SEQ ID NO: 1235722 - RNA, 22 nt, Homo sapiens
auuaaaccugucuccacugugc

SEQ ID NO: 1235723 - RNA, 18 nt, Homo sapiens
auuaaaguuaauagaacu

SEQ ID NO: 1235724 - RNA, 17 nt, Homo sapiens
auuaaauucacaaacuu

SEQ ID NO: 1235725 - RNA, 13 nt, Homo sapiens
auuaacaaacauc

SEQ ID NO: 1235726 - RNA, 20 nt, Homo sapiens
auuaacaacaauaacacugu

SEQ ID NO: 1235727 - RNA, 16 nt, Homo sapiens
auuaaccaccaaucca

SEQ ID NO: 1235728 - RNA, 22 nt, Homo sapiens
auuaaccuuacuaauuauacua

SEQ ID NO: 1235729 - RNA, 20 nt, Homo sapiens
auuaacugcacaaacaauau

SEQ ID NO: 1235730 - RNA, 17 nt, Homo sapiens
auuaagacaacugaguu

SEQ ID NO: 1235731 - RNA, 18 nt, Homo sapiens
auuaagacuuuauguagu

SEQ ID NO: 1235732 - RNA, 19 nt, Homo sapiens
auuaagacuuuauguaguu

SEQ ID NO: 1235733 - RNA, 17 nt, Homo sapiens
auuaagucaugugugaa

SEQ ID NO: 1235734 - RNA, 17 nt, Homo sapiens
auuaauacucugcagug

SEQ ID NO: 1235735 - RNA, 19 nt, Homo sapiens
auuaauacucugcagugau

SEQ ID NO: 1235736 - RNA, 15 nt, Homo sapiens
auuaauaucauuuau

SEQ ID NO: 1235737 - RNA, 19 nt, Homo sapiens
auuaaucuuaguguaugau

SEQ ID NO: 1235738 - RNA, 23 nt, Homo sapiens
auuaauguuaauucagcacugau

SEQ ID NO: 1235739 - RNA, 14 nt, Homo sapiens
auuaauguuuucaa

SEQ ID NO: 1235740 - RNA, 14 nt, Homo sapiens
auuaauuacauaca

SEQ ID NO: 1235741 - RNA, 12 nt, Homo sapiens
auuaauuuccac

SEQ ID NO: 1235742 - RNA, 13 nt, Homo sapiens
auuaauuuccacu

SEQ ID NO: 1235743 - RNA, 14 nt, Homo sapiens
caaaucgugccuug

SEQ ID NO: 1235744 - RNA, 15 nt, Homo sapiens
caaaucgugccuugu

SEQ ID NO: 1235745 - RNA, 18 nt, Homo sapiens
caaaucuaccacuguaug

SEQ ID NO: 1235746 - RNA, 20 nt, Homo sapiens
caaaucucuuccacaugggu

SEQ ID NO: 1235747 - RNA, 16 nt, Homo sapiens
caaaucugacauauua

SEQ ID NO: 1235748 - RNA, 21 nt, Homo sapiens
caaaucuggguaucuuuccag

SEQ ID NO: 1235749 - RNA, 18 nt, Homo sapiens
caaaucuuggguggguga

SEQ ID NO: 1235750 - RNA, 14 nt, Homo sapiens
caaaugaaacuuua

SEQ ID NO: 1235751 - RNA, 14 nt, Homo sapiens
caaaugacaaaaag

SEQ ID NO: 1235752 - RNA, 23 nt, Homo sapiens
caaaugaccgcacguucucugcc

SEQ ID NO: 1235753 - RNA, 13 nt, Homo sapiens
caaaugaugccau

SEQ ID NO: 1235754 - RNA, 18 nt, Homo sapiens
caaaugcacaucucaugg

SEQ ID NO: 1235755 - RNA, 20 nt, Homo sapiens
caaaugcacaucucauggca

SEQ ID NO: 1235756 - RNA, 17 nt, Homo sapiens
caaaugcagaaccacaa

SEQ ID NO: 1235757 - RNA, 13 nt, Homo sapiens
caaaugcuccucc

SEQ ID NO: 1235758 - RNA, 21 nt, Homo sapiens
caaaugcuccuccuccaugcu

SEQ ID NO: 1235759 - RNA, 18 nt, Homo sapiens
caaaugguauuuugauag

SEQ ID NO: 1235760 - RNA, 15 nt, Homo sapiens
caaauguauagacuu

SEQ ID NO: 1235761 - RNA, 14 nt, Homo sapiens
caaauguccuccag

SEQ ID NO: 1235762 - RNA, 20 nt, Homo sapiens
caaaugugcuggucacccuu

SEQ ID NO: 1235763 - RNA, 23 nt, Homo sapiens
caaaugugcuggucacccuucaa

SEQ ID NO: 1235764 - RNA, 16 nt, Homo sapiens
caaaugugcugucaaa

SEQ ID NO: 1235765 - RNA, 18 nt, Homo sapiens
caaauuaagugugcauga

SEQ ID NO: 1235766 - RNA, 15 nt, Homo sapiens
caaauuauaaaaagc

SEQ ID NO: 1235767 - RNA, 18 nt, Homo sapiens
caaauucuucugaacuca

SEQ ID NO: 1235768 - RNA, 22 nt, Homo sapiens
caaauugggacaacagugcuuu

SEQ ID NO: 1235769 - RNA, 14 nt, Homo sapiens
caaauuuucaaguu

SEQ ID NO: 1235770 - RNA, 23 nt, Homo sapiens
caacaaaauggucauccaaacuc

SEQ ID NO: 1235771 - RNA, 19 nt, Homo sapiens
caacaaacucuacuaucca

SEQ ID NO: 1235772 - RNA, 21 nt, Homo sapiens
caacaaagauugagaagccau

SEQ ID NO: 1235773 - RNA, 23 nt, Homo sapiens
caacaaagauugagaagccaugu

SEQ ID NO: 1235774 - RNA, 19 nt, Homo sapiens
caacaaagcgagaucccau

SEQ ID NO: 1235775 - RNA, 18 nt, Homo sapiens
caacaaaggcugaacugg

SEQ ID NO: 1235776 - RNA, 19 nt, Homo sapiens
caacaacacaauaacacua

SEQ ID NO: 1235777 - RNA, 15 nt, Homo sapiens
caacaagaauauugu

SEQ ID NO: 1235778 - RNA, 20 nt, Homo sapiens
caacaagcccugcuuuugca

SEQ ID NO: 1235779 - RNA, 13 nt, Homo sapiens
caacaauacaugc

SEQ ID NO: 1235780 - RNA, 21 nt, Homo sapiens
caacacagagcugaguccucu

SEQ ID NO: 1235781 - RNA, 19 nt, Homo sapiens
caacacagugaaacuccau

SEQ ID NO: 1235782 - RNA, 15 nt, Homo sapiens
caacaccacuaggaa

SEQ ID NO: 1235783 - RNA, 12 nt, Homo sapiens
caacacccaaag

SEQ ID NO: 1235784 - RNA, 10 nt, Homo sapiens
caacacucca

SEQ ID NO: 1235785 - RNA, 14 nt, Homo sapiens
caacacugcucaca

SEQ ID NO: 1235786 - RNA, 21 nt, Homo sapiens
caacacugucacuagucucac

SEQ ID NO: 1235787 - RNA, 19 nt, Homo sapiens
caacagcaagucacccauc

SEQ ID NO: 1235788 - RNA, 14 nt, Homo sapiens
caacaggacagagu

SEQ ID NO: 1235789 - RNA, 22 nt, Homo sapiens
caacaggauuacaguguagcua

SEQ ID NO: 1235790 - RNA, 22 nt, Homo sapiens
caacaggcaguggaagcaguuu

SEQ ID NO: 1235791 - RNA, 18 nt, Homo sapiens
caacagguaaaacagggc

SEQ ID NO: 1235792 - RNA, 17 nt, Homo sapiens
caacagugagucuguca

SEQ ID NO: 1235793 - RNA, 22 nt, Homo sapiens
caacauaauuaaauuuugaguu

SEQ ID NO: 1235794 - RNA, 12 nt, Homo sapiens
caacauaucauu

SEQ ID NO: 1235795 - RNA, 14 nt, Homo sapiens
caacauccaaaaua

SEQ ID NO: 1235796 - RNA, 18 nt, Homo sapiens
caacaucuaaaaaucaaa

SEQ ID NO: 1235797 - RNA, 18 nt, Homo sapiens
caacaucuggucuuccag

SEQ ID NO: 1235798 - RNA, 21 nt, Homo sapiens
caacaucuucauagaugaaug

SEQ ID NO: 1235799 - RNA, 15 nt, Homo sapiens
caacauggcuuucuu

SEQ ID NO: 1235800 - RNA, 23 nt, Homo sapiens
caacauguuauucaaugugacac

SEQ ID NO: 1235801 - RNA, 15 nt, Homo sapiens
caacauuaaacacaa

SEQ ID NO: 1235802 - RNA, 17 nt, Homo sapiens
caacauuaaacacaaag

SEQ ID NO: 1235803 - RNA, 13 nt, Homo sapiens
caacauuacuguu

SEQ ID NO: 1235804 - RNA, 17 nt, Homo sapiens
auuugaaaccaggacau

SEQ ID NO: 1235805 - RNA, 19 nt, Homo sapiens
auuugaagcgagucauuuc

SEQ ID NO: 1235806 - RNA, 14 nt, Homo sapiens
auuugacuguucaa

SEQ ID NO: 1235807 - RNA, 20 nt, Homo sapiens
auuugagagaagccacgcug

SEQ ID NO: 1235808 - RNA, 19 nt, Homo sapiens
auuugauaccauggcacug

SEQ ID NO: 1235809 - RNA, 24 nt, Homo sapiens
auuugauaccauggcacugacaau

SEQ ID NO: 1235810 - RNA, 23 nt, Homo sapiens
auuugauucuccagccaaccuca

SEQ ID NO: 1235811 - RNA, 14 nt, Homo sapiens
auuugauugcagau

SEQ ID NO: 1235812 - RNA, 15 nt, Homo sapiens
auuugcaacagcuac

SEQ ID NO: 1235813 - RNA, 12 nt, Homo sapiens
auuugcaacuca

SEQ ID NO: 1235814 - RNA, 17 nt, Homo sapiens
auuugcaauauggauuu

SEQ ID NO: 1235815 - RNA, 19 nt, Homo sapiens
auuugcacacugcacuguu

SEQ ID NO: 1235816 - RNA, 16 nt, Homo sapiens
auuugcacuaaaucag

SEQ ID NO: 1235817 - RNA, 17 nt, Homo sapiens
auuugccagagccaaau

SEQ ID NO: 1235818 - RNA, 19 nt, Homo sapiens
auuugcccuuaaggacaaa

SEQ ID NO: 1235819 - RNA, 16 nt, Homo sapiens
auuugcucauugcugu

SEQ ID NO: 1235820 - RNA, 18 nt, Homo sapiens
auuuggauuagaaauuua

SEQ ID NO: 1235821 - RNA, 17 nt, Homo sapiens
auuugggagacauguga

SEQ ID NO: 1235822 - RNA, 18 nt, Homo sapiens
auuugguaccauggugua

SEQ ID NO: 1235823 - RNA, 17 nt, Homo sapiens
auuugguuuguuaauuc

SEQ ID NO: 1235824 - RNA, 16 nt, Homo sapiens
auuuguaaaucugcca

SEQ ID NO: 1235825 - RNA, 22 nt, Homo sapiens
auuuguaaaucugccacaaaaa

SEQ ID NO: 1235826 - RNA, 17 nt, Homo sapiens
auuuguaauugaacuua

SEQ ID NO: 1235827 - RNA, 13 nt, Homo sapiens
auuuguagcacug

SEQ ID NO: 1235828 - RNA, 16 nt, Homo sapiens
auuuguagcacugagg

SEQ ID NO: 1235829 - RNA, 18 nt, Homo sapiens
auuugucgcaaagacgua

SEQ ID NO: 1235830 - RNA, 14 nt, Homo sapiens
auuugucuucauga

SEQ ID NO: 1235831 - RNA, 18 nt, Homo sapiens
auuugugaacuggaagaa

SEQ ID NO: 1235832 - RNA, 20 nt, Homo sapiens
auuugugcuagaaauuuuca

SEQ ID NO: 1235833 - RNA, 19 nt, Homo sapiens
auuuguuaaaauuaucaau

SEQ ID NO: 1235834 - RNA, 13 nt, Homo sapiens
auuuguucagaga

SEQ ID NO: 1235835 - RNA, 14 nt, Homo sapiens
auuuguuucaaugg

SEQ ID NO: 1235836 - RNA, 18 nt, Homo sapiens
auuuguuuguauacauau

SEQ ID NO: 1235837 - RNA, 20 nt, Homo sapiens
auuuguuuucuucuguaugu

SEQ ID NO: 1235838 - RNA, 19 nt, Homo sapiens
auuuuaagaauuucacaag

SEQ ID NO: 1235839 - RNA, 14 nt, Homo sapiens
auuuuaaggacugc

SEQ ID NO: 1235840 - RNA, 13 nt, Homo sapiens
auuuuaauuaucu

SEQ ID NO: 1235841 - RNA, 23 nt, Homo sapiens
auuuuacaauuuuuuaucaugca

SEQ ID NO: 1235842 - RNA, 13 nt, Homo sapiens
auuuuacuuccau

SEQ ID NO: 1235843 - RNA, 15 nt, Homo sapiens
auuuuaguuccuuua

SEQ ID NO: 1235844 - RNA, 18 nt, Homo sapiens
auuuuauaccaaagccaa

SEQ ID NO: 1235845 - RNA, 12 nt, Homo sapiens
auuuuauaggug

SEQ ID NO: 1235846 - RNA, 15 nt, Homo sapiens
auuuuaucugugaau

SEQ ID NO: 1235847 - RNA, 16 nt, Homo sapiens
auuuuaugaucuuggc

SEQ ID NO: 1235848 - RNA, 13 nt, Homo sapiens
auuuuaugcugcu

SEQ ID NO: 1235849 - RNA, 21 nt, Homo sapiens
auuuuaugcugcuguuuacaa

SEQ ID NO: 1235850 - RNA, 13 nt, Homo sapiens
auuuuauuauaau

SEQ ID NO: 1235851 - RNA, 14 nt, Homo sapiens
auuuuauucccaag

SEQ ID NO: 1235852 - RNA, 24 nt, Homo sapiens
auuuucaagaauaaucacgcuuuc

SEQ ID NO: 1235853 - RNA, 14 nt, Homo sapiens
auuuucaaguuuac

SEQ ID NO: 1235854 - RNA, 22 nt, Homo sapiens
auuuucacaggugugguguaau

SEQ ID NO: 1235855 - RNA, 16 nt, Homo sapiens
auuuucacaucaaaga

SEQ ID NO: 1235856 - RNA, 15 nt, Homo sapiens
auuuucagccuacag

SEQ ID NO: 1235857 - RNA, 14 nt, Homo sapiens
auuuucaguauaau

SEQ ID NO: 1235858 - RNA, 22 nt, Homo sapiens
auuuucaucaccccaaaagcaa

SEQ ID NO: 1235859 - RNA, 20 nt, Homo sapiens
auuuucauugaaaugcacag

SEQ ID NO: 1235860 - RNA, 13 nt, Homo sapiens
auuuuccaaugca

SEQ ID NO: 1235861 - RNA, 21 nt, Homo sapiens
auuuuccuggugccaauuuca

SEQ ID NO: 1235862 - RNA, 14 nt, Homo sapiens
auuuucuacuguaa

SEQ ID NO: 1235863 - RNA, 19 nt, Homo sapiens
auuuucuggaauacaugaa

SEQ ID NO: 1235864 - RNA, 16 nt, Homo sapiens
auuuucuuaaaccaac

SEQ ID NO: 1235865 - RNA, 20 nt, Homo sapiens
auuuucuuaauuguuagcua

SEQ ID NO: 1235866 - RNA, 11 nt, Homo sapiens
auuuucuugcu

SEQ ID NO: 1235867 - RNA, 17 nt, Homo sapiens
auuuucuuuacagguau

SEQ ID NO: 1235868 - RNA, 19 nt, Homo sapiens
auuuugaaaacugugcaau

SEQ ID NO: 1235869 - RNA, 13 nt, Homo sapiens
auuuugaagaaua

SEQ ID NO: 1235870 - RNA, 15 nt, Homo sapiens
auuuugauccaagcu

SEQ ID NO: 1235871 - RNA, 17 nt, Homo sapiens
auuuugaugugacaaua

SEQ ID NO: 1235872 - RNA, 16 nt, Homo sapiens
auuuugcaccuguaaa

SEQ ID NO: 1235873 - RNA, 15 nt, Homo sapiens
auuuugcagcaguga

SEQ ID NO: 1235874 - RNA, 17 nt, Homo sapiens
auuuugcauaguaccaa

SEQ ID NO: 1235875 - RNA, 18 nt, Homo sapiens
auuuugccauaaagucaa

SEQ ID NO: 1235876 - RNA, 20 nt, Homo sapiens
auuuugcccaggcaacagua

SEQ ID NO: 1235877 - RNA, 20 nt, Homo sapiens
auuuuggauaaaucauuuca

SEQ ID NO: 1235878 - RNA, 14 nt, Homo sapiens
auuuuggcgcuauu

SEQ ID NO: 1235879 - RNA, 17 nt, Homo sapiens
auuuugggaaguugcau

SEQ ID NO: 1235880 - RNA, 18 nt, Homo sapiens
auuuugggacuucuaccc

SEQ ID NO: 1235881 - RNA, 21 nt, Homo sapiens
auuuugggagugacucaagaa

SEQ ID NO: 1235882 - RNA, 13 nt, Homo sapiens
auuuugguacuuu

SEQ ID NO: 1235883 - RNA, 19 nt, Homo sapiens
auuuuguaacgaagacaca

SEQ ID NO: 1235884 - RNA, 15 nt, Homo sapiens
auuuuguauuguggu

SEQ ID NO: 1235885 - RNA, 21 nt, Homo sapiens
auuuugucuguacucauguca

SEQ ID NO: 1235886 - RNA, 16 nt, Homo sapiens
auuuugugaauuguga

SEQ ID NO: 1235887 - RNA, 16 nt, Homo sapiens
auuuuguggucauuaa

SEQ ID NO: 1235888 - RNA, 15 nt, Homo sapiens
auuuuguuacacuaa

SEQ ID NO: 1235889 - RNA, 19 nt, Homo sapiens
auuuuuaaaauauuacaca

SEQ ID NO: 1235890 - RNA, 12 nt, Homo sapiens
auuuuuacuuca

SEQ ID NO: 1235891 - RNA, 16 nt, Homo sapiens
auuuuuauacuuucag

SEQ ID NO: 1235892 - RNA, 15 nt, Homo sapiens
auuuuuauauagcuu

SEQ ID NO: 1235893 - RNA, 17 nt, Homo sapiens
auuuuucaagagcuccu

SEQ ID NO: 1235894 - RNA, 17 nt, Homo sapiens
auuuuucacugccccag

SEQ ID NO: 1235895 - RNA, 16 nt, Homo sapiens
auuuuucaucaaacau

SEQ ID NO: 1235896 - RNA, 15 nt, Homo sapiens
auuuuuccaacuacu

SEQ ID NO: 1235897 - RNA, 15 nt, Homo sapiens
auuuuuccacuuaaa

SEQ ID NO: 1235898 - RNA, 20 nt, Homo sapiens
auuuuucuuagugugccaag

SEQ ID NO: 1235899 - RNA, 11 nt, Homo sapiens
auuuuugcucu

SEQ ID NO: 1235900 - RNA, 16 nt, Homo sapiens
auuuuugcucuauggg

SEQ ID NO: 1235901 - RNA, 18 nt, Homo sapiens
auuuuugugaaguauuca

SEQ ID NO: 1235902 - RNA, 11 nt, Homo sapiens
auuuuuugcca

SEQ ID NO: 1235903 - RNA, 14 nt, Homo sapiens
auuuuuugccauuu

SEQ ID NO: 1235904 - RNA, 16 nt, Homo sapiens
auuuuuuuaacacaua

SEQ ID NO: 1235905 - RNA, 22 nt, Homo sapiens
auuuuuuuuaaagaagagugac

SEQ ID NO: 1235906 - RNA, 19 nt, Homo sapiens
auuuuuuuugagaccgagu

SEQ ID NO: 1235907 - RNA, 21 nt, Homo sapiens
caaaaaagaaugugcuaugaa

SEQ ID NO: 1235908 - RNA, 18 nt, Homo sapiens
caaaaaauagcacacuuu

SEQ ID NO: 1235909 - RNA, 23 nt, Homo sapiens
caaaaacauguaugugcauuuca

SEQ ID NO: 1235910 - RNA, 12 nt, Homo sapiens
caaaaacuuugg

SEQ ID NO: 1235911 - RNA, 14 nt, Homo sapiens
caaaaagaccagcc

SEQ ID NO: 1235912 - RNA, 15 nt, Homo sapiens
caaaaagaugaccuu

SEQ ID NO: 1235913 - RNA, 18 nt, Homo sapiens
caaaaagccuuuuccaga

SEQ ID NO: 1235914 - RNA, 22 nt, Homo sapiens
caaaaaguuuaucacacagugu

SEQ ID NO: 1235915 - RNA, 17 nt, Homo sapiens
caaaaauaaacgaacuc

SEQ ID NO: 1235916 - RNA, 19 nt, Homo sapiens
caaaaaucguuuugcccga

SEQ ID NO: 1235917 - RNA, 21 nt, Homo sapiens
caaaaaugaaagcaugucuca

SEQ ID NO: 1235918 - RNA, 14 nt, Homo sapiens
caaaaaugaacuga

SEQ ID NO: 1235919 - RNA, 21 nt, Homo sapiens
caaaaaugaagcugcucugaa

SEQ ID NO: 1235920 - RNA, 21 nt, Homo sapiens
caaaaauggauauuauuagaa

SEQ ID NO: 1235921 - RNA, 19 nt, Homo sapiens
caaaaauguaaugaucaua

SEQ ID NO: 1235922 - RNA, 18 nt, Homo sapiens
caaaacagagaugugaua

SEQ ID NO: 1235923 - RNA, 13 nt, Homo sapiens
caaaacauaucuu

SEQ ID NO: 1235924 - RNA, 12 nt, Homo sapiens
caaaacauucca

SEQ ID NO: 1235925 - RNA, 23 nt, Homo sapiens
caaaacgaaaugcuaugacugua

SEQ ID NO: 1235926 - RNA, 17 nt, Homo sapiens
caaaacuaaccaucuga

SEQ ID NO: 1235927 - RNA, 13 nt, Homo sapiens
caaaacucaguag

SEQ ID NO: 1235928 - RNA, 12 nt, Homo sapiens
caaaacucuccu

SEQ ID NO: 1235929 - RNA, 19 nt, Homo sapiens
caaaacuuaaaaguauuca

SEQ ID NO: 1235930 - RNA, 16 nt, Homo sapiens
caaaacuucuugucag

SEQ ID NO: 1235931 - RNA, 13 nt, Homo sapiens
caaaagaagacaa

SEQ ID NO: 1235932 - RNA, 17 nt, Homo sapiens
cagaaccccuacaugaa

SEQ ID NO: 1235933 - RNA, 18 nt, Homo sapiens
cagaaccccuacaugaaa

SEQ ID NO: 1235934 - RNA, 12 nt, Homo sapiens
cagaacccugcu

SEQ ID NO: 1235935 - RNA, 21 nt, Homo sapiens
cagaaccuacuguuccuuuca

SEQ ID NO: 1235936 - RNA, 20 nt, Homo sapiens
cagaaccucuuccccagaaa

SEQ ID NO: 1235937 - RNA, 15 nt, Homo sapiens
cagaaccugcuccug

SEQ ID NO: 1235938 - RNA, 20 nt, Homo sapiens
cagaaccugcuccuggagua

SEQ ID NO: 1235939 - RNA, 13 nt, Homo sapiens
cagaacugccauu

SEQ ID NO: 1235940 - RNA, 20 nt, Homo sapiens
cagaacuuaaggauggagcc

SEQ ID NO: 1235941 - RNA, 14 nt, Homo sapiens
cagaagaaaggaac

SEQ ID NO: 1235942 - RNA, 19 nt, Homo sapiens
cagaagaagcuggugcccu

SEQ ID NO: 1235943 - RNA, 15 nt, Homo sapiens
cagaagaaugggaau

SEQ ID NO: 1235944 - RNA, 14 nt, Homo sapiens
cagaagacaaaaag

SEQ ID NO: 1235945 - RNA, 14 nt, Homo sapiens
cagaagacacugca

SEQ ID NO: 1235946 - RNA, 11 nt, Homo sapiens
cagaagaucug

SEQ ID NO: 1235947 - RNA, 13 nt, Homo sapiens
cagaagaucugaa

SEQ ID NO: 1235948 - RNA, 20 nt, Homo sapiens
cagaagcaggguacccuuug

SEQ ID NO: 1235949 - RNA, 23 nt, Homo sapiens
cagaagcaguugagucgucauca

SEQ ID NO: 1235950 - RNA, 23 nt, Homo sapiens
cagaaggacacuagccugugcac

SEQ ID NO: 1235951 - RNA, 20 nt, Homo sapiens
cagaaggagaugcugcugag

SEQ ID NO: 1235952 - RNA, 22 nt, Homo sapiens
cagaaggagggcagagccaugg

SEQ ID NO: 1235953 - RNA, 22 nt, Homo sapiens
cagaaggugccacuuuacccac

SEQ ID NO: 1235954 - RNA, 15 nt, Homo sapiens
cagaagguugcucua

SEQ ID NO: 1235955 - RNA, 14 nt, Homo sapiens
cagaaguacuccua

SEQ ID NO: 1235956 - RNA, 19 nt, Homo sapiens
cagaaguauuucuguggau

SEQ ID NO: 1235957 - RNA, 21 nt, Homo sapiens
cagaauaauggaaacauuaca

SEQ ID NO: 1235958 - RNA, 23 nt, Homo sapiens
cagaauagcuuugaauguggccc

SEQ ID NO: 1235959 - RNA, 18 nt, Homo sapiens
cagaauaucagaauauga

SEQ ID NO: 1235960 - RNA, 19 nt, Homo sapiens
cagaauaucagaauaugau

SEQ ID NO: 1235961 - RNA, 22 nt, Homo sapiens
cagaaucagaucugagcuucau

SEQ ID NO: 1235962 - RNA, 12 nt, Homo sapiens
cagaauguaucu

SEQ ID NO: 1235963 - RNA, 13 nt, Homo sapiens
cagaauguaucug

SEQ ID NO: 1235964 - RNA, 14 nt, Homo sapiens
cagaauguaucugu

SEQ ID NO: 1235965 - RNA, 18 nt, Homo sapiens
cagaauguucuauuguca

SEQ ID NO: 1235966 - RNA, 19 nt, Homo sapiens
cagaauuaugaagagguau

SEQ ID NO: 1235967 - RNA, 20 nt, Homo sapiens
cagaauucucagaaucucaa

SEQ ID NO: 1235968 - RNA, 15 nt, Homo sapiens
cagaauugagaguga

SEQ ID NO: 1235969 - RNA, 17 nt, Homo sapiens
cagacaaaguaauuccu

SEQ ID NO: 1235970 - RNA, 15 nt, Homo sapiens
cagacaaccaaaaca

SEQ ID NO: 1235971 - RNA, 15 nt, Homo sapiens
cagacaaccuaucau

SEQ ID NO: 1235972 - RNA, 15 nt, Homo sapiens
cagacacagacuggc

SEQ ID NO: 1235973 - RNA, 20 nt, Homo sapiens
cagacacagacuggcaauaa

SEQ ID NO: 1235974 - RNA, 14 nt, Homo sapiens
cagacaccuggacu

SEQ ID NO: 1235975 - RNA, 20 nt, Homo sapiens
cagacacuggcauggauaua

SEQ ID NO: 1235976 - RNA, 13 nt, Homo sapiens
cagacacuuauuu

SEQ ID NO: 1235977 - RNA, 18 nt, Homo sapiens
cagacagaagucuccuca

SEQ ID NO: 1235978 - RNA, 12 nt, Homo sapiens
cagacagagauu

SEQ ID NO: 1235979 - RNA, 20 nt, Homo sapiens
cagacauacauuucucauac

SEQ ID NO: 1235980 - RNA, 22 nt, Homo sapiens
cagaccaaggcgaguuucccca

SEQ ID NO: 1235981 - RNA, 18 nt, Homo sapiens
cagaccacagagcuguca

SEQ ID NO: 1235982 - RNA, 16 nt, Homo sapiens
cagaccaccuuucaca

SEQ ID NO: 1235983 - RNA, 12 nt, Homo sapiens
cagaccagugac

SEQ ID NO: 1235984 - RNA, 17 nt, Homo sapiens
cagacccaggucuucca

SEQ ID NO: 1235985 - RNA, 12 nt, Homo sapiens
cagacccagugg

SEQ ID NO: 1235986 - RNA, 22 nt, Homo sapiens
cagacccaguggacucuuccac

SEQ ID NO: 1235987 - RNA, 16 nt, Homo sapiens
cagacgggaggggaaa

SEQ ID NO: 1235988 - RNA, 16 nt, Homo sapiens
cagacggugugcacca

SEQ ID NO: 1235989 - RNA, 15 nt, Homo sapiens
cagacuacacaggau

SEQ ID NO: 1235990 - RNA, 20 nt, Homo sapiens
cagacuacacaggaugaggu

SEQ ID NO: 1235991 - RNA, 16 nt, Homo sapiens
cagacucaaagggaaa

SEQ ID NO: 1235992 - RNA, 16 nt, Homo sapiens
cagacucaguuuguca

SEQ ID NO: 1235993 - RNA, 17 nt, Homo sapiens
cagacugaaaugugcuc

SEQ ID NO: 1235994 - RNA, 22 nt, Homo sapiens
cagacugaaaugugcucaggcc

SEQ ID NO: 1235995 - RNA, 15 nt, Homo sapiens
cagacuggcaauaaa

SEQ ID NO: 1235996 - RNA, 19 nt, Homo sapiens
cagacuggcaauaaacucc

SEQ ID NO: 1235997 - RNA, 16 nt, Homo sapiens
cagacuguaggauuug

SEQ ID NO: 1235998 - RNA, 18 nt, Homo sapiens
cagacuguaggauuugaa

SEQ ID NO: 1235999 - RNA, 21 nt, Homo sapiens
cagacuugccaggcucccuuu

SEQ ID NO: 1236000 - RNA, 13 nt, Homo sapiens
cagacuuggagua

SEQ ID NO: 1236001 - RNA, 21 nt, Homo sapiens
cagagaaaauaauuaauuuca

SEQ ID NO: 1236002 - RNA, 20 nt, Homo sapiens
cagagaacuggaaagacaua

SEQ ID NO: 1236003 - RNA, 21 nt, Homo sapiens
cagagaagaccaaagcauugc

SEQ ID NO: 1236004 - RNA, 22 nt, Homo sapiens
cagagaagcauccuccacaucc

SEQ ID NO: 1236005 - RNA, 21 nt, Homo sapiens
cagagaaggaaaagacugaau

SEQ ID NO: 1236006 - RNA, 17 nt, Homo sapiens
cagagaaguuuguagcc

SEQ ID NO: 1236007 - RNA, 21 nt, Homo sapiens
cagagaaucucuagugaauuu

SEQ ID NO: 1236008 - RNA, 15 nt, Homo sapiens
cagagaccaccacau

SEQ ID NO: 1236009 - RNA, 18 nt, Homo sapiens
cagagacccaagcugccu

SEQ ID NO: 1236010 - RNA, 15 nt, Homo sapiens
cagagaccguccuca

SEQ ID NO: 1236011 - RNA, 14 nt, Homo sapiens
cagagacuaucuga

SEQ ID NO: 1236012 - RNA, 16 nt, Homo sapiens
cagagacugaauagau

SEQ ID NO: 1236013 - RNA, 14 nt, Homo sapiens
cagagagacuggcc

SEQ ID NO: 1236014 - RNA, 22 nt, Homo sapiens
cagagagaggggagaagccugg

SEQ ID NO: 1236015 - RNA, 15 nt, Homo sapiens
cagagagcaacucug

SEQ ID NO: 1236016 - RNA, 16 nt, Homo sapiens
cagagagcaacucuga

SEQ ID NO: 1236017 - RNA, 15 nt, Homo sapiens
cagagagcggucuca

SEQ ID NO: 1236018 - RNA, 17 nt, Homo sapiens
cagagaggcucugagaa

SEQ ID NO: 1236019 - RNA, 13 nt, Homo sapiens
cagagagggccca

SEQ ID NO: 1236020 - RNA, 16 nt, Homo sapiens
cagagauaaaccaaua

SEQ ID NO: 1236021 - RNA, 18 nt, Homo sapiens
cagagaucccacacuacu

SEQ ID NO: 1236022 - RNA, 20 nt, Homo sapiens
cagagaucguguauugagau

SEQ ID NO: 1236023 - RNA, 18 nt, Homo sapiens
cagagaugaacaucuaac

SEQ ID NO: 1236024 - RNA, 24 nt, Homo sapiens
cagagcaagagauaagucuuucau

SEQ ID NO: 1236025 - RNA, 11 nt, Homo sapiens
cagagcacaaa

SEQ ID NO: 1236026 - RNA, 23 nt, Homo sapiens
cagagcaggaagcauucagagag

SEQ ID NO: 1236027 - RNA, 22 nt, Homo sapiens
cagagcaggggcuccagcaccu

SEQ ID NO: 1236028 - RNA, 21 nt, Homo sapiens
cagagccaccugacucuugca

SEQ ID NO: 1236029 - RNA, 19 nt, Homo sapiens
cagagccuucaagugccaa

SEQ ID NO: 1236030 - RNA, 20 nt, Homo sapiens
cagagcgaggaaaggauuuu

SEQ ID NO: 1236031 - RNA, 12 nt, Homo sapiens
cagagcucccuc

SEQ ID NO: 1236032 - RNA, 15 nt, Homo sapiens
cagagcuggaccagu

SEQ ID NO: 1236033 - RNA, 17 nt, Homo sapiens
cagagcugucugaacuc

SEQ ID NO: 1236034 - RNA, 17 nt, Homo sapiens
cagaggaaaagacaccu

SEQ ID NO: 1236035 - RNA, 14 nt, Homo sapiens
cagaggaaguggaa

SEQ ID NO: 1236036 - RNA, 21 nt, Homo sapiens
cagaggagccaccaguucuca

SEQ ID NO: 1236037 - RNA, 20 nt, Homo sapiens
cagaggauaaggaggcacug

SEQ ID NO: 1236038 - RNA, 15 nt, Homo sapiens
cagaggaugucacaa

SEQ ID NO: 1236039 - RNA, 14 nt, Homo sapiens
cagaggcccugugg

SEQ ID NO: 1236040 - RNA, 14 nt, Homo sapiens
cagaggcucuaaug

SEQ ID NO: 1236041 - RNA, 17 nt, Homo sapiens
cagaggcucuaauguac

SEQ ID NO: 1236042 - RNA, 18 nt, Homo sapiens
cagaggcucuaauguaca

SEQ ID NO: 1236043 - RNA, 22 nt, Homo sapiens
cagaggcucuaauguacaauaa

SEQ ID NO: 1236044 - RNA, 16 nt, Homo sapiens
cagagggcuugugaac

SEQ ID NO: 1236045 - RNA, 17 nt, Homo sapiens
cagaggggcucagguca

SEQ ID NO: 1236046 - RNA, 20 nt, Homo sapiens
cagagguaauguuaguaaau

SEQ ID NO: 1236047 - RNA, 15 nt, Homo sapiens
cagaguagaaacuca

SEQ ID NO: 1236048 - RNA, 17 nt, Homo sapiens
cagaguccuugcaaaau

SEQ ID NO: 1236049 - RNA, 15 nt, Homo sapiens
cagaguccuuuccaa

SEQ ID NO: 1236050 - RNA, 12 nt, Homo sapiens
cagagucucacu

SEQ ID NO: 1236051 - RNA, 21 nt, Homo sapiens
cagagugagcaagggggccca

SEQ ID NO: 1236052 - RNA, 19 nt, Homo sapiens
cagagugagggaaugguag

SEQ ID NO: 1236053 - RNA, 11 nt, Homo sapiens
cagagugccac

SEQ ID NO: 1236054 - RNA, 19 nt, Homo sapiens
cagagugcuggacuguucc

SEQ ID NO: 1236055 - RNA, 20 nt, Homo sapiens
cagagugguuuccaaugugu

SEQ ID NO: 1236056 - RNA, 13 nt, Homo sapiens
cagaguuugccuu

SEQ ID NO: 1236057 - RNA, 18 nt, Homo sapiens
cagaguuugccuuccuuu

SEQ ID NO: 1236058 - RNA, 12 nt, Homo sapiens
cagaguuugugu

SEQ ID NO: 1236059 - RNA, 16 nt, Homo sapiens
cagauaaaugugcaaa

SEQ ID NO: 1236060 - RNA, 21 nt, Homo sapiens
caguaugagucaaugugcagu

SEQ ID NO: 1236061 - RNA, 14 nt, Homo sapiens
caguaugauaucau

SEQ ID NO: 1236062 - RNA, 20 nt, Homo sapiens
caguauguacuucagugcac

SEQ ID NO: 1236063 - RNA, 14 nt, Homo sapiens
caguauuaagugug

SEQ ID NO: 1236064 - RNA, 16 nt, Homo sapiens
caguauucucagagca

SEQ ID NO: 1236065 - RNA, 17 nt, Homo sapiens
caguauucuugucaaaa

SEQ ID NO: 1236066 - RNA, 23 nt, Homo sapiens
caguauuuagaagccaacuauga

SEQ ID NO: 1236067 - RNA, 21 nt, Homo sapiens
caguauuucauugccugugua

SEQ ID NO: 1236068 - RNA, 22 nt, Homo sapiens
caguauuuucccaauagcacuu

SEQ ID NO: 1236069 - RNA, 19 nt, Homo sapiens
cagucaaaauguuugauau

SEQ ID NO: 1236070 - RNA, 16 nt, Homo sapiens
cagucaaguucagagu

SEQ ID NO: 1236071 - RNA, 19 nt, Homo sapiens
cagucaaugaggaagauuu

SEQ ID NO: 1236072 - RNA, 12 nt, Homo sapiens
cagucaccacca

SEQ ID NO: 1236073 - RNA, 19 nt, Homo sapiens
cagucacugacaguuaaua

SEQ ID NO: 1236074 - RNA, 15 nt, Homo sapiens
cagucagcauucuua

SEQ ID NO: 1236075 - RNA, 13 nt, Homo sapiens
cagucauccugca

SEQ ID NO: 1236076 - RNA, 15 nt, Homo sapiens
caguccaacaaacca

SEQ ID NO: 1236077 - RNA, 18 nt, Homo sapiens
caguccaacaaaccacac

SEQ ID NO: 1236078 - RNA, 11 nt, Homo sapiens
caguccacugc

SEQ ID NO: 1236079 - RNA, 14 nt, Homo sapiens
caguccacugcuga

SEQ ID NO: 1236080 - RNA, 22 nt, Homo sapiens
caguccaggaugcuaacaucua

SEQ ID NO: 1236081 - RNA, 22 nt, Homo sapiens
caguccaguacuugacccaugc

SEQ ID NO: 1236082 - RNA, 16 nt, Homo sapiens
caguccauagcagaga

SEQ ID NO: 1236083 - RNA, 21 nt, Homo sapiens
caguccaucccagagggaccg

SEQ ID NO: 1236084 - RNA, 13 nt, Homo sapiens
caguccaugucuc

SEQ ID NO: 1236085 - RNA, 13 nt, Homo sapiens
caguccauugcuc

SEQ ID NO: 1236086 - RNA, 23 nt, Homo sapiens
cagucccaaaacccuuacaguga

SEQ ID NO: 1236087 - RNA, 23 nt, Homo sapiens
caguccccguggccaucccugug

SEQ ID NO: 1236088 - RNA, 23 nt, Homo sapiens
caguccugggagaaccucaggcu

SEQ ID NO: 1236089 - RNA, 17 nt, Homo sapiens
caguccuguacucuggg

SEQ ID NO: 1236090 - RNA, 20 nt, Homo sapiens
cagucgaugcguucacucca

SEQ ID NO: 1236091 - RNA, 17 nt, Homo sapiens
cagucggccccaucucu

SEQ ID NO: 1236092 - RNA, 21 nt, Homo sapiens
cagucguacugauucuaaugg

SEQ ID NO: 1236093 - RNA, 13 nt, Homo sapiens
cagucucacuuug

SEQ ID NO: 1236094 - RNA, 17 nt, Homo sapiens
cagucuccucacucugu

SEQ ID NO: 1236095 - RNA, 18 nt, Homo sapiens
cagucuggaucguuugac

SEQ ID NO: 1236096 - RNA, 21 nt, Homo sapiens
cagucuguguuuacagacaga

SEQ ID NO: 1236097 - RNA, 17 nt, Homo sapiens
cagucuuccuugucucu

SEQ ID NO: 1236098 - RNA, 21 nt, Homo sapiens
cagugaaggucuuuguuauga

SEQ ID NO: 1236099 - RNA, 16 nt, Homo sapiens
cagugaauccagacca

SEQ ID NO: 1236100 - RNA, 14 nt, Homo sapiens
cagugacaacaucg

SEQ ID NO: 1236101 - RNA, 16 nt, Homo sapiens
cagugacaaggcccug

SEQ ID NO: 1236102 - RNA, 17 nt, Homo sapiens
cagugacaaggcccuga

SEQ ID NO: 1236103 - RNA, 12 nt, Homo sapiens
cagugacaguau

SEQ ID NO: 1236104 - RNA, 13 nt, Homo sapiens
cagugacuucuuu

SEQ ID NO: 1236105 - RNA, 18 nt, Homo sapiens
cagugagaaaaagcuccu

SEQ ID NO: 1236106 - RNA, 17 nt, Homo sapiens
cagugagauauuuggua

SEQ ID NO: 1236107 - RNA, 18 nt, Homo sapiens
cagugagauauuugguac

SEQ ID NO: 1236108 - RNA, 14 nt, Homo sapiens
cagugagccaagau

SEQ ID NO: 1236109 - RNA, 14 nt, Homo sapiens
cagugagcccagau

SEQ ID NO: 1236110 - RNA, 20 nt, Homo sapiens
cagugagccgagauugcgcc

SEQ ID NO: 1236111 - RNA, 19 nt, Homo sapiens
cagugagguucuuggguuu

SEQ ID NO: 1236112 - RNA, 16 nt, Homo sapiens
cagugauauggcagaa

SEQ ID NO: 1236113 - RNA, 13 nt, Homo sapiens
cagugaucuccau

SEQ ID NO: 1236114 - RNA, 20 nt, Homo sapiens
cagugcagggaaccgugaua

SEQ ID NO: 1236115 - RNA, 17 nt, Homo sapiens
cagugcauagcgaagac

SEQ ID NO: 1236116 - RNA, 19 nt, Homo sapiens
cagugcauagcgaagacca

SEQ ID NO: 1236117 - RNA, 21 nt, Homo sapiens
cagugcauagcgaagaccagu

SEQ ID NO: 1236118 - RNA, 16 nt, Homo sapiens
cagugccaacuccuca

SEQ ID NO: 1236119 - RNA, 22 nt, Homo sapiens
cagugccagcaaugacaucuca

SEQ ID NO: 1236120 - RNA, 18 nt, Homo sapiens
cagugccagcaccugccc

SEQ ID NO: 1236121 - RNA, 10 nt, Homo sapiens
cagugccauu

SEQ ID NO: 1236122 - RNA, 13 nt, Homo sapiens
cagugccauucca

SEQ ID NO: 1236123 - RNA, 15 nt, Homo sapiens
cagugccauuccacu

SEQ ID NO: 1236124 - RNA, 18 nt, Homo sapiens
cagugcccaugcaauggc

SEQ ID NO: 1236125 - RNA, 15 nt, Homo sapiens
cagugcugcuguaaa

SEQ ID NO: 1236126 - RNA, 14 nt, Homo sapiens
caguggaucuucag

SEQ ID NO: 1236127 - RNA, 14 nt, Homo sapiens
caguggauucucau

SEQ ID NO: 1236128 - RNA, 14 nt, Homo sapiens
caguggcccggcuu

SEQ ID NO: 1236129 - RNA, 16 nt, Homo sapiens
cagugggagcccugac

SEQ ID NO: 1236130 - RNA, 16 nt, Homo sapiens
cagugggaucccagac

SEQ ID NO: 1236131 - RNA, 19 nt, Homo sapiens
cagugguggucuucaagac

SEQ ID NO: 1236132 - RNA, 16 nt, Homo sapiens
caguguaauccagggg

SEQ ID NO: 1236133 - RNA, 23 nt, Homo sapiens
caguguaaucccccaggagaaca

SEQ ID NO: 1236134 - RNA, 19 nt, Homo sapiens
caguguagcccacacuuga

SEQ ID NO: 1236135 - RNA, 20 nt, Homo sapiens
caguguagcccacacuugag

SEQ ID NO: 1236136 - RNA, 15 nt, Homo sapiens
caguguaggcauuua

SEQ ID NO: 1236137 - RNA, 22 nt, Homo sapiens
cagugucccaccuugaccaaaa

SEQ ID NO: 1236138 - RNA, 20 nt, Homo sapiens
caguguccccuccacuguca

SEQ ID NO: 1236139 - RNA, 15 nt, Homo sapiens
cagugucuuccauaa

SEQ ID NO: 1236140 - RNA, 12 nt, Homo sapiens
cagugugacaag

SEQ ID NO: 1236141 - RNA, 14 nt, Homo sapiens
cagugugacaucua

SEQ ID NO: 1236142 - RNA, 21 nt, Homo sapiens
cagugugcuccagauggugcu

SEQ ID NO: 1236143 - RNA, 22 nt, Homo sapiens
cagugugcuccagauggugcua

SEQ ID NO: 1236144 - RNA, 18 nt, Homo sapiens
caguguuccccaucuggg

SEQ ID NO: 1236145 - RNA, 11 nt, Homo sapiens
caguguugccc

SEQ ID NO: 1236146 - RNA, 11 nt, Homo sapiens
caguguuuaca

SEQ ID NO: 1236147 - RNA, 13 nt, Homo sapiens
caguguuuggaca

SEQ ID NO: 1236148 - RNA, 23 nt, Homo sapiens
caguguuuuagagagagaacuuu

SEQ ID NO: 1236149 - RNA, 20 nt, Homo sapiens
caguuaggguuuugcaauaa

SEQ ID NO: 1236150 - RNA, 16 nt, Homo sapiens
caguuagguagcuuua

SEQ ID NO: 1236151 - RNA, 20 nt, Homo sapiens
caguucauuauuuugugguu

SEQ ID NO: 1236152 - RNA, 18 nt, Homo sapiens
caguucauugcacuuuga

SEQ ID NO: 1236153 - RNA, 18 nt, Homo sapiens
caguucccccaguaccuc

SEQ ID NO: 1236154 - RNA, 15 nt, Homo sapiens
caguucccucuugcu

SEQ ID NO: 1236155 - RNA, 22 nt, Homo sapiens
caguuccugccuuaacugauga

SEQ ID NO: 1236156 - RNA, 13 nt, Homo sapiens
caguucucacucc

SEQ ID NO: 1236157 - RNA, 17 nt, Homo sapiens
caguucuuggugcucug

SEQ ID NO: 1236158 - RNA, 17 nt, Homo sapiens
caguugaagcugacuca

SEQ ID NO: 1236159 - RNA, 23 nt, Homo sapiens
caguugagcuucauauaccagca

SEQ ID NO: 1236160 - RNA, 22 nt, Homo sapiens
caguugcccagagcacuuuagc

SEQ ID NO: 1236161 - RNA, 21 nt, Homo sapiens
caguugcccuagcccagacuc

SEQ ID NO: 1236162 - RNA, 22 nt, Homo sapiens
caguugcccuagcccagacucu

SEQ ID NO: 1236163 - RNA, 19 nt, Homo sapiens
caguugccgucuaggauug

SEQ ID NO: 1236164 - RNA, 22 nt, Homo sapiens
caguugcucaaaaagaaaucaa

SEQ ID NO: 1236165 - RNA, 23 nt, Homo sapiens
caguuggauuuauucugccaaac

SEQ ID NO: 1236166 - RNA, 14 nt, Homo sapiens
caguugggacucag

SEQ ID NO: 1236167 - RNA, 18 nt, Homo sapiens
caguugggauggaaaucu

SEQ ID NO: 1236168 - RNA, 21 nt, Homo sapiens
caguuggggaagccaggugag

SEQ ID NO: 1236169 - RNA, 18 nt, Homo sapiens
caguuguauggagccucu

SEQ ID NO: 1236170 - RNA, 23 nt, Homo sapiens
caguuguugauugacugcaugaa

SEQ ID NO: 1236171 - RNA, 17 nt, Homo sapiens
caguuuauacccuaguu

SEQ ID NO: 1236172 - RNA, 15 nt, Homo sapiens
caguuucagcucacu

SEQ ID NO: 1236173 - RNA, 19 nt, Homo sapiens
caguuucuaggcaccucag

SEQ ID NO: 1236174 - RNA, 17 nt, Homo sapiens
caguuucuggaaaaagu

SEQ ID NO: 1236175 - RNA, 15 nt, Homo sapiens
caguuugauaccugc

SEQ ID NO: 1236176 - RNA, 15 nt, Homo sapiens
caguuugcaccuguc

SEQ ID NO: 1236177 - RNA, 20 nt, Homo sapiens
caguuuuaccucuucucucu

SEQ ID NO: 1236178 - RNA, 23 nt, Homo sapiens
caguuuuaccucuucucucucag

SEQ ID NO: 1236179 - RNA, 19 nt, Homo sapiens
caguuuuauaaaaagugga

SEQ ID NO: 1236180 - RNA, 23 nt, Homo sapiens
caguuuuauauuuauaagccuua

SEQ ID NO: 1236181 - RNA, 14 nt, Homo sapiens
caguuuuguugaga

SEQ ID NO: 1236182 - RNA, 20 nt, Homo sapiens
cauaaaaaagaagcacuuug

SEQ ID NO: 1236183 - RNA, 19 nt, Homo sapiens
cauaaaaaauaaaguacca

SEQ ID NO: 1236184 - RNA, 14 nt, Homo sapiens
cauaaaaaccaaac

SEQ ID NO: 1236185 - RNA, 17 nt, Homo sapiens
cauaaaacccuauacaa

SEQ ID NO: 1236186 - RNA, 19 nt, Homo sapiens
cauaaaauauauaggauua

SEQ ID NO: 1236187 - RNA, 14 nt, Homo sapiens
caggccuaccucac

SEQ ID NO: 1236188 - RNA, 13 nt, Homo sapiens
caggccuggacuu

SEQ ID NO: 1236189 - RNA, 14 nt, Homo sapiens
caggcgaccgggcc

SEQ ID NO: 1236190 - RNA, 19 nt, Homo sapiens
caggcgauucuccugccuc

SEQ ID NO: 1236191 - RNA, 15 nt, Homo sapiens
caggcgcugugcuau

SEQ ID NO: 1236192 - RNA, 15 nt, Homo sapiens
caggcggggugggca

SEQ ID NO: 1236193 - RNA, 20 nt, Homo sapiens
caggcgugagccaccgcgcc

SEQ ID NO: 1236194 - RNA, 13 nt, Homo sapiens
caggcgugaucca

SEQ ID NO: 1236195 - RNA, 14 nt, Homo sapiens
caggcucugaccag

SEQ ID NO: 1236196 - RNA, 11 nt, Homo sapiens
caggcucugcu

SEQ ID NO: 1236197 - RNA, 18 nt, Homo sapiens
caggcucuuccccugcuc

SEQ ID NO: 1236198 - RNA, 20 nt, Homo sapiens
caggcugcagucccuggaaa

SEQ ID NO: 1236199 - RNA, 15 nt, Homo sapiens
caggcuggacaugcu

SEQ ID NO: 1236200 - RNA, 16 nt, Homo sapiens
caggcuggagugcaau

SEQ ID NO: 1236201 - RNA, 17 nt, Homo sapiens
caggcuggagugcaaug

SEQ ID NO: 1236202 - RNA, 17 nt, Homo sapiens
caggcugggccaugucc

SEQ ID NO: 1236203 - RNA, 18 nt, Homo sapiens
caggcugggccaugucca

SEQ ID NO: 1236204 - RNA, 19 nt, Homo sapiens
caggcugggccauguccaa

SEQ ID NO: 1236205 - RNA, 23 nt, Homo sapiens
caggcugggccauguccaaagag

SEQ ID NO: 1236206 - RNA, 20 nt, Homo sapiens
caggcugggcuucaguggca

SEQ ID NO: 1236207 - RNA, 13 nt, Homo sapiens
caggcuggucuca

SEQ ID NO: 1236208 - RNA, 20 nt, Homo sapiens
caggcuggucucaaacuccu

SEQ ID NO: 1236209 - RNA, 14 nt, Homo sapiens
caggcugugcagcg

SEQ ID NO: 1236210 - RNA, 14 nt, Homo sapiens
caggcuuggcaaag

SEQ ID NO: 1236211 - RNA, 19 nt, Homo sapiens
caggcuuucaagaagugcc

SEQ ID NO: 1236212 - RNA, 20 nt, Homo sapiens
caggcuuucaagaagugcca

SEQ ID NO: 1236213 - RNA, 13 nt, Homo sapiens
cagggaaaacugc

SEQ ID NO: 1236214 - RNA, 16 nt, Homo sapiens
cagggaagagggcagu

SEQ ID NO: 1236215 - RNA, 19 nt, Homo sapiens
cagggaagcugucccucac

SEQ ID NO: 1236216 - RNA, 20 nt, Homo sapiens
cagggaaucagggaccagcu

SEQ ID NO: 1236217 - RNA, 13 nt, Homo sapiens
cagggaauuucag

SEQ ID NO: 1236218 - RNA, 21 nt, Homo sapiens
cagggacaaaacacugugucc

SEQ ID NO: 1236219 - RNA, 15 nt, Homo sapiens
cagggacagagccau

SEQ ID NO: 1236220 - RNA, 21 nt, Homo sapiens
cagggaccacguugcugccug

SEQ ID NO: 1236221 - RNA, 16 nt, Homo sapiens
cagggacuccaugcug

SEQ ID NO: 1236222 - RNA, 19 nt, Homo sapiens
cagggacuccaugcugcca

SEQ ID NO: 1236223 - RNA, 20 nt, Homo sapiens
cagggacuccaugcugccag

SEQ ID NO: 1236224 - RNA, 20 nt, Homo sapiens
cagggacugcaaguggccau

SEQ ID NO: 1236225 - RNA, 23 nt, Homo sapiens
cagggagggagggcgguggacaa

SEQ ID NO: 1236226 - RNA, 19 nt, Homo sapiens
cagggagugcacauaucca

SEQ ID NO: 1236227 - RNA, 16 nt, Homo sapiens
cagggauaauacugug

SEQ ID NO: 1236228 - RNA, 17 nt, Homo sapiens
cagggauacccagugau

SEQ ID NO: 1236229 - RNA, 18 nt, Homo sapiens
cagggauuaaccucugca

SEQ ID NO: 1236230 - RNA, 18 nt, Homo sapiens
cagggauuaggagcagcu

SEQ ID NO: 1236231 - RNA, 19 nt, Homo sapiens
cagggcacgcaggaccagu

SEQ ID NO: 1236232 - RNA, 17 nt, Homo sapiens
cagggcagugcuaguga

SEQ ID NO: 1236233 - RNA, 20 nt, Homo sapiens
cagggccaccucuugcuugg

SEQ ID NO: 1236234 - RNA, 18 nt, Homo sapiens
cagggccuggggccugag

SEQ ID NO: 1236235 - RNA, 20 nt, Homo sapiens
cagggcgagacuccgucuca

SEQ ID NO: 1236236 - RNA, 21 nt, Homo sapiens
cagggcgccccugggagacaa

SEQ ID NO: 1236237 - RNA, 16 nt, Homo sapiens
cagggcuccugcacuu

SEQ ID NO: 1236238 - RNA, 17 nt, Homo sapiens
cagggcuggcucugcac

SEQ ID NO: 1236239 - RNA, 19 nt, Homo sapiens
cagggcugggccagugcau

SEQ ID NO: 1236240 - RNA, 20 nt, Homo sapiens
cagggcuuuacuccguaaca

SEQ ID NO: 1236241 - RNA, 17 nt, Homo sapiens
caggggaccacaccucc

SEQ ID NO: 1236242 - RNA, 22 nt, Homo sapiens
caggggacuugaaucuuuccaa

SEQ ID NO: 1236243 - RNA, 23 nt, Homo sapiens
caggggggcugugccaaccuguu

SEQ ID NO: 1236244 - RNA, 14 nt, Homo sapiens
caggggugcucacc

SEQ ID NO: 1236245 - RNA, 20 nt, Homo sapiens
caggguccagugggaacuga

SEQ ID NO: 1236246 - RNA, 19 nt, Homo sapiens
cagggucucacucugucgc

SEQ ID NO: 1236247 - RNA, 20 nt, Homo sapiens
cagggugacccugaagugag

SEQ ID NO: 1236248 - RNA, 12 nt, Homo sapiens
cagggugagcuc

SEQ ID NO: 1236249 - RNA, 23 nt, Homo sapiens
caggguguguguuuugacacuga

SEQ ID NO: 1236250 - RNA, 15 nt, Homo sapiens
caggguuaucugcaa

SEQ ID NO: 1236251 - RNA, 13 nt, Homo sapiens
caggguucaucug

SEQ ID NO: 1236252 - RNA, 20 nt, Homo sapiens
caggguuucaccauguugcc

SEQ ID NO: 1236253 - RNA, 22 nt, Homo sapiens
caggguuugcuguuugcgugaa

SEQ ID NO: 1236254 - RNA, 16 nt, Homo sapiens
cagguaaaacagggcc

SEQ ID NO: 1236255 - RNA, 19 nt, Homo sapiens
cagguaaagggcaaauaau

SEQ ID NO: 1236256 - RNA, 21 nt, Homo sapiens
cagguaccaucuuguauacac

SEQ ID NO: 1236257 - RNA, 23 nt, Homo sapiens
cagguaccaucuuguauacacau

SEQ ID NO: 1236258 - RNA, 17 nt, Homo sapiens
cagguaccucuuucagg

SEQ ID NO: 1236259 - RNA, 15 nt, Homo sapiens
caggucagcaucucg

SEQ ID NO: 1236260 - RNA, 13 nt, Homo sapiens
caggucccacugc

SEQ ID NO: 1236261 - RNA, 12 nt, Homo sapiens
cagguccuccau

SEQ ID NO: 1236262 - RNA, 20 nt, Homo sapiens
cagguccuuuccacccugag

SEQ ID NO: 1236263 - RNA, 20 nt, Homo sapiens
caggucuccggaggagacac

SEQ ID NO: 1236264 - RNA, 19 nt, Homo sapiens
caggugaaaauccaucuca

SEQ ID NO: 1236265 - RNA, 20 nt, Homo sapiens
caggugaaaauccaucucau

SEQ ID NO: 1236266 - RNA, 14 nt, Homo sapiens
caggugaacagccu

SEQ ID NO: 1236267 - RNA, 15 nt, Homo sapiens
caggugaacagccuc

SEQ ID NO: 1236268 - RNA, 13 nt, Homo sapiens
caggugacaugaa

SEQ ID NO: 1236269 - RNA, 17 nt, Homo sapiens
caggugauccaccugcc

SEQ ID NO: 1236270 - RNA, 11 nt, Homo sapiens
caggugcagcc

SEQ ID NO: 1236271 - RNA, 16 nt, Homo sapiens
caggugcucuguggau

SEQ ID NO: 1236272 - RNA, 16 nt, Homo sapiens
cagguggagggcacag

SEQ ID NO: 1236273 - RNA, 16 nt, Homo sapiens
cagguggcagagugaa

SEQ ID NO: 1236274 - RNA, 14 nt, Homo sapiens
cagguggugcaaau

SEQ ID NO: 1236275 - RNA, 13 nt, Homo sapiens
caggugguugugg

SEQ ID NO: 1236276 - RNA, 15 nt, Homo sapiens
caggugucauaugac

SEQ ID NO: 1236277 - RNA, 17 nt, Homo sapiens
caggugugguugcucac

SEQ ID NO: 1236278 - RNA, 17 nt, Homo sapiens
cagguguucugggcucc

SEQ ID NO: 1236279 - RNA, 17 nt, Homo sapiens
cagguuauaacaguguu

SEQ ID NO: 1236280 - RNA, 16 nt, Homo sapiens
cagguuauacuccucc

SEQ ID NO: 1236281 - RNA, 18 nt, Homo sapiens
cagguucacacucagaaa

SEQ ID NO: 1236282 - RNA, 18 nt, Homo sapiens
cagguucucuuagagcca

SEQ ID NO: 1236283 - RNA, 14 nt, Homo sapiens
cagguucugagaua

SEQ ID NO: 1236284 - RNA, 14 nt, Homo sapiens
cagguucuuuacaa

SEQ ID NO: 1236285 - RNA, 21 nt, Homo sapiens
cagguuggaugggagugggca

SEQ ID NO: 1236286 - RNA, 16 nt, Homo sapiens
cagguuuagacaguau

SEQ ID NO: 1236287 - RNA, 23 nt, Homo sapiens
cagguuuucuggguguccaaagg

SEQ ID NO: 1236288 - RNA, 18 nt, Homo sapiens
caguaaaaacuguucucu

SEQ ID NO: 1236289 - RNA, 18 nt, Homo sapiens
caguaaaaauaaaauacu

SEQ ID NO: 1236290 - RNA, 20 nt, Homo sapiens
caguaaacgggaacaugccc

SEQ ID NO: 1236291 - RNA, 22 nt, Homo sapiens
caguaaagcaggaagccuccaa

SEQ ID NO: 1236292 - RNA, 19 nt, Homo sapiens
caguaaauguacaacugca

SEQ ID NO: 1236293 - RNA, 21 nt, Homo sapiens
caguaacaaauaaagugcagu

SEQ ID NO: 1236294 - RNA, 21 nt, Homo sapiens
caguaacggguagcagcagau

SEQ ID NO: 1236295 - RNA, 14 nt, Homo sapiens
caguaacuuuaugu

SEQ ID NO: 1236296 - RNA, 17 nt, Homo sapiens
caguaagcuaucuucaa

SEQ ID NO: 1236297 - RNA, 19 nt, Homo sapiens
caguaauaaaacaucuuuc

SEQ ID NO: 1236298 - RNA, 14 nt, Homo sapiens
caguaauguuccuc

SEQ ID NO: 1236299 - RNA, 23 nt, Homo sapiens
caguaauuauguucuacagaaua

SEQ ID NO: 1236300 - RNA, 17 nt, Homo sapiens
caguaauuccuguuacu

SEQ ID NO: 1236301 - RNA, 13 nt, Homo sapiens
caguacaacaguu

SEQ ID NO: 1236302 - RNA, 18 nt, Homo sapiens
caguacacccaguugcca

SEQ ID NO: 1236303 - RNA, 12 nt, Homo sapiens
caguacauuuaa

SEQ ID NO: 1236304 - RNA, 15 nt, Homo sapiens
caguaccaucuacau

SEQ ID NO: 1236305 - RNA, 15 nt, Homo sapiens
caguacuauggagug

SEQ ID NO: 1236306 - RNA, 23 nt, Homo sapiens
caguagaaagcauaacaaaaaga

SEQ ID NO: 1236307 - RNA, 16 nt, Homo sapiens
caguagcuccaacacu

SEQ ID NO: 1236308 - RNA, 16 nt, Homo sapiens
caguaguuagcuuucu

SEQ ID NO: 1236309 - RNA, 21 nt, Homo sapiens
caguauaccuaucugcugcac

SEQ ID NO: 1236310 - RNA, 14 nt, Homo sapiens
caguaucaucucca

SEQ ID NO: 1236311 - RNA, 20 nt, Homo sapiens
caguaucuauauauguguau

SEQ ID NO: 1236312 - RNA, 15 nt, Homo sapiens
caguaucuugggcau

SEQ ID NO: 1236313 - RNA, 20 nt, Homo sapiens
caguaugagucaaugugcag

SEQ ID NO: 1236314 - RNA, 21 nt, Homo sapiens
cagcgagggcaccuugugauc

SEQ ID NO: 1236315 - RNA, 20 nt, Homo sapiens
cagcgcagcuggacucugca

SEQ ID NO: 1236316 - RNA, 20 nt, Homo sapiens
cagcggcggaggcgcaggcg

SEQ ID NO: 1236317 - RNA, 15 nt, Homo sapiens
cagcgggcacagggc

SEQ ID NO: 1236318 - RNA, 14 nt, Homo sapiens
cagcgggugcugcu

SEQ ID NO: 1236319 - RNA, 21 nt, Homo sapiens
cagcguguguauccgacucua

SEQ ID NO: 1236320 - RNA, 21 nt, Homo sapiens
cagcuaacucugaccugggag

SEQ ID NO: 1236321 - RNA, 17 nt, Homo sapiens
cagcuaagacauauuca

SEQ ID NO: 1236322 - RNA, 22 nt, Homo sapiens
cagcuacgaauauagaggguuu

SEQ ID NO: 1236323 - RNA, 20 nt, Homo sapiens
cagcuagaaaaggccuucuu

SEQ ID NO: 1236324 - RNA, 15 nt, Homo sapiens
cagcucacuuccucc

SEQ ID NO: 1236325 - RNA, 19 nt, Homo sapiens
cagcucagggacuggcaca

SEQ ID NO: 1236326 - RNA, 15 nt, Homo sapiens
cagcuccagugccag

SEQ ID NO: 1236327 - RNA, 16 nt, Homo sapiens
cagcucccagccacau

SEQ ID NO: 1236328 - RNA, 23 nt, Homo sapiens
cagcucccugaggaccaccuccu

SEQ ID NO: 1236329 - RNA, 17 nt, Homo sapiens
cagcucuccaccagcug

SEQ ID NO: 1236330 - RNA, 19 nt, Homo sapiens
cagcucucuccuuucaggg

SEQ ID NO: 1236331 - RNA, 13 nt, Homo sapiens
cagcucugagauc

SEQ ID NO: 1236332 - RNA, 17 nt, Homo sapiens
cagcucuguccugggag

SEQ ID NO: 1236333 - RNA, 16 nt, Homo sapiens
cagcucuuacuuuuaa

SEQ ID NO: 1236334 - RNA, 21 nt, Homo sapiens
cagcucuugcuaaucaguguc

SEQ ID NO: 1236335 - RNA, 19 nt, Homo sapiens
cagcugaagaacaucucga

SEQ ID NO: 1236336 - RNA, 13 nt, Homo sapiens
cagcugacuaaac

SEQ ID NO: 1236337 - RNA, 22 nt, Homo sapiens
cagcugauugggcaccugacca

SEQ ID NO: 1236338 - RNA, 19 nt, Homo sapiens
cagcugccuuggacugugu

SEQ ID NO: 1236339 - RNA, 17 nt, Homo sapiens
cagcugcucccaaauaa

SEQ ID NO: 1236340 - RNA, 21 nt, Homo sapiens
cagcugcucccuggcauucaa

SEQ ID NO: 1236341 - RNA, 18 nt, Homo sapiens
cagcuggccccggagcca

SEQ ID NO: 1236342 - RNA, 22 nt, Homo sapiens
cagcugggagacacagcaagac

SEQ ID NO: 1236343 - RNA, 16 nt, Homo sapiens
cagcugguugcuccau

SEQ ID NO: 1236344 - RNA, 18 nt, Homo sapiens
cagcuguccagcugcaaa

SEQ ID NO: 1236345 - RNA, 23 nt, Homo sapiens
cagcugugugggucauaccgugu

SEQ ID NO: 1236346 - RNA, 16 nt, Homo sapiens
cagcuguuacuuucuu

SEQ ID NO: 1236347 - RNA, 19 nt, Homo sapiens
cagcuguuacuuucuuuca

SEQ ID NO: 1236348 - RNA, 12 nt, Homo sapiens
cagcuuaucucu

SEQ ID NO: 1236349 - RNA, 20 nt, Homo sapiens
cagcuucaccagagcauuuc

SEQ ID NO: 1236350 - RNA, 12 nt, Homo sapiens
cagcuucaugaa

SEQ ID NO: 1236351 - RNA, 21 nt, Homo sapiens
cagcuucugauaaacacaauc

SEQ ID NO: 1236352 - RNA, 17 nt, Homo sapiens
cagcuucuucacaggca

SEQ ID NO: 1236353 - RNA, 19 nt, Homo sapiens
cagcuucuugcacuccuuc

SEQ ID NO: 1236354 - RNA, 20 nt, Homo sapiens
cagcuugaguggguucucug

SEQ ID NO: 1236355 - RNA, 14 nt, Homo sapiens
caggaaaguguuau

SEQ ID NO: 1236356 - RNA, 19 nt, Homo sapiens
caggaaauaaauuguaaaa

SEQ ID NO: 1236357 - RNA, 14 nt, Homo sapiens
caggaaauagucac

SEQ ID NO: 1236358 - RNA, 18 nt, Homo sapiens
caggaagagcugacccau

SEQ ID NO: 1236359 - RNA, 17 nt, Homo sapiens
caggaagcauucagaga

SEQ ID NO: 1236360 - RNA, 19 nt, Homo sapiens
caggaaggaaaacuaugua

SEQ ID NO: 1236361 - RNA, 14 nt, Homo sapiens
caggaaggagcaaa

SEQ ID NO: 1236362 - RNA, 21 nt, Homo sapiens
caggaagggcaggaaggagag

SEQ ID NO: 1236363 - RNA, 16 nt, Homo sapiens
caggaaggggugugcu

SEQ ID NO: 1236364 - RNA, 15 nt, Homo sapiens
caggaagguagaaau

SEQ ID NO: 1236365 - RNA, 14 nt, Homo sapiens
caggaauacugaac

SEQ ID NO: 1236366 - RNA, 16 nt, Homo sapiens
caggaauaugacacaa

SEQ ID NO: 1236367 - RNA, 16 nt, Homo sapiens
caggaauguguggccu

SEQ ID NO: 1236368 - RNA, 19 nt, Homo sapiens
caggaauuagagaagcuga

SEQ ID NO: 1236369 - RNA, 20 nt, Homo sapiens
caggacaacuuuacaaaaca

SEQ ID NO: 1236370 - RNA, 18 nt, Homo sapiens
caggacauuaaggaccaa

SEQ ID NO: 1236371 - RNA, 12 nt, Homo sapiens
caggaccagcug

SEQ ID NO: 1236372 - RNA, 14 nt, Homo sapiens
caggacccucagga

SEQ ID NO: 1236373 - RNA, 15 nt, Homo sapiens
caggaccuacuagga

SEQ ID NO: 1236374 - RNA, 19 nt, Homo sapiens
caggaccucccuuccgacc

SEQ ID NO: 1236375 - RNA, 18 nt, Homo sapiens
caggacguccuaucuccc

SEQ ID NO: 1236376 - RNA, 14 nt, Homo sapiens
caggacuccacugg

SEQ ID NO: 1236377 - RNA, 16 nt, Homo sapiens
caggacuccacuggac

SEQ ID NO: 1236378 - RNA, 20 nt, Homo sapiens
caggacuccaucucuuaaaa

SEQ ID NO: 1236379 - RNA, 16 nt, Homo sapiens
caggacuccccaggag

SEQ ID NO: 1236380 - RNA, 22 nt, Homo sapiens
caggacucugccuccucuucaa

SEQ ID NO: 1236381 - RNA, 20 nt, Homo sapiens
caggacuugagaagaccuca

SEQ ID NO: 1236382 - RNA, 20 nt, Homo sapiens
caggacuugcuaaagcacuu

SEQ ID NO: 1236383 - RNA, 14 nt, Homo sapiens
caggagaacaugcu

SEQ ID NO: 1236384 - RNA, 14 nt, Homo sapiens
caggagaagggaua

SEQ ID NO: 1236385 - RNA, 13 nt, Homo sapiens
caggagaaucgcu

SEQ ID NO: 1236386 - RNA, 17 nt, Homo sapiens
caggagaccuggcacug

SEQ ID NO: 1236387 - RNA, 21 nt, Homo sapiens
caggagacuuuacauggaugc

SEQ ID NO: 1236388 - RNA, 19 nt, Homo sapiens
caggagagacagugaggcu

SEQ ID NO: 1236389 - RNA, 17 nt, Homo sapiens
caggagaucgagaccau

SEQ ID NO: 1236390 - RNA, 17 nt, Homo sapiens
caggagcacccaggcau

SEQ ID NO: 1236391 - RNA, 22 nt, Homo sapiens
caggagcgugaaggacuuagcc

SEQ ID NO: 1236392 - RNA, 11 nt, Homo sapiens
caggagcucuu

SEQ ID NO: 1236393 - RNA, 17 nt, Homo sapiens
caggaggaucacuugag

SEQ ID NO: 1236394 - RNA, 17 nt, Homo sapiens
caggaggccaauaaaaa

SEQ ID NO: 1236395 - RNA, 18 nt, Homo sapiens
caggaggcuuggaaagca

SEQ ID NO: 1236396 - RNA, 17 nt, Homo sapiens
caggaggugcuaucgca

SEQ ID NO: 1236397 - RNA, 22 nt, Homo sapiens
caggagguggagguugcaguga

SEQ ID NO: 1236398 - RNA, 20 nt, Homo sapiens
caggaggugugaaugcacgu

SEQ ID NO: 1236399 - RNA, 21 nt, Homo sapiens
caggaggugugauuccugaag

SEQ ID NO: 1236400 - RNA, 21 nt, Homo sapiens
caggagucucugccacccacu

SEQ ID NO: 1236401 - RNA, 17 nt, Homo sapiens
caggagugguggaaccu

SEQ ID NO: 1236402 - RNA, 12 nt, Homo sapiens
caggaguucaag

SEQ ID NO: 1236403 - RNA, 23 nt, Homo sapiens
caggaguucucccaccaccucac

SEQ ID NO: 1236404 - RNA, 22 nt, Homo sapiens
caggaguuugaggcugcagcga

SEQ ID NO: 1236405 - RNA, 17 nt, Homo sapiens
caggauauccuuaucag

SEQ ID NO: 1236406 - RNA, 22 nt, Homo sapiens
caggaucaaaccccgaccaccu

SEQ ID NO: 1236407 - RNA, 18 nt, Homo sapiens
caggaucuuugacugaaa

SEQ ID NO: 1236408 - RNA, 12 nt, Homo sapiens
caggauggucau

SEQ ID NO: 1236409 - RNA, 20 nt, Homo sapiens
caggauggucucgaucuccu

SEQ ID NO: 1236410 - RNA, 14 nt, Homo sapiens
caggcaacgcacaa

SEQ ID NO: 1236411 - RNA, 18 nt, Homo sapiens
caggcaacgcacaaaaca

SEQ ID NO: 1236412 - RNA, 13 nt, Homo sapiens
caggcaagcaccu

SEQ ID NO: 1236413 - RNA, 18 nt, Homo sapiens
caggcacacagcuacucu

SEQ ID NO: 1236414 - RNA, 12 nt, Homo sapiens
caggcaccugcc

SEQ ID NO: 1236415 - RNA, 12 nt, Homo sapiens
caggcacgggug

SEQ ID NO: 1236416 - RNA, 12 nt, Homo sapiens
caggcacuccaa

SEQ ID NO: 1236417 - RNA, 15 nt, Homo sapiens
caggcacugcugccc

SEQ ID NO: 1236418 - RNA, 22 nt, Homo sapiens
caggcagacuacacaggaugag

SEQ ID NO: 1236419 - RNA, 14 nt, Homo sapiens
caggcagauuugag

SEQ ID NO: 1236420 - RNA, 12 nt, Homo sapiens
caggcaggagca

SEQ ID NO: 1236421 - RNA, 15 nt, Homo sapiens
caggcagggugagcu

SEQ ID NO: 1236422 - RNA, 18 nt, Homo sapiens
caggcaguggaagcaguu

SEQ ID NO: 1236423 - RNA, 21 nt, Homo sapiens
caggcaugaggaaucugggag

SEQ ID NO: 1236424 - RNA, 19 nt, Homo sapiens
caggcauggcgaggcugag

SEQ ID NO: 1236425 - RNA, 16 nt, Homo sapiens
caggccacaccacagc

SEQ ID NO: 1236426 - RNA, 17 nt, Homo sapiens
caggccaccaguuaaau

SEQ ID NO: 1236427 - RNA, 14 nt, Homo sapiens
caggccagcccagc

SEQ ID NO: 1236428 - RNA, 14 nt, Homo sapiens
caggccaggaccac

SEQ ID NO: 1236429 - RNA, 23 nt, Homo sapiens
caggccagggaaagcccguguca

SEQ ID NO: 1236430 - RNA, 18 nt, Homo sapiens
caggccagugaccucauu

SEQ ID NO: 1236431 - RNA, 14 nt, Homo sapiens
caggccagugucug

SEQ ID NO: 1236432 - RNA, 15 nt, Homo sapiens
caggccauacuuuac

SEQ ID NO: 1236433 - RNA, 14 nt, Homo sapiens
caggcccaagagau

SEQ ID NO: 1236434 - RNA, 13 nt, Homo sapiens
caggcccagagaa

SEQ ID NO: 1236435 - RNA, 14 nt, Homo sapiens
caggccccugccac

SEQ ID NO: 1236436 - RNA, 22 nt, Homo sapiens
caggcccuguccuaagcacuuu

SEQ ID NO: 1236437 - RNA, 18 nt, Homo sapiens
caggcccuuccucuccac

SEQ ID NO: 1236438 - RNA, 17 nt, Homo sapiens
caggccgcagcuccauu

SEQ ID NO: 1236439 - RNA, 19 nt, Homo sapiens
caggccggaaccacagggc

SEQ ID NO: 1236440 - RNA, 18 nt, Homo sapiens
caggccggccagccucac

SEQ ID NO: 1236441 - RNA, 14 nt, Homo sapiens
cagauaacucuccu

SEQ ID NO: 1236442 - RNA, 15 nt, Homo sapiens
cagauaaguuugcag

SEQ ID NO: 1236443 - RNA, 18 nt, Homo sapiens
cagauacauaucugugua

SEQ ID NO: 1236444 - RNA, 15 nt, Homo sapiens
cagauacaucacugc

SEQ ID NO: 1236445 - RNA, 19 nt, Homo sapiens
cagauauauuuaagccuua

SEQ ID NO: 1236446 - RNA, 19 nt, Homo sapiens
cagauaugauggaaugcau

SEQ ID NO: 1236447 - RNA, 12 nt, Homo sapiens
cagauauuucac

SEQ ID NO: 1236448 - RNA, 20 nt, Homo sapiens
cagaucaagaguuuuggaga

SEQ ID NO: 1236449 - RNA, 15 nt, Homo sapiens
cagaucaauuuguaa

SEQ ID NO: 1236450 - RNA, 19 nt, Homo sapiens
cagaucacugccacacucu

SEQ ID NO: 1236451 - RNA, 15 nt, Homo sapiens
cagauccagacugua

SEQ ID NO: 1236452 - RNA, 17 nt, Homo sapiens
cagauccagcagcugcu

SEQ ID NO: 1236453 - RNA, 15 nt, Homo sapiens
cagaucccacuggaa

SEQ ID NO: 1236454 - RNA, 11 nt, Homo sapiens
cagauccugca

SEQ ID NO: 1236455 - RNA, 16 nt, Homo sapiens
cagaucugaacacagu

SEQ ID NO: 1236456 - RNA, 16 nt, Homo sapiens
cagaucugugccccau

SEQ ID NO: 1236457 - RNA, 15 nt, Homo sapiens
cagaugaaaugcauc

SEQ ID NO: 1236458 - RNA, 17 nt, Homo sapiens
cagaugaccuuuuggaa

SEQ ID NO: 1236459 - RNA, 15 nt, Homo sapiens
cagaugauuguucaa

SEQ ID NO: 1236460 - RNA, 20 nt, Homo sapiens
cagaugccuacaaccauccc

SEQ ID NO: 1236461 - RNA, 17 nt, Homo sapiens
cagaugcuccaagauuc

SEQ ID NO: 1236462 - RNA, 17 nt, Homo sapiens
cagaugcugaauccccu

SEQ ID NO: 1236463 - RNA, 19 nt, Homo sapiens
cagauggaaaaacugaggc

SEQ ID NO: 1236464 - RNA, 22 nt, Homo sapiens
cagauggagguucucagagcca

SEQ ID NO: 1236465 - RNA, 14 nt, Homo sapiens
cagauggcacuuug

SEQ ID NO: 1236466 - RNA, 17 nt, Homo sapiens
cagauggcacuuugaag

SEQ ID NO: 1236467 - RNA, 16 nt, Homo sapiens
cagauggccccuccac

SEQ ID NO: 1236468 - RNA, 19 nt, Homo sapiens
cagaugggccuggccuuga

SEQ ID NO: 1236469 - RNA, 19 nt, Homo sapiens
cagauggggcacugaccca

SEQ ID NO: 1236470 - RNA, 19 nt, Homo sapiens
cagaugugaaaacaucuca

SEQ ID NO: 1236471 - RNA, 11 nt, Homo sapiens
cagaugugcau

SEQ ID NO: 1236472 - RNA, 21 nt, Homo sapiens
cagauucuguccucuucucug

SEQ ID NO: 1236473 - RNA, 13 nt, Homo sapiens
cagauucuuucag

SEQ ID NO: 1236474 - RNA, 17 nt, Homo sapiens
cagauuguuaucuauca

SEQ ID NO: 1236475 - RNA, 16 nt, Homo sapiens
cagauuuaaaaaaaga

SEQ ID NO: 1236476 - RNA, 20 nt, Homo sapiens
cagauuuaaaaaaagaacau

SEQ ID NO: 1236477 - RNA, 23 nt, Homo sapiens
cagauuuaaaaaaagaacauaaa

SEQ ID NO: 1236478 - RNA, 23 nt, Homo sapiens
cagauuuauuuuugaaacaaaca

SEQ ID NO: 1236479 - RNA, 14 nt, Homo sapiens
cagauuuguguuau

SEQ ID NO: 1236480 - RNA, 23 nt, Homo sapiens
cagauuuuaagggggaaaacugu

SEQ ID NO: 1236481 - RNA, 18 nt, Homo sapiens
cagauuuuuuccucugca

SEQ ID NO: 1236482 - RNA, 19 nt, Homo sapiens
cagauuuuuuccucugcau

SEQ ID NO: 1236483 - RNA, 16 nt, Homo sapiens
cagcaaaauguugaag

SEQ ID NO: 1236484 - RNA, 22 nt, Homo sapiens
cagcaaacaggugcuaauuugu

SEQ ID NO: 1236485 - RNA, 22 nt, Homo sapiens
cagcaaauaacagucugagacu

SEQ ID NO: 1236486 - RNA, 19 nt, Homo sapiens
cagcaacuucuucuccauc

SEQ ID NO: 1236487 - RNA, 17 nt, Homo sapiens
cagcaaggaaagcucac

SEQ ID NO: 1236488 - RNA, 18 nt, Homo sapiens
cagcaagugagagcuggg

SEQ ID NO: 1236489 - RNA, 21 nt, Homo sapiens
cagcaaugacaucucaggggc

SEQ ID NO: 1236490 - RNA, 16 nt, Homo sapiens
cagcaauuugauaaaa

SEQ ID NO: 1236491 - RNA, 20 nt, Homo sapiens
cagcacaccugccgucuuca

SEQ ID NO: 1236492 - RNA, 17 nt, Homo sapiens
cagcaccggccucggga

SEQ ID NO: 1236493 - RNA, 19 nt, Homo sapiens
cagcaccuucccucucacc

SEQ ID NO: 1236494 - RNA, 19 nt, Homo sapiens
cagcacucacgcaccggag

SEQ ID NO: 1236495 - RNA, 15 nt, Homo sapiens
cagcacucuuaucua

SEQ ID NO: 1236496 - RNA, 18 nt, Homo sapiens
cagcacuuguguugucug

SEQ ID NO: 1236497 - RNA, 13 nt, Homo sapiens
cagcacuuuggac

SEQ ID NO: 1236498 - RNA, 16 nt, Homo sapiens
cagcagagaagcugua

SEQ ID NO: 1236499 - RNA, 23 nt, Homo sapiens
cagcagagaagcuguaggacugu

SEQ ID NO: 1236500 - RNA, 16 nt, Homo sapiens
cagcagaggacagucu

SEQ ID NO: 1236501 - RNA, 22 nt, Homo sapiens
cagcagauguaguuucagacuu

SEQ ID NO: 1236502 - RNA, 17 nt, Homo sapiens
cagcagcaaauuuucag

SEQ ID NO: 1236503 - RNA, 12 nt, Homo sapiens
cagcagcacugu

SEQ ID NO: 1236504 - RNA, 22 nt, Homo sapiens
cagcagcuucaccagagcauuu

SEQ ID NO: 1236505 - RNA, 19 nt, Homo sapiens
cagcaggagagacugagca

SEQ ID NO: 1236506 - RNA, 18 nt, Homo sapiens
cagcaggagccagccaag

SEQ ID NO: 1236507 - RNA, 20 nt, Homo sapiens
cagcagggggagaaacccuu

SEQ ID NO: 1236508 - RNA, 15 nt, Homo sapiens
cagcaggugcucaau

SEQ ID NO: 1236509 - RNA, 13 nt, Homo sapiens
cagcagugccuug

SEQ ID NO: 1236510 - RNA, 15 nt, Homo sapiens
cagcagugccuugug

SEQ ID NO: 1236511 - RNA, 18 nt, Homo sapiens
cagcagugccuugugcaa

SEQ ID NO: 1236512 - RNA, 19 nt, Homo sapiens
cagcauacccuuacucugc

SEQ ID NO: 1236513 - RNA, 13 nt, Homo sapiens
cagcauacgucag

SEQ ID NO: 1236514 - RNA, 21 nt, Homo sapiens
cagcaugaaaaugcaguuucu

SEQ ID NO: 1236515 - RNA, 16 nt, Homo sapiens
cagcaugccugaacua

SEQ ID NO: 1236516 - RNA, 18 nt, Homo sapiens
cagcauguacggauuuuc

SEQ ID NO: 1236517 - RNA, 17 nt, Homo sapiens
cagcauucucacuccua

SEQ ID NO: 1236518 - RNA, 14 nt, Homo sapiens
cagcauugccuagg

SEQ ID NO: 1236519 - RNA, 16 nt, Homo sapiens
cagccaaaugcaggga

SEQ ID NO: 1236520 - RNA, 17 nt, Homo sapiens
cagccaaaugcagggag

SEQ ID NO: 1236521 - RNA, 14 nt, Homo sapiens
cagccaacugaaaa

SEQ ID NO: 1236522 - RNA, 19 nt, Homo sapiens
cagccacacccaggcacuu

SEQ ID NO: 1236523 - RNA, 17 nt, Homo sapiens
cagccacugcuuuacag

SEQ ID NO: 1236524 - RNA, 19 nt, Homo sapiens
cagccaggacaucucugcc

SEQ ID NO: 1236525 - RNA, 21 nt, Homo sapiens
cagccaggcagguccacagag

SEQ ID NO: 1236526 - RNA, 21 nt, Homo sapiens
cagccaggcuaugguugccac

SEQ ID NO: 1236527 - RNA, 13 nt, Homo sapiens
cagccagugccau

SEQ ID NO: 1236528 - RNA, 17 nt, Homo sapiens
cagccauaaaaccuggg

SEQ ID NO: 1236529 - RNA, 19 nt, Homo sapiens
cagccauaagaaagcacua

SEQ ID NO: 1236530 - RNA, 19 nt, Homo sapiens
cagccaucguccugggacu

SEQ ID NO: 1236531 - RNA, 23 nt, Homo sapiens
cagccaucguccugggacucgga

SEQ ID NO: 1236532 - RNA, 14 nt, Homo sapiens
cagccaugaaguca

SEQ ID NO: 1236533 - RNA, 21 nt, Homo sapiens
cagccaugcauuguuaaucau

SEQ ID NO: 1236534 - RNA, 18 nt, Homo sapiens
cagccauuaccauggaga

SEQ ID NO: 1236535 - RNA, 18 nt, Homo sapiens
cagccauuuguaaugaau

SEQ ID NO: 1236536 - RNA, 16 nt, Homo sapiens
cagcccaaaacccagg

SEQ ID NO: 1236537 - RNA, 18 nt, Homo sapiens
cagcccaaccuucacauc

SEQ ID NO: 1236538 - RNA, 17 nt, Homo sapiens
cagcccagacccagugg

SEQ ID NO: 1236539 - RNA, 17 nt, Homo sapiens
cagcccagagacuuugu

SEQ ID NO: 1236540 - RNA, 18 nt, Homo sapiens
cagcccauggcccccaau

SEQ ID NO: 1236541 - RNA, 19 nt, Homo sapiens
cagcccccuaaaagcacuc

SEQ ID NO: 1236542 - RNA, 16 nt, Homo sapiens
cagccccuccacguga

SEQ ID NO: 1236543 - RNA, 19 nt, Homo sapiens
cagcccugaggugaaaggg

SEQ ID NO: 1236544 - RNA, 14 nt, Homo sapiens
cagcccuugaggga

SEQ ID NO: 1236545 - RNA, 24 nt, Homo sapiens
cagccgggauuuugagaucaucag

SEQ ID NO: 1236546 - RNA, 18 nt, Homo sapiens
cagccuagacauccaggu

SEQ ID NO: 1236547 - RNA, 13 nt, Homo sapiens
cagccuaguuccu

SEQ ID NO: 1236548 - RNA, 16 nt, Homo sapiens
cagccuaugagcaucc

SEQ ID NO: 1236549 - RNA, 14 nt, Homo sapiens
cagccucagaggag

SEQ ID NO: 1236550 - RNA, 14 nt, Homo sapiens
cagccuccaacaca

SEQ ID NO: 1236551 - RNA, 17 nt, Homo sapiens
cagccucccaaagugcu

SEQ ID NO: 1236552 - RNA, 23 nt, Homo sapiens
cagccucccaaagugcugagauu

SEQ ID NO: 1236553 - RNA, 17 nt, Homo sapiens
cagccuccccgugccaa

SEQ ID NO: 1236554 - RNA, 19 nt, Homo sapiens
cagccucccgaauagcugg

SEQ ID NO: 1236555 - RNA, 19 nt, Homo sapiens
cagccucccgaguagcugg

SEQ ID NO: 1236556 - RNA, 17 nt, Homo sapiens
cagccucccuuugauga

SEQ ID NO: 1236557 - RNA, 16 nt, Homo sapiens
cagccuccuccugacc

SEQ ID NO: 1236558 - RNA, 18 nt, Homo sapiens
cagccucucaaguagcug

SEQ ID NO: 1236559 - RNA, 19 nt, Homo sapiens
cagccugaccaacaucgug

SEQ ID NO: 1236560 - RNA, 20 nt, Homo sapiens
cagccugcucuagugggaca

SEQ ID NO: 1236561 - RNA, 21 nt, Homo sapiens
cagccuggcuaacauggugaa

SEQ ID NO: 1236562 - RNA, 19 nt, Homo sapiens
cagccugggugacagagca

SEQ ID NO: 1236563 - RNA, 18 nt, Homo sapiens
cagccugucccauggaca

SEQ ID NO: 1236564 - RNA, 15 nt, Homo sapiens
cagccuucagucaca

SEQ ID NO: 1236565 - RNA, 16 nt, Homo sapiens
cagccuucagucacau

SEQ ID NO: 1236566 - RNA, 18 nt, Homo sapiens
cagccuucccaacaugcc

SEQ ID NO: 1236567 - RNA, 19 nt, Homo sapiens
cagcgaccuuccucaucca

SEQ ID NO: 1236568 - RNA, 13 nt, Homo sapiens
cccauuuccugua

SEQ ID NO: 1236569 - RNA, 23 nt, Homo sapiens
cccauuuuuaauugugagagauu

SEQ ID NO: 1236570 - RNA, 22 nt, Homo sapiens
ccccaaaccuggcaagucaccu

SEQ ID NO: 1236571 - RNA, 22 nt, Homo sapiens
ccccaaaguaccacacugaguu

SEQ ID NO: 1236572 - RNA, 20 nt, Homo sapiens
ccccaacaaaccauccagug

SEQ ID NO: 1236573 - RNA, 13 nt, Homo sapiens
ccccaaccacaga

SEQ ID NO: 1236574 - RNA, 18 nt, Homo sapiens
ccccaagauacucuuugu

SEQ ID NO: 1236575 - RNA, 18 nt, Homo sapiens
ccccaauaaaggcagcug

SEQ ID NO: 1236576 - RNA, 16 nt, Homo sapiens
ccccaauuacagggug

SEQ ID NO: 1236577 - RNA, 21 nt, Homo sapiens
ccccacaagccaggaccugcu

SEQ ID NO: 1236578 - RNA, 13 nt, Homo sapiens
ccccacaccccag

SEQ ID NO: 1236579 - RNA, 23 nt, Homo sapiens
ccccacagaaccuucaacccagu

SEQ ID NO: 1236580 - RNA, 17 nt, Homo sapiens
ccccacccaccccacag

SEQ ID NO: 1236581 - RNA, 20 nt, Homo sapiens
ccccacccaguuucuggaaa

SEQ ID NO: 1236582 - RNA, 15 nt, Homo sapiens
ccccacccuugagaa

SEQ ID NO: 1236583 - RNA, 11 nt, Homo sapiens
ccccaccuacu

SEQ ID NO: 1236584 - RNA, 22 nt, Homo sapiens
ccccaccugccauuugcacccu

SEQ ID NO: 1236585 - RNA, 15 nt, Homo sapiens
ccccacucuaccucc

SEQ ID NO: 1236586 - RNA, 19 nt, Homo sapiens
ccccacugccugucccaga

SEQ ID NO: 1236587 - RNA, 18 nt, Homo sapiens
ccccagaagcagccauaa

SEQ ID NO: 1236588 - RNA, 10 nt, Homo sapiens
ccccagagag

SEQ ID NO: 1236589 - RNA, 17 nt, Homo sapiens
ccccagagcaggagcuu

SEQ ID NO: 1236590 - RNA, 14 nt, Homo sapiens
ccccagagcuguuu

SEQ ID NO: 1236591 - RNA, 19 nt, Homo sapiens
ccccagauacauggugaug

SEQ ID NO: 1236592 - RNA, 15 nt, Homo sapiens
ccccagcaguugaau

SEQ ID NO: 1236593 - RNA, 17 nt, Homo sapiens
ccccagccccuagccca

SEQ ID NO: 1236594 - RNA, 22 nt, Homo sapiens
ccccagccucccaaagugcuaa

SEQ ID NO: 1236595 - RNA, 21 nt, Homo sapiens
ccccagccugcucccuagcca

SEQ ID NO: 1236596 - RNA, 23 nt, Homo sapiens
ccccagcuuugcccaacaccagc

SEQ ID NO: 1236597 - RNA, 18 nt, Homo sapiens
ccccaggagaacaucuuu

SEQ ID NO: 1236598 - RNA, 22 nt, Homo sapiens
ccccaggcccagugggguggcc

SEQ ID NO: 1236599 - RNA, 16 nt, Homo sapiens
ccccaggccuguccac

SEQ ID NO: 1236600 - RNA, 17 nt, Homo sapiens
ccccaggggucccagcc

SEQ ID NO: 1236601 - RNA, 15 nt, Homo sapiens
ccccaggucugggaa

SEQ ID NO: 1236602 - RNA, 23 nt, Homo sapiens
ccccagugcagggaaccgugaua

SEQ ID NO: 1236603 - RNA, 21 nt, Homo sapiens
ccccaucaucccagcugcucc

SEQ ID NO: 1236604 - RNA, 17 nt, Homo sapiens
ccccauccaacacugga

SEQ ID NO: 1236605 - RNA, 21 nt, Homo sapiens
ccccauccuucuccaccaaag

SEQ ID NO: 1236606 - RNA, 15 nt, Homo sapiens
ccccaugugccugca

SEQ ID NO: 1236607 - RNA, 21 nt, Homo sapiens
ccccauuuccuccucaucuga

SEQ ID NO: 1236608 - RNA, 20 nt, Homo sapiens
cccccaaccaucuucacugg

SEQ ID NO: 1236609 - RNA, 12 nt, Homo sapiens
cccccagcacuu

SEQ ID NO: 1236610 - RNA, 15 nt, Homo sapiens
cccccaggagaacau

SEQ ID NO: 1236611 - RNA, 16 nt, Homo sapiens
cccccaucccucggga

SEQ ID NO: 1236612 - RNA, 14 nt, Homo sapiens
cccccgccaccuca

SEQ ID NO: 1236613 - RNA, 21 nt, Homo sapiens
cccccuuccuuuggugccuca

SEQ ID NO: 1236614 - RNA, 22 nt, Homo sapiens
ccccgauugaaagaaccagaga

SEQ ID NO: 1236615 - RNA, 16 nt, Homo sapiens
ccccgcccagugcagu

SEQ ID NO: 1236616 - RNA, 21 nt, Homo sapiens
ccccgucgaggggcucucagc

SEQ ID NO: 1236617 - RNA, 22 nt, Homo sapiens
ccccgucucuauaccaaccaaa

SEQ ID NO: 1236618 - RNA, 15 nt, Homo sapiens
ccccgugacugcaau

SEQ ID NO: 1236619 - RNA, 14 nt, Homo sapiens
ccccuaagagccau

SEQ ID NO: 1236620 - RNA, 14 nt, Homo sapiens
ccccuacagaauuu

SEQ ID NO: 1236621 - RNA, 15 nt, Homo sapiens
ccccucacucuguca

SEQ ID NO: 1236622 - RNA, 16 nt, Homo sapiens
ccccucagaugaucuc

SEQ ID NO: 1236623 - RNA, 12 nt, Homo sapiens
ccccuccacugg

SEQ ID NO: 1236624 - RNA, 12 nt, Homo sapiens
ccccuccacugu

SEQ ID NO: 1236625 - RNA, 14 nt, Homo sapiens
ccccucccuggaug

SEQ ID NO: 1236626 - RNA, 21 nt, Homo sapiens
ccccucccuggaugacauuaa

SEQ ID NO: 1236627 - RNA, 16 nt, Homo sapiens
ccccuccggccugggc

SEQ ID NO: 1236628 - RNA, 17 nt, Homo sapiens
ccccucgugucagcuca

SEQ ID NO: 1236629 - RNA, 14 nt, Homo sapiens
ccccucucaccaaa

SEQ ID NO: 1236630 - RNA, 22 nt, Homo sapiens
ccccucuccugcccaagcacuu

SEQ ID NO: 1236631 - RNA, 15 nt, Homo sapiens
ccccucucugggcag

SEQ ID NO: 1236632 - RNA, 14 nt, Homo sapiens
ccccugcacaguug

SEQ ID NO: 1236633 - RNA, 18 nt, Homo sapiens
ccccuggaucuaccagca

SEQ ID NO: 1236634 - RNA, 19 nt, Homo sapiens
ccccuggaucuaccagcau

SEQ ID NO: 1236635 - RNA, 23 nt, Homo sapiens
ccccuggcuccagagauggucac

SEQ ID NO: 1236636 - RNA, 23 nt, Homo sapiens
ccccuggggcuucuccugaccca

SEQ ID NO: 1236637 - RNA, 20 nt, Homo sapiens
ccccuguagacuagugccgu

SEQ ID NO: 1236638 - RNA, 23 nt, Homo sapiens
ccccugucauccucaugcugcuc

SEQ ID NO: 1236639 - RNA, 16 nt, Homo sapiens
ccccuuauuugcacuu

SEQ ID NO: 1236640 - RNA, 14 nt, Homo sapiens
ccccuugggugacc

SEQ ID NO: 1236641 - RNA, 14 nt, Homo sapiens
ccccuuguccuuuc

SEQ ID NO: 1236642 - RNA, 14 nt, Homo sapiens
cccgaaaugccacg

SEQ ID NO: 1236643 - RNA, 12 nt, Homo sapiens
cccgaagccacc

SEQ ID NO: 1236644 - RNA, 13 nt, Homo sapiens
cccgacagccugg

SEQ ID NO: 1236645 - RNA, 14 nt, Homo sapiens
cccgagaagcacuu

SEQ ID NO: 1236646 - RNA, 21 nt, Homo sapiens
cccgccaccucagggcacgca

SEQ ID NO: 1236647 - RNA, 14 nt, Homo sapiens
cccgccugcagucu

SEQ ID NO: 1236648 - RNA, 22 nt, Homo sapiens
cccggacauacucucugccugg

SEQ ID NO: 1236649 - RNA, 16 nt, Homo sapiens
cccggggccagcacuu

SEQ ID NO: 1236650 - RNA, 17 nt, Homo sapiens
cccggggcuggugggcc

SEQ ID NO: 1236651 - RNA, 16 nt, Homo sapiens
cccggggugaguccau

SEQ ID NO: 1236652 - RNA, 16 nt, Homo sapiens
cccgucauguuccuca

SEQ ID NO: 1236653 - RNA, 15 nt, Homo sapiens
cccguccacagggca

SEQ ID NO: 1236654 - RNA, 22 nt, Homo sapiens
cccguggucuccuugcacuuuc

SEQ ID NO: 1236655 - RNA, 19 nt, Homo sapiens
cccguuccugacaucacag

SEQ ID NO: 1236656 - RNA, 23 nt, Homo sapiens
cccuaaagaaugcaaccuaguca

SEQ ID NO: 1236657 - RNA, 10 nt, Homo sapiens
cccuaaggga

SEQ ID NO: 1236658 - RNA, 16 nt, Homo sapiens
cccuacacaaaauaca

SEQ ID NO: 1236659 - RNA, 23 nt, Homo sapiens
cccuacacaaaauacagcacuuu

SEQ ID NO: 1236660 - RNA, 12 nt, Homo sapiens
cccuacagaauu

SEQ ID NO: 1236661 - RNA, 11 nt, Homo sapiens
cccuacaugga

SEQ ID NO: 1236662 - RNA, 21 nt, Homo sapiens
cccuacauuaguaaaaauaaa

SEQ ID NO: 1236663 - RNA, 14 nt, Homo sapiens
cccuacccacuucc

SEQ ID NO: 1236664 - RNA, 18 nt, Homo sapiens
cccuacuauucaguggcg

SEQ ID NO: 1236665 - RNA, 15 nt, Homo sapiens
cccuacuccacugcc

SEQ ID NO: 1236666 - RNA, 16 nt, Homo sapiens
cccuagccaaugucuc

SEQ ID NO: 1236667 - RNA, 19 nt, Homo sapiens
cccuagccuugcuuguuaa

SEQ ID NO: 1236668 - RNA, 20 nt, Homo sapiens
cccuaggaaacucacacucc

SEQ ID NO: 1236669 - RNA, 17 nt, Homo sapiens
cccuauccuuggcacca

SEQ ID NO: 1236670 - RNA, 22 nt, Homo sapiens
cccuaugaaaaauguguuccau

SEQ ID NO: 1236671 - RNA, 17 nt, Homo sapiens
cccuauggagaauuuau

SEQ ID NO: 1236672 - RNA, 15 nt, Homo sapiens
cccuauuuuugcaau

SEQ ID NO: 1236673 - RNA, 13 nt, Homo sapiens
cccucaaccuccu

SEQ ID NO: 1236674 - RNA, 19 nt, Homo sapiens
cccucaaccuccuguggaa

SEQ ID NO: 1236675 - RNA, 23 nt, Homo sapiens
cccucacacuuugccauuugcuu

SEQ ID NO: 1236676 - RNA, 15 nt, Homo sapiens
cccucacuguugaau

SEQ ID NO: 1236677 - RNA, 22 nt, Homo sapiens
cccucauuuaaacccaaucaga

SEQ ID NO: 1236678 - RNA, 10 nt, Homo sapiens
cccuccaaag

SEQ ID NO: 1236679 - RNA, 21 nt, Homo sapiens
cccuccaagucuguaccucaa

SEQ ID NO: 1236680 - RNA, 16 nt, Homo sapiens
cccuccacaccagugg

SEQ ID NO: 1236681 - RNA, 22 nt, Homo sapiens
cccuccaccgccacuaugggcc

SEQ ID NO: 1236682 - RNA, 15 nt, Homo sapiens
cccuccccuccaucc

SEQ ID NO: 1236683 - RNA, 18 nt, Homo sapiens
cccucccuggaugacauu

SEQ ID NO: 1236684 - RNA, 20 nt, Homo sapiens
cccucccuggaugacauuaa

SEQ ID NO: 1236685 - RNA, 14 nt, Homo sapiens
cccuccgaccacuu

SEQ ID NO: 1236686 - RNA, 21 nt, Homo sapiens
cccuccgguuaucaagcaaaa

SEQ ID NO: 1236687 - RNA, 18 nt, Homo sapiens
cccuccuggcucuugaua

SEQ ID NO: 1236688 - RNA, 23 nt, Homo sapiens
cccucgacaagaccacacuuugg

SEQ ID NO: 1236689 - RNA, 21 nt, Homo sapiens
cccucgucaucaggugcauag

SEQ ID NO: 1236690 - RNA, 17 nt, Homo sapiens
cccucgugcgcaucuca

SEQ ID NO: 1236691 - RNA, 21 nt, Homo sapiens
cccucguggccagcccggcug

SEQ ID NO: 1236692 - RNA, 19 nt, Homo sapiens
cccucuagaaauuuuucag

SEQ ID NO: 1236693 - RNA, 16 nt, Homo sapiens
cccucucauucucacu

SEQ ID NO: 1236694 - RNA, 21 nt, Homo sapiens
cccucuccugcccaagcacuu

SEQ ID NO: 1236695 - RNA, 15 nt, Homo sapiens
cacucagaacccagg

SEQ ID NO: 1236696 - RNA, 21 nt, Homo sapiens
cacucaggccaacaagccaac

SEQ ID NO: 1236697 - RNA, 16 nt, Homo sapiens
cacucagggagcauuu

SEQ ID NO: 1236698 - RNA, 18 nt, Homo sapiens
cacucagguucuucaggg

SEQ ID NO: 1236699 - RNA, 22 nt, Homo sapiens
cacucagguucuucagggccag

SEQ ID NO: 1236700 - RNA, 17 nt, Homo sapiens
cacucagugcagcaaua

SEQ ID NO: 1236701 - RNA, 21 nt, Homo sapiens
cacuccaggauauugacaaga

SEQ ID NO: 1236702 - RNA, 16 nt, Homo sapiens
cacuccagucuggcaa

SEQ ID NO: 1236703 - RNA, 15 nt, Homo sapiens
cacuccauguuugca

SEQ ID NO: 1236704 - RNA, 21 nt, Homo sapiens
cacuccccagagcugugccag

SEQ ID NO: 1236705 - RNA, 23 nt, Homo sapiens
cacucccuaauuuaugugcuaua

SEQ ID NO: 1236706 - RNA, 15 nt, Homo sapiens
cacucccuccaucaa

SEQ ID NO: 1236707 - RNA, 22 nt, Homo sapiens
cacucccuguagugaauccucu

SEQ ID NO: 1236708 - RNA, 23 nt, Homo sapiens
cacuccguccauccgacugcccc

SEQ ID NO: 1236709 - RNA, 14 nt, Homo sapiens
cacuccugaacccc

SEQ ID NO: 1236710 - RNA, 15 nt, Homo sapiens
cacuccuuuuuugca

SEQ ID NO: 1236711 - RNA, 19 nt, Homo sapiens
cacuccuuuuuugcaugug

SEQ ID NO: 1236712 - RNA, 16 nt, Homo sapiens
cacucucagugcuucu

SEQ ID NO: 1236713 - RNA, 21 nt, Homo sapiens
cacucuccaaacagucaccau

SEQ ID NO: 1236714 - RNA, 20 nt, Homo sapiens
cacucucccaccuccuggug

SEQ ID NO: 1236715 - RNA, 16 nt, Homo sapiens
cacucucuucccuuuc

SEQ ID NO: 1236716 - RNA, 14 nt, Homo sapiens
cacucugaaacuga

SEQ ID NO: 1236717 - RNA, 11 nt, Homo sapiens
cacucugucac

SEQ ID NO: 1236718 - RNA, 18 nt, Homo sapiens
cacucugucacccaggcu

SEQ ID NO: 1236719 - RNA, 22 nt, Homo sapiens
cacucuuaucuacauaaggaug

SEQ ID NO: 1236720 - RNA, 14 nt, Homo sapiens
cacucuuguaauaa

SEQ ID NO: 1236721 - RNA, 16 nt, Homo sapiens
cacucuuuugcuuuau

SEQ ID NO: 1236722 - RNA, 21 nt, Homo sapiens
cacugaccuuggagagacaca

SEQ ID NO: 1236723 - RNA, 15 nt, Homo sapiens
cacugacucaagaca

SEQ ID NO: 1236724 - RNA, 16 nt, Homo sapiens
cacugacuccugugga

SEQ ID NO: 1236725 - RNA, 22 nt, Homo sapiens
cacugagaagucaaacauuuca

SEQ ID NO: 1236726 - RNA, 13 nt, Homo sapiens
cacugagggccac

SEQ ID NO: 1236727 - RNA, 18 nt, Homo sapiens
cacugaggguggcacuca

SEQ ID NO: 1236728 - RNA, 13 nt, Homo sapiens
cacugaguucuau

SEQ ID NO: 1236729 - RNA, 20 nt, Homo sapiens
cacugaucacccaaugcauc

SEQ ID NO: 1236730 - RNA, 18 nt, Homo sapiens
cacugcaauccugucuuu

SEQ ID NO: 1236731 - RNA, 19 nt, Homo sapiens
cacugcacuauagccuagg

SEQ ID NO: 1236732 - RNA, 21 nt, Homo sapiens
cacugcacucaaccuuaagac

SEQ ID NO: 1236733 - RNA, 14 nt, Homo sapiens
cacugcagugcuga

SEQ ID NO: 1236734 - RNA, 14 nt, Homo sapiens
cacugccagcaucu

SEQ ID NO: 1236735 - RNA, 19 nt, Homo sapiens
cacugccaggccagccucc

SEQ ID NO: 1236736 - RNA, 19 nt, Homo sapiens
cacugccccagacacagug

SEQ ID NO: 1236737 - RNA, 18 nt, Homo sapiens
cacugcccccuccacugg

SEQ ID NO: 1236738 - RNA, 23 nt, Homo sapiens
cacugcccucuuguggugcauug

SEQ ID NO: 1236739 - RNA, 9 nt, Homo sapiens
cacugccuc

SEQ ID NO: 1236740 - RNA, 18 nt, Homo sapiens
cacugccugucccagaga

SEQ ID NO: 1236741 - RNA, 17 nt, Homo sapiens
cacugcucucuguggug

SEQ ID NO: 1236742 - RNA, 21 nt, Homo sapiens
cacugcuggguuuuacaucca

SEQ ID NO: 1236743 - RNA, 13 nt, Homo sapiens
cacugcuuuacag

SEQ ID NO: 1236744 - RNA, 20 nt, Homo sapiens
cacuggcaucucacuuuaug

SEQ ID NO: 1236745 - RNA, 22 nt, Homo sapiens
cacuggccccucaaaucgucca

SEQ ID NO: 1236746 - RNA, 17 nt, Homo sapiens
cacuggcguuacugcuu

SEQ ID NO: 1236747 - RNA, 17 nt, Homo sapiens
cacugggacccucagcc

SEQ ID NO: 1236748 - RNA, 21 nt, Homo sapiens
cacugggugagagaggaauaa

SEQ ID NO: 1236749 - RNA, 19 nt, Homo sapiens
cacugguuuguucccugug

SEQ ID NO: 1236750 - RNA, 18 nt, Homo sapiens
cacuguaagacucauucc

SEQ ID NO: 1236751 - RNA, 22 nt, Homo sapiens
cacuguacaccauaguuuacaa

SEQ ID NO: 1236752 - RNA, 11 nt, Homo sapiens
cacuguacuua

SEQ ID NO: 1236753 - RNA, 19 nt, Homo sapiens
cacuguauauaaacauauc

SEQ ID NO: 1236754 - RNA, 17 nt, Homo sapiens
cacuguaugauuuauaa

SEQ ID NO: 1236755 - RNA, 12 nt, Homo sapiens
cacuguccagua

SEQ ID NO: 1236756 - RNA, 19 nt, Homo sapiens
cacugucuccuuucucuua

SEQ ID NO: 1236757 - RNA, 15 nt, Homo sapiens
cacugugaaaccccc

SEQ ID NO: 1236758 - RNA, 21 nt, Homo sapiens
cacugugacaaaagccagcau

SEQ ID NO: 1236759 - RNA, 19 nt, Homo sapiens
cacugugccaugugccagg

SEQ ID NO: 1236760 - RNA, 22 nt, Homo sapiens
cacugugcuaauaacagugcau

SEQ ID NO: 1236761 - RNA, 17 nt, Homo sapiens
cacugugcucagauucc

SEQ ID NO: 1236762 - RNA, 21 nt, Homo sapiens
cacuguggcauugucuguaau

SEQ ID NO: 1236763 - RNA, 18 nt, Homo sapiens
cacuguguacaccucaaa

SEQ ID NO: 1236764 - RNA, 13 nt, Homo sapiens
cacuguuagcuuu

SEQ ID NO: 1236765 - RNA, 22 nt, Homo sapiens
cacuguugcaaacucagugcaa

SEQ ID NO: 1236766 - RNA, 17 nt, Homo sapiens
cacuguugcccaggcug

SEQ ID NO: 1236767 - RNA, 15 nt, Homo sapiens
cacuguugucaaaaa

SEQ ID NO: 1236768 - RNA, 16 nt, Homo sapiens
cacuguuuuuuuccca

SEQ ID NO: 1236769 - RNA, 18 nt, Homo sapiens
cacuuaaaaaauguccau

SEQ ID NO: 1236770 - RNA, 20 nt, Homo sapiens
cacuuaaaaaauguccauga

SEQ ID NO: 1236771 - RNA, 21 nt, Homo sapiens
cacuuaaagccuuuuccugaa

SEQ ID NO: 1236772 - RNA, 15 nt, Homo sapiens
cacuuaaccauucca

SEQ ID NO: 1236773 - RNA, 17 nt, Homo sapiens
cacuuaagacuguguau

SEQ ID NO: 1236774 - RNA, 13 nt, Homo sapiens
cacuuaauagcaa

SEQ ID NO: 1236775 - RNA, 22 nt, Homo sapiens
cacuuaauuuguaaacuucuga

SEQ ID NO: 1236776 - RNA, 19 nt, Homo sapiens
cacuuaguccuuuaucauc

SEQ ID NO: 1236777 - RNA, 19 nt, Homo sapiens
cacuuauucuguauugcca

SEQ ID NO: 1236778 - RNA, 21 nt, Homo sapiens
cacuucaaggcucaaugcuau

SEQ ID NO: 1236779 - RNA, 18 nt, Homo sapiens
cacuucaguuuaaugucu

SEQ ID NO: 1236780 - RNA, 16 nt, Homo sapiens
cacuucccuacaugga

SEQ ID NO: 1236781 - RNA, 19 nt, Homo sapiens
cacuuccuuuuaccugccc

SEQ ID NO: 1236782 - RNA, 18 nt, Homo sapiens
cacuucuaugcaaaugcc

SEQ ID NO: 1236783 - RNA, 11 nt, Homo sapiens
cacuugauguu

SEQ ID NO: 1236784 - RNA, 15 nt, Homo sapiens
cacuugcaugaauua

SEQ ID NO: 1236785 - RNA, 17 nt, Homo sapiens
cacuugcauguacagag

SEQ ID NO: 1236786 - RNA, 17 nt, Homo sapiens
cacuugcccuguucucu

SEQ ID NO: 1236787 - RNA, 13 nt, Homo sapiens
cacuuggaugcag

SEQ ID NO: 1236788 - RNA, 10 nt, Homo sapiens
cacuuggcca

SEQ ID NO: 1236789 - RNA, 22 nt, Homo sapiens
cacuuguuauucgaaccacuga

SEQ ID NO: 1236790 - RNA, 18 nt, Homo sapiens
cacuuuaccucuguggac

SEQ ID NO: 1236791 - RNA, 20 nt, Homo sapiens
cacuuuaccucuguggaccu

SEQ ID NO: 1236792 - RNA, 17 nt, Homo sapiens
cacuuucauugccagug

SEQ ID NO: 1236793 - RNA, 19 nt, Homo sapiens
cacuuugagaagcugaggu

SEQ ID NO: 1236794 - RNA, 18 nt, Homo sapiens
cacuuuggacauggcuca

SEQ ID NO: 1236795 - RNA, 20 nt, Homo sapiens
cacuuugggaggcugaggcg

SEQ ID NO: 1236796 - RNA, 15 nt, Homo sapiens
cacuuuguccauuug

SEQ ID NO: 1236797 - RNA, 18 nt, Homo sapiens
cacuuuugcuugaauuua

SEQ ID NO: 1236798 - RNA, 18 nt, Homo sapiens
cacuuuuuaaaaucucaa

SEQ ID NO: 1236799 - RNA, 20 nt, Homo sapiens
cagaaaaacucugggaaaua

SEQ ID NO: 1236800 - RNA, 18 nt, Homo sapiens
cagaaaaaugguggucau

SEQ ID NO: 1236801 - RNA, 14 nt, Homo sapiens
cagaaaaaugucau

SEQ ID NO: 1236802 - RNA, 14 nt, Homo sapiens
cagaaaacaaaaaa

SEQ ID NO: 1236803 - RNA, 13 nt, Homo sapiens
cagaaaacagaga

SEQ ID NO: 1236804 - RNA, 20 nt, Homo sapiens
cagaaaagaaaauauaguuu

SEQ ID NO: 1236805 - RNA, 22 nt, Homo sapiens
cagaaaagcaauacuguuucca

SEQ ID NO: 1236806 - RNA, 15 nt, Homo sapiens
cagaaaagugacagu

SEQ ID NO: 1236807 - RNA, 14 nt, Homo sapiens
cagaaaaugagggc

SEQ ID NO: 1236808 - RNA, 18 nt, Homo sapiens
cagaaacaaaaacacuaa

SEQ ID NO: 1236809 - RNA, 18 nt, Homo sapiens
cagaaacacacagucaca

SEQ ID NO: 1236810 - RNA, 23 nt, Homo sapiens
cagaaacacacagucacauucga

SEQ ID NO: 1236811 - RNA, 22 nt, Homo sapiens
cagaaacagugggagcccugac

SEQ ID NO: 1236812 - RNA, 20 nt, Homo sapiens
cagaaaccaguuaugugaau

SEQ ID NO: 1236813 - RNA, 20 nt, Homo sapiens
cagaaacuugugaaguggaa

SEQ ID NO: 1236814 - RNA, 15 nt, Homo sapiens
cagaaagauuuuccu

SEQ ID NO: 1236815 - RNA, 17 nt, Homo sapiens
cagaaagggaacagaaa

SEQ ID NO: 1236816 - RNA, 22 nt, Homo sapiens
cagaaaugcaaggggcugcaug

SEQ ID NO: 1236817 - RNA, 23 nt, Homo sapiens
cagaaauggugcucaccaugcuu

SEQ ID NO: 1236818 - RNA, 21 nt, Homo sapiens
cagaaaugucuaaaugcugaa

SEQ ID NO: 1236819 - RNA, 17 nt, Homo sapiens
cagaacaucgauaugua

SEQ ID NO: 1236820 - RNA, 23 nt, Homo sapiens
cagaaccauccauaguaguauga

SEQ ID NO: 1236821 - RNA, 17 nt, Homo sapiens
ccaggguacccgccuga

SEQ ID NO: 1236822 - RNA, 21 nt, Homo sapiens
ccagggugauuuuaugaucag

SEQ ID NO: 1236823 - RNA, 21 nt, Homo sapiens
ccagguacaggagaggcagca

SEQ ID NO: 1236824 - RNA, 15 nt, Homo sapiens
ccagguaccacccuu

SEQ ID NO: 1236825 - RNA, 17 nt, Homo sapiens
ccagguccauuuugccu

SEQ ID NO: 1236826 - RNA, 22 nt, Homo sapiens
ccagguguucuacacucaucuu

SEQ ID NO: 1236827 - RNA, 14 nt, Homo sapiens
ccagguuagcacag

SEQ ID NO: 1236828 - RNA, 13 nt, Homo sapiens
ccagguucacuuu

SEQ ID NO: 1236829 - RNA, 22 nt, Homo sapiens
ccagguucucuuagagccauau

SEQ ID NO: 1236830 - RNA, 18 nt, Homo sapiens
ccagguuuaugaaugaca

SEQ ID NO: 1236831 - RNA, 16 nt, Homo sapiens
ccaguaauugguccga

SEQ ID NO: 1236832 - RNA, 13 nt, Homo sapiens
ccaguacauuuaa

SEQ ID NO: 1236833 - RNA, 13 nt, Homo sapiens
ccaguaucgcuca

SEQ ID NO: 1236834 - RNA, 23 nt, Homo sapiens
ccagucaugagcguuagacugac

SEQ ID NO: 1236835 - RNA, 19 nt, Homo sapiens
ccaguccagauauuucaca

SEQ ID NO: 1236836 - RNA, 20 nt, Homo sapiens
ccaguccagauauuucacau

SEQ ID NO: 1236837 - RNA, 21 nt, Homo sapiens
ccagucccagacaauuccauu

SEQ ID NO: 1236838 - RNA, 14 nt, Homo sapiens
ccaguccuccagac

SEQ ID NO: 1236839 - RNA, 15 nt, Homo sapiens
ccagucucaccuuca

SEQ ID NO: 1236840 - RNA, 16 nt, Homo sapiens
ccagucucugccagac

SEQ ID NO: 1236841 - RNA, 20 nt, Homo sapiens
ccagucucuuguacagcguu

SEQ ID NO: 1236842 - RNA, 19 nt, Homo sapiens
ccagucuuccugacacuuu

SEQ ID NO: 1236843 - RNA, 20 nt, Homo sapiens
ccagucuugucauugccagc

SEQ ID NO: 1236844 - RNA, 19 nt, Homo sapiens
ccagugacaaggcccugag

SEQ ID NO: 1236845 - RNA, 19 nt, Homo sapiens
ccagugagauuacagagga

SEQ ID NO: 1236846 - RNA, 18 nt, Homo sapiens
ccagugaugugugagcua

SEQ ID NO: 1236847 - RNA, 15 nt, Homo sapiens
ccagugcaacagcac

SEQ ID NO: 1236848 - RNA, 13 nt, Homo sapiens
ccagugcagggaa

SEQ ID NO: 1236849 - RNA, 15 nt, Homo sapiens
ccagugcuccaggca

SEQ ID NO: 1236850 - RNA, 14 nt, Homo sapiens
ccagugcugcugua

SEQ ID NO: 1236851 - RNA, 20 nt, Homo sapiens
ccagugcuguccaugcuucu

SEQ ID NO: 1236852 - RNA, 13 nt, Homo sapiens
ccaguggacucuu

SEQ ID NO: 1236853 - RNA, 14 nt, Homo sapiens
ccaguggaugccac

SEQ ID NO: 1236854 - RNA, 18 nt, Homo sapiens
ccagugggcugaugcugg

SEQ ID NO: 1236855 - RNA, 21 nt, Homo sapiens
ccaguguaucaggucagggac

SEQ ID NO: 1236856 - RNA, 13 nt, Homo sapiens
ccagugucauccg

SEQ ID NO: 1236857 - RNA, 16 nt, Homo sapiens
ccaguguggaaccacu

SEQ ID NO: 1236858 - RNA, 18 nt, Homo sapiens
ccagugugggcuugacca

SEQ ID NO: 1236859 - RNA, 14 nt, Homo sapiens
ccaguguucuauga

SEQ ID NO: 1236860 - RNA, 18 nt, Homo sapiens
ccaguguuguuuguaaau

SEQ ID NO: 1236861 - RNA, 22 nt, Homo sapiens
ccaguuccucuuuugugcugcu

SEQ ID NO: 1236862 - RNA, 19 nt, Homo sapiens
ccaguugaucaaugaauaa

SEQ ID NO: 1236863 - RNA, 17 nt, Homo sapiens
ccaguuucagcucacuu

SEQ ID NO: 1236864 - RNA, 11 nt, Homo sapiens
ccaguuugcac

SEQ ID NO: 1236865 - RNA, 20 nt, Homo sapiens
ccaguuugcaccugucccca

SEQ ID NO: 1236866 - RNA, 19 nt, Homo sapiens
ccaguuuuuguuuuugcau

SEQ ID NO: 1236867 - RNA, 20 nt, Homo sapiens
ccauaaacgguuccugguga

SEQ ID NO: 1236868 - RNA, 13 nt, Homo sapiens
ccauaaccauuau

SEQ ID NO: 1236869 - RNA, 14 nt, Homo sapiens
ccauaacuugaaaa

SEQ ID NO: 1236870 - RNA, 13 nt, Homo sapiens
ccauaauguuaca

SEQ ID NO: 1236871 - RNA, 15 nt, Homo sapiens
ccauaauuauuauuu

SEQ ID NO: 1236872 - RNA, 23 nt, Homo sapiens
ccauaauucuaaguuauuuacuu

SEQ ID NO: 1236873 - RNA, 19 nt, Homo sapiens
ccauacuuugucugaaaaa

SEQ ID NO: 1236874 - RNA, 13 nt, Homo sapiens
ccauagaaacaug

SEQ ID NO: 1236875 - RNA, 22 nt, Homo sapiens
ccauagaaacaugacacugacc

SEQ ID NO: 1236876 - RNA, 15 nt, Homo sapiens
ccauagcuacaucag

SEQ ID NO: 1236877 - RNA, 16 nt, Homo sapiens
ccauaguaccauuuau

SEQ ID NO: 1236878 - RNA, 19 nt, Homo sapiens
ccauagucagcagcagcuc

SEQ ID NO: 1236879 - RNA, 23 nt, Homo sapiens
ccauauaccaucuccagcuauuu

SEQ ID NO: 1236880 - RNA, 18 nt, Homo sapiens
ccauauauaacagauaca

SEQ ID NO: 1236881 - RNA, 22 nt, Homo sapiens
ccauaucuugcgaauccaagcu

SEQ ID NO: 1236882 - RNA, 19 nt, Homo sapiens
ccauauuuaauaaagcaca

SEQ ID NO: 1236883 - RNA, 18 nt, Homo sapiens
ccauauuuuacugaucuc

SEQ ID NO: 1236884 - RNA, 12 nt, Homo sapiens
ccaucaucccag

SEQ ID NO: 1236885 - RNA, 23 nt, Homo sapiens
ccaucaugggcuggacauuggac

SEQ ID NO: 1236886 - RNA, 12 nt, Homo sapiens
ccauccaaauaa

SEQ ID NO: 1236887 - RNA, 15 nt, Homo sapiens
ccauccaacacugga

SEQ ID NO: 1236888 - RNA, 13 nt, Homo sapiens
ccauccaguuccu

SEQ ID NO: 1236889 - RNA, 18 nt, Homo sapiens
ccauccccucacuauucc

SEQ ID NO: 1236890 - RNA, 22 nt, Homo sapiens
ccaucccuuuuuuuacauuuca

SEQ ID NO: 1236891 - RNA, 11 nt, Homo sapiens
ccauccucacc

SEQ ID NO: 1236892 - RNA, 16 nt, Homo sapiens
ccauccuguauucuuc

SEQ ID NO: 1236893 - RNA, 23 nt, Homo sapiens
ccaucgaccuggagacugacaac

SEQ ID NO: 1236894 - RNA, 17 nt, Homo sapiens
ccaucgcaggaugacag

SEQ ID NO: 1236895 - RNA, 22 nt, Homo sapiens
ccaucguccuuccucucaagcu

SEQ ID NO: 1236896 - RNA, 21 nt, Homo sapiens
ccaucuaaugcuuguuuauga

SEQ ID NO: 1236897 - RNA, 14 nt, Homo sapiens
ccaucuagucacaa

SEQ ID NO: 1236898 - RNA, 15 nt, Homo sapiens
ccaucucgggcacag

SEQ ID NO: 1236899 - RNA, 22 nt, Homo sapiens
ccaucucuacugaaaguacaaa

SEQ ID NO: 1236900 - RNA, 15 nt, Homo sapiens
ccaucuucacuggcu

SEQ ID NO: 1236901 - RNA, 13 nt, Homo sapiens
ccaucuugaucug

SEQ ID NO: 1236902 - RNA, 19 nt, Homo sapiens
ccaucuugguucuagccgc

SEQ ID NO: 1236903 - RNA, 22 nt, Homo sapiens
ccaucuuuugugagauguaauu

SEQ ID NO: 1236904 - RNA, 23 nt, Homo sapiens
ccaucuuuugugagauguaauug

SEQ ID NO: 1236905 - RNA, 23 nt, Homo sapiens
ccaugaacaucuuuagugucuga

SEQ ID NO: 1236906 - RNA, 19 nt, Homo sapiens
ccaugaagcgaaacacaga

SEQ ID NO: 1236907 - RNA, 23 nt, Homo sapiens
ccaugacgacauacaugcuacuu

SEQ ID NO: 1236908 - RNA, 23 nt, Homo sapiens
ccaugacuggcugucugccugua

SEQ ID NO: 1236909 - RNA, 19 nt, Homo sapiens
ccaugacugugaccaccuu

SEQ ID NO: 1236910 - RNA, 11 nt, Homo sapiens
ccaugagacac

SEQ ID NO: 1236911 - RNA, 23 nt, Homo sapiens
ccaugagagaaggaggggagcag

SEQ ID NO: 1236912 - RNA, 13 nt, Homo sapiens
ccaugcacucaaa

SEQ ID NO: 1236913 - RNA, 21 nt, Homo sapiens
ccaugcagccgcaccagagag

SEQ ID NO: 1236914 - RNA, 10 nt, Homo sapiens
ccaugccacc

SEQ ID NO: 1236915 - RNA, 20 nt, Homo sapiens
ccaugccacccuguuuucag

SEQ ID NO: 1236916 - RNA, 22 nt, Homo sapiens
ccaugcgugccgccugcuccuc

SEQ ID NO: 1236917 - RNA, 21 nt, Homo sapiens
ccaugcguguuucugacucug

SEQ ID NO: 1236918 - RNA, 12 nt, Homo sapiens
ccaugcugccag

SEQ ID NO: 1236919 - RNA, 19 nt, Homo sapiens
ccaugcuucucaucugcaa

SEQ ID NO: 1236920 - RNA, 14 nt, Homo sapiens
ccauggacacucca

SEQ ID NO: 1236921 - RNA, 21 nt, Homo sapiens
ccauggaggccagugccagca

SEQ ID NO: 1236922 - RNA, 21 nt, Homo sapiens
ccauggauacccaucacuuug

SEQ ID NO: 1236923 - RNA, 19 nt, Homo sapiens
ccauggcaccuucagacuu

SEQ ID NO: 1236924 - RNA, 11 nt, Homo sapiens
ccauggcacug

SEQ ID NO: 1236925 - RNA, 14 nt, Homo sapiens
ccauggcacugaca

SEQ ID NO: 1236926 - RNA, 16 nt, Homo sapiens
ccauggcacugacaau

SEQ ID NO: 1236927 - RNA, 18 nt, Homo sapiens
ccauggcacugacaaugg

SEQ ID NO: 1236928 - RNA, 22 nt, Homo sapiens
ccauggcccccaauaaaggcag

SEQ ID NO: 1236929 - RNA, 23 nt, Homo sapiens
ccaugguagccuuagggugcuga

SEQ ID NO: 1236930 - RNA, 16 nt, Homo sapiens
ccauggugacauugug

SEQ ID NO: 1236931 - RNA, 14 nt, Homo sapiens
ccauggugagcucu

SEQ ID NO: 1236932 - RNA, 14 nt, Homo sapiens
ccauguaaauugca

SEQ ID NO: 1236933 - RNA, 17 nt, Homo sapiens
ccauguaaauugcaaau

SEQ ID NO: 1236934 - RNA, 16 nt, Homo sapiens
ccauguacaugaagaa

SEQ ID NO: 1236935 - RNA, 13 nt, Homo sapiens
ccauguaucuuuu

SEQ ID NO: 1236936 - RNA, 23 nt, Homo sapiens
ccauguaucuuuugaacuggcaa

SEQ ID NO: 1236937 - RNA, 19 nt, Homo sapiens
ccaugucgccucugcauuc

SEQ ID NO: 1236938 - RNA, 20 nt, Homo sapiens
ccauguucacaccgcugcac

SEQ ID NO: 1236939 - RNA, 20 nt, Homo sapiens
ccauguucauuauaaucuca

SEQ ID NO: 1236940 - RNA, 18 nt, Homo sapiens
ccauguuguaaugcugca

SEQ ID NO: 1236941 - RNA, 19 nt, Homo sapiens
ccauguuguaaugcugcac

SEQ ID NO: 1236942 - RNA, 16 nt, Homo sapiens
ccauuaaaaacuacca

SEQ ID NO: 1236943 - RNA, 15 nt, Homo sapiens
ccauuaaaacugcuu

SEQ ID NO: 1236944 - RNA, 18 nt, Homo sapiens
ccauuaagucauguguga

SEQ ID NO: 1236945 - RNA, 16 nt, Homo sapiens
ccauuacagagguauu

SEQ ID NO: 1236946 - RNA, 12 nt, Homo sapiens
ccauuauacuuu

SEQ ID NO: 1236947 - RNA, 19 nt, Homo sapiens
ccauuauacuuuauaucug

SEQ ID NO: 1236948 - RNA, 20 nt, Homo sapiens
ccauuaugcaaguguuccua

SEQ ID NO: 1236949 - RNA, 19 nt, Homo sapiens
ccauucacuucauaaucca

SEQ ID NO: 1236950 - RNA, 18 nt, Homo sapiens
ccauuccucagcuucuuc

SEQ ID NO: 1236951 - RNA, 23 nt, Homo sapiens
ccauucgguguggugcaguguga

SEQ ID NO: 1236952 - RNA, 18 nt, Homo sapiens
ccauucuccugccucagc

SEQ ID NO: 1236953 - RNA, 12 nt, Homo sapiens
ccauucuuugcu

SEQ ID NO: 1236954 - RNA, 20 nt, Homo sapiens
ccauugauuuaauguaauag

SEQ ID NO: 1236955 - RNA, 14 nt, Homo sapiens
ccauugucuuuaua

SEQ ID NO: 1236956 - RNA, 22 nt, Homo sapiens
ccauuuacacuuuugagacuuu

SEQ ID NO: 1236957 - RNA, 14 nt, Homo sapiens
ccauuugacuguuc

SEQ ID NO: 1236958 - RNA, 17 nt, Homo sapiens
ccauuugacuguucaau

SEQ ID NO: 1236959 - RNA, 19 nt, Homo sapiens
ccauuuuggaaguuuucag

SEQ ID NO: 1236960 - RNA, 14 nt, Homo sapiens
cccaaaacaaagua

SEQ ID NO: 1236961 - RNA, 13 nt, Homo sapiens
cccaaaacacagg

SEQ ID NO: 1236962 - RNA, 23 nt, Homo sapiens
cccaaaacgucuuauugugguag

SEQ ID NO: 1236963 - RNA, 18 nt, Homo sapiens
cccaaacaaugugcugga

SEQ ID NO: 1236964 - RNA, 21 nt, Homo sapiens
cccaaacuugcuuuaugccuu

SEQ ID NO: 1236965 - RNA, 20 nt, Homo sapiens
cccaaagcucagacuugcca

SEQ ID NO: 1236966 - RNA, 14 nt, Homo sapiens
cccaaauauuuagc

SEQ ID NO: 1236967 - RNA, 21 nt, Homo sapiens
cccaacaguaaucugcaucau

SEQ ID NO: 1236968 - RNA, 19 nt, Homo sapiens
cccaacuagacauuaccaa

SEQ ID NO: 1236969 - RNA, 23 nt, Homo sapiens
cccaagagcauaacuguucucau

SEQ ID NO: 1236970 - RNA, 17 nt, Homo sapiens
cccaaggaagagccaau

SEQ ID NO: 1236971 - RNA, 17 nt, Homo sapiens
cccaaggacucuuccac

SEQ ID NO: 1236972 - RNA, 16 nt, Homo sapiens
cccaaggaugcuguca

SEQ ID NO: 1236973 - RNA, 15 nt, Homo sapiens
cccaagucccuguca

SEQ ID NO: 1236974 - RNA, 22 nt, Homo sapiens
cccaagucccugucauuugaac

SEQ ID NO: 1236975 - RNA, 18 nt, Homo sapiens
cccaagugaggagugcca

SEQ ID NO: 1236976 - RNA, 20 nt, Homo sapiens
cccaagugaggagugccagc

SEQ ID NO: 1236977 - RNA, 22 nt, Homo sapiens
cccaaguggugaaugacacgcc

SEQ ID NO: 1236978 - RNA, 17 nt, Homo sapiens
cccaaucagcacugaaa

SEQ ID NO: 1236979 - RNA, 12 nt, Homo sapiens
cccaaugaauua

SEQ ID NO: 1236980 - RNA, 22 nt, Homo sapiens
cccacaaucuggcuuagugcca

SEQ ID NO: 1236981 - RNA, 20 nt, Homo sapiens
cccacacagcuacagcuuuc

SEQ ID NO: 1236982 - RNA, 18 nt, Homo sapiens
cccacaccaacgagguga

SEQ ID NO: 1236983 - RNA, 23 nt, Homo sapiens
cccacagcugagaauguggaaua

SEQ ID NO: 1236984 - RNA, 15 nt, Homo sapiens
cccacaguaggcacu

SEQ ID NO: 1236985 - RNA, 19 nt, Homo sapiens
cccacaugugacacauaug

SEQ ID NO: 1236986 - RNA, 22 nt, Homo sapiens
cccaccagcuaaggacauuucc

SEQ ID NO: 1236987 - RNA, 16 nt, Homo sapiens
cccaccgguccagcug

SEQ ID NO: 1236988 - RNA, 17 nt, Homo sapiens
cccaccuccugcaauaa

SEQ ID NO: 1236989 - RNA, 22 nt, Homo sapiens
cccacgagggucaggacuguga

SEQ ID NO: 1236990 - RNA, 17 nt, Homo sapiens
cccacgggaaaggagcu

SEQ ID NO: 1236991 - RNA, 13 nt, Homo sapiens
cccacugccagca

SEQ ID NO: 1236992 - RNA, 17 nt, Homo sapiens
cccacuggggugugugg

SEQ ID NO: 1236993 - RNA, 16 nt, Homo sapiens
cccacuuccauccucu

SEQ ID NO: 1236994 - RNA, 10 nt, Homo sapiens
cccacuuccu

SEQ ID NO: 1236995 - RNA, 23 nt, Homo sapiens
cccacuugucacugacacaaagg

SEQ ID NO: 1236996 - RNA, 20 nt, Homo sapiens
cccagaacuucccugauuga

SEQ ID NO: 1236997 - RNA, 12 nt, Homo sapiens
cccagaaggcag

SEQ ID NO: 1236998 - RNA, 14 nt, Homo sapiens
cccagacaaccaaa

SEQ ID NO: 1236999 - RNA, 18 nt, Homo sapiens
cccagacaauuccauuca

SEQ ID NO: 1237000 - RNA, 20 nt, Homo sapiens
cccagacaauuccauucaau

SEQ ID NO: 1237001 - RNA, 18 nt, Homo sapiens
cccagacacagacuggca

SEQ ID NO: 1237002 - RNA, 19 nt, Homo sapiens
cccagacacagacuggcaa

SEQ ID NO: 1237003 - RNA, 22 nt, Homo sapiens
cccagacacagacuggcaauaa

SEQ ID NO: 1237004 - RNA, 13 nt, Homo sapiens
cccagacacuggc

SEQ ID NO: 1237005 - RNA, 20 nt, Homo sapiens
cccagaccauacugacucaa

SEQ ID NO: 1237006 - RNA, 17 nt, Homo sapiens
cccagacuagauguagu

SEQ ID NO: 1237007 - RNA, 13 nt, Homo sapiens
cccagacucagcu

SEQ ID NO: 1237008 - RNA, 20 nt, Homo sapiens
cccagagaggguggugaccu

SEQ ID NO: 1237009 - RNA, 13 nt, Homo sapiens
cccagagcacuuu

SEQ ID NO: 1237010 - RNA, 18 nt, Homo sapiens
cccagagcugugccagca

SEQ ID NO: 1237011 - RNA, 22 nt, Homo sapiens
cccagaggagccaccaguucuc

SEQ ID NO: 1237012 - RNA, 15 nt, Homo sapiens
cccagauacuuccca

SEQ ID NO: 1237013 - RNA, 12 nt, Homo sapiens
cccagauuuccu

SEQ ID NO: 1237014 - RNA, 14 nt, Homo sapiens
cccagcacacggcu

SEQ ID NO: 1237015 - RNA, 12 nt, Homo sapiens
cccagcacuuug

SEQ ID NO: 1237016 - RNA, 19 nt, Homo sapiens
cccagcagcgguaccccag

SEQ ID NO: 1237017 - RNA, 21 nt, Homo sapiens
cccagcaggacagugacccca

SEQ ID NO: 1237018 - RNA, 15 nt, Homo sapiens
cccagcagugucacu

SEQ ID NO: 1237019 - RNA, 13 nt, Homo sapiens
cccagcaucacuc

SEQ ID NO: 1237020 - RNA, 23 nt, Homo sapiens
cccagcccagggcuccugcacuu

SEQ ID NO: 1237021 - RNA, 15 nt, Homo sapiens
cccagcccagggugg

SEQ ID NO: 1237022 - RNA, 23 nt, Homo sapiens
cccagcccugggaaccacuccca

SEQ ID NO: 1237023 - RNA, 21 nt, Homo sapiens
cccagcccuguucugggugca

SEQ ID NO: 1237024 - RNA, 12 nt, Homo sapiens
cccagccuauga

SEQ ID NO: 1237025 - RNA, 20 nt, Homo sapiens
cccagccuccccgugccaaa

SEQ ID NO: 1237026 - RNA, 13 nt, Homo sapiens
cccagccucuggc

SEQ ID NO: 1237027 - RNA, 16 nt, Homo sapiens
cccagcguguguaucc

SEQ ID NO: 1237028 - RNA, 16 nt, Homo sapiens
cccagcuaacucugac

SEQ ID NO: 1237029 - RNA, 21 nt, Homo sapiens
cccagcuaucuauauggaauu

SEQ ID NO: 1237030 - RNA, 13 nt, Homo sapiens
cccagcugugcug

SEQ ID NO: 1237031 - RNA, 23 nt, Homo sapiens
cccagcuuuuagaaaaugcaguc

SEQ ID NO: 1237032 - RNA, 13 nt, Homo sapiens
cccaggaagagcu

SEQ ID NO: 1237033 - RNA, 14 nt, Homo sapiens
cccaggagacagac

SEQ ID NO: 1237034 - RNA, 20 nt, Homo sapiens
cccaggagcacccaggcaug

SEQ ID NO: 1237035 - RNA, 21 nt, Homo sapiens
cccaggagcagcggggcagug

SEQ ID NO: 1237036 - RNA, 21 nt, Homo sapiens
cccaggaggugugauuccuga

SEQ ID NO: 1237037 - RNA, 17 nt, Homo sapiens
cccaggcaaacuugcac

SEQ ID NO: 1237038 - RNA, 13 nt, Homo sapiens
cccaggccaggga

SEQ ID NO: 1237039 - RNA, 15 nt, Homo sapiens
cccaggccccagcug

SEQ ID NO: 1237040 - RNA, 17 nt, Homo sapiens
cccaggccccuccaguu

SEQ ID NO: 1237041 - RNA, 21 nt, Homo sapiens
cccaggccuguacagauguau

SEQ ID NO: 1237042 - RNA, 20 nt, Homo sapiens
cccaggcuggagugcaaugc

SEQ ID NO: 1237043 - RNA, 16 nt, Homo sapiens
cccaggcugugcagcg

SEQ ID NO: 1237044 - RNA, 15 nt, Homo sapiens
cccagggacaaaaca

SEQ ID NO: 1237045 - RNA, 14 nt, Homo sapiens
cccagggcaacaag

SEQ ID NO: 1237046 - RNA, 24 nt, Homo sapiens
cccagggcacuacauaauugcugu

SEQ ID NO: 1237047 - RNA, 20 nt, Homo sapiens
cccagggccugggggcagug

SEQ ID NO: 1237048 - RNA, 18 nt, Homo sapiens
cccaggggacaagggauu

SEQ ID NO: 1237049 - RNA, 16 nt, Homo sapiens
cccaggucuuccagac

SEQ ID NO: 1237050 - RNA, 20 nt, Homo sapiens
cccagguggaaggcagacag

SEQ ID NO: 1237051 - RNA, 23 nt, Homo sapiens
cccagguggcccuaaaggacucu

SEQ ID NO: 1237052 - RNA, 17 nt, Homo sapiens
cccaguaccuccaagca

SEQ ID NO: 1237053 - RNA, 14 nt, Homo sapiens
cccaguccaugcuu

SEQ ID NO: 1237054 - RNA, 18 nt, Homo sapiens
cccagucucccuccagga

SEQ ID NO: 1237055 - RNA, 19 nt, Homo sapiens
cccagugacaacaucgcaa

SEQ ID NO: 1237056 - RNA, 12 nt, Homo sapiens
cccagugcugcu

SEQ ID NO: 1237057 - RNA, 16 nt, Homo sapiens
cccagugcugcuguaa

SEQ ID NO: 1237058 - RNA, 21 nt, Homo sapiens
cccaguucauugcacuuugau

SEQ ID NO: 1237059 - RNA, 15 nt, Homo sapiens
cccauaaccauacac

SEQ ID NO: 1237060 - RNA, 21 nt, Homo sapiens
cccauagacuuauaagucuaa

SEQ ID NO: 1237061 - RNA, 14 nt, Homo sapiens
cccauaucugugaa

SEQ ID NO: 1237062 - RNA, 22 nt, Homo sapiens
cccaucccacacccuggaggau

SEQ ID NO: 1237063 - RNA, 15 nt, Homo sapiens
cccaucccugucauu

SEQ ID NO: 1237064 - RNA, 12 nt, Homo sapiens
cccaucuaugag

SEQ ID NO: 1237065 - RNA, 16 nt, Homo sapiens
cccaucucuacuaaaa

SEQ ID NO: 1237066 - RNA, 23 nt, Homo sapiens
cccaucuuguuucacacuaguca

SEQ ID NO: 1237067 - RNA, 18 nt, Homo sapiens
cccaugagguacagcaga

SEQ ID NO: 1237068 - RNA, 18 nt, Homo sapiens
cccaugccccaacaaacu

SEQ ID NO: 1237069 - RNA, 21 nt, Homo sapiens
cccaugccuggucccaagaca

SEQ ID NO: 1237070 - RNA, 16 nt, Homo sapiens
cccauggacacuccag

SEQ ID NO: 1237071 - RNA, 13 nt, Homo sapiens
cccauggccacuu

SEQ ID NO: 1237072 - RNA, 16 nt, Homo sapiens
cccauugguguuguca

SEQ ID NO: 1237073 - RNA, 23 nt, Homo sapiens
cccauugguguugucauuguaaa

SEQ ID NO: 1237074 - RNA, 15 nt, Homo sapiens
cccauuucaaugugu

SEQ ID NO: 1237075 - RNA, 20 nt, Homo sapiens
caucauccuaagcuauucag

SEQ ID NO: 1237076 - RNA, 19 nt, Homo sapiens
caucauggaggucauacau

SEQ ID NO: 1237077 - RNA, 13 nt, Homo sapiens
caucauuacccuu

SEQ ID NO: 1237078 - RNA, 23 nt, Homo sapiens
caucauuguuuaggggugaagga

SEQ ID NO: 1237079 - RNA, 21 nt, Homo sapiens
caucauuuugagaaugcugac

SEQ ID NO: 1237080 - RNA, 18 nt, Homo sapiens
cauccaaccacuguacac

SEQ ID NO: 1237081 - RNA, 15 nt, Homo sapiens
cauccaaguggcaua

SEQ ID NO: 1237082 - RNA, 17 nt, Homo sapiens
cauccacaaacagcaga

SEQ ID NO: 1237083 - RNA, 22 nt, Homo sapiens
cauccacaggguuuugacacuu

SEQ ID NO: 1237084 - RNA, 12 nt, Homo sapiens
cauccacuagcu

SEQ ID NO: 1237085 - RNA, 14 nt, Homo sapiens
cauccacugugcca

SEQ ID NO: 1237086 - RNA, 20 nt, Homo sapiens
cauccagaguucugugacac

SEQ ID NO: 1237087 - RNA, 17 nt, Homo sapiens
cauccagggguucauuu

SEQ ID NO: 1237088 - RNA, 23 nt, Homo sapiens
cauccagggguucauuuucauga

SEQ ID NO: 1237089 - RNA, 16 nt, Homo sapiens
cauccagguucagcuu

SEQ ID NO: 1237090 - RNA, 15 nt, Homo sapiens
cauccauaccagcuc

SEQ ID NO: 1237091 - RNA, 11 nt, Homo sapiens
cauccaugaaa

SEQ ID NO: 1237092 - RNA, 19 nt, Homo sapiens
cauccccuuuguguagaaa

SEQ ID NO: 1237093 - RNA, 18 nt, Homo sapiens
caucccugaugucugucu

SEQ ID NO: 1237094 - RNA, 17 nt, Homo sapiens
caucccugccacauaca

SEQ ID NO: 1237095 - RNA, 15 nt, Homo sapiens
caucccuggaaggac

SEQ ID NO: 1237096 - RNA, 21 nt, Homo sapiens
caucccuuuuccugucagugu

SEQ ID NO: 1237097 - RNA, 17 nt, Homo sapiens
caucccuuuuucugcua

SEQ ID NO: 1237098 - RNA, 18 nt, Homo sapiens
caucccuuuuucugcuaa

SEQ ID NO: 1237099 - RNA, 19 nt, Homo sapiens
caucccuuuuucugcuaau

SEQ ID NO: 1237100 - RNA, 18 nt, Homo sapiens
cauccuaaaaaguuccau

SEQ ID NO: 1237101 - RNA, 19 nt, Homo sapiens
cauccucacaugugacaaa

SEQ ID NO: 1237102 - RNA, 21 nt, Homo sapiens
cauccuccuuuagaguugcau

SEQ ID NO: 1237103 - RNA, 14 nt, Homo sapiens
cauccugacugaaa

SEQ ID NO: 1237104 - RNA, 22 nt, Homo sapiens
cauccugagcagugccagcuuu

SEQ ID NO: 1237105 - RNA, 13 nt, Homo sapiens
cauccugugccac

SEQ ID NO: 1237106 - RNA, 20 nt, Homo sapiens
caucgcaggaugacagcucc

SEQ ID NO: 1237107 - RNA, 16 nt, Homo sapiens
caucggccuccaugac

SEQ ID NO: 1237108 - RNA, 15 nt, Homo sapiens
caucguccugggacu

SEQ ID NO: 1237109 - RNA, 19 nt, Homo sapiens
caucuaauaaguauauaau

SEQ ID NO: 1237110 - RNA, 16 nt, Homo sapiens
caucuacaaucaggag

SEQ ID NO: 1237111 - RNA, 17 nt, Homo sapiens
caucuacaucuccuuca

SEQ ID NO: 1237112 - RNA, 17 nt, Homo sapiens
caucuacccugcugacc

SEQ ID NO: 1237113 - RNA, 21 nt, Homo sapiens
caucuacccugcugaccuccc

SEQ ID NO: 1237114 - RNA, 21 nt, Homo sapiens
caucuagggaguaugaagaau

SEQ ID NO: 1237115 - RNA, 14 nt, Homo sapiens
caucuagucacaaa

SEQ ID NO: 1237116 - RNA, 20 nt, Homo sapiens
caucuagucacaaagacucc

SEQ ID NO: 1237117 - RNA, 19 nt, Homo sapiens
caucuauaaagaagaacuu

SEQ ID NO: 1237118 - RNA, 17 nt, Homo sapiens
caucuauucaagcacuu

SEQ ID NO: 1237119 - RNA, 21 nt, Homo sapiens
caucuauuuuggauuguauau

SEQ ID NO: 1237120 - RNA, 23 nt, Homo sapiens
caucucaaaaaaaaacaacuauu

SEQ ID NO: 1237121 - RNA, 17 nt, Homo sapiens
caucucaaagaaggcau

SEQ ID NO: 1237122 - RNA, 13 nt, Homo sapiens
caucucacuuuau

SEQ ID NO: 1237123 - RNA, 15 nt, Homo sapiens
caucucacuuuauga

SEQ ID NO: 1237124 - RNA, 18 nt, Homo sapiens
caucucugucuaguucca

SEQ ID NO: 1237125 - RNA, 14 nt, Homo sapiens
caucucuuguauau

SEQ ID NO: 1237126 - RNA, 12 nt, Homo sapiens
caucugcaaaag

SEQ ID NO: 1237127 - RNA, 20 nt, Homo sapiens
caucugccagaccuuaauaa

SEQ ID NO: 1237128 - RNA, 12 nt, Homo sapiens
caucuggagacc

SEQ ID NO: 1237129 - RNA, 22 nt, Homo sapiens
caucuggccuaauguuccagau

SEQ ID NO: 1237130 - RNA, 14 nt, Homo sapiens
caucuggggcaccu

SEQ ID NO: 1237131 - RNA, 16 nt, Homo sapiens
caucuguagugaccca

SEQ ID NO: 1237132 - RNA, 15 nt, Homo sapiens
caucugugccagaga

SEQ ID NO: 1237133 - RNA, 15 nt, Homo sapiens
caucuuauagcacuu

SEQ ID NO: 1237134 - RNA, 23 nt, Homo sapiens
caucuucaauuuauuacugaaaa

SEQ ID NO: 1237135 - RNA, 16 nt, Homo sapiens
caucuucacugcaauu

SEQ ID NO: 1237136 - RNA, 17 nt, Homo sapiens
caucuucacugcaauuu

SEQ ID NO: 1237137 - RNA, 17 nt, Homo sapiens
caucuucccacaguggc

SEQ ID NO: 1237138 - RNA, 13 nt, Homo sapiens
caucuucucucau

SEQ ID NO: 1237139 - RNA, 15 nt, Homo sapiens
caucuugaucugugu

SEQ ID NO: 1237140 - RNA, 21 nt, Homo sapiens
caucuuguaauuuccagcuuu

SEQ ID NO: 1237141 - RNA, 13 nt, Homo sapiens
caucuuguuucau

SEQ ID NO: 1237142 - RNA, 20 nt, Homo sapiens
caucuuuaucuguucuugcu

SEQ ID NO: 1237143 - RNA, 13 nt, Homo sapiens
caucuuucacuau

SEQ ID NO: 1237144 - RNA, 18 nt, Homo sapiens
caucuuugacacucugca

SEQ ID NO: 1237145 - RNA, 14 nt, Homo sapiens
caucuuuggcugag

SEQ ID NO: 1237146 - RNA, 16 nt, Homo sapiens
caucuuuggcugagcu

SEQ ID NO: 1237147 - RNA, 18 nt, Homo sapiens
caucuuuuacauucugca

SEQ ID NO: 1237148 - RNA, 18 nt, Homo sapiens
caugaaaaaaaugauccc

SEQ ID NO: 1237149 - RNA, 19 nt, Homo sapiens
caugaaaaacaggugacau

SEQ ID NO: 1237150 - RNA, 20 nt, Homo sapiens
caugaaaaauauugcugaac

SEQ ID NO: 1237151 - RNA, 13 nt, Homo sapiens
caugaaaaguuau

SEQ ID NO: 1237152 - RNA, 15 nt, Homo sapiens
caugaaaauaccauu

SEQ ID NO: 1237153 - RNA, 19 nt, Homo sapiens
caugaaaauuuuaaaaaua

SEQ ID NO: 1237154 - RNA, 18 nt, Homo sapiens
caugaaaguggacaagga

SEQ ID NO: 1237155 - RNA, 23 nt, Homo sapiens
caugaacaucuuuaggagacuaa

SEQ ID NO: 1237156 - RNA, 19 nt, Homo sapiens
caugaagcacaucaauuac

SEQ ID NO: 1237157 - RNA, 16 nt, Homo sapiens
caugaagcgaaacaca

SEQ ID NO: 1237158 - RNA, 22 nt, Homo sapiens
caugaaggagagcccagucucc

SEQ ID NO: 1237159 - RNA, 17 nt, Homo sapiens
caugaaggcagagccau

SEQ ID NO: 1237160 - RNA, 23 nt, Homo sapiens
caugaaucccacccacaugugac

SEQ ID NO: 1237161 - RNA, 19 nt, Homo sapiens
caugacaaacacacaucca

SEQ ID NO: 1237162 - RNA, 13 nt, Homo sapiens
caugacacugacc

SEQ ID NO: 1237163 - RNA, 18 nt, Homo sapiens
caugacacugaccuugga

SEQ ID NO: 1237164 - RNA, 18 nt, Homo sapiens
caugacuuuauauggaug

SEQ ID NO: 1237165 - RNA, 23 nt, Homo sapiens
caugacuuuauauggaugauuca

SEQ ID NO: 1237166 - RNA, 22 nt, Homo sapiens
caugaggaggucccacuugcaa

SEQ ID NO: 1237167 - RNA, 15 nt, Homo sapiens
caugauaacugcaau

SEQ ID NO: 1237168 - RNA, 21 nt, Homo sapiens
caugauaccaccuuuacugug

SEQ ID NO: 1237169 - RNA, 18 nt, Homo sapiens
caugauacuaucugugcc

SEQ ID NO: 1237170 - RNA, 22 nt, Homo sapiens
caugaucccuguguugucucua

SEQ ID NO: 1237171 - RNA, 16 nt, Homo sapiens
caugaugcccugcuga

SEQ ID NO: 1237172 - RNA, 19 nt, Homo sapiens
caugauggccuuacacuga

SEQ ID NO: 1237173 - RNA, 13 nt, Homo sapiens
caugaugucuacc

SEQ ID NO: 1237174 - RNA, 23 nt, Homo sapiens
caugauuguauauggaacaaaua

SEQ ID NO: 1237175 - RNA, 11 nt, Homo sapiens
caugcacacac

SEQ ID NO: 1237176 - RNA, 14 nt, Homo sapiens
caugcccagcugcu

SEQ ID NO: 1237177 - RNA, 18 nt, Homo sapiens
caugccucagccucucaa

SEQ ID NO: 1237178 - RNA, 14 nt, Homo sapiens
caugccucagugaa

SEQ ID NO: 1237179 - RNA, 20 nt, Homo sapiens
caugccucugauaugggacu

SEQ ID NO: 1237180 - RNA, 16 nt, Homo sapiens
caugcucaggagccac

SEQ ID NO: 1237181 - RNA, 22 nt, Homo sapiens
caugcucccuuaauccccaugc

SEQ ID NO: 1237182 - RNA, 13 nt, Homo sapiens
caugcuccucacc

SEQ ID NO: 1237183 - RNA, 18 nt, Homo sapiens
caugcugaaaacuacaca

SEQ ID NO: 1237184 - RNA, 22 nt, Homo sapiens
caugcugcuaauucaaagcucu

SEQ ID NO: 1237185 - RNA, 23 nt, Homo sapiens
caugcugcuauacacaagcaaug

SEQ ID NO: 1237186 - RNA, 18 nt, Homo sapiens
caugcugggaaugagaca

SEQ ID NO: 1237187 - RNA, 14 nt, Homo sapiens
caugcuggugcaua

SEQ ID NO: 1237188 - RNA, 14 nt, Homo sapiens
caugcugugcugug

SEQ ID NO: 1237189 - RNA, 21 nt, Homo sapiens
caugcugugugcuggagacac

SEQ ID NO: 1237190 - RNA, 19 nt, Homo sapiens
caugcuguugcugcuacug

SEQ ID NO: 1237191 - RNA, 21 nt, Homo sapiens
caugcuuccuccuuugcucuu

SEQ ID NO: 1237192 - RNA, 23 nt, Homo sapiens
caugcuugcauaagagcuuaaga

SEQ ID NO: 1237193 - RNA, 16 nt, Homo sapiens
caugcuuuuuguauca

SEQ ID NO: 1237194 - RNA, 19 nt, Homo sapiens
cauggaaaacccccuuccu

SEQ ID NO: 1237195 - RNA, 17 nt, Homo sapiens
cauggacacuccagugc

SEQ ID NO: 1237196 - RNA, 21 nt, Homo sapiens
cauggacacuccagugccagc

SEQ ID NO: 1237197 - RNA, 12 nt, Homo sapiens
cauggaccacga

SEQ ID NO: 1237198 - RNA, 16 nt, Homo sapiens
cauggaggucauacau

SEQ ID NO: 1237199 - RNA, 21 nt, Homo sapiens
cauggaugcgaggaccacuuu

SEQ ID NO: 1237200 - RNA, 14 nt, Homo sapiens
cauggccaccucca

SEQ ID NO: 1237201 - RNA, 20 nt, Homo sapiens
cauggccccaguccaugcuu

SEQ ID NO: 1237202 - RNA, 14 nt, Homo sapiens
cauaaaaucuguga

SEQ ID NO: 1237203 - RNA, 18 nt, Homo sapiens
cauaaagagcuucagcag

SEQ ID NO: 1237204 - RNA, 11 nt, Homo sapiens
cauaaagccau

SEQ ID NO: 1237205 - RNA, 17 nt, Homo sapiens
cauaaagccauguuucc

SEQ ID NO: 1237206 - RNA, 16 nt, Homo sapiens
cauaaagugucuauaa

SEQ ID NO: 1237207 - RNA, 14 nt, Homo sapiens
cauaaaugaaucau

SEQ ID NO: 1237208 - RNA, 13 nt, Homo sapiens
cauaacaaaaaga

SEQ ID NO: 1237209 - RNA, 15 nt, Homo sapiens
cauaaccauacacag

SEQ ID NO: 1237210 - RNA, 20 nt, Homo sapiens
cauaacugaaaaugugcuau

SEQ ID NO: 1237211 - RNA, 12 nt, Homo sapiens
cauaacuugaaa

SEQ ID NO: 1237212 - RNA, 21 nt, Homo sapiens
cauaacuuggccauguucucc

SEQ ID NO: 1237213 - RNA, 14 nt, Homo sapiens
cauaagaaagcacu

SEQ ID NO: 1237214 - RNA, 20 nt, Homo sapiens
cauaagagcuuaagaaccau

SEQ ID NO: 1237215 - RNA, 17 nt, Homo sapiens
cauaagaggugaucucu

SEQ ID NO: 1237216 - RNA, 18 nt, Homo sapiens
cauaagcaauaccagcaa

SEQ ID NO: 1237217 - RNA, 22 nt, Homo sapiens
cauaagguuucguuucuguaua

SEQ ID NO: 1237218 - RNA, 19 nt, Homo sapiens
cauaagucuaaauaaauga

SEQ ID NO: 1237219 - RNA, 23 nt, Homo sapiens
cauaaguuuacugaaucuucaag

SEQ ID NO: 1237220 - RNA, 20 nt, Homo sapiens
cauaauaaaucacacauuca

SEQ ID NO: 1237221 - RNA, 17 nt, Homo sapiens
cauaauaagcuaaagag

SEQ ID NO: 1237222 - RNA, 22 nt, Homo sapiens
cauaauagucaauuucuacuuc

SEQ ID NO: 1237223 - RNA, 24 nt, Homo sapiens
cauaaugugcaaagucaucaaaga

SEQ ID NO: 1237224 - RNA, 18 nt, Homo sapiens
cauaauguuacauuauua

SEQ ID NO: 1237225 - RNA, 21 nt, Homo sapiens
cauaauguuucuggauuucau

SEQ ID NO: 1237226 - RNA, 17 nt, Homo sapiens
cauaauucagcacuuaa

SEQ ID NO: 1237227 - RNA, 13 nt, Homo sapiens
cauaauucagggg

SEQ ID NO: 1237228 - RNA, 19 nt, Homo sapiens
cauaauucuugcuaugaaa

SEQ ID NO: 1237229 - RNA, 15 nt, Homo sapiens
cauacacacaugccc

SEQ ID NO: 1237230 - RNA, 20 nt, Homo sapiens
cauacacaguggcaccuuca

SEQ ID NO: 1237231 - RNA, 19 nt, Homo sapiens
cauacacucaaacaaucau

SEQ ID NO: 1237232 - RNA, 16 nt, Homo sapiens
cauacacuuauuggaa

SEQ ID NO: 1237233 - RNA, 15 nt, Homo sapiens
cauacauauuaucuc

SEQ ID NO: 1237234 - RNA, 18 nt, Homo sapiens
cauacauuuaugcacauu

SEQ ID NO: 1237235 - RNA, 20 nt, Homo sapiens
cauacccuuacucugccaga

SEQ ID NO: 1237236 - RNA, 18 nt, Homo sapiens
cauaccuaaguacuguaa

SEQ ID NO: 1237237 - RNA, 16 nt, Homo sapiens
cauacguucuuuucaa

SEQ ID NO: 1237238 - RNA, 19 nt, Homo sapiens
cauacucuccuuuugacuc

SEQ ID NO: 1237239 - RNA, 17 nt, Homo sapiens
cauacucugcuuagaau

SEQ ID NO: 1237240 - RNA, 11 nt, Homo sapiens
cauacugaaau

SEQ ID NO: 1237241 - RNA, 18 nt, Homo sapiens
cauacuggccuggacugu

SEQ ID NO: 1237242 - RNA, 16 nt, Homo sapiens
cauacuuaaugcauau

SEQ ID NO: 1237243 - RNA, 16 nt, Homo sapiens
cauagaaacaugacac

SEQ ID NO: 1237244 - RNA, 21 nt, Homo sapiens
cauagaaauuacacccaaaga

SEQ ID NO: 1237245 - RNA, 13 nt, Homo sapiens
cauagaggcuucu

SEQ ID NO: 1237246 - RNA, 21 nt, Homo sapiens
cauagagucuuuauguccaua

SEQ ID NO: 1237247 - RNA, 19 nt, Homo sapiens
cauagaugaaugaaacccu

SEQ ID NO: 1237248 - RNA, 17 nt, Homo sapiens
cauagauuaauggcacu

SEQ ID NO: 1237249 - RNA, 17 nt, Homo sapiens
cauagccucaccaaggu

SEQ ID NO: 1237250 - RNA, 22 nt, Homo sapiens
cauagcgcugcucuuaugccau

SEQ ID NO: 1237251 - RNA, 23 nt, Homo sapiens
cauagcgcugcucuuaugccauu

SEQ ID NO: 1237252 - RNA, 14 nt, Homo sapiens
cauagcucuccuuc

SEQ ID NO: 1237253 - RNA, 16 nt, Homo sapiens
cauagcugacuacaaa

SEQ ID NO: 1237254 - RNA, 15 nt, Homo sapiens
cauagcuuccaugag

SEQ ID NO: 1237255 - RNA, 19 nt, Homo sapiens
cauaggaaguauggcauga

SEQ ID NO: 1237256 - RNA, 15 nt, Homo sapiens
cauaggaauugcaca

SEQ ID NO: 1237257 - RNA, 17 nt, Homo sapiens
cauaggcgcaggugcac

SEQ ID NO: 1237258 - RNA, 19 nt, Homo sapiens
cauaggcgcaggugcacag

SEQ ID NO: 1237259 - RNA, 23 nt, Homo sapiens
cauaggcugacuuuugcagaugg

SEQ ID NO: 1237260 - RNA, 21 nt, Homo sapiens
cauaggguccugaauguuuca

SEQ ID NO: 1237261 - RNA, 15 nt, Homo sapiens
cauaggucacuggcu

SEQ ID NO: 1237262 - RNA, 20 nt, Homo sapiens
cauaguaacugacaugauua

SEQ ID NO: 1237263 - RNA, 22 nt, Homo sapiens
cauagugaccaacauagugaaa

SEQ ID NO: 1237264 - RNA, 16 nt, Homo sapiens
cauaguucucuuuaag

SEQ ID NO: 1237265 - RNA, 15 nt, Homo sapiens
cauauaaauucugau

SEQ ID NO: 1237266 - RNA, 14 nt, Homo sapiens
cauauaaguuugaa

SEQ ID NO: 1237267 - RNA, 22 nt, Homo sapiens
cauauaauuuucacuucugucu

SEQ ID NO: 1237268 - RNA, 15 nt, Homo sapiens
cauauagaggcaaga

SEQ ID NO: 1237269 - RNA, 16 nt, Homo sapiens
cauauaggacacacau

SEQ ID NO: 1237270 - RNA, 20 nt, Homo sapiens
cauauaggccagaguugcaa

SEQ ID NO: 1237271 - RNA, 13 nt, Homo sapiens
cauaucaaaaagu

SEQ ID NO: 1237272 - RNA, 16 nt, Homo sapiens
cauaucaauuggcagu

SEQ ID NO: 1237273 - RNA, 18 nt, Homo sapiens
cauaucaguugagcuuca

SEQ ID NO: 1237274 - RNA, 22 nt, Homo sapiens
cauaucaucaaugugacauuua

SEQ ID NO: 1237275 - RNA, 17 nt, Homo sapiens
cauaucccuuccucuca

SEQ ID NO: 1237276 - RNA, 18 nt, Homo sapiens
cauaucuuaaaacuaaau

SEQ ID NO: 1237277 - RNA, 14 nt, Homo sapiens
cauaugaacauaua

SEQ ID NO: 1237278 - RNA, 20 nt, Homo sapiens
cauaugccaccccaugugcc

SEQ ID NO: 1237279 - RNA, 15 nt, Homo sapiens
cauauggacucugca

SEQ ID NO: 1237280 - RNA, 23 nt, Homo sapiens
cauauguaguauaauuucuagaa

SEQ ID NO: 1237281 - RNA, 20 nt, Homo sapiens
cauauguauauauauauaug

SEQ ID NO: 1237282 - RNA, 13 nt, Homo sapiens
cauauuaagcacu

SEQ ID NO: 1237283 - RNA, 16 nt, Homo sapiens
cauauuaagcacuuua

SEQ ID NO: 1237284 - RNA, 17 nt, Homo sapiens
cauauuccuuucuauca

SEQ ID NO: 1237285 - RNA, 13 nt, Homo sapiens
cauauucuuaaca

SEQ ID NO: 1237286 - RNA, 16 nt, Homo sapiens
cauauucuuuucugca

SEQ ID NO: 1237287 - RNA, 21 nt, Homo sapiens
cauauugcaggauucuguaau

SEQ ID NO: 1237288 - RNA, 18 nt, Homo sapiens
cauauuggaauguacaug

SEQ ID NO: 1237289 - RNA, 15 nt, Homo sapiens
cauauuggacugaua

SEQ ID NO: 1237290 - RNA, 21 nt, Homo sapiens
cauauuggacugauaaucucu

SEQ ID NO: 1237291 - RNA, 17 nt, Homo sapiens
cauauugugauucugcc

SEQ ID NO: 1237292 - RNA, 16 nt, Homo sapiens
cauauugugccaauau

SEQ ID NO: 1237293 - RNA, 18 nt, Homo sapiens
cauauugugccaauaugu

SEQ ID NO: 1237294 - RNA, 19 nt, Homo sapiens
cauauuuaauaaagcacaa

SEQ ID NO: 1237295 - RNA, 20 nt, Homo sapiens
cauauuuaauaaagcacaaa

SEQ ID NO: 1237296 - RNA, 13 nt, Homo sapiens
cauauuuacuucu

SEQ ID NO: 1237297 - RNA, 13 nt, Homo sapiens
cauauuuauaugu

SEQ ID NO: 1237298 - RNA, 15 nt, Homo sapiens
cauauuuauauguau

SEQ ID NO: 1237299 - RNA, 15 nt, Homo sapiens
cauauuugaaaacca

SEQ ID NO: 1237300 - RNA, 18 nt, Homo sapiens
cauauuuuacugaucucu

SEQ ID NO: 1237301 - RNA, 23 nt, Homo sapiens
cauauuuugguuuguguauccau

SEQ ID NO: 1237302 - RNA, 21 nt, Homo sapiens
cauauuuuuugcacagcuagc

SEQ ID NO: 1237303 - RNA, 20 nt, Homo sapiens
caucaaaaaagauagaucua

SEQ ID NO: 1237304 - RNA, 17 nt, Homo sapiens
caucaaaagcaccagca

SEQ ID NO: 1237305 - RNA, 18 nt, Homo sapiens
caucaaagaacaaacauc

SEQ ID NO: 1237306 - RNA, 21 nt, Homo sapiens
caucaaagcucacaccaaauu

SEQ ID NO: 1237307 - RNA, 15 nt, Homo sapiens
caucaacaacacagc

SEQ ID NO: 1237308 - RNA, 17 nt, Homo sapiens
caucaacaacacagcaa

SEQ ID NO: 1237309 - RNA, 13 nt, Homo sapiens
caucaacugaucu

SEQ ID NO: 1237310 - RNA, 24 nt, Homo sapiens
caucaagaauggggaucacagaga

SEQ ID NO: 1237311 - RNA, 14 nt, Homo sapiens
caucaauacaacca

SEQ ID NO: 1237312 - RNA, 23 nt, Homo sapiens
caucaauugaauggucagcguug

SEQ ID NO: 1237313 - RNA, 12 nt, Homo sapiens
caucacaacauu

SEQ ID NO: 1237314 - RNA, 14 nt, Homo sapiens
caucacacucucca

SEQ ID NO: 1237315 - RNA, 16 nt, Homo sapiens
caucacccucuuccug

SEQ ID NO: 1237316 - RNA, 19 nt, Homo sapiens
caucacccucuuccuguga

SEQ ID NO: 1237317 - RNA, 21 nt, Homo sapiens
caucacuggggcugggagcag

SEQ ID NO: 1237318 - RNA, 23 nt, Homo sapiens
caucacuucccauuuuauggaau

SEQ ID NO: 1237319 - RNA, 22 nt, Homo sapiens
caucagagaugguaaucuacag

SEQ ID NO: 1237320 - RNA, 23 nt, Homo sapiens
caucagagccagucucaccuuca

SEQ ID NO: 1237321 - RNA, 19 nt, Homo sapiens
caucagagguuugcuuccu

SEQ ID NO: 1237322 - RNA, 19 nt, Homo sapiens
caucaggaaggaaaugaca

SEQ ID NO: 1237323 - RNA, 19 nt, Homo sapiens
caucaggagcuagagccau

SEQ ID NO: 1237324 - RNA, 17 nt, Homo sapiens
caucaguagcaucugua

SEQ ID NO: 1237325 - RNA, 18 nt, Homo sapiens
caucagucuccaacaugu

SEQ ID NO: 1237326 - RNA, 12 nt, Homo sapiens
caucaguucccc

SEQ ID NO: 1237327 - RNA, 19 nt, Homo sapiens
caucauaagcugauuugau

SEQ ID NO: 1237328 - RNA, 18 nt, Homo sapiens
caucaucaaaaacuuugg

SEQ ID NO: 1237329 - RNA, 12 nt, Homo sapiens
ccuggaaaccac

SEQ ID NO: 1237330 - RNA, 21 nt, Homo sapiens
ccuggacacgcugguggugcu

SEQ ID NO: 1237331 - RNA, 12 nt, Homo sapiens
ccuggacugagc

SEQ ID NO: 1237332 - RNA, 14 nt, Homo sapiens
ccuggagauccucc

SEQ ID NO: 1237333 - RNA, 18 nt, Homo sapiens
ccuggagaugcugccugg

SEQ ID NO: 1237334 - RNA, 15 nt, Homo sapiens
ccuggaggcacugaa

SEQ ID NO: 1237335 - RNA, 16 nt, Homo sapiens
ccuggaucuaccagca

SEQ ID NO: 1237336 - RNA, 14 nt, Homo sapiens
ccuggaucuccuca

SEQ ID NO: 1237337 - RNA, 19 nt, Homo sapiens
ccuggauuccucacuuuga

SEQ ID NO: 1237338 - RNA, 17 nt, Homo sapiens
ccuggauugggagaccu

SEQ ID NO: 1237339 - RNA, 22 nt, Homo sapiens
ccuggauuuauaguaugugacu

SEQ ID NO: 1237340 - RNA, 18 nt, Homo sapiens
ccuggcagcaugacucag

SEQ ID NO: 1237341 - RNA, 14 nt, Homo sapiens
ccuggccaggagcu

SEQ ID NO: 1237342 - RNA, 16 nt, Homo sapiens
ccuggccauccacaaa

SEQ ID NO: 1237343 - RNA, 14 nt, Homo sapiens
ccuggcccaucuca

SEQ ID NO: 1237344 - RNA, 21 nt, Homo sapiens
ccuggcccucgccagcugcca

SEQ ID NO: 1237345 - RNA, 16 nt, Homo sapiens
ccuggcuuuuacuuua

SEQ ID NO: 1237346 - RNA, 13 nt, Homo sapiens
ccugggaacauca

SEQ ID NO: 1237347 - RNA, 21 nt, Homo sapiens
ccugggaaggcuaaguucagu

SEQ ID NO: 1237348 - RNA, 20 nt, Homo sapiens
ccugggaccucccccggcag

SEQ ID NO: 1237349 - RNA, 12 nt, Homo sapiens
ccugggagacag

SEQ ID NO: 1237350 - RNA, 21 nt, Homo sapiens
ccugggaggaaauuugaaugg

SEQ ID NO: 1237351 - RNA, 23 nt, Homo sapiens
ccugggagguagagguugcacug

SEQ ID NO: 1237352 - RNA, 22 nt, Homo sapiens
ccugggaugaggggugcugggu

SEQ ID NO: 1237353 - RNA, 17 nt, Homo sapiens
ccugggcaauuccgcau

SEQ ID NO: 1237354 - RNA, 17 nt, Homo sapiens
ccugggcugucugucac

SEQ ID NO: 1237355 - RNA, 23 nt, Homo sapiens
ccugggcugucugucaccagcua

SEQ ID NO: 1237356 - RNA, 22 nt, Homo sapiens
ccuggggacuguuccaaagcca

SEQ ID NO: 1237357 - RNA, 19 nt, Homo sapiens
ccuggggcagaaagccaca

SEQ ID NO: 1237358 - RNA, 17 nt, Homo sapiens
ccuggggcgagcacugu

SEQ ID NO: 1237359 - RNA, 19 nt, Homo sapiens
ccuggggcuucuccugacc

SEQ ID NO: 1237360 - RNA, 18 nt, Homo sapiens
ccugggggcuuuugccac

SEQ ID NO: 1237361 - RNA, 18 nt, Homo sapiens
ccugggugggacagccuc

SEQ ID NO: 1237362 - RNA, 12 nt, Homo sapiens
ccugggugugcc

SEQ ID NO: 1237363 - RNA, 15 nt, Homo sapiens
ccugguaaaagggau

SEQ ID NO: 1237364 - RNA, 22 nt, Homo sapiens
ccugguaaaagggauacacagg

SEQ ID NO: 1237365 - RNA, 22 nt, Homo sapiens
ccuggucagugguggucuucaa

SEQ ID NO: 1237366 - RNA, 18 nt, Homo sapiens
ccuggucccuuggagaca

SEQ ID NO: 1237367 - RNA, 14 nt, Homo sapiens
ccugguccuggaca

SEQ ID NO: 1237368 - RNA, 18 nt, Homo sapiens
ccuguaaucccaacacuu

SEQ ID NO: 1237369 - RNA, 19 nt, Homo sapiens
ccuguaaucccagcacuuu

SEQ ID NO: 1237370 - RNA, 17 nt, Homo sapiens
ccuguaaucucagcacu

SEQ ID NO: 1237371 - RNA, 20 nt, Homo sapiens
ccuguaaucucagcacuuug

SEQ ID NO: 1237372 - RNA, 20 nt, Homo sapiens
ccuguaccccagcacuugug

SEQ ID NO: 1237373 - RNA, 15 nt, Homo sapiens
ccuguaccucagugg

SEQ ID NO: 1237374 - RNA, 12 nt, Homo sapiens
ccuguaccucau

SEQ ID NO: 1237375 - RNA, 17 nt, Homo sapiens
ccuguacuaaaccaccu

SEQ ID NO: 1237376 - RNA, 14 nt, Homo sapiens
ccuguacucuugaa

SEQ ID NO: 1237377 - RNA, 18 nt, Homo sapiens
ccuguagacuagugccgu

SEQ ID NO: 1237378 - RNA, 15 nt, Homo sapiens
ccuguagcgccagug

SEQ ID NO: 1237379 - RNA, 19 nt, Homo sapiens
ccuguagcgccaguguaau

SEQ ID NO: 1237380 - RNA, 23 nt, Homo sapiens
ccuguauaaguggaggcacuuua

SEQ ID NO: 1237381 - RNA, 14 nt, Homo sapiens
ccuguauacuuuag

SEQ ID NO: 1237382 - RNA, 21 nt, Homo sapiens
ccuguauacuuuaguaugacg

SEQ ID NO: 1237383 - RNA, 18 nt, Homo sapiens
ccuguauucuacagcaga

SEQ ID NO: 1237384 - RNA, 20 nt, Homo sapiens
ccuguauucuacagcagaua

SEQ ID NO: 1237385 - RNA, 17 nt, Homo sapiens
ccugucaauacuaugga

SEQ ID NO: 1237386 - RNA, 19 nt, Homo sapiens
ccugucaauacuauggagu

SEQ ID NO: 1237387 - RNA, 22 nt, Homo sapiens
ccugucauccucaugcugcuca

SEQ ID NO: 1237388 - RNA, 16 nt, Homo sapiens
ccugucaucucacauu

SEQ ID NO: 1237389 - RNA, 23 nt, Homo sapiens
ccugucccagagguuaucugccu

SEQ ID NO: 1237390 - RNA, 14 nt, Homo sapiens
ccugucgugccagu

SEQ ID NO: 1237391 - RNA, 16 nt, Homo sapiens
ccugucuccacugugc

SEQ ID NO: 1237392 - RNA, 16 nt, Homo sapiens
ccugucugaagccaua

SEQ ID NO: 1237393 - RNA, 21 nt, Homo sapiens
ccugucuucugggcacagugg

SEQ ID NO: 1237394 - RNA, 16 nt, Homo sapiens
ccugucuugcugucau

SEQ ID NO: 1237395 - RNA, 14 nt, Homo sapiens
ccugugaaugcuga

SEQ ID NO: 1237396 - RNA, 12 nt, Homo sapiens
ccugugacuguc

SEQ ID NO: 1237397 - RNA, 13 nt, Homo sapiens
ccugugcacacac

SEQ ID NO: 1237398 - RNA, 14 nt, Homo sapiens
ccugugccaucacc

SEQ ID NO: 1237399 - RNA, 15 nt, Homo sapiens
ccugugccuccucag

SEQ ID NO: 1237400 - RNA, 15 nt, Homo sapiens
ccugugcuaauccca

SEQ ID NO: 1237401 - RNA, 14 nt, Homo sapiens
ccuguggagcucag

SEQ ID NO: 1237402 - RNA, 19 nt, Homo sapiens
ccuguggccaacugcaaaa

SEQ ID NO: 1237403 - RNA, 14 nt, Homo sapiens
ccugugggaguaga

SEQ ID NO: 1237404 - RNA, 18 nt, Homo sapiens
ccugugguuaacaucuca

SEQ ID NO: 1237405 - RNA, 15 nt, Homo sapiens
ccuguguacauauaa

SEQ ID NO: 1237406 - RNA, 14 nt, Homo sapiens
ccuguguacugccu

SEQ ID NO: 1237407 - RNA, 17 nt, Homo sapiens
ccuguguacugccuuaa

SEQ ID NO: 1237408 - RNA, 15 nt, Homo sapiens
ccuguguagcucuca

SEQ ID NO: 1237409 - RNA, 21 nt, Homo sapiens
ccuguguagcucucacaugca

SEQ ID NO: 1237410 - RNA, 17 nt, Homo sapiens
ccuguguccagcagcug

SEQ ID NO: 1237411 - RNA, 17 nt, Homo sapiens
ccugugugccauuuuaa

SEQ ID NO: 1237412 - RNA, 20 nt, Homo sapiens
ccuguguguccaaaacugcc

SEQ ID NO: 1237413 - RNA, 13 nt, Homo sapiens
ccuguuacuuuac

SEQ ID NO: 1237414 - RNA, 17 nt, Homo sapiens
ccuguucaucuugccaa

SEQ ID NO: 1237415 - RNA, 17 nt, Homo sapiens
ccuguuucaaucacugu

SEQ ID NO: 1237416 - RNA, 16 nt, Homo sapiens
ccuguuuuauauauua

SEQ ID NO: 1237417 - RNA, 15 nt, Homo sapiens
ccuuaaaaugcauug

SEQ ID NO: 1237418 - RNA, 13 nt, Homo sapiens
ccuuaagagucau

SEQ ID NO: 1237419 - RNA, 23 nt, Homo sapiens
ccuuaagcuuuggacccaaggaa

SEQ ID NO: 1237420 - RNA, 17 nt, Homo sapiens
ccuuaagucaaaagaga

SEQ ID NO: 1237421 - RNA, 15 nt, Homo sapiens
ccuuaauauguuaac

SEQ ID NO: 1237422 - RNA, 22 nt, Homo sapiens
ccuuacgcuuugucacacaaaa

SEQ ID NO: 1237423 - RNA, 15 nt, Homo sapiens
ccuuagaagucacac

SEQ ID NO: 1237424 - RNA, 14 nt, Homo sapiens
ccuuagagguccuc

SEQ ID NO: 1237425 - RNA, 15 nt, Homo sapiens
ccuuagcuggcauua

SEQ ID NO: 1237426 - RNA, 22 nt, Homo sapiens
ccuuaggagacgcugcacuuga

SEQ ID NO: 1237427 - RNA, 19 nt, Homo sapiens
ccuuaucaagugucuucca

SEQ ID NO: 1237428 - RNA, 19 nt, Homo sapiens
ccuuaugauuaaacuuccu

SEQ ID NO: 1237429 - RNA, 22 nt, Homo sapiens
ccuuauuaguuacaaaguuaua

SEQ ID NO: 1237430 - RNA, 18 nt, Homo sapiens
ccuuauucagaauuucua

SEQ ID NO: 1237431 - RNA, 16 nt, Homo sapiens
ccuuauucuacauuuc

SEQ ID NO: 1237432 - RNA, 14 nt, Homo sapiens
ccuuauuguaccuc

SEQ ID NO: 1237433 - RNA, 13 nt, Homo sapiens
ccuucaagugcca

SEQ ID NO: 1237434 - RNA, 14 nt, Homo sapiens
ccuucaagugccaa

SEQ ID NO: 1237435 - RNA, 12 nt, Homo sapiens
ccuucacuuuac

SEQ ID NO: 1237436 - RNA, 13 nt, Homo sapiens
ccuucagaagcua

SEQ ID NO: 1237437 - RNA, 15 nt, Homo sapiens
ccuucagaagcuauu

SEQ ID NO: 1237438 - RNA, 15 nt, Homo sapiens
ccuucagcaccugac

SEQ ID NO: 1237439 - RNA, 16 nt, Homo sapiens
ccuucagcgauuauuu

SEQ ID NO: 1237440 - RNA, 19 nt, Homo sapiens
ccuucaucuucacugcaau

SEQ ID NO: 1237441 - RNA, 21 nt, Homo sapiens
ccuucauugccacacuuggug

SEQ ID NO: 1237442 - RNA, 18 nt, Homo sapiens
ccuuccagaucacugcca

SEQ ID NO: 1237443 - RNA, 19 nt, Homo sapiens
ccuucccaaucagcacuga

SEQ ID NO: 1237444 - RNA, 18 nt, Homo sapiens
ccuucccucucaugacuu

SEQ ID NO: 1237445 - RNA, 19 nt, Homo sapiens
ccuuccgacccucugggaa

SEQ ID NO: 1237446 - RNA, 24 nt, Homo sapiens
ccuuccuaugcuguucacuggaca

SEQ ID NO: 1237447 - RNA, 15 nt, Homo sapiens
ccuuccuguguaugc

SEQ ID NO: 1237448 - RNA, 14 nt, Homo sapiens
cgcaugaaccugga

SEQ ID NO: 1237449 - RNA, 23 nt, Homo sapiens
cgcaugucucccuccaguccucu

SEQ ID NO: 1237450 - RNA, 11 nt, Homo sapiens
cgcaugugcag

SEQ ID NO: 1237451 - RNA, 14 nt, Homo sapiens
cgccagcucuacca

SEQ ID NO: 1237452 - RNA, 21 nt, Homo sapiens
cgccauugagaaugugcuuug

SEQ ID NO: 1237453 - RNA, 22 nt, Homo sapiens
cgccauugagaaugugcuuugu

SEQ ID NO: 1237454 - RNA, 20 nt, Homo sapiens
cgcccaggcuggagugcaau

SEQ ID NO: 1237455 - RNA, 16 nt, Homo sapiens
cgccccuuccuagguc

SEQ ID NO: 1237456 - RNA, 18 nt, Homo sapiens
ccuccuccaugcucccuu

SEQ ID NO: 1237457 - RNA, 17 nt, Homo sapiens
ccuccuccccuagggaa

SEQ ID NO: 1237458 - RNA, 14 nt, Homo sapiens
ccuccucuugacuu

SEQ ID NO: 1237459 - RNA, 15 nt, Homo sapiens
ccuccugaaagccug

SEQ ID NO: 1237460 - RNA, 12 nt, Homo sapiens
ccuccugaaccg

SEQ ID NO: 1237461 - RNA, 15 nt, Homo sapiens
ccuccugauggccaa

SEQ ID NO: 1237462 - RNA, 19 nt, Homo sapiens
ccuccugcaaggggcucaa

SEQ ID NO: 1237463 - RNA, 13 nt, Homo sapiens
ccuccugcuccuc

SEQ ID NO: 1237464 - RNA, 21 nt, Homo sapiens
ccuccugguugauacuuguuc

SEQ ID NO: 1237465 - RNA, 13 nt, Homo sapiens
ccuccugugggga

SEQ ID NO: 1237466 - RNA, 20 nt, Homo sapiens
ccuccuuuagaguugcauga

SEQ ID NO: 1237467 - RNA, 15 nt, Homo sapiens
ccucgcaugacuguu

SEQ ID NO: 1237468 - RNA, 15 nt, Homo sapiens
ccucgcccuccacaa

SEQ ID NO: 1237469 - RNA, 12 nt, Homo sapiens
ccucgcuaugug

SEQ ID NO: 1237470 - RNA, 18 nt, Homo sapiens
ccucggcagucacuucca

SEQ ID NO: 1237471 - RNA, 17 nt, Homo sapiens
ccucgggugugcuaugg

SEQ ID NO: 1237472 - RNA, 14 nt, Homo sapiens
ccucggucacucca

SEQ ID NO: 1237473 - RNA, 16 nt, Homo sapiens
ccucuacuuaaugaga

SEQ ID NO: 1237474 - RNA, 14 nt, Homo sapiens
ccucuacuuuccag

SEQ ID NO: 1237475 - RNA, 20 nt, Homo sapiens
ccucuaguaagaugcacuga

SEQ ID NO: 1237476 - RNA, 22 nt, Homo sapiens
ccucuaguaagaugcacugaaa

SEQ ID NO: 1237477 - RNA, 13 nt, Homo sapiens
ccucuauaaacuu

SEQ ID NO: 1237478 - RNA, 16 nt, Homo sapiens
ccucuccaguuugcac

SEQ ID NO: 1237479 - RNA, 18 nt, Homo sapiens
ccucucccggcaacaucu

SEQ ID NO: 1237480 - RNA, 11 nt, Homo sapiens
ccucucuagca

SEQ ID NO: 1237481 - RNA, 23 nt, Homo sapiens
ccucucugcagacuucccagcua

SEQ ID NO: 1237482 - RNA, 19 nt, Homo sapiens
ccucucugggcagucagaa

SEQ ID NO: 1237483 - RNA, 16 nt, Homo sapiens
ccucucuuauagaaua

SEQ ID NO: 1237484 - RNA, 16 nt, Homo sapiens
ccucugaacuugccuu

SEQ ID NO: 1237485 - RNA, 17 nt, Homo sapiens
ccucugaacuugccuua

SEQ ID NO: 1237486 - RNA, 17 nt, Homo sapiens
ccucugcacuacugaca

SEQ ID NO: 1237487 - RNA, 22 nt, Homo sapiens
ccucugcauggaacagcauuac

SEQ ID NO: 1237488 - RNA, 23 nt, Homo sapiens
ccucugccaaaggaugugauaua

SEQ ID NO: 1237489 - RNA, 16 nt, Homo sapiens
ccucugcuacuagcca

SEQ ID NO: 1237490 - RNA, 13 nt, Homo sapiens
ccucuggacaaag

SEQ ID NO: 1237491 - RNA, 13 nt, Homo sapiens
ccucuggacaguu

SEQ ID NO: 1237492 - RNA, 16 nt, Homo sapiens
ccucugggcagcuccu

SEQ ID NO: 1237493 - RNA, 15 nt, Homo sapiens
ccucugguucuucau

SEQ ID NO: 1237494 - RNA, 15 nt, Homo sapiens
ccucuucccaugacu

SEQ ID NO: 1237495 - RNA, 14 nt, Homo sapiens
ccucuuccccagaa

SEQ ID NO: 1237496 - RNA, 22 nt, Homo sapiens
ccucuuccccagaaaggagacu

SEQ ID NO: 1237497 - RNA, 18 nt, Homo sapiens
ccucuuccccuugcccuu

SEQ ID NO: 1237498 - RNA, 21 nt, Homo sapiens
ccucuuccgugacgucacugg

SEQ ID NO: 1237499 - RNA, 19 nt, Homo sapiens
ccucuucugacgugccuuu

SEQ ID NO: 1237500 - RNA, 14 nt, Homo sapiens
ccucuucugugguc

SEQ ID NO: 1237501 - RNA, 14 nt, Homo sapiens
ccucuuuaaaaaca

SEQ ID NO: 1237502 - RNA, 23 nt, Homo sapiens
ccucuuuaaucaugaaacaccuu

SEQ ID NO: 1237503 - RNA, 22 nt, Homo sapiens
ccucuuugucauaccuuuggau

SEQ ID NO: 1237504 - RNA, 24 nt, Homo sapiens
ccucuuugugugcgucacugugaa

SEQ ID NO: 1237505 - RNA, 18 nt, Homo sapiens
ccucuuuucucugugcuu

SEQ ID NO: 1237506 - RNA, 13 nt, Homo sapiens
ccugaaacacgaa

SEQ ID NO: 1237507 - RNA, 18 nt, Homo sapiens
ccugaaacagccaugucc

SEQ ID NO: 1237508 - RNA, 14 nt, Homo sapiens
ccugaaagccacaa

SEQ ID NO: 1237509 - RNA, 23 nt, Homo sapiens
ccugaaauaaacacuggugccaa

SEQ ID NO: 1237510 - RNA, 18 nt, Homo sapiens
ccugaaauuuauucacau

SEQ ID NO: 1237511 - RNA, 21 nt, Homo sapiens
ccugaacuacauaacuuccua

SEQ ID NO: 1237512 - RNA, 20 nt, Homo sapiens
ccugaagcguuuuucucaaa

SEQ ID NO: 1237513 - RNA, 14 nt, Homo sapiens
ccugaagucacaca

SEQ ID NO: 1237514 - RNA, 20 nt, Homo sapiens
ccugaagucacacagugagu

SEQ ID NO: 1237515 - RNA, 23 nt, Homo sapiens
ccugaauauuuguuauguagaua

SEQ ID NO: 1237516 - RNA, 14 nt, Homo sapiens
ccugaaucugugca

SEQ ID NO: 1237517 - RNA, 18 nt, Homo sapiens
ccugaaugguuccaugcc

SEQ ID NO: 1237518 - RNA, 19 nt, Homo sapiens
ccugaauuaucuauuucau

SEQ ID NO: 1237519 - RNA, 22 nt, Homo sapiens
ccugaauucuuuuucauuugag

SEQ ID NO: 1237520 - RNA, 12 nt, Homo sapiens
ccugaauuuccc

SEQ ID NO: 1237521 - RNA, 18 nt, Homo sapiens
ccugacaaguuauuacug

SEQ ID NO: 1237522 - RNA, 22 nt, Homo sapiens
ccugacacuaaccagagucagc

SEQ ID NO: 1237523 - RNA, 14 nt, Homo sapiens
ccugaccacccucc

SEQ ID NO: 1237524 - RNA, 17 nt, Homo sapiens
ccugacccuacuucuuu

SEQ ID NO: 1237525 - RNA, 16 nt, Homo sapiens
ccugaccucacuguga

SEQ ID NO: 1237526 - RNA, 12 nt, Homo sapiens
ccugaccuguca

SEQ ID NO: 1237527 - RNA, 13 nt, Homo sapiens
ccugacucaggcc

SEQ ID NO: 1237528 - RNA, 12 nt, Homo sapiens
ccugacuggcaa

SEQ ID NO: 1237529 - RNA, 14 nt, Homo sapiens
ccugacuggccaaa

SEQ ID NO: 1237530 - RNA, 17 nt, Homo sapiens
ccugacuguaaaugcuc

SEQ ID NO: 1237531 - RNA, 13 nt, Homo sapiens
ccugagagucuga

SEQ ID NO: 1237532 - RNA, 22 nt, Homo sapiens
ccugagccaagaggaacuugac

SEQ ID NO: 1237533 - RNA, 20 nt, Homo sapiens
ccugagcccaggagguggag

SEQ ID NO: 1237534 - RNA, 15 nt, Homo sapiens
ccugaggaagaugac

SEQ ID NO: 1237535 - RNA, 15 nt, Homo sapiens
ccugaggaccaccuc

SEQ ID NO: 1237536 - RNA, 21 nt, Homo sapiens
ccugaggugaaagggagcuau

SEQ ID NO: 1237537 - RNA, 18 nt, Homo sapiens
ccugagucugcaugugca

SEQ ID NO: 1237538 - RNA, 21 nt, Homo sapiens
ccugagucugcaugugcacgg

SEQ ID NO: 1237539 - RNA, 20 nt, Homo sapiens
ccugaguucauccaggccca

SEQ ID NO: 1237540 - RNA, 19 nt, Homo sapiens
ccugauauaucaaacugaa

SEQ ID NO: 1237541 - RNA, 19 nt, Homo sapiens
ccugaucaagguacaauuc

SEQ ID NO: 1237542 - RNA, 20 nt, Homo sapiens
ccugaucaagguacaauucu

SEQ ID NO: 1237543 - RNA, 17 nt, Homo sapiens
ccugaugacacccaccc

SEQ ID NO: 1237544 - RNA, 13 nt, Homo sapiens
ccugaugagauuu

SEQ ID NO: 1237545 - RNA, 16 nt, Homo sapiens
ccugaugcagagccuu

SEQ ID NO: 1237546 - RNA, 12 nt, Homo sapiens
ccugauguuaaa

SEQ ID NO: 1237547 - RNA, 23 nt, Homo sapiens
ccugauuagaugacucucagucc

SEQ ID NO: 1237548 - RNA, 20 nt, Homo sapiens
ccugauuuguuuucauuaua

SEQ ID NO: 1237549 - RNA, 18 nt, Homo sapiens
ccugcaccccugcaguuu

SEQ ID NO: 1237550 - RNA, 14 nt, Homo sapiens
ccugcaccugacag

SEQ ID NO: 1237551 - RNA, 14 nt, Homo sapiens
ccugcaccugugca

SEQ ID NO: 1237552 - RNA, 16 nt, Homo sapiens
ccugcacuaaagccag

SEQ ID NO: 1237553 - RNA, 19 nt, Homo sapiens
ccugcagaagaagcuggug

SEQ ID NO: 1237554 - RNA, 17 nt, Homo sapiens
ccugcagcccaugguga

SEQ ID NO: 1237555 - RNA, 17 nt, Homo sapiens
ccugcaggcaggaacaa

SEQ ID NO: 1237556 - RNA, 19 nt, Homo sapiens
ccugcagggacuccaugcu

SEQ ID NO: 1237557 - RNA, 14 nt, Homo sapiens
ccugcagucuggca

SEQ ID NO: 1237558 - RNA, 21 nt, Homo sapiens
ccugcaguuauuaacacuaac

SEQ ID NO: 1237559 - RNA, 19 nt, Homo sapiens
ccugcauuucucuucucag

SEQ ID NO: 1237560 - RNA, 13 nt, Homo sapiens
ccugccacucuca

SEQ ID NO: 1237561 - RNA, 17 nt, Homo sapiens
ccugcccaagcacuuca

SEQ ID NO: 1237562 - RNA, 22 nt, Homo sapiens
ccugccccaaacaaauaugcaa

SEQ ID NO: 1237563 - RNA, 20 nt, Homo sapiens
ccugccccagacagacuuca

SEQ ID NO: 1237564 - RNA, 19 nt, Homo sapiens
ccugccccagauuuacuaa

SEQ ID NO: 1237565 - RNA, 14 nt, Homo sapiens
ccugccuaggaauu

SEQ ID NO: 1237566 - RNA, 22 nt, Homo sapiens
ccugccucccaagguccucuca

SEQ ID NO: 1237567 - RNA, 21 nt, Homo sapiens
ccugccugcaucugugaaaag

SEQ ID NO: 1237568 - RNA, 20 nt, Homo sapiens
ccugccuguagcagugagaa

SEQ ID NO: 1237569 - RNA, 22 nt, Homo sapiens
ccugccuuuuaacguagauaua

SEQ ID NO: 1237570 - RNA, 14 nt, Homo sapiens
ccugcgauuuugcc

SEQ ID NO: 1237571 - RNA, 23 nt, Homo sapiens
ccugcgggcgcgggcagccaccc

SEQ ID NO: 1237572 - RNA, 19 nt, Homo sapiens
ccugcuccacgaagccuua

SEQ ID NO: 1237573 - RNA, 23 nt, Homo sapiens
cucauuuguuuuucucacuccuu

SEQ ID NO: 1237574 - RNA, 14 nt, Homo sapiens
cuccaaaagcacuu

SEQ ID NO: 1237575 - RNA, 15 nt, Homo sapiens
cuccaaaagcacuua

SEQ ID NO: 1237576 - RNA, 13 nt, Homo sapiens
cuccaaacugaag

SEQ ID NO: 1237577 - RNA, 17 nt, Homo sapiens
cuccaaauagcauuagu

SEQ ID NO: 1237578 - RNA, 13 nt, Homo sapiens
cuccaaaugagau

SEQ ID NO: 1237579 - RNA, 13 nt, Homo sapiens
cuccaacuggauu

SEQ ID NO: 1237580 - RNA, 13 nt, Homo sapiens
cuccaagcuccau

SEQ ID NO: 1237581 - RNA, 18 nt, Homo sapiens
cuccaagguaacccggcu

SEQ ID NO: 1237582 - RNA, 20 nt, Homo sapiens
cuccaagguagaauuugcaa

SEQ ID NO: 1237583 - RNA, 19 nt, Homo sapiens
cuccaagucuguaccucaa

SEQ ID NO: 1237584 - RNA, 20 nt, Homo sapiens
cuccacaaaugggaaaacca

SEQ ID NO: 1237585 - RNA, 22 nt, Homo sapiens
cuccacagagugagccagugag

SEQ ID NO: 1237586 - RNA, 16 nt, Homo sapiens
cuccacaggcacaggu

SEQ ID NO: 1237587 - RNA, 12 nt, Homo sapiens
cuccacagggca

SEQ ID NO: 1237588 - RNA, 16 nt, Homo sapiens
cuccacagugcugcuu

SEQ ID NO: 1237589 - RNA, 13 nt, Homo sapiens
cuccacaucugcc

SEQ ID NO: 1237590 - RNA, 16 nt, Homo sapiens
auuuauccaagaccug

SEQ ID NO: 1237591 - RNA, 12 nt, Homo sapiens
auuuaucugugu

SEQ ID NO: 1237592 - RNA, 19 nt, Homo sapiens
auuuauggucaacacuuaa

SEQ ID NO: 1237593 - RNA, 15 nt, Homo sapiens
auuuaugucccugac

SEQ ID NO: 1237594 - RNA, 22 nt, Homo sapiens
auuuauguggcuuguuuauccu

SEQ ID NO: 1237595 - RNA, 15 nt, Homo sapiens
auuuauuaacaggau

SEQ ID NO: 1237596 - RNA, 14 nt, Homo sapiens
auuuauuaccucug

SEQ ID NO: 1237597 - RNA, 14 nt, Homo sapiens
auuuauugagcacc

SEQ ID NO: 1237598 - RNA, 21 nt, Homo sapiens
auuuauugguggguugaauau

SEQ ID NO: 1237599 - RNA, 21 nt, Homo sapiens
auuuauugugcuucgagugac

SEQ ID NO: 1237600 - RNA, 16 nt, Homo sapiens
auuuauuuaagcauca

SEQ ID NO: 1237601 - RNA, 18 nt, Homo sapiens
auuuauuuacaugugauu

SEQ ID NO: 1237602 - RNA, 16 nt, Homo sapiens
auuuauuuauggagga

SEQ ID NO: 1237603 - RNA, 18 nt, Homo sapiens
auuuauuuuccuaaagag

SEQ ID NO: 1237604 - RNA, 22 nt, Homo sapiens
auuucaaaguuuuguuguacuu

SEQ ID NO: 1237605 - RNA, 19 nt, Homo sapiens
auuucaaaugugcugucaa

SEQ ID NO: 1237606 - RNA, 15 nt, Homo sapiens
auuucaagucucuca

SEQ ID NO: 1237607 - RNA, 14 nt, Homo sapiens
auuucaagugccua

SEQ ID NO: 1237608 - RNA, 16 nt, Homo sapiens
auuucacaagcuauuc

SEQ ID NO: 1237609 - RNA, 12 nt, Homo sapiens
auuucacacagu

SEQ ID NO: 1237610 - RNA, 16 nt, Homo sapiens
auuucaccuacuuugu

SEQ ID NO: 1237611 - RNA, 17 nt, Homo sapiens
auuucaccugugacaaa

SEQ ID NO: 1237612 - RNA, 13 nt, Homo sapiens
auuucacucucaa

SEQ ID NO: 1237613 - RNA, 13 nt, Homo sapiens
auuucacugaugu

SEQ ID NO: 1237614 - RNA, 15 nt, Homo sapiens
auuucagaccuagca

SEQ ID NO: 1237615 - RNA, 18 nt, Homo sapiens
auuucagauaaacaacaa

SEQ ID NO: 1237616 - RNA, 15 nt, Homo sapiens
auuucagcagggaug

SEQ ID NO: 1237617 - RNA, 19 nt, Homo sapiens
auuucaggaagacugacag

SEQ ID NO: 1237618 - RNA, 18 nt, Homo sapiens
auuucaguaucaucucca

SEQ ID NO: 1237619 - RNA, 14 nt, Homo sapiens
auuucauaccucag

SEQ ID NO: 1237620 - RNA, 15 nt, Homo sapiens
auuucauacuguaac

SEQ ID NO: 1237621 - RNA, 20 nt, Homo sapiens
auuucaugauuucauuucaa

SEQ ID NO: 1237622 - RNA, 22 nt, Homo sapiens
auuucaugggacuaaaugaacu

SEQ ID NO: 1237623 - RNA, 22 nt, Homo sapiens
auuucaugucuuuacuggaccu

SEQ ID NO: 1237624 - RNA, 22 nt, Homo sapiens
auuucauguuuuugaucaaaaa

SEQ ID NO: 1237625 - RNA, 17 nt, Homo sapiens
auuucauuguaugaugu

SEQ ID NO: 1237626 - RNA, 22 nt, Homo sapiens
auuuccaaaccuccacugcugc

SEQ ID NO: 1237627 - RNA, 18 nt, Homo sapiens
auuuccaacaccacagac

SEQ ID NO: 1237628 - RNA, 22 nt, Homo sapiens
auuuccaagaaauauuccuuaa

SEQ ID NO: 1237629 - RNA, 18 nt, Homo sapiens
auuuccaaguaagaguac

SEQ ID NO: 1237630 - RNA, 13 nt, Homo sapiens
auuuccacaaaau

SEQ ID NO: 1237631 - RNA, 15 nt, Homo sapiens
auuuccaucauguca

SEQ ID NO: 1237632 - RNA, 19 nt, Homo sapiens
auuucccauuugugccaga

SEQ ID NO: 1237633 - RNA, 23 nt, Homo sapiens
auuucccauuugugccagaggaa

SEQ ID NO: 1237634 - RNA, 16 nt, Homo sapiens
auuuccuaaugucaga

SEQ ID NO: 1237635 - RNA, 20 nt, Homo sapiens
auuuccuaaugucagaguag

SEQ ID NO: 1237636 - RNA, 19 nt, Homo sapiens
auuuccucagcuuaucucu

SEQ ID NO: 1237637 - RNA, 15 nt, Homo sapiens
auuuccugacuugag

SEQ ID NO: 1237638 - RNA, 18 nt, Homo sapiens
auuuccugauaacauuau

SEQ ID NO: 1237639 - RNA, 23 nt, Homo sapiens
auuuccugugucuuuuuucacua

SEQ ID NO: 1237640 - RNA, 16 nt, Homo sapiens
auuucuaauggcccau

SEQ ID NO: 1237641 - RNA, 15 nt, Homo sapiens
auuucuacacagugg

SEQ ID NO: 1237642 - RNA, 13 nt, Homo sapiens
auuucuaccucag

SEQ ID NO: 1237643 - RNA, 16 nt, Homo sapiens
auuucuagaagcacau

SEQ ID NO: 1237644 - RNA, 17 nt, Homo sapiens
auuucucaaaugcacau

SEQ ID NO: 1237645 - RNA, 15 nt, Homo sapiens
auuucucuuccuaca

SEQ ID NO: 1237646 - RNA, 17 nt, Homo sapiens
auuucugaacuguuaca

SEQ ID NO: 1237647 - RNA, 23 nt, Homo sapiens
auuucugagagugaaaccaugac

SEQ ID NO: 1237648 - RNA, 16 nt, Homo sapiens
auuucugauacugcug

SEQ ID NO: 1237649 - RNA, 19 nt, Homo sapiens
auuucugaucuauacaaau

SEQ ID NO: 1237650 - RNA, 21 nt, Homo sapiens
auuucugggucuuucugacau

SEQ ID NO: 1237651 - RNA, 17 nt, Homo sapiens
auuucugguucugaugc

SEQ ID NO: 1237652 - RNA, 22 nt, Homo sapiens
auuucuguuauggggacuuuau

SEQ ID NO: 1237653 - RNA, 19 nt, Homo sapiens
auuucuguuccagucacau

SEQ ID NO: 1237654 - RNA, 15 nt, Homo sapiens
auuucuuaacuucuu

SEQ ID NO: 1237655 - RNA, 14 nt, Homo sapiens
auuucuucaaauaa

SEQ ID NO: 1237656 - RNA, 13 nt, Homo sapiens
auuucuucagucc

SEQ ID NO: 1237657 - RNA, 16 nt, Homo sapiens
auuucuucuacugcua

SEQ ID NO: 1237658 - RNA, 15 nt, Homo sapiens
auuucuuuccuccag

SEQ ID NO: 1237659 - RNA, 20 nt, Homo sapiens
auuucuuugaucuggacaga

SEQ ID NO: 1237660 - RNA, 15 nt, Homo sapiens
auuucuuuucugcau

SEQ ID NO: 1237661 - RNA, 20 nt, Homo sapiens
auuugaaaacauaaucugca

SEQ ID NO: 1237662 - RNA, 16 nt, Homo sapiens
cuccaccuagacugua

SEQ ID NO: 1237663 - RNA, 14 nt, Homo sapiens
cuccaccucuucac

SEQ ID NO: 1237664 - RNA, 16 nt, Homo sapiens
cuccaccuuccaaagg

SEQ ID NO: 1237665 - RNA, 21 nt, Homo sapiens
cuccacgugauuuccagugag

SEQ ID NO: 1237666 - RNA, 13 nt, Homo sapiens
cuccacucagguu

SEQ ID NO: 1237667 - RNA, 21 nt, Homo sapiens
cuccacuggaggggucuccuc

SEQ ID NO: 1237668 - RNA, 16 nt, Homo sapiens
cuccagaagggcagcu

SEQ ID NO: 1237669 - RNA, 17 nt, Homo sapiens
cuccagaaucugcuguu

SEQ ID NO: 1237670 - RNA, 12 nt, Homo sapiens
cuccagaccacc

SEQ ID NO: 1237671 - RNA, 22 nt, Homo sapiens
cuccagacuugggaaacuauuc

SEQ ID NO: 1237672 - RNA, 20 nt, Homo sapiens
cuccagauaguguagcugag

SEQ ID NO: 1237673 - RNA, 13 nt, Homo sapiens
cuccagcaccaua

SEQ ID NO: 1237674 - RNA, 23 nt, Homo sapiens
cuccagccaccacccacaaucac

SEQ ID NO: 1237675 - RNA, 21 nt, Homo sapiens
cuccagccuggcuacagggcg

SEQ ID NO: 1237676 - RNA, 22 nt, Homo sapiens
cuccagcugggagacacagcaa

SEQ ID NO: 1237677 - RNA, 18 nt, Homo sapiens
cuccagcuucgaugaugu

SEQ ID NO: 1237678 - RNA, 17 nt, Homo sapiens
cuccaggacaaccugcu

SEQ ID NO: 1237679 - RNA, 19 nt, Homo sapiens
cuccaggacucagugaucc

SEQ ID NO: 1237680 - RNA, 20 nt, Homo sapiens
cuccaggacuccacuggaca

SEQ ID NO: 1237681 - RNA, 21 nt, Homo sapiens
cuccaggaugaguuacuugaa

SEQ ID NO: 1237682 - RNA, 22 nt, Homo sapiens
cuccaggaugaguuacuugaaa

SEQ ID NO: 1237683 - RNA, 18 nt, Homo sapiens
cuccaggcccaaggcucc

SEQ ID NO: 1237684 - RNA, 18 nt, Homo sapiens
cuccaggcuuucaauguu

SEQ ID NO: 1237685 - RNA, 19 nt, Homo sapiens
cuccaguaccuugcuucuu

SEQ ID NO: 1237686 - RNA, 13 nt, Homo sapiens
cuccaguagaaag

SEQ ID NO: 1237687 - RNA, 17 nt, Homo sapiens
cuccaguauucuuguca

SEQ ID NO: 1237688 - RNA, 18 nt, Homo sapiens
cuccagugccagcaauga

SEQ ID NO: 1237689 - RNA, 19 nt, Homo sapiens
cuccagugggcugaugcug

SEQ ID NO: 1237690 - RNA, 14 nt, Homo sapiens
cuccaguguacaua

SEQ ID NO: 1237691 - RNA, 19 nt, Homo sapiens
cuccaguuuuuuguuauau

SEQ ID NO: 1237692 - RNA, 22 nt, Homo sapiens
cuccauaucccuuccucucagg

SEQ ID NO: 1237693 - RNA, 21 nt, Homo sapiens
cuccaucaauaaauguugcaa

SEQ ID NO: 1237694 - RNA, 18 nt, Homo sapiens
cuccaucccaacagccau

SEQ ID NO: 1237695 - RNA, 22 nt, Homo sapiens
cuccaucuuuauagaaggaauu

SEQ ID NO: 1237696 - RNA, 20 nt, Homo sapiens
cuccaugaauuaguucuccu

SEQ ID NO: 1237697 - RNA, 20 nt, Homo sapiens
cuccauuuaccaguaacuua

SEQ ID NO: 1237698 - RNA, 21 nt, Homo sapiens
cuccauuugcaauugaccucu

SEQ ID NO: 1237699 - RNA, 18 nt, Homo sapiens
cucccaaagugcugagau

SEQ ID NO: 1237700 - RNA, 21 nt, Homo sapiens
cucccaaagugcugagauuac

SEQ ID NO: 1237701 - RNA, 18 nt, Homo sapiens
cucccaaagugcuggaau

SEQ ID NO: 1237702 - RNA, 17 nt, Homo sapiens
cucccacaaugcugaau

SEQ ID NO: 1237703 - RNA, 19 nt, Homo sapiens
cucccacacugaaaccaaa

SEQ ID NO: 1237704 - RNA, 12 nt, Homo sapiens
cucccacagaac

SEQ ID NO: 1237705 - RNA, 13 nt, Homo sapiens
cucccacauucug

SEQ ID NO: 1237706 - RNA, 20 nt, Homo sapiens
cucccaggcuggagugcagu

SEQ ID NO: 1237707 - RNA, 16 nt, Homo sapiens
cucccagguaccagcu

SEQ ID NO: 1237708 - RNA, 14 nt, Homo sapiens
cucccaucuucagg

SEQ ID NO: 1237709 - RNA, 19 nt, Homo sapiens
cuccccacacagacuccac

SEQ ID NO: 1237710 - RNA, 20 nt, Homo sapiens
cuccccaccccacacacacu

SEQ ID NO: 1237711 - RNA, 13 nt, Homo sapiens
cuccccaccuuca

SEQ ID NO: 1237712 - RNA, 20 nt, Homo sapiens
cuccccacgacaaccccacu

SEQ ID NO: 1237713 - RNA, 15 nt, Homo sapiens
cuccccacucuaggg

SEQ ID NO: 1237714 - RNA, 21 nt, Homo sapiens
cuccccagaugugacuacuga

SEQ ID NO: 1237715 - RNA, 18 nt, Homo sapiens
cuccccagcaagugagag

SEQ ID NO: 1237716 - RNA, 20 nt, Homo sapiens
cuccccaugccacguuccac

SEQ ID NO: 1237717 - RNA, 17 nt, Homo sapiens
cuccccugcccuggucc

SEQ ID NO: 1237718 - RNA, 15 nt, Homo sapiens
cuccccuguaccuuu

SEQ ID NO: 1237719 - RNA, 20 nt, Homo sapiens
cucccgaguagcugggauua

SEQ ID NO: 1237720 - RNA, 15 nt, Homo sapiens
cucccgaugcugcua

SEQ ID NO: 1237721 - RNA, 16 nt, Homo sapiens
cucccgaugcugcuau

SEQ ID NO: 1237722 - RNA, 17 nt, Homo sapiens
cucccggguucaaguga

SEQ ID NO: 1237723 - RNA, 17 nt, Homo sapiens
cucccuaccguccuccu

SEQ ID NO: 1237724 - RNA, 16 nt, Homo sapiens
cucccuccaguaccau

SEQ ID NO: 1237725 - RNA, 23 nt, Homo sapiens
cucccuccccagaaacagugugc

SEQ ID NO: 1237726 - RNA, 16 nt, Homo sapiens
cucccucucaguggag

SEQ ID NO: 1237727 - RNA, 17 nt, Homo sapiens
cucccugcugugccaug

SEQ ID NO: 1237728 - RNA, 15 nt, Homo sapiens
cucccuggagcugcu

SEQ ID NO: 1237729 - RNA, 14 nt, Homo sapiens
cucccuggaugaca

SEQ ID NO: 1237730 - RNA, 17 nt, Homo sapiens
cucccuggaugacauua

SEQ ID NO: 1237731 - RNA, 20 nt, Homo sapiens
cucccuguagcucugccucc

SEQ ID NO: 1237732 - RNA, 22 nt, Homo sapiens
cucccugucucugcaucugacu

SEQ ID NO: 1237733 - RNA, 17 nt, Homo sapiens
cucccuugcccuagaua

SEQ ID NO: 1237734 - RNA, 18 nt, Homo sapiens
cucccuuugccagugccu

SEQ ID NO: 1237735 - RNA, 16 nt, Homo sapiens
cuccgcgccuugccuc

SEQ ID NO: 1237736 - RNA, 18 nt, Homo sapiens
cuccgggcaaauggcuga

SEQ ID NO: 1237737 - RNA, 19 nt, Homo sapiens
cuccggggucugugcugug

SEQ ID NO: 1237738 - RNA, 18 nt, Homo sapiens
cuccguuuggcagugcaa

SEQ ID NO: 1237739 - RNA, 20 nt, Homo sapiens
cuccuacaggugcuguucag

SEQ ID NO: 1237740 - RNA, 15 nt, Homo sapiens
cuccuacuaugcaau

SEQ ID NO: 1237741 - RNA, 22 nt, Homo sapiens
cuccuaggggaacagaccagug

SEQ ID NO: 1237742 - RNA, 12 nt, Homo sapiens
cuccucaaaagc

SEQ ID NO: 1237743 - RNA, 21 nt, Homo sapiens
cuccucacuggaggagcagcu

SEQ ID NO: 1237744 - RNA, 20 nt, Homo sapiens
cuccucacuguauccagguu

SEQ ID NO: 1237745 - RNA, 21 nt, Homo sapiens
cuccucagaucugaacacagu

SEQ ID NO: 1237746 - RNA, 15 nt, Homo sapiens
cuccuccauucccua

SEQ ID NO: 1237747 - RNA, 15 nt, Homo sapiens
cuccucccugucaua

SEQ ID NO: 1237748 - RNA, 16 nt, Homo sapiens
cuccuccucuucacuu

SEQ ID NO: 1237749 - RNA, 14 nt, Homo sapiens
cuccucgcugccag

SEQ ID NO: 1237750 - RNA, 22 nt, Homo sapiens
cuccucuccagcccugcagcua

SEQ ID NO: 1237751 - RNA, 16 nt, Homo sapiens
cuccucuccccagcaa

SEQ ID NO: 1237752 - RNA, 12 nt, Homo sapiens
cuccucugcacu

SEQ ID NO: 1237753 - RNA, 18 nt, Homo sapiens
cuccucugcagugccuug

SEQ ID NO: 1237754 - RNA, 22 nt, Homo sapiens
cuccucuguccaggcacugcug

SEQ ID NO: 1237755 - RNA, 12 nt, Homo sapiens
cuccugaccucg

SEQ ID NO: 1237756 - RNA, 14 nt, Homo sapiens
cuccugacuguaac

SEQ ID NO: 1237757 - RNA, 17 nt, Homo sapiens
cuccugagaaaggugag

SEQ ID NO: 1237758 - RNA, 17 nt, Homo sapiens
cuccugagccacucaga

SEQ ID NO: 1237759 - RNA, 14 nt, Homo sapiens
cuccugagccugug

SEQ ID NO: 1237760 - RNA, 12 nt, Homo sapiens
cuccugccugag

SEQ ID NO: 1237761 - RNA, 12 nt, Homo sapiens
cuccugccuuag

SEQ ID NO: 1237762 - RNA, 23 nt, Homo sapiens
cuccugcgcccuucauugccaca

SEQ ID NO: 1237763 - RNA, 15 nt, Homo sapiens
cuccuggccuggcca

SEQ ID NO: 1237764 - RNA, 20 nt, Homo sapiens
cuccuggguucaagugauuc

SEQ ID NO: 1237765 - RNA, 14 nt, Homo sapiens
cuccuggucuguga

SEQ ID NO: 1237766 - RNA, 19 nt, Homo sapiens
cuccugucccuugaccuua

SEQ ID NO: 1237767 - RNA, 14 nt, Homo sapiens
cuuuccuugcucaa

SEQ ID NO: 1237768 - RNA, 15 nt, Homo sapiens
cuuucuaaauugcau

SEQ ID NO: 1237769 - RNA, 13 nt, Homo sapiens
cuuucuaacaaaa

SEQ ID NO: 1237770 - RNA, 20 nt, Homo sapiens
cuuucuaaguaggaugaauc

SEQ ID NO: 1237771 - RNA, 14 nt, Homo sapiens
cuuucuacccagcg

SEQ ID NO: 1237772 - RNA, 23 nt, Homo sapiens
cuuucuaggagggagacacuggc

SEQ ID NO: 1237773 - RNA, 21 nt, Homo sapiens
cuuucuaucuuauauacuuau

SEQ ID NO: 1237774 - RNA, 16 nt, Homo sapiens
cuuucuccaggaccaa

SEQ ID NO: 1237775 - RNA, 12 nt, Homo sapiens
cuuucucuaaaa

SEQ ID NO: 1237776 - RNA, 20 nt, Homo sapiens
cuuucucugccagugacaga

SEQ ID NO: 1237777 - RNA, 22 nt, Homo sapiens
cuuucucugccagugacagaca

SEQ ID NO: 1237778 - RNA, 12 nt, Homo sapiens
cuuucucuguag

SEQ ID NO: 1237779 - RNA, 22 nt, Homo sapiens
cuuucucuuguaaacguuucag

SEQ ID NO: 1237780 - RNA, 18 nt, Homo sapiens
cuuucugaaauuagggcc

SEQ ID NO: 1237781 - RNA, 16 nt, Homo sapiens
cuuucugacaaaaagu

SEQ ID NO: 1237782 - RNA, 16 nt, Homo sapiens
cuuucugugcagagau

SEQ ID NO: 1237783 - RNA, 22 nt, Homo sapiens
cuuucuuacauuagcaguuugc

SEQ ID NO: 1237784 - RNA, 15 nt, Homo sapiens
cuuucuuuccauuua

SEQ ID NO: 1237785 - RNA, 13 nt, Homo sapiens
cuuugaaauaccu

SEQ ID NO: 1237786 - RNA, 14 nt, Homo sapiens
cuuugaagccucag

SEQ ID NO: 1237787 - RNA, 22 nt, Homo sapiens
cuuugaagugacuucacagaga

SEQ ID NO: 1237788 - RNA, 14 nt, Homo sapiens
cuuugacaguguuu

SEQ ID NO: 1237789 - RNA, 15 nt, Homo sapiens
cuuugacuccuuuga

SEQ ID NO: 1237790 - RNA, 17 nt, Homo sapiens
cuuugagacugggucuc

SEQ ID NO: 1237791 - RNA, 23 nt, Homo sapiens
cuuugagggacugccucugccac

SEQ ID NO: 1237792 - RNA, 14 nt, Homo sapiens
cuuugaucaguaua

SEQ ID NO: 1237793 - RNA, 17 nt, Homo sapiens
cuuugaucuucagggaa

SEQ ID NO: 1237794 - RNA, 16 nt, Homo sapiens
cuuugauuaugcagac

SEQ ID NO: 1237795 - RNA, 13 nt, Homo sapiens
cuuugcaaacccu

SEQ ID NO: 1237796 - RNA, 17 nt, Homo sapiens
cuuugcaccaaagacau

SEQ ID NO: 1237797 - RNA, 11 nt, Homo sapiens
cuuugcacuga

SEQ ID NO: 1237798 - RNA, 13 nt, Homo sapiens
cuuugcacugagg

SEQ ID NO: 1237799 - RNA, 20 nt, Homo sapiens
cuuugcagagaaccucagau

SEQ ID NO: 1237800 - RNA, 21 nt, Homo sapiens
cuuugccaauucauuucucua

SEQ ID NO: 1237801 - RNA, 14 nt, Homo sapiens
cuuugccacaaagc

SEQ ID NO: 1237802 - RNA, 19 nt, Homo sapiens
cuuugccacacacaguuac

SEQ ID NO: 1237803 - RNA, 19 nt, Homo sapiens
cuuugccagaaagcauaaa

SEQ ID NO: 1237804 - RNA, 16 nt, Homo sapiens
cuuugcccaacaccag

SEQ ID NO: 1237805 - RNA, 21 nt, Homo sapiens
cuuugccccuggggcuuccau

SEQ ID NO: 1237806 - RNA, 20 nt, Homo sapiens
cuuugccuucucuguucccu

SEQ ID NO: 1237807 - RNA, 15 nt, Homo sapiens
cuuugcggugggacc

SEQ ID NO: 1237808 - RNA, 17 nt, Homo sapiens
cuuugcucccugcaaga

SEQ ID NO: 1237809 - RNA, 18 nt, Homo sapiens
cuuugcucccugcaagaa

SEQ ID NO: 1237810 - RNA, 15 nt, Homo sapiens
cuuugcugauuuccc

SEQ ID NO: 1237811 - RNA, 14 nt, Homo sapiens
cuuugcugccugag

SEQ ID NO: 1237812 - RNA, 16 nt, Homo sapiens
cuuuggaaauacacag

SEQ ID NO: 1237813 - RNA, 17 nt, Homo sapiens
cuuuggagaugcugagg

SEQ ID NO: 1237814 - RNA, 17 nt, Homo sapiens
cuuuggagcagcuucug

SEQ ID NO: 1237815 - RNA, 20 nt, Homo sapiens
cuuuggcaaaacuuaggcau

SEQ ID NO: 1237816 - RNA, 22 nt, Homo sapiens
cuuuggguuccaucuugcuaau

SEQ ID NO: 1237817 - RNA, 19 nt, Homo sapiens
cuuuguaacggcucuuagc

SEQ ID NO: 1237818 - RNA, 15 nt, Homo sapiens
cuuuguauuccuuaa

SEQ ID NO: 1237819 - RNA, 11 nt, Homo sapiens
cuuugucacaa

SEQ ID NO: 1237820 - RNA, 14 nt, Homo sapiens
cuuugucagcauca

SEQ ID NO: 1237821 - RNA, 14 nt, Homo sapiens
cuuugucucaaaau

SEQ ID NO: 1237822 - RNA, 16 nt, Homo sapiens
cuuugucucaaaauaa

SEQ ID NO: 1237823 - RNA, 15 nt, Homo sapiens
cuuugugauaauuua

SEQ ID NO: 1237824 - RNA, 13 nt, Homo sapiens
cuuuguggaccaa

SEQ ID NO: 1237825 - RNA, 20 nt, Homo sapiens
cuuugugugcgucacuguga

SEQ ID NO: 1237826 - RNA, 11 nt, Homo sapiens
cuuuguugccc

SEQ ID NO: 1237827 - RNA, 16 nt, Homo sapiens
cuuuguugcucagcaa

SEQ ID NO: 1237828 - RNA, 15 nt, Homo sapiens
cuuuuaaaaaugucc

SEQ ID NO: 1237829 - RNA, 22 nt, Homo sapiens
cuuuuaaaaauucaaaugauuu

SEQ ID NO: 1237830 - RNA, 19 nt, Homo sapiens
cuuuuaaaaugcaauguaa

SEQ ID NO: 1237831 - RNA, 16 nt, Homo sapiens
cuuuuaaaaugcccuu

SEQ ID NO: 1237832 - RNA, 15 nt, Homo sapiens
cuuuuaaacuuugau

SEQ ID NO: 1237833 - RNA, 16 nt, Homo sapiens
cuuuuaacagaacaga

SEQ ID NO: 1237834 - RNA, 17 nt, Homo sapiens
cuuuuaagaaacacagg

SEQ ID NO: 1237835 - RNA, 16 nt, Homo sapiens
cuuuuaagcagucuca

SEQ ID NO: 1237836 - RNA, 12 nt, Homo sapiens
cuuuuaagccag

SEQ ID NO: 1237837 - RNA, 23 nt, Homo sapiens
cuuuuaccuacccgugccugaga

SEQ ID NO: 1237838 - RNA, 17 nt, Homo sapiens
cuuuuacucugccuaca

SEQ ID NO: 1237839 - RNA, 21 nt, Homo sapiens
cuuuuagaaauacugcaagaa

SEQ ID NO: 1237840 - RNA, 21 nt, Homo sapiens
cuuuuagacaacuagauuugu

SEQ ID NO: 1237841 - RNA, 20 nt, Homo sapiens
cuuuuaggagaauucacaga

SEQ ID NO: 1237842 - RNA, 14 nt, Homo sapiens
cuuuuaucugcaga

SEQ ID NO: 1237843 - RNA, 13 nt, Homo sapiens
cuuuuaugcagau

SEQ ID NO: 1237844 - RNA, 16 nt, Homo sapiens
cuuuuauggaugauua

SEQ ID NO: 1237845 - RNA, 19 nt, Homo sapiens
cuuuuauguagcacauaaa

SEQ ID NO: 1237846 - RNA, 22 nt, Homo sapiens
cuuuucaggguuuucugaggga

SEQ ID NO: 1237847 - RNA, 18 nt, Homo sapiens
cuuuucauaaccuagccu

SEQ ID NO: 1237848 - RNA, 18 nt, Homo sapiens
cuuuucauuaaagaaugu

SEQ ID NO: 1237849 - RNA, 15 nt, Homo sapiens
cuuuuccaagcuccu

SEQ ID NO: 1237850 - RNA, 16 nt, Homo sapiens
cuuuuccaagcuccuu

SEQ ID NO: 1237851 - RNA, 18 nt, Homo sapiens
cuuuuccacuuguuaaaa

SEQ ID NO: 1237852 - RNA, 16 nt, Homo sapiens
cuuuuccuuucugcca

SEQ ID NO: 1237853 - RNA, 22 nt, Homo sapiens
cuuuucggccccauguaucuca

SEQ ID NO: 1237854 - RNA, 23 nt, Homo sapiens
cuuuucggccccauguaucucag

SEQ ID NO: 1237855 - RNA, 16 nt, Homo sapiens
cuuuucuaacucuccc

SEQ ID NO: 1237856 - RNA, 14 nt, Homo sapiens
cuuuucuacauaca

SEQ ID NO: 1237857 - RNA, 21 nt, Homo sapiens
cuuuucuccucacuguaucca

SEQ ID NO: 1237858 - RNA, 16 nt, Homo sapiens
cuuuucugcauguucu

SEQ ID NO: 1237859 - RNA, 19 nt, Homo sapiens
cuuuucuguacuuccugag

SEQ ID NO: 1237860 - RNA, 16 nt, Homo sapiens
cuuuucuuuuucuccc

SEQ ID NO: 1237861 - RNA, 16 nt, Homo sapiens
cuuuugaaguaauccc

SEQ ID NO: 1237862 - RNA, 18 nt, Homo sapiens
cuuuugaauuuuugguua

SEQ ID NO: 1237863 - RNA, 16 nt, Homo sapiens
cuuuugcauaaaagac

SEQ ID NO: 1237864 - RNA, 22 nt, Homo sapiens
cuuuugccaguauuaugcauau

SEQ ID NO: 1237865 - RNA, 16 nt, Homo sapiens
cuuuuggaacauuucu

SEQ ID NO: 1237866 - RNA, 23 nt, Homo sapiens
cuuuugugaauuaggcuguaacu

SEQ ID NO: 1237867 - RNA, 21 nt, Homo sapiens
cuuuuguuaaaagaugguaaa

SEQ ID NO: 1237868 - RNA, 18 nt, Homo sapiens
cuuuuguuccuuuguuaa

SEQ ID NO: 1237869 - RNA, 12 nt, Homo sapiens
cuuuuguugccc

SEQ ID NO: 1237870 - RNA, 15 nt, Homo sapiens
cuuuuguuucuagaa

SEQ ID NO: 1237871 - RNA, 23 nt, Homo sapiens
cuuuuuaaaguguuucuguuauu

SEQ ID NO: 1237872 - RNA, 13 nt, Homo sapiens
cuuuuuaguuuac

SEQ ID NO: 1237873 - RNA, 13 nt, Homo sapiens
cuuuuuaugcauu

SEQ ID NO: 1237874 - RNA, 13 nt, Homo sapiens
cuuuuuccacaag

SEQ ID NO: 1237875 - RNA, 18 nt, Homo sapiens
cuuuuuccaucuucuccc

SEQ ID NO: 1237876 - RNA, 17 nt, Homo sapiens
cuuuuucccucuuccca

SEQ ID NO: 1237877 - RNA, 21 nt, Homo sapiens
cuuuuucugugauaacucugc

SEQ ID NO: 1237878 - RNA, 15 nt, Homo sapiens
cuuuuuggagagugc

SEQ ID NO: 1237879 - RNA, 21 nt, Homo sapiens
cuuuuuggcugacuucaucug

SEQ ID NO: 1237880 - RNA, 19 nt, Homo sapiens
cuuuuugggagaaugaugu

SEQ ID NO: 1237881 - RNA, 14 nt, Homo sapiens
cuuuuuguauguga

SEQ ID NO: 1237882 - RNA, 16 nt, Homo sapiens
cuuuuuucaauaugca

SEQ ID NO: 1237883 - RNA, 13 nt, Homo sapiens
cuuuuuucauuuc

SEQ ID NO: 1237884 - RNA, 16 nt, Homo sapiens
cuuuuuucuaguuuca

SEQ ID NO: 1237885 - RNA, 14 nt, Homo sapiens
cuuuuuucuuacca

SEQ ID NO: 1237886 - RNA, 22 nt, Homo sapiens
cuuuuuuucuugcuaguauucg

SEQ ID NO: 1237887 - RNA, 18 nt, Homo sapiens
cuuuuuuuuuaaggugaa

SEQ ID NO: 1237888 - RNA, 12 nt, Homo sapiens
gaaaaaaacugg

SEQ ID NO: 1237889 - RNA, 22 nt, Homo sapiens
gaaaaaaacugggauaacugau

SEQ ID NO: 1237890 - RNA, 17 nt, Homo sapiens
gaaaaaaauguacauuu

SEQ ID NO: 1237891 - RNA, 14 nt, Homo sapiens
gaaaaaaauuacua

SEQ ID NO: 1237892 - RNA, 16 nt, Homo sapiens
gaaaaaagaaccaaaa

SEQ ID NO: 1237893 - RNA, 15 nt, Homo sapiens
gaaaaaauucccuca

SEQ ID NO: 1237894 - RNA, 19 nt, Homo sapiens
gaaaaacaccgcuucugcc

SEQ ID NO: 1237895 - RNA, 13 nt, Homo sapiens
cucgcaugacugu

SEQ ID NO: 1237896 - RNA, 15 nt, Homo sapiens
cucgcaugacuguua

SEQ ID NO: 1237897 - RNA, 19 nt, Homo sapiens
cucgccuaccaaucucugc

SEQ ID NO: 1237898 - RNA, 16 nt, Homo sapiens
cucgcuccucaacccc

SEQ ID NO: 1237899 - RNA, 16 nt, Homo sapiens
cucgcugaaagcacua

SEQ ID NO: 1237900 - RNA, 15 nt, Homo sapiens
cucggauacuugcca

SEQ ID NO: 1237901 - RNA, 18 nt, Homo sapiens
cucggcagucacuuccac

SEQ ID NO: 1237902 - RNA, 23 nt, Homo sapiens
cucggccuccucccacaagcacc

SEQ ID NO: 1237903 - RNA, 20 nt, Homo sapiens
cucgggaaacacacaagcaa

SEQ ID NO: 1237904 - RNA, 21 nt, Homo sapiens
cucgggaagggaagauggaug

SEQ ID NO: 1237905 - RNA, 21 nt, Homo sapiens
cucgggugcauuugagagaag

SEQ ID NO: 1237906 - RNA, 22 nt, Homo sapiens
cucgguucaaaaccuugcacag

SEQ ID NO: 1237907 - RNA, 17 nt, Homo sapiens
cucgucuuccuuguuaa

SEQ ID NO: 1237908 - RNA, 11 nt, Homo sapiens
cucgugccaug

SEQ ID NO: 1237909 - RNA, 18 nt, Homo sapiens
cucguucaaaacauucca

SEQ ID NO: 1237910 - RNA, 13 nt, Homo sapiens
cucuaacaaaaug

SEQ ID NO: 1237911 - RNA, 14 nt, Homo sapiens
cucuaacauccuug

SEQ ID NO: 1237912 - RNA, 16 nt, Homo sapiens
cucuaacuccugccau

SEQ ID NO: 1237913 - RNA, 17 nt, Homo sapiens
cucuaagccaacuuuaa

SEQ ID NO: 1237914 - RNA, 12 nt, Homo sapiens
cucuaagcugug

SEQ ID NO: 1237915 - RNA, 18 nt, Homo sapiens
cucuaaugagacugacca

SEQ ID NO: 1237916 - RNA, 19 nt, Homo sapiens
cucuaaugcuugauuuagg

SEQ ID NO: 1237917 - RNA, 16 nt, Homo sapiens
cucuaauguacaauaa

SEQ ID NO: 1237918 - RNA, 19 nt, Homo sapiens
cucuaauucggauuugcca

SEQ ID NO: 1237919 - RNA, 17 nt, Homo sapiens
cucuacaaaaaccaaaa

SEQ ID NO: 1237920 - RNA, 19 nt, Homo sapiens
cucuacaucuagcaauuuc

SEQ ID NO: 1237921 - RNA, 18 nt, Homo sapiens
cucuacgggugacagauc

SEQ ID NO: 1237922 - RNA, 17 nt, Homo sapiens
cucuacgucccagggag

SEQ ID NO: 1237923 - RNA, 16 nt, Homo sapiens
cucuacuacaugugac

SEQ ID NO: 1237924 - RNA, 17 nt, Homo sapiens
cucuacuccuaccucag

SEQ ID NO: 1237925 - RNA, 17 nt, Homo sapiens
cucuagagucacugaua

SEQ ID NO: 1237926 - RNA, 23 nt, Homo sapiens
cucuaggccucuccaguuugcac

SEQ ID NO: 1237927 - RNA, 17 nt, Homo sapiens
cucuaggccuguugccu

SEQ ID NO: 1237928 - RNA, 23 nt, Homo sapiens
cucuaguaucacuuuugcuguga

SEQ ID NO: 1237929 - RNA, 14 nt, Homo sapiens
cucuagugggacag

SEQ ID NO: 1237930 - RNA, 18 nt, Homo sapiens
cucuagugucuuuugccu

SEQ ID NO: 1237931 - RNA, 21 nt, Homo sapiens
cucuagugucuuuugccuuua

SEQ ID NO: 1237932 - RNA, 14 nt, Homo sapiens
cucuauacaucucu

SEQ ID NO: 1237933 - RNA, 13 nt, Homo sapiens
cucuaucuuccuc

SEQ ID NO: 1237934 - RNA, 13 nt, Homo sapiens
cucuauucucaaa

SEQ ID NO: 1237935 - RNA, 16 nt, Homo sapiens
cucuauugcuauugcc

SEQ ID NO: 1237936 - RNA, 22 nt, Homo sapiens
cucuauuuugugaugaugcugu

SEQ ID NO: 1237937 - RNA, 16 nt, Homo sapiens
cucuauuuuuacauuu

SEQ ID NO: 1237938 - RNA, 14 nt, Homo sapiens
cucucaaacuucac

SEQ ID NO: 1237939 - RNA, 20 nt, Homo sapiens
cucucaaguagcugggacua

SEQ ID NO: 1237940 - RNA, 17 nt, Homo sapiens
cucucacccgaccggug

SEQ ID NO: 1237941 - RNA, 13 nt, Homo sapiens
cucucacccucau

SEQ ID NO: 1237942 - RNA, 15 nt, Homo sapiens
cucucagcagaaaca

SEQ ID NO: 1237943 - RNA, 15 nt, Homo sapiens
cucucagcugaccau

SEQ ID NO: 1237944 - RNA, 17 nt, Homo sapiens
cucucagcugaccauca

SEQ ID NO: 1237945 - RNA, 17 nt, Homo sapiens
cucuccaauacucaggu

SEQ ID NO: 1237946 - RNA, 11 nt, Homo sapiens
cucuccaggga

SEQ ID NO: 1237947 - RNA, 22 nt, Homo sapiens
cucuccauaucuccuuccccua

SEQ ID NO: 1237948 - RNA, 17 nt, Homo sapiens
cucuccccagcaaguga

SEQ ID NO: 1237949 - RNA, 22 nt, Homo sapiens
cucuccccauccccacccaguc

SEQ ID NO: 1237950 - RNA, 22 nt, Homo sapiens
cucucccgucagggcccaaguc

SEQ ID NO: 1237951 - RNA, 14 nt, Homo sapiens
cucucccugccaag

SEQ ID NO: 1237952 - RNA, 15 nt, Homo sapiens
cucucccugccaagu

SEQ ID NO: 1237953 - RNA, 15 nt, Homo sapiens
cucuccgaccagaca

SEQ ID NO: 1237954 - RNA, 16 nt, Homo sapiens
cucuccugaauccuuu

SEQ ID NO: 1237955 - RNA, 20 nt, Homo sapiens
cucuccuguaagccaaagaa

SEQ ID NO: 1237956 - RNA, 14 nt, Homo sapiens
cucuccuucuuagc

SEQ ID NO: 1237957 - RNA, 15 nt, Homo sapiens
cucucgacaguaucc

SEQ ID NO: 1237958 - RNA, 18 nt, Homo sapiens
cucucgacaguauccaca

SEQ ID NO: 1237959 - RNA, 15 nt, Homo sapiens
cucucuacagugcca

SEQ ID NO: 1237960 - RNA, 11 nt, Homo sapiens
cucucuagcac

SEQ ID NO: 1237961 - RNA, 23 nt, Homo sapiens
cucucugggccucaguuuuccca

SEQ ID NO: 1237962 - RNA, 18 nt, Homo sapiens
cucucugguuuacuucaa

SEQ ID NO: 1237963 - RNA, 15 nt, Homo sapiens
cucucuguggugaga

SEQ ID NO: 1237964 - RNA, 19 nt, Homo sapiens
cucugaaaucucagaauuc

SEQ ID NO: 1237965 - RNA, 15 nt, Homo sapiens
cucugaaugaagcug

SEQ ID NO: 1237966 - RNA, 16 nt, Homo sapiens
cucugaaugaagcuga

SEQ ID NO: 1237967 - RNA, 16 nt, Homo sapiens
cucugacccuagcucu

SEQ ID NO: 1237968 - RNA, 17 nt, Homo sapiens
cucugaccugcacuggg

SEQ ID NO: 1237969 - RNA, 21 nt, Homo sapiens
cucugacguugaucccagaga

SEQ ID NO: 1237970 - RNA, 14 nt, Homo sapiens
cucugagaucuaag

SEQ ID NO: 1237971 - RNA, 20 nt, Homo sapiens
cucugagcaaauguggcucc

SEQ ID NO: 1237972 - RNA, 15 nt, Homo sapiens
cucugaggcuaugga

SEQ ID NO: 1237973 - RNA, 12 nt, Homo sapiens
cucugauaccuc

SEQ ID NO: 1237974 - RNA, 17 nt, Homo sapiens
cucugaucccauauucu

SEQ ID NO: 1237975 - RNA, 16 nt, Homo sapiens
cucugcaaugcuucug

SEQ ID NO: 1237976 - RNA, 14 nt, Homo sapiens
cucugcacagacaa

SEQ ID NO: 1237977 - RNA, 18 nt, Homo sapiens
cucugcacaugucuugua

SEQ ID NO: 1237978 - RNA, 17 nt, Homo sapiens
cucugcacuacugacau

SEQ ID NO: 1237979 - RNA, 18 nt, Homo sapiens
cucugcagacugcuagug

SEQ ID NO: 1237980 - RNA, 17 nt, Homo sapiens
cucugcagcccucagau

SEQ ID NO: 1237981 - RNA, 20 nt, Homo sapiens
cucugcagcccucagauuau

SEQ ID NO: 1237982 - RNA, 17 nt, Homo sapiens
cucugcagcucagggac

SEQ ID NO: 1237983 - RNA, 15 nt, Homo sapiens
cucugcauaccguga

SEQ ID NO: 1237984 - RNA, 20 nt, Homo sapiens
cucugcauaccgugaauuua

SEQ ID NO: 1237985 - RNA, 19 nt, Homo sapiens
cucugcaucuccugucuuu

SEQ ID NO: 1237986 - RNA, 14 nt, Homo sapiens
cucugcauguuaca

SEQ ID NO: 1237987 - RNA, 14 nt, Homo sapiens
cucugccugaaguc

SEQ ID NO: 1237988 - RNA, 21 nt, Homo sapiens
cucugcgccggacuuggugcg

SEQ ID NO: 1237989 - RNA, 15 nt, Homo sapiens
cucugcuacuccauc

SEQ ID NO: 1237990 - RNA, 11 nt, Homo sapiens
cucugcuccuu

SEQ ID NO: 1237991 - RNA, 14 nt, Homo sapiens
cucugcugaaggaa

SEQ ID NO: 1237992 - RNA, 20 nt, Homo sapiens
cucuggacaggcauguucuc

SEQ ID NO: 1237993 - RNA, 16 nt, Homo sapiens
cucuggagcaauguug

SEQ ID NO: 1237994 - RNA, 23 nt, Homo sapiens
cucuggccucagccgacugcaca

SEQ ID NO: 1237995 - RNA, 23 nt, Homo sapiens
cucuggcugcucccugacagcac

SEQ ID NO: 1237996 - RNA, 14 nt, Homo sapiens
cucugggagacuuu

SEQ ID NO: 1237997 - RNA, 21 nt, Homo sapiens
cucugggggagugcagggugg

SEQ ID NO: 1237998 - RNA, 17 nt, Homo sapiens
cucuggggucuuuuuau

SEQ ID NO: 1237999 - RNA, 24 nt, Homo sapiens
cucugggugucucccacaugucua

SEQ ID NO: 1238000 - RNA, 18 nt, Homo sapiens
cucugguaaaugaucacu

SEQ ID NO: 1238001 - RNA, 15 nt, Homo sapiens
cucugguaauauuga

SEQ ID NO: 1238002 - RNA, 20 nt, Homo sapiens
cucuguaaaaacacugaaaa

SEQ ID NO: 1238003 - RNA, 11 nt, Homo sapiens
cucuguaaaac

SEQ ID NO: 1238004 - RNA, 21 nt, Homo sapiens
cucugugggugcuacacagaa

SEQ ID NO: 1238005 - RNA, 22 nt, Homo sapiens
cucugugucagcacaguguaau

SEQ ID NO: 1238006 - RNA, 14 nt, Homo sapiens
cucugugucaggug

SEQ ID NO: 1238007 - RNA, 17 nt, Homo sapiens
cucuguuauguacugua

SEQ ID NO: 1238008 - RNA, 14 nt, Homo sapiens
cucuguucacaaac

SEQ ID NO: 1238009 - RNA, 12 nt, Homo sapiens
cucuguugacug

SEQ ID NO: 1238010 - RNA, 19 nt, Homo sapiens
cucuguuucccuuucacug

SEQ ID NO: 1238011 - RNA, 20 nt, Homo sapiens
cucuuaaaccacagcacuau

SEQ ID NO: 1238012 - RNA, 19 nt, Homo sapiens
cucuuaagccuaaaugccu

SEQ ID NO: 1238013 - RNA, 15 nt, Homo sapiens
cucuuacacauagca

SEQ ID NO: 1238014 - RNA, 16 nt, Homo sapiens
cucuuagacccacaga

SEQ ID NO: 1238015 - RNA, 21 nt, Homo sapiens
cucuuagagaaagaacuauga

SEQ ID NO: 1238016 - RNA, 23 nt, Homo sapiens
cucuuagagaaagaacuaugaaa

SEQ ID NO: 1238017 - RNA, 12 nt, Homo sapiens
cucuuaucucag

SEQ ID NO: 1238018 - RNA, 21 nt, Homo sapiens
cucuuaucucagucaugcaua

SEQ ID NO: 1238019 - RNA, 21 nt, Homo sapiens
cucuucaacugaccagccucc

SEQ ID NO: 1238020 - RNA, 22 nt, Homo sapiens
cucuucacagggaagcauguga

SEQ ID NO: 1238021 - RNA, 19 nt, Homo sapiens
cucuucagaaaacccuuuu

SEQ ID NO: 1238022 - RNA, 17 nt, Homo sapiens
cucuucaggaaaccaga

SEQ ID NO: 1238023 - RNA, 18 nt, Homo sapiens
cugcauggugacagucuc

SEQ ID NO: 1238024 - RNA, 14 nt, Homo sapiens
cugcauguacugua

SEQ ID NO: 1238025 - RNA, 15 nt, Homo sapiens
cugcaugugcuguca

SEQ ID NO: 1238026 - RNA, 15 nt, Homo sapiens
cugcauguuacauaa

SEQ ID NO: 1238027 - RNA, 15 nt, Homo sapiens
cugcauuagucucau

SEQ ID NO: 1238028 - RNA, 15 nt, Homo sapiens
cugcauuccugauga

SEQ ID NO: 1238029 - RNA, 15 nt, Homo sapiens
cugcauuuagcacaa

SEQ ID NO: 1238030 - RNA, 16 nt, Homo sapiens
cugcauuuagcacaaa

SEQ ID NO: 1238031 - RNA, 12 nt, Homo sapiens
cugccaaacuga

SEQ ID NO: 1238032 - RNA, 20 nt, Homo sapiens
cugccacauacaggugcuca

SEQ ID NO: 1238033 - RNA, 13 nt, Homo sapiens
cugccacauucua

SEQ ID NO: 1238034 - RNA, 14 nt, Homo sapiens
cugccacccacuca

SEQ ID NO: 1238035 - RNA, 18 nt, Homo sapiens
cugccacuguguacugug

SEQ ID NO: 1238036 - RNA, 12 nt, Homo sapiens
cugccacuuugc

SEQ ID NO: 1238037 - RNA, 16 nt, Homo sapiens
cugccacuuugcacau

SEQ ID NO: 1238038 - RNA, 19 nt, Homo sapiens
cugccagcaggggugugau

SEQ ID NO: 1238039 - RNA, 13 nt, Homo sapiens
cugccagcaucug

SEQ ID NO: 1238040 - RNA, 16 nt, Homo sapiens
cugccagccacaucca

SEQ ID NO: 1238041 - RNA, 15 nt, Homo sapiens
cugccaguguggaac

SEQ ID NO: 1238042 - RNA, 16 nt, Homo sapiens
cugccauguuuaguga

SEQ ID NO: 1238043 - RNA, 20 nt, Homo sapiens
cugccauuauuuucugucag

SEQ ID NO: 1238044 - RNA, 11 nt, Homo sapiens
cugccauuucc

SEQ ID NO: 1238045 - RNA, 19 nt, Homo sapiens
cugcccaaggaugcuguca

SEQ ID NO: 1238046 - RNA, 13 nt, Homo sapiens
cugcccaaugaga

SEQ ID NO: 1238047 - RNA, 17 nt, Homo sapiens
cugcccacgcagaggac

SEQ ID NO: 1238048 - RNA, 21 nt, Homo sapiens
cugcccagaccccucuggcca

SEQ ID NO: 1238049 - RNA, 23 nt, Homo sapiens
cugcccagucccccaaccccagc

SEQ ID NO: 1238050 - RNA, 19 nt, Homo sapiens
cugcccauucaccaaaauu

SEQ ID NO: 1238051 - RNA, 18 nt, Homo sapiens
cugccccugccccaaguc

SEQ ID NO: 1238052 - RNA, 15 nt, Homo sapiens
cugcccgcacacccu

SEQ ID NO: 1238053 - RNA, 19 nt, Homo sapiens
cugcccgcgggagacagcu

SEQ ID NO: 1238054 - RNA, 18 nt, Homo sapiens
cugcccugguccagggaa

SEQ ID NO: 1238055 - RNA, 17 nt, Homo sapiens
cugcccuugucugagau

SEQ ID NO: 1238056 - RNA, 20 nt, Homo sapiens
cugccgccucagcuucucaa

SEQ ID NO: 1238057 - RNA, 21 nt, Homo sapiens
cugccggucgggcagccagca

SEQ ID NO: 1238058 - RNA, 13 nt, Homo sapiens
cugccgugcacuc

SEQ ID NO: 1238059 - RNA, 17 nt, Homo sapiens
cugccuacuccaaaaug

SEQ ID NO: 1238060 - RNA, 21 nt, Homo sapiens
cugccuauaaucuuauacaac

SEQ ID NO: 1238061 - RNA, 23 nt, Homo sapiens
cugccuccauucugaccauuuca

SEQ ID NO: 1238062 - RNA, 19 nt, Homo sapiens
cugccuccugugacgugag

SEQ ID NO: 1238063 - RNA, 16 nt, Homo sapiens
cugccugaagucacac

SEQ ID NO: 1238064 - RNA, 13 nt, Homo sapiens
cugccuguauacu

SEQ ID NO: 1238065 - RNA, 21 nt, Homo sapiens
cugccugugaaugcugaguga

SEQ ID NO: 1238066 - RNA, 22 nt, Homo sapiens
cugccuguuauaacucugcacu

SEQ ID NO: 1238067 - RNA, 22 nt, Homo sapiens
cugccuuaaauguaccuauggc

SEQ ID NO: 1238068 - RNA, 15 nt, Homo sapiens
cugccuuaacugaug

SEQ ID NO: 1238069 - RNA, 23 nt, Homo sapiens
cugccuucaccaucuacaccagu

SEQ ID NO: 1238070 - RNA, 18 nt, Homo sapiens
cugccuugaagccacuga

SEQ ID NO: 1238071 - RNA, 17 nt, Homo sapiens
cugcgagagaaagggag

SEQ ID NO: 1238072 - RNA, 19 nt, Homo sapiens
cugcggggggcaccagagg

SEQ ID NO: 1238073 - RNA, 17 nt, Homo sapiens
cugcuaaagacagugcg

SEQ ID NO: 1238074 - RNA, 14 nt, Homo sapiens
cugcuaccaaaaca

SEQ ID NO: 1238075 - RNA, 13 nt, Homo sapiens
cugcuagaacuuu

SEQ ID NO: 1238076 - RNA, 23 nt, Homo sapiens
cugcuagcaaauggcagaaccaa

SEQ ID NO: 1238077 - RNA, 16 nt, Homo sapiens
cugcucagcagagccu

SEQ ID NO: 1238078 - RNA, 15 nt, Homo sapiens
cugcucauauuguga

SEQ ID NO: 1238079 - RNA, 15 nt, Homo sapiens
cugcucauccaaagu

SEQ ID NO: 1238080 - RNA, 14 nt, Homo sapiens
cugcuccaccacau

SEQ ID NO: 1238081 - RNA, 13 nt, Homo sapiens
cugcuccacccuu

SEQ ID NO: 1238082 - RNA, 16 nt, Homo sapiens
cugcuccacgcgcuuc

SEQ ID NO: 1238083 - RNA, 16 nt, Homo sapiens
cugcuccagugcagga

SEQ ID NO: 1238084 - RNA, 15 nt, Homo sapiens
cugcucccuagccag

SEQ ID NO: 1238085 - RNA, 21 nt, Homo sapiens
cugcucccugcacccaugaca

SEQ ID NO: 1238086 - RNA, 19 nt, Homo sapiens
cugcuccuggagccuuuga

SEQ ID NO: 1238087 - RNA, 17 nt, Homo sapiens
cugcuccuggaguacac

SEQ ID NO: 1238088 - RNA, 24 nt, Homo sapiens
cugcucguugccugccacugagca

SEQ ID NO: 1238089 - RNA, 18 nt, Homo sapiens
cugcucuccgaccagaca

SEQ ID NO: 1238090 - RNA, 15 nt, Homo sapiens
cugcucucuguggug

SEQ ID NO: 1238091 - RNA, 20 nt, Homo sapiens
cugcucugguuagaaaaagg

SEQ ID NO: 1238092 - RNA, 15 nt, Homo sapiens
cugcucuuucucugc

SEQ ID NO: 1238093 - RNA, 22 nt, Homo sapiens
cugcucuuucucugccagugac

SEQ ID NO: 1238094 - RNA, 23 nt, Homo sapiens
cugcugaaggcagucauaucaaa

SEQ ID NO: 1238095 - RNA, 14 nt, Homo sapiens
cugcugacaguguu

SEQ ID NO: 1238096 - RNA, 22 nt, Homo sapiens
cugcugagagggcugcugacca

SEQ ID NO: 1238097 - RNA, 19 nt, Homo sapiens
cugcugagugcaccacuuc

SEQ ID NO: 1238098 - RNA, 17 nt, Homo sapiens
cugcugcauagcucuau

SEQ ID NO: 1238099 - RNA, 21 nt, Homo sapiens
cugcugcccaggccacagccg

SEQ ID NO: 1238100 - RNA, 18 nt, Homo sapiens
cugcugcuccagugcagg

SEQ ID NO: 1238101 - RNA, 16 nt, Homo sapiens
cugcuggcugcucccc

SEQ ID NO: 1238102 - RNA, 23 nt, Homo sapiens
cugcugggggcagcaguaccauc

SEQ ID NO: 1238103 - RNA, 15 nt, Homo sapiens
cugcugguaccugcc

SEQ ID NO: 1238104 - RNA, 11 nt, Homo sapiens
cugcuguaaau

SEQ ID NO: 1238105 - RNA, 14 nt, Homo sapiens
cugcuguaucuuua

SEQ ID NO: 1238106 - RNA, 11 nt, Homo sapiens
cugcugugauu

SEQ ID NO: 1238107 - RNA, 23 nt, Homo sapiens
cugcugugcacauuuaugaauca

SEQ ID NO: 1238108 - RNA, 12 nt, Homo sapiens
cugcuguugcca

SEQ ID NO: 1238109 - RNA, 19 nt, Homo sapiens
cugcuucacaaaccuugcu

SEQ ID NO: 1238110 - RNA, 16 nt, Homo sapiens
cugcuucaugugaaca

SEQ ID NO: 1238111 - RNA, 13 nt, Homo sapiens
cugcuucccuuac

SEQ ID NO: 1238112 - RNA, 13 nt, Homo sapiens
cugcuucuccagc

SEQ ID NO: 1238113 - RNA, 17 nt, Homo sapiens
cugggaugaggggugcu

SEQ ID NO: 1238114 - RNA, 21 nt, Homo sapiens
cugggauguuuugagggucuu

SEQ ID NO: 1238115 - RNA, 23 nt, Homo sapiens
cugggauuacaggcgugagccac

SEQ ID NO: 1238116 - RNA, 21 nt, Homo sapiens
cugggauuacaggcgugaucc

SEQ ID NO: 1238117 - RNA, 18 nt, Homo sapiens
cugggauuacagguguga

SEQ ID NO: 1238118 - RNA, 16 nt, Homo sapiens
cugggcaaagccacaa

SEQ ID NO: 1238119 - RNA, 16 nt, Homo sapiens
cugggcacagagguca

SEQ ID NO: 1238120 - RNA, 15 nt, Homo sapiens
cugggcacaguggac

SEQ ID NO: 1238121 - RNA, 23 nt, Homo sapiens
cugggcagaccccucuaccuccu

SEQ ID NO: 1238122 - RNA, 21 nt, Homo sapiens
cugggcauuuggugagaguca

SEQ ID NO: 1238123 - RNA, 11 nt, Homo sapiens
cugggccagug

SEQ ID NO: 1238124 - RNA, 15 nt, Homo sapiens
cugggccauguccaa

SEQ ID NO: 1238125 - RNA, 17 nt, Homo sapiens
cugggccauguccaaag

SEQ ID NO: 1238126 - RNA, 14 nt, Homo sapiens
cugggccauugugg

SEQ ID NO: 1238127 - RNA, 23 nt, Homo sapiens
cugggcccaguaccuagcuggcu

SEQ ID NO: 1238128 - RNA, 19 nt, Homo sapiens
cugggccccaugcucugcc

SEQ ID NO: 1238129 - RNA, 15 nt, Homo sapiens
cugggccucaguuca

SEQ ID NO: 1238130 - RNA, 21 nt, Homo sapiens
cugggccuccugacagcaaua

SEQ ID NO: 1238131 - RNA, 16 nt, Homo sapiens
cugggccugugcagca

SEQ ID NO: 1238132 - RNA, 14 nt, Homo sapiens
cugggcucaagcaa

SEQ ID NO: 1238133 - RNA, 16 nt, Homo sapiens
cugggcucagccugag

SEQ ID NO: 1238134 - RNA, 23 nt, Homo sapiens
cugggcuguaacguggcacuggu

SEQ ID NO: 1238135 - RNA, 21 nt, Homo sapiens
cugggcugucugucaccagcu

SEQ ID NO: 1238136 - RNA, 19 nt, Homo sapiens
cuggggaaacaacauuuau

SEQ ID NO: 1238137 - RNA, 18 nt, Homo sapiens
cuggggaauaaacuccag

SEQ ID NO: 1238138 - RNA, 15 nt, Homo sapiens
cuggggacucaggga

SEQ ID NO: 1238139 - RNA, 14 nt, Homo sapiens
cuggggaggugaac

SEQ ID NO: 1238140 - RNA, 16 nt, Homo sapiens
cuggggcaagcuccuc

SEQ ID NO: 1238141 - RNA, 19 nt, Homo sapiens
cuggggcaggucacuuuac

SEQ ID NO: 1238142 - RNA, 16 nt, Homo sapiens
cuggggcauccugugc

SEQ ID NO: 1238143 - RNA, 20 nt, Homo sapiens
cuggggcccaggaagcccac

SEQ ID NO: 1238144 - RNA, 18 nt, Homo sapiens
cuggggcucucugagacu

SEQ ID NO: 1238145 - RNA, 19 nt, Homo sapiens
cuggggggguugggcgggc

SEQ ID NO: 1238146 - RNA, 17 nt, Homo sapiens
cuggggugcugccugaa

SEQ ID NO: 1238147 - RNA, 17 nt, Homo sapiens
cuggggugggcaguuuu

SEQ ID NO: 1238148 - RNA, 23 nt, Homo sapiens
cuggguacugaaagccuuaggga

SEQ ID NO: 1238149 - RNA, 22 nt, Homo sapiens
cuggguccgccuuaaucuggaa

SEQ ID NO: 1238150 - RNA, 21 nt, Homo sapiens
cugggucucgcuuuguugccc

SEQ ID NO: 1238151 - RNA, 16 nt, Homo sapiens
cuggguggaucggccu

SEQ ID NO: 1238152 - RNA, 22 nt, Homo sapiens
uuauccaagaccugaaagaugg

SEQ ID NO: 1238153 - RNA, 12 nt, Homo sapiens
uuauccuagauc

SEQ ID NO: 1238154 - RNA, 16 nt, Homo sapiens
uuauccuagucauucu

SEQ ID NO: 1238155 - RNA, 18 nt, Homo sapiens
uuaucgggagcagugucu

SEQ ID NO: 1238156 - RNA, 12 nt, Homo sapiens
uuaucugcuaug

SEQ ID NO: 1238157 - RNA, 21 nt, Homo sapiens
uuaucuggcccucgacacuca

SEQ ID NO: 1238158 - RNA, 12 nt, Homo sapiens
uuaucugucaca

SEQ ID NO: 1238159 - RNA, 21 nt, Homo sapiens
uuaucugugucaaaagccaga

SEQ ID NO: 1238160 - RNA, 13 nt, Homo sapiens
uuaucuuaugcca

SEQ ID NO: 1238161 - RNA, 13 nt, Homo sapiens
uuaucuucacuuu

SEQ ID NO: 1238162 - RNA, 20 nt, Homo sapiens
uuaucuugcaccccaaagcu

SEQ ID NO: 1238163 - RNA, 15 nt, Homo sapiens
uuaucuuggacugac

SEQ ID NO: 1238164 - RNA, 23 nt, Homo sapiens
uuaucuuuuuaaaaacucuucag

SEQ ID NO: 1238165 - RNA, 14 nt, Homo sapiens
uuaugaaaugaccu

SEQ ID NO: 1238166 - RNA, 22 nt, Homo sapiens
uuaugaagcaagccccacuuau

SEQ ID NO: 1238167 - RNA, 22 nt, Homo sapiens
uuaugacuguuuuuguaguggu

SEQ ID NO: 1238168 - RNA, 14 nt, Homo sapiens
uuaugacuugcuac

SEQ ID NO: 1238169 - RNA, 16 nt, Homo sapiens
uuaugagcagaaggaa

SEQ ID NO: 1238170 - RNA, 13 nt, Homo sapiens
uuaugaugcuaug

SEQ ID NO: 1238171 - RNA, 18 nt, Homo sapiens
uuaugauugcauuguaug

SEQ ID NO: 1238172 - RNA, 16 nt, Homo sapiens
uuaugcaaguguuccu

SEQ ID NO: 1238173 - RNA, 21 nt, Homo sapiens
uuaugcagaauccaaaguaaa

SEQ ID NO: 1238174 - RNA, 21 nt, Homo sapiens
uuaugccuucacuuuacaaau

SEQ ID NO: 1238175 - RNA, 22 nt, Homo sapiens
uuaugggagaauugcacacaga

SEQ ID NO: 1238176 - RNA, 14 nt, Homo sapiens
uuauguaaucucac

SEQ ID NO: 1238177 - RNA, 15 nt, Homo sapiens
uuaaauaaaccucaa

SEQ ID NO: 1238178 - RNA, 21 nt, Homo sapiens
uuaaauaaagucucucugacu

SEQ ID NO: 1238179 - RNA, 17 nt, Homo sapiens
uuaaauaaaucauaaaa

SEQ ID NO: 1238180 - RNA, 23 nt, Homo sapiens
uuaaauaaaucauaaaacuugau

SEQ ID NO: 1238181 - RNA, 19 nt, Homo sapiens
uuaaauaaaucauuaauac

SEQ ID NO: 1238182 - RNA, 14 nt, Homo sapiens
uuaaauaugcaucu

SEQ ID NO: 1238183 - RNA, 21 nt, Homo sapiens
uuaaauauuuuggcauuguac

SEQ ID NO: 1238184 - RNA, 21 nt, Homo sapiens
uuaaaucugaauaaauaauuc

SEQ ID NO: 1238185 - RNA, 19 nt, Homo sapiens
uuaaaucugugaugauccu

SEQ ID NO: 1238186 - RNA, 16 nt, Homo sapiens
uuaaaugaacuugaua

SEQ ID NO: 1238187 - RNA, 16 nt, Homo sapiens
uuaaaugauacaguau

SEQ ID NO: 1238188 - RNA, 16 nt, Homo sapiens
uuaaaugccuuguaua

SEQ ID NO: 1238189 - RNA, 19 nt, Homo sapiens
uuaaauguuuauacuguau

SEQ ID NO: 1238190 - RNA, 15 nt, Homo sapiens
uuaaauuaauaucuu

SEQ ID NO: 1238191 - RNA, 17 nt, Homo sapiens
uuaaauuacaauuuuau

SEQ ID NO: 1238192 - RNA, 23 nt, Homo sapiens
uuaaauuacagcuuuuauggaug

SEQ ID NO: 1238193 - RNA, 18 nt, Homo sapiens
uuaaauuccugguggaua

SEQ ID NO: 1238194 - RNA, 11 nt, Homo sapiens
uuaaauucuga

SEQ ID NO: 1238195 - RNA, 17 nt, Homo sapiens
uuaaauuugauuuccau

SEQ ID NO: 1238196 - RNA, 17 nt, Homo sapiens
uuaacaauaacuacugu

SEQ ID NO: 1238197 - RNA, 11 nt, Homo sapiens
uuaacaaucua

SEQ ID NO: 1238198 - RNA, 13 nt, Homo sapiens
uuaacaccuucau

SEQ ID NO: 1238199 - RNA, 15 nt, Homo sapiens
uuaacacucaugaag

SEQ ID NO: 1238200 - RNA, 15 nt, Homo sapiens
uuaacagaacagaca

SEQ ID NO: 1238201 - RNA, 16 nt, Homo sapiens
uuaacagaucuuuacu

SEQ ID NO: 1238202 - RNA, 18 nt, Homo sapiens
uuaacaggauauuagaca

SEQ ID NO: 1238203 - RNA, 15 nt, Homo sapiens
uuaacaguuuuccau

SEQ ID NO: 1238204 - RNA, 21 nt, Homo sapiens
uuaacaugcuuaugacaauga

SEQ ID NO: 1238205 - RNA, 15 nt, Homo sapiens
uuaaccaagaaacaa

SEQ ID NO: 1238206 - RNA, 23 nt, Homo sapiens
uuaaccucugcuuuuaucucaga

SEQ ID NO: 1238207 - RNA, 13 nt, Homo sapiens
uuaaccuuaucag

SEQ ID NO: 1238208 - RNA, 17 nt, Homo sapiens
uuaacguauauugcugu

SEQ ID NO: 1238209 - RNA, 19 nt, Homo sapiens
uuaacucaccucucaaggu

SEQ ID NO: 1238210 - RNA, 16 nt, Homo sapiens
ugagggaaaaugagua

SEQ ID NO: 1238211 - RNA, 13 nt, Homo sapiens
ugagggacugccu

SEQ ID NO: 1238212 - RNA, 21 nt, Homo sapiens
ugagggcagcuccagugccag

SEQ ID NO: 1238213 - RNA, 15 nt, Homo sapiens
ugagggcaguucuga

SEQ ID NO: 1238214 - RNA, 20 nt, Homo sapiens
ugagggcuggggguggacuu

SEQ ID NO: 1238215 - RNA, 17 nt, Homo sapiens
ugaggggcuggcacuga

SEQ ID NO: 1238216 - RNA, 22 nt, Homo sapiens
ugaggggguaauaaaccuccuu

SEQ ID NO: 1238217 - RNA, 19 nt, Homo sapiens
ugaggguaucugacaaugc

SEQ ID NO: 1238218 - RNA, 18 nt, Homo sapiens
ugagggucuuugcaagaa

SEQ ID NO: 1238219 - RNA, 17 nt, Homo sapiens
ugaggucccuguauguc

SEQ ID NO: 1238220 - RNA, 16 nt, Homo sapiens
ugaggucucuugaggg

SEQ ID NO: 1238221 - RNA, 20 nt, Homo sapiens
ugaggugacugcagucugau

SEQ ID NO: 1238222 - RNA, 17 nt, Homo sapiens
ugaggugggcuggggcu

SEQ ID NO: 1238223 - RNA, 15 nt, Homo sapiens
ugagguggugccuuc

SEQ ID NO: 1238224 - RNA, 19 nt, Homo sapiens
ugagguuucccccugucuc

SEQ ID NO: 1238225 - RNA, 15 nt, Homo sapiens
ugaguaacauuugcu

SEQ ID NO: 1238226 - RNA, 18 nt, Homo sapiens
ugaguaauacaucaaaga

SEQ ID NO: 1238227 - RNA, 18 nt, Homo sapiens
ugaguagagcuuguaaua

SEQ ID NO: 1238228 - RNA, 14 nt, Homo sapiens
ugaguagauauuac

SEQ ID NO: 1238229 - RNA, 15 nt, Homo sapiens
ugaguagauauuacu

SEQ ID NO: 1238230 - RNA, 19 nt, Homo sapiens
ugaguagauauuacuuuau

SEQ ID NO: 1238231 - RNA, 16 nt, Homo sapiens
ugaguaguguggaauu

SEQ ID NO: 1238232 - RNA, 17 nt, Homo sapiens
ugagucagacauuuggu

SEQ ID NO: 1238233 - RNA, 13 nt, Homo sapiens
ugaguccaaagaa

SEQ ID NO: 1238234 - RNA, 22 nt, Homo sapiens
ugagucccauuugccuugcaau

SEQ ID NO: 1238235 - RNA, 14 nt, Homo sapiens
ugagucgaggacag

SEQ ID NO: 1238236 - RNA, 15 nt, Homo sapiens
ugagucggaagcucc

SEQ ID NO: 1238237 - RNA, 17 nt, Homo sapiens
ugagucugcaugugcac

SEQ ID NO: 1238238 - RNA, 17 nt, Homo sapiens
ugagugaaccuguauaa

SEQ ID NO: 1238239 - RNA, 16 nt, Homo sapiens
ugagugagcuggugac

SEQ ID NO: 1238240 - RNA, 21 nt, Homo sapiens
ugagugccugauacugccuga

SEQ ID NO: 1238241 - RNA, 22 nt, Homo sapiens
ugagugcuggauauuuuacuac

SEQ ID NO: 1238242 - RNA, 22 nt, Homo sapiens
ugaguggccagccagugccauu

SEQ ID NO: 1238243 - RNA, 15 nt, Homo sapiens
ugaguguaaguguga

SEQ ID NO: 1238244 - RNA, 19 nt, Homo sapiens
ugagugucuucuaacuuua

SEQ ID NO: 1238245 - RNA, 16 nt, Homo sapiens
ugaguucgaggacuac

SEQ ID NO: 1238246 - RNA, 22 nt, Homo sapiens
ugaguuucuggcucuugaggca

SEQ ID NO: 1238247 - RNA, 19 nt, Homo sapiens
ugauacaagaaagcaaugc

SEQ ID NO: 1238248 - RNA, 16 nt, Homo sapiens
ugauaccacgaggaaa

SEQ ID NO: 1238249 - RNA, 14 nt, Homo sapiens
ugauaccacugcac

SEQ ID NO: 1238250 - RNA, 16 nt, Homo sapiens
ugauaccauggcacug

SEQ ID NO: 1238251 - RNA, 18 nt, Homo sapiens
ugauaccauggcacugac

SEQ ID NO: 1238252 - RNA, 19 nt, Homo sapiens
ugauacgcaacauaauuaa

SEQ ID NO: 1238253 - RNA, 14 nt, Homo sapiens
ugauacuaucugug

SEQ ID NO: 1238254 - RNA, 20 nt, Homo sapiens
ugauacuggaggaacacuug

SEQ ID NO: 1238255 - RNA, 22 nt, Homo sapiens
ugauacuuauauuuucguauga

SEQ ID NO: 1238256 - RNA, 16 nt, Homo sapiens
ugauacuucacuacuu

SEQ ID NO: 1238257 - RNA, 17 nt, Homo sapiens
ugauacuuugacagugu

SEQ ID NO: 1238258 - RNA, 13 nt, Homo sapiens
ugauagcacuuuc

SEQ ID NO: 1238259 - RNA, 11 nt, Homo sapiens
ugauagcuuua

SEQ ID NO: 1238260 - RNA, 22 nt, Homo sapiens
ugauagggaaggcuacuaccua

SEQ ID NO: 1238261 - RNA, 22 nt, Homo sapiens
ugauaguucacccccugagauc

SEQ ID NO: 1238262 - RNA, 23 nt, Homo sapiens
ucauuuuuaacagcaugcugcuu

SEQ ID NO: 1238263 - RNA, 21 nt, Homo sapiens
ucauuuuucacuguacauuau

SEQ ID NO: 1238264 - RNA, 20 nt, Homo sapiens
ucauuuuuuuuauauugccu

SEQ ID NO: 1238265 - RNA, 22 nt, Homo sapiens
uccaaaaauuauuauaagcauu

SEQ ID NO: 1238266 - RNA, 18 nt, Homo sapiens
uccaaaacucuuucauaa

SEQ ID NO: 1238267 - RNA, 21 nt, Homo sapiens
uccaaaacuuuaaugaacuaa

SEQ ID NO: 1238268 - RNA, 23 nt, Homo sapiens
uccaaaacuuuaaugaacuaacu

SEQ ID NO: 1238269 - RNA, 15 nt, Homo sapiens
uccaaaagcacuuac

SEQ ID NO: 1238270 - RNA, 22 nt, Homo sapiens
uccaaaccugucuuggggccac

SEQ ID NO: 1238271 - RNA, 19 nt, Homo sapiens
uccaaacucaaacuugaga

SEQ ID NO: 1238272 - RNA, 14 nt, Homo sapiens
uccaaagacauguu

SEQ ID NO: 1238273 - RNA, 12 nt, Homo sapiens
uccaaagaggcu

SEQ ID NO: 1238274 - RNA, 20 nt, Homo sapiens
uccaaagcacauugaaagag

SEQ ID NO: 1238275 - RNA, 12 nt, Homo sapiens
uccaaagccaga

SEQ ID NO: 1238276 - RNA, 18 nt, Homo sapiens
uccaaagugccacucauu

SEQ ID NO: 1238277 - RNA, 19 nt, Homo sapiens
uccaaauaacaaguaccaa

SEQ ID NO: 1238278 - RNA, 14 nt, Homo sapiens
uccaaauagcauua

SEQ ID NO: 1238279 - RNA, 21 nt, Homo sapiens
uccaacauuucucacugaaag

SEQ ID NO: 1238280 - RNA, 15 nt, Homo sapiens
uccaacuccaggaua

SEQ ID NO: 1238281 - RNA, 14 nt, Homo sapiens
uccaacucccuuaa

SEQ ID NO: 1238282 - RNA, 19 nt, Homo sapiens
uccaagguguaacucuaau

SEQ ID NO: 1238283 - RNA, 22 nt, Homo sapiens
uccaaguaagaguacugggaga

SEQ ID NO: 1238284 - RNA, 14 nt, Homo sapiens
uccaagucuucuca

SEQ ID NO: 1238285 - RNA, 13 nt, Homo sapiens
uccaagugccaau

SEQ ID NO: 1238286 - RNA, 17 nt, Homo sapiens
uccaagugccacaugcc

SEQ ID NO: 1238287 - RNA, 21 nt, Homo sapiens
uccaaguuccccaucccuguc

SEQ ID NO: 1238288 - RNA, 17 nt, Homo sapiens
uccaaguugcuaauaca

SEQ ID NO: 1238289 - RNA, 15 nt, Homo sapiens
uccaauaggcauuug

SEQ ID NO: 1238290 - RNA, 12 nt, Homo sapiens
uccaaucuguga

SEQ ID NO: 1238291 - RNA, 16 nt, Homo sapiens
uccaaugucaauguga

SEQ ID NO: 1238292 - RNA, 17 nt, Homo sapiens
uccaauuccuugcacau

SEQ ID NO: 1238293 - RNA, 18 nt, Homo sapiens
uccaauuccuugcacaua

SEQ ID NO: 1238294 - RNA, 19 nt, Homo sapiens
uccaauuccuugcacauag

SEQ ID NO: 1238295 - RNA, 19 nt, Homo sapiens
uccaauuuggaaucuucuc

SEQ ID NO: 1238296 - RNA, 14 nt, Homo sapiens
uccacaacagaagu

SEQ ID NO: 1238297 - RNA, 22 nt, Homo sapiens
uccacacagggguggaguuucu

SEQ ID NO: 1238298 - RNA, 20 nt, Homo sapiens
uccacaccacuguugccuuu

SEQ ID NO: 1238299 - RNA, 19 nt, Homo sapiens
uccacaccccaucuugcuc

SEQ ID NO: 1238300 - RNA, 17 nt, Homo sapiens
uccacaccuuuuauuga

SEQ ID NO: 1238301 - RNA, 17 nt, Homo sapiens
uccacagccaugcccuu

SEQ ID NO: 1238302 - RNA, 15 nt, Homo sapiens
uccacaguuaucuua

SEQ ID NO: 1238303 - RNA, 16 nt, Homo sapiens
uccaccagcccauggc

SEQ ID NO: 1238304 - RNA, 14 nt, Homo sapiens
uccaccaugagcuc

SEQ ID NO: 1238305 - RNA, 20 nt, Homo sapiens
uccacccaggcugcacugca

SEQ ID NO: 1238306 - RNA, 22 nt, Homo sapiens
uccacccauaauccuuucugcc

SEQ ID NO: 1238307 - RNA, 21 nt, Homo sapiens
uccacccuuggccugucucau

SEQ ID NO: 1238308 - RNA, 21 nt, Homo sapiens
uccaccucccauuacuuugau

SEQ ID NO: 1238309 - RNA, 20 nt, Homo sapiens
uccacggaaaaugcuaucca

SEQ ID NO: 1238310 - RNA, 23 nt, Homo sapiens
uccacguaucuuuccuaggcaga

SEQ ID NO: 1238311 - RNA, 17 nt, Homo sapiens
uccacgucaacagaauu

SEQ ID NO: 1238312 - RNA, 20 nt, Homo sapiens
uccacgugauuuccagugag

SEQ ID NO: 1238313 - RNA, 19 nt, Homo sapiens
uccacuaggguccaccagg

SEQ ID NO: 1238314 - RNA, 18 nt, Homo sapiens
uccacuccuccuacugua

SEQ ID NO: 1238315 - RNA, 17 nt, Homo sapiens
uccacucuacccuccca

SEQ ID NO: 1238316 - RNA, 19 nt, Homo sapiens
uccacucuuguggucauca

SEQ ID NO: 1238317 - RNA, 19 nt, Homo sapiens
uccacuggaaaaguguaau

SEQ ID NO: 1238318 - RNA, 19 nt, Homo sapiens
uccacuggacagacccagg

SEQ ID NO: 1238319 - RNA, 20 nt, Homo sapiens
uccacugggacccccaacau

SEQ ID NO: 1238320 - RNA, 23 nt, Homo sapiens
uccacugggacccccaacauucu

SEQ ID NO: 1238321 - RNA, 19 nt, Homo sapiens
uccacuucuuguuccccac

SEQ ID NO: 1238322 - RNA, 23 nt, Homo sapiens
uccacuucuuguuccccacugac

SEQ ID NO: 1238323 - RNA, 19 nt, Homo sapiens
uccacuugagugucaagcu

SEQ ID NO: 1238324 - RNA, 11 nt, Homo sapiens
uccacuuuuau

SEQ ID NO: 1238325 - RNA, 21 nt, Homo sapiens
uccagaaagcuaaaauuuaau

SEQ ID NO: 1238326 - RNA, 12 nt, Homo sapiens
uccagaauucac

SEQ ID NO: 1238327 - RNA, 13 nt, Homo sapiens
uccagacacuuaa

SEQ ID NO: 1238328 - RNA, 12 nt, Homo sapiens
uccagaccugcu

SEQ ID NO: 1238329 - RNA, 13 nt, Homo sapiens
uccagaccugcuu

SEQ ID NO: 1238330 - RNA, 15 nt, Homo sapiens
uccagacggugugca

SEQ ID NO: 1238331 - RNA, 18 nt, Homo sapiens
uccagacuguccacucgg

SEQ ID NO: 1238332 - RNA, 21 nt, Homo sapiens
uccagacuugaaauucucauc

SEQ ID NO: 1238333 - RNA, 15 nt, Homo sapiens
uccagagcagaguuu

SEQ ID NO: 1238334 - RNA, 18 nt, Homo sapiens
uccagaguucugugacac

SEQ ID NO: 1238335 - RNA, 16 nt, Homo sapiens
uccagaguuguucucu

SEQ ID NO: 1238336 - RNA, 17 nt, Homo sapiens
uccagauagcagggcau

SEQ ID NO: 1238337 - RNA, 17 nt, Homo sapiens
uccagauccagacugua

SEQ ID NO: 1238338 - RNA, 19 nt, Homo sapiens
uccagauccuucaaagagu

SEQ ID NO: 1238339 - RNA, 15 nt, Homo sapiens
uccagcaaccuauaa

SEQ ID NO: 1238340 - RNA, 20 nt, Homo sapiens
uccagccaaccucauugcag

SEQ ID NO: 1238341 - RNA, 20 nt, Homo sapiens
uccagccccagacaacagcc

SEQ ID NO: 1238342 - RNA, 19 nt, Homo sapiens
uccagccgcugcacaucac

SEQ ID NO: 1238343 - RNA, 19 nt, Homo sapiens
uccagccuggcuacagggc

SEQ ID NO: 1238344 - RNA, 15 nt, Homo sapiens
uccagccugggcaac

SEQ ID NO: 1238345 - RNA, 22 nt, Homo sapiens
uccagccuuuggccuuggcuuu

SEQ ID NO: 1238346 - RNA, 16 nt, Homo sapiens
uccaggacuccacugg

SEQ ID NO: 1238347 - RNA, 23 nt, Homo sapiens
uccaggcaaaauugauauacuuu

SEQ ID NO: 1238348 - RNA, 14 nt, Homo sapiens
uccaggcaccaucu

SEQ ID NO: 1238349 - RNA, 13 nt, Homo sapiens
uccaggcccucca

SEQ ID NO: 1238350 - RNA, 16 nt, Homo sapiens
uccagggcaaggccau

SEQ ID NO: 1238351 - RNA, 18 nt, Homo sapiens
uccagggucccucugugu

SEQ ID NO: 1238352 - RNA, 17 nt, Homo sapiens
uccaggugaggcccaag

SEQ ID NO: 1238353 - RNA, 21 nt, Homo sapiens
uccagguggagacccugagaa

SEQ ID NO: 1238354 - RNA, 14 nt, Homo sapiens
uccagguucacuuu

SEQ ID NO: 1238355 - RNA, 13 nt, Homo sapiens
uccagucuggauc

SEQ ID NO: 1238356 - RNA, 22 nt, Homo sapiens
uccagucuuccgacaaacuaac

SEQ ID NO: 1238357 - RNA, 11 nt, Homo sapiens
uccagugcagg

SEQ ID NO: 1238358 - RNA, 20 nt, Homo sapiens
uccagugugggcuugaccag

SEQ ID NO: 1238359 - RNA, 13 nt, Homo sapiens
uccaguguuuaca

SEQ ID NO: 1238360 - RNA, 14 nt, Homo sapiens
uccaguuccgggag

SEQ ID NO: 1238361 - RNA, 23 nt, Homo sapiens
uccaguuuuauaaaaaguggaga

SEQ ID NO: 1238362 - RNA, 17 nt, Homo sapiens
uccauaaugcuacuguc

SEQ ID NO: 1238363 - RNA, 19 nt, Homo sapiens
uccauaaugcuacugucuc

SEQ ID NO: 1238364 - RNA, 13 nt, Homo sapiens
uccauaauuauua

SEQ ID NO: 1238365 - RNA, 23 nt, Homo sapiens
uccauacagggucucuuccuucg

SEQ ID NO: 1238366 - RNA, 21 nt, Homo sapiens
uccaucagagaaggugcaggu

SEQ ID NO: 1238367 - RNA, 17 nt, Homo sapiens
uccaucagcuguaagaa

SEQ ID NO: 1238368 - RNA, 12 nt, Homo sapiens
uccaucaugccc

SEQ ID NO: 1238369 - RNA, 17 nt, Homo sapiens
uccaucauggcugcuug

SEQ ID NO: 1238370 - RNA, 22 nt, Homo sapiens
uaauaaaaaauauucuugucaa

SEQ ID NO: 1238371 - RNA, 21 nt, Homo sapiens
uaauaaaggcccccacuucuc

SEQ ID NO: 1238372 - RNA, 15 nt, Homo sapiens
uaauaaaguauauaa

SEQ ID NO: 1238373 - RNA, 24 nt, Homo sapiens
uaauaaaucucuucuuugcugcag

SEQ ID NO: 1238374 - RNA, 13 nt, Homo sapiens
uaauaacugugaa

SEQ ID NO: 1238375 - RNA, 19 nt, Homo sapiens
uaauaauaagucaguguua

SEQ ID NO: 1238376 - RNA, 14 nt, Homo sapiens
uaauaauaaucuag

SEQ ID NO: 1238377 - RNA, 13 nt, Homo sapiens
uaauaauaccuca

SEQ ID NO: 1238378 - RNA, 15 nt, Homo sapiens
uaauacagacaucua

SEQ ID NO: 1238379 - RNA, 11 nt, Homo sapiens
uaauaccucaa

SEQ ID NO: 1238380 - RNA, 17 nt, Homo sapiens
uaauacucugcagugau

SEQ ID NO: 1238381 - RNA, 17 nt, Homo sapiens
uaauagcuacagugcau

SEQ ID NO: 1238382 - RNA, 15 nt, Homo sapiens
uaauagcuauccuaa

SEQ ID NO: 1238383 - RNA, 19 nt, Homo sapiens
uaauagucaauuucuacuu

SEQ ID NO: 1238384 - RNA, 18 nt, Homo sapiens
uaauaguuuaacugaaag

SEQ ID NO: 1238385 - RNA, 21 nt, Homo sapiens
uaauauacagucaguucucau

SEQ ID NO: 1238386 - RNA, 20 nt, Homo sapiens
uaauauaguuauugcacaag

SEQ ID NO: 1238387 - RNA, 14 nt, Homo sapiens
uaauauauuguaca

SEQ ID NO: 1238388 - RNA, 20 nt, Homo sapiens
uaauauauuguacacuacag

SEQ ID NO: 1238389 - RNA, 18 nt, Homo sapiens
uaauauauuugcagauaa

SEQ ID NO: 1238390 - RNA, 21 nt, Homo sapiens
uaauauauuuuuugaacuuug

SEQ ID NO: 1238391 - RNA, 20 nt, Homo sapiens
uaauaugaguaauacaucaa

SEQ ID NO: 1238392 - RNA, 14 nt, Homo sapiens
uaauaugcugccaa

SEQ ID NO: 1238393 - RNA, 16 nt, Homo sapiens
uaauauugacuuguau

SEQ ID NO: 1238394 - RNA, 22 nt, Homo sapiens
uaauauuuuauaccaaagccaa

SEQ ID NO: 1238395 - RNA, 17 nt, Homo sapiens
uaauauuuuccuaguag

SEQ ID NO: 1238396 - RNA, 19 nt, Homo sapiens
uaauauuuuuccacuuaaa

SEQ ID NO: 1238397 - RNA, 19 nt, Homo sapiens
uaaucaaggccagugcuaa

SEQ ID NO: 1238398 - RNA, 15 nt, Homo sapiens
uaaucaccucucugu

SEQ ID NO: 1238399 - RNA, 16 nt, Homo sapiens
uaaucacucuaauuaa

SEQ ID NO: 1238400 - RNA, 21 nt, Homo sapiens
uaaucagaaaaguaauuuugu

SEQ ID NO: 1238401 - RNA, 12 nt, Homo sapiens
uaaucagcauua

SEQ ID NO: 1238402 - RNA, 20 nt, Homo sapiens
uaaucaugugggugagccag

SEQ ID NO: 1238403 - RNA, 16 nt, Homo sapiens
uaaucccaacuacuca

SEQ ID NO: 1238404 - RNA, 14 nt, Homo sapiens
uaaucccagcacuu

SEQ ID NO: 1238405 - RNA, 14 nt, Homo sapiens
uaaucucagcacuu

SEQ ID NO: 1238406 - RNA, 22 nt, Homo sapiens
uaaucucuguuauguacuguac

SEQ ID NO: 1238407 - RNA, 20 nt, Homo sapiens
uaaucugucaaaacacugug

SEQ ID NO: 1238408 - RNA, 16 nt, Homo sapiens
uaaucuguguguauau

SEQ ID NO: 1238409 - RNA, 14 nt, Homo sapiens
uaaucuucauuucu

SEQ ID NO: 1238410 - RNA, 19 nt, Homo sapiens
uaaucuucuuaugcaauuu

SEQ ID NO: 1238411 - RNA, 16 nt, Homo sapiens
uaaucuuugagucuaa

SEQ ID NO: 1238412 - RNA, 14 nt, Homo sapiens
uaaugaacauguga

SEQ ID NO: 1238413 - RNA, 14 nt, Homo sapiens
uaaugaacuaccau

SEQ ID NO: 1238414 - RNA, 19 nt, Homo sapiens
uaaugaaggaguucacugu

SEQ ID NO: 1238415 - RNA, 20 nt, Homo sapiens
uaaugaaggggaagagauua

SEQ ID NO: 1238416 - RNA, 19 nt, Homo sapiens
uaaugaaguguuuagcaua

SEQ ID NO: 1238417 - RNA, 16 nt, Homo sapiens
uaaugaauacuuucuu

SEQ ID NO: 1238418 - RNA, 22 nt, Homo sapiens
uaaugaauacuuucuuagauuu

SEQ ID NO: 1238419 - RNA, 15 nt, Homo sapiens
uaaugagacaugaau

SEQ ID NO: 1238420 - RNA, 14 nt, Homo sapiens
uaaugaucacauuc

SEQ ID NO: 1238421 - RNA, 13 nt, Homo sapiens
uaauggaaaccaa

SEQ ID NO: 1238422 - RNA, 13 nt, Homo sapiens
uaauggcacugau

SEQ ID NO: 1238423 - RNA, 16 nt, Homo sapiens
uaauggcuaguacugu

SEQ ID NO: 1238424 - RNA, 11 nt, Homo sapiens
uaaugggaccc

SEQ ID NO: 1238425 - RNA, 17 nt, Homo sapiens
uaauggggacacagauc

SEQ ID NO: 1238426 - RNA, 14 nt, Homo sapiens
uaauguacaucugg

SEQ ID NO: 1238427 - RNA, 19 nt, Homo sapiens
uaauguauuuguuugcaau

SEQ ID NO: 1238428 - RNA, 23 nt, Homo sapiens
uaaugugaaguagaauccuaaau

SEQ ID NO: 1238429 - RNA, 22 nt, Homo sapiens
uaauguggaagaaaaugguuua

SEQ ID NO: 1238430 - RNA, 15 nt, Homo sapiens
uaauguuaauucagc

SEQ ID NO: 1238431 - RNA, 13 nt, Homo sapiens
uaauguugcuuag

SEQ ID NO: 1238432 - RNA, 20 nt, Homo sapiens
uaauguuguaauucaugcca

SEQ ID NO: 1238433 - RNA, 20 nt, Homo sapiens
uaauguuuuguaauuuugca

SEQ ID NO: 1238434 - RNA, 12 nt, Homo sapiens
uaauuaccaugc

SEQ ID NO: 1238435 - RNA, 17 nt, Homo sapiens
uaauuauacuacuuugu

SEQ ID NO: 1238436 - RNA, 19 nt, Homo sapiens
uaauuauuauuuccagugu

SEQ ID NO: 1238437 - RNA, 21 nt, Homo sapiens
uaauucacucaagcacugaua

SEQ ID NO: 1238438 - RNA, 14 nt, Homo sapiens
uaauucagcacuua

SEQ ID NO: 1238439 - RNA, 19 nt, Homo sapiens
uaauucauugugauuuauu

SEQ ID NO: 1238440 - RNA, 18 nt, Homo sapiens
uaauuccuguuacuuuac

SEQ ID NO: 1238441 - RNA, 20 nt, Homo sapiens
uaauuccuguuacuuuacag

SEQ ID NO: 1238442 - RNA, 16 nt, Homo sapiens
uaauucggauuugcca

SEQ ID NO: 1238443 - RNA, 17 nt, Homo sapiens
uaauucuaaucuaacaa

SEQ ID NO: 1238444 - RNA, 17 nt, Homo sapiens
uaauucuguacauagcc

SEQ ID NO: 1238445 - RNA, 20 nt, Homo sapiens
uaauucuuacacugccugua

SEQ ID NO: 1238446 - RNA, 21 nt, Homo sapiens
uaauugauuauucugauucca

SEQ ID NO: 1238447 - RNA, 17 nt, Homo sapiens
uaauugcuguucugcug

SEQ ID NO: 1238448 - RNA, 15 nt, Homo sapiens
uaauuguaaucugaa

SEQ ID NO: 1238449 - RNA, 16 nt, Homo sapiens
uaauugugugucacaa

SEQ ID NO: 1238450 - RNA, 16 nt, Homo sapiens
uaauuuacagaaauca

SEQ ID NO: 1238451 - RNA, 23 nt, Homo sapiens
uaauuuacuguugcccauugcac

SEQ ID NO: 1238452 - RNA, 15 nt, Homo sapiens
uaauuuaugugcuau

SEQ ID NO: 1238453 - RNA, 17 nt, Homo sapiens
uaauuucaggaauugaa

SEQ ID NO: 1238454 - RNA, 20 nt, Homo sapiens
uaauuucuacucugucuuaa

SEQ ID NO: 1238455 - RNA, 22 nt, Homo sapiens
uaauuucuuugaucuggacaga

SEQ ID NO: 1238456 - RNA, 20 nt, Homo sapiens
uaauuucuuuuuuccucuga

SEQ ID NO: 1238457 - RNA, 18 nt, Homo sapiens
uaauuuguaaacuucuga

SEQ ID NO: 1238458 - RNA, 24 nt, Homo sapiens
uaauuuuagaugccugugaaauag

SEQ ID NO: 1238459 - RNA, 15 nt, Homo sapiens
uaauuuuaguuucau

SEQ ID NO: 1238460 - RNA, 10 nt, Homo sapiens
uaauuuuccu

SEQ ID NO: 1238461 - RNA, 21 nt, Homo sapiens
uaauuuuccuggaaagacuga

SEQ ID NO: 1238462 - RNA, 13 nt, Homo sapiens
uaauuuucgcuua

SEQ ID NO: 1238463 - RNA, 15 nt, Homo sapiens
uaauuuuggauuuug

SEQ ID NO: 1238464 - RNA, 17 nt, Homo sapiens
uaauuuuugaaaacugg

SEQ ID NO: 1238465 - RNA, 15 nt, Homo sapiens
uacaaaaaacaacaa

SEQ ID NO: 1238466 - RNA, 21 nt, Homo sapiens
uacaaaaauuguucaaccuaa

SEQ ID NO: 1238467 - RNA, 23 nt, Homo sapiens
uacaaaacauuuuuuuguucucu

SEQ ID NO: 1238468 - RNA, 18 nt, Homo sapiens
uacaaaacuuccaggcua

SEQ ID NO: 1238469 - RNA, 18 nt, Homo sapiens
uacaaaagauguauccuu

SEQ ID NO: 1238470 - RNA, 18 nt, Homo sapiens
uacaaacacaauauucaa

SEQ ID NO: 1238471 - RNA, 17 nt, Homo sapiens
uacaaacucccacuugu

SEQ ID NO: 1238472 - RNA, 20 nt, Homo sapiens
uccauuuauucuuugaucuu

SEQ ID NO: 1238473 - RNA, 22 nt, Homo sapiens
uccauuuauugcacucagcuuu

SEQ ID NO: 1238474 - RNA, 22 nt, Homo sapiens
uccauuuuuaaccccauuugca

SEQ ID NO: 1238475 - RNA, 20 nt, Homo sapiens
ucccaaaacccuuacaguga

SEQ ID NO: 1238476 - RNA, 15 nt, Homo sapiens
ucccaaacuacagaa

SEQ ID NO: 1238477 - RNA, 10 nt, Homo sapiens
ucccaaagag

SEQ ID NO: 1238478 - RNA, 20 nt, Homo sapiens
ucccaaagugcugagauuac

SEQ ID NO: 1238479 - RNA, 20 nt, Homo sapiens
ucccaaagugcugggauuac

SEQ ID NO: 1238480 - RNA, 16 nt, Homo sapiens
ucccaaaucaauaaga

SEQ ID NO: 1238481 - RNA, 14 nt, Homo sapiens
ucccaacacuguca

SEQ ID NO: 1238482 - RNA, 14 nt, Homo sapiens
ucccaacauaugcc

SEQ ID NO: 1238483 - RNA, 13 nt, Homo sapiens
ucccaacccauuc

SEQ ID NO: 1238484 - RNA, 21 nt, Homo sapiens
ucccaacccauucacuacagg

SEQ ID NO: 1238485 - RNA, 22 nt, Homo sapiens
ucccaacccauucacuacaggu

SEQ ID NO: 1238486 - RNA, 15 nt, Homo sapiens
ucccaaccccaggaa

SEQ ID NO: 1238487 - RNA, 19 nt, Homo sapiens
ucccaacuucauacuggca

SEQ ID NO: 1238488 - RNA, 21 nt, Homo sapiens
ucccaacuuguauuaaagaca

SEQ ID NO: 1238489 - RNA, 20 nt, Homo sapiens
ucccaaguagcugggauuac

SEQ ID NO: 1238490 - RNA, 15 nt, Homo sapiens
ucccaauagcacuuu

SEQ ID NO: 1238491 - RNA, 21 nt, Homo sapiens
ucccaaucaaagaauuacagu

SEQ ID NO: 1238492 - RNA, 16 nt, Homo sapiens
ucccaaucagcacuga

SEQ ID NO: 1238493 - RNA, 17 nt, Homo sapiens
ucccaaucagcacugaa

SEQ ID NO: 1238494 - RNA, 18 nt, Homo sapiens
ucccaaucagcacugaaa

SEQ ID NO: 1238495 - RNA, 12 nt, Homo sapiens
ucccaauuagcu

SEQ ID NO: 1238496 - RNA, 22 nt, Homo sapiens
ucccacaaguauauacuuuuaa

SEQ ID NO: 1238497 - RNA, 16 nt, Homo sapiens
ucccacaggcccuucc

SEQ ID NO: 1238498 - RNA, 14 nt, Homo sapiens
ucccaccacaggca

SEQ ID NO: 1238499 - RNA, 17 nt, Homo sapiens
ucccacccacaugugac

SEQ ID NO: 1238500 - RNA, 19 nt, Homo sapiens
ucccacccacaugugacac

SEQ ID NO: 1238501 - RNA, 20 nt, Homo sapiens
ucccacccacaugugacaca

SEQ ID NO: 1238502 - RNA, 18 nt, Homo sapiens
ucccacccccaucucucc

SEQ ID NO: 1238503 - RNA, 14 nt, Homo sapiens
ucccaccugcacac

SEQ ID NO: 1238504 - RNA, 15 nt, Homo sapiens
ucccaccuugaccaa

SEQ ID NO: 1238505 - RNA, 21 nt, Homo sapiens
ucccacgggaaaggagcugcu

SEQ ID NO: 1238506 - RNA, 22 nt, Homo sapiens
ucccacguacuuauaaagaagg

SEQ ID NO: 1238507 - RNA, 16 nt, Homo sapiens
ucccacgugucuucca

SEQ ID NO: 1238508 - RNA, 17 nt, Homo sapiens
ucccacucaggugaaaa

SEQ ID NO: 1238509 - RNA, 21 nt, Homo sapiens
ucccacugcggggagacagaa

SEQ ID NO: 1238510 - RNA, 11 nt, Homo sapiens
ucccacuggaa

SEQ ID NO: 1238511 - RNA, 13 nt, Homo sapiens
ucccacuguauga

SEQ ID NO: 1238512 - RNA, 17 nt, Homo sapiens
ucccagacucaccccau

SEQ ID NO: 1238513 - RNA, 17 nt, Homo sapiens
ucccagcaagaccucau

SEQ ID NO: 1238514 - RNA, 13 nt, Homo sapiens
ucccagcacuuug

SEQ ID NO: 1238515 - RNA, 13 nt, Homo sapiens
ucccagccaaguc

SEQ ID NO: 1238516 - RNA, 16 nt, Homo sapiens
ucccagccacacccag

SEQ ID NO: 1238517 - RNA, 20 nt, Homo sapiens
ucccagcugcagaugccaca

SEQ ID NO: 1238518 - RNA, 15 nt, Homo sapiens
ucccaggaacugggc

SEQ ID NO: 1238519 - RNA, 17 nt, Homo sapiens
ucccaggauuaggccau

SEQ ID NO: 1238520 - RNA, 21 nt, Homo sapiens
ucccaggcccgagaugugacc

SEQ ID NO: 1238521 - RNA, 17 nt, Homo sapiens
ucccaguccuccagacc

SEQ ID NO: 1238522 - RNA, 20 nt, Homo sapiens
ucccauaauugcuuugccaa

SEQ ID NO: 1238523 - RNA, 20 nt, Homo sapiens
ucccauccccuggacuggga

SEQ ID NO: 1238524 - RNA, 16 nt, Homo sapiens
ucccaucgcugucaca

SEQ ID NO: 1238525 - RNA, 14 nt, Homo sapiens
ucccaucuuuacuc

SEQ ID NO: 1238526 - RNA, 17 nt, Homo sapiens
ucccauggcaccuucag

SEQ ID NO: 1238527 - RNA, 21 nt, Homo sapiens
ucccauucauauuaagacagu

SEQ ID NO: 1238528 - RNA, 12 nt, Homo sapiens
ucccauucuugg

SEQ ID NO: 1238529 - RNA, 18 nt, Homo sapiens
ucccauugcaucaccucu

SEQ ID NO: 1238530 - RNA, 13 nt, Homo sapiens
ucccauugccaug

SEQ ID NO: 1238531 - RNA, 17 nt, Homo sapiens
ucccauuucaucagcaa

SEQ ID NO: 1238532 - RNA, 15 nt, Homo sapiens
uccccaaaccauaaa

SEQ ID NO: 1238533 - RNA, 15 nt, Homo sapiens
uccccaacuucccua

SEQ ID NO: 1238534 - RNA, 13 nt, Homo sapiens
uccccaagcaccu

SEQ ID NO: 1238535 - RNA, 14 nt, Homo sapiens
uccccaaggacucu

SEQ ID NO: 1238536 - RNA, 22 nt, Homo sapiens
uccccaauuggcucuagucacu

SEQ ID NO: 1238537 - RNA, 20 nt, Homo sapiens
uccccacaccucccuacucc

SEQ ID NO: 1238538 - RNA, 18 nt, Homo sapiens
uccccacccauaccacag

SEQ ID NO: 1238539 - RNA, 16 nt, Homo sapiens
uccccacccugaacaa

SEQ ID NO: 1238540 - RNA, 12 nt, Homo sapiens
uccccacugcuc

SEQ ID NO: 1238541 - RNA, 22 nt, Homo sapiens
uccccacugcucucugugguga

SEQ ID NO: 1238542 - RNA, 20 nt, Homo sapiens
uccccacuucucucucccca

SEQ ID NO: 1238543 - RNA, 19 nt, Homo sapiens
uccccagacucagcuggaa

SEQ ID NO: 1238544 - RNA, 15 nt, Homo sapiens
uccccagagcacugg

SEQ ID NO: 1238545 - RNA, 13 nt, Homo sapiens
uccccagagcugu

SEQ ID NO: 1238546 - RNA, 23 nt, Homo sapiens
uccccagcccuggcucugcaaug

SEQ ID NO: 1238547 - RNA, 23 nt, Homo sapiens
uccccagccuccccgugccaaaa

SEQ ID NO: 1238548 - RNA, 13 nt, Homo sapiens
uccccagccugcu

SEQ ID NO: 1238549 - RNA, 20 nt, Homo sapiens
uccccagggcccuuguacaa

SEQ ID NO: 1238550 - RNA, 17 nt, Homo sapiens
uccccagucccagacaa

SEQ ID NO: 1238551 - RNA, 20 nt, Homo sapiens
uccccaguugccgucuagga

SEQ ID NO: 1238552 - RNA, 22 nt, Homo sapiens
uccccauauccaaguaccaaug

SEQ ID NO: 1238553 - RNA, 14 nt, Homo sapiens
uccccaucauccca

SEQ ID NO: 1238554 - RNA, 19 nt, Homo sapiens
uccccaucuggguccuugc

SEQ ID NO: 1238555 - RNA, 18 nt, Homo sapiens
ucccccaaagcaauguga

SEQ ID NO: 1238556 - RNA, 14 nt, Homo sapiens
ucccccaaccucag

SEQ ID NO: 1238557 - RNA, 14 nt, Homo sapiens
ucccccauagccac

SEQ ID NO: 1238558 - RNA, 16 nt, Homo sapiens
ucccccgccacuccug

SEQ ID NO: 1238559 - RNA, 22 nt, Homo sapiens
ucccccuggggcuucuccugac

SEQ ID NO: 1238560 - RNA, 22 nt, Homo sapiens
ucccccuguagacuagugccgu

SEQ ID NO: 1238561 - RNA, 22 nt, Homo sapiens
uccccgagugccuagguuuugg

SEQ ID NO: 1238562 - RNA, 18 nt, Homo sapiens
uccccgccugcagucuuc

SEQ ID NO: 1238563 - RNA, 16 nt, Homo sapiens
uccccggacauacucu

SEQ ID NO: 1238564 - RNA, 21 nt, Homo sapiens
uccccgugccaaaaaucuuuu

SEQ ID NO: 1238565 - RNA, 19 nt, Homo sapiens
uccccucaaacucauugca

SEQ ID NO: 1238566 - RNA, 16 nt, Homo sapiens
uccccuccacauccca

SEQ ID NO: 1238567 - RNA, 13 nt, Homo sapiens
uccccuccacugu

SEQ ID NO: 1238568 - RNA, 15 nt, Homo sapiens
uccccuccagccuuu

SEQ ID NO: 1238569 - RNA, 16 nt, Homo sapiens
uccccucccccaagau

SEQ ID NO: 1238570 - RNA, 20 nt, Homo sapiens
uccccuccucagugacauca

SEQ ID NO: 1238571 - RNA, 22 nt, Homo sapiens
uccccugcccccuguacauuug

SEQ ID NO: 1238572 - RNA, 15 nt, Homo sapiens
uccccuggacuggga

SEQ ID NO: 1238573 - RNA, 21 nt, Homo sapiens
uccccuguagcagucacugac

SEQ ID NO: 1238574 - RNA, 16 nt, Homo sapiens
uccccuucaguaccac

SEQ ID NO: 1238575 - RNA, 19 nt, Homo sapiens
uccccuugcccuugcccug

SEQ ID NO: 1238576 - RNA, 19 nt, Homo sapiens
uccccuugccuaaauacaa

SEQ ID NO: 1238577 - RNA, 14 nt, Homo sapiens
ucaguaagucucau

SEQ ID NO: 1238578 - RNA, 15 nt, Homo sapiens
ucaguaagucucaua

SEQ ID NO: 1238579 - RNA, 15 nt, Homo sapiens
ucaguacacuuggug

SEQ ID NO: 1238580 - RNA, 12 nt, Homo sapiens
ucaguacagagg

SEQ ID NO: 1238581 - RNA, 12 nt, Homo sapiens
ucaguaccccau

SEQ ID NO: 1238582 - RNA, 20 nt, Homo sapiens
ucaguacugacuuucugauu

SEQ ID NO: 1238583 - RNA, 22 nt, Homo sapiens
ucaguagcaucuguaacagcau

SEQ ID NO: 1238584 - RNA, 19 nt, Homo sapiens
ucaguauuagaugcacuua

SEQ ID NO: 1238585 - RNA, 20 nt, Homo sapiens
ucaguauuucaguguaguua

SEQ ID NO: 1238586 - RNA, 20 nt, Homo sapiens
ucagucaacaacuuacacuu

SEQ ID NO: 1238587 - RNA, 18 nt, Homo sapiens
cuacaaaggaaauaucaa

SEQ ID NO: 1238588 - RNA, 23 nt, Homo sapiens
cuacaaaggaaauaucaaagugu

SEQ ID NO: 1238589 - RNA, 19 nt, Homo sapiens
cuacaaguauuauuuuaca

SEQ ID NO: 1238590 - RNA, 22 nt, Homo sapiens
cuacaauaaacugguaugaaua

SEQ ID NO: 1238591 - RNA, 14 nt, Homo sapiens
cuacacacugucau

SEQ ID NO: 1238592 - RNA, 15 nt, Homo sapiens
cuacagagaucccac

SEQ ID NO: 1238593 - RNA, 22 nt, Homo sapiens
cuacagagucuggugaagcuca

SEQ ID NO: 1238594 - RNA, 14 nt, Homo sapiens
cuacagauagaaaa

SEQ ID NO: 1238595 - RNA, 21 nt, Homo sapiens
cuacagaugugggccaccaug

SEQ ID NO: 1238596 - RNA, 14 nt, Homo sapiens
cuacagcagcacug

SEQ ID NO: 1238597 - RNA, 11 nt, Homo sapiens
cuacagcuuuc

SEQ ID NO: 1238598 - RNA, 19 nt, Homo sapiens
cuacagggacacuaucacu

SEQ ID NO: 1238599 - RNA, 19 nt, Homo sapiens
cuacagggccacaacugcc

SEQ ID NO: 1238600 - RNA, 23 nt, Homo sapiens
cuacagggcgagacucugucuca

SEQ ID NO: 1238601 - RNA, 19 nt, Homo sapiens
cuacaggugaaggcucuca

SEQ ID NO: 1238602 - RNA, 22 nt, Homo sapiens
cuacagucuaaaauugcuucuu

SEQ ID NO: 1238603 - RNA, 20 nt, Homo sapiens
cuacagugccaacuccucac

SEQ ID NO: 1238604 - RNA, 17 nt, Homo sapiens
cuacaguuuuaacugug

SEQ ID NO: 1238605 - RNA, 14 nt, Homo sapiens
cuacauaaguaauu

SEQ ID NO: 1238606 - RNA, 16 nt, Homo sapiens
cuacauaauacccagg

SEQ ID NO: 1238607 - RNA, 18 nt, Homo sapiens
cuacauagugacaugcac

SEQ ID NO: 1238608 - RNA, 18 nt, Homo sapiens
cuacauauugucuggaaa

SEQ ID NO: 1238609 - RNA, 19 nt, Homo sapiens
cuacaucuaguuaaucaua

SEQ ID NO: 1238610 - RNA, 15 nt, Homo sapiens
cuacaugccaugacc

SEQ ID NO: 1238611 - RNA, 22 nt, Homo sapiens
cuacaugcugaaaaauauagcc

SEQ ID NO: 1238612 - RNA, 14 nt, Homo sapiens
cuacauuaucucac

SEQ ID NO: 1238613 - RNA, 15 nt, Homo sapiens
cuacauucuaaugca

SEQ ID NO: 1238614 - RNA, 15 nt, Homo sapiens
cuaccacagugucug

SEQ ID NO: 1238615 - RNA, 12 nt, Homo sapiens
cuaccacucaca

SEQ ID NO: 1238616 - RNA, 16 nt, Homo sapiens
cuaccaguugcccuag

SEQ ID NO: 1238617 - RNA, 13 nt, Homo sapiens
cuaccaucaggga

SEQ ID NO: 1238618 - RNA, 17 nt, Homo sapiens
cuacccaaacccuaggu

SEQ ID NO: 1238619 - RNA, 13 nt, Homo sapiens
cuacccacuucca

SEQ ID NO: 1238620 - RNA, 17 nt, Homo sapiens
cuacccaugacuuuaua

SEQ ID NO: 1238621 - RNA, 20 nt, Homo sapiens
cuaccccaaaguuugcucaa

SEQ ID NO: 1238622 - RNA, 17 nt, Homo sapiens
cuaccccuuucuucucg

SEQ ID NO: 1238623 - RNA, 15 nt, Homo sapiens
cuacccugcucccug

SEQ ID NO: 1238624 - RNA, 18 nt, Homo sapiens
cuacccugcugaccuccc

SEQ ID NO: 1238625 - RNA, 13 nt, Homo sapiens
cuacccuguguau

SEQ ID NO: 1238626 - RNA, 21 nt, Homo sapiens
cuacccuuuuccuuugugguu

SEQ ID NO: 1238627 - RNA, 23 nt, Homo sapiens
cuaccgagucucuucuccacugg

SEQ ID NO: 1238628 - RNA, 15 nt, Homo sapiens
cuaccguaaaugucc

SEQ ID NO: 1238629 - RNA, 20 nt, Homo sapiens
cuaccucagaauuaaaacuu

SEQ ID NO: 1238630 - RNA, 17 nt, Homo sapiens
cuaccuccagacuucaa

SEQ ID NO: 1238631 - RNA, 16 nt, Homo sapiens
cuaccugagcuaaaua

SEQ ID NO: 1238632 - RNA, 23 nt, Homo sapiens
cuaccugcucguugccugccacu

SEQ ID NO: 1238633 - RNA, 22 nt, Homo sapiens
cuaccuguaggaucagggucua

SEQ ID NO: 1238634 - RNA, 23 nt, Homo sapiens
cuaccuuuauauuugggguccuu

SEQ ID NO: 1238635 - RNA, 15 nt, Homo sapiens
cuacuaaagugccua

SEQ ID NO: 1238636 - RNA, 21 nt, Homo sapiens
cuacuaaagugccuaccccag

SEQ ID NO: 1238637 - RNA, 20 nt, Homo sapiens
cuacuaccuagggcacuuua

SEQ ID NO: 1238638 - RNA, 14 nt, Homo sapiens
cuacuauguacugc

SEQ ID NO: 1238639 - RNA, 22 nt, Homo sapiens
cuacucaaugccuggagacaga

SEQ ID NO: 1238640 - RNA, 15 nt, Homo sapiens
cuacuccucugcagu

SEQ ID NO: 1238641 - RNA, 12 nt, Homo sapiens
cuacuccugacu

SEQ ID NO: 1238642 - RNA, 19 nt, Homo sapiens
cuacucgggaggcugaggc

SEQ ID NO: 1238643 - RNA, 16 nt, Homo sapiens
cuacucucaugcugca

SEQ ID NO: 1238644 - RNA, 16 nt, Homo sapiens
cuacucuucagggucu

SEQ ID NO: 1238645 - RNA, 22 nt, Homo sapiens
cuacugagcugagaccacugag

SEQ ID NO: 1238646 - RNA, 19 nt, Homo sapiens
cuacugagggcaguucuga

SEQ ID NO: 1238647 - RNA, 19 nt, Homo sapiens
cuacugaguagggggagca

SEQ ID NO: 1238648 - RNA, 20 nt, Homo sapiens
cuacugaguagggggagcaa

SEQ ID NO: 1238649 - RNA, 18 nt, Homo sapiens
cuacugcuaaauccucau

SEQ ID NO: 1238650 - RNA, 14 nt, Homo sapiens
cuacugcucugugu

SEQ ID NO: 1238651 - RNA, 18 nt, Homo sapiens
cuacugcuggaaaaagcc

SEQ ID NO: 1238652 - RNA, 13 nt, Homo sapiens
cuacuggcagcuc

SEQ ID NO: 1238653 - RNA, 15 nt, Homo sapiens
cuacugucucacuga

SEQ ID NO: 1238654 - RNA, 13 nt, Homo sapiens
cuacuucaguaca

SEQ ID NO: 1238655 - RNA, 17 nt, Homo sapiens
cuacuucuuuugcucuu

SEQ ID NO: 1238656 - RNA, 15 nt, Homo sapiens
cuacuugcaauucaa

SEQ ID NO: 1238657 - RNA, 19 nt, Homo sapiens
cuacuugggaggcugaggc

SEQ ID NO: 1238658 - RNA, 21 nt, Homo sapiens
cuacuuuaagcacuacauaaa

SEQ ID NO: 1238659 - RNA, 16 nt, Homo sapiens
cuacuuucucaaaaug

SEQ ID NO: 1238660 - RNA, 17 nt, Homo sapiens
cuacuuucucaaaaugg

SEQ ID NO: 1238661 - RNA, 21 nt, Homo sapiens
cuacuuugguuucugucugua

SEQ ID NO: 1238662 - RNA, 13 nt, Homo sapiens
cuacuuuuaguug

SEQ ID NO: 1238663 - RNA, 19 nt, Homo sapiens
cuacuuuuuuuugacauaa

SEQ ID NO: 1238664 - RNA, 21 nt, Homo sapiens
cuagaaaaauguucuuuaaag

SEQ ID NO: 1238665 - RNA, 18 nt, Homo sapiens
cuagaaaaccagcuugcg

SEQ ID NO: 1238666 - RNA, 18 nt, Homo sapiens
cuagaaaaggcagcuaaa

SEQ ID NO: 1238667 - RNA, 18 nt, Homo sapiens
cuagaaagagaaacaguu

SEQ ID NO: 1238668 - RNA, 17 nt, Homo sapiens
cuagaacacuaacucac

SEQ ID NO: 1238669 - RNA, 19 nt, Homo sapiens
cuagaacaguaaaagccuu

SEQ ID NO: 1238670 - RNA, 18 nt, Homo sapiens
cuagaagaagcuauguca

SEQ ID NO: 1238671 - RNA, 18 nt, Homo sapiens
cuagaagauaacauuuuc

SEQ ID NO: 1238672 - RNA, 10 nt, Homo sapiens
cuagaaggca

SEQ ID NO: 1238673 - RNA, 18 nt, Homo sapiens
cuagaauagucucacugu

SEQ ID NO: 1238674 - RNA, 14 nt, Homo sapiens
cuagacaaguaaaa

SEQ ID NO: 1238675 - RNA, 12 nt, Homo sapiens
cuagacuauaaa

SEQ ID NO: 1238676 - RNA, 13 nt, Homo sapiens
cuagacugccagg

SEQ ID NO: 1238677 - RNA, 17 nt, Homo sapiens
cuagacuguuacuuugg

SEQ ID NO: 1238678 - RNA, 21 nt, Homo sapiens
cuagacuucccaacagccuua

SEQ ID NO: 1238679 - RNA, 18 nt, Homo sapiens
cuagagaucuggcugugg

SEQ ID NO: 1238680 - RNA, 14 nt, Homo sapiens
cuagagaugacuga

SEQ ID NO: 1238681 - RNA, 20 nt, Homo sapiens
cuagagcugacagcuuuguu

SEQ ID NO: 1238682 - RNA, 20 nt, Homo sapiens
cuagaggauguaucucacaa

SEQ ID NO: 1238683 - RNA, 17 nt, Homo sapiens
cuagaguaggugcagaa

SEQ ID NO: 1238684 - RNA, 14 nt, Homo sapiens
cuagaguguagccu

SEQ ID NO: 1238685 - RNA, 15 nt, Homo sapiens
cuagauagcuauuaa

SEQ ID NO: 1238686 - RNA, 13 nt, Homo sapiens
cuagaugagccca

SEQ ID NO: 1238687 - RNA, 18 nt, Homo sapiens
cuagaugcaucacugggu

SEQ ID NO: 1238688 - RNA, 16 nt, Homo sapiens
cuagauguaacauucc

SEQ ID NO: 1238689 - RNA, 19 nt, Homo sapiens
cuagauuaguagaugcauc

SEQ ID NO: 1238690 - RNA, 14 nt, Homo sapiens
cuagauuauaucaa

SEQ ID NO: 1238691 - RNA, 15 nt, Homo sapiens
cuagauucaaagguu

SEQ ID NO: 1238692 - RNA, 18 nt, Homo sapiens
cuagauucaaagguucua

SEQ ID NO: 1238693 - RNA, 19 nt, Homo sapiens
cuagauuuucuacuuuauu

SEQ ID NO: 1238694 - RNA, 23 nt, Homo sapiens
cuagcaaauggcagaaccaaagc

SEQ ID NO: 1238695 - RNA, 15 nt, Homo sapiens
cuagcaauuccauca

SEQ ID NO: 1238696 - RNA, 23 nt, Homo sapiens
cuagcacaauuugcacuaaauca

SEQ ID NO: 1238697 - RNA, 14 nt, Homo sapiens
cuagcagaaaucua

SEQ ID NO: 1238698 - RNA, 23 nt, Homo sapiens
cuagcagauacauggcaacgugu

SEQ ID NO: 1238699 - RNA, 13 nt, Homo sapiens
cuagccaaucaga

SEQ ID NO: 1238700 - RNA, 22 nt, Homo sapiens
cuagccaugauaacugcaauuu

SEQ ID NO: 1238701 - RNA, 18 nt, Homo sapiens
cuagcccucucacauuua

SEQ ID NO: 1238702 - RNA, 19 nt, Homo sapiens
cuagccuauuuaccugcag

SEQ ID NO: 1238703 - RNA, 14 nt, Homo sapiens
cuagccuugcuugu

SEQ ID NO: 1238704 - RNA, 15 nt, Homo sapiens
cuagcugugcaagac

SEQ ID NO: 1238705 - RNA, 19 nt, Homo sapiens
cuaggaaacucacacuccc

SEQ ID NO: 1238706 - RNA, 18 nt, Homo sapiens
cuaggaagacauuuuucc

SEQ ID NO: 1238707 - RNA, 16 nt, Homo sapiens
cuaggaugguucugug

SEQ ID NO: 1238708 - RNA, 18 nt, Homo sapiens
cuaggccucaauuguucc

SEQ ID NO: 1238709 - RNA, 21 nt, Homo sapiens
cuaggccucuccaguuugcac

SEQ ID NO: 1238710 - RNA, 19 nt, Homo sapiens
cuaggcgauuuugucuacc

SEQ ID NO: 1238711 - RNA, 22 nt, Homo sapiens
cuagggaaagggauauggaguu

SEQ ID NO: 1238712 - RNA, 13 nt, Homo sapiens
cuagggagccauu

SEQ ID NO: 1238713 - RNA, 14 nt, Homo sapiens
cuagggagccauuu

SEQ ID NO: 1238714 - RNA, 12 nt, Homo sapiens
ggccgcacuggg

SEQ ID NO: 1238715 - RNA, 14 nt, Homo sapiens
ggccgccugagacc

SEQ ID NO: 1238716 - RNA, 23 nt, Homo sapiens
ggccgggcaggcgugacucagca

SEQ ID NO: 1238717 - RNA, 18 nt, Homo sapiens
ggccuaaucucauaccuc

SEQ ID NO: 1238718 - RNA, 16 nt, Homo sapiens
ggccuacggagucagc

SEQ ID NO: 1238719 - RNA, 16 nt, Homo sapiens
ggccuagaccuggugc

SEQ ID NO: 1238720 - RNA, 21 nt, Homo sapiens
ggccuagccauccccucacua

SEQ ID NO: 1238721 - RNA, 17 nt, Homo sapiens
ggccuaugcacauaugg

SEQ ID NO: 1238722 - RNA, 22 nt, Homo sapiens
ggccucacccaccccugcacag

SEQ ID NO: 1238723 - RNA, 10 nt, Homo sapiens
ggccucagaa

SEQ ID NO: 1238724 - RNA, 18 nt, Homo sapiens
ggccucagggcgcucaga

SEQ ID NO: 1238725 - RNA, 12 nt, Homo sapiens
ggccuccacucc

SEQ ID NO: 1238726 - RNA, 11 nt, Homo sapiens
ggccuccagaa

SEQ ID NO: 1238727 - RNA, 23 nt, Homo sapiens
ggccucccucugcuacuccaucc

SEQ ID NO: 1238728 - RNA, 20 nt, Homo sapiens
ggccuccugacagcaauaaa

SEQ ID NO: 1238729 - RNA, 18 nt, Homo sapiens
ggccucuccaguuugcac

SEQ ID NO: 1238730 - RNA, 15 nt, Homo sapiens
ggccugaccaaacag

SEQ ID NO: 1238731 - RNA, 19 nt, Homo sapiens
ggccugcugccagugcagc

SEQ ID NO: 1238732 - RNA, 17 nt, Homo sapiens
ggccuggacuuccagug

SEQ ID NO: 1238733 - RNA, 23 nt, Homo sapiens
ggccuggacuuccagugcucaga

SEQ ID NO: 1238734 - RNA, 15 nt, Homo sapiens
ggccuggccagucaa

SEQ ID NO: 1238735 - RNA, 16 nt, Homo sapiens
ggccuggcccaaagca

SEQ ID NO: 1238736 - RNA, 17 nt, Homo sapiens
ggccuggggaggcccua

SEQ ID NO: 1238737 - RNA, 16 nt, Homo sapiens
ggccuggggccugaga

SEQ ID NO: 1238738 - RNA, 18 nt, Homo sapiens
ggccuucggccuccaucc

SEQ ID NO: 1238739 - RNA, 14 nt, Homo sapiens
ggccuuguggcacu

SEQ ID NO: 1238740 - RNA, 15 nt, Homo sapiens
ggccuuucugugucc

SEQ ID NO: 1238741 - RNA, 14 nt, Homo sapiens
ggccuuuuuugcca

SEQ ID NO: 1238742 - RNA, 15 nt, Homo sapiens
ggccuuuuuugccag

SEQ ID NO: 1238743 - RNA, 23 nt, Homo sapiens
ggcgaacccugggccauccucac

SEQ ID NO: 1238744 - RNA, 20 nt, Homo sapiens
ggcgacagagcgagacuccg

SEQ ID NO: 1238745 - RNA, 21 nt, Homo sapiens
ggcgacugagccaugcucaga

SEQ ID NO: 1238746 - RNA, 17 nt, Homo sapiens
ggcgccaucgccaagua

SEQ ID NO: 1238747 - RNA, 13 nt, Homo sapiens
ggcgcucuuccag

SEQ ID NO: 1238748 - RNA, 15 nt, Homo sapiens
ggcggccaggcacag

SEQ ID NO: 1238749 - RNA, 16 nt, Homo sapiens
ggcggcccacacccag

SEQ ID NO: 1238750 - RNA, 14 nt, Homo sapiens
ggcggcccggccag

SEQ ID NO: 1238751 - RNA, 20 nt, Homo sapiens
ggcggguggaucacgagguc

SEQ ID NO: 1238752 - RNA, 12 nt, Homo sapiens
ggcgugaucuug

SEQ ID NO: 1238753 - RNA, 17 nt, Homo sapiens
ggcguggagacuggcag

SEQ ID NO: 1238754 - RNA, 21 nt, Homo sapiens
ggcguuuugucuguguugcug

SEQ ID NO: 1238755 - RNA, 13 nt, Homo sapiens
ggcuaacauccca

SEQ ID NO: 1238756 - RNA, 11 nt, Homo sapiens
ggcuaacggga

SEQ ID NO: 1238757 - RNA, 23 nt, Homo sapiens
ggcuacaaagcguuucuuuacuu

SEQ ID NO: 1238758 - RNA, 17 nt, Homo sapiens
ggcuacacacaaaccag

SEQ ID NO: 1238759 - RNA, 23 nt, Homo sapiens
ggcuacuaccuagggcacuuuaa

SEQ ID NO: 1238760 - RNA, 17 nt, Homo sapiens
ggcucagacauguuuuc

SEQ ID NO: 1238761 - RNA, 18 nt, Homo sapiens
ggcucaggccauggcucc

SEQ ID NO: 1238762 - RNA, 15 nt, Homo sapiens
ggcucaugccuguaa

SEQ ID NO: 1238763 - RNA, 16 nt, Homo sapiens
ggcuccaacacugcug

SEQ ID NO: 1238764 - RNA, 15 nt, Homo sapiens
ggcuccaagaccuag

SEQ ID NO: 1238765 - RNA, 22 nt, Homo sapiens
ggcuccaccccauccaguucau

SEQ ID NO: 1238766 - RNA, 14 nt, Homo sapiens
ggcuccagcaccuu

SEQ ID NO: 1238767 - RNA, 21 nt, Homo sapiens
ggcuccccuccucggcuuccu

SEQ ID NO: 1238768 - RNA, 16 nt, Homo sapiens
ggcuccuggcugccag

SEQ ID NO: 1238769 - RNA, 22 nt, Homo sapiens
ggcucgccaugccggggguuca

SEQ ID NO: 1238770 - RNA, 16 nt, Homo sapiens
ggcucguguauuuauu

SEQ ID NO: 1238771 - RNA, 17 nt, Homo sapiens
ggcucuaauguacaaua

SEQ ID NO: 1238772 - RNA, 19 nt, Homo sapiens
ggcucuaauucacagugcu

SEQ ID NO: 1238773 - RNA, 20 nt, Homo sapiens
ggcucuccucgcagguguuc

SEQ ID NO: 1238774 - RNA, 22 nt, Homo sapiens
ggcucuguaccacgcuggccau

SEQ ID NO: 1238775 - RNA, 19 nt, Homo sapiens
ggcucuuaugugugccuuu

SEQ ID NO: 1238776 - RNA, 16 nt, Homo sapiens
ggcugaaaaugcaaag

SEQ ID NO: 1238777 - RNA, 15 nt, Homo sapiens
ggcugaagugucaca

SEQ ID NO: 1238778 - RNA, 19 nt, Homo sapiens
ggcugaauccgugguggca

SEQ ID NO: 1238779 - RNA, 18 nt, Homo sapiens
ggcugacaugaagcuguu

SEQ ID NO: 1238780 - RNA, 21 nt, Homo sapiens
ggcugagcaucggaguggagu

SEQ ID NO: 1238781 - RNA, 15 nt, Homo sapiens
ggcugaggauuucaa

SEQ ID NO: 1238782 - RNA, 21 nt, Homo sapiens
ggcugauuucucacacacugg

SEQ ID NO: 1238783 - RNA, 18 nt, Homo sapiens
ggcugcacccacccagga

SEQ ID NO: 1238784 - RNA, 19 nt, Homo sapiens
ggcugccccugcguggccu

SEQ ID NO: 1238785 - RNA, 15 nt, Homo sapiens
ggcugcccucuccac

SEQ ID NO: 1238786 - RNA, 17 nt, Homo sapiens
ggcugccugacacugag

SEQ ID NO: 1238787 - RNA, 19 nt, Homo sapiens
ggcugcugaaaaccaucug

SEQ ID NO: 1238788 - RNA, 18 nt, Homo sapiens
ggcugcuggggccucaga

SEQ ID NO: 1238789 - RNA, 20 nt, Homo sapiens
ggcugcuuggagcagccuaa

SEQ ID NO: 1238790 - RNA, 20 nt, Homo sapiens
ggcuggagugcaauggcgcg

SEQ ID NO: 1238791 - RNA, 14 nt, Homo sapiens
ggcuggagugcagu

SEQ ID NO: 1238792 - RNA, 21 nt, Homo sapiens
gcacuacauucauuuagcuaa

SEQ ID NO: 1238793 - RNA, 13 nt, Homo sapiens
gcacuacucugug

SEQ ID NO: 1238794 - RNA, 13 nt, Homo sapiens
gcacuauguauau

SEQ ID NO: 1238795 - RNA, 13 nt, Homo sapiens
gcacuauuugccg

SEQ ID NO: 1238796 - RNA, 18 nt, Homo sapiens
gcacucaaagcuuguuaa

SEQ ID NO: 1238797 - RNA, 22 nt, Homo sapiens
gcacucagaaaagaaaaccauu

SEQ ID NO: 1238798 - RNA, 19 nt, Homo sapiens
gcacucagaagacacugau

SEQ ID NO: 1238799 - RNA, 22 nt, Homo sapiens
gcacucugaguuuaccauuugu

SEQ ID NO: 1238800 - RNA, 21 nt, Homo sapiens
gcacugacaaugggcacacag

SEQ ID NO: 1238801 - RNA, 15 nt, Homo sapiens
gcacugacugggcau

SEQ ID NO: 1238802 - RNA, 16 nt, Homo sapiens
gcacugaggaccagcc

SEQ ID NO: 1238803 - RNA, 18 nt, Homo sapiens
gcacugaggguggcacuc

SEQ ID NO: 1238804 - RNA, 22 nt, Homo sapiens
gcacuggggagcccgucucagu

SEQ ID NO: 1238805 - RNA, 21 nt, Homo sapiens
gcacuggugguuuuugcucuc

SEQ ID NO: 1238806 - RNA, 17 nt, Homo sapiens
gcacugugagcaccuga

SEQ ID NO: 1238807 - RNA, 13 nt, Homo sapiens
gcacuguucaaua

SEQ ID NO: 1238808 - RNA, 17 nt, Homo sapiens
gcacuguugcaaacuca

SEQ ID NO: 1238809 - RNA, 12 nt, Homo sapiens
gcacuguuuuca

SEQ ID NO: 1238810 - RNA, 20 nt, Homo sapiens
gcacuuacagcucuggccac

SEQ ID NO: 1238811 - RNA, 21 nt, Homo sapiens
gcacuuauauagcaccuuuca

SEQ ID NO: 1238812 - RNA, 16 nt, Homo sapiens
gcacuugugcuuucag

SEQ ID NO: 1238813 - RNA, 19 nt, Homo sapiens
gcacuuuagcagauguggu

SEQ ID NO: 1238814 - RNA, 14 nt, Homo sapiens
gcagaaagccacaa

SEQ ID NO: 1238815 - RNA, 17 nt, Homo sapiens
gcagaaagccacaaacu

SEQ ID NO: 1238816 - RNA, 13 nt, Homo sapiens
gcagaaaugcaag

SEQ ID NO: 1238817 - RNA, 19 nt, Homo sapiens
gcagaaauuuaucuuucaa

SEQ ID NO: 1238818 - RNA, 14 nt, Homo sapiens
gcagaacagcauca

SEQ ID NO: 1238819 - RNA, 12 nt, Homo sapiens
gcagaaccacaa

SEQ ID NO: 1238820 - RNA, 15 nt, Homo sapiens
gcagaacuccuccaa

SEQ ID NO: 1238821 - RNA, 13 nt, Homo sapiens
gcagaauggacuu

SEQ ID NO: 1238822 - RNA, 21 nt, Homo sapiens
gcagaauuuaaguugguaaua

SEQ ID NO: 1238823 - RNA, 15 nt, Homo sapiens
gcagacaaguggaca

SEQ ID NO: 1238824 - RNA, 15 nt, Homo sapiens
gcagacaccuggacu

SEQ ID NO: 1238825 - RNA, 22 nt, Homo sapiens
gcagacaggaggaaucauguca

SEQ ID NO: 1238826 - RNA, 13 nt, Homo sapiens
gcagacgggcaca

SEQ ID NO: 1238827 - RNA, 12 nt, Homo sapiens
gcagagaagcau

SEQ ID NO: 1238828 - RNA, 13 nt, Homo sapiens
gcagagcauuuaa

SEQ ID NO: 1238829 - RNA, 20 nt, Homo sapiens
gcagagccucguuucugcuu

SEQ ID NO: 1238830 - RNA, 14 nt, Homo sapiens
gcagaggaugucuc

SEQ ID NO: 1238831 - RNA, 16 nt, Homo sapiens
gcagaggaugucucaa

SEQ ID NO: 1238832 - RNA, 13 nt, Homo sapiens
gcagaggcaccuc

SEQ ID NO: 1238833 - RNA, 21 nt, Homo sapiens
gcagaggcggagcugugcuca

SEQ ID NO: 1238834 - RNA, 23 nt, Homo sapiens
gcagaggcuccgcggcaggagga

SEQ ID NO: 1238835 - RNA, 16 nt, Homo sapiens
gcagaguacaaaguaa

SEQ ID NO: 1238836 - RNA, 23 nt, Homo sapiens
gcagaguuuguguguugucuuga

SEQ ID NO: 1238837 - RNA, 19 nt, Homo sapiens
gcagauacaggaaaagcug

SEQ ID NO: 1238838 - RNA, 19 nt, Homo sapiens
gcagauaggagcugcaggg

SEQ ID NO: 1238839 - RNA, 16 nt, Homo sapiens
gcagauggggcacuga

SEQ ID NO: 1238840 - RNA, 14 nt, Homo sapiens
gcagauuugcacug

SEQ ID NO: 1238841 - RNA, 21 nt, Homo sapiens
gcagcaaggaaagcucacgaa

SEQ ID NO: 1238842 - RNA, 12 nt, Homo sapiens
gcagcaaggccc

SEQ ID NO: 1238843 - RNA, 21 nt, Homo sapiens
gcagcacagucacccauggaa

SEQ ID NO: 1238844 - RNA, 18 nt, Homo sapiens
gcagcaccaaccacagca

SEQ ID NO: 1238845 - RNA, 21 nt, Homo sapiens
gcagcacggacaauaaaccuc

SEQ ID NO: 1238846 - RNA, 21 nt, Homo sapiens
gcagcagcaaggaaagcucac

SEQ ID NO: 1238847 - RNA, 15 nt, Homo sapiens
gcagcaguaccaucu

SEQ ID NO: 1238848 - RNA, 20 nt, Homo sapiens
gagucaacaggucacuugau

SEQ ID NO: 1238849 - RNA, 18 nt, Homo sapiens
gagucaaugugcagugua

SEQ ID NO: 1238850 - RNA, 23 nt, Homo sapiens
gagucacccaugaagacaggaca

SEQ ID NO: 1238851 - RNA, 15 nt, Homo sapiens
gagucagacugucag

SEQ ID NO: 1238852 - RNA, 19 nt, Homo sapiens
gagucauccagcucuugcu

SEQ ID NO: 1238853 - RNA, 18 nt, Homo sapiens
gagucauggcuaauuuaa

SEQ ID NO: 1238854 - RNA, 15 nt, Homo sapiens
gaguccaagaaucca

SEQ ID NO: 1238855 - RNA, 16 nt, Homo sapiens
gaguccacugcuccau

SEQ ID NO: 1238856 - RNA, 23 nt, Homo sapiens
gaguccacuguggcacuggccac

SEQ ID NO: 1238857 - RNA, 14 nt, Homo sapiens
gaguccucacuccc

SEQ ID NO: 1238858 - RNA, 15 nt, Homo sapiens
gaguccucacuccca

SEQ ID NO: 1238859 - RNA, 20 nt, Homo sapiens
gaguccucguagccaucucu

SEQ ID NO: 1238860 - RNA, 20 nt, Homo sapiens
gagucgcaucucagugcagg

SEQ ID NO: 1238861 - RNA, 14 nt, Homo sapiens
gagucuacagagaa

SEQ ID NO: 1238862 - RNA, 15 nt, Homo sapiens
gagucugaacagcug

SEQ ID NO: 1238863 - RNA, 23 nt, Homo sapiens
gagucugaauagucuucagagau

SEQ ID NO: 1238864 - RNA, 14 nt, Homo sapiens
gagucugugcucuu

SEQ ID NO: 1238865 - RNA, 18 nt, Homo sapiens
gagucuugcucuguuacc

SEQ ID NO: 1238866 - RNA, 23 nt, Homo sapiens
gagucuuuaauuuuuccugauga

SEQ ID NO: 1238867 - RNA, 19 nt, Homo sapiens
gagucuuugguucuaagga

SEQ ID NO: 1238868 - RNA, 18 nt, Homo sapiens
gagugaaaccaugacugu

SEQ ID NO: 1238869 - RNA, 19 nt, Homo sapiens
gagugagacucugucucaa

SEQ ID NO: 1238870 - RNA, 13 nt, Homo sapiens
gagugagacugac

SEQ ID NO: 1238871 - RNA, 13 nt, Homo sapiens
gagugagcugguu

SEQ ID NO: 1238872 - RNA, 20 nt, Homo sapiens
gagugcaccacuucaaguga

SEQ ID NO: 1238873 - RNA, 14 nt, Homo sapiens
gagugcagggugga

SEQ ID NO: 1238874 - RNA, 16 nt, Homo sapiens
gagugcaguggcacca

SEQ ID NO: 1238875 - RNA, 19 nt, Homo sapiens
gagugcaguggcgugaucu

SEQ ID NO: 1238876 - RNA, 19 nt, Homo sapiens
gagugcaguggugugaucu

SEQ ID NO: 1238877 - RNA, 23 nt, Homo sapiens
gagugcggcguggagacuggcag

SEQ ID NO: 1238878 - RNA, 20 nt, Homo sapiens
gagugcucugaugcaauagu

SEQ ID NO: 1238879 - RNA, 14 nt, Homo sapiens
gagugcucuugcua

SEQ ID NO: 1238880 - RNA, 22 nt, Homo sapiens
gagugggccccgggcuggagaa

SEQ ID NO: 1238881 - RNA, 16 nt, Homo sapiens
gagugguuuccaaugu

SEQ ID NO: 1238882 - RNA, 23 nt, Homo sapiens
gagugguuuccaauguguucaau

SEQ ID NO: 1238883 - RNA, 15 nt, Homo sapiens
gagugucacaucucu

SEQ ID NO: 1238884 - RNA, 14 nt, Homo sapiens
gaguguccggcuga

SEQ ID NO: 1238885 - RNA, 21 nt, Homo sapiens
gaguguccggcugaggccuga

SEQ ID NO: 1238886 - RNA, 19 nt, Homo sapiens
gaguguccuuaguguauaa

SEQ ID NO: 1238887 - RNA, 16 nt, Homo sapiens
gaguguuauuugcaca

SEQ ID NO: 1238888 - RNA, 21 nt, Homo sapiens
gaguguuauuugcacacugca

SEQ ID NO: 1238889 - RNA, 19 nt, Homo sapiens
gaguguuucuuccacaaca

SEQ ID NO: 1238890 - RNA, 18 nt, Homo sapiens
gaguuaaugauggcagag

SEQ ID NO: 1238891 - RNA, 21 nt, Homo sapiens
gaguuaguggauuacugccau

SEQ ID NO: 1238892 - RNA, 21 nt, Homo sapiens
gaguucacaggaggccagugg

SEQ ID NO: 1238893 - RNA, 20 nt, Homo sapiens
gaguucauacccuguuacca

SEQ ID NO: 1238894 - RNA, 17 nt, Homo sapiens
gaguuccuaacaggaug

SEQ ID NO: 1238895 - RNA, 20 nt, Homo sapiens
gaguugauggggugcagaua

SEQ ID NO: 1238896 - RNA, 23 nt, Homo sapiens
gaguuggacuucagucuugccua

SEQ ID NO: 1238897 - RNA, 14 nt, Homo sapiens
gaguuggcaaaaug

SEQ ID NO: 1238898 - RNA, 21 nt, Homo sapiens
gaguugggggcggcuugucuu

SEQ ID NO: 1238899 - RNA, 15 nt, Homo sapiens
gaguugguuacuuca

SEQ ID NO: 1238900 - RNA, 20 nt, Homo sapiens
gaguuguuucugacccacug

SEQ ID NO: 1238901 - RNA, 23 nt, Homo sapiens
gaguuuauuggaggaucaaagaa

SEQ ID NO: 1238902 - RNA, 21 nt, Homo sapiens
gaguuugagcugccuucccua

SEQ ID NO: 1238903 - RNA, 17 nt, Homo sapiens
gaguuugcaaugucaca

SEQ ID NO: 1238904 - RNA, 22 nt, Homo sapiens
gaguuugccuguucuaugccuu

SEQ ID NO: 1238905 - RNA, 15 nt, Homo sapiens
gaguuugucauuaua

SEQ ID NO: 1238906 - RNA, 22 nt, Homo sapiens
gaguuuuccucuauacaucucu

SEQ ID NO: 1238907 - RNA, 14 nt, Homo sapiens
gauaaaauccaaaa

SEQ ID NO: 1238908 - RNA, 17 nt, Homo sapiens
gauaaaugacacaauga

SEQ ID NO: 1238909 - RNA, 19 nt, Homo sapiens
gauaacccuacacccagac

SEQ ID NO: 1238910 - RNA, 20 nt, Homo sapiens
gauaacuuggggaggcaaga

SEQ ID NO: 1238911 - RNA, 20 nt, Homo sapiens
gauaagacacccccucaaac

SEQ ID NO: 1238912 - RNA, 17 nt, Homo sapiens
gauaaguugugauuuga

SEQ ID NO: 1238913 - RNA, 16 nt, Homo sapiens
gauaauagauucucuu

SEQ ID NO: 1238914 - RNA, 14 nt, Homo sapiens
gauaauaucuuugu

SEQ ID NO: 1238915 - RNA, 20 nt, Homo sapiens
gauaauaugaaaaucuccau

SEQ ID NO: 1238916 - RNA, 15 nt, Homo sapiens
gauaaucagccucuu

SEQ ID NO: 1238917 - RNA, 16 nt, Homo sapiens
gauaaugaaauaauca

SEQ ID NO: 1238918 - RNA, 19 nt, Homo sapiens
gauaauggugaacauuuua

SEQ ID NO: 1238919 - RNA, 23 nt, Homo sapiens
gauaauuuauuaaaggugguccu

SEQ ID NO: 1238920 - RNA, 17 nt, Homo sapiens
gauacacaccuuucaca

SEQ ID NO: 1238921 - RNA, 23 nt, Homo sapiens
gauacacugaaguuaacagagac

SEQ ID NO: 1238922 - RNA, 14 nt, Homo sapiens
gauacagaaaugca

SEQ ID NO: 1238923 - RNA, 18 nt, Homo sapiens
gauacagaaaugcaaaag

SEQ ID NO: 1238924 - RNA, 20 nt, Homo sapiens
gauacauggcaacgugugaa

SEQ ID NO: 1238925 - RNA, 23 nt, Homo sapiens
gauggccacccgcccacagccag

SEQ ID NO: 1238926 - RNA, 14 nt, Homo sapiens
gauggccacuguga

SEQ ID NO: 1238927 - RNA, 18 nt, Homo sapiens
gauggcccauagaccuga

SEQ ID NO: 1238928 - RNA, 20 nt, Homo sapiens
gauggccccuccacugggga

SEQ ID NO: 1238929 - RNA, 21 nt, Homo sapiens
gauggccucucucaaaagaga

SEQ ID NO: 1238930 - RNA, 17 nt, Homo sapiens
gauggccuuacacugaa

SEQ ID NO: 1238931 - RNA, 17 nt, Homo sapiens
gauggcucgugggaugu

SEQ ID NO: 1238932 - RNA, 19 nt, Homo sapiens
gauggcuggaaggggucca

SEQ ID NO: 1238933 - RNA, 12 nt, Homo sapiens
gaugggcaaagc

SEQ ID NO: 1238934 - RNA, 14 nt, Homo sapiens
gauggggcucccag

SEQ ID NO: 1238935 - RNA, 15 nt, Homo sapiens
gaugguaaaccagau

SEQ ID NO: 1238936 - RNA, 12 nt, Homo sapiens
gauggugccugc

SEQ ID NO: 1238937 - RNA, 20 nt, Homo sapiens
gaugguuccucucuuggcaa

SEQ ID NO: 1238938 - RNA, 22 nt, Homo sapiens
gauguaaugucccuuucagaga

SEQ ID NO: 1238939 - RNA, 11 nt, Homo sapiens
gauguacaauu

SEQ ID NO: 1238940 - RNA, 13 nt, Homo sapiens
gauguacaauuaa

SEQ ID NO: 1238941 - RNA, 20 nt, Homo sapiens
gauguaugugugaaacaaug

SEQ ID NO: 1238942 - RNA, 15 nt, Homo sapiens
gaugucaggcccaga

SEQ ID NO: 1238943 - RNA, 19 nt, Homo sapiens
gaugucaucacacucucca

SEQ ID NO: 1238944 - RNA, 17 nt, Homo sapiens
gaugucccugggccagg

SEQ ID NO: 1238945 - RNA, 17 nt, Homo sapiens
gaugucucuuguagaag

SEQ ID NO: 1238946 - RNA, 18 nt, Homo sapiens
gaugugaaaauauacuug

SEQ ID NO: 1238947 - RNA, 16 nt, Homo sapiens
gaugugaucacugaga

SEQ ID NO: 1238948 - RNA, 18 nt, Homo sapiens
gauguggccugcauguac

SEQ ID NO: 1238949 - RNA, 18 nt, Homo sapiens
gaugugugagcuaugcaa

SEQ ID NO: 1238950 - RNA, 16 nt, Homo sapiens
gauguuacuagccucu

SEQ ID NO: 1238951 - RNA, 15 nt, Homo sapiens
gauguucacuguggc

SEQ ID NO: 1238952 - RNA, 12 nt, Homo sapiens
gauguugcucag

SEQ ID NO: 1238953 - RNA, 18 nt, Homo sapiens
gauguuuccagacuuccu

SEQ ID NO: 1238954 - RNA, 19 nt, Homo sapiens
gauguuuccagacuuccuu

SEQ ID NO: 1238955 - RNA, 18 nt, Homo sapiens
gauguuugaggcuuucag

SEQ ID NO: 1238956 - RNA, 22 nt, Homo sapiens
gauguuuuaaguuuaucuuuca

SEQ ID NO: 1238957 - RNA, 20 nt, Homo sapiens
gauguuuuuaaaaguuucaa

SEQ ID NO: 1238958 - RNA, 20 nt, Homo sapiens
gauuaaacaaacaaacaauu

SEQ ID NO: 1238959 - RNA, 14 nt, Homo sapiens
gauuaaacagacuu

SEQ ID NO: 1238960 - RNA, 23 nt, Homo sapiens
gauuaaacgugcagacuaugcaa

SEQ ID NO: 1238961 - RNA, 14 nt, Homo sapiens
gauuaaagugccca

SEQ ID NO: 1238962 - RNA, 14 nt, Homo sapiens
gauuaaccucugca

SEQ ID NO: 1238963 - RNA, 23 nt, Homo sapiens
gauuaaccucugcacuacugaca

SEQ ID NO: 1238964 - RNA, 18 nt, Homo sapiens
gauuaaggugaugugauu

SEQ ID NO: 1238965 - RNA, 14 nt, Homo sapiens
gauuaauauuauua

SEQ ID NO: 1238966 - RNA, 14 nt, Homo sapiens
gauuaauguuuuca

SEQ ID NO: 1238967 - RNA, 22 nt, Homo sapiens
gauuacaagcgugagccacugc

SEQ ID NO: 1238968 - RNA, 21 nt, Homo sapiens
gauuacaggcaugagccaccg

SEQ ID NO: 1238969 - RNA, 16 nt, Homo sapiens
gauuacucuccauauc

SEQ ID NO: 1238970 - RNA, 14 nt, Homo sapiens
gauuacugucaaua

SEQ ID NO: 1238971 - RNA, 20 nt, Homo sapiens
gauuagguguucaggccagu

SEQ ID NO: 1238972 - RNA, 22 nt, Homo sapiens
gauuauaaaaaauguaacauca

SEQ ID NO: 1238973 - RNA, 16 nt, Homo sapiens
gauuaugaagugacuc

SEQ ID NO: 1238974 - RNA, 19 nt, Homo sapiens
gauuaugcagacaaccuca

SEQ ID NO: 1238975 - RNA, 21 nt, Homo sapiens
gauuauuggaaauuuguuaua

SEQ ID NO: 1238976 - RNA, 13 nt, Homo sapiens
cacacacacuggc

SEQ ID NO: 1238977 - RNA, 14 nt, Homo sapiens
cacacacaugcaca

SEQ ID NO: 1238978 - RNA, 20 nt, Homo sapiens
cacacaccaaguaccaguau

SEQ ID NO: 1238979 - RNA, 18 nt, Homo sapiens
cacacacgaugcauuuaa

SEQ ID NO: 1238980 - RNA, 19 nt, Homo sapiens
cacacacgaugcauuuaau

SEQ ID NO: 1238981 - RNA, 20 nt, Homo sapiens
cacacacgugcgugcgagca

SEQ ID NO: 1238982 - RNA, 14 nt, Homo sapiens
cacacagacuccac

SEQ ID NO: 1238983 - RNA, 14 nt, Homo sapiens
cacacagacucuag

SEQ ID NO: 1238984 - RNA, 14 nt, Homo sapiens
cacacagucacauu

SEQ ID NO: 1238985 - RNA, 12 nt, Homo sapiens
cacacagugaaa

SEQ ID NO: 1238986 - RNA, 15 nt, Homo sapiens
cacaccagaaagcua

SEQ ID NO: 1238987 - RNA, 21 nt, Homo sapiens
cacaccagucacaugaccuga

SEQ ID NO: 1238988 - RNA, 21 nt, Homo sapiens
cacaccccuccggacauccag

SEQ ID NO: 1238989 - RNA, 12 nt, Homo sapiens
cacacccggcua

SEQ ID NO: 1238990 - RNA, 16 nt, Homo sapiens
cacaccgucuuccuuc

SEQ ID NO: 1238991 - RNA, 17 nt, Homo sapiens
cacaccugaacuugccu

SEQ ID NO: 1238992 - RNA, 15 nt, Homo sapiens
cacaccuggccuuaa

SEQ ID NO: 1238993 - RNA, 16 nt, Homo sapiens
cacacgauaaagggau

SEQ ID NO: 1238994 - RNA, 13 nt, Homo sapiens
cacacgaugcauu

SEQ ID NO: 1238995 - RNA, 15 nt, Homo sapiens
cacacgaugcauuua

SEQ ID NO: 1238996 - RNA, 17 nt, Homo sapiens
cacacucagaacccagg

SEQ ID NO: 1238997 - RNA, 18 nt, Homo sapiens
cacacuggcuggcccucu

SEQ ID NO: 1238998 - RNA, 15 nt, Homo sapiens
cacacuugugugugg

SEQ ID NO: 1238999 - RNA, 13 nt, Homo sapiens
cacacuuugcacu

SEQ ID NO: 1239000 - RNA, 13 nt, Homo sapiens
cacacuuugccau

SEQ ID NO: 1239001 - RNA, 20 nt, Homo sapiens
cacagaacacagcaauuccu

SEQ ID NO: 1239002 - RNA, 17 nt, Homo sapiens
cacagaauagcacaaac

SEQ ID NO: 1239003 - RNA, 13 nt, Homo sapiens
cacagacuggcaa

SEQ ID NO: 1239004 - RNA, 16 nt, Homo sapiens
cacagacuggcaauaa

SEQ ID NO: 1239005 - RNA, 13 nt, Homo sapiens
cacagagacauuc

SEQ ID NO: 1239006 - RNA, 14 nt, Homo sapiens
cacagagugcauug

SEQ ID NO: 1239007 - RNA, 19 nt, Homo sapiens
cacagauccccccacaaag

SEQ ID NO: 1239008 - RNA, 20 nt, Homo sapiens
cacagaucugcuugaucaau

SEQ ID NO: 1239009 - RNA, 17 nt, Homo sapiens
cacagauguaauuaugu

SEQ ID NO: 1239010 - RNA, 13 nt, Homo sapiens
cacagaugucucu

SEQ ID NO: 1239011 - RNA, 18 nt, Homo sapiens
cacagcaaggaaauucac

SEQ ID NO: 1239012 - RNA, 21 nt, Homo sapiens
cacagcagccccugcacaaag

SEQ ID NO: 1239013 - RNA, 16 nt, Homo sapiens
cacagcaugugccaag

SEQ ID NO: 1239014 - RNA, 13 nt, Homo sapiens
cacagcauuguau

SEQ ID NO: 1239015 - RNA, 11 nt, Homo sapiens
cacagccaaac

SEQ ID NO: 1239016 - RNA, 15 nt, Homo sapiens
cacagccuggccccu

SEQ ID NO: 1239017 - RNA, 20 nt, Homo sapiens
cacagccuuggaucaggaca

SEQ ID NO: 1239018 - RNA, 23 nt, Homo sapiens
cacagcgucccuagcagugaacu

SEQ ID NO: 1239019 - RNA, 14 nt, Homo sapiens
cacagcguccuguc

SEQ ID NO: 1239020 - RNA, 16 nt, Homo sapiens
cacagcuacagcuuuc

SEQ ID NO: 1239021 - RNA, 17 nt, Homo sapiens
cacagcucccugccaaa

SEQ ID NO: 1239022 - RNA, 21 nt, Homo sapiens
cacagcugccaucgaccugga

SEQ ID NO: 1239023 - RNA, 19 nt, Homo sapiens
cacagcugcugcuggaaau

SEQ ID NO: 1239024 - RNA, 20 nt, Homo sapiens
cacagcugggcaaagccaca

SEQ ID NO: 1239025 - RNA, 19 nt, Homo sapiens
cacagcuuagaagugcuau

SEQ ID NO: 1239026 - RNA, 18 nt, Homo sapiens
cacagcuuagauuucaua

SEQ ID NO: 1239027 - RNA, 22 nt, Homo sapiens
cacaggaaaccaacacccaaag

SEQ ID NO: 1239028 - RNA, 20 nt, Homo sapiens
cacaggacugaaaagggaau

SEQ ID NO: 1239029 - RNA, 21 nt, Homo sapiens
cacaggauuuguaauuccuua

SEQ ID NO: 1239030 - RNA, 22 nt, Homo sapiens
cacaggcagcuggaugagacuu

SEQ ID NO: 1239031 - RNA, 23 nt, Homo sapiens
cacaggcuggcgcucggcuccac

SEQ ID NO: 1239032 - RNA, 16 nt, Homo sapiens
cacaggcugugccaac

SEQ ID NO: 1239033 - RNA, 15 nt, Homo sapiens
cacagggacacaaag

SEQ ID NO: 1239034 - RNA, 16 nt, Homo sapiens
cacagggcaggggugg

SEQ ID NO: 1239035 - RNA, 15 nt, Homo sapiens
cacagggucugcucu

SEQ ID NO: 1239036 - RNA, 12 nt, Homo sapiens
cacaggucccac

SEQ ID NO: 1239037 - RNA, 18 nt, Homo sapiens
cacaguaauuauguucua

SEQ ID NO: 1239038 - RNA, 18 nt, Homo sapiens
cacaguaggcacucaaua

SEQ ID NO: 1239039 - RNA, 14 nt, Homo sapiens
caauaauuacugua

SEQ ID NO: 1239040 - RNA, 14 nt, Homo sapiens
caauacaaauggau

SEQ ID NO: 1239041 - RNA, 15 nt, Homo sapiens
caauacaugcugcua

SEQ ID NO: 1239042 - RNA, 17 nt, Homo sapiens
caauacaugcugcuaau

SEQ ID NO: 1239043 - RNA, 18 nt, Homo sapiens
caauacaugcugcuaauu

SEQ ID NO: 1239044 - RNA, 13 nt, Homo sapiens
caauacuaccucu

SEQ ID NO: 1239045 - RNA, 15 nt, Homo sapiens
caauacuguuuccau

SEQ ID NO: 1239046 - RNA, 14 nt, Homo sapiens
caauaggagucuua

SEQ ID NO: 1239047 - RNA, 14 nt, Homo sapiens
caauaguaaaagau

SEQ ID NO: 1239048 - RNA, 23 nt, Homo sapiens
caauaucuaauauauaugaauaa

SEQ ID NO: 1239049 - RNA, 16 nt, Homo sapiens
caauauggauuucuua

SEQ ID NO: 1239050 - RNA, 21 nt, Homo sapiens
caauauggggcagcuuaccaa

SEQ ID NO: 1239051 - RNA, 16 nt, Homo sapiens
caauauuaaauacaga

SEQ ID NO: 1239052 - RNA, 21 nt, Homo sapiens
caauauuaaauacagacacua

SEQ ID NO: 1239053 - RNA, 21 nt, Homo sapiens
caauauuuuuauaucaugcaa

SEQ ID NO: 1239054 - RNA, 17 nt, Homo sapiens
caaucaaggccacugcu

SEQ ID NO: 1239055 - RNA, 15 nt, Homo sapiens
caaucagaugccuca

SEQ ID NO: 1239056 - RNA, 21 nt, Homo sapiens
caaucaggguuuuuagauuaa

SEQ ID NO: 1239057 - RNA, 19 nt, Homo sapiens
caaucaugagcaagugaac

SEQ ID NO: 1239058 - RNA, 14 nt, Homo sapiens
caauccaacaucca

SEQ ID NO: 1239059 - RNA, 22 nt, Homo sapiens
caaucccugaggacugauuuca

SEQ ID NO: 1239060 - RNA, 18 nt, Homo sapiens
caauccgaaguaugaggg

SEQ ID NO: 1239061 - RNA, 15 nt, Homo sapiens
caauccuuaguccua

SEQ ID NO: 1239062 - RNA, 18 nt, Homo sapiens
caauccuugccacagugu

SEQ ID NO: 1239063 - RNA, 19 nt, Homo sapiens
caaucuaaagauacagugu

SEQ ID NO: 1239064 - RNA, 18 nt, Homo sapiens
caaucuauguuugcacuu

SEQ ID NO: 1239065 - RNA, 15 nt, Homo sapiens
caaucucucucugug

SEQ ID NO: 1239066 - RNA, 16 nt, Homo sapiens
caaucucucucugugu

SEQ ID NO: 1239067 - RNA, 19 nt, Homo sapiens
caaucuggcuuagugccac

SEQ ID NO: 1239068 - RNA, 12 nt, Homo sapiens
caaucuguaauu

SEQ ID NO: 1239069 - RNA, 14 nt, Homo sapiens
caaucuugaacuca

SEQ ID NO: 1239070 - RNA, 13 nt, Homo sapiens
caaucuuugccuu

SEQ ID NO: 1239071 - RNA, 21 nt, Homo sapiens
caaugaaaaauguaauuuaga

SEQ ID NO: 1239072 - RNA, 13 nt, Homo sapiens
caaugacaucuca

SEQ ID NO: 1239073 - RNA, 14 nt, Homo sapiens
caaugacaucucag

SEQ ID NO: 1239074 - RNA, 22 nt, Homo sapiens
caaugacugugcuacugucuuu

SEQ ID NO: 1239075 - RNA, 23 nt, Homo sapiens
caaugcaucacguaccccacugg

SEQ ID NO: 1239076 - RNA, 14 nt, Homo sapiens
caaugcauugcuaa

SEQ ID NO: 1239077 - RNA, 23 nt, Homo sapiens
caaugccccuggaucuaccagca

SEQ ID NO: 1239078 - RNA, 20 nt, Homo sapiens
caaugcccugugcaugccau

SEQ ID NO: 1239079 - RNA, 12 nt, Homo sapiens
caaugcugaggu

SEQ ID NO: 1239080 - RNA, 19 nt, Homo sapiens
caauggccuuuaucaucua

SEQ ID NO: 1239081 - RNA, 18 nt, Homo sapiens
caaugggaccugcucuua

SEQ ID NO: 1239082 - RNA, 16 nt, Homo sapiens
caaugggcacugggau

SEQ ID NO: 1239083 - RNA, 15 nt, Homo sapiens
caauggucucagccu

SEQ ID NO: 1239084 - RNA, 22 nt, Homo sapiens
caauguacaguugaaauaacug

SEQ ID NO: 1239085 - RNA, 12 nt, Homo sapiens
caaugucauguc

SEQ ID NO: 1239086 - RNA, 15 nt, Homo sapiens
caauguccuaaaaag

SEQ ID NO: 1239087 - RNA, 16 nt, Homo sapiens
caaugugacaccuaac

SEQ ID NO: 1239088 - RNA, 15 nt, Homo sapiens
caaugugacauuuac

SEQ ID NO: 1239089 - RNA, 14 nt, Homo sapiens
caaugugaguccca

SEQ ID NO: 1239090 - RNA, 12 nt, Homo sapiens
caaugugcugcu

SEQ ID NO: 1239091 - RNA, 16 nt, Homo sapiens
caaugugcugcugcuu

SEQ ID NO: 1239092 - RNA, 11 nt, Homo sapiens
caauguuccau

SEQ ID NO: 1239093 - RNA, 21 nt, Homo sapiens
caauguucuuugucucaaaau

SEQ ID NO: 1239094 - RNA, 20 nt, Homo sapiens
caauguugcaacacauucau

SEQ ID NO: 1239095 - RNA, 22 nt, Homo sapiens
caauguuuguaauaauugcuca

SEQ ID NO: 1239096 - RNA, 19 nt, Homo sapiens
caauguuuguccuguauaa

SEQ ID NO: 1239097 - RNA, 17 nt, Homo sapiens
caauguuuuccacccau

SEQ ID NO: 1239098 - RNA, 19 nt, Homo sapiens
caauuaaaccgcaugugau

SEQ ID NO: 1239099 - RNA, 23 nt, Homo sapiens
caauuaacaucgugggucacuac

SEQ ID NO: 1239100 - RNA, 22 nt, Homo sapiens
caccagagggauaaaaacaaua

SEQ ID NO: 1239101 - RNA, 14 nt, Homo sapiens
caccagccaugugc

SEQ ID NO: 1239102 - RNA, 18 nt, Homo sapiens
caccagcccugaccccag

SEQ ID NO: 1239103 - RNA, 23 nt, Homo sapiens
caccaggaauccccaacaugcac

SEQ ID NO: 1239104 - RNA, 22 nt, Homo sapiens
caccaggacuuggggucaggaa

SEQ ID NO: 1239105 - RNA, 20 nt, Homo sapiens
caccaggggaggagccugug

SEQ ID NO: 1239106 - RNA, 20 nt, Homo sapiens
caccaggggugcucaccucu

SEQ ID NO: 1239107 - RNA, 22 nt, Homo sapiens
caccaguguccccuccacuguc

SEQ ID NO: 1239108 - RNA, 11 nt, Homo sapiens
caccaguucuc

SEQ ID NO: 1239109 - RNA, 16 nt, Homo sapiens
caccauaaccucuggg

SEQ ID NO: 1239110 - RNA, 20 nt, Homo sapiens
caccauacacacuguuguca

SEQ ID NO: 1239111 - RNA, 18 nt, Homo sapiens
caccauccugcagccucc

SEQ ID NO: 1239112 - RNA, 13 nt, Homo sapiens
caccaucuggaag

SEQ ID NO: 1239113 - RNA, 23 nt, Homo sapiens
caccaugaagcgaaacacagaga

SEQ ID NO: 1239114 - RNA, 15 nt, Homo sapiens
caccauguuggccag

SEQ ID NO: 1239115 - RNA, 14 nt, Homo sapiens
cacccacaaucaca

SEQ ID NO: 1239116 - RNA, 14 nt, Homo sapiens
cacccacccaggag

SEQ ID NO: 1239117 - RNA, 23 nt, Homo sapiens
cacccaccccacagacuccggcc

SEQ ID NO: 1239118 - RNA, 16 nt, Homo sapiens
cacccaccucaccaaa

SEQ ID NO: 1239119 - RNA, 22 nt, Homo sapiens
cacccagacuggaaugcaguga

SEQ ID NO: 1239120 - RNA, 16 nt, Homo sapiens
cacccagugcugccau

SEQ ID NO: 1239121 - RNA, 16 nt, Homo sapiens
cacccauaauccuuuc

SEQ ID NO: 1239122 - RNA, 20 nt, Homo sapiens
cacccaucguucucugcuaa

SEQ ID NO: 1239123 - RNA, 14 nt, Homo sapiens
cacccaucugcuca

SEQ ID NO: 1239124 - RNA, 19 nt, Homo sapiens
cacccccaccauccaggug

SEQ ID NO: 1239125 - RNA, 15 nt, Homo sapiens
cacccuacacaaaau

SEQ ID NO: 1239126 - RNA, 17 nt, Homo sapiens
cacccuccaugcuccuc

SEQ ID NO: 1239127 - RNA, 20 nt, Homo sapiens
cacccuccaugcuccucacc

SEQ ID NO: 1239128 - RNA, 22 nt, Homo sapiens
cacccucccccgccacuccuga

SEQ ID NO: 1239129 - RNA, 17 nt, Homo sapiens
cacccuccuugcaggau

SEQ ID NO: 1239130 - RNA, 16 nt, Homo sapiens
cacccugauccucacc

SEQ ID NO: 1239131 - RNA, 16 nt, Homo sapiens
cacccuggacaaagaa

SEQ ID NO: 1239132 - RNA, 16 nt, Homo sapiens
cacccuggaggauuuc

SEQ ID NO: 1239133 - RNA, 21 nt, Homo sapiens
cacccuggaggauuucaucuc

SEQ ID NO: 1239134 - RNA, 15 nt, Homo sapiens
cacccugggagacag

SEQ ID NO: 1239135 - RNA, 21 nt, Homo sapiens
cacccugugccaucaccauaa

SEQ ID NO: 1239136 - RNA, 21 nt, Homo sapiens
cacccuuccccuccuucuccc

SEQ ID NO: 1239137 - RNA, 22 nt, Homo sapiens
cacccuugagaaggugcuuugu

SEQ ID NO: 1239138 - RNA, 15 nt, Homo sapiens
caccgacaacaugcu

SEQ ID NO: 1239139 - RNA, 18 nt, Homo sapiens
caccgagacaccaccuau

SEQ ID NO: 1239140 - RNA, 21 nt, Homo sapiens
caccgcuccaaugccuacuga

SEQ ID NO: 1239141 - RNA, 18 nt, Homo sapiens
caccgcugccagcacaga

SEQ ID NO: 1239142 - RNA, 22 nt, Homo sapiens
caccguacaucugcaauaugaa

SEQ ID NO: 1239143 - RNA, 17 nt, Homo sapiens
caccgugcagagcugca

SEQ ID NO: 1239144 - RNA, 14 nt, Homo sapiens
caccuaauaucaau

SEQ ID NO: 1239145 - RNA, 16 nt, Homo sapiens
caccuacauuaucuca

SEQ ID NO: 1239146 - RNA, 22 nt, Homo sapiens
caccuaccaucagggacaggau

SEQ ID NO: 1239147 - RNA, 16 nt, Homo sapiens
caccuacuaugugcug

SEQ ID NO: 1239148 - RNA, 15 nt, Homo sapiens
caccuagacuguaaa

SEQ ID NO: 1239149 - RNA, 17 nt, Homo sapiens
caccuaugugguccaga

SEQ ID NO: 1239150 - RNA, 12 nt, Homo sapiens
caccuauuucca

SEQ ID NO: 1239151 - RNA, 23 nt, Homo sapiens
caccucacacuccuccaaggcac

SEQ ID NO: 1239152 - RNA, 20 nt, Homo sapiens
caccucacaggccccaggaa

SEQ ID NO: 1239153 - RNA, 14 nt, Homo sapiens
caccucaccaaaac

SEQ ID NO: 1239154 - RNA, 18 nt, Homo sapiens
caccuccaccacaucugc

SEQ ID NO: 1239155 - RNA, 19 nt, Homo sapiens
caccuccaccacaucugcc

SEQ ID NO: 1239156 - RNA, 22 nt, Homo sapiens
caccuccauuucucuccaggaa

SEQ ID NO: 1239157 - RNA, 16 nt, Homo sapiens
cauggguccacugcac

SEQ ID NO: 1239158 - RNA, 23 nt, Homo sapiens
cauggguuauguguaugugccau

SEQ ID NO: 1239159 - RNA, 17 nt, Homo sapiens
caugguaauucacuuca

SEQ ID NO: 1239160 - RNA, 23 nt, Homo sapiens
caugguagucacuaacauauaua

SEQ ID NO: 1239161 - RNA, 19 nt, Homo sapiens
caugguuacaaacuacaga

SEQ ID NO: 1239162 - RNA, 15 nt, Homo sapiens
cauguaaaacaguua

SEQ ID NO: 1239163 - RNA, 13 nt, Homo sapiens
cauguaauccuuu

SEQ ID NO: 1239164 - RNA, 21 nt, Homo sapiens
cauguaauguuaauguuauau

SEQ ID NO: 1239165 - RNA, 19 nt, Homo sapiens
cauguaauuaaguacuaug

SEQ ID NO: 1239166 - RNA, 17 nt, Homo sapiens
cauguacagacauacau

SEQ ID NO: 1239167 - RNA, 20 nt, Homo sapiens
cauguacagacauacauuua

SEQ ID NO: 1239168 - RNA, 17 nt, Homo sapiens
cauguacauacccuggc

SEQ ID NO: 1239169 - RNA, 12 nt, Homo sapiens
cauguacaugaa

SEQ ID NO: 1239170 - RNA, 20 nt, Homo sapiens
cauguaucucaguaccccau

SEQ ID NO: 1239171 - RNA, 22 nt, Homo sapiens
cauguauggaaucccacuguau

SEQ ID NO: 1239172 - RNA, 13 nt, Homo sapiens
cauguaugucuug

SEQ ID NO: 1239173 - RNA, 17 nt, Homo sapiens
cauguaugucuuggaca

SEQ ID NO: 1239174 - RNA, 14 nt, Homo sapiens
cauguauugcacau

SEQ ID NO: 1239175 - RNA, 15 nt, Homo sapiens
cauguauugcacauu

SEQ ID NO: 1239176 - RNA, 12 nt, Homo sapiens
caugucagcaau

SEQ ID NO: 1239177 - RNA, 14 nt, Homo sapiens
caugucgcacaaug

SEQ ID NO: 1239178 - RNA, 20 nt, Homo sapiens
caugucucugguggugcugg

SEQ ID NO: 1239179 - RNA, 14 nt, Homo sapiens
caugugaagagaau

SEQ ID NO: 1239180 - RNA, 15 nt, Homo sapiens
caugugacacauaug

SEQ ID NO: 1239181 - RNA, 20 nt, Homo sapiens
caugugacacauaugcaccu

SEQ ID NO: 1239182 - RNA, 22 nt, Homo sapiens
caugugacacauaugcaccuug

SEQ ID NO: 1239183 - RNA, 17 nt, Homo sapiens
caugugcaaaugugcug

SEQ ID NO: 1239184 - RNA, 22 nt, Homo sapiens
caugugcaaaugugcuggucac

SEQ ID NO: 1239185 - RNA, 14 nt, Homo sapiens
caugugcaccugcc

SEQ ID NO: 1239186 - RNA, 18 nt, Homo sapiens
caugugcgcgcgugcaug

SEQ ID NO: 1239187 - RNA, 15 nt, Homo sapiens
caugugcugugacca

SEQ ID NO: 1239188 - RNA, 16 nt, Homo sapiens
cauguggcuuuuuuaa

SEQ ID NO: 1239189 - RNA, 17 nt, Homo sapiens
cauguguacauucugcc

SEQ ID NO: 1239190 - RNA, 16 nt, Homo sapiens
cauguguaccuacaga

SEQ ID NO: 1239191 - RNA, 23 nt, Homo sapiens
cauguguccccucacucugucag

SEQ ID NO: 1239192 - RNA, 21 nt, Homo sapiens
cauguuaccaucuuacuugag

SEQ ID NO: 1239193 - RNA, 16 nt, Homo sapiens
cauguuacucaugacu

SEQ ID NO: 1239194 - RNA, 17 nt, Homo sapiens
cauguuacugaccagca

SEQ ID NO: 1239195 - RNA, 12 nt, Homo sapiens
cauguuuccauc

SEQ ID NO: 1239196 - RNA, 17 nt, Homo sapiens
cauguuugcagggguga

SEQ ID NO: 1239197 - RNA, 21 nt, Homo sapiens
cauguuuuccgugaaaacgga

SEQ ID NO: 1239198 - RNA, 19 nt, Homo sapiens
cauguuuugauuuguagca

SEQ ID NO: 1239199 - RNA, 23 nt, Homo sapiens
cauguuuugccacccccugugag

SEQ ID NO: 1239200 - RNA, 16 nt, Homo sapiens
cauguuuuguauacaa

SEQ ID NO: 1239201 - RNA, 19 nt, Homo sapiens
cauuaaaauaaaccaaaua

SEQ ID NO: 1239202 - RNA, 23 nt, Homo sapiens
cauuaaaauaaaccaaauauguu

SEQ ID NO: 1239203 - RNA, 15 nt, Homo sapiens
cauuaaacaugacau

SEQ ID NO: 1239204 - RNA, 21 nt, Homo sapiens
cauuaaaccugucuccacugu

SEQ ID NO: 1239205 - RNA, 20 nt, Homo sapiens
cauuaaauguuugacacaau

SEQ ID NO: 1239206 - RNA, 22 nt, Homo sapiens
cauuaacaaaaauauuagcaaa

SEQ ID NO: 1239207 - RNA, 13 nt, Homo sapiens
cauuaacacaaag

SEQ ID NO: 1239208 - RNA, 21 nt, Homo sapiens
cauuaacaguuuuccaugaaa

SEQ ID NO: 1239209 - RNA, 18 nt, Homo sapiens
cauuaaccugaggucucu

SEQ ID NO: 1239210 - RNA, 13 nt, Homo sapiens
cauuaacuugaaa

SEQ ID NO: 1239211 - RNA, 14 nt, Homo sapiens
cauuaauacaaaga

SEQ ID NO: 1239212 - RNA, 17 nt, Homo sapiens
cauuaauauauccuaaa

SEQ ID NO: 1239213 - RNA, 19 nt, Homo sapiens
cauuaauauugcagucaau

SEQ ID NO: 1239214 - RNA, 15 nt, Homo sapiens
cauuaauguuaauuc

SEQ ID NO: 1239215 - RNA, 17 nt, Homo sapiens
cauuaccauggagacaa

SEQ ID NO: 1239216 - RNA, 17 nt, Homo sapiens
cauuacuuuuucauaua

SEQ ID NO: 1239217 - RNA, 13 nt, Homo sapiens
cauuagagucagc

SEQ ID NO: 1239218 - RNA, 23 nt, Homo sapiens
cauuagcauaauuuuguguugua

SEQ ID NO: 1239219 - RNA, 18 nt, Homo sapiens
cauuagugaaaauucugu

SEQ ID NO: 1239220 - RNA, 17 nt, Homo sapiens
cauuauaaaccuucaga

SEQ ID NO: 1239221 - RNA, 17 nt, Homo sapiens
cauuauaaacgugauga

SEQ ID NO: 1239222 - RNA, 15 nt, Homo sapiens
cauuauauugcaaug

SEQ ID NO: 1239223 - RNA, 15 nt, Homo sapiens
cauuaucacagugaa

SEQ ID NO: 1239224 - RNA, 18 nt, Homo sapiens
cauuaucgagcagcauuu

SEQ ID NO: 1239225 - RNA, 23 nt, Homo sapiens
cauuaucuuugucuguucacuuu

SEQ ID NO: 1239226 - RNA, 13 nt, Homo sapiens
cauuauuagcacu

SEQ ID NO: 1239227 - RNA, 14 nt, Homo sapiens
cauuauuauuugcu

SEQ ID NO: 1239228 - RNA, 16 nt, Homo sapiens
cauuauuccuccagga

SEQ ID NO: 1239229 - RNA, 17 nt, Homo sapiens
cauuauuuucugucaga

SEQ ID NO: 1239230 - RNA, 17 nt, Homo sapiens
cauuauuuugaauguga

SEQ ID NO: 1239231 - RNA, 19 nt, Homo sapiens
cauuauuuuuccacuuugu

SEQ ID NO: 1239232 - RNA, 18 nt, Homo sapiens
cauucaacagagacugaa

SEQ ID NO: 1239233 - RNA, 14 nt, Homo sapiens
cauucacuagcuuu

SEQ ID NO: 1239234 - RNA, 17 nt, Homo sapiens
cauucagagagcagcuu

SEQ ID NO: 1239235 - RNA, 21 nt, Homo sapiens
cauucagggcuauuuuuuccc

SEQ ID NO: 1239236 - RNA, 17 nt, Homo sapiens
cauuccaacuucaauuu

SEQ ID NO: 1239237 - RNA, 13 nt, Homo sapiens
cauuccaggaaac

SEQ ID NO: 1239238 - RNA, 17 nt, Homo sapiens
cauucccucucaucuca

SEQ ID NO: 1239239 - RNA, 16 nt, Homo sapiens
cauucccucuccugcc

SEQ ID NO: 1239240 - RNA, 20 nt, Homo sapiens
cauuccugaaagaaacaguu

SEQ ID NO: 1239241 - RNA, 21 nt, Homo sapiens
cauuccugaaagaaacaguua

SEQ ID NO: 1239242 - RNA, 13 nt, Homo sapiens
cauuccugcucaa

SEQ ID NO: 1239243 - RNA, 17 nt, Homo sapiens
cauuccuguagucaaaa

SEQ ID NO: 1239244 - RNA, 23 nt, Homo sapiens
cauuccuguagucaaaaucuggu

SEQ ID NO: 1239245 - RNA, 19 nt, Homo sapiens
cauuccuucacucauccag

SEQ ID NO: 1239246 - RNA, 21 nt, Homo sapiens
cauucggggaagcugcacaug

SEQ ID NO: 1239247 - RNA, 17 nt, Homo sapiens
cauucuaguacuuggga

SEQ ID NO: 1239248 - RNA, 17 nt, Homo sapiens
cauucuauuuuggguau

SEQ ID NO: 1239249 - RNA, 14 nt, Homo sapiens
cauucugaccauuu

SEQ ID NO: 1239250 - RNA, 18 nt, Homo sapiens
cauucugcaagcacaucu

SEQ ID NO: 1239251 - RNA, 16 nt, Homo sapiens
cauucugcaaguauac

SEQ ID NO: 1239252 - RNA, 14 nt, Homo sapiens
cauucuuauugaca

SEQ ID NO: 1239253 - RNA, 20 nt, Homo sapiens
cauucuucacucuguuugaa

SEQ ID NO: 1239254 - RNA, 21 nt, Homo sapiens
cauucuucccuaaucuuccac

SEQ ID NO: 1239255 - RNA, 13 nt, Homo sapiens
cauucuuggccca

SEQ ID NO: 1239256 - RNA, 18 nt, Homo sapiens
cauucuuuaucuugacau

SEQ ID NO: 1239257 - RNA, 21 nt, Homo sapiens
cauucuuuuccacuuguuaaa

SEQ ID NO: 1239258 - RNA, 22 nt, Homo sapiens
cauugaaaugcacagaucugcu

SEQ ID NO: 1239259 - RNA, 14 nt, Homo sapiens
cauugaacuuuaag

SEQ ID NO: 1239260 - RNA, 17 nt, Homo sapiens
cauugacccauagcaca

SEQ ID NO: 1239261 - RNA, 11 nt, Homo sapiens
cauugaccucu

SEQ ID NO: 1239262 - RNA, 22 nt, Homo sapiens
cauugacuuaggggaguucagu

SEQ ID NO: 1239263 - RNA, 19 nt, Homo sapiens
cauugagaucacuacucag

SEQ ID NO: 1239264 - RNA, 13 nt, Homo sapiens
cauugaugacccu

SEQ ID NO: 1239265 - RNA, 23 nt, Homo sapiens
cauugaugagcaagacauacuua

SEQ ID NO: 1239266 - RNA, 18 nt, Homo sapiens
cauugcacauaagcuucc

SEQ ID NO: 1239267 - RNA, 14 nt, Homo sapiens
cauugcagcagaua

SEQ ID NO: 1239268 - RNA, 21 nt, Homo sapiens
cauugccauagcugacuacaa

SEQ ID NO: 1239269 - RNA, 20 nt, Homo sapiens
cauugcgucggaaagccaag

SEQ ID NO: 1239270 - RNA, 14 nt, Homo sapiens
cauugcugcugcua

SEQ ID NO: 1239271 - RNA, 20 nt, Homo sapiens
cauugcuguaccacaucugc

SEQ ID NO: 1239272 - RNA, 23 nt, Homo sapiens
cauugcuuuugggagacuggaaa

SEQ ID NO: 1239273 - RNA, 20 nt, Homo sapiens
caacauuacuguuaacugug

SEQ ID NO: 1239274 - RNA, 17 nt, Homo sapiens
caacauuguaagaacaa

SEQ ID NO: 1239275 - RNA, 11 nt, Homo sapiens
caacauugugu

SEQ ID NO: 1239276 - RNA, 13 nt, Homo sapiens
caacccaaacugu

SEQ ID NO: 1239277 - RNA, 17 nt, Homo sapiens
caacccaauaaaacuga

SEQ ID NO: 1239278 - RNA, 19 nt, Homo sapiens
caacccacaccgucuuccu

SEQ ID NO: 1239279 - RNA, 12 nt, Homo sapiens
caacccacuuaa

SEQ ID NO: 1239280 - RNA, 17 nt, Homo sapiens
caaccccccaccugcca

SEQ ID NO: 1239281 - RNA, 20 nt, Homo sapiens
caaccccccuccugcuccuc

SEQ ID NO: 1239282 - RNA, 21 nt, Homo sapiens
caacccgacauguguaccuca

SEQ ID NO: 1239283 - RNA, 22 nt, Homo sapiens
caacccgucuggcccaccaggg

SEQ ID NO: 1239284 - RNA, 16 nt, Homo sapiens
caaccucauccaggcu

SEQ ID NO: 1239285 - RNA, 17 nt, Homo sapiens
caaccucauugcagcua

SEQ ID NO: 1239286 - RNA, 16 nt, Homo sapiens
caaccuccaacaacga

SEQ ID NO: 1239287 - RNA, 16 nt, Homo sapiens
caaccuccuguggaac

SEQ ID NO: 1239288 - RNA, 14 nt, Homo sapiens
caaccugaagacac

SEQ ID NO: 1239289 - RNA, 17 nt, Homo sapiens
caaccugacucaggcca

SEQ ID NO: 1239290 - RNA, 18 nt, Homo sapiens
caaccuggguccaaauaa

SEQ ID NO: 1239291 - RNA, 16 nt, Homo sapiens
caaccuuccauucaca

SEQ ID NO: 1239292 - RNA, 15 nt, Homo sapiens
caaccuuguuucuac

SEQ ID NO: 1239293 - RNA, 13 nt, Homo sapiens
caacgaugaauuu

SEQ ID NO: 1239294 - RNA, 14 nt, Homo sapiens
caacgaugaugcuu

SEQ ID NO: 1239295 - RNA, 21 nt, Homo sapiens
caacgcacaggaaaagguagc

SEQ ID NO: 1239296 - RNA, 13 nt, Homo sapiens
caacgugugaacu

SEQ ID NO: 1239297 - RNA, 22 nt, Homo sapiens
caacguucgauuucuaccucag

SEQ ID NO: 1239298 - RNA, 11 nt, Homo sapiens
caacuaccuga

SEQ ID NO: 1239299 - RNA, 12 nt, Homo sapiens
caacuaccugag

SEQ ID NO: 1239300 - RNA, 13 nt, Homo sapiens
caacuacuaauag

SEQ ID NO: 1239301 - RNA, 18 nt, Homo sapiens
caacuagacauucugucg

SEQ ID NO: 1239302 - RNA, 19 nt, Homo sapiens
caacuagauaucaugaugu

SEQ ID NO: 1239303 - RNA, 12 nt, Homo sapiens
caacuagccauc

SEQ ID NO: 1239304 - RNA, 21 nt, Homo sapiens
caacuaguagcuaaccaucac

SEQ ID NO: 1239305 - RNA, 20 nt, Homo sapiens
caacuauuuuuccaaaauaa

SEQ ID NO: 1239306 - RNA, 20 nt, Homo sapiens
caacucuaccccugcuccca

SEQ ID NO: 1239307 - RNA, 13 nt, Homo sapiens
caacucuauuuaa

SEQ ID NO: 1239308 - RNA, 21 nt, Homo sapiens
caacucuucgaagccuugccu

SEQ ID NO: 1239309 - RNA, 14 nt, Homo sapiens
caacugaaauuaca

SEQ ID NO: 1239310 - RNA, 12 nt, Homo sapiens
caacugacacag

SEQ ID NO: 1239311 - RNA, 20 nt, Homo sapiens
caacugaguguuauuugcac

SEQ ID NO: 1239312 - RNA, 21 nt, Homo sapiens
caacugaguguuauuugcaca

SEQ ID NO: 1239313 - RNA, 17 nt, Homo sapiens
caacugcaaaaaaagcc

SEQ ID NO: 1239314 - RNA, 13 nt, Homo sapiens
caacugccaagaa

SEQ ID NO: 1239315 - RNA, 17 nt, Homo sapiens
caacugcugcugugcac

SEQ ID NO: 1239316 - RNA, 18 nt, Homo sapiens
caacugcugcugugcaca

SEQ ID NO: 1239317 - RNA, 22 nt, Homo sapiens
caacugcuguucauguuacuca

SEQ ID NO: 1239318 - RNA, 18 nt, Homo sapiens
caacugucuaacuuuaga

SEQ ID NO: 1239319 - RNA, 13 nt, Homo sapiens
caacugugacugu

SEQ ID NO: 1239320 - RNA, 20 nt, Homo sapiens
caacuguuucccugcugaau

SEQ ID NO: 1239321 - RNA, 16 nt, Homo sapiens
caacuuaagcugggau

SEQ ID NO: 1239322 - RNA, 14 nt, Homo sapiens
caacuucaaguaua

SEQ ID NO: 1239323 - RNA, 21 nt, Homo sapiens
caacuucuuucuguugagaga

SEQ ID NO: 1239324 - RNA, 19 nt, Homo sapiens
caacuuggcauuucuauac

SEQ ID NO: 1239325 - RNA, 18 nt, Homo sapiens
caacuuggguucuucuca

SEQ ID NO: 1239326 - RNA, 13 nt, Homo sapiens
caacuuuacugua

SEQ ID NO: 1239327 - RNA, 12 nt, Homo sapiens
caacuuugacaa

SEQ ID NO: 1239328 - RNA, 23 nt, Homo sapiens
caagaaaacaacuucaauaucca

SEQ ID NO: 1239329 - RNA, 18 nt, Homo sapiens
caagaaacugaugaauga

SEQ ID NO: 1239330 - RNA, 22 nt, Homo sapiens
caagaaagcucacuguagcuuu

SEQ ID NO: 1239331 - RNA, 17 nt, Homo sapiens
caagaaaguauuuggua

SEQ ID NO: 1239332 - RNA, 16 nt, Homo sapiens
caagaaaucagccaua

SEQ ID NO: 1239333 - RNA, 12 nt, Homo sapiens
caagaaauuacu

SEQ ID NO: 1239334 - RNA, 19 nt, Homo sapiens
caagaagcguuaugugcag

SEQ ID NO: 1239335 - RNA, 20 nt, Homo sapiens
caagaagcguuaugugcagu

SEQ ID NO: 1239336 - RNA, 17 nt, Homo sapiens
caagaaggaaagauuug

SEQ ID NO: 1239337 - RNA, 17 nt, Homo sapiens
caagaaggaacaauaaa

SEQ ID NO: 1239338 - RNA, 21 nt, Homo sapiens
caagaagugaagaaugcacaa

SEQ ID NO: 1239339 - RNA, 19 nt, Homo sapiens
caagaagugguccaucucc

SEQ ID NO: 1239340 - RNA, 18 nt, Homo sapiens
caagaaguuuauucucau

SEQ ID NO: 1239341 - RNA, 22 nt, Homo sapiens
caagaaucagucuauccacaga

SEQ ID NO: 1239342 - RNA, 13 nt, Homo sapiens
caagaaugugcag

SEQ ID NO: 1239343 - RNA, 20 nt, Homo sapiens
caagaauuaaguauuuuccu

SEQ ID NO: 1239344 - RNA, 13 nt, Homo sapiens
caagacaaaaagc

SEQ ID NO: 1239345 - RNA, 18 nt, Homo sapiens
caagacacugaggagaua

SEQ ID NO: 1239346 - RNA, 11 nt, Homo sapiens
caagacauuuc

SEQ ID NO: 1239347 - RNA, 19 nt, Homo sapiens
caagacucugucucaaaaa

SEQ ID NO: 1239348 - RNA, 19 nt, Homo sapiens
caagacuuccucaugaauc

SEQ ID NO: 1239349 - RNA, 21 nt, Homo sapiens
caagagaacucgcgcucagua

SEQ ID NO: 1239350 - RNA, 22 nt, Homo sapiens
caagagagggccaugcaauuca

SEQ ID NO: 1239351 - RNA, 22 nt, Homo sapiens
caagaggacugagacuggcacu

SEQ ID NO: 1239352 - RNA, 14 nt, Homo sapiens
caagaggccucaug

SEQ ID NO: 1239353 - RNA, 17 nt, Homo sapiens
caagauauugaugauaa

SEQ ID NO: 1239354 - RNA, 17 nt, Homo sapiens
caagauccuuaaugcag

SEQ ID NO: 1239355 - RNA, 19 nt, Homo sapiens
caagaucgcaccauugcac

SEQ ID NO: 1239356 - RNA, 20 nt, Homo sapiens
caagaucgcaccauugcacu

SEQ ID NO: 1239357 - RNA, 16 nt, Homo sapiens
caagaucuuucaggaa

SEQ ID NO: 1239358 - RNA, 21 nt, Homo sapiens
caagauggggcgagccaggac

SEQ ID NO: 1239359 - RNA, 20 nt, Homo sapiens
caagauucuagaugauuaaa

SEQ ID NO: 1239360 - RNA, 23 nt, Homo sapiens
caagcaaaccaauggugauccuc

SEQ ID NO: 1239361 - RNA, 15 nt, Homo sapiens
caagcacauguaaua

SEQ ID NO: 1239362 - RNA, 12 nt, Homo sapiens
caagcaccucca

SEQ ID NO: 1239363 - RNA, 19 nt, Homo sapiens
caagcaccugcaugugcug

SEQ ID NO: 1239364 - RNA, 14 nt, Homo sapiens
caagcacugugguc

SEQ ID NO: 1239365 - RNA, 15 nt, Homo sapiens
caagcagagugcaca

SEQ ID NO: 1239366 - RNA, 15 nt, Homo sapiens
caagcaggagacgac

SEQ ID NO: 1239367 - RNA, 18 nt, Homo sapiens
caagcaggcgcugugcua

SEQ ID NO: 1239368 - RNA, 16 nt, Homo sapiens
caagcaugaagugcug

SEQ ID NO: 1239369 - RNA, 15 nt, Homo sapiens
caagcauuccugcuc

SEQ ID NO: 1239370 - RNA, 23 nt, Homo sapiens
caagcauuuugugaacuagggaa

SEQ ID NO: 1239371 - RNA, 18 nt, Homo sapiens
caagccuacaugacacag

SEQ ID NO: 1239372 - RNA, 16 nt, Homo sapiens
caagccugccuaggaa

SEQ ID NO: 1239373 - RNA, 20 nt, Homo sapiens
caagccuguccuuccugacc

SEQ ID NO: 1239374 - RNA, 16 nt, Homo sapiens
caagccugucuucaga

SEQ ID NO: 1239375 - RNA, 20 nt, Homo sapiens
caagcgacgacagaugcuaa

SEQ ID NO: 1239376 - RNA, 18 nt, Homo sapiens
caagcgccagaaagagcu

SEQ ID NO: 1239377 - RNA, 14 nt, Homo sapiens
caagcuccaucucu

SEQ ID NO: 1239378 - RNA, 19 nt, Homo sapiens
caagcuccuggucuugaga

SEQ ID NO: 1239379 - RNA, 21 nt, Homo sapiens
caagcuggucccacucagucc

SEQ ID NO: 1239380 - RNA, 21 nt, Homo sapiens
caagcugguggccucugcagg

SEQ ID NO: 1239381 - RNA, 15 nt, Homo sapiens
caagcugucccugca

SEQ ID NO: 1239382 - RNA, 20 nt, Homo sapiens
caaggaaaaacaggucuuca

SEQ ID NO: 1239383 - RNA, 17 nt, Homo sapiens
caaggaaagaccaguuu

SEQ ID NO: 1239384 - RNA, 23 nt, Homo sapiens
caaggaagagccaauguuuucca

SEQ ID NO: 1239385 - RNA, 19 nt, Homo sapiens
caaggacaaaaaaccucag

SEQ ID NO: 1239386 - RNA, 13 nt, Homo sapiens
caaggacucuucc

SEQ ID NO: 1239387 - RNA, 15 nt, Homo sapiens
caaggacucuuccac

SEQ ID NO: 1239388 - RNA, 18 nt, Homo sapiens
caaggagaaaaaaggcag

SEQ ID NO: 1239389 - RNA, 14 nt, Homo sapiens
caaggagacugccu

SEQ ID NO: 1239390 - RNA, 23 nt, Homo sapiens
caaggaggaguuccaccaugagc

SEQ ID NO: 1239391 - RNA, 18 nt, Homo sapiens
caaggaguacuccaagac

SEQ ID NO: 1239392 - RNA, 16 nt, Homo sapiens
caaggauauacugcag

SEQ ID NO: 1239393 - RNA, 18 nt, Homo sapiens
caaggaugcugucaagca

SEQ ID NO: 1239394 - RNA, 19 nt, Homo sapiens
caaggaugucugagaccac

SEQ ID NO: 1239395 - RNA, 23 nt, Homo sapiens
caaggauucagcauuauuccucc

SEQ ID NO: 1239396 - RNA, 20 nt, Homo sapiens
caaggcaguugcuuguguuu

SEQ ID NO: 1239397 - RNA, 19 nt, Homo sapiens
caaggcccauaucugugaa

SEQ ID NO: 1239398 - RNA, 22 nt, Homo sapiens
caaggcccauaucugugaaaug

SEQ ID NO: 1239399 - RNA, 22 nt, Homo sapiens
cguuguuuugguuguacuuugg

SEQ ID NO: 1239400 - RNA, 16 nt, Homo sapiens
cguuucugguggucug

SEQ ID NO: 1239401 - RNA, 11 nt, Homo sapiens
cguuucuugcc

SEQ ID NO: 1239402 - RNA, 19 nt, Homo sapiens
cguuuuuuuaaauuagcaa

SEQ ID NO: 1239403 - RNA, 15 nt, Homo sapiens
cuaaaaagauuagca

SEQ ID NO: 1239404 - RNA, 17 nt, Homo sapiens
cuaaaaaggucuguuaa

SEQ ID NO: 1239405 - RNA, 17 nt, Homo sapiens
cuaaaaaguuccaugaa

SEQ ID NO: 1239406 - RNA, 19 nt, Homo sapiens
cuaaaaauaaaccaaagga

SEQ ID NO: 1239407 - RNA, 19 nt, Homo sapiens
cuaaaaaucaaauaagcua

SEQ ID NO: 1239408 - RNA, 13 nt, Homo sapiens
cuaaaaauccaga

SEQ ID NO: 1239409 - RNA, 19 nt, Homo sapiens
cuaaaaccacaugugcaac

SEQ ID NO: 1239410 - RNA, 17 nt, Homo sapiens
cuaaaacuggccugacu

SEQ ID NO: 1239411 - RNA, 18 nt, Homo sapiens
cuaaaacuuaacauucau

SEQ ID NO: 1239412 - RNA, 18 nt, Homo sapiens
cuaaaagaaaaaggaacu

SEQ ID NO: 1239413 - RNA, 21 nt, Homo sapiens
cuaaaagcguuggauguagca

SEQ ID NO: 1239414 - RNA, 22 nt, Homo sapiens
cuaaaagcguuggauguagcau

SEQ ID NO: 1239415 - RNA, 12 nt, Homo sapiens
cuaaaagcuuuc

SEQ ID NO: 1239416 - RNA, 16 nt, Homo sapiens
cuaaaagguaugcaau

SEQ ID NO: 1239417 - RNA, 18 nt, Homo sapiens
cuaaaauauauuccugag

SEQ ID NO: 1239418 - RNA, 20 nt, Homo sapiens
cuaaaaucccuggaucacga

SEQ ID NO: 1239419 - RNA, 20 nt, Homo sapiens
cuaaaaucuuauaguucuag

SEQ ID NO: 1239420 - RNA, 19 nt, Homo sapiens
cuaaaauguaucuaagaau

SEQ ID NO: 1239421 - RNA, 21 nt, Homo sapiens
cuaaaauugcuucuuuaccaa

SEQ ID NO: 1239422 - RNA, 19 nt, Homo sapiens
cuaaacaagaaucagucua

SEQ ID NO: 1239423 - RNA, 14 nt, Homo sapiens
cuaaacagauauaa

SEQ ID NO: 1239424 - RNA, 20 nt, Homo sapiens
cuaaaccuccuucagaucuc

SEQ ID NO: 1239425 - RNA, 15 nt, Homo sapiens
cuaaaccuuacaugu

SEQ ID NO: 1239426 - RNA, 17 nt, Homo sapiens
cuaaacuacaacgaaca

SEQ ID NO: 1239427 - RNA, 21 nt, Homo sapiens
cuaaacuacaacgaacacaag

SEQ ID NO: 1239428 - RNA, 21 nt, Homo sapiens
cuaaacuaucuguauuuauua

SEQ ID NO: 1239429 - RNA, 20 nt, Homo sapiens
cuaaacuucaccuacauuau

SEQ ID NO: 1239430 - RNA, 21 nt, Homo sapiens
cuaaagaaaaauaucuuggcc

SEQ ID NO: 1239431 - RNA, 11 nt, Homo sapiens
cuaaagcacuu

SEQ ID NO: 1239432 - RNA, 12 nt, Homo sapiens
cuaaagcacuuu

SEQ ID NO: 1239433 - RNA, 20 nt, Homo sapiens
cuaaagcacuuugcacuuaa

SEQ ID NO: 1239434 - RNA, 20 nt, Homo sapiens
cuaaagccaaggguauccaa

SEQ ID NO: 1239435 - RNA, 16 nt, Homo sapiens
cuaaagccagccugac

SEQ ID NO: 1239436 - RNA, 18 nt, Homo sapiens
cuaaaggacucuccagcc

SEQ ID NO: 1239437 - RNA, 11 nt, Homo sapiens
cuaaagggcag

SEQ ID NO: 1239438 - RNA, 19 nt, Homo sapiens
cuaaagguccacaggucua

SEQ ID NO: 1239439 - RNA, 20 nt, Homo sapiens
cuaaagguccacaggucuag

SEQ ID NO: 1239440 - RNA, 16 nt, Homo sapiens
cuaaaggugcacugcu

SEQ ID NO: 1239441 - RNA, 21 nt, Homo sapiens
cuaaaguauagagaaaagugu

SEQ ID NO: 1239442 - RNA, 22 nt, Homo sapiens
cuaaaguuaaauaggauauuaa

SEQ ID NO: 1239443 - RNA, 18 nt, Homo sapiens
cuaaaguuacaaacagac

SEQ ID NO: 1239444 - RNA, 20 nt, Homo sapiens
cuaaauaauguuaucugugu

SEQ ID NO: 1239445 - RNA, 14 nt, Homo sapiens
cuaaauaggagaua

SEQ ID NO: 1239446 - RNA, 15 nt, Homo sapiens
cuaaaucaaucugca

SEQ ID NO: 1239447 - RNA, 15 nt, Homo sapiens
cuaaaucucuaauau

SEQ ID NO: 1239448 - RNA, 15 nt, Homo sapiens
cuaaaucuucagcau

SEQ ID NO: 1239449 - RNA, 14 nt, Homo sapiens
cuaaaugaacuaau

SEQ ID NO: 1239450 - RNA, 20 nt, Homo sapiens
cuaaaugcagacaacaccuu

SEQ ID NO: 1239451 - RNA, 23 nt, Homo sapiens
cuaaauggugcugcagauuugau

SEQ ID NO: 1239452 - RNA, 16 nt, Homo sapiens
cuaaaugucagcuguu

SEQ ID NO: 1239453 - RNA, 17 nt, Homo sapiens
cuaaauuuaaugcugcc

SEQ ID NO: 1239454 - RNA, 15 nt, Homo sapiens
cuaaauuugguucua

SEQ ID NO: 1239455 - RNA, 22 nt, Homo sapiens
cuaacaaguagcacccuggauu

SEQ ID NO: 1239456 - RNA, 11 nt, Homo sapiens
cuaacacaaaa

SEQ ID NO: 1239457 - RNA, 22 nt, Homo sapiens
cuaacagcccuccucugcacuc

SEQ ID NO: 1239458 - RNA, 14 nt, Homo sapiens
cuaacaggaacaaa

SEQ ID NO: 1239459 - RNA, 13 nt, Homo sapiens
cuaacauaaaaua

SEQ ID NO: 1239460 - RNA, 16 nt, Homo sapiens
cuaacaucuaaaaaua

SEQ ID NO: 1239461 - RNA, 17 nt, Homo sapiens
cuaacauuauacuucau

SEQ ID NO: 1239462 - RNA, 23 nt, Homo sapiens
cuaaccacuuagcaugugugauu

SEQ ID NO: 1239463 - RNA, 16 nt, Homo sapiens
cuaaccagccugguca

SEQ ID NO: 1239464 - RNA, 17 nt, Homo sapiens
cuaaccagccuggucaa

SEQ ID NO: 1239465 - RNA, 17 nt, Homo sapiens
cuaaccaguuaccacac

SEQ ID NO: 1239466 - RNA, 11 nt, Homo sapiens
cuaaccaucug

SEQ ID NO: 1239467 - RNA, 14 nt, Homo sapiens
cuaaccccuuccag

SEQ ID NO: 1239468 - RNA, 15 nt, Homo sapiens
cuaacuauauuugcu

SEQ ID NO: 1239469 - RNA, 15 nt, Homo sapiens
cuaacuccugccauu

SEQ ID NO: 1239470 - RNA, 14 nt, Homo sapiens
cuaacucuggugcu

SEQ ID NO: 1239471 - RNA, 12 nt, Homo sapiens
cuaacugaucaa

SEQ ID NO: 1239472 - RNA, 14 nt, Homo sapiens
cuaacuuauccauc

SEQ ID NO: 1239473 - RNA, 19 nt, Homo sapiens
cuaacuuauccaucuuuga

SEQ ID NO: 1239474 - RNA, 19 nt, Homo sapiens
cuaagaaauaugcacaaua

SEQ ID NO: 1239475 - RNA, 21 nt, Homo sapiens
cuaagaagcagauaauggugu

SEQ ID NO: 1239476 - RNA, 20 nt, Homo sapiens
cuaagaagcgagcacugacc

SEQ ID NO: 1239477 - RNA, 18 nt, Homo sapiens
cuaagaauucaaacuggg

SEQ ID NO: 1239478 - RNA, 14 nt, Homo sapiens
cuaagacauauuca

SEQ ID NO: 1239479 - RNA, 23 nt, Homo sapiens
cuaagacauauucagacaucaac

SEQ ID NO: 1239480 - RNA, 20 nt, Homo sapiens
cuaagaucucgguuugccaa

SEQ ID NO: 1239481 - RNA, 21 nt, Homo sapiens
cuaagcacuuuauaaauauca

SEQ ID NO: 1239482 - RNA, 22 nt, Homo sapiens
cuaagcaguaagcuaucuucaa

SEQ ID NO: 1239483 - RNA, 14 nt, Homo sapiens
cuaagcaugugucc

SEQ ID NO: 1239484 - RNA, 15 nt, Homo sapiens
cuaagccaacuuuaa

SEQ ID NO: 1239485 - RNA, 16 nt, Homo sapiens
cuaagcccuuugccau

SEQ ID NO: 1239486 - RNA, 17 nt, Homo sapiens
cuaagccuuuccauaag

SEQ ID NO: 1239487 - RNA, 16 nt, Homo sapiens
cuaagcgcacauucau

SEQ ID NO: 1239488 - RNA, 20 nt, Homo sapiens
cuaagcugccgguucuuaaa

SEQ ID NO: 1239489 - RNA, 15 nt, Homo sapiens
cuaaggaaugcacaa

SEQ ID NO: 1239490 - RNA, 20 nt, Homo sapiens
cuaaggaaugcacaaauuga

SEQ ID NO: 1239491 - RNA, 18 nt, Homo sapiens
cuaaggacaagacacuga

SEQ ID NO: 1239492 - RNA, 14 nt, Homo sapiens
cuaaggacauuucc

SEQ ID NO: 1239493 - RNA, 21 nt, Homo sapiens
cuaaggaugguuuuaucuucc

SEQ ID NO: 1239494 - RNA, 20 nt, Homo sapiens
cuaaggcucuaugagucuag

SEQ ID NO: 1239495 - RNA, 17 nt, Homo sapiens
cuaagggaacaauccau

SEQ ID NO: 1239496 - RNA, 22 nt, Homo sapiens
cuaagggucgaaagcucuagaa

SEQ ID NO: 1239497 - RNA, 18 nt, Homo sapiens
cuaagggugggugcucag

SEQ ID NO: 1239498 - RNA, 14 nt, Homo sapiens
cuaaggugugcucu

SEQ ID NO: 1239499 - RNA, 17 nt, Homo sapiens
cuaagguucagccugaa

SEQ ID NO: 1239500 - RNA, 18 nt, Homo sapiens
cuaaguauauuaauauca

SEQ ID NO: 1239501 - RNA, 23 nt, Homo sapiens
cuaagugauccucccaccucagc

SEQ ID NO: 1239502 - RNA, 19 nt, Homo sapiens
cuaauaaauauacuaugaa

SEQ ID NO: 1239503 - RNA, 15 nt, Homo sapiens
cuaauaaguauauaa

SEQ ID NO: 1239504 - RNA, 16 nt, Homo sapiens
cuaauacaacauguag

SEQ ID NO: 1239505 - RNA, 19 nt, Homo sapiens
cuaauacagcaacaauuua

SEQ ID NO: 1239506 - RNA, 15 nt, Homo sapiens
cuaauaccucugugu

SEQ ID NO: 1239507 - RNA, 12 nt, Homo sapiens
cuaauacuuugu

SEQ ID NO: 1239508 - RNA, 16 nt, Homo sapiens
cuaauagcagaaauaa

SEQ ID NO: 1239509 - RNA, 13 nt, Homo sapiens
cuaauaugauuau

SEQ ID NO: 1239510 - RNA, 14 nt, Homo sapiens
cuaauauggcaaaa

SEQ ID NO: 1239511 - RNA, 17 nt, Homo sapiens
cuaauauguaacaagcc

SEQ ID NO: 1239512 - RNA, 17 nt, Homo sapiens
cuaaucagcauucucac

SEQ ID NO: 1239513 - RNA, 22 nt, Homo sapiens
cuaaucagcauucucacuccua

SEQ ID NO: 1239514 - RNA, 17 nt, Homo sapiens
cuaaugagacugaccau

SEQ ID NO: 1239515 - RNA, 18 nt, Homo sapiens
cuaaugagggugugagaa

SEQ ID NO: 1239516 - RNA, 22 nt, Homo sapiens
cuaaugauuuagugaucaaauu

SEQ ID NO: 1239517 - RNA, 16 nt, Homo sapiens
cuaauggggacacaga

SEQ ID NO: 1239518 - RNA, 20 nt, Homo sapiens
cuaauguacaauaaagcaau

SEQ ID NO: 1239519 - RNA, 13 nt, Homo sapiens
cuaauuaggcaag

SEQ ID NO: 1239520 - RNA, 23 nt, Homo sapiens
cuaauucggauuugccauagccu

SEQ ID NO: 1239521 - RNA, 23 nt, Homo sapiens
cuaauuugaauggaaaacacaug

SEQ ID NO: 1239522 - RNA, 20 nt, Homo sapiens
cuaauuuguaggaaaaagca

SEQ ID NO: 1239523 - RNA, 15 nt, Homo sapiens
cuaauuuucucaaaa

SEQ ID NO: 1239524 - RNA, 15 nt, Homo sapiens
cuaauuuuguugaaa

SEQ ID NO: 1239525 - RNA, 16 nt, Homo sapiens
cuaauuuuuaagaauu

SEQ ID NO: 1239526 - RNA, 21 nt, Homo sapiens
ccaacuugagggcccagagca

SEQ ID NO: 1239527 - RNA, 17 nt, Homo sapiens
ccaagaaaauugccuuu

SEQ ID NO: 1239528 - RNA, 22 nt, Homo sapiens
ccaagagaacucgcgcucagua

SEQ ID NO: 1239529 - RNA, 21 nt, Homo sapiens
ccaagagcauaacuguucuca

SEQ ID NO: 1239530 - RNA, 22 nt, Homo sapiens
ccaagcaccuccaaccaaauaa

SEQ ID NO: 1239531 - RNA, 15 nt, Homo sapiens
ccaagcacuucacag

SEQ ID NO: 1239532 - RNA, 18 nt, Homo sapiens
ccaagcaggaaccccagg

SEQ ID NO: 1239533 - RNA, 18 nt, Homo sapiens
ccaagcccugcauuguaa

SEQ ID NO: 1239534 - RNA, 14 nt, Homo sapiens
ccaagccuccacag

SEQ ID NO: 1239535 - RNA, 22 nt, Homo sapiens
ccaagcucccugccccaaauaa

SEQ ID NO: 1239536 - RNA, 12 nt, Homo sapiens
ccaagcucugcu

SEQ ID NO: 1239537 - RNA, 18 nt, Homo sapiens
ccaagcuuguuaucagcu

SEQ ID NO: 1239538 - RNA, 21 nt, Homo sapiens
ccaagcuuguuaucagcuuuc

SEQ ID NO: 1239539 - RNA, 14 nt, Homo sapiens
ccaaggaagagcca

SEQ ID NO: 1239540 - RNA, 20 nt, Homo sapiens
ccaaggaauuucugcucugg

SEQ ID NO: 1239541 - RNA, 19 nt, Homo sapiens
ccaaggaggggcuguaaaa

SEQ ID NO: 1239542 - RNA, 16 nt, Homo sapiens
ccaaggauauuuacag

SEQ ID NO: 1239543 - RNA, 16 nt, Homo sapiens
ccaaggcucugagcaa

SEQ ID NO: 1239544 - RNA, 17 nt, Homo sapiens
ccaagggaaaggggugc

SEQ ID NO: 1239545 - RNA, 16 nt, Homo sapiens
ccaagggcaccuggag

SEQ ID NO: 1239546 - RNA, 22 nt, Homo sapiens
ccaagggcugaguguccagcac

SEQ ID NO: 1239547 - RNA, 18 nt, Homo sapiens
ccaaggguuucgacuggu

SEQ ID NO: 1239548 - RNA, 20 nt, Homo sapiens
ccaagguuuaaagagucuag

SEQ ID NO: 1239549 - RNA, 18 nt, Homo sapiens
ccaaguccucccucucua

SEQ ID NO: 1239550 - RNA, 16 nt, Homo sapiens
ccaagugccaauauuu

SEQ ID NO: 1239551 - RNA, 16 nt, Homo sapiens
ccaagugccagucuug

SEQ ID NO: 1239552 - RNA, 16 nt, Homo sapiens
ccaagugggauuugca

SEQ ID NO: 1239553 - RNA, 17 nt, Homo sapiens
ccaauaaaaaugucuca

SEQ ID NO: 1239554 - RNA, 21 nt, Homo sapiens
ccaauaaaacugauguuacua

SEQ ID NO: 1239555 - RNA, 14 nt, Homo sapiens
ccaauaaaauuucu

SEQ ID NO: 1239556 - RNA, 12 nt, Homo sapiens
ccaauagcuuua

SEQ ID NO: 1239557 - RNA, 13 nt, Homo sapiens
ccaaucagaucaa

SEQ ID NO: 1239558 - RNA, 18 nt, Homo sapiens
ccaaucagaucaacucug

SEQ ID NO: 1239559 - RNA, 15 nt, Homo sapiens
ccaaucagcacugaa

SEQ ID NO: 1239560 - RNA, 12 nt, Homo sapiens
ccaauccccucc

SEQ ID NO: 1239561 - RNA, 17 nt, Homo sapiens
ccaaucuccaucuguca

SEQ ID NO: 1239562 - RNA, 19 nt, Homo sapiens
ccaaucuuaaacauaauaa

SEQ ID NO: 1239563 - RNA, 18 nt, Homo sapiens
ccaaugagacucuagggu

SEQ ID NO: 1239564 - RNA, 13 nt, Homo sapiens
ccaaugaugguca

SEQ ID NO: 1239565 - RNA, 14 nt, Homo sapiens
ccaaugauggucac

SEQ ID NO: 1239566 - RNA, 16 nt, Homo sapiens
ccaauggaaaccucac

SEQ ID NO: 1239567 - RNA, 19 nt, Homo sapiens
ccaaugguccuagaacuuu

SEQ ID NO: 1239568 - RNA, 15 nt, Homo sapiens
ccaaugguccugacu

SEQ ID NO: 1239569 - RNA, 19 nt, Homo sapiens
ccaauuacagggugacuca

SEQ ID NO: 1239570 - RNA, 13 nt, Homo sapiens
ccaauuccugaca

SEQ ID NO: 1239571 - RNA, 22 nt, Homo sapiens
ccaauuuaaagaaaacuguuaa

SEQ ID NO: 1239572 - RNA, 22 nt, Homo sapiens
ccaauuugguaaaaaugcugcu

SEQ ID NO: 1239573 - RNA, 23 nt, Homo sapiens
ccacaaagcacaguuugaacaaa

SEQ ID NO: 1239574 - RNA, 9 nt, Homo sapiens
ccacaaagg

SEQ ID NO: 1239575 - RNA, 13 nt, Homo sapiens
ccacaaccaaaaa

SEQ ID NO: 1239576 - RNA, 21 nt, Homo sapiens
ccacaaccaccuucaccugga

SEQ ID NO: 1239577 - RNA, 19 nt, Homo sapiens
ccacaacucccuugcacgu

SEQ ID NO: 1239578 - RNA, 16 nt, Homo sapiens
ccacaagagugaauuu

SEQ ID NO: 1239579 - RNA, 15 nt, Homo sapiens
ccacaagucuuccag

SEQ ID NO: 1239580 - RNA, 14 nt, Homo sapiens
ccacaauacuuccu

SEQ ID NO: 1239581 - RNA, 15 nt, Homo sapiens
ccacaauguuuauaa

SEQ ID NO: 1239582 - RNA, 15 nt, Homo sapiens
ccacacacacuggcc

SEQ ID NO: 1239583 - RNA, 18 nt, Homo sapiens
ccacacagcuacagcuuu

SEQ ID NO: 1239584 - RNA, 19 nt, Homo sapiens
ccacacauuaguacuuaug

SEQ ID NO: 1239585 - RNA, 19 nt, Homo sapiens
ccacaccgagacaccaccu

SEQ ID NO: 1239586 - RNA, 19 nt, Homo sapiens
ccacaccgucuuccuucag

SEQ ID NO: 1239587 - RNA, 22 nt, Homo sapiens
ccacaccgucuuccuucaggga

SEQ ID NO: 1239588 - RNA, 13 nt, Homo sapiens
ccacaccuaccac

SEQ ID NO: 1239589 - RNA, 14 nt, Homo sapiens
ccacacucuccauc

SEQ ID NO: 1239590 - RNA, 16 nt, Homo sapiens
ccacacucugacgcaa

SEQ ID NO: 1239591 - RNA, 17 nt, Homo sapiens
ccacacugaaaccaaaa

SEQ ID NO: 1239592 - RNA, 15 nt, Homo sapiens
ccacacuugguggga

SEQ ID NO: 1239593 - RNA, 18 nt, Homo sapiens
ccacagagagaggggaga

SEQ ID NO: 1239594 - RNA, 21 nt, Homo sapiens
ccacagagagggagagcagag

SEQ ID NO: 1239595 - RNA, 19 nt, Homo sapiens
ccacagagugagccaguga

SEQ ID NO: 1239596 - RNA, 16 nt, Homo sapiens
ccacagaguuuuucag

SEQ ID NO: 1239597 - RNA, 17 nt, Homo sapiens
ccacagcacagcucccu

SEQ ID NO: 1239598 - RNA, 12 nt, Homo sapiens
ccacagcacuau

SEQ ID NO: 1239599 - RNA, 18 nt, Homo sapiens
ccacagccacuaagauaa

SEQ ID NO: 1239600 - RNA, 12 nt, Homo sapiens
ccacagccaugg

SEQ ID NO: 1239601 - RNA, 21 nt, Homo sapiens
ccacagccgccugaaagccac

SEQ ID NO: 1239602 - RNA, 23 nt, Homo sapiens
ccacagccuucggacagacauau

SEQ ID NO: 1239603 - RNA, 12 nt, Homo sapiens
ccacagcucuuc

SEQ ID NO: 1239604 - RNA, 17 nt, Homo sapiens
ccacaggcucugaccag

SEQ ID NO: 1239605 - RNA, 18 nt, Homo sapiens
ccacagggcagggccuca

SEQ ID NO: 1239606 - RNA, 14 nt, Homo sapiens
ccacagucugacac

SEQ ID NO: 1239607 - RNA, 13 nt, Homo sapiens
ccacaguuuuagu

SEQ ID NO: 1239608 - RNA, 15 nt, Homo sapiens
ccacauaauguucca

SEQ ID NO: 1239609 - RNA, 12 nt, Homo sapiens
ccacauaccucu

SEQ ID NO: 1239610 - RNA, 23 nt, Homo sapiens
ccacauccccaccccagcuguua

SEQ ID NO: 1239611 - RNA, 21 nt, Homo sapiens
ccacaucuugcucugcugaca

SEQ ID NO: 1239612 - RNA, 22 nt, Homo sapiens
ccacaugaggccaucucaggag

SEQ ID NO: 1239613 - RNA, 20 nt, Homo sapiens
ccacaugugacacauaugca

SEQ ID NO: 1239614 - RNA, 12 nt, Homo sapiens
ccacauugagau

SEQ ID NO: 1239615 - RNA, 20 nt, Homo sapiens
ccacauugagaucacuacuc

SEQ ID NO: 1239616 - RNA, 16 nt, Homo sapiens
ccacauuuagaacuuu

SEQ ID NO: 1239617 - RNA, 23 nt, Homo sapiens
ccacauuuagauccugguuucau

SEQ ID NO: 1239618 - RNA, 16 nt, Homo sapiens
ccaccaaagacaguug

SEQ ID NO: 1239619 - RNA, 17 nt, Homo sapiens
ccaccaaagcugcccac

SEQ ID NO: 1239620 - RNA, 15 nt, Homo sapiens
ccaccaccacuggcc

SEQ ID NO: 1239621 - RNA, 13 nt, Homo sapiens
ccaccaccaggac

SEQ ID NO: 1239622 - RNA, 16 nt, Homo sapiens
ccaccaccucaccagu

SEQ ID NO: 1239623 - RNA, 17 nt, Homo sapiens
ccaccaccucaccaguu

SEQ ID NO: 1239624 - RNA, 19 nt, Homo sapiens
ccaccacugauauccuccu

SEQ ID NO: 1239625 - RNA, 16 nt, Homo sapiens
ccaccauccuauugca

SEQ ID NO: 1239626 - RNA, 12 nt, Homo sapiens
ccaccaugagcu

SEQ ID NO: 1239627 - RNA, 15 nt, Homo sapiens
ccaccaugauugaug

SEQ ID NO: 1239628 - RNA, 19 nt, Homo sapiens
ccaccauuguucauuugug

SEQ ID NO: 1239629 - RNA, 12 nt, Homo sapiens
ccaccccaagag

SEQ ID NO: 1239630 - RNA, 15 nt, Homo sapiens
ccacccgaggggggc

SEQ ID NO: 1239631 - RNA, 17 nt, Homo sapiens
ccacccgcccacagcca

SEQ ID NO: 1239632 - RNA, 15 nt, Homo sapiens
ccacccgggggagcc

SEQ ID NO: 1239633 - RNA, 13 nt, Homo sapiens
ccacccuaguccc

SEQ ID NO: 1239634 - RNA, 20 nt, Homo sapiens
ccacccuccuuucaccacau

SEQ ID NO: 1239635 - RNA, 14 nt, Homo sapiens
ccaccgcccagaga

SEQ ID NO: 1239636 - RNA, 20 nt, Homo sapiens
ccaccuaauccuucuggcaa

SEQ ID NO: 1239637 - RNA, 13 nt, Homo sapiens
ccaccuagacugu

SEQ ID NO: 1239638 - RNA, 24 nt, Homo sapiens
ccaccuagagguagguaggaucau

SEQ ID NO: 1239639 - RNA, 14 nt, Homo sapiens
ccaccucuucacuc

SEQ ID NO: 1239640 - RNA, 16 nt, Homo sapiens
ccaccugacaauggca

SEQ ID NO: 1239641 - RNA, 12 nt, Homo sapiens
ccaccugccauu

SEQ ID NO: 1239642 - RNA, 15 nt, Homo sapiens
ccaccugcccaucac

SEQ ID NO: 1239643 - RNA, 21 nt, Homo sapiens
ccaccugugcccucaccacca

SEQ ID NO: 1239644 - RNA, 17 nt, Homo sapiens
ccaccuuggcucaaguc

SEQ ID NO: 1239645 - RNA, 18 nt, Homo sapiens
ccacgaagacaaccauca

SEQ ID NO: 1239646 - RNA, 20 nt, Homo sapiens
ccacgaccuuugaagagcuu

SEQ ID NO: 1239647 - RNA, 21 nt, Homo sapiens
ccacgagggucaggacuguga

SEQ ID NO: 1239648 - RNA, 18 nt, Homo sapiens
ccacgauuuucuccagcu

SEQ ID NO: 1239649 - RNA, 15 nt, Homo sapiens
ccacggccaggccag

SEQ ID NO: 1239650 - RNA, 19 nt, Homo sapiens
ccacgugauuuccagugag

SEQ ID NO: 1239651 - RNA, 18 nt, Homo sapiens
ccacguggggcucacuuu

SEQ ID NO: 1239652 - RNA, 17 nt, Homo sapiens
ccacuaaaaauauuguu

SEQ ID NO: 1239653 - RNA, 16 nt, Homo sapiens
cuagggagccauuuga

SEQ ID NO: 1239654 - RNA, 19 nt, Homo sapiens
cuagggauucaggcugcuu

SEQ ID NO: 1239655 - RNA, 18 nt, Homo sapiens
cuagggcacuuuaaguca

SEQ ID NO: 1239656 - RNA, 19 nt, Homo sapiens
cuaggguccaccaggaguu

SEQ ID NO: 1239657 - RNA, 16 nt, Homo sapiens
cuagguagugaccuaa

SEQ ID NO: 1239658 - RNA, 22 nt, Homo sapiens
cuagguagugaccuaaccacuu

SEQ ID NO: 1239659 - RNA, 16 nt, Homo sapiens
cuaggucacuucucac

SEQ ID NO: 1239660 - RNA, 23 nt, Homo sapiens
cuagguucuaaaaauugugauca

SEQ ID NO: 1239661 - RNA, 15 nt, Homo sapiens
cuaguaaaagccauc

SEQ ID NO: 1239662 - RNA, 16 nt, Homo sapiens
cuaguaagaugcacug

SEQ ID NO: 1239663 - RNA, 19 nt, Homo sapiens
cuaguaagaugcacugaaa

SEQ ID NO: 1239664 - RNA, 20 nt, Homo sapiens
cuaguaucuucaaacuuuca

SEQ ID NO: 1239665 - RNA, 13 nt, Homo sapiens
cuagucacaaaga

SEQ ID NO: 1239666 - RNA, 22 nt, Homo sapiens
cuagucacucauccauccccug

SEQ ID NO: 1239667 - RNA, 15 nt, Homo sapiens
cuagucugcuagcca

SEQ ID NO: 1239668 - RNA, 15 nt, Homo sapiens
cuagugaaccacagg

SEQ ID NO: 1239669 - RNA, 23 nt, Homo sapiens
cuagugcuuccacuucuaugcaa

SEQ ID NO: 1239670 - RNA, 17 nt, Homo sapiens
cuagugggaaggggugc

SEQ ID NO: 1239671 - RNA, 16 nt, Homo sapiens
cuagugucuuuugccu

SEQ ID NO: 1239672 - RNA, 22 nt, Homo sapiens
cuagugugaguggcagccaugc

SEQ ID NO: 1239673 - RNA, 13 nt, Homo sapiens
cuaguguucuguc

SEQ ID NO: 1239674 - RNA, 13 nt, Homo sapiens
cuaguuaaucaua

SEQ ID NO: 1239675 - RNA, 23 nt, Homo sapiens
cuaguuaaucauagguuugauau

SEQ ID NO: 1239676 - RNA, 12 nt, Homo sapiens
cuaguuacacau

SEQ ID NO: 1239677 - RNA, 14 nt, Homo sapiens
cuaguuugaccuca

SEQ ID NO: 1239678 - RNA, 16 nt, Homo sapiens
cuaguuuucagcugcu

SEQ ID NO: 1239679 - RNA, 20 nt, Homo sapiens
cuaguuuuuuugaaauccaa

SEQ ID NO: 1239680 - RNA, 19 nt, Homo sapiens
cuauaaaacucugcaugua

SEQ ID NO: 1239681 - RNA, 15 nt, Homo sapiens
cuauaaaagaauugc

SEQ ID NO: 1239682 - RNA, 16 nt, Homo sapiens
cuauaaagaagaacuu

SEQ ID NO: 1239683 - RNA, 19 nt, Homo sapiens
cuauaaagaagaacuugca

SEQ ID NO: 1239684 - RNA, 20 nt, Homo sapiens
cuauaaagaagaacuugcau

SEQ ID NO: 1239685 - RNA, 16 nt, Homo sapiens
cuauaaauauguacaa

SEQ ID NO: 1239686 - RNA, 22 nt, Homo sapiens
cuauaacuugaugcaugugguu

SEQ ID NO: 1239687 - RNA, 17 nt, Homo sapiens
cuauaauaaaacuaaac

SEQ ID NO: 1239688 - RNA, 22 nt, Homo sapiens
cuauaauuaguuaugacagcca

SEQ ID NO: 1239689 - RNA, 21 nt, Homo sapiens
cuauaauuuugccuuuaacag

SEQ ID NO: 1239690 - RNA, 12 nt, Homo sapiens
cuauacaaguug

SEQ ID NO: 1239691 - RNA, 15 nt, Homo sapiens
cuauacacaagcaau

SEQ ID NO: 1239692 - RNA, 15 nt, Homo sapiens
cuauacacacacaca

SEQ ID NO: 1239693 - RNA, 20 nt, Homo sapiens
cuauaccgcuucgacuggaa

SEQ ID NO: 1239694 - RNA, 17 nt, Homo sapiens
cuauaggaacauaugaa

SEQ ID NO: 1239695 - RNA, 13 nt, Homo sapiens
cuauaguucuaga

SEQ ID NO: 1239696 - RNA, 19 nt, Homo sapiens
cuauauauuuuaugaucuu

SEQ ID NO: 1239697 - RNA, 19 nt, Homo sapiens
cuauauccauguacuguag

SEQ ID NO: 1239698 - RNA, 15 nt, Homo sapiens
cuauauccugugacu

SEQ ID NO: 1239699 - RNA, 14 nt, Homo sapiens
cuauauucaaaaug

SEQ ID NO: 1239700 - RNA, 20 nt, Homo sapiens
cuaucaacaccacuaggaau

SEQ ID NO: 1239701 - RNA, 17 nt, Homo sapiens
cuaucagcaauacucau

SEQ ID NO: 1239702 - RNA, 13 nt, Homo sapiens
cuauccacagaga

SEQ ID NO: 1239703 - RNA, 17 nt, Homo sapiens
cuaucccuaggcacuua

SEQ ID NO: 1239704 - RNA, 23 nt, Homo sapiens
cuauccugggaggguguggugcu

SEQ ID NO: 1239705 - RNA, 13 nt, Homo sapiens
cuauccuguguau

SEQ ID NO: 1239706 - RNA, 14 nt, Homo sapiens
cuaucuacuacaaa

SEQ ID NO: 1239707 - RNA, 21 nt, Homo sapiens
cuaucuacuacaaacuucaaa

SEQ ID NO: 1239708 - RNA, 22 nt, Homo sapiens
cuaugaaaagcccacaccuaac

SEQ ID NO: 1239709 - RNA, 18 nt, Homo sapiens
cuaugaaaauuauaucuc

SEQ ID NO: 1239710 - RNA, 15 nt, Homo sapiens
cuaugacuguaucuu

SEQ ID NO: 1239711 - RNA, 21 nt, Homo sapiens
cuaugagaauugggauuacau

SEQ ID NO: 1239712 - RNA, 19 nt, Homo sapiens
cuaugaggggguuuggcac

SEQ ID NO: 1239713 - RNA, 20 nt, Homo sapiens
cuaugaguuggacuucaguc

SEQ ID NO: 1239714 - RNA, 22 nt, Homo sapiens
cuaugauauuuucugugccuga

SEQ ID NO: 1239715 - RNA, 20 nt, Homo sapiens
cuaugaucagaagacuuuaa

SEQ ID NO: 1239716 - RNA, 15 nt, Homo sapiens
cuaugaugugaaaca

SEQ ID NO: 1239717 - RNA, 22 nt, Homo sapiens
cuaugcaaacaaaauccaagau

SEQ ID NO: 1239718 - RNA, 14 nt, Homo sapiens
cuaugcaaucugag

SEQ ID NO: 1239719 - RNA, 14 nt, Homo sapiens
cuaugcacauaugg

SEQ ID NO: 1239720 - RNA, 16 nt, Homo sapiens
cuaugcagccacauca

SEQ ID NO: 1239721 - RNA, 16 nt, Homo sapiens
cuaugcuguucacugg

SEQ ID NO: 1239722 - RNA, 16 nt, Homo sapiens
cuauggagugcucaca

SEQ ID NO: 1239723 - RNA, 10 nt, Homo sapiens
cuauggaugu

SEQ ID NO: 1239724 - RNA, 14 nt, Homo sapiens
cuauggccuugcua

SEQ ID NO: 1239725 - RNA, 21 nt, Homo sapiens
cuaugggaacaauugaaguaa

SEQ ID NO: 1239726 - RNA, 18 nt, Homo sapiens
cuaugggacugcagugcc

SEQ ID NO: 1239727 - RNA, 15 nt, Homo sapiens
cuaugggggcacuga

SEQ ID NO: 1239728 - RNA, 23 nt, Homo sapiens
cuauggucagguuauacuccucc

SEQ ID NO: 1239729 - RNA, 14 nt, Homo sapiens
cuaugguugccacc

SEQ ID NO: 1239730 - RNA, 15 nt, Homo sapiens
cuauguaaaccacau

SEQ ID NO: 1239731 - RNA, 22 nt, Homo sapiens
cuaugucagcaguauuggcuga

SEQ ID NO: 1239732 - RNA, 14 nt, Homo sapiens
cuauguuacuauuu

SEQ ID NO: 1239733 - RNA, 11 nt, Homo sapiens
cuauguucccc

SEQ ID NO: 1239734 - RNA, 19 nt, Homo sapiens
cuauguuugugugauuucc

SEQ ID NO: 1239735 - RNA, 22 nt, Homo sapiens
cuauuaaagugcuaagguucua

SEQ ID NO: 1239736 - RNA, 17 nt, Homo sapiens
cuauuaauacucugcag

SEQ ID NO: 1239737 - RNA, 15 nt, Homo sapiens
cuauuauaaaaccau

SEQ ID NO: 1239738 - RNA, 15 nt, Homo sapiens
cuauucaguuuucag

SEQ ID NO: 1239739 - RNA, 14 nt, Homo sapiens
cuauuccaaagugc

SEQ ID NO: 1239740 - RNA, 21 nt, Homo sapiens
cuauucccugucacuacacac

SEQ ID NO: 1239741 - RNA, 13 nt, Homo sapiens
cuauucuauugca

SEQ ID NO: 1239742 - RNA, 18 nt, Homo sapiens
cuauucucaaaguuuccu

SEQ ID NO: 1239743 - RNA, 15 nt, Homo sapiens
cuauucucaugccuc

SEQ ID NO: 1239744 - RNA, 21 nt, Homo sapiens
cuauucucggggcccugugua

SEQ ID NO: 1239745 - RNA, 16 nt, Homo sapiens
cuauugacuucaauga

SEQ ID NO: 1239746 - RNA, 12 nt, Homo sapiens
cuauuggucucc

SEQ ID NO: 1239747 - RNA, 15 nt, Homo sapiens
cuauuguuacucugg

SEQ ID NO: 1239748 - RNA, 21 nt, Homo sapiens
cuauuuaaaggaaaaucacau

SEQ ID NO: 1239749 - RNA, 14 nt, Homo sapiens
cuauuuacuauuca

SEQ ID NO: 1239750 - RNA, 23 nt, Homo sapiens
cuauuucaucuauuuuuggcagu

SEQ ID NO: 1239751 - RNA, 22 nt, Homo sapiens
cuauuucauguuuuugaucaaa

SEQ ID NO: 1239752 - RNA, 11 nt, Homo sapiens
cuauuuccauu

SEQ ID NO: 1239753 - RNA, 19 nt, Homo sapiens
cuauuucuucuacugcuau

SEQ ID NO: 1239754 - RNA, 17 nt, Homo sapiens
cuauuugaacaugugcc

SEQ ID NO: 1239755 - RNA, 20 nt, Homo sapiens
cuauuuguaaaucugccaca

SEQ ID NO: 1239756 - RNA, 15 nt, Homo sapiens
cuauuuguucagaga

SEQ ID NO: 1239757 - RNA, 14 nt, Homo sapiens
cuauuuguuuucau

SEQ ID NO: 1239758 - RNA, 14 nt, Homo sapiens
cuauuuucagagca

SEQ ID NO: 1239759 - RNA, 22 nt, Homo sapiens
cuauuuucugcagaaauuugca

SEQ ID NO: 1239760 - RNA, 12 nt, Homo sapiens
cuauuuugugaa

SEQ ID NO: 1239761 - RNA, 18 nt, Homo sapiens
cuauuuuuuguaaugugu

SEQ ID NO: 1239762 - RNA, 13 nt, Homo sapiens
cucaaaacuuaac

SEQ ID NO: 1239763 - RNA, 12 nt, Homo sapiens
cucaaaagacaa

SEQ ID NO: 1239764 - RNA, 12 nt, Homo sapiens
cucaaacucauu

SEQ ID NO: 1239765 - RNA, 18 nt, Homo sapiens
cucaaacuccugaccuca

SEQ ID NO: 1239766 - RNA, 22 nt, Homo sapiens
cucaaacuccugaccucaggug

SEQ ID NO: 1239767 - RNA, 23 nt, Homo sapiens
cucaaacuccugaccuugugauu

SEQ ID NO: 1239768 - RNA, 22 nt, Homo sapiens
cucaaacucuugaccucaggug

SEQ ID NO: 1239769 - RNA, 16 nt, Homo sapiens
cucaaacuuccaguca

SEQ ID NO: 1239770 - RNA, 13 nt, Homo sapiens
cucaaacuugaga

SEQ ID NO: 1239771 - RNA, 18 nt, Homo sapiens
cucaaaggcccucaguga

SEQ ID NO: 1239772 - RNA, 13 nt, Homo sapiens
cucaaaguuaaaa

SEQ ID NO: 1239773 - RNA, 15 nt, Homo sapiens
cucaaauaacuaaaa

SEQ ID NO: 1239774 - RNA, 19 nt, Homo sapiens
cucaaaucaggguccagug

SEQ ID NO: 1239775 - RNA, 17 nt, Homo sapiens
cucaaaugcacaucuca

SEQ ID NO: 1239776 - RNA, 21 nt, Homo sapiens
cucaaaugcacaucucauggc

SEQ ID NO: 1239777 - RNA, 21 nt, Homo sapiens
cucaaauguucuaaguuucua

SEQ ID NO: 1239778 - RNA, 20 nt, Homo sapiens
cucaaauuggugaacagugu

SEQ ID NO: 1239779 - RNA, 12 nt, Homo sapiens
cucaacagccaa

SEQ ID NO: 1239780 - RNA, 23 nt, Homo sapiens
cucaacauguuacugaccagcaa

SEQ ID NO: 1239781 - RNA, 12 nt, Homo sapiens
aagccugagaac

SEQ ID NO: 1239782 - RNA, 14 nt, Homo sapiens
aagccugugcaaug

SEQ ID NO: 1239783 - RNA, 21 nt, Homo sapiens
aagccuuaauuugcacagugu

SEQ ID NO: 1239784 - RNA, 12 nt, Homo sapiens
aagccuuaggga

SEQ ID NO: 1239785 - RNA, 22 nt, Homo sapiens
aagccuuaucaagugucuucca

SEQ ID NO: 1239786 - RNA, 14 nt, Homo sapiens
aagccuuccuacac

SEQ ID NO: 1239787 - RNA, 13 nt, Homo sapiens
aagccuucugcag

SEQ ID NO: 1239788 - RNA, 19 nt, Homo sapiens
aagcgagcagucagcauuc

SEQ ID NO: 1239789 - RNA, 15 nt, Homo sapiens
aagcgagucauuucg

SEQ ID NO: 1239790 - RNA, 13 nt, Homo sapiens
aagcgcugcagua

SEQ ID NO: 1239791 - RNA, 19 nt, Homo sapiens
aagcguaauuuugccaaau

SEQ ID NO: 1239792 - RNA, 17 nt, Homo sapiens
aagcguuaugugcagua

SEQ ID NO: 1239793 - RNA, 15 nt, Homo sapiens
aagcguuuuucucaa

SEQ ID NO: 1239794 - RNA, 21 nt, Homo sapiens
aagcuaaaauauauaauauac

SEQ ID NO: 1239795 - RNA, 16 nt, Homo sapiens
aagcuagcacuaacuc

SEQ ID NO: 1239796 - RNA, 20 nt, Homo sapiens
aagcuauuagccaggaucau

SEQ ID NO: 1239797 - RNA, 16 nt, Homo sapiens
aagcucacucuggauu

SEQ ID NO: 1239798 - RNA, 16 nt, Homo sapiens
aagcucacugcugauc

SEQ ID NO: 1239799 - RNA, 15 nt, Homo sapiens
aagcucauaauggaa

SEQ ID NO: 1239800 - RNA, 15 nt, Homo sapiens
aagcuccacugucac

SEQ ID NO: 1239801 - RNA, 13 nt, Homo sapiens
aagcuccaucucu

SEQ ID NO: 1239802 - RNA, 14 nt, Homo sapiens
aagcucccagcuga

SEQ ID NO: 1239803 - RNA, 21 nt, Homo sapiens
aagcucccagcugaccagaca

SEQ ID NO: 1239804 - RNA, 19 nt, Homo sapiens
aagcuccugccucuuugug

SEQ ID NO: 1239805 - RNA, 19 nt, Homo sapiens
aagcucuaguucuuaacaa

SEQ ID NO: 1239806 - RNA, 23 nt, Homo sapiens
aagcucugcuccucuccccagca

SEQ ID NO: 1239807 - RNA, 14 nt, Homo sapiens
aagcucuguugcaa

SEQ ID NO: 1239808 - RNA, 20 nt, Homo sapiens
aagcugaagaccauggauuu

SEQ ID NO: 1239809 - RNA, 16 nt, Homo sapiens
aagcugacucaaaaau

SEQ ID NO: 1239810 - RNA, 13 nt, Homo sapiens
aagcugauuugau

SEQ ID NO: 1239811 - RNA, 19 nt, Homo sapiens
aagcugcagcuugggagag

SEQ ID NO: 1239812 - RNA, 16 nt, Homo sapiens
aagcugcccacuguuu

SEQ ID NO: 1239813 - RNA, 22 nt, Homo sapiens
aagcugcuaccccuacaucauc

SEQ ID NO: 1239814 - RNA, 22 nt, Homo sapiens
aagcugcuccaggccugcagca

SEQ ID NO: 1239815 - RNA, 13 nt, Homo sapiens
aagcugcuuuaaa

SEQ ID NO: 1239816 - RNA, 14 nt, Homo sapiens
aagcugcuuuagaa

SEQ ID NO: 1239817 - RNA, 17 nt, Homo sapiens
aagcuguaggacuguuu

SEQ ID NO: 1239818 - RNA, 12 nt, Homo sapiens
aagcuuauguca

SEQ ID NO: 1239819 - RNA, 12 nt, Homo sapiens
aagcuucuaucc

SEQ ID NO: 1239820 - RNA, 18 nt, Homo sapiens
aagcuugaagcuguggag

SEQ ID NO: 1239821 - RNA, 14 nt, Homo sapiens
aagcuugucaaaga

SEQ ID NO: 1239822 - RNA, 15 nt, Homo sapiens
aaggaaaaaugcugc

SEQ ID NO: 1239823 - RNA, 16 nt, Homo sapiens
aaggaaaaaugcugcu

SEQ ID NO: 1239824 - RNA, 18 nt, Homo sapiens
aaggaaaaaugcugcuuc

SEQ ID NO: 1239825 - RNA, 14 nt, Homo sapiens
aaggaaaaugacuc

SEQ ID NO: 1239826 - RNA, 14 nt, Homo sapiens
aaggaaacuccuga

SEQ ID NO: 1239827 - RNA, 14 nt, Homo sapiens
aaggaaaguuauuu

SEQ ID NO: 1239828 - RNA, 19 nt, Homo sapiens
aaggaacaagaauugcuaa

SEQ ID NO: 1239829 - RNA, 23 nt, Homo sapiens
aaggaacagagugagagacauca

SEQ ID NO: 1239830 - RNA, 13 nt, Homo sapiens
aaggaagagccaa

SEQ ID NO: 1239831 - RNA, 21 nt, Homo sapiens
aaggaagcaaguuuucuucca

SEQ ID NO: 1239832 - RNA, 22 nt, Homo sapiens
aaggaagcaaguuuucuuccau

SEQ ID NO: 1239833 - RNA, 16 nt, Homo sapiens
aaggaagcuccacugu

SEQ ID NO: 1239834 - RNA, 18 nt, Homo sapiens
aaggaagcuccacuguca

SEQ ID NO: 1239835 - RNA, 13 nt, Homo sapiens
aaggaaggcuucu

SEQ ID NO: 1239836 - RNA, 15 nt, Homo sapiens
aaggaaguacugcac

SEQ ID NO: 1239837 - RNA, 19 nt, Homo sapiens
aaggaaucuuuaagcagag

SEQ ID NO: 1239838 - RNA, 20 nt, Homo sapiens
aaggaaucuuuaagcagaga

SEQ ID NO: 1239839 - RNA, 19 nt, Homo sapiens
aaggaauuaucaauuacaa

SEQ ID NO: 1239840 - RNA, 18 nt, Homo sapiens
aaggacacuagaagauuu

SEQ ID NO: 1239841 - RNA, 14 nt, Homo sapiens
aaggacaggccaca

SEQ ID NO: 1239842 - RNA, 21 nt, Homo sapiens
aaggacggccuucaacugaaa

SEQ ID NO: 1239843 - RNA, 17 nt, Homo sapiens
aaggacucagauuguau

SEQ ID NO: 1239844 - RNA, 19 nt, Homo sapiens
aaggacucugcuucagucc

SEQ ID NO: 1239845 - RNA, 18 nt, Homo sapiens
aaggacucuuccaccucc

SEQ ID NO: 1239846 - RNA, 20 nt, Homo sapiens
aaggacuucacugcaaguuu

SEQ ID NO: 1239847 - RNA, 16 nt, Homo sapiens
aaggagaacuauccaa

SEQ ID NO: 1239848 - RNA, 23 nt, Homo sapiens
aaggagcaaaacgccucuuuucc

SEQ ID NO: 1239849 - RNA, 22 nt, Homo sapiens
aaggagggagcucugaugagca

SEQ ID NO: 1239850 - RNA, 17 nt, Homo sapiens
aaggaggggaagcugca

SEQ ID NO: 1239851 - RNA, 17 nt, Homo sapiens
aaggaguacuccaagac

SEQ ID NO: 1239852 - RNA, 22 nt, Homo sapiens
aaggaguaggacaaaguuguca

SEQ ID NO: 1239853 - RNA, 17 nt, Homo sapiens
aaggagucccugguuca

SEQ ID NO: 1239854 - RNA, 17 nt, Homo sapiens
aaggauaaugaaauaau

SEQ ID NO: 1239855 - RNA, 19 nt, Homo sapiens
aaggauagcaccgcuuuug

SEQ ID NO: 1239856 - RNA, 21 nt, Homo sapiens
aaggaucuaggagaagggucu

SEQ ID NO: 1239857 - RNA, 20 nt, Homo sapiens
aaggaucucuauaacagauc

SEQ ID NO: 1239858 - RNA, 23 nt, Homo sapiens
aaggaugcugucaagcaccugca

SEQ ID NO: 1239859 - RNA, 19 nt, Homo sapiens
aaggaugucacagggccaa

SEQ ID NO: 1239860 - RNA, 21 nt, Homo sapiens
aaggauuguacacgcugauga

SEQ ID NO: 1239861 - RNA, 16 nt, Homo sapiens
aaggauuuuaccaaag

SEQ ID NO: 1239862 - RNA, 12 nt, Homo sapiens
aaggcacaugcc

SEQ ID NO: 1239863 - RNA, 14 nt, Homo sapiens
aaggcagauggggc

SEQ ID NO: 1239864 - RNA, 19 nt, Homo sapiens
aaggcagauggggcacuga

SEQ ID NO: 1239865 - RNA, 14 nt, Homo sapiens
aaggcagcugccuc

SEQ ID NO: 1239866 - RNA, 20 nt, Homo sapiens
aaggcagcugccucugcucc

SEQ ID NO: 1239867 - RNA, 20 nt, Homo sapiens
aaggcaggaggaucacuuga

SEQ ID NO: 1239868 - RNA, 16 nt, Homo sapiens
aaggcaggcauaucaa

SEQ ID NO: 1239869 - RNA, 17 nt, Homo sapiens
aaggcaggugccuccag

SEQ ID NO: 1239870 - RNA, 15 nt, Homo sapiens
aaggcaggugggcuc

SEQ ID NO: 1239871 - RNA, 16 nt, Homo sapiens
aaggcagucauaucaa

SEQ ID NO: 1239872 - RNA, 20 nt, Homo sapiens
aaggcagugauuagcacuug

SEQ ID NO: 1239873 - RNA, 15 nt, Homo sapiens
aaggcauaucuucua

SEQ ID NO: 1239874 - RNA, 14 nt, Homo sapiens
aaggcauaugcaca

SEQ ID NO: 1239875 - RNA, 16 nt, Homo sapiens
aaggcauuuucaucuu

SEQ ID NO: 1239876 - RNA, 16 nt, Homo sapiens
aaggccacauaccucu

SEQ ID NO: 1239877 - RNA, 22 nt, Homo sapiens
aaggccagcgccagaacccaga

SEQ ID NO: 1239878 - RNA, 18 nt, Homo sapiens
aaggcccugcugcccaau

SEQ ID NO: 1239879 - RNA, 15 nt, Homo sapiens
aaggcggcagguggg

SEQ ID NO: 1239880 - RNA, 18 nt, Homo sapiens
aaggcggcuacaugccuc

SEQ ID NO: 1239881 - RNA, 13 nt, Homo sapiens
aaggcucagucuc

SEQ ID NO: 1239882 - RNA, 17 nt, Homo sapiens
aaggcucagucucagga

SEQ ID NO: 1239883 - RNA, 12 nt, Homo sapiens
aaggcugaccaa

SEQ ID NO: 1239884 - RNA, 17 nt, Homo sapiens
aaggcugaccaagagag

SEQ ID NO: 1239885 - RNA, 13 nt, Homo sapiens
aaggcuuggcaca

SEQ ID NO: 1239886 - RNA, 14 nt, Homo sapiens
aaggcuugguccca

SEQ ID NO: 1239887 - RNA, 14 nt, Homo sapiens
aaggcuuugaguua

SEQ ID NO: 1239888 - RNA, 21 nt, Homo sapiens
aagggaaaccccccagucacc

SEQ ID NO: 1239889 - RNA, 13 nt, Homo sapiens
aagggaaacuauu

SEQ ID NO: 1239890 - RNA, 15 nt, Homo sapiens
aagggaaagucagcu

SEQ ID NO: 1239891 - RNA, 13 nt, Homo sapiens
aagggaacuucca

SEQ ID NO: 1239892 - RNA, 14 nt, Homo sapiens
aagggaaggacaga

SEQ ID NO: 1239893 - RNA, 15 nt, Homo sapiens
aagggaauugcucag

SEQ ID NO: 1239894 - RNA, 21 nt, Homo sapiens
aagggagaacuugaaacagau

SEQ ID NO: 1239895 - RNA, 22 nt, Homo sapiens
aagggagagaacaaaagcuaua

SEQ ID NO: 1239896 - RNA, 16 nt, Homo sapiens
aagggauaguccaaag

SEQ ID NO: 1239897 - RNA, 21 nt, Homo sapiens
aagggauggaagaaguaaaua

SEQ ID NO: 1239898 - RNA, 20 nt, Homo sapiens
aagggauuguuguguaguca

SEQ ID NO: 1239899 - RNA, 12 nt, Homo sapiens
aagggcagagaa

SEQ ID NO: 1239900 - RNA, 18 nt, Homo sapiens
aagggcuucugcacccuc

SEQ ID NO: 1239901 - RNA, 22 nt, Homo sapiens
aaggggcccaagccccaucuca

SEQ ID NO: 1239902 - RNA, 16 nt, Homo sapiens
aaggggccugcccuca

SEQ ID NO: 1239903 - RNA, 19 nt, Homo sapiens
aaggggcuguuacauaaca

SEQ ID NO: 1239904 - RNA, 17 nt, Homo sapiens
aagggggguugcagugg

SEQ ID NO: 1239905 - RNA, 14 nt, Homo sapiens
aaggggugggccac

SEQ ID NO: 1239906 - RNA, 21 nt, Homo sapiens
aagggguuggauugcaauauc

SEQ ID NO: 1239907 - RNA, 19 nt, Homo sapiens
aagggguuggggugacagu

SEQ ID NO: 1239908 - RNA, 21 nt, Homo sapiens
aagggugcccuuugggguccc

SEQ ID NO: 1239909 - RNA, 15 nt, Homo sapiens
aauaugggggccuuu

SEQ ID NO: 1239910 - RNA, 18 nt, Homo sapiens
accugucuauaagagaau

SEQ ID NO: 1239911 - RNA, 17 nt, Homo sapiens
accugucuccacugugc

SEQ ID NO: 1239912 - RNA, 16 nt, Homo sapiens
accugucucuaccuaa

SEQ ID NO: 1239913 - RNA, 22 nt, Homo sapiens
accugugagauccgugaauucu

SEQ ID NO: 1239914 - RNA, 24 nt, Homo sapiens
accuguucuuagaguguagcugua

SEQ ID NO: 1239915 - RNA, 19 nt, Homo sapiens
accuguugguuagauucaa

SEQ ID NO: 1239916 - RNA, 22 nt, Homo sapiens
accuguugguuagauucaaggc

SEQ ID NO: 1239917 - RNA, 18 nt, Homo sapiens
accuuaagauuuugcacc

SEQ ID NO: 1239918 - RNA, 15 nt, Homo sapiens
accuuaaugacaaca

SEQ ID NO: 1239919 - RNA, 18 nt, Homo sapiens
accuuaccaacuuucugu

SEQ ID NO: 1239920 - RNA, 14 nt, Homo sapiens
accuuagaaaucau

SEQ ID NO: 1239921 - RNA, 18 nt, Homo sapiens
accuuauaguuacugugu

SEQ ID NO: 1239922 - RNA, 16 nt, Homo sapiens
accuuaucugugcgug

SEQ ID NO: 1239923 - RNA, 17 nt, Homo sapiens
accuuauuguaccucuc

SEQ ID NO: 1239924 - RNA, 22 nt, Homo sapiens
accuuauuuuacagaagugaaa

SEQ ID NO: 1239925 - RNA, 15 nt, Homo sapiens
accuucaagaucuca

SEQ ID NO: 1239926 - RNA, 15 nt, Homo sapiens
accuucaauacuuaa

SEQ ID NO: 1239927 - RNA, 19 nt, Homo sapiens
accuucagauuuguguuau

SEQ ID NO: 1239928 - RNA, 19 nt, Homo sapiens
accuuccagcuccuguaac

SEQ ID NO: 1239929 - RNA, 19 nt, Homo sapiens
accuuccauucacaccagc

SEQ ID NO: 1239930 - RNA, 20 nt, Homo sapiens
accuuccauucacaccagcu

SEQ ID NO: 1239931 - RNA, 16 nt, Homo sapiens
accuuccgacauccca

SEQ ID NO: 1239932 - RNA, 12 nt, Homo sapiens
accuuccucauc

SEQ ID NO: 1239933 - RNA, 19 nt, Homo sapiens
accuuccuuaagccaggaa

SEQ ID NO: 1239934 - RNA, 19 nt, Homo sapiens
accuugaagaaccucucac

SEQ ID NO: 1239935 - RNA, 18 nt, Homo sapiens
accuugggaucagaucaa

SEQ ID NO: 1239936 - RNA, 13 nt, Homo sapiens
accuuggugcuua

SEQ ID NO: 1239937 - RNA, 12 nt, Homo sapiens
accuugucucau

SEQ ID NO: 1239938 - RNA, 15 nt, Homo sapiens
accuugugucuguac

SEQ ID NO: 1239939 - RNA, 17 nt, Homo sapiens
accuugugucuguacac

SEQ ID NO: 1239940 - RNA, 12 nt, Homo sapiens
accuuguucuau

SEQ ID NO: 1239941 - RNA, 14 nt, Homo sapiens
accuuuauauuugg

SEQ ID NO: 1239942 - RNA, 23 nt, Homo sapiens
accuuucacaagggcaaacuuuu

SEQ ID NO: 1239943 - RNA, 21 nt, Homo sapiens
accuuucacgaacaugggcau

SEQ ID NO: 1239944 - RNA, 20 nt, Homo sapiens
accuuuccauuuauucuuug

SEQ ID NO: 1239945 - RNA, 19 nt, Homo sapiens
accuuuggaagucaugagc

SEQ ID NO: 1239946 - RNA, 13 nt, Homo sapiens
accuuuuccccaa

SEQ ID NO: 1239947 - RNA, 22 nt, Homo sapiens
accuuuuccccaaccacagaga

SEQ ID NO: 1239948 - RNA, 23 nt, Homo sapiens
accuuuucucgcugaaagcacua

SEQ ID NO: 1239949 - RNA, 18 nt, Homo sapiens
acgaaacacaaaccacaa

SEQ ID NO: 1239950 - RNA, 13 nt, Homo sapiens
acgaaaucuaggu

SEQ ID NO: 1239951 - RNA, 21 nt, Homo sapiens
acgaaaugcuaugacuguauc

SEQ ID NO: 1239952 - RNA, 22 nt, Homo sapiens
acgaacgcucuuagcuuucuca

SEQ ID NO: 1239953 - RNA, 12 nt, Homo sapiens
aaguuugaacuu

SEQ ID NO: 1239954 - RNA, 16 nt, Homo sapiens
aaguuugucacuaaac

SEQ ID NO: 1239955 - RNA, 15 nt, Homo sapiens
aaguuuuaacuuuua

SEQ ID NO: 1239956 - RNA, 18 nt, Homo sapiens
aaguuuuccaguauugaa

SEQ ID NO: 1239957 - RNA, 19 nt, Homo sapiens
aaguuuucuuccaugauuu

SEQ ID NO: 1239958 - RNA, 20 nt, Homo sapiens
aaguuuuggaaagaguucaa

SEQ ID NO: 1239959 - RNA, 21 nt, Homo sapiens
aaggguugggagcugaugaaa

SEQ ID NO: 1239960 - RNA, 23 nt, Homo sapiens
aaggguuucgacugguccagcuc

SEQ ID NO: 1239961 - RNA, 14 nt, Homo sapiens
aagguaacuguaca

SEQ ID NO: 1239962 - RNA, 21 nt, Homo sapiens
aagguagcuuaccugacacaa

SEQ ID NO: 1239963 - RNA, 13 nt, Homo sapiens
aagguaugguggg

SEQ ID NO: 1239964 - RNA, 15 nt, Homo sapiens
aaggucucauucuuc

SEQ ID NO: 1239965 - RNA, 16 nt, Homo sapiens
aaggugaagagaccaa

SEQ ID NO: 1239966 - RNA, 17 nt, Homo sapiens
aaggugaguuugagcug

SEQ ID NO: 1239967 - RNA, 13 nt, Homo sapiens
aaggugcacugcu

SEQ ID NO: 1239968 - RNA, 22 nt, Homo sapiens
aaggugcuuuguaauauucucc

SEQ ID NO: 1239969 - RNA, 15 nt, Homo sapiens
aagguggucacuguu

SEQ ID NO: 1239970 - RNA, 16 nt, Homo sapiens
ggugaaagauggaacu

SEQ ID NO: 1239971 - RNA, 21 nt, Homo sapiens
ggugaaccacuucauucugca

SEQ ID NO: 1239972 - RNA, 19 nt, Homo sapiens
ggugaacguguccuucuca

SEQ ID NO: 1239973 - RNA, 15 nt, Homo sapiens
ggugaauuucacaag

SEQ ID NO: 1239974 - RNA, 21 nt, Homo sapiens
ggugacagugccuucucuauu

SEQ ID NO: 1239975 - RNA, 16 nt, Homo sapiens
ggugacauugcaccug

SEQ ID NO: 1239976 - RNA, 16 nt, Homo sapiens
ggugacauuguggacu

SEQ ID NO: 1239977 - RNA, 17 nt, Homo sapiens
ggugaccugcggcagua

SEQ ID NO: 1239978 - RNA, 17 nt, Homo sapiens
ggugacugaaauugcau

SEQ ID NO: 1239979 - RNA, 13 nt, Homo sapiens
ggugaggaccacu

SEQ ID NO: 1239980 - RNA, 17 nt, Homo sapiens
ggugaguccccuacucc

SEQ ID NO: 1239981 - RNA, 15 nt, Homo sapiens
ggugauauccucuca

SEQ ID NO: 1239982 - RNA, 18 nt, Homo sapiens
ggugcaaauccuacugaa

SEQ ID NO: 1239983 - RNA, 13 nt, Homo sapiens
ggugcauagcaga

SEQ ID NO: 1239984 - RNA, 12 nt, Homo sapiens
ggugcauauacg

SEQ ID NO: 1239985 - RNA, 15 nt, Homo sapiens
ggugcaugaugcugc

SEQ ID NO: 1239986 - RNA, 21 nt, Homo sapiens
ggugcccagaacuucccugau

SEQ ID NO: 1239987 - RNA, 19 nt, Homo sapiens
ggugcccuuuggggucccg

SEQ ID NO: 1239988 - RNA, 20 nt, Homo sapiens
ggugccuuuugugugaugcg

SEQ ID NO: 1239989 - RNA, 19 nt, Homo sapiens
ggugcgcccugucucugug

SEQ ID NO: 1239990 - RNA, 17 nt, Homo sapiens
ggugcguuuggccaaaa

SEQ ID NO: 1239991 - RNA, 13 nt, Homo sapiens
ggugcuccaagca

SEQ ID NO: 1239992 - RNA, 18 nt, Homo sapiens
ggugcucuuugcugcacu

SEQ ID NO: 1239993 - RNA, 20 nt, Homo sapiens
gguggaaaucaacccucucc

SEQ ID NO: 1239994 - RNA, 15 nt, Homo sapiens
gguggaacaagcaca

SEQ ID NO: 1239995 - RNA, 19 nt, Homo sapiens
gguggagggcacagcccuc

SEQ ID NO: 1239996 - RNA, 21 nt, Homo sapiens
gguggaugccugguggcagcu

SEQ ID NO: 1239997 - RNA, 19 nt, Homo sapiens
gguggcccuugcaguucag

SEQ ID NO: 1239998 - RNA, 21 nt, Homo sapiens
gguggggggugcaggugggca

SEQ ID NO: 1239999 - RNA, 20 nt, Homo sapiens
gguggggguaaggugcaucu

SEQ ID NO: 1240000 - RNA, 18 nt, Homo sapiens
gguguacacggaggucuc

SEQ ID NO: 1240001 - RNA, 13 nt, Homo sapiens
ggugucagagcug

SEQ ID NO: 1240002 - RNA, 17 nt, Homo sapiens
ggugucagucagggaca

SEQ ID NO: 1240003 - RNA, 21 nt, Homo sapiens
ggugugaccauguucauuaua

SEQ ID NO: 1240004 - RNA, 15 nt, Homo sapiens
ggugugagcuucaga

SEQ ID NO: 1240005 - RNA, 14 nt, Homo sapiens
gguguggagugacu

SEQ ID NO: 1240006 - RNA, 15 nt, Homo sapiens
ggugugggggcugca

SEQ ID NO: 1240007 - RNA, 14 nt, Homo sapiens
gguuaaauuugaau

SEQ ID NO: 1240008 - RNA, 15 nt, Homo sapiens
gguuaagacaaaggg

SEQ ID NO: 1240009 - RNA, 24 nt, Homo sapiens
gguuaguagcccuucagucuuaau

SEQ ID NO: 1240010 - RNA, 18 nt, Homo sapiens
gguuauucagaaccuaaa

SEQ ID NO: 1240011 - RNA, 13 nt, Homo sapiens
gguucacugagcu

SEQ ID NO: 1240012 - RNA, 15 nt, Homo sapiens
gguucagcugaagcu

SEQ ID NO: 1240013 - RNA, 16 nt, Homo sapiens
gguuccuggugacucc

SEQ ID NO: 1240014 - RNA, 20 nt, Homo sapiens
gguucuugguagagauucau

SEQ ID NO: 1240015 - RNA, 22 nt, Homo sapiens
gguucuuuccaugcagacuccu

SEQ ID NO: 1240016 - RNA, 20 nt, Homo sapiens
gguugaacucugguggcaca

SEQ ID NO: 1240017 - RNA, 22 nt, Homo sapiens
gguugaagaaaggaaccuggga

SEQ ID NO: 1240018 - RNA, 16 nt, Homo sapiens
gguugacuuaugggcc

SEQ ID NO: 1240019 - RNA, 13 nt, Homo sapiens
gguuggcaaaaua

SEQ ID NO: 1240020 - RNA, 20 nt, Homo sapiens
gguuggggugacagucauca

SEQ ID NO: 1240021 - RNA, 15 nt, Homo sapiens
gguuguuucuguucc

SEQ ID NO: 1240022 - RNA, 21 nt, Homo sapiens
gguuucacccuuaacccaagg

SEQ ID NO: 1240023 - RNA, 20 nt, Homo sapiens
gguuucauguucacugugag

SEQ ID NO: 1240024 - RNA, 21 nt, Homo sapiens
gguuuccaagucccgggucuc

SEQ ID NO: 1240025 - RNA, 22 nt, Homo sapiens
gguuugaaguggagucucauga

SEQ ID NO: 1240026 - RNA, 21 nt, Homo sapiens
gguuugccaaaauucauuucu

SEQ ID NO: 1240027 - RNA, 18 nt, Homo sapiens
gguuuguugcagccaaag

SEQ ID NO: 1240028 - RNA, 16 nt, Homo sapiens
gguuuuaacaauuucc

SEQ ID NO: 1240029 - RNA, 23 nt, Homo sapiens
gguuuuagacgaggccacagcug

SEQ ID NO: 1240030 - RNA, 22 nt, Homo sapiens
gguuuuuccuacuguccucaga

SEQ ID NO: 1240031 - RNA, 19 nt, Homo sapiens
gguuuuuuucuucuguauu

SEQ ID NO: 1240032 - RNA, 15 nt, Homo sapiens
guaaaaaugcugcuc

SEQ ID NO: 1240033 - RNA, 17 nt, Homo sapiens
guaaaacacuuauuccc

SEQ ID NO: 1240034 - RNA, 15 nt, Homo sapiens
guaaaacuauauucu

SEQ ID NO: 1240035 - RNA, 21 nt, Homo sapiens
guaaaacuauauucucagugu

SEQ ID NO: 1240036 - RNA, 23 nt, Homo sapiens
guaaaacuauauucucaguguag

SEQ ID NO: 1240037 - RNA, 12 nt, Homo sapiens
guaaaacuguau

SEQ ID NO: 1240038 - RNA, 17 nt, Homo sapiens
guaaaacuuauauuaaa

SEQ ID NO: 1240039 - RNA, 21 nt, Homo sapiens
guaaaaguucuuuuugcucua

SEQ ID NO: 1240040 - RNA, 18 nt, Homo sapiens
guaauuccuguuacuuua

SEQ ID NO: 1240041 - RNA, 19 nt, Homo sapiens
guaauuccuguuacuuuac

SEQ ID NO: 1240042 - RNA, 20 nt, Homo sapiens
guaauuuagcaguccaaaga

SEQ ID NO: 1240043 - RNA, 13 nt, Homo sapiens
guaauuuaugcaa

SEQ ID NO: 1240044 - RNA, 15 nt, Homo sapiens
guaauuuugcaaaac

SEQ ID NO: 1240045 - RNA, 16 nt, Homo sapiens
guacaaagauuaguuu

SEQ ID NO: 1240046 - RNA, 17 nt, Homo sapiens
guacaaaguaagccaug

SEQ ID NO: 1240047 - RNA, 17 nt, Homo sapiens
guacaaauguauuuuga

SEQ ID NO: 1240048 - RNA, 12 nt, Homo sapiens
guacacaacaau

SEQ ID NO: 1240049 - RNA, 15 nt, Homo sapiens
guacacugcuguacc

SEQ ID NO: 1240050 - RNA, 18 nt, Homo sapiens
guacaguagauuuuccaa

SEQ ID NO: 1240051 - RNA, 16 nt, Homo sapiens
guacaguauuucugga

SEQ ID NO: 1240052 - RNA, 23 nt, Homo sapiens
guacagucuguaucaaacccacg

SEQ ID NO: 1240053 - RNA, 23 nt, Homo sapiens
guacaguucugggguacauguua

SEQ ID NO: 1240054 - RNA, 15 nt, Homo sapiens
guacaguuugcugua

SEQ ID NO: 1240055 - RNA, 12 nt, Homo sapiens
guacaucuggcc

SEQ ID NO: 1240056 - RNA, 13 nt, Homo sapiens
guacaucuuugga

SEQ ID NO: 1240057 - RNA, 21 nt, Homo sapiens
guacauggaauaacauguaau

SEQ ID NO: 1240058 - RNA, 17 nt, Homo sapiens
guacaugguguuugugg

SEQ ID NO: 1240059 - RNA, 16 nt, Homo sapiens
guaccaaaucugacau

SEQ ID NO: 1240060 - RNA, 14 nt, Homo sapiens
guaccacacauauu

SEQ ID NO: 1240061 - RNA, 17 nt, Homo sapiens
guaccacacauauugca

SEQ ID NO: 1240062 - RNA, 11 nt, Homo sapiens
guaccaguuaa

SEQ ID NO: 1240063 - RNA, 19 nt, Homo sapiens
guaccaucuacaucuccuu

SEQ ID NO: 1240064 - RNA, 22 nt, Homo sapiens
guaccauuuaugaagguuuguu

SEQ ID NO: 1240065 - RNA, 17 nt, Homo sapiens
guacccagccaucugcc

SEQ ID NO: 1240066 - RNA, 18 nt, Homo sapiens
guacccccuucugggcau

SEQ ID NO: 1240067 - RNA, 22 nt, Homo sapiens
guacccucgcaugacuguuaca

SEQ ID NO: 1240068 - RNA, 23 nt, Homo sapiens
guaccucugcuauuugcuguuau

SEQ ID NO: 1240069 - RNA, 18 nt, Homo sapiens
guaccucuucccaugacu

SEQ ID NO: 1240070 - RNA, 18 nt, Homo sapiens
guaccuuccuuaagccag

SEQ ID NO: 1240071 - RNA, 20 nt, Homo sapiens
guacuaacuagcauuguaaa

SEQ ID NO: 1240072 - RNA, 16 nt, Homo sapiens
guacuagcaguguuuc

SEQ ID NO: 1240073 - RNA, 17 nt, Homo sapiens
guacuaguucagacacu

SEQ ID NO: 1240074 - RNA, 16 nt, Homo sapiens
guacuauguaucaaug

SEQ ID NO: 1240075 - RNA, 13 nt, Homo sapiens
guacucuccugga

SEQ ID NO: 1240076 - RNA, 21 nt, Homo sapiens
guacucuggggugcugccuga

SEQ ID NO: 1240077 - RNA, 15 nt, Homo sapiens
guacucuugcugaug

SEQ ID NO: 1240078 - RNA, 18 nt, Homo sapiens
guacugaaagccuuaggg

SEQ ID NO: 1240079 - RNA, 22 nt, Homo sapiens
guacugauauaauuuaguucca

SEQ ID NO: 1240080 - RNA, 18 nt, Homo sapiens
guacugccuuagugcuga

SEQ ID NO: 1240081 - RNA, 17 nt, Homo sapiens
guacugcugucuuccaa

SEQ ID NO: 1240082 - RNA, 20 nt, Homo sapiens
guacuguaauaauaccucaa

SEQ ID NO: 1240083 - RNA, 13 nt, Homo sapiens
guacuguacuaau

SEQ ID NO: 1240084 - RNA, 21 nt, Homo sapiens
guacuguauggaaacacugau

SEQ ID NO: 1240085 - RNA, 20 nt, Homo sapiens
guacuuagaaauacacguau

SEQ ID NO: 1240086 - RNA, 15 nt, Homo sapiens
guacuucucacccag

SEQ ID NO: 1240087 - RNA, 16 nt, Homo sapiens
guacuugggaggccaa

SEQ ID NO: 1240088 - RNA, 22 nt, Homo sapiens
guacuuuuucuaccuguacaca

SEQ ID NO: 1240089 - RNA, 19 nt, Homo sapiens
guacuuuuuuuaaacugug

SEQ ID NO: 1240090 - RNA, 22 nt, Homo sapiens
guagaacagauaaucagugugu

SEQ ID NO: 1240091 - RNA, 17 nt, Homo sapiens
guagacuagugccguag

SEQ ID NO: 1240092 - RNA, 13 nt, Homo sapiens
guagagccagcuu

SEQ ID NO: 1240093 - RNA, 21 nt, Homo sapiens
guagaggccuggggccgguag

SEQ ID NO: 1240094 - RNA, 15 nt, Homo sapiens
guagauacuagcuau

SEQ ID NO: 1240095 - RNA, 18 nt, Homo sapiens
guagauuuuaaaagauaa

SEQ ID NO: 1240096 - RNA, 16 nt, Homo sapiens
guagcaaguacuuugg

SEQ ID NO: 1240097 - RNA, 21 nt, Homo sapiens
guagcagagaaaggauugauu

SEQ ID NO: 1240098 - RNA, 13 nt, Homo sapiens
guagcagcaguug

SEQ ID NO: 1240099 - RNA, 21 nt, Homo sapiens
guagcgugcaucaguacuuca

SEQ ID NO: 1240100 - RNA, 20 nt, Homo sapiens
guagcuaagugaaaagguca

SEQ ID NO: 1240101 - RNA, 19 nt, Homo sapiens
guagcucucacaugcacag

SEQ ID NO: 1240102 - RNA, 19 nt, Homo sapiens
guagcugggacuacaggca

SEQ ID NO: 1240103 - RNA, 20 nt, Homo sapiens
guagcugggauuacaggcgu

SEQ ID NO: 1240104 - RNA, 21 nt, Homo sapiens
guagcuuaccagaagcuucca

SEQ ID NO: 1240105 - RNA, 14 nt, Homo sapiens
guagcuugcucccu

SEQ ID NO: 1240106 - RNA, 15 nt, Homo sapiens
guaggagcugccuug

SEQ ID NO: 1240107 - RNA, 14 nt, Homo sapiens
guagggaguaccug

SEQ ID NO: 1240108 - RNA, 11 nt, Homo sapiens
guaggggccac

SEQ ID NO: 1240109 - RNA, 15 nt, Homo sapiens
guagguaauguuccu

SEQ ID NO: 1240110 - RNA, 17 nt, Homo sapiens
guaggucggcacuugga

SEQ ID NO: 1240111 - RNA, 17 nt, Homo sapiens
guaggugaaagaacaag

SEQ ID NO: 1240112 - RNA, 14 nt, Homo sapiens
guagguucuugaua

SEQ ID NO: 1240113 - RNA, 21 nt, Homo sapiens
agugaugugugagcuaugcaa

SEQ ID NO: 1240114 - RNA, 14 nt, Homo sapiens
agugauuacuguca

SEQ ID NO: 1240115 - RNA, 16 nt, Homo sapiens
agugauucuccugccu

SEQ ID NO: 1240116 - RNA, 22 nt, Homo sapiens
agugauugaaccagcucaucuc

SEQ ID NO: 1240117 - RNA, 23 nt, Homo sapiens
agugauugugucugcauuguuau

SEQ ID NO: 1240118 - RNA, 18 nt, Homo sapiens
agugcaacagcacuggcu

SEQ ID NO: 1240119 - RNA, 17 nt, Homo sapiens
agugcaaugcacgaucu

SEQ ID NO: 1240120 - RNA, 20 nt, Homo sapiens
agugcaguggcaugauguca

SEQ ID NO: 1240121 - RNA, 14 nt, Homo sapiens
agugcaguuuaaaa

SEQ ID NO: 1240122 - RNA, 21 nt, Homo sapiens
agugcauauuccuuucuauca

SEQ ID NO: 1240123 - RNA, 13 nt, Homo sapiens
agugcaucuugcu

SEQ ID NO: 1240124 - RNA, 23 nt, Homo sapiens
agugcauuugccuugucaccugu

SEQ ID NO: 1240125 - RNA, 21 nt, Homo sapiens
agugccacccaccuuugccac

SEQ ID NO: 1240126 - RNA, 16 nt, Homo sapiens
agugccacucauuccu

SEQ ID NO: 1240127 - RNA, 21 nt, Homo sapiens
agugccacuuaauguauguua

SEQ ID NO: 1240128 - RNA, 16 nt, Homo sapiens
agugccagcaaugaca

SEQ ID NO: 1240129 - RNA, 21 nt, Homo sapiens
agugccagcaaugacaucuca

SEQ ID NO: 1240130 - RNA, 19 nt, Homo sapiens
agugccagcccuggcagac

SEQ ID NO: 1240131 - RNA, 20 nt, Homo sapiens
agugccaugauugcuagcca

SEQ ID NO: 1240132 - RNA, 19 nt, Homo sapiens
agugccauuccacuccacu

SEQ ID NO: 1240133 - RNA, 21 nt, Homo sapiens
agugccguaacaacugugguc

SEQ ID NO: 1240134 - RNA, 14 nt, Homo sapiens
agugccugggaaug

SEQ ID NO: 1240135 - RNA, 15 nt, Homo sapiens
agugcgaguccucca

SEQ ID NO: 1240136 - RNA, 13 nt, Homo sapiens
agugcgguuuacu

SEQ ID NO: 1240137 - RNA, 18 nt, Homo sapiens
agugcuaaacaaguaaga

SEQ ID NO: 1240138 - RNA, 16 nt, Homo sapiens
agugcucacaaaggau

SEQ ID NO: 1240139 - RNA, 15 nt, Homo sapiens
agugcugaacagugg

SEQ ID NO: 1240140 - RNA, 15 nt, Homo sapiens
agugcugaccagaca

SEQ ID NO: 1240141 - RNA, 12 nt, Homo sapiens
agugcugagauu

SEQ ID NO: 1240142 - RNA, 11 nt, Homo sapiens
agugcugcuau

SEQ ID NO: 1240143 - RNA, 13 nt, Homo sapiens
agugcugcuguaa

SEQ ID NO: 1240144 - RNA, 17 nt, Homo sapiens
agugcugggaccagagc

SEQ ID NO: 1240145 - RNA, 19 nt, Homo sapiens
agugcugggauuacaggcg

SEQ ID NO: 1240146 - RNA, 19 nt, Homo sapiens
agugcugggauuacaggug

SEQ ID NO: 1240147 - RNA, 15 nt, Homo sapiens
agugcuguccaugcu

SEQ ID NO: 1240148 - RNA, 20 nt, Homo sapiens
agugcuguccaugcuucuca

SEQ ID NO: 1240149 - RNA, 21 nt, Homo sapiens
agugcuguccaugcuucucau

SEQ ID NO: 1240150 - RNA, 23 nt, Homo sapiens
agugcuguugguggcagugacuu

SEQ ID NO: 1240151 - RNA, 15 nt, Homo sapiens
agugcuucagaguuu

SEQ ID NO: 1240152 - RNA, 15 nt, Homo sapiens
agugcuuccacuucu

SEQ ID NO: 1240153 - RNA, 16 nt, Homo sapiens
agugcuuccacuucua

SEQ ID NO: 1240154 - RNA, 15 nt, Homo sapiens
agugcuugggcucca

SEQ ID NO: 1240155 - RNA, 19 nt, Homo sapiens
aguggaacuaaaauucugu

SEQ ID NO: 1240156 - RNA, 15 nt, Homo sapiens
aguggaauagugaau

SEQ ID NO: 1240157 - RNA, 17 nt, Homo sapiens
aguggaugccugcugca

SEQ ID NO: 1240158 - RNA, 15 nt, Homo sapiens
aguggcaagaccaaa

SEQ ID NO: 1240159 - RNA, 14 nt, Homo sapiens
aguggcagccaugc

SEQ ID NO: 1240160 - RNA, 19 nt, Homo sapiens
aguggcaggggacaggagu

SEQ ID NO: 1240161 - RNA, 18 nt, Homo sapiens
aguggcauaauucagggg

SEQ ID NO: 1240162 - RNA, 18 nt, Homo sapiens
aguggcaugugcugugac

SEQ ID NO: 1240163 - RNA, 20 nt, Homo sapiens
aguggccaugccacccuguu

SEQ ID NO: 1240164 - RNA, 14 nt, Homo sapiens
aguggccuggccag

SEQ ID NO: 1240165 - RNA, 20 nt, Homo sapiens
aguggcguaaucucggcuca

SEQ ID NO: 1240166 - RNA, 23 nt, Homo sapiens
aguggcucacgccuaugauccca

SEQ ID NO: 1240167 - RNA, 15 nt, Homo sapiens
agugggaaggggugc

SEQ ID NO: 1240168 - RNA, 14 nt, Homo sapiens
agugggacccauag

SEQ ID NO: 1240169 - RNA, 14 nt, Homo sapiens
agugggacucugau

SEQ ID NO: 1240170 - RNA, 15 nt, Homo sapiens
agugggaucccagac

SEQ ID NO: 1240171 - RNA, 21 nt, Homo sapiens
agugggcugcuagaagcacga

SEQ ID NO: 1240172 - RNA, 12 nt, Homo sapiens
aguggggugcug

SEQ ID NO: 1240173 - RNA, 15 nt, Homo sapiens
aguggucgcuuacuu

SEQ ID NO: 1240174 - RNA, 17 nt, Homo sapiens
aguggucuuuguaagag

SEQ ID NO: 1240175 - RNA, 15 nt, Homo sapiens
agugguggucuucaa

SEQ ID NO: 1240176 - RNA, 16 nt, Homo sapiens
agugguggucuucaag

SEQ ID NO: 1240177 - RNA, 14 nt, Homo sapiens
agugguuguugcca

SEQ ID NO: 1240178 - RNA, 16 nt, Homo sapiens
agugguuuccagucau

SEQ ID NO: 1240179 - RNA, 15 nt, Homo sapiens
aguguaaacaccaua

SEQ ID NO: 1240180 - RNA, 17 nt, Homo sapiens
aguguacaaaacuguaa

SEQ ID NO: 1240181 - RNA, 20 nt, Homo sapiens
aguguacauaugugcuggaa

SEQ ID NO: 1240182 - RNA, 15 nt, Homo sapiens
aguguaccauuugcc

SEQ ID NO: 1240183 - RNA, 16 nt, Homo sapiens
aguguagaagcauucc

SEQ ID NO: 1240184 - RNA, 17 nt, Homo sapiens
aguguagcuaccuacau

SEQ ID NO: 1240185 - RNA, 20 nt, Homo sapiens
aguguagcuaccuacaugcu

SEQ ID NO: 1240186 - RNA, 17 nt, Homo sapiens
aguguaugauuacuggc

SEQ ID NO: 1240187 - RNA, 21 nt, Homo sapiens
agugucacuuaccuagauuua

SEQ ID NO: 1240188 - RNA, 19 nt, Homo sapiens
aguguccccuccacuguca

SEQ ID NO: 1240189 - RNA, 20 nt, Homo sapiens
aguguccccuccacugucac

SEQ ID NO: 1240190 - RNA, 17 nt, Homo sapiens
aguguccuucuugcucc

SEQ ID NO: 1240191 - RNA, 19 nt, Homo sapiens
agugucugucuucuuucac

SEQ ID NO: 1240192 - RNA, 19 nt, Homo sapiens
agugucuuaggguagaaag

SEQ ID NO: 1240193 - RNA, 13 nt, Homo sapiens
agugugaauucac

SEQ ID NO: 1240194 - RNA, 14 nt, Homo sapiens
agugugacagggcc

SEQ ID NO: 1240195 - RNA, 16 nt, Homo sapiens
agugugauauacaaag

SEQ ID NO: 1240196 - RNA, 19 nt, Homo sapiens
agugugauauacaaagugu

SEQ ID NO: 1240197 - RNA, 12 nt, Homo sapiens
agugugauccca

SEQ ID NO: 1240198 - RNA, 14 nt, Homo sapiens
agugugaucccaag

SEQ ID NO: 1240199 - RNA, 20 nt, Homo sapiens
agugugcaugauuguauaug

SEQ ID NO: 1240200 - RNA, 22 nt, Homo sapiens
agugugcuccagauggugcuag

SEQ ID NO: 1240201 - RNA, 16 nt, Homo sapiens
aguguggaaagaaaga

SEQ ID NO: 1240202 - RNA, 18 nt, Homo sapiens
aguguggacuuggcaggu

SEQ ID NO: 1240203 - RNA, 15 nt, Homo sapiens
aguguggagcuggac

SEQ ID NO: 1240204 - RNA, 12 nt, Homo sapiens
aguguggcccag

SEQ ID NO: 1240205 - RNA, 20 nt, Homo sapiens
caccuucaccuggaugugca

SEQ ID NO: 1240206 - RNA, 16 nt, Homo sapiens
caccuucagacuuugc

SEQ ID NO: 1240207 - RNA, 14 nt, Homo sapiens
caccuuccaaagga

SEQ ID NO: 1240208 - RNA, 14 nt, Homo sapiens
caccuugacagggc

SEQ ID NO: 1240209 - RNA, 16 nt, Homo sapiens
caccuugcccuuuacg

SEQ ID NO: 1240210 - RNA, 12 nt, Homo sapiens
caccuuugccac

SEQ ID NO: 1240211 - RNA, 21 nt, Homo sapiens
caccuuuuccccaaccacaga

SEQ ID NO: 1240212 - RNA, 16 nt, Homo sapiens
cacgaacugaaaugag

SEQ ID NO: 1240213 - RNA, 12 nt, Homo sapiens
cacgagaucaag

SEQ ID NO: 1240214 - RNA, 12 nt, Homo sapiens
cacgaggaaaag

SEQ ID NO: 1240215 - RNA, 18 nt, Homo sapiens
cacgagugggaaggacuu

SEQ ID NO: 1240216 - RNA, 16 nt, Homo sapiens
cacgaucguuaugcug

SEQ ID NO: 1240217 - RNA, 11 nt, Homo sapiens
cacgaugcauu

SEQ ID NO: 1240218 - RNA, 12 nt, Homo sapiens
cacgaugcauuu

SEQ ID NO: 1240219 - RNA, 19 nt, Homo sapiens
cacgaugguggaaacagug

SEQ ID NO: 1240220 - RNA, 17 nt, Homo sapiens
cacgcaugugugcugca

SEQ ID NO: 1240221 - RNA, 18 nt, Homo sapiens
cacgcaugugugcugcag

SEQ ID NO: 1240222 - RNA, 23 nt, Homo sapiens
cacgccgcucuucacugugguca

SEQ ID NO: 1240223 - RNA, 22 nt, Homo sapiens
cacgccuaaggucacagcuagu

SEQ ID NO: 1240224 - RNA, 13 nt, Homo sapiens
cacgccuacuuaa

SEQ ID NO: 1240225 - RNA, 14 nt, Homo sapiens
cacgcgaaaaccuu

SEQ ID NO: 1240226 - RNA, 13 nt, Homo sapiens
cacgcgugcacac

SEQ ID NO: 1240227 - RNA, 17 nt, Homo sapiens
cacgcucgcugccauca

SEQ ID NO: 1240228 - RNA, 13 nt, Homo sapiens
cacgcugaaggcu

SEQ ID NO: 1240229 - RNA, 21 nt, Homo sapiens
cacgcugaaggcuuacuucag

SEQ ID NO: 1240230 - RNA, 17 nt, Homo sapiens
cacgcuggagugcagug

SEQ ID NO: 1240231 - RNA, 16 nt, Homo sapiens
cacgcuuugcugcuac

SEQ ID NO: 1240232 - RNA, 18 nt, Homo sapiens
cacggaggagggaugcug

SEQ ID NO: 1240233 - RNA, 16 nt, Homo sapiens
cacgggaaaggagcug

SEQ ID NO: 1240234 - RNA, 23 nt, Homo sapiens
cacgguggugcaugccuguaauc

SEQ ID NO: 1240235 - RNA, 13 nt, Homo sapiens
cacgucugccagg

SEQ ID NO: 1240236 - RNA, 18 nt, Homo sapiens
cacgugauuuccagugag

SEQ ID NO: 1240237 - RNA, 19 nt, Homo sapiens
cacgugucuuccacuuugc

SEQ ID NO: 1240238 - RNA, 23 nt, Homo sapiens
cacuaaaacuuuccugacuuaca

SEQ ID NO: 1240239 - RNA, 16 nt, Homo sapiens
cacuaaaagaucgcag

SEQ ID NO: 1240240 - RNA, 22 nt, Homo sapiens
cacuaacauuucccccgagcuc

SEQ ID NO: 1240241 - RNA, 16 nt, Homo sapiens
cacuaaccacgcugga

SEQ ID NO: 1240242 - RNA, 15 nt, Homo sapiens
cacuacauucauuua

SEQ ID NO: 1240243 - RNA, 20 nt, Homo sapiens
cacuaccauagcuacaucag

SEQ ID NO: 1240244 - RNA, 16 nt, Homo sapiens
cacuaccguaaauguc

SEQ ID NO: 1240245 - RNA, 13 nt, Homo sapiens
cacuacuaccucu

SEQ ID NO: 1240246 - RNA, 16 nt, Homo sapiens
cacuacucagugcaua

SEQ ID NO: 1240247 - RNA, 16 nt, Homo sapiens
cacuacucaguuauua

SEQ ID NO: 1240248 - RNA, 14 nt, Homo sapiens
cacuacugcuaaau

SEQ ID NO: 1240249 - RNA, 22 nt, Homo sapiens
cacuagaauauuuaaaacauca

SEQ ID NO: 1240250 - RNA, 22 nt, Homo sapiens
cacuagccaugauaacugcaau

SEQ ID NO: 1240251 - RNA, 12 nt, Homo sapiens
cacuagccugug

SEQ ID NO: 1240252 - RNA, 16 nt, Homo sapiens
cacuagccugugcacg

SEQ ID NO: 1240253 - RNA, 18 nt, Homo sapiens
cacuaggguccaccagga

SEQ ID NO: 1240254 - RNA, 19 nt, Homo sapiens
cacuauaauguaagcucua

SEQ ID NO: 1240255 - RNA, 20 nt, Homo sapiens
cacuauaauguaagcucuac

SEQ ID NO: 1240256 - RNA, 19 nt, Homo sapiens
cacuauagccuaggugaca

SEQ ID NO: 1240257 - RNA, 12 nt, Homo sapiens
cacuauaucaug

SEQ ID NO: 1240258 - RNA, 15 nt, Homo sapiens
cacuaucauggacua

SEQ ID NO: 1240259 - RNA, 19 nt, Homo sapiens
cacuaugaagauguuucaa

SEQ ID NO: 1240260 - RNA, 12 nt, Homo sapiens
cacuaugcacag

SEQ ID NO: 1240261 - RNA, 12 nt, Homo sapiens
cacuaugcugcu

SEQ ID NO: 1240262 - RNA, 21 nt, Homo sapiens
cacucaaaagacaaacaugca

SEQ ID NO: 1240263 - RNA, 23 nt, Homo sapiens
cacucaaagauuggauuuuacag

SEQ ID NO: 1240264 - RNA, 20 nt, Homo sapiens
cacucagaaagaggucuccc

SEQ ID NO: 1240265 - RNA, 13 nt, Homo sapiens
cacucagguucuu

SEQ ID NO: 1240266 - RNA, 15 nt, Homo sapiens
cacuccacagaguga

SEQ ID NO: 1240267 - RNA, 15 nt, Homo sapiens
cacuccacucagguu

SEQ ID NO: 1240268 - RNA, 11 nt, Homo sapiens
cacuccagugc

SEQ ID NO: 1240269 - RNA, 14 nt, Homo sapiens
cacuccagugccag

SEQ ID NO: 1240270 - RNA, 23 nt, Homo sapiens
cacucccaccugacacaccaggc

SEQ ID NO: 1240271 - RNA, 14 nt, Homo sapiens
cacucccagcacuc

SEQ ID NO: 1240272 - RNA, 16 nt, Homo sapiens
cacucccuggcucuca

SEQ ID NO: 1240273 - RNA, 23 nt, Homo sapiens
cacuccgagaggugggccagucu

SEQ ID NO: 1240274 - RNA, 16 nt, Homo sapiens
cacuccuccuacugua

SEQ ID NO: 1240275 - RNA, 16 nt, Homo sapiens
cacucggcauuucaaa

SEQ ID NO: 1240276 - RNA, 13 nt, Homo sapiens
cacucuacuacau

SEQ ID NO: 1240277 - RNA, 17 nt, Homo sapiens
cacucucccuggagcug

SEQ ID NO: 1240278 - RNA, 19 nt, Homo sapiens
cacucuguaguuacugugg

SEQ ID NO: 1240279 - RNA, 23 nt, Homo sapiens
cacucuuauucccaaacuacaga

SEQ ID NO: 1240280 - RNA, 20 nt, Homo sapiens
cacucuucuccccgugcuuu

SEQ ID NO: 1240281 - RNA, 18 nt, Homo sapiens
cacugaaaauaccaucag

SEQ ID NO: 1240282 - RNA, 21 nt, Homo sapiens
cacugaaaaugucacauucua

SEQ ID NO: 1240283 - RNA, 22 nt, Homo sapiens
cacugaaaaugucacauucuau

SEQ ID NO: 1240284 - RNA, 18 nt, Homo sapiens
cacugaaaccaaaacaua

SEQ ID NO: 1240285 - RNA, 13 nt, Homo sapiens
cacugaagcacca

SEQ ID NO: 1240286 - RNA, 17 nt, Homo sapiens
cacugaagcaccacagg

SEQ ID NO: 1240287 - RNA, 17 nt, Homo sapiens
cacugaagccacagcug

SEQ ID NO: 1240288 - RNA, 15 nt, Homo sapiens
cacugacaaugggca

SEQ ID NO: 1240289 - RNA, 19 nt, Homo sapiens
cacugagaagauugugaau

SEQ ID NO: 1240290 - RNA, 10 nt, Homo sapiens
cacugagaua

SEQ ID NO: 1240291 - RNA, 17 nt, Homo sapiens
cacugaggaccagccau

SEQ ID NO: 1240292 - RNA, 19 nt, Homo sapiens
cacugaggagauacugaac

SEQ ID NO: 1240293 - RNA, 16 nt, Homo sapiens
cacugaggguggcacu

SEQ ID NO: 1240294 - RNA, 15 nt, Homo sapiens
cacugaguucuauca

SEQ ID NO: 1240295 - RNA, 15 nt, Homo sapiens
cacugauaagacugu

SEQ ID NO: 1240296 - RNA, 16 nt, Homo sapiens
cacugaucacccaaug

SEQ ID NO: 1240297 - RNA, 16 nt, Homo sapiens
cacugaugcuguucuc

SEQ ID NO: 1240298 - RNA, 22 nt, Homo sapiens
cacugaugcuuagauguuccag

SEQ ID NO: 1240299 - RNA, 15 nt, Homo sapiens
cacugauugguguuu

SEQ ID NO: 1240300 - RNA, 13 nt, Homo sapiens
cacugauuugaua

SEQ ID NO: 1240301 - RNA, 14 nt, Homo sapiens
cacugauuugauac

SEQ ID NO: 1240302 - RNA, 16 nt, Homo sapiens
cacugcaagcucugcc

SEQ ID NO: 1240303 - RNA, 14 nt, Homo sapiens
cacugcacugcaug

SEQ ID NO: 1240304 - RNA, 14 nt, Homo sapiens
cacugcacugucug

SEQ ID NO: 1240305 - RNA, 18 nt, Homo sapiens
cacugcacugucugagaa

SEQ ID NO: 1240306 - RNA, 16 nt, Homo sapiens
cacugcacuguuuuca

SEQ ID NO: 1240307 - RNA, 13 nt, Homo sapiens
cacugcauuucau

SEQ ID NO: 1240308 - RNA, 15 nt, Homo sapiens
cacugccuguauacu

SEQ ID NO: 1240309 - RNA, 11 nt, Homo sapiens
cacugccuuca

SEQ ID NO: 1240310 - RNA, 18 nt, Homo sapiens
cacugcgggagcucugua

SEQ ID NO: 1240311 - RNA, 14 nt, Homo sapiens
cacugcucaagaag

SEQ ID NO: 1240312 - RNA, 21 nt, Homo sapiens
cacugcugaggacacucagug

SEQ ID NO: 1240313 - RNA, 11 nt, Homo sapiens
cacugcuguac

SEQ ID NO: 1240314 - RNA, 17 nt, Homo sapiens
cacuggaaaaguguaau

SEQ ID NO: 1240315 - RNA, 23 nt, Homo sapiens
cacuggaggggucuccucugcag

SEQ ID NO: 1240316 - RNA, 14 nt, Homo sapiens
cacuggaugcagaa

SEQ ID NO: 1240317 - RNA, 14 nt, Homo sapiens
cacuguccuaccag

SEQ ID NO: 1240318 - RNA, 15 nt, Homo sapiens
cacuguccugaccau

SEQ ID NO: 1240319 - RNA, 15 nt, Homo sapiens
cacugugagcaccug

SEQ ID NO: 1240320 - RNA, 16 nt, Homo sapiens
cacugugagcaccuga

SEQ ID NO: 1240321 - RNA, 23 nt, Homo sapiens
cacugugcaaauauaucugcuau

SEQ ID NO: 1240322 - RNA, 17 nt, Homo sapiens
cacugugcuucgagcca

SEQ ID NO: 1240323 - RNA, 17 nt, Homo sapiens
cacuguggagaccacac

SEQ ID NO: 1240324 - RNA, 19 nt, Homo sapiens
cacuguguacaccucugga

SEQ ID NO: 1240325 - RNA, 19 nt, Homo sapiens
cacuguuaucuucacuuuu

SEQ ID NO: 1240326 - RNA, 21 nt, Homo sapiens
cacuguuuuuagacaccuuca

SEQ ID NO: 1240327 - RNA, 15 nt, Homo sapiens
cacuuacagaauuau

SEQ ID NO: 1240328 - RNA, 17 nt, Homo sapiens
cacuuaguagagugauu

SEQ ID NO: 1240329 - RNA, 17 nt, Homo sapiens
cacuucagaauuccaua

SEQ ID NO: 1240330 - RNA, 14 nt, Homo sapiens
cacuucagaucuga

SEQ ID NO: 1240331 - RNA, 18 nt, Homo sapiens
cacuucauauagcauuga

SEQ ID NO: 1240332 - RNA, 16 nt, Homo sapiens
cacuuccccacaggcu

SEQ ID NO: 1240333 - RNA, 14 nt, Homo sapiens
cacuuccuuggaaa

SEQ ID NO: 1240334 - RNA, 21 nt, Homo sapiens
cacuucucccuggcccaggcu

SEQ ID NO: 1240335 - RNA, 21 nt, Homo sapiens
cacuucucucuccccaucccc

SEQ ID NO: 1240336 - RNA, 21 nt, Homo sapiens
cacuucuuguuccccacugac

SEQ ID NO: 1240337 - RNA, 16 nt, Homo sapiens
cacuugaagaugcugc

SEQ ID NO: 1240338 - RNA, 18 nt, Homo sapiens
cacuugaaugugucacua

SEQ ID NO: 1240339 - RNA, 15 nt, Homo sapiens
cacuugaugauacaa

SEQ ID NO: 1240340 - RNA, 13 nt, Homo sapiens
cacuugguguacu

SEQ ID NO: 1240341 - RNA, 14 nt, Homo sapiens
cacuuguauaaaug

SEQ ID NO: 1240342 - RNA, 21 nt, Homo sapiens
cacuugugcaguguugacagu

SEQ ID NO: 1240343 - RNA, 15 nt, Homo sapiens
cacuuuaaaccuguu

SEQ ID NO: 1240344 - RNA, 17 nt, Homo sapiens
cacuuuagggcuguaaa

SEQ ID NO: 1240345 - RNA, 17 nt, Homo sapiens
cacuuuauaaauaucaa

SEQ ID NO: 1240346 - RNA, 12 nt, Homo sapiens
cacuuugcucuc

SEQ ID NO: 1240347 - RNA, 23 nt, Homo sapiens
cacuuuggacauggcucacaaac

SEQ ID NO: 1240348 - RNA, 16 nt, Homo sapiens
cacuuugggacuuggg

SEQ ID NO: 1240349 - RNA, 23 nt, Homo sapiens
cacuuuuagccagagaugcaaua

SEQ ID NO: 1240350 - RNA, 18 nt, Homo sapiens
cagaaaaagcuagcacua

SEQ ID NO: 1240351 - RNA, 15 nt, Homo sapiens
cagaaaaccuguuca

SEQ ID NO: 1240352 - RNA, 16 nt, Homo sapiens
cagaaaagaaaaccau

SEQ ID NO: 1240353 - RNA, 18 nt, Homo sapiens
cagaaaagcccaaguuca

SEQ ID NO: 1240354 - RNA, 22 nt, Homo sapiens
cagaaaauauuauguguuucca

SEQ ID NO: 1240355 - RNA, 15 nt, Homo sapiens
cagaaacagccauug

SEQ ID NO: 1240356 - RNA, 19 nt, Homo sapiens
cagaaacaguucaccuuga

SEQ ID NO: 1240357 - RNA, 13 nt, Homo sapiens
cagaaacugaugc

SEQ ID NO: 1240358 - RNA, 16 nt, Homo sapiens
cagaaacugaugccaa

SEQ ID NO: 1240359 - RNA, 20 nt, Homo sapiens
cagaaagagacuccgucuca

SEQ ID NO: 1240360 - RNA, 16 nt, Homo sapiens
cagaaagcauccuaaa

SEQ ID NO: 1240361 - RNA, 17 nt, Homo sapiens
cagaaagcauccuaaau

SEQ ID NO: 1240362 - RNA, 18 nt, Homo sapiens
cagaaagcuagaaagugu

SEQ ID NO: 1240363 - RNA, 18 nt, Homo sapiens
cagaaaguggccaugcca

SEQ ID NO: 1240364 - RNA, 15 nt, Homo sapiens
cagaaaguuaugaaa

SEQ ID NO: 1240365 - RNA, 19 nt, Homo sapiens
cagaaaucaaaaagggaau

SEQ ID NO: 1240366 - RNA, 19 nt, Homo sapiens
cagaaaucuagaagacugu

SEQ ID NO: 1240367 - RNA, 21 nt, Homo sapiens
cagaaaucuagaagacuguca

SEQ ID NO: 1240368 - RNA, 13 nt, Homo sapiens
cagaaaugcuguc

SEQ ID NO: 1240369 - RNA, 21 nt, Homo sapiens
cagaaauggggaauucucuaa

SEQ ID NO: 1240370 - RNA, 23 nt, Homo sapiens
cagaacaaaaagaaaucuugucu

SEQ ID NO: 1240371 - RNA, 15 nt, Homo sapiens
cagaacaacacuucc

SEQ ID NO: 1240372 - RNA, 20 nt, Homo sapiens
cagaacaagaccccgucuca

SEQ ID NO: 1240373 - RNA, 22 nt, Homo sapiens
cagaacagggucauguuugcag

SEQ ID NO: 1240374 - RNA, 16 nt, Homo sapiens
cagaacccagauuucc

SEQ ID NO: 1240375 - RNA, 17 nt, Homo sapiens
cagaacccagauuuccu

SEQ ID NO: 1240376 - RNA, 23 nt, Homo sapiens
cagaacccagggcucugccccag

SEQ ID NO: 1240377 - RNA, 12 nt, Homo sapiens
cagaaccugcuc

SEQ ID NO: 1240378 - RNA, 14 nt, Homo sapiens
cagaacuugaaugu

SEQ ID NO: 1240379 - RNA, 21 nt, Homo sapiens
cagaacuugaaugugucaggu

SEQ ID NO: 1240380 - RNA, 14 nt, Homo sapiens
cagaagaacugugu

SEQ ID NO: 1240381 - RNA, 17 nt, Homo sapiens
cagaagacccgcucucc

SEQ ID NO: 1240382 - RNA, 18 nt, Homo sapiens
cagaagagaaggaagcca

SEQ ID NO: 1240383 - RNA, 14 nt, Homo sapiens
cagaagaucugaaa

SEQ ID NO: 1240384 - RNA, 12 nt, Homo sapiens
cagaagcccuga

SEQ ID NO: 1240385 - RNA, 18 nt, Homo sapiens
cagaagcggagagccugg

SEQ ID NO: 1240386 - RNA, 20 nt, Homo sapiens
cagaaggauuaccugaggca

SEQ ID NO: 1240387 - RNA, 16 nt, Homo sapiens
cagaagggaauugcuc

SEQ ID NO: 1240388 - RNA, 14 nt, Homo sapiens
cagaagguauuccu

SEQ ID NO: 1240389 - RNA, 14 nt, Homo sapiens
cagaaggugccacu

SEQ ID NO: 1240390 - RNA, 19 nt, Homo sapiens
cagaauacaguaagcugcu

SEQ ID NO: 1240391 - RNA, 12 nt, Homo sapiens
cagaauuaugaa

SEQ ID NO: 1240392 - RNA, 23 nt, Homo sapiens
cagaauugccccugccauuucca

SEQ ID NO: 1240393 - RNA, 14 nt, Homo sapiens
cagaauuguccuca

SEQ ID NO: 1240394 - RNA, 16 nt, Homo sapiens
cagaauuuuaaagagc

SEQ ID NO: 1240395 - RNA, 16 nt, Homo sapiens
cagacaacaccuuccu

SEQ ID NO: 1240396 - RNA, 13 nt, Homo sapiens
cagacaagcacua

SEQ ID NO: 1240397 - RNA, 15 nt, Homo sapiens
cagacacaacccaau

SEQ ID NO: 1240398 - RNA, 19 nt, Homo sapiens
cagacacacacacacacaa

SEQ ID NO: 1240399 - RNA, 16 nt, Homo sapiens
cagacacagacuggca

SEQ ID NO: 1240400 - RNA, 18 nt, Homo sapiens
cagacacaggcccggcuc

SEQ ID NO: 1240401 - RNA, 19 nt, Homo sapiens
cagacacuaaaugcagaca

SEQ ID NO: 1240402 - RNA, 21 nt, Homo sapiens
cagacacuggcguuacugcuu

SEQ ID NO: 1240403 - RNA, 17 nt, Homo sapiens
cagacauaaagccaugu

SEQ ID NO: 1240404 - RNA, 19 nt, Homo sapiens
cagacaucggccuccauga

SEQ ID NO: 1240405 - RNA, 21 nt, Homo sapiens
cagacaucggccuccaugacc

SEQ ID NO: 1240406 - RNA, 14 nt, Homo sapiens
cagacaugaacugc

SEQ ID NO: 1240407 - RNA, 14 nt, Homo sapiens
cagaccaccaucca

SEQ ID NO: 1240408 - RNA, 17 nt, Homo sapiens
cagaccaugaaguaaau

SEQ ID NO: 1240409 - RNA, 19 nt, Homo sapiens
cagacccugccacucucac

SEQ ID NO: 1240410 - RNA, 20 nt, Homo sapiens
cagaccugugugugccucca

SEQ ID NO: 1240411 - RNA, 22 nt, Homo sapiens
cagacuaaagauugcagcauuu

SEQ ID NO: 1240412 - RNA, 12 nt, Homo sapiens
cagacuccaugg

SEQ ID NO: 1240413 - RNA, 16 nt, Homo sapiens
cagacucccgcgugaa

SEQ ID NO: 1240414 - RNA, 20 nt, Homo sapiens
cagacucuagugcuacauga

SEQ ID NO: 1240415 - RNA, 22 nt, Homo sapiens
cagacucuugggccguccccau

SEQ ID NO: 1240416 - RNA, 13 nt, Homo sapiens
cagacugaaaaac

SEQ ID NO: 1240417 - RNA, 12 nt, Homo sapiens
cagacuggcaau

SEQ ID NO: 1240418 - RNA, 21 nt, Homo sapiens
cagacuggcaauaaacuccua

SEQ ID NO: 1240419 - RNA, 15 nt, Homo sapiens
cagacuggcuccaac

SEQ ID NO: 1240420 - RNA, 20 nt, Homo sapiens
cagacuggugggcuagccaa

SEQ ID NO: 1240421 - RNA, 16 nt, Homo sapiens
cagacugucaagaaga

SEQ ID NO: 1240422 - RNA, 13 nt, Homo sapiens
cagacuucagcug

SEQ ID NO: 1240423 - RNA, 15 nt, Homo sapiens
cagacuuccuugaga

SEQ ID NO: 1240424 - RNA, 14 nt, Homo sapiens
cagacuucuccaga

SEQ ID NO: 1240425 - RNA, 14 nt, Homo sapiens
cagacuuuagcuua

SEQ ID NO: 1240426 - RNA, 16 nt, Homo sapiens
cagacuuuuaccuacc

SEQ ID NO: 1240427 - RNA, 17 nt, Homo sapiens
cagagaaaaaugcuccc

SEQ ID NO: 1240428 - RNA, 16 nt, Homo sapiens
cagagaaagaaguccu

SEQ ID NO: 1240429 - RNA, 14 nt, Homo sapiens
cagagaaaggauug

SEQ ID NO: 1240430 - RNA, 22 nt, Homo sapiens
cagagaagauaauguucuuuaa

SEQ ID NO: 1240431 - RNA, 21 nt, Homo sapiens
cagagaagauucuuguauuua

SEQ ID NO: 1240432 - RNA, 18 nt, Homo sapiens
cagagaauauauacauuc

SEQ ID NO: 1240433 - RNA, 13 nt, Homo sapiens
ccaaaguguuaau

SEQ ID NO: 1240434 - RNA, 20 nt, Homo sapiens
ccaaauaacaucaacaacac

SEQ ID NO: 1240435 - RNA, 21 nt, Homo sapiens
ccaaauauuuagcaucuuccu

SEQ ID NO: 1240436 - RNA, 18 nt, Homo sapiens
ccaaaucugacauauuau

SEQ ID NO: 1240437 - RNA, 19 nt, Homo sapiens
ccaaaugaugccacuuccc

SEQ ID NO: 1240438 - RNA, 19 nt, Homo sapiens
ccaaauucagccuacugcc

SEQ ID NO: 1240439 - RNA, 18 nt, Homo sapiens
ccaaauuuuaucuggaag

SEQ ID NO: 1240440 - RNA, 14 nt, Homo sapiens
ccaacaaaccacac

SEQ ID NO: 1240441 - RNA, 21 nt, Homo sapiens
ccaacacugucacuagucuca

SEQ ID NO: 1240442 - RNA, 16 nt, Homo sapiens
ccaacagcgacauagc

SEQ ID NO: 1240443 - RNA, 22 nt, Homo sapiens
ccaacaggcuguucugcacuga

SEQ ID NO: 1240444 - RNA, 15 nt, Homo sapiens
ccaacaugcacugau

SEQ ID NO: 1240445 - RNA, 14 nt, Homo sapiens
ccaaccacagagaa

SEQ ID NO: 1240446 - RNA, 21 nt, Homo sapiens
ccaaccacagcaucgggagca

SEQ ID NO: 1240447 - RNA, 20 nt, Homo sapiens
ccaacccaauaaaacugaug

SEQ ID NO: 1240448 - RNA, 20 nt, Homo sapiens
ccaaccccaguggauucuca

SEQ ID NO: 1240449 - RNA, 17 nt, Homo sapiens
ccaaccccccaccugcc

SEQ ID NO: 1240450 - RNA, 16 nt, Homo sapiens
ccaaccugaagacacc

SEQ ID NO: 1240451 - RNA, 18 nt, Homo sapiens
ccaaccuuccaaguguaa

SEQ ID NO: 1240452 - RNA, 21 nt, Homo sapiens
ccaaccuucuugucauugaaa

SEQ ID NO: 1240453 - RNA, 16 nt, Homo sapiens
ccaacgcacaggaaaa

SEQ ID NO: 1240454 - RNA, 22 nt, Homo sapiens
ccaacguucgauuucuaccuca

SEQ ID NO: 1240455 - RNA, 17 nt, Homo sapiens
ccaacuguuucccugcu

SEQ ID NO: 1240456 - RNA, 20 nt, Homo sapiens
ccaacuugguucugcuucaa

SEQ ID NO: 1240457 - RNA, 23 nt, Homo sapiens
ccaacuuguaaauacaccaccuc

SEQ ID NO: 1240458 - RNA, 13 nt, Homo sapiens
ccaacuuuugcau

SEQ ID NO: 1240459 - RNA, 23 nt, Homo sapiens
ccaagaaaaauccgcuuuucugc

SEQ ID NO: 1240460 - RNA, 20 nt, Homo sapiens
ccaagaaagccuucaagaug

SEQ ID NO: 1240461 - RNA, 13 nt, Homo sapiens
ccaagaacugcau

SEQ ID NO: 1240462 - RNA, 19 nt, Homo sapiens
ccaagaacugcauggaccu

SEQ ID NO: 1240463 - RNA, 13 nt, Homo sapiens
ccaagacaaauca

SEQ ID NO: 1240464 - RNA, 19 nt, Homo sapiens
ccaagaggacugagacugg

SEQ ID NO: 1240465 - RNA, 21 nt, Homo sapiens
ccaagcaaaccaauggugauc

SEQ ID NO: 1240466 - RNA, 11 nt, Homo sapiens
ccaagcaccuc

SEQ ID NO: 1240467 - RNA, 23 nt, Homo sapiens
ccaagcagaauucugcaugguga

SEQ ID NO: 1240468 - RNA, 19 nt, Homo sapiens
ccaagcaguuucuuucaaa

SEQ ID NO: 1240469 - RNA, 23 nt, Homo sapiens
ccaagcccuggagccaacugcug

SEQ ID NO: 1240470 - RNA, 17 nt, Homo sapiens
ccaagcgagagcagcug

SEQ ID NO: 1240471 - RNA, 20 nt, Homo sapiens
ccaagcuuguuaucagcuuu

SEQ ID NO: 1240472 - RNA, 20 nt, Homo sapiens
ccaaggaacaaaaaaaccac

SEQ ID NO: 1240473 - RNA, 16 nt, Homo sapiens
ccaaggacucuuccac

SEQ ID NO: 1240474 - RNA, 13 nt, Homo sapiens
ccaaggagaccaa

SEQ ID NO: 1240475 - RNA, 18 nt, Homo sapiens
ccaaggauggaccacaca

SEQ ID NO: 1240476 - RNA, 20 nt, Homo sapiens
ccaaggggaauuacugaaaa

SEQ ID NO: 1240477 - RNA, 18 nt, Homo sapiens
ccaaggggguggacgcaa

SEQ ID NO: 1240478 - RNA, 20 nt, Homo sapiens
ccaagggguuaaugaaacaa

SEQ ID NO: 1240479 - RNA, 13 nt, Homo sapiens
ccaagguccguga

SEQ ID NO: 1240480 - RNA, 11 nt, Homo sapiens
ccaagguccug

SEQ ID NO: 1240481 - RNA, 22 nt, Homo sapiens
ccaaggugcugaugucaaagug

SEQ ID NO: 1240482 - RNA, 22 nt, Homo sapiens
ccaaguaaacaggguaccucaa

SEQ ID NO: 1240483 - RNA, 14 nt, Homo sapiens
ccaaguaccaguau

SEQ ID NO: 1240484 - RNA, 15 nt, Homo sapiens
ccaagucaugugcau

SEQ ID NO: 1240485 - RNA, 16 nt, Homo sapiens
ccaagucuguaccuca

SEQ ID NO: 1240486 - RNA, 17 nt, Homo sapiens
ccaagucuguaccucaa

SEQ ID NO: 1240487 - RNA, 20 nt, Homo sapiens
ccaagugaggagugccagcu

SEQ ID NO: 1240488 - RNA, 14 nt, Homo sapiens
ccaagugauaauuu

SEQ ID NO: 1240489 - RNA, 24 nt, Homo sapiens
ccaaguuccacuuuucugcaggua

SEQ ID NO: 1240490 - RNA, 23 nt, Homo sapiens
ccaaguugaagggaaacaaagaa

SEQ ID NO: 1240491 - RNA, 16 nt, Homo sapiens
ccaaguuuccauagca

SEQ ID NO: 1240492 - RNA, 15 nt, Homo sapiens
ccaauaaaaaguuca

SEQ ID NO: 1240493 - RNA, 16 nt, Homo sapiens
ccaauaaaaaguucag

SEQ ID NO: 1240494 - RNA, 19 nt, Homo sapiens
ccaauaaaaaguucagagu

SEQ ID NO: 1240495 - RNA, 20 nt, Homo sapiens
ccaauaaaaaguucagaguu

SEQ ID NO: 1240496 - RNA, 13 nt, Homo sapiens
ccaauaaaacuga

SEQ ID NO: 1240497 - RNA, 19 nt, Homo sapiens
ccaauaaaggcagcugccu

SEQ ID NO: 1240498 - RNA, 20 nt, Homo sapiens
ccaauagcaaggcugugcau

SEQ ID NO: 1240499 - RNA, 13 nt, Homo sapiens
ccaauagcacuuu

SEQ ID NO: 1240500 - RNA, 16 nt, Homo sapiens
ccaauagcacuuucau

SEQ ID NO: 1240501 - RNA, 14 nt, Homo sapiens
ccaaucauuuuaau

SEQ ID NO: 1240502 - RNA, 18 nt, Homo sapiens
ccaaucucuuggugggga

SEQ ID NO: 1240503 - RNA, 22 nt, Homo sapiens
ccaaugcacaguugccacauuu

SEQ ID NO: 1240504 - RNA, 18 nt, Homo sapiens
ccaaugcacauccauucc

SEQ ID NO: 1240505 - RNA, 23 nt, Homo sapiens
ccaaugcauugcuaaaauauuau

SEQ ID NO: 1240506 - RNA, 23 nt, Homo sapiens
ccaauguucuauuaaucaccucu

SEQ ID NO: 1240507 - RNA, 18 nt, Homo sapiens
ccaauucaccaacacagu

SEQ ID NO: 1240508 - RNA, 23 nt, Homo sapiens
ccaauuuauaaugaauacuuucu

SEQ ID NO: 1240509 - RNA, 19 nt, Homo sapiens
ccaauuucucuuuacuuga

SEQ ID NO: 1240510 - RNA, 23 nt, Homo sapiens
ccaauuugguaaaaaugcugcuc

SEQ ID NO: 1240511 - RNA, 21 nt, Homo sapiens
ccacaaaggccaaacugcugg

SEQ ID NO: 1240512 - RNA, 21 nt, Homo sapiens
ccacaaaugggaaaaccagac

SEQ ID NO: 1240513 - RNA, 15 nt, Homo sapiens
ccacaacaacaaaag

SEQ ID NO: 1240514 - RNA, 17 nt, Homo sapiens
ccacaaccaaaaaauuc

SEQ ID NO: 1240515 - RNA, 17 nt, Homo sapiens
ccacaacugacacagga

SEQ ID NO: 1240516 - RNA, 18 nt, Homo sapiens
ccacaacugacacaggaa

SEQ ID NO: 1240517 - RNA, 12 nt, Homo sapiens
ccacaacuuuaa

SEQ ID NO: 1240518 - RNA, 18 nt, Homo sapiens
ccacaaguccuuguucca

SEQ ID NO: 1240519 - RNA, 14 nt, Homo sapiens
ccacaagucuucca

SEQ ID NO: 1240520 - RNA, 21 nt, Homo sapiens
ccacaauagcagacaguguuu

SEQ ID NO: 1240521 - RNA, 14 nt, Homo sapiens
ccacaauggucuca

SEQ ID NO: 1240522 - RNA, 19 nt, Homo sapiens
ccacaauggucucagccua

SEQ ID NO: 1240523 - RNA, 19 nt, Homo sapiens
ccacacaaauaggcucugc

SEQ ID NO: 1240524 - RNA, 11 nt, Homo sapiens
ccacacaagcg

SEQ ID NO: 1240525 - RNA, 21 nt, Homo sapiens
ccacacaagggaaggacagaa

SEQ ID NO: 1240526 - RNA, 15 nt, Homo sapiens
ccacacagacuccac

SEQ ID NO: 1240527 - RNA, 12 nt, Homo sapiens
ccacacauauug

SEQ ID NO: 1240528 - RNA, 15 nt, Homo sapiens
ccacacauauugcac

SEQ ID NO: 1240529 - RNA, 14 nt, Homo sapiens
ccacaccaagcagc

SEQ ID NO: 1240530 - RNA, 20 nt, Homo sapiens
ccacaccacaaccaccuuca

SEQ ID NO: 1240531 - RNA, 15 nt, Homo sapiens
ccacaccacagcaga

SEQ ID NO: 1240532 - RNA, 18 nt, Homo sapiens
ccacacccacuuugucca

SEQ ID NO: 1240533 - RNA, 15 nt, Homo sapiens
ccacacccagcucag

SEQ ID NO: 1240534 - RNA, 18 nt, Homo sapiens
ccacaccuccacaguuca

SEQ ID NO: 1240535 - RNA, 22 nt, Homo sapiens
ccacaccuggcccuugcaaucu

SEQ ID NO: 1240536 - RNA, 16 nt, Homo sapiens
ccacacggaggcaucu

SEQ ID NO: 1240537 - RNA, 23 nt, Homo sapiens
ccaugcaauuuuauuaaaugcau

SEQ ID NO: 1240538 - RNA, 23 nt, Homo sapiens
ccaugcacccucauacacagaaa

SEQ ID NO: 1240539 - RNA, 16 nt, Homo sapiens
ccaugcacucaaagau

SEQ ID NO: 1240540 - RNA, 22 nt, Homo sapiens
ccaugcaggggucagugcagca

SEQ ID NO: 1240541 - RNA, 21 nt, Homo sapiens
ccaugccacugccaggcaccu

SEQ ID NO: 1240542 - RNA, 21 nt, Homo sapiens
ccaugccaggaaccuguccua

SEQ ID NO: 1240543 - RNA, 20 nt, Homo sapiens
ccaugcucccuuaaucccca

SEQ ID NO: 1240544 - RNA, 16 nt, Homo sapiens
ccaugcugugcugugu

SEQ ID NO: 1240545 - RNA, 22 nt, Homo sapiens
ccauggaaggaagaaaagcugc

SEQ ID NO: 1240546 - RNA, 22 nt, Homo sapiens
ccauggacacuccagugccagc

SEQ ID NO: 1240547 - RNA, 13 nt, Homo sapiens
ccauggcacugac

SEQ ID NO: 1240548 - RNA, 16 nt, Homo sapiens
ccauggcccccaauaa

SEQ ID NO: 1240549 - RNA, 13 nt, Homo sapiens
ccauggugagcuc

SEQ ID NO: 1240550 - RNA, 15 nt, Homo sapiens
ccauggugcacaaaa

SEQ ID NO: 1240551 - RNA, 23 nt, Homo sapiens
ccauguacucaaguaccaccaag

SEQ ID NO: 1240552 - RNA, 17 nt, Homo sapiens
ccauguauuuaucucua

SEQ ID NO: 1240553 - RNA, 13 nt, Homo sapiens
ccauguccaaaga

SEQ ID NO: 1240554 - RNA, 23 nt, Homo sapiens
ccauguggcugaagacauuccaa

SEQ ID NO: 1240555 - RNA, 23 nt, Homo sapiens
ccauguucugcccccagcccaaa

SEQ ID NO: 1240556 - RNA, 21 nt, Homo sapiens
ccauguuuagugaaugacuuu

SEQ ID NO: 1240557 - RNA, 13 nt, Homo sapiens
ccauuacuuugau

SEQ ID NO: 1240558 - RNA, 22 nt, Homo sapiens
ccauuacuuugauaucugauca

SEQ ID NO: 1240559 - RNA, 21 nt, Homo sapiens
ccauuauuuugguuuaucuuc

SEQ ID NO: 1240560 - RNA, 13 nt, Homo sapiens
ccauucacaccag

SEQ ID NO: 1240561 - RNA, 17 nt, Homo sapiens
ccauuccagacugcuuc

SEQ ID NO: 1240562 - RNA, 19 nt, Homo sapiens
ccauucugccgcccccucc

SEQ ID NO: 1240563 - RNA, 17 nt, Homo sapiens
ccauucuggacaccagg

SEQ ID NO: 1240564 - RNA, 13 nt, Homo sapiens
ccauugcucuuga

SEQ ID NO: 1240565 - RNA, 21 nt, Homo sapiens
ccauuggaauggaccuuucag

SEQ ID NO: 1240566 - RNA, 16 nt, Homo sapiens
ccauuuacacuuuuga

SEQ ID NO: 1240567 - RNA, 13 nt, Homo sapiens
ccauuuacagucu

SEQ ID NO: 1240568 - RNA, 21 nt, Homo sapiens
ccauuuauaauguuaguagaa

SEQ ID NO: 1240569 - RNA, 22 nt, Homo sapiens
ccauuuauaauguuaguagaaa

SEQ ID NO: 1240570 - RNA, 17 nt, Homo sapiens
ccauuuauccacaggaa

SEQ ID NO: 1240571 - RNA, 23 nt, Homo sapiens
ccauuuccaaaccuccacugcug

SEQ ID NO: 1240572 - RNA, 13 nt, Homo sapiens
ccauuuccugaga

SEQ ID NO: 1240573 - RNA, 19 nt, Homo sapiens
ccauuucugaacuguuaca

SEQ ID NO: 1240574 - RNA, 12 nt, Homo sapiens
ccauuugauacc

SEQ ID NO: 1240575 - RNA, 23 nt, Homo sapiens
ccauuuuaauuuuaaagugcaaa

SEQ ID NO: 1240576 - RNA, 21 nt, Homo sapiens
ccauuuucaacugcuuugaaa

SEQ ID NO: 1240577 - RNA, 23 nt, Homo sapiens
ccauuuucuuauugcgcugcuac

SEQ ID NO: 1240578 - RNA, 18 nt, Homo sapiens
ccauuuugugaauuguga

SEQ ID NO: 1240579 - RNA, 20 nt, Homo sapiens
ccauuuuuacauccaugaaa

SEQ ID NO: 1240580 - RNA, 17 nt, Homo sapiens
ccauuuuuuaauaaaga

SEQ ID NO: 1240581 - RNA, 17 nt, Homo sapiens
cccaaaaauuacuuugg

SEQ ID NO: 1240582 - RNA, 18 nt, Homo sapiens
cccaaacagugggcugcu

SEQ ID NO: 1240583 - RNA, 19 nt, Homo sapiens
cccaaacuggagugcagug

SEQ ID NO: 1240584 - RNA, 17 nt, Homo sapiens
cccaaauggcagggaua

SEQ ID NO: 1240585 - RNA, 20 nt, Homo sapiens
cccaaauuaagaaucuagga

SEQ ID NO: 1240586 - RNA, 16 nt, Homo sapiens
cccaaccuucuuguca

SEQ ID NO: 1240587 - RNA, 14 nt, Homo sapiens
cccaacucuuacuc

SEQ ID NO: 1240588 - RNA, 22 nt, Homo sapiens
cccaagagauuguuguuugcca

SEQ ID NO: 1240589 - RNA, 22 nt, Homo sapiens
cccaagaggacugagacuggca

SEQ ID NO: 1240590 - RNA, 18 nt, Homo sapiens
cccaagcacuucacagcu

SEQ ID NO: 1240591 - RNA, 23 nt, Homo sapiens
cccaagccugggcuugagcugca

SEQ ID NO: 1240592 - RNA, 22 nt, Homo sapiens
cccaagcugccucugggccaug

SEQ ID NO: 1240593 - RNA, 18 nt, Homo sapiens
cccaaggcucaugguccu

SEQ ID NO: 1240594 - RNA, 18 nt, Homo sapiens
cccaaggugcugauguca

SEQ ID NO: 1240595 - RNA, 15 nt, Homo sapiens
cccaaguccucauuu

SEQ ID NO: 1240596 - RNA, 19 nt, Homo sapiens
cccaagugaggagugccag

SEQ ID NO: 1240597 - RNA, 17 nt, Homo sapiens
cccaaguucaugcagcu

SEQ ID NO: 1240598 - RNA, 19 nt, Homo sapiens
cccaaguuccaaaagcaca

SEQ ID NO: 1240599 - RNA, 20 nt, Homo sapiens
cccaaugcacauccauuccc

SEQ ID NO: 1240600 - RNA, 22 nt, Homo sapiens
cccaaugcacauccauucccaa

SEQ ID NO: 1240601 - RNA, 19 nt, Homo sapiens
cccaauuacagggugacuc

SEQ ID NO: 1240602 - RNA, 23 nt, Homo sapiens
cccacaaucuggcuuagugccac

SEQ ID NO: 1240603 - RNA, 10 nt, Homo sapiens
cccacaccca

SEQ ID NO: 1240604 - RNA, 15 nt, Homo sapiens
cccacagaaccuuca

SEQ ID NO: 1240605 - RNA, 19 nt, Homo sapiens
cccacaguucagaccaaug

SEQ ID NO: 1240606 - RNA, 17 nt, Homo sapiens
cccacauccaacuccag

SEQ ID NO: 1240607 - RNA, 23 nt, Homo sapiens
cccaccaaucuacuuuguugcua

SEQ ID NO: 1240608 - RNA, 19 nt, Homo sapiens
cccaccagcaauacaaaga

SEQ ID NO: 1240609 - RNA, 15 nt, Homo sapiens
cccaccaucaugucu

SEQ ID NO: 1240610 - RNA, 14 nt, Homo sapiens
cccacccacaugug

SEQ ID NO: 1240611 - RNA, 17 nt, Homo sapiens
cccacccccuucucugc

SEQ ID NO: 1240612 - RNA, 21 nt, Homo sapiens
cccacccccuucucugcucca

SEQ ID NO: 1240613 - RNA, 16 nt, Homo sapiens
cccacccugcugccuu

SEQ ID NO: 1240614 - RNA, 14 nt, Homo sapiens
cccacccugugcca

SEQ ID NO: 1240615 - RNA, 15 nt, Homo sapiens
cccaccgguccagcu

SEQ ID NO: 1240616 - RNA, 22 nt, Homo sapiens
cccacgaagacaaccaucacac

SEQ ID NO: 1240617 - RNA, 19 nt, Homo sapiens
cccacgcuggagugcagug

SEQ ID NO: 1240618 - RNA, 12 nt, Homo sapiens
cccacggcaccu

SEQ ID NO: 1240619 - RNA, 19 nt, Homo sapiens
cccacggcaccucggggac

SEQ ID NO: 1240620 - RNA, 21 nt, Homo sapiens
cccacgggaaaggagcugcuu

SEQ ID NO: 1240621 - RNA, 18 nt, Homo sapiens
cccacgugucuuccacuu

SEQ ID NO: 1240622 - RNA, 22 nt, Homo sapiens
cccacucccuggcucucagaag

SEQ ID NO: 1240623 - RNA, 19 nt, Homo sapiens
cccacuguuucucuugagc

SEQ ID NO: 1240624 - RNA, 16 nt, Homo sapiens
cccacuugacacuauu

SEQ ID NO: 1240625 - RNA, 17 nt, Homo sapiens
cccagaaacagugugca

SEQ ID NO: 1240626 - RNA, 19 nt, Homo sapiens
cccagaaacagugugcaug

SEQ ID NO: 1240627 - RNA, 14 nt, Homo sapiens
cccagaauagcuuu

SEQ ID NO: 1240628 - RNA, 23 nt, Homo sapiens
cccagacacuggcguuacugcuu

SEQ ID NO: 1240629 - RNA, 20 nt, Homo sapiens
cccagagaagcaaguggcuu

SEQ ID NO: 1240630 - RNA, 13 nt, Homo sapiens
cccagagcacugg

SEQ ID NO: 1240631 - RNA, 15 nt, Homo sapiens
cccagagcacuuuag

SEQ ID NO: 1240632 - RNA, 15 nt, Homo sapiens
cccagagcagggugu

SEQ ID NO: 1240633 - RNA, 21 nt, Homo sapiens
cccagaggcucagcacuuugg

SEQ ID NO: 1240634 - RNA, 18 nt, Homo sapiens
cuaagcuauucaguaaua

SEQ ID NO: 1240635 - RNA, 16 nt, Homo sapiens
cuaagcugugugcagg

SEQ ID NO: 1240636 - RNA, 14 nt, Homo sapiens
cuaaggaucucuca

SEQ ID NO: 1240637 - RNA, 21 nt, Homo sapiens
cuaaggaugucacagggccaa

SEQ ID NO: 1240638 - RNA, 20 nt, Homo sapiens
cuaaggcucugagagucuag

SEQ ID NO: 1240639 - RNA, 15 nt, Homo sapiens
cuaagugcccaaagu

SEQ ID NO: 1240640 - RNA, 13 nt, Homo sapiens
cuaagugcuuauu

SEQ ID NO: 1240641 - RNA, 20 nt, Homo sapiens
cuaagugggagaaggacuau

SEQ ID NO: 1240642 - RNA, 15 nt, Homo sapiens
cuaaguuauuuacuu

SEQ ID NO: 1240643 - RNA, 17 nt, Homo sapiens
cuaaguuauuuacuuuu

SEQ ID NO: 1240644 - RNA, 19 nt, Homo sapiens
cuaaguuauuuacuuuuac

SEQ ID NO: 1240645 - RNA, 16 nt, Homo sapiens
cuaauaaaacuuugac

SEQ ID NO: 1240646 - RNA, 18 nt, Homo sapiens
cuaauaaaauauaaucua

SEQ ID NO: 1240647 - RNA, 20 nt, Homo sapiens
cuaauaaauauacuaugaaa

SEQ ID NO: 1240648 - RNA, 13 nt, Homo sapiens
cuaauaacagugc

SEQ ID NO: 1240649 - RNA, 15 nt, Homo sapiens
cuaauaagcaguaug

SEQ ID NO: 1240650 - RNA, 14 nt, Homo sapiens
cuaauacuaauuca

SEQ ID NO: 1240651 - RNA, 22 nt, Homo sapiens
cuaauagaauaaaggcaguuuu

SEQ ID NO: 1240652 - RNA, 14 nt, Homo sapiens
cuaauagagauuaa

SEQ ID NO: 1240653 - RNA, 16 nt, Homo sapiens
cuaauagcauugucau

SEQ ID NO: 1240654 - RNA, 16 nt, Homo sapiens
cuaauagucuuugcca

SEQ ID NO: 1240655 - RNA, 17 nt, Homo sapiens
cuaauaugacauaugac

SEQ ID NO: 1240656 - RNA, 13 nt, Homo sapiens
cuaauaugccuag

SEQ ID NO: 1240657 - RNA, 19 nt, Homo sapiens
cuaaucaaagccagggucu

SEQ ID NO: 1240658 - RNA, 16 nt, Homo sapiens
cuaaucagugucucac

SEQ ID NO: 1240659 - RNA, 17 nt, Homo sapiens
cuaaucuaacaauggaa

SEQ ID NO: 1240660 - RNA, 12 nt, Homo sapiens
cuaaugggacac

SEQ ID NO: 1240661 - RNA, 22 nt, Homo sapiens
cuaaugucucacuguucugcaa

SEQ ID NO: 1240662 - RNA, 22 nt, Homo sapiens
cuaaugugaaaaucaucacuca

SEQ ID NO: 1240663 - RNA, 11 nt, Homo sapiens
cuaaugugcau

SEQ ID NO: 1240664 - RNA, 14 nt, Homo sapiens
cuaaugugcauuaa

SEQ ID NO: 1240665 - RNA, 22 nt, Homo sapiens
cuaaugugcauuaaaacaaauc

SEQ ID NO: 1240666 - RNA, 23 nt, Homo sapiens
cuaauuaaaaaacacaucuggcc

SEQ ID NO: 1240667 - RNA, 15 nt, Homo sapiens
cuaauuacauuucac

SEQ ID NO: 1240668 - RNA, 23 nt, Homo sapiens
cuaauuagaaaauauaguuugag

SEQ ID NO: 1240669 - RNA, 17 nt, Homo sapiens
cuaauucacagugcucu

SEQ ID NO: 1240670 - RNA, 16 nt, Homo sapiens
cuaauuccauccauaa

SEQ ID NO: 1240671 - RNA, 21 nt, Homo sapiens
cuaauucccauuuugcaaaau

SEQ ID NO: 1240672 - RNA, 18 nt, Homo sapiens
cuaauuuauaacuauuau

SEQ ID NO: 1240673 - RNA, 15 nt, Homo sapiens
cuaauuuuugcaaau

SEQ ID NO: 1240674 - RNA, 15 nt, Homo sapiens
cuacaaaaaugaagc

SEQ ID NO: 1240675 - RNA, 14 nt, Homo sapiens
cuacaaacacugca

SEQ ID NO: 1240676 - RNA, 23 nt, Homo sapiens
cuacaaacucccacuugucaugu

SEQ ID NO: 1240677 - RNA, 17 nt, Homo sapiens
cuacaaacuucaaagag

SEQ ID NO: 1240678 - RNA, 18 nt, Homo sapiens
cuacaaagcuuugcuaca

SEQ ID NO: 1240679 - RNA, 13 nt, Homo sapiens
cuacaacauguga

SEQ ID NO: 1240680 - RNA, 17 nt, Homo sapiens
cuacaacgaacacaaga

SEQ ID NO: 1240681 - RNA, 20 nt, Homo sapiens
cuacaacuuuuccuaaggca

SEQ ID NO: 1240682 - RNA, 21 nt, Homo sapiens
cuacaauauuaacauaagaaa

SEQ ID NO: 1240683 - RNA, 23 nt, Homo sapiens
cuacacaaauuauaagcauacaa

SEQ ID NO: 1240684 - RNA, 14 nt, Homo sapiens
cuacacacaaacca

SEQ ID NO: 1240685 - RNA, 14 nt, Homo sapiens
cuacacacaguacg

SEQ ID NO: 1240686 - RNA, 17 nt, Homo sapiens
cuacacacucugagucu

SEQ ID NO: 1240687 - RNA, 21 nt, Homo sapiens
cuacacagagcaggacugcac

SEQ ID NO: 1240688 - RNA, 17 nt, Homo sapiens
cuacacccagaccccag

SEQ ID NO: 1240689 - RNA, 16 nt, Homo sapiens
cuacacugauacacuu

SEQ ID NO: 1240690 - RNA, 13 nt, Homo sapiens
cuacacugaugca

SEQ ID NO: 1240691 - RNA, 22 nt, Homo sapiens
cuacagacaccaaguuccguca

SEQ ID NO: 1240692 - RNA, 14 nt, Homo sapiens
cuacagacuaaaga

SEQ ID NO: 1240693 - RNA, 16 nt, Homo sapiens
cuacagagagaaaaau

SEQ ID NO: 1240694 - RNA, 14 nt, Homo sapiens
cuacagaggccaug

SEQ ID NO: 1240695 - RNA, 19 nt, Homo sapiens
cuacagcuaacccucacaa

SEQ ID NO: 1240696 - RNA, 20 nt, Homo sapiens
cuacaggaagcaccccaugc

SEQ ID NO: 1240697 - RNA, 19 nt, Homo sapiens
cuacagggagaaaauccag

SEQ ID NO: 1240698 - RNA, 22 nt, Homo sapiens
cuacagggagaaaauccagguc

SEQ ID NO: 1240699 - RNA, 17 nt, Homo sapiens
cuacagggcuuaggacu

SEQ ID NO: 1240700 - RNA, 20 nt, Homo sapiens
cuacagugaauuuaaucaaa

SEQ ID NO: 1240701 - RNA, 22 nt, Homo sapiens
cuacaucaucuccaaccgguca

SEQ ID NO: 1240702 - RNA, 23 nt, Homo sapiens
cuacaucuucugccuuagucuca

SEQ ID NO: 1240703 - RNA, 14 nt, Homo sapiens
cuacaugacugggc

SEQ ID NO: 1240704 - RNA, 17 nt, Homo sapiens
cuacaugaugcccugcu

SEQ ID NO: 1240705 - RNA, 19 nt, Homo sapiens
cuacauggaguauauguca

SEQ ID NO: 1240706 - RNA, 18 nt, Homo sapiens
cuacauuauggaaucaug

SEQ ID NO: 1240707 - RNA, 20 nt, Homo sapiens
cuacauuuaaaaauacuucu

SEQ ID NO: 1240708 - RNA, 22 nt, Homo sapiens
cuacauuuaaaaauacuucucu

SEQ ID NO: 1240709 - RNA, 14 nt, Homo sapiens
cuaccaaaacaguu

SEQ ID NO: 1240710 - RNA, 21 nt, Homo sapiens
cuaccaaagcaccuuagcugg

SEQ ID NO: 1240711 - RNA, 17 nt, Homo sapiens
cuaccaaauaauuucau

SEQ ID NO: 1240712 - RNA, 15 nt, Homo sapiens
cuaccaagcagcuca

SEQ ID NO: 1240713 - RNA, 17 nt, Homo sapiens
cuaccaguuggccauga

SEQ ID NO: 1240714 - RNA, 15 nt, Homo sapiens
cuaccaucagggaca

SEQ ID NO: 1240715 - RNA, 18 nt, Homo sapiens
cuaccauuugaauuugug

SEQ ID NO: 1240716 - RNA, 17 nt, Homo sapiens
cuauaccuuauccauag

SEQ ID NO: 1240717 - RNA, 18 nt, Homo sapiens
cuauagccuaggugacag

SEQ ID NO: 1240718 - RNA, 11 nt, Homo sapiens
cuauagcucuu

SEQ ID NO: 1240719 - RNA, 19 nt, Homo sapiens
cuauauaaaaaacauaaua

SEQ ID NO: 1240720 - RNA, 19 nt, Homo sapiens
cuauauaauaaagcuacug

SEQ ID NO: 1240721 - RNA, 14 nt, Homo sapiens
cuauaucuuaggua

SEQ ID NO: 1240722 - RNA, 20 nt, Homo sapiens
cuauauucucaguguagggc

SEQ ID NO: 1240723 - RNA, 12 nt, Homo sapiens
cuauauuugcuu

SEQ ID NO: 1240724 - RNA, 13 nt, Homo sapiens
cuaucaacaaaga

SEQ ID NO: 1240725 - RNA, 19 nt, Homo sapiens
cuaucaccucuuaugcaca

SEQ ID NO: 1240726 - RNA, 19 nt, Homo sapiens
cuaucauaauucagcacuu

SEQ ID NO: 1240727 - RNA, 20 nt, Homo sapiens
cuaucauaauucagcacuua

SEQ ID NO: 1240728 - RNA, 20 nt, Homo sapiens
cuaucauggacuacaccagg

SEQ ID NO: 1240729 - RNA, 16 nt, Homo sapiens
cuaucauggcauauaa

SEQ ID NO: 1240730 - RNA, 13 nt, Homo sapiens
cuaucauucucag

SEQ ID NO: 1240731 - RNA, 18 nt, Homo sapiens
cuaucauuggccuccaaa

SEQ ID NO: 1240732 - RNA, 22 nt, Homo sapiens
cuaucauuggccuccaaacaca

SEQ ID NO: 1240733 - RNA, 19 nt, Homo sapiens
cuauccaaaacuaauuucc

SEQ ID NO: 1240734 - RNA, 14 nt, Homo sapiens
cuauccacagagag

SEQ ID NO: 1240735 - RNA, 20 nt, Homo sapiens
cuauccauauuuuacugauc

SEQ ID NO: 1240736 - RNA, 15 nt, Homo sapiens
cuaucccucuccuaa

SEQ ID NO: 1240737 - RNA, 13 nt, Homo sapiens
cuauccugcccag

SEQ ID NO: 1240738 - RNA, 21 nt, Homo sapiens
cuauccugugcuugaugcuag

SEQ ID NO: 1240739 - RNA, 14 nt, Homo sapiens
cuaucgaacuucac

SEQ ID NO: 1240740 - RNA, 13 nt, Homo sapiens
cuaucuccugaca

SEQ ID NO: 1240741 - RNA, 18 nt, Homo sapiens
cuaucugagugaauuaca

SEQ ID NO: 1240742 - RNA, 22 nt, Homo sapiens
cuaucugagugaauuacagaca

SEQ ID NO: 1240743 - RNA, 20 nt, Homo sapiens
cuaucugauuuccuaauguc

SEQ ID NO: 1240744 - RNA, 20 nt, Homo sapiens
cuaucugcuguauauggaau

SEQ ID NO: 1240745 - RNA, 19 nt, Homo sapiens
cuaucugggcugugggcaa

SEQ ID NO: 1240746 - RNA, 13 nt, Homo sapiens
cuaugaacaacuc

SEQ ID NO: 1240747 - RNA, 16 nt, Homo sapiens
cuaugaacuucucuca

SEQ ID NO: 1240748 - RNA, 17 nt, Homo sapiens
cuaugaauuuucaagua

SEQ ID NO: 1240749 - RNA, 14 nt, Homo sapiens
cuaugagccaggca

SEQ ID NO: 1240750 - RNA, 18 nt, Homo sapiens
cuaugaggggguuuggca

SEQ ID NO: 1240751 - RNA, 12 nt, Homo sapiens
cuaugagucuag

SEQ ID NO: 1240752 - RNA, 17 nt, Homo sapiens
cuaugcaagccuugcua

SEQ ID NO: 1240753 - RNA, 23 nt, Homo sapiens
cuaugcaauuuuucaagagcucc

SEQ ID NO: 1240754 - RNA, 11 nt, Homo sapiens
cuaugggacuc

SEQ ID NO: 1240755 - RNA, 14 nt, Homo sapiens
cuaugggugagcau

SEQ ID NO: 1240756 - RNA, 22 nt, Homo sapiens
cuauguacugccuuagugcuga

SEQ ID NO: 1240757 - RNA, 22 nt, Homo sapiens
cuauguauggaauacaguguua

SEQ ID NO: 1240758 - RNA, 13 nt, Homo sapiens
cuaugugauuaca

SEQ ID NO: 1240759 - RNA, 14 nt, Homo sapiens
cuaugugauuacaa

SEQ ID NO: 1240760 - RNA, 20 nt, Homo sapiens
cuauguggcugaaaaugcaa

SEQ ID NO: 1240761 - RNA, 18 nt, Homo sapiens
cuauguuucacugugcaa

SEQ ID NO: 1240762 - RNA, 20 nt, Homo sapiens
cuauuaaaacagccaaaacu

SEQ ID NO: 1240763 - RNA, 16 nt, Homo sapiens
cuauuaauacucugca

SEQ ID NO: 1240764 - RNA, 14 nt, Homo sapiens
ccagcucauucuca

SEQ ID NO: 1240765 - RNA, 18 nt, Homo sapiens
ccagcugcaccugccagc

SEQ ID NO: 1240766 - RNA, 21 nt, Homo sapiens
ccagcuggccuggacaguauc

SEQ ID NO: 1240767 - RNA, 22 nt, Homo sapiens
ccagcugugcacuuucuucucu

SEQ ID NO: 1240768 - RNA, 12 nt, Homo sapiens
ccagcugugcug

SEQ ID NO: 1240769 - RNA, 22 nt, Homo sapiens
ccagcugugggacaauuaucug

SEQ ID NO: 1240770 - RNA, 18 nt, Homo sapiens
ccagcuuaugagcucaaa

SEQ ID NO: 1240771 - RNA, 20 nt, Homo sapiens
ccagcuucaggcaccagcau

SEQ ID NO: 1240772 - RNA, 12 nt, Homo sapiens
ccaggaaggcag

SEQ ID NO: 1240773 - RNA, 15 nt, Homo sapiens
ccaggaaggcagcug

SEQ ID NO: 1240774 - RNA, 13 nt, Homo sapiens
ccaggaaugccuc

SEQ ID NO: 1240775 - RNA, 12 nt, Homo sapiens
ccaggaauuuga

SEQ ID NO: 1240776 - RNA, 15 nt, Homo sapiens
ccaggaccaagccac

SEQ ID NO: 1240777 - RNA, 19 nt, Homo sapiens
ccaggacgcccucacugca

SEQ ID NO: 1240778 - RNA, 22 nt, Homo sapiens
ccaggacggggcacaaguguca

SEQ ID NO: 1240779 - RNA, 18 nt, Homo sapiens
ccaggacuccacuggaca

SEQ ID NO: 1240780 - RNA, 20 nt, Homo sapiens
ccaggagaacaucuuugaca

SEQ ID NO: 1240781 - RNA, 23 nt, Homo sapiens
ccaggagacagacagagaaggca

SEQ ID NO: 1240782 - RNA, 16 nt, Homo sapiens
ccaggagagagccagg

SEQ ID NO: 1240783 - RNA, 18 nt, Homo sapiens
ccaggagcaggcacgggu

SEQ ID NO: 1240784 - RNA, 13 nt, Homo sapiens
ccaggagcucuuc

SEQ ID NO: 1240785 - RNA, 21 nt, Homo sapiens
ccaggagguugagaaugcagu

SEQ ID NO: 1240786 - RNA, 17 nt, Homo sapiens
ccaggaguagugagcug

SEQ ID NO: 1240787 - RNA, 20 nt, Homo sapiens
ccaggaucaugguguaauaa

SEQ ID NO: 1240788 - RNA, 22 nt, Homo sapiens
ccaggauccagaagggguuugg

SEQ ID NO: 1240789 - RNA, 20 nt, Homo sapiens
ccaggauuauugucaaagaa

SEQ ID NO: 1240790 - RNA, 14 nt, Homo sapiens
ccaggcacugcugc

SEQ ID NO: 1240791 - RNA, 17 nt, Homo sapiens
ccaggcaggugccugga

SEQ ID NO: 1240792 - RNA, 20 nt, Homo sapiens
ccaggccacccaaaggagcu

SEQ ID NO: 1240793 - RNA, 23 nt, Homo sapiens
ccaggcccagaaggaaccagcca

SEQ ID NO: 1240794 - RNA, 18 nt, Homo sapiens
ccaggccuguugcuauag

SEQ ID NO: 1240795 - RNA, 19 nt, Homo sapiens
ccaggcugcacugcaguga

SEQ ID NO: 1240796 - RNA, 22 nt, Homo sapiens
ccaggcugccuggucacugccc

SEQ ID NO: 1240797 - RNA, 16 nt, Homo sapiens
ccaggcuggagugcaa

SEQ ID NO: 1240798 - RNA, 17 nt, Homo sapiens
ccaggcuggagugcaau

SEQ ID NO: 1240799 - RNA, 19 nt, Homo sapiens
ccaggcuggagugcaaugc

SEQ ID NO: 1240800 - RNA, 20 nt, Homo sapiens
ccaggcuggagugcaguggu

SEQ ID NO: 1240801 - RNA, 15 nt, Homo sapiens
ccaggcugugcagcg

SEQ ID NO: 1240802 - RNA, 21 nt, Homo sapiens
ccaggcuucacccugaauggu

SEQ ID NO: 1240803 - RNA, 19 nt, Homo sapiens
ccagggacaaaacacugug

SEQ ID NO: 1240804 - RNA, 15 nt, Homo sapiens
ccagggagcaagaca

SEQ ID NO: 1240805 - RNA, 18 nt, Homo sapiens
ccagggagggaaguguga

SEQ ID NO: 1240806 - RNA, 17 nt, Homo sapiens
ccagggcagugcuagug

SEQ ID NO: 1240807 - RNA, 12 nt, Homo sapiens
ccagggccagug

SEQ ID NO: 1240808 - RNA, 19 nt, Homo sapiens
ccagggccugggggcagug

SEQ ID NO: 1240809 - RNA, 16 nt, Homo sapiens
ccagggcugcccugag

SEQ ID NO: 1240810 - RNA, 22 nt, Homo sapiens
ccaggggaaccugccaugccag

SEQ ID NO: 1240811 - RNA, 13 nt, Homo sapiens
ccagggucucacu

SEQ ID NO: 1240812 - RNA, 14 nt, Homo sapiens
ccaggguuuugccc

SEQ ID NO: 1240813 - RNA, 20 nt, Homo sapiens
ccagguaagggggugcagca

SEQ ID NO: 1240814 - RNA, 15 nt, Homo sapiens
ccaggucucacgggc

SEQ ID NO: 1240815 - RNA, 20 nt, Homo sapiens
ccaggucuccggaggagaca

SEQ ID NO: 1240816 - RNA, 12 nt, Homo sapiens
ccaggucuucca

SEQ ID NO: 1240817 - RNA, 15 nt, Homo sapiens
ccaggugagcucuga

SEQ ID NO: 1240818 - RNA, 20 nt, Homo sapiens
ccagguuuuuggucugaccc

SEQ ID NO: 1240819 - RNA, 10 nt, Homo sapiens
ccaguaccau

SEQ ID NO: 1240820 - RNA, 18 nt, Homo sapiens
ccaguacuuccugcagua

SEQ ID NO: 1240821 - RNA, 14 nt, Homo sapiens
ccaguauuaugcau

SEQ ID NO: 1240822 - RNA, 21 nt, Homo sapiens
ccagucacaugaccugaucac

SEQ ID NO: 1240823 - RNA, 20 nt, Homo sapiens
ccaguccuguuugcagggaa

SEQ ID NO: 1240824 - RNA, 21 nt, Homo sapiens
ccagucuuccugacacuuuaa

SEQ ID NO: 1240825 - RNA, 15 nt, Homo sapiens
ccagugaaaugugaa

SEQ ID NO: 1240826 - RNA, 20 nt, Homo sapiens
ccagugaccccugaccucac

SEQ ID NO: 1240827 - RNA, 23 nt, Homo sapiens
ccagugaggucggggauuuugag

SEQ ID NO: 1240828 - RNA, 13 nt, Homo sapiens
ccagugcagccac

SEQ ID NO: 1240829 - RNA, 15 nt, Homo sapiens
ccagugccagcaccu

SEQ ID NO: 1240830 - RNA, 15 nt, Homo sapiens
ccagugccaggccag

SEQ ID NO: 1240831 - RNA, 17 nt, Homo sapiens
ccagugccaggccagug

SEQ ID NO: 1240832 - RNA, 11 nt, Homo sapiens
ccagugccauu

SEQ ID NO: 1240833 - RNA, 15 nt, Homo sapiens
ccagugccauuccac

SEQ ID NO: 1240834 - RNA, 17 nt, Homo sapiens
ccaguguaugucuugua

SEQ ID NO: 1240835 - RNA, 18 nt, Homo sapiens
ccaguguucuaugaacaa

SEQ ID NO: 1240836 - RNA, 12 nt, Homo sapiens
ccaguguucucc

SEQ ID NO: 1240837 - RNA, 13 nt, Homo sapiens
ccaguguuuacaa

SEQ ID NO: 1240838 - RNA, 14 nt, Homo sapiens
ccaguuaugaauca

SEQ ID NO: 1240839 - RNA, 23 nt, Homo sapiens
ccaguucuacuauggcugaguuc

SEQ ID NO: 1240840 - RNA, 15 nt, Homo sapiens
ccaguucugucuuca

SEQ ID NO: 1240841 - RNA, 23 nt, Homo sapiens
ccaguuucagagaaauacuuuca

SEQ ID NO: 1240842 - RNA, 23 nt, Homo sapiens
ccaguuuggguaaaauacuuuua

SEQ ID NO: 1240843 - RNA, 22 nt, Homo sapiens
ccauaaaaauaaaucaguucau

SEQ ID NO: 1240844 - RNA, 22 nt, Homo sapiens
ccauaaacgguuccuggugacu

SEQ ID NO: 1240845 - RNA, 23 nt, Homo sapiens
ccauaagaggugaucucugggag

SEQ ID NO: 1240846 - RNA, 18 nt, Homo sapiens
ccauaauaauaauuugca

SEQ ID NO: 1240847 - RNA, 21 nt, Homo sapiens
ccauaauugcuuugccaaaau

SEQ ID NO: 1240848 - RNA, 19 nt, Homo sapiens
ccauaauuuauuuugucca

SEQ ID NO: 1240849 - RNA, 18 nt, Homo sapiens
ccauacacacuguuguca

SEQ ID NO: 1240850 - RNA, 18 nt, Homo sapiens
ccauacuuugucugaaaa

SEQ ID NO: 1240851 - RNA, 16 nt, Homo sapiens
ccauagcuuccaugag

SEQ ID NO: 1240852 - RNA, 21 nt, Homo sapiens
ccauaggacauacugcaugua

SEQ ID NO: 1240853 - RNA, 22 nt, Homo sapiens
ccauaggguccugaauguuuca

SEQ ID NO: 1240854 - RNA, 21 nt, Homo sapiens
ccauaguaguaugaugauaca

SEQ ID NO: 1240855 - RNA, 14 nt, Homo sapiens
ccauaguauaauca

SEQ ID NO: 1240856 - RNA, 21 nt, Homo sapiens
ccauauauaacagauacauuu

SEQ ID NO: 1240857 - RNA, 19 nt, Homo sapiens
ccauaucccuuccucucag

SEQ ID NO: 1240858 - RNA, 17 nt, Homo sapiens
ccauauucauguaaaca

SEQ ID NO: 1240859 - RNA, 22 nt, Homo sapiens
ccauauugugcuucacaguaga

SEQ ID NO: 1240860 - RNA, 17 nt, Homo sapiens
ccauauuugauaguaua

SEQ ID NO: 1240861 - RNA, 18 nt, Homo sapiens
ccauauuugugccauucu

SEQ ID NO: 1240862 - RNA, 23 nt, Homo sapiens
ccauauuuguggcccgugcagcu

SEQ ID NO: 1240863 - RNA, 14 nt, Homo sapiens
cucagcggugccac

SEQ ID NO: 1240864 - RNA, 17 nt, Homo sapiens
cucagcucaaccacagu

SEQ ID NO: 1240865 - RNA, 20 nt, Homo sapiens
cucagcugguuacucagggu

SEQ ID NO: 1240866 - RNA, 16 nt, Homo sapiens
cucagcuguccagcug

SEQ ID NO: 1240867 - RNA, 19 nt, Homo sapiens
cucagcuguccagcugcaa

SEQ ID NO: 1240868 - RNA, 15 nt, Homo sapiens
cucagcuguccugca

SEQ ID NO: 1240869 - RNA, 20 nt, Homo sapiens
cucagcuucucaaaguacug

SEQ ID NO: 1240870 - RNA, 15 nt, Homo sapiens
cucagcuucuucaca

SEQ ID NO: 1240871 - RNA, 17 nt, Homo sapiens
cucagcuuuauaacaaa

SEQ ID NO: 1240872 - RNA, 13 nt, Homo sapiens
cucaggaugcauc

SEQ ID NO: 1240873 - RNA, 17 nt, Homo sapiens
cucaggcaccugcacuu

SEQ ID NO: 1240874 - RNA, 15 nt, Homo sapiens
cucaggcuugaaaug

SEQ ID NO: 1240875 - RNA, 16 nt, Homo sapiens
cucagggagcagggaa

SEQ ID NO: 1240876 - RNA, 21 nt, Homo sapiens
cucaggugaucuaccugccuc

SEQ ID NO: 1240877 - RNA, 15 nt, Homo sapiens
cucagguucuuucca

SEQ ID NO: 1240878 - RNA, 17 nt, Homo sapiens
cucaguaaaauguuuaa

SEQ ID NO: 1240879 - RNA, 17 nt, Homo sapiens
cucaguagagaucuaua

SEQ ID NO: 1240880 - RNA, 21 nt, Homo sapiens
cucagucauccugcaggcaca

SEQ ID NO: 1240881 - RNA, 15 nt, Homo sapiens
cucaguccacugcug

SEQ ID NO: 1240882 - RNA, 13 nt, Homo sapiens
cucaguccuguac

SEQ ID NO: 1240883 - RNA, 15 nt, Homo sapiens
cucagugucauuuau

SEQ ID NO: 1240884 - RNA, 21 nt, Homo sapiens
cucaguguuuuggacuccauc

SEQ ID NO: 1240885 - RNA, 23 nt, Homo sapiens
cucaguuauuacauguaauuuga

SEQ ID NO: 1240886 - RNA, 17 nt, Homo sapiens
cucaguucccucuugcu

SEQ ID NO: 1240887 - RNA, 21 nt, Homo sapiens
cucaguuggaaucauugcuaa

SEQ ID NO: 1240888 - RNA, 14 nt, Homo sapiens
cucaguuugcauau

SEQ ID NO: 1240889 - RNA, 20 nt, Homo sapiens
cucauaaaauggaagcaauu

SEQ ID NO: 1240890 - RNA, 18 nt, Homo sapiens
cucauacugucugggauu

SEQ ID NO: 1240891 - RNA, 19 nt, Homo sapiens
cucauaucaugguagucac

SEQ ID NO: 1240892 - RNA, 13 nt, Homo sapiens
cucauauugugau

SEQ ID NO: 1240893 - RNA, 16 nt, Homo sapiens
cucaucaacacaguga

SEQ ID NO: 1240894 - RNA, 21 nt, Homo sapiens
cucaucaacugaaugagguca

SEQ ID NO: 1240895 - RNA, 17 nt, Homo sapiens
cucaucagaaaugucau

SEQ ID NO: 1240896 - RNA, 15 nt, Homo sapiens
cucaucagcuuuauu

SEQ ID NO: 1240897 - RNA, 14 nt, Homo sapiens
cucaucccaugaga

SEQ ID NO: 1240898 - RNA, 15 nt, Homo sapiens
cucaucuuacuguac

SEQ ID NO: 1240899 - RNA, 12 nt, Homo sapiens
cucaugagcuga

SEQ ID NO: 1240900 - RNA, 15 nt, Homo sapiens
cucaugccuguaauc

SEQ ID NO: 1240901 - RNA, 21 nt, Homo sapiens
cucaugcugcagaggguacuu

SEQ ID NO: 1240902 - RNA, 20 nt, Homo sapiens
cucauggcagcuaagccaca

SEQ ID NO: 1240903 - RNA, 23 nt, Homo sapiens
cucauggguggcacucagucucu

SEQ ID NO: 1240904 - RNA, 17 nt, Homo sapiens
cucaugguccuuggagg

SEQ ID NO: 1240905 - RNA, 15 nt, Homo sapiens
cucauguggccaagc

SEQ ID NO: 1240906 - RNA, 16 nt, Homo sapiens
cucauguuacucagug

SEQ ID NO: 1240907 - RNA, 21 nt, Homo sapiens
cucauuaucuugcagcuguaa

SEQ ID NO: 1240908 - RNA, 13 nt, Homo sapiens
cucauuccaccuu

SEQ ID NO: 1240909 - RNA, 18 nt, Homo sapiens
cucauuccccaaccacuu

SEQ ID NO: 1240910 - RNA, 13 nt, Homo sapiens
cucauuccuguag

SEQ ID NO: 1240911 - RNA, 18 nt, Homo sapiens
cucauugacaagaacuga

SEQ ID NO: 1240912 - RNA, 23 nt, Homo sapiens
cucauugacaagaacugaaacca

SEQ ID NO: 1240913 - RNA, 20 nt, Homo sapiens
cucauuucuggaaagugcaa

SEQ ID NO: 1240914 - RNA, 19 nt, Homo sapiens
cucauuugucacacacuuu

SEQ ID NO: 1240915 - RNA, 16 nt, Homo sapiens
cucauuuuacacaaag

SEQ ID NO: 1240916 - RNA, 13 nt, Homo sapiens
cuccaaaacccau

SEQ ID NO: 1240917 - RNA, 16 nt, Homo sapiens
cuccaaaguccacaca

SEQ ID NO: 1240918 - RNA, 18 nt, Homo sapiens
cuccaaaguccacacaaa

SEQ ID NO: 1240919 - RNA, 18 nt, Homo sapiens
cuccaaauuuuuuuuacu

SEQ ID NO: 1240920 - RNA, 21 nt, Homo sapiens
cuccaagggacccuuugccuu

SEQ ID NO: 1240921 - RNA, 23 nt, Homo sapiens
cuccaaggguuucgacuggucca

SEQ ID NO: 1240922 - RNA, 14 nt, Homo sapiens
cuccaaucugguaa

SEQ ID NO: 1240923 - RNA, 17 nt, Homo sapiens
cuccaaugucugcugag

SEQ ID NO: 1240924 - RNA, 17 nt, Homo sapiens
cuccacaccuaccacga

SEQ ID NO: 1240925 - RNA, 19 nt, Homo sapiens
cuccacaccuaccacgacc

SEQ ID NO: 1240926 - RNA, 17 nt, Homo sapiens
cuccacauccuguguca

SEQ ID NO: 1240927 - RNA, 22 nt, Homo sapiens
cuccacaucugccuuaaaacca

SEQ ID NO: 1240928 - RNA, 15 nt, Homo sapiens
cuccacaugcuggug

SEQ ID NO: 1240929 - RNA, 21 nt, Homo sapiens
cuccaccaacuggagcacuga

SEQ ID NO: 1240930 - RNA, 15 nt, Homo sapiens
cuccaccucaccucc

SEQ ID NO: 1240931 - RNA, 14 nt, Homo sapiens
cuccaccugugaga

SEQ ID NO: 1240932 - RNA, 21 nt, Homo sapiens
cuccacgaagccuuaagccau

SEQ ID NO: 1240933 - RNA, 18 nt, Homo sapiens
cuccacucagguucuuca

SEQ ID NO: 1240934 - RNA, 12 nt, Homo sapiens
cuccacugccuc

SEQ ID NO: 1240935 - RNA, 12 nt, Homo sapiens
cuccacugucac

SEQ ID NO: 1240936 - RNA, 13 nt, Homo sapiens
cuccacugucaca

SEQ ID NO: 1240937 - RNA, 20 nt, Homo sapiens
cuccacugugccuuugcaaa

SEQ ID NO: 1240938 - RNA, 13 nt, Homo sapiens
cuuucagggccaa

SEQ ID NO: 1240939 - RNA, 21 nt, Homo sapiens
cuuucauuauuaguacugcuc

SEQ ID NO: 1240940 - RNA, 18 nt, Homo sapiens
cuuucauugccagugucu

SEQ ID NO: 1240941 - RNA, 18 nt, Homo sapiens
cuuuccaauguagcucag

SEQ ID NO: 1240942 - RNA, 21 nt, Homo sapiens
cuuuccacauauagagcucca

SEQ ID NO: 1240943 - RNA, 13 nt, Homo sapiens
cuuucccaaauaa

SEQ ID NO: 1240944 - RNA, 22 nt, Homo sapiens
cuuucccagaaaaaaaaaaacu

SEQ ID NO: 1240945 - RNA, 14 nt, Homo sapiens
cuuucccaguccca

SEQ ID NO: 1240946 - RNA, 13 nt, Homo sapiens
cuuucccagugag

SEQ ID NO: 1240947 - RNA, 16 nt, Homo sapiens
cuuuccccuaagcaga

SEQ ID NO: 1240948 - RNA, 13 nt, Homo sapiens
cuuucccuaccuu

SEQ ID NO: 1240949 - RNA, 20 nt, Homo sapiens
cuuucccucgcuaugugcac

SEQ ID NO: 1240950 - RNA, 19 nt, Homo sapiens
cuuucccuucaguacccuc

SEQ ID NO: 1240951 - RNA, 13 nt, Homo sapiens
cuuucccuugugu

SEQ ID NO: 1240952 - RNA, 19 nt, Homo sapiens
cuuucccuuuaucaguuug

SEQ ID NO: 1240953 - RNA, 21 nt, Homo sapiens
cuuuccggcacacugccaaau

SEQ ID NO: 1240954 - RNA, 14 nt, Homo sapiens
cuuuccuacucuca

SEQ ID NO: 1240955 - RNA, 16 nt, Homo sapiens
cuuuccugacuuacaa

SEQ ID NO: 1240956 - RNA, 20 nt, Homo sapiens
cuuuccugguuuucaucagg

SEQ ID NO: 1240957 - RNA, 13 nt, Homo sapiens
cuuuccuuccuaa

SEQ ID NO: 1240958 - RNA, 14 nt, Homo sapiens
cuuuccuuguggca

SEQ ID NO: 1240959 - RNA, 20 nt, Homo sapiens
cuuucgagguggguuuguac

SEQ ID NO: 1240960 - RNA, 18 nt, Homo sapiens
cuuucuaaaauauuucau

SEQ ID NO: 1240961 - RNA, 14 nt, Homo sapiens
cuuucuaaauugca

SEQ ID NO: 1240962 - RNA, 15 nt, Homo sapiens
cuuucuaauguuucu

SEQ ID NO: 1240963 - RNA, 21 nt, Homo sapiens
cuuucucaaucuugaacucau

SEQ ID NO: 1240964 - RNA, 15 nt, Homo sapiens
cuuucucagccacaa

SEQ ID NO: 1240965 - RNA, 13 nt, Homo sapiens
cuuucuccacaga

SEQ ID NO: 1240966 - RNA, 19 nt, Homo sapiens
cuuucuccaggaccaauaa

SEQ ID NO: 1240967 - RNA, 12 nt, Homo sapiens
cuuucucucaga

SEQ ID NO: 1240968 - RNA, 14 nt, Homo sapiens
cuuucucucaguga

SEQ ID NO: 1240969 - RNA, 12 nt, Homo sapiens
cuuucucugcaa

SEQ ID NO: 1240970 - RNA, 18 nt, Homo sapiens
cuuucugccaacuuuguu

SEQ ID NO: 1240971 - RNA, 23 nt, Homo sapiens
cuuucuggaaguuucuggugcca

SEQ ID NO: 1240972 - RNA, 19 nt, Homo sapiens
cuuucuguacaagggagaa

SEQ ID NO: 1240973 - RNA, 15 nt, Homo sapiens
cuuucuguugccaca

SEQ ID NO: 1240974 - RNA, 12 nt, Homo sapiens
cuuucuugcucc

SEQ ID NO: 1240975 - RNA, 18 nt, Homo sapiens
cuuucuuuagcaugcuac

SEQ ID NO: 1240976 - RNA, 14 nt, Homo sapiens
cuuucuuuggugcc

SEQ ID NO: 1240977 - RNA, 16 nt, Homo sapiens
cuuugaaauaccucau

SEQ ID NO: 1240978 - RNA, 21 nt, Homo sapiens
cuuugaaugcuaagaaugcau

SEQ ID NO: 1240979 - RNA, 15 nt, Homo sapiens
cuuugacacucugca

SEQ ID NO: 1240980 - RNA, 13 nt, Homo sapiens
cuuugacaguguu

SEQ ID NO: 1240981 - RNA, 18 nt, Homo sapiens
cuuugacauaacuaggau

SEQ ID NO: 1240982 - RNA, 13 nt, Homo sapiens
cuuugacugaugc

SEQ ID NO: 1240983 - RNA, 21 nt, Homo sapiens
cuuugagaagccuucagcucc

SEQ ID NO: 1240984 - RNA, 15 nt, Homo sapiens
cuuugagauuauucu

SEQ ID NO: 1240985 - RNA, 17 nt, Homo sapiens
cuuugaguagauccauu

SEQ ID NO: 1240986 - RNA, 14 nt, Homo sapiens
gcagaagcagggua

SEQ ID NO: 1240987 - RNA, 20 nt, Homo sapiens
gcagaagcaggguacccuuu

SEQ ID NO: 1240988 - RNA, 14 nt, Homo sapiens
gcagaauccagcua

SEQ ID NO: 1240989 - RNA, 16 nt, Homo sapiens
gcagaauccucaguug

SEQ ID NO: 1240990 - RNA, 17 nt, Homo sapiens
gcagaauugagagugau

SEQ ID NO: 1240991 - RNA, 23 nt, Homo sapiens
gcagaauugagagugauuccuuu

SEQ ID NO: 1240992 - RNA, 17 nt, Homo sapiens
gcagacaacaccuuccu

SEQ ID NO: 1240993 - RNA, 21 nt, Homo sapiens
gcagacaccagcagcccuguc

SEQ ID NO: 1240994 - RNA, 17 nt, Homo sapiens
gcagacaguagacagaa

SEQ ID NO: 1240995 - RNA, 13 nt, Homo sapiens
gcagacagucaca

SEQ ID NO: 1240996 - RNA, 16 nt, Homo sapiens
gcagacccccaugaga

SEQ ID NO: 1240997 - RNA, 15 nt, Homo sapiens
gcagacuacacagga

SEQ ID NO: 1240998 - RNA, 21 nt, Homo sapiens
gcagacucuacagaggccaug

SEQ ID NO: 1240999 - RNA, 21 nt, Homo sapiens
gcagagaacuggaaagacaua

SEQ ID NO: 1241000 - RNA, 21 nt, Homo sapiens
gcagagaagcuguaggacugu

SEQ ID NO: 1241001 - RNA, 21 nt, Homo sapiens
gcagagagggauggguuccug

SEQ ID NO: 1241002 - RNA, 15 nt, Homo sapiens
gcagagaugacuguc

SEQ ID NO: 1241003 - RNA, 19 nt, Homo sapiens
gcagagaugacuguccaag

SEQ ID NO: 1241004 - RNA, 20 nt, Homo sapiens
gcagagcuuguuuuguuuca

SEQ ID NO: 1241005 - RNA, 17 nt, Homo sapiens
gcagaggucagacuaag

SEQ ID NO: 1241006 - RNA, 21 nt, Homo sapiens
gcagagucguuggagacugaa

SEQ ID NO: 1241007 - RNA, 17 nt, Homo sapiens
gcagagucuaccuugaa

SEQ ID NO: 1241008 - RNA, 14 nt, Homo sapiens
gcagauaggagcug

SEQ ID NO: 1241009 - RNA, 17 nt, Homo sapiens
gcagaucugugccccau

SEQ ID NO: 1241010 - RNA, 20 nt, Homo sapiens
gcagaugguggagcugaaua

SEQ ID NO: 1241011 - RNA, 15 nt, Homo sapiens
gcagcaaauuuucag

SEQ ID NO: 1241012 - RNA, 13 nt, Homo sapiens
gcagcagaauugc

SEQ ID NO: 1241013 - RNA, 20 nt, Homo sapiens
gcagcauccuccaaaacuua

SEQ ID NO: 1241014 - RNA, 22 nt, Homo sapiens
gcagcaugcuugggcugaccca

SEQ ID NO: 1241015 - RNA, 22 nt, Homo sapiens
gcagccaacccggcacugcccu

SEQ ID NO: 1241016 - RNA, 16 nt, Homo sapiens
gcagccacaaccaaaa

SEQ ID NO: 1241017 - RNA, 19 nt, Homo sapiens
gcagccacaaccaaaaaau

SEQ ID NO: 1241018 - RNA, 14 nt, Homo sapiens
gcagccagggccag

SEQ ID NO: 1241019 - RNA, 13 nt, Homo sapiens
gcagcccaugccc

SEQ ID NO: 1241020 - RNA, 14 nt, Homo sapiens
gcagcccaugccca

SEQ ID NO: 1241021 - RNA, 21 nt, Homo sapiens
gcagccuaacacggugcucau

SEQ ID NO: 1241022 - RNA, 19 nt, Homo sapiens
gcagccucaaaacggguca

SEQ ID NO: 1241023 - RNA, 13 nt, Homo sapiens
gcagccuuuccag

SEQ ID NO: 1241024 - RNA, 16 nt, Homo sapiens
gcagcgccagugacag

SEQ ID NO: 1241025 - RNA, 16 nt, Homo sapiens
gcagcgguaccccagg

SEQ ID NO: 1241026 - RNA, 14 nt, Homo sapiens
gcagcuaagccaca

SEQ ID NO: 1241027 - RNA, 22 nt, Homo sapiens
gcagcucaagaacacaugugca

SEQ ID NO: 1241028 - RNA, 18 nt, Homo sapiens
gcagcucacggaacugga

SEQ ID NO: 1241029 - RNA, 21 nt, Homo sapiens
gcagcucacggaacuggagaa

SEQ ID NO: 1241030 - RNA, 12 nt, Homo sapiens
gcagcucaggga

SEQ ID NO: 1241031 - RNA, 22 nt, Homo sapiens
gcagcucauuuugucugguccu

SEQ ID NO: 1241032 - RNA, 19 nt, Homo sapiens
gcagcugagaaaaugagug

SEQ ID NO: 1241033 - RNA, 21 nt, Homo sapiens
gcagcuggugcuccaagcaca

SEQ ID NO: 1241034 - RNA, 15 nt, Homo sapiens
gcagcuucaccagag

SEQ ID NO: 1241035 - RNA, 20 nt, Homo sapiens
gcagcuucaccagagcauuu

SEQ ID NO: 1241036 - RNA, 21 nt, Homo sapiens
gcagcuucaccagagcauuuc

SEQ ID NO: 1241037 - RNA, 19 nt, Homo sapiens
gcagcuuuaaacucaggga

SEQ ID NO: 1241038 - RNA, 13 nt, Homo sapiens
gcaggacugcaca

SEQ ID NO: 1241039 - RNA, 17 nt, Homo sapiens
gcaggagaaucacugca

SEQ ID NO: 1241040 - RNA, 18 nt, Homo sapiens
gcaggagaaucacuggaa

SEQ ID NO: 1241041 - RNA, 19 nt, Homo sapiens
gcaggagaaucacuggaac

SEQ ID NO: 1241042 - RNA, 18 nt, Homo sapiens
gcaggagaauggugugaa

SEQ ID NO: 1241043 - RNA, 17 nt, Homo sapiens
gcaggagaauuacuuga

SEQ ID NO: 1241044 - RNA, 14 nt, Homo sapiens
gccaagaacgcagg

SEQ ID NO: 1241045 - RNA, 20 nt, Homo sapiens
gccaagacaaaucaacagaa

SEQ ID NO: 1241046 - RNA, 18 nt, Homo sapiens
gccaagagugaagggaag

SEQ ID NO: 1241047 - RNA, 20 nt, Homo sapiens
gccaagaucgccccacugca

SEQ ID NO: 1241048 - RNA, 22 nt, Homo sapiens
gccaagcuuguuaucagcuuuc

SEQ ID NO: 1241049 - RNA, 18 nt, Homo sapiens
gccaaggcuaauccaauu

SEQ ID NO: 1241050 - RNA, 19 nt, Homo sapiens
gccaagggaaccugugucc

SEQ ID NO: 1241051 - RNA, 18 nt, Homo sapiens
gccaaguaagaaagugaa

SEQ ID NO: 1241052 - RNA, 16 nt, Homo sapiens
gccaaguggggugcug

SEQ ID NO: 1241053 - RNA, 17 nt, Homo sapiens
gccaagugugaccccac

SEQ ID NO: 1241054 - RNA, 21 nt, Homo sapiens
gccaauaaaaaguucagaguu

SEQ ID NO: 1241055 - RNA, 18 nt, Homo sapiens
gccaaucuucaguauuuu

SEQ ID NO: 1241056 - RNA, 14 nt, Homo sapiens
gccaauuagcaauu

SEQ ID NO: 1241057 - RNA, 21 nt, Homo sapiens
gccacaaccugaaagacaaaa

SEQ ID NO: 1241058 - RNA, 15 nt, Homo sapiens
gccacagagaaguuu

SEQ ID NO: 1241059 - RNA, 11 nt, Homo sapiens
gccacagccau

SEQ ID NO: 1241060 - RNA, 18 nt, Homo sapiens
gccacaguccuucuuuga

SEQ ID NO: 1241061 - RNA, 20 nt, Homo sapiens
gccacauggccccaucccag

SEQ ID NO: 1241062 - RNA, 19 nt, Homo sapiens
gccacauggcgcaugaagg

SEQ ID NO: 1241063 - RNA, 18 nt, Homo sapiens
gccacauuucugaucaga

SEQ ID NO: 1241064 - RNA, 21 nt, Homo sapiens
gccaccacccacaaucacaag

SEQ ID NO: 1241065 - RNA, 15 nt, Homo sapiens
gccaccauccugcag

SEQ ID NO: 1241066 - RNA, 20 nt, Homo sapiens
gccacccaggaacuccugac

SEQ ID NO: 1241067 - RNA, 13 nt, Homo sapiens
gccaccccagaaa

SEQ ID NO: 1241068 - RNA, 22 nt, Homo sapiens
gccacccucacacacacagcug

SEQ ID NO: 1241069 - RNA, 20 nt, Homo sapiens
gccaccggaggucacuccac

SEQ ID NO: 1241070 - RNA, 19 nt, Homo sapiens
gccaccucucccucaacaa

SEQ ID NO: 1241071 - RNA, 15 nt, Homo sapiens
gccacgcacugggcc

SEQ ID NO: 1241072 - RNA, 23 nt, Homo sapiens
gccacgcacugggccacggagga

SEQ ID NO: 1241073 - RNA, 21 nt, Homo sapiens
gccacugagcccagccuacuu

SEQ ID NO: 1241074 - RNA, 13 nt, Homo sapiens
gccacugcacucc

SEQ ID NO: 1241075 - RNA, 13 nt, Homo sapiens
gccacuguguacu

SEQ ID NO: 1241076 - RNA, 16 nt, Homo sapiens
gccacuuuacccaccu

SEQ ID NO: 1241077 - RNA, 22 nt, Homo sapiens
gccagaaagcauaaaauucuua

SEQ ID NO: 1241078 - RNA, 19 nt, Homo sapiens
gccagacgugguggcucac

SEQ ID NO: 1241079 - RNA, 22 nt, Homo sapiens
gccagagaaaauguuggaagag

SEQ ID NO: 1241080 - RNA, 17 nt, Homo sapiens
gccagaggaacugucca

SEQ ID NO: 1241081 - RNA, 15 nt, Homo sapiens
gccagaggcucuaau

SEQ ID NO: 1241082 - RNA, 13 nt, Homo sapiens
gccagagggcagu

SEQ ID NO: 1241083 - RNA, 13 nt, Homo sapiens
gccagaguuccug

SEQ ID NO: 1241084 - RNA, 18 nt, Homo sapiens
gccagaugauuguucaaa

SEQ ID NO: 1241085 - RNA, 15 nt, Homo sapiens
gccagaugcaggaca

SEQ ID NO: 1241086 - RNA, 20 nt, Homo sapiens
gccagcaagagggaacaaaa

SEQ ID NO: 1241087 - RNA, 19 nt, Homo sapiens
gccagcaccugcccagugg

SEQ ID NO: 1241088 - RNA, 21 nt, Homo sapiens
gccagcaggagcucugacuaa

SEQ ID NO: 1241089 - RNA, 17 nt, Homo sapiens
gccagccagcauggcca

SEQ ID NO: 1241090 - RNA, 15 nt, Homo sapiens
gccagccagugccau

SEQ ID NO: 1241091 - RNA, 15 nt, Homo sapiens
gccagccaugcauug

SEQ ID NO: 1241092 - RNA, 16 nt, Homo sapiens
gccagccaugcauugu

SEQ ID NO: 1241093 - RNA, 14 nt, Homo sapiens
gccagccccacaca

SEQ ID NO: 1241094 - RNA, 14 nt, Homo sapiens
gccagcccuucagg

SEQ ID NO: 1241095 - RNA, 17 nt, Homo sapiens
gccagccgugaugcuca

SEQ ID NO: 1241096 - RNA, 21 nt, Homo sapiens
gccagccuccggcggggaccc

SEQ ID NO: 1241097 - RNA, 21 nt, Homo sapiens
gccagcgggcacagggcacca

SEQ ID NO: 1241098 - RNA, 14 nt, Homo sapiens
gccagcuacuuccu

SEQ ID NO: 1241099 - RNA, 18 nt, Homo sapiens
gccagcucccagccacau

SEQ ID NO: 1241100 - RNA, 22 nt, Homo sapiens
gccagcuuacuagcacuuugag

SEQ ID NO: 1241101 - RNA, 21 nt, Homo sapiens
gccagcuuggggccaccaaag

SEQ ID NO: 1241102 - RNA, 17 nt, Homo sapiens
gccaggaaguacuucca

SEQ ID NO: 1241103 - RNA, 20 nt, Homo sapiens
gccaggaccacagagcuccu

SEQ ID NO: 1241104 - RNA, 11 nt, Homo sapiens
gccaggagcuc

SEQ ID NO: 1241105 - RNA, 20 nt, Homo sapiens
gccaggcaggugccuggaca

SEQ ID NO: 1241106 - RNA, 21 nt, Homo sapiens
gccaggcccggccaaaauaau

SEQ ID NO: 1241107 - RNA, 21 nt, Homo sapiens
gccaggccucuuggcagucac

SEQ ID NO: 1241108 - RNA, 18 nt, Homo sapiens
gccagggcagugcuagug

SEQ ID NO: 1241109 - RNA, 21 nt, Homo sapiens
gccaggggauugucucagggc

SEQ ID NO: 1241110 - RNA, 21 nt, Homo sapiens
gccagggggaugccacuccuc

SEQ ID NO: 1241111 - RNA, 19 nt, Homo sapiens
gccagggucugugugaaug

SEQ ID NO: 1241112 - RNA, 20 nt, Homo sapiens
cuuuuuaauauugauaugcu

SEQ ID NO: 1241113 - RNA, 12 nt, Homo sapiens
cuuuuuccagag

SEQ ID NO: 1241114 - RNA, 15 nt, Homo sapiens
cuuuuuccaucauuu

SEQ ID NO: 1241115 - RNA, 17 nt, Homo sapiens
cuuuuuccuacuuguua

SEQ ID NO: 1241116 - RNA, 16 nt, Homo sapiens
cuuuuuccuccuggaa

SEQ ID NO: 1241117 - RNA, 15 nt, Homo sapiens
cuuuuucuauauucu

SEQ ID NO: 1241118 - RNA, 16 nt, Homo sapiens
cuuuuucugagcuuuu

SEQ ID NO: 1241119 - RNA, 16 nt, Homo sapiens
cuuuuucuuguauuca

SEQ ID NO: 1241120 - RNA, 16 nt, Homo sapiens
cuuuuugguuugauca

SEQ ID NO: 1241121 - RNA, 15 nt, Homo sapiens
cuuuuugugucucca

SEQ ID NO: 1241122 - RNA, 13 nt, Homo sapiens
cuuuuuucuuaac

SEQ ID NO: 1241123 - RNA, 22 nt, Homo sapiens
cuuuuuugaggccuuuuuugcc

SEQ ID NO: 1241124 - RNA, 12 nt, Homo sapiens
cuuuuuugccag

SEQ ID NO: 1241125 - RNA, 22 nt, Homo sapiens
cuuuuuuuauaucagaaugagg

SEQ ID NO: 1241126 - RNA, 21 nt, Homo sapiens
gaaaaaaaaaagaaaugcaaa

SEQ ID NO: 1241127 - RNA, 17 nt, Homo sapiens
gaaaaaaaaacagccac

SEQ ID NO: 1241128 - RNA, 18 nt, Homo sapiens
gaaaaaaaccacacaaag

SEQ ID NO: 1241129 - RNA, 14 nt, Homo sapiens
gaaaaaacauuuua

SEQ ID NO: 1241130 - RNA, 13 nt, Homo sapiens
gaaaaaauggaug

SEQ ID NO: 1241131 - RNA, 16 nt, Homo sapiens
gaaaaaauucucuuaa

SEQ ID NO: 1241132 - RNA, 19 nt, Homo sapiens
gaaaaacauuccaggaaac

SEQ ID NO: 1241133 - RNA, 13 nt, Homo sapiens
gaaaaacuuccau

SEQ ID NO: 1241134 - RNA, 13 nt, Homo sapiens
gaaaaagacugau

SEQ ID NO: 1241135 - RNA, 18 nt, Homo sapiens
gaaaaagcccuaauagca

SEQ ID NO: 1241136 - RNA, 12 nt, Homo sapiens
gaaaaauaauca

SEQ ID NO: 1241137 - RNA, 17 nt, Homo sapiens
gaaaaauauagccuuua

SEQ ID NO: 1241138 - RNA, 14 nt, Homo sapiens
gaaaaaugcugcuu

SEQ ID NO: 1241139 - RNA, 19 nt, Homo sapiens
gaaaaauguuugucucagu

SEQ ID NO: 1241140 - RNA, 17 nt, Homo sapiens
gaaaacaaucaaauauu

SEQ ID NO: 1241141 - RNA, 19 nt, Homo sapiens
gaaaacacuguuucuggua

SEQ ID NO: 1241142 - RNA, 20 nt, Homo sapiens
gaaaacagagccugccuaac

SEQ ID NO: 1241143 - RNA, 13 nt, Homo sapiens
gaaaacauuugcu

SEQ ID NO: 1241144 - RNA, 14 nt, Homo sapiens
gaaaaccuagaucu

SEQ ID NO: 1241145 - RNA, 22 nt, Homo sapiens
gaaaacuauaagccaauauucc

SEQ ID NO: 1241146 - RNA, 13 nt, Homo sapiens
gaaaacuguaguc

SEQ ID NO: 1241147 - RNA, 15 nt, Homo sapiens
gaaaacugugcaaug

SEQ ID NO: 1241148 - RNA, 19 nt, Homo sapiens
gaaaacuuagagagguaca

SEQ ID NO: 1241149 - RNA, 20 nt, Homo sapiens
gaaaagaaaccagagucaaa

SEQ ID NO: 1241150 - RNA, 21 nt, Homo sapiens
gaaaagaaaccagagucaaau

SEQ ID NO: 1241151 - RNA, 19 nt, Homo sapiens
gaaaagaccaguccaugag

SEQ ID NO: 1241152 - RNA, 21 nt, Homo sapiens
gaaaagcaauacuguuuccau

SEQ ID NO: 1241153 - RNA, 22 nt, Homo sapiens
gaaaagcuaguguaccuccucu

SEQ ID NO: 1241154 - RNA, 17 nt, Homo sapiens
gaaaagcuauuagccag

SEQ ID NO: 1241155 - RNA, 16 nt, Homo sapiens
gaaaaggauaugcagu

SEQ ID NO: 1241156 - RNA, 14 nt, Homo sapiens
gaaaauaagacaau

SEQ ID NO: 1241157 - RNA, 18 nt, Homo sapiens
gaaaauaauuaauuucau

SEQ ID NO: 1241158 - RNA, 18 nt, Homo sapiens
gaaaauaccaucaggccu

SEQ ID NO: 1241159 - RNA, 18 nt, Homo sapiens
gaaaauauacuugacucu

SEQ ID NO: 1241160 - RNA, 19 nt, Homo sapiens
gaaaauauacuugacucua

SEQ ID NO: 1241161 - RNA, 17 nt, Homo sapiens
cuuggugugauugcaca

SEQ ID NO: 1241162 - RNA, 21 nt, Homo sapiens
cuugguucaucaguguuaaaa

SEQ ID NO: 1241163 - RNA, 16 nt, Homo sapiens
cuugguuccuucugcc

SEQ ID NO: 1241164 - RNA, 15 nt, Homo sapiens
cuuguaaagacugua

SEQ ID NO: 1241165 - RNA, 16 nt, Homo sapiens
cuuguaaagacuguag

SEQ ID NO: 1241166 - RNA, 23 nt, Homo sapiens
cuuguaacaagaaaacauaagag

SEQ ID NO: 1241167 - RNA, 18 nt, Homo sapiens
cuuguaaccagugcagaa

SEQ ID NO: 1241168 - RNA, 22 nt, Homo sapiens
cuuguacagugucugugccaug

SEQ ID NO: 1241169 - RNA, 13 nt, Homo sapiens
cuuguagcuguaa

SEQ ID NO: 1241170 - RNA, 16 nt, Homo sapiens
cuuguauauacgcauc

SEQ ID NO: 1241171 - RNA, 10 nt, Homo sapiens
cuuguauuca

SEQ ID NO: 1241172 - RNA, 14 nt, Homo sapiens
cuuguauuuccaaa

SEQ ID NO: 1241173 - RNA, 14 nt, Homo sapiens
cuugucagacauaa

SEQ ID NO: 1241174 - RNA, 20 nt, Homo sapiens
cuugucagacauaaagccau

SEQ ID NO: 1241175 - RNA, 23 nt, Homo sapiens
cuugucagacauaaagccauguu

SEQ ID NO: 1241176 - RNA, 22 nt, Homo sapiens
cuugucauuuuuaauauuacug

SEQ ID NO: 1241177 - RNA, 15 nt, Homo sapiens
cuuguccaugugguu

SEQ ID NO: 1241178 - RNA, 20 nt, Homo sapiens
cuugucccuuucccuaccuu

SEQ ID NO: 1241179 - RNA, 16 nt, Homo sapiens
cuuguccugaugcugu

SEQ ID NO: 1241180 - RNA, 19 nt, Homo sapiens
cuuguccuugagugcucuu

SEQ ID NO: 1241181 - RNA, 16 nt, Homo sapiens
cuugucucacuugugc

SEQ ID NO: 1241182 - RNA, 18 nt, Homo sapiens
cuugucugucucagcuca

SEQ ID NO: 1241183 - RNA, 20 nt, Homo sapiens
cuugucugucucagcucaac

SEQ ID NO: 1241184 - RNA, 14 nt, Homo sapiens
cuugucuucuggua

SEQ ID NO: 1241185 - RNA, 11 nt, Homo sapiens
cuugugccaua

SEQ ID NO: 1241186 - RNA, 15 nt, Homo sapiens
cuuguggcacuccaa

SEQ ID NO: 1241187 - RNA, 22 nt, Homo sapiens
cuuguggcuucucucucuagca

SEQ ID NO: 1241188 - RNA, 21 nt, Homo sapiens
cuugugucucauauacccuau

SEQ ID NO: 1241189 - RNA, 21 nt, Homo sapiens
cuugugugugggcugugagug

SEQ ID NO: 1241190 - RNA, 23 nt, Homo sapiens
cuuguuauucgaaccacugagag

SEQ ID NO: 1241191 - RNA, 16 nt, Homo sapiens
cuuguuccccacugac

SEQ ID NO: 1241192 - RNA, 15 nt, Homo sapiens
cuuguucugggcuca

SEQ ID NO: 1241193 - RNA, 11 nt, Homo sapiens
cuuguucuguc

SEQ ID NO: 1241194 - RNA, 23 nt, Homo sapiens
cuuguuuacaacauuuuugcaaa

SEQ ID NO: 1241195 - RNA, 19 nt, Homo sapiens
cuuguuucucauucccaca

SEQ ID NO: 1241196 - RNA, 16 nt, Homo sapiens
cuuguuugucuuccau

SEQ ID NO: 1241197 - RNA, 22 nt, Homo sapiens
cuuguuuuacccuauacaucca

SEQ ID NO: 1241198 - RNA, 15 nt, Homo sapiens
cuuguuuuccagucu

SEQ ID NO: 1241199 - RNA, 20 nt, Homo sapiens
cuuuaaaaccauaucagaga

SEQ ID NO: 1241200 - RNA, 15 nt, Homo sapiens
cuuuaaaauucacua

SEQ ID NO: 1241201 - RNA, 16 nt, Homo sapiens
cuuuaaacaaauucau

SEQ ID NO: 1241202 - RNA, 14 nt, Homo sapiens
cuuuaaaucuguga

SEQ ID NO: 1241203 - RNA, 20 nt, Homo sapiens
cuuuaagaacaaacucugaa

SEQ ID NO: 1241204 - RNA, 19 nt, Homo sapiens
cuuuaauucuguaucugua

SEQ ID NO: 1241205 - RNA, 11 nt, Homo sapiens
cuuuaauuuca

SEQ ID NO: 1241206 - RNA, 15 nt, Homo sapiens
cuuuacaaauauguc

SEQ ID NO: 1241207 - RNA, 13 nt, Homo sapiens
cuuuacaauguga

SEQ ID NO: 1241208 - RNA, 18 nt, Homo sapiens
cuuuacaccaacuccuaa

SEQ ID NO: 1241209 - RNA, 14 nt, Homo sapiens
cuuuacauaagaaa

SEQ ID NO: 1241210 - RNA, 16 nt, Homo sapiens
cuuuacauggaugcca

SEQ ID NO: 1241211 - RNA, 19 nt, Homo sapiens
cuuuaccccucauccaaag

SEQ ID NO: 1241212 - RNA, 18 nt, Homo sapiens
cuuuaccuccuuuucucu

SEQ ID NO: 1241213 - RNA, 18 nt, Homo sapiens
cuuuacucaaauugguga

SEQ ID NO: 1241214 - RNA, 20 nt, Homo sapiens
cuuuacuccguaacagauuu

SEQ ID NO: 1241215 - RNA, 12 nt, Homo sapiens
cuuuacucuuga

SEQ ID NO: 1241216 - RNA, 20 nt, Homo sapiens
cuuuagaaaugucaguugcu

SEQ ID NO: 1241217 - RNA, 20 nt, Homo sapiens
cuuuagagccagcccauggc

SEQ ID NO: 1241218 - RNA, 14 nt, Homo sapiens
cuuuagcuaccuca

SEQ ID NO: 1241219 - RNA, 21 nt, Homo sapiens
cuuuagcuaccucacuaugcu

SEQ ID NO: 1241220 - RNA, 17 nt, Homo sapiens
cuuuaguagacauuuau

SEQ ID NO: 1241221 - RNA, 21 nt, Homo sapiens
cuuuagucaggaauggcugca

SEQ ID NO: 1241222 - RNA, 21 nt, Homo sapiens
cuuuauaaauguaccagagag

SEQ ID NO: 1241223 - RNA, 19 nt, Homo sapiens
cuuuauacacaguggauug

SEQ ID NO: 1241224 - RNA, 18 nt, Homo sapiens
cuuuauauggaugauuca

SEQ ID NO: 1241225 - RNA, 14 nt, Homo sapiens
cuuuaucauugcua

SEQ ID NO: 1241226 - RNA, 13 nt, Homo sapiens
cuuuaucucaggg

SEQ ID NO: 1241227 - RNA, 23 nt, Homo sapiens
cuuuaugaugacugcuuaacucc

SEQ ID NO: 1241228 - RNA, 13 nt, Homo sapiens
cuuuauguacugc

SEQ ID NO: 1241229 - RNA, 14 nt, Homo sapiens
cuuuauguaucucu

SEQ ID NO: 1241230 - RNA, 12 nt, Homo sapiens
cuuuauuguaca

SEQ ID NO: 1241231 - RNA, 12 nt, Homo sapiens
cuuuauuuuaga

SEQ ID NO: 1241232 - RNA, 16 nt, Homo sapiens
cuuucaaaagcaagaa

SEQ ID NO: 1241233 - RNA, 22 nt, Homo sapiens
cuuucaagaagugccaguugau

SEQ ID NO: 1241234 - RNA, 15 nt, Homo sapiens
cuuucaagcaaaaaa

SEQ ID NO: 1241235 - RNA, 14 nt, Homo sapiens
cuuucacacacaca

SEQ ID NO: 1241236 - RNA, 21 nt, Homo sapiens
cuuucacccgcuccuacagcu

SEQ ID NO: 1241237 - RNA, 14 nt, Homo sapiens
cuuucaccuuucua

SEQ ID NO: 1241238 - RNA, 14 nt, Homo sapiens
cuuucacucuguca

SEQ ID NO: 1241239 - RNA, 13 nt, Homo sapiens
cuuucacuuugaa

SEQ ID NO: 1241240 - RNA, 19 nt, Homo sapiens
cuuucagcauuaggcuuuu

SEQ ID NO: 1241241 - RNA, 20 nt, Homo sapiens
cuuucagcucagcuaaugaa

SEQ ID NO: 1241242 - RNA, 15 nt, Homo sapiens
cuuucaggaccuuuu

SEQ ID NO: 1241243 - RNA, 18 nt, Homo sapiens
acauggugugaguccaaa

SEQ ID NO: 1241244 - RNA, 18 nt, Homo sapiens
acauguaauaaauucaaa

SEQ ID NO: 1241245 - RNA, 19 nt, Homo sapiens
acauguaguaguacuugaa

SEQ ID NO: 1241246 - RNA, 18 nt, Homo sapiens
acauguauuuauggagug

SEQ ID NO: 1241247 - RNA, 16 nt, Homo sapiens
acaugucaaucugucc

SEQ ID NO: 1241248 - RNA, 17 nt, Homo sapiens
acaugucuacaugccau

SEQ ID NO: 1241249 - RNA, 19 nt, Homo sapiens
acaugucuuguacaugugu

SEQ ID NO: 1241250 - RNA, 18 nt, Homo sapiens
acaugugacacauaugca

SEQ ID NO: 1241251 - RNA, 12 nt, Homo sapiens
acaugugacauu

SEQ ID NO: 1241252 - RNA, 15 nt, Homo sapiens
acaugugacuggcag

SEQ ID NO: 1241253 - RNA, 14 nt, Homo sapiens
acaugugauuguga

SEQ ID NO: 1241254 - RNA, 16 nt, Homo sapiens
acaugugauugugauu

SEQ ID NO: 1241255 - RNA, 13 nt, Homo sapiens
acaugugcacaug

SEQ ID NO: 1241256 - RNA, 16 nt, Homo sapiens
acaugugcacaugcac

SEQ ID NO: 1241257 - RNA, 14 nt, Homo sapiens
acaugugcagucac

SEQ ID NO: 1241258 - RNA, 17 nt, Homo sapiens
acaugugcagucacugg

SEQ ID NO: 1241259 - RNA, 15 nt, Homo sapiens
acauguggcaaaaua

SEQ ID NO: 1241260 - RNA, 15 nt, Homo sapiens
acauguguaccucag

SEQ ID NO: 1241261 - RNA, 22 nt, Homo sapiens
acauguguagccugugcaugua

SEQ ID NO: 1241262 - RNA, 22 nt, Homo sapiens
acauguguguauauauguguau

SEQ ID NO: 1241263 - RNA, 21 nt, Homo sapiens
acauguuaaugacaauauucc

SEQ ID NO: 1241264 - RNA, 18 nt, Homo sapiens
acauguuacugaccagca

SEQ ID NO: 1241265 - RNA, 18 nt, Homo sapiens
acauguuauucaauguga

SEQ ID NO: 1241266 - RNA, 23 nt, Homo sapiens
acauguuuccaucauuucugucu

SEQ ID NO: 1241267 - RNA, 21 nt, Homo sapiens
acauguuuguuucuguagaaa

SEQ ID NO: 1241268 - RNA, 20 nt, Homo sapiens
acauuaaaauaaaccaaaua

SEQ ID NO: 1241269 - RNA, 23 nt, Homo sapiens
acauuaaacacaaagcuguugaa

SEQ ID NO: 1241270 - RNA, 20 nt, Homo sapiens
acauuaaagaaggguugagc

SEQ ID NO: 1241271 - RNA, 13 nt, Homo sapiens
acauuaaugccug

SEQ ID NO: 1241272 - RNA, 19 nt, Homo sapiens
acauuacuaaggcuaauaa

SEQ ID NO: 1241273 - RNA, 20 nt, Homo sapiens
acauuauaaaaauugacaau

SEQ ID NO: 1241274 - RNA, 15 nt, Homo sapiens
acauuauauugcaau

SEQ ID NO: 1241275 - RNA, 14 nt, Homo sapiens
acauuaucaucuga

SEQ ID NO: 1241276 - RNA, 22 nt, Homo sapiens
acauuaucaucugaaaaucugg

SEQ ID NO: 1241277 - RNA, 22 nt, Homo sapiens
acauuaucgggagcagugucuu

SEQ ID NO: 1241278 - RNA, 21 nt, Homo sapiens
acauuauguggcccucuggau

SEQ ID NO: 1241279 - RNA, 15 nt, Homo sapiens
acauuauuagcacuu

SEQ ID NO: 1241280 - RNA, 16 nt, Homo sapiens
acauuauuagcacuuc

SEQ ID NO: 1241281 - RNA, 14 nt, Homo sapiens
acauucacacaggg

SEQ ID NO: 1241282 - RNA, 14 nt, Homo sapiens
acauucagggcuau

SEQ ID NO: 1241283 - RNA, 18 nt, Homo sapiens
acauuccccucccaccuc

SEQ ID NO: 1241284 - RNA, 17 nt, Homo sapiens
acauucugaugagcaac

SEQ ID NO: 1241285 - RNA, 23 nt, Homo sapiens
acauucugcaagcacaucugcau

SEQ ID NO: 1241286 - RNA, 23 nt, Homo sapiens
acauugugucagauuaccaguua

SEQ ID NO: 1241287 - RNA, 22 nt, Homo sapiens
acauuuaauacagcagugucau

SEQ ID NO: 1241288 - RNA, 15 nt, Homo sapiens
acauuuaguccugua

SEQ ID NO: 1241289 - RNA, 21 nt, Homo sapiens
acauuuauagauaauugauau

SEQ ID NO: 1241290 - RNA, 15 nt, Homo sapiens
acauuuaucacugaa

SEQ ID NO: 1241291 - RNA, 13 nt, Homo sapiens
acauuucucaccc

SEQ ID NO: 1241292 - RNA, 22 nt, Homo sapiens
acauuucuggacaguaccugau

SEQ ID NO: 1241293 - RNA, 19 nt, Homo sapiens
acauuugggagacauguga

SEQ ID NO: 1241294 - RNA, 18 nt, Homo sapiens
acauuuucaauacugucc

SEQ ID NO: 1241295 - RNA, 13 nt, Homo sapiens
acauuuugacaca

SEQ ID NO: 1241296 - RNA, 18 nt, Homo sapiens
acauuuuuccguuugcuu

SEQ ID NO: 1241297 - RNA, 16 nt, Homo sapiens
acauuuuuguacuaac

SEQ ID NO: 1241298 - RNA, 19 nt, Homo sapiens
acauuuuuuucuaccuaua

SEQ ID NO: 1241299 - RNA, 23 nt, Homo sapiens
acauuuuuuuuaacuacuauauu

SEQ ID NO: 1241300 - RNA, 17 nt, Homo sapiens
accaaaaaccuaaaaau

SEQ ID NO: 1241301 - RNA, 20 nt, Homo sapiens
accaaaacuuccaaggcccu

SEQ ID NO: 1241302 - RNA, 13 nt, Homo sapiens
accaaaccccacu

SEQ ID NO: 1241303 - RNA, 14 nt, Homo sapiens
accaaauaagacuu

SEQ ID NO: 1241304 - RNA, 18 nt, Homo sapiens
accaaaucugacauauua

SEQ ID NO: 1241305 - RNA, 18 nt, Homo sapiens
accaaaugaugccacuuc

SEQ ID NO: 1241306 - RNA, 14 nt, Homo sapiens
accaacacugaccc

SEQ ID NO: 1241307 - RNA, 11 nt, Homo sapiens
accaaccaaac

SEQ ID NO: 1241308 - RNA, 14 nt, Homo sapiens
accaaccagaccac

SEQ ID NO: 1241309 - RNA, 13 nt, Homo sapiens
accaaccuguuac

SEQ ID NO: 1241310 - RNA, 19 nt, Homo sapiens
accaagaaagcucacugua

SEQ ID NO: 1241311 - RNA, 14 nt, Homo sapiens
accaagaacugaag

SEQ ID NO: 1241312 - RNA, 14 nt, Homo sapiens
accaagaacugcau

SEQ ID NO: 1241313 - RNA, 16 nt, Homo sapiens
accaagaugccaucug

SEQ ID NO: 1241314 - RNA, 14 nt, Homo sapiens
accaagcucugucc

SEQ ID NO: 1241315 - RNA, 15 nt, Homo sapiens
accaagcucugucca

SEQ ID NO: 1241316 - RNA, 16 nt, Homo sapiens
accaagcucuguccaa

SEQ ID NO: 1241317 - RNA, 17 nt, Homo sapiens
accaagggaucugccau

SEQ ID NO: 1241318 - RNA, 19 nt, Homo sapiens
accaagggaucugccauug

SEQ ID NO: 1241319 - RNA, 19 nt, Homo sapiens
accaaguaaaacaaaacca

SEQ ID NO: 1241320 - RNA, 15 nt, Homo sapiens
accaaguggcuccca

SEQ ID NO: 1241321 - RNA, 15 nt, Homo sapiens
aaauguacaacugca

SEQ ID NO: 1241322 - RNA, 22 nt, Homo sapiens
aaauguacucagcuaucagcuc

SEQ ID NO: 1241323 - RNA, 12 nt, Homo sapiens
aaauguagcaau

SEQ ID NO: 1241324 - RNA, 14 nt, Homo sapiens
aaauguauauacac

SEQ ID NO: 1241325 - RNA, 13 nt, Homo sapiens
aaauguaugugcu

SEQ ID NO: 1241326 - RNA, 19 nt, Homo sapiens
aaauguauucaaauaccaa

SEQ ID NO: 1241327 - RNA, 19 nt, Homo sapiens
aaauguccauuuauaucau

SEQ ID NO: 1241328 - RNA, 20 nt, Homo sapiens
aaaugugaauugcaugacuu

SEQ ID NO: 1241329 - RNA, 22 nt, Homo sapiens
aaaugugaccguccauccuccu

SEQ ID NO: 1241330 - RNA, 13 nt, Homo sapiens
aaaugugauuucc

SEQ ID NO: 1241331 - RNA, 14 nt, Homo sapiens
aaaugugcuuaugu

SEQ ID NO: 1241332 - RNA, 15 nt, Homo sapiens
aaauguuaacacuca

SEQ ID NO: 1241333 - RNA, 22 nt, Homo sapiens
aaauguuaacacucaugaagca

SEQ ID NO: 1241334 - RNA, 18 nt, Homo sapiens
aaauguugagaaucccaa

SEQ ID NO: 1241335 - RNA, 16 nt, Homo sapiens
aaauuaaaucugaaua

SEQ ID NO: 1241336 - RNA, 15 nt, Homo sapiens
aaauuaacacaaagg

SEQ ID NO: 1241337 - RNA, 13 nt, Homo sapiens
aaauuaaccauuu

SEQ ID NO: 1241338 - RNA, 14 nt, Homo sapiens
aaauuaacuguaug

SEQ ID NO: 1241339 - RNA, 15 nt, Homo sapiens
aaauuaacuuuacau

SEQ ID NO: 1241340 - RNA, 15 nt, Homo sapiens
aaauuaagugugcau

SEQ ID NO: 1241341 - RNA, 17 nt, Homo sapiens
aaauuaauacugaagga

SEQ ID NO: 1241342 - RNA, 22 nt, Homo sapiens
aaauuacacaguuaaugccaca

SEQ ID NO: 1241343 - RNA, 22 nt, Homo sapiens
aaauuacagcuuuuauggauga

SEQ ID NO: 1241344 - RNA, 14 nt, Homo sapiens
aaauuaccagauau

SEQ ID NO: 1241345 - RNA, 21 nt, Homo sapiens
aaauuacuucccccacuacuu

SEQ ID NO: 1241346 - RNA, 16 nt, Homo sapiens
aaauuagccauuucac

SEQ ID NO: 1241347 - RNA, 15 nt, Homo sapiens
aaauuagcugggcau

SEQ ID NO: 1241348 - RNA, 19 nt, Homo sapiens
aaauuagcuugagcaaccu

SEQ ID NO: 1241349 - RNA, 23 nt, Homo sapiens
aaauuagcuugagcaaccuggcu

SEQ ID NO: 1241350 - RNA, 17 nt, Homo sapiens
aaauuaggacuguauaa

SEQ ID NO: 1241351 - RNA, 16 nt, Homo sapiens
aaauuagucuuggaaa

SEQ ID NO: 1241352 - RNA, 23 nt, Homo sapiens
aaauuauacuguagcugaugaaa

SEQ ID NO: 1241353 - RNA, 23 nt, Homo sapiens
aaauuauguuuuaaacacaugcc

SEQ ID NO: 1241354 - RNA, 17 nt, Homo sapiens
aaauuauugcaagcauu

SEQ ID NO: 1241355 - RNA, 15 nt, Homo sapiens
aaauuauuucucuca

SEQ ID NO: 1241356 - RNA, 16 nt, Homo sapiens
aaauucacaaacuuuu

SEQ ID NO: 1241357 - RNA, 15 nt, Homo sapiens
aaauucagaugcugu

SEQ ID NO: 1241358 - RNA, 11 nt, Homo sapiens
aaauuccccaa

SEQ ID NO: 1241359 - RNA, 21 nt, Homo sapiens
aaauucuauaggaacauauga

SEQ ID NO: 1241360 - RNA, 24 nt, Homo sapiens
aaauucucagucaguaauugccaa

SEQ ID NO: 1241361 - RNA, 21 nt, Homo sapiens
aaauucugaugagcauuacua

SEQ ID NO: 1241362 - RNA, 9 nt, Homo sapiens
aaauucugu

SEQ ID NO: 1241363 - RNA, 16 nt, Homo sapiens
aaauucugucaggggu

SEQ ID NO: 1241364 - RNA, 12 nt, Homo sapiens
aaauucuuaacc

SEQ ID NO: 1241365 - RNA, 17 nt, Homo sapiens
aaauucuugaaguucau

SEQ ID NO: 1241366 - RNA, 19 nt, Homo sapiens
aaauugaaaacacacucaa

SEQ ID NO: 1241367 - RNA, 20 nt, Homo sapiens
aaauugagaccugagugaag

SEQ ID NO: 1241368 - RNA, 20 nt, Homo sapiens
aaauugcacuuuuaaaccuc

SEQ ID NO: 1241369 - RNA, 13 nt, Homo sapiens
aaauugcugcuug

SEQ ID NO: 1241370 - RNA, 20 nt, Homo sapiens
aaauugcuucuuuaccaagg

SEQ ID NO: 1241371 - RNA, 18 nt, Homo sapiens
aaauuuaaaacuguugga

SEQ ID NO: 1241372 - RNA, 18 nt, Homo sapiens
aaauuuaauaccagauac

SEQ ID NO: 1241373 - RNA, 16 nt, Homo sapiens
aaauuuaauuaccuua

SEQ ID NO: 1241374 - RNA, 15 nt, Homo sapiens
aaauuuaucaaagca

SEQ ID NO: 1241375 - RNA, 21 nt, Homo sapiens
aaauuuaugaagcagauuuau

SEQ ID NO: 1241376 - RNA, 17 nt, Homo sapiens
aaauuuauucacauaua

SEQ ID NO: 1241377 - RNA, 14 nt, Homo sapiens
aaauuucaccacug

SEQ ID NO: 1241378 - RNA, 16 nt, Homo sapiens
aaauuucuacaccaag

SEQ ID NO: 1241379 - RNA, 16 nt, Homo sapiens
aaauuugaauuucagu

SEQ ID NO: 1241380 - RNA, 22 nt, Homo sapiens
aaauuugcaaaucucaggauaa

SEQ ID NO: 1241381 - RNA, 20 nt, Homo sapiens
aaauuuguaaaucuuauucu

SEQ ID NO: 1241382 - RNA, 13 nt, Homo sapiens
aaauuuguaaguu

SEQ ID NO: 1241383 - RNA, 17 nt, Homo sapiens
aaauuuuaaccagaaaa

SEQ ID NO: 1241384 - RNA, 20 nt, Homo sapiens
aaauuuuaaugaagugcaau

SEQ ID NO: 1241385 - RNA, 20 nt, Homo sapiens
aaauuuuaccagcagaagga

SEQ ID NO: 1241386 - RNA, 16 nt, Homo sapiens
aaauuuugaaaacugu

SEQ ID NO: 1241387 - RNA, 14 nt, Homo sapiens
aacaaaaaaaccac

SEQ ID NO: 1241388 - RNA, 21 nt, Homo sapiens
aacaaaaaaaccucuaugcaa

SEQ ID NO: 1241389 - RNA, 19 nt, Homo sapiens
aacaaaaauguaaugauca

SEQ ID NO: 1241390 - RNA, 22 nt, Homo sapiens
aacaaaagcuugaagcugugga

SEQ ID NO: 1241391 - RNA, 15 nt, Homo sapiens
aacaaacaaacaauu

SEQ ID NO: 1241392 - RNA, 12 nt, Homo sapiens
aacaaacagggc

SEQ ID NO: 1241393 - RNA, 18 nt, Homo sapiens
aacaaacauccuugcaaa

SEQ ID NO: 1241394 - RNA, 15 nt, Homo sapiens
aacaaacaugcagua

SEQ ID NO: 1241395 - RNA, 13 nt, Homo sapiens
aacaaacauggau

SEQ ID NO: 1241396 - RNA, 12 nt, Homo sapiens
aacaaaccacac

SEQ ID NO: 1241397 - RNA, 15 nt, Homo sapiens
aacaaacccaaaggu

SEQ ID NO: 1241398 - RNA, 23 nt, Homo sapiens
aacaaacuggcugcuuuguucaa

SEQ ID NO: 1241399 - RNA, 14 nt, Homo sapiens
aacaaagaaugggc

SEQ ID NO: 1241400 - RNA, 22 nt, Homo sapiens
aacaaagugacuguuuggcuua

SEQ ID NO: 1241401 - RNA, 18 nt, Homo sapiens
aacaaaucaaauugcuua

SEQ ID NO: 1241402 - RNA, 20 nt, Homo sapiens
aacaaauguggcuccaagcu

SEQ ID NO: 1241403 - RNA, 13 nt, Homo sapiens
aacaacaacuauc

SEQ ID NO: 1241404 - RNA, 19 nt, Homo sapiens
aacaacaauaacacugucu

SEQ ID NO: 1241405 - RNA, 12 nt, Homo sapiens
aacaacauuuau

SEQ ID NO: 1241406 - RNA, 21 nt, Homo sapiens
aacaacccacaccgucuuccu

SEQ ID NO: 1241407 - RNA, 13 nt, Homo sapiens
aacaacuaccuga

SEQ ID NO: 1241408 - RNA, 21 nt, Homo sapiens
aacaacuauccugacuucuaa

SEQ ID NO: 1241409 - RNA, 13 nt, Homo sapiens
aacaacucuaguc

SEQ ID NO: 1241410 - RNA, 18 nt, Homo sapiens
aacaagaaauuguuucuu

SEQ ID NO: 1241411 - RNA, 14 nt, Homo sapiens
aacaagaacuuuaa

SEQ ID NO: 1241412 - RNA, 18 nt, Homo sapiens
aacaagcuccaccuucca

SEQ ID NO: 1241413 - RNA, 13 nt, Homo sapiens
aacaaugaagaua

SEQ ID NO: 1241414 - RNA, 15 nt, Homo sapiens
aacaaugaagauaaa

SEQ ID NO: 1241415 - RNA, 20 nt, Homo sapiens
aacaaugcugauuuggugac

SEQ ID NO: 1241416 - RNA, 21 nt, Homo sapiens
aacaauguuguccaacaauaa

SEQ ID NO: 1241417 - RNA, 15 nt, Homo sapiens
aacaauucugugaca

SEQ ID NO: 1241418 - RNA, 15 nt, Homo sapiens
acaucauaauuacau

SEQ ID NO: 1241419 - RNA, 17 nt, Homo sapiens
acauccaaaauaguuaa

SEQ ID NO: 1241420 - RNA, 22 nt, Homo sapiens
acauccaaccccccaccugcca

SEQ ID NO: 1241421 - RNA, 16 nt, Homo sapiens
acauccaacuccagca

SEQ ID NO: 1241422 - RNA, 14 nt, Homo sapiens
acauccagcccagg

SEQ ID NO: 1241423 - RNA, 12 nt, Homo sapiens
acauccaugaaa

SEQ ID NO: 1241424 - RNA, 14 nt, Homo sapiens
acauccauucccaa

SEQ ID NO: 1241425 - RNA, 22 nt, Homo sapiens
acaucccuuccuggaaacagca

SEQ ID NO: 1241426 - RNA, 20 nt, Homo sapiens
acauccuccagauaguguag

SEQ ID NO: 1241427 - RNA, 17 nt, Homo sapiens
acauccuuaagucaaaa

SEQ ID NO: 1241428 - RNA, 17 nt, Homo sapiens
acaucucaggggccaga

SEQ ID NO: 1241429 - RNA, 17 nt, Homo sapiens
acaucucccugugggau

SEQ ID NO: 1241430 - RNA, 21 nt, Homo sapiens
acaucuccuccauacucagga

SEQ ID NO: 1241431 - RNA, 23 nt, Homo sapiens
acaucucuuccuccgaggccagu

SEQ ID NO: 1241432 - RNA, 18 nt, Homo sapiens
acaucugagagaugacag

SEQ ID NO: 1241433 - RNA, 15 nt, Homo sapiens
acaucuguauacccu

SEQ ID NO: 1241434 - RNA, 23 nt, Homo sapiens
acaucuucugccuuagucucagu

SEQ ID NO: 1241435 - RNA, 19 nt, Homo sapiens
acaucuugcucugcugaca

SEQ ID NO: 1241436 - RNA, 23 nt, Homo sapiens
acaucuuggucagauuugaacuc

SEQ ID NO: 1241437 - RNA, 16 nt, Homo sapiens
acaucuuuauugaaau

SEQ ID NO: 1241438 - RNA, 22 nt, Homo sapiens
acaucuuugaccacgucaucgg

SEQ ID NO: 1241439 - RNA, 13 nt, Homo sapiens
acaucuuuuacau

SEQ ID NO: 1241440 - RNA, 17 nt, Homo sapiens
acaucuuuuacauucug

SEQ ID NO: 1241441 - RNA, 19 nt, Homo sapiens
acaucuuuuacauucugca

SEQ ID NO: 1241442 - RNA, 20 nt, Homo sapiens
acaugaaaugcccuccuaaa

SEQ ID NO: 1241443 - RNA, 18 nt, Homo sapiens
acaugaacagaaacaaua

SEQ ID NO: 1241444 - RNA, 13 nt, Homo sapiens
acaugaaugcaca

SEQ ID NO: 1241445 - RNA, 15 nt, Homo sapiens
acaugacaacuuugc

SEQ ID NO: 1241446 - RNA, 14 nt, Homo sapiens
acaugacacccgug

SEQ ID NO: 1241447 - RNA, 20 nt, Homo sapiens
acaugacccaggccuggcca

SEQ ID NO: 1241448 - RNA, 21 nt, Homo sapiens
acaugaccugaucacuagccu

SEQ ID NO: 1241449 - RNA, 22 nt, Homo sapiens
acaugauggagcgcaccugccc

SEQ ID NO: 1241450 - RNA, 14 nt, Homo sapiens
acaugcacugaccc

SEQ ID NO: 1241451 - RNA, 17 nt, Homo sapiens
acaugcagcccaugccc

SEQ ID NO: 1241452 - RNA, 11 nt, Homo sapiens
acaugcauugu

SEQ ID NO: 1241453 - RNA, 19 nt, Homo sapiens
acaugccaugaccuuccuc

SEQ ID NO: 1241454 - RNA, 20 nt, Homo sapiens
acaugcgaccgugaccagga

SEQ ID NO: 1241455 - RNA, 22 nt, Homo sapiens
acaugcucaccucuagccuuaa

SEQ ID NO: 1241456 - RNA, 21 nt, Homo sapiens
acaugcugaaaaauauagccu

SEQ ID NO: 1241457 - RNA, 18 nt, Homo sapiens
acaugcugcuaauucaaa

SEQ ID NO: 1241458 - RNA, 21 nt, Homo sapiens
acaugcuggugaacguguccu

SEQ ID NO: 1241459 - RNA, 16 nt, Homo sapiens
acaugcuggugcauau

SEQ ID NO: 1241460 - RNA, 17 nt, Homo sapiens
acaugcugugcucuuug

SEQ ID NO: 1241461 - RNA, 18 nt, Homo sapiens
acaugcuuagcuuaucuu

SEQ ID NO: 1241462 - RNA, 16 nt, Homo sapiens
acauggaacgcuuuca

SEQ ID NO: 1241463 - RNA, 23 nt, Homo sapiens
acauggaugcgaggaccacuuug

SEQ ID NO: 1241464 - RNA, 21 nt, Homo sapiens
acauggccuaugcacauaugg

SEQ ID NO: 1241465 - RNA, 13 nt, Homo sapiens
acauggugugagu

SEQ ID NO: 1241466 - RNA, 21 nt, Homo sapiens
accaggucuuguuucucucuc

SEQ ID NO: 1241467 - RNA, 13 nt, Homo sapiens
accaguaugacag

SEQ ID NO: 1241468 - RNA, 20 nt, Homo sapiens
accaguccacaccacuguug

SEQ ID NO: 1241469 - RNA, 13 nt, Homo sapiens
accaguccaugag

SEQ ID NO: 1241470 - RNA, 13 nt, Homo sapiens
accagugccaagg

SEQ ID NO: 1241471 - RNA, 15 nt, Homo sapiens
accaguguagcauug

SEQ ID NO: 1241472 - RNA, 21 nt, Homo sapiens
accaguguagcauuggaucaa

SEQ ID NO: 1241473 - RNA, 21 nt, Homo sapiens
accaguguaucaggucaggga

SEQ ID NO: 1241474 - RNA, 23 nt, Homo sapiens
accaguguccccuccacugucac

SEQ ID NO: 1241475 - RNA, 16 nt, Homo sapiens
accagugugacaucua

SEQ ID NO: 1241476 - RNA, 17 nt, Homo sapiens
accagugugacaucuac

SEQ ID NO: 1241477 - RNA, 18 nt, Homo sapiens
accagugugacaucuaca

SEQ ID NO: 1241478 - RNA, 18 nt, Homo sapiens
accaguuaauuuuuccaa

SEQ ID NO: 1241479 - RNA, 13 nt, Homo sapiens
accaguugcccua

SEQ ID NO: 1241480 - RNA, 17 nt, Homo sapiens
accaguugggagcacug

SEQ ID NO: 1241481 - RNA, 19 nt, Homo sapiens
accauaagggacugugcca

SEQ ID NO: 1241482 - RNA, 15 nt, Homo sapiens
accauacacacuguu

SEQ ID NO: 1241483 - RNA, 20 nt, Homo sapiens
accauagggacccauucuac

SEQ ID NO: 1241484 - RNA, 15 nt, Homo sapiens
accauaguaccauuu

SEQ ID NO: 1241485 - RNA, 20 nt, Homo sapiens
accauauuuacucuuucuaa

SEQ ID NO: 1241486 - RNA, 18 nt, Homo sapiens
accaucaaaaauauucca

SEQ ID NO: 1241487 - RNA, 22 nt, Homo sapiens
accaucauuauaaacgugauga

SEQ ID NO: 1241488 - RNA, 15 nt, Homo sapiens
accauccagugacaa

SEQ ID NO: 1241489 - RNA, 14 nt, Homo sapiens
accauccuacauaa

SEQ ID NO: 1241490 - RNA, 17 nt, Homo sapiens
accaucuacaucuccuu

SEQ ID NO: 1241491 - RNA, 18 nt, Homo sapiens
accaucucuucauucaaa

SEQ ID NO: 1241492 - RNA, 20 nt, Homo sapiens
accaucugaagaaacuuccc

SEQ ID NO: 1241493 - RNA, 16 nt, Homo sapiens
accaugaagacaggau

SEQ ID NO: 1241494 - RNA, 19 nt, Homo sapiens
accaugagaccacuguuau

SEQ ID NO: 1241495 - RNA, 9 nt, Homo sapiens
accaugcug

SEQ ID NO: 1241496 - RNA, 14 nt, Homo sapiens
accauggcacugac

SEQ ID NO: 1241497 - RNA, 16 nt, Homo sapiens
accauggcacugacaa

SEQ ID NO: 1241498 - RNA, 22 nt, Homo sapiens
accauggcacugacaaugggca

SEQ ID NO: 1241499 - RNA, 17 nt, Homo sapiens
accaugguagccuuagg

SEQ ID NO: 1241500 - RNA, 20 nt, Homo sapiens
accauguggauaacuuuaca

SEQ ID NO: 1241501 - RNA, 17 nt, Homo sapiens
accauuaagucaugugu

SEQ ID NO: 1241502 - RNA, 16 nt, Homo sapiens
accauuauacuuuaua

SEQ ID NO: 1241503 - RNA, 17 nt, Homo sapiens
accauucacagugcaag

SEQ ID NO: 1241504 - RNA, 16 nt, Homo sapiens
accauuccaacuucaa

SEQ ID NO: 1241505 - RNA, 21 nt, Homo sapiens
accauucuaccugaggccagg

SEQ ID NO: 1241506 - RNA, 15 nt, Homo sapiens
accauuuaucuaccc

SEQ ID NO: 1241507 - RNA, 17 nt, Homo sapiens
accauuugacuguucaa

SEQ ID NO: 1241508 - RNA, 18 nt, Homo sapiens
accauuugacuguucaau

SEQ ID NO: 1241509 - RNA, 21 nt, Homo sapiens
accauuuuuuaauuuacuugu

SEQ ID NO: 1241510 - RNA, 18 nt, Homo sapiens
acccaaacuguguguagu

SEQ ID NO: 1241511 - RNA, 16 nt, Homo sapiens
acccaaagcacaugcu

SEQ ID NO: 1241512 - RNA, 21 nt, Homo sapiens
acccaaagggugacuuuucau

SEQ ID NO: 1241513 - RNA, 18 nt, Homo sapiens
acccaacuacugagcuga

SEQ ID NO: 1241514 - RNA, 13 nt, Homo sapiens
acccaagacauca

SEQ ID NO: 1241515 - RNA, 16 nt, Homo sapiens
acccaagggcaggggc

SEQ ID NO: 1241516 - RNA, 14 nt, Homo sapiens
acccacaaucccac

SEQ ID NO: 1241517 - RNA, 23 nt, Homo sapiens
acccacaugugacacauaugcac

SEQ ID NO: 1241518 - RNA, 15 nt, Homo sapiens
acccaccaccaugcc

SEQ ID NO: 1241519 - RNA, 12 nt, Homo sapiens
acccaccucagc

SEQ ID NO: 1241520 - RNA, 14 nt, Homo sapiens
acccacuuugucca

SEQ ID NO: 1241521 - RNA, 16 nt, Homo sapiens
acccagacaaccaaaa

SEQ ID NO: 1241522 - RNA, 15 nt, Homo sapiens
acccagauuuccuaa

SEQ ID NO: 1241523 - RNA, 14 nt, Homo sapiens
acccagcacccaca

SEQ ID NO: 1241524 - RNA, 16 nt, Homo sapiens
acccagcaguucuguu

SEQ ID NO: 1241525 - RNA, 15 nt, Homo sapiens
acccagccccacaaa

SEQ ID NO: 1241526 - RNA, 18 nt, Homo sapiens
acccaggaccaagccaca

SEQ ID NO: 1241527 - RNA, 20 nt, Homo sapiens
acccaggacuuccauuugcu

SEQ ID NO: 1241528 - RNA, 15 nt, Homo sapiens
acccaggcaugggca

SEQ ID NO: 1241529 - RNA, 19 nt, Homo sapiens
acccaggcuggagugcagu

SEQ ID NO: 1241530 - RNA, 23 nt, Homo sapiens
acccaggucuuccagaccugcuu

SEQ ID NO: 1241531 - RNA, 14 nt, Homo sapiens
acccauaaccauac

SEQ ID NO: 1241532 - RNA, 12 nt, Homo sapiens
acccaugacaau

SEQ ID NO: 1241533 - RNA, 15 nt, Homo sapiens
acccaugacuuuaua

SEQ ID NO: 1241534 - RNA, 19 nt, Homo sapiens
acccaugcuggucagagac

SEQ ID NO: 1241535 - RNA, 18 nt, Homo sapiens
acccauucacuacaggug

SEQ ID NO: 1241536 - RNA, 15 nt, Homo sapiens
acccauuccugugua

SEQ ID NO: 1241537 - RNA, 15 nt, Homo sapiens
accccaaagcuuucc

SEQ ID NO: 1241538 - RNA, 15 nt, Homo sapiens
accccaagcaggaac

SEQ ID NO: 1241539 - RNA, 19 nt, Homo sapiens
accccacacacacuggccu

SEQ ID NO: 1241540 - RNA, 14 nt, Homo sapiens
accccacauuuuuc

SEQ ID NO: 1241541 - RNA, 13 nt, Homo sapiens
accccaccugcag

SEQ ID NO: 1241542 - RNA, 20 nt, Homo sapiens
accccacgugcgacagagag

SEQ ID NO: 1241543 - RNA, 23 nt, Homo sapiens
accccagagauucccaagccaaa

SEQ ID NO: 1241544 - RNA, 13 nt, Homo sapiens
acuucaauaucca

SEQ ID NO: 1241545 - RNA, 18 nt, Homo sapiens
acuucaaugggcucuucc

SEQ ID NO: 1241546 - RNA, 18 nt, Homo sapiens
acuucacuaaugaucaca

SEQ ID NO: 1241547 - RNA, 18 nt, Homo sapiens
acuucagagcaugaaaau

SEQ ID NO: 1241548 - RNA, 12 nt, Homo sapiens
acuucagcagua

SEQ ID NO: 1241549 - RNA, 19 nt, Homo sapiens
acuucagcaguaccuauaa

SEQ ID NO: 1241550 - RNA, 16 nt, Homo sapiens
acuucagcugccugaa

SEQ ID NO: 1241551 - RNA, 15 nt, Homo sapiens
acuucagucuugccu

SEQ ID NO: 1241552 - RNA, 14 nt, Homo sapiens
acuucauaauccag

SEQ ID NO: 1241553 - RNA, 18 nt, Homo sapiens
acuucauacuggcaggag

SEQ ID NO: 1241554 - RNA, 11 nt, Homo sapiens
acuucaucugg

SEQ ID NO: 1241555 - RNA, 17 nt, Homo sapiens
acuucauugucccucuu

SEQ ID NO: 1241556 - RNA, 18 nt, Homo sapiens
acuucauuugaugcuaaa

SEQ ID NO: 1241557 - RNA, 13 nt, Homo sapiens
acuuccaagugau

SEQ ID NO: 1241558 - RNA, 19 nt, Homo sapiens
acuuccaauuuauaaugaa

SEQ ID NO: 1241559 - RNA, 16 nt, Homo sapiens
acuuccauuaacuuag

SEQ ID NO: 1241560 - RNA, 13 nt, Homo sapiens
acuuccauuugcu

SEQ ID NO: 1241561 - RNA, 22 nt, Homo sapiens
acuucccaaguguaagacucug

SEQ ID NO: 1241562 - RNA, 14 nt, Homo sapiens
acuuccccacaggc

SEQ ID NO: 1241563 - RNA, 14 nt, Homo sapiens
acuucccucaggcc

SEQ ID NO: 1241564 - RNA, 14 nt, Homo sapiens
acuuccuacuguag

SEQ ID NO: 1241565 - RNA, 14 nt, Homo sapiens
acuuccucagucug

SEQ ID NO: 1241566 - RNA, 23 nt, Homo sapiens
acuuccucagucuggugcuccag

SEQ ID NO: 1241567 - RNA, 19 nt, Homo sapiens
acuuccugggaccuuuugu

SEQ ID NO: 1241568 - RNA, 14 nt, Homo sapiens
acuuccuugcucuc

SEQ ID NO: 1241569 - RNA, 18 nt, Homo sapiens
acuucgacucaggaucca

SEQ ID NO: 1241570 - RNA, 15 nt, Homo sapiens
acuucuaaaugcaua

SEQ ID NO: 1241571 - RNA, 17 nt, Homo sapiens
acuucuaauaucauuca

SEQ ID NO: 1241572 - RNA, 12 nt, Homo sapiens
acuucuaugcaa

SEQ ID NO: 1241573 - RNA, 17 nt, Homo sapiens
acuucuccccucaagaa

SEQ ID NO: 1241574 - RNA, 18 nt, Homo sapiens
acuucuccccucaagaaa

SEQ ID NO: 1241575 - RNA, 19 nt, Homo sapiens
acuucucugaaauauuuag

SEQ ID NO: 1241576 - RNA, 17 nt, Homo sapiens
acuucugacuacuuguu

SEQ ID NO: 1241577 - RNA, 23 nt, Homo sapiens
acuucugcaacaagcaugcagcu

SEQ ID NO: 1241578 - RNA, 13 nt, Homo sapiens
acuucugcucugg

SEQ ID NO: 1241579 - RNA, 16 nt, Homo sapiens
acuucugcuggcauca

SEQ ID NO: 1241580 - RNA, 15 nt, Homo sapiens
acuucuggaagucau

SEQ ID NO: 1241581 - RNA, 15 nt, Homo sapiens
acuucuggcuccuca

SEQ ID NO: 1241582 - RNA, 23 nt, Homo sapiens
acuucuuaaaaguugugauucca

SEQ ID NO: 1241583 - RNA, 17 nt, Homo sapiens
acuucuugcuucaguca

SEQ ID NO: 1241584 - RNA, 15 nt, Homo sapiens
acuucuugucagaca

SEQ ID NO: 1241585 - RNA, 19 nt, Homo sapiens
acuugaaaguuuuccagua

SEQ ID NO: 1241586 - RNA, 17 nt, Homo sapiens
acuugaaauucucauca

SEQ ID NO: 1241587 - RNA, 13 nt, Homo sapiens
acuugagaaaaua

SEQ ID NO: 1241588 - RNA, 15 nt, Homo sapiens
acuugaggccaguga

SEQ ID NO: 1241589 - RNA, 23 nt, Homo sapiens
acuugaggccagugagcugugau

SEQ ID NO: 1241590 - RNA, 18 nt, Homo sapiens
acuugaugauacaaugaa

SEQ ID NO: 1241591 - RNA, 21 nt, Homo sapiens
acuugaugauuuuuaacuuuu

SEQ ID NO: 1241592 - RNA, 17 nt, Homo sapiens
acuugauguguuaucuc

SEQ ID NO: 1241593 - RNA, 15 nt, Homo sapiens
acuugcagcauucau

SEQ ID NO: 1241594 - RNA, 22 nt, Homo sapiens
acuugcauauuguuggcacaga

SEQ ID NO: 1241595 - RNA, 23 nt, Homo sapiens
acuugccuaaaauauauuccuga

SEQ ID NO: 1241596 - RNA, 14 nt, Homo sapiens
acuugccucugcac

SEQ ID NO: 1241597 - RNA, 16 nt, Homo sapiens
acuugccucugcacac

SEQ ID NO: 1241598 - RNA, 19 nt, Homo sapiens
acuugcuaaagcacuuugc

SEQ ID NO: 1241599 - RNA, 16 nt, Homo sapiens
acuugcuaacaaauca

SEQ ID NO: 1241600 - RNA, 23 nt, Homo sapiens
acuugcugcugagugcaccacuu

SEQ ID NO: 1241601 - RNA, 22 nt, Homo sapiens
acuugcugugugaccucaggcc

SEQ ID NO: 1241602 - RNA, 20 nt, Homo sapiens
acuuggaaguggggacauca

SEQ ID NO: 1241603 - RNA, 14 nt, Homo sapiens
agaaaagcugccau

SEQ ID NO: 1241604 - RNA, 19 nt, Homo sapiens
agaaaaggacaaauaucuu

SEQ ID NO: 1241605 - RNA, 22 nt, Homo sapiens
agaaaaggagcauccuuaccuc

SEQ ID NO: 1241606 - RNA, 19 nt, Homo sapiens
agaaaaggccuucuuccca

SEQ ID NO: 1241607 - RNA, 23 nt, Homo sapiens
agaaaaguguauuagaugugguu

SEQ ID NO: 1241608 - RNA, 15 nt, Homo sapiens
agaaaauacaauaaa

SEQ ID NO: 1241609 - RNA, 16 nt, Homo sapiens
agaaaaugagacaaaa

SEQ ID NO: 1241610 - RNA, 13 nt, Homo sapiens
agaaaaugcaguc

SEQ ID NO: 1241611 - RNA, 18 nt, Homo sapiens
agaaaauggguuuauuca

SEQ ID NO: 1241612 - RNA, 16 nt, Homo sapiens
agaaaauguaaaggag

SEQ ID NO: 1241613 - RNA, 21 nt, Homo sapiens
agaaaauguaaaggagggaga

SEQ ID NO: 1241614 - RNA, 21 nt, Homo sapiens
agaaaauguuacuucucucau

SEQ ID NO: 1241615 - RNA, 16 nt, Homo sapiens
agaaaauucuccugau

SEQ ID NO: 1241616 - RNA, 16 nt, Homo sapiens
agaaaauuugcuuuaa

SEQ ID NO: 1241617 - RNA, 21 nt, Homo sapiens
agaaacaccacccauuucuac

SEQ ID NO: 1241618 - RNA, 18 nt, Homo sapiens
agaaacagagcaguacca

SEQ ID NO: 1241619 - RNA, 12 nt, Homo sapiens
agaaacaugaca

SEQ ID NO: 1241620 - RNA, 16 nt, Homo sapiens
agaaacaugacacuga

SEQ ID NO: 1241621 - RNA, 17 nt, Homo sapiens
agaaacaugacacugac

SEQ ID NO: 1241622 - RNA, 20 nt, Homo sapiens
agaaaccaagagaaguuuug

SEQ ID NO: 1241623 - RNA, 19 nt, Homo sapiens
agaaaccagaaaagcaaua

SEQ ID NO: 1241624 - RNA, 11 nt, Homo sapiens
agaaacccaag

SEQ ID NO: 1241625 - RNA, 16 nt, Homo sapiens
agaaacccuucacacc

SEQ ID NO: 1241626 - RNA, 21 nt, Homo sapiens
agaaaccuauauuucaauacu

SEQ ID NO: 1241627 - RNA, 20 nt, Homo sapiens
agaaaccuggggugaauacu

SEQ ID NO: 1241628 - RNA, 14 nt, Homo sapiens
agaaacgucuucua

SEQ ID NO: 1241629 - RNA, 20 nt, Homo sapiens
agaaacuccaaaguccacac

SEQ ID NO: 1241630 - RNA, 18 nt, Homo sapiens
agaaacuugugaagugga

SEQ ID NO: 1241631 - RNA, 19 nt, Homo sapiens
agaaacuuuaagaacaaac

SEQ ID NO: 1241632 - RNA, 17 nt, Homo sapiens
agaaagaaguccuuucu

SEQ ID NO: 1241633 - RNA, 15 nt, Homo sapiens
agaaagagucaggcc

SEQ ID NO: 1241634 - RNA, 14 nt, Homo sapiens
agaaagcaaacuua

SEQ ID NO: 1241635 - RNA, 12 nt, Homo sapiens
agaaagccaaau

SEQ ID NO: 1241636 - RNA, 11 nt, Homo sapiens
agaaagccaca

SEQ ID NO: 1241637 - RNA, 12 nt, Homo sapiens
agaaagccacaa

SEQ ID NO: 1241638 - RNA, 15 nt, Homo sapiens
agaaagccuucauaa

SEQ ID NO: 1241639 - RNA, 18 nt, Homo sapiens
agaaaggugugcugguca

SEQ ID NO: 1241640 - RNA, 18 nt, Homo sapiens
agaaagugaagcaaauca

SEQ ID NO: 1241641 - RNA, 13 nt, Homo sapiens
agaaagugccuga

SEQ ID NO: 1241642 - RNA, 12 nt, Homo sapiens
agaaaguucuca

SEQ ID NO: 1241643 - RNA, 18 nt, Homo sapiens
agaaaguucuuaaacuca

SEQ ID NO: 1241644 - RNA, 22 nt, Homo sapiens
agaaaguugauauucaaccuca

SEQ ID NO: 1241645 - RNA, 12 nt, Homo sapiens
agaaauaagccc

SEQ ID NO: 1241646 - RNA, 18 nt, Homo sapiens
agaaauaauugugucaug

SEQ ID NO: 1241647 - RNA, 23 nt, Homo sapiens
agaaauacaauucuacauuguca

SEQ ID NO: 1241648 - RNA, 19 nt, Homo sapiens
agaaauauggaacuuacau

SEQ ID NO: 1241649 - RNA, 14 nt, Homo sapiens
agaaaucaauggua

SEQ ID NO: 1241650 - RNA, 14 nt, Homo sapiens
agaaaucuauucca

SEQ ID NO: 1241651 - RNA, 16 nt, Homo sapiens
agaaaucuggucuugu

SEQ ID NO: 1241652 - RNA, 13 nt, Homo sapiens
agaaaugcaaaac

SEQ ID NO: 1241653 - RNA, 12 nt, Homo sapiens
agaaauggccaa

SEQ ID NO: 1241654 - RNA, 23 nt, Homo sapiens
agaaauguuaaagguucacaggg

SEQ ID NO: 1241655 - RNA, 14 nt, Homo sapiens
agaaauuagcugug

SEQ ID NO: 1241656 - RNA, 21 nt, Homo sapiens
agaaauuucugugaaaccugu

SEQ ID NO: 1241657 - RNA, 21 nt, Homo sapiens
agaaauuugcaacucacugau

SEQ ID NO: 1241658 - RNA, 15 nt, Homo sapiens
agaaauuuggcuaua

SEQ ID NO: 1241659 - RNA, 22 nt, Homo sapiens
agaacaaaaagaaaucuugucu

SEQ ID NO: 1241660 - RNA, 16 nt, Homo sapiens
agaacaacuacuguga

SEQ ID NO: 1241661 - RNA, 17 nt, Homo sapiens
agaacacguuggcucag

SEQ ID NO: 1241662 - RNA, 17 nt, Homo sapiens
agaacacuacugcuaaa

SEQ ID NO: 1241663 - RNA, 12 nt, Homo sapiens
agaacaggguca

SEQ ID NO: 1241664 - RNA, 20 nt, Homo sapiens
agaacauaaaaaauaaagua

SEQ ID NO: 1241665 - RNA, 12 nt, Homo sapiens
agaacauguuaa

SEQ ID NO: 1241666 - RNA, 16 nt, Homo sapiens
agaaccaaaacuucca

SEQ ID NO: 1241667 - RNA, 20 nt, Homo sapiens
agaaccaaaaguuuuccuga

SEQ ID NO: 1241668 - RNA, 16 nt, Homo sapiens
agaaccacacuugaaa

SEQ ID NO: 1241669 - RNA, 13 nt, Homo sapiens
agaaccacuuccu

SEQ ID NO: 1241670 - RNA, 21 nt, Homo sapiens
agaaccaugcaggaaggaaaa

SEQ ID NO: 1241671 - RNA, 14 nt, Homo sapiens
agaaccauuuacuu

SEQ ID NO: 1241672 - RNA, 17 nt, Homo sapiens
agaacccaggacagcca

SEQ ID NO: 1241673 - RNA, 19 nt, Homo sapiens
agaacccagggcucugccc

SEQ ID NO: 1241674 - RNA, 18 nt, Homo sapiens
agaacccuuggagccaau

SEQ ID NO: 1241675 - RNA, 14 nt, Homo sapiens
agaaccgagcaaag

SEQ ID NO: 1241676 - RNA, 18 nt, Homo sapiens
agaaccgagcaaagauca

SEQ ID NO: 1241677 - RNA, 12 nt, Homo sapiens
agaaccucaggc

SEQ ID NO: 1241678 - RNA, 13 nt, Homo sapiens
agaaccucuuccc

SEQ ID NO: 1241679 - RNA, 22 nt, Homo sapiens
agaaccuuaaugacaacacuua

SEQ ID NO: 1241680 - RNA, 14 nt, Homo sapiens
agaaccuucaaccc

SEQ ID NO: 1241681 - RNA, 15 nt, Homo sapiens
agaaccuucaaccca

SEQ ID NO: 1241682 - RNA, 20 nt, Homo sapiens
agaacguggugaccuuucac

SEQ ID NO: 1241683 - RNA, 23 nt, Homo sapiens
agaacguggugaccuuucacgaa

SEQ ID NO: 1241684 - RNA, 20 nt, Homo sapiens
agaacuaaugauaaucccac

SEQ ID NO: 1241685 - RNA, 20 nt, Homo sapiens
agaacuagccaaaccaggac

SEQ ID NO: 1241686 - RNA, 12 nt, Homo sapiens
agaacuauccaa

SEQ ID NO: 1241687 - RNA, 16 nt, Homo sapiens
agaacuauguacuuua

SEQ ID NO: 1241688 - RNA, 15 nt, Homo sapiens
agaacucacucuggg

SEQ ID NO: 1241689 - RNA, 20 nt, Homo sapiens
agaacucagcuguccagcug

SEQ ID NO: 1241690 - RNA, 18 nt, Homo sapiens
agaacucgcgcucaguaa

SEQ ID NO: 1241691 - RNA, 20 nt, Homo sapiens
agaacugaaggcauaugcac

SEQ ID NO: 1241692 - RNA, 11 nt, Homo sapiens
agaacugccau

SEQ ID NO: 1241693 - RNA, 23 nt, Homo sapiens
agaacugccauuauuuucuguca

SEQ ID NO: 1241694 - RNA, 23 nt, Homo sapiens
agaacuggaaagacauagccaac

SEQ ID NO: 1241695 - RNA, 19 nt, Homo sapiens
agaacuucagaaagacuug

SEQ ID NO: 1241696 - RNA, 21 nt, Homo sapiens
agaacuucccugauugaccug

SEQ ID NO: 1241697 - RNA, 15 nt, Homo sapiens
agaacuugauuugca

SEQ ID NO: 1241698 - RNA, 14 nt, Homo sapiens
agaacuuguuuaca

SEQ ID NO: 1241699 - RNA, 19 nt, Homo sapiens
agaagaauaaaaaauggga

SEQ ID NO: 1241700 - RNA, 18 nt, Homo sapiens
agaagacaacauuucuca

SEQ ID NO: 1241701 - RNA, 18 nt, Homo sapiens
agaagacaccagagcaga

SEQ ID NO: 1241702 - RNA, 15 nt, Homo sapiens
agaagacucugaccu

SEQ ID NO: 1241703 - RNA, 23 nt, Homo sapiens
agaagacugucagcuuccaaaca

SEQ ID NO: 1241704 - RNA, 14 nt, Homo sapiens
agaagagauuucuc

SEQ ID NO: 1241705 - RNA, 20 nt, Homo sapiens
agaagagguugggcuuccau

SEQ ID NO: 1241706 - RNA, 19 nt, Homo sapiens
agaagauccaagaggcccu

SEQ ID NO: 1241707 - RNA, 17 nt, Homo sapiens
agaagcaagacacgugg

SEQ ID NO: 1241708 - RNA, 20 nt, Homo sapiens
agaagcacccaggacuucca

SEQ ID NO: 1241709 - RNA, 12 nt, Homo sapiens
agaagcacuuga

SEQ ID NO: 1241710 - RNA, 16 nt, Homo sapiens
agaagcagaaacuggc

SEQ ID NO: 1241711 - RNA, 22 nt, Homo sapiens
agaagcagcuucuuuugucucc

SEQ ID NO: 1241712 - RNA, 13 nt, Homo sapiens
agaagcaugucuc

SEQ ID NO: 1241713 - RNA, 14 nt, Homo sapiens
agaagccagccaca

SEQ ID NO: 1241714 - RNA, 22 nt, Homo sapiens
agaagccccuuauuuuuagcca

SEQ ID NO: 1241715 - RNA, 22 nt, Homo sapiens
agaagcccugauguguccucag

SEQ ID NO: 1241716 - RNA, 19 nt, Homo sapiens
agaagcggauuuccaggga

SEQ ID NO: 1241717 - RNA, 18 nt, Homo sapiens
agaagcguuaugugcagu

SEQ ID NO: 1241718 - RNA, 23 nt, Homo sapiens
agaagcguuaugugcaguacuua

SEQ ID NO: 1241719 - RNA, 23 nt, Homo sapiens
agaagcuaaauccuuuacuguua

SEQ ID NO: 1241720 - RNA, 22 nt, Homo sapiens
agaagcuccauggacgugucug

SEQ ID NO: 1241721 - RNA, 15 nt, Homo sapiens
agaagcugagacaca

SEQ ID NO: 1241722 - RNA, 13 nt, Homo sapiens
agaagcuggugcc

SEQ ID NO: 1241723 - RNA, 20 nt, Homo sapiens
agaagcuguuguacauuuau

SEQ ID NO: 1241724 - RNA, 19 nt, Homo sapiens
agaaggaaccagccaugag

SEQ ID NO: 1241725 - RNA, 16 nt, Homo sapiens
agaaggaggggagcag

SEQ ID NO: 1241726 - RNA, 22 nt, Homo sapiens
agaaggcagcaggcggccuuug

SEQ ID NO: 1241727 - RNA, 22 nt, Homo sapiens
agaaggcaugaaauugucuagc

SEQ ID NO: 1241728 - RNA, 15 nt, Homo sapiens
agaaggcaugagaaa

SEQ ID NO: 1241729 - RNA, 23 nt, Homo sapiens
agacacagcgucccuagcaguga

SEQ ID NO: 1241730 - RNA, 22 nt, Homo sapiens
agacacaucuccuccauacuca

SEQ ID NO: 1241731 - RNA, 15 nt, Homo sapiens
agacacgcucuucua

SEQ ID NO: 1241732 - RNA, 14 nt, Homo sapiens
agacacugugcuau

SEQ ID NO: 1241733 - RNA, 19 nt, Homo sapiens
agacacuucccugcauuaa

SEQ ID NO: 1241734 - RNA, 21 nt, Homo sapiens
agacagaaccccuacaugaaa

SEQ ID NO: 1241735 - RNA, 18 nt, Homo sapiens
agacagaagucacucaau

SEQ ID NO: 1241736 - RNA, 15 nt, Homo sapiens
agacagaauguaucu

SEQ ID NO: 1241737 - RNA, 18 nt, Homo sapiens
agacagaauguaucugug

SEQ ID NO: 1241738 - RNA, 17 nt, Homo sapiens
agacagagaagaccaaa

SEQ ID NO: 1241739 - RNA, 18 nt, Homo sapiens
agacagagagacuggcca

SEQ ID NO: 1241740 - RNA, 20 nt, Homo sapiens
agacagauuuaaagcacaug

SEQ ID NO: 1241741 - RNA, 16 nt, Homo sapiens
agacagcuucucugca

SEQ ID NO: 1241742 - RNA, 24 nt, Homo sapiens
agacaggaaaguuccagaaacuuu

SEQ ID NO: 1241743 - RNA, 20 nt, Homo sapiens
agacaggaugguuacucuug

SEQ ID NO: 1241744 - RNA, 20 nt, Homo sapiens
agacaggccaugugagccac

SEQ ID NO: 1241745 - RNA, 16 nt, Homo sapiens
agacaggcucuuagca

SEQ ID NO: 1241746 - RNA, 19 nt, Homo sapiens
agacaggguuuugccaugu

SEQ ID NO: 1241747 - RNA, 13 nt, Homo sapiens
agacauaaagcca

SEQ ID NO: 1241748 - RNA, 14 nt, Homo sapiens
agacauaacaaaac

SEQ ID NO: 1241749 - RNA, 20 nt, Homo sapiens
agacauacauuuaugcacau

SEQ ID NO: 1241750 - RNA, 19 nt, Homo sapiens
agacauacgaaacacaaac

SEQ ID NO: 1241751 - RNA, 19 nt, Homo sapiens
agacauacuccuuccauca

SEQ ID NO: 1241752 - RNA, 12 nt, Homo sapiens
agacaucaucaa

SEQ ID NO: 1241753 - RNA, 21 nt, Homo sapiens
agacaucauguaucgcauauu

SEQ ID NO: 1241754 - RNA, 14 nt, Homo sapiens
agacauccauguuu

SEQ ID NO: 1241755 - RNA, 19 nt, Homo sapiens
agacaucggccuccaugac

SEQ ID NO: 1241756 - RNA, 13 nt, Homo sapiens
agacaucucagga

SEQ ID NO: 1241757 - RNA, 22 nt, Homo sapiens
agacaucucaggauuucaccag

SEQ ID NO: 1241758 - RNA, 14 nt, Homo sapiens
agacaugaaccaag

SEQ ID NO: 1241759 - RNA, 20 nt, Homo sapiens
agacaugagccuccgcgccu

SEQ ID NO: 1241760 - RNA, 17 nt, Homo sapiens
agacauggagguucuaa

SEQ ID NO: 1241761 - RNA, 19 nt, Homo sapiens
agacaugugaggaggaaaa

SEQ ID NO: 1241762 - RNA, 13 nt, Homo sapiens
agacauuccacca

SEQ ID NO: 1241763 - RNA, 14 nt, Homo sapiens
agacauucuuccaa

SEQ ID NO: 1241764 - RNA, 12 nt, Homo sapiens
agaccaaaauaa

SEQ ID NO: 1241765 - RNA, 15 nt, Homo sapiens
agaccaaccuuccau

SEQ ID NO: 1241766 - RNA, 14 nt, Homo sapiens
agaccaaggcacug

SEQ ID NO: 1241767 - RNA, 19 nt, Homo sapiens
agaccaauucuaacagcaa

SEQ ID NO: 1241768 - RNA, 21 nt, Homo sapiens
agaccacaaaaauugacucaa

SEQ ID NO: 1241769 - RNA, 21 nt, Homo sapiens
agaccacgcccguccugccug

SEQ ID NO: 1241770 - RNA, 14 nt, Homo sapiens
agaccagaagugga

SEQ ID NO: 1241771 - RNA, 12 nt, Homo sapiens
agaccagcuuug

SEQ ID NO: 1241772 - RNA, 17 nt, Homo sapiens
agaccagcuuugcagug

SEQ ID NO: 1241773 - RNA, 17 nt, Homo sapiens
agaccaguauggcaaaa

SEQ ID NO: 1241774 - RNA, 13 nt, Homo sapiens
agaccaguccaug

SEQ ID NO: 1241775 - RNA, 19 nt, Homo sapiens
agaccaguugggagcacug

SEQ ID NO: 1241776 - RNA, 19 nt, Homo sapiens
agacccaguggacucuucc

SEQ ID NO: 1241777 - RNA, 13 nt, Homo sapiens
agaccccagguca

SEQ ID NO: 1241778 - RNA, 17 nt, Homo sapiens
agacccccacaccucag

SEQ ID NO: 1241779 - RNA, 12 nt, Homo sapiens
agacccggcugc

SEQ ID NO: 1241780 - RNA, 18 nt, Homo sapiens
agacccguagaugccagg

SEQ ID NO: 1241781 - RNA, 21 nt, Homo sapiens
agacccugagaaggacccugg

SEQ ID NO: 1241782 - RNA, 23 nt, Homo sapiens
agacccuugacaccugcugagaa

SEQ ID NO: 1241783 - RNA, 18 nt, Homo sapiens
agaccggcugguggagcu

SEQ ID NO: 1241784 - RNA, 22 nt, Homo sapiens
agaccuaacccaccauagucaa

SEQ ID NO: 1241785 - RNA, 16 nt, Homo sapiens
agaccuaccucagguu

SEQ ID NO: 1241786 - RNA, 16 nt, Homo sapiens
agaccucugugcacuu

SEQ ID NO: 1241787 - RNA, 23 nt, Homo sapiens
agaccugaaagaugggcaaaaga

SEQ ID NO: 1241788 - RNA, 15 nt, Homo sapiens
agaccuggcacugga

SEQ ID NO: 1241789 - RNA, 13 nt, Homo sapiens
agaccuggugcug

SEQ ID NO: 1241790 - RNA, 20 nt, Homo sapiens
agaccugguucccgccuccc

SEQ ID NO: 1241791 - RNA, 20 nt, Homo sapiens
agaccuugucuccacaaaaa

SEQ ID NO: 1241792 - RNA, 17 nt, Homo sapiens
agaccuuuggagcaaag

SEQ ID NO: 1241793 - RNA, 23 nt, Homo sapiens
agacgaggccacagcugccaucg

SEQ ID NO: 1241794 - RNA, 17 nt, Homo sapiens
agcaauucuccugccuc

SEQ ID NO: 1241795 - RNA, 20 nt, Homo sapiens
agcaauucuccugccuuagc

SEQ ID NO: 1241796 - RNA, 13 nt, Homo sapiens
agcaauugcauaa

SEQ ID NO: 1241797 - RNA, 14 nt, Homo sapiens
agcaauuucuaauu

SEQ ID NO: 1241798 - RNA, 22 nt, Homo sapiens
agcaauuugauaaaauauacuu

SEQ ID NO: 1241799 - RNA, 22 nt, Homo sapiens
agcacaaacuuuaggguaaaaa

SEQ ID NO: 1241800 - RNA, 21 nt, Homo sapiens
agcacaacccccccaaaacaa

SEQ ID NO: 1241801 - RNA, 12 nt, Homo sapiens
agcacaagaagc

SEQ ID NO: 1241802 - RNA, 19 nt, Homo sapiens
agcacaagcagagugcaca

SEQ ID NO: 1241803 - RNA, 22 nt, Homo sapiens
agcacaagccacaagucuucca

SEQ ID NO: 1241804 - RNA, 15 nt, Homo sapiens
agcacaauuugcacu

SEQ ID NO: 1241805 - RNA, 13 nt, Homo sapiens
agcacacuuuucc

SEQ ID NO: 1241806 - RNA, 16 nt, Homo sapiens
agcacacuuuuccaca

SEQ ID NO: 1241807 - RNA, 15 nt, Homo sapiens
agcacagcagcaucu

SEQ ID NO: 1241808 - RNA, 16 nt, Homo sapiens
agcacagcuugaccug

SEQ ID NO: 1241809 - RNA, 16 nt, Homo sapiens
agcaccaaccuuccaa

SEQ ID NO: 1241810 - RNA, 15 nt, Homo sapiens
agcaccaggacucag

SEQ ID NO: 1241811 - RNA, 14 nt, Homo sapiens
agcaccccaugcca

SEQ ID NO: 1241812 - RNA, 14 nt, Homo sapiens
agcaccccuugccg

SEQ ID NO: 1241813 - RNA, 17 nt, Homo sapiens
agcacccugggugccau

SEQ ID NO: 1241814 - RNA, 20 nt, Homo sapiens
agcaccuccccgcugggaag

SEQ ID NO: 1241815 - RNA, 14 nt, Homo sapiens
agcaccugcucaac

SEQ ID NO: 1241816 - RNA, 18 nt, Homo sapiens
agcaccuucuuucuggac

SEQ ID NO: 1241817 - RNA, 18 nt, Homo sapiens
agcacgagcuggaaccca

SEQ ID NO: 1241818 - RNA, 17 nt, Homo sapiens
agcacuacaccuugccu

SEQ ID NO: 1241819 - RNA, 18 nt, Homo sapiens
agcacuacauaaacugac

SEQ ID NO: 1241820 - RNA, 13 nt, Homo sapiens
agcacuagaauau

SEQ ID NO: 1241821 - RNA, 19 nt, Homo sapiens
agcacuauguggagcucag

SEQ ID NO: 1241822 - RNA, 21 nt, Homo sapiens
agcacuccccagagcugugcc

SEQ ID NO: 1241823 - RNA, 17 nt, Homo sapiens
agcacuccccuugccuu

SEQ ID NO: 1241824 - RNA, 17 nt, Homo sapiens
agcacugugagcaccug

SEQ ID NO: 1241825 - RNA, 22 nt, Homo sapiens
agcacuuacagcucuggccaca

SEQ ID NO: 1241826 - RNA, 20 nt, Homo sapiens
agcacuuagcaggcaccgcc

SEQ ID NO: 1241827 - RNA, 23 nt, Homo sapiens
agcagaaaucuagaagacuguca

SEQ ID NO: 1241828 - RNA, 20 nt, Homo sapiens
agcagaagagaaaauguugu

SEQ ID NO: 1241829 - RNA, 17 nt, Homo sapiens
agcagagacaugacuca

SEQ ID NO: 1241830 - RNA, 22 nt, Homo sapiens
agcagagaccuuccaaggacau

SEQ ID NO: 1241831 - RNA, 22 nt, Homo sapiens
agcagagaguccaauuuauuga

SEQ ID NO: 1241832 - RNA, 14 nt, Homo sapiens
agcagaggggccag

SEQ ID NO: 1241833 - RNA, 15 nt, Homo sapiens
agcagaggucuccca

SEQ ID NO: 1241834 - RNA, 18 nt, Homo sapiens
agcagagugcacagcugu

SEQ ID NO: 1241835 - RNA, 13 nt, Homo sapiens
agcagaugaugcc

SEQ ID NO: 1241836 - RNA, 13 nt, Homo sapiens
agcagauggagua

SEQ ID NO: 1241837 - RNA, 23 nt, Homo sapiens
agcagcacuguucuguccucaag

SEQ ID NO: 1241838 - RNA, 13 nt, Homo sapiens
agcagcagcacca

SEQ ID NO: 1241839 - RNA, 16 nt, Homo sapiens
agcagccacaaccaaa

SEQ ID NO: 1241840 - RNA, 18 nt, Homo sapiens
agcagccaguucaaaaac

SEQ ID NO: 1241841 - RNA, 14 nt, Homo sapiens
agcagccccgggag

SEQ ID NO: 1241842 - RNA, 14 nt, Homo sapiens
agcagcccugucac

SEQ ID NO: 1241843 - RNA, 18 nt, Homo sapiens
agcagccuaacacggugc

SEQ ID NO: 1241844 - RNA, 22 nt, Homo sapiens
agcagccuguacuagcuuuuga

SEQ ID NO: 1241845 - RNA, 18 nt, Homo sapiens
agcagcggggcagugugg

SEQ ID NO: 1241846 - RNA, 17 nt, Homo sapiens
agcagcugaaaauuuau

SEQ ID NO: 1241847 - RNA, 13 nt, Homo sapiens
agcagcuggugcu

SEQ ID NO: 1241848 - RNA, 15 nt, Homo sapiens
agcagcuucugggac

SEQ ID NO: 1241849 - RNA, 21 nt, Homo sapiens
agcagcuucuuuugucuccca

SEQ ID NO: 1241850 - RNA, 18 nt, Homo sapiens
agcagcuuugggauccca

SEQ ID NO: 1241851 - RNA, 15 nt, Homo sapiens
agcaggaaaccugug

SEQ ID NO: 1241852 - RNA, 23 nt, Homo sapiens
agcaggaaggugacucugaccuu

SEQ ID NO: 1241853 - RNA, 16 nt, Homo sapiens
agcaggagccagccaa

SEQ ID NO: 1241854 - RNA, 14 nt, Homo sapiens
agcaggcaauuuca

SEQ ID NO: 1241855 - RNA, 11 nt, Homo sapiens
agcaggcaugg

SEQ ID NO: 1241856 - RNA, 15 nt, Homo sapiens
agcaggccggaacca

SEQ ID NO: 1241857 - RNA, 21 nt, Homo sapiens
agccaauguuuuccacccaua

SEQ ID NO: 1241858 - RNA, 22 nt, Homo sapiens
agccacaaaugccuugaacugu

SEQ ID NO: 1241859 - RNA, 19 nt, Homo sapiens
agccacagcagguccucca

SEQ ID NO: 1241860 - RNA, 17 nt, Homo sapiens
agccacgaggugcagua

SEQ ID NO: 1241861 - RNA, 14 nt, Homo sapiens
agccacugugaugc

SEQ ID NO: 1241862 - RNA, 16 nt, Homo sapiens
agccagccaagcuuua

SEQ ID NO: 1241863 - RNA, 12 nt, Homo sapiens
agccagccugac

SEQ ID NO: 1241864 - RNA, 18 nt, Homo sapiens
agccagccugaccuuccu

SEQ ID NO: 1241865 - RNA, 15 nt, Homo sapiens
agccagcucaaauca

SEQ ID NO: 1241866 - RNA, 18 nt, Homo sapiens
agccagcugugcacuuuc

SEQ ID NO: 1241867 - RNA, 13 nt, Homo sapiens
agccaggacaucu

SEQ ID NO: 1241868 - RNA, 15 nt, Homo sapiens
agccaggaccacaga

SEQ ID NO: 1241869 - RNA, 20 nt, Homo sapiens
agccaggaccacagagcucc

SEQ ID NO: 1241870 - RNA, 18 nt, Homo sapiens
agccaggaggccugcuag

SEQ ID NO: 1241871 - RNA, 18 nt, Homo sapiens
agccaggccaacagcacc

SEQ ID NO: 1241872 - RNA, 18 nt, Homo sapiens
agccaggccccaagccca

SEQ ID NO: 1241873 - RNA, 22 nt, Homo sapiens
agccaggccugggggcagccuc

SEQ ID NO: 1241874 - RNA, 21 nt, Homo sapiens
agccaggcuaugguugccacc

SEQ ID NO: 1241875 - RNA, 14 nt, Homo sapiens
agccagggggacua

SEQ ID NO: 1241876 - RNA, 17 nt, Homo sapiens
agccagggggacuagcc

SEQ ID NO: 1241877 - RNA, 19 nt, Homo sapiens
agccagggggacuagcccc

SEQ ID NO: 1241878 - RNA, 15 nt, Homo sapiens
agccaggugagcucu

SEQ ID NO: 1241879 - RNA, 16 nt, Homo sapiens
agccaguaaucuuuau

SEQ ID NO: 1241880 - RNA, 16 nt, Homo sapiens
agccagugccauucca

SEQ ID NO: 1241881 - RNA, 17 nt, Homo sapiens
agccagugccauuccac

SEQ ID NO: 1241882 - RNA, 17 nt, Homo sapiens
agccaucguccugggac

SEQ ID NO: 1241883 - RNA, 15 nt, Homo sapiens
agccaucuaaugcuu

SEQ ID NO: 1241884 - RNA, 15 nt, Homo sapiens
agccaucucuaauaa

SEQ ID NO: 1241885 - RNA, 21 nt, Homo sapiens
agccaugaucgagccacugca

SEQ ID NO: 1241886 - RNA, 11 nt, Homo sapiens
agccaugggcc

SEQ ID NO: 1241887 - RNA, 15 nt, Homo sapiens
agccauguaucucag

SEQ ID NO: 1241888 - RNA, 21 nt, Homo sapiens
agccauugcggccccaggagg

SEQ ID NO: 1241889 - RNA, 16 nt, Homo sapiens
agccauuggcacugug

SEQ ID NO: 1241890 - RNA, 17 nt, Homo sapiens
agccauuucacucucaa

SEQ ID NO: 1241891 - RNA, 20 nt, Homo sapiens
agccauuucccccuccucag

SEQ ID NO: 1241892 - RNA, 19 nt, Homo sapiens
agccauuuuuaaugaucuc

SEQ ID NO: 1241893 - RNA, 22 nt, Homo sapiens
agcccaaaggggacaggccuca

SEQ ID NO: 1241894 - RNA, 14 nt, Homo sapiens
agcccaaguucaug

SEQ ID NO: 1241895 - RNA, 15 nt, Homo sapiens
agcccacacuugaga

SEQ ID NO: 1241896 - RNA, 18 nt, Homo sapiens
agcccagaauagcuuuga

SEQ ID NO: 1241897 - RNA, 12 nt, Homo sapiens
agcccagacuuu

SEQ ID NO: 1241898 - RNA, 20 nt, Homo sapiens
agcccagaucgcaccacugc

SEQ ID NO: 1241899 - RNA, 15 nt, Homo sapiens
agcccagauggaaag

SEQ ID NO: 1241900 - RNA, 16 nt, Homo sapiens
agcccauagccagcug

SEQ ID NO: 1241901 - RNA, 12 nt, Homo sapiens
agcccauaucac

SEQ ID NO: 1241902 - RNA, 18 nt, Homo sapiens
agcccauccagucuccca

SEQ ID NO: 1241903 - RNA, 14 nt, Homo sapiens
agcccauggcuuua

SEQ ID NO: 1241904 - RNA, 23 nt, Homo sapiens
agcccauggcuuuagcuaccuca

SEQ ID NO: 1241905 - RNA, 14 nt, Homo sapiens
agccccacugccag

SEQ ID NO: 1241906 - RNA, 14 nt, Homo sapiens
agccccacuugaag

SEQ ID NO: 1241907 - RNA, 16 nt, Homo sapiens
agccccauccaacacu

SEQ ID NO: 1241908 - RNA, 22 nt, Homo sapiens
agccccauucugccugcccagg

SEQ ID NO: 1241909 - RNA, 17 nt, Homo sapiens
agcccccaaaacagccu

SEQ ID NO: 1241910 - RNA, 20 nt, Homo sapiens
agcccccccaacacugugcc

SEQ ID NO: 1241911 - RNA, 24 nt, Homo sapiens
agcccccuggaugggcauugggcu

SEQ ID NO: 1241912 - RNA, 23 nt, Homo sapiens
agccccggugugcggugcauaca

SEQ ID NO: 1241913 - RNA, 15 nt, Homo sapiens
agccccugguccuga

SEQ ID NO: 1241914 - RNA, 20 nt, Homo sapiens
agccccuguauggcacuggc

SEQ ID NO: 1241915 - RNA, 21 nt, Homo sapiens
agccccuuauuugcacuucac

SEQ ID NO: 1241916 - RNA, 21 nt, Homo sapiens
agccccuuccuggguauuuau

SEQ ID NO: 1241917 - RNA, 20 nt, Homo sapiens
agcccgaacucgcggcaaaa

SEQ ID NO: 1241918 - RNA, 16 nt, Homo sapiens
agccuuagcugccagu

SEQ ID NO: 1241919 - RNA, 20 nt, Homo sapiens
agccuuauaaaccaaucuua

SEQ ID NO: 1241920 - RNA, 19 nt, Homo sapiens
agccuuauuuaugauguau

SEQ ID NO: 1241921 - RNA, 17 nt, Homo sapiens
agccuucaagugccaaa

SEQ ID NO: 1241922 - RNA, 18 nt, Homo sapiens
agccuucccaacaugccu

SEQ ID NO: 1241923 - RNA, 12 nt, Homo sapiens
agccuugcacua

SEQ ID NO: 1241924 - RNA, 14 nt, Homo sapiens
agccuugcacuagg

SEQ ID NO: 1241925 - RNA, 15 nt, Homo sapiens
agccuuguaaauaac

SEQ ID NO: 1241926 - RNA, 17 nt, Homo sapiens
agccuuguugguggaga

SEQ ID NO: 1241927 - RNA, 19 nt, Homo sapiens
agccuuuacuguuugauau

SEQ ID NO: 1241928 - RNA, 16 nt, Homo sapiens
agccuuugcccuguca

SEQ ID NO: 1241929 - RNA, 17 nt, Homo sapiens
agccuuuggcucuggag

SEQ ID NO: 1241930 - RNA, 13 nt, Homo sapiens
agcgaaucucugc

SEQ ID NO: 1241931 - RNA, 14 nt, Homo sapiens
agcgaaucucugcc

SEQ ID NO: 1241932 - RNA, 22 nt, Homo sapiens
agcgccaaauguucauccucau

SEQ ID NO: 1241933 - RNA, 17 nt, Homo sapiens
agcgccagcucuaccag

SEQ ID NO: 1241934 - RNA, 14 nt, Homo sapiens
agcgccugugcaca

SEQ ID NO: 1241935 - RNA, 21 nt, Homo sapiens
agcgcugcucuuaugccauuu

SEQ ID NO: 1241936 - RNA, 20 nt, Homo sapiens
agcgcuucugcaccaacuca

SEQ ID NO: 1241937 - RNA, 21 nt, Homo sapiens
agcgcuucugcaccaacucac

SEQ ID NO: 1241938 - RNA, 21 nt, Homo sapiens
agcggacuggugaggagcaca

SEQ ID NO: 1241939 - RNA, 22 nt, Homo sapiens
agcggccccccgcacagccacc

SEQ ID NO: 1241940 - RNA, 14 nt, Homo sapiens
agcggcuguucccc

SEQ ID NO: 1241941 - RNA, 17 nt, Homo sapiens
agcgggaggcagaguuu

SEQ ID NO: 1241942 - RNA, 17 nt, Homo sapiens
agcgggcggaggggauc

SEQ ID NO: 1241943 - RNA, 13 nt, Homo sapiens
agcgguaccccag

SEQ ID NO: 1241944 - RNA, 14 nt, Homo sapiens
agcggugggcugcc

SEQ ID NO: 1241945 - RNA, 22 nt, Homo sapiens
agcgucacucuaccuaaugucu

SEQ ID NO: 1241946 - RNA, 13 nt, Homo sapiens
agcgugagccacu

SEQ ID NO: 1241947 - RNA, 16 nt, Homo sapiens
agcgugagccacugca

SEQ ID NO: 1241948 - RNA, 19 nt, Homo sapiens
agcguuccaaguuccccau

SEQ ID NO: 1241949 - RNA, 17 nt, Homo sapiens
agcguucccagcagggg

SEQ ID NO: 1241950 - RNA, 15 nt, Homo sapiens
agcuaaagaggcuga

SEQ ID NO: 1241951 - RNA, 12 nt, Homo sapiens
agcuaaccauca

SEQ ID NO: 1241952 - RNA, 20 nt, Homo sapiens
agcuaaccccaagcugccuc

SEQ ID NO: 1241953 - RNA, 20 nt, Homo sapiens
agcuaacccucacaagcaug

SEQ ID NO: 1241954 - RNA, 16 nt, Homo sapiens
agcuaagacauauuca

SEQ ID NO: 1241955 - RNA, 13 nt, Homo sapiens
agcuaagccacau

SEQ ID NO: 1241956 - RNA, 23 nt, Homo sapiens
agcuaaggucacauugugccuuu

SEQ ID NO: 1241957 - RNA, 12 nt, Homo sapiens
agcuaagugaaa

SEQ ID NO: 1241958 - RNA, 19 nt, Homo sapiens
agcuaagugaaaaggucau

SEQ ID NO: 1241959 - RNA, 13 nt, Homo sapiens
agcuaauauacag

SEQ ID NO: 1241960 - RNA, 22 nt, Homo sapiens
agcuaauggcgaucaucuuugc

SEQ ID NO: 1241961 - RNA, 17 nt, Homo sapiens
agcuaauuaaacacauu

SEQ ID NO: 1241962 - RNA, 19 nt, Homo sapiens
agcuaauuuauagcaagau

SEQ ID NO: 1241963 - RNA, 13 nt, Homo sapiens
agcuacagcuuuc

SEQ ID NO: 1241964 - RNA, 13 nt, Homo sapiens
agcuacaggacau

SEQ ID NO: 1241965 - RNA, 21 nt, Homo sapiens
agcuacagucuaaaauugcuu

SEQ ID NO: 1241966 - RNA, 11 nt, Homo sapiens
agcuacagugu

SEQ ID NO: 1241967 - RNA, 17 nt, Homo sapiens
agcuacaucaguuugau

SEQ ID NO: 1241968 - RNA, 22 nt, Homo sapiens
agcuaccacgggucugccaugc

SEQ ID NO: 1241969 - RNA, 16 nt, Homo sapiens
agcuaccucaaacuuc

SEQ ID NO: 1241970 - RNA, 21 nt, Homo sapiens
agcuaccucacuaugcugcuu

SEQ ID NO: 1241971 - RNA, 14 nt, Homo sapiens
agcuacugacuaug

SEQ ID NO: 1241972 - RNA, 19 nt, Homo sapiens
agcuacuucaaauguggua

SEQ ID NO: 1241973 - RNA, 11 nt, Homo sapiens
agcuacuuucc

SEQ ID NO: 1241974 - RNA, 14 nt, Homo sapiens
agcuagaauaccac

SEQ ID NO: 1241975 - RNA, 16 nt, Homo sapiens
agcuagaugccacugc

SEQ ID NO: 1241976 - RNA, 15 nt, Homo sapiens
agcuaggaugguucu

SEQ ID NO: 1241977 - RNA, 21 nt, Homo sapiens
agcuaggaugguucugugacc

SEQ ID NO: 1241978 - RNA, 15 nt, Homo sapiens
agcuagugagcaaaa

SEQ ID NO: 1241979 - RNA, 23 nt, Homo sapiens
auuauaguuuaaauucaauuaca

SEQ ID NO: 1241980 - RNA, 20 nt, Homo sapiens
auuaucacagugaaugcacu

SEQ ID NO: 1241981 - RNA, 13 nt, Homo sapiens
auuaucaucugaa

SEQ ID NO: 1241982 - RNA, 22 nt, Homo sapiens
auuauccuagauuauaucaaag

SEQ ID NO: 1241983 - RNA, 17 nt, Homo sapiens
auuaucgggaacagugu

SEQ ID NO: 1241984 - RNA, 17 nt, Homo sapiens
auuaucgggagcagugu

SEQ ID NO: 1241985 - RNA, 21 nt, Homo sapiens
auuaucgggagcagugucuuc

SEQ ID NO: 1241986 - RNA, 16 nt, Homo sapiens
auuaucuauuaucuca

SEQ ID NO: 1241987 - RNA, 21 nt, Homo sapiens
auuaucucaaggaauguacaa

SEQ ID NO: 1241988 - RNA, 15 nt, Homo sapiens
auuaucugugucaaa

SEQ ID NO: 1241989 - RNA, 22 nt, Homo sapiens
auuaucugugucaaaagccaga

SEQ ID NO: 1241990 - RNA, 22 nt, Homo sapiens
auuaugaagugacucucacaag

SEQ ID NO: 1241991 - RNA, 16 nt, Homo sapiens
auuaugagaggcaaug

SEQ ID NO: 1241992 - RNA, 21 nt, Homo sapiens
auuaugcagacaaccucauca

SEQ ID NO: 1241993 - RNA, 19 nt, Homo sapiens
auuauguaauauauuguac

SEQ ID NO: 1241994 - RNA, 22 nt, Homo sapiens
auuaugugcacuaccauagcua

SEQ ID NO: 1241995 - RNA, 18 nt, Homo sapiens
auuauguggcccucugga

SEQ ID NO: 1241996 - RNA, 13 nt, Homo sapiens
auuauuaauugca

SEQ ID NO: 1241997 - RNA, 14 nt, Homo sapiens
auuauuaugucuca

SEQ ID NO: 1241998 - RNA, 23 nt, Homo sapiens
auuauucugggcaccacaaaaua

SEQ ID NO: 1241999 - RNA, 19 nt, Homo sapiens
auuauuuauucagcuucau

SEQ ID NO: 1242000 - RNA, 14 nt, Homo sapiens
auuauuuccagugu

SEQ ID NO: 1242001 - RNA, 22 nt, Homo sapiens
auuauuuccaguguucuaugaa

SEQ ID NO: 1242002 - RNA, 22 nt, Homo sapiens
auuauuuuuauuuuuaaacagg

SEQ ID NO: 1242003 - RNA, 18 nt, Homo sapiens
auucaaacuuuuauuagc

SEQ ID NO: 1242004 - RNA, 15 nt, Homo sapiens
auucaacaauuucaa

SEQ ID NO: 1242005 - RNA, 12 nt, Homo sapiens
auucaacuaccu

SEQ ID NO: 1242006 - RNA, 16 nt, Homo sapiens
auucaacucuccaaug

SEQ ID NO: 1242007 - RNA, 22 nt, Homo sapiens
auucaacugccauguuuugcca

SEQ ID NO: 1242008 - RNA, 17 nt, Homo sapiens
auucaagcaaacaucaa

SEQ ID NO: 1242009 - RNA, 23 nt, Homo sapiens
auucaaucuuuggaggcuuuuaa

SEQ ID NO: 1242010 - RNA, 21 nt, Homo sapiens
auucaauuacauaguccagug

SEQ ID NO: 1242011 - RNA, 21 nt, Homo sapiens
auucacacaacaccucacuuu

SEQ ID NO: 1242012 - RNA, 16 nt, Homo sapiens
auucacacauggcaug

SEQ ID NO: 1242013 - RNA, 20 nt, Homo sapiens
caaccugcucuccucuugcc

SEQ ID NO: 1242014 - RNA, 23 nt, Homo sapiens
caaccuggucacaggacucugcc

SEQ ID NO: 1242015 - RNA, 18 nt, Homo sapiens
caaccuucacaucuguca

SEQ ID NO: 1242016 - RNA, 16 nt, Homo sapiens
caacggcuuagacuuc

SEQ ID NO: 1242017 - RNA, 14 nt, Homo sapiens
caacgugugggcag

SEQ ID NO: 1242018 - RNA, 21 nt, Homo sapiens
caacguucgauuucuaccuca

SEQ ID NO: 1242019 - RNA, 18 nt, Homo sapiens
caacuaaugccuuacucu

SEQ ID NO: 1242020 - RNA, 14 nt, Homo sapiens
caacuauuuuucca

SEQ ID NO: 1242021 - RNA, 20 nt, Homo sapiens
caacucugagaucuaaggau

SEQ ID NO: 1242022 - RNA, 22 nt, Homo sapiens
caacucuguaaauauguaugua

SEQ ID NO: 1242023 - RNA, 19 nt, Homo sapiens
caacugaaguucuauuuau

SEQ ID NO: 1242024 - RNA, 17 nt, Homo sapiens
caacugauacuucacua

SEQ ID NO: 1242025 - RNA, 12 nt, Homo sapiens
caacugcaaaaa

SEQ ID NO: 1242026 - RNA, 21 nt, Homo sapiens
caacugcccccgccacaaccc

SEQ ID NO: 1242027 - RNA, 18 nt, Homo sapiens
caacugccugccuuaggg

SEQ ID NO: 1242028 - RNA, 15 nt, Homo sapiens
caacuggagcacuga

SEQ ID NO: 1242029 - RNA, 19 nt, Homo sapiens
caacuguauaacuauuuac

SEQ ID NO: 1242030 - RNA, 14 nt, Homo sapiens
caacuucagcagua

SEQ ID NO: 1242031 - RNA, 21 nt, Homo sapiens
caacuucauuugaugcuaaau

SEQ ID NO: 1242032 - RNA, 15 nt, Homo sapiens
caacuuccuguugau

SEQ ID NO: 1242033 - RNA, 16 nt, Homo sapiens
caacuugagggcccag

SEQ ID NO: 1242034 - RNA, 23 nt, Homo sapiens
caacuuuaauugcuuaaaagaca

SEQ ID NO: 1242035 - RNA, 20 nt, Homo sapiens
caacuuuguggaugucuucc

SEQ ID NO: 1242036 - RNA, 15 nt, Homo sapiens
caacuuuguuuucca

SEQ ID NO: 1242037 - RNA, 17 nt, Homo sapiens
caagaaaaacaucuuug

SEQ ID NO: 1242038 - RNA, 19 nt, Homo sapiens
caagaaaaguugaagaaga

SEQ ID NO: 1242039 - RNA, 16 nt, Homo sapiens
caagaaacgucuucua

SEQ ID NO: 1242040 - RNA, 20 nt, Homo sapiens
caagaaauaugaagcacuuu

SEQ ID NO: 1242041 - RNA, 13 nt, Homo sapiens
caagaaccucucc

SEQ ID NO: 1242042 - RNA, 15 nt, Homo sapiens
caagaagaaugaacu

SEQ ID NO: 1242043 - RNA, 21 nt, Homo sapiens
caagaagcguuaugugcagua

SEQ ID NO: 1242044 - RNA, 23 nt, Homo sapiens
caagaauagaugcugacuguacu

SEQ ID NO: 1242045 - RNA, 18 nt, Homo sapiens
caagaauggggaucacag

SEQ ID NO: 1242046 - RNA, 19 nt, Homo sapiens
caagaauggggaucacaga

SEQ ID NO: 1242047 - RNA, 19 nt, Homo sapiens
caagaauuaaguauuuucc

SEQ ID NO: 1242048 - RNA, 15 nt, Homo sapiens
caagacaaaaagcca

SEQ ID NO: 1242049 - RNA, 22 nt, Homo sapiens
caagacaauucuucuucuucca

SEQ ID NO: 1242050 - RNA, 22 nt, Homo sapiens
caagacagugccuauacugccu

SEQ ID NO: 1242051 - RNA, 22 nt, Homo sapiens
caagacauuucucuaacuccug

SEQ ID NO: 1242052 - RNA, 18 nt, Homo sapiens
caagacccccagcacuug

SEQ ID NO: 1242053 - RNA, 18 nt, Homo sapiens
caagaccucugugcacuu

SEQ ID NO: 1242054 - RNA, 16 nt, Homo sapiens
caagaccuucucccca

SEQ ID NO: 1242055 - RNA, 16 nt, Homo sapiens
caagacucaccucauc

SEQ ID NO: 1242056 - RNA, 19 nt, Homo sapiens
caagacuccaucucaaaaa

SEQ ID NO: 1242057 - RNA, 19 nt, Homo sapiens
caagacuuagagcugggaa

SEQ ID NO: 1242058 - RNA, 13 nt, Homo sapiens
caagagcugagaa

SEQ ID NO: 1242059 - RNA, 15 nt, Homo sapiens
caagagcuuacauaa

SEQ ID NO: 1242060 - RNA, 16 nt, Homo sapiens
caagaggacugagacu

SEQ ID NO: 1242061 - RNA, 16 nt, Homo sapiens
caagagggauaaaaca

SEQ ID NO: 1242062 - RNA, 13 nt, Homo sapiens
caagaggggaaaa

SEQ ID NO: 1242063 - RNA, 22 nt, Homo sapiens
caagaggguccuuuaguaccug

SEQ ID NO: 1242064 - RNA, 22 nt, Homo sapiens
caagaguacagaagcuuuagca

SEQ ID NO: 1242065 - RNA, 15 nt, Homo sapiens
caagaguggacugaa

SEQ ID NO: 1242066 - RNA, 21 nt, Homo sapiens
caagaguuuauuuccaaauaa

SEQ ID NO: 1242067 - RNA, 21 nt, Homo sapiens
caagaguuuucuuccuuguaa

SEQ ID NO: 1242068 - RNA, 21 nt, Homo sapiens
caagauacugcuacuguaauu

SEQ ID NO: 1242069 - RNA, 18 nt, Homo sapiens
caagauauaauggauaau

SEQ ID NO: 1242070 - RNA, 20 nt, Homo sapiens
caagauccgagucuacccag

SEQ ID NO: 1242071 - RNA, 20 nt, Homo sapiens
caagaucgccccacugcacu

SEQ ID NO: 1242072 - RNA, 16 nt, Homo sapiens
caagaucuacaggaca

SEQ ID NO: 1242073 - RNA, 17 nt, Homo sapiens
caagaucuuucaggaaa

SEQ ID NO: 1242074 - RNA, 14 nt, Homo sapiens
caagauucuacuug

SEQ ID NO: 1242075 - RNA, 16 nt, Homo sapiens
caagcaaaaugucucu

SEQ ID NO: 1242076 - RNA, 13 nt, Homo sapiens
caagcaaugcaag

SEQ ID NO: 1242077 - RNA, 14 nt, Homo sapiens
caagcaccugcuca

SEQ ID NO: 1242078 - RNA, 19 nt, Homo sapiens
caagcagcuggugcuccaa

SEQ ID NO: 1242079 - RNA, 20 nt, Homo sapiens
caagcauuucuagcagugau

SEQ ID NO: 1242080 - RNA, 23 nt, Homo sapiens
caagccaaaaaccuuagcucccu

SEQ ID NO: 1242081 - RNA, 18 nt, Homo sapiens
caagccaguacgugcuaa

SEQ ID NO: 1242082 - RNA, 17 nt, Homo sapiens
caagccauucacuuccc

SEQ ID NO: 1242083 - RNA, 16 nt, Homo sapiens
caagcccaggugccag

SEQ ID NO: 1242084 - RNA, 16 nt, Homo sapiens
caagccccacuuauuc

SEQ ID NO: 1242085 - RNA, 17 nt, Homo sapiens
caagccccauuuccuca

SEQ ID NO: 1242086 - RNA, 17 nt, Homo sapiens
caagccccucagcccuu

SEQ ID NO: 1242087 - RNA, 18 nt, Homo sapiens
caagccgggaaugagcuu

SEQ ID NO: 1242088 - RNA, 15 nt, Homo sapiens
caagccuacaugaca

SEQ ID NO: 1242089 - RNA, 18 nt, Homo sapiens
caagccugucuucagaga

SEQ ID NO: 1242090 - RNA, 14 nt, Homo sapiens
caagcgacgacaga

SEQ ID NO: 1242091 - RNA, 22 nt, Homo sapiens
caagcuaagccaucauaucccc

SEQ ID NO: 1242092 - RNA, 23 nt, Homo sapiens
caagcuaugaucagaagacuuua

SEQ ID NO: 1242093 - RNA, 12 nt, Homo sapiens
caagcuauucaa

SEQ ID NO: 1242094 - RNA, 13 nt, Homo sapiens
caagcuccaucuc

SEQ ID NO: 1242095 - RNA, 17 nt, Homo sapiens
caagcucccugccccaa

SEQ ID NO: 1242096 - RNA, 22 nt, Homo sapiens
caagcucuguccaaucagguag

SEQ ID NO: 1242097 - RNA, 23 nt, Homo sapiens
caagcugacucgacaccguguca

SEQ ID NO: 1242098 - RNA, 21 nt, Homo sapiens
caagcuguccagagaaaagag

SEQ ID NO: 1242099 - RNA, 20 nt, Homo sapiens
caagcugugacuucuccagg

SEQ ID NO: 1242100 - RNA, 15 nt, Homo sapiens
caagcugugcaggca

SEQ ID NO: 1242101 - RNA, 18 nt, Homo sapiens
caagcuuguuaucagcuu

SEQ ID NO: 1242102 - RNA, 17 nt, Homo sapiens
caaggaaaaaugcugcu

SEQ ID NO: 1242103 - RNA, 14 nt, Homo sapiens
caaggaaauaugag

SEQ ID NO: 1242104 - RNA, 15 nt, Homo sapiens
caaggaauaaaugag

SEQ ID NO: 1242105 - RNA, 18 nt, Homo sapiens
caaggaaugccugugcca

SEQ ID NO: 1242106 - RNA, 16 nt, Homo sapiens
caaggaauuucugcuc

SEQ ID NO: 1242107 - RNA, 19 nt, Homo sapiens
caaggacguggaugacccu

SEQ ID NO: 1242108 - RNA, 14 nt, Homo sapiens
caaggacuuugcag

SEQ ID NO: 1242109 - RNA, 22 nt, Homo sapiens
caaggagaaugaauacugggaa

SEQ ID NO: 1242110 - RNA, 22 nt, Homo sapiens
caaggagaccaaguccuggcua

SEQ ID NO: 1242111 - RNA, 20 nt, Homo sapiens
caaggagcaaacacugaaau

SEQ ID NO: 1242112 - RNA, 18 nt, Homo sapiens
caaggagcacaagccaca

SEQ ID NO: 1242113 - RNA, 20 nt, Homo sapiens
caaggaggaguuccaccaug

SEQ ID NO: 1242114 - RNA, 14 nt, Homo sapiens
caaggaguacaaug

SEQ ID NO: 1242115 - RNA, 22 nt, Homo sapiens
caaggaucuccagcucuaacaa

SEQ ID NO: 1242116 - RNA, 16 nt, Homo sapiens
caaggcaggugccucc

SEQ ID NO: 1242117 - RNA, 18 nt, Homo sapiens
aguauuuuaauccuguac

SEQ ID NO: 1242118 - RNA, 20 nt, Homo sapiens
aguauuuuccuaagcacaaa

SEQ ID NO: 1242119 - RNA, 21 nt, Homo sapiens
aguauuuuccuccaggcaaaa

SEQ ID NO: 1242120 - RNA, 15 nt, Homo sapiens
agucaaaacagagau

SEQ ID NO: 1242121 - RNA, 21 nt, Homo sapiens
agucaaccuuguuucuacugu

SEQ ID NO: 1242122 - RNA, 16 nt, Homo sapiens
agucaauguguucuua

SEQ ID NO: 1242123 - RNA, 13 nt, Homo sapiens
agucaauuucuac

SEQ ID NO: 1242124 - RNA, 13 nt, Homo sapiens
agucacacagugu

SEQ ID NO: 1242125 - RNA, 21 nt, Homo sapiens
agucacaguuagguagcuuua

SEQ ID NO: 1242126 - RNA, 14 nt, Homo sapiens
agucacaucucuuc

SEQ ID NO: 1242127 - RNA, 12 nt, Homo sapiens
agucacaugacc

SEQ ID NO: 1242128 - RNA, 16 nt, Homo sapiens
agucacaugaccugau

SEQ ID NO: 1242129 - RNA, 21 nt, Homo sapiens
agucacauggccuaugcacau

SEQ ID NO: 1242130 - RNA, 12 nt, Homo sapiens
agucaccaaaua

SEQ ID NO: 1242131 - RNA, 21 nt, Homo sapiens
agucaccacuccauucccaac

SEQ ID NO: 1242132 - RNA, 18 nt, Homo sapiens
agucaccauacacacugu

SEQ ID NO: 1242133 - RNA, 17 nt, Homo sapiens
agucacccacugucagc

SEQ ID NO: 1242134 - RNA, 20 nt, Homo sapiens
agucacugccacuuugcaca

SEQ ID NO: 1242135 - RNA, 12 nt, Homo sapiens
agucacuggcau

SEQ ID NO: 1242136 - RNA, 21 nt, Homo sapiens
agucacuggcaucucacuuua

SEQ ID NO: 1242137 - RNA, 20 nt, Homo sapiens
agucacuuauaauuaugcua

SEQ ID NO: 1242138 - RNA, 12 nt, Homo sapiens
agucacuuccac

SEQ ID NO: 1242139 - RNA, 20 nt, Homo sapiens
agucacuugugucaaccacu

SEQ ID NO: 1242140 - RNA, 22 nt, Homo sapiens
agucacuugugucaaccacuaa

SEQ ID NO: 1242141 - RNA, 21 nt, Homo sapiens
agucacuuugccagagccuga

SEQ ID NO: 1242142 - RNA, 23 nt, Homo sapiens
agucagaggauggccagugucug

SEQ ID NO: 1242143 - RNA, 16 nt, Homo sapiens
agucagcuuucagagc

SEQ ID NO: 1242144 - RNA, 17 nt, Homo sapiens
agucagguucuuuacaa

SEQ ID NO: 1242145 - RNA, 14 nt, Homo sapiens
agucauauaccuau

SEQ ID NO: 1242146 - RNA, 13 nt, Homo sapiens
agucaucaaagau

SEQ ID NO: 1242147 - RNA, 17 nt, Homo sapiens
agucaucaucagggccu

SEQ ID NO: 1242148 - RNA, 23 nt, Homo sapiens
agucauucagcagcaaauuuuca

SEQ ID NO: 1242149 - RNA, 14 nt, Homo sapiens
agucauucuucccu

SEQ ID NO: 1242150 - RNA, 22 nt, Homo sapiens
aguccaaauaacaaguaccaaa

SEQ ID NO: 1242151 - RNA, 16 nt, Homo sapiens
aguccaacaaaccaca

SEQ ID NO: 1242152 - RNA, 20 nt, Homo sapiens
aguccaauuccuugcacaua

SEQ ID NO: 1242153 - RNA, 21 nt, Homo sapiens
aguccacaccacuguugccuu

SEQ ID NO: 1242154 - RNA, 16 nt, Homo sapiens
aguccacuucugcucu

SEQ ID NO: 1242155 - RNA, 21 nt, Homo sapiens
aguccagagcuggaucucuca

SEQ ID NO: 1242156 - RNA, 12 nt, Homo sapiens
aguccagcacug

SEQ ID NO: 1242157 - RNA, 15 nt, Homo sapiens
aguccaggagcucag

SEQ ID NO: 1242158 - RNA, 13 nt, Homo sapiens
aguccaugcuucu

SEQ ID NO: 1242159 - RNA, 20 nt, Homo sapiens
agucccagaauuguaucuca

SEQ ID NO: 1242160 - RNA, 16 nt, Homo sapiens
agucccaguauucuca

SEQ ID NO: 1242161 - RNA, 19 nt, Homo sapiens
aguccccaaccugcacucu

SEQ ID NO: 1242162 - RNA, 16 nt, Homo sapiens
aguccccagacucagc

SEQ ID NO: 1242163 - RNA, 23 nt, Homo sapiens
agucccuggaaaaacagucacug

SEQ ID NO: 1242164 - RNA, 12 nt, Homo sapiens
agucccugugaa

SEQ ID NO: 1242165 - RNA, 17 nt, Homo sapiens
aguccgcagaagcccug

SEQ ID NO: 1242166 - RNA, 14 nt, Homo sapiens
aguccuacccugaa

SEQ ID NO: 1242167 - RNA, 20 nt, Homo sapiens
aguccuacccugaaccuaug

SEQ ID NO: 1242168 - RNA, 15 nt, Homo sapiens
aguccuagcuacuca

SEQ ID NO: 1242169 - RNA, 17 nt, Homo sapiens
aguccuauucuauugca

SEQ ID NO: 1242170 - RNA, 18 nt, Homo sapiens
aguccuccacucgaccca

SEQ ID NO: 1242171 - RNA, 18 nt, Homo sapiens
aguccugacacuauucau

SEQ ID NO: 1242172 - RNA, 14 nt, Homo sapiens
aguccuguacugua

SEQ ID NO: 1242173 - RNA, 19 nt, Homo sapiens
aguccuguuugcagggaag

SEQ ID NO: 1242174 - RNA, 19 nt, Homo sapiens
aguccuuucuaaguauuuu

SEQ ID NO: 1242175 - RNA, 19 nt, Homo sapiens
agucggccccaucucucau

SEQ ID NO: 1242176 - RNA, 13 nt, Homo sapiens
agucucaaaaaua

SEQ ID NO: 1242177 - RNA, 18 nt, Homo sapiens
agucucaaaaauacaaaa

SEQ ID NO: 1242178 - RNA, 23 nt, Homo sapiens
agucucacugugggaaggccagc

SEQ ID NO: 1242179 - RNA, 14 nt, Homo sapiens
cacaggcccggcuc

SEQ ID NO: 1242180 - RNA, 18 nt, Homo sapiens
cacaggcugugccaacau

SEQ ID NO: 1242181 - RNA, 17 nt, Homo sapiens
cacagggagugcacaua

SEQ ID NO: 1242182 - RNA, 13 nt, Homo sapiens
cacaggggcccca

SEQ ID NO: 1242183 - RNA, 21 nt, Homo sapiens
cacagggguucccuucucuca

SEQ ID NO: 1242184 - RNA, 23 nt, Homo sapiens
cacaggguuuuguauucuuuacu

SEQ ID NO: 1242185 - RNA, 16 nt, Homo sapiens
cacagguucaugccac

SEQ ID NO: 1242186 - RNA, 17 nt, Homo sapiens
cacaguacuuuauugua

SEQ ID NO: 1242187 - RNA, 14 nt, Homo sapiens
cacaguagaacugu

SEQ ID NO: 1242188 - RNA, 21 nt, Homo sapiens
cacaguagaacugucugugaa

SEQ ID NO: 1242189 - RNA, 13 nt, Homo sapiens
cacaguaggcacu

SEQ ID NO: 1242190 - RNA, 14 nt, Homo sapiens
cacagugaauccag

SEQ ID NO: 1242191 - RNA, 12 nt, Homo sapiens
cacaguggcacc

SEQ ID NO: 1242192 - RNA, 13 nt, Homo sapiens
cacagugugcucc

SEQ ID NO: 1242193 - RNA, 19 nt, Homo sapiens
cacaguuguguucaugcug

SEQ ID NO: 1242194 - RNA, 18 nt, Homo sapiens
cacuggcaucucacuuua

SEQ ID NO: 1242195 - RNA, 13 nt, Homo sapiens
cacuggcauuguc

SEQ ID NO: 1242196 - RNA, 17 nt, Homo sapiens
cacuggccaccaggcug

SEQ ID NO: 1242197 - RNA, 21 nt, Homo sapiens
cacuggcuguuaaucuuucaa

SEQ ID NO: 1242198 - RNA, 15 nt, Homo sapiens
cacugggaguguccu

SEQ ID NO: 1242199 - RNA, 23 nt, Homo sapiens
cacugggaugagccgcugugagc

SEQ ID NO: 1242200 - RNA, 22 nt, Homo sapiens
cacugggugguggccugguccc

SEQ ID NO: 1242201 - RNA, 17 nt, Homo sapiens
cacuggguguugaucuu

SEQ ID NO: 1242202 - RNA, 14 nt, Homo sapiens
cacuggugccaacc

SEQ ID NO: 1242203 - RNA, 22 nt, Homo sapiens
cacugguggccgugguggggcc

SEQ ID NO: 1242204 - RNA, 11 nt, Homo sapiens
cagacccagug

SEQ ID NO: 1242205 - RNA, 19 nt, Homo sapiens
cagacccuggagagcucac

SEQ ID NO: 1242206 - RNA, 20 nt, Homo sapiens
cagaccgugaccaucuuugu

SEQ ID NO: 1242207 - RNA, 19 nt, Homo sapiens
cagaccugguucccacuga

SEQ ID NO: 1242208 - RNA, 18 nt, Homo sapiens
cagacggcggccaggcac

SEQ ID NO: 1242209 - RNA, 23 nt, Homo sapiens
cagacggcggccaggcacagggc

SEQ ID NO: 1242210 - RNA, 20 nt, Homo sapiens
cagacucuacagaggccaug

SEQ ID NO: 1242211 - RNA, 19 nt, Homo sapiens
cagacucuguaauugaaua

SEQ ID NO: 1242212 - RNA, 20 nt, Homo sapiens
cagacugcaugacagucaca

SEQ ID NO: 1242213 - RNA, 18 nt, Homo sapiens
cagacuggcaauaaacuc

SEQ ID NO: 1242214 - RNA, 23 nt, Homo sapiens
cagacuguaagauguuguuuuag

SEQ ID NO: 1242215 - RNA, 17 nt, Homo sapiens
cagacuguccacucggg

SEQ ID NO: 1242216 - RNA, 21 nt, Homo sapiens
cagacugugucuuauucuccc

SEQ ID NO: 1242217 - RNA, 19 nt, Homo sapiens
cagacuucaagaccauccu

SEQ ID NO: 1242218 - RNA, 20 nt, Homo sapiens
cagacuucaucauugugcua

SEQ ID NO: 1242219 - RNA, 21 nt, Homo sapiens
cagacuugaaugcuaguuaua

SEQ ID NO: 1242220 - RNA, 23 nt, Homo sapiens
cagacuuggaguaaaacuguaua

SEQ ID NO: 1242221 - RNA, 15 nt, Homo sapiens
cagacuuguugugac

SEQ ID NO: 1242222 - RNA, 14 nt, Homo sapiens
cagagaaaguacuu

SEQ ID NO: 1242223 - RNA, 16 nt, Homo sapiens
cagagaaauacuuuca

SEQ ID NO: 1242224 - RNA, 19 nt, Homo sapiens
cagagaaauacuuucaggc

SEQ ID NO: 1242225 - RNA, 18 nt, Homo sapiens
cagagaagcauccuccac

SEQ ID NO: 1242226 - RNA, 18 nt, Homo sapiens
cagagaagcggauuucca

SEQ ID NO: 1242227 - RNA, 14 nt, Homo sapiens
cagagaagcuggac

SEQ ID NO: 1242228 - RNA, 21 nt, Homo sapiens
cagagaaguucuggcugaaca

SEQ ID NO: 1242229 - RNA, 18 nt, Homo sapiens
cagagacaggcccaagag

SEQ ID NO: 1242230 - RNA, 19 nt, Homo sapiens
cagagacaggcccaagaga

SEQ ID NO: 1242231 - RNA, 21 nt, Homo sapiens
cagagacccucugccaccaga

SEQ ID NO: 1242232 - RNA, 14 nt, Homo sapiens
cagagaccuaugua

SEQ ID NO: 1242233 - RNA, 19 nt, Homo sapiens
cagagaccugaagugugca

SEQ ID NO: 1242234 - RNA, 23 nt, Homo sapiens
cagagacugcagggguccacugu

SEQ ID NO: 1242235 - RNA, 20 nt, Homo sapiens
cagagacugggaugggaaca

SEQ ID NO: 1242236 - RNA, 21 nt, Homo sapiens
cagagacugggaugggaacac

SEQ ID NO: 1242237 - RNA, 23 nt, Homo sapiens
cagagagcagcuucagugacaaa

SEQ ID NO: 1242238 - RNA, 21 nt, Homo sapiens
cagagagcagcuuuaaacuca

SEQ ID NO: 1242239 - RNA, 23 nt, Homo sapiens
cagagagccauuuugugaaugga

SEQ ID NO: 1242240 - RNA, 19 nt, Homo sapiens
cagagagccuggugcugcu

SEQ ID NO: 1242241 - RNA, 19 nt, Homo sapiens
cagagagcggucucaggcu

SEQ ID NO: 1242242 - RNA, 20 nt, Homo sapiens
cagagaggccuuuuguuuaa

SEQ ID NO: 1242243 - RNA, 19 nt, Homo sapiens
cagagagucccacugccuc

SEQ ID NO: 1242244 - RNA, 20 nt, Homo sapiens
cagagaguccugugcugaau

SEQ ID NO: 1242245 - RNA, 21 nt, Homo sapiens
cagagaguguacaucauguua

SEQ ID NO: 1242246 - RNA, 20 nt, Homo sapiens
cagagaguugauggggugca

SEQ ID NO: 1242247 - RNA, 20 nt, Homo sapiens
cagagaucgagaccauccua

SEQ ID NO: 1242248 - RNA, 23 nt, Homo sapiens
cagagaugcaccaccaagccaag

SEQ ID NO: 1242249 - RNA, 21 nt, Homo sapiens
cagagaugucaucagagcucc

SEQ ID NO: 1242250 - RNA, 19 nt, Homo sapiens
cagagauucccaagccaaa

SEQ ID NO: 1242251 - RNA, 17 nt, Homo sapiens
cagagauugaacuccaa

SEQ ID NO: 1242252 - RNA, 20 nt, Homo sapiens
cagagcaagacucugucuca

SEQ ID NO: 1242253 - RNA, 11 nt, Homo sapiens
cagagcacugg

SEQ ID NO: 1242254 - RNA, 22 nt, Homo sapiens
cagagcacuuuagcagaugugg

SEQ ID NO: 1242255 - RNA, 20 nt, Homo sapiens
cagagcagagaggcugaaua

SEQ ID NO: 1242256 - RNA, 22 nt, Homo sapiens
cagagcaucucggaguucagac

SEQ ID NO: 1242257 - RNA, 16 nt, Homo sapiens
cagagccagucucacc

SEQ ID NO: 1242258 - RNA, 12 nt, Homo sapiens
cagagccaguga

SEQ ID NO: 1242259 - RNA, 16 nt, Homo sapiens
cagagcccacuuccau

SEQ ID NO: 1242260 - RNA, 18 nt, Homo sapiens
cagagcccucaacuauuc

SEQ ID NO: 1242261 - RNA, 21 nt, Homo sapiens
cagagcccuucacugccauga

SEQ ID NO: 1242262 - RNA, 22 nt, Homo sapiens
cagagccguggccacccaggaa

SEQ ID NO: 1242263 - RNA, 21 nt, Homo sapiens
cagagccuccuagauguaaca

SEQ ID NO: 1242264 - RNA, 22 nt, Homo sapiens
cagagccucggcccuagcauug

SEQ ID NO: 1242265 - RNA, 14 nt, Homo sapiens
cagagccugaguca

SEQ ID NO: 1242266 - RNA, 16 nt, Homo sapiens
cagagcgcacagggag

SEQ ID NO: 1242267 - RNA, 19 nt, Homo sapiens
cagagcuaacauaaaggac

SEQ ID NO: 1242268 - RNA, 22 nt, Homo sapiens
cagagcuggguggggacaguga

SEQ ID NO: 1242269 - RNA, 18 nt, Homo sapiens
cagagcuucccucauuua

SEQ ID NO: 1242270 - RNA, 19 nt, Homo sapiens
cagaggaacuguccagaga

SEQ ID NO: 1242271 - RNA, 13 nt, Homo sapiens
cagaggagcucua

SEQ ID NO: 1242272 - RNA, 23 nt, Homo sapiens
cagaggagcucuacccugcuccc

SEQ ID NO: 1242273 - RNA, 22 nt, Homo sapiens
cagaggcagcccgcacaccugc

SEQ ID NO: 1242274 - RNA, 19 nt, Homo sapiens
cagaggcggagcugugcuc

SEQ ID NO: 1242275 - RNA, 15 nt, Homo sapiens
cagaggcggucuuca

SEQ ID NO: 1242276 - RNA, 22 nt, Homo sapiens
cagaggcucagacucacuguua

SEQ ID NO: 1242277 - RNA, 20 nt, Homo sapiens
cagaggcugcaaggauucag

SEQ ID NO: 1242278 - RNA, 15 nt, Homo sapiens
cagaggguacuuuaa

SEQ ID NO: 1242279 - RNA, 20 nt, Homo sapiens
cagaggugggcagguggugg

SEQ ID NO: 1242280 - RNA, 20 nt, Homo sapiens
cagagguugcagugagccga

SEQ ID NO: 1242281 - RNA, 16 nt, Homo sapiens
cagagguuugcuuccu

SEQ ID NO: 1242282 - RNA, 17 nt, Homo sapiens
cagagucaaagcucauu

SEQ ID NO: 1242283 - RNA, 13 nt, Homo sapiens
cagaguccacugu

SEQ ID NO: 1242284 - RNA, 22 nt, Homo sapiens
cagagucguuggagacugaaga

SEQ ID NO: 1242285 - RNA, 18 nt, Homo sapiens
cagagucucacuguugcc

SEQ ID NO: 1242286 - RNA, 18 nt, Homo sapiens
cagagugcacagcugucc

SEQ ID NO: 1242287 - RNA, 13 nt, Homo sapiens
cagagugccacug

SEQ ID NO: 1242288 - RNA, 16 nt, Homo sapiens
cagaguguucccugac

SEQ ID NO: 1242289 - RNA, 21 nt, Homo sapiens
cagaguuagguugucuccagg

SEQ ID NO: 1242290 - RNA, 15 nt, Homo sapiens
cagaguucugcucua

SEQ ID NO: 1242291 - RNA, 14 nt, Homo sapiens
cagaguuugccuuc

SEQ ID NO: 1242292 - RNA, 19 nt, Homo sapiens
cagauacauaucuguguau

SEQ ID NO: 1242293 - RNA, 13 nt, Homo sapiens
cagauacauuucc

SEQ ID NO: 1242294 - RNA, 18 nt, Homo sapiens
cagauagauauaugcucu

SEQ ID NO: 1242295 - RNA, 22 nt, Homo sapiens
cagauauaagagaagucucauu

SEQ ID NO: 1242296 - RNA, 13 nt, Homo sapiens
cagauauuucaca

SEQ ID NO: 1242297 - RNA, 14 nt, Homo sapiens
cagaucacugccac

SEQ ID NO: 1242298 - RNA, 15 nt, Homo sapiens
cagaucauauuucac

SEQ ID NO: 1242299 - RNA, 17 nt, Homo sapiens
cagaucgcaccacugca

SEQ ID NO: 1242300 - RNA, 20 nt, Homo sapiens
cagaucgcaccacugcacuc

SEQ ID NO: 1242301 - RNA, 19 nt, Homo sapiens
cagaucugucuccaagacc

SEQ ID NO: 1242302 - RNA, 18 nt, Homo sapiens
cagaucuuccguggucag

SEQ ID NO: 1242303 - RNA, 20 nt, Homo sapiens
cagaugaacucuuucuggcc

SEQ ID NO: 1242304 - RNA, 15 nt, Homo sapiens
cagaugauacuucca

SEQ ID NO: 1242305 - RNA, 14 nt, Homo sapiens
cagaugaucucucc

SEQ ID NO: 1242306 - RNA, 12 nt, Homo sapiens
cagaugcaauug

SEQ ID NO: 1242307 - RNA, 19 nt, Homo sapiens
cagaugccccagagcuguu

SEQ ID NO: 1242308 - RNA, 15 nt, Homo sapiens
cagaugcuccaagau

SEQ ID NO: 1242309 - RNA, 21 nt, Homo sapiens
cagaugcuguuaguaccuaca

SEQ ID NO: 1242310 - RNA, 21 nt, Homo sapiens
cagauggacuccagccugccu

SEQ ID NO: 1242311 - RNA, 21 nt, Homo sapiens
cagaugggccuggccuugaga

SEQ ID NO: 1242312 - RNA, 15 nt, Homo sapiens
cagauggggcacuga

SEQ ID NO: 1242313 - RNA, 15 nt, Homo sapiens
cagaugggucugaua

SEQ ID NO: 1242314 - RNA, 16 nt, Homo sapiens
cagaugugaaaacauc

SEQ ID NO: 1242315 - RNA, 21 nt, Homo sapiens
cagaugugaaaacaucucaau

SEQ ID NO: 1242316 - RNA, 19 nt, Homo sapiens
cagauugcaacaggcuggg

SEQ ID NO: 1242317 - RNA, 18 nt, Homo sapiens
cagauuguuucuauacaa

SEQ ID NO: 1242318 - RNA, 16 nt, Homo sapiens
cagauuuaaagcacau

SEQ ID NO: 1242319 - RNA, 19 nt, Homo sapiens
cagauuuccuaacucuggu

SEQ ID NO: 1242320 - RNA, 19 nt, Homo sapiens
cagauuuuaauugucaugg

SEQ ID NO: 1242321 - RNA, 14 nt, Homo sapiens
cagcaaaagagcua

SEQ ID NO: 1242322 - RNA, 17 nt, Homo sapiens
cagcaacagcaaaucac

SEQ ID NO: 1242323 - RNA, 20 nt, Homo sapiens
cagcaacuucuucuccaucc

SEQ ID NO: 1242324 - RNA, 23 nt, Homo sapiens
cagcaaggccagaugcacauccc

SEQ ID NO: 1242325 - RNA, 18 nt, Homo sapiens
cagcaaugacaucucagg

SEQ ID NO: 1242326 - RNA, 21 nt, Homo sapiens
cagcaauggugucaguaucca

SEQ ID NO: 1242327 - RNA, 14 nt, Homo sapiens
cagcaauuccaugc

SEQ ID NO: 1242328 - RNA, 17 nt, Homo sapiens
cagcacaaagacacaga

SEQ ID NO: 1242329 - RNA, 11 nt, Homo sapiens
cagcacccucc

SEQ ID NO: 1242330 - RNA, 21 nt, Homo sapiens
cagcaccuccgucauucacag

SEQ ID NO: 1242331 - RNA, 20 nt, Homo sapiens
cagcaccuucuuucuggacu

SEQ ID NO: 1242332 - RNA, 21 nt, Homo sapiens
cagcacggacaauaaaccucc

SEQ ID NO: 1242333 - RNA, 17 nt, Homo sapiens
cagcacucuuaucuaca

SEQ ID NO: 1242334 - RNA, 19 nt, Homo sapiens
cagcacucuuaucuacaua

SEQ ID NO: 1242335 - RNA, 20 nt, Homo sapiens
cagcacugaaaauaccauca

SEQ ID NO: 1242336 - RNA, 20 nt, Homo sapiens
cagcacuggaagccagagaa

SEQ ID NO: 1242337 - RNA, 11 nt, Homo sapiens
cagcacuuugg

SEQ ID NO: 1242338 - RNA, 13 nt, Homo sapiens
cagcagaaacaca

SEQ ID NO: 1242339 - RNA, 18 nt, Homo sapiens
cagcagagaccaccacau

SEQ ID NO: 1242340 - RNA, 16 nt, Homo sapiens
cagcagcccaagcuua

SEQ ID NO: 1242341 - RNA, 22 nt, Homo sapiens
cagcagccuccaacacaaggcu

SEQ ID NO: 1242342 - RNA, 17 nt, Homo sapiens
cagcagcgguaccccag

SEQ ID NO: 1242343 - RNA, 17 nt, Homo sapiens
cagcagcuucaccagag

SEQ ID NO: 1242344 - RNA, 18 nt, Homo sapiens
cagcaggcauggauccag

SEQ ID NO: 1242345 - RNA, 14 nt, Homo sapiens
cagcagugccuugu

SEQ ID NO: 1242346 - RNA, 20 nt, Homo sapiens
cagcaguugaucagacugaa

SEQ ID NO: 1242347 - RNA, 17 nt, Homo sapiens
cagcauacacagaugaa

SEQ ID NO: 1242348 - RNA, 15 nt, Homo sapiens
cagcaucacucccca

SEQ ID NO: 1242349 - RNA, 12 nt, Homo sapiens
cagcaugaauaa

SEQ ID NO: 1242350 - RNA, 21 nt, Homo sapiens
cagcaugaccugugaccagca

SEQ ID NO: 1242351 - RNA, 23 nt, Homo sapiens
cagcaugaggacagaccacagag

SEQ ID NO: 1242352 - RNA, 13 nt, Homo sapiens
cagcaugugcuuu

SEQ ID NO: 1242353 - RNA, 11 nt, Homo sapiens
cagcauugcuu

SEQ ID NO: 1242354 - RNA, 19 nt, Homo sapiens
cagcauugucucguguaca

SEQ ID NO: 1242355 - RNA, 17 nt, Homo sapiens
cagcauuuccacaccaa

SEQ ID NO: 1242356 - RNA, 15 nt, Homo sapiens
cagcauuugauaaaa

SEQ ID NO: 1242357 - RNA, 18 nt, Homo sapiens
cagccaaacugucuuugu

SEQ ID NO: 1242358 - RNA, 21 nt, Homo sapiens
cagccaaccucauugcagcua

SEQ ID NO: 1242359 - RNA, 15 nt, Homo sapiens
cagccaacuuuugca

SEQ ID NO: 1242360 - RNA, 14 nt, Homo sapiens
cagccaagugugac

SEQ ID NO: 1242361 - RNA, 21 nt, Homo sapiens
cagccaccacccacaaucaca

SEQ ID NO: 1242362 - RNA, 14 nt, Homo sapiens
cagccacccaagcc

SEQ ID NO: 1242363 - RNA, 22 nt, Homo sapiens
cagccacccguggggugcugcc

SEQ ID NO: 1242364 - RNA, 19 nt, Homo sapiens
cagccacuugacuggcaca

SEQ ID NO: 1242365 - RNA, 18 nt, Homo sapiens
cagccagcccauggcccc

SEQ ID NO: 1242366 - RNA, 14 nt, Homo sapiens
cagccaggacaucu

SEQ ID NO: 1242367 - RNA, 18 nt, Homo sapiens
cagccagguuagccuuug

SEQ ID NO: 1242368 - RNA, 15 nt, Homo sapiens
cagccagugccauuc

SEQ ID NO: 1242369 - RNA, 20 nt, Homo sapiens
cagccauaagaaagcacuau

SEQ ID NO: 1242370 - RNA, 22 nt, Homo sapiens
cagccauaauaauaauuugcac

SEQ ID NO: 1242371 - RNA, 20 nt, Homo sapiens
cagccaugaaacugacucau

SEQ ID NO: 1242372 - RNA, 13 nt, Homo sapiens
cagccaugcccag

SEQ ID NO: 1242373 - RNA, 20 nt, Homo sapiens
cagcccaugugcaccugccc

SEQ ID NO: 1242374 - RNA, 21 nt, Homo sapiens
cagccccaccucacagccaga

SEQ ID NO: 1242375 - RNA, 19 nt, Homo sapiens
cagccccagagcagggugu

SEQ ID NO: 1242376 - RNA, 16 nt, Homo sapiens
cagccccagugcccac

SEQ ID NO: 1242377 - RNA, 19 nt, Homo sapiens
cagcccccaggccagguga

SEQ ID NO: 1242378 - RNA, 12 nt, Homo sapiens
cagccccggggu

SEQ ID NO: 1242379 - RNA, 21 nt, Homo sapiens
cagccccucacauuccuaggg

SEQ ID NO: 1242380 - RNA, 15 nt, Homo sapiens
cagccccucccccau

SEQ ID NO: 1242381 - RNA, 13 nt, Homo sapiens
cagccccugugac

SEQ ID NO: 1242382 - RNA, 19 nt, Homo sapiens
cagccccuuauuugcacuu

SEQ ID NO: 1242383 - RNA, 20 nt, Homo sapiens
cagccccuuauuugcacuuc

SEQ ID NO: 1242384 - RNA, 17 nt, Homo sapiens
cagcccgcaacucucca

SEQ ID NO: 1242385 - RNA, 14 nt, Homo sapiens
cagcccugcugcag

SEQ ID NO: 1242386 - RNA, 18 nt, Homo sapiens
cagcccugucacgccggg

SEQ ID NO: 1242387 - RNA, 22 nt, Homo sapiens
cagcccuguucugggugcagcu

SEQ ID NO: 1242388 - RNA, 17 nt, Homo sapiens
cagcccuuuugugaacc

SEQ ID NO: 1242389 - RNA, 20 nt, Homo sapiens
cagccuacuuucacacuaag

SEQ ID NO: 1242390 - RNA, 19 nt, Homo sapiens
cagccucagaggagcucua

SEQ ID NO: 1242391 - RNA, 15 nt, Homo sapiens
cagccucaguccucc

SEQ ID NO: 1242392 - RNA, 20 nt, Homo sapiens
cagccucccgaguagcuggg

SEQ ID NO: 1242393 - RNA, 20 nt, Homo sapiens
cagccucccucugaccugca

SEQ ID NO: 1242394 - RNA, 15 nt, Homo sapiens
cagccucccuuugau

SEQ ID NO: 1242395 - RNA, 14 nt, Homo sapiens
cagccuccuugaag

SEQ ID NO: 1242396 - RNA, 15 nt, Homo sapiens
cagccucuggcucca

SEQ ID NO: 1242397 - RNA, 17 nt, Homo sapiens
cagccucuugacucuga

SEQ ID NO: 1242398 - RNA, 12 nt, Homo sapiens
cagccugaaccc

SEQ ID NO: 1242399 - RNA, 17 nt, Homo sapiens
cagccugcucuaguggg

SEQ ID NO: 1242400 - RNA, 18 nt, Homo sapiens
cagccuggccaucuggau

SEQ ID NO: 1242401 - RNA, 17 nt, Homo sapiens
cagccuggccccugugc

SEQ ID NO: 1242402 - RNA, 19 nt, Homo sapiens
cagccugggcaacauacca

SEQ ID NO: 1242403 - RNA, 19 nt, Homo sapiens
cagccuugaccucugggag

SEQ ID NO: 1242404 - RNA, 17 nt, Homo sapiens
cagccuuggaucaggac

SEQ ID NO: 1242405 - RNA, 19 nt, Homo sapiens
cagcgaacccaauggguaa

SEQ ID NO: 1242406 - RNA, 16 nt, Homo sapiens
cagcgagcccuggugg

SEQ ID NO: 1242407 - RNA, 13 nt, Homo sapiens
cagcgcaccuguu

SEQ ID NO: 1242408 - RNA, 18 nt, Homo sapiens
cagcgccagugacaguca

SEQ ID NO: 1242409 - RNA, 17 nt, Homo sapiens
cagcgccuuuccugcca

SEQ ID NO: 1242410 - RNA, 17 nt, Homo sapiens
cagcgggcacagggcac

SEQ ID NO: 1242411 - RNA, 22 nt, Homo sapiens
cagcguguguauccgacucuaa

SEQ ID NO: 1242412 - RNA, 18 nt, Homo sapiens
cagcuaacccuagucaaa

SEQ ID NO: 1242413 - RNA, 19 nt, Homo sapiens
cagcuaaggacauuuccca

SEQ ID NO: 1242414 - RNA, 14 nt, Homo sapiens
cagcuagcuuauuc

SEQ ID NO: 1242415 - RNA, 22 nt, Homo sapiens
cagcuagcuuauucuuguguac

SEQ ID NO: 1242416 - RNA, 15 nt, Homo sapiens
cagcuagugccuuua

SEQ ID NO: 1242417 - RNA, 18 nt, Homo sapiens
cagcuaucugucaucucu

SEQ ID NO: 1242418 - RNA, 20 nt, Homo sapiens
cagcuaucugucaucucucu

SEQ ID NO: 1242419 - RNA, 23 nt, Homo sapiens
cagcuauuuucaacauaacugaa

SEQ ID NO: 1242420 - RNA, 16 nt, Homo sapiens
cagcucagaacccagg

SEQ ID NO: 1242421 - RNA, 14 nt, Homo sapiens
cagcucagccagug

SEQ ID NO: 1242422 - RNA, 17 nt, Homo sapiens
cagcucagcgccagccu

SEQ ID NO: 1242423 - RNA, 18 nt, Homo sapiens
cagcucaggaacuagacu

SEQ ID NO: 1242424 - RNA, 12 nt, Homo sapiens
cagcuccagugc

SEQ ID NO: 1242425 - RNA, 16 nt, Homo sapiens
cagcuccagugccagc

SEQ ID NO: 1242426 - RNA, 16 nt, Homo sapiens
cagcucccuucucugu

SEQ ID NO: 1242427 - RNA, 21 nt, Homo sapiens
cagcuccuguaacauacuggc

SEQ ID NO: 1242428 - RNA, 17 nt, Homo sapiens
cagcucuagcuuugcag

SEQ ID NO: 1242429 - RNA, 16 nt, Homo sapiens
cagcucuccaccagcu

SEQ ID NO: 1242430 - RNA, 17 nt, Homo sapiens
cagcucucuccuuucag

SEQ ID NO: 1242431 - RNA, 20 nt, Homo sapiens
cagcucugcaggcuuaauaa

SEQ ID NO: 1242432 - RNA, 18 nt, Homo sapiens
cagcucuguguugccaug

SEQ ID NO: 1242433 - RNA, 12 nt, Homo sapiens
cagcucuuccau

SEQ ID NO: 1242434 - RNA, 15 nt, Homo sapiens
cagcugaggacacac

SEQ ID NO: 1242435 - RNA, 19 nt, Homo sapiens
cagcugauugggcaccuga

SEQ ID NO: 1242436 - RNA, 23 nt, Homo sapiens
cagcugauugggcaccugaccac

SEQ ID NO: 1242437 - RNA, 13 nt, Homo sapiens
cagcugcaccugc

SEQ ID NO: 1242438 - RNA, 16 nt, Homo sapiens
cagcugccucugcucc

SEQ ID NO: 1242439 - RNA, 19 nt, Homo sapiens
cagcugccucugcucccuc

SEQ ID NO: 1242440 - RNA, 21 nt, Homo sapiens
cagcuggaagucuaccugcug

SEQ ID NO: 1242441 - RNA, 22 nt, Homo sapiens
cagcuggagaaaaaacauugcc

SEQ ID NO: 1242442 - RNA, 13 nt, Homo sapiens
cagcugggagcac

SEQ ID NO: 1242443 - RNA, 18 nt, Homo sapiens
cagcugggcucugcaauu

SEQ ID NO: 1242444 - RNA, 16 nt, Homo sapiens
cagcuguacauacuca

SEQ ID NO: 1242445 - RNA, 15 nt, Homo sapiens
cagcuguagccaugg

SEQ ID NO: 1242446 - RNA, 12 nt, Homo sapiens
cagcugugcugu

SEQ ID NO: 1242447 - RNA, 20 nt, Homo sapiens
cagcuguggcagaguuacag

SEQ ID NO: 1242448 - RNA, 23 nt, Homo sapiens
cagcuguuuggccaaugugcaua

SEQ ID NO: 1242449 - RNA, 15 nt, Homo sapiens
cagcuuagauuucau

SEQ ID NO: 1242450 - RNA, 17 nt, Homo sapiens
cagcuuauaugugacac

SEQ ID NO: 1242451 - RNA, 21 nt, Homo sapiens
cagcuucaccagagcauuucc

SEQ ID NO: 1242452 - RNA, 15 nt, Homo sapiens
cagcuucacucgaca

SEQ ID NO: 1242453 - RNA, 20 nt, Homo sapiens
cagcuucccgaguaacugag

SEQ ID NO: 1242454 - RNA, 16 nt, Homo sapiens
cagcuuggcccuuucc

SEQ ID NO: 1242455 - RNA, 20 nt, Homo sapiens
cagcuuggggccaccaaagc

SEQ ID NO: 1242456 - RNA, 16 nt, Homo sapiens
cagcuuucugugcaga

SEQ ID NO: 1242457 - RNA, 18 nt, Homo sapiens
cagcuuucugugcagaga

SEQ ID NO: 1242458 - RNA, 13 nt, Homo sapiens
cagcuuucuugcu

SEQ ID NO: 1242459 - RNA, 19 nt, Homo sapiens
cagcuuugcuaccaaagca

SEQ ID NO: 1242460 - RNA, 21 nt, Homo sapiens
cagcuuuuagaaaaugcaguc

SEQ ID NO: 1242461 - RNA, 13 nt, Homo sapiens
cagcuuuuccuca

SEQ ID NO: 1242462 - RNA, 17 nt, Homo sapiens
caggaaaacaaaucacu

SEQ ID NO: 1242463 - RNA, 13 nt, Homo sapiens
caggaacaaacag

SEQ ID NO: 1242464 - RNA, 17 nt, Homo sapiens
caggaacaaacagggcu

SEQ ID NO: 1242465 - RNA, 14 nt, Homo sapiens
caggaacucuggac

SEQ ID NO: 1242466 - RNA, 20 nt, Homo sapiens
caggaagcccacacuaugca

SEQ ID NO: 1242467 - RNA, 19 nt, Homo sapiens
caggaaggacagacuggcc

SEQ ID NO: 1242468 - RNA, 19 nt, Homo sapiens
caggaagggagaacuugaa

SEQ ID NO: 1242469 - RNA, 15 nt, Homo sapiens
caggaaguacuucca

SEQ ID NO: 1242470 - RNA, 18 nt, Homo sapiens
caggaauccccaacaugc

SEQ ID NO: 1242471 - RNA, 19 nt, Homo sapiens
caggaauccccaacaugca

SEQ ID NO: 1242472 - RNA, 19 nt, Homo sapiens
caggaauggcuugccuaag

SEQ ID NO: 1242473 - RNA, 19 nt, Homo sapiens
caggacagguggugcaaau

SEQ ID NO: 1242474 - RNA, 10 nt, Homo sapiens
caggacaucu

SEQ ID NO: 1242475 - RNA, 12 nt, Homo sapiens
caggacaucucu

SEQ ID NO: 1242476 - RNA, 15 nt, Homo sapiens
caggaccaagccaca

SEQ ID NO: 1242477 - RNA, 15 nt, Homo sapiens
caggaccaguuugau

SEQ ID NO: 1242478 - RNA, 21 nt, Homo sapiens
caggacccgcacgccucuucc

SEQ ID NO: 1242479 - RNA, 15 nt, Homo sapiens
caggacccuccugcc

SEQ ID NO: 1242480 - RNA, 21 nt, Homo sapiens
caggacuccaucucuuaaaaa

SEQ ID NO: 1242481 - RNA, 18 nt, Homo sapiens
caggacuccccaggagca

SEQ ID NO: 1242482 - RNA, 22 nt, Homo sapiens
caggacugaguccccuccagga

SEQ ID NO: 1242483 - RNA, 20 nt, Homo sapiens
caggacuuccauuugcuuug

SEQ ID NO: 1242484 - RNA, 18 nt, Homo sapiens
caggagaauggugugaac

SEQ ID NO: 1242485 - RNA, 19 nt, Homo sapiens
caggagaauggugugaacc

SEQ ID NO: 1242486 - RNA, 18 nt, Homo sapiens
caggagacagaccacuug

SEQ ID NO: 1242487 - RNA, 19 nt, Homo sapiens
caggagaccacggggagca

SEQ ID NO: 1242488 - RNA, 19 nt, Homo sapiens
caggagaccuggcacugga

SEQ ID NO: 1242489 - RNA, 22 nt, Homo sapiens
caggagaccuggcacuggaugc

SEQ ID NO: 1242490 - RNA, 19 nt, Homo sapiens
caggagagagaaagccagg

SEQ ID NO: 1242491 - RNA, 17 nt, Homo sapiens
caggagcauggggauaa

SEQ ID NO: 1242492 - RNA, 18 nt, Homo sapiens
caggagcuagagccauuu

SEQ ID NO: 1242493 - RNA, 18 nt, Homo sapiens
caggaggaucacuugagg

SEQ ID NO: 1242494 - RNA, 15 nt, Homo sapiens
caggaggauggcaaa

SEQ ID NO: 1242495 - RNA, 15 nt, Homo sapiens
caggaggcaagcaag

SEQ ID NO: 1242496 - RNA, 21 nt, Homo sapiens
caggaggcagaggguugcagu

SEQ ID NO: 1242497 - RNA, 22 nt, Homo sapiens
caggaggccaauaaaaaguuca

SEQ ID NO: 1242498 - RNA, 23 nt, Homo sapiens
caggagggcagaccacauugcuu

SEQ ID NO: 1242499 - RNA, 16 nt, Homo sapiens
caggagggcccuaccu

SEQ ID NO: 1242500 - RNA, 15 nt, Homo sapiens
caggaggggucucau

SEQ ID NO: 1242501 - RNA, 21 nt, Homo sapiens
caggagggguuaaagcugccg

SEQ ID NO: 1242502 - RNA, 21 nt, Homo sapiens
caggaggguauggugcugcuc

SEQ ID NO: 1242503 - RNA, 20 nt, Homo sapiens
caggagguggagguugcagu

SEQ ID NO: 1242504 - RNA, 23 nt, Homo sapiens
caggagguggagguugcagugag

SEQ ID NO: 1242505 - RNA, 18 nt, Homo sapiens
caggagguuggugacuga

SEQ ID NO: 1242506 - RNA, 16 nt, Homo sapiens
caggaguaaaacuccc

SEQ ID NO: 1242507 - RNA, 16 nt, Homo sapiens
caggaguagugagcug

SEQ ID NO: 1242508 - RNA, 16 nt, Homo sapiens
caggagucagugucug

SEQ ID NO: 1242509 - RNA, 22 nt, Homo sapiens
caggagugugaggaggagacag

SEQ ID NO: 1242510 - RNA, 19 nt, Homo sapiens
caggaguucaauaaauguc

SEQ ID NO: 1242511 - RNA, 23 nt, Homo sapiens
caggaguuggaauguuguaguua

SEQ ID NO: 1242512 - RNA, 15 nt, Homo sapiens
caggauacucuguca

SEQ ID NO: 1242513 - RNA, 16 nt, Homo sapiens
caggauauugacaaga

SEQ ID NO: 1242514 - RNA, 23 nt, Homo sapiens
caggaucuguacaauaauaauua

SEQ ID NO: 1242515 - RNA, 13 nt, Homo sapiens
caggaugcacauu

SEQ ID NO: 1242516 - RNA, 19 nt, Homo sapiens
caggauuauugucaaagaa

SEQ ID NO: 1242517 - RNA, 15 nt, Homo sapiens
caggauugaucauuc

SEQ ID NO: 1242518 - RNA, 15 nt, Homo sapiens
caggcaacgcacaaa

SEQ ID NO: 1242519 - RNA, 21 nt, Homo sapiens
caggcaacuucaguccuggga

SEQ ID NO: 1242520 - RNA, 12 nt, Homo sapiens
caggcacagggc

SEQ ID NO: 1242521 - RNA, 19 nt, Homo sapiens
caggcacagguccccagau

SEQ ID NO: 1242522 - RNA, 22 nt, Homo sapiens
caggcacaucaacugaucucau

SEQ ID NO: 1242523 - RNA, 20 nt, Homo sapiens
caggcacccaccaccaugcc

SEQ ID NO: 1242524 - RNA, 17 nt, Homo sapiens
caggcacccaccaucau

SEQ ID NO: 1242525 - RNA, 12 nt, Homo sapiens
caggcaccucac

SEQ ID NO: 1242526 - RNA, 23 nt, Homo sapiens
caggcaccugcacuuacaggccu

SEQ ID NO: 1242527 - RNA, 19 nt, Homo sapiens
caggcacuuugagaugugu

SEQ ID NO: 1242528 - RNA, 12 nt, Homo sapiens
caggcagacuac

SEQ ID NO: 1242529 - RNA, 16 nt, Homo sapiens
caggcagaucugugcc

SEQ ID NO: 1242530 - RNA, 20 nt, Homo sapiens
caggcagcacagugugugaa

SEQ ID NO: 1242531 - RNA, 16 nt, Homo sapiens
caggcagcgccaagug

SEQ ID NO: 1242532 - RNA, 13 nt, Homo sapiens
caggcagcucaag

SEQ ID NO: 1242533 - RNA, 14 nt, Homo sapiens
caggcagcugccug

SEQ ID NO: 1242534 - RNA, 18 nt, Homo sapiens
caggcauagaggcuucuc

SEQ ID NO: 1242535 - RNA, 12 nt, Homo sapiens
caggcaugggca

SEQ ID NO: 1242536 - RNA, 14 nt, Homo sapiens
caggccacugggga

SEQ ID NO: 1242537 - RNA, 18 nt, Homo sapiens
caggccacuguggccaga

SEQ ID NO: 1242538 - RNA, 16 nt, Homo sapiens
caggccagagggcagu

SEQ ID NO: 1242539 - RNA, 13 nt, Homo sapiens
caggcccagugac

SEQ ID NO: 1242540 - RNA, 15 nt, Homo sapiens
caggccccuccaguu

SEQ ID NO: 1242541 - RNA, 18 nt, Homo sapiens
caggcccggcuccaggcu

SEQ ID NO: 1242542 - RNA, 20 nt, Homo sapiens
caggcccugcuccugcagca

SEQ ID NO: 1242543 - RNA, 23 nt, Homo sapiens
caggcccuguccuaagcacuuua

SEQ ID NO: 1242544 - RNA, 21 nt, Homo sapiens
caggcccuuccucuccacugc

SEQ ID NO: 1242545 - RNA, 21 nt, Homo sapiens
caggccgcauccugaacugcu

SEQ ID NO: 1242546 - RNA, 19 nt, Homo sapiens
caggccgugugucugucag

SEQ ID NO: 1242547 - RNA, 22 nt, Homo sapiens
caggccucuuggcagucacauc

SEQ ID NO: 1242548 - RNA, 15 nt, Homo sapiens
caggcuaugguugcc

SEQ ID NO: 1242549 - RNA, 13 nt, Homo sapiens
caggcuccgcccu

SEQ ID NO: 1242550 - RNA, 13 nt, Homo sapiens
caggcucuucucc

SEQ ID NO: 1242551 - RNA, 22 nt, Homo sapiens
caggcugaaauuucuuguucau

SEQ ID NO: 1242552 - RNA, 20 nt, Homo sapiens
caggcuggagugcaauggcg

SEQ ID NO: 1242553 - RNA, 16 nt, Homo sapiens
caggcuggagugcagu

SEQ ID NO: 1242554 - RNA, 15 nt, Homo sapiens
caggcuggccagucc

SEQ ID NO: 1242555 - RNA, 21 nt, Homo sapiens
caggcuggcgcagccaaggcc

SEQ ID NO: 1242556 - RNA, 12 nt, Homo sapiens
caggcugggaac

SEQ ID NO: 1242557 - RNA, 20 nt, Homo sapiens
caggcugggccauguccaaa

SEQ ID NO: 1242558 - RNA, 22 nt, Homo sapiens
caggcugggccauguccaaaga

SEQ ID NO: 1242559 - RNA, 19 nt, Homo sapiens
caggcuggucucaaacucc

SEQ ID NO: 1242560 - RNA, 18 nt, Homo sapiens
caggcuggucuugaacuc

SEQ ID NO: 1242561 - RNA, 13 nt, Homo sapiens
caggcugugccaa

SEQ ID NO: 1242562 - RNA, 18 nt, Homo sapiens
caggcuguucugcacuga

SEQ ID NO: 1242563 - RNA, 19 nt, Homo sapiens
caggcuguucugcacugaa

SEQ ID NO: 1242564 - RNA, 23 nt, Homo sapiens
caggcuucugucaauuucauuau

SEQ ID NO: 1242565 - RNA, 16 nt, Homo sapiens
cagggaaaacugcaaa

SEQ ID NO: 1242566 - RNA, 18 nt, Homo sapiens
cagggaaagcccguguca

SEQ ID NO: 1242567 - RNA, 23 nt, Homo sapiens
cagggaaguggggaaguguucca

SEQ ID NO: 1242568 - RNA, 22 nt, Homo sapiens
cagggaauggagaaugguguuc

SEQ ID NO: 1242569 - RNA, 14 nt, Homo sapiens
cagggaauggagcu

SEQ ID NO: 1242570 - RNA, 12 nt, Homo sapiens
cagggagcauuu

SEQ ID NO: 1242571 - RNA, 17 nt, Homo sapiens
cagggaugacagauuug

SEQ ID NO: 1242572 - RNA, 21 nt, Homo sapiens
cagggauuaaccucugcacua

SEQ ID NO: 1242573 - RNA, 13 nt, Homo sapiens
cagggcacuacau

SEQ ID NO: 1242574 - RNA, 22 nt, Homo sapiens
cagggcagccccacaacuuuaa

SEQ ID NO: 1242575 - RNA, 18 nt, Homo sapiens
cagggcauuuugguccaa

SEQ ID NO: 1242576 - RNA, 14 nt, Homo sapiens
cagggggacuagcc

SEQ ID NO: 1242577 - RNA, 18 nt, Homo sapiens
cagggggagaaacccuuc

SEQ ID NO: 1242578 - RNA, 11 nt, Homo sapiens
caggggugacg

SEQ ID NO: 1242579 - RNA, 18 nt, Homo sapiens
caggguaacugugcugaa

SEQ ID NO: 1242580 - RNA, 13 nt, Homo sapiens
caggguaccucaa

SEQ ID NO: 1242581 - RNA, 20 nt, Homo sapiens
caggguaccucaagccccau

SEQ ID NO: 1242582 - RNA, 23 nt, Homo sapiens
caggguccagugggaacugaaga

SEQ ID NO: 1242583 - RNA, 16 nt, Homo sapiens
cagggucugcucuuuc

SEQ ID NO: 1242584 - RNA, 18 nt, Homo sapiens
cagggugaagcagcucau

SEQ ID NO: 1242585 - RNA, 20 nt, Homo sapiens
cagggugggaucagcccugc

SEQ ID NO: 1242586 - RNA, 19 nt, Homo sapiens
caggguggucuugaucucc

SEQ ID NO: 1242587 - RNA, 14 nt, Homo sapiens
cagggugucccagg

SEQ ID NO: 1242588 - RNA, 18 nt, Homo sapiens
caggguucaucuguccau

SEQ ID NO: 1242589 - RNA, 23 nt, Homo sapiens
cagguacaguaggauaagccacu

SEQ ID NO: 1242590 - RNA, 20 nt, Homo sapiens
cagguaccaucuuguauaca

SEQ ID NO: 1242591 - RNA, 14 nt, Homo sapiens
caggucacacgacc

SEQ ID NO: 1242592 - RNA, 19 nt, Homo sapiens
cagguccucuacuuaauga

SEQ ID NO: 1242593 - RNA, 14 nt, Homo sapiens
cagguccuuuccac

SEQ ID NO: 1242594 - RNA, 15 nt, Homo sapiens
caggugaaaauccau

SEQ ID NO: 1242595 - RNA, 17 nt, Homo sapiens
caggugaccccuaggag

SEQ ID NO: 1242596 - RNA, 18 nt, Homo sapiens
caggugauccgccuaccu

SEQ ID NO: 1242597 - RNA, 13 nt, Homo sapiens
caggugaucugcc

SEQ ID NO: 1242598 - RNA, 23 nt, Homo sapiens
caggugauuuguaugcucauuga

SEQ ID NO: 1242599 - RNA, 19 nt, Homo sapiens
caggugcaacagacuugaa

SEQ ID NO: 1242600 - RNA, 22 nt, Homo sapiens
caggugccuccaggugugcacg

SEQ ID NO: 1242601 - RNA, 16 nt, Homo sapiens
caggugccuucccaga

SEQ ID NO: 1242602 - RNA, 23 nt, Homo sapiens
caggugggugguggcucuuaagg

SEQ ID NO: 1242603 - RNA, 16 nt, Homo sapiens
caggugucuagacugc

SEQ ID NO: 1242604 - RNA, 16 nt, Homo sapiens
caggugugaaccacca

SEQ ID NO: 1242605 - RNA, 14 nt, Homo sapiens
caggugugagucac

SEQ ID NO: 1242606 - RNA, 20 nt, Homo sapiens
cagguguuacuguaauuccu

SEQ ID NO: 1242607 - RNA, 16 nt, Homo sapiens
cagguguuacuuacag

SEQ ID NO: 1242608 - RNA, 20 nt, Homo sapiens
cagguguuacuuacaguccc

SEQ ID NO: 1242609 - RNA, 22 nt, Homo sapiens
cagguguucuacacucaucuua

SEQ ID NO: 1242610 - RNA, 18 nt, Homo sapiens
cagguuaagacaaagggu

SEQ ID NO: 1242611 - RNA, 15 nt, Homo sapiens
cagguuaaugcugaa

SEQ ID NO: 1242612 - RNA, 13 nt, Homo sapiens
cagguuagccuuu

SEQ ID NO: 1242613 - RNA, 14 nt, Homo sapiens
cagguucacuuugg

SEQ ID NO: 1242614 - RNA, 17 nt, Homo sapiens
cagguuccaucccgaaa

SEQ ID NO: 1242615 - RNA, 15 nt, Homo sapiens
cagguucuucagggc

SEQ ID NO: 1242616 - RNA, 19 nt, Homo sapiens
cagguuuaugaaugacagu

SEQ ID NO: 1242617 - RNA, 19 nt, Homo sapiens
caguaaacgggaacaugcc

SEQ ID NO: 1242618 - RNA, 16 nt, Homo sapiens
caguaaaucucacaaa

SEQ ID NO: 1242619 - RNA, 17 nt, Homo sapiens
caguaaaucucacaaau

SEQ ID NO: 1242620 - RNA, 17 nt, Homo sapiens
caguaacgcgucuuccu

SEQ ID NO: 1242621 - RNA, 17 nt, Homo sapiens
caguaacuccccaacuc

SEQ ID NO: 1242622 - RNA, 17 nt, Homo sapiens
caguaagaaaaagaaga

SEQ ID NO: 1242623 - RNA, 22 nt, Homo sapiens
caguaagagguguuauuuggaa

SEQ ID NO: 1242624 - RNA, 20 nt, Homo sapiens
caguaagcugcucuauugua

SEQ ID NO: 1242625 - RNA, 20 nt, Homo sapiens
caguacacccaguugccaaa

SEQ ID NO: 1242626 - RNA, 21 nt, Homo sapiens
caguaccaaaguaacugaauu

SEQ ID NO: 1242627 - RNA, 16 nt, Homo sapiens
caguaccaucuacauc

SEQ ID NO: 1242628 - RNA, 22 nt, Homo sapiens
caguaccccugguaaaccaagc

SEQ ID NO: 1242629 - RNA, 17 nt, Homo sapiens
caguacuuccugcagua

SEQ ID NO: 1242630 - RNA, 21 nt, Homo sapiens
caguacuugugaaacacagcu

SEQ ID NO: 1242631 - RNA, 18 nt, Homo sapiens
caguagaaauaauaugca

SEQ ID NO: 1242632 - RNA, 18 nt, Homo sapiens
caguagaacugucuguga

SEQ ID NO: 1242633 - RNA, 19 nt, Homo sapiens
caguagagcaaaucuauga

SEQ ID NO: 1242634 - RNA, 16 nt, Homo sapiens
caguagagucaucucc

SEQ ID NO: 1242635 - RNA, 14 nt, Homo sapiens
caguagaugugcuu

SEQ ID NO: 1242636 - RNA, 23 nt, Homo sapiens
caguagauugcagaaaauucugu

SEQ ID NO: 1242637 - RNA, 22 nt, Homo sapiens
caguauaagcaucugccaucug

SEQ ID NO: 1242638 - RNA, 20 nt, Homo sapiens
caguauaccuaucugcugca

SEQ ID NO: 1242639 - RNA, 21 nt, Homo sapiens
caguauauucuuugguuguga

SEQ ID NO: 1242640 - RNA, 20 nt, Homo sapiens
caguauauuuauagucacaa

SEQ ID NO: 1242641 - RNA, 20 nt, Homo sapiens
caguauccacaauagcugac

SEQ ID NO: 1242642 - RNA, 16 nt, Homo sapiens
caguaucccacaucca

SEQ ID NO: 1242643 - RNA, 17 nt, Homo sapiens
caguaucccacauccaa

SEQ ID NO: 1242644 - RNA, 22 nt, Homo sapiens
caguaugagucaaugugcagug

SEQ ID NO: 1242645 - RNA, 18 nt, Homo sapiens
caguauguuuguuucauu

SEQ ID NO: 1242646 - RNA, 22 nt, Homo sapiens
caguauucucagagcauguguc

SEQ ID NO: 1242647 - RNA, 22 nt, Homo sapiens
cagucacaugaccugaucacua

SEQ ID NO: 1242648 - RNA, 13 nt, Homo sapiens
cagucacuuccac

SEQ ID NO: 1242649 - RNA, 21 nt, Homo sapiens
cagucauaacuaaauaaagcu

SEQ ID NO: 1242650 - RNA, 19 nt, Homo sapiens
cagucauccugcaggcaca

SEQ ID NO: 1242651 - RNA, 16 nt, Homo sapiens
caguccaauaggugua

SEQ ID NO: 1242652 - RNA, 15 nt, Homo sapiens
caguccacugcugag

SEQ ID NO: 1242653 - RNA, 22 nt, Homo sapiens
cagucccagcuaacucugaccu

SEQ ID NO: 1242654 - RNA, 15 nt, Homo sapiens
cagucccaguauucu

SEQ ID NO: 1242655 - RNA, 15 nt, Homo sapiens
cagucccaugaccuu

SEQ ID NO: 1242656 - RNA, 15 nt, Homo sapiens
caguccccagcccuu

SEQ ID NO: 1242657 - RNA, 14 nt, Homo sapiens
caguccuagcagaa

SEQ ID NO: 1242658 - RNA, 14 nt, Homo sapiens
caguccuguuugca

SEQ ID NO: 1242659 - RNA, 17 nt, Homo sapiens
cagucgaccgcacuuau

SEQ ID NO: 1242660 - RNA, 18 nt, Homo sapiens
cagucucuucuaagcaaa

SEQ ID NO: 1242661 - RNA, 19 nt, Homo sapiens
cagucucuucuaagcaaaa

SEQ ID NO: 1242662 - RNA, 15 nt, Homo sapiens
cagucuggagaaggu

SEQ ID NO: 1242663 - RNA, 19 nt, Homo sapiens
cagucugucuacuguggug

SEQ ID NO: 1242664 - RNA, 21 nt, Homo sapiens
cagucuuauuuccaaguaaga

SEQ ID NO: 1242665 - RNA, 13 nt, Homo sapiens
cagugaaggcuaa

SEQ ID NO: 1242666 - RNA, 18 nt, Homo sapiens
cagugaaggcuaaaugag

SEQ ID NO: 1242667 - RNA, 18 nt, Homo sapiens
cagugaaggucuuuguua

SEQ ID NO: 1242668 - RNA, 20 nt, Homo sapiens
cagugaaugugucuggaccu

SEQ ID NO: 1242669 - RNA, 23 nt, Homo sapiens
cagugacaaacauauccuuucaa

SEQ ID NO: 1242670 - RNA, 12 nt, Homo sapiens
cagugaccucau

SEQ ID NO: 1242671 - RNA, 17 nt, Homo sapiens
cagugacgugcaccugu

SEQ ID NO: 1242672 - RNA, 17 nt, Homo sapiens
cagugacuggugccagu

SEQ ID NO: 1242673 - RNA, 18 nt, Homo sapiens
cagugacuggugccagug

SEQ ID NO: 1242674 - RNA, 23 nt, Homo sapiens
cagugagauauuugguaccaugg

SEQ ID NO: 1242675 - RNA, 13 nt, Homo sapiens
cagugagcacuag

SEQ ID NO: 1242676 - RNA, 15 nt, Homo sapiens
cagugagccauguuc

SEQ ID NO: 1242677 - RNA, 17 nt, Homo sapiens
cagugagucucuucaga

SEQ ID NO: 1242678 - RNA, 17 nt, Homo sapiens
cagugaugcugugcuau

SEQ ID NO: 1242679 - RNA, 23 nt, Homo sapiens
cagugaugcugugcuaugaauuu

SEQ ID NO: 1242680 - RNA, 23 nt, Homo sapiens
cagugauggcgcgggaggcacca

SEQ ID NO: 1242681 - RNA, 23 nt, Homo sapiens
cagugcaccuacugcuuacuguu

SEQ ID NO: 1242682 - RNA, 12 nt, Homo sapiens
cagugcacucga

SEQ ID NO: 1242683 - RNA, 13 nt, Homo sapiens
cagugcauuugcc

SEQ ID NO: 1242684 - RNA, 15 nt, Homo sapiens
cagugcauuugccuu

SEQ ID NO: 1242685 - RNA, 16 nt, Homo sapiens
cagugcauuugccuug

SEQ ID NO: 1242686 - RNA, 18 nt, Homo sapiens
cagugccaggccagugac

SEQ ID NO: 1242687 - RNA, 14 nt, Homo sapiens
cagugccauuccac

SEQ ID NO: 1242688 - RNA, 22 nt, Homo sapiens
cagugcccacaggaucagucug

SEQ ID NO: 1242689 - RNA, 15 nt, Homo sapiens
cagugcccuacaaag

SEQ ID NO: 1242690 - RNA, 16 nt, Homo sapiens
cagugcccucauuuua

SEQ ID NO: 1242691 - RNA, 16 nt, Homo sapiens
cagugccuuccauaau

SEQ ID NO: 1242692 - RNA, 23 nt, Homo sapiens
aaagagaaacuuugugcuacaug

SEQ ID NO: 1242693 - RNA, 22 nt, Homo sapiens
aaagagaacaccuccagcuuuu

SEQ ID NO: 1242694 - RNA, 18 nt, Homo sapiens
aaagagagaugaaccaca

SEQ ID NO: 1242695 - RNA, 15 nt, Homo sapiens
aaagaggaaccagga

SEQ ID NO: 1242696 - RNA, 16 nt, Homo sapiens
aaagagguagcacuac

SEQ ID NO: 1242697 - RNA, 19 nt, Homo sapiens
aaagagguagcacuacaaa

SEQ ID NO: 1242698 - RNA, 12 nt, Homo sapiens
aaagaguaugua

SEQ ID NO: 1242699 - RNA, 20 nt, Homo sapiens
aaagauaacaagaucuuuca

SEQ ID NO: 1242700 - RNA, 21 nt, Homo sapiens
aaagauaguugauucuugccu

SEQ ID NO: 1242701 - RNA, 16 nt, Homo sapiens
aaagauccuauagcuc

SEQ ID NO: 1242702 - RNA, 16 nt, Homo sapiens
aaagaugaaaaguaua

SEQ ID NO: 1242703 - RNA, 19 nt, Homo sapiens
aaagaugaccuuugucuca

SEQ ID NO: 1242704 - RNA, 21 nt, Homo sapiens
aaagaugaucuacucagaaau

SEQ ID NO: 1242705 - RNA, 21 nt, Homo sapiens
aaagauggcugugccucugcc

SEQ ID NO: 1242706 - RNA, 19 nt, Homo sapiens
aaagauuagcaaggucauu

SEQ ID NO: 1242707 - RNA, 19 nt, Homo sapiens
aaagauucucaucacucaa

SEQ ID NO: 1242708 - RNA, 15 nt, Homo sapiens
aaagauucugucuua

SEQ ID NO: 1242709 - RNA, 13 nt, Homo sapiens
aaagauugagaag

SEQ ID NO: 1242710 - RNA, 23 nt, Homo sapiens
aaagauuggacaccccugcuaua

SEQ ID NO: 1242711 - RNA, 17 nt, Homo sapiens
aaagauuuaagcacaaa

SEQ ID NO: 1242712 - RNA, 18 nt, Homo sapiens
aaagauuugugaacugga

SEQ ID NO: 1242713 - RNA, 15 nt, Homo sapiens
aaagauuuucagaaa

SEQ ID NO: 1242714 - RNA, 19 nt, Homo sapiens
aaagcaaaaggcugagaag

SEQ ID NO: 1242715 - RNA, 14 nt, Homo sapiens
aaagcaaaugauuc

SEQ ID NO: 1242716 - RNA, 21 nt, Homo sapiens
aaagcaacaaagauugagaag

SEQ ID NO: 1242717 - RNA, 18 nt, Homo sapiens
aaagcaacuacagaauuu

SEQ ID NO: 1242718 - RNA, 22 nt, Homo sapiens
aaaguaccacacugaguucuau

SEQ ID NO: 1242719 - RNA, 13 nt, Homo sapiens
aaaguagauugag

SEQ ID NO: 1242720 - RNA, 22 nt, Homo sapiens
aaaguauuauucaaaccaauuu

SEQ ID NO: 1242721 - RNA, 15 nt, Homo sapiens
aaaguccacaguuua

SEQ ID NO: 1242722 - RNA, 16 nt, Homo sapiens
aaagucguuuuccaaa

SEQ ID NO: 1242723 - RNA, 16 nt, Homo sapiens
aaagucuauucaaaag

SEQ ID NO: 1242724 - RNA, 20 nt, Homo sapiens
aaagugagaaaaugccucaa

SEQ ID NO: 1242725 - RNA, 17 nt, Homo sapiens
aaagugagacauuguga

SEQ ID NO: 1242726 - RNA, 10 nt, Homo sapiens
aaagugcaua

SEQ ID NO: 1242727 - RNA, 21 nt, Homo sapiens
aaagugcauaugaaauccuug

SEQ ID NO: 1242728 - RNA, 18 nt, Homo sapiens
aaagugcauauuuaucca

SEQ ID NO: 1242729 - RNA, 14 nt, Homo sapiens
aaagugcaugaugg

SEQ ID NO: 1242730 - RNA, 17 nt, Homo sapiens
aaagugcgaguccucca

SEQ ID NO: 1242731 - RNA, 18 nt, Homo sapiens
aaagugcuaagguucuaa

SEQ ID NO: 1242732 - RNA, 23 nt, Homo sapiens
aaagugcugggauuacaggugug

SEQ ID NO: 1242733 - RNA, 18 nt, Homo sapiens
aaaguggacaaggagugu

SEQ ID NO: 1242734 - RNA, 14 nt, Homo sapiens
aaaguggccaugcc

SEQ ID NO: 1242735 - RNA, 19 nt, Homo sapiens
aaaguguaacaauugugua

SEQ ID NO: 1242736 - RNA, 23 nt, Homo sapiens
aaaguguaacaauuguguagccu

SEQ ID NO: 1242737 - RNA, 17 nt, Homo sapiens
aaaguguaauaauauga

SEQ ID NO: 1242738 - RNA, 19 nt, Homo sapiens
aaaguguaauagcauacau

SEQ ID NO: 1242739 - RNA, 17 nt, Homo sapiens
aaaguguaccaacauaa

SEQ ID NO: 1242740 - RNA, 13 nt, Homo sapiens
aaagugugugauu

SEQ ID NO: 1242741 - RNA, 16 nt, Homo sapiens
aaaguguucauuguuu

SEQ ID NO: 1242742 - RNA, 17 nt, Homo sapiens
aaaguuacuauucugua

SEQ ID NO: 1242743 - RNA, 20 nt, Homo sapiens
aaaguucauaacagugccau

SEQ ID NO: 1242744 - RNA, 22 nt, Homo sapiens
aaaguuccaugaauucuugauu

SEQ ID NO: 1242745 - RNA, 18 nt, Homo sapiens
aaaguucccacuccuuca

SEQ ID NO: 1242746 - RNA, 13 nt, Homo sapiens
caguggauucuca

SEQ ID NO: 1242747 - RNA, 18 nt, Homo sapiens
caguggauugauuauaaa

SEQ ID NO: 1242748 - RNA, 16 nt, Homo sapiens
caguggauuguuuaua

SEQ ID NO: 1242749 - RNA, 20 nt, Homo sapiens
caguggcaccaccauggcuc

SEQ ID NO: 1242750 - RNA, 16 nt, Homo sapiens
caguggcgugaucucg

SEQ ID NO: 1242751 - RNA, 14 nt, Homo sapiens
caguggcuaccuac

SEQ ID NO: 1242752 - RNA, 15 nt, Homo sapiens
caguggcucauaaaa

SEQ ID NO: 1242753 - RNA, 17 nt, Homo sapiens
cagugggggcagagcca

SEQ ID NO: 1242754 - RNA, 23 nt, Homo sapiens
cagugguauccugugacauguaa

SEQ ID NO: 1242755 - RNA, 16 nt, Homo sapiens
caguggugugaucucg

SEQ ID NO: 1242756 - RNA, 19 nt, Homo sapiens
cagugguuuuauacugaag

SEQ ID NO: 1242757 - RNA, 14 nt, Homo sapiens
caguguacauggaa

SEQ ID NO: 1242758 - RNA, 16 nt, Homo sapiens
caguguauguacuaag

SEQ ID NO: 1242759 - RNA, 17 nt, Homo sapiens
cagugucacucuguagu

SEQ ID NO: 1242760 - RNA, 19 nt, Homo sapiens
caguguccucuugcucaaa

SEQ ID NO: 1242761 - RNA, 13 nt, Homo sapiens
cagugucuuccau

SEQ ID NO: 1242762 - RNA, 13 nt, Homo sapiens
cagugugcuccag

SEQ ID NO: 1242763 - RNA, 22 nt, Homo sapiens
caguguggcccagggaagccaa

SEQ ID NO: 1242764 - RNA, 20 nt, Homo sapiens
caguguucuaugaacaacuc

SEQ ID NO: 1242765 - RNA, 19 nt, Homo sapiens
caguuaaucagcaaccuga

SEQ ID NO: 1242766 - RNA, 12 nt, Homo sapiens
caguuacaacca

SEQ ID NO: 1242767 - RNA, 22 nt, Homo sapiens
caguuacagagugaacacucua

SEQ ID NO: 1242768 - RNA, 17 nt, Homo sapiens
caguuaccacacaucua

SEQ ID NO: 1242769 - RNA, 16 nt, Homo sapiens
caguuacuccaguaua

SEQ ID NO: 1242770 - RNA, 20 nt, Homo sapiens
caguuacucccuacacugau

SEQ ID NO: 1242771 - RNA, 18 nt, Homo sapiens
caguuagagacucuguca

SEQ ID NO: 1242772 - RNA, 20 nt, Homo sapiens
caguuaugugaaugaucucu

SEQ ID NO: 1242773 - RNA, 23 nt, Homo sapiens
caguuauuaaucuggacauucga

SEQ ID NO: 1242774 - RNA, 14 nt, Homo sapiens
caguucaagacuua

SEQ ID NO: 1242775 - RNA, 17 nt, Homo sapiens
caguucagguaugugug

SEQ ID NO: 1242776 - RNA, 18 nt, Homo sapiens
caguucccccaaccucag

SEQ ID NO: 1242777 - RNA, 18 nt, Homo sapiens
caguucuacacugauaca

SEQ ID NO: 1242778 - RNA, 17 nt, Homo sapiens
caguucugaacuggaac

SEQ ID NO: 1242779 - RNA, 20 nt, Homo sapiens
caguucugaauaacuugaag

SEQ ID NO: 1242780 - RNA, 14 nt, Homo sapiens
caguucugacacac

SEQ ID NO: 1242781 - RNA, 14 nt, Homo sapiens
caguucugcuccuc

SEQ ID NO: 1242782 - RNA, 13 nt, Homo sapiens
caguucugugguu

SEQ ID NO: 1242783 - RNA, 22 nt, Homo sapiens
caguucuguguggauuugucug

SEQ ID NO: 1242784 - RNA, 14 nt, Homo sapiens
caguugaacagagg

SEQ ID NO: 1242785 - RNA, 16 nt, Homo sapiens
caguugaucagacuga

SEQ ID NO: 1242786 - RNA, 20 nt, Homo sapiens
caguugcccagagcacuuua

SEQ ID NO: 1242787 - RNA, 19 nt, Homo sapiens
caguuggacucucagggau

SEQ ID NO: 1242788 - RNA, 19 nt, Homo sapiens
caguugggacccaaaacac

SEQ ID NO: 1242789 - RNA, 19 nt, Homo sapiens
caguuuaaaggggucccau

SEQ ID NO: 1242790 - RNA, 20 nt, Homo sapiens
caguuucagguguuuaguug

SEQ ID NO: 1242791 - RNA, 18 nt, Homo sapiens
caguuucuaggcaccuca

SEQ ID NO: 1242792 - RNA, 15 nt, Homo sapiens
caguuugacuguggc

SEQ ID NO: 1242793 - RNA, 18 nt, Homo sapiens
caguuugauaccugcacu

SEQ ID NO: 1242794 - RNA, 17 nt, Homo sapiens
caguuuggagucacugu

SEQ ID NO: 1242795 - RNA, 16 nt, Homo sapiens
caguuuuuaacauaau

SEQ ID NO: 1242796 - RNA, 22 nt, Homo sapiens
cauaaaaagccugcaauuucau

SEQ ID NO: 1242797 - RNA, 21 nt, Homo sapiens
cauaaaagacaagcacuuugg

SEQ ID NO: 1242798 - RNA, 21 nt, Homo sapiens
cauaaacgguuccuggugacu

SEQ ID NO: 1242799 - RNA, 21 nt, Homo sapiens
cauaaagagguaaaaaacugu

SEQ ID NO: 1242800 - RNA, 23 nt, Homo sapiens
cauaaagagguaaaaaacuguca

SEQ ID NO: 1242801 - RNA, 21 nt, Homo sapiens
cauaaagucuuugaagugacu

SEQ ID NO: 1242802 - RNA, 12 nt, Homo sapiens
cauaaagugaau

SEQ ID NO: 1242803 - RNA, 18 nt, Homo sapiens
cauaaagugaauguuuac

SEQ ID NO: 1242804 - RNA, 23 nt, Homo sapiens
cauaacagacugaaaugugcuca

SEQ ID NO: 1242805 - RNA, 16 nt, Homo sapiens
cauaacaggagugcca

SEQ ID NO: 1242806 - RNA, 22 nt, Homo sapiens
cauaaccucuggggaccccaac

SEQ ID NO: 1242807 - RNA, 14 nt, Homo sapiens
cauaaccugucuca

SEQ ID NO: 1242808 - RNA, 21 nt, Homo sapiens
cauaacuaaauuugauacuua

SEQ ID NO: 1242809 - RNA, 22 nt, Homo sapiens
cauaacuaaauuugauacuuau

SEQ ID NO: 1242810 - RNA, 21 nt, Homo sapiens
cauaacugaaaaugugcuaua

SEQ ID NO: 1242811 - RNA, 17 nt, Homo sapiens
cauaacuguucucauuu

SEQ ID NO: 1242812 - RNA, 15 nt, Homo sapiens
cauaagaaagcacua

SEQ ID NO: 1242813 - RNA, 18 nt, Homo sapiens
cauaagaaagcacuauua

SEQ ID NO: 1242814 - RNA, 22 nt, Homo sapiens
cauaagaaauguauuccugaaa

SEQ ID NO: 1242815 - RNA, 20 nt, Homo sapiens
cauaagccuccauuuaguuc

SEQ ID NO: 1242816 - RNA, 20 nt, Homo sapiens
cauaagcugauuugauacca

SEQ ID NO: 1242817 - RNA, 18 nt, Homo sapiens
cauaagggguuugccauu

SEQ ID NO: 1242818 - RNA, 18 nt, Homo sapiens
cauaauaauaauuugcac

SEQ ID NO: 1242819 - RNA, 23 nt, Homo sapiens
cauaauaauaauuugcacuuaua

SEQ ID NO: 1242820 - RNA, 16 nt, Homo sapiens
cauaauguuacauuau

SEQ ID NO: 1242821 - RNA, 15 nt, Homo sapiens
cauaauucagcacuu

SEQ ID NO: 1242822 - RNA, 21 nt, Homo sapiens
cauaauucaggggcugacacu

SEQ ID NO: 1242823 - RNA, 15 nt, Homo sapiens
cauaauucuaaguua

SEQ ID NO: 1242824 - RNA, 22 nt, Homo sapiens
cauaauugcuguucugcugaau

SEQ ID NO: 1242825 - RNA, 17 nt, Homo sapiens
cauaauugcuuugccaa

SEQ ID NO: 1242826 - RNA, 16 nt, Homo sapiens
cauaauuguucuuagu

SEQ ID NO: 1242827 - RNA, 17 nt, Homo sapiens
cauaauuuaaaagcaca

SEQ ID NO: 1242828 - RNA, 14 nt, Homo sapiens
cauacaaagcaguu

SEQ ID NO: 1242829 - RNA, 16 nt, Homo sapiens
cauacaacagaaacca

SEQ ID NO: 1242830 - RNA, 13 nt, Homo sapiens
cauacaacuggac

SEQ ID NO: 1242831 - RNA, 14 nt, Homo sapiens
cauacaaguuucau

SEQ ID NO: 1242832 - RNA, 13 nt, Homo sapiens
cauacaauuccaa

SEQ ID NO: 1242833 - RNA, 18 nt, Homo sapiens
cauacaauuccaaacaca

SEQ ID NO: 1242834 - RNA, 23 nt, Homo sapiens
cauacagaauguucuauugucau

SEQ ID NO: 1242835 - RNA, 17 nt, Homo sapiens
cauacauauuaucucau

SEQ ID NO: 1242836 - RNA, 18 nt, Homo sapiens
cauacaugcauacaaaga

SEQ ID NO: 1242837 - RNA, 21 nt, Homo sapiens
cauaccaagacccccgucucu

SEQ ID NO: 1242838 - RNA, 11 nt, Homo sapiens
cauaccacagc

SEQ ID NO: 1242839 - RNA, 16 nt, Homo sapiens
cauaccaccaccaaga

SEQ ID NO: 1242840 - RNA, 17 nt, Homo sapiens
cauacccacacacccag

SEQ ID NO: 1242841 - RNA, 17 nt, Homo sapiens
cauaccguguaccucag

SEQ ID NO: 1242842 - RNA, 19 nt, Homo sapiens
cauacgagagcagaggucu

SEQ ID NO: 1242843 - RNA, 13 nt, Homo sapiens
cauacugcaugua

SEQ ID NO: 1242844 - RNA, 16 nt, Homo sapiens
cauacuucuucauuca

SEQ ID NO: 1242845 - RNA, 23 nt, Homo sapiens
cauagaaaaggcgugcaguacua

SEQ ID NO: 1242846 - RNA, 15 nt, Homo sapiens
cauagaauagcgaca

SEQ ID NO: 1242847 - RNA, 16 nt, Homo sapiens
cauagccauggaaccc

SEQ ID NO: 1242848 - RNA, 18 nt, Homo sapiens
cauagcgaagaccaguau

SEQ ID NO: 1242849 - RNA, 15 nt, Homo sapiens
cauagcuacccaaaa

SEQ ID NO: 1242850 - RNA, 19 nt, Homo sapiens
cauagcuccucucccucac

SEQ ID NO: 1242851 - RNA, 16 nt, Homo sapiens
cauaggacauacugca

SEQ ID NO: 1242852 - RNA, 14 nt, Homo sapiens
cauaggccaugaaa

SEQ ID NO: 1242853 - RNA, 20 nt, Homo sapiens
cauagguuaaaaaaaaaagu

SEQ ID NO: 1242854 - RNA, 20 nt, Homo sapiens
cauaguaccauuuauacaaa

SEQ ID NO: 1242855 - RNA, 17 nt, Homo sapiens
cauaguaccucugcuau

SEQ ID NO: 1242856 - RNA, 17 nt, Homo sapiens
cauaguuuacaauauua

SEQ ID NO: 1242857 - RNA, 14 nt, Homo sapiens
cauaguuugugaau

SEQ ID NO: 1242858 - RNA, 20 nt, Homo sapiens
cauauaacgcagucuaauua

SEQ ID NO: 1242859 - RNA, 16 nt, Homo sapiens
cauauagaaugcagag

SEQ ID NO: 1242860 - RNA, 19 nt, Homo sapiens
cauauaggugauguuugcu

SEQ ID NO: 1242861 - RNA, 16 nt, Homo sapiens
cauauauacaggcaua

SEQ ID NO: 1242862 - RNA, 18 nt, Homo sapiens
cauauauaugucaggcaa

SEQ ID NO: 1242863 - RNA, 16 nt, Homo sapiens
cauauauauuaauacu

SEQ ID NO: 1242864 - RNA, 14 nt, Homo sapiens
gcaauugacuguca

SEQ ID NO: 1242865 - RNA, 14 nt, Homo sapiens
gcaauuuagcucuc

SEQ ID NO: 1242866 - RNA, 18 nt, Homo sapiens
gcaauuuuauuaaaugca

SEQ ID NO: 1242867 - RNA, 18 nt, Homo sapiens
gcaauuuucgaacauucu

SEQ ID NO: 1242868 - RNA, 17 nt, Homo sapiens
gcaauuuuguaaauuga

SEQ ID NO: 1242869 - RNA, 13 nt, Homo sapiens
gcaauuuuuccau

SEQ ID NO: 1242870 - RNA, 12 nt, Homo sapiens
gcacaaguacuu

SEQ ID NO: 1242871 - RNA, 20 nt, Homo sapiens
gcacacacacacacaugcac

SEQ ID NO: 1242872 - RNA, 19 nt, Homo sapiens
gcacacacacacaucucau

SEQ ID NO: 1242873 - RNA, 20 nt, Homo sapiens
gcacacacacacgcuuucuu

SEQ ID NO: 1242874 - RNA, 20 nt, Homo sapiens
gcacacuagccucuccagga

SEQ ID NO: 1242875 - RNA, 11 nt, Homo sapiens
gcacacuuugc

SEQ ID NO: 1242876 - RNA, 18 nt, Homo sapiens
gcacagaagcucaucuca

SEQ ID NO: 1242877 - RNA, 13 nt, Homo sapiens
gcacagaggucag

SEQ ID NO: 1242878 - RNA, 22 nt, Homo sapiens
gcacagaucugcuugaucaauu

SEQ ID NO: 1242879 - RNA, 13 nt, Homo sapiens
gcacagauggauu

SEQ ID NO: 1242880 - RNA, 16 nt, Homo sapiens
gcacagcagcaauugu

SEQ ID NO: 1242881 - RNA, 12 nt, Homo sapiens
gcacagccaccc

SEQ ID NO: 1242882 - RNA, 23 nt, Homo sapiens
gcacagcccugggagggggcuau

SEQ ID NO: 1242883 - RNA, 22 nt, Homo sapiens
gcacaggaguguccucuucccu

SEQ ID NO: 1242884 - RNA, 16 nt, Homo sapiens
gcacagggcaccagag

SEQ ID NO: 1242885 - RNA, 14 nt, Homo sapiens
gcacaggggcccau

SEQ ID NO: 1242886 - RNA, 19 nt, Homo sapiens
gcacaguagagcaaaucua

SEQ ID NO: 1242887 - RNA, 21 nt, Homo sapiens
gcacaguaucuuuucuuucaa

SEQ ID NO: 1242888 - RNA, 12 nt, Homo sapiens
gcacaguuugaa

SEQ ID NO: 1242889 - RNA, 18 nt, Homo sapiens
gcacauagcuaucaagug

SEQ ID NO: 1242890 - RNA, 23 nt, Homo sapiens
gcacauauccaggcaccaggacu

SEQ ID NO: 1242891 - RNA, 15 nt, Homo sapiens
gcacaucaauuacaa

SEQ ID NO: 1242892 - RNA, 17 nt, Homo sapiens
gcacauccauucccaag

SEQ ID NO: 1242893 - RNA, 12 nt, Homo sapiens
gcacaucuuuga

SEQ ID NO: 1242894 - RNA, 20 nt, Homo sapiens
gcacaugucuuguacaugug

SEQ ID NO: 1242895 - RNA, 20 nt, Homo sapiens
gcacaugugccacacaguga

SEQ ID NO: 1242896 - RNA, 22 nt, Homo sapiens
gcacauuuaugaaucacaguau

SEQ ID NO: 1242897 - RNA, 22 nt, Homo sapiens
gcacauuugucaguauuuuugc

SEQ ID NO: 1242898 - RNA, 21 nt, Homo sapiens
gcaccaaccacagcaucggga

SEQ ID NO: 1242899 - RNA, 14 nt, Homo sapiens
gcaccacugcacuc

SEQ ID NO: 1242900 - RNA, 20 nt, Homo sapiens
gcaccacugcacuccagccu

SEQ ID NO: 1242901 - RNA, 19 nt, Homo sapiens
gcaccacuguguauuuaac

SEQ ID NO: 1242902 - RNA, 20 nt, Homo sapiens
gcaccacuuuuaacagaaca

SEQ ID NO: 1242903 - RNA, 10 nt, Homo sapiens
gcaccagagg

SEQ ID NO: 1242904 - RNA, 23 nt, Homo sapiens
gcaccagagggauaaaaacaaua

SEQ ID NO: 1242905 - RNA, 20 nt, Homo sapiens
gcaccauucuccugccucag

SEQ ID NO: 1242906 - RNA, 12 nt, Homo sapiens
gcaccauugcac

SEQ ID NO: 1242907 - RNA, 19 nt, Homo sapiens
gcaccauuucugucacuca

SEQ ID NO: 1242908 - RNA, 22 nt, Homo sapiens
gcacccaacuacugagcugaga

SEQ ID NO: 1242909 - RNA, 22 nt, Homo sapiens
gcacccaugacaaucaccuuca

SEQ ID NO: 1242910 - RNA, 12 nt, Homo sapiens
gcacccuggauu

SEQ ID NO: 1242911 - RNA, 15 nt, Homo sapiens
gcaccggccucggga

SEQ ID NO: 1242912 - RNA, 19 nt, Homo sapiens
gcaccuaccaucagggaca

SEQ ID NO: 1242913 - RNA, 13 nt, Homo sapiens
gcaccuaccucac

SEQ ID NO: 1242914 - RNA, 13 nt, Homo sapiens
gcaccuacugcuu

SEQ ID NO: 1242915 - RNA, 20 nt, Homo sapiens
gcaccucaccucccgaagcc

SEQ ID NO: 1242916 - RNA, 20 nt, Homo sapiens
gcaccugagggugcuuugug

SEQ ID NO: 1242917 - RNA, 23 nt, Homo sapiens
gcaccugagggugcuuuguguaa

SEQ ID NO: 1242918 - RNA, 17 nt, Homo sapiens
gcagcauacacagauga

SEQ ID NO: 1242919 - RNA, 17 nt, Homo sapiens
gcagcauggucccugcc

SEQ ID NO: 1242920 - RNA, 17 nt, Homo sapiens
gcagcauuuuauuuacc

SEQ ID NO: 1242921 - RNA, 21 nt, Homo sapiens
gcagccccaccucacagccag

SEQ ID NO: 1242922 - RNA, 16 nt, Homo sapiens
gcagccccucaugccu

SEQ ID NO: 1242923 - RNA, 20 nt, Homo sapiens
gcagcccggcgccaccaucc

SEQ ID NO: 1242924 - RNA, 20 nt, Homo sapiens
gcagcccuaaggaucucuca

SEQ ID NO: 1242925 - RNA, 13 nt, Homo sapiens
gcagccugugaag

SEQ ID NO: 1242926 - RNA, 15 nt, Homo sapiens
gcagcgccagugaca

SEQ ID NO: 1242927 - RNA, 15 nt, Homo sapiens
gcagcuaacaauguc

SEQ ID NO: 1242928 - RNA, 15 nt, Homo sapiens
gcagcuacucagagg

SEQ ID NO: 1242929 - RNA, 15 nt, Homo sapiens
gcagcuagcucuuug

SEQ ID NO: 1242930 - RNA, 19 nt, Homo sapiens
gcagcucacggaacuggag

SEQ ID NO: 1242931 - RNA, 22 nt, Homo sapiens
gcagcuccacagggcagggccu

SEQ ID NO: 1242932 - RNA, 14 nt, Homo sapiens
gcagcuucugggac

SEQ ID NO: 1242933 - RNA, 15 nt, Homo sapiens
gcaggaagggagaac

SEQ ID NO: 1242934 - RNA, 15 nt, Homo sapiens
gcaggaagugucuag

SEQ ID NO: 1242935 - RNA, 21 nt, Homo sapiens
gcaggacuugagaagaccuca

SEQ ID NO: 1242936 - RNA, 22 nt, Homo sapiens
gcaggaucuggacgguccccuc

SEQ ID NO: 1242937 - RNA, 15 nt, Homo sapiens
gcaggcaauuucacc

SEQ ID NO: 1242938 - RNA, 16 nt, Homo sapiens
gcaggcaugcuucuca

SEQ ID NO: 1242939 - RNA, 20 nt, Homo sapiens
gcaggccgugugucugucag

SEQ ID NO: 1242940 - RNA, 20 nt, Homo sapiens
gcaggcucugccagcccugg

SEQ ID NO: 1242941 - RNA, 23 nt, Homo sapiens
gcaggcuggcagcucuccaguca

SEQ ID NO: 1242942 - RNA, 14 nt, Homo sapiens
gcaggcugggccau

SEQ ID NO: 1242943 - RNA, 18 nt, Homo sapiens
gcaggcugggccaugucc

SEQ ID NO: 1242944 - RNA, 23 nt, Homo sapiens
gcaggcuuucugggugugacuga

SEQ ID NO: 1242945 - RNA, 21 nt, Homo sapiens
gcagggaagccccacuugaag

SEQ ID NO: 1242946 - RNA, 15 nt, Homo sapiens
gcagggcaaaugaca

SEQ ID NO: 1242947 - RNA, 17 nt, Homo sapiens
gcagggcccagugacaa

SEQ ID NO: 1242948 - RNA, 20 nt, Homo sapiens
gcagggcugggccagugcau

SEQ ID NO: 1242949 - RNA, 13 nt, Homo sapiens
gcaggggaagccu

SEQ ID NO: 1242950 - RNA, 13 nt, Homo sapiens
gcaggggagacag

SEQ ID NO: 1242951 - RNA, 21 nt, Homo sapiens
gcaggggagacaggagccuag

SEQ ID NO: 1242952 - RNA, 16 nt, Homo sapiens
gcaggggccuggagau

SEQ ID NO: 1242953 - RNA, 21 nt, Homo sapiens
gcagggucaguggaagcccca

SEQ ID NO: 1242954 - RNA, 19 nt, Homo sapiens
gcagggugaagcagcucau

SEQ ID NO: 1242955 - RNA, 12 nt, Homo sapiens
gcaggugucaua

SEQ ID NO: 1242956 - RNA, 20 nt, Homo sapiens
gcagguuccccaagggcccu

SEQ ID NO: 1242957 - RNA, 17 nt, Homo sapiens
gcagguuggaccccaga

SEQ ID NO: 1242958 - RNA, 14 nt, Homo sapiens
gcaguaauguuccu

SEQ ID NO: 1242959 - RNA, 20 nt, Homo sapiens
gcaguaccaucuacaucucc

SEQ ID NO: 1242960 - RNA, 13 nt, Homo sapiens
gcaguacuuugug

SEQ ID NO: 1242961 - RNA, 19 nt, Homo sapiens
gcaguauguuuguuucauu

SEQ ID NO: 1242962 - RNA, 17 nt, Homo sapiens
gcagucaauuuucacau

SEQ ID NO: 1242963 - RNA, 13 nt, Homo sapiens
gcagucagggaca

SEQ ID NO: 1242964 - RNA, 22 nt, Homo sapiens
gcagucauuaugagaggcaaug

SEQ ID NO: 1242965 - RNA, 21 nt, Homo sapiens
gcagucgaugcguucacucca

SEQ ID NO: 1242966 - RNA, 19 nt, Homo sapiens
gcagucgucgcacagucuc

SEQ ID NO: 1242967 - RNA, 17 nt, Homo sapiens
gcagucgugccuguguc

SEQ ID NO: 1242968 - RNA, 21 nt, Homo sapiens
gcagucuaauuacauuucacu

SEQ ID NO: 1242969 - RNA, 18 nt, Homo sapiens
gcagugacgugcaccugu

SEQ ID NO: 1242970 - RNA, 13 nt, Homo sapiens
gcagugagcagaa

SEQ ID NO: 1242971 - RNA, 12 nt, Homo sapiens
gcagugccuugu

SEQ ID NO: 1242972 - RNA, 21 nt, Homo sapiens
gcagugucuguaaaagagccu

SEQ ID NO: 1242973 - RNA, 21 nt, Homo sapiens
gcauuggugacucacuucaau

SEQ ID NO: 1242974 - RNA, 22 nt, Homo sapiens
gcauugucccugugccuaacac

SEQ ID NO: 1242975 - RNA, 19 nt, Homo sapiens
gcauuuaaauuugauuucc

SEQ ID NO: 1242976 - RNA, 16 nt, Homo sapiens
gcauuuagucuugcca

SEQ ID NO: 1242977 - RNA, 18 nt, Homo sapiens
gcauuuagucuugccagg

SEQ ID NO: 1242978 - RNA, 22 nt, Homo sapiens
gcauuuauggucaacacuuaag

SEQ ID NO: 1242979 - RNA, 19 nt, Homo sapiens
gcauuuauuuauacagugc

SEQ ID NO: 1242980 - RNA, 19 nt, Homo sapiens
gcauuuccaacaccacaga

SEQ ID NO: 1242981 - RNA, 16 nt, Homo sapiens
gcauuuggcacugaga

SEQ ID NO: 1242982 - RNA, 19 nt, Homo sapiens
gcauuuggugagagucaaa

SEQ ID NO: 1242983 - RNA, 15 nt, Homo sapiens
gcauuuuucugggag

SEQ ID NO: 1242984 - RNA, 22 nt, Homo sapiens
gccaaacauuaaaauuagcacu

SEQ ID NO: 1242985 - RNA, 18 nt, Homo sapiens
gccaaacccuugucagug

SEQ ID NO: 1242986 - RNA, 15 nt, Homo sapiens
gccaaacucugccag

SEQ ID NO: 1242987 - RNA, 19 nt, Homo sapiens
gccaaccggucacccagga

SEQ ID NO: 1242988 - RNA, 19 nt, Homo sapiens
gccaaccucuggagcaaug

SEQ ID NO: 1242989 - RNA, 16 nt, Homo sapiens
gccaacugaaaauccu

SEQ ID NO: 1242990 - RNA, 17 nt, Homo sapiens
gccaacugcugcuuuuu

SEQ ID NO: 1242991 - RNA, 13 nt, Homo sapiens
gccaagacuccuc

SEQ ID NO: 1242992 - RNA, 16 nt, Homo sapiens
gccaagagaaaggccu

SEQ ID NO: 1242993 - RNA, 16 nt, Homo sapiens
gccaagagaauauccg

SEQ ID NO: 1242994 - RNA, 21 nt, Homo sapiens
gccaagauuuuccucuuguga

SEQ ID NO: 1242995 - RNA, 12 nt, Homo sapiens
gccaagcaguuu

SEQ ID NO: 1242996 - RNA, 16 nt, Homo sapiens
gccaauaaaugaacug

SEQ ID NO: 1242997 - RNA, 17 nt, Homo sapiens
gccacaaacuccaucca

SEQ ID NO: 1242998 - RNA, 14 nt, Homo sapiens
gccacaacccuguu

SEQ ID NO: 1242999 - RNA, 14 nt, Homo sapiens
gccacaacugcccc

SEQ ID NO: 1243000 - RNA, 16 nt, Homo sapiens
gccacaagucuuccag

SEQ ID NO: 1243001 - RNA, 15 nt, Homo sapiens
gccacacagugacuu

SEQ ID NO: 1243002 - RNA, 18 nt, Homo sapiens
gccacagcccccuugccc

SEQ ID NO: 1243003 - RNA, 13 nt, Homo sapiens
gccacaguggcca

SEQ ID NO: 1243004 - RNA, 19 nt, Homo sapiens
gccacauggccccauccca

SEQ ID NO: 1243005 - RNA, 19 nt, Homo sapiens
gccacauuucauugucuua

SEQ ID NO: 1243006 - RNA, 11 nt, Homo sapiens
gccacauuucu

SEQ ID NO: 1243007 - RNA, 17 nt, Homo sapiens
gccaccaaagcugccca

SEQ ID NO: 1243008 - RNA, 14 nt, Homo sapiens
gccaccacauuuag

SEQ ID NO: 1243009 - RNA, 14 nt, Homo sapiens
gccacccuagccaa

SEQ ID NO: 1243010 - RNA, 18 nt, Homo sapiens
gccaccgccagagcuccu

SEQ ID NO: 1243011 - RNA, 13 nt, Homo sapiens
gccaccucagggc

SEQ ID NO: 1243012 - RNA, 11 nt, Homo sapiens
gccaccucucc

SEQ ID NO: 1243013 - RNA, 24 nt, Homo sapiens
gccacguaugguggcucaugucua

SEQ ID NO: 1243014 - RNA, 19 nt, Homo sapiens
gccacucagagcucccuca

SEQ ID NO: 1243015 - RNA, 21 nt, Homo sapiens
gccacucuuagcuaaaucccu

SEQ ID NO: 1243016 - RNA, 23 nt, Homo sapiens
gccacugagaagugcacuuuaag

SEQ ID NO: 1243017 - RNA, 15 nt, Homo sapiens
gccacugagcagucu

SEQ ID NO: 1243018 - RNA, 22 nt, Homo sapiens
gccacugccccccgaggcugcu

SEQ ID NO: 1243019 - RNA, 16 nt, Homo sapiens
gccacuguggccagag

SEQ ID NO: 1243020 - RNA, 17 nt, Homo sapiens
gccacuguguacugugg

SEQ ID NO: 1243021 - RNA, 12 nt, Homo sapiens
gccagaagugaa

SEQ ID NO: 1243022 - RNA, 23 nt, Homo sapiens
gccagaccagcaggcuggccuau

SEQ ID NO: 1243023 - RNA, 13 nt, Homo sapiens
gccagagaauaga

SEQ ID NO: 1243024 - RNA, 15 nt, Homo sapiens
gccagagaugcaaua

SEQ ID NO: 1243025 - RNA, 22 nt, Homo sapiens
gccagagcccuucacugccaug

SEQ ID NO: 1243026 - RNA, 19 nt, Homo sapiens
gccagaggcagccucugca

SEQ ID NO: 1243027 - RNA, 13 nt, Homo sapiens
gccagaggcagcu

SEQ ID NO: 1243028 - RNA, 21 nt, Homo sapiens
gccagaggcucuaauguacaa

SEQ ID NO: 1243029 - RNA, 22 nt, Homo sapiens
gccagaggcucuaauguacaau

SEQ ID NO: 1243030 - RNA, 23 nt, Homo sapiens
gccagaggcucuaauguacaaua

SEQ ID NO: 1243031 - RNA, 16 nt, Homo sapiens
gccagaggugcuucac

SEQ ID NO: 1243032 - RNA, 22 nt, Homo sapiens
gccagagucaaugccuucaugg

SEQ ID NO: 1243033 - RNA, 16 nt, Homo sapiens
gccagaugauuguuca

SEQ ID NO: 1243034 - RNA, 19 nt, Homo sapiens
gccagaugugaaaacaucu

SEQ ID NO: 1243035 - RNA, 21 nt, Homo sapiens
gccagcaaugacaucucaggg

SEQ ID NO: 1243036 - RNA, 17 nt, Homo sapiens
gccagcaaugaugucca

SEQ ID NO: 1243037 - RNA, 20 nt, Homo sapiens
gccagcacaggggccccaga

SEQ ID NO: 1243038 - RNA, 14 nt, Homo sapiens
gccagcaccacuuc

SEQ ID NO: 1243039 - RNA, 14 nt, Homo sapiens
gccagcacgccgcu

SEQ ID NO: 1243040 - RNA, 19 nt, Homo sapiens
gccagcagucuaccugcuc

SEQ ID NO: 1243041 - RNA, 16 nt, Homo sapiens
gccagccagugccauu

SEQ ID NO: 1243042 - RNA, 16 nt, Homo sapiens
gccagccuccagcacc

SEQ ID NO: 1243043 - RNA, 13 nt, Homo sapiens
gccagcgggcaca

SEQ ID NO: 1243044 - RNA, 17 nt, Homo sapiens
gccagcugugcacuuuc

SEQ ID NO: 1243045 - RNA, 22 nt, Homo sapiens
gccagcuuggggccaccaaagc

SEQ ID NO: 1243046 - RNA, 22 nt, Homo sapiens
gccaggaacuguguguguugca

SEQ ID NO: 1243047 - RNA, 22 nt, Homo sapiens
gccaggaaucacuggcuguuaa

SEQ ID NO: 1243048 - RNA, 14 nt, Homo sapiens
gccaggacugagcc

SEQ ID NO: 1243049 - RNA, 17 nt, Homo sapiens
gccaggaggccugcuag

SEQ ID NO: 1243050 - RNA, 23 nt, Homo sapiens
gccaggccagagggagugacaga

SEQ ID NO: 1243051 - RNA, 19 nt, Homo sapiens
gccaggccagagggcagug

SEQ ID NO: 1243052 - RNA, 15 nt, Homo sapiens
gccaggccaggacca

SEQ ID NO: 1243053 - RNA, 18 nt, Homo sapiens
gccaggcguuggugccac

SEQ ID NO: 1243054 - RNA, 20 nt, Homo sapiens
gccaggcugccaaggccaga

SEQ ID NO: 1243055 - RNA, 18 nt, Homo sapiens
gccagggcaaugaugaau

SEQ ID NO: 1243056 - RNA, 13 nt, Homo sapiens
gccaggugcagug

SEQ ID NO: 1243057 - RNA, 17 nt, Homo sapiens
gccagugagcugugauc

SEQ ID NO: 1243058 - RNA, 17 nt, Homo sapiens
gccagugagggcagucc

SEQ ID NO: 1243059 - RNA, 14 nt, Homo sapiens
gccagugccucuca

SEQ ID NO: 1243060 - RNA, 23 nt, Homo sapiens
gccagugcuuuaauggcauguca

SEQ ID NO: 1243061 - RNA, 14 nt, Homo sapiens
gccagugucuuucu

SEQ ID NO: 1243062 - RNA, 22 nt, Homo sapiens
gccauaaaaauaaaucaguuca

SEQ ID NO: 1243063 - RNA, 14 nt, Homo sapiens
gccauaacuugaaa

SEQ ID NO: 1243064 - RNA, 18 nt, Homo sapiens
gccauaagaaagcacuau

SEQ ID NO: 1243065 - RNA, 17 nt, Homo sapiens
gccauaauucuaaguua

SEQ ID NO: 1243066 - RNA, 18 nt, Homo sapiens
gccauacugccuuugcag

SEQ ID NO: 1243067 - RNA, 14 nt, Homo sapiens
gccauagccccaua

SEQ ID NO: 1243068 - RNA, 23 nt, Homo sapiens
gccauaugcccucaucaucccag

SEQ ID NO: 1243069 - RNA, 14 nt, Homo sapiens
gccauaugccuugg

SEQ ID NO: 1243070 - RNA, 22 nt, Homo sapiens
gccauauucuguuggccagugu

SEQ ID NO: 1243071 - RNA, 12 nt, Homo sapiens
gccaucacagga

SEQ ID NO: 1243072 - RNA, 21 nt, Homo sapiens
gccaucacucuuguacugccu

SEQ ID NO: 1243073 - RNA, 12 nt, Homo sapiens
gccaucaugccu

SEQ ID NO: 1243074 - RNA, 16 nt, Homo sapiens
gccauccccaccuuca

SEQ ID NO: 1243075 - RNA, 21 nt, Homo sapiens
gccauccucacaugugacaaa

SEQ ID NO: 1243076 - RNA, 15 nt, Homo sapiens
gccauccucacccag

SEQ ID NO: 1243077 - RNA, 17 nt, Homo sapiens
gccauccucccaagggg

SEQ ID NO: 1243078 - RNA, 15 nt, Homo sapiens
gccaucgccaaguaa

SEQ ID NO: 1243079 - RNA, 13 nt, Homo sapiens
gccaugagggaca

SEQ ID NO: 1243080 - RNA, 12 nt, Homo sapiens
gccauggcagcg

SEQ ID NO: 1243081 - RNA, 23 nt, Homo sapiens
gccaugggaugucaacagccaua

SEQ ID NO: 1243082 - RNA, 19 nt, Homo sapiens
gccauggugacauugugga

SEQ ID NO: 1243083 - RNA, 14 nt, Homo sapiens
gccauguccaaaga

SEQ ID NO: 1243084 - RNA, 15 nt, Homo sapiens
gccauguccaaagag

SEQ ID NO: 1243085 - RNA, 16 nt, Homo sapiens
gcccccuuucagaugu

SEQ ID NO: 1243086 - RNA, 22 nt, Homo sapiens
gccccguggugacauuucccaa

SEQ ID NO: 1243087 - RNA, 23 nt, Homo sapiens
gccccguuucuugccccagugug

SEQ ID NO: 1243088 - RNA, 22 nt, Homo sapiens
gccccucaaccuccuguggaac

SEQ ID NO: 1243089 - RNA, 17 nt, Homo sapiens
gccccucccaacccagc

SEQ ID NO: 1243090 - RNA, 22 nt, Homo sapiens
gccccuccuagacccaggugga

SEQ ID NO: 1243091 - RNA, 18 nt, Homo sapiens
gccccucucucacuggcu

SEQ ID NO: 1243092 - RNA, 20 nt, Homo sapiens
gccccucugcacccuuauca

SEQ ID NO: 1243093 - RNA, 20 nt, Homo sapiens
gccccuguauggcacuggca

SEQ ID NO: 1243094 - RNA, 23 nt, Homo sapiens
gccccugucauccucaugcugcu

SEQ ID NO: 1243095 - RNA, 19 nt, Homo sapiens
gcccgcagugcugggacca

SEQ ID NO: 1243096 - RNA, 15 nt, Homo sapiens
gcccggaccuccauc

SEQ ID NO: 1243097 - RNA, 18 nt, Homo sapiens
gcccggcgccgggcacca

SEQ ID NO: 1243098 - RNA, 21 nt, Homo sapiens
gcccgguggcggcagggccag

SEQ ID NO: 1243099 - RNA, 13 nt, Homo sapiens
gcccguacccagc

SEQ ID NO: 1243100 - RNA, 20 nt, Homo sapiens
gcccgucauguuccucaaaa

SEQ ID NO: 1243101 - RNA, 21 nt, Homo sapiens
gcccgucauguuccucaaaag

SEQ ID NO: 1243102 - RNA, 21 nt, Homo sapiens
gcccuaaccccuuccagauca

SEQ ID NO: 1243103 - RNA, 16 nt, Homo sapiens
gcccuaagggacuuaa

SEQ ID NO: 1243104 - RNA, 13 nt, Homo sapiens
gcccuaaucucac

SEQ ID NO: 1243105 - RNA, 15 nt, Homo sapiens
gcccuacaaaggcua

SEQ ID NO: 1243106 - RNA, 21 nt, Homo sapiens
gcccuaccugauuggugcaac

SEQ ID NO: 1243107 - RNA, 13 nt, Homo sapiens
gcccuacucaccu

SEQ ID NO: 1243108 - RNA, 13 nt, Homo sapiens
gcccuagcauuuc

SEQ ID NO: 1243109 - RNA, 17 nt, Homo sapiens
gcccucaacuauucugu

SEQ ID NO: 1243110 - RNA, 16 nt, Homo sapiens
gcccucaggcaccugc

SEQ ID NO: 1243111 - RNA, 21 nt, Homo sapiens
gcccucaucaucaacgucuca

SEQ ID NO: 1243112 - RNA, 20 nt, Homo sapiens
gcccucauuacugggccuua

SEQ ID NO: 1243113 - RNA, 18 nt, Homo sapiens
gcccuccaaaagcacuua

SEQ ID NO: 1243114 - RNA, 13 nt, Homo sapiens
gcccuccaggcuu

SEQ ID NO: 1243115 - RNA, 19 nt, Homo sapiens
gcccuccccaucccaugua

SEQ ID NO: 1243116 - RNA, 22 nt, Homo sapiens
gcccuccucgggccgaggccca

SEQ ID NO: 1243117 - RNA, 20 nt, Homo sapiens
gcccuccuuugccuuccacc

SEQ ID NO: 1243118 - RNA, 15 nt, Homo sapiens
gcccucggccucuuc

SEQ ID NO: 1243119 - RNA, 17 nt, Homo sapiens
gcccucucauucucacu

SEQ ID NO: 1243120 - RNA, 16 nt, Homo sapiens
gcccucucugcuccuu

SEQ ID NO: 1243121 - RNA, 18 nt, Homo sapiens
gcccucugaacuugccuu

SEQ ID NO: 1243122 - RNA, 19 nt, Homo sapiens
gcccugcagagggaccaga

SEQ ID NO: 1243123 - RNA, 18 nt, Homo sapiens
gcccugcagggaguaccg

SEQ ID NO: 1243124 - RNA, 19 nt, Homo sapiens
gcccugggucuaugcacag

SEQ ID NO: 1243125 - RNA, 16 nt, Homo sapiens
gcccuguuggcagcuc

SEQ ID NO: 1243126 - RNA, 14 nt, Homo sapiens
gcccuuaaggacaa

SEQ ID NO: 1243127 - RNA, 22 nt, Homo sapiens
gcccuuccucacagaguuaaau

SEQ ID NO: 1243128 - RNA, 15 nt, Homo sapiens
gcccuuccugaagaa

SEQ ID NO: 1243129 - RNA, 12 nt, Homo sapiens
gcccuuuccucc

SEQ ID NO: 1243130 - RNA, 16 nt, Homo sapiens
gcccuuuccuuccaga

SEQ ID NO: 1243131 - RNA, 13 nt, Homo sapiens
gccgaagcuacug

SEQ ID NO: 1243132 - RNA, 14 nt, Homo sapiens
gccgacuuggagac

SEQ ID NO: 1243133 - RNA, 20 nt, Homo sapiens
gccgagauugcaccacugca

SEQ ID NO: 1243134 - RNA, 17 nt, Homo sapiens
gccgaggccugcauguc

SEQ ID NO: 1243135 - RNA, 20 nt, Homo sapiens
gccgauaucaacacuuguau

SEQ ID NO: 1243136 - RNA, 11 nt, Homo sapiens
gccgcacuggg

SEQ ID NO: 1243137 - RNA, 16 nt, Homo sapiens
gccgcagacgggcaca

SEQ ID NO: 1243138 - RNA, 17 nt, Homo sapiens
gccgcaggugggugcug

SEQ ID NO: 1243139 - RNA, 18 nt, Homo sapiens
gccgcaguuuggagucac

SEQ ID NO: 1243140 - RNA, 14 nt, Homo sapiens
gccgcaucauggga

SEQ ID NO: 1243141 - RNA, 13 nt, Homo sapiens
gccgcuaccuccc

SEQ ID NO: 1243142 - RNA, 21 nt, Homo sapiens
gccggaaaaggcgcaucuaac

SEQ ID NO: 1243143 - RNA, 22 nt, Homo sapiens
gccggcaaccccaguucugcuc

SEQ ID NO: 1243144 - RNA, 23 nt, Homo sapiens
gccggcaaccccaguucugcucc

SEQ ID NO: 1243145 - RNA, 15 nt, Homo sapiens
gccggcuguggagca

SEQ ID NO: 1243146 - RNA, 22 nt, Homo sapiens
gccgggaaugagcuugugugcc

SEQ ID NO: 1243147 - RNA, 19 nt, Homo sapiens
gccgggcaccaacuccaug

SEQ ID NO: 1243148 - RNA, 14 nt, Homo sapiens
gccgggcgcagugg

SEQ ID NO: 1243149 - RNA, 16 nt, Homo sapiens
gccgggcugacugccc

SEQ ID NO: 1243150 - RNA, 23 nt, Homo sapiens
gccgguccuucccucucaugacu

SEQ ID NO: 1243151 - RNA, 22 nt, Homo sapiens
gccgucuccauggcaucuucgu

SEQ ID NO: 1243152 - RNA, 19 nt, Homo sapiens
gccgugccuucagcucuac

SEQ ID NO: 1243153 - RNA, 20 nt, Homo sapiens
gccuaaaagugggcuugauu

SEQ ID NO: 1243154 - RNA, 21 nt, Homo sapiens
gccuaaaagugggcuugauuc

SEQ ID NO: 1243155 - RNA, 21 nt, Homo sapiens
guauucuuuacuaaagauauc

SEQ ID NO: 1243156 - RNA, 14 nt, Homo sapiens
guauugaucaaugc

SEQ ID NO: 1243157 - RNA, 19 nt, Homo sapiens
guauuuauuacaacucuau

SEQ ID NO: 1243158 - RNA, 21 nt, Homo sapiens
guauuucaacugaaguucuau

SEQ ID NO: 1243159 - RNA, 17 nt, Homo sapiens
guauuucuccuuugcaa

SEQ ID NO: 1243160 - RNA, 21 nt, Homo sapiens
guauuuguauuaauaaagcau

SEQ ID NO: 1243161 - RNA, 22 nt, Homo sapiens
guauuuuccaacuuguucaaau

SEQ ID NO: 1243162 - RNA, 12 nt, Homo sapiens
guauuuuugccg

SEQ ID NO: 1243163 - RNA, 20 nt, Homo sapiens
guauuuuugccggcugguga

SEQ ID NO: 1243164 - RNA, 16 nt, Homo sapiens
gucaaaaggacauuua

SEQ ID NO: 1243165 - RNA, 22 nt, Homo sapiens
gucaaaauaaaggauaacucug

SEQ ID NO: 1243166 - RNA, 18 nt, Homo sapiens
gucaaagaagucauucuu

SEQ ID NO: 1243167 - RNA, 13 nt, Homo sapiens
gucaaagacugua

SEQ ID NO: 1243168 - RNA, 17 nt, Homo sapiens
gucaaagugaugaauau

SEQ ID NO: 1243169 - RNA, 16 nt, Homo sapiens
gucaaauuuacauuua

SEQ ID NO: 1243170 - RNA, 15 nt, Homo sapiens
gucaacaacuuacac

SEQ ID NO: 1243171 - RNA, 21 nt, Homo sapiens
gucaaccuuguuucuacuguu

SEQ ID NO: 1243172 - RNA, 22 nt, Homo sapiens
gucaacuucagagacuaucuga

SEQ ID NO: 1243173 - RNA, 23 nt, Homo sapiens
gucaacuucuggcuccucaaaca

SEQ ID NO: 1243174 - RNA, 20 nt, Homo sapiens
gucaagaagaggaaagggag

SEQ ID NO: 1243175 - RNA, 13 nt, Homo sapiens
gucaagcaccugc

SEQ ID NO: 1243176 - RNA, 20 nt, Homo sapiens
gucaaggcaguagaacucca

SEQ ID NO: 1243177 - RNA, 18 nt, Homo sapiens
gucaagguuuguguuacc

SEQ ID NO: 1243178 - RNA, 19 nt, Homo sapiens
gucaauaaaaccacuguac

SEQ ID NO: 1243179 - RNA, 21 nt, Homo sapiens
gucaauauuaaauacagacac

SEQ ID NO: 1243180 - RNA, 14 nt, Homo sapiens
gucaaugugcagug

SEQ ID NO: 1243181 - RNA, 21 nt, Homo sapiens
gucacagggccaacuugaggg

SEQ ID NO: 1243182 - RNA, 13 nt, Homo sapiens
gucacaugaccca

SEQ ID NO: 1243183 - RNA, 22 nt, Homo sapiens
gucaccaaaucagcugcuacua

SEQ ID NO: 1243184 - RNA, 16 nt, Homo sapiens
gucaccacgacuggcc

SEQ ID NO: 1243185 - RNA, 20 nt, Homo sapiens
gucacccuuggacaagacaa

SEQ ID NO: 1243186 - RNA, 19 nt, Homo sapiens
gucaccggccgauggagac

SEQ ID NO: 1243187 - RNA, 12 nt, Homo sapiens
gucacguguauu

SEQ ID NO: 1243188 - RNA, 19 nt, Homo sapiens
gucacguuaccauuuacau

SEQ ID NO: 1243189 - RNA, 16 nt, Homo sapiens
gucacuaaacucucau

SEQ ID NO: 1243190 - RNA, 14 nt, Homo sapiens
gucacuagucucac

SEQ ID NO: 1243191 - RNA, 20 nt, Homo sapiens
gucacucauuuacguaaaaa

SEQ ID NO: 1243192 - RNA, 19 nt, Homo sapiens
gucacugauacacagaaua

SEQ ID NO: 1243193 - RNA, 16 nt, Homo sapiens
gucacugcugucauca

SEQ ID NO: 1243194 - RNA, 16 nt, Homo sapiens
gucacuggcaucucac

SEQ ID NO: 1243195 - RNA, 16 nt, Homo sapiens
gucacuggcucuccaa

SEQ ID NO: 1243196 - RNA, 23 nt, Homo sapiens
gucacuguuuuuuucccaggugu

SEQ ID NO: 1243197 - RNA, 22 nt, Homo sapiens
gucacuuuuuaaaccacuguau

SEQ ID NO: 1243198 - RNA, 15 nt, Homo sapiens
gucagacagauguca

SEQ ID NO: 1243199 - RNA, 23 nt, Homo sapiens
gucagauaggacaacacugcugg

SEQ ID NO: 1243200 - RNA, 22 nt, Homo sapiens
gucagauguacauagagaucua

SEQ ID NO: 1243201 - RNA, 20 nt, Homo sapiens
gucagcccaugugcaccugc

SEQ ID NO: 1243202 - RNA, 20 nt, Homo sapiens
gucagcguugcaugucguga

SEQ ID NO: 1243203 - RNA, 13 nt, Homo sapiens
gucagcuguuacu

SEQ ID NO: 1243204 - RNA, 21 nt, Homo sapiens
gucagcuuuuugauccucuac

SEQ ID NO: 1243205 - RNA, 15 nt, Homo sapiens
gucaggcccagagaa

SEQ ID NO: 1243206 - RNA, 16 nt, Homo sapiens
gucagggccagacugg

SEQ ID NO: 1243207 - RNA, 17 nt, Homo sapiens
gucagggguuucuucaa

SEQ ID NO: 1243208 - RNA, 15 nt, Homo sapiens
gucagguucuuuaca

SEQ ID NO: 1243209 - RNA, 16 nt, Homo sapiens
gucagguucuuuacaa

SEQ ID NO: 1243210 - RNA, 19 nt, Homo sapiens
gucagucucuuucuguaca

SEQ ID NO: 1243211 - RNA, 18 nt, Homo sapiens
gucagugguggucuucaa

SEQ ID NO: 1243212 - RNA, 15 nt, Homo sapiens
gucaguuagcaucau

SEQ ID NO: 1243213 - RNA, 18 nt, Homo sapiens
gucauaccuuuggauuua

SEQ ID NO: 1243214 - RNA, 10 nt, Homo sapiens
gucauagaaa

SEQ ID NO: 1243215 - RNA, 21 nt, Homo sapiens
gucaucaaauauuaccaaaaa

SEQ ID NO: 1243216 - RNA, 19 nt, Homo sapiens
gucaucaacaauuugacca

SEQ ID NO: 1243217 - RNA, 17 nt, Homo sapiens
gucaucaggugcauagc

SEQ ID NO: 1243218 - RNA, 17 nt, Homo sapiens
gucaucccagugcacau

SEQ ID NO: 1243219 - RNA, 14 nt, Homo sapiens
gucauccucuggaa

SEQ ID NO: 1243220 - RNA, 22 nt, Homo sapiens
gucaucgggaggagcagccuga

SEQ ID NO: 1243221 - RNA, 17 nt, Homo sapiens
gucaugaggacaccaaa

SEQ ID NO: 1243222 - RNA, 16 nt, Homo sapiens
gucaugcuucaucauu

SEQ ID NO: 1243223 - RNA, 19 nt, Homo sapiens
gucauggaauggcaggugu

SEQ ID NO: 1243224 - RNA, 21 nt, Homo sapiens
gucauguuugcaggggugacg

SEQ ID NO: 1243225 - RNA, 15 nt, Homo sapiens
gucauuauauucuaa

SEQ ID NO: 1243226 - RNA, 13 nt, Homo sapiens
gucauuguauuca

SEQ ID NO: 1243227 - RNA, 23 nt, Homo sapiens
gucauuuauucaaguauugagaa

SEQ ID NO: 1243228 - RNA, 13 nt, Homo sapiens
guccaaaacugcc

SEQ ID NO: 1243229 - RNA, 21 nt, Homo sapiens
guccaacaaaccacacacagu

SEQ ID NO: 1243230 - RNA, 17 nt, Homo sapiens
guccaagagacauggaa

SEQ ID NO: 1243231 - RNA, 21 nt, Homo sapiens
guccaagccccccacaccuuu

SEQ ID NO: 1243232 - RNA, 13 nt, Homo sapiens
guccaagucuucu

SEQ ID NO: 1243233 - RNA, 14 nt, Homo sapiens
guccacacaucucc

SEQ ID NO: 1243234 - RNA, 13 nt, Homo sapiens
guccacacccagc

SEQ ID NO: 1243235 - RNA, 10 nt, Homo sapiens
guccacaggg

SEQ ID NO: 1243236 - RNA, 18 nt, Homo sapiens
guccacagggcagccuga

SEQ ID NO: 1243237 - RNA, 12 nt, Homo sapiens
guggccucagaa

SEQ ID NO: 1243238 - RNA, 16 nt, Homo sapiens
guggcggcagggccag

SEQ ID NO: 1243239 - RNA, 16 nt, Homo sapiens
guggcucaacauugug

SEQ ID NO: 1243240 - RNA, 14 nt, Homo sapiens
guggcuccuaucug

SEQ ID NO: 1243241 - RNA, 23 nt, Homo sapiens
guggcuuagaaaguccaauucca

SEQ ID NO: 1243242 - RNA, 22 nt, Homo sapiens
guggcuucacagacccacaaga

SEQ ID NO: 1243243 - RNA, 20 nt, Homo sapiens
gugggaaaaaaaugaaugag

SEQ ID NO: 1243244 - RNA, 13 nt, Homo sapiens
gugggaacucuga

SEQ ID NO: 1243245 - RNA, 15 nt, Homo sapiens
gugggagaaggacua

SEQ ID NO: 1243246 - RNA, 21 nt, Homo sapiens
gugggagcagcgguuugggga

SEQ ID NO: 1243247 - RNA, 16 nt, Homo sapiens
gugggagggacuuugc

SEQ ID NO: 1243248 - RNA, 17 nt, Homo sapiens
gugggauaucacuucca

SEQ ID NO: 1243249 - RNA, 17 nt, Homo sapiens
gugggcagagccuucca

SEQ ID NO: 1243250 - RNA, 18 nt, Homo sapiens
gugggcagagccuuccac

SEQ ID NO: 1243251 - RNA, 15 nt, Homo sapiens
gugggcagguggugg

SEQ ID NO: 1243252 - RNA, 12 nt, Homo sapiens
gugggcugugag

SEQ ID NO: 1243253 - RNA, 20 nt, Homo sapiens
guggggauggggccucccuc

SEQ ID NO: 1243254 - RNA, 15 nt, Homo sapiens
guggggcauguccuc

SEQ ID NO: 1243255 - RNA, 19 nt, Homo sapiens
guggggccuguggaaugag

SEQ ID NO: 1243256 - RNA, 20 nt, Homo sapiens
guggggggugacagugccuu

SEQ ID NO: 1243257 - RNA, 21 nt, Homo sapiens
guggggguaaggugcaucugu

SEQ ID NO: 1243258 - RNA, 21 nt, Homo sapiens
gugggguaaccaaauguuggc

SEQ ID NO: 1243259 - RNA, 18 nt, Homo sapiens
guggguacaaaaagucaa

SEQ ID NO: 1243260 - RNA, 19 nt, Homo sapiens
gugggucuguguggcagga

SEQ ID NO: 1243261 - RNA, 19 nt, Homo sapiens
gugggugaaacagaacaau

SEQ ID NO: 1243262 - RNA, 22 nt, Homo sapiens
gugguaaaaccuguucuccaua

SEQ ID NO: 1243263 - RNA, 13 nt, Homo sapiens
gugguaugugaca

SEQ ID NO: 1243264 - RNA, 22 nt, Homo sapiens
guggucccucugugucugcucu

SEQ ID NO: 1243265 - RNA, 22 nt, Homo sapiens
guggucuaagguucagccugaa

SEQ ID NO: 1243266 - RNA, 17 nt, Homo sapiens
guggucugagccaaaga

SEQ ID NO: 1243267 - RNA, 18 nt, Homo sapiens
gugguggagaaccacagc

SEQ ID NO: 1243268 - RNA, 22 nt, Homo sapiens
gugguguuuucagggcacugug

SEQ ID NO: 1243269 - RNA, 14 nt, Homo sapiens
gugguuccaugcag

SEQ ID NO: 1243270 - RNA, 17 nt, Homo sapiens
gugguuccucugcucac

SEQ ID NO: 1243271 - RNA, 13 nt, Homo sapiens
gugguuccuuugc

SEQ ID NO: 1243272 - RNA, 15 nt, Homo sapiens
gugguuguuuuguca

SEQ ID NO: 1243273 - RNA, 20 nt, Homo sapiens
gugguuuccacaugcucuga

SEQ ID NO: 1243274 - RNA, 15 nt, Homo sapiens
guuaguuaaaagccc

SEQ ID NO: 1243275 - RNA, 23 nt, Homo sapiens
guuauaaaucaaugucacuuaaa

SEQ ID NO: 1243276 - RNA, 21 nt, Homo sapiens
guuauaacucugcacuacucc

SEQ ID NO: 1243277 - RNA, 19 nt, Homo sapiens
guuauacuuauuuguauau

SEQ ID NO: 1243278 - RNA, 17 nt, Homo sapiens
guuauaucauauguaua

SEQ ID NO: 1243279 - RNA, 14 nt, Homo sapiens
guuaucaguuaaca

SEQ ID NO: 1243280 - RNA, 16 nt, Homo sapiens
guuauccccuccuuua

SEQ ID NO: 1243281 - RNA, 20 nt, Homo sapiens
guuaucugucugcauuuuaa

SEQ ID NO: 1243282 - RNA, 14 nt, Homo sapiens
guuaugacagccau

SEQ ID NO: 1243283 - RNA, 17 nt, Homo sapiens
guuauggcuuaaaagca

SEQ ID NO: 1243284 - RNA, 18 nt, Homo sapiens
guuaugggcacaugccuu

SEQ ID NO: 1243285 - RNA, 16 nt, Homo sapiens
guuauugcacaaguuc

SEQ ID NO: 1243286 - RNA, 19 nt, Homo sapiens
guuauugccucugaaaugc

SEQ ID NO: 1243287 - RNA, 13 nt, Homo sapiens
guuauuugcacac

SEQ ID NO: 1243288 - RNA, 19 nt, Homo sapiens
guuauuuugcuauuugccu

SEQ ID NO: 1243289 - RNA, 15 nt, Homo sapiens
guucaaaacauucca

SEQ ID NO: 1243290 - RNA, 20 nt, Homo sapiens
guucaaaaccuugcacaggu

SEQ ID NO: 1243291 - RNA, 18 nt, Homo sapiens
guucaagacuuagcuccu

SEQ ID NO: 1243292 - RNA, 14 nt, Homo sapiens
guucaauacaguga

SEQ ID NO: 1243293 - RNA, 23 nt, Homo sapiens
guucaauucucauuugucacaca

SEQ ID NO: 1243294 - RNA, 16 nt, Homo sapiens
guucacaaacuaccuc

SEQ ID NO: 1243295 - RNA, 15 nt, Homo sapiens
guucacacaaagccu

SEQ ID NO: 1243296 - RNA, 19 nt, Homo sapiens
guucacacucagaacccag

SEQ ID NO: 1243297 - RNA, 13 nt, Homo sapiens
guucacacuuugc

SEQ ID NO: 1243298 - RNA, 22 nt, Homo sapiens
guucagaguuguacacugugua

SEQ ID NO: 1243299 - RNA, 16 nt, Homo sapiens
guucagcuucagacuu

SEQ ID NO: 1243300 - RNA, 20 nt, Homo sapiens
guucaggaguuggagaccag

SEQ ID NO: 1243301 - RNA, 13 nt, Homo sapiens
guucagugaccug

SEQ ID NO: 1243302 - RNA, 20 nt, Homo sapiens
guucagugagguucuugggu

SEQ ID NO: 1243303 - RNA, 15 nt, Homo sapiens
guucaugugccucug

SEQ ID NO: 1243304 - RNA, 16 nt, Homo sapiens
guucauguuugcuuca

SEQ ID NO: 1243305 - RNA, 12 nt, Homo sapiens
guucauguuugg

SEQ ID NO: 1243306 - RNA, 19 nt, Homo sapiens
guucauuacuuuuucauau

SEQ ID NO: 1243307 - RNA, 16 nt, Homo sapiens
guucauuauguaugaa

SEQ ID NO: 1243308 - RNA, 18 nt, Homo sapiens
guucauuugugugcucau

SEQ ID NO: 1243309 - RNA, 17 nt, Homo sapiens
guuccaaagccagugaa

SEQ ID NO: 1243310 - RNA, 13 nt, Homo sapiens
uaaucccaccacc

SEQ ID NO: 1243311 - RNA, 13 nt, Homo sapiens
uaaucccagcacu

SEQ ID NO: 1243312 - RNA, 18 nt, Homo sapiens
uaaucccagcacuuugau

SEQ ID NO: 1243313 - RNA, 19 nt, Homo sapiens
uaaucccaguacuugggag

SEQ ID NO: 1243314 - RNA, 13 nt, Homo sapiens
uaauccuaucugg

SEQ ID NO: 1243315 - RNA, 15 nt, Homo sapiens
uaauccuucuggcaa

SEQ ID NO: 1243316 - RNA, 19 nt, Homo sapiens
uaaucggcuugaauuuuga

SEQ ID NO: 1243317 - RNA, 14 nt, Homo sapiens
uaaucuaguuuuau

SEQ ID NO: 1243318 - RNA, 22 nt, Homo sapiens
uaaucuccucagacaguaacca

SEQ ID NO: 1243319 - RNA, 21 nt, Homo sapiens
uaaucucuguuauguacugua

SEQ ID NO: 1243320 - RNA, 14 nt, Homo sapiens
uaaucugaaauucu

SEQ ID NO: 1243321 - RNA, 16 nt, Homo sapiens
uaaucuggacuccucu

SEQ ID NO: 1243322 - RNA, 22 nt, Homo sapiens
uaaucuggacuccucuguccag

SEQ ID NO: 1243323 - RNA, 16 nt, Homo sapiens
uaaucuuagagacaaa

SEQ ID NO: 1243324 - RNA, 19 nt, Homo sapiens
uaaucuuauuuauaccuca

SEQ ID NO: 1243325 - RNA, 15 nt, Homo sapiens
uaaugaaaaugaaua

SEQ ID NO: 1243326 - RNA, 23 nt, Homo sapiens
uaaugaaaaugaauaucuauuaa

SEQ ID NO: 1243327 - RNA, 22 nt, Homo sapiens
uaaugaaauaauguacaucugg

SEQ ID NO: 1243328 - RNA, 18 nt, Homo sapiens
uaaugacaaaggcacuga

SEQ ID NO: 1243329 - RNA, 14 nt, Homo sapiens
uaaugacaacacuu

SEQ ID NO: 1243330 - RNA, 12 nt, Homo sapiens
uaaugacacucc

SEQ ID NO: 1243331 - RNA, 13 nt, Homo sapiens
uaaugacauuccc

SEQ ID NO: 1243332 - RNA, 16 nt, Homo sapiens
uaaugagacugaccau

SEQ ID NO: 1243333 - RNA, 16 nt, Homo sapiens
uaaugagccaucacua

SEQ ID NO: 1243334 - RNA, 16 nt, Homo sapiens
uaaugagggugugaga

SEQ ID NO: 1243335 - RNA, 16 nt, Homo sapiens
uaaugaucaaaacaug

SEQ ID NO: 1243336 - RNA, 15 nt, Homo sapiens
uaaugaucaacaauu

SEQ ID NO: 1243337 - RNA, 20 nt, Homo sapiens
uaaugccuuuucucaccugu

SEQ ID NO: 1243338 - RNA, 15 nt, Homo sapiens
uaaugcuuuguuaaa

SEQ ID NO: 1243339 - RNA, 21 nt, Homo sapiens
uacaguuaauuaugugcauau

SEQ ID NO: 1243340 - RNA, 20 nt, Homo sapiens
uacaguuaggcaccagaaga

SEQ ID NO: 1243341 - RNA, 16 nt, Homo sapiens
uacaguuugcuguacu

SEQ ID NO: 1243342 - RNA, 17 nt, Homo sapiens
uacauaacuaaauuuga

SEQ ID NO: 1243343 - RNA, 19 nt, Homo sapiens
uacauaauugcuguucugc

SEQ ID NO: 1243344 - RNA, 15 nt, Homo sapiens
uacauauauauguca

SEQ ID NO: 1243345 - RNA, 17 nt, Homo sapiens
uacauauauaugucagg

SEQ ID NO: 1243346 - RNA, 13 nt, Homo sapiens
uacauaugugcug

SEQ ID NO: 1243347 - RNA, 18 nt, Homo sapiens
uacauauguuuaucucac

SEQ ID NO: 1243348 - RNA, 13 nt, Homo sapiens
uacauauuaucuc

SEQ ID NO: 1243349 - RNA, 15 nt, Homo sapiens
uacauauuaucucau

SEQ ID NO: 1243350 - RNA, 13 nt, Homo sapiens
uacaucaaagagu

SEQ ID NO: 1243351 - RNA, 16 nt, Homo sapiens
uacaucccagccugug

SEQ ID NO: 1243352 - RNA, 16 nt, Homo sapiens
uacaucuagcaauuuc

SEQ ID NO: 1243353 - RNA, 11 nt, Homo sapiens
uacaugacugg

SEQ ID NO: 1243354 - RNA, 20 nt, Homo sapiens
uacaugagaaagaugucuau

SEQ ID NO: 1243355 - RNA, 18 nt, Homo sapiens
uacaugcagcccaugccc

SEQ ID NO: 1243356 - RNA, 14 nt, Homo sapiens
uacaugccaugacc

SEQ ID NO: 1243357 - RNA, 19 nt, Homo sapiens
uacaugccucagugaagga

SEQ ID NO: 1243358 - RNA, 16 nt, Homo sapiens
uacaugcuggggucaa

SEQ ID NO: 1243359 - RNA, 11 nt, Homo sapiens
uacauggaaua

SEQ ID NO: 1243360 - RNA, 16 nt, Homo sapiens
uacauguaauuugaug

SEQ ID NO: 1243361 - RNA, 18 nt, Homo sapiens
uacaugucuacaugccau

SEQ ID NO: 1243362 - RNA, 16 nt, Homo sapiens
uacauguguagccugu

SEQ ID NO: 1243363 - RNA, 14 nt, Homo sapiens
uacauguguguaua

SEQ ID NO: 1243364 - RNA, 11 nt, Homo sapiens
uacauguuaag

SEQ ID NO: 1243365 - RNA, 15 nt, Homo sapiens
uacauuaauuaccuu

SEQ ID NO: 1243366 - RNA, 22 nt, Homo sapiens
uacauucugcaagcacaucugc

SEQ ID NO: 1243367 - RNA, 13 nt, Homo sapiens
uacauuuaugcac

SEQ ID NO: 1243368 - RNA, 17 nt, Homo sapiens
uacauuucaccuacuuu

SEQ ID NO: 1243369 - RNA, 14 nt, Homo sapiens
uacauuucugcaga

SEQ ID NO: 1243370 - RNA, 18 nt, Homo sapiens
uacauuucuuagacuaca

SEQ ID NO: 1243371 - RNA, 19 nt, Homo sapiens
uacauuuggccucugcccu

SEQ ID NO: 1243372 - RNA, 19 nt, Homo sapiens
uacauuuuauuaagcuuuu

SEQ ID NO: 1243373 - RNA, 19 nt, Homo sapiens
uacauuuuuuaacuuucua

SEQ ID NO: 1243374 - RNA, 22 nt, Homo sapiens
uacauuuuuuucuuugucuuau

SEQ ID NO: 1243375 - RNA, 19 nt, Homo sapiens
uaccaaagcaucaauacaa

SEQ ID NO: 1243376 - RNA, 22 nt, Homo sapiens
uaccaaagccaauaaaugaacu

SEQ ID NO: 1243377 - RNA, 17 nt, Homo sapiens
uaccaaccugaagacac

SEQ ID NO: 1243378 - RNA, 12 nt, Homo sapiens
uaccaacuuuac

SEQ ID NO: 1243379 - RNA, 14 nt, Homo sapiens
uaccaaucucugaa

SEQ ID NO: 1243380 - RNA, 18 nt, Homo sapiens
uaccacaagccugagaac

SEQ ID NO: 1243381 - RNA, 9 nt, Homo sapiens
uaccacagc

SEQ ID NO: 1243382 - RNA, 16 nt, Homo sapiens
uaccacaguguuuuau

SEQ ID NO: 1243383 - RNA, 21 nt, Homo sapiens
uaccaccaagggaucugccau

SEQ ID NO: 1243384 - RNA, 16 nt, Homo sapiens
uaccacgggucugcca

SEQ ID NO: 1243385 - RNA, 20 nt, Homo sapiens
uaccacucuuuaccuuuauu

SEQ ID NO: 1243386 - RNA, 14 nt, Homo sapiens
uaccacugcacugu

SEQ ID NO: 1243387 - RNA, 13 nt, Homo sapiens
uaccagaugcuac

SEQ ID NO: 1243388 - RNA, 17 nt, Homo sapiens
uaccagggauguagauu

SEQ ID NO: 1243389 - RNA, 18 nt, Homo sapiens
uaccagguccauuuugcc

SEQ ID NO: 1243390 - RNA, 23 nt, Homo sapiens
uaccaguuuguccaucuugagau

SEQ ID NO: 1243391 - RNA, 15 nt, Homo sapiens
uaccaucugcaucca

SEQ ID NO: 1243392 - RNA, 23 nt, Homo sapiens
uaccaucuuguauacacauauau

SEQ ID NO: 1243393 - RNA, 12 nt, Homo sapiens
uaccaugcugaa

SEQ ID NO: 1243394 - RNA, 13 nt, Homo sapiens
uaccaugcugcuu

SEQ ID NO: 1243395 - RNA, 21 nt, Homo sapiens
uaccauuugcuacuguacaua

SEQ ID NO: 1243396 - RNA, 22 nt, Homo sapiens
uacccacugaagcccauuucuc

SEQ ID NO: 1243397 - RNA, 14 nt, Homo sapiens
uacccagaauguca

SEQ ID NO: 1243398 - RNA, 17 nt, Homo sapiens
uacccaucuaguacuug

SEQ ID NO: 1243399 - RNA, 20 nt, Homo sapiens
uaccccagacuagauguagu

SEQ ID NO: 1243400 - RNA, 19 nt, Homo sapiens
uacccgagaagcacuugag

SEQ ID NO: 1243401 - RNA, 17 nt, Homo sapiens
uacccgugccugagaaa

SEQ ID NO: 1243402 - RNA, 16 nt, Homo sapiens
uacccuauacauccac

SEQ ID NO: 1243403 - RNA, 11 nt, Homo sapiens
uacccucucag

SEQ ID NO: 1243404 - RNA, 18 nt, Homo sapiens
uacccugcgauuuugccu

SEQ ID NO: 1243405 - RNA, 20 nt, Homo sapiens
uacccuuacucugccagagu

SEQ ID NO: 1243406 - RNA, 18 nt, Homo sapiens
uacccuuuagacuguagc

SEQ ID NO: 1243407 - RNA, 21 nt, Homo sapiens
uaccgaguucaagugauuuuc

SEQ ID NO: 1243408 - RNA, 22 nt, Homo sapiens
uaccgauguuaauuauuuugac

SEQ ID NO: 1243409 - RNA, 14 nt, Homo sapiens
uaccuaaugucuca

SEQ ID NO: 1243410 - RNA, 14 nt, Homo sapiens
uaccuaguuugcac

SEQ ID NO: 1243411 - RNA, 16 nt, Homo sapiens
uaccuaguuugcacua

SEQ ID NO: 1243412 - RNA, 17 nt, Homo sapiens
uaccucaagggggacug

SEQ ID NO: 1243413 - RNA, 12 nt, Homo sapiens
uaccucacuuua

SEQ ID NO: 1243414 - RNA, 11 nt, Homo sapiens
uaccucagcuu

SEQ ID NO: 1243415 - RNA, 13 nt, Homo sapiens
uaccucagguugc

SEQ ID NO: 1243416 - RNA, 20 nt, Homo sapiens
uaccuccuuagcuuucccug

SEQ ID NO: 1243417 - RNA, 22 nt, Homo sapiens
uaccucugcuauuugcuguuau

SEQ ID NO: 1243418 - RNA, 18 nt, Homo sapiens
uaccucuucucucucagu

SEQ ID NO: 1243419 - RNA, 16 nt, Homo sapiens
uaccucuuucaggguu

SEQ ID NO: 1243420 - RNA, 19 nt, Homo sapiens
uaccugagauggaggaguc

SEQ ID NO: 1243421 - RNA, 20 nt, Homo sapiens
uaccuggauguucuuuuuac

SEQ ID NO: 1243422 - RNA, 18 nt, Homo sapiens
uaccuggcucugcuucca

SEQ ID NO: 1243423 - RNA, 21 nt, Homo sapiens
uaccugggcauucuuguuuca

SEQ ID NO: 1243424 - RNA, 11 nt, Homo sapiens
uaccuguguac

SEQ ID NO: 1243425 - RNA, 21 nt, Homo sapiens
uaccuuaagauuuuucuuuuc

SEQ ID NO: 1243426 - RNA, 22 nt, Homo sapiens
uaccuuccccacaucugagaga

SEQ ID NO: 1243427 - RNA, 19 nt, Homo sapiens
uaccuuccuuaagccagga

SEQ ID NO: 1243428 - RNA, 17 nt, Homo sapiens
uaccuugagccaguaau

SEQ ID NO: 1243429 - RNA, 16 nt, Homo sapiens
uacgaagacaaagucc

SEQ ID NO: 1243430 - RNA, 21 nt, Homo sapiens
uacgacuuauuuuguugaaau

SEQ ID NO: 1243431 - RNA, 13 nt, Homo sapiens
uacgauuguguau

SEQ ID NO: 1243432 - RNA, 15 nt, Homo sapiens
uacgcacguggagcu

SEQ ID NO: 1243433 - RNA, 16 nt, Homo sapiens
uacgcacguggagcug

SEQ ID NO: 1243434 - RNA, 14 nt, Homo sapiens
uacggcccaugcaa

SEQ ID NO: 1243435 - RNA, 13 nt, Homo sapiens
uacggcuaccugg

SEQ ID NO: 1243436 - RNA, 23 nt, Homo sapiens
uacguauuuuuucuaaugugcau

SEQ ID NO: 1243437 - RNA, 16 nt, Homo sapiens
uacuaaaaauacagaa

SEQ ID NO: 1243438 - RNA, 17 nt, Homo sapiens
uacuaaauuacaaaugc

SEQ ID NO: 1243439 - RNA, 19 nt, Homo sapiens
uacuaacauuuucauugau

SEQ ID NO: 1243440 - RNA, 14 nt, Homo sapiens
uacucuccuagaga

SEQ ID NO: 1243441 - RNA, 18 nt, Homo sapiens
uacucugaaauuggucac

SEQ ID NO: 1243442 - RNA, 14 nt, Homo sapiens
uacucugcagugau

SEQ ID NO: 1243443 - RNA, 13 nt, Homo sapiens
uacucugccagag

SEQ ID NO: 1243444 - RNA, 19 nt, Homo sapiens
uacucuucuuacuggugcu

SEQ ID NO: 1243445 - RNA, 16 nt, Homo sapiens
uacucuugaugugaag

SEQ ID NO: 1243446 - RNA, 17 nt, Homo sapiens
uacugaaccacucuccc

SEQ ID NO: 1243447 - RNA, 20 nt, Homo sapiens
uacugaaucugcuaccaaaa

SEQ ID NO: 1243448 - RNA, 22 nt, Homo sapiens
uacugaaucuucaagaccaaag

SEQ ID NO: 1243449 - RNA, 13 nt, Homo sapiens
uacugaccagcaa

SEQ ID NO: 1243450 - RNA, 13 nt, Homo sapiens
uacugacuugagg

SEQ ID NO: 1243451 - RNA, 16 nt, Homo sapiens
uacugauaauuuugcu

SEQ ID NO: 1243452 - RNA, 16 nt, Homo sapiens
uacugauucacugcau

SEQ ID NO: 1243453 - RNA, 17 nt, Homo sapiens
uacugcaauauuuggau

SEQ ID NO: 1243454 - RNA, 22 nt, Homo sapiens
uacugcacccagcagugucacu

SEQ ID NO: 1243455 - RNA, 16 nt, Homo sapiens
uacugcagcaccucca

SEQ ID NO: 1243456 - RNA, 14 nt, Homo sapiens
uacugcggaccaag

SEQ ID NO: 1243457 - RNA, 19 nt, Homo sapiens
uacugcuaucuacuacaaa

SEQ ID NO: 1243458 - RNA, 18 nt, Homo sapiens
uacugcuugaccaaagag

SEQ ID NO: 1243459 - RNA, 22 nt, Homo sapiens
uacuggaagcugcagaucuuug

SEQ ID NO: 1243460 - RNA, 14 nt, Homo sapiens
uacuggaaggcuuc

SEQ ID NO: 1243461 - RNA, 22 nt, Homo sapiens
uacugggacaccauuaccaaaa

SEQ ID NO: 1243462 - RNA, 22 nt, Homo sapiens
uacuguaaagagaccuaccuca

SEQ ID NO: 1243463 - RNA, 16 nt, Homo sapiens
uacuguaaaugcauug

SEQ ID NO: 1243464 - RNA, 21 nt, Homo sapiens
uacuguacccucgcaugacug

SEQ ID NO: 1243465 - RNA, 22 nt, Homo sapiens
uacuguacccucgcaugacugu

SEQ ID NO: 1243466 - RNA, 13 nt, Homo sapiens
uacuguacuuaau

SEQ ID NO: 1243467 - RNA, 15 nt, Homo sapiens
uacuguaugccuuca

SEQ ID NO: 1243468 - RNA, 15 nt, Homo sapiens
uacugucucuggcau

SEQ ID NO: 1243469 - RNA, 22 nt, Homo sapiens
uacugucugggauuaagggcaa

SEQ ID NO: 1243470 - RNA, 21 nt, Homo sapiens
uacugucuuacuauuauagca

SEQ ID NO: 1243471 - RNA, 13 nt, Homo sapiens
uacuguucuugcu

SEQ ID NO: 1243472 - RNA, 15 nt, Homo sapiens
uacuguucuugcugc

SEQ ID NO: 1243473 - RNA, 15 nt, Homo sapiens
uacuguugcacugau

SEQ ID NO: 1243474 - RNA, 19 nt, Homo sapiens
uacuguugcccauugcacu

SEQ ID NO: 1243475 - RNA, 15 nt, Homo sapiens
uacuguuuuaauugu

SEQ ID NO: 1243476 - RNA, 14 nt, Homo sapiens
uacuuaaacuucca

SEQ ID NO: 1243477 - RNA, 16 nt, Homo sapiens
uacuuaauaaacugug

SEQ ID NO: 1243478 - RNA, 16 nt, Homo sapiens
uacuuaauacuaggau

SEQ ID NO: 1243479 - RNA, 16 nt, Homo sapiens
uacuuaccauuugcua

SEQ ID NO: 1243480 - RNA, 14 nt, Homo sapiens
uacuuacuccccac

SEQ ID NO: 1243481 - RNA, 18 nt, Homo sapiens
uacuuagcaugcacaaag

SEQ ID NO: 1243482 - RNA, 17 nt, Homo sapiens
uacuuauucuagauuac

SEQ ID NO: 1243483 - RNA, 20 nt, Homo sapiens
uacuuauuguauuuaugugu

SEQ ID NO: 1243484 - RNA, 19 nt, Homo sapiens
uacuucaaccagccuacaa

SEQ ID NO: 1243485 - RNA, 18 nt, Homo sapiens
uacuucaucauuuugaca

SEQ ID NO: 1243486 - RNA, 17 nt, Homo sapiens
uacuucauggacuucca

SEQ ID NO: 1243487 - RNA, 16 nt, Homo sapiens
uacuucauggugauag

SEQ ID NO: 1243488 - RNA, 15 nt, Homo sapiens
uacuucccucaggcc

SEQ ID NO: 1243489 - RNA, 14 nt, Homo sapiens
uacuuccugauuag

SEQ ID NO: 1243490 - RNA, 12 nt, Homo sapiens
uacuucucacca

SEQ ID NO: 1243491 - RNA, 14 nt, Homo sapiens
uacuucuccacugu

SEQ ID NO: 1243492 - RNA, 20 nt, Homo sapiens
uacuucuggaagucaucuca

SEQ ID NO: 1243493 - RNA, 18 nt, Homo sapiens
uacuucuuauacauuuga

SEQ ID NO: 1243494 - RNA, 16 nt, Homo sapiens
uacuucuugaauauaa

SEQ ID NO: 1243495 - RNA, 20 nt, Homo sapiens
uacuugacuugaaugugcac

SEQ ID NO: 1243496 - RNA, 15 nt, Homo sapiens
uacuugcuucucuag

SEQ ID NO: 1243497 - RNA, 21 nt, Homo sapiens
uacuugcuuucaauugacaaa

SEQ ID NO: 1243498 - RNA, 14 nt, Homo sapiens
uacuuguuccagau

SEQ ID NO: 1243499 - RNA, 18 nt, Homo sapiens
uacuuuacagacaggaaa

SEQ ID NO: 1243500 - RNA, 16 nt, Homo sapiens
uacuuuaugaugcuau

SEQ ID NO: 1243501 - RNA, 17 nt, Homo sapiens
uacuuuaugaugcuaug

SEQ ID NO: 1243502 - RNA, 20 nt, Homo sapiens
uacuuuauuucugaucuaua

SEQ ID NO: 1243503 - RNA, 16 nt, Homo sapiens
uacuuucgaaauuuca

SEQ ID NO: 1243504 - RNA, 20 nt, Homo sapiens
uacuuucucuagggagaaaa

SEQ ID NO: 1243505 - RNA, 17 nt, Homo sapiens
uacuuucuguugccaca

SEQ ID NO: 1243506 - RNA, 18 nt, Homo sapiens
uacuuugauaucugauca

SEQ ID NO: 1243507 - RNA, 22 nt, Homo sapiens
uacuuugguuucugucuguaag

SEQ ID NO: 1243508 - RNA, 18 nt, Homo sapiens
uacuuuguaaauaggauu

SEQ ID NO: 1243509 - RNA, 17 nt, Homo sapiens
uacuuuguccuaagaga

SEQ ID NO: 1243510 - RNA, 15 nt, Homo sapiens
uacuuuguuaggauu

SEQ ID NO: 1243511 - RNA, 17 nt, Homo sapiens
uacuuuuaaacuuugau

SEQ ID NO: 1243512 - RNA, 15 nt, Homo sapiens
uacuuuuacucugcc

SEQ ID NO: 1243513 - RNA, 22 nt, Homo sapiens
uacuuuuucugguguguuaaca

SEQ ID NO: 1243514 - RNA, 14 nt, Homo sapiens
uacuuuuuuacacu

SEQ ID NO: 1243515 - RNA, 19 nt, Homo sapiens
uacuuuuuuauagcuuaac

SEQ ID NO: 1243516 - RNA, 14 nt, Homo sapiens
uagaaaaagauucu

SEQ ID NO: 1243517 - RNA, 19 nt, Homo sapiens
uagaaaaaggacucugcuu

SEQ ID NO: 1243518 - RNA, 22 nt, Homo sapiens
uagaaaaauagcugugaacaga

SEQ ID NO: 1243519 - RNA, 20 nt, Homo sapiens
uagaaaacaggcaaauuccu

SEQ ID NO: 1243520 - RNA, 13 nt, Homo sapiens
uagaaaaccucac

SEQ ID NO: 1243521 - RNA, 21 nt, Homo sapiens
uagaaaaggcagcuaaaggaa

SEQ ID NO: 1243522 - RNA, 15 nt, Homo sapiens
uagaaacauuguaaa

SEQ ID NO: 1243523 - RNA, 12 nt, Homo sapiens
uagaaacccaag

SEQ ID NO: 1243524 - RNA, 20 nt, Homo sapiens
uagaaagcauaacaaaaaga

SEQ ID NO: 1243525 - RNA, 19 nt, Homo sapiens
uagaaagcugaguguuuca

SEQ ID NO: 1243526 - RNA, 20 nt, Homo sapiens
uagaaaggcaguucagguau

SEQ ID NO: 1243527 - RNA, 21 nt, Homo sapiens
uagaaauaagcccaacagaca

SEQ ID NO: 1243528 - RNA, 19 nt, Homo sapiens
uagaaauacccaacgcaca

SEQ ID NO: 1243529 - RNA, 13 nt, Homo sapiens
uagaaaugcaaaa

SEQ ID NO: 1243530 - RNA, 17 nt, Homo sapiens
uagaaauguaaacugcc

SEQ ID NO: 1243531 - RNA, 18 nt, Homo sapiens
uagaacaacgccugucac

SEQ ID NO: 1243532 - RNA, 17 nt, Homo sapiens
uagaacagauaaucagu

SEQ ID NO: 1243533 - RNA, 11 nt, Homo sapiens
uagaaccagcc

SEQ ID NO: 1243534 - RNA, 19 nt, Homo sapiens
uagaaccuuaaagaaccau

SEQ ID NO: 1243535 - RNA, 18 nt, Homo sapiens
uagaacugucugugaaca

SEQ ID NO: 1243536 - RNA, 19 nt, Homo sapiens
uagaacuuuaccuauggaa

SEQ ID NO: 1243537 - RNA, 15 nt, Homo sapiens
uagaagaagcccaua

SEQ ID NO: 1243538 - RNA, 21 nt, Homo sapiens
uagaagaagcccauaucacau

SEQ ID NO: 1243539 - RNA, 18 nt, Homo sapiens
uagaagauagaugcacuu

SEQ ID NO: 1243540 - RNA, 21 nt, Homo sapiens
uagaagcaaaugacaaaaagc

SEQ ID NO: 1243541 - RNA, 21 nt, Homo sapiens
uagaagcuguaguagcccuuu

SEQ ID NO: 1243542 - RNA, 22 nt, Homo sapiens
uaggacagcauauaaauguaau

SEQ ID NO: 1243543 - RNA, 16 nt, Homo sapiens
uaggacauugugucag

SEQ ID NO: 1243544 - RNA, 18 nt, Homo sapiens
uaggagcagaaaugcaag

SEQ ID NO: 1243545 - RNA, 21 nt, Homo sapiens
uaggagcuaaggcucuaugag

SEQ ID NO: 1243546 - RNA, 16 nt, Homo sapiens
uaggaggcugaggcag

SEQ ID NO: 1243547 - RNA, 20 nt, Homo sapiens
uaggagggcuggcaacuuag

SEQ ID NO: 1243548 - RNA, 14 nt, Homo sapiens
uaggauaagccacu

SEQ ID NO: 1243549 - RNA, 19 nt, Homo sapiens
uaggauacagaaaugcaaa

SEQ ID NO: 1243550 - RNA, 16 nt, Homo sapiens
uaggauucaagucugc

SEQ ID NO: 1243551 - RNA, 12 nt, Homo sapiens
uaggcauguaaa

SEQ ID NO: 1243552 - RNA, 17 nt, Homo sapiens
uaggcgcaggugcacag

SEQ ID NO: 1243553 - RNA, 17 nt, Homo sapiens
uaggcuauuaaaaaagu

SEQ ID NO: 1243554 - RNA, 21 nt, Homo sapiens
uaggcucuuaugugugccuuu

SEQ ID NO: 1243555 - RNA, 14 nt, Homo sapiens
uagggaagcucagg

SEQ ID NO: 1243556 - RNA, 15 nt, Homo sapiens
uagggaaguaacauu

SEQ ID NO: 1243557 - RNA, 14 nt, Homo sapiens
uagggagaaaccaa

SEQ ID NO: 1243558 - RNA, 15 nt, Homo sapiens
uagggaguaccugcu

SEQ ID NO: 1243559 - RNA, 23 nt, Homo sapiens
uagggaguuagaggcuguacaag

SEQ ID NO: 1243560 - RNA, 16 nt, Homo sapiens
uagggcaacaauacau

SEQ ID NO: 1243561 - RNA, 23 nt, Homo sapiens
uagggcaacaauacaugcugcua

SEQ ID NO: 1243562 - RNA, 20 nt, Homo sapiens
uaggggaacagaccagugac

SEQ ID NO: 1243563 - RNA, 13 nt, Homo sapiens
uaggggcaaaaau

SEQ ID NO: 1243564 - RNA, 15 nt, Homo sapiens
uaggggcugggagcu

SEQ ID NO: 1243565 - RNA, 22 nt, Homo sapiens
uagggggagcaaaucgugccuu

SEQ ID NO: 1243566 - RNA, 22 nt, Homo sapiens
uagggguuaacuuggucagagc

SEQ ID NO: 1243567 - RNA, 20 nt, Homo sapiens
uauauacaguaacuuuaugu

SEQ ID NO: 1243568 - RNA, 16 nt, Homo sapiens
uauauagaaugaucua

SEQ ID NO: 1243569 - RNA, 17 nt, Homo sapiens
uauauagguugugcaaa

SEQ ID NO: 1243570 - RNA, 22 nt, Homo sapiens
uauauauacauacacuuguaua

SEQ ID NO: 1243571 - RNA, 15 nt, Homo sapiens
uauauauauaugccu

SEQ ID NO: 1243572 - RNA, 19 nt, Homo sapiens
uauauaugcauaccuggau

SEQ ID NO: 1243573 - RNA, 21 nt, Homo sapiens
uauauauuuaauugauuucug

SEQ ID NO: 1243574 - RNA, 19 nt, Homo sapiens
uauauauuuauaacucauc

SEQ ID NO: 1243575 - RNA, 19 nt, Homo sapiens
uauauauuuuaaagaccaa

SEQ ID NO: 1243576 - RNA, 20 nt, Homo sapiens
uauauauuuucauccuauaa

SEQ ID NO: 1243577 - RNA, 14 nt, Homo sapiens
uauaucacuaagcu

SEQ ID NO: 1243578 - RNA, 15 nt, Homo sapiens
uauaucccauugaaa

SEQ ID NO: 1243579 - RNA, 17 nt, Homo sapiens
uauauccccugcuaccc

SEQ ID NO: 1243580 - RNA, 14 nt, Homo sapiens
uauauccuauauag

SEQ ID NO: 1243581 - RNA, 12 nt, Homo sapiens
uauauccuguga

SEQ ID NO: 1243582 - RNA, 14 nt, Homo sapiens
uauauccugugacu

SEQ ID NO: 1243583 - RNA, 14 nt, Homo sapiens
uauaucuaccccag

SEQ ID NO: 1243584 - RNA, 16 nt, Homo sapiens
uauauguacagcucuc

SEQ ID NO: 1243585 - RNA, 22 nt, Homo sapiens
uauauguccuuggguugcuggu

SEQ ID NO: 1243586 - RNA, 14 nt, Homo sapiens
uauauguugcuaua

SEQ ID NO: 1243587 - RNA, 22 nt, Homo sapiens
uauauuaaaauaagcacugugc

SEQ ID NO: 1243588 - RNA, 14 nt, Homo sapiens
uauauuaccucaaa

SEQ ID NO: 1243589 - RNA, 17 nt, Homo sapiens
uauauuauaaucuucca

SEQ ID NO: 1243590 - RNA, 12 nt, Homo sapiens
uauauuauuugg

SEQ ID NO: 1243591 - RNA, 12 nt, Homo sapiens
uauauugccuua

SEQ ID NO: 1243592 - RNA, 20 nt, Homo sapiens
uauauuguguugacuuuaua

SEQ ID NO: 1243593 - RNA, 13 nt, Homo sapiens
uauauuuccuuau

SEQ ID NO: 1243594 - RNA, 19 nt, Homo sapiens
uauauuugcagauaauucu

SEQ ID NO: 1243595 - RNA, 14 nt, Homo sapiens
uauauuuguacaaa

SEQ ID NO: 1243596 - RNA, 16 nt, Homo sapiens
uauauuuuaaagacca

SEQ ID NO: 1243597 - RNA, 20 nt, Homo sapiens
uauauuuugugcuaucagac

SEQ ID NO: 1243598 - RNA, 23 nt, Homo sapiens
uauauuuuuuguaacauaaugca

SEQ ID NO: 1243599 - RNA, 21 nt, Homo sapiens
uaucaauguucuaguucugug

SEQ ID NO: 1243600 - RNA, 20 nt, Homo sapiens
uaucaauguuuguccuguau

SEQ ID NO: 1243601 - RNA, 21 nt, Homo sapiens
uaucaauguuuguccuguaua

SEQ ID NO: 1243602 - RNA, 13 nt, Homo sapiens
uaucacacuguau

SEQ ID NO: 1243603 - RNA, 16 nt, Homo sapiens
uaucacauauuugaua

SEQ ID NO: 1243604 - RNA, 23 nt, Homo sapiens
uaucacaugaauauaaaugggaa

SEQ ID NO: 1243605 - RNA, 17 nt, Homo sapiens
uaucacauuuaccauaa

SEQ ID NO: 1243606 - RNA, 21 nt, Homo sapiens
uaucaccuagcagccucaaaa

SEQ ID NO: 1243607 - RNA, 18 nt, Homo sapiens
uaucaccucuuaugcaca

SEQ ID NO: 1243608 - RNA, 19 nt, Homo sapiens
uaucacugaacaaacuaaa

SEQ ID NO: 1243609 - RNA, 20 nt, Homo sapiens
uaucacuuuuugaacuaaga

SEQ ID NO: 1243610 - RNA, 20 nt, Homo sapiens
uaucagacuguaggauuuga

SEQ ID NO: 1243611 - RNA, 16 nt, Homo sapiens
uaucagauucuuggcu

SEQ ID NO: 1243612 - RNA, 11 nt, Homo sapiens
uaucaguuccc

SEQ ID NO: 1243613 - RNA, 16 nt, Homo sapiens
uaucaguugacagugu

SEQ ID NO: 1243614 - RNA, 20 nt, Homo sapiens
uaucauaauucagcacuuaa

SEQ ID NO: 1243615 - RNA, 23 nt, Homo sapiens
uaucaucugucauuauauucuaa

SEQ ID NO: 1243616 - RNA, 11 nt, Homo sapiens
uaucaucuuuu

SEQ ID NO: 1243617 - RNA, 21 nt, Homo sapiens
uaucaugaugugcaaccagca

SEQ ID NO: 1243618 - RNA, 16 nt, Homo sapiens
uaucauuggaacaacu

SEQ ID NO: 1243619 - RNA, 13 nt, Homo sapiens
uauccaaauugau

SEQ ID NO: 1243620 - RNA, 19 nt, Homo sapiens
uauccaagaaucagugaag

SEQ ID NO: 1243621 - RNA, 13 nt, Homo sapiens
uauccaagacuua

SEQ ID NO: 1243622 - RNA, 23 nt, Homo sapiens
uauccaaucugugaugacauucc

SEQ ID NO: 1243623 - RNA, 23 nt, Homo sapiens
uauccacaacuuuucaaguauug

SEQ ID NO: 1243624 - RNA, 21 nt, Homo sapiens
uauccacaucuuuaaguauug

SEQ ID NO: 1243625 - RNA, 14 nt, Homo sapiens
uauccaucuuucac

SEQ ID NO: 1243626 - RNA, 23 nt, Homo sapiens
uauccaucuuucacuaucuguaa

SEQ ID NO: 1243627 - RNA, 20 nt, Homo sapiens
uaucccaaucaaagaauuac

SEQ ID NO: 1243628 - RNA, 21 nt, Homo sapiens
uaucccuacauguauugcaca

SEQ ID NO: 1243629 - RNA, 15 nt, Homo sapiens
uauccgaacuuuaau

SEQ ID NO: 1243630 - RNA, 16 nt, Homo sapiens
uauccuagucauucuu

SEQ ID NO: 1243631 - RNA, 20 nt, Homo sapiens
uauccugagccaucggugaa

SEQ ID NO: 1243632 - RNA, 22 nt, Homo sapiens
uauccuuccaaaaaauuaaaac

SEQ ID NO: 1243633 - RNA, 19 nt, Homo sapiens
uauccuuggcaccaaagau

SEQ ID NO: 1243634 - RNA, 22 nt, Homo sapiens
uauccuuugugagccuaugaua

SEQ ID NO: 1243635 - RNA, 13 nt, Homo sapiens
uaucgaucucuua

SEQ ID NO: 1243636 - RNA, 17 nt, Homo sapiens
uaucgggagcagugucu

SEQ ID NO: 1243637 - RNA, 14 nt, Homo sapiens
uaucuaaaccauau

SEQ ID NO: 1243638 - RNA, 21 nt, Homo sapiens
uaucuaacccucccauggcac

SEQ ID NO: 1243639 - RNA, 21 nt, Homo sapiens
uaucuacccaagggcagaaag

SEQ ID NO: 1243640 - RNA, 16 nt, Homo sapiens
uaucucaguaccccau

SEQ ID NO: 1243641 - RNA, 14 nt, Homo sapiens
uaucucauuacuua

SEQ ID NO: 1243642 - RNA, 10 nt, Homo sapiens
uaucucucaa

SEQ ID NO: 1243643 - RNA, 14 nt, Homo sapiens
uaucugaauggaag

SEQ ID NO: 1243644 - RNA, 23 nt, Homo sapiens
uaucugagggaggaggccaccuc

SEQ ID NO: 1243645 - RNA, 21 nt, Homo sapiens
uaucugagugaauuacagaca

SEQ ID NO: 1243646 - RNA, 14 nt, Homo sapiens
uaucugauuuccua

SEQ ID NO: 1243647 - RNA, 22 nt, Homo sapiens
uaucugcagggacagagcauug

SEQ ID NO: 1243648 - RNA, 12 nt, Homo sapiens
uaucugcugcac

SEQ ID NO: 1243649 - RNA, 23 nt, Homo sapiens
uaucuggcccucgacacucacca

SEQ ID NO: 1243650 - RNA, 18 nt, Homo sapiens
uaucugugaauucagauu

SEQ ID NO: 1243651 - RNA, 15 nt, Homo sapiens
uaucugugucaaaag

SEQ ID NO: 1243652 - RNA, 15 nt, Homo sapiens
uaucuuagcuggaua

SEQ ID NO: 1243653 - RNA, 17 nt, Homo sapiens
uaucuucaaacuuucac

SEQ ID NO: 1243654 - RNA, 17 nt, Homo sapiens
uaucuucucaaguucua

SEQ ID NO: 1243655 - RNA, 14 nt, Homo sapiens
uaucuuucaaagag

SEQ ID NO: 1243656 - RNA, 20 nt, Homo sapiens
uaucuuugucuguucacuuu

SEQ ID NO: 1243657 - RNA, 21 nt, Homo sapiens
uaugaaaacaaguuccaaauc

SEQ ID NO: 1243658 - RNA, 16 nt, Homo sapiens
uaugaaaugaccucug

SEQ ID NO: 1243659 - RNA, 16 nt, Homo sapiens
uaugaacaacuccaaa

SEQ ID NO: 1243660 - RNA, 14 nt, Homo sapiens
uaugaacaugcagu

SEQ ID NO: 1243661 - RNA, 23 nt, Homo sapiens
uaugaaccuauuuucauuuguac

SEQ ID NO: 1243662 - RNA, 16 nt, Homo sapiens
uaugaacuucucucag

SEQ ID NO: 1243663 - RNA, 16 nt, Homo sapiens
uaugaaucacaguauu

SEQ ID NO: 1243664 - RNA, 14 nt, Homo sapiens
uaugaaucugcuca

SEQ ID NO: 1243665 - RNA, 13 nt, Homo sapiens
uaugaaugcagug

SEQ ID NO: 1243666 - RNA, 18 nt, Homo sapiens
uaugacaauaagccacga

SEQ ID NO: 1243667 - RNA, 12 nt, Homo sapiens
uaugacauauga

SEQ ID NO: 1243668 - RNA, 16 nt, Homo sapiens
uaugacaucacuugua

SEQ ID NO: 1243669 - RNA, 16 nt, Homo sapiens
uaugacgcugauacau

SEQ ID NO: 1243670 - RNA, 22 nt, Homo sapiens
uaugacuguuuuuguaguggua

SEQ ID NO: 1243671 - RNA, 17 nt, Homo sapiens
uauuucuagaagcacau

SEQ ID NO: 1243672 - RNA, 17 nt, Homo sapiens
uauuucucuugcuggaa

SEQ ID NO: 1243673 - RNA, 15 nt, Homo sapiens
uauuucucuuugcac

SEQ ID NO: 1243674 - RNA, 22 nt, Homo sapiens
uauuucuucuacugcuaucuac

SEQ ID NO: 1243675 - RNA, 15 nt, Homo sapiens
uauuucuugcuuuca

SEQ ID NO: 1243676 - RNA, 23 nt, Homo sapiens
uauuugaaauacuaaaagcaaau

SEQ ID NO: 1243677 - RNA, 11 nt, Homo sapiens
uauuugaaccc

SEQ ID NO: 1243678 - RNA, 21 nt, Homo sapiens
uauuugauaacaguuacucca

SEQ ID NO: 1243679 - RNA, 19 nt, Homo sapiens
uauuugcacacugcacugu

SEQ ID NO: 1243680 - RNA, 20 nt, Homo sapiens
uauuugcacuaugagccuau

SEQ ID NO: 1243681 - RNA, 19 nt, Homo sapiens
uauuugcacuauuuccaca

SEQ ID NO: 1243682 - RNA, 19 nt, Homo sapiens
uauuugcauguuaccuccu

SEQ ID NO: 1243683 - RNA, 16 nt, Homo sapiens
uauuugcuuuuugcua

SEQ ID NO: 1243684 - RNA, 13 nt, Homo sapiens
uauuugguacugu

SEQ ID NO: 1243685 - RNA, 17 nt, Homo sapiens
uauuuguuugcaauuuu

SEQ ID NO: 1243686 - RNA, 17 nt, Homo sapiens
uauuuuaagaauuucac

SEQ ID NO: 1243687 - RNA, 19 nt, Homo sapiens
uauuuuaagaauuucacaa

SEQ ID NO: 1243688 - RNA, 18 nt, Homo sapiens
uauuuuaaguaucagagg

SEQ ID NO: 1243689 - RNA, 16 nt, Homo sapiens
uauuuucaucacccca

SEQ ID NO: 1243690 - RNA, 12 nt, Homo sapiens
uauuuuccaaag

SEQ ID NO: 1243691 - RNA, 22 nt, Homo sapiens
uauuuugcauaguaccaaucau

SEQ ID NO: 1243692 - RNA, 13 nt, Homo sapiens
uauuuugguucuu

SEQ ID NO: 1243693 - RNA, 17 nt, Homo sapiens
uauuuuguaaugcugca

SEQ ID NO: 1243694 - RNA, 19 nt, Homo sapiens
ucccucagccucagaggag

SEQ ID NO: 1243695 - RNA, 14 nt, Homo sapiens
ucccucagcucucu

SEQ ID NO: 1243696 - RNA, 20 nt, Homo sapiens
ucccucaggucccuugguca

SEQ ID NO: 1243697 - RNA, 14 nt, Homo sapiens
ucccucucaugacu

SEQ ID NO: 1243698 - RNA, 19 nt, Homo sapiens
ucccucugugucugcucuc

SEQ ID NO: 1243699 - RNA, 12 nt, Homo sapiens
ucccucuuccaa

SEQ ID NO: 1243700 - RNA, 23 nt, Homo sapiens
ucccugaaaauguuuuucugcca

SEQ ID NO: 1243701 - RNA, 14 nt, Homo sapiens
ucccugaagccagc

SEQ ID NO: 1243702 - RNA, 14 nt, Homo sapiens
ucccugacuccucc

SEQ ID NO: 1243703 - RNA, 15 nt, Homo sapiens
ucccugacuguaaau

SEQ ID NO: 1243704 - RNA, 15 nt, Homo sapiens
ucccugauuauuuau

SEQ ID NO: 1243705 - RNA, 24 nt, Homo sapiens
ucccugcacuaaagccagccugac

SEQ ID NO: 1243706 - RNA, 15 nt, Homo sapiens
ucccugcagaugcca

SEQ ID NO: 1243707 - RNA, 16 nt, Homo sapiens
ucccugcagaugccac

SEQ ID NO: 1243708 - RNA, 23 nt, Homo sapiens
ucccugcagaugccacccuagcc

SEQ ID NO: 1243709 - RNA, 12 nt, Homo sapiens
ucccugccacau

SEQ ID NO: 1243710 - RNA, 21 nt, Homo sapiens
ucccugccugugacuuucaag

SEQ ID NO: 1243711 - RNA, 14 nt, Homo sapiens
ucccuggagcugcu

SEQ ID NO: 1243712 - RNA, 21 nt, Homo sapiens
ucccuggaucacgacgcugca

SEQ ID NO: 1243713 - RNA, 14 nt, Homo sapiens
ucccuggaugacau

SEQ ID NO: 1243714 - RNA, 11 nt, Homo sapiens
ucccugggaag

SEQ ID NO: 1243715 - RNA, 19 nt, Homo sapiens
ucccuggucccucguccac

SEQ ID NO: 1243716 - RNA, 22 nt, Homo sapiens
ucccuguacaguagauuuucca

SEQ ID NO: 1243717 - RNA, 20 nt, Homo sapiens
ucccugucccucuagugccu

SEQ ID NO: 1243718 - RNA, 16 nt, Homo sapiens
ucccuguccuugcccu

SEQ ID NO: 1243719 - RNA, 21 nt, Homo sapiens
ucccuguguauucuagugaau

SEQ ID NO: 1243720 - RNA, 18 nt, Homo sapiens
ucccuguguugucucuag

SEQ ID NO: 1243721 - RNA, 19 nt, Homo sapiens
ucccuuaagagucauccag

SEQ ID NO: 1243722 - RNA, 16 nt, Homo sapiens
ucccuuaaucugccag

SEQ ID NO: 1243723 - RNA, 23 nt, Homo sapiens
ucccuuaauuuaagucauuuuca

SEQ ID NO: 1243724 - RNA, 16 nt, Homo sapiens
ucccuuccacugccuc

SEQ ID NO: 1243725 - RNA, 15 nt, Homo sapiens
ucccuucccuuccac

SEQ ID NO: 1243726 - RNA, 21 nt, Homo sapiens
ucccuuccgacccucugggaa

SEQ ID NO: 1243727 - RNA, 19 nt, Homo sapiens
ucccuuccugggucuacca

SEQ ID NO: 1243728 - RNA, 20 nt, Homo sapiens
ucccuucucacagcacaugc

SEQ ID NO: 1243729 - RNA, 23 nt, Homo sapiens
ucccuugauggucucaagcuaug

SEQ ID NO: 1243730 - RNA, 16 nt, Homo sapiens
ucccuuggguucugau

SEQ ID NO: 1243731 - RNA, 17 nt, Homo sapiens
ucccuuuaucaguuuga

SEQ ID NO: 1243732 - RNA, 18 nt, Homo sapiens
ucccuuuccuacucucag

SEQ ID NO: 1243733 - RNA, 16 nt, Homo sapiens
ucccuuucuuggccag

SEQ ID NO: 1243734 - RNA, 13 nt, Homo sapiens
ucccuuugccagu

SEQ ID NO: 1243735 - RNA, 15 nt, Homo sapiens
ucccuuugcugcuga

SEQ ID NO: 1243736 - RNA, 17 nt, Homo sapiens
ucccuuuguugcacacu

SEQ ID NO: 1243737 - RNA, 20 nt, Homo sapiens
ucccuuuuaaaugcaaauca

SEQ ID NO: 1243738 - RNA, 17 nt, Homo sapiens
ucccuuuuccugucagu

SEQ ID NO: 1243739 - RNA, 23 nt, Homo sapiens
ucccuuuuuauaucccauuuuua

SEQ ID NO: 1243740 - RNA, 19 nt, Homo sapiens
ucccuuuuucaaugaauuu

SEQ ID NO: 1243741 - RNA, 19 nt, Homo sapiens
ucccuuuuuuuacauuuca

SEQ ID NO: 1243742 - RNA, 18 nt, Homo sapiens
uccgacucuaagcugugu

SEQ ID NO: 1243743 - RNA, 17 nt, Homo sapiens
uccgaugaguaaaaagu

SEQ ID NO: 1243744 - RNA, 18 nt, Homo sapiens
uccgauuccccuguagca

SEQ ID NO: 1243745 - RNA, 11 nt, Homo sapiens
uccgcacuuuc

SEQ ID NO: 1243746 - RNA, 16 nt, Homo sapiens
uccgcacuuuccacuu

SEQ ID NO: 1243747 - RNA, 20 nt, Homo sapiens
uccgcaguuccugucccuuc

SEQ ID NO: 1243748 - RNA, 13 nt, Homo sapiens
uccgccuaccuca

SEQ ID NO: 1243749 - RNA, 23 nt, Homo sapiens
uccgccuggggcagaaagccaca

SEQ ID NO: 1243750 - RNA, 21 nt, Homo sapiens
uccggaagcugucgacuucau

SEQ ID NO: 1243751 - RNA, 16 nt, Homo sapiens
uccggcacacugccaa

SEQ ID NO: 1243752 - RNA, 22 nt, Homo sapiens
uccggcugaaggcugagugucc

SEQ ID NO: 1243753 - RNA, 20 nt, Homo sapiens
uccgguccccugccuggaac

SEQ ID NO: 1243754 - RNA, 18 nt, Homo sapiens
uccgguuugccauguugc

SEQ ID NO: 1243755 - RNA, 18 nt, Homo sapiens
uccguccaggagccugug

SEQ ID NO: 1243756 - RNA, 20 nt, Homo sapiens
uccguggucagagugccacu

SEQ ID NO: 1243757 - RNA, 23 nt, Homo sapiens
uccgugguggcaccgagaccaaa

SEQ ID NO: 1243758 - RNA, 20 nt, Homo sapiens
uccgugguuugaacacgaaa

SEQ ID NO: 1243759 - RNA, 12 nt, Homo sapiens
uccguguaaaau

SEQ ID NO: 1243760 - RNA, 20 nt, Homo sapiens
uccguucacaugugugguac

SEQ ID NO: 1243761 - RNA, 21 nt, Homo sapiens
uccguucuauuuugugaauuu

SEQ ID NO: 1243762 - RNA, 14 nt, Homo sapiens
uccuaaacauaauu

SEQ ID NO: 1243763 - RNA, 12 nt, Homo sapiens
uccuaaaccauu

SEQ ID NO: 1243764 - RNA, 23 nt, Homo sapiens
uccuaaagaaaaauaucuuggcc

SEQ ID NO: 1243765 - RNA, 24 nt, Homo sapiens
uccuaaagaaaaauaucuuggccu

SEQ ID NO: 1243766 - RNA, 18 nt, Homo sapiens
uccuaagacacaaaugca

SEQ ID NO: 1243767 - RNA, 13 nt, Homo sapiens
uccuaagcacuuu

SEQ ID NO: 1243768 - RNA, 19 nt, Homo sapiens
uccuaaggccuuagggguc

SEQ ID NO: 1243769 - RNA, 14 nt, Homo sapiens
uccuaauacuguca

SEQ ID NO: 1243770 - RNA, 19 nt, Homo sapiens
uccuaauauuuugauucau

SEQ ID NO: 1243771 - RNA, 16 nt, Homo sapiens
uccuaauggauucaau

SEQ ID NO: 1243772 - RNA, 14 nt, Homo sapiens
uccuaauuaccagu

SEQ ID NO: 1243773 - RNA, 14 nt, Homo sapiens
uccuacaagcuaaa

SEQ ID NO: 1243774 - RNA, 23 nt, Homo sapiens
uccuacacguuagauuugccgua

SEQ ID NO: 1243775 - RNA, 19 nt, Homo sapiens
uccuacagcuaacccucac

SEQ ID NO: 1243776 - RNA, 13 nt, Homo sapiens
uccuacaugucua

SEQ ID NO: 1243777 - RNA, 20 nt, Homo sapiens
uccuacccuccugcacuguu

SEQ ID NO: 1243778 - RNA, 20 nt, Homo sapiens
uccuaccgaaaccuugccuu

SEQ ID NO: 1243779 - RNA, 12 nt, Homo sapiens
uccuaccucagc

SEQ ID NO: 1243780 - RNA, 15 nt, Homo sapiens
uccuacguauccugc

SEQ ID NO: 1243781 - RNA, 16 nt, Homo sapiens
uccuacguauccugca

SEQ ID NO: 1243782 - RNA, 18 nt, Homo sapiens
uccuacuaucacugaaca

SEQ ID NO: 1243783 - RNA, 12 nt, Homo sapiens
uccuagaacuuu

SEQ ID NO: 1243784 - RNA, 19 nt, Homo sapiens
uccuagccaacaucgugaa

SEQ ID NO: 1243785 - RNA, 23 nt, Homo sapiens
uccuaggggaacagaccagugac

SEQ ID NO: 1243786 - RNA, 17 nt, Homo sapiens
uccuagucauucuuccc

SEQ ID NO: 1243787 - RNA, 13 nt, Homo sapiens
uccuauaagcuua

SEQ ID NO: 1243788 - RNA, 14 nt, Homo sapiens
uccuauauccugug

SEQ ID NO: 1243789 - RNA, 23 nt, Homo sapiens
uccuaucacugauaguguccaaa

SEQ ID NO: 1243790 - RNA, 16 nt, Homo sapiens
uccuauccacugggca

SEQ ID NO: 1243791 - RNA, 21 nt, Homo sapiens
uccuaugcccagguaccaccc

SEQ ID NO: 1243792 - RNA, 16 nt, Homo sapiens
uccuaugggaacaauu

SEQ ID NO: 1243793 - RNA, 18 nt, Homo sapiens
uccucaauaaacauuuca

SEQ ID NO: 1243794 - RNA, 20 nt, Homo sapiens
uccucaauuuuugucucaga

SEQ ID NO: 1243795 - RNA, 19 nt, Homo sapiens
uccucacccaucaaaagca

SEQ ID NO: 1243796 - RNA, 20 nt, Homo sapiens
uccucaccucuggacuggcu

SEQ ID NO: 1243797 - RNA, 23 nt, Homo sapiens
uccucagcccccaggccagguga

SEQ ID NO: 1243798 - RNA, 15 nt, Homo sapiens
uccucagcuuaucuc

SEQ ID NO: 1243799 - RNA, 22 nt, Homo sapiens
uccucaggcacacagcuacucu

SEQ ID NO: 1243800 - RNA, 11 nt, Homo sapiens
uccucagggag

SEQ ID NO: 1243801 - RNA, 21 nt, Homo sapiens
uagaaggcuucuuagcgcagu

SEQ ID NO: 1243802 - RNA, 19 nt, Homo sapiens
uagaagucuuucaguggaa

SEQ ID NO: 1243803 - RNA, 12 nt, Homo sapiens
uagaagugcuaa

SEQ ID NO: 1243804 - RNA, 17 nt, Homo sapiens
uagaauauccaugaccu

SEQ ID NO: 1243805 - RNA, 23 nt, Homo sapiens
uagaauauuuauuaccucugaua

SEQ ID NO: 1243806 - RNA, 20 nt, Homo sapiens
uagaaugaucuauugcucau

SEQ ID NO: 1243807 - RNA, 18 nt, Homo sapiens
uagaaugcuuuuguuaaa

SEQ ID NO: 1243808 - RNA, 12 nt, Homo sapiens
uagaauugcauu

SEQ ID NO: 1243809 - RNA, 17 nt, Homo sapiens
uagaauuggagaguaaa

SEQ ID NO: 1243810 - RNA, 20 nt, Homo sapiens
uagaauuugggggaaaauuu

SEQ ID NO: 1243811 - RNA, 16 nt, Homo sapiens
uagacagagucucacu

SEQ ID NO: 1243812 - RNA, 13 nt, Homo sapiens
uagacagccaggu

SEQ ID NO: 1243813 - RNA, 22 nt, Homo sapiens
uagacaugucuagccacugauc

SEQ ID NO: 1243814 - RNA, 19 nt, Homo sapiens
uagaccaccuaauaucaau

SEQ ID NO: 1243815 - RNA, 17 nt, Homo sapiens
uagacuccauguaguua

SEQ ID NO: 1243816 - RNA, 23 nt, Homo sapiens
uagacugccgugcauuagcacag

SEQ ID NO: 1243817 - RNA, 12 nt, Homo sapiens
uagacugccugg

SEQ ID NO: 1243818 - RNA, 15 nt, Homo sapiens
uagacuuaaaucuca

SEQ ID NO: 1243819 - RNA, 17 nt, Homo sapiens
uagacuuacugcaguua

SEQ ID NO: 1243820 - RNA, 23 nt, Homo sapiens
uagacuugaaaguuuuccaguau

SEQ ID NO: 1243821 - RNA, 22 nt, Homo sapiens
uagacuugccaacaccacagaa

SEQ ID NO: 1243822 - RNA, 19 nt, Homo sapiens
uagacuuucuuaucacuua

SEQ ID NO: 1243823 - RNA, 20 nt, Homo sapiens
uagagaauuuucugcauuau

SEQ ID NO: 1243824 - RNA, 14 nt, Homo sapiens
uagagaugcaguuu

SEQ ID NO: 1243825 - RNA, 21 nt, Homo sapiens
uagagcagccacaaccaaaaa

SEQ ID NO: 1243826 - RNA, 18 nt, Homo sapiens
uagagcauaccacuugaa

SEQ ID NO: 1243827 - RNA, 20 nt, Homo sapiens
ucggacuaaacuaucuguau

SEQ ID NO: 1243828 - RNA, 16 nt, Homo sapiens
ucggagagcagcagca

SEQ ID NO: 1243829 - RNA, 18 nt, Homo sapiens
ucggaguucagacucuca

SEQ ID NO: 1243830 - RNA, 23 nt, Homo sapiens
ucggcacucccaggcugggagcu

SEQ ID NO: 1243831 - RNA, 12 nt, Homo sapiens
ucggcaucuucu

SEQ ID NO: 1243832 - RNA, 14 nt, Homo sapiens
ucggccccagcaca

SEQ ID NO: 1243833 - RNA, 16 nt, Homo sapiens
ucggccccagcacaug

SEQ ID NO: 1243834 - RNA, 14 nt, Homo sapiens
ucggccuccaugac

SEQ ID NO: 1243835 - RNA, 16 nt, Homo sapiens
ucggcuccaccccagg

SEQ ID NO: 1243836 - RNA, 19 nt, Homo sapiens
ucggcuccgggcaaauggc

SEQ ID NO: 1243837 - RNA, 15 nt, Homo sapiens
ucggcugaccaugcu

SEQ ID NO: 1243838 - RNA, 15 nt, Homo sapiens
ucgggggcuguggau

SEQ ID NO: 1243839 - RNA, 20 nt, Homo sapiens
ucgguagaggauuucuaguu

SEQ ID NO: 1243840 - RNA, 15 nt, Homo sapiens
ucggugguaccugag

SEQ ID NO: 1243841 - RNA, 10 nt, Homo sapiens
ucguagccaa

SEQ ID NO: 1243842 - RNA, 14 nt, Homo sapiens
ucgugucagcucag

SEQ ID NO: 1243843 - RNA, 15 nt, Homo sapiens
ucguguggaucuugc

SEQ ID NO: 1243844 - RNA, 18 nt, Homo sapiens
ucguuagaaugucugccu

SEQ ID NO: 1243845 - RNA, 17 nt, Homo sapiens
ucguucaaaacauucca

SEQ ID NO: 1243846 - RNA, 17 nt, Homo sapiens
ucguugccugccacuga

SEQ ID NO: 1243847 - RNA, 22 nt, Homo sapiens
ucguuuugcccgauuccguauu

SEQ ID NO: 1243848 - RNA, 21 nt, Homo sapiens
ucuaaaaaucaaauaagcuaa

SEQ ID NO: 1243849 - RNA, 13 nt, Homo sapiens
ucuaaaagcuuuc

SEQ ID NO: 1243850 - RNA, 17 nt, Homo sapiens
ucuaaaccauaugaaca

SEQ ID NO: 1243851 - RNA, 12 nt, Homo sapiens
ucuaaaccuuac

SEQ ID NO: 1243852 - RNA, 16 nt, Homo sapiens
ucuaaacuuuaauuca

SEQ ID NO: 1243853 - RNA, 13 nt, Homo sapiens
ucuaaacuuuccc

SEQ ID NO: 1243854 - RNA, 20 nt, Homo sapiens
ucuaaagauacagugucuga

SEQ ID NO: 1243855 - RNA, 19 nt, Homo sapiens
ucuaaauaaaaagcauuau

SEQ ID NO: 1243856 - RNA, 14 nt, Homo sapiens
ucuaaaugccaaug

SEQ ID NO: 1243857 - RNA, 14 nt, Homo sapiens
ucuaacaagucaua

SEQ ID NO: 1243858 - RNA, 23 nt, Homo sapiens
ucuaacaccaacauaagguacua

SEQ ID NO: 1243859 - RNA, 21 nt, Homo sapiens
ucuaacagaucagaacaugaa

SEQ ID NO: 1243860 - RNA, 13 nt, Homo sapiens
ucuaacgcuuuaa

SEQ ID NO: 1243861 - RNA, 19 nt, Homo sapiens
ucuaacuagaaaucugcca

SEQ ID NO: 1243862 - RNA, 20 nt, Homo sapiens
ucuaagauaguaacaaugaa

SEQ ID NO: 1243863 - RNA, 16 nt, Homo sapiens
ucuaagccaguuuuca

SEQ ID NO: 1243864 - RNA, 17 nt, Homo sapiens
ucuaagccuuuccauaa

SEQ ID NO: 1243865 - RNA, 12 nt, Homo sapiens
ucuaagcugugu

SEQ ID NO: 1243866 - RNA, 16 nt, Homo sapiens
ucuaaggaaugcacaa

SEQ ID NO: 1243867 - RNA, 20 nt, Homo sapiens
ucuaagguaguaacuuucca

SEQ ID NO: 1243868 - RNA, 20 nt, Homo sapiens
ucuaaguuauuuacuuuuac

SEQ ID NO: 1243869 - RNA, 14 nt, Homo sapiens
ucuaauauggccac

SEQ ID NO: 1243870 - RNA, 13 nt, Homo sapiens
ucuaaucaaaagg

SEQ ID NO: 1243871 - RNA, 14 nt, Homo sapiens
ucuaaucgaaagaa

SEQ ID NO: 1243872 - RNA, 15 nt, Homo sapiens
ucuaaugcauguauu

SEQ ID NO: 1243873 - RNA, 19 nt, Homo sapiens
ucuaauggggacacagauc

SEQ ID NO: 1243874 - RNA, 12 nt, Homo sapiens
ucuaaugucuuc

SEQ ID NO: 1243875 - RNA, 15 nt, Homo sapiens
ucuaauuacauuuca

SEQ ID NO: 1243876 - RNA, 20 nt, Homo sapiens
ucuacaagauccuccugcug

SEQ ID NO: 1243877 - RNA, 14 nt, Homo sapiens
ucuacagaggccau

SEQ ID NO: 1243878 - RNA, 17 nt, Homo sapiens
ucuacauaaguaauuca

SEQ ID NO: 1243879 - RNA, 21 nt, Homo sapiens
ucuacauuucaccuacuuugu

SEQ ID NO: 1243880 - RNA, 19 nt, Homo sapiens
ucuaccacaagggcucucu

SEQ ID NO: 1243881 - RNA, 15 nt, Homo sapiens
ucuaccagcauaaau

SEQ ID NO: 1243882 - RNA, 17 nt, Homo sapiens
ucuaccaggcaaauuca

SEQ ID NO: 1243883 - RNA, 15 nt, Homo sapiens
ucuacccuggcacua

SEQ ID NO: 1243884 - RNA, 15 nt, Homo sapiens
ucuaccuguacacau

SEQ ID NO: 1243885 - RNA, 16 nt, Homo sapiens
ucuacuacaugugacu

SEQ ID NO: 1243886 - RNA, 16 nt, Homo sapiens
ucuacuaccacaagga

SEQ ID NO: 1243887 - RNA, 21 nt, Homo sapiens
ucuacucugucuuaaaugaga

SEQ ID NO: 1243888 - RNA, 15 nt, Homo sapiens
ucuacugaggugcua

SEQ ID NO: 1243889 - RNA, 16 nt, Homo sapiens
ucuacugaggugcuau

SEQ ID NO: 1243890 - RNA, 22 nt, Homo sapiens
ucuacuugcuuauuacauuuaa

SEQ ID NO: 1243891 - RNA, 15 nt, Homo sapiens
ucuagaaaaccagcu

SEQ ID NO: 1243892 - RNA, 15 nt, Homo sapiens
ucuagaaacagaucu

SEQ ID NO: 1243893 - RNA, 15 nt, Homo sapiens
ucuagaacacaggca

SEQ ID NO: 1243894 - RNA, 24 nt, Homo sapiens
ucuagaauuauaagucacaaagag

SEQ ID NO: 1243895 - RNA, 22 nt, Homo sapiens
ucuagacacugccacacagggu

SEQ ID NO: 1243896 - RNA, 14 nt, Homo sapiens
ucuagagucacuga

SEQ ID NO: 1243897 - RNA, 13 nt, Homo sapiens
ucuagauaccacu

SEQ ID NO: 1243898 - RNA, 19 nt, Homo sapiens
ucuagaucacugugcuuau

SEQ ID NO: 1243899 - RNA, 18 nt, Homo sapiens
ucuagauuauaaacugac

SEQ ID NO: 1243900 - RNA, 18 nt, Homo sapiens
ucuagauuauggagcuuu

SEQ ID NO: 1243901 - RNA, 18 nt, Homo sapiens
ucuagauuuucuacuuua

SEQ ID NO: 1243902 - RNA, 14 nt, Homo sapiens
ucuagcaagggagg

SEQ ID NO: 1243903 - RNA, 16 nt, Homo sapiens
ucuagcaccaggacuc

SEQ ID NO: 1243904 - RNA, 22 nt, Homo sapiens
ucuagcaccaggacucagagga

SEQ ID NO: 1243905 - RNA, 18 nt, Homo sapiens
ucuaggcaucccagggga

SEQ ID NO: 1243906 - RNA, 21 nt, Homo sapiens
ucuaguaagaugcacugaaaa

SEQ ID NO: 1243907 - RNA, 19 nt, Homo sapiens
ucuagucaggggaaaagac

SEQ ID NO: 1243908 - RNA, 13 nt, Homo sapiens
ucuagugaaugaa

SEQ ID NO: 1243909 - RNA, 17 nt, Homo sapiens
ucuagugaaugaaucuc

SEQ ID NO: 1243910 - RNA, 18 nt, Homo sapiens
ucuagugucuuuugccuu

SEQ ID NO: 1243911 - RNA, 20 nt, Homo sapiens
ucuaguucuuuucauuugga

SEQ ID NO: 1243912 - RNA, 20 nt, Homo sapiens
ucuaguugaggaguuuccua

SEQ ID NO: 1243913 - RNA, 15 nt, Homo sapiens
ucuaguuuugucaaa

SEQ ID NO: 1243914 - RNA, 18 nt, Homo sapiens
ucuauaaaagaauugcac

SEQ ID NO: 1243915 - RNA, 21 nt, Homo sapiens
ucuauaaagaagaacuugcau

SEQ ID NO: 1243916 - RNA, 13 nt, Homo sapiens
ucuauaaauaacc

SEQ ID NO: 1243917 - RNA, 14 nt, Homo sapiens
ucuauaaggccaua

SEQ ID NO: 1243918 - RNA, 14 nt, Homo sapiens
ucuauaauuuaccu

SEQ ID NO: 1243919 - RNA, 19 nt, Homo sapiens
ucuauaauuuugccuuuaa

SEQ ID NO: 1243920 - RNA, 20 nt, Homo sapiens
ucuauaccgcuucgacugga

SEQ ID NO: 1243921 - RNA, 19 nt, Homo sapiens
ucuauacucagguaccucu

SEQ ID NO: 1243922 - RNA, 21 nt, Homo sapiens
ucuauagagaaaaacuuucau

SEQ ID NO: 1243923 - RNA, 13 nt, Homo sapiens
ucuauagcagauu

SEQ ID NO: 1243924 - RNA, 17 nt, Homo sapiens
ucuauauggaauugcuu

SEQ ID NO: 1243925 - RNA, 20 nt, Homo sapiens
ucuauauuagaucaaauagu

SEQ ID NO: 1243926 - RNA, 12 nt, Homo sapiens
ucuauccaaauc

SEQ ID NO: 1243927 - RNA, 21 nt, Homo sapiens
ucuaugaaacugcacauuggu

SEQ ID NO: 1243928 - RNA, 18 nt, Homo sapiens
ucuaugacgcaaagauca

SEQ ID NO: 1243929 - RNA, 13 nt, Homo sapiens
ucuaugcacagcu

SEQ ID NO: 1243930 - RNA, 23 nt, Homo sapiens
ucuaugcucucgcaccuuuccaa

SEQ ID NO: 1243931 - RNA, 18 nt, Homo sapiens
ucuaugggacucaaugca

SEQ ID NO: 1243932 - RNA, 23 nt, Homo sapiens
ucuaugggacucaaugcacugac

SEQ ID NO: 1243933 - RNA, 16 nt, Homo sapiens
ucugaggauucagggg

SEQ ID NO: 1243934 - RNA, 17 nt, Homo sapiens
ucugagggaaagugcau

SEQ ID NO: 1243935 - RNA, 20 nt, Homo sapiens
ucugaguaagaaacagaauc

SEQ ID NO: 1243936 - RNA, 18 nt, Homo sapiens
ucugagucucugaaugaa

SEQ ID NO: 1243937 - RNA, 16 nt, Homo sapiens
ucugauaccacugcac

SEQ ID NO: 1243938 - RNA, 19 nt, Homo sapiens
ucugauaccacugcacugu

SEQ ID NO: 1243939 - RNA, 13 nt, Homo sapiens
ucugauaccucaa

SEQ ID NO: 1243940 - RNA, 18 nt, Homo sapiens
ucugaugccaauacuagu

SEQ ID NO: 1243941 - RNA, 16 nt, Homo sapiens
ucugaugggucccaaa

SEQ ID NO: 1243942 - RNA, 20 nt, Homo sapiens
ucugcaaaguguaugugacc

SEQ ID NO: 1243943 - RNA, 18 nt, Homo sapiens
ucugcaaggucuuugguu

SEQ ID NO: 1243944 - RNA, 21 nt, Homo sapiens
ucugcaauggcagcaggaucu

SEQ ID NO: 1243945 - RNA, 23 nt, Homo sapiens
ucugcacagccuagacauccagg

SEQ ID NO: 1243946 - RNA, 19 nt, Homo sapiens
ucugcaccaacucaccugg

SEQ ID NO: 1243947 - RNA, 13 nt, Homo sapiens
ucugcacuacucc

SEQ ID NO: 1243948 - RNA, 23 nt, Homo sapiens
ucugcacuuauaagaaagaucaa

SEQ ID NO: 1243949 - RNA, 19 nt, Homo sapiens
ucugcagcacucuuaucua

SEQ ID NO: 1243950 - RNA, 23 nt, Homo sapiens
ucugcagcccggcgccaccaucc

SEQ ID NO: 1243951 - RNA, 16 nt, Homo sapiens
ucugcagguacuuccu

SEQ ID NO: 1243952 - RNA, 11 nt, Homo sapiens
ucugcauuuac

SEQ ID NO: 1243953 - RNA, 14 nt, Homo sapiens
ucugccaaacauua

SEQ ID NO: 1243954 - RNA, 13 nt, Homo sapiens
ucugccacccacu

SEQ ID NO: 1243955 - RNA, 19 nt, Homo sapiens
ucugccacccacucaggau

SEQ ID NO: 1243956 - RNA, 14 nt, Homo sapiens
ucugccaugcucug

SEQ ID NO: 1243957 - RNA, 19 nt, Homo sapiens
ucugccauuaaaacauuac

SEQ ID NO: 1243958 - RNA, 15 nt, Homo sapiens
ucugcccucauuacu

SEQ ID NO: 1243959 - RNA, 19 nt, Homo sapiens
ucugcccugccuacuuuua

SEQ ID NO: 1243960 - RNA, 14 nt, Homo sapiens
ucugcccuuuccua

SEQ ID NO: 1243961 - RNA, 13 nt, Homo sapiens
ucugccgccucag

SEQ ID NO: 1243962 - RNA, 16 nt, Homo sapiens
ucugccgcuaccuccc

SEQ ID NO: 1243963 - RNA, 19 nt, Homo sapiens
ucugccucugacacacagc

SEQ ID NO: 1243964 - RNA, 16 nt, Homo sapiens
ucugccugaagucaca

SEQ ID NO: 1243965 - RNA, 20 nt, Homo sapiens
ucugccuuaaaaccaaagag

SEQ ID NO: 1243966 - RNA, 14 nt, Homo sapiens
ucugcgcaccaagg

SEQ ID NO: 1243967 - RNA, 23 nt, Homo sapiens
ucugcgcuuggucuuucugugcu

SEQ ID NO: 1243968 - RNA, 18 nt, Homo sapiens
ucugcggaucucagcuuu

SEQ ID NO: 1243969 - RNA, 18 nt, Homo sapiens
ucugcuccucuccaggca

SEQ ID NO: 1243970 - RNA, 21 nt, Homo sapiens
ucugcucuagggaaucuggau

SEQ ID NO: 1243971 - RNA, 21 nt, Homo sapiens
ucugcugaaucaaaucucuuc

SEQ ID NO: 1243972 - RNA, 18 nt, Homo sapiens
ucugcugcauagcucuau

SEQ ID NO: 1243973 - RNA, 15 nt, Homo sapiens
ucugcuggugaauaa

SEQ ID NO: 1243974 - RNA, 20 nt, Homo sapiens
ucugcuuuucccauugccau

SEQ ID NO: 1243975 - RNA, 14 nt, Homo sapiens
ucuggaaaagcaaa

SEQ ID NO: 1243976 - RNA, 13 nt, Homo sapiens
ucuggaagaccug

SEQ ID NO: 1243977 - RNA, 16 nt, Homo sapiens
ucuggaagucaucuca

SEQ ID NO: 1243978 - RNA, 21 nt, Homo sapiens
ucuggaagucaucucauucca

SEQ ID NO: 1243979 - RNA, 13 nt, Homo sapiens
ucuggaaucugga

SEQ ID NO: 1243980 - RNA, 11 nt, Homo sapiens
ucuggacaaag

SEQ ID NO: 1243981 - RNA, 16 nt, Homo sapiens
ucuggacaccagggga

SEQ ID NO: 1243982 - RNA, 18 nt, Homo sapiens
ucuggagcuggcacugug

SEQ ID NO: 1243983 - RNA, 13 nt, Homo sapiens
ucuggauauuuca

SEQ ID NO: 1243984 - RNA, 16 nt, Homo sapiens
ucuggaucuccugacc

SEQ ID NO: 1243985 - RNA, 20 nt, Homo sapiens
ucuggauuagaaugccgguu

SEQ ID NO: 1243986 - RNA, 12 nt, Homo sapiens
ucuggauuucau

SEQ ID NO: 1243987 - RNA, 19 nt, Homo sapiens
ucuggcaagccugucuuca

SEQ ID NO: 1243988 - RNA, 20 nt, Homo sapiens
ucuggcaucuuagaccucca

SEQ ID NO: 1243989 - RNA, 19 nt, Homo sapiens
ucuggcauuuguuuccuca

SEQ ID NO: 1243990 - RNA, 16 nt, Homo sapiens
ucuggcccuucuugcc

SEQ ID NO: 1243991 - RNA, 18 nt, Homo sapiens
ucuggcucccaucaccuc

SEQ ID NO: 1243992 - RNA, 19 nt, Homo sapiens
ucuggcucuugaggcauuu

SEQ ID NO: 1243993 - RNA, 16 nt, Homo sapiens
ucuggcuuagugccac

SEQ ID NO: 1243994 - RNA, 22 nt, Homo sapiens
ucugggacugugcgcuggacuu

SEQ ID NO: 1243995 - RNA, 15 nt, Homo sapiens
ucugggagucacaca

SEQ ID NO: 1243996 - RNA, 23 nt, Homo sapiens
ucugggaguuauaggucauggga

SEQ ID NO: 1243997 - RNA, 18 nt, Homo sapiens
ucugggauuaagggcaaa

SEQ ID NO: 1243998 - RNA, 12 nt, Homo sapiens
ucugggccagug

SEQ ID NO: 1243999 - RNA, 18 nt, Homo sapiens
ucugggcugccaugugaa

SEQ ID NO: 1244000 - RNA, 20 nt, Homo sapiens
ucugggcuuggggcuuccua

SEQ ID NO: 1244001 - RNA, 18 nt, Homo sapiens
ucuggggugcugccugaa

SEQ ID NO: 1244002 - RNA, 14 nt, Homo sapiens
ucuggguccuugca

SEQ ID NO: 1244003 - RNA, 23 nt, Homo sapiens
ucugggucuuucugacaucagca

SEQ ID NO: 1244004 - RNA, 19 nt, Homo sapiens
ucugggugaccucacuuua

SEQ ID NO: 1244005 - RNA, 13 nt, Homo sapiens
ucugggugcagcu

SEQ ID NO: 1244006 - RNA, 15 nt, Homo sapiens
ucugguaaugaagca

SEQ ID NO: 1244007 - RNA, 16 nt, Homo sapiens
ucugguuuacuucaaa

SEQ ID NO: 1244008 - RNA, 16 nt, Homo sapiens
ucugguuuauuuccua

SEQ ID NO: 1244009 - RNA, 13 nt, Homo sapiens
ucuguaaauacca

SEQ ID NO: 1244010 - RNA, 22 nt, Homo sapiens
ucuguaaauaccauugacacau

SEQ ID NO: 1244011 - RNA, 12 nt, Homo sapiens
ucuguaaauacu

SEQ ID NO: 1244012 - RNA, 18 nt, Homo sapiens
ucuguaaguaacuucaca

SEQ ID NO: 1244013 - RNA, 19 nt, Homo sapiens
ucuguaauagugaacauau

SEQ ID NO: 1244014 - RNA, 22 nt, Homo sapiens
ucuguaaugauacugauuauga

SEQ ID NO: 1244015 - RNA, 16 nt, Homo sapiens
ucuguaaugguacuga

SEQ ID NO: 1244016 - RNA, 16 nt, Homo sapiens
ucuguacauagccuau

SEQ ID NO: 1244017 - RNA, 22 nt, Homo sapiens
ucuguacccuuuuccaucaugu

SEQ ID NO: 1244018 - RNA, 12 nt, Homo sapiens
ucuguaccucaa

SEQ ID NO: 1244019 - RNA, 18 nt, Homo sapiens
ucuguacgucugacaggc

SEQ ID NO: 1244020 - RNA, 16 nt, Homo sapiens
ucuguagccuccuuug

SEQ ID NO: 1244021 - RNA, 15 nt, Homo sapiens
ucuguagggaacucu

SEQ ID NO: 1244022 - RNA, 13 nt, Homo sapiens
ucuguagggauuu

SEQ ID NO: 1244023 - RNA, 15 nt, Homo sapiens
ucuguaguaaacuau

SEQ ID NO: 1244024 - RNA, 15 nt, Homo sapiens
ucuguauguguucaa

SEQ ID NO: 1244025 - RNA, 20 nt, Homo sapiens
ucuguauuacagcuuucaca

SEQ ID NO: 1244026 - RNA, 21 nt, Homo sapiens
ucuguauugggguacaggaau

SEQ ID NO: 1244027 - RNA, 18 nt, Homo sapiens
ucugucaccaacugaagu

SEQ ID NO: 1244028 - RNA, 23 nt, Homo sapiens
ucugucaccaacugaaguggcua

SEQ ID NO: 1244029 - RNA, 21 nt, Homo sapiens
ucugucaccagcuaucuguca

SEQ ID NO: 1244030 - RNA, 19 nt, Homo sapiens
ucugucagaaugcuauuga

SEQ ID NO: 1244031 - RNA, 16 nt, Homo sapiens
ucugucaucucucugg

SEQ ID NO: 1244032 - RNA, 15 nt, Homo sapiens
ucugucauuauauuc

SEQ ID NO: 1244033 - RNA, 19 nt, Homo sapiens
ucuguccacgauucacuca

SEQ ID NO: 1244034 - RNA, 17 nt, Homo sapiens
ucuguuccccauggcca

SEQ ID NO: 1244035 - RNA, 23 nt, Homo sapiens
ucuguucuguuggaugacuuuga

SEQ ID NO: 1244036 - RNA, 17 nt, Homo sapiens
ucuguugaggcaucaaa

SEQ ID NO: 1244037 - RNA, 16 nt, Homo sapiens
ucuguugaguugcugc

SEQ ID NO: 1244038 - RNA, 17 nt, Homo sapiens
ucuguuggccaguguga

SEQ ID NO: 1244039 - RNA, 13 nt, Homo sapiens
ucuguuucuaguu

SEQ ID NO: 1244040 - RNA, 14 nt, Homo sapiens
ucuguuuugcacag

SEQ ID NO: 1244041 - RNA, 18 nt, Homo sapiens
ucuuaaaacacuuuucaa

SEQ ID NO: 1244042 - RNA, 21 nt, Homo sapiens
ucuuaaacuaaaugugcaaua

SEQ ID NO: 1244043 - RNA, 23 nt, Homo sapiens
ucuuaaauguagcaauggcacug

SEQ ID NO: 1244044 - RNA, 19 nt, Homo sapiens
ucuuaaauguuuauacugu

SEQ ID NO: 1244045 - RNA, 19 nt, Homo sapiens
ucuuaacccccuagaaaga

SEQ ID NO: 1244046 - RNA, 22 nt, Homo sapiens
ucuuaagauccacaaaugaagg

SEQ ID NO: 1244047 - RNA, 18 nt, Homo sapiens
ucuuaagcagcauggaaa

SEQ ID NO: 1244048 - RNA, 18 nt, Homo sapiens
ucuuaagccuaaaugccu

SEQ ID NO: 1244049 - RNA, 15 nt, Homo sapiens
ucuuaauaaucucau

SEQ ID NO: 1244050 - RNA, 21 nt, Homo sapiens
ucuuacguucuuucacuucaa

SEQ ID NO: 1244051 - RNA, 14 nt, Homo sapiens
ucuuacuacacuga

SEQ ID NO: 1244052 - RNA, 22 nt, Homo sapiens
ucuuacugcaggcaagugggau

SEQ ID NO: 1244053 - RNA, 23 nt, Homo sapiens
ucuuacuguaccuguuccuuaga

SEQ ID NO: 1244054 - RNA, 17 nt, Homo sapiens
ucuuacuugacuugaau

SEQ ID NO: 1244055 - RNA, 22 nt, Homo sapiens
ucuuacuuugaguuagugccau

SEQ ID NO: 1244056 - RNA, 20 nt, Homo sapiens
ucuuagaagcacuacaccuu

SEQ ID NO: 1244057 - RNA, 20 nt, Homo sapiens
ucuuagcacaccuacaccuc

SEQ ID NO: 1244058 - RNA, 21 nt, Homo sapiens
ucuuagcagcuuccagauuga

SEQ ID NO: 1244059 - RNA, 14 nt, Homo sapiens
ucuuaguuguucag

SEQ ID NO: 1244060 - RNA, 18 nt, Homo sapiens
ucuuauaauacucuguug

SEQ ID NO: 1244061 - RNA, 13 nt, Homo sapiens
ucuuauacaacag

SEQ ID NO: 1244062 - RNA, 21 nt, Homo sapiens
ucuuauccaacaucaacaucu

SEQ ID NO: 1244063 - RNA, 22 nt, Homo sapiens
ucuuaugauuacuaucauggca

SEQ ID NO: 1244064 - RNA, 12 nt, Homo sapiens
ucuuaugccauu

SEQ ID NO: 1244065 - RNA, 19 nt, Homo sapiens
ucuuauucccaaacuacag

SEQ ID NO: 1244066 - RNA, 19 nt, Homo sapiens
ucuuauucuuuuguaauau

SEQ ID NO: 1244067 - RNA, 12 nt, Homo sapiens
ucuuauugcaaa

SEQ ID NO: 1244068 - RNA, 14 nt, Homo sapiens
ucuuauuuccucaa

SEQ ID NO: 1244069 - RNA, 22 nt, Homo sapiens
ucuucaaccucauugacaagaa

SEQ ID NO: 1244070 - RNA, 14 nt, Homo sapiens
ucuucaagaccaaa

SEQ ID NO: 1244071 - RNA, 22 nt, Homo sapiens
ucuucaagacgacagcucugua

SEQ ID NO: 1244072 - RNA, 13 nt, Homo sapiens
ucuucacucagga

SEQ ID NO: 1244073 - RNA, 20 nt, Homo sapiens
ucuucacucaggacacaaac

SEQ ID NO: 1244074 - RNA, 14 nt, Homo sapiens
ucuucacugccagg

SEQ ID NO: 1244075 - RNA, 17 nt, Homo sapiens
ucuucacuggcuuccau

SEQ ID NO: 1244076 - RNA, 15 nt, Homo sapiens
ucuucacugugguca

SEQ ID NO: 1244077 - RNA, 20 nt, Homo sapiens
ucuucacuuccccacaggcu

SEQ ID NO: 1244078 - RNA, 18 nt, Homo sapiens
ucuucagaacuugucagg

SEQ ID NO: 1244079 - RNA, 16 nt, Homo sapiens
ucuucagaagacacug

SEQ ID NO: 1244080 - RNA, 21 nt, Homo sapiens
ucuucagagagcuaaauuaca

SEQ ID NO: 1244081 - RNA, 18 nt, Homo sapiens
ucuucagauacaaacugc

SEQ ID NO: 1244082 - RNA, 21 nt, Homo sapiens
ucuucagggaacugcauagau

SEQ ID NO: 1244083 - RNA, 15 nt, Homo sapiens
ucuucagggccaguc

SEQ ID NO: 1244084 - RNA, 16 nt, Homo sapiens
ucuucagggccagucc

SEQ ID NO: 1244085 - RNA, 18 nt, Homo sapiens
ucuucaugaccuacuuca

SEQ ID NO: 1244086 - RNA, 20 nt, Homo sapiens
ucuucaugcuuuugcuugca

SEQ ID NO: 1244087 - RNA, 19 nt, Homo sapiens
ucuuccacaaaaaauacuu

SEQ ID NO: 1244088 - RNA, 22 nt, Homo sapiens
ucuuccacccauucccccaugu

SEQ ID NO: 1244089 - RNA, 23 nt, Homo sapiens
ucuuccacuggaaaaguguaaua

SEQ ID NO: 1244090 - RNA, 16 nt, Homo sapiens
ucuuccagaccugcuu

SEQ ID NO: 1244091 - RNA, 12 nt, Homo sapiens
ucuuccaugacc

SEQ ID NO: 1244092 - RNA, 12 nt, Homo sapiens
ucuuccauucca

SEQ ID NO: 1244093 - RNA, 19 nt, Homo sapiens
ucuucccacaccugucagc

SEQ ID NO: 1244094 - RNA, 15 nt, Homo sapiens
ucuucccuaccucag

SEQ ID NO: 1244095 - RNA, 18 nt, Homo sapiens
ucuucccuaccucaggca

SEQ ID NO: 1244096 - RNA, 19 nt, Homo sapiens
ucuucccucagaaacuaga

SEQ ID NO: 1244097 - RNA, 21 nt, Homo sapiens
ucuuccucccucauuccaccu

SEQ ID NO: 1244098 - RNA, 14 nt, Homo sapiens
ucuuccugacacuu

SEQ ID NO: 1244099 - RNA, 19 nt, Homo sapiens
ucuuccugaguggugccaa

SEQ ID NO: 1244100 - RNA, 16 nt, Homo sapiens
ucuuccugcacccaca

SEQ ID NO: 1244101 - RNA, 16 nt, Homo sapiens
ucuuccuuagacuuac

SEQ ID NO: 1244102 - RNA, 16 nt, Homo sapiens
ucuuccuuucuaaucc

SEQ ID NO: 1244103 - RNA, 21 nt, Homo sapiens
ucuucgcccugcguuccuucc

SEQ ID NO: 1244104 - RNA, 15 nt, Homo sapiens
ucuucuaaauggcaa

SEQ ID NO: 1244105 - RNA, 14 nt, Homo sapiens
ucuucuaacacaaa

SEQ ID NO: 1244106 - RNA, 16 nt, Homo sapiens
ucuucuaccauuugaa

SEQ ID NO: 1244107 - RNA, 14 nt, Homo sapiens
ucuucuacugcuau

SEQ ID NO: 1244108 - RNA, 14 nt, Homo sapiens
ucuucucaagaucc

SEQ ID NO: 1244109 - RNA, 16 nt, Homo sapiens
ucuucucaaguucuaa

SEQ ID NO: 1244110 - RNA, 20 nt, Homo sapiens
ucuucuccuaaaacuuuaaa

SEQ ID NO: 1244111 - RNA, 23 nt, Homo sapiens
ucuucugacaaacuguguacaua

SEQ ID NO: 1244112 - RNA, 16 nt, Homo sapiens
ucuucugggaacuucc

SEQ ID NO: 1244113 - RNA, 20 nt, Homo sapiens
ucuucuugugauugcugcca

SEQ ID NO: 1244114 - RNA, 14 nt, Homo sapiens
ucuucuuugcugca

SEQ ID NO: 1244115 - RNA, 22 nt, Homo sapiens
ucuucuuuuggcuuccaugaug

SEQ ID NO: 1244116 - RNA, 15 nt, Homo sapiens
ucuugaauguggucu

SEQ ID NO: 1244117 - RNA, 15 nt, Homo sapiens
ucuugacuuccccac

SEQ ID NO: 1244118 - RNA, 16 nt, Homo sapiens
ucuugaggcauuucca

SEQ ID NO: 1244119 - RNA, 22 nt, Homo sapiens
ucuugaguucuggaagggacuu

SEQ ID NO: 1244120 - RNA, 17 nt, Homo sapiens
ucuugaucuguguuuua

SEQ ID NO: 1244121 - RNA, 18 nt, Homo sapiens
ucuugcaacucuguaaau

SEQ ID NO: 1244122 - RNA, 13 nt, Homo sapiens
ucuugcaccccaa

SEQ ID NO: 1244123 - RNA, 15 nt, Homo sapiens
ucuugcagcuguaaa

SEQ ID NO: 1244124 - RNA, 20 nt, Homo sapiens
ucuugccccagugugguuug

SEQ ID NO: 1244125 - RNA, 17 nt, Homo sapiens
ucuugccucucucagga

SEQ ID NO: 1244126 - RNA, 19 nt, Homo sapiens
ucuugcugcuagaacuuuu

SEQ ID NO: 1244127 - RNA, 17 nt, Homo sapiens
ucuugcugggcauacuu

SEQ ID NO: 1244128 - RNA, 19 nt, Homo sapiens
ucuuggaaaaaaaccacag

SEQ ID NO: 1244129 - RNA, 17 nt, Homo sapiens
ucuuggaauuacaagcc

SEQ ID NO: 1244130 - RNA, 14 nt, Homo sapiens
ucuuggcguggcag

SEQ ID NO: 1244131 - RNA, 17 nt, Homo sapiens
ucuuggcuuaaucauuu

SEQ ID NO: 1244132 - RNA, 21 nt, Homo sapiens
ucuugggcuuugcuagccugu

SEQ ID NO: 1244133 - RNA, 16 nt, Homo sapiens
ucuuggguucccaaau

SEQ ID NO: 1244134 - RNA, 18 nt, Homo sapiens
ucuuugagggacugccuc

SEQ ID NO: 1244135 - RNA, 20 nt, Homo sapiens
ucuuugcaccaaagacauca

SEQ ID NO: 1244136 - RNA, 17 nt, Homo sapiens
ucuuugccuuuaucucu

SEQ ID NO: 1244137 - RNA, 18 nt, Homo sapiens
ucuuugcucccugcaaga

SEQ ID NO: 1244138 - RNA, 19 nt, Homo sapiens
ucuuugcucccugcaagaa

SEQ ID NO: 1244139 - RNA, 19 nt, Homo sapiens
ucuuuggaaaguacacucu

SEQ ID NO: 1244140 - RNA, 21 nt, Homo sapiens
ucuuuggggguuagaccacuu

SEQ ID NO: 1244141 - RNA, 22 nt, Homo sapiens
ucuuuguaaagaaaguggcuug

SEQ ID NO: 1244142 - RNA, 19 nt, Homo sapiens
ucuuugucaccacgugggg

SEQ ID NO: 1244143 - RNA, 21 nt, Homo sapiens
ucuuugucaccacguggggcu

SEQ ID NO: 1244144 - RNA, 18 nt, Homo sapiens
ucuuuugaacaaaugaca

SEQ ID NO: 1244145 - RNA, 14 nt, Homo sapiens
ucuuuugaguggua

SEQ ID NO: 1244146 - RNA, 19 nt, Homo sapiens
ucuuuuggggaagcuuucu

SEQ ID NO: 1244147 - RNA, 18 nt, Homo sapiens
ucuuuuuaaaauggugcu

SEQ ID NO: 1244148 - RNA, 19 nt, Homo sapiens
ucuuuuuaaguaaugugga

SEQ ID NO: 1244149 - RNA, 16 nt, Homo sapiens
ugaaaaaaaacagugg

SEQ ID NO: 1244150 - RNA, 23 nt, Homo sapiens
ugaaaaaagguuguguagcugug

SEQ ID NO: 1244151 - RNA, 19 nt, Homo sapiens
ugaaaaacauuccaggaaa

SEQ ID NO: 1244152 - RNA, 23 nt, Homo sapiens
ugaaaaaguagauugaguauaaa

SEQ ID NO: 1244153 - RNA, 12 nt, Homo sapiens
ugaaaacagcua

SEQ ID NO: 1244154 - RNA, 14 nt, Homo sapiens
ugaaaaccaucugg

SEQ ID NO: 1244155 - RNA, 22 nt, Homo sapiens
ugaaaacugugcaauguauuaa

SEQ ID NO: 1244156 - RNA, 14 nt, Homo sapiens
ugaaaacuucaaag

SEQ ID NO: 1244157 - RNA, 16 nt, Homo sapiens
ugaaaagaagccucag

SEQ ID NO: 1244158 - RNA, 17 nt, Homo sapiens
ugaaaagacucaguguu

SEQ ID NO: 1244159 - RNA, 17 nt, Homo sapiens
ugaaaagguugccugaa

SEQ ID NO: 1244160 - RNA, 17 nt, Homo sapiens
ugaaaaguuacuaccug

SEQ ID NO: 1244161 - RNA, 13 nt, Homo sapiens
ugaaaauaaagca

SEQ ID NO: 1244162 - RNA, 21 nt, Homo sapiens
ugaaaauaaagcagaagcaac

SEQ ID NO: 1244163 - RNA, 11 nt, Homo sapiens
ugaaaauaacu

SEQ ID NO: 1244164 - RNA, 20 nt, Homo sapiens
ugaaaauauuucucuagugu

SEQ ID NO: 1244165 - RNA, 17 nt, Homo sapiens
ugaaaaucaucacucaa

SEQ ID NO: 1244166 - RNA, 14 nt, Homo sapiens
ugaaaaugaaagga

SEQ ID NO: 1244167 - RNA, 14 nt, Homo sapiens
ugaaaaugaaccau

SEQ ID NO: 1244168 - RNA, 16 nt, Homo sapiens
ugaaaaugaauaucua

SEQ ID NO: 1244169 - RNA, 11 nt, Homo sapiens
ugaaaauugca

SEQ ID NO: 1244170 - RNA, 23 nt, Homo sapiens
ugaaaauuuauuuuuagugauaa

SEQ ID NO: 1244171 - RNA, 16 nt, Homo sapiens
ugaaaauuuuacuucc

SEQ ID NO: 1244172 - RNA, 22 nt, Homo sapiens
ugaaacaaaaauugucuuuaug

SEQ ID NO: 1244173 - RNA, 21 nt, Homo sapiens
ugaaacacaauaccuacaaua

SEQ ID NO: 1244174 - RNA, 24 nt, Homo sapiens
ugaaacacccaucguucucugcua

SEQ ID NO: 1244175 - RNA, 21 nt, Homo sapiens
ugaaacacucaguuguucaau

SEQ ID NO: 1244176 - RNA, 15 nt, Homo sapiens
ugaaaccaaaacaua

SEQ ID NO: 1244177 - RNA, 14 nt, Homo sapiens
ugaaaccaugacug

SEQ ID NO: 1244178 - RNA, 15 nt, Homo sapiens
ugaaaccccaucucu

SEQ ID NO: 1244179 - RNA, 20 nt, Homo sapiens
ugaaaccccaucucuacuga

SEQ ID NO: 1244180 - RNA, 22 nt, Homo sapiens
ugaaacccccacccuucugccu

SEQ ID NO: 1244181 - RNA, 15 nt, Homo sapiens
ugaaaccccgucucu

SEQ ID NO: 1244182 - RNA, 18 nt, Homo sapiens
ugaaaccuacacacuguc

SEQ ID NO: 1244183 - RNA, 19 nt, Homo sapiens
ugaaacucauagacacuga

SEQ ID NO: 1244184 - RNA, 15 nt, Homo sapiens
ugaaacuuauaguua

SEQ ID NO: 1244185 - RNA, 20 nt, Homo sapiens
ugaaacuucauaaauguuca

SEQ ID NO: 1244186 - RNA, 23 nt, Homo sapiens
ugaaacuuguuuauuauguacaa

SEQ ID NO: 1244187 - RNA, 13 nt, Homo sapiens
ugaaagaaaccac

SEQ ID NO: 1244188 - RNA, 21 nt, Homo sapiens
ugaaagaacauggacuuguau

SEQ ID NO: 1244189 - RNA, 22 nt, Homo sapiens
ugaaagaagagaugagaaauga

SEQ ID NO: 1244190 - RNA, 20 nt, Homo sapiens
ugaaagauugauuaaugaac

SEQ ID NO: 1244191 - RNA, 14 nt, Homo sapiens
ugaaagcucagcug

SEQ ID NO: 1244192 - RNA, 13 nt, Homo sapiens
ugaaagggcaaua

SEQ ID NO: 1244193 - RNA, 13 nt, Homo sapiens
ugaaaguguaaaa

SEQ ID NO: 1244194 - RNA, 15 nt, Homo sapiens
ugaaauaaaugacaa

SEQ ID NO: 1244195 - RNA, 14 nt, Homo sapiens
ugaaauaccacaag

SEQ ID NO: 1244196 - RNA, 14 nt, Homo sapiens
ugaaauaugcaucu

SEQ ID NO: 1244197 - RNA, 15 nt, Homo sapiens
ugaaaugaaaacaug

SEQ ID NO: 1244198 - RNA, 13 nt, Homo sapiens
ugaaaugaccucu

SEQ ID NO: 1244199 - RNA, 16 nt, Homo sapiens
ugaaaugcaucagguc

SEQ ID NO: 1244200 - RNA, 18 nt, Homo sapiens
ugaaaugcuggcauuugc

SEQ ID NO: 1244201 - RNA, 17 nt, Homo sapiens
ugaaauuaagaaggcaa

SEQ ID NO: 1244202 - RNA, 21 nt, Homo sapiens
ugaaauucacccccuuuccug

SEQ ID NO: 1244203 - RNA, 22 nt, Homo sapiens
ugaaauuguaagugaaguaaaa

SEQ ID NO: 1244204 - RNA, 16 nt, Homo sapiens
ugaaauuguaucucag

SEQ ID NO: 1244205 - RNA, 20 nt, Homo sapiens
ugaaauuuguuauacuucaa

SEQ ID NO: 1244206 - RNA, 20 nt, Homo sapiens
ugaaauuuuaaccuaugaua

SEQ ID NO: 1244207 - RNA, 16 nt, Homo sapiens
ugaaauuuuaauugaa

SEQ ID NO: 1244208 - RNA, 15 nt, Homo sapiens
ugaacaaacuaaagg

SEQ ID NO: 1244209 - RNA, 13 nt, Homo sapiens
ugaacaaaugaca

SEQ ID NO: 1244210 - RNA, 18 nt, Homo sapiens
ugaacaaucaaagcacuu

SEQ ID NO: 1244211 - RNA, 16 nt, Homo sapiens
ugaacacaggcagcuu

SEQ ID NO: 1244212 - RNA, 12 nt, Homo sapiens
ugaacacaucuu

SEQ ID NO: 1244213 - RNA, 12 nt, Homo sapiens
ugaacacucccc

SEQ ID NO: 1244214 - RNA, 19 nt, Homo sapiens
ugaacacucuacuacaugu

SEQ ID NO: 1244215 - RNA, 15 nt, Homo sapiens
ugaacacuguucuac

SEQ ID NO: 1244216 - RNA, 20 nt, Homo sapiens
ugaacagagagcgcuuuugu

SEQ ID NO: 1244217 - RNA, 15 nt, Homo sapiens
ugaacagcauuagaa

SEQ ID NO: 1244218 - RNA, 18 nt, Homo sapiens
ugaacaguguauaggaag

SEQ ID NO: 1244219 - RNA, 22 nt, Homo sapiens
ugaacauccccucccaucauua

SEQ ID NO: 1244220 - RNA, 21 nt, Homo sapiens
ugaacaucuuuaggagacuaa

SEQ ID NO: 1244221 - RNA, 11 nt, Homo sapiens
ugaacauuuca

SEQ ID NO: 1244222 - RNA, 23 nt, Homo sapiens
ugaacauuuugcaaaacuuauca

SEQ ID NO: 1244223 - RNA, 15 nt, Homo sapiens
ugaacuaacugacag

SEQ ID NO: 1244224 - RNA, 19 nt, Homo sapiens
ugaacuagauugcaugcuu

SEQ ID NO: 1244225 - RNA, 22 nt, Homo sapiens
ugaacuagauugcaugcuuccu

SEQ ID NO: 1244226 - RNA, 18 nt, Homo sapiens
ugaacuagggaagcucag

SEQ ID NO: 1244227 - RNA, 18 nt, Homo sapiens
ugaacucuucaaucucuu

SEQ ID NO: 1244228 - RNA, 17 nt, Homo sapiens
ugaacucuuucuggccu

SEQ ID NO: 1244229 - RNA, 18 nt, Homo sapiens
ugaacugaaguuucacau

SEQ ID NO: 1244230 - RNA, 17 nt, Homo sapiens
ugaacuugcauugugau

SEQ ID NO: 1244231 - RNA, 20 nt, Homo sapiens
ugaagaaaagcacuuuuuaa

SEQ ID NO: 1244232 - RNA, 19 nt, Homo sapiens
ugaagaacacagcaugugc

SEQ ID NO: 1244233 - RNA, 23 nt, Homo sapiens
ugaagaagagacucuuugcauau

SEQ ID NO: 1244234 - RNA, 17 nt, Homo sapiens
ugcaggagagacaguga

SEQ ID NO: 1244235 - RNA, 21 nt, Homo sapiens
ugcaggagagucgggggacca

SEQ ID NO: 1244236 - RNA, 15 nt, Homo sapiens
ugcaggagcgugaag

SEQ ID NO: 1244237 - RNA, 22 nt, Homo sapiens
ugcaggcccuuugaagccucag

SEQ ID NO: 1244238 - RNA, 16 nt, Homo sapiens
ugcaggccuggcugca

SEQ ID NO: 1244239 - RNA, 22 nt, Homo sapiens
ugcagggaagccccacuugaag

SEQ ID NO: 1244240 - RNA, 13 nt, Homo sapiens
ugcagggagcuca

SEQ ID NO: 1244241 - RNA, 18 nt, Homo sapiens
ugcagguuuguuacauag

SEQ ID NO: 1244242 - RNA, 19 nt, Homo sapiens
ugcaguacaagaaccucuc

SEQ ID NO: 1244243 - RNA, 21 nt, Homo sapiens
ugcaguacuuaauguuuguaa

SEQ ID NO: 1244244 - RNA, 22 nt, Homo sapiens
ugcaguaggggcuacugugacc

SEQ ID NO: 1244245 - RNA, 17 nt, Homo sapiens
ugcaguaugggaucuga

SEQ ID NO: 1244246 - RNA, 15 nt, Homo sapiens
ugcagucaucuacuu

SEQ ID NO: 1244247 - RNA, 20 nt, Homo sapiens
ugcaguggcaccaucucagu

SEQ ID NO: 1244248 - RNA, 18 nt, Homo sapiens
ugcaguggcgugaucucg

SEQ ID NO: 1244249 - RNA, 18 nt, Homo sapiens
ugcagugguaugaucacg

SEQ ID NO: 1244250 - RNA, 21 nt, Homo sapiens
ugcaguucaccugcacuuaag

SEQ ID NO: 1244251 - RNA, 14 nt, Homo sapiens
ugcaguucuucauc

SEQ ID NO: 1244252 - RNA, 19 nt, Homo sapiens
ugcauagagcccuggccag

SEQ ID NO: 1244253 - RNA, 13 nt, Homo sapiens
ugcauagcucuau

SEQ ID NO: 1244254 - RNA, 14 nt, Homo sapiens
ugcauaggaaguau

SEQ ID NO: 1244255 - RNA, 15 nt, Homo sapiens
ugcauaggcucuuaa

SEQ ID NO: 1244256 - RNA, 17 nt, Homo sapiens
ugcauagugcugggaug

SEQ ID NO: 1244257 - RNA, 20 nt, Homo sapiens
ugaggcccauucuucacucu

SEQ ID NO: 1244258 - RNA, 21 nt, Homo sapiens
ugaggcccauucuucacucug

SEQ ID NO: 1244259 - RNA, 16 nt, Homo sapiens
ugaggcccugcccaau

SEQ ID NO: 1244260 - RNA, 18 nt, Homo sapiens
ugaggccuggacuuuccu

SEQ ID NO: 1244261 - RNA, 22 nt, Homo sapiens
ugaggcugcgagagaaagggag

SEQ ID NO: 1244262 - RNA, 13 nt, Homo sapiens
ugaggcugucagu

SEQ ID NO: 1244263 - RNA, 15 nt, Homo sapiens
ugaggcuuccaggcu

SEQ ID NO: 1244264 - RNA, 22 nt, Homo sapiens
ugagggcaguucugaguguuua

SEQ ID NO: 1244265 - RNA, 15 nt, Homo sapiens
ugagggcauggguaa

SEQ ID NO: 1244266 - RNA, 23 nt, Homo sapiens
ugaggggaggaguuccacagauu

SEQ ID NO: 1244267 - RNA, 13 nt, Homo sapiens
ugaggggugcugg

SEQ ID NO: 1244268 - RNA, 11 nt, Homo sapiens
ugagggucccc

SEQ ID NO: 1244269 - RNA, 18 nt, Homo sapiens
ugagggugcugacuggcu

SEQ ID NO: 1244270 - RNA, 21 nt, Homo sapiens
ugaggguguuucuuccugcac

SEQ ID NO: 1244271 - RNA, 19 nt, Homo sapiens
ugaggguucaccucugccu

SEQ ID NO: 1244272 - RNA, 22 nt, Homo sapiens
ugagguacagcagaaaggagaa

SEQ ID NO: 1244273 - RNA, 19 nt, Homo sapiens
ugagguggugccuucucac

SEQ ID NO: 1244274 - RNA, 18 nt, Homo sapiens
ugaguaacaggugccuuc

SEQ ID NO: 1244275 - RNA, 15 nt, Homo sapiens
ugaguaagauuuacc

SEQ ID NO: 1244276 - RNA, 17 nt, Homo sapiens
ugaguacauauuguggu

SEQ ID NO: 1244277 - RNA, 15 nt, Homo sapiens
ugagucaaugugcag

SEQ ID NO: 1244278 - RNA, 17 nt, Homo sapiens
ugagucaaugugcagug

SEQ ID NO: 1244279 - RNA, 14 nt, Homo sapiens
ugaguccauuagcu

SEQ ID NO: 1244280 - RNA, 24 nt, Homo sapiens
ugagucccccagagaugucaucag

SEQ ID NO: 1244281 - RNA, 13 nt, Homo sapiens
aacccggcacugc

SEQ ID NO: 1244282 - RNA, 18 nt, Homo sapiens
aacccggggcuggugggc

SEQ ID NO: 1244283 - RNA, 18 nt, Homo sapiens
aacccucacaagcaugaa

SEQ ID NO: 1244284 - RNA, 21 nt, Homo sapiens
aacccuggucuccguggcacu

SEQ ID NO: 1244285 - RNA, 15 nt, Homo sapiens
aacccuuaacugaca

SEQ ID NO: 1244286 - RNA, 21 nt, Homo sapiens
aacccuuacauuaugcuauga

SEQ ID NO: 1244287 - RNA, 20 nt, Homo sapiens
aaccgacacuccuacaagau

SEQ ID NO: 1244288 - RNA, 16 nt, Homo sapiens
aaccgcacaugcacac

SEQ ID NO: 1244289 - RNA, 16 nt, Homo sapiens
aaccggucacccagga

SEQ ID NO: 1244290 - RNA, 16 nt, Homo sapiens
aaccuaccagccagag

SEQ ID NO: 1244291 - RNA, 22 nt, Homo sapiens
aaccuagccuuagaagucacac

SEQ ID NO: 1244292 - RNA, 20 nt, Homo sapiens
aaccuaggcaaagaguauau

SEQ ID NO: 1244293 - RNA, 14 nt, Homo sapiens
aaccuaguacugcc

SEQ ID NO: 1244294 - RNA, 18 nt, Homo sapiens
aaccuauaaaaaggauuc

SEQ ID NO: 1244295 - RNA, 18 nt, Homo sapiens
aaccuauauuucaauacu

SEQ ID NO: 1244296 - RNA, 15 nt, Homo sapiens
aaccuauccuuccag

SEQ ID NO: 1244297 - RNA, 23 nt, Homo sapiens
aaccuaugauauuuucugugccu

SEQ ID NO: 1244298 - RNA, 20 nt, Homo sapiens
aaccucaaguaaacuccccu

SEQ ID NO: 1244299 - RNA, 17 nt, Homo sapiens
aaccucaccaacugcac

SEQ ID NO: 1244300 - RNA, 16 nt, Homo sapiens
aaccucaccauuguga

SEQ ID NO: 1244301 - RNA, 14 nt, Homo sapiens
aaccucacugagag

SEQ ID NO: 1244302 - RNA, 20 nt, Homo sapiens
aaccucaggcuuccuuggca

SEQ ID NO: 1244303 - RNA, 22 nt, Homo sapiens
aaccucauccaggcuaccaucc

SEQ ID NO: 1244304 - RNA, 14 nt, Homo sapiens
aaccucaucuuucu

SEQ ID NO: 1244305 - RNA, 21 nt, Homo sapiens
aaccucauuccccaaccacuu

SEQ ID NO: 1244306 - RNA, 14 nt, Homo sapiens
aaccucauugacaa

SEQ ID NO: 1244307 - RNA, 16 nt, Homo sapiens
aaccucauugcagcua

SEQ ID NO: 1244308 - RNA, 23 nt, Homo sapiens
aaccucauuggccagcucauaaa

SEQ ID NO: 1244309 - RNA, 13 nt, Homo sapiens
aaccuccacugcu

SEQ ID NO: 1244310 - RNA, 15 nt, Homo sapiens
aaccuccacugcugc

SEQ ID NO: 1244311 - RNA, 20 nt, Homo sapiens
aaccuccgccucccagguuc

SEQ ID NO: 1244312 - RNA, 14 nt, Homo sapiens
aaccuccuuuacca

SEQ ID NO: 1244313 - RNA, 18 nt, Homo sapiens
aaccucuaugcaaucuga

SEQ ID NO: 1244314 - RNA, 15 nt, Homo sapiens
aaccucugcacuacu

SEQ ID NO: 1244315 - RNA, 12 nt, Homo sapiens
aaccugaacuuu

SEQ ID NO: 1244316 - RNA, 17 nt, Homo sapiens
aaccugaagacugagga

SEQ ID NO: 1244317 - RNA, 21 nt, Homo sapiens
aaccugaauuaucuauuucau

SEQ ID NO: 1244318 - RNA, 20 nt, Homo sapiens
aaccugcagccccucaugcc

SEQ ID NO: 1244319 - RNA, 14 nt, Homo sapiens
aaccugcugugaua

SEQ ID NO: 1244320 - RNA, 16 nt, Homo sapiens
aaccuggagcacuuac

SEQ ID NO: 1244321 - RNA, 18 nt, Homo sapiens
aaccuggaguauaauauu

SEQ ID NO: 1244322 - RNA, 17 nt, Homo sapiens
aaccuggauccagcacu

SEQ ID NO: 1244323 - RNA, 23 nt, Homo sapiens
aaccuggccgcguuuagaccaag

SEQ ID NO: 1244324 - RNA, 17 nt, Homo sapiens
aaccuggugcuggauau

SEQ ID NO: 1244325 - RNA, 12 nt, Homo sapiens
aaccugucucac

SEQ ID NO: 1244326 - RNA, 22 nt, Homo sapiens
aaccugucuccacugugccuuu

SEQ ID NO: 1244327 - RNA, 13 nt, Homo sapiens
aaccugugaagcu

SEQ ID NO: 1244328 - RNA, 16 nt, Homo sapiens
aaccugugaagcugaa

SEQ ID NO: 1244329 - RNA, 14 nt, Homo sapiens
aaccugugugccau

SEQ ID NO: 1244330 - RNA, 22 nt, Homo sapiens
aaccuuaaagaaccaucagcau

SEQ ID NO: 1244331 - RNA, 19 nt, Homo sapiens
aaccuucacaucugucacg

SEQ ID NO: 1244332 - RNA, 21 nt, Homo sapiens
aaccuuccauucacaccagcu

SEQ ID NO: 1244333 - RNA, 19 nt, Homo sapiens
aaccuuccuuccugcuuga

SEQ ID NO: 1244334 - RNA, 23 nt, Homo sapiens
aaccuugcacaggucccacugcc

SEQ ID NO: 1244335 - RNA, 23 nt, Homo sapiens
aaccuugcuguccugaucuguga

SEQ ID NO: 1244336 - RNA, 14 nt, Homo sapiens
aaccuugugccuug

SEQ ID NO: 1244337 - RNA, 16 nt, Homo sapiens
aaccuuucaaauuuca

SEQ ID NO: 1244338 - RNA, 17 nt, Homo sapiens
aaccuuuggaagucaug

SEQ ID NO: 1244339 - RNA, 23 nt, Homo sapiens
aaccuuuuuuaagauuuuucuca

SEQ ID NO: 1244340 - RNA, 15 nt, Homo sapiens
aacgacaaagccaaa

SEQ ID NO: 1244341 - RNA, 13 nt, Homo sapiens
aacgacacauuca

SEQ ID NO: 1244342 - RNA, 12 nt, Homo sapiens
aacgcacaaaac

SEQ ID NO: 1244343 - RNA, 22 nt, Homo sapiens
aacgccacguguaguggcucau

SEQ ID NO: 1244344 - RNA, 22 nt, Homo sapiens
aacgccuggugccccagcacca

SEQ ID NO: 1244345 - RNA, 16 nt, Homo sapiens
aacgcguaucuaggcu

SEQ ID NO: 1244346 - RNA, 17 nt, Homo sapiens
aacggaagcugacauaa

SEQ ID NO: 1244347 - RNA, 16 nt, Homo sapiens
aacggagagugcuugg

SEQ ID NO: 1244348 - RNA, 18 nt, Homo sapiens
aacggcuccaggauuuua

SEQ ID NO: 1244349 - RNA, 12 nt, Homo sapiens
aacgggcauuuc

SEQ ID NO: 1244350 - RNA, 20 nt, Homo sapiens
aacggugcuugugucacuag

SEQ ID NO: 1244351 - RNA, 16 nt, Homo sapiens
aacgguuuuuagucuc

SEQ ID NO: 1244352 - RNA, 22 nt, Homo sapiens
aacguagcuucuaccaugaaca

SEQ ID NO: 1244353 - RNA, 22 nt, Homo sapiens
aacgucauguguuuugccaaag

SEQ ID NO: 1244354 - RNA, 15 nt, Homo sapiens
aacguccacaugaaa

SEQ ID NO: 1244355 - RNA, 14 nt, Homo sapiens
aacguggcacuggu

SEQ ID NO: 1244356 - RNA, 17 nt, Homo sapiens
aacgugucagaauccuu

SEQ ID NO: 1244357 - RNA, 14 nt, Homo sapiens
aacuaaauaaagcu

SEQ ID NO: 1244358 - RNA, 17 nt, Homo sapiens
aacuaagaaauaugcac

SEQ ID NO: 1244359 - RNA, 19 nt, Homo sapiens
aacuacaacgaacacaaga

SEQ ID NO: 1244360 - RNA, 17 nt, Homo sapiens
aacuacagaaguggaag

SEQ ID NO: 1244361 - RNA, 16 nt, Homo sapiens
aacuacauguaaucca

SEQ ID NO: 1244362 - RNA, 14 nt, Homo sapiens
aacuaccaucugau

SEQ ID NO: 1244363 - RNA, 13 nt, Homo sapiens
aacuagcuuuugc

SEQ ID NO: 1244364 - RNA, 12 nt, Homo sapiens
aacuagugaaau

SEQ ID NO: 1244365 - RNA, 15 nt, Homo sapiens
aacuauaacuguugg

SEQ ID NO: 1244366 - RNA, 18 nt, Homo sapiens
aacuauaagcccacuguu

SEQ ID NO: 1244367 - RNA, 17 nt, Homo sapiens
aacuauauguauucaca

SEQ ID NO: 1244368 - RNA, 17 nt, Homo sapiens
aacuauauucauuucca

SEQ ID NO: 1244369 - RNA, 13 nt, Homo sapiens
aacuauccugacu

SEQ ID NO: 1244370 - RNA, 22 nt, Homo sapiens
aacuaugaaaucaacugacaag

SEQ ID NO: 1244371 - RNA, 16 nt, Homo sapiens
aacuauguacuuuaaa

SEQ ID NO: 1244372 - RNA, 19 nt, Homo sapiens
aacuauguucacaagaaca

SEQ ID NO: 1244373 - RNA, 15 nt, Homo sapiens
aacuauuuacuauuc

SEQ ID NO: 1244374 - RNA, 20 nt, Homo sapiens
aacuauuucuacacaguggg

SEQ ID NO: 1244375 - RNA, 18 nt, Homo sapiens
aacucaaggacuuugcag

SEQ ID NO: 1244376 - RNA, 18 nt, Homo sapiens
aacucaaggauaccuucu

SEQ ID NO: 1244377 - RNA, 14 nt, Homo sapiens
aacucaagguucua

SEQ ID NO: 1244378 - RNA, 22 nt, Homo sapiens
aacucaauuucuugguauuauu

SEQ ID NO: 1244379 - RNA, 21 nt, Homo sapiens
aacucaccagccccacugcca

SEQ ID NO: 1244380 - RNA, 18 nt, Homo sapiens
aacucacggaccacucga

SEQ ID NO: 1244381 - RNA, 17 nt, Homo sapiens
aacucacugauucucua

SEQ ID NO: 1244382 - RNA, 23 nt, Homo sapiens
aacucacugauucucuacaugcu

SEQ ID NO: 1244383 - RNA, 23 nt, Homo sapiens
aacucacuuucccuugugucaag

SEQ ID NO: 1244384 - RNA, 19 nt, Homo sapiens
aacucagggacagagccau

SEQ ID NO: 1244385 - RNA, 15 nt, Homo sapiens
aacucaguccuguac

SEQ ID NO: 1244386 - RNA, 19 nt, Homo sapiens
aacucaguccuguacucug

SEQ ID NO: 1244387 - RNA, 22 nt, Homo sapiens
aacucaguccuguacucugggg

SEQ ID NO: 1244388 - RNA, 17 nt, Homo sapiens
aacucaguuucuaggca

SEQ ID NO: 1244389 - RNA, 21 nt, Homo sapiens
aacucauggaccacaguaaca

SEQ ID NO: 1244390 - RNA, 15 nt, Homo sapiens
aacuccaaaguccac

SEQ ID NO: 1244391 - RNA, 20 nt, Homo sapiens
aacuccagcaacuucuucuc

SEQ ID NO: 1244392 - RNA, 15 nt, Homo sapiens
aacuccuacuaaauc

SEQ ID NO: 1244393 - RNA, 15 nt, Homo sapiens
aacuccuggccucaa

SEQ ID NO: 1244394 - RNA, 14 nt, Homo sapiens
aacucuacauuuaa

SEQ ID NO: 1244395 - RNA, 19 nt, Homo sapiens
aacucuccuacacuuccau

SEQ ID NO: 1244396 - RNA, 21 nt, Homo sapiens
aacucucugguuuacuucaaa

SEQ ID NO: 1244397 - RNA, 18 nt, Homo sapiens
aacucugacaagggcuga

SEQ ID NO: 1244398 - RNA, 21 nt, Homo sapiens
aacucugagaucuaaggaugu

SEQ ID NO: 1244399 - RNA, 16 nt, Homo sapiens
aacucugcaaaggccu

SEQ ID NO: 1244400 - RNA, 16 nt, Homo sapiens
aacucugcacuacucc

SEQ ID NO: 1244401 - RNA, 12 nt, Homo sapiens
aacucuggaccc

SEQ ID NO: 1244402 - RNA, 15 nt, Homo sapiens
aacucugguuucuac

SEQ ID NO: 1244403 - RNA, 16 nt, Homo sapiens
aacucuguaaaaccuc

SEQ ID NO: 1244404 - RNA, 21 nt, Homo sapiens
aacucuguccacgauucacuc

SEQ ID NO: 1244405 - RNA, 14 nt, Homo sapiens
aacucuuacucuua

SEQ ID NO: 1244406 - RNA, 20 nt, Homo sapiens
aacucuucagaacacacaga

SEQ ID NO: 1244407 - RNA, 18 nt, Homo sapiens
aauauuuucucuguacuu

SEQ ID NO: 1244408 - RNA, 19 nt, Homo sapiens
aauauuuuguaaugcugca

SEQ ID NO: 1244409 - RNA, 21 nt, Homo sapiens
aauauuuuguaaugcugcaca

SEQ ID NO: 1244410 - RNA, 18 nt, Homo sapiens
aauauuuuuccacuuaaa

SEQ ID NO: 1244411 - RNA, 23 nt, Homo sapiens
aauauuuuucuaaagaaauuaca

SEQ ID NO: 1244412 - RNA, 14 nt, Homo sapiens
aaucaaagccaggg

SEQ ID NO: 1244413 - RNA, 15 nt, Homo sapiens
aaucaaaugauuuca

SEQ ID NO: 1244414 - RNA, 12 nt, Homo sapiens
aaucaacucuaa

SEQ ID NO: 1244415 - RNA, 22 nt, Homo sapiens
aaucaaucuuuaacaaccucug

SEQ ID NO: 1244416 - RNA, 14 nt, Homo sapiens
aaucaaugaauauu

SEQ ID NO: 1244417 - RNA, 18 nt, Homo sapiens
aaucacaagaagauuccc

SEQ ID NO: 1244418 - RNA, 15 nt, Homo sapiens
aaucacacugucuuc

SEQ ID NO: 1244419 - RNA, 14 nt, Homo sapiens
aaucacaucuccag

SEQ ID NO: 1244420 - RNA, 14 nt, Homo sapiens
aaucacucuguccu

SEQ ID NO: 1244421 - RNA, 15 nt, Homo sapiens
aaucacugcauuuca

SEQ ID NO: 1244422 - RNA, 11 nt, Homo sapiens
aaucacuggaa

SEQ ID NO: 1244423 - RNA, 23 nt, Homo sapiens
aaucacuggcuguuaaucuuuca

SEQ ID NO: 1244424 - RNA, 19 nt, Homo sapiens
aaucacuugccaaaaucca

SEQ ID NO: 1244425 - RNA, 13 nt, Homo sapiens
aaucagagacaaa

SEQ ID NO: 1244426 - RNA, 14 nt, Homo sapiens
aaucagaugcagcu

SEQ ID NO: 1244427 - RNA, 12 nt, Homo sapiens
aaucagcacuga

SEQ ID NO: 1244428 - RNA, 13 nt, Homo sapiens
aaucagcauuuag

SEQ ID NO: 1244429 - RNA, 23 nt, Homo sapiens
aaucagccauaagaaagcacuau

SEQ ID NO: 1244430 - RNA, 19 nt, Homo sapiens
aaucaggaauauuuuccaa

SEQ ID NO: 1244431 - RNA, 22 nt, Homo sapiens
aaucaggacagguggugcaaau

SEQ ID NO: 1244432 - RNA, 15 nt, Homo sapiens
aaucagucagccgcu

SEQ ID NO: 1244433 - RNA, 20 nt, Homo sapiens
aaucagucuauccacagaga

SEQ ID NO: 1244434 - RNA, 23 nt, Homo sapiens
aaucagugugucuaaauuugaau

SEQ ID NO: 1244435 - RNA, 13 nt, Homo sapiens
aaucauacugucu

SEQ ID NO: 1244436 - RNA, 21 nt, Homo sapiens
aaucauaguuuaaacugcauu

SEQ ID NO: 1244437 - RNA, 16 nt, Homo sapiens
aaucauauugaugaaa

SEQ ID NO: 1244438 - RNA, 24 nt, Homo sapiens
aaucaucuauaaagaagaacuugc

SEQ ID NO: 1244439 - RNA, 21 nt, Homo sapiens
aaucaucugcauuccugauga

SEQ ID NO: 1244440 - RNA, 21 nt, Homo sapiens
aaucaugaaauaugcaucuca

SEQ ID NO: 1244441 - RNA, 20 nt, Homo sapiens
aaucaugaacagcucugaga

SEQ ID NO: 1244442 - RNA, 15 nt, Homo sapiens
aaucaugugaggaaa

SEQ ID NO: 1244443 - RNA, 19 nt, Homo sapiens
aaucaugugaggaaaugau

SEQ ID NO: 1244444 - RNA, 19 nt, Homo sapiens
aaucauuucuagauuauaa

SEQ ID NO: 1244445 - RNA, 21 nt, Homo sapiens
aaucauuuguuuacauuugau

SEQ ID NO: 1244446 - RNA, 23 nt, Homo sapiens
aaucauuuuucacuguacauuau

SEQ ID NO: 1244447 - RNA, 16 nt, Homo sapiens
aauccaaacuaaucca

SEQ ID NO: 1244448 - RNA, 20 nt, Homo sapiens
aauccaaacuauuuccuaaa

SEQ ID NO: 1244449 - RNA, 17 nt, Homo sapiens
aauccagacucuuucga

SEQ ID NO: 1244450 - RNA, 11 nt, Homo sapiens
aauccagcucc

SEQ ID NO: 1244451 - RNA, 20 nt, Homo sapiens
aauccaguaggauccaguga

SEQ ID NO: 1244452 - RNA, 22 nt, Homo sapiens
aauccaguccagauauuucaca

SEQ ID NO: 1244453 - RNA, 16 nt, Homo sapiens
aauccagugagcacua

SEQ ID NO: 1244454 - RNA, 23 nt, Homo sapiens
aauccaucacuagccaugauaac

SEQ ID NO: 1244455 - RNA, 19 nt, Homo sapiens
aauccauccaaaguucccu

SEQ ID NO: 1244456 - RNA, 19 nt, Homo sapiens
aauccaugcuucucaucug

SEQ ID NO: 1244457 - RNA, 22 nt, Homo sapiens
aauccaugguguuauuuucuga

SEQ ID NO: 1244458 - RNA, 20 nt, Homo sapiens
aauccauguaaauugcaaau

SEQ ID NO: 1244459 - RNA, 22 nt, Homo sapiens
aauccauguaaauugcaaauaa

SEQ ID NO: 1244460 - RNA, 21 nt, Homo sapiens
aaucccagggaaggacuugga

SEQ ID NO: 1244461 - RNA, 14 nt, Homo sapiens
aaucccaguacuug

SEQ ID NO: 1244462 - RNA, 18 nt, Homo sapiens
aauccccaacaugcacug

SEQ ID NO: 1244463 - RNA, 13 nt, Homo sapiens
aauccccaugcuu

SEQ ID NO: 1244464 - RNA, 20 nt, Homo sapiens
aaucccuguuuaauauuuaa

SEQ ID NO: 1244465 - RNA, 20 nt, Homo sapiens
aauccgcauugauggccuca

SEQ ID NO: 1244466 - RNA, 20 nt, Homo sapiens
aauccuaagacacaaaugca

SEQ ID NO: 1244467 - RNA, 17 nt, Homo sapiens
aauccuuccacuaucau

SEQ ID NO: 1244468 - RNA, 17 nt, Homo sapiens
aauccuugccacagugu

SEQ ID NO: 1244469 - RNA, 18 nt, Homo sapiens
aauccuuuacuguuaguc

SEQ ID NO: 1244470 - RNA, 19 nt, Homo sapiens
aauccuuuacuguuaguca

SEQ ID NO: 1244471 - RNA, 19 nt, Homo sapiens
aaucggcuggggacugcua

SEQ ID NO: 1244472 - RNA, 17 nt, Homo sapiens
aaucuaccucugaaaaa

SEQ ID NO: 1244473 - RNA, 14 nt, Homo sapiens
aaucuacuaauucc

SEQ ID NO: 1244474 - RNA, 16 nt, Homo sapiens
aaucuacuaauuccac

SEQ ID NO: 1244475 - RNA, 17 nt, Homo sapiens
aaucuaggaagcucaga

SEQ ID NO: 1244476 - RNA, 14 nt, Homo sapiens
aaucuaugaugaag

SEQ ID NO: 1244477 - RNA, 18 nt, Homo sapiens
aaucucaaauaacuaaaa

SEQ ID NO: 1244478 - RNA, 14 nt, Homo sapiens
aaucucauucccag

SEQ ID NO: 1244479 - RNA, 16 nt, Homo sapiens
aaucucccacuccagc

SEQ ID NO: 1244480 - RNA, 13 nt, Homo sapiens
aaucucccaguga

SEQ ID NO: 1244481 - RNA, 14 nt, Homo sapiens
aaucucuaagccaa

SEQ ID NO: 1244482 - RNA, 15 nt, Homo sapiens
aaucucuaccccuuu

SEQ ID NO: 1244483 - RNA, 22 nt, Homo sapiens
aaucucugacuaaaaauacuua

SEQ ID NO: 1244484 - RNA, 20 nt, Homo sapiens
aaucucuguuauguacugua

SEQ ID NO: 1244485 - RNA, 21 nt, Homo sapiens
aaucucuguuauguacuguac

SEQ ID NO: 1244486 - RNA, 18 nt, Homo sapiens
aaucucuuuucuacauac

SEQ ID NO: 1244487 - RNA, 21 nt, Homo sapiens
aaucugaauaaauaauucuuc

SEQ ID NO: 1244488 - RNA, 13 nt, Homo sapiens
aaucugaccaaaa

SEQ ID NO: 1244489 - RNA, 21 nt, Homo sapiens
aaucugaccaaaacaaacaaa

SEQ ID NO: 1244490 - RNA, 13 nt, Homo sapiens
aaucugagcugca

SEQ ID NO: 1244491 - RNA, 17 nt, Homo sapiens
aaucuguaagcucuuug

SEQ ID NO: 1244492 - RNA, 17 nt, Homo sapiens
aaucuguaauugcuuau

SEQ ID NO: 1244493 - RNA, 20 nt, Homo sapiens
aaucuguauauguuguaaua

SEQ ID NO: 1244494 - RNA, 18 nt, Homo sapiens
aaucuguccgugaccuau

SEQ ID NO: 1244495 - RNA, 14 nt, Homo sapiens
aaucugugaugaca

SEQ ID NO: 1244496 - RNA, 21 nt, Homo sapiens
aaucuguguucgauggcucaa

SEQ ID NO: 1244497 - RNA, 17 nt, Homo sapiens
aaucuuaccagaugcua

SEQ ID NO: 1244498 - RNA, 15 nt, Homo sapiens
aaucuuagagacaaa

SEQ ID NO: 1244499 - RNA, 22 nt, Homo sapiens
aaucuuaucuuugcucccugca

SEQ ID NO: 1244500 - RNA, 12 nt, Homo sapiens
aaucuucuacuu

SEQ ID NO: 1244501 - RNA, 22 nt, Homo sapiens
aaucuugaggaauaaaugccuu

SEQ ID NO: 1244502 - RNA, 20 nt, Homo sapiens
aaucuugucuaacauucccg

SEQ ID NO: 1244503 - RNA, 20 nt, Homo sapiens
aaucuuucaaagugucuuga

SEQ ID NO: 1244504 - RNA, 16 nt, Homo sapiens
aaucuuucacuugaaa

SEQ ID NO: 1244505 - RNA, 17 nt, Homo sapiens
aaucuuucagcacucag

SEQ ID NO: 1244506 - RNA, 17 nt, Homo sapiens
aaucuuuccaguuagaa

SEQ ID NO: 1244507 - RNA, 17 nt, Homo sapiens
aaucuuucugugucuuc

SEQ ID NO: 1244508 - RNA, 21 nt, Homo sapiens
aaucuuugcuguauacuuuua

SEQ ID NO: 1244509 - RNA, 19 nt, Homo sapiens
aaucuuuuaaaaauucaaa

SEQ ID NO: 1244510 - RNA, 18 nt, Homo sapiens
aaucuuuuacaacugccu

SEQ ID NO: 1244511 - RNA, 21 nt, Homo sapiens
aaugaaaaaaaguacauguau

SEQ ID NO: 1244512 - RNA, 15 nt, Homo sapiens
aaugaaaaacaacca

SEQ ID NO: 1244513 - RNA, 17 nt, Homo sapiens
aaugaaacugcugugaa

SEQ ID NO: 1244514 - RNA, 13 nt, Homo sapiens
aaugaaacuuuaa

SEQ ID NO: 1244515 - RNA, 18 nt, Homo sapiens
aaugaacacaucuugagu

SEQ ID NO: 1244516 - RNA, 22 nt, Homo sapiens
aaugaaccauucacagugcaag

SEQ ID NO: 1244517 - RNA, 16 nt, Homo sapiens
aaugaacuaacugaca

SEQ ID NO: 1244518 - RNA, 17 nt, Homo sapiens
aaugaacuaccaucuga

SEQ ID NO: 1244519 - RNA, 19 nt, Homo sapiens
aaugaacuuguuacuugca

SEQ ID NO: 1244520 - RNA, 23 nt, Homo sapiens
aaugaagccaagugggauuugca

SEQ ID NO: 1244521 - RNA, 21 nt, Homo sapiens
aaugaagguuaggauuuaaca

SEQ ID NO: 1244522 - RNA, 16 nt, Homo sapiens
aaugaauaaacugaau

SEQ ID NO: 1244523 - RNA, 19 nt, Homo sapiens
aaugaaucaacaaaccaca

SEQ ID NO: 1244524 - RNA, 12 nt, Homo sapiens
aaugaaucuuca

SEQ ID NO: 1244525 - RNA, 12 nt, Homo sapiens
aaugaaugccua

SEQ ID NO: 1244526 - RNA, 15 nt, Homo sapiens
aaugacaucucaggg

SEQ ID NO: 1244527 - RNA, 20 nt, Homo sapiens
aaugacaucucaggggccag

SEQ ID NO: 1244528 - RNA, 20 nt, Homo sapiens
aaugagacauaggccaugaa

SEQ ID NO: 1244529 - RNA, 14 nt, Homo sapiens
aaugagacugacca

SEQ ID NO: 1244530 - RNA, 17 nt, Homo sapiens
aaugagccaucacuaga

SEQ ID NO: 1244531 - RNA, 18 nt, Homo sapiens
aaugagcuugugugcccu

SEQ ID NO: 1244532 - RNA, 15 nt, Homo sapiens
aaugaggacauguuu

SEQ ID NO: 1244533 - RNA, 14 nt, Homo sapiens
aaugagugcuuaaa

SEQ ID NO: 1244534 - RNA, 11 nt, Homo sapiens
aaugagugugc

SEQ ID NO: 1244535 - RNA, 14 nt, Homo sapiens
aaugauaguuauaa

SEQ ID NO: 1244536 - RNA, 13 nt, Homo sapiens
aaugaucacucca

SEQ ID NO: 1244537 - RNA, 12 nt, Homo sapiens
aaugaugaugac

SEQ ID NO: 1244538 - RNA, 15 nt, Homo sapiens
aaugaugggacaaua

SEQ ID NO: 1244539 - RNA, 14 nt, Homo sapiens
aaugauguuuuccu

SEQ ID NO: 1244540 - RNA, 23 nt, Homo sapiens
aaugauuaacaguuaugugguca

SEQ ID NO: 1244541 - RNA, 18 nt, Homo sapiens
aaugauuugcucuuugac

SEQ ID NO: 1244542 - RNA, 9 nt, Homo sapiens
aaugcaaaa

SEQ ID NO: 1244543 - RNA, 13 nt, Homo sapiens
aaugcacaucuca

SEQ ID NO: 1244544 - RNA, 13 nt, Homo sapiens
aaugcaccacuuu

SEQ ID NO: 1244545 - RNA, 17 nt, Homo sapiens
aaugcaccuagcugugc

SEQ ID NO: 1244546 - RNA, 18 nt, Homo sapiens
aaugcacguuucaaagcu

SEQ ID NO: 1244547 - RNA, 18 nt, Homo sapiens
aaugcagaauucuugagu

SEQ ID NO: 1244548 - RNA, 16 nt, Homo sapiens
aaugcaugaugaacuc

SEQ ID NO: 1244549 - RNA, 15 nt, Homo sapiens
aaugccaaauugcag

SEQ ID NO: 1244550 - RNA, 20 nt, Homo sapiens
aaugccaaucuucaguauuu

SEQ ID NO: 1244551 - RNA, 13 nt, Homo sapiens
aaugcccagugag

SEQ ID NO: 1244552 - RNA, 14 nt, Homo sapiens
aaugcccugugcau

SEQ ID NO: 1244553 - RNA, 13 nt, Homo sapiens
aaugccuuuauau

SEQ ID NO: 1244554 - RNA, 20 nt, Homo sapiens
aaugccuuugagacaguuuc

SEQ ID NO: 1244555 - RNA, 18 nt, Homo sapiens
aaugcuaagaaugcauua

SEQ ID NO: 1244556 - RNA, 19 nt, Homo sapiens
aaugcuaauaaaguccuau

SEQ ID NO: 1244557 - RNA, 19 nt, Homo sapiens
aaugcuacugucucacuga

SEQ ID NO: 1244558 - RNA, 19 nt, Homo sapiens
aaugcucccagcugugcug

SEQ ID NO: 1244559 - RNA, 12 nt, Homo sapiens
aaugcugagaag

SEQ ID NO: 1244560 - RNA, 20 nt, Homo sapiens
aaugcugcaggacuugagaa

SEQ ID NO: 1244561 - RNA, 15 nt, Homo sapiens
aaugcugcuacuuaa

SEQ ID NO: 1244562 - RNA, 16 nt, Homo sapiens
aaugcuggcauuugca

SEQ ID NO: 1244563 - RNA, 18 nt, Homo sapiens
aaugcugggacucagccu

SEQ ID NO: 1244564 - RNA, 18 nt, Homo sapiens
aaugcugucccuauacac

SEQ ID NO: 1244565 - RNA, 18 nt, Homo sapiens
aaugcugugguugauauu

SEQ ID NO: 1244566 - RNA, 13 nt, Homo sapiens
aaugcuuccaagc

SEQ ID NO: 1244567 - RNA, 18 nt, Homo sapiens
aaugcuuuggaaaaaugg

SEQ ID NO: 1244568 - RNA, 19 nt, Homo sapiens
aaugcuuuuugaauguuau

SEQ ID NO: 1244569 - RNA, 14 nt, Homo sapiens
aauggaccucucag

SEQ ID NO: 1244570 - RNA, 12 nt, Homo sapiens
aauggagcucag

SEQ ID NO: 1244571 - RNA, 22 nt, Homo sapiens
aauggauacaugguuaaaggau

SEQ ID NO: 1244572 - RNA, 12 nt, Homo sapiens
aauggaucacaa

SEQ ID NO: 1244573 - RNA, 21 nt, Homo sapiens
aauggauuugaugcuguuuga

SEQ ID NO: 1244574 - RNA, 15 nt, Homo sapiens
aauggcacuguugca

SEQ ID NO: 1244575 - RNA, 19 nt, Homo sapiens
aauggcagcaggaucugga

SEQ ID NO: 1244576 - RNA, 13 nt, Homo sapiens
aauggcagggaua

SEQ ID NO: 1244577 - RNA, 20 nt, Homo sapiens
aauggcaggugucauaugac

SEQ ID NO: 1244578 - RNA, 23 nt, Homo sapiens
aauggcauaggcugacuuuugca

SEQ ID NO: 1244579 - RNA, 22 nt, Homo sapiens
aauggcaugcugaaacucgaag

SEQ ID NO: 1244580 - RNA, 13 nt, Homo sapiens
aauggcaugucag

SEQ ID NO: 1244581 - RNA, 19 nt, Homo sapiens
aauggccuuuaucaucuag

SEQ ID NO: 1244582 - RNA, 15 nt, Homo sapiens
aauggcuaguacugu

SEQ ID NO: 1244583 - RNA, 16 nt, Homo sapiens
aauggcuaguacugua

SEQ ID NO: 1244584 - RNA, 21 nt, Homo sapiens
aauggcuuuaugcuaguuuga

SEQ ID NO: 1244585 - RNA, 23 nt, Homo sapiens
aaugggaagauuaaaaagcacag

SEQ ID NO: 1244586 - RNA, 23 nt, Homo sapiens
aaugggcacugauuugauaccau

SEQ ID NO: 1244587 - RNA, 15 nt, Homo sapiens
aaugggcucuuccaa

SEQ ID NO: 1244588 - RNA, 18 nt, Homo sapiens
aauggggaucacagagac

SEQ ID NO: 1244589 - RNA, 16 nt, Homo sapiens
aaugguaauuguugcu

SEQ ID NO: 1244590 - RNA, 18 nt, Homo sapiens
aaugguagcaacugaaag

SEQ ID NO: 1244591 - RNA, 22 nt, Homo sapiens
aauggugcaaauccuacugaau

SEQ ID NO: 1244592 - RNA, 17 nt, Homo sapiens
aaugguguuguaugccu

SEQ ID NO: 1244593 - RNA, 15 nt, Homo sapiens
aauguaaagaacuua

SEQ ID NO: 1244594 - RNA, 17 nt, Homo sapiens
aauguaacugugccagu

SEQ ID NO: 1244595 - RNA, 14 nt, Homo sapiens
aauguaagcuguuu

SEQ ID NO: 1244596 - RNA, 14 nt, Homo sapiens
aauguaaugaugcu

SEQ ID NO: 1244597 - RNA, 16 nt, Homo sapiens
aauguacaauaaagca

SEQ ID NO: 1244598 - RNA, 16 nt, Homo sapiens
aauguaccugauguac

SEQ ID NO: 1244599 - RNA, 13 nt, Homo sapiens
aauguauaaagau

SEQ ID NO: 1244600 - RNA, 15 nt, Homo sapiens
aauguauauacacau

SEQ ID NO: 1244601 - RNA, 20 nt, Homo sapiens
aauguauauacacauauacc

SEQ ID NO: 1244602 - RNA, 13 nt, Homo sapiens
aauguaugugcac

SEQ ID NO: 1244603 - RNA, 15 nt, Homo sapiens
aauguaugugcucuu

SEQ ID NO: 1244604 - RNA, 21 nt, Homo sapiens
aauguaugugcucuuagcaaa

SEQ ID NO: 1244605 - RNA, 18 nt, Homo sapiens
aauguauucaaauaccaa

SEQ ID NO: 1244606 - RNA, 16 nt, Homo sapiens
aauguauuuuucuaca

SEQ ID NO: 1244607 - RNA, 20 nt, Homo sapiens
aaugucaagaucacaaagac

SEQ ID NO: 1244608 - RNA, 19 nt, Homo sapiens
aaugucaauacuuacuucu

SEQ ID NO: 1244609 - RNA, 14 nt, Homo sapiens
aaugucacauucua

SEQ ID NO: 1244610 - RNA, 13 nt, Homo sapiens
aaugucacuguga

SEQ ID NO: 1244611 - RNA, 14 nt, Homo sapiens
aaugucacuuaaag

SEQ ID NO: 1244612 - RNA, 16 nt, Homo sapiens
aaugucagaaaccagu

SEQ ID NO: 1244613 - RNA, 19 nt, Homo sapiens
aaugucagaaaccaguuau

SEQ ID NO: 1244614 - RNA, 12 nt, Homo sapiens
aaugucaucaaa

SEQ ID NO: 1244615 - RNA, 20 nt, Homo sapiens
aaugucaucaaauauuacca

SEQ ID NO: 1244616 - RNA, 14 nt, Homo sapiens
aaugucauggccuu

SEQ ID NO: 1244617 - RNA, 19 nt, Homo sapiens
aauguccccacgguacuua

SEQ ID NO: 1244618 - RNA, 15 nt, Homo sapiens
aauguccuuuuauga

SEQ ID NO: 1244619 - RNA, 13 nt, Homo sapiens
aaugucuauaugu

SEQ ID NO: 1244620 - RNA, 23 nt, Homo sapiens
aaugucuggagugguaacagcuc

SEQ ID NO: 1244621 - RNA, 18 nt, Homo sapiens
aaugugaauugcaugacu

SEQ ID NO: 1244622 - RNA, 14 nt, Homo sapiens
aaugugacauuuac

SEQ ID NO: 1244623 - RNA, 18 nt, Homo sapiens
aaugugauuuccggguga

SEQ ID NO: 1244624 - RNA, 18 nt, Homo sapiens
aaugugcaaagucaucaa

SEQ ID NO: 1244625 - RNA, 18 nt, Homo sapiens
aaugugcagaugcaauug

SEQ ID NO: 1244626 - RNA, 15 nt, Homo sapiens
aaugugcucaugcau

SEQ ID NO: 1244627 - RNA, 17 nt, Homo sapiens
aauguggauucuuccca

SEQ ID NO: 1244628 - RNA, 22 nt, Homo sapiens
aauguguauugaagaaaagcac

SEQ ID NO: 1244629 - RNA, 21 nt, Homo sapiens
aauguguucggugauuucaga

SEQ ID NO: 1244630 - RNA, 16 nt, Homo sapiens
aauguuaacuacauau

SEQ ID NO: 1244631 - RNA, 13 nt, Homo sapiens
aauguuaagcaga

SEQ ID NO: 1244632 - RNA, 18 nt, Homo sapiens
aauguuacugaucaugca

SEQ ID NO: 1244633 - RNA, 20 nt, Homo sapiens
aauguuacugaucaugcauu

SEQ ID NO: 1244634 - RNA, 22 nt, Homo sapiens
aauguuagaaaaauagcuguga

SEQ ID NO: 1244635 - RNA, 20 nt, Homo sapiens
aauguuagauuccucuugcc

SEQ ID NO: 1244636 - RNA, 21 nt, Homo sapiens
aauguuauuuuuuaauuauua

SEQ ID NO: 1244637 - RNA, 19 nt, Homo sapiens
aauguucaucaauucccau

SEQ ID NO: 1244638 - RNA, 12 nt, Homo sapiens
aauguuccauuc

SEQ ID NO: 1244639 - RNA, 13 nt, Homo sapiens
aauguuccugaaa

SEQ ID NO: 1244640 - RNA, 14 nt, Homo sapiens
aauguuccugaaaa

SEQ ID NO: 1244641 - RNA, 21 nt, Homo sapiens
aauguuccugaaaauugcaau

SEQ ID NO: 1244642 - RNA, 13 nt, Homo sapiens
aauguucugacau

SEQ ID NO: 1244643 - RNA, 23 nt, Homo sapiens
aauguugcaacacauucauuugg

SEQ ID NO: 1244644 - RNA, 21 nt, Homo sapiens
aauguuggacaccuuuagguu

SEQ ID NO: 1244645 - RNA, 14 nt, Homo sapiens
aauguugggagaaa

SEQ ID NO: 1244646 - RNA, 15 nt, Homo sapiens
aauguuguaauucau

SEQ ID NO: 1244647 - RNA, 15 nt, Homo sapiens
aauguuguccaggaa

SEQ ID NO: 1244648 - RNA, 16 nt, Homo sapiens
aauguuuaaagaucau

SEQ ID NO: 1244649 - RNA, 20 nt, Homo sapiens
aauguuuaaagaucaugaca

SEQ ID NO: 1244650 - RNA, 14 nt, Homo sapiens
aauguuuacacucu

SEQ ID NO: 1244651 - RNA, 14 nt, Homo sapiens
aauguuuaccauga

SEQ ID NO: 1244652 - RNA, 14 nt, Homo sapiens
aauguuugcauaaa

SEQ ID NO: 1244653 - RNA, 22 nt, Homo sapiens
aauguuuuacugugaaacuggc

SEQ ID NO: 1244654 - RNA, 21 nt, Homo sapiens
aauguuuucauuauguucaug

SEQ ID NO: 1244655 - RNA, 13 nt, Homo sapiens
aauuaaaaaccac

SEQ ID NO: 1244656 - RNA, 23 nt, Homo sapiens
aauuaaaaguuugaaaagcaaua

SEQ ID NO: 1244657 - RNA, 21 nt, Homo sapiens
aauuaacagagauugaacucc

SEQ ID NO: 1244658 - RNA, 17 nt, Homo sapiens
aauuaaccuggugcugg

SEQ ID NO: 1244659 - RNA, 22 nt, Homo sapiens
acaguggaggaagagggacaga

SEQ ID NO: 1244660 - RNA, 16 nt, Homo sapiens
acaguggccaaagagg

SEQ ID NO: 1244661 - RNA, 12 nt, Homo sapiens
acaguggcugcu

SEQ ID NO: 1244662 - RNA, 18 nt, Homo sapiens
acagugggaacucugaca

SEQ ID NO: 1244663 - RNA, 21 nt, Homo sapiens
acaguggucccagaaccuauu

SEQ ID NO: 1244664 - RNA, 19 nt, Homo sapiens
acaguguauguacuaagca

SEQ ID NO: 1244665 - RNA, 22 nt, Homo sapiens
acaguguauguacuaagcagua

SEQ ID NO: 1244666 - RNA, 13 nt, Homo sapiens
acagugugcucca

SEQ ID NO: 1244667 - RNA, 19 nt, Homo sapiens
acaguguuagaugugcaca

SEQ ID NO: 1244668 - RNA, 22 nt, Homo sapiens
acaguguuuuaauaaaugguuu

SEQ ID NO: 1244669 - RNA, 18 nt, Homo sapiens
acaguuaaagaagcaauc

SEQ ID NO: 1244670 - RNA, 23 nt, Homo sapiens
acaguuaauuaugugcauauuaa

SEQ ID NO: 1244671 - RNA, 23 nt, Homo sapiens
acaguucaauucucauuugucac

SEQ ID NO: 1244672 - RNA, 14 nt, Homo sapiens
acaguucugugguu

SEQ ID NO: 1244673 - RNA, 18 nt, Homo sapiens
acaguugguucaucccuu

SEQ ID NO: 1244674 - RNA, 22 nt, Homo sapiens
acaguuuagugcuuuacaugcu

SEQ ID NO: 1244675 - RNA, 18 nt, Homo sapiens
acaguuuauugauuucaa

SEQ ID NO: 1244676 - RNA, 22 nt, Homo sapiens
acaguuuauuuuuauacuuuca

SEQ ID NO: 1244677 - RNA, 15 nt, Homo sapiens
acaguuugaugucau

SEQ ID NO: 1244678 - RNA, 24 nt, Homo sapiens
acaguuuugaaagaaaaauaccau

SEQ ID NO: 1244679 - RNA, 14 nt, Homo sapiens
acauaaagccaugu

SEQ ID NO: 1244680 - RNA, 22 nt, Homo sapiens
acauaacacuauaaagguugac

SEQ ID NO: 1244681 - RNA, 18 nt, Homo sapiens
acauaacuaaauuugaua

SEQ ID NO: 1244682 - RNA, 20 nt, Homo sapiens
acauaacucuguaaaaacac

SEQ ID NO: 1244683 - RNA, 19 nt, Homo sapiens
acauaagggguuugccauu

SEQ ID NO: 1244684 - RNA, 22 nt, Homo sapiens
acauaagggguuugccauuuga

SEQ ID NO: 1244685 - RNA, 18 nt, Homo sapiens
acauaaguguugguagca

SEQ ID NO: 1244686 - RNA, 22 nt, Homo sapiens
acauaaguguugguagcacuua

SEQ ID NO: 1244687 - RNA, 23 nt, Homo sapiens
acauaauaauagcagugguaaaa

SEQ ID NO: 1244688 - RNA, 20 nt, Homo sapiens
acauacaauuccaaacacau

SEQ ID NO: 1244689 - RNA, 13 nt, Homo sapiens
acauacagaacuc

SEQ ID NO: 1244690 - RNA, 17 nt, Homo sapiens
acauacagaauguucua

SEQ ID NO: 1244691 - RNA, 19 nt, Homo sapiens
acauacaggccauacuuua

SEQ ID NO: 1244692 - RNA, 18 nt, Homo sapiens
acauacauauuaucucau

SEQ ID NO: 1244693 - RNA, 16 nt, Homo sapiens
acauacauuucucaua

SEQ ID NO: 1244694 - RNA, 17 nt, Homo sapiens
acauacgugcacagggu

SEQ ID NO: 1244695 - RNA, 21 nt, Homo sapiens
acauacucugcuuagaauuug

SEQ ID NO: 1244696 - RNA, 19 nt, Homo sapiens
acauacuuuaucaaugugu

SEQ ID NO: 1244697 - RNA, 17 nt, Homo sapiens
acauagaaaacaaucaa

SEQ ID NO: 1244698 - RNA, 19 nt, Homo sapiens
acauagauuaauggcacug

SEQ ID NO: 1244699 - RNA, 13 nt, Homo sapiens
acauagcaucuca

SEQ ID NO: 1244700 - RNA, 12 nt, Homo sapiens
acauaguccagu

SEQ ID NO: 1244701 - RNA, 23 nt, Homo sapiens
acauagugaaaccccaucucuac

SEQ ID NO: 1244702 - RNA, 12 nt, Homo sapiens
acauagugagac

SEQ ID NO: 1244703 - RNA, 21 nt, Homo sapiens
acauauauaagguaugugcua

SEQ ID NO: 1244704 - RNA, 18 nt, Homo sapiens
acauauauauuaauacug

SEQ ID NO: 1244705 - RNA, 23 nt, Homo sapiens
acauauccacaaaugacugcaaa

SEQ ID NO: 1244706 - RNA, 18 nt, Homo sapiens
acauauccuuucaagaca

SEQ ID NO: 1244707 - RNA, 14 nt, Homo sapiens
acauaugacuugau

SEQ ID NO: 1244708 - RNA, 17 nt, Homo sapiens
acauauggacucugcac

SEQ ID NO: 1244709 - RNA, 12 nt, Homo sapiens
acauaugugcug

SEQ ID NO: 1244710 - RNA, 16 nt, Homo sapiens
acauauuaacaugcuu

SEQ ID NO: 1244711 - RNA, 23 nt, Homo sapiens
acauauuacuguugcauuuacuu

SEQ ID NO: 1244712 - RNA, 13 nt, Homo sapiens
acauauuaucuca

SEQ ID NO: 1244713 - RNA, 16 nt, Homo sapiens
acauauuuguggaaua

SEQ ID NO: 1244714 - RNA, 22 nt, Homo sapiens
acaucaaagacagcaucuaaga

SEQ ID NO: 1244715 - RNA, 21 nt, Homo sapiens
acaucaacugaucucauuucu

SEQ ID NO: 1244716 - RNA, 18 nt, Homo sapiens
acaucagaccugucuucc

SEQ ID NO: 1244717 - RNA, 14 nt, Homo sapiens
acaucagcagagaa

SEQ ID NO: 1244718 - RNA, 17 nt, Homo sapiens
acaucagucuccaacau

SEQ ID NO: 1244719 - RNA, 21 nt, Homo sapiens
acauccaaccccccaccugcc

SEQ ID NO: 1244720 - RNA, 15 nt, Homo sapiens
acauccaacuccagc

SEQ ID NO: 1244721 - RNA, 17 nt, Homo sapiens
acauccaacuccagcaa

SEQ ID NO: 1244722 - RNA, 14 nt, Homo sapiens
acauccagaucuau

SEQ ID NO: 1244723 - RNA, 19 nt, Homo sapiens
acauccauguccuaugugu

SEQ ID NO: 1244724 - RNA, 21 nt, Homo sapiens
acauccuguauaagcacugaa

SEQ ID NO: 1244725 - RNA, 18 nt, Homo sapiens
acaucggccuccaugacc

SEQ ID NO: 1244726 - RNA, 17 nt, Homo sapiens
acaucgugaaacccugu

SEQ ID NO: 1244727 - RNA, 15 nt, Homo sapiens
acaucuaugauauaa

SEQ ID NO: 1244728 - RNA, 19 nt, Homo sapiens
acaucuauuauaaaaccau

SEQ ID NO: 1244729 - RNA, 18 nt, Homo sapiens
acaucuccaggcuuucaa

SEQ ID NO: 1244730 - RNA, 18 nt, Homo sapiens
acaucucgggaguccucu

SEQ ID NO: 1244731 - RNA, 14 nt, Homo sapiens
acaucugagcagug

SEQ ID NO: 1244732 - RNA, 12 nt, Homo sapiens
acaucugcaaua

SEQ ID NO: 1244733 - RNA, 15 nt, Homo sapiens
acaucugcauuuuca

SEQ ID NO: 1244734 - RNA, 22 nt, Homo sapiens
acaucuggccuugaaaccaccu

SEQ ID NO: 1244735 - RNA, 22 nt, Homo sapiens
acaucuggucuuccaggcacuc

SEQ ID NO: 1244736 - RNA, 20 nt, Homo sapiens
acaucuuuagugucugagcu

SEQ ID NO: 1244737 - RNA, 17 nt, Homo sapiens
acaucuuuccaguccuu

SEQ ID NO: 1244738 - RNA, 14 nt, Homo sapiens
acaucuuuccuguc

SEQ ID NO: 1244739 - RNA, 19 nt, Homo sapiens
acaugaacacuuuuuauca

SEQ ID NO: 1244740 - RNA, 15 nt, Homo sapiens
acaugaacuacagac

SEQ ID NO: 1244741 - RNA, 13 nt, Homo sapiens
acaugaacugcca

SEQ ID NO: 1244742 - RNA, 23 nt, Homo sapiens
acaugaaucccacccacauguga

SEQ ID NO: 1244743 - RNA, 17 nt, Homo sapiens
acaugacaacuuugcca

SEQ ID NO: 1244744 - RNA, 14 nt, Homo sapiens
acaugacacugacc

SEQ ID NO: 1244745 - RNA, 18 nt, Homo sapiens
acaugaucuucuuuauaa

SEQ ID NO: 1244746 - RNA, 21 nt, Homo sapiens
acaugauggagcgcaccugcc

SEQ ID NO: 1244747 - RNA, 15 nt, Homo sapiens
acaugcacugacccu

SEQ ID NO: 1244748 - RNA, 23 nt, Homo sapiens
acaugcagcccagaauagcuuug

SEQ ID NO: 1244749 - RNA, 10 nt, Homo sapiens
acaugccagu

SEQ ID NO: 1244750 - RNA, 19 nt, Homo sapiens
acaugcccagaccuucuca

SEQ ID NO: 1244751 - RNA, 22 nt, Homo sapiens
acaugccccccagauugcugca

SEQ ID NO: 1244752 - RNA, 19 nt, Homo sapiens
acaugccucugccaaagga

SEQ ID NO: 1244753 - RNA, 23 nt, Homo sapiens
acaugcgcacucucauaugccac

SEQ ID NO: 1244754 - RNA, 12 nt, Homo sapiens
acaugcucuuuu

SEQ ID NO: 1244755 - RNA, 21 nt, Homo sapiens
acaugcugagucucccaaggc

SEQ ID NO: 1244756 - RNA, 16 nt, Homo sapiens
acaugcuuaugacaau

SEQ ID NO: 1244757 - RNA, 22 nt, Homo sapiens
acaugcuuaugacaaugacugu

SEQ ID NO: 1244758 - RNA, 22 nt, Homo sapiens
acaugcuuuucugccacuccau

SEQ ID NO: 1244759 - RNA, 17 nt, Homo sapiens
acauggaacgcuuucau

SEQ ID NO: 1244760 - RNA, 17 nt, Homo sapiens
acauggacugcuucauc

SEQ ID NO: 1244761 - RNA, 20 nt, Homo sapiens
acauggccagugugauccca

SEQ ID NO: 1244762 - RNA, 17 nt, Homo sapiens
acauggccuaugcacau

SEQ ID NO: 1244763 - RNA, 22 nt, Homo sapiens
acaugguacgaauggcagcaua

SEQ ID NO: 1244764 - RNA, 23 nt, Homo sapiens
acauggugugaguccaaagaagg

SEQ ID NO: 1244765 - RNA, 13 nt, Homo sapiens
acauguaugugca

SEQ ID NO: 1244766 - RNA, 20 nt, Homo sapiens
acaugucuacaugccaugac

SEQ ID NO: 1244767 - RNA, 20 nt, Homo sapiens
acaugucuagccacugauca

SEQ ID NO: 1244768 - RNA, 15 nt, Homo sapiens
acaugugauugugau

SEQ ID NO: 1244769 - RNA, 15 nt, Homo sapiens
acaugugcacuugaa

SEQ ID NO: 1244770 - RNA, 19 nt, Homo sapiens
acaugugccgaaugugcag

SEQ ID NO: 1244771 - RNA, 17 nt, Homo sapiens
acauguggggccagguc

SEQ ID NO: 1244772 - RNA, 16 nt, Homo sapiens
acauguguguauauau

SEQ ID NO: 1244773 - RNA, 20 nt, Homo sapiens
acauguguguauauaugugu

SEQ ID NO: 1244774 - RNA, 13 nt, Homo sapiens
acauguuaagaua

SEQ ID NO: 1244775 - RNA, 14 nt, Homo sapiens
acauguuucacuua

SEQ ID NO: 1244776 - RNA, 23 nt, Homo sapiens
acauuaaaagaaguaaccaacug

SEQ ID NO: 1244777 - RNA, 13 nt, Homo sapiens
acauuaaggacca

SEQ ID NO: 1244778 - RNA, 20 nt, Homo sapiens
acauuaaggaccaauagcau

SEQ ID NO: 1244779 - RNA, 18 nt, Homo sapiens
acauuaccuuacugugga

SEQ ID NO: 1244780 - RNA, 12 nt, Homo sapiens
acauuaucucac

SEQ ID NO: 1244781 - RNA, 14 nt, Homo sapiens
acauuaugccuuaa

SEQ ID NO: 1244782 - RNA, 21 nt, Homo sapiens
acauucaaggcauuucuauca

SEQ ID NO: 1244783 - RNA, 13 nt, Homo sapiens
acauuccaggaaa

SEQ ID NO: 1244784 - RNA, 22 nt, Homo sapiens
agauuccugguuaaauuugaau

SEQ ID NO: 1244785 - RNA, 17 nt, Homo sapiens
agauucuaaagauucua

SEQ ID NO: 1244786 - RNA, 14 nt, Homo sapiens
agauucuagaugau

SEQ ID NO: 1244787 - RNA, 17 nt, Homo sapiens
agauucuauaguucuag

SEQ ID NO: 1244788 - RNA, 21 nt, Homo sapiens
agauucuucaggcuuccugca

SEQ ID NO: 1244789 - RNA, 14 nt, Homo sapiens
agauucuuccccaa

SEQ ID NO: 1244790 - RNA, 20 nt, Homo sapiens
agauugacuaacucaaauac

SEQ ID NO: 1244791 - RNA, 17 nt, Homo sapiens
agauugauuaaugaacu

SEQ ID NO: 1244792 - RNA, 23 nt, Homo sapiens
agauugcaccacugcacuccagc

SEQ ID NO: 1244793 - RNA, 16 nt, Homo sapiens
agauugcgccacugca

SEQ ID NO: 1244794 - RNA, 21 nt, Homo sapiens
agauugcugaaaaaguagauu

SEQ ID NO: 1244795 - RNA, 21 nt, Homo sapiens
agauugggguagagggaaaag

SEQ ID NO: 1244796 - RNA, 22 nt, Homo sapiens
agauuuaaaaaaagaacauaaa

SEQ ID NO: 1244797 - RNA, 17 nt, Homo sapiens
agauuuaacaauuccaa

SEQ ID NO: 1244798 - RNA, 21 nt, Homo sapiens
agauuuauuuuugaaacaaac

SEQ ID NO: 1244799 - RNA, 15 nt, Homo sapiens
agauuucaacauauc

SEQ ID NO: 1244800 - RNA, 16 nt, Homo sapiens
agauuucaacauauca

SEQ ID NO: 1244801 - RNA, 15 nt, Homo sapiens
agauuuccuaacucu

SEQ ID NO: 1244802 - RNA, 14 nt, Homo sapiens
agauuuccuacuuu

SEQ ID NO: 1244803 - RNA, 18 nt, Homo sapiens
agauuuccuccuggccuu

SEQ ID NO: 1244804 - RNA, 13 nt, Homo sapiens
agauuucuucucu

SEQ ID NO: 1244805 - RNA, 19 nt, Homo sapiens
agauuuggaauaggaauaa

SEQ ID NO: 1244806 - RNA, 18 nt, Homo sapiens
agauuuggaugcacucau

SEQ ID NO: 1244807 - RNA, 17 nt, Homo sapiens
agauuuggcuugacaaa

SEQ ID NO: 1244808 - RNA, 18 nt, Homo sapiens
agauuuggcuugacaaag

SEQ ID NO: 1244809 - RNA, 17 nt, Homo sapiens
agauuugggugaacaaa

SEQ ID NO: 1244810 - RNA, 18 nt, Homo sapiens
agauuuguugacagcaaa

SEQ ID NO: 1244811 - RNA, 13 nt, Homo sapiens
agauuuugcaccu

SEQ ID NO: 1244812 - RNA, 22 nt, Homo sapiens
agauuuuucggaggccccacug

SEQ ID NO: 1244813 - RNA, 16 nt, Homo sapiens
agcaaaaacauguaug

SEQ ID NO: 1244814 - RNA, 21 nt, Homo sapiens
agcaaaaacauguaugugcau

SEQ ID NO: 1244815 - RNA, 13 nt, Homo sapiens
agcaaaaggcagc

SEQ ID NO: 1244816 - RNA, 21 nt, Homo sapiens
agcaaaaggcagcucaccccu

SEQ ID NO: 1244817 - RNA, 13 nt, Homo sapiens
agcaaaaugucuc

SEQ ID NO: 1244818 - RNA, 12 nt, Homo sapiens
agcaaaccagcu

SEQ ID NO: 1244819 - RNA, 19 nt, Homo sapiens
agcaaaccgcccugcagca

SEQ ID NO: 1244820 - RNA, 18 nt, Homo sapiens
agcaaacgggagaaauuu

SEQ ID NO: 1244821 - RNA, 13 nt, Homo sapiens
agcaaacuuggaa

SEQ ID NO: 1244822 - RNA, 16 nt, Homo sapiens
agcaaagauuaaaugu

SEQ ID NO: 1244823 - RNA, 17 nt, Homo sapiens
agcaaagcuccugccuc

SEQ ID NO: 1244824 - RNA, 21 nt, Homo sapiens
agcaaagcugaugacaacuuc

SEQ ID NO: 1244825 - RNA, 20 nt, Homo sapiens
agcaaaugcuauuugauaac

SEQ ID NO: 1244826 - RNA, 18 nt, Homo sapiens
agcaaauggcagaaccaa

SEQ ID NO: 1244827 - RNA, 20 nt, Homo sapiens
agcaaauggcagaaccaaag

SEQ ID NO: 1244828 - RNA, 16 nt, Homo sapiens
agcaaauuuucagcau

SEQ ID NO: 1244829 - RNA, 17 nt, Homo sapiens
agcaacaaaaauuacuc

SEQ ID NO: 1244830 - RNA, 12 nt, Homo sapiens
agcaacaaugac

SEQ ID NO: 1244831 - RNA, 18 nt, Homo sapiens
agcaacccuaacaguaag

SEQ ID NO: 1244832 - RNA, 19 nt, Homo sapiens
agcaacccuggguuuucag

SEQ ID NO: 1244833 - RNA, 16 nt, Homo sapiens
agcaacuaggaaaauc

SEQ ID NO: 1244834 - RNA, 14 nt, Homo sapiens
agcaacucagagaa

SEQ ID NO: 1244835 - RNA, 21 nt, Homo sapiens
agcaacucugagaucuaagga

SEQ ID NO: 1244836 - RNA, 24 nt, Homo sapiens
agcaacuucaaguauaacaacuuu

SEQ ID NO: 1244837 - RNA, 12 nt, Homo sapiens
agcaacuuugau

SEQ ID NO: 1244838 - RNA, 19 nt, Homo sapiens
agcaagacccugucuuaaa

SEQ ID NO: 1244839 - RNA, 14 nt, Homo sapiens
agcaagaccuggag

SEQ ID NO: 1244840 - RNA, 18 nt, Homo sapiens
agcaagacucugucucaa

SEQ ID NO: 1244841 - RNA, 14 nt, Homo sapiens
agcaagcacugugg

SEQ ID NO: 1244842 - RNA, 18 nt, Homo sapiens
agcaagccgagcucuccu

SEQ ID NO: 1244843 - RNA, 13 nt, Homo sapiens
agcaaggagcaca

SEQ ID NO: 1244844 - RNA, 19 nt, Homo sapiens
agcaaggcuuugguuucca

SEQ ID NO: 1244845 - RNA, 23 nt, Homo sapiens
agcaaggguuggguuguguucgu

SEQ ID NO: 1244846 - RNA, 22 nt, Homo sapiens
agcaaguguucacaacagugaa

SEQ ID NO: 1244847 - RNA, 18 nt, Homo sapiens
agcaaguuacagugaugc

SEQ ID NO: 1244848 - RNA, 14 nt, Homo sapiens
agcaauaacauaca

SEQ ID NO: 1244849 - RNA, 9 nt, Homo sapiens
agcaauacu

SEQ ID NO: 1244850 - RNA, 23 nt, Homo sapiens
agcaauaggguggcacagaagcu

SEQ ID NO: 1244851 - RNA, 21 nt, Homo sapiens
agcaauggaguggcugccaug

SEQ ID NO: 1244852 - RNA, 15 nt, Homo sapiens
agcaaugguggugca

SEQ ID NO: 1244853 - RNA, 14 nt, Homo sapiens
agcaauucuccugc

SEQ ID NO: 1244854 - RNA, 18 nt, Homo sapiens
agcaauuucucuuuaaaa

SEQ ID NO: 1244855 - RNA, 18 nt, Homo sapiens
agcacaaucacuaaacuu

SEQ ID NO: 1244856 - RNA, 18 nt, Homo sapiens
agcacaauuugcacuaaa

SEQ ID NO: 1244857 - RNA, 21 nt, Homo sapiens
agcacaauuugcacuaaauca

SEQ ID NO: 1244858 - RNA, 15 nt, Homo sapiens
agcacacuuuuccac

SEQ ID NO: 1244859 - RNA, 13 nt, Homo sapiens
agcacagaauuug

SEQ ID NO: 1244860 - RNA, 19 nt, Homo sapiens
agcacagaauuugucagaa

SEQ ID NO: 1244861 - RNA, 16 nt, Homo sapiens
agcacagcgaacccaa

SEQ ID NO: 1244862 - RNA, 12 nt, Homo sapiens
agcacagugugu

SEQ ID NO: 1244863 - RNA, 18 nt, Homo sapiens
agcacaucaauuacaagc

SEQ ID NO: 1244864 - RNA, 21 nt, Homo sapiens
agcacaucuuugaccacguca

SEQ ID NO: 1244865 - RNA, 14 nt, Homo sapiens
agcaccauugcacu

SEQ ID NO: 1244866 - RNA, 15 nt, Homo sapiens
agcacccaagccagg

SEQ ID NO: 1244867 - RNA, 15 nt, Homo sapiens
agcacccuacaggga

SEQ ID NO: 1244868 - RNA, 20 nt, Homo sapiens
agcaccuuuccuucaagcca

SEQ ID NO: 1244869 - RNA, 23 nt, Homo sapiens
agcacuaaggugugcucugauca

SEQ ID NO: 1244870 - RNA, 17 nt, Homo sapiens
agcacuacauaaacuga

SEQ ID NO: 1244871 - RNA, 20 nt, Homo sapiens
agcacuagagaaugcacaga

SEQ ID NO: 1244872 - RNA, 15 nt, Homo sapiens
agcacuauuaauacu

SEQ ID NO: 1244873 - RNA, 22 nt, Homo sapiens
agcacucccuaauuuaugugcu

SEQ ID NO: 1244874 - RNA, 18 nt, Homo sapiens
agcacugucccuugccuc

SEQ ID NO: 1244875 - RNA, 17 nt, Homo sapiens
agcacugucucaguuuc

SEQ ID NO: 1244876 - RNA, 11 nt, Homo sapiens
agcacugugag

SEQ ID NO: 1244877 - RNA, 14 nt, Homo sapiens
agcacuuccauggg

SEQ ID NO: 1244878 - RNA, 20 nt, Homo sapiens
agcacuugagaaccagucuc

SEQ ID NO: 1244879 - RNA, 22 nt, Homo sapiens
agcacuugcaaccgucuguuau

SEQ ID NO: 1244880 - RNA, 12 nt, Homo sapiens
agcacuugucca

SEQ ID NO: 1244881 - RNA, 17 nt, Homo sapiens
agcacuuucauugccag

SEQ ID NO: 1244882 - RNA, 15 nt, Homo sapiens
agcacuuuggacaug

SEQ ID NO: 1244883 - RNA, 20 nt, Homo sapiens
agcacuuuggacauggcuca

SEQ ID NO: 1244884 - RNA, 14 nt, Homo sapiens
agcagaaggccauc

SEQ ID NO: 1244885 - RNA, 23 nt, Homo sapiens
agcagaccaccccgccugcccuc

SEQ ID NO: 1244886 - RNA, 22 nt, Homo sapiens
agcagaccuaccugcaguggga

SEQ ID NO: 1244887 - RNA, 14 nt, Homo sapiens
agcagacucuggag

SEQ ID NO: 1244888 - RNA, 20 nt, Homo sapiens
agcagacucuggaggccugu

SEQ ID NO: 1244889 - RNA, 21 nt, Homo sapiens
agcagacucuggaggccugug

SEQ ID NO: 1244890 - RNA, 15 nt, Homo sapiens
agcagagaacuggaa

SEQ ID NO: 1244891 - RNA, 17 nt, Homo sapiens
agcagagugcacagcug

SEQ ID NO: 1244892 - RNA, 21 nt, Homo sapiens
agcagaguguucccugacucc

SEQ ID NO: 1244893 - RNA, 15 nt, Homo sapiens
agcagauaacuuuuu

SEQ ID NO: 1244894 - RNA, 13 nt, Homo sapiens
agcagauaauggu

SEQ ID NO: 1244895 - RNA, 14 nt, Homo sapiens
agcagauacuuugu

SEQ ID NO: 1244896 - RNA, 21 nt, Homo sapiens
agcagauggacagcgaugagg

SEQ ID NO: 1244897 - RNA, 15 nt, Homo sapiens
agcagaugguuucca

SEQ ID NO: 1244898 - RNA, 16 nt, Homo sapiens
agcagauuguguaaca

SEQ ID NO: 1244899 - RNA, 13 nt, Homo sapiens
agcagauuuaaca

SEQ ID NO: 1244900 - RNA, 13 nt, Homo sapiens
agcagauuugcac

SEQ ID NO: 1244901 - RNA, 15 nt, Homo sapiens
agcagcaucuucaaa

SEQ ID NO: 1244902 - RNA, 18 nt, Homo sapiens
agcagccacaaccaaaaa

SEQ ID NO: 1244903 - RNA, 21 nt, Homo sapiens
agcagcccuaaggaucucuca

SEQ ID NO: 1244904 - RNA, 22 nt, Homo sapiens
agcagcccugcucuggggugcu

SEQ ID NO: 1244905 - RNA, 15 nt, Homo sapiens
agcagcccugucacg

SEQ ID NO: 1244906 - RNA, 18 nt, Homo sapiens
agcagccgccagcuggga

SEQ ID NO: 1244907 - RNA, 17 nt, Homo sapiens
agcagcgaaaacugcca

SEQ ID NO: 1244908 - RNA, 13 nt, Homo sapiens
agcagcucaagaa

SEQ ID NO: 1244909 - RNA, 21 nt, Homo sapiens
agcagcugugcauugacauca

SEQ ID NO: 1244910 - RNA, 17 nt, Homo sapiens
aggauguauaaaauggu

SEQ ID NO: 1244911 - RNA, 21 nt, Homo sapiens
aggaugucccugggccagggu

SEQ ID NO: 1244912 - RNA, 12 nt, Homo sapiens
aggaugugauau

SEQ ID NO: 1244913 - RNA, 19 nt, Homo sapiens
aggaugugauuguggaaug

SEQ ID NO: 1244914 - RNA, 11 nt, Homo sapiens
aggauguugcc

SEQ ID NO: 1244915 - RNA, 23 nt, Homo sapiens
aggauguugccacuggcaaaugu

SEQ ID NO: 1244916 - RNA, 15 nt, Homo sapiens
aggauuucaugauuu

SEQ ID NO: 1244917 - RNA, 17 nt, Homo sapiens
aggauuuuuauugauug

SEQ ID NO: 1244918 - RNA, 14 nt, Homo sapiens
aggcaaauguguac

SEQ ID NO: 1244919 - RNA, 14 nt, Homo sapiens
aggcaacauccaaa

SEQ ID NO: 1244920 - RNA, 22 nt, Homo sapiens
aggcaaccugauuguaaacuuc

SEQ ID NO: 1244921 - RNA, 19 nt, Homo sapiens
aggcaagccccucagcccu

SEQ ID NO: 1244922 - RNA, 23 nt, Homo sapiens
aggcaaggaguuugagaccagcu

SEQ ID NO: 1244923 - RNA, 19 nt, Homo sapiens
aggcaaggaugucugagac

SEQ ID NO: 1244924 - RNA, 17 nt, Homo sapiens
aggcaagggauaacucu

SEQ ID NO: 1244925 - RNA, 21 nt, Homo sapiens
aggcaauuucaccaccaaaug

SEQ ID NO: 1244926 - RNA, 13 nt, Homo sapiens
aggcacaacaguu

SEQ ID NO: 1244927 - RNA, 18 nt, Homo sapiens
aggcacacagcuacucuc

SEQ ID NO: 1244928 - RNA, 21 nt, Homo sapiens
aggcacaucaacugaucucau

SEQ ID NO: 1244929 - RNA, 20 nt, Homo sapiens
aggcacuagccuuuggcucu

SEQ ID NO: 1244930 - RNA, 13 nt, Homo sapiens
aggcacucauggg

SEQ ID NO: 1244931 - RNA, 16 nt, Homo sapiens
aggcacugguggcauc

SEQ ID NO: 1244932 - RNA, 16 nt, Homo sapiens
aggcacuguaguucua

SEQ ID NO: 1244933 - RNA, 20 nt, Homo sapiens
aggcacuguaguucuaagac

SEQ ID NO: 1244934 - RNA, 14 nt, Homo sapiens
aggcacuguucaau

SEQ ID NO: 1244935 - RNA, 20 nt, Homo sapiens
aggcacuguucaauacugua

SEQ ID NO: 1244936 - RNA, 16 nt, Homo sapiens
aggcagacuugcagag

SEQ ID NO: 1244937 - RNA, 15 nt, Homo sapiens
aggcagaguuugccu

SEQ ID NO: 1244938 - RNA, 21 nt, Homo sapiens
aggcagaguuugccuuccuuu

SEQ ID NO: 1244939 - RNA, 16 nt, Homo sapiens
aggcagcacagugugu

SEQ ID NO: 1244940 - RNA, 20 nt, Homo sapiens
aggcagcagaauugcuugaa

SEQ ID NO: 1244941 - RNA, 19 nt, Homo sapiens
aggcagcagggaagcaacc

SEQ ID NO: 1244942 - RNA, 13 nt, Homo sapiens
aggcagccuccag

SEQ ID NO: 1244943 - RNA, 19 nt, Homo sapiens
aggcagcucaccccugggc

SEQ ID NO: 1244944 - RNA, 19 nt, Homo sapiens
aggcagcugccucugcucc

SEQ ID NO: 1244945 - RNA, 19 nt, Homo sapiens
aggcagcuggaugagacuu

SEQ ID NO: 1244946 - RNA, 17 nt, Homo sapiens
aggcaggagaauggugu

SEQ ID NO: 1244947 - RNA, 20 nt, Homo sapiens
aggcaggagaauuacuugaa

SEQ ID NO: 1244948 - RNA, 12 nt, Homo sapiens
aggcaggagcag

SEQ ID NO: 1244949 - RNA, 15 nt, Homo sapiens
aggcaggagguacaa

SEQ ID NO: 1244950 - RNA, 17 nt, Homo sapiens
aggcagggcaaaugaca

SEQ ID NO: 1244951 - RNA, 14 nt, Homo sapiens
aggcagggucucac

SEQ ID NO: 1244952 - RNA, 15 nt, Homo sapiens
aggcaggugggcucg

SEQ ID NO: 1244953 - RNA, 15 nt, Homo sapiens
aggcaguaaugccuu

SEQ ID NO: 1244954 - RNA, 22 nt, Homo sapiens
aggcagugacagcagucaggga

SEQ ID NO: 1244955 - RNA, 13 nt, Homo sapiens
aggcagugucccu

SEQ ID NO: 1244956 - RNA, 17 nt, Homo sapiens
aggcaguuggccagaga

SEQ ID NO: 1244957 - RNA, 17 nt, Homo sapiens
aggcaucucuguacuuu

SEQ ID NO: 1244958 - RNA, 13 nt, Homo sapiens
aggcaugaaauga

SEQ ID NO: 1244959 - RNA, 18 nt, Homo sapiens
aggcaugaagaagccacu

SEQ ID NO: 1244960 - RNA, 22 nt, Homo sapiens
aggcaugggcagcaaccccugc

SEQ ID NO: 1244961 - RNA, 15 nt, Homo sapiens
aggcaugguagcuca

SEQ ID NO: 1244962 - RNA, 16 nt, Homo sapiens
aggcauuaacacaaag

SEQ ID NO: 1244963 - RNA, 18 nt, Homo sapiens
aggcauuuucaucuuucc

SEQ ID NO: 1244964 - RNA, 23 nt, Homo sapiens
aggccaagcauuucuagcaguga

SEQ ID NO: 1244965 - RNA, 13 nt, Homo sapiens
aggccaaggcagg

SEQ ID NO: 1244966 - RNA, 14 nt, Homo sapiens
aggccacagccgcc

SEQ ID NO: 1244967 - RNA, 20 nt, Homo sapiens
aggccacuugaugaccccca

SEQ ID NO: 1244968 - RNA, 14 nt, Homo sapiens
aggccaggaccaca

SEQ ID NO: 1244969 - RNA, 14 nt, Homo sapiens
aggccagggacuca

SEQ ID NO: 1244970 - RNA, 12 nt, Homo sapiens
aggccagugcua

SEQ ID NO: 1244971 - RNA, 22 nt, Homo sapiens
aggccagugugccgaccucucu

SEQ ID NO: 1244972 - RNA, 20 nt, Homo sapiens
aggccaugaaaaaaaugauc

SEQ ID NO: 1244973 - RNA, 19 nt, Homo sapiens
aggcccagugacaaagacu

SEQ ID NO: 1244974 - RNA, 19 nt, Homo sapiens
aggccccagcuggagaaaa

SEQ ID NO: 1244975 - RNA, 23 nt, Homo sapiens
aggcccggccaaaauaaugcacc

SEQ ID NO: 1244976 - RNA, 13 nt, Homo sapiens
aggcccucaguga

SEQ ID NO: 1244977 - RNA, 19 nt, Homo sapiens
aggcccugcuccugcagca

SEQ ID NO: 1244978 - RNA, 20 nt, Homo sapiens
aggcccuggcccuuuccccu

SEQ ID NO: 1244979 - RNA, 21 nt, Homo sapiens
aggcccuguccuaagcacuuu

SEQ ID NO: 1244980 - RNA, 22 nt, Homo sapiens
aggccgagagcagacaccagca

SEQ ID NO: 1244981 - RNA, 20 nt, Homo sapiens
aggccgaggaauccucagag

SEQ ID NO: 1244982 - RNA, 23 nt, Homo sapiens
aggccggaaaaggcgcaucuaac

SEQ ID NO: 1244983 - RNA, 20 nt, Homo sapiens
aggccgggcgcgguggcuca

SEQ ID NO: 1244984 - RNA, 15 nt, Homo sapiens
aggccgugugucugu

SEQ ID NO: 1244985 - RNA, 19 nt, Homo sapiens
aggccucucucaccucucc

SEQ ID NO: 1244986 - RNA, 20 nt, Homo sapiens
aggccuggacuuuccugcaa

SEQ ID NO: 1244987 - RNA, 15 nt, Homo sapiens
aggccugggaccucc

SEQ ID NO: 1244988 - RNA, 15 nt, Homo sapiens
aggccuguacagaug

SEQ ID NO: 1244989 - RNA, 14 nt, Homo sapiens
aggccugugccuug

SEQ ID NO: 1244990 - RNA, 19 nt, Homo sapiens
aggcgaggucgauggaacu

SEQ ID NO: 1244991 - RNA, 20 nt, Homo sapiens
aggcgccugccaucaugccu

SEQ ID NO: 1244992 - RNA, 19 nt, Homo sapiens
aggcgccuggcacauuuca

SEQ ID NO: 1244993 - RNA, 22 nt, Homo sapiens
aggcggagcugugcucagcaca

SEQ ID NO: 1244994 - RNA, 17 nt, Homo sapiens
aggcggcuacaugccuc

SEQ ID NO: 1244995 - RNA, 18 nt, Homo sapiens
aggcggguggaucaccug

SEQ ID NO: 1244996 - RNA, 20 nt, Homo sapiens
aggcggguggaucacuugag

SEQ ID NO: 1244997 - RNA, 23 nt, Homo sapiens
aggcgugcugguccccuccucag

SEQ ID NO: 1244998 - RNA, 18 nt, Homo sapiens
aggcuaaaugagauacac

SEQ ID NO: 1244999 - RNA, 13 nt, Homo sapiens
aggcuaugccauc

SEQ ID NO: 1245000 - RNA, 16 nt, Homo sapiens
aggcucaagcccuaga

SEQ ID NO: 1245001 - RNA, 17 nt, Homo sapiens
aggcucaauauuccuga

SEQ ID NO: 1245002 - RNA, 19 nt, Homo sapiens
aggcucacugcaacuucug

SEQ ID NO: 1245003 - RNA, 16 nt, Homo sapiens
aggcucagaggagcca

SEQ ID NO: 1245004 - RNA, 17 nt, Homo sapiens
aggcucaggccauggcu

SEQ ID NO: 1245005 - RNA, 15 nt, Homo sapiens
aggcuccugccugag

SEQ ID NO: 1245006 - RNA, 15 nt, Homo sapiens
aggcucuaauguaca

SEQ ID NO: 1245007 - RNA, 16 nt, Homo sapiens
aggcucuagaucauaa

SEQ ID NO: 1245008 - RNA, 20 nt, Homo sapiens
aggcucucccucucucucau

SEQ ID NO: 1245009 - RNA, 16 nt, Homo sapiens
aggcucugaaauggaa

SEQ ID NO: 1245010 - RNA, 19 nt, Homo sapiens
aggcucuggcccuugccuu

SEQ ID NO: 1245011 - RNA, 20 nt, Homo sapiens
aggcucuuagcagcuuccag

SEQ ID NO: 1245012 - RNA, 15 nt, Homo sapiens
aggcugacuuuugca

SEQ ID NO: 1245013 - RNA, 14 nt, Homo sapiens
aggcugagaaggaa

SEQ ID NO: 1245014 - RNA, 14 nt, Homo sapiens
aggcugaggacuua

SEQ ID NO: 1245015 - RNA, 21 nt, Homo sapiens
aggcugaggcaagagaauuac

SEQ ID NO: 1245016 - RNA, 22 nt, Homo sapiens
aggcugaggccuggacuuuccu

SEQ ID NO: 1245017 - RNA, 19 nt, Homo sapiens
aggcugaggggaggaucac

SEQ ID NO: 1245018 - RNA, 14 nt, Homo sapiens
aggcugaguguccg

SEQ ID NO: 1245019 - RNA, 18 nt, Homo sapiens
aggcugcagucccuggaa

SEQ ID NO: 1245020 - RNA, 18 nt, Homo sapiens
aggcugcgacugaugaag

SEQ ID NO: 1245021 - RNA, 17 nt, Homo sapiens
aggcuggagugcaaugg

SEQ ID NO: 1245022 - RNA, 17 nt, Homo sapiens
aggcuggagugcagugg

SEQ ID NO: 1245023 - RNA, 15 nt, Homo sapiens
aggcugggaggaaca

SEQ ID NO: 1245024 - RNA, 20 nt, Homo sapiens
aggcugggcagccccagaga

SEQ ID NO: 1245025 - RNA, 17 nt, Homo sapiens
aggcugggccaugucca

SEQ ID NO: 1245026 - RNA, 18 nt, Homo sapiens
aggcugggccauguccaa

SEQ ID NO: 1245027 - RNA, 20 nt, Homo sapiens
aggcugucgugagcuaugau

SEQ ID NO: 1245028 - RNA, 20 nt, Homo sapiens
aggcuguguauuuacaugaa

SEQ ID NO: 1245029 - RNA, 18 nt, Homo sapiens
aggcuguucugcacugaa

SEQ ID NO: 1245030 - RNA, 12 nt, Homo sapiens
aggcuuacuuca

SEQ ID NO: 1245031 - RNA, 15 nt, Homo sapiens
aggcuucaucaaggu

SEQ ID NO: 1245032 - RNA, 22 nt, Homo sapiens
aggcuucccugacuugcuuuag

SEQ ID NO: 1245033 - RNA, 14 nt, Homo sapiens
aggcuuuacagugu

SEQ ID NO: 1245034 - RNA, 15 nt, Homo sapiens
aggcuuuaugauaau

SEQ ID NO: 1245035 - RNA, 14 nt, Homo sapiens
aggcuuucaagaag

SEQ ID NO: 1245036 - RNA, 18 nt, Homo sapiens
agugagcagugagcagaa

SEQ ID NO: 1245037 - RNA, 15 nt, Homo sapiens
agugagcugauauca

SEQ ID NO: 1245038 - RNA, 21 nt, Homo sapiens
agugaggcugcacccacccag

SEQ ID NO: 1245039 - RNA, 12 nt, Homo sapiens
agugauccugcc

SEQ ID NO: 1245040 - RNA, 14 nt, Homo sapiens
agugauggucagag

SEQ ID NO: 1245041 - RNA, 17 nt, Homo sapiens
agugauugauagagugu

SEQ ID NO: 1245042 - RNA, 22 nt, Homo sapiens
agugauugauagaguguuauca

SEQ ID NO: 1245043 - RNA, 16 nt, Homo sapiens
agugcaacagcacugg

SEQ ID NO: 1245044 - RNA, 15 nt, Homo sapiens
agugcacagcugucc

SEQ ID NO: 1245045 - RNA, 18 nt, Homo sapiens
agugcaggagagacagug

SEQ ID NO: 1245046 - RNA, 18 nt, Homo sapiens
agugcagggaaccgugau

SEQ ID NO: 1245047 - RNA, 21 nt, Homo sapiens
agugcagugagccgagaucac

SEQ ID NO: 1245048 - RNA, 20 nt, Homo sapiens
agugcaguggugugaucuca

SEQ ID NO: 1245049 - RNA, 14 nt, Homo sapiens
agugccaacuccuc

SEQ ID NO: 1245050 - RNA, 16 nt, Homo sapiens
agugccaacuccucac

SEQ ID NO: 1245051 - RNA, 20 nt, Homo sapiens
agugccaauauuucugauau

SEQ ID NO: 1245052 - RNA, 13 nt, Homo sapiens
agugccauuccac

SEQ ID NO: 1245053 - RNA, 14 nt, Homo sapiens
agugccauuccacu

SEQ ID NO: 1245054 - RNA, 15 nt, Homo sapiens
agugccauuccacuc

SEQ ID NO: 1245055 - RNA, 22 nt, Homo sapiens
agugccauugucuuuauaugaa

SEQ ID NO: 1245056 - RNA, 14 nt, Homo sapiens
agugcccuacaaag

SEQ ID NO: 1245057 - RNA, 18 nt, Homo sapiens
agugcggacaaguuuuaa

SEQ ID NO: 1245058 - RNA, 23 nt, Homo sapiens
agugcgugcucccgaugcugcua

SEQ ID NO: 1245059 - RNA, 15 nt, Homo sapiens
agugcuauugcagag

SEQ ID NO: 1245060 - RNA, 13 nt, Homo sapiens
agugcugcaguau

SEQ ID NO: 1245061 - RNA, 21 nt, Homo sapiens
agugcugggauuacaggcaug

SEQ ID NO: 1245062 - RNA, 18 nt, Homo sapiens
agugcuggucacuaacca

SEQ ID NO: 1245063 - RNA, 14 nt, Homo sapiens
agugcuuguuagag

SEQ ID NO: 1245064 - RNA, 20 nt, Homo sapiens
aguggaagccccaacgggaa

SEQ ID NO: 1245065 - RNA, 16 nt, Homo sapiens
aguggaggcacuuuag

SEQ ID NO: 1245066 - RNA, 16 nt, Homo sapiens
aguggauugcauuucu

SEQ ID NO: 1245067 - RNA, 18 nt, Homo sapiens
aguggcaccaccauggcu

SEQ ID NO: 1245068 - RNA, 19 nt, Homo sapiens
aguggcaccaccauggcuc

SEQ ID NO: 1245069 - RNA, 14 nt, Homo sapiens
aguggccaugccac

SEQ ID NO: 1245070 - RNA, 17 nt, Homo sapiens
aguggccauuaccaucu

SEQ ID NO: 1245071 - RNA, 20 nt, Homo sapiens
aguggcgcaaucucggcuca

SEQ ID NO: 1245072 - RNA, 19 nt, Homo sapiens
aguggcgugggagccagcc

SEQ ID NO: 1245073 - RNA, 21 nt, Homo sapiens
aguggcucacgccuaugaucc

SEQ ID NO: 1245074 - RNA, 15 nt, Homo sapiens
aguggcugugccacc

SEQ ID NO: 1245075 - RNA, 15 nt, Homo sapiens
agugggaacucugac

SEQ ID NO: 1245076 - RNA, 13 nt, Homo sapiens
agugggacccaua

SEQ ID NO: 1245077 - RNA, 11 nt, Homo sapiens
agugggagaag

SEQ ID NO: 1245078 - RNA, 20 nt, Homo sapiens
agugggagcugagcuggaag

SEQ ID NO: 1245079 - RNA, 14 nt, Homo sapiens
agugggcaccucag

SEQ ID NO: 1245080 - RNA, 21 nt, Homo sapiens
agugggcaucagcagcagggu

SEQ ID NO: 1245081 - RNA, 11 nt, Homo sapiens
agugggccagg

SEQ ID NO: 1245082 - RNA, 16 nt, Homo sapiens
agugggccuccaagga

SEQ ID NO: 1245083 - RNA, 15 nt, Homo sapiens
agugguauccuguga

SEQ ID NO: 1245084 - RNA, 13 nt, Homo sapiens
aguggugccaaac

SEQ ID NO: 1245085 - RNA, 15 nt, Homo sapiens
agugguugcauucua

SEQ ID NO: 1245086 - RNA, 10 nt, Homo sapiens
aguguaagaa

SEQ ID NO: 1245087 - RNA, 12 nt, Homo sapiens
aguguacaugga

SEQ ID NO: 1245088 - RNA, 12 nt, Homo sapiens
aguguaccuccu

SEQ ID NO: 1245089 - RNA, 16 nt, Homo sapiens
aguguagccuugcccg

SEQ ID NO: 1245090 - RNA, 18 nt, Homo sapiens
aguguagggcaacaauac

SEQ ID NO: 1245091 - RNA, 18 nt, Homo sapiens
aguguaugacugcacaug

SEQ ID NO: 1245092 - RNA, 13 nt, Homo sapiens
aguguaugauuac

SEQ ID NO: 1245093 - RNA, 23 nt, Homo sapiens
aguguauuuuauguguggcccaa

SEQ ID NO: 1245094 - RNA, 16 nt, Homo sapiens
agugucccaccuugac

SEQ ID NO: 1245095 - RNA, 21 nt, Homo sapiens
aguguccccuccacugucaca

SEQ ID NO: 1245096 - RNA, 17 nt, Homo sapiens
aguguccuaagugcuaa

SEQ ID NO: 1245097 - RNA, 17 nt, Homo sapiens
aguguccucuugcucaa

SEQ ID NO: 1245098 - RNA, 21 nt, Homo sapiens
agugucucugccuugagucau

SEQ ID NO: 1245099 - RNA, 19 nt, Homo sapiens
agugugaggaggagacagc

SEQ ID NO: 1245100 - RNA, 23 nt, Homo sapiens
agugugaguggcagccaugccuc

SEQ ID NO: 1245101 - RNA, 19 nt, Homo sapiens
agugugccccucuguaaca

SEQ ID NO: 1245102 - RNA, 12 nt, Homo sapiens
aguguggaacca

SEQ ID NO: 1245103 - RNA, 23 nt, Homo sapiens
aguguggccacgugggcaaacag

SEQ ID NO: 1245104 - RNA, 16 nt, Homo sapiens
agugugggggguccuu

SEQ ID NO: 1245105 - RNA, 22 nt, Homo sapiens
aguguguccuggggacuuccuc

SEQ ID NO: 1245106 - RNA, 19 nt, Homo sapiens
aguguuaagcguucaguga

SEQ ID NO: 1245107 - RNA, 21 nt, Homo sapiens
aguguucauuuuagugacugu

SEQ ID NO: 1245108 - RNA, 20 nt, Homo sapiens
aguguuccccgauaccaugc

SEQ ID NO: 1245109 - RNA, 19 nt, Homo sapiens
aguguucuaugaacaacuc

SEQ ID NO: 1245110 - RNA, 22 nt, Homo sapiens
aguguuuacaaggugacaaaug

SEQ ID NO: 1245111 - RNA, 23 nt, Homo sapiens
aguuaaagugaauaaccacuuaa

SEQ ID NO: 1245112 - RNA, 16 nt, Homo sapiens
aguuaaauaugcaucu

SEQ ID NO: 1245113 - RNA, 20 nt, Homo sapiens
aguuaaaugccgucuaucag

SEQ ID NO: 1245114 - RNA, 15 nt, Homo sapiens
aguuaagaacaucaa

SEQ ID NO: 1245115 - RNA, 19 nt, Homo sapiens
aguuaagagguuuguauau

SEQ ID NO: 1245116 - RNA, 12 nt, Homo sapiens
aguuaagggaug

SEQ ID NO: 1245117 - RNA, 21 nt, Homo sapiens
aguuaauaaucuaugaugaag

SEQ ID NO: 1245118 - RNA, 19 nt, Homo sapiens
aguuaauuaugugcauauu

SEQ ID NO: 1245119 - RNA, 13 nt, Homo sapiens
aguuaauucaccu

SEQ ID NO: 1245120 - RNA, 12 nt, Homo sapiens
aguuacuaccug

SEQ ID NO: 1245121 - RNA, 17 nt, Homo sapiens
aguuacugccgguuuga

SEQ ID NO: 1245122 - RNA, 23 nt, Homo sapiens
aguuacugguaucugucacugac

SEQ ID NO: 1245123 - RNA, 19 nt, Homo sapiens
aguuagguuaauaaaucaa

SEQ ID NO: 1245124 - RNA, 22 nt, Homo sapiens
aguuauaaaucaaugucacuua

SEQ ID NO: 1245125 - RNA, 15 nt, Homo sapiens
aguuaugacaagcuu

SEQ ID NO: 1245126 - RNA, 12 nt, Homo sapiens
aguuauugcaca

SEQ ID NO: 1245127 - RNA, 17 nt, Homo sapiens
aguucaauacagugaag

SEQ ID NO: 1245128 - RNA, 19 nt, Homo sapiens
aguucacaggaggccagug

SEQ ID NO: 1245129 - RNA, 22 nt, Homo sapiens
aguucagaagcggagagccugg

SEQ ID NO: 1245130 - RNA, 16 nt, Homo sapiens
aguucagagucuucag

SEQ ID NO: 1245131 - RNA, 17 nt, Homo sapiens
aguucagccuccuugaa

SEQ ID NO: 1245132 - RNA, 22 nt, Homo sapiens
aguucaguagaauuaccauuaa

SEQ ID NO: 1245133 - RNA, 18 nt, Homo sapiens
aguucauagggucucuuc

SEQ ID NO: 1245134 - RNA, 16 nt, Homo sapiens
aguucauauguaccau

SEQ ID NO: 1245135 - RNA, 20 nt, Homo sapiens
aguucaucggaauucagcca

SEQ ID NO: 1245136 - RNA, 18 nt, Homo sapiens
aguucauggugaucagug

SEQ ID NO: 1245137 - RNA, 17 nt, Homo sapiens
aguuccaaaagcacaga

SEQ ID NO: 1245138 - RNA, 18 nt, Homo sapiens
aguuccaccaugagcuca

SEQ ID NO: 1245139 - RNA, 18 nt, Homo sapiens
aguuccagaaacuuuaag

SEQ ID NO: 1245140 - RNA, 17 nt, Homo sapiens
aguuccagcagaugcca

SEQ ID NO: 1245141 - RNA, 21 nt, Homo sapiens
aguucccccaaccaucuucac

SEQ ID NO: 1245142 - RNA, 19 nt, Homo sapiens
aguucccccaguaccucca

SEQ ID NO: 1245143 - RNA, 20 nt, Homo sapiens
aguuccucgcucugggaugc

SEQ ID NO: 1245144 - RNA, 20 nt, Homo sapiens
aguuccugccuuaacugaug

SEQ ID NO: 1245145 - RNA, 22 nt, Homo sapiens
aguuccuuggagggacaugacu

SEQ ID NO: 1245146 - RNA, 15 nt, Homo sapiens
aguucuaagauucua

SEQ ID NO: 1245147 - RNA, 19 nt, Homo sapiens
aguucucagggcuccugcc

SEQ ID NO: 1245148 - RNA, 22 nt, Homo sapiens
aguucugaggucccugugugua

SEQ ID NO: 1245149 - RNA, 22 nt, Homo sapiens
aguucuggaagggacuuuagag

SEQ ID NO: 1245150 - RNA, 17 nt, Homo sapiens
aguucuggucagaugau

SEQ ID NO: 1245151 - RNA, 20 nt, Homo sapiens
aguucuggucagaugauaua

SEQ ID NO: 1245152 - RNA, 15 nt, Homo sapiens
aguucuugugccaua

SEQ ID NO: 1245153 - RNA, 21 nt, Homo sapiens
aguucuuuauaacaaaacagg

SEQ ID NO: 1245154 - RNA, 18 nt, Homo sapiens
aguugaagcuaagauuua

SEQ ID NO: 1245155 - RNA, 19 nt, Homo sapiens
aguugagagagaaucucaa

SEQ ID NO: 1245156 - RNA, 17 nt, Homo sapiens
aguugcaauugaauuaa

SEQ ID NO: 1245157 - RNA, 14 nt, Homo sapiens
aguugcagccaggg

SEQ ID NO: 1245158 - RNA, 19 nt, Homo sapiens
aguugcagccagggccagu

SEQ ID NO: 1245159 - RNA, 19 nt, Homo sapiens
aguugcauugacugucaca

SEQ ID NO: 1245160 - RNA, 23 nt, Homo sapiens
aguugccacauuuaguccuguac

SEQ ID NO: 1245161 - RNA, 18 nt, Homo sapiens
auucuuucuaaacuacaa

SEQ ID NO: 1245162 - RNA, 13 nt, Homo sapiens
auucuuuuaguuu

SEQ ID NO: 1245163 - RNA, 18 nt, Homo sapiens
auucuuuuccaagcuccu

SEQ ID NO: 1245164 - RNA, 14 nt, Homo sapiens
auugaaaguccuag

SEQ ID NO: 1245165 - RNA, 17 nt, Homo sapiens
auugaaaucaagcuuau

SEQ ID NO: 1245166 - RNA, 13 nt, Homo sapiens
auugaaaugucac

SEQ ID NO: 1245167 - RNA, 19 nt, Homo sapiens
auugaaauguuugcauaaa

SEQ ID NO: 1245168 - RNA, 15 nt, Homo sapiens
auugaacacaaacug

SEQ ID NO: 1245169 - RNA, 17 nt, Homo sapiens
auugaagaaaagcacuu

SEQ ID NO: 1245170 - RNA, 12 nt, Homo sapiens
auugaaguaaug

SEQ ID NO: 1245171 - RNA, 16 nt, Homo sapiens
auugaaguauuuugcu

SEQ ID NO: 1245172 - RNA, 18 nt, Homo sapiens
auugaaguuuuggcaauu

SEQ ID NO: 1245173 - RNA, 19 nt, Homo sapiens
auugaaucugauuggacau

SEQ ID NO: 1245174 - RNA, 13 nt, Homo sapiens
auugaauuaucuu

SEQ ID NO: 1245175 - RNA, 17 nt, Homo sapiens
auugacccuagccagag

SEQ ID NO: 1245176 - RNA, 22 nt, Homo sapiens
auugaccgcgacuaauuucaaa

SEQ ID NO: 1245177 - RNA, 15 nt, Homo sapiens
auugaccuacuuugg

SEQ ID NO: 1245178 - RNA, 18 nt, Homo sapiens
auugacgacaagugcuga

SEQ ID NO: 1245179 - RNA, 19 nt, Homo sapiens
auugacgacaagugcugaa

SEQ ID NO: 1245180 - RNA, 15 nt, Homo sapiens
auugagaagccaugu

SEQ ID NO: 1245181 - RNA, 14 nt, Homo sapiens
auugagagugauuc

SEQ ID NO: 1245182 - RNA, 18 nt, Homo sapiens
auugagcagaagaucaag

SEQ ID NO: 1245183 - RNA, 17 nt, Homo sapiens
auugaggaaauauuaau

SEQ ID NO: 1245184 - RNA, 23 nt, Homo sapiens
auugauaaucuucaggugaacac

SEQ ID NO: 1245185 - RNA, 12 nt, Homo sapiens
auugauguugcu

SEQ ID NO: 1245186 - RNA, 15 nt, Homo sapiens
auugauuaaugaacu

SEQ ID NO: 1245187 - RNA, 16 nt, Homo sapiens
auugauuucugacucu

SEQ ID NO: 1245188 - RNA, 17 nt, Homo sapiens
auugauuuuaaccaaug

SEQ ID NO: 1245189 - RNA, 22 nt, Homo sapiens
auugcaaauaaaccacuuucua

SEQ ID NO: 1245190 - RNA, 15 nt, Homo sapiens
auugcaagcauugac

SEQ ID NO: 1245191 - RNA, 13 nt, Homo sapiens
auugcaauaacug

SEQ ID NO: 1245192 - RNA, 21 nt, Homo sapiens
auugcacgggagaauauacaa

SEQ ID NO: 1245193 - RNA, 15 nt, Homo sapiens
auugcacugcuguuc

SEQ ID NO: 1245194 - RNA, 22 nt, Homo sapiens
auugcagcuagaggcaucuucu

SEQ ID NO: 1245195 - RNA, 13 nt, Homo sapiens
auugcauccacua

SEQ ID NO: 1245196 - RNA, 16 nt, Homo sapiens
auugcauccacuagcu

SEQ ID NO: 1245197 - RNA, 21 nt, Homo sapiens
auugccaaauugacauguugu

SEQ ID NO: 1245198 - RNA, 12 nt, Homo sapiens
auugccaucacu

SEQ ID NO: 1245199 - RNA, 14 nt, Homo sapiens
auugcuagccagca

SEQ ID NO: 1245200 - RNA, 20 nt, Homo sapiens
auugcuagccagcauuccau

SEQ ID NO: 1245201 - RNA, 19 nt, Homo sapiens
auugcuauuuauuuuuaca

SEQ ID NO: 1245202 - RNA, 17 nt, Homo sapiens
auugcucagagaaggaa

SEQ ID NO: 1245203 - RNA, 21 nt, Homo sapiens
auugcugggaggacuggaccg

SEQ ID NO: 1245204 - RNA, 16 nt, Homo sapiens
auugcuguugagaugg

SEQ ID NO: 1245205 - RNA, 20 nt, Homo sapiens
auugcuuacaagccuaagaa

SEQ ID NO: 1245206 - RNA, 14 nt, Homo sapiens
auugcuugagccca

SEQ ID NO: 1245207 - RNA, 15 nt, Homo sapiens
auugcuuugccaaaa

SEQ ID NO: 1245208 - RNA, 13 nt, Homo sapiens
auugcuuugguca

SEQ ID NO: 1245209 - RNA, 21 nt, Homo sapiens
auuggaauggaacuacuguac

SEQ ID NO: 1245210 - RNA, 19 nt, Homo sapiens
auuggagaguaaaaacuga

SEQ ID NO: 1245211 - RNA, 20 nt, Homo sapiens
auuggauaaaauaaaugcaa

SEQ ID NO: 1245212 - RNA, 13 nt, Homo sapiens
auuggcacugugg

SEQ ID NO: 1245213 - RNA, 14 nt, Homo sapiens
auuggcacugugga

SEQ ID NO: 1245214 - RNA, 18 nt, Homo sapiens
auuggcuauaacaugucu

SEQ ID NO: 1245215 - RNA, 13 nt, Homo sapiens
auuggcugagaua

SEQ ID NO: 1245216 - RNA, 18 nt, Homo sapiens
auugggcugacaccuacc

SEQ ID NO: 1245217 - RNA, 21 nt, Homo sapiens
auugguccgaucuuugacucu

SEQ ID NO: 1245218 - RNA, 19 nt, Homo sapiens
auuggugaacaguguauag

SEQ ID NO: 1245219 - RNA, 20 nt, Homo sapiens
auugguggcagauuuuacaa

SEQ ID NO: 1245220 - RNA, 21 nt, Homo sapiens
auugguggggcuggguaccaa

SEQ ID NO: 1245221 - RNA, 13 nt, Homo sapiens
auugguuuggcaa

SEQ ID NO: 1245222 - RNA, 16 nt, Homo sapiens
auuguacacgcugaug

SEQ ID NO: 1245223 - RNA, 20 nt, Homo sapiens
auuguacauauuuguggaau

SEQ ID NO: 1245224 - RNA, 21 nt, Homo sapiens
auuguauuuuuaacaccagaa

SEQ ID NO: 1245225 - RNA, 20 nt, Homo sapiens
auugucagaguucugcucua

SEQ ID NO: 1245226 - RNA, 24 nt, Homo sapiens
auugucaugguuacaaacuacaga

SEQ ID NO: 1245227 - RNA, 11 nt, Homo sapiens
auuguccuugg

SEQ ID NO: 1245228 - RNA, 20 nt, Homo sapiens
auugucgguuaccucugcau

SEQ ID NO: 1245229 - RNA, 23 nt, Homo sapiens
auugucucguguacagcucccuu

SEQ ID NO: 1245230 - RNA, 18 nt, Homo sapiens
auugucuguaaugacaaa

SEQ ID NO: 1245231 - RNA, 17 nt, Homo sapiens
auugucuuauuacagca

SEQ ID NO: 1245232 - RNA, 15 nt, Homo sapiens
auugugagccaccac

SEQ ID NO: 1245233 - RNA, 21 nt, Homo sapiens
auugugagcgaauuagcaaua

SEQ ID NO: 1245234 - RNA, 15 nt, Homo sapiens
auugugcaguacuuu

SEQ ID NO: 1245235 - RNA, 17 nt, Homo sapiens
auugugcugauugugga

SEQ ID NO: 1245236 - RNA, 21 nt, Homo sapiens
auuguggaucuuuucauucuc

SEQ ID NO: 1245237 - RNA, 23 nt, Homo sapiens
auuguggauuauaaaaaauguaa

SEQ ID NO: 1245238 - RNA, 12 nt, Homo sapiens
auuguggcugca

SEQ ID NO: 1245239 - RNA, 14 nt, Homo sapiens
auugugugucacaa

SEQ ID NO: 1245240 - RNA, 20 nt, Homo sapiens
auuguguuaggacagcauau

SEQ ID NO: 1245241 - RNA, 22 nt, Homo sapiens
auuguguuaggacagcauauaa

SEQ ID NO: 1245242 - RNA, 12 nt, Homo sapiens
auuguguucucu

SEQ ID NO: 1245243 - RNA, 17 nt, Homo sapiens
auuguguuugugccaua

SEQ ID NO: 1245244 - RNA, 20 nt, Homo sapiens
auuguuccaguacuauggag

SEQ ID NO: 1245245 - RNA, 17 nt, Homo sapiens
auuguugacaacuguga

SEQ ID NO: 1245246 - RNA, 18 nt, Homo sapiens
auuguugacaacugugac

SEQ ID NO: 1245247 - RNA, 16 nt, Homo sapiens
auuguugggaggacag

SEQ ID NO: 1245248 - RNA, 13 nt, Homo sapiens
auuguuguuacuu

SEQ ID NO: 1245249 - RNA, 21 nt, Homo sapiens
auuguuugguaaauguuucuu

SEQ ID NO: 1245250 - RNA, 14 nt, Homo sapiens
auuguuuucagugu

SEQ ID NO: 1245251 - RNA, 17 nt, Homo sapiens
auuguuuucuuuuacag

SEQ ID NO: 1245252 - RNA, 21 nt, Homo sapiens
auuuaaaaaaauacaguauuc

SEQ ID NO: 1245253 - RNA, 21 nt, Homo sapiens
auuuaaaacagacacuggcau

SEQ ID NO: 1245254 - RNA, 17 nt, Homo sapiens
auuuaaaacaucauuac

SEQ ID NO: 1245255 - RNA, 20 nt, Homo sapiens
auuuaaaacgcaugugcagc

SEQ ID NO: 1245256 - RNA, 19 nt, Homo sapiens
auuuaaaacguuuugguca

SEQ ID NO: 1245257 - RNA, 20 nt, Homo sapiens
auuuaaaaggacugcugauu

SEQ ID NO: 1245258 - RNA, 16 nt, Homo sapiens
auuuaaaaugagaucg

SEQ ID NO: 1245259 - RNA, 18 nt, Homo sapiens
auuuaaacaaugccaagu

SEQ ID NO: 1245260 - RNA, 18 nt, Homo sapiens
auuuaaacaccuccucau

SEQ ID NO: 1245261 - RNA, 16 nt, Homo sapiens
auuuaaacucaagaca

SEQ ID NO: 1245262 - RNA, 17 nt, Homo sapiens
auuuaaacucaagacaa

SEQ ID NO: 1245263 - RNA, 13 nt, Homo sapiens
auuuaaacuucua

SEQ ID NO: 1245264 - RNA, 23 nt, Homo sapiens
auuuaaagaaaauaaacaccauu

SEQ ID NO: 1245265 - RNA, 13 nt, Homo sapiens
auuuaacacuaaa

SEQ ID NO: 1245266 - RNA, 15 nt, Homo sapiens
auuuaagacuaugau

SEQ ID NO: 1245267 - RNA, 15 nt, Homo sapiens
auuuaagccuuauaa

SEQ ID NO: 1245268 - RNA, 22 nt, Homo sapiens
auuuaagguccuaaauucuuaa

SEQ ID NO: 1245269 - RNA, 18 nt, Homo sapiens
auuuaaguuaucaacuuu

SEQ ID NO: 1245270 - RNA, 19 nt, Homo sapiens
auuuaauacagacaucuaa

SEQ ID NO: 1245271 - RNA, 19 nt, Homo sapiens
auuuaauaucuggcacugu

SEQ ID NO: 1245272 - RNA, 19 nt, Homo sapiens
auuuaauguauuaguccaa

SEQ ID NO: 1245273 - RNA, 19 nt, Homo sapiens
auuuacaaaauuacacagu

SEQ ID NO: 1245274 - RNA, 15 nt, Homo sapiens
auuuacaauuugaca

SEQ ID NO: 1245275 - RNA, 23 nt, Homo sapiens
auuuacagaaaagacucugacca

SEQ ID NO: 1245276 - RNA, 13 nt, Homo sapiens
auuuacauugccu

SEQ ID NO: 1245277 - RNA, 17 nt, Homo sapiens
auuuaccuauacauuau

SEQ ID NO: 1245278 - RNA, 14 nt, Homo sapiens
auuuacuaaaucaa

SEQ ID NO: 1245279 - RNA, 19 nt, Homo sapiens
auuuacuuuuaccacuauu

SEQ ID NO: 1245280 - RNA, 20 nt, Homo sapiens
auuuagaaaaaaguuuacaa

SEQ ID NO: 1245281 - RNA, 17 nt, Homo sapiens
auuuagacucaucuuac

SEQ ID NO: 1245282 - RNA, 22 nt, Homo sapiens
auuuagauccugguuucauaac

SEQ ID NO: 1245283 - RNA, 13 nt, Homo sapiens
auuuagcacaaaa

SEQ ID NO: 1245284 - RNA, 21 nt, Homo sapiens
auuuaggaaaugggcagugaa

SEQ ID NO: 1245285 - RNA, 22 nt, Homo sapiens
auuuaggaaaugggcagugaag

SEQ ID NO: 1245286 - RNA, 18 nt, Homo sapiens
auuuagguuuuuauuagu

SEQ ID NO: 1245287 - RNA, 15 nt, Homo sapiens
caaggccagugcuaa

SEQ ID NO: 1245288 - RNA, 24 nt, Homo sapiens
caaggcccugagcuuuguccugaa

SEQ ID NO: 1245289 - RNA, 17 nt, Homo sapiens
caaggcugcacagcuca

SEQ ID NO: 1245290 - RNA, 13 nt, Homo sapiens
caagggcaccugg

SEQ ID NO: 1245291 - RNA, 18 nt, Homo sapiens
caagggcacgugaaguca

SEQ ID NO: 1245292 - RNA, 15 nt, Homo sapiens
caaggggacaucuua

SEQ ID NO: 1245293 - RNA, 16 nt, Homo sapiens
caaggggugggccaca

SEQ ID NO: 1245294 - RNA, 18 nt, Homo sapiens
caagguacaauucuuuaa

SEQ ID NO: 1245295 - RNA, 19 nt, Homo sapiens
caagguccccuccacaucc

SEQ ID NO: 1245296 - RNA, 12 nt, Homo sapiens
caaggugacaaa

SEQ ID NO: 1245297 - RNA, 15 nt, Homo sapiens
caaggugacacauua

SEQ ID NO: 1245298 - RNA, 17 nt, Homo sapiens
caagguuuuagguucua

SEQ ID NO: 1245299 - RNA, 19 nt, Homo sapiens
caaguauaacaacuuugaa

SEQ ID NO: 1245300 - RNA, 19 nt, Homo sapiens
caaguauguugagaguugc

SEQ ID NO: 1245301 - RNA, 21 nt, Homo sapiens
caaguauguugagaguugcug

SEQ ID NO: 1245302 - RNA, 19 nt, Homo sapiens
caaguauguugauaaauga

SEQ ID NO: 1245303 - RNA, 17 nt, Homo sapiens
caaguauuauuuuacaa

SEQ ID NO: 1245304 - RNA, 21 nt, Homo sapiens
caagucaggcccuuauuuuca

SEQ ID NO: 1245305 - RNA, 18 nt, Homo sapiens
caagucaugugcauuucc

SEQ ID NO: 1245306 - RNA, 21 nt, Homo sapiens
caagucccaaauucauugacu

SEQ ID NO: 1245307 - RNA, 22 nt, Homo sapiens
caaguccguuccgaaggcauuu

SEQ ID NO: 1245308 - RNA, 16 nt, Homo sapiens
caaguccuguucuguu

SEQ ID NO: 1245309 - RNA, 17 nt, Homo sapiens
caaguccuuaccucuuc

SEQ ID NO: 1245310 - RNA, 23 nt, Homo sapiens
caagucgcuccuagguucuuaag

SEQ ID NO: 1245311 - RNA, 14 nt, Homo sapiens
caagucugacucuc

SEQ ID NO: 1245312 - RNA, 18 nt, Homo sapiens
caagugaggagugccagc

SEQ ID NO: 1245313 - RNA, 17 nt, Homo sapiens
caagugccacaugccua

SEQ ID NO: 1245314 - RNA, 17 nt, Homo sapiens
caagugcgugccgugug

SEQ ID NO: 1245315 - RNA, 19 nt, Homo sapiens
caaguggccauuaccaucu

SEQ ID NO: 1245316 - RNA, 23 nt, Homo sapiens
caagugggauuugcauaaaguga

SEQ ID NO: 1245317 - RNA, 16 nt, Homo sapiens
caagugucuagaguca

SEQ ID NO: 1245318 - RNA, 12 nt, Homo sapiens
caagugugaaca

SEQ ID NO: 1245319 - RNA, 17 nt, Homo sapiens
caagugugcacuccagc

SEQ ID NO: 1245320 - RNA, 14 nt, Homo sapiens
caagugugucuuac

SEQ ID NO: 1245321 - RNA, 17 nt, Homo sapiens
caaguuacagugaugcu

SEQ ID NO: 1245322 - RNA, 18 nt, Homo sapiens
caaguuacucugccuuuc

SEQ ID NO: 1245323 - RNA, 21 nt, Homo sapiens
caaguucaugcagcuguggca

SEQ ID NO: 1245324 - RNA, 22 nt, Homo sapiens
caaguuccaugggauacaaccu

SEQ ID NO: 1245325 - RNA, 17 nt, Homo sapiens
caaguuccgucagucca

SEQ ID NO: 1245326 - RNA, 18 nt, Homo sapiens
caaguuccgucaguccaa

SEQ ID NO: 1245327 - RNA, 14 nt, Homo sapiens
caaguucuucaccu

SEQ ID NO: 1245328 - RNA, 21 nt, Homo sapiens
caaguucuucaccucuaucca

SEQ ID NO: 1245329 - RNA, 18 nt, Homo sapiens
caaguugcuuuuaccuga

SEQ ID NO: 1245330 - RNA, 22 nt, Homo sapiens
caaguuggaaauauucaugcuu

SEQ ID NO: 1245331 - RNA, 16 nt, Homo sapiens
caaguuucaucaguca

SEQ ID NO: 1245332 - RNA, 16 nt, Homo sapiens
caaguuuuucugucaa

SEQ ID NO: 1245333 - RNA, 15 nt, Homo sapiens
caauaaaaaguucag

SEQ ID NO: 1245334 - RNA, 16 nt, Homo sapiens
caauaaaaccacugua

SEQ ID NO: 1245335 - RNA, 17 nt, Homo sapiens
caauaaaaccacuguac

SEQ ID NO: 1245336 - RNA, 14 nt, Homo sapiens
caauaaaaguguga

SEQ ID NO: 1245337 - RNA, 15 nt, Homo sapiens
caauaaacauaacag

SEQ ID NO: 1245338 - RNA, 14 nt, Homo sapiens
caauaaacaucuga

SEQ ID NO: 1245339 - RNA, 17 nt, Homo sapiens
caauaaaccuccgccaa

SEQ ID NO: 1245340 - RNA, 15 nt, Homo sapiens
caauaaacuuagagg

SEQ ID NO: 1245341 - RNA, 19 nt, Homo sapiens
caauaaagcaaugugguag

SEQ ID NO: 1245342 - RNA, 18 nt, Homo sapiens
caauaaaggcagcugccu

SEQ ID NO: 1245343 - RNA, 19 nt, Homo sapiens
caauaaaggcagcugccuc

SEQ ID NO: 1245344 - RNA, 17 nt, Homo sapiens
caauaaauaaucuguac

SEQ ID NO: 1245345 - RNA, 19 nt, Homo sapiens
caauaaauaccagacacgu

SEQ ID NO: 1245346 - RNA, 16 nt, Homo sapiens
caauaaaucuuuggaa

SEQ ID NO: 1245347 - RNA, 15 nt, Homo sapiens
caauaaaugaacugc

SEQ ID NO: 1245348 - RNA, 16 nt, Homo sapiens
caauaacacugucucc

SEQ ID NO: 1245349 - RNA, 13 nt, Homo sapiens
caauaacagguca

SEQ ID NO: 1245350 - RNA, 21 nt, Homo sapiens
caauaacauacaugagauaac

SEQ ID NO: 1245351 - RNA, 15 nt, Homo sapiens
caauaacuucugacc

SEQ ID NO: 1245352 - RNA, 19 nt, Homo sapiens
caauaaguuccauguuaaa

SEQ ID NO: 1245353 - RNA, 22 nt, Homo sapiens
caauaaguuccauguuaaaaua

SEQ ID NO: 1245354 - RNA, 23 nt, Homo sapiens
caauaauauuucaagugccuaga

SEQ ID NO: 1245355 - RNA, 12 nt, Homo sapiens
caauacagugaa

SEQ ID NO: 1245356 - RNA, 16 nt, Homo sapiens
caauacaugcugcuaa

SEQ ID NO: 1245357 - RNA, 21 nt, Homo sapiens
caauacaugcugcuaauucaa

SEQ ID NO: 1245358 - RNA, 15 nt, Homo sapiens
caauagagacuguag

SEQ ID NO: 1245359 - RNA, 18 nt, Homo sapiens
caauagaguugggacaau

SEQ ID NO: 1245360 - RNA, 14 nt, Homo sapiens
caauagaucuccag

SEQ ID NO: 1245361 - RNA, 17 nt, Homo sapiens
caauagugaaaugccac

SEQ ID NO: 1245362 - RNA, 22 nt, Homo sapiens
caauauacuuguauagcaguuu

SEQ ID NO: 1245363 - RNA, 15 nt, Homo sapiens
caauaucauaucauc

SEQ ID NO: 1245364 - RNA, 16 nt, Homo sapiens
caauauguauuacaaa

SEQ ID NO: 1245365 - RNA, 21 nt, Homo sapiens
caauauuccuuauuaauacaa

SEQ ID NO: 1245366 - RNA, 13 nt, Homo sapiens
caauauugccaug

SEQ ID NO: 1245367 - RNA, 19 nt, Homo sapiens
caauauugccaugguuuua

SEQ ID NO: 1245368 - RNA, 18 nt, Homo sapiens
caauauuuuuauaucaug

SEQ ID NO: 1245369 - RNA, 22 nt, Homo sapiens
caauauuuuuauaucaugcaaa

SEQ ID NO: 1245370 - RNA, 13 nt, Homo sapiens
caaucacaagaag

SEQ ID NO: 1245371 - RNA, 15 nt, Homo sapiens
caaucagcacugaaa

SEQ ID NO: 1245372 - RNA, 20 nt, Homo sapiens
caaucuaaagauacaguguc

SEQ ID NO: 1245373 - RNA, 15 nt, Homo sapiens
caaucucuggugccu

SEQ ID NO: 1245374 - RNA, 18 nt, Homo sapiens
caaucuggcuuagugcca

SEQ ID NO: 1245375 - RNA, 12 nt, Homo sapiens
caaucuguaaac

SEQ ID NO: 1245376 - RNA, 12 nt, Homo sapiens
caaucuguguuc

SEQ ID NO: 1245377 - RNA, 21 nt, Homo sapiens
caaucuguguucgauggcuca

SEQ ID NO: 1245378 - RNA, 19 nt, Homo sapiens
caaucuuaaaacaaauuca

SEQ ID NO: 1245379 - RNA, 23 nt, Homo sapiens
caaucuuugcuguauacuuuuaa

SEQ ID NO: 1245380 - RNA, 22 nt, Homo sapiens
caaugaaaaaaaguacauguau

SEQ ID NO: 1245381 - RNA, 19 nt, Homo sapiens
caaugaaaaauguaauuua

SEQ ID NO: 1245382 - RNA, 15 nt, Homo sapiens
caaugacaucucagg

SEQ ID NO: 1245383 - RNA, 21 nt, Homo sapiens
caaugacaucucaggggccag

SEQ ID NO: 1245384 - RNA, 22 nt, Homo sapiens
caaugacaucucaggggccaga

SEQ ID NO: 1245385 - RNA, 19 nt, Homo sapiens
caaugacuucccugcucca

SEQ ID NO: 1245386 - RNA, 12 nt, Homo sapiens
caaugauucaua

SEQ ID NO: 1245387 - RNA, 16 nt, Homo sapiens
caaugauucauaacaa

SEQ ID NO: 1245388 - RNA, 17 nt, Homo sapiens
caaugcacauccauucc

SEQ ID NO: 1245389 - RNA, 18 nt, Homo sapiens
caaugcacauccauuccc

SEQ ID NO: 1245390 - RNA, 21 nt, Homo sapiens
caaugcacccccaaccuccau

SEQ ID NO: 1245391 - RNA, 15 nt, Homo sapiens
caaugccaaucuuca

SEQ ID NO: 1245392 - RNA, 19 nt, Homo sapiens
caaugcuaauaaaguccua

SEQ ID NO: 1245393 - RNA, 21 nt, Homo sapiens
caaugcugcaggucaacagcu

SEQ ID NO: 1245394 - RNA, 19 nt, Homo sapiens
caaugcuuaaacuaaauaa

SEQ ID NO: 1245395 - RNA, 21 nt, Homo sapiens
caaugcuuugggaggccaagg

SEQ ID NO: 1245396 - RNA, 17 nt, Homo sapiens
caauggaagauuugccc

SEQ ID NO: 1245397 - RNA, 21 nt, Homo sapiens
caauggaccucucagcagaaa

SEQ ID NO: 1245398 - RNA, 21 nt, Homo sapiens
caauggaguggcugccaugga

SEQ ID NO: 1245399 - RNA, 22 nt, Homo sapiens
caauggcacuguugcaaacuca

SEQ ID NO: 1245400 - RNA, 13 nt, Homo sapiens
caaugggcacuga

SEQ ID NO: 1245401 - RNA, 18 nt, Homo sapiens
caaugggcacugauuuga

SEQ ID NO: 1245402 - RNA, 16 nt, Homo sapiens
caaugggcucuuccaa

SEQ ID NO: 1245403 - RNA, 14 nt, Homo sapiens
caauguaagcauac

SEQ ID NO: 1245404 - RNA, 18 nt, Homo sapiens
caauguaccguuuccuua

SEQ ID NO: 1245405 - RNA, 15 nt, Homo sapiens
caaugucaaugugaa

SEQ ID NO: 1245406 - RNA, 13 nt, Homo sapiens
caaugucacuuaa

SEQ ID NO: 1245407 - RNA, 18 nt, Homo sapiens
caaugucucuuugugcuc

SEQ ID NO: 1245408 - RNA, 23 nt, Homo sapiens
caaugucugcaccaaugcuaaua

SEQ ID NO: 1245409 - RNA, 15 nt, Homo sapiens
caaugugaacacugg

SEQ ID NO: 1245410 - RNA, 17 nt, Homo sapiens
caaugugaacuuuauua

SEQ ID NO: 1245411 - RNA, 21 nt, Homo sapiens
caaugugauucuaaugucuuc

SEQ ID NO: 1245412 - RNA, 12 nt, Homo sapiens
cacuuaauagca

SEQ ID NO: 1245413 - RNA, 20 nt, Homo sapiens
cacuuacagcucuggccaca

SEQ ID NO: 1245414 - RNA, 16 nt, Homo sapiens
cacuuagcccaagagg

SEQ ID NO: 1245415 - RNA, 18 nt, Homo sapiens
cacuuagcuaucagaaga

SEQ ID NO: 1245416 - RNA, 15 nt, Homo sapiens
cacuuagugaucauu

SEQ ID NO: 1245417 - RNA, 17 nt, Homo sapiens
cacuuagugaucauuua

SEQ ID NO: 1245418 - RNA, 23 nt, Homo sapiens
cacuuauaagaaagaucaaagac

SEQ ID NO: 1245419 - RNA, 13 nt, Homo sapiens
cacuucagaauuc

SEQ ID NO: 1245420 - RNA, 18 nt, Homo sapiens
cacuucauucugcagggu

SEQ ID NO: 1245421 - RNA, 12 nt, Homo sapiens
cacuuccagggg

SEQ ID NO: 1245422 - RNA, 12 nt, Homo sapiens
cacuuccagucc

SEQ ID NO: 1245423 - RNA, 18 nt, Homo sapiens
cacuuccuuggaaacaga

SEQ ID NO: 1245424 - RNA, 19 nt, Homo sapiens
cacuucgagcacuguccag

SEQ ID NO: 1245425 - RNA, 17 nt, Homo sapiens
cacuucuaacuccacug

SEQ ID NO: 1245426 - RNA, 19 nt, Homo sapiens
cacuugaaggaagaagucu

SEQ ID NO: 1245427 - RNA, 13 nt, Homo sapiens
cacuugagaggau

SEQ ID NO: 1245428 - RNA, 14 nt, Homo sapiens
cacuugauguuugu

SEQ ID NO: 1245429 - RNA, 20 nt, Homo sapiens
cacuugcucccaacccauuc

SEQ ID NO: 1245430 - RNA, 22 nt, Homo sapiens
cacuuggccucagcuggcugua

SEQ ID NO: 1245431 - RNA, 19 nt, Homo sapiens
cacuugggucuucccugua

SEQ ID NO: 1245432 - RNA, 19 nt, Homo sapiens
cacuuuaaagcaauugcau

SEQ ID NO: 1245433 - RNA, 21 nt, Homo sapiens
cacuuuaauuaccaaccuguu

SEQ ID NO: 1245434 - RNA, 20 nt, Homo sapiens
cacuuuagauauacauauca

SEQ ID NO: 1245435 - RNA, 16 nt, Homo sapiens
cacuuuauaaauauca

SEQ ID NO: 1245436 - RNA, 17 nt, Homo sapiens
cacuuugaaauaccuca

SEQ ID NO: 1245437 - RNA, 22 nt, Homo sapiens
cacuuugcacugauauaucaug

SEQ ID NO: 1245438 - RNA, 12 nt, Homo sapiens
cacuuugccucc

SEQ ID NO: 1245439 - RNA, 14 nt, Homo sapiens
cacuuugcucuggg

SEQ ID NO: 1245440 - RNA, 18 nt, Homo sapiens
cacuuuggacuucucuga

SEQ ID NO: 1245441 - RNA, 19 nt, Homo sapiens
cacuuuggacuucucugaa

SEQ ID NO: 1245442 - RNA, 22 nt, Homo sapiens
cacuuuggacuucucugaaaua

SEQ ID NO: 1245443 - RNA, 19 nt, Homo sapiens
cacuuugggaggcugaggc

SEQ ID NO: 1245444 - RNA, 15 nt, Homo sapiens
cagaaaaacaaucuu

SEQ ID NO: 1245445 - RNA, 16 nt, Homo sapiens
cagaaaaacucuggga

SEQ ID NO: 1245446 - RNA, 15 nt, Homo sapiens
cagaaaacagagccu

SEQ ID NO: 1245447 - RNA, 17 nt, Homo sapiens
cagaaaagcaauacugu

SEQ ID NO: 1245448 - RNA, 13 nt, Homo sapiens
cagaaaagugaca

SEQ ID NO: 1245449 - RNA, 17 nt, Homo sapiens
cagaaaagugacagugg

SEQ ID NO: 1245450 - RNA, 20 nt, Homo sapiens
cagaaaauauuauguguuuc

SEQ ID NO: 1245451 - RNA, 16 nt, Homo sapiens
cagaaacacacaguca

SEQ ID NO: 1245452 - RNA, 22 nt, Homo sapiens
cagaaaccugcagggacuccau

SEQ ID NO: 1245453 - RNA, 22 nt, Homo sapiens
cagaaacuagaaaugugaauga

SEQ ID NO: 1245454 - RNA, 22 nt, Homo sapiens
cagaaacugaugccaaggggcu

SEQ ID NO: 1245455 - RNA, 19 nt, Homo sapiens
cagaaaggagaacuaucca

SEQ ID NO: 1245456 - RNA, 19 nt, Homo sapiens
cagaaaguggccaugccac

SEQ ID NO: 1245457 - RNA, 17 nt, Homo sapiens
cagaaaugcauuuguaa

SEQ ID NO: 1245458 - RNA, 15 nt, Homo sapiens
cagaaauggacugga

SEQ ID NO: 1245459 - RNA, 21 nt, Homo sapiens
cagaaauggugcucaccaugc

SEQ ID NO: 1245460 - RNA, 22 nt, Homo sapiens
cagaaauuuaucuuucaaagag

SEQ ID NO: 1245461 - RNA, 21 nt, Homo sapiens
cagaacacagcaauuccucag

SEQ ID NO: 1245462 - RNA, 18 nt, Homo sapiens
cagaacagcaucauguca

SEQ ID NO: 1245463 - RNA, 18 nt, Homo sapiens
cagaacaucgauauguau

SEQ ID NO: 1245464 - RNA, 20 nt, Homo sapiens
cagaacaucgauauguauau

SEQ ID NO: 1245465 - RNA, 12 nt, Homo sapiens
cagaaccaaagc

SEQ ID NO: 1245466 - RNA, 16 nt, Homo sapiens
cagaaccaaagcucaa

SEQ ID NO: 1245467 - RNA, 19 nt, Homo sapiens
cagaacccaggacagccac

SEQ ID NO: 1245468 - RNA, 19 nt, Homo sapiens
cagaaccuucaacccagug

SEQ ID NO: 1245469 - RNA, 20 nt, Homo sapiens
cagaacguggugaccuuuca

SEQ ID NO: 1245470 - RNA, 18 nt, Homo sapiens
cagaacucccauuacaac

SEQ ID NO: 1245471 - RNA, 23 nt, Homo sapiens
cagaacugaagugugcugugaca

SEQ ID NO: 1245472 - RNA, 22 nt, Homo sapiens
cagaacugcagucagcaugaau

SEQ ID NO: 1245473 - RNA, 12 nt, Homo sapiens
cagaacugccau

SEQ ID NO: 1245474 - RNA, 16 nt, Homo sapiens
cagaacugcccccacu

SEQ ID NO: 1245475 - RNA, 18 nt, Homo sapiens
cagaacuucccugauuga

SEQ ID NO: 1245476 - RNA, 17 nt, Homo sapiens
cagaagaaaauucuccu

SEQ ID NO: 1245477 - RNA, 18 nt, Homo sapiens
cagaagaauauucaggac

SEQ ID NO: 1245478 - RNA, 19 nt, Homo sapiens
cagaagaccccugacucau

SEQ ID NO: 1245479 - RNA, 20 nt, Homo sapiens
cagaagaccccugacucauc

SEQ ID NO: 1245480 - RNA, 22 nt, Homo sapiens
cagaagacccgcucuccaucuu

SEQ ID NO: 1245481 - RNA, 23 nt, Homo sapiens
cagaagagguugggcuuccaugc

SEQ ID NO: 1245482 - RNA, 22 nt, Homo sapiens
cagaagauaacuugagcaccgu

SEQ ID NO: 1245483 - RNA, 21 nt, Homo sapiens
cagaagauccaagaggcccug

SEQ ID NO: 1245484 - RNA, 23 nt, Homo sapiens
cagaagcagcuucuuuugucucc

SEQ ID NO: 1245485 - RNA, 18 nt, Homo sapiens
cagaagcucccagcugac

SEQ ID NO: 1245486 - RNA, 13 nt, Homo sapiens
cagaagcuuaaaa

SEQ ID NO: 1245487 - RNA, 23 nt, Homo sapiens
cagaaggaaagaagggggcccug

SEQ ID NO: 1245488 - RNA, 14 nt, Homo sapiens
cagaaggaaccagc

SEQ ID NO: 1245489 - RNA, 18 nt, Homo sapiens
cagaaggaaccagccaug

SEQ ID NO: 1245490 - RNA, 13 nt, Homo sapiens
cagaaggacucag

SEQ ID NO: 1245491 - RNA, 18 nt, Homo sapiens
cagaaguauuuucuaguu

SEQ ID NO: 1245492 - RNA, 14 nt, Homo sapiens
cagaaguuccucaa

SEQ ID NO: 1245493 - RNA, 21 nt, Homo sapiens
cagaaguuugcaaauaggcag

SEQ ID NO: 1245494 - RNA, 14 nt, Homo sapiens
cagaauagcacaaa

SEQ ID NO: 1245495 - RNA, 20 nt, Homo sapiens
cagaauagcuuccaauaaag

SEQ ID NO: 1245496 - RNA, 18 nt, Homo sapiens
cagaauauacccauccau

SEQ ID NO: 1245497 - RNA, 23 nt, Homo sapiens
cagaauauuaauaaaacuuuaug

SEQ ID NO: 1245498 - RNA, 16 nt, Homo sapiens
cagaauauucucccau

SEQ ID NO: 1245499 - RNA, 17 nt, Homo sapiens
cagaauauugugcccca

SEQ ID NO: 1245500 - RNA, 18 nt, Homo sapiens
cagaauauugugccccau

SEQ ID NO: 1245501 - RNA, 15 nt, Homo sapiens
cagaaucagaucuga

SEQ ID NO: 1245502 - RNA, 21 nt, Homo sapiens
cagaauccauaaauguguucc

SEQ ID NO: 1245503 - RNA, 17 nt, Homo sapiens
cagaaucucaaauaacu

SEQ ID NO: 1245504 - RNA, 16 nt, Homo sapiens
cagaaucugaauguaa

SEQ ID NO: 1245505 - RNA, 18 nt, Homo sapiens
cagaaucugcuguugcca

SEQ ID NO: 1245506 - RNA, 14 nt, Homo sapiens
cagaaugacuccac

SEQ ID NO: 1245507 - RNA, 22 nt, Homo sapiens
cagaaugcugcaggacuugaga

SEQ ID NO: 1245508 - RNA, 18 nt, Homo sapiens
cagaauguaucugugaag

SEQ ID NO: 1245509 - RNA, 22 nt, Homo sapiens
cagaauguuuuuaaaauaugag

SEQ ID NO: 1245510 - RNA, 14 nt, Homo sapiens
cagaauucaucuga

SEQ ID NO: 1245511 - RNA, 19 nt, Homo sapiens
cagaauuguuccaguacua

SEQ ID NO: 1245512 - RNA, 21 nt, Homo sapiens
cagacaaaguaauuccucuca

SEQ ID NO: 1245513 - RNA, 12 nt, Homo sapiens
cagacaaaugga

SEQ ID NO: 1245514 - RNA, 15 nt, Homo sapiens
cagacaaaugugguu

SEQ ID NO: 1245515 - RNA, 19 nt, Homo sapiens
cagacaacuuguccugacu

SEQ ID NO: 1245516 - RNA, 14 nt, Homo sapiens
cagacacacccaca

SEQ ID NO: 1245517 - RNA, 18 nt, Homo sapiens
cagacacacccacagaag

SEQ ID NO: 1245518 - RNA, 11 nt, Homo sapiens
cagacaccagu

SEQ ID NO: 1245519 - RNA, 16 nt, Homo sapiens
cagacaccuggacuga

SEQ ID NO: 1245520 - RNA, 19 nt, Homo sapiens
cagacaccuggacugagcc

SEQ ID NO: 1245521 - RNA, 14 nt, Homo sapiens
cagacacucugacu

SEQ ID NO: 1245522 - RNA, 23 nt, Homo sapiens
cagacacugaccauccacucuac

SEQ ID NO: 1245523 - RNA, 16 nt, Homo sapiens
cagacagaaggugcua

SEQ ID NO: 1245524 - RNA, 19 nt, Homo sapiens
cagacauacauuuaugcac

SEQ ID NO: 1245525 - RNA, 18 nt, Homo sapiens
cagacauacgaaacacaa

SEQ ID NO: 1245526 - RNA, 20 nt, Homo sapiens
cagacaucggccuccaugac

SEQ ID NO: 1245527 - RNA, 16 nt, Homo sapiens
cagaccacgaguucau

SEQ ID NO: 1245528 - RNA, 14 nt, Homo sapiens
cagaccacuugcca

SEQ ID NO: 1245529 - RNA, 22 nt, Homo sapiens
cagaccaguuucagagaaauac

SEQ ID NO: 1245530 - RNA, 21 nt, Homo sapiens
cagacccaacucgccugugga

SEQ ID NO: 1245531 - RNA, 21 nt, Homo sapiens
cagaccccuccccucguguca

SEQ ID NO: 1245532 - RNA, 16 nt, Homo sapiens
cagaccucuucuaaga

SEQ ID NO: 1245533 - RNA, 14 nt, Homo sapiens
cagaccugcuuccu

SEQ ID NO: 1245534 - RNA, 20 nt, Homo sapiens
cagaccugcuuccugaaaua

SEQ ID NO: 1245535 - RNA, 16 nt, Homo sapiens
cagacgggcaagaagc

SEQ ID NO: 1245536 - RNA, 19 nt, Homo sapiens
cagacuaagaaauauucca

SEQ ID NO: 1245537 - RNA, 23 nt, Homo sapiens
cagugaaacuccaucucaauuua

SEQ ID NO: 1245538 - RNA, 14 nt, Homo sapiens
cagugaaaugugaa

SEQ ID NO: 1245539 - RNA, 17 nt, Homo sapiens
cagugaagaugccagug

SEQ ID NO: 1245540 - RNA, 23 nt, Homo sapiens
cagugaaggcuaagaaccuggug

SEQ ID NO: 1245541 - RNA, 16 nt, Homo sapiens
cagugaaucuguuuca

SEQ ID NO: 1245542 - RNA, 14 nt, Homo sapiens
cagugacaaacaua

SEQ ID NO: 1245543 - RNA, 19 nt, Homo sapiens
cagugacaacaucgcaaua

SEQ ID NO: 1245544 - RNA, 15 nt, Homo sapiens
cagugaccacaccaa

SEQ ID NO: 1245545 - RNA, 15 nt, Homo sapiens
cagugaccccugacc

SEQ ID NO: 1245546 - RNA, 18 nt, Homo sapiens
cagugaccccugaccuca

SEQ ID NO: 1245547 - RNA, 19 nt, Homo sapiens
cagugaccccugaccucac

SEQ ID NO: 1245548 - RNA, 20 nt, Homo sapiens
cagugagcuguguucuugcc

SEQ ID NO: 1245549 - RNA, 18 nt, Homo sapiens
cagugaggcugcacccac

SEQ ID NO: 1245550 - RNA, 15 nt, Homo sapiens
cagugaucuccauau

SEQ ID NO: 1245551 - RNA, 18 nt, Homo sapiens
cagugcaccuacugcuua

SEQ ID NO: 1245552 - RNA, 17 nt, Homo sapiens
cagugcaucauuacugu

SEQ ID NO: 1245553 - RNA, 14 nt, Homo sapiens
cagugcauuugccu

SEQ ID NO: 1245554 - RNA, 17 nt, Homo sapiens
cagugccagcaaugaca

SEQ ID NO: 1245555 - RNA, 16 nt, Homo sapiens
cagugccagcaccugc

SEQ ID NO: 1245556 - RNA, 16 nt, Homo sapiens
cagugccauugucuuu

SEQ ID NO: 1245557 - RNA, 13 nt, Homo sapiens
cagugcccaugca

SEQ ID NO: 1245558 - RNA, 22 nt, Homo sapiens
cagugccuggacaaaugaugcc

SEQ ID NO: 1245559 - RNA, 15 nt, Homo sapiens
cagugccuuccauaa

SEQ ID NO: 1245560 - RNA, 13 nt, Homo sapiens
cagugccuugcuc

SEQ ID NO: 1245561 - RNA, 23 nt, Homo sapiens
cagugcgugcucccgaugcugcu

SEQ ID NO: 1245562 - RNA, 14 nt, Homo sapiens
cagugcugcuguaa

SEQ ID NO: 1245563 - RNA, 18 nt, Homo sapiens
cagugcuucuuacuauua

SEQ ID NO: 1245564 - RNA, 14 nt, Homo sapiens
caguggacucuucc

SEQ ID NO: 1245565 - RNA, 15 nt, Homo sapiens
caguggacucuucca

SEQ ID NO: 1245566 - RNA, 16 nt, Homo sapiens
caguggcaugauguca

SEQ ID NO: 1245567 - RNA, 19 nt, Homo sapiens
cagugggcgggccaugagg

SEQ ID NO: 1245568 - RNA, 18 nt, Homo sapiens
cagugguaaaaguauuug

SEQ ID NO: 1245569 - RNA, 17 nt, Homo sapiens
cagugguauccugugac

SEQ ID NO: 1245570 - RNA, 19 nt, Homo sapiens
caguggucccagaaccuau

SEQ ID NO: 1245571 - RNA, 15 nt, Homo sapiens
caguguaaucucuau

SEQ ID NO: 1245572 - RNA, 18 nt, Homo sapiens
caguguccccuccacugu

SEQ ID NO: 1245573 - RNA, 21 nt, Homo sapiens
caguguccccuccacugucac

SEQ ID NO: 1245574 - RNA, 20 nt, Homo sapiens
cagugucugugccauggauu

SEQ ID NO: 1245575 - RNA, 16 nt, Homo sapiens
cagugucuuccauaau

SEQ ID NO: 1245576 - RNA, 20 nt, Homo sapiens
cagugugugccacaggauug

SEQ ID NO: 1245577 - RNA, 17 nt, Homo sapiens
caguguuauuaaugaca

SEQ ID NO: 1245578 - RNA, 15 nt, Homo sapiens
caguguucuaugaac

SEQ ID NO: 1245579 - RNA, 21 nt, Homo sapiens
caguuaaaugccgucuaucag

SEQ ID NO: 1245580 - RNA, 21 nt, Homo sapiens
caguuaacaggauauuagaca

SEQ ID NO: 1245581 - RNA, 20 nt, Homo sapiens
caguuaauaaaccuuugcaa

SEQ ID NO: 1245582 - RNA, 15 nt, Homo sapiens
caguuacaaaguaau

SEQ ID NO: 1245583 - RNA, 23 nt, Homo sapiens
caguuacaagauuguaaguaaau

SEQ ID NO: 1245584 - RNA, 21 nt, Homo sapiens
caguuacucccuacacugaug

SEQ ID NO: 1245585 - RNA, 20 nt, Homo sapiens
caguuacuuuuuuacacuga

SEQ ID NO: 1245586 - RNA, 15 nt, Homo sapiens
caguuagacuagucc

SEQ ID NO: 1245587 - RNA, 17 nt, Homo sapiens
caguuauagaaaaucua

SEQ ID NO: 1245588 - RNA, 19 nt, Homo sapiens
caguuaugcagaauccaaa

SEQ ID NO: 1245589 - RNA, 20 nt, Homo sapiens
caguuauuaaaauguuaaaa

SEQ ID NO: 1245590 - RNA, 19 nt, Homo sapiens
caguucacacccugcaagg

SEQ ID NO: 1245591 - RNA, 17 nt, Homo sapiens
caguucaccugcacuua

SEQ ID NO: 1245592 - RNA, 12 nt, Homo sapiens
caguucagugag

SEQ ID NO: 1245593 - RNA, 14 nt, Homo sapiens
caguucagugaggu

SEQ ID NO: 1245594 - RNA, 19 nt, Homo sapiens
caguucucacuccuaggag

SEQ ID NO: 1245595 - RNA, 16 nt, Homo sapiens
caguugaucaaugaau

SEQ ID NO: 1245596 - RNA, 19 nt, Homo sapiens
caguugcccagagcacuuu

SEQ ID NO: 1245597 - RNA, 14 nt, Homo sapiens
caguugcuuugcag

SEQ ID NO: 1245598 - RNA, 22 nt, Homo sapiens
caguuggauuuauucugccaaa

SEQ ID NO: 1245599 - RNA, 16 nt, Homo sapiens
caguugggagcacugg

SEQ ID NO: 1245600 - RNA, 13 nt, Homo sapiens
caguuuaaugucu

SEQ ID NO: 1245601 - RNA, 19 nt, Homo sapiens
caguuucuuagcuuuuuaa

SEQ ID NO: 1245602 - RNA, 14 nt, Homo sapiens
caguuuuaccucuu

SEQ ID NO: 1245603 - RNA, 20 nt, Homo sapiens
caguuuuauuuuugccaagg

SEQ ID NO: 1245604 - RNA, 23 nt, Homo sapiens
caguuuucaggaugauacacuau

SEQ ID NO: 1245605 - RNA, 14 nt, Homo sapiens
caguuuuccaugaa

SEQ ID NO: 1245606 - RNA, 20 nt, Homo sapiens
cauaaaaaauaaaguaccac

SEQ ID NO: 1245607 - RNA, 22 nt, Homo sapiens
cauaaaaaauaaaguaccacac

SEQ ID NO: 1245608 - RNA, 13 nt, Homo sapiens
cauaaaaaccaaa

SEQ ID NO: 1245609 - RNA, 22 nt, Homo sapiens
cauaaaaaccaaacccagacaa

SEQ ID NO: 1245610 - RNA, 20 nt, Homo sapiens
cauaaaaauaaaucaguuca

SEQ ID NO: 1245611 - RNA, 15 nt, Homo sapiens
cauaaaaguaaagga

SEQ ID NO: 1245612 - RNA, 21 nt, Homo sapiens
cauaaaaugucucgaguccua

SEQ ID NO: 1245613 - RNA, 21 nt, Homo sapiens
cauaaacaacuuaauguucug

SEQ ID NO: 1245614 - RNA, 14 nt, Homo sapiens
cauaaacaaugaug

SEQ ID NO: 1245615 - RNA, 20 nt, Homo sapiens
cauaaacgguuccuggugac

SEQ ID NO: 1245616 - RNA, 20 nt, Homo sapiens
cauaaagagaaaaugaugag

SEQ ID NO: 1245617 - RNA, 12 nt, Homo sapiens
cauaaagaucaa

SEQ ID NO: 1245618 - RNA, 13 nt, Homo sapiens
cauaaagccaugu

SEQ ID NO: 1245619 - RNA, 16 nt, Homo sapiens
cauaaaggacaggcca

SEQ ID NO: 1245620 - RNA, 21 nt, Homo sapiens
cauaaagugagacauugugaa

SEQ ID NO: 1245621 - RNA, 18 nt, Homo sapiens
cauaaaucuuuuuacuuu

SEQ ID NO: 1245622 - RNA, 19 nt, Homo sapiens
cauaaaugaagcagcuuua

SEQ ID NO: 1245623 - RNA, 22 nt, Homo sapiens
cauaacagucuuacugcaggca

SEQ ID NO: 1245624 - RNA, 15 nt, Homo sapiens
cauaacccacuuguc

SEQ ID NO: 1245625 - RNA, 15 nt, Homo sapiens
cauaaccugucucac

SEQ ID NO: 1245626 - RNA, 22 nt, Homo sapiens
cauaacggaaaaauaauugcca

SEQ ID NO: 1245627 - RNA, 19 nt, Homo sapiens
cauaacuaguggcucucag

SEQ ID NO: 1245628 - RNA, 11 nt, Homo sapiens
cauaacuguag

SEQ ID NO: 1245629 - RNA, 14 nt, Homo sapiens
cauaacuguucuca

SEQ ID NO: 1245630 - RNA, 16 nt, Homo sapiens
cauaagaaaacuaaga

SEQ ID NO: 1245631 - RNA, 16 nt, Homo sapiens
cauaagaaagcacuau

SEQ ID NO: 1245632 - RNA, 15 nt, Homo sapiens
cauaagaauucuguu

SEQ ID NO: 1245633 - RNA, 20 nt, Homo sapiens
cauaagagagccuugguuca

SEQ ID NO: 1245634 - RNA, 17 nt, Homo sapiens
cauaagauaaaugugcu

SEQ ID NO: 1245635 - RNA, 11 nt, Homo sapiens
cauaagccuac

SEQ ID NO: 1245636 - RNA, 15 nt, Homo sapiens
cauaagcugauuuga

SEQ ID NO: 1245637 - RNA, 21 nt, Homo sapiens
cauaagcugauuugauaccau

SEQ ID NO: 1245638 - RNA, 16 nt, Homo sapiens
cauaaggcuucaaaau

SEQ ID NO: 1245639 - RNA, 23 nt, Homo sapiens
cauaagggguuugccauuugaua

SEQ ID NO: 1245640 - RNA, 18 nt, Homo sapiens
cauaaguuaacuuccaau

SEQ ID NO: 1245641 - RNA, 21 nt, Homo sapiens
cauaaguuuacugaaucuuca

SEQ ID NO: 1245642 - RNA, 20 nt, Homo sapiens
cauaaguuuaggauaaaaua

SEQ ID NO: 1245643 - RNA, 22 nt, Homo sapiens
cauaauaaauaauuaaccacca

SEQ ID NO: 1245644 - RNA, 16 nt, Homo sapiens
cauaauaaauaucugu

SEQ ID NO: 1245645 - RNA, 18 nt, Homo sapiens
cauaauaaauaucuguac

SEQ ID NO: 1245646 - RNA, 20 nt, Homo sapiens
cauaauagcuacagugcaua

SEQ ID NO: 1245647 - RNA, 15 nt, Homo sapiens
cauaauagucaauuu

SEQ ID NO: 1245648 - RNA, 16 nt, Homo sapiens
cauaauccuuucugcc

SEQ ID NO: 1245649 - RNA, 15 nt, Homo sapiens
cauaaugcacuuuag

SEQ ID NO: 1245650 - RNA, 14 nt, Homo sapiens
cauaaugcuuuguu

SEQ ID NO: 1245651 - RNA, 18 nt, Homo sapiens
cauaauggggauuaauua

SEQ ID NO: 1245652 - RNA, 21 nt, Homo sapiens
cauaauguuacauuauuauca

SEQ ID NO: 1245653 - RNA, 16 nt, Homo sapiens
cauaauguuccagaca

SEQ ID NO: 1245654 - RNA, 21 nt, Homo sapiens
cauaauuauuauuuccagugu

SEQ ID NO: 1245655 - RNA, 14 nt, Homo sapiens
cauaauucagcacu

SEQ ID NO: 1245656 - RNA, 22 nt, Homo sapiens
cauaauuuuagaugccugugaa

SEQ ID NO: 1245657 - RNA, 21 nt, Homo sapiens
cauaauuuucuucaugcaaug

SEQ ID NO: 1245658 - RNA, 23 nt, Homo sapiens
cauacaaagcaguuuauuuuaga

SEQ ID NO: 1245659 - RNA, 13 nt, Homo sapiens
cauacaacagaaa

SEQ ID NO: 1245660 - RNA, 22 nt, Homo sapiens
cauacacacacacgcgugcaca

SEQ ID NO: 1245661 - RNA, 21 nt, Homo sapiens
cauacacacuguugucaaaaa

SEQ ID NO: 1245662 - RNA, 14 nt, Homo sapiens
ccugacaauggcag

SEQ ID NO: 1245663 - RNA, 18 nt, Homo sapiens
ccugacagaaggacucag

SEQ ID NO: 1245664 - RNA, 18 nt, Homo sapiens
ccugacagcuuuaucucc

SEQ ID NO: 1245665 - RNA, 18 nt, Homo sapiens
ccugacaucacagcagcc

SEQ ID NO: 1245666 - RNA, 20 nt, Homo sapiens
ccugaccaucgcacaccggc

SEQ ID NO: 1245667 - RNA, 15 nt, Homo sapiens
ccugacuaacuuuuu

SEQ ID NO: 1245668 - RNA, 16 nt, Homo sapiens
ccugacuggcaaagga

SEQ ID NO: 1245669 - RNA, 10 nt, Homo sapiens
ccugagacag

SEQ ID NO: 1245670 - RNA, 21 nt, Homo sapiens
ccugagaggaaccagagcaga

SEQ ID NO: 1245671 - RNA, 13 nt, Homo sapiens
ccugagagugggu

SEQ ID NO: 1245672 - RNA, 12 nt, Homo sapiens
ccugagaucccc

SEQ ID NO: 1245673 - RNA, 22 nt, Homo sapiens
ccugagauccugcacaaggugg

SEQ ID NO: 1245674 - RNA, 21 nt, Homo sapiens
ccugagauucagaugucauuu

SEQ ID NO: 1245675 - RNA, 19 nt, Homo sapiens
ccugagcaacagagugaga

SEQ ID NO: 1245676 - RNA, 17 nt, Homo sapiens
ccugagcagugccagcu

SEQ ID NO: 1245677 - RNA, 21 nt, Homo sapiens
ccugagcgaguguccagccaa

SEQ ID NO: 1245678 - RNA, 22 nt, Homo sapiens
ccugagucggccccacauggga

SEQ ID NO: 1245679 - RNA, 17 nt, Homo sapiens
ccugaguggugccaaac

SEQ ID NO: 1245680 - RNA, 21 nt, Homo sapiens
ccugaguuuagggucaaggac

SEQ ID NO: 1245681 - RNA, 19 nt, Homo sapiens
ccugauacaggcauggcag

SEQ ID NO: 1245682 - RNA, 14 nt, Homo sapiens
ccugaucugugaua

SEQ ID NO: 1245683 - RNA, 17 nt, Homo sapiens
ccugaugugacauucca

SEQ ID NO: 1245684 - RNA, 15 nt, Homo sapiens
ccugcaaaccuuccu

SEQ ID NO: 1245685 - RNA, 15 nt, Homo sapiens
ccugcaagucagucc

SEQ ID NO: 1245686 - RNA, 11 nt, Homo sapiens
ccugcacacaa

SEQ ID NO: 1245687 - RNA, 12 nt, Homo sapiens
ccugcacaggcu

SEQ ID NO: 1245688 - RNA, 22 nt, Homo sapiens
ccugcacccaugacaaucaccu

SEQ ID NO: 1245689 - RNA, 17 nt, Homo sapiens
ccugcaccccugcaguu

SEQ ID NO: 1245690 - RNA, 19 nt, Homo sapiens
ccugcacuguccugaccau

SEQ ID NO: 1245691 - RNA, 22 nt, Homo sapiens
ccugcagaagaagcuggugccc

SEQ ID NO: 1245692 - RNA, 18 nt, Homo sapiens
ccugcagaaguacuccua

SEQ ID NO: 1245693 - RNA, 18 nt, Homo sapiens
ccugcagcaaacacucca

SEQ ID NO: 1245694 - RNA, 12 nt, Homo sapiens
ccugcagcacgg

SEQ ID NO: 1245695 - RNA, 22 nt, Homo sapiens
ccugcagcccauggugagcucu

SEQ ID NO: 1245696 - RNA, 19 nt, Homo sapiens
ccugcaggccaagagcaga

SEQ ID NO: 1245697 - RNA, 10 nt, Homo sapiens
ccugccaagu

SEQ ID NO: 1245698 - RNA, 15 nt, Homo sapiens
ccugcccaugugucc

SEQ ID NO: 1245699 - RNA, 20 nt, Homo sapiens
ccugcccccgcccacccucc

SEQ ID NO: 1245700 - RNA, 17 nt, Homo sapiens
ccugcccccuuggguga

SEQ ID NO: 1245701 - RNA, 16 nt, Homo sapiens
ccugccccugccccau

SEQ ID NO: 1245702 - RNA, 22 nt, Homo sapiens
ccugcccuacagaggucucugc

SEQ ID NO: 1245703 - RNA, 23 nt, Homo sapiens
ccugcccuacagaggucucugcc

SEQ ID NO: 1245704 - RNA, 16 nt, Homo sapiens
ccugcccucaucauca

SEQ ID NO: 1245705 - RNA, 16 nt, Homo sapiens
ccugcccugcugccgc

SEQ ID NO: 1245706 - RNA, 17 nt, Homo sapiens
ccugccgagugcucuga

SEQ ID NO: 1245707 - RNA, 23 nt, Homo sapiens
ccugccuggguugggggcacuca

SEQ ID NO: 1245708 - RNA, 20 nt, Homo sapiens
ccugcgccaccgcccagaga

SEQ ID NO: 1245709 - RNA, 19 nt, Homo sapiens
ccugcgcgucaucucugac

SEQ ID NO: 1245710 - RNA, 14 nt, Homo sapiens
ccugcucccacaga

SEQ ID NO: 1245711 - RNA, 22 nt, Homo sapiens
ccugcucccuagccagaggcuc

SEQ ID NO: 1245712 - RNA, 17 nt, Homo sapiens
ccugcuccgcugcuccu

SEQ ID NO: 1245713 - RNA, 20 nt, Homo sapiens
ccugcuccuccaggaauucc

SEQ ID NO: 1245714 - RNA, 14 nt, Homo sapiens
ccugcuccuggagu

SEQ ID NO: 1245715 - RNA, 12 nt, Homo sapiens
ccugcugugcug

SEQ ID NO: 1245716 - RNA, 23 nt, Homo sapiens
ccugcuuagcugccuugagcuaa

SEQ ID NO: 1245717 - RNA, 13 nt, Homo sapiens
ccuggaaaccaca

SEQ ID NO: 1245718 - RNA, 16 nt, Homo sapiens
ccuggaacccauguca

SEQ ID NO: 1245719 - RNA, 19 nt, Homo sapiens
ccuggaagcaggugcuaca

SEQ ID NO: 1245720 - RNA, 18 nt, Homo sapiens
ccuggaagggaccugguu

SEQ ID NO: 1245721 - RNA, 22 nt, Homo sapiens
ccuggacaguaucccacaucca

SEQ ID NO: 1245722 - RNA, 21 nt, Homo sapiens
ccuggagacguggaaccucug

SEQ ID NO: 1245723 - RNA, 19 nt, Homo sapiens
ccuggagcccauccagucu

SEQ ID NO: 1245724 - RNA, 17 nt, Homo sapiens
ccuggagccuccacugc

SEQ ID NO: 1245725 - RNA, 22 nt, Homo sapiens
ccuggaggaggcuuugggacca

SEQ ID NO: 1245726 - RNA, 12 nt, Homo sapiens
ccuggauaggca

SEQ ID NO: 1245727 - RNA, 23 nt, Homo sapiens
ccuggaucaguccuuugaucagu

SEQ ID NO: 1245728 - RNA, 14 nt, Homo sapiens
ccuggauccagcac

SEQ ID NO: 1245729 - RNA, 16 nt, Homo sapiens
ccuggauccagcacug

SEQ ID NO: 1245730 - RNA, 12 nt, Homo sapiens
ccuggaugacau

SEQ ID NO: 1245731 - RNA, 18 nt, Homo sapiens
ccuggaugacauuaaaga

SEQ ID NO: 1245732 - RNA, 13 nt, Homo sapiens
ccuggaugagaaa

SEQ ID NO: 1245733 - RNA, 17 nt, Homo sapiens
ccuggauguacuaucca

SEQ ID NO: 1245734 - RNA, 19 nt, Homo sapiens
ccuggauguguggggcaug

SEQ ID NO: 1245735 - RNA, 18 nt, Homo sapiens
ccuggcaagugggugaaa

SEQ ID NO: 1245736 - RNA, 22 nt, Homo sapiens
ccuggcaaucaauacagcuuca

SEQ ID NO: 1245737 - RNA, 15 nt, Homo sapiens
ccuggcacacaucag

SEQ ID NO: 1245738 - RNA, 14 nt, Homo sapiens
ccuggcacauuuca

SEQ ID NO: 1245739 - RNA, 18 nt, Homo sapiens
ccuggcacuaacguugag

SEQ ID NO: 1245740 - RNA, 20 nt, Homo sapiens
ccuggcacuggaugcagaaa

SEQ ID NO: 1245741 - RNA, 15 nt, Homo sapiens
ccuggcaggccagug

SEQ ID NO: 1245742 - RNA, 16 nt, Homo sapiens
ccuggcaggccagugu

SEQ ID NO: 1245743 - RNA, 19 nt, Homo sapiens
ccuggcaggccagugucug

SEQ ID NO: 1245744 - RNA, 22 nt, Homo sapiens
ccuggccaagcgagagcagcug

SEQ ID NO: 1245745 - RNA, 17 nt, Homo sapiens
ccuggccaggagcucuu

SEQ ID NO: 1245746 - RNA, 15 nt, Homo sapiens
ccuggccgaugguac

SEQ ID NO: 1245747 - RNA, 21 nt, Homo sapiens
ccuggccgcguuuagaccaag

SEQ ID NO: 1245748 - RNA, 19 nt, Homo sapiens
ccuggccucaagugaucug

SEQ ID NO: 1245749 - RNA, 14 nt, Homo sapiens
ccuggccucacugg

SEQ ID NO: 1245750 - RNA, 18 nt, Homo sapiens
ccuggccuggcacacauc

SEQ ID NO: 1245751 - RNA, 23 nt, Homo sapiens
ccuggccuuaaaaggggcccaag

SEQ ID NO: 1245752 - RNA, 14 nt, Homo sapiens
ccuggcgugagaug

SEQ ID NO: 1245753 - RNA, 16 nt, Homo sapiens
ccuggcucugcaaugg

SEQ ID NO: 1245754 - RNA, 17 nt, Homo sapiens
ccuggcucugcaauggg

SEQ ID NO: 1245755 - RNA, 16 nt, Homo sapiens
ccuggcucugcuucca

SEQ ID NO: 1245756 - RNA, 19 nt, Homo sapiens
ccugggagaaccucaggcu

SEQ ID NO: 1245757 - RNA, 13 nt, Homo sapiens
ccugggagacaga

SEQ ID NO: 1245758 - RNA, 23 nt, Homo sapiens
ccugggagagaaguuugaagcac

SEQ ID NO: 1245759 - RNA, 18 nt, Homo sapiens
ccugggaggaaauuugaa

SEQ ID NO: 1245760 - RNA, 18 nt, Homo sapiens
ccugggaggguguggugc

SEQ ID NO: 1245761 - RNA, 20 nt, Homo sapiens
ccugggaggguguggugcuu

SEQ ID NO: 1245762 - RNA, 16 nt, Homo sapiens
ccugggccuccugaca

SEQ ID NO: 1245763 - RNA, 17 nt, Homo sapiens
ccugggcugugcugcuu

SEQ ID NO: 1245764 - RNA, 20 nt, Homo sapiens
ccuggggaaagacgccuuca

SEQ ID NO: 1245765 - RNA, 12 nt, Homo sapiens
ccuggggaccau

SEQ ID NO: 1245766 - RNA, 20 nt, Homo sapiens
ccuggggcgagcacugugag

SEQ ID NO: 1245767 - RNA, 12 nt, Homo sapiens
ccugggggacca

SEQ ID NO: 1245768 - RNA, 18 nt, Homo sapiens
ccugggggcagugacugg

SEQ ID NO: 1245769 - RNA, 15 nt, Homo sapiens
ccuggggguggcagg

SEQ ID NO: 1245770 - RNA, 20 nt, Homo sapiens
ccuggggguggcaggcacac

SEQ ID NO: 1245771 - RNA, 22 nt, Homo sapiens
ccugggugacauuugggagaca

SEQ ID NO: 1245772 - RNA, 16 nt, Homo sapiens
ccugguauauccaaaa

SEQ ID NO: 1245773 - RNA, 17 nt, Homo sapiens
ccuggucaacaugguga

SEQ ID NO: 1245774 - RNA, 19 nt, Homo sapiens
ccuggucaacauggugaaa

SEQ ID NO: 1245775 - RNA, 19 nt, Homo sapiens
ccuggucccuuggagacaa

SEQ ID NO: 1245776 - RNA, 13 nt, Homo sapiens
ccuggugcugcug

SEQ ID NO: 1245777 - RNA, 17 nt, Homo sapiens
ccugguggcaccagaug

SEQ ID NO: 1245778 - RNA, 21 nt, Homo sapiens
ccuggugugcagggugaagca

SEQ ID NO: 1245779 - RNA, 16 nt, Homo sapiens
ccugguugugugcaca

SEQ ID NO: 1245780 - RNA, 16 nt, Homo sapiens
ccuguaaagucuaauc

SEQ ID NO: 1245781 - RNA, 20 nt, Homo sapiens
ccuguaacccuggcacuuaa

SEQ ID NO: 1245782 - RNA, 20 nt, Homo sapiens
ccuguaaucccaacacuuug

SEQ ID NO: 1245783 - RNA, 20 nt, Homo sapiens
ccuguaaucccagcuacuug

SEQ ID NO: 1245784 - RNA, 12 nt, Homo sapiens
ccuguacccagc

SEQ ID NO: 1245785 - RNA, 20 nt, Homo sapiens
ccuguaccucaucccaugag

SEQ ID NO: 1245786 - RNA, 21 nt, Homo sapiens
ccuguacucuggggugcugcc

SEQ ID NO: 1245787 - RNA, 18 nt, Homo sapiens
cuaaaugagauacacuga

SEQ ID NO: 1245788 - RNA, 16 nt, Homo sapiens
cuaaaugcagugaauu

SEQ ID NO: 1245789 - RNA, 22 nt, Homo sapiens
cuaaauggugcugcagauuuga

SEQ ID NO: 1245790 - RNA, 16 nt, Homo sapiens
cuaaauuacaaaugca

SEQ ID NO: 1245791 - RNA, 11 nt, Homo sapiens
cuaacaaaaga

SEQ ID NO: 1245792 - RNA, 14 nt, Homo sapiens
cuaacaagauuugu

SEQ ID NO: 1245793 - RNA, 12 nt, Homo sapiens
cuaacacaaaau

SEQ ID NO: 1245794 - RNA, 23 nt, Homo sapiens
cuaacacccagucuguuccccau

SEQ ID NO: 1245795 - RNA, 14 nt, Homo sapiens
cuaacacggugcuc

SEQ ID NO: 1245796 - RNA, 13 nt, Homo sapiens
cuaacacuggcau

SEQ ID NO: 1245797 - RNA, 20 nt, Homo sapiens
cuaacagaucagaacaugaa

SEQ ID NO: 1245798 - RNA, 21 nt, Homo sapiens
cuaacauuauauugcaaugaa

SEQ ID NO: 1245799 - RNA, 23 nt, Homo sapiens
cuaacuacuguccuuaaagccau

SEQ ID NO: 1245800 - RNA, 15 nt, Homo sapiens
cuaacugacagcuuc

SEQ ID NO: 1245801 - RNA, 15 nt, Homo sapiens
cuaacugccaaaaua

SEQ ID NO: 1245802 - RNA, 17 nt, Homo sapiens
cuaacuucaaggcccau

SEQ ID NO: 1245803 - RNA, 15 nt, Homo sapiens
cuaagaaauauucca

SEQ ID NO: 1245804 - RNA, 23 nt, Homo sapiens
cuaagaacuguggucugguguuc

SEQ ID NO: 1245805 - RNA, 23 nt, Homo sapiens
cuaagacaggaggaucacaagag

SEQ ID NO: 1245806 - RNA, 23 nt, Homo sapiens
cuaagacugugacaacugucuaa

SEQ ID NO: 1245807 - RNA, 21 nt, Homo sapiens
cuaagagaaugugcucaugca

SEQ ID NO: 1245808 - RNA, 13 nt, Homo sapiens
cuaagauuaccuu

SEQ ID NO: 1245809 - RNA, 15 nt, Homo sapiens
cuaagauuuugugaa

SEQ ID NO: 1245810 - RNA, 12 nt, Homo sapiens
cuaagcacaaag

SEQ ID NO: 1245811 - RNA, 17 nt, Homo sapiens
cuaagcccccacacaga

SEQ ID NO: 1245812 - RNA, 11 nt, Homo sapiens
cuaagccuuuc

SEQ ID NO: 1245813 - RNA, 15 nt, Homo sapiens
cuaagcugugugcag

SEQ ID NO: 1245814 - RNA, 17 nt, Homo sapiens
cuaaggaagauaucuag

SEQ ID NO: 1245815 - RNA, 14 nt, Homo sapiens
cuaaggaaugcaca

SEQ ID NO: 1245816 - RNA, 11 nt, Homo sapiens
cuaaguacugu

SEQ ID NO: 1245817 - RNA, 13 nt, Homo sapiens
cuaaguacuguaa

SEQ ID NO: 1245818 - RNA, 14 nt, Homo sapiens
cuaaguuagagcug

SEQ ID NO: 1245819 - RNA, 22 nt, Homo sapiens
cuaauagagugguacagcacug

SEQ ID NO: 1245820 - RNA, 14 nt, Homo sapiens
cuaauaucuuuaaa

SEQ ID NO: 1245821 - RNA, 19 nt, Homo sapiens
cuaauauuuuuagcucugu

SEQ ID NO: 1245822 - RNA, 16 nt, Homo sapiens
cuaaucagcauucuca

SEQ ID NO: 1245823 - RNA, 16 nt, Homo sapiens
cuaaucaucugcaguu

SEQ ID NO: 1245824 - RNA, 15 nt, Homo sapiens
cuaauccaaauauca

SEQ ID NO: 1245825 - RNA, 14 nt, Homo sapiens
cuaaucugcagugg

SEQ ID NO: 1245826 - RNA, 16 nt, Homo sapiens
cuaaucugcaguggau

SEQ ID NO: 1245827 - RNA, 21 nt, Homo sapiens
cuaaucuucuuaugcaauuuc

SEQ ID NO: 1245828 - RNA, 20 nt, Homo sapiens
cuaaugcuucaaguguugcu

SEQ ID NO: 1245829 - RNA, 19 nt, Homo sapiens
cuaauggggacacagauca

SEQ ID NO: 1245830 - RNA, 13 nt, Homo sapiens
cuaauguacaaua

SEQ ID NO: 1245831 - RNA, 15 nt, Homo sapiens
cuaauguacaauaaa

SEQ ID NO: 1245832 - RNA, 21 nt, Homo sapiens
cuaauguacaauaaagcaaug

SEQ ID NO: 1245833 - RNA, 16 nt, Homo sapiens
cuaauguaggacugua

SEQ ID NO: 1245834 - RNA, 15 nt, Homo sapiens
cuaaugucagaguag

SEQ ID NO: 1245835 - RNA, 17 nt, Homo sapiens
cuaaugugaaaaucauc

SEQ ID NO: 1245836 - RNA, 13 nt, Homo sapiens
cuaaugugcauua

SEQ ID NO: 1245837 - RNA, 13 nt, Homo sapiens
cuaauuaaacaca

SEQ ID NO: 1245838 - RNA, 20 nt, Homo sapiens
cuaauuagaaaauauaguuu

SEQ ID NO: 1245839 - RNA, 13 nt, Homo sapiens
cuaauuaggguac

SEQ ID NO: 1245840 - RNA, 18 nt, Homo sapiens
cuaauuauacuacuuugu

SEQ ID NO: 1245841 - RNA, 19 nt, Homo sapiens
cuaauucuucuguccugag

SEQ ID NO: 1245842 - RNA, 21 nt, Homo sapiens
cuaauuuauccugaaauuuca

SEQ ID NO: 1245843 - RNA, 14 nt, Homo sapiens
cuaauuuauucaaa

SEQ ID NO: 1245844 - RNA, 15 nt, Homo sapiens
cuacaaaaaacaaca

SEQ ID NO: 1245845 - RNA, 20 nt, Homo sapiens
cuacaaacacaauauucaau

SEQ ID NO: 1245846 - RNA, 14 nt, Homo sapiens
cuacaaaggccaug

SEQ ID NO: 1245847 - RNA, 21 nt, Homo sapiens
cuacaaauuuaugcauuucau

SEQ ID NO: 1245848 - RNA, 13 nt, Homo sapiens
cuacaaauuugag

SEQ ID NO: 1245849 - RNA, 18 nt, Homo sapiens
cuacaaccaauuuacacu

SEQ ID NO: 1245850 - RNA, 19 nt, Homo sapiens
cuacaaguauaugugaaaa

SEQ ID NO: 1245851 - RNA, 13 nt, Homo sapiens
cuacaaguauuau

SEQ ID NO: 1245852 - RNA, 19 nt, Homo sapiens
cuacaauaaacugguauga

SEQ ID NO: 1245853 - RNA, 22 nt, Homo sapiens
cuacaauuaauaguuugucuau

SEQ ID NO: 1245854 - RNA, 22 nt, Homo sapiens
cuacaauuuucccuugauaacc

SEQ ID NO: 1245855 - RNA, 12 nt, Homo sapiens
cuacacacaaac

SEQ ID NO: 1245856 - RNA, 18 nt, Homo sapiens
cuacacagcacaccagcc

SEQ ID NO: 1245857 - RNA, 16 nt, Homo sapiens
cuacacguaaguauaa

SEQ ID NO: 1245858 - RNA, 15 nt, Homo sapiens
cuacagagcagccag

SEQ ID NO: 1245859 - RNA, 20 nt, Homo sapiens
cuacagcaaagccuagccug

SEQ ID NO: 1245860 - RNA, 23 nt, Homo sapiens
cuacagcagcacuguucuguccu

SEQ ID NO: 1245861 - RNA, 20 nt, Homo sapiens
cuacagcucuuaaauguagc

SEQ ID NO: 1245862 - RNA, 12 nt, Homo sapiens
cuacaguuauua

SEQ ID NO: 1245863 - RNA, 13 nt, Homo sapiens
cuacaguucugug

SEQ ID NO: 1245864 - RNA, 15 nt, Homo sapiens
cuacauaacuuccua

SEQ ID NO: 1245865 - RNA, 15 nt, Homo sapiens
cuacaucuaguuaau

SEQ ID NO: 1245866 - RNA, 11 nt, Homo sapiens
cuacaugccuc

SEQ ID NO: 1245867 - RNA, 14 nt, Homo sapiens
cuacauguauugca

SEQ ID NO: 1245868 - RNA, 15 nt, Homo sapiens
cuacauguauugcac

SEQ ID NO: 1245869 - RNA, 18 nt, Homo sapiens
cuacauguauugcacauu

SEQ ID NO: 1245870 - RNA, 19 nt, Homo sapiens
cuacaugucuacaugccau

SEQ ID NO: 1245871 - RNA, 15 nt, Homo sapiens
cuacauugugcugca

SEQ ID NO: 1245872 - RNA, 17 nt, Homo sapiens
cuacauuucugcagauc

SEQ ID NO: 1245873 - RNA, 19 nt, Homo sapiens
cuaccaagaacugaaggca

SEQ ID NO: 1245874 - RNA, 14 nt, Homo sapiens
cuaccaauguagac

SEQ ID NO: 1245875 - RNA, 13 nt, Homo sapiens
cuaccacaguguc

SEQ ID NO: 1245876 - RNA, 13 nt, Homo sapiens
cuaccagcauaaa

SEQ ID NO: 1245877 - RNA, 14 nt, Homo sapiens
cuaccaucagggac

SEQ ID NO: 1245878 - RNA, 9 nt, Homo sapiens
cuaccccag

SEQ ID NO: 1245879 - RNA, 14 nt, Homo sapiens
cuacccugcugacc

SEQ ID NO: 1245880 - RNA, 15 nt, Homo sapiens
cuaccguuguuugca

SEQ ID NO: 1245881 - RNA, 16 nt, Homo sapiens
cuaccuagggcacuuu

SEQ ID NO: 1245882 - RNA, 16 nt, Homo sapiens
cuaccucaaacuucca

SEQ ID NO: 1245883 - RNA, 19 nt, Homo sapiens
cuaccucacuaugcugcuu

SEQ ID NO: 1245884 - RNA, 14 nt, Homo sapiens
cuaccucagaauua

SEQ ID NO: 1245885 - RNA, 15 nt, Homo sapiens
cuaccucagaauuaa

SEQ ID NO: 1245886 - RNA, 13 nt, Homo sapiens
cuaccugccucag

SEQ ID NO: 1245887 - RNA, 20 nt, Homo sapiens
cuaccuuagaaaacaaguau

SEQ ID NO: 1245888 - RNA, 20 nt, Homo sapiens
cuacuaaguucacauuagaa

SEQ ID NO: 1245889 - RNA, 19 nt, Homo sapiens
cuacuacaaacuucaaaga

SEQ ID NO: 1245890 - RNA, 16 nt, Homo sapiens
cuacuacaugugacug

SEQ ID NO: 1245891 - RNA, 22 nt, Homo sapiens
cuacuagagucugaacagcugu

SEQ ID NO: 1245892 - RNA, 13 nt, Homo sapiens
cuacuaucacuga

SEQ ID NO: 1245893 - RNA, 21 nt, Homo sapiens
cuacuaucacugaacaaacua

SEQ ID NO: 1245894 - RNA, 19 nt, Homo sapiens
cuacucaggaggcugaggc

SEQ ID NO: 1245895 - RNA, 12 nt, Homo sapiens
cuacuccaaaau

SEQ ID NO: 1245896 - RNA, 15 nt, Homo sapiens
cuacucccucuucac

SEQ ID NO: 1245897 - RNA, 14 nt, Homo sapiens
cuacucuuauaugc

SEQ ID NO: 1245898 - RNA, 16 nt, Homo sapiens
cuacugauuguuucau

SEQ ID NO: 1245899 - RNA, 17 nt, Homo sapiens
cuacugcuaaauccuca

SEQ ID NO: 1245900 - RNA, 18 nt, Homo sapiens
cuacugcucuguguuuac

SEQ ID NO: 1245901 - RNA, 16 nt, Homo sapiens
cuacugcuuacuguug

SEQ ID NO: 1245902 - RNA, 13 nt, Homo sapiens
cuacuguguuccu

SEQ ID NO: 1245903 - RNA, 14 nt, Homo sapiens
cuacuugaccuaag

SEQ ID NO: 1245904 - RNA, 15 nt, Homo sapiens
cuacuuuaagcacua

SEQ ID NO: 1245905 - RNA, 15 nt, Homo sapiens
cuacuuuguugcuau

SEQ ID NO: 1245906 - RNA, 18 nt, Homo sapiens
cuacuuuucuuuccucag

SEQ ID NO: 1245907 - RNA, 18 nt, Homo sapiens
cuacuuuuugcaccuuau

SEQ ID NO: 1245908 - RNA, 17 nt, Homo sapiens
cuacuuuuuuuugacau

SEQ ID NO: 1245909 - RNA, 17 nt, Homo sapiens
cuagaaaacaggcaaau

SEQ ID NO: 1245910 - RNA, 16 nt, Homo sapiens
cuagaaagacagaagc

SEQ ID NO: 1245911 - RNA, 18 nt, Homo sapiens
cuagaacaacgccuguca

SEQ ID NO: 1245912 - RNA, 13 nt, Homo sapiens
cuagaagacuguc

SEQ ID NO: 1245913 - RNA, 20 nt, Homo sapiens
cuagaagcacauguguauuu

SEQ ID NO: 1245914 - RNA, 21 nt, Homo sapiens
cuagaauauuauguuccucaa

SEQ ID NO: 1245915 - RNA, 20 nt, Homo sapiens
cucugcuucaguccacagua

SEQ ID NO: 1245916 - RNA, 19 nt, Homo sapiens
cucugcuugauuuuugccu

SEQ ID NO: 1245917 - RNA, 15 nt, Homo sapiens
cucuggacaguugug

SEQ ID NO: 1245918 - RNA, 22 nt, Homo sapiens
cucuggaccugucucuaccuaa

SEQ ID NO: 1245919 - RNA, 19 nt, Homo sapiens
cucuggauuccacacugca

SEQ ID NO: 1245920 - RNA, 15 nt, Homo sapiens
cucuggcacagugua

SEQ ID NO: 1245921 - RNA, 16 nt, Homo sapiens
cucuggcucucauggg

SEQ ID NO: 1245922 - RNA, 22 nt, Homo sapiens
cucugggaauuuggagugacca

SEQ ID NO: 1245923 - RNA, 21 nt, Homo sapiens
cucugggagcucaagugaucc

SEQ ID NO: 1245924 - RNA, 15 nt, Homo sapiens
cucugggcacagccu

SEQ ID NO: 1245925 - RNA, 15 nt, Homo sapiens
cucuggggugcugcc

SEQ ID NO: 1245926 - RNA, 17 nt, Homo sapiens
cucugguaugaauucac

SEQ ID NO: 1245927 - RNA, 19 nt, Homo sapiens
cucuguaacaguugcauug

SEQ ID NO: 1245928 - RNA, 15 nt, Homo sapiens
cucuguacuuuucau

SEQ ID NO: 1245929 - RNA, 23 nt, Homo sapiens
cucuguaguuccuaauggauuca

SEQ ID NO: 1245930 - RNA, 12 nt, Homo sapiens
cucuguauuccg

SEQ ID NO: 1245931 - RNA, 12 nt, Homo sapiens
cucugucagcca

SEQ ID NO: 1245932 - RNA, 20 nt, Homo sapiens
cucuguccacgauucacuca

SEQ ID NO: 1245933 - RNA, 14 nt, Homo sapiens
cucugucucaaaaa

SEQ ID NO: 1245934 - RNA, 19 nt, Homo sapiens
cucugucuuaaaugagaag

SEQ ID NO: 1245935 - RNA, 19 nt, Homo sapiens
cucugugaggaaagcacac

SEQ ID NO: 1245936 - RNA, 13 nt, Homo sapiens
cucuguguagcaa

SEQ ID NO: 1245937 - RNA, 18 nt, Homo sapiens
cucugugucucuccauca

SEQ ID NO: 1245938 - RNA, 17 nt, Homo sapiens
cucugugucugcucuca

SEQ ID NO: 1245939 - RNA, 15 nt, Homo sapiens
cucuguucauuucac

SEQ ID NO: 1245940 - RNA, 17 nt, Homo sapiens
cucuuaaucaaauagca

SEQ ID NO: 1245941 - RNA, 12 nt, Homo sapiens
cucuuacacaua

SEQ ID NO: 1245942 - RNA, 13 nt, Homo sapiens
cucuuagagccau

SEQ ID NO: 1245943 - RNA, 12 nt, Homo sapiens
cucuuagcacac

SEQ ID NO: 1245944 - RNA, 17 nt, Homo sapiens
cucuuaugugugccuuu

SEQ ID NO: 1245945 - RNA, 15 nt, Homo sapiens
cucuucaacugacca

SEQ ID NO: 1245946 - RNA, 19 nt, Homo sapiens
cucuucaacugaccagccu

SEQ ID NO: 1245947 - RNA, 16 nt, Homo sapiens
cucuucaaucucuugc

SEQ ID NO: 1245948 - RNA, 18 nt, Homo sapiens
cucuucacuuggccaguu

SEQ ID NO: 1245949 - RNA, 16 nt, Homo sapiens
cucuucagaacacaca

SEQ ID NO: 1245950 - RNA, 17 nt, Homo sapiens
cucuucagcacaaagac

SEQ ID NO: 1245951 - RNA, 22 nt, Homo sapiens
cucuucagguucuuagugucac

SEQ ID NO: 1245952 - RNA, 14 nt, Homo sapiens
cucuucccaugacu

SEQ ID NO: 1245953 - RNA, 16 nt, Homo sapiens
cucuucccccuuccaa

SEQ ID NO: 1245954 - RNA, 14 nt, Homo sapiens
cucuuccuacaugu

SEQ ID NO: 1245955 - RNA, 13 nt, Homo sapiens
cucuuccugugau

SEQ ID NO: 1245956 - RNA, 16 nt, Homo sapiens
cucuuccugugaucca

SEQ ID NO: 1245957 - RNA, 13 nt, Homo sapiens
cucuucuaacaca

SEQ ID NO: 1245958 - RNA, 13 nt, Homo sapiens
cucuucuaugcaa

SEQ ID NO: 1245959 - RNA, 14 nt, Homo sapiens
cucuucuccacugg

SEQ ID NO: 1245960 - RNA, 13 nt, Homo sapiens
cucuucucugcaa

SEQ ID NO: 1245961 - RNA, 17 nt, Homo sapiens
cucuucugggaacuucc

SEQ ID NO: 1245962 - RNA, 12 nt, Homo sapiens
cucuucuuucau

SEQ ID NO: 1245963 - RNA, 12 nt, Homo sapiens
cucuugacuacu

SEQ ID NO: 1245964 - RNA, 20 nt, Homo sapiens
cucuugagggagcuuagcca

SEQ ID NO: 1245965 - RNA, 13 nt, Homo sapiens
cucuugcacucaa

SEQ ID NO: 1245966 - RNA, 22 nt, Homo sapiens
cucuugccaaaaaauagcacac

SEQ ID NO: 1245967 - RNA, 17 nt, Homo sapiens
cucuugcccauccugac

SEQ ID NO: 1245968 - RNA, 10 nt, Homo sapiens
cucuugcccu

SEQ ID NO: 1245969 - RNA, 13 nt, Homo sapiens
cucuugcugccac

SEQ ID NO: 1245970 - RNA, 17 nt, Homo sapiens
cucuugcuugucauuga

SEQ ID NO: 1245971 - RNA, 15 nt, Homo sapiens
cucuuggagcuguga

SEQ ID NO: 1245972 - RNA, 21 nt, Homo sapiens
cucuugggaacugaacucacu

SEQ ID NO: 1245973 - RNA, 22 nt, Homo sapiens
cucuuguaagucaucuacuuaa

SEQ ID NO: 1245974 - RNA, 19 nt, Homo sapiens
cucuuguaauaaaaugucu

SEQ ID NO: 1245975 - RNA, 19 nt, Homo sapiens
cucuuguacugccugccac

SEQ ID NO: 1245976 - RNA, 17 nt, Homo sapiens
cucuuguauaugaugau

SEQ ID NO: 1245977 - RNA, 18 nt, Homo sapiens
cucuuguauaugaugauc

SEQ ID NO: 1245978 - RNA, 13 nt, Homo sapiens
cucuugucaaaag

SEQ ID NO: 1245979 - RNA, 13 nt, Homo sapiens
cucuuguuauuau

SEQ ID NO: 1245980 - RNA, 14 nt, Homo sapiens
cucuuuaaguauuu

SEQ ID NO: 1245981 - RNA, 13 nt, Homo sapiens
cucuuuacuugaa

SEQ ID NO: 1245982 - RNA, 15 nt, Homo sapiens
cucuuucaaagcuaa

SEQ ID NO: 1245983 - RNA, 18 nt, Homo sapiens
cucuuuccuccugcuuca

SEQ ID NO: 1245984 - RNA, 15 nt, Homo sapiens
cucuuucuuuacucu

SEQ ID NO: 1245985 - RNA, 22 nt, Homo sapiens
cucuuuggcuccccuguaccuu

SEQ ID NO: 1245986 - RNA, 23 nt, Homo sapiens
cucuuuggucuauuuucugcaga

SEQ ID NO: 1245987 - RNA, 23 nt, Homo sapiens
cucuuuucuuucccucucauggu

SEQ ID NO: 1245988 - RNA, 14 nt, Homo sapiens
cucuuuugagcuaa

SEQ ID NO: 1245989 - RNA, 15 nt, Homo sapiens
cucuuuuucugugau

SEQ ID NO: 1245990 - RNA, 14 nt, Homo sapiens
cugaaaaccuacca

SEQ ID NO: 1245991 - RNA, 15 nt, Homo sapiens
cugaaaacuacacaa

SEQ ID NO: 1245992 - RNA, 14 nt, Homo sapiens
cugaaaagaagccu

SEQ ID NO: 1245993 - RNA, 12 nt, Homo sapiens
cugaaaagggaa

SEQ ID NO: 1245994 - RNA, 13 nt, Homo sapiens
cugaaaaucugga

SEQ ID NO: 1245995 - RNA, 21 nt, Homo sapiens
cugaaaaugucacauucuauu

SEQ ID NO: 1245996 - RNA, 13 nt, Homo sapiens
cugaaaauucugu

SEQ ID NO: 1245997 - RNA, 13 nt, Homo sapiens
cugaaaauugcaa

SEQ ID NO: 1245998 - RNA, 14 nt, Homo sapiens
cugaaaccaaaaca

SEQ ID NO: 1245999 - RNA, 16 nt, Homo sapiens
cugaaaccucugccuu

SEQ ID NO: 1246000 - RNA, 14 nt, Homo sapiens
cugaaacuggagua

SEQ ID NO: 1246001 - RNA, 15 nt, Homo sapiens
cugaaagaagacauc

SEQ ID NO: 1246002 - RNA, 17 nt, Homo sapiens
cugaaagagaaaucaau

SEQ ID NO: 1246003 - RNA, 12 nt, Homo sapiens
cugaaagccaca

SEQ ID NO: 1246004 - RNA, 16 nt, Homo sapiens
cugaaagccuuaggga

SEQ ID NO: 1246005 - RNA, 15 nt, Homo sapiens
cugaaaggaugugga

SEQ ID NO: 1246006 - RNA, 22 nt, Homo sapiens
cugaaaggauguggaagagcau

SEQ ID NO: 1246007 - RNA, 21 nt, Homo sapiens
cugaaaggcagaacucagaac

SEQ ID NO: 1246008 - RNA, 13 nt, Homo sapiens
cugaaaguacaaa

SEQ ID NO: 1246009 - RNA, 17 nt, Homo sapiens
cugaaauaaacacuggu

SEQ ID NO: 1246010 - RNA, 21 nt, Homo sapiens
cugaaaucuccuuuagccauc

SEQ ID NO: 1246011 - RNA, 18 nt, Homo sapiens
cugaaaugugcucaggcc

SEQ ID NO: 1246012 - RNA, 13 nt, Homo sapiens
cugaaauugcauc

SEQ ID NO: 1246013 - RNA, 12 nt, Homo sapiens
cugaacagugga

SEQ ID NO: 1246014 - RNA, 18 nt, Homo sapiens
cugaaccauguggauaac

SEQ ID NO: 1246015 - RNA, 19 nt, Homo sapiens
cugaaccauuccaacuuca

SEQ ID NO: 1246016 - RNA, 15 nt, Homo sapiens
cugaacccugugcug

SEQ ID NO: 1246017 - RNA, 17 nt, Homo sapiens
cugaaccgcacagcuca

SEQ ID NO: 1246018 - RNA, 13 nt, Homo sapiens
cugaagaaaccuu

SEQ ID NO: 1246019 - RNA, 17 nt, Homo sapiens
cugaagaacuuggcaca

SEQ ID NO: 1246020 - RNA, 17 nt, Homo sapiens
cugaagauccacaaaag

SEQ ID NO: 1246021 - RNA, 23 nt, Homo sapiens
cugaagauugcgguuuacagcua

SEQ ID NO: 1246022 - RNA, 15 nt, Homo sapiens
cugaagccaaaugaa

SEQ ID NO: 1246023 - RNA, 23 nt, Homo sapiens
cugaagcugaccaacacuacaga

SEQ ID NO: 1246024 - RNA, 13 nt, Homo sapiens
cugaagucacaca

SEQ ID NO: 1246025 - RNA, 20 nt, Homo sapiens
cugaagugugcugugacaag

SEQ ID NO: 1246026 - RNA, 17 nt, Homo sapiens
cugaaguuugugggggc

SEQ ID NO: 1246027 - RNA, 19 nt, Homo sapiens
cugaauaacuugaagaaca

SEQ ID NO: 1246028 - RNA, 15 nt, Homo sapiens
cugaauaucuguuca

SEQ ID NO: 1246029 - RNA, 24 nt, Homo sapiens
cugaauauuuuuuauuucuaagua

SEQ ID NO: 1246030 - RNA, 23 nt, Homo sapiens
cugaauccauaaaggcauaccuu

SEQ ID NO: 1246031 - RNA, 16 nt, Homo sapiens
cugaaucugcuaccaa

SEQ ID NO: 1246032 - RNA, 20 nt, Homo sapiens
cugaaucuucaagaccaaag

SEQ ID NO: 1246033 - RNA, 18 nt, Homo sapiens
cugaaugacuccacuguu

SEQ ID NO: 1246034 - RNA, 14 nt, Homo sapiens
cugaaugauuuaga

SEQ ID NO: 1246035 - RNA, 18 nt, Homo sapiens
cugaaugcugcuacuuaa

SEQ ID NO: 1246036 - RNA, 18 nt, Homo sapiens
cugaaugucuuacuguga

SEQ ID NO: 1246037 - RNA, 15 nt, Homo sapiens
cugaauuacagugaa

SEQ ID NO: 1246038 - RNA, 13 nt, Homo sapiens
cugaauuaguaau

SEQ ID NO: 1246039 - RNA, 18 nt, Homo sapiens
cugaauuaucuauuucau

SEQ ID NO: 1246040 - RNA, 16 nt, Homo sapiens
cugaauuaugcuucca

SEQ ID NO: 1246041 - RNA, 23 nt, Homo sapiens
cugaauugcccguuuccauacag

SEQ ID NO: 1246042 - RNA, 16 nt, Homo sapiens
cugacaacaugcuagg

SEQ ID NO: 1246043 - RNA, 16 nt, Homo sapiens
gaaugaauacugggaa

SEQ ID NO: 1246044 - RNA, 13 nt, Homo sapiens
gaaugacauugaa

SEQ ID NO: 1246045 - RNA, 20 nt, Homo sapiens
gaaugagacugaacugugug

SEQ ID NO: 1246046 - RNA, 18 nt, Homo sapiens
gaaugagagguuccuaag

SEQ ID NO: 1246047 - RNA, 21 nt, Homo sapiens
gaaugagcuugugugcccuga

SEQ ID NO: 1246048 - RNA, 20 nt, Homo sapiens
gaaugauuuagguacgucaa

SEQ ID NO: 1246049 - RNA, 24 nt, Homo sapiens
gaaugcacacuagccucuccagga

SEQ ID NO: 1246050 - RNA, 13 nt, Homo sapiens
gaaugcagggaag

SEQ ID NO: 1246051 - RNA, 15 nt, Homo sapiens
gaaugcagugacaca

SEQ ID NO: 1246052 - RNA, 11 nt, Homo sapiens
gaaugcagugg

SEQ ID NO: 1246053 - RNA, 20 nt, Homo sapiens
gaaugccgguuaaauuccau

SEQ ID NO: 1246054 - RNA, 16 nt, Homo sapiens
gaaugccuccuguggg

SEQ ID NO: 1246055 - RNA, 21 nt, Homo sapiens
gaaugcucuuuacuucaugga

SEQ ID NO: 1246056 - RNA, 17 nt, Homo sapiens
gaauggagcucaggucc

SEQ ID NO: 1246057 - RNA, 15 nt, Homo sapiens
gaauggcaugcugaa

SEQ ID NO: 1246058 - RNA, 19 nt, Homo sapiens
gaaugggaagggucauaga

SEQ ID NO: 1246059 - RNA, 17 nt, Homo sapiens
gaaugggcacagcacag

SEQ ID NO: 1246060 - RNA, 21 nt, Homo sapiens
gaaugggcacagcacagccag

SEQ ID NO: 1246061 - RNA, 21 nt, Homo sapiens
gaaugggcuugaaacauuaua

SEQ ID NO: 1246062 - RNA, 15 nt, Homo sapiens
gaauggggaucacag

SEQ ID NO: 1246063 - RNA, 16 nt, Homo sapiens
gaauggguuugcuaga

SEQ ID NO: 1246064 - RNA, 18 nt, Homo sapiens
gaaugguguuguaugccu

SEQ ID NO: 1246065 - RNA, 14 nt, Homo sapiens
gaauguacucuguu

SEQ ID NO: 1246066 - RNA, 17 nt, Homo sapiens
gaauguauguaaugugu

SEQ ID NO: 1246067 - RNA, 15 nt, Homo sapiens
gaaugugauauuuga

SEQ ID NO: 1246068 - RNA, 17 nt, Homo sapiens
gaaugugauauuugaag

SEQ ID NO: 1246069 - RNA, 21 nt, Homo sapiens
gaaugugcucaugcauugcuu

SEQ ID NO: 1246070 - RNA, 19 nt, Homo sapiens
gaaugugcuuuguaagauc

SEQ ID NO: 1246071 - RNA, 16 nt, Homo sapiens
gaauguugcaauguga

SEQ ID NO: 1246072 - RNA, 20 nt, Homo sapiens
gaauguugguuuacuuucaa

SEQ ID NO: 1246073 - RNA, 17 nt, Homo sapiens
gaauguuuacacucuuu

SEQ ID NO: 1246074 - RNA, 17 nt, Homo sapiens
gaauguuuuacugugaa

SEQ ID NO: 1246075 - RNA, 21 nt, Homo sapiens
gaauuaagaauugguugccau

SEQ ID NO: 1246076 - RNA, 12 nt, Homo sapiens
gaauuaagacgg

SEQ ID NO: 1246077 - RNA, 13 nt, Homo sapiens
gaauuaugcuucc

SEQ ID NO: 1246078 - RNA, 21 nt, Homo sapiens
gaauuauuuugaaugucacaa

SEQ ID NO: 1246079 - RNA, 21 nt, Homo sapiens
gaauucaccuugguguuucuc

SEQ ID NO: 1246080 - RNA, 15 nt, Homo sapiens
gaauucagcucagcu

SEQ ID NO: 1246081 - RNA, 11 nt, Homo sapiens
gaauucagugc

SEQ ID NO: 1246082 - RNA, 14 nt, Homo sapiens
gaauucgcuguuac

SEQ ID NO: 1246083 - RNA, 17 nt, Homo sapiens
gaauucuguacuuccaa

SEQ ID NO: 1246084 - RNA, 20 nt, Homo sapiens
gaauugcccguuuccauaca

SEQ ID NO: 1246085 - RNA, 16 nt, Homo sapiens
gaauuguuuucuuaca

SEQ ID NO: 1246086 - RNA, 15 nt, Homo sapiens
gaauuuaaugcugaa

SEQ ID NO: 1246087 - RNA, 21 nt, Homo sapiens
gaauuuacagucuaguacuua

SEQ ID NO: 1246088 - RNA, 17 nt, Homo sapiens
gaauuuauucaauuccu

SEQ ID NO: 1246089 - RNA, 10 nt, Homo sapiens
gaauuucaca

SEQ ID NO: 1246090 - RNA, 18 nt, Homo sapiens
gaauuucacaagcuauuu

SEQ ID NO: 1246091 - RNA, 19 nt, Homo sapiens
gaauuucacaagcuauuuu

SEQ ID NO: 1246092 - RNA, 13 nt, Homo sapiens
gaauuucccacau

SEQ ID NO: 1246093 - RNA, 16 nt, Homo sapiens
gaauuucuucagucca

SEQ ID NO: 1246094 - RNA, 18 nt, Homo sapiens
gaauuuggguaugaacag

SEQ ID NO: 1246095 - RNA, 14 nt, Homo sapiens
gaauuuuaccauuc

SEQ ID NO: 1246096 - RNA, 20 nt, Homo sapiens
gaauuuuugcuaugcuguaa

SEQ ID NO: 1246097 - RNA, 19 nt, Homo sapiens
gaauuuuuuuuaacauucc

SEQ ID NO: 1246098 - RNA, 23 nt, Homo sapiens
gacaaaaagccuuuuccagaaga

SEQ ID NO: 1246099 - RNA, 21 nt, Homo sapiens
gacaaaacuucuugucagaca

SEQ ID NO: 1246100 - RNA, 16 nt, Homo sapiens
gacaaaccgagugcaa

SEQ ID NO: 1246101 - RNA, 12 nt, Homo sapiens
gacaaagccaaa

SEQ ID NO: 1246102 - RNA, 21 nt, Homo sapiens
gacaaaggaguaguagcugaa

SEQ ID NO: 1246103 - RNA, 14 nt, Homo sapiens
gacaaagugacauu

SEQ ID NO: 1246104 - RNA, 15 nt, Homo sapiens
gacaaauauuuucau

SEQ ID NO: 1246105 - RNA, 18 nt, Homo sapiens
gacaaaucuuuaagaaua

SEQ ID NO: 1246106 - RNA, 20 nt, Homo sapiens
gacaacacagcaggacucca

SEQ ID NO: 1246107 - RNA, 19 nt, Homo sapiens
gacaacaccuuccuccugc

SEQ ID NO: 1246108 - RNA, 13 nt, Homo sapiens
gacaacaucgcaa

SEQ ID NO: 1246109 - RNA, 13 nt, Homo sapiens
gacaacgaugaau

SEQ ID NO: 1246110 - RNA, 15 nt, Homo sapiens
gacaacgaugaugcu

SEQ ID NO: 1246111 - RNA, 17 nt, Homo sapiens
gacaagcugcauuucag

SEQ ID NO: 1246112 - RNA, 17 nt, Homo sapiens
gacaaggagacugccuu

SEQ ID NO: 1246113 - RNA, 13 nt, Homo sapiens
gacaagugccuga

SEQ ID NO: 1246114 - RNA, 18 nt, Homo sapiens
gacaauacaguaagcaua

SEQ ID NO: 1246115 - RNA, 13 nt, Homo sapiens
gacaaugacugug

SEQ ID NO: 1246116 - RNA, 14 nt, Homo sapiens
gacaaugauccagu

SEQ ID NO: 1246117 - RNA, 22 nt, Homo sapiens
gacaaugcaccuagcugugcaa

SEQ ID NO: 1246118 - RNA, 20 nt, Homo sapiens
gacaaugggcacacagggaa

SEQ ID NO: 1246119 - RNA, 13 nt, Homo sapiens
gacacaaaugcau

SEQ ID NO: 1246120 - RNA, 18 nt, Homo sapiens
gacacaacuauuuuucca

SEQ ID NO: 1246121 - RNA, 22 nt, Homo sapiens
gacacaauuggaauugucuuua

SEQ ID NO: 1246122 - RNA, 18 nt, Homo sapiens
gacacagacaaagugaca

SEQ ID NO: 1246123 - RNA, 14 nt, Homo sapiens
gacacagacuggca

SEQ ID NO: 1246124 - RNA, 17 nt, Homo sapiens
gacacagacuggcaaua

SEQ ID NO: 1246125 - RNA, 21 nt, Homo sapiens
gacacagacuuggggaccugg

SEQ ID NO: 1246126 - RNA, 22 nt, Homo sapiens
gacacagcgucccuagcaguga

SEQ ID NO: 1246127 - RNA, 21 nt, Homo sapiens
gacacagcuuaacaaugcaac

SEQ ID NO: 1246128 - RNA, 14 nt, Homo sapiens
gacacagugcccaa

SEQ ID NO: 1246129 - RNA, 18 nt, Homo sapiens
gacacauagaaaacaauc

SEQ ID NO: 1246130 - RNA, 19 nt, Homo sapiens
gacacauagaaaacaauca

SEQ ID NO: 1246131 - RNA, 13 nt, Homo sapiens
gacacauaugcac

SEQ ID NO: 1246132 - RNA, 22 nt, Homo sapiens
gacaccagagcagaugcagaga

SEQ ID NO: 1246133 - RNA, 19 nt, Homo sapiens
gacaccagagcccacuucc

SEQ ID NO: 1246134 - RNA, 16 nt, Homo sapiens
gacaccauuaccaaaa

SEQ ID NO: 1246135 - RNA, 15 nt, Homo sapiens
gacaccauuuaucua

SEQ ID NO: 1246136 - RNA, 16 nt, Homo sapiens
gacaccucaccucacc

SEQ ID NO: 1246137 - RNA, 17 nt, Homo sapiens
gacacgccuaaggucac

SEQ ID NO: 1246138 - RNA, 14 nt, Homo sapiens
gacacuacauaucu

SEQ ID NO: 1246139 - RNA, 15 nt, Homo sapiens
gacacuacauaucua

SEQ ID NO: 1246140 - RNA, 15 nt, Homo sapiens
gacacuagccugugc

SEQ ID NO: 1246141 - RNA, 19 nt, Homo sapiens
gacacuccccgaagucuuu

SEQ ID NO: 1246142 - RNA, 12 nt, Homo sapiens
gacacugcagug

SEQ ID NO: 1246143 - RNA, 14 nt, Homo sapiens
gacacugugcuaua

SEQ ID NO: 1246144 - RNA, 20 nt, Homo sapiens
gacacuuaauacuaccuuga

SEQ ID NO: 1246145 - RNA, 22 nt, Homo sapiens
gacacuuaauacuaccuugaaa

SEQ ID NO: 1246146 - RNA, 17 nt, Homo sapiens
gacacuucaaggugaca

SEQ ID NO: 1246147 - RNA, 19 nt, Homo sapiens
gacacuucaaggugacaga

SEQ ID NO: 1246148 - RNA, 19 nt, Homo sapiens
gacacuucccaagaaggcc

SEQ ID NO: 1246149 - RNA, 10 nt, Homo sapiens
gacagaauuc

SEQ ID NO: 1246150 - RNA, 14 nt, Homo sapiens
gacagacauacauu

SEQ ID NO: 1246151 - RNA, 16 nt, Homo sapiens
gacagacccaggucuu

SEQ ID NO: 1246152 - RNA, 17 nt, Homo sapiens
gacagagacucagcgcu

SEQ ID NO: 1246153 - RNA, 21 nt, Homo sapiens
gacagagaggggcagguugac

SEQ ID NO: 1246154 - RNA, 16 nt, Homo sapiens
gacagagcgagacucc

SEQ ID NO: 1246155 - RNA, 22 nt, Homo sapiens
gacagagggcucaccucuugcc

SEQ ID NO: 1246156 - RNA, 19 nt, Homo sapiens
gacagagugagacucuguc

SEQ ID NO: 1246157 - RNA, 17 nt, Homo sapiens
gacagaugaccaaagcc

SEQ ID NO: 1246158 - RNA, 20 nt, Homo sapiens
gacagcauauaaauguaaua

SEQ ID NO: 1246159 - RNA, 15 nt, Homo sapiens
gacagccacagccac

SEQ ID NO: 1246160 - RNA, 19 nt, Homo sapiens
gacagccucuucagccccu

SEQ ID NO: 1246161 - RNA, 13 nt, Homo sapiens
gacagccuggcac

SEQ ID NO: 1246162 - RNA, 18 nt, Homo sapiens
gacagcucuuacuuuuaa

SEQ ID NO: 1246163 - RNA, 22 nt, Homo sapiens
gacagcugcugggucaggccac

SEQ ID NO: 1246164 - RNA, 16 nt, Homo sapiens
gacagcuuccuuuccu

SEQ ID NO: 1246165 - RNA, 19 nt, Homo sapiens
gacaggaggaaucauguca

SEQ ID NO: 1246166 - RNA, 18 nt, Homo sapiens
gacaggccacaccacagc

SEQ ID NO: 1246167 - RNA, 23 nt, Homo sapiens
gacaggcccaagagaugaagagu

SEQ ID NO: 1246168 - RNA, 23 nt, Homo sapiens
gacaggcgagagaggagccagac

SEQ ID NO: 1246169 - RNA, 20 nt, Homo sapiens
gaggcaggagaauuacuuga

SEQ ID NO: 1246170 - RNA, 20 nt, Homo sapiens
gaggcaggaggauugcuuga

SEQ ID NO: 1246171 - RNA, 12 nt, Homo sapiens
gaggcaggugag

SEQ ID NO: 1246172 - RNA, 20 nt, Homo sapiens
gaggcagguggauugcuuga

SEQ ID NO: 1246173 - RNA, 13 nt, Homo sapiens
gaggcagugacag

SEQ ID NO: 1246174 - RNA, 19 nt, Homo sapiens
gaggccaguaccuuuccau

SEQ ID NO: 1246175 - RNA, 12 nt, Homo sapiens
gaggccaucuca

SEQ ID NO: 1246176 - RNA, 18 nt, Homo sapiens
gaggccccacugaugcug

SEQ ID NO: 1246177 - RNA, 19 nt, Homo sapiens
gaggccccuggagccagau

SEQ ID NO: 1246178 - RNA, 18 nt, Homo sapiens
gaggcccuccugugcugg

SEQ ID NO: 1246179 - RNA, 18 nt, Homo sapiens
gaggcccugcccaaugag

SEQ ID NO: 1246180 - RNA, 22 nt, Homo sapiens
gaggccgaaggugccucagacu

SEQ ID NO: 1246181 - RNA, 18 nt, Homo sapiens
gaggccgaggcgggugga

SEQ ID NO: 1246182 - RNA, 23 nt, Homo sapiens
gaggccgccuccucggggcucca

SEQ ID NO: 1246183 - RNA, 11 nt, Homo sapiens
gaggccuauaa

SEQ ID NO: 1246184 - RNA, 13 nt, Homo sapiens
gaggccuauaaug

SEQ ID NO: 1246185 - RNA, 16 nt, Homo sapiens
gaggccucugugcugu

SEQ ID NO: 1246186 - RNA, 14 nt, Homo sapiens
gaggccugugcuag

SEQ ID NO: 1246187 - RNA, 16 nt, Homo sapiens
gaggccuuuuuugcca

SEQ ID NO: 1246188 - RNA, 17 nt, Homo sapiens
gaggccuuuuuugccag

SEQ ID NO: 1246189 - RNA, 19 nt, Homo sapiens
gaggcggguggaucacuug

SEQ ID NO: 1246190 - RNA, 14 nt, Homo sapiens
gaggcucacacugu

SEQ ID NO: 1246191 - RNA, 21 nt, Homo sapiens
gaggcucuaauguacaauaaa

SEQ ID NO: 1246192 - RNA, 21 nt, Homo sapiens
gaggcugagcuggaucacuug

SEQ ID NO: 1246193 - RNA, 20 nt, Homo sapiens
gaggcugcacccacccagga

SEQ ID NO: 1246194 - RNA, 18 nt, Homo sapiens
gaggcugccccucucacc

SEQ ID NO: 1246195 - RNA, 23 nt, Homo sapiens
gaggcuggaggccggaaucucag

SEQ ID NO: 1246196 - RNA, 19 nt, Homo sapiens
gaggcuggguucauuugug

SEQ ID NO: 1246197 - RNA, 15 nt, Homo sapiens
gaggcuggugacagg

SEQ ID NO: 1246198 - RNA, 23 nt, Homo sapiens
gaggcuuucuccaggaggauuag

SEQ ID NO: 1246199 - RNA, 20 nt, Homo sapiens
gaggcuuugggagcaaaaua

SEQ ID NO: 1246200 - RNA, 14 nt, Homo sapiens
gagggaaagugcau

SEQ ID NO: 1246201 - RNA, 18 nt, Homo sapiens
gagggaagugucaugcaa

SEQ ID NO: 1246202 - RNA, 17 nt, Homo sapiens
gagggacaggcacucca

SEQ ID NO: 1246203 - RNA, 15 nt, Homo sapiens
gagggagagggaggu

SEQ ID NO: 1246204 - RNA, 16 nt, Homo sapiens
gagggaggagaaugag

SEQ ID NO: 1246205 - RNA, 21 nt, Homo sapiens
gagggaggcgcugcugguguu

SEQ ID NO: 1246206 - RNA, 16 nt, Homo sapiens
gagggagggcggugga

SEQ ID NO: 1246207 - RNA, 19 nt, Homo sapiens
gagggauaaaaacaauacu

SEQ ID NO: 1246208 - RNA, 23 nt, Homo sapiens
gagggauaagccagcugcagcug

SEQ ID NO: 1246209 - RNA, 17 nt, Homo sapiens
gagggcaggcacuccca

SEQ ID NO: 1246210 - RNA, 21 nt, Homo sapiens
gagggccagguuagcacagcg

SEQ ID NO: 1246211 - RNA, 16 nt, Homo sapiens
gagggcccagcccaga

SEQ ID NO: 1246212 - RNA, 15 nt, Homo sapiens
gaggggaagggccag

SEQ ID NO: 1246213 - RNA, 21 nt, Homo sapiens
gaggggacuauuuaugaaggc

SEQ ID NO: 1246214 - RNA, 17 nt, Homo sapiens
gaggggcucucagcuca

SEQ ID NO: 1246215 - RNA, 17 nt, Homo sapiens
gagggggaguagccaag

SEQ ID NO: 1246216 - RNA, 17 nt, Homo sapiens
gagggggccaggcggug

SEQ ID NO: 1246217 - RNA, 21 nt, Homo sapiens
gagggugaggggcuggcacug

SEQ ID NO: 1246218 - RNA, 15 nt, Homo sapiens
gaggguggcugccuc

SEQ ID NO: 1246219 - RNA, 18 nt, Homo sapiens
gagggugggguaaccaaa

SEQ ID NO: 1246220 - RNA, 20 nt, Homo sapiens
gagguagcacuacaaacaca

SEQ ID NO: 1246221 - RNA, 12 nt, Homo sapiens
gaggucacugga

SEQ ID NO: 1246222 - RNA, 15 nt, Homo sapiens
gaggucauacaugca

SEQ ID NO: 1246223 - RNA, 15 nt, Homo sapiens
gaggucccacuugca

SEQ ID NO: 1246224 - RNA, 18 nt, Homo sapiens
gaggucuuuugacaugug

SEQ ID NO: 1246225 - RNA, 15 nt, Homo sapiens
gaggugggaggugga

SEQ ID NO: 1246226 - RNA, 17 nt, Homo sapiens
gagguggugccuucuca

SEQ ID NO: 1246227 - RNA, 15 nt, Homo sapiens
gagguuauaggucac

SEQ ID NO: 1246228 - RNA, 20 nt, Homo sapiens
gagguucugucuacagggag

SEQ ID NO: 1246229 - RNA, 15 nt, Homo sapiens
gagguugaagccaag

SEQ ID NO: 1246230 - RNA, 12 nt, Homo sapiens
gagguugcacug

SEQ ID NO: 1246231 - RNA, 13 nt, Homo sapiens
gagguugcaguga

SEQ ID NO: 1246232 - RNA, 17 nt, Homo sapiens
gagguuuauacugcaaa

SEQ ID NO: 1246233 - RNA, 18 nt, Homo sapiens
gagguuuggaagagugaa

SEQ ID NO: 1246234 - RNA, 14 nt, Homo sapiens
gaguaauuguuauu

SEQ ID NO: 1246235 - RNA, 17 nt, Homo sapiens
gaguagaauugcauuga

SEQ ID NO: 1246236 - RNA, 18 nt, Homo sapiens
gaguaguauuaaaagcua

SEQ ID NO: 1246237 - RNA, 13 nt, Homo sapiens
gaguaugucugau

SEQ ID NO: 1246238 - RNA, 19 nt, Homo sapiens
gaguauguuaagcucuuua

SEQ ID NO: 1246239 - RNA, 16 nt, Homo sapiens
gagucacaauaaagau

SEQ ID NO: 1246240 - RNA, 14 nt, Homo sapiens
gagucacacagugu

SEQ ID NO: 1246241 - RNA, 14 nt, Homo sapiens
gagucaccuuccag

SEQ ID NO: 1246242 - RNA, 14 nt, Homo sapiens
gagucacugauaca

SEQ ID NO: 1246243 - RNA, 11 nt, Homo sapiens
gagucacugua

SEQ ID NO: 1246244 - RNA, 21 nt, Homo sapiens
gagucauggcuaauuuaacac

SEQ ID NO: 1246245 - RNA, 20 nt, Homo sapiens
gaguccacgaugguggugga

SEQ ID NO: 1246246 - RNA, 20 nt, Homo sapiens
gaguccacugcuccauuuau

SEQ ID NO: 1246247 - RNA, 17 nt, Homo sapiens
gagucgaggacagggag

SEQ ID NO: 1246248 - RNA, 19 nt, Homo sapiens
gagucuagcacucauuuuc

SEQ ID NO: 1246249 - RNA, 22 nt, Homo sapiens
gagucuagccuggacaacacag

SEQ ID NO: 1246250 - RNA, 20 nt, Homo sapiens
gagucucacucuguugccca

SEQ ID NO: 1246251 - RNA, 18 nt, Homo sapiens
gagucucaugaccucuca

SEQ ID NO: 1246252 - RNA, 16 nt, Homo sapiens
gagucucucacugucg

SEQ ID NO: 1246253 - RNA, 21 nt, Homo sapiens
gagucucugaaugaagcugaa

SEQ ID NO: 1246254 - RNA, 18 nt, Homo sapiens
gagucucuucuccacugg

SEQ ID NO: 1246255 - RNA, 15 nt, Homo sapiens
gagucugaggccuga

SEQ ID NO: 1246256 - RNA, 20 nt, Homo sapiens
gagucuguacuaaacaguaa

SEQ ID NO: 1246257 - RNA, 16 nt, Homo sapiens
gagucuuaucauuuga

SEQ ID NO: 1246258 - RNA, 18 nt, Homo sapiens
gagugaaacauugaacuc

SEQ ID NO: 1246259 - RNA, 17 nt, Homo sapiens
gagugaauuugaccuag

SEQ ID NO: 1246260 - RNA, 16 nt, Homo sapiens
gagugacuaguacaaa

SEQ ID NO: 1246261 - RNA, 15 nt, Homo sapiens
gagugagcaaggggg

SEQ ID NO: 1246262 - RNA, 14 nt, Homo sapiens
gagugauccuccaa

SEQ ID NO: 1246263 - RNA, 19 nt, Homo sapiens
gagugcauugugaggguua

SEQ ID NO: 1246264 - RNA, 13 nt, Homo sapiens
gagugcccugucc

SEQ ID NO: 1246265 - RNA, 22 nt, Homo sapiens
gagugccguaacaacugugguc

SEQ ID NO: 1246266 - RNA, 16 nt, Homo sapiens
gagugcucaccgccuc

SEQ ID NO: 1246267 - RNA, 14 nt, Homo sapiens
gaguggaaggucua

SEQ ID NO: 1246268 - RNA, 13 nt, Homo sapiens
gaguggccagcuu

SEQ ID NO: 1246269 - RNA, 15 nt, Homo sapiens
gaguggggggacaga

SEQ ID NO: 1246270 - RNA, 13 nt, Homo sapiens
gaguggucuucaa

SEQ ID NO: 1246271 - RNA, 11 nt, Homo sapiens
gaguggugcca

SEQ ID NO: 1246272 - RNA, 15 nt, Homo sapiens
gagugguuguugcca

SEQ ID NO: 1246273 - RNA, 16 nt, Homo sapiens
gaguguagacuguggc

SEQ ID NO: 1246274 - RNA, 12 nt, Homo sapiens
gagugugacagg

SEQ ID NO: 1246275 - RNA, 21 nt, Homo sapiens
gagugugugacauuccagggg

SEQ ID NO: 1246276 - RNA, 21 nt, Homo sapiens
gaguguucaaaauacuacuga

SEQ ID NO: 1246277 - RNA, 22 nt, Homo sapiens
gaguguucauuuuagugacugu

SEQ ID NO: 1246278 - RNA, 21 nt, Homo sapiens
gaguguugggcaugugaucac

SEQ ID NO: 1246279 - RNA, 22 nt, Homo sapiens
gaguuauggugaacccacaacu

SEQ ID NO: 1246280 - RNA, 15 nt, Homo sapiens
gaguucaagccugug

SEQ ID NO: 1246281 - RNA, 23 nt, Homo sapiens
gaguucuagaaccacuuccugcu

SEQ ID NO: 1246282 - RNA, 20 nt, Homo sapiens
gaguugaugggggugugauu

SEQ ID NO: 1246283 - RNA, 20 nt, Homo sapiens
gaguugcagccagggccagu

SEQ ID NO: 1246284 - RNA, 22 nt, Homo sapiens
gaguugcagccagggccagugg

SEQ ID NO: 1246285 - RNA, 18 nt, Homo sapiens
gaguugcugccacaaaca

SEQ ID NO: 1246286 - RNA, 18 nt, Homo sapiens
gaguugggacaauugcuu

SEQ ID NO: 1246287 - RNA, 15 nt, Homo sapiens
gaguuuaacaugugu

SEQ ID NO: 1246288 - RNA, 14 nt, Homo sapiens
gaguuuacauucua

SEQ ID NO: 1246289 - RNA, 14 nt, Homo sapiens
gaguuuagugugau

SEQ ID NO: 1246290 - RNA, 21 nt, Homo sapiens
gaguuuagugugauaaaggca

SEQ ID NO: 1246291 - RNA, 17 nt, Homo sapiens
gaguuuccacuauccca

SEQ ID NO: 1246292 - RNA, 18 nt, Homo sapiens
gaguuuccacuaucccaa

SEQ ID NO: 1246293 - RNA, 20 nt, Homo sapiens
gaguuuguguguauuuguau

SEQ ID NO: 1246294 - RNA, 16 nt, Homo sapiens
gauaaaaagauggccu

SEQ ID NO: 1246295 - RNA, 20 nt, Homo sapiens
gcacgcuccugccuacccag

SEQ ID NO: 1246296 - RNA, 12 nt, Homo sapiens
gcacggacaaua

SEQ ID NO: 1246297 - RNA, 16 nt, Homo sapiens
gcacgugccugugauc

SEQ ID NO: 1246298 - RNA, 22 nt, Homo sapiens
gcacguggccucuugagcagug

SEQ ID NO: 1246299 - RNA, 13 nt, Homo sapiens
gcacuaacccagc

SEQ ID NO: 1246300 - RNA, 14 nt, Homo sapiens
gcacuacaguuuua

SEQ ID NO: 1246301 - RNA, 16 nt, Homo sapiens
gcacuagaauauuuaa

SEQ ID NO: 1246302 - RNA, 18 nt, Homo sapiens
gcacuagagaaugcacag

SEQ ID NO: 1246303 - RNA, 13 nt, Homo sapiens
gcacuauuuccac

SEQ ID NO: 1246304 - RNA, 13 nt, Homo sapiens
gcacucacgcccu

SEQ ID NO: 1246305 - RNA, 17 nt, Homo sapiens
gcacucagggagcauuu

SEQ ID NO: 1246306 - RNA, 21 nt, Homo sapiens
gcacugacauuguuggccaaa

SEQ ID NO: 1246307 - RNA, 17 nt, Homo sapiens
gcacugaggaccagcca

SEQ ID NO: 1246308 - RNA, 14 nt, Homo sapiens
gcacugagggccac

SEQ ID NO: 1246309 - RNA, 14 nt, Homo sapiens
gcacugaucaccca

SEQ ID NO: 1246310 - RNA, 13 nt, Homo sapiens
gcacugauuugau

SEQ ID NO: 1246311 - RNA, 21 nt, Homo sapiens
gcacugcggcugucuccuuga

SEQ ID NO: 1246312 - RNA, 16 nt, Homo sapiens
gcacuggcucucucca

SEQ ID NO: 1246313 - RNA, 15 nt, Homo sapiens
gcacuguccugacca

SEQ ID NO: 1246314 - RNA, 12 nt, Homo sapiens
gcacuguucaau

SEQ ID NO: 1246315 - RNA, 9 nt, Homo sapiens
gcacuguuu

SEQ ID NO: 1246316 - RNA, 23 nt, Homo sapiens
gcacuuauaagaaagaucaaaga

SEQ ID NO: 1246317 - RNA, 18 nt, Homo sapiens
gcacuuauauagcaccuu

SEQ ID NO: 1246318 - RNA, 15 nt, Homo sapiens
gcacuucagaauucc

SEQ ID NO: 1246319 - RNA, 13 nt, Homo sapiens
gcacuucaucuga

SEQ ID NO: 1246320 - RNA, 21 nt, Homo sapiens
gcacuugauguuuguuugcau

SEQ ID NO: 1246321 - RNA, 18 nt, Homo sapiens
gcacuuugaaauaccuca

SEQ ID NO: 1246322 - RNA, 21 nt, Homo sapiens
gcacuuuuguuauuccaucaa

SEQ ID NO: 1246323 - RNA, 12 nt, Homo sapiens
gcagaaagggaa

SEQ ID NO: 1246324 - RNA, 22 nt, Homo sapiens
gcagaacagaucuuuuacuuug

SEQ ID NO: 1246325 - RNA, 17 nt, Homo sapiens
gcagaaccaaagcucaa

SEQ ID NO: 1246326 - RNA, 12 nt, Homo sapiens
gcagaagcccug

SEQ ID NO: 1246327 - RNA, 16 nt, Homo sapiens
gcagaagcccugaugu

SEQ ID NO: 1246328 - RNA, 19 nt, Homo sapiens
gcagaauagcaaggugcuc

SEQ ID NO: 1246329 - RNA, 13 nt, Homo sapiens
gcagacaccagca

SEQ ID NO: 1246330 - RNA, 14 nt, Homo sapiens
gcagacaccagcag

SEQ ID NO: 1246331 - RNA, 17 nt, Homo sapiens
gcagacaggccauguga

SEQ ID NO: 1246332 - RNA, 14 nt, Homo sapiens
gcagacaguagaca

SEQ ID NO: 1246333 - RNA, 23 nt, Homo sapiens
gcagacguccauagcuccucucc

SEQ ID NO: 1246334 - RNA, 22 nt, Homo sapiens
gcagagagccauuuugugaaug

SEQ ID NO: 1246335 - RNA, 16 nt, Homo sapiens
gcagagaggcugaaua

SEQ ID NO: 1246336 - RNA, 23 nt, Homo sapiens
gcagagcaccuuugcacaggaug

SEQ ID NO: 1246337 - RNA, 16 nt, Homo sapiens
gcagagccugagucac

SEQ ID NO: 1246338 - RNA, 21 nt, Homo sapiens
gcagagccugagucacugguc

SEQ ID NO: 1246339 - RNA, 17 nt, Homo sapiens
gcagaggacgcacgcuc

SEQ ID NO: 1246340 - RNA, 14 nt, Homo sapiens
gcagaggccagagg

SEQ ID NO: 1246341 - RNA, 21 nt, Homo sapiens
gcagaggccggcccuggccau

SEQ ID NO: 1246342 - RNA, 23 nt, Homo sapiens
gcagaggggccaggcccaggcag

SEQ ID NO: 1246343 - RNA, 21 nt, Homo sapiens
gcagaggucagacuaagaaau

SEQ ID NO: 1246344 - RNA, 21 nt, Homo sapiens
gcagaguacaaaguaagccau

SEQ ID NO: 1246345 - RNA, 12 nt, Homo sapiens
gcagagugaaug

SEQ ID NO: 1246346 - RNA, 16 nt, Homo sapiens
gcagagugcacagcug

SEQ ID NO: 1246347 - RNA, 19 nt, Homo sapiens
gcagaucacguugcaaugg

SEQ ID NO: 1246348 - RNA, 19 nt, Homo sapiens
gcagauccuuugucuacag

SEQ ID NO: 1246349 - RNA, 19 nt, Homo sapiens
gcagaucgcucacuguugu

SEQ ID NO: 1246350 - RNA, 21 nt, Homo sapiens
gcagauugaaaaggacaccuu

SEQ ID NO: 1246351 - RNA, 12 nt, Homo sapiens
gcagcagaauug

SEQ ID NO: 1246352 - RNA, 21 nt, Homo sapiens
gcagcaucuucaaacauguac

SEQ ID NO: 1246353 - RNA, 22 nt, Homo sapiens
gcagccccucaugccuggagaa

SEQ ID NO: 1246354 - RNA, 13 nt, Homo sapiens
gcagccucaaaac

SEQ ID NO: 1246355 - RNA, 16 nt, Homo sapiens
gcagccuccuccugac

SEQ ID NO: 1246356 - RNA, 15 nt, Homo sapiens
gcagcgguaccccag

SEQ ID NO: 1246357 - RNA, 20 nt, Homo sapiens
gcagcgucacucuaccuaau

SEQ ID NO: 1246358 - RNA, 19 nt, Homo sapiens
gcagcuaaaggaagugaau

SEQ ID NO: 1246359 - RNA, 20 nt, Homo sapiens
gcagcuaaaggaagugaauc

SEQ ID NO: 1246360 - RNA, 21 nt, Homo sapiens
gcagcuaccacgggucugcca

SEQ ID NO: 1246361 - RNA, 14 nt, Homo sapiens
gcagcuccacaggg

SEQ ID NO: 1246362 - RNA, 16 nt, Homo sapiens
gcagcuccagugccag

SEQ ID NO: 1246363 - RNA, 14 nt, Homo sapiens
gcagcuccuggaau

SEQ ID NO: 1246364 - RNA, 17 nt, Homo sapiens
gcagcucuccaccagcu

SEQ ID NO: 1246365 - RNA, 14 nt, Homo sapiens
gcagcucuugcccu

SEQ ID NO: 1246366 - RNA, 22 nt, Homo sapiens
gcagcucuugcuaaucaguguc

SEQ ID NO: 1246367 - RNA, 17 nt, Homo sapiens
gcagcugccucugcucc

SEQ ID NO: 1246368 - RNA, 15 nt, Homo sapiens
gcagcuucagugaca

SEQ ID NO: 1246369 - RNA, 20 nt, Homo sapiens
gcagcuuuugcagacgggca

SEQ ID NO: 1246370 - RNA, 23 nt, Homo sapiens
gcaggacaggaggcggcccggcc

SEQ ID NO: 1246371 - RNA, 17 nt, Homo sapiens
gcaggagaauagccuga

SEQ ID NO: 1246372 - RNA, 18 nt, Homo sapiens
gcaggagaaucacugcag

SEQ ID NO: 1246373 - RNA, 24 nt, Homo sapiens
gcaggauucuguaauagugaacau

SEQ ID NO: 1246374 - RNA, 14 nt, Homo sapiens
gcaggcacaugagg

SEQ ID NO: 1246375 - RNA, 18 nt, Homo sapiens
gcaggcauggauccagaa

SEQ ID NO: 1246376 - RNA, 14 nt, Homo sapiens
gcaggcccagugac

SEQ ID NO: 1246377 - RNA, 16 nt, Homo sapiens
gcaggcccuguccuaa

SEQ ID NO: 1246378 - RNA, 16 nt, Homo sapiens
gcaggcugcagucccu

SEQ ID NO: 1246379 - RNA, 23 nt, Homo sapiens
gcaggcugggccauguccaaaga

SEQ ID NO: 1246380 - RNA, 23 nt, Homo sapiens
gcaggcuuaauaaaaaugacaga

SEQ ID NO: 1246381 - RNA, 13 nt, Homo sapiens
gcaggcuuucaag

SEQ ID NO: 1246382 - RNA, 15 nt, Homo sapiens
gcagggaaacagcua

SEQ ID NO: 1246383 - RNA, 18 nt, Homo sapiens
gcagggaaggacaggacc

SEQ ID NO: 1246384 - RNA, 16 nt, Homo sapiens
gcagggacaagcccug

SEQ ID NO: 1246385 - RNA, 16 nt, Homo sapiens
gcagggacuccaugcu

SEQ ID NO: 1246386 - RNA, 11 nt, Homo sapiens
gcagggccagg

SEQ ID NO: 1246387 - RNA, 19 nt, Homo sapiens
gcagggcgccccugggaga

SEQ ID NO: 1246388 - RNA, 21 nt, Homo sapiens
gcaggggggcaguaacucccc

SEQ ID NO: 1246389 - RNA, 18 nt, Homo sapiens
gcagguacuuccucaguc

SEQ ID NO: 1246390 - RNA, 16 nt, Homo sapiens
gcaggugacauuugcu

SEQ ID NO: 1246391 - RNA, 20 nt, Homo sapiens
gcaggugacauuugcucuga

SEQ ID NO: 1246392 - RNA, 12 nt, Homo sapiens
gcaggugccaac

SEQ ID NO: 1246393 - RNA, 12 nt, Homo sapiens
gcaggugccucc

SEQ ID NO: 1246394 - RNA, 17 nt, Homo sapiens
gcaggugggacuuuguu

SEQ ID NO: 1246395 - RNA, 15 nt, Homo sapiens
gcagguguucugggc

SEQ ID NO: 1246396 - RNA, 20 nt, Homo sapiens
gcagguuccuuaucugucac

SEQ ID NO: 1246397 - RNA, 21 nt, Homo sapiens
gcagguugaccgggacuucaa

SEQ ID NO: 1246398 - RNA, 21 nt, Homo sapiens
gcaguaacuccccaacucccu

SEQ ID NO: 1246399 - RNA, 19 nt, Homo sapiens
gcaguaggggcuacuguga

SEQ ID NO: 1246400 - RNA, 23 nt, Homo sapiens
gcaguauccaauaggcauuugau

SEQ ID NO: 1246401 - RNA, 22 nt, Homo sapiens
gcaguauguacuucagugcacc

SEQ ID NO: 1246402 - RNA, 21 nt, Homo sapiens
gcaguccuuuguaaacagugu

SEQ ID NO: 1246403 - RNA, 19 nt, Homo sapiens
gcagugagcccagaucgca

SEQ ID NO: 1246404 - RNA, 16 nt, Homo sapiens
gcagugagcugagauc

SEQ ID NO: 1246405 - RNA, 21 nt, Homo sapiens
gcagugagcugauaucaugcc

SEQ ID NO: 1246406 - RNA, 15 nt, Homo sapiens
gcagugcaugugaag

SEQ ID NO: 1246407 - RNA, 16 nt, Homo sapiens
gcagugccuugugcaa

SEQ ID NO: 1246408 - RNA, 21 nt, Homo sapiens
gcagugccuugugcaauguga

SEQ ID NO: 1246409 - RNA, 22 nt, Homo sapiens
gcaguucuucaucaugagacaa

SEQ ID NO: 1246410 - RNA, 22 nt, Homo sapiens
gcaguugaaacaagaagccaca

SEQ ID NO: 1246411 - RNA, 17 nt, Homo sapiens
gcaguuggacucucagg

SEQ ID NO: 1246412 - RNA, 23 nt, Homo sapiens
gcaguuuccaauaaacgcaagcu

SEQ ID NO: 1246413 - RNA, 22 nt, Homo sapiens
gcauaaaagacaagcacuuugg

SEQ ID NO: 1246414 - RNA, 13 nt, Homo sapiens
gcauaaaugcauu

SEQ ID NO: 1246415 - RNA, 14 nt, Homo sapiens
gcauaacaaaaaga

SEQ ID NO: 1246416 - RNA, 13 nt, Homo sapiens
gcauaaccugucu

SEQ ID NO: 1246417 - RNA, 18 nt, Homo sapiens
gcauaauaagcuaaagag

SEQ ID NO: 1246418 - RNA, 22 nt, Homo sapiens
gcauaauuuuguguuguacaau

SEQ ID NO: 1246419 - RNA, 23 nt, Homo sapiens
gcauaccuggauuuccuuggcuu

SEQ ID NO: 1246420 - RNA, 16 nt, Homo sapiens
gcauacgagagacuug

SEQ ID NO: 1246421 - RNA, 20 nt, Homo sapiens
gccuucauaagccuaccaau

SEQ ID NO: 1246422 - RNA, 15 nt, Homo sapiens
gccuuccacaauuca

SEQ ID NO: 1246423 - RNA, 20 nt, Homo sapiens
gccuuccauaauuaugacag

SEQ ID NO: 1246424 - RNA, 12 nt, Homo sapiens
gccuucuuacaa

SEQ ID NO: 1246425 - RNA, 20 nt, Homo sapiens
gccuucuuacaacagagaug

SEQ ID NO: 1246426 - RNA, 16 nt, Homo sapiens
gccuugaaaccaccuu

SEQ ID NO: 1246427 - RNA, 16 nt, Homo sapiens
gccuugagcccuggcu

SEQ ID NO: 1246428 - RNA, 20 nt, Homo sapiens
gccuugagucaucuauucaa

SEQ ID NO: 1246429 - RNA, 19 nt, Homo sapiens
gccuugcaauuagcauucu

SEQ ID NO: 1246430 - RNA, 17 nt, Homo sapiens
gccuugcagaacugcca

SEQ ID NO: 1246431 - RNA, 14 nt, Homo sapiens
gccuugggcugcuc

SEQ ID NO: 1246432 - RNA, 18 nt, Homo sapiens
gccuuguaagacccuuau

SEQ ID NO: 1246433 - RNA, 14 nt, Homo sapiens
gccuuguaccucaa

SEQ ID NO: 1246434 - RNA, 15 nt, Homo sapiens
gccuugucauuuuau

SEQ ID NO: 1246435 - RNA, 21 nt, Homo sapiens
gccuuuaguuuuaacaguuca

SEQ ID NO: 1246436 - RNA, 18 nt, Homo sapiens
gccuuuauuugcuguuaa

SEQ ID NO: 1246437 - RNA, 21 nt, Homo sapiens
gccuuuauuuggcaaauaacu

SEQ ID NO: 1246438 - RNA, 19 nt, Homo sapiens
gccuuucugggagcagaaa

SEQ ID NO: 1246439 - RNA, 14 nt, Homo sapiens
gccuuuguugcuca

SEQ ID NO: 1246440 - RNA, 21 nt, Homo sapiens
gccuuuucucaccugucaucu

SEQ ID NO: 1246441 - RNA, 15 nt, Homo sapiens
gccuuuugugugaug

SEQ ID NO: 1246442 - RNA, 13 nt, Homo sapiens
gccuuuuuugcca

SEQ ID NO: 1246443 - RNA, 17 nt, Homo sapiens
gcgaaccacccaaaaca

SEQ ID NO: 1246444 - RNA, 15 nt, Homo sapiens
gcgaauaacaguccc

SEQ ID NO: 1246445 - RNA, 21 nt, Homo sapiens
gcgacaggaauagaugugguc

SEQ ID NO: 1246446 - RNA, 14 nt, Homo sapiens
gcgacauagcccau

SEQ ID NO: 1246447 - RNA, 13 nt, Homo sapiens
gcgagcacuguga

SEQ ID NO: 1246448 - RNA, 22 nt, Homo sapiens
gcgauccaccugucucagccuc

SEQ ID NO: 1246449 - RNA, 12 nt, Homo sapiens
gcgaugcucccu

SEQ ID NO: 1246450 - RNA, 17 nt, Homo sapiens
gcgauugaaagggcaau

SEQ ID NO: 1246451 - RNA, 22 nt, Homo sapiens
gcgcacacacacacacacacau

SEQ ID NO: 1246452 - RNA, 17 nt, Homo sapiens
gcgcaguuguucagagc

SEQ ID NO: 1246453 - RNA, 22 nt, Homo sapiens
gcgccagccugucccauggaca

SEQ ID NO: 1246454 - RNA, 13 nt, Homo sapiens
gcgccagcucuac

SEQ ID NO: 1246455 - RNA, 20 nt, Homo sapiens
gcgcccagggaggagucagu

SEQ ID NO: 1246456 - RNA, 23 nt, Homo sapiens
gcgcccugcaccugacagcuuua

SEQ ID NO: 1246457 - RNA, 16 nt, Homo sapiens
gcgcccuggguggugg

SEQ ID NO: 1246458 - RNA, 21 nt, Homo sapiens
gcgcccuuggcuucugugaug

SEQ ID NO: 1246459 - RNA, 14 nt, Homo sapiens
gcgcgcgugcacac

SEQ ID NO: 1246460 - RNA, 13 nt, Homo sapiens
gcgcuauuacaaa

SEQ ID NO: 1246461 - RNA, 14 nt, Homo sapiens
gcgcucagggccau

SEQ ID NO: 1246462 - RNA, 20 nt, Homo sapiens
gcgcugaguauggagcagcc

SEQ ID NO: 1246463 - RNA, 20 nt, Homo sapiens
gcgcugcucuuaugccauuu

SEQ ID NO: 1246464 - RNA, 16 nt, Homo sapiens
gcgcugcugguguucu

SEQ ID NO: 1246465 - RNA, 15 nt, Homo sapiens
gcgcuggacacucuc

SEQ ID NO: 1246466 - RNA, 20 nt, Homo sapiens
gcgcuguuuucucagcucca

SEQ ID NO: 1246467 - RNA, 18 nt, Homo sapiens
gcgcuucccaacuucaua

SEQ ID NO: 1246468 - RNA, 19 nt, Homo sapiens
gcggaccccagcugugagc

SEQ ID NO: 1246469 - RNA, 22 nt, Homo sapiens
gcggaccccucgucaucaggug

SEQ ID NO: 1246470 - RNA, 18 nt, Homo sapiens
gcggccauaagaggugau

SEQ ID NO: 1246471 - RNA, 17 nt, Homo sapiens
gcggcuucaccugcgug

SEQ ID NO: 1246472 - RNA, 16 nt, Homo sapiens
gcgggcauggcgugga

SEQ ID NO: 1246473 - RNA, 15 nt, Homo sapiens
gcgggcgcgugagug

SEQ ID NO: 1246474 - RNA, 12 nt, Homo sapiens
gcgguggcucac

SEQ ID NO: 1246475 - RNA, 22 nt, Homo sapiens
gcgguggcucacgccuguaauc

SEQ ID NO: 1246476 - RNA, 14 nt, Homo sapiens
gcguagacaggugu

SEQ ID NO: 1246477 - RNA, 17 nt, Homo sapiens
gcguaguccgcuuucuc

SEQ ID NO: 1246478 - RNA, 20 nt, Homo sapiens
gcgucaucucugacacggcc

SEQ ID NO: 1246479 - RNA, 15 nt, Homo sapiens
gcgucuggguucuca

SEQ ID NO: 1246480 - RNA, 12 nt, Homo sapiens
gcgugcacacac

SEQ ID NO: 1246481 - RNA, 17 nt, Homo sapiens
gcgugcccagcucuuca

SEQ ID NO: 1246482 - RNA, 21 nt, Homo sapiens
gcgugcucccgaugcugcuau

SEQ ID NO: 1246483 - RNA, 18 nt, Homo sapiens
gcguggacucugcacaug

SEQ ID NO: 1246484 - RNA, 20 nt, Homo sapiens
gcguggacucugcacauguc

SEQ ID NO: 1246485 - RNA, 14 nt, Homo sapiens
gcguggagacuggc

SEQ ID NO: 1246486 - RNA, 20 nt, Homo sapiens
gcguggugcucuuugcugca

SEQ ID NO: 1246487 - RNA, 18 nt, Homo sapiens
gcgugucccucucggaag

SEQ ID NO: 1246488 - RNA, 14 nt, Homo sapiens
gcguucaccucccu

SEQ ID NO: 1246489 - RNA, 23 nt, Homo sapiens
gcguuucauguagccagcagaac

SEQ ID NO: 1246490 - RNA, 16 nt, Homo sapiens
gcguuuuucucaaagg

SEQ ID NO: 1246491 - RNA, 20 nt, Homo sapiens
gcuaaaauuagaugaacuca

SEQ ID NO: 1246492 - RNA, 21 nt, Homo sapiens
gcuaaagagcuuugugauaua

SEQ ID NO: 1246493 - RNA, 17 nt, Homo sapiens
gcuaaaggacaguggau

SEQ ID NO: 1246494 - RNA, 20 nt, Homo sapiens
gcuaaauuuggguacugggu

SEQ ID NO: 1246495 - RNA, 20 nt, Homo sapiens
gcuaacuauauuugcuuuuu

SEQ ID NO: 1246496 - RNA, 21 nt, Homo sapiens
gcuaagauagaggggcucugg

SEQ ID NO: 1246497 - RNA, 21 nt, Homo sapiens
gcuaagauuuagagaugaauu

SEQ ID NO: 1246498 - RNA, 17 nt, Homo sapiens
gcuaaggacauuuccca

SEQ ID NO: 1246499 - RNA, 15 nt, Homo sapiens
gcuaagggugggugc

SEQ ID NO: 1246500 - RNA, 17 nt, Homo sapiens
gcuaagggugggugcuc

SEQ ID NO: 1246501 - RNA, 15 nt, Homo sapiens
gcuaauaaaguccua

SEQ ID NO: 1246502 - RNA, 14 nt, Homo sapiens
gcuaauauugcaau

SEQ ID NO: 1246503 - RNA, 21 nt, Homo sapiens
gcuaaucaaagccagggucuc

SEQ ID NO: 1246504 - RNA, 19 nt, Homo sapiens
gcuaaucuucuuaugcaau

SEQ ID NO: 1246505 - RNA, 16 nt, Homo sapiens
gcuaauuuuugcaaau

SEQ ID NO: 1246506 - RNA, 18 nt, Homo sapiens
gcuacaaauuuaugcauu

SEQ ID NO: 1246507 - RNA, 14 nt, Homo sapiens
gcuacaacauguga

SEQ ID NO: 1246508 - RNA, 20 nt, Homo sapiens
gcuacagagccgagcaauau

SEQ ID NO: 1246509 - RNA, 17 nt, Homo sapiens
gcuacaguuauuaaucu

SEQ ID NO: 1246510 - RNA, 17 nt, Homo sapiens
gcuacccaugacuuuau

SEQ ID NO: 1246511 - RNA, 19 nt, Homo sapiens
gcuaccuacaugcugaaaa

SEQ ID NO: 1246512 - RNA, 15 nt, Homo sapiens
gcuaccuacugauaa

SEQ ID NO: 1246513 - RNA, 21 nt, Homo sapiens
gcuaccuguugguuagauuca

SEQ ID NO: 1246514 - RNA, 19 nt, Homo sapiens
gcuacuaccuagggcacuu

SEQ ID NO: 1246515 - RNA, 21 nt, Homo sapiens
gcuacuaccuagggcacuuua

SEQ ID NO: 1246516 - RNA, 14 nt, Homo sapiens
gcuacuggcagcuc

SEQ ID NO: 1246517 - RNA, 12 nt, Homo sapiens
gcuacugucauu

SEQ ID NO: 1246518 - RNA, 13 nt, Homo sapiens
gcuacuugggagg

SEQ ID NO: 1246519 - RNA, 22 nt, Homo sapiens
gcuacuuuuuuuuaguucaaua

SEQ ID NO: 1246520 - RNA, 11 nt, Homo sapiens
gcuagaacuuu

SEQ ID NO: 1246521 - RNA, 23 nt, Homo sapiens
gcuagaaggcaaagugcacauga

SEQ ID NO: 1246522 - RNA, 17 nt, Homo sapiens
gcuagaugcugugacag

SEQ ID NO: 1246523 - RNA, 15 nt, Homo sapiens
gcuagcagcugugau

SEQ ID NO: 1246524 - RNA, 19 nt, Homo sapiens
gcuagcgauuucagaccua

SEQ ID NO: 1246525 - RNA, 15 nt, Homo sapiens
gcuaggcggagcuca

SEQ ID NO: 1246526 - RNA, 19 nt, Homo sapiens
gcuagggcggggcacagau

SEQ ID NO: 1246527 - RNA, 16 nt, Homo sapiens
gcuagggggcguuauu

SEQ ID NO: 1246528 - RNA, 16 nt, Homo sapiens
gcuaguaaaagccauc

SEQ ID NO: 1246529 - RNA, 12 nt, Homo sapiens
gcuagugccuuu

SEQ ID NO: 1246530 - RNA, 17 nt, Homo sapiens
gcuauacacaagcaaug

SEQ ID NO: 1246531 - RNA, 14 nt, Homo sapiens
gcuauagcuacagg

SEQ ID NO: 1246532 - RNA, 21 nt, Homo sapiens
gcuauauucaaaaugucuaua

SEQ ID NO: 1246533 - RNA, 14 nt, Homo sapiens
gcuauucuccauac

SEQ ID NO: 1246534 - RNA, 19 nt, Homo sapiens
gcuauuuauuaaguauuuu

SEQ ID NO: 1246535 - RNA, 22 nt, Homo sapiens
gcuauuugaaauacuaaaagca

SEQ ID NO: 1246536 - RNA, 17 nt, Homo sapiens
gcuauuuguucagagag

SEQ ID NO: 1246537 - RNA, 17 nt, Homo sapiens
gcucaaacaacauucca

SEQ ID NO: 1246538 - RNA, 19 nt, Homo sapiens
gcucaaaguacuacagcaa

SEQ ID NO: 1246539 - RNA, 20 nt, Homo sapiens
gcucaaaguacuacagcaaa

SEQ ID NO: 1246540 - RNA, 16 nt, Homo sapiens
gcucaagaacacaugu

SEQ ID NO: 1246541 - RNA, 17 nt, Homo sapiens
gcucaagaggccacuua

SEQ ID NO: 1246542 - RNA, 12 nt, Homo sapiens
gcucaagcugac

SEQ ID NO: 1246543 - RNA, 13 nt, Homo sapiens
gcucaauuccuuc

SEQ ID NO: 1246544 - RNA, 19 nt, Homo sapiens
gcucacaaaccaugcaaau

SEQ ID NO: 1246545 - RNA, 13 nt, Homo sapiens
gcucacaguacag

SEQ ID NO: 1246546 - RNA, 18 nt, Homo sapiens
gcucacauaucugucauu

SEQ ID NO: 1246547 - RNA, 16 nt, Homo sapiens
gucucaucuucucuca

SEQ ID NO: 1246548 - RNA, 16 nt, Homo sapiens
gucucauuuagaacuu

SEQ ID NO: 1246549 - RNA, 21 nt, Homo sapiens
gucuccacugugccuuugcaa

SEQ ID NO: 1246550 - RNA, 18 nt, Homo sapiens
gucucccuucuguuucuu

SEQ ID NO: 1246551 - RNA, 15 nt, Homo sapiens
gucuccuacuccuga

SEQ ID NO: 1246552 - RNA, 23 nt, Homo sapiens
gucuccuuauucggcagccuuau

SEQ ID NO: 1246553 - RNA, 18 nt, Homo sapiens
gucuccuuugcacugagg

SEQ ID NO: 1246554 - RNA, 19 nt, Homo sapiens
gucuccuuugcucuugcca

SEQ ID NO: 1246555 - RNA, 17 nt, Homo sapiens
gucucgauuagacucca

SEQ ID NO: 1246556 - RNA, 18 nt, Homo sapiens
gucucuaguuccacgccu

SEQ ID NO: 1246557 - RNA, 18 nt, Homo sapiens
gucucugccggcucuuuc

SEQ ID NO: 1246558 - RNA, 15 nt, Homo sapiens
gucucuggcauuugu

SEQ ID NO: 1246559 - RNA, 16 nt, Homo sapiens
gucucuuccacaggaa

SEQ ID NO: 1246560 - RNA, 16 nt, Homo sapiens
gucugagaauuuccaa

SEQ ID NO: 1246561 - RNA, 18 nt, Homo sapiens
gucugagaauuuccaaaa

SEQ ID NO: 1246562 - RNA, 16 nt, Homo sapiens
gucugauuuaugguuu

SEQ ID NO: 1246563 - RNA, 20 nt, Homo sapiens
gucugcaugugcacgguggc

SEQ ID NO: 1246564 - RNA, 18 nt, Homo sapiens
gucuggaaagugauguca

SEQ ID NO: 1246565 - RNA, 15 nt, Homo sapiens
gucugggacuuccuu

SEQ ID NO: 1246566 - RNA, 16 nt, Homo sapiens
gucugggauauggcug

SEQ ID NO: 1246567 - RNA, 21 nt, Homo sapiens
gucugggcucccugcgccuga

SEQ ID NO: 1246568 - RNA, 18 nt, Homo sapiens
gucuggggucuccuauac

SEQ ID NO: 1246569 - RNA, 15 nt, Homo sapiens
gucugggucuaccag

SEQ ID NO: 1246570 - RNA, 19 nt, Homo sapiens
gucugguugggcagccaga

SEQ ID NO: 1246571 - RNA, 15 nt, Homo sapiens
gucuguacacguguc

SEQ ID NO: 1246572 - RNA, 13 nt, Homo sapiens
gucuguaccucaa

SEQ ID NO: 1246573 - RNA, 15 nt, Homo sapiens
gucugucuacugugg

SEQ ID NO: 1246574 - RNA, 15 nt, Homo sapiens
gucugucucagcuca

SEQ ID NO: 1246575 - RNA, 18 nt, Homo sapiens
gucugugagaugcuagaa

SEQ ID NO: 1246576 - RNA, 11 nt, Homo sapiens
gucuguuggca

SEQ ID NO: 1246577 - RNA, 19 nt, Homo sapiens
gucuguuuggacugcagaa

SEQ ID NO: 1246578 - RNA, 20 nt, Homo sapiens
gucuuaacuuuucaccaggg

SEQ ID NO: 1246579 - RNA, 15 nt, Homo sapiens
gucuuaaucauuugu

SEQ ID NO: 1246580 - RNA, 15 nt, Homo sapiens
gucuuaauguacaca

SEQ ID NO: 1246581 - RNA, 16 nt, Homo sapiens
gucuuaguaccagagc

SEQ ID NO: 1246582 - RNA, 12 nt, Homo sapiens
gucuuagucaaa

SEQ ID NO: 1246583 - RNA, 15 nt, Homo sapiens
gucuuaucaacuggu

SEQ ID NO: 1246584 - RNA, 20 nt, Homo sapiens
gucuuaugaaacaauuugag

SEQ ID NO: 1246585 - RNA, 18 nt, Homo sapiens
gucuucaacauccugcca

SEQ ID NO: 1246586 - RNA, 17 nt, Homo sapiens
gucuucagggaagguca

SEQ ID NO: 1246587 - RNA, 23 nt, Homo sapiens
gucuuccacaaaaaauacuuuau

SEQ ID NO: 1246588 - RNA, 12 nt, Homo sapiens
gucuuccauaau

SEQ ID NO: 1246589 - RNA, 14 nt, Homo sapiens
gucuucccuaccuc

SEQ ID NO: 1246590 - RNA, 19 nt, Homo sapiens
gucuucccugaucaaguca

SEQ ID NO: 1246591 - RNA, 13 nt, Homo sapiens
gucuucccuguau

SEQ ID NO: 1246592 - RNA, 20 nt, Homo sapiens
gucuucccuucugauugaug

SEQ ID NO: 1246593 - RNA, 16 nt, Homo sapiens
gucuucucugucucag

SEQ ID NO: 1246594 - RNA, 23 nt, Homo sapiens
gucuugaaaguggcaccagaggu

SEQ ID NO: 1246595 - RNA, 16 nt, Homo sapiens
gucuugaugacugcug

SEQ ID NO: 1246596 - RNA, 19 nt, Homo sapiens
gucuuggaaaaaaaccaca

SEQ ID NO: 1246597 - RNA, 21 nt, Homo sapiens
gucuuggaaaaaaaccacagc

SEQ ID NO: 1246598 - RNA, 14 nt, Homo sapiens
gucuuguacuucug

SEQ ID NO: 1246599 - RNA, 17 nt, Homo sapiens
gucuuguucugugauga

SEQ ID NO: 1246600 - RNA, 18 nt, Homo sapiens
gucuuguuuuuuacucaa

SEQ ID NO: 1246601 - RNA, 14 nt, Homo sapiens
gucuuugaacccuu

SEQ ID NO: 1246602 - RNA, 14 nt, Homo sapiens
gucuuugcagagaa

SEQ ID NO: 1246603 - RNA, 15 nt, Homo sapiens
gucuuuuagaagaua

SEQ ID NO: 1246604 - RNA, 14 nt, Homo sapiens
gucuuuugcagcuu

SEQ ID NO: 1246605 - RNA, 20 nt, Homo sapiens
gugaaaauuuuuacauucau

SEQ ID NO: 1246606 - RNA, 16 nt, Homo sapiens
gugaaaccccaucucu

SEQ ID NO: 1246607 - RNA, 21 nt, Homo sapiens
gugaaaccccaucucuacuaa

SEQ ID NO: 1246608 - RNA, 15 nt, Homo sapiens
gugaaaggcucagua

SEQ ID NO: 1246609 - RNA, 15 nt, Homo sapiens
gugaaaguacauuug

SEQ ID NO: 1246610 - RNA, 13 nt, Homo sapiens
gugaaaguggcug

SEQ ID NO: 1246611 - RNA, 20 nt, Homo sapiens
gugaaauaccacaagccuga

SEQ ID NO: 1246612 - RNA, 19 nt, Homo sapiens
gugaaaugcuggcauuugc

SEQ ID NO: 1246613 - RNA, 20 nt, Homo sapiens
gugaaaugcuggcauuugca

SEQ ID NO: 1246614 - RNA, 17 nt, Homo sapiens
gugaaaugugaaggaaa

SEQ ID NO: 1246615 - RNA, 14 nt, Homo sapiens
gugaacaguguaua

SEQ ID NO: 1246616 - RNA, 12 nt, Homo sapiens
gugaacaucccc

SEQ ID NO: 1246617 - RNA, 12 nt, Homo sapiens
gugaaccaaaga

SEQ ID NO: 1246618 - RNA, 16 nt, Homo sapiens
gugaaccacuucauuc

SEQ ID NO: 1246619 - RNA, 18 nt, Homo sapiens
gugaaccacuucauucug

SEQ ID NO: 1246620 - RNA, 15 nt, Homo sapiens
gugaaccaucauuau

SEQ ID NO: 1246621 - RNA, 19 nt, Homo sapiens
gugaacuagggaagcucag

SEQ ID NO: 1246622 - RNA, 14 nt, Homo sapiens
gugaacuuacacuu

SEQ ID NO: 1246623 - RNA, 17 nt, Homo sapiens
gugaagaaaaauguauu

SEQ ID NO: 1246624 - RNA, 21 nt, Homo sapiens
gugaagaacacuacugcuaaa

SEQ ID NO: 1246625 - RNA, 14 nt, Homo sapiens
gugaagacccagga

SEQ ID NO: 1246626 - RNA, 12 nt, Homo sapiens
gugaagcagcuc

SEQ ID NO: 1246627 - RNA, 18 nt, Homo sapiens
gugaagggagagccagcu

SEQ ID NO: 1246628 - RNA, 16 nt, Homo sapiens
gugaaguuuaaacucu

SEQ ID NO: 1246629 - RNA, 17 nt, Homo sapiens
gugaauagucaucuccu

SEQ ID NO: 1246630 - RNA, 15 nt, Homo sapiens
gugaaugaaucucaa

SEQ ID NO: 1246631 - RNA, 15 nt, Homo sapiens
gugaaugcacugugu

SEQ ID NO: 1246632 - RNA, 18 nt, Homo sapiens
gugaaugcacugugugau

SEQ ID NO: 1246633 - RNA, 20 nt, Homo sapiens
gugaauguggauucuuccca

SEQ ID NO: 1246634 - RNA, 17 nt, Homo sapiens
gugaauguuuaccauga

SEQ ID NO: 1246635 - RNA, 17 nt, Homo sapiens
gugacaagccaauguga

SEQ ID NO: 1246636 - RNA, 13 nt, Homo sapiens
gugacacauugua

SEQ ID NO: 1246637 - RNA, 15 nt, Homo sapiens
gugacauuugggaga

SEQ ID NO: 1246638 - RNA, 23 nt, Homo sapiens
gugaccaacuagacauucugucg

SEQ ID NO: 1246639 - RNA, 23 nt, Homo sapiens
gugaccccugaccucacugugac

SEQ ID NO: 1246640 - RNA, 14 nt, Homo sapiens
gugaccgacuaccc

SEQ ID NO: 1246641 - RNA, 21 nt, Homo sapiens
gugaccucugccugaagucac

SEQ ID NO: 1246642 - RNA, 14 nt, Homo sapiens
gugacuaucacccc

SEQ ID NO: 1246643 - RNA, 12 nt, Homo sapiens
gugacugaaauu

SEQ ID NO: 1246644 - RNA, 19 nt, Homo sapiens
gugacuucuccaggucuca

SEQ ID NO: 1246645 - RNA, 12 nt, Homo sapiens
gugacuuucuaa

SEQ ID NO: 1246646 - RNA, 17 nt, Homo sapiens
gugagaaauuucuguga

SEQ ID NO: 1246647 - RNA, 15 nt, Homo sapiens
gugagacugacugca

SEQ ID NO: 1246648 - RNA, 20 nt, Homo sapiens
gugagacuguaaguuacaug

SEQ ID NO: 1246649 - RNA, 23 nt, Homo sapiens
gugagagaaagagagaagccagc

SEQ ID NO: 1246650 - RNA, 18 nt, Homo sapiens
gugagaugcuagaacucc

SEQ ID NO: 1246651 - RNA, 13 nt, Homo sapiens
gugagauguaauu

SEQ ID NO: 1246652 - RNA, 13 nt, Homo sapiens
gugagcacgcuga

SEQ ID NO: 1246653 - RNA, 16 nt, Homo sapiens
gugagcuaugcaaaca

SEQ ID NO: 1246654 - RNA, 19 nt, Homo sapiens
gugaggaagccuauuugaa

SEQ ID NO: 1246655 - RNA, 15 nt, Homo sapiens
gugaguggcagccau

SEQ ID NO: 1246656 - RNA, 19 nt, Homo sapiens
gugaguuuaccuuguauac

SEQ ID NO: 1246657 - RNA, 13 nt, Homo sapiens
gugauagcacuuu

SEQ ID NO: 1246658 - RNA, 18 nt, Homo sapiens
gugauccacccaccucag

SEQ ID NO: 1246659 - RNA, 18 nt, Homo sapiens
gugauccucccaccucag

SEQ ID NO: 1246660 - RNA, 13 nt, Homo sapiens
gugaugaugcugu

SEQ ID NO: 1246661 - RNA, 13 nt, Homo sapiens
gugauggggcaag

SEQ ID NO: 1246662 - RNA, 21 nt, Homo sapiens
gugaugugugagcuaugcaaa

SEQ ID NO: 1246663 - RNA, 14 nt, Homo sapiens
gugauguuugcucu

SEQ ID NO: 1246664 - RNA, 23 nt, Homo sapiens
gugauugaaccagcucaucucca

SEQ ID NO: 1246665 - RNA, 16 nt, Homo sapiens
gugcaaaccuguucau

SEQ ID NO: 1246666 - RNA, 23 nt, Homo sapiens
gugcaaaccuguucaucuugcca

SEQ ID NO: 1246667 - RNA, 20 nt, Homo sapiens
gugcaagaaggauaccaaau

SEQ ID NO: 1246668 - RNA, 18 nt, Homo sapiens
gugcaauaugaggccaaa

SEQ ID NO: 1246669 - RNA, 19 nt, Homo sapiens
gugcacagggggaggccau

SEQ ID NO: 1246670 - RNA, 17 nt, Homo sapiens
gugcaccgaguggccau

SEQ ID NO: 1246671 - RNA, 18 nt, Homo sapiens
gugcacguacacacacau

SEQ ID NO: 1246672 - RNA, 21 nt, Homo sapiens
gugcagggcucagggggcccg

SEQ ID NO: 1246673 - RNA, 19 nt, Homo sapiens
gugcaguggcgcauucuag

SEQ ID NO: 1246674 - RNA, 22 nt, Homo sapiens
uaaacuuggauucucuaaccuu

SEQ ID NO: 1246675 - RNA, 14 nt, Homo sapiens
uaaacuuguuugcu

SEQ ID NO: 1246676 - RNA, 22 nt, Homo sapiens
uaaacuuuauuuguaaaccauu

SEQ ID NO: 1246677 - RNA, 19 nt, Homo sapiens
uaaagaaaauaaacaccau

SEQ ID NO: 1246678 - RNA, 15 nt, Homo sapiens
uaaagaagaacuugc

SEQ ID NO: 1246679 - RNA, 19 nt, Homo sapiens
uaaagaaggguguuuaaua

SEQ ID NO: 1246680 - RNA, 23 nt, Homo sapiens
uaaagaauguuucuuaacuauaa

SEQ ID NO: 1246681 - RNA, 20 nt, Homo sapiens
uaaagacugguuuucugcca

SEQ ID NO: 1246682 - RNA, 18 nt, Homo sapiens
uaaagagaaacuuugugc

SEQ ID NO: 1246683 - RNA, 23 nt, Homo sapiens
uaaagagagagagagagaauucc

SEQ ID NO: 1246684 - RNA, 21 nt, Homo sapiens
uaaagauaacccuuauuccau

SEQ ID NO: 1246685 - RNA, 20 nt, Homo sapiens
uaaagauacuaaaccagcau

SEQ ID NO: 1246686 - RNA, 10 nt, Homo sapiens
uaaagauaug

SEQ ID NO: 1246687 - RNA, 21 nt, Homo sapiens
uaaagauauggagaauugcug

SEQ ID NO: 1246688 - RNA, 18 nt, Homo sapiens
uaaagaugaucuacucag

SEQ ID NO: 1246689 - RNA, 21 nt, Homo sapiens
uaaagauggaguuucuaaggu

SEQ ID NO: 1246690 - RNA, 17 nt, Homo sapiens
uaaagauguuuauuuca

SEQ ID NO: 1246691 - RNA, 20 nt, Homo sapiens
uaaagauugcagcauuuaug

SEQ ID NO: 1246692 - RNA, 11 nt, Homo sapiens
uaaagcaaagu

SEQ ID NO: 1246693 - RNA, 17 nt, Homo sapiens
uaaagcaaugugguagu

SEQ ID NO: 1246694 - RNA, 15 nt, Homo sapiens
uaaagcauauuggug

SEQ ID NO: 1246695 - RNA, 14 nt, Homo sapiens
uaaagccuccucau

SEQ ID NO: 1246696 - RNA, 13 nt, Homo sapiens
uaaagcucaaggu

SEQ ID NO: 1246697 - RNA, 15 nt, Homo sapiens
uaaaggaaaaucaca

SEQ ID NO: 1246698 - RNA, 21 nt, Homo sapiens
uaaaggacaggccacaccaca

SEQ ID NO: 1246699 - RNA, 14 nt, Homo sapiens
uaaaggcagcugcc

SEQ ID NO: 1246700 - RNA, 14 nt, Homo sapiens
uaaaggccuggaac

SEQ ID NO: 1246701 - RNA, 17 nt, Homo sapiens
uaaaggcuaaaagggaa

SEQ ID NO: 1246702 - RNA, 23 nt, Homo sapiens
uaaagggcaggugguucuaauau

SEQ ID NO: 1246703 - RNA, 18 nt, Homo sapiens
uaaagggcauuuuacuaa

SEQ ID NO: 1246704 - RNA, 16 nt, Homo sapiens
uaaagggucuuaugaa

SEQ ID NO: 1246705 - RNA, 15 nt, Homo sapiens
uaaagguuuucucua

SEQ ID NO: 1246706 - RNA, 14 nt, Homo sapiens
uaaaguaagacauc

SEQ ID NO: 1246707 - RNA, 21 nt, Homo sapiens
uaaaguaccacacauauugca

SEQ ID NO: 1246708 - RNA, 22 nt, Homo sapiens
uaaaguaccacacauauugcac

SEQ ID NO: 1246709 - RNA, 19 nt, Homo sapiens
uaaaguauguuauugcaua

SEQ ID NO: 1246710 - RNA, 20 nt, Homo sapiens
uaaaguauguuauugcauaa

SEQ ID NO: 1246711 - RNA, 13 nt, Homo sapiens
uaaaguauugucu

SEQ ID NO: 1246712 - RNA, 14 nt, Homo sapiens
uaaagucugaauca

SEQ ID NO: 1246713 - RNA, 20 nt, Homo sapiens
uaaagugaauaaccacuuaa

SEQ ID NO: 1246714 - RNA, 21 nt, Homo sapiens
uaaagugaauaaccacuuaaa

SEQ ID NO: 1246715 - RNA, 16 nt, Homo sapiens
uaaagugcccagcaca

SEQ ID NO: 1246716 - RNA, 15 nt, Homo sapiens
uaaagugcuaagguu

SEQ ID NO: 1246717 - RNA, 16 nt, Homo sapiens
uaaagugcugcaguau

SEQ ID NO: 1246718 - RNA, 11 nt, Homo sapiens
uaaaguggcag

SEQ ID NO: 1246719 - RNA, 16 nt, Homo sapiens
uaaaguugcuccauac

SEQ ID NO: 1246720 - RNA, 21 nt, Homo sapiens
uaaauaaaauucauuucuaca

SEQ ID NO: 1246721 - RNA, 21 nt, Homo sapiens
uaaauaaauguaucuuauuca

SEQ ID NO: 1246722 - RNA, 19 nt, Homo sapiens
uaaauaaccucuggcccuu

SEQ ID NO: 1246723 - RNA, 13 nt, Homo sapiens
uaaauaagaucag

SEQ ID NO: 1246724 - RNA, 15 nt, Homo sapiens
uaaauaauaccauaa

SEQ ID NO: 1246725 - RNA, 19 nt, Homo sapiens
uaaauaauguuaucugugu

SEQ ID NO: 1246726 - RNA, 11 nt, Homo sapiens
uaaauacaggu

SEQ ID NO: 1246727 - RNA, 13 nt, Homo sapiens
uaaauacagguag

SEQ ID NO: 1246728 - RNA, 16 nt, Homo sapiens
uaaauacugcuugacc

SEQ ID NO: 1246729 - RNA, 20 nt, Homo sapiens
uaaauacuguaaaugcauug

SEQ ID NO: 1246730 - RNA, 17 nt, Homo sapiens
uaaauacuguguggaac

SEQ ID NO: 1246731 - RNA, 21 nt, Homo sapiens
uaaauagaguauaugcacuuu

SEQ ID NO: 1246732 - RNA, 23 nt, Homo sapiens
uaaauagcuauauccauguacug

SEQ ID NO: 1246733 - RNA, 22 nt, Homo sapiens
uaaauaguagaaaaaucagagu

SEQ ID NO: 1246734 - RNA, 23 nt, Homo sapiens
uaaauaguauuugagaguucuaa

SEQ ID NO: 1246735 - RNA, 21 nt, Homo sapiens
uaaauauauuuuaaagcacuu

SEQ ID NO: 1246736 - RNA, 13 nt, Homo sapiens
uaaauaugcaucu

SEQ ID NO: 1246737 - RNA, 19 nt, Homo sapiens
uaaauaugccuaguaacac

SEQ ID NO: 1246738 - RNA, 18 nt, Homo sapiens
uaaauauuuauguagaug

SEQ ID NO: 1246739 - RNA, 20 nt, Homo sapiens
uaaaucaggacagguggugc

SEQ ID NO: 1246740 - RNA, 15 nt, Homo sapiens
uaaaucauuucagua

SEQ ID NO: 1246741 - RNA, 16 nt, Homo sapiens
uaaauccaugcaccua

SEQ ID NO: 1246742 - RNA, 15 nt, Homo sapiens
uaaauccaugguguu

SEQ ID NO: 1246743 - RNA, 17 nt, Homo sapiens
uaaauccaugguguuau

SEQ ID NO: 1246744 - RNA, 20 nt, Homo sapiens
uaaauccucauguuacucag

SEQ ID NO: 1246745 - RNA, 12 nt, Homo sapiens
uaaaucugaaua

SEQ ID NO: 1246746 - RNA, 13 nt, Homo sapiens
uaaaucugugaug

SEQ ID NO: 1246747 - RNA, 15 nt, Homo sapiens
uaaaugaguucaaca

SEQ ID NO: 1246748 - RNA, 12 nt, Homo sapiens
uaaaugcauugg

SEQ ID NO: 1246749 - RNA, 15 nt, Homo sapiens
uaaaugggacuggag

SEQ ID NO: 1246750 - RNA, 17 nt, Homo sapiens
uaaauguaucauagaaa

SEQ ID NO: 1246751 - RNA, 16 nt, Homo sapiens
uaaauucaacuuugua

SEQ ID NO: 1246752 - RNA, 19 nt, Homo sapiens
uaaauugacccuagccaga

SEQ ID NO: 1246753 - RNA, 19 nt, Homo sapiens
uaaauugcuccuugacauu

SEQ ID NO: 1246754 - RNA, 23 nt, Homo sapiens
uaaauugcuuuuguugugacuuu

SEQ ID NO: 1246755 - RNA, 15 nt, Homo sapiens
uaaauuuaauuuaca

SEQ ID NO: 1246756 - RNA, 23 nt, Homo sapiens
uaaauuuguuauuguguauuaug

SEQ ID NO: 1246757 - RNA, 16 nt, Homo sapiens
uaaauuuuagcaaguu

SEQ ID NO: 1246758 - RNA, 18 nt, Homo sapiens
uaaauuuuauaacagaau

SEQ ID NO: 1246759 - RNA, 18 nt, Homo sapiens
uaacaacaauaacacugu

SEQ ID NO: 1246760 - RNA, 20 nt, Homo sapiens
uaacaacaauaacacugucu

SEQ ID NO: 1246761 - RNA, 22 nt, Homo sapiens
uaacaacccacaccgucuuccu

SEQ ID NO: 1246762 - RNA, 13 nt, Homo sapiens
uaacaagauuugu

SEQ ID NO: 1246763 - RNA, 19 nt, Homo sapiens
uaacaagguucuucuaaaa

SEQ ID NO: 1246764 - RNA, 20 nt, Homo sapiens
uaacaaguagcacccuggau

SEQ ID NO: 1246765 - RNA, 21 nt, Homo sapiens
uaacaauaacuacuguguucc

SEQ ID NO: 1246766 - RNA, 17 nt, Homo sapiens
uaacaaucacaaaggaa

SEQ ID NO: 1246767 - RNA, 11 nt, Homo sapiens
uaacaaugaag

SEQ ID NO: 1246768 - RNA, 19 nt, Homo sapiens
uaacacaaguccugugaau

SEQ ID NO: 1246769 - RNA, 21 nt, Homo sapiens
uaacacccuuuagaaccuuaa

SEQ ID NO: 1246770 - RNA, 16 nt, Homo sapiens
uaacacuuuguauuac

SEQ ID NO: 1246771 - RNA, 22 nt, Homo sapiens
uaacagaaagccugggugacau

SEQ ID NO: 1246772 - RNA, 19 nt, Homo sapiens
uaacagaacagcuucaggu

SEQ ID NO: 1246773 - RNA, 22 nt, Homo sapiens
uaacagacugaaaugugcucag

SEQ ID NO: 1246774 - RNA, 22 nt, Homo sapiens
uaacagauggaaaaacugaggc

SEQ ID NO: 1246775 - RNA, 13 nt, Homo sapiens
uaacagauuugcu

SEQ ID NO: 1246776 - RNA, 17 nt, Homo sapiens
uaacagcauuaacuguc

SEQ ID NO: 1246777 - RNA, 16 nt, Homo sapiens
uaacaggaaaauuuua

SEQ ID NO: 1246778 - RNA, 18 nt, Homo sapiens
uaacaggauauuuaauga

SEQ ID NO: 1246779 - RNA, 16 nt, Homo sapiens
uaacaggcagauacag

SEQ ID NO: 1246780 - RNA, 16 nt, Homo sapiens
uaacaggugccuuccc

SEQ ID NO: 1246781 - RNA, 15 nt, Homo sapiens
uaacagucauuuaaa

SEQ ID NO: 1246782 - RNA, 14 nt, Homo sapiens
uaacagugcauauu

SEQ ID NO: 1246783 - RNA, 18 nt, Homo sapiens
uaacaguugugaugacua

SEQ ID NO: 1246784 - RNA, 17 nt, Homo sapiens
uaacaguuuuccaugaa

SEQ ID NO: 1246785 - RNA, 21 nt, Homo sapiens
uaacaucacuauccaugcacc

SEQ ID NO: 1246786 - RNA, 22 nt, Homo sapiens
uaacaucuaaaaauagacuuaa

SEQ ID NO: 1246787 - RNA, 21 nt, Homo sapiens
uaacauguaauuaaguacuau

SEQ ID NO: 1246788 - RNA, 20 nt, Homo sapiens
uaacaugucuuucagcauua

SEQ ID NO: 1246789 - RNA, 13 nt, Homo sapiens
uaacauguuauca

SEQ ID NO: 1246790 - RNA, 22 nt, Homo sapiens
uaacauuaccuuacuguggagg

SEQ ID NO: 1246791 - RNA, 19 nt, Homo sapiens
uaaccacaaagcacaguuu

SEQ ID NO: 1246792 - RNA, 12 nt, Homo sapiens
uaaccacauuaa

SEQ ID NO: 1246793 - RNA, 14 nt, Homo sapiens
uaaccauuugcacu

SEQ ID NO: 1246794 - RNA, 14 nt, Homo sapiens
uaacccaaaccuca

SEQ ID NO: 1246795 - RNA, 16 nt, Homo sapiens
uaaccccauucuuugc

SEQ ID NO: 1246796 - RNA, 20 nt, Homo sapiens
uaacccgcucaucacuggau

SEQ ID NO: 1246797 - RNA, 16 nt, Homo sapiens
uaaccgcacaugcaca

SEQ ID NO: 1246798 - RNA, 17 nt, Homo sapiens
uaaccgcacaugcacac

SEQ ID NO: 1246799 - RNA, 12 nt, Homo sapiens
uacacacuuuau

SEQ ID NO: 1246800 - RNA, 16 nt, Homo sapiens
uacacagaugaaggug

SEQ ID NO: 1246801 - RNA, 21 nt, Homo sapiens
uacacaggacugaaaagggaa

SEQ ID NO: 1246802 - RNA, 16 nt, Homo sapiens
uacacauagcauguaa

SEQ ID NO: 1246803 - RNA, 17 nt, Homo sapiens
uacacauuagauuuuau

SEQ ID NO: 1246804 - RNA, 14 nt, Homo sapiens
uacaccaaugccca

SEQ ID NO: 1246805 - RNA, 20 nt, Homo sapiens
uacaccaguuugacugugcu

SEQ ID NO: 1246806 - RNA, 17 nt, Homo sapiens
uacacccaguugccaaa

SEQ ID NO: 1246807 - RNA, 18 nt, Homo sapiens
uacacccaguugccaaag

SEQ ID NO: 1246808 - RNA, 18 nt, Homo sapiens
uacaccucaaauaccacc

SEQ ID NO: 1246809 - RNA, 15 nt, Homo sapiens
uacacgaacugaaau

SEQ ID NO: 1246810 - RNA, 16 nt, Homo sapiens
uacacggagugugcua

SEQ ID NO: 1246811 - RNA, 21 nt, Homo sapiens
uacacuaaaaccacaugugca

SEQ ID NO: 1246812 - RNA, 15 nt, Homo sapiens
uacacuaacauuucc

SEQ ID NO: 1246813 - RNA, 23 nt, Homo sapiens
uacacuaagcgaauguguacaaa

SEQ ID NO: 1246814 - RNA, 18 nt, Homo sapiens
uacacugaaaaugucaca

SEQ ID NO: 1246815 - RNA, 17 nt, Homo sapiens
uacacugaggagagauu

SEQ ID NO: 1246816 - RNA, 16 nt, Homo sapiens
uacacugccuguauac

SEQ ID NO: 1246817 - RNA, 18 nt, Homo sapiens
uacacugcuguacccaga

SEQ ID NO: 1246818 - RNA, 21 nt, Homo sapiens
uacacuuggagcccgugcagu

SEQ ID NO: 1246819 - RNA, 21 nt, Homo sapiens
uacacuuuugagacuuuuugg

SEQ ID NO: 1246820 - RNA, 12 nt, Homo sapiens
uacagaaacuga

SEQ ID NO: 1246821 - RNA, 16 nt, Homo sapiens
uacagacaaccuauca

SEQ ID NO: 1246822 - RNA, 13 nt, Homo sapiens
uacagacauacau

SEQ ID NO: 1246823 - RNA, 13 nt, Homo sapiens
uacagacaucuaa

SEQ ID NO: 1246824 - RNA, 18 nt, Homo sapiens
uacagaccaccuuucaca

SEQ ID NO: 1246825 - RNA, 13 nt, Homo sapiens
uacagagaagauu

SEQ ID NO: 1246826 - RNA, 20 nt, Homo sapiens
uacagagauuacuuugcugc

SEQ ID NO: 1246827 - RNA, 14 nt, Homo sapiens
uacagaggucucug

SEQ ID NO: 1246828 - RNA, 13 nt, Homo sapiens
uacagauacauau

SEQ ID NO: 1246829 - RNA, 20 nt, Homo sapiens
uacagauacauaucugugua

SEQ ID NO: 1246830 - RNA, 21 nt, Homo sapiens
uacagauagaaaauaugauau

SEQ ID NO: 1246831 - RNA, 15 nt, Homo sapiens
uacagauagauauau

SEQ ID NO: 1246832 - RNA, 20 nt, Homo sapiens
uacagauagauauaugcucu

SEQ ID NO: 1246833 - RNA, 17 nt, Homo sapiens
uacagauauuugucaug

SEQ ID NO: 1246834 - RNA, 14 nt, Homo sapiens
uacagcacuacucu

SEQ ID NO: 1246835 - RNA, 16 nt, Homo sapiens
uacagcacuacucugu

SEQ ID NO: 1246836 - RNA, 13 nt, Homo sapiens
uacagcacuuuga

SEQ ID NO: 1246837 - RNA, 20 nt, Homo sapiens
uacagccagcagcacaguca

SEQ ID NO: 1246838 - RNA, 22 nt, Homo sapiens
uacagcuaaucagcauucucac

SEQ ID NO: 1246839 - RNA, 13 nt, Homo sapiens
uacagcucucccc

SEQ ID NO: 1246840 - RNA, 17 nt, Homo sapiens
uacaggaagcaccccau

SEQ ID NO: 1246841 - RNA, 20 nt, Homo sapiens
uacaggcgugauccaccaca

SEQ ID NO: 1246842 - RNA, 21 nt, Homo sapiens
uacagggagccuccugcccag

SEQ ID NO: 1246843 - RNA, 14 nt, Homo sapiens
uacaggugugaguc

SEQ ID NO: 1246844 - RNA, 18 nt, Homo sapiens
uacaggugugugccacca

SEQ ID NO: 1246845 - RNA, 15 nt, Homo sapiens
uacaguacacagaua

SEQ ID NO: 1246846 - RNA, 21 nt, Homo sapiens
uacagucuaaaauugcuucuu

SEQ ID NO: 1246847 - RNA, 19 nt, Homo sapiens
uacagucucuuucuuccuu

SEQ ID NO: 1246848 - RNA, 18 nt, Homo sapiens
uacagugagcucuagcaa

SEQ ID NO: 1246849 - RNA, 12 nt, Homo sapiens
uacaguguuauu

SEQ ID NO: 1246850 - RNA, 13 nt, Homo sapiens
uacauaaacugac

SEQ ID NO: 1246851 - RNA, 19 nt, Homo sapiens
uacauaaacugucacucua

SEQ ID NO: 1246852 - RNA, 22 nt, Homo sapiens
uacauaacuaaauuugauacuu

SEQ ID NO: 1246853 - RNA, 13 nt, Homo sapiens
uacauaaguaauu

SEQ ID NO: 1246854 - RNA, 20 nt, Homo sapiens
uacauaccaccaccaagaaa

SEQ ID NO: 1246855 - RNA, 20 nt, Homo sapiens
uacauacuuuaucaaugugu

SEQ ID NO: 1246856 - RNA, 15 nt, Homo sapiens
uacauaguuguauau

SEQ ID NO: 1246857 - RNA, 19 nt, Homo sapiens
uacauauaucucugugucu

SEQ ID NO: 1246858 - RNA, 22 nt, Homo sapiens
uacauauguagacuauauacau

SEQ ID NO: 1246859 - RNA, 15 nt, Homo sapiens
uacauauuacuguug

SEQ ID NO: 1246860 - RNA, 14 nt, Homo sapiens
uacauauuaucuca

SEQ ID NO: 1246861 - RNA, 16 nt, Homo sapiens
uacauauuaucucauu

SEQ ID NO: 1246862 - RNA, 17 nt, Homo sapiens
uacauauuuguggaaua

SEQ ID NO: 1246863 - RNA, 19 nt, Homo sapiens
uacaucaaugguguguuaa

SEQ ID NO: 1246864 - RNA, 19 nt, Homo sapiens
uacaucacugcuugaugaa

SEQ ID NO: 1246865 - RNA, 13 nt, Homo sapiens
uacaucaucucca

SEQ ID NO: 1246866 - RNA, 17 nt, Homo sapiens
uacaucucccagacucu

SEQ ID NO: 1246867 - RNA, 15 nt, Homo sapiens
uacaucugcaauaug

SEQ ID NO: 1246868 - RNA, 11 nt, Homo sapiens
uacaucuggcc

SEQ ID NO: 1246869 - RNA, 16 nt, Homo sapiens
uacaugagauaacuca

SEQ ID NO: 1246870 - RNA, 20 nt, Homo sapiens
uacaugaugcccugcugacc

SEQ ID NO: 1246871 - RNA, 14 nt, Homo sapiens
uacaugcaauuuau

SEQ ID NO: 1246872 - RNA, 19 nt, Homo sapiens
uacaugcugugcucuuuga

SEQ ID NO: 1246873 - RNA, 18 nt, Homo sapiens
uacauggaaaggauuuug

SEQ ID NO: 1246874 - RNA, 14 nt, Homo sapiens
uacauguauugcac

SEQ ID NO: 1246875 - RNA, 14 nt, Homo sapiens
uacaugucuuccau

SEQ ID NO: 1246876 - RNA, 18 nt, Homo sapiens
uacaugugagugacgaug

SEQ ID NO: 1246877 - RNA, 11 nt, Homo sapiens
uacaugugauu

SEQ ID NO: 1246878 - RNA, 20 nt, Homo sapiens
uacauuaaaauaaaccaaau

SEQ ID NO: 1246879 - RNA, 21 nt, Homo sapiens
uacauuaaaauaaaccaaaua

SEQ ID NO: 1246880 - RNA, 13 nt, Homo sapiens
uacauuaucucac

SEQ ID NO: 1246881 - RNA, 20 nt, Homo sapiens
uacauucugcaagcacaucu

SEQ ID NO: 1246882 - RNA, 20 nt, Homo sapiens
uacauucuuuaucuugacau

SEQ ID NO: 1246883 - RNA, 14 nt, Homo sapiens
uacauuguaaauag

SEQ ID NO: 1246884 - RNA, 15 nt, Homo sapiens
uacauugugcugcac

SEQ ID NO: 1246885 - RNA, 22 nt, Homo sapiens
uacauuguucuuauucuggcau

SEQ ID NO: 1246886 - RNA, 15 nt, Homo sapiens
uacauuuaauacagc

SEQ ID NO: 1246887 - RNA, 18 nt, Homo sapiens
uacauuuagcuuguucac

SEQ ID NO: 1246888 - RNA, 17 nt, Homo sapiens
uacauuuaugcacauuc

SEQ ID NO: 1246889 - RNA, 18 nt, Homo sapiens
uacauuucaccuacuuug

SEQ ID NO: 1246890 - RNA, 22 nt, Homo sapiens
uacauuugaugcaugucuuuua

SEQ ID NO: 1246891 - RNA, 16 nt, Homo sapiens
uacauuugugcuccau

SEQ ID NO: 1246892 - RNA, 14 nt, Homo sapiens
uaccaaagcaucaa

SEQ ID NO: 1246893 - RNA, 18 nt, Homo sapiens
uaccaaaucugacauauu

SEQ ID NO: 1246894 - RNA, 17 nt, Homo sapiens
uaccaacaucuggucuu

SEQ ID NO: 1246895 - RNA, 20 nt, Homo sapiens
uaccaagaacugaaggcaua

SEQ ID NO: 1246896 - RNA, 14 nt, Homo sapiens
uaccaaguauuuau

SEQ ID NO: 1246897 - RNA, 16 nt, Homo sapiens
uaccaauauuuacuca

SEQ ID NO: 1246898 - RNA, 19 nt, Homo sapiens
uaccaauuaauauuacuca

SEQ ID NO: 1246899 - RNA, 13 nt, Homo sapiens
uaccacagcaucc

SEQ ID NO: 1246900 - RNA, 18 nt, Homo sapiens
uaccacagugucuguauc

SEQ ID NO: 1246901 - RNA, 16 nt, Homo sapiens
uaccacgaggaaaaga

SEQ ID NO: 1246902 - RNA, 14 nt, Homo sapiens
uaccacucacauga

SEQ ID NO: 1246903 - RNA, 15 nt, Homo sapiens
uaccacucagagaaa

SEQ ID NO: 1246904 - RNA, 17 nt, Homo sapiens
uaccagaaggagaugcu

SEQ ID NO: 1246905 - RNA, 19 nt, Homo sapiens
uaccaggggcugggcuccc

SEQ ID NO: 1246906 - RNA, 17 nt, Homo sapiens
uaccaguauaagcaucu

SEQ ID NO: 1246907 - RNA, 21 nt, Homo sapiens
uaccaguugcccuagcccaga

SEQ ID NO: 1246908 - RNA, 13 nt, Homo sapiens
uaccaucagggac

SEQ ID NO: 1246909 - RNA, 14 nt, Homo sapiens
uaccauggcacuga

SEQ ID NO: 1246910 - RNA, 13 nt, Homo sapiens
uaccauguggcaa

SEQ ID NO: 1246911 - RNA, 14 nt, Homo sapiens
uaccauuuccucag

SEQ ID NO: 1246912 - RNA, 13 nt, Homo sapiens
uacccaaacguga

SEQ ID NO: 1246913 - RNA, 21 nt, Homo sapiens
uacccacauguacagacauac

SEQ ID NO: 1246914 - RNA, 19 nt, Homo sapiens
uacccaccuagaacacuaa

SEQ ID NO: 1246915 - RNA, 12 nt, Homo sapiens
uacccacugaag

SEQ ID NO: 1246916 - RNA, 12 nt, Homo sapiens
uacccacuucca

SEQ ID NO: 1246917 - RNA, 19 nt, Homo sapiens
uacccaggaccaagccaca

SEQ ID NO: 1246918 - RNA, 22 nt, Homo sapiens
uacccauauaucuuauguuaaa

SEQ ID NO: 1246919 - RNA, 16 nt, Homo sapiens
uaccccacugggccag

SEQ ID NO: 1246920 - RNA, 16 nt, Homo sapiens
uaccccccuaccacac

SEQ ID NO: 1246921 - RNA, 18 nt, Homo sapiens
uaccccggcugcuuggca

SEQ ID NO: 1246922 - RNA, 15 nt, Homo sapiens
uaccccugcucccau

SEQ ID NO: 1246923 - RNA, 18 nt, Homo sapiens
uaccccugguaaaccaag

SEQ ID NO: 1246924 - RNA, 14 nt, Homo sapiens
uacccuauacaucc

SEQ ID NO: 1246925 - RNA, 23 nt, Homo sapiens
uacccuccuguaaaugguguaca

SEQ ID NO: 1246926 - RNA, 17 nt, Homo sapiens
uagccaugauuuguccc

SEQ ID NO: 1246927 - RNA, 23 nt, Homo sapiens
uagcccucccccucaaccucacc

SEQ ID NO: 1246928 - RNA, 22 nt, Homo sapiens
uagccgacugcgcugcuuuuuc

SEQ ID NO: 1246929 - RNA, 20 nt, Homo sapiens
uagccuaauacaacauguag

SEQ ID NO: 1246930 - RNA, 18 nt, Homo sapiens
uagccuauuuaccugcag

SEQ ID NO: 1246931 - RNA, 15 nt, Homo sapiens
uagccucaccaaggu

SEQ ID NO: 1246932 - RNA, 17 nt, Homo sapiens
uagccucgcucuuggca

SEQ ID NO: 1246933 - RNA, 16 nt, Homo sapiens
uagccucuccaggaau

SEQ ID NO: 1246934 - RNA, 13 nt, Homo sapiens
uagccugggacca

SEQ ID NO: 1246935 - RNA, 17 nt, Homo sapiens
uagccuuagaagucaca

SEQ ID NO: 1246936 - RNA, 18 nt, Homo sapiens
uagccuuagaagucacac

SEQ ID NO: 1246937 - RNA, 17 nt, Homo sapiens
uagccuuugucauuuua

SEQ ID NO: 1246938 - RNA, 16 nt, Homo sapiens
uagcgaagaccaguau

SEQ ID NO: 1246939 - RNA, 14 nt, Homo sapiens
uagcggagcccagc

SEQ ID NO: 1246940 - RNA, 22 nt, Homo sapiens
uagcguucccaacaacauccau

SEQ ID NO: 1246941 - RNA, 17 nt, Homo sapiens
uagcuacaucaguuuga

SEQ ID NO: 1246942 - RNA, 15 nt, Homo sapiens
uagcuauauccaugu

SEQ ID NO: 1246943 - RNA, 17 nt, Homo sapiens
uagcuauauccauguac

SEQ ID NO: 1246944 - RNA, 23 nt, Homo sapiens
uagcuauauccauguacuguagu

SEQ ID NO: 1246945 - RNA, 11 nt, Homo sapiens
uagcucaggug

SEQ ID NO: 1246946 - RNA, 14 nt, Homo sapiens
uagcucauccuuua

SEQ ID NO: 1246947 - RNA, 17 nt, Homo sapiens
uagcucuggugaccuug

SEQ ID NO: 1246948 - RNA, 14 nt, Homo sapiens
uagcucuuuggucu

SEQ ID NO: 1246949 - RNA, 19 nt, Homo sapiens
uagcugaguuuaacaugug

SEQ ID NO: 1246950 - RNA, 19 nt, Homo sapiens
uagcugccuaucagaauuu

SEQ ID NO: 1246951 - RNA, 17 nt, Homo sapiens
uagcugggacuacaggc

SEQ ID NO: 1246952 - RNA, 18 nt, Homo sapiens
uagcugggacuacaggug

SEQ ID NO: 1246953 - RNA, 22 nt, Homo sapiens
uagcuguaaaacgcugucaaaa

SEQ ID NO: 1246954 - RNA, 15 nt, Homo sapiens
uagcugucugcucag

SEQ ID NO: 1246955 - RNA, 17 nt, Homo sapiens
uagcuuagcaucagagg

SEQ ID NO: 1246956 - RNA, 18 nt, Homo sapiens
uagcuuagcaucagaggu

SEQ ID NO: 1246957 - RNA, 21 nt, Homo sapiens
uagcuuagcuaugucagccaa

SEQ ID NO: 1246958 - RNA, 18 nt, Homo sapiens
uagcuuauuauugaagga

SEQ ID NO: 1246959 - RNA, 17 nt, Homo sapiens
uagcuuguuccacugca

SEQ ID NO: 1246960 - RNA, 16 nt, Homo sapiens
uagcuuuagggcaaua

SEQ ID NO: 1246961 - RNA, 14 nt, Homo sapiens
uaggaaaaaaacug

SEQ ID NO: 1246962 - RNA, 18 nt, Homo sapiens
uaggaaaaaaauaguaaa

SEQ ID NO: 1246963 - RNA, 21 nt, Homo sapiens
uaggaaaaauaaaacuucaca

SEQ ID NO: 1246964 - RNA, 17 nt, Homo sapiens
uaggaaaaguacauuua

SEQ ID NO: 1246965 - RNA, 19 nt, Homo sapiens
uaggaaaucuagaaguagu

SEQ ID NO: 1246966 - RNA, 15 nt, Homo sapiens
uaggaaauucugaug

SEQ ID NO: 1246967 - RNA, 23 nt, Homo sapiens
uaggaacaaucuuugcuguauac

SEQ ID NO: 1246968 - RNA, 16 nt, Homo sapiens
uaggaagagaaaccag

SEQ ID NO: 1246969 - RNA, 13 nt, Homo sapiens
uaggaauaugacc

SEQ ID NO: 1246970 - RNA, 20 nt, Homo sapiens
uaggagaaacuuagaggaaa

SEQ ID NO: 1246971 - RNA, 15 nt, Homo sapiens
uaggagacuaaugga

SEQ ID NO: 1246972 - RNA, 19 nt, Homo sapiens
uaggagcaacuucucugau

SEQ ID NO: 1246973 - RNA, 22 nt, Homo sapiens
uaggagcuuccagcucuaauaa

SEQ ID NO: 1246974 - RNA, 16 nt, Homo sapiens
uaggagguuauuucaa

SEQ ID NO: 1246975 - RNA, 17 nt, Homo sapiens
uaggauaguugaugcau

SEQ ID NO: 1246976 - RNA, 15 nt, Homo sapiens
uaggauaucuuggcu

SEQ ID NO: 1246977 - RNA, 19 nt, Homo sapiens
uaggaugaaucauauucau

SEQ ID NO: 1246978 - RNA, 15 nt, Homo sapiens
uaggauguugcucag

SEQ ID NO: 1246979 - RNA, 17 nt, Homo sapiens
uaggcauguagcuacag

SEQ ID NO: 1246980 - RNA, 16 nt, Homo sapiens
uaggcauuaacacaaa

SEQ ID NO: 1246981 - RNA, 21 nt, Homo sapiens
uaggccacaugcgguggcuca

SEQ ID NO: 1246982 - RNA, 16 nt, Homo sapiens
uaggccaucucagcuu

SEQ ID NO: 1246983 - RNA, 20 nt, Homo sapiens
uaggccccguggugacauuu

SEQ ID NO: 1246984 - RNA, 14 nt, Homo sapiens
uaggccuaccugau

SEQ ID NO: 1246985 - RNA, 22 nt, Homo sapiens
uaggcuccugccaguguggaac

SEQ ID NO: 1246986 - RNA, 12 nt, Homo sapiens
uaggcucugcac

SEQ ID NO: 1246987 - RNA, 12 nt, Homo sapiens
uaggcuuaucaa

SEQ ID NO: 1246988 - RNA, 14 nt, Homo sapiens
uagggaacugggga

SEQ ID NO: 1246989 - RNA, 22 nt, Homo sapiens
uagggacaugaaauuuacaaag

SEQ ID NO: 1246990 - RNA, 21 nt, Homo sapiens
uagggcaccagggacagagcu

SEQ ID NO: 1246991 - RNA, 18 nt, Homo sapiens
uaggggaacagaccagug

SEQ ID NO: 1246992 - RNA, 15 nt, Homo sapiens
uaggguccugaaugu

SEQ ID NO: 1246993 - RNA, 22 nt, Homo sapiens
uaggguuacagagaccuaugua

SEQ ID NO: 1246994 - RNA, 12 nt, Homo sapiens
uagguagccuug

SEQ ID NO: 1246995 - RNA, 14 nt, Homo sapiens
uagguaucauucaa

SEQ ID NO: 1246996 - RNA, 13 nt, Homo sapiens
uaggucggcacuu

SEQ ID NO: 1246997 - RNA, 16 nt, Homo sapiens
uaggucuccucagggu

SEQ ID NO: 1246998 - RNA, 17 nt, Homo sapiens
uaggucuccucagggug

SEQ ID NO: 1246999 - RNA, 19 nt, Homo sapiens
uaggucuuucucucaguga

SEQ ID NO: 1247000 - RNA, 15 nt, Homo sapiens
uagguggcugagcau

SEQ ID NO: 1247001 - RNA, 16 nt, Homo sapiens
uagguguguccacaga

SEQ ID NO: 1247002 - RNA, 22 nt, Homo sapiens
uagguuaguagcccuucagucu

SEQ ID NO: 1247003 - RNA, 21 nt, Homo sapiens
uagguucuaaaguucuaagau

SEQ ID NO: 1247004 - RNA, 14 nt, Homo sapiens
uagguugugcaaau

SEQ ID NO: 1247005 - RNA, 13 nt, Homo sapiens
uaguaaauccaug

SEQ ID NO: 1247006 - RNA, 13 nt, Homo sapiens
uaguaaaucuccc

SEQ ID NO: 1247007 - RNA, 14 nt, Homo sapiens
uaguaacaauacau

SEQ ID NO: 1247008 - RNA, 15 nt, Homo sapiens
uaguacugaagccaa

SEQ ID NO: 1247009 - RNA, 16 nt, Homo sapiens
uaguagagcauaccac

SEQ ID NO: 1247010 - RNA, 14 nt, Homo sapiens
uaguagaugcaucu

SEQ ID NO: 1247011 - RNA, 15 nt, Homo sapiens
uaguauaauugaccu

SEQ ID NO: 1247012 - RNA, 13 nt, Homo sapiens
uaguauuuaugaa

SEQ ID NO: 1247013 - RNA, 20 nt, Homo sapiens
uagucaaggaggaaagggau

SEQ ID NO: 1247014 - RNA, 16 nt, Homo sapiens
uagucaauccaagacu

SEQ ID NO: 1247015 - RNA, 15 nt, Homo sapiens
uagucaauguaaaaa

SEQ ID NO: 1247016 - RNA, 17 nt, Homo sapiens
uagucaauuucuacuuc

SEQ ID NO: 1247017 - RNA, 20 nt, Homo sapiens
uagucaauuucuacuucugg

SEQ ID NO: 1247018 - RNA, 21 nt, Homo sapiens
uagucacauggccuaugcaca

SEQ ID NO: 1247019 - RNA, 23 nt, Homo sapiens
uagucaccccaaguagucugcuc

SEQ ID NO: 1247020 - RNA, 18 nt, Homo sapiens
uagucacucauccauccc

SEQ ID NO: 1247021 - RNA, 18 nt, Homo sapiens
uagucaggaauggcugca

SEQ ID NO: 1247022 - RNA, 13 nt, Homo sapiens
uagucaugugacc

SEQ ID NO: 1247023 - RNA, 14 nt, Homo sapiens
uagucauuuacuaa

SEQ ID NO: 1247024 - RNA, 16 nt, Homo sapiens
uaguccaaagacuuaa

SEQ ID NO: 1247025 - RNA, 15 nt, Homo sapiens
uagucccagcuacuu

SEQ ID NO: 1247026 - RNA, 23 nt, Homo sapiens
uaguccccguacuagguuggaca

SEQ ID NO: 1247027 - RNA, 21 nt, Homo sapiens
uagucccgauaggguauuuga

SEQ ID NO: 1247028 - RNA, 19 nt, Homo sapiens
uaguccgcuuucucuugcu

SEQ ID NO: 1247029 - RNA, 15 nt, Homo sapiens
uaguccuguacugua

SEQ ID NO: 1247030 - RNA, 14 nt, Homo sapiens
uagucgguucugua

SEQ ID NO: 1247031 - RNA, 15 nt, Homo sapiens
uagucucuccccugg

SEQ ID NO: 1247032 - RNA, 22 nt, Homo sapiens
uagucuuggaagcuguuuggaa

SEQ ID NO: 1247033 - RNA, 15 nt, Homo sapiens
uagugaaaugccaca

SEQ ID NO: 1247034 - RNA, 15 nt, Homo sapiens
uagugaacauaugga

SEQ ID NO: 1247035 - RNA, 17 nt, Homo sapiens
uagugaauacugcuaca

SEQ ID NO: 1247036 - RNA, 20 nt, Homo sapiens
uagugaccaaauucagccua

SEQ ID NO: 1247037 - RNA, 14 nt, Homo sapiens
uagugacuaugaac

SEQ ID NO: 1247038 - RNA, 21 nt, Homo sapiens
uagugacuugugucccaugau

SEQ ID NO: 1247039 - RNA, 14 nt, Homo sapiens
uagugaucauuuaa

SEQ ID NO: 1247040 - RNA, 17 nt, Homo sapiens
uagugcauuucaaggaa

SEQ ID NO: 1247041 - RNA, 14 nt, Homo sapiens
uagugccacccacc

SEQ ID NO: 1247042 - RNA, 21 nt, Homo sapiens
uagugccacccaccuuugcca

SEQ ID NO: 1247043 - RNA, 23 nt, Homo sapiens
uagugcugaugccuguguacugc

SEQ ID NO: 1247044 - RNA, 15 nt, Homo sapiens
uagugguacucugaa

SEQ ID NO: 1247045 - RNA, 19 nt, Homo sapiens
uagugguguuuuaaagaga

SEQ ID NO: 1247046 - RNA, 18 nt, Homo sapiens
uaguguccaaauucucac

SEQ ID NO: 1247047 - RNA, 16 nt, Homo sapiens
uaguuaccuacugagu

SEQ ID NO: 1247048 - RNA, 17 nt, Homo sapiens
uaguucaauacagugaa

SEQ ID NO: 1247049 - RNA, 16 nt, Homo sapiens
uaguucuaucaggaaa

SEQ ID NO: 1247050 - RNA, 19 nt, Homo sapiens
uaguugcaugaaauuuugc

SEQ ID NO: 1247051 - RNA, 21 nt, Homo sapiens
uaguugcaugaaauuuugccu

SEQ ID NO: 1247052 - RNA, 20 nt, Homo sapiens
ucguaucccgagucugggac

SEQ ID NO: 1247053 - RNA, 13 nt, Homo sapiens
ucguccugggacu

SEQ ID NO: 1247054 - RNA, 14 nt, Homo sapiens
ucgucugggcuccc

SEQ ID NO: 1247055 - RNA, 18 nt, Homo sapiens
ucgugaaaccccaucucu

SEQ ID NO: 1247056 - RNA, 19 nt, Homo sapiens
ucgugaaaccccaucucua

SEQ ID NO: 1247057 - RNA, 13 nt, Homo sapiens
ucgugaaacccug

SEQ ID NO: 1247058 - RNA, 15 nt, Homo sapiens
ucgugcuaaacgcac

SEQ ID NO: 1247059 - RNA, 18 nt, Homo sapiens
ucgugggccgcacugggg

SEQ ID NO: 1247060 - RNA, 16 nt, Homo sapiens
ucguuuugaugccauu

SEQ ID NO: 1247061 - RNA, 23 nt, Homo sapiens
ucguuuuucagcacccccaccca

SEQ ID NO: 1247062 - RNA, 13 nt, Homo sapiens
ucuaaaacauucc

SEQ ID NO: 1247063 - RNA, 12 nt, Homo sapiens
ucuaaaacugcc

SEQ ID NO: 1247064 - RNA, 22 nt, Homo sapiens
ucuaaaagcguuggauguagca

SEQ ID NO: 1247065 - RNA, 21 nt, Homo sapiens
ucuaaacaagaaucagucuau

SEQ ID NO: 1247066 - RNA, 22 nt, Homo sapiens
ucuaaacuacaacgaacacaag

SEQ ID NO: 1247067 - RNA, 18 nt, Homo sapiens
ucuaaagauggaguuucu

SEQ ID NO: 1247068 - RNA, 14 nt, Homo sapiens
ucuaaaggcuugau

SEQ ID NO: 1247069 - RNA, 20 nt, Homo sapiens
ucuaaagguggugaggcaau

SEQ ID NO: 1247070 - RNA, 20 nt, Homo sapiens
ucuaaaguugcuccauacaa

SEQ ID NO: 1247071 - RNA, 17 nt, Homo sapiens
ucuaaauacaugccaca

SEQ ID NO: 1247072 - RNA, 22 nt, Homo sapiens
ucuaaauuuugucuuuaacuca

SEQ ID NO: 1247073 - RNA, 12 nt, Homo sapiens
ucuaacagauca

SEQ ID NO: 1247074 - RNA, 18 nt, Homo sapiens
ucuaacagcccuccucug

SEQ ID NO: 1247075 - RNA, 23 nt, Homo sapiens
ucuaacuauauguacagcucucc

SEQ ID NO: 1247076 - RNA, 19 nt, Homo sapiens
ucuaagaaguuuuguucug

SEQ ID NO: 1247077 - RNA, 21 nt, Homo sapiens
ucuaagacucaaauguucuaa

SEQ ID NO: 1247078 - RNA, 20 nt, Homo sapiens
ucuaagauaagaguugagau

SEQ ID NO: 1247079 - RNA, 20 nt, Homo sapiens
ucuaagaucuuagauucucu

SEQ ID NO: 1247080 - RNA, 14 nt, Homo sapiens
ucuaagauucugau

SEQ ID NO: 1247081 - RNA, 19 nt, Homo sapiens
ucuaagguaguaacuuucc

SEQ ID NO: 1247082 - RNA, 20 nt, Homo sapiens
ucuaaguggaaaaaguauua

SEQ ID NO: 1247083 - RNA, 19 nt, Homo sapiens
ucuaauaaauauacuauga

SEQ ID NO: 1247084 - RNA, 16 nt, Homo sapiens
ucuaauaauaagucag

SEQ ID NO: 1247085 - RNA, 17 nt, Homo sapiens
ucuaauaugauuauaca

SEQ ID NO: 1247086 - RNA, 13 nt, Homo sapiens
ucuaauccuaucu

SEQ ID NO: 1247087 - RNA, 18 nt, Homo sapiens
ucuaaugagacugaccau

SEQ ID NO: 1247088 - RNA, 13 nt, Homo sapiens
ucuaauguacaau

SEQ ID NO: 1247089 - RNA, 21 nt, Homo sapiens
ucuaauguacaauaaagcaau

SEQ ID NO: 1247090 - RNA, 19 nt, Homo sapiens
ucuaaugugaaaaucauca

SEQ ID NO: 1247091 - RNA, 20 nt, Homo sapiens
ucuaauuaauuguaaucuga

SEQ ID NO: 1247092 - RNA, 22 nt, Homo sapiens
ucuaauucuauuaaagugcuaa

SEQ ID NO: 1247093 - RNA, 21 nt, Homo sapiens
ucuacaaacucccacuuguca

SEQ ID NO: 1247094 - RNA, 14 nt, Homo sapiens
ucuacaaaggccau

SEQ ID NO: 1247095 - RNA, 21 nt, Homo sapiens
ucuacaguuaggguugaguua

SEQ ID NO: 1247096 - RNA, 15 nt, Homo sapiens
ucuacauacauuauu

SEQ ID NO: 1247097 - RNA, 18 nt, Homo sapiens
ucuacauuucacauuauu

SEQ ID NO: 1247098 - RNA, 15 nt, Homo sapiens
ucuacauuugagggc

SEQ ID NO: 1247099 - RNA, 18 nt, Homo sapiens
ucuaccaugaacagaaaa

SEQ ID NO: 1247100 - RNA, 19 nt, Homo sapiens
ucuacccugcugaccuccc

SEQ ID NO: 1247101 - RNA, 19 nt, Homo sapiens
ucuaccugccucagccucc

SEQ ID NO: 1247102 - RNA, 14 nt, Homo sapiens
ucuaccugcuggac

SEQ ID NO: 1247103 - RNA, 18 nt, Homo sapiens
ucuacuucauagcuccuu

SEQ ID NO: 1247104 - RNA, 15 nt, Homo sapiens
ucuacuuuccaggcu

SEQ ID NO: 1247105 - RNA, 21 nt, Homo sapiens
ucuacuuuccaggcuaguccg

SEQ ID NO: 1247106 - RNA, 22 nt, Homo sapiens
ucuagaacacaggcaaaauccu

SEQ ID NO: 1247107 - RNA, 15 nt, Homo sapiens
ucuagaagacuguca

SEQ ID NO: 1247108 - RNA, 12 nt, Homo sapiens
ucuagaagccaa

SEQ ID NO: 1247109 - RNA, 19 nt, Homo sapiens
ucuagacuauuaggugcaa

SEQ ID NO: 1247110 - RNA, 16 nt, Homo sapiens
ucuagacuugugcuga

SEQ ID NO: 1247111 - RNA, 20 nt, Homo sapiens
ucuagagcuuaaugcuacau

SEQ ID NO: 1247112 - RNA, 16 nt, Homo sapiens
ucuagagucacugaua

SEQ ID NO: 1247113 - RNA, 12 nt, Homo sapiens
ucuagauucaaa

SEQ ID NO: 1247114 - RNA, 15 nt, Homo sapiens
ucuagcaccaggacu

SEQ ID NO: 1247115 - RNA, 20 nt, Homo sapiens
ucuagccuauuuaccugcag

SEQ ID NO: 1247116 - RNA, 18 nt, Homo sapiens
ucuaggcuaccagaagag

SEQ ID NO: 1247117 - RNA, 15 nt, Homo sapiens
ucuagguuauacaau

SEQ ID NO: 1247118 - RNA, 22 nt, Homo sapiens
ucuaguccuauucuauugcagu

SEQ ID NO: 1247119 - RNA, 21 nt, Homo sapiens
ucuagucuccuuugcacugag

SEQ ID NO: 1247120 - RNA, 17 nt, Homo sapiens
ucuagugcaguaaaggg

SEQ ID NO: 1247121 - RNA, 20 nt, Homo sapiens
ucuagugucuuuugccuuua

SEQ ID NO: 1247122 - RNA, 19 nt, Homo sapiens
ucuaguugccaaaucuggc

SEQ ID NO: 1247123 - RNA, 20 nt, Homo sapiens
ucuauaaagaagaacuugca

SEQ ID NO: 1247124 - RNA, 23 nt, Homo sapiens
ucuauaccaaccaaaccaauuca

SEQ ID NO: 1247125 - RNA, 15 nt, Homo sapiens
ucuauagaacaucca

SEQ ID NO: 1247126 - RNA, 16 nt, Homo sapiens
ucuauaggaacauaug

SEQ ID NO: 1247127 - RNA, 12 nt, Homo sapiens
ucuauaucauga

SEQ ID NO: 1247128 - RNA, 13 nt, Homo sapiens
ucuauauucucau

SEQ ID NO: 1247129 - RNA, 19 nt, Homo sapiens
ucuauccaaagaacuugau

SEQ ID NO: 1247130 - RNA, 12 nt, Homo sapiens
ucuaucucucaa

SEQ ID NO: 1247131 - RNA, 19 nt, Homo sapiens
ucuaugaucuggacuuccu

SEQ ID NO: 1247132 - RNA, 11 nt, Homo sapiens
ucuauguuaau

SEQ ID NO: 1247133 - RNA, 23 nt, Homo sapiens
ucuauuaaauaguuauauaauuc

SEQ ID NO: 1247134 - RNA, 14 nt, Homo sapiens
ucuauuaaucaccu

SEQ ID NO: 1247135 - RNA, 15 nt, Homo sapiens
ucuauucaagcacuu

SEQ ID NO: 1247136 - RNA, 14 nt, Homo sapiens
ucuauucagcauug

SEQ ID NO: 1247137 - RNA, 13 nt, Homo sapiens
ucuauucuaagua

SEQ ID NO: 1247138 - RNA, 19 nt, Homo sapiens
ucuauuggccaacaauccu

SEQ ID NO: 1247139 - RNA, 16 nt, Homo sapiens
ucuauuuaaauaaagu

SEQ ID NO: 1247140 - RNA, 19 nt, Homo sapiens
ucuauuuuauuaugagcuu

SEQ ID NO: 1247141 - RNA, 13 nt, Homo sapiens
ucuauuuugugaa

SEQ ID NO: 1247142 - RNA, 18 nt, Homo sapiens
ucuauuuuucaaucauca

SEQ ID NO: 1247143 - RNA, 22 nt, Homo sapiens
ucucaaaaaaaaaaaaaugcac

SEQ ID NO: 1247144 - RNA, 13 nt, Homo sapiens
ucucaaaauggaa

SEQ ID NO: 1247145 - RNA, 14 nt, Homo sapiens
ucucaaacuccuga

SEQ ID NO: 1247146 - RNA, 20 nt, Homo sapiens
ucucaaacucuugaccucag

SEQ ID NO: 1247147 - RNA, 12 nt, Homo sapiens
ucucaaacuuca

SEQ ID NO: 1247148 - RNA, 19 nt, Homo sapiens
ucucaaaggcccucaguga

SEQ ID NO: 1247149 - RNA, 14 nt, Homo sapiens
ucucaaaugcacau

SEQ ID NO: 1247150 - RNA, 16 nt, Homo sapiens
ucucaaaugcacaucu

SEQ ID NO: 1247151 - RNA, 21 nt, Homo sapiens
ucucaagauggggcgagccag

SEQ ID NO: 1247152 - RNA, 14 nt, Homo sapiens
ucucaauuugcagu

SEQ ID NO: 1247153 - RNA, 13 nt, Homo sapiens
ucucacacacaua

SEQ ID NO: 1247154 - RNA, 18 nt, Homo sapiens
ucucacaguguugcccag

SEQ ID NO: 1247155 - RNA, 20 nt, Homo sapiens
ucucacccucaucacuagga

SEQ ID NO: 1247156 - RNA, 22 nt, Homo sapiens
ucucacucucccuggagcugcu

SEQ ID NO: 1247157 - RNA, 18 nt, Homo sapiens
ucucacuguugcccaggc

SEQ ID NO: 1247158 - RNA, 20 nt, Homo sapiens
ucucacuuuuuacccagaac

SEQ ID NO: 1247159 - RNA, 19 nt, Homo sapiens
ucucagacugcauguacca

SEQ ID NO: 1247160 - RNA, 13 nt, Homo sapiens
ucucagagcaugu

SEQ ID NO: 1247161 - RNA, 17 nt, Homo sapiens
ucucagagcauguguca

SEQ ID NO: 1247162 - RNA, 21 nt, Homo sapiens
ucucagagcccucaacuauuc

SEQ ID NO: 1247163 - RNA, 23 nt, Homo sapiens
ucucagauguugaaacuuugaau

SEQ ID NO: 1247164 - RNA, 14 nt, Homo sapiens
ucucagcaagagaa

SEQ ID NO: 1247165 - RNA, 16 nt, Homo sapiens
ucucagcaggcaaaga

SEQ ID NO: 1247166 - RNA, 14 nt, Homo sapiens
ucucagcccagaag

SEQ ID NO: 1247167 - RNA, 16 nt, Homo sapiens
ucucagccuaccauga

SEQ ID NO: 1247168 - RNA, 13 nt, Homo sapiens
ucucagcugacca

SEQ ID NO: 1247169 - RNA, 14 nt, Homo sapiens
ucucagcuuugaga

SEQ ID NO: 1247170 - RNA, 14 nt, Homo sapiens
ucucagggugcaga

SEQ ID NO: 1247171 - RNA, 16 nt, Homo sapiens
ucucagguguugccaa

SEQ ID NO: 1247172 - RNA, 15 nt, Homo sapiens
ucucauauacccuau

SEQ ID NO: 1247173 - RNA, 15 nt, Homo sapiens
ucucaucacagaagu

SEQ ID NO: 1247174 - RNA, 14 nt, Homo sapiens
ucucaucaguccau

SEQ ID NO: 1247175 - RNA, 22 nt, Homo sapiens
ucucauccuccaguaccuugcu

SEQ ID NO: 1247176 - RNA, 19 nt, Homo sapiens
ucucaucuuacauuucuca

SEQ ID NO: 1247177 - RNA, 17 nt, Homo sapiens
ucucaugauaccaccuu

SEQ ID NO: 1247178 - RNA, 17 nt, Homo sapiens
ugaaaaaauagauccaa

SEQ ID NO: 1247179 - RNA, 18 nt, Homo sapiens
ugaaaaaucuaagugaua

SEQ ID NO: 1247180 - RNA, 14 nt, Homo sapiens
ugaaaaauguauau

SEQ ID NO: 1247181 - RNA, 22 nt, Homo sapiens
ugaaaaauucucagucaguaau

SEQ ID NO: 1247182 - RNA, 18 nt, Homo sapiens
ugaaaacaaguuccaaau

SEQ ID NO: 1247183 - RNA, 16 nt, Homo sapiens
ugaaaacacacauaca

SEQ ID NO: 1247184 - RNA, 14 nt, Homo sapiens
ugaaaacacacuca

SEQ ID NO: 1247185 - RNA, 20 nt, Homo sapiens
ugaaaacacacucaaaagac

SEQ ID NO: 1247186 - RNA, 18 nt, Homo sapiens
ugaaaacauagcaucuca

SEQ ID NO: 1247187 - RNA, 21 nt, Homo sapiens
ugaaaacuuagagagguacaa

SEQ ID NO: 1247188 - RNA, 21 nt, Homo sapiens
ugaaaagcugcauuuaaauca

SEQ ID NO: 1247189 - RNA, 15 nt, Homo sapiens
ugaaaagcuucuuaa

SEQ ID NO: 1247190 - RNA, 15 nt, Homo sapiens
ugaaaaguaucagga

SEQ ID NO: 1247191 - RNA, 16 nt, Homo sapiens
ugaaaauaauguugua

SEQ ID NO: 1247192 - RNA, 19 nt, Homo sapiens
ugaaaauauuuuguugccu

SEQ ID NO: 1247193 - RNA, 13 nt, Homo sapiens
ugaaaaucuccau

SEQ ID NO: 1247194 - RNA, 20 nt, Homo sapiens
ugaaaaugaagaaggaagcu

SEQ ID NO: 1247195 - RNA, 14 nt, Homo sapiens
ugaaaaugaaucuu

SEQ ID NO: 1247196 - RNA, 12 nt, Homo sapiens
ugaaaaugcaaa

SEQ ID NO: 1247197 - RNA, 18 nt, Homo sapiens
ugaaaauguaagcuguuu

SEQ ID NO: 1247198 - RNA, 20 nt, Homo sapiens
ugaaaauugggcaugccauu

SEQ ID NO: 1247199 - RNA, 15 nt, Homo sapiens
ugaaaauuguagggu

SEQ ID NO: 1247200 - RNA, 19 nt, Homo sapiens
ugaaaauuuuuacauucau

SEQ ID NO: 1247201 - RNA, 12 nt, Homo sapiens
ugaaacaaacau

SEQ ID NO: 1247202 - RNA, 17 nt, Homo sapiens
ugaaacaauguugucca

SEQ ID NO: 1247203 - RNA, 18 nt, Homo sapiens
ugaaacacgaaacuuguu

SEQ ID NO: 1247204 - RNA, 15 nt, Homo sapiens
ugaaacacuuugccu

SEQ ID NO: 1247205 - RNA, 16 nt, Homo sapiens
ugaaacauggcugugu

SEQ ID NO: 1247206 - RNA, 12 nt, Homo sapiens
ugaaaccaaaac

SEQ ID NO: 1247207 - RNA, 17 nt, Homo sapiens
ugaaaccaggacauuaa

SEQ ID NO: 1247208 - RNA, 15 nt, Homo sapiens
ugaaaccaugacugu

SEQ ID NO: 1247209 - RNA, 22 nt, Homo sapiens
ugaaacccuauggagaauuuau

SEQ ID NO: 1247210 - RNA, 14 nt, Homo sapiens
ugaaacuaacagau

SEQ ID NO: 1247211 - RNA, 23 nt, Homo sapiens
ugaaacuaacagauaagcaagag

SEQ ID NO: 1247212 - RNA, 14 nt, Homo sapiens
ugaaacuccaucuc

SEQ ID NO: 1247213 - RNA, 11 nt, Homo sapiens
ugaaacuggag

SEQ ID NO: 1247214 - RNA, 12 nt, Homo sapiens
ugaaacuggagu

SEQ ID NO: 1247215 - RNA, 18 nt, Homo sapiens
ugaaacuggcacugaauu

SEQ ID NO: 1247216 - RNA, 18 nt, Homo sapiens
ugaaacuguccaccaaga

SEQ ID NO: 1247217 - RNA, 19 nt, Homo sapiens
ugaaacuucauaaauguuc

SEQ ID NO: 1247218 - RNA, 23 nt, Homo sapiens
ugaaagaaaaauaccaugucucu

SEQ ID NO: 1247219 - RNA, 15 nt, Homo sapiens
ugaaagaagcaagac

SEQ ID NO: 1247220 - RNA, 11 nt, Homo sapiens
ugaaagaucuu

SEQ ID NO: 1247221 - RNA, 13 nt, Homo sapiens
ugaaagaugcagu

SEQ ID NO: 1247222 - RNA, 14 nt, Homo sapiens
ugaaagccacaaug

SEQ ID NO: 1247223 - RNA, 17 nt, Homo sapiens
ugaaagcucuguugcaa

SEQ ID NO: 1247224 - RNA, 20 nt, Homo sapiens
ugaaagcugauuacugucaa

SEQ ID NO: 1247225 - RNA, 18 nt, Homo sapiens
ugaaaggaucucugagac

SEQ ID NO: 1247226 - RNA, 20 nt, Homo sapiens
ugaaaggggggaaccaguga

SEQ ID NO: 1247227 - RNA, 16 nt, Homo sapiens
ugaaaguggacaagga

SEQ ID NO: 1247228 - RNA, 17 nt, Homo sapiens
ugaaaguggacaaggag

SEQ ID NO: 1247229 - RNA, 21 nt, Homo sapiens
ugaaauaaaacuacaugguca

SEQ ID NO: 1247230 - RNA, 15 nt, Homo sapiens
ugaaauaaacacugg

SEQ ID NO: 1247231 - RNA, 12 nt, Homo sapiens
ugaaauaagaaa

SEQ ID NO: 1247232 - RNA, 12 nt, Homo sapiens
ugaaauaccuca

SEQ ID NO: 1247233 - RNA, 13 nt, Homo sapiens
ugaaauaccucau

SEQ ID NO: 1247234 - RNA, 15 nt, Homo sapiens
ugaaaucucagaauu

SEQ ID NO: 1247235 - RNA, 12 nt, Homo sapiens
ugaaaugaccuc

SEQ ID NO: 1247236 - RNA, 20 nt, Homo sapiens
ugaaaugagcaccuccauua

SEQ ID NO: 1247237 - RNA, 19 nt, Homo sapiens
ugaaaugcuggcauuugca

SEQ ID NO: 1247238 - RNA, 23 nt, Homo sapiens
ugaaaugggauuguuuuuuacuc

SEQ ID NO: 1247239 - RNA, 17 nt, Homo sapiens
ugaaauucacaguaaua

SEQ ID NO: 1247240 - RNA, 15 nt, Homo sapiens
ugaaauucucaucag

SEQ ID NO: 1247241 - RNA, 19 nt, Homo sapiens
ugaaauugcauacuuugua

SEQ ID NO: 1247242 - RNA, 15 nt, Homo sapiens
ugaaauuuauucaca

SEQ ID NO: 1247243 - RNA, 15 nt, Homo sapiens
ugaaauuuggcaaag

SEQ ID NO: 1247244 - RNA, 20 nt, Homo sapiens
ugaaauuuuagaaauauuca

SEQ ID NO: 1247245 - RNA, 21 nt, Homo sapiens
ugaaauuuucuagacuuucug

SEQ ID NO: 1247246 - RNA, 23 nt, Homo sapiens
ugaaauuuugccugcaacagaga

SEQ ID NO: 1247247 - RNA, 22 nt, Homo sapiens
ugaacaaaaauugagacauuua

SEQ ID NO: 1247248 - RNA, 12 nt, Homo sapiens
ugaacaaacaau

SEQ ID NO: 1247249 - RNA, 14 nt, Homo sapiens
ugaacaacuccaaa

SEQ ID NO: 1247250 - RNA, 18 nt, Homo sapiens
ugaacaacuguugggaua

SEQ ID NO: 1247251 - RNA, 12 nt, Homo sapiens
ugaacaagagcu

SEQ ID NO: 1247252 - RNA, 21 nt, Homo sapiens
ugaacacucuuuugcuuuauu

SEQ ID NO: 1247253 - RNA, 19 nt, Homo sapiens
ugaacacuggcuaaagaua

SEQ ID NO: 1247254 - RNA, 15 nt, Homo sapiens
ugaacagaaaugcau

SEQ ID NO: 1247255 - RNA, 14 nt, Homo sapiens
ugaacaucccuuau

SEQ ID NO: 1247256 - RNA, 20 nt, Homo sapiens
ugaacaugcaguucauuauu

SEQ ID NO: 1247257 - RNA, 18 nt, Homo sapiens
ugaacauguuuacagguu

SEQ ID NO: 1247258 - RNA, 13 nt, Homo sapiens
ugaaccacaucuu

SEQ ID NO: 1247259 - RNA, 20 nt, Homo sapiens
ugaaccauucacagugcaag

SEQ ID NO: 1247260 - RNA, 18 nt, Homo sapiens
ugaaccgcacagcucagg

SEQ ID NO: 1247261 - RNA, 20 nt, Homo sapiens
ugaaccugaggaugcaucuu

SEQ ID NO: 1247262 - RNA, 16 nt, Homo sapiens
ugaaccuucugcaaca

SEQ ID NO: 1247263 - RNA, 19 nt, Homo sapiens
ugaacgcagaagaaagggu

SEQ ID NO: 1247264 - RNA, 14 nt, Homo sapiens
ugaacuaacugaca

SEQ ID NO: 1247265 - RNA, 18 nt, Homo sapiens
ugaacuacagacuaaaga

SEQ ID NO: 1247266 - RNA, 17 nt, Homo sapiens
ugaacuaccaucugaug

SEQ ID NO: 1247267 - RNA, 17 nt, Homo sapiens
ugaacuaggcugagcaa

SEQ ID NO: 1247268 - RNA, 21 nt, Homo sapiens
ugaacuauuucuacacagugg

SEQ ID NO: 1247269 - RNA, 17 nt, Homo sapiens
ugaacugaaguuucaca

SEQ ID NO: 1247270 - RNA, 22 nt, Homo sapiens
ugaacuggauucuuaaccaaga

SEQ ID NO: 1247271 - RNA, 22 nt, Homo sapiens
ugaacuggguacuuguggacac

SEQ ID NO: 1247272 - RNA, 13 nt, Homo sapiens
ugaacugugcaua

SEQ ID NO: 1247273 - RNA, 14 nt, Homo sapiens
ugaacugugcauag

SEQ ID NO: 1247274 - RNA, 17 nt, Homo sapiens
ugaagaaaaaaucagaa

SEQ ID NO: 1247275 - RNA, 23 nt, Homo sapiens
ugaagaaaauagucaguguucuu

SEQ ID NO: 1247276 - RNA, 15 nt, Homo sapiens
ugaagacuagaaaau

SEQ ID NO: 1247277 - RNA, 20 nt, Homo sapiens
ugaagacugggugaggauaa

SEQ ID NO: 1247278 - RNA, 18 nt, Homo sapiens
ugaagagcgauugugagg

SEQ ID NO: 1247279 - RNA, 23 nt, Homo sapiens
ugaagaguauccuuccuucaggg

SEQ ID NO: 1247280 - RNA, 18 nt, Homo sapiens
ugaagauauuacuacuua

SEQ ID NO: 1247281 - RNA, 20 nt, Homo sapiens
ugaagaucugguuccagaac

SEQ ID NO: 1247282 - RNA, 13 nt, Homo sapiens
ugaagaugaucau

SEQ ID NO: 1247283 - RNA, 19 nt, Homo sapiens
ugaagauucuccugugcua

SEQ ID NO: 1247284 - RNA, 20 nt, Homo sapiens
ugaagauucuccugugcuag

SEQ ID NO: 1247285 - RNA, 19 nt, Homo sapiens
ugaagauuuaugaugcacu

SEQ ID NO: 1247286 - RNA, 15 nt, Homo sapiens
ugaagcagucuugcu

SEQ ID NO: 1247287 - RNA, 23 nt, Homo sapiens
ugaagcauaccccggccucucag

SEQ ID NO: 1247288 - RNA, 18 nt, Homo sapiens
ugaagccauagccuccac

SEQ ID NO: 1247289 - RNA, 17 nt, Homo sapiens
ugaagcccacccagaaa

SEQ ID NO: 1247290 - RNA, 20 nt, Homo sapiens
ugaagcuucacucacuguca

SEQ ID NO: 1247291 - RNA, 12 nt, Homo sapiens
ugaagcuuuaua

SEQ ID NO: 1247292 - RNA, 16 nt, Homo sapiens
ugaaggaaaaacacaa

SEQ ID NO: 1247293 - RNA, 14 nt, Homo sapiens
ugaaggauaagaga

SEQ ID NO: 1247294 - RNA, 22 nt, Homo sapiens
ugaaggaugcggcaggugcucu

SEQ ID NO: 1247295 - RNA, 18 nt, Homo sapiens
ugaaggcagcagaauauu

SEQ ID NO: 1247296 - RNA, 20 nt, Homo sapiens
ugaaggcaguggcaggggag

SEQ ID NO: 1247297 - RNA, 20 nt, Homo sapiens
ugaaggcauccccaggcccu

SEQ ID NO: 1247298 - RNA, 23 nt, Homo sapiens
ugaaggcugucaggauucuucaa

SEQ ID NO: 1247299 - RNA, 15 nt, Homo sapiens
ugaaggggaggucac

SEQ ID NO: 1247300 - RNA, 16 nt, Homo sapiens
ugaaguaggugugacu

SEQ ID NO: 1247301 - RNA, 14 nt, Homo sapiens
ugaaguauugcuaa

SEQ ID NO: 1247302 - RNA, 16 nt, Homo sapiens
ugaagucacacaguga

SEQ ID NO: 1247303 - RNA, 20 nt, Homo sapiens
ugaagucaugaccuccaggg

SEQ ID NO: 1247304 - RNA, 15 nt, Homo sapiens
ugauuaagcuuuugu

SEQ ID NO: 1247305 - RNA, 14 nt, Homo sapiens
ugauuaauguuucu

SEQ ID NO: 1247306 - RNA, 15 nt, Homo sapiens
ugauuaccugccaau

SEQ ID NO: 1247307 - RNA, 21 nt, Homo sapiens
ugauuagaaggcaaguuucua

SEQ ID NO: 1247308 - RNA, 23 nt, Homo sapiens
ugauuaggaauaugaccauuuga

SEQ ID NO: 1247309 - RNA, 13 nt, Homo sapiens
ugauucacugcau

SEQ ID NO: 1247310 - RNA, 17 nt, Homo sapiens
ugauucauuuucugccu

SEQ ID NO: 1247311 - RNA, 12 nt, Homo sapiens
ugauucuugccu

SEQ ID NO: 1247312 - RNA, 20 nt, Homo sapiens
ugauugaaucugauuggaca

SEQ ID NO: 1247313 - RNA, 19 nt, Homo sapiens
ugauugaggagcugcacug

SEQ ID NO: 1247314 - RNA, 14 nt, Homo sapiens
ugauugcacuugau

SEQ ID NO: 1247315 - RNA, 13 nt, Homo sapiens
ugauugcugccau

SEQ ID NO: 1247316 - RNA, 19 nt, Homo sapiens
ugauuggacauuuucuuca

SEQ ID NO: 1247317 - RNA, 21 nt, Homo sapiens
ugauuggacauuuucuucaga

SEQ ID NO: 1247318 - RNA, 20 nt, Homo sapiens
ugauugggaaaacauuugcu

SEQ ID NO: 1247319 - RNA, 17 nt, Homo sapiens
ugauugucagcuacuaa

SEQ ID NO: 1247320 - RNA, 13 nt, Homo sapiens
ugauuuacauuuc

SEQ ID NO: 1247321 - RNA, 16 nt, Homo sapiens
ugauuuggugaccaac

SEQ ID NO: 1247322 - RNA, 14 nt, Homo sapiens
ugauuuugugauau

SEQ ID NO: 1247323 - RNA, 22 nt, Homo sapiens
ugauuuuuugcauuccugacaa

SEQ ID NO: 1247324 - RNA, 14 nt, Homo sapiens
ugauuuuuuuccac

SEQ ID NO: 1247325 - RNA, 17 nt, Homo sapiens
ugcaaaacacuaaagau

SEQ ID NO: 1247326 - RNA, 21 nt, Homo sapiens
ugcaaaagaagugaaacuaua

SEQ ID NO: 1247327 - RNA, 23 nt, Homo sapiens
ugcaaaauauuugacuauucugu

SEQ ID NO: 1247328 - RNA, 13 nt, Homo sapiens
ugcaaaauuucca

SEQ ID NO: 1247329 - RNA, 17 nt, Homo sapiens
ugcaaagcugaagacca

SEQ ID NO: 1247330 - RNA, 20 nt, Homo sapiens
ugcaaaguucccuacuuccu

SEQ ID NO: 1247331 - RNA, 17 nt, Homo sapiens
ugcaaauauaucugcua

SEQ ID NO: 1247332 - RNA, 15 nt, Homo sapiens
ugcaaaugccuccaa

SEQ ID NO: 1247333 - RNA, 16 nt, Homo sapiens
ugcaaauuaaaacaua

SEQ ID NO: 1247334 - RNA, 15 nt, Homo sapiens
ugcaacacauucauu

SEQ ID NO: 1247335 - RNA, 16 nt, Homo sapiens
ugcaacuucaugucaa

SEQ ID NO: 1247336 - RNA, 19 nt, Homo sapiens
ugcaacuuuuaauuacugu

SEQ ID NO: 1247337 - RNA, 19 nt, Homo sapiens
ugcaagaaaaaaacuuacu

SEQ ID NO: 1247338 - RNA, 19 nt, Homo sapiens
ugcaagcacaucugcauuu

SEQ ID NO: 1247339 - RNA, 14 nt, Homo sapiens
ugcaagccaucucu

SEQ ID NO: 1247340 - RNA, 15 nt, Homo sapiens
ugcaagccaucucua

SEQ ID NO: 1247341 - RNA, 19 nt, Homo sapiens
ugcaagccaucucuaauaa

SEQ ID NO: 1247342 - RNA, 21 nt, Homo sapiens
ugcaagccugucugagacuca

SEQ ID NO: 1247343 - RNA, 22 nt, Homo sapiens
ugcaagcgaaauuaaaucugaa

SEQ ID NO: 1247344 - RNA, 18 nt, Homo sapiens
ugcaagcgacgacagaug

SEQ ID NO: 1247345 - RNA, 17 nt, Homo sapiens
ugcaagcuggaugccug

SEQ ID NO: 1247346 - RNA, 16 nt, Homo sapiens
ugcaaggauuacagaa

SEQ ID NO: 1247347 - RNA, 22 nt, Homo sapiens
ugcaaggauucagcauuauucc

SEQ ID NO: 1247348 - RNA, 18 nt, Homo sapiens
ugcaaggcccacaggagg

SEQ ID NO: 1247349 - RNA, 16 nt, Homo sapiens
ugcaaguauacuaggg

SEQ ID NO: 1247350 - RNA, 18 nt, Homo sapiens
ugcaauaaaauaguagca

SEQ ID NO: 1247351 - RNA, 16 nt, Homo sapiens
ugcaauagagacugua

SEQ ID NO: 1247352 - RNA, 16 nt, Homo sapiens
ugcaauccucccuacc

SEQ ID NO: 1247353 - RNA, 23 nt, Homo sapiens
ugcaaucuguguucgauggcuca

SEQ ID NO: 1247354 - RNA, 22 nt, Homo sapiens
ugcaaugccaguccugcaggag

SEQ ID NO: 1247355 - RNA, 13 nt, Homo sapiens
ugcaauggcucaa

SEQ ID NO: 1247356 - RNA, 16 nt, Homo sapiens
ugcaauguaagcauac

SEQ ID NO: 1247357 - RNA, 13 nt, Homo sapiens
ugcaaugucacaa

SEQ ID NO: 1247358 - RNA, 13 nt, Homo sapiens
ugcaaugucugag

SEQ ID NO: 1247359 - RNA, 17 nt, Homo sapiens
ugcaauucaucccagag

SEQ ID NO: 1247360 - RNA, 22 nt, Homo sapiens
ugcaauuuuauuaaaugcauca

SEQ ID NO: 1247361 - RNA, 19 nt, Homo sapiens
ugcaauuuucuaagcaauu

SEQ ID NO: 1247362 - RNA, 16 nt, Homo sapiens
ugcacaaagcccuucc

SEQ ID NO: 1247363 - RNA, 21 nt, Homo sapiens
ugcacaaauugggccaaagaa

SEQ ID NO: 1247364 - RNA, 23 nt, Homo sapiens
ugcacaagaauggaucacaagau

SEQ ID NO: 1247365 - RNA, 20 nt, Homo sapiens
ugcacacacacacacaugca

SEQ ID NO: 1247366 - RNA, 13 nt, Homo sapiens
ugcacacaccaga

SEQ ID NO: 1247367 - RNA, 16 nt, Homo sapiens
ugcacacucacuugua

SEQ ID NO: 1247368 - RNA, 21 nt, Homo sapiens
ugcacacucacuuguaagaaa

SEQ ID NO: 1247369 - RNA, 13 nt, Homo sapiens
ugcacacugccug

SEQ ID NO: 1247370 - RNA, 15 nt, Homo sapiens
ugcacagagcuggag

SEQ ID NO: 1247371 - RNA, 22 nt, Homo sapiens
ugcacagaucugcuugaucaau

SEQ ID NO: 1247372 - RNA, 18 nt, Homo sapiens
ugcacagggggaggccau

SEQ ID NO: 1247373 - RNA, 19 nt, Homo sapiens
ugcacaggguccucagcuc

SEQ ID NO: 1247374 - RNA, 19 nt, Homo sapiens
ugcacaggucccacugccc

SEQ ID NO: 1247375 - RNA, 16 nt, Homo sapiens
ugcacaguagagcaaa

SEQ ID NO: 1247376 - RNA, 17 nt, Homo sapiens
ugcacagugugugacuu

SEQ ID NO: 1247377 - RNA, 15 nt, Homo sapiens
ugcacaucacaacau

SEQ ID NO: 1247378 - RNA, 13 nt, Homo sapiens
ugcaccaaagaca

SEQ ID NO: 1247379 - RNA, 14 nt, Homo sapiens
ugcaccaccaagcc

SEQ ID NO: 1247380 - RNA, 13 nt, Homo sapiens
ugcaccacugcac

SEQ ID NO: 1247381 - RNA, 14 nt, Homo sapiens
ugcaccagagcaac

SEQ ID NO: 1247382 - RNA, 17 nt, Homo sapiens
ugcaccaggagacagac

SEQ ID NO: 1247383 - RNA, 15 nt, Homo sapiens
ugcaccaggcacugc

SEQ ID NO: 1247384 - RNA, 18 nt, Homo sapiens
ugcaccaggcacugcugc

SEQ ID NO: 1247385 - RNA, 18 nt, Homo sapiens
ugcacccagcagugucac

SEQ ID NO: 1247386 - RNA, 20 nt, Homo sapiens
ugcaccccaaagcuuuccug

SEQ ID NO: 1247387 - RNA, 19 nt, Homo sapiens
ugcaccuacugcuuacugu

SEQ ID NO: 1247388 - RNA, 15 nt, Homo sapiens
ugcaccugugcauuu

SEQ ID NO: 1247389 - RNA, 17 nt, Homo sapiens
ugcacguggccucuuga

SEQ ID NO: 1247390 - RNA, 23 nt, Homo sapiens
ugcacuaaaucagagacaaaaua

SEQ ID NO: 1247391 - RNA, 14 nt, Homo sapiens
ugcacuccagccug

SEQ ID NO: 1247392 - RNA, 22 nt, Homo sapiens
ugcacucuaaaagguucaggga

SEQ ID NO: 1247393 - RNA, 16 nt, Homo sapiens
ugcacugaucacccaa

SEQ ID NO: 1247394 - RNA, 16 nt, Homo sapiens
ugcacugucacuuugc

SEQ ID NO: 1247395 - RNA, 23 nt, Homo sapiens
ugcacugucugagaauuuccaaa

SEQ ID NO: 1247396 - RNA, 15 nt, Homo sapiens
ugcacuuauucaaua

SEQ ID NO: 1247397 - RNA, 23 nt, Homo sapiens
ugcacuuguggcaacagauaagu

SEQ ID NO: 1247398 - RNA, 17 nt, Homo sapiens
ugcacuuuuaaaccucu

SEQ ID NO: 1247399 - RNA, 15 nt, Homo sapiens
ugcagaacugccauu

SEQ ID NO: 1247400 - RNA, 16 nt, Homo sapiens
ugcagaagaaaucaua

SEQ ID NO: 1247401 - RNA, 15 nt, Homo sapiens
ugcagaaugacucca

SEQ ID NO: 1247402 - RNA, 21 nt, Homo sapiens
ugcagacagaagucuccucaa

SEQ ID NO: 1247403 - RNA, 17 nt, Homo sapiens
ugcagacgggcaagaag

SEQ ID NO: 1247404 - RNA, 20 nt, Homo sapiens
ugcagacucuacagaggcca

SEQ ID NO: 1247405 - RNA, 12 nt, Homo sapiens
ugcagacuuccc

SEQ ID NO: 1247406 - RNA, 17 nt, Homo sapiens
ugcagagcccauagcca

SEQ ID NO: 1247407 - RNA, 20 nt, Homo sapiens
ugcagaggauaaggaggcac

SEQ ID NO: 1247408 - RNA, 16 nt, Homo sapiens
ugcagaguccauuucc

SEQ ID NO: 1247409 - RNA, 18 nt, Homo sapiens
ugcagcaaggggacaucu

SEQ ID NO: 1247410 - RNA, 14 nt, Homo sapiens
ugcagcaccuccag

SEQ ID NO: 1247411 - RNA, 22 nt, Homo sapiens
ugcagcagugagucucuucaga

SEQ ID NO: 1247412 - RNA, 22 nt, Homo sapiens
ugcagccacuggcuuggaacac

SEQ ID NO: 1247413 - RNA, 16 nt, Homo sapiens
ugcagccucaaccucc

SEQ ID NO: 1247414 - RNA, 13 nt, Homo sapiens
ugcagccuccaca

SEQ ID NO: 1247415 - RNA, 17 nt, Homo sapiens
ugcagcuguaaacauau

SEQ ID NO: 1247416 - RNA, 23 nt, Homo sapiens
ugcaggaagugucuagaggaaua

SEQ ID NO: 1247417 - RNA, 18 nt, Homo sapiens
ugcaggagagucggggga

SEQ ID NO: 1247418 - RNA, 21 nt, Homo sapiens
ugcagggagcucaagcccuug

SEQ ID NO: 1247419 - RNA, 12 nt, Homo sapiens
ugcagggccauc

SEQ ID NO: 1247420 - RNA, 16 nt, Homo sapiens
ugcagggcucaggggg

SEQ ID NO: 1247421 - RNA, 19 nt, Homo sapiens
ugcaggggggcaguaacuc

SEQ ID NO: 1247422 - RNA, 22 nt, Homo sapiens
ugcaggggguggacaaacugga

SEQ ID NO: 1247423 - RNA, 21 nt, Homo sapiens
ugcagggggugugucugcuca

SEQ ID NO: 1247424 - RNA, 16 nt, Homo sapiens
ugcagggguccacugu

SEQ ID NO: 1247425 - RNA, 13 nt, Homo sapiens
ugcaggggucccc

SEQ ID NO: 1247426 - RNA, 16 nt, Homo sapiens
ugcagguugcauaggu

SEQ ID NO: 1247427 - RNA, 22 nt, Homo sapiens
ugcagguuuucuucacugccag

SEQ ID NO: 1247428 - RNA, 22 nt, Homo sapiens
ugcaguaaauuaucuugggaua

SEQ ID NO: 1247429 - RNA, 21 nt, Homo sapiens
ugcaguaggggcuacugugac

SEQ ID NO: 1247430 - RNA, 15 nt, Homo sapiens
uggacaggagucagu

SEQ ID NO: 1247431 - RNA, 23 nt, Homo sapiens
uggacagucacugccacuuugca

SEQ ID NO: 1247432 - RNA, 18 nt, Homo sapiens
uggacagucucaccuccu

SEQ ID NO: 1247433 - RNA, 22 nt, Homo sapiens
uggacagugggcaucagcagca

SEQ ID NO: 1247434 - RNA, 20 nt, Homo sapiens
uggacaguucacacccugca

SEQ ID NO: 1247435 - RNA, 14 nt, Homo sapiens
uggacauggcucac

SEQ ID NO: 1247436 - RNA, 19 nt, Homo sapiens
uggaccaaggugaagcaaa

SEQ ID NO: 1247437 - RNA, 22 nt, Homo sapiens
uggaccaggaagcccugaaucc

SEQ ID NO: 1247438 - RNA, 17 nt, Homo sapiens
uggacccccagcuuugc

SEQ ID NO: 1247439 - RNA, 19 nt, Homo sapiens
uggaccuauguccuaagga

SEQ ID NO: 1247440 - RNA, 11 nt, Homo sapiens
uggaccugcau

SEQ ID NO: 1247441 - RNA, 15 nt, Homo sapiens
uggaccuguucaaaa

SEQ ID NO: 1247442 - RNA, 14 nt, Homo sapiens
uggacuaugcugau

SEQ ID NO: 1247443 - RNA, 22 nt, Homo sapiens
uggacuccaucucucauccucc

SEQ ID NO: 1247444 - RNA, 14 nt, Homo sapiens
uggacucuaaagac

SEQ ID NO: 1247445 - RNA, 18 nt, Homo sapiens
uggacucuaaagaccaaa

SEQ ID NO: 1247446 - RNA, 22 nt, Homo sapiens
uggacucucauguggccaagca

SEQ ID NO: 1247447 - RNA, 14 nt, Homo sapiens
uggacucugcacau

SEQ ID NO: 1247448 - RNA, 15 nt, Homo sapiens
uggacucugcacaug

SEQ ID NO: 1247449 - RNA, 13 nt, Homo sapiens
uggacucuuccac

SEQ ID NO: 1247450 - RNA, 22 nt, Homo sapiens
uggacuuccagugcucagaggg

SEQ ID NO: 1247451 - RNA, 13 nt, Homo sapiens
uggacuucucuga

SEQ ID NO: 1247452 - RNA, 21 nt, Homo sapiens
uggacuugauagcaaacacug

SEQ ID NO: 1247453 - RNA, 16 nt, Homo sapiens
uggagaaagagcugcc

SEQ ID NO: 1247454 - RNA, 16 nt, Homo sapiens
uggagaaagcacugac

SEQ ID NO: 1247455 - RNA, 21 nt, Homo sapiens
uggagacagagagacuggcca

SEQ ID NO: 1247456 - RNA, 23 nt, Homo sapiens
uggagacccugcaaacagaacag

SEQ ID NO: 1247457 - RNA, 16 nt, Homo sapiens
uggagaccuccaggcu

SEQ ID NO: 1247458 - RNA, 12 nt, Homo sapiens
uggagacugaca

SEQ ID NO: 1247459 - RNA, 17 nt, Homo sapiens
uggagacugacaaccuc

SEQ ID NO: 1247460 - RNA, 19 nt, Homo sapiens
uggagacugacaaccucau

SEQ ID NO: 1247461 - RNA, 15 nt, Homo sapiens
uggagagaagcugau

SEQ ID NO: 1247462 - RNA, 15 nt, Homo sapiens
uggagagaagggcau

SEQ ID NO: 1247463 - RNA, 14 nt, Homo sapiens
uggagaggaacaca

SEQ ID NO: 1247464 - RNA, 18 nt, Homo sapiens
uggagaggaggggaccca

SEQ ID NO: 1247465 - RNA, 21 nt, Homo sapiens
uggagagugagcuacagagcc

SEQ ID NO: 1247466 - RNA, 17 nt, Homo sapiens
uggagaguggaaggacu

SEQ ID NO: 1247467 - RNA, 17 nt, Homo sapiens
uggagcccacaaccuuc

SEQ ID NO: 1247468 - RNA, 17 nt, Homo sapiens
uggagccccaggggaca

SEQ ID NO: 1247469 - RNA, 15 nt, Homo sapiens
uggagcccgugcagu

SEQ ID NO: 1247470 - RNA, 22 nt, Homo sapiens
uggagcccuaaccccuuccaga

SEQ ID NO: 1247471 - RNA, 19 nt, Homo sapiens
uggagccuacauuccuuga

SEQ ID NO: 1247472 - RNA, 18 nt, Homo sapiens
uggagcuggcacugugga

SEQ ID NO: 1247473 - RNA, 19 nt, Homo sapiens
uggaggaucaaagaacuga

SEQ ID NO: 1247474 - RNA, 17 nt, Homo sapiens
uggaggccugugccuug

SEQ ID NO: 1247475 - RNA, 20 nt, Homo sapiens
uggaggcuccaggacuccac

SEQ ID NO: 1247476 - RNA, 23 nt, Homo sapiens
uggagggagaagcugucagggac

SEQ ID NO: 1247477 - RNA, 15 nt, Homo sapiens
uggagggauaagcca

SEQ ID NO: 1247478 - RNA, 21 nt, Homo sapiens
uggagggauaagccagcugca

SEQ ID NO: 1247479 - RNA, 17 nt, Homo sapiens
uggagggggcugggcuc

SEQ ID NO: 1247480 - RNA, 13 nt, Homo sapiens
uggaggggggagc

SEQ ID NO: 1247481 - RNA, 17 nt, Homo sapiens
uggaggguaaaugaugu

SEQ ID NO: 1247482 - RNA, 16 nt, Homo sapiens
uggagguugaagccaa

SEQ ID NO: 1247483 - RNA, 15 nt, Homo sapiens
uggagguugcaguga

SEQ ID NO: 1247484 - RNA, 16 nt, Homo sapiens
uggaguaaguauuuag

SEQ ID NO: 1247485 - RNA, 18 nt, Homo sapiens
uggaguagauauuaauua

SEQ ID NO: 1247486 - RNA, 20 nt, Homo sapiens
uggaguaucauucuuuacau

SEQ ID NO: 1247487 - RNA, 21 nt, Homo sapiens
uggaguaugucugauggaucc

SEQ ID NO: 1247488 - RNA, 13 nt, Homo sapiens
uggagucacugua

SEQ ID NO: 1247489 - RNA, 14 nt, Homo sapiens
uggagugagacuga

SEQ ID NO: 1247490 - RNA, 22 nt, Homo sapiens
uggaguggcugccauggaagga

SEQ ID NO: 1247491 - RNA, 17 nt, Homo sapiens
uggauaaaauaaaugca

SEQ ID NO: 1247492 - RNA, 19 nt, Homo sapiens
uggauaaaauaaaugcaau

SEQ ID NO: 1247493 - RNA, 15 nt, Homo sapiens
uggauaacuuuacag

SEQ ID NO: 1247494 - RNA, 15 nt, Homo sapiens
uggauauugaugaaa

SEQ ID NO: 1247495 - RNA, 18 nt, Homo sapiens
uggauauuuuuuacuuua

SEQ ID NO: 1247496 - RNA, 21 nt, Homo sapiens
uggaucagggaauccagcucc

SEQ ID NO: 1247497 - RNA, 21 nt, Homo sapiens
uggaugacauuaaagaagggu

SEQ ID NO: 1247498 - RNA, 13 nt, Homo sapiens
uggaugcagcucu

SEQ ID NO: 1247499 - RNA, 14 nt, Homo sapiens
uggaugcaggguuu

SEQ ID NO: 1247500 - RNA, 14 nt, Homo sapiens
uggaugcauuucaa

SEQ ID NO: 1247501 - RNA, 17 nt, Homo sapiens
uggaugccaaccgguca

SEQ ID NO: 1247502 - RNA, 14 nt, Homo sapiens
uggaugcugugaag

SEQ ID NO: 1247503 - RNA, 20 nt, Homo sapiens
uggaugcugugaagagucua

SEQ ID NO: 1247504 - RNA, 20 nt, Homo sapiens
uggaugguggacccuacuau

SEQ ID NO: 1247505 - RNA, 16 nt, Homo sapiens
uggauguaaagugugg

SEQ ID NO: 1247506 - RNA, 23 nt, Homo sapiens
uggaugugguuuaauuguuuguc

SEQ ID NO: 1247507 - RNA, 22 nt, Homo sapiens
uggauguucugacccugcuuca

SEQ ID NO: 1247508 - RNA, 14 nt, Homo sapiens
uggauuauucauuu

SEQ ID NO: 1247509 - RNA, 14 nt, Homo sapiens
uggauuauuuagau

SEQ ID NO: 1247510 - RNA, 16 nt, Homo sapiens
uggauuccacacugca

SEQ ID NO: 1247511 - RNA, 15 nt, Homo sapiens
uggauucgugacaac

SEQ ID NO: 1247512 - RNA, 20 nt, Homo sapiens
uggauucuucccacacagaa

SEQ ID NO: 1247513 - RNA, 19 nt, Homo sapiens
uggauuguguuugugccau

SEQ ID NO: 1247514 - RNA, 22 nt, Homo sapiens
uggauuuaaaagccugcucaau

SEQ ID NO: 1247515 - RNA, 15 nt, Homo sapiens
uggauuuauagcuau

SEQ ID NO: 1247516 - RNA, 16 nt, Homo sapiens
uggauuuauucugcca

SEQ ID NO: 1247517 - RNA, 17 nt, Homo sapiens
uggauuucauacuguaa

SEQ ID NO: 1247518 - RNA, 23 nt, Homo sapiens
uggauuugcaggugaacagccuc

SEQ ID NO: 1247519 - RNA, 17 nt, Homo sapiens
uggauuugccugugcca

SEQ ID NO: 1247520 - RNA, 22 nt, Homo sapiens
uggauuuucaaaaagccguuga

SEQ ID NO: 1247521 - RNA, 14 nt, Homo sapiens
uggauuuucuacug

SEQ ID NO: 1247522 - RNA, 19 nt, Homo sapiens
uggauuuugaaauuuacug

SEQ ID NO: 1247523 - RNA, 22 nt, Homo sapiens
uggauuuugggagugacucaag

SEQ ID NO: 1247524 - RNA, 15 nt, Homo sapiens
uggcaaagugcugua

SEQ ID NO: 1247525 - RNA, 13 nt, Homo sapiens
uggcaaccuuccu

SEQ ID NO: 1247526 - RNA, 21 nt, Homo sapiens
uggcaaggcuuaggaaaguga

SEQ ID NO: 1247527 - RNA, 18 nt, Homo sapiens
uggcaagucuuccaugac

SEQ ID NO: 1247528 - RNA, 19 nt, Homo sapiens
uggcaauaaacuccuacua

SEQ ID NO: 1247529 - RNA, 16 nt, Homo sapiens
uggcaaucaauacagc

SEQ ID NO: 1247530 - RNA, 19 nt, Homo sapiens
uggcaaucaauacagcuuc

SEQ ID NO: 1247531 - RNA, 15 nt, Homo sapiens
uggcacacucuccaa

SEQ ID NO: 1247532 - RNA, 23 nt, Homo sapiens
uggcacaugacaacuuugccagc

SEQ ID NO: 1247533 - RNA, 19 nt, Homo sapiens
uggcaccaaagaugcagcc

SEQ ID NO: 1247534 - RNA, 17 nt, Homo sapiens
uggcaccccagcuaccc

SEQ ID NO: 1247535 - RNA, 17 nt, Homo sapiens
uggcacucaacucugag

SEQ ID NO: 1247536 - RNA, 19 nt, Homo sapiens
uggcacuuaagugcacuuu

SEQ ID NO: 1247537 - RNA, 12 nt, Homo sapiens
uggcacuuugaa

SEQ ID NO: 1247538 - RNA, 19 nt, Homo sapiens
uggcacuuugaaggggccu

SEQ ID NO: 1247539 - RNA, 20 nt, Homo sapiens
uggcagaagggaauugcuca

SEQ ID NO: 1247540 - RNA, 21 nt, Homo sapiens
uggcagaagggaauugcucag

SEQ ID NO: 1247541 - RNA, 14 nt, Homo sapiens
uggcagauuuuaca

SEQ ID NO: 1247542 - RNA, 17 nt, Homo sapiens
uggcagcauacacagau

SEQ ID NO: 1247543 - RNA, 14 nt, Homo sapiens
uggcagcaugacuc

SEQ ID NO: 1247544 - RNA, 21 nt, Homo sapiens
uggcagcggguggcauccagg

SEQ ID NO: 1247545 - RNA, 11 nt, Homo sapiens
uggcagggaua

SEQ ID NO: 1247546 - RNA, 15 nt, Homo sapiens
uggcauaaccugucu

SEQ ID NO: 1247547 - RNA, 17 nt, Homo sapiens
uggcauaaccugucuca

SEQ ID NO: 1247548 - RNA, 17 nt, Homo sapiens
uggcauaauucaggggc

SEQ ID NO: 1247549 - RNA, 13 nt, Homo sapiens
uggccaaagccaa

SEQ ID NO: 1247550 - RNA, 22 nt, Homo sapiens
uggccaacugcaaaaaaagccu

SEQ ID NO: 1247551 - RNA, 20 nt, Homo sapiens
uggccaagcaauuccucuga

SEQ ID NO: 1247552 - RNA, 15 nt, Homo sapiens
uggccaccaguauga

SEQ ID NO: 1247553 - RNA, 21 nt, Homo sapiens
uggccaccaguaugacaguau

SEQ ID NO: 1247554 - RNA, 23 nt, Homo sapiens
uggccagagagccuggugcugcu

SEQ ID NO: 1247555 - RNA, 16 nt, Homo sapiens
uucugggacacaguuc

SEQ ID NO: 1247556 - RNA, 14 nt, Homo sapiens
uucugggacugugc

SEQ ID NO: 1247557 - RNA, 17 nt, Homo sapiens
uucugggcuucaucugg

SEQ ID NO: 1247558 - RNA, 15 nt, Homo sapiens
uucuggggccaucca

SEQ ID NO: 1247559 - RNA, 16 nt, Homo sapiens
uucuggguccugaaga

SEQ ID NO: 1247560 - RNA, 14 nt, Homo sapiens
uucuggugccauuu

SEQ ID NO: 1247561 - RNA, 15 nt, Homo sapiens
uucugguuacugugg

SEQ ID NO: 1247562 - RNA, 23 nt, Homo sapiens
uucuguagauguugucuuggcuu

SEQ ID NO: 1247563 - RNA, 17 nt, Homo sapiens
uucuguaugaacuuuau

SEQ ID NO: 1247564 - RNA, 10 nt, Homo sapiens
uucugucacc

SEQ ID NO: 1247565 - RNA, 21 nt, Homo sapiens
uucugucugugucuucaggag

SEQ ID NO: 1247566 - RNA, 18 nt, Homo sapiens
uucuguggaccacugcau

SEQ ID NO: 1247567 - RNA, 12 nt, Homo sapiens
uucuguggcuca

SEQ ID NO: 1247568 - RNA, 19 nt, Homo sapiens
uucugugguuucauguuag

SEQ ID NO: 1247569 - RNA, 17 nt, Homo sapiens
uucuguucucauuugau

SEQ ID NO: 1247570 - RNA, 13 nt, Homo sapiens
uucuguucugcug

SEQ ID NO: 1247571 - RNA, 17 nt, Homo sapiens
uucuguuggggaggggu

SEQ ID NO: 1247572 - RNA, 14 nt, Homo sapiens
uucuguuuggcacu

SEQ ID NO: 1247573 - RNA, 14 nt, Homo sapiens
uucuguuuggugug

SEQ ID NO: 1247574 - RNA, 22 nt, Homo sapiens
uucuuaaauggaauuauuuuga

SEQ ID NO: 1247575 - RNA, 14 nt, Homo sapiens
uucuuaacaaccga

SEQ ID NO: 1247576 - RNA, 13 nt, Homo sapiens
uucuuaacagauc

SEQ ID NO: 1247577 - RNA, 21 nt, Homo sapiens
uucuuaaccuggaacuggagu

SEQ ID NO: 1247578 - RNA, 13 nt, Homo sapiens
uucuuaagacaug

SEQ ID NO: 1247579 - RNA, 15 nt, Homo sapiens
uucuuacacauacag

SEQ ID NO: 1247580 - RNA, 20 nt, Homo sapiens
uucuuacauuacuaaggcua

SEQ ID NO: 1247581 - RNA, 15 nt, Homo sapiens
uucuuagacuuaucu

SEQ ID NO: 1247582 - RNA, 17 nt, Homo sapiens
uucuuagucacaaaaua

SEQ ID NO: 1247583 - RNA, 20 nt, Homo sapiens
uucuuagugcuucagaguuu

SEQ ID NO: 1247584 - RNA, 13 nt, Homo sapiens
uucuucaaccuca

SEQ ID NO: 1247585 - RNA, 11 nt, Homo sapiens
uucuucacucu

SEQ ID NO: 1247586 - RNA, 15 nt, Homo sapiens
uucuucacucuuuga

SEQ ID NO: 1247587 - RNA, 18 nt, Homo sapiens
uucuucauccaacuucca

SEQ ID NO: 1247588 - RNA, 17 nt, Homo sapiens
uucuucaugcaaugaca

SEQ ID NO: 1247589 - RNA, 14 nt, Homo sapiens
uucuucuacugcua

SEQ ID NO: 1247590 - RNA, 13 nt, Homo sapiens
uucuucucauaaa

SEQ ID NO: 1247591 - RNA, 21 nt, Homo sapiens
uucuucugaagaucagaacau

SEQ ID NO: 1247592 - RNA, 15 nt, Homo sapiens
uucuucuguccugag

SEQ ID NO: 1247593 - RNA, 18 nt, Homo sapiens
uucuugccuuguaccuca

SEQ ID NO: 1247594 - RNA, 12 nt, Homo sapiens
uucuugcugcua

SEQ ID NO: 1247595 - RNA, 13 nt, Homo sapiens
uucuugguauuau

SEQ ID NO: 1247596 - RNA, 22 nt, Homo sapiens
uucuuggugcucuguguuccca

SEQ ID NO: 1247597 - RNA, 20 nt, Homo sapiens
uucuuguauauuauggaaga

SEQ ID NO: 1247598 - RNA, 22 nt, Homo sapiens
uucuugucagacauaaagccau

SEQ ID NO: 1247599 - RNA, 22 nt, Homo sapiens
uucuuuaaaaaacaacuaugga

SEQ ID NO: 1247600 - RNA, 19 nt, Homo sapiens
uucuuuaaaauucacuaau

SEQ ID NO: 1247601 - RNA, 15 nt, Homo sapiens
uucuuuaaaggcauc

SEQ ID NO: 1247602 - RNA, 22 nt, Homo sapiens
uucuuuaagcagcgccagugac

SEQ ID NO: 1247603 - RNA, 17 nt, Homo sapiens
uucuuuaagucaguuca

SEQ ID NO: 1247604 - RNA, 20 nt, Homo sapiens
uucuuuaccaaggauauuua

SEQ ID NO: 1247605 - RNA, 13 nt, Homo sapiens
uucuuuacuccau

SEQ ID NO: 1247606 - RNA, 20 nt, Homo sapiens
uucuuuagagcauugccauu

SEQ ID NO: 1247607 - RNA, 13 nt, Homo sapiens
uucuuuauacugu

SEQ ID NO: 1247608 - RNA, 15 nt, Homo sapiens
uucuuucaaagaagc

SEQ ID NO: 1247609 - RNA, 20 nt, Homo sapiens
uucuuugcugcagucaucua

SEQ ID NO: 1247610 - RNA, 14 nt, Homo sapiens
uucuuuggaggcag

SEQ ID NO: 1247611 - RNA, 13 nt, Homo sapiens
uucuuuuauguga

SEQ ID NO: 1247612 - RNA, 14 nt, Homo sapiens
uucuuuucacuucg

SEQ ID NO: 1247613 - RNA, 12 nt, Homo sapiens
uucuuuuccacu

SEQ ID NO: 1247614 - RNA, 15 nt, Homo sapiens
uucuuuucuuuacaa

SEQ ID NO: 1247615 - RNA, 20 nt, Homo sapiens
uucuuuuuaaaauggugcuu

SEQ ID NO: 1247616 - RNA, 16 nt, Homo sapiens
uugaaaauaaccuaau

SEQ ID NO: 1247617 - RNA, 19 nt, Homo sapiens
uugaaaauauuuuguugcc

SEQ ID NO: 1247618 - RNA, 13 nt, Homo sapiens
uugaaaaugggcu

SEQ ID NO: 1247619 - RNA, 14 nt, Homo sapiens
uugaaacaaacaug

SEQ ID NO: 1247620 - RNA, 22 nt, Homo sapiens
uugaaacaacuuucucuuguaa

SEQ ID NO: 1247621 - RNA, 22 nt, Homo sapiens
uugaaacagcagucccaguauu

SEQ ID NO: 1247622 - RNA, 13 nt, Homo sapiens
uugaaacuuugaa

SEQ ID NO: 1247623 - RNA, 15 nt, Homo sapiens
uugaaagaaauggug

SEQ ID NO: 1247624 - RNA, 15 nt, Homo sapiens
uugaaagaaccagag

SEQ ID NO: 1247625 - RNA, 11 nt, Homo sapiens
uugaaagaaga

SEQ ID NO: 1247626 - RNA, 21 nt, Homo sapiens
uugaaaggagaugucuuggaa

SEQ ID NO: 1247627 - RNA, 16 nt, Homo sapiens
uugaaaguuagcauaa

SEQ ID NO: 1247628 - RNA, 20 nt, Homo sapiens
uugaaauauaguaaacacuu

SEQ ID NO: 1247629 - RNA, 20 nt, Homo sapiens
uugaaauuaagaaggcaaaa

SEQ ID NO: 1247630 - RNA, 15 nt, Homo sapiens
uugaacccaggagau

SEQ ID NO: 1247631 - RNA, 15 nt, Homo sapiens
uugaacucuguaaaa

SEQ ID NO: 1247632 - RNA, 22 nt, Homo sapiens
uugaacuucauaagguaauuca

SEQ ID NO: 1247633 - RNA, 19 nt, Homo sapiens
uugaacuucugacuacuug

SEQ ID NO: 1247634 - RNA, 18 nt, Homo sapiens
uugaagaaaauagucagu

SEQ ID NO: 1247635 - RNA, 21 nt, Homo sapiens
uugaagagauuucaacauauc

SEQ ID NO: 1247636 - RNA, 22 nt, Homo sapiens
uugaagagauuucaacauauca

SEQ ID NO: 1247637 - RNA, 13 nt, Homo sapiens
uugaagccaaaga

SEQ ID NO: 1247638 - RNA, 12 nt, Homo sapiens
uugaagccucag

SEQ ID NO: 1247639 - RNA, 20 nt, Homo sapiens
uugaaguauauucaaccaaa

SEQ ID NO: 1247640 - RNA, 14 nt, Homo sapiens
uugaaguaugguug

SEQ ID NO: 1247641 - RNA, 13 nt, Homo sapiens
uugaaguggagcc

SEQ ID NO: 1247642 - RNA, 21 nt, Homo sapiens
uugaauaccauuaaaacugcu

SEQ ID NO: 1247643 - RNA, 19 nt, Homo sapiens
uugaauaguucuauacaaa

SEQ ID NO: 1247644 - RNA, 12 nt, Homo sapiens
uugaaugucaca

SEQ ID NO: 1247645 - RNA, 19 nt, Homo sapiens
uugaaugugguuacuuccu

SEQ ID NO: 1247646 - RNA, 21 nt, Homo sapiens
uugaaugugguuacuuccuac

SEQ ID NO: 1247647 - RNA, 22 nt, Homo sapiens
uugaauuguaggugacuauuau

SEQ ID NO: 1247648 - RNA, 17 nt, Homo sapiens
uugacaaaguuacugau

SEQ ID NO: 1247649 - RNA, 11 nt, Homo sapiens
uugacaaugau

SEQ ID NO: 1247650 - RNA, 20 nt, Homo sapiens
uugacaccacaccaucaggc

SEQ ID NO: 1247651 - RNA, 17 nt, Homo sapiens
uugacaggaauacuuaa

SEQ ID NO: 1247652 - RNA, 13 nt, Homo sapiens
uugacaggauuau

SEQ ID NO: 1247653 - RNA, 23 nt, Homo sapiens
uugacagggucucacucugucac

SEQ ID NO: 1247654 - RNA, 19 nt, Homo sapiens
uugacaguucauauguacc

SEQ ID NO: 1247655 - RNA, 11 nt, Homo sapiens
uugaccacaga

SEQ ID NO: 1247656 - RNA, 22 nt, Homo sapiens
uugaccacgucaucgggccaga

SEQ ID NO: 1247657 - RNA, 21 nt, Homo sapiens
uugacguauauauaaacagaa

SEQ ID NO: 1247658 - RNA, 21 nt, Homo sapiens
uugacuaaagcuauguuacau

SEQ ID NO: 1247659 - RNA, 16 nt, Homo sapiens
uugacuaacaagaaug

SEQ ID NO: 1247660 - RNA, 23 nt, Homo sapiens
uugacugucacuguuccuuguca

SEQ ID NO: 1247661 - RNA, 16 nt, Homo sapiens
uugacuguucaaugau

SEQ ID NO: 1247662 - RNA, 19 nt, Homo sapiens
uugacuuuuauaaagcaug

SEQ ID NO: 1247663 - RNA, 22 nt, Homo sapiens
uugagaagccuucagcuccagg

SEQ ID NO: 1247664 - RNA, 21 nt, Homo sapiens
uugagauuauucuuuguuucc

SEQ ID NO: 1247665 - RNA, 19 nt, Homo sapiens
uugagcagaagaucaagga

SEQ ID NO: 1247666 - RNA, 20 nt, Homo sapiens
uugagcaguggcugguccag

SEQ ID NO: 1247667 - RNA, 23 nt, Homo sapiens
uugagcuacuucaaaugugguau

SEQ ID NO: 1247668 - RNA, 11 nt, Homo sapiens
uugaggacaag

SEQ ID NO: 1247669 - RNA, 17 nt, Homo sapiens
uugaggagcugcacuga

SEQ ID NO: 1247670 - RNA, 17 nt, Homo sapiens
uugaggauuuugaucca

SEQ ID NO: 1247671 - RNA, 17 nt, Homo sapiens
uugaggcagcagaauug

SEQ ID NO: 1247672 - RNA, 19 nt, Homo sapiens
uugaggcauuuccagacuu

SEQ ID NO: 1247673 - RNA, 15 nt, Homo sapiens
uugagggacugccuc

SEQ ID NO: 1247674 - RNA, 13 nt, Homo sapiens
uugagguccauau

SEQ ID NO: 1247675 - RNA, 21 nt, Homo sapiens
uugagguggugccuucucaca

SEQ ID NO: 1247676 - RNA, 22 nt, Homo sapiens
uugagugguaaucauauguguc

SEQ ID NO: 1247677 - RNA, 15 nt, Homo sapiens
uugauaaaauccaaa

SEQ ID NO: 1247678 - RNA, 14 nt, Homo sapiens
uugauaaucuucag

SEQ ID NO: 1247679 - RNA, 17 nt, Homo sapiens
uugauaccucugcuggg

SEQ ID NO: 1247680 - RNA, 16 nt, Homo sapiens
uugauaccugcacugu

SEQ ID NO: 1247681 - RNA, 17 nt, Homo sapiens
uugauagaaccauugca

SEQ ID NO: 1247682 - RNA, 17 nt, Homo sapiens
uuguuugccaggacaug

SEQ ID NO: 1247683 - RNA, 23 nt, Homo sapiens
uuguuuggaccgauaagugugcu

SEQ ID NO: 1247684 - RNA, 19 nt, Homo sapiens
uuguuuuacccuauacauc

SEQ ID NO: 1247685 - RNA, 21 nt, Homo sapiens
uuguuuuaugcucagggucaa

SEQ ID NO: 1247686 - RNA, 22 nt, Homo sapiens
uuguuuuggggacagacuuuua

SEQ ID NO: 1247687 - RNA, 15 nt, Homo sapiens
uuguuuuugcaugaa

SEQ ID NO: 1247688 - RNA, 19 nt, Homo sapiens
uuuaaaaaauauuuucucu

SEQ ID NO: 1247689 - RNA, 13 nt, Homo sapiens
uuuaaaaagcaaa

SEQ ID NO: 1247690 - RNA, 22 nt, Homo sapiens
uuuaaaacccaacucuuacucu

SEQ ID NO: 1247691 - RNA, 14 nt, Homo sapiens
uuuaaaagauaaaa

SEQ ID NO: 1247692 - RNA, 15 nt, Homo sapiens
uuuaaaagcaucuca

SEQ ID NO: 1247693 - RNA, 16 nt, Homo sapiens
uuuaaaauauuacaca

SEQ ID NO: 1247694 - RNA, 15 nt, Homo sapiens
uuuaaaauucaauua

SEQ ID NO: 1247695 - RNA, 13 nt, Homo sapiens
uuuaaaauuucau

SEQ ID NO: 1247696 - RNA, 16 nt, Homo sapiens
uuuaaacacaugccuu

SEQ ID NO: 1247697 - RNA, 18 nt, Homo sapiens
uuuaaacacaugccuuaa

SEQ ID NO: 1247698 - RNA, 22 nt, Homo sapiens
uuuaaacacuuaucuucuggau

SEQ ID NO: 1247699 - RNA, 12 nt, Homo sapiens
uuuaaacaguga

SEQ ID NO: 1247700 - RNA, 20 nt, Homo sapiens
uuuaaacuaucuugugugau

SEQ ID NO: 1247701 - RNA, 22 nt, Homo sapiens
uuuaaacucaagacaaugcacc

SEQ ID NO: 1247702 - RNA, 22 nt, Homo sapiens
uuuaaacucagggacagagcca

SEQ ID NO: 1247703 - RNA, 18 nt, Homo sapiens
uuuaaacuuguuugcugu

SEQ ID NO: 1247704 - RNA, 11 nt, Homo sapiens
uuuaaagacag

SEQ ID NO: 1247705 - RNA, 17 nt, Homo sapiens
uuuaaagagcauaauaa

SEQ ID NO: 1247706 - RNA, 14 nt, Homo sapiens
uuuaaaguaugcau

SEQ ID NO: 1247707 - RNA, 14 nt, Homo sapiens
uuuaaagugauuaa

SEQ ID NO: 1247708 - RNA, 15 nt, Homo sapiens
uuuaaaucugugaug

SEQ ID NO: 1247709 - RNA, 20 nt, Homo sapiens
uuuaaaugaugauuccuuga

SEQ ID NO: 1247710 - RNA, 21 nt, Homo sapiens
uuuaaauggcuuuaugcuagu

SEQ ID NO: 1247711 - RNA, 16 nt, Homo sapiens
uuuaacaaacuaaaaa

SEQ ID NO: 1247712 - RNA, 18 nt, Homo sapiens
uuuaacaugguauuauca

SEQ ID NO: 1247713 - RNA, 19 nt, Homo sapiens
uuuaacaugguauuaucaa

SEQ ID NO: 1247714 - RNA, 19 nt, Homo sapiens
uuuaaccccuugguacuga

SEQ ID NO: 1247715 - RNA, 17 nt, Homo sapiens
uuuaaccgcacaugcac

SEQ ID NO: 1247716 - RNA, 17 nt, Homo sapiens
uuuaaccucuagaguca

SEQ ID NO: 1247717 - RNA, 20 nt, Homo sapiens
uuuaaccucuagagucacug

SEQ ID NO: 1247718 - RNA, 13 nt, Homo sapiens
uuuaagaaaucaa

SEQ ID NO: 1247719 - RNA, 22 nt, Homo sapiens
uuuaagaauaugaaacuuucau

SEQ ID NO: 1247720 - RNA, 14 nt, Homo sapiens
uuuaagaauuucac

SEQ ID NO: 1247721 - RNA, 14 nt, Homo sapiens
uuuaagacuaugau

SEQ ID NO: 1247722 - RNA, 17 nt, Homo sapiens
uuuaagacuaugauuua

SEQ ID NO: 1247723 - RNA, 17 nt, Homo sapiens
uuuaagaguuacuuaau

SEQ ID NO: 1247724 - RNA, 21 nt, Homo sapiens
uuuaagccaaagaaacaagcu

SEQ ID NO: 1247725 - RNA, 11 nt, Homo sapiens
uuuaagccagg

SEQ ID NO: 1247726 - RNA, 15 nt, Homo sapiens
uuuaagccaggagca

SEQ ID NO: 1247727 - RNA, 14 nt, Homo sapiens
uuuaagcuaccaau

SEQ ID NO: 1247728 - RNA, 17 nt, Homo sapiens
uuuaagcuucaguugcu

SEQ ID NO: 1247729 - RNA, 19 nt, Homo sapiens
uuuaaggcaggacagagaa

SEQ ID NO: 1247730 - RNA, 12 nt, Homo sapiens
uuuaaggcuaaa

SEQ ID NO: 1247731 - RNA, 23 nt, Homo sapiens
uuuaagggcaugccuugugcugu

SEQ ID NO: 1247732 - RNA, 16 nt, Homo sapiens
uuuaaggggagcucuu

SEQ ID NO: 1247733 - RNA, 10 nt, Homo sapiens
uuuaagguga

SEQ ID NO: 1247734 - RNA, 22 nt, Homo sapiens
uuuaauaaaugguuuauucugc

SEQ ID NO: 1247735 - RNA, 15 nt, Homo sapiens
uuuaauacaggguag

SEQ ID NO: 1247736 - RNA, 19 nt, Homo sapiens
uuuaauacaggguagauaa

SEQ ID NO: 1247737 - RNA, 19 nt, Homo sapiens
uuuaauacagugagcucua

SEQ ID NO: 1247738 - RNA, 19 nt, Homo sapiens
uuuaauagcuauggaauca

SEQ ID NO: 1247739 - RNA, 21 nt, Homo sapiens
uuuaaugaacuaccaucugau

SEQ ID NO: 1247740 - RNA, 16 nt, Homo sapiens
uuuaaugauaaguaaa

SEQ ID NO: 1247741 - RNA, 19 nt, Homo sapiens
uuuaauguuuuuugccaca

SEQ ID NO: 1247742 - RNA, 16 nt, Homo sapiens
uuuaauugauuauucu

SEQ ID NO: 1247743 - RNA, 16 nt, Homo sapiens
uuuacaaaagauguau

SEQ ID NO: 1247744 - RNA, 23 nt, Homo sapiens
uuuacaauaaaacuuugcugcca

SEQ ID NO: 1247745 - RNA, 15 nt, Homo sapiens
uuuacacaaagggaa

SEQ ID NO: 1247746 - RNA, 14 nt, Homo sapiens
uuuacagaagugaa

SEQ ID NO: 1247747 - RNA, 13 nt, Homo sapiens
uuuacagcugccu

SEQ ID NO: 1247748 - RNA, 21 nt, Homo sapiens
uuuacauaucaccucauggcc

SEQ ID NO: 1247749 - RNA, 22 nt, Homo sapiens
uuuacauccagaguucugugac

SEQ ID NO: 1247750 - RNA, 14 nt, Homo sapiens
uuuacauucugcaa

SEQ ID NO: 1247751 - RNA, 11 nt, Homo sapiens
uuuacauuuca

SEQ ID NO: 1247752 - RNA, 20 nt, Homo sapiens
uuuaccaaagagauauugau

SEQ ID NO: 1247753 - RNA, 11 nt, Homo sapiens
uuuaccaaagc

SEQ ID NO: 1247754 - RNA, 20 nt, Homo sapiens
uuuaccaaggauauuuacag

SEQ ID NO: 1247755 - RNA, 19 nt, Homo sapiens
uuuaccaguuaauuacuca

SEQ ID NO: 1247756 - RNA, 20 nt, Homo sapiens
uuuaccccucauccaaaguu

SEQ ID NO: 1247757 - RNA, 20 nt, Homo sapiens
uuuacccuauacauccacag

SEQ ID NO: 1247758 - RNA, 14 nt, Homo sapiens
uuuacccucaggca

SEQ ID NO: 1247759 - RNA, 19 nt, Homo sapiens
uuuacccuuuauagaacau

SEQ ID NO: 1247760 - RNA, 15 nt, Homo sapiens
uuuaccuauccacaa

SEQ ID NO: 1247761 - RNA, 17 nt, Homo sapiens
uuuaccucuucuaugca

SEQ ID NO: 1247762 - RNA, 21 nt, Homo sapiens
uuuacugaugaaacagccucu

SEQ ID NO: 1247763 - RNA, 18 nt, Homo sapiens
uuuacuguuuuaauugua

SEQ ID NO: 1247764 - RNA, 19 nt, Homo sapiens
uuuacuuaucuuaugccac

SEQ ID NO: 1247765 - RNA, 16 nt, Homo sapiens
uuuacuuuguacuugu

SEQ ID NO: 1247766 - RNA, 17 nt, Homo sapiens
uuuacuuuuaaacugug

SEQ ID NO: 1247767 - RNA, 23 nt, Homo sapiens
uuuagaaaagaaagcaaacuuaa

SEQ ID NO: 1247768 - RNA, 16 nt, Homo sapiens
uuuagaaaaugcaguc

SEQ ID NO: 1247769 - RNA, 14 nt, Homo sapiens
uuuagaaacuaaga

SEQ ID NO: 1247770 - RNA, 18 nt, Homo sapiens
uuuagaaaucacaacaaa

SEQ ID NO: 1247771 - RNA, 14 nt, Homo sapiens
uuuagagaaguaua

SEQ ID NO: 1247772 - RNA, 22 nt, Homo sapiens
uuuagagugaaauauaugcuau

SEQ ID NO: 1247773 - RNA, 20 nt, Homo sapiens
uuuagaugguuacacuguua

SEQ ID NO: 1247774 - RNA, 18 nt, Homo sapiens
uuuagauuaaacaaacaa

SEQ ID NO: 1247775 - RNA, 14 nt, Homo sapiens
uuuagccagugacu

SEQ ID NO: 1247776 - RNA, 19 nt, Homo sapiens
uuuagcguagcuaagugaa

SEQ ID NO: 1247777 - RNA, 22 nt, Homo sapiens
uuuaggaaaaucacuuugucua

SEQ ID NO: 1247778 - RNA, 23 nt, Homo sapiens
uuuaggauaaccuugugccuugg

SEQ ID NO: 1247779 - RNA, 12 nt, Homo sapiens
uuuagggagaac

SEQ ID NO: 1247780 - RNA, 13 nt, Homo sapiens
uuuagggcagcuu

SEQ ID NO: 1247781 - RNA, 18 nt, Homo sapiens
uuuagggcagcuugcccc

SEQ ID NO: 1247782 - RNA, 12 nt, Homo sapiens
uuuagucacuaa

SEQ ID NO: 1247783 - RNA, 24 nt, Homo sapiens
uuuagucgguucuguaucuccagu

SEQ ID NO: 1247784 - RNA, 12 nt, Homo sapiens
uuuagucuugau

SEQ ID NO: 1247785 - RNA, 13 nt, Homo sapiens
uuuaguuucauga

SEQ ID NO: 1247786 - RNA, 18 nt, Homo sapiens
uuuaguuuuauacuauau

SEQ ID NO: 1247787 - RNA, 23 nt, Homo sapiens
uuuauaaaagaauaaaauugcac

SEQ ID NO: 1247788 - RNA, 16 nt, Homo sapiens
uuuauaaaaguguuca

SEQ ID NO: 1247789 - RNA, 16 nt, Homo sapiens
uuuauaagcuacaugu

SEQ ID NO: 1247790 - RNA, 13 nt, Homo sapiens
uuuauaagucauu

SEQ ID NO: 1247791 - RNA, 12 nt, Homo sapiens
uuuauacaggaa

SEQ ID NO: 1247792 - RNA, 22 nt, Homo sapiens
uuuauaccagcuuaugagcuca

SEQ ID NO: 1247793 - RNA, 16 nt, Homo sapiens
uuuauacguguagcua

SEQ ID NO: 1247794 - RNA, 19 nt, Homo sapiens
uuuauacuccaguguacau

SEQ ID NO: 1247795 - RNA, 23 nt, Homo sapiens
uuuauagagcagaacccuagucu

SEQ ID NO: 1247796 - RNA, 18 nt, Homo sapiens
uuuauagaggcuagcuuc

SEQ ID NO: 1247797 - RNA, 14 nt, Homo sapiens
uuuauagagugucu

SEQ ID NO: 1247798 - RNA, 18 nt, Homo sapiens
uuuauauaaaaaucccau

SEQ ID NO: 1247799 - RNA, 13 nt, Homo sapiens
uuuauauagcuug

SEQ ID NO: 1247800 - RNA, 12 nt, Homo sapiens
uuuauauauaua

SEQ ID NO: 1247801 - RNA, 11 nt, Homo sapiens
uuuauaugauu

SEQ ID NO: 1247802 - RNA, 19 nt, Homo sapiens
uuuauaugauucacaugcu

SEQ ID NO: 1247803 - RNA, 13 nt, Homo sapiens
uuuauaugcuauu

SEQ ID NO: 1247804 - RNA, 13 nt, Homo sapiens
uuuauauguugcu

SEQ ID NO: 1247805 - RNA, 14 nt, Homo sapiens
uuuauauuaauuuc

SEQ ID NO: 1247806 - RNA, 14 nt, Homo sapiens
uuuaucaaagcaua

SEQ ID NO: 1247807 - RNA, 19 nt, Homo sapiens
uuuaucugugaauucagau

SEQ ID NO: 1247808 - RNA, 18 nt, Homo sapiens
uugcccagacuacagggc

SEQ ID NO: 1247809 - RNA, 21 nt, Homo sapiens
uugcccaggcuggagugcaau

SEQ ID NO: 1247810 - RNA, 20 nt, Homo sapiens
uugcccaggcuggucucaaa

SEQ ID NO: 1247811 - RNA, 19 nt, Homo sapiens
uugcccccagauacauggu

SEQ ID NO: 1247812 - RNA, 21 nt, Homo sapiens
uugccccuuacgacucucacc

SEQ ID NO: 1247813 - RNA, 15 nt, Homo sapiens
uugcccuaugacauu

SEQ ID NO: 1247814 - RNA, 13 nt, Homo sapiens
uugcccuuuccau

SEQ ID NO: 1247815 - RNA, 23 nt, Homo sapiens
uugccucccgggcucaagcgauu

SEQ ID NO: 1247816 - RNA, 12 nt, Homo sapiens
uugccugcaaaa

SEQ ID NO: 1247817 - RNA, 13 nt, Homo sapiens
uugccugcaaaaa

SEQ ID NO: 1247818 - RNA, 14 nt, Homo sapiens
uugccugcaaaaau

SEQ ID NO: 1247819 - RNA, 17 nt, Homo sapiens
uugccuuccuuucucca

SEQ ID NO: 1247820 - RNA, 15 nt, Homo sapiens
uugccuugggcugcu

SEQ ID NO: 1247821 - RNA, 13 nt, Homo sapiens
uugcgccaccugc

SEQ ID NO: 1247822 - RNA, 13 nt, Homo sapiens
uugcggacagcca

SEQ ID NO: 1247823 - RNA, 19 nt, Homo sapiens
uugcguuuguauauccaaa

SEQ ID NO: 1247824 - RNA, 23 nt, Homo sapiens
uugcuaaaagauuauagaaguag

SEQ ID NO: 1247825 - RNA, 18 nt, Homo sapiens
ggguggggggugacagug

SEQ ID NO: 1247826 - RNA, 13 nt, Homo sapiens
ggguggguggugg

SEQ ID NO: 1247827 - RNA, 22 nt, Homo sapiens
gggugugggaagaccaaaggaa

SEQ ID NO: 1247828 - RNA, 13 nt, Homo sapiens
ggguguguguagc

SEQ ID NO: 1247829 - RNA, 17 nt, Homo sapiens
ggguguguguagccaag

SEQ ID NO: 1247830 - RNA, 18 nt, Homo sapiens
ggguuauguaucagaaga

SEQ ID NO: 1247831 - RNA, 16 nt, Homo sapiens
ggguucugauauugcc

SEQ ID NO: 1247832 - RNA, 17 nt, Homo sapiens
gguaaaaccccaucucu

SEQ ID NO: 1247833 - RNA, 15 nt, Homo sapiens
gguaaaaguuacuua

SEQ ID NO: 1247834 - RNA, 17 nt, Homo sapiens
gguaaccccauacucuc

SEQ ID NO: 1247835 - RNA, 14 nt, Homo sapiens
gguaagcaccagga

SEQ ID NO: 1247836 - RNA, 18 nt, Homo sapiens
gguacauuuaucacugaa

SEQ ID NO: 1247837 - RNA, 14 nt, Homo sapiens
gguaccauggugua

SEQ ID NO: 1247838 - RNA, 16 nt, Homo sapiens
gguacgaugacagugu

SEQ ID NO: 1247839 - RNA, 21 nt, Homo sapiens
gguacuuuuaugauguauauu

SEQ ID NO: 1247840 - RNA, 14 nt, Homo sapiens
gguagaaaggcagu

SEQ ID NO: 1247841 - RNA, 14 nt, Homo sapiens
gguaggucggcacu

SEQ ID NO: 1247842 - RNA, 15 nt, Homo sapiens
gguagguugggacac

SEQ ID NO: 1247843 - RNA, 23 nt, Homo sapiens
gguaugaucacggcucacugcag

SEQ ID NO: 1247844 - RNA, 16 nt, Homo sapiens
gguaugucagugucac

SEQ ID NO: 1247845 - RNA, 22 nt, Homo sapiens
gguauguguggaugaugcugcc

SEQ ID NO: 1247846 - RNA, 18 nt, Homo sapiens
gguauuagcaaagcaaaa

SEQ ID NO: 1247847 - RNA, 21 nt, Homo sapiens
ggucaagagaguucugaccug

SEQ ID NO: 1247848 - RNA, 17 nt, Homo sapiens
ggucacauugugccuuu

SEQ ID NO: 1247849 - RNA, 17 nt, Homo sapiens
ggucaccccuccaggaa

SEQ ID NO: 1247850 - RNA, 17 nt, Homo sapiens
ggucacccucuccagca

SEQ ID NO: 1247851 - RNA, 23 nt, Homo sapiens
ggucacuuaaagggucuuaugaa

SEQ ID NO: 1247852 - RNA, 13 nt, Homo sapiens
ggucagagccacu

SEQ ID NO: 1247853 - RNA, 11 nt, Homo sapiens
ggucagccagc

SEQ ID NO: 1247854 - RNA, 23 nt, Homo sapiens
ggucaguggaagccccaacggga

SEQ ID NO: 1247855 - RNA, 14 nt, Homo sapiens
ggucauacaugcau

SEQ ID NO: 1247856 - RNA, 14 nt, Homo sapiens
ggucaucacuuuga

SEQ ID NO: 1247857 - RNA, 17 nt, Homo sapiens
ggucauccaaacucaaa

SEQ ID NO: 1247858 - RNA, 14 nt, Homo sapiens
ggucauucuuuauu

SEQ ID NO: 1247859 - RNA, 14 nt, Homo sapiens
gguccagugggaac

SEQ ID NO: 1247860 - RNA, 20 nt, Homo sapiens
ggucccauuucucacugaga

SEQ ID NO: 1247861 - RNA, 13 nt, Homo sapiens
ggucccggggcca

SEQ ID NO: 1247862 - RNA, 13 nt, Homo sapiens
ggucccucugugu

SEQ ID NO: 1247863 - RNA, 17 nt, Homo sapiens
gguccuaaagaugcuga

SEQ ID NO: 1247864 - RNA, 22 nt, Homo sapiens
gguccuaaauucuuaaccugga

SEQ ID NO: 1247865 - RNA, 18 nt, Homo sapiens
gguccuggacaaaggagu

SEQ ID NO: 1247866 - RNA, 21 nt, Homo sapiens
gguccuucccucucaugacuu

SEQ ID NO: 1247867 - RNA, 22 nt, Homo sapiens
gguccuugcaccccucacucug

SEQ ID NO: 1247868 - RNA, 19 nt, Homo sapiens
gguccuuuucaaaauucaa

SEQ ID NO: 1247869 - RNA, 16 nt, Homo sapiens
ggucuaagguucagcc

SEQ ID NO: 1247870 - RNA, 16 nt, Homo sapiens
ggucucaaacuccuga

SEQ ID NO: 1247871 - RNA, 20 nt, Homo sapiens
ggucucaaacuccugaccuc

SEQ ID NO: 1247872 - RNA, 20 nt, Homo sapiens
ggucucaggagaagggauag

SEQ ID NO: 1247873 - RNA, 16 nt, Homo sapiens
ggucucauguccugcu

SEQ ID NO: 1247874 - RNA, 21 nt, Homo sapiens
ggucucauuuagaacuugcag

SEQ ID NO: 1247875 - RNA, 15 nt, Homo sapiens
ggucuccuugcacuu

SEQ ID NO: 1247876 - RNA, 16 nt, Homo sapiens
ggucuccuugcacuuu

SEQ ID NO: 1247877 - RNA, 21 nt, Homo sapiens
ggucucuggcccuucuugccu

SEQ ID NO: 1247878 - RNA, 21 nt, Homo sapiens
ggucucuuucuuuacucuggg

SEQ ID NO: 1247879 - RNA, 16 nt, Homo sapiens
ggucuguguguguucu

SEQ ID NO: 1247880 - RNA, 23 nt, Homo sapiens
ggucuguuguaggguugccagau

SEQ ID NO: 1247881 - RNA, 21 nt, Homo sapiens
ggucuuaggaugucuguaaua

SEQ ID NO: 1247882 - RNA, 17 nt, Homo sapiens
ggucuuuccacuuucau

SEQ ID NO: 1247883 - RNA, 22 nt, Homo sapiens
ggugaaacuaacagauaagcaa

SEQ ID NO: 1247884 - RNA, 20 nt, Homo sapiens
gcaucuagauuauggagcuu

SEQ ID NO: 1247885 - RNA, 14 nt, Homo sapiens
gcaucucacuuuau

SEQ ID NO: 1247886 - RNA, 12 nt, Homo sapiens
gcaucugugaug

SEQ ID NO: 1247887 - RNA, 17 nt, Homo sapiens
gcaucuucccacagugg

SEQ ID NO: 1247888 - RNA, 14 nt, Homo sapiens
gcaugaccugugac

SEQ ID NO: 1247889 - RNA, 23 nt, Homo sapiens
gcaugaccugugaccagcacugu

SEQ ID NO: 1247890 - RNA, 21 nt, Homo sapiens
gcaugacuuggacacgguaac

SEQ ID NO: 1247891 - RNA, 11 nt, Homo sapiens
gcaugaugaaa

SEQ ID NO: 1247892 - RNA, 11 nt, Homo sapiens
gcaugcacaaa

SEQ ID NO: 1247893 - RNA, 22 nt, Homo sapiens
gcaugcagcuuugcaaacccau

SEQ ID NO: 1247894 - RNA, 17 nt, Homo sapiens
gcaugccaaauguucca

SEQ ID NO: 1247895 - RNA, 14 nt, Homo sapiens
gcaugccacccuca

SEQ ID NO: 1247896 - RNA, 21 nt, Homo sapiens
gcaugcccccuccugcaaggg

SEQ ID NO: 1247897 - RNA, 17 nt, Homo sapiens
gcauggaacagcauuac

SEQ ID NO: 1247898 - RNA, 23 nt, Homo sapiens
gcauggaggcugcgacugaugaa

SEQ ID NO: 1247899 - RNA, 24 nt, Homo sapiens
gcauguaugucuuggacacuguac

SEQ ID NO: 1247900 - RNA, 18 nt, Homo sapiens
gcaugucgugaccaacua

SEQ ID NO: 1247901 - RNA, 17 nt, Homo sapiens
gcaugugcagcuauuua

SEQ ID NO: 1247902 - RNA, 21 nt, Homo sapiens
gcaugugcugugaccauuuau

SEQ ID NO: 1247903 - RNA, 23 nt, Homo sapiens
gcauuaacaaggaaaaauacuga

SEQ ID NO: 1247904 - RNA, 17 nt, Homo sapiens
gcauucaagaaacugau

SEQ ID NO: 1247905 - RNA, 20 nt, Homo sapiens
gcauucuguacuaauacagc

SEQ ID NO: 1247906 - RNA, 21 nt, Homo sapiens
gcauucuguggccagccaaaa

SEQ ID NO: 1247907 - RNA, 21 nt, Homo sapiens
gcauucuuuuggcaguucuga

SEQ ID NO: 1247908 - RNA, 22 nt, Homo sapiens
gcauugaauauauuauaaucuu

SEQ ID NO: 1247909 - RNA, 14 nt, Homo sapiens
gcauugacaucaca

SEQ ID NO: 1247910 - RNA, 21 nt, Homo sapiens
gcauugauaaucuucagguga

SEQ ID NO: 1247911 - RNA, 23 nt, Homo sapiens
gcauugauggccucaauguggca

SEQ ID NO: 1247912 - RNA, 18 nt, Homo sapiens
gcauugauugcacuugau

SEQ ID NO: 1247913 - RNA, 12 nt, Homo sapiens
gcauugcacuug

SEQ ID NO: 1247914 - RNA, 14 nt, Homo sapiens
gcauugcuuuccac

SEQ ID NO: 1247915 - RNA, 16 nt, Homo sapiens
gcauuggugacucacu

SEQ ID NO: 1247916 - RNA, 16 nt, Homo sapiens
gcauugucucucucga

SEQ ID NO: 1247917 - RNA, 18 nt, Homo sapiens
gcauugucuguaaugaca

SEQ ID NO: 1247918 - RNA, 20 nt, Homo sapiens
gcauuuaaaucaagucccaa

SEQ ID NO: 1247919 - RNA, 14 nt, Homo sapiens
gcauuuaggagaua

SEQ ID NO: 1247920 - RNA, 12 nt, Homo sapiens
gcauuucuugcg

SEQ ID NO: 1247921 - RNA, 15 nt, Homo sapiens
gcauuugauuuugcc

SEQ ID NO: 1247922 - RNA, 22 nt, Homo sapiens
gcauuuguuuccucaucuuuaa

SEQ ID NO: 1247923 - RNA, 16 nt, Homo sapiens
gccaaaauaaugcacc

SEQ ID NO: 1247924 - RNA, 21 nt, Homo sapiens
gccaaaauaaugcaccacuuu

SEQ ID NO: 1247925 - RNA, 14 nt, Homo sapiens
gccaaaaugccauu

SEQ ID NO: 1247926 - RNA, 13 nt, Homo sapiens
gccaaaccaggac

SEQ ID NO: 1247927 - RNA, 21 nt, Homo sapiens
gccaaaccuguguaggcauuu

SEQ ID NO: 1247928 - RNA, 19 nt, Homo sapiens
gccaaagaaaugaacauuc

SEQ ID NO: 1247929 - RNA, 14 nt, Homo sapiens
gccaaagacuguaa

SEQ ID NO: 1247930 - RNA, 15 nt, Homo sapiens
gccaaauaaaaucua

SEQ ID NO: 1247931 - RNA, 13 nt, Homo sapiens
gccaaauguaauu

SEQ ID NO: 1247932 - RNA, 14 nt, Homo sapiens
gccaaauuuuggcc

SEQ ID NO: 1247933 - RNA, 21 nt, Homo sapiens
gccaaccagaauaaaauaacc

SEQ ID NO: 1247934 - RNA, 19 nt, Homo sapiens
gccaaccagagaagcugcu

SEQ ID NO: 1247935 - RNA, 22 nt, Homo sapiens
gccaaccagcccgacagugcca

SEQ ID NO: 1247936 - RNA, 12 nt, Homo sapiens
gccaacccagcc

SEQ ID NO: 1247937 - RNA, 22 nt, Homo sapiens
gccaacccggcacugcccucag

SEQ ID NO: 1247938 - RNA, 18 nt, Homo sapiens
gccaaccggucacccagg

SEQ ID NO: 1247939 - RNA, 15 nt, Homo sapiens
gccaacuuguaaaua

SEQ ID NO: 1247940 - RNA, 20 nt, Homo sapiens
gccaacuuucucugcaacua

SEQ ID NO: 1247941 - RNA, 19 nt, Homo sapiens
gccaagaaacgucuucuaa

SEQ ID NO: 1247942 - RNA, 19 nt, Homo sapiens
gcccaugcccaccugccca

SEQ ID NO: 1247943 - RNA, 20 nt, Homo sapiens
gcccauggugagcucuggga

SEQ ID NO: 1247944 - RNA, 22 nt, Homo sapiens
gcccauuaggucuggcaugccc

SEQ ID NO: 1247945 - RNA, 14 nt, Homo sapiens
gccccacaacuuua

SEQ ID NO: 1247946 - RNA, 22 nt, Homo sapiens
gccccacacagcuacagcuuuc

SEQ ID NO: 1247947 - RNA, 18 nt, Homo sapiens
gccccacaguuguguuca

SEQ ID NO: 1247948 - RNA, 16 nt, Homo sapiens
gccccacccuaacuga

SEQ ID NO: 1247949 - RNA, 15 nt, Homo sapiens
gccccagaccccagg

SEQ ID NO: 1247950 - RNA, 20 nt, Homo sapiens
gccccagacgcauagacuga

SEQ ID NO: 1247951 - RNA, 23 nt, Homo sapiens
gccccagauaccagccccuguau

SEQ ID NO: 1247952 - RNA, 14 nt, Homo sapiens
gccccagaucugcc

SEQ ID NO: 1247953 - RNA, 15 nt, Homo sapiens
gccccagcaccaacc

SEQ ID NO: 1247954 - RNA, 17 nt, Homo sapiens
gccccagcagugccuug

SEQ ID NO: 1247955 - RNA, 18 nt, Homo sapiens
gccccagggaucacuggc

SEQ ID NO: 1247956 - RNA, 15 nt, Homo sapiens
gccccaugccugucc

SEQ ID NO: 1247957 - RNA, 13 nt, Homo sapiens
gccccauguaucu

SEQ ID NO: 1247958 - RNA, 20 nt, Homo sapiens
gcccccagauacauggugau

SEQ ID NO: 1247959 - RNA, 22 nt, Homo sapiens
gccccccacaccuuuuccccaa

SEQ ID NO: 1247960 - RNA, 20 nt, Homo sapiens
gcccccgccugccaccggag

SEQ ID NO: 1247961 - RNA, 23 nt, Homo sapiens
gcccccucccuggaugacauuaa

SEQ ID NO: 1247962 - RNA, 15 nt, Homo sapiens
gcccccuccugcaag

SEQ ID NO: 1247963 - RNA, 21 nt, Homo sapiens
gcccccuucaagccugugcaa

SEQ ID NO: 1247964 - RNA, 17 nt, Homo sapiens
gccccggccuccucgga

SEQ ID NO: 1247965 - RNA, 16 nt, Homo sapiens
gccccgggcaaagggu

SEQ ID NO: 1247966 - RNA, 19 nt, Homo sapiens
gccccguggugacauuucc

SEQ ID NO: 1247967 - RNA, 17 nt, Homo sapiens
gccccuagaaacccaag

SEQ ID NO: 1247968 - RNA, 14 nt, Homo sapiens
gccccucaaccucc

SEQ ID NO: 1247969 - RNA, 14 nt, Homo sapiens
gccccucugaccug

SEQ ID NO: 1247970 - RNA, 12 nt, Homo sapiens
gccccuggccau

SEQ ID NO: 1247971 - RNA, 19 nt, Homo sapiens
gccccuggggcuuccaucc

SEQ ID NO: 1247972 - RNA, 22 nt, Homo sapiens
gccccugggguggccaccagua

SEQ ID NO: 1247973 - RNA, 18 nt, Homo sapiens
gcccgacagccuggcaca

SEQ ID NO: 1247974 - RNA, 21 nt, Homo sapiens
gcccgcacacccucacucugc

SEQ ID NO: 1247975 - RNA, 15 nt, Homo sapiens
gcccgcugcaaugcc

SEQ ID NO: 1247976 - RNA, 17 nt, Homo sapiens
gcccgggagccuaggac

SEQ ID NO: 1247977 - RNA, 22 nt, Homo sapiens
gcccguacccagcccugcugca

SEQ ID NO: 1247978 - RNA, 21 nt, Homo sapiens
gcccgugcccccgccugccac

SEQ ID NO: 1247979 - RNA, 16 nt, Homo sapiens
gcccguuuccauacag

SEQ ID NO: 1247980 - RNA, 15 nt, Homo sapiens
gcccuacauugugcu

SEQ ID NO: 1247981 - RNA, 16 nt, Homo sapiens
gcccuacucaccugag

SEQ ID NO: 1247982 - RNA, 17 nt, Homo sapiens
gcccuacuccacugccc

SEQ ID NO: 1247983 - RNA, 16 nt, Homo sapiens
gcccuagcccagacuc

SEQ ID NO: 1247984 - RNA, 17 nt, Homo sapiens
gcccuagcccagacucu

SEQ ID NO: 1247985 - RNA, 17 nt, Homo sapiens
gcccuaggggagcaccg

SEQ ID NO: 1247986 - RNA, 19 nt, Homo sapiens
gcccucaggggacuugaau

SEQ ID NO: 1247987 - RNA, 19 nt, Homo sapiens
gcccuccaccuuguuccug

SEQ ID NO: 1247988 - RNA, 19 nt, Homo sapiens
gcccucccccagcaguuga

SEQ ID NO: 1247989 - RNA, 17 nt, Homo sapiens
gcccuccucccugucau

SEQ ID NO: 1247990 - RNA, 22 nt, Homo sapiens
gcccucuacagccugacuuucu

SEQ ID NO: 1247991 - RNA, 13 nt, Homo sapiens
gcccucuauuuau

SEQ ID NO: 1247992 - RNA, 15 nt, Homo sapiens
gcccucucucugggc

SEQ ID NO: 1247993 - RNA, 20 nt, Homo sapiens
gcccucugaacuugccuuaa

SEQ ID NO: 1247994 - RNA, 23 nt, Homo sapiens
gcccucuuccugacgaaacuggc

SEQ ID NO: 1247995 - RNA, 20 nt, Homo sapiens
gcccugaauccauaaaggca

SEQ ID NO: 1247996 - RNA, 19 nt, Homo sapiens
gcccugagcuuuguccuga

SEQ ID NO: 1247997 - RNA, 18 nt, Homo sapiens
gcccugaucuagugcagu

SEQ ID NO: 1247998 - RNA, 20 nt, Homo sapiens
gcccugauguguccucaggg

SEQ ID NO: 1247999 - RNA, 18 nt, Homo sapiens
gcccugcaccugacagcu

SEQ ID NO: 1248000 - RNA, 17 nt, Homo sapiens
gcccugcaccugugcag

SEQ ID NO: 1248001 - RNA, 17 nt, Homo sapiens
gcccugcacgucauggg

SEQ ID NO: 1248002 - RNA, 18 nt, Homo sapiens
gcccugcagcccaaaacc

SEQ ID NO: 1248003 - RNA, 12 nt, Homo sapiens
gcccugcuccuc

SEQ ID NO: 1248004 - RNA, 17 nt, Homo sapiens
gcccugcucuuccucag

SEQ ID NO: 1248005 - RNA, 20 nt, Homo sapiens
gcccugcugcccaaucucca

SEQ ID NO: 1248006 - RNA, 16 nt, Homo sapiens
gcccugcugugggaga

SEQ ID NO: 1248007 - RNA, 12 nt, Homo sapiens
gcccuggcagca

SEQ ID NO: 1248008 - RNA, 21 nt, Homo sapiens
gcccuggcagcaugacucaga

SEQ ID NO: 1248009 - RNA, 14 nt, Homo sapiens
guaaaaucuuggca

SEQ ID NO: 1248010 - RNA, 13 nt, Homo sapiens
guaaaaugaaauu

SEQ ID NO: 1248011 - RNA, 12 nt, Homo sapiens
guaaacaaacuc

SEQ ID NO: 1248012 - RNA, 17 nt, Homo sapiens
guaaacagaagccuguu

SEQ ID NO: 1248013 - RNA, 13 nt, Homo sapiens
guaaaccaaaaag

SEQ ID NO: 1248014 - RNA, 17 nt, Homo sapiens
guaaacgggaacaugcc

SEQ ID NO: 1248015 - RNA, 20 nt, Homo sapiens
guaaacuguacuagucugug

SEQ ID NO: 1248016 - RNA, 20 nt, Homo sapiens
guaaacuucugaagacugag

SEQ ID NO: 1248017 - RNA, 18 nt, Homo sapiens
guaaagacugguuuucug

SEQ ID NO: 1248018 - RNA, 19 nt, Homo sapiens
guaaagccagccaugcauu

SEQ ID NO: 1248019 - RNA, 18 nt, Homo sapiens
guaaauaaacuguuuaua

SEQ ID NO: 1248020 - RNA, 18 nt, Homo sapiens
guaaauacuguaaaugca

SEQ ID NO: 1248021 - RNA, 14 nt, Homo sapiens
guaaauaugaaucu

SEQ ID NO: 1248022 - RNA, 16 nt, Homo sapiens
guaaauccaugguguu

SEQ ID NO: 1248023 - RNA, 19 nt, Homo sapiens
guaaauccugccauuuaaa

SEQ ID NO: 1248024 - RNA, 23 nt, Homo sapiens
guaaauccuuuuggaacauauag

SEQ ID NO: 1248025 - RNA, 21 nt, Homo sapiens
guaaaugguguacauaaugua

SEQ ID NO: 1248026 - RNA, 12 nt, Homo sapiens
guaaauguuucu

SEQ ID NO: 1248027 - RNA, 15 nt, Homo sapiens
guaaauucaaccacu

SEQ ID NO: 1248028 - RNA, 20 nt, Homo sapiens
guaacaaauaaauaagauca

SEQ ID NO: 1248029 - RNA, 18 nt, Homo sapiens
guaacaacuguggucaau

SEQ ID NO: 1248030 - RNA, 19 nt, Homo sapiens
guaacaacuguggucaauc

SEQ ID NO: 1248031 - RNA, 17 nt, Homo sapiens
guaacaauacaaaugga

SEQ ID NO: 1248032 - RNA, 20 nt, Homo sapiens
guaacaauuguguagccuuu

SEQ ID NO: 1248033 - RNA, 16 nt, Homo sapiens
guaacauauucuguau

SEQ ID NO: 1248034 - RNA, 19 nt, Homo sapiens
guaacaucacuauccaugc

SEQ ID NO: 1248035 - RNA, 23 nt, Homo sapiens
guaacaugaggggacauuuuggu

SEQ ID NO: 1248036 - RNA, 16 nt, Homo sapiens
guaaccaaauguuggc

SEQ ID NO: 1248037 - RNA, 21 nt, Homo sapiens
guaacccgcucaucacuggau

SEQ ID NO: 1248038 - RNA, 17 nt, Homo sapiens
guaacuccccucaggga

SEQ ID NO: 1248039 - RNA, 15 nt, Homo sapiens
guaagaaguuuuaaa

SEQ ID NO: 1248040 - RNA, 14 nt, Homo sapiens
guaagacaggccag

SEQ ID NO: 1248041 - RNA, 21 nt, Homo sapiens
guaagacccuuauugcugucc

SEQ ID NO: 1248042 - RNA, 15 nt, Homo sapiens
guaagacgaaugauu

SEQ ID NO: 1248043 - RNA, 18 nt, Homo sapiens
guaagacuaaaucuguaa

SEQ ID NO: 1248044 - RNA, 14 nt, Homo sapiens
guaagacucauucc

SEQ ID NO: 1248045 - RNA, 15 nt, Homo sapiens
guaagaugcacugaa

SEQ ID NO: 1248046 - RNA, 19 nt, Homo sapiens
guaagauuuuccauuguau

SEQ ID NO: 1248047 - RNA, 14 nt, Homo sapiens
guaagcucuacuga

SEQ ID NO: 1248048 - RNA, 14 nt, Homo sapiens
guaagcuguuuauu

SEQ ID NO: 1248049 - RNA, 13 nt, Homo sapiens
guaaggugcaguu

SEQ ID NO: 1248050 - RNA, 19 nt, Homo sapiens
guaaguuucaggugacaug

SEQ ID NO: 1248051 - RNA, 14 nt, Homo sapiens
guaaguuucuuccu

SEQ ID NO: 1248052 - RNA, 21 nt, Homo sapiens
guaauaaguaucacacuguau

SEQ ID NO: 1248053 - RNA, 15 nt, Homo sapiens
guaauacaucaaaga

SEQ ID NO: 1248054 - RNA, 19 nt, Homo sapiens
guaauauaguuauugcaca

SEQ ID NO: 1248055 - RNA, 14 nt, Homo sapiens
guaaucacucccau

SEQ ID NO: 1248056 - RNA, 15 nt, Homo sapiens
guaaucaguuuugua

SEQ ID NO: 1248057 - RNA, 18 nt, Homo sapiens
guaaucccaacuacucag

SEQ ID NO: 1248058 - RNA, 16 nt, Homo sapiens
guaaucccagcacuuu

SEQ ID NO: 1248059 - RNA, 19 nt, Homo sapiens
guaaucccaguacuuggga

SEQ ID NO: 1248060 - RNA, 22 nt, Homo sapiens
guaauccuguacaauugcauca

SEQ ID NO: 1248061 - RNA, 15 nt, Homo sapiens
guaaucucggcucac

SEQ ID NO: 1248062 - RNA, 16 nt, Homo sapiens
guaaucuuuauacugg

SEQ ID NO: 1248063 - RNA, 20 nt, Homo sapiens
guaauguuaguaaauccaug

SEQ ID NO: 1248064 - RNA, 19 nt, Homo sapiens
guaauuaaguaaaccaaaa

SEQ ID NO: 1248065 - RNA, 20 nt, Homo sapiens
guaauuaaguacuauguauc

SEQ ID NO: 1248066 - RNA, 19 nt, Homo sapiens
uacaaggcuuuaucucagg

SEQ ID NO: 1248067 - RNA, 16 nt, Homo sapiens
uacaagucagcuccag

SEQ ID NO: 1248068 - RNA, 13 nt, Homo sapiens
uacaaguuucaga

SEQ ID NO: 1248069 - RNA, 20 nt, Homo sapiens
uacaauaggugcuuauucuc

SEQ ID NO: 1248070 - RNA, 23 nt, Homo sapiens
uacaauaggugcuuauucucaaa

SEQ ID NO: 1248071 - RNA, 19 nt, Homo sapiens
uacaaucaaggccacugcu

SEQ ID NO: 1248072 - RNA, 23 nt, Homo sapiens
uacaaucaugaacagcucugaga

SEQ ID NO: 1248073 - RNA, 21 nt, Homo sapiens
uacaaucuuagugaaugggaa

SEQ ID NO: 1248074 - RNA, 20 nt, Homo sapiens
uacaaugugaacuuuauuaa

SEQ ID NO: 1248075 - RNA, 11 nt, Homo sapiens
uacaauucuuu

SEQ ID NO: 1248076 - RNA, 13 nt, Homo sapiens
uacaauugugagc

SEQ ID NO: 1248077 - RNA, 20 nt, Homo sapiens
uacaauuucacuuagucugu

SEQ ID NO: 1248078 - RNA, 22 nt, Homo sapiens
uacaauuuuuuaucaugcaugu

SEQ ID NO: 1248079 - RNA, 21 nt, Homo sapiens
uacacaaauuauaagcauaca

SEQ ID NO: 1248080 - RNA, 22 nt, Homo sapiens
uacacaaauuauaagcauacaa

SEQ ID NO: 1248081 - RNA, 21 nt, Homo sapiens
uacacacacacgcgugcacac

SEQ ID NO: 1248082 - RNA, 21 nt, Homo sapiens
uacacacuguugucaaaaagu

SEQ ID NO: 1248083 - RNA, 13 nt, Homo sapiens
uacacauauaccu

SEQ ID NO: 1248084 - RNA, 22 nt, Homo sapiens
uacacauccccagaauccauaa

SEQ ID NO: 1248085 - RNA, 14 nt, Homo sapiens
uacacauugcauuu

SEQ ID NO: 1248086 - RNA, 22 nt, Homo sapiens
uacaccaaugcccaacugccug

SEQ ID NO: 1248087 - RNA, 16 nt, Homo sapiens
uacaccgacuagccag

SEQ ID NO: 1248088 - RNA, 18 nt, Homo sapiens
uacaccuugcuaaccuaa

SEQ ID NO: 1248089 - RNA, 16 nt, Homo sapiens
uacacuaaaguuacaa

SEQ ID NO: 1248090 - RNA, 21 nt, Homo sapiens
uacacugccuguauacuuuag

SEQ ID NO: 1248091 - RNA, 18 nt, Homo sapiens
uacacuucuuaccccagc

SEQ ID NO: 1248092 - RNA, 22 nt, Homo sapiens
uacacuuguauaaauguauaua

SEQ ID NO: 1248093 - RNA, 15 nt, Homo sapiens
uacagaaacugaugc

SEQ ID NO: 1248094 - RNA, 17 nt, Homo sapiens
uacagaaaucaauggua

SEQ ID NO: 1248095 - RNA, 20 nt, Homo sapiens
uacagacagaaggugcuaag

SEQ ID NO: 1248096 - RNA, 13 nt, Homo sapiens
uacagacuagcag

SEQ ID NO: 1248097 - RNA, 19 nt, Homo sapiens
uacagauagaguuccauau

SEQ ID NO: 1248098 - RNA, 13 nt, Homo sapiens
uacagaugggcaa

SEQ ID NO: 1248099 - RNA, 16 nt, Homo sapiens
uacagcaacaauuuau

SEQ ID NO: 1248100 - RNA, 20 nt, Homo sapiens
uacagcagaaaggagaacua

SEQ ID NO: 1248101 - RNA, 14 nt, Homo sapiens
uacagcagcacugu

SEQ ID NO: 1248102 - RNA, 16 nt, Homo sapiens
uacagcagcacuguuc

SEQ ID NO: 1248103 - RNA, 20 nt, Homo sapiens
uacagcuaacccucacaagc

SEQ ID NO: 1248104 - RNA, 15 nt, Homo sapiens
uacaggagugagcac

SEQ ID NO: 1248105 - RNA, 14 nt, Homo sapiens
uacaggcauaaaau

SEQ ID NO: 1248106 - RNA, 19 nt, Homo sapiens
uacaggccauacuuuacaa

SEQ ID NO: 1248107 - RNA, 20 nt, Homo sapiens
uacagggacacuaucacuca

SEQ ID NO: 1248108 - RNA, 20 nt, Homo sapiens
uacaggggcccgccaccaca

SEQ ID NO: 1248109 - RNA, 15 nt, Homo sapiens
uacaggggugcugca

SEQ ID NO: 1248110 - RNA, 19 nt, Homo sapiens
uacaggugaaggcucucac

SEQ ID NO: 1248111 - RNA, 22 nt, Homo sapiens
uacaggugcucaauaaacacuu

SEQ ID NO: 1248112 - RNA, 15 nt, Homo sapiens
uacaggugucuagac

SEQ ID NO: 1248113 - RNA, 16 nt, Homo sapiens
uacaggugugagucac

SEQ ID NO: 1248114 - RNA, 22 nt, Homo sapiens
uacaguaacaaauaaagugcag

SEQ ID NO: 1248115 - RNA, 14 nt, Homo sapiens
uacaguaagcauag

SEQ ID NO: 1248116 - RNA, 21 nt, Homo sapiens
uacaguauugaaaaauuauca

SEQ ID NO: 1248117 - RNA, 14 nt, Homo sapiens
uacagucaucugcc

SEQ ID NO: 1248118 - RNA, 18 nt, Homo sapiens
uacagucugucaugaaca

SEQ ID NO: 1248119 - RNA, 19 nt, Homo sapiens
uacagugccaacuccucac

SEQ ID NO: 1248120 - RNA, 13 nt, Homo sapiens
uacagugcuauuu

SEQ ID NO: 1248121 - RNA, 16 nt, Homo sapiens
uacaguguauguacua

SEQ ID NO: 1248122 - RNA, 17 nt, Homo sapiens
uacaguguugauugauu

SEQ ID NO: 1248123 - RNA, 19 nt, Homo sapiens
uacaguuaaagaagcaauc

SEQ ID NO: 1248124 - RNA, 21 nt, Homo sapiens
uacaguuauuaaucuggacau

SEQ ID NO: 1248125 - RNA, 20 nt, Homo sapiens
uacaguucugggguacaugu

SEQ ID NO: 1248126 - RNA, 18 nt, Homo sapiens
uacaguuugcuguacuag

SEQ ID NO: 1248127 - RNA, 14 nt, Homo sapiens
uacauaacaagaaa

SEQ ID NO: 1248128 - RNA, 21 nt, Homo sapiens
uacauaagacuggacauuuaa

SEQ ID NO: 1248129 - RNA, 15 nt, Homo sapiens
uacauaauguauugu

SEQ ID NO: 1248130 - RNA, 22 nt, Homo sapiens
uacauaauuuaaaagcacacuc

SEQ ID NO: 1248131 - RNA, 20 nt, Homo sapiens
uacauacaggccauacuuua

SEQ ID NO: 1248132 - RNA, 12 nt, Homo sapiens
uacauagccuau

SEQ ID NO: 1248133 - RNA, 16 nt, Homo sapiens
uacauaucuuuauuaa

SEQ ID NO: 1248134 - RNA, 15 nt, Homo sapiens
uacauaugaggacaa

SEQ ID NO: 1248135 - RNA, 15 nt, Homo sapiens
uacauauguagacua

SEQ ID NO: 1248136 - RNA, 23 nt, Homo sapiens
uacauauuuauauguauguuuua

SEQ ID NO: 1248137 - RNA, 18 nt, Homo sapiens
uacaucaaugguguguua

SEQ ID NO: 1248138 - RNA, 21 nt, Homo sapiens
uacaucaauuuaaaaagcaaa

SEQ ID NO: 1248139 - RNA, 18 nt, Homo sapiens
uacauccagucacuuugc

SEQ ID NO: 1248140 - RNA, 20 nt, Homo sapiens
uacauccagucacuuugcca

SEQ ID NO: 1248141 - RNA, 21 nt, Homo sapiens
uacaucugcaauaugaauuca

SEQ ID NO: 1248142 - RNA, 23 nt, Homo sapiens
uacaucugcaauaugaauucaag

SEQ ID NO: 1248143 - RNA, 13 nt, Homo sapiens
uacaucugugaug

SEQ ID NO: 1248144 - RNA, 15 nt, Homo sapiens
uacaugaauugcauu

SEQ ID NO: 1248145 - RNA, 10 nt, Homo sapiens
uacaugacug

SEQ ID NO: 1248146 - RNA, 21 nt, Homo sapiens
uacaugagaaggaacuuccag

SEQ ID NO: 1248147 - RNA, 19 nt, Homo sapiens
uacaugcaaggcacuguac

SEQ ID NO: 1248148 - RNA, 15 nt, Homo sapiens
uacccagagaguccu

SEQ ID NO: 1248149 - RNA, 18 nt, Homo sapiens
uacccagagaguccugug

SEQ ID NO: 1248150 - RNA, 22 nt, Homo sapiens
uacccaggauucccccaacaca

SEQ ID NO: 1248151 - RNA, 19 nt, Homo sapiens
uacccauagcuuccaugag

SEQ ID NO: 1248152 - RNA, 19 nt, Homo sapiens
uaccccagguucuagucau

SEQ ID NO: 1248153 - RNA, 19 nt, Homo sapiens
uaccccgauggccaagcaa

SEQ ID NO: 1248154 - RNA, 19 nt, Homo sapiens
uaccccugcucccauuccu

SEQ ID NO: 1248155 - RNA, 23 nt, Homo sapiens
uacccuccaagucuguaccucaa

SEQ ID NO: 1248156 - RNA, 19 nt, Homo sapiens
uacccuggagcaagaccug

SEQ ID NO: 1248157 - RNA, 16 nt, Homo sapiens
uacccuuuggggagca

SEQ ID NO: 1248158 - RNA, 18 nt, Homo sapiens
uaccgccugucucuuuaa

SEQ ID NO: 1248159 - RNA, 16 nt, Homo sapiens
uaccuaacauuauuua

SEQ ID NO: 1248160 - RNA, 17 nt, Homo sapiens
uaccuacagagcagcca

SEQ ID NO: 1248161 - RNA, 15 nt, Homo sapiens
uaccuaccacagugu

SEQ ID NO: 1248162 - RNA, 14 nt, Homo sapiens
uaccuacugcugag

SEQ ID NO: 1248163 - RNA, 20 nt, Homo sapiens
uaccuagagcaggcacuuga

SEQ ID NO: 1248164 - RNA, 22 nt, Homo sapiens
uaccuauaauguguguaugugu

SEQ ID NO: 1248165 - RNA, 21 nt, Homo sapiens
uaccuauucuggauauuucau

SEQ ID NO: 1248166 - RNA, 19 nt, Homo sapiens
uaccucacagagugcauug

SEQ ID NO: 1248167 - RNA, 18 nt, Homo sapiens
uaccucacuaugcugcuu

SEQ ID NO: 1248168 - RNA, 13 nt, Homo sapiens
uaccucagccuag

SEQ ID NO: 1248169 - RNA, 13 nt, Homo sapiens
uaccucugagaag

SEQ ID NO: 1248170 - RNA, 20 nt, Homo sapiens
uaccucugagaagacacaag

SEQ ID NO: 1248171 - RNA, 16 nt, Homo sapiens
uaccucuuaacaauuu

SEQ ID NO: 1248172 - RNA, 15 nt, Homo sapiens
uaccugaggccagga

SEQ ID NO: 1248173 - RNA, 14 nt, Homo sapiens
uaccugauggaccu

SEQ ID NO: 1248174 - RNA, 17 nt, Homo sapiens
uaccugcucaugguuau

SEQ ID NO: 1248175 - RNA, 14 nt, Homo sapiens
uaccuggaguuuaa

SEQ ID NO: 1248176 - RNA, 18 nt, Homo sapiens
uaccuguacuaaaccacc

SEQ ID NO: 1248177 - RNA, 21 nt, Homo sapiens
uaccuguacuaaaccaccuca

SEQ ID NO: 1248178 - RNA, 22 nt, Homo sapiens
uaccuuaaaauguaaaacaaaa

SEQ ID NO: 1248179 - RNA, 18 nt, Homo sapiens
uaccuuaagagacacucc

SEQ ID NO: 1248180 - RNA, 21 nt, Homo sapiens
uaccuuccuguguaugcugag

SEQ ID NO: 1248181 - RNA, 23 nt, Homo sapiens
uaccuuuaucuuucaccuuucua

SEQ ID NO: 1248182 - RNA, 19 nt, Homo sapiens
uaccuuuuuauuugcaugu

SEQ ID NO: 1248183 - RNA, 23 nt, Homo sapiens
uacgaaacacaaaccacaacuga

SEQ ID NO: 1248184 - RNA, 15 nt, Homo sapiens
uacgaugacaguguu

SEQ ID NO: 1248185 - RNA, 21 nt, Homo sapiens
uacggagaagaauagaggucc

SEQ ID NO: 1248186 - RNA, 23 nt, Homo sapiens
uacgguggcacgugccugugauc

SEQ ID NO: 1248187 - RNA, 13 nt, Homo sapiens
uacguaucugcuc

SEQ ID NO: 1248188 - RNA, 22 nt, Homo sapiens
uacguauuuuuucuaaugugca

SEQ ID NO: 1248189 - RNA, 21 nt, Homo sapiens
uacguggcaaauuaacuugag

SEQ ID NO: 1248190 - RNA, 14 nt, Homo sapiens
uacgugucugaauc

SEQ ID NO: 1248191 - RNA, 14 nt, Homo sapiens
uacguucuuuucaa

SEQ ID NO: 1248192 - RNA, 16 nt, Homo sapiens
uacuaagcauagcaaa

SEQ ID NO: 1248193 - RNA, 14 nt, Homo sapiens
uacuaagggaacaa

SEQ ID NO: 1248194 - RNA, 15 nt, Homo sapiens
uacuacacugaggag

SEQ ID NO: 1248195 - RNA, 14 nt, Homo sapiens
uacuaccugucaag

SEQ ID NO: 1248196 - RNA, 21 nt, Homo sapiens
uacuacuuucucaaaauggaa

SEQ ID NO: 1248197 - RNA, 14 nt, Homo sapiens
uacuagcaggcaau

SEQ ID NO: 1248198 - RNA, 11 nt, Homo sapiens
uacuagccucu

SEQ ID NO: 1248199 - RNA, 15 nt, Homo sapiens
uacuagggaaguuga

SEQ ID NO: 1248200 - RNA, 22 nt, Homo sapiens
uacuaguuuuaguuuucucuua

SEQ ID NO: 1248201 - RNA, 13 nt, Homo sapiens
uacuaucauucuc

SEQ ID NO: 1248202 - RNA, 14 nt, Homo sapiens
uacuaucauucuca

SEQ ID NO: 1248203 - RNA, 12 nt, Homo sapiens
uacuauggagug

SEQ ID NO: 1248204 - RNA, 18 nt, Homo sapiens
uacuauggcuccaacaga

SEQ ID NO: 1248205 - RNA, 17 nt, Homo sapiens
uacucaauacuaccucu

SEQ ID NO: 1248206 - RNA, 15 nt, Homo sapiens
uacuccuaccucagc

SEQ ID NO: 1248207 - RNA, 13 nt, Homo sapiens
uacuccucugcag

SEQ ID NO: 1248208 - RNA, 16 nt, Homo sapiens
uacuccuuccaucaaa

SEQ ID NO: 1248209 - RNA, 15 nt, Homo sapiens
uacucucaugcugca

SEQ ID NO: 1248210 - RNA, 21 nt, Homo sapiens
uacugaacaaucaaagcacuu

SEQ ID NO: 1248211 - RNA, 23 nt, Homo sapiens
uacugaacaaucaaagcacuugg

SEQ ID NO: 1248212 - RNA, 14 nt, Homo sapiens
uacugaguaugugg

SEQ ID NO: 1248213 - RNA, 14 nt, Homo sapiens
uacugauucacugc

SEQ ID NO: 1248214 - RNA, 18 nt, Homo sapiens
uacugcacccagcagugu

SEQ ID NO: 1248215 - RNA, 17 nt, Homo sapiens
uacugccaucuuuauca

SEQ ID NO: 1248216 - RNA, 18 nt, Homo sapiens
uacugccucggaucucuc

SEQ ID NO: 1248217 - RNA, 16 nt, Homo sapiens
uacugcugucuuccaa

SEQ ID NO: 1248218 - RNA, 15 nt, Homo sapiens
uacugggagaaucac

SEQ ID NO: 1248219 - RNA, 14 nt, Homo sapiens
uacuggugcaguca

SEQ ID NO: 1248220 - RNA, 16 nt, Homo sapiens
uacuguaauaauaccu

SEQ ID NO: 1248221 - RNA, 13 nt, Homo sapiens
uacuguaauuccu

SEQ ID NO: 1248222 - RNA, 12 nt, Homo sapiens
uacuguacuuaa

SEQ ID NO: 1248223 - RNA, 17 nt, Homo sapiens
uacuguagcugaugaaa

SEQ ID NO: 1248224 - RNA, 23 nt, Homo sapiens
uacuguaggcacacuuugcacug

SEQ ID NO: 1248225 - RNA, 14 nt, Homo sapiens
uacuguccaaagac

SEQ ID NO: 1248226 - RNA, 17 nt, Homo sapiens
uacugucucacugaaac

SEQ ID NO: 1248227 - RNA, 17 nt, Homo sapiens
uacugugaaacuggcac

SEQ ID NO: 1248228 - RNA, 15 nt, Homo sapiens
uacugugaccaugga

SEQ ID NO: 1248229 - RNA, 20 nt, Homo sapiens
uacugugucauaaacagaug

SEQ ID NO: 1248230 - RNA, 19 nt, Homo sapiens
uacuguugcacugaugucc

SEQ ID NO: 1248231 - RNA, 22 nt, Homo sapiens
uacuuagugguaugucucuuua

SEQ ID NO: 1248232 - RNA, 13 nt, Homo sapiens
ucccaccagagac

SEQ ID NO: 1248233 - RNA, 16 nt, Homo sapiens
ucccaccauuccugcc

SEQ ID NO: 1248234 - RNA, 16 nt, Homo sapiens
ucccacccacauguga

SEQ ID NO: 1248235 - RNA, 23 nt, Homo sapiens
ucccacccccacccccagcucaa

SEQ ID NO: 1248236 - RNA, 17 nt, Homo sapiens
ucccaccccggccucca

SEQ ID NO: 1248237 - RNA, 20 nt, Homo sapiens
ucccaccucugugaccucag

SEQ ID NO: 1248238 - RNA, 14 nt, Homo sapiens
ucccaccugcaucu

SEQ ID NO: 1248239 - RNA, 16 nt, Homo sapiens
ucccacuaaaacugca

SEQ ID NO: 1248240 - RNA, 16 nt, Homo sapiens
ucccacuccuucagga

SEQ ID NO: 1248241 - RNA, 21 nt, Homo sapiens
ucccacugcccccuccacugg

SEQ ID NO: 1248242 - RNA, 18 nt, Homo sapiens
ucccacuguuuaaggagu

SEQ ID NO: 1248243 - RNA, 19 nt, Homo sapiens
ucccacuuuucggagacag

SEQ ID NO: 1248244 - RNA, 14 nt, Homo sapiens
ucccagaaccuauu

SEQ ID NO: 1248245 - RNA, 13 nt, Homo sapiens
ucccagacacugg

SEQ ID NO: 1248246 - RNA, 21 nt, Homo sapiens
ucccagaggagccaccaguuc

SEQ ID NO: 1248247 - RNA, 12 nt, Homo sapiens
ucccagcacuuu

SEQ ID NO: 1248248 - RNA, 23 nt, Homo sapiens
ucccagcagcccuaaggaucucu

SEQ ID NO: 1248249 - RNA, 19 nt, Homo sapiens
ucccagcauaggauucauu

SEQ ID NO: 1248250 - RNA, 15 nt, Homo sapiens
ucccagcuacuuggg

SEQ ID NO: 1248251 - RNA, 15 nt, Homo sapiens
ucccagcugaccaga

SEQ ID NO: 1248252 - RNA, 13 nt, Homo sapiens
ucccagcugugcu

SEQ ID NO: 1248253 - RNA, 22 nt, Homo sapiens
ucccaggagcagcggggcagug

SEQ ID NO: 1248254 - RNA, 20 nt, Homo sapiens
ucccaggcuggagugcagug

SEQ ID NO: 1248255 - RNA, 15 nt, Homo sapiens
ucccaggcugucagg

SEQ ID NO: 1248256 - RNA, 22 nt, Homo sapiens
ucccagguguuaacauuccaag

SEQ ID NO: 1248257 - RNA, 18 nt, Homo sapiens
ucccagguugacaccauu

SEQ ID NO: 1248258 - RNA, 16 nt, Homo sapiens
ucccaguauaccucau

SEQ ID NO: 1248259 - RNA, 12 nt, Homo sapiens
ucccagucccau

SEQ ID NO: 1248260 - RNA, 22 nt, Homo sapiens
ucccagugaccccugaccucac

SEQ ID NO: 1248261 - RNA, 13 nt, Homo sapiens
ucccauccuugau

SEQ ID NO: 1248262 - RNA, 13 nt, Homo sapiens
uagaaacaugaca

SEQ ID NO: 1248263 - RNA, 15 nt, Homo sapiens
uagaaacaugacacu

SEQ ID NO: 1248264 - RNA, 14 nt, Homo sapiens
uagaaacauuguaa

SEQ ID NO: 1248265 - RNA, 16 nt, Homo sapiens
uagaaaccccucugua

SEQ ID NO: 1248266 - RNA, 13 nt, Homo sapiens
uagaaaccucauu

SEQ ID NO: 1248267 - RNA, 20 nt, Homo sapiens
uagaaacuaagagaaugaua

SEQ ID NO: 1248268 - RNA, 20 nt, Homo sapiens
uagaaacucaggauggucau

SEQ ID NO: 1248269 - RNA, 16 nt, Homo sapiens
uagaaagcaggggcua

SEQ ID NO: 1248270 - RNA, 16 nt, Homo sapiens
uagaaagcuugaaaag

SEQ ID NO: 1248271 - RNA, 12 nt, Homo sapiens
uagaaaguaaaa

SEQ ID NO: 1248272 - RNA, 13 nt, Homo sapiens
uagaaaguagcca

SEQ ID NO: 1248273 - RNA, 19 nt, Homo sapiens
uagaaauauagccaaaaau

SEQ ID NO: 1248274 - RNA, 11 nt, Homo sapiens
uagaaaugcaa

SEQ ID NO: 1248275 - RNA, 12 nt, Homo sapiens
uagaaauggauu

SEQ ID NO: 1248276 - RNA, 22 nt, Homo sapiens
uagaacaguggaaacuaugugu

SEQ ID NO: 1248277 - RNA, 20 nt, Homo sapiens
uagaaccugggcugugcugc

SEQ ID NO: 1248278 - RNA, 18 nt, Homo sapiens
uagaacuagccaaaccag

SEQ ID NO: 1248279 - RNA, 20 nt, Homo sapiens
uagaacuucaagaaguaaga

SEQ ID NO: 1248280 - RNA, 12 nt, Homo sapiens
uagaacuugcag

SEQ ID NO: 1248281 - RNA, 19 nt, Homo sapiens
uagaacuugcagcugaugu

SEQ ID NO: 1248282 - RNA, 15 nt, Homo sapiens
uagaacuuucugcuu

SEQ ID NO: 1248283 - RNA, 17 nt, Homo sapiens
uagaagacaacaggcau

SEQ ID NO: 1248284 - RNA, 21 nt, Homo sapiens
uagaagaggguuuuagguaga

SEQ ID NO: 1248285 - RNA, 22 nt, Homo sapiens
uagaagcaacuaggaaaaucac

SEQ ID NO: 1248286 - RNA, 14 nt, Homo sapiens
uagaagccaaggga

SEQ ID NO: 1248287 - RNA, 20 nt, Homo sapiens
uagaagccaagggaaagggg

SEQ ID NO: 1248288 - RNA, 23 nt, Homo sapiens
uagaagccugcagaauccagcua

SEQ ID NO: 1248289 - RNA, 21 nt, Homo sapiens
uagaagcuaauguaggacugu

SEQ ID NO: 1248290 - RNA, 22 nt, Homo sapiens
uagaagggccaguccugccugg

SEQ ID NO: 1248291 - RNA, 19 nt, Homo sapiens
uagaaguagcaaaaaguau

SEQ ID NO: 1248292 - RNA, 22 nt, Homo sapiens
uagaaguagcaaaaaguauuga

SEQ ID NO: 1248293 - RNA, 17 nt, Homo sapiens
uagaagucuuagaugua

SEQ ID NO: 1248294 - RNA, 11 nt, Homo sapiens
uagaauaccac

SEQ ID NO: 1248295 - RNA, 16 nt, Homo sapiens
uagaauauaggucucu

SEQ ID NO: 1248296 - RNA, 17 nt, Homo sapiens
uagaauauuuauuaccu

SEQ ID NO: 1248297 - RNA, 13 nt, Homo sapiens
uagaaucaauuua

SEQ ID NO: 1248298 - RNA, 23 nt, Homo sapiens
uagaauguuacuuuggaaugacu

SEQ ID NO: 1248299 - RNA, 13 nt, Homo sapiens
uagaauuuauuca

SEQ ID NO: 1248300 - RNA, 14 nt, Homo sapiens
uagacaaaguacau

SEQ ID NO: 1248301 - RNA, 18 nt, Homo sapiens
uagacaaauagaaaaugg

SEQ ID NO: 1248302 - RNA, 16 nt, Homo sapiens
uagacaaucacuacaa

SEQ ID NO: 1248303 - RNA, 22 nt, Homo sapiens
uagacaccuucauuuugagggg

SEQ ID NO: 1248304 - RNA, 20 nt, Homo sapiens
uagacagguguuacuuacag

SEQ ID NO: 1248305 - RNA, 22 nt, Homo sapiens
uagacaguaugagucaaugugc

SEQ ID NO: 1248306 - RNA, 21 nt, Homo sapiens
uagacauggagguucuaaggc

SEQ ID NO: 1248307 - RNA, 11 nt, Homo sapiens
uagacauguag

SEQ ID NO: 1248308 - RNA, 14 nt, Homo sapiens
uagaccaccuaaua

SEQ ID NO: 1248309 - RNA, 20 nt, Homo sapiens
uagaccaggauuucuaauca

SEQ ID NO: 1248310 - RNA, 22 nt, Homo sapiens
uagaccuccacacccgugagaa

SEQ ID NO: 1248311 - RNA, 23 nt, Homo sapiens
uagaccuuuauuggguaucaaga

SEQ ID NO: 1248312 - RNA, 18 nt, Homo sapiens
uagacgaggccacagcug

SEQ ID NO: 1248313 - RNA, 19 nt, Homo sapiens
uagacuauauacaugugug

SEQ ID NO: 1248314 - RNA, 15 nt, Homo sapiens
uagacugagguauaa

SEQ ID NO: 1248315 - RNA, 22 nt, Homo sapiens
uagacugagguauaaagacaag

SEQ ID NO: 1248316 - RNA, 14 nt, Homo sapiens
uagacugagucaga

SEQ ID NO: 1248317 - RNA, 11 nt, Homo sapiens
uagacuugaaa

SEQ ID NO: 1248318 - RNA, 18 nt, Homo sapiens
uagagaaagaacuaugaa

SEQ ID NO: 1248319 - RNA, 15 nt, Homo sapiens
uagagaaauaugauu

SEQ ID NO: 1248320 - RNA, 20 nt, Homo sapiens
uagagaaauuagaacccaua

SEQ ID NO: 1248321 - RNA, 13 nt, Homo sapiens
uagagaagcugaa

SEQ ID NO: 1248322 - RNA, 18 nt, Homo sapiens
uagagaauaccaguguua

SEQ ID NO: 1248323 - RNA, 22 nt, Homo sapiens
uagagacaggguuucacugugu

SEQ ID NO: 1248324 - RNA, 22 nt, Homo sapiens
uagagacgggguuucaccaugu

SEQ ID NO: 1248325 - RNA, 15 nt, Homo sapiens
uagagacuguagauu

SEQ ID NO: 1248326 - RNA, 15 nt, Homo sapiens
uagagagagaacuuu

SEQ ID NO: 1248327 - RNA, 14 nt, Homo sapiens
uagagagagacuau

SEQ ID NO: 1248328 - RNA, 21 nt, Homo sapiens
uagagaggacaauacuggggu

SEQ ID NO: 1248329 - RNA, 19 nt, Homo sapiens
uagagagggaaggucucag

SEQ ID NO: 1248330 - RNA, 22 nt, Homo sapiens
uagagauggggucucacagugu

SEQ ID NO: 1248331 - RNA, 14 nt, Homo sapiens
uagagaugugcaau

SEQ ID NO: 1248332 - RNA, 19 nt, Homo sapiens
uagagcagccacaaccaaa

SEQ ID NO: 1248333 - RNA, 12 nt, Homo sapiens
uagagccagcuu

SEQ ID NO: 1248334 - RNA, 19 nt, Homo sapiens
uagagccauaugcccucau

SEQ ID NO: 1248335 - RNA, 21 nt, Homo sapiens
uagagccauuuaacauuuccu

SEQ ID NO: 1248336 - RNA, 17 nt, Homo sapiens
uagagcccagugagguc

SEQ ID NO: 1248337 - RNA, 18 nt, Homo sapiens
uagagcucuauuucucua

SEQ ID NO: 1248338 - RNA, 16 nt, Homo sapiens
uagagcugcagggugg

SEQ ID NO: 1248339 - RNA, 18 nt, Homo sapiens
uagagcugggaaucuuuu

SEQ ID NO: 1248340 - RNA, 22 nt, Homo sapiens
uagaggcaagaaagagauacca

SEQ ID NO: 1248341 - RNA, 14 nt, Homo sapiens
uagagggauugacu

SEQ ID NO: 1248342 - RNA, 15 nt, Homo sapiens
uagagggggucucag

SEQ ID NO: 1248343 - RNA, 21 nt, Homo sapiens
uagagguccucaugggucccu

SEQ ID NO: 1248344 - RNA, 23 nt, Homo sapiens
uagaggugggcagcugggcccca

SEQ ID NO: 1248345 - RNA, 14 nt, Homo sapiens
uagagucaucucca

SEQ ID NO: 1248346 - RNA, 18 nt, Homo sapiens
uagagucugaacagcugu

SEQ ID NO: 1248347 - RNA, 21 nt, Homo sapiens
uucaaggaaaaaugcugcuuc

SEQ ID NO: 1248348 - RNA, 17 nt, Homo sapiens
uucaaggaggugcuuag

SEQ ID NO: 1248349 - RNA, 22 nt, Homo sapiens
uucaagguuuguucaacaucua

SEQ ID NO: 1248350 - RNA, 12 nt, Homo sapiens
uucaagugccua

SEQ ID NO: 1248351 - RNA, 12 nt, Homo sapiens
uucaaguuuaca

SEQ ID NO: 1248352 - RNA, 15 nt, Homo sapiens
uucaauaaacauuga

SEQ ID NO: 1248353 - RNA, 19 nt, Homo sapiens
uucaauaugcaagcagcuu

SEQ ID NO: 1248354 - RNA, 16 nt, Homo sapiens
uucaaucuguguaaga

SEQ ID NO: 1248355 - RNA, 14 nt, Homo sapiens
uucaauuauacuaa

SEQ ID NO: 1248356 - RNA, 15 nt, Homo sapiens
uucaauucucaaaag

SEQ ID NO: 1248357 - RNA, 20 nt, Homo sapiens
uucacacagggcucuuugau

SEQ ID NO: 1248358 - RNA, 13 nt, Homo sapiens
uucacaccagcua

SEQ ID NO: 1248359 - RNA, 14 nt, Homo sapiens
uucacacccugcaa

SEQ ID NO: 1248360 - RNA, 12 nt, Homo sapiens
uucacacuuuuu

SEQ ID NO: 1248361 - RNA, 16 nt, Homo sapiens
uucacagaauagcaca

SEQ ID NO: 1248362 - RNA, 19 nt, Homo sapiens
uucacagaauagcacaaac

SEQ ID NO: 1248363 - RNA, 20 nt, Homo sapiens
uucacaggcagugcauguga

SEQ ID NO: 1248364 - RNA, 18 nt, Homo sapiens
uucacauaaaaccucauu

SEQ ID NO: 1248365 - RNA, 19 nt, Homo sapiens
uucacauacacucaaacaa

SEQ ID NO: 1248366 - RNA, 19 nt, Homo sapiens
uucacauauaucaaaguga

SEQ ID NO: 1248367 - RNA, 22 nt, Homo sapiens
uucacauauauguaauuuagca

SEQ ID NO: 1248368 - RNA, 14 nt, Homo sapiens
uucacaucugucac

SEQ ID NO: 1248369 - RNA, 19 nt, Homo sapiens
uucacauucccaucuguca

SEQ ID NO: 1248370 - RNA, 15 nt, Homo sapiens
uucacauugaaucau

SEQ ID NO: 1248371 - RNA, 18 nt, Homo sapiens
uucaccacaugugcacau

SEQ ID NO: 1248372 - RNA, 13 nt, Homo sapiens
uucaccaccaaau

SEQ ID NO: 1248373 - RNA, 17 nt, Homo sapiens
uucaccagagcauuucc

SEQ ID NO: 1248374 - RNA, 15 nt, Homo sapiens
uucaccagauuugcu

SEQ ID NO: 1248375 - RNA, 18 nt, Homo sapiens
uucaccuaccgaguucaa

SEQ ID NO: 1248376 - RNA, 13 nt, Homo sapiens
uucaccuguaaac

SEQ ID NO: 1248377 - RNA, 15 nt, Homo sapiens
uucaccugugacaaa

SEQ ID NO: 1248378 - RNA, 13 nt, Homo sapiens
uucaccuuucuag

SEQ ID NO: 1248379 - RNA, 17 nt, Homo sapiens
uucacguaagacuuuuu

SEQ ID NO: 1248380 - RNA, 22 nt, Homo sapiens
uucacgugcagcagcaacacaa

SEQ ID NO: 1248381 - RNA, 14 nt, Homo sapiens
uucacuaaugauug

SEQ ID NO: 1248382 - RNA, 12 nt, Homo sapiens
uucacuacaggu

SEQ ID NO: 1248383 - RNA, 14 nt, Homo sapiens
uucacuaucuguaa

SEQ ID NO: 1248384 - RNA, 16 nt, Homo sapiens
uucacucccaaccuga

SEQ ID NO: 1248385 - RNA, 10 nt, Homo sapiens
uucacugagc

SEQ ID NO: 1248386 - RNA, 19 nt, Homo sapiens
uucacugagcuccccagau

SEQ ID NO: 1248387 - RNA, 18 nt, Homo sapiens
uucacuguaagacucauu

SEQ ID NO: 1248388 - RNA, 17 nt, Homo sapiens
uucacuuggccaguuuc

SEQ ID NO: 1248389 - RNA, 13 nt, Homo sapiens
uucacuuuacaaa

SEQ ID NO: 1248390 - RNA, 14 nt, Homo sapiens
uucacuuuacaaau

SEQ ID NO: 1248391 - RNA, 21 nt, Homo sapiens
uucacuuuuuacagugcuauu

SEQ ID NO: 1248392 - RNA, 14 nt, Homo sapiens
uucagacacuuugg

SEQ ID NO: 1248393 - RNA, 23 nt, Homo sapiens
uucagagagcagcuuuaaacuca

SEQ ID NO: 1248394 - RNA, 15 nt, Homo sapiens
uucagagagcuggua

SEQ ID NO: 1248395 - RNA, 16 nt, Homo sapiens
uucagaggauaaauau

SEQ ID NO: 1248396 - RNA, 22 nt, Homo sapiens
uucagagggcguguuguuuuac

SEQ ID NO: 1248397 - RNA, 13 nt, Homo sapiens
uucagaguccuca

SEQ ID NO: 1248398 - RNA, 17 nt, Homo sapiens
uucagaguccuugcaaa

SEQ ID NO: 1248399 - RNA, 19 nt, Homo sapiens
uucagaguuguacacugug

SEQ ID NO: 1248400 - RNA, 16 nt, Homo sapiens
uucagauacaaacugc

SEQ ID NO: 1248401 - RNA, 17 nt, Homo sapiens
uucagaucauauuucac

SEQ ID NO: 1248402 - RNA, 19 nt, Homo sapiens
uucagaucauauuucacaa

SEQ ID NO: 1248403 - RNA, 20 nt, Homo sapiens
uucagaugcuguuaguaccu

SEQ ID NO: 1248404 - RNA, 18 nt, Homo sapiens
uucagcagagaaguuuuc

SEQ ID NO: 1248405 - RNA, 15 nt, Homo sapiens
uucagcagucaauac

SEQ ID NO: 1248406 - RNA, 18 nt, Homo sapiens
uucagcauggacagcauc

SEQ ID NO: 1248407 - RNA, 15 nt, Homo sapiens
uucagcaugugcuuu

SEQ ID NO: 1248408 - RNA, 20 nt, Homo sapiens
uucagcauuauuccuccagg

SEQ ID NO: 1248409 - RNA, 15 nt, Homo sapiens
uucagcgaagucuca

SEQ ID NO: 1248410 - RNA, 19 nt, Homo sapiens
uucagcgaagucucauggg

SEQ ID NO: 1248411 - RNA, 16 nt, Homo sapiens
uucagcucacuuccuc

SEQ ID NO: 1248412 - RNA, 20 nt, Homo sapiens
uucagcucagcuaaugaagu

SEQ ID NO: 1248413 - RNA, 16 nt, Homo sapiens
uucagcucuguuuuac

SEQ ID NO: 1248414 - RNA, 14 nt, Homo sapiens
uucaggaaaccaga

SEQ ID NO: 1248415 - RNA, 18 nt, Homo sapiens
uucaggcaacgcacaaaa

SEQ ID NO: 1248416 - RNA, 18 nt, Homo sapiens
uucagggaauuucaggaa

SEQ ID NO: 1248417 - RNA, 21 nt, Homo sapiens
uucaguacacuugguguacug

SEQ ID NO: 1248418 - RNA, 21 nt, Homo sapiens
uucaguagaauuaccauuaau

SEQ ID NO: 1248419 - RNA, 13 nt, Homo sapiens
uucaguauacugu

SEQ ID NO: 1248420 - RNA, 17 nt, Homo sapiens
uucagucaaaacuuuaa

SEQ ID NO: 1248421 - RNA, 17 nt, Homo sapiens
uucaguccacaguacau

SEQ ID NO: 1248422 - RNA, 13 nt, Homo sapiens
uucagugcuucuu

SEQ ID NO: 1248423 - RNA, 16 nt, Homo sapiens
uucaguucuacgugaa

SEQ ID NO: 1248424 - RNA, 13 nt, Homo sapiens
uucaguugccaag

SEQ ID NO: 1248425 - RNA, 17 nt, Homo sapiens
uucaguuuaaugucucc

SEQ ID NO: 1248426 - RNA, 16 nt, Homo sapiens
uucauacccuguuacc

SEQ ID NO: 1248427 - RNA, 17 nt, Homo sapiens
uucauauaaauggaauc

SEQ ID NO: 1248428 - RNA, 22 nt, Homo sapiens
uucauauaggccagaguugcaa

SEQ ID NO: 1248429 - RNA, 15 nt, Homo sapiens
uucauauauacaggc

SEQ ID NO: 1248430 - RNA, 18 nt, Homo sapiens
uucauaugcuguauaucc

SEQ ID NO: 1248431 - RNA, 20 nt, Homo sapiens
uucaucaggaaggaaaugac

SEQ ID NO: 1248432 - RNA, 22 nt, Homo sapiens
uucauccaguuuguucuccggg

SEQ ID NO: 1248433 - RNA, 13 nt, Homo sapiens
uucaucugggaca

SEQ ID NO: 1248434 - RNA, 15 nt, Homo sapiens
uucaugaaacugucc

SEQ ID NO: 1248435 - RNA, 13 nt, Homo sapiens
uucauggccccag

SEQ ID NO: 1248436 - RNA, 17 nt, Homo sapiens
uucaugggaaaacagac

SEQ ID NO: 1248437 - RNA, 23 nt, Homo sapiens
uucaugggaaaacagaccugugu

SEQ ID NO: 1248438 - RNA, 16 nt, Homo sapiens
uucauggucugcugag

SEQ ID NO: 1248439 - RNA, 19 nt, Homo sapiens
uucauggugaaaauguacu

SEQ ID NO: 1248440 - RNA, 17 nt, Homo sapiens
uucaugucuuuacugga

SEQ ID NO: 1248441 - RNA, 14 nt, Homo sapiens
uucauguuacucau

SEQ ID NO: 1248442 - RNA, 12 nt, Homo sapiens
uucauguucacu

SEQ ID NO: 1248443 - RNA, 17 nt, Homo sapiens
uucauucagcuaacaaa

SEQ ID NO: 1248444 - RNA, 21 nt, Homo sapiens
uucauucaggcaacgcacaaa

SEQ ID NO: 1248445 - RNA, 19 nt, Homo sapiens
uucauuccuucagauuugg

SEQ ID NO: 1248446 - RNA, 13 nt, Homo sapiens
uucauugcacuuu

SEQ ID NO: 1248447 - RNA, 22 nt, Homo sapiens
uucauugucuacauagugacau

SEQ ID NO: 1248448 - RNA, 15 nt, Homo sapiens
uucauuguguucucu

SEQ ID NO: 1248449 - RNA, 22 nt, Homo sapiens
uucauuuaauggggauuccacu

SEQ ID NO: 1248450 - RNA, 23 nt, Homo sapiens
uucauuucagauaaacaacaaau

SEQ ID NO: 1248451 - RNA, 13 nt, Homo sapiens
uucauuucaggaa

SEQ ID NO: 1248452 - RNA, 13 nt, Homo sapiens
uucauuuguauug

SEQ ID NO: 1248453 - RNA, 22 nt, Homo sapiens
uucauuugugcaccaauuauca

SEQ ID NO: 1248454 - RNA, 17 nt, Homo sapiens
uucauuuugagaucaag

SEQ ID NO: 1248455 - RNA, 15 nt, Homo sapiens
uuccaaaacauuucu

SEQ ID NO: 1248456 - RNA, 23 nt, Homo sapiens
uuccaaaacuuuaaugaacuaac

SEQ ID NO: 1248457 - RNA, 16 nt, Homo sapiens
uuccaaacacauacag

SEQ ID NO: 1248458 - RNA, 19 nt, Homo sapiens
uuccaaagcagccugugaa

SEQ ID NO: 1248459 - RNA, 15 nt, Homo sapiens
uuccaacaccacaga

SEQ ID NO: 1248460 - RNA, 16 nt, Homo sapiens
uuccaaccuuuggaag

SEQ ID NO: 1248461 - RNA, 23 nt, Homo sapiens
uuccaacucgaaucugugugaaa

SEQ ID NO: 1248462 - RNA, 23 nt, Homo sapiens
uuccaagacucuagaguccaagg

SEQ ID NO: 1248463 - RNA, 20 nt, Homo sapiens
uuccaccuccaccacaucug

SEQ ID NO: 1248464 - RNA, 18 nt, Homo sapiens
uuccacuaucauucccau

SEQ ID NO: 1248465 - RNA, 12 nt, Homo sapiens
uuccacugccuc

SEQ ID NO: 1248466 - RNA, 22 nt, Homo sapiens
uuccagaaacuuuaagaacaaa

SEQ ID NO: 1248467 - RNA, 14 nt, Homo sapiens
uuccagaaaggaua

SEQ ID NO: 1248468 - RNA, 13 nt, Homo sapiens
uuccagacugcuu

SEQ ID NO: 1248469 - RNA, 19 nt, Homo sapiens
uuccagacuuccuugagac

SEQ ID NO: 1248470 - RNA, 16 nt, Homo sapiens
uuccagaucacugcca

SEQ ID NO: 1248471 - RNA, 16 nt, Homo sapiens
uuccagcuccuguaac

SEQ ID NO: 1248472 - RNA, 14 nt, Homo sapiens
uuccagggaagcaa

SEQ ID NO: 1248473 - RNA, 14 nt, Homo sapiens
uuccaguacuaugg

SEQ ID NO: 1248474 - RNA, 22 nt, Homo sapiens
uuccaguacuauggagugcuca

SEQ ID NO: 1248475 - RNA, 17 nt, Homo sapiens
uccuagcugugugaaua

SEQ ID NO: 1248476 - RNA, 18 nt, Homo sapiens
uccuagcugugugaauac

SEQ ID NO: 1248477 - RNA, 19 nt, Homo sapiens
uccuaggccacaccaucuc

SEQ ID NO: 1248478 - RNA, 20 nt, Homo sapiens
uccuaggccacaccaucucc

SEQ ID NO: 1248479 - RNA, 18 nt, Homo sapiens
uccuaguggaugacuguu

SEQ ID NO: 1248480 - RNA, 23 nt, Homo sapiens
uccuagugggccauuaaaaacua

SEQ ID NO: 1248481 - RNA, 22 nt, Homo sapiens
uccuaguguuucuuuguggucu

SEQ ID NO: 1248482 - RNA, 15 nt, Homo sapiens
uccuauaagcuuaaa

SEQ ID NO: 1248483 - RNA, 13 nt, Homo sapiens
uccuauacucuau

SEQ ID NO: 1248484 - RNA, 17 nt, Homo sapiens
uccuaugcuguucacug

SEQ ID NO: 1248485 - RNA, 15 nt, Homo sapiens
uccuauucccuguca

SEQ ID NO: 1248486 - RNA, 19 nt, Homo sapiens
uccuauucccugucacuac

SEQ ID NO: 1248487 - RNA, 17 nt, Homo sapiens
uccuauucuauugcagu

SEQ ID NO: 1248488 - RNA, 19 nt, Homo sapiens
uccucaagggccaggacuu

SEQ ID NO: 1248489 - RNA, 13 nt, Homo sapiens
uccucaccacagu

SEQ ID NO: 1248490 - RNA, 18 nt, Homo sapiens
uccucaccacaguuuauu

SEQ ID NO: 1248491 - RNA, 12 nt, Homo sapiens
uccucacccacc

SEQ ID NO: 1248492 - RNA, 22 nt, Homo sapiens
uccucacgcagacacacccaca

SEQ ID NO: 1248493 - RNA, 13 nt, Homo sapiens
uccucacuuugaa

SEQ ID NO: 1248494 - RNA, 16 nt, Homo sapiens
uccucagaggacaguu

SEQ ID NO: 1248495 - RNA, 21 nt, Homo sapiens
uccucaggguggggggugaca

SEQ ID NO: 1248496 - RNA, 16 nt, Homo sapiens
uccucaguaacauuuc

SEQ ID NO: 1248497 - RNA, 15 nt, Homo sapiens
uccucaguccacugc

SEQ ID NO: 1248498 - RNA, 21 nt, Homo sapiens
uccucauauggcccaguguca

SEQ ID NO: 1248499 - RNA, 18 nt, Homo sapiens
uccuccacagugcugcuu

SEQ ID NO: 1248500 - RNA, 16 nt, Homo sapiens
uccuccacgccugucc

SEQ ID NO: 1248501 - RNA, 22 nt, Homo sapiens
uccuccagcccagacccagugg

SEQ ID NO: 1248502 - RNA, 12 nt, Homo sapiens
uccuccaggcaa

SEQ ID NO: 1248503 - RNA, 13 nt, Homo sapiens
uccuccaggguga

SEQ ID NO: 1248504 - RNA, 13 nt, Homo sapiens
uccuccaucccaa

SEQ ID NO: 1248505 - RNA, 15 nt, Homo sapiens
uccuccccucuugag

SEQ ID NO: 1248506 - RNA, 14 nt, Homo sapiens
uccuccuacuguau

SEQ ID NO: 1248507 - RNA, 17 nt, Homo sapiens
uccuccugcagacaccu

SEQ ID NO: 1248508 - RNA, 20 nt, Homo sapiens
uccuccugcagacaccugga

SEQ ID NO: 1248509 - RNA, 19 nt, Homo sapiens
uccuccugcuucaugggaa

SEQ ID NO: 1248510 - RNA, 20 nt, Homo sapiens
uccuccuggaacagaagaca

SEQ ID NO: 1248511 - RNA, 19 nt, Homo sapiens
uccuccuuugcucuuggga

SEQ ID NO: 1248512 - RNA, 20 nt, Homo sapiens
uccucgaggcccuagcauuu

SEQ ID NO: 1248513 - RNA, 14 nt, Homo sapiens
uccucgcugccaga

SEQ ID NO: 1248514 - RNA, 22 nt, Homo sapiens
uccucuaguaagaugcacugaa

SEQ ID NO: 1248515 - RNA, 17 nt, Homo sapiens
uccucuauaauuaguua

SEQ ID NO: 1248516 - RNA, 13 nt, Homo sapiens
uccucuauugaug

SEQ ID NO: 1248517 - RNA, 16 nt, Homo sapiens
uccucuccacugccuu

SEQ ID NO: 1248518 - RNA, 18 nt, Homo sapiens
uccucuccacugccuucg

SEQ ID NO: 1248519 - RNA, 19 nt, Homo sapiens
uccucucccauccuugaug

SEQ ID NO: 1248520 - RNA, 14 nt, Homo sapiens
uccucuccuacuuu

SEQ ID NO: 1248521 - RNA, 19 nt, Homo sapiens
uccucuccuccagcccaga

SEQ ID NO: 1248522 - RNA, 21 nt, Homo sapiens
uccucucugugucccugcugc

SEQ ID NO: 1248523 - RNA, 15 nt, Homo sapiens
uccucugcauuuaca

SEQ ID NO: 1248524 - RNA, 23 nt, Homo sapiens
uccucugccucccauucugacca

SEQ ID NO: 1248525 - RNA, 12 nt, Homo sapiens
uccucugugauu

SEQ ID NO: 1248526 - RNA, 11 nt, Homo sapiens
uccucuucuau

SEQ ID NO: 1248527 - RNA, 16 nt, Homo sapiens
uccucuuggugucaua

SEQ ID NO: 1248528 - RNA, 15 nt, Homo sapiens
uccugaaauaaacac

SEQ ID NO: 1248529 - RNA, 19 nt, Homo sapiens
uccugacagaaggugccac

SEQ ID NO: 1248530 - RNA, 19 nt, Homo sapiens
uccugaccucgugauccac

SEQ ID NO: 1248531 - RNA, 14 nt, Homo sapiens
uccugaucugugau

SEQ ID NO: 1248532 - RNA, 16 nt, Homo sapiens
uccugauuaggaauau

SEQ ID NO: 1248533 - RNA, 20 nt, Homo sapiens
uccugcagccuccuccugac

SEQ ID NO: 1248534 - RNA, 21 nt, Homo sapiens
uccugcagccuccuccugacc

SEQ ID NO: 1248535 - RNA, 14 nt, Homo sapiens
uccugccacaugga

SEQ ID NO: 1248536 - RNA, 20 nt, Homo sapiens
uccugccagccccacacagc

SEQ ID NO: 1248537 - RNA, 15 nt, Homo sapiens
uccugcccaagcacu

SEQ ID NO: 1248538 - RNA, 21 nt, Homo sapiens
uccugccccacccuaacugau

SEQ ID NO: 1248539 - RNA, 17 nt, Homo sapiens
uccugccgcaacaguuu

SEQ ID NO: 1248540 - RNA, 14 nt, Homo sapiens
uccugccuggccag

SEQ ID NO: 1248541 - RNA, 18 nt, Homo sapiens
uccugccuuuaagccaaa

SEQ ID NO: 1248542 - RNA, 18 nt, Homo sapiens
uccugcuuaaucuucaaa

SEQ ID NO: 1248543 - RNA, 22 nt, Homo sapiens
uccuggacaaggcuaacauccc

SEQ ID NO: 1248544 - RNA, 16 nt, Homo sapiens
uccuggaguacaccaa

SEQ ID NO: 1248545 - RNA, 18 nt, Homo sapiens
uccuggagugauaugauc

SEQ ID NO: 1248546 - RNA, 23 nt, Homo sapiens
uccuggcaaucaauacagcuuca

SEQ ID NO: 1248547 - RNA, 16 nt, Homo sapiens
uccuggccucaaguga

SEQ ID NO: 1248548 - RNA, 18 nt, Homo sapiens
uccugggagaaccucagg

SEQ ID NO: 1248549 - RNA, 20 nt, Homo sapiens
uccugggagaaccucaggcu

SEQ ID NO: 1248550 - RNA, 14 nt, Homo sapiens
uccugggaggacag

SEQ ID NO: 1248551 - RNA, 17 nt, Homo sapiens
uccugggcuaagugauc

SEQ ID NO: 1248552 - RNA, 16 nt, Homo sapiens
uccuggguacugaaag

SEQ ID NO: 1248553 - RNA, 22 nt, Homo sapiens
uccuggguacugaaagccuuag

SEQ ID NO: 1248554 - RNA, 14 nt, Homo sapiens
uccugggucuacca

SEQ ID NO: 1248555 - RNA, 15 nt, Homo sapiens
uccugguccuggaca

SEQ ID NO: 1248556 - RNA, 20 nt, Homo sapiens
uccugguggauacuguagaa

SEQ ID NO: 1248557 - RNA, 15 nt, Homo sapiens
uccuguaacuuuuaa

SEQ ID NO: 1248558 - RNA, 22 nt, Homo sapiens
uccuguacaaucaugaacagcu

SEQ ID NO: 1248559 - RNA, 22 nt, Homo sapiens
uccuguacauugugggauguuc

SEQ ID NO: 1248560 - RNA, 19 nt, Homo sapiens
uccuguacucuggggugcu

SEQ ID NO: 1248561 - RNA, 17 nt, Homo sapiens
uccuguacuguauggaa

SEQ ID NO: 1248562 - RNA, 14 nt, Homo sapiens
uccuguauucuaca

SEQ ID NO: 1248563 - RNA, 18 nt, Homo sapiens
uccuguauucuucaacca

SEQ ID NO: 1248564 - RNA, 21 nt, Homo sapiens
uccugucugcccuagggagaa

SEQ ID NO: 1248565 - RNA, 16 nt, Homo sapiens
uccugugauccuuuga

SEQ ID NO: 1248566 - RNA, 21 nt, Homo sapiens
uccugugcuugaugcuagaaa

SEQ ID NO: 1248567 - RNA, 17 nt, Homo sapiens
uccuguguguacucugu

SEQ ID NO: 1248568 - RNA, 16 nt, Homo sapiens
uccuuaaaaaucacac

SEQ ID NO: 1248569 - RNA, 15 nt, Homo sapiens
uccuuaacuucaggg

SEQ ID NO: 1248570 - RNA, 17 nt, Homo sapiens
uccuuaauaacaacaga

SEQ ID NO: 1248571 - RNA, 13 nt, Homo sapiens
uccuuaaugcaga

SEQ ID NO: 1248572 - RNA, 13 nt, Homo sapiens
uccuuaguguaua

SEQ ID NO: 1248573 - RNA, 16 nt, Homo sapiens
uccuuccaauuuggaa

SEQ ID NO: 1248574 - RNA, 19 nt, Homo sapiens
uccuuccccagcuuugcug

SEQ ID NO: 1248575 - RNA, 14 nt, Homo sapiens
uccuuccuaccucu

SEQ ID NO: 1248576 - RNA, 13 nt, Homo sapiens
uucuagucaugug

SEQ ID NO: 1248577 - RNA, 24 nt, Homo sapiens
uucuaguuuugucaaacuguagaa

SEQ ID NO: 1248578 - RNA, 20 nt, Homo sapiens
uucuauggccauuacuaaca

SEQ ID NO: 1248579 - RNA, 22 nt, Homo sapiens
uucuaugguuaugaaagaauau

SEQ ID NO: 1248580 - RNA, 16 nt, Homo sapiens
uucuauguccauucuc

SEQ ID NO: 1248581 - RNA, 14 nt, Homo sapiens
uucuauuaacuuua

SEQ ID NO: 1248582 - RNA, 14 nt, Homo sapiens
uucuauuuacuuga

SEQ ID NO: 1248583 - RNA, 21 nt, Homo sapiens
uucuauuuauauguacaugag

SEQ ID NO: 1248584 - RNA, 15 nt, Homo sapiens
uucucaaaguuaaaa

SEQ ID NO: 1248585 - RNA, 21 nt, Homo sapiens
uucucaaaguuaauucaccua

SEQ ID NO: 1248586 - RNA, 14 nt, Homo sapiens
uucucaagucccuu

SEQ ID NO: 1248587 - RNA, 14 nt, Homo sapiens
uucucacucagaug

SEQ ID NO: 1248588 - RNA, 21 nt, Homo sapiens
uucucagaaucucaaauaacu

SEQ ID NO: 1248589 - RNA, 19 nt, Homo sapiens
uucucagggcuccugccuu

SEQ ID NO: 1248590 - RNA, 21 nt, Homo sapiens
uucucagggcuccugccuucu

SEQ ID NO: 1248591 - RNA, 17 nt, Homo sapiens
uucucagguguugccaa

SEQ ID NO: 1248592 - RNA, 15 nt, Homo sapiens
gaagaaugcauucaa

SEQ ID NO: 1248593 - RNA, 16 nt, Homo sapiens
gaagacaaccaucaca

SEQ ID NO: 1248594 - RNA, 19 nt, Homo sapiens
gaagacagcugcuggguca

SEQ ID NO: 1248595 - RNA, 23 nt, Homo sapiens
gaagacauccugagcagugccag

SEQ ID NO: 1248596 - RNA, 17 nt, Homo sapiens
gaagaccagcuuugcag

SEQ ID NO: 1248597 - RNA, 21 nt, Homo sapiens
gaagaccaguccuguuugcag

SEQ ID NO: 1248598 - RNA, 12 nt, Homo sapiens
gaagacuggaag

SEQ ID NO: 1248599 - RNA, 17 nt, Homo sapiens
gaagagaaagcacgugu

SEQ ID NO: 1248600 - RNA, 15 nt, Homo sapiens
gaagaggaaagggag

SEQ ID NO: 1248601 - RNA, 20 nt, Homo sapiens
gaagagggagaagcaugaaa

SEQ ID NO: 1248602 - RNA, 16 nt, Homo sapiens
gaagauagaugcacuu

SEQ ID NO: 1248603 - RNA, 21 nt, Homo sapiens
gaagaucaacgccucacugaa

SEQ ID NO: 1248604 - RNA, 20 nt, Homo sapiens
gaagauccuagugaccaaau

SEQ ID NO: 1248605 - RNA, 14 nt, Homo sapiens
gaagauggauguaa

SEQ ID NO: 1248606 - RNA, 20 nt, Homo sapiens
gaagauguuuacucauugcc

SEQ ID NO: 1248607 - RNA, 14 nt, Homo sapiens
gaagcaaauuugug

SEQ ID NO: 1248608 - RNA, 16 nt, Homo sapiens
gaagcacagagggcua

SEQ ID NO: 1248609 - RNA, 19 nt, Homo sapiens
gaagcacagagggcuaggg

SEQ ID NO: 1248610 - RNA, 17 nt, Homo sapiens
gaagcacagcagcaucu

SEQ ID NO: 1248611 - RNA, 16 nt, Homo sapiens
gaagcaccccaugcca

SEQ ID NO: 1248612 - RNA, 19 nt, Homo sapiens
gaagcagccaucacaugau

SEQ ID NO: 1248613 - RNA, 17 nt, Homo sapiens
gaagcaggguacccuuu

SEQ ID NO: 1248614 - RNA, 18 nt, Homo sapiens
gaagcaggguacccuuug

SEQ ID NO: 1248615 - RNA, 23 nt, Homo sapiens
gaagcaguuuaugagacagcuga

SEQ ID NO: 1248616 - RNA, 16 nt, Homo sapiens
gaagcaguuucagaga

SEQ ID NO: 1248617 - RNA, 21 nt, Homo sapiens
gaagcaucacauaaaaaugau

SEQ ID NO: 1248618 - RNA, 19 nt, Homo sapiens
gaagcaugcuuugcugcua

SEQ ID NO: 1248619 - RNA, 18 nt, Homo sapiens
gaagcauuccuucuuuga

SEQ ID NO: 1248620 - RNA, 18 nt, Homo sapiens
gaagcauuugauuuucaa

SEQ ID NO: 1248621 - RNA, 15 nt, Homo sapiens
gaagccaagugggau

SEQ ID NO: 1248622 - RNA, 20 nt, Homo sapiens
gaagccacugaagcugggau

SEQ ID NO: 1248623 - RNA, 23 nt, Homo sapiens
gaagccauguacucaaguaccac

SEQ ID NO: 1248624 - RNA, 19 nt, Homo sapiens
gaagcccugauguguccuc

SEQ ID NO: 1248625 - RNA, 13 nt, Homo sapiens
gaagccucagcua

SEQ ID NO: 1248626 - RNA, 16 nt, Homo sapiens
gaagccucuggcuaga

SEQ ID NO: 1248627 - RNA, 22 nt, Homo sapiens
gaagccugcccuugucugagau

SEQ ID NO: 1248628 - RNA, 17 nt, Homo sapiens
gaagcgagauguguggc

SEQ ID NO: 1248629 - RNA, 21 nt, Homo sapiens
gaagcggauuuccagggauau

SEQ ID NO: 1248630 - RNA, 18 nt, Homo sapiens
gaagcguuaugugcagua

SEQ ID NO: 1248631 - RNA, 21 nt, Homo sapiens
gaagcuaauguaggacuguau

SEQ ID NO: 1248632 - RNA, 12 nt, Homo sapiens
gaagcucaucuc

SEQ ID NO: 1248633 - RNA, 13 nt, Homo sapiens
gaagcuccacugu

SEQ ID NO: 1248634 - RNA, 14 nt, Homo sapiens
gaagcuccacuguc

SEQ ID NO: 1248635 - RNA, 16 nt, Homo sapiens
gaagcuccacugucac

SEQ ID NO: 1248636 - RNA, 13 nt, Homo sapiens
gaagcucccagcu

SEQ ID NO: 1248637 - RNA, 22 nt, Homo sapiens
gaagcuccugggggaugcucua

SEQ ID NO: 1248638 - RNA, 15 nt, Homo sapiens
gaagcugcacaugug

SEQ ID NO: 1248639 - RNA, 16 nt, Homo sapiens
gaagcuggugcgcccu

SEQ ID NO: 1248640 - RNA, 19 nt, Homo sapiens
gaagcuuaaaaucugugaa

SEQ ID NO: 1248641 - RNA, 15 nt, Homo sapiens
gaaggaaaagcaaga

SEQ ID NO: 1248642 - RNA, 14 nt, Homo sapiens
gaaggaaaaugaua

SEQ ID NO: 1248643 - RNA, 23 nt, Homo sapiens
gaaggaaacggaagcugacauaa

SEQ ID NO: 1248644 - RNA, 13 nt, Homo sapiens
gaaggaaaugaca

SEQ ID NO: 1248645 - RNA, 22 nt, Homo sapiens
gaaggaacagcaauggugucag

SEQ ID NO: 1248646 - RNA, 21 nt, Homo sapiens
gaaggagaguccccugaaggu

SEQ ID NO: 1248647 - RNA, 19 nt, Homo sapiens
gaaggagcagucacuggga

SEQ ID NO: 1248648 - RNA, 20 nt, Homo sapiens
gaaggagguucuaauauuca

SEQ ID NO: 1248649 - RNA, 15 nt, Homo sapiens
gaaggauuacucucc

SEQ ID NO: 1248650 - RNA, 12 nt, Homo sapiens
gaaggcaaaauu

SEQ ID NO: 1248651 - RNA, 19 nt, Homo sapiens
gaaggcaagagggggugga

SEQ ID NO: 1248652 - RNA, 14 nt, Homo sapiens
gaaggcagagccau

SEQ ID NO: 1248653 - RNA, 11 nt, Homo sapiens
gaaggcagcug

SEQ ID NO: 1248654 - RNA, 18 nt, Homo sapiens
gaaggcaguggcagggga

SEQ ID NO: 1248655 - RNA, 14 nt, Homo sapiens
gaaggcauaugcac

SEQ ID NO: 1248656 - RNA, 14 nt, Homo sapiens
gaaggcuucugugu

SEQ ID NO: 1248657 - RNA, 12 nt, Homo sapiens
gaagggccaguc

SEQ ID NO: 1248658 - RNA, 17 nt, Homo sapiens
gaagggcgagugaaucu

SEQ ID NO: 1248659 - RNA, 19 nt, Homo sapiens
gaagggcucuuucucucug

SEQ ID NO: 1248660 - RNA, 11 nt, Homo sapiens
gaaggggccac

SEQ ID NO: 1248661 - RNA, 14 nt, Homo sapiens
gaaaauaucuugcu

SEQ ID NO: 1248662 - RNA, 18 nt, Homo sapiens
gaaaauaucuugcuuuca

SEQ ID NO: 1248663 - RNA, 16 nt, Homo sapiens
gaaaaucacacugucu

SEQ ID NO: 1248664 - RNA, 18 nt, Homo sapiens
gaaaaucacuugccaaaa

SEQ ID NO: 1248665 - RNA, 18 nt, Homo sapiens
gaaaauccuaacuuucag

SEQ ID NO: 1248666 - RNA, 17 nt, Homo sapiens
gaaaaugaaucuucaca

SEQ ID NO: 1248667 - RNA, 18 nt, Homo sapiens
gaaaaugaauuuuuucca

SEQ ID NO: 1248668 - RNA, 15 nt, Homo sapiens
gaaaaugacucuggg

SEQ ID NO: 1248669 - RNA, 14 nt, Homo sapiens
gaaaaugagaaaau

SEQ ID NO: 1248670 - RNA, 21 nt, Homo sapiens
gaaaaugagggccgcuuugag

SEQ ID NO: 1248671 - RNA, 12 nt, Homo sapiens
gaaaaugccuca

SEQ ID NO: 1248672 - RNA, 20 nt, Homo sapiens
gaaaaugccucaauucacau

SEQ ID NO: 1248673 - RNA, 20 nt, Homo sapiens
gaaaaugucagaaaccaguu

SEQ ID NO: 1248674 - RNA, 21 nt, Homo sapiens
gaaaauucuguagguucugug

SEQ ID NO: 1248675 - RNA, 12 nt, Homo sapiens
gaaaauugcaau

SEQ ID NO: 1248676 - RNA, 16 nt, Homo sapiens
gaaaauugcaauacau

SEQ ID NO: 1248677 - RNA, 18 nt, Homo sapiens
gaaaauuuuaccagcaga

SEQ ID NO: 1248678 - RNA, 16 nt, Homo sapiens
gaaaauuuuacuucca

SEQ ID NO: 1248679 - RNA, 18 nt, Homo sapiens
gaaaauuuuuacauucau

SEQ ID NO: 1248680 - RNA, 15 nt, Homo sapiens
gaaacaaacaucuaa

SEQ ID NO: 1248681 - RNA, 23 nt, Homo sapiens
gaaacaaauagcuguugacguuu

SEQ ID NO: 1248682 - RNA, 20 nt, Homo sapiens
gaaacacacaagcaacaaac

SEQ ID NO: 1248683 - RNA, 14 nt, Homo sapiens
gaaacacacaguca

SEQ ID NO: 1248684 - RNA, 23 nt, Homo sapiens
gaaacacaucuucccuagagggu

SEQ ID NO: 1248685 - RNA, 14 nt, Homo sapiens
gaaacacuuugccu

SEQ ID NO: 1248686 - RNA, 17 nt, Homo sapiens
gaaacagccauguccaa

SEQ ID NO: 1248687 - RNA, 16 nt, Homo sapiens
gaaacaguuucuugcu

SEQ ID NO: 1248688 - RNA, 17 nt, Homo sapiens
gaaacauacguucuuuu

SEQ ID NO: 1248689 - RNA, 17 nt, Homo sapiens
gaaacauauguucuccc

SEQ ID NO: 1248690 - RNA, 21 nt, Homo sapiens
gaaacauuauuagcacuuccc

SEQ ID NO: 1248691 - RNA, 16 nt, Homo sapiens
gaaaccaacacccaaa

SEQ ID NO: 1248692 - RNA, 18 nt, Homo sapiens
gaaaccagaaaagcaaua

SEQ ID NO: 1248693 - RNA, 13 nt, Homo sapiens
gaaacccaagcuc

SEQ ID NO: 1248694 - RNA, 13 nt, Homo sapiens
gaaacccacagau

SEQ ID NO: 1248695 - RNA, 15 nt, Homo sapiens
gaaacccucugucau

SEQ ID NO: 1248696 - RNA, 16 nt, Homo sapiens
gaaacccugagagucu

SEQ ID NO: 1248697 - RNA, 17 nt, Homo sapiens
gaaacccuugcugcuuu

SEQ ID NO: 1248698 - RNA, 14 nt, Homo sapiens
gaaaccucugccuu

SEQ ID NO: 1248699 - RNA, 20 nt, Homo sapiens
gaaaccuuauuguaccucuc

SEQ ID NO: 1248700 - RNA, 14 nt, Homo sapiens
gaaacggauccagc

SEQ ID NO: 1248701 - RNA, 20 nt, Homo sapiens
gaaacuaauauuuuauguga

SEQ ID NO: 1248702 - RNA, 24 nt, Homo sapiens
gaaacuauuucuguuccagucaca

SEQ ID NO: 1248703 - RNA, 14 nt, Homo sapiens
gaaacucaaaaaua

SEQ ID NO: 1248704 - RNA, 15 nt, Homo sapiens
gaaacucacacuccc

SEQ ID NO: 1248705 - RNA, 20 nt, Homo sapiens
gaaacuccaaaguccacaca

SEQ ID NO: 1248706 - RNA, 22 nt, Homo sapiens
gaaacugauuucuucagaauua

SEQ ID NO: 1248707 - RNA, 17 nt, Homo sapiens
gaaacugcuaaauucua

SEQ ID NO: 1248708 - RNA, 20 nt, Homo sapiens
gaaacuggaauaaguguuua

SEQ ID NO: 1248709 - RNA, 14 nt, Homo sapiens
gaaacuggcacuga

SEQ ID NO: 1248710 - RNA, 16 nt, Homo sapiens
gaaacuguuaucacuu

SEQ ID NO: 1248711 - RNA, 19 nt, Homo sapiens
gaaagaaauuuggcuauaa

SEQ ID NO: 1248712 - RNA, 14 nt, Homo sapiens
gaaagaaguaggca

SEQ ID NO: 1248713 - RNA, 17 nt, Homo sapiens
gaaagaaguuauauucu

SEQ ID NO: 1248714 - RNA, 21 nt, Homo sapiens
gaaagauugauuaaugaacua

SEQ ID NO: 1248715 - RNA, 21 nt, Homo sapiens
gaaagauuuucuccacagugu

SEQ ID NO: 1248716 - RNA, 18 nt, Homo sapiens
gaaagcaaguguucacaa

SEQ ID NO: 1248717 - RNA, 14 nt, Homo sapiens
gaaagcaggggcua

SEQ ID NO: 1248718 - RNA, 18 nt, Homo sapiens
gaaagcauaaagcucaaa

SEQ ID NO: 1248719 - RNA, 18 nt, Homo sapiens
gaaagcauaacaaaaaga

SEQ ID NO: 1248720 - RNA, 17 nt, Homo sapiens
gaaagccauucuggaca

SEQ ID NO: 1248721 - RNA, 14 nt, Homo sapiens
gaaagccauugacc

SEQ ID NO: 1248722 - RNA, 19 nt, Homo sapiens
gaaagcucacuguagcuuu

SEQ ID NO: 1248723 - RNA, 22 nt, Homo sapiens
gaaagcuguggccagcuuguua

SEQ ID NO: 1248724 - RNA, 18 nt, Homo sapiens
gaaagcuucaaacugcau

SEQ ID NO: 1248725 - RNA, 21 nt, Homo sapiens
gaaaggaaauaguaccuucaa

SEQ ID NO: 1248726 - RNA, 20 nt, Homo sapiens
gaaaggaagcuccacuguca

SEQ ID NO: 1248727 - RNA, 14 nt, Homo sapiens
gaaaggagacuaga

SEQ ID NO: 1248728 - RNA, 22 nt, Homo sapiens
gaaaggcuuggcacacagcagg

SEQ ID NO: 1248729 - RNA, 17 nt, Homo sapiens
gaaagggaagcacauga

SEQ ID NO: 1248730 - RNA, 16 nt, Homo sapiens
gaaagggauaguccaa

SEQ ID NO: 1248731 - RNA, 15 nt, Homo sapiens
gaaaggggaaugugg

SEQ ID NO: 1248732 - RNA, 21 nt, Homo sapiens
gaaagggguuggggugacagu

SEQ ID NO: 1248733 - RNA, 19 nt, Homo sapiens
gaaaggugaggagggcagu

SEQ ID NO: 1248734 - RNA, 16 nt, Homo sapiens
gaaagguuauguuagc

SEQ ID NO: 1248735 - RNA, 20 nt, Homo sapiens
gaaaguaaaaaguugcuucu

SEQ ID NO: 1248736 - RNA, 12 nt, Homo sapiens
gaaaguucuuaa

SEQ ID NO: 1248737 - RNA, 13 nt, Homo sapiens
gaaauaaaacuac

SEQ ID NO: 1248738 - RNA, 14 nt, Homo sapiens
gaaauaaacacugg

SEQ ID NO: 1248739 - RNA, 16 nt, Homo sapiens
gaaauaaacuucacug

SEQ ID NO: 1248740 - RNA, 14 nt, Homo sapiens
agaaggaacaauaa

SEQ ID NO: 1248741 - RNA, 14 nt, Homo sapiens
agaaggcaaaaaug

SEQ ID NO: 1248742 - RNA, 18 nt, Homo sapiens
agaagggaauccuccucc

SEQ ID NO: 1248743 - RNA, 17 nt, Homo sapiens
agaagggauaacccuac

SEQ ID NO: 1248744 - RNA, 13 nt, Homo sapiens
aggcuuaucaaaa

SEQ ID NO: 1248745 - RNA, 19 nt, Homo sapiens
aggcuucuacagacuguag

SEQ ID NO: 1248746 - RNA, 11 nt, Homo sapiens
aggcuuggcac

SEQ ID NO: 1248747 - RNA, 19 nt, Homo sapiens
aggcuuguuuaccuuucuc

SEQ ID NO: 1248748 - RNA, 19 nt, Homo sapiens
aggcuuugaguuaacucac

SEQ ID NO: 1248749 - RNA, 21 nt, Homo sapiens
aggcuuuguacagagugcuuu

SEQ ID NO: 1248750 - RNA, 20 nt, Homo sapiens
aggcuuuuaagaaacacagg

SEQ ID NO: 1248751 - RNA, 21 nt, Homo sapiens
agggaaaaggguucaacaaag

SEQ ID NO: 1248752 - RNA, 18 nt, Homo sapiens
agggaaaaguucuccuau

SEQ ID NO: 1248753 - RNA, 13 nt, Homo sapiens
agggaaagugcau

SEQ ID NO: 1248754 - RNA, 22 nt, Homo sapiens
agggaaagugcauaugaaaucc

SEQ ID NO: 1248755 - RNA, 18 nt, Homo sapiens
agggaagccccacuugaa

SEQ ID NO: 1248756 - RNA, 22 nt, Homo sapiens
agggaagcugucccucacuguu

SEQ ID NO: 1248757 - RNA, 17 nt, Homo sapiens
agggaaggugaagauga

SEQ ID NO: 1248758 - RNA, 14 nt, Homo sapiens
agggaauccagcuc

SEQ ID NO: 1248759 - RNA, 15 nt, Homo sapiens
agggacaagggauuc

SEQ ID NO: 1248760 - RNA, 13 nt, Homo sapiens
agggacagaauua

SEQ ID NO: 1248761 - RNA, 16 nt, Homo sapiens
agggacaggcacucca

SEQ ID NO: 1248762 - RNA, 21 nt, Homo sapiens
agggaccacacccuguacugu

SEQ ID NO: 1248763 - RNA, 22 nt, Homo sapiens
agggacccagccuucagucaca

SEQ ID NO: 1248764 - RNA, 14 nt, Homo sapiens
agggacuccaugcu

SEQ ID NO: 1248765 - RNA, 18 nt, Homo sapiens
aguauuuaggauaaccuu

SEQ ID NO: 1248766 - RNA, 15 nt, Homo sapiens
aguauuucuguggau

SEQ ID NO: 1248767 - RNA, 23 nt, Homo sapiens
aguauuugggaagugaagacugg

SEQ ID NO: 1248768 - RNA, 15 nt, Homo sapiens
agucaaauuuguaaa

SEQ ID NO: 1248769 - RNA, 16 nt, Homo sapiens
agucaacgccucggug

SEQ ID NO: 1248770 - RNA, 21 nt, Homo sapiens
agucaagucaccaugcugaau

SEQ ID NO: 1248771 - RNA, 18 nt, Homo sapiens
agucacaaagaguucugg

SEQ ID NO: 1248772 - RNA, 20 nt, Homo sapiens
agucacacacacauacaaaa

SEQ ID NO: 1248773 - RNA, 22 nt, Homo sapiens
agucacauggccuaugcacaua

SEQ ID NO: 1248774 - RNA, 14 nt, Homo sapiens
agucacauugccau

SEQ ID NO: 1248775 - RNA, 12 nt, Homo sapiens
agucacgcuggg

SEQ ID NO: 1248776 - RNA, 17 nt, Homo sapiens
agucacugccacuuugc

SEQ ID NO: 1248777 - RNA, 23 nt, Homo sapiens
agucacuggagguugaagccaag

SEQ ID NO: 1248778 - RNA, 11 nt, Homo sapiens
agucacuguag

SEQ ID NO: 1248779 - RNA, 16 nt, Homo sapiens
agucacuuauugucca

SEQ ID NO: 1248780 - RNA, 21 nt, Homo sapiens
agucaggaauggcugcaccuu

SEQ ID NO: 1248781 - RNA, 13 nt, Homo sapiens
agucaggcccuga

SEQ ID NO: 1248782 - RNA, 15 nt, Homo sapiens
agucagugucuggcu

SEQ ID NO: 1248783 - RNA, 17 nt, Homo sapiens
agucauaucaaagggua

SEQ ID NO: 1248784 - RNA, 22 nt, Homo sapiens
agucauauuuugauuauuguau

SEQ ID NO: 1248785 - RNA, 21 nt, Homo sapiens
agucaucacauuucuaugcca

SEQ ID NO: 1248786 - RNA, 16 nt, Homo sapiens
agucaucccagugcac

SEQ ID NO: 1248787 - RNA, 16 nt, Homo sapiens
agucaucucauuccac

SEQ ID NO: 1248788 - RNA, 22 nt, Homo sapiens
agucauggagaaucugcugcau

SEQ ID NO: 1248789 - RNA, 17 nt, Homo sapiens
agucauggcuaauuuaa

SEQ ID NO: 1248790 - RNA, 19 nt, Homo sapiens
agucauggcuaauuuaaca

SEQ ID NO: 1248791 - RNA, 18 nt, Homo sapiens
agucauuggaauaaggca

SEQ ID NO: 1248792 - RNA, 19 nt, Homo sapiens
agucauuugcugagcaugu

SEQ ID NO: 1248793 - RNA, 21 nt, Homo sapiens
agucauuugcugagcauguac

SEQ ID NO: 1248794 - RNA, 20 nt, Homo sapiens
aguccaauuccaaagccaga

SEQ ID NO: 1248795 - RNA, 16 nt, Homo sapiens
aguccacaaagcauuu

SEQ ID NO: 1248796 - RNA, 16 nt, Homo sapiens
aguccacaguacauaa

SEQ ID NO: 1248797 - RNA, 17 nt, Homo sapiens
aguccaccucccauuac

SEQ ID NO: 1248798 - RNA, 23 nt, Homo sapiens
aguccaccucccauuacuuugau

SEQ ID NO: 1248799 - RNA, 15 nt, Homo sapiens
aguccacuguggcac

SEQ ID NO: 1248800 - RNA, 20 nt, Homo sapiens
aguccagagcuggaucucuc

SEQ ID NO: 1248801 - RNA, 15 nt, Homo sapiens
aguccagcacuggaa

SEQ ID NO: 1248802 - RNA, 18 nt, Homo sapiens
aguccaucuaacaucaua

SEQ ID NO: 1248803 - RNA, 16 nt, Homo sapiens
agucccaaaacccuua

SEQ ID NO: 1248804 - RNA, 22 nt, Homo sapiens
agucccagacaauuccauucaa

SEQ ID NO: 1248805 - RNA, 17 nt, Homo sapiens
agucccagagcaccuca

SEQ ID NO: 1248806 - RNA, 16 nt, Homo sapiens
agucccagcuacuuga

SEQ ID NO: 1248807 - RNA, 18 nt, Homo sapiens
agucccaguauaccucau

SEQ ID NO: 1248808 - RNA, 14 nt, Homo sapiens
agucccaguauucu

SEQ ID NO: 1248809 - RNA, 12 nt, Homo sapiens
agucccauucau

SEQ ID NO: 1248810 - RNA, 17 nt, Homo sapiens
agucccccuggucugaa

SEQ ID NO: 1248811 - RNA, 20 nt, Homo sapiens
aguccccucaccuccucuaa

SEQ ID NO: 1248812 - RNA, 19 nt, Homo sapiens
agucccgucccugcccaga

SEQ ID NO: 1248813 - RNA, 21 nt, Homo sapiens
agucccucaugcaaaucaauu

SEQ ID NO: 1248814 - RNA, 23 nt, Homo sapiens
agucccugacucucugugaccug

SEQ ID NO: 1248815 - RNA, 18 nt, Homo sapiens
aguccgcagucuggccug

SEQ ID NO: 1248816 - RNA, 15 nt, Homo sapiens
aguccuaaggccuua

SEQ ID NO: 1248817 - RNA, 17 nt, Homo sapiens
aguccuacaagcuaaaa

SEQ ID NO: 1248818 - RNA, 18 nt, Homo sapiens
aguccuacccugaaccua

SEQ ID NO: 1248819 - RNA, 17 nt, Homo sapiens
aguccugacacuauuca

SEQ ID NO: 1248820 - RNA, 20 nt, Homo sapiens
aguccuggaagccagcuuuc

SEQ ID NO: 1248821 - RNA, 13 nt, Homo sapiens
aguccugggagac

SEQ ID NO: 1248822 - RNA, 19 nt, Homo sapiens
aguccuggucccucugagg

SEQ ID NO: 1248823 - RNA, 23 nt, Homo sapiens
agucgauuauuuccaguguucua

SEQ ID NO: 1248824 - RNA, 21 nt, Homo sapiens
agucgcaggauccgcugccac

SEQ ID NO: 1248825 - RNA, 23 nt, Homo sapiens
agucggauacccuggagcaagac

SEQ ID NO: 1248826 - RNA, 23 nt, Homo sapiens
agucgugccuguuugcuuagcau

SEQ ID NO: 1248827 - RNA, 18 nt, Homo sapiens
agucguggggugugcugg

SEQ ID NO: 1248828 - RNA, 12 nt, Homo sapiens
agucuauucugu

SEQ ID NO: 1248829 - RNA, 13 nt, Homo sapiens
agucucaccuuca

SEQ ID NO: 1248830 - RNA, 16 nt, Homo sapiens
agucucacuguugccc

SEQ ID NO: 1248831 - RNA, 15 nt, Homo sapiens
agucucauagguuaa

SEQ ID NO: 1248832 - RNA, 15 nt, Homo sapiens
agucucccacuaaaa

SEQ ID NO: 1248833 - RNA, 16 nt, Homo sapiens
agucuccucacucugu

SEQ ID NO: 1248834 - RNA, 20 nt, Homo sapiens
agucucuucuaagcaaaauu

SEQ ID NO: 1248835 - RNA, 22 nt, Homo sapiens
agucucuuuaaucuucaguuuu

SEQ ID NO: 1248836 - RNA, 18 nt, Homo sapiens
agucucuuuucuuuagag

SEQ ID NO: 1248837 - RNA, 23 nt, Homo sapiens
agucugcccacgcagaggacgca

SEQ ID NO: 1248838 - RNA, 16 nt, Homo sapiens
agucugccucuuccuc

SEQ ID NO: 1248839 - RNA, 21 nt, Homo sapiens
agucugcuacccucauuucuc

SEQ ID NO: 1248840 - RNA, 22 nt, Homo sapiens
agucugcuacccucauuucuca

SEQ ID NO: 1248841 - RNA, 20 nt, Homo sapiens
agucugcucacaguaaccca

SEQ ID NO: 1248842 - RNA, 14 nt, Homo sapiens
agucugcugcugug

SEQ ID NO: 1248843 - RNA, 17 nt, Homo sapiens
agucuggaaagugaugu

SEQ ID NO: 1248844 - RNA, 14 nt, Homo sapiens
agucuguaccucaa

SEQ ID NO: 1248845 - RNA, 18 nt, Homo sapiens
agucugugagugcgucug

SEQ ID NO: 1248846 - RNA, 17 nt, Homo sapiens
agucuuauuuccucaac

SEQ ID NO: 1248847 - RNA, 20 nt, Homo sapiens
agucuucaacauaacccacu

SEQ ID NO: 1248848 - RNA, 20 nt, Homo sapiens
agucuucagcagagaaguuu

SEQ ID NO: 1248849 - RNA, 14 nt, Homo sapiens
agucuuccaugacc

SEQ ID NO: 1248850 - RNA, 19 nt, Homo sapiens
agucuucucauagcauuaa

SEQ ID NO: 1248851 - RNA, 21 nt, Homo sapiens
agucuucucauagcauuaacu

SEQ ID NO: 1248852 - RNA, 14 nt, Homo sapiens
agucuucugggcug

SEQ ID NO: 1248853 - RNA, 21 nt, Homo sapiens
agucuuggaaaaaaaccacag

SEQ ID NO: 1248854 - RNA, 20 nt, Homo sapiens
agucuugggucuaugccuug

SEQ ID NO: 1248855 - RNA, 23 nt, Homo sapiens
agucuugguuucucucuacagug

SEQ ID NO: 1248856 - RNA, 12 nt, Homo sapiens
agucuuucccaa

SEQ ID NO: 1248857 - RNA, 18 nt, Homo sapiens
agugaaacuccaucucaa

SEQ ID NO: 1248858 - RNA, 16 nt, Homo sapiens
agugaaagccagauuc

SEQ ID NO: 1248859 - RNA, 21 nt, Homo sapiens
agugaaauaauuaaaaaccac

SEQ ID NO: 1248860 - RNA, 16 nt, Homo sapiens
agugaaauauaugcua

SEQ ID NO: 1248861 - RNA, 20 nt, Homo sapiens
agugaacauucgaccuccau

SEQ ID NO: 1248862 - RNA, 23 nt, Homo sapiens
agugaacuauuucuacacagugg

SEQ ID NO: 1248863 - RNA, 14 nt, Homo sapiens
agugaagacuggaa

SEQ ID NO: 1248864 - RNA, 21 nt, Homo sapiens
agugaagcuaauuaaacacau

SEQ ID NO: 1248865 - RNA, 19 nt, Homo sapiens
agugaagucaugaccucca

SEQ ID NO: 1248866 - RNA, 19 nt, Homo sapiens
agugaauccugaaacuggu

SEQ ID NO: 1248867 - RNA, 13 nt, Homo sapiens
agugaaugcacug

SEQ ID NO: 1248868 - RNA, 16 nt, Homo sapiens
agugaauuacagacaa

SEQ ID NO: 1248869 - RNA, 14 nt, Homo sapiens
agugacacagcagc

SEQ ID NO: 1248870 - RNA, 15 nt, Homo sapiens
agugacacagcagcu

SEQ ID NO: 1248871 - RNA, 12 nt, Homo sapiens
agugacagucag

SEQ ID NO: 1248872 - RNA, 19 nt, Homo sapiens
agugacauaauauauucua

SEQ ID NO: 1248873 - RNA, 21 nt, Homo sapiens
agugaccaaaggugugcccug

SEQ ID NO: 1248874 - RNA, 21 nt, Homo sapiens
agugaccuggaaucagugaag

SEQ ID NO: 1248875 - RNA, 21 nt, Homo sapiens
agugaccuuuucuucauuuug

SEQ ID NO: 1248876 - RNA, 16 nt, Homo sapiens
agugacuccaagaaca

SEQ ID NO: 1248877 - RNA, 13 nt, Homo sapiens
agugacuggugcc

SEQ ID NO: 1248878 - RNA, 20 nt, Homo sapiens
agugacuggugccaguguca

SEQ ID NO: 1248879 - RNA, 17 nt, Homo sapiens
agugacuguuuggcuua

SEQ ID NO: 1248880 - RNA, 22 nt, Homo sapiens
agugacuguuuggcuuauaaac

SEQ ID NO: 1248881 - RNA, 22 nt, Homo sapiens
agugacuugugucccaugaucc

SEQ ID NO: 1248882 - RNA, 22 nt, Homo sapiens
agugagacaaaaagcacuagua

SEQ ID NO: 1248883 - RNA, 20 nt, Homo sapiens
agugagauauuugguaccau

SEQ ID NO: 1248884 - RNA, 12 nt, Homo sapiens
agugagcacuag

SEQ ID NO: 1248885 - RNA, 14 nt, Homo sapiens
agugagcuggugac

SEQ ID NO: 1248886 - RNA, 16 nt, Homo sapiens
agugagcugugaucac

SEQ ID NO: 1248887 - RNA, 21 nt, Homo sapiens
agugaggaagccuauuugaac

SEQ ID NO: 1248888 - RNA, 11 nt, Homo sapiens
agugaguucaa

SEQ ID NO: 1248889 - RNA, 14 nt, Homo sapiens
agugauaugcauuu

SEQ ID NO: 1248890 - RNA, 16 nt, Homo sapiens
agugaugugugagcua

SEQ ID NO: 1248891 - RNA, 14 nt, Homo sapiens
aaaaugcugucaca

SEQ ID NO: 1248892 - RNA, 11 nt, Homo sapiens
aaaauggaacu

SEQ ID NO: 1248893 - RNA, 22 nt, Homo sapiens
aaaaugggagacagccucuuac

SEQ ID NO: 1248894 - RNA, 23 nt, Homo sapiens
aaaauguacucagcuaucagcuc

SEQ ID NO: 1248895 - RNA, 13 nt, Homo sapiens
aaaauguccauga

SEQ ID NO: 1248896 - RNA, 23 nt, Homo sapiens
aaaaugucuaagauaguaacaau

SEQ ID NO: 1248897 - RNA, 21 nt, Homo sapiens
aaaaugucucuuguggcccau

SEQ ID NO: 1248898 - RNA, 21 nt, Homo sapiens
aaaaugugaauugcaugacuu

SEQ ID NO: 1248899 - RNA, 23 nt, Homo sapiens
aaaauguucuguuugcuguggaa

SEQ ID NO: 1248900 - RNA, 16 nt, Homo sapiens
aaaauguuuaccagug

SEQ ID NO: 1248901 - RNA, 15 nt, Homo sapiens
aaaauuaaacaaaua

SEQ ID NO: 1248902 - RNA, 15 nt, Homo sapiens
aaaauuagacuguga

SEQ ID NO: 1248903 - RNA, 13 nt, Homo sapiens
aaaauuagccagg

SEQ ID NO: 1248904 - RNA, 17 nt, Homo sapiens
aaaauucagagaguuag

SEQ ID NO: 1248905 - RNA, 18 nt, Homo sapiens
aaaauucauuucuaauua

SEQ ID NO: 1248906 - RNA, 17 nt, Homo sapiens
aaaauuccaaauucaug

SEQ ID NO: 1248907 - RNA, 18 nt, Homo sapiens
aaaauuccucuuacugua

SEQ ID NO: 1248908 - RNA, 20 nt, Homo sapiens
aaaauucuauguuaauuaca

SEQ ID NO: 1248909 - RNA, 15 nt, Homo sapiens
aaaauucucuuaaac

SEQ ID NO: 1248910 - RNA, 20 nt, Homo sapiens
aaaauucucuuaaaccacag

SEQ ID NO: 1248911 - RNA, 22 nt, Homo sapiens
aaaauugagaccugagugaaga

SEQ ID NO: 1248912 - RNA, 13 nt, Homo sapiens
aaaauugauauac

SEQ ID NO: 1248913 - RNA, 15 nt, Homo sapiens
aaaauugcacuuuua

SEQ ID NO: 1248914 - RNA, 17 nt, Homo sapiens
aaaauugcuauguuacu

SEQ ID NO: 1248915 - RNA, 22 nt, Homo sapiens
aaaauugcuucuuuaccaagga

SEQ ID NO: 1248916 - RNA, 15 nt, Homo sapiens
aaaauuuagcccuuu

SEQ ID NO: 1248917 - RNA, 16 nt, Homo sapiens
aaaauuugagacuauu

SEQ ID NO: 1248918 - RNA, 15 nt, Homo sapiens
aaaauuuuacuucca

SEQ ID NO: 1248919 - RNA, 12 nt, Homo sapiens
aaaauuuugcuu

SEQ ID NO: 1248920 - RNA, 18 nt, Homo sapiens
aaaauuuuguauguuaaa

SEQ ID NO: 1248921 - RNA, 16 nt, Homo sapiens
aaaauuuuuacauuca

SEQ ID NO: 1248922 - RNA, 21 nt, Homo sapiens
aaaauuuuuuuuguaacugga

SEQ ID NO: 1248923 - RNA, 12 nt, Homo sapiens
aaacaaaaagcc

SEQ ID NO: 1248924 - RNA, 18 nt, Homo sapiens
aaacaaaaaucuguguaa

SEQ ID NO: 1248925 - RNA, 13 nt, Homo sapiens
aaacaaauaugca

SEQ ID NO: 1248926 - RNA, 14 nt, Homo sapiens
aaacaaaugcuccu

SEQ ID NO: 1248927 - RNA, 19 nt, Homo sapiens
aaacaacccaacccacgag

SEQ ID NO: 1248928 - RNA, 20 nt, Homo sapiens
aaacaacuucaauauccaaa

SEQ ID NO: 1248929 - RNA, 18 nt, Homo sapiens
aaacaaggggcuguuaca

SEQ ID NO: 1248930 - RNA, 16 nt, Homo sapiens
aaacaauaucauauca

SEQ ID NO: 1248931 - RNA, 18 nt, Homo sapiens
aaacaaugaaaacucuuu

SEQ ID NO: 1248932 - RNA, 13 nt, Homo sapiens
aaacacacucaaa

SEQ ID NO: 1248933 - RNA, 12 nt, Homo sapiens
aaacacagagaa

SEQ ID NO: 1248934 - RNA, 22 nt, Homo sapiens
aaacacaucuggccuaauguuc

SEQ ID NO: 1248935 - RNA, 21 nt, Homo sapiens
aaacacccgacgucauguauu

SEQ ID NO: 1248936 - RNA, 17 nt, Homo sapiens
aaacaccgcuucugccu

SEQ ID NO: 1248937 - RNA, 17 nt, Homo sapiens
aaacagaacugcaguca

SEQ ID NO: 1248938 - RNA, 22 nt, Homo sapiens
aaacagagccuccuagauguaa

SEQ ID NO: 1248939 - RNA, 14 nt, Homo sapiens
aaacagaguauguc

SEQ ID NO: 1248940 - RNA, 15 nt, Homo sapiens
aaacagccaugucca

SEQ ID NO: 1248941 - RNA, 22 nt, Homo sapiens
aaacaggcaguuggccagagag

SEQ ID NO: 1248942 - RNA, 13 nt, Homo sapiens
aaacagggcaaag

SEQ ID NO: 1248943 - RNA, 22 nt, Homo sapiens
aaacaggguuugauagcacuua

SEQ ID NO: 1248944 - RNA, 24 nt, Homo sapiens
aaacaggguuugauagcacuuaaa

SEQ ID NO: 1248945 - RNA, 21 nt, Homo sapiens
aaacagguuauaacaguguuu

SEQ ID NO: 1248946 - RNA, 14 nt, Homo sapiens
aaacaguuuuccaa

SEQ ID NO: 1248947 - RNA, 23 nt, Homo sapiens
aaacauaauaaaucacacauuca

SEQ ID NO: 1248948 - RNA, 14 nt, Homo sapiens
aaacauagcaucuc

SEQ ID NO: 1248949 - RNA, 17 nt, Homo sapiens
aaacauagcaucucagg

SEQ ID NO: 1248950 - RNA, 16 nt, Homo sapiens
aaacauauucaaagca

SEQ ID NO: 1248951 - RNA, 18 nt, Homo sapiens
aaacauauuggaauguac

SEQ ID NO: 1248952 - RNA, 20 nt, Homo sapiens
aaacaucuuuccaguccuug

SEQ ID NO: 1248953 - RNA, 15 nt, Homo sapiens
aaacaugaguuauuc

SEQ ID NO: 1248954 - RNA, 16 nt, Homo sapiens
aaacaugauuguuuac

SEQ ID NO: 1248955 - RNA, 17 nt, Homo sapiens
aaacaugauuguuuaca

SEQ ID NO: 1248956 - RNA, 15 nt, Homo sapiens
aaacaugcacgguga

SEQ ID NO: 1248957 - RNA, 16 nt, Homo sapiens
aaacauguaugugcau

SEQ ID NO: 1248958 - RNA, 23 nt, Homo sapiens
aaacauguauuuauguaaugaag

SEQ ID NO: 1248959 - RNA, 20 nt, Homo sapiens
aaaaauauuguuucugcauu

SEQ ID NO: 1248960 - RNA, 11 nt, Homo sapiens
aaaaauccauu

SEQ ID NO: 1248961 - RNA, 20 nt, Homo sapiens
aaaaaucuuuucauuaaaga

SEQ ID NO: 1248962 - RNA, 22 nt, Homo sapiens
aaaaaugcugcuucuccuccca

SEQ ID NO: 1248963 - RNA, 21 nt, Homo sapiens
aaaaauggacaaaauccauga

SEQ ID NO: 1248964 - RNA, 23 nt, Homo sapiens
aaaaauggauacuggugcaguca

SEQ ID NO: 1248965 - RNA, 14 nt, Homo sapiens
aaaaauguaucaaa

SEQ ID NO: 1248966 - RNA, 15 nt, Homo sapiens
aaaaauguccugccu

SEQ ID NO: 1248967 - RNA, 21 nt, Homo sapiens
aaaaauguguuccauugccau

SEQ ID NO: 1248968 - RNA, 20 nt, Homo sapiens
aaaaauuagcaugcugcuuu

SEQ ID NO: 1248969 - RNA, 20 nt, Homo sapiens
aaaaauucuguuguuccauu

SEQ ID NO: 1248970 - RNA, 21 nt, Homo sapiens
aaaaauuguaucucauuacuu

SEQ ID NO: 1248971 - RNA, 18 nt, Homo sapiens
aaaaauuuaagcauuguu

SEQ ID NO: 1248972 - RNA, 18 nt, Homo sapiens
aaaaauuugaacacuggc

SEQ ID NO: 1248973 - RNA, 13 nt, Homo sapiens
aaaacacagguuu

SEQ ID NO: 1248974 - RNA, 15 nt, Homo sapiens
aaaacacaucuuucc

SEQ ID NO: 1248975 - RNA, 14 nt, Homo sapiens
aaaacaccaugaaa

SEQ ID NO: 1248976 - RNA, 18 nt, Homo sapiens
aaaacacugcccucuugu

SEQ ID NO: 1248977 - RNA, 23 nt, Homo sapiens
aaaacagaacaucauuagaacaa

SEQ ID NO: 1248978 - RNA, 18 nt, Homo sapiens
aaaacagagaugugauaa

SEQ ID NO: 1248979 - RNA, 15 nt, Homo sapiens
aaaacaggucuucau

SEQ ID NO: 1248980 - RNA, 23 nt, Homo sapiens
aaaacaguuuugucagucuuucu

SEQ ID NO: 1248981 - RNA, 17 nt, Homo sapiens
aaaacauaaaaaccaaa

SEQ ID NO: 1248982 - RNA, 11 nt, Homo sapiens
aaaacauguau

SEQ ID NO: 1248983 - RNA, 16 nt, Homo sapiens
aaaacauguaugugca

SEQ ID NO: 1248984 - RNA, 11 nt, Homo sapiens
aaaacauuccc

SEQ ID NO: 1248985 - RNA, 12 nt, Homo sapiens
aaaacauuugcu

SEQ ID NO: 1248986 - RNA, 11 nt, Homo sapiens
aaaaccaauga

SEQ ID NO: 1248987 - RNA, 15 nt, Homo sapiens
aaaaccacagccacu

SEQ ID NO: 1248988 - RNA, 19 nt, Homo sapiens
aaaacccaggacaucuccu

SEQ ID NO: 1248989 - RNA, 14 nt, Homo sapiens
aaaaccccaucucu

SEQ ID NO: 1248990 - RNA, 18 nt, Homo sapiens
aaaaccccaucucuacua

SEQ ID NO: 1248991 - RNA, 18 nt, Homo sapiens
aaaaccuuucaaauuuca

SEQ ID NO: 1248992 - RNA, 14 nt, Homo sapiens
aaaacuaaccaucu

SEQ ID NO: 1248993 - RNA, 13 nt, Homo sapiens
aaaacuaagcaca

SEQ ID NO: 1248994 - RNA, 15 nt, Homo sapiens
aaaacuaagcacaaa

SEQ ID NO: 1248995 - RNA, 11 nt, Homo sapiens
aaaacucucug

SEQ ID NO: 1248996 - RNA, 21 nt, Homo sapiens
aaaacucugguaaaugaucac

SEQ ID NO: 1248997 - RNA, 18 nt, Homo sapiens
aaaacucuucagugcaaa

SEQ ID NO: 1248998 - RNA, 19 nt, Homo sapiens
aaaacugaaaaucuaauau

SEQ ID NO: 1248999 - RNA, 19 nt, Homo sapiens
aaaacugacaguaaaucuc

SEQ ID NO: 1249000 - RNA, 16 nt, Homo sapiens
aaaacugacauagaga

SEQ ID NO: 1249001 - RNA, 18 nt, Homo sapiens
aaaacugcacagugcugu

SEQ ID NO: 1249002 - RNA, 22 nt, Homo sapiens
aaaacuggguaugcguuucaug

SEQ ID NO: 1249003 - RNA, 17 nt, Homo sapiens
aaaacuguguugccaca

SEQ ID NO: 1249004 - RNA, 14 nt, Homo sapiens
aaaacuuaacauuc

SEQ ID NO: 1249005 - RNA, 12 nt, Homo sapiens
aaaacuuaucac

SEQ ID NO: 1249006 - RNA, 14 nt, Homo sapiens
aaaacuucuuguca

SEQ ID NO: 1249007 - RNA, 17 nt, Homo sapiens
aaaacuuuaaugaacua

SEQ ID NO: 1249008 - RNA, 21 nt, Homo sapiens
aaaacuuuaggcccugcccca

SEQ ID NO: 1249009 - RNA, 21 nt, Homo sapiens
aaaacuuuggaguccccucac

SEQ ID NO: 1249010 - RNA, 12 nt, Homo sapiens
aaaagaacauaa

SEQ ID NO: 1249011 - RNA, 12 nt, Homo sapiens
aaaagaaccaaa

SEQ ID NO: 1249012 - RNA, 18 nt, Homo sapiens
aaaagaaccgagcaauuu

SEQ ID NO: 1249013 - RNA, 15 nt, Homo sapiens
aaaagaagacauucu

SEQ ID NO: 1249014 - RNA, 22 nt, Homo sapiens
aaaagaagaccguuuaccuaga

SEQ ID NO: 1249015 - RNA, 15 nt, Homo sapiens
aaaagaagacucuga

SEQ ID NO: 1249016 - RNA, 15 nt, Homo sapiens
aaaagacacagaaca

SEQ ID NO: 1249017 - RNA, 15 nt, Homo sapiens
aaaagacauguugua

SEQ ID NO: 1249018 - RNA, 13 nt, Homo sapiens
aaaagaccuauga

SEQ ID NO: 1249019 - RNA, 20 nt, Homo sapiens
aaaagacucugaccagagau

SEQ ID NO: 1249020 - RNA, 12 nt, Homo sapiens
aaaagacugaau

SEQ ID NO: 1249021 - RNA, 15 nt, Homo sapiens
aaaagacugaaucua

SEQ ID NO: 1249022 - RNA, 13 nt, Homo sapiens
acuaggacacucc

SEQ ID NO: 1249023 - RNA, 23 nt, Homo sapiens
acuaggcucuuaugugugccuuu

SEQ ID NO: 1249024 - RNA, 15 nt, Homo sapiens
acuagggaagcucag

SEQ ID NO: 1249025 - RNA, 20 nt, Homo sapiens
acuaguucagacacuuugga

SEQ ID NO: 1249026 - RNA, 20 nt, Homo sapiens
acuauaaucaaaugauuuca

SEQ ID NO: 1249027 - RNA, 16 nt, Homo sapiens
acuauacccgggacca

SEQ ID NO: 1249028 - RNA, 22 nt, Homo sapiens
acuauagccuaggugacagagu

SEQ ID NO: 1249029 - RNA, 15 nt, Homo sapiens
acuauauuaaucacc

SEQ ID NO: 1249030 - RNA, 18 nt, Homo sapiens
acuaucaaaauugccuuu

SEQ ID NO: 1249031 - RNA, 22 nt, Homo sapiens
acuauccaaucugugaugacau

SEQ ID NO: 1249032 - RNA, 14 nt, Homo sapiens
acuaucuucuucaa

SEQ ID NO: 1249033 - RNA, 13 nt, Homo sapiens
acuaugagccuau

SEQ ID NO: 1249034 - RNA, 15 nt, Homo sapiens
acuaugauuuaccua

SEQ ID NO: 1249035 - RNA, 12 nt, Homo sapiens
acuaugcugcuu

SEQ ID NO: 1249036 - RNA, 14 nt, Homo sapiens
acuauggaaaauca

SEQ ID NO: 1249037 - RNA, 19 nt, Homo sapiens
acuaugggcccgagcucau

SEQ ID NO: 1249038 - RNA, 16 nt, Homo sapiens
acuauguaaaccacau

SEQ ID NO: 1249039 - RNA, 14 nt, Homo sapiens
acuauguacugccu

SEQ ID NO: 1249040 - RNA, 23 nt, Homo sapiens
acuauguggcugaaaaugcaaag

SEQ ID NO: 1249041 - RNA, 16 nt, Homo sapiens
acuauucacugaugca

SEQ ID NO: 1249042 - RNA, 17 nt, Homo sapiens
acuauucacugaugcag

SEQ ID NO: 1249043 - RNA, 21 nt, Homo sapiens
acuauucacugaugcagaaag

SEQ ID NO: 1249044 - RNA, 20 nt, Homo sapiens
acuauugugaccacaggcug

SEQ ID NO: 1249045 - RNA, 18 nt, Homo sapiens
acuauuuagauauaacac

SEQ ID NO: 1249046 - RNA, 17 nt, Homo sapiens
acuauuuccacauggaa

SEQ ID NO: 1249047 - RNA, 22 nt, Homo sapiens
acuauuucugggucuuuugcua

SEQ ID NO: 1249048 - RNA, 15 nt, Homo sapiens
acuauuuugugcucc

SEQ ID NO: 1249049 - RNA, 19 nt, Homo sapiens
acuauuuuuguaaaagaca

SEQ ID NO: 1249050 - RNA, 20 nt, Homo sapiens
acucaaaagacaaacaugca

SEQ ID NO: 1249051 - RNA, 12 nt, Homo sapiens
acucaaacaauc

SEQ ID NO: 1249052 - RNA, 17 nt, Homo sapiens
acucaaacagucuuucu

SEQ ID NO: 1249053 - RNA, 22 nt, Homo sapiens
acucaaaccacauggaccacga

SEQ ID NO: 1249054 - RNA, 18 nt, Homo sapiens
acucaaauacacauuugc

SEQ ID NO: 1249055 - RNA, 15 nt, Homo sapiens
acucaaaucaguaua

SEQ ID NO: 1249056 - RNA, 22 nt, Homo sapiens
acucaaguuucagguaugcuua

SEQ ID NO: 1249057 - RNA, 16 nt, Homo sapiens
acucaauggaguaugu

SEQ ID NO: 1249058 - RNA, 15 nt, Homo sapiens
acucacagucucuuu

SEQ ID NO: 1249059 - RNA, 21 nt, Homo sapiens
acucaccagccccacugccag

SEQ ID NO: 1249060 - RNA, 20 nt, Homo sapiens
acucacuccacaacccaaga

SEQ ID NO: 1249061 - RNA, 19 nt, Homo sapiens
acucacugauucucuacau

SEQ ID NO: 1249062 - RNA, 14 nt, Homo sapiens
acucacugcucaag

SEQ ID NO: 1249063 - RNA, 12 nt, Homo sapiens
acucacugugau

SEQ ID NO: 1249064 - RNA, 13 nt, Homo sapiens
acucagaacccag

SEQ ID NO: 1249065 - RNA, 17 nt, Homo sapiens
acucagaaccugcuccu

SEQ ID NO: 1249066 - RNA, 21 nt, Homo sapiens
acucagacugcaugacaguca

SEQ ID NO: 1249067 - RNA, 20 nt, Homo sapiens
acucagaggaggacauuugg

SEQ ID NO: 1249068 - RNA, 14 nt, Homo sapiens
acucagcauuguga

SEQ ID NO: 1249069 - RNA, 18 nt, Homo sapiens
acucaggcgccuggcaca

SEQ ID NO: 1249070 - RNA, 20 nt, Homo sapiens
acucaggcgccuggcacauu

SEQ ID NO: 1249071 - RNA, 18 nt, Homo sapiens
acucagggacagagccau

SEQ ID NO: 1249072 - RNA, 17 nt, Homo sapiens
acucagggagcauuuaa

SEQ ID NO: 1249073 - RNA, 16 nt, Homo sapiens
acucaggguucaucug

SEQ ID NO: 1249074 - RNA, 17 nt, Homo sapiens
acucaggguucaucugu

SEQ ID NO: 1249075 - RNA, 17 nt, Homo sapiens
acucagguggugccccu

SEQ ID NO: 1249076 - RNA, 13 nt, Homo sapiens
acucaucagagca

SEQ ID NO: 1249077 - RNA, 17 nt, Homo sapiens
acucaucuuagugccug

SEQ ID NO: 1249078 - RNA, 21 nt, Homo sapiens
acucaugcugguggcauuguu

SEQ ID NO: 1249079 - RNA, 19 nt, Homo sapiens
acucauuaucacagugaau

SEQ ID NO: 1249080 - RNA, 22 nt, Homo sapiens
acucauucuucuguacgucuga

SEQ ID NO: 1249081 - RNA, 14 nt, Homo sapiens
acuccacagaguga

SEQ ID NO: 1249082 - RNA, 14 nt, Homo sapiens
acuccacucagguu

SEQ ID NO: 1249083 - RNA, 12 nt, Homo sapiens
acuccacuggac

SEQ ID NO: 1249084 - RNA, 13 nt, Homo sapiens
acuccagccugag

SEQ ID NO: 1249085 - RNA, 18 nt, Homo sapiens
acuccagccugggcaaca

SEQ ID NO: 1249086 - RNA, 21 nt, Homo sapiens
acuccagucuggcaacagagc

SEQ ID NO: 1249087 - RNA, 12 nt, Homo sapiens
acuccaucucaa

SEQ ID NO: 1249088 - RNA, 14 nt, Homo sapiens
acuccaucucuuaa

SEQ ID NO: 1249089 - RNA, 19 nt, Homo sapiens
acucccaccacaggcauaa

SEQ ID NO: 1249090 - RNA, 13 nt, Homo sapiens
acucccacuuuuc

SEQ ID NO: 1249091 - RNA, 16 nt, Homo sapiens
acuccccaacugaguu

SEQ ID NO: 1249092 - RNA, 20 nt, Homo sapiens
acuccccagagcugugccag

SEQ ID NO: 1249093 - RNA, 21 nt, Homo sapiens
acucccucguuaaucacagga

SEQ ID NO: 1249094 - RNA, 18 nt, Homo sapiens
acucccugcagaugccac

SEQ ID NO: 1249095 - RNA, 19 nt, Homo sapiens
acuccuaaaccuuugcccc

SEQ ID NO: 1249096 - RNA, 12 nt, Homo sapiens
acuccuacuaaa

SEQ ID NO: 1249097 - RNA, 14 nt, Homo sapiens
acuccuagcugacu

SEQ ID NO: 1249098 - RNA, 22 nt, Homo sapiens
acuccucaaaagcaaaugagau

SEQ ID NO: 1249099 - RNA, 15 nt, Homo sapiens
acuccucauaccuca

SEQ ID NO: 1249100 - RNA, 19 nt, Homo sapiens
acuccuccaaggaaaggga

SEQ ID NO: 1249101 - RNA, 14 nt, Homo sapiens
acuccugacuguaa

SEQ ID NO: 1249102 - RNA, 16 nt, Homo sapiens
acuccugcccuguugu

SEQ ID NO: 1249103 - RNA, 18 nt, Homo sapiens
acuccuggccucaaguga

SEQ ID NO: 1249104 - RNA, 21 nt, Homo sapiens
acuccuuaggcuuuguugaau

SEQ ID NO: 1249105 - RNA, 22 nt, Homo sapiens
acuccuuguaaagacuguagaa

SEQ ID NO: 1249106 - RNA, 18 nt, Homo sapiens
acucgcccucgccagugg

SEQ ID NO: 1249107 - RNA, 12 nt, Homo sapiens
acucgcuuuuau

SEQ ID NO: 1249108 - RNA, 17 nt, Homo sapiens
acucuaagcugugugca

SEQ ID NO: 1249109 - RNA, 22 nt, Homo sapiens
acuggagcacugaucaauccuu

SEQ ID NO: 1249110 - RNA, 17 nt, Homo sapiens
acuggagcucaucugca

SEQ ID NO: 1249111 - RNA, 20 nt, Homo sapiens
acuggagcuggcgucugcau

SEQ ID NO: 1249112 - RNA, 19 nt, Homo sapiens
acuggauucuuaaccaaga

SEQ ID NO: 1249113 - RNA, 23 nt, Homo sapiens
acuggauucuuaaccaagaaaca

SEQ ID NO: 1249114 - RNA, 20 nt, Homo sapiens
acuggauugcagacuguucu

SEQ ID NO: 1249115 - RNA, 15 nt, Homo sapiens
acuggcaauaaacuc

SEQ ID NO: 1249116 - RNA, 17 nt, Homo sapiens
acuggcaauaaacuccu

SEQ ID NO: 1249117 - RNA, 19 nt, Homo sapiens
acuggcaauaaacuccuac

SEQ ID NO: 1249118 - RNA, 19 nt, Homo sapiens
acuggcacacugcucuuaa

SEQ ID NO: 1249119 - RNA, 23 nt, Homo sapiens
acuggccagagagggcccagcug

SEQ ID NO: 1249120 - RNA, 22 nt, Homo sapiens
acuggccagggccacgcuccag

SEQ ID NO: 1249121 - RNA, 19 nt, Homo sapiens
acuggccccuacuuugugg

SEQ ID NO: 1249122 - RNA, 23 nt, Homo sapiens
acuggcuccaugauucucugagu

SEQ ID NO: 1249123 - RNA, 21 nt, Homo sapiens
acuggcuuaccuccucauggc

SEQ ID NO: 1249124 - RNA, 17 nt, Homo sapiens
acuggcuucucuugagu

SEQ ID NO: 1249125 - RNA, 17 nt, Homo sapiens
acugggccuuagugggc

SEQ ID NO: 1249126 - RNA, 18 nt, Homo sapiens
acugggcugggccucgug

SEQ ID NO: 1249127 - RNA, 18 nt, Homo sapiens
acuggggagucuuugugg

SEQ ID NO: 1249128 - RNA, 20 nt, Homo sapiens
acuggggagucuuuguggau

SEQ ID NO: 1249129 - RNA, 17 nt, Homo sapiens
acuggguaaaugcaaag

SEQ ID NO: 1249130 - RNA, 19 nt, Homo sapiens
acugguagaaaggcaguuc

SEQ ID NO: 1249131 - RNA, 20 nt, Homo sapiens
acuggucccaagguguaaag

SEQ ID NO: 1249132 - RNA, 14 nt, Homo sapiens
acuggugcugauaa

SEQ ID NO: 1249133 - RNA, 21 nt, Homo sapiens
acugguuuggucaguuacaaa

SEQ ID NO: 1249134 - RNA, 16 nt, Homo sapiens
acuguaaacuucugca

SEQ ID NO: 1249135 - RNA, 14 nt, Homo sapiens
acuguaaaugcauu

SEQ ID NO: 1249136 - RNA, 14 nt, Homo sapiens
acuguaacuacuuc

SEQ ID NO: 1249137 - RNA, 17 nt, Homo sapiens
acuguaacugacugccu

SEQ ID NO: 1249138 - RNA, 17 nt, Homo sapiens
acuguaauaauaccuca

SEQ ID NO: 1249139 - RNA, 18 nt, Homo sapiens
acuguaauaauaccucaa

SEQ ID NO: 1249140 - RNA, 21 nt, Homo sapiens
acuguaauuaaguaaaccaaa

SEQ ID NO: 1249141 - RNA, 14 nt, Homo sapiens
acuguacccucgca

SEQ ID NO: 1249142 - RNA, 15 nt, Homo sapiens
acuguacuacaucua

SEQ ID NO: 1249143 - RNA, 18 nt, Homo sapiens
acuguagcucaaguuuaa

SEQ ID NO: 1249144 - RNA, 16 nt, Homo sapiens
acuguagcugaugaaa

SEQ ID NO: 1249145 - RNA, 19 nt, Homo sapiens
acuguaggcacacuuugca

SEQ ID NO: 1249146 - RNA, 14 nt, Homo sapiens
acuguagggccagg

SEQ ID NO: 1249147 - RNA, 22 nt, Homo sapiens
acuguauauucaggacuugaaa

SEQ ID NO: 1249148 - RNA, 14 nt, Homo sapiens
aauaugucaguuug

SEQ ID NO: 1249149 - RNA, 13 nt, Homo sapiens
aauauuaaauaca

SEQ ID NO: 1249150 - RNA, 14 nt, Homo sapiens
aauauuaccaaaaa

SEQ ID NO: 1249151 - RNA, 13 nt, Homo sapiens
aauauuacucuca

SEQ ID NO: 1249152 - RNA, 18 nt, Homo sapiens
aauauuagcauugccaau

SEQ ID NO: 1249153 - RNA, 13 nt, Homo sapiens
aauauuauaguuu

SEQ ID NO: 1249154 - RNA, 17 nt, Homo sapiens
aauauuauguuccucaa

SEQ ID NO: 1249155 - RNA, 19 nt, Homo sapiens
aauauugauguuaacaaga

SEQ ID NO: 1249156 - RNA, 18 nt, Homo sapiens
aauauugucugccuuaaa

SEQ ID NO: 1249157 - RNA, 13 nt, Homo sapiens
aauauuguugaca

SEQ ID NO: 1249158 - RNA, 18 nt, Homo sapiens
aauauuuaaacagcagug

SEQ ID NO: 1249159 - RNA, 19 nt, Homo sapiens
aauauuuauauugucacuc

SEQ ID NO: 1249160 - RNA, 18 nt, Homo sapiens
aauauuuuaagaauuuca

SEQ ID NO: 1249161 - RNA, 19 nt, Homo sapiens
aauauuuuaagaauuucac

SEQ ID NO: 1249162 - RNA, 23 nt, Homo sapiens
aauauuuuuauaucaugcaaaau

SEQ ID NO: 1249163 - RNA, 15 nt, Homo sapiens
aaucaaagaauuaca

SEQ ID NO: 1249164 - RNA, 13 nt, Homo sapiens
aaucaaauagcau

SEQ ID NO: 1249165 - RNA, 18 nt, Homo sapiens
aaucaacaaaauggucau

SEQ ID NO: 1249166 - RNA, 21 nt, Homo sapiens
aaucaacaaaauggucaucca

SEQ ID NO: 1249167 - RNA, 22 nt, Homo sapiens
aaucaacaaaauggucauccaa

SEQ ID NO: 1249168 - RNA, 15 nt, Homo sapiens
aaucaacuuuacugu

SEQ ID NO: 1249169 - RNA, 23 nt, Homo sapiens
aaucaagaaauaugaagcacuuu

SEQ ID NO: 1249170 - RNA, 21 nt, Homo sapiens
aaucaaggaaagaccaguuuc

SEQ ID NO: 1249171 - RNA, 18 nt, Homo sapiens
aaucaaggccagugcuaa

SEQ ID NO: 1249172 - RNA, 13 nt, Homo sapiens
aaucaaguccuuu

SEQ ID NO: 1249173 - RNA, 12 nt, Homo sapiens
aaucaaucugca

SEQ ID NO: 1249174 - RNA, 23 nt, Homo sapiens
aaucacaggacauuaaggaccaa

SEQ ID NO: 1249175 - RNA, 13 nt, Homo sapiens
aaucacaucucca

SEQ ID NO: 1249176 - RNA, 14 nt, Homo sapiens
aaucaccucucugu

SEQ ID NO: 1249177 - RNA, 16 nt, Homo sapiens
aaucacuaaacuuuau

SEQ ID NO: 1249178 - RNA, 11 nt, Homo sapiens
aaucacugcag

SEQ ID NO: 1249179 - RNA, 14 nt, Homo sapiens
aaucagagacaaaa

SEQ ID NO: 1249180 - RNA, 18 nt, Homo sapiens
aaucagaguguacaaauu

SEQ ID NO: 1249181 - RNA, 14 nt, Homo sapiens
aaucagaugccuca

SEQ ID NO: 1249182 - RNA, 20 nt, Homo sapiens
aaucagauucuucucucuca

SEQ ID NO: 1249183 - RNA, 16 nt, Homo sapiens
aaucagcaaccugacu

SEQ ID NO: 1249184 - RNA, 14 nt, Homo sapiens
aaucagcauucuca

SEQ ID NO: 1249185 - RNA, 17 nt, Homo sapiens
aaucagcauucucacuc

SEQ ID NO: 1249186 - RNA, 16 nt, Homo sapiens
aaucagcauuuagucu

SEQ ID NO: 1249187 - RNA, 16 nt, Homo sapiens
aaucagccacauucua

SEQ ID NO: 1249188 - RNA, 12 nt, Homo sapiens
aaucagccauaa

SEQ ID NO: 1249189 - RNA, 20 nt, Homo sapiens
aaucagcugcuacuacuccu

SEQ ID NO: 1249190 - RNA, 18 nt, Homo sapiens
aaucagcuuuguaacugu

SEQ ID NO: 1249191 - RNA, 18 nt, Homo sapiens
aaucaggaauauuuucca

SEQ ID NO: 1249192 - RNA, 21 nt, Homo sapiens
aaucagugaagccaaagggac

SEQ ID NO: 1249193 - RNA, 19 nt, Homo sapiens
aaucauaaaacuugaugug

SEQ ID NO: 1249194 - RNA, 19 nt, Homo sapiens
aaucauauucauaugcaga

SEQ ID NO: 1249195 - RNA, 15 nt, Homo sapiens
aaucaugaaaagggg

SEQ ID NO: 1249196 - RNA, 16 nt, Homo sapiens
aaucaugcccugccuu

SEQ ID NO: 1249197 - RNA, 20 nt, Homo sapiens
aaucaugugaggaaaugaug

SEQ ID NO: 1249198 - RNA, 21 nt, Homo sapiens
aaucauguugaucauguacuu

SEQ ID NO: 1249199 - RNA, 22 nt, Homo sapiens
aaucauuucaguaucaucucca

SEQ ID NO: 1249200 - RNA, 17 nt, Homo sapiens
aaucauuuuaauuauua

SEQ ID NO: 1249201 - RNA, 18 nt, Homo sapiens
aaucauuuucauuccuaa

SEQ ID NO: 1249202 - RNA, 20 nt, Homo sapiens
aaucauuuucauuccuaaag

SEQ ID NO: 1249203 - RNA, 13 nt, Homo sapiens
aauccaacaucca

SEQ ID NO: 1249204 - RNA, 14 nt, Homo sapiens
aauccaacauccag

SEQ ID NO: 1249205 - RNA, 17 nt, Homo sapiens
aaucccaauucuguccc

SEQ ID NO: 1249206 - RNA, 17 nt, Homo sapiens
aaucccacccacaugug

SEQ ID NO: 1249207 - RNA, 18 nt, Homo sapiens
aaucccagcacuuugaua

SEQ ID NO: 1249208 - RNA, 15 nt, Homo sapiens
aaucccagcuacuug

SEQ ID NO: 1249209 - RNA, 20 nt, Homo sapiens
aaucccuccccgugacugca

SEQ ID NO: 1249210 - RNA, 15 nt, Homo sapiens
aaucccucucacaag

SEQ ID NO: 1249211 - RNA, 15 nt, Homo sapiens
aauccgcauugaugg

SEQ ID NO: 1249212 - RNA, 14 nt, Homo sapiens
aauccuauuuauca

SEQ ID NO: 1249213 - RNA, 20 nt, Homo sapiens
aauccuauuuaucagacucu

SEQ ID NO: 1249214 - RNA, 15 nt, Homo sapiens
aauccucucugcaag

SEQ ID NO: 1249215 - RNA, 18 nt, Homo sapiens
aauccugaacuuucuccc

SEQ ID NO: 1249216 - RNA, 12 nt, Homo sapiens
aauccuguacaa

SEQ ID NO: 1249217 - RNA, 22 nt, Homo sapiens
aauccuguaccaaaucugacau

SEQ ID NO: 1249218 - RNA, 16 nt, Homo sapiens
aauccuuuacauucaa

SEQ ID NO: 1249219 - RNA, 15 nt, Homo sapiens
aauccuuucugccca

SEQ ID NO: 1249220 - RNA, 23 nt, Homo sapiens
aaucgauucugcagcaccggccu

SEQ ID NO: 1249221 - RNA, 13 nt, Homo sapiens
aaucguuccugac

SEQ ID NO: 1249222 - RNA, 20 nt, Homo sapiens
aaucuaaaccuuacaugugu

SEQ ID NO: 1249223 - RNA, 20 nt, Homo sapiens
aaucuaaaguugcuccauac

SEQ ID NO: 1249224 - RNA, 17 nt, Homo sapiens
aaucuaaggauaaugaa

SEQ ID NO: 1249225 - RNA, 12 nt, Homo sapiens
aaucuaagugau

SEQ ID NO: 1249226 - RNA, 15 nt, Homo sapiens
aaucuacuaauucca

SEQ ID NO: 1249227 - RNA, 22 nt, Homo sapiens
aaucuagguucaggaagaccac

SEQ ID NO: 1249228 - RNA, 13 nt, Homo sapiens
aaucuauucugug

SEQ ID NO: 1249229 - RNA, 21 nt, Homo sapiens
aaucuauuuuguuacuugcac

SEQ ID NO: 1249230 - RNA, 16 nt, Homo sapiens
aaucucacaaaugauc

SEQ ID NO: 1249231 - RNA, 15 nt, Homo sapiens
aaucucagccagccu

SEQ ID NO: 1249232 - RNA, 17 nt, Homo sapiens
aaucucagcgugggcca

SEQ ID NO: 1249233 - RNA, 16 nt, Homo sapiens
aaucuccaucucaaaa

SEQ ID NO: 1249234 - RNA, 14 nt, Homo sapiens
aaucuccucagaca

SEQ ID NO: 1249235 - RNA, 22 nt, Homo sapiens
aaucucuacgacuaaucaccua

SEQ ID NO: 1249236 - RNA, 10 nt, Homo sapiens
aaucucucuc

SEQ ID NO: 1249237 - RNA, 17 nt, Homo sapiens
aaucucugugaaauacu

SEQ ID NO: 1249238 - RNA, 22 nt, Homo sapiens
aaucucuucuuugcugcaguca

SEQ ID NO: 1249239 - RNA, 14 nt, Homo sapiens
aaucugaacucuca

SEQ ID NO: 1249240 - RNA, 15 nt, Homo sapiens
aaucugaacucucaa

SEQ ID NO: 1249241 - RNA, 13 nt, Homo sapiens
aaucugacauauu

SEQ ID NO: 1249242 - RNA, 23 nt, Homo sapiens
aaucugagccagugcuuuaaugg

SEQ ID NO: 1249243 - RNA, 22 nt, Homo sapiens
aaucugaguagagcagccacaa

SEQ ID NO: 1249244 - RNA, 17 nt, Homo sapiens
aaucugauuggacauuu

SEQ ID NO: 1249245 - RNA, 16 nt, Homo sapiens
aaucugcucacuuuaa

SEQ ID NO: 1249246 - RNA, 20 nt, Homo sapiens
aaucugcugcauagcucuau

SEQ ID NO: 1249247 - RNA, 22 nt, Homo sapiens
aaucuggcuccuuuacaaaaga

SEQ ID NO: 1249248 - RNA, 17 nt, Homo sapiens
aaucuggcuuagugcca

SEQ ID NO: 1249249 - RNA, 18 nt, Homo sapiens
aaucuggcuuagugccac

SEQ ID NO: 1249250 - RNA, 23 nt, Homo sapiens
aaucugucccugagagugucucu

SEQ ID NO: 1249251 - RNA, 17 nt, Homo sapiens
aaucuguguaacuguaa

SEQ ID NO: 1249252 - RNA, 22 nt, Homo sapiens
aaucuuaccagaugcuacugga

SEQ ID NO: 1249253 - RNA, 13 nt, Homo sapiens
aaucuucauuucu

SEQ ID NO: 1249254 - RNA, 21 nt, Homo sapiens
aaucuuccuuuguugcacaaa

SEQ ID NO: 1249255 - RNA, 19 nt, Homo sapiens
aaucuucucuuugacaauu

SEQ ID NO: 1249256 - RNA, 23 nt, Homo sapiens
aaucuuuaagcagagaagggcau

SEQ ID NO: 1249257 - RNA, 19 nt, Homo sapiens
aaucuuugccuuuaucucu

SEQ ID NO: 1249258 - RNA, 16 nt, Homo sapiens
aaucuuuguaccaaaa

SEQ ID NO: 1249259 - RNA, 14 nt, Homo sapiens
aaucuuugugacag

SEQ ID NO: 1249260 - RNA, 20 nt, Homo sapiens
aaucuuuuugauaagcacau

SEQ ID NO: 1249261 - RNA, 14 nt, Homo sapiens
aaugaaaauuguau

SEQ ID NO: 1249262 - RNA, 12 nt, Homo sapiens
aaugaaauccag

SEQ ID NO: 1249263 - RNA, 18 nt, Homo sapiens
aaugaaauccagugagca

SEQ ID NO: 1249264 - RNA, 17 nt, Homo sapiens
aaugaaauguaugugcu

SEQ ID NO: 1249265 - RNA, 16 nt, Homo sapiens
aaugaaauuuaaacau

SEQ ID NO: 1249266 - RNA, 13 nt, Homo sapiens
aaugaacacuccc

SEQ ID NO: 1249267 - RNA, 16 nt, Homo sapiens
aaugaaccuucugcaa

SEQ ID NO: 1249268 - RNA, 22 nt, Homo sapiens
aaugaaccuucugcaacaucuu

SEQ ID NO: 1249269 - RNA, 11 nt, Homo sapiens
aaugaacuaau

SEQ ID NO: 1249270 - RNA, 12 nt, Homo sapiens
aaugaagcuuua

SEQ ID NO: 1249271 - RNA, 13 nt, Homo sapiens
aaugaagugcaau

SEQ ID NO: 1249272 - RNA, 15 nt, Homo sapiens
aaugaauaagcuuuc

SEQ ID NO: 1249273 - RNA, 16 nt, Homo sapiens
aaugaauacugggaau

SEQ ID NO: 1249274 - RNA, 18 nt, Homo sapiens
aaugaaugaaugagccaa

SEQ ID NO: 1249275 - RNA, 20 nt, Homo sapiens
aaguuuuuuauuaugcauua

SEQ ID NO: 1249276 - RNA, 20 nt, Homo sapiens
aauaaaaaaaaaaggaugaa

SEQ ID NO: 1249277 - RNA, 14 nt, Homo sapiens
aauaaaaaucacuu

SEQ ID NO: 1249278 - RNA, 11 nt, Homo sapiens
aauaaaacuga

SEQ ID NO: 1249279 - RNA, 17 nt, Homo sapiens
aauaaaauccuaagaca

SEQ ID NO: 1249280 - RNA, 19 nt, Homo sapiens
aauaaaauuucuaagagag

SEQ ID NO: 1249281 - RNA, 17 nt, Homo sapiens
aauaaacaccauuucau

SEQ ID NO: 1249282 - RNA, 19 nt, Homo sapiens
aauaaacacuggugccaac

SEQ ID NO: 1249283 - RNA, 22 nt, Homo sapiens
aauaaacaguugugaaccaaga

SEQ ID NO: 1249284 - RNA, 12 nt, Homo sapiens
aauaaacauuaa

SEQ ID NO: 1249285 - RNA, 19 nt, Homo sapiens
aauaaaccuccgccaaugc

SEQ ID NO: 1249286 - RNA, 15 nt, Homo sapiens
aauaaacuccuacua

SEQ ID NO: 1249287 - RNA, 12 nt, Homo sapiens
aauaaacugugc

SEQ ID NO: 1249288 - RNA, 17 nt, Homo sapiens
aauaaagaauuaacaga

SEQ ID NO: 1249289 - RNA, 11 nt, Homo sapiens
aauaaagcaau

SEQ ID NO: 1249290 - RNA, 15 nt, Homo sapiens
aauaaagcacaaaac

SEQ ID NO: 1249291 - RNA, 13 nt, Homo sapiens
aauaaagcauucu

SEQ ID NO: 1249292 - RNA, 14 nt, Homo sapiens
aauaaagcuugcaa

SEQ ID NO: 1249293 - RNA, 20 nt, Homo sapiens
aauaaaggaugugauugugg

SEQ ID NO: 1249294 - RNA, 23 nt, Homo sapiens
aauaaaguaccacacauauugca

SEQ ID NO: 1249295 - RNA, 14 nt, Homo sapiens
aauaaaguccugac

SEQ ID NO: 1249296 - RNA, 13 nt, Homo sapiens
aauaaagugcagu

SEQ ID NO: 1249297 - RNA, 16 nt, Homo sapiens
aauaaaguguaacaau

SEQ ID NO: 1249298 - RNA, 15 nt, Homo sapiens
aauaaaguguuuuca

SEQ ID NO: 1249299 - RNA, 15 nt, Homo sapiens
aauaaauaaacgagc

SEQ ID NO: 1249300 - RNA, 15 nt, Homo sapiens
aauaaauaaucugua

SEQ ID NO: 1249301 - RNA, 22 nt, Homo sapiens
aauaaauacguuuugucuuucc

SEQ ID NO: 1249302 - RNA, 14 nt, Homo sapiens
aauaaauacugcag

SEQ ID NO: 1249303 - RNA, 16 nt, Homo sapiens
aauaaaugacaaugua

SEQ ID NO: 1249304 - RNA, 12 nt, Homo sapiens
aauaaaugccuu

SEQ ID NO: 1249305 - RNA, 16 nt, Homo sapiens
aauaaauguacauuaa

SEQ ID NO: 1249306 - RNA, 23 nt, Homo sapiens
aauaaauuggugauaaguggaaa

SEQ ID NO: 1249307 - RNA, 14 nt, Homo sapiens
aauaacaaucacaa

SEQ ID NO: 1249308 - RNA, 20 nt, Homo sapiens
aauaacaucaacaacacagc

SEQ ID NO: 1249309 - RNA, 13 nt, Homo sapiens
aauaacugugaag

SEQ ID NO: 1249310 - RNA, 17 nt, Homo sapiens
aauaacuuggagacaga

SEQ ID NO: 1249311 - RNA, 17 nt, Homo sapiens
aauaagcacagaaaauc

SEQ ID NO: 1249312 - RNA, 22 nt, Homo sapiens
aauaagcaguauguuuguuuca

SEQ ID NO: 1249313 - RNA, 13 nt, Homo sapiens
aauaaggcacaaa

SEQ ID NO: 1249314 - RNA, 20 nt, Homo sapiens
aauaagucagguucuuuaca

SEQ ID NO: 1249315 - RNA, 15 nt, Homo sapiens
aauaauaccauaaua

SEQ ID NO: 1249316 - RNA, 12 nt, Homo sapiens
aauaauaugcau

SEQ ID NO: 1249317 - RNA, 14 nt, Homo sapiens
aauaauauuagcuu

SEQ ID NO: 1249318 - RNA, 13 nt, Homo sapiens
aauaauauugcau

SEQ ID NO: 1249319 - RNA, 17 nt, Homo sapiens
aauaaucuaugaugaag

SEQ ID NO: 1249320 - RNA, 13 nt, Homo sapiens
aauaaucuuauua

SEQ ID NO: 1249321 - RNA, 16 nt, Homo sapiens
aauaaugaacacuaca

SEQ ID NO: 1249322 - RNA, 14 nt, Homo sapiens
aauaaugacacucc

SEQ ID NO: 1249323 - RNA, 21 nt, Homo sapiens
aauaaugaguuagaacuauua

SEQ ID NO: 1249324 - RNA, 20 nt, Homo sapiens
aauaauuagguuaacauugu

SEQ ID NO: 1249325 - RNA, 22 nt, Homo sapiens
aauaauuuuaagaaaucaaaga

SEQ ID NO: 1249326 - RNA, 13 nt, Homo sapiens
aauacaaccagcc

SEQ ID NO: 1249327 - RNA, 20 nt, Homo sapiens
aauacacaauccuccaagaa

SEQ ID NO: 1249328 - RNA, 14 nt, Homo sapiens
aauacacauuugcu

SEQ ID NO: 1249329 - RNA, 16 nt, Homo sapiens
aauacacuaauuccuu

SEQ ID NO: 1249330 - RNA, 20 nt, Homo sapiens
aauacagauagauauaugcu

SEQ ID NO: 1249331 - RNA, 23 nt, Homo sapiens
aauacagauagauauaugcucug

SEQ ID NO: 1249332 - RNA, 16 nt, Homo sapiens
aauacagcacuuugac

SEQ ID NO: 1249333 - RNA, 19 nt, Homo sapiens
aauacaggggugaaagggg

SEQ ID NO: 1249334 - RNA, 21 nt, Homo sapiens
aauacaucaaaauauacuggg

SEQ ID NO: 1249335 - RNA, 14 nt, Homo sapiens
aauacaucaaagag

SEQ ID NO: 1249336 - RNA, 15 nt, Homo sapiens
aauacaugcaucuca

SEQ ID NO: 1249337 - RNA, 19 nt, Homo sapiens
aauacaugcugcuaauuca

SEQ ID NO: 1249338 - RNA, 13 nt, Homo sapiens
aauacauguucau

SEQ ID NO: 1249339 - RNA, 20 nt, Homo sapiens
aauacauuucaauuauacua

SEQ ID NO: 1249340 - RNA, 21 nt, Homo sapiens
aauaccauggguuauuuaugc

SEQ ID NO: 1249341 - RNA, 18 nt, Homo sapiens
aauaccauuaaaacugcu

SEQ ID NO: 1249342 - RNA, 15 nt, Homo sapiens
aauaccuacugcuga

SEQ ID NO: 1249343 - RNA, 18 nt, Homo sapiens
aauacgguaaggauacuu

SEQ ID NO: 1249344 - RNA, 17 nt, Homo sapiens
aauacuaccucacuacu

SEQ ID NO: 1249345 - RNA, 23 nt, Homo sapiens
aauacuaccucacuacuacaucu

SEQ ID NO: 1249346 - RNA, 22 nt, Homo sapiens
aauacuaggauacagaaaugca

SEQ ID NO: 1249347 - RNA, 12 nt, Homo sapiens
aauacucugcag

SEQ ID NO: 1249348 - RNA, 23 nt, Homo sapiens
aauacugaaggacacagcagugg

SEQ ID NO: 1249349 - RNA, 21 nt, Homo sapiens
aauacugcagagggacagaug

SEQ ID NO: 1249350 - RNA, 16 nt, Homo sapiens
aauacugcgugugaua

SEQ ID NO: 1249351 - RNA, 20 nt, Homo sapiens
aauacugugcauaagccauu

SEQ ID NO: 1249352 - RNA, 14 nt, Homo sapiens
aauacuuacuauaa

SEQ ID NO: 1249353 - RNA, 21 nt, Homo sapiens
aauacuugaacucuguucccc

SEQ ID NO: 1249354 - RNA, 11 nt, Homo sapiens
aauacuuucag

SEQ ID NO: 1249355 - RNA, 20 nt, Homo sapiens
aauagaaccacuaugaagcu

SEQ ID NO: 1249356 - RNA, 12 nt, Homo sapiens
aauagauaugaa

SEQ ID NO: 1249357 - RNA, 23 nt, Homo sapiens
aauagaucaaaguccagcaggca

SEQ ID NO: 1249358 - RNA, 16 nt, Homo sapiens
aauagccacauuugga

SEQ ID NO: 1249359 - RNA, 15 nt, Homo sapiens
aauagcuauggaauc

SEQ ID NO: 1249360 - RNA, 23 nt, Homo sapiens
aauagcugggacuacagguguga

SEQ ID NO: 1249361 - RNA, 17 nt, Homo sapiens
aauaggaacaaucuuug

SEQ ID NO: 1249362 - RNA, 12 nt, Homo sapiens
aauagggagaaa

SEQ ID NO: 1249363 - RNA, 20 nt, Homo sapiens
aauagguagguuaguagccc

SEQ ID NO: 1249364 - RNA, 23 nt, Homo sapiens
aauaguaaaagauaacaagaucu

SEQ ID NO: 1249365 - RNA, 22 nt, Homo sapiens
aauaguacagacagaaggugcu

SEQ ID NO: 1249366 - RNA, 17 nt, Homo sapiens
aauaguaccuucaauac

SEQ ID NO: 1249367 - RNA, 14 nt, Homo sapiens
aauaguauuuauga

SEQ ID NO: 1249368 - RNA, 21 nt, Homo sapiens
aauaguauuugagaguucuaa

SEQ ID NO: 1249369 - RNA, 21 nt, Homo sapiens
aauaguccaccucccauuacu

SEQ ID NO: 1249370 - RNA, 23 nt, Homo sapiens
aauaguccaccucccauuacuuu

SEQ ID NO: 1249371 - RNA, 15 nt, Homo sapiens
aauagucucacuguc

SEQ ID NO: 1249372 - RNA, 15 nt, Homo sapiens
aauagugacaaguga

SEQ ID NO: 1249373 - RNA, 14 nt, Homo sapiens
aauaguuuacaugu

SEQ ID NO: 1249374 - RNA, 18 nt, Homo sapiens
aauaguuuugauccuaaa

SEQ ID NO: 1249375 - RNA, 19 nt, Homo sapiens
aauaguuuugauccuaaau

SEQ ID NO: 1249376 - RNA, 16 nt, Homo sapiens
aauauaauuugaucuu

SEQ ID NO: 1249377 - RNA, 14 nt, Homo sapiens
aauauacuaugaaa

SEQ ID NO: 1249378 - RNA, 16 nt, Homo sapiens
aauauagaaaguugau

SEQ ID NO: 1249379 - RNA, 16 nt, Homo sapiens
aauauagaaugaaaga

SEQ ID NO: 1249380 - RNA, 22 nt, Homo sapiens
aauauagagggcuuaugauuca

SEQ ID NO: 1249381 - RNA, 15 nt, Homo sapiens
aauauagcucaggua

SEQ ID NO: 1249382 - RNA, 19 nt, Homo sapiens
aauauagugacuaugaacu

SEQ ID NO: 1249383 - RNA, 15 nt, Homo sapiens
aauauauaguccaga

SEQ ID NO: 1249384 - RNA, 17 nt, Homo sapiens
aauauauauacauaugu

SEQ ID NO: 1249385 - RNA, 19 nt, Homo sapiens
aauauauccccacuacuca

SEQ ID NO: 1249386 - RNA, 15 nt, Homo sapiens
aauauaugucugaua

SEQ ID NO: 1249387 - RNA, 17 nt, Homo sapiens
aauauauuccugagauu

SEQ ID NO: 1249388 - RNA, 21 nt, Homo sapiens
aauauauuuuuugaacuuugu

SEQ ID NO: 1249389 - RNA, 17 nt, Homo sapiens
aauauccaaaccaaaua

SEQ ID NO: 1249390 - RNA, 17 nt, Homo sapiens
aauauccgaacuuuaau

SEQ ID NO: 1249391 - RNA, 17 nt, Homo sapiens
aauauccuccaaugugu

SEQ ID NO: 1249392 - RNA, 23 nt, Homo sapiens
aauaugaaccuauuuucauuugu

SEQ ID NO: 1249393 - RNA, 18 nt, Homo sapiens
aauaugauuuuauuugac

SEQ ID NO: 1249394 - RNA, 19 nt, Homo sapiens
aauaugcaaaccaggauuu

SEQ ID NO: 1249395 - RNA, 11 nt, Homo sapiens
aauaugcaucu

SEQ ID NO: 1249396 - RNA, 17 nt, Homo sapiens
aauaugcuuauaaccua

SEQ ID NO: 1249397 - RNA, 20 nt, Homo sapiens
aagguuauguucauuuuuca

SEQ ID NO: 1249398 - RNA, 12 nt, Homo sapiens
aagguucacagg

SEQ ID NO: 1249399 - RNA, 16 nt, Homo sapiens
aagguuccaacuguau

SEQ ID NO: 1249400 - RNA, 22 nt, Homo sapiens
aagguucucagguguugccaaa

SEQ ID NO: 1249401 - RNA, 20 nt, Homo sapiens
aagguuucauguucacugug

SEQ ID NO: 1249402 - RNA, 22 nt, Homo sapiens
aagguuuugguugcauuauuau

SEQ ID NO: 1249403 - RNA, 17 nt, Homo sapiens
aagguuuuuacugugag

SEQ ID NO: 1249404 - RNA, 15 nt, Homo sapiens
aaguaaaacuuaaga

SEQ ID NO: 1249405 - RNA, 20 nt, Homo sapiens
aaguaaauauagcucaggua

SEQ ID NO: 1249406 - RNA, 18 nt, Homo sapiens
aaguaacuucacauuaaa

SEQ ID NO: 1249407 - RNA, 14 nt, Homo sapiens
aaguaagacuuuua

SEQ ID NO: 1249408 - RNA, 15 nt, Homo sapiens
aaguaaggcaugguu

SEQ ID NO: 1249409 - RNA, 17 nt, Homo sapiens
aaguaaguuugauuuca

SEQ ID NO: 1249410 - RNA, 13 nt, Homo sapiens
aaguaaugauuaa

SEQ ID NO: 1249411 - RNA, 17 nt, Homo sapiens
aaguaauguuaauucuu

SEQ ID NO: 1249412 - RNA, 20 nt, Homo sapiens
aaguaauuccucucacuaaa

SEQ ID NO: 1249413 - RNA, 14 nt, Homo sapiens
aaguaauugugaaa

SEQ ID NO: 1249414 - RNA, 23 nt, Homo sapiens
aaguaauuucuuugaucuggaca

SEQ ID NO: 1249415 - RNA, 13 nt, Homo sapiens
aaguacaaagcau

SEQ ID NO: 1249416 - RNA, 22 nt, Homo sapiens
aaguacaaagguugcagugcug

SEQ ID NO: 1249417 - RNA, 12 nt, Homo sapiens
aaguacauguau

SEQ ID NO: 1249418 - RNA, 11 nt, Homo sapiens
aaguaccacac

SEQ ID NO: 1249419 - RNA, 14 nt, Homo sapiens
aaguaccacacaua

SEQ ID NO: 1249420 - RNA, 17 nt, Homo sapiens
aaguaccacacauauug

SEQ ID NO: 1249421 - RNA, 19 nt, Homo sapiens
aaguaccacacauauugca

SEQ ID NO: 1249422 - RNA, 14 nt, Homo sapiens
aaguaccagcaugu

SEQ ID NO: 1249423 - RNA, 23 nt, Homo sapiens
aaguacuccuauugccgccagaa

SEQ ID NO: 1249424 - RNA, 19 nt, Homo sapiens
aaguacuguaauaauaccu

SEQ ID NO: 1249425 - RNA, 21 nt, Homo sapiens
aaguacuguaauaauaccuca

SEQ ID NO: 1249426 - RNA, 18 nt, Homo sapiens
aaguacuucuccacccug

SEQ ID NO: 1249427 - RNA, 16 nt, Homo sapiens
aaguagaggaauccau

SEQ ID NO: 1249428 - RNA, 15 nt, Homo sapiens
aaguagauugccagc

SEQ ID NO: 1249429 - RNA, 18 nt, Homo sapiens
aaguagauuuuaaaagau

SEQ ID NO: 1249430 - RNA, 20 nt, Homo sapiens
aaguagcaaaaaguauugaa

SEQ ID NO: 1249431 - RNA, 18 nt, Homo sapiens
aaguagcucuggugaccu

SEQ ID NO: 1249432 - RNA, 22 nt, Homo sapiens
aaguagcuuuccacauuuguca

SEQ ID NO: 1249433 - RNA, 21 nt, Homo sapiens
aaguaggugugacuugaacua

SEQ ID NO: 1249434 - RNA, 13 nt, Homo sapiens
aaguauaaaugaa

SEQ ID NO: 1249435 - RNA, 17 nt, Homo sapiens
aaguauaacaacuuuga

SEQ ID NO: 1249436 - RNA, 18 nt, Homo sapiens
aaguauaacaacuuugaa

SEQ ID NO: 1249437 - RNA, 19 nt, Homo sapiens
aaguauauacugaagugug

SEQ ID NO: 1249438 - RNA, 21 nt, Homo sapiens
aaguaugaauauuacucucaa

SEQ ID NO: 1249439 - RNA, 18 nt, Homo sapiens
aaguauguaaacaggaga

SEQ ID NO: 1249440 - RNA, 21 nt, Homo sapiens
aaguauuauucaaaccaauuu

SEQ ID NO: 1249441 - RNA, 15 nt, Homo sapiens
aaguauuauuuuaca

SEQ ID NO: 1249442 - RNA, 17 nt, Homo sapiens
aaguauuuaaauguucu

SEQ ID NO: 1249443 - RNA, 15 nt, Homo sapiens
aaguauuucugugga

SEQ ID NO: 1249444 - RNA, 17 nt, Homo sapiens
aagucaaucauuucuca

SEQ ID NO: 1249445 - RNA, 15 nt, Homo sapiens
aagucagcucuuguc

SEQ ID NO: 1249446 - RNA, 16 nt, Homo sapiens
aagucagguccaauuu

SEQ ID NO: 1249447 - RNA, 17 nt, Homo sapiens
aagucagguucuuuaca

SEQ ID NO: 1249448 - RNA, 15 nt, Homo sapiens
aagucaucccagugc

SEQ ID NO: 1249449 - RNA, 22 nt, Homo sapiens
aagucaucucauuccacuguug

SEQ ID NO: 1249450 - RNA, 16 nt, Homo sapiens
aaguccacuuuacuca

SEQ ID NO: 1249451 - RNA, 13 nt, Homo sapiens
aaguccagccacu

SEQ ID NO: 1249452 - RNA, 19 nt, Homo sapiens
aagucccaguauaccucau

SEQ ID NO: 1249453 - RNA, 19 nt, Homo sapiens
aaguccuacaagcuaaaau

SEQ ID NO: 1249454 - RNA, 17 nt, Homo sapiens
aaguccuuucuaaguau

SEQ ID NO: 1249455 - RNA, 23 nt, Homo sapiens
aagucuaaauaaaugaaguauuu

SEQ ID NO: 1249456 - RNA, 14 nt, Homo sapiens
aagucuacaacaua

SEQ ID NO: 1249457 - RNA, 14 nt, Homo sapiens
aagucucacugugu

SEQ ID NO: 1249458 - RNA, 20 nt, Homo sapiens
aagucuccagucaccuacaa

SEQ ID NO: 1249459 - RNA, 18 nt, Homo sapiens
aagucucuauuuaaauuc

SEQ ID NO: 1249460 - RNA, 18 nt, Homo sapiens
aagucucucguaguguua

SEQ ID NO: 1249461 - RNA, 16 nt, Homo sapiens
aagucuguaccucaaa

SEQ ID NO: 1249462 - RNA, 20 nt, Homo sapiens
aagucugucugucugaugau

SEQ ID NO: 1249463 - RNA, 12 nt, Homo sapiens
aagucugugagu

SEQ ID NO: 1249464 - RNA, 13 nt, Homo sapiens
aagugaaagcaag

SEQ ID NO: 1249465 - RNA, 13 nt, Homo sapiens
aagugaacuauga

SEQ ID NO: 1249466 - RNA, 21 nt, Homo sapiens
aagugaagaacacuacugcua

SEQ ID NO: 1249467 - RNA, 23 nt, Homo sapiens
aagugaauguuuaccaugaagau

SEQ ID NO: 1249468 - RNA, 15 nt, Homo sapiens
aagugacuucacaga

SEQ ID NO: 1249469 - RNA, 15 nt, Homo sapiens
aagugagagagacaa

SEQ ID NO: 1249470 - RNA, 19 nt, Homo sapiens
aagugauccucccaccuca

SEQ ID NO: 1249471 - RNA, 20 nt, Homo sapiens
aagugaucugcccaccucag

SEQ ID NO: 1249472 - RNA, 17 nt, Homo sapiens
aagugccacucauuccu

SEQ ID NO: 1249473 - RNA, 16 nt, Homo sapiens
aagugcgaguccucca

SEQ ID NO: 1249474 - RNA, 18 nt, Homo sapiens
aagugcgugaauguaugu

SEQ ID NO: 1249475 - RNA, 21 nt, Homo sapiens
aagugcgugccgugugagugu

SEQ ID NO: 1249476 - RNA, 20 nt, Homo sapiens
aagugcugagauuacaggca

SEQ ID NO: 1249477 - RNA, 21 nt, Homo sapiens
aagugcugggauuacaggugu

SEQ ID NO: 1249478 - RNA, 14 nt, Homo sapiens
aaguggccaugcca

SEQ ID NO: 1249479 - RNA, 14 nt, Homo sapiens
aaguggcuucccau

SEQ ID NO: 1249480 - RNA, 19 nt, Homo sapiens
aaguggggaaguguuccag

SEQ ID NO: 1249481 - RNA, 15 nt, Homo sapiens
aaguggugaaugaca

SEQ ID NO: 1249482 - RNA, 17 nt, Homo sapiens
aaguguaacagauauca

SEQ ID NO: 1249483 - RNA, 14 nt, Homo sapiens
aaguguaauagauu

SEQ ID NO: 1249484 - RNA, 14 nt, Homo sapiens
aaguguacauaugu

SEQ ID NO: 1249485 - RNA, 14 nt, Homo sapiens
aagugugaauucac

SEQ ID NO: 1249486 - RNA, 20 nt, Homo sapiens
aagugugauauacaaagugu

SEQ ID NO: 1249487 - RNA, 13 nt, Homo sapiens
aagugugcaugau

SEQ ID NO: 1249488 - RNA, 13 nt, Homo sapiens
aaguguggaugca

SEQ ID NO: 1249489 - RNA, 23 nt, Homo sapiens
aagugugugccaccaugccucac

SEQ ID NO: 1249490 - RNA, 20 nt, Homo sapiens
aaguguucacaacagugaaa

SEQ ID NO: 1249491 - RNA, 16 nt, Homo sapiens
aaguguuucuguuauu

SEQ ID NO: 1249492 - RNA, 22 nt, Homo sapiens
aaguguuuuuuauugaaugcuu

SEQ ID NO: 1249493 - RNA, 15 nt, Homo sapiens
aaguuaaagugaaua

SEQ ID NO: 1249494 - RNA, 13 nt, Homo sapiens
aaguuaagcuuuu

SEQ ID NO: 1249495 - RNA, 22 nt, Homo sapiens
aaguuauacuguggcuaugcaa

SEQ ID NO: 1249496 - RNA, 22 nt, Homo sapiens
aaguuauguucuucuucauuga

SEQ ID NO: 1249497 - RNA, 17 nt, Homo sapiens
aaguuauuaacuuuaau

SEQ ID NO: 1249498 - RNA, 15 nt, Homo sapiens
aaguuauugugauaa

SEQ ID NO: 1249499 - RNA, 14 nt, Homo sapiens
aaguucaacuucca

SEQ ID NO: 1249500 - RNA, 22 nt, Homo sapiens
aaguucauaccuaaguacugua

SEQ ID NO: 1249501 - RNA, 20 nt, Homo sapiens
aaguucaugcagcuguggca

SEQ ID NO: 1249502 - RNA, 22 nt, Homo sapiens
aaguuccaguguucucucuuau

SEQ ID NO: 1249503 - RNA, 18 nt, Homo sapiens
aaguucuacaguuaauua

SEQ ID NO: 1249504 - RNA, 22 nt, Homo sapiens
aaguucuucuccaauccuauca

SEQ ID NO: 1249505 - RNA, 23 nt, Homo sapiens
aaguuggugcuuuugagaaccaa

SEQ ID NO: 1249506 - RNA, 22 nt, Homo sapiens
aaguuuaagugugcagccauag

SEQ ID NO: 1249507 - RNA, 18 nt, Homo sapiens
aaguuuaucacacagugu

SEQ ID NO: 1249508 - RNA, 15 nt, Homo sapiens
aaguuucaaugugau

SEQ ID NO: 1249509 - RNA, 22 nt, Homo sapiens
aaguuucaucagucaaugagga

SEQ ID NO: 1249510 - RNA, 18 nt, Homo sapiens
aaguuucccuuccuccau

SEQ ID NO: 1249511 - RNA, 22 nt, Homo sapiens
aaguuuccguggguucugucau

SEQ ID NO: 1249512 - RNA, 18 nt, Homo sapiens
aaguuucugcagcagaug

SEQ ID NO: 1249513 - RNA, 20 nt, Homo sapiens
aucugugucaaaagccagau

SEQ ID NO: 1249514 - RNA, 15 nt, Homo sapiens
aucuguucuugcuac

SEQ ID NO: 1249515 - RNA, 23 nt, Homo sapiens
aucuuaaacauaauaaaucacac

SEQ ID NO: 1249516 - RNA, 15 nt, Homo sapiens
aucuuacuguaccug

SEQ ID NO: 1249517 - RNA, 17 nt, Homo sapiens
aucuuagggugaaccac

SEQ ID NO: 1249518 - RNA, 18 nt, Homo sapiens
aucuuauagcacuuugaa

SEQ ID NO: 1249519 - RNA, 13 nt, Homo sapiens
aucuuauguuaaa

SEQ ID NO: 1249520 - RNA, 20 nt, Homo sapiens
aucuuauucuuuuguaauau

SEQ ID NO: 1249521 - RNA, 22 nt, Homo sapiens
aucuucaaacauguacaaaauc

SEQ ID NO: 1249522 - RNA, 18 nt, Homo sapiens
aucuucaaacuuucacuu

SEQ ID NO: 1249523 - RNA, 13 nt, Homo sapiens
aucuucaacagac

SEQ ID NO: 1249524 - RNA, 13 nt, Homo sapiens
aucuucacugcaa

SEQ ID NO: 1249525 - RNA, 18 nt, Homo sapiens
aucuucacugucugacuu

SEQ ID NO: 1249526 - RNA, 14 nt, Homo sapiens
aucuucacuuuuau

SEQ ID NO: 1249527 - RNA, 24 nt, Homo sapiens
aucuucagcucuuuuuguggauau

SEQ ID NO: 1249528 - RNA, 22 nt, Homo sapiens
aucuucagggaacugcauagau

SEQ ID NO: 1249529 - RNA, 17 nt, Homo sapiens
aucuuccaaaugcaauu

SEQ ID NO: 1249530 - RNA, 18 nt, Homo sapiens
aucuuccaaaugcaauuu

SEQ ID NO: 1249531 - RNA, 15 nt, Homo sapiens
aucuucccacagugg

SEQ ID NO: 1249532 - RNA, 23 nt, Homo sapiens
aucuucccuuuauuacaagaagg

SEQ ID NO: 1249533 - RNA, 23 nt, Homo sapiens
aucuuccguggucagagugccac

SEQ ID NO: 1249534 - RNA, 15 nt, Homo sapiens
aucuuccugcugcug

SEQ ID NO: 1249535 - RNA, 13 nt, Homo sapiens
aucuucuacugua

SEQ ID NO: 1249536 - RNA, 14 nt, Homo sapiens
aucuucuacuguau

SEQ ID NO: 1249537 - RNA, 12 nt, Homo sapiens
aucuucuacuuu

SEQ ID NO: 1249538 - RNA, 12 nt, Homo sapiens
aucuucucccca

SEQ ID NO: 1249539 - RNA, 13 nt, Homo sapiens
aucuucugaauuu

SEQ ID NO: 1249540 - RNA, 15 nt, Homo sapiens
aucuucugccuuagu

SEQ ID NO: 1249541 - RNA, 16 nt, Homo sapiens
aucuucuuacuaagcu

SEQ ID NO: 1249542 - RNA, 22 nt, Homo sapiens
aucuucuuuauaauucuacuuu

SEQ ID NO: 1249543 - RNA, 17 nt, Homo sapiens
aucuugauuucacugga

SEQ ID NO: 1249544 - RNA, 14 nt, Homo sapiens
aucuugcaccccaa

SEQ ID NO: 1249545 - RNA, 19 nt, Homo sapiens
aucuuggacugacauuuag

SEQ ID NO: 1249546 - RNA, 18 nt, Homo sapiens
aucuuggagggaccaagg

SEQ ID NO: 1249547 - RNA, 12 nt, Homo sapiens
aucuuguuucau

SEQ ID NO: 1249548 - RNA, 22 nt, Homo sapiens
aucuuucccucuucgguguucu

SEQ ID NO: 1249549 - RNA, 20 nt, Homo sapiens
aucuuucugugucuucacau

SEQ ID NO: 1249550 - RNA, 22 nt, Homo sapiens
aucuuucuuuucccaacauaug

SEQ ID NO: 1249551 - RNA, 18 nt, Homo sapiens
aucuuugaccacgucauc

SEQ ID NO: 1249552 - RNA, 15 nt, Homo sapiens
aucuuugacugaaaa

SEQ ID NO: 1249553 - RNA, 14 nt, Homo sapiens
aucuuugcuguaua

SEQ ID NO: 1249554 - RNA, 13 nt, Homo sapiens
aucuuuucauuaa

SEQ ID NO: 1249555 - RNA, 19 nt, Homo sapiens
aucuuuuccagaguaugca

SEQ ID NO: 1249556 - RNA, 13 nt, Homo sapiens
aucuuuucuacuu

SEQ ID NO: 1249557 - RNA, 14 nt, Homo sapiens
aucuuuugugagau

SEQ ID NO: 1249558 - RNA, 18 nt, Homo sapiens
aucuuuuuaaaaacucuu

SEQ ID NO: 1249559 - RNA, 14 nt, Homo sapiens
aucuuuuucuauau

SEQ ID NO: 1249560 - RNA, 19 nt, Homo sapiens
aucuuuuucuauauucuca

SEQ ID NO: 1249561 - RNA, 20 nt, Homo sapiens
aucuuuuucuauauucucau

SEQ ID NO: 1249562 - RNA, 21 nt, Homo sapiens
acgaauggcagcauacacaga

SEQ ID NO: 1249563 - RNA, 22 nt, Homo sapiens
acgaauuaauuaccuggcacca

SEQ ID NO: 1249564 - RNA, 18 nt, Homo sapiens
acgacaagugcugaacag

SEQ ID NO: 1249565 - RNA, 23 nt, Homo sapiens
acgacaggcgagagaggagccag

SEQ ID NO: 1249566 - RNA, 19 nt, Homo sapiens
acgacuaaucaccuacuca

SEQ ID NO: 1249567 - RNA, 14 nt, Homo sapiens
acgagcuggaaccc

SEQ ID NO: 1249568 - RNA, 19 nt, Homo sapiens
acgaggccacagcugccau

SEQ ID NO: 1249569 - RNA, 13 nt, Homo sapiens
acgaggugcagua

SEQ ID NO: 1249570 - RNA, 20 nt, Homo sapiens
acgagucaccugcaagcccc

SEQ ID NO: 1249571 - RNA, 22 nt, Homo sapiens
acgaguggccaguucauugugg

SEQ ID NO: 1249572 - RNA, 15 nt, Homo sapiens
acgaucuuccuggcu

SEQ ID NO: 1249573 - RNA, 14 nt, Homo sapiens
acgaugacaguguu

SEQ ID NO: 1249574 - RNA, 11 nt, Homo sapiens
acgaugcauuu

SEQ ID NO: 1249575 - RNA, 13 nt, Homo sapiens
acgaugcauuuaa

SEQ ID NO: 1249576 - RNA, 18 nt, Homo sapiens
acgcacgcucgcugccau

SEQ ID NO: 1249577 - RNA, 22 nt, Homo sapiens
acgcacgcucgcugccaucacc

SEQ ID NO: 1249578 - RNA, 15 nt, Homo sapiens
acgcagaucacuaaa

SEQ ID NO: 1249579 - RNA, 14 nt, Homo sapiens
acgccgagaaggcc

SEQ ID NO: 1249580 - RNA, 22 nt, Homo sapiens
acgccuacuuaagagugcugug

SEQ ID NO: 1249581 - RNA, 22 nt, Homo sapiens
acgccucgguggcauacagacu

SEQ ID NO: 1249582 - RNA, 16 nt, Homo sapiens
acgccuggcuaauaag

SEQ ID NO: 1249583 - RNA, 18 nt, Homo sapiens
acgccuguaaucccagca

SEQ ID NO: 1249584 - RNA, 21 nt, Homo sapiens
acgccuguaaucccagcacuu

SEQ ID NO: 1249585 - RNA, 22 nt, Homo sapiens
acgcgggacgucccugcccaug

SEQ ID NO: 1249586 - RNA, 20 nt, Homo sapiens
acgcgguuccagauguggau

SEQ ID NO: 1249587 - RNA, 17 nt, Homo sapiens
acgcuaaagagcccuug

SEQ ID NO: 1249588 - RNA, 20 nt, Homo sapiens
acgcuagggcggggcacaga

SEQ ID NO: 1249589 - RNA, 13 nt, Homo sapiens
acgcucgcugcca

SEQ ID NO: 1249590 - RNA, 13 nt, Homo sapiens
acgcuuaaaggaa

SEQ ID NO: 1249591 - RNA, 19 nt, Homo sapiens
acgcuugcuuuagcacagg

SEQ ID NO: 1249592 - RNA, 20 nt, Homo sapiens
acgcuuuuugggagaaugau

SEQ ID NO: 1249593 - RNA, 14 nt, Homo sapiens
acggaagcugacau

SEQ ID NO: 1249594 - RNA, 20 nt, Homo sapiens
acggacugugcauacuuucc

SEQ ID NO: 1249595 - RNA, 21 nt, Homo sapiens
acggagccgcgggacagccaa

SEQ ID NO: 1249596 - RNA, 16 nt, Homo sapiens
acggcaucaaggugcu

SEQ ID NO: 1249597 - RNA, 14 nt, Homo sapiens
acggcccugcaaug

SEQ ID NO: 1249598 - RNA, 13 nt, Homo sapiens
acggcuuacaugu

SEQ ID NO: 1249599 - RNA, 21 nt, Homo sapiens
acgggaccauuuuuacaucca

SEQ ID NO: 1249600 - RNA, 17 nt, Homo sapiens
acgggcaaucaugagca

SEQ ID NO: 1249601 - RNA, 18 nt, Homo sapiens
acggggaagccgagcucc

SEQ ID NO: 1249602 - RNA, 17 nt, Homo sapiens
acggggcucagcaaugc

SEQ ID NO: 1249603 - RNA, 23 nt, Homo sapiens
acggggcugacuccugcucucug

SEQ ID NO: 1249604 - RNA, 21 nt, Homo sapiens
acgggucugccaugcucugga

SEQ ID NO: 1249605 - RNA, 13 nt, Homo sapiens
acggucaguccau

SEQ ID NO: 1249606 - RNA, 12 nt, Homo sapiens
acgguccaugaa

SEQ ID NO: 1249607 - RNA, 19 nt, Homo sapiens
acggugcguuuggccaaaa

SEQ ID NO: 1249608 - RNA, 21 nt, Homo sapiens
acgguuaaauacuguguggaa

SEQ ID NO: 1249609 - RNA, 21 nt, Homo sapiens
acguacaaaauccagcuauga

SEQ ID NO: 1249610 - RNA, 19 nt, Homo sapiens
acguauuuaugucccugac

SEQ ID NO: 1249611 - RNA, 14 nt, Homo sapiens
acgucaagucuccu

SEQ ID NO: 1249612 - RNA, 13 nt, Homo sapiens
acgucagccagcu

SEQ ID NO: 1249613 - RNA, 18 nt, Homo sapiens
acgucauguguuuugcca

SEQ ID NO: 1249614 - RNA, 15 nt, Homo sapiens
acgucgggcauucau

SEQ ID NO: 1249615 - RNA, 17 nt, Homo sapiens
acgucuguggacugaau

SEQ ID NO: 1249616 - RNA, 17 nt, Homo sapiens
acgugaggcccauucuu

SEQ ID NO: 1249617 - RNA, 16 nt, Homo sapiens
acgugccagcucuagu

SEQ ID NO: 1249618 - RNA, 17 nt, Homo sapiens
acguggccucuugagca

SEQ ID NO: 1249619 - RNA, 19 nt, Homo sapiens
acgugggcaaacaggcagu

SEQ ID NO: 1249620 - RNA, 18 nt, Homo sapiens
acguguauaguaucugua

SEQ ID NO: 1249621 - RNA, 18 nt, Homo sapiens
acgugucuuccacuuugc

SEQ ID NO: 1249622 - RNA, 22 nt, Homo sapiens
acgugucuuccacuuugcauau

SEQ ID NO: 1249623 - RNA, 17 nt, Homo sapiens
acguucauuugugugcu

SEQ ID NO: 1249624 - RNA, 17 nt, Homo sapiens
acguugcugccugugaa

SEQ ID NO: 1249625 - RNA, 15 nt, Homo sapiens
acuaaaaaaugucua

SEQ ID NO: 1249626 - RNA, 12 nt, Homo sapiens
acuaaaaauacu

SEQ ID NO: 1249627 - RNA, 19 nt, Homo sapiens
acuaaaagguaugcaauca

SEQ ID NO: 1249628 - RNA, 14 nt, Homo sapiens
acuaaacauuuugu

SEQ ID NO: 1249629 - RNA, 17 nt, Homo sapiens
acuaaaggugcacugcu

SEQ ID NO: 1249630 - RNA, 18 nt, Homo sapiens
acuaaaggugcacugcuu

SEQ ID NO: 1249631 - RNA, 12 nt, Homo sapiens
acuaaaguauau

SEQ ID NO: 1249632 - RNA, 12 nt, Homo sapiens
acuaaaguuaac

SEQ ID NO: 1249633 - RNA, 16 nt, Homo sapiens
acuaaaucaaucugca

SEQ ID NO: 1249634 - RNA, 13 nt, Homo sapiens
acuaaaugaacua

SEQ ID NO: 1249635 - RNA, 14 nt, Homo sapiens
acuaaaugaacuaa

SEQ ID NO: 1249636 - RNA, 18 nt, Homo sapiens
acuaaaugcacauuuuau

SEQ ID NO: 1249637 - RNA, 19 nt, Homo sapiens
acuaaauuacaaaugcaau

SEQ ID NO: 1249638 - RNA, 16 nt, Homo sapiens
acuaacaagauuugua

SEQ ID NO: 1249639 - RNA, 17 nt, Homo sapiens
acuaacagauaagcaag

SEQ ID NO: 1249640 - RNA, 16 nt, Homo sapiens
acuaacaggccaaaga

SEQ ID NO: 1249641 - RNA, 23 nt, Homo sapiens
acuaacauuucccccgagcucuu

SEQ ID NO: 1249642 - RNA, 19 nt, Homo sapiens
acuaaccagagucagcaca

SEQ ID NO: 1249643 - RNA, 14 nt, Homo sapiens
acuaaccaucugaa

SEQ ID NO: 1249644 - RNA, 22 nt, Homo sapiens
acuaaccaucugaagaaacuuc

SEQ ID NO: 1249645 - RNA, 18 nt, Homo sapiens
acuaaccuggguucccuu

SEQ ID NO: 1249646 - RNA, 16 nt, Homo sapiens
acuaacuagacuaaga

SEQ ID NO: 1249647 - RNA, 16 nt, Homo sapiens
acuaagaaauauucca

SEQ ID NO: 1249648 - RNA, 18 nt, Homo sapiens
auccuggaugauuucauc

SEQ ID NO: 1249649 - RNA, 15 nt, Homo sapiens
auccugggggaccaa

SEQ ID NO: 1249650 - RNA, 20 nt, Homo sapiens
auccugggggaccaaugagg

SEQ ID NO: 1249651 - RNA, 22 nt, Homo sapiens
auccugguuucauaacuuccug

SEQ ID NO: 1249652 - RNA, 20 nt, Homo sapiens
auccuguauaagcacugaaa

SEQ ID NO: 1249653 - RNA, 22 nt, Homo sapiens
auccuguauucuucaaccagug

SEQ ID NO: 1249654 - RNA, 17 nt, Homo sapiens
auccugugacugucuca

SEQ ID NO: 1249655 - RNA, 17 nt, Homo sapiens
auccuuaaaacaauucu

SEQ ID NO: 1249656 - RNA, 14 nt, Homo sapiens
auccuuccaaagaa

SEQ ID NO: 1249657 - RNA, 16 nt, Homo sapiens
auccuuccacuaucau

SEQ ID NO: 1249658 - RNA, 20 nt, Homo sapiens
auccuuucaagacagaaaga

SEQ ID NO: 1249659 - RNA, 13 nt, Homo sapiens
aucgaacuucaca

SEQ ID NO: 1249660 - RNA, 16 nt, Homo sapiens
aucgaaucuacuaauu

SEQ ID NO: 1249661 - RNA, 21 nt, Homo sapiens
aucgacuuguuuuugcacaug

SEQ ID NO: 1249662 - RNA, 15 nt, Homo sapiens
aucgcaccacugcac

SEQ ID NO: 1249663 - RNA, 16 nt, Homo sapiens
aucgcaccacugcacu

SEQ ID NO: 1249664 - RNA, 20 nt, Homo sapiens
aucgcaggagucucugccac

SEQ ID NO: 1249665 - RNA, 23 nt, Homo sapiens
aucgccguguuacuguugcacug

SEQ ID NO: 1249666 - RNA, 18 nt, Homo sapiens
aucgcucauagaucagca

SEQ ID NO: 1249667 - RNA, 23 nt, Homo sapiens
aucgcucguguguucuauccaaa

SEQ ID NO: 1249668 - RNA, 17 nt, Homo sapiens
aucggagacagugaucu

SEQ ID NO: 1249669 - RNA, 19 nt, Homo sapiens
aucggcuggggacugcuac

SEQ ID NO: 1249670 - RNA, 16 nt, Homo sapiens
aucgggagcagugucu

SEQ ID NO: 1249671 - RNA, 22 nt, Homo sapiens
aucgucuaaacuuuagaauuaa

SEQ ID NO: 1249672 - RNA, 19 nt, Homo sapiens
aucgugaaaccccaucucu

SEQ ID NO: 1249673 - RNA, 14 nt, Homo sapiens
aucguuuugcccga

SEQ ID NO: 1249674 - RNA, 22 nt, Homo sapiens
aucuaaaccauaugaacauaua

SEQ ID NO: 1249675 - RNA, 21 nt, Homo sapiens
aucuaaaguugcuccauacaa

SEQ ID NO: 1249676 - RNA, 13 nt, Homo sapiens
aucuaaaucuuca

SEQ ID NO: 1249677 - RNA, 14 nt, Homo sapiens
aucuaaggauguca

SEQ ID NO: 1249678 - RNA, 14 nt, Homo sapiens
aucuaagugauaua

SEQ ID NO: 1249679 - RNA, 17 nt, Homo sapiens
aucuaauuacaucauga

SEQ ID NO: 1249680 - RNA, 18 nt, Homo sapiens
aucuacaaaaaacaacaa

SEQ ID NO: 1249681 - RNA, 19 nt, Homo sapiens
aucuacauaaggaugaagg

SEQ ID NO: 1249682 - RNA, 18 nt, Homo sapiens
aucuaccacuguaugagu

SEQ ID NO: 1249683 - RNA, 11 nt, Homo sapiens
aucuaccagca

SEQ ID NO: 1249684 - RNA, 14 nt, Homo sapiens
aucuaccagcauaa

SEQ ID NO: 1249685 - RNA, 13 nt, Homo sapiens
aucuacccugcug

SEQ ID NO: 1249686 - RNA, 18 nt, Homo sapiens
aucuacccugcugaccuc

SEQ ID NO: 1249687 - RNA, 15 nt, Homo sapiens
aucuaccugccucag

SEQ ID NO: 1249688 - RNA, 14 nt, Homo sapiens
aucuagaagacugu

SEQ ID NO: 1249689 - RNA, 17 nt, Homo sapiens
aucuagaagacugucag

SEQ ID NO: 1249690 - RNA, 20 nt, Homo sapiens
aucuaggagaagggucucau

SEQ ID NO: 1249691 - RNA, 22 nt, Homo sapiens
aucuagguucaggaagaccaca

SEQ ID NO: 1249692 - RNA, 16 nt, Homo sapiens
aucuagucacaaagac

SEQ ID NO: 1249693 - RNA, 22 nt, Homo sapiens
aucuaguguuggggauccuggc

SEQ ID NO: 1249694 - RNA, 16 nt, Homo sapiens
aucuauagaacaucca

SEQ ID NO: 1249695 - RNA, 23 nt, Homo sapiens
aggaugagagcccagagguaaca

SEQ ID NO: 1249696 - RNA, 12 nt, Homo sapiens
aggaugcacauu

SEQ ID NO: 1249697 - RNA, 18 nt, Homo sapiens
aggauggccuggaaccca

SEQ ID NO: 1249698 - RNA, 22 nt, Homo sapiens
aggauggggcucccagcuccuu

SEQ ID NO: 1249699 - RNA, 23 nt, Homo sapiens
aggaugguggacuacaaaauaca

SEQ ID NO: 1249700 - RNA, 16 nt, Homo sapiens
aggaugguucugugac

SEQ ID NO: 1249701 - RNA, 14 nt, Homo sapiens
aggauguaagccug

SEQ ID NO: 1249702 - RNA, 18 nt, Homo sapiens
aggauguaucucacaagu

SEQ ID NO: 1249703 - RNA, 13 nt, Homo sapiens
aggaugugauaua

SEQ ID NO: 1249704 - RNA, 13 nt, Homo sapiens
aggaugugcaagc

SEQ ID NO: 1249705 - RNA, 17 nt, Homo sapiens
aggauguucugggacac

SEQ ID NO: 1249706 - RNA, 22 nt, Homo sapiens
aggauuaauaaagauggcacuu

SEQ ID NO: 1249707 - RNA, 14 nt, Homo sapiens
aggauucagcuauu

SEQ ID NO: 1249708 - RNA, 17 nt, Homo sapiens
aggauucccccaacaca

SEQ ID NO: 1249709 - RNA, 14 nt, Homo sapiens
aggauugcuacugu

SEQ ID NO: 1249710 - RNA, 14 nt, Homo sapiens
aggauuuuaccaaa

SEQ ID NO: 1249711 - RNA, 15 nt, Homo sapiens
aggauuuugauccaa

SEQ ID NO: 1249712 - RNA, 19 nt, Homo sapiens
aggcaaagugcugcuggaa

SEQ ID NO: 1249713 - RNA, 17 nt, Homo sapiens
aggcaagcaagcucucu

SEQ ID NO: 1249714 - RNA, 19 nt, Homo sapiens
aggcaagcaggaccuggca

SEQ ID NO: 1249715 - RNA, 19 nt, Homo sapiens
aggcacccaccaccaugcc

SEQ ID NO: 1249716 - RNA, 22 nt, Homo sapiens
aggcaccuggccugcugggaac

SEQ ID NO: 1249717 - RNA, 21 nt, Homo sapiens
aggcacuagccuuuggcucug

SEQ ID NO: 1249718 - RNA, 15 nt, Homo sapiens
aggcacucaaaagcu

SEQ ID NO: 1249719 - RNA, 22 nt, Homo sapiens
aggcacugcugcccagccucca

SEQ ID NO: 1249720 - RNA, 19 nt, Homo sapiens
aggcacuguaguucuaaga

SEQ ID NO: 1249721 - RNA, 18 nt, Homo sapiens
aggcacuguggcucugca

SEQ ID NO: 1249722 - RNA, 17 nt, Homo sapiens
aggcagaaaaaugucau

SEQ ID NO: 1249723 - RNA, 17 nt, Homo sapiens
aggcagagguugcagug

SEQ ID NO: 1249724 - RNA, 19 nt, Homo sapiens
aggcagaguuugccuuccu

SEQ ID NO: 1249725 - RNA, 22 nt, Homo sapiens
aggcagauggggcacugaccca

SEQ ID NO: 1249726 - RNA, 22 nt, Homo sapiens
aggcagccacccugucaccuag

SEQ ID NO: 1249727 - RNA, 20 nt, Homo sapiens
aggcaggagaaucacuggaa

SEQ ID NO: 1249728 - RNA, 15 nt, Homo sapiens
aggcaggaggaucac

SEQ ID NO: 1249729 - RNA, 16 nt, Homo sapiens
aggcagggcugggaag

SEQ ID NO: 1249730 - RNA, 18 nt, Homo sapiens
aggcagugauuagcacuu

SEQ ID NO: 1249731 - RNA, 18 nt, Homo sapiens
aggcaucagguuguuaga

SEQ ID NO: 1249732 - RNA, 20 nt, Homo sapiens
aggcaucauacuaaacuuca

SEQ ID NO: 1249733 - RNA, 21 nt, Homo sapiens
aggcaucauacuaaacuucac

SEQ ID NO: 1249734 - RNA, 17 nt, Homo sapiens
aggcaugaagagcaaaa

SEQ ID NO: 1249735 - RNA, 19 nt, Homo sapiens
aggcaugagccacugcacu

SEQ ID NO: 1249736 - RNA, 22 nt, Homo sapiens
aggcaugagggaucacagggcc

SEQ ID NO: 1249737 - RNA, 14 nt, Homo sapiens
aggcauggcucaga

SEQ ID NO: 1249738 - RNA, 22 nt, Homo sapiens
aggcauggucccuuaaggcaca

SEQ ID NO: 1249739 - RNA, 21 nt, Homo sapiens
aggcauguagcuacaggacau

SEQ ID NO: 1249740 - RNA, 20 nt, Homo sapiens
aggcauucuguggccagcca

SEQ ID NO: 1249741 - RNA, 16 nt, Homo sapiens
aggccacaccaucucc

SEQ ID NO: 1249742 - RNA, 16 nt, Homo sapiens
aggccacauaccucuc

SEQ ID NO: 1249743 - RNA, 20 nt, Homo sapiens
aggccacccccuauccucug

SEQ ID NO: 1249744 - RNA, 22 nt, Homo sapiens
aggccaccccuaggaacucagu

SEQ ID NO: 1249745 - RNA, 14 nt, Homo sapiens
aggccacuggggac

SEQ ID NO: 1249746 - RNA, 20 nt, Homo sapiens
aggccagagggagugacaga

SEQ ID NO: 1249747 - RNA, 19 nt, Homo sapiens
aggccagagggcaguggcc

SEQ ID NO: 1249748 - RNA, 11 nt, Homo sapiens
aggccagguga

SEQ ID NO: 1249749 - RNA, 20 nt, Homo sapiens
aggccagguguggugacuca

SEQ ID NO: 1249750 - RNA, 15 nt, Homo sapiens
aggccagugaccuca

SEQ ID NO: 1249751 - RNA, 19 nt, Homo sapiens
aggccagugccagcaccug

SEQ ID NO: 1249752 - RNA, 13 nt, Homo sapiens
aggccagugucug

SEQ ID NO: 1249753 - RNA, 18 nt, Homo sapiens
aggccauaggaguccuaa

SEQ ID NO: 1249754 - RNA, 17 nt, Homo sapiens
aggccauggugcacaaa

SEQ ID NO: 1249755 - RNA, 18 nt, Homo sapiens
aggccauuaggguugccu

SEQ ID NO: 1249756 - RNA, 14 nt, Homo sapiens
aggcccaacuguga

SEQ ID NO: 1249757 - RNA, 20 nt, Homo sapiens
aggcccaagagcagagucug

SEQ ID NO: 1249758 - RNA, 17 nt, Homo sapiens
aggcccacaggaggcaa

SEQ ID NO: 1249759 - RNA, 14 nt, Homo sapiens
aggcccauucuuca

SEQ ID NO: 1249760 - RNA, 15 nt, Homo sapiens
aggcccccacuucuc

SEQ ID NO: 1249761 - RNA, 17 nt, Homo sapiens
aggcccccacuugccuc

SEQ ID NO: 1249762 - RNA, 21 nt, Homo sapiens
aggcccugagcuuuguccuga

SEQ ID NO: 1249763 - RNA, 17 nt, Homo sapiens
aggcccuggaacucuau

SEQ ID NO: 1249764 - RNA, 16 nt, Homo sapiens
aggcccuggaggucuc

SEQ ID NO: 1249765 - RNA, 14 nt, Homo sapiens
aggcccuguccuaa

SEQ ID NO: 1249766 - RNA, 19 nt, Homo sapiens
aggcccuuauuuucaagaa

SEQ ID NO: 1249767 - RNA, 15 nt, Homo sapiens
aggccgcuguggccu

SEQ ID NO: 1249768 - RNA, 20 nt, Homo sapiens
aggccgggcacgguggcuca

SEQ ID NO: 1249769 - RNA, 19 nt, Homo sapiens
aggccgggcgcaguggcuc

SEQ ID NO: 1249770 - RNA, 23 nt, Homo sapiens
aggccgugcaguggcugugccac

SEQ ID NO: 1249771 - RNA, 18 nt, Homo sapiens
aggccgugugucugucag

SEQ ID NO: 1249772 - RNA, 15 nt, Homo sapiens
aggccuagacucugu

SEQ ID NO: 1249773 - RNA, 23 nt, Homo sapiens
aggccuagacucugucuaccugg

SEQ ID NO: 1249774 - RNA, 19 nt, Homo sapiens
aggccugagcgagugucca

SEQ ID NO: 1249775 - RNA, 15 nt, Homo sapiens
aggccuggauaauau

SEQ ID NO: 1249776 - RNA, 18 nt, Homo sapiens
aggccuggccagaugcac

SEQ ID NO: 1249777 - RNA, 18 nt, Homo sapiens
aggccuggggaggcccua

SEQ ID NO: 1249778 - RNA, 17 nt, Homo sapiens
aggccuuuuaacauuuu

SEQ ID NO: 1249779 - RNA, 22 nt, Homo sapiens
aggccuuuuuugccagacucua

SEQ ID NO: 1249780 - RNA, 19 nt, Homo sapiens
aggcgagagaggagccaga

SEQ ID NO: 1249781 - RNA, 15 nt, Homo sapiens
aggcgauccaccugu

SEQ ID NO: 1249782 - RNA, 20 nt, Homo sapiens
aggcgauucuccugccucag

SEQ ID NO: 1249783 - RNA, 16 nt, Homo sapiens
aggcgcaggugcacag

SEQ ID NO: 1249784 - RNA, 16 nt, Homo sapiens
aggcgccugccaucau

SEQ ID NO: 1249785 - RNA, 18 nt, Homo sapiens
aggcgcuuggcaucacac

SEQ ID NO: 1249786 - RNA, 14 nt, Homo sapiens
aggcggggugggca

SEQ ID NO: 1249787 - RNA, 23 nt, Homo sapiens
aggcguuuguuauauaaaaauac

SEQ ID NO: 1249788 - RNA, 14 nt, Homo sapiens
aggcuaaaugagau

SEQ ID NO: 1249789 - RNA, 15 nt, Homo sapiens
aggcuaccucaagac

SEQ ID NO: 1249790 - RNA, 20 nt, Homo sapiens
aggcuagaacacuacagggg

SEQ ID NO: 1249791 - RNA, 17 nt, Homo sapiens
aggcuaguccggaccca

SEQ ID NO: 1249792 - RNA, 16 nt, Homo sapiens
aggcuaucaacaaaga

SEQ ID NO: 1249793 - RNA, 21 nt, Homo sapiens
aggcuccacuuggucugugag

SEQ ID NO: 1249794 - RNA, 21 nt, Homo sapiens
aggcuccugccaguguggaac

SEQ ID NO: 1249795 - RNA, 17 nt, Homo sapiens
aggcucuaauguacaau

SEQ ID NO: 1249796 - RNA, 19 nt, Homo sapiens
aggcucugggcucagggcu

SEQ ID NO: 1249797 - RNA, 23 nt, Homo sapiens
aggcucuuaagcagcauggaaaa

SEQ ID NO: 1249798 - RNA, 23 nt, Homo sapiens
aggcugaaaagaagccucagcuc

SEQ ID NO: 1249799 - RNA, 20 nt, Homo sapiens
aggcugcagcgagcuaugau

SEQ ID NO: 1249800 - RNA, 20 nt, Homo sapiens
aggcugcccccaacacucca

SEQ ID NO: 1249801 - RNA, 16 nt, Homo sapiens
aggcugccccucucac

SEQ ID NO: 1249802 - RNA, 17 nt, Homo sapiens
aggcugcuagauguagg

SEQ ID NO: 1249803 - RNA, 14 nt, Homo sapiens
aggcuggagugcag

SEQ ID NO: 1249804 - RNA, 15 nt, Homo sapiens
aggcuggagugcagu

SEQ ID NO: 1249805 - RNA, 20 nt, Homo sapiens
aggcuggagugcaguggcac

SEQ ID NO: 1249806 - RNA, 13 nt, Homo sapiens
aggcuggucucaa

SEQ ID NO: 1249807 - RNA, 11 nt, Homo sapiens
aggcuggugcc

SEQ ID NO: 1249808 - RNA, 14 nt, Homo sapiens
aggcugguggcaag

SEQ ID NO: 1249809 - RNA, 15 nt, Homo sapiens
aggcugucacagucc

SEQ ID NO: 1249810 - RNA, 16 nt, Homo sapiens
aggcuguccuguacau

SEQ ID NO: 1249811 - RNA, 15 nt, Homo sapiens
aggcuucacccugaa

SEQ ID NO: 1249812 - RNA, 15 nt, Homo sapiens
aggcuuuacagugua

SEQ ID NO: 1249813 - RNA, 22 nt, Homo sapiens
aggcuuucaagaagugccaguu

SEQ ID NO: 1249814 - RNA, 23 nt, Homo sapiens
aggcuuucagaagcucuucuaaa

SEQ ID NO: 1249815 - RNA, 12 nt, Homo sapiens
agggaaaacugc

SEQ ID NO: 1249816 - RNA, 13 nt, Homo sapiens
agggaaaacugca

SEQ ID NO: 1249817 - RNA, 13 nt, Homo sapiens
agggaaaggggag

SEQ ID NO: 1249818 - RNA, 16 nt, Homo sapiens
agggaaaggggugcuu

SEQ ID NO: 1249819 - RNA, 18 nt, Homo sapiens
agggaacgggguccuuca

SEQ ID NO: 1249820 - RNA, 20 nt, Homo sapiens
agggaagaaugaacacuccc

SEQ ID NO: 1249821 - RNA, 20 nt, Homo sapiens
agggaagagugcauuuuccc

SEQ ID NO: 1249822 - RNA, 12 nt, Homo sapiens
aaaaaaauggau

SEQ ID NO: 1249823 - RNA, 13 nt, Homo sapiens
aaaaaaauuacuu

SEQ ID NO: 1249824 - RNA, 18 nt, Homo sapiens
aaaaaagagaacaccucc

SEQ ID NO: 1249825 - RNA, 12 nt, Homo sapiens
aaaaaaugcaca

SEQ ID NO: 1249826 - RNA, 21 nt, Homo sapiens
aaaaacacccgacgucaugua

SEQ ID NO: 1249827 - RNA, 23 nt, Homo sapiens
aaaaacagagccuccuagaugua

SEQ ID NO: 1249828 - RNA, 11 nt, Homo sapiens
aaaaaccaaug

SEQ ID NO: 1249829 - RNA, 18 nt, Homo sapiens
aaaaaccauaggcugcuc

SEQ ID NO: 1249830 - RNA, 17 nt, Homo sapiens
aaaaaccccaaacuguu

SEQ ID NO: 1249831 - RNA, 20 nt, Homo sapiens
aaaaaccccguuucccugaa

SEQ ID NO: 1249832 - RNA, 22 nt, Homo sapiens
aaaaagaagaacuauaugugaa

SEQ ID NO: 1249833 - RNA, 18 nt, Homo sapiens
aaaaagacauucuuccaa

SEQ ID NO: 1249834 - RNA, 18 nt, Homo sapiens
aaaaagcaucuaucucau

SEQ ID NO: 1249835 - RNA, 21 nt, Homo sapiens
aaaaagcccuuaaaaauaugu

SEQ ID NO: 1249836 - RNA, 15 nt, Homo sapiens
aaaaagcuagcacua

SEQ ID NO: 1249837 - RNA, 23 nt, Homo sapiens
aaaaaguccuugauuuagcacua

SEQ ID NO: 1249838 - RNA, 19 nt, Homo sapiens
aaaaauaaaaaagaucucc

SEQ ID NO: 1249839 - RNA, 17 nt, Homo sapiens
aaaaauaaaguaccaca

SEQ ID NO: 1249840 - RNA, 20 nt, Homo sapiens
aaaaauaaaguaccacacau

SEQ ID NO: 1249841 - RNA, 14 nt, Homo sapiens
aaaaauaauugcca

SEQ ID NO: 1249842 - RNA, 15 nt, Homo sapiens
aaaaauagacacucc

SEQ ID NO: 1249843 - RNA, 15 nt, Homo sapiens
aaaaauagacaugua

SEQ ID NO: 1249844 - RNA, 16 nt, Homo sapiens
aaaaauagcaaugccu

SEQ ID NO: 1249845 - RNA, 16 nt, Homo sapiens
aaaaauauauaugcau

SEQ ID NO: 1249846 - RNA, 19 nt, Homo sapiens
aaaaauauauuuaaugaua

SEQ ID NO: 1249847 - RNA, 23 nt, Homo sapiens
aaaaauauauuuaaugauaagua

SEQ ID NO: 1249848 - RNA, 13 nt, Homo sapiens
aaaaauauuauaa

SEQ ID NO: 1249849 - RNA, 16 nt, Homo sapiens
aaaaauauuugcugag

SEQ ID NO: 1249850 - RNA, 16 nt, Homo sapiens
aaagagauauugauau

SEQ ID NO: 1249851 - RNA, 21 nt, Homo sapiens
aaagagcaacaauccaucucu

SEQ ID NO: 1249852 - RNA, 18 nt, Homo sapiens
aaagagcagccuggcuaa

SEQ ID NO: 1249853 - RNA, 20 nt, Homo sapiens
aaagagcuccaaauugaauc

SEQ ID NO: 1249854 - RNA, 15 nt, Homo sapiens
aaagaggcugccccu

SEQ ID NO: 1249855 - RNA, 20 nt, Homo sapiens
aaagaggcugccccucucac

SEQ ID NO: 1249856 - RNA, 22 nt, Homo sapiens
aaagaggcugccccucucacca

SEQ ID NO: 1249857 - RNA, 14 nt, Homo sapiens
aaagagggcuuccu

SEQ ID NO: 1249858 - RNA, 22 nt, Homo sapiens
aaagaguucaagugucuguaua

SEQ ID NO: 1249859 - RNA, 22 nt, Homo sapiens
aaagauccaagaaggccuucau

SEQ ID NO: 1249860 - RNA, 20 nt, Homo sapiens
aaagaugaucuacucagaaa

SEQ ID NO: 1249861 - RNA, 12 nt, Homo sapiens
aaagaugcagug

SEQ ID NO: 1249862 - RNA, 13 nt, Homo sapiens
aaagaugcagugg

SEQ ID NO: 1249863 - RNA, 15 nt, Homo sapiens
aaagauggaugugcu

SEQ ID NO: 1249864 - RNA, 16 nt, Homo sapiens
aaagauguuugucaga

SEQ ID NO: 1249865 - RNA, 19 nt, Homo sapiens
aaagauguuugucagauau

SEQ ID NO: 1249866 - RNA, 21 nt, Homo sapiens
aaagauuauagaaguagcaaa

SEQ ID NO: 1249867 - RNA, 18 nt, Homo sapiens
aaagauucuauaguucua

SEQ ID NO: 1249868 - RNA, 20 nt, Homo sapiens
aaagauuugugaacuggaag

SEQ ID NO: 1249869 - RNA, 23 nt, Homo sapiens
aaagauuuucuaaggaaugcaca

SEQ ID NO: 1249870 - RNA, 13 nt, Homo sapiens
aaagcaaaagcaa

SEQ ID NO: 1249871 - RNA, 22 nt, Homo sapiens
aaagcaaacacuuacagaauua

SEQ ID NO: 1249872 - RNA, 23 nt, Homo sapiens
aaagcaacaucuucauagaugaa

SEQ ID NO: 1249873 - RNA, 12 nt, Homo sapiens
aaagcacaguuu

SEQ ID NO: 1249874 - RNA, 23 nt, Homo sapiens
aaagcacgugucucagacugcau

SEQ ID NO: 1249875 - RNA, 21 nt, Homo sapiens
aaagcacuuacaccaguuuga

SEQ ID NO: 1249876 - RNA, 16 nt, Homo sapiens
aaagcagacagucaca

SEQ ID NO: 1249877 - RNA, 22 nt, Homo sapiens
aaagcagaguggacugcauuua

SEQ ID NO: 1249878 - RNA, 12 nt, Homo sapiens
aaagcagcaucu

SEQ ID NO: 1249879 - RNA, 20 nt, Homo sapiens
aaagcagccauuggcacugu

SEQ ID NO: 1249880 - RNA, 17 nt, Homo sapiens
aaagcagcucaagaaca

SEQ ID NO: 1249881 - RNA, 23 nt, Homo sapiens
aaagcaggccuuugcagauauga

SEQ ID NO: 1249882 - RNA, 21 nt, Homo sapiens
aaagcauauuggugcuagaaa

SEQ ID NO: 1249883 - RNA, 14 nt, Homo sapiens
aaagcauccaugug

SEQ ID NO: 1249884 - RNA, 20 nt, Homo sapiens
aaagcauggacuaaccccaa

SEQ ID NO: 1249885 - RNA, 10 nt, Homo sapiens
aaagcauucu

SEQ ID NO: 1249886 - RNA, 16 nt, Homo sapiens
aaagccaaacaagccu

SEQ ID NO: 1249887 - RNA, 18 nt, Homo sapiens
aaagccaaacaagccuua

SEQ ID NO: 1249888 - RNA, 15 nt, Homo sapiens
aaagccaacagucaa

SEQ ID NO: 1249889 - RNA, 14 nt, Homo sapiens
aaagccacaaggcu

SEQ ID NO: 1249890 - RNA, 22 nt, Homo sapiens
aaagccacaaugagaaugaugc

SEQ ID NO: 1249891 - RNA, 15 nt, Homo sapiens
aaagccaccacauuu

SEQ ID NO: 1249892 - RNA, 16 nt, Homo sapiens
aaagccacccuaccau

SEQ ID NO: 1249893 - RNA, 19 nt, Homo sapiens
aaagccaccucucccucaa

SEQ ID NO: 1249894 - RNA, 17 nt, Homo sapiens
aaagccagccaagcuuu

SEQ ID NO: 1249895 - RNA, 18 nt, Homo sapiens
aaagccagugaaauguga

SEQ ID NO: 1249896 - RNA, 18 nt, Homo sapiens
aaagcccaaccuccugac

SEQ ID NO: 1249897 - RNA, 16 nt, Homo sapiens
aaagcccauugccauu

SEQ ID NO: 1249898 - RNA, 18 nt, Homo sapiens
aaagccccucucuguuga

SEQ ID NO: 1249899 - RNA, 17 nt, Homo sapiens
aaagcccuaauagcaga

SEQ ID NO: 1249900 - RNA, 21 nt, Homo sapiens
aaagcccuuaaaaauaugugu

SEQ ID NO: 1249901 - RNA, 24 nt, Homo sapiens
aaagccuccaaggguuucgacugg

SEQ ID NO: 1249902 - RNA, 13 nt, Homo sapiens
aaagccuccucau

SEQ ID NO: 1249903 - RNA, 21 nt, Homo sapiens
aaagccucgggccacaugggu

SEQ ID NO: 1249904 - RNA, 13 nt, Homo sapiens
aaagccuuaggga

SEQ ID NO: 1249905 - RNA, 23 nt, Homo sapiens
aaagccuuaucaagugucuucca

SEQ ID NO: 1249906 - RNA, 14 nt, Homo sapiens
aaagcgagauccca

SEQ ID NO: 1249907 - RNA, 19 nt, Homo sapiens
aaagcgagaucccaucucu

SEQ ID NO: 1249908 - RNA, 15 nt, Homo sapiens
aaagcuaaauuccac

SEQ ID NO: 1249909 - RNA, 16 nt, Homo sapiens
aaagcuaauuaaucau

SEQ ID NO: 1249910 - RNA, 13 nt, Homo sapiens
aaagcuacuaugu

SEQ ID NO: 1249911 - RNA, 17 nt, Homo sapiens
aaagcuagguguuuaau

SEQ ID NO: 1249912 - RNA, 17 nt, Homo sapiens
aaagcucacugcugauc

SEQ ID NO: 1249913 - RNA, 15 nt, Homo sapiens
aaagcucuguugcaa

SEQ ID NO: 1249914 - RNA, 18 nt, Homo sapiens
aaagcucuguugcaauua

SEQ ID NO: 1249915 - RNA, 14 nt, Homo sapiens
aaagcugaagacca

SEQ ID NO: 1249916 - RNA, 22 nt, Homo sapiens
aaagcugauuacugucaauaaa

SEQ ID NO: 1249917 - RNA, 12 nt, Homo sapiens
aaagcugccauu

SEQ ID NO: 1249918 - RNA, 15 nt, Homo sapiens
aaagcugcccacugu

SEQ ID NO: 1249919 - RNA, 17 nt, Homo sapiens
aaagcugcuaaaucucc

SEQ ID NO: 1249920 - RNA, 17 nt, Homo sapiens
aaagcugcugacagugu

SEQ ID NO: 1249921 - RNA, 18 nt, Homo sapiens
aaagcugggaaccagcau

SEQ ID NO: 1249922 - RNA, 18 nt, Homo sapiens
aaagcuugaagcugugga

SEQ ID NO: 1249923 - RNA, 21 nt, Homo sapiens
aaagcuuguggccccuuuuac

SEQ ID NO: 1249924 - RNA, 21 nt, Homo sapiens
aaagcuuuuuacucaaagagu

SEQ ID NO: 1249925 - RNA, 15 nt, Homo sapiens
aaagcuuuuuccucc

SEQ ID NO: 1249926 - RNA, 16 nt, Homo sapiens
aaaggaaaaagcacaa

SEQ ID NO: 1249927 - RNA, 23 nt, Homo sapiens
aaaggaaaauaaaugaacauaug

SEQ ID NO: 1249928 - RNA, 19 nt, Homo sapiens
aaaggaaaaucacaucucc

SEQ ID NO: 1249929 - RNA, 20 nt, Homo sapiens
aaaggaaaaucacaucucca

SEQ ID NO: 1249930 - RNA, 21 nt, Homo sapiens
aaaggaacucuagaagaccaa

SEQ ID NO: 1249931 - RNA, 16 nt, Homo sapiens
aaaggaagacuugaag

SEQ ID NO: 1249932 - RNA, 21 nt, Homo sapiens
aaaggaagcuccacugucacc

SEQ ID NO: 1249933 - RNA, 22 nt, Homo sapiens
aaaggaaggcuucugugucaau

SEQ ID NO: 1249934 - RNA, 15 nt, Homo sapiens
aaaggacucuccaaa

SEQ ID NO: 1249935 - RNA, 16 nt, Homo sapiens
aaaggacucuccagcc

SEQ ID NO: 1249936 - RNA, 16 nt, Homo sapiens
aaaggagaacuaucca

SEQ ID NO: 1249937 - RNA, 21 nt, Homo sapiens
aaaggagccaauugauuucaa

SEQ ID NO: 1249938 - RNA, 23 nt, Homo sapiens
aaaggaugcuuacuccacuucgc

SEQ ID NO: 1249939 - RNA, 23 nt, Homo sapiens
aaaggauucuauaucaugaccaa

SEQ ID NO: 1249940 - RNA, 17 nt, Homo sapiens
aaaggauuuuacagaaa

SEQ ID NO: 1249941 - RNA, 18 nt, Homo sapiens
aaaggauuuuaccaaagc

SEQ ID NO: 1249942 - RNA, 22 nt, Homo sapiens
aaaggcagauuaaaagcacaag

SEQ ID NO: 1249943 - RNA, 11 nt, Homo sapiens
aaaggcaguuc

SEQ ID NO: 1249944 - RNA, 13 nt, Homo sapiens
aaaggcaguuuuc

SEQ ID NO: 1249945 - RNA, 13 nt, Homo sapiens
aaaggcugagaag

SEQ ID NO: 1249946 - RNA, 15 nt, Homo sapiens
aaaggcugguggcaa

SEQ ID NO: 1249947 - RNA, 21 nt, Homo sapiens
aaagggaaggugacugaaggc

SEQ ID NO: 1249948 - RNA, 16 nt, Homo sapiens
aaagggagugcaugug

SEQ ID NO: 1249949 - RNA, 14 nt, Homo sapiens
aaagggauacacag

SEQ ID NO: 1249950 - RNA, 16 nt, Homo sapiens
aaagggauaguccaaa

SEQ ID NO: 1249951 - RNA, 14 nt, Homo sapiens
aaaggggcacuggu

SEQ ID NO: 1249952 - RNA, 15 nt, Homo sapiens
aaaggguaauuuccu

SEQ ID NO: 1249953 - RNA, 19 nt, Homo sapiens
aaagguagcuuaccugaca

SEQ ID NO: 1249954 - RNA, 18 nt, Homo sapiens
aaagguauuauacaugug

SEQ ID NO: 1249955 - RNA, 16 nt, Homo sapiens
aaaggugaccaaugau

SEQ ID NO: 1249956 - RNA, 21 nt, Homo sapiens
aaaggugguccuuccuaccuc

SEQ ID NO: 1249957 - RNA, 22 nt, Homo sapiens
aaaggugucuucuuugacuuaa

SEQ ID NO: 1249958 - RNA, 18 nt, Homo sapiens
aaagguucuucaucccuu

SEQ ID NO: 1249959 - RNA, 16 nt, Homo sapiens
aaagguugaagcacca

SEQ ID NO: 1249960 - RNA, 14 nt, Homo sapiens
aaaguaaaggcaaa

SEQ ID NO: 1249961 - RNA, 16 nt, Homo sapiens
aaaguaagacaucuca

SEQ ID NO: 1249962 - RNA, 20 nt, Homo sapiens
aaaguaauuucuuugaucug

SEQ ID NO: 1249963 - RNA, 22 nt, Homo sapiens
aaaguaauuucuuugaucugga

SEQ ID NO: 1249964 - RNA, 14 nt, Homo sapiens
aaaguaauuuuguc

SEQ ID NO: 1249965 - RNA, 14 nt, Homo sapiens
aaaguaccacacau

SEQ ID NO: 1249966 - RNA, 14 nt, Homo sapiens
aaaguacuucucca

SEQ ID NO: 1249967 - RNA, 12 nt, Homo sapiens
aaaguacuuucu

SEQ ID NO: 1249968 - RNA, 17 nt, Homo sapiens
aaaguagaaaaagauuc

SEQ ID NO: 1249969 - RNA, 20 nt, Homo sapiens
aaaguagaggaauccaugua

SEQ ID NO: 1249970 - RNA, 14 nt, Homo sapiens
aaaguagcaauuuc

SEQ ID NO: 1249971 - RNA, 16 nt, Homo sapiens
aaaguaguccugugaa

SEQ ID NO: 1249972 - RNA, 15 nt, Homo sapiens
aaaguauagagaaaa

SEQ ID NO: 1249973 - RNA, 17 nt, Homo sapiens
aaaguauuagaaauauu

SEQ ID NO: 1249974 - RNA, 15 nt, Homo sapiens
aaaguauucuagugu

SEQ ID NO: 1249975 - RNA, 13 nt, Homo sapiens
aaagucaaaaaua

SEQ ID NO: 1249976 - RNA, 17 nt, Homo sapiens
aaaguccauaccuuaua

SEQ ID NO: 1249977 - RNA, 23 nt, Homo sapiens
aaaacauuuuacuuuaaaaggag

SEQ ID NO: 1249978 - RNA, 12 nt, Homo sapiens
aaaaccaaagag

SEQ ID NO: 1249979 - RNA, 10 nt, Homo sapiens
aaaaccaaug

SEQ ID NO: 1249980 - RNA, 13 nt, Homo sapiens
aaaaccacuguac

SEQ ID NO: 1249981 - RNA, 14 nt, Homo sapiens
aaaaccacuuuccu

SEQ ID NO: 1249982 - RNA, 21 nt, Homo sapiens
aaaaccagucucagauaucau

SEQ ID NO: 1249983 - RNA, 16 nt, Homo sapiens
aaaacccuuacaguga

SEQ ID NO: 1249984 - RNA, 17 nt, Homo sapiens
aaaaccuaccagccaga

SEQ ID NO: 1249985 - RNA, 16 nt, Homo sapiens
aaaaccucuaugcaau

SEQ ID NO: 1249986 - RNA, 16 nt, Homo sapiens
aaaacuaaacuuucau

SEQ ID NO: 1249987 - RNA, 13 nt, Homo sapiens
aaaacuaauuucc

SEQ ID NO: 1249988 - RNA, 20 nt, Homo sapiens
aaaacuaauuuccucugaca

SEQ ID NO: 1249989 - RNA, 18 nt, Homo sapiens
aaaacuacacaaauuaua

SEQ ID NO: 1249990 - RNA, 15 nt, Homo sapiens
aaaacuauauucuca

SEQ ID NO: 1249991 - RNA, 19 nt, Homo sapiens
aaaacucaguaagaauuau

SEQ ID NO: 1249992 - RNA, 17 nt, Homo sapiens
aaaacuccccuuccuca

SEQ ID NO: 1249993 - RNA, 11 nt, Homo sapiens
aaaacucuccu

SEQ ID NO: 1249994 - RNA, 15 nt, Homo sapiens
aaaacucugcaugua

SEQ ID NO: 1249995 - RNA, 11 nt, Homo sapiens
aaaacugccuc

SEQ ID NO: 1249996 - RNA, 17 nt, Homo sapiens
aaaacuggcaucugaca

SEQ ID NO: 1249997 - RNA, 16 nt, Homo sapiens
aaaacuuagugacaaa

SEQ ID NO: 1249998 - RNA, 15 nt, Homo sapiens
aaaacuucuugucag

SEQ ID NO: 1249999 - RNA, 21 nt, Homo sapiens
aaaagaaagcaaacuuaagaa

SEQ ID NO: 1250000 - RNA, 17 nt, Homo sapiens
aaaagaaugugcuauga

SEQ ID NO: 1250001 - RNA, 20 nt, Homo sapiens
aaaagacguucauuauguau

SEQ ID NO: 1250002 - RNA, 20 nt, Homo sapiens
aaaagacugaaucuaccugc

SEQ ID NO: 1250003 - RNA, 22 nt, Homo sapiens
aaaagagcauggaugcauuuca

SEQ ID NO: 1250004 - RNA, 17 nt, Homo sapiens
aaaagagcuauugccaa

SEQ ID NO: 1250005 - RNA, 18 nt, Homo sapiens
aaaagaguuaacauccca

SEQ ID NO: 1250006 - RNA, 20 nt, Homo sapiens
aaaagauacggcccaugcaa

SEQ ID NO: 1250007 - RNA, 14 nt, Homo sapiens
aaaagauuauagaa

SEQ ID NO: 1250008 - RNA, 10 nt, Homo sapiens
aaaagcaaga

SEQ ID NO: 1250009 - RNA, 14 nt, Homo sapiens
aaaagcaaguucgu

SEQ ID NO: 1250010 - RNA, 16 nt, Homo sapiens
aaaagcacaaguacuu

SEQ ID NO: 1250011 - RNA, 14 nt, Homo sapiens
aaaagcacaaucac

SEQ ID NO: 1250012 - RNA, 15 nt, Homo sapiens
aaaagcugaucauaa

SEQ ID NO: 1250013 - RNA, 14 nt, Homo sapiens
aaaagcugcauuua

SEQ ID NO: 1250014 - RNA, 13 nt, Homo sapiens
aaaagcuuagcag

SEQ ID NO: 1250015 - RNA, 20 nt, Homo sapiens
aaaagcuuauucaucuguuu

SEQ ID NO: 1250016 - RNA, 22 nt, Homo sapiens
aaaaggaacucuagaagaccaa

SEQ ID NO: 1250017 - RNA, 21 nt, Homo sapiens
aaaaggacucugcuucagucc

SEQ ID NO: 1250018 - RNA, 16 nt, Homo sapiens
aaaaggauaguaagca

SEQ ID NO: 1250019 - RNA, 13 nt, Homo sapiens
aaaaggcugagaa

SEQ ID NO: 1250020 - RNA, 20 nt, Homo sapiens
aaaagggcagggcaucuccu

SEQ ID NO: 1250021 - RNA, 19 nt, Homo sapiens
aaaagggcugacauuuucu

SEQ ID NO: 1250022 - RNA, 16 nt, Homo sapiens
aaaagguaacuguaca

SEQ ID NO: 1250023 - RNA, 21 nt, Homo sapiens
aaaagguaccccgauggccaa

SEQ ID NO: 1250024 - RNA, 22 nt, Homo sapiens
aaaagguagcuuaccugacaca

SEQ ID NO: 1250025 - RNA, 24 nt, Homo sapiens
aaaagguauuuugaauaccauuaa

SEQ ID NO: 1250026 - RNA, 22 nt, Homo sapiens
aaaagguuaaacccacagccaa

SEQ ID NO: 1250027 - RNA, 15 nt, Homo sapiens
aaaagguuauauacc

SEQ ID NO: 1250028 - RNA, 19 nt, Homo sapiens
aaaagguuuucuucauuca

SEQ ID NO: 1250029 - RNA, 19 nt, Homo sapiens
aaaagucuacaacauagca

SEQ ID NO: 1250030 - RNA, 21 nt, Homo sapiens
aaaagugaucaauaaaaugug

SEQ ID NO: 1250031 - RNA, 19 nt, Homo sapiens
aaaaguucuuuuugcucua

SEQ ID NO: 1250032 - RNA, 13 nt, Homo sapiens
aaaaguugugauu

SEQ ID NO: 1250033 - RNA, 19 nt, Homo sapiens
aaaauaaacaccauuauuc

SEQ ID NO: 1250034 - RNA, 15 nt, Homo sapiens
aaaauaaacaucagu

SEQ ID NO: 1250035 - RNA, 17 nt, Homo sapiens
aaaauaaagcaaugugu

SEQ ID NO: 1250036 - RNA, 12 nt, Homo sapiens
aaaauaaauucc

SEQ ID NO: 1250037 - RNA, 22 nt, Homo sapiens
aaaauaacggugcuugugucac

SEQ ID NO: 1250038 - RNA, 12 nt, Homo sapiens
aaaauaauauua

SEQ ID NO: 1250039 - RNA, 13 nt, Homo sapiens
aaaauaaugcacc

SEQ ID NO: 1250040 - RNA, 14 nt, Homo sapiens
aaaauaauuguucc

SEQ ID NO: 1250041 - RNA, 21 nt, Homo sapiens
aaaauacaguauucuguacca

SEQ ID NO: 1250042 - RNA, 20 nt, Homo sapiens
aaaauagaaauauagccaaa

SEQ ID NO: 1250043 - RNA, 19 nt, Homo sapiens
aaaauagaauguuacuuug

SEQ ID NO: 1250044 - RNA, 16 nt, Homo sapiens
aaaauaguaaagccaa

SEQ ID NO: 1250045 - RNA, 14 nt, Homo sapiens
aaaauagucuucca

SEQ ID NO: 1250046 - RNA, 18 nt, Homo sapiens
aaaauaguuaagacauga

SEQ ID NO: 1250047 - RNA, 14 nt, Homo sapiens
aaaauauggcuaua

SEQ ID NO: 1250048 - RNA, 22 nt, Homo sapiens
aaaauauuaagacaauagcacu

SEQ ID NO: 1250049 - RNA, 18 nt, Homo sapiens
aaaauauuucauuuugau

SEQ ID NO: 1250050 - RNA, 15 nt, Homo sapiens
aaaaucacacuguaa

SEQ ID NO: 1250051 - RNA, 13 nt, Homo sapiens
aaaaucacucuca

SEQ ID NO: 1250052 - RNA, 19 nt, Homo sapiens
aaaaucacucucagugcuu

SEQ ID NO: 1250053 - RNA, 13 nt, Homo sapiens
aaaaucauuaaca

SEQ ID NO: 1250054 - RNA, 20 nt, Homo sapiens
aaaauccaaggcaauuccug

SEQ ID NO: 1250055 - RNA, 20 nt, Homo sapiens
aaaauccugaacuuucuccc

SEQ ID NO: 1250056 - RNA, 13 nt, Homo sapiens
aaaaucuccaucu

SEQ ID NO: 1250057 - RNA, 12 nt, Homo sapiens
aaaaucugucca

SEQ ID NO: 1250058 - RNA, 21 nt, Homo sapiens
aaaaucuuggaaguacaugaa

SEQ ID NO: 1250059 - RNA, 19 nt, Homo sapiens
aaaaugaaagcaugucuca

SEQ ID NO: 1250060 - RNA, 14 nt, Homo sapiens
aaaaugaaaggaag

SEQ ID NO: 1250061 - RNA, 23 nt, Homo sapiens
aaaaugaagguggaacaagcaca

SEQ ID NO: 1250062 - RNA, 16 nt, Homo sapiens
aaaaugaaucuucaca

SEQ ID NO: 1250063 - RNA, 23 nt, Homo sapiens
aaaaugagugacuagacguucau

SEQ ID NO: 1250064 - RNA, 21 nt, Homo sapiens
aaaaugauuuuaucugugaau

SEQ ID NO: 1250065 - RNA, 19 nt, Homo sapiens
aaaaugcaagccaucucua

SEQ ID NO: 1250066 - RNA, 20 nt, Homo sapiens
aaaaugcaagccaucucuaa

SEQ ID NO: 1250067 - RNA, 14 nt, Homo sapiens
aaaaugcaccacuu

SEQ ID NO: 1250068 - RNA, 15 nt, Homo sapiens
aaaaugcacguagcu

SEQ ID NO: 1250069 - RNA, 12 nt, Homo sapiens
aaaaugccuuug

SEQ ID NO: 1250070 - RNA, 15 nt, Homo sapiens
aaaaugcugcucuca

SEQ ID NO: 1250071 - RNA, 22 nt, Homo sapiens
aauaaaugagagggaaucgacu

SEQ ID NO: 1250072 - RNA, 15 nt, Homo sapiens
aauaaaugucuugcc

SEQ ID NO: 1250073 - RNA, 16 nt, Homo sapiens
aauaaauucaucagau

SEQ ID NO: 1250074 - RNA, 13 nt, Homo sapiens
aauaaauuccuaa

SEQ ID NO: 1250075 - RNA, 14 nt, Homo sapiens
aauaaauugcuccu

SEQ ID NO: 1250076 - RNA, 21 nt, Homo sapiens
aauaaauugcuuacugauauu

SEQ ID NO: 1250077 - RNA, 13 nt, Homo sapiens
aauaacacuaaaa

SEQ ID NO: 1250078 - RNA, 14 nt, Homo sapiens
aauaacacuuguca

SEQ ID NO: 1250079 - RNA, 14 nt, Homo sapiens
aauaaccacuuaaa

SEQ ID NO: 1250080 - RNA, 13 nt, Homo sapiens
aauaaccucuggc

SEQ ID NO: 1250081 - RNA, 20 nt, Homo sapiens
aauaacgucuuuuuauaucu

SEQ ID NO: 1250082 - RNA, 23 nt, Homo sapiens
aauaacuaaaagguaugcaauca

SEQ ID NO: 1250083 - RNA, 17 nt, Homo sapiens
aauaagaucagacucug

SEQ ID NO: 1250084 - RNA, 14 nt, Homo sapiens
aauaaggcacaaaa

SEQ ID NO: 1250085 - RNA, 21 nt, Homo sapiens
aauaaguauauaauccuguga

SEQ ID NO: 1250086 - RNA, 15 nt, Homo sapiens
aauaauaauuugcac

SEQ ID NO: 1250087 - RNA, 14 nt, Homo sapiens
aauaauaccuaagc

SEQ ID NO: 1250088 - RNA, 20 nt, Homo sapiens
aauaauagggaaaauaccua

SEQ ID NO: 1250089 - RNA, 18 nt, Homo sapiens
aauaauaugcugccaaau

SEQ ID NO: 1250090 - RNA, 18 nt, Homo sapiens
aauaauauuguuguauaa

SEQ ID NO: 1250091 - RNA, 20 nt, Homo sapiens
aauaaucacgcuuuccugaa

SEQ ID NO: 1250092 - RNA, 14 nt, Homo sapiens
aauaaugauaguua

SEQ ID NO: 1250093 - RNA, 15 nt, Homo sapiens
aauaaugcaccacuu

SEQ ID NO: 1250094 - RNA, 23 nt, Homo sapiens
aauaaugcaugaugaacucaccu

SEQ ID NO: 1250095 - RNA, 20 nt, Homo sapiens
aauaauguuguaauucaugc

SEQ ID NO: 1250096 - RNA, 15 nt, Homo sapiens
aauaauugauuucaa

SEQ ID NO: 1250097 - RNA, 20 nt, Homo sapiens
aauacaauaaauauuugaac

SEQ ID NO: 1250098 - RNA, 14 nt, Homo sapiens
aauacacacaagua

SEQ ID NO: 1250099 - RNA, 18 nt, Homo sapiens
aauacagcuucauuaucu

SEQ ID NO: 1250100 - RNA, 14 nt, Homo sapiens
aauacaguaagcau

SEQ ID NO: 1250101 - RNA, 19 nt, Homo sapiens
aauacagugagcucuagca

SEQ ID NO: 1250102 - RNA, 21 nt, Homo sapiens
aauacauaucgcugacuucau

SEQ ID NO: 1250103 - RNA, 20 nt, Homo sapiens
aauacaugcugcuaauucaa

SEQ ID NO: 1250104 - RNA, 12 nt, Homo sapiens
aauacauggcua

SEQ ID NO: 1250105 - RNA, 17 nt, Homo sapiens
aauacauuucaauuaua

SEQ ID NO: 1250106 - RNA, 18 nt, Homo sapiens
aauaccacagcucagcca

SEQ ID NO: 1250107 - RNA, 14 nt, Homo sapiens
aauaccacuuaccu

SEQ ID NO: 1250108 - RNA, 17 nt, Homo sapiens
aauaccacuuaccucaa

SEQ ID NO: 1250109 - RNA, 21 nt, Homo sapiens
aauaccuagaccuaaacggcu

SEQ ID NO: 1250110 - RNA, 22 nt, Homo sapiens
aauaccuuggcugauguugcag

SEQ ID NO: 1250111 - RNA, 16 nt, Homo sapiens
aauacucugcagugau

SEQ ID NO: 1250112 - RNA, 19 nt, Homo sapiens
aauacucugcuauuucucu

SEQ ID NO: 1250113 - RNA, 22 nt, Homo sapiens
aauacugaaggacacagcagug

SEQ ID NO: 1250114 - RNA, 20 nt, Homo sapiens
aauacuguaaaugcauugga

SEQ ID NO: 1250115 - RNA, 13 nt, Homo sapiens
aauacuguuucca

SEQ ID NO: 1250116 - RNA, 17 nt, Homo sapiens
aauacuuuaugaugcua

SEQ ID NO: 1250117 - RNA, 21 nt, Homo sapiens
aauacuuuuuuuuuaaagcca

SEQ ID NO: 1250118 - RNA, 20 nt, Homo sapiens
aauagaaauaaauuccuaaa

SEQ ID NO: 1250119 - RNA, 21 nt, Homo sapiens
aauagaauauaauuaucggaa

SEQ ID NO: 1250120 - RNA, 14 nt, Homo sapiens
aauagacaaaaagu

SEQ ID NO: 1250121 - RNA, 16 nt, Homo sapiens
aauagacaauuugcac

SEQ ID NO: 1250122 - RNA, 23 nt, Homo sapiens
aauagacauauuaacaugcuuau

SEQ ID NO: 1250123 - RNA, 17 nt, Homo sapiens
aauagacugagucagau

SEQ ID NO: 1250124 - RNA, 22 nt, Homo sapiens
aauagacuuaaaucucauugcu

SEQ ID NO: 1250125 - RNA, 15 nt, Homo sapiens
aauagagacuguaga

SEQ ID NO: 1250126 - RNA, 22 nt, Homo sapiens
aauagauuuuagcaugaugaaa

SEQ ID NO: 1250127 - RNA, 13 nt, Homo sapiens
aauagcaguggua

SEQ ID NO: 1250128 - RNA, 23 nt, Homo sapiens
aauagcauacaucaauggugugu

SEQ ID NO: 1250129 - RNA, 18 nt, Homo sapiens
aauagcuauauccaugua

SEQ ID NO: 1250130 - RNA, 24 nt, Homo sapiens
aauaggagaggaugagagcccaga

SEQ ID NO: 1250131 - RNA, 14 nt, Homo sapiens
aauaggcauuugau

SEQ ID NO: 1250132 - RNA, 19 nt, Homo sapiens
aauaggcuauuaaaaaagu

SEQ ID NO: 1250133 - RNA, 22 nt, Homo sapiens
aauaggcuguguauuuacauga

SEQ ID NO: 1250134 - RNA, 14 nt, Homo sapiens
aauaguaaaugcuu

SEQ ID NO: 1250135 - RNA, 12 nt, Homo sapiens
aauaguauuuau

SEQ ID NO: 1250136 - RNA, 14 nt, Homo sapiens
aauaguauuugcau

SEQ ID NO: 1250137 - RNA, 16 nt, Homo sapiens
aauagucuuccacaaa

SEQ ID NO: 1250138 - RNA, 15 nt, Homo sapiens
aauagugcaacuaug

SEQ ID NO: 1250139 - RNA, 15 nt, Homo sapiens
aauaguguucugcaa

SEQ ID NO: 1250140 - RNA, 22 nt, Homo sapiens
aauaguucccuuugccaacaga

SEQ ID NO: 1250141 - RNA, 16 nt, Homo sapiens
aauaguuuacauguag

SEQ ID NO: 1250142 - RNA, 22 nt, Homo sapiens
aauauaaaaggcaaauguguac

SEQ ID NO: 1250143 - RNA, 20 nt, Homo sapiens
aauauaaauuuaucauuuag

SEQ ID NO: 1250144 - RNA, 12 nt, Homo sapiens
aauauaagccuu

SEQ ID NO: 1250145 - RNA, 22 nt, Homo sapiens
aauauaauuguaccaaccucau

SEQ ID NO: 1250146 - RNA, 21 nt, Homo sapiens
aauauagcguucccaacaaca

SEQ ID NO: 1250147 - RNA, 17 nt, Homo sapiens
aauauaguuauugcaca

SEQ ID NO: 1250148 - RNA, 16 nt, Homo sapiens
aauauaguuuaggagu

SEQ ID NO: 1250149 - RNA, 18 nt, Homo sapiens
aauauaguuuaggaguaa

SEQ ID NO: 1250150 - RNA, 21 nt, Homo sapiens
aauauauaguccagacacuua

SEQ ID NO: 1250151 - RNA, 14 nt, Homo sapiens
aauauauauuuuag

SEQ ID NO: 1250152 - RNA, 20 nt, Homo sapiens
aauauauccccacuacucaa

SEQ ID NO: 1250153 - RNA, 19 nt, Homo sapiens
aauauauuuuaaagcacuu

SEQ ID NO: 1250154 - RNA, 19 nt, Homo sapiens
aauauauuuuuagacucau

SEQ ID NO: 1250155 - RNA, 15 nt, Homo sapiens
aauaucagacaagca

SEQ ID NO: 1250156 - RNA, 16 nt, Homo sapiens
aauaucauacuguuca

SEQ ID NO: 1250157 - RNA, 16 nt, Homo sapiens
aauaucccuacaugua

SEQ ID NO: 1250158 - RNA, 17 nt, Homo sapiens
aauaucccuacauguau

SEQ ID NO: 1250159 - RNA, 15 nt, Homo sapiens
aauaucuauauucua

SEQ ID NO: 1250160 - RNA, 20 nt, Homo sapiens
aauaucuuuuuuggaacuaa

SEQ ID NO: 1250161 - RNA, 22 nt, Homo sapiens
aauaugaaaaucuccaucucaa

SEQ ID NO: 1250162 - RNA, 12 nt, Homo sapiens
aauaugacauau

SEQ ID NO: 1250163 - RNA, 16 nt, Homo sapiens
aauaugaguaauacau

SEQ ID NO: 1250164 - RNA, 19 nt, Homo sapiens
aauaugauuauacaaaaga

SEQ ID NO: 1250165 - RNA, 16 nt, Homo sapiens
aauaugcaaaccagga

SEQ ID NO: 1250166 - RNA, 13 nt, Homo sapiens
aauaugcagugau

SEQ ID NO: 1250167 - RNA, 14 nt, Homo sapiens
aauaugcagugaua

SEQ ID NO: 1250168 - RNA, 22 nt, Homo sapiens
aauaugggaaagacaugcagcu

SEQ ID NO: 1250169 - RNA, 23 nt, Homo sapiens
aauaugguugauaguuuaccuga

SEQ ID NO: 1250170 - RNA, 17 nt, Homo sapiens
aauauguugaguguuca

SEQ ID NO: 1250171 - RNA, 18 nt, Homo sapiens
aauauuaaaaaacuucau

SEQ ID NO: 1250172 - RNA, 13 nt, Homo sapiens
aauauuacaauac

SEQ ID NO: 1250173 - RNA, 13 nt, Homo sapiens
aauauuacaguga

SEQ ID NO: 1250174 - RNA, 14 nt, Homo sapiens
aauauuacagugaa

SEQ ID NO: 1250175 - RNA, 15 nt, Homo sapiens
aauauucagauauaa

SEQ ID NO: 1250176 - RNA, 14 nt, Homo sapiens
aauauugugcaaac

SEQ ID NO: 1250177 - RNA, 18 nt, Homo sapiens
aauauuguguugugaaug

SEQ ID NO: 1250178 - RNA, 14 nt, Homo sapiens
aauauuguugacaa

SEQ ID NO: 1250179 - RNA, 19 nt, Homo sapiens
aauauuuaaacagcagugu

SEQ ID NO: 1250180 - RNA, 20 nt, Homo sapiens
aauauuuaagacacugaaaa

SEQ ID NO: 1250181 - RNA, 20 nt, Homo sapiens
aauauuuauacauacaagau

SEQ ID NO: 1250182 - RNA, 15 nt, Homo sapiens
aauauuuaucugauu

SEQ ID NO: 1250183 - RNA, 17 nt, Homo sapiens
aauauuuaucugauuaa

SEQ ID NO: 1250184 - RNA, 20 nt, Homo sapiens
aauauuuauuauuuucaccu

SEQ ID NO: 1250185 - RNA, 19 nt, Homo sapiens
aauauuucugauacugcug

SEQ ID NO: 1250186 - RNA, 22 nt, Homo sapiens
aauauuuuggcauuguacuaau

SEQ ID NO: 1250187 - RNA, 18 nt, Homo sapiens
aauauuuuuuuuuugcca

SEQ ID NO: 1250188 - RNA, 17 nt, Homo sapiens
aaucaaaaucaaugcag

SEQ ID NO: 1250189 - RNA, 13 nt, Homo sapiens
aaucaaaugauuu

SEQ ID NO: 1250190 - RNA, 15 nt, Homo sapiens
aaucaacaaaccaca

SEQ ID NO: 1250191 - RNA, 16 nt, Homo sapiens
aaucaacaaaccacaa

SEQ ID NO: 1250192 - RNA, 12 nt, Homo sapiens
aaucaacuuuac

SEQ ID NO: 1250193 - RNA, 20 nt, Homo sapiens
aaucaagaaaaacaucuuug

SEQ ID NO: 1250194 - RNA, 22 nt, Homo sapiens
aaucaaguauuugggaagugaa

SEQ ID NO: 1250195 - RNA, 22 nt, Homo sapiens
aaucaauaagaagguagaauga

SEQ ID NO: 1250196 - RNA, 13 nt, Homo sapiens
aaucaaucugcag

SEQ ID NO: 1250197 - RNA, 17 nt, Homo sapiens
aaucaaugguagcauuu

SEQ ID NO: 1250198 - RNA, 12 nt, Homo sapiens
aaucacaucucc

SEQ ID NO: 1250199 - RNA, 18 nt, Homo sapiens
aaucacuggcuguuaauc

SEQ ID NO: 1250200 - RNA, 18 nt, Homo sapiens
aaucagcaaccugacuca

SEQ ID NO: 1250201 - RNA, 15 nt, Homo sapiens
aaucagccacauucu

SEQ ID NO: 1250202 - RNA, 19 nt, Homo sapiens
aaucagccauaagaaagca

SEQ ID NO: 1250203 - RNA, 13 nt, Homo sapiens
aaucagcugcuca

SEQ ID NO: 1250204 - RNA, 18 nt, Homo sapiens
aaucagguccucagagaa

SEQ ID NO: 1250205 - RNA, 18 nt, Homo sapiens
aaucaguaagagguguua

SEQ ID NO: 1250206 - RNA, 18 nt, Homo sapiens
aaucagucuauccacaga

SEQ ID NO: 1250207 - RNA, 20 nt, Homo sapiens
aaucagugaagccaaaggga

SEQ ID NO: 1250208 - RNA, 20 nt, Homo sapiens
aaucauaaaggaucagagau

SEQ ID NO: 1250209 - RNA, 19 nt, Homo sapiens
aaucauauaauaaauguac

SEQ ID NO: 1250210 - RNA, 15 nt, Homo sapiens
aaucauauagugucu

SEQ ID NO: 1250211 - RNA, 23 nt, Homo sapiens
aaucaucacugguuccuccuuaa

SEQ ID NO: 1250212 - RNA, 14 nt, Homo sapiens
aaucauccaucacu

SEQ ID NO: 1250213 - RNA, 17 nt, Homo sapiens
aaucaugagcaagugaa

SEQ ID NO: 1250214 - RNA, 20 nt, Homo sapiens
aaucauguuugucaauggaa

SEQ ID NO: 1250215 - RNA, 21 nt, Homo sapiens
aaucauguuuuuaaaugcaua

SEQ ID NO: 1250216 - RNA, 16 nt, Homo sapiens
aaucauuaauacucuu

SEQ ID NO: 1250217 - RNA, 20 nt, Homo sapiens
aaucauuguagaaacacagu

SEQ ID NO: 1250218 - RNA, 22 nt, Homo sapiens
aaucauuuauuuacaugugauu

SEQ ID NO: 1250219 - RNA, 23 nt, Homo sapiens
aaucauuuauuuacaugugauug

SEQ ID NO: 1250220 - RNA, 11 nt, Homo sapiens
aaucauuuccc

SEQ ID NO: 1250221 - RNA, 20 nt, Homo sapiens
aauccaaauggcgucuggaa

SEQ ID NO: 1250222 - RNA, 14 nt, Homo sapiens
aauccaacccgggg

SEQ ID NO: 1250223 - RNA, 19 nt, Homo sapiens
aauccaauggguuuuuccc

SEQ ID NO: 1250224 - RNA, 16 nt, Homo sapiens
aauccagacccggcug

SEQ ID NO: 1250225 - RNA, 19 nt, Homo sapiens
aauccagcuacgaauauag

SEQ ID NO: 1250226 - RNA, 17 nt, Homo sapiens
aauccagugagcacuag

SEQ ID NO: 1250227 - RNA, 21 nt, Homo sapiens
aauccauccaaaguucccuau

SEQ ID NO: 1250228 - RNA, 20 nt, Homo sapiens
aauccaugaacagcauuaga

SEQ ID NO: 1250229 - RNA, 22 nt, Homo sapiens
aauccauuaucgagcagcauuu

SEQ ID NO: 1250230 - RNA, 18 nt, Homo sapiens
aauccauuuuacacagca

SEQ ID NO: 1250231 - RNA, 17 nt, Homo sapiens
aaucccaaucuuucuau

SEQ ID NO: 1250232 - RNA, 14 nt, Homo sapiens
aaucccagcacuuu

SEQ ID NO: 1250233 - RNA, 17 nt, Homo sapiens
aauccccuaucccauuc

SEQ ID NO: 1250234 - RNA, 14 nt, Homo sapiens
aauccgaaguauga

SEQ ID NO: 1250235 - RNA, 14 nt, Homo sapiens
aauccuaagacaca

SEQ ID NO: 1250236 - RNA, 23 nt, Homo sapiens
aauccuaagacacaaaugcauga

SEQ ID NO: 1250237 - RNA, 23 nt, Homo sapiens
aauccuauuuaucagacucugua

SEQ ID NO: 1250238 - RNA, 20 nt, Homo sapiens
aauccugaggcaaaguagug

SEQ ID NO: 1250239 - RNA, 15 nt, Homo sapiens
aauccuuaucccaag

SEQ ID NO: 1250240 - RNA, 19 nt, Homo sapiens
aauccuucuauucuagccu

SEQ ID NO: 1250241 - RNA, 14 nt, Homo sapiens
aauccuugacugga

SEQ ID NO: 1250242 - RNA, 15 nt, Homo sapiens
aauccuuuacauuca

SEQ ID NO: 1250243 - RNA, 15 nt, Homo sapiens
aauccuuuacuguua

SEQ ID NO: 1250244 - RNA, 14 nt, Homo sapiens
aaucgaacuaugaa

SEQ ID NO: 1250245 - RNA, 21 nt, Homo sapiens
aaucguccagcgaccuuccuc

SEQ ID NO: 1250246 - RNA, 21 nt, Homo sapiens
aaucuaacaucguggcugugg

SEQ ID NO: 1250247 - RNA, 15 nt, Homo sapiens
aaucuaccacuguau

SEQ ID NO: 1250248 - RNA, 20 nt, Homo sapiens
aaucuaccugcccuaaggga

SEQ ID NO: 1250249 - RNA, 17 nt, Homo sapiens
aaucuagacaauauaca

SEQ ID NO: 1250250 - RNA, 18 nt, Homo sapiens
aaucucaagauucuacuu

SEQ ID NO: 1250251 - RNA, 18 nt, Homo sapiens
aaucucaccccaucccac

SEQ ID NO: 1250252 - RNA, 20 nt, Homo sapiens
aaucucacccucuccuccag

SEQ ID NO: 1250253 - RNA, 18 nt, Homo sapiens
aaucucagccagccucca

SEQ ID NO: 1250254 - RNA, 14 nt, Homo sapiens
aaucuccaguuuuc

SEQ ID NO: 1250255 - RNA, 22 nt, Homo sapiens
aaucucccagugacaacaucgc

SEQ ID NO: 1250256 - RNA, 23 nt, Homo sapiens
aaucuccucuuuuagcugaugaa

SEQ ID NO: 1250257 - RNA, 18 nt, Homo sapiens
aaucucggcucacugcaa

SEQ ID NO: 1250258 - RNA, 22 nt, Homo sapiens
aaucucugccuagaaucuuuau

SEQ ID NO: 1250259 - RNA, 19 nt, Homo sapiens
aaucucuuauucuaauaaa

SEQ ID NO: 1250260 - RNA, 19 nt, Homo sapiens
aaucucuuuucuacauaca

SEQ ID NO: 1250261 - RNA, 22 nt, Homo sapiens
aaucugaagauugcgguuuaca

SEQ ID NO: 1250262 - RNA, 13 nt, Homo sapiens
aaucugagccagu

SEQ ID NO: 1250263 - RNA, 20 nt, Homo sapiens
aaucugagccagugcuuuaa

SEQ ID NO: 1250264 - RNA, 16 nt, Homo sapiens
aaucugagcugcaggu

SEQ ID NO: 1250265 - RNA, 18 nt, Homo sapiens
aaucugcauuuagcacaa

SEQ ID NO: 1250266 - RNA, 22 nt, Homo sapiens
aaucugggcagacauuauguaa

SEQ ID NO: 1250267 - RNA, 19 nt, Homo sapiens
aaucuggguaucuuuccag

SEQ ID NO: 1250268 - RNA, 21 nt, Homo sapiens
aaucuguacauuuuguuguaa

SEQ ID NO: 1250269 - RNA, 20 nt, Homo sapiens
aaucuguccguucacaugug

SEQ ID NO: 1250270 - RNA, 21 nt, Homo sapiens
aaucuguccguucacaugugu

SEQ ID NO: 1250271 - RNA, 20 nt, Homo sapiens
aaucuguguucgauggcuca

SEQ ID NO: 1250272 - RNA, 17 nt, Homo sapiens
aaucuuaaacaauguau

SEQ ID NO: 1250273 - RNA, 13 nt, Homo sapiens
aaucuuaucuuug

SEQ ID NO: 1250274 - RNA, 14 nt, Homo sapiens
aaucuuaugcucuc

SEQ ID NO: 1250275 - RNA, 14 nt, Homo sapiens
aaucuuauuuauac

SEQ ID NO: 1250276 - RNA, 11 nt, Homo sapiens
aaucuucaggu

SEQ ID NO: 1250277 - RNA, 21 nt, Homo sapiens
aaucuuccgauggaugaaucu

SEQ ID NO: 1250278 - RNA, 16 nt, Homo sapiens
aaucuucuuaugcaau

SEQ ID NO: 1250279 - RNA, 20 nt, Homo sapiens
aaucuuucagcacucagaaa

SEQ ID NO: 1250280 - RNA, 11 nt, Homo sapiens
aaucuuuccag

SEQ ID NO: 1250281 - RNA, 19 nt, Homo sapiens
aaucuuucuuuaccugaga

SEQ ID NO: 1250282 - RNA, 17 nt, Homo sapiens
aaugaaaaacaaccaag

SEQ ID NO: 1250283 - RNA, 18 nt, Homo sapiens
aaugaaaauaacugaacc

SEQ ID NO: 1250284 - RNA, 14 nt, Homo sapiens
aaugaaaaugcagu

SEQ ID NO: 1250285 - RNA, 22 nt, Homo sapiens
aaugaaagcccucaugugcagu

SEQ ID NO: 1250286 - RNA, 16 nt, Homo sapiens
aaugaaauccagugag

SEQ ID NO: 1250287 - RNA, 14 nt, Homo sapiens
aaugaagugcaaua

SEQ ID NO: 1250288 - RNA, 15 nt, Homo sapiens
aaugaagugcaauac

SEQ ID NO: 1250289 - RNA, 20 nt, Homo sapiens
aaugaaucaacaaaccacaa

SEQ ID NO: 1250290 - RNA, 14 nt, Homo sapiens
aaugaaucuucaca

SEQ ID NO: 1250291 - RNA, 15 nt, Homo sapiens
aaugaaucuucacaa

SEQ ID NO: 1250292 - RNA, 15 nt, Homo sapiens
aaugaaugacauuga

SEQ ID NO: 1250293 - RNA, 14 nt, Homo sapiens
aaugaaugagccaa

SEQ ID NO: 1250294 - RNA, 14 nt, Homo sapiens
aaugaaugccuaaa

SEQ ID NO: 1250295 - RNA, 14 nt, Homo sapiens
aaugaauguuuaca

SEQ ID NO: 1250296 - RNA, 23 nt, Homo sapiens
aaugaauucugggaauccacagc

SEQ ID NO: 1250297 - RNA, 13 nt, Homo sapiens
aaugaauuuggag

SEQ ID NO: 1250298 - RNA, 13 nt, Homo sapiens
aaugacaguaguc

SEQ ID NO: 1250299 - RNA, 23 nt, Homo sapiens
aaugacaucuucaaagcuugaag

SEQ ID NO: 1250300 - RNA, 18 nt, Homo sapiens
aaugacaugcacugaccc

SEQ ID NO: 1250301 - RNA, 14 nt, Homo sapiens
aaugaccaauauua

SEQ ID NO: 1250302 - RNA, 16 nt, Homo sapiens
aaugaccaauauuaua

SEQ ID NO: 1250303 - RNA, 12 nt, Homo sapiens
aaugacuauaaa

SEQ ID NO: 1250304 - RNA, 21 nt, Homo sapiens
aaugagacugaacugugugaa

SEQ ID NO: 1250305 - RNA, 16 nt, Homo sapiens
aaugagccaucacuag

SEQ ID NO: 1250306 - RNA, 16 nt, Homo sapiens
aaugagggccaagaaa

SEQ ID NO: 1250307 - RNA, 10 nt, Homo sapiens
aaugagucag

SEQ ID NO: 1250308 - RNA, 20 nt, Homo sapiens
aaugaguuaugaguuauuca

SEQ ID NO: 1250309 - RNA, 13 nt, Homo sapiens
aaugauacaguau

SEQ ID NO: 1250310 - RNA, 14 nt, Homo sapiens
aaugauaguuuuca

SEQ ID NO: 1250311 - RNA, 14 nt, Homo sapiens
aaugaucacauucu

SEQ ID NO: 1250312 - RNA, 18 nt, Homo sapiens
aaugaucagcaucuguga

SEQ ID NO: 1250313 - RNA, 20 nt, Homo sapiens
aaugaucagcaucugugaug

SEQ ID NO: 1250314 - RNA, 16 nt, Homo sapiens
aaugaucauaagucua

SEQ ID NO: 1250315 - RNA, 19 nt, Homo sapiens
aaugaucucggaugaccaa

SEQ ID NO: 1250316 - RNA, 23 nt, Homo sapiens
aaugaugaaugaaugaaugagcc

SEQ ID NO: 1250317 - RNA, 21 nt, Homo sapiens
aaugaugaguauuaguucccu

SEQ ID NO: 1250318 - RNA, 13 nt, Homo sapiens
aaugaugaucuuc

SEQ ID NO: 1250319 - RNA, 15 nt, Homo sapiens
aaugaugaucuucag

SEQ ID NO: 1250320 - RNA, 16 nt, Homo sapiens
aaugaugccacuuccc

SEQ ID NO: 1250321 - RNA, 21 nt, Homo sapiens
aaugauugagguccauauuua

SEQ ID NO: 1250322 - RNA, 19 nt, Homo sapiens
aaugauuuagguacgucaa

SEQ ID NO: 1250323 - RNA, 22 nt, Homo sapiens
aaugauuuagguacgucaaagc

SEQ ID NO: 1250324 - RNA, 20 nt, Homo sapiens
aaugauuucauauugaucuu

SEQ ID NO: 1250325 - RNA, 23 nt, Homo sapiens
aaugauuucaugcuaucucugug

SEQ ID NO: 1250326 - RNA, 14 nt, Homo sapiens
aaugauuuuaucug

SEQ ID NO: 1250327 - RNA, 23 nt, Homo sapiens
aaugcaaaucaauaaauucccaa

SEQ ID NO: 1250328 - RNA, 18 nt, Homo sapiens
aaugcaagccaucucuaa

SEQ ID NO: 1250329 - RNA, 21 nt, Homo sapiens
aaugcaagccaucucuaauaa

SEQ ID NO: 1250330 - RNA, 21 nt, Homo sapiens
aaugcacaaauugaaaacaca

SEQ ID NO: 1250331 - RNA, 18 nt, Homo sapiens
aaugcacauagcuaucaa

SEQ ID NO: 1250332 - RNA, 12 nt, Homo sapiens
aaugcaccacuu

SEQ ID NO: 1250333 - RNA, 14 nt, Homo sapiens
aaugcaccacuuuu

SEQ ID NO: 1250334 - RNA, 15 nt, Homo sapiens
aaugcaccacuuuuu

SEQ ID NO: 1250335 - RNA, 22 nt, Homo sapiens
aaugcaccuagcugugcaagac

SEQ ID NO: 1250336 - RNA, 12 nt, Homo sapiens
aaugcacugugu

SEQ ID NO: 1250337 - RNA, 13 nt, Homo sapiens
aaugcaguccuga

SEQ ID NO: 1250338 - RNA, 10 nt, Homo sapiens
aaugcagugg

SEQ ID NO: 1250339 - RNA, 14 nt, Homo sapiens
aaugcaucaauaug

SEQ ID NO: 1250340 - RNA, 21 nt, Homo sapiens
aaugcauuauaggaucauuug

SEQ ID NO: 1250341 - RNA, 16 nt, Homo sapiens
aaugcauugcuaaaau

SEQ ID NO: 1250342 - RNA, 19 nt, Homo sapiens
aaugcauuuuauucuuuaa

SEQ ID NO: 1250343 - RNA, 18 nt, Homo sapiens
aaugccaaaauucauuca

SEQ ID NO: 1250344 - RNA, 19 nt, Homo sapiens
aaugccaaaauucauucag

SEQ ID NO: 1250345 - RNA, 23 nt, Homo sapiens
aaugccacaaaacugacaguaaa

SEQ ID NO: 1250346 - RNA, 21 nt, Homo sapiens
aaugccuaaauauaauuaucc

SEQ ID NO: 1250347 - RNA, 19 nt, Homo sapiens
aaugccuccaagccauuca

SEQ ID NO: 1250348 - RNA, 14 nt, Homo sapiens
aaugccugugccaa

SEQ ID NO: 1250349 - RNA, 21 nt, Homo sapiens
aaugcuaaagaauccauaaaa

SEQ ID NO: 1250350 - RNA, 16 nt, Homo sapiens
aaugcuaaccuuguag

SEQ ID NO: 1250351 - RNA, 14 nt, Homo sapiens
aaugcuaaguccau

SEQ ID NO: 1250352 - RNA, 20 nt, Homo sapiens
aaugcuacgcacguggagcu

SEQ ID NO: 1250353 - RNA, 13 nt, Homo sapiens
aaugcuacugucu

SEQ ID NO: 1250354 - RNA, 21 nt, Homo sapiens
aaugcuaugacuguaucuuga

SEQ ID NO: 1250355 - RNA, 20 nt, Homo sapiens
aaugcuccuccuccaugcuc

SEQ ID NO: 1250356 - RNA, 12 nt, Homo sapiens
aaugcugcacuu

SEQ ID NO: 1250357 - RNA, 21 nt, Homo sapiens
aaugcugcgcuucgcuuggug

SEQ ID NO: 1250358 - RNA, 17 nt, Homo sapiens
aaugcugcugcugagac

SEQ ID NO: 1250359 - RNA, 17 nt, Homo sapiens
aaugcugucccuauaca

SEQ ID NO: 1250360 - RNA, 17 nt, Homo sapiens
aaugcuucauaugagga

SEQ ID NO: 1250361 - RNA, 14 nt, Homo sapiens
aauggaaaccaagg

SEQ ID NO: 1250362 - RNA, 19 nt, Homo sapiens
aauggaagauuugcccauu

SEQ ID NO: 1250363 - RNA, 20 nt, Homo sapiens
aauggacguuauccucucag

SEQ ID NO: 1250364 - RNA, 12 nt, Homo sapiens
aauggacuggag

SEQ ID NO: 1250365 - RNA, 20 nt, Homo sapiens
aauggaggcagagaccucca

SEQ ID NO: 1250366 - RNA, 17 nt, Homo sapiens
aauggaggccauugugu

SEQ ID NO: 1250367 - RNA, 14 nt, Homo sapiens
aauggcacgcuccu

SEQ ID NO: 1250368 - RNA, 18 nt, Homo sapiens
aauggcagcauacacaga

SEQ ID NO: 1250369 - RNA, 19 nt, Homo sapiens
aauggcagcuagugccuuu

SEQ ID NO: 1250370 - RNA, 21 nt, Homo sapiens
aauggcagggauacccaguga

SEQ ID NO: 1250371 - RNA, 20 nt, Homo sapiens
aauggcgcgaucuuggcuca

SEQ ID NO: 1250372 - RNA, 15 nt, Homo sapiens
aaugggaaaaccaga

SEQ ID NO: 1250373 - RNA, 15 nt, Homo sapiens
aaugggcacagcaca

SEQ ID NO: 1250374 - RNA, 17 nt, Homo sapiens
aaugggcacagcacagc

SEQ ID NO: 1250375 - RNA, 23 nt, Homo sapiens
aauggguuugcuagaaugugaua

SEQ ID NO: 1250376 - RNA, 12 nt, Homo sapiens
aauggucaucca

SEQ ID NO: 1250377 - RNA, 14 nt, Homo sapiens
aauggucucagccu

SEQ ID NO: 1250378 - RNA, 15 nt, Homo sapiens
aauggugcugcagau

SEQ ID NO: 1250379 - RNA, 18 nt, Homo sapiens
aaugguguuguaugccuu

SEQ ID NO: 1250380 - RNA, 18 nt, Homo sapiens
aauguaaaauguugaaua

SEQ ID NO: 1250381 - RNA, 14 nt, Homo sapiens
aauguaaagccagc

SEQ ID NO: 1250382 - RNA, 20 nt, Homo sapiens
aauguaaaguaagacaucuc

SEQ ID NO: 1250383 - RNA, 23 nt, Homo sapiens
aauguaauacuccuaagacuuau

SEQ ID NO: 1250384 - RNA, 17 nt, Homo sapiens
aauguacaauaaagcaa

SEQ ID NO: 1250385 - RNA, 20 nt, Homo sapiens
aauguacaauaaagcaaugu

SEQ ID NO: 1250386 - RNA, 15 nt, Homo sapiens
aauguagaccuguga

SEQ ID NO: 1250387 - RNA, 13 nt, Homo sapiens
aauguagucaaua

SEQ ID NO: 1250388 - RNA, 16 nt, Homo sapiens
aauguaucauagaaau

SEQ ID NO: 1250389 - RNA, 16 nt, Homo sapiens
aauguaucuuggugcu

SEQ ID NO: 1250390 - RNA, 18 nt, Homo sapiens
aauguauuauaacuuuaa

SEQ ID NO: 1250391 - RNA, 15 nt, Homo sapiens
aauguauuugcuaua

SEQ ID NO: 1250392 - RNA, 17 nt, Homo sapiens
aauguauuuguuugcaa

SEQ ID NO: 1250393 - RNA, 21 nt, Homo sapiens
aauguauuuguuugcaauuuu

SEQ ID NO: 1250394 - RNA, 20 nt, Homo sapiens
aaugucaauaugagauauua

SEQ ID NO: 1250395 - RNA, 17 nt, Homo sapiens
aaugucacguacugucu

SEQ ID NO: 1250396 - RNA, 12 nt, Homo sapiens
aaugucacuuaa

SEQ ID NO: 1250397 - RNA, 13 nt, Homo sapiens
aauguccauuuau

SEQ ID NO: 1250398 - RNA, 22 nt, Homo sapiens
aaugucccuuucagagacagcu

SEQ ID NO: 1250399 - RNA, 13 nt, Homo sapiens
aaugucuaagaua

SEQ ID NO: 1250400 - RNA, 18 nt, Homo sapiens
aaugucucuuugugcucu

SEQ ID NO: 1250401 - RNA, 16 nt, Homo sapiens
aaugucuuacugugau

SEQ ID NO: 1250402 - RNA, 19 nt, Homo sapiens
aaugucuucaagacuuuuc

SEQ ID NO: 1250403 - RNA, 21 nt, Homo sapiens
aaugucuucauaaaguacuug

SEQ ID NO: 1250404 - RNA, 20 nt, Homo sapiens
aaugucuuuugaauauuccc

SEQ ID NO: 1250405 - RNA, 21 nt, Homo sapiens
aaugugauauuugaagcauca

SEQ ID NO: 1250406 - RNA, 16 nt, Homo sapiens
aaugugcuaugaagcu

SEQ ID NO: 1250407 - RNA, 17 nt, Homo sapiens
aaugugcuaugaagcuu

SEQ ID NO: 1250408 - RNA, 20 nt, Homo sapiens
aauguggauuaaagugccca

SEQ ID NO: 1250409 - RNA, 18 nt, Homo sapiens
aauguggcuccaagcuca

SEQ ID NO: 1250410 - RNA, 16 nt, Homo sapiens
aauguguacagugaau

SEQ ID NO: 1250411 - RNA, 23 nt, Homo sapiens
aaugugucaggugacccugauga

SEQ ID NO: 1250412 - RNA, 20 nt, Homo sapiens
aaugugugggccgcaugcau

SEQ ID NO: 1250413 - RNA, 21 nt, Homo sapiens
aauguuaacacucaugaagca

SEQ ID NO: 1250414 - RNA, 18 nt, Homo sapiens
aauguuaauguuauauca

SEQ ID NO: 1250415 - RNA, 19 nt, Homo sapiens
aauguuacugaucaugcau

SEQ ID NO: 1250416 - RNA, 23 nt, Homo sapiens
aauguuaguauuuuaauccugua

SEQ ID NO: 1250417 - RNA, 17 nt, Homo sapiens
aauguuaucauagaauu

SEQ ID NO: 1250418 - RNA, 16 nt, Homo sapiens
aauguuguccaggaaa

SEQ ID NO: 1250419 - RNA, 23 nt, Homo sapiens
aauguuuaaguauuaacuuacaa

SEQ ID NO: 1250420 - RNA, 13 nt, Homo sapiens
aauguuuaaucuc

SEQ ID NO: 1250421 - RNA, 22 nt, Homo sapiens
aauguuugucuggauuggcuau

SEQ ID NO: 1250422 - RNA, 15 nt, Homo sapiens
aauguuuguucauua

SEQ ID NO: 1250423 - RNA, 19 nt, Homo sapiens
aauguuuucaaaagguauu

SEQ ID NO: 1250424 - RNA, 12 nt, Homo sapiens
aauuaaagcaaa

SEQ ID NO: 1250425 - RNA, 17 nt, Homo sapiens
aauuaaaggaacagagu

SEQ ID NO: 1250426 - RNA, 21 nt, Homo sapiens
aauuaaauauugaaacacugu

SEQ ID NO: 1250427 - RNA, 17 nt, Homo sapiens
aauuaacuuuacauccu

SEQ ID NO: 1250428 - RNA, 12 nt, Homo sapiens
aauuaaguuaca

SEQ ID NO: 1250429 - RNA, 14 nt, Homo sapiens
aauuacagauguga

SEQ ID NO: 1250430 - RNA, 16 nt, Homo sapiens
aauuacaguacacauc

SEQ ID NO: 1250431 - RNA, 20 nt, Homo sapiens
aauuacuauauucuuacccu

SEQ ID NO: 1250432 - RNA, 19 nt, Homo sapiens
aauuacuuauuguauuuau

SEQ ID NO: 1250433 - RNA, 16 nt, Homo sapiens
aauuagaaaguagcca

SEQ ID NO: 1250434 - RNA, 16 nt, Homo sapiens
aauuagaacccauaac

SEQ ID NO: 1250435 - RNA, 18 nt, Homo sapiens
aauuagaauauccaugac

SEQ ID NO: 1250436 - RNA, 14 nt, Homo sapiens
aauuagacuaagug

SEQ ID NO: 1250437 - RNA, 14 nt, Homo sapiens
aauuagaugaacuc

SEQ ID NO: 1250438 - RNA, 23 nt, Homo sapiens
aauuagcaauugacugucacugu

SEQ ID NO: 1250439 - RNA, 14 nt, Homo sapiens
aauuagcucugggg

SEQ ID NO: 1250440 - RNA, 14 nt, Homo sapiens
aauuagggcccaau

SEQ ID NO: 1250441 - RNA, 21 nt, Homo sapiens
aauuagggguuaaagcagaca

SEQ ID NO: 1250442 - RNA, 15 nt, Homo sapiens
aauuaguaagccaug

SEQ ID NO: 1250443 - RNA, 19 nt, Homo sapiens
aauuaguuaugacagccau

SEQ ID NO: 1250444 - RNA, 12 nt, Homo sapiens
aauuauaacuua

SEQ ID NO: 1250445 - RNA, 15 nt, Homo sapiens
aauuauaagcauaca

SEQ ID NO: 1250446 - RNA, 16 nt, Homo sapiens
aauuauaagcauacaa

SEQ ID NO: 1250447 - RNA, 19 nt, Homo sapiens
aauuauaaucaaaaucaau

SEQ ID NO: 1250448 - RNA, 21 nt, Homo sapiens
aauuauauuaaagaaccaaaa

SEQ ID NO: 1250449 - RNA, 21 nt, Homo sapiens
aauuaucaucuuuugaucuuu

SEQ ID NO: 1250450 - RNA, 18 nt, Homo sapiens
aauuaucggaagcagugc

SEQ ID NO: 1250451 - RNA, 20 nt, Homo sapiens
aauuaucggaagcagugccu

SEQ ID NO: 1250452 - RNA, 21 nt, Homo sapiens
aauuauuauuaucacauuuac

SEQ ID NO: 1250453 - RNA, 21 nt, Homo sapiens
aauuauuauuuauauauguau

SEQ ID NO: 1250454 - RNA, 18 nt, Homo sapiens
aauuauugcuguauguaa

SEQ ID NO: 1250455 - RNA, 20 nt, Homo sapiens
aauucaaaaaaaaaagcaac

SEQ ID NO: 1250456 - RNA, 17 nt, Homo sapiens
aauucacucaagcacug

SEQ ID NO: 1250457 - RNA, 14 nt, Homo sapiens
aauucagcacuuaa

SEQ ID NO: 1250458 - RNA, 22 nt, Homo sapiens
aauucagcuuuguccaaaggaa

SEQ ID NO: 1250459 - RNA, 12 nt, Homo sapiens
aauucaguucug

SEQ ID NO: 1250460 - RNA, 20 nt, Homo sapiens
aauucauuuuuuucacugga

SEQ ID NO: 1250461 - RNA, 18 nt, Homo sapiens
aauuccaaacacauacag

SEQ ID NO: 1250462 - RNA, 13 nt, Homo sapiens
aauuccgcauuua

SEQ ID NO: 1250463 - RNA, 22 nt, Homo sapiens
aauuccuaauaaguuugaucaa

SEQ ID NO: 1250464 - RNA, 20 nt, Homo sapiens
aauuccuguuacuuuacaga

SEQ ID NO: 1250465 - RNA, 18 nt, Homo sapiens
aauucggguggcauccuc

SEQ ID NO: 1250466 - RNA, 17 nt, Homo sapiens
aauucuaaagagcacuu

SEQ ID NO: 1250467 - RNA, 19 nt, Homo sapiens
aauucuaaguuauuuacuu

SEQ ID NO: 1250468 - RNA, 14 nt, Homo sapiens
aauucuacuuugag

SEQ ID NO: 1250469 - RNA, 17 nt, Homo sapiens
aauucuauucugaucuu

SEQ ID NO: 1250470 - RNA, 16 nt, Homo sapiens
aauucucagaaucuca

SEQ ID NO: 1250471 - RNA, 17 nt, Homo sapiens
aauucucauuugucaca

SEQ ID NO: 1250472 - RNA, 19 nt, Homo sapiens
aauucuccugccucagccu

SEQ ID NO: 1250473 - RNA, 23 nt, Homo sapiens
aauucucucccccuauuuauuga

SEQ ID NO: 1250474 - RNA, 20 nt, Homo sapiens
aauucugagacaugugucaa

SEQ ID NO: 1250475 - RNA, 19 nt, Homo sapiens
aauucugaugagcauuacu

SEQ ID NO: 1250476 - RNA, 20 nt, Homo sapiens
aauucugcaacuagccaagg

SEQ ID NO: 1250477 - RNA, 16 nt, Homo sapiens
aauucugggaauccac

SEQ ID NO: 1250478 - RNA, 19 nt, Homo sapiens
aauucuguacuuccaauuu

SEQ ID NO: 1250479 - RNA, 20 nt, Homo sapiens
aauucugugacauacauauu

SEQ ID NO: 1250480 - RNA, 22 nt, Homo sapiens
aauucugugacauacauauuau

SEQ ID NO: 1250481 - RNA, 21 nt, Homo sapiens
aauucuguuuuuaaugcuauu

SEQ ID NO: 1250482 - RNA, 17 nt, Homo sapiens
aauucuuagucacaaaa

SEQ ID NO: 1250483 - RNA, 15 nt, Homo sapiens
aauucuuucaguggc

SEQ ID NO: 1250484 - RNA, 22 nt, Homo sapiens
aauugaagaaagucagcucuug

SEQ ID NO: 1250485 - RNA, 18 nt, Homo sapiens
aauugaaugucaauauga

SEQ ID NO: 1250486 - RNA, 17 nt, Homo sapiens
aauugacaaugauuuau

SEQ ID NO: 1250487 - RNA, 13 nt, Homo sapiens
aauugacaggauu

SEQ ID NO: 1250488 - RNA, 16 nt, Homo sapiens
aauugacauguuguca

SEQ ID NO: 1250489 - RNA, 23 nt, Homo sapiens
aauugaccauacaauuucauccu

SEQ ID NO: 1250490 - RNA, 21 nt, Homo sapiens
aauugaccuuuugacuuaaag

SEQ ID NO: 1250491 - RNA, 15 nt, Homo sapiens
aauugacuaaaaagu

SEQ ID NO: 1250492 - RNA, 13 nt, Homo sapiens
aauugacugucac

SEQ ID NO: 1250493 - RNA, 12 nt, Homo sapiens
aauugauuucaa

SEQ ID NO: 1250494 - RNA, 20 nt, Homo sapiens
aauugauuuuccuuugugca

SEQ ID NO: 1250495 - RNA, 23 nt, Homo sapiens
aauugcaaauaaaccacuuucua

SEQ ID NO: 1250496 - RNA, 13 nt, Homo sapiens
aauugcaauacau

SEQ ID NO: 1250497 - RNA, 17 nt, Homo sapiens
aauugcaauacauuuca

SEQ ID NO: 1250498 - RNA, 13 nt, Homo sapiens
aauugcaugacuu

SEQ ID NO: 1250499 - RNA, 17 nt, Homo sapiens
aauugcucauaagcaau

SEQ ID NO: 1250500 - RNA, 15 nt, Homo sapiens
aauugcuuugccaaa

SEQ ID NO: 1250501 - RNA, 13 nt, Homo sapiens
aauuggcucuagu

SEQ ID NO: 1250502 - RNA, 15 nt, Homo sapiens
aauuggcucuaguca

SEQ ID NO: 1250503 - RNA, 18 nt, Homo sapiens
aauugggaauaugcacaa

SEQ ID NO: 1250504 - RNA, 15 nt, Homo sapiens
aauugguagaaggau

SEQ ID NO: 1250505 - RNA, 18 nt, Homo sapiens
aauuggugcuauuugaag

SEQ ID NO: 1250506 - RNA, 20 nt, Homo sapiens
aauuguaaaauuuaaaucau

SEQ ID NO: 1250507 - RNA, 14 nt, Homo sapiens
aauuguauaaguca

SEQ ID NO: 1250508 - RNA, 19 nt, Homo sapiens
aauugucuaaaaugucagu

SEQ ID NO: 1250509 - RNA, 22 nt, Homo sapiens
aauugugguuuauugaauguga

SEQ ID NO: 1250510 - RNA, 11 nt, Homo sapiens
aauuguugcua

SEQ ID NO: 1250511 - RNA, 21 nt, Homo sapiens
aauuguuucuugacaagcuga

SEQ ID NO: 1250512 - RNA, 18 nt, Homo sapiens
aauuguuuucacuuguau

SEQ ID NO: 1250513 - RNA, 16 nt, Homo sapiens
aauuuaaaaaaauaca

SEQ ID NO: 1250514 - RNA, 19 nt, Homo sapiens
aauuuaaacugcaaugcca

SEQ ID NO: 1250515 - RNA, 12 nt, Homo sapiens
aauuuaacaaga

SEQ ID NO: 1250516 - RNA, 13 nt, Homo sapiens
aauuuaauaccag

SEQ ID NO: 1250517 - RNA, 14 nt, Homo sapiens
aauuuaaugcugcc

SEQ ID NO: 1250518 - RNA, 15 nt, Homo sapiens
aauuuaauuaccuua

SEQ ID NO: 1250519 - RNA, 14 nt, Homo sapiens
aauuuaauuccucu

SEQ ID NO: 1250520 - RNA, 19 nt, Homo sapiens
aauuuaccuaagauuacaa

SEQ ID NO: 1250521 - RNA, 22 nt, Homo sapiens
aauuuacuguugcccauugcac

SEQ ID NO: 1250522 - RNA, 19 nt, Homo sapiens
aauuuagaaauauaauuga

SEQ ID NO: 1250523 - RNA, 13 nt, Homo sapiens
aauuuagcccuuu

SEQ ID NO: 1250524 - RNA, 18 nt, Homo sapiens
aauuuauaaauauauuca

SEQ ID NO: 1250525 - RNA, 21 nt, Homo sapiens
aauuuauaaugaauacuuucu

SEQ ID NO: 1250526 - RNA, 13 nt, Homo sapiens
aauuuauaguuaa

SEQ ID NO: 1250527 - RNA, 22 nt, Homo sapiens
aauuuaucccuuuacaauguga

SEQ ID NO: 1250528 - RNA, 18 nt, Homo sapiens
aauuuauuaaaaugauug

SEQ ID NO: 1250529 - RNA, 15 nt, Homo sapiens
aauuuauuacugaaa

SEQ ID NO: 1250530 - RNA, 16 nt, Homo sapiens
aauuuauucacauaua

SEQ ID NO: 1250531 - RNA, 22 nt, Homo sapiens
aauuuccaaagcagccugugaa

SEQ ID NO: 1250532 - RNA, 12 nt, Homo sapiens
aauuuccagggu

SEQ ID NO: 1250533 - RNA, 23 nt, Homo sapiens
aauuuccaggguugcuugaucau

SEQ ID NO: 1250534 - RNA, 15 nt, Homo sapiens
aauuuccucugacau

SEQ ID NO: 1250535 - RNA, 15 nt, Homo sapiens
aauuucucauacuua

SEQ ID NO: 1250536 - RNA, 15 nt, Homo sapiens
aauuucuuacuaaac

SEQ ID NO: 1250537 - RNA, 21 nt, Homo sapiens
aauuucuuccuuccacaguua

SEQ ID NO: 1250538 - RNA, 22 nt, Homo sapiens
aauuugaaaacauaaucugcaa

SEQ ID NO: 1250539 - RNA, 15 nt, Homo sapiens
aauuugaugccagga

SEQ ID NO: 1250540 - RNA, 22 nt, Homo sapiens
aauuugaugguauuucuuucuc

SEQ ID NO: 1250541 - RNA, 18 nt, Homo sapiens
aauuugcauugugucaga

SEQ ID NO: 1250542 - RNA, 20 nt, Homo sapiens
aauuugguaaaaaugcugcu

SEQ ID NO: 1250543 - RNA, 19 nt, Homo sapiens
aauuuguaauugcuuacau

SEQ ID NO: 1250544 - RNA, 16 nt, Homo sapiens
aauuugucgcaaagac

SEQ ID NO: 1250545 - RNA, 16 nt, Homo sapiens
aauuugugccacuuua

SEQ ID NO: 1250546 - RNA, 18 nt, Homo sapiens
aauuuuaaaaagcagcug

SEQ ID NO: 1250547 - RNA, 13 nt, Homo sapiens
aauuuuaaccuau

SEQ ID NO: 1250548 - RNA, 20 nt, Homo sapiens
aauuuuaaugaagugcaaua

SEQ ID NO: 1250549 - RNA, 20 nt, Homo sapiens
aauuuuaauuccugauuaaa

SEQ ID NO: 1250550 - RNA, 13 nt, Homo sapiens
aauuuuaauugau

SEQ ID NO: 1250551 - RNA, 15 nt, Homo sapiens
aauuuuaccauucag

SEQ ID NO: 1250552 - RNA, 20 nt, Homo sapiens
aauuuuacuccauaaacaga

SEQ ID NO: 1250553 - RNA, 17 nt, Homo sapiens
aauuuuauaacagaauu

SEQ ID NO: 1250554 - RNA, 20 nt, Homo sapiens
aauuuuauaacagaauuaaa

SEQ ID NO: 1250555 - RNA, 14 nt, Homo sapiens
aauuuugccuuuaa

SEQ ID NO: 1250556 - RNA, 14 nt, Homo sapiens
aauuuuuacauuca

SEQ ID NO: 1250557 - RNA, 15 nt, Homo sapiens
aauuuuuacauucau

SEQ ID NO: 1250558 - RNA, 16 nt, Homo sapiens
aauuuuugaaaacugg

SEQ ID NO: 1250559 - RNA, 19 nt, Homo sapiens
aauuuuugcuaugcuguaa

SEQ ID NO: 1250560 - RNA, 15 nt, Homo sapiens
aauuuuugucucaga

SEQ ID NO: 1250561 - RNA, 16 nt, Homo sapiens
acaaaaaaaccucuau

SEQ ID NO: 1250562 - RNA, 20 nt, Homo sapiens
acaaaaaaaccucuaugcaa

SEQ ID NO: 1250563 - RNA, 23 nt, Homo sapiens
acaaaaaaauauauuuaaugaua

SEQ ID NO: 1250564 - RNA, 21 nt, Homo sapiens
acaaaaaauuugagaaagccu

SEQ ID NO: 1250565 - RNA, 22 nt, Homo sapiens
acaaaaacagguauauacuuug

SEQ ID NO: 1250566 - RNA, 14 nt, Homo sapiens
acaaaaagagcuuu

SEQ ID NO: 1250567 - RNA, 13 nt, Homo sapiens
acaaaaaugagcu

SEQ ID NO: 1250568 - RNA, 21 nt, Homo sapiens
acaaaaauguaaugaucauaa

SEQ ID NO: 1250569 - RNA, 16 nt, Homo sapiens
acaaaacuucuuguca

SEQ ID NO: 1250570 - RNA, 15 nt, Homo sapiens
acaaaagauguaucc

SEQ ID NO: 1250571 - RNA, 19 nt, Homo sapiens
acaaaauagacaauuugca

SEQ ID NO: 1250572 - RNA, 17 nt, Homo sapiens
acaaaauccaugaacaa

SEQ ID NO: 1250573 - RNA, 16 nt, Homo sapiens
acaaaauggucaucca

SEQ ID NO: 1250574 - RNA, 20 nt, Homo sapiens
acaaaauggucauccaaacu

SEQ ID NO: 1250575 - RNA, 21 nt, Homo sapiens
acaaaauggucauccaaacuc

SEQ ID NO: 1250576 - RNA, 23 nt, Homo sapiens
acaaaauuuuauuuugugcucau

SEQ ID NO: 1250577 - RNA, 14 nt, Homo sapiens
acaaacaaacagaa

SEQ ID NO: 1250578 - RNA, 18 nt, Homo sapiens
acaaacaagaggacugug

SEQ ID NO: 1250579 - RNA, 19 nt, Homo sapiens
acuaugaaguaagcaacaa

SEQ ID NO: 1250580 - RNA, 18 nt, Homo sapiens
acuaugagggccuuguaa

SEQ ID NO: 1250581 - RNA, 11 nt, Homo sapiens
acuaugcacaa

SEQ ID NO: 1250582 - RNA, 17 nt, Homo sapiens
acuauggagugcucaca

SEQ ID NO: 1250583 - RNA, 14 nt, Homo sapiens
acuauguggcugaa

SEQ ID NO: 1250584 - RNA, 14 nt, Homo sapiens
acuauuaaagcaca

SEQ ID NO: 1250585 - RNA, 15 nt, Homo sapiens
acuauuaagcaguaa

SEQ ID NO: 1250586 - RNA, 16 nt, Homo sapiens
acuauuaauacucugc

SEQ ID NO: 1250587 - RNA, 16 nt, Homo sapiens
acuauuacaccaaaua

SEQ ID NO: 1250588 - RNA, 22 nt, Homo sapiens
acuauucuaaugaaaacauuaa

SEQ ID NO: 1250589 - RNA, 16 nt, Homo sapiens
acuauugaaaucaagc

SEQ ID NO: 1250590 - RNA, 20 nt, Homo sapiens
acuauugagugaaacauuga

SEQ ID NO: 1250591 - RNA, 21 nt, Homo sapiens
acuauuguuacauuaugugga

SEQ ID NO: 1250592 - RNA, 22 nt, Homo sapiens
acuauuguuacauuauguggaa

SEQ ID NO: 1250593 - RNA, 13 nt, Homo sapiens
acuauuuccacau

SEQ ID NO: 1250594 - RNA, 15 nt, Homo sapiens
acucaaaagacaaac

SEQ ID NO: 1250595 - RNA, 22 nt, Homo sapiens
acucaaaagacaaacaugcaag

SEQ ID NO: 1250596 - RNA, 14 nt, Homo sapiens
acucaaacugagga

SEQ ID NO: 1250597 - RNA, 13 nt, Homo sapiens
acucaaacuugag

SEQ ID NO: 1250598 - RNA, 12 nt, Homo sapiens
acucaacauguu

SEQ ID NO: 1250599 - RNA, 23 nt, Homo sapiens
acucaacauguuacugaccagca

SEQ ID NO: 1250600 - RNA, 19 nt, Homo sapiens
acucaacucugagcccaua

SEQ ID NO: 1250601 - RNA, 20 nt, Homo sapiens
acucaaguaccaccaaggga

SEQ ID NO: 1250602 - RNA, 13 nt, Homo sapiens
acucacaugacac

SEQ ID NO: 1250603 - RNA, 20 nt, Homo sapiens
acucaccagccccacugcca

SEQ ID NO: 1250604 - RNA, 23 nt, Homo sapiens
acucaccaguguccccuccacug

SEQ ID NO: 1250605 - RNA, 13 nt, Homo sapiens
acucaccgugcug

SEQ ID NO: 1250606 - RNA, 21 nt, Homo sapiens
acucacugacucuucuaugca

SEQ ID NO: 1250607 - RNA, 23 nt, Homo sapiens
acucacugaggguaucugacaau

SEQ ID NO: 1250608 - RNA, 23 nt, Homo sapiens
acucacugcugcaaauacuguau

SEQ ID NO: 1250609 - RNA, 20 nt, Homo sapiens
acucacuuaucccaagagaa

SEQ ID NO: 1250610 - RNA, 15 nt, Homo sapiens
acucacuuguaagaa

SEQ ID NO: 1250611 - RNA, 19 nt, Homo sapiens
acucagaaaagaaaaccau

SEQ ID NO: 1250612 - RNA, 15 nt, Homo sapiens
acucagagcagauga

SEQ ID NO: 1250613 - RNA, 15 nt, Homo sapiens
acucagcauugugac

SEQ ID NO: 1250614 - RNA, 16 nt, Homo sapiens
acucagcuaucagcuc

SEQ ID NO: 1250615 - RNA, 17 nt, Homo sapiens
acucagcuguccugcag

SEQ ID NO: 1250616 - RNA, 18 nt, Homo sapiens
acucaggccaacaagcca

SEQ ID NO: 1250617 - RNA, 19 nt, Homo sapiens
acucaguaaaauguuuaau

SEQ ID NO: 1250618 - RNA, 18 nt, Homo sapiens
acucagucucucuucucu

SEQ ID NO: 1250619 - RNA, 13 nt, Homo sapiens
acucagugcaaac

SEQ ID NO: 1250620 - RNA, 16 nt, Homo sapiens
acuccaaaauguuggu

SEQ ID NO: 1250621 - RNA, 23 nt, Homo sapiens
acuccacccguucccacugcccu

SEQ ID NO: 1250622 - RNA, 23 nt, Homo sapiens
acuccacccuccaccuuccauuu

SEQ ID NO: 1250623 - RNA, 19 nt, Homo sapiens
acuccacccuccuacaggu

SEQ ID NO: 1250624 - RNA, 22 nt, Homo sapiens
acuccacuggacagacccaggu

SEQ ID NO: 1250625 - RNA, 19 nt, Homo sapiens
acuccagagucaguaguua

SEQ ID NO: 1250626 - RNA, 13 nt, Homo sapiens
acuccaguaaaaa

SEQ ID NO: 1250627 - RNA, 13 nt, Homo sapiens
acuccagugccag

SEQ ID NO: 1250628 - RNA, 17 nt, Homo sapiens
acuccaguguacauagu

SEQ ID NO: 1250629 - RNA, 13 nt, Homo sapiens
acuccaugcugcc

SEQ ID NO: 1250630 - RNA, 18 nt, Homo sapiens
acuccaugcugccagccu

SEQ ID NO: 1250631 - RNA, 23 nt, Homo sapiens
acuccccauuaacagauggaaaa

SEQ ID NO: 1250632 - RNA, 21 nt, Homo sapiens
acucccuagucuccaccugag

SEQ ID NO: 1250633 - RNA, 20 nt, Homo sapiens
acucccuccucaccucugga

SEQ ID NO: 1250634 - RNA, 24 nt, Homo sapiens
acucccucuucacuguggccacag

SEQ ID NO: 1250635 - RNA, 17 nt, Homo sapiens
acucccugcagaugcca

SEQ ID NO: 1250636 - RNA, 22 nt, Homo sapiens
acuccucagaucugaacacagu

SEQ ID NO: 1250637 - RNA, 21 nt, Homo sapiens
acuccucauccccacaaucug

SEQ ID NO: 1250638 - RNA, 16 nt, Homo sapiens
acuccuccaaggcaca

SEQ ID NO: 1250639 - RNA, 22 nt, Homo sapiens
acuccuccagccaccacccaca

SEQ ID NO: 1250640 - RNA, 19 nt, Homo sapiens
acuccucucccacagagug

SEQ ID NO: 1250641 - RNA, 14 nt, Homo sapiens
acuccucuuuacac

SEQ ID NO: 1250642 - RNA, 14 nt, Homo sapiens
acuccugaccucag

SEQ ID NO: 1250643 - RNA, 13 nt, Homo sapiens
acuccugcaaaau

SEQ ID NO: 1250644 - RNA, 17 nt, Homo sapiens
acuccugccacaacaga

SEQ ID NO: 1250645 - RNA, 13 nt, Homo sapiens
acuccugccauuc

SEQ ID NO: 1250646 - RNA, 19 nt, Homo sapiens
acuccuguaggaagguuaa

SEQ ID NO: 1250647 - RNA, 17 nt, Homo sapiens
acuccugugucugugua

SEQ ID NO: 1250648 - RNA, 12 nt, Homo sapiens
acuccuucagga

SEQ ID NO: 1250649 - RNA, 16 nt, Homo sapiens
acuccuuggccuagcc

SEQ ID NO: 1250650 - RNA, 12 nt, Homo sapiens
acucgccagcuc

SEQ ID NO: 1250651 - RNA, 21 nt, Homo sapiens
acucgcccucgccaguggugu

SEQ ID NO: 1250652 - RNA, 14 nt, Homo sapiens
acucggauuccagc

SEQ ID NO: 1250653 - RNA, 21 nt, Homo sapiens
acucuaaaagauagacaucag

SEQ ID NO: 1250654 - RNA, 16 nt, Homo sapiens
acucuaauagugcuua

SEQ ID NO: 1250655 - RNA, 13 nt, Homo sapiens
acucuacauuuaa

SEQ ID NO: 1250656 - RNA, 18 nt, Homo sapiens
acucuagaagaccaaaug

SEQ ID NO: 1250657 - RNA, 16 nt, Homo sapiens
acucuaggguccagug

SEQ ID NO: 1250658 - RNA, 20 nt, Homo sapiens
acucuaggguccaguggaug

SEQ ID NO: 1250659 - RNA, 14 nt, Homo sapiens
acucuagugcuaca

SEQ ID NO: 1250660 - RNA, 20 nt, Homo sapiens
acucuagugcuacaugaugc

SEQ ID NO: 1250661 - RNA, 21 nt, Homo sapiens
acucuccuagagacagaagca

SEQ ID NO: 1250662 - RNA, 19 nt, Homo sapiens
acucuccuuuugacuccuu

SEQ ID NO: 1250663 - RNA, 13 nt, Homo sapiens
acucucugcucua

SEQ ID NO: 1250664 - RNA, 16 nt, Homo sapiens
acucugaaacugagaa

SEQ ID NO: 1250665 - RNA, 15 nt, Homo sapiens
acucugaaagaccua

SEQ ID NO: 1250666 - RNA, 15 nt, Homo sapiens
acucugaauccucau

SEQ ID NO: 1250667 - RNA, 15 nt, Homo sapiens
acucugagaucuaag

SEQ ID NO: 1250668 - RNA, 14 nt, Homo sapiens
acucugcacaugaa

SEQ ID NO: 1250669 - RNA, 19 nt, Homo sapiens
acucugcacaugucuugua

SEQ ID NO: 1250670 - RNA, 15 nt, Homo sapiens
acucugcacuacucc

SEQ ID NO: 1250671 - RNA, 19 nt, Homo sapiens
acucugccagccacaucca

SEQ ID NO: 1250672 - RNA, 18 nt, Homo sapiens
acucuggaccauauacca

SEQ ID NO: 1250673 - RNA, 19 nt, Homo sapiens
acucuggggugcugccuga

SEQ ID NO: 1250674 - RNA, 20 nt, Homo sapiens
acucuggggugcugccugaa

SEQ ID NO: 1250675 - RNA, 14 nt, Homo sapiens
acucugguggcaca

SEQ ID NO: 1250676 - RNA, 17 nt, Homo sapiens
acucugguuucuaccag

SEQ ID NO: 1250677 - RNA, 22 nt, Homo sapiens
acucuguauuacagcuuucaca

SEQ ID NO: 1250678 - RNA, 21 nt, Homo sapiens
acucuguccacgauucacuca

SEQ ID NO: 1250679 - RNA, 15 nt, Homo sapiens
acucugucuaccugg

SEQ ID NO: 1250680 - RNA, 12 nt, Homo sapiens
acucugucuugu

SEQ ID NO: 1250681 - RNA, 16 nt, Homo sapiens
acucugugggugcuac

SEQ ID NO: 1250682 - RNA, 17 nt, Homo sapiens
acucuguuauuuagacu

SEQ ID NO: 1250683 - RNA, 18 nt, Homo sapiens
acucuguuuccuggucag

SEQ ID NO: 1250684 - RNA, 16 nt, Homo sapiens
acucuuaucuacauaa

SEQ ID NO: 1250685 - RNA, 15 nt, Homo sapiens
acucuucagaggaau

SEQ ID NO: 1250686 - RNA, 18 nt, Homo sapiens
acucuuccaccucccaac

SEQ ID NO: 1250687 - RNA, 16 nt, Homo sapiens
acucuucuaacacaaa

SEQ ID NO: 1250688 - RNA, 20 nt, Homo sapiens
acugaaaaugucacauucua

SEQ ID NO: 1250689 - RNA, 13 nt, Homo sapiens
acugaaaccaaaa

SEQ ID NO: 1250690 - RNA, 14 nt, Homo sapiens
acugaaaccaaaac

SEQ ID NO: 1250691 - RNA, 17 nt, Homo sapiens
acugaaacgucuaggaa

SEQ ID NO: 1250692 - RNA, 14 nt, Homo sapiens
acugaaacuucccu

SEQ ID NO: 1250693 - RNA, 18 nt, Homo sapiens
acugaacaaucaaagcac

SEQ ID NO: 1250694 - RNA, 12 nt, Homo sapiens
acugaaccaaau

SEQ ID NO: 1250695 - RNA, 17 nt, Homo sapiens
acugaaccacucuccca

SEQ ID NO: 1250696 - RNA, 15 nt, Homo sapiens
acugaacucacuuuc

SEQ ID NO: 1250697 - RNA, 16 nt, Homo sapiens
acugaaggacacagca

SEQ ID NO: 1250698 - RNA, 16 nt, Homo sapiens
acugaaucuaccugcc

SEQ ID NO: 1250699 - RNA, 19 nt, Homo sapiens
acugaaucugcuaccaaaa

SEQ ID NO: 1250700 - RNA, 20 nt, Homo sapiens
acugaauuuuuugucuguua

SEQ ID NO: 1250701 - RNA, 20 nt, Homo sapiens
acugacccugauacaggcau

SEQ ID NO: 1250702 - RNA, 15 nt, Homo sapiens
acugacuccugugga

SEQ ID NO: 1250703 - RNA, 18 nt, Homo sapiens
acugacugccuugcuaaa

SEQ ID NO: 1250704 - RNA, 21 nt, Homo sapiens
acugagagugagcaaccagcu

SEQ ID NO: 1250705 - RNA, 20 nt, Homo sapiens
acugagauuuugguauuaca

SEQ ID NO: 1250706 - RNA, 18 nt, Homo sapiens
acugagcagccgccagcu

SEQ ID NO: 1250707 - RNA, 13 nt, Homo sapiens
acugagccaugcu

SEQ ID NO: 1250708 - RNA, 19 nt, Homo sapiens
acugagcugagaccacuga

SEQ ID NO: 1250709 - RNA, 18 nt, Homo sapiens
acugagcugggcaggaag

SEQ ID NO: 1250710 - RNA, 14 nt, Homo sapiens
acugauaaccacuc

SEQ ID NO: 1250711 - RNA, 13 nt, Homo sapiens
acugauaaucucu

SEQ ID NO: 1250712 - RNA, 14 nt, Homo sapiens
acugauauccuccu

SEQ ID NO: 1250713 - RNA, 17 nt, Homo sapiens
acugauaucuggccuaa

SEQ ID NO: 1250714 - RNA, 19 nt, Homo sapiens
acugaugggcaacccccag

SEQ ID NO: 1250715 - RNA, 16 nt, Homo sapiens
acugauguacaauuaa

SEQ ID NO: 1250716 - RNA, 14 nt, Homo sapiens
acugauucucuaca

SEQ ID NO: 1250717 - RNA, 21 nt, Homo sapiens
acugauuugauaccauggcac

SEQ ID NO: 1250718 - RNA, 20 nt, Homo sapiens
acugauuuuuagcuuuacaa

SEQ ID NO: 1250719 - RNA, 16 nt, Homo sapiens
acugcaaaaaaagccu

SEQ ID NO: 1250720 - RNA, 13 nt, Homo sapiens
acugcaacauggg

SEQ ID NO: 1250721 - RNA, 16 nt, Homo sapiens
acugcaaccucugccu

SEQ ID NO: 1250722 - RNA, 20 nt, Homo sapiens
acugcacacugccuggccca

SEQ ID NO: 1250723 - RNA, 16 nt, Homo sapiens
acugcacaguagagca

SEQ ID NO: 1250724 - RNA, 20 nt, Homo sapiens
acugcaccgggccacagaga

SEQ ID NO: 1250725 - RNA, 21 nt, Homo sapiens
acugcacuauagccuagguga

SEQ ID NO: 1250726 - RNA, 19 nt, Homo sapiens
acugcacuccagccuggca

SEQ ID NO: 1250727 - RNA, 13 nt, Homo sapiens
acugcacuuacau

SEQ ID NO: 1250728 - RNA, 18 nt, Homo sapiens
acugcagagggacagaug

SEQ ID NO: 1250729 - RNA, 17 nt, Homo sapiens
acugcagcaguggcuua

SEQ ID NO: 1250730 - RNA, 15 nt, Homo sapiens
acugcagcuuuacau

SEQ ID NO: 1250731 - RNA, 20 nt, Homo sapiens
acugcagggacugccagucc

SEQ ID NO: 1250732 - RNA, 17 nt, Homo sapiens
acugcagugaccacuua

SEQ ID NO: 1250733 - RNA, 21 nt, Homo sapiens
acugccaagccauacuuauua

SEQ ID NO: 1250734 - RNA, 20 nt, Homo sapiens
acugccacacucuccaucac

SEQ ID NO: 1250735 - RNA, 13 nt, Homo sapiens
acugccacuuugc

SEQ ID NO: 1250736 - RNA, 17 nt, Homo sapiens
acugccaucauuuacuu

SEQ ID NO: 1250737 - RNA, 14 nt, Homo sapiens
acugcccccgccac

SEQ ID NO: 1250738 - RNA, 21 nt, Homo sapiens
acugccgugcauuagcacaga

SEQ ID NO: 1250739 - RNA, 13 nt, Homo sapiens
acugccucugcca

SEQ ID NO: 1250740 - RNA, 22 nt, Homo sapiens
acugccucuggaauugcucaag

SEQ ID NO: 1250741 - RNA, 20 nt, Homo sapiens
acugccucuuccucccucau

SEQ ID NO: 1250742 - RNA, 20 nt, Homo sapiens
acugccuucgcuucuugccu

SEQ ID NO: 1250743 - RNA, 23 nt, Homo sapiens
acugccuuuuuguaauccuguac

SEQ ID NO: 1250744 - RNA, 13 nt, Homo sapiens
acugcggaccaag

SEQ ID NO: 1250745 - RNA, 14 nt, Homo sapiens
acugcguggugcuc

SEQ ID NO: 1250746 - RNA, 22 nt, Homo sapiens
acugcuacagcaauuucuaauu

SEQ ID NO: 1250747 - RNA, 18 nt, Homo sapiens
acugcucuguguuuacag

SEQ ID NO: 1250748 - RNA, 20 nt, Homo sapiens
acugcugaaacagacaugaa

SEQ ID NO: 1250749 - RNA, 20 nt, Homo sapiens
acugcugcacaacaagauac

SEQ ID NO: 1250750 - RNA, 19 nt, Homo sapiens
acugcuggagucuggcuuu

SEQ ID NO: 1250751 - RNA, 15 nt, Homo sapiens
acugcugugaaugug

SEQ ID NO: 1250752 - RNA, 20 nt, Homo sapiens
acugcuguucauguuacuca

SEQ ID NO: 1250753 - RNA, 14 nt, Homo sapiens
acugcuucauguga

SEQ ID NO: 1250754 - RNA, 17 nt, Homo sapiens
acugcuucuccaaggac

SEQ ID NO: 1250755 - RNA, 16 nt, Homo sapiens
acugcuugaccaaaga

SEQ ID NO: 1250756 - RNA, 23 nt, Homo sapiens
acugcuuuggucucuucuuucau

SEQ ID NO: 1250757 - RNA, 22 nt, Homo sapiens
acuggaaccccagcuucccucc

SEQ ID NO: 1250758 - RNA, 15 nt, Homo sapiens
acuggaagcacagcu

SEQ ID NO: 1250759 - RNA, 22 nt, Homo sapiens
acuggaccguuuccaagcugcg

SEQ ID NO: 1250760 - RNA, 18 nt, Homo sapiens
acuggacugugugcaacg

SEQ ID NO: 1250761 - RNA, 16 nt, Homo sapiens
acuggagcaugcagag

SEQ ID NO: 1250762 - RNA, 19 nt, Homo sapiens
acuggagguugaagccaag

SEQ ID NO: 1250763 - RNA, 21 nt, Homo sapiens
acuggaguaucauucuuuaca

SEQ ID NO: 1250764 - RNA, 17 nt, Homo sapiens
acuggauggucaucucg

SEQ ID NO: 1250765 - RNA, 20 nt, Homo sapiens
acuggcaauaaacuccuacu

SEQ ID NO: 1250766 - RNA, 21 nt, Homo sapiens
acuggcacagagguagucuca

SEQ ID NO: 1250767 - RNA, 21 nt, Homo sapiens
acuggcagaucgcucacuguu

SEQ ID NO: 1250768 - RNA, 16 nt, Homo sapiens
acuggcagcaucuuca

SEQ ID NO: 1250769 - RNA, 18 nt, Homo sapiens
acuggcaucugacacaaa

SEQ ID NO: 1250770 - RNA, 15 nt, Homo sapiens
acuggcaugggagac

SEQ ID NO: 1250771 - RNA, 12 nt, Homo sapiens
acuggccuccag

SEQ ID NO: 1250772 - RNA, 23 nt, Homo sapiens
acuggccucccuuugugugcaua

SEQ ID NO: 1250773 - RNA, 17 nt, Homo sapiens
acuggcguucaccuccc

SEQ ID NO: 1250774 - RNA, 15 nt, Homo sapiens
acuggcucucuccag

SEQ ID NO: 1250775 - RNA, 18 nt, Homo sapiens
acuggcugucugccugua

SEQ ID NO: 1250776 - RNA, 20 nt, Homo sapiens
acuggcuguuaaucuuucaa

SEQ ID NO: 1250777 - RNA, 23 nt, Homo sapiens
acugggacccccaacauucugcc

SEQ ID NO: 1250778 - RNA, 19 nt, Homo sapiens
acugggugaggauaacaca

SEQ ID NO: 1250779 - RNA, 23 nt, Homo sapiens
acuggguguugaucuuacaagau

SEQ ID NO: 1250780 - RNA, 21 nt, Homo sapiens
acuggguuuggaccccagcug

SEQ ID NO: 1250781 - RNA, 17 nt, Homo sapiens
acugguagguugggaca

SEQ ID NO: 1250782 - RNA, 23 nt, Homo sapiens
acugguauguguggaugaugcug

SEQ ID NO: 1250783 - RNA, 18 nt, Homo sapiens
acugguccagcucugaca

SEQ ID NO: 1250784 - RNA, 22 nt, Homo sapiens
acugguccagcucugacauccc

SEQ ID NO: 1250785 - RNA, 21 nt, Homo sapiens
acuggucuuguggaauuggga

SEQ ID NO: 1250786 - RNA, 13 nt, Homo sapiens
acuggugugcucu

SEQ ID NO: 1250787 - RNA, 17 nt, Homo sapiens
acugguuggguuugcuu

SEQ ID NO: 1250788 - RNA, 22 nt, Homo sapiens
acuguaaauaugaaucugcuca

SEQ ID NO: 1250789 - RNA, 23 nt, Homo sapiens
acuguaacguuuucuuucacaca

SEQ ID NO: 1250790 - RNA, 18 nt, Homo sapiens
acuguaacugacugccuu

SEQ ID NO: 1250791 - RNA, 14 nt, Homo sapiens
acuguaagggauug

SEQ ID NO: 1250792 - RNA, 15 nt, Homo sapiens
acuguaauaauaccu

SEQ ID NO: 1250793 - RNA, 20 nt, Homo sapiens
acuguaauuaaguaaaccaa

SEQ ID NO: 1250794 - RNA, 21 nt, Homo sapiens
acuguacacagaauuguucca

SEQ ID NO: 1250795 - RNA, 23 nt, Homo sapiens
acuguacacuuguuuggugcuaa

SEQ ID NO: 1250796 - RNA, 15 nt, Homo sapiens
acuguacuagucugu

SEQ ID NO: 1250797 - RNA, 13 nt, Homo sapiens
acuguacuccucc

SEQ ID NO: 1250798 - RNA, 12 nt, Homo sapiens
acuguacuggcc

SEQ ID NO: 1250799 - RNA, 14 nt, Homo sapiens
acuguagucucuga

SEQ ID NO: 1250800 - RNA, 19 nt, Homo sapiens
acuguauggaaacacugau

SEQ ID NO: 1250801 - RNA, 21 nt, Homo sapiens
acuguauuggcucugugaaaa

SEQ ID NO: 1250802 - RNA, 16 nt, Homo sapiens
acuguauuucuaagaa

SEQ ID NO: 1250803 - RNA, 14 nt, Homo sapiens
acuguauuuuccaa

SEQ ID NO: 1250804 - RNA, 19 nt, Homo sapiens
acugucacauaaugcucau

SEQ ID NO: 1250805 - RNA, 12 nt, Homo sapiens
acugucacuguu

SEQ ID NO: 1250806 - RNA, 14 nt, Homo sapiens
acugucauagaaau

SEQ ID NO: 1250807 - RNA, 13 nt, Homo sapiens
acuguccaaagac

SEQ ID NO: 1250808 - RNA, 22 nt, Homo sapiens
acuguccaagugccacaugccu

SEQ ID NO: 1250809 - RNA, 22 nt, Homo sapiens
acuguccagagagcaacucuga

SEQ ID NO: 1250810 - RNA, 14 nt, Homo sapiens
acugucccuugccu

SEQ ID NO: 1250811 - RNA, 16 nt, Homo sapiens
acugucccuugccuca

SEQ ID NO: 1250812 - RNA, 17 nt, Homo sapiens
acuguccuuaaagccau

SEQ ID NO: 1250813 - RNA, 12 nt, Homo sapiens
acugucucaaga

SEQ ID NO: 1250814 - RNA, 14 nt, Homo sapiens
acugucucacuuaa

SEQ ID NO: 1250815 - RNA, 12 nt, Homo sapiens
acugugacugua

SEQ ID NO: 1250816 - RNA, 22 nt, Homo sapiens
acugugcaaauauaucugcuau

SEQ ID NO: 1250817 - RNA, 12 nt, Homo sapiens
acugugcaucuc

SEQ ID NO: 1250818 - RNA, 14 nt, Homo sapiens
acugugcaucuccu

SEQ ID NO: 1250819 - RNA, 21 nt, Homo sapiens
acugugcuaauaacagugcau

SEQ ID NO: 1250820 - RNA, 12 nt, Homo sapiens
acugugcuacug

SEQ ID NO: 1250821 - RNA, 18 nt, Homo sapiens
acuguggcuagugacaaa

SEQ ID NO: 1250822 - RNA, 14 nt, Homo sapiens
acuguggcucugca

SEQ ID NO: 1250823 - RNA, 22 nt, Homo sapiens
acugugggauguguucuucuuu

SEQ ID NO: 1250824 - RNA, 19 nt, Homo sapiens
acuguguggacugugaugc

SEQ ID NO: 1250825 - RNA, 18 nt, Homo sapiens
acuguguuuuuccuccau

SEQ ID NO: 1250826 - RNA, 16 nt, Homo sapiens
acuguucagcuguccu

SEQ ID NO: 1250827 - RNA, 16 nt, Homo sapiens
acuguuccagauuccu

SEQ ID NO: 1250828 - RNA, 21 nt, Homo sapiens
acuguucuaccaagaacugaa

SEQ ID NO: 1250829 - RNA, 14 nt, Homo sapiens
acuguugcacugau

SEQ ID NO: 1250830 - RNA, 13 nt, Homo sapiens
acuguugcccagg

SEQ ID NO: 1250831 - RNA, 17 nt, Homo sapiens
acuguugcuuuagucac

SEQ ID NO: 1250832 - RNA, 22 nt, Homo sapiens
acuguugguauuauauaauuca

SEQ ID NO: 1250833 - RNA, 19 nt, Homo sapiens
acuguuuaagcccagccaa

SEQ ID NO: 1250834 - RNA, 21 nt, Homo sapiens
acuguuuuguaagugcugcua

SEQ ID NO: 1250835 - RNA, 17 nt, Homo sapiens
acuuaaaaaaaugacag

SEQ ID NO: 1250836 - RNA, 14 nt, Homo sapiens
acuuaaacuuccac

SEQ ID NO: 1250837 - RNA, 15 nt, Homo sapiens
acuuaagacugugua

SEQ ID NO: 1250838 - RNA, 19 nt, Homo sapiens
acuuaagaguggcauauaa

SEQ ID NO: 1250839 - RNA, 21 nt, Homo sapiens
acuuaagcaucuggcucuaau

SEQ ID NO: 1250840 - RNA, 17 nt, Homo sapiens
acuuaaggaaguuugau

SEQ ID NO: 1250841 - RNA, 19 nt, Homo sapiens
acuuaaggauggagccagc

SEQ ID NO: 1250842 - RNA, 22 nt, Homo sapiens
acuuacaauaccauggguuauu

SEQ ID NO: 1250843 - RNA, 19 nt, Homo sapiens
acuuacaggccuugcucac

SEQ ID NO: 1250844 - RNA, 14 nt, Homo sapiens
acuuacuuuacuca

SEQ ID NO: 1250845 - RNA, 17 nt, Homo sapiens
acuuagaucaucaguca

SEQ ID NO: 1250846 - RNA, 17 nt, Homo sapiens
acuuagcaugucccuac

SEQ ID NO: 1250847 - RNA, 21 nt, Homo sapiens
acuuauaaaucauauugauga

SEQ ID NO: 1250848 - RNA, 22 nt, Homo sapiens
acuuauggccacagcccaucca

SEQ ID NO: 1250849 - RNA, 12 nt, Homo sapiens
acuuauuacaau

SEQ ID NO: 1250850 - RNA, 17 nt, Homo sapiens
acuuauuggaacucugc

SEQ ID NO: 1250851 - RNA, 14 nt, Homo sapiens
acuucaaauguggu

SEQ ID NO: 1250852 - RNA, 19 nt, Homo sapiens
acuucaaggcucaaugcua

SEQ ID NO: 1250853 - RNA, 23 nt, Homo sapiens
acuucaaguauaacaacuuugaa

SEQ ID NO: 1250854 - RNA, 20 nt, Homo sapiens
acuucaaguuaaagugaaua

SEQ ID NO: 1250855 - RNA, 19 nt, Homo sapiens
acuucaaugggcucuucca

SEQ ID NO: 1250856 - RNA, 20 nt, Homo sapiens
acuucaaugggcucuuccaa

SEQ ID NO: 1250857 - RNA, 14 nt, Homo sapiens
acuucaauuuacuu

SEQ ID NO: 1250858 - RNA, 20 nt, Homo sapiens
acuucaccuacauuaucuca

SEQ ID NO: 1250859 - RNA, 15 nt, Homo sapiens
acuucagcugccuga

SEQ ID NO: 1250860 - RNA, 12 nt, Homo sapiens
acuucagggauc

SEQ ID NO: 1250861 - RNA, 19 nt, Homo sapiens
acuucaguuuaaugucucc

SEQ ID NO: 1250862 - RNA, 17 nt, Homo sapiens
acuucauauuguugcau

SEQ ID NO: 1250863 - RNA, 19 nt, Homo sapiens
acuucauuugaugcuaaau

SEQ ID NO: 1250864 - RNA, 19 nt, Homo sapiens
acuuccacaagagugaauu

SEQ ID NO: 1250865 - RNA, 22 nt, Homo sapiens
acuuccacauuauacauuugau

SEQ ID NO: 1250866 - RNA, 16 nt, Homo sapiens
acuuccacugccaucc

SEQ ID NO: 1250867 - RNA, 12 nt, Homo sapiens
acuuccagcuuu

SEQ ID NO: 1250868 - RNA, 19 nt, Homo sapiens
acuuccaggggaaccugcc

SEQ ID NO: 1250869 - RNA, 20 nt, Homo sapiens
acuucccucaggccuaugca

SEQ ID NO: 1250870 - RNA, 13 nt, Homo sapiens
acuuccucaugaa

SEQ ID NO: 1250871 - RNA, 14 nt, Homo sapiens
acuuccugcuacag

SEQ ID NO: 1250872 - RNA, 13 nt, Homo sapiens
acuuccuugcucu

SEQ ID NO: 1250873 - RNA, 19 nt, Homo sapiens
acuuccuuggaaacagagc

SEQ ID NO: 1250874 - RNA, 17 nt, Homo sapiens
acuuccuuuaaagauga

SEQ ID NO: 1250875 - RNA, 23 nt, Homo sapiens
acuucuaacuagaaaucugccaa

SEQ ID NO: 1250876 - RNA, 14 nt, Homo sapiens
acuucuaccaggac

SEQ ID NO: 1250877 - RNA, 14 nt, Homo sapiens
acuucucaagauac

SEQ ID NO: 1250878 - RNA, 20 nt, Homo sapiens
acuucucucaucugggcaaa

SEQ ID NO: 1250879 - RNA, 15 nt, Homo sapiens
acuucugaagacuga

SEQ ID NO: 1250880 - RNA, 22 nt, Homo sapiens
acuucugucuguugaggcauca

SEQ ID NO: 1250881 - RNA, 13 nt, Homo sapiens
acuucuuccuuuc

SEQ ID NO: 1250882 - RNA, 11 nt, Homo sapiens
acuucuuguca

SEQ ID NO: 1250883 - RNA, 14 nt, Homo sapiens
acuucuugucagac

SEQ ID NO: 1250884 - RNA, 17 nt, Homo sapiens
acuugaaacagauucag

SEQ ID NO: 1250885 - RNA, 21 nt, Homo sapiens
acuugaaagaaauggugaaug

SEQ ID NO: 1250886 - RNA, 23 nt, Homo sapiens
acuugaaaguuuuccaguauuga

SEQ ID NO: 1250887 - RNA, 21 nt, Homo sapiens
acuugaaauuuggcuaauaac

SEQ ID NO: 1250888 - RNA, 15 nt, Homo sapiens
acuugacccaugccc

SEQ ID NO: 1250889 - RNA, 22 nt, Homo sapiens
acuugacugggugagacccaaa

SEQ ID NO: 1250890 - RNA, 16 nt, Homo sapiens
acuugacuugaaugug

SEQ ID NO: 1250891 - RNA, 21 nt, Homo sapiens
acuugagaaccagucuccuca

SEQ ID NO: 1250892 - RNA, 20 nt, Homo sapiens
acuugagaggaugaauguau

SEQ ID NO: 1250893 - RNA, 20 nt, Homo sapiens
acuugauagcaaacacuggg

SEQ ID NO: 1250894 - RNA, 14 nt, Homo sapiens
acuugauugucucc

SEQ ID NO: 1250895 - RNA, 20 nt, Homo sapiens
acuugcaauucaaaauucag

SEQ ID NO: 1250896 - RNA, 21 nt, Homo sapiens
acuugcauccaacuccaggau

SEQ ID NO: 1250897 - RNA, 14 nt, Homo sapiens
acuugccuucugau

SEQ ID NO: 1250898 - RNA, 14 nt, Homo sapiens
acuugcguccugca

SEQ ID NO: 1250899 - RNA, 17 nt, Homo sapiens
acuugcuaaagcacuuu

SEQ ID NO: 1250900 - RNA, 21 nt, Homo sapiens
acuuggaauuuguaaccucag

SEQ ID NO: 1250901 - RNA, 22 nt, Homo sapiens
acuuggacacgguaacuguugc

SEQ ID NO: 1250902 - RNA, 19 nt, Homo sapiens
acuuggaguaaaacuguau

SEQ ID NO: 1250903 - RNA, 12 nt, Homo sapiens
acuuggccaguu

SEQ ID NO: 1250904 - RNA, 18 nt, Homo sapiens
acuugggaaacuauucau

SEQ ID NO: 1250905 - RNA, 19 nt, Homo sapiens
acuugggggccauccugcc

SEQ ID NO: 1250906 - RNA, 16 nt, Homo sapiens
acuuggguugaacuau

SEQ ID NO: 1250907 - RNA, 17 nt, Homo sapiens
acuuguagggaugccuu

SEQ ID NO: 1250908 - RNA, 19 nt, Homo sapiens
acuugucacugacacaaag

SEQ ID NO: 1250909 - RNA, 16 nt, Homo sapiens
acuuguggacacagcu

SEQ ID NO: 1250910 - RNA, 17 nt, Homo sapiens
acuuguuugucuuccau

SEQ ID NO: 1250911 - RNA, 14 nt, Homo sapiens
acuuguuugugcau

SEQ ID NO: 1250912 - RNA, 15 nt, Homo sapiens
acuuguuuuaugcuc

SEQ ID NO: 1250913 - RNA, 19 nt, Homo sapiens
acuuguuuucacuuuauca

SEQ ID NO: 1250914 - RNA, 17 nt, Homo sapiens
acuuguuuuugcacaug

SEQ ID NO: 1250915 - RNA, 16 nt, Homo sapiens
acuuuaaaaggauuaa

SEQ ID NO: 1250916 - RNA, 16 nt, Homo sapiens
acuuuaagaaguaauu

SEQ ID NO: 1250917 - RNA, 13 nt, Homo sapiens
acuuuaaugaacu

SEQ ID NO: 1250918 - RNA, 14 nt, Homo sapiens
acuuuaaugaacua

SEQ ID NO: 1250919 - RNA, 13 nt, Homo sapiens
acuuuagaaauaa

SEQ ID NO: 1250920 - RNA, 21 nt, Homo sapiens
acuuuagaagugcauuucuga

SEQ ID NO: 1250921 - RNA, 20 nt, Homo sapiens
acuuuagaguagcaugagag

SEQ ID NO: 1250922 - RNA, 11 nt, Homo sapiens
acuuuagucuc

SEQ ID NO: 1250923 - RNA, 15 nt, Homo sapiens
acuuuauaucuguaa

SEQ ID NO: 1250924 - RNA, 21 nt, Homo sapiens
acuuuaucaaagagaaguuac

SEQ ID NO: 1250925 - RNA, 22 nt, Homo sapiens
acuuuauguaguuuuuauaugu

SEQ ID NO: 1250926 - RNA, 16 nt, Homo sapiens
acuuucaaaauuaaau

SEQ ID NO: 1250927 - RNA, 12 nt, Homo sapiens
acuuuccacuuc

SEQ ID NO: 1250928 - RNA, 20 nt, Homo sapiens
acuuuccccaauuacagggu

SEQ ID NO: 1250929 - RNA, 19 nt, Homo sapiens
acuuucccuugugucaaga

SEQ ID NO: 1250930 - RNA, 17 nt, Homo sapiens
acuuucucaguuuucau

SEQ ID NO: 1250931 - RNA, 22 nt, Homo sapiens
acuuucugauuacuguccagcu

SEQ ID NO: 1250932 - RNA, 20 nt, Homo sapiens
acuuucugugacgcagacag

SEQ ID NO: 1250933 - RNA, 22 nt, Homo sapiens
acuuucuguugccacaacccug

SEQ ID NO: 1250934 - RNA, 18 nt, Homo sapiens
acuuucuuaucacuuaua

SEQ ID NO: 1250935 - RNA, 18 nt, Homo sapiens
acuuucuucucuuuccca

SEQ ID NO: 1250936 - RNA, 21 nt, Homo sapiens
acuuucuugaaaagaagcaag

SEQ ID NO: 1250937 - RNA, 13 nt, Homo sapiens
acuuugaccuaaa

SEQ ID NO: 1250938 - RNA, 15 nt, Homo sapiens
acuuugagaagcuga

SEQ ID NO: 1250939 - RNA, 18 nt, Homo sapiens
acuuugaguuagugccau

SEQ ID NO: 1250940 - RNA, 18 nt, Homo sapiens
acuuugauaucugaucaa

SEQ ID NO: 1250941 - RNA, 13 nt, Homo sapiens
acuuugcacuuaa

SEQ ID NO: 1250942 - RNA, 17 nt, Homo sapiens
acuuugcuugcuuugaa

SEQ ID NO: 1250943 - RNA, 16 nt, Homo sapiens
acuuuggcaauuuccu

SEQ ID NO: 1250944 - RNA, 15 nt, Homo sapiens
acuuugggaccugcu

SEQ ID NO: 1250945 - RNA, 16 nt, Homo sapiens
acuuugggaucaaaua

SEQ ID NO: 1250946 - RNA, 23 nt, Homo sapiens
acuuuguaauaccagaacucuaa

SEQ ID NO: 1250947 - RNA, 15 nt, Homo sapiens
acuuuguauuuugau

SEQ ID NO: 1250948 - RNA, 22 nt, Homo sapiens
acuuugucaugguuuccauuua

SEQ ID NO: 1250949 - RNA, 18 nt, Homo sapiens
acuuugugagccaaagcu

SEQ ID NO: 1250950 - RNA, 13 nt, Homo sapiens
acuuugugcauuc

SEQ ID NO: 1250951 - RNA, 19 nt, Homo sapiens
acuuuguggcaaucugugg

SEQ ID NO: 1250952 - RNA, 15 nt, Homo sapiens
acuuuuaaaaugccc

SEQ ID NO: 1250953 - RNA, 22 nt, Homo sapiens
acuuuuaaguugcugaugaacu

SEQ ID NO: 1250954 - RNA, 23 nt, Homo sapiens
acuuuuaaguugcugaugaacuc

SEQ ID NO: 1250955 - RNA, 17 nt, Homo sapiens
acuuuuauuuccuguau

SEQ ID NO: 1250956 - RNA, 15 nt, Homo sapiens
acuuuucgacauauu

SEQ ID NO: 1250957 - RNA, 15 nt, Homo sapiens
acuuuucugcugaua

SEQ ID NO: 1250958 - RNA, 21 nt, Homo sapiens
acuuuuuaaaauaauaacaau

SEQ ID NO: 1250959 - RNA, 19 nt, Homo sapiens
acuuuuuaguuguucagca

SEQ ID NO: 1250960 - RNA, 15 nt, Homo sapiens
acuuuuugcauuuaa

SEQ ID NO: 1250961 - RNA, 19 nt, Homo sapiens
acuuuuuuagaaaugcaaa

SEQ ID NO: 1250962 - RNA, 22 nt, Homo sapiens
acuuuuuucuuauuuaacuuaa

SEQ ID NO: 1250963 - RNA, 20 nt, Homo sapiens
acuuuuuuugguauaauguu

SEQ ID NO: 1250964 - RNA, 18 nt, Homo sapiens
acuuuuuuuuuaaagcca

SEQ ID NO: 1250965 - RNA, 13 nt, Homo sapiens
agaaaaaccaaug

SEQ ID NO: 1250966 - RNA, 14 nt, Homo sapiens
agaaaaagaagaac

SEQ ID NO: 1250967 - RNA, 20 nt, Homo sapiens
agaaaaauaagcucgaguga

SEQ ID NO: 1250968 - RNA, 13 nt, Homo sapiens
agaaaacaaucaa

SEQ ID NO: 1250969 - RNA, 15 nt, Homo sapiens
agaaaacauaaucuu

SEQ ID NO: 1250970 - RNA, 13 nt, Homo sapiens
agaaaaccagcuu

SEQ ID NO: 1250971 - RNA, 15 nt, Homo sapiens
agaaaacuguuaaua

SEQ ID NO: 1250972 - RNA, 16 nt, Homo sapiens
agaaaagaaauuaguu

SEQ ID NO: 1250973 - RNA, 22 nt, Homo sapiens
agaaaagaauuuuaguguuaau

SEQ ID NO: 1250974 - RNA, 19 nt, Homo sapiens
agaaaagcccaaguucaug

SEQ ID NO: 1250975 - RNA, 16 nt, Homo sapiens
agaaaagcugccauuu

SEQ ID NO: 1250976 - RNA, 19 nt, Homo sapiens
agaaaagcugccauuuccc

SEQ ID NO: 1250977 - RNA, 17 nt, Homo sapiens
agaaaagggaguuuaaa

SEQ ID NO: 1250978 - RNA, 14 nt, Homo sapiens
agaaaagugcauau

SEQ ID NO: 1250979 - RNA, 15 nt, Homo sapiens
agaaaaguugcagau

SEQ ID NO: 1250980 - RNA, 17 nt, Homo sapiens
agaaaauagagcuuuua

SEQ ID NO: 1250981 - RNA, 12 nt, Homo sapiens
agaaaauaucuu

SEQ ID NO: 1250982 - RNA, 22 nt, Homo sapiens
agaaaauauuauguguuuccau

SEQ ID NO: 1250983 - RNA, 20 nt, Homo sapiens
agaaaauccccaacuaugca

SEQ ID NO: 1250984 - RNA, 23 nt, Homo sapiens
agaaaaugacuuauuucugcucu

SEQ ID NO: 1250985 - RNA, 22 nt, Homo sapiens
agaaaaugauguguacccaaac

SEQ ID NO: 1250986 - RNA, 13 nt, Homo sapiens
agaaaaugccuca

SEQ ID NO: 1250987 - RNA, 22 nt, Homo sapiens
agaaaaugccucaauucacaua

SEQ ID NO: 1250988 - RNA, 16 nt, Homo sapiens
agaaaauguguccuau

SEQ ID NO: 1250989 - RNA, 16 nt, Homo sapiens
agaaacaaacaucuaa

SEQ ID NO: 1250990 - RNA, 17 nt, Homo sapiens
agaaacaaauaauagca

SEQ ID NO: 1250991 - RNA, 21 nt, Homo sapiens
agaaacacauucuuauugaca

SEQ ID NO: 1250992 - RNA, 21 nt, Homo sapiens
agaaacacugacuccugugga

SEQ ID NO: 1250993 - RNA, 13 nt, Homo sapiens
agaaacacuuucu

SEQ ID NO: 1250994 - RNA, 18 nt, Homo sapiens
agaaacaguccaguacuu

SEQ ID NO: 1250995 - RNA, 15 nt, Homo sapiens
agaaacagugugcau

SEQ ID NO: 1250996 - RNA, 16 nt, Homo sapiens
agaaacagugugcaug

SEQ ID NO: 1250997 - RNA, 19 nt, Homo sapiens
agaaacaguugguaacuuu

SEQ ID NO: 1250998 - RNA, 19 nt, Homo sapiens
agaaacaugacacugaccu

SEQ ID NO: 1250999 - RNA, 20 nt, Homo sapiens
agaaacaugacacugaccuu

SEQ ID NO: 1251000 - RNA, 18 nt, Homo sapiens
agaaacauucuuuuccac

SEQ ID NO: 1251001 - RNA, 23 nt, Homo sapiens
agaaacauuguaaauauuuacuc

SEQ ID NO: 1251002 - RNA, 16 nt, Homo sapiens
agaaaccagagucaaa

SEQ ID NO: 1251003 - RNA, 20 nt, Homo sapiens
agaaacccaaauugggacaa

SEQ ID NO: 1251004 - RNA, 23 nt, Homo sapiens
agaaacccuugcugcuuuagucc

SEQ ID NO: 1251005 - RNA, 13 nt, Homo sapiens
agaaaccucggga

SEQ ID NO: 1251006 - RNA, 23 nt, Homo sapiens
agaaaccuggggugaauacuuau

SEQ ID NO: 1251007 - RNA, 21 nt, Homo sapiens
agaaaccuuauuguaccucuc

SEQ ID NO: 1251008 - RNA, 12 nt, Homo sapiens
agaaacucccau

SEQ ID NO: 1251009 - RNA, 13 nt, Homo sapiens
agaaacuucccaa

SEQ ID NO: 1251010 - RNA, 14 nt, Homo sapiens
agaaacuucccaag

SEQ ID NO: 1251011 - RNA, 15 nt, Homo sapiens
agaaagacuaucuaa

SEQ ID NO: 1251012 - RNA, 23 nt, Homo sapiens
agaaagcacgugucucagacugc

SEQ ID NO: 1251013 - RNA, 12 nt, Homo sapiens
agaaaggcauga

SEQ ID NO: 1251014 - RNA, 17 nt, Homo sapiens
agaaagguuuuauucua

SEQ ID NO: 1251015 - RNA, 19 nt, Homo sapiens
agaaaguaaaaaguugcuu

SEQ ID NO: 1251016 - RNA, 14 nt, Homo sapiens
agaaaguacuucuc

SEQ ID NO: 1251017 - RNA, 22 nt, Homo sapiens
agaaaguacuucuccacccugc

SEQ ID NO: 1251018 - RNA, 14 nt, Homo sapiens
agaaaguacuucuu

SEQ ID NO: 1251019 - RNA, 12 nt, Homo sapiens
agaaaguauuug

SEQ ID NO: 1251020 - RNA, 19 nt, Homo sapiens
agaaagugcgaguccucca

SEQ ID NO: 1251021 - RNA, 13 nt, Homo sapiens
agaaaguuaugaa

SEQ ID NO: 1251022 - RNA, 23 nt, Homo sapiens
agaaauaaauguaccugauguac

SEQ ID NO: 1251023 - RNA, 15 nt, Homo sapiens
agaaauaauaugcau

SEQ ID NO: 1251024 - RNA, 20 nt, Homo sapiens
agaaauaauaugcauuguca

SEQ ID NO: 1251025 - RNA, 17 nt, Homo sapiens
agaaauagacaguauau

SEQ ID NO: 1251026 - RNA, 17 nt, Homo sapiens
agaaauaugaagcacuu

SEQ ID NO: 1251027 - RNA, 14 nt, Homo sapiens
agaaauauuccaaa

SEQ ID NO: 1251028 - RNA, 22 nt, Homo sapiens
agaaaucaaugguagcauuuag

SEQ ID NO: 1251029 - RNA, 18 nt, Homo sapiens
agaaaucuagaagacugu

SEQ ID NO: 1251030 - RNA, 19 nt, Homo sapiens
agaaaucuagaagacuguc

SEQ ID NO: 1251031 - RNA, 12 nt, Homo sapiens
agaaaucugcca

SEQ ID NO: 1251032 - RNA, 22 nt, Homo sapiens
agaaaucuuguuggcaaaucag

SEQ ID NO: 1251033 - RNA, 12 nt, Homo sapiens
agaaaugauuca

SEQ ID NO: 1251034 - RNA, 22 nt, Homo sapiens
agaaaugauucaaauugcugcu

SEQ ID NO: 1251035 - RNA, 18 nt, Homo sapiens
agaaaugcaaccaacugc

SEQ ID NO: 1251036 - RNA, 20 nt, Homo sapiens
agaaaugcauaaaagacaag

SEQ ID NO: 1251037 - RNA, 19 nt, Homo sapiens
agaaauguuguucauuauu

SEQ ID NO: 1251038 - RNA, 13 nt, Homo sapiens
agaaauuccccaa

SEQ ID NO: 1251039 - RNA, 20 nt, Homo sapiens
agaaauuccuuccuuaccug

SEQ ID NO: 1251040 - RNA, 22 nt, Homo sapiens
agaaauugcauuuccugacaga

SEQ ID NO: 1251041 - RNA, 20 nt, Homo sapiens
agaaauuugcaacucacuga

SEQ ID NO: 1251042 - RNA, 15 nt, Homo sapiens
agaacaaacucugaa

SEQ ID NO: 1251043 - RNA, 18 nt, Homo sapiens
agaacaaauaaaugagcc

SEQ ID NO: 1251044 - RNA, 15 nt, Homo sapiens
agaacaacuaccuga

SEQ ID NO: 1251045 - RNA, 15 nt, Homo sapiens
agaacaacuacugug

SEQ ID NO: 1251046 - RNA, 14 nt, Homo sapiens
agaacacuaacuca

SEQ ID NO: 1251047 - RNA, 11 nt, Homo sapiens
agaacagggaa

SEQ ID NO: 1251048 - RNA, 22 nt, Homo sapiens
agaacauaaaaaauaaaguacc

SEQ ID NO: 1251049 - RNA, 21 nt, Homo sapiens
agaacauuuauaucaguuuca

SEQ ID NO: 1251050 - RNA, 10 nt, Homo sapiens
agaaccaaaa

SEQ ID NO: 1251051 - RNA, 23 nt, Homo sapiens
agaaccacauauuuuagacacuu

SEQ ID NO: 1251052 - RNA, 14 nt, Homo sapiens
agaaccacuuccug

SEQ ID NO: 1251053 - RNA, 20 nt, Homo sapiens
agaaccagagaggcucugag

SEQ ID NO: 1251054 - RNA, 20 nt, Homo sapiens
agaaccccaggacgcccuca

SEQ ID NO: 1251055 - RNA, 15 nt, Homo sapiens
agaaccccguggggu

SEQ ID NO: 1251056 - RNA, 19 nt, Homo sapiens
agaacccucaggucacaag

SEQ ID NO: 1251057 - RNA, 14 nt, Homo sapiens
agaacccugcugau

SEQ ID NO: 1251058 - RNA, 12 nt, Homo sapiens
agaaccuacugu

SEQ ID NO: 1251059 - RNA, 19 nt, Homo sapiens
agaaccuggauguacuuaa

SEQ ID NO: 1251060 - RNA, 17 nt, Homo sapiens
agaaccuuaaagaacca

SEQ ID NO: 1251061 - RNA, 15 nt, Homo sapiens
agaacguggugaccu

SEQ ID NO: 1251062 - RNA, 16 nt, Homo sapiens
agaacuauaugugaau

SEQ ID NO: 1251063 - RNA, 17 nt, Homo sapiens
agaacuauaugugaauc

SEQ ID NO: 1251064 - RNA, 15 nt, Homo sapiens
agaacugaaggcaua

SEQ ID NO: 1251065 - RNA, 15 nt, Homo sapiens
agaacugcagggccu

SEQ ID NO: 1251066 - RNA, 16 nt, Homo sapiens
agaacugcagucagca

SEQ ID NO: 1251067 - RNA, 21 nt, Homo sapiens
agaacuuagccuuuaccugug

SEQ ID NO: 1251068 - RNA, 18 nt, Homo sapiens
agaacuuggcacacucuc

SEQ ID NO: 1251069 - RNA, 14 nt, Homo sapiens
agaagaagaaggag

SEQ ID NO: 1251070 - RNA, 14 nt, Homo sapiens
agaagacagcugcu

SEQ ID NO: 1251071 - RNA, 20 nt, Homo sapiens
agaagacauccugagcagug

SEQ ID NO: 1251072 - RNA, 21 nt, Homo sapiens
agaagaccccugacucaucau

SEQ ID NO: 1251073 - RNA, 13 nt, Homo sapiens
agaagacuggaag

SEQ ID NO: 1251074 - RNA, 16 nt, Homo sapiens
agaagaggaaagggag

SEQ ID NO: 1251075 - RNA, 18 nt, Homo sapiens
agaagauagaugcacuua

SEQ ID NO: 1251076 - RNA, 21 nt, Homo sapiens
agaagauagaugcacuuaugc

SEQ ID NO: 1251077 - RNA, 19 nt, Homo sapiens
agaagauuuuaugcugcug

SEQ ID NO: 1251078 - RNA, 14 nt, Homo sapiens
agaagcaaaccgcc

SEQ ID NO: 1251079 - RNA, 15 nt, Homo sapiens
agaagcauccuccac

SEQ ID NO: 1251080 - RNA, 16 nt, Homo sapiens
agaagccaacuaugau

SEQ ID NO: 1251081 - RNA, 12 nt, Homo sapiens
agaagccaagga

SEQ ID NO: 1251082 - RNA, 15 nt, Homo sapiens
agaagcccauaucac

SEQ ID NO: 1251083 - RNA, 15 nt, Homo sapiens
agaagccucagcucc

SEQ ID NO: 1251084 - RNA, 18 nt, Homo sapiens
agaagccuuaauuugcac

SEQ ID NO: 1251085 - RNA, 19 nt, Homo sapiens
agaagcucaucucagucau

SEQ ID NO: 1251086 - RNA, 21 nt, Homo sapiens
agaagcucgccccaccuccac

SEQ ID NO: 1251087 - RNA, 17 nt, Homo sapiens
agaagcuguaggacugu

SEQ ID NO: 1251088 - RNA, 20 nt, Homo sapiens
agaagcuuaaaaucugugaa

SEQ ID NO: 1251089 - RNA, 19 nt, Homo sapiens
agggacuccaugcugccag

SEQ ID NO: 1251090 - RNA, 20 nt, Homo sapiens
agggacugacaaaagacuug

SEQ ID NO: 1251091 - RNA, 16 nt, Homo sapiens
agggacuuugcugauu

SEQ ID NO: 1251092 - RNA, 14 nt, Homo sapiens
agggagaacgggaa

SEQ ID NO: 1251093 - RNA, 15 nt, Homo sapiens
agggagaacuugaaa

SEQ ID NO: 1251094 - RNA, 21 nt, Homo sapiens
agggagcuaucaggaacagcu

SEQ ID NO: 1251095 - RNA, 20 nt, Homo sapiens
agggagcugaguaacaccau

SEQ ID NO: 1251096 - RNA, 16 nt, Homo sapiens
agggagcuggaacccg

SEQ ID NO: 1251097 - RNA, 21 nt, Homo sapiens
agggaggaacaccugaucuua

SEQ ID NO: 1251098 - RNA, 14 nt, Homo sapiens
agggaggucacugg

SEQ ID NO: 1251099 - RNA, 14 nt, Homo sapiens
agggagguggcaag

SEQ ID NO: 1251100 - RNA, 17 nt, Homo sapiens
agggagugcuggcucac

SEQ ID NO: 1251101 - RNA, 20 nt, Homo sapiens
agggaguguuugugucugac

SEQ ID NO: 1251102 - RNA, 23 nt, Homo sapiens
agggaguguuugugucugacuca

SEQ ID NO: 1251103 - RNA, 18 nt, Homo sapiens
agggaugcggauccugcu

SEQ ID NO: 1251104 - RNA, 21 nt, Homo sapiens
agggcaaaucuauuacuuuug

SEQ ID NO: 1251105 - RNA, 22 nt, Homo sapiens
agggcaaaugacaugcacugac

SEQ ID NO: 1251106 - RNA, 23 nt, Homo sapiens
agggcaacaauacaugcugcuaa

SEQ ID NO: 1251107 - RNA, 13 nt, Homo sapiens
agggcaccuggag

SEQ ID NO: 1251108 - RNA, 19 nt, Homo sapiens
agggcagcuccagugccag

SEQ ID NO: 1251109 - RNA, 23 nt, Homo sapiens
agggcagggcaucuccugugcau

SEQ ID NO: 1251110 - RNA, 20 nt, Homo sapiens
agggcagggcuggcaccucu

SEQ ID NO: 1251111 - RNA, 18 nt, Homo sapiens
agggcaguaccugggaaa

SEQ ID NO: 1251112 - RNA, 17 nt, Homo sapiens
agggcaguucugagugu

SEQ ID NO: 1251113 - RNA, 17 nt, Homo sapiens
agggcauggccaggugg

SEQ ID NO: 1251114 - RNA, 20 nt, Homo sapiens
agggcauucuuucccaguga

SEQ ID NO: 1251115 - RNA, 17 nt, Homo sapiens
agggcauuuccaaguua

SEQ ID NO: 1251116 - RNA, 19 nt, Homo sapiens
agggccaccacaccugacu

SEQ ID NO: 1251117 - RNA, 21 nt, Homo sapiens
agggccagagggagcuggaac

SEQ ID NO: 1251118 - RNA, 18 nt, Homo sapiens
agggccccucccucugcc

SEQ ID NO: 1251119 - RNA, 14 nt, Homo sapiens
agggcccuaccuga

SEQ ID NO: 1251120 - RNA, 20 nt, Homo sapiens
agggccguugcccccagacu

SEQ ID NO: 1251121 - RNA, 15 nt, Homo sapiens
agggccugcaugggg

SEQ ID NO: 1251122 - RNA, 21 nt, Homo sapiens
agggccuggcaggccaguguc

SEQ ID NO: 1251123 - RNA, 17 nt, Homo sapiens
agggcgagacuccgucu

SEQ ID NO: 1251124 - RNA, 20 nt, Homo sapiens
agggcgagacucugucucaa

SEQ ID NO: 1251125 - RNA, 19 nt, Homo sapiens
agggcgccuacucuucagg

SEQ ID NO: 1251126 - RNA, 14 nt, Homo sapiens
agggcgcucagacg

SEQ ID NO: 1251127 - RNA, 18 nt, Homo sapiens
agggcgggcagagggcug

SEQ ID NO: 1251128 - RNA, 15 nt, Homo sapiens
agggcuagugacuug

SEQ ID NO: 1251129 - RNA, 19 nt, Homo sapiens
agggcuggcagaaagggaa

SEQ ID NO: 1251130 - RNA, 19 nt, Homo sapiens
aggggaacagaccagugac

SEQ ID NO: 1251131 - RNA, 22 nt, Homo sapiens
aggggaagggccagucugggcu

SEQ ID NO: 1251132 - RNA, 21 nt, Homo sapiens
aggggacaccuuggcuccuca

SEQ ID NO: 1251133 - RNA, 13 nt, Homo sapiens
aggggauccagcc

SEQ ID NO: 1251134 - RNA, 18 nt, Homo sapiens
aggggcagauaggagcug

SEQ ID NO: 1251135 - RNA, 14 nt, Homo sapiens
aggggcccuuggga

SEQ ID NO: 1251136 - RNA, 19 nt, Homo sapiens
aggggcgaguuccucgcuc

SEQ ID NO: 1251137 - RNA, 16 nt, Homo sapiens
aggggcugacucucca

SEQ ID NO: 1251138 - RNA, 16 nt, Homo sapiens
aggggcuggaagggaa

SEQ ID NO: 1251139 - RNA, 13 nt, Homo sapiens
aggggcuguguuu

SEQ ID NO: 1251140 - RNA, 18 nt, Homo sapiens
agggggagaauggguguu

SEQ ID NO: 1251141 - RNA, 20 nt, Homo sapiens
agggggccaggcgguggcuu

SEQ ID NO: 1251142 - RNA, 12 nt, Homo sapiens
agggggcccaaa

SEQ ID NO: 1251143 - RNA, 18 nt, Homo sapiens
aggggggggugggugaga

SEQ ID NO: 1251144 - RNA, 13 nt, Homo sapiens
agggguauguucc

SEQ ID NO: 1251145 - RNA, 15 nt, Homo sapiens
agggguauguucccu

SEQ ID NO: 1251146 - RNA, 19 nt, Homo sapiens
aggggugguccugacucaa

SEQ ID NO: 1251147 - RNA, 20 nt, Homo sapiens
agggguuugagaugcuguag

SEQ ID NO: 1251148 - RNA, 14 nt, Homo sapiens
aggguaaguuguua

SEQ ID NO: 1251149 - RNA, 20 nt, Homo sapiens
aggguagauaaccuguacuu

SEQ ID NO: 1251150 - RNA, 20 nt, Homo sapiens
agggucaaggaguacuccaa

SEQ ID NO: 1251151 - RNA, 12 nt, Homo sapiens
agggucagugga

SEQ ID NO: 1251152 - RNA, 16 nt, Homo sapiens
aggguccccacagccc

SEQ ID NO: 1251153 - RNA, 16 nt, Homo sapiens
aggguccgcaccagcu

SEQ ID NO: 1251154 - RNA, 19 nt, Homo sapiens
aggguccucaguccacugc

SEQ ID NO: 1251155 - RNA, 15 nt, Homo sapiens
agggucggccuguac

SEQ ID NO: 1251156 - RNA, 21 nt, Homo sapiens
agggucucgcugucacuggcu

SEQ ID NO: 1251157 - RNA, 16 nt, Homo sapiens
agggucuuugguguuu

SEQ ID NO: 1251158 - RNA, 16 nt, Homo sapiens
agggugcuaacguauc

SEQ ID NO: 1251159 - RNA, 23 nt, Homo sapiens
aggguggacuuagaaagcagggg

SEQ ID NO: 1251160 - RNA, 22 nt, Homo sapiens
aggguggcacucaacucugagc

SEQ ID NO: 1251161 - RNA, 18 nt, Homo sapiens
aggguggcccuugcaguu

SEQ ID NO: 1251162 - RNA, 17 nt, Homo sapiens
aggguggugaguagagc

SEQ ID NO: 1251163 - RNA, 22 nt, Homo sapiens
agggugguggcgugcauaugua

SEQ ID NO: 1251164 - RNA, 14 nt, Homo sapiens
aggguuccaaaggg

SEQ ID NO: 1251165 - RNA, 17 nt, Homo sapiens
aggguuccuguagaccu

SEQ ID NO: 1251166 - RNA, 13 nt, Homo sapiens
aggguugagcugg

SEQ ID NO: 1251167 - RNA, 15 nt, Homo sapiens
agguaacacauuaua

SEQ ID NO: 1251168 - RNA, 18 nt, Homo sapiens
agguaagggggugcagca

SEQ ID NO: 1251169 - RNA, 22 nt, Homo sapiens
agguaauguuaguaaauccaug

SEQ ID NO: 1251170 - RNA, 16 nt, Homo sapiens
agguacagcagaaagg

SEQ ID NO: 1251171 - RNA, 22 nt, Homo sapiens
agguacuucaggggcacuucau

SEQ ID NO: 1251172 - RNA, 18 nt, Homo sapiens
agguagaagugagcaaaa

SEQ ID NO: 1251173 - RNA, 20 nt, Homo sapiens
agguagaccaggauuucuaa

SEQ ID NO: 1251174 - RNA, 17 nt, Homo sapiens
agguaggaucaucccac

SEQ ID NO: 1251175 - RNA, 19 nt, Homo sapiens
agguaggggcccacuucac

SEQ ID NO: 1251176 - RNA, 17 nt, Homo sapiens
agguauacuuuaguaga

SEQ ID NO: 1251177 - RNA, 13 nt, Homo sapiens
agguauguugccu

SEQ ID NO: 1251178 - RNA, 21 nt, Homo sapiens
agguauuuuguaauauucucu

SEQ ID NO: 1251179 - RNA, 16 nt, Homo sapiens
aggucaauuuccugau

SEQ ID NO: 1251180 - RNA, 21 nt, Homo sapiens
aggucagagcagagguggaaa

SEQ ID NO: 1251181 - RNA, 22 nt, Homo sapiens
aggucagagccugcaguuauua

SEQ ID NO: 1251182 - RNA, 22 nt, Homo sapiens
aggucagauggagguucucaga

SEQ ID NO: 1251183 - RNA, 12 nt, Homo sapiens
aggucaggagau

SEQ ID NO: 1251184 - RNA, 18 nt, Homo sapiens
aggucccaccuccauuug

SEQ ID NO: 1251185 - RNA, 15 nt, Homo sapiens
aggucccucagacau

SEQ ID NO: 1251186 - RNA, 16 nt, Homo sapiens
agguccgguguucuaa

SEQ ID NO: 1251187 - RNA, 18 nt, Homo sapiens
agguccuaaagaugcuga

SEQ ID NO: 1251188 - RNA, 14 nt, Homo sapiens
agguccuaaauucu

SEQ ID NO: 1251189 - RNA, 13 nt, Homo sapiens
agguccucuacuu

SEQ ID NO: 1251190 - RNA, 21 nt, Homo sapiens
agguccuuaggccucugagaa

SEQ ID NO: 1251191 - RNA, 19 nt, Homo sapiens
agguccuuuccacccugag

SEQ ID NO: 1251192 - RNA, 14 nt, Homo sapiens
aggucuaccccugg

SEQ ID NO: 1251193 - RNA, 21 nt, Homo sapiens
aggucucacgggcaugggcac

SEQ ID NO: 1251194 - RNA, 17 nt, Homo sapiens
aggucucauucuuccaa

SEQ ID NO: 1251195 - RNA, 16 nt, Homo sapiens
aggucugaaauggagg

SEQ ID NO: 1251196 - RNA, 19 nt, Homo sapiens
aggucuuccagaccugcuu

SEQ ID NO: 1251197 - RNA, 18 nt, Homo sapiens
aggugaaaauccaucuca

SEQ ID NO: 1251198 - RNA, 21 nt, Homo sapiens
aggugaacacuuagugaucau

SEQ ID NO: 1251199 - RNA, 22 nt, Homo sapiens
aggugacagaggcgaaggcaga

SEQ ID NO: 1251200 - RNA, 13 nt, Homo sapiens
aggugacagagug

SEQ ID NO: 1251201 - RNA, 15 nt, Homo sapiens
aggugaccaguggga

SEQ ID NO: 1251202 - RNA, 16 nt, Homo sapiens
aggugauccacccacc

SEQ ID NO: 1251203 - RNA, 19 nt, Homo sapiens
aggugauccgccuaccuca

SEQ ID NO: 1251204 - RNA, 20 nt, Homo sapiens
aggugauucgcccaccucag

SEQ ID NO: 1251205 - RNA, 23 nt, Homo sapiens
aggugauuuguaugcucauugaa

SEQ ID NO: 1251206 - RNA, 21 nt, Homo sapiens
aggugcgaaugacaguagcau

SEQ ID NO: 1251207 - RNA, 19 nt, Homo sapiens
aggugcuaucgcaccacug

SEQ ID NO: 1251208 - RNA, 21 nt, Homo sapiens
aggugcuauguucuuagugga

SEQ ID NO: 1251209 - RNA, 20 nt, Homo sapiens
aggugcuggaggugggagca

SEQ ID NO: 1251210 - RNA, 22 nt, Homo sapiens
aggugcuuaagcagaagcauua

SEQ ID NO: 1251211 - RNA, 21 nt, Homo sapiens
aggugcuuuguaauauucucc

SEQ ID NO: 1251212 - RNA, 18 nt, Homo sapiens
agguggaaaauggugccu

SEQ ID NO: 1251213 - RNA, 18 nt, Homo sapiens
agguggaacaagcacaga

SEQ ID NO: 1251214 - RNA, 17 nt, Homo sapiens
agguggacuuccagcuu

SEQ ID NO: 1251215 - RNA, 18 nt, Homo sapiens
agguggcagagugaaugu

SEQ ID NO: 1251216 - RNA, 16 nt, Homo sapiens
agguggcccuaaagga

SEQ ID NO: 1251217 - RNA, 12 nt, Homo sapiens
aggugggcacug

SEQ ID NO: 1251218 - RNA, 16 nt, Homo sapiens
aggugggcaugccacc

SEQ ID NO: 1251219 - RNA, 20 nt, Homo sapiens
aggugggccagucuguggau

SEQ ID NO: 1251220 - RNA, 21 nt, Homo sapiens
aggugggccuugcuaccucaa

SEQ ID NO: 1251221 - RNA, 14 nt, Homo sapiens
agguggggcagcuu

SEQ ID NO: 1251222 - RNA, 14 nt, Homo sapiens
agguggguccagga

SEQ ID NO: 1251223 - RNA, 23 nt, Homo sapiens
agguggguccaggaaggcagcug

SEQ ID NO: 1251224 - RNA, 19 nt, Homo sapiens
aggugguccuuccuaccuc

SEQ ID NO: 1251225 - RNA, 16 nt, Homo sapiens
agguggugccuucuca

SEQ ID NO: 1251226 - RNA, 17 nt, Homo sapiens
aggugucuagacugcca

SEQ ID NO: 1251227 - RNA, 20 nt, Homo sapiens
aggugucuucuuugacuuaa

SEQ ID NO: 1251228 - RNA, 16 nt, Homo sapiens
agguuaaauuucaagc

SEQ ID NO: 1251229 - RNA, 16 nt, Homo sapiens
agguuaaggugcaaua

SEQ ID NO: 1251230 - RNA, 15 nt, Homo sapiens
agguuauacuccucc

SEQ ID NO: 1251231 - RNA, 23 nt, Homo sapiens
agguuaucugccuggccuggcuc

SEQ ID NO: 1251232 - RNA, 17 nt, Homo sapiens
agguucaggaagaccac

SEQ ID NO: 1251233 - RNA, 20 nt, Homo sapiens
agguuccuuaucugucacac

SEQ ID NO: 1251234 - RNA, 19 nt, Homo sapiens
agguucuaaaguucuaaga

SEQ ID NO: 1251235 - RNA, 18 nt, Homo sapiens
agguucugagaccagugu

SEQ ID NO: 1251236 - RNA, 12 nt, Homo sapiens
agguucuugaua

SEQ ID NO: 1251237 - RNA, 14 nt, Homo sapiens
agguucuuuccaug

SEQ ID NO: 1251238 - RNA, 22 nt, Homo sapiens
agguugaagaaaggaaccuggg

SEQ ID NO: 1251239 - RNA, 16 nt, Homo sapiens
agguugccugaaaaau

SEQ ID NO: 1251240 - RNA, 16 nt, Homo sapiens
agguuggcaccccagc

SEQ ID NO: 1251241 - RNA, 14 nt, Homo sapiens
agguuggugacuga

SEQ ID NO: 1251242 - RNA, 21 nt, Homo sapiens
agguuggugacugaaacauuc

SEQ ID NO: 1251243 - RNA, 18 nt, Homo sapiens
agguugucugaagucacu

SEQ ID NO: 1251244 - RNA, 21 nt, Homo sapiens
agguugucugaagucacugca

SEQ ID NO: 1251245 - RNA, 23 nt, Homo sapiens
agguugucugaagucacugcaca

SEQ ID NO: 1251246 - RNA, 15 nt, Homo sapiens
agguuuacauuguca

SEQ ID NO: 1251247 - RNA, 17 nt, Homo sapiens
agguuucccccugucuc

SEQ ID NO: 1251248 - RNA, 23 nt, Homo sapiens
agguuugguuugguuuuggacau

SEQ ID NO: 1251249 - RNA, 17 nt, Homo sapiens
agguuuuacacuugcau

SEQ ID NO: 1251250 - RNA, 22 nt, Homo sapiens
aguaaaacucccccccacccaa

SEQ ID NO: 1251251 - RNA, 13 nt, Homo sapiens
aguaaaacuguau

SEQ ID NO: 1251252 - RNA, 16 nt, Homo sapiens
aguaaaacuguauaaa

SEQ ID NO: 1251253 - RNA, 12 nt, Homo sapiens
aguaaacacuug

SEQ ID NO: 1251254 - RNA, 13 nt, Homo sapiens
aguaaaccaaaaa

SEQ ID NO: 1251255 - RNA, 19 nt, Homo sapiens
aguaaacgggaacaugccc

SEQ ID NO: 1251256 - RNA, 16 nt, Homo sapiens
aguaaaggcaaacuua

SEQ ID NO: 1251257 - RNA, 19 nt, Homo sapiens
aguaaaguuguuguaaaaa

SEQ ID NO: 1251258 - RNA, 17 nt, Homo sapiens
aguaaauauuucaggca

SEQ ID NO: 1251259 - RNA, 12 nt, Homo sapiens
aguaaauccaug

SEQ ID NO: 1251260 - RNA, 22 nt, Homo sapiens
aguaaaugcuagguuaauucca

SEQ ID NO: 1251261 - RNA, 18 nt, Homo sapiens
aguaaauuaguaauguac

SEQ ID NO: 1251262 - RNA, 23 nt, Homo sapiens
aguaacaaauaaagugcaguuua

SEQ ID NO: 1251263 - RNA, 22 nt, Homo sapiens
aguaacaugaggggacauuuug

SEQ ID NO: 1251264 - RNA, 12 nt, Homo sapiens
aguaacauuugc

SEQ ID NO: 1251265 - RNA, 13 nt, Homo sapiens
aguaacauuugcc

SEQ ID NO: 1251266 - RNA, 17 nt, Homo sapiens
aguaacgcgucuuccug

SEQ ID NO: 1251267 - RNA, 15 nt, Homo sapiens
aguaacugaaccauu

SEQ ID NO: 1251268 - RNA, 13 nt, Homo sapiens
aguaacugagauu

SEQ ID NO: 1251269 - RNA, 23 nt, Homo sapiens
aguaacugugagaacccaguuuc

SEQ ID NO: 1251270 - RNA, 16 nt, Homo sapiens
aguaagaauaccacau

SEQ ID NO: 1251271 - RNA, 18 nt, Homo sapiens
aguaagagcuggugucug

SEQ ID NO: 1251272 - RNA, 14 nt, Homo sapiens
aguaaggugcaguu

SEQ ID NO: 1251273 - RNA, 20 nt, Homo sapiens
aguaaguaccacucaggcca

SEQ ID NO: 1251274 - RNA, 22 nt, Homo sapiens
aguaaguacuuaauaaacugug

SEQ ID NO: 1251275 - RNA, 23 nt, Homo sapiens
aguaaguacuuaauaaacugugg

SEQ ID NO: 1251276 - RNA, 19 nt, Homo sapiens
aguaaguuuauccaaaucu

SEQ ID NO: 1251277 - RNA, 15 nt, Homo sapiens
aguaauagagcaaaa

SEQ ID NO: 1251278 - RNA, 22 nt, Homo sapiens
aguaauagagcaaaauugaugu

SEQ ID NO: 1251279 - RNA, 14 nt, Homo sapiens
aguaaucuguacau

SEQ ID NO: 1251280 - RNA, 15 nt, Homo sapiens
aguaaugagcaugau

SEQ ID NO: 1251281 - RNA, 23 nt, Homo sapiens
aguaauguugacuguauuuucca

SEQ ID NO: 1251282 - RNA, 15 nt, Homo sapiens
aguaauuaugcacua

SEQ ID NO: 1251283 - RNA, 18 nt, Homo sapiens
aguacaaacacaggauuu

SEQ ID NO: 1251284 - RNA, 14 nt, Homo sapiens
aguacaaugcccag

SEQ ID NO: 1251285 - RNA, 20 nt, Homo sapiens
aguacaauguuaacccuaaa

SEQ ID NO: 1251286 - RNA, 17 nt, Homo sapiens
aguacaccaaccagacc

SEQ ID NO: 1251287 - RNA, 19 nt, Homo sapiens
aguacacccaguugccaaa

SEQ ID NO: 1251288 - RNA, 20 nt, Homo sapiens
aguacacuugguguacuggg

SEQ ID NO: 1251289 - RNA, 10 nt, Homo sapiens
aguacagggg

SEQ ID NO: 1251290 - RNA, 12 nt, Homo sapiens
aguacagucuua

SEQ ID NO: 1251291 - RNA, 19 nt, Homo sapiens
aguaccacacauauugcac

SEQ ID NO: 1251292 - RNA, 14 nt, Homo sapiens
aguaccacacugag

SEQ ID NO: 1251293 - RNA, 18 nt, Homo sapiens
aguaccccccuaccacac

SEQ ID NO: 1251294 - RNA, 22 nt, Homo sapiens
aguaccucuguauagaaaucua

SEQ ID NO: 1251295 - RNA, 14 nt, Homo sapiens
aguaccuucaauac

SEQ ID NO: 1251296 - RNA, 17 nt, Homo sapiens
aguacgaaccuacaguu

SEQ ID NO: 1251297 - RNA, 16 nt, Homo sapiens
aguacuaagggaacaa

SEQ ID NO: 1251298 - RNA, 19 nt, Homo sapiens
aguacuagaugcaucacug

SEQ ID NO: 1251299 - RNA, 22 nt, Homo sapiens
aguacuagaugcaucacugggu

SEQ ID NO: 1251300 - RNA, 14 nt, Homo sapiens
aguacuccaagaca

SEQ ID NO: 1251301 - RNA, 20 nt, Homo sapiens
aguacuccaagacagagaca

SEQ ID NO: 1251302 - RNA, 18 nt, Homo sapiens
aguacuuauguugcacaa

SEQ ID NO: 1251303 - RNA, 17 nt, Homo sapiens
aguacuuggguuugcaa

SEQ ID NO: 1251304 - RNA, 21 nt, Homo sapiens
aguacuugugaaacacagcug

SEQ ID NO: 1251305 - RNA, 17 nt, Homo sapiens
aguagaaagcauaacaa

SEQ ID NO: 1251306 - RNA, 22 nt, Homo sapiens
aguagaaagcauaacaaaaaga

SEQ ID NO: 1251307 - RNA, 22 nt, Homo sapiens
aguagaagauuuuaugcugcug

SEQ ID NO: 1251308 - RNA, 16 nt, Homo sapiens
aguagagacaggguuu

SEQ ID NO: 1251309 - RNA, 15 nt, Homo sapiens
aguagagcauaccac

SEQ ID NO: 1251310 - RNA, 15 nt, Homo sapiens
aguagauccauuucc

SEQ ID NO: 1251311 - RNA, 22 nt, Homo sapiens
aguagaucuauauuagaucaaa

SEQ ID NO: 1251312 - RNA, 20 nt, Homo sapiens
aguagaugcaucuaagcagg

SEQ ID NO: 1251313 - RNA, 14 nt, Homo sapiens
aguaggaugaauca

SEQ ID NO: 1251314 - RNA, 19 nt, Homo sapiens
aguaggcauauaucacuaa

SEQ ID NO: 1251315 - RNA, 17 nt, Homo sapiens
aguaggggcuacuguga

SEQ ID NO: 1251316 - RNA, 18 nt, Homo sapiens
aguaggggcuacugugac

SEQ ID NO: 1251317 - RNA, 13 nt, Homo sapiens
aguagggggagca

SEQ ID NO: 1251318 - RNA, 14 nt, Homo sapiens
aguagggggagcaa

SEQ ID NO: 1251319 - RNA, 13 nt, Homo sapiens
aguaguacuugaa

SEQ ID NO: 1251320 - RNA, 13 nt, Homo sapiens
aguaguagcugaa

SEQ ID NO: 1251321 - RNA, 23 nt, Homo sapiens
aguaguugggauuaccaguagau

SEQ ID NO: 1251322 - RNA, 16 nt, Homo sapiens
aguauaaacaaaguua

SEQ ID NO: 1251323 - RNA, 17 nt, Homo sapiens
aguauaauguuuauuaa

SEQ ID NO: 1251324 - RNA, 12 nt, Homo sapiens
aguauaccucau

SEQ ID NO: 1251325 - RNA, 12 nt, Homo sapiens
aguauacugugu

SEQ ID NO: 1251326 - RNA, 14 nt, Homo sapiens
aguauauauagaau

SEQ ID NO: 1251327 - RNA, 21 nt, Homo sapiens
aguauauuuauagucacaaga

SEQ ID NO: 1251328 - RNA, 16 nt, Homo sapiens
aguaucacacuguaua

SEQ ID NO: 1251329 - RNA, 17 nt, Homo sapiens
aguaucauucuuuacau

SEQ ID NO: 1251330 - RNA, 13 nt, Homo sapiens
aguauccacuuug

SEQ ID NO: 1251331 - RNA, 15 nt, Homo sapiens
aguauccaggcuuug

SEQ ID NO: 1251332 - RNA, 16 nt, Homo sapiens
aguauccaggcuuugu

SEQ ID NO: 1251333 - RNA, 11 nt, Homo sapiens
aguaucuauau

SEQ ID NO: 1251334 - RNA, 19 nt, Homo sapiens
aguaugagucaaugugcag

SEQ ID NO: 1251335 - RNA, 18 nt, Homo sapiens
aguauggcaugaacaucu

SEQ ID NO: 1251336 - RNA, 19 nt, Homo sapiens
aguauuagaugcacuuaag

SEQ ID NO: 1251337 - RNA, 12 nt, Homo sapiens
aguauucacaaa

SEQ ID NO: 1251338 - RNA, 12 nt, Homo sapiens
aguauuccauuu

SEQ ID NO: 1251339 - RNA, 17 nt, Homo sapiens
aguauucuguaccauag

SEQ ID NO: 1251340 - RNA, 12 nt, Homo sapiens
aguauugcuaau

SEQ ID NO: 1251341 - RNA, 16 nt, Homo sapiens
aguauugguguaugua

SEQ ID NO: 1251342 - RNA, 17 nt, Homo sapiens
aguauugucgguuaccu

SEQ ID NO: 1251343 - RNA, 17 nt, Homo sapiens
uucacgaacaugggcau

SEQ ID NO: 1251344 - RNA, 19 nt, Homo sapiens
uucacgggcaaucaugagc

SEQ ID NO: 1251345 - RNA, 21 nt, Homo sapiens
uucacuagaaaagcugaucau

SEQ ID NO: 1251346 - RNA, 17 nt, Homo sapiens
uucacucaagcacugau

SEQ ID NO: 1251347 - RNA, 17 nt, Homo sapiens
uucacugaaagacacca

SEQ ID NO: 1251348 - RNA, 18 nt, Homo sapiens
uucacugcaaccucugcc

SEQ ID NO: 1251349 - RNA, 18 nt, Homo sapiens
uucacuguagaaugauuu

SEQ ID NO: 1251350 - RNA, 20 nt, Homo sapiens
uucacuguagaaugauuuca

SEQ ID NO: 1251351 - RNA, 14 nt, Homo sapiens
uucacuguuucacu

SEQ ID NO: 1251352 - RNA, 18 nt, Homo sapiens
uucacuugaugauacaau

SEQ ID NO: 1251353 - RNA, 16 nt, Homo sapiens
uucacuuguauugacu

SEQ ID NO: 1251354 - RNA, 16 nt, Homo sapiens
uucacuuugugauuau

SEQ ID NO: 1251355 - RNA, 18 nt, Homo sapiens
uucagaaccauccauagu

SEQ ID NO: 1251356 - RNA, 14 nt, Homo sapiens
uucagaagacacug

SEQ ID NO: 1251357 - RNA, 15 nt, Homo sapiens
uucagaagacacugc

SEQ ID NO: 1251358 - RNA, 17 nt, Homo sapiens
uucagaagagaugggcu

SEQ ID NO: 1251359 - RNA, 17 nt, Homo sapiens
uucagaagguugcucua

SEQ ID NO: 1251360 - RNA, 23 nt, Homo sapiens
uucagaauguacggaaagaugau

SEQ ID NO: 1251361 - RNA, 14 nt, Homo sapiens
uucagacaccuguu

SEQ ID NO: 1251362 - RNA, 17 nt, Homo sapiens
uucagaccaaugcucaa

SEQ ID NO: 1251363 - RNA, 13 nt, Homo sapiens
uucagacucucag

SEQ ID NO: 1251364 - RNA, 23 nt, Homo sapiens
ugcacaugucuuguacaugugua

SEQ ID NO: 1251365 - RNA, 11 nt, Homo sapiens
ugcaccaaaga

SEQ ID NO: 1251366 - RNA, 18 nt, Homo sapiens
ugcaccaaagacaucagu

SEQ ID NO: 1251367 - RNA, 17 nt, Homo sapiens
ugcaccaccaagccaag

SEQ ID NO: 1251368 - RNA, 21 nt, Homo sapiens
ugcacccaacuacugagcuga

SEQ ID NO: 1251369 - RNA, 18 nt, Homo sapiens
ugcaccccaccagcaaua

SEQ ID NO: 1251370 - RNA, 14 nt, Homo sapiens
ugcaccguccucag

SEQ ID NO: 1251371 - RNA, 22 nt, Homo sapiens
ugcaccuacugcuuacuguugc

SEQ ID NO: 1251372 - RNA, 24 nt, Homo sapiens
ugcaccuagcugugcaagaccuag

SEQ ID NO: 1251373 - RNA, 14 nt, Homo sapiens
ugcaccuggaugua

SEQ ID NO: 1251374 - RNA, 18 nt, Homo sapiens
ugcaccuguacucaggag

SEQ ID NO: 1251375 - RNA, 21 nt, Homo sapiens
ugcaccuguccccacccucca

SEQ ID NO: 1251376 - RNA, 21 nt, Homo sapiens
ugcaccuugugucuguacacg

SEQ ID NO: 1251377 - RNA, 14 nt, Homo sapiens
ugcacgaucucagu

SEQ ID NO: 1251378 - RNA, 14 nt, Homo sapiens
ugcacuaacagagu

SEQ ID NO: 1251379 - RNA, 16 nt, Homo sapiens
ugcacuaugagccuau

SEQ ID NO: 1251380 - RNA, 17 nt, Homo sapiens
ugcacucaccucacugu

SEQ ID NO: 1251381 - RNA, 15 nt, Homo sapiens
ugcacucccaccuga

SEQ ID NO: 1251382 - RNA, 23 nt, Homo sapiens
ugcacucuaaaagguucagggaa

SEQ ID NO: 1251383 - RNA, 16 nt, Homo sapiens
ugcacugaaguuuuug

SEQ ID NO: 1251384 - RNA, 16 nt, Homo sapiens
ugcacugccagcaucu

SEQ ID NO: 1251385 - RNA, 15 nt, Homo sapiens
ugcacugcccuguuc

SEQ ID NO: 1251386 - RNA, 11 nt, Homo sapiens
ugcacugcugu

SEQ ID NO: 1251387 - RNA, 23 nt, Homo sapiens
ugcacuggaaccauugcuuuacu

SEQ ID NO: 1251388 - RNA, 22 nt, Homo sapiens
ugcacuggggagcccgucucag

SEQ ID NO: 1251389 - RNA, 15 nt, Homo sapiens
ugcacuguccugacc

SEQ ID NO: 1251390 - RNA, 17 nt, Homo sapiens
ugcacuguccugaccau

SEQ ID NO: 1251391 - RNA, 22 nt, Homo sapiens
ugcacuguccugaccaucgcac

SEQ ID NO: 1251392 - RNA, 21 nt, Homo sapiens
ugcacugucgauaaucagaga

SEQ ID NO: 1251393 - RNA, 13 nt, Homo sapiens
ugcacuuacauaa

SEQ ID NO: 1251394 - RNA, 22 nt, Homo sapiens
ugcacuuauaagaaagaucaaa

SEQ ID NO: 1251395 - RNA, 18 nt, Homo sapiens
ugcacuuuuaaaccucuc

SEQ ID NO: 1251396 - RNA, 21 nt, Homo sapiens
ugcagaaaauucugugccuug

SEQ ID NO: 1251397 - RNA, 17 nt, Homo sapiens
ugcagaaggaaagaagg

SEQ ID NO: 1251398 - RNA, 16 nt, Homo sapiens
ugcagaaguacuccua

SEQ ID NO: 1251399 - RNA, 21 nt, Homo sapiens
ugcagaauacaguaagcugcu

SEQ ID NO: 1251400 - RNA, 17 nt, Homo sapiens
ugcagaauccaaaguaa

SEQ ID NO: 1251401 - RNA, 18 nt, Homo sapiens
ugcagaauccaaaguaaa

SEQ ID NO: 1251402 - RNA, 19 nt, Homo sapiens
ugcagaauugagagugauu

SEQ ID NO: 1251403 - RNA, 12 nt, Homo sapiens
ugcagacuguuc

SEQ ID NO: 1251404 - RNA, 20 nt, Homo sapiens
ugcagacuguucuuacugua

SEQ ID NO: 1251405 - RNA, 14 nt, Homo sapiens
ugcagagaugacug

SEQ ID NO: 1251406 - RNA, 21 nt, Homo sapiens
ugcagagcgccgugaguucuc

SEQ ID NO: 1251407 - RNA, 21 nt, Homo sapiens
ugcagaggauaaggaggcacu

SEQ ID NO: 1251408 - RNA, 16 nt, Homo sapiens
ugcagagggacagaug

SEQ ID NO: 1251409 - RNA, 22 nt, Homo sapiens
ugcagaggggaaagacuuccau

SEQ ID NO: 1251410 - RNA, 21 nt, Homo sapiens
ugcagaugccacccuagccaa

SEQ ID NO: 1251411 - RNA, 23 nt, Homo sapiens
ugcagcacggacaauaaaccucc

SEQ ID NO: 1251412 - RNA, 12 nt, Homo sapiens
ugcagcaggaac

SEQ ID NO: 1251413 - RNA, 15 nt, Homo sapiens
ugcagcccaugccca

SEQ ID NO: 1251414 - RNA, 15 nt, Homo sapiens
ugcagcucuccacca

SEQ ID NO: 1251415 - RNA, 23 nt, Homo sapiens
ugcagcugggccccaugcucugc

SEQ ID NO: 1251416 - RNA, 17 nt, Homo sapiens
ugcaggcaagugggaua

SEQ ID NO: 1251417 - RNA, 13 nt, Homo sapiens
ugcagggacucca

SEQ ID NO: 1251418 - RNA, 12 nt, Homo sapiens
ugcagggguccc

SEQ ID NO: 1251419 - RNA, 21 nt, Homo sapiens
ugcaggggugacggcccucau

SEQ ID NO: 1251420 - RNA, 16 nt, Homo sapiens
ugcaggugacauuugc

SEQ ID NO: 1251421 - RNA, 22 nt, Homo sapiens
ugcagguuccuuaucugucaca

SEQ ID NO: 1251422 - RNA, 20 nt, Homo sapiens
ugcaguacaacaguuuuaga

SEQ ID NO: 1251423 - RNA, 22 nt, Homo sapiens
ugcaguagagucaucuccauca

SEQ ID NO: 1251424 - RNA, 20 nt, Homo sapiens
ugcaguaggggcuacuguga

SEQ ID NO: 1251425 - RNA, 13 nt, Homo sapiens
ugcaguaguauuu

SEQ ID NO: 1251426 - RNA, 14 nt, Homo sapiens
ugcagucacuggag

SEQ ID NO: 1251427 - RNA, 20 nt, Homo sapiens
ugcagucggugguaccugag

SEQ ID NO: 1251428 - RNA, 21 nt, Homo sapiens
ugcagucggugguaccugaga

SEQ ID NO: 1251429 - RNA, 22 nt, Homo sapiens
ugcagucggugguaccugagau

SEQ ID NO: 1251430 - RNA, 17 nt, Homo sapiens
ugcagugacagcuugag

SEQ ID NO: 1251431 - RNA, 20 nt, Homo sapiens
uuaacugugaaauaccacaa

SEQ ID NO: 1251432 - RNA, 22 nt, Homo sapiens
uuaacugugaaauaccacaagc

SEQ ID NO: 1251433 - RNA, 21 nt, Homo sapiens
uuaacuuccaauuuacauacu

SEQ ID NO: 1251434 - RNA, 13 nt, Homo sapiens
uuaagaaaauaca

SEQ ID NO: 1251435 - RNA, 15 nt, Homo sapiens
uuaagaaacacaggg

SEQ ID NO: 1251436 - RNA, 22 nt, Homo sapiens
uuaagaaacacaggguuuugua

SEQ ID NO: 1251437 - RNA, 19 nt, Homo sapiens
uuaagaacaaacucugaaa

SEQ ID NO: 1251438 - RNA, 21 nt, Homo sapiens
uuaagaacaucaaaacuaacc

SEQ ID NO: 1251439 - RNA, 22 nt, Homo sapiens
uuaagaaugucgauuaaaauca

SEQ ID NO: 1251440 - RNA, 19 nt, Homo sapiens
uuaagaauguugguuuacu

SEQ ID NO: 1251441 - RNA, 17 nt, Homo sapiens
uuaagacaguguacaaa

SEQ ID NO: 1251442 - RNA, 14 nt, Homo sapiens
uuaagagacacucc

SEQ ID NO: 1251443 - RNA, 14 nt, Homo sapiens
uuaagaguccaaga

SEQ ID NO: 1251444 - RNA, 21 nt, Homo sapiens
uuaagauuuuacaaaagagga

SEQ ID NO: 1251445 - RNA, 20 nt, Homo sapiens
uuaagcagauggaaugcugu

SEQ ID NO: 1251446 - RNA, 18 nt, Homo sapiens
uuaagccuaaaugccuua

SEQ ID NO: 1251447 - RNA, 16 nt, Homo sapiens
uuaagccucaguuaua

SEQ ID NO: 1251448 - RNA, 18 nt, Homo sapiens
uuaagccuuauaaaccaa

SEQ ID NO: 1251449 - RNA, 19 nt, Homo sapiens
uuaagcugggauaaucaca

SEQ ID NO: 1251450 - RNA, 13 nt, Homo sapiens
uuaaggcacagug

SEQ ID NO: 1251451 - RNA, 15 nt, Homo sapiens
uuaaggggaagaaug

SEQ ID NO: 1251452 - RNA, 18 nt, Homo sapiens
uuaaggugaaccaaagaa

SEQ ID NO: 1251453 - RNA, 22 nt, Homo sapiens
uuaaguagaaaaguugcagaug

SEQ ID NO: 1251454 - RNA, 22 nt, Homo sapiens
uuaaguaguccuccuguaucua

SEQ ID NO: 1251455 - RNA, 20 nt, Homo sapiens
uuaaguuauugauguuuuaa

SEQ ID NO: 1251456 - RNA, 15 nt, Homo sapiens
uuaaguucacaaccu

SEQ ID NO: 1251457 - RNA, 15 nt, Homo sapiens
uuaaguuuaucuuuc

SEQ ID NO: 1251458 - RNA, 13 nt, Homo sapiens
uuaauaaauugcu

SEQ ID NO: 1251459 - RNA, 13 nt, Homo sapiens
uuaauaacagcuc

SEQ ID NO: 1251460 - RNA, 23 nt, Homo sapiens
uuaauaauaaucuaggcaugaag

SEQ ID NO: 1251461 - RNA, 15 nt, Homo sapiens
uuaauaaucucaugc

SEQ ID NO: 1251462 - RNA, 19 nt, Homo sapiens
uuaauacucaaaugaguaa

SEQ ID NO: 1251463 - RNA, 12 nt, Homo sapiens
uuaauagacuga

SEQ ID NO: 1251464 - RNA, 18 nt, Homo sapiens
uuaauagggaauauaucu

SEQ ID NO: 1251465 - RNA, 18 nt, Homo sapiens
uuaauauauaguccagac

SEQ ID NO: 1251466 - RNA, 14 nt, Homo sapiens
uuaauauaucccag

SEQ ID NO: 1251467 - RNA, 19 nt, Homo sapiens
uuaauaucccuacauguau

SEQ ID NO: 1251468 - RNA, 13 nt, Homo sapiens
uuaauaucuucac

SEQ ID NO: 1251469 - RNA, 23 nt, Homo sapiens
uuaauauguuaaccucaguguca

SEQ ID NO: 1251470 - RNA, 20 nt, Homo sapiens
uuaauauuuuuccacuuaaa

SEQ ID NO: 1251471 - RNA, 14 nt, Homo sapiens
uuaaucacugcauu

SEQ ID NO: 1251472 - RNA, 21 nt, Homo sapiens
uuaaucucugcugaaacucag

SEQ ID NO: 1251473 - RNA, 13 nt, Homo sapiens
uuaaugaacuaac

SEQ ID NO: 1251474 - RNA, 14 nt, Homo sapiens
uuaaugacucuuuc

SEQ ID NO: 1251475 - RNA, 17 nt, Homo sapiens
uuaaugagccaucacua

SEQ ID NO: 1251476 - RNA, 19 nt, Homo sapiens
uuaaugccacaaaacugac

SEQ ID NO: 1251477 - RNA, 14 nt, Homo sapiens
uuaauggcacugau

SEQ ID NO: 1251478 - RNA, 21 nt, Homo sapiens
uuaauggcagcuagugccuuu

SEQ ID NO: 1251479 - RNA, 16 nt, Homo sapiens
uuaauggcuaguacug

SEQ ID NO: 1251480 - RNA, 18 nt, Homo sapiens
uuaauggggauuccacua

SEQ ID NO: 1251481 - RNA, 17 nt, Homo sapiens
uuaaugucuggugcuuu

SEQ ID NO: 1251482 - RNA, 12 nt, Homo sapiens
uuaaugugaugg

SEQ ID NO: 1251483 - RNA, 17 nt, Homo sapiens
uuaauguuauaucauau

SEQ ID NO: 1251484 - RNA, 13 nt, Homo sapiens
uuaauuaagcaaa

SEQ ID NO: 1251485 - RNA, 16 nt, Homo sapiens
uuaauuaaguaucugg

SEQ ID NO: 1251486 - RNA, 18 nt, Homo sapiens
uuaauuagggguugcuaa

SEQ ID NO: 1251487 - RNA, 19 nt, Homo sapiens
uuaauucucuuucaaagcu

SEQ ID NO: 1251488 - RNA, 13 nt, Homo sapiens
uuaauugucaugg

SEQ ID NO: 1251489 - RNA, 24 nt, Homo sapiens
uuaauuuacagaaaucaaugguag

SEQ ID NO: 1251490 - RNA, 16 nt, Homo sapiens
uuaauuugcacagugu

SEQ ID NO: 1251491 - RNA, 22 nt, Homo sapiens
uuaauuuuuaaggauguugcca

SEQ ID NO: 1251492 - RNA, 18 nt, Homo sapiens
uuaauuuuuauuucuucc

SEQ ID NO: 1251493 - RNA, 17 nt, Homo sapiens
uuacaaaaaaauacaaa

SEQ ID NO: 1251494 - RNA, 24 nt, Homo sapiens
uuacaaagggccaucguucaucca

SEQ ID NO: 1251495 - RNA, 14 nt, Homo sapiens
uuacaaauggugaa

SEQ ID NO: 1251496 - RNA, 19 nt, Homo sapiens
uuacaacuuguauuuccaa

SEQ ID NO: 1251497 - RNA, 13 nt, Homo sapiens
uuacaauugugag

SEQ ID NO: 1251498 - RNA, 11 nt, Homo sapiens
uuacacaggag

SEQ ID NO: 1251499 - RNA, 22 nt, Homo sapiens
uuacaccaguuugacugugcua

SEQ ID NO: 1251500 - RNA, 15 nt, Homo sapiens
uuacacguaccucuc

SEQ ID NO: 1251501 - RNA, 22 nt, Homo sapiens
uuacacugccuguauacuuuag

SEQ ID NO: 1251502 - RNA, 14 nt, Homo sapiens
uuacagaaacugca

SEQ ID NO: 1251503 - RNA, 19 nt, Homo sapiens
uuacagaagugaaagugag

SEQ ID NO: 1251504 - RNA, 17 nt, Homo sapiens
uuacagacaugaacugc

SEQ ID NO: 1251505 - RNA, 21 nt, Homo sapiens
uuacagagaggagaaacacau

SEQ ID NO: 1251506 - RNA, 16 nt, Homo sapiens
uuacagggugacucac

SEQ ID NO: 1251507 - RNA, 11 nt, Homo sapiens
uuacaguucug

SEQ ID NO: 1251508 - RNA, 18 nt, Homo sapiens
uuacauagguauauauau

SEQ ID NO: 1251509 - RNA, 21 nt, Homo sapiens
uuaccaaagagauauugauau

SEQ ID NO: 1251510 - RNA, 19 nt, Homo sapiens
uuaccaaagcaucaauaca

SEQ ID NO: 1251511 - RNA, 20 nt, Homo sapiens
uuaccaaagcaucaauacaa

SEQ ID NO: 1251512 - RNA, 19 nt, Homo sapiens
uuaccaacuuucuguaaac

SEQ ID NO: 1251513 - RNA, 22 nt, Homo sapiens
uuaccagaugcugacuggcacu

SEQ ID NO: 1251514 - RNA, 14 nt, Homo sapiens
uuaccagcaagaau

SEQ ID NO: 1251515 - RNA, 20 nt, Homo sapiens
uuaccagguccauuuugccu

SEQ ID NO: 1251516 - RNA, 15 nt, Homo sapiens
uuaccaggugagaag

SEQ ID NO: 1251517 - RNA, 14 nt, Homo sapiens
uuaccuaaacagau

SEQ ID NO: 1251518 - RNA, 17 nt, Homo sapiens
uuaccuaguuugcacua

SEQ ID NO: 1251519 - RNA, 13 nt, Homo sapiens
uuaccugacacaa

SEQ ID NO: 1251520 - RNA, 20 nt, Homo sapiens
uuacuaaacauaugauuuca

SEQ ID NO: 1251521 - RNA, 22 nt, Homo sapiens
uuacuaaagguuuuaaccgcac

SEQ ID NO: 1251522 - RNA, 22 nt, Homo sapiens
uuacuaacacgcauuguacacu

SEQ ID NO: 1251523 - RNA, 16 nt, Homo sapiens
uuacuauaauuugacu

SEQ ID NO: 1251524 - RNA, 16 nt, Homo sapiens
uuacuaucauggcaua

SEQ ID NO: 1251525 - RNA, 18 nt, Homo sapiens
ugagaagccuucagcucc

SEQ ID NO: 1251526 - RNA, 14 nt, Homo sapiens
ugagaaggugcuuu

SEQ ID NO: 1251527 - RNA, 13 nt, Homo sapiens
ugagaagugcacu

SEQ ID NO: 1251528 - RNA, 18 nt, Homo sapiens
ugagaauauuaauugugg

SEQ ID NO: 1251529 - RNA, 15 nt, Homo sapiens
ugagaaucaugcacu

SEQ ID NO: 1251530 - RNA, 15 nt, Homo sapiens
ugagaauguggaaua

SEQ ID NO: 1251531 - RNA, 20 nt, Homo sapiens
ugagaauguggaauaccuaa

SEQ ID NO: 1251532 - RNA, 13 nt, Homo sapiens
ugagaauuggaga

SEQ ID NO: 1251533 - RNA, 23 nt, Homo sapiens
ugagacaggagaccuggcacugg

SEQ ID NO: 1251534 - RNA, 21 nt, Homo sapiens
ugagacaggaggauugccuga

SEQ ID NO: 1251535 - RNA, 16 nt, Homo sapiens
ugagacauugugaaaa

SEQ ID NO: 1251536 - RNA, 14 nt, Homo sapiens
ugagacauuuacau

SEQ ID NO: 1251537 - RNA, 17 nt, Homo sapiens
ugagaccacuguuauca

SEQ ID NO: 1251538 - RNA, 22 nt, Homo sapiens
ugagaccgagggaagggcucag

SEQ ID NO: 1251539 - RNA, 22 nt, Homo sapiens
ugagaccuugucuccacaaaaa

SEQ ID NO: 1251540 - RNA, 22 nt, Homo sapiens
ugagacuacaagugugugccac

SEQ ID NO: 1251541 - RNA, 17 nt, Homo sapiens
ugagacucuagggucca

SEQ ID NO: 1251542 - RNA, 16 nt, Homo sapiens
ugagacugaacugugu

SEQ ID NO: 1251543 - RNA, 12 nt, Homo sapiens
ugagacuggagc

SEQ ID NO: 1251544 - RNA, 22 nt, Homo sapiens
ugagagaaagagagaagccagc

SEQ ID NO: 1251545 - RNA, 18 nt, Homo sapiens
ugagagaauaaaaacuuc

SEQ ID NO: 1251546 - RNA, 23 nt, Homo sapiens
ugagaggaugaauguaugugcac

SEQ ID NO: 1251547 - RNA, 19 nt, Homo sapiens
ugagagggcugcugaccau

SEQ ID NO: 1251548 - RNA, 21 nt, Homo sapiens
ugagauacaagucauccaugc

SEQ ID NO: 1251549 - RNA, 14 nt, Homo sapiens
ugagaucccgacaa

SEQ ID NO: 1251550 - RNA, 23 nt, Homo sapiens
ugagaucuaaggaugucacaggg

SEQ ID NO: 1251551 - RNA, 20 nt, Homo sapiens
ugagaugcuucuggcuccca

SEQ ID NO: 1251552 - RNA, 21 nt, Homo sapiens
ugagauucagaugucauuuag

SEQ ID NO: 1251553 - RNA, 20 nt, Homo sapiens
ugagauuuccuccuggccuu

SEQ ID NO: 1251554 - RNA, 21 nt, Homo sapiens
ugagauuuccuccuggccuuu

SEQ ID NO: 1251555 - RNA, 14 nt, Homo sapiens
ugagcaaaggugau

SEQ ID NO: 1251556 - RNA, 12 nt, Homo sapiens
ugagcaacucuu

SEQ ID NO: 1251557 - RNA, 23 nt, Homo sapiens
ugagcaauggaguggcugccaug

SEQ ID NO: 1251558 - RNA, 17 nt, Homo sapiens
ugagcaccgucauggcu

SEQ ID NO: 1251559 - RNA, 15 nt, Homo sapiens
ugagcagagacauga

SEQ ID NO: 1251560 - RNA, 15 nt, Homo sapiens
ugagcauaccugucu

SEQ ID NO: 1251561 - RNA, 17 nt, Homo sapiens
ugagcauuuuuaaggga

SEQ ID NO: 1251562 - RNA, 19 nt, Homo sapiens
ugagccaaagagaaugcca

SEQ ID NO: 1251563 - RNA, 22 nt, Homo sapiens
ugagccaaagcuuaugugacau

SEQ ID NO: 1251564 - RNA, 14 nt, Homo sapiens
ugagccgcugugag

SEQ ID NO: 1251565 - RNA, 14 nt, Homo sapiens
ugagcgcauggcaa

SEQ ID NO: 1251566 - RNA, 16 nt, Homo sapiens
ugagcgccugugcaca

SEQ ID NO: 1251567 - RNA, 13 nt, Homo sapiens
ugagcuacuucaa

SEQ ID NO: 1251568 - RNA, 14 nt, Homo sapiens
ugagcuacuucaaa

SEQ ID NO: 1251569 - RNA, 20 nt, Homo sapiens
ugagcuacuucaaauguggu

SEQ ID NO: 1251570 - RNA, 21 nt, Homo sapiens
ugagcuauugcuguucucuug

SEQ ID NO: 1251571 - RNA, 18 nt, Homo sapiens
ugagcuccccagaucucc

SEQ ID NO: 1251572 - RNA, 15 nt, Homo sapiens
ugagcugagaccacu

SEQ ID NO: 1251573 - RNA, 17 nt, Homo sapiens
ugagcugagaccacuga

SEQ ID NO: 1251574 - RNA, 21 nt, Homo sapiens
ugagcuggccucucuagcaca

SEQ ID NO: 1251575 - RNA, 14 nt, Homo sapiens
ugagcuggggacuc

SEQ ID NO: 1251576 - RNA, 18 nt, Homo sapiens
ugagcuuucuuugcacuu

SEQ ID NO: 1251577 - RNA, 17 nt, Homo sapiens
ugaggaaaaaacccagc

SEQ ID NO: 1251578 - RNA, 18 nt, Homo sapiens
ugaggaaagcacacaguc

SEQ ID NO: 1251579 - RNA, 18 nt, Homo sapiens
ugaggacaagauaccaag

SEQ ID NO: 1251580 - RNA, 22 nt, Homo sapiens
ugaggacccgugugacucgcca

SEQ ID NO: 1251581 - RNA, 15 nt, Homo sapiens
ugaggacgcaccgcc

SEQ ID NO: 1251582 - RNA, 15 nt, Homo sapiens
ugaggacugauuuca

SEQ ID NO: 1251583 - RNA, 18 nt, Homo sapiens
ugaggaggguacuuuucc

SEQ ID NO: 1251584 - RNA, 13 nt, Homo sapiens
ugaggagugccag

SEQ ID NO: 1251585 - RNA, 14 nt, Homo sapiens
ugaggauugcugau

SEQ ID NO: 1251586 - RNA, 12 nt, Homo sapiens
ugaggauuucaa

SEQ ID NO: 1251587 - RNA, 13 nt, Homo sapiens
ugaggauuucaag

SEQ ID NO: 1251588 - RNA, 20 nt, Homo sapiens
ugaggauuuugauccaagcu

SEQ ID NO: 1251589 - RNA, 18 nt, Homo sapiens
ugaggcaagagaauuacu

SEQ ID NO: 1251590 - RNA, 14 nt, Homo sapiens
ugaggcaauaaaaa

SEQ ID NO: 1251591 - RNA, 11 nt, Homo sapiens
ugaggcccaag

SEQ ID NO: 1251592 - RNA, 16 nt, Homo sapiens
ugaggcccauucuuca

SEQ ID NO: 1251593 - RNA, 19 nt, Homo sapiens
ugaggccgggcgcaguggc

SEQ ID NO: 1251594 - RNA, 18 nt, Homo sapiens
ugaggccuagacucuguc

SEQ ID NO: 1251595 - RNA, 16 nt, Homo sapiens
ugaggcggagaauugc

SEQ ID NO: 1251596 - RNA, 23 nt, Homo sapiens
ugaggcugggcgucuaugcugcu

SEQ ID NO: 1251597 - RNA, 14 nt, Homo sapiens
ugaggcugucacag

SEQ ID NO: 1251598 - RNA, 15 nt, Homo sapiens
ugaggcuucucagcc

SEQ ID NO: 1251599 - RNA, 17 nt, Homo sapiens
ugaggcuucuccuucuc

SEQ ID NO: 1251600 - RNA, 23 nt, Homo sapiens
uccccuuuacuaucauucucagu

SEQ ID NO: 1251601 - RNA, 16 nt, Homo sapiens
uccccuuuuucuuccu

SEQ ID NO: 1251602 - RNA, 13 nt, Homo sapiens
ucccgaagccacc

SEQ ID NO: 1251603 - RNA, 14 nt, Homo sapiens
ucccgaauccacag

SEQ ID NO: 1251604 - RNA, 19 nt, Homo sapiens
ucccgaguaacugagauua

SEQ ID NO: 1251605 - RNA, 20 nt, Homo sapiens
ucccgaguaacugagauuac

SEQ ID NO: 1251606 - RNA, 20 nt, Homo sapiens
ucccgaguagcugggauuac

SEQ ID NO: 1251607 - RNA, 14 nt, Homo sapiens
ucccgcagggcuga

SEQ ID NO: 1251608 - RNA, 20 nt, Homo sapiens
ucccggcgucccuaccuccu

SEQ ID NO: 1251609 - RNA, 18 nt, Homo sapiens
ucccggggcuccacugaa

SEQ ID NO: 1251610 - RNA, 21 nt, Homo sapiens
ucccuaccccauuugugguca

SEQ ID NO: 1251611 - RNA, 22 nt, Homo sapiens
ucccuagauagcuauuaagaua

SEQ ID NO: 1251612 - RNA, 13 nt, Homo sapiens
ucccuagccagag

SEQ ID NO: 1251613 - RNA, 22 nt, Homo sapiens
ucccucaaaugcgcgugugcac

SEQ ID NO: 1251614 - RNA, 18 nt, Homo sapiens
ucccucacuguugaauuu

SEQ ID NO: 1251615 - RNA, 18 nt, Homo sapiens
ucccucauccuuucaggu

SEQ ID NO: 1251616 - RNA, 22 nt, Homo sapiens
ucccuccccuccccguccacag

SEQ ID NO: 1251617 - RNA, 16 nt, Homo sapiens
ucccuccccugccauu

SEQ ID NO: 1251618 - RNA, 23 nt, Homo sapiens
ucccucucagaggccugcugcca

SEQ ID NO: 1251619 - RNA, 21 nt, Homo sapiens
ucccucucaugacuugcaggg

SEQ ID NO: 1251620 - RNA, 20 nt, Homo sapiens
ucccucucccggcaacaucu

SEQ ID NO: 1251621 - RNA, 17 nt, Homo sapiens
ucccucugugucugcuc

SEQ ID NO: 1251622 - RNA, 18 nt, Homo sapiens
ucacugcuggcugccuua

SEQ ID NO: 1251623 - RNA, 13 nt, Homo sapiens
ucacuggaugaaa

SEQ ID NO: 1251624 - RNA, 16 nt, Homo sapiens
ucacuggcuggccuga

SEQ ID NO: 1251625 - RNA, 16 nt, Homo sapiens
ucacugucaucuucaa

SEQ ID NO: 1251626 - RNA, 23 nt, Homo sapiens
ucacuguccuccacacaagggaa

SEQ ID NO: 1251627 - RNA, 22 nt, Homo sapiens
ucacugucuuuaauucuguauc

SEQ ID NO: 1251628 - RNA, 23 nt, Homo sapiens
ucacuguggaagaaauuccuucc

SEQ ID NO: 1251629 - RNA, 23 nt, Homo sapiens
ucacuuaaagcccgccugacaga

SEQ ID NO: 1251630 - RNA, 13 nt, Homo sapiens
ucacuucaguugc

SEQ ID NO: 1251631 - RNA, 21 nt, Homo sapiens
ucacuuccacacaauuauuua

SEQ ID NO: 1251632 - RNA, 13 nt, Homo sapiens
ucacuuccaugac

SEQ ID NO: 1251633 - RNA, 18 nt, Homo sapiens
ucacuucccuacauggag

SEQ ID NO: 1251634 - RNA, 16 nt, Homo sapiens
ucacuuggccaguuuc

SEQ ID NO: 1251635 - RNA, 13 nt, Homo sapiens
ucagaaaccugca

SEQ ID NO: 1251636 - RNA, 20 nt, Homo sapiens
ucagaaauaugacaauuaau

SEQ ID NO: 1251637 - RNA, 18 nt, Homo sapiens
ucagaaaugcugucauaa

SEQ ID NO: 1251638 - RNA, 22 nt, Homo sapiens
ucagaagacacugaugggcaac

SEQ ID NO: 1251639 - RNA, 22 nt, Homo sapiens
ucagaagagguugggcuuccau

SEQ ID NO: 1251640 - RNA, 23 nt, Homo sapiens
ucagaagcaucgcuccucuccag

SEQ ID NO: 1251641 - RNA, 20 nt, Homo sapiens
ucagaauaaauuauugcugu

SEQ ID NO: 1251642 - RNA, 21 nt, Homo sapiens
ucagaauaaggcaggcauuga

SEQ ID NO: 1251643 - RNA, 16 nt, Homo sapiens
ucagaauauacccauc

SEQ ID NO: 1251644 - RNA, 16 nt, Homo sapiens
ucagaaugcuauugaa

SEQ ID NO: 1251645 - RNA, 17 nt, Homo sapiens
ucagacucccgcgugaa

SEQ ID NO: 1251646 - RNA, 23 nt, Homo sapiens
ucagacuuggaguaaaacuguau

SEQ ID NO: 1251647 - RNA, 15 nt, Homo sapiens
ucagagaacuuuccc

SEQ ID NO: 1251648 - RNA, 16 nt, Homo sapiens
ucagagaccugaagug

SEQ ID NO: 1251649 - RNA, 14 nt, Homo sapiens
ucagagccagugaa

SEQ ID NO: 1251650 - RNA, 14 nt, Homo sapiens
ucagaggagcugca

SEQ ID NO: 1251651 - RNA, 14 nt, Homo sapiens
ucagaggccuauaa

SEQ ID NO: 1251652 - RNA, 22 nt, Homo sapiens
ucagagguuugcuuccucagua

SEQ ID NO: 1251653 - RNA, 15 nt, Homo sapiens
ucagaguaucuuuac

SEQ ID NO: 1251654 - RNA, 16 nt, Homo sapiens
ucagaguccuugcaaa

SEQ ID NO: 1251655 - RNA, 12 nt, Homo sapiens
ucagagugccac

SEQ ID NO: 1251656 - RNA, 22 nt, Homo sapiens
ucagaguugcugcaaaccugac

SEQ ID NO: 1251657 - RNA, 21 nt, Homo sapiens
ucagaguuuguguguauuugu

SEQ ID NO: 1251658 - RNA, 22 nt, Homo sapiens
ucagaguuuguguguauuugua

SEQ ID NO: 1251659 - RNA, 16 nt, Homo sapiens
ucagaucugaacacag

SEQ ID NO: 1251660 - RNA, 20 nt, Homo sapiens
ucagaucugaacacaguuua

SEQ ID NO: 1251661 - RNA, 14 nt, Homo sapiens
ucagaucugagguu

SEQ ID NO: 1251662 - RNA, 19 nt, Homo sapiens
ucagauggagguucucaga

SEQ ID NO: 1251663 - RNA, 18 nt, Homo sapiens
ucagauuguuaucuauca

SEQ ID NO: 1251664 - RNA, 20 nt, Homo sapiens
ucagauuguuaucuaucaac

SEQ ID NO: 1251665 - RNA, 21 nt, Homo sapiens
ucagauuuuuuccucugcauu

SEQ ID NO: 1251666 - RNA, 18 nt, Homo sapiens
ucagcaaccugacucagg

SEQ ID NO: 1251667 - RNA, 16 nt, Homo sapiens
ucagcaacucgcuuua

SEQ ID NO: 1251668 - RNA, 17 nt, Homo sapiens
ucagcaauacuaaggga

SEQ ID NO: 1251669 - RNA, 18 nt, Homo sapiens
ucagcaauacucaucaga

SEQ ID NO: 1251670 - RNA, 11 nt, Homo sapiens
ucagcaauucc

SEQ ID NO: 1251671 - RNA, 12 nt, Homo sapiens
ucagcacaaaga

SEQ ID NO: 1251672 - RNA, 21 nt, Homo sapiens
ucagcacugucccuugccuca

SEQ ID NO: 1251673 - RNA, 15 nt, Homo sapiens
ucagcagcaggguuu

SEQ ID NO: 1251674 - RNA, 16 nt, Homo sapiens
ucagcagugaaguaua

SEQ ID NO: 1251675 - RNA, 22 nt, Homo sapiens
ucagcauccagguuuaugaaug

SEQ ID NO: 1251676 - RNA, 15 nt, Homo sapiens
ucagcaucugugaug

SEQ ID NO: 1251677 - RNA, 23 nt, Homo sapiens
ucagcaugauguguuguguauaa

SEQ ID NO: 1251678 - RNA, 15 nt, Homo sapiens
ucagcauuauuccuc

SEQ ID NO: 1251679 - RNA, 18 nt, Homo sapiens
ucagcauucucacuccua

SEQ ID NO: 1251680 - RNA, 15 nt, Homo sapiens
ucagcauugugacac

SEQ ID NO: 1251681 - RNA, 19 nt, Homo sapiens
ucagcauuuccacaccaag

SEQ ID NO: 1251682 - RNA, 23 nt, Homo sapiens
ucagcauuuucuucucugcacuu

SEQ ID NO: 1251683 - RNA, 15 nt, Homo sapiens
ucagccaagcuuguu

SEQ ID NO: 1251684 - RNA, 16 nt, Homo sapiens
ucagccaggcugcuaa

SEQ ID NO: 1251685 - RNA, 21 nt, Homo sapiens
ucagccaggcugcuaaccugg

SEQ ID NO: 1251686 - RNA, 20 nt, Homo sapiens
ucagccaugaaacugacuca

SEQ ID NO: 1251687 - RNA, 23 nt, Homo sapiens
ucagcccccagccccucccccau

SEQ ID NO: 1251688 - RNA, 17 nt, Homo sapiens
ucagccccucacauucc

SEQ ID NO: 1251689 - RNA, 13 nt, Homo sapiens
ucagcccucagaa

SEQ ID NO: 1251690 - RNA, 23 nt, Homo sapiens
ucagccuacuuucacacuaagaa

SEQ ID NO: 1251691 - RNA, 14 nt, Homo sapiens
ucagccucccaaag

SEQ ID NO: 1251692 - RNA, 17 nt, Homo sapiens
ucagccuccuugaagcu

SEQ ID NO: 1251693 - RNA, 20 nt, Homo sapiens
ucagccucuuaaagcugccu

SEQ ID NO: 1251694 - RNA, 18 nt, Homo sapiens
ucagccugaccaacaugg

SEQ ID NO: 1251695 - RNA, 14 nt, Homo sapiens
ucagccugagucuc

SEQ ID NO: 1251696 - RNA, 13 nt, Homo sapiens
ucagcgacugcca

SEQ ID NO: 1251697 - RNA, 21 nt, Homo sapiens
ucagcgcucuccccugaggga

SEQ ID NO: 1251698 - RNA, 19 nt, Homo sapiens
ucagcgugggccagaggca

SEQ ID NO: 1251699 - RNA, 14 nt, Homo sapiens
ucagcucaaccaca

SEQ ID NO: 1251700 - RNA, 23 nt, Homo sapiens
ucagcucaauuguuaaugugaug

SEQ ID NO: 1251701 - RNA, 14 nt, Homo sapiens
ucagcucagcuucu

SEQ ID NO: 1251702 - RNA, 17 nt, Homo sapiens
ucagcucucugggaccu

SEQ ID NO: 1251703 - RNA, 12 nt, Homo sapiens
ucagcucugagg

SEQ ID NO: 1251704 - RNA, 21 nt, Homo sapiens
ucagcucugaggauguauacc

SEQ ID NO: 1251705 - RNA, 14 nt, Homo sapiens
ucagcucuugucaa

SEQ ID NO: 1251706 - RNA, 22 nt, Homo sapiens
ucagcuucccagccaugcccag

SEQ ID NO: 1251707 - RNA, 11 nt, Homo sapiens
ucagcuuuauu

SEQ ID NO: 1251708 - RNA, 19 nt, Homo sapiens
ucagcuuucagggccaugg

SEQ ID NO: 1251709 - RNA, 22 nt, Homo sapiens
ucagcuuuuucccucacuugca

SEQ ID NO: 1251710 - RNA, 18 nt, Homo sapiens
ucaggaaggggugugcug

SEQ ID NO: 1251711 - RNA, 20 nt, Homo sapiens
ucaggaauucagugccuuca

SEQ ID NO: 1251712 - RNA, 19 nt, Homo sapiens
ucaggacaagggcucagag

SEQ ID NO: 1251713 - RNA, 17 nt, Homo sapiens
ucaggagaucgagacca

SEQ ID NO: 1251714 - RNA, 16 nt, Homo sapiens
ucaggagccaccagca

SEQ ID NO: 1251715 - RNA, 18 nt, Homo sapiens
ucaggaguuccuaaccag

SEQ ID NO: 1251716 - RNA, 17 nt, Homo sapiens
ucaggaguuggagacca

SEQ ID NO: 1251717 - RNA, 16 nt, Homo sapiens
ucaggauacucuguca

SEQ ID NO: 1251718 - RNA, 17 nt, Homo sapiens
ucaggaugcacauuucu

SEQ ID NO: 1251719 - RNA, 16 nt, Homo sapiens
ucaggauuucaccaga

SEQ ID NO: 1251720 - RNA, 13 nt, Homo sapiens
ucaggcacacagc

SEQ ID NO: 1251721 - RNA, 14 nt, Homo sapiens
ucaggcacacagcu

SEQ ID NO: 1251722 - RNA, 20 nt, Homo sapiens
ucaggcaugaagaagccacu

SEQ ID NO: 1251723 - RNA, 21 nt, Homo sapiens
ucaggccagugugucucugaa

SEQ ID NO: 1251724 - RNA, 23 nt, Homo sapiens
ucaggcccagagaagcaaguggc

SEQ ID NO: 1251725 - RNA, 16 nt, Homo sapiens
ucaggccgcauccuga

SEQ ID NO: 1251726 - RNA, 17 nt, Homo sapiens
ucaggcgauucuccugc

SEQ ID NO: 1251727 - RNA, 17 nt, Homo sapiens
ucagggccaguccuccu

SEQ ID NO: 1251728 - RNA, 17 nt, Homo sapiens
ucaggguagcugaagga

SEQ ID NO: 1251729 - RNA, 12 nt, Homo sapiens
ucagggucuaag

SEQ ID NO: 1251730 - RNA, 16 nt, Homo sapiens
ucagguauguugccuu

SEQ ID NO: 1251731 - RNA, 12 nt, Homo sapiens
ucaggucacaag

SEQ ID NO: 1251732 - RNA, 19 nt, Homo sapiens
ucaggugaaaauccaucuc

SEQ ID NO: 1251733 - RNA, 22 nt, Homo sapiens
ucaggugaucuaccugccucag

SEQ ID NO: 1251734 - RNA, 16 nt, Homo sapiens
ucagguguugccaaau

SEQ ID NO: 1251735 - RNA, 15 nt, Homo sapiens
ucagguucuucaggg

SEQ ID NO: 1251736 - RNA, 16 nt, Homo sapiens
ucagguucuucagggc

SEQ ID NO: 1251737 - RNA, 15 nt, Homo sapiens
ucagguucuuuacaa

SEQ ID NO: 1251738 - RNA, 19 nt, Homo sapiens
ucagguucuuucugaaauc

SEQ ID NO: 1251739 - RNA, 22 nt, Homo sapiens
uccauccauaaauccaguucua

SEQ ID NO: 1251740 - RNA, 20 nt, Homo sapiens
uccauccuuuacguguuuaa

SEQ ID NO: 1251741 - RNA, 21 nt, Homo sapiens
uccaucucucauccuccagua

SEQ ID NO: 1251742 - RNA, 16 nt, Homo sapiens
uccaucucugacuuaa

SEQ ID NO: 1251743 - RNA, 20 nt, Homo sapiens
uccaucuguacccuuuucca

SEQ ID NO: 1251744 - RNA, 20 nt, Homo sapiens
uccaucuuuacaaaacuaca

SEQ ID NO: 1251745 - RNA, 18 nt, Homo sapiens
uccaugaaaaugaaccau

SEQ ID NO: 1251746 - RNA, 16 nt, Homo sapiens
uccaugagacacaucu

SEQ ID NO: 1251747 - RNA, 20 nt, Homo sapiens
uccaugcaccuaccuuagaa

SEQ ID NO: 1251748 - RNA, 14 nt, Homo sapiens
uccaugcuccucac

SEQ ID NO: 1251749 - RNA, 13 nt, Homo sapiens
uccaugcugccag

SEQ ID NO: 1251750 - RNA, 18 nt, Homo sapiens
uccaugcugccagccuuc

SEQ ID NO: 1251751 - RNA, 23 nt, Homo sapiens
uccaugguggaaguuaaagggca

SEQ ID NO: 1251752 - RNA, 13 nt, Homo sapiens
uccauguacugua

SEQ ID NO: 1251753 - RNA, 20 nt, Homo sapiens
uccauguuugauguaucuga

SEQ ID NO: 1251754 - RNA, 15 nt, Homo sapiens
uccauguuuguaaaa

SEQ ID NO: 1251755 - RNA, 14 nt, Homo sapiens
uccauuauuuauau

SEQ ID NO: 1251756 - RNA, 15 nt, Homo sapiens
uccauugauucaggg

SEQ ID NO: 1251757 - RNA, 16 nt, Homo sapiens
uccauugcucuugagu

SEQ ID NO: 1251758 - RNA, 16 nt, Homo sapiens
uacaaagcgugcacaa

SEQ ID NO: 1251759 - RNA, 17 nt, Homo sapiens
uacaaaggaaauaucaa

SEQ ID NO: 1251760 - RNA, 19 nt, Homo sapiens
uacaaagguugcagugcug

SEQ ID NO: 1251761 - RNA, 19 nt, Homo sapiens
uacaaaguaagccauguau

SEQ ID NO: 1251762 - RNA, 20 nt, Homo sapiens
uacaaaguuauauucacagu

SEQ ID NO: 1251763 - RNA, 17 nt, Homo sapiens
uacaaauauauuguuaa

SEQ ID NO: 1251764 - RNA, 17 nt, Homo sapiens
uacaaauuuaugcauuu

SEQ ID NO: 1251765 - RNA, 15 nt, Homo sapiens
uacaacacacacugu

SEQ ID NO: 1251766 - RNA, 13 nt, Homo sapiens
uacaacagaauaa

SEQ ID NO: 1251767 - RNA, 13 nt, Homo sapiens
uacaacaggcagu

SEQ ID NO: 1251768 - RNA, 11 nt, Homo sapiens
uacaaccagcc

SEQ ID NO: 1251769 - RNA, 16 nt, Homo sapiens
uacaacuucagcagua

SEQ ID NO: 1251770 - RNA, 17 nt, Homo sapiens
uacaacuuguauuucca

SEQ ID NO: 1251771 - RNA, 14 nt, Homo sapiens
uacaagcgugagcc

SEQ ID NO: 1251772 - RNA, 14 nt, Homo sapiens
uacaaggcuuuauc

SEQ ID NO: 1251773 - RNA, 20 nt, Homo sapiens
uacaaggcuuuaucucaggg

SEQ ID NO: 1251774 - RNA, 13 nt, Homo sapiens
uacaaguguauau

SEQ ID NO: 1251775 - RNA, 17 nt, Homo sapiens
uacaaguuucagacagg

SEQ ID NO: 1251776 - RNA, 16 nt, Homo sapiens
uacaauauacuuguau

SEQ ID NO: 1251777 - RNA, 23 nt, Homo sapiens
uacaaucaggagugguggaaccu

SEQ ID NO: 1251778 - RNA, 14 nt, Homo sapiens
uacaaugugaauag

SEQ ID NO: 1251779 - RNA, 14 nt, Homo sapiens
uacaauguuaaccc

SEQ ID NO: 1251780 - RNA, 16 nt, Homo sapiens
uacaauuacaucucua

SEQ ID NO: 1251781 - RNA, 17 nt, Homo sapiens
uacaauugcacugcugu

SEQ ID NO: 1251782 - RNA, 21 nt, Homo sapiens
uaaauuuugaaaacugugcaa

SEQ ID NO: 1251783 - RNA, 22 nt, Homo sapiens
uaaauuuuuuuuuuuuacuuga

SEQ ID NO: 1251784 - RNA, 17 nt, Homo sapiens
uaacaaacaucacucug

SEQ ID NO: 1251785 - RNA, 19 nt, Homo sapiens
uaacaaacuacauguaauc

SEQ ID NO: 1251786 - RNA, 19 nt, Homo sapiens
uaacaacaauaacacuguc

SEQ ID NO: 1251787 - RNA, 13 nt, Homo sapiens
uaacaacuguggu

SEQ ID NO: 1251788 - RNA, 20 nt, Homo sapiens
uaacaauauauagaauugua

SEQ ID NO: 1251789 - RNA, 19 nt, Homo sapiens
uaacacagagagacagacu

SEQ ID NO: 1251790 - RNA, 23 nt, Homo sapiens
uaacacauuaucgggagcagugu

SEQ ID NO: 1251791 - RNA, 11 nt, Homo sapiens
uaacacuuugg

SEQ ID NO: 1251792 - RNA, 19 nt, Homo sapiens
uaacagaucagaacaugaa

SEQ ID NO: 1251793 - RNA, 17 nt, Homo sapiens
uaacagauccuuucaaa

SEQ ID NO: 1251794 - RNA, 15 nt, Homo sapiens
uaacagaugcaaugu

SEQ ID NO: 1251795 - RNA, 14 nt, Homo sapiens
uaacagauuugcuc

SEQ ID NO: 1251796 - RNA, 17 nt, Homo sapiens
uaacaggagugccacuu

SEQ ID NO: 1251797 - RNA, 20 nt, Homo sapiens
uaacaguugcauugacuguc

SEQ ID NO: 1251798 - RNA, 10 nt, Homo sapiens
uaacaucaac

SEQ ID NO: 1251799 - RNA, 16 nt, Homo sapiens
uaacaucaacaacaca

SEQ ID NO: 1251800 - RNA, 23 nt, Homo sapiens
uaacauggugaaaccccgucucu

SEQ ID NO: 1251801 - RNA, 20 nt, Homo sapiens
uaacauguaauuaaguacua

SEQ ID NO: 1251802 - RNA, 17 nt, Homo sapiens
uaacauguuaucaaauc

SEQ ID NO: 1251803 - RNA, 23 nt, Homo sapiens
uaacauuaaugccugcuuuuugg

SEQ ID NO: 1251804 - RNA, 14 nt, Homo sapiens
uaacauuugccuua

SEQ ID NO: 1251805 - RNA, 18 nt, Homo sapiens
uaaccauauaaauucuga

SEQ ID NO: 1251806 - RNA, 14 nt, Homo sapiens
uaaccauuaugcaa

SEQ ID NO: 1251807 - RNA, 23 nt, Homo sapiens
uaaccccuuccagaucacugcca

SEQ ID NO: 1251808 - RNA, 14 nt, Homo sapiens
uaacccuuauucca

SEQ ID NO: 1251809 - RNA, 19 nt, Homo sapiens
gguguacacuaacauuucc

SEQ ID NO: 1251810 - RNA, 20 nt, Homo sapiens
gguguagccagguauggcuc

SEQ ID NO: 1251811 - RNA, 13 nt, Homo sapiens
gguguaggggcca

SEQ ID NO: 1251812 - RNA, 21 nt, Homo sapiens
ggugucaguauccaggcuuug

SEQ ID NO: 1251813 - RNA, 11 nt, Homo sapiens
ggugucauauu

SEQ ID NO: 1251814 - RNA, 15 nt, Homo sapiens
ggugucgucugugaa

SEQ ID NO: 1251815 - RNA, 21 nt, Homo sapiens
ggugucuagacugccagggag

SEQ ID NO: 1251816 - RNA, 15 nt, Homo sapiens
ggugugaaagucaga

SEQ ID NO: 1251817 - RNA, 14 nt, Homo sapiens
ggugugaguccaaa

SEQ ID NO: 1251818 - RNA, 14 nt, Homo sapiens
gguguuuuaugggc

SEQ ID NO: 1251819 - RNA, 15 nt, Homo sapiens
gguuaacaccuucau

SEQ ID NO: 1251820 - RNA, 16 nt, Homo sapiens
gguuaacuuggucaga

SEQ ID NO: 1251821 - RNA, 12 nt, Homo sapiens
gguuaaguuaaa

SEQ ID NO: 1251822 - RNA, 20 nt, Homo sapiens
gguuaggauuuaacagucau

SEQ ID NO: 1251823 - RNA, 17 nt, Homo sapiens
gguuauaacaguguuua

SEQ ID NO: 1251824 - RNA, 19 nt, Homo sapiens
gguucaaaaccuugcacag

SEQ ID NO: 1251825 - RNA, 14 nt, Homo sapiens
gguucaacaucuaa

SEQ ID NO: 1251826 - RNA, 21 nt, Homo sapiens
gguucaauuucagaaguaaug

SEQ ID NO: 1251827 - RNA, 19 nt, Homo sapiens
gguucagcuaagcuaggaa

SEQ ID NO: 1251828 - RNA, 22 nt, Homo sapiens
gguuccagggucccucugugua

SEQ ID NO: 1251829 - RNA, 17 nt, Homo sapiens
gguucucuuagagccau

SEQ ID NO: 1251830 - RNA, 23 nt, Homo sapiens
gguucucuuagcaacucagagaa

SEQ ID NO: 1251831 - RNA, 20 nt, Homo sapiens
gguucuuaaaaaggaacaaa

SEQ ID NO: 1251832 - RNA, 17 nt, Homo sapiens
gguucuucagggccagu

SEQ ID NO: 1251833 - RNA, 20 nt, Homo sapiens
gguucuuuacaaaugguauu

SEQ ID NO: 1251834 - RNA, 21 nt, Homo sapiens
gguugaaacuguuaucacuua

SEQ ID NO: 1251835 - RNA, 11 nt, Homo sapiens
gguugaacuau

SEQ ID NO: 1251836 - RNA, 22 nt, Homo sapiens
gguugaaugagcgucagcaucc

SEQ ID NO: 1251837 - RNA, 16 nt, Homo sapiens
gguugaucaguuaaaa

SEQ ID NO: 1251838 - RNA, 14 nt, Homo sapiens
gguugaucuugcaa

SEQ ID NO: 1251839 - RNA, 16 nt, Homo sapiens
gguugcagugcugagc

SEQ ID NO: 1251840 - RNA, 21 nt, Homo sapiens
gguugccaccccaacccaaua

SEQ ID NO: 1251841 - RNA, 22 nt, Homo sapiens
gguugcuguauuuguucaguga

SEQ ID NO: 1251842 - RNA, 19 nt, Homo sapiens
gguuggacuguaagggauu

SEQ ID NO: 1251843 - RNA, 19 nt, Homo sapiens
gguuggaugggagugggca

SEQ ID NO: 1251844 - RNA, 20 nt, Homo sapiens
gguuggggccgggcacauug

SEQ ID NO: 1251845 - RNA, 18 nt, Homo sapiens
gguuggugcacagugauu

SEQ ID NO: 1251846 - RNA, 19 nt, Homo sapiens
gguuucaccguguuagcca

SEQ ID NO: 1251847 - RNA, 23 nt, Homo sapiens
gguuuccgaaggguuuugcuaca

SEQ ID NO: 1251848 - RNA, 20 nt, Homo sapiens
gguuucugagagagugccau

SEQ ID NO: 1251849 - RNA, 17 nt, Homo sapiens
gguuuggucaguuacaa

SEQ ID NO: 1251850 - RNA, 21 nt, Homo sapiens
gguuuuauaaggcugauguca

SEQ ID NO: 1251851 - RNA, 13 nt, Homo sapiens
gguuuuccgccca

SEQ ID NO: 1251852 - RNA, 18 nt, Homo sapiens
gguuuuuguuaccuuuau

SEQ ID NO: 1251853 - RNA, 19 nt, Homo sapiens
gggaauucgagcugggcau

SEQ ID NO: 1251854 - RNA, 14 nt, Homo sapiens
gggacaagggauuu

SEQ ID NO: 1251855 - RNA, 18 nt, Homo sapiens
gggacacucgggcccaug

SEQ ID NO: 1251856 - RNA, 20 nt, Homo sapiens
gggacaggaugaccuggaua

SEQ ID NO: 1251857 - RNA, 19 nt, Homo sapiens
gggacaucgccaaggacug

SEQ ID NO: 1251858 - RNA, 13 nt, Homo sapiens
gggaccaaugagg

SEQ ID NO: 1251859 - RNA, 14 nt, Homo sapiens
gggaccagggaugg

SEQ ID NO: 1251860 - RNA, 15 nt, Homo sapiens
gggaccgacuuucca

SEQ ID NO: 1251861 - RNA, 21 nt, Homo sapiens
gggaccugcucuuaaccucaa

SEQ ID NO: 1251862 - RNA, 13 nt, Homo sapiens
gggacugagccug

SEQ ID NO: 1251863 - RNA, 18 nt, Homo sapiens
gggacugcaaguggccau

SEQ ID NO: 1251864 - RNA, 12 nt, Homo sapiens
gggagaaaaaga

SEQ ID NO: 1251865 - RNA, 21 nt, Homo sapiens
gggagaaaaagaaacacaaga

SEQ ID NO: 1251866 - RNA, 13 nt, Homo sapiens
gggagaaggcagu

SEQ ID NO: 1251867 - RNA, 14 nt, Homo sapiens
gggagaaggcauga

SEQ ID NO: 1251868 - RNA, 13 nt, Homo sapiens
gggagcagugucu

SEQ ID NO: 1251869 - RNA, 12 nt, Homo sapiens
gggagcccagug

SEQ ID NO: 1251870 - RNA, 14 nt, Homo sapiens
gggagcccucaggc

SEQ ID NO: 1251871 - RNA, 12 nt, Homo sapiens
gggaggacaaaa

SEQ ID NO: 1251872 - RNA, 22 nt, Homo sapiens
gggaggacaaaacuucuuguca

SEQ ID NO: 1251873 - RNA, 21 nt, Homo sapiens
gggaggcccugagacagggau

SEQ ID NO: 1251874 - RNA, 17 nt, Homo sapiens
gggaggcugauuucuca

SEQ ID NO: 1251875 - RNA, 13 nt, Homo sapiens
gggaggggguccg

SEQ ID NO: 1251876 - RNA, 13 nt, Homo sapiens
gggauagaaagga

SEQ ID NO: 1251877 - RNA, 13 nt, Homo sapiens
gggaucagaucaa

SEQ ID NO: 1251878 - RNA, 17 nt, Homo sapiens
gggaucucaggggcugu

SEQ ID NO: 1251879 - RNA, 23 nt, Homo sapiens
gggaucuuccuugggaugaucuu

SEQ ID NO: 1251880 - RNA, 20 nt, Homo sapiens
gggaugacaauggaccucuc

SEQ ID NO: 1251881 - RNA, 15 nt, Homo sapiens
gggauggguuugcuu

SEQ ID NO: 1251882 - RNA, 23 nt, Homo sapiens
gggauucacaaggugaagaacug

SEQ ID NO: 1251883 - RNA, 23 nt, Homo sapiens
gggauuucuucgcugcucuagcu

SEQ ID NO: 1251884 - RNA, 23 nt, Homo sapiens
gggcaaaagacgggaagcaagau

SEQ ID NO: 1251885 - RNA, 13 nt, Homo sapiens
gggcaaagaagaa

SEQ ID NO: 1251886 - RNA, 21 nt, Homo sapiens
gggcaacaauacaugcugcua

SEQ ID NO: 1251887 - RNA, 23 nt, Homo sapiens
gggcacagauccccccacaaagu

SEQ ID NO: 1251888 - RNA, 13 nt, Homo sapiens
gggcacagcacag

SEQ ID NO: 1251889 - RNA, 14 nt, Homo sapiens
gggcaccugaccac

SEQ ID NO: 1251890 - RNA, 17 nt, Homo sapiens
gggcacuacauaauugc

SEQ ID NO: 1251891 - RNA, 18 nt, Homo sapiens
gggcacugaggaccagcc

SEQ ID NO: 1251892 - RNA, 13 nt, Homo sapiens
gggcacugguggc

SEQ ID NO: 1251893 - RNA, 16 nt, Homo sapiens
gggcagaugggcggac

SEQ ID NO: 1251894 - RNA, 15 nt, Homo sapiens
gggcagcucauagag

SEQ ID NO: 1251895 - RNA, 21 nt, Homo sapiens
gggcaggcugggccaugucca

SEQ ID NO: 1251896 - RNA, 14 nt, Homo sapiens
gggcagugcccaug

SEQ ID NO: 1251897 - RNA, 14 nt, Homo sapiens
gggcauaaacuguu

SEQ ID NO: 1251898 - RNA, 20 nt, Homo sapiens
gggcaugccccggccaccuc

SEQ ID NO: 1251899 - RNA, 16 nt, Homo sapiens
gggcauguguaugugu

SEQ ID NO: 1251900 - RNA, 14 nt, Homo sapiens
gggccacccagcca

SEQ ID NO: 1251901 - RNA, 20 nt, Homo sapiens
gggccaccccacucuaccuc

SEQ ID NO: 1251902 - RNA, 19 nt, Homo sapiens
gggccagaggaacugucca

SEQ ID NO: 1251903 - RNA, 14 nt, Homo sapiens
gggccauguccaaa

SEQ ID NO: 1251904 - RNA, 19 nt, Homo sapiens
gggcccagccaggagcaga

SEQ ID NO: 1251905 - RNA, 19 nt, Homo sapiens
gggccuccuucccaugccu

SEQ ID NO: 1251906 - RNA, 14 nt, Homo sapiens
gggccucugcauuu

SEQ ID NO: 1251907 - RNA, 16 nt, Homo sapiens
gggccugcagaaggaa

SEQ ID NO: 1251908 - RNA, 22 nt, Homo sapiens
gggccuggcaggccagugucug

SEQ ID NO: 1251909 - RNA, 20 nt, Homo sapiens
gggcgagccaggaccacaga

SEQ ID NO: 1251910 - RNA, 21 nt, Homo sapiens
gggcgccaccgccacccgcag

SEQ ID NO: 1251911 - RNA, 20 nt, Homo sapiens
gggcgguaccuugugcccag

SEQ ID NO: 1251912 - RNA, 17 nt, Homo sapiens
gggcguugggagccuag

SEQ ID NO: 1251913 - RNA, 16 nt, Homo sapiens
gggcuagugacuugug

SEQ ID NO: 1251914 - RNA, 23 nt, Homo sapiens
gggcuauuuuuucccccacaaac

SEQ ID NO: 1251915 - RNA, 19 nt, Homo sapiens
gggcucaaggaaagggggu

SEQ ID NO: 1251916 - RNA, 22 nt, Homo sapiens
gggcucaaggaaaggggguccc

SEQ ID NO: 1251917 - RNA, 15 nt, Homo sapiens
gggcuccacgggcag

SEQ ID NO: 1251918 - RNA, 12 nt, Homo sapiens
gggcuccaggcu

SEQ ID NO: 1251919 - RNA, 16 nt, Homo sapiens
gggcuggcacugacug

SEQ ID NO: 1251920 - RNA, 22 nt, Homo sapiens
gggcuuaccaggugagaaguga

SEQ ID NO: 1251921 - RNA, 13 nt, Homo sapiens
gggcuuuugccac

SEQ ID NO: 1251922 - RNA, 23 nt, Homo sapiens
ggggaacauuucuguaaauacca

SEQ ID NO: 1251923 - RNA, 22 nt, Homo sapiens
ggggacugcuaccucugagaag

SEQ ID NO: 1251924 - RNA, 14 nt, Homo sapiens
ggggcacaugcuga

SEQ ID NO: 1251925 - RNA, 16 nt, Homo sapiens
ggggccacguggaugg

SEQ ID NO: 1251926 - RNA, 23 nt, Homo sapiens
ggggccaggucacccuuugcugu

SEQ ID NO: 1251927 - RNA, 22 nt, Homo sapiens
ggggcccaaauucuuucagugg

SEQ ID NO: 1251928 - RNA, 17 nt, Homo sapiens
ggggcgagcacugugag

SEQ ID NO: 1251929 - RNA, 16 nt, Homo sapiens
ggggcucugugcaggg

SEQ ID NO: 1251930 - RNA, 10 nt, Homo sapiens
ggggcuucca

SEQ ID NO: 1251931 - RNA, 13 nt, Homo sapiens
gggggacguuucu

SEQ ID NO: 1251932 - RNA, 21 nt, Homo sapiens
gggggagggugugagcacgga

SEQ ID NO: 1251933 - RNA, 16 nt, Homo sapiens
augagaccacuguuau

SEQ ID NO: 1251934 - RNA, 15 nt, Homo sapiens
augagauguaacuca

SEQ ID NO: 1251935 - RNA, 22 nt, Homo sapiens
augagcagaaggaaacaaaaaa

SEQ ID NO: 1251936 - RNA, 14 nt, Homo sapiens
augagccacugagc

SEQ ID NO: 1251937 - RNA, 14 nt, Homo sapiens
augagcuauuucca

SEQ ID NO: 1251938 - RNA, 11 nt, Homo sapiens
augagcucaaa

SEQ ID NO: 1251939 - RNA, 16 nt, Homo sapiens
augagcugacaucuca

SEQ ID NO: 1251940 - RNA, 22 nt, Homo sapiens
augagcuuucuuugcacuuaaa

SEQ ID NO: 1251941 - RNA, 15 nt, Homo sapiens
augaggaaaugaucc

SEQ ID NO: 1251942 - RNA, 23 nt, Homo sapiens
augaggaccaagggcaccuggag

SEQ ID NO: 1251943 - RNA, 22 nt, Homo sapiens
augaggacuugugucucugugc

SEQ ID NO: 1251944 - RNA, 14 nt, Homo sapiens
augaggccaucuca

SEQ ID NO: 1251945 - RNA, 14 nt, Homo sapiens
augaggcuucucag

SEQ ID NO: 1251946 - RNA, 22 nt, Homo sapiens
augaggggaggggggcacaugc

SEQ ID NO: 1251947 - RNA, 21 nt, Homo sapiens
augagguucugagaccagugu

SEQ ID NO: 1251948 - RNA, 22 nt, Homo sapiens
augagguucuggccccugucau

SEQ ID NO: 1251949 - RNA, 20 nt, Homo sapiens
augaguaauacaucaaagag

SEQ ID NO: 1251950 - RNA, 18 nt, Homo sapiens
augagucaaugugcagug

SEQ ID NO: 1251951 - RNA, 20 nt, Homo sapiens
augagucauccgcuaucaca

SEQ ID NO: 1251952 - RNA, 14 nt, Homo sapiens
augagugcuuaaac

SEQ ID NO: 1251953 - RNA, 12 nt, Homo sapiens
augaguggcuuc

SEQ ID NO: 1251954 - RNA, 16 nt, Homo sapiens
augaguuaacugugaa

SEQ ID NO: 1251955 - RNA, 14 nt, Homo sapiens
augaguuacuugaa

SEQ ID NO: 1251956 - RNA, 22 nt, Homo sapiens
augaguuacuugaaauuugccu

SEQ ID NO: 1251957 - RNA, 20 nt, Homo sapiens
augaguuggacuucagucuu

SEQ ID NO: 1251958 - RNA, 18 nt, Homo sapiens
augaguuuuucaguuuug

SEQ ID NO: 1251959 - RNA, 20 nt, Homo sapiens
augaguuuuugauagcuuua

SEQ ID NO: 1251960 - RNA, 16 nt, Homo sapiens
augauacacaccuuuc

SEQ ID NO: 1251961 - RNA, 13 nt, Homo sapiens
augauaccaccuu

SEQ ID NO: 1251962 - RNA, 15 nt, Homo sapiens
augauagaugacaaa

SEQ ID NO: 1251963 - RNA, 16 nt, Homo sapiens
augauauaacccuaac

SEQ ID NO: 1251964 - RNA, 18 nt, Homo sapiens
augauauuccccauuucc

SEQ ID NO: 1251965 - RNA, 14 nt, Homo sapiens
augaucacggcuca

SEQ ID NO: 1251966 - RNA, 18 nt, Homo sapiens
augauccccaagugugaa

SEQ ID NO: 1251967 - RNA, 22 nt, Homo sapiens
augaucuguuuuucaccacuuc

SEQ ID NO: 1251968 - RNA, 15 nt, Homo sapiens
augaugauguggaag

SEQ ID NO: 1251969 - RNA, 15 nt, Homo sapiens
augaugcauacaguu

SEQ ID NO: 1251970 - RNA, 18 nt, Homo sapiens
augaugcuaaucuugucc

SEQ ID NO: 1251971 - RNA, 19 nt, Homo sapiens
augauggccuuacacugaa

SEQ ID NO: 1251972 - RNA, 21 nt, Homo sapiens
augauggccuuacacugaaaa

SEQ ID NO: 1251973 - RNA, 22 nt, Homo sapiens
augaugucuaccucagaauuaa

SEQ ID NO: 1251974 - RNA, 11 nt, Homo sapiens
augauguuuca

SEQ ID NO: 1251975 - RNA, 17 nt, Homo sapiens
augauuaaagacuguga

SEQ ID NO: 1251976 - RNA, 13 nt, Homo sapiens
augauuaaugugu

SEQ ID NO: 1251977 - RNA, 14 nt, Homo sapiens
augauucauaacaa

SEQ ID NO: 1251978 - RNA, 15 nt, Homo sapiens
augauuccuugagca

SEQ ID NO: 1251979 - RNA, 17 nt, Homo sapiens
augauugcuagccagca

SEQ ID NO: 1251980 - RNA, 20 nt, Homo sapiens
augauuguucaaagcacaga

SEQ ID NO: 1251981 - RNA, 21 nt, Homo sapiens
augauuugggggaggcuuugg

SEQ ID NO: 1251982 - RNA, 18 nt, Homo sapiens
ucugugcccuacucauug

SEQ ID NO: 1251983 - RNA, 14 nt, Homo sapiens
ucugugccugaaua

SEQ ID NO: 1251984 - RNA, 20 nt, Homo sapiens
ucugugugguucagcuacuu

SEQ ID NO: 1251985 - RNA, 14 nt, Homo sapiens
ucuguguuaggggu

SEQ ID NO: 1251986 - RNA, 15 nt, Homo sapiens
ucuguguuaggggua

SEQ ID NO: 1251987 - RNA, 22 nt, Homo sapiens
ucuguguuuugaaugguguugu

SEQ ID NO: 1251988 - RNA, 19 nt, Homo sapiens
ucuguuaccaugucacugu

SEQ ID NO: 1251989 - RNA, 18 nt, Homo sapiens
ucuguuauguacuguacu

SEQ ID NO: 1251990 - RNA, 22 nt, Homo sapiens
ucuguuauuaacaaacaucacu

SEQ ID NO: 1251991 - RNA, 22 nt, Homo sapiens
ucuguucauuucacacagugaa

SEQ ID NO: 1251992 - RNA, 17 nt, Homo sapiens
ucuguucccuugccauc

SEQ ID NO: 1251993 - RNA, 23 nt, Homo sapiens
ucuguuuaggaagaagugguacu

SEQ ID NO: 1251994 - RNA, 20 nt, Homo sapiens
ucuguuuauggccacauuua

SEQ ID NO: 1251995 - RNA, 21 nt, Homo sapiens
ucuguuuccuggucagcaugu

SEQ ID NO: 1251996 - RNA, 22 nt, Homo sapiens
ucuguuucuuaagggcacacac

SEQ ID NO: 1251997 - RNA, 22 nt, Homo sapiens
ucuguuugcuguggaacuacau

SEQ ID NO: 1251998 - RNA, 16 nt, Homo sapiens
ucuguuuggaagacca

SEQ ID NO: 1251999 - RNA, 14 nt, Homo sapiens
ucuuaaaacaaauu

SEQ ID NO: 1252000 - RNA, 22 nt, Homo sapiens
ucuuaacaaaccaacaucuuug

SEQ ID NO: 1252001 - RNA, 20 nt, Homo sapiens
ucuuaacagaucuuuacucu

SEQ ID NO: 1252002 - RNA, 17 nt, Homo sapiens
ucuuacaauugcacugc

SEQ ID NO: 1252003 - RNA, 14 nt, Homo sapiens
ucuuacacauagca

SEQ ID NO: 1252004 - RNA, 14 nt, Homo sapiens
ucuuacacuacauu

SEQ ID NO: 1252005 - RNA, 14 nt, Homo sapiens
ucuuacaugcauuu

SEQ ID NO: 1252006 - RNA, 19 nt, Homo sapiens
ucuuacauuacuaaggcua

SEQ ID NO: 1252007 - RNA, 15 nt, Homo sapiens
ucuuacauuagcagu

SEQ ID NO: 1252008 - RNA, 14 nt, Homo sapiens
ucuuacccaaagca

SEQ ID NO: 1252009 - RNA, 19 nt, Homo sapiens
ucuuaccuguaugucucca

SEQ ID NO: 1252010 - RNA, 15 nt, Homo sapiens
ucuuagaaaugaagg

SEQ ID NO: 1252011 - RNA, 21 nt, Homo sapiens
ucuuagauguauauauuuccu

SEQ ID NO: 1252012 - RNA, 18 nt, Homo sapiens
ucuuagcacacucacaga

SEQ ID NO: 1252013 - RNA, 17 nt, Homo sapiens
ucuuagcugucugcuca

SEQ ID NO: 1252014 - RNA, 19 nt, Homo sapiens
ucuuagugcuucagaguuu

SEQ ID NO: 1252015 - RNA, 15 nt, Homo sapiens
ucuuaguguaugauu

SEQ ID NO: 1252016 - RNA, 13 nt, Homo sapiens
ucuuagugucacu

SEQ ID NO: 1252017 - RNA, 20 nt, Homo sapiens
ucuuagugugccaagaguuc

SEQ ID NO: 1252018 - RNA, 16 nt, Homo sapiens
ucuuaguucucacugu

SEQ ID NO: 1252019 - RNA, 11 nt, Homo sapiens
ucuuaucauuu

SEQ ID NO: 1252020 - RNA, 21 nt, Homo sapiens
ucuuauucuuucuaaacuaca

SEQ ID NO: 1252021 - RNA, 22 nt, Homo sapiens
ucuuauucuuucuaaacuacaa

SEQ ID NO: 1252022 - RNA, 23 nt, Homo sapiens
ucuuauuuaaugaaagacuguac

SEQ ID NO: 1252023 - RNA, 16 nt, Homo sapiens
ucuuauuuauaccuca

SEQ ID NO: 1252024 - RNA, 22 nt, Homo sapiens
ucuucaaacugugaagcauuua

SEQ ID NO: 1252025 - RNA, 18 nt, Homo sapiens
ucuucaaggagaaugaau

SEQ ID NO: 1252026 - RNA, 18 nt, Homo sapiens
ucuucaccccccacucac

SEQ ID NO: 1252027 - RNA, 15 nt, Homo sapiens
ucuucaccuuauuca

SEQ ID NO: 1252028 - RNA, 16 nt, Homo sapiens
ucuucacucucugaag

SEQ ID NO: 1252029 - RNA, 19 nt, Homo sapiens
ucuucacucugaauccuca

SEQ ID NO: 1252030 - RNA, 16 nt, Homo sapiens
ucuucacucuuugaag

SEQ ID NO: 1252031 - RNA, 21 nt, Homo sapiens
ucuucacuguggucauccugc

SEQ ID NO: 1252032 - RNA, 22 nt, Homo sapiens
ucuucacuucuaaaugcauauc

SEQ ID NO: 1252033 - RNA, 22 nt, Homo sapiens
ucuucagagauaggccuguggg

SEQ ID NO: 1252034 - RNA, 14 nt, Homo sapiens
ucuucaggcccagc

SEQ ID NO: 1252035 - RNA, 20 nt, Homo sapiens
ucuucaugaguagugggcua

SEQ ID NO: 1252036 - RNA, 16 nt, Homo sapiens
ucuucauugucuacau

SEQ ID NO: 1252037 - RNA, 17 nt, Homo sapiens
ucuucauuucauuguau

SEQ ID NO: 1252038 - RNA, 12 nt, Homo sapiens
ucuucauuucua

SEQ ID NO: 1252039 - RNA, 18 nt, Homo sapiens
ucuuccaaagcacauuga

SEQ ID NO: 1252040 - RNA, 15 nt, Homo sapiens
ucuuccaacccacug

SEQ ID NO: 1252041 - RNA, 11 nt, Homo sapiens
ucuuccacugc

SEQ ID NO: 1252042 - RNA, 11 nt, Homo sapiens
ucuuccaugac

SEQ ID NO: 1252043 - RNA, 22 nt, Homo sapiens
ucuucccacacagaauauacau

SEQ ID NO: 1252044 - RNA, 15 nt, Homo sapiens
ucuucccccuuccaa

SEQ ID NO: 1252045 - RNA, 16 nt, Homo sapiens
ucuucccccuuccaaa

SEQ ID NO: 1252046 - RNA, 21 nt, Homo sapiens
ucuucccucacuuuucccagg

SEQ ID NO: 1252047 - RNA, 22 nt, Homo sapiens
ucuucccucuccccauucggug

SEQ ID NO: 1252048 - RNA, 22 nt, Homo sapiens
ucuucccucucugcagacuucc

SEQ ID NO: 1252049 - RNA, 23 nt, Homo sapiens
ucuucccuguaugauuccuugau

SEQ ID NO: 1252050 - RNA, 22 nt, Homo sapiens
ucuuccguggucagagugccac

SEQ ID NO: 1252051 - RNA, 23 nt, Homo sapiens
ucuuccuccgaggccaguaccuu

SEQ ID NO: 1252052 - RNA, 19 nt, Homo sapiens
ucuuccucuagacuuggag

SEQ ID NO: 1252053 - RNA, 20 nt, Homo sapiens
ucuuccuuacccugcgauuu

SEQ ID NO: 1252054 - RNA, 19 nt, Homo sapiens
ucuuccuuccuaauaggca

SEQ ID NO: 1252055 - RNA, 23 nt, Homo sapiens
ucuuccuuucuugucuuuccucc

SEQ ID NO: 1252056 - RNA, 21 nt, Homo sapiens
ucuucgacauccgucauugcu

SEQ ID NO: 1252057 - RNA, 14 nt, Homo sapiens
ucuucuaaacuucc

SEQ ID NO: 1252058 - RNA, 15 nt, Homo sapiens
ucuucuaccucagac

SEQ ID NO: 1252059 - RNA, 14 nt, Homo sapiens
ucuucuauaucuga

SEQ ID NO: 1252060 - RNA, 13 nt, Homo sapiens
ucuucuccacugg

SEQ ID NO: 1252061 - RNA, 18 nt, Homo sapiens
ucuucuccauccucacac

SEQ ID NO: 1252062 - RNA, 18 nt, Homo sapiens
ucuucucuauuucuggau

SEQ ID NO: 1252063 - RNA, 20 nt, Homo sapiens
ucuucugcaaaaauggauau

SEQ ID NO: 1252064 - RNA, 16 nt, Homo sapiens
ucuucuggauuagaau

SEQ ID NO: 1252065 - RNA, 17 nt, Homo sapiens
ucuucugugugaccaug

SEQ ID NO: 1252066 - RNA, 19 nt, Homo sapiens
ucuucuuacaugcauuuga

SEQ ID NO: 1252067 - RNA, 17 nt, Homo sapiens
ucuucuuacuggugcua

SEQ ID NO: 1252068 - RNA, 14 nt, Homo sapiens
ucuucuucauugaa

SEQ ID NO: 1252069 - RNA, 23 nt, Homo sapiens
ucuugaaaaaugcccauuugccu

SEQ ID NO: 1252070 - RNA, 20 nt, Homo sapiens
ucuugaaaagaagcaaggaa

SEQ ID NO: 1252071 - RNA, 23 nt, Homo sapiens
ucuugaaaauagaacaacuugca

SEQ ID NO: 1252072 - RNA, 20 nt, Homo sapiens
ucuugaaauuaagaaggcaa

SEQ ID NO: 1252073 - RNA, 21 nt, Homo sapiens
ucuugaaauuaagaaggcaaa

SEQ ID NO: 1252074 - RNA, 21 nt, Homo sapiens
ucuugaauuguaggugacuau

SEQ ID NO: 1252075 - RNA, 17 nt, Homo sapiens
ucuugacauucaaggca

SEQ ID NO: 1252076 - RNA, 20 nt, Homo sapiens
ucuugacauucaaggcauuu

SEQ ID NO: 1252077 - RNA, 22 nt, Homo sapiens
ucuugaccucaggugauccacc

SEQ ID NO: 1252078 - RNA, 19 nt, Homo sapiens
ucuugagcccaggaguuca

SEQ ID NO: 1252079 - RNA, 14 nt, Homo sapiens
ucuugcauucauuu

SEQ ID NO: 1252080 - RNA, 23 nt, Homo sapiens
ucuugccccagugugguuugcau

SEQ ID NO: 1252081 - RNA, 15 nt, Homo sapiens
ucuugcucagugaag

SEQ ID NO: 1252082 - RNA, 15 nt, Homo sapiens
ucuugcucccuucag

SEQ ID NO: 1252083 - RNA, 13 nt, Homo sapiens
gcuguaguaacug

SEQ ID NO: 1252084 - RNA, 16 nt, Homo sapiens
gcuguauguaaacugu

SEQ ID NO: 1252085 - RNA, 18 nt, Homo sapiens
gcugucaggacaccagcc

SEQ ID NO: 1252086 - RNA, 19 nt, Homo sapiens
gcugucccugcagggccau

SEQ ID NO: 1252087 - RNA, 16 nt, Homo sapiens
gcugucuggggccuuu

SEQ ID NO: 1252088 - RNA, 13 nt, Homo sapiens
gcugugaugaugu

SEQ ID NO: 1252089 - RNA, 17 nt, Homo sapiens
gcugugccaccaagcau

SEQ ID NO: 1252090 - RNA, 22 nt, Homo sapiens
gcuguggagagggucaaggagu

SEQ ID NO: 1252091 - RNA, 14 nt, Homo sapiens
gcuguggagcaaaa

SEQ ID NO: 1252092 - RNA, 15 nt, Homo sapiens
gcuguggcccuggag

SEQ ID NO: 1252093 - RNA, 22 nt, Homo sapiens
gcugugggcaagccuaagggau

SEQ ID NO: 1252094 - RNA, 20 nt, Homo sapiens
gcuguggggcgggcaugggg

SEQ ID NO: 1252095 - RNA, 23 nt, Homo sapiens
gcuguguuugcagccugcucuag

SEQ ID NO: 1252096 - RNA, 15 nt, Homo sapiens
gcuguucugcacuga

SEQ ID NO: 1252097 - RNA, 14 nt, Homo sapiens
gcuguucugcugaa

SEQ ID NO: 1252098 - RNA, 18 nt, Homo sapiens
gcuguugaagucaccuug

SEQ ID NO: 1252099 - RNA, 18 nt, Homo sapiens
gcuguuuccaggaaauua

SEQ ID NO: 1252100 - RNA, 15 nt, Homo sapiens
gcuguuuucuucuau

SEQ ID NO: 1252101 - RNA, 13 nt, Homo sapiens
gcuuaaaagcaag

SEQ ID NO: 1252102 - RNA, 13 nt, Homo sapiens
gcuuaaaauaagc

SEQ ID NO: 1252103 - RNA, 20 nt, Homo sapiens
gcuuaacgcacuaacccagc

SEQ ID NO: 1252104 - RNA, 17 nt, Homo sapiens
gcuuaaugcuacaugug

SEQ ID NO: 1252105 - RNA, 19 nt, Homo sapiens
gcuuacagggcuaggcagu

SEQ ID NO: 1252106 - RNA, 18 nt, Homo sapiens
gcuuacauuuuuacaaua

SEQ ID NO: 1252107 - RNA, 15 nt, Homo sapiens
gcuuagagaggacaa

SEQ ID NO: 1252108 - RNA, 22 nt, Homo sapiens
gcuuagaugagggugacuguca

SEQ ID NO: 1252109 - RNA, 13 nt, Homo sapiens
gcuuagauuucau

SEQ ID NO: 1252110 - RNA, 15 nt, Homo sapiens
gcuuagcggcaagaa

SEQ ID NO: 1252111 - RNA, 18 nt, Homo sapiens
gcuuaggaugugugcaug

SEQ ID NO: 1252112 - RNA, 15 nt, Homo sapiens
gcuuaguaacuagug

SEQ ID NO: 1252113 - RNA, 15 nt, Homo sapiens
gcuuauaugugacac

SEQ ID NO: 1252114 - RNA, 21 nt, Homo sapiens
gcuuaucuuugcacauguuaa

SEQ ID NO: 1252115 - RNA, 12 nt, Homo sapiens
gcuuaugauuca

SEQ ID NO: 1252116 - RNA, 22 nt, Homo sapiens
gcuuauggauucauauaggcca

SEQ ID NO: 1252117 - RNA, 20 nt, Homo sapiens
gcuucaaggauauacugcag

SEQ ID NO: 1252118 - RNA, 13 nt, Homo sapiens
gcuucacaguacc

SEQ ID NO: 1252119 - RNA, 21 nt, Homo sapiens
gcuucaccagagcauuuccaa

SEQ ID NO: 1252120 - RNA, 17 nt, Homo sapiens
gcuucaccagucugucu

SEQ ID NO: 1252121 - RNA, 19 nt, Homo sapiens
gcuucaccccugcacuuca

SEQ ID NO: 1252122 - RNA, 13 nt, Homo sapiens
gcuucagccugag

SEQ ID NO: 1252123 - RNA, 14 nt, Homo sapiens
gcuucaguugcaua

SEQ ID NO: 1252124 - RNA, 19 nt, Homo sapiens
gcuucaguugcauaucuua

SEQ ID NO: 1252125 - RNA, 21 nt, Homo sapiens
gcuucauaaaugaagcagcuu

SEQ ID NO: 1252126 - RNA, 23 nt, Homo sapiens
gcuucauaaaugaagcagcuuua

SEQ ID NO: 1252127 - RNA, 24 nt, Homo sapiens
gcuucaugugcugccugcaagcuu

SEQ ID NO: 1252128 - RNA, 18 nt, Homo sapiens
gcuucauuugugucaaug

SEQ ID NO: 1252129 - RNA, 15 nt, Homo sapiens
gcuuccagcuucagg

SEQ ID NO: 1252130 - RNA, 15 nt, Homo sapiens
gcuuccaucaguggu

SEQ ID NO: 1252131 - RNA, 11 nt, Homo sapiens
gcuuccaugau

SEQ ID NO: 1252132 - RNA, 19 nt, Homo sapiens
gcuucccuaaucuaugguc

SEQ ID NO: 1252133 - RNA, 12 nt, Homo sapiens
gcuuccuaacug

SEQ ID NO: 1252134 - RNA, 14 nt, Homo sapiens
gcuuccuaacugcu

SEQ ID NO: 1252135 - RNA, 18 nt, Homo sapiens
gcuuccuccgcucugggu

SEQ ID NO: 1252136 - RNA, 10 nt, Homo sapiens
gcuuccucua

SEQ ID NO: 1252137 - RNA, 16 nt, Homo sapiens
gcuuccuucugugaaa

SEQ ID NO: 1252138 - RNA, 20 nt, Homo sapiens
gcuucuccaauucugcccaa

SEQ ID NO: 1252139 - RNA, 12 nt, Homo sapiens
gcuucuccuucu

SEQ ID NO: 1252140 - RNA, 23 nt, Homo sapiens
gcuucuccuucuccuucccauuu

SEQ ID NO: 1252141 - RNA, 18 nt, Homo sapiens
gcuucucugacuucugcc

SEQ ID NO: 1252142 - RNA, 22 nt, Homo sapiens
gcuucucugcuccagguucacu

SEQ ID NO: 1252143 - RNA, 19 nt, Homo sapiens
gcuucucuugagucacacu

SEQ ID NO: 1252144 - RNA, 17 nt, Homo sapiens
gcuucugaaacuggagu

SEQ ID NO: 1252145 - RNA, 18 nt, Homo sapiens
ggaauggcaggugucaua

SEQ ID NO: 1252146 - RNA, 19 nt, Homo sapiens
ggaauuauuuugaauguca

SEQ ID NO: 1252147 - RNA, 12 nt, Homo sapiens
ggaauucagugc

SEQ ID NO: 1252148 - RNA, 21 nt, Homo sapiens
ggaauuccagugccaggccag

SEQ ID NO: 1252149 - RNA, 15 nt, Homo sapiens
ggaauugauuugcau

SEQ ID NO: 1252150 - RNA, 14 nt, Homo sapiens
ggaauuuggaguga

SEQ ID NO: 1252151 - RNA, 18 nt, Homo sapiens
ggacaaaacuucuuguca

SEQ ID NO: 1252152 - RNA, 17 nt, Homo sapiens
ggacaagauacauauga

SEQ ID NO: 1252153 - RNA, 17 nt, Homo sapiens
ggacaagcagcuggugc

SEQ ID NO: 1252154 - RNA, 12 nt, Homo sapiens
ggacaagggauu

SEQ ID NO: 1252155 - RNA, 18 nt, Homo sapiens
ggacaccuuuuaacucac

SEQ ID NO: 1252156 - RNA, 14 nt, Homo sapiens
ggacagacuggccg

SEQ ID NO: 1252157 - RNA, 12 nt, Homo sapiens
ggacagagccau

SEQ ID NO: 1252158 - RNA, 17 nt, Homo sapiens
ggacagaugaaugccgu

SEQ ID NO: 1252159 - RNA, 15 nt, Homo sapiens
ggacaggaugaccug

SEQ ID NO: 1252160 - RNA, 15 nt, Homo sapiens
ggacaggcacuccaa

SEQ ID NO: 1252161 - RNA, 19 nt, Homo sapiens
ggacagggcugucucugaa

SEQ ID NO: 1252162 - RNA, 16 nt, Homo sapiens
ggacagucagcucucu

SEQ ID NO: 1252163 - RNA, 16 nt, Homo sapiens
ggacaguggaugcugc

SEQ ID NO: 1252164 - RNA, 18 nt, Homo sapiens
ggacauagccugcaaagc

SEQ ID NO: 1252165 - RNA, 12 nt, Homo sapiens
ggacauggcuca

SEQ ID NO: 1252166 - RNA, 17 nt, Homo sapiens
ggacauuuaaaauucaa

SEQ ID NO: 1252167 - RNA, 19 nt, Homo sapiens
ggacauuuaaaauucaauu

SEQ ID NO: 1252168 - RNA, 14 nt, Homo sapiens
ggaccacauuuuau

SEQ ID NO: 1252169 - RNA, 17 nt, Homo sapiens
ggaccaguggugccuug

SEQ ID NO: 1252170 - RNA, 20 nt, Homo sapiens
ggacccccagcuuugcccaa

SEQ ID NO: 1252171 - RNA, 22 nt, Homo sapiens
ggaccccugaaacuggaccugc

SEQ ID NO: 1252172 - RNA, 23 nt, Homo sapiens
ggaccgcugauaagcauugacuu

SEQ ID NO: 1252173 - RNA, 17 nt, Homo sapiens
ggaccugcccugggcca

SEQ ID NO: 1252174 - RNA, 18 nt, Homo sapiens
ggaccuuuuguacuuuau

SEQ ID NO: 1252175 - RNA, 19 nt, Homo sapiens
ggacgagacccuacaggag

SEQ ID NO: 1252176 - RNA, 18 nt, Homo sapiens
ggacgcaauugugggaug

SEQ ID NO: 1252177 - RNA, 22 nt, Homo sapiens
ggacgcacgcucgcugccauca

SEQ ID NO: 1252178 - RNA, 18 nt, Homo sapiens
ggacuauguaaaccacau

SEQ ID NO: 1252179 - RNA, 23 nt, Homo sapiens
ggacucagguugucugaagucac

SEQ ID NO: 1252180 - RNA, 23 nt, Homo sapiens
ggacuccaucucucauccuccag

SEQ ID NO: 1252181 - RNA, 17 nt, Homo sapiens
ggacuccaugcugccag

SEQ ID NO: 1252182 - RNA, 16 nt, Homo sapiens
ggacucucagggauuc

SEQ ID NO: 1252183 - RNA, 13 nt, Homo sapiens
ggacucuuccacc

SEQ ID NO: 1252184 - RNA, 17 nt, Homo sapiens
ggacugcaaguggccau

SEQ ID NO: 1252185 - RNA, 17 nt, Homo sapiens
ggacuggcacacuggcc

SEQ ID NO: 1252186 - RNA, 15 nt, Homo sapiens
ggacuguaagggauu

SEQ ID NO: 1252187 - RNA, 18 nt, Homo sapiens
ggacuguuagaauagaac

SEQ ID NO: 1252188 - RNA, 23 nt, Homo sapiens
ggacuuaagacuuaucaugccaa

SEQ ID NO: 1252189 - RNA, 16 nt, Homo sapiens
ggacuucugcagcuau

SEQ ID NO: 1252190 - RNA, 17 nt, Homo sapiens
ggacuucuggcagggaa

SEQ ID NO: 1252191 - RNA, 22 nt, Homo sapiens
ggacuugguuuguuauaucagg

SEQ ID NO: 1252192 - RNA, 13 nt, Homo sapiens
ggacuuguaggga

SEQ ID NO: 1252193 - RNA, 17 nt, Homo sapiens
ggagaaacgggugagcu

SEQ ID NO: 1252194 - RNA, 24 nt, Homo sapiens
ggagaacaucuuugacacucugca

SEQ ID NO: 1252195 - RNA, 13 nt, Homo sapiens
ggagaacuagaga

SEQ ID NO: 1252196 - RNA, 17 nt, Homo sapiens
ggagaaggcagugauua

SEQ ID NO: 1252197 - RNA, 12 nt, Homo sapiens
ggagaaucucag

SEQ ID NO: 1252198 - RNA, 24 nt, Homo sapiens
ggagaauuauauagguugugcaaa

SEQ ID NO: 1252199 - RNA, 15 nt, Homo sapiens
ggagacaaguuccau

SEQ ID NO: 1252200 - RNA, 16 nt, Homo sapiens
ggagacaugugacauu

SEQ ID NO: 1252201 - RNA, 22 nt, Homo sapiens
ggagacccauguaaauaccaga

SEQ ID NO: 1252202 - RNA, 17 nt, Homo sapiens
ggagaccuggcacugga

SEQ ID NO: 1252203 - RNA, 15 nt, Homo sapiens
ggagaccugugcuag

SEQ ID NO: 1252204 - RNA, 17 nt, Homo sapiens
ggagagagaaagccagg

SEQ ID NO: 1252205 - RNA, 18 nt, Homo sapiens
ggagaggggaagggccag

SEQ ID NO: 1252206 - RNA, 11 nt, Homo sapiens
ggagaggucau

SEQ ID NO: 1252207 - RNA, 17 nt, Homo sapiens
ggagagguuacccgaga

SEQ ID NO: 1252208 - RNA, 17 nt, Homo sapiens
ggagauaaucuagaaca

SEQ ID NO: 1252209 - RNA, 22 nt, Homo sapiens
ggagaucagguaccaaggaaau

SEQ ID NO: 1252210 - RNA, 17 nt, Homo sapiens
gccuugcugcugcugca

SEQ ID NO: 1252211 - RNA, 14 nt, Homo sapiens
gccuugcuuguuaa

SEQ ID NO: 1252212 - RNA, 16 nt, Homo sapiens
gccuugggccuugcug

SEQ ID NO: 1252213 - RNA, 20 nt, Homo sapiens
gccuugucugucucagcuca

SEQ ID NO: 1252214 - RNA, 13 nt, Homo sapiens
gccuuguggcacu

SEQ ID NO: 1252215 - RNA, 15 nt, Homo sapiens
gccuuuaagaaccuu

SEQ ID NO: 1252216 - RNA, 19 nt, Homo sapiens
gccuuuccccccagagggc

SEQ ID NO: 1252217 - RNA, 21 nt, Homo sapiens
gccuuucuaguccuauucuau

SEQ ID NO: 1252218 - RNA, 19 nt, Homo sapiens
gccuuucuccgcaacagcc

SEQ ID NO: 1252219 - RNA, 20 nt, Homo sapiens
gccuuugaauaaaaaugcac

SEQ ID NO: 1252220 - RNA, 15 nt, Homo sapiens
gccuuuuaacauuuu

SEQ ID NO: 1252221 - RNA, 19 nt, Homo sapiens
gccuuuugcugcgcaccaa

SEQ ID NO: 1252222 - RNA, 13 nt, Homo sapiens
gccuuuuuguaua

SEQ ID NO: 1252223 - RNA, 18 nt, Homo sapiens
gcgaaaaccuuccucagc

SEQ ID NO: 1252224 - RNA, 21 nt, Homo sapiens
gcgaaaguucuugguggugga

SEQ ID NO: 1252225 - RNA, 17 nt, Homo sapiens
gcgacuccaucucaaaa

SEQ ID NO: 1252226 - RNA, 21 nt, Homo sapiens
gcgagaaaccucccccaaugu

SEQ ID NO: 1252227 - RNA, 21 nt, Homo sapiens
gcgagaagaaaggaagagaaa

SEQ ID NO: 1252228 - RNA, 23 nt, Homo sapiens
gcgagaggugagcuacuuuguga

SEQ ID NO: 1252229 - RNA, 20 nt, Homo sapiens
gcgagcagucagcauucuua

SEQ ID NO: 1252230 - RNA, 21 nt, Homo sapiens
gcgagccaggaccacagagcu

SEQ ID NO: 1252231 - RNA, 16 nt, Homo sapiens
gcgaggaccacuuugg

SEQ ID NO: 1252232 - RNA, 16 nt, Homo sapiens
gcgauuacaggcauga

SEQ ID NO: 1252233 - RNA, 21 nt, Homo sapiens
gcgcaaucucggcucacugca

SEQ ID NO: 1252234 - RNA, 14 nt, Homo sapiens
gcgcaguggcucac

SEQ ID NO: 1252235 - RNA, 16 nt, Homo sapiens
gcgcaugaaccuggac

SEQ ID NO: 1252236 - RNA, 14 nt, Homo sapiens
gcgccagugacagu

SEQ ID NO: 1252237 - RNA, 14 nt, Homo sapiens
gcgcccucucugcu

SEQ ID NO: 1252238 - RNA, 22 nt, Homo sapiens
gcgccugacauucacacagaga

SEQ ID NO: 1252239 - RNA, 17 nt, Homo sapiens
gcgccuggcacauuuca

SEQ ID NO: 1252240 - RNA, 18 nt, Homo sapiens
gcgccuugcugauggcuu

SEQ ID NO: 1252241 - RNA, 14 nt, Homo sapiens
gcgcgugcacacac

SEQ ID NO: 1252242 - RNA, 19 nt, Homo sapiens
gcgcuaccggccgggccua

SEQ ID NO: 1252243 - RNA, 14 nt, Homo sapiens
gcgcucgcccagca

SEQ ID NO: 1252244 - RNA, 11 nt, Homo sapiens
gcgcugcagua

SEQ ID NO: 1252245 - RNA, 21 nt, Homo sapiens
gcggaaagccuguaagccugc

SEQ ID NO: 1252246 - RNA, 21 nt, Homo sapiens
gcggaaggagggagcucugau

SEQ ID NO: 1252247 - RNA, 19 nt, Homo sapiens
gcggagucuguccugugac

SEQ ID NO: 1252248 - RNA, 17 nt, Homo sapiens
gcggcggaaagccugua

SEQ ID NO: 1252249 - RNA, 20 nt, Homo sapiens
gcggcucaaaaggaaaccaa

SEQ ID NO: 1252250 - RNA, 18 nt, Homo sapiens
gcgggccagccaggcggg

SEQ ID NO: 1252251 - RNA, 14 nt, Homo sapiens
gcgggcuaacggga

SEQ ID NO: 1252252 - RNA, 14 nt, Homo sapiens
gcguacagaucucu

SEQ ID NO: 1252253 - RNA, 15 nt, Homo sapiens
gcgucaccguccacu

SEQ ID NO: 1252254 - RNA, 19 nt, Homo sapiens
gcgugauccaccacaccug

SEQ ID NO: 1252255 - RNA, 16 nt, Homo sapiens
gcgugcgagcacacac

SEQ ID NO: 1252256 - RNA, 19 nt, Homo sapiens
gcgugcucccgaugcugcu

SEQ ID NO: 1252257 - RNA, 19 nt, Homo sapiens
gcgugguggcgggcaccua

SEQ ID NO: 1252258 - RNA, 15 nt, Homo sapiens
gcgugugauaagcaa

SEQ ID NO: 1252259 - RNA, 19 nt, Homo sapiens
gcguuacugcuugaccaaa

SEQ ID NO: 1252260 - RNA, 15 nt, Homo sapiens
gcguuaugugcagua

SEQ ID NO: 1252261 - RNA, 19 nt, Homo sapiens
gcguuaugugcaguacuua

SEQ ID NO: 1252262 - RNA, 24 nt, Homo sapiens
gcguucugcaagcaucaguucuac

SEQ ID NO: 1252263 - RNA, 17 nt, Homo sapiens
gcguuugaacucaggga

SEQ ID NO: 1252264 - RNA, 17 nt, Homo sapiens
gcuaaagaauccauaaa

SEQ ID NO: 1252265 - RNA, 11 nt, Homo sapiens
gcuaagccauc

SEQ ID NO: 1252266 - RNA, 19 nt, Homo sapiens
gcuaaggcccccaaacaua

SEQ ID NO: 1252267 - RNA, 16 nt, Homo sapiens
gcuaaguggcuuccca

SEQ ID NO: 1252268 - RNA, 15 nt, Homo sapiens
gcuaaguguggagcu

SEQ ID NO: 1252269 - RNA, 17 nt, Homo sapiens
gcuaauccaauuauuau

SEQ ID NO: 1252270 - RNA, 14 nt, Homo sapiens
gcuaauguaauaac

SEQ ID NO: 1252271 - RNA, 15 nt, Homo sapiens
ggccauggcaugugu

SEQ ID NO: 1252272 - RNA, 15 nt, Homo sapiens
ggccauguccaaaga

SEQ ID NO: 1252273 - RNA, 15 nt, Homo sapiens
ggccauuaccaucuc

SEQ ID NO: 1252274 - RNA, 12 nt, Homo sapiens
ggcccaugcaau

SEQ ID NO: 1252275 - RNA, 22 nt, Homo sapiens
ggcccaugcaauuuuauuaaau

SEQ ID NO: 1252276 - RNA, 14 nt, Homo sapiens
ggccccagcucuga

SEQ ID NO: 1252277 - RNA, 17 nt, Homo sapiens
ggccccaguccaugcuu

SEQ ID NO: 1252278 - RNA, 12 nt, Homo sapiens
ggccccaucucu

SEQ ID NO: 1252279 - RNA, 19 nt, Homo sapiens
ggccccucuuauuccucua

SEQ ID NO: 1252280 - RNA, 19 nt, Homo sapiens
ggccccugcgugggggcca

SEQ ID NO: 1252281 - RNA, 17 nt, Homo sapiens
ggcccgcaccccggccu

SEQ ID NO: 1252282 - RNA, 15 nt, Homo sapiens
ggcccgcaccgcugg

SEQ ID NO: 1252283 - RNA, 22 nt, Homo sapiens
ggcccgcagugcugggaccaga

SEQ ID NO: 1252284 - RNA, 14 nt, Homo sapiens
ggcccggccggccu

SEQ ID NO: 1252285 - RNA, 20 nt, Homo sapiens
ggcccuaaaggacucuccag

SEQ ID NO: 1252286 - RNA, 14 nt, Homo sapiens
ggcccucagugaga

SEQ ID NO: 1252287 - RNA, 18 nt, Homo sapiens
ggcccuccucucccaucc

SEQ ID NO: 1252288 - RNA, 23 nt, Homo sapiens
ggcccuccucucccauccuugau

SEQ ID NO: 1252289 - RNA, 18 nt, Homo sapiens
ggcccugaggcugcugga

SEQ ID NO: 1252290 - RNA, 19 nt, Homo sapiens
ggcccugcugcccaaucuc

SEQ ID NO: 1252291 - RNA, 21 nt, Homo sapiens
ggcccuguccuggcaucagua

SEQ ID NO: 1252292 - RNA, 15 nt, Homo sapiens
ggcccuuugaagccu

SEQ ID NO: 1252293 - RNA, 12 nt, Homo sapiens
ggccgacuccac

SEQ ID NO: 1252294 - RNA, 17 nt, Homo sapiens
ggccggaaccacagggc

SEQ ID NO: 1252295 - RNA, 14 nt, Homo sapiens
ggccuacagcuuug

SEQ ID NO: 1252296 - RNA, 19 nt, Homo sapiens
ggccucagcugaaugccuc

SEQ ID NO: 1252297 - RNA, 15 nt, Homo sapiens
ggccuccaugaccug

SEQ ID NO: 1252298 - RNA, 22 nt, Homo sapiens
ggccucccaaagugcugggauu

SEQ ID NO: 1252299 - RNA, 22 nt, Homo sapiens
ggccucccaccagagacuggga

SEQ ID NO: 1252300 - RNA, 20 nt, Homo sapiens
ggccucccacccgaugcugc

SEQ ID NO: 1252301 - RNA, 17 nt, Homo sapiens
ggccucucucauggcac

SEQ ID NO: 1252302 - RNA, 15 nt, Homo sapiens
ggccucugacucuga

SEQ ID NO: 1252303 - RNA, 19 nt, Homo sapiens
ggccucugagaagcucuga

SEQ ID NO: 1252304 - RNA, 16 nt, Homo sapiens
ggccucuggcucucau

SEQ ID NO: 1252305 - RNA, 20 nt, Homo sapiens
ggccucuggcucucaugggg

SEQ ID NO: 1252306 - RNA, 22 nt, Homo sapiens
ggccucuuccuucguuccaggc

SEQ ID NO: 1252307 - RNA, 14 nt, Homo sapiens
ggccugaacaaaau

SEQ ID NO: 1252308 - RNA, 23 nt, Homo sapiens
ggccuggaccugcccugggccac

SEQ ID NO: 1252309 - RNA, 15 nt, Homo sapiens
ggccugguugugugc

SEQ ID NO: 1252310 - RNA, 24 nt, Homo sapiens
ggccuguccacccugccaagacuc

SEQ ID NO: 1252311 - RNA, 22 nt, Homo sapiens
ggccuuaauuuucaguauaauu

SEQ ID NO: 1252312 - RNA, 19 nt, Homo sapiens
ggccuuccucucuccagau

SEQ ID NO: 1252313 - RNA, 12 nt, Homo sapiens
ggccuuuccugg

SEQ ID NO: 1252314 - RNA, 18 nt, Homo sapiens
ggccuuuccugguuuuca

SEQ ID NO: 1252315 - RNA, 15 nt, Homo sapiens
ggccuuugcauuuau

SEQ ID NO: 1252316 - RNA, 15 nt, Homo sapiens
ggccuuugcucuuac

SEQ ID NO: 1252317 - RNA, 21 nt, Homo sapiens
ggcgagcacugugagcaccug

SEQ ID NO: 1252318 - RNA, 23 nt, Homo sapiens
ggcgaugcucccucagccucaga

SEQ ID NO: 1252319 - RNA, 15 nt, Homo sapiens
ggcgcaggugcacag

SEQ ID NO: 1252320 - RNA, 16 nt, Homo sapiens
ggcgcccugcaccuga

SEQ ID NO: 1252321 - RNA, 23 nt, Homo sapiens
ggcggaggcccgcagagcacaga

SEQ ID NO: 1252322 - RNA, 14 nt, Homo sapiens
ggcgucccuaccuc

SEQ ID NO: 1252323 - RNA, 15 nt, Homo sapiens
ggcgucggaaaugau

SEQ ID NO: 1252324 - RNA, 18 nt, Homo sapiens
ggcguggaggaggaggga

SEQ ID NO: 1252325 - RNA, 22 nt, Homo sapiens
ggcguuacugcuugaccaaaga

SEQ ID NO: 1252326 - RNA, 23 nt, Homo sapiens
ggcguuuggacccaguucaguga

SEQ ID NO: 1252327 - RNA, 17 nt, Homo sapiens
ggcuaaccuggaccugg

SEQ ID NO: 1252328 - RNA, 21 nt, Homo sapiens
ggcuaacuauauuugcuuuuu

SEQ ID NO: 1252329 - RNA, 21 nt, Homo sapiens
ggcuaagaugagauuugccag

SEQ ID NO: 1252330 - RNA, 12 nt, Homo sapiens
ggcuaagugauc

SEQ ID NO: 1252331 - RNA, 23 nt, Homo sapiens
ggcuaauuuaacaagaacuuuaa

SEQ ID NO: 1252332 - RNA, 17 nt, Homo sapiens
ggcuacccuaaagggag

SEQ ID NO: 1252333 - RNA, 22 nt, Homo sapiens
gugcuuucccauaucuugccuu

SEQ ID NO: 1252334 - RNA, 18 nt, Homo sapiens
guggaaaacuuaugcuga

SEQ ID NO: 1252335 - RNA, 22 nt, Homo sapiens
guggaaagaaagaccaucuccc

SEQ ID NO: 1252336 - RNA, 18 nt, Homo sapiens
guggaaagugaauuugaa

SEQ ID NO: 1252337 - RNA, 20 nt, Homo sapiens
guggaaggcaucagucccua

SEQ ID NO: 1252338 - RNA, 22 nt, Homo sapiens
guggaaguuaaagggcauuucc

SEQ ID NO: 1252339 - RNA, 23 nt, Homo sapiens
guggaauauaaggaaagcaauaa

SEQ ID NO: 1252340 - RNA, 17 nt, Homo sapiens
guggaccacugcaugag

SEQ ID NO: 1252341 - RNA, 16 nt, Homo sapiens
guggagaaagcacuga

SEQ ID NO: 1252342 - RNA, 14 nt, Homo sapiens
guggagacuggcag

SEQ ID NO: 1252343 - RNA, 13 nt, Homo sapiens
guggagcucagcc

SEQ ID NO: 1252344 - RNA, 18 nt, Homo sapiens
guggagcugcugguguuu

SEQ ID NO: 1252345 - RNA, 18 nt, Homo sapiens
guggaggggcccuccgag

SEQ ID NO: 1252346 - RNA, 15 nt, Homo sapiens
guggagguugcagug

SEQ ID NO: 1252347 - RNA, 21 nt, Homo sapiens
guggauauuaaaaaucuguaa

SEQ ID NO: 1252348 - RNA, 15 nt, Homo sapiens
guggaugaugcugcc

SEQ ID NO: 1252349 - RNA, 20 nt, Homo sapiens
guggauuggcuuugugcuug

SEQ ID NO: 1252350 - RNA, 18 nt, Homo sapiens
guggcacagaagcucauc

SEQ ID NO: 1252351 - RNA, 16 nt, Homo sapiens
guggcaccgagaccaa

SEQ ID NO: 1252352 - RNA, 19 nt, Homo sapiens
guggcacgugccugugauc

SEQ ID NO: 1252353 - RNA, 20 nt, Homo sapiens
guggcacucaacucugagcc

SEQ ID NO: 1252354 - RNA, 16 nt, Homo sapiens
guggcacucagucucu

SEQ ID NO: 1252355 - RNA, 20 nt, Homo sapiens
guggcagacaucggccucca

SEQ ID NO: 1252356 - RNA, 15 nt, Homo sapiens
guggcagggcucagg

SEQ ID NO: 1252357 - RNA, 18 nt, Homo sapiens
guggcauguuuugugcau

SEQ ID NO: 1252358 - RNA, 22 nt, Homo sapiens
guggccaccaguaugacaguau

SEQ ID NO: 1252359 - RNA, 17 nt, Homo sapiens
guggccagcacucugaa

SEQ ID NO: 1252360 - RNA, 19 nt, Homo sapiens
guggcccagggaagccaaa

SEQ ID NO: 1252361 - RNA, 22 nt, Homo sapiens
guggcccugucccucccaccuc

SEQ ID NO: 1252362 - RNA, 20 nt, Homo sapiens
guggccgugccugagcugca

SEQ ID NO: 1252363 - RNA, 19 nt, Homo sapiens
guggccuaggcuaccucaa

SEQ ID NO: 1252364 - RNA, 16 nt, Homo sapiens
guggccuguuucugca

SEQ ID NO: 1252365 - RNA, 17 nt, Homo sapiens
guggcuccuaucugugu

SEQ ID NO: 1252366 - RNA, 22 nt, Homo sapiens
guggcuucuuuugaacuguuag

SEQ ID NO: 1252367 - RNA, 19 nt, Homo sapiens
gugggaacucacuuucccu

SEQ ID NO: 1252368 - RNA, 21 nt, Homo sapiens
gugggaaggucccuuguuucc

SEQ ID NO: 1252369 - RNA, 20 nt, Homo sapiens
gugggauacuuagugguaug

SEQ ID NO: 1252370 - RNA, 20 nt, Homo sapiens
gugggcagaucacgagguca

SEQ ID NO: 1252371 - RNA, 21 nt, Homo sapiens
gugggcaggcaggagcagggg

SEQ ID NO: 1252372 - RNA, 15 nt, Homo sapiens
gugggccacagccau

SEQ ID NO: 1252373 - RNA, 18 nt, Homo sapiens
gugggccaugaaccaaau

SEQ ID NO: 1252374 - RNA, 20 nt, Homo sapiens
gugggccucaaggacuugaa

SEQ ID NO: 1252375 - RNA, 17 nt, Homo sapiens
gugggccuuaacauccc

SEQ ID NO: 1252376 - RNA, 19 nt, Homo sapiens
guggggcugguagcucagg

SEQ ID NO: 1252377 - RNA, 20 nt, Homo sapiens
gugggguccccaucauccca

SEQ ID NO: 1252378 - RNA, 21 nt, Homo sapiens
gugggugcugcccuguguaca

SEQ ID NO: 1252379 - RNA, 19 nt, Homo sapiens
gugguacuuuauucuugcu

SEQ ID NO: 1252380 - RNA, 14 nt, Homo sapiens
gugguaugugacac

SEQ ID NO: 1252381 - RNA, 16 nt, Homo sapiens
guggucagagugccac

SEQ ID NO: 1252382 - RNA, 15 nt, Homo sapiens
guggucaucauggcc

SEQ ID NO: 1252383 - RNA, 16 nt, Homo sapiens
guuuugucaaacugua

SEQ ID NO: 1252384 - RNA, 18 nt, Homo sapiens
guuuuuaaaaguuucaau

SEQ ID NO: 1252385 - RNA, 13 nt, Homo sapiens
guuuuuacuguga

SEQ ID NO: 1252386 - RNA, 20 nt, Homo sapiens
guuuuuauauuaauguacuu

SEQ ID NO: 1252387 - RNA, 21 nt, Homo sapiens
guuuuuggcucuuucagagag

SEQ ID NO: 1252388 - RNA, 17 nt, Homo sapiens
guuuuuguuuuuuucca

SEQ ID NO: 1252389 - RNA, 18 nt, Homo sapiens
guuuuuuuacaacauuca

SEQ ID NO: 1252390 - RNA, 23 nt, Homo sapiens
guuuuuuuuuuuuuuaacaugua

SEQ ID NO: 1252391 - RNA, 17 nt, Homo sapiens
uaaaaaaaaaaguuaca

SEQ ID NO: 1252392 - RNA, 17 nt, Homo sapiens
uaaaaaaagaacauaaa

SEQ ID NO: 1252393 - RNA, 18 nt, Homo sapiens
uaaaaaauaaaguaccac

SEQ ID NO: 1252394 - RNA, 18 nt, Homo sapiens
uaaaaaauagacauguag

SEQ ID NO: 1252395 - RNA, 21 nt, Homo sapiens
uaaaaaaugaaaaacauuauu

SEQ ID NO: 1252396 - RNA, 13 nt, Homo sapiens
uaaaaaaugucua

SEQ ID NO: 1252397 - RNA, 22 nt, Homo sapiens
uaaaaacagaaggaaauugaga

SEQ ID NO: 1252398 - RNA, 19 nt, Homo sapiens
uaaaaaccccaaacuguug

SEQ ID NO: 1252399 - RNA, 17 nt, Homo sapiens
uaaaaaccugaacuuuc

SEQ ID NO: 1252400 - RNA, 22 nt, Homo sapiens
uaaaaagcauuauuauuugcug

SEQ ID NO: 1252401 - RNA, 18 nt, Homo sapiens
uaaaaagcgcugcaguag

SEQ ID NO: 1252402 - RNA, 20 nt, Homo sapiens
uaaaaagcucacugcugauc

SEQ ID NO: 1252403 - RNA, 12 nt, Homo sapiens
uaaaaaggccaa

SEQ ID NO: 1252404 - RNA, 18 nt, Homo sapiens
uaaaaagugacacagcag

SEQ ID NO: 1252405 - RNA, 12 nt, Homo sapiens
uaaaaaguucag

SEQ ID NO: 1252406 - RNA, 15 nt, Homo sapiens
uaaaaauacaaaaau

SEQ ID NO: 1252407 - RNA, 22 nt, Homo sapiens
uaaaaauauauagcgacauccu

SEQ ID NO: 1252408 - RNA, 22 nt, Homo sapiens
uaaaaauauauauagugcuaua

SEQ ID NO: 1252409 - RNA, 16 nt, Homo sapiens
uaaaaaucacacugua

SEQ ID NO: 1252410 - RNA, 19 nt, Homo sapiens
uaaaaaucauugauuguca

SEQ ID NO: 1252411 - RNA, 12 nt, Homo sapiens
uaaaaaugcacc

SEQ ID NO: 1252412 - RNA, 23 nt, Homo sapiens
uaaaaauggcaggggguggaauu

SEQ ID NO: 1252413 - RNA, 19 nt, Homo sapiens
uaaaaauggccauuugcuu

SEQ ID NO: 1252414 - RNA, 13 nt, Homo sapiens
uaaaaauguccug

SEQ ID NO: 1252415 - RNA, 17 nt, Homo sapiens
uaaaaauguccugccuu

SEQ ID NO: 1252416 - RNA, 15 nt, Homo sapiens
uaaaaauguucucaa

SEQ ID NO: 1252417 - RNA, 15 nt, Homo sapiens
uaaaaauugugauca

SEQ ID NO: 1252418 - RNA, 15 nt, Homo sapiens
uaaaacaauacucaa

SEQ ID NO: 1252419 - RNA, 16 nt, Homo sapiens
uaaaacaucuuuccag

SEQ ID NO: 1252420 - RNA, 20 nt, Homo sapiens
uaaaacaugcuggugaacca

SEQ ID NO: 1252421 - RNA, 14 nt, Homo sapiens
uaaaaccacuguac

SEQ ID NO: 1252422 - RNA, 22 nt, Homo sapiens
uaaaaccaucaaaaauauucca

SEQ ID NO: 1252423 - RNA, 17 nt, Homo sapiens
uaaaaccugugugccau

SEQ ID NO: 1252424 - RNA, 18 nt, Homo sapiens
uaaaaccugugugccauu

SEQ ID NO: 1252425 - RNA, 15 nt, Homo sapiens
uaaaacuaagcacaa

SEQ ID NO: 1252426 - RNA, 19 nt, Homo sapiens
uaaaacuacauggucaaca

SEQ ID NO: 1252427 - RNA, 18 nt, Homo sapiens
uaaaacucacugugauca

SEQ ID NO: 1252428 - RNA, 12 nt, Homo sapiens
uaaaacucgcuu

SEQ ID NO: 1252429 - RNA, 15 nt, Homo sapiens
uaaaacugaaucuca

SEQ ID NO: 1252430 - RNA, 20 nt, Homo sapiens
uaaaagaacuuacugauuau

SEQ ID NO: 1252431 - RNA, 15 nt, Homo sapiens
uaaacuacaacgaac

SEQ ID NO: 1252432 - RNA, 16 nt, Homo sapiens
uaaacuauaaccucuc

SEQ ID NO: 1252433 - RNA, 13 nt, Homo sapiens
uaaacucagaaua

SEQ ID NO: 1252434 - RNA, 21 nt, Homo sapiens
uaaacucagaauauacccauc

SEQ ID NO: 1252435 - RNA, 15 nt, Homo sapiens
uaaacuccuacuaaa

SEQ ID NO: 1252436 - RNA, 17 nt, Homo sapiens
uaaacuccuacuaaauc

SEQ ID NO: 1252437 - RNA, 12 nt, Homo sapiens
uaaacuccuuaa

SEQ ID NO: 1252438 - RNA, 13 nt, Homo sapiens
uaaacucugcuca

SEQ ID NO: 1252439 - RNA, 13 nt, Homo sapiens
uaaacucugucca

SEQ ID NO: 1252440 - RNA, 16 nt, Homo sapiens
uaaacugaaaauggac

SEQ ID NO: 1252441 - RNA, 23 nt, Homo sapiens
uaaacuggaauccuuucacccgc

SEQ ID NO: 1252442 - RNA, 13 nt, Homo sapiens
uaaacuguuuaua

SEQ ID NO: 1252443 - RNA, 13 nt, Homo sapiens
uaaacuucacuga

SEQ ID NO: 1252444 - RNA, 16 nt, Homo sapiens
uaaacuugccuguuca

SEQ ID NO: 1252445 - RNA, 11 nt, Homo sapiens
uaaacuuucaa

SEQ ID NO: 1252446 - RNA, 19 nt, Homo sapiens
uaaacuuuuuuucaaugug

SEQ ID NO: 1252447 - RNA, 20 nt, Homo sapiens
uaaagaaaauaaacaccauu

SEQ ID NO: 1252448 - RNA, 18 nt, Homo sapiens
uaaagaaaugcauaaaag

SEQ ID NO: 1252449 - RNA, 13 nt, Homo sapiens
uaaagaauccaua

SEQ ID NO: 1252450 - RNA, 11 nt, Homo sapiens
uaaagaccaaa

SEQ ID NO: 1252451 - RNA, 17 nt, Homo sapiens
uaaagacccuccuauuc

SEQ ID NO: 1252452 - RNA, 13 nt, Homo sapiens
uaaagacugugau

SEQ ID NO: 1252453 - RNA, 19 nt, Homo sapiens
uaaagagagaugaaccaca

SEQ ID NO: 1252454 - RNA, 15 nt, Homo sapiens
uaaagcaauguggua

SEQ ID NO: 1252455 - RNA, 14 nt, Homo sapiens
uaaagcacaugccu

SEQ ID NO: 1252456 - RNA, 14 nt, Homo sapiens
uaaagcagaagcaa

SEQ ID NO: 1252457 - RNA, 18 nt, Homo sapiens
uaaagcauauuggugcua

SEQ ID NO: 1252458 - RNA, 18 nt, Homo sapiens
uaaagcauuccccaaaga

SEQ ID NO: 1252459 - RNA, 15 nt, Homo sapiens
uaaagccauguuucc

SEQ ID NO: 1252460 - RNA, 15 nt, Homo sapiens
uaaagccucaagguu

SEQ ID NO: 1252461 - RNA, 19 nt, Homo sapiens
uaaagcuauguuacaugga

SEQ ID NO: 1252462 - RNA, 23 nt, Homo sapiens
uaaaggaagcaaguuuucuucca

SEQ ID NO: 1252463 - RNA, 16 nt, Homo sapiens
uaaaggaauuccccaa

SEQ ID NO: 1252464 - RNA, 22 nt, Homo sapiens
uaaaggauaauggugaacauuu

SEQ ID NO: 1252465 - RNA, 12 nt, Homo sapiens
uaaaggcagcug

SEQ ID NO: 1252466 - RNA, 13 nt, Homo sapiens
uaaaggcaucuac

SEQ ID NO: 1252467 - RNA, 21 nt, Homo sapiens
uaaagggagaaggaagggcag

SEQ ID NO: 1252468 - RNA, 22 nt, Homo sapiens
uaaagguccacaggucuagacu

SEQ ID NO: 1252469 - RNA, 13 nt, Homo sapiens
uaaaguaccacac

SEQ ID NO: 1252470 - RNA, 14 nt, Homo sapiens
uaaaguaccacaca

SEQ ID NO: 1252471 - RNA, 16 nt, Homo sapiens
uaaaguaccacacaua

SEQ ID NO: 1252472 - RNA, 17 nt, Homo sapiens
uaaaguaccacacauau

SEQ ID NO: 1252473 - RNA, 18 nt, Homo sapiens
uaaaguauaauguuuauu

SEQ ID NO: 1252474 - RNA, 15 nt, Homo sapiens
uaaagucacagaauu

SEQ ID NO: 1252475 - RNA, 16 nt, Homo sapiens
uaaagucacagaauua

SEQ ID NO: 1252476 - RNA, 13 nt, Homo sapiens
uaaagucugaauc

SEQ ID NO: 1252477 - RNA, 18 nt, Homo sapiens
uaaagugccuaccccagc

SEQ ID NO: 1252478 - RNA, 22 nt, Homo sapiens
uaaagugcuaagguucuaaggc

SEQ ID NO: 1252479 - RNA, 22 nt, Homo sapiens
uaaucaaaauugucucuucuga

SEQ ID NO: 1252480 - RNA, 20 nt, Homo sapiens
uaaucacuauuguuccagca

SEQ ID NO: 1252481 - RNA, 12 nt, Homo sapiens
uaaucacucuaa

SEQ ID NO: 1252482 - RNA, 22 nt, Homo sapiens
uaaucacucuaauuaauuguaa

SEQ ID NO: 1252483 - RNA, 21 nt, Homo sapiens
uaaucagacaaaguaauuccu

SEQ ID NO: 1252484 - RNA, 22 nt, Homo sapiens
uaaucagguccucagagaauuu

SEQ ID NO: 1252485 - RNA, 17 nt, Homo sapiens
uaaucccaacacuuuga

SEQ ID NO: 1252486 - RNA, 19 nt, Homo sapiens
uaaucccaacacuuugaga

SEQ ID NO: 1252487 - RNA, 19 nt, Homo sapiens
uaaucccacccaccucacc

SEQ ID NO: 1252488 - RNA, 20 nt, Homo sapiens
uaaucccagcuacuugggag

SEQ ID NO: 1252489 - RNA, 14 nt, Homo sapiens
uaaucccaggauua

SEQ ID NO: 1252490 - RNA, 14 nt, Homo sapiens
uaaucuaugaauuc

SEQ ID NO: 1252491 - RNA, 15 nt, Homo sapiens
uaaucucagcacuuu

SEQ ID NO: 1252492 - RNA, 13 nt, Homo sapiens
uaaucuguagggc

SEQ ID NO: 1252493 - RNA, 22 nt, Homo sapiens
uaaucuuagagacaaaccuuaa

SEQ ID NO: 1252494 - RNA, 14 nt, Homo sapiens
uaaucuucagguga

SEQ ID NO: 1252495 - RNA, 19 nt, Homo sapiens
uaaucuuccauacuucuuc

SEQ ID NO: 1252496 - RNA, 18 nt, Homo sapiens
uaaucuucugccuucuca

SEQ ID NO: 1252497 - RNA, 21 nt, Homo sapiens
uaaucuucugccuucucauga

SEQ ID NO: 1252498 - RNA, 22 nt, Homo sapiens
uaaucuuuauacuggguuucaa

SEQ ID NO: 1252499 - RNA, 15 nt, Homo sapiens
uaaugaaaacauuaa

SEQ ID NO: 1252500 - RNA, 20 nt, Homo sapiens
uaaugaaaaugaauaucuau

SEQ ID NO: 1252501 - RNA, 15 nt, Homo sapiens
uaaugaaaaugucag

SEQ ID NO: 1252502 - RNA, 22 nt, Homo sapiens
uaaugaaagacuguacaaagua

SEQ ID NO: 1252503 - RNA, 17 nt, Homo sapiens
uaaugaacuaacugaca

SEQ ID NO: 1252504 - RNA, 20 nt, Homo sapiens
uaaugaacuaccaucugaug

SEQ ID NO: 1252505 - RNA, 13 nt, Homo sapiens
uaaugaaugacau

SEQ ID NO: 1252506 - RNA, 18 nt, Homo sapiens
uaaugaauuuuuaugaua

SEQ ID NO: 1252507 - RNA, 21 nt, Homo sapiens
uaaugacucuuucugaaggaa

SEQ ID NO: 1252508 - RNA, 13 nt, Homo sapiens
uaaugauacugau

SEQ ID NO: 1252509 - RNA, 14 nt, Homo sapiens
uaaugaugaucuuc

SEQ ID NO: 1252510 - RNA, 14 nt, Homo sapiens
uaaugauuaaagac

SEQ ID NO: 1252511 - RNA, 23 nt, Homo sapiens
uaaugccuuuucucaccugucau

SEQ ID NO: 1252512 - RNA, 20 nt, Homo sapiens
uaaugcuacugucucacuga

SEQ ID NO: 1252513 - RNA, 16 nt, Homo sapiens
uaauggaugguugaau

SEQ ID NO: 1252514 - RNA, 17 nt, Homo sapiens
uaauggcaauaggacau

SEQ ID NO: 1252515 - RNA, 17 nt, Homo sapiens
uaauggcuaguacugua

SEQ ID NO: 1252516 - RNA, 14 nt, Homo sapiens
uaaugguguuuuaa

SEQ ID NO: 1252517 - RNA, 18 nt, Homo sapiens
uaaugguuuuuaacaccu

SEQ ID NO: 1252518 - RNA, 17 nt, Homo sapiens
uaauguaauaauagaaa

SEQ ID NO: 1252519 - RNA, 17 nt, Homo sapiens
uaauguagcguguuuac

SEQ ID NO: 1252520 - RNA, 22 nt, Homo sapiens
uaaugucauagguaagaaacac

SEQ ID NO: 1252521 - RNA, 14 nt, Homo sapiens
uaaugucucacugu

SEQ ID NO: 1252522 - RNA, 18 nt, Homo sapiens
uaaugucuccuuugcucu

SEQ ID NO: 1252523 - RNA, 23 nt, Homo sapiens
uaaugucuccuuugcucuugcca

SEQ ID NO: 1252524 - RNA, 21 nt, Homo sapiens
uaaugucuucauaaaguacuu

SEQ ID NO: 1252525 - RNA, 22 nt, Homo sapiens
uaaugucuucauaaaguacuug

SEQ ID NO: 1252526 - RNA, 23 nt, Homo sapiens
uaaugucuuuaaaaguauccaga

SEQ ID NO: 1252527 - RNA, 19 nt, Homo sapiens
uaaugugugguggccucag

SEQ ID NO: 1252528 - RNA, 20 nt, Homo sapiens
uaauguuaauucagcacuga

SEQ ID NO: 1252529 - RNA, 13 nt, Homo sapiens
uaauguuacauua

SEQ ID NO: 1252530 - RNA, 14 nt, Homo sapiens
uaauguuacugauc

SEQ ID NO: 1252531 - RNA, 22 nt, Homo sapiens
uaauguuacugaucaugcauug

SEQ ID NO: 1252532 - RNA, 16 nt, Homo sapiens
uaauguuauuuccacu

SEQ ID NO: 1252533 - RNA, 22 nt, Homo sapiens
uaauguuccugaaaauugcaau

SEQ ID NO: 1252534 - RNA, 22 nt, Homo sapiens
uaauguuguaauucaugccagg

SEQ ID NO: 1252535 - RNA, 19 nt, Homo sapiens
uaauuaaagcccacaaucc

SEQ ID NO: 1252536 - RNA, 15 nt, Homo sapiens
uaauuaaauuucaca

SEQ ID NO: 1252537 - RNA, 23 nt, Homo sapiens
uaauuaaauuuugaguucuacau

SEQ ID NO: 1252538 - RNA, 17 nt, Homo sapiens
uaauuaaguaaaccaaa

SEQ ID NO: 1252539 - RNA, 20 nt, Homo sapiens
uaauuaaugucaguauuuca

SEQ ID NO: 1252540 - RNA, 12 nt, Homo sapiens
uaauuaauuuca

SEQ ID NO: 1252541 - RNA, 12 nt, Homo sapiens
uaauuacauucc

SEQ ID NO: 1252542 - RNA, 18 nt, Homo sapiens
uaauuaccaaccuguuac

SEQ ID NO: 1252543 - RNA, 20 nt, Homo sapiens
uaauuacuuauuguauuuau

SEQ ID NO: 1252544 - RNA, 22 nt, Homo sapiens
uaauuagcauggccccagucca

SEQ ID NO: 1252545 - RNA, 18 nt, Homo sapiens
uaauuaggguacauuuau

SEQ ID NO: 1252546 - RNA, 17 nt, Homo sapiens
uaauuaguugauugcug

SEQ ID NO: 1252547 - RNA, 21 nt, Homo sapiens
uaauuaucggaagcagugccu

SEQ ID NO: 1252548 - RNA, 16 nt, Homo sapiens
uaauuauuuugacaaa

SEQ ID NO: 1252549 - RNA, 19 nt, Homo sapiens
uaauucaagaaaacaacuu

SEQ ID NO: 1252550 - RNA, 13 nt, Homo sapiens
uaauucaauguga

SEQ ID NO: 1252551 - RNA, 14 nt, Homo sapiens
uaauucaccaaagu

SEQ ID NO: 1252552 - RNA, 17 nt, Homo sapiens
uaauucacucaagcacu

SEQ ID NO: 1252553 - RNA, 19 nt, Homo sapiens
uaauucacucaagcacuga

SEQ ID NO: 1252554 - RNA, 14 nt, Homo sapiens
uaauucagcacuga

SEQ ID NO: 1252555 - RNA, 16 nt, Homo sapiens
uaauucauggcauuga

SEQ ID NO: 1252556 - RNA, 15 nt, Homo sapiens
uaauucauugugauu

SEQ ID NO: 1252557 - RNA, 18 nt, Homo sapiens
uaauucauugugauuuau

SEQ ID NO: 1252558 - RNA, 13 nt, Homo sapiens
uaauuccuaugaa

SEQ ID NO: 1252559 - RNA, 11 nt, Homo sapiens
uaguacuccuu

SEQ ID NO: 1252560 - RNA, 12 nt, Homo sapiens
uaguaucuguau

SEQ ID NO: 1252561 - RNA, 16 nt, Homo sapiens
uagucaaggaggaaag

SEQ ID NO: 1252562 - RNA, 13 nt, Homo sapiens
uagucaauccaag

SEQ ID NO: 1252563 - RNA, 13 nt, Homo sapiens
uagucacacauag

SEQ ID NO: 1252564 - RNA, 22 nt, Homo sapiens
uagucauucuuacaauugcacu

SEQ ID NO: 1252565 - RNA, 22 nt, Homo sapiens
uaguccaaauaacaaguaccaa

SEQ ID NO: 1252566 - RNA, 14 nt, Homo sapiens
uaguccaauuccuu

SEQ ID NO: 1252567 - RNA, 20 nt, Homo sapiens
uagucccagcuacuugagag

SEQ ID NO: 1252568 - RNA, 19 nt, Homo sapiens
uaguccggacccaccucac

SEQ ID NO: 1252569 - RNA, 16 nt, Homo sapiens
uagucuguacuucauc

SEQ ID NO: 1252570 - RNA, 15 nt, Homo sapiens
uagucuguuugcaaa

SEQ ID NO: 1252571 - RNA, 13 nt, Homo sapiens
uagucuuugccag

SEQ ID NO: 1252572 - RNA, 21 nt, Homo sapiens
uagugaacauucgaccuccau

SEQ ID NO: 1252573 - RNA, 14 nt, Homo sapiens
uagugacacacaga

SEQ ID NO: 1252574 - RNA, 21 nt, Homo sapiens
uagugacuuaauucuuucuaa

SEQ ID NO: 1252575 - RNA, 13 nt, Homo sapiens
uagugaucauuua

SEQ ID NO: 1252576 - RNA, 19 nt, Homo sapiens
uagugaugagaauuguaug

SEQ ID NO: 1252577 - RNA, 23 nt, Homo sapiens
uagugggccagggcugcccugag

SEQ ID NO: 1252578 - RNA, 22 nt, Homo sapiens
uagugguauagaguacugcaga

SEQ ID NO: 1252579 - RNA, 20 nt, Homo sapiens
uaguguaccuccucucagug

SEQ ID NO: 1252580 - RNA, 18 nt, Homo sapiens
uaguguauccauaaugca

SEQ ID NO: 1252581 - RNA, 21 nt, Homo sapiens
uaguguauuaucacugucugu

SEQ ID NO: 1252582 - RNA, 12 nt, Homo sapiens
uagugucacuua

SEQ ID NO: 1252583 - RNA, 15 nt, Homo sapiens
uagugucugucuucu

SEQ ID NO: 1252584 - RNA, 16 nt, Homo sapiens
uaguguuggggauccu

SEQ ID NO: 1252585 - RNA, 14 nt, Homo sapiens
uaguuaagugugga

SEQ ID NO: 1252586 - RNA, 12 nt, Homo sapiens
uaguuaaucucc

SEQ ID NO: 1252587 - RNA, 22 nt, Homo sapiens
uaguuacaaaguuauauucaca

SEQ ID NO: 1252588 - RNA, 13 nt, Homo sapiens
uaguuacuguggu

SEQ ID NO: 1252589 - RNA, 11 nt, Homo sapiens
uaguuagcuuu

SEQ ID NO: 1252590 - RNA, 15 nt, Homo sapiens
uaguucaacuguaua

SEQ ID NO: 1252591 - RNA, 22 nt, Homo sapiens
uaguucaauauuuguuacuguu

SEQ ID NO: 1252592 - RNA, 16 nt, Homo sapiens
uaguucagugaccugu

SEQ ID NO: 1252593 - RNA, 20 nt, Homo sapiens
uaguucccuuugccaacaga

SEQ ID NO: 1252594 - RNA, 21 nt, Homo sapiens
uaguuccuaauggauucaauu

SEQ ID NO: 1252595 - RNA, 21 nt, Homo sapiens
uaguugaucuacaaaggccau

SEQ ID NO: 1252596 - RNA, 21 nt, Homo sapiens
uaguuuacuccugaccacuaa

SEQ ID NO: 1252597 - RNA, 22 nt, Homo sapiens
uaguuuauuuuguuacacuaaa

SEQ ID NO: 1252598 - RNA, 22 nt, Homo sapiens
uaguuugauacucccagucuug

SEQ ID NO: 1252599 - RNA, 23 nt, Homo sapiens
uaguuuugauccuaaaucugccu

SEQ ID NO: 1252600 - RNA, 13 nt, Homo sapiens
uaacugacagcuu

SEQ ID NO: 1252601 - RNA, 14 nt, Homo sapiens
uaacugagauuaca

SEQ ID NO: 1252602 - RNA, 21 nt, Homo sapiens
uaacugauuaccugccaauug

SEQ ID NO: 1252603 - RNA, 14 nt, Homo sapiens
uaacugcacaaaca

SEQ ID NO: 1252604 - RNA, 17 nt, Homo sapiens
uaacugccuuguguaca

SEQ ID NO: 1252605 - RNA, 19 nt, Homo sapiens
uaacuggaaggccuuccac

SEQ ID NO: 1252606 - RNA, 18 nt, Homo sapiens
uaacugugaaauaccaca

SEQ ID NO: 1252607 - RNA, 19 nt, Homo sapiens
uaacugugaaauaccacaa

SEQ ID NO: 1252608 - RNA, 12 nt, Homo sapiens
uaacugugaaca

SEQ ID NO: 1252609 - RNA, 12 nt, Homo sapiens
uaacugugcuga

SEQ ID NO: 1252610 - RNA, 13 nt, Homo sapiens
uaacuguguuuua

SEQ ID NO: 1252611 - RNA, 23 nt, Homo sapiens
uaacuguuaacuaugacagauau

SEQ ID NO: 1252612 - RNA, 12 nt, Homo sapiens
uaacuguucuca

SEQ ID NO: 1252613 - RNA, 13 nt, Homo sapiens
uaacuguuucccu

SEQ ID NO: 1252614 - RNA, 16 nt, Homo sapiens
uaacuuagguggcaag

SEQ ID NO: 1252615 - RNA, 20 nt, Homo sapiens
uaacuuauuuuaaauaugcc

SEQ ID NO: 1252616 - RNA, 13 nt, Homo sapiens
uaacuuauuuucc

SEQ ID NO: 1252617 - RNA, 14 nt, Homo sapiens
uaagaaagcacuau

SEQ ID NO: 1252618 - RNA, 19 nt, Homo sapiens
uaagaaauguauuccugaa

SEQ ID NO: 1252619 - RNA, 17 nt, Homo sapiens
uaagaacaucauaaaau

SEQ ID NO: 1252620 - RNA, 21 nt, Homo sapiens
uaagaagcagauaaugguguu

SEQ ID NO: 1252621 - RNA, 21 nt, Homo sapiens
uaagaagccuuaauuugcaca

SEQ ID NO: 1252622 - RNA, 17 nt, Homo sapiens
uaagaaugcagauuccu

SEQ ID NO: 1252623 - RNA, 20 nt, Homo sapiens
uaagaauucuguacuuccaa

SEQ ID NO: 1252624 - RNA, 14 nt, Homo sapiens
uaagaauuucacaa

SEQ ID NO: 1252625 - RNA, 17 nt, Homo sapiens
uaagaauuucacaagcu

SEQ ID NO: 1252626 - RNA, 14 nt, Homo sapiens
uaagacaccaaaua

SEQ ID NO: 1252627 - RNA, 22 nt, Homo sapiens
uaagacaggaggaucacaagag

SEQ ID NO: 1252628 - RNA, 12 nt, Homo sapiens
uaagacauguga

SEQ ID NO: 1252629 - RNA, 13 nt, Homo sapiens
uaagacuacugaa

SEQ ID NO: 1252630 - RNA, 21 nt, Homo sapiens
uaagaggcugcugaaaaccau

SEQ ID NO: 1252631 - RNA, 19 nt, Homo sapiens
uaagaggugaucucuggga

SEQ ID NO: 1252632 - RNA, 20 nt, Homo sapiens
uaagauaaauucaugcacuu

SEQ ID NO: 1252633 - RNA, 21 nt, Homo sapiens
uaagauaaauucaugcacuuu

SEQ ID NO: 1252634 - RNA, 19 nt, Homo sapiens
uaagauauuaacugagaag

SEQ ID NO: 1252635 - RNA, 19 nt, Homo sapiens
uaagaucucgguuugccaa

SEQ ID NO: 1252636 - RNA, 11 nt, Homo sapiens
uaagauucuaa

SEQ ID NO: 1252637 - RNA, 18 nt, Homo sapiens
uaagauuuuacaaaagag

SEQ ID NO: 1252638 - RNA, 17 nt, Homo sapiens
uaagauuuugcaccugu

SEQ ID NO: 1252639 - RNA, 15 nt, Homo sapiens
uaagauuuugugaau

SEQ ID NO: 1252640 - RNA, 20 nt, Homo sapiens
uaagcaccaggacgcccucg

SEQ ID NO: 1252641 - RNA, 15 nt, Homo sapiens
uaagcacugugcuaa

SEQ ID NO: 1252642 - RNA, 12 nt, Homo sapiens
uaagcagucuca

SEQ ID NO: 1252643 - RNA, 21 nt, Homo sapiens
uaagcauauguguuacuucaa

SEQ ID NO: 1252644 - RNA, 15 nt, Homo sapiens
uaagccuuuccauaa

SEQ ID NO: 1252645 - RNA, 16 nt, Homo sapiens
uaagcuaggaaugaaa

SEQ ID NO: 1252646 - RNA, 16 nt, Homo sapiens
uaagcuaucagcaaua

SEQ ID NO: 1252647 - RNA, 21 nt, Homo sapiens
uaagcuaucuucaaaugucua

SEQ ID NO: 1252648 - RNA, 22 nt, Homo sapiens
uaagcucuuugaaacaacuuuc

SEQ ID NO: 1252649 - RNA, 18 nt, Homo sapiens
uaagcugauuugauacca

SEQ ID NO: 1252650 - RNA, 19 nt, Homo sapiens
uaagcugauuugauaccau

SEQ ID NO: 1252651 - RNA, 18 nt, Homo sapiens
uaagcugggauaaucaca

SEQ ID NO: 1252652 - RNA, 18 nt, Homo sapiens
uaagcuguaaauuacaua

SEQ ID NO: 1252653 - RNA, 21 nt, Homo sapiens
uaagcuuuggacccaaggaaa

SEQ ID NO: 1252654 - RNA, 14 nt, Homo sapiens
uaaggaaagcaaua

SEQ ID NO: 1252655 - RNA, 15 nt, Homo sapiens
uaaggagacugaggc

SEQ ID NO: 1252656 - RNA, 14 nt, Homo sapiens
uaaggaggcacugc

SEQ ID NO: 1252657 - RNA, 18 nt, Homo sapiens
uaaggcagcuaagacaua

SEQ ID NO: 1252658 - RNA, 18 nt, Homo sapiens
uaagggauuucuuagggg

SEQ ID NO: 1252659 - RNA, 14 nt, Homo sapiens
uaagggcagugccc

SEQ ID NO: 1252660 - RNA, 23 nt, Homo sapiens
uaaggggggcagggagugaugau

SEQ ID NO: 1252661 - RNA, 15 nt, Homo sapiens
uaagggggugcagca

SEQ ID NO: 1252662 - RNA, 18 nt, Homo sapiens
uaagggucgaaagcucua

SEQ ID NO: 1252663 - RNA, 20 nt, Homo sapiens
uaaggguuaguuuacaauca

SEQ ID NO: 1252664 - RNA, 13 nt, Homo sapiens
uaagguacuagca

SEQ ID NO: 1252665 - RNA, 15 nt, Homo sapiens
uaagguaugugcuau

SEQ ID NO: 1252666 - RNA, 15 nt, Homo sapiens
uaaggugaaccaaag

SEQ ID NO: 1252667 - RNA, 17 nt, Homo sapiens
uaagguucuaaggccua

SEQ ID NO: 1252668 - RNA, 19 nt, Homo sapiens
uaaguaaaagcuacuaugu

SEQ ID NO: 1252669 - RNA, 23 nt, Homo sapiens
uaaguaaaagcuacuauguacug

SEQ ID NO: 1252670 - RNA, 15 nt, Homo sapiens
uaaguaacauaacua

SEQ ID NO: 1252671 - RNA, 15 nt, Homo sapiens
uaaguaagacuuuua

SEQ ID NO: 1252672 - RNA, 17 nt, Homo sapiens
uaaguaccacucaggcc

SEQ ID NO: 1252673 - RNA, 14 nt, Homo sapiens
uaaguaucagaggu

SEQ ID NO: 1252674 - RNA, 16 nt, Homo sapiens
uaagucacaaagaguu

SEQ ID NO: 1252675 - RNA, 16 nt, Homo sapiens
uaagucaccuguauaa

SEQ ID NO: 1252676 - RNA, 17 nt, Homo sapiens
uaagucagguucuuuac

SEQ ID NO: 1252677 - RNA, 19 nt, Homo sapiens
uaagucagguucuuuacaa

SEQ ID NO: 1252678 - RNA, 19 nt, Homo sapiens
uaagucccaguauaccuca

SEQ ID NO: 1252679 - RNA, 16 nt, Homo sapiens
uaagucuuuacucuga

SEQ ID NO: 1252680 - RNA, 11 nt, Homo sapiens
uaagugucacc

SEQ ID NO: 1252681 - RNA, 23 nt, Homo sapiens
uauuaauaugaguuacugaaggu

SEQ ID NO: 1252682 - RNA, 13 nt, Homo sapiens
uauuaaucaccuc

SEQ ID NO: 1252683 - RNA, 15 nt, Homo sapiens
uauuaauuuccacua

SEQ ID NO: 1252684 - RNA, 20 nt, Homo sapiens
uauuaauuuuccaaugcaca

SEQ ID NO: 1252685 - RNA, 12 nt, Homo sapiens
uauuaauuuugc

SEQ ID NO: 1252686 - RNA, 15 nt, Homo sapiens
uauuacagcauuuga

SEQ ID NO: 1252687 - RNA, 20 nt, Homo sapiens
uauuaccagguccauuuugc

SEQ ID NO: 1252688 - RNA, 22 nt, Homo sapiens
uauuaccuccccuacucccuua

SEQ ID NO: 1252689 - RNA, 17 nt, Homo sapiens
uauuagauaaauuucaa

SEQ ID NO: 1252690 - RNA, 19 nt, Homo sapiens
uauuaggaaauucugauga

SEQ ID NO: 1252691 - RNA, 20 nt, Homo sapiens
uauuaggaaauucugaugag

SEQ ID NO: 1252692 - RNA, 15 nt, Homo sapiens
uauuauacuaagaaa

SEQ ID NO: 1252693 - RNA, 22 nt, Homo sapiens
uauuauccuagauuauaucaaa

SEQ ID NO: 1252694 - RNA, 22 nt, Homo sapiens
uauuaucuacaaacacugcaga

SEQ ID NO: 1252695 - RNA, 14 nt, Homo sapiens
uauuaugcauauau

SEQ ID NO: 1252696 - RNA, 18 nt, Homo sapiens
uauuaugccugaaugacu

SEQ ID NO: 1252697 - RNA, 14 nt, Homo sapiens
uauuaugucucaaa

SEQ ID NO: 1252698 - RNA, 16 nt, Homo sapiens
uauuauguuccucaag

SEQ ID NO: 1252699 - RNA, 17 nt, Homo sapiens
uauuauucuucauaaca

SEQ ID NO: 1252700 - RNA, 18 nt, Homo sapiens
uauuauucuucauaacaa

SEQ ID NO: 1252701 - RNA, 19 nt, Homo sapiens
uauuauugaagauuuacca

SEQ ID NO: 1252702 - RNA, 24 nt, Homo sapiens
uauuauugguuguuguauugauca

SEQ ID NO: 1252703 - RNA, 15 nt, Homo sapiens
uauuauuuugcacug

SEQ ID NO: 1252704 - RNA, 21 nt, Homo sapiens
uauucagauauaaaacaguuu

SEQ ID NO: 1252705 - RNA, 16 nt, Homo sapiens
uauuccaaaccaaauu

SEQ ID NO: 1252706 - RNA, 21 nt, Homo sapiens
uauucccaaaaauuacuuugg

SEQ ID NO: 1252707 - RNA, 18 nt, Homo sapiens
uauucccaagcccaugag

SEQ ID NO: 1252708 - RNA, 14 nt, Homo sapiens
uauuccccauuucc

SEQ ID NO: 1252709 - RNA, 21 nt, Homo sapiens
uauucccugucacuacacacu

SEQ ID NO: 1252710 - RNA, 21 nt, Homo sapiens
uauuccuccaaaucucuugcu

SEQ ID NO: 1252711 - RNA, 15 nt, Homo sapiens
uauuccuuugccaau

SEQ ID NO: 1252712 - RNA, 18 nt, Homo sapiens
uauucuaagccaguuuuc

SEQ ID NO: 1252713 - RNA, 20 nt, Homo sapiens
uauucuaagcccuuugccau

SEQ ID NO: 1252714 - RNA, 20 nt, Homo sapiens
uauucucccacugacagaaa

SEQ ID NO: 1252715 - RNA, 13 nt, Homo sapiens
uauucuccccacc

SEQ ID NO: 1252716 - RNA, 15 nt, Homo sapiens
uauucugauuccacu

SEQ ID NO: 1252717 - RNA, 21 nt, Homo sapiens
uauucugggcaccacaaaaua

SEQ ID NO: 1252718 - RNA, 17 nt, Homo sapiens
uauucugguagcaaauu

SEQ ID NO: 1252719 - RNA, 16 nt, Homo sapiens
ucacaagaaaacuaua

SEQ ID NO: 1252720 - RNA, 17 nt, Homo sapiens
ucacaagaaaacuauaa

SEQ ID NO: 1252721 - RNA, 21 nt, Homo sapiens
ucacaagggauuggcaauugu

SEQ ID NO: 1252722 - RNA, 16 nt, Homo sapiens
ucacaagggcucucaa

SEQ ID NO: 1252723 - RNA, 17 nt, Homo sapiens
ucacaaguacuaucugu

SEQ ID NO: 1252724 - RNA, 20 nt, Homo sapiens
ucacaauaccucaugcuuca

SEQ ID NO: 1252725 - RNA, 15 nt, Homo sapiens
ucacaaugagauuga

SEQ ID NO: 1252726 - RNA, 19 nt, Homo sapiens
ucacaaugucaguauuuca

SEQ ID NO: 1252727 - RNA, 24 nt, Homo sapiens
ucacaaugucccuucagcaccuga

SEQ ID NO: 1252728 - RNA, 21 nt, Homo sapiens
ucacacacacagcugggcaaa

SEQ ID NO: 1252729 - RNA, 12 nt, Homo sapiens
ucacacagugaa

SEQ ID NO: 1252730 - RNA, 12 nt, Homo sapiens
ucacacauucag

SEQ ID NO: 1252731 - RNA, 11 nt, Homo sapiens
ucacacuguau

SEQ ID NO: 1252732 - RNA, 13 nt, Homo sapiens
ucacacugugcuc

SEQ ID NO: 1252733 - RNA, 22 nt, Homo sapiens
ucacagaaaguucuuaaacuca

SEQ ID NO: 1252734 - RNA, 19 nt, Homo sapiens
ucacagaacuauguacuuu

SEQ ID NO: 1252735 - RNA, 13 nt, Homo sapiens
ucacagacuggca

SEQ ID NO: 1252736 - RNA, 17 nt, Homo sapiens
ucacagaguagaaacuc

SEQ ID NO: 1252737 - RNA, 15 nt, Homo sapiens
ucacagagugcauug

SEQ ID NO: 1252738 - RNA, 18 nt, Homo sapiens
ucacagagugcauuguga

SEQ ID NO: 1252739 - RNA, 14 nt, Homo sapiens
ucacaggacauuaa

SEQ ID NO: 1252740 - RNA, 22 nt, Homo sapiens
ucacaggacauuaaggaccaau

SEQ ID NO: 1252741 - RNA, 21 nt, Homo sapiens
ucacaggcagguccaggguuu

SEQ ID NO: 1252742 - RNA, 17 nt, Homo sapiens
ucacaggccccaggaaa

SEQ ID NO: 1252743 - RNA, 12 nt, Homo sapiens
ucacagggccaa

SEQ ID NO: 1252744 - RNA, 18 nt, Homo sapiens
ucacaguugacaaaaagc

SEQ ID NO: 1252745 - RNA, 17 nt, Homo sapiens
ucacaguugauacauag

SEQ ID NO: 1252746 - RNA, 17 nt, Homo sapiens
ucacauaaugcucauac

SEQ ID NO: 1252747 - RNA, 23 nt, Homo sapiens
ucacauaaugcucauacuuaucu

SEQ ID NO: 1252748 - RNA, 22 nt, Homo sapiens
ucacauccuaccccuuugcacu

SEQ ID NO: 1252749 - RNA, 13 nt, Homo sapiens
ucacaucugucac

SEQ ID NO: 1252750 - RNA, 14 nt, Homo sapiens
ucacaugaccugau

SEQ ID NO: 1252751 - RNA, 15 nt, Homo sapiens
ucacaugaugcauac

SEQ ID NO: 1252752 - RNA, 18 nt, Homo sapiens
ucacauggccuaugcaca

SEQ ID NO: 1252753 - RNA, 23 nt, Homo sapiens
ucacauucuauuuuggguauuaa

SEQ ID NO: 1252754 - RNA, 15 nt, Homo sapiens
ucacauucuuuccaa

SEQ ID NO: 1252755 - RNA, 22 nt, Homo sapiens
ucacauugugugaauacuggaa

SEQ ID NO: 1252756 - RNA, 23 nt, Homo sapiens
uccaccuguggguguagccaggu

SEQ ID NO: 1252757 - RNA, 16 nt, Homo sapiens
uccaccuuccaaagga

SEQ ID NO: 1252758 - RNA, 14 nt, Homo sapiens
uccacgaagccuua

SEQ ID NO: 1252759 - RNA, 14 nt, Homo sapiens
uccacgauggugga

SEQ ID NO: 1252760 - RNA, 20 nt, Homo sapiens
uccacuaggguccaccagga

SEQ ID NO: 1252761 - RNA, 23 nt, Homo sapiens
uccacucggggguggagugagac

SEQ ID NO: 1252762 - RNA, 11 nt, Homo sapiens
uccacuuagaa

SEQ ID NO: 1252763 - RNA, 19 nt, Homo sapiens
uccacuuggucugugagau

SEQ ID NO: 1252764 - RNA, 14 nt, Homo sapiens
uccagaacacggcu

SEQ ID NO: 1252765 - RNA, 14 nt, Homo sapiens
uccagaacugcacu

SEQ ID NO: 1252766 - RNA, 15 nt, Homo sapiens
uccagaagaucugaa

SEQ ID NO: 1252767 - RNA, 12 nt, Homo sapiens
uccagacuguaa

SEQ ID NO: 1252768 - RNA, 20 nt, Homo sapiens
uccagacuuccuugagacac

SEQ ID NO: 1252769 - RNA, 14 nt, Homo sapiens
uccagagaaaagag

SEQ ID NO: 1252770 - RNA, 14 nt, Homo sapiens
uccagagcugagau

SEQ ID NO: 1252771 - RNA, 15 nt, Homo sapiens
uccagaucacugcca

SEQ ID NO: 1252772 - RNA, 20 nt, Homo sapiens
uccagauugggugccagcau

SEQ ID NO: 1252773 - RNA, 23 nt, Homo sapiens
uccagcaaaagagcuauugccaa

SEQ ID NO: 1252774 - RNA, 11 nt, Homo sapiens
uccagcaccuu

SEQ ID NO: 1252775 - RNA, 22 nt, Homo sapiens
uccagccaaccucauugcagcu

SEQ ID NO: 1252776 - RNA, 20 nt, Homo sapiens
uccagcccagacccagugga

SEQ ID NO: 1252777 - RNA, 15 nt, Homo sapiens
uccagccccagacaa

SEQ ID NO: 1252778 - RNA, 17 nt, Homo sapiens
uccagccgccauugcca

SEQ ID NO: 1252779 - RNA, 16 nt, Homo sapiens
uccagccugggggaca

SEQ ID NO: 1252780 - RNA, 20 nt, Homo sapiens
uccagcgugacggagcccac

SEQ ID NO: 1252781 - RNA, 14 nt, Homo sapiens
uccagcuccuguaa

SEQ ID NO: 1252782 - RNA, 20 nt, Homo sapiens
uccagcuuauagucuuccag

SEQ ID NO: 1252783 - RNA, 15 nt, Homo sapiens
uccagcuuucugcca

SEQ ID NO: 1252784 - RNA, 14 nt, Homo sapiens
uccaggaaggcagc

SEQ ID NO: 1252785 - RNA, 18 nt, Homo sapiens
uccaggacuccacuggac

SEQ ID NO: 1252786 - RNA, 16 nt, Homo sapiens
uccaggagagagccag

SEQ ID NO: 1252787 - RNA, 17 nt, Homo sapiens
uccaggaucuccacuga

SEQ ID NO: 1252788 - RNA, 14 nt, Homo sapiens
uccaggaucuuuga

SEQ ID NO: 1252789 - RNA, 20 nt, Homo sapiens
uccaggaugaguuacuugaa

SEQ ID NO: 1252790 - RNA, 12 nt, Homo sapiens
uccaggcacuca

SEQ ID NO: 1252791 - RNA, 18 nt, Homo sapiens
uccaggcccaacugugag

SEQ ID NO: 1252792 - RNA, 21 nt, Homo sapiens
uccaggguauggccauggagu

SEQ ID NO: 1252793 - RNA, 17 nt, Homo sapiens
uccagguguuacuguaa

SEQ ID NO: 1252794 - RNA, 16 nt, Homo sapiens
uccagguuaguuuacu

SEQ ID NO: 1252795 - RNA, 21 nt, Homo sapiens
uccagguucucuuagagccau

SEQ ID NO: 1252796 - RNA, 12 nt, Homo sapiens
uccaguacuuga

SEQ ID NO: 1252797 - RNA, 18 nt, Homo sapiens
uccaguagaaagcauaac

SEQ ID NO: 1252798 - RNA, 17 nt, Homo sapiens
uccaguauucuugucaa

SEQ ID NO: 1252799 - RNA, 14 nt, Homo sapiens
uccagugcaauugu

SEQ ID NO: 1252800 - RNA, 19 nt, Homo sapiens
uccagugccagcaaugaca

SEQ ID NO: 1252801 - RNA, 23 nt, Homo sapiens
uccagugccaggccagugaccuc

SEQ ID NO: 1252802 - RNA, 15 nt, Homo sapiens
uccagugccuggauc

SEQ ID NO: 1252803 - RNA, 23 nt, Homo sapiens
uccagugggcugaugcugggacc

SEQ ID NO: 1252804 - RNA, 19 nt, Homo sapiens
uccaguuccucuuuugugc

SEQ ID NO: 1252805 - RNA, 22 nt, Homo sapiens
uccaguuuuauaaaaaguggag

SEQ ID NO: 1252806 - RNA, 12 nt, Homo sapiens
uccauaccagcu

SEQ ID NO: 1252807 - RNA, 22 nt, Homo sapiens
uccauaggcgcaggugcacagg

SEQ ID NO: 1252808 - RNA, 21 nt, Homo sapiens
uccauaguucugaggucccug

SEQ ID NO: 1252809 - RNA, 23 nt, Homo sapiens
uccauauguuauaucaacagaua

SEQ ID NO: 1252810 - RNA, 19 nt, Homo sapiens
uccauauuuuuugcacagc

SEQ ID NO: 1252811 - RNA, 21 nt, Homo sapiens
uccaucacuagccaugauaac

SEQ ID NO: 1252812 - RNA, 22 nt, Homo sapiens
uccaucagguuccaucccgaaa

SEQ ID NO: 1252813 - RNA, 15 nt, Homo sapiens
uccaucgccuugcag

SEQ ID NO: 1252814 - RNA, 14 nt, Homo sapiens
uccaucucccuuag

SEQ ID NO: 1252815 - RNA, 13 nt, Homo sapiens
uccaucucucauc

SEQ ID NO: 1252816 - RNA, 15 nt, Homo sapiens
uccaucuuucacuau

SEQ ID NO: 1252817 - RNA, 16 nt, Homo sapiens
uccaucuuucacuauc

SEQ ID NO: 1252818 - RNA, 14 nt, Homo sapiens
uccaugaauguauc

SEQ ID NO: 1252819 - RNA, 15 nt, Homo sapiens
uccaugaauucuuga

SEQ ID NO: 1252820 - RNA, 22 nt, Homo sapiens
uccaugauuuuaaauugugauc

SEQ ID NO: 1252821 - RNA, 16 nt, Homo sapiens
uccaugcugccuccag

SEQ ID NO: 1252822 - RNA, 20 nt, Homo sapiens
uccaugggauacaaccuccc

SEQ ID NO: 1252823 - RNA, 12 nt, Homo sapiens
uccauguacuug

SEQ ID NO: 1252824 - RNA, 17 nt, Homo sapiens
uccauguuugcaccugu

SEQ ID NO: 1252825 - RNA, 16 nt, Homo sapiens
uccauuaaguacaugu

SEQ ID NO: 1252826 - RNA, 14 nt, Homo sapiens
uccauucacaccag

SEQ ID NO: 1252827 - RNA, 17 nt, Homo sapiens
uccauucacaccagcua

SEQ ID NO: 1252828 - RNA, 18 nt, Homo sapiens
uccauuccccacuucucu

SEQ ID NO: 1252829 - RNA, 14 nt, Homo sapiens
uccauucuucgaca

SEQ ID NO: 1252830 - RNA, 19 nt, Homo sapiens
uccauuucccacaucuuuc

SEQ ID NO: 1252831 - RNA, 20 nt, Homo sapiens
uccauuuccccuccuuccca

SEQ ID NO: 1252832 - RNA, 19 nt, Homo sapiens
uccauuuugugaauuguga

SEQ ID NO: 1252833 - RNA, 17 nt, Homo sapiens
ucccaaaagucaccacu

SEQ ID NO: 1252834 - RNA, 21 nt, Homo sapiens
ucccaaaagucaccacuccau

SEQ ID NO: 1252835 - RNA, 15 nt, Homo sapiens
ucccaaaccagacac

SEQ ID NO: 1252836 - RNA, 19 nt, Homo sapiens
ucccaaagugcugagauua

SEQ ID NO: 1252837 - RNA, 15 nt, Homo sapiens
ucccaaauaaacucc

SEQ ID NO: 1252838 - RNA, 18 nt, Homo sapiens
ucccaaauaaacuccaga

SEQ ID NO: 1252839 - RNA, 23 nt, Homo sapiens
ucccaaaucaauaagaagguaga

SEQ ID NO: 1252840 - RNA, 19 nt, Homo sapiens
ucccaaaucccucucacaa

SEQ ID NO: 1252841 - RNA, 16 nt, Homo sapiens
ucccaacaacauccau

SEQ ID NO: 1252842 - RNA, 22 nt, Homo sapiens
ucccaacaacauccauguccua

SEQ ID NO: 1252843 - RNA, 15 nt, Homo sapiens
ucccaacacuuugag

SEQ ID NO: 1252844 - RNA, 15 nt, Homo sapiens
ucccaacauaugccc

SEQ ID NO: 1252845 - RNA, 16 nt, Homo sapiens
ucccaaccccagugga

SEQ ID NO: 1252846 - RNA, 21 nt, Homo sapiens
ucccaaugcacauccauuccc

SEQ ID NO: 1252847 - RNA, 20 nt, Homo sapiens
ucccaauuagcuuggccuac

SEQ ID NO: 1252848 - RNA, 18 nt, Homo sapiens
ucccacaacaacaaaagc

SEQ ID NO: 1252849 - RNA, 17 nt, Homo sapiens
ucccacaauauuaccuu

SEQ ID NO: 1252850 - RNA, 18 nt, Homo sapiens
ucccacacccuguuuuac

SEQ ID NO: 1252851 - RNA, 20 nt, Homo sapiens
ucccacacugaaaccaaaac

SEQ ID NO: 1252852 - RNA, 20 nt, Homo sapiens
ucccacaugaggccaucuca

SEQ ID NO: 1252853 - RNA, 14 nt, Homo sapiens
gauacaaacugcag

SEQ ID NO: 1252854 - RNA, 20 nt, Homo sapiens
gauacaaugaacacuuauaa

SEQ ID NO: 1252855 - RNA, 18 nt, Homo sapiens
gauacacuugaaggacca

SEQ ID NO: 1252856 - RNA, 16 nt, Homo sapiens
gauacagaaaugcaaa

SEQ ID NO: 1252857 - RNA, 18 nt, Homo sapiens
gauacaggaaaagcugcu

SEQ ID NO: 1252858 - RNA, 20 nt, Homo sapiens
gauacaugguugugaccuga

SEQ ID NO: 1252859 - RNA, 20 nt, Homo sapiens
gauaccauggcacugacaau

SEQ ID NO: 1252860 - RNA, 21 nt, Homo sapiens
gauaccucaacccccauuucu

SEQ ID NO: 1252861 - RNA, 15 nt, Homo sapiens
gauaccugcacuguc

SEQ ID NO: 1252862 - RNA, 16 nt, Homo sapiens
gauaccugcacugucc

SEQ ID NO: 1252863 - RNA, 13 nt, Homo sapiens
gauacuacuuucu

SEQ ID NO: 1252864 - RNA, 22 nt, Homo sapiens
gauacugccugacaagugccug

SEQ ID NO: 1252865 - RNA, 19 nt, Homo sapiens
gauacugcgacuuucugcc

SEQ ID NO: 1252866 - RNA, 19 nt, Homo sapiens
gauacuugccaaaaugaga

SEQ ID NO: 1252867 - RNA, 16 nt, Homo sapiens
gauacuuugacagugu

SEQ ID NO: 1252868 - RNA, 12 nt, Homo sapiens
gauagacaucag

SEQ ID NO: 1252869 - RNA, 13 nt, Homo sapiens
gauagacaucaga

SEQ ID NO: 1252870 - RNA, 15 nt, Homo sapiens
gauagacaucagaaa

SEQ ID NO: 1252871 - RNA, 15 nt, Homo sapiens
gauagauauaugcuc

SEQ ID NO: 1252872 - RNA, 19 nt, Homo sapiens
gauaguugauucuugccuu

SEQ ID NO: 1252873 - RNA, 15 nt, Homo sapiens
gauaguuuaccugaa

SEQ ID NO: 1252874 - RNA, 20 nt, Homo sapiens
gauauaacacuauguuuauu

SEQ ID NO: 1252875 - RNA, 20 nt, Homo sapiens
gauauaauggauaauuuuca

SEQ ID NO: 1252876 - RNA, 22 nt, Homo sapiens
gauauaugcucugcauguuaca

SEQ ID NO: 1252877 - RNA, 16 nt, Homo sapiens
gauaucaaaagcaaau

SEQ ID NO: 1252878 - RNA, 21 nt, Homo sapiens
gauaucaugccccuguacucc

SEQ ID NO: 1252879 - RNA, 18 nt, Homo sapiens
gauaucuuggcuuugcca

SEQ ID NO: 1252880 - RNA, 18 nt, Homo sapiens
gauauggcacuucuccaa

SEQ ID NO: 1252881 - RNA, 14 nt, Homo sapiens
gauaugggacugag

SEQ ID NO: 1252882 - RNA, 16 nt, Homo sapiens
gauaugggacugagcc

SEQ ID NO: 1252883 - RNA, 18 nt, Homo sapiens
gauauuacuacuuaccau

SEQ ID NO: 1252884 - RNA, 16 nt, Homo sapiens
gauauucagaaguaua

SEQ ID NO: 1252885 - RNA, 21 nt, Homo sapiens
gauauugaugauaacacuuaa

SEQ ID NO: 1252886 - RNA, 16 nt, Homo sapiens
gauauugucagucuuu

SEQ ID NO: 1252887 - RNA, 18 nt, Homo sapiens
gauauuuauuuuuugcca

SEQ ID NO: 1252888 - RNA, 17 nt, Homo sapiens
gaucaaauugugcagua

SEQ ID NO: 1252889 - RNA, 19 nt, Homo sapiens
gaucaacucugucuugggc

SEQ ID NO: 1252890 - RNA, 20 nt, Homo sapiens
gaucaaugcauguuacccau

SEQ ID NO: 1252891 - RNA, 17 nt, Homo sapiens
gaucacgccacugcacu

SEQ ID NO: 1252892 - RNA, 17 nt, Homo sapiens
gaucacuaaaguauauc

SEQ ID NO: 1252893 - RNA, 18 nt, Homo sapiens
gaucacuagccugucauc

SEQ ID NO: 1252894 - RNA, 18 nt, Homo sapiens
gaucagagcgcacaggga

SEQ ID NO: 1252895 - RNA, 14 nt, Homo sapiens
gaucagaugaacuc

SEQ ID NO: 1252896 - RNA, 19 nt, Homo sapiens
gaucagcaaaccggggccu

SEQ ID NO: 1252897 - RNA, 17 nt, Homo sapiens
gaucagcaucugugaug

SEQ ID NO: 1252898 - RNA, 17 nt, Homo sapiens
gaucagcccugccaggu

SEQ ID NO: 1252899 - RNA, 17 nt, Homo sapiens
gaucaguguuacugccu

SEQ ID NO: 1252900 - RNA, 21 nt, Homo sapiens
gaucauauuucacaauccugu

SEQ ID NO: 1252901 - RNA, 15 nt, Homo sapiens
gaucaucuuugccac

SEQ ID NO: 1252902 - RNA, 23 nt, Homo sapiens
gaucaucuuugccaccaccuggg

SEQ ID NO: 1252903 - RNA, 20 nt, Homo sapiens
gaucaugccacuacacucca

SEQ ID NO: 1252904 - RNA, 21 nt, Homo sapiens
gaucauuuguuggaaugaauu

SEQ ID NO: 1252905 - RNA, 21 nt, Homo sapiens
gauccaauggaauacugaaaa

SEQ ID NO: 1252906 - RNA, 17 nt, Homo sapiens
gauccagaacugcacuc

SEQ ID NO: 1252907 - RNA, 15 nt, Homo sapiens
gauccagacuguaag

SEQ ID NO: 1252908 - RNA, 18 nt, Homo sapiens
gaucccaagacaaugaaa

SEQ ID NO: 1252909 - RNA, 20 nt, Homo sapiens
gauccccaaaacaggccagg

SEQ ID NO: 1252910 - RNA, 16 nt, Homo sapiens
gauccccacuguccua

SEQ ID NO: 1252911 - RNA, 21 nt, Homo sapiens
gauccccacuguccuaccagu

SEQ ID NO: 1252912 - RNA, 21 nt, Homo sapiens
gauccccggggcggcaggaag

SEQ ID NO: 1252913 - RNA, 12 nt, Homo sapiens
gaucccugacau

SEQ ID NO: 1252914 - RNA, 14 nt, Homo sapiens
gauccgagucuacc

SEQ ID NO: 1252915 - RNA, 14 nt, Homo sapiens
gauccggucugccu

SEQ ID NO: 1252916 - RNA, 16 nt, Homo sapiens
gauccucccaccucag

SEQ ID NO: 1252917 - RNA, 13 nt, Homo sapiens
gauccucuacugu

SEQ ID NO: 1252918 - RNA, 15 nt, Homo sapiens
gauccugggggacca

SEQ ID NO: 1252919 - RNA, 14 nt, Homo sapiens
gauccuucaaagag

SEQ ID NO: 1252920 - RNA, 15 nt, Homo sapiens
gauccuucaaagagu

SEQ ID NO: 1252921 - RNA, 18 nt, Homo sapiens
gaucgagccacugcacuc

SEQ ID NO: 1252922 - RNA, 14 nt, Homo sapiens
gaucgcaccacugc

SEQ ID NO: 1252923 - RNA, 18 nt, Homo sapiens
gaucgccaaccuuucccc

SEQ ID NO: 1252924 - RNA, 21 nt, Homo sapiens
gaucgugggccgcacuggggc

SEQ ID NO: 1252925 - RNA, 22 nt, Homo sapiens
gaucucauaaugcuuuguuaaa

SEQ ID NO: 1252926 - RNA, 20 nt, Homo sapiens
gaucuccagcucuaacaaaa

SEQ ID NO: 1252927 - RNA, 17 nt, Homo sapiens
gaucuccauauguuaca

SEQ ID NO: 1252928 - RNA, 15 nt, Homo sapiens
gaucuccugaccucg

SEQ ID NO: 1252929 - RNA, 18 nt, Homo sapiens
gaucucggcucacugcaa

SEQ ID NO: 1252930 - RNA, 21 nt, Homo sapiens
gaucucuucuuuuggcuucca

SEQ ID NO: 1252931 - RNA, 14 nt, Homo sapiens
gaucugaacacagu

SEQ ID NO: 1252932 - RNA, 15 nt, Homo sapiens
gaucugauaagcaag

SEQ ID NO: 1252933 - RNA, 17 nt, Homo sapiens
gaucuggucccuugcag

SEQ ID NO: 1252934 - RNA, 11 nt, Homo sapiens
gaucugugaua

SEQ ID NO: 1252935 - RNA, 13 nt, Homo sapiens
gaucugugauagu

SEQ ID NO: 1252936 - RNA, 19 nt, Homo sapiens
gaucuguuuugaaggcaaa

SEQ ID NO: 1252937 - RNA, 20 nt, Homo sapiens
gaucuuaaagcauuccccaa

SEQ ID NO: 1252938 - RNA, 23 nt, Homo sapiens
gaucuuccguggucagagugcca

SEQ ID NO: 1252939 - RNA, 23 nt, Homo sapiens
gaucuucuucauccaacuuccaa

SEQ ID NO: 1252940 - RNA, 15 nt, Homo sapiens
gaucuuuacucuuga

SEQ ID NO: 1252941 - RNA, 22 nt, Homo sapiens
gaucuuucucaaucuugaacuc

SEQ ID NO: 1252942 - RNA, 18 nt, Homo sapiens
gaucuuucugcaggaaau

SEQ ID NO: 1252943 - RNA, 19 nt, Homo sapiens
gaucuuucuuuccaaaaca

SEQ ID NO: 1252944 - RNA, 16 nt, Homo sapiens
gaucuuucuuuuccca

SEQ ID NO: 1252945 - RNA, 19 nt, Homo sapiens
gaugaaaaugaaucuucac

SEQ ID NO: 1252946 - RNA, 14 nt, Homo sapiens
gaugaaacuccuga

SEQ ID NO: 1252947 - RNA, 16 nt, Homo sapiens
gaugaaauaacuccuu

SEQ ID NO: 1252948 - RNA, 20 nt, Homo sapiens
gaugaaauuuucuagacuuu

SEQ ID NO: 1252949 - RNA, 22 nt, Homo sapiens
gaugaaccugagcgggugccga

SEQ ID NO: 1252950 - RNA, 21 nt, Homo sapiens
gaugaagacccuauuucagaa

SEQ ID NO: 1252951 - RNA, 15 nt, Homo sapiens
gaugaaucauauuca

SEQ ID NO: 1252952 - RNA, 12 nt, Homo sapiens
gaugacauuccc

SEQ ID NO: 1252953 - RNA, 14 nt, Homo sapiens
gaugacccacuguc

SEQ ID NO: 1252954 - RNA, 17 nt, Homo sapiens
gaugacuuugagauuau

SEQ ID NO: 1252955 - RNA, 16 nt, Homo sapiens
gaugagaaucaugcac

SEQ ID NO: 1252956 - RNA, 17 nt, Homo sapiens
gaugagcaagacauacu

SEQ ID NO: 1252957 - RNA, 15 nt, Homo sapiens
gaugaggcacuggaa

SEQ ID NO: 1252958 - RNA, 17 nt, Homo sapiens
gaugaggcuggccaagc

SEQ ID NO: 1252959 - RNA, 15 nt, Homo sapiens
gaugauauucucacc

SEQ ID NO: 1252960 - RNA, 16 nt, Homo sapiens
gaugauggaugccaau

SEQ ID NO: 1252961 - RNA, 14 nt, Homo sapiens
gaugcaagugcaac

SEQ ID NO: 1252962 - RNA, 15 nt, Homo sapiens
gaugcaauacaagau

SEQ ID NO: 1252963 - RNA, 13 nt, Homo sapiens
gaugcacauuucu

SEQ ID NO: 1252964 - RNA, 22 nt, Homo sapiens
gaugcacuauauguuuacacaa

SEQ ID NO: 1252965 - RNA, 17 nt, Homo sapiens
gaugcacuuauucaaua

SEQ ID NO: 1252966 - RNA, 20 nt, Homo sapiens
gaugcagcucuugggaccgu

SEQ ID NO: 1252967 - RNA, 21 nt, Homo sapiens
gaugcaucacuggguguugau

SEQ ID NO: 1252968 - RNA, 17 nt, Homo sapiens
gaugccagggcuggaag

SEQ ID NO: 1252969 - RNA, 13 nt, Homo sapiens
gaugccauaugcc

SEQ ID NO: 1252970 - RNA, 16 nt, Homo sapiens
gaugccauaugccuug

SEQ ID NO: 1252971 - RNA, 22 nt, Homo sapiens
gaugccgagguaaaaguucuuu

SEQ ID NO: 1252972 - RNA, 21 nt, Homo sapiens
gaauauuuauaaaugagcaaa

SEQ ID NO: 1252973 - RNA, 18 nt, Homo sapiens
gaaucaaaucucuuccac

SEQ ID NO: 1252974 - RNA, 22 nt, Homo sapiens
gaaucaaucuuuaacaaccucu

SEQ ID NO: 1252975 - RNA, 16 nt, Homo sapiens
gaaucaauucaauuug

SEQ ID NO: 1252976 - RNA, 12 nt, Homo sapiens
gaaucacuggaa

SEQ ID NO: 1252977 - RNA, 17 nt, Homo sapiens
gaaucacuggcuguuaa

SEQ ID NO: 1252978 - RNA, 15 nt, Homo sapiens
gaaucagaccugguu

SEQ ID NO: 1252979 - RNA, 20 nt, Homo sapiens
gaaucaggaauauuuuccaa

SEQ ID NO: 1252980 - RNA, 18 nt, Homo sapiens
gaaucagucuauccacag

SEQ ID NO: 1252981 - RNA, 20 nt, Homo sapiens
gaaucagugaagaugccagu

SEQ ID NO: 1252982 - RNA, 19 nt, Homo sapiens
gaaucauauucauaugcag

SEQ ID NO: 1252983 - RNA, 12 nt, Homo sapiens
gaauccaagcuc

SEQ ID NO: 1252984 - RNA, 21 nt, Homo sapiens
gaauccagaccaaccuuccau

SEQ ID NO: 1252985 - RNA, 20 nt, Homo sapiens
gaauccauaaauguguuccu

SEQ ID NO: 1252986 - RNA, 16 nt, Homo sapiens
gaauccuggcagccca

SEQ ID NO: 1252987 - RNA, 20 nt, Homo sapiens
gaauccuuggggagcacuug

SEQ ID NO: 1252988 - RNA, 23 nt, Homo sapiens
gaauccuuuggugccaacuggug

SEQ ID NO: 1252989 - RNA, 15 nt, Homo sapiens
gaaucucugugccuu

SEQ ID NO: 1252990 - RNA, 20 nt, Homo sapiens
gaaucugaauguaauuugug

SEQ ID NO: 1252991 - RNA, 22 nt, Homo sapiens
gaaucuucaagaccaaagcaga

SEQ ID NO: 1252992 - RNA, 20 nt, Homo sapiens
gaaucuucacaaaacacuuc

SEQ ID NO: 1252993 - RNA, 11 nt, Homo sapiens
gaaucuucucu

SEQ ID NO: 1252994 - RNA, 19 nt, Homo sapiens
gaaucuuugucagcaguuc

SEQ ID NO: 1252995 - RNA, 13 nt, Homo sapiens
gaaugaaacugau

SEQ ID NO: 1252996 - RNA, 15 nt, Homo sapiens
gaaugaaagacugaa

SEQ ID NO: 1252997 - RNA, 23 nt, Homo sapiens
gaaugaaagauuaaacagaugau

SEQ ID NO: 1252998 - RNA, 14 nt, Homo sapiens
gaaugaacacuccc

SEQ ID NO: 1252999 - RNA, 22 nt, Homo sapiens
gaaugaacuaugucgaugcaca

SEQ ID NO: 1253000 - RNA, 21 nt, Homo sapiens
gaaugacuccaccuucucacc

SEQ ID NO: 1253001 - RNA, 20 nt, Homo sapiens
gaaugaucagcaucugugau

SEQ ID NO: 1253002 - RNA, 15 nt, Homo sapiens
gaaugauucauguua

SEQ ID NO: 1253003 - RNA, 13 nt, Homo sapiens
gaaugcagugaca

SEQ ID NO: 1253004 - RNA, 15 nt, Homo sapiens
gaaugccacugccuu

SEQ ID NO: 1253005 - RNA, 21 nt, Homo sapiens
gaauggagggaaugcucagaa

SEQ ID NO: 1253006 - RNA, 17 nt, Homo sapiens
gaauggauuuaucagaa

SEQ ID NO: 1253007 - RNA, 20 nt, Homo sapiens
gaaugggcuugaaacauuau

SEQ ID NO: 1253008 - RNA, 19 nt, Homo sapiens
gaauggggaucacagagac

SEQ ID NO: 1253009 - RNA, 14 nt, Homo sapiens
gaaugguguaggaa

SEQ ID NO: 1253010 - RNA, 15 nt, Homo sapiens
gaauguggucucagg

SEQ ID NO: 1253011 - RNA, 16 nt, Homo sapiens
gaauguggucucagga

SEQ ID NO: 1253012 - RNA, 23 nt, Homo sapiens
gaauguguggccugcacagugaa

SEQ ID NO: 1253013 - RNA, 20 nt, Homo sapiens
gaauguuagauuccucuugc

SEQ ID NO: 1253014 - RNA, 21 nt, Homo sapiens
gaauuaacaauaaaaguguga

SEQ ID NO: 1253015 - RNA, 15 nt, Homo sapiens
gaauuaacagagauu

SEQ ID NO: 1253016 - RNA, 23 nt, Homo sapiens
gaauuaagacgguuaaauacugu

SEQ ID NO: 1253017 - RNA, 13 nt, Homo sapiens
gaauuaagcacag

SEQ ID NO: 1253018 - RNA, 17 nt, Homo sapiens
gaauuacacugugccuu

SEQ ID NO: 1253019 - RNA, 20 nt, Homo sapiens
gaauuacaguacacaucccc

SEQ ID NO: 1253020 - RNA, 20 nt, Homo sapiens
gaauuaugucguaagucacu

SEQ ID NO: 1253021 - RNA, 17 nt, Homo sapiens
gaauuauuguaccauuu

SEQ ID NO: 1253022 - RNA, 20 nt, Homo sapiens
gaauuauuuugaaugucaca

SEQ ID NO: 1253023 - RNA, 16 nt, Homo sapiens
gaauucaaacuggggc

SEQ ID NO: 1253024 - RNA, 15 nt, Homo sapiens
gaauucacgccucuc

SEQ ID NO: 1253025 - RNA, 17 nt, Homo sapiens
gaauucagugccuucaa

SEQ ID NO: 1253026 - RNA, 21 nt, Homo sapiens
gaauucauuuucaucacuggg

SEQ ID NO: 1253027 - RNA, 15 nt, Homo sapiens
gaauuccagugccag

SEQ ID NO: 1253028 - RNA, 13 nt, Homo sapiens
gaauuccuaacuu

SEQ ID NO: 1253029 - RNA, 18 nt, Homo sapiens
gaauucuaacaagucaua

SEQ ID NO: 1253030 - RNA, 22 nt, Homo sapiens
gaauucuagaggauguaucuca

SEQ ID NO: 1253031 - RNA, 21 nt, Homo sapiens
gaauucugggaauccacagcu

SEQ ID NO: 1253032 - RNA, 13 nt, Homo sapiens
gaauugauuagga

SEQ ID NO: 1253033 - RNA, 18 nt, Homo sapiens
gaauuggccgcugucacu

SEQ ID NO: 1253034 - RNA, 23 nt, Homo sapiens
gaauuguuuccuuauuugcacuu

SEQ ID NO: 1253035 - RNA, 15 nt, Homo sapiens
gaauuuaaggcccaa

SEQ ID NO: 1253036 - RNA, 19 nt, Homo sapiens
gaauuuauuuaaguucaca

SEQ ID NO: 1253037 - RNA, 14 nt, Homo sapiens
gaauuucacaagcu

SEQ ID NO: 1253038 - RNA, 11 nt, Homo sapiens
gaauuuccucu

SEQ ID NO: 1253039 - RNA, 18 nt, Homo sapiens
gaauuugaacagcucacc

SEQ ID NO: 1253040 - RNA, 14 nt, Homo sapiens
gaauuuggaaaucc

SEQ ID NO: 1253041 - RNA, 20 nt, Homo sapiens
gaauuuguuaucaguaagaa

SEQ ID NO: 1253042 - RNA, 15 nt, Homo sapiens
gaauuuuauaaucug

SEQ ID NO: 1253043 - RNA, 21 nt, Homo sapiens
gaauuuuauauucuaagccag

SEQ ID NO: 1253044 - RNA, 19 nt, Homo sapiens
gaauuuucucuaacuucaa

SEQ ID NO: 1253045 - RNA, 16 nt, Homo sapiens
gaauuuuucccuccac

SEQ ID NO: 1253046 - RNA, 14 nt, Homo sapiens
gacaaaacacugug

SEQ ID NO: 1253047 - RNA, 15 nt, Homo sapiens
gacaaaacacugugu

SEQ ID NO: 1253048 - RNA, 17 nt, Homo sapiens
gacaaaacuucuuguca

SEQ ID NO: 1253049 - RNA, 16 nt, Homo sapiens
gacaaaauauuuccca

SEQ ID NO: 1253050 - RNA, 18 nt, Homo sapiens
gacaaaauccaugaacaa

SEQ ID NO: 1253051 - RNA, 11 nt, Homo sapiens
gacaaacugug

SEQ ID NO: 1253052 - RNA, 17 nt, Homo sapiens
gacaaagguuuuccucu

SEQ ID NO: 1253053 - RNA, 22 nt, Homo sapiens
gacaaagugacauuccugaguc

SEQ ID NO: 1253054 - RNA, 21 nt, Homo sapiens
gacaacauuucucaaaugcac

SEQ ID NO: 1253055 - RNA, 12 nt, Homo sapiens
gacaaccaaaac

SEQ ID NO: 1253056 - RNA, 13 nt, Homo sapiens
gacaaccaaaaca

SEQ ID NO: 1253057 - RNA, 18 nt, Homo sapiens
gacaaccucauccaggcu

SEQ ID NO: 1253058 - RNA, 14 nt, Homo sapiens
gacaacgaugaauu

SEQ ID NO: 1253059 - RNA, 15 nt, Homo sapiens
gacaacugugacugu

SEQ ID NO: 1253060 - RNA, 16 nt, Homo sapiens
gacaacugugacugua

SEQ ID NO: 1253061 - RNA, 20 nt, Homo sapiens
gacaagacccccagcacuug

SEQ ID NO: 1253062 - RNA, 14 nt, Homo sapiens
gacaagcacuuugg

SEQ ID NO: 1253063 - RNA, 22 nt, Homo sapiens
gacaagccaacuuguaaauaca

SEQ ID NO: 1253064 - RNA, 22 nt, Homo sapiens
gacaagcugacuuggcacuuaa

SEQ ID NO: 1253065 - RNA, 13 nt, Homo sapiens
gacaaggcccuga

SEQ ID NO: 1253066 - RNA, 14 nt, Homo sapiens
gacaauaaaccucc

SEQ ID NO: 1253067 - RNA, 17 nt, Homo sapiens
gacaauagggcugauaa

SEQ ID NO: 1253068 - RNA, 21 nt, Homo sapiens
gacaauauuccagaucuuuca

SEQ ID NO: 1253069 - RNA, 22 nt, Homo sapiens
gacaaugcugagguuaugaaca

SEQ ID NO: 1253070 - RNA, 15 nt, Homo sapiens
gagacaggagccuag

SEQ ID NO: 1253071 - RNA, 12 nt, Homo sapiens
gagacaggguuu

SEQ ID NO: 1253072 - RNA, 17 nt, Homo sapiens
gagacaggguuucaccg

SEQ ID NO: 1253073 - RNA, 19 nt, Homo sapiens
gagacauguaccuugacca

SEQ ID NO: 1253074 - RNA, 11 nt, Homo sapiens
gagacauguga

SEQ ID NO: 1253075 - RNA, 16 nt, Homo sapiens
gagacaugugacauuu

SEQ ID NO: 1253076 - RNA, 14 nt, Homo sapiens
gagacgacaggcga

SEQ ID NO: 1253077 - RNA, 14 nt, Homo sapiens
gagacgcaggaaug

SEQ ID NO: 1253078 - RNA, 19 nt, Homo sapiens
gagacgcugcacuugacac

SEQ ID NO: 1253079 - RNA, 17 nt, Homo sapiens
gagacguggaaccucug

SEQ ID NO: 1253080 - RNA, 14 nt, Homo sapiens
gagacuccgucuca

SEQ ID NO: 1253081 - RNA, 13 nt, Homo sapiens
gagacucuagggu

SEQ ID NO: 1253082 - RNA, 16 nt, Homo sapiens
gagacucuagggucca

SEQ ID NO: 1253083 - RNA, 18 nt, Homo sapiens
gagacucuaggguccagu

SEQ ID NO: 1253084 - RNA, 15 nt, Homo sapiens
gagacugaagaccag

SEQ ID NO: 1253085 - RNA, 22 nt, Homo sapiens
gagacugacaaccucauccagg

SEQ ID NO: 1253086 - RNA, 21 nt, Homo sapiens
gagacugcagggguccacugu

SEQ ID NO: 1253087 - RNA, 20 nt, Homo sapiens
gagacugggagccacuucuc

SEQ ID NO: 1253088 - RNA, 20 nt, Homo sapiens
gagacuguaaguuacaugaa

SEQ ID NO: 1253089 - RNA, 14 nt, Homo sapiens
gagagaaaucugaa

SEQ ID NO: 1253090 - RNA, 14 nt, Homo sapiens
gagagaaucucaag

SEQ ID NO: 1253091 - RNA, 15 nt, Homo sapiens
gagagagcuuggaau

SEQ ID NO: 1253092 - RNA, 14 nt, Homo sapiens
gagagagugccaug

SEQ ID NO: 1253093 - RNA, 20 nt, Homo sapiens
gagagauggagaagcuagaa

SEQ ID NO: 1253094 - RNA, 14 nt, Homo sapiens
gagagaugguguuu

SEQ ID NO: 1253095 - RNA, 15 nt, Homo sapiens
gagagcagaggucuc

SEQ ID NO: 1253096 - RNA, 16 nt, Homo sapiens
gagagcaggcuggcag

SEQ ID NO: 1253097 - RNA, 17 nt, Homo sapiens
gagagcccagucucccu

SEQ ID NO: 1253098 - RNA, 17 nt, Homo sapiens
gagagccuggugcugcu

SEQ ID NO: 1253099 - RNA, 20 nt, Homo sapiens
gagagcggcugcccgacuca

SEQ ID NO: 1253100 - RNA, 17 nt, Homo sapiens
gagaggacaguggauug

SEQ ID NO: 1253101 - RNA, 14 nt, Homo sapiens
gagaggaugugcaa

SEQ ID NO: 1253102 - RNA, 21 nt, Homo sapiens
gagaggccuggagcccacaac

SEQ ID NO: 1253103 - RNA, 15 nt, Homo sapiens
gagaggcucugagaa

SEQ ID NO: 1253104 - RNA, 14 nt, Homo sapiens
gagaggcuuuccaa

SEQ ID NO: 1253105 - RNA, 19 nt, Homo sapiens
gagagggaccaugugucac

SEQ ID NO: 1253106 - RNA, 15 nt, Homo sapiens
gagagggccuuuccu

SEQ ID NO: 1253107 - RNA, 18 nt, Homo sapiens
gagaggggacucaaacag

SEQ ID NO: 1253108 - RNA, 22 nt, Homo sapiens
gagaguagaugguuugagccug

SEQ ID NO: 1253109 - RNA, 20 nt, Homo sapiens
gagagucccacugccucagg

SEQ ID NO: 1253110 - RNA, 12 nt, Homo sapiens
gagaguccugug

SEQ ID NO: 1253111 - RNA, 14 nt, Homo sapiens
gagagugaaaccau

SEQ ID NO: 1253112 - RNA, 16 nt, Homo sapiens
gagaguggcuccuccc

SEQ ID NO: 1253113 - RNA, 21 nt, Homo sapiens
gagagugguuagaaggcuucu

SEQ ID NO: 1253114 - RNA, 19 nt, Homo sapiens
gagaguuugccuguucuau

SEQ ID NO: 1253115 - RNA, 17 nt, Homo sapiens
gagauaggggcagauag

SEQ ID NO: 1253116 - RNA, 16 nt, Homo sapiens
gagauauuugguacca

SEQ ID NO: 1253117 - RNA, 18 nt, Homo sapiens
gagauauuugguaccaug

SEQ ID NO: 1253118 - RNA, 22 nt, Homo sapiens
gagauauuugguaccauggugu

SEQ ID NO: 1253119 - RNA, 13 nt, Homo sapiens
gagauccugcaca

SEQ ID NO: 1253120 - RNA, 20 nt, Homo sapiens
gagaucgcaucauugcacuc

SEQ ID NO: 1253121 - RNA, 20 nt, Homo sapiens
gagaucgcgccacugcacuc

SEQ ID NO: 1253122 - RNA, 19 nt, Homo sapiens
gagaucgugcuacugcacu

SEQ ID NO: 1253123 - RNA, 21 nt, Homo sapiens
gagaucguuguuuacagugua

SEQ ID NO: 1253124 - RNA, 21 nt, Homo sapiens
gagaucuaaggaugucacagg

SEQ ID NO: 1253125 - RNA, 17 nt, Homo sapiens
gagaucuuucuuuccaa

SEQ ID NO: 1253126 - RNA, 14 nt, Homo sapiens
gagaugacagggaa

SEQ ID NO: 1253127 - RNA, 20 nt, Homo sapiens
gagaugcugguaauggccau

SEQ ID NO: 1253128 - RNA, 20 nt, Homo sapiens
gagauggaaguugcagugag

SEQ ID NO: 1253129 - RNA, 18 nt, Homo sapiens
gagauguccauagucaaa

SEQ ID NO: 1253130 - RNA, 17 nt, Homo sapiens
gagauugcaccacugca

SEQ ID NO: 1253131 - RNA, 18 nt, Homo sapiens
gagauuguuguuugccau

SEQ ID NO: 1253132 - RNA, 13 nt, Homo sapiens
gagauuuugcaau

SEQ ID NO: 1253133 - RNA, 19 nt, Homo sapiens
gagcaaaaucgaugcagug

SEQ ID NO: 1253134 - RNA, 20 nt, Homo sapiens
gagcaaagacguggggcccc

SEQ ID NO: 1253135 - RNA, 21 nt, Homo sapiens
gagcaaaucaucugcauuccu

SEQ ID NO: 1253136 - RNA, 12 nt, Homo sapiens
gagcaaccucuc

SEQ ID NO: 1253137 - RNA, 23 nt, Homo sapiens
gagcaaugggaauggcauuauug

SEQ ID NO: 1253138 - RNA, 15 nt, Homo sapiens
gagcacagcucagga

SEQ ID NO: 1253139 - RNA, 21 nt, Homo sapiens
gagcacaggucccaccuccag

SEQ ID NO: 1253140 - RNA, 16 nt, Homo sapiens
gagcacccuacaggga

SEQ ID NO: 1253141 - RNA, 20 nt, Homo sapiens
gagcaccuuugcacaggaug

SEQ ID NO: 1253142 - RNA, 18 nt, Homo sapiens
gagcacucauuccuuccc

SEQ ID NO: 1253143 - RNA, 17 nt, Homo sapiens
gagcacuggagugcagg

SEQ ID NO: 1253144 - RNA, 22 nt, Homo sapiens
gagcacuguccaguauucuacc

SEQ ID NO: 1253145 - RNA, 11 nt, Homo sapiens
gagcacuguga

SEQ ID NO: 1253146 - RNA, 15 nt, Homo sapiens
gagcagaaacagcca

SEQ ID NO: 1253147 - RNA, 17 nt, Homo sapiens
gagcagaagaucaagga

SEQ ID NO: 1253148 - RNA, 15 nt, Homo sapiens
gagcagaugaugcca

SEQ ID NO: 1253149 - RNA, 14 nt, Homo sapiens
gagcagcagcacca

SEQ ID NO: 1253150 - RNA, 14 nt, Homo sapiens
gagcagccaggugg

SEQ ID NO: 1253151 - RNA, 15 nt, Homo sapiens
gagcagcuucuggga

SEQ ID NO: 1253152 - RNA, 19 nt, Homo sapiens
gagcagcuucugggaccau

SEQ ID NO: 1253153 - RNA, 15 nt, Homo sapiens
gagcaggaacaauga

SEQ ID NO: 1253154 - RNA, 16 nt, Homo sapiens
gagcaggaacaaugac

SEQ ID NO: 1253155 - RNA, 16 nt, Homo sapiens
gagcaggaagcauuca

SEQ ID NO: 1253156 - RNA, 17 nt, Homo sapiens
gagcaggaagcauucag

SEQ ID NO: 1253157 - RNA, 11 nt, Homo sapiens
gagcagggauu

SEQ ID NO: 1253158 - RNA, 16 nt, Homo sapiens
gagcauaccacuugaa

SEQ ID NO: 1253159 - RNA, 21 nt, Homo sapiens
gagcauagcagaggggccagg

SEQ ID NO: 1253160 - RNA, 14 nt, Homo sapiens
gagcaucugcagua

SEQ ID NO: 1253161 - RNA, 12 nt, Homo sapiens
gagcaucuggcu

SEQ ID NO: 1253162 - RNA, 16 nt, Homo sapiens
gagccaaagaacaaau

SEQ ID NO: 1253163 - RNA, 17 nt, Homo sapiens
gagccaaguggggcccu

SEQ ID NO: 1253164 - RNA, 23 nt, Homo sapiens
gagccaauugauuucaacagaau

SEQ ID NO: 1253165 - RNA, 17 nt, Homo sapiens
gagccaccccuaaagag

SEQ ID NO: 1253166 - RNA, 18 nt, Homo sapiens
gagccacugcaccgggcc

SEQ ID NO: 1253167 - RNA, 12 nt, Homo sapiens
gagccagacaga

SEQ ID NO: 1253168 - RNA, 19 nt, Homo sapiens
gagccagccagcauggcca

SEQ ID NO: 1253169 - RNA, 15 nt, Homo sapiens
gagccagcucccucu

SEQ ID NO: 1253170 - RNA, 22 nt, Homo sapiens
gagccagcugcuuuuugugauu

SEQ ID NO: 1253171 - RNA, 20 nt, Homo sapiens
gagccagcuuggggccacca

SEQ ID NO: 1253172 - RNA, 20 nt, Homo sapiens
gagccaguccuccacucgac

SEQ ID NO: 1253173 - RNA, 13 nt, Homo sapiens
gagccagucucac

SEQ ID NO: 1253174 - RNA, 17 nt, Homo sapiens
gagccagugagggcagu

SEQ ID NO: 1253175 - RNA, 17 nt, Homo sapiens
gagccaguuagacuagu

SEQ ID NO: 1253176 - RNA, 17 nt, Homo sapiens
gagccauuuugugaaug

SEQ ID NO: 1253177 - RNA, 13 nt, Homo sapiens
gagcccacuucca

SEQ ID NO: 1253178 - RNA, 20 nt, Homo sapiens
gagcccaggccguuccccuu

SEQ ID NO: 1253179 - RNA, 17 nt, Homo sapiens
gagcccauccagucucc

SEQ ID NO: 1253180 - RNA, 18 nt, Homo sapiens
gagccccagggugcccag

SEQ ID NO: 1253181 - RNA, 20 nt, Homo sapiens
gagccccgccucacacccac

SEQ ID NO: 1253182 - RNA, 17 nt, Homo sapiens
gagccccggaucccaag

SEQ ID NO: 1253183 - RNA, 21 nt, Homo sapiens
gagcccgcuuuuguucuuccc

SEQ ID NO: 1253184 - RNA, 22 nt, Homo sapiens
gagcccuaagcauugacuucuc

SEQ ID NO: 1253185 - RNA, 18 nt, Homo sapiens
gagcccugguggaucuug

SEQ ID NO: 1253186 - RNA, 14 nt, Homo sapiens
gagccgcugugagc

SEQ ID NO: 1253187 - RNA, 13 nt, Homo sapiens
gagccgguggugc

SEQ ID NO: 1253188 - RNA, 18 nt, Homo sapiens
gagccgugaacugugcau

SEQ ID NO: 1253189 - RNA, 15 nt, Homo sapiens
gagccucacagcagc

SEQ ID NO: 1253190 - RNA, 13 nt, Homo sapiens
gagccucacugau

SEQ ID NO: 1253191 - RNA, 16 nt, Homo sapiens
gagccuccacugccuc

SEQ ID NO: 1253192 - RNA, 16 nt, Homo sapiens
gagccugcugcauggg

SEQ ID NO: 1253193 - RNA, 23 nt, Homo sapiens
gagccuguccagguuaguuuacu

SEQ ID NO: 1253194 - RNA, 19 nt, Homo sapiens
gagccuucaagugccaaac

SEQ ID NO: 1253195 - RNA, 16 nt, Homo sapiens
gagcgucacggccaag

SEQ ID NO: 1253196 - RNA, 16 nt, Homo sapiens
gagcuaacauaaagga

SEQ ID NO: 1253197 - RNA, 13 nt, Homo sapiens
gagcuacaacaaa

SEQ ID NO: 1253198 - RNA, 12 nt, Homo sapiens
gagcuacaguag

SEQ ID NO: 1253199 - RNA, 19 nt, Homo sapiens
gagcucgcauuugucaaug

SEQ ID NO: 1253200 - RNA, 21 nt, Homo sapiens
gagcucgggaguuugagacca

SEQ ID NO: 1253201 - RNA, 21 nt, Homo sapiens
gagcugagaucacaccacugu

SEQ ID NO: 1253202 - RNA, 18 nt, Homo sapiens
gagcugagugcuagagua

SEQ ID NO: 1253203 - RNA, 14 nt, Homo sapiens
gagcuggaaggcag

SEQ ID NO: 1253204 - RNA, 22 nt, Homo sapiens
gagcuggccucucuagcacaau

SEQ ID NO: 1253205 - RNA, 18 nt, Homo sapiens
gagcugucccaccugcac

SEQ ID NO: 1253206 - RNA, 16 nt, Homo sapiens
gagcuguuaccauuca

SEQ ID NO: 1253207 - RNA, 18 nt, Homo sapiens
gagcuuccuucugugaaa

SEQ ID NO: 1253208 - RNA, 19 nt, Homo sapiens
gagcuugcaugcuugcaua

SEQ ID NO: 1253209 - RNA, 17 nt, Homo sapiens
gagcuugggugugcuga

SEQ ID NO: 1253210 - RNA, 20 nt, Homo sapiens
gagcuuguaauaaauacugc

SEQ ID NO: 1253211 - RNA, 22 nt, Homo sapiens
gagcuuguaauugcaccacugc

SEQ ID NO: 1253212 - RNA, 20 nt, Homo sapiens
gagcuugucuuuucugcuga

SEQ ID NO: 1253213 - RNA, 16 nt, Homo sapiens
gagcuuuucacuguga

SEQ ID NO: 1253214 - RNA, 16 nt, Homo sapiens
gaggaaaaaacccagc

SEQ ID NO: 1253215 - RNA, 16 nt, Homo sapiens
gaggaaagaacacuuc

SEQ ID NO: 1253216 - RNA, 15 nt, Homo sapiens
gaggaacucucaagu

SEQ ID NO: 1253217 - RNA, 18 nt, Homo sapiens
gaggaacuguccagagag

SEQ ID NO: 1253218 - RNA, 22 nt, Homo sapiens
gaggaagaacuacagcucuuaa

SEQ ID NO: 1253219 - RNA, 14 nt, Homo sapiens
gaggaagauggagg

SEQ ID NO: 1253220 - RNA, 16 nt, Homo sapiens
gaggaagccuauuuga

SEQ ID NO: 1253221 - RNA, 14 nt, Homo sapiens
gaggaauccucaga

SEQ ID NO: 1253222 - RNA, 17 nt, Homo sapiens
gaggaauucagcucagc

SEQ ID NO: 1253223 - RNA, 19 nt, Homo sapiens
gaggacagagcuggugaua

SEQ ID NO: 1253224 - RNA, 16 nt, Homo sapiens
gaggagacccuggaau

SEQ ID NO: 1253225 - RNA, 22 nt, Homo sapiens
gaggagccaggcaacuucaguc

SEQ ID NO: 1253226 - RNA, 19 nt, Homo sapiens
gaggagccggccaccagau

SEQ ID NO: 1253227 - RNA, 15 nt, Homo sapiens
gaggagguuucugca

SEQ ID NO: 1253228 - RNA, 15 nt, Homo sapiens
gaggagugccagcuc

SEQ ID NO: 1253229 - RNA, 22 nt, Homo sapiens
gaggaugaauguaugugcacug

SEQ ID NO: 1253230 - RNA, 15 nt, Homo sapiens
gaggcaaaguaguga

SEQ ID NO: 1253231 - RNA, 21 nt, Homo sapiens
gaggcaagugugggggguccu

SEQ ID NO: 1253232 - RNA, 18 nt, Homo sapiens
gaggcagagguugcagug

SEQ ID NO: 1253233 - RNA, 22 nt, Homo sapiens
gaggcagccccauucugccugc

SEQ ID NO: 1253234 - RNA, 21 nt, Homo sapiens
gaggcaggagaauggugugaa

SEQ ID NO: 1253235 - RNA, 14 nt, Homo sapiens
gaggccaaggcagg

SEQ ID NO: 1253236 - RNA, 23 nt, Homo sapiens
gaggccaauaaaaaguucagagu

SEQ ID NO: 1253237 - RNA, 13 nt, Homo sapiens
gaggccacagcug

SEQ ID NO: 1253238 - RNA, 22 nt, Homo sapiens
gaggccagggugcugacuguca

SEQ ID NO: 1253239 - RNA, 18 nt, Homo sapiens
gaggccagugggcgggcc

SEQ ID NO: 1253240 - RNA, 14 nt, Homo sapiens
gaggccauccugcc

SEQ ID NO: 1253241 - RNA, 17 nt, Homo sapiens
gaggcccaggcugggaa

SEQ ID NO: 1253242 - RNA, 17 nt, Homo sapiens
gaggccgggcgcagugg

SEQ ID NO: 1253243 - RNA, 23 nt, Homo sapiens
gaggccuauaaugaagcuuuaua

SEQ ID NO: 1253244 - RNA, 20 nt, Homo sapiens
gaggccugcauguccggcug

SEQ ID NO: 1253245 - RNA, 17 nt, Homo sapiens
gaggccuggacuuuccu

SEQ ID NO: 1253246 - RNA, 17 nt, Homo sapiens
gaggcgaugccacgcuu

SEQ ID NO: 1253247 - RNA, 15 nt, Homo sapiens
gaggcgcaggcgacc

SEQ ID NO: 1253248 - RNA, 19 nt, Homo sapiens
gaggcucacacugugcuca

SEQ ID NO: 1253249 - RNA, 23 nt, Homo sapiens
gaggcuccacuuggucugugaga

SEQ ID NO: 1253250 - RNA, 23 nt, Homo sapiens
gaggcuccaggacuccacuggac

SEQ ID NO: 1253251 - RNA, 22 nt, Homo sapiens
gaggcuccgccccagcccucag

SEQ ID NO: 1253252 - RNA, 16 nt, Homo sapiens
gaggcugagcuggauc

SEQ ID NO: 1253253 - RNA, 22 nt, Homo sapiens
gaggcuucuccuucuccuuccc

SEQ ID NO: 1253254 - RNA, 20 nt, Homo sapiens
gagggaaaguaaauauuuca

SEQ ID NO: 1253255 - RNA, 21 nt, Homo sapiens
gagggaagaaugaacacuccc

SEQ ID NO: 1253256 - RNA, 18 nt, Homo sapiens
gagggaggaacaccugau

SEQ ID NO: 1253257 - RNA, 17 nt, Homo sapiens
gagggaggccaggcggg

SEQ ID NO: 1253258 - RNA, 17 nt, Homo sapiens
gagggaggucacuggaa

SEQ ID NO: 1253259 - RNA, 15 nt, Homo sapiens
gagggcaguccaaga

SEQ ID NO: 1253260 - RNA, 22 nt, Homo sapiens
gagggcccuccgaccacuucca

SEQ ID NO: 1253261 - RNA, 14 nt, Homo sapiens
gagggcggcacagg

SEQ ID NO: 1253262 - RNA, 19 nt, Homo sapiens
gaggggacucaaacagucu

SEQ ID NO: 1253263 - RNA, 22 nt, Homo sapiens
gaggggaggauguauaaaaugg

SEQ ID NO: 1253264 - RNA, 18 nt, Homo sapiens
gagggggcuugaagccaa

SEQ ID NO: 1253265 - RNA, 21 nt, Homo sapiens
gaggggggggugggugagaga

SEQ ID NO: 1253266 - RNA, 16 nt, Homo sapiens
gagggguguaccuaaa

SEQ ID NO: 1253267 - RNA, 23 nt, Homo sapiens
gagggguucuucuggggugcuaa

SEQ ID NO: 1253268 - RNA, 17 nt, Homo sapiens
gaggguccagacugucc

SEQ ID NO: 1253269 - RNA, 21 nt, Homo sapiens
gaggguccuuuaguaccugaa

SEQ ID NO: 1253270 - RNA, 12 nt, Homo sapiens
gagggugacugu

SEQ ID NO: 1253271 - RNA, 15 nt, Homo sapiens
gaggguguggugcuu

SEQ ID NO: 1253272 - RNA, 22 nt, Homo sapiens
gaggguuauaaauuuuagcaag

SEQ ID NO: 1253273 - RNA, 15 nt, Homo sapiens
gaggguuuugcucuu

SEQ ID NO: 1253274 - RNA, 15 nt, Homo sapiens
gagguaaaaaacugu

SEQ ID NO: 1253275 - RNA, 22 nt, Homo sapiens
gagguaacgggugccugcugcg

SEQ ID NO: 1253276 - RNA, 13 nt, Homo sapiens
gagguacucuccu

SEQ ID NO: 1253277 - RNA, 18 nt, Homo sapiens
gagguagagguugcacug

SEQ ID NO: 1253278 - RNA, 17 nt, Homo sapiens
gaggucaucacuuugac

SEQ ID NO: 1253279 - RNA, 23 nt, Homo sapiens
gaggucauuaaaauuacauugag

SEQ ID NO: 1253280 - RNA, 16 nt, Homo sapiens
gaggucucuugaggga

SEQ ID NO: 1253281 - RNA, 16 nt, Homo sapiens
gaggugacacuguugg

SEQ ID NO: 1253282 - RNA, 19 nt, Homo sapiens
gaggugagagaagaccucu

SEQ ID NO: 1253283 - RNA, 23 nt, Homo sapiens
gagguggaaaauggugccuggag

SEQ ID NO: 1253284 - RNA, 20 nt, Homo sapiens
gaggugggaggauugcuuga

SEQ ID NO: 1253285 - RNA, 17 nt, Homo sapiens
gaggugggcagguggug

SEQ ID NO: 1253286 - RNA, 20 nt, Homo sapiens
gaggugggguacauuucucu

SEQ ID NO: 1253287 - RNA, 18 nt, Homo sapiens
gaggugggugugggugga

SEQ ID NO: 1253288 - RNA, 14 nt, Homo sapiens
gagguguacaggua

SEQ ID NO: 1253289 - RNA, 15 nt, Homo sapiens
gagguguacagguac

SEQ ID NO: 1253290 - RNA, 16 nt, Homo sapiens
gagguguuggcuuugu

SEQ ID NO: 1253291 - RNA, 17 nt, Homo sapiens
gagguucugagaccagu

SEQ ID NO: 1253292 - RNA, 14 nt, Homo sapiens
gagguugaagccaa

SEQ ID NO: 1253293 - RNA, 23 nt, Homo sapiens
gagguuucacccuuaacccaagg

SEQ ID NO: 1253294 - RNA, 15 nt, Homo sapiens
gaguaaaauucaguu

SEQ ID NO: 1253295 - RNA, 15 nt, Homo sapiens
gaguaaauacaggua

SEQ ID NO: 1253296 - RNA, 21 nt, Homo sapiens
gaguaauauagugacuaugaa

SEQ ID NO: 1253297 - RNA, 15 nt, Homo sapiens
gaguacuccaagaca

SEQ ID NO: 1253298 - RNA, 14 nt, Homo sapiens
gaguagaauugcau

SEQ ID NO: 1253299 - RNA, 14 nt, Homo sapiens
gaguagggggagca

SEQ ID NO: 1253300 - RNA, 14 nt, Homo sapiens
gaguauaauauuca

SEQ ID NO: 1253301 - RNA, 14 nt, Homo sapiens
gagucacaccagaa

SEQ ID NO: 1253302 - RNA, 13 nt, Homo sapiens
gagucacuugugu

SEQ ID NO: 1253303 - RNA, 22 nt, Homo sapiens
gagucagucucuuucuguacaa

SEQ ID NO: 1253304 - RNA, 22 nt, Homo sapiens
gagucaucuauucaagcacuua

SEQ ID NO: 1253305 - RNA, 22 nt, Homo sapiens
gagucauguugaaggugcccaa

SEQ ID NO: 1253306 - RNA, 14 nt, Homo sapiens
gaguccacuuuguu

SEQ ID NO: 1253307 - RNA, 16 nt, Homo sapiens
gaguccccuacucccu

SEQ ID NO: 1253308 - RNA, 13 nt, Homo sapiens
gagucuagauucu

SEQ ID NO: 1253309 - RNA, 17 nt, Homo sapiens
gagucucacuguugccc

SEQ ID NO: 1253310 - RNA, 19 nt, Homo sapiens
gagucucugaaugaagcug

SEQ ID NO: 1253311 - RNA, 17 nt, Homo sapiens
gagucucuucuccacug

SEQ ID NO: 1253312 - RNA, 15 nt, Homo sapiens
gagucugcaugugca

SEQ ID NO: 1253313 - RNA, 23 nt, Homo sapiens
gagucuggggucuccuauacucu

SEQ ID NO: 1253314 - RNA, 16 nt, Homo sapiens
gagucuguuucaggag

SEQ ID NO: 1253315 - RNA, 20 nt, Homo sapiens
gagucuuguuuuuuacucaa

SEQ ID NO: 1253316 - RNA, 15 nt, Homo sapiens
gagugaaccuaccuu

SEQ ID NO: 1253317 - RNA, 12 nt, Homo sapiens
gagugaauuuga

SEQ ID NO: 1253318 - RNA, 20 nt, Homo sapiens
gagugacuacacacaguacg

SEQ ID NO: 1253319 - RNA, 12 nt, Homo sapiens
gagugagacuga

SEQ ID NO: 1253320 - RNA, 15 nt, Homo sapiens
gagugagcaaccagc

SEQ ID NO: 1253321 - RNA, 14 nt, Homo sapiens
gagugaggagccca

SEQ ID NO: 1253322 - RNA, 17 nt, Homo sapiens
gagugauaugauccaga

SEQ ID NO: 1253323 - RNA, 15 nt, Homo sapiens
gagugcaaugaauga

SEQ ID NO: 1253324 - RNA, 11 nt, Homo sapiens
gaaggggccau

SEQ ID NO: 1253325 - RNA, 15 nt, Homo sapiens
gaagggggcugugug

SEQ ID NO: 1253326 - RNA, 19 nt, Homo sapiens
gaagggggucaaaggaaga

SEQ ID NO: 1253327 - RNA, 21 nt, Homo sapiens
gaaggguuuugcuacauucua

SEQ ID NO: 1253328 - RNA, 15 nt, Homo sapiens
gaaggucccucagac

SEQ ID NO: 1253329 - RNA, 19 nt, Homo sapiens
gaaggugaaagugcaguuc

SEQ ID NO: 1253330 - RNA, 18 nt, Homo sapiens
gaaggugcaggugacaga

SEQ ID NO: 1253331 - RNA, 12 nt, Homo sapiens
gaaggugcccaa

SEQ ID NO: 1253332 - RNA, 17 nt, Homo sapiens
gaaggugcccaaccuaa

SEQ ID NO: 1253333 - RNA, 14 nt, Homo sapiens
gaaggugcuuugua

SEQ ID NO: 1253334 - RNA, 20 nt, Homo sapiens
gaagguuggugaauuucaca

SEQ ID NO: 1253335 - RNA, 15 nt, Homo sapiens
gaaguaacauuugcc

SEQ ID NO: 1253336 - RNA, 16 nt, Homo sapiens
gaaguaacauuugccu

SEQ ID NO: 1253337 - RNA, 22 nt, Homo sapiens
gaaguacugcacccagcagugu

SEQ ID NO: 1253338 - RNA, 18 nt, Homo sapiens
gaaguagaauuuguccaa

SEQ ID NO: 1253339 - RNA, 22 nt, Homo sapiens
gaaguagaauuuguccaauaac

SEQ ID NO: 1253340 - RNA, 18 nt, Homo sapiens
gaaguagcagugucugua

SEQ ID NO: 1253341 - RNA, 17 nt, Homo sapiens
gaaguaggugugacuug

SEQ ID NO: 1253342 - RNA, 15 nt, Homo sapiens
gaaguaugagggaaa

SEQ ID NO: 1253343 - RNA, 15 nt, Homo sapiens
gaaguauugcuaaua

SEQ ID NO: 1253344 - RNA, 16 nt, Homo sapiens
gaaguauuucugugga

SEQ ID NO: 1253345 - RNA, 18 nt, Homo sapiens
gaaguauuuucuaguucu

SEQ ID NO: 1253346 - RNA, 12 nt, Homo sapiens
gaagucauccca

SEQ ID NO: 1253347 - RNA, 20 nt, Homo sapiens
gaagugaaugaaacacucag

SEQ ID NO: 1253348 - RNA, 14 nt, Homo sapiens
gaagugacucucac

SEQ ID NO: 1253349 - RNA, 21 nt, Homo sapiens
gaagugauugaauauuguuaa

SEQ ID NO: 1253350 - RNA, 15 nt, Homo sapiens
gaaguggagucucau

SEQ ID NO: 1253351 - RNA, 16 nt, Homo sapiens
gaagugguccaucucc

SEQ ID NO: 1253352 - RNA, 16 nt, Homo sapiens
gaagugguucuauguc

SEQ ID NO: 1253353 - RNA, 14 nt, Homo sapiens
gaaguuaaagggca

SEQ ID NO: 1253354 - RNA, 13 nt, Homo sapiens
gaaguuacuuugu

SEQ ID NO: 1253355 - RNA, 22 nt, Homo sapiens
gaauaaaaaaugggaacauaca

SEQ ID NO: 1253356 - RNA, 15 nt, Homo sapiens
gaauaaaaacauuuc

SEQ ID NO: 1253357 - RNA, 20 nt, Homo sapiens
gaauaaaaauauguacaagu

SEQ ID NO: 1253358 - RNA, 13 nt, Homo sapiens
gaauaaaacacuc

SEQ ID NO: 1253359 - RNA, 14 nt, Homo sapiens
gaauaaaauacucu

SEQ ID NO: 1253360 - RNA, 16 nt, Homo sapiens
gaauaaaauacucucu

SEQ ID NO: 1253361 - RNA, 14 nt, Homo sapiens
gaauaaauaauucu

SEQ ID NO: 1253362 - RNA, 15 nt, Homo sapiens
gaauaaaugucuugc

SEQ ID NO: 1253363 - RNA, 17 nt, Homo sapiens
gaauaaauugcuccuug

SEQ ID NO: 1253364 - RNA, 20 nt, Homo sapiens
gaauaacuguguuuccuacc

SEQ ID NO: 1253365 - RNA, 21 nt, Homo sapiens
gaauacugggaaucaagacaa

SEQ ID NO: 1253366 - RNA, 14 nt, Homo sapiens
gaauacugugcaua

SEQ ID NO: 1253367 - RNA, 14 nt, Homo sapiens
gaauacuuaacuca

SEQ ID NO: 1253368 - RNA, 22 nt, Homo sapiens
gaauacuuaacucaauaauucu

SEQ ID NO: 1253369 - RNA, 23 nt, Homo sapiens
gaauagaaauaaaggaugugauu

SEQ ID NO: 1253370 - RNA, 19 nt, Homo sapiens
gaauagaaccaacccaaac

SEQ ID NO: 1253371 - RNA, 15 nt, Homo sapiens
gaauagaugcugacu

SEQ ID NO: 1253372 - RNA, 12 nt, Homo sapiens
gaauagcacaaa

SEQ ID NO: 1253373 - RNA, 19 nt, Homo sapiens
gaauagcuuugaauguggc

SEQ ID NO: 1253374 - RNA, 18 nt, Homo sapiens
gaauaguccauccccaga

SEQ ID NO: 1253375 - RNA, 24 nt, Homo sapiens
gaauagucuuuugcaugucgcaca

SEQ ID NO: 1253376 - RNA, 19 nt, Homo sapiens
gaauauacuaaauuaacuu

SEQ ID NO: 1253377 - RNA, 20 nt, Homo sapiens
gaauaucauuaaauuggaau

SEQ ID NO: 1253378 - RNA, 19 nt, Homo sapiens
gaauaucgagaacugccau

SEQ ID NO: 1253379 - RNA, 19 nt, Homo sapiens
gaauauggugggcacagaa

SEQ ID NO: 1253380 - RNA, 23 nt, Homo sapiens
gaauauggugggcacagaaguag

SEQ ID NO: 1253381 - RNA, 14 nt, Homo sapiens
gaauauuacucuca

SEQ ID NO: 1253382 - RNA, 18 nt, Homo sapiens
gaauauuagcauugccaa

SEQ ID NO: 1253383 - RNA, 14 nt, Homo sapiens
cugucaccuagcuc

SEQ ID NO: 1253384 - RNA, 15 nt, Homo sapiens
cugucaccuagcuca

SEQ ID NO: 1253385 - RNA, 19 nt, Homo sapiens
cugucagaaugcuauugaa

SEQ ID NO: 1253386 - RNA, 12 nt, Homo sapiens
cugucagauuaa

SEQ ID NO: 1253387 - RNA, 15 nt, Homo sapiens
cugucaggacaccag

SEQ ID NO: 1253388 - RNA, 19 nt, Homo sapiens
cugucauccucaugcugcu

SEQ ID NO: 1253389 - RNA, 17 nt, Homo sapiens
cugucauguaacacgac

SEQ ID NO: 1253390 - RNA, 15 nt, Homo sapiens
cugucauuuccucua

SEQ ID NO: 1253391 - RNA, 17 nt, Homo sapiens
cuguccaccaagaucaa

SEQ ID NO: 1253392 - RNA, 17 nt, Homo sapiens
cuguccacugggccauu

SEQ ID NO: 1253393 - RNA, 21 nt, Homo sapiens
cugucccgccuuccuccucca

SEQ ID NO: 1253394 - RNA, 18 nt, Homo sapiens
cugucccucgugaaguca

SEQ ID NO: 1253395 - RNA, 17 nt, Homo sapiens
cuguccuaccaguugcc

SEQ ID NO: 1253396 - RNA, 12 nt, Homo sapiens
cuguccuaggcc

SEQ ID NO: 1253397 - RNA, 13 nt, Homo sapiens
cuguccucaagua

SEQ ID NO: 1253398 - RNA, 15 nt, Homo sapiens
cuguccuccacacaa

SEQ ID NO: 1253399 - RNA, 14 nt, Homo sapiens
cuguccuucuuaga

SEQ ID NO: 1253400 - RNA, 17 nt, Homo sapiens
cugucgauaaucagaga

SEQ ID NO: 1253401 - RNA, 14 nt, Homo sapiens
cugucuacauuucu

SEQ ID NO: 1253402 - RNA, 14 nt, Homo sapiens
cugucucagccucc

SEQ ID NO: 1253403 - RNA, 13 nt, Homo sapiens
cugucucagcuca

SEQ ID NO: 1253404 - RNA, 17 nt, Homo sapiens
cugucucugaaguacua

SEQ ID NO: 1253405 - RNA, 21 nt, Homo sapiens
cugucugggauuaagggcaaa

SEQ ID NO: 1253406 - RNA, 19 nt, Homo sapiens
cugucugucaccagcuauc

SEQ ID NO: 1253407 - RNA, 15 nt, Homo sapiens
cugucuuggggccac

SEQ ID NO: 1253408 - RNA, 20 nt, Homo sapiens
cugucuuuauaaucuacucc

SEQ ID NO: 1253409 - RNA, 21 nt, Homo sapiens
cugugaaaguacauuuggaga

SEQ ID NO: 1253410 - RNA, 21 nt, Homo sapiens
cugugaaaugcuggcauuugc

SEQ ID NO: 1253411 - RNA, 19 nt, Homo sapiens
cugguccagggcuagugac

SEQ ID NO: 1253412 - RNA, 16 nt, Homo sapiens
cuggucccacucaguc

SEQ ID NO: 1253413 - RNA, 21 nt, Homo sapiens
cugguccccuccucagugaca

SEQ ID NO: 1253414 - RNA, 13 nt, Homo sapiens
cuggucuugugga

SEQ ID NO: 1253415 - RNA, 12 nt, Homo sapiens
cuggugacuccu

SEQ ID NO: 1253416 - RNA, 18 nt, Homo sapiens
cuggugcagucauuauga

SEQ ID NO: 1253417 - RNA, 16 nt, Homo sapiens
cuggugcauggccuua

SEQ ID NO: 1253418 - RNA, 17 nt, Homo sapiens
cuggugcuccaagcaca

SEQ ID NO: 1253419 - RNA, 14 nt, Homo sapiens
cuggugcuccaguu

SEQ ID NO: 1253420 - RNA, 20 nt, Homo sapiens
cugguggagaaagcacugac

SEQ ID NO: 1253421 - RNA, 18 nt, Homo sapiens
cuggugguggcaccaucu

SEQ ID NO: 1253422 - RNA, 13 nt, Homo sapiens
cugguguucacca

SEQ ID NO: 1253423 - RNA, 15 nt, Homo sapiens
cugguuacucagggu

SEQ ID NO: 1253424 - RNA, 23 nt, Homo sapiens
cugguuagaaaaaggacucugcu

SEQ ID NO: 1253425 - RNA, 15 nt, Homo sapiens
cugguuagaaaugca

SEQ ID NO: 1253426 - RNA, 13 nt, Homo sapiens
cugguuagguaga

SEQ ID NO: 1253427 - RNA, 13 nt, Homo sapiens
cugguugcuguau

SEQ ID NO: 1253428 - RNA, 16 nt, Homo sapiens
cugguugugugcacaa

SEQ ID NO: 1253429 - RNA, 18 nt, Homo sapiens
cugguuguuaugugauca

SEQ ID NO: 1253430 - RNA, 17 nt, Homo sapiens
cugguuucuaccagcuc

SEQ ID NO: 1253431 - RNA, 17 nt, Homo sapiens
cugguuuucugccaaug

SEQ ID NO: 1253432 - RNA, 13 nt, Homo sapiens
cuguaaacauauu

SEQ ID NO: 1253433 - RNA, 20 nt, Homo sapiens
cuguaaagucuaaucucuaa

SEQ ID NO: 1253434 - RNA, 15 nt, Homo sapiens
cuguaaagugccuua

SEQ ID NO: 1253435 - RNA, 22 nt, Homo sapiens
cuguaaauaugaaucugcucac

SEQ ID NO: 1253436 - RNA, 18 nt, Homo sapiens
cuguaaaugcauuggaau

SEQ ID NO: 1253437 - RNA, 13 nt, Homo sapiens
cuguaacagcauu

SEQ ID NO: 1253438 - RNA, 12 nt, Homo sapiens
cuguaacuacuu

SEQ ID NO: 1253439 - RNA, 13 nt, Homo sapiens
cuguaagcuccuu

SEQ ID NO: 1253440 - RNA, 22 nt, Homo sapiens
cuguaauaaauaaauauacuca

SEQ ID NO: 1253441 - RNA, 17 nt, Homo sapiens
cuguaauaauaccucaa

SEQ ID NO: 1253442 - RNA, 21 nt, Homo sapiens
cuguaauaguucaguagaauu

SEQ ID NO: 1253443 - RNA, 19 nt, Homo sapiens
cuguaaucccaacacuuug

SEQ ID NO: 1253444 - RNA, 15 nt, Homo sapiens
cuguaaugacaaaua

SEQ ID NO: 1253445 - RNA, 14 nt, Homo sapiens
cuguacaauugcau

SEQ ID NO: 1253446 - RNA, 14 nt, Homo sapiens
cuguacacagaauu

SEQ ID NO: 1253447 - RNA, 13 nt, Homo sapiens
cuguacacaggcg

SEQ ID NO: 1253448 - RNA, 17 nt, Homo sapiens
cuguacauagccuauau

SEQ ID NO: 1253449 - RNA, 22 nt, Homo sapiens
cuguaccacaucugcucuaggg

SEQ ID NO: 1253450 - RNA, 14 nt, Homo sapiens
cuguaccucagugg

SEQ ID NO: 1253451 - RNA, 11 nt, Homo sapiens
cuguaccucau

SEQ ID NO: 1253452 - RNA, 16 nt, Homo sapiens
cuguaccuguuccuua

SEQ ID NO: 1253453 - RNA, 22 nt, Homo sapiens
cuguacuccagccugggugaca

SEQ ID NO: 1253454 - RNA, 22 nt, Homo sapiens
cuguagaaugauuucaugcuau

SEQ ID NO: 1253455 - RNA, 15 nt, Homo sapiens
cuguagaguugcuga

SEQ ID NO: 1253456 - RNA, 16 nt, Homo sapiens
cuguagccugggacca

SEQ ID NO: 1253457 - RNA, 18 nt, Homo sapiens
cuguagguucaugcccaa

SEQ ID NO: 1253458 - RNA, 22 nt, Homo sapiens
cuguagucccagcuacucggga

SEQ ID NO: 1253459 - RNA, 18 nt, Homo sapiens
cuguagucccagcuacuu

SEQ ID NO: 1253460 - RNA, 15 nt, Homo sapiens
cuguaguuacugugg

SEQ ID NO: 1253461 - RNA, 17 nt, Homo sapiens
cuguaguucuaagacuc

SEQ ID NO: 1253462 - RNA, 22 nt, Homo sapiens
cuguaguugcguggacucugca

SEQ ID NO: 1253463 - RNA, 23 nt, Homo sapiens
cuguaguugcguggacucugcac

SEQ ID NO: 1253464 - RNA, 13 nt, Homo sapiens
cuguauaagugga

SEQ ID NO: 1253465 - RNA, 20 nt, Homo sapiens
cuguauacagauucuagcca

SEQ ID NO: 1253466 - RNA, 23 nt, Homo sapiens
cuguauaguuaggauagcauuuu

SEQ ID NO: 1253467 - RNA, 14 nt, Homo sapiens
cuguaugaacuuua

SEQ ID NO: 1253468 - RNA, 16 nt, Homo sapiens
cuguaugauuccuuga

SEQ ID NO: 1253469 - RNA, 17 nt, Homo sapiens
cuguauggaaaugcacc

SEQ ID NO: 1253470 - RNA, 22 nt, Homo sapiens
cuguauguaaacuguuacugaa

SEQ ID NO: 1253471 - RNA, 18 nt, Homo sapiens
cugucaaaacacugugga

SEQ ID NO: 1253472 - RNA, 12 nt, Homo sapiens
cugucaagaaga

SEQ ID NO: 1253473 - RNA, 19 nt, Homo sapiens
cugucaaguuaacaaggaa

SEQ ID NO: 1253474 - RNA, 21 nt, Homo sapiens
aguucauaccuaaguacugua

SEQ ID NO: 1253475 - RNA, 17 nt, Homo sapiens
aguucauauguaccaug

SEQ ID NO: 1253476 - RNA, 16 nt, Homo sapiens
aguuccaaaagcacag

SEQ ID NO: 1253477 - RNA, 22 nt, Homo sapiens
aguuccaugaauucuugauuuc

SEQ ID NO: 1253478 - RNA, 14 nt, Homo sapiens
aguuccauguuaaa

SEQ ID NO: 1253479 - RNA, 14 nt, Homo sapiens
aguucccucuugcu

SEQ ID NO: 1253480 - RNA, 23 nt, Homo sapiens
aguuccugcuacaacuucagcag

SEQ ID NO: 1253481 - RNA, 17 nt, Homo sapiens
aguuccuggcccaucaa

SEQ ID NO: 1253482 - RNA, 13 nt, Homo sapiens
aguucuaggcacu

SEQ ID NO: 1253483 - RNA, 13 nt, Homo sapiens
aguucuaucagga

SEQ ID NO: 1253484 - RNA, 13 nt, Homo sapiens
aguucucacuguu

SEQ ID NO: 1253485 - RNA, 21 nt, Homo sapiens
aguucucauggguggcacuca

SEQ ID NO: 1253486 - RNA, 23 nt, Homo sapiens
aguucucccuguacaguguuacc

SEQ ID NO: 1253487 - RNA, 19 nt, Homo sapiens
aguucucuagggucugaua

SEQ ID NO: 1253488 - RNA, 19 nt, Homo sapiens
aguucugaauaacuugaag

SEQ ID NO: 1253489 - RNA, 17 nt, Homo sapiens
aguucugccaggcaacu

SEQ ID NO: 1253490 - RNA, 21 nt, Homo sapiens
aguucugcuucugaaacugga

SEQ ID NO: 1253491 - RNA, 22 nt, Homo sapiens
aguucugcuucugaaacuggag

SEQ ID NO: 1253492 - RNA, 21 nt, Homo sapiens
aguucuugagggccuccccac

SEQ ID NO: 1253493 - RNA, 13 nt, Homo sapiens
aguugaaacaaga

SEQ ID NO: 1253494 - RNA, 20 nt, Homo sapiens
aguugaagcugacucaaaaa

SEQ ID NO: 1253495 - RNA, 23 nt, Homo sapiens
aguugaggagacauuacaaugug

SEQ ID NO: 1253496 - RNA, 16 nt, Homo sapiens
aguugauuacuuuuca

SEQ ID NO: 1253497 - RNA, 12 nt, Homo sapiens
aguugcaaaggu

SEQ ID NO: 1253498 - RNA, 20 nt, Homo sapiens
aguugcagccagggccagug

SEQ ID NO: 1253499 - RNA, 18 nt, Homo sapiens
aguugccaagacaaauca

SEQ ID NO: 1253500 - RNA, 17 nt, Homo sapiens
aguugcugaugaacucu

SEQ ID NO: 1253501 - RNA, 20 nt, Homo sapiens
aguuggacuucagucuugcc

SEQ ID NO: 1253502 - RNA, 17 nt, Homo sapiens
aguuggcaaaauggggu

SEQ ID NO: 1253503 - RNA, 19 nt, Homo sapiens
aguugguaaauucacaaau

SEQ ID NO: 1253504 - RNA, 21 nt, Homo sapiens
aguuggugcuuuugagaacca

SEQ ID NO: 1253505 - RNA, 16 nt, Homo sapiens
aguuguacacugugua

SEQ ID NO: 1253506 - RNA, 16 nt, Homo sapiens
aguugucuuuugccau

SEQ ID NO: 1253507 - RNA, 23 nt, Homo sapiens
aguuguggggagauccacuggga

SEQ ID NO: 1253508 - RNA, 22 nt, Homo sapiens
aguuguguuguuuuuuguucaa

SEQ ID NO: 1253509 - RNA, 20 nt, Homo sapiens
aguuguuguaaaaauaaaag

SEQ ID NO: 1253510 - RNA, 22 nt, Homo sapiens
aguuguuuuaauaacuuaucua

SEQ ID NO: 1253511 - RNA, 12 nt, Homo sapiens
aguuuaccucuu

SEQ ID NO: 1253512 - RNA, 23 nt, Homo sapiens
aguuuaggaguaagagucuuguu

SEQ ID NO: 1253513 - RNA, 14 nt, Homo sapiens
aguuuagugugaua

SEQ ID NO: 1253514 - RNA, 20 nt, Homo sapiens
aguuuauaagacuggaauau

SEQ ID NO: 1253515 - RNA, 19 nt, Homo sapiens
aguuuauacccguuucaca

SEQ ID NO: 1253516 - RNA, 14 nt, Homo sapiens
aguuuauauucuga

SEQ ID NO: 1253517 - RNA, 15 nt, Homo sapiens
aguuuaucacacagu

SEQ ID NO: 1253518 - RNA, 19 nt, Homo sapiens
aguuuauuggaaguguuca

SEQ ID NO: 1253519 - RNA, 20 nt, Homo sapiens
aguuuauuuuuauacuuuca

SEQ ID NO: 1253520 - RNA, 18 nt, Homo sapiens
aguuucaaacuuacuauu

SEQ ID NO: 1253521 - RNA, 21 nt, Homo sapiens
aguuucagagaaauacuuuca

SEQ ID NO: 1253522 - RNA, 14 nt, Homo sapiens
aguuucaucaguca

SEQ ID NO: 1253523 - RNA, 21 nt, Homo sapiens
aguuuccacuaucccaaucaa

SEQ ID NO: 1253524 - RNA, 17 nt, Homo sapiens
aguuuccauauguuaua

SEQ ID NO: 1253525 - RNA, 21 nt, Homo sapiens
aguuuccuaugggaacaauug

SEQ ID NO: 1253526 - RNA, 16 nt, Homo sapiens
aguuucuaucucuaag

SEQ ID NO: 1253527 - RNA, 17 nt, Homo sapiens
aguuucuauucugucag

SEQ ID NO: 1253528 - RNA, 21 nt, Homo sapiens
aguuucucagcucccaaggcu

SEQ ID NO: 1253529 - RNA, 15 nt, Homo sapiens
aguuucuggugccau

SEQ ID NO: 1253530 - RNA, 15 nt, Homo sapiens
aguuucuuagcuuuu

SEQ ID NO: 1253531 - RNA, 20 nt, Homo sapiens
aguuugaagcacaacucccu

SEQ ID NO: 1253532 - RNA, 21 nt, Homo sapiens
aguuugaagcacaacucccuu

SEQ ID NO: 1253533 - RNA, 13 nt, Homo sapiens
aguuugagacagg

SEQ ID NO: 1253534 - RNA, 13 nt, Homo sapiens
aguuugauuucau

SEQ ID NO: 1253535 - RNA, 19 nt, Homo sapiens
aguuugcaaauaggcagaa

SEQ ID NO: 1253536 - RNA, 19 nt, Homo sapiens
aguuuggaaugaagaaauu

SEQ ID NO: 1253537 - RNA, 19 nt, Homo sapiens
aguuugguccuggggacca

SEQ ID NO: 1253538 - RNA, 15 nt, Homo sapiens
aguuuguagccaggu

SEQ ID NO: 1253539 - RNA, 22 nt, Homo sapiens
aguuuguguguauuuguauuaa

SEQ ID NO: 1253540 - RNA, 23 nt, Homo sapiens
aguuuguguguauuuguauuaau

SEQ ID NO: 1253541 - RNA, 15 nt, Homo sapiens
aguuuuaaauaagcu

SEQ ID NO: 1253542 - RNA, 13 nt, Homo sapiens
aguuuuaccucuu

SEQ ID NO: 1253543 - RNA, 19 nt, Homo sapiens
aguuuuaguuuucucuuag

SEQ ID NO: 1253544 - RNA, 19 nt, Homo sapiens
aguuuuccuacacuugaga

SEQ ID NO: 1253545 - RNA, 22 nt, Homo sapiens
aguuuuccuuuguaaucacucc

SEQ ID NO: 1253546 - RNA, 20 nt, Homo sapiens
aguuuucuggagugagcacu

SEQ ID NO: 1253547 - RNA, 15 nt, Homo sapiens
aguuuuggcauaaua

SEQ ID NO: 1253548 - RNA, 10 nt, Homo sapiens
aguuuuuacu

SEQ ID NO: 1253549 - RNA, 14 nt, Homo sapiens
auaaaaaacauaau

SEQ ID NO: 1253550 - RNA, 18 nt, Homo sapiens
auaaaaaauaaaguacca

SEQ ID NO: 1253551 - RNA, 14 nt, Homo sapiens
auaaaaaaucugaa

SEQ ID NO: 1253552 - RNA, 12 nt, Homo sapiens
auaaaaacccaa

SEQ ID NO: 1253553 - RNA, 14 nt, Homo sapiens
auaaaaacugcuua

SEQ ID NO: 1253554 - RNA, 14 nt, Homo sapiens
auaaaaagcauuau

SEQ ID NO: 1253555 - RNA, 15 nt, Homo sapiens
auaaaaagcauuauu

SEQ ID NO: 1253556 - RNA, 18 nt, Homo sapiens
auaaaaagcgcugcagua

SEQ ID NO: 1253557 - RNA, 23 nt, Homo sapiens
auaaaaaguuucacaggucaaua

SEQ ID NO: 1253558 - RNA, 16 nt, Homo sapiens
auaaaaauauguacaa

SEQ ID NO: 1253559 - RNA, 21 nt, Homo sapiens
auaaaaauauuguguugugaa

SEQ ID NO: 1253560 - RNA, 14 nt, Homo sapiens
auaaaaaugagugc

SEQ ID NO: 1253561 - RNA, 15 nt, Homo sapiens
auaaaaaugagugcu

SEQ ID NO: 1253562 - RNA, 18 nt, Homo sapiens
auaaaacucugcauguag

SEQ ID NO: 1253563 - RNA, 19 nt, Homo sapiens
auaaaacuucacauuuaug

SEQ ID NO: 1253564 - RNA, 19 nt, Homo sapiens
auaaaagaguuaacauccc

SEQ ID NO: 1253565 - RNA, 16 nt, Homo sapiens
auaaaagauucaccug

SEQ ID NO: 1253566 - RNA, 17 nt, Homo sapiens
auaaaagcauugucucu

SEQ ID NO: 1253567 - RNA, 15 nt, Homo sapiens
auaaaagcuaugaca

SEQ ID NO: 1253568 - RNA, 17 nt, Homo sapiens
auaaaaggaaucuuccu

SEQ ID NO: 1253569 - RNA, 18 nt, Homo sapiens
auaaaaguguucauuguu

SEQ ID NO: 1253570 - RNA, 21 nt, Homo sapiens
auaaaaguuaauaacagcucc

SEQ ID NO: 1253571 - RNA, 17 nt, Homo sapiens
auaaaauauaaucuaau

SEQ ID NO: 1253572 - RNA, 20 nt, Homo sapiens
auaaaauauuugcuucacuu

SEQ ID NO: 1253573 - RNA, 16 nt, Homo sapiens
auaaaauuagcuugag

SEQ ID NO: 1253574 - RNA, 20 nt, Homo sapiens
auaaacaaaguuacuaggua

SEQ ID NO: 1253575 - RNA, 20 nt, Homo sapiens
auaaacaaauaacaaugugc

SEQ ID NO: 1253576 - RNA, 12 nt, Homo sapiens
auaaacacuggu

SEQ ID NO: 1253577 - RNA, 17 nt, Homo sapiens
auaaacagaacucccuu

SEQ ID NO: 1253578 - RNA, 20 nt, Homo sapiens
auaaacaguggcucauaaaa

SEQ ID NO: 1253579 - RNA, 20 nt, Homo sapiens
auaaaccguuuuuaacacau

SEQ ID NO: 1253580 - RNA, 20 nt, Homo sapiens
auaaacgguuccuggugacu

SEQ ID NO: 1253581 - RNA, 16 nt, Homo sapiens
auaaacuccuacuaaa

SEQ ID NO: 1253582 - RNA, 20 nt, Homo sapiens
auaaacuccuacuaaauccc

SEQ ID NO: 1253583 - RNA, 17 nt, Homo sapiens
auaaacugucacucuag

SEQ ID NO: 1253584 - RNA, 14 nt, Homo sapiens
auaaacuguuuaua

SEQ ID NO: 1253585 - RNA, 15 nt, Homo sapiens
auaaagaaauugcaa

SEQ ID NO: 1253586 - RNA, 17 nt, Homo sapiens
auaaagagacagugaua

SEQ ID NO: 1253587 - RNA, 17 nt, Homo sapiens
auaaagauuucaagauc

SEQ ID NO: 1253588 - RNA, 22 nt, Homo sapiens
auaaagcacccuguaucacaga

SEQ ID NO: 1253589 - RNA, 15 nt, Homo sapiens
auaaagcagccucau

SEQ ID NO: 1253590 - RNA, 11 nt, Homo sapiens
auaaagcauuc

SEQ ID NO: 1253591 - RNA, 16 nt, Homo sapiens
auaaagcauucuuuaa

SEQ ID NO: 1253592 - RNA, 11 nt, Homo sapiens
auaaagccaug

SEQ ID NO: 1253593 - RNA, 14 nt, Homo sapiens
auaaaggaugugau

SEQ ID NO: 1253594 - RNA, 18 nt, Homo sapiens
auaaaggcaguuuucuaa

SEQ ID NO: 1253595 - RNA, 16 nt, Homo sapiens
auaaaguaccacacau

SEQ ID NO: 1253596 - RNA, 21 nt, Homo sapiens
auaaaguaccacacauauugc

SEQ ID NO: 1253597 - RNA, 22 nt, Homo sapiens
auaaaguaccacacauauugca

SEQ ID NO: 1253598 - RNA, 11 nt, Homo sapiens
auaaagucaac

SEQ ID NO: 1253599 - RNA, 14 nt, Homo sapiens
auaaaguccugaca

SEQ ID NO: 1253600 - RNA, 21 nt, Homo sapiens
auaaagucuauggacagggcu

SEQ ID NO: 1253601 - RNA, 19 nt, Homo sapiens
accauuuugggguacccac

SEQ ID NO: 1253602 - RNA, 21 nt, Homo sapiens
accauuuuguuauugacuaac

SEQ ID NO: 1253603 - RNA, 20 nt, Homo sapiens
accauuuuuacauccaugaa

SEQ ID NO: 1253604 - RNA, 22 nt, Homo sapiens
acccaauaaaacugauguuacu

SEQ ID NO: 1253605 - RNA, 22 nt, Homo sapiens
acccacaaucccaccuagccca

SEQ ID NO: 1253606 - RNA, 13 nt, Homo sapiens
acccacacaagcg

SEQ ID NO: 1253607 - RNA, 22 nt, Homo sapiens
acccacagacugguuuugcaac

SEQ ID NO: 1253608 - RNA, 14 nt, Homo sapiens
acccacagaugucu

SEQ ID NO: 1253609 - RNA, 12 nt, Homo sapiens
acccacccagga

SEQ ID NO: 1253610 - RNA, 21 nt, Homo sapiens
acccacccagugucuuucgag

SEQ ID NO: 1253611 - RNA, 14 nt, Homo sapiens
acccaccccugugc

SEQ ID NO: 1253612 - RNA, 14 nt, Homo sapiens
acccaccucagccu

SEQ ID NO: 1253613 - RNA, 23 nt, Homo sapiens
acccacuguccgcgguggacucu

SEQ ID NO: 1253614 - RNA, 17 nt, Homo sapiens
acccagaccccaggcug

SEQ ID NO: 1253615 - RNA, 20 nt, Homo sapiens
acccagacguggaguggagu

SEQ ID NO: 1253616 - RNA, 24 nt, Homo sapiens
acccagagaguccugugcugaaug

SEQ ID NO: 1253617 - RNA, 12 nt, Homo sapiens
acccagccaggc

SEQ ID NO: 1253618 - RNA, 14 nt, Homo sapiens
acccaggacaucuc

SEQ ID NO: 1253619 - RNA, 14 nt, Homo sapiens
acccaggucuucca

SEQ ID NO: 1253620 - RNA, 18 nt, Homo sapiens
acccagguggagggcaca

SEQ ID NO: 1253621 - RNA, 14 nt, Homo sapiens
acccaguauuccau

SEQ ID NO: 1253622 - RNA, 13 nt, Homo sapiens
acccagucucaga

SEQ ID NO: 1253623 - RNA, 12 nt, Homo sapiens
acccagucucau

SEQ ID NO: 1253624 - RNA, 19 nt, Homo sapiens
acccaguggacucuuccac

SEQ ID NO: 1253625 - RNA, 15 nt, Homo sapiens
acccaguucagugag

SEQ ID NO: 1253626 - RNA, 23 nt, Homo sapiens
acccaguuugauaccugcacugu

SEQ ID NO: 1253627 - RNA, 18 nt, Homo sapiens
acccaucguucucugcua

SEQ ID NO: 1253628 - RNA, 13 nt, Homo sapiens
acccauucuacac

SEQ ID NO: 1253629 - RNA, 19 nt, Homo sapiens
accgucuuccuucagggau

SEQ ID NO: 1253630 - RNA, 21 nt, Homo sapiens
accgucuucucccuauucccu

SEQ ID NO: 1253631 - RNA, 20 nt, Homo sapiens
accguggacaggcccagcgc

SEQ ID NO: 1253632 - RNA, 23 nt, Homo sapiens
accguucauucaggcaacgcaca

SEQ ID NO: 1253633 - RNA, 14 nt, Homo sapiens
accguuguuugcaa

SEQ ID NO: 1253634 - RNA, 21 nt, Homo sapiens
accguuuugaagcuacugugu

SEQ ID NO: 1253635 - RNA, 22 nt, Homo sapiens
accuaaaaacauuuacugacca

SEQ ID NO: 1253636 - RNA, 23 nt, Homo sapiens
accuaaaaggaaaucucacccca

SEQ ID NO: 1253637 - RNA, 16 nt, Homo sapiens
accuaaaccaccagug

SEQ ID NO: 1253638 - RNA, 11 nt, Homo sapiens
accuaauccaa

SEQ ID NO: 1253639 - RNA, 14 nt, Homo sapiens
accuaaugggaccc

SEQ ID NO: 1253640 - RNA, 21 nt, Homo sapiens
accuaauguuuaugagccaga

SEQ ID NO: 1253641 - RNA, 17 nt, Homo sapiens
accuaauucgaugaagg

SEQ ID NO: 1253642 - RNA, 12 nt, Homo sapiens
accuacagagca

SEQ ID NO: 1253643 - RNA, 15 nt, Homo sapiens
accuacauuaucuca

SEQ ID NO: 1253644 - RNA, 12 nt, Homo sapiens
accuaccaaaau

SEQ ID NO: 1253645 - RNA, 17 nt, Homo sapiens
accuaccaaaauggaau

SEQ ID NO: 1253646 - RNA, 16 nt, Homo sapiens
accuaccaugcugcuu

SEQ ID NO: 1253647 - RNA, 17 nt, Homo sapiens
accuacccuccacaggc

SEQ ID NO: 1253648 - RNA, 21 nt, Homo sapiens
accuacccuccacaggcacag

SEQ ID NO: 1253649 - RNA, 13 nt, Homo sapiens
accuacugcugag

SEQ ID NO: 1253650 - RNA, 19 nt, Homo sapiens
accuacuuuucuuuccuca

SEQ ID NO: 1253651 - RNA, 16 nt, Homo sapiens
accuagcagccucaaa

SEQ ID NO: 1253652 - RNA, 18 nt, Homo sapiens
accuagcagccucaaaac

SEQ ID NO: 1253653 - RNA, 13 nt, Homo sapiens
accuagcauuuca

SEQ ID NO: 1253654 - RNA, 17 nt, Homo sapiens
agauuccacacaggggu

SEQ ID NO: 1253655 - RNA, 15 nt, Homo sapiens
agauucuaaagauuc

SEQ ID NO: 1253656 - RNA, 13 nt, Homo sapiens
agauucuaaugau

SEQ ID NO: 1253657 - RNA, 16 nt, Homo sapiens
agauucuaaugaugau

SEQ ID NO: 1253658 - RNA, 22 nt, Homo sapiens
agauugagaagccauguacuca

SEQ ID NO: 1253659 - RNA, 18 nt, Homo sapiens
agauugauuaaugaacua

SEQ ID NO: 1253660 - RNA, 17 nt, Homo sapiens
agauugugaauauuucc

SEQ ID NO: 1253661 - RNA, 14 nt, Homo sapiens
agauuuaacacuaa

SEQ ID NO: 1253662 - RNA, 13 nt, Homo sapiens
agauuuaucucug

SEQ ID NO: 1253663 - RNA, 23 nt, Homo sapiens
agauuucggaggccauccugcca

SEQ ID NO: 1253664 - RNA, 15 nt, Homo sapiens
agauuuggaugcacu

SEQ ID NO: 1253665 - RNA, 18 nt, Homo sapiens
agauuugucuaauugcau

SEQ ID NO: 1253666 - RNA, 17 nt, Homo sapiens
agauuuuaagggggaaa

SEQ ID NO: 1253667 - RNA, 17 nt, Homo sapiens
agauuuuacaaaagagg

SEQ ID NO: 1253668 - RNA, 14 nt, Homo sapiens
agauuuuaccuauc

SEQ ID NO: 1253669 - RNA, 15 nt, Homo sapiens
agauuuuaccuaucc

SEQ ID NO: 1253670 - RNA, 15 nt, Homo sapiens
agauuuuaugcugcu

SEQ ID NO: 1253671 - RNA, 22 nt, Homo sapiens
agauuuugaaugcuuccugaca

SEQ ID NO: 1253672 - RNA, 18 nt, Homo sapiens
agauuuugcaaucugugu

SEQ ID NO: 1253673 - RNA, 20 nt, Homo sapiens
agauuuugcaaucuguguuc

SEQ ID NO: 1253674 - RNA, 18 nt, Homo sapiens
agauuuugcaccuguaaa

SEQ ID NO: 1253675 - RNA, 15 nt, Homo sapiens
agauuuuuuccucug

SEQ ID NO: 1253676 - RNA, 22 nt, Homo sapiens
agauuuuuuccucugcauuuac

SEQ ID NO: 1253677 - RNA, 18 nt, Homo sapiens
agauuuuuuuguguaugu

SEQ ID NO: 1253678 - RNA, 19 nt, Homo sapiens
agcaaaaacauguaugugc

SEQ ID NO: 1253679 - RNA, 16 nt, Homo sapiens
agcaaaaaguauugaa

SEQ ID NO: 1253680 - RNA, 17 nt, Homo sapiens
agcaaaacgcauggagu

SEQ ID NO: 1253681 - RNA, 17 nt, Homo sapiens
agcaaaaugcuucugca

SEQ ID NO: 1253682 - RNA, 13 nt, Homo sapiens
agcaaacacuggg

SEQ ID NO: 1253683 - RNA, 17 nt, Homo sapiens
agcaaaucgugccuugu

SEQ ID NO: 1253684 - RNA, 14 nt, Homo sapiens
agcaaaucuaugag

SEQ ID NO: 1253685 - RNA, 12 nt, Homo sapiens
agcaaaugacaa

SEQ ID NO: 1253686 - RNA, 15 nt, Homo sapiens
agcaaauguggcucc

SEQ ID NO: 1253687 - RNA, 16 nt, Homo sapiens
agcaacagagcacuug

SEQ ID NO: 1253688 - RNA, 20 nt, Homo sapiens
agcaacagauguuuuauuga

SEQ ID NO: 1253689 - RNA, 15 nt, Homo sapiens
agcaacaucucggga

SEQ ID NO: 1253690 - RNA, 14 nt, Homo sapiens
agcaaccacacgga

SEQ ID NO: 1253691 - RNA, 13 nt, Homo sapiens
agcaacccugggu

SEQ ID NO: 1253692 - RNA, 17 nt, Homo sapiens
agcaacuguuaugaaau

SEQ ID NO: 1253693 - RNA, 16 nt, Homo sapiens
agcaacuucaaguaua

SEQ ID NO: 1253694 - RNA, 20 nt, Homo sapiens
agcaacuucuucuccauccc

SEQ ID NO: 1253695 - RNA, 23 nt, Homo sapiens
agcaagacaaauuagccauuuca

SEQ ID NO: 1253696 - RNA, 18 nt, Homo sapiens
agcaagacuccaucucag

SEQ ID NO: 1253697 - RNA, 22 nt, Homo sapiens
agcaagaucccauggguugugu

SEQ ID NO: 1253698 - RNA, 17 nt, Homo sapiens
agcaagcacuguggucu

SEQ ID NO: 1253699 - RNA, 21 nt, Homo sapiens
agcaaggcuggguaaugugaa

SEQ ID NO: 1253700 - RNA, 16 nt, Homo sapiens
agcaagugugcacucc

SEQ ID NO: 1253701 - RNA, 15 nt, Homo sapiens
agcaaguuagaacua

SEQ ID NO: 1253702 - RNA, 15 nt, Homo sapiens
agcaauaaauaacac

SEQ ID NO: 1253703 - RNA, 16 nt, Homo sapiens
agcaauacucaucaga

SEQ ID NO: 1253704 - RNA, 14 nt, Homo sapiens
agcaaugccauuuc

SEQ ID NO: 1253705 - RNA, 15 nt, Homo sapiens
agcaaugccauuuca

SEQ ID NO: 1253706 - RNA, 15 nt, Homo sapiens
agcaauggaguggcu

SEQ ID NO: 1253707 - RNA, 13 nt, Homo sapiens
agcaaugugguag

SEQ ID NO: 1253708 - RNA, 20 nt, Homo sapiens
agcaauuauuuuaagcacuu

SEQ ID NO: 1253709 - RNA, 18 nt, Homo sapiens
agcaauuccucugaacaa

SEQ ID NO: 1253710 - RNA, 16 nt, Homo sapiens
agcaauucuccugccu

SEQ ID NO: 1253711 - RNA, 19 nt, Homo sapiens
agcaauucuccugccuuag

SEQ ID NO: 1253712 - RNA, 20 nt, Homo sapiens
agcaauugacugucacuguu

SEQ ID NO: 1253713 - RNA, 13 nt, Homo sapiens
agcacaaacauuu

SEQ ID NO: 1253714 - RNA, 20 nt, Homo sapiens
agcacaacccccccaaaaca

SEQ ID NO: 1253715 - RNA, 13 nt, Homo sapiens
agcacaagccaca

SEQ ID NO: 1253716 - RNA, 22 nt, Homo sapiens
agcacaaucacuaaacuuuauu

SEQ ID NO: 1253717 - RNA, 19 nt, Homo sapiens
agcacagacucaaagggaa

SEQ ID NO: 1253718 - RNA, 18 nt, Homo sapiens
agcacagagcaguggcca

SEQ ID NO: 1253719 - RNA, 21 nt, Homo sapiens
agcacagauuuuaauugucau

SEQ ID NO: 1253720 - RNA, 20 nt, Homo sapiens
agcacagcagccccugcaca

SEQ ID NO: 1253721 - RNA, 20 nt, Homo sapiens
agcacagggggaagaagaag

SEQ ID NO: 1253722 - RNA, 15 nt, Homo sapiens
agcacagugccugac

SEQ ID NO: 1253723 - RNA, 16 nt, Homo sapiens
agcacaucaauuacaa

SEQ ID NO: 1253724 - RNA, 15 nt, Homo sapiens
agcaccggccucggg

SEQ ID NO: 1253725 - RNA, 21 nt, Homo sapiens
agcaccugaagugaccuggaa

SEQ ID NO: 1253726 - RNA, 22 nt, Homo sapiens
agcaccuucccucucaccaucc

SEQ ID NO: 1253727 - RNA, 14 nt, Homo sapiens
agcacgcugaaggc

SEQ ID NO: 1253728 - RNA, 13 nt, Homo sapiens
agcacggacaaua

SEQ ID NO: 1253729 - RNA, 14 nt, Homo sapiens
agcacggacaauaa

SEQ ID NO: 1253730 - RNA, 19 nt, Homo sapiens
agcacuaaggugugcucug

SEQ ID NO: 1253731 - RNA, 22 nt, Homo sapiens
agcacucagaaaagaaaaccau

SEQ ID NO: 1253732 - RNA, 14 nt, Homo sapiens
agcacucauuccuu

SEQ ID NO: 1253733 - RNA, 23 nt, Homo sapiens
agcacuccccagagcugugccag

SEQ ID NO: 1253734 - RNA, 17 nt, Homo sapiens
agcacucccuaauuuau

SEQ ID NO: 1253735 - RNA, 21 nt, Homo sapiens
agcacugaggguggcacucaa

SEQ ID NO: 1253736 - RNA, 15 nt, Homo sapiens
agcacuguccaguau

SEQ ID NO: 1253737 - RNA, 15 nt, Homo sapiens
agcacuguucugucc

SEQ ID NO: 1253738 - RNA, 15 nt, Homo sapiens
agcacuugagaacca

SEQ ID NO: 1253739 - RNA, 19 nt, Homo sapiens
agcacuuucauugccagug

SEQ ID NO: 1253740 - RNA, 17 nt, Homo sapiens
agcacuuugcacuuaau

SEQ ID NO: 1253741 - RNA, 15 nt, Homo sapiens
agcacuuugccaugc

SEQ ID NO: 1253742 - RNA, 20 nt, Homo sapiens
agcagaacagaucuuuuacu

SEQ ID NO: 1253743 - RNA, 17 nt, Homo sapiens
agcagagaccaccacau

SEQ ID NO: 1253744 - RNA, 18 nt, Homo sapiens
agcagagagggauggguu

SEQ ID NO: 1253745 - RNA, 17 nt, Homo sapiens
agcagaggcggucuuca

SEQ ID NO: 1253746 - RNA, 17 nt, Homo sapiens
agcagauccucaauaaa

SEQ ID NO: 1253747 - RNA, 14 nt, Homo sapiens
agcagcccugcucu

SEQ ID NO: 1253748 - RNA, 23 nt, Homo sapiens
agcagccuggaagaaacagucca

SEQ ID NO: 1253749 - RNA, 23 nt, Homo sapiens
agcagccuuucucucuuuauaca

SEQ ID NO: 1253750 - RNA, 18 nt, Homo sapiens
agcagcgaaaacugccag

SEQ ID NO: 1253751 - RNA, 14 nt, Homo sapiens
agcagcgccaguga

SEQ ID NO: 1253752 - RNA, 15 nt, Homo sapiens
agcagcgccagugac

SEQ ID NO: 1253753 - RNA, 16 nt, Homo sapiens
agcagcgguaccccag

SEQ ID NO: 1253754 - RNA, 14 nt, Homo sapiens
agcagcuggugcuc

SEQ ID NO: 1253755 - RNA, 19 nt, Homo sapiens
agcagcuuuaaacucaggg

SEQ ID NO: 1253756 - RNA, 13 nt, Homo sapiens
agcaggacuccag

SEQ ID NO: 1253757 - RNA, 18 nt, Homo sapiens
agcaggacuccaucucuu

SEQ ID NO: 1253758 - RNA, 14 nt, Homo sapiens
agcaggagccagcc

SEQ ID NO: 1253759 - RNA, 23 nt, Homo sapiens
agcaggcagcgccaagugcgugc

SEQ ID NO: 1253760 - RNA, 13 nt, Homo sapiens
agcagggacaaga

SEQ ID NO: 1253761 - RNA, 19 nt, Homo sapiens
agcagggauuaaccucugc

SEQ ID NO: 1253762 - RNA, 19 nt, Homo sapiens
agcaggggcuccagcaccu

SEQ ID NO: 1253763 - RNA, 11 nt, Homo sapiens
agcagggucag

SEQ ID NO: 1253764 - RNA, 21 nt, Homo sapiens
agcaggugcuacaacauguga

SEQ ID NO: 1253765 - RNA, 13 nt, Homo sapiens
agcaguaccaucu

SEQ ID NO: 1253766 - RNA, 10 nt, Homo sapiens
agcagucaau

SEQ ID NO: 1253767 - RNA, 12 nt, Homo sapiens
agcagucagggu

SEQ ID NO: 1253768 - RNA, 17 nt, Homo sapiens
agcagugucuuccauaa

SEQ ID NO: 1253769 - RNA, 22 nt, Homo sapiens
agcagugucuuccauaauguau

SEQ ID NO: 1253770 - RNA, 20 nt, Homo sapiens
agcaguugaucagacugaaa

SEQ ID NO: 1253771 - RNA, 14 nt, Homo sapiens
agcaguugugucag

SEQ ID NO: 1253772 - RNA, 19 nt, Homo sapiens
agcauaaauaaaacugaau

SEQ ID NO: 1253773 - RNA, 16 nt, Homo sapiens
agcauaacuguucuca

SEQ ID NO: 1253774 - RNA, 14 nt, Homo sapiens
agcauacaacugga

SEQ ID NO: 1253775 - RNA, 19 nt, Homo sapiens
agcauaccugucucagcug

SEQ ID NO: 1253776 - RNA, 13 nt, Homo sapiens
agcauagauaucu

SEQ ID NO: 1253777 - RNA, 14 nt, Homo sapiens
agcaucaccucagg

SEQ ID NO: 1253778 - RNA, 17 nt, Homo sapiens
agcaucaccucaggcca

SEQ ID NO: 1253779 - RNA, 18 nt, Homo sapiens
agcauccaaguggcauaa

SEQ ID NO: 1253780 - RNA, 13 nt, Homo sapiens
agcauccagcugc

SEQ ID NO: 1253781 - RNA, 17 nt, Homo sapiens
agcaucucccagcaaga

SEQ ID NO: 1253782 - RNA, 13 nt, Homo sapiens
agcaucugugaug

SEQ ID NO: 1253783 - RNA, 14 nt, Homo sapiens
agcaugaaagugga

SEQ ID NO: 1253784 - RNA, 20 nt, Homo sapiens
agcaugaccugugaccagca

SEQ ID NO: 1253785 - RNA, 13 nt, Homo sapiens
agcaugcacaaag

SEQ ID NO: 1253786 - RNA, 15 nt, Homo sapiens
agcaugccugaacua

SEQ ID NO: 1253787 - RNA, 13 nt, Homo sapiens
agcaugcuacagu

SEQ ID NO: 1253788 - RNA, 17 nt, Homo sapiens
agcaugcugcuuugcca

SEQ ID NO: 1253789 - RNA, 21 nt, Homo sapiens
agcaugcugcuuuuuguacuu

SEQ ID NO: 1253790 - RNA, 17 nt, Homo sapiens
agcaugcuucccagagg

SEQ ID NO: 1253791 - RNA, 22 nt, Homo sapiens
agcaugcuuugcugcuaugaaa

SEQ ID NO: 1253792 - RNA, 15 nt, Homo sapiens
agcauggacauuuag

SEQ ID NO: 1253793 - RNA, 17 nt, Homo sapiens
agcauggccccagucca

SEQ ID NO: 1253794 - RNA, 21 nt, Homo sapiens
agcauggccccaguccaugcu

SEQ ID NO: 1253795 - RNA, 15 nt, Homo sapiens
agcaugguauuugaa

SEQ ID NO: 1253796 - RNA, 15 nt, Homo sapiens
agcauguguauuucc

SEQ ID NO: 1253797 - RNA, 12 nt, Homo sapiens
agcauguuucau

SEQ ID NO: 1253798 - RNA, 22 nt, Homo sapiens
agcauuagcuggcgcauauuaa

SEQ ID NO: 1253799 - RNA, 17 nt, Homo sapiens
agcauuccagacuucaa

SEQ ID NO: 1253800 - RNA, 22 nt, Homo sapiens
agcauuuacagaaacgcaucca

SEQ ID NO: 1253801 - RNA, 23 nt, Homo sapiens
agcauuuccaacaccacagacac

SEQ ID NO: 1253802 - RNA, 16 nt, Homo sapiens
agcauuucuagcagug

SEQ ID NO: 1253803 - RNA, 18 nt, Homo sapiens
agcauuucuagcagugau

SEQ ID NO: 1253804 - RNA, 13 nt, Homo sapiens
agcauuucuugau

SEQ ID NO: 1253805 - RNA, 13 nt, Homo sapiens
agccaaacaaaac

SEQ ID NO: 1253806 - RNA, 19 nt, Homo sapiens
agccaaacccuugucagug

SEQ ID NO: 1253807 - RNA, 21 nt, Homo sapiens
agccaaacugucuuugucacc

SEQ ID NO: 1253808 - RNA, 16 nt, Homo sapiens
agccaaauaaaaucua

SEQ ID NO: 1253809 - RNA, 13 nt, Homo sapiens
agccaaauguaau

SEQ ID NO: 1253810 - RNA, 23 nt, Homo sapiens
agccaacucuaacaggcacuuug

SEQ ID NO: 1253811 - RNA, 20 nt, Homo sapiens
agccaacuguuucccugcug

SEQ ID NO: 1253812 - RNA, 16 nt, Homo sapiens
agccaagaacgcaggg

SEQ ID NO: 1253813 - RNA, 21 nt, Homo sapiens
agccaagaucgccccacugca

SEQ ID NO: 1253814 - RNA, 23 nt, Homo sapiens
agccaagcucccuggagcccugu

SEQ ID NO: 1253815 - RNA, 22 nt, Homo sapiens
agccaagcuuguuaucagcuuu

SEQ ID NO: 1253816 - RNA, 19 nt, Homo sapiens
agccaagggaaaggggugc

SEQ ID NO: 1253817 - RNA, 13 nt, Homo sapiens
agccaauauuccu

SEQ ID NO: 1253818 - RNA, 16 nt, Homo sapiens
agccacaaacuccauc

SEQ ID NO: 1253819 - RNA, 16 nt, Homo sapiens
agccacaaccaaaaaa

SEQ ID NO: 1253820 - RNA, 19 nt, Homo sapiens
agccacacaaacguuuacu

SEQ ID NO: 1253821 - RNA, 12 nt, Homo sapiens
agccacagcucu

SEQ ID NO: 1253822 - RNA, 18 nt, Homo sapiens
agccacaggcaccucucc

SEQ ID NO: 1253823 - RNA, 20 nt, Homo sapiens
agccacauggccccauccca

SEQ ID NO: 1253824 - RNA, 15 nt, Homo sapiens
agccaccacauuuag

SEQ ID NO: 1253825 - RNA, 14 nt, Homo sapiens
agccaccaguucuc

SEQ ID NO: 1253826 - RNA, 19 nt, Homo sapiens
agccacccguggggugcug

SEQ ID NO: 1253827 - RNA, 17 nt, Homo sapiens
agccacgaccagccccu

SEQ ID NO: 1253828 - RNA, 16 nt, Homo sapiens
agccacgaggugcagu

SEQ ID NO: 1253829 - RNA, 14 nt, Homo sapiens
agccacgugaaugg

SEQ ID NO: 1253830 - RNA, 14 nt, Homo sapiens
agccacuaagcaga

SEQ ID NO: 1253831 - RNA, 20 nt, Homo sapiens
agccacucagucucuuccac

SEQ ID NO: 1253832 - RNA, 14 nt, Homo sapiens
agccacuucggcca

SEQ ID NO: 1253833 - RNA, 16 nt, Homo sapiens
agccagagaugcaaua

SEQ ID NO: 1253834 - RNA, 12 nt, Homo sapiens
agccagcaagag

SEQ ID NO: 1253835 - RNA, 13 nt, Homo sapiens
agccagccaugca

SEQ ID NO: 1253836 - RNA, 14 nt, Homo sapiens
agccagcucccagc

SEQ ID NO: 1253837 - RNA, 16 nt, Homo sapiens
agccagcucccagcca

SEQ ID NO: 1253838 - RNA, 19 nt, Homo sapiens
agccagcucccagccacau

SEQ ID NO: 1253839 - RNA, 16 nt, Homo sapiens
agccagcucugcauua

SEQ ID NO: 1253840 - RNA, 15 nt, Homo sapiens
agccagcugcagcug

SEQ ID NO: 1253841 - RNA, 17 nt, Homo sapiens
agccagcugcuuuuugu

SEQ ID NO: 1253842 - RNA, 20 nt, Homo sapiens
agccagcuuacuagcacuuu

SEQ ID NO: 1253843 - RNA, 23 nt, Homo sapiens
agccagcuuggggccaccaaagc

SEQ ID NO: 1253844 - RNA, 15 nt, Homo sapiens
agccaggacaucucu

SEQ ID NO: 1253845 - RNA, 18 nt, Homo sapiens
agccaggaccacagagcu

SEQ ID NO: 1253846 - RNA, 15 nt, Homo sapiens
agccaggaccugcug

SEQ ID NO: 1253847 - RNA, 19 nt, Homo sapiens
agccaggccaacagcaccu

SEQ ID NO: 1253848 - RNA, 14 nt, Homo sapiens
agccagggucucac

SEQ ID NO: 1253849 - RNA, 16 nt, Homo sapiens
agccagugagggcagu

SEQ ID NO: 1253850 - RNA, 14 nt, Homo sapiens
agccagugccauuc

SEQ ID NO: 1253851 - RNA, 21 nt, Homo sapiens
agccaguggggaugaggucac

SEQ ID NO: 1253852 - RNA, 18 nt, Homo sapiens
agccauaagaaagcacua

SEQ ID NO: 1253853 - RNA, 22 nt, Homo sapiens
agccauaagaaagcacuauuaa

SEQ ID NO: 1253854 - RNA, 21 nt, Homo sapiens
agccauauaaguuugaaggaa

SEQ ID NO: 1253855 - RNA, 22 nt, Homo sapiens
agccauaugcccucaucauccc

SEQ ID NO: 1253856 - RNA, 20 nt, Homo sapiens
agccaucccuuuuuuuacau

SEQ ID NO: 1253857 - RNA, 23 nt, Homo sapiens
agccaucccuuuuuuuacauuuc

SEQ ID NO: 1253858 - RNA, 18 nt, Homo sapiens
agccaucugcacacaccu

SEQ ID NO: 1253859 - RNA, 15 nt, Homo sapiens
agccaucuugaucug

SEQ ID NO: 1253860 - RNA, 18 nt, Homo sapiens
agccaucuugaucugugu

SEQ ID NO: 1253861 - RNA, 17 nt, Homo sapiens
agccauggaacccugcc

SEQ ID NO: 1253862 - RNA, 15 nt, Homo sapiens
agccauuggcacugu

SEQ ID NO: 1253863 - RNA, 15 nt, Homo sapiens
agccauuuugugaau

SEQ ID NO: 1253864 - RNA, 15 nt, Homo sapiens
agcccaaaacccagg

SEQ ID NO: 1253865 - RNA, 20 nt, Homo sapiens
agcccaacagacaccaucuu

SEQ ID NO: 1253866 - RNA, 18 nt, Homo sapiens
agcccacccugcugccuu

SEQ ID NO: 1253867 - RNA, 17 nt, Homo sapiens
agcccaccugcacccag

SEQ ID NO: 1253868 - RNA, 16 nt, Homo sapiens
agcccagacgcagcug

SEQ ID NO: 1253869 - RNA, 19 nt, Homo sapiens
agcccagacucugagcugc

SEQ ID NO: 1253870 - RNA, 13 nt, Homo sapiens
agcccagacuuua

SEQ ID NO: 1253871 - RNA, 14 nt, Homo sapiens
agcccagccauuac

SEQ ID NO: 1253872 - RNA, 14 nt, Homo sapiens
agcccagccuggga

SEQ ID NO: 1253873 - RNA, 22 nt, Homo sapiens
agcccagcuuggcccuuuccuu

SEQ ID NO: 1253874 - RNA, 22 nt, Homo sapiens
agcccaggagagagcuacggca

SEQ ID NO: 1253875 - RNA, 22 nt, Homo sapiens
agcccagggcuccugcacuuac

SEQ ID NO: 1253876 - RNA, 14 nt, Homo sapiens
agcccauccauagu

SEQ ID NO: 1253877 - RNA, 20 nt, Homo sapiens
agcccauggcccccaauaaa

SEQ ID NO: 1253878 - RNA, 24 nt, Homo sapiens
agcccauggcccccaauaaaggca

SEQ ID NO: 1253879 - RNA, 19 nt, Homo sapiens
agcccaugugcaccugccc

SEQ ID NO: 1253880 - RNA, 16 nt, Homo sapiens
agccccacaacuuuaa

SEQ ID NO: 1253881 - RNA, 17 nt, Homo sapiens
agccccacccuccuuga

SEQ ID NO: 1253882 - RNA, 14 nt, Homo sapiens
agccccaccucaca

SEQ ID NO: 1253883 - RNA, 16 nt, Homo sapiens
agccccagacaacagc

SEQ ID NO: 1253884 - RNA, 18 nt, Homo sapiens
agccccagagcagggugu

SEQ ID NO: 1253885 - RNA, 19 nt, Homo sapiens
agccccaggccucuguguc

SEQ ID NO: 1253886 - RNA, 16 nt, Homo sapiens
agccccaggggacaag

SEQ ID NO: 1253887 - RNA, 15 nt, Homo sapiens
agccccagucuuccu

SEQ ID NO: 1253888 - RNA, 16 nt, Homo sapiens
agccccauguguaccu

SEQ ID NO: 1253889 - RNA, 20 nt, Homo sapiens
agcccccaccccgagucaca

SEQ ID NO: 1253890 - RNA, 18 nt, Homo sapiens
agccccuagaaacccaag

SEQ ID NO: 1253891 - RNA, 17 nt, Homo sapiens
agccccucacauuccua

SEQ ID NO: 1253892 - RNA, 16 nt, Homo sapiens
agccccuuauuugcac

SEQ ID NO: 1253893 - RNA, 18 nt, Homo sapiens
agccccuuauuugcacuu

SEQ ID NO: 1253894 - RNA, 20 nt, Homo sapiens
agccccuuauuugcacuuca

SEQ ID NO: 1253895 - RNA, 17 nt, Homo sapiens
agcccgacagugccauc

SEQ ID NO: 1253896 - RNA, 20 nt, Homo sapiens
agcccgacagugccaucccc

SEQ ID NO: 1253897 - RNA, 18 nt, Homo sapiens
agcccuaaagaaugcaac

SEQ ID NO: 1253898 - RNA, 16 nt, Homo sapiens
agcccuaauagcagaa

SEQ ID NO: 1253899 - RNA, 23 nt, Homo sapiens
agcccuacauugugcugcaccug

SEQ ID NO: 1253900 - RNA, 19 nt, Homo sapiens
agcccucccccagcaguug

SEQ ID NO: 1253901 - RNA, 19 nt, Homo sapiens
agcccuccucugcacuccc

SEQ ID NO: 1253902 - RNA, 20 nt, Homo sapiens
agcccucgaaccaaggcagc

SEQ ID NO: 1253903 - RNA, 15 nt, Homo sapiens
agcccugaggugaaa

SEQ ID NO: 1253904 - RNA, 17 nt, Homo sapiens
agcccugcagagcacaa

SEQ ID NO: 1253905 - RNA, 16 nt, Homo sapiens
agcccuggccagcccu

SEQ ID NO: 1253906 - RNA, 15 nt, Homo sapiens
agcccugucugcuag

SEQ ID NO: 1253907 - RNA, 22 nt, Homo sapiens
agcccuguggccgccaccugag

SEQ ID NO: 1253908 - RNA, 16 nt, Homo sapiens
agcccuguguguguca

SEQ ID NO: 1253909 - RNA, 16 nt, Homo sapiens
agcccuuagcagggaa

SEQ ID NO: 1253910 - RNA, 14 nt, Homo sapiens
agcccuuuacuuga

SEQ ID NO: 1253911 - RNA, 21 nt, Homo sapiens
agcccuuuuuguacugauaua

SEQ ID NO: 1253912 - RNA, 20 nt, Homo sapiens
agccgagauugcaccacugc

SEQ ID NO: 1253913 - RNA, 23 nt, Homo sapiens
agccgagauugcaccacugcacu

SEQ ID NO: 1253914 - RNA, 21 nt, Homo sapiens
agccgagauugcgccacugca

SEQ ID NO: 1253915 - RNA, 20 nt, Homo sapiens
agccgauggaaaauaccuaa

SEQ ID NO: 1253916 - RNA, 18 nt, Homo sapiens
agccgccugaaagccaca

SEQ ID NO: 1253917 - RNA, 12 nt, Homo sapiens
agccgcugugag

SEQ ID NO: 1253918 - RNA, 15 nt, Homo sapiens
agccguauuuuacau

SEQ ID NO: 1253919 - RNA, 17 nt, Homo sapiens
agccgugaugcucaggc

SEQ ID NO: 1253920 - RNA, 19 nt, Homo sapiens
agccuaauacaacauguag

SEQ ID NO: 1253921 - RNA, 24 nt, Homo sapiens
agccuacaguuauguucagucaca

SEQ ID NO: 1253922 - RNA, 21 nt, Homo sapiens
agccuacuuucacacuaagaa

SEQ ID NO: 1253923 - RNA, 18 nt, Homo sapiens
agccuagccugcauauca

SEQ ID NO: 1253924 - RNA, 16 nt, Homo sapiens
agccuaggaccacuca

SEQ ID NO: 1253925 - RNA, 18 nt, Homo sapiens
agccuaggaccacucagc

SEQ ID NO: 1253926 - RNA, 22 nt, Homo sapiens
agccuauaccccuuacuuagca

SEQ ID NO: 1253927 - RNA, 23 nt, Homo sapiens
agccuaugaggggguuuggcacc

SEQ ID NO: 1253928 - RNA, 15 nt, Homo sapiens
agccuauuuaccugc

SEQ ID NO: 1253929 - RNA, 23 nt, Homo sapiens
agccucaagucuuauuuccucaa

SEQ ID NO: 1253930 - RNA, 17 nt, Homo sapiens
agccucagcaacccagg

SEQ ID NO: 1253931 - RNA, 23 nt, Homo sapiens
agccuccagcaccuucccucuca

SEQ ID NO: 1253932 - RNA, 20 nt, Homo sapiens
agccuccccgugccaaaaau

SEQ ID NO: 1253933 - RNA, 15 nt, Homo sapiens
agccuccuccugacc

SEQ ID NO: 1253934 - RNA, 17 nt, Homo sapiens
agccuccugcccagucc

SEQ ID NO: 1253935 - RNA, 17 nt, Homo sapiens
agccucucaaguaauau

SEQ ID NO: 1253936 - RNA, 16 nt, Homo sapiens
agccucucaccuggac

SEQ ID NO: 1253937 - RNA, 14 nt, Homo sapiens
agccucuccuccau

SEQ ID NO: 1253938 - RNA, 21 nt, Homo sapiens
agccucugaccccuccucacu

SEQ ID NO: 1253939 - RNA, 16 nt, Homo sapiens
agccucuggcauuaga

SEQ ID NO: 1253940 - RNA, 13 nt, Homo sapiens
agccucuggcuag

SEQ ID NO: 1253941 - RNA, 21 nt, Homo sapiens
agccucuggcuccacaccucc

SEQ ID NO: 1253942 - RNA, 20 nt, Homo sapiens
agccucuggggcuguugaag

SEQ ID NO: 1253943 - RNA, 22 nt, Homo sapiens
agccucuugacgcuggaagugu

SEQ ID NO: 1253944 - RNA, 21 nt, Homo sapiens
agccugagcagagacaugacu

SEQ ID NO: 1253945 - RNA, 20 nt, Homo sapiens
agccugaggcagccacuucg

SEQ ID NO: 1253946 - RNA, 15 nt, Homo sapiens
agccugagucagggc

SEQ ID NO: 1253947 - RNA, 23 nt, Homo sapiens
agccugcaaacucacugcucaag

SEQ ID NO: 1253948 - RNA, 13 nt, Homo sapiens
agccugcacuggg

SEQ ID NO: 1253949 - RNA, 18 nt, Homo sapiens
agccugcagaauccagcu

SEQ ID NO: 1253950 - RNA, 12 nt, Homo sapiens
agccugcauuga

SEQ ID NO: 1253951 - RNA, 20 nt, Homo sapiens
agccugcauugagcuugcau

SEQ ID NO: 1253952 - RNA, 12 nt, Homo sapiens
agccugcucccu

SEQ ID NO: 1253953 - RNA, 14 nt, Homo sapiens
agccugcucccuag

SEQ ID NO: 1253954 - RNA, 17 nt, Homo sapiens
agccugcucccuagcca

SEQ ID NO: 1253955 - RNA, 18 nt, Homo sapiens
agccugcucccuagccag

SEQ ID NO: 1253956 - RNA, 20 nt, Homo sapiens
agccugcucccuagccagag

SEQ ID NO: 1253957 - RNA, 19 nt, Homo sapiens
agccugcucuagugggaca

SEQ ID NO: 1253958 - RNA, 14 nt, Homo sapiens
agccugcugcaugg

SEQ ID NO: 1253959 - RNA, 15 nt, Homo sapiens
agccugcuguuucca

SEQ ID NO: 1253960 - RNA, 20 nt, Homo sapiens
agccuggccccggccuuuau

SEQ ID NO: 1253961 - RNA, 16 nt, Homo sapiens
agccuggccccugugc

SEQ ID NO: 1253962 - RNA, 18 nt, Homo sapiens
agccuggcucuaucuucc

SEQ ID NO: 1253963 - RNA, 16 nt, Homo sapiens
agccugggagcccaga

SEQ ID NO: 1253964 - RNA, 20 nt, Homo sapiens
agccuggggccuggcaggga

SEQ ID NO: 1253965 - RNA, 16 nt, Homo sapiens
agccuggugcugcugc

SEQ ID NO: 1253966 - RNA, 15 nt, Homo sapiens
agccuguacaaccua

SEQ ID NO: 1253967 - RNA, 16 nt, Homo sapiens
agccugugcaaugcau

SEQ ID NO: 1253968 - RNA, 15 nt, Homo sapiens
agccuuaagccauag

SEQ ID NO: 1253969 - RNA, 12 nt, Homo sapiens
agccuucaagau

SEQ ID NO: 1253970 - RNA, 14 nt, Homo sapiens
agccuucagucaca

SEQ ID NO: 1253971 - RNA, 15 nt, Homo sapiens
agccuuccacaguga

SEQ ID NO: 1253972 - RNA, 16 nt, Homo sapiens
agccuucggacagaca

SEQ ID NO: 1253973 - RNA, 19 nt, Homo sapiens
agccuugaugccauaugcc

SEQ ID NO: 1253974 - RNA, 21 nt, Homo sapiens
agccuugugugaacucaccaa

SEQ ID NO: 1253975 - RNA, 13 nt, Homo sapiens
agccuuuccauaa

SEQ ID NO: 1253976 - RNA, 16 nt, Homo sapiens
agccuuuuauacugau

SEQ ID NO: 1253977 - RNA, 16 nt, Homo sapiens
agcgaagucucauggg

SEQ ID NO: 1253978 - RNA, 22 nt, Homo sapiens
agcgaccgcccccuccucuagc

SEQ ID NO: 1253979 - RNA, 19 nt, Homo sapiens
agcgagcagucagcauucu

SEQ ID NO: 1253980 - RNA, 16 nt, Homo sapiens
agcgagcuaugaucgc

SEQ ID NO: 1253981 - RNA, 18 nt, Homo sapiens
agcgaugaauuuggagac

SEQ ID NO: 1253982 - RNA, 19 nt, Homo sapiens
agcgaugaggggacauuuu

SEQ ID NO: 1253983 - RNA, 15 nt, Homo sapiens
agcgauggugccugc

SEQ ID NO: 1253984 - RNA, 13 nt, Homo sapiens
agcgcacagggag

SEQ ID NO: 1253985 - RNA, 20 nt, Homo sapiens
agcgcucugccucaccgcuu

SEQ ID NO: 1253986 - RNA, 20 nt, Homo sapiens
agcggacaagcagcuggugc

SEQ ID NO: 1253987 - RNA, 23 nt, Homo sapiens
agcggagaucgcaucauugcacu

SEQ ID NO: 1253988 - RNA, 14 nt, Homo sapiens
agcgggcacagggc

SEQ ID NO: 1253989 - RNA, 23 nt, Homo sapiens
agcggggccaccgcgacguugca

SEQ ID NO: 1253990 - RNA, 16 nt, Homo sapiens
agcggugccacugagg

SEQ ID NO: 1253991 - RNA, 15 nt, Homo sapiens
agcggugggcacugu

SEQ ID NO: 1253992 - RNA, 16 nt, Homo sapiens
agcgucccuagcagug

SEQ ID NO: 1253993 - RNA, 18 nt, Homo sapiens
agcgucccuagcagugaa

SEQ ID NO: 1253994 - RNA, 20 nt, Homo sapiens
agcguccucguucaaaacau

SEQ ID NO: 1253995 - RNA, 21 nt, Homo sapiens
agcguguguauccgacucuaa

SEQ ID NO: 1253996 - RNA, 17 nt, Homo sapiens
agcguguuuacaugugu

SEQ ID NO: 1253997 - RNA, 13 nt, Homo sapiens
agcguuaugugca

SEQ ID NO: 1253998 - RNA, 12 nt, Homo sapiens
agcguucccaac

SEQ ID NO: 1253999 - RNA, 23 nt, Homo sapiens
agcuaacccucacaagcaugaag

SEQ ID NO: 1254000 - RNA, 16 nt, Homo sapiens
agcuaacuuauuuucc

SEQ ID NO: 1254001 - RNA, 14 nt, Homo sapiens
agcuaagauuaucu

SEQ ID NO: 1254002 - RNA, 18 nt, Homo sapiens
agcuaagccacauggcug

SEQ ID NO: 1254003 - RNA, 15 nt, Homo sapiens
agcuaauguaauaac

SEQ ID NO: 1254004 - RNA, 12 nt, Homo sapiens
agcuacaguaga

SEQ ID NO: 1254005 - RNA, 14 nt, Homo sapiens
agcuaccagguguu

SEQ ID NO: 1254006 - RNA, 16 nt, Homo sapiens
agcuacuaaugauguu

SEQ ID NO: 1254007 - RNA, 20 nt, Homo sapiens
agcuacucaggagguugagg

SEQ ID NO: 1254008 - RNA, 14 nt, Homo sapiens
agcuacucucccca

SEQ ID NO: 1254009 - RNA, 20 nt, Homo sapiens
agcuacuggacuaugcugau

SEQ ID NO: 1254010 - RNA, 23 nt, Homo sapiens
agcuacugugugugugaaugaac

SEQ ID NO: 1254011 - RNA, 13 nt, Homo sapiens
agcuacuugccuu

SEQ ID NO: 1254012 - RNA, 23 nt, Homo sapiens
agcuagaggacuucuggcaggga

SEQ ID NO: 1254013 - RNA, 18 nt, Homo sapiens
agcuagcacuaacucgug

SEQ ID NO: 1254014 - RNA, 14 nt, Homo sapiens
agcuaggaugguuc

SEQ ID NO: 1254015 - RNA, 16 nt, Homo sapiens
agcuaguguaccuccu

SEQ ID NO: 1254016 - RNA, 17 nt, Homo sapiens
agcuaguguaccuccuc

SEQ ID NO: 1254017 - RNA, 19 nt, Homo sapiens
agcuaucagcaauacucau

SEQ ID NO: 1254018 - RNA, 19 nt, Homo sapiens
agcuaucugucaucucucu

SEQ ID NO: 1254019 - RNA, 14 nt, Homo sapiens
agcuaugaauauag

SEQ ID NO: 1254020 - RNA, 16 nt, Homo sapiens
agcuaugaucgcgcca

SEQ ID NO: 1254021 - RNA, 20 nt, Homo sapiens
agcuaugauuaugccacugc

SEQ ID NO: 1254022 - RNA, 17 nt, Homo sapiens
agcuaugggagccccag

SEQ ID NO: 1254023 - RNA, 14 nt, Homo sapiens
agcuauuaagauac

SEQ ID NO: 1254024 - RNA, 16 nt, Homo sapiens
agcuauuagccaggau

SEQ ID NO: 1254025 - RNA, 19 nt, Homo sapiens
agcuauugccaaccaguuu

SEQ ID NO: 1254026 - RNA, 20 nt, Homo sapiens
agcuauuuaucuguaguaaa

SEQ ID NO: 1254027 - RNA, 15 nt, Homo sapiens
agcucaagaacacau

SEQ ID NO: 1254028 - RNA, 20 nt, Homo sapiens
agcucaauuguuaaugugau

SEQ ID NO: 1254029 - RNA, 16 nt, Homo sapiens
agcucacagugacauu

SEQ ID NO: 1254030 - RNA, 12 nt, Homo sapiens
agcucaccagcc

SEQ ID NO: 1254031 - RNA, 16 nt, Homo sapiens
agcucacuuccuccag

SEQ ID NO: 1254032 - RNA, 16 nt, Homo sapiens
agcucagcauuuccac

SEQ ID NO: 1254033 - RNA, 14 nt, Homo sapiens
agcucagccagugg

SEQ ID NO: 1254034 - RNA, 22 nt, Homo sapiens
agcucagcugggguugugcaag

SEQ ID NO: 1254035 - RNA, 14 nt, Homo sapiens
agcucaggcauuug

SEQ ID NO: 1254036 - RNA, 20 nt, Homo sapiens
agcucaggucccaggccagc

SEQ ID NO: 1254037 - RNA, 22 nt, Homo sapiens
agcucaggugucccugcacuug

SEQ ID NO: 1254038 - RNA, 16 nt, Homo sapiens
agcucaguguguucug

SEQ ID NO: 1254039 - RNA, 12 nt, Homo sapiens
agcucaguuuau

SEQ ID NO: 1254040 - RNA, 22 nt, Homo sapiens
agcucaugcauuucaagcagcu

SEQ ID NO: 1254041 - RNA, 16 nt, Homo sapiens
agcucauucucaccaa

SEQ ID NO: 1254042 - RNA, 23 nt, Homo sapiens
agcucauuuugucugguccugau

SEQ ID NO: 1254043 - RNA, 13 nt, Homo sapiens
agcuccacagggc

SEQ ID NO: 1254044 - RNA, 14 nt, Homo sapiens
agcuccacugucac

SEQ ID NO: 1254045 - RNA, 20 nt, Homo sapiens
agcucccagcugaccagaca

SEQ ID NO: 1254046 - RNA, 19 nt, Homo sapiens
agcuccccagaucucccac

SEQ ID NO: 1254047 - RNA, 22 nt, Homo sapiens
agcucccggggacgacgcugac

SEQ ID NO: 1254048 - RNA, 17 nt, Homo sapiens
agcuccgccucccgggu

SEQ ID NO: 1254049 - RNA, 21 nt, Homo sapiens
agcuccucccacaaugcugaa

SEQ ID NO: 1254050 - RNA, 15 nt, Homo sapiens
agcucucacaugcac

SEQ ID NO: 1254051 - RNA, 16 nt, Homo sapiens
agcucucacaugcaca

SEQ ID NO: 1254052 - RNA, 19 nt, Homo sapiens
agcucuccccaaacuugcu

SEQ ID NO: 1254053 - RNA, 22 nt, Homo sapiens
agcucugauugcagcacagagc

SEQ ID NO: 1254054 - RNA, 19 nt, Homo sapiens
agcucugcuccucucccca

SEQ ID NO: 1254055 - RNA, 22 nt, Homo sapiens
agcucuggccacaacagggcau

SEQ ID NO: 1254056 - RNA, 20 nt, Homo sapiens
agcucuggggugggcaguuu

SEQ ID NO: 1254057 - RNA, 21 nt, Homo sapiens
agcucuguauggucaggaugu

SEQ ID NO: 1254058 - RNA, 19 nt, Homo sapiens
agcucuguuuuacaauaaa

SEQ ID NO: 1254059 - RNA, 14 nt, Homo sapiens
agcucuucagcaca

SEQ ID NO: 1254060 - RNA, 20 nt, Homo sapiens
agcucuucagcacaaagaca

SEQ ID NO: 1254061 - RNA, 21 nt, Homo sapiens
agcucuucaggccucccucuc

SEQ ID NO: 1254062 - RNA, 14 nt, Homo sapiens
agcucuuccuaucc

SEQ ID NO: 1254063 - RNA, 16 nt, Homo sapiens
agcugaaagauugauu

SEQ ID NO: 1254064 - RNA, 15 nt, Homo sapiens
agcugaaaggaugau

SEQ ID NO: 1254065 - RNA, 14 nt, Homo sapiens
agcugaacaauagg

SEQ ID NO: 1254066 - RNA, 18 nt, Homo sapiens
agcugaacaauaggcugu

SEQ ID NO: 1254067 - RNA, 23 nt, Homo sapiens
agcugaagaacuuggcacacucu

SEQ ID NO: 1254068 - RNA, 15 nt, Homo sapiens
agcugaccaucaucc

SEQ ID NO: 1254069 - RNA, 21 nt, Homo sapiens
agcugaccuggagaugcugcc

SEQ ID NO: 1254070 - RNA, 18 nt, Homo sapiens
agcugacuguucuuggua

SEQ ID NO: 1254071 - RNA, 16 nt, Homo sapiens
agcugagaucgugcua

SEQ ID NO: 1254072 - RNA, 16 nt, Homo sapiens
agcugagauugcacua

SEQ ID NO: 1254073 - RNA, 22 nt, Homo sapiens
agcugagugcuagaguaggugc

SEQ ID NO: 1254074 - RNA, 23 nt, Homo sapiens
agcugagugcuagaguaggugca

SEQ ID NO: 1254075 - RNA, 14 nt, Homo sapiens
agcugauacuuuga

SEQ ID NO: 1254076 - RNA, 20 nt, Homo sapiens
agcugauguuuugguguauu

SEQ ID NO: 1254077 - RNA, 23 nt, Homo sapiens
agcugauugggcaccugaccaca

SEQ ID NO: 1254078 - RNA, 21 nt, Homo sapiens
agcugauuugauaccauggca

SEQ ID NO: 1254079 - RNA, 14 nt, Homo sapiens
agcugcaaguguau

SEQ ID NO: 1254080 - RNA, 15 nt, Homo sapiens
agcugcaccugccag

SEQ ID NO: 1254081 - RNA, 19 nt, Homo sapiens
agcugcacugaucacccaa

SEQ ID NO: 1254082 - RNA, 17 nt, Homo sapiens
agcugcagaucuuugcu

SEQ ID NO: 1254083 - RNA, 13 nt, Homo sapiens
agcugcauaugau

SEQ ID NO: 1254084 - RNA, 14 nt, Homo sapiens
agcugccucugcuc

SEQ ID NO: 1254085 - RNA, 22 nt, Homo sapiens
agcugccuuggcucagacaugu

SEQ ID NO: 1254086 - RNA, 16 nt, Homo sapiens
agcugcuggcuugcag

SEQ ID NO: 1254087 - RNA, 14 nt, Homo sapiens
agcuggaaaaccuc

SEQ ID NO: 1254088 - RNA, 23 nt, Homo sapiens
agcuggaagggucaacaucuuuu

SEQ ID NO: 1254089 - RNA, 17 nt, Homo sapiens
agcuggaccaguggugc

SEQ ID NO: 1254090 - RNA, 14 nt, Homo sapiens
agcuggacuacggc

SEQ ID NO: 1254091 - RNA, 19 nt, Homo sapiens
agcuggaggcuccaggacu

SEQ ID NO: 1254092 - RNA, 22 nt, Homo sapiens
agcuggagguggaaaauggugc

SEQ ID NO: 1254093 - RNA, 18 nt, Homo sapiens
agcuggccuggacaguau

SEQ ID NO: 1254094 - RNA, 23 nt, Homo sapiens
agcuggcgaacccugggccaucc

SEQ ID NO: 1254095 - RNA, 17 nt, Homo sapiens
agcugggacuacaggug

SEQ ID NO: 1254096 - RNA, 16 nt, Homo sapiens
agcugggagcacuggu

SEQ ID NO: 1254097 - RNA, 22 nt, Homo sapiens
agcugggauaaucacauuauca

SEQ ID NO: 1254098 - RNA, 17 nt, Homo sapiens
agcugggauuacaggcg

SEQ ID NO: 1254099 - RNA, 16 nt, Homo sapiens
agcugggcagaccccu

SEQ ID NO: 1254100 - RNA, 21 nt, Homo sapiens
agcugggcccaccgaggugcu

SEQ ID NO: 1254101 - RNA, 23 nt, Homo sapiens
agcugggcccaccgaggugcuau

SEQ ID NO: 1254102 - RNA, 17 nt, Homo sapiens
agcugggcucugcaauu

SEQ ID NO: 1254103 - RNA, 15 nt, Homo sapiens
agcugggguugugca

SEQ ID NO: 1254104 - RNA, 18 nt, Homo sapiens
agcugguaaacuauuugu

SEQ ID NO: 1254105 - RNA, 19 nt, Homo sapiens
agcuggugcuccaagcaca

SEQ ID NO: 1254106 - RNA, 21 nt, Homo sapiens
agcugguggcaauaaauauua

SEQ ID NO: 1254107 - RNA, 23 nt, Homo sapiens
agcuguagaccaccuaauaucaa

SEQ ID NO: 1254108 - RNA, 17 nt, Homo sapiens
agcuguagccauggcuc

SEQ ID NO: 1254109 - RNA, 17 nt, Homo sapiens
agcugucaggcugauua

SEQ ID NO: 1254110 - RNA, 19 nt, Homo sapiens
agcugucccaccugcacac

SEQ ID NO: 1254111 - RNA, 15 nt, Homo sapiens
agcugucgacuucau

SEQ ID NO: 1254112 - RNA, 16 nt, Homo sapiens
agcugugaugguaccu

SEQ ID NO: 1254113 - RNA, 19 nt, Homo sapiens
agcugugcgcaauugcuca

SEQ ID NO: 1254114 - RNA, 21 nt, Homo sapiens
agcuguggccuaggcuaccuc

SEQ ID NO: 1254115 - RNA, 14 nt, Homo sapiens
agcuguuuccauag

SEQ ID NO: 1254116 - RNA, 16 nt, Homo sapiens
agcuuacuagcacuuu

SEQ ID NO: 1254117 - RNA, 22 nt, Homo sapiens
agcuuagccaaugugggagcag

SEQ ID NO: 1254118 - RNA, 21 nt, Homo sapiens
agcuuauaaaaauaaagggaa

SEQ ID NO: 1254119 - RNA, 14 nt, Homo sapiens
agcuucaccagagc

SEQ ID NO: 1254120 - RNA, 13 nt, Homo sapiens
agcuuccucggua

SEQ ID NO: 1254121 - RNA, 17 nt, Homo sapiens
agcuuccuucugugaaa

SEQ ID NO: 1254122 - RNA, 16 nt, Homo sapiens
agcuucggaagcaucu

SEQ ID NO: 1254123 - RNA, 16 nt, Homo sapiens
agcuucuaucccagga

SEQ ID NO: 1254124 - RNA, 18 nt, Homo sapiens
agcuucugcccaccuacu

SEQ ID NO: 1254125 - RNA, 18 nt, Homo sapiens
agcuucugggaccauaag

SEQ ID NO: 1254126 - RNA, 23 nt, Homo sapiens
agcuugaaacauagagggagaga

SEQ ID NO: 1254127 - RNA, 22 nt, Homo sapiens
agcuugacucccaaguuuccau

SEQ ID NO: 1254128 - RNA, 15 nt, Homo sapiens
agcuuggagggaugg

SEQ ID NO: 1254129 - RNA, 22 nt, Homo sapiens
agcuuggggcuuuuuccaucuu

SEQ ID NO: 1254130 - RNA, 13 nt, Homo sapiens
agcuuguaauugc

SEQ ID NO: 1254131 - RNA, 18 nt, Homo sapiens
agcuuucaaaagcaagaa

SEQ ID NO: 1254132 - RNA, 19 nt, Homo sapiens
agcuuucagagccagugaa

SEQ ID NO: 1254133 - RNA, 22 nt, Homo sapiens
agcuuucccugccucucaucaa

SEQ ID NO: 1254134 - RNA, 13 nt, Homo sapiens
agcuuucucaggg

SEQ ID NO: 1254135 - RNA, 21 nt, Homo sapiens
agcuuucuccccgcuaaggaa

SEQ ID NO: 1254136 - RNA, 13 nt, Homo sapiens
agcuuucucucag

SEQ ID NO: 1254137 - RNA, 12 nt, Homo sapiens
agcuuucuugcu

SEQ ID NO: 1254138 - RNA, 20 nt, Homo sapiens
agcuuugaugauaaacacug

SEQ ID NO: 1254139 - RNA, 15 nt, Homo sapiens
agcuuuggaccuaau

SEQ ID NO: 1254140 - RNA, 21 nt, Homo sapiens
agcuuuuagaaaaugcaguca

SEQ ID NO: 1254141 - RNA, 13 nt, Homo sapiens
agcuuuuuuacac

SEQ ID NO: 1254142 - RNA, 15 nt, Homo sapiens
aggaaaaauaaucaa

SEQ ID NO: 1254143 - RNA, 14 nt, Homo sapiens
aggaaaagcaagaa

SEQ ID NO: 1254144 - RNA, 18 nt, Homo sapiens
aggaaaagggagcuauga

SEQ ID NO: 1254145 - RNA, 17 nt, Homo sapiens
aggaaaagguugaauaa

SEQ ID NO: 1254146 - RNA, 20 nt, Homo sapiens
aggaaaaguaaggugcaguu

SEQ ID NO: 1254147 - RNA, 20 nt, Homo sapiens
aggaaaaguuauugugauaa

SEQ ID NO: 1254148 - RNA, 12 nt, Homo sapiens
aggaaacaguua

SEQ ID NO: 1254149 - RNA, 19 nt, Homo sapiens
aggaaacuguacuacaucu

SEQ ID NO: 1254150 - RNA, 22 nt, Homo sapiens
aggaaagauuugugaacuggaa

SEQ ID NO: 1254151 - RNA, 16 nt, Homo sapiens
aggaaaggauuuuacc

SEQ ID NO: 1254152 - RNA, 18 nt, Homo sapiens
aggaaagggauaguccaa

SEQ ID NO: 1254153 - RNA, 23 nt, Homo sapiens
aggaaagggauaguccaaagacu

SEQ ID NO: 1254154 - RNA, 23 nt, Homo sapiens
aggaaauaguaccuucaauacuu

SEQ ID NO: 1254155 - RNA, 17 nt, Homo sapiens
aggaaauaucaaagugu

SEQ ID NO: 1254156 - RNA, 23 nt, Homo sapiens
aggaaaugaugagaaauauuaaa

SEQ ID NO: 1254157 - RNA, 19 nt, Homo sapiens
aggaaauggcuuugugauu

SEQ ID NO: 1254158 - RNA, 19 nt, Homo sapiens
aggaacaaaaaaaccacaa

SEQ ID NO: 1254159 - RNA, 15 nt, Homo sapiens
aggaacaaucuuugc

SEQ ID NO: 1254160 - RNA, 13 nt, Homo sapiens
aggaacagcacug

SEQ ID NO: 1254161 - RNA, 16 nt, Homo sapiens
aggaaccccaggagau

SEQ ID NO: 1254162 - RNA, 16 nt, Homo sapiens
aggaagaaaugucaga

SEQ ID NO: 1254163 - RNA, 22 nt, Homo sapiens
aggaagaauuccugccaugccc

SEQ ID NO: 1254164 - RNA, 20 nt, Homo sapiens
aggaagacuugaagcacaga

SEQ ID NO: 1254165 - RNA, 14 nt, Homo sapiens
aggaagagccaaug

SEQ ID NO: 1254166 - RNA, 17 nt, Homo sapiens
aggaagaugggggcaag

SEQ ID NO: 1254167 - RNA, 17 nt, Homo sapiens
aggaagcuccacuguca

SEQ ID NO: 1254168 - RNA, 19 nt, Homo sapiens
aggaagcuccacugucacc

SEQ ID NO: 1254169 - RNA, 21 nt, Homo sapiens
aggaaggaacagcaauggugu

SEQ ID NO: 1254170 - RNA, 15 nt, Homo sapiens
aggaaggagauucca

SEQ ID NO: 1254171 - RNA, 18 nt, Homo sapiens
aggaaggagauuccacac

SEQ ID NO: 1254172 - RNA, 15 nt, Homo sapiens
aggaagggagaacuu

SEQ ID NO: 1254173 - RNA, 21 nt, Homo sapiens
aggaagguagaaauaucugaa

SEQ ID NO: 1254174 - RNA, 19 nt, Homo sapiens
aggaaguggcugucccugu

SEQ ID NO: 1254175 - RNA, 23 nt, Homo sapiens
aggaauaguugagccccaagucc

SEQ ID NO: 1254176 - RNA, 21 nt, Homo sapiens
aggaaucauuccagugcuaga

SEQ ID NO: 1254177 - RNA, 17 nt, Homo sapiens
aggaaugcacaaauuga

SEQ ID NO: 1254178 - RNA, 16 nt, Homo sapiens
aggaauucuaggcauc

SEQ ID NO: 1254179 - RNA, 19 nt, Homo sapiens
aggaauuucaccuguaaac

SEQ ID NO: 1254180 - RNA, 18 nt, Homo sapiens
aggacaaccauuccagac

SEQ ID NO: 1254181 - RNA, 21 nt, Homo sapiens
aggacaaccauuccagacugc

SEQ ID NO: 1254182 - RNA, 15 nt, Homo sapiens
aggacaagacacuga

SEQ ID NO: 1254183 - RNA, 18 nt, Homo sapiens
aggacaagacacugagga

SEQ ID NO: 1254184 - RNA, 19 nt, Homo sapiens
aggacaccagccuggugcc

SEQ ID NO: 1254185 - RNA, 18 nt, Homo sapiens
aggacaccuuuuaacuca

SEQ ID NO: 1254186 - RNA, 22 nt, Homo sapiens
aggacaccuuuuaacucaccuc

SEQ ID NO: 1254187 - RNA, 21 nt, Homo sapiens
aggacacuagaagauuuugaa

SEQ ID NO: 1254188 - RNA, 15 nt, Homo sapiens
aggacagaaaggaga

SEQ ID NO: 1254189 - RNA, 21 nt, Homo sapiens
aggacagggaggugaccccag

SEQ ID NO: 1254190 - RNA, 15 nt, Homo sapiens
aggacagucagcucu

SEQ ID NO: 1254191 - RNA, 15 nt, Homo sapiens
aggacaguggaugcu

SEQ ID NO: 1254192 - RNA, 15 nt, Homo sapiens
aggacauacugcaug

SEQ ID NO: 1254193 - RNA, 14 nt, Homo sapiens
aggaccaagccaca

SEQ ID NO: 1254194 - RNA, 14 nt, Homo sapiens
aggaccaauagcau

SEQ ID NO: 1254195 - RNA, 15 nt, Homo sapiens
aggaccacucagccc

SEQ ID NO: 1254196 - RNA, 13 nt, Homo sapiens
aggaccacuccug

SEQ ID NO: 1254197 - RNA, 12 nt, Homo sapiens
aggaccacuuug

SEQ ID NO: 1254198 - RNA, 19 nt, Homo sapiens
aggacccaggaggugugau

SEQ ID NO: 1254199 - RNA, 19 nt, Homo sapiens
aggaccccauccuguucuc

SEQ ID NO: 1254200 - RNA, 11 nt, Homo sapiens
aggaccugcug

SEQ ID NO: 1254201 - RNA, 21 nt, Homo sapiens
aggacgcacgcucgcugccau

SEQ ID NO: 1254202 - RNA, 15 nt, Homo sapiens
aggacguguguaaau

SEQ ID NO: 1254203 - RNA, 15 nt, Homo sapiens
aggacuccacuggac

SEQ ID NO: 1254204 - RNA, 15 nt, Homo sapiens
aggacucugcuucag

SEQ ID NO: 1254205 - RNA, 16 nt, Homo sapiens
aggacugaaaagggaa

SEQ ID NO: 1254206 - RNA, 12 nt, Homo sapiens
aggacugaacaa

SEQ ID NO: 1254207 - RNA, 23 nt, Homo sapiens
aggacugcgggacuugggucuca

SEQ ID NO: 1254208 - RNA, 20 nt, Homo sapiens
aggacuuaacggcuccagga

SEQ ID NO: 1254209 - RNA, 21 nt, Homo sapiens
aggacuuccauuugcuuuguc

SEQ ID NO: 1254210 - RNA, 15 nt, Homo sapiens
aggacuugaaagcau

SEQ ID NO: 1254211 - RNA, 19 nt, Homo sapiens
aggacuugugucucugugc

SEQ ID NO: 1254212 - RNA, 23 nt, Homo sapiens
aggagaaucacuggaaccuggga

SEQ ID NO: 1254213 - RNA, 13 nt, Homo sapiens
aggagaauugaau

SEQ ID NO: 1254214 - RNA, 18 nt, Homo sapiens
aggagaauuuaaacaaug

SEQ ID NO: 1254215 - RNA, 23 nt, Homo sapiens
aggagacaaguuccaugggauac

SEQ ID NO: 1254216 - RNA, 16 nt, Homo sapiens
aggagacagaccacuu

SEQ ID NO: 1254217 - RNA, 13 nt, Homo sapiens
aggagacgcugca

SEQ ID NO: 1254218 - RNA, 15 nt, Homo sapiens
aggagacuagauugc

SEQ ID NO: 1254219 - RNA, 21 nt, Homo sapiens
aggagacuuaggaaccuacca

SEQ ID NO: 1254220 - RNA, 15 nt, Homo sapiens
aggagagaaaacugc

SEQ ID NO: 1254221 - RNA, 17 nt, Homo sapiens
aggagagcccagucucc

SEQ ID NO: 1254222 - RNA, 16 nt, Homo sapiens
aggagaucgagaccau

SEQ ID NO: 1254223 - RNA, 20 nt, Homo sapiens
aggagauggaaguugcagug

SEQ ID NO: 1254224 - RNA, 15 nt, Homo sapiens
aggagauggccucau

SEQ ID NO: 1254225 - RNA, 16 nt, Homo sapiens
aggagcacagguccca

SEQ ID NO: 1254226 - RNA, 14 nt, Homo sapiens
aggagcacuuccaa

SEQ ID NO: 1254227 - RNA, 17 nt, Homo sapiens
aggagcaggcacgggug

SEQ ID NO: 1254228 - RNA, 23 nt, Homo sapiens
aggagccgaccgggaauaaccuu

SEQ ID NO: 1254229 - RNA, 14 nt, Homo sapiens
aggagcugcaaauu

SEQ ID NO: 1254230 - RNA, 20 nt, Homo sapiens
aggaggacauuuggugggcu

SEQ ID NO: 1254231 - RNA, 15 nt, Homo sapiens
aggaggagauggcca

SEQ ID NO: 1254232 - RNA, 21 nt, Homo sapiens
aggaggcagaggguugcagug

SEQ ID NO: 1254233 - RNA, 18 nt, Homo sapiens
aggaggccaccucuccaa

SEQ ID NO: 1254234 - RNA, 17 nt, Homo sapiens
aggaggcuggcagguau

SEQ ID NO: 1254235 - RNA, 20 nt, Homo sapiens
aggaggggguucuuccucac

SEQ ID NO: 1254236 - RNA, 19 nt, Homo sapiens
aggagggguuaaagcugcc

SEQ ID NO: 1254237 - RNA, 20 nt, Homo sapiens
aggagguugagaaugcagug

SEQ ID NO: 1254238 - RNA, 18 nt, Homo sapiens
aggaguagugagcuguac

SEQ ID NO: 1254239 - RNA, 20 nt, Homo sapiens
aggagucaacguguuuaccu

SEQ ID NO: 1254240 - RNA, 13 nt, Homo sapiens
aggagucagucuc

SEQ ID NO: 1254241 - RNA, 14 nt, Homo sapiens
aggagucucugcca

SEQ ID NO: 1254242 - RNA, 18 nt, Homo sapiens
aggagugugaccacugaa

SEQ ID NO: 1254243 - RNA, 22 nt, Homo sapiens
aggaguuguuucugacccacug

SEQ ID NO: 1254244 - RNA, 18 nt, Homo sapiens
aggauaaccuugugccuu

SEQ ID NO: 1254245 - RNA, 19 nt, Homo sapiens
aggauaauaaacaauuuug

SEQ ID NO: 1254246 - RNA, 18 nt, Homo sapiens
aggauacagaaaugcaaa

SEQ ID NO: 1254247 - RNA, 12 nt, Homo sapiens
aggauaugcagu

SEQ ID NO: 1254248 - RNA, 15 nt, Homo sapiens
aggauauuaacaaca

SEQ ID NO: 1254249 - RNA, 19 nt, Homo sapiens
aggauauuaacaacaauaa

SEQ ID NO: 1254250 - RNA, 14 nt, Homo sapiens
aggauauugucagu

SEQ ID NO: 1254251 - RNA, 17 nt, Homo sapiens
aggauauuuucuuccaa

SEQ ID NO: 1254252 - RNA, 18 nt, Homo sapiens
aggaucaaagaacugaaa

SEQ ID NO: 1254253 - RNA, 17 nt, Homo sapiens
aggaucgccugagccca

SEQ ID NO: 1254254 - RNA, 17 nt, Homo sapiens
aggaugaaucauauuca

SEQ ID NO: 1254255 - RNA, 20 nt, Homo sapiens
aggaugacuaacaagauuug

SEQ ID NO: 1254256 - RNA, 23 nt, Homo sapiens
aggaugaggugguggaguggagu

SEQ ID NO: 1254257 - RNA, 18 nt, Homo sapiens
aggaugauccuggggaag

SEQ ID NO: 1254258 - RNA, 13 nt, Homo sapiens
aggaugcugucaa

SEQ ID NO: 1254259 - RNA, 18 nt, Homo sapiens
aggauggcaaagagaguc

SEQ ID NO: 1254260 - RNA, 15 nt, Homo sapiens
aggauguaagccugg

SEQ ID NO: 1254261 - RNA, 14 nt, Homo sapiens
aggauguaguucug

SEQ ID NO: 1254262 - RNA, 18 nt, Homo sapiens
aggaugucacagggccaa

SEQ ID NO: 1254263 - RNA, 20 nt, Homo sapiens
aggaugucugagaccacuug

SEQ ID NO: 1254264 - RNA, 11 nt, Homo sapiens
aggaugugaua

SEQ ID NO: 1254265 - RNA, 21 nt, Homo sapiens
aggauguggaagagcauuagc

SEQ ID NO: 1254266 - RNA, 14 nt, Homo sapiens
aggauuauugucaa

SEQ ID NO: 1254267 - RNA, 14 nt, Homo sapiens
aggauucuauauca

SEQ ID NO: 1254268 - RNA, 21 nt, Homo sapiens
aggauucugggaaucaugucc

SEQ ID NO: 1254269 - RNA, 18 nt, Homo sapiens
aggauuuuacagaaacgu

SEQ ID NO: 1254270 - RNA, 16 nt, Homo sapiens
aggcaaaaaacucuua

SEQ ID NO: 1254271 - RNA, 14 nt, Homo sapiens
aggcaaaauugcaa

SEQ ID NO: 1254272 - RNA, 16 nt, Homo sapiens
aggcaaauauaagcug

SEQ ID NO: 1254273 - RNA, 17 nt, Homo sapiens
aggcaaauuaacuguau

SEQ ID NO: 1254274 - RNA, 23 nt, Homo sapiens
aggcaacaggauugaucauucuu

SEQ ID NO: 1254275 - RNA, 15 nt, Homo sapiens
aggcaacauccaaaa

SEQ ID NO: 1254276 - RNA, 21 nt, Homo sapiens
aggcaagcaagcucucuugcc

SEQ ID NO: 1254277 - RNA, 17 nt, Homo sapiens
aggcaagccccucagcc

SEQ ID NO: 1254278 - RNA, 13 nt, Homo sapiens
aggcaagcccuuc

SEQ ID NO: 1254279 - RNA, 20 nt, Homo sapiens
aggcaagcugaaauuuuaga

SEQ ID NO: 1254280 - RNA, 15 nt, Homo sapiens
aggcaaggaugucug

SEQ ID NO: 1254281 - RNA, 21 nt, Homo sapiens
aggcaauuccugauggaaaau

SEQ ID NO: 1254282 - RNA, 18 nt, Homo sapiens
aggcacaacaguucucuu

SEQ ID NO: 1254283 - RNA, 23 nt, Homo sapiens
aggcacagugggagcugagcugg

SEQ ID NO: 1254284 - RNA, 18 nt, Homo sapiens
aggcaccucuuccuugau

SEQ ID NO: 1254285 - RNA, 19 nt, Homo sapiens
aggcaccugccaccaugcc

SEQ ID NO: 1254286 - RNA, 12 nt, Homo sapiens
aggcacugcuga

SEQ ID NO: 1254287 - RNA, 13 nt, Homo sapiens
aggcacugcugau

SEQ ID NO: 1254288 - RNA, 13 nt, Homo sapiens
aggcagagccuga

SEQ ID NO: 1254289 - RNA, 18 nt, Homo sapiens
aggcagagguugcagugu

SEQ ID NO: 1254290 - RNA, 23 nt, Homo sapiens
aggcagaucugugccccaugccu

SEQ ID NO: 1254291 - RNA, 19 nt, Homo sapiens
aggcagcacagugugugaa

SEQ ID NO: 1254292 - RNA, 16 nt, Homo sapiens
aggcagcccccuccac

SEQ ID NO: 1254293 - RNA, 12 nt, Homo sapiens
aggcagcucaag

SEQ ID NO: 1254294 - RNA, 18 nt, Homo sapiens
aggcagcuucaagugccu

SEQ ID NO: 1254295 - RNA, 21 nt, Homo sapiens
aggcaggaacaaacagggcug

SEQ ID NO: 1254296 - RNA, 18 nt, Homo sapiens
aggcagggcaaaugacau

SEQ ID NO: 1254297 - RNA, 20 nt, Homo sapiens
aggcagggucucacucuguc

SEQ ID NO: 1254298 - RNA, 23 nt, Homo sapiens
aggcagggugagcuccagcugcu

SEQ ID NO: 1254299 - RNA, 14 nt, Homo sapiens
aggcaguaaccaug

SEQ ID NO: 1254300 - RNA, 16 nt, Homo sapiens
aggcaguagaacucca

SEQ ID NO: 1254301 - RNA, 18 nt, Homo sapiens
aggcagugcugagaggga

SEQ ID NO: 1254302 - RNA, 19 nt, Homo sapiens
aggcauaagaaaacuaaga

SEQ ID NO: 1254303 - RNA, 16 nt, Homo sapiens
aggcauagaggcuucu

SEQ ID NO: 1254304 - RNA, 14 nt, Homo sapiens
aggcauaguuuuua

SEQ ID NO: 1254305 - RNA, 19 nt, Homo sapiens
aggcauaugcacagucaag

SEQ ID NO: 1254306 - RNA, 18 nt, Homo sapiens
aggcaucaaaaaaacaag

SEQ ID NO: 1254307 - RNA, 13 nt, Homo sapiens
aggcauccugccu

SEQ ID NO: 1254308 - RNA, 17 nt, Homo sapiens
aggcaugaagaagccac

SEQ ID NO: 1254309 - RNA, 20 nt, Homo sapiens
aggcauugauugcacuugau

SEQ ID NO: 1254310 - RNA, 14 nt, Homo sapiens
aggcauuuccagac

SEQ ID NO: 1254311 - RNA, 18 nt, Homo sapiens
aggcauuugcaggguccu

SEQ ID NO: 1254312 - RNA, 13 nt, Homo sapiens
aggccaacagcac

SEQ ID NO: 1254313 - RNA, 15 nt, Homo sapiens
aggccaacagcaccu

SEQ ID NO: 1254314 - RNA, 13 nt, Homo sapiens
aggccaagcauuu

SEQ ID NO: 1254315 - RNA, 19 nt, Homo sapiens
aggccaagggccaagagaa

SEQ ID NO: 1254316 - RNA, 18 nt, Homo sapiens
aggccaauaaaaaguuca

SEQ ID NO: 1254317 - RNA, 14 nt, Homo sapiens
aggccacaccacag

SEQ ID NO: 1254318 - RNA, 15 nt, Homo sapiens
aggccacaccacagc

SEQ ID NO: 1254319 - RNA, 17 nt, Homo sapiens
aggccaguaugauuuau

SEQ ID NO: 1254320 - RNA, 14 nt, Homo sapiens
aggccagugccagc

SEQ ID NO: 1254321 - RNA, 22 nt, Homo sapiens
aggccagugccagcaccugccc

SEQ ID NO: 1254322 - RNA, 21 nt, Homo sapiens
aggccauugggauauucugaa

SEQ ID NO: 1254323 - RNA, 17 nt, Homo sapiens
aggcccaaaugauggau

SEQ ID NO: 1254324 - RNA, 21 nt, Homo sapiens
aggcccaacugugagcaagga

SEQ ID NO: 1254325 - RNA, 14 nt, Homo sapiens
aggcccagcugaga

SEQ ID NO: 1254326 - RNA, 22 nt, Homo sapiens
aggcccagggagggaaguguga

SEQ ID NO: 1254327 - RNA, 19 nt, Homo sapiens
aggcccagggaggugaccc

SEQ ID NO: 1254328 - RNA, 12 nt, Homo sapiens
aggcccagugac

SEQ ID NO: 1254329 - RNA, 14 nt, Homo sapiens
aggccccagcugga

SEQ ID NO: 1254330 - RNA, 16 nt, Homo sapiens
aggcccccacuugccu

SEQ ID NO: 1254331 - RNA, 21 nt, Homo sapiens
aggccccugcagcugccucac

SEQ ID NO: 1254332 - RNA, 16 nt, Homo sapiens
aggcccgcaccgcugg

SEQ ID NO: 1254333 - RNA, 16 nt, Homo sapiens
aggcccuccaugggcu

SEQ ID NO: 1254334 - RNA, 17 nt, Homo sapiens
aggcccugcacugccag

SEQ ID NO: 1254335 - RNA, 22 nt, Homo sapiens
aggcccugcacugccagcaucu

SEQ ID NO: 1254336 - RNA, 20 nt, Homo sapiens
aggcccugcugcccaaucuc

SEQ ID NO: 1254337 - RNA, 17 nt, Homo sapiens
aggcccuggagaccucc

SEQ ID NO: 1254338 - RNA, 16 nt, Homo sapiens
aggcccuggcccuuuc

SEQ ID NO: 1254339 - RNA, 20 nt, Homo sapiens
aggcccuguccuaagcacuu

SEQ ID NO: 1254340 - RNA, 23 nt, Homo sapiens
aggcccuuccucuccacugccuu

SEQ ID NO: 1254341 - RNA, 21 nt, Homo sapiens
aggccgagagcagacaccagc

SEQ ID NO: 1254342 - RNA, 20 nt, Homo sapiens
aggccgggcgcaguggcuca

SEQ ID NO: 1254343 - RNA, 21 nt, Homo sapiens
aggccggugugggcugugucg

SEQ ID NO: 1254344 - RNA, 13 nt, Homo sapiens
aggccgugugucu

SEQ ID NO: 1254345 - RNA, 21 nt, Homo sapiens
aggccucccuagccagcacuu

SEQ ID NO: 1254346 - RNA, 19 nt, Homo sapiens
aggccucuccaguuugcac

SEQ ID NO: 1254347 - RNA, 22 nt, Homo sapiens
aggccucuccaguuugcaccug

SEQ ID NO: 1254348 - RNA, 13 nt, Homo sapiens
aggccucugagaa

SEQ ID NO: 1254349 - RNA, 22 nt, Homo sapiens
aggccugcacagcuaagugugg

SEQ ID NO: 1254350 - RNA, 12 nt, Homo sapiens
aggccugccugu

SEQ ID NO: 1254351 - RNA, 20 nt, Homo sapiens
aggccuggccagaugcacca

SEQ ID NO: 1254352 - RNA, 23 nt, Homo sapiens
aggccuggccagaugcaccagcc

SEQ ID NO: 1254353 - RNA, 14 nt, Homo sapiens
aggccuuccaacgc

SEQ ID NO: 1254354 - RNA, 21 nt, Homo sapiens
aggccuuugugucuguguccu

SEQ ID NO: 1254355 - RNA, 19 nt, Homo sapiens
aggcgauccaccugucuca

SEQ ID NO: 1254356 - RNA, 22 nt, Homo sapiens
aggcgauccaccugucucagcc

SEQ ID NO: 1254357 - RNA, 17 nt, Homo sapiens
aggcgauucuccugccu

SEQ ID NO: 1254358 - RNA, 21 nt, Homo sapiens
aggcgccccuucccccuccaa

SEQ ID NO: 1254359 - RNA, 23 nt, Homo sapiens
aggcgcccuuggcuucugugaug

SEQ ID NO: 1254360 - RNA, 17 nt, Homo sapiens
aggcgccgcacuuccuu

SEQ ID NO: 1254361 - RNA, 23 nt, Homo sapiens
aggcggccucgugccaugaucug

SEQ ID NO: 1254362 - RNA, 20 nt, Homo sapiens
aggcgggaggauugcuugag

SEQ ID NO: 1254363 - RNA, 21 nt, Homo sapiens
aggcuaagaugagauuugcca

SEQ ID NO: 1254364 - RNA, 13 nt, Homo sapiens
aggcuaccucaag

SEQ ID NO: 1254365 - RNA, 23 nt, Homo sapiens
aggcuaguccggacccaccucac

SEQ ID NO: 1254366 - RNA, 16 nt, Homo sapiens
aggcuaucaacauguu

SEQ ID NO: 1254367 - RNA, 15 nt, Homo sapiens
aggcuauguauggaa

SEQ ID NO: 1254368 - RNA, 15 nt, Homo sapiens
aggcucacacugugc

SEQ ID NO: 1254369 - RNA, 18 nt, Homo sapiens
aggcucacacugugcuca

SEQ ID NO: 1254370 - RNA, 22 nt, Homo sapiens
aggcuccacuuggucugugaga

SEQ ID NO: 1254371 - RNA, 14 nt, Homo sapiens
aggcuccagccaca

SEQ ID NO: 1254372 - RNA, 18 nt, Homo sapiens
aggcuccaggacuccacu

SEQ ID NO: 1254373 - RNA, 12 nt, Homo sapiens
aggcucuaaugu

SEQ ID NO: 1254374 - RNA, 19 nt, Homo sapiens
aggcucuaauguacaauaa

SEQ ID NO: 1254375 - RNA, 22 nt, Homo sapiens
aggcucuaauguacaauaaagc

SEQ ID NO: 1254376 - RNA, 21 nt, Homo sapiens
aggcucugcacagacaagcag

SEQ ID NO: 1254377 - RNA, 18 nt, Homo sapiens
aggcucuggcccuugccu

SEQ ID NO: 1254378 - RNA, 13 nt, Homo sapiens
aggcucuuagcag

SEQ ID NO: 1254379 - RNA, 15 nt, Homo sapiens
aggcugaacuggauu

SEQ ID NO: 1254380 - RNA, 18 nt, Homo sapiens
aggcugaauuacagugaa

SEQ ID NO: 1254381 - RNA, 16 nt, Homo sapiens
aggcugaccaagagag

SEQ ID NO: 1254382 - RNA, 17 nt, Homo sapiens
aggcugaggcaggagaa

SEQ ID NO: 1254383 - RNA, 15 nt, Homo sapiens
aggcugcaccaggag

SEQ ID NO: 1254384 - RNA, 15 nt, Homo sapiens
aggcugcacugcagu

SEQ ID NO: 1254385 - RNA, 19 nt, Homo sapiens
aggcugcgacugaugaagg

SEQ ID NO: 1254386 - RNA, 20 nt, Homo sapiens
aggcugcgagagaaagggag

SEQ ID NO: 1254387 - RNA, 15 nt, Homo sapiens
aggcuggagugcaau

SEQ ID NO: 1254388 - RNA, 18 nt, Homo sapiens
aggcuggagugcaaugca

SEQ ID NO: 1254389 - RNA, 20 nt, Homo sapiens
aggcuggagugcaguggcgu

SEQ ID NO: 1254390 - RNA, 20 nt, Homo sapiens
aggcuggagugcaguggugu

SEQ ID NO: 1254391 - RNA, 22 nt, Homo sapiens
aggcugggaacucaucugguug

SEQ ID NO: 1254392 - RNA, 17 nt, Homo sapiens
aggcugggagcauagca

SEQ ID NO: 1254393 - RNA, 21 nt, Homo sapiens
aggcugggccauguccaaaga

SEQ ID NO: 1254394 - RNA, 23 nt, Homo sapiens
aggcugggccauguccaaagagg

SEQ ID NO: 1254395 - RNA, 17 nt, Homo sapiens
aggcugggccugaacua

SEQ ID NO: 1254396 - RNA, 11 nt, Homo sapiens
aggcuguaacu

SEQ ID NO: 1254397 - RNA, 12 nt, Homo sapiens
aggcugucacag

SEQ ID NO: 1254398 - RNA, 22 nt, Homo sapiens
aguguggcccagggaagccaaa

SEQ ID NO: 1254399 - RNA, 23 nt, Homo sapiens
aguguggcccagggaagccaaaa

SEQ ID NO: 1254400 - RNA, 20 nt, Homo sapiens
aguguggggauuuucacuga

SEQ ID NO: 1254401 - RNA, 14 nt, Homo sapiens
aguguuauuugcac

SEQ ID NO: 1254402 - RNA, 10 nt, Homo sapiens
aguguucucc

SEQ ID NO: 1254403 - RNA, 22 nt, Homo sapiens
aguguugcccaggcuggucuca

SEQ ID NO: 1254404 - RNA, 22 nt, Homo sapiens
aguguuuuagagagagaacuuu

SEQ ID NO: 1254405 - RNA, 22 nt, Homo sapiens
aguguuuuugaaacccacaguu

SEQ ID NO: 1254406 - RNA, 20 nt, Homo sapiens
aguguuuuuuagauacagag

SEQ ID NO: 1254407 - RNA, 15 nt, Homo sapiens
aguguuuuuuauuca

SEQ ID NO: 1254408 - RNA, 16 nt, Homo sapiens
aguuaaagaagcaauc

SEQ ID NO: 1254409 - RNA, 18 nt, Homo sapiens
aguuaacucacugagggu

SEQ ID NO: 1254410 - RNA, 23 nt, Homo sapiens
aguuaacugugaaauaccacaag

SEQ ID NO: 1254411 - RNA, 18 nt, Homo sapiens
aguuaagaagcuguugua

SEQ ID NO: 1254412 - RNA, 13 nt, Homo sapiens
aguuaagugugga

SEQ ID NO: 1254413 - RNA, 15 nt, Homo sapiens
aguuaauucaccuau

SEQ ID NO: 1254414 - RNA, 16 nt, Homo sapiens
aguuacaaacagacca

SEQ ID NO: 1254415 - RNA, 13 nt, Homo sapiens
aguuacacuaaaa

SEQ ID NO: 1254416 - RNA, 22 nt, Homo sapiens
aguuaccuuauaguuacugugu

SEQ ID NO: 1254417 - RNA, 12 nt, Homo sapiens
aguuacuugaaa

SEQ ID NO: 1254418 - RNA, 17 nt, Homo sapiens
aguuagaacuagccaaa

SEQ ID NO: 1254419 - RNA, 15 nt, Homo sapiens
aguuagguagcuuua

SEQ ID NO: 1254420 - RNA, 22 nt, Homo sapiens
aguuagguagcuuuagggcaau

SEQ ID NO: 1254421 - RNA, 16 nt, Homo sapiens
aguuauagcuucuuaa

SEQ ID NO: 1254422 - RNA, 21 nt, Homo sapiens
aguuauaggaacaauucucuu

SEQ ID NO: 1254423 - RNA, 19 nt, Homo sapiens
aguuaugcugucauggucc

SEQ ID NO: 1254424 - RNA, 16 nt, Homo sapiens
aguuauguucagucac

SEQ ID NO: 1254425 - RNA, 20 nt, Homo sapiens
aguuauuacauguaauuuga

SEQ ID NO: 1254426 - RNA, 14 nt, Homo sapiens
aguuauucauucug

SEQ ID NO: 1254427 - RNA, 20 nt, Homo sapiens
aguuauuuacuuuuaccacu

SEQ ID NO: 1254428 - RNA, 19 nt, Homo sapiens
aguuauuuguucauuauuu

SEQ ID NO: 1254429 - RNA, 14 nt, Homo sapiens
aguuauuuucagac

SEQ ID NO: 1254430 - RNA, 19 nt, Homo sapiens
aguucaauaaaugucuguu

SEQ ID NO: 1254431 - RNA, 20 nt, Homo sapiens
aguucacaggaggccagugg

SEQ ID NO: 1254432 - RNA, 13 nt, Homo sapiens
aguucaccaucuc

SEQ ID NO: 1254433 - RNA, 14 nt, Homo sapiens
aguucaguuuacua

SEQ ID NO: 1254434 - RNA, 15 nt, Homo sapiens
auccuaucuggggag

SEQ ID NO: 1254435 - RNA, 20 nt, Homo sapiens
auccuaucuggggagcuccu

SEQ ID NO: 1254436 - RNA, 15 nt, Homo sapiens
auccuauuuaucaga

SEQ ID NO: 1254437 - RNA, 13 nt, Homo sapiens
auccucacugugg

SEQ ID NO: 1254438 - RNA, 22 nt, Homo sapiens
auccuccaaaacuuagacccau

SEQ ID NO: 1254439 - RNA, 14 nt, Homo sapiens
auccucccaccuca

SEQ ID NO: 1254440 - RNA, 21 nt, Homo sapiens
auccucccuggcagacacaac

SEQ ID NO: 1254441 - RNA, 17 nt, Homo sapiens
auccucugguucuucau

SEQ ID NO: 1254442 - RNA, 14 nt, Homo sapiens
auccugaacuuucu

SEQ ID NO: 1254443 - RNA, 23 nt, Homo sapiens
auccugaauuccagcaaaagagc

SEQ ID NO: 1254444 - RNA, 20 nt, Homo sapiens
auccugcagaaguacuccua

SEQ ID NO: 1254445 - RNA, 17 nt, Homo sapiens
auccugccacccuguag

SEQ ID NO: 1254446 - RNA, 21 nt, Homo sapiens
auccugccagccccacacagc

SEQ ID NO: 1254447 - RNA, 14 nt, Homo sapiens
auccugcccagugu

SEQ ID NO: 1254448 - RNA, 18 nt, Homo sapiens
auccuggcuaacacguga

SEQ ID NO: 1254449 - RNA, 19 nt, Homo sapiens
auccuggggcagcacuccc

SEQ ID NO: 1254450 - RNA, 22 nt, Homo sapiens
auccuggguacugaaagccuua

SEQ ID NO: 1254451 - RNA, 16 nt, Homo sapiens
auccugugacauguaa

SEQ ID NO: 1254452 - RNA, 18 nt, Homo sapiens
auccuuaaugcagagcua

SEQ ID NO: 1254453 - RNA, 20 nt, Homo sapiens
auccuucacaggcagugcau

SEQ ID NO: 1254454 - RNA, 14 nt, Homo sapiens
auccuuccaaaaau

SEQ ID NO: 1254455 - RNA, 19 nt, Homo sapiens
auccuucgugaacaucccc

SEQ ID NO: 1254456 - RNA, 18 nt, Homo sapiens
auccuucuccaccaaaga

SEQ ID NO: 1254457 - RNA, 24 nt, Homo sapiens
auccuuggaaauuggaagagcaca

SEQ ID NO: 1254458 - RNA, 13 nt, Homo sapiens
auccuuuacuguu

SEQ ID NO: 1254459 - RNA, 15 nt, Homo sapiens
auccuuuacuguuag

SEQ ID NO: 1254460 - RNA, 19 nt, Homo sapiens
auccuuucaagacagaaag

SEQ ID NO: 1254461 - RNA, 21 nt, Homo sapiens
aucgaggugaaaggcucagua

SEQ ID NO: 1254462 - RNA, 20 nt, Homo sapiens
aucgauccuggauucacuca

SEQ ID NO: 1254463 - RNA, 18 nt, Homo sapiens
aucgugggccgcacuggg

SEQ ID NO: 1254464 - RNA, 17 nt, Homo sapiens
aucguuguuuacagugu

SEQ ID NO: 1254465 - RNA, 22 nt, Homo sapiens
aucuacaaaaaacaacaaauaa

SEQ ID NO: 1254466 - RNA, 13 nt, Homo sapiens
aucuacaggacaa

SEQ ID NO: 1254467 - RNA, 21 nt, Homo sapiens
aucuacuacaaacuucaaaga

SEQ ID NO: 1254468 - RNA, 22 nt, Homo sapiens
aucuacuccuuguaaagacugu

SEQ ID NO: 1254469 - RNA, 22 nt, Homo sapiens
aucuacuucaacacuucaugua

SEQ ID NO: 1254470 - RNA, 15 nt, Homo sapiens
aucuagaagacuguc

SEQ ID NO: 1254471 - RNA, 15 nt, Homo sapiens
aucuagagcuuaaug

SEQ ID NO: 1254472 - RNA, 13 nt, Homo sapiens
aucuagcaauuuc

SEQ ID NO: 1254473 - RNA, 20 nt, Homo sapiens
aucuagccagagcccuucac

SEQ ID NO: 1254474 - RNA, 15 nt, Homo sapiens
aucuagguucaggaa

SEQ ID NO: 1254475 - RNA, 12 nt, Homo sapiens
aucuaguuuaca

SEQ ID NO: 1254476 - RNA, 19 nt, Homo sapiens
aucuauaauuuaccuaaga

SEQ ID NO: 1254477 - RNA, 18 nt, Homo sapiens
aucuauauuucuggugaa

SEQ ID NO: 1254478 - RNA, 17 nt, Homo sapiens
aucuauuauaaaaccau

SEQ ID NO: 1254479 - RNA, 13 nt, Homo sapiens
aucuauuuauuaa

SEQ ID NO: 1254480 - RNA, 16 nt, Homo sapiens
aucucaaagaaggcau

SEQ ID NO: 1254481 - RNA, 17 nt, Homo sapiens
aucucaaagaaggcauu

SEQ ID NO: 1254482 - RNA, 18 nt, Homo sapiens
aucucaagauucaguaga

SEQ ID NO: 1254483 - RNA, 15 nt, Homo sapiens
aucucaggauuucac

SEQ ID NO: 1254484 - RNA, 15 nt, Homo sapiens
aucucaguaccccau

SEQ ID NO: 1254485 - RNA, 19 nt, Homo sapiens
aucucauacugucugggau

SEQ ID NO: 1254486 - RNA, 22 nt, Homo sapiens
aucucauugcuuacaagccuaa

SEQ ID NO: 1254487 - RNA, 20 nt, Homo sapiens
aucuccaguagaaagcauaa

SEQ ID NO: 1254488 - RNA, 20 nt, Homo sapiens
aucuccaguauucuugucaa

SEQ ID NO: 1254489 - RNA, 20 nt, Homo sapiens
aucuccaucauaugccugac

SEQ ID NO: 1254490 - RNA, 15 nt, Homo sapiens
aucucccagcaagac

SEQ ID NO: 1254491 - RNA, 21 nt, Homo sapiens
aucuccugacagaaggugcca

SEQ ID NO: 1254492 - RNA, 13 nt, Homo sapiens
aucuccugaccuc

SEQ ID NO: 1254493 - RNA, 15 nt, Homo sapiens
aucuccuguccauca

SEQ ID NO: 1254494 - RNA, 22 nt, Homo sapiens
aucucggcucacugaaaccucu

SEQ ID NO: 1254495 - RNA, 22 nt, Homo sapiens
aucucggcucacugcaaccucu

SEQ ID NO: 1254496 - RNA, 21 nt, Homo sapiens
aucucuacuaaaaauacaaaa

SEQ ID NO: 1254497 - RNA, 13 nt, Homo sapiens
aucucuacugcuu

SEQ ID NO: 1254498 - RNA, 22 nt, Homo sapiens
aucucugagaccacagaggcuc

SEQ ID NO: 1254499 - RNA, 17 nt, Homo sapiens
aucucugaggccucaga

SEQ ID NO: 1254500 - RNA, 18 nt, Homo sapiens
aucucugcccucuucuca

SEQ ID NO: 1254501 - RNA, 23 nt, Homo sapiens
aucucuggcccaggcucaagccc

SEQ ID NO: 1254502 - RNA, 20 nt, Homo sapiens
ucggcuuccuacagccagca

SEQ ID NO: 1254503 - RNA, 15 nt, Homo sapiens
ucgggccagaaggcg

SEQ ID NO: 1254504 - RNA, 17 nt, Homo sapiens
ucgggccccauccucau

SEQ ID NO: 1254505 - RNA, 22 nt, Homo sapiens
ucggucacuccaacucccuuaa

SEQ ID NO: 1254506 - RNA, 16 nt, Homo sapiens
ucgguggcucaugccu

SEQ ID NO: 1254507 - RNA, 15 nt, Homo sapiens
ucgguguucuguccc

SEQ ID NO: 1254508 - RNA, 23 nt, Homo sapiens
ucgguucugcgccacuuccuuug

SEQ ID NO: 1254509 - RNA, 14 nt, Homo sapiens
ucguaagucacuga

SEQ ID NO: 1254510 - RNA, 18 nt, Homo sapiens
ucguaguguuaaguuaua

SEQ ID NO: 1254511 - RNA, 18 nt, Homo sapiens
ucgucaucaggugcauag

SEQ ID NO: 1254512 - RNA, 15 nt, Homo sapiens
ucgucuaaacuuuag

SEQ ID NO: 1254513 - RNA, 15 nt, Homo sapiens
ucgugacaacacuug

SEQ ID NO: 1254514 - RNA, 13 nt, Homo sapiens
ucgugacaacaug

SEQ ID NO: 1254515 - RNA, 21 nt, Homo sapiens
ucguggguguguguagccaag

SEQ ID NO: 1254516 - RNA, 18 nt, Homo sapiens
ucguguaauuggcccaag

SEQ ID NO: 1254517 - RNA, 20 nt, Homo sapiens
ucuaaaaaccagacaaggaa

SEQ ID NO: 1254518 - RNA, 22 nt, Homo sapiens
ucuaaaaagauuagcaagguca

SEQ ID NO: 1254519 - RNA, 17 nt, Homo sapiens
ucuaaaagguucaggga

SEQ ID NO: 1254520 - RNA, 17 nt, Homo sapiens
ucuaaaaucccuuucaa

SEQ ID NO: 1254521 - RNA, 21 nt, Homo sapiens
ucuaaaauugcuucuuuacca

SEQ ID NO: 1254522 - RNA, 21 nt, Homo sapiens
ucuaaacuuccccaucuucua

SEQ ID NO: 1254523 - RNA, 19 nt, Homo sapiens
ucuaaacuuuagaauuaau

SEQ ID NO: 1254524 - RNA, 23 nt, Homo sapiens
ucuaaagauggaguuucuaaggu

SEQ ID NO: 1254525 - RNA, 23 nt, Homo sapiens
ucuaaaugcauauccugagccau

SEQ ID NO: 1254526 - RNA, 12 nt, Homo sapiens
ucuaaaugccaa

SEQ ID NO: 1254527 - RNA, 23 nt, Homo sapiens
ucuaaauuugaauguuaagcaga

SEQ ID NO: 1254528 - RNA, 24 nt, Homo sapiens
ucuaaauuugaauguuaagcagau

SEQ ID NO: 1254529 - RNA, 15 nt, Homo sapiens
ucuaacagcaaauaa

SEQ ID NO: 1254530 - RNA, 17 nt, Homo sapiens
ucuaacagcaaauaaca

SEQ ID NO: 1254531 - RNA, 16 nt, Homo sapiens
ucuaacauccuugucu

SEQ ID NO: 1254532 - RNA, 16 nt, Homo sapiens
ucuaacauguuaucaa

SEQ ID NO: 1254533 - RNA, 12 nt, Homo sapiens
ucuaacuccacu

SEQ ID NO: 1254534 - RNA, 12 nt, Homo sapiens
ucuaacucuccc

SEQ ID NO: 1254535 - RNA, 17 nt, Homo sapiens
ucuaagauaguaacaau

SEQ ID NO: 1254536 - RNA, 14 nt, Homo sapiens
ucuaagauucuaaa

SEQ ID NO: 1254537 - RNA, 14 nt, Homo sapiens
ucuaagauucuaau

SEQ ID NO: 1254538 - RNA, 16 nt, Homo sapiens
ucuaagcugugugcag

SEQ ID NO: 1254539 - RNA, 17 nt, Homo sapiens
ucuaagcugugugcagg

SEQ ID NO: 1254540 - RNA, 12 nt, Homo sapiens
ucuaaguauuua

SEQ ID NO: 1254541 - RNA, 13 nt, Homo sapiens
ucuaaguauuuga

SEQ ID NO: 1254542 - RNA, 12 nt, Homo sapiens
ucuaagugauau

SEQ ID NO: 1254543 - RNA, 14 nt, Homo sapiens
ucuaagugggagaa

SEQ ID NO: 1254544 - RNA, 19 nt, Homo sapiens
ucuaauaaaauauaaucua

SEQ ID NO: 1254545 - RNA, 14 nt, Homo sapiens
ucuaauaaacuugg

SEQ ID NO: 1254546 - RNA, 22 nt, Homo sapiens
ucuaaucuuuuaauguauuugu

SEQ ID NO: 1254547 - RNA, 15 nt, Homo sapiens
ucuaaugugcauuaa

SEQ ID NO: 1254548 - RNA, 16 nt, Homo sapiens
ucuaaugugcauuaaa

SEQ ID NO: 1254549 - RNA, 17 nt, Homo sapiens
ucuaauuuauuaaucua

SEQ ID NO: 1254550 - RNA, 16 nt, Homo sapiens
ucuaauuuuuaagaau

SEQ ID NO: 1254551 - RNA, 19 nt, Homo sapiens
ucuacaaacucccacuugu

SEQ ID NO: 1254552 - RNA, 16 nt, Homo sapiens
ucuacaaaugucuuca

SEQ ID NO: 1254553 - RNA, 14 nt, Homo sapiens
ucuacaacauagca

SEQ ID NO: 1254554 - RNA, 13 nt, Homo sapiens
ucuacagugccaa

SEQ ID NO: 1254555 - RNA, 24 nt, Homo sapiens
ucuacaguuaauuaugugcauauu

SEQ ID NO: 1254556 - RNA, 21 nt, Homo sapiens
ucuacauaaguaauucaagaa

SEQ ID NO: 1254557 - RNA, 23 nt, Homo sapiens
ucuacauagucagcuacuucuga

SEQ ID NO: 1254558 - RNA, 13 nt, Homo sapiens
ucuaccauuugaa

SEQ ID NO: 1254559 - RNA, 16 nt, Homo sapiens
ucuaccauuugaauuu

SEQ ID NO: 1254560 - RNA, 10 nt, Homo sapiens
ucuaccccag

SEQ ID NO: 1254561 - RNA, 16 nt, Homo sapiens
ucuaccccugcuccca

SEQ ID NO: 1254562 - RNA, 13 nt, Homo sapiens
ucuaccucaggca

SEQ ID NO: 1254563 - RNA, 20 nt, Homo sapiens
ucuaccucaggcagcucaag

SEQ ID NO: 1254564 - RNA, 15 nt, Homo sapiens
ucuacuaaaaacaca

SEQ ID NO: 1254565 - RNA, 12 nt, Homo sapiens
ucuacuaauucc

SEQ ID NO: 1254566 - RNA, 17 nt, Homo sapiens
ucuacuaccacaaggaa

SEQ ID NO: 1254567 - RNA, 17 nt, Homo sapiens
ucuacucuugucauuuu

SEQ ID NO: 1254568 - RNA, 18 nt, Homo sapiens
ucuacuggucuuguggaa

SEQ ID NO: 1254569 - RNA, 18 nt, Homo sapiens
ucuacuuggugguuugcu

SEQ ID NO: 1254570 - RNA, 23 nt, Homo sapiens
ucuacuuuguugcuauggcuuua

SEQ ID NO: 1254571 - RNA, 13 nt, Homo sapiens
ucuagaagcacau

SEQ ID NO: 1254572 - RNA, 20 nt, Homo sapiens
ucuagacauggagguucuaa

SEQ ID NO: 1254573 - RNA, 23 nt, Homo sapiens
ucuagacauggagguucuaaggc

SEQ ID NO: 1254574 - RNA, 16 nt, Homo sapiens
ucuagagcagggauua

SEQ ID NO: 1254575 - RNA, 19 nt, Homo sapiens
ucuagaggauguaucucac

SEQ ID NO: 1254576 - RNA, 15 nt, Homo sapiens
ucuagagucauguga

SEQ ID NO: 1254577 - RNA, 18 nt, Homo sapiens
ucuagaguucagaguccu

SEQ ID NO: 1254578 - RNA, 12 nt, Homo sapiens
ucuagcaguugu

SEQ ID NO: 1254579 - RNA, 21 nt, Homo sapiens
ucuagccagagcccuucacug

SEQ ID NO: 1254580 - RNA, 15 nt, Homo sapiens
ucuagcugugggggu

SEQ ID NO: 1254581 - RNA, 15 nt, Homo sapiens
ucuagggaaucugga

SEQ ID NO: 1254582 - RNA, 18 nt, Homo sapiens
ucuaguaagaugcacuga

SEQ ID NO: 1254583 - RNA, 19 nt, Homo sapiens
ucuaguaagaugcacugaa

SEQ ID NO: 1254584 - RNA, 19 nt, Homo sapiens
ucuaguaucacuuuugcug

SEQ ID NO: 1254585 - RNA, 21 nt, Homo sapiens
ucuagugaaugaaucucaaga

SEQ ID NO: 1254586 - RNA, 14 nt, Homo sapiens
ucuaguuaaucaua

SEQ ID NO: 1254587 - RNA, 20 nt, Homo sapiens
ucuaguuucuugugggcuaa

SEQ ID NO: 1254588 - RNA, 19 nt, Homo sapiens
ucuauacuccuucccuuaa

SEQ ID NO: 1254589 - RNA, 13 nt, Homo sapiens
ucuaucagguuuu

SEQ ID NO: 1254590 - RNA, 14 nt, Homo sapiens
ucuaucucucaaaa

SEQ ID NO: 1254591 - RNA, 14 nt, Homo sapiens
ucuaugaaacugca

SEQ ID NO: 1254592 - RNA, 17 nt, Homo sapiens
ucuaugaacaacuccaa

SEQ ID NO: 1254593 - RNA, 19 nt, Homo sapiens
ucuaugaaguugcuguuua

SEQ ID NO: 1254594 - RNA, 23 nt, Homo sapiens
ucuaugaccucgcccuccacaaa

SEQ ID NO: 1254595 - RNA, 17 nt, Homo sapiens
ucuaugagggcuaauau

SEQ ID NO: 1254596 - RNA, 16 nt, Homo sapiens
ucuaugucagcaguau

SEQ ID NO: 1254597 - RNA, 23 nt, Homo sapiens
acagcagcuucaccagagcauuu

SEQ ID NO: 1254598 - RNA, 18 nt, Homo sapiens
acagcagucccaguauuc

SEQ ID NO: 1254599 - RNA, 21 nt, Homo sapiens
acagcagucccaguauucuca

SEQ ID NO: 1254600 - RNA, 16 nt, Homo sapiens
acagcaugugccuuaa

SEQ ID NO: 1254601 - RNA, 23 nt, Homo sapiens
acagcauuaacugucuuaaagag

SEQ ID NO: 1254602 - RNA, 15 nt, Homo sapiens
acagcauucuuguca

SEQ ID NO: 1254603 - RNA, 12 nt, Homo sapiens
acagcauugcuu

SEQ ID NO: 1254604 - RNA, 19 nt, Homo sapiens
acagccagggcgcucuucc

SEQ ID NO: 1254605 - RNA, 21 nt, Homo sapiens
acagcccaggauacuggcaca

SEQ ID NO: 1254606 - RNA, 22 nt, Homo sapiens
acagccucugaccccuccucac

SEQ ID NO: 1254607 - RNA, 17 nt, Homo sapiens
acagccucuuacuugcc

SEQ ID NO: 1254608 - RNA, 20 nt, Homo sapiens
acagccuggccccugugcac

SEQ ID NO: 1254609 - RNA, 16 nt, Homo sapiens
acagcgacauagccca

SEQ ID NO: 1254610 - RNA, 18 nt, Homo sapiens
acagcuaaguguggagcu

SEQ ID NO: 1254611 - RNA, 21 nt, Homo sapiens
acagcucaagucuucccugau

SEQ ID NO: 1254612 - RNA, 19 nt, Homo sapiens
acagcucuacguggcaaau

SEQ ID NO: 1254613 - RNA, 20 nt, Homo sapiens
acagcugggcaaagccacaa

SEQ ID NO: 1254614 - RNA, 16 nt, Homo sapiens
acagcuuucugugcag

SEQ ID NO: 1254615 - RNA, 20 nt, Homo sapiens
acagcuuuggggugucuuuu

SEQ ID NO: 1254616 - RNA, 23 nt, Homo sapiens
acagcuuuugcaacuuaauacuc

SEQ ID NO: 1254617 - RNA, 23 nt, Homo sapiens
acaggaaaaaaaaaaaucuaucc

SEQ ID NO: 1254618 - RNA, 21 nt, Homo sapiens
acaggaauacuuaacucaaua

SEQ ID NO: 1254619 - RNA, 15 nt, Homo sapiens
acaggagaccuggca

SEQ ID NO: 1254620 - RNA, 12 nt, Homo sapiens
acaggagccuag

SEQ ID NO: 1254621 - RNA, 21 nt, Homo sapiens
acaggaggaagacaggcaaau

SEQ ID NO: 1254622 - RNA, 20 nt, Homo sapiens
acaggaggcaagcaagcucu

SEQ ID NO: 1254623 - RNA, 15 nt, Homo sapiens
acaggaggccagugg

SEQ ID NO: 1254624 - RNA, 17 nt, Homo sapiens
acaggaggccagugggc

SEQ ID NO: 1254625 - RNA, 13 nt, Homo sapiens
acaggaguguccu

SEQ ID NO: 1254626 - RNA, 15 nt, Homo sapiens
acaggauaacccuug

SEQ ID NO: 1254627 - RNA, 19 nt, Homo sapiens
acaggauuauuggaaauuu

SEQ ID NO: 1254628 - RNA, 19 nt, Homo sapiens
acaggcaaaacucaguaga

SEQ ID NO: 1254629 - RNA, 23 nt, Homo sapiens
acaggcaaauguacuucucaccc

SEQ ID NO: 1254630 - RNA, 23 nt, Homo sapiens
acaggcaaugcuggcuguuggcu

SEQ ID NO: 1254631 - RNA, 13 nt, Homo sapiens
acaggcaccugcc

SEQ ID NO: 1254632 - RNA, 13 nt, Homo sapiens
acaggcccagcgc

SEQ ID NO: 1254633 - RNA, 21 nt, Homo sapiens
acaggcccccuugaguggggu

SEQ ID NO: 1254634 - RNA, 24 nt, Homo sapiens
acaggccccugaguccuggcucau

SEQ ID NO: 1254635 - RNA, 16 nt, Homo sapiens
acaggcccuuccucuc

SEQ ID NO: 1254636 - RNA, 22 nt, Homo sapiens
acaggcccuuccucuccacugc

SEQ ID NO: 1254637 - RNA, 18 nt, Homo sapiens
acaggcgcugaguaugga

SEQ ID NO: 1254638 - RNA, 14 nt, Homo sapiens
acaggcucugacca

SEQ ID NO: 1254639 - RNA, 22 nt, Homo sapiens
acaggcuggucucaaacuccua

SEQ ID NO: 1254640 - RNA, 22 nt, Homo sapiens
acaggcuguucugcacugaaaa

SEQ ID NO: 1254641 - RNA, 20 nt, Homo sapiens
acagggaaaacugcaaagcu

SEQ ID NO: 1254642 - RNA, 15 nt, Homo sapiens
acagggcauggccag

SEQ ID NO: 1254643 - RNA, 13 nt, Homo sapiens
acagggccagagg

SEQ ID NO: 1254644 - RNA, 23 nt, Homo sapiens
acagggccaguggggccugugga

SEQ ID NO: 1254645 - RNA, 22 nt, Homo sapiens
acaggggcccauggacucuuca

SEQ ID NO: 1254646 - RNA, 19 nt, Homo sapiens
acaggggccccagaucugc

SEQ ID NO: 1254647 - RNA, 17 nt, Homo sapiens
acaggguccucagcuca

SEQ ID NO: 1254648 - RNA, 12 nt, Homo sapiens
acagggucucac

SEQ ID NO: 1254649 - RNA, 19 nt, Homo sapiens
acagggucugcucuuucuc

SEQ ID NO: 1254650 - RNA, 19 nt, Homo sapiens
acaggucccaccuccagcc

SEQ ID NO: 1254651 - RNA, 18 nt, Homo sapiens
acaggugacaugaacuac

SEQ ID NO: 1254652 - RNA, 19 nt, Homo sapiens
acagguggugagaaauuuc

SEQ ID NO: 1254653 - RNA, 15 nt, Homo sapiens
acaggugugagucac

SEQ ID NO: 1254654 - RNA, 22 nt, Homo sapiens
acaguaacaaauaaagugcagu

SEQ ID NO: 1254655 - RNA, 17 nt, Homo sapiens
acaguaagaacaucaua

SEQ ID NO: 1254656 - RNA, 18 nt, Homo sapiens
acaguacagcaugugccu

SEQ ID NO: 1254657 - RNA, 15 nt, Homo sapiens
acaguagaacugucu

SEQ ID NO: 1254658 - RNA, 13 nt, Homo sapiens
acaguagagccag

SEQ ID NO: 1254659 - RNA, 19 nt, Homo sapiens
acagucacugacucaagac

SEQ ID NO: 1254660 - RNA, 22 nt, Homo sapiens
acagucacugauguacaauuaa

SEQ ID NO: 1254661 - RNA, 14 nt, Homo sapiens
acagucagcucucu

SEQ ID NO: 1254662 - RNA, 18 nt, Homo sapiens
acaguccuggacuccugc

SEQ ID NO: 1254663 - RNA, 14 nt, Homo sapiens
acagucucacuuug

SEQ ID NO: 1254664 - RNA, 20 nt, Homo sapiens
acagucucccuuccuaugcu

SEQ ID NO: 1254665 - RNA, 18 nt, Homo sapiens
acagugaaaauguaagcu

SEQ ID NO: 1254666 - RNA, 22 nt, Homo sapiens
acagugaaaauguaagcuguuu

SEQ ID NO: 1254667 - RNA, 16 nt, Homo sapiens
acagugaaacuccauc

SEQ ID NO: 1254668 - RNA, 20 nt, Homo sapiens
acagugaaguuuuacugucu

SEQ ID NO: 1254669 - RNA, 12 nt, Homo sapiens
acagugaugccg

SEQ ID NO: 1254670 - RNA, 12 nt, Homo sapiens
acagugaugcug

SEQ ID NO: 1254671 - RNA, 13 nt, Homo sapiens
acagugcagacag

SEQ ID NO: 1254672 - RNA, 15 nt, Homo sapiens
acagugcauuugccu

SEQ ID NO: 1254673 - RNA, 20 nt, Homo sapiens
acagugcauuugccuuguca

SEQ ID NO: 1254674 - RNA, 21 nt, Homo sapiens
acagugccauccccaccuuca

SEQ ID NO: 1254675 - RNA, 17 nt, Homo sapiens
acagugccgacagcucu

SEQ ID NO: 1254676 - RNA, 20 nt, Homo sapiens
acagugccgacagcucucca

SEQ ID NO: 1254677 - RNA, 21 nt, Homo sapiens
acagugcucuuuucuccucac

SEQ ID NO: 1254678 - RNA, 15 nt, Homo sapiens
acagugggcugcuag

SEQ ID NO: 1254679 - RNA, 18 nt, Homo sapiens
acaguguacaaugccuuu

SEQ ID NO: 1254680 - RNA, 20 nt, Homo sapiens
acaguguaggcauuuaacuc

SEQ ID NO: 1254681 - RNA, 23 nt, Homo sapiens
acaguguuggagguuaaggcaua

SEQ ID NO: 1254682 - RNA, 15 nt, Homo sapiens
acaguguuuggacag

SEQ ID NO: 1254683 - RNA, 17 nt, Homo sapiens
acaguuaauuaugugca

SEQ ID NO: 1254684 - RNA, 14 nt, Homo sapiens
acaaaccauuuugu

SEQ ID NO: 1254685 - RNA, 18 nt, Homo sapiens
acaaaccgagugcaauga

SEQ ID NO: 1254686 - RNA, 21 nt, Homo sapiens
acaaaccgagugcaaugaaug

SEQ ID NO: 1254687 - RNA, 15 nt, Homo sapiens
acaaaccuaccaaaa

SEQ ID NO: 1254688 - RNA, 16 nt, Homo sapiens
acaaaccuaccaaaau

SEQ ID NO: 1254689 - RNA, 12 nt, Homo sapiens
acaaacuaacag

SEQ ID NO: 1254690 - RNA, 16 nt, Homo sapiens
acaaacuacauguaau

SEQ ID NO: 1254691 - RNA, 18 nt, Homo sapiens
acaaacuucccugacucu

SEQ ID NO: 1254692 - RNA, 15 nt, Homo sapiens
acaaagaaacaaaga

SEQ ID NO: 1254693 - RNA, 22 nt, Homo sapiens
acaaagacuccucugggccugg

SEQ ID NO: 1254694 - RNA, 18 nt, Homo sapiens
acaaagauuauuugcacg

SEQ ID NO: 1254695 - RNA, 14 nt, Homo sapiens
acaaagauugagaa

SEQ ID NO: 1254696 - RNA, 17 nt, Homo sapiens
acaaagcacaguuugaa

SEQ ID NO: 1254697 - RNA, 13 nt, Homo sapiens
acaaagcugcuaa

SEQ ID NO: 1254698 - RNA, 19 nt, Homo sapiens
acaaagcuguuaaacuguu

SEQ ID NO: 1254699 - RNA, 13 nt, Homo sapiens
acaaagcuucuau

SEQ ID NO: 1254700 - RNA, 16 nt, Homo sapiens
acaaaggaaauaucaa

SEQ ID NO: 1254701 - RNA, 21 nt, Homo sapiens
acaaaggaaauaucaaagugu

SEQ ID NO: 1254702 - RNA, 22 nt, Homo sapiens
acaaaggaguaguagcugaauu

SEQ ID NO: 1254703 - RNA, 17 nt, Homo sapiens
acaaagggccagcaguc

SEQ ID NO: 1254704 - RNA, 22 nt, Homo sapiens
acaaagggccaucguucaucca

SEQ ID NO: 1254705 - RNA, 19 nt, Homo sapiens
acaaaguaagccauguauc

SEQ ID NO: 1254706 - RNA, 14 nt, Homo sapiens
acaaaguacauucu

SEQ ID NO: 1254707 - RNA, 19 nt, Homo sapiens
acaaaguagaggaauccau

SEQ ID NO: 1254708 - RNA, 21 nt, Homo sapiens
acaaaguccacuuuacucaaa

SEQ ID NO: 1254709 - RNA, 15 nt, Homo sapiens
acaaagugacauucc

SEQ ID NO: 1254710 - RNA, 21 nt, Homo sapiens
acaaagugaggagaaugaaau

SEQ ID NO: 1254711 - RNA, 16 nt, Homo sapiens
acaaauaaagugcagu

SEQ ID NO: 1254712 - RNA, 17 nt, Homo sapiens
acaaauaaagugcaguu

SEQ ID NO: 1254713 - RNA, 17 nt, Homo sapiens
acaaauaaucacauuga

SEQ ID NO: 1254714 - RNA, 22 nt, Homo sapiens
acaaauaauuuuuaaauauaag

SEQ ID NO: 1254715 - RNA, 16 nt, Homo sapiens
acaaauacauaaccuu

SEQ ID NO: 1254716 - RNA, 22 nt, Homo sapiens
acaaauauggggaaaaaacugu

SEQ ID NO: 1254717 - RNA, 17 nt, Homo sapiens
acaaauccauaauuauu

SEQ ID NO: 1254718 - RNA, 13 nt, Homo sapiens
acaaaugacauca

SEQ ID NO: 1254719 - RNA, 14 nt, Homo sapiens
acaaaugacaucaa

SEQ ID NO: 1254720 - RNA, 15 nt, Homo sapiens
acaaaugacaucaaa

SEQ ID NO: 1254721 - RNA, 22 nt, Homo sapiens
acaaaugagugagagaguucag

SEQ ID NO: 1254722 - RNA, 16 nt, Homo sapiens
acaaaugcuccuccuc

SEQ ID NO: 1254723 - RNA, 23 nt, Homo sapiens
acaaaugcuccuccuccaugcuc

SEQ ID NO: 1254724 - RNA, 16 nt, Homo sapiens
acaaauuauaagcaua

SEQ ID NO: 1254725 - RNA, 16 nt, Homo sapiens
acaaauuauguuacau

SEQ ID NO: 1254726 - RNA, 13 nt, Homo sapiens
acaaauuccacag

SEQ ID NO: 1254727 - RNA, 15 nt, Homo sapiens
acaacaaaaggacuu

SEQ ID NO: 1254728 - RNA, 17 nt, Homo sapiens
acaacaaccuggucaca

SEQ ID NO: 1254729 - RNA, 24 nt, Homo sapiens
acaacaccuuccuccugcagacac

SEQ ID NO: 1254730 - RNA, 21 nt, Homo sapiens
acaccauaguuuacaauauua

SEQ ID NO: 1254731 - RNA, 17 nt, Homo sapiens
acaccauucuccugccu

SEQ ID NO: 1254732 - RNA, 17 nt, Homo sapiens
acaccauuuuccugccu

SEQ ID NO: 1254733 - RNA, 15 nt, Homo sapiens
acacccaaugcugcu

SEQ ID NO: 1254734 - RNA, 15 nt, Homo sapiens
acacccacagaagga

SEQ ID NO: 1254735 - RNA, 17 nt, Homo sapiens
acacccacccugugcca

SEQ ID NO: 1254736 - RNA, 20 nt, Homo sapiens
acacccacccugugccauca

SEQ ID NO: 1254737 - RNA, 21 nt, Homo sapiens
acacccagccucaguccuccc

SEQ ID NO: 1254738 - RNA, 22 nt, Homo sapiens
acacccccaccuccugcaauaa

SEQ ID NO: 1254739 - RNA, 23 nt, Homo sapiens
acaccccugcucuacccaugagc

SEQ ID NO: 1254740 - RNA, 17 nt, Homo sapiens
acacccuuccuucugua

SEQ ID NO: 1254741 - RNA, 15 nt, Homo sapiens
acacccuuucaucuc

SEQ ID NO: 1254742 - RNA, 21 nt, Homo sapiens
acacccuuugggaaagcucuu

SEQ ID NO: 1254743 - RNA, 17 nt, Homo sapiens
acaccgagacaccaccu

SEQ ID NO: 1254744 - RNA, 21 nt, Homo sapiens
acaccgcagggacaagcccug

SEQ ID NO: 1254745 - RNA, 19 nt, Homo sapiens
acaccguacaucugcaaua

SEQ ID NO: 1254746 - RNA, 20 nt, Homo sapiens
acaccguacaucugcaauau

SEQ ID NO: 1254747 - RNA, 20 nt, Homo sapiens
acaccgugggucauuacaaa

SEQ ID NO: 1254748 - RNA, 13 nt, Homo sapiens
acaccucccugaa

SEQ ID NO: 1254749 - RNA, 21 nt, Homo sapiens
acaccugggcaaacuuucuuc

SEQ ID NO: 1254750 - RNA, 12 nt, Homo sapiens
acaccuucaucc

SEQ ID NO: 1254751 - RNA, 19 nt, Homo sapiens
acaccuugacagggcacac

SEQ ID NO: 1254752 - RNA, 18 nt, Homo sapiens
acaccuuuuauugacaca

SEQ ID NO: 1254753 - RNA, 16 nt, Homo sapiens
acacgaccggggccag

SEQ ID NO: 1254754 - RNA, 13 nt, Homo sapiens
acacgaugcauuu

SEQ ID NO: 1254755 - RNA, 14 nt, Homo sapiens
acacgaugcauuua

SEQ ID NO: 1254756 - RNA, 16 nt, Homo sapiens
acacgauuagcuuuau

SEQ ID NO: 1254757 - RNA, 22 nt, Homo sapiens
acacgccuaaggucacagcuag

SEQ ID NO: 1254758 - RNA, 15 nt, Homo sapiens
acacgcgcgcgcaca

SEQ ID NO: 1254759 - RNA, 16 nt, Homo sapiens
acacgcgcgcgcacac

SEQ ID NO: 1254760 - RNA, 14 nt, Homo sapiens
acacgcgugcacac

SEQ ID NO: 1254761 - RNA, 22 nt, Homo sapiens
acacggacucccgggccacgcc

SEQ ID NO: 1254762 - RNA, 15 nt, Homo sapiens
acacggacugugcau

SEQ ID NO: 1254763 - RNA, 14 nt, Homo sapiens
acacggaggcaucu

SEQ ID NO: 1254764 - RNA, 20 nt, Homo sapiens
acacggccucccucugcuac

SEQ ID NO: 1254765 - RNA, 23 nt, Homo sapiens
acacggccuggggcgagcacugu

SEQ ID NO: 1254766 - RNA, 15 nt, Homo sapiens
acacguguccuguag

SEQ ID NO: 1254767 - RNA, 15 nt, Homo sapiens
acacuaaaaggugac

SEQ ID NO: 1254768 - RNA, 15 nt, Homo sapiens
acacuaacauauaau

SEQ ID NO: 1254769 - RNA, 12 nt, Homo sapiens
acacuaccacau

SEQ ID NO: 1254770 - RNA, 16 nt, Homo sapiens
acacuaccacauuaaa

SEQ ID NO: 1254771 - RNA, 14 nt, Homo sapiens
acacuacugcuaaa

SEQ ID NO: 1254772 - RNA, 23 nt, Homo sapiens
acacucaaaacgcuacugaguca

SEQ ID NO: 1254773 - RNA, 13 nt, Homo sapiens
acacucaugaagc

SEQ ID NO: 1254774 - RNA, 22 nt, Homo sapiens
acacucuccaaacagucaccau

SEQ ID NO: 1254775 - RNA, 22 nt, Homo sapiens
acacucugcagacugcuagugu

SEQ ID NO: 1254776 - RNA, 23 nt, Homo sapiens
acacugagagggcaaucuuugcc

SEQ ID NO: 1254777 - RNA, 17 nt, Homo sapiens
acacugagauauucagc

SEQ ID NO: 1254778 - RNA, 21 nt, Homo sapiens
acacugaggcccaauggccuu

SEQ ID NO: 1254779 - RNA, 23 nt, Homo sapiens
acacugaggccuuguguccuuua

SEQ ID NO: 1254780 - RNA, 22 nt, Homo sapiens
acacugaguucuaucaguuauc

SEQ ID NO: 1254781 - RNA, 23 nt, Homo sapiens
acacugcagcagaaaggcucuga

SEQ ID NO: 1254782 - RNA, 20 nt, Homo sapiens
acacugcugcuccagugcag

SEQ ID NO: 1254783 - RNA, 21 nt, Homo sapiens
acacuggcguuacugcuugac

SEQ ID NO: 1254784 - RNA, 15 nt, Homo sapiens
acacuggugccaacc

SEQ ID NO: 1254785 - RNA, 12 nt, Homo sapiens
acacuguacaag

SEQ ID NO: 1254786 - RNA, 15 nt, Homo sapiens
acacuguucugaaag

SEQ ID NO: 1254787 - RNA, 18 nt, Homo sapiens
acacuguugucaaaaagu

SEQ ID NO: 1254788 - RNA, 12 nt, Homo sapiens
acacuuacuguu

SEQ ID NO: 1254789 - RNA, 22 nt, Homo sapiens
acacuuaucugucucuucuaca

SEQ ID NO: 1254790 - RNA, 18 nt, Homo sapiens
acacuugguguacugggu

SEQ ID NO: 1254791 - RNA, 23 nt, Homo sapiens
acacuugugugugggcugugagu

SEQ ID NO: 1254792 - RNA, 18 nt, Homo sapiens
acacuuuuccacauucca

SEQ ID NO: 1254793 - RNA, 20 nt, Homo sapiens
acacuuuuccacauuccagu

SEQ ID NO: 1254794 - RNA, 13 nt, Homo sapiens
acagaaacuggau

SEQ ID NO: 1254795 - RNA, 15 nt, Homo sapiens
acagaaaguucuuaa

SEQ ID NO: 1254796 - RNA, 23 nt, Homo sapiens
acagaacagggucauguuugcag

SEQ ID NO: 1254797 - RNA, 18 nt, Homo sapiens
acagaacuauguacuuua

SEQ ID NO: 1254798 - RNA, 15 nt, Homo sapiens
acagaacugcaguca

SEQ ID NO: 1254799 - RNA, 13 nt, Homo sapiens
acagaagcaggcu

SEQ ID NO: 1254800 - RNA, 16 nt, Homo sapiens
acagaagccaagcucc

SEQ ID NO: 1254801 - RNA, 20 nt, Homo sapiens
acagaagccuggacucugcc

SEQ ID NO: 1254802 - RNA, 15 nt, Homo sapiens
acagaaggauguccc

SEQ ID NO: 1254803 - RNA, 16 nt, Homo sapiens
acagaauaauccagua

SEQ ID NO: 1254804 - RNA, 18 nt, Homo sapiens
acagaauaauguguuaaa

SEQ ID NO: 1254805 - RNA, 12 nt, Homo sapiens
acagaauauucu

SEQ ID NO: 1254806 - RNA, 20 nt, Homo sapiens
acagaauguuuuacugugaa

SEQ ID NO: 1254807 - RNA, 9 nt, Homo sapiens
acagaauuu

SEQ ID NO: 1254808 - RNA, 14 nt, Homo sapiens
acagaauuugucag

SEQ ID NO: 1254809 - RNA, 16 nt, Homo sapiens
acagacacaauaugua

SEQ ID NO: 1254810 - RNA, 20 nt, Homo sapiens
acagacacaauauguaugcu

SEQ ID NO: 1254811 - RNA, 23 nt, Homo sapiens
acagacaccaucuuuugugagau

SEQ ID NO: 1254812 - RNA, 14 nt, Homo sapiens
acagacacuuacau

SEQ ID NO: 1254813 - RNA, 14 nt, Homo sapiens
acagacaggcucuu

SEQ ID NO: 1254814 - RNA, 15 nt, Homo sapiens
acagacauacauuua

SEQ ID NO: 1254815 - RNA, 17 nt, Homo sapiens
aaggacaagacacugag

SEQ ID NO: 1254816 - RNA, 21 nt, Homo sapiens
aaggaccugaaauuccaaagu

SEQ ID NO: 1254817 - RNA, 19 nt, Homo sapiens
aaggacuagauacuacuuu

SEQ ID NO: 1254818 - RNA, 20 nt, Homo sapiens
aaggacucugcuucagucca

SEQ ID NO: 1254819 - RNA, 14 nt, Homo sapiens
aaggacucuuccac

SEQ ID NO: 1254820 - RNA, 17 nt, Homo sapiens
aaggacucuuccaccuc

SEQ ID NO: 1254821 - RNA, 15 nt, Homo sapiens
aaggacuuugcagcc

SEQ ID NO: 1254822 - RNA, 22 nt, Homo sapiens
aaggagauauggcuaguggcaa

SEQ ID NO: 1254823 - RNA, 15 nt, Homo sapiens
aaggagcagcauuga

SEQ ID NO: 1254824 - RNA, 20 nt, Homo sapiens
aaggagcaucagccagugaa

SEQ ID NO: 1254825 - RNA, 24 nt, Homo sapiens
aaggagccaauugauuucaacaga

SEQ ID NO: 1254826 - RNA, 15 nt, Homo sapiens
aaggaggccugggga

SEQ ID NO: 1254827 - RNA, 21 nt, Homo sapiens
aaggaggggguucuuccucac

SEQ ID NO: 1254828 - RNA, 22 nt, Homo sapiens
aaggaggucaggccccacuccu

SEQ ID NO: 1254829 - RNA, 16 nt, Homo sapiens
aaggaguacaaugccc

SEQ ID NO: 1254830 - RNA, 15 nt, Homo sapiens
aaggauagugcgaug

SEQ ID NO: 1254831 - RNA, 15 nt, Homo sapiens
aaggauaugauuaau

SEQ ID NO: 1254832 - RNA, 15 nt, Homo sapiens
aaggauauuuacaga

SEQ ID NO: 1254833 - RNA, 17 nt, Homo sapiens
aaggauccucuccacuc

SEQ ID NO: 1254834 - RNA, 15 nt, Homo sapiens
aaggaucucucagga

SEQ ID NO: 1254835 - RNA, 21 nt, Homo sapiens
aaggaugguuuuaucuucccu

SEQ ID NO: 1254836 - RNA, 15 nt, Homo sapiens
aaggauucuauauca

SEQ ID NO: 1254837 - RNA, 16 nt, Homo sapiens
aaggauucuauaucau

SEQ ID NO: 1254838 - RNA, 14 nt, Homo sapiens
aaggauugugauau

SEQ ID NO: 1254839 - RNA, 17 nt, Homo sapiens
aaggauuuuaccaaagc

SEQ ID NO: 1254840 - RNA, 19 nt, Homo sapiens
aaggcaggaggaucacuug

SEQ ID NO: 1254841 - RNA, 15 nt, Homo sapiens
aaggcauuucuauca

SEQ ID NO: 1254842 - RNA, 19 nt, Homo sapiens
aaggccacugcuacaucuc

SEQ ID NO: 1254843 - RNA, 12 nt, Homo sapiens
aaggccuuccaa

SEQ ID NO: 1254844 - RNA, 17 nt, Homo sapiens
aaggccuuccacugugg

SEQ ID NO: 1254845 - RNA, 17 nt, Homo sapiens
aaggcggcaggugggac

SEQ ID NO: 1254846 - RNA, 16 nt, Homo sapiens
aaggcuccuccuugcc

SEQ ID NO: 1254847 - RNA, 22 nt, Homo sapiens
aaggcucugaaauaaaaugcca

SEQ ID NO: 1254848 - RNA, 20 nt, Homo sapiens
aaggcugagacagugaauuu

SEQ ID NO: 1254849 - RNA, 16 nt, Homo sapiens
aaggcugcacagcuca

SEQ ID NO: 1254850 - RNA, 20 nt, Homo sapiens
aaggcugcuuagaauccaaa

SEQ ID NO: 1254851 - RNA, 15 nt, Homo sapiens
aaggcuuugaguuaa

SEQ ID NO: 1254852 - RNA, 20 nt, Homo sapiens
aaggcuuugguuuccaaguc

SEQ ID NO: 1254853 - RNA, 20 nt, Homo sapiens
aaggcuuuguauaaucccac

SEQ ID NO: 1254854 - RNA, 23 nt, Homo sapiens
aagggaauacugugcauaagcca

SEQ ID NO: 1254855 - RNA, 14 nt, Homo sapiens
aagggaauugcuca

SEQ ID NO: 1254856 - RNA, 12 nt, Homo sapiens
aagggacuccca

SEQ ID NO: 1254857 - RNA, 19 nt, Homo sapiens
aagggagcgcucucuugau

SEQ ID NO: 1254858 - RNA, 21 nt, Homo sapiens
aagggaggggcuguguuucca

SEQ ID NO: 1254859 - RNA, 15 nt, Homo sapiens
aagggauaguccaaa

SEQ ID NO: 1254860 - RNA, 15 nt, Homo sapiens
aagggcaugccuugu

SEQ ID NO: 1254861 - RNA, 12 nt, Homo sapiens
aagggcauuucc

SEQ ID NO: 1254862 - RNA, 14 nt, Homo sapiens
aagggccacuggga

SEQ ID NO: 1254863 - RNA, 17 nt, Homo sapiens
aagggcccaaugaauua

SEQ ID NO: 1254864 - RNA, 15 nt, Homo sapiens
aaggggagaagggaa

SEQ ID NO: 1254865 - RNA, 12 nt, Homo sapiens
aaggggcacugg

SEQ ID NO: 1254866 - RNA, 18 nt, Homo sapiens
aaggggcccaaauucuuu

SEQ ID NO: 1254867 - RNA, 14 nt, Homo sapiens
aagggggaaaaagu

SEQ ID NO: 1254868 - RNA, 16 nt, Homo sapiens
aaggggggucucuggc

SEQ ID NO: 1254869 - RNA, 17 nt, Homo sapiens
aagggguuggggugaca

SEQ ID NO: 1254870 - RNA, 16 nt, Homo sapiens
aaggguucaacaaagg

SEQ ID NO: 1254871 - RNA, 22 nt, Homo sapiens
aagguagagucuuacaaucaaa

SEQ ID NO: 1254872 - RNA, 12 nt, Homo sapiens
aagguaugcaau

SEQ ID NO: 1254873 - RNA, 16 nt, Homo sapiens
aagguaugcaaucaaa

SEQ ID NO: 1254874 - RNA, 13 nt, Homo sapiens
aagguauugcacu

SEQ ID NO: 1254875 - RNA, 19 nt, Homo sapiens
aagguauuuugaauaccau

SEQ ID NO: 1254876 - RNA, 12 nt, Homo sapiens
aagguccacucc

SEQ ID NO: 1254877 - RNA, 14 nt, Homo sapiens
aaggugccacuuua

SEQ ID NO: 1254878 - RNA, 19 nt, Homo sapiens
aagguggaacaagcacaga

SEQ ID NO: 1254879 - RNA, 14 nt, Homo sapiens
aagguggucacugu

SEQ ID NO: 1254880 - RNA, 12 nt, Homo sapiens
aaggugugcucg

SEQ ID NO: 1254881 - RNA, 24 nt, Homo sapiens
aaggugugcucugaucauccacug

SEQ ID NO: 1254882 - RNA, 18 nt, Homo sapiens
acaguuagguagcuuuag

SEQ ID NO: 1254883 - RNA, 18 nt, Homo sapiens
acaguucagaccaaugcu

SEQ ID NO: 1254884 - RNA, 20 nt, Homo sapiens
acaguucagaccaaugcuca

SEQ ID NO: 1254885 - RNA, 21 nt, Homo sapiens
acaguucauguuugcuucaua

SEQ ID NO: 1254886 - RNA, 22 nt, Homo sapiens
acaguugcauugacugucacau

SEQ ID NO: 1254887 - RNA, 21 nt, Homo sapiens
acaguuggauuuauucugcca

SEQ ID NO: 1254888 - RNA, 20 nt, Homo sapiens
acaguuuagugcuuuacaug

SEQ ID NO: 1254889 - RNA, 18 nt, Homo sapiens
acaguuucuugcuuggaa

SEQ ID NO: 1254890 - RNA, 17 nt, Homo sapiens
acaguuuguggcuuaua

SEQ ID NO: 1254891 - RNA, 12 nt, Homo sapiens
acaguuuuccaa

SEQ ID NO: 1254892 - RNA, 13 nt, Homo sapiens
acauaaaaaccaa

SEQ ID NO: 1254893 - RNA, 12 nt, Homo sapiens
acauaaacugac

SEQ ID NO: 1254894 - RNA, 12 nt, Homo sapiens
acauaaagccau

SEQ ID NO: 1254895 - RNA, 23 nt, Homo sapiens
acauaacuaguggcucucaguua

SEQ ID NO: 1254896 - RNA, 15 nt, Homo sapiens
acauaaguaauucaa

SEQ ID NO: 1254897 - RNA, 23 nt, Homo sapiens
acauacaagaugcuaguucauuu

SEQ ID NO: 1254898 - RNA, 17 nt, Homo sapiens
acauacauauuaucuca

SEQ ID NO: 1254899 - RNA, 16 nt, Homo sapiens
acauacuccuuccauc

SEQ ID NO: 1254900 - RNA, 19 nt, Homo sapiens
acauacuccuuccaucaaa

SEQ ID NO: 1254901 - RNA, 15 nt, Homo sapiens
acauacuuaaugcau

SEQ ID NO: 1254902 - RNA, 23 nt, Homo sapiens
acauagccuauauuuacagugaa

SEQ ID NO: 1254903 - RNA, 15 nt, Homo sapiens
acauagccucaccaa

SEQ ID NO: 1254904 - RNA, 19 nt, Homo sapiens
acauagccugcaaagcugg

SEQ ID NO: 1254905 - RNA, 20 nt, Homo sapiens
acauaggccugcucagccuc

SEQ ID NO: 1254906 - RNA, 16 nt, Homo sapiens
acauagguaaaaacug

SEQ ID NO: 1254907 - RNA, 18 nt, Homo sapiens
acauagguaaaaacugga

SEQ ID NO: 1254908 - RNA, 13 nt, Homo sapiens
acauauccacaaa

SEQ ID NO: 1254909 - RNA, 22 nt, Homo sapiens
acauauccuuucaagacagaaa

SEQ ID NO: 1254910 - RNA, 13 nt, Homo sapiens
acauaucugucau

SEQ ID NO: 1254911 - RNA, 21 nt, Homo sapiens
acauaucuguguauuaucuca

SEQ ID NO: 1254912 - RNA, 12 nt, Homo sapiens
acauaugcaccu

SEQ ID NO: 1254913 - RNA, 20 nt, Homo sapiens
acauauggacucugcacaug

SEQ ID NO: 1254914 - RNA, 15 nt, Homo sapiens
acauaugugcuggaa

SEQ ID NO: 1254915 - RNA, 14 nt, Homo sapiens
acauauuacuguug

SEQ ID NO: 1254916 - RNA, 23 nt, Homo sapiens
acauauugcaggauucuguaaua

SEQ ID NO: 1254917 - RNA, 23 nt, Homo sapiens
acauauuggaauguacaugucaa

SEQ ID NO: 1254918 - RNA, 14 nt, Homo sapiens
auagucacaagagc

SEQ ID NO: 1254919 - RNA, 21 nt, Homo sapiens
auaguccaccucccauuacuu

SEQ ID NO: 1254920 - RNA, 14 nt, Homo sapiens
auagucgcagcuac

SEQ ID NO: 1254921 - RNA, 11 nt, Homo sapiens
auagucuuuca

SEQ ID NO: 1254922 - RNA, 19 nt, Homo sapiens
auagugaaaccccaucucu

SEQ ID NO: 1254923 - RNA, 16 nt, Homo sapiens
auagugacaugcacac

SEQ ID NO: 1254924 - RNA, 17 nt, Homo sapiens
auagugacuaugaacuu

SEQ ID NO: 1254925 - RNA, 23 nt, Homo sapiens
auagugacuaugaacuucucuca

SEQ ID NO: 1254926 - RNA, 17 nt, Homo sapiens
auaguguagcugaggag

SEQ ID NO: 1254927 - RNA, 12 nt, Homo sapiens
auaguguccaaa

SEQ ID NO: 1254928 - RNA, 14 nt, Homo sapiens
auaguuaagacaug

SEQ ID NO: 1254929 - RNA, 19 nt, Homo sapiens
auaguuauauaauucacuc

SEQ ID NO: 1254930 - RNA, 17 nt, Homo sapiens
auaguucacuccauuug

SEQ ID NO: 1254931 - RNA, 13 nt, Homo sapiens
auaguugaugcau

SEQ ID NO: 1254932 - RNA, 23 nt, Homo sapiens
auaguuguuuuuuaaaauccaaa

SEQ ID NO: 1254933 - RNA, 17 nt, Homo sapiens
auaguuugugaauccuu

SEQ ID NO: 1254934 - RNA, 18 nt, Homo sapiens
auaguuuuauuuacuucu

SEQ ID NO: 1254935 - RNA, 15 nt, Homo sapiens
auauaaaaaaucaug

SEQ ID NO: 1254936 - RNA, 14 nt, Homo sapiens
auauaaacauauca

SEQ ID NO: 1254937 - RNA, 14 nt, Homo sapiens
auauaaauggaauc

SEQ ID NO: 1254938 - RNA, 13 nt, Homo sapiens
auauaaauuuauc

SEQ ID NO: 1254939 - RNA, 23 nt, Homo sapiens
auauaacccuaggaauuuagaca

SEQ ID NO: 1254940 - RNA, 16 nt, Homo sapiens
auauaagcugccauau

SEQ ID NO: 1254941 - RNA, 19 nt, Homo sapiens
auauaaguuuacaccuuua

SEQ ID NO: 1254942 - RNA, 14 nt, Homo sapiens
auauaauccuguga

SEQ ID NO: 1254943 - RNA, 20 nt, Homo sapiens
auauaauguauuuucagcuc

SEQ ID NO: 1254944 - RNA, 24 nt, Homo sapiens
auauaauucuguacauagccuaua

SEQ ID NO: 1254945 - RNA, 16 nt, Homo sapiens
auauaauuuauuucca

SEQ ID NO: 1254946 - RNA, 21 nt, Homo sapiens
auauaauuuccauagugugag

SEQ ID NO: 1254947 - RNA, 22 nt, Homo sapiens
auauaccacucuuuaccuuuau

SEQ ID NO: 1254948 - RNA, 21 nt, Homo sapiens
auauaccuggcuuuuacuuua

SEQ ID NO: 1254949 - RNA, 23 nt, Homo sapiens
auauagcaaaugcagaaccacaa

SEQ ID NO: 1254950 - RNA, 19 nt, Homo sapiens
auauagcuugaaacauaga

SEQ ID NO: 1254951 - RNA, 17 nt, Homo sapiens
auauaguaugaaugcag

SEQ ID NO: 1254952 - RNA, 14 nt, Homo sapiens
auauaguccagaca

SEQ ID NO: 1254953 - RNA, 19 nt, Homo sapiens
auauaguccagacacuuaa

SEQ ID NO: 1254954 - RNA, 16 nt, Homo sapiens
auauagugacuaugaa

SEQ ID NO: 1254955 - RNA, 13 nt, Homo sapiens
auauauacaggca

SEQ ID NO: 1254956 - RNA, 17 nt, Homo sapiens
auauaugcacuauguau

SEQ ID NO: 1254957 - RNA, 16 nt, Homo sapiens
auauaugcaggaaaga

SEQ ID NO: 1254958 - RNA, 18 nt, Homo sapiens
auauaugccuucccccac

SEQ ID NO: 1254959 - RNA, 13 nt, Homo sapiens
auauauuucacuu

SEQ ID NO: 1254960 - RNA, 18 nt, Homo sapiens
auauauuuuaaagcacuu

SEQ ID NO: 1254961 - RNA, 16 nt, Homo sapiens
auauauuuuagcauuu

SEQ ID NO: 1254962 - RNA, 21 nt, Homo sapiens
auauauuuuugguugucaaua

SEQ ID NO: 1254963 - RNA, 14 nt, Homo sapiens
auaucaaaagcaaa

SEQ ID NO: 1254964 - RNA, 17 nt, Homo sapiens
auaucaaaagcaaauaa

SEQ ID NO: 1254965 - RNA, 18 nt, Homo sapiens
auaucaaaucuaccacug

SEQ ID NO: 1254966 - RNA, 15 nt, Homo sapiens
ucucagccagccucc

SEQ ID NO: 1254967 - RNA, 15 nt, Homo sapiens
ucucagcucuuccau

SEQ ID NO: 1254968 - RNA, 23 nt, Homo sapiens
ucucaggaguaucuuaccuguaa

SEQ ID NO: 1254969 - RNA, 12 nt, Homo sapiens
ucucagugcagg

SEQ ID NO: 1254970 - RNA, 21 nt, Homo sapiens
ucucagugcuucuuacuauua

SEQ ID NO: 1254971 - RNA, 13 nt, Homo sapiens
ucucaguggagcc

SEQ ID NO: 1254972 - RNA, 15 nt, Homo sapiens
ucucaguucuugagg

SEQ ID NO: 1254973 - RNA, 17 nt, Homo sapiens
ucucauaaugcuuuguu

SEQ ID NO: 1254974 - RNA, 20 nt, Homo sapiens
ucucauacugucugggauua

SEQ ID NO: 1254975 - RNA, 12 nt, Homo sapiens
ucucauaggaga

SEQ ID NO: 1254976 - RNA, 17 nt, Homo sapiens
ucucauagguugccaau

SEQ ID NO: 1254977 - RNA, 20 nt, Homo sapiens
ucucaugccucagccucuca

SEQ ID NO: 1254978 - RNA, 16 nt, Homo sapiens
ucucauugacuuuuau

SEQ ID NO: 1254979 - RNA, 12 nt, Homo sapiens
ucucauuuggag

SEQ ID NO: 1254980 - RNA, 15 nt, Homo sapiens
ucucauuugucacac

SEQ ID NO: 1254981 - RNA, 21 nt, Homo sapiens
ucuccaaacagucaccauaca

SEQ ID NO: 1254982 - RNA, 14 nt, Homo sapiens
ucuccaaaugagau

SEQ ID NO: 1254983 - RNA, 22 nt, Homo sapiens
ucuccaccgucacccaacauca

SEQ ID NO: 1254984 - RNA, 18 nt, Homo sapiens
ucuccaggacaaccugcu

SEQ ID NO: 1254985 - RNA, 21 nt, Homo sapiens
ucuccagguccucuacuuaau

SEQ ID NO: 1254986 - RNA, 18 nt, Homo sapiens
ucuccaguuugcaccugu

SEQ ID NO: 1254987 - RNA, 16 nt, Homo sapiens
ucuccauacucuguaa

SEQ ID NO: 1254988 - RNA, 22 nt, Homo sapiens
ucuccauguuugauguaucuga

SEQ ID NO: 1254989 - RNA, 19 nt, Homo sapiens
ucucccacccuguaccuca

SEQ ID NO: 1254990 - RNA, 21 nt, Homo sapiens
ucuccccacucuaggggucag

SEQ ID NO: 1254991 - RNA, 12 nt, Homo sapiens
ucuccccagaau

SEQ ID NO: 1254992 - RNA, 19 nt, Homo sapiens
ucuccccaguguaugucuu

SEQ ID NO: 1254993 - RNA, 21 nt, Homo sapiens
ucuccccucccagucucuacu

SEQ ID NO: 1254994 - RNA, 21 nt, Homo sapiens
ucuccccucccuuguccuuga

SEQ ID NO: 1254995 - RNA, 23 nt, Homo sapiens
ucucccggcaacaucucugggaa

SEQ ID NO: 1254996 - RNA, 13 nt, Homo sapiens
ucucccugccaag

SEQ ID NO: 1254997 - RNA, 22 nt, Homo sapiens
ucuccgcaacagccaaguggaa

SEQ ID NO: 1254998 - RNA, 18 nt, Homo sapiens
ucuccuacuaugcaauuu

SEQ ID NO: 1254999 - RNA, 20 nt, Homo sapiens
ucuccucugcagcucaggga

SEQ ID NO: 1255000 - RNA, 18 nt, Homo sapiens
ucuccugaagaggaacug

SEQ ID NO: 1255001 - RNA, 18 nt, Homo sapiens
ucuccugcccaagcacuu

SEQ ID NO: 1255002 - RNA, 23 nt, Homo sapiens
ucuccugcgcccuucauugccac

SEQ ID NO: 1255003 - RNA, 12 nt, Homo sapiens
ucuccugcugau

SEQ ID NO: 1255004 - RNA, 19 nt, Homo sapiens
ucuccugugauccuuugau

SEQ ID NO: 1255005 - RNA, 22 nt, Homo sapiens
ucuccuucaccccuauggugcu

SEQ ID NO: 1255006 - RNA, 16 nt, Homo sapiens
ucuccuucccauuucu

SEQ ID NO: 1255007 - RNA, 14 nt, Homo sapiens
ucuccuucugaaag

SEQ ID NO: 1255008 - RNA, 13 nt, Homo sapiens
ucuccuugcacuu

SEQ ID NO: 1255009 - RNA, 13 nt, Homo sapiens
ucuccuugcccua

SEQ ID NO: 1255010 - RNA, 14 nt, Homo sapiens
ucuccuuugagcaa

SEQ ID NO: 1255011 - RNA, 14 nt, Homo sapiens
ucucgagaggcaau

SEQ ID NO: 1255012 - RNA, 18 nt, Homo sapiens
ucucgcuccucaaccccu

SEQ ID NO: 1255013 - RNA, 12 nt, Homo sapiens
ucucgcuuuguu

SEQ ID NO: 1255014 - RNA, 15 nt, Homo sapiens
ucucggcucacugaa

SEQ ID NO: 1255015 - RNA, 15 nt, Homo sapiens
ucucgggcacaggcc

SEQ ID NO: 1255016 - RNA, 12 nt, Homo sapiens
ucucuacugcuu

SEQ ID NO: 1255017 - RNA, 17 nt, Homo sapiens
ucucuauguauguagcg

SEQ ID NO: 1255018 - RNA, 17 nt, Homo sapiens
ucucuauuucuggauga

SEQ ID NO: 1255019 - RNA, 16 nt, Homo sapiens
ucucucacaaagucca

SEQ ID NO: 1255020 - RNA, 13 nt, Homo sapiens
ucucucacaugga

SEQ ID NO: 1255021 - RNA, 15 nt, Homo sapiens
ucucuccagccugac

SEQ ID NO: 1255022 - RNA, 23 nt, Homo sapiens
ucucuccccauccccacccaguc

SEQ ID NO: 1255023 - RNA, 16 nt, Homo sapiens
ucucugaacacaggca

SEQ ID NO: 1255024 - RNA, 23 nt, Homo sapiens
ucucugaagaugaucauuugccc

SEQ ID NO: 1255025 - RNA, 19 nt, Homo sapiens
ucucugaagcauguuucau

SEQ ID NO: 1255026 - RNA, 21 nt, Homo sapiens
ucucugagcacccaagccagg

SEQ ID NO: 1255027 - RNA, 19 nt, Homo sapiens
ucucuggcuuuauuacucc

SEQ ID NO: 1255028 - RNA, 21 nt, Homo sapiens
ucucuggggcaggcugcuuca

SEQ ID NO: 1255029 - RNA, 14 nt, Homo sapiens
ucucugguggugcu

SEQ ID NO: 1255030 - RNA, 14 nt, Homo sapiens
ucucugugccuucg

SEQ ID NO: 1255031 - RNA, 23 nt, Homo sapiens
ucucuuccuguuuuguacauaga

SEQ ID NO: 1255032 - RNA, 22 nt, Homo sapiens
ucucuucuuuuggcuuccauga

SEQ ID NO: 1255033 - RNA, 17 nt, Homo sapiens
ucucuugacguuuacau

SEQ ID NO: 1255034 - RNA, 21 nt, Homo sapiens
ucucuuuaaauggcuuuaugc

SEQ ID NO: 1255035 - RNA, 20 nt, Homo sapiens
ucucuuuaaguuuugauuaa

SEQ ID NO: 1255036 - RNA, 14 nt, Homo sapiens
ucucuuugugcucu

SEQ ID NO: 1255037 - RNA, 14 nt, Homo sapiens
ucugaaaauuccag

SEQ ID NO: 1255038 - RNA, 23 nt, Homo sapiens
ucugaaaggauguggaagagcau

SEQ ID NO: 1255039 - RNA, 19 nt, Homo sapiens
ucugaaaucuccuuuagcc

SEQ ID NO: 1255040 - RNA, 15 nt, Homo sapiens
ucugaaauuggucac

SEQ ID NO: 1255041 - RNA, 18 nt, Homo sapiens
ucugaagaaacuucccaa

SEQ ID NO: 1255042 - RNA, 12 nt, Homo sapiens
ucugaaguacuu

SEQ ID NO: 1255043 - RNA, 21 nt, Homo sapiens
ucugaaguacuuaaacuucca

SEQ ID NO: 1255044 - RNA, 20 nt, Homo sapiens
ucugaauaaaguguaacaau

SEQ ID NO: 1255045 - RNA, 16 nt, Homo sapiens
ucugaauaacuugaag

SEQ ID NO: 1255046 - RNA, 20 nt, Homo sapiens
ucugaaucgagugagacaaa

SEQ ID NO: 1255047 - RNA, 18 nt, Homo sapiens
ucugacaaugcugagguu

SEQ ID NO: 1255048 - RNA, 13 nt, Homo sapiens
ucugacacacagc

SEQ ID NO: 1255049 - RNA, 13 nt, Homo sapiens
ucugaccauuuca

SEQ ID NO: 1255050 - RNA, 13 nt, Homo sapiens
ucugacuacuugu

SEQ ID NO: 1255051 - RNA, 20 nt, Homo sapiens
ucugacuauaaccuuguucc

SEQ ID NO: 1255052 - RNA, 20 nt, Homo sapiens
ucugagaagacacaagguga

SEQ ID NO: 1255053 - RNA, 17 nt, Homo sapiens
ucugagaaggugagaua

SEQ ID NO: 1255054 - RNA, 14 nt, Homo sapiens
ucugagaauuucca

SEQ ID NO: 1255055 - RNA, 22 nt, Homo sapiens
ucugagacuccucauaccucag

SEQ ID NO: 1255056 - RNA, 16 nt, Homo sapiens
ucugagagacagaauu

SEQ ID NO: 1255057 - RNA, 23 nt, Homo sapiens
auugaccauuuuuuaauuuacuu

SEQ ID NO: 1255058 - RNA, 16 nt, Homo sapiens
auugacuucauuuuau

SEQ ID NO: 1255059 - RNA, 21 nt, Homo sapiens
auugacuucauuuuauauuua

SEQ ID NO: 1255060 - RNA, 18 nt, Homo sapiens
auugacuuugacaauuac

SEQ ID NO: 1255061 - RNA, 19 nt, Homo sapiens
auugagaaagaaacuaaua

SEQ ID NO: 1255062 - RNA, 14 nt, Homo sapiens
auugagaccugagu

SEQ ID NO: 1255063 - RNA, 16 nt, Homo sapiens
auugagaccugaguga

SEQ ID NO: 1255064 - RNA, 23 nt, Homo sapiens
auugagccuucgaguggccagcu

SEQ ID NO: 1255065 - RNA, 15 nt, Homo sapiens
auugaggcccugcug

SEQ ID NO: 1255066 - RNA, 23 nt, Homo sapiens
auugagguccauauuuaguggua

SEQ ID NO: 1255067 - RNA, 16 nt, Homo sapiens
auugagugaaacauug

SEQ ID NO: 1255068 - RNA, 14 nt, Homo sapiens
auugagugagcacc

SEQ ID NO: 1255069 - RNA, 15 nt, Homo sapiens
auugauauaauuucc

SEQ ID NO: 1255070 - RNA, 23 nt, Homo sapiens
auugauauacacggaugacuuaa

SEQ ID NO: 1255071 - RNA, 22 nt, Homo sapiens
auugauuaaugaacuauuguua

SEQ ID NO: 1255072 - RNA, 15 nt, Homo sapiens
auugauuacuaucau

SEQ ID NO: 1255073 - RNA, 11 nt, Homo sapiens
auugauuucaa

SEQ ID NO: 1255074 - RNA, 15 nt, Homo sapiens
auugcaaagguucca

SEQ ID NO: 1255075 - RNA, 16 nt, Homo sapiens
auugcaagaguuuaau

SEQ ID NO: 1255076 - RNA, 17 nt, Homo sapiens
auugcaagcuccaucuc

SEQ ID NO: 1255077 - RNA, 20 nt, Homo sapiens
auugcacuuggccucaugcu

SEQ ID NO: 1255078 - RNA, 19 nt, Homo sapiens
auugcacuuuuaaaccucu

SEQ ID NO: 1255079 - RNA, 21 nt, Homo sapiens
auugcagcauuuauguuagag

SEQ ID NO: 1255080 - RNA, 14 nt, Homo sapiens
auugcauacuuugu

SEQ ID NO: 1255081 - RNA, 13 nt, Homo sapiens
auugccaaccagu

SEQ ID NO: 1255082 - RNA, 17 nt, Homo sapiens
auugccaaccaguuuga

SEQ ID NO: 1255083 - RNA, 19 nt, Homo sapiens
auugccacaaguccagcug

SEQ ID NO: 1255084 - RNA, 13 nt, Homo sapiens
auugccucugaaa

SEQ ID NO: 1255085 - RNA, 13 nt, Homo sapiens
auugcuacaaauc

SEQ ID NO: 1255086 - RNA, 14 nt, Homo sapiens
auugcuacuauaau

SEQ ID NO: 1255087 - RNA, 16 nt, Homo sapiens
auugcucuugagucuu

SEQ ID NO: 1255088 - RNA, 21 nt, Homo sapiens
auugcuucaauaauauuagcu

SEQ ID NO: 1255089 - RNA, 15 nt, Homo sapiens
auugcuugugccaca

SEQ ID NO: 1255090 - RNA, 12 nt, Homo sapiens
auugcuuugcca

SEQ ID NO: 1255091 - RNA, 23 nt, Homo sapiens
auugcuuugccaaaauaccagag

SEQ ID NO: 1255092 - RNA, 13 nt, Homo sapiens
auugcuuuuauua

SEQ ID NO: 1255093 - RNA, 19 nt, Homo sapiens
auuggaacagaauguuuua

SEQ ID NO: 1255094 - RNA, 16 nt, Homo sapiens
auuggaaucugauaua

SEQ ID NO: 1255095 - RNA, 18 nt, Homo sapiens
auuggaauuaaccuggug

SEQ ID NO: 1255096 - RNA, 19 nt, Homo sapiens
auuggaccugcccacaacu

SEQ ID NO: 1255097 - RNA, 20 nt, Homo sapiens
auuggaccuguucaaaaagg

SEQ ID NO: 1255098 - RNA, 12 nt, Homo sapiens
auuggcacugug

SEQ ID NO: 1255099 - RNA, 18 nt, Homo sapiens
auuggcacuguggagcuc

SEQ ID NO: 1255100 - RNA, 13 nt, Homo sapiens
auuggcucagccc

SEQ ID NO: 1255101 - RNA, 15 nt, Homo sapiens
auuggcugaguccau

SEQ ID NO: 1255102 - RNA, 20 nt, Homo sapiens
auuggcugguaacaguucau

SEQ ID NO: 1255103 - RNA, 15 nt, Homo sapiens
auugggaaaacucca

SEQ ID NO: 1255104 - RNA, 23 nt, Homo sapiens
auugggaaaugaaaaaaaaaugg

SEQ ID NO: 1255105 - RNA, 13 nt, Homo sapiens
auugggcaccuga

SEQ ID NO: 1255106 - RNA, 16 nt, Homo sapiens
auugggccuuuuggau

SEQ ID NO: 1255107 - RNA, 23 nt, Homo sapiens
auugggugccagcauacauuuuc

SEQ ID NO: 1255108 - RNA, 19 nt, Homo sapiens
auuggucuaauuuauucaa

SEQ ID NO: 1255109 - RNA, 17 nt, Homo sapiens
auuggugcauagcagau

SEQ ID NO: 1255110 - RNA, 16 nt, Homo sapiens
auugguguuuuaucuc

SEQ ID NO: 1255111 - RNA, 23 nt, Homo sapiens
auugguuaacaauaaagugacaa

SEQ ID NO: 1255112 - RNA, 18 nt, Homo sapiens
auuguaacaauagcacaa

SEQ ID NO: 1255113 - RNA, 15 nt, Homo sapiens
auuguacacuaucua

SEQ ID NO: 1255114 - RNA, 14 nt, Homo sapiens
auuguaccaugaaa

SEQ ID NO: 1255115 - RNA, 14 nt, Homo sapiens
auuguacuaauacc

SEQ ID NO: 1255116 - RNA, 13 nt, Homo sapiens
auuguaggugcaa

SEQ ID NO: 1255117 - RNA, 21 nt, Homo sapiens
auuguaucagaggccuauaau

SEQ ID NO: 1255118 - RNA, 15 nt, Homo sapiens
auuguauuacagaug

SEQ ID NO: 1255119 - RNA, 17 nt, Homo sapiens
auuguccucuuugacua

SEQ ID NO: 1255120 - RNA, 13 nt, Homo sapiens
auuguccuuggag

SEQ ID NO: 1255121 - RNA, 17 nt, Homo sapiens
auugucgguuaccucug

SEQ ID NO: 1255122 - RNA, 14 nt, Homo sapiens
auugucugucuaca

SEQ ID NO: 1255123 - RNA, 20 nt, Homo sapiens
auugucuguuuggaagacca

SEQ ID NO: 1255124 - RNA, 20 nt, Homo sapiens
auugucuuuaauuucuguca

SEQ ID NO: 1255125 - RNA, 15 nt, Homo sapiens
auugugauuuauuuc

SEQ ID NO: 1255126 - RNA, 17 nt, Homo sapiens
auugugcaguacuuugu

SEQ ID NO: 1255127 - RNA, 23 nt, Homo sapiens
auugugccgagaaaagcauuuua

SEQ ID NO: 1255128 - RNA, 17 nt, Homo sapiens
auugugguuccaugcag

SEQ ID NO: 1255129 - RNA, 18 nt, Homo sapiens
auuguuaaucucuguuau

SEQ ID NO: 1255130 - RNA, 16 nt, Homo sapiens
auuguuaccucugagu

SEQ ID NO: 1255131 - RNA, 13 nt, Homo sapiens
gugcucauuuaag

SEQ ID NO: 1255132 - RNA, 18 nt, Homo sapiens
gugcuccagauggugcua

SEQ ID NO: 1255133 - RNA, 22 nt, Homo sapiens
gugcucuacaccuuagugcagc

SEQ ID NO: 1255134 - RNA, 16 nt, Homo sapiens
gugcucuuaagccuaa

SEQ ID NO: 1255135 - RNA, 20 nt, Homo sapiens
gugcugagugagcuggugac

SEQ ID NO: 1255136 - RNA, 18 nt, Homo sapiens
gugcugcagguggcagag

SEQ ID NO: 1255137 - RNA, 18 nt, Homo sapiens
gugcuggaauuacaggcg

SEQ ID NO: 1255138 - RNA, 16 nt, Homo sapiens
gugcuggauuugauga

SEQ ID NO: 1255139 - RNA, 19 nt, Homo sapiens
gugcugggauuacaggugu

SEQ ID NO: 1255140 - RNA, 22 nt, Homo sapiens
gugcuguggcauagacauggau

SEQ ID NO: 1255141 - RNA, 17 nt, Homo sapiens
gugcuguggccugggca

SEQ ID NO: 1255142 - RNA, 18 nt, Homo sapiens
gugcuuaaaaaucauuga

SEQ ID NO: 1255143 - RNA, 22 nt, Homo sapiens
gugcuucagaguuuguguguau

SEQ ID NO: 1255144 - RNA, 15 nt, Homo sapiens
gugcuucagccugag

SEQ ID NO: 1255145 - RNA, 14 nt, Homo sapiens
gugcuugggcucca

SEQ ID NO: 1255146 - RNA, 18 nt, Homo sapiens
guggaaccaacacuaaca

SEQ ID NO: 1255147 - RNA, 18 nt, Homo sapiens
guggaacccccaucucua

SEQ ID NO: 1255148 - RNA, 15 nt, Homo sapiens
guggaagcuucuaaa

SEQ ID NO: 1255149 - RNA, 16 nt, Homo sapiens
guggaaugagugugca

SEQ ID NO: 1255150 - RNA, 12 nt, Homo sapiens
guggacugugau

SEQ ID NO: 1255151 - RNA, 18 nt, Homo sapiens
guggacuuagaaagcagg

SEQ ID NO: 1255152 - RNA, 13 nt, Homo sapiens
guggaggggcccu

SEQ ID NO: 1255153 - RNA, 16 nt, Homo sapiens
guggagguugcaguga

SEQ ID NO: 1255154 - RNA, 16 nt, Homo sapiens
guggauaacuuuacag

SEQ ID NO: 1255155 - RNA, 15 nt, Homo sapiens
guggauagcauuguu

SEQ ID NO: 1255156 - RNA, 14 nt, Homo sapiens
guggaugacuguug

SEQ ID NO: 1255157 - RNA, 11 nt, Homo sapiens
guggcaauggg

SEQ ID NO: 1255158 - RNA, 13 nt, Homo sapiens
guggcacaggagu

SEQ ID NO: 1255159 - RNA, 21 nt, Homo sapiens
guggcagauaaucagccucuu

SEQ ID NO: 1255160 - RNA, 17 nt, Homo sapiens
guggcaugaggaggucc

SEQ ID NO: 1255161 - RNA, 13 nt, Homo sapiens
guggcauguggcc

SEQ ID NO: 1255162 - RNA, 13 nt, Homo sapiens
guggccaguauuu

SEQ ID NO: 1255163 - RNA, 14 nt, Homo sapiens
guggccgugccuga

SEQ ID NO: 1255164 - RNA, 19 nt, Homo sapiens
guggccucagcccucagaa

SEQ ID NO: 1255165 - RNA, 14 nt, Homo sapiens
guggccuuccccuu

SEQ ID NO: 1255166 - RNA, 14 nt, Homo sapiens
guggcgacucuaua

SEQ ID NO: 1255167 - RNA, 19 nt, Homo sapiens
guggcugcaccacuuccag

SEQ ID NO: 1255168 - RNA, 22 nt, Homo sapiens
guggcugcaggugggacuuugu

SEQ ID NO: 1255169 - RNA, 19 nt, Homo sapiens
guggcugugccaccaagca

SEQ ID NO: 1255170 - RNA, 19 nt, Homo sapiens
guggcuuguaucaacacug

SEQ ID NO: 1255171 - RNA, 15 nt, Homo sapiens
gugggagaaggcagu

SEQ ID NO: 1255172 - RNA, 20 nt, Homo sapiens
gugggaggggcgcccaccuc

SEQ ID NO: 1255173 - RNA, 19 nt, Homo sapiens
gugggaucagcccugccag

SEQ ID NO: 1255174 - RNA, 17 nt, Homo sapiens
gugggauccucccucau

SEQ ID NO: 1255175 - RNA, 15 nt, Homo sapiens
gugggcaccucagaa

SEQ ID NO: 1255176 - RNA, 21 nt, Homo sapiens
gugggcucugugcagucacug

SEQ ID NO: 1255177 - RNA, 23 nt, Homo sapiens
gugggcucugugcagucacugga

SEQ ID NO: 1255178 - RNA, 13 nt, Homo sapiens
guggggacaucag

SEQ ID NO: 1255179 - RNA, 15 nt, Homo sapiens
guggggauuggggga

SEQ ID NO: 1255180 - RNA, 14 nt, Homo sapiens
gugguacagcacug

SEQ ID NO: 1255181 - RNA, 16 nt, Homo sapiens
guggucuccuugcacu

SEQ ID NO: 1255182 - RNA, 17 nt, Homo sapiens
guggucuccuugcacuu

SEQ ID NO: 1255183 - RNA, 15 nt, Homo sapiens
guggucuugaucucc

SEQ ID NO: 1255184 - RNA, 13 nt, Homo sapiens
gugguggcacuga

SEQ ID NO: 1255185 - RNA, 17 nt, Homo sapiens
gugguggcuagagggaa

SEQ ID NO: 1255186 - RNA, 19 nt, Homo sapiens
gugguuacuuccuacugua

SEQ ID NO: 1255187 - RNA, 21 nt, Homo sapiens
gugguuccucccucuccugaa

SEQ ID NO: 1255188 - RNA, 20 nt, Homo sapiens
guguaagaacaacuaccuga

SEQ ID NO: 1255189 - RNA, 16 nt, Homo sapiens
guguaauggaaaccaa

SEQ ID NO: 1255190 - RNA, 11 nt, Homo sapiens
guguacauuuu

SEQ ID NO: 1255191 - RNA, 20 nt, Homo sapiens
guguaccuccucucaguguu

SEQ ID NO: 1255192 - RNA, 19 nt, Homo sapiens
guguagaggguguuugcag

SEQ ID NO: 1255193 - RNA, 15 nt, Homo sapiens
guguagcuuugcucu

SEQ ID NO: 1255194 - RNA, 19 nt, Homo sapiens
guguaggaaaaaugcaagc

SEQ ID NO: 1255195 - RNA, 19 nt, Homo sapiens
guguauaucucuuggaaaa

SEQ ID NO: 1255196 - RNA, 19 nt, Homo sapiens
guguauccgacucuaagcu

SEQ ID NO: 1255197 - RNA, 20 nt, Homo sapiens
guguauccgacucuaagcug

SEQ ID NO: 1255198 - RNA, 16 nt, Homo sapiens
gugucaaaagccagau

SEQ ID NO: 1255199 - RNA, 21 nt, Homo sapiens
gugucacuacucacagucucu

SEQ ID NO: 1255200 - RNA, 19 nt, Homo sapiens
gugucaguucaacuuucag

SEQ ID NO: 1255201 - RNA, 22 nt, Homo sapiens
gugucauaugacugauuacuca

SEQ ID NO: 1255202 - RNA, 16 nt, Homo sapiens
gugucaugaauuccuu

SEQ ID NO: 1255203 - RNA, 17 nt, Homo sapiens
guguccaguugcagcug

SEQ ID NO: 1255204 - RNA, 17 nt, Homo sapiens
guguccccuccacuguc

SEQ ID NO: 1255205 - RNA, 21 nt, Homo sapiens
gugucccuggccccacaagcc

SEQ ID NO: 1255206 - RNA, 21 nt, Homo sapiens
gugucuagacugccagggaga

SEQ ID NO: 1255207 - RNA, 14 nt, Homo sapiens
gugucuagagucau

SEQ ID NO: 1255208 - RNA, 13 nt, Homo sapiens
gugucugcacagg

SEQ ID NO: 1255209 - RNA, 12 nt, Homo sapiens
gugucugucagc

SEQ ID NO: 1255210 - RNA, 20 nt, Homo sapiens
gugugacucgccagcucauu

SEQ ID NO: 1255211 - RNA, 13 nt, Homo sapiens
gugugauugcaca

SEQ ID NO: 1255212 - RNA, 20 nt, Homo sapiens
gugugccauagaguuuaaca

SEQ ID NO: 1255213 - RNA, 11 nt, Homo sapiens
gugugcucucu

SEQ ID NO: 1255214 - RNA, 14 nt, Homo sapiens
gugugcugugacaa

SEQ ID NO: 1255215 - RNA, 23 nt, Homo sapiens
gugugcuuauuuuaaauguuacu

SEQ ID NO: 1255216 - RNA, 22 nt, Homo sapiens
guguggcccagggaagccaaaa

SEQ ID NO: 1255217 - RNA, 19 nt, Homo sapiens
guguggugagaucaugcca

SEQ ID NO: 1255218 - RNA, 21 nt, Homo sapiens
guguguauauaguaugaaugc

SEQ ID NO: 1255219 - RNA, 13 nt, Homo sapiens
guguguaugcuga

SEQ ID NO: 1255220 - RNA, 13 nt, Homo sapiens
auuauuuaccguu

SEQ ID NO: 1255221 - RNA, 22 nt, Homo sapiens
auuauuucacuuuagaugcuga

SEQ ID NO: 1255222 - RNA, 17 nt, Homo sapiens
auuauuuuaagcacuug

SEQ ID NO: 1255223 - RNA, 16 nt, Homo sapiens
auuauuuuacaaucaa

SEQ ID NO: 1255224 - RNA, 17 nt, Homo sapiens
auuauuuuacaaucaac

SEQ ID NO: 1255225 - RNA, 14 nt, Homo sapiens
auuauuuucuguca

SEQ ID NO: 1255226 - RNA, 18 nt, Homo sapiens
auuauuuuucacugcccc

SEQ ID NO: 1255227 - RNA, 20 nt, Homo sapiens
auucaaaaaaaaaagcaaca

SEQ ID NO: 1255228 - RNA, 23 nt, Homo sapiens
auucaaaagcacuuugugcugug

SEQ ID NO: 1255229 - RNA, 20 nt, Homo sapiens
auucaaaagguuauauacca

SEQ ID NO: 1255230 - RNA, 13 nt, Homo sapiens
auucaaagcagca

SEQ ID NO: 1255231 - RNA, 16 nt, Homo sapiens
auucaaaggcauuucu

SEQ ID NO: 1255232 - RNA, 21 nt, Homo sapiens
auucaaaguuaaaagcaaaca

SEQ ID NO: 1255233 - RNA, 17 nt, Homo sapiens
auucaaaugggugauau

SEQ ID NO: 1255234 - RNA, 16 nt, Homo sapiens
auucaaauugcugcuu

SEQ ID NO: 1255235 - RNA, 18 nt, Homo sapiens
auucaaauuuguacagga

SEQ ID NO: 1255236 - RNA, 22 nt, Homo sapiens
auucaaauuuguacaggacugu

SEQ ID NO: 1255237 - RNA, 13 nt, Homo sapiens
auucaacaaauau

SEQ ID NO: 1255238 - RNA, 22 nt, Homo sapiens
auucaacaagagcacuacauuc

SEQ ID NO: 1255239 - RNA, 14 nt, Homo sapiens
auucaaccacugua

SEQ ID NO: 1255240 - RNA, 21 nt, Homo sapiens
auucaaggagaauaugauaaa

SEQ ID NO: 1255241 - RNA, 12 nt, Homo sapiens
auucaaggccuu

SEQ ID NO: 1255242 - RNA, 18 nt, Homo sapiens
auucaagguuuguucaac

SEQ ID NO: 1255243 - RNA, 22 nt, Homo sapiens
auucaauuacggacucuggaua

SEQ ID NO: 1255244 - RNA, 18 nt, Homo sapiens
auucacaaaauuuccaca

SEQ ID NO: 1255245 - RNA, 15 nt, Homo sapiens
auucacacauggcau

SEQ ID NO: 1255246 - RNA, 14 nt, Homo sapiens
auucacagaaccua

SEQ ID NO: 1255247 - RNA, 15 nt, Homo sapiens
auucacagugcaaga

SEQ ID NO: 1255248 - RNA, 14 nt, Homo sapiens
auucacagugcucu

SEQ ID NO: 1255249 - RNA, 16 nt, Homo sapiens
auucacaguugauaca

SEQ ID NO: 1255250 - RNA, 14 nt, Homo sapiens
auucaccaacacag

SEQ ID NO: 1255251 - RNA, 22 nt, Homo sapiens
auucaccuuccagugucucgga

SEQ ID NO: 1255252 - RNA, 15 nt, Homo sapiens
auucacuagaccaga

SEQ ID NO: 1255253 - RNA, 16 nt, Homo sapiens
auucacuugcauuucu

SEQ ID NO: 1255254 - RNA, 15 nt, Homo sapiens
auucagauaauuaga

SEQ ID NO: 1255255 - RNA, 22 nt, Homo sapiens
auucagcucccuuauaccccca

SEQ ID NO: 1255256 - RNA, 17 nt, Homo sapiens
auucaggcaacgcacaa

SEQ ID NO: 1255257 - RNA, 18 nt, Homo sapiens
auucaggggcugacacuu

SEQ ID NO: 1255258 - RNA, 16 nt, Homo sapiens
auucagguaacacuag

SEQ ID NO: 1255259 - RNA, 21 nt, Homo sapiens
auucaguaugauuuauccuca

SEQ ID NO: 1255260 - RNA, 23 nt, Homo sapiens
auucagugagggucuucuuacau

SEQ ID NO: 1255261 - RNA, 11 nt, Homo sapiens
auucauaacaa

SEQ ID NO: 1255262 - RNA, 13 nt, Homo sapiens
auucauaugcaga

SEQ ID NO: 1255263 - RNA, 22 nt, Homo sapiens
auucauauuuacuucuuauaca

SEQ ID NO: 1255264 - RNA, 22 nt, Homo sapiens
auucaucugggaggcagaacag

SEQ ID NO: 1255265 - RNA, 22 nt, Homo sapiens
auucauuauuuuuccacuuugu

SEQ ID NO: 1255266 - RNA, 20 nt, Homo sapiens
auucauuuaaaaugauuaga

SEQ ID NO: 1255267 - RNA, 17 nt, Homo sapiens
auucauuuucaucacug

SEQ ID NO: 1255268 - RNA, 21 nt, Homo sapiens
auuccaaacacauacaggaag

SEQ ID NO: 1255269 - RNA, 13 nt, Homo sapiens
auuccaaagucuc

SEQ ID NO: 1255270 - RNA, 16 nt, Homo sapiens
auuccaacauuucuca

SEQ ID NO: 1255271 - RNA, 21 nt, Homo sapiens
auuccaacauuucucacugaa

SEQ ID NO: 1255272 - RNA, 20 nt, Homo sapiens
auuccaagacucuagagucc

SEQ ID NO: 1255273 - RNA, 16 nt, Homo sapiens
auuccacuccacucag

SEQ ID NO: 1255274 - RNA, 18 nt, Homo sapiens
auuccacuccacucaggu

SEQ ID NO: 1255275 - RNA, 13 nt, Homo sapiens
auuccacuggacu

SEQ ID NO: 1255276 - RNA, 18 nt, Homo sapiens
auuccacuuuuauucauu

SEQ ID NO: 1255277 - RNA, 15 nt, Homo sapiens
auuccaggagcugcg

SEQ ID NO: 1255278 - RNA, 16 nt, Homo sapiens
auuccagucauuuugg

SEQ ID NO: 1255279 - RNA, 13 nt, Homo sapiens
auuccagugccag

SEQ ID NO: 1255280 - RNA, 14 nt, Homo sapiens
auuccagugccagg

SEQ ID NO: 1255281 - RNA, 17 nt, Homo sapiens
auuccagugccaggcca

SEQ ID NO: 1255282 - RNA, 17 nt, Homo sapiens
auuccagugcuagaaaa

SEQ ID NO: 1255283 - RNA, 21 nt, Homo sapiens
auuccagugguucugcuucaa

SEQ ID NO: 1255284 - RNA, 18 nt, Homo sapiens
auuccaugacgacauaca

SEQ ID NO: 1255285 - RNA, 23 nt, Homo sapiens
auucccaagccaaaaaccuuagc

SEQ ID NO: 1255286 - RNA, 22 nt, Homo sapiens
auucccacaccuccacaguuca

SEQ ID NO: 1255287 - RNA, 17 nt, Homo sapiens
auucccauuuugcaaaa

SEQ ID NO: 1255288 - RNA, 19 nt, Homo sapiens
auucccuaucuuuuaguuu

SEQ ID NO: 1255289 - RNA, 14 nt, Homo sapiens
auuccgauacaaag

SEQ ID NO: 1255290 - RNA, 18 nt, Homo sapiens
auuccuaacuagaauuag

SEQ ID NO: 1255291 - RNA, 17 nt, Homo sapiens
auuccuacuugcaguac

SEQ ID NO: 1255292 - RNA, 20 nt, Homo sapiens
auuccuaggcaacuauuaau

SEQ ID NO: 1255293 - RNA, 15 nt, Homo sapiens
auuccuaugauggau

SEQ ID NO: 1255294 - RNA, 23 nt, Homo sapiens
agcacaggccauggugcacaaaa

SEQ ID NO: 1255295 - RNA, 18 nt, Homo sapiens
agcacagugccugacaca

SEQ ID NO: 1255296 - RNA, 18 nt, Homo sapiens
agcacaguguaaucucua

SEQ ID NO: 1255297 - RNA, 13 nt, Homo sapiens
agcacaguuugaa

SEQ ID NO: 1255298 - RNA, 17 nt, Homo sapiens
agcaccacagugaaucc

SEQ ID NO: 1255299 - RNA, 15 nt, Homo sapiens
agcaccacccuaguc

SEQ ID NO: 1255300 - RNA, 14 nt, Homo sapiens
agcacccaagccag

SEQ ID NO: 1255301 - RNA, 19 nt, Homo sapiens
agcacccauuucaaugugu

SEQ ID NO: 1255302 - RNA, 21 nt, Homo sapiens
agcaccuccgccagauccugc

SEQ ID NO: 1255303 - RNA, 13 nt, Homo sapiens
agcacgugucuca

SEQ ID NO: 1255304 - RNA, 15 nt, Homo sapiens
agcacgugucucaga

SEQ ID NO: 1255305 - RNA, 24 nt, Homo sapiens
agcacgugucucagacugcaugua

SEQ ID NO: 1255306 - RNA, 23 nt, Homo sapiens
agcacuacauaaacugacuuuau

SEQ ID NO: 1255307 - RNA, 20 nt, Homo sapiens
agcacuagaauauuuaaaac

SEQ ID NO: 1255308 - RNA, 12 nt, Homo sapiens
agcacucugaaa

SEQ ID NO: 1255309 - RNA, 18 nt, Homo sapiens
agcacugccucccuuaau

SEQ ID NO: 1255310 - RNA, 17 nt, Homo sapiens
agcacuggggagucuuu

SEQ ID NO: 1255311 - RNA, 19 nt, Homo sapiens
agcacuggugaacugagcu

SEQ ID NO: 1255312 - RNA, 20 nt, Homo sapiens
agcacugugcuaauaacagu

SEQ ID NO: 1255313 - RNA, 12 nt, Homo sapiens
agcacugugguc

SEQ ID NO: 1255314 - RNA, 18 nt, Homo sapiens
agcacuguugauguaucu

SEQ ID NO: 1255315 - RNA, 21 nt, Homo sapiens
agcacuuuagcagaugugguu

SEQ ID NO: 1255316 - RNA, 20 nt, Homo sapiens
agcacuuugaaauaccucau

SEQ ID NO: 1255317 - RNA, 22 nt, Homo sapiens
agcacuuuuuggcugacuucau

SEQ ID NO: 1255318 - RNA, 22 nt, Homo sapiens
agcagaaaucuagaagacuguc

SEQ ID NO: 1255319 - RNA, 19 nt, Homo sapiens
agcagacguccauagcucc

SEQ ID NO: 1255320 - RNA, 18 nt, Homo sapiens
agcagagcagcucugcua

SEQ ID NO: 1255321 - RNA, 13 nt, Homo sapiens
agcagagcaggca

SEQ ID NO: 1255322 - RNA, 16 nt, Homo sapiens
agcagaggcccugugg

SEQ ID NO: 1255323 - RNA, 16 nt, Homo sapiens
agcagauaacaaugca

SEQ ID NO: 1255324 - RNA, 18 nt, Homo sapiens
agcagauggaaugcugug

SEQ ID NO: 1255325 - RNA, 22 nt, Homo sapiens
agcagaugguggagcugaauau

SEQ ID NO: 1255326 - RNA, 15 nt, Homo sapiens
agcagauuugcacug

SEQ ID NO: 1255327 - RNA, 23 nt, Homo sapiens
agcagcacagucacccauggaac

SEQ ID NO: 1255328 - RNA, 17 nt, Homo sapiens
aucagaaucauugaagu

SEQ ID NO: 1255329 - RNA, 15 nt, Homo sapiens
aucagacaagcacua

SEQ ID NO: 1255330 - RNA, 13 nt, Homo sapiens
aucagaccaugaa

SEQ ID NO: 1255331 - RNA, 13 nt, Homo sapiens
aucagaccugguu

SEQ ID NO: 1255332 - RNA, 24 nt, Homo sapiens
aucagaccugucuuccaaggagac

SEQ ID NO: 1255333 - RNA, 12 nt, Homo sapiens
aucagacuguag

SEQ ID NO: 1255334 - RNA, 13 nt, Homo sapiens
aucagagaacuuu

SEQ ID NO: 1255335 - RNA, 15 nt, Homo sapiens
aucagagacuaugua

SEQ ID NO: 1255336 - RNA, 17 nt, Homo sapiens
aucagagccagucucac

SEQ ID NO: 1255337 - RNA, 15 nt, Homo sapiens
aucagagggugacug

SEQ ID NO: 1255338 - RNA, 21 nt, Homo sapiens
aucagauccgugcgugaagua

SEQ ID NO: 1255339 - RNA, 13 nt, Homo sapiens
aucagaugaacuc

SEQ ID NO: 1255340 - RNA, 16 nt, Homo sapiens
aucagaugccucagag

SEQ ID NO: 1255341 - RNA, 17 nt, Homo sapiens
aucagcaaccugacuca

SEQ ID NO: 1255342 - RNA, 12 nt, Homo sapiens
aucagcacugaa

SEQ ID NO: 1255343 - RNA, 14 nt, Homo sapiens
aucagcacugaaaa

SEQ ID NO: 1255344 - RNA, 18 nt, Homo sapiens
aucagcagagaacuggaa

SEQ ID NO: 1255345 - RNA, 22 nt, Homo sapiens
aucagcaugaaaaugcaguuuc

SEQ ID NO: 1255346 - RNA, 15 nt, Homo sapiens
aucagccacauucua

SEQ ID NO: 1255347 - RNA, 19 nt, Homo sapiens
aucagcucuugaugccuuu

SEQ ID NO: 1255348 - RNA, 14 nt, Homo sapiens
aucagcugcuacua

SEQ ID NO: 1255349 - RNA, 18 nt, Homo sapiens
aucagcuucagaauggca

SEQ ID NO: 1255350 - RNA, 18 nt, Homo sapiens
aucaggaauauuuuccaa

SEQ ID NO: 1255351 - RNA, 21 nt, Homo sapiens
aucagggaaaaggaguaggga

SEQ ID NO: 1255352 - RNA, 21 nt, Homo sapiens
aucaggugcauagcaagugaa

SEQ ID NO: 1255353 - RNA, 17 nt, Homo sapiens
aucaguagcaucuguaa

SEQ ID NO: 1255354 - RNA, 18 nt, Homo sapiens
aucagucuccaacauguu

SEQ ID NO: 1255355 - RNA, 16 nt, Homo sapiens
aucaguguuguugcuc

SEQ ID NO: 1255356 - RNA, 21 nt, Homo sapiens
aucaguuaacauuaacaucua

SEQ ID NO: 1255357 - RNA, 21 nt, Homo sapiens
aucaguuuccaugaaagaccu

SEQ ID NO: 1255358 - RNA, 21 nt, Homo sapiens
aucaguuuuguauaacuuaaa

SEQ ID NO: 1255359 - RNA, 18 nt, Homo sapiens
aucauaaaggaucagaga

SEQ ID NO: 1255360 - RNA, 17 nt, Homo sapiens
aucauaauucagcacuu

SEQ ID NO: 1255361 - RNA, 18 nt, Homo sapiens
aucauaauucagcacuua

SEQ ID NO: 1255362 - RNA, 22 nt, Homo sapiens
aucauaauucagcacuuaacua

SEQ ID NO: 1255363 - RNA, 20 nt, Homo sapiens
aucauacuaaacuucaccua

SEQ ID NO: 1255364 - RNA, 14 nt, Homo sapiens
aucauaugccugac

SEQ ID NO: 1255365 - RNA, 17 nt, Homo sapiens
aucauauucauaugcag

SEQ ID NO: 1255366 - RNA, 21 nt, Homo sapiens
aucauauugguauucacuaau

SEQ ID NO: 1255367 - RNA, 20 nt, Homo sapiens
aucaucaaagcucacaccaa

SEQ ID NO: 1255368 - RNA, 19 nt, Homo sapiens
aucaucaacaagauuuccu

SEQ ID NO: 1255369 - RNA, 23 nt, Homo sapiens
aucaucaacuaccauucuauucc

SEQ ID NO: 1255370 - RNA, 16 nt, Homo sapiens
aucaucagugccucuu

SEQ ID NO: 1255371 - RNA, 22 nt, Homo sapiens
aucaucccagcugcucccaaau

SEQ ID NO: 1255372 - RNA, 18 nt, Homo sapiens
aucaucuagggaguauga

SEQ ID NO: 1255373 - RNA, 13 nt, Homo sapiens
aucaucuguagau

SEQ ID NO: 1255374 - RNA, 20 nt, Homo sapiens
auggcuagaacguguuuaau

SEQ ID NO: 1255375 - RNA, 19 nt, Homo sapiens
auggcugaauaauauugca

SEQ ID NO: 1255376 - RNA, 17 nt, Homo sapiens
auggcuuaaaagcaagu

SEQ ID NO: 1255377 - RNA, 14 nt, Homo sapiens
auggcuugugaacu

SEQ ID NO: 1255378 - RNA, 23 nt, Homo sapiens
auggcuuuuuuugccuaccauuu

SEQ ID NO: 1255379 - RNA, 14 nt, Homo sapiens
augggaaagacaug

SEQ ID NO: 1255380 - RNA, 14 nt, Homo sapiens
augggaacacuggu

SEQ ID NO: 1255381 - RNA, 18 nt, Homo sapiens
augggaacauacagaacu

SEQ ID NO: 1255382 - RNA, 17 nt, Homo sapiens
augggaaccccuucauc

SEQ ID NO: 1255383 - RNA, 16 nt, Homo sapiens
augggaagggcuccca

SEQ ID NO: 1255384 - RNA, 14 nt, Homo sapiens
augggaccagggau

SEQ ID NO: 1255385 - RNA, 22 nt, Homo sapiens
augggacggagguccuuuggac

SEQ ID NO: 1255386 - RNA, 14 nt, Homo sapiens
augggagugggcac

SEQ ID NO: 1255387 - RNA, 12 nt, Homo sapiens
augggcacugau

SEQ ID NO: 1255388 - RNA, 10 nt, Homo sapiens
augggccagc

SEQ ID NO: 1255389 - RNA, 20 nt, Homo sapiens
augggcgcaggcccagugac

SEQ ID NO: 1255390 - RNA, 16 nt, Homo sapiens
auggggaaaaaacugu

SEQ ID NO: 1255391 - RNA, 21 nt, Homo sapiens
auggggacacagaucauggua

SEQ ID NO: 1255392 - RNA, 23 nt, Homo sapiens
auggggauaaaggagaaggcaug

SEQ ID NO: 1255393 - RNA, 14 nt, Homo sapiens
auggggcaugugcc

SEQ ID NO: 1255394 - RNA, 15 nt, Homo sapiens
auggggcgagccagg

SEQ ID NO: 1255395 - RNA, 14 nt, Homo sapiens
augggguagaaaca

SEQ ID NO: 1255396 - RNA, 14 nt, Homo sapiens
auggggugggccca

SEQ ID NO: 1255397 - RNA, 18 nt, Homo sapiens
auggggugggguagggcu

SEQ ID NO: 1255398 - RNA, 22 nt, Homo sapiens
augggugauacuggagucuuau

SEQ ID NO: 1255399 - RNA, 22 nt, Homo sapiens
auggguuauauaaagacugccu

SEQ ID NO: 1255400 - RNA, 14 nt, Homo sapiens
augguaaaccagau

SEQ ID NO: 1255401 - RNA, 16 nt, Homo sapiens
augguaaauccuuuug

SEQ ID NO: 1255402 - RNA, 16 nt, Homo sapiens
augguaauaagcacug

SEQ ID NO: 1255403 - RNA, 21 nt, Homo sapiens
augguacuaguguuuuuuaga

SEQ ID NO: 1255404 - RNA, 23 nt, Homo sapiens
augguacucuuguugaguucugu

SEQ ID NO: 1255405 - RNA, 13 nt, Homo sapiens
augguagaccuuu

SEQ ID NO: 1255406 - RNA, 19 nt, Homo sapiens
auggucccuuaaggcacag

SEQ ID NO: 1255407 - RNA, 15 nt, Homo sapiens
augguccucuuacca

SEQ ID NO: 1255408 - RNA, 16 nt, Homo sapiens
augguccuuucuggaa

SEQ ID NO: 1255409 - RNA, 19 nt, Homo sapiens
auggucuucuccauccuca

SEQ ID NO: 1255410 - RNA, 16 nt, Homo sapiens
auggucuuuccacuuu

SEQ ID NO: 1255411 - RNA, 15 nt, Homo sapiens
auggugaauggauuu

SEQ ID NO: 1255412 - RNA, 15 nt, Homo sapiens
auggugccuggagcu

SEQ ID NO: 1255413 - RNA, 14 nt, Homo sapiens
auggugcucagccc

SEQ ID NO: 1255414 - RNA, 15 nt, Homo sapiens
augguggguacaaaa

SEQ ID NO: 1255415 - RNA, 15 nt, Homo sapiens
auggugugaguccaa

SEQ ID NO: 1255416 - RNA, 16 nt, Homo sapiens
auggugugaguccaaa

SEQ ID NO: 1255417 - RNA, 16 nt, Homo sapiens
augguuacucuuguca

SEQ ID NO: 1255418 - RNA, 19 nt, Homo sapiens
augguugauggguucuaau

SEQ ID NO: 1255419 - RNA, 21 nt, Homo sapiens
auguaaaagaacuuacugauu

SEQ ID NO: 1255420 - RNA, 16 nt, Homo sapiens
auguaaaauguugaau

SEQ ID NO: 1255421 - RNA, 20 nt, Homo sapiens
auguaaacauaauucuugua

SEQ ID NO: 1255422 - RNA, 13 nt, Homo sapiens
auguaaaccacau

SEQ ID NO: 1255423 - RNA, 16 nt, Homo sapiens
auguaaauauacaaaa

SEQ ID NO: 1255424 - RNA, 12 nt, Homo sapiens
auguaacauucc

SEQ ID NO: 1255425 - RNA, 22 nt, Homo sapiens
auguaagauuauagauucuaaa

SEQ ID NO: 1255426 - RNA, 20 nt, Homo sapiens
auguaaugaucauaagucua

SEQ ID NO: 1255427 - RNA, 23 nt, Homo sapiens
auguaaugcauaggaaguauggc

SEQ ID NO: 1255428 - RNA, 21 nt, Homo sapiens
auguaauugaauaaaguugaa

SEQ ID NO: 1255429 - RNA, 14 nt, Homo sapiens
auguacaacugcac

SEQ ID NO: 1255430 - RNA, 20 nt, Homo sapiens
auguacaauaaagcaaugug

SEQ ID NO: 1255431 - RNA, 12 nt, Homo sapiens
auguacagcucu

SEQ ID NO: 1255432 - RNA, 18 nt, Homo sapiens
auguacaugaagaagcua

SEQ ID NO: 1255433 - RNA, 15 nt, Homo sapiens
auguacaugucaaua

SEQ ID NO: 1255434 - RNA, 15 nt, Homo sapiens
auguacauuuauuca

SEQ ID NO: 1255435 - RNA, 17 nt, Homo sapiens
auguaccugaugcuaug

SEQ ID NO: 1255436 - RNA, 23 nt, Homo sapiens
auguaccuucuuucacucuguca

SEQ ID NO: 1255437 - RNA, 19 nt, Homo sapiens
auguacucaaguaccacca

SEQ ID NO: 1255438 - RNA, 15 nt, Homo sapiens
auguacugccuuagu

SEQ ID NO: 1255439 - RNA, 18 nt, Homo sapiens
auguacuucagugcaccu

SEQ ID NO: 1255440 - RNA, 14 nt, Homo sapiens
auguacuucucacc

SEQ ID NO: 1255441 - RNA, 16 nt, Homo sapiens
auguacuuguuugcaa

SEQ ID NO: 1255442 - RNA, 20 nt, Homo sapiens
auguagaggcuuguuuaccu

SEQ ID NO: 1255443 - RNA, 15 nt, Homo sapiens
auguagauuuguaca

SEQ ID NO: 1255444 - RNA, 21 nt, Homo sapiens
auguagcaaaacgcauggagu

SEQ ID NO: 1255445 - RNA, 15 nt, Homo sapiens
auguagcacauaaac

SEQ ID NO: 1255446 - RNA, 15 nt, Homo sapiens
auguagccagcagaa

SEQ ID NO: 1255447 - RNA, 13 nt, Homo sapiens
auguagcucagua

SEQ ID NO: 1255448 - RNA, 20 nt, Homo sapiens
auguaguuuuuauauguugu

SEQ ID NO: 1255449 - RNA, 21 nt, Homo sapiens
auguaguuuuuauauguugua

SEQ ID NO: 1255450 - RNA, 19 nt, Homo sapiens
auguauauauauauaugca

SEQ ID NO: 1255451 - RNA, 20 nt, Homo sapiens
auguauccccacuuaucucg

SEQ ID NO: 1255452 - RNA, 18 nt, Homo sapiens
auaugcaccuugugucug

SEQ ID NO: 1255453 - RNA, 14 nt, Homo sapiens
auaugcagugauau

SEQ ID NO: 1255454 - RNA, 19 nt, Homo sapiens
auaugccaagcuaauuuau

SEQ ID NO: 1255455 - RNA, 17 nt, Homo sapiens
auaugcccucaucaucc

SEQ ID NO: 1255456 - RNA, 19 nt, Homo sapiens
auaugcccucaucauccca

SEQ ID NO: 1255457 - RNA, 20 nt, Homo sapiens
auaugcccucaucaucccag

SEQ ID NO: 1255458 - RNA, 22 nt, Homo sapiens
auaugccuuggggaggacaaaa

SEQ ID NO: 1255459 - RNA, 14 nt, Homo sapiens
auaugcugccaaau

SEQ ID NO: 1255460 - RNA, 18 nt, Homo sapiens
auauggaggaggcucugg

SEQ ID NO: 1255461 - RNA, 16 nt, Homo sapiens
auaugggaaagacaug

SEQ ID NO: 1255462 - RNA, 18 nt, Homo sapiens
auaugggacugagccugg

SEQ ID NO: 1255463 - RNA, 20 nt, Homo sapiens
auauggggaaaaaacugugc

SEQ ID NO: 1255464 - RNA, 16 nt, Homo sapiens
auauggugggcacaga

SEQ ID NO: 1255465 - RNA, 14 nt, Homo sapiens
auauguacagcucu

SEQ ID NO: 1255466 - RNA, 14 nt, Homo sapiens
auauguauuacaaa

SEQ ID NO: 1255467 - RNA, 20 nt, Homo sapiens
auaugugaagaaaaauguau

SEQ ID NO: 1255468 - RNA, 19 nt, Homo sapiens
auaugugauuuacauuuca

SEQ ID NO: 1255469 - RNA, 15 nt, Homo sapiens
auauguucccuccag

SEQ ID NO: 1255470 - RNA, 14 nt, Homo sapiens
auauguugauuuau

SEQ ID NO: 1255471 - RNA, 13 nt, Homo sapiens
auauguugcuaua

SEQ ID NO: 1255472 - RNA, 21 nt, Homo sapiens
auauguuuuaagaggcagggu

SEQ ID NO: 1255473 - RNA, 19 nt, Homo sapiens
auauuaacaacaauaacac

SEQ ID NO: 1255474 - RNA, 17 nt, Homo sapiens
auauuaauuaugaagau

SEQ ID NO: 1255475 - RNA, 14 nt, Homo sapiens
auauuaccaaaaaa

SEQ ID NO: 1255476 - RNA, 12 nt, Homo sapiens
auauuacucagc

SEQ ID NO: 1255477 - RNA, 17 nt, Homo sapiens
auauuacugacauuucu

SEQ ID NO: 1255478 - RNA, 12 nt, Homo sapiens
auauuacuuuau

SEQ ID NO: 1255479 - RNA, 18 nt, Homo sapiens
auauuacuuuaucacuuu

SEQ ID NO: 1255480 - RNA, 19 nt, Homo sapiens
auauuaguuaaucuccuca

SEQ ID NO: 1255481 - RNA, 13 nt, Homo sapiens
auauuauaacucu

SEQ ID NO: 1255482 - RNA, 12 nt, Homo sapiens
auauuauuuggc

SEQ ID NO: 1255483 - RNA, 20 nt, Homo sapiens
auauucagauauaaaacagu

SEQ ID NO: 1255484 - RNA, 17 nt, Homo sapiens
auauucauuuccacucu

SEQ ID NO: 1255485 - RNA, 21 nt, Homo sapiens
auauuccugcauuugugaaau

SEQ ID NO: 1255486 - RNA, 18 nt, Homo sapiens
auauucuauacacacccu

SEQ ID NO: 1255487 - RNA, 18 nt, Homo sapiens
auauucuauuaacuuuaa

SEQ ID NO: 1255488 - RNA, 21 nt, Homo sapiens
auauucucaguguagggcaga

SEQ ID NO: 1255489 - RNA, 20 nt, Homo sapiens
auauugcaagcuccaucucu

SEQ ID NO: 1255490 - RNA, 13 nt, Homo sapiens
auauugcagucaa

SEQ ID NO: 1255491 - RNA, 14 nt, Homo sapiens
auauugcagucaau

SEQ ID NO: 1255492 - RNA, 18 nt, Homo sapiens
auauuguaaagauccuau

SEQ ID NO: 1255493 - RNA, 17 nt, Homo sapiens
auauuguauaggggcaa

SEQ ID NO: 1255494 - RNA, 15 nt, Homo sapiens
auauugucagucuuu

SEQ ID NO: 1255495 - RNA, 16 nt, Homo sapiens
auauuguuuucagugu

SEQ ID NO: 1255496 - RNA, 16 nt, Homo sapiens
auauuuaaauauuacc

SEQ ID NO: 1255497 - RNA, 14 nt, Homo sapiens
auauuuacagugaa

SEQ ID NO: 1255498 - RNA, 14 nt, Homo sapiens
auauuuacucauag

SEQ ID NO: 1255499 - RNA, 19 nt, Homo sapiens
auauuuauaaaugagcaaa

SEQ ID NO: 1255500 - RNA, 16 nt, Homo sapiens
auauuuauaacucauc

SEQ ID NO: 1255501 - RNA, 19 nt, Homo sapiens
auauuuauagcaauccaug

SEQ ID NO: 1255502 - RNA, 16 nt, Homo sapiens
auauuuaucauauccu

SEQ ID NO: 1255503 - RNA, 14 nt, Homo sapiens
auauuuauguagau

SEQ ID NO: 1255504 - RNA, 21 nt, Homo sapiens
auauuuauuuauguguucaca

SEQ ID NO: 1255505 - RNA, 18 nt, Homo sapiens
auauuuauuuuuugccau

SEQ ID NO: 1255506 - RNA, 16 nt, Homo sapiens
auauuucaauacugcu

SEQ ID NO: 1255507 - RNA, 13 nt, Homo sapiens
auauuucaggcau

SEQ ID NO: 1255508 - RNA, 22 nt, Homo sapiens
auauuuccaagaaauauuccuu

SEQ ID NO: 1255509 - RNA, 19 nt, Homo sapiens
auauuucucccaacuuauc

SEQ ID NO: 1255510 - RNA, 21 nt, Homo sapiens
auauuucucccaacuuaucca

SEQ ID NO: 1255511 - RNA, 23 nt, Homo sapiens
auauuucucuaguguauuaucac

SEQ ID NO: 1255512 - RNA, 17 nt, Homo sapiens
auauuugaaaaccauau

SEQ ID NO: 1255513 - RNA, 13 nt, Homo sapiens
auauuuggaagaa

SEQ ID NO: 1255514 - RNA, 13 nt, Homo sapiens
auauuugugaaaa

SEQ ID NO: 1255515 - RNA, 20 nt, Homo sapiens
auauuugugugaaaauguga

SEQ ID NO: 1255516 - RNA, 15 nt, Homo sapiens
auauuuuacugaucu

SEQ ID NO: 1255517 - RNA, 21 nt, Homo sapiens
auauuuuacugaucucuuuaa

SEQ ID NO: 1255518 - RNA, 16 nt, Homo sapiens
auauuuucacaggugu

SEQ ID NO: 1255519 - RNA, 18 nt, Homo sapiens
auauuuuguaacuauuac

SEQ ID NO: 1255520 - RNA, 22 nt, Homo sapiens
auauuuuuaauaaaaguugcaa

SEQ ID NO: 1255521 - RNA, 20 nt, Homo sapiens
auauuuuucaucaaacauug

SEQ ID NO: 1255522 - RNA, 21 nt, Homo sapiens
aucaaaauaaaaagugacaca

SEQ ID NO: 1255523 - RNA, 15 nt, Homo sapiens
aucaaaaucaaugca

SEQ ID NO: 1255524 - RNA, 21 nt, Homo sapiens
aucaaaaucuuucagcacuca

SEQ ID NO: 1255525 - RNA, 14 nt, Homo sapiens
aucaaaauugccuu

SEQ ID NO: 1255526 - RNA, 18 nt, Homo sapiens
aucaaaccuacuauaaaa

SEQ ID NO: 1255527 - RNA, 17 nt, Homo sapiens
aucaaagaacaaacauc

SEQ ID NO: 1255528 - RNA, 16 nt, Homo sapiens
aucaaagaacugaaag

SEQ ID NO: 1255529 - RNA, 15 nt, Homo sapiens
aucaaagacagcauc

SEQ ID NO: 1255530 - RNA, 18 nt, Homo sapiens
aucaaauauuaccaaaaa

SEQ ID NO: 1255531 - RNA, 18 nt, Homo sapiens
aucaaaucuccugcugau

SEQ ID NO: 1255532 - RNA, 15 nt, Homo sapiens
aucaaaucucuucca

SEQ ID NO: 1255533 - RNA, 17 nt, Homo sapiens
aucaaaucucuuccaca

SEQ ID NO: 1255534 - RNA, 14 nt, Homo sapiens
aucaacaacacagc

SEQ ID NO: 1255535 - RNA, 18 nt, Homo sapiens
aucaacaucuuggucaga

SEQ ID NO: 1255536 - RNA, 14 nt, Homo sapiens
aucaacccacuuaa

SEQ ID NO: 1255537 - RNA, 13 nt, Homo sapiens
aucaacucugucu

SEQ ID NO: 1255538 - RNA, 13 nt, Homo sapiens
aucaacuuuagcu

SEQ ID NO: 1255539 - RNA, 15 nt, Homo sapiens
aucaagaacauguca

SEQ ID NO: 1255540 - RNA, 20 nt, Homo sapiens
aucaagaauggggaucacag

SEQ ID NO: 1255541 - RNA, 21 nt, Homo sapiens
aucaagaauggggaucacaga

SEQ ID NO: 1255542 - RNA, 22 nt, Homo sapiens
aucaagaauuagaagucuuuca

SEQ ID NO: 1255543 - RNA, 20 nt, Homo sapiens
aucaauaaagaaaacuucca

SEQ ID NO: 1255544 - RNA, 20 nt, Homo sapiens
aucaauaaauguugcaaugc

SEQ ID NO: 1255545 - RNA, 22 nt, Homo sapiens
aucaauauuuuuauaucaugca

SEQ ID NO: 1255546 - RNA, 23 nt, Homo sapiens
aucaauccuucuuauguuugcuu

SEQ ID NO: 1255547 - RNA, 19 nt, Homo sapiens
aucaaucugcaguuuaaca

SEQ ID NO: 1255548 - RNA, 14 nt, Homo sapiens
aucaaucuuuaaca

SEQ ID NO: 1255549 - RNA, 18 nt, Homo sapiens
aucaauggcacgcuccug

SEQ ID NO: 1255550 - RNA, 11 nt, Homo sapiens
aucaaugucac

SEQ ID NO: 1255551 - RNA, 20 nt, Homo sapiens
aucaauuacugguccaaaag

SEQ ID NO: 1255552 - RNA, 15 nt, Homo sapiens
aucaauucccuugaa

SEQ ID NO: 1255553 - RNA, 17 nt, Homo sapiens
aucaauugaccuuguga

SEQ ID NO: 1255554 - RNA, 16 nt, Homo sapiens
aucacaagauggaauu

SEQ ID NO: 1255555 - RNA, 18 nt, Homo sapiens
aucacacuacacaucaca

SEQ ID NO: 1255556 - RNA, 13 nt, Homo sapiens
aucacacucucca

SEQ ID NO: 1255557 - RNA, 19 nt, Homo sapiens
aucacacugggugguggcc

SEQ ID NO: 1255558 - RNA, 22 nt, Homo sapiens
aucacagcuuucaaaagcaaga

SEQ ID NO: 1255559 - RNA, 15 nt, Homo sapiens
aucacauuaucaucu

SEQ ID NO: 1255560 - RNA, 21 nt, Homo sapiens
aucacauuauuugcauguuac

SEQ ID NO: 1255561 - RNA, 15 nt, Homo sapiens
aucacauucuuucca

SEQ ID NO: 1255562 - RNA, 23 nt, Homo sapiens
aucacccuuuccggcacacugcc

SEQ ID NO: 1255563 - RNA, 15 nt, Homo sapiens
aucaccucaggccag

SEQ ID NO: 1255564 - RNA, 18 nt, Homo sapiens
aucacgagaucaagagau

SEQ ID NO: 1255565 - RNA, 18 nt, Homo sapiens
aucacgaggucaggagau

SEQ ID NO: 1255566 - RNA, 17 nt, Homo sapiens
aucacgcagaucacuaa

SEQ ID NO: 1255567 - RNA, 14 nt, Homo sapiens
aucacgccuggcua

SEQ ID NO: 1255568 - RNA, 23 nt, Homo sapiens
aucacggcucacugcagccucaa

SEQ ID NO: 1255569 - RNA, 18 nt, Homo sapiens
aucacuacucagugcaua

SEQ ID NO: 1255570 - RNA, 15 nt, Homo sapiens
aucacucaaccuuau

SEQ ID NO: 1255571 - RNA, 14 nt, Homo sapiens
aucacucuaaaaaa

SEQ ID NO: 1255572 - RNA, 20 nt, Homo sapiens
aucacugccacacucuccau

SEQ ID NO: 1255573 - RNA, 21 nt, Homo sapiens
aucacugccacacucuccauc

SEQ ID NO: 1255574 - RNA, 19 nt, Homo sapiens
aucacuggcuggccugagc

SEQ ID NO: 1255575 - RNA, 11 nt, Homo sapiens
aucacuuugac

SEQ ID NO: 1255576 - RNA, 16 nt, Homo sapiens
aucagaaacuugugaa

SEQ ID NO: 1255577 - RNA, 22 nt, Homo sapiens
aucagaaguguuaagugacaug

SEQ ID NO: 1255578 - RNA, 19 nt, Homo sapiens
aucagaauagccacauuug

SEQ ID NO: 1255579 - RNA, 13 nt, Homo sapiens
aucagaauauuaa

SEQ ID NO: 1255580 - RNA, 19 nt, Homo sapiens
auacuuuuuucuaguuuca

SEQ ID NO: 1255581 - RNA, 18 nt, Homo sapiens
auagaaacaugacacuga

SEQ ID NO: 1255582 - RNA, 17 nt, Homo sapiens
auagaacauauuuuccu

SEQ ID NO: 1255583 - RNA, 17 nt, Homo sapiens
auagaaccaacccaaac

SEQ ID NO: 1255584 - RNA, 16 nt, Homo sapiens
auagaagugauugaau

SEQ ID NO: 1255585 - RNA, 17 nt, Homo sapiens
auagaauaaaagcuaua

SEQ ID NO: 1255586 - RNA, 18 nt, Homo sapiens
auagaauaaaggcaguuu

SEQ ID NO: 1255587 - RNA, 16 nt, Homo sapiens
auagaauuuccaauau

SEQ ID NO: 1255588 - RNA, 12 nt, Homo sapiens
auagacaaauag

SEQ ID NO: 1255589 - RNA, 15 nt, Homo sapiens
auagacaauuugcac

SEQ ID NO: 1255590 - RNA, 17 nt, Homo sapiens
auagacacuugcuccca

SEQ ID NO: 1255591 - RNA, 19 nt, Homo sapiens
auagacucugguguucuau

SEQ ID NO: 1255592 - RNA, 21 nt, Homo sapiens
auagagauagcuacaguguaa

SEQ ID NO: 1255593 - RNA, 18 nt, Homo sapiens
auagagauuugucuaauu

SEQ ID NO: 1255594 - RNA, 22 nt, Homo sapiens
auagagcccuggccagcccuuc

SEQ ID NO: 1255595 - RNA, 12 nt, Homo sapiens
auagaggcuucu

SEQ ID NO: 1255596 - RNA, 13 nt, Homo sapiens
auagaguacugca

SEQ ID NO: 1255597 - RNA, 14 nt, Homo sapiens
auagagugucucag

SEQ ID NO: 1255598 - RNA, 15 nt, Homo sapiens
auagauauuuucaca

SEQ ID NO: 1255599 - RNA, 19 nt, Homo sapiens
auagaucaaagucaaaaau

SEQ ID NO: 1255600 - RNA, 21 nt, Homo sapiens
auagaugcacuuaugcaguaa

SEQ ID NO: 1255601 - RNA, 18 nt, Homo sapiens
auagauuaauggcacuga

SEQ ID NO: 1255602 - RNA, 15 nt, Homo sapiens
auagcaaacacuggg

SEQ ID NO: 1255603 - RNA, 21 nt, Homo sapiens
auagcaaaugcagaaccacaa

SEQ ID NO: 1255604 - RNA, 17 nt, Homo sapiens
auagcaaggugcucaca

SEQ ID NO: 1255605 - RNA, 23 nt, Homo sapiens
auagcacacuuuuccacauucca

SEQ ID NO: 1255606 - RNA, 19 nt, Homo sapiens
auagcaccuuucaaccagg

SEQ ID NO: 1255607 - RNA, 18 nt, Homo sapiens
auagcagaugguuuccac

SEQ ID NO: 1255608 - RNA, 22 nt, Homo sapiens
auagcagccuuucucucuuuau

SEQ ID NO: 1255609 - RNA, 20 nt, Homo sapiens
auagcauugauaaucuucag

SEQ ID NO: 1255610 - RNA, 13 nt, Homo sapiens
auagcccacagcu

SEQ ID NO: 1255611 - RNA, 21 nt, Homo sapiens
auagccuaauacaacauguag

SEQ ID NO: 1255612 - RNA, 17 nt, Homo sapiens
auagccuaggugacaga

SEQ ID NO: 1255613 - RNA, 21 nt, Homo sapiens
auagcgcugcucuuaugccau

SEQ ID NO: 1255614 - RNA, 20 nt, Homo sapiens
auagcuacuuuggaggacaa

SEQ ID NO: 1255615 - RNA, 22 nt, Homo sapiens
auagcucuggggugggcaguuu

SEQ ID NO: 1255616 - RNA, 23 nt, Homo sapiens
auaggaaauauuuuaauguuucu

SEQ ID NO: 1255617 - RNA, 15 nt, Homo sapiens
auaggaauaguccau

SEQ ID NO: 1255618 - RNA, 14 nt, Homo sapiens
auaggaauugcaca

SEQ ID NO: 1255619 - RNA, 16 nt, Homo sapiens
auaggacaacacugcu

SEQ ID NO: 1255620 - RNA, 17 nt, Homo sapiens
auaggacauugugucag

SEQ ID NO: 1255621 - RNA, 18 nt, Homo sapiens
auaggagccgauggaucu

SEQ ID NO: 1255622 - RNA, 15 nt, Homo sapiens
auaggcaugagccac

SEQ ID NO: 1255623 - RNA, 18 nt, Homo sapiens
auaggcauuaacacaaag

SEQ ID NO: 1255624 - RNA, 17 nt, Homo sapiens
auaggccagaguugcaa

SEQ ID NO: 1255625 - RNA, 17 nt, Homo sapiens
auagguauauauaugcc

SEQ ID NO: 1255626 - RNA, 13 nt, Homo sapiens
auaggucacuggc

SEQ ID NO: 1255627 - RNA, 12 nt, Homo sapiens
auaggugcuuau

SEQ ID NO: 1255628 - RNA, 16 nt, Homo sapiens
auaguaccucugcuau

SEQ ID NO: 1255629 - RNA, 19 nt, Homo sapiens
auaguaccuucaauacuua

SEQ ID NO: 1255630 - RNA, 20 nt, Homo sapiens
auaguacucuuuguagcaaa

SEQ ID NO: 1255631 - RNA, 18 nt, Homo sapiens
auagucaauuucuacuuc

SEQ ID NO: 1255632 - RNA, 18 nt, Homo sapiens
auagucccagcuacccag

SEQ ID NO: 1255633 - RNA, 17 nt, Homo sapiens
auagucccagcuacuca

SEQ ID NO: 1255634 - RNA, 16 nt, Homo sapiens
auagucgcagcuacua

SEQ ID NO: 1255635 - RNA, 14 nt, Homo sapiens
auagucuuugccag

SEQ ID NO: 1255636 - RNA, 13 nt, Homo sapiens
auaguuacugugu

SEQ ID NO: 1255637 - RNA, 18 nt, Homo sapiens
auaguucaguagaauuac

SEQ ID NO: 1255638 - RNA, 18 nt, Homo sapiens
auaguucuaucaggaaaa

SEQ ID NO: 1255639 - RNA, 15 nt, Homo sapiens
auaguugauucuugc

SEQ ID NO: 1255640 - RNA, 20 nt, Homo sapiens
auaguuuaaauucaauuaca

SEQ ID NO: 1255641 - RNA, 14 nt, Homo sapiens
auaguuuaccugaa

SEQ ID NO: 1255642 - RNA, 23 nt, Homo sapiens
auaguuuucuccuuuuacuucac

SEQ ID NO: 1255643 - RNA, 16 nt, Homo sapiens
auaguuuugaauccuu

SEQ ID NO: 1255644 - RNA, 19 nt, Homo sapiens
auaguuuuucauuguacca

SEQ ID NO: 1255645 - RNA, 20 nt, Homo sapiens
auauaaaauguuuaaucucu

SEQ ID NO: 1255646 - RNA, 13 nt, Homo sapiens
auauaaacauauc

SEQ ID NO: 1255647 - RNA, 17 nt, Homo sapiens
auauaaagacugccugc

SEQ ID NO: 1255648 - RNA, 15 nt, Homo sapiens
auauaaaguguaaua

SEQ ID NO: 1255649 - RNA, 18 nt, Homo sapiens
auauaaauucugauuuaa

SEQ ID NO: 1255650 - RNA, 18 nt, Homo sapiens
auauaaggaaagcaauaa

SEQ ID NO: 1255651 - RNA, 20 nt, Homo sapiens
auauaauuauccaaauugau

SEQ ID NO: 1255652 - RNA, 20 nt, Homo sapiens
auauaauucacucaagcacu

SEQ ID NO: 1255653 - RNA, 16 nt, Homo sapiens
auauaauuucaaacca

SEQ ID NO: 1255654 - RNA, 15 nt, Homo sapiens
auauacaaaacuuua

SEQ ID NO: 1255655 - RNA, 16 nt, Homo sapiens
auauacaguaacuuua

SEQ ID NO: 1255656 - RNA, 19 nt, Homo sapiens
auauacaguaacuuuaugu

SEQ ID NO: 1255657 - RNA, 20 nt, Homo sapiens
auauacauauguagacuaua

SEQ ID NO: 1255658 - RNA, 11 nt, Homo sapiens
auauaccaaau

SEQ ID NO: 1255659 - RNA, 12 nt, Homo sapiens
auauaccaaauu

SEQ ID NO: 1255660 - RNA, 22 nt, Homo sapiens
auauaccuggcuuuuacuuuau

SEQ ID NO: 1255661 - RNA, 12 nt, Homo sapiens
auauacuaugaa

SEQ ID NO: 1255662 - RNA, 22 nt, Homo sapiens
auauacuugacucuaauaugau

SEQ ID NO: 1255663 - RNA, 20 nt, Homo sapiens
auauagagaauaaggcacaa

SEQ ID NO: 1255664 - RNA, 22 nt, Homo sapiens
auauagagggcuuaugauucag

SEQ ID NO: 1255665 - RNA, 17 nt, Homo sapiens
auauagccaaaaauguc

SEQ ID NO: 1255666 - RNA, 15 nt, Homo sapiens
auauaggccagaguu

SEQ ID NO: 1255667 - RNA, 19 nt, Homo sapiens
auauagggaucaaccagcu

SEQ ID NO: 1255668 - RNA, 17 nt, Homo sapiens
auauaguaaacacucaa

SEQ ID NO: 1255669 - RNA, 13 nt, Homo sapiens
auauauaaacaga

SEQ ID NO: 1255670 - RNA, 14 nt, Homo sapiens
auauauaccacuuu

SEQ ID NO: 1255671 - RNA, 17 nt, Homo sapiens
auauauacccacaugua

SEQ ID NO: 1255672 - RNA, 12 nt, Homo sapiens
auauauaugcac

SEQ ID NO: 1255673 - RNA, 13 nt, Homo sapiens
auauauaugcaua

SEQ ID NO: 1255674 - RNA, 15 nt, Homo sapiens
auauaucacuaagcu

SEQ ID NO: 1255675 - RNA, 15 nt, Homo sapiens
auauaucuaccccag

SEQ ID NO: 1255676 - RNA, 16 nt, Homo sapiens
auauaugcacuaugua

SEQ ID NO: 1255677 - RNA, 22 nt, Homo sapiens
auauauuuauuuaagcuuaugu

SEQ ID NO: 1255678 - RNA, 17 nt, Homo sapiens
auauauuucagauauca

SEQ ID NO: 1255679 - RNA, 21 nt, Homo sapiens
auauauuuuaaagcacuuuaa

SEQ ID NO: 1255680 - RNA, 18 nt, Homo sapiens
auaucaugguagucacua

SEQ ID NO: 1255681 - RNA, 23 nt, Homo sapiens
auaucauucacccaaaacaaagu

SEQ ID NO: 1255682 - RNA, 21 nt, Homo sapiens
auaucauuuuaaaaacuuuau

SEQ ID NO: 1255683 - RNA, 22 nt, Homo sapiens
auaucauuuuaaaaacuuuauu

SEQ ID NO: 1255684 - RNA, 17 nt, Homo sapiens
auaucauuuuuuuaaca

SEQ ID NO: 1255685 - RNA, 16 nt, Homo sapiens
auauccaaagacugua

SEQ ID NO: 1255686 - RNA, 18 nt, Homo sapiens
auauccaggcaccaggac

SEQ ID NO: 1255687 - RNA, 18 nt, Homo sapiens
auauccuuucaagacaga

SEQ ID NO: 1255688 - RNA, 13 nt, Homo sapiens
auaucgaucucuu

SEQ ID NO: 1255689 - RNA, 21 nt, Homo sapiens
auaucugggauucuacuuuaa

SEQ ID NO: 1255690 - RNA, 12 nt, Homo sapiens
auaucugggcug

SEQ ID NO: 1255691 - RNA, 21 nt, Homo sapiens
auaucuuagguaagacauaua

SEQ ID NO: 1255692 - RNA, 14 nt, Homo sapiens
auaucuuauguuaa

SEQ ID NO: 1255693 - RNA, 12 nt, Homo sapiens
auaucuugccuu

SEQ ID NO: 1255694 - RNA, 22 nt, Homo sapiens
auaucuugcgaauccaagcucc

SEQ ID NO: 1255695 - RNA, 11 nt, Homo sapiens
auaucuuggcc

SEQ ID NO: 1255696 - RNA, 21 nt, Homo sapiens
auaugaaaaucuccaucucaa

SEQ ID NO: 1255697 - RNA, 18 nt, Homo sapiens
auaugaaacuaggguuug

SEQ ID NO: 1255698 - RNA, 17 nt, Homo sapiens
auaugaagaacugagga

SEQ ID NO: 1255699 - RNA, 13 nt, Homo sapiens
auaugaagcacuu

SEQ ID NO: 1255700 - RNA, 15 nt, Homo sapiens
auaugaaggauuacu

SEQ ID NO: 1255701 - RNA, 19 nt, Homo sapiens
auaugagacguuuuuggaa

SEQ ID NO: 1255702 - RNA, 17 nt, Homo sapiens
auaugaggcuugauaau

SEQ ID NO: 1255703 - RNA, 14 nt, Homo sapiens
auaugauacucuca

SEQ ID NO: 1255704 - RNA, 14 nt, Homo sapiens
auaugauccagagc

SEQ ID NO: 1255705 - RNA, 22 nt, Homo sapiens
auaugauggggcaugugccaua

SEQ ID NO: 1255706 - RNA, 19 nt, Homo sapiens
auaugauuuauauuacugu

SEQ ID NO: 1255707 - RNA, 15 nt, Homo sapiens
auaugcaagcagcuu

SEQ ID NO: 1255708 - RNA, 15 nt, Homo sapiens
auaagccaauauucc

SEQ ID NO: 1255709 - RNA, 17 nt, Homo sapiens
auaagccacucuguccc

SEQ ID NO: 1255710 - RNA, 22 nt, Homo sapiens
auaagcucuccccaaacuugcu

SEQ ID NO: 1255711 - RNA, 22 nt, Homo sapiens
auaagcugauuugauaccaugg

SEQ ID NO: 1255712 - RNA, 23 nt, Homo sapiens
auaagcuuccuagaaaguucugu

SEQ ID NO: 1255713 - RNA, 11 nt, Homo sapiens
auaagcuuucu

SEQ ID NO: 1255714 - RNA, 19 nt, Homo sapiens
auaagcuuucucucagaaa

SEQ ID NO: 1255715 - RNA, 20 nt, Homo sapiens
auaagcuuucucucagaaau

SEQ ID NO: 1255716 - RNA, 16 nt, Homo sapiens
auaaggaaagcaauaa

SEQ ID NO: 1255717 - RNA, 15 nt, Homo sapiens
auaaggacgugugua

SEQ ID NO: 1255718 - RNA, 13 nt, Homo sapiens
auaaggcccagag

SEQ ID NO: 1255719 - RNA, 21 nt, Homo sapiens
auaagggaggaauauagaaug

SEQ ID NO: 1255720 - RNA, 15 nt, Homo sapiens
auaaguaauacuuca

SEQ ID NO: 1255721 - RNA, 23 nt, Homo sapiens
auaaguacuagaugcaucacugg

SEQ ID NO: 1255722 - RNA, 18 nt, Homo sapiens
auaaguaucacacuguau

SEQ ID NO: 1255723 - RNA, 13 nt, Homo sapiens
auaagucuuucau

SEQ ID NO: 1255724 - RNA, 22 nt, Homo sapiens
auaagugaagugauacuaucca

SEQ ID NO: 1255725 - RNA, 18 nt, Homo sapiens
auaaguguguacaagcau

SEQ ID NO: 1255726 - RNA, 16 nt, Homo sapiens
auaaguuaacuuccaa

SEQ ID NO: 1255727 - RNA, 14 nt, Homo sapiens
auaaguuuacugaa

SEQ ID NO: 1255728 - RNA, 21 nt, Homo sapiens
auaauaaaacuaaacuuucau

SEQ ID NO: 1255729 - RNA, 14 nt, Homo sapiens
auaauaacagcagu

SEQ ID NO: 1255730 - RNA, 16 nt, Homo sapiens
auaauaauaauuugca

SEQ ID NO: 1255731 - RNA, 15 nt, Homo sapiens
auaauaauagcagug

SEQ ID NO: 1255732 - RNA, 17 nt, Homo sapiens
auaauaaugaugaugau

SEQ ID NO: 1255733 - RNA, 15 nt, Homo sapiens
auaauaauugaucaa

SEQ ID NO: 1255734 - RNA, 14 nt, Homo sapiens
auaauaauuugcac

SEQ ID NO: 1255735 - RNA, 13 nt, Homo sapiens
auaauaccucaau

SEQ ID NO: 1255736 - RNA, 18 nt, Homo sapiens
auaauacugugcagauuu

SEQ ID NO: 1255737 - RNA, 23 nt, Homo sapiens
auaauaugaaaaucuccaucuca

SEQ ID NO: 1255738 - RNA, 20 nt, Homo sapiens
auaauauuagugauucugau

SEQ ID NO: 1255739 - RNA, 17 nt, Homo sapiens
auaauauugauuccuca

SEQ ID NO: 1255740 - RNA, 19 nt, Homo sapiens
auaauauuucaagugccua

SEQ ID NO: 1255741 - RNA, 20 nt, Homo sapiens
auaaucacauuaucaucuga

SEQ ID NO: 1255742 - RNA, 14 nt, Homo sapiens
auaaucuaauuaca

SEQ ID NO: 1255743 - RNA, 18 nt, Homo sapiens
auaaucuaggcaugaaga

SEQ ID NO: 1255744 - RNA, 12 nt, Homo sapiens
auaaucugucaa

SEQ ID NO: 1255745 - RNA, 17 nt, Homo sapiens
auaaucuuguagacacu

SEQ ID NO: 1255746 - RNA, 19 nt, Homo sapiens
auaaucuuguagacacuua

SEQ ID NO: 1255747 - RNA, 14 nt, Homo sapiens
auaaugcaaucaaa

SEQ ID NO: 1255748 - RNA, 17 nt, Homo sapiens
auaaugcaccacuuuua

SEQ ID NO: 1255749 - RNA, 15 nt, Homo sapiens
auaaugcuacugucu

SEQ ID NO: 1255750 - RNA, 19 nt, Homo sapiens
auaauguaaacgcaaacag

SEQ ID NO: 1255751 - RNA, 20 nt, Homo sapiens
auaaugucauuaaacaugac

SEQ ID NO: 1255752 - RNA, 13 nt, Homo sapiens
auaauguguguau

SEQ ID NO: 1255753 - RNA, 19 nt, Homo sapiens
auaauguuaacauggacau

SEQ ID NO: 1255754 - RNA, 22 nt, Homo sapiens
auaauucacucaagcacugaua

SEQ ID NO: 1255755 - RNA, 14 nt, Homo sapiens
auaauucagcacuu

SEQ ID NO: 1255756 - RNA, 15 nt, Homo sapiens
auaauucagcacuua

SEQ ID NO: 1255757 - RNA, 16 nt, Homo sapiens
auaauucuacuuugag

SEQ ID NO: 1255758 - RNA, 16 nt, Homo sapiens
auaauucucucacaaa

SEQ ID NO: 1255759 - RNA, 20 nt, Homo sapiens
auaauugcucauaagcaaua

SEQ ID NO: 1255760 - RNA, 12 nt, Homo sapiens
auaauuguugaa

SEQ ID NO: 1255761 - RNA, 16 nt, Homo sapiens
auaauuucaaaccaca

SEQ ID NO: 1255762 - RNA, 20 nt, Homo sapiens
auaauuuuaguuuauauuaa

SEQ ID NO: 1255763 - RNA, 20 nt, Homo sapiens
auaauuuuccucaaucacac

SEQ ID NO: 1255764 - RNA, 21 nt, Homo sapiens
auaauuuuccucaaucacacu

SEQ ID NO: 1255765 - RNA, 15 nt, Homo sapiens
auaauuuucugaaag

SEQ ID NO: 1255766 - RNA, 12 nt, Homo sapiens
auacaaaccuac

SEQ ID NO: 1255767 - RNA, 14 nt, Homo sapiens
auacaaaccuacca

SEQ ID NO: 1255768 - RNA, 13 nt, Homo sapiens
auacaaauggauu

SEQ ID NO: 1255769 - RNA, 18 nt, Homo sapiens
auacaacagaaaccagaa

SEQ ID NO: 1255770 - RNA, 12 nt, Homo sapiens
auacaaccagcc

SEQ ID NO: 1255771 - RNA, 16 nt, Homo sapiens
auacacaacuguuccc

SEQ ID NO: 1255772 - RNA, 16 nt, Homo sapiens
auacacagaugaaggu

SEQ ID NO: 1255773 - RNA, 19 nt, Homo sapiens
auacaccaccucacuccug

SEQ ID NO: 1255774 - RNA, 18 nt, Homo sapiens
auacacccaaacacuuac

SEQ ID NO: 1255775 - RNA, 21 nt, Homo sapiens
auacacgguauuuauagagag

SEQ ID NO: 1255776 - RNA, 22 nt, Homo sapiens
auacacguaugguuaauguuca

SEQ ID NO: 1255777 - RNA, 13 nt, Homo sapiens
auacacuagacaa

SEQ ID NO: 1255778 - RNA, 16 nt, Homo sapiens
auacagaaaugcaaaa

SEQ ID NO: 1255779 - RNA, 14 nt, Homo sapiens
auacagaacucuaa

SEQ ID NO: 1255780 - RNA, 14 nt, Homo sapiens
auacagacaucuaa

SEQ ID NO: 1255781 - RNA, 14 nt, Homo sapiens
auacagcacuuuga

SEQ ID NO: 1255782 - RNA, 13 nt, Homo sapiens
auacaggugcuca

SEQ ID NO: 1255783 - RNA, 22 nt, Homo sapiens
auacaguauucuguaccauagc

SEQ ID NO: 1255784 - RNA, 13 nt, Homo sapiens
auacagugccuug

SEQ ID NO: 1255785 - RNA, 12 nt, Homo sapiens
auacaguuauuu

SEQ ID NO: 1255786 - RNA, 21 nt, Homo sapiens
auacauaacuaaauuugauac

SEQ ID NO: 1255787 - RNA, 23 nt, Homo sapiens
auacauaagcggcguaaguuuaa

SEQ ID NO: 1255788 - RNA, 14 nt, Homo sapiens
auacauauuaucuc

SEQ ID NO: 1255789 - RNA, 17 nt, Homo sapiens
auacauauuaucucauu

SEQ ID NO: 1255790 - RNA, 22 nt, Homo sapiens
auacaucaauuuaaaaagcaaa

SEQ ID NO: 1255791 - RNA, 15 nt, Homo sapiens
auacauccuggguaa

SEQ ID NO: 1255792 - RNA, 13 nt, Homo sapiens
auacaugcugcua

SEQ ID NO: 1255793 - RNA, 15 nt, Homo sapiens
auacaugugccgaau

SEQ ID NO: 1255794 - RNA, 15 nt, Homo sapiens
auacauuugauaaag

SEQ ID NO: 1255795 - RNA, 19 nt, Homo sapiens
auaccaagaugccaucugu

SEQ ID NO: 1255796 - RNA, 13 nt, Homo sapiens
auaccaagcuugu

SEQ ID NO: 1255797 - RNA, 14 nt, Homo sapiens
auaccaauauuuac

SEQ ID NO: 1255798 - RNA, 23 nt, Homo sapiens
auaccagagccuucaagugccaa

SEQ ID NO: 1255799 - RNA, 12 nt, Homo sapiens
auaccagcaaua

SEQ ID NO: 1255800 - RNA, 18 nt, Homo sapiens
auaccagcuuaugagcuc

SEQ ID NO: 1255801 - RNA, 21 nt, Homo sapiens
auaccagguuuuacacuugca

SEQ ID NO: 1255802 - RNA, 22 nt, Homo sapiens
auaccagguuuuacacuugcau

SEQ ID NO: 1255803 - RNA, 19 nt, Homo sapiens
auaccauuuuuuaaggaaa

SEQ ID NO: 1255804 - RNA, 14 nt, Homo sapiens
auacccagugaugu

SEQ ID NO: 1255805 - RNA, 16 nt, Homo sapiens
auaccuaaguacugua

SEQ ID NO: 1255806 - RNA, 17 nt, Homo sapiens
auaccuaaguacuguaa

SEQ ID NO: 1255807 - RNA, 19 nt, Homo sapiens
auaccuaaguacuguaaua

SEQ ID NO: 1255808 - RNA, 14 nt, Homo sapiens
auaccucugaccaa

SEQ ID NO: 1255809 - RNA, 18 nt, Homo sapiens
auaccuggcuuuuacuuu

SEQ ID NO: 1255810 - RNA, 19 nt, Homo sapiens
auaccuggcuuuuacuuua

SEQ ID NO: 1255811 - RNA, 21 nt, Homo sapiens
auaccuguugagacugauuca

SEQ ID NO: 1255812 - RNA, 15 nt, Homo sapiens
auaccuuuuuguguc

SEQ ID NO: 1255813 - RNA, 20 nt, Homo sapiens
auacgcucaggugguugugg

SEQ ID NO: 1255814 - RNA, 18 nt, Homo sapiens
auacggcccaugcaauuu

SEQ ID NO: 1255815 - RNA, 15 nt, Homo sapiens
auacguguagcuaua

SEQ ID NO: 1255816 - RNA, 23 nt, Homo sapiens
auacuagucaccccaaguagucu

SEQ ID NO: 1255817 - RNA, 21 nt, Homo sapiens
auacuauuuaauuauuucacu

SEQ ID NO: 1255818 - RNA, 16 nt, Homo sapiens
auacuccacugcucau

SEQ ID NO: 1255819 - RNA, 23 nt, Homo sapiens
auacucuagaugaaguuuuacau

SEQ ID NO: 1255820 - RNA, 18 nt, Homo sapiens
auacugaaggaaaaacac

SEQ ID NO: 1255821 - RNA, 19 nt, Homo sapiens
auacugacacuuugccaga

SEQ ID NO: 1255822 - RNA, 14 nt, Homo sapiens
auacugaguaugug

SEQ ID NO: 1255823 - RNA, 18 nt, Homo sapiens
auacugagugugccucau

SEQ ID NO: 1255824 - RNA, 22 nt, Homo sapiens
auacugcuugaccguacucuca

SEQ ID NO: 1255825 - RNA, 19 nt, Homo sapiens
auacuggccuggacuguuu

SEQ ID NO: 1255826 - RNA, 17 nt, Homo sapiens
auacugggaaucaagac

SEQ ID NO: 1255827 - RNA, 21 nt, Homo sapiens
auacuguagaagaagcccaua

SEQ ID NO: 1255828 - RNA, 18 nt, Homo sapiens
auacuguauauucaggac

SEQ ID NO: 1255829 - RNA, 12 nt, Homo sapiens
auacugugcaua

SEQ ID NO: 1255830 - RNA, 13 nt, Homo sapiens
auacuguuuccau

SEQ ID NO: 1255831 - RNA, 20 nt, Homo sapiens
auacuugccuucugauagua

SEQ ID NO: 1255832 - RNA, 13 nt, Homo sapiens
auacuuuacaaag

SEQ ID NO: 1255833 - RNA, 23 nt, Homo sapiens
auacuuuauaucuguaaugauac

SEQ ID NO: 1255834 - RNA, 15 nt, Homo sapiens
auacuuuauuguggg

SEQ ID NO: 1255835 - RNA, 16 nt, Homo sapiens
auacuuugucugaaaa

SEQ ID NO: 1255836 - RNA, 16 nt, Homo sapiens
aguugcugaugaacuc

SEQ ID NO: 1255837 - RNA, 20 nt, Homo sapiens
aguuggaguugacugcucau

SEQ ID NO: 1255838 - RNA, 15 nt, Homo sapiens
aguuggcacauuuca

SEQ ID NO: 1255839 - RNA, 18 nt, Homo sapiens
aguuggccaugaugucuu

SEQ ID NO: 1255840 - RNA, 21 nt, Homo sapiens
aguugggcaaaacccaggaca

SEQ ID NO: 1255841 - RNA, 22 nt, Homo sapiens
aguuggugcuuuugagaaccaa

SEQ ID NO: 1255842 - RNA, 14 nt, Homo sapiens
aguugguggggcca

SEQ ID NO: 1255843 - RNA, 21 nt, Homo sapiens
aguuguccuauggacaacuua

SEQ ID NO: 1255844 - RNA, 17 nt, Homo sapiens
aguugucuuuccuggca

SEQ ID NO: 1255845 - RNA, 12 nt, Homo sapiens
aguugugaaaga

SEQ ID NO: 1255846 - RNA, 21 nt, Homo sapiens
aguugugucagcuacugcgga

SEQ ID NO: 1255847 - RNA, 20 nt, Homo sapiens
aguuguucuaguaacaauac

SEQ ID NO: 1255848 - RNA, 15 nt, Homo sapiens
aguuuaaagacacuu

SEQ ID NO: 1255849 - RNA, 17 nt, Homo sapiens
aguuuauuuuguuacac

SEQ ID NO: 1255850 - RNA, 15 nt, Homo sapiens
aguuucaaguuuuaa

SEQ ID NO: 1255851 - RNA, 15 nt, Homo sapiens
aguuucaaugugauu

SEQ ID NO: 1255852 - RNA, 13 nt, Homo sapiens
aguuucagugaag

SEQ ID NO: 1255853 - RNA, 18 nt, Homo sapiens
aguuuccuaugggaacaa

SEQ ID NO: 1255854 - RNA, 17 nt, Homo sapiens
aguuucuaagauucuaa

SEQ ID NO: 1255855 - RNA, 18 nt, Homo sapiens
aguuucugauaccacugc

SEQ ID NO: 1255856 - RNA, 15 nt, Homo sapiens
aguuucuuuccugcc

SEQ ID NO: 1255857 - RNA, 14 nt, Homo sapiens
aguuugaccucaca

SEQ ID NO: 1255858 - RNA, 20 nt, Homo sapiens
aguuugagacaggagaccug

SEQ ID NO: 1255859 - RNA, 17 nt, Homo sapiens
aguuugauaccugcacu

SEQ ID NO: 1255860 - RNA, 21 nt, Homo sapiens
aguuugauaccugcacugucc

SEQ ID NO: 1255861 - RNA, 17 nt, Homo sapiens
aguuugcaaugucacaa

SEQ ID NO: 1255862 - RNA, 15 nt, Homo sapiens
aguuugcacaacaag

SEQ ID NO: 1255863 - RNA, 19 nt, Homo sapiens
aguuugcccugguuucacu

SEQ ID NO: 1255864 - RNA, 22 nt, Homo sapiens
aguuugccggauacaaacuggu

SEQ ID NO: 1255865 - RNA, 21 nt, Homo sapiens
aguuugcuuauguaaucucac

SEQ ID NO: 1255866 - RNA, 19 nt, Homo sapiens
aguuugcuuuguaugcacu

SEQ ID NO: 1255867 - RNA, 16 nt, Homo sapiens
aguuuggagucacugu

SEQ ID NO: 1255868 - RNA, 21 nt, Homo sapiens
aguuuguagccagguacugca

SEQ ID NO: 1255869 - RNA, 20 nt, Homo sapiens
aguuuguuuuagaaccagcc

SEQ ID NO: 1255870 - RNA, 21 nt, Homo sapiens
aguuuuaauguauaguuuuga

SEQ ID NO: 1255871 - RNA, 14 nt, Homo sapiens
aguuuuaucuucag

SEQ ID NO: 1255872 - RNA, 18 nt, Homo sapiens
aguuuuauuuuuguagag

SEQ ID NO: 1255873 - RNA, 23 nt, Homo sapiens
aguuuuauuuuuucgugcacucu

SEQ ID NO: 1255874 - RNA, 18 nt, Homo sapiens
aguuuucaacuucaguac

SEQ ID NO: 1255875 - RNA, 15 nt, Homo sapiens
aguuuucuguaguca

SEQ ID NO: 1255876 - RNA, 21 nt, Homo sapiens
aguuuuucccucagugaaggc

SEQ ID NO: 1255877 - RNA, 17 nt, Homo sapiens
aguuuuugauagcuuua

SEQ ID NO: 1255878 - RNA, 21 nt, Homo sapiens
aguuuuuuauuaugcauuaua

SEQ ID NO: 1255879 - RNA, 14 nt, Homo sapiens
auaaaaaauagaca

SEQ ID NO: 1255880 - RNA, 19 nt, Homo sapiens
auaaaaagauaaucucagu

SEQ ID NO: 1255881 - RNA, 20 nt, Homo sapiens
auaaaaagugacacagcagc

SEQ ID NO: 1255882 - RNA, 16 nt, Homo sapiens
auaaaacacugcccuc

SEQ ID NO: 1255883 - RNA, 19 nt, Homo sapiens
auaaaacaugggaaucucc

SEQ ID NO: 1255884 - RNA, 20 nt, Homo sapiens
auaaaaccaagggauaucuu

SEQ ID NO: 1255885 - RNA, 15 nt, Homo sapiens
auaaaaccacuguac

SEQ ID NO: 1255886 - RNA, 21 nt, Homo sapiens
auaaaaccaucaaaaauauuc

SEQ ID NO: 1255887 - RNA, 14 nt, Homo sapiens
auaaaacucuccuu

SEQ ID NO: 1255888 - RNA, 13 nt, Homo sapiens
auaaaacuuuccu

SEQ ID NO: 1255889 - RNA, 12 nt, Homo sapiens
auaaaagacuuu

SEQ ID NO: 1255890 - RNA, 13 nt, Homo sapiens
auaaaagacuuuu

SEQ ID NO: 1255891 - RNA, 18 nt, Homo sapiens
auaaaagauguacuugug

SEQ ID NO: 1255892 - RNA, 12 nt, Homo sapiens
auaaaagcuaug

SEQ ID NO: 1255893 - RNA, 14 nt, Homo sapiens
auaaaaguugcaaa

SEQ ID NO: 1255894 - RNA, 15 nt, Homo sapiens
auaaaaucagaguug

SEQ ID NO: 1255895 - RNA, 23 nt, Homo sapiens
auaaaauccuaagacacaaaugc

SEQ ID NO: 1255896 - RNA, 17 nt, Homo sapiens
auaaaauggaagcaauu

SEQ ID NO: 1255897 - RNA, 13 nt, Homo sapiens
auaaaaugugauu

SEQ ID NO: 1255898 - RNA, 19 nt, Homo sapiens
auaaaauguguacagugaa

SEQ ID NO: 1255899 - RNA, 21 nt, Homo sapiens
auaaaauguuuaaucucugcu

SEQ ID NO: 1255900 - RNA, 15 nt, Homo sapiens
auaaacaccauuuca

SEQ ID NO: 1255901 - RNA, 22 nt, Homo sapiens
auaaacagacuguuaauuauag

SEQ ID NO: 1255902 - RNA, 14 nt, Homo sapiens
auaaacagcuucau

SEQ ID NO: 1255903 - RNA, 16 nt, Homo sapiens
auaaacauaucaaugu

SEQ ID NO: 1255904 - RNA, 19 nt, Homo sapiens
auaaacauuucauuuccca

SEQ ID NO: 1255905 - RNA, 12 nt, Homo sapiens
auaaaccacuuu

SEQ ID NO: 1255906 - RNA, 15 nt, Homo sapiens
auaaaccacuuucua

SEQ ID NO: 1255907 - RNA, 16 nt, Homo sapiens
auaaaccuggagauau

SEQ ID NO: 1255908 - RNA, 18 nt, Homo sapiens
auaaacgguuccugguga

SEQ ID NO: 1255909 - RNA, 16 nt, Homo sapiens
auaaacucaaugagcu

SEQ ID NO: 1255910 - RNA, 14 nt, Homo sapiens
auaaacuccuacua

SEQ ID NO: 1255911 - RNA, 18 nt, Homo sapiens
auaaacugacuaaacuua

SEQ ID NO: 1255912 - RNA, 15 nt, Homo sapiens
auaaacuucagggau

SEQ ID NO: 1255913 - RNA, 23 nt, Homo sapiens
auaaagaagguuggugaauuuca

SEQ ID NO: 1255914 - RNA, 14 nt, Homo sapiens
auaaagaugaucua

SEQ ID NO: 1255915 - RNA, 13 nt, Homo sapiens
auaaagauguuau

SEQ ID NO: 1255916 - RNA, 12 nt, Homo sapiens
auaaagccuuuu

SEQ ID NO: 1255917 - RNA, 15 nt, Homo sapiens
auaaaggcagcugcc

SEQ ID NO: 1255918 - RNA, 18 nt, Homo sapiens
auaaaggcccccacuucu

SEQ ID NO: 1255919 - RNA, 12 nt, Homo sapiens
auaaagugcagu

SEQ ID NO: 1255920 - RNA, 13 nt, Homo sapiens
auaaagugcaguu

SEQ ID NO: 1255921 - RNA, 18 nt, Homo sapiens
auaaaguguaaguucaca

SEQ ID NO: 1255922 - RNA, 20 nt, Homo sapiens
auaaauaagaucagacucug

SEQ ID NO: 1255923 - RNA, 15 nt, Homo sapiens
auaaauauacucaag

SEQ ID NO: 1255924 - RNA, 16 nt, Homo sapiens
auaaauauauauucua

SEQ ID NO: 1255925 - RNA, 13 nt, Homo sapiens
auaaauaugcagu

SEQ ID NO: 1255926 - RNA, 15 nt, Homo sapiens
auaaauaugucagau

SEQ ID NO: 1255927 - RNA, 17 nt, Homo sapiens
auaaauauuacagugaa

SEQ ID NO: 1255928 - RNA, 20 nt, Homo sapiens
auaaauauuauuagauuuau

SEQ ID NO: 1255929 - RNA, 23 nt, Homo sapiens
auaaaucagagagcaaggcaucg

SEQ ID NO: 1255930 - RNA, 13 nt, Homo sapiens
auaaaucauaaaa

SEQ ID NO: 1255931 - RNA, 17 nt, Homo sapiens
auaaaucucuccuauaa

SEQ ID NO: 1255932 - RNA, 15 nt, Homo sapiens
auaaaugaacugcau

SEQ ID NO: 1255933 - RNA, 19 nt, Homo sapiens
auaaaugacaagugagaca

SEQ ID NO: 1255934 - RNA, 14 nt, Homo sapiens
auaaauggaaucau

SEQ ID NO: 1255935 - RNA, 14 nt, Homo sapiens
auaaauuauggcau

SEQ ID NO: 1255936 - RNA, 18 nt, Homo sapiens
auaaauuccuacaacuua

SEQ ID NO: 1255937 - RNA, 22 nt, Homo sapiens
auaaauucuauaggaacauaug

SEQ ID NO: 1255938 - RNA, 18 nt, Homo sapiens
auaaauugcuccuugaca

SEQ ID NO: 1255939 - RNA, 22 nt, Homo sapiens
auaaauugcuuacugauauuau

SEQ ID NO: 1255940 - RNA, 14 nt, Homo sapiens
auaaauuugguucu

SEQ ID NO: 1255941 - RNA, 20 nt, Homo sapiens
auaacaagaucuuucaggaa

SEQ ID NO: 1255942 - RNA, 13 nt, Homo sapiens
auaacagaauuaa

SEQ ID NO: 1255943 - RNA, 13 nt, Homo sapiens
auaacagugcaua

SEQ ID NO: 1255944 - RNA, 15 nt, Homo sapiens
auaacagugcauauu

SEQ ID NO: 1255945 - RNA, 15 nt, Homo sapiens
auaacaucaacaaca

SEQ ID NO: 1255946 - RNA, 16 nt, Homo sapiens
auaacccacuugucac

SEQ ID NO: 1255947 - RNA, 14 nt, Homo sapiens
auaaccucuggccc

SEQ ID NO: 1255948 - RNA, 13 nt, Homo sapiens
auaacuaugccag

SEQ ID NO: 1255949 - RNA, 15 nt, Homo sapiens
auaacucuucuaaca

SEQ ID NO: 1255950 - RNA, 18 nt, Homo sapiens
auaacugaaaaugugcua

SEQ ID NO: 1255951 - RNA, 13 nt, Homo sapiens
auaacuguucuca

SEQ ID NO: 1255952 - RNA, 13 nt, Homo sapiens
auaacuuaaaaua

SEQ ID NO: 1255953 - RNA, 17 nt, Homo sapiens
auaacuugaagaacagg

SEQ ID NO: 1255954 - RNA, 19 nt, Homo sapiens
auaacuuggccauguucuc

SEQ ID NO: 1255955 - RNA, 19 nt, Homo sapiens
auaacuuggggaggcaaga

SEQ ID NO: 1255956 - RNA, 23 nt, Homo sapiens
auaacuuuuuugagucauugacu

SEQ ID NO: 1255957 - RNA, 17 nt, Homo sapiens
auaagaaagaucaaaga

SEQ ID NO: 1255958 - RNA, 17 nt, Homo sapiens
auaagaaagcacuauua

SEQ ID NO: 1255959 - RNA, 18 nt, Homo sapiens
auaagacugucauguaag

SEQ ID NO: 1255960 - RNA, 13 nt, Homo sapiens
auaagacuuccac

SEQ ID NO: 1255961 - RNA, 13 nt, Homo sapiens
auaagagauuugg

SEQ ID NO: 1255962 - RNA, 19 nt, Homo sapiens
auaagagcuggaugcacau

SEQ ID NO: 1255963 - RNA, 17 nt, Homo sapiens
auaagcauacaacugga

SEQ ID NO: 1255964 - RNA, 17 nt, Homo sapiens
agccuucugaugucucu

SEQ ID NO: 1255965 - RNA, 20 nt, Homo sapiens
agccuuuuccagaagaucug

SEQ ID NO: 1255966 - RNA, 13 nt, Homo sapiens
agcgaagaccagu

SEQ ID NO: 1255967 - RNA, 12 nt, Homo sapiens
agcgaagucuca

SEQ ID NO: 1255968 - RNA, 19 nt, Homo sapiens
agcgaauguguacaaagug

SEQ ID NO: 1255969 - RNA, 21 nt, Homo sapiens
agcgcaacggcuccuuugcca

SEQ ID NO: 1255970 - RNA, 19 nt, Homo sapiens
agcgcagguuuaguuuacu

SEQ ID NO: 1255971 - RNA, 18 nt, Homo sapiens
agcgcauccaaucucaag

SEQ ID NO: 1255972 - RNA, 19 nt, Homo sapiens
agcgcugagugggagaagg

SEQ ID NO: 1255973 - RNA, 12 nt, Homo sapiens
agcgcugcagua

SEQ ID NO: 1255974 - RNA, 22 nt, Homo sapiens
agcggcccuaagggagugucua

SEQ ID NO: 1255975 - RNA, 15 nt, Homo sapiens
agcgggcacagggca

SEQ ID NO: 1255976 - RNA, 14 nt, Homo sapiens
agcgguaccccagg

SEQ ID NO: 1255977 - RNA, 13 nt, Homo sapiens
agcgguccaaagu

SEQ ID NO: 1255978 - RNA, 15 nt, Homo sapiens
agcguagcuaaguga

SEQ ID NO: 1255979 - RNA, 17 nt, Homo sapiens
agcguagcuaagugaaa

SEQ ID NO: 1255980 - RNA, 18 nt, Homo sapiens
agcgucacggccaagugu

SEQ ID NO: 1255981 - RNA, 21 nt, Homo sapiens
agcgugggccagaggcagcuc

SEQ ID NO: 1255982 - RNA, 21 nt, Homo sapiens
agcuaacagucccuauggaaa

SEQ ID NO: 1255983 - RNA, 23 nt, Homo sapiens
agcuaaggagucccugguucauu

SEQ ID NO: 1255984 - RNA, 20 nt, Homo sapiens
agcuaaguucuaaguucaug

SEQ ID NO: 1255985 - RNA, 23 nt, Homo sapiens
agcuaauauacagucaguucuca

SEQ ID NO: 1255986 - RNA, 22 nt, Homo sapiens
agcuaauguaauaacugugaag

SEQ ID NO: 1255987 - RNA, 19 nt, Homo sapiens
agcuaauguaggacuguau

SEQ ID NO: 1255988 - RNA, 12 nt, Homo sapiens
agcuaauuugca

SEQ ID NO: 1255989 - RNA, 13 nt, Homo sapiens
agcuaccaggugu

SEQ ID NO: 1255990 - RNA, 20 nt, Homo sapiens
agcuaccucacuaugcugcu

SEQ ID NO: 1255991 - RNA, 16 nt, Homo sapiens
agcuaccuuccugugu

SEQ ID NO: 1255992 - RNA, 18 nt, Homo sapiens
agcuacggguaggucuau

SEQ ID NO: 1255993 - RNA, 17 nt, Homo sapiens
agcuacuauguacugcc

SEQ ID NO: 1255994 - RNA, 20 nt, Homo sapiens
agcuacuauguacugccuua

SEQ ID NO: 1255995 - RNA, 21 nt, Homo sapiens
agcuacuauguacugccuuag

SEQ ID NO: 1255996 - RNA, 19 nt, Homo sapiens
agcuacucagaagccugag

SEQ ID NO: 1255997 - RNA, 21 nt, Homo sapiens
agcuacucuccccacgagggc

SEQ ID NO: 1255998 - RNA, 22 nt, Homo sapiens
agcuacuguuuauuauuuuauu

SEQ ID NO: 1255999 - RNA, 16 nt, Homo sapiens
agcuacuugcaauuca

SEQ ID NO: 1256000 - RNA, 18 nt, Homo sapiens
agcuacuugggaggcuga

SEQ ID NO: 1256001 - RNA, 22 nt, Homo sapiens
agcuacuuugugagccaaagcu

SEQ ID NO: 1256002 - RNA, 15 nt, Homo sapiens
agcuagcgauuucag

SEQ ID NO: 1256003 - RNA, 20 nt, Homo sapiens
agcuaggaagagcaggacuc

SEQ ID NO: 1256004 - RNA, 18 nt, Homo sapiens
agcuaggccuggccagau

SEQ ID NO: 1256005 - RNA, 22 nt, Homo sapiens
agcuaggccuggccagaugcac

SEQ ID NO: 1256006 - RNA, 16 nt, Homo sapiens
agcuaguuugagccag

SEQ ID NO: 1256007 - RNA, 22 nt, Homo sapiens
agcuaguuuuuuugaaauccaa

SEQ ID NO: 1256008 - RNA, 13 nt, Homo sapiens
agcuaucaccuag

SEQ ID NO: 1256009 - RNA, 18 nt, Homo sapiens
agauaagaaaugaucuuu

SEQ ID NO: 1256010 - RNA, 17 nt, Homo sapiens
agauaauaaucuuggcu

SEQ ID NO: 1256011 - RNA, 21 nt, Homo sapiens
agauaauuuauuaaagguggu

SEQ ID NO: 1256012 - RNA, 12 nt, Homo sapiens
agauacaaacug

SEQ ID NO: 1256013 - RNA, 14 nt, Homo sapiens
agauacuagcuauc

SEQ ID NO: 1256014 - RNA, 19 nt, Homo sapiens
agauacuuugucagcaaua

SEQ ID NO: 1256015 - RNA, 19 nt, Homo sapiens
agauagaugcacuuaugca

SEQ ID NO: 1256016 - RNA, 20 nt, Homo sapiens
agauaguagcauacauuuau

SEQ ID NO: 1256017 - RNA, 18 nt, Homo sapiens
agauauuaaaugauguuu

SEQ ID NO: 1256018 - RNA, 13 nt, Homo sapiens
agauauugguuua

SEQ ID NO: 1256019 - RNA, 13 nt, Homo sapiens
agauauuguucaa

SEQ ID NO: 1256020 - RNA, 15 nt, Homo sapiens
agauauuugguacca

SEQ ID NO: 1256021 - RNA, 20 nt, Homo sapiens
agaucaaggaguacaaugcc

SEQ ID NO: 1256022 - RNA, 16 nt, Homo sapiens
agaucacgagaucaag

SEQ ID NO: 1256023 - RNA, 16 nt, Homo sapiens
agaucacguugcaaug

SEQ ID NO: 1256024 - RNA, 19 nt, Homo sapiens
agaucacuacucagugcau

SEQ ID NO: 1256025 - RNA, 10 nt, Homo sapiens
agaucacugc

SEQ ID NO: 1256026 - RNA, 22 nt, Homo sapiens
agaucacugccacacucuccau

SEQ ID NO: 1256027 - RNA, 18 nt, Homo sapiens
agaucagaacauucagcu

SEQ ID NO: 1256028 - RNA, 13 nt, Homo sapiens
agaucagacucug

SEQ ID NO: 1256029 - RNA, 19 nt, Homo sapiens
agaucagaugcuccaagau

SEQ ID NO: 1256030 - RNA, 21 nt, Homo sapiens
agaucaguauuucacugauac

SEQ ID NO: 1256031 - RNA, 11 nt, Homo sapiens
agaucagucag

SEQ ID NO: 1256032 - RNA, 20 nt, Homo sapiens
agaucauccagaaguuccuc

SEQ ID NO: 1256033 - RNA, 20 nt, Homo sapiens
agauccagauccagacugua

SEQ ID NO: 1256034 - RNA, 16 nt, Homo sapiens
agauccaguucuugaa

SEQ ID NO: 1256035 - RNA, 15 nt, Homo sapiens
agaucccacuggaag

SEQ ID NO: 1256036 - RNA, 16 nt, Homo sapiens
agauccuauagcucuu

SEQ ID NO: 1256037 - RNA, 21 nt, Homo sapiens
agaucgauccuggauucacuc

SEQ ID NO: 1256038 - RNA, 21 nt, Homo sapiens
agaucgaugauaugaccagaa

SEQ ID NO: 1256039 - RNA, 19 nt, Homo sapiens
agaucgccccacugcacuc

SEQ ID NO: 1256040 - RNA, 18 nt, Homo sapiens
agaucgugcuacugcacu

SEQ ID NO: 1256041 - RNA, 20 nt, Homo sapiens
agaucuaagccuuuccauaa

SEQ ID NO: 1256042 - RNA, 17 nt, Homo sapiens
agaucuaaggaugucac

SEQ ID NO: 1256043 - RNA, 15 nt, Homo sapiens
agaucuagugaacau

SEQ ID NO: 1256044 - RNA, 24 nt, Homo sapiens
agaucucccacugcggggagacag

SEQ ID NO: 1256045 - RNA, 14 nt, Homo sapiens
agccaccgcugcca

SEQ ID NO: 1256046 - RNA, 16 nt, Homo sapiens
agccaccucucccuca

SEQ ID NO: 1256047 - RNA, 17 nt, Homo sapiens
agccacuggcuuggaac

SEQ ID NO: 1256048 - RNA, 16 nt, Homo sapiens
agccacuugacuggca

SEQ ID NO: 1256049 - RNA, 16 nt, Homo sapiens
agccagaggcucuaau

SEQ ID NO: 1256050 - RNA, 23 nt, Homo sapiens
agccagaggcucuaauguacaau

SEQ ID NO: 1256051 - RNA, 18 nt, Homo sapiens
agccagaggguagggcac

SEQ ID NO: 1256052 - RNA, 19 nt, Homo sapiens
agccagaggguagggcaca

SEQ ID NO: 1256053 - RNA, 13 nt, Homo sapiens
agccagauucaaa

SEQ ID NO: 1256054 - RNA, 14 nt, Homo sapiens
agccagcacuugua

SEQ ID NO: 1256055 - RNA, 18 nt, Homo sapiens
agccagcucccagccaca

SEQ ID NO: 1256056 - RNA, 15 nt, Homo sapiens
agccagcugugcacu

SEQ ID NO: 1256057 - RNA, 22 nt, Homo sapiens
agccagcuuacuagcacuuuga

SEQ ID NO: 1256058 - RNA, 18 nt, Homo sapiens
agccaggaaguacuucca

SEQ ID NO: 1256059 - RNA, 14 nt, Homo sapiens
agccaggacaucuc

SEQ ID NO: 1256060 - RNA, 23 nt, Homo sapiens
agccaggccugggggcagccucu

SEQ ID NO: 1256061 - RNA, 19 nt, Homo sapiens
agccaggcugcuaaccugg

SEQ ID NO: 1256062 - RNA, 15 nt, Homo sapiens
agccagggccagugg

SEQ ID NO: 1256063 - RNA, 22 nt, Homo sapiens
agccagggggaugccacuccuc

SEQ ID NO: 1256064 - RNA, 15 nt, Homo sapiens
agccagguaauguga

SEQ ID NO: 1256065 - RNA, 16 nt, Homo sapiens
agccagguaaugugaa

SEQ ID NO: 1256066 - RNA, 18 nt, Homo sapiens
agccaggugagcucugac

SEQ ID NO: 1256067 - RNA, 18 nt, Homo sapiens
agccagguuagccuuugc

SEQ ID NO: 1256068 - RNA, 14 nt, Homo sapiens
agccagguucacac

SEQ ID NO: 1256069 - RNA, 13 nt, Homo sapiens
agccagugccauu

SEQ ID NO: 1256070 - RNA, 15 nt, Homo sapiens
agccaguuggugggg

SEQ ID NO: 1256071 - RNA, 22 nt, Homo sapiens
agccaguuuggguaaaauacuu

SEQ ID NO: 1256072 - RNA, 20 nt, Homo sapiens
agccauaagaaagcacuauu

SEQ ID NO: 1256073 - RNA, 21 nt, Homo sapiens
agccauaagaaagcacuauua

SEQ ID NO: 1256074 - RNA, 15 nt, Homo sapiens
agccauacuuauuaa

SEQ ID NO: 1256075 - RNA, 20 nt, Homo sapiens
agccauagugucacuuccac

SEQ ID NO: 1256076 - RNA, 16 nt, Homo sapiens
agccaucacaugaucu

SEQ ID NO: 1256077 - RNA, 15 nt, Homo sapiens
agccaucauaucccc

SEQ ID NO: 1256078 - RNA, 21 nt, Homo sapiens
agccaucuaaugcuuguuuau

SEQ ID NO: 1256079 - RNA, 13 nt, Homo sapiens
agccaucucuaau

SEQ ID NO: 1256080 - RNA, 15 nt, Homo sapiens
agccaucuugaauau

SEQ ID NO: 1256081 - RNA, 19 nt, Homo sapiens
agccaugaaacugacucau

SEQ ID NO: 1256082 - RNA, 11 nt, Homo sapiens
agccaugccug

SEQ ID NO: 1256083 - RNA, 16 nt, Homo sapiens
agccaugccugagguc

SEQ ID NO: 1256084 - RNA, 17 nt, Homo sapiens
agccauuaaaugaauau

SEQ ID NO: 1256085 - RNA, 21 nt, Homo sapiens
agguggaaaaacagcauguac

SEQ ID NO: 1256086 - RNA, 17 nt, Homo sapiens
agguggagacccugaga

SEQ ID NO: 1256087 - RNA, 16 nt, Homo sapiens
agguggagugucacau

SEQ ID NO: 1256088 - RNA, 23 nt, Homo sapiens
aggugggaggaggccugcacagg

SEQ ID NO: 1256089 - RNA, 19 nt, Homo sapiens
aggugggccuugcuaccuc

SEQ ID NO: 1256090 - RNA, 20 nt, Homo sapiens
aggugguaagcaccaggacg

SEQ ID NO: 1256091 - RNA, 13 nt, Homo sapiens
agguggugcaaau

SEQ ID NO: 1256092 - RNA, 13 nt, Homo sapiens
agguggugccuuc

SEQ ID NO: 1256093 - RNA, 18 nt, Homo sapiens
aggugucuagacugccag

SEQ ID NO: 1256094 - RNA, 20 nt, Homo sapiens
aggugucuagacugccaggg

SEQ ID NO: 1256095 - RNA, 10 nt, Homo sapiens
aggugucuga

SEQ ID NO: 1256096 - RNA, 14 nt, Homo sapiens
aggugugacuugaa

SEQ ID NO: 1256097 - RNA, 15 nt, Homo sapiens
agguguuuaguugca

SEQ ID NO: 1256098 - RNA, 13 nt, Homo sapiens
agguuaaggcaua

SEQ ID NO: 1256099 - RNA, 23 nt, Homo sapiens
agguuacccgagaagcacuugag

SEQ ID NO: 1256100 - RNA, 13 nt, Homo sapiens
agguuagcacagc

SEQ ID NO: 1256101 - RNA, 19 nt, Homo sapiens
agguuauagaguagaagau

SEQ ID NO: 1256102 - RNA, 14 nt, Homo sapiens
agguuauauccaau

SEQ ID NO: 1256103 - RNA, 14 nt, Homo sapiens
agguuaucgaaaua

SEQ ID NO: 1256104 - RNA, 14 nt, Homo sapiens
agguucacaggggu

SEQ ID NO: 1256105 - RNA, 15 nt, Homo sapiens
agguucacugagcuc

SEQ ID NO: 1256106 - RNA, 15 nt, Homo sapiens
agguucagccugaaa

SEQ ID NO: 1256107 - RNA, 20 nt, Homo sapiens
agguucuaaaguucuaagau

SEQ ID NO: 1256108 - RNA, 19 nt, Homo sapiens
agguucucagguguugcca

SEQ ID NO: 1256109 - RNA, 20 nt, Homo sapiens
agguucucagguguugccaa

SEQ ID NO: 1256110 - RNA, 19 nt, Homo sapiens
agguucuuagugucacuua

SEQ ID NO: 1256111 - RNA, 14 nt, Homo sapiens
agguucuucagggc

SEQ ID NO: 1256112 - RNA, 17 nt, Homo sapiens
agguucuucagggccag

SEQ ID NO: 1256113 - RNA, 16 nt, Homo sapiens
agguugaacuuugcca

SEQ ID NO: 1256114 - RNA, 20 nt, Homo sapiens
agguugaggggcuccuggaa

SEQ ID NO: 1256115 - RNA, 12 nt, Homo sapiens
agguuggcagua

SEQ ID NO: 1256116 - RNA, 19 nt, Homo sapiens
agguuggugaauuucacaa

SEQ ID NO: 1256117 - RNA, 16 nt, Homo sapiens
agguuuuaaagugauu

SEQ ID NO: 1256118 - RNA, 21 nt, Homo sapiens
agguuuuaaccgcacaugcac

SEQ ID NO: 1256119 - RNA, 19 nt, Homo sapiens
agguuuucuucacugccag

SEQ ID NO: 1256120 - RNA, 19 nt, Homo sapiens
agguuuuucucauguaucu

SEQ ID NO: 1256121 - RNA, 16 nt, Homo sapiens
agguuuuuggucugac

SEQ ID NO: 1256122 - RNA, 15 nt, Homo sapiens
aguaaaaagguggua

SEQ ID NO: 1256123 - RNA, 13 nt, Homo sapiens
aguaaaagccauc

SEQ ID NO: 1256124 - RNA, 19 nt, Homo sapiens
aguaaacaugugggaaaaa

SEQ ID NO: 1256125 - RNA, 12 nt, Homo sapiens
aguaaagacagg

SEQ ID NO: 1256126 - RNA, 19 nt, Homo sapiens
aguaaauuuugugaugaau

SEQ ID NO: 1256127 - RNA, 16 nt, Homo sapiens
aguaacaaauaaauaa

SEQ ID NO: 1256128 - RNA, 14 nt, Homo sapiens
aguaacaguuguga

SEQ ID NO: 1256129 - RNA, 20 nt, Homo sapiens
aguaacaugcauacuuuauu

SEQ ID NO: 1256130 - RNA, 21 nt, Homo sapiens
aguaacauuugcuguuuuaaa

SEQ ID NO: 1256131 - RNA, 13 nt, Homo sapiens
aguaacccaaacc

SEQ ID NO: 1256132 - RNA, 16 nt, Homo sapiens
aguaacccaaaccuca

SEQ ID NO: 1256133 - RNA, 15 nt, Homo sapiens
aguaacuccccucag

SEQ ID NO: 1256134 - RNA, 16 nt, Homo sapiens
aguaacugaaccauuc

SEQ ID NO: 1256135 - RNA, 15 nt, Homo sapiens
aguaagaagacauga

SEQ ID NO: 1256136 - RNA, 19 nt, Homo sapiens
aguaagaguacugggagaa

SEQ ID NO: 1256137 - RNA, 14 nt, Homo sapiens
aguaagaugcacug

SEQ ID NO: 1256138 - RNA, 15 nt, Homo sapiens
aguaagaugcacuga

SEQ ID NO: 1256139 - RNA, 16 nt, Homo sapiens
aguaagaugcacugaa

SEQ ID NO: 1256140 - RNA, 11 nt, Homo sapiens
aguaagccaug

SEQ ID NO: 1256141 - RNA, 19 nt, Homo sapiens
aguaauaaaacaucuuucc

SEQ ID NO: 1256142 - RNA, 19 nt, Homo sapiens
aguaauauagcugagacua

SEQ ID NO: 1256143 - RNA, 19 nt, Homo sapiens
aguaaucuaauauggccac

SEQ ID NO: 1256144 - RNA, 21 nt, Homo sapiens
aguaaugaauuuuuaugauau

SEQ ID NO: 1256145 - RNA, 13 nt, Homo sapiens
aguaauggcagag

SEQ ID NO: 1256146 - RNA, 23 nt, Homo sapiens
aguaauuggucaugugaugcaag

SEQ ID NO: 1256147 - RNA, 15 nt, Homo sapiens
aguacacagauaccu

SEQ ID NO: 1256148 - RNA, 21 nt, Homo sapiens
aguaccaggggcugggcuccc

SEQ ID NO: 1256149 - RNA, 15 nt, Homo sapiens
aguacccaucuagua

SEQ ID NO: 1256150 - RNA, 14 nt, Homo sapiens
aguaccucugcuau

SEQ ID NO: 1256151 - RNA, 21 nt, Homo sapiens
aguacguguuauuuuuuucaa

SEQ ID NO: 1256152 - RNA, 22 nt, Homo sapiens
aguacuaaauucuuaguaaaau

SEQ ID NO: 1256153 - RNA, 18 nt, Homo sapiens
aguacuaagggaacaauc

SEQ ID NO: 1256154 - RNA, 19 nt, Homo sapiens
aguacucaaauauuucuga

SEQ ID NO: 1256155 - RNA, 19 nt, Homo sapiens
aguacuccaagacagagac

SEQ ID NO: 1256156 - RNA, 20 nt, Homo sapiens
aguacuuaauaaacuguggu

SEQ ID NO: 1256157 - RNA, 11 nt, Homo sapiens
aguacuugaaa

SEQ ID NO: 1256158 - RNA, 22 nt, Homo sapiens
aguacuugacccaugccccaac

SEQ ID NO: 1256159 - RNA, 15 nt, Homo sapiens
aguacuugugaaaca

SEQ ID NO: 1256160 - RNA, 15 nt, Homo sapiens
aguacuuugugcauu

SEQ ID NO: 1256161 - RNA, 19 nt, Homo sapiens
aguagaaauaaaagugaau

SEQ ID NO: 1256162 - RNA, 15 nt, Homo sapiens
aguagaauuaccauu

SEQ ID NO: 1256163 - RNA, 18 nt, Homo sapiens
aguagagcaaaucuauga

SEQ ID NO: 1256164 - RNA, 12 nt, Homo sapiens
aguagagccagc

SEQ ID NO: 1256165 - RNA, 16 nt, Homo sapiens
aguagaggcuauggac

SEQ ID NO: 1256166 - RNA, 16 nt, Homo sapiens
aguagcaucaccaucu

SEQ ID NO: 1256167 - RNA, 14 nt, Homo sapiens
aguagcugggacua

SEQ ID NO: 1256168 - RNA, 20 nt, Homo sapiens
aguagcugggauuacaggug

SEQ ID NO: 1256169 - RNA, 14 nt, Homo sapiens
aguaguuagcuuuc

SEQ ID NO: 1256170 - RNA, 14 nt, Homo sapiens
aguauaacaacuuu

SEQ ID NO: 1256171 - RNA, 15 nt, Homo sapiens
aguauaacaacuuug

SEQ ID NO: 1256172 - RNA, 14 nt, Homo sapiens
aguauaauuuaacu

SEQ ID NO: 1256173 - RNA, 19 nt, Homo sapiens
aguauacuagggagccauu

SEQ ID NO: 1256174 - RNA, 20 nt, Homo sapiens
aguauagagaaaaguguauu

SEQ ID NO: 1256175 - RNA, 22 nt, Homo sapiens
aguauagagaaaaguguauuag

SEQ ID NO: 1256176 - RNA, 12 nt, Homo sapiens
aguauauguuaa

SEQ ID NO: 1256177 - RNA, 21 nt, Homo sapiens
aguauauucaaccaaauacuu

SEQ ID NO: 1256178 - RNA, 21 nt, Homo sapiens
aguauauuuccgcacuucaga

SEQ ID NO: 1256179 - RNA, 23 nt, Homo sapiens
aguaucaguguuuuaaauucuga

SEQ ID NO: 1256180 - RNA, 14 nt, Homo sapiens
aguaucccacaucc

SEQ ID NO: 1256181 - RNA, 15 nt, Homo sapiens
aguaucccacaucca

SEQ ID NO: 1256182 - RNA, 23 nt, Homo sapiens
aguaucuguauguauauauacac

SEQ ID NO: 1256183 - RNA, 19 nt, Homo sapiens
aguaugaauauuacucuca

SEQ ID NO: 1256184 - RNA, 15 nt, Homo sapiens
aguaugaaugcagug

SEQ ID NO: 1256185 - RNA, 14 nt, Homo sapiens
aguaugagggaaaa

SEQ ID NO: 1256186 - RNA, 14 nt, Homo sapiens
aguaugggaucuga

SEQ ID NO: 1256187 - RNA, 14 nt, Homo sapiens
aguauguacuucag

SEQ ID NO: 1256188 - RNA, 13 nt, Homo sapiens
aguauguuuucaa

SEQ ID NO: 1256189 - RNA, 18 nt, Homo sapiens
aguauuauuuuacaauca

SEQ ID NO: 1256190 - RNA, 14 nt, Homo sapiens
aguauucucagagc

SEQ ID NO: 1256191 - RNA, 20 nt, Homo sapiens
aguauugucgguuaccucug

SEQ ID NO: 1256192 - RNA, 15 nt, Homo sapiens
aguauuguggcugca

SEQ ID NO: 1256193 - RNA, 18 nt, Homo sapiens
aguauuucaugcugggaa

SEQ ID NO: 1256194 - RNA, 13 nt, Homo sapiens
aguauuuuaccua

SEQ ID NO: 1256195 - RNA, 21 nt, Homo sapiens
agucaaauuuguaaaucuuau

SEQ ID NO: 1256196 - RNA, 15 nt, Homo sapiens
agucaauuucuacuu

SEQ ID NO: 1256197 - RNA, 14 nt, Homo sapiens
agucaauuuuacaa

SEQ ID NO: 1256198 - RNA, 18 nt, Homo sapiens
agucaauuuuacaauuau

SEQ ID NO: 1256199 - RNA, 22 nt, Homo sapiens
agucacaugcuagcagcuguga

SEQ ID NO: 1256200 - RNA, 13 nt, Homo sapiens
agucacauucgaa

SEQ ID NO: 1256201 - RNA, 19 nt, Homo sapiens
agucaccaaauagugugaa

SEQ ID NO: 1256202 - RNA, 13 nt, Homo sapiens
agucaccuuccag

SEQ ID NO: 1256203 - RNA, 19 nt, Homo sapiens
agucacugccacuuugcac

SEQ ID NO: 1256204 - RNA, 17 nt, Homo sapiens
agucacuggcaucucac

SEQ ID NO: 1256205 - RNA, 20 nt, Homo sapiens
agucacuggucuguuugcau

SEQ ID NO: 1256206 - RNA, 11 nt, Homo sapiens
agucacuucca

SEQ ID NO: 1256207 - RNA, 16 nt, Homo sapiens
agucagacugucagaa

SEQ ID NO: 1256208 - RNA, 14 nt, Homo sapiens
agucagaugcccag

SEQ ID NO: 1256209 - RNA, 23 nt, Homo sapiens
agucagccaguggcuagcgcaag

SEQ ID NO: 1256210 - RNA, 13 nt, Homo sapiens
agucagcucucuc

SEQ ID NO: 1256211 - RNA, 19 nt, Homo sapiens
agucagggaaggugccucu

SEQ ID NO: 1256212 - RNA, 16 nt, Homo sapiens
agucaguaauugccaa

SEQ ID NO: 1256213 - RNA, 14 nt, Homo sapiens
agucaguauggucu

SEQ ID NO: 1256214 - RNA, 21 nt, Homo sapiens
aguggaaaacaaagccaaaca

SEQ ID NO: 1256215 - RNA, 18 nt, Homo sapiens
aguggaaauuaagacuuu

SEQ ID NO: 1256216 - RNA, 23 nt, Homo sapiens
aguggaaggucuauuggccaaca

SEQ ID NO: 1256217 - RNA, 11 nt, Homo sapiens
aguggacaaau

SEQ ID NO: 1256218 - RNA, 22 nt, Homo sapiens
aguggacucagcagugaccaca

SEQ ID NO: 1256219 - RNA, 14 nt, Homo sapiens
aguggagacagacu

SEQ ID NO: 1256220 - RNA, 15 nt, Homo sapiens
aguggagacaguccu

SEQ ID NO: 1256221 - RNA, 15 nt, Homo sapiens
aguggaggcacuuua

SEQ ID NO: 1256222 - RNA, 22 nt, Homo sapiens
aguggagugagagcaauuguaa

SEQ ID NO: 1256223 - RNA, 16 nt, Homo sapiens
aguggauuacugccau

SEQ ID NO: 1256224 - RNA, 21 nt, Homo sapiens
aguggauuggcuuugugcuug

SEQ ID NO: 1256225 - RNA, 18 nt, Homo sapiens
aguggcauuuccugguca

SEQ ID NO: 1256226 - RNA, 15 nt, Homo sapiens
aguggccagccagug

SEQ ID NO: 1256227 - RNA, 16 nt, Homo sapiens
aguggccagccagugc

SEQ ID NO: 1256228 - RNA, 19 nt, Homo sapiens
aguggccagccagugccau

SEQ ID NO: 1256229 - RNA, 20 nt, Homo sapiens
aguggccagcuucacucucu

SEQ ID NO: 1256230 - RNA, 12 nt, Homo sapiens
aguggccaguuc

SEQ ID NO: 1256231 - RNA, 15 nt, Homo sapiens
aguggccgaugauuu

SEQ ID NO: 1256232 - RNA, 20 nt, Homo sapiens
aguggcgugaucucggcuca

SEQ ID NO: 1256233 - RNA, 13 nt, Homo sapiens
aguggcuagcgca

SEQ ID NO: 1256234 - RNA, 14 nt, Homo sapiens
aguggcugguuggg

SEQ ID NO: 1256235 - RNA, 16 nt, Homo sapiens
aguggcuucuuuugaa

SEQ ID NO: 1256236 - RNA, 22 nt, Homo sapiens
agugggagggagguaacgggug

SEQ ID NO: 1256237 - RNA, 22 nt, Homo sapiens
agugggauuuccagaaccacac

SEQ ID NO: 1256238 - RNA, 18 nt, Homo sapiens
agugggccauuaaaaacu

SEQ ID NO: 1256239 - RNA, 16 nt, Homo sapiens
aguggggaacuacugc

SEQ ID NO: 1256240 - RNA, 21 nt, Homo sapiens
agugguaaucauaugugucuu

SEQ ID NO: 1256241 - RNA, 16 nt, Homo sapiens
agugguaggucagcua

SEQ ID NO: 1256242 - RNA, 17 nt, Homo sapiens
agugguauccugugaca

SEQ ID NO: 1256243 - RNA, 17 nt, Homo sapiens
aguggucccagaaccua

SEQ ID NO: 1256244 - RNA, 18 nt, Homo sapiens
aguggucccagaaccuau

SEQ ID NO: 1256245 - RNA, 12 nt, Homo sapiens
aguggucuucaa

SEQ ID NO: 1256246 - RNA, 12 nt, Homo sapiens
aguggugcaauc

SEQ ID NO: 1256247 - RNA, 21 nt, Homo sapiens
aguggugcgaucuggguucac

SEQ ID NO: 1256248 - RNA, 23 nt, Homo sapiens
aguggugggcccugaugcugcca

SEQ ID NO: 1256249 - RNA, 18 nt, Homo sapiens
agugguguaggugggggu

SEQ ID NO: 1256250 - RNA, 22 nt, Homo sapiens
agugguucuauguccauucuca

SEQ ID NO: 1256251 - RNA, 15 nt, Homo sapiens
agugguuugaucauu

SEQ ID NO: 1256252 - RNA, 17 nt, Homo sapiens
aguguaacagauaucag

SEQ ID NO: 1256253 - RNA, 18 nt, Homo sapiens
aguguacauaguguaaug

SEQ ID NO: 1256254 - RNA, 15 nt, Homo sapiens
aguguagacuguggc

SEQ ID NO: 1256255 - RNA, 20 nt, Homo sapiens
aguguagcauuggaucaaaa

SEQ ID NO: 1256256 - RNA, 17 nt, Homo sapiens
aguguaugacugcacau

SEQ ID NO: 1256257 - RNA, 18 nt, Homo sapiens
aguguauuaucacugucu

SEQ ID NO: 1256258 - RNA, 17 nt, Homo sapiens
agugucacuggauguca

SEQ ID NO: 1256259 - RNA, 12 nt, Homo sapiens
agugucacuuac

SEQ ID NO: 1256260 - RNA, 20 nt, Homo sapiens
aguguccccuuauacagugg

SEQ ID NO: 1256261 - RNA, 14 nt, Homo sapiens
aguguccucuugcu

SEQ ID NO: 1256262 - RNA, 18 nt, Homo sapiens
agugucucagggugcaga

SEQ ID NO: 1256263 - RNA, 20 nt, Homo sapiens
agugucuggagcggcugcuc

SEQ ID NO: 1256264 - RNA, 21 nt, Homo sapiens
agugugaacaaaagaugcucu

SEQ ID NO: 1256265 - RNA, 22 nt, Homo sapiens
agugugacagggccaguggggc

SEQ ID NO: 1256266 - RNA, 14 nt, Homo sapiens
agugugaccacuga

SEQ ID NO: 1256267 - RNA, 16 nt, Homo sapiens
aguguggaaccacuga

SEQ ID NO: 1256268 - RNA, 19 nt, Homo sapiens
aguguggcugcaucuugcu

SEQ ID NO: 1256269 - RNA, 17 nt, Homo sapiens
agugugggcuugaccag

SEQ ID NO: 1256270 - RNA, 15 nt, Homo sapiens
agugugugacauucc

SEQ ID NO: 1256271 - RNA, 18 nt, Homo sapiens
agugugugacauuccagg

SEQ ID NO: 1256272 - RNA, 22 nt, Homo sapiens
aguguuaucagucauaacuaaa

SEQ ID NO: 1256273 - RNA, 19 nt, Homo sapiens
aguguuccccaucuggguc

SEQ ID NO: 1256274 - RNA, 13 nt, Homo sapiens
aguguucccugac

SEQ ID NO: 1256275 - RNA, 23 nt, Homo sapiens
aguguugcccaggcuggucucaa

SEQ ID NO: 1256276 - RNA, 18 nt, Homo sapiens
aguguugggcaugugauc

SEQ ID NO: 1256277 - RNA, 14 nt, Homo sapiens
aguguuucuuccac

SEQ ID NO: 1256278 - RNA, 13 nt, Homo sapiens
aguuaaaaguaaa

SEQ ID NO: 1256279 - RNA, 21 nt, Homo sapiens
aguuaaauagaguauaugcac

SEQ ID NO: 1256280 - RNA, 20 nt, Homo sapiens
aguuaagaaugucgauuaaa

SEQ ID NO: 1256281 - RNA, 15 nt, Homo sapiens
aguuaaggagccuaa

SEQ ID NO: 1256282 - RNA, 14 nt, Homo sapiens
aguuaauucaccua

SEQ ID NO: 1256283 - RNA, 18 nt, Homo sapiens
aguuacaguucugugguu

SEQ ID NO: 1256284 - RNA, 14 nt, Homo sapiens
aguuacccacugaa

SEQ ID NO: 1256285 - RNA, 23 nt, Homo sapiens
aguuaccuuauaguuacugugua

SEQ ID NO: 1256286 - RNA, 16 nt, Homo sapiens
aguuacuaccugucaa

SEQ ID NO: 1256287 - RNA, 18 nt, Homo sapiens
aguuacuagguaacuuca

SEQ ID NO: 1256288 - RNA, 13 nt, Homo sapiens
aguuacugugguc

SEQ ID NO: 1256289 - RNA, 14 nt, Homo sapiens
aguuacugugguca

SEQ ID NO: 1256290 - RNA, 24 nt, Homo sapiens
aguuacuuuugacccaugugcaag

SEQ ID NO: 1256291 - RNA, 20 nt, Homo sapiens
aguuacuuuuuuacacugau

SEQ ID NO: 1256292 - RNA, 20 nt, Homo sapiens
aguuagagcuggcaccagaa

SEQ ID NO: 1256293 - RNA, 13 nt, Homo sapiens
aguuagugccaua

SEQ ID NO: 1256294 - RNA, 23 nt, Homo sapiens
aguuaguguuuugccucaccuaa

SEQ ID NO: 1256295 - RNA, 15 nt, Homo sapiens
aguuauaucagugaa

SEQ ID NO: 1256296 - RNA, 23 nt, Homo sapiens
aguuaugaaaaauaagucacuua

SEQ ID NO: 1256297 - RNA, 12 nt, Homo sapiens
aguuaugacagc

SEQ ID NO: 1256298 - RNA, 15 nt, Homo sapiens
aguuaugacagccau

SEQ ID NO: 1256299 - RNA, 16 nt, Homo sapiens
aguuauuaaucuggac

SEQ ID NO: 1256300 - RNA, 20 nt, Homo sapiens
aguuauuacugucucuggca

SEQ ID NO: 1256301 - RNA, 18 nt, Homo sapiens
aguuauucauauucuguu

SEQ ID NO: 1256302 - RNA, 17 nt, Homo sapiens
aguuauuuacuuuuacc

SEQ ID NO: 1256303 - RNA, 16 nt, Homo sapiens
aguuauuuucagacau

SEQ ID NO: 1256304 - RNA, 13 nt, Homo sapiens
aguucaacuguau

SEQ ID NO: 1256305 - RNA, 15 nt, Homo sapiens
aguucaacuguauag

SEQ ID NO: 1256306 - RNA, 15 nt, Homo sapiens
aguucaauacaguga

SEQ ID NO: 1256307 - RNA, 17 nt, Homo sapiens
aguucacacccugcaag

SEQ ID NO: 1256308 - RNA, 13 nt, Homo sapiens
aguucacugcaac

SEQ ID NO: 1256309 - RNA, 22 nt, Homo sapiens
aguucacuuuuuacagugcuau

SEQ ID NO: 1256310 - RNA, 23 nt, Homo sapiens
aguucagaguuguacacugugua

SEQ ID NO: 1256311 - RNA, 22 nt, Homo sapiens
aguucaguggcagggcucagga

SEQ ID NO: 1256312 - RNA, 19 nt, Homo sapiens
aguucauacccuguuacca

SEQ ID NO: 1256313 - RNA, 13 nt, Homo sapiens
aguucauaccuaa

SEQ ID NO: 1256314 - RNA, 22 nt, Homo sapiens
aguucauaccuaaguacuguaa

SEQ ID NO: 1256315 - RNA, 20 nt, Homo sapiens
aguucauauuucauuuccaa

SEQ ID NO: 1256316 - RNA, 19 nt, Homo sapiens
aguucaugcagcuguggca

SEQ ID NO: 1256317 - RNA, 12 nt, Homo sapiens
aguucauugugg

SEQ ID NO: 1256318 - RNA, 15 nt, Homo sapiens
aguuccaagagucua

SEQ ID NO: 1256319 - RNA, 20 nt, Homo sapiens
aguuccaagagucuaaagau

SEQ ID NO: 1256320 - RNA, 17 nt, Homo sapiens
aguuccacgaaacacug

SEQ ID NO: 1256321 - RNA, 23 nt, Homo sapiens
aguuccaguugaaguuaguggaa

SEQ ID NO: 1256322 - RNA, 15 nt, Homo sapiens
aguuccccaaauaca

SEQ ID NO: 1256323 - RNA, 17 nt, Homo sapiens
aguucccuuggccucag

SEQ ID NO: 1256324 - RNA, 19 nt, Homo sapiens
aguuccuaauggauucaau

SEQ ID NO: 1256325 - RNA, 22 nt, Homo sapiens
aguucggaaaccguccugugua

SEQ ID NO: 1256326 - RNA, 15 nt, Homo sapiens
aguucggcucugggu

SEQ ID NO: 1256327 - RNA, 16 nt, Homo sapiens
aguucuaagauucuaa

SEQ ID NO: 1256328 - RNA, 16 nt, Homo sapiens
aguucuaagauucuga

SEQ ID NO: 1256329 - RNA, 14 nt, Homo sapiens
aguucuacaguuaa

SEQ ID NO: 1256330 - RNA, 22 nt, Homo sapiens
aguucuaggcacuguaguucua

SEQ ID NO: 1256331 - RNA, 20 nt, Homo sapiens
aguucuaugagggcuaauau

SEQ ID NO: 1256332 - RNA, 24 nt, Homo sapiens
aguucucccuguacaguguuacca

SEQ ID NO: 1256333 - RNA, 17 nt, Homo sapiens
aguucuccuaucuugau

SEQ ID NO: 1256334 - RNA, 19 nt, Homo sapiens
aguucuucaccucuaucca

SEQ ID NO: 1256335 - RNA, 17 nt, Homo sapiens
aguugaaauucuauucu

SEQ ID NO: 1256336 - RNA, 20 nt, Homo sapiens
aguugaucuacaaaggccau

SEQ ID NO: 1256337 - RNA, 16 nt, Homo sapiens
aguugauucuugccuu

SEQ ID NO: 1256338 - RNA, 11 nt, Homo sapiens
aguugcacaaa

SEQ ID NO: 1256339 - RNA, 12 nt, Homo sapiens
aguugccuuuau

SEQ ID NO: 1256340 - RNA, 18 nt, Homo sapiens
aguugcguggacucugca

SEQ ID NO: 1256341 - RNA, 17 nt, Homo sapiens
agucagugacagccccu

SEQ ID NO: 1256342 - RNA, 13 nt, Homo sapiens
agucagugucugg

SEQ ID NO: 1256343 - RNA, 13 nt, Homo sapiens
agucaguguuaaa

SEQ ID NO: 1256344 - RNA, 18 nt, Homo sapiens
agucaguucucauuauuc

SEQ ID NO: 1256345 - RNA, 15 nt, Homo sapiens
agucauauaccuaua

SEQ ID NO: 1256346 - RNA, 18 nt, Homo sapiens
agucaucuccaucagcug

SEQ ID NO: 1256347 - RNA, 18 nt, Homo sapiens
agucaugugugaacacau

SEQ ID NO: 1256348 - RNA, 19 nt, Homo sapiens
agucauuaugagaggcaau

SEQ ID NO: 1256349 - RNA, 21 nt, Homo sapiens
agucauucuucccuaaucuuc

SEQ ID NO: 1256350 - RNA, 15 nt, Homo sapiens
agucauugaggcccu

SEQ ID NO: 1256351 - RNA, 21 nt, Homo sapiens
agucauuucguucccugauua

SEQ ID NO: 1256352 - RNA, 16 nt, Homo sapiens
aguccaaaugugauca

SEQ ID NO: 1256353 - RNA, 14 nt, Homo sapiens
aguccaacugucaa

SEQ ID NO: 1256354 - RNA, 21 nt, Homo sapiens
aguccaagaggguccuuuagu

SEQ ID NO: 1256355 - RNA, 14 nt, Homo sapiens
aguccaauuccuug

SEQ ID NO: 1256356 - RNA, 16 nt, Homo sapiens
aguccacggaccccca

SEQ ID NO: 1256357 - RNA, 12 nt, Homo sapiens
aguccacugcug

SEQ ID NO: 1256358 - RNA, 13 nt, Homo sapiens
aguccacugcuga

SEQ ID NO: 1256359 - RNA, 18 nt, Homo sapiens
aguccacugcugaggaca

SEQ ID NO: 1256360 - RNA, 22 nt, Homo sapiens
aguccagacacuuaacucaauu

SEQ ID NO: 1256361 - RNA, 16 nt, Homo sapiens
aguccagauauuucac

SEQ ID NO: 1256362 - RNA, 17 nt, Homo sapiens
aguccagauauuucaca

SEQ ID NO: 1256363 - RNA, 16 nt, Homo sapiens
aguccagcacuggaag

SEQ ID NO: 1256364 - RNA, 19 nt, Homo sapiens
agucccaaugguccugacu

SEQ ID NO: 1256365 - RNA, 15 nt, Homo sapiens
agucccagcuacuug

SEQ ID NO: 1256366 - RNA, 19 nt, Homo sapiens
agucccccuauccuuggca

SEQ ID NO: 1256367 - RNA, 22 nt, Homo sapiens
agucccgggucucaacuuuaag

SEQ ID NO: 1256368 - RNA, 13 nt, Homo sapiens
agucccugacucu

SEQ ID NO: 1256369 - RNA, 16 nt, Homo sapiens
agucccugggccuagc

SEQ ID NO: 1256370 - RNA, 18 nt, Homo sapiens
aguccguuccgaaggcau

SEQ ID NO: 1256371 - RNA, 14 nt, Homo sapiens
aguccucccuggug

SEQ ID NO: 1256372 - RNA, 19 nt, Homo sapiens
aguccucgcggcucuccag

SEQ ID NO: 1256373 - RNA, 19 nt, Homo sapiens
aguccucguagccaucucu

SEQ ID NO: 1256374 - RNA, 12 nt, Homo sapiens
aguccucuagca

SEQ ID NO: 1256375 - RNA, 20 nt, Homo sapiens
aguccucuuugucauaccuu

SEQ ID NO: 1256376 - RNA, 18 nt, Homo sapiens
aguccugcuccagaauuu

SEQ ID NO: 1256377 - RNA, 17 nt, Homo sapiens
aguccuguacucugggg

SEQ ID NO: 1256378 - RNA, 21 nt, Homo sapiens
aguccuuaaaaaucacacugu

SEQ ID NO: 1256379 - RNA, 23 nt, Homo sapiens
aguccuugauuucaaaguuuugu

SEQ ID NO: 1256380 - RNA, 12 nt, Homo sapiens
aguccuugcaaa

SEQ ID NO: 1256381 - RNA, 15 nt, Homo sapiens
agucuaaacagaguc

SEQ ID NO: 1256382 - RNA, 21 nt, Homo sapiens
agucuaaagauggaguuucua

SEQ ID NO: 1256383 - RNA, 13 nt, Homo sapiens
agucucaccagcc

SEQ ID NO: 1256384 - RNA, 15 nt, Homo sapiens
agucucugaaugaag

SEQ ID NO: 1256385 - RNA, 20 nt, Homo sapiens
agucucugaaugaagcugaa

SEQ ID NO: 1256386 - RNA, 17 nt, Homo sapiens
agucucuucuaagcaaa

SEQ ID NO: 1256387 - RNA, 20 nt, Homo sapiens
agucugaauagucuucagag

SEQ ID NO: 1256388 - RNA, 23 nt, Homo sapiens
agucugaaugcugccacaaccag

SEQ ID NO: 1256389 - RNA, 22 nt, Homo sapiens
agucugagacuccucauaccuc

SEQ ID NO: 1256390 - RNA, 17 nt, Homo sapiens
agucugauucccaagcu

SEQ ID NO: 1256391 - RNA, 24 nt, Homo sapiens
agucuggcagacuuucuucucuau

SEQ ID NO: 1256392 - RNA, 15 nt, Homo sapiens
agucuggugcuccag

SEQ ID NO: 1256393 - RNA, 13 nt, Homo sapiens
agucuguaccuca

SEQ ID NO: 1256394 - RNA, 15 nt, Homo sapiens
agucuguaccucaaa

SEQ ID NO: 1256395 - RNA, 14 nt, Homo sapiens
agucugucuacugu

SEQ ID NO: 1256396 - RNA, 22 nt, Homo sapiens
agucuuccaguuuaaugaacua

SEQ ID NO: 1256397 - RNA, 23 nt, Homo sapiens
agucuuccaguuuaaugaacuac

SEQ ID NO: 1256398 - RNA, 20 nt, Homo sapiens
agucuucucauagcauuaac

SEQ ID NO: 1256399 - RNA, 19 nt, Homo sapiens
agucuugucauugccagcu

SEQ ID NO: 1256400 - RNA, 18 nt, Homo sapiens
agucuuguuuuuuauuca

SEQ ID NO: 1256401 - RNA, 16 nt, Homo sapiens
agucuuuccugauaua

SEQ ID NO: 1256402 - RNA, 13 nt, Homo sapiens
agucuuugccagu

SEQ ID NO: 1256403 - RNA, 19 nt, Homo sapiens
agugaaacauugaacucau

SEQ ID NO: 1256404 - RNA, 15 nt, Homo sapiens
agugaaaccaugacu

SEQ ID NO: 1256405 - RNA, 18 nt, Homo sapiens
agugaaaccccaucucua

SEQ ID NO: 1256406 - RNA, 22 nt, Homo sapiens
agugaaacuauauguauucaca

SEQ ID NO: 1256407 - RNA, 16 nt, Homo sapiens
agugaaacuccaucuc

SEQ ID NO: 1256408 - RNA, 19 nt, Homo sapiens
agugaaagaagccacagcu

SEQ ID NO: 1256409 - RNA, 23 nt, Homo sapiens
agugaaagaagccacagcucuuc

SEQ ID NO: 1256410 - RNA, 18 nt, Homo sapiens
agugaaauuauacagaua

SEQ ID NO: 1256411 - RNA, 23 nt, Homo sapiens
agugaacauauggaaaguauuag

SEQ ID NO: 1256412 - RNA, 15 nt, Homo sapiens
agugaagaacacuac

SEQ ID NO: 1256413 - RNA, 19 nt, Homo sapiens
agugaaugaaacacucagu

SEQ ID NO: 1256414 - RNA, 16 nt, Homo sapiens
agugacaaaccaucca

SEQ ID NO: 1256415 - RNA, 18 nt, Homo sapiens
agugacaacaucgcaaua

SEQ ID NO: 1256416 - RNA, 14 nt, Homo sapiens
agugacaaggcccu

SEQ ID NO: 1256417 - RNA, 17 nt, Homo sapiens
agugacaaggcccugag

SEQ ID NO: 1256418 - RNA, 18 nt, Homo sapiens
agugacaguggucccaga

SEQ ID NO: 1256419 - RNA, 13 nt, Homo sapiens
agugaccaaaggu

SEQ ID NO: 1256420 - RNA, 22 nt, Homo sapiens
agugaccccugaccucacugug

SEQ ID NO: 1256421 - RNA, 18 nt, Homo sapiens
agugagaaaaugccucaa

SEQ ID NO: 1256422 - RNA, 14 nt, Homo sapiens
agugagacuguguu

SEQ ID NO: 1256423 - RNA, 15 nt, Homo sapiens
agugagcaaccagcu

SEQ ID NO: 1256424 - RNA, 19 nt, Homo sapiens
agugagcaagggggcccaa

SEQ ID NO: 1256425 - RNA, 22 nt, Homo sapiens
agugagcacucacgcccuaagc

SEQ ID NO: 1256426 - RNA, 22 nt, Homo sapiens
agugagccugaauuuuguugcu

SEQ ID NO: 1256427 - RNA, 19 nt, Homo sapiens
agugagcuguguucuugcc

SEQ ID NO: 1256428 - RNA, 22 nt, Homo sapiens
agugagggucuucuuacaugca

SEQ ID NO: 1256429 - RNA, 13 nt, Homo sapiens
agugagucucuuc

SEQ ID NO: 1256430 - RNA, 19 nt, Homo sapiens
agugauaaaauguuuguua

SEQ ID NO: 1256431 - RNA, 15 nt, Homo sapiens
agugauaggcccaag

SEQ ID NO: 1256432 - RNA, 22 nt, Homo sapiens
agugauccuccugccucagucu

SEQ ID NO: 1256433 - RNA, 19 nt, Homo sapiens
agugaucugcccaccucag

SEQ ID NO: 1256434 - RNA, 12 nt, Homo sapiens
agugaugucagg

SEQ ID NO: 1256435 - RNA, 20 nt, Homo sapiens
agugcaaugcacgaucucag

SEQ ID NO: 1256436 - RNA, 14 nt, Homo sapiens
agugcacagcuguc

SEQ ID NO: 1256437 - RNA, 16 nt, Homo sapiens
agugcaccuacugcuu

SEQ ID NO: 1256438 - RNA, 21 nt, Homo sapiens
agugcaggcuuggggagcuuu

SEQ ID NO: 1256439 - RNA, 19 nt, Homo sapiens
agugcaguggcgugaucuc

SEQ ID NO: 1256440 - RNA, 20 nt, Homo sapiens
agugcaguggcgugaucucg

SEQ ID NO: 1256441 - RNA, 16 nt, Homo sapiens
agugcaguggugcaau

SEQ ID NO: 1256442 - RNA, 14 nt, Homo sapiens
agugcaucucagcc

SEQ ID NO: 1256443 - RNA, 13 nt, Homo sapiens
agugcauuugccu

SEQ ID NO: 1256444 - RNA, 16 nt, Homo sapiens
agugcauuugugcuag

SEQ ID NO: 1256445 - RNA, 17 nt, Homo sapiens
agugccaaggaccuccu

SEQ ID NO: 1256446 - RNA, 14 nt, Homo sapiens
agugccagcaauga

SEQ ID NO: 1256447 - RNA, 12 nt, Homo sapiens
agugccauucca

SEQ ID NO: 1256448 - RNA, 19 nt, Homo sapiens
agugccauugucuuuauau

SEQ ID NO: 1256449 - RNA, 23 nt, Homo sapiens
agugcccaaggaauuucugcucu

SEQ ID NO: 1256450 - RNA, 19 nt, Homo sapiens
agugccgacagcucuccaa

SEQ ID NO: 1256451 - RNA, 16 nt, Homo sapiens
agugccguaacaacug

SEQ ID NO: 1256452 - RNA, 14 nt, Homo sapiens
agugccuaccccag

SEQ ID NO: 1256453 - RNA, 16 nt, Homo sapiens
agugccuagacuguua

SEQ ID NO: 1256454 - RNA, 21 nt, Homo sapiens
agugccugauacugccugaca

SEQ ID NO: 1256455 - RNA, 20 nt, Homo sapiens
agugccuucugcccucccug

SEQ ID NO: 1256456 - RNA, 14 nt, Homo sapiens
agugccuuuaguuu

SEQ ID NO: 1256457 - RNA, 15 nt, Homo sapiens
agugcgucugagggg

SEQ ID NO: 1256458 - RNA, 15 nt, Homo sapiens
agugcguguguagag

SEQ ID NO: 1256459 - RNA, 15 nt, Homo sapiens
agugcugaugccugu

SEQ ID NO: 1256460 - RNA, 11 nt, Homo sapiens
agugcugccau

SEQ ID NO: 1256461 - RNA, 20 nt, Homo sapiens
agugcugcuauaucuaucca

SEQ ID NO: 1256462 - RNA, 14 nt, Homo sapiens
agugcuggcucaca

SEQ ID NO: 1256463 - RNA, 17 nt, Homo sapiens
agugcugggauuacaau

SEQ ID NO: 1256464 - RNA, 18 nt, Homo sapiens
agugcuguccaugcuucu

SEQ ID NO: 1256465 - RNA, 13 nt, Homo sapiens
agugcuugauaug

SEQ ID NO: 1256466 - RNA, 15 nt, Homo sapiens
agugcuuggcugcug

SEQ ID NO: 1256467 - RNA, 16 nt, Homo sapiens
agugcuuggguggugg

SEQ ID NO: 1256468 - RNA, 14 nt, Homo sapiens
aguggaaaacaaag

SEQ ID NO: 1256469 - RNA, 16 nt, Homo sapiens
auuguuaugcacagaa

SEQ ID NO: 1256470 - RNA, 18 nt, Homo sapiens
auuguucaaagcacagaa

SEQ ID NO: 1256471 - RNA, 17 nt, Homo sapiens
auuguugaaauuuugca

SEQ ID NO: 1256472 - RNA, 21 nt, Homo sapiens
auuguugaugggcacuugaga

SEQ ID NO: 1256473 - RNA, 19 nt, Homo sapiens
auuguugauuuuguucaca

SEQ ID NO: 1256474 - RNA, 20 nt, Homo sapiens
auuguuuuguguaacauauu

SEQ ID NO: 1256475 - RNA, 22 nt, Homo sapiens
auuguuuuuuacucgucuuccu

SEQ ID NO: 1256476 - RNA, 18 nt, Homo sapiens
auuuaaaaaaagaacaua

SEQ ID NO: 1256477 - RNA, 21 nt, Homo sapiens
auuuaaaaaacuaacacccag

SEQ ID NO: 1256478 - RNA, 22 nt, Homo sapiens
auuuaaaauuacguuuguuauu

SEQ ID NO: 1256479 - RNA, 15 nt, Homo sapiens
auuuaaaauucaauu

SEQ ID NO: 1256480 - RNA, 21 nt, Homo sapiens
auuuaaagaaaauaaacacca

SEQ ID NO: 1256481 - RNA, 13 nt, Homo sapiens
auuuaaagcacau

SEQ ID NO: 1256482 - RNA, 19 nt, Homo sapiens
auuuaaagcuuacucuguc

SEQ ID NO: 1256483 - RNA, 23 nt, Homo sapiens
auuuaaauuacaauuuuaucugu

SEQ ID NO: 1256484 - RNA, 20 nt, Homo sapiens
auuuaaauuuuuuuccuuac

SEQ ID NO: 1256485 - RNA, 17 nt, Homo sapiens
auuuaacagucauuuaa

SEQ ID NO: 1256486 - RNA, 20 nt, Homo sapiens
auuuaacaugaacacccuua

SEQ ID NO: 1256487 - RNA, 21 nt, Homo sapiens
auuuaaccccuugguacugaa

SEQ ID NO: 1256488 - RNA, 13 nt, Homo sapiens
auuuaaugcauua

SEQ ID NO: 1256489 - RNA, 15 nt, Homo sapiens
auuuaauuuccaggg

SEQ ID NO: 1256490 - RNA, 16 nt, Homo sapiens
auuuaauuuccagggu

SEQ ID NO: 1256491 - RNA, 19 nt, Homo sapiens
auuuaauuuuuuacuuuca

SEQ ID NO: 1256492 - RNA, 20 nt, Homo sapiens
auuuacagaaacgcauccag

SEQ ID NO: 1256493 - RNA, 15 nt, Homo sapiens
auuuacagaaaucaa

SEQ ID NO: 1256494 - RNA, 20 nt, Homo sapiens
auuuacagccucacuugaau

SEQ ID NO: 1256495 - RNA, 17 nt, Homo sapiens
auuuacaggaacuucau

SEQ ID NO: 1256496 - RNA, 19 nt, Homo sapiens
auuuacagucuaguacuua

SEQ ID NO: 1256497 - RNA, 14 nt, Homo sapiens
auuuacaguuucca

SEQ ID NO: 1256498 - RNA, 20 nt, Homo sapiens
auuuacauacucugcuuaga

SEQ ID NO: 1256499 - RNA, 21 nt, Homo sapiens
auuuacaugaauugcauuuua

SEQ ID NO: 1256500 - RNA, 19 nt, Homo sapiens
auuuacaugugauugugau

SEQ ID NO: 1256501 - RNA, 22 nt, Homo sapiens
auuuacuaaaucaaucugcagu

SEQ ID NO: 1256502 - RNA, 22 nt, Homo sapiens
auuuacuauauauauaugccuu

SEQ ID NO: 1256503 - RNA, 21 nt, Homo sapiens
auuuacugaaguuauuuauua

SEQ ID NO: 1256504 - RNA, 19 nt, Homo sapiens
auuuagaaaaaaguuuaca

SEQ ID NO: 1256505 - RNA, 22 nt, Homo sapiens
auuuagaaaauagagcuuuuaa

SEQ ID NO: 1256506 - RNA, 18 nt, Homo sapiens
auuuagaacuguauguca

SEQ ID NO: 1256507 - RNA, 12 nt, Homo sapiens
auuuagaacuug

SEQ ID NO: 1256508 - RNA, 19 nt, Homo sapiens
auuuagaagccaacuauga

SEQ ID NO: 1256509 - RNA, 23 nt, Homo sapiens
auuuagaagccaacuaugauuau

SEQ ID NO: 1256510 - RNA, 21 nt, Homo sapiens
auuuagaccccccaccugugu

SEQ ID NO: 1256511 - RNA, 15 nt, Homo sapiens
auuuagaucucauaa

SEQ ID NO: 1256512 - RNA, 23 nt, Homo sapiens
auuuagcaucuuccuugauaaua

SEQ ID NO: 1256513 - RNA, 21 nt, Homo sapiens
auuuagcuaaacggauuccaa

SEQ ID NO: 1256514 - RNA, 23 nt, Homo sapiens
auuuaggauaaccuugugccuug

SEQ ID NO: 1256515 - RNA, 15 nt, Homo sapiens
auuuagucaugugac

SEQ ID NO: 1256516 - RNA, 14 nt, Homo sapiens
auuuagugacuuaa

SEQ ID NO: 1256517 - RNA, 17 nt, Homo sapiens
auuuauaaaacuucuca

SEQ ID NO: 1256518 - RNA, 16 nt, Homo sapiens
auuuauaaaugagcaa

SEQ ID NO: 1256519 - RNA, 13 nt, Homo sapiens
auuuauaauugca

SEQ ID NO: 1256520 - RNA, 16 nt, Homo sapiens
auuuauaucaguuuca

SEQ ID NO: 1256521 - RNA, 12 nt, Homo sapiens
auuuauauucau

SEQ ID NO: 1256522 - RNA, 23 nt, Homo sapiens
auuuaucagaaauuauacuauau

SEQ ID NO: 1256523 - RNA, 22 nt, Homo sapiens
uuucucuucucagcucuuccau

SEQ ID NO: 1256524 - RNA, 23 nt, Homo sapiens
uuucucuuuacuugaaauuuggc

SEQ ID NO: 1256525 - RNA, 19 nt, Homo sapiens
uuucugaacuguuacaacu

SEQ ID NO: 1256526 - RNA, 19 nt, Homo sapiens
uuucugagagagugccaug

SEQ ID NO: 1256527 - RNA, 15 nt, Homo sapiens
uuucuggaauggaaa

SEQ ID NO: 1256528 - RNA, 22 nt, Homo sapiens
uuucuggacuggcguucaccuc

SEQ ID NO: 1256529 - RNA, 18 nt, Homo sapiens
uuucuggaggucucugaa

SEQ ID NO: 1256530 - RNA, 15 nt, Homo sapiens
uuucuggccugccuu

SEQ ID NO: 1256531 - RNA, 14 nt, Homo sapiens
uuucuggugccauu

SEQ ID NO: 1256532 - RNA, 15 nt, Homo sapiens
uuucuggugccauuu

SEQ ID NO: 1256533 - RNA, 21 nt, Homo sapiens
uuucugucagaugagaacaaa

SEQ ID NO: 1256534 - RNA, 20 nt, Homo sapiens
uuucugugauaacucugcaa

SEQ ID NO: 1256535 - RNA, 22 nt, Homo sapiens
uuucuguuagcuggguuuacau

SEQ ID NO: 1256536 - RNA, 12 nt, Homo sapiens
uuucuguucuca

SEQ ID NO: 1256537 - RNA, 14 nt, Homo sapiens
uuucuuacauuagc

SEQ ID NO: 1256538 - RNA, 22 nt, Homo sapiens
uuucuucagagagcuaaauuac

SEQ ID NO: 1256539 - RNA, 16 nt, Homo sapiens
uuucuucaugcaauga

SEQ ID NO: 1256540 - RNA, 21 nt, Homo sapiens
uuucuuccaaagcacauugaa

SEQ ID NO: 1256541 - RNA, 23 nt, Homo sapiens
uuucuucuacugcuaucuacuac

SEQ ID NO: 1256542 - RNA, 20 nt, Homo sapiens
uuucuugggguacucuugau

SEQ ID NO: 1256543 - RNA, 21 nt, Homo sapiens
uuucuuguuugauuuuugaca

SEQ ID NO: 1256544 - RNA, 18 nt, Homo sapiens
uuucuuuaagucaguuca

SEQ ID NO: 1256545 - RNA, 18 nt, Homo sapiens
uuucuuuagcaugcuaca

SEQ ID NO: 1256546 - RNA, 13 nt, Homo sapiens
uuucuuuccucag

SEQ ID NO: 1256547 - RNA, 15 nt, Homo sapiens
uuucuuuuaagcuau

SEQ ID NO: 1256548 - RNA, 16 nt, Homo sapiens
uuucuuuuuacagcau

SEQ ID NO: 1256549 - RNA, 19 nt, Homo sapiens
uuugaaaccaggacauuaa

SEQ ID NO: 1256550 - RNA, 17 nt, Homo sapiens
uuugaaacugaauguuu

SEQ ID NO: 1256551 - RNA, 13 nt, Homo sapiens
uuugaaagaugca

SEQ ID NO: 1256552 - RNA, 15 nt, Homo sapiens
uuugaaauaccucau

SEQ ID NO: 1256553 - RNA, 16 nt, Homo sapiens
uuugaaauccaaagaa

SEQ ID NO: 1256554 - RNA, 20 nt, Homo sapiens
uuugaagcagucuugcucug

SEQ ID NO: 1256555 - RNA, 15 nt, Homo sapiens
uuugaagcgagcagu

SEQ ID NO: 1256556 - RNA, 18 nt, Homo sapiens
uuugaaucuuucuguguc

SEQ ID NO: 1256557 - RNA, 22 nt, Homo sapiens
uuugaaugucacaaauugauca

SEQ ID NO: 1256558 - RNA, 18 nt, Homo sapiens
uuugaauucauacuagaa

SEQ ID NO: 1256559 - RNA, 19 nt, Homo sapiens
uuugaccucauuuguaaaa

SEQ ID NO: 1256560 - RNA, 22 nt, Homo sapiens
uuugacgacagugcauuugccu

SEQ ID NO: 1256561 - RNA, 20 nt, Homo sapiens
uuugacugugcuagcuaaaa

SEQ ID NO: 1256562 - RNA, 20 nt, Homo sapiens
uuugacuguucaaugauuau

SEQ ID NO: 1256563 - RNA, 23 nt, Homo sapiens
uuugacuuugguuguguuuaaau

SEQ ID NO: 1256564 - RNA, 18 nt, Homo sapiens
uuugagacaaagucucac

SEQ ID NO: 1256565 - RNA, 23 nt, Homo sapiens
uuugagcccacaaagccuuauca

SEQ ID NO: 1256566 - RNA, 19 nt, Homo sapiens
uuugaggccuuuuuugcca

SEQ ID NO: 1256567 - RNA, 22 nt, Homo sapiens
uuugagucccccagagauguca

SEQ ID NO: 1256568 - RNA, 14 nt, Homo sapiens
uuugauagaaccau

SEQ ID NO: 1256569 - RNA, 20 nt, Homo sapiens
uuugauaguugguguucaaa

SEQ ID NO: 1256570 - RNA, 18 nt, Homo sapiens
uuugauaugaaguguuag

SEQ ID NO: 1256571 - RNA, 13 nt, Homo sapiens
uuugaugaacugu

SEQ ID NO: 1256572 - RNA, 21 nt, Homo sapiens
uuugaugagauauuaaauucu

SEQ ID NO: 1256573 - RNA, 20 nt, Homo sapiens
uuugaugauuaauucaccuu

SEQ ID NO: 1256574 - RNA, 14 nt, Homo sapiens
uuugauggugccag

SEQ ID NO: 1256575 - RNA, 20 nt, Homo sapiens
uuugauucagcaaaaaucuc

SEQ ID NO: 1256576 - RNA, 23 nt, Homo sapiens
uuugauugaggagcugcacugau

SEQ ID NO: 1256577 - RNA, 17 nt, Homo sapiens
uuugcaaaauaaguaaa

SEQ ID NO: 1256578 - RNA, 21 nt, Homo sapiens
uuugcaaaauuuccaguaccu

SEQ ID NO: 1256579 - RNA, 23 nt, Homo sapiens
uuugcaacucacugauucucuac

SEQ ID NO: 1256580 - RNA, 13 nt, Homo sapiens
uuugcaacuuaau

SEQ ID NO: 1256581 - RNA, 13 nt, Homo sapiens
uuugcacaggaug

SEQ ID NO: 1256582 - RNA, 21 nt, Homo sapiens
uuugcaggagaaaaguaucaa

SEQ ID NO: 1256583 - RNA, 15 nt, Homo sapiens
uuugcaguucaccug

SEQ ID NO: 1256584 - RNA, 23 nt, Homo sapiens
uuugcauuugcucuuucaucucu

SEQ ID NO: 1256585 - RNA, 17 nt, Homo sapiens
uuugccaaaauucauuu

SEQ ID NO: 1256586 - RNA, 14 nt, Homo sapiens
uuugccauguugcc

SEQ ID NO: 1256587 - RNA, 14 nt, Homo sapiens
uuugccuucuccac

SEQ ID NO: 1256588 - RNA, 12 nt, Homo sapiens
uuugcuacaaau

SEQ ID NO: 1256589 - RNA, 20 nt, Homo sapiens
uuugcuccgcucccaccgcc

SEQ ID NO: 1256590 - RNA, 12 nt, Homo sapiens
uuugcucuugcc

SEQ ID NO: 1256591 - RNA, 15 nt, Homo sapiens
uuugcucuugccaaa

SEQ ID NO: 1256592 - RNA, 23 nt, Homo sapiens
uuugcugacuuuaaaaggauuaa

SEQ ID NO: 1256593 - RNA, 17 nt, Homo sapiens
uuugcugcagucaucua

SEQ ID NO: 1256594 - RNA, 12 nt, Homo sapiens
uuuggaagacca

SEQ ID NO: 1256595 - RNA, 16 nt, Homo sapiens
uuuggaagucaugagc

SEQ ID NO: 1256596 - RNA, 22 nt, Homo sapiens
uuuggaaucuucucuuugacaa

SEQ ID NO: 1256597 - RNA, 16 nt, Homo sapiens
uuuggacccaguucag

SEQ ID NO: 1256598 - RNA, 20 nt, Homo sapiens
uuuggacuauguaaaccaca

SEQ ID NO: 1256599 - RNA, 22 nt, Homo sapiens
uuuggacucagcccaccugcac

SEQ ID NO: 1256600 - RNA, 20 nt, Homo sapiens
uuuggagcacaaaauucaaa

SEQ ID NO: 1256601 - RNA, 22 nt, Homo sapiens
uuuggagccucccuucugccuu

SEQ ID NO: 1256602 - RNA, 21 nt, Homo sapiens
uuuggauaaguugugauuuga

SEQ ID NO: 1256603 - RNA, 22 nt, Homo sapiens
uuuggauucuaaauacaugcca

SEQ ID NO: 1256604 - RNA, 21 nt, Homo sapiens
uuuggcacuugccauuccaaa

SEQ ID NO: 1256605 - RNA, 13 nt, Homo sapiens
uuuggccucaaaa

SEQ ID NO: 1256606 - RNA, 19 nt, Homo sapiens
uuuggcuagguaucauuca

SEQ ID NO: 1256607 - RNA, 12 nt, Homo sapiens
uuuggggagcag

SEQ ID NO: 1256608 - RNA, 23 nt, Homo sapiens
uuugggggguguuuuguggggcu

SEQ ID NO: 1256609 - RNA, 18 nt, Homo sapiens
uuuggucgaggaguaaca

SEQ ID NO: 1256610 - RNA, 18 nt, Homo sapiens
uuugguuccacaaucucu

SEQ ID NO: 1256611 - RNA, 23 nt, Homo sapiens
uuugguuguguaagagaauguug

SEQ ID NO: 1256612 - RNA, 18 nt, Homo sapiens
uuugguuuaccuggggau

SEQ ID NO: 1256613 - RNA, 18 nt, Homo sapiens
uuuguaaaucugccacaa

SEQ ID NO: 1256614 - RNA, 16 nt, Homo sapiens
uuuguaauauggaaug

SEQ ID NO: 1256615 - RNA, 13 nt, Homo sapiens
uuuguaaugcugc

SEQ ID NO: 1256616 - RNA, 16 nt, Homo sapiens
uuuguaaugcugcaca

SEQ ID NO: 1256617 - RNA, 22 nt, Homo sapiens
uuuguaaugggaacugccucuu

SEQ ID NO: 1256618 - RNA, 14 nt, Homo sapiens
uuuguaauugcuua

SEQ ID NO: 1256619 - RNA, 16 nt, Homo sapiens
uuuguagccagguacu

SEQ ID NO: 1256620 - RNA, 22 nt, Homo sapiens
uuuguauacaaauauauuguua

SEQ ID NO: 1256621 - RNA, 23 nt, Homo sapiens
uuugucccagcgauggugccugc

SEQ ID NO: 1256622 - RNA, 17 nt, Homo sapiens
uuuguccccacuuacag

SEQ ID NO: 1256623 - RNA, 22 nt, Homo sapiens
uuugucccggggcuccacugaa

SEQ ID NO: 1256624 - RNA, 15 nt, Homo sapiens
uuugucucaccucau

SEQ ID NO: 1256625 - RNA, 13 nt, Homo sapiens
uuugucuugaaug

SEQ ID NO: 1256626 - RNA, 19 nt, Homo sapiens
uuugugaaguauucacaaa

SEQ ID NO: 1256627 - RNA, 10 nt, Homo sapiens
uuugugacau

SEQ ID NO: 1256628 - RNA, 14 nt, Homo sapiens
uuugugacauugua

SEQ ID NO: 1256629 - RNA, 19 nt, Homo sapiens
uuugugauagcacuuucua

SEQ ID NO: 1256630 - RNA, 23 nt, Homo sapiens
uuugugccagaggaauccuggca

SEQ ID NO: 1256631 - RNA, 14 nt, Homo sapiens
uuugugugcgucac

SEQ ID NO: 1256632 - RNA, 21 nt, Homo sapiens
uuuguguucuguuuguuaaaa

SEQ ID NO: 1256633 - RNA, 13 nt, Homo sapiens
uuuguucagagag

SEQ ID NO: 1256634 - RNA, 10 nt, Homo sapiens
uuuguucccu

SEQ ID NO: 1256635 - RNA, 14 nt, Homo sapiens
uuuguugagccagg

SEQ ID NO: 1256636 - RNA, 12 nt, Homo sapiens
uuuguuguaaaa

SEQ ID NO: 1256637 - RNA, 14 nt, Homo sapiens
uuuguuucaaucuc

SEQ ID NO: 1256638 - RNA, 13 nt, Homo sapiens
uuuguuucaauga

SEQ ID NO: 1256639 - RNA, 16 nt, Homo sapiens
uuuguuuccagcauga

SEQ ID NO: 1256640 - RNA, 17 nt, Homo sapiens
uuuguuugccaggacau

SEQ ID NO: 1256641 - RNA, 21 nt, Homo sapiens
uuuguuugccaggacaugcaa

SEQ ID NO: 1256642 - RNA, 17 nt, Homo sapiens
uugucuuguucugugau

SEQ ID NO: 1256643 - RNA, 20 nt, Homo sapiens
uguugcaaacucagugcaaa

SEQ ID NO: 1256644 - RNA, 18 nt, Homo sapiens
uguugcaaugcaugauac

SEQ ID NO: 1256645 - RNA, 14 nt, Homo sapiens
uguugcacacucac

SEQ ID NO: 1256646 - RNA, 17 nt, Homo sapiens
uguugcgcucccaccuc

SEQ ID NO: 1256647 - RNA, 19 nt, Homo sapiens
uguuggagguuaaggcaua

SEQ ID NO: 1256648 - RNA, 20 nt, Homo sapiens
uguugguauuauauaauuca

SEQ ID NO: 1256649 - RNA, 21 nt, Homo sapiens
uguuguaaccugcugugauac

SEQ ID NO: 1256650 - RNA, 17 nt, Homo sapiens
uguuguaagaaagacaa

SEQ ID NO: 1256651 - RNA, 18 nt, Homo sapiens
uguuguagguuucaggga

SEQ ID NO: 1256652 - RNA, 19 nt, Homo sapiens
uguuguagugaaauuauac

SEQ ID NO: 1256653 - RNA, 14 nt, Homo sapiens
uguuguauugauca

SEQ ID NO: 1256654 - RNA, 19 nt, Homo sapiens
uguuguggucugagccaaa

SEQ ID NO: 1256655 - RNA, 18 nt, Homo sapiens
uguuguugaggcugucac

SEQ ID NO: 1256656 - RNA, 14 nt, Homo sapiens
uguuuaacugugaa

SEQ ID NO: 1256657 - RNA, 15 nt, Homo sapiens
uguuuacagcacuac

SEQ ID NO: 1256658 - RNA, 19 nt, Homo sapiens
uguuuacagcacuacucug

SEQ ID NO: 1256659 - RNA, 13 nt, Homo sapiens
uguuuaccaugaa

SEQ ID NO: 1256660 - RNA, 16 nt, Homo sapiens
uguuuacccaguauuc

SEQ ID NO: 1256661 - RNA, 18 nt, Homo sapiens
uguuuaccucuucuaugc

SEQ ID NO: 1256662 - RNA, 15 nt, Homo sapiens
uguuuacucauugcc

SEQ ID NO: 1256663 - RNA, 21 nt, Homo sapiens
uguuuacuucucaccauuuga

SEQ ID NO: 1256664 - RNA, 22 nt, Homo sapiens
uguuuauacuccaguguacaua

SEQ ID NO: 1256665 - RNA, 17 nt, Homo sapiens
uguuuauauacuggguu

SEQ ID NO: 1256666 - RNA, 16 nt, Homo sapiens
uguuuauauaguuuag

SEQ ID NO: 1256667 - RNA, 14 nt, Homo sapiens
uguuuauuccugau

SEQ ID NO: 1256668 - RNA, 23 nt, Homo sapiens
uguuuauuucaggcauuggauau

SEQ ID NO: 1256669 - RNA, 22 nt, Homo sapiens
uguuucucugccgcuaccuccc

SEQ ID NO: 1256670 - RNA, 13 nt, Homo sapiens
uguuucuguuauu

SEQ ID NO: 1256671 - RNA, 21 nt, Homo sapiens
uguuucuuccccuuacucuca

SEQ ID NO: 1256672 - RNA, 18 nt, Homo sapiens
uguuugauuucaacauga

SEQ ID NO: 1256673 - RNA, 16 nt, Homo sapiens
uguuugcauguggcca

SEQ ID NO: 1256674 - RNA, 22 nt, Homo sapiens
uguuuggaagaccagaauguga

SEQ ID NO: 1256675 - RNA, 23 nt, Homo sapiens
uguuuggcuuauaaacacauuga

SEQ ID NO: 1256676 - RNA, 19 nt, Homo sapiens
uguuuguaguugacauaaa

SEQ ID NO: 1256677 - RNA, 17 nt, Homo sapiens
uguuuguauacauauau

SEQ ID NO: 1256678 - RNA, 17 nt, Homo sapiens
uguuuguuucuguagaa

SEQ ID NO: 1256679 - RNA, 21 nt, Homo sapiens
uguuuuaaacucuccuaguca

SEQ ID NO: 1256680 - RNA, 20 nt, Homo sapiens
uguuuuacccuauacaucca

SEQ ID NO: 1256681 - RNA, 13 nt, Homo sapiens
uguuuuauauguu

SEQ ID NO: 1256682 - RNA, 21 nt, Homo sapiens
uguuuucuaaaguuguucaca

SEQ ID NO: 1256683 - RNA, 21 nt, Homo sapiens
uguuuucugacuaauuaggca

SEQ ID NO: 1256684 - RNA, 21 nt, Homo sapiens
uguuuucuguucccuugccau

SEQ ID NO: 1256685 - RNA, 24 nt, Homo sapiens
uguuuugauucccgggcuuaccag

SEQ ID NO: 1256686 - RNA, 22 nt, Homo sapiens
uguuuugauuuguagcacugag

SEQ ID NO: 1256687 - RNA, 12 nt, Homo sapiens
uguuuuuacuaa

SEQ ID NO: 1256688 - RNA, 14 nt, Homo sapiens
uguuuuuuacucaa

SEQ ID NO: 1256689 - RNA, 15 nt, Homo sapiens
uguuuuuucuugcca

SEQ ID NO: 1256690 - RNA, 13 nt, Homo sapiens
uguuuuuuuccaa

SEQ ID NO: 1256691 - RNA, 14 nt, Homo sapiens
uuaaaaaaagaaca

SEQ ID NO: 1256692 - RNA, 18 nt, Homo sapiens
uuaaaaacacuacuuuug

SEQ ID NO: 1256693 - RNA, 13 nt, Homo sapiens
uuaaaaacuacca

SEQ ID NO: 1256694 - RNA, 18 nt, Homo sapiens
uuaaaaacuaccacaugu

SEQ ID NO: 1256695 - RNA, 16 nt, Homo sapiens
uuaaaaagcacagggg

SEQ ID NO: 1256696 - RNA, 20 nt, Homo sapiens
uuaaaaagcucacugcugau

SEQ ID NO: 1256697 - RNA, 15 nt, Homo sapiens
uuaaaaaggaaauuu

SEQ ID NO: 1256698 - RNA, 12 nt, Homo sapiens
uuaaaaaguaac

SEQ ID NO: 1256699 - RNA, 17 nt, Homo sapiens
uuaaaaagucuucacuc

SEQ ID NO: 1256700 - RNA, 19 nt, Homo sapiens
uuaaaaaugcaccacuuuu

SEQ ID NO: 1256701 - RNA, 21 nt, Homo sapiens
uuaaaaaugggaguacugaug

SEQ ID NO: 1256702 - RNA, 21 nt, Homo sapiens
uuaaaaauuguuaauuuuucc

SEQ ID NO: 1256703 - RNA, 18 nt, Homo sapiens
uuaaaacaauucugugac

SEQ ID NO: 1256704 - RNA, 19 nt, Homo sapiens
uuaaaacaauucugugaca

SEQ ID NO: 1256705 - RNA, 13 nt, Homo sapiens
uuaaaaccaaaga

SEQ ID NO: 1256706 - RNA, 21 nt, Homo sapiens
uuaaaacgauagcuauauuca

SEQ ID NO: 1256707 - RNA, 17 nt, Homo sapiens
uuaaaacuugaaguagg

SEQ ID NO: 1256708 - RNA, 19 nt, Homo sapiens
uuaaaaggaaagucaagaa

SEQ ID NO: 1256709 - RNA, 14 nt, Homo sapiens
uuaaaagucucaca

SEQ ID NO: 1256710 - RNA, 19 nt, Homo sapiens
uuaaaaguugugauuccag

SEQ ID NO: 1256711 - RNA, 16 nt, Homo sapiens
uuaaaauaaugaacac

SEQ ID NO: 1256712 - RNA, 14 nt, Homo sapiens
uuaaaauaccuaga

SEQ ID NO: 1256713 - RNA, 14 nt, Homo sapiens
uuaaaaucaguauu

SEQ ID NO: 1256714 - RNA, 16 nt, Homo sapiens
uuaaaaucugugaaga

SEQ ID NO: 1256715 - RNA, 15 nt, Homo sapiens
uuaaaauuuuguaug

SEQ ID NO: 1256716 - RNA, 21 nt, Homo sapiens
uuaaacaaaauagaagcugua

SEQ ID NO: 1256717 - RNA, 14 nt, Homo sapiens
uuaaacacaaagug

SEQ ID NO: 1256718 - RNA, 14 nt, Homo sapiens
uuaaacccacagcc

SEQ ID NO: 1256719 - RNA, 18 nt, Homo sapiens
uuaaaccuuaagauacua

SEQ ID NO: 1256720 - RNA, 13 nt, Homo sapiens
uuaaacucaggga

SEQ ID NO: 1256721 - RNA, 16 nt, Homo sapiens
uuaaacucagggacag

SEQ ID NO: 1256722 - RNA, 18 nt, Homo sapiens
uuaaacuguuagcacugu

SEQ ID NO: 1256723 - RNA, 13 nt, Homo sapiens
uuaaagaaagugu

SEQ ID NO: 1256724 - RNA, 14 nt, Homo sapiens
uuaaagaaccaaaa

SEQ ID NO: 1256725 - RNA, 17 nt, Homo sapiens
uuaaagaaggguugagc

SEQ ID NO: 1256726 - RNA, 12 nt, Homo sapiens
uuaaagacacuu

SEQ ID NO: 1256727 - RNA, 11 nt, Homo sapiens
uuaaagaccaa

SEQ ID NO: 1256728 - RNA, 18 nt, Homo sapiens
uuaaagcagacagucaca

SEQ ID NO: 1256729 - RNA, 14 nt, Homo sapiens
uuaaagccuccuca

SEQ ID NO: 1256730 - RNA, 22 nt, Homo sapiens
uuaaaggaaaaucacaucucca

SEQ ID NO: 1256731 - RNA, 19 nt, Homo sapiens
uuaaaggguguacuuauau

SEQ ID NO: 1256732 - RNA, 18 nt, Homo sapiens
uuaaaguacuuucuuaua

SEQ ID NO: 1256733 - RNA, 21 nt, Homo sapiens
uuaaagucagguccaauuugu

SEQ ID NO: 1256734 - RNA, 16 nt, Homo sapiens
uuaaauaaaagcacaa

SEQ ID NO: 1256735 - RNA, 23 nt, Homo sapiens
uucucccuguacaguguuaccau

SEQ ID NO: 1256736 - RNA, 16 nt, Homo sapiens
uucuccuacaaaggga

SEQ ID NO: 1256737 - RNA, 15 nt, Homo sapiens
uucuccucacuguau

SEQ ID NO: 1256738 - RNA, 12 nt, Homo sapiens
uucuccugaaac

SEQ ID NO: 1256739 - RNA, 13 nt, Homo sapiens
uucuccugccuca

SEQ ID NO: 1256740 - RNA, 19 nt, Homo sapiens
uucuccuguuuauucccau

SEQ ID NO: 1256741 - RNA, 16 nt, Homo sapiens
uucucuauacucaggu

SEQ ID NO: 1256742 - RNA, 13 nt, Homo sapiens
uucucucuguaau

SEQ ID NO: 1256743 - RNA, 18 nt, Homo sapiens
uucucucuuauuccacuu

SEQ ID NO: 1256744 - RNA, 13 nt, Homo sapiens
uucucugcaaugc

SEQ ID NO: 1256745 - RNA, 18 nt, Homo sapiens
uucucugccccguuucuu

SEQ ID NO: 1256746 - RNA, 22 nt, Homo sapiens
uucucugcuccagguucacuuu

SEQ ID NO: 1256747 - RNA, 15 nt, Homo sapiens
uucucugugaccuga

SEQ ID NO: 1256748 - RNA, 14 nt, Homo sapiens
uugcuucucuagcu

SEQ ID NO: 1256749 - RNA, 12 nt, Homo sapiens
uugcuugaauuu

SEQ ID NO: 1256750 - RNA, 14 nt, Homo sapiens
uugcuugagcccag

SEQ ID NO: 1256751 - RNA, 21 nt, Homo sapiens
uugcuugccgagccuaaugaa

SEQ ID NO: 1256752 - RNA, 19 nt, Homo sapiens
uugcuuggaagccagguac

SEQ ID NO: 1256753 - RNA, 18 nt, Homo sapiens
uugcuugugccacacccu

SEQ ID NO: 1256754 - RNA, 22 nt, Homo sapiens
uugcuuuagcacaggacaacuu

SEQ ID NO: 1256755 - RNA, 12 nt, Homo sapiens
uugcuuuccacu

SEQ ID NO: 1256756 - RNA, 13 nt, Homo sapiens
uugcuuugccaaa

SEQ ID NO: 1256757 - RNA, 19 nt, Homo sapiens
uuggaaaaagccugugaaa

SEQ ID NO: 1256758 - RNA, 21 nt, Homo sapiens
uuggaaaaauguuugucucag

SEQ ID NO: 1256759 - RNA, 14 nt, Homo sapiens
uuggaacagaaugu

SEQ ID NO: 1256760 - RNA, 21 nt, Homo sapiens
uuggaagaggaacagcacugg

SEQ ID NO: 1256761 - RNA, 18 nt, Homo sapiens
uuggaaguacaugaauac

SEQ ID NO: 1256762 - RNA, 16 nt, Homo sapiens
uuggaauaaaacuguc

SEQ ID NO: 1256763 - RNA, 15 nt, Homo sapiens
uuggaaucaaaagag

SEQ ID NO: 1256764 - RNA, 19 nt, Homo sapiens
uuggaauggaacuacugua

SEQ ID NO: 1256765 - RNA, 13 nt, Homo sapiens
uuggaauggcaau

SEQ ID NO: 1256766 - RNA, 22 nt, Homo sapiens
uuggacaaaccgagugcaauga

SEQ ID NO: 1256767 - RNA, 23 nt, Homo sapiens
uuggacaaucaugaaauaugcau

SEQ ID NO: 1256768 - RNA, 21 nt, Homo sapiens
uuggacugauaaucucuuuaa

SEQ ID NO: 1256769 - RNA, 18 nt, Homo sapiens
uuggacuguaagggauug

SEQ ID NO: 1256770 - RNA, 16 nt, Homo sapiens
uuggacuucucugaaa

SEQ ID NO: 1256771 - RNA, 15 nt, Homo sapiens
uuggagaaaaugggu

SEQ ID NO: 1256772 - RNA, 17 nt, Homo sapiens
uuggagagaagggcauu

SEQ ID NO: 1256773 - RNA, 18 nt, Homo sapiens
uuggagcucuauccauau

SEQ ID NO: 1256774 - RNA, 19 nt, Homo sapiens
uuggaggcagggcugggaa

SEQ ID NO: 1256775 - RNA, 14 nt, Homo sapiens
uuggagucacugua

SEQ ID NO: 1256776 - RNA, 18 nt, Homo sapiens
uuggaguuagguccucac

SEQ ID NO: 1256777 - RNA, 21 nt, Homo sapiens
uuggauaaaauaaaugcaauu

SEQ ID NO: 1256778 - RNA, 21 nt, Homo sapiens
uuggauaaguugugauuugac

SEQ ID NO: 1256779 - RNA, 18 nt, Homo sapiens
uuggauauauuauuguaa

SEQ ID NO: 1256780 - RNA, 14 nt, Homo sapiens
uuggaucaggacag

SEQ ID NO: 1256781 - RNA, 17 nt, Homo sapiens
uuggauguaaaacugaa

SEQ ID NO: 1256782 - RNA, 18 nt, Homo sapiens
uuggauuauucauuuaaa

SEQ ID NO: 1256783 - RNA, 18 nt, Homo sapiens
uuggauucuaaauacaug

SEQ ID NO: 1256784 - RNA, 12 nt, Homo sapiens
uuggauuugaca

SEQ ID NO: 1256785 - RNA, 11 nt, Homo sapiens
uuggcacugug

SEQ ID NO: 1256786 - RNA, 17 nt, Homo sapiens
uuggcauaauagucaau

SEQ ID NO: 1256787 - RNA, 22 nt, Homo sapiens
uuggccaaacaucagaccuguc

SEQ ID NO: 1256788 - RNA, 20 nt, Homo sapiens
uuggcccaggauuauuguca

SEQ ID NO: 1256789 - RNA, 20 nt, Homo sapiens
uuggccuagcccacccugcu

SEQ ID NO: 1256790 - RNA, 17 nt, Homo sapiens
uuggccucugcuaaggu

SEQ ID NO: 1256791 - RNA, 22 nt, Homo sapiens
uuggcuccaugcuccucacugc

SEQ ID NO: 1256792 - RNA, 21 nt, Homo sapiens
uuggcugaauagcacagguga

SEQ ID NO: 1256793 - RNA, 22 nt, Homo sapiens
uuggcuggcuuguuugauuuca

SEQ ID NO: 1256794 - RNA, 24 nt, Homo sapiens
uuggcuucugugaugagcugaucu

SEQ ID NO: 1256795 - RNA, 21 nt, Homo sapiens
uugggaaauuuuucuuucuaa

SEQ ID NO: 1256796 - RNA, 13 nt, Homo sapiens
uugggaagaccag

SEQ ID NO: 1256797 - RNA, 18 nt, Homo sapiens
uugggacaauuguuuuaa

SEQ ID NO: 1256798 - RNA, 16 nt, Homo sapiens
uugggacccaaaacac

SEQ ID NO: 1256799 - RNA, 12 nt, Homo sapiens
uugggagcaaaa

SEQ ID NO: 1256800 - RNA, 14 nt, Homo sapiens
uugggaggccaagg

SEQ ID NO: 1256801 - RNA, 23 nt, Homo sapiens
uugggagggugguucaacaaaga

SEQ ID NO: 1256802 - RNA, 20 nt, Homo sapiens
uugggauuuugguuucuucc

SEQ ID NO: 1256803 - RNA, 16 nt, Homo sapiens
uugggcaccugaccac

SEQ ID NO: 1256804 - RNA, 12 nt, Homo sapiens
uugggcauguga

SEQ ID NO: 1256805 - RNA, 10 nt, Homo sapiens
uugggcuccu

SEQ ID NO: 1256806 - RNA, 16 nt, Homo sapiens
uugggcugcuccucau

SEQ ID NO: 1256807 - RNA, 22 nt, Homo sapiens
uuggggaaaccuucaucugaaa

SEQ ID NO: 1256808 - RNA, 21 nt, Homo sapiens
uuggggaggggccucccugug

SEQ ID NO: 1256809 - RNA, 20 nt, Homo sapiens
uuggggaugagaaagguuga

SEQ ID NO: 1256810 - RNA, 13 nt, Homo sapiens
uugggucuuugaa

SEQ ID NO: 1256811 - RNA, 20 nt, Homo sapiens
uugguaaaacucacugugau

SEQ ID NO: 1256812 - RNA, 15 nt, Homo sapiens
uugguaaauucacaa

SEQ ID NO: 1256813 - RNA, 12 nt, Homo sapiens
uugguacugaaa

SEQ ID NO: 1256814 - RNA, 20 nt, Homo sapiens
uugguaguggaauagugaau

SEQ ID NO: 1256815 - RNA, 11 nt, Homo sapiens
uuggugccuuu

SEQ ID NO: 1256816 - RNA, 20 nt, Homo sapiens
uugguggcagugacuucuuu

SEQ ID NO: 1256817 - RNA, 13 nt, Homo sapiens
uugguggggccag

SEQ ID NO: 1256818 - RNA, 19 nt, Homo sapiens
uuggugugugugacaauuc

SEQ ID NO: 1256819 - RNA, 19 nt, Homo sapiens
uugguuagacgccuuccag

SEQ ID NO: 1256820 - RNA, 21 nt, Homo sapiens
uugguuauuuaaucacaguca

SEQ ID NO: 1256821 - RNA, 19 nt, Homo sapiens
uugguuuccuucacagaaa

SEQ ID NO: 1256822 - RNA, 18 nt, Homo sapiens
uugguuuuccuguggcau

SEQ ID NO: 1256823 - RNA, 17 nt, Homo sapiens
uuguaaaauuauuucau

SEQ ID NO: 1256824 - RNA, 15 nt, Homo sapiens
uuguaaagauccuau

SEQ ID NO: 1256825 - RNA, 17 nt, Homo sapiens
uuguaaaguuagccuuu

SEQ ID NO: 1256826 - RNA, 19 nt, Homo sapiens
uuguaaauacugcuugacc

SEQ ID NO: 1256827 - RNA, 15 nt, Homo sapiens
uuguaaauaggauuu

SEQ ID NO: 1256828 - RNA, 17 nt, Homo sapiens
uuguaacauaaugcacu

SEQ ID NO: 1256829 - RNA, 20 nt, Homo sapiens
uuguaacgaagacacagacu

SEQ ID NO: 1256830 - RNA, 21 nt, Homo sapiens
uuguaacgacuucuccaucuc

SEQ ID NO: 1256831 - RNA, 20 nt, Homo sapiens
uuguaagaguggaaccaaca

SEQ ID NO: 1256832 - RNA, 22 nt, Homo sapiens
uuguaagaguguagaagcauuc

SEQ ID NO: 1256833 - RNA, 24 nt, Homo sapiens
uuguaagugaaguaaaacuuaaga

SEQ ID NO: 1256834 - RNA, 15 nt, Homo sapiens
uuguaagugcugcua

SEQ ID NO: 1256835 - RNA, 16 nt, Homo sapiens
uuguaagugcugcuau

SEQ ID NO: 1256836 - RNA, 14 nt, Homo sapiens
uuguaauccuguac

SEQ ID NO: 1256837 - RNA, 15 nt, Homo sapiens
uuguaauuccuuacu

SEQ ID NO: 1256838 - RNA, 13 nt, Homo sapiens
uuguaauugcuua

SEQ ID NO: 1256839 - RNA, 19 nt, Homo sapiens
uuguacaaauguaagcaaa

SEQ ID NO: 1256840 - RNA, 15 nt, Homo sapiens
uuguacacugcugua

SEQ ID NO: 1256841 - RNA, 14 nt, Homo sapiens
uuguacacugugua

SEQ ID NO: 1256842 - RNA, 18 nt, Homo sapiens
uuguacagugucugugcc

SEQ ID NO: 1256843 - RNA, 23 nt, Homo sapiens
uuguaccauauagagguguaaca

SEQ ID NO: 1256844 - RNA, 15 nt, Homo sapiens
uuguagagacagggu

SEQ ID NO: 1256845 - RNA, 22 nt, Homo sapiens
uuguagagauggggucucacag

SEQ ID NO: 1256846 - RNA, 13 nt, Homo sapiens
uuguagagcagau

SEQ ID NO: 1256847 - RNA, 21 nt, Homo sapiens
uuguagagccagggucucacu

SEQ ID NO: 1256848 - RNA, 13 nt, Homo sapiens
uuguagcacugag

SEQ ID NO: 1256849 - RNA, 22 nt, Homo sapiens
uuguagcacugaggguggcacu

SEQ ID NO: 1256850 - RNA, 21 nt, Homo sapiens
uuguagugguauagaguacug

SEQ ID NO: 1256851 - RNA, 20 nt, Homo sapiens
uuguaguuuuggcuaguccu

SEQ ID NO: 1256852 - RNA, 14 nt, Homo sapiens
uuguauauuacaca

SEQ ID NO: 1256853 - RNA, 23 nt, Homo sapiens
uuguaucucauacugucugggau

SEQ ID NO: 1256854 - RNA, 14 nt, Homo sapiens
uugucaaaaaguuc

SEQ ID NO: 1256855 - RNA, 22 nt, Homo sapiens
uugucaagaagcguuaugugca

SEQ ID NO: 1256856 - RNA, 12 nt, Homo sapiens
uugucaccaauc

SEQ ID NO: 1256857 - RNA, 13 nt, Homo sapiens
uugucaccuguga

SEQ ID NO: 1256858 - RNA, 20 nt, Homo sapiens
uugucagacauaaagccaug

SEQ ID NO: 1256859 - RNA, 12 nt, Homo sapiens
uugucaguucuu

SEQ ID NO: 1256860 - RNA, 18 nt, Homo sapiens
uugucaguucuuggugcu

SEQ ID NO: 1256861 - RNA, 13 nt, Homo sapiens
uugucauaccuuu

SEQ ID NO: 1256862 - RNA, 11 nt, Homo sapiens
uugucaugaau

SEQ ID NO: 1256863 - RNA, 20 nt, Homo sapiens
uugucccagccuggggcucc

SEQ ID NO: 1256864 - RNA, 18 nt, Homo sapiens
uuguccugagauggaaaa

SEQ ID NO: 1256865 - RNA, 13 nt, Homo sapiens
uugucgcaaagac

SEQ ID NO: 1256866 - RNA, 18 nt, Homo sapiens
uugucuacauagugacau

SEQ ID NO: 1256867 - RNA, 15 nt, Homo sapiens
uugucuaccauuugu

SEQ ID NO: 1256868 - RNA, 14 nt, Homo sapiens
uugucuagaguuga

SEQ ID NO: 1256869 - RNA, 18 nt, Homo sapiens
uugucucguguacagcuc

SEQ ID NO: 1256870 - RNA, 22 nt, Homo sapiens
uugucuguuaaaugaacuugau

SEQ ID NO: 1256871 - RNA, 12 nt, Homo sapiens
ugugcccgggga

SEQ ID NO: 1256872 - RNA, 16 nt, Homo sapiens
ugugccgaaugugcag

SEQ ID NO: 1256873 - RNA, 22 nt, Homo sapiens
ugugccuggaagaguuggucuc

SEQ ID NO: 1256874 - RNA, 18 nt, Homo sapiens
ugugccuuugcaaaucag

SEQ ID NO: 1256875 - RNA, 20 nt, Homo sapiens
ugugcugcucaaggccacag

SEQ ID NO: 1256876 - RNA, 15 nt, Homo sapiens
ugugcuguccugccc

SEQ ID NO: 1256877 - RNA, 23 nt, Homo sapiens
uguggaacuuuuauuagauaaca

SEQ ID NO: 1256878 - RNA, 15 nt, Homo sapiens
uguggaagagcauua

SEQ ID NO: 1256879 - RNA, 18 nt, Homo sapiens
uguggaggccugaugcug

SEQ ID NO: 1256880 - RNA, 21 nt, Homo sapiens
uguggagugacucaaaucagu

SEQ ID NO: 1256881 - RNA, 17 nt, Homo sapiens
uguggauggucauugca

SEQ ID NO: 1256882 - RNA, 20 nt, Homo sapiens
uguggauuuucuacuguaag

SEQ ID NO: 1256883 - RNA, 12 nt, Homo sapiens
uguggcacucca

SEQ ID NO: 1256884 - RNA, 13 nt, Homo sapiens
uguggcacuccaa

SEQ ID NO: 1256885 - RNA, 22 nt, Homo sapiens
uguggcauaaauugcaucacug

SEQ ID NO: 1256886 - RNA, 19 nt, Homo sapiens
uguggccaacugcaaaaaa

SEQ ID NO: 1256887 - RNA, 16 nt, Homo sapiens
uguggccccaacacaa

SEQ ID NO: 1256888 - RNA, 15 nt, Homo sapiens
uguggccccuuuuac

SEQ ID NO: 1256889 - RNA, 17 nt, Homo sapiens
uguggcugggcuuccca

SEQ ID NO: 1256890 - RNA, 13 nt, Homo sapiens
ugugggggguccu

SEQ ID NO: 1256891 - RNA, 20 nt, Homo sapiens
ugugggucuguguggcagga

SEQ ID NO: 1256892 - RNA, 16 nt, Homo sapiens
ugugggugucagucag

SEQ ID NO: 1256893 - RNA, 21 nt, Homo sapiens
uguggucaauccgaaguauga

SEQ ID NO: 1256894 - RNA, 12 nt, Homo sapiens
uguggucucagg

SEQ ID NO: 1256895 - RNA, 13 nt, Homo sapiens
uguggucucagga

SEQ ID NO: 1256896 - RNA, 18 nt, Homo sapiens
ugugguggccgugccuga

SEQ ID NO: 1256897 - RNA, 18 nt, Homo sapiens
ugugguggccucagcuga

SEQ ID NO: 1256898 - RNA, 16 nt, Homo sapiens
ugugguuacaguuuga

SEQ ID NO: 1256899 - RNA, 14 nt, Homo sapiens
ugugguuccucugc

SEQ ID NO: 1256900 - RNA, 13 nt, Homo sapiens
ugugguugcucac

SEQ ID NO: 1256901 - RNA, 13 nt, Homo sapiens
ugugguuguaaau

SEQ ID NO: 1256902 - RNA, 20 nt, Homo sapiens
uguguaaacagaagccuguu

SEQ ID NO: 1256903 - RNA, 13 nt, Homo sapiens
uguguaacugaau

SEQ ID NO: 1256904 - RNA, 22 nt, Homo sapiens
uguguaacuguaaaacauugaa

SEQ ID NO: 1256905 - RNA, 21 nt, Homo sapiens
uguguaauaaaguguuuucag

SEQ ID NO: 1256906 - RNA, 13 nt, Homo sapiens
uguguaauaugca

SEQ ID NO: 1256907 - RNA, 13 nt, Homo sapiens
uguguacaaagug

SEQ ID NO: 1256908 - RNA, 21 nt, Homo sapiens
uguguagcucucacaugcaca

SEQ ID NO: 1256909 - RNA, 23 nt, Homo sapiens
uguguauccaugcaccuaccuua

SEQ ID NO: 1256910 - RNA, 17 nt, Homo sapiens
uguguauccgacucuaa

SEQ ID NO: 1256911 - RNA, 18 nt, Homo sapiens
uguguauccgacucuaag

SEQ ID NO: 1256912 - RNA, 19 nt, Homo sapiens
uguguaugcugaugaucaa

SEQ ID NO: 1256913 - RNA, 13 nt, Homo sapiens
uguguaugugcca

SEQ ID NO: 1256914 - RNA, 16 nt, Homo sapiens
uguguauuuacaugaa

SEQ ID NO: 1256915 - RNA, 11 nt, Homo sapiens
uguguccaaaa

SEQ ID NO: 1256916 - RNA, 15 nt, Homo sapiens
uguguccacagaguu

SEQ ID NO: 1256917 - RNA, 17 nt, Homo sapiens
ugugucccccccagugc

SEQ ID NO: 1256918 - RNA, 20 nt, Homo sapiens
ugugucgcgcacacagcuua

SEQ ID NO: 1256919 - RNA, 16 nt, Homo sapiens
ugugucuaagauucua

SEQ ID NO: 1256920 - RNA, 12 nt, Homo sapiens
ugugucuguaca

SEQ ID NO: 1256921 - RNA, 17 nt, Homo sapiens
ugugugaccaacugugu

SEQ ID NO: 1256922 - RNA, 22 nt, Homo sapiens
ugugugacuuacagaaacugca

SEQ ID NO: 1256923 - RNA, 21 nt, Homo sapiens
ugugugagcuaugcaaacaaa

SEQ ID NO: 1256924 - RNA, 21 nt, Homo sapiens
ugugugcauggaacaaauaau

SEQ ID NO: 1256925 - RNA, 19 nt, Homo sapiens
ugugugccuuuguuuccca

SEQ ID NO: 1256926 - RNA, 14 nt, Homo sapiens
ugugugcuuuccca

SEQ ID NO: 1256927 - RNA, 16 nt, Homo sapiens
uguguggcagagccag

SEQ ID NO: 1256928 - RNA, 18 nt, Homo sapiens
uguguguauguuugcaca

SEQ ID NO: 1256929 - RNA, 12 nt, Homo sapiens
ugugugugccuc

SEQ ID NO: 1256930 - RNA, 13 nt, Homo sapiens
ugugugugucacc

SEQ ID NO: 1256931 - RNA, 14 nt, Homo sapiens
uguguuaucucuua

SEQ ID NO: 1256932 - RNA, 19 nt, Homo sapiens
uguguuauuuaaugaguca

SEQ ID NO: 1256933 - RNA, 18 nt, Homo sapiens
uguguucucuauugcugc

SEQ ID NO: 1256934 - RNA, 18 nt, Homo sapiens
uguguuucaaguggggcu

SEQ ID NO: 1256935 - RNA, 18 nt, Homo sapiens
uguguuucuauugacuuc

SEQ ID NO: 1256936 - RNA, 22 nt, Homo sapiens
uguguuuugaaugguguuguau

SEQ ID NO: 1256937 - RNA, 20 nt, Homo sapiens
uguguuuuuaacaugucaau

SEQ ID NO: 1256938 - RNA, 18 nt, Homo sapiens
uguguuuuuuaggacgau

SEQ ID NO: 1256939 - RNA, 13 nt, Homo sapiens
uguuaacacucau

SEQ ID NO: 1256940 - RNA, 21 nt, Homo sapiens
uguuaacacucaugaagcaua

SEQ ID NO: 1256941 - RNA, 23 nt, Homo sapiens
uguuaaccucugcuuuuaucuca

SEQ ID NO: 1256942 - RNA, 15 nt, Homo sapiens
uguuaaggaaacucu

SEQ ID NO: 1256943 - RNA, 22 nt, Homo sapiens
uguuaaggaaacucuuaucuca

SEQ ID NO: 1256944 - RNA, 16 nt, Homo sapiens
uguuaaucauccauca

SEQ ID NO: 1256945 - RNA, 16 nt, Homo sapiens
uguuacagcuucgcug

SEQ ID NO: 1256946 - RNA, 12 nt, Homo sapiens
uguuaccaaaua

SEQ ID NO: 1256947 - RNA, 15 nt, Homo sapiens
uguuaccauucacaa

SEQ ID NO: 1256948 - RNA, 22 nt, Homo sapiens
uguuacccauucaaccauuuua

SEQ ID NO: 1256949 - RNA, 15 nt, Homo sapiens
uguuaccuccuauaa

SEQ ID NO: 1256950 - RNA, 16 nt, Homo sapiens
uguuacucaguguuag

SEQ ID NO: 1256951 - RNA, 15 nt, Homo sapiens
uguuacugccuauaa

SEQ ID NO: 1256952 - RNA, 14 nt, Homo sapiens
uguuacuguaauuc

SEQ ID NO: 1256953 - RNA, 12 nt, Homo sapiens
uguuacuugcac

SEQ ID NO: 1256954 - RNA, 17 nt, Homo sapiens
uguuagaucaaccucca

SEQ ID NO: 1256955 - RNA, 14 nt, Homo sapiens
uguuagauuccucu

SEQ ID NO: 1256956 - RNA, 19 nt, Homo sapiens
uguuagauuccucuugccu

SEQ ID NO: 1256957 - RNA, 15 nt, Homo sapiens
uguuagcacuguuga

SEQ ID NO: 1256958 - RNA, 21 nt, Homo sapiens
uguuauaacucugcacuacuc

SEQ ID NO: 1256959 - RNA, 14 nt, Homo sapiens
ugucacauaaugcu

SEQ ID NO: 1256960 - RNA, 22 nt, Homo sapiens
ugucaccuacgugccacuccug

SEQ ID NO: 1256961 - RNA, 18 nt, Homo sapiens
ugucacuacacacuaaaa

SEQ ID NO: 1256962 - RNA, 21 nt, Homo sapiens
ugucagaaaccaguuauguga

SEQ ID NO: 1256963 - RNA, 14 nt, Homo sapiens
ugucagcaguuccc

SEQ ID NO: 1256964 - RNA, 11 nt, Homo sapiens
ugucagcauca

SEQ ID NO: 1256965 - RNA, 23 nt, Homo sapiens
ugucagcuucccagccaugccca

SEQ ID NO: 1256966 - RNA, 14 nt, Homo sapiens
ugucaggacaccag

SEQ ID NO: 1256967 - RNA, 16 nt, Homo sapiens
ugucaggauucuucaa

SEQ ID NO: 1256968 - RNA, 18 nt, Homo sapiens
ugucagggguuucuucaa

SEQ ID NO: 1256969 - RNA, 14 nt, Homo sapiens
ugucagucagggac

SEQ ID NO: 1256970 - RNA, 16 nt, Homo sapiens
ugucagugacaguauu

SEQ ID NO: 1256971 - RNA, 22 nt, Homo sapiens
ugucauaaacgauucugagcca

SEQ ID NO: 1256972 - RNA, 22 nt, Homo sapiens
ugucaucaaauauuaccaaaaa

SEQ ID NO: 1256973 - RNA, 23 nt, Homo sapiens
ugucaucaaauauuaccaaaaaa

SEQ ID NO: 1256974 - RNA, 20 nt, Homo sapiens
ugucaucagccaccauccua

SEQ ID NO: 1256975 - RNA, 14 nt, Homo sapiens
ugucauccucaugc

SEQ ID NO: 1256976 - RNA, 18 nt, Homo sapiens
ugucauccucaugcugcu

SEQ ID NO: 1256977 - RNA, 18 nt, Homo sapiens
ugucauguaacacgacau

SEQ ID NO: 1256978 - RNA, 20 nt, Homo sapiens
ugucauucagaaaccugaag

SEQ ID NO: 1256979 - RNA, 15 nt, Homo sapiens
ugucauuguaaacaa

SEQ ID NO: 1256980 - RNA, 14 nt, Homo sapiens
uguccaagugccac

SEQ ID NO: 1256981 - RNA, 17 nt, Homo sapiens
uguccacgauucacuca

SEQ ID NO: 1256982 - RNA, 20 nt, Homo sapiens
uguccagaggcugcaaggau

SEQ ID NO: 1256983 - RNA, 13 nt, Homo sapiens
uguccagcagcug

SEQ ID NO: 1256984 - RNA, 17 nt, Homo sapiens
ugucccaaccccagugg

SEQ ID NO: 1256985 - RNA, 18 nt, Homo sapiens
ugucccaccuugaccaaa

SEQ ID NO: 1256986 - RNA, 23 nt, Homo sapiens
ugucccacgugucuuccacuuug

SEQ ID NO: 1256987 - RNA, 21 nt, Homo sapiens
uguccccagcccuguccuggu

SEQ ID NO: 1256988 - RNA, 14 nt, Homo sapiens
ugucccccuaccca

SEQ ID NO: 1256989 - RNA, 18 nt, Homo sapiens
ugucccccuacccaccga

SEQ ID NO: 1256990 - RNA, 15 nt, Homo sapiens
uguccccuccacugu

SEQ ID NO: 1256991 - RNA, 17 nt, Homo sapiens
uguccccuccacuguca

SEQ ID NO: 1256992 - RNA, 24 nt, Homo sapiens
ugucccugugggugaaacagaaca

SEQ ID NO: 1256993 - RNA, 22 nt, Homo sapiens
ugucccuugccucaaugccagu

SEQ ID NO: 1256994 - RNA, 23 nt, Homo sapiens
ugucccuuucuuggccaguuauc

SEQ ID NO: 1256995 - RNA, 17 nt, Homo sapiens
ugucccuuuuaauauaa

SEQ ID NO: 1256996 - RNA, 14 nt, Homo sapiens
uguccuaagcacuu

SEQ ID NO: 1256997 - RNA, 17 nt, Homo sapiens
uguccuacucuguguca

SEQ ID NO: 1256998 - RNA, 23 nt, Homo sapiens
uguccuauucccugucacuacac

SEQ ID NO: 1256999 - RNA, 18 nt, Homo sapiens
uguccucucccugccaag

SEQ ID NO: 1257000 - RNA, 15 nt, Homo sapiens
uguccugaucuguga

SEQ ID NO: 1257001 - RNA, 16 nt, Homo sapiens
uguccugaucugugau

SEQ ID NO: 1257002 - RNA, 14 nt, Homo sapiens
uguccuuccugacc

SEQ ID NO: 1257003 - RNA, 15 nt, Homo sapiens
ugucgcgcacacagc

SEQ ID NO: 1257004 - RNA, 18 nt, Homo sapiens
ugucgguuaccucugcau

SEQ ID NO: 1257005 - RNA, 13 nt, Homo sapiens
ugucguagccaag

SEQ ID NO: 1257006 - RNA, 14 nt, Homo sapiens
ugucgucuuuaugu

SEQ ID NO: 1257007 - RNA, 17 nt, Homo sapiens
ugucuaaaaugucagug

SEQ ID NO: 1257008 - RNA, 15 nt, Homo sapiens
ugucuaagauucuag

SEQ ID NO: 1257009 - RNA, 18 nt, Homo sapiens
ugucuacacacagaugac

SEQ ID NO: 1257010 - RNA, 23 nt, Homo sapiens
ugucuacaccaaugcccaacugc

SEQ ID NO: 1257011 - RNA, 21 nt, Homo sapiens
ugucuacauagugacaugcac

SEQ ID NO: 1257012 - RNA, 18 nt, Homo sapiens
ugucuccacgauggugga

SEQ ID NO: 1257013 - RNA, 13 nt, Homo sapiens
ugucuccacugug

SEQ ID NO: 1257014 - RNA, 14 nt, Homo sapiens
ugucuccacugugc

SEQ ID NO: 1257015 - RNA, 17 nt, Homo sapiens
ugucuccacugugccuu

SEQ ID NO: 1257016 - RNA, 19 nt, Homo sapiens
ugucucgauuagacuccau

SEQ ID NO: 1257017 - RNA, 20 nt, Homo sapiens
ugucucuacuaaaaaugcaa

SEQ ID NO: 1257018 - RNA, 18 nt, Homo sapiens
ugucucuuuaaugucaca

SEQ ID NO: 1257019 - RNA, 19 nt, Homo sapiens
ugucucuuugugcucuaaa

SEQ ID NO: 1257020 - RNA, 19 nt, Homo sapiens
ugucugaagccauagccuc

SEQ ID NO: 1257021 - RNA, 13 nt, Homo sapiens
ugucugccuuaaa

SEQ ID NO: 1257022 - RNA, 19 nt, Homo sapiens
ugucuggagugacagacca

SEQ ID NO: 1257023 - RNA, 21 nt, Homo sapiens
ugucuggagugguaacagcuc

SEQ ID NO: 1257024 - RNA, 15 nt, Homo sapiens
ugucuggccaggccu

SEQ ID NO: 1257025 - RNA, 22 nt, Homo sapiens
ugucugggugaccucacuuuag

SEQ ID NO: 1257026 - RNA, 15 nt, Homo sapiens
ugucuggugguggca

SEQ ID NO: 1257027 - RNA, 19 nt, Homo sapiens
ugucuguaaugacaaauaa

SEQ ID NO: 1257028 - RNA, 20 nt, Homo sapiens
ugucuguccugauuucuaca

SEQ ID NO: 1257029 - RNA, 21 nt, Homo sapiens
ugucugucuacauuucugcag

SEQ ID NO: 1257030 - RNA, 19 nt, Homo sapiens
ugucuguuuggaagaccag

SEQ ID NO: 1257031 - RNA, 13 nt, Homo sapiens
ugucuuagucaaa

SEQ ID NO: 1257032 - RNA, 16 nt, Homo sapiens
ugucuucaaacuguga

SEQ ID NO: 1257033 - RNA, 20 nt, Homo sapiens
ugucuucaccugccaccaca

SEQ ID NO: 1257034 - RNA, 13 nt, Homo sapiens
ugucuucagagaa

SEQ ID NO: 1257035 - RNA, 15 nt, Homo sapiens
ugucuucuuucacua

SEQ ID NO: 1257036 - RNA, 21 nt, Homo sapiens
ugucuugaaaguggcaccaga

SEQ ID NO: 1257037 - RNA, 22 nt, Homo sapiens
ugucuuuaaaaguauccagaga

SEQ ID NO: 1257038 - RNA, 18 nt, Homo sapiens
ugucuuuaauuucuguca

SEQ ID NO: 1257039 - RNA, 21 nt, Homo sapiens
ugucuuucugagcacacuuua

SEQ ID NO: 1257040 - RNA, 17 nt, Homo sapiens
ugucuuucuuuggugcc

SEQ ID NO: 1257041 - RNA, 23 nt, Homo sapiens
ugugaaaggaagcuccacuguca

SEQ ID NO: 1257042 - RNA, 15 nt, Homo sapiens
uguaaaauuauuuca

SEQ ID NO: 1257043 - RNA, 13 nt, Homo sapiens
uguaaacguuaaa

SEQ ID NO: 1257044 - RNA, 13 nt, Homo sapiens
uguaaacugccau

SEQ ID NO: 1257045 - RNA, 19 nt, Homo sapiens
uguaaacuguacuagucug

SEQ ID NO: 1257046 - RNA, 16 nt, Homo sapiens
uguaaagaaauuuacu

SEQ ID NO: 1257047 - RNA, 12 nt, Homo sapiens
uguaaagccagc

SEQ ID NO: 1257048 - RNA, 17 nt, Homo sapiens
uguaaauacacauagca

SEQ ID NO: 1257049 - RNA, 14 nt, Homo sapiens
uguaaauaugaauc

SEQ ID NO: 1257050 - RNA, 15 nt, Homo sapiens
uguaaaucugccaca

SEQ ID NO: 1257051 - RNA, 16 nt, Homo sapiens
uguaaaugcauuggaa

SEQ ID NO: 1257052 - RNA, 17 nt, Homo sapiens
uguaaauugcaaauaaa

SEQ ID NO: 1257053 - RNA, 13 nt, Homo sapiens
uguaacacugugu

SEQ ID NO: 1257054 - RNA, 14 nt, Homo sapiens
uguaacacuuguca

SEQ ID NO: 1257055 - RNA, 20 nt, Homo sapiens
uguaacagauaucagugucu

SEQ ID NO: 1257056 - RNA, 23 nt, Homo sapiens
uguaacagcggcaggguguccca

SEQ ID NO: 1257057 - RNA, 21 nt, Homo sapiens
uguaacugacugccuugcuaa

SEQ ID NO: 1257058 - RNA, 19 nt, Homo sapiens
uguaacuguaaaacauuga

SEQ ID NO: 1257059 - RNA, 13 nt, Homo sapiens
uguaacugucagu

SEQ ID NO: 1257060 - RNA, 19 nt, Homo sapiens
uguaacuuauguagauauu

SEQ ID NO: 1257061 - RNA, 20 nt, Homo sapiens
uguaagaaaacaaacuaaau

SEQ ID NO: 1257062 - RNA, 12 nt, Homo sapiens
uguaagaacaac

SEQ ID NO: 1257063 - RNA, 19 nt, Homo sapiens
uguaagaacaacuaccuga

SEQ ID NO: 1257064 - RNA, 15 nt, Homo sapiens
uguaagacucauucc

SEQ ID NO: 1257065 - RNA, 14 nt, Homo sapiens
uguaagccaaguca

SEQ ID NO: 1257066 - RNA, 15 nt, Homo sapiens
uguaagcuguuuauu

SEQ ID NO: 1257067 - RNA, 19 nt, Homo sapiens
uguaaggaauuaucaauua

SEQ ID NO: 1257068 - RNA, 15 nt, Homo sapiens
uguaaggcucuagau

SEQ ID NO: 1257069 - RNA, 21 nt, Homo sapiens
uguaagggauggcuggcugga

SEQ ID NO: 1257070 - RNA, 18 nt, Homo sapiens
uguaagguggucacuguu

SEQ ID NO: 1257071 - RNA, 14 nt, Homo sapiens
uguaaguacuucca

SEQ ID NO: 1257072 - RNA, 13 nt, Homo sapiens
uguaagucaucua

SEQ ID NO: 1257073 - RNA, 15 nt, Homo sapiens
uguaagugcugcuau

SEQ ID NO: 1257074 - RNA, 21 nt, Homo sapiens
uguaauaaguaucacacugua

SEQ ID NO: 1257075 - RNA, 16 nt, Homo sapiens
uguaauaauaccucaa

SEQ ID NO: 1257076 - RNA, 23 nt, Homo sapiens
uguaauaauugcucauaagcaau

SEQ ID NO: 1257077 - RNA, 18 nt, Homo sapiens
uguaauagugaacauaug

SEQ ID NO: 1257078 - RNA, 14 nt, Homo sapiens
uguaaucauauaau

SEQ ID NO: 1257079 - RNA, 19 nt, Homo sapiens
uguaaucccaacacuuugg

SEQ ID NO: 1257080 - RNA, 13 nt, Homo sapiens
uguaaucccagca

SEQ ID NO: 1257081 - RNA, 17 nt, Homo sapiens
uguaaucccagcacuuu

SEQ ID NO: 1257082 - RNA, 17 nt, Homo sapiens
uguaaucccccaggaga

SEQ ID NO: 1257083 - RNA, 16 nt, Homo sapiens
uguaaucucagcacuu

SEQ ID NO: 1257084 - RNA, 17 nt, Homo sapiens
uguaaucucagcacuuu

SEQ ID NO: 1257085 - RNA, 21 nt, Homo sapiens
uguaaugaaaaugaauaucua

SEQ ID NO: 1257086 - RNA, 21 nt, Homo sapiens
uguaaugauacugauuaugaa

SEQ ID NO: 1257087 - RNA, 20 nt, Homo sapiens
uguaaugugugguggccuca

SEQ ID NO: 1257088 - RNA, 17 nt, Homo sapiens
uguaauguuauuuccac

SEQ ID NO: 1257089 - RNA, 14 nt, Homo sapiens
uguacaauaaagca

SEQ ID NO: 1257090 - RNA, 20 nt, Homo sapiens
uguacaaucaugaacagcuc

SEQ ID NO: 1257091 - RNA, 12 nt, Homo sapiens
uguacacugugu

SEQ ID NO: 1257092 - RNA, 13 nt, Homo sapiens
uguacacugugua

SEQ ID NO: 1257093 - RNA, 20 nt, Homo sapiens
uguacagaccaccuuucaca

SEQ ID NO: 1257094 - RNA, 13 nt, Homo sapiens
uguacagacuguu

SEQ ID NO: 1257095 - RNA, 22 nt, Homo sapiens
uguacagcucuccccucccuug

SEQ ID NO: 1257096 - RNA, 21 nt, Homo sapiens
uguacaguagauuuuccaaau

SEQ ID NO: 1257097 - RNA, 16 nt, Homo sapiens
uguacaguuugcugua

SEQ ID NO: 1257098 - RNA, 16 nt, Homo sapiens
uguacauaaacuguca

SEQ ID NO: 1257099 - RNA, 21 nt, Homo sapiens
uguacauaaacugucacucua

SEQ ID NO: 1257100 - RNA, 18 nt, Homo sapiens
uguacauaauucuugcua

SEQ ID NO: 1257101 - RNA, 23 nt, Homo sapiens
uguacauaccuccuugcacaaau

SEQ ID NO: 1257102 - RNA, 16 nt, Homo sapiens
uguacauagccuauau

SEQ ID NO: 1257103 - RNA, 16 nt, Homo sapiens
uguacauaguguaaug

SEQ ID NO: 1257104 - RNA, 23 nt, Homo sapiens
uguacaucuauuuuggauuguau

SEQ ID NO: 1257105 - RNA, 17 nt, Homo sapiens
uguacauggaauaacau

SEQ ID NO: 1257106 - RNA, 15 nt, Homo sapiens
uguacauugugggau

SEQ ID NO: 1257107 - RNA, 12 nt, Homo sapiens
uguacugauaua

SEQ ID NO: 1257108 - RNA, 19 nt, Homo sapiens
uguacugccuuaaauguac

SEQ ID NO: 1257109 - RNA, 16 nt, Homo sapiens
uguacugccuuagugc

SEQ ID NO: 1257110 - RNA, 15 nt, Homo sapiens
uguacuuccaccucc

SEQ ID NO: 1257111 - RNA, 21 nt, Homo sapiens
uguacuuccaccuccaccaca

SEQ ID NO: 1257112 - RNA, 19 nt, Homo sapiens
uguacuuuaaaaagaugua

SEQ ID NO: 1257113 - RNA, 16 nt, Homo sapiens
uguagaaaaauacuga

SEQ ID NO: 1257114 - RNA, 16 nt, Homo sapiens
uguagagcuucuggca

SEQ ID NO: 1257115 - RNA, 17 nt, Homo sapiens
uguagauauugugaagu

SEQ ID NO: 1257116 - RNA, 22 nt, Homo sapiens
uguagaugggggaacugugaau

SEQ ID NO: 1257117 - RNA, 13 nt, Homo sapiens
uguagccagguac

SEQ ID NO: 1257118 - RNA, 16 nt, Homo sapiens
uguagcccauccuucc

SEQ ID NO: 1257119 - RNA, 22 nt, Homo sapiens
uguagcgccaguguaauccccc

SEQ ID NO: 1257120 - RNA, 13 nt, Homo sapiens
uguagcugaugaa

SEQ ID NO: 1257121 - RNA, 17 nt, Homo sapiens
uguagcuguaagggcag

SEQ ID NO: 1257122 - RNA, 16 nt, Homo sapiens
uguaguaaacuauuua

SEQ ID NO: 1257123 - RNA, 15 nt, Homo sapiens
ugggagaaggcagug

SEQ ID NO: 1257124 - RNA, 18 nt, Homo sapiens
ugggagacaacuggacaa

SEQ ID NO: 1257125 - RNA, 15 nt, Homo sapiens
ugggagacaugugac

SEQ ID NO: 1257126 - RNA, 18 nt, Homo sapiens
ugggagacugaagacuca

SEQ ID NO: 1257127 - RNA, 15 nt, Homo sapiens
ugggagcaccgccug

SEQ ID NO: 1257128 - RNA, 22 nt, Homo sapiens
ugggagccaguccuccacucga

SEQ ID NO: 1257129 - RNA, 17 nt, Homo sapiens
ugggaggguguggugcu

SEQ ID NO: 1257130 - RNA, 15 nt, Homo sapiens
ugggaggucuugcua

SEQ ID NO: 1257131 - RNA, 19 nt, Homo sapiens
ugggaguuuagugugauaa

SEQ ID NO: 1257132 - RNA, 19 nt, Homo sapiens
ugggauaacugauuucuau

SEQ ID NO: 1257133 - RNA, 14 nt, Homo sapiens
ugggauaaucacau

SEQ ID NO: 1257134 - RNA, 14 nt, Homo sapiens
ugggauacaaccuc

SEQ ID NO: 1257135 - RNA, 13 nt, Homo sapiens
ugggaugggaucc

SEQ ID NO: 1257136 - RNA, 17 nt, Homo sapiens
ugggauguucagcacug

SEQ ID NO: 1257137 - RNA, 17 nt, Homo sapiens
ugggauuacagguguga

SEQ ID NO: 1257138 - RNA, 19 nt, Homo sapiens
ugggauuacaggugugaac

SEQ ID NO: 1257139 - RNA, 17 nt, Homo sapiens
ugggauuauucuuugaa

SEQ ID NO: 1257140 - RNA, 19 nt, Homo sapiens
ugggauuuaaagccuuuag

SEQ ID NO: 1257141 - RNA, 23 nt, Homo sapiens
ugggauuucucccucucagugga

SEQ ID NO: 1257142 - RNA, 18 nt, Homo sapiens
ugggcaacauaguaagac

SEQ ID NO: 1257143 - RNA, 23 nt, Homo sapiens
ugggcaacauaguaagaccccau

SEQ ID NO: 1257144 - RNA, 17 nt, Homo sapiens
ugggcacagcacagcca

SEQ ID NO: 1257145 - RNA, 19 nt, Homo sapiens
ugggcacaguggacucagc

SEQ ID NO: 1257146 - RNA, 16 nt, Homo sapiens
ugggcaccucagaaag

SEQ ID NO: 1257147 - RNA, 22 nt, Homo sapiens
ugggcacucccuugguggcaag

SEQ ID NO: 1257148 - RNA, 15 nt, Homo sapiens
ugggcagcauacuga

SEQ ID NO: 1257149 - RNA, 22 nt, Homo sapiens
ugggcagggucuguuuggacug

SEQ ID NO: 1257150 - RNA, 18 nt, Homo sapiens
ugggcagggugacccuga

SEQ ID NO: 1257151 - RNA, 14 nt, Homo sapiens
ugggcagguaguuu

SEQ ID NO: 1257152 - RNA, 19 nt, Homo sapiens
ugggcaggugguggcacug

SEQ ID NO: 1257153 - RNA, 17 nt, Homo sapiens
ugggcauagccauggaa

SEQ ID NO: 1257154 - RNA, 18 nt, Homo sapiens
ugggcauucuuguuucaa

SEQ ID NO: 1257155 - RNA, 15 nt, Homo sapiens
ugggcauugacaaau

SEQ ID NO: 1257156 - RNA, 16 nt, Homo sapiens
ugggccagugcaccuu

SEQ ID NO: 1257157 - RNA, 14 nt, Homo sapiens
ugggccauccucac

SEQ ID NO: 1257158 - RNA, 14 nt, Homo sapiens
ugggccauguccaa

SEQ ID NO: 1257159 - RNA, 17 nt, Homo sapiens
ugggccauuaaaaacua

SEQ ID NO: 1257160 - RNA, 14 nt, Homo sapiens
ugggcccagaucug

SEQ ID NO: 1257161 - RNA, 15 nt, Homo sapiens
ugggccucaguucaa

SEQ ID NO: 1257162 - RNA, 20 nt, Homo sapiens
ugggccucugcuucucucac

SEQ ID NO: 1257163 - RNA, 12 nt, Homo sapiens
ugggcucaggga

SEQ ID NO: 1257164 - RNA, 21 nt, Homo sapiens
ugggcugucagcccaugugca

SEQ ID NO: 1257165 - RNA, 14 nt, Homo sapiens
ugggcugucuguca

SEQ ID NO: 1257166 - RNA, 19 nt, Homo sapiens
ugggcugugggcaagccua

SEQ ID NO: 1257167 - RNA, 15 nt, Homo sapiens
ugggcuucaguaagu

SEQ ID NO: 1257168 - RNA, 16 nt, Homo sapiens
ugggcuugaaacauua

SEQ ID NO: 1257169 - RNA, 15 nt, Homo sapiens
ugggcuugagcugca

SEQ ID NO: 1257170 - RNA, 14 nt, Homo sapiens
ugggcuugauucug

SEQ ID NO: 1257171 - RNA, 23 nt, Homo sapiens
uggggaacugcguggugcucuuu

SEQ ID NO: 1257172 - RNA, 16 nt, Homo sapiens
uggggaagguggagca

SEQ ID NO: 1257173 - RNA, 15 nt, Homo sapiens
uggggaaguguucca

SEQ ID NO: 1257174 - RNA, 16 nt, Homo sapiens
uggggaaguguuccag

SEQ ID NO: 1257175 - RNA, 14 nt, Homo sapiens
uggggacauuugcc

SEQ ID NO: 1257176 - RNA, 16 nt, Homo sapiens
uggggagaaaguacuu

SEQ ID NO: 1257177 - RNA, 18 nt, Homo sapiens
uggggagcaggaggccaa

SEQ ID NO: 1257178 - RNA, 12 nt, Homo sapiens
uggggaggacaa

SEQ ID NO: 1257179 - RNA, 14 nt, Homo sapiens
uggggaggcccaaa

SEQ ID NO: 1257180 - RNA, 14 nt, Homo sapiens
uggggagguggagu

SEQ ID NO: 1257181 - RNA, 19 nt, Homo sapiens
uggggaguaggacauacca

SEQ ID NO: 1257182 - RNA, 17 nt, Homo sapiens
uggggaucucaggggcu

SEQ ID NO: 1257183 - RNA, 19 nt, Homo sapiens
uggggaugguccacuguca

SEQ ID NO: 1257184 - RNA, 22 nt, Homo sapiens
uggggcaggucacuuuaccucu

SEQ ID NO: 1257185 - RNA, 17 nt, Homo sapiens
uggggcauuauccaucu

SEQ ID NO: 1257186 - RNA, 18 nt, Homo sapiens
uggggccuccagaacuca

SEQ ID NO: 1257187 - RNA, 16 nt, Homo sapiens
uggggccuguggaaug

SEQ ID NO: 1257188 - RNA, 10 nt, Homo sapiens
uggggcuccu

SEQ ID NO: 1257189 - RNA, 17 nt, Homo sapiens
uggggcuuuuuccaucu

SEQ ID NO: 1257190 - RNA, 23 nt, Homo sapiens
ugggggaaaguguugaccacaga

SEQ ID NO: 1257191 - RNA, 20 nt, Homo sapiens
ugggggaccaaugaggugag

SEQ ID NO: 1257192 - RNA, 21 nt, Homo sapiens
ugggggccuuguggcacucca

SEQ ID NO: 1257193 - RNA, 14 nt, Homo sapiens
ugggggugaagucu

SEQ ID NO: 1257194 - RNA, 15 nt, Homo sapiens
ugggggugucccugg

SEQ ID NO: 1257195 - RNA, 18 nt, Homo sapiens
ugggguacccacugcucu

SEQ ID NO: 1257196 - RNA, 13 nt, Homo sapiens
uggggucaggaac

SEQ ID NO: 1257197 - RNA, 21 nt, Homo sapiens
uggggucuuugugguagcuua

SEQ ID NO: 1257198 - RNA, 19 nt, Homo sapiens
uggggugcauccuccucag

SEQ ID NO: 1257199 - RNA, 19 nt, Homo sapiens
ugggguggcgggaauccua

SEQ ID NO: 1257200 - RNA, 19 nt, Homo sapiens
uggguaagaagaaagcaaa

SEQ ID NO: 1257201 - RNA, 20 nt, Homo sapiens
uggguaagacuaaaucugua

SEQ ID NO: 1257202 - RNA, 22 nt, Homo sapiens
uggguaauaaccaagauggagu

SEQ ID NO: 1257203 - RNA, 23 nt, Homo sapiens
uggguacugaaagccuuagggaa

SEQ ID NO: 1257204 - RNA, 22 nt, Homo sapiens
uggguauaaaggcuaaaaggga

SEQ ID NO: 1257205 - RNA, 18 nt, Homo sapiens
ugggucaaguacaccagc

SEQ ID NO: 1257206 - RNA, 22 nt, Homo sapiens
ugggucccuccucucaccucuc

SEQ ID NO: 1257207 - RNA, 14 nt, Homo sapiens
ugggucuaugccuu

SEQ ID NO: 1257208 - RNA, 20 nt, Homo sapiens
ugggucucauuuagaacuug

SEQ ID NO: 1257209 - RNA, 22 nt, Homo sapiens
ugggucugggagucacacagug

SEQ ID NO: 1257210 - RNA, 21 nt, Homo sapiens
ugggucuucccuguaugauuc

SEQ ID NO: 1257211 - RNA, 18 nt, Homo sapiens
ugggugccagcauacauu

SEQ ID NO: 1257212 - RNA, 21 nt, Homo sapiens
uggguguuucaguuugaaaau

SEQ ID NO: 1257213 - RNA, 20 nt, Homo sapiens
uggguuauucagaaccuaaa

SEQ ID NO: 1257214 - RNA, 20 nt, Homo sapiens
uggguuuugggucuuugaac

SEQ ID NO: 1257215 - RNA, 14 nt, Homo sapiens
ugguaaaaccuguu

SEQ ID NO: 1257216 - RNA, 18 nt, Homo sapiens
ugguaaaacucacuguga

SEQ ID NO: 1257217 - RNA, 18 nt, Homo sapiens
ugguaaauucacaaauac

SEQ ID NO: 1257218 - RNA, 23 nt, Homo sapiens
ugguaacugauuaccugccaauu

SEQ ID NO: 1257219 - RNA, 22 nt, Homo sapiens
ugguaagagacagaauguaucu

SEQ ID NO: 1257220 - RNA, 14 nt, Homo sapiens
ugguaagcaccagg

SEQ ID NO: 1257221 - RNA, 19 nt, Homo sapiens
ugguaauauuaauuuccac

SEQ ID NO: 1257222 - RNA, 18 nt, Homo sapiens
ugguaauauugacuugua

SEQ ID NO: 1257223 - RNA, 18 nt, Homo sapiens
ugguaauuuuugcuuuuu

SEQ ID NO: 1257224 - RNA, 14 nt, Homo sapiens
ugguacagcacugu

SEQ ID NO: 1257225 - RNA, 21 nt, Homo sapiens
ugguagucacuaacauauaua

SEQ ID NO: 1257226 - RNA, 19 nt, Homo sapiens
ugguaguuguggcuuuuau

SEQ ID NO: 1257227 - RNA, 15 nt, Homo sapiens
ugguauacuuuugcu

SEQ ID NO: 1257228 - RNA, 19 nt, Homo sapiens
ugguauccugugacaugua

SEQ ID NO: 1257229 - RNA, 15 nt, Homo sapiens
uggucaacacuuaag

SEQ ID NO: 1257230 - RNA, 19 nt, Homo sapiens
uggucaauccgaaguauga

SEQ ID NO: 1257231 - RNA, 13 nt, Homo sapiens
uggucaccaaauc

SEQ ID NO: 1257232 - RNA, 15 nt, Homo sapiens
uggucagagugccac

SEQ ID NO: 1257233 - RNA, 17 nt, Homo sapiens
uggucagagugccacug

SEQ ID NO: 1257234 - RNA, 23 nt, Homo sapiens
uggucaggauuccuguugccuuu

SEQ ID NO: 1257235 - RNA, 14 nt, Homo sapiens
uggucaucauggcc

SEQ ID NO: 1257236 - RNA, 18 nt, Homo sapiens
uggucccaagacagugag

SEQ ID NO: 1257237 - RNA, 14 nt, Homo sapiens
ugguccucuuacca

SEQ ID NO: 1257238 - RNA, 17 nt, Homo sapiens
ugguccuuccuaccucu

SEQ ID NO: 1257239 - RNA, 22 nt, Homo sapiens
uggucucaaacuccugaccuca

SEQ ID NO: 1257240 - RNA, 23 nt, Homo sapiens
uggucucgaacuccuggccucaa

SEQ ID NO: 1257241 - RNA, 18 nt, Homo sapiens
uggucuguuugcauuuga

SEQ ID NO: 1257242 - RNA, 18 nt, Homo sapiens
uggucuugagaugucuuc

SEQ ID NO: 1257243 - RNA, 20 nt, Homo sapiens
uggugaacugagcugggcag

SEQ ID NO: 1257244 - RNA, 21 nt, Homo sapiens
uggugaagaguaguuuacuag

SEQ ID NO: 1257245 - RNA, 18 nt, Homo sapiens
uggugaauaacuaugcca

SEQ ID NO: 1257246 - RNA, 12 nt, Homo sapiens
uggugaaugaca

SEQ ID NO: 1257247 - RNA, 18 nt, Homo sapiens
uggugacaccucaccuca

SEQ ID NO: 1257248 - RNA, 14 nt, Homo sapiens
uggugacagucucc

SEQ ID NO: 1257249 - RNA, 16 nt, Homo sapiens
uggugacauuucccaa

SEQ ID NO: 1257250 - RNA, 17 nt, Homo sapiens
ugaaacagccaugucca

SEQ ID NO: 1257251 - RNA, 11 nt, Homo sapiens
ugaaaccaaaa

SEQ ID NO: 1257252 - RNA, 14 nt, Homo sapiens
ugaaaccaaaacau

SEQ ID NO: 1257253 - RNA, 23 nt, Homo sapiens
ugaaacccuuguauaaguaauac

SEQ ID NO: 1257254 - RNA, 19 nt, Homo sapiens
ugaaaccuacacacuguca

SEQ ID NO: 1257255 - RNA, 21 nt, Homo sapiens
ugaaacucauagacacugauc

SEQ ID NO: 1257256 - RNA, 12 nt, Homo sapiens
ugaaacuccauc

SEQ ID NO: 1257257 - RNA, 15 nt, Homo sapiens
ugaaacuccaucuca

SEQ ID NO: 1257258 - RNA, 14 nt, Homo sapiens
ugaaacugcacauu

SEQ ID NO: 1257259 - RNA, 12 nt, Homo sapiens
ugaaagaacaag

SEQ ID NO: 1257260 - RNA, 14 nt, Homo sapiens
ugaaagaaccagag

SEQ ID NO: 1257261 - RNA, 15 nt, Homo sapiens
ugaaagaaccagaga

SEQ ID NO: 1257262 - RNA, 20 nt, Homo sapiens
ugaaagacaccauuuaucua

SEQ ID NO: 1257263 - RNA, 14 nt, Homo sapiens
ugaaagaccuucuc

SEQ ID NO: 1257264 - RNA, 11 nt, Homo sapiens
ugaaagcacag

SEQ ID NO: 1257265 - RNA, 15 nt, Homo sapiens
ugaaagcaguagcau

SEQ ID NO: 1257266 - RNA, 17 nt, Homo sapiens
ugaaagcccaaggugcu

SEQ ID NO: 1257267 - RNA, 21 nt, Homo sapiens
ugaaagcguuuacaugagacu

SEQ ID NO: 1257268 - RNA, 19 nt, Homo sapiens
ugaaagcugagaacuccug

SEQ ID NO: 1257269 - RNA, 23 nt, Homo sapiens
ugaaaggagaugucuuggaacau

SEQ ID NO: 1257270 - RNA, 16 nt, Homo sapiens
ugaaaggauguggaag

SEQ ID NO: 1257271 - RNA, 21 nt, Homo sapiens
ugaaagggaaagucagcuuuc

SEQ ID NO: 1257272 - RNA, 19 nt, Homo sapiens
ugaaaguccagcacuggaa

SEQ ID NO: 1257273 - RNA, 19 nt, Homo sapiens
ugaaaguguuuuacucuuu

SEQ ID NO: 1257274 - RNA, 15 nt, Homo sapiens
ugaaaguuaacauua

SEQ ID NO: 1257275 - RNA, 14 nt, Homo sapiens
ugaaaguuuaacua

SEQ ID NO: 1257276 - RNA, 18 nt, Homo sapiens
ugaaauaaacacuggugc

SEQ ID NO: 1257277 - RNA, 19 nt, Homo sapiens
ugaaauaauguacaucugg

SEQ ID NO: 1257278 - RNA, 23 nt, Homo sapiens
ugaaauaccaaccugaagacacc

SEQ ID NO: 1257279 - RNA, 18 nt, Homo sapiens
ugaaauaccacaagccug

SEQ ID NO: 1257280 - RNA, 23 nt, Homo sapiens
ugaaauacuauuuaaagccuccu

SEQ ID NO: 1257281 - RNA, 15 nt, Homo sapiens
ugaaaucaacugaca

SEQ ID NO: 1257282 - RNA, 20 nt, Homo sapiens
ugaaauccagugagcacuag

SEQ ID NO: 1257283 - RNA, 19 nt, Homo sapiens
ugaaaucuuuaugugauau

SEQ ID NO: 1257284 - RNA, 13 nt, Homo sapiens
ugaaaucuuuuaa

SEQ ID NO: 1257285 - RNA, 15 nt, Homo sapiens
ugaaaugccuggaag

SEQ ID NO: 1257286 - RNA, 15 nt, Homo sapiens
ugaaaugcuggcauu

SEQ ID NO: 1257287 - RNA, 13 nt, Homo sapiens
ugaaaugcuucca

SEQ ID NO: 1257288 - RNA, 18 nt, Homo sapiens
ugaaauguuagucauugu

SEQ ID NO: 1257289 - RNA, 17 nt, Homo sapiens
ugaaauguuugcauaaa

SEQ ID NO: 1257290 - RNA, 16 nt, Homo sapiens
ugaaauuagggcccaa

SEQ ID NO: 1257291 - RNA, 16 nt, Homo sapiens
ugaaauuauacagaua

SEQ ID NO: 1257292 - RNA, 18 nt, Homo sapiens
ugaaauuauuucucucac

SEQ ID NO: 1257293 - RNA, 13 nt, Homo sapiens
ugaaauuuauuca

SEQ ID NO: 1257294 - RNA, 19 nt, Homo sapiens
ugaaauuuggcuaauaaca

SEQ ID NO: 1257295 - RNA, 19 nt, Homo sapiens
ugaaauuuguuauacuuca

SEQ ID NO: 1257296 - RNA, 21 nt, Homo sapiens
ugaaauuuguuauacuucaaa

SEQ ID NO: 1257297 - RNA, 15 nt, Homo sapiens
ugaacaaacaaugaa

SEQ ID NO: 1257298 - RNA, 21 nt, Homo sapiens
ugaacaaacuuagaaagggaa

SEQ ID NO: 1257299 - RNA, 15 nt, Homo sapiens
ugaacaaaugacauc

SEQ ID NO: 1257300 - RNA, 19 nt, Homo sapiens
ugaacaaucaaagcacuug

SEQ ID NO: 1257301 - RNA, 11 nt, Homo sapiens
ugaacacuccc

SEQ ID NO: 1257302 - RNA, 23 nt, Homo sapiens
ugaacacucuacuacaugugacu

SEQ ID NO: 1257303 - RNA, 18 nt, Homo sapiens
ugaacacuggcuaaagau

SEQ ID NO: 1257304 - RNA, 19 nt, Homo sapiens
ugaacacuuauaagugaag

SEQ ID NO: 1257305 - RNA, 23 nt, Homo sapiens
ugaacauaggaaaauagaaacuu

SEQ ID NO: 1257306 - RNA, 16 nt, Homo sapiens
ugaacauccccuccca

SEQ ID NO: 1257307 - RNA, 21 nt, Homo sapiens
ugaacaucccuuuuucaauga

SEQ ID NO: 1257308 - RNA, 11 nt, Homo sapiens
ugaaccaaauu

SEQ ID NO: 1257309 - RNA, 12 nt, Homo sapiens
ugaacccugugc

SEQ ID NO: 1257310 - RNA, 22 nt, Homo sapiens
ugaacggcaucaaggugcugaa

SEQ ID NO: 1257311 - RNA, 22 nt, Homo sapiens
ugaacuaccaucugauguuuca

SEQ ID NO: 1257312 - RNA, 13 nt, Homo sapiens
ugaacucagggag

SEQ ID NO: 1257313 - RNA, 15 nt, Homo sapiens
ugaacucuguaaaac

SEQ ID NO: 1257314 - RNA, 15 nt, Homo sapiens
ugaacuucucucaga

SEQ ID NO: 1257315 - RNA, 20 nt, Homo sapiens
ugaacuuguagcuguaaaac

SEQ ID NO: 1257316 - RNA, 15 nt, Homo sapiens
ugaagaaaauccuaa

SEQ ID NO: 1257317 - RNA, 14 nt, Homo sapiens
ugaagaaacuuccc

SEQ ID NO: 1257318 - RNA, 23 nt, Homo sapiens
ugaagaaagucagcucuugucaa

SEQ ID NO: 1257319 - RNA, 22 nt, Homo sapiens
ugaagaacacagcaugugccaa

SEQ ID NO: 1257320 - RNA, 21 nt, Homo sapiens
ugaagaacaggcuuggcaaag

SEQ ID NO: 1257321 - RNA, 23 nt, Homo sapiens
ugaagaacugcaggcccuggccu

SEQ ID NO: 1257322 - RNA, 16 nt, Homo sapiens
ugaagaagauauguga

SEQ ID NO: 1257323 - RNA, 23 nt, Homo sapiens
ugaagaauauuuaagaaaagcac

SEQ ID NO: 1257324 - RNA, 16 nt, Homo sapiens
ugaagaaugagcaaga

SEQ ID NO: 1257325 - RNA, 17 nt, Homo sapiens
ugaagaaugcauucaaa

SEQ ID NO: 1257326 - RNA, 13 nt, Homo sapiens
ugaagaauguaga

SEQ ID NO: 1257327 - RNA, 13 nt, Homo sapiens
ugaagaauuuaga

SEQ ID NO: 1257328 - RNA, 15 nt, Homo sapiens
ugaagacacacucag

SEQ ID NO: 1257329 - RNA, 22 nt, Homo sapiens
ugaagacccuauuucagaaaua

SEQ ID NO: 1257330 - RNA, 23 nt, Homo sapiens
ugaagagagggacaggcacucca

SEQ ID NO: 1257331 - RNA, 14 nt, Homo sapiens
ucccucuucacucc

SEQ ID NO: 1257332 - RNA, 17 nt, Homo sapiens
ucccucuucugugguca

SEQ ID NO: 1257333 - RNA, 23 nt, Homo sapiens
ucccugaagaucuagugaacauu

SEQ ID NO: 1257334 - RNA, 14 nt, Homo sapiens
ucccugacuguaaa

SEQ ID NO: 1257335 - RNA, 23 nt, Homo sapiens
ucccugcacuaaagccagccuga

SEQ ID NO: 1257336 - RNA, 17 nt, Homo sapiens
ucccugcagaugccacc

SEQ ID NO: 1257337 - RNA, 15 nt, Homo sapiens
ucccugccacauaca

SEQ ID NO: 1257338 - RNA, 12 nt, Homo sapiens
ucccugcucagu

SEQ ID NO: 1257339 - RNA, 18 nt, Homo sapiens
ucccugcucuaacaccug

SEQ ID NO: 1257340 - RNA, 15 nt, Homo sapiens
ucccugcugugccau

SEQ ID NO: 1257341 - RNA, 12 nt, Homo sapiens
ucccuggaugac

SEQ ID NO: 1257342 - RNA, 15 nt, Homo sapiens
ucccuggaugacauu

SEQ ID NO: 1257343 - RNA, 17 nt, Homo sapiens
ucccuggaugacauuaa

SEQ ID NO: 1257344 - RNA, 23 nt, Homo sapiens
ucccuggaugacauuaaagaagg

SEQ ID NO: 1257345 - RNA, 23 nt, Homo sapiens
ucccuggcccccucccuggauga

SEQ ID NO: 1257346 - RNA, 13 nt, Homo sapiens
ucccugggcauug

SEQ ID NO: 1257347 - RNA, 23 nt, Homo sapiens
ucccuguaugucuaccucugacu

SEQ ID NO: 1257348 - RNA, 16 nt, Homo sapiens
ucccugucauuugaac

SEQ ID NO: 1257349 - RNA, 11 nt, Homo sapiens
ucccuguucuc

SEQ ID NO: 1257350 - RNA, 14 nt, Homo sapiens
ucccuguugguucu

SEQ ID NO: 1257351 - RNA, 16 nt, Homo sapiens
ucccuuaauuuaaguc

SEQ ID NO: 1257352 - RNA, 13 nt, Homo sapiens
ucccuucaaugcu

SEQ ID NO: 1257353 - RNA, 19 nt, Homo sapiens
ucccuucccuaaagugaug

SEQ ID NO: 1257354 - RNA, 19 nt, Homo sapiens
ucccuuccggagucuuuga

SEQ ID NO: 1257355 - RNA, 18 nt, Homo sapiens
ucccuucuggacacugag

SEQ ID NO: 1257356 - RNA, 18 nt, Homo sapiens
ucccuucuuggugcuuac

SEQ ID NO: 1257357 - RNA, 13 nt, Homo sapiens
ucccuugcccuuu

SEQ ID NO: 1257358 - RNA, 19 nt, Homo sapiens
ucccuugccucaaugccag

SEQ ID NO: 1257359 - RNA, 14 nt, Homo sapiens
ucccuugcuguaug

SEQ ID NO: 1257360 - RNA, 20 nt, Homo sapiens
ucccuugcuguaugcugauc

SEQ ID NO: 1257361 - RNA, 15 nt, Homo sapiens
ucccuugguggcaag

SEQ ID NO: 1257362 - RNA, 19 nt, Homo sapiens
ucccuuucuugagggaguu

SEQ ID NO: 1257363 - RNA, 16 nt, Homo sapiens
ucccuuugcugcugau

SEQ ID NO: 1257364 - RNA, 21 nt, Homo sapiens
ucccuuuguugcacacucacu

SEQ ID NO: 1257365 - RNA, 15 nt, Homo sapiens
ucccuuuucuguucu

SEQ ID NO: 1257366 - RNA, 21 nt, Homo sapiens
ucccuuuugcuagagcugaca

SEQ ID NO: 1257367 - RNA, 17 nt, Homo sapiens
ucccuuuuuauauccca

SEQ ID NO: 1257368 - RNA, 13 nt, Homo sapiens
uccgaggccagua

SEQ ID NO: 1257369 - RNA, 15 nt, Homo sapiens
uccgaggccaguacc

SEQ ID NO: 1257370 - RNA, 15 nt, Homo sapiens
uccgcaccagcugcu

SEQ ID NO: 1257371 - RNA, 20 nt, Homo sapiens
uccgcagaauggacuugaua

SEQ ID NO: 1257372 - RNA, 22 nt, Homo sapiens
uccgcaggcagacuacacagga

SEQ ID NO: 1257373 - RNA, 16 nt, Homo sapiens
uccgccagauccugca

SEQ ID NO: 1257374 - RNA, 18 nt, Homo sapiens
uccgccuuuuguauacau

SEQ ID NO: 1257375 - RNA, 18 nt, Homo sapiens
uccgcuagcaguacuaau

SEQ ID NO: 1257376 - RNA, 13 nt, Homo sapiens
uccggaauccuug

SEQ ID NO: 1257377 - RNA, 20 nt, Homo sapiens
uccggagugagcaauggagu

SEQ ID NO: 1257378 - RNA, 14 nt, Homo sapiens
uccggcacacugcc

SEQ ID NO: 1257379 - RNA, 15 nt, Homo sapiens
uccgguuaucaagca

SEQ ID NO: 1257380 - RNA, 13 nt, Homo sapiens
uccgugccuccac

SEQ ID NO: 1257381 - RNA, 19 nt, Homo sapiens
uccgugccuccaccaccac

SEQ ID NO: 1257382 - RNA, 21 nt, Homo sapiens
uccuaaacuguuuauuugcac

SEQ ID NO: 1257383 - RNA, 17 nt, Homo sapiens
uccuaaacuuucaaguc

SEQ ID NO: 1257384 - RNA, 16 nt, Homo sapiens
uccuaaaugcagugaa

SEQ ID NO: 1257385 - RNA, 20 nt, Homo sapiens
uccuaaauuugaaauaguga

SEQ ID NO: 1257386 - RNA, 13 nt, Homo sapiens
uccuaacaaaaga

SEQ ID NO: 1257387 - RNA, 21 nt, Homo sapiens
uccuaagcuucaaaucagaag

SEQ ID NO: 1257388 - RNA, 16 nt, Homo sapiens
uccuaaggacacacua

SEQ ID NO: 1257389 - RNA, 21 nt, Homo sapiens
uccuaagggucgaaagcucua

SEQ ID NO: 1257390 - RNA, 15 nt, Homo sapiens
uccuacacacucuga

SEQ ID NO: 1257391 - RNA, 21 nt, Homo sapiens
uccuacacacucugagucucu

SEQ ID NO: 1257392 - RNA, 13 nt, Homo sapiens
uccuacacuugag

SEQ ID NO: 1257393 - RNA, 20 nt, Homo sapiens
uccuaccuguuuugugguca

SEQ ID NO: 1257394 - RNA, 19 nt, Homo sapiens
uccuacgauacgcuacuau

SEQ ID NO: 1257395 - RNA, 18 nt, Homo sapiens
uccuacucugugucaggu

SEQ ID NO: 1257396 - RNA, 13 nt, Homo sapiens
uccuacuuucucc

SEQ ID NO: 1257397 - RNA, 14 nt, Homo sapiens
uccuagacuugaaa

SEQ ID NO: 1257398 - RNA, 21 nt, Homo sapiens
uccuaggggaacagaccagug

SEQ ID NO: 1257399 - RNA, 15 nt, Homo sapiens
uccuaggucaugccu

SEQ ID NO: 1257400 - RNA, 14 nt, Homo sapiens
uccuaguacuuaga

SEQ ID NO: 1257401 - RNA, 14 nt, Homo sapiens
uccuaguuugaccu

SEQ ID NO: 1257402 - RNA, 15 nt, Homo sapiens
uccuauaaucuguca

SEQ ID NO: 1257403 - RNA, 12 nt, Homo sapiens
uccuaucugugu

SEQ ID NO: 1257404 - RNA, 15 nt, Homo sapiens
uccuauguuucacug

SEQ ID NO: 1257405 - RNA, 22 nt, Homo sapiens
uccuauuuauaagagugccgua

SEQ ID NO: 1257406 - RNA, 20 nt, Homo sapiens
uccuauuucuccaaagccuu

SEQ ID NO: 1257407 - RNA, 17 nt, Homo sapiens
uccucaagaaguaauaa

SEQ ID NO: 1257408 - RNA, 15 nt, Homo sapiens
uccucaaguacucaa

SEQ ID NO: 1257409 - RNA, 22 nt, Homo sapiens
uccucacacacccugaggucag

SEQ ID NO: 1257410 - RNA, 16 nt, Homo sapiens
uccucacuguauccag

SEQ ID NO: 1257411 - RNA, 13 nt, Homo sapiens
uccucacuuccau

SEQ ID NO: 1257412 - RNA, 22 nt, Homo sapiens
uccucagagaauuucuaccauu

SEQ ID NO: 1257413 - RNA, 19 nt, Homo sapiens
uccucagagcuaacauaaa

SEQ ID NO: 1257414 - RNA, 21 nt, Homo sapiens
uccucaggugauuuguaugcu

SEQ ID NO: 1257415 - RNA, 19 nt, Homo sapiens
uccucaucuuuaaaaugaa

SEQ ID NO: 1257416 - RNA, 20 nt, Homo sapiens
uccucauugccuccuguucu

SEQ ID NO: 1257417 - RNA, 23 nt, Homo sapiens
uccuccaagaauuugacuuggaa

SEQ ID NO: 1257418 - RNA, 16 nt, Homo sapiens
uccuccacacaaggga

SEQ ID NO: 1257419 - RNA, 16 nt, Homo sapiens
uccuccacagugcugc

SEQ ID NO: 1257420 - RNA, 21 nt, Homo sapiens
uccuccagcccagacccagug

SEQ ID NO: 1257421 - RNA, 22 nt, Homo sapiens
uccuccauaaauuauggcauuu

SEQ ID NO: 1257422 - RNA, 16 nt, Homo sapiens
uccuccaugcucccuu

SEQ ID NO: 1257423 - RNA, 14 nt, Homo sapiens
uccucccucugauu

SEQ ID NO: 1257424 - RNA, 13 nt, Homo sapiens
uccucccugucuc

SEQ ID NO: 1257425 - RNA, 12 nt, Homo sapiens
uccuccguccac

SEQ ID NO: 1257426 - RNA, 15 nt, Homo sapiens
uccuccuacuguauu

SEQ ID NO: 1257427 - RNA, 14 nt, Homo sapiens
uccuccugcugcag

SEQ ID NO: 1257428 - RNA, 21 nt, Homo sapiens
uccuccuuuagaguugcauga

SEQ ID NO: 1257429 - RNA, 19 nt, Homo sapiens
uccucgagaugcucugcug

SEQ ID NO: 1257430 - RNA, 19 nt, Homo sapiens
uccucgcucugggaugcag

SEQ ID NO: 1257431 - RNA, 14 nt, Homo sapiens
uccucggacaccaa

SEQ ID NO: 1257432 - RNA, 22 nt, Homo sapiens
uccucgggccgaggcccagcgg

SEQ ID NO: 1257433 - RNA, 14 nt, Homo sapiens
ucaagugucuucca

SEQ ID NO: 1257434 - RNA, 16 nt, Homo sapiens
ucaaguuaacaaggaa

SEQ ID NO: 1257435 - RNA, 15 nt, Homo sapiens
ucaaguugugcuugu

SEQ ID NO: 1257436 - RNA, 18 nt, Homo sapiens
ucaaguuugaacucugua

SEQ ID NO: 1257437 - RNA, 18 nt, Homo sapiens
ucaauaaaaccacuguac

SEQ ID NO: 1257438 - RNA, 15 nt, Homo sapiens
ucaauaaacacuugu

SEQ ID NO: 1257439 - RNA, 14 nt, Homo sapiens
ucaauacagcuuca

SEQ ID NO: 1257440 - RNA, 12 nt, Homo sapiens
ucaauacuaccu

SEQ ID NO: 1257441 - RNA, 14 nt, Homo sapiens
ucaauacuaccucu

SEQ ID NO: 1257442 - RNA, 21 nt, Homo sapiens
ucaauacuuaaaaauagucuu

SEQ ID NO: 1257443 - RNA, 16 nt, Homo sapiens
ucaaucugcaguuuaa

SEQ ID NO: 1257444 - RNA, 23 nt, Homo sapiens
ucaaucuguccguucacaugugu

SEQ ID NO: 1257445 - RNA, 21 nt, Homo sapiens
ucaaugauuauuuucauuaca

SEQ ID NO: 1257446 - RNA, 14 nt, Homo sapiens
ucaaugcagguuug

SEQ ID NO: 1257447 - RNA, 12 nt, Homo sapiens
ucaaugccuuca

SEQ ID NO: 1257448 - RNA, 16 nt, Homo sapiens
ucaauggaaagcugcu

SEQ ID NO: 1257449 - RNA, 21 nt, Homo sapiens
ucaauggaguaugucugaugg

SEQ ID NO: 1257450 - RNA, 14 nt, Homo sapiens
ucaauggauuugau

SEQ ID NO: 1257451 - RNA, 20 nt, Homo sapiens
ucaaugggcucuuccaacaa

SEQ ID NO: 1257452 - RNA, 16 nt, Homo sapiens
ucaaugugaacacugg

SEQ ID NO: 1257453 - RNA, 17 nt, Homo sapiens
ucaauguucauuguaau

SEQ ID NO: 1257454 - RNA, 22 nt, Homo sapiens
ucaauguuugaaauaguucaaa

SEQ ID NO: 1257455 - RNA, 13 nt, Homo sapiens
ucaauuacaaagc

SEQ ID NO: 1257456 - RNA, 16 nt, Homo sapiens
ucaauuacaacaguga

SEQ ID NO: 1257457 - RNA, 18 nt, Homo sapiens
ucaauuucuugguauuau

SEQ ID NO: 1257458 - RNA, 18 nt, Homo sapiens
ucaauuuguaauugcuua

SEQ ID NO: 1257459 - RNA, 20 nt, Homo sapiens
ucaauuuugucuguacucau

SEQ ID NO: 1257460 - RNA, 21 nt, Homo sapiens
ucacaaaacgaaaugcuauga

SEQ ID NO: 1257461 - RNA, 23 nt, Homo sapiens
ucacaaaguagaggaauccaugu

SEQ ID NO: 1257462 - RNA, 14 nt, Homo sapiens
ucacaaauacauaa

SEQ ID NO: 1257463 - RNA, 16 nt, Homo sapiens
ucacaaauugaucaag

SEQ ID NO: 1257464 - RNA, 22 nt, Homo sapiens
ucacaagaaaacuauaagccaa

SEQ ID NO: 1257465 - RNA, 16 nt, Homo sapiens
ucacaagaaugugcag

SEQ ID NO: 1257466 - RNA, 13 nt, Homo sapiens
ucacaagaauuua

SEQ ID NO: 1257467 - RNA, 14 nt, Homo sapiens
ucacaagaauuuaa

SEQ ID NO: 1257468 - RNA, 18 nt, Homo sapiens
ucacacagggcucuuuga

SEQ ID NO: 1257469 - RNA, 20 nt, Homo sapiens
ucacaccugacucugaaauc

SEQ ID NO: 1257470 - RNA, 22 nt, Homo sapiens
ucacaccugggcaaacuuucuu

SEQ ID NO: 1257471 - RNA, 14 nt, Homo sapiens
ucacacucagaaag

SEQ ID NO: 1257472 - RNA, 22 nt, Homo sapiens
ucacacuguauauaaacauauc

SEQ ID NO: 1257473 - RNA, 18 nt, Homo sapiens
ucacacugugcucagauu

SEQ ID NO: 1257474 - RNA, 16 nt, Homo sapiens
ucacagacccacaaga

SEQ ID NO: 1257475 - RNA, 16 nt, Homo sapiens
ucacagagugcauugu

SEQ ID NO: 1257476 - RNA, 21 nt, Homo sapiens
ucacagccuuucugaggacac

SEQ ID NO: 1257477 - RNA, 16 nt, Homo sapiens
ucacagcuggacccug

SEQ ID NO: 1257478 - RNA, 19 nt, Homo sapiens
ucacaggacucugccuccu

SEQ ID NO: 1257479 - RNA, 20 nt, Homo sapiens
ucacaguccuggacuccugc

SEQ ID NO: 1257480 - RNA, 19 nt, Homo sapiens
ucacagugacccuucccaa

SEQ ID NO: 1257481 - RNA, 19 nt, Homo sapiens
ucacaguuagguagcuuua

SEQ ID NO: 1257482 - RNA, 22 nt, Homo sapiens
ucacauaaaaaagaagcacuuu

SEQ ID NO: 1257483 - RNA, 13 nt, Homo sapiens
ucacaucucugcc

SEQ ID NO: 1257484 - RNA, 22 nt, Homo sapiens
ucacaugcguaaacgacacucu

SEQ ID NO: 1257485 - RNA, 20 nt, Homo sapiens
ucacaugcuagcagcuguga

SEQ ID NO: 1257486 - RNA, 17 nt, Homo sapiens
ucacauggccuaugcac

SEQ ID NO: 1257487 - RNA, 22 nt, Homo sapiens
ucacauggccuaugcacauaug

SEQ ID NO: 1257488 - RNA, 23 nt, Homo sapiens
ucacauggccuaugcacauaugg

SEQ ID NO: 1257489 - RNA, 14 nt, Homo sapiens
ucacauguucuaau

SEQ ID NO: 1257490 - RNA, 14 nt, Homo sapiens
ucacauucuuggcu

SEQ ID NO: 1257491 - RNA, 21 nt, Homo sapiens
ucacauuguuugcugcuauug

SEQ ID NO: 1257492 - RNA, 19 nt, Homo sapiens
ucacauuuagaaaagugaa

SEQ ID NO: 1257493 - RNA, 18 nt, Homo sapiens
ucacauuuuccuuuucaa

SEQ ID NO: 1257494 - RNA, 18 nt, Homo sapiens
ucaccaaaucagcugcua

SEQ ID NO: 1257495 - RNA, 15 nt, Homo sapiens
ucaccaagcccaguu

SEQ ID NO: 1257496 - RNA, 21 nt, Homo sapiens
ucaccaaggaaacgcuaccuc

SEQ ID NO: 1257497 - RNA, 22 nt, Homo sapiens
ucaccacaguuuauugauuuca

SEQ ID NO: 1257498 - RNA, 17 nt, Homo sapiens
ucaccaccaaaugccaa

SEQ ID NO: 1257499 - RNA, 16 nt, Homo sapiens
ucaccacuccauuccc

SEQ ID NO: 1257500 - RNA, 21 nt, Homo sapiens
ucaccagaauauuucuuucau

SEQ ID NO: 1257501 - RNA, 18 nt, Homo sapiens
ucaccagagcauuuccaa

SEQ ID NO: 1257502 - RNA, 20 nt, Homo sapiens
ucaccagucugucuacugug

SEQ ID NO: 1257503 - RNA, 16 nt, Homo sapiens
ucaccaguuuccaggu

SEQ ID NO: 1257504 - RNA, 17 nt, Homo sapiens
ucaccauacacacuguu

SEQ ID NO: 1257505 - RNA, 14 nt, Homo sapiens
ucaccauggccuua

SEQ ID NO: 1257506 - RNA, 19 nt, Homo sapiens
ucacccaggcuggagugca

SEQ ID NO: 1257507 - RNA, 16 nt, Homo sapiens
ucacccaucaaaagca

SEQ ID NO: 1257508 - RNA, 16 nt, Homo sapiens
ucacccauuggugacc

SEQ ID NO: 1257509 - RNA, 18 nt, Homo sapiens
ucaccccaacuaguagcu

SEQ ID NO: 1257510 - RNA, 21 nt, Homo sapiens
ucaccccaaguagucugcuca

SEQ ID NO: 1257511 - RNA, 22 nt, Homo sapiens
ucaccccuguccucacugcucc

SEQ ID NO: 1257512 - RNA, 14 nt, Homo sapiens
ucacccuaccugug

SEQ ID NO: 1257513 - RNA, 18 nt, Homo sapiens
ucacccuggauaggcaag

SEQ ID NO: 1257514 - RNA, 16 nt, Homo sapiens
ucacccuguauguuag

SEQ ID NO: 1257515 - RNA, 15 nt, Homo sapiens
ucacccuuaacccaa

SEQ ID NO: 1257516 - RNA, 21 nt, Homo sapiens
ucacccuuuccggcacacugc

SEQ ID NO: 1257517 - RNA, 14 nt, Homo sapiens
ucaccgacaacaug

SEQ ID NO: 1257518 - RNA, 17 nt, Homo sapiens
ucaccguccucacccau

SEQ ID NO: 1257519 - RNA, 20 nt, Homo sapiens
ucaccuagcagccucaaaac

SEQ ID NO: 1257520 - RNA, 14 nt, Homo sapiens
ucaccuagcucaau

SEQ ID NO: 1257521 - RNA, 17 nt, Homo sapiens
ucaccucccgaagccac

SEQ ID NO: 1257522 - RNA, 15 nt, Homo sapiens
ucaccuccucuguga

SEQ ID NO: 1257523 - RNA, 17 nt, Homo sapiens
ucaccuccucugugauu

SEQ ID NO: 1257524 - RNA, 14 nt, Homo sapiens
ucaccucucaaggu

SEQ ID NO: 1257525 - RNA, 17 nt, Homo sapiens
ucaccucuuaugcacac

SEQ ID NO: 1257526 - RNA, 21 nt, Homo sapiens
ucaccucuuaugcacaccucc

SEQ ID NO: 1257527 - RNA, 15 nt, Homo sapiens
ucaccuggaugugca

SEQ ID NO: 1257528 - RNA, 15 nt, Homo sapiens
ucaccuucuagucuu

SEQ ID NO: 1257529 - RNA, 17 nt, Homo sapiens
ucaccuugguguuucuc

SEQ ID NO: 1257530 - RNA, 21 nt, Homo sapiens
ucaccuuuugaccauaacugu

SEQ ID NO: 1257531 - RNA, 14 nt, Homo sapiens
ucacgccacugcac

SEQ ID NO: 1257532 - RNA, 14 nt, Homo sapiens
ucacggccaagugu

SEQ ID NO: 1257533 - RNA, 17 nt, Homo sapiens
ucacguuuccuuuucau

SEQ ID NO: 1257534 - RNA, 20 nt, Homo sapiens
ucacuaaaacacacaggugc

SEQ ID NO: 1257535 - RNA, 17 nt, Homo sapiens
ucacuaaaauuaaucug

SEQ ID NO: 1257536 - RNA, 15 nt, Homo sapiens
ucacuaaacuuuauu

SEQ ID NO: 1257537 - RNA, 23 nt, Homo sapiens
ucacuaaagcaguagaaauaaua

SEQ ID NO: 1257538 - RNA, 14 nt, Homo sapiens
ucacuaauacuaau

SEQ ID NO: 1257539 - RNA, 19 nt, Homo sapiens
ucacuaaugaucacauucu

SEQ ID NO: 1257540 - RNA, 16 nt, Homo sapiens
ucacuacucagugcau

SEQ ID NO: 1257541 - RNA, 20 nt, Homo sapiens
ucacuagaagaaaagcccau

SEQ ID NO: 1257542 - RNA, 23 nt, Homo sapiens
ucacuagccaugauaacugcaau

SEQ ID NO: 1257543 - RNA, 20 nt, Homo sapiens
ucacuauccaugcaccaaac

SEQ ID NO: 1257544 - RNA, 15 nt, Homo sapiens
ucacuaugguaugcu

SEQ ID NO: 1257545 - RNA, 23 nt, Homo sapiens
ucacuauucccgacccaaagggu

SEQ ID NO: 1257546 - RNA, 14 nt, Homo sapiens
ucacucaccaucug

SEQ ID NO: 1257547 - RNA, 15 nt, Homo sapiens
ucacucacucauucc

SEQ ID NO: 1257548 - RNA, 16 nt, Homo sapiens
ucacucaggacagccc

SEQ ID NO: 1257549 - RNA, 19 nt, Homo sapiens
ucacuccacaacccaagaa

SEQ ID NO: 1257550 - RNA, 12 nt, Homo sapiens
ucacucugucac

SEQ ID NO: 1257551 - RNA, 23 nt, Homo sapiens
ucacucuuugaagcgagcaguca

SEQ ID NO: 1257552 - RNA, 18 nt, Homo sapiens
ucacugaaaccucugccu

SEQ ID NO: 1257553 - RNA, 22 nt, Homo sapiens
ucacugaagaaaccuucagauu

SEQ ID NO: 1257554 - RNA, 19 nt, Homo sapiens
guuuuuguucuuaauugca

SEQ ID NO: 1257555 - RNA, 19 nt, Homo sapiens
guuuuuuauuaugcauuau

SEQ ID NO: 1257556 - RNA, 18 nt, Homo sapiens
uaaaaaaaaaaggaugaa

SEQ ID NO: 1257557 - RNA, 19 nt, Homo sapiens
uaaaaaaaaaaggaugaaa

SEQ ID NO: 1257558 - RNA, 18 nt, Homo sapiens
uaaaaaaaaaauuacuuc

SEQ ID NO: 1257559 - RNA, 19 nt, Homo sapiens
uaaaaaaaaaauuacuucc

SEQ ID NO: 1257560 - RNA, 23 nt, Homo sapiens
uaaaaaaaaauuguaucucauua

SEQ ID NO: 1257561 - RNA, 23 nt, Homo sapiens
uaaaaaaaaugauaaggcucuga

SEQ ID NO: 1257562 - RNA, 22 nt, Homo sapiens
uaaaaaacauaaauuucuuuaa

SEQ ID NO: 1257563 - RNA, 16 nt, Homo sapiens
uaaaaaagaucuccaa

SEQ ID NO: 1257564 - RNA, 15 nt, Homo sapiens
uaaaaaaucaugcca

SEQ ID NO: 1257565 - RNA, 13 nt, Homo sapiens
uaaaaaccaaauu

SEQ ID NO: 1257566 - RNA, 23 nt, Homo sapiens
uaaaaacucuauaaccucagcuu

SEQ ID NO: 1257567 - RNA, 17 nt, Homo sapiens
uaaaaacucuucagugc

SEQ ID NO: 1257568 - RNA, 23 nt, Homo sapiens
uaaaaacuuccuucaaucuucau

SEQ ID NO: 1257569 - RNA, 13 nt, Homo sapiens
uaaaaacuuuauu

SEQ ID NO: 1257570 - RNA, 16 nt, Homo sapiens
uaaaaagaaaaaccac

SEQ ID NO: 1257571 - RNA, 18 nt, Homo sapiens
uaaaaagcagcugcauuu

SEQ ID NO: 1257572 - RNA, 13 nt, Homo sapiens
uaaaaagcauuau

SEQ ID NO: 1257573 - RNA, 20 nt, Homo sapiens
uaaaaagccugcaauuucau

SEQ ID NO: 1257574 - RNA, 15 nt, Homo sapiens
uaaaaagucuucacu

SEQ ID NO: 1257575 - RNA, 13 nt, Homo sapiens
uaaaaagugacac

SEQ ID NO: 1257576 - RNA, 20 nt, Homo sapiens
uaaaaagugacacagcagcu

SEQ ID NO: 1257577 - RNA, 19 nt, Homo sapiens
uaaaaaguuucuaaagugu

SEQ ID NO: 1257578 - RNA, 16 nt, Homo sapiens
uaaaaauaaaagcagu

SEQ ID NO: 1257579 - RNA, 17 nt, Homo sapiens
uaaaaauaaacaaaaag

SEQ ID NO: 1257580 - RNA, 18 nt, Homo sapiens
uaaaaauaaaucccaugg

SEQ ID NO: 1257581 - RNA, 22 nt, Homo sapiens
uaaaaauaaaucccauggaaua

SEQ ID NO: 1257582 - RNA, 13 nt, Homo sapiens
uaaaaauagacac

SEQ ID NO: 1257583 - RNA, 19 nt, Homo sapiens
uaaaaauauagcaaaugca

SEQ ID NO: 1257584 - RNA, 17 nt, Homo sapiens
uaaaaaucacacuguaa

SEQ ID NO: 1257585 - RNA, 18 nt, Homo sapiens
uaaaaaugagugcuuaaa

SEQ ID NO: 1257586 - RNA, 15 nt, Homo sapiens
uaaaaaugcugcucu

SEQ ID NO: 1257587 - RNA, 18 nt, Homo sapiens
uaaaaauggccauuugcu

SEQ ID NO: 1257588 - RNA, 16 nt, Homo sapiens
uaaaaauugacaauga

SEQ ID NO: 1257589 - RNA, 23 nt, Homo sapiens
uaaaaauugugaucagaccauaa

SEQ ID NO: 1257590 - RNA, 23 nt, Homo sapiens
uaaaacaaaaucugaacucucaa

SEQ ID NO: 1257591 - RNA, 16 nt, Homo sapiens
uaaaacaaaauuugac

SEQ ID NO: 1257592 - RNA, 17 nt, Homo sapiens
uaaaacaaaauuugacu

SEQ ID NO: 1257593 - RNA, 20 nt, Homo sapiens
uaaaacaacacucacauuua

SEQ ID NO: 1257594 - RNA, 22 nt, Homo sapiens
uaaaacaaucuguaauugcuua

SEQ ID NO: 1257595 - RNA, 22 nt, Homo sapiens
uaaaacagccaaaacuccacag

SEQ ID NO: 1257596 - RNA, 18 nt, Homo sapiens
uaaaacaugcugaaaacu

SEQ ID NO: 1257597 - RNA, 14 nt, Homo sapiens
uaaaacuaagcaca

SEQ ID NO: 1257598 - RNA, 16 nt, Homo sapiens
uaaaacuacaugguca

SEQ ID NO: 1257599 - RNA, 16 nt, Homo sapiens
uaaaacucacugugau

SEQ ID NO: 1257600 - RNA, 17 nt, Homo sapiens
uaaaacucgcuuuuauu

SEQ ID NO: 1257601 - RNA, 16 nt, Homo sapiens
uaaaacugauguuacu

SEQ ID NO: 1257602 - RNA, 21 nt, Homo sapiens
uaaaacugauuuuuagcuuua

SEQ ID NO: 1257603 - RNA, 12 nt, Homo sapiens
uaaaacugcaca

SEQ ID NO: 1257604 - RNA, 17 nt, Homo sapiens
uaaaacuuaacauucau

SEQ ID NO: 1257605 - RNA, 16 nt, Homo sapiens
uaaaacuuaugcuagu

SEQ ID NO: 1257606 - RNA, 12 nt, Homo sapiens
uaaaacuuuccu

SEQ ID NO: 1257607 - RNA, 19 nt, Homo sapiens
uaaaacuuuucugcugaua

SEQ ID NO: 1257608 - RNA, 23 nt, Homo sapiens
uaaaagaaccgagcaauuuucug

SEQ ID NO: 1257609 - RNA, 14 nt, Homo sapiens
uaaaagagccuagu

SEQ ID NO: 1257610 - RNA, 16 nt, Homo sapiens
uaaaagauaaguuugu

SEQ ID NO: 1257611 - RNA, 19 nt, Homo sapiens
uaaaagaugguaaaccaga

SEQ ID NO: 1257612 - RNA, 17 nt, Homo sapiens
uaaaagcacaaguacuu

SEQ ID NO: 1257613 - RNA, 16 nt, Homo sapiens
uaaaagcaugucaaca

SEQ ID NO: 1257614 - RNA, 16 nt, Homo sapiens
uaaaagcuacuaugua

SEQ ID NO: 1257615 - RNA, 19 nt, Homo sapiens
uaaaagguagagucuuaca

SEQ ID NO: 1257616 - RNA, 24 nt, Homo sapiens
uaaaagguauacuuuaguagacau

SEQ ID NO: 1257617 - RNA, 18 nt, Homo sapiens
uaaaaguaaaggaugcuu

SEQ ID NO: 1257618 - RNA, 21 nt, Homo sapiens
uaaaagugaaugaaagauuaa

SEQ ID NO: 1257619 - RNA, 20 nt, Homo sapiens
uaaaaguuacuuaccacaga

SEQ ID NO: 1257620 - RNA, 16 nt, Homo sapiens
uaaaauaaaccaaaua

SEQ ID NO: 1257621 - RNA, 14 nt, Homo sapiens
uaaaauaaauuccu

SEQ ID NO: 1257622 - RNA, 22 nt, Homo sapiens
uaaaauaacaguaugugggaua

SEQ ID NO: 1257623 - RNA, 18 nt, Homo sapiens
uaaaauaagcacugugcu

SEQ ID NO: 1257624 - RNA, 16 nt, Homo sapiens
uaaaauaauaacaauc

SEQ ID NO: 1257625 - RNA, 22 nt, Homo sapiens
uaaaauagaaacauuuguaugg

SEQ ID NO: 1257626 - RNA, 12 nt, Homo sapiens
uaaaauagagua

SEQ ID NO: 1257627 - RNA, 14 nt, Homo sapiens
uaaaauauaaucua

SEQ ID NO: 1257628 - RNA, 18 nt, Homo sapiens
uaaaauauauuucagaua

SEQ ID NO: 1257629 - RNA, 16 nt, Homo sapiens
uaaaauccuaagacac

SEQ ID NO: 1257630 - RNA, 23 nt, Homo sapiens
uaaaauccuaagacacaaaugca

SEQ ID NO: 1257631 - RNA, 21 nt, Homo sapiens
uaaaaucuuauaguucuaggc

SEQ ID NO: 1257632 - RNA, 19 nt, Homo sapiens
uaaaaucuuggcacagaaa

SEQ ID NO: 1257633 - RNA, 16 nt, Homo sapiens
uaaaauguuuaaugaa

SEQ ID NO: 1257634 - RNA, 20 nt, Homo sapiens
uaaaauguuuguuaaagcua

SEQ ID NO: 1257635 - RNA, 18 nt, Homo sapiens
uaaaauuagaugaacuca

SEQ ID NO: 1257636 - RNA, 23 nt, Homo sapiens
uaaaauuaugaaucugauuuuua

SEQ ID NO: 1257637 - RNA, 13 nt, Homo sapiens
uaaaauuauuuca

SEQ ID NO: 1257638 - RNA, 15 nt, Homo sapiens
uaaaauuauuuuucc

SEQ ID NO: 1257639 - RNA, 17 nt, Homo sapiens
uaaaauucagaugcugu

SEQ ID NO: 1257640 - RNA, 12 nt, Homo sapiens
uaaaauucauuu

SEQ ID NO: 1257641 - RNA, 15 nt, Homo sapiens
uaaaauucuauuaua

SEQ ID NO: 1257642 - RNA, 12 nt, Homo sapiens
uaaaauugcuau

SEQ ID NO: 1257643 - RNA, 15 nt, Homo sapiens
uaaaauuguaugaaa

SEQ ID NO: 1257644 - RNA, 11 nt, Homo sapiens
uaaaauuguga

SEQ ID NO: 1257645 - RNA, 14 nt, Homo sapiens
uaaaauugugcaua

SEQ ID NO: 1257646 - RNA, 15 nt, Homo sapiens
uaaaauuucuaagag

SEQ ID NO: 1257647 - RNA, 14 nt, Homo sapiens
uaaaauuugugcug

SEQ ID NO: 1257648 - RNA, 16 nt, Homo sapiens
uaaacaaacauugugu

SEQ ID NO: 1257649 - RNA, 20 nt, Homo sapiens
uaaacaagaguuuucuuccu

SEQ ID NO: 1257650 - RNA, 20 nt, Homo sapiens
aaacucacagaacuauguac

SEQ ID NO: 1257651 - RNA, 17 nt, Homo sapiens
aaacucaccuugucuca

SEQ ID NO: 1257652 - RNA, 12 nt, Homo sapiens
aaacucagggac

SEQ ID NO: 1257653 - RNA, 20 nt, Homo sapiens
aaacucagggacagagccau

SEQ ID NO: 1257654 - RNA, 14 nt, Homo sapiens
aaacuccuacuaaa

SEQ ID NO: 1257655 - RNA, 17 nt, Homo sapiens
aaacuccuuuugguuua

SEQ ID NO: 1257656 - RNA, 18 nt, Homo sapiens
aaacucuacuuaauccaa

SEQ ID NO: 1257657 - RNA, 20 nt, Homo sapiens
aaacucucugguuuacuuca

SEQ ID NO: 1257658 - RNA, 22 nt, Homo sapiens
aaacucuguccacgauucacuc

SEQ ID NO: 1257659 - RNA, 21 nt, Homo sapiens
aaacucuucgggagacauguu

SEQ ID NO: 1257660 - RNA, 20 nt, Homo sapiens
aaacucuugaccucagguga

SEQ ID NO: 1257661 - RNA, 17 nt, Homo sapiens
aaacugaaaaucuaaua

SEQ ID NO: 1257662 - RNA, 15 nt, Homo sapiens
aaacugaauuuguac

SEQ ID NO: 1257663 - RNA, 14 nt, Homo sapiens
aaacugaugacuua

SEQ ID NO: 1257664 - RNA, 21 nt, Homo sapiens
aaacugauuucuucagaauua

SEQ ID NO: 1257665 - RNA, 23 nt, Homo sapiens
aaacugcaauagagacuguagau

SEQ ID NO: 1257666 - RNA, 14 nt, Homo sapiens
aaacugcacauugg

SEQ ID NO: 1257667 - RNA, 23 nt, Homo sapiens
aaacugcuucccuuacuuugcug

SEQ ID NO: 1257668 - RNA, 23 nt, Homo sapiens
aaacuggaguaucauucuuuaca

SEQ ID NO: 1257669 - RNA, 18 nt, Homo sapiens
aaacugguuuguugcagc

SEQ ID NO: 1257670 - RNA, 16 nt, Homo sapiens
aaacuguccaccaaga

SEQ ID NO: 1257671 - RNA, 18 nt, Homo sapiens
aaacugucuuuaaaagag

SEQ ID NO: 1257672 - RNA, 21 nt, Homo sapiens
aaacugugaagcauuuacaga

SEQ ID NO: 1257673 - RNA, 13 nt, Homo sapiens
aaacuguggugcu

SEQ ID NO: 1257674 - RNA, 20 nt, Homo sapiens
aaacuguuccaaucaugaaa

SEQ ID NO: 1257675 - RNA, 22 nt, Homo sapiens
aaacuuaagggaaaaguucucc

SEQ ID NO: 1257676 - RNA, 16 nt, Homo sapiens
aaacuuagaaagggaa

SEQ ID NO: 1257677 - RNA, 19 nt, Homo sapiens
aaacuuagaucaucaguca

SEQ ID NO: 1257678 - RNA, 13 nt, Homo sapiens
aaacuuagccaga

SEQ ID NO: 1257679 - RNA, 13 nt, Homo sapiens
aaacuucaaagag

SEQ ID NO: 1257680 - RNA, 12 nt, Homo sapiens
aaacuucaccua

SEQ ID NO: 1257681 - RNA, 21 nt, Homo sapiens
aaacuucaccuacauuaucuc

SEQ ID NO: 1257682 - RNA, 17 nt, Homo sapiens
aaacuucacuaaugauc

SEQ ID NO: 1257683 - RNA, 13 nt, Homo sapiens
aaacuuccaguca

SEQ ID NO: 1257684 - RNA, 22 nt, Homo sapiens
aaacuugccuggggucugagca

SEQ ID NO: 1257685 - RNA, 15 nt, Homo sapiens
aaacuugcuuaucaa

SEQ ID NO: 1257686 - RNA, 18 nt, Homo sapiens
aaacuuggauacuuggau

SEQ ID NO: 1257687 - RNA, 19 nt, Homo sapiens
aaacuugugagguguuugc

SEQ ID NO: 1257688 - RNA, 23 nt, Homo sapiens
aaacuuguuauugugaaugauuc

SEQ ID NO: 1257689 - RNA, 16 nt, Homo sapiens
aaacuuuaaugaacua

SEQ ID NO: 1257690 - RNA, 17 nt, Homo sapiens
aaacuuuagaguagcau

SEQ ID NO: 1257691 - RNA, 21 nt, Homo sapiens
aaacuuuagaguagcaugaga

SEQ ID NO: 1257692 - RNA, 23 nt, Homo sapiens
aaacuuuaggcccugccccagau

SEQ ID NO: 1257693 - RNA, 18 nt, Homo sapiens
aaacuuuccugacuuaca

SEQ ID NO: 1257694 - RNA, 22 nt, Homo sapiens
aaacuuuccugacuuacaauac

SEQ ID NO: 1257695 - RNA, 19 nt, Homo sapiens
aaacuuuuuuucuguacca

SEQ ID NO: 1257696 - RNA, 13 nt, Homo sapiens
aaagaaaaaccac

SEQ ID NO: 1257697 - RNA, 23 nt, Homo sapiens
aaagaaaaauaucuuggccuaaa

SEQ ID NO: 1257698 - RNA, 16 nt, Homo sapiens
aaagaaauuccccaag

SEQ ID NO: 1257699 - RNA, 19 nt, Homo sapiens
aaagaacaaauaaaugagc

SEQ ID NO: 1257700 - RNA, 13 nt, Homo sapiens
aaagaaccagaga

SEQ ID NO: 1257701 - RNA, 13 nt, Homo sapiens
aaagaagcaagga

SEQ ID NO: 1257702 - RNA, 20 nt, Homo sapiens
aaagaagguguuuuccugaa

SEQ ID NO: 1257703 - RNA, 21 nt, Homo sapiens
aaagaagguuggugaauuuca

SEQ ID NO: 1257704 - RNA, 20 nt, Homo sapiens
aaagaauaguaguaacuguu

SEQ ID NO: 1257705 - RNA, 22 nt, Homo sapiens
aaagaauccauaaaaaguaaua

SEQ ID NO: 1257706 - RNA, 18 nt, Homo sapiens
aaagaaucgccaugccca

SEQ ID NO: 1257707 - RNA, 15 nt, Homo sapiens
aaagaauucugugag

SEQ ID NO: 1257708 - RNA, 16 nt, Homo sapiens
aaagaauuuuaccauu

SEQ ID NO: 1257709 - RNA, 14 nt, Homo sapiens
aaagacaccauuua

SEQ ID NO: 1257710 - RNA, 15 nt, Homo sapiens
aaagacaguauuuau

SEQ ID NO: 1257711 - RNA, 15 nt, Homo sapiens
aaagacagucauaua

SEQ ID NO: 1257712 - RNA, 17 nt, Homo sapiens
aaagacaucagucucca

SEQ ID NO: 1257713 - RNA, 12 nt, Homo sapiens
aaagaccaguuu

SEQ ID NO: 1257714 - RNA, 20 nt, Homo sapiens
aaagaccaguuuccauuuau

SEQ ID NO: 1257715 - RNA, 14 nt, Homo sapiens
aaagaccuaccucc

SEQ ID NO: 1257716 - RNA, 14 nt, Homo sapiens
aaagaccuaugagc

SEQ ID NO: 1257717 - RNA, 19 nt, Homo sapiens
aaagaccugaauaccacuu

SEQ ID NO: 1257718 - RNA, 14 nt, Homo sapiens
aaagacucugacca

SEQ ID NO: 1257719 - RNA, 23 nt, Homo sapiens
aaagacugaaucuaccugcccua

SEQ ID NO: 1257720 - RNA, 21 nt, Homo sapiens
aaagacuguagaagaaagagc

SEQ ID NO: 1257721 - RNA, 18 nt, Homo sapiens
aaagacuuaacugguuca

SEQ ID NO: 1257722 - RNA, 16 nt, Homo sapiens
aauuuucugaaaguua

SEQ ID NO: 1257723 - RNA, 21 nt, Homo sapiens
aauuuugccauaaagucaaau

SEQ ID NO: 1257724 - RNA, 12 nt, Homo sapiens
aauuuugcugga

SEQ ID NO: 1257725 - RNA, 20 nt, Homo sapiens
aauuuuguuuaaaacucaga

SEQ ID NO: 1257726 - RNA, 19 nt, Homo sapiens
aauuuuguuuguugaugug

SEQ ID NO: 1257727 - RNA, 14 nt, Homo sapiens
aauuuuuccaugaa

SEQ ID NO: 1257728 - RNA, 22 nt, Homo sapiens
aauuuuucugugcucaaugugu

SEQ ID NO: 1257729 - RNA, 21 nt, Homo sapiens
aauuuuuuaguauaaguacau

SEQ ID NO: 1257730 - RNA, 23 nt, Homo sapiens
aauuuuuuaguauaaguacauua

SEQ ID NO: 1257731 - RNA, 16 nt, Homo sapiens
acaaaaaaagauuuaa

SEQ ID NO: 1257732 - RNA, 13 nt, Homo sapiens
acaaaaaauacuu

SEQ ID NO: 1257733 - RNA, 13 nt, Homo sapiens
aagagcaaaaaua

SEQ ID NO: 1257734 - RNA, 13 nt, Homo sapiens
aagagcaacaauc

SEQ ID NO: 1257735 - RNA, 13 nt, Homo sapiens
aagagcacacaga

SEQ ID NO: 1257736 - RNA, 20 nt, Homo sapiens
aagagcauggaugcauuuca

SEQ ID NO: 1257737 - RNA, 20 nt, Homo sapiens
aagagccauauaaguuugaa

SEQ ID NO: 1257738 - RNA, 22 nt, Homo sapiens
aagagcccccuugacaccgggg

SEQ ID NO: 1257739 - RNA, 22 nt, Homo sapiens
aagagcccucaagcggcccuua

SEQ ID NO: 1257740 - RNA, 21 nt, Homo sapiens
aagagcugccuggaugagaaa

SEQ ID NO: 1257741 - RNA, 21 nt, Homo sapiens
aagagcuggaugcacaucagg

SEQ ID NO: 1257742 - RNA, 16 nt, Homo sapiens
aagagcuuaagaacca

SEQ ID NO: 1257743 - RNA, 15 nt, Homo sapiens
aagaggaacuugacc

SEQ ID NO: 1257744 - RNA, 21 nt, Homo sapiens
aagaggacuguguuguggucu

SEQ ID NO: 1257745 - RNA, 15 nt, Homo sapiens
aagaggcugcugcag

SEQ ID NO: 1257746 - RNA, 13 nt, Homo sapiens
aagagggcuuccu

SEQ ID NO: 1257747 - RNA, 16 nt, Homo sapiens
aagagggucugaggaa

SEQ ID NO: 1257748 - RNA, 14 nt, Homo sapiens
aagaggucugagcc

SEQ ID NO: 1257749 - RNA, 16 nt, Homo sapiens
aagagguuuguauaua

SEQ ID NO: 1257750 - RNA, 13 nt, Homo sapiens
aagaguaguaaua

SEQ ID NO: 1257751 - RNA, 14 nt, Homo sapiens
aagaguaguaauag

SEQ ID NO: 1257752 - RNA, 14 nt, Homo sapiens
aagaguaguuauua

SEQ ID NO: 1257753 - RNA, 23 nt, Homo sapiens
aagaguaguuauuaguucugcuu

SEQ ID NO: 1257754 - RNA, 16 nt, Homo sapiens
aacuucaauuuacuua

SEQ ID NO: 1257755 - RNA, 20 nt, Homo sapiens
aacuucaccuacauuaucuc

SEQ ID NO: 1257756 - RNA, 16 nt, Homo sapiens
aacuucagguggauga

SEQ ID NO: 1257757 - RNA, 20 nt, Homo sapiens
aacuucaguccaacugucaa

SEQ ID NO: 1257758 - RNA, 23 nt, Homo sapiens
aacuuccacauuauacauuugau

SEQ ID NO: 1257759 - RNA, 23 nt, Homo sapiens
aacuucccugauugaccugcucc

SEQ ID NO: 1257760 - RNA, 22 nt, Homo sapiens
aacuucccuuaagagucaucca

SEQ ID NO: 1257761 - RNA, 12 nt, Homo sapiens
aacuuccuucuc

SEQ ID NO: 1257762 - RNA, 18 nt, Homo sapiens
aacuucuugcuucuuucu

SEQ ID NO: 1257763 - RNA, 16 nt, Homo sapiens
aacuugaaaauauaug

SEQ ID NO: 1257764 - RNA, 15 nt, Homo sapiens
aacuugaaacagauu

SEQ ID NO: 1257765 - RNA, 16 nt, Homo sapiens
aacuugagggcccaga

SEQ ID NO: 1257766 - RNA, 20 nt, Homo sapiens
aacuugcacgacgccugcca

SEQ ID NO: 1257767 - RNA, 16 nt, Homo sapiens
aacuugcauugugauu

SEQ ID NO: 1257768 - RNA, 12 nt, Homo sapiens
aacuugcuacag

SEQ ID NO: 1257769 - RNA, 15 nt, Homo sapiens
aacuugcugcugagu

SEQ ID NO: 1257770 - RNA, 20 nt, Homo sapiens
aacuuggaaugcaagcugga

SEQ ID NO: 1257771 - RNA, 15 nt, Homo sapiens
aacuuggcacacucu

SEQ ID NO: 1257772 - RNA, 18 nt, Homo sapiens
aacuuggcacacucucca

SEQ ID NO: 1257773 - RNA, 18 nt, Homo sapiens
aacuuguauuaaagacag

SEQ ID NO: 1257774 - RNA, 15 nt, Homo sapiens
aacuuguauuuccaa

SEQ ID NO: 1257775 - RNA, 19 nt, Homo sapiens
aacuuguuugcugugaaca

SEQ ID NO: 1257776 - RNA, 22 nt, Homo sapiens
aacuuuacuguccuaacauggu

SEQ ID NO: 1257777 - RNA, 16 nt, Homo sapiens
aacuuuaucuaaagaa

SEQ ID NO: 1257778 - RNA, 14 nt, Homo sapiens
aacuuucacuuuga

SEQ ID NO: 1257779 - RNA, 23 nt, Homo sapiens
aacuuucaggggcugacucucca

SEQ ID NO: 1257780 - RNA, 15 nt, Homo sapiens
aaccucuagagucac

SEQ ID NO: 1257781 - RNA, 18 nt, Homo sapiens
aaccucuagagucacuga

SEQ ID NO: 1257782 - RNA, 14 nt, Homo sapiens
aaccucuaugcaau

SEQ ID NO: 1257783 - RNA, 18 nt, Homo sapiens
aaccucucuucuaccuua

SEQ ID NO: 1257784 - RNA, 20 nt, Homo sapiens
aaccucugccuuccagguuc

SEQ ID NO: 1257785 - RNA, 20 nt, Homo sapiens
aaccucuucaugagcuugaa

SEQ ID NO: 1257786 - RNA, 21 nt, Homo sapiens
aaccugcagggacuccaugcu

SEQ ID NO: 1257787 - RNA, 13 nt, Homo sapiens
aaccugcucuccu

SEQ ID NO: 1257788 - RNA, 23 nt, Homo sapiens
aaccuggaccccuucggcagcua

SEQ ID NO: 1257789 - RNA, 22 nt, Homo sapiens
aaccugggagccggaggcugca

SEQ ID NO: 1257790 - RNA, 19 nt, Homo sapiens
aaccugguggcaccagaug

SEQ ID NO: 1257791 - RNA, 18 nt, Homo sapiens
aaccugucuccacugugc

SEQ ID NO: 1257792 - RNA, 13 nt, Homo sapiens
aaccugugccagg

SEQ ID NO: 1257793 - RNA, 17 nt, Homo sapiens
aaccuuaaauauauaau

SEQ ID NO: 1257794 - RNA, 13 nt, Homo sapiens
aaccuuaauugac

SEQ ID NO: 1257795 - RNA, 15 nt, Homo sapiens
aaccuucaacccagu

SEQ ID NO: 1257796 - RNA, 18 nt, Homo sapiens
aaccuugaccgacaugaa

SEQ ID NO: 1257797 - RNA, 23 nt, Homo sapiens
aaccuuuucaccuccaacuggau

SEQ ID NO: 1257798 - RNA, 20 nt, Homo sapiens
aacgaagaguucccuugaaa

SEQ ID NO: 1257799 - RNA, 17 nt, Homo sapiens
aacgaaucgauucugca

SEQ ID NO: 1257800 - RNA, 19 nt, Homo sapiens
aacgacuacccagaagugu

SEQ ID NO: 1257801 - RNA, 23 nt, Homo sapiens
aacgauuuuaugaaaugaccucu

SEQ ID NO: 1257802 - RNA, 12 nt, Homo sapiens
aacgcacaggaa

SEQ ID NO: 1257803 - RNA, 22 nt, Homo sapiens
aacgcagaagaaaggguggaaa

SEQ ID NO: 1257804 - RNA, 19 nt, Homo sapiens
aacgcaggagaaucacugc

SEQ ID NO: 1257805 - RNA, 11 nt, Homo sapiens
aacgccagucu

SEQ ID NO: 1257806 - RNA, 19 nt, Homo sapiens
aacgcccuuuccuccucag

SEQ ID NO: 1257807 - RNA, 14 nt, Homo sapiens
aacgccuggugccc

SEQ ID NO: 1257808 - RNA, 17 nt, Homo sapiens
aacgcuuuuugggagaa

SEQ ID NO: 1257809 - RNA, 23 nt, Homo sapiens
aacggcuaaccuggaccuggaac

SEQ ID NO: 1257810 - RNA, 22 nt, Homo sapiens
aaauguuauuuuuuaauuauua

SEQ ID NO: 1257811 - RNA, 23 nt, Homo sapiens
aaauguuccauauguggguguca

SEQ ID NO: 1257812 - RNA, 17 nt, Homo sapiens
aaauguucuaacagauc

SEQ ID NO: 1257813 - RNA, 12 nt, Homo sapiens
aaauguuugaua

SEQ ID NO: 1257814 - RNA, 16 nt, Homo sapiens
aaauguuuuacucaga

SEQ ID NO: 1257815 - RNA, 18 nt, Homo sapiens
aaauuaaacaaauaugca

SEQ ID NO: 1257816 - RNA, 22 nt, Homo sapiens
aaauuaaagccuuuaguaucag

SEQ ID NO: 1257817 - RNA, 17 nt, Homo sapiens
aaauuaacaguccuaac

SEQ ID NO: 1257818 - RNA, 12 nt, Homo sapiens
aaauuaagaagg

SEQ ID NO: 1257819 - RNA, 15 nt, Homo sapiens
aaauuaagaaggcaa

SEQ ID NO: 1257820 - RNA, 16 nt, Homo sapiens
aaauuacaauugucau

SEQ ID NO: 1257821 - RNA, 18 nt, Homo sapiens
aaauuacugauccucgca

SEQ ID NO: 1257822 - RNA, 18 nt, Homo sapiens
aaauuacuggaaggcuuc

SEQ ID NO: 1257823 - RNA, 14 nt, Homo sapiens
aaauuacuguguaa

SEQ ID NO: 1257824 - RNA, 20 nt, Homo sapiens
aaauuagaaaguagccacgu

SEQ ID NO: 1257825 - RNA, 15 nt, Homo sapiens
aaauuagauuuggca

SEQ ID NO: 1257826 - RNA, 15 nt, Homo sapiens
aaauuagccagacau

SEQ ID NO: 1257827 - RNA, 17 nt, Homo sapiens
aaauuagcugugugaaa

SEQ ID NO: 1257828 - RNA, 13 nt, Homo sapiens
aaauuagcuugag

SEQ ID NO: 1257829 - RNA, 20 nt, Homo sapiens
aaauuaguuucaaauuuacc

SEQ ID NO: 1257830 - RNA, 17 nt, Homo sapiens
aaauuauuucucucaca

SEQ ID NO: 1257831 - RNA, 20 nt, Homo sapiens
aaauucaaaaccugcaguua

SEQ ID NO: 1257832 - RNA, 15 nt, Homo sapiens
aaauucaagccuuag

SEQ ID NO: 1257833 - RNA, 18 nt, Homo sapiens
aaauucaauuaggauuaa

SEQ ID NO: 1257834 - RNA, 11 nt, Homo sapiens
aaauucacugu

SEQ ID NO: 1257835 - RNA, 17 nt, Homo sapiens
aaauucagaugcuguua

SEQ ID NO: 1257836 - RNA, 15 nt, Homo sapiens
aaauucaugcacuuu

SEQ ID NO: 1257837 - RNA, 22 nt, Homo sapiens
aaauucauuuuuuucacuggag

SEQ ID NO: 1257838 - RNA, 19 nt, Homo sapiens
aaauuccacacuaccacau

SEQ ID NO: 1257839 - RNA, 18 nt, Homo sapiens
aaauuccuacaacuuaau

SEQ ID NO: 1257840 - RNA, 15 nt, Homo sapiens
aaauucuacaacuuu

SEQ ID NO: 1257841 - RNA, 17 nt, Homo sapiens
aaauucugaugagcauu

SEQ ID NO: 1257842 - RNA, 18 nt, Homo sapiens
aaauucugaugagcauua

SEQ ID NO: 1257843 - RNA, 22 nt, Homo sapiens
aaauucuuaacuuuuaacauaa

SEQ ID NO: 1257844 - RNA, 17 nt, Homo sapiens
aaauugagacauuuaca

SEQ ID NO: 1257845 - RNA, 19 nt, Homo sapiens
aaauugagaccugagugaa

SEQ ID NO: 1257846 - RNA, 20 nt, Homo sapiens
aaauugcaucagugaucaua

SEQ ID NO: 1257847 - RNA, 14 nt, Homo sapiens
aaauugccugcaaa

SEQ ID NO: 1257848 - RNA, 17 nt, Homo sapiens
aaauugggaaaacucca

SEQ ID NO: 1257849 - RNA, 22 nt, Homo sapiens
aaauuguauacauuuuguuaua

SEQ ID NO: 1257850 - RNA, 16 nt, Homo sapiens
aaaacuauuugggaua

SEQ ID NO: 1257851 - RNA, 15 nt, Homo sapiens
aaaacucacugugau

SEQ ID NO: 1257852 - RNA, 20 nt, Homo sapiens
aaaacucauuacuuuuccau

SEQ ID NO: 1257853 - RNA, 22 nt, Homo sapiens
aaaacucugggaaauaagagag

SEQ ID NO: 1257854 - RNA, 16 nt, Homo sapiens
aaaacugauguuacua

SEQ ID NO: 1257855 - RNA, 17 nt, Homo sapiens
aaaacugauuuuuagcu

SEQ ID NO: 1257856 - RNA, 15 nt, Homo sapiens
aaaacuguuaccuaa

SEQ ID NO: 1257857 - RNA, 16 nt, Homo sapiens
aaaacuucaguaagua

SEQ ID NO: 1257858 - RNA, 19 nt, Homo sapiens
aaaacuucaguaaguacgu

SEQ ID NO: 1257859 - RNA, 11 nt, Homo sapiens
aaaacuuuauu

SEQ ID NO: 1257860 - RNA, 16 nt, Homo sapiens
aaaagaaaagccgaaa

SEQ ID NO: 1257861 - RNA, 13 nt, Homo sapiens
aaaagaacauaaa

SEQ ID NO: 1257862 - RNA, 16 nt, Homo sapiens
aaaagaagacucugac

SEQ ID NO: 1257863 - RNA, 16 nt, Homo sapiens
aaaagaauacagaaag

SEQ ID NO: 1257864 - RNA, 20 nt, Homo sapiens
aaaagacauuuuuauuuagu

SEQ ID NO: 1257865 - RNA, 15 nt, Homo sapiens
aaaagaccaguccau

SEQ ID NO: 1257866 - RNA, 19 nt, Homo sapiens
aaaagacucugaccagaga

SEQ ID NO: 1257867 - RNA, 22 nt, Homo sapiens
aaaagacuuuuuuuuaacacuu

SEQ ID NO: 1257868 - RNA, 23 nt, Homo sapiens
aaaagaguaguuauuaguucugc

SEQ ID NO: 1257869 - RNA, 12 nt, Homo sapiens
aaaagaguaugu

SEQ ID NO: 1257870 - RNA, 19 nt, Homo sapiens
aaaagaugguaaaccagau

SEQ ID NO: 1257871 - RNA, 18 nt, Homo sapiens
aaaagauuuucagaaaau

SEQ ID NO: 1257872 - RNA, 22 nt, Homo sapiens
aaaagcaagacuguugcucaaa

SEQ ID NO: 1257873 - RNA, 14 nt, Homo sapiens
aaaagcaauacugu

SEQ ID NO: 1257874 - RNA, 16 nt, Homo sapiens
aaaagcaauacuguuu

SEQ ID NO: 1257875 - RNA, 13 nt, Homo sapiens
aaaagcacacucc

SEQ ID NO: 1257876 - RNA, 11 nt, Homo sapiens
aaaagcacuua

SEQ ID NO: 1257877 - RNA, 14 nt, Homo sapiens
aaaagcagcuacca

SEQ ID NO: 1257878 - RNA, 22 nt, Homo sapiens
aaaagcagcucaagaacacaug

SEQ ID NO: 1257879 - RNA, 23 nt, Homo sapiens
aaaagcagucgaccgcacuuaug

SEQ ID NO: 1257880 - RNA, 13 nt, Homo sapiens
aaaagcauucugu

SEQ ID NO: 1257881 - RNA, 21 nt, Homo sapiens
aaaagcccacaccuaacauua

SEQ ID NO: 1257882 - RNA, 20 nt, Homo sapiens
aaaagcgacccauucagaga

SEQ ID NO: 1257883 - RNA, 22 nt, Homo sapiens
aaaagcuauuagccaggaucau

SEQ ID NO: 1257884 - RNA, 18 nt, Homo sapiens
aaaagcugggaaccagca

SEQ ID NO: 1257885 - RNA, 21 nt, Homo sapiens
aaaaggaaaccaaguggucag

SEQ ID NO: 1257886 - RNA, 15 nt, Homo sapiens
aaaaggauaugcagu

SEQ ID NO: 1257887 - RNA, 23 nt, Homo sapiens
aaaaggauaugcaguaugcuuaa

SEQ ID NO: 1257888 - RNA, 20 nt, Homo sapiens
aaaaguagagcaaaacuaua

SEQ ID NO: 1257889 - RNA, 15 nt, Homo sapiens
aaaaguauaugugag

SEQ ID NO: 1257890 - RNA, 19 nt, Homo sapiens
aaaaguccuugauuuagca

SEQ ID NO: 1257891 - RNA, 15 nt, Homo sapiens
aaaagucuaccaccg

SEQ ID NO: 1257892 - RNA, 14 nt, Homo sapiens
aaaagucucacaaa

SEQ ID NO: 1257893 - RNA, 14 nt, Homo sapiens
aaaaguggcauuuc

SEQ ID NO: 1257894 - RNA, 19 nt, Homo sapiens
aaaaguuacuaccugucaa

SEQ ID NO: 1257895 - RNA, 22 nt, Homo sapiens
aaaaguugaaccauuauacuuu

SEQ ID NO: 1257896 - RNA, 12 nt, Homo sapiens
aaaaguuuacaa

SEQ ID NO: 1257897 - RNA, 16 nt, Homo sapiens
aaaaguuuugaugaaa

SEQ ID NO: 1257898 - RNA, 18 nt, Homo sapiens
aaaauaaaauacuuugag

SEQ ID NO: 1257899 - RNA, 18 nt, Homo sapiens
aaaauaaaguaccacaca

SEQ ID NO: 1257900 - RNA, 18 nt, Homo sapiens
aaaauaaugcaccacuuu

SEQ ID NO: 1257901 - RNA, 19 nt, Homo sapiens
aaaauaaugcaccacuuuu

SEQ ID NO: 1257902 - RNA, 18 nt, Homo sapiens
aaaauacaguauucugua

SEQ ID NO: 1257903 - RNA, 14 nt, Homo sapiens
aaaauagacauauu

SEQ ID NO: 1257904 - RNA, 14 nt, Homo sapiens
aaaauagacaugua

SEQ ID NO: 1257905 - RNA, 15 nt, Homo sapiens
aaaauagacauguag

SEQ ID NO: 1257906 - RNA, 21 nt, Homo sapiens
aaaauaguaaaugcuuugugu

SEQ ID NO: 1257907 - RNA, 17 nt, Homo sapiens
aaaauaguacaguuaca

SEQ ID NO: 1257908 - RNA, 23 nt, Homo sapiens
aaaauaguucccuuugccaacag

SEQ ID NO: 1257909 - RNA, 15 nt, Homo sapiens
aaaauauacauucaa

SEQ ID NO: 1257910 - RNA, 15 nt, Homo sapiens
aaaauauaguuugau

SEQ ID NO: 1257911 - RNA, 14 nt, Homo sapiens
aaaauauauuucag

SEQ ID NO: 1257912 - RNA, 21 nt, Homo sapiens
aaaauauauuucagauaucag

SEQ ID NO: 1257913 - RNA, 16 nt, Homo sapiens
aaaauauuucagauau

SEQ ID NO: 1257914 - RNA, 20 nt, Homo sapiens
aaaauauuucagauaucaaa

SEQ ID NO: 1257915 - RNA, 16 nt, Homo sapiens
aaaaucauaguacucu

SEQ ID NO: 1257916 - RNA, 16 nt, Homo sapiens
aaaaucaugggccaga

SEQ ID NO: 1257917 - RNA, 21 nt, Homo sapiens
aaaaucauguuuuuaaaugca

SEQ ID NO: 1257918 - RNA, 16 nt, Homo sapiens
aaaauccaaaacucuu

SEQ ID NO: 1257919 - RNA, 19 nt, Homo sapiens
aaaauccaacucucugaga

SEQ ID NO: 1257920 - RNA, 13 nt, Homo sapiens
aaaauccauuuua

SEQ ID NO: 1257921 - RNA, 22 nt, Homo sapiens
aaaauccuaagacacaaaugca

SEQ ID NO: 1257922 - RNA, 18 nt, Homo sapiens
aaaauccugaacuuucuc

SEQ ID NO: 1257923 - RNA, 18 nt, Homo sapiens
aaaauccuuuuugcauau

SEQ ID NO: 1257924 - RNA, 16 nt, Homo sapiens
aaaaucuccaucucaa

SEQ ID NO: 1257925 - RNA, 21 nt, Homo sapiens
aaaaucuuuguuacucuguaa

SEQ ID NO: 1257926 - RNA, 22 nt, Homo sapiens
aaaaugaaaauuaggauuucau

SEQ ID NO: 1257927 - RNA, 13 nt, Homo sapiens
aaaaugaacugaa

SEQ ID NO: 1257928 - RNA, 21 nt, Homo sapiens
aaaaugaaucuucacaaaaca

SEQ ID NO: 1257929 - RNA, 12 nt, Homo sapiens
aaaaugagacaa

SEQ ID NO: 1257930 - RNA, 20 nt, Homo sapiens
aaaaugagacuuacugggug

SEQ ID NO: 1257931 - RNA, 14 nt, Homo sapiens
aaaaugagguacuc

SEQ ID NO: 1257932 - RNA, 22 nt, Homo sapiens
aaaaugagguucaacuguugau

SEQ ID NO: 1257933 - RNA, 13 nt, Homo sapiens
aaaaugagugcuu

SEQ ID NO: 1257934 - RNA, 16 nt, Homo sapiens
aaaaugagugcuuaaa

SEQ ID NO: 1257935 - RNA, 19 nt, Homo sapiens
aaaaugaguugugaugaau

SEQ ID NO: 1257936 - RNA, 19 nt, Homo sapiens
aaaaugcaaagcugaagac

SEQ ID NO: 1257937 - RNA, 20 nt, Homo sapiens
aaaaugcaauguaagcauac

SEQ ID NO: 1257938 - RNA, 22 nt, Homo sapiens
aaaaugccucaauucacauaga

SEQ ID NO: 1257939 - RNA, 16 nt, Homo sapiens
aaaaugccuccauggc

SEQ ID NO: 1257940 - RNA, 12 nt, Homo sapiens
aaaaugcugcuu

SEQ ID NO: 1257941 - RNA, 17 nt, Homo sapiens
aaaaugcugcuucuccu

SEQ ID NO: 1257942 - RNA, 20 nt, Homo sapiens
aaaaugcugcuucuccuccc

SEQ ID NO: 1257943 - RNA, 19 nt, Homo sapiens
aaaauggacaaaauccaug

SEQ ID NO: 1257944 - RNA, 18 nt, Homo sapiens
aaaaugguaauuguugcu

SEQ ID NO: 1257945 - RNA, 15 nt, Homo sapiens
aaaauguaaugauca

SEQ ID NO: 1257946 - RNA, 15 nt, Homo sapiens
aaaauguaugaccac

SEQ ID NO: 1257947 - RNA, 15 nt, Homo sapiens
aaaauguauuuuucc

SEQ ID NO: 1257948 - RNA, 16 nt, Homo sapiens
aaaauguccugccuuu

SEQ ID NO: 1257949 - RNA, 19 nt, Homo sapiens
aaaaugugcuauacugcau

SEQ ID NO: 1257950 - RNA, 13 nt, Homo sapiens
aaaauguugaaua

SEQ ID NO: 1257951 - RNA, 19 nt, Homo sapiens
aaaauguugagaaucccaa

SEQ ID NO: 1257952 - RNA, 15 nt, Homo sapiens
aaaauguuggaagag

SEQ ID NO: 1257953 - RNA, 22 nt, Homo sapiens
aaaauguuuuccccaaaccaua

SEQ ID NO: 1257954 - RNA, 15 nt, Homo sapiens
aaaauuaauacugaa

SEQ ID NO: 1257955 - RNA, 17 nt, Homo sapiens
aaaauuaauaugauuau

SEQ ID NO: 1257956 - RNA, 21 nt, Homo sapiens
aaaauuagccgggcauggugg

SEQ ID NO: 1257957 - RNA, 13 nt, Homo sapiens
aaaauucaaagca

SEQ ID NO: 1257958 - RNA, 19 nt, Homo sapiens
aaaauucauuucacauuaa

SEQ ID NO: 1257959 - RNA, 11 nt, Homo sapiens
aaaauugcucu

SEQ ID NO: 1257960 - RNA, 17 nt, Homo sapiens
aaaauugggcaugccau

SEQ ID NO: 1257961 - RNA, 13 nt, Homo sapiens
aaaauuuuacuuc

SEQ ID NO: 1257962 - RNA, 16 nt, Homo sapiens
aaaauuuuaguccaaa

SEQ ID NO: 1257963 - RNA, 17 nt, Homo sapiens
aaacaaaauuugacuaa

SEQ ID NO: 1257964 - RNA, 10 nt, Homo sapiens
aaacaaagug

SEQ ID NO: 1257965 - RNA, 15 nt, Homo sapiens
aaacaaauaauagca

SEQ ID NO: 1257966 - RNA, 21 nt, Homo sapiens
aaacaaauaaucacauugacu

SEQ ID NO: 1257967 - RNA, 17 nt, Homo sapiens
aaacaauauguuugcaa

SEQ ID NO: 1257968 - RNA, 21 nt, Homo sapiens
aaacaauuuuuuuuuuccucu

SEQ ID NO: 1257969 - RNA, 16 nt, Homo sapiens
aaacacaauaccuaca

SEQ ID NO: 1257970 - RNA, 13 nt, Homo sapiens
aaacacacuacua

SEQ ID NO: 1257971 - RNA, 18 nt, Homo sapiens
aaacacacuacuaccucu

SEQ ID NO: 1257972 - RNA, 22 nt, Homo sapiens
aaacacauacaggaagguagaa

SEQ ID NO: 1257973 - RNA, 18 nt, Homo sapiens
aaacacgaaacuuguuau

SEQ ID NO: 1257974 - RNA, 12 nt, Homo sapiens
aaacacuccacc

SEQ ID NO: 1257975 - RNA, 13 nt, Homo sapiens
aaacacugaauua

SEQ ID NO: 1257976 - RNA, 12 nt, Homo sapiens
aaacacugccau

SEQ ID NO: 1257977 - RNA, 17 nt, Homo sapiens
aaacacuggcucuggga

SEQ ID NO: 1257978 - RNA, 20 nt, Homo sapiens
aaacagaaagcauccuaaau

SEQ ID NO: 1257979 - RNA, 15 nt, Homo sapiens
aaacagagaugugau

SEQ ID NO: 1257980 - RNA, 15 nt, Homo sapiens
aaacagagccugccu

SEQ ID NO: 1257981 - RNA, 19 nt, Homo sapiens
aaacagauggcacuuugaa

SEQ ID NO: 1257982 - RNA, 16 nt, Homo sapiens
aaacagauuucauacc

SEQ ID NO: 1257983 - RNA, 21 nt, Homo sapiens
aaacagcagauuucagaucau

SEQ ID NO: 1257984 - RNA, 16 nt, Homo sapiens
aaacaggaacaaucca

SEQ ID NO: 1257985 - RNA, 12 nt, Homo sapiens
aaacaggccagg

SEQ ID NO: 1257986 - RNA, 21 nt, Homo sapiens
aaacagggcugccuucuggcc

SEQ ID NO: 1257987 - RNA, 18 nt, Homo sapiens
aaacaggugcuaauuugu

SEQ ID NO: 1257988 - RNA, 17 nt, Homo sapiens
aaacaguggcucauaaa

SEQ ID NO: 1257989 - RNA, 22 nt, Homo sapiens
aaacauaaaaaccaaacccaga

SEQ ID NO: 1257990 - RNA, 17 nt, Homo sapiens
aaacauacagaauguuc

SEQ ID NO: 1257991 - RNA, 20 nt, Homo sapiens
aaacauacagaauguucuau

SEQ ID NO: 1257992 - RNA, 14 nt, Homo sapiens
aaacauacgacuua

SEQ ID NO: 1257993 - RNA, 14 nt, Homo sapiens
aaacauauuggaau

SEQ ID NO: 1257994 - RNA, 16 nt, Homo sapiens
aaacauccuugcaaau

SEQ ID NO: 1257995 - RNA, 21 nt, Homo sapiens
aaacaucuaauaaguauauaa

SEQ ID NO: 1257996 - RNA, 13 nt, Homo sapiens
aaacaucuuucca

SEQ ID NO: 1257997 - RNA, 17 nt, Homo sapiens
aaacaugcuaaauaguu

SEQ ID NO: 1257998 - RNA, 21 nt, Homo sapiens
aaacaugcugaaaacuacaca

SEQ ID NO: 1257999 - RNA, 15 nt, Homo sapiens
aaacauuaaugcaau

SEQ ID NO: 1258000 - RNA, 23 nt, Homo sapiens
aaacauucacacagggcucuuug

SEQ ID NO: 1258001 - RNA, 21 nt, Homo sapiens
aaacauuggauuuuuccuuaa

SEQ ID NO: 1258002 - RNA, 19 nt, Homo sapiens
aaacauuguguugacauua

SEQ ID NO: 1258003 - RNA, 20 nt, Homo sapiens
aaacauuguuuuguguaaca

SEQ ID NO: 1258004 - RNA, 11 nt, Homo sapiens
aaacauuugcu

SEQ ID NO: 1258005 - RNA, 13 nt, Homo sapiens
aaacauuuugaca

SEQ ID NO: 1258006 - RNA, 19 nt, Homo sapiens
aaacauuuuuuuguucucu

SEQ ID NO: 1258007 - RNA, 23 nt, Homo sapiens
aaaccaaaacauaaaaaccaaac

SEQ ID NO: 1258008 - RNA, 16 nt, Homo sapiens
aaaccaauagcuuuaa

SEQ ID NO: 1258009 - RNA, 16 nt, Homo sapiens
aaaccaccaggcaucc

SEQ ID NO: 1258010 - RNA, 14 nt, Homo sapiens
aaaccacuuuccuu

SEQ ID NO: 1258011 - RNA, 22 nt, Homo sapiens
aaaccagcuuguucugggcuca

SEQ ID NO: 1258012 - RNA, 21 nt, Homo sapiens
aaaccaggauuuccuugacuu

SEQ ID NO: 1258013 - RNA, 14 nt, Homo sapiens
aaaccauccaguga

SEQ ID NO: 1258014 - RNA, 11 nt, Homo sapiens
aaaccaugacu

SEQ ID NO: 1258015 - RNA, 13 nt, Homo sapiens
aaaccaugacugu

SEQ ID NO: 1258016 - RNA, 18 nt, Homo sapiens
aaacccacauucuuacca

SEQ ID NO: 1258017 - RNA, 22 nt, Homo sapiens
aaacccauguugaucuuucuca

SEQ ID NO: 1258018 - RNA, 14 nt, Homo sapiens
aaaccccacuuccc

SEQ ID NO: 1258019 - RNA, 13 nt, Homo sapiens
aaaccccaucucu

SEQ ID NO: 1258020 - RNA, 14 nt, Homo sapiens
aaaccccauuucua

SEQ ID NO: 1258021 - RNA, 13 nt, Homo sapiens
aaacccucuguca

SEQ ID NO: 1258022 - RNA, 16 nt, Homo sapiens
aaaccuaggucuccag

SEQ ID NO: 1258023 - RNA, 14 nt, Homo sapiens
aaaccuauguuugc

SEQ ID NO: 1258024 - RNA, 20 nt, Homo sapiens
aaaccucauuaauucugaaa

SEQ ID NO: 1258025 - RNA, 14 nt, Homo sapiens
aaaccucuaugcaa

SEQ ID NO: 1258026 - RNA, 22 nt, Homo sapiens
aaaccugauguuaaaauuccau

SEQ ID NO: 1258027 - RNA, 9 nt, Homo sapiens
aaaccuggg

SEQ ID NO: 1258028 - RNA, 19 nt, Homo sapiens
aaaccugucuccacugugc

SEQ ID NO: 1258029 - RNA, 13 nt, Homo sapiens
aaaccugugccag

SEQ ID NO: 1258030 - RNA, 14 nt, Homo sapiens
aaaccuuagcuccc

SEQ ID NO: 1258031 - RNA, 13 nt, Homo sapiens
aaaccuuugcaaa

SEQ ID NO: 1258032 - RNA, 17 nt, Homo sapiens
aaacgagggcugaugga

SEQ ID NO: 1258033 - RNA, 13 nt, Homo sapiens
aaacgcuacugag

SEQ ID NO: 1258034 - RNA, 16 nt, Homo sapiens
aaacggauuccaaaga

SEQ ID NO: 1258035 - RNA, 17 nt, Homo sapiens
aaacuaaacucuuacca

SEQ ID NO: 1258036 - RNA, 17 nt, Homo sapiens
aaacuaaaucucuaaua

SEQ ID NO: 1258037 - RNA, 13 nt, Homo sapiens
aaacuaaccaucu

SEQ ID NO: 1258038 - RNA, 14 nt, Homo sapiens
aaacuaauuucaua

SEQ ID NO: 1258039 - RNA, 18 nt, Homo sapiens
aaacuauucaugaauauu

SEQ ID NO: 1258040 - RNA, 17 nt, Homo sapiens
aaacucaagacaaugca

SEQ ID NO: 1258041 - RNA, 18 nt, Homo sapiens
aaacucaagacaaugcac

SEQ ID NO: 1258042 - RNA, 15 nt, Homo sapiens
aaacucacugcucaa

SEQ ID NO: 1258043 - RNA, 11 nt, Homo sapiens
aaacucaggga

SEQ ID NO: 1258044 - RNA, 13 nt, Homo sapiens
aaacucagugcaa

SEQ ID NO: 1258045 - RNA, 15 nt, Homo sapiens
aaacucauaacaguc

SEQ ID NO: 1258046 - RNA, 12 nt, Homo sapiens
aaacuccaaagu

SEQ ID NO: 1258047 - RNA, 20 nt, Homo sapiens
aaacuccuagguucacuuug

SEQ ID NO: 1258048 - RNA, 23 nt, Homo sapiens
aaacuccugauuuuguaguuaau

SEQ ID NO: 1258049 - RNA, 16 nt, Homo sapiens
aaacucuccuagucaa

SEQ ID NO: 1258050 - RNA, 13 nt, Homo sapiens
aaacucuucagug

SEQ ID NO: 1258051 - RNA, 18 nt, Homo sapiens
aaacucuucagugcaaau

SEQ ID NO: 1258052 - RNA, 13 nt, Homo sapiens
aaacugaugccaa

SEQ ID NO: 1258053 - RNA, 20 nt, Homo sapiens
aaacugauuuuuagcuuuac

SEQ ID NO: 1258054 - RNA, 20 nt, Homo sapiens
aaacugcaaagcucggugcu

SEQ ID NO: 1258055 - RNA, 17 nt, Homo sapiens
aaacugccugaaagcaa

SEQ ID NO: 1258056 - RNA, 17 nt, Homo sapiens
aaacugccuuccacaau

SEQ ID NO: 1258057 - RNA, 16 nt, Homo sapiens
aaacugcgaggccagu

SEQ ID NO: 1258058 - RNA, 18 nt, Homo sapiens
aaacuggacagucacugc

SEQ ID NO: 1258059 - RNA, 21 nt, Homo sapiens
aaacuggcugcuuuguucaau

SEQ ID NO: 1258060 - RNA, 19 nt, Homo sapiens
aaacuguccucuacaucaa

SEQ ID NO: 1258061 - RNA, 14 nt, Homo sapiens
aaacugucuugccc

SEQ ID NO: 1258062 - RNA, 14 nt, Homo sapiens
aaacuguguugcca

SEQ ID NO: 1258063 - RNA, 15 nt, Homo sapiens
aaacuguuacugaaa

SEQ ID NO: 1258064 - RNA, 19 nt, Homo sapiens
aaacuguuccaaucaugaa

SEQ ID NO: 1258065 - RNA, 23 nt, Homo sapiens
aaacuguucucuauuagacuuua

SEQ ID NO: 1258066 - RNA, 22 nt, Homo sapiens
aaacuguuuauuugcacuauga

SEQ ID NO: 1258067 - RNA, 18 nt, Homo sapiens
aaacuuaaaaguauucau

SEQ ID NO: 1258068 - RNA, 21 nt, Homo sapiens
aaacuuaccuaagugacauuu

SEQ ID NO: 1258069 - RNA, 13 nt, Homo sapiens
aaacuuagaucau

SEQ ID NO: 1258070 - RNA, 17 nt, Homo sapiens
aaacuuaggcaugcaca

SEQ ID NO: 1258071 - RNA, 19 nt, Homo sapiens
aaacuuagugacaaaauag

SEQ ID NO: 1258072 - RNA, 18 nt, Homo sapiens
aaacuuaugcuaguuuau

SEQ ID NO: 1258073 - RNA, 22 nt, Homo sapiens
aaacuucaccuacauuaucuca

SEQ ID NO: 1258074 - RNA, 21 nt, Homo sapiens
aaacuuccacaagagugaauu

SEQ ID NO: 1258075 - RNA, 11 nt, Homo sapiens
aaacuugccug

SEQ ID NO: 1258076 - RNA, 19 nt, Homo sapiens
aaacuuguaaaugcuguca

SEQ ID NO: 1258077 - RNA, 16 nt, Homo sapiens
aaacuuuaagaacaaa

SEQ ID NO: 1258078 - RNA, 23 nt, Homo sapiens
aaacuuugacgagucaccuucca

SEQ ID NO: 1258079 - RNA, 14 nt, Homo sapiens
aaacuuugucaugg

SEQ ID NO: 1258080 - RNA, 23 nt, Homo sapiens
aaacuuuuuuucuguaccaguua

SEQ ID NO: 1258081 - RNA, 18 nt, Homo sapiens
aaagaaaaagaccuauga

SEQ ID NO: 1258082 - RNA, 19 nt, Homo sapiens
aaagaaaaauaucuuggcc

SEQ ID NO: 1258083 - RNA, 12 nt, Homo sapiens
aaagaaaaccau

SEQ ID NO: 1258084 - RNA, 19 nt, Homo sapiens
aaagaaaauauaguuugau

SEQ ID NO: 1258085 - RNA, 16 nt, Homo sapiens
aaagaaagcugagaag

SEQ ID NO: 1258086 - RNA, 15 nt, Homo sapiens
aaagaaaucuugucu

SEQ ID NO: 1258087 - RNA, 17 nt, Homo sapiens
aaagaaaugcauaaaag

SEQ ID NO: 1258088 - RNA, 13 nt, Homo sapiens
aaagaagaacuug

SEQ ID NO: 1258089 - RNA, 23 nt, Homo sapiens
aaagaagcaaucuccuuacugug

SEQ ID NO: 1258090 - RNA, 22 nt, Homo sapiens
aaagaagguuggugaauuucac

SEQ ID NO: 1258091 - RNA, 22 nt, Homo sapiens
aaagaauaauaugcugccaaau

SEQ ID NO: 1258092 - RNA, 14 nt, Homo sapiens
aaagacaagacauu

SEQ ID NO: 1258093 - RNA, 18 nt, Homo sapiens
aaagacaccuacugagug

SEQ ID NO: 1258094 - RNA, 19 nt, Homo sapiens
aaagacacgguugcucuau

SEQ ID NO: 1258095 - RNA, 12 nt, Homo sapiens
aaagacaucagu

SEQ ID NO: 1258096 - RNA, 12 nt, Homo sapiens
aaagacaugggg

SEQ ID NO: 1258097 - RNA, 12 nt, Homo sapiens
aaagacauguug

SEQ ID NO: 1258098 - RNA, 17 nt, Homo sapiens
aaagacauucuuccaaa

SEQ ID NO: 1258099 - RNA, 21 nt, Homo sapiens
aaagacauucuuccaaaaaga

SEQ ID NO: 1258100 - RNA, 20 nt, Homo sapiens
aaagaccugaauaccacuua

SEQ ID NO: 1258101 - RNA, 19 nt, Homo sapiens
aaagacuguacaaaguaga

SEQ ID NO: 1258102 - RNA, 20 nt, Homo sapiens
aaagacuguacaaaguagaa

SEQ ID NO: 1258103 - RNA, 16 nt, Homo sapiens
aagggaucuuccuugg

SEQ ID NO: 1258104 - RNA, 19 nt, Homo sapiens
aagggauggaaaaggaaga

SEQ ID NO: 1258105 - RNA, 21 nt, Homo sapiens
aagggcacgugaagucauuga

SEQ ID NO: 1258106 - RNA, 14 nt, Homo sapiens
aagggcagcauaua

SEQ ID NO: 1258107 - RNA, 18 nt, Homo sapiens
aagggcagcuccacaggg

SEQ ID NO: 1258108 - RNA, 14 nt, Homo sapiens
aagggcaucaucua

SEQ ID NO: 1258109 - RNA, 15 nt, Homo sapiens
aagggccacugggac

SEQ ID NO: 1258110 - RNA, 9 nt, Homo sapiens
aagggccag

SEQ ID NO: 1258111 - RNA, 17 nt, Homo sapiens
aagggcucccagccaca

SEQ ID NO: 1258112 - RNA, 17 nt, Homo sapiens
aagggcugaguguccag

SEQ ID NO: 1258113 - RNA, 21 nt, Homo sapiens
aaggggagcucuucaacauua

SEQ ID NO: 1258114 - RNA, 18 nt, Homo sapiens
aaggggaggggaugucag

SEQ ID NO: 1258115 - RNA, 23 nt, Homo sapiens
aaggggccucaccgagugggggc

SEQ ID NO: 1258116 - RNA, 13 nt, Homo sapiens
aaggguacugaaa

SEQ ID NO: 1258117 - RNA, 13 nt, Homo sapiens
aaggguggaaauc

SEQ ID NO: 1258118 - RNA, 19 nt, Homo sapiens
aagggugggugcucagaau

SEQ ID NO: 1258119 - RNA, 17 nt, Homo sapiens
aagguagagucuuacaa

SEQ ID NO: 1258120 - RNA, 18 nt, Homo sapiens
aagguauuagcaaagcaa

SEQ ID NO: 1258121 - RNA, 19 nt, Homo sapiens
aagguauuagcaaagcaaa

SEQ ID NO: 1258122 - RNA, 15 nt, Homo sapiens
aagguauuucuccag

SEQ ID NO: 1258123 - RNA, 21 nt, Homo sapiens
aagguauuuuguaauauucuc

SEQ ID NO: 1258124 - RNA, 18 nt, Homo sapiens
aaggucacauugugccuu

SEQ ID NO: 1258125 - RNA, 19 nt, Homo sapiens
aagguccacaggucuagac

SEQ ID NO: 1258126 - RNA, 17 nt, Homo sapiens
aaggucccuuguuucca

SEQ ID NO: 1258127 - RNA, 19 nt, Homo sapiens
aaggucuccaaaccagacg

SEQ ID NO: 1258128 - RNA, 22 nt, Homo sapiens
aaggucuuugacggcaccaucu

SEQ ID NO: 1258129 - RNA, 16 nt, Homo sapiens
aaggugaaagugcagu

SEQ ID NO: 1258130 - RNA, 15 nt, Homo sapiens
aaggugaaccaaaga

SEQ ID NO: 1258131 - RNA, 15 nt, Homo sapiens
aaggugaccuugcaa

SEQ ID NO: 1258132 - RNA, 12 nt, Homo sapiens
aaggugccacuu

SEQ ID NO: 1258133 - RNA, 18 nt, Homo sapiens
aagguggacuuccagcuu

SEQ ID NO: 1258134 - RNA, 19 nt, Homo sapiens
aaggugugagacugggaag

SEQ ID NO: 1258135 - RNA, 14 nt, Homo sapiens
aagguuaaauuuca

SEQ ID NO: 1258136 - RNA, 15 nt, Homo sapiens
aagguucacucucaa

SEQ ID NO: 1258137 - RNA, 17 nt, Homo sapiens
aagguuccaacuguaua

SEQ ID NO: 1258138 - RNA, 18 nt, Homo sapiens
aagguugcagugcugagc

SEQ ID NO: 1258139 - RNA, 22 nt, Homo sapiens
aagguuguguagcugugucaug

SEQ ID NO: 1258140 - RNA, 13 nt, Homo sapiens
aagguuugugcug

SEQ ID NO: 1258141 - RNA, 21 nt, Homo sapiens
aagguuuuaaccgcacaugca

SEQ ID NO: 1258142 - RNA, 23 nt, Homo sapiens
aaguaaaacaugcugaaaacuac

SEQ ID NO: 1258143 - RNA, 15 nt, Homo sapiens
aaguaaaccaaaaag

SEQ ID NO: 1258144 - RNA, 14 nt, Homo sapiens
aaguaaauugccug

SEQ ID NO: 1258145 - RNA, 14 nt, Homo sapiens
aaguaacauuugcc

SEQ ID NO: 1258146 - RNA, 16 nt, Homo sapiens
aaguaaccauuugcac

SEQ ID NO: 1258147 - RNA, 21 nt, Homo sapiens
aaguaacugaaccauuccaac

SEQ ID NO: 1258148 - RNA, 18 nt, Homo sapiens
aaguaacugaauuauuuc

SEQ ID NO: 1258149 - RNA, 18 nt, Homo sapiens
aaguaaguaccacucagg

SEQ ID NO: 1258150 - RNA, 18 nt, Homo sapiens
aaguaaguuaauaaugua

SEQ ID NO: 1258151 - RNA, 23 nt, Homo sapiens
aaguaauuaucgggaacaguguu

SEQ ID NO: 1258152 - RNA, 22 nt, Homo sapiens
aaguaauuucuuugaucuggac

SEQ ID NO: 1258153 - RNA, 19 nt, Homo sapiens
aaguacagaauuugaauua

SEQ ID NO: 1258154 - RNA, 16 nt, Homo sapiens
aaguaccacacauauu

SEQ ID NO: 1258155 - RNA, 15 nt, Homo sapiens
aaguaccacucaggc

SEQ ID NO: 1258156 - RNA, 20 nt, Homo sapiens
aaguacucaaauauuucuga

SEQ ID NO: 1258157 - RNA, 20 nt, Homo sapiens
aaguagcaucccaucccaac

SEQ ID NO: 1258158 - RNA, 23 nt, Homo sapiens
aaguaguaaauuuugugaugaau

SEQ ID NO: 1258159 - RNA, 21 nt, Homo sapiens
aaguauacuuuuccccuguua

SEQ ID NO: 1258160 - RNA, 14 nt, Homo sapiens
aaguaucacucuaa

SEQ ID NO: 1258161 - RNA, 13 nt, Homo sapiens
aaguaugagggaa

SEQ ID NO: 1258162 - RNA, 16 nt, Homo sapiens
aaguaugagggaaaau

SEQ ID NO: 1258163 - RNA, 13 nt, Homo sapiens
aaguauguugaua

SEQ ID NO: 1258164 - RNA, 12 nt, Homo sapiens
aaguauuagcca

SEQ ID NO: 1258165 - RNA, 19 nt, Homo sapiens
aaguauuauuuauuugaau

SEQ ID NO: 1258166 - RNA, 16 nt, Homo sapiens
aaguauuauuuuacaa

SEQ ID NO: 1258167 - RNA, 12 nt, Homo sapiens
aaguauuugaaa

SEQ ID NO: 1258168 - RNA, 13 nt, Homo sapiens
aagucaagcacau

SEQ ID NO: 1258169 - RNA, 17 nt, Homo sapiens
aagucaagcacauguaa

SEQ ID NO: 1258170 - RNA, 17 nt, Homo sapiens
aagucaaguuuguggcu

SEQ ID NO: 1258171 - RNA, 19 nt, Homo sapiens
aagucaaguuuguggcuua

SEQ ID NO: 1258172 - RNA, 23 nt, Homo sapiens
aagucaccaaauagugugaaaua

SEQ ID NO: 1258173 - RNA, 15 nt, Homo sapiens
aagucaccuguauaa

SEQ ID NO: 1258174 - RNA, 23 nt, Homo sapiens
aagucacugcacagugcaucuca

SEQ ID NO: 1258175 - RNA, 13 nt, Homo sapiens
aagucagcuccag

SEQ ID NO: 1258176 - RNA, 14 nt, Homo sapiens
aagucaucuacuua

SEQ ID NO: 1258177 - RNA, 18 nt, Homo sapiens
aagucauuuuaacuuuau

SEQ ID NO: 1258178 - RNA, 14 nt, Homo sapiens
aaguccaauuccaa

SEQ ID NO: 1258179 - RNA, 24 nt, Homo sapiens
aaguccagccacuugacuggcaca

SEQ ID NO: 1258180 - RNA, 20 nt, Homo sapiens
aagucccugucauuugaacc

SEQ ID NO: 1258181 - RNA, 23 nt, Homo sapiens
aaguccugacacuauucauuuga

SEQ ID NO: 1258182 - RNA, 17 nt, Homo sapiens
aagucuaaauaaaugaa

SEQ ID NO: 1258183 - RNA, 15 nt, Homo sapiens
aagucugacucucca

SEQ ID NO: 1258184 - RNA, 15 nt, Homo sapiens
aagucugcuacccuc

SEQ ID NO: 1258185 - RNA, 18 nt, Homo sapiens
aagucugggauguagaac

SEQ ID NO: 1258186 - RNA, 15 nt, Homo sapiens
aagucuguaccucaa

SEQ ID NO: 1258187 - RNA, 14 nt, Homo sapiens
aagucugucugucu

SEQ ID NO: 1258188 - RNA, 17 nt, Homo sapiens
aagucuuauuuccucaa

SEQ ID NO: 1258189 - RNA, 21 nt, Homo sapiens
aagucuuuuuuucugcuucuu

SEQ ID NO: 1258190 - RNA, 23 nt, Homo sapiens
aagugaaggacauagagguauau

SEQ ID NO: 1258191 - RNA, 13 nt, Homo sapiens
aagugacucucac

SEQ ID NO: 1258192 - RNA, 16 nt, Homo sapiens
aagugaggagugccag

SEQ ID NO: 1258193 - RNA, 20 nt, Homo sapiens
aagugaggagugccagcuca

SEQ ID NO: 1258194 - RNA, 17 nt, Homo sapiens
aagugauacuauccagu

SEQ ID NO: 1258195 - RNA, 16 nt, Homo sapiens
aagugauucacugugc

SEQ ID NO: 1258196 - RNA, 15 nt, Homo sapiens
aagugcauauuuauc

SEQ ID NO: 1258197 - RNA, 14 nt, Homo sapiens
aagugcaugauggu

SEQ ID NO: 1258198 - RNA, 16 nt, Homo sapiens
aagugccagcauucca

SEQ ID NO: 1258199 - RNA, 18 nt, Homo sapiens
aagugccugacacacuaa

SEQ ID NO: 1258200 - RNA, 12 nt, Homo sapiens
aagugcugcuau

SEQ ID NO: 1258201 - RNA, 21 nt, Homo sapiens
aagugcugcuauaucuaucca

SEQ ID NO: 1258202 - RNA, 18 nt, Homo sapiens
aagugcuggcaaccacua

SEQ ID NO: 1258203 - RNA, 13 nt, Homo sapiens
aagugggugaaug

SEQ ID NO: 1258204 - RNA, 16 nt, Homo sapiens
aaguggugaaugacac

SEQ ID NO: 1258205 - RNA, 16 nt, Homo sapiens
aagugguugcauucua

SEQ ID NO: 1258206 - RNA, 12 nt, Homo sapiens
aaguguaacaau

SEQ ID NO: 1258207 - RNA, 15 nt, Homo sapiens
aaguguaccugugua

SEQ ID NO: 1258208 - RNA, 17 nt, Homo sapiens
aagugucuagagucaug

SEQ ID NO: 1258209 - RNA, 12 nt, Homo sapiens
aagugucuucca

SEQ ID NO: 1258210 - RNA, 11 nt, Homo sapiens
aagugugagua

SEQ ID NO: 1258211 - RNA, 20 nt, Homo sapiens
aagugugcugugacaagcca

SEQ ID NO: 1258212 - RNA, 16 nt, Homo sapiens
aaguguguacaagcau

SEQ ID NO: 1258213 - RNA, 15 nt, Homo sapiens
aaguguuucuguuau

SEQ ID NO: 1258214 - RNA, 20 nt, Homo sapiens
aaguuaaaauaaaaccaagg

SEQ ID NO: 1258215 - RNA, 12 nt, Homo sapiens
aaguuacuuugu

SEQ ID NO: 1258216 - RNA, 22 nt, Homo sapiens
aaguuagccuccaccacccuuu

SEQ ID NO: 1258217 - RNA, 15 nt, Homo sapiens
aaguuauuacugucu

SEQ ID NO: 1258218 - RNA, 14 nt, Homo sapiens
aaguuauugauguu

SEQ ID NO: 1258219 - RNA, 13 nt, Homo sapiens
aaguuauuuacuu

SEQ ID NO: 1258220 - RNA, 16 nt, Homo sapiens
aaguuauuuaugcuau

SEQ ID NO: 1258221 - RNA, 16 nt, Homo sapiens
aaguuccaaaagcaca

SEQ ID NO: 1258222 - RNA, 18 nt, Homo sapiens
aaguuccaguguucucuc

SEQ ID NO: 1258223 - RNA, 20 nt, Homo sapiens
aaguuccccaucccugucau

SEQ ID NO: 1258224 - RNA, 21 nt, Homo sapiens
aaguuccccaucccugucauu

SEQ ID NO: 1258225 - RNA, 23 nt, Homo sapiens
aaguuccccaucccugucauuuu

SEQ ID NO: 1258226 - RNA, 20 nt, Homo sapiens
aaguuccccuuauguggguu

SEQ ID NO: 1258227 - RNA, 21 nt, Homo sapiens
aaguucuauuuauuugugaga

SEQ ID NO: 1258228 - RNA, 22 nt, Homo sapiens
aaguucuguguuuaauuucuuc

SEQ ID NO: 1258229 - RNA, 14 nt, Homo sapiens
aaguucuucaccuc

SEQ ID NO: 1258230 - RNA, 20 nt, Homo sapiens
aaguugaagcuaagauuuag

SEQ ID NO: 1258231 - RNA, 13 nt, Homo sapiens
aaguugcugucac

SEQ ID NO: 1258232 - RNA, 13 nt, Homo sapiens
aaguugugcuuga

SEQ ID NO: 1258233 - RNA, 14 nt, Homo sapiens
aaguuucccuuccu

SEQ ID NO: 1258234 - RNA, 17 nt, Homo sapiens
aaguuucuggugccauu

SEQ ID NO: 1258235 - RNA, 19 nt, Homo sapiens
aaguuucuggugccauuuc

SEQ ID NO: 1258236 - RNA, 17 nt, Homo sapiens
aaguuugggccagugaa

SEQ ID NO: 1258237 - RNA, 21 nt, Homo sapiens
aaguuuuacuaaauacuuuaa

SEQ ID NO: 1258238 - RNA, 14 nt, Homo sapiens
aaguuuuacugucu

SEQ ID NO: 1258239 - RNA, 23 nt, Homo sapiens
aaguuuucagaaccucuucccca

SEQ ID NO: 1258240 - RNA, 14 nt, Homo sapiens
aaguuuugcugucu

SEQ ID NO: 1258241 - RNA, 23 nt, Homo sapiens
aaguuuuugauucuacucuuaua

SEQ ID NO: 1258242 - RNA, 15 nt, Homo sapiens
aauaaaaaaucugaa

SEQ ID NO: 1258243 - RNA, 15 nt, Homo sapiens
aauaaaaaguucaga

SEQ ID NO: 1258244 - RNA, 21 nt, Homo sapiens
aauaaaacaucuuuccagucc

SEQ ID NO: 1258245 - RNA, 17 nt, Homo sapiens
aauaaaacugauguuac

SEQ ID NO: 1258246 - RNA, 18 nt, Homo sapiens
aauaaaacuuaugcuagu

SEQ ID NO: 1258247 - RNA, 16 nt, Homo sapiens
aauaaaagauucaccu

SEQ ID NO: 1258248 - RNA, 17 nt, Homo sapiens
aauaaaaguacaaagca

SEQ ID NO: 1258249 - RNA, 12 nt, Homo sapiens
aauaaaagugga

SEQ ID NO: 1258250 - RNA, 16 nt, Homo sapiens
aauaaaauccuaagac

SEQ ID NO: 1258251 - RNA, 17 nt, Homo sapiens
aauaaaauuaacuggug

SEQ ID NO: 1258252 - RNA, 14 nt, Homo sapiens
aauaaaauuguaca

SEQ ID NO: 1258253 - RNA, 12 nt, Homo sapiens
aauaaacacugg

SEQ ID NO: 1258254 - RNA, 13 nt, Homo sapiens
aauaaacauugag

SEQ ID NO: 1258255 - RNA, 15 nt, Homo sapiens
aauaaacccuuccug

SEQ ID NO: 1258256 - RNA, 17 nt, Homo sapiens
aauaaacucaaugagcu

SEQ ID NO: 1258257 - RNA, 18 nt, Homo sapiens
aauaaacugaaaauggac

SEQ ID NO: 1258258 - RNA, 20 nt, Homo sapiens
aauaaacuguguuuacucag

SEQ ID NO: 1258259 - RNA, 17 nt, Homo sapiens
aauaaagaaauugcaau

SEQ ID NO: 1258260 - RNA, 18 nt, Homo sapiens
aauaaagcaaugugguag

SEQ ID NO: 1258261 - RNA, 14 nt, Homo sapiens
aauaaaggcagcug

SEQ ID NO: 1258262 - RNA, 15 nt, Homo sapiens
aauaaauaaaaagcg

SEQ ID NO: 1258263 - RNA, 22 nt, Homo sapiens
aauaaauagcuauauccaugua

SEQ ID NO: 1258264 - RNA, 13 nt, Homo sapiens
aauaaauauuaca

SEQ ID NO: 1258265 - RNA, 17 nt, Homo sapiens
aauaaaucacacauuca

SEQ ID NO: 1258266 - RNA, 23 nt, Homo sapiens
aauaaaugagagggaaucgacug

SEQ ID NO: 1258267 - RNA, 12 nt, Homo sapiens
aauaaaugauua

SEQ ID NO: 1258268 - RNA, 23 nt, Homo sapiens
aggggugcccccaggcucucaug

SEQ ID NO: 1258269 - RNA, 19 nt, Homo sapiens
aggggugcugcagguggca

SEQ ID NO: 1258270 - RNA, 22 nt, Homo sapiens
agggguggggguggaggcuucc

SEQ ID NO: 1258271 - RNA, 14 nt, Homo sapiens
aggggugugcugag

SEQ ID NO: 1258272 - RNA, 18 nt, Homo sapiens
agggguuauagcuucagg

SEQ ID NO: 1258273 - RNA, 18 nt, Homo sapiens
agggguuggauugcaaua

SEQ ID NO: 1258274 - RNA, 15 nt, Homo sapiens
agggguuucuucaag

SEQ ID NO: 1258275 - RNA, 14 nt, Homo sapiens
aggguaaauucucu

SEQ ID NO: 1258276 - RNA, 23 nt, Homo sapiens
aggguagucugguuucuagacuu

SEQ ID NO: 1258277 - RNA, 18 nt, Homo sapiens
aggguccagacuguccac

SEQ ID NO: 1258278 - RNA, 13 nt, Homo sapiens
aggguccagugga

SEQ ID NO: 1258279 - RNA, 21 nt, Homo sapiens
agggucccauuucucacugag

SEQ ID NO: 1258280 - RNA, 20 nt, Homo sapiens
aggguccucaguccacugcu

SEQ ID NO: 1258281 - RNA, 23 nt, Homo sapiens
agggucugugugaaugugggcac

SEQ ID NO: 1258282 - RNA, 23 nt, Homo sapiens
agggucuucuuacaugcauuuga

SEQ ID NO: 1258283 - RNA, 17 nt, Homo sapiens
agggucuuugcaagaau

SEQ ID NO: 1258284 - RNA, 19 nt, Homo sapiens
agggugacguuagcauuac

SEQ ID NO: 1258285 - RNA, 11 nt, Homo sapiens
agggugacugu

SEQ ID NO: 1258286 - RNA, 15 nt, Homo sapiens
aggguggacuuagaa

SEQ ID NO: 1258287 - RNA, 22 nt, Homo sapiens
aggguggcacagaagcucaucu

SEQ ID NO: 1258288 - RNA, 16 nt, Homo sapiens
aggguggcccuugcag

SEQ ID NO: 1258289 - RNA, 22 nt, Homo sapiens
agggugggaucagcccugccag

SEQ ID NO: 1258290 - RNA, 16 nt, Homo sapiens
agggugggcagccuau

SEQ ID NO: 1258291 - RNA, 23 nt, Homo sapiens
agggugggguaaccaaauguugg

SEQ ID NO: 1258292 - RNA, 13 nt, Homo sapiens
aggguggugaccu

SEQ ID NO: 1258293 - RNA, 16 nt, Homo sapiens
aggguguaggggccac

SEQ ID NO: 1258294 - RNA, 14 nt, Homo sapiens
aggguguggugcuu

SEQ ID NO: 1258295 - RNA, 13 nt, Homo sapiens
aggguuacuaugc

SEQ ID NO: 1258296 - RNA, 15 nt, Homo sapiens
aggguucaacaaagg

SEQ ID NO: 1258297 - RNA, 18 nt, Homo sapiens
aggguucaucuguccaug

SEQ ID NO: 1258298 - RNA, 15 nt, Homo sapiens
aggguuccaaagggc

SEQ ID NO: 1258299 - RNA, 16 nt, Homo sapiens
aggguucuaaguggga

SEQ ID NO: 1258300 - RNA, 20 nt, Homo sapiens
aggguuucaccauguugccc

SEQ ID NO: 1258301 - RNA, 18 nt, Homo sapiens
aggguuugauagcacuua

SEQ ID NO: 1258302 - RNA, 15 nt, Homo sapiens
aggguuuugacacuu

SEQ ID NO: 1258303 - RNA, 23 nt, Homo sapiens
aggguuuugccccaaguccucau

SEQ ID NO: 1258304 - RNA, 14 nt, Homo sapiens
agguaaaaacugga

SEQ ID NO: 1258305 - RNA, 12 nt, Homo sapiens
agguaacauguu

SEQ ID NO: 1258306 - RNA, 11 nt, Homo sapiens
agguacaggag

SEQ ID NO: 1258307 - RNA, 21 nt, Homo sapiens
agguaccagcugcgcuugcuu

SEQ ID NO: 1258308 - RNA, 15 nt, Homo sapiens
agguaguuuggauau

SEQ ID NO: 1258309 - RNA, 17 nt, Homo sapiens
agguauaaugauacugc

SEQ ID NO: 1258310 - RNA, 20 nt, Homo sapiens
agguaucuuuuuuaaaugaa

SEQ ID NO: 1258311 - RNA, 19 nt, Homo sapiens
aggucaauuuccugaugca

SEQ ID NO: 1258312 - RNA, 12 nt, Homo sapiens
aggucacuccug

SEQ ID NO: 1258313 - RNA, 22 nt, Homo sapiens
aggucagggagugcuggcucac

SEQ ID NO: 1258314 - RNA, 11 nt, Homo sapiens
aggucaugccu

SEQ ID NO: 1258315 - RNA, 13 nt, Homo sapiens
aggucaugggaag

SEQ ID NO: 1258316 - RNA, 15 nt, Homo sapiens
agguccagcucugga

SEQ ID NO: 1258317 - RNA, 14 nt, Homo sapiens
agguccauuuugcc

SEQ ID NO: 1258318 - RNA, 15 nt, Homo sapiens
aggucccaggaagug

SEQ ID NO: 1258319 - RNA, 20 nt, Homo sapiens
agguccuuaggccucugaga

SEQ ID NO: 1258320 - RNA, 21 nt, Homo sapiens
aggucgaccccaaagccccuu

SEQ ID NO: 1258321 - RNA, 18 nt, Homo sapiens
aggucuagaaaaccagcu

SEQ ID NO: 1258322 - RNA, 18 nt, Homo sapiens
aauauuucuuucaugucu

SEQ ID NO: 1258323 - RNA, 16 nt, Homo sapiens
aauauuuucauuguga

SEQ ID NO: 1258324 - RNA, 20 nt, Homo sapiens
aauauuuuguaacuauuaca

SEQ ID NO: 1258325 - RNA, 19 nt, Homo sapiens
aauauuuuguuuugugcag

SEQ ID NO: 1258326 - RNA, 21 nt, Homo sapiens
aaucaaaauugucucuucuga

SEQ ID NO: 1258327 - RNA, 13 nt, Homo sapiens
aaucaaagcacuu

SEQ ID NO: 1258328 - RNA, 14 nt, Homo sapiens
aaucaaagcacuug

SEQ ID NO: 1258329 - RNA, 15 nt, Homo sapiens
aaucaaagcugagga

SEQ ID NO: 1258330 - RNA, 22 nt, Homo sapiens
aaucaaaggaaaauaguaaugu

SEQ ID NO: 1258331 - RNA, 22 nt, Homo sapiens
aaucaaaucucuuccacauggg

SEQ ID NO: 1258332 - RNA, 17 nt, Homo sapiens
aaucaacagaagcauuu

SEQ ID NO: 1258333 - RNA, 13 nt, Homo sapiens
aaucaaucuuuaa

SEQ ID NO: 1258334 - RNA, 14 nt, Homo sapiens
aaucaaugaagcaa

SEQ ID NO: 1258335 - RNA, 11 nt, Homo sapiens
aaucacaagaa

SEQ ID NO: 1258336 - RNA, 11 nt, Homo sapiens
aaucacacugu

SEQ ID NO: 1258337 - RNA, 15 nt, Homo sapiens
aaucacggugguaaa

SEQ ID NO: 1258338 - RNA, 10 nt, Homo sapiens
aaucacuguc

SEQ ID NO: 1258339 - RNA, 15 nt, Homo sapiens
aaucagaacuaacca

SEQ ID NO: 1258340 - RNA, 17 nt, Homo sapiens
aaucagaacuaaccagu

SEQ ID NO: 1258341 - RNA, 15 nt, Homo sapiens
aaucagccuggccau

SEQ ID NO: 1258342 - RNA, 12 nt, Homo sapiens
aaucagcuuugu

SEQ ID NO: 1258343 - RNA, 21 nt, Homo sapiens
aaucagucuauccacagagag

SEQ ID NO: 1258344 - RNA, 16 nt, Homo sapiens
aaucauaaaacuugau

SEQ ID NO: 1258345 - RNA, 13 nt, Homo sapiens
aaucauaaaggau

SEQ ID NO: 1258346 - RNA, 21 nt, Homo sapiens
aaucauauuugaaaaccauau

SEQ ID NO: 1258347 - RNA, 18 nt, Homo sapiens
aaucauccaagacaguua

SEQ ID NO: 1258348 - RNA, 23 nt, Homo sapiens
aaucaucuauaaagaagaacuug

SEQ ID NO: 1258349 - RNA, 18 nt, Homo sapiens
aaucaugagcaagugaac

SEQ ID NO: 1258350 - RNA, 21 nt, Homo sapiens
aaucaugugggugagccagug

SEQ ID NO: 1258351 - RNA, 23 nt, Homo sapiens
aaucauugauugucagcuacuaa

SEQ ID NO: 1258352 - RNA, 16 nt, Homo sapiens
aaucauuucaguauca

SEQ ID NO: 1258353 - RNA, 16 nt, Homo sapiens
aaucauuuugccucuu

SEQ ID NO: 1258354 - RNA, 17 nt, Homo sapiens
aauccaagauucugcug

SEQ ID NO: 1258355 - RNA, 13 nt, Homo sapiens
aauccaagcuccc

SEQ ID NO: 1258356 - RNA, 22 nt, Homo sapiens
aauccagcucccuagacugcau

SEQ ID NO: 1258357 - RNA, 23 nt, Homo sapiens
aauccagucccaaugguccugac

SEQ ID NO: 1258358 - RNA, 19 nt, Homo sapiens
aauccagugagcacuagaa

SEQ ID NO: 1258359 - RNA, 13 nt, Homo sapiens
aauccaugguguu

SEQ ID NO: 1258360 - RNA, 16 nt, Homo sapiens
aauccauuaucgagca

SEQ ID NO: 1258361 - RNA, 17 nt, Homo sapiens
aaucccaacacuuugag

SEQ ID NO: 1258362 - RNA, 15 nt, Homo sapiens
aaucccagcacuuug

SEQ ID NO: 1258363 - RNA, 15 nt, Homo sapiens
aauccccagcccuuu

SEQ ID NO: 1258364 - RNA, 20 nt, Homo sapiens
aaucccuauguuugucucac

SEQ ID NO: 1258365 - RNA, 17 nt, Homo sapiens
aauccuaaauaauguua

SEQ ID NO: 1258366 - RNA, 15 nt, Homo sapiens
aauccuaacauucag

SEQ ID NO: 1258367 - RNA, 16 nt, Homo sapiens
aauccuagacuugaaa

SEQ ID NO: 1258368 - RNA, 18 nt, Homo sapiens
aauccucauguuacucag

SEQ ID NO: 1258369 - RNA, 23 nt, Homo sapiens
aauccucuaggaggcuccuccuc

SEQ ID NO: 1258370 - RNA, 22 nt, Homo sapiens
aauccucuucuuuauacuguaa

SEQ ID NO: 1258371 - RNA, 19 nt, Homo sapiens
aauccugaaagggcacuua

SEQ ID NO: 1258372 - RNA, 13 nt, Homo sapiens
aauccugccauuu

SEQ ID NO: 1258373 - RNA, 14 nt, Homo sapiens
aauccuguacaauu

SEQ ID NO: 1258374 - RNA, 19 nt, Homo sapiens
aauccuuaguccuacccug

SEQ ID NO: 1258375 - RNA, 18 nt, Homo sapiens
aauccuuggggagcacuu

SEQ ID NO: 1258376 - RNA, 23 nt, Homo sapiens
aauccuuuacauucaacuuuucu

SEQ ID NO: 1258377 - RNA, 22 nt, Homo sapiens
aauccuuucacccgcuccuaca

SEQ ID NO: 1258378 - RNA, 22 nt, Homo sapiens
aaucgacuguauucgugcauuu

SEQ ID NO: 1258379 - RNA, 19 nt, Homo sapiens
aaucgauucugcagcaccg

SEQ ID NO: 1258380 - RNA, 21 nt, Homo sapiens
aaucgcugcccucucugccag

SEQ ID NO: 1258381 - RNA, 22 nt, Homo sapiens
aaucggcuggggacugcuaccu

SEQ ID NO: 1258382 - RNA, 21 nt, Homo sapiens
aaucguaguuaacguauauug

SEQ ID NO: 1258383 - RNA, 15 nt, Homo sapiens
aaucuaaaucuucag

SEQ ID NO: 1258384 - RNA, 15 nt, Homo sapiens
aaucuaacaucgugg

SEQ ID NO: 1258385 - RNA, 13 nt, Homo sapiens
aaucuaaucucuu

SEQ ID NO: 1258386 - RNA, 14 nt, Homo sapiens
aaucuaguuuacag

SEQ ID NO: 1258387 - RNA, 15 nt, Homo sapiens
aaucuauguuugcac

SEQ ID NO: 1258388 - RNA, 21 nt, Homo sapiens
aaucucaagauucuacuuggu

SEQ ID NO: 1258389 - RNA, 19 nt, Homo sapiens
aaucucaaugaagccagcu

SEQ ID NO: 1258390 - RNA, 11 nt, Homo sapiens
aaucucacaaa

SEQ ID NO: 1258391 - RNA, 13 nt, Homo sapiens
aaucucagcacuu

SEQ ID NO: 1258392 - RNA, 14 nt, Homo sapiens
aaucucagcacuuu

SEQ ID NO: 1258393 - RNA, 15 nt, Homo sapiens
aaucuccaucucaaa

SEQ ID NO: 1258394 - RNA, 15 nt, Homo sapiens
aaucucccacuccag

SEQ ID NO: 1258395 - RNA, 15 nt, Homo sapiens
aaucuccugcugauu

SEQ ID NO: 1258396 - RNA, 14 nt, Homo sapiens
aaucucggcucacu

SEQ ID NO: 1258397 - RNA, 16 nt, Homo sapiens
aaucucggcucacuga

SEQ ID NO: 1258398 - RNA, 16 nt, Homo sapiens
aaucucggcucacugc

SEQ ID NO: 1258399 - RNA, 18 nt, Homo sapiens
aaucucguuucuccucuu

SEQ ID NO: 1258400 - RNA, 22 nt, Homo sapiens
aaucucuaauagaggcauuacu

SEQ ID NO: 1258401 - RNA, 19 nt, Homo sapiens
aaucucuacugcuuuggau

SEQ ID NO: 1258402 - RNA, 14 nt, Homo sapiens
aaucucugccuaga

SEQ ID NO: 1258403 - RNA, 18 nt, Homo sapiens
aaucucugcucucuaugu

SEQ ID NO: 1258404 - RNA, 22 nt, Homo sapiens
aaucucuguucuguuuggcacu

SEQ ID NO: 1258405 - RNA, 14 nt, Homo sapiens
aaucucuugcacuc

SEQ ID NO: 1258406 - RNA, 16 nt, Homo sapiens
aaucucuugcacucaa

SEQ ID NO: 1258407 - RNA, 15 nt, Homo sapiens
aaucucuuuaccucc

SEQ ID NO: 1258408 - RNA, 19 nt, Homo sapiens
uauuuuuauaucaugcaaa

SEQ ID NO: 1258409 - RNA, 20 nt, Homo sapiens
uauuuuuguguuuucuugua

SEQ ID NO: 1258410 - RNA, 22 nt, Homo sapiens
uauuuuuguuucuuccaaagca

SEQ ID NO: 1258411 - RNA, 18 nt, Homo sapiens
uauuuuuuagugaugaga

SEQ ID NO: 1258412 - RNA, 16 nt, Homo sapiens
uauuuuuuauauauac

SEQ ID NO: 1258413 - RNA, 12 nt, Homo sapiens
uauuuuuugcca

SEQ ID NO: 1258414 - RNA, 13 nt, Homo sapiens
uauuuuuugccau

SEQ ID NO: 1258415 - RNA, 18 nt, Homo sapiens
ucaaaaaaaaaaauggau

SEQ ID NO: 1258416 - RNA, 18 nt, Homo sapiens
ucaaaaaagauagaucua

SEQ ID NO: 1258417 - RNA, 20 nt, Homo sapiens
ucaaaaaaucugaccaaaac

SEQ ID NO: 1258418 - RNA, 12 nt, Homo sapiens
ucaaaaagggaa

SEQ ID NO: 1258419 - RNA, 13 nt, Homo sapiens
ucaaaaaguaauu

SEQ ID NO: 1258420 - RNA, 14 nt, Homo sapiens
ucaaaaaguguuua

SEQ ID NO: 1258421 - RNA, 13 nt, Homo sapiens
ucaaaaaguucca

SEQ ID NO: 1258422 - RNA, 14 nt, Homo sapiens
ucaaaaaguuccau

SEQ ID NO: 1258423 - RNA, 16 nt, Homo sapiens
ucaaaaauauuugcug

SEQ ID NO: 1258424 - RNA, 19 nt, Homo sapiens
ucaaaaauccuaacauuca

SEQ ID NO: 1258425 - RNA, 15 nt, Homo sapiens
ucaaaaaucuguccg

SEQ ID NO: 1258426 - RNA, 17 nt, Homo sapiens
ucaaaacagagauguga

SEQ ID NO: 1258427 - RNA, 20 nt, Homo sapiens
ucaaaacagagggcugcauu

SEQ ID NO: 1258428 - RNA, 20 nt, Homo sapiens
ucaaaacauucauaggcagu

SEQ ID NO: 1258429 - RNA, 13 nt, Homo sapiens
ucaaaacauucca

SEQ ID NO: 1258430 - RNA, 16 nt, Homo sapiens
ucaaaaccugugccag

SEQ ID NO: 1258431 - RNA, 22 nt, Homo sapiens
ucaaaagaaccagacugugucu

SEQ ID NO: 1258432 - RNA, 12 nt, Homo sapiens
ucaaaagaucaa

SEQ ID NO: 1258433 - RNA, 15 nt, Homo sapiens
ucaaaagcaccagca

SEQ ID NO: 1258434 - RNA, 15 nt, Homo sapiens
ucaaaagcacuuugu

SEQ ID NO: 1258435 - RNA, 22 nt, Homo sapiens
ucaaaauaaaaaugagguacuc

SEQ ID NO: 1258436 - RNA, 15 nt, Homo sapiens
ucaaaauccuuccaa

SEQ ID NO: 1258437 - RNA, 18 nt, Homo sapiens
ucaaaauccuuccaaaga

SEQ ID NO: 1258438 - RNA, 20 nt, Homo sapiens
ucaaaaucuuucagcacuca

SEQ ID NO: 1258439 - RNA, 13 nt, Homo sapiens
ucaaaauugccuu

SEQ ID NO: 1258440 - RNA, 15 nt, Homo sapiens
ucaaacccagucuca

SEQ ID NO: 1258441 - RNA, 17 nt, Homo sapiens
ucaaacccagucucaga

SEQ ID NO: 1258442 - RNA, 15 nt, Homo sapiens
ucaaacccauucccu

SEQ ID NO: 1258443 - RNA, 12 nt, Homo sapiens
ucaaacugugaa

SEQ ID NO: 1258444 - RNA, 12 nt, Homo sapiens
ucaaacuuuuau

SEQ ID NO: 1258445 - RNA, 12 nt, Homo sapiens
ucaaagaaagaa

SEQ ID NO: 1258446 - RNA, 14 nt, Homo sapiens
ucaaagaacaaaca

SEQ ID NO: 1258447 - RNA, 20 nt, Homo sapiens
ucaaagaauuacaguacaca

SEQ ID NO: 1258448 - RNA, 21 nt, Homo sapiens
ucaaagaauuucuucagucca

SEQ ID NO: 1258449 - RNA, 20 nt, Homo sapiens
ucaaagacagagaagaccaa

SEQ ID NO: 1258450 - RNA, 19 nt, Homo sapiens
ucaaagagguauauuugaa

SEQ ID NO: 1258451 - RNA, 21 nt, Homo sapiens
ucaaagcacagaauuugucag

SEQ ID NO: 1258452 - RNA, 18 nt, Homo sapiens
ucaaagcacuuggacucu

SEQ ID NO: 1258453 - RNA, 23 nt, Homo sapiens
ucaaagcuaaaauauauaauaua

SEQ ID NO: 1258454 - RNA, 21 nt, Homo sapiens
ucaaagcuuuuuccagaggcu

SEQ ID NO: 1258455 - RNA, 17 nt, Homo sapiens
ucaaaggccacauaccu

SEQ ID NO: 1258456 - RNA, 20 nt, Homo sapiens
ucaaaguguaaacaccauag

SEQ ID NO: 1258457 - RNA, 15 nt, Homo sapiens
ucaaaguguuuuuca

SEQ ID NO: 1258458 - RNA, 21 nt, Homo sapiens
ucaaaguuuggauuguaucaa

SEQ ID NO: 1258459 - RNA, 17 nt, Homo sapiens
ucaaauacacauuugcu

SEQ ID NO: 1258460 - RNA, 22 nt, Homo sapiens
ucaaauacacauuugcuacugu

SEQ ID NO: 1258461 - RNA, 13 nt, Homo sapiens
ucaaauagcauaa

SEQ ID NO: 1258462 - RNA, 19 nt, Homo sapiens
ucaaauaguugcauagcag

SEQ ID NO: 1258463 - RNA, 16 nt, Homo sapiens
ucaaauauuaccaaaa

SEQ ID NO: 1258464 - RNA, 20 nt, Homo sapiens
ucaaauauuaccaaaaaagu

SEQ ID NO: 1258465 - RNA, 15 nt, Homo sapiens
ucaaaucucuuccac

SEQ ID NO: 1258466 - RNA, 14 nt, Homo sapiens
ucaaauuaagcaua

SEQ ID NO: 1258467 - RNA, 19 nt, Homo sapiens
ucaaauuaagugugcauga

SEQ ID NO: 1258468 - RNA, 14 nt, Homo sapiens
ucaaauugcuuaaa

SEQ ID NO: 1258469 - RNA, 17 nt, Homo sapiens
ucaaauuggacuuucaa

SEQ ID NO: 1258470 - RNA, 19 nt, Homo sapiens
ucaacaaagcacaguguua

SEQ ID NO: 1258471 - RNA, 17 nt, Homo sapiens
ucaacaacacagcaaaa

SEQ ID NO: 1258472 - RNA, 20 nt, Homo sapiens
ucaacaccaggagagcuucu

SEQ ID NO: 1258473 - RNA, 12 nt, Homo sapiens
ucaacagaauuu

SEQ ID NO: 1258474 - RNA, 21 nt, Homo sapiens
ucaacauaggccugcucagcc

SEQ ID NO: 1258475 - RNA, 14 nt, Homo sapiens
ucaacauuacuguu

SEQ ID NO: 1258476 - RNA, 16 nt, Homo sapiens
ucaacccccuaccccg

SEQ ID NO: 1258477 - RNA, 21 nt, Homo sapiens
ucaaccugguggcaccagaug

SEQ ID NO: 1258478 - RNA, 14 nt, Homo sapiens
ucaacgucucagcc

SEQ ID NO: 1258479 - RNA, 19 nt, Homo sapiens
ucaacucguuuuuauauua

SEQ ID NO: 1258480 - RNA, 23 nt, Homo sapiens
ucaacucuccaauguucuauuaa

SEQ ID NO: 1258481 - RNA, 22 nt, Homo sapiens
ucaacugcuuugaaacuugccu

SEQ ID NO: 1258482 - RNA, 15 nt, Homo sapiens
ucaacugguuguaua

SEQ ID NO: 1258483 - RNA, 16 nt, Homo sapiens
ucaacugguuguauau

SEQ ID NO: 1258484 - RNA, 19 nt, Homo sapiens
ucaacuucagagacuaucu

SEQ ID NO: 1258485 - RNA, 12 nt, Homo sapiens
ucaacuuugaca

SEQ ID NO: 1258486 - RNA, 16 nt, Homo sapiens
ucaagaaaacaacuuc

SEQ ID NO: 1258487 - RNA, 15 nt, Homo sapiens
ucaagaaacugagga

SEQ ID NO: 1258488 - RNA, 19 nt, Homo sapiens
ucaagaagaggaaagggag

SEQ ID NO: 1258489 - RNA, 19 nt, Homo sapiens
ucaagaauggggaucacag

SEQ ID NO: 1258490 - RNA, 15 nt, Homo sapiens
ucaagacaaugcacc

SEQ ID NO: 1258491 - RNA, 15 nt, Homo sapiens
ucaagaccauaguga

SEQ ID NO: 1258492 - RNA, 19 nt, Homo sapiens
ucaagaccauagugaccaa

SEQ ID NO: 1258493 - RNA, 18 nt, Homo sapiens
ucaagauucuacuuggug

SEQ ID NO: 1258494 - RNA, 19 nt, Homo sapiens
ucaagauuuuuuuugucag

SEQ ID NO: 1258495 - RNA, 18 nt, Homo sapiens
ucaagcaccugcaugugc

SEQ ID NO: 1258496 - RNA, 13 nt, Homo sapiens
ucaagcacuaaaa

SEQ ID NO: 1258497 - RNA, 22 nt, Homo sapiens
ucaagcacuuacagcucuggcc

SEQ ID NO: 1258498 - RNA, 15 nt, Homo sapiens
ucaagcuagccagag

SEQ ID NO: 1258499 - RNA, 15 nt, Homo sapiens
ucaagcuauucucau

SEQ ID NO: 1258500 - RNA, 19 nt, Homo sapiens
ucaagcuauucucaugccu

SEQ ID NO: 1258501 - RNA, 22 nt, Homo sapiens
ucaagcuauucucaugccucag

SEQ ID NO: 1258502 - RNA, 18 nt, Homo sapiens
ucaagcugagauugagca

SEQ ID NO: 1258503 - RNA, 14 nt, Homo sapiens
ucaaggcacucuag

SEQ ID NO: 1258504 - RNA, 14 nt, Homo sapiens
ucaaggccuuccaa

SEQ ID NO: 1258505 - RNA, 15 nt, Homo sapiens
ucaaggcugcaguga

SEQ ID NO: 1258506 - RNA, 23 nt, Homo sapiens
ucaaggugggccuugcuaccuca

SEQ ID NO: 1258507 - RNA, 17 nt, Homo sapiens
ucaagguucuaacccua

SEQ ID NO: 1258508 - RNA, 17 nt, Homo sapiens
ucaagguugguucaaca

SEQ ID NO: 1258509 - RNA, 20 nt, Homo sapiens
ucaaguaguguaucacagua

SEQ ID NO: 1258510 - RNA, 19 nt, Homo sapiens
ucaaguccuacaagcuaaa

SEQ ID NO: 1258511 - RNA, 17 nt, Homo sapiens
ucaagucugacucucca

SEQ ID NO: 1258512 - RNA, 21 nt, Homo sapiens
ucaagugauucuccugccuca

SEQ ID NO: 1258513 - RNA, 20 nt, Homo sapiens
uaaaaguucuuuuugcucua

SEQ ID NO: 1258514 - RNA, 19 nt, Homo sapiens
uaaaaguuguuaccaaaua

SEQ ID NO: 1258515 - RNA, 21 nt, Homo sapiens
uaaaaguuuuuuauuaugcau

SEQ ID NO: 1258516 - RNA, 17 nt, Homo sapiens
uaaaauaaaaugcagac

SEQ ID NO: 1258517 - RNA, 13 nt, Homo sapiens
uaaaauaaaccaa

SEQ ID NO: 1258518 - RNA, 15 nt, Homo sapiens
uaaaauaaaccaaau

SEQ ID NO: 1258519 - RNA, 23 nt, Homo sapiens
uaaaauaaaguauauauagaauc

SEQ ID NO: 1258520 - RNA, 17 nt, Homo sapiens
uaaaauaagaaugauuu

SEQ ID NO: 1258521 - RNA, 17 nt, Homo sapiens
uaaaauaccuagaccua

SEQ ID NO: 1258522 - RNA, 18 nt, Homo sapiens
uaaaauacugcaaaaugu

SEQ ID NO: 1258523 - RNA, 20 nt, Homo sapiens
uaaaauacuuuuacucugcc

SEQ ID NO: 1258524 - RNA, 24 nt, Homo sapiens
uaaaauacuuuuacucugccuaca

SEQ ID NO: 1258525 - RNA, 13 nt, Homo sapiens
uaaaauagaaaca

SEQ ID NO: 1258526 - RNA, 22 nt, Homo sapiens
uaaaauagacuuacugcaguua

SEQ ID NO: 1258527 - RNA, 14 nt, Homo sapiens
uaaaauaguagcau

SEQ ID NO: 1258528 - RNA, 14 nt, Homo sapiens
uaaaauauggcuau

SEQ ID NO: 1258529 - RNA, 18 nt, Homo sapiens
uaaaauauuugaaugaaa

SEQ ID NO: 1258530 - RNA, 22 nt, Homo sapiens
uaaaauauuuuguaaugcugca

SEQ ID NO: 1258531 - RNA, 19 nt, Homo sapiens
uaaaauccuaagacacaaa

SEQ ID NO: 1258532 - RNA, 12 nt, Homo sapiens
uaaaaucucuaa

SEQ ID NO: 1258533 - RNA, 19 nt, Homo sapiens
uaaaaugaaauuacuacaa

SEQ ID NO: 1258534 - RNA, 12 nt, Homo sapiens
uaaaaugacuau

SEQ ID NO: 1258535 - RNA, 14 nt, Homo sapiens
uaaaaugcauugaa

SEQ ID NO: 1258536 - RNA, 11 nt, Homo sapiens
uaaaauggagg

SEQ ID NO: 1258537 - RNA, 16 nt, Homo sapiens
uaaaaugggaagacug

SEQ ID NO: 1258538 - RNA, 18 nt, Homo sapiens
uaaaaugugaagugaaug

SEQ ID NO: 1258539 - RNA, 14 nt, Homo sapiens
uaaaauguguugaa

SEQ ID NO: 1258540 - RNA, 12 nt, Homo sapiens
uaaaauguuuaa

SEQ ID NO: 1258541 - RNA, 15 nt, Homo sapiens
uaaaauuaccagaca

SEQ ID NO: 1258542 - RNA, 18 nt, Homo sapiens
uaaaauuaucaauaucua

SEQ ID NO: 1258543 - RNA, 19 nt, Homo sapiens
uaaaauucagaugcuguua

SEQ ID NO: 1258544 - RNA, 14 nt, Homo sapiens
uaaaauugcacuuu

SEQ ID NO: 1258545 - RNA, 15 nt, Homo sapiens
uaaaauugcacuuuu

SEQ ID NO: 1258546 - RNA, 16 nt, Homo sapiens
uaaaauugcugugcuu

SEQ ID NO: 1258547 - RNA, 19 nt, Homo sapiens
uaaaauugcuucuuuacca

SEQ ID NO: 1258548 - RNA, 15 nt, Homo sapiens
uaaaauuugugcugg

SEQ ID NO: 1258549 - RNA, 15 nt, Homo sapiens
uaaacaaaaagccaa

SEQ ID NO: 1258550 - RNA, 14 nt, Homo sapiens
uaaacaaacaaaca

SEQ ID NO: 1258551 - RNA, 22 nt, Homo sapiens
uaaacacauguucugugccugc

SEQ ID NO: 1258552 - RNA, 14 nt, Homo sapiens
uaaacaccauuuca

SEQ ID NO: 1258553 - RNA, 19 nt, Homo sapiens
uaaacagauggcacuuuga

SEQ ID NO: 1258554 - RNA, 15 nt, Homo sapiens
uaaacagguggugag

SEQ ID NO: 1258555 - RNA, 17 nt, Homo sapiens
uaaacauauuggaaugu

SEQ ID NO: 1258556 - RNA, 13 nt, Homo sapiens
uaaacauguguuu

SEQ ID NO: 1258557 - RNA, 22 nt, Homo sapiens
uaaacauugguaagaaugagcu

SEQ ID NO: 1258558 - RNA, 15 nt, Homo sapiens
uaaacauuucauuuc

SEQ ID NO: 1258559 - RNA, 13 nt, Homo sapiens
uaaaccaaccuuu

SEQ ID NO: 1258560 - RNA, 15 nt, Homo sapiens
uaaaccacagcacua

SEQ ID NO: 1258561 - RNA, 20 nt, Homo sapiens
uaaaccauaugaacauauau

SEQ ID NO: 1258562 - RNA, 20 nt, Homo sapiens
uaaaccuccgccaaugcacg

SEQ ID NO: 1258563 - RNA, 18 nt, Homo sapiens
uaaacgguuccuggugac

SEQ ID NO: 1258564 - RNA, 22 nt, Homo sapiens
uaaacuacaacgaacacaagaa

SEQ ID NO: 1258565 - RNA, 22 nt, Homo sapiens
uaaacucaagacaaugcaccua

SEQ ID NO: 1258566 - RNA, 13 nt, Homo sapiens
uaaacucagggac

SEQ ID NO: 1258567 - RNA, 13 nt, Homo sapiens
uaaacuccuacua

SEQ ID NO: 1258568 - RNA, 17 nt, Homo sapiens
uaaacugacuuuuuccc

SEQ ID NO: 1258569 - RNA, 19 nt, Homo sapiens
uaaacuggaauccuuucac

SEQ ID NO: 1258570 - RNA, 22 nt, Homo sapiens
uaaacuggcuggcccagaguuu

SEQ ID NO: 1258571 - RNA, 14 nt, Homo sapiens
uaaacuguacaugu

SEQ ID NO: 1258572 - RNA, 21 nt, Homo sapiens
uaaacuguaucaaaucuguau

SEQ ID NO: 1258573 - RNA, 18 nt, Homo sapiens
uaaacuguggguuuuccu

SEQ ID NO: 1258574 - RNA, 11 nt, Homo sapiens
uaaacugugua

SEQ ID NO: 1258575 - RNA, 21 nt, Homo sapiens
uaaacuguuuauuugcacuau

SEQ ID NO: 1258576 - RNA, 21 nt, Homo sapiens
uaaacuuaccugggcauucuu

SEQ ID NO: 1258577 - RNA, 22 nt, Homo sapiens
uaaacuucaccuacauuaucuc

SEQ ID NO: 1258578 - RNA, 21 nt, Homo sapiens
uaaacuuuagaauuaauuuau

SEQ ID NO: 1258579 - RNA, 20 nt, Homo sapiens
uaaagaaaaauaugauacuc

SEQ ID NO: 1258580 - RNA, 19 nt, Homo sapiens
uaaagaaaaugaacugccc

SEQ ID NO: 1258581 - RNA, 15 nt, Homo sapiens
uaaagaaauugcaau

SEQ ID NO: 1258582 - RNA, 13 nt, Homo sapiens
uaaagaagcaauc

SEQ ID NO: 1258583 - RNA, 21 nt, Homo sapiens
uaaagaaugcaaccuagucag

SEQ ID NO: 1258584 - RNA, 21 nt, Homo sapiens
uaaagacagggaagagcagaa

SEQ ID NO: 1258585 - RNA, 18 nt, Homo sapiens
uaaagagagaugaaccac

SEQ ID NO: 1258586 - RNA, 19 nt, Homo sapiens
uaaagagcagccuggcuaa

SEQ ID NO: 1258587 - RNA, 18 nt, Homo sapiens
uaaagagcuuugugauau

SEQ ID NO: 1258588 - RNA, 18 nt, Homo sapiens
uaaagauaauugcuauuu

SEQ ID NO: 1258589 - RNA, 17 nt, Homo sapiens
uaaagaugaucuacuca

SEQ ID NO: 1258590 - RNA, 15 nt, Homo sapiens
uaaagauggcacuuu

SEQ ID NO: 1258591 - RNA, 21 nt, Homo sapiens
uaaagcacccuguaucacaga

SEQ ID NO: 1258592 - RNA, 19 nt, Homo sapiens
uaaagcacuuugcacuuaa

SEQ ID NO: 1258593 - RNA, 17 nt, Homo sapiens
uaaagcauaaguauaca

SEQ ID NO: 1258594 - RNA, 19 nt, Homo sapiens
uaaagcauauuggugcuag

SEQ ID NO: 1258595 - RNA, 21 nt, Homo sapiens
uaaagccaacacccugucuaa

SEQ ID NO: 1258596 - RNA, 17 nt, Homo sapiens
uaaagccagccaugcau

SEQ ID NO: 1258597 - RNA, 11 nt, Homo sapiens
uaaagccucaa

SEQ ID NO: 1258598 - RNA, 14 nt, Homo sapiens
uaaagcuauuuccu

SEQ ID NO: 1258599 - RNA, 18 nt, Homo sapiens
uaaagcucaucagcuauc

SEQ ID NO: 1258600 - RNA, 22 nt, Homo sapiens
uaaagcugccggcacagaacuu

SEQ ID NO: 1258601 - RNA, 21 nt, Homo sapiens
uaaagcuggaacauuugauau

SEQ ID NO: 1258602 - RNA, 19 nt, Homo sapiens
uaaaggaaaaucacaucuc

SEQ ID NO: 1258603 - RNA, 14 nt, Homo sapiens
uaaaggacaggcca

SEQ ID NO: 1258604 - RNA, 20 nt, Homo sapiens
uaaaggcagcugccucugcu

SEQ ID NO: 1258605 - RNA, 21 nt, Homo sapiens
uaaaggcagcugccucugcuc

SEQ ID NO: 1258606 - RNA, 18 nt, Homo sapiens
uaaaggcccccacuucuc

SEQ ID NO: 1258607 - RNA, 23 nt, Homo sapiens
uaaaggcuugauauuuuccaaau

SEQ ID NO: 1258608 - RNA, 17 nt, Homo sapiens
uaaagggaucugcuuaa

SEQ ID NO: 1258609 - RNA, 20 nt, Homo sapiens
gcuguguguccuugcauggc

SEQ ID NO: 1258610 - RNA, 16 nt, Homo sapiens
gcuguguuuccaucuc

SEQ ID NO: 1258611 - RNA, 20 nt, Homo sapiens
gcuguuaauauaguuuagga

SEQ ID NO: 1258612 - RNA, 20 nt, Homo sapiens
gcuguuauuuuaucugcuau

SEQ ID NO: 1258613 - RNA, 23 nt, Homo sapiens
gcuguucauguuacucaugacuc

SEQ ID NO: 1258614 - RNA, 15 nt, Homo sapiens
gcuguuccuguucag

SEQ ID NO: 1258615 - RNA, 17 nt, Homo sapiens
gcuguucucuucuucau

SEQ ID NO: 1258616 - RNA, 21 nt, Homo sapiens
gcuguucuucuguucugcaga

SEQ ID NO: 1258617 - RNA, 15 nt, Homo sapiens
gcuguuguuccauug

SEQ ID NO: 1258618 - RNA, 15 nt, Homo sapiens
gcuguuugacaccuc

SEQ ID NO: 1258619 - RNA, 16 nt, Homo sapiens
gcuuaaaguugucacu

SEQ ID NO: 1258620 - RNA, 21 nt, Homo sapiens
gcuuaaccuuuccaguuuaua

SEQ ID NO: 1258621 - RNA, 15 nt, Homo sapiens
gcuuaacuugaaaaa

SEQ ID NO: 1258622 - RNA, 22 nt, Homo sapiens
gcuuaagaacugcuucauguga

SEQ ID NO: 1258623 - RNA, 17 nt, Homo sapiens
gcuuaccuccucauggc

SEQ ID NO: 1258624 - RNA, 18 nt, Homo sapiens
gcuuacuagcacuuugag

SEQ ID NO: 1258625 - RNA, 20 nt, Homo sapiens
gcuuacuguugcuuuaguca

SEQ ID NO: 1258626 - RNA, 16 nt, Homo sapiens
gcuuacuuaugccaua

SEQ ID NO: 1258627 - RNA, 20 nt, Homo sapiens
gcuuagacuucgacucagga

SEQ ID NO: 1258628 - RNA, 16 nt, Homo sapiens
gcuuaguuuguguguu

SEQ ID NO: 1258629 - RNA, 21 nt, Homo sapiens
gcuuauaaaaauaaagggaag

SEQ ID NO: 1258630 - RNA, 21 nt, Homo sapiens
gcuuauacacuuacacuuuau

SEQ ID NO: 1258631 - RNA, 15 nt, Homo sapiens
gcuuauggauucaua

SEQ ID NO: 1258632 - RNA, 13 nt, Homo sapiens
gcuuaugugacau

SEQ ID NO: 1258633 - RNA, 21 nt, Homo sapiens
gcuucaaauaaaguccugaca

SEQ ID NO: 1258634 - RNA, 21 nt, Homo sapiens
gcuucaaggauauacugcagc

SEQ ID NO: 1258635 - RNA, 15 nt, Homo sapiens
gcuucaaggcuucca

SEQ ID NO: 1258636 - RNA, 18 nt, Homo sapiens
gcuucaccagagcauuuc

SEQ ID NO: 1258637 - RNA, 12 nt, Homo sapiens
gcuucaccaguc

SEQ ID NO: 1258638 - RNA, 18 nt, Homo sapiens
gcuucagugacaaacaua

SEQ ID NO: 1258639 - RNA, 16 nt, Homo sapiens
gcuucauauaccagca

SEQ ID NO: 1258640 - RNA, 16 nt, Homo sapiens
gcuucauuuccugugu

SEQ ID NO: 1258641 - RNA, 13 nt, Homo sapiens
gcuuccaucccaa

SEQ ID NO: 1258642 - RNA, 15 nt, Homo sapiens
gcuuccaugauucua

SEQ ID NO: 1258643 - RNA, 17 nt, Homo sapiens
gcuuccuaaacuuucaa

SEQ ID NO: 1258644 - RNA, 13 nt, Homo sapiens
gcuuccugaaaua

SEQ ID NO: 1258645 - RNA, 20 nt, Homo sapiens
gcuuccugaaauaaacacug

SEQ ID NO: 1258646 - RNA, 22 nt, Homo sapiens
gcuuccugaaauaaacacuggu

SEQ ID NO: 1258647 - RNA, 19 nt, Homo sapiens
gcuuccuuuuauuuuuaua

SEQ ID NO: 1258648 - RNA, 12 nt, Homo sapiens
gcuucgcuggaa

SEQ ID NO: 1258649 - RNA, 12 nt, Homo sapiens
gcuucucaaagu

SEQ ID NO: 1258650 - RNA, 13 nt, Homo sapiens
gcuucucaucccc

SEQ ID NO: 1258651 - RNA, 14 nt, Homo sapiens
gcuucucaucccca

SEQ ID NO: 1258652 - RNA, 17 nt, Homo sapiens
gcuucuggaaacuacca

SEQ ID NO: 1258653 - RNA, 13 nt, Homo sapiens
gcuucuuuaccaa

SEQ ID NO: 1258654 - RNA, 14 nt, Homo sapiens
gcuugaagccaaag

SEQ ID NO: 1258655 - RNA, 22 nt, Homo sapiens
gcuugaagcuguggagggccac

SEQ ID NO: 1258656 - RNA, 15 nt, Homo sapiens
gcuugcaugcuugca

SEQ ID NO: 1258657 - RNA, 16 nt, Homo sapiens
gcuuggaguucucuau

SEQ ID NO: 1258658 - RNA, 17 nt, Homo sapiens
gcuuggggaacccauga

SEQ ID NO: 1258659 - RNA, 16 nt, Homo sapiens
gcuuguaucaacacug

SEQ ID NO: 1258660 - RNA, 16 nt, Homo sapiens
gcuuguuccacugcaa

SEQ ID NO: 1258661 - RNA, 21 nt, Homo sapiens
gcuuguuuacagcacuacucu

SEQ ID NO: 1258662 - RNA, 23 nt, Homo sapiens
gcuuguuuacagcacuacucugu

SEQ ID NO: 1258663 - RNA, 18 nt, Homo sapiens
gcuuguuucucauuccca

SEQ ID NO: 1258664 - RNA, 17 nt, Homo sapiens
gcuuuaaacucagggac

SEQ ID NO: 1258665 - RNA, 15 nt, Homo sapiens
gcuuuacugcaugaa

SEQ ID NO: 1258666 - RNA, 22 nt, Homo sapiens
gcuuuagaugaggaaaugaucc

SEQ ID NO: 1258667 - RNA, 20 nt, Homo sapiens
gcuuuauuccagaaugcugu

SEQ ID NO: 1258668 - RNA, 21 nt, Homo sapiens
gcuuucaagugccuuucugca

SEQ ID NO: 1258669 - RNA, 15 nt, Homo sapiens
gcuuucagcacucac

SEQ ID NO: 1258670 - RNA, 14 nt, Homo sapiens
gcuuucagggccau

SEQ ID NO: 1258671 - RNA, 13 nt, Homo sapiens
gcuuuccaaaacc

SEQ ID NO: 1258672 - RNA, 13 nt, Homo sapiens
cguucacucccaa

SEQ ID NO: 1258673 - RNA, 14 nt, Homo sapiens
cguucccacugccc

SEQ ID NO: 1258674 - RNA, 17 nt, Homo sapiens
cguugggagccuagcuc

SEQ ID NO: 1258675 - RNA, 13 nt, Homo sapiens
cguuguguuguug

SEQ ID NO: 1258676 - RNA, 21 nt, Homo sapiens
cguuucccagagucaucugau

SEQ ID NO: 1258677 - RNA, 14 nt, Homo sapiens
cguuucuguauaca

SEQ ID NO: 1258678 - RNA, 18 nt, Homo sapiens
cguuugugagcucccagc

SEQ ID NO: 1258679 - RNA, 13 nt, Homo sapiens
cguuuuauuccag

SEQ ID NO: 1258680 - RNA, 20 nt, Homo sapiens
cuaaaaagcauuuugaaaca

SEQ ID NO: 1258681 - RNA, 14 nt, Homo sapiens
cuaaaaaguaccag

SEQ ID NO: 1258682 - RNA, 14 nt, Homo sapiens
cuaaaacugcauuu

SEQ ID NO: 1258683 - RNA, 17 nt, Homo sapiens
cuaaaacuuaacauuca

SEQ ID NO: 1258684 - RNA, 12 nt, Homo sapiens
cuaaaagauuau

SEQ ID NO: 1258685 - RNA, 18 nt, Homo sapiens
cuaaaagcuuucaugucc

SEQ ID NO: 1258686 - RNA, 17 nt, Homo sapiens
cuaaaaggaaaucucac

SEQ ID NO: 1258687 - RNA, 18 nt, Homo sapiens
cuaaaagugggcuugauu

SEQ ID NO: 1258688 - RNA, 16 nt, Homo sapiens
cuaaaaguguaagaaa

SEQ ID NO: 1258689 - RNA, 16 nt, Homo sapiens
cuaaaauacaaaccca

SEQ ID NO: 1258690 - RNA, 13 nt, Homo sapiens
cuaaaauauuauu

SEQ ID NO: 1258691 - RNA, 15 nt, Homo sapiens
cuaaaauauuucauu

SEQ ID NO: 1258692 - RNA, 13 nt, Homo sapiens
cuaaaauucuguc

SEQ ID NO: 1258693 - RNA, 14 nt, Homo sapiens
cuaaaauucuguca

SEQ ID NO: 1258694 - RNA, 17 nt, Homo sapiens
cuaaaauucugucaggg

SEQ ID NO: 1258695 - RNA, 16 nt, Homo sapiens
cuaaacaaugcugauu

SEQ ID NO: 1258696 - RNA, 20 nt, Homo sapiens
cuaaacaaugcugauuuggu

SEQ ID NO: 1258697 - RNA, 12 nt, Homo sapiens
cuaaacauuucu

SEQ ID NO: 1258698 - RNA, 16 nt, Homo sapiens
cuaaacguauuucacu

SEQ ID NO: 1258699 - RNA, 22 nt, Homo sapiens
cuaaacuguuuauuugcacuau

SEQ ID NO: 1258700 - RNA, 12 nt, Homo sapiens
cuaaacuuucaa

SEQ ID NO: 1258701 - RNA, 14 nt, Homo sapiens
cuaaagaauccaua

SEQ ID NO: 1258702 - RNA, 20 nt, Homo sapiens
cuaaagagagaugaaccaca

SEQ ID NO: 1258703 - RNA, 18 nt, Homo sapiens
cuaaagauugcagcauuu

SEQ ID NO: 1258704 - RNA, 16 nt, Homo sapiens
cuacaguacaaucagc

SEQ ID NO: 1258705 - RNA, 18 nt, Homo sapiens
cuacauaaggaugaaggu

SEQ ID NO: 1258706 - RNA, 21 nt, Homo sapiens
cuacaugacgacaaagcugcu

SEQ ID NO: 1258707 - RNA, 14 nt, Homo sapiens
cuacaugccaugac

SEQ ID NO: 1258708 - RNA, 21 nt, Homo sapiens
cuacaugccucagugaaggac

SEQ ID NO: 1258709 - RNA, 14 nt, Homo sapiens
cuacaugcugaaaa

SEQ ID NO: 1258710 - RNA, 16 nt, Homo sapiens
cuacauguauugcaca

SEQ ID NO: 1258711 - RNA, 21 nt, Homo sapiens
cuaccaauuucuuuuauguua

SEQ ID NO: 1258712 - RNA, 13 nt, Homo sapiens
cuaccacaaggaa

SEQ ID NO: 1258713 - RNA, 18 nt, Homo sapiens
cuaccacgggucugccau

SEQ ID NO: 1258714 - RNA, 12 nt, Homo sapiens
cuaccacuguau

SEQ ID NO: 1258715 - RNA, 21 nt, Homo sapiens
cuaccagguguucuacacuca

SEQ ID NO: 1258716 - RNA, 17 nt, Homo sapiens
cuaccaucugauguuuc

SEQ ID NO: 1258717 - RNA, 15 nt, Homo sapiens
cuacccuaaagggag

SEQ ID NO: 1258718 - RNA, 20 nt, Homo sapiens
cuaccuaaaaguugguuaaa

SEQ ID NO: 1258719 - RNA, 18 nt, Homo sapiens
cuaccuagggcacuuuaa

SEQ ID NO: 1258720 - RNA, 12 nt, Homo sapiens
cuaccucugacu

SEQ ID NO: 1258721 - RNA, 15 nt, Homo sapiens
cuacggguaggucua

SEQ ID NO: 1258722 - RNA, 22 nt, Homo sapiens
cuacgguuuuauaaaagccuug

SEQ ID NO: 1258723 - RNA, 14 nt, Homo sapiens
cuacguauccugca

SEQ ID NO: 1258724 - RNA, 14 nt, Homo sapiens
cuacuaaaaacaca

SEQ ID NO: 1258725 - RNA, 20 nt, Homo sapiens
cuacuacaaacuucaaagag

SEQ ID NO: 1258726 - RNA, 17 nt, Homo sapiens
cuacuaccuagggcacu

SEQ ID NO: 1258727 - RNA, 14 nt, Homo sapiens
cuacuagagucuga

SEQ ID NO: 1258728 - RNA, 13 nt, Homo sapiens
cuacuauauugau

SEQ ID NO: 1258729 - RNA, 19 nt, Homo sapiens
cuacuauguacugccuuag

SEQ ID NO: 1258730 - RNA, 21 nt, Homo sapiens
cuacucagccuagcacaggcu

SEQ ID NO: 1258731 - RNA, 22 nt, Homo sapiens
cuacucccuuauguguugugua

SEQ ID NO: 1258732 - RNA, 20 nt, Homo sapiens
cuacuccuuguaaagacugu

SEQ ID NO: 1258733 - RNA, 16 nt, Homo sapiens
cuacugaggugcuaug

SEQ ID NO: 1258734 - RNA, 20 nt, Homo sapiens
cuacugagucacaauaaaga

SEQ ID NO: 1258735 - RNA, 18 nt, Homo sapiens
cuacugcagcaccuccag

SEQ ID NO: 1258736 - RNA, 19 nt, Homo sapiens
cuacugccucggaucucuc

SEQ ID NO: 1258737 - RNA, 17 nt, Homo sapiens
cuacuggacuaugcuga

SEQ ID NO: 1258738 - RNA, 20 nt, Homo sapiens
cuacuguuccuuucagauga

SEQ ID NO: 1258739 - RNA, 12 nt, Homo sapiens
cuacuguucuaa

SEQ ID NO: 1258740 - RNA, 15 nt, Homo sapiens
cuacuuaaugagaua

SEQ ID NO: 1258741 - RNA, 15 nt, Homo sapiens
cuacuucauagcucc

SEQ ID NO: 1258742 - RNA, 19 nt, Homo sapiens
cuacuuccugugacuucag

SEQ ID NO: 1258743 - RNA, 14 nt, Homo sapiens
cuacuugggagcac

SEQ ID NO: 1258744 - RNA, 20 nt, Homo sapiens
cuacuugggaggcugaggca

SEQ ID NO: 1258745 - RNA, 15 nt, Homo sapiens
cuacuuuuugcaccu

SEQ ID NO: 1258746 - RNA, 22 nt, Homo sapiens
cuacuuuuuuuuaguucaauac

SEQ ID NO: 1258747 - RNA, 19 nt, Homo sapiens
cuagaaaacaggcaaauuc

SEQ ID NO: 1258748 - RNA, 19 nt, Homo sapiens
cuagaaacaaacaucuaau

SEQ ID NO: 1258749 - RNA, 13 nt, Homo sapiens
cuagaaacccaag

SEQ ID NO: 1258750 - RNA, 18 nt, Homo sapiens
cuagaaacccaagcuccu

SEQ ID NO: 1258751 - RNA, 19 nt, Homo sapiens
cuagaaaggaagacagauu

SEQ ID NO: 1258752 - RNA, 20 nt, Homo sapiens
cuagaaauaagcccaacaga

SEQ ID NO: 1258753 - RNA, 16 nt, Homo sapiens
cuagaaaucugccaau

SEQ ID NO: 1258754 - RNA, 24 nt, Homo sapiens
cuagaauauuuaaaacaucauuac

SEQ ID NO: 1258755 - RNA, 19 nt, Homo sapiens
cuagaauuuucucccuuua

SEQ ID NO: 1258756 - RNA, 16 nt, Homo sapiens
cuagaccuggugcuga

SEQ ID NO: 1258757 - RNA, 20 nt, Homo sapiens
cuagacuauuaggugcaauu

SEQ ID NO: 1258758 - RNA, 19 nt, Homo sapiens
cuagacugccagggagacc

SEQ ID NO: 1258759 - RNA, 13 nt, Homo sapiens
cuagagaugugca

SEQ ID NO: 1258760 - RNA, 20 nt, Homo sapiens
cuagagccauuuaacauuuc

SEQ ID NO: 1258761 - RNA, 18 nt, Homo sapiens
cuagaggauguaucucac

SEQ ID NO: 1258762 - RNA, 22 nt, Homo sapiens
cuagaggcuugcauaauaagcu

SEQ ID NO: 1258763 - RNA, 14 nt, Homo sapiens
cuagagucauguga

SEQ ID NO: 1258764 - RNA, 17 nt, Homo sapiens
cuagaguccucacuccc

SEQ ID NO: 1258765 - RNA, 12 nt, Homo sapiens
cuagaguuuuau

SEQ ID NO: 1258766 - RNA, 13 nt, Homo sapiens
cuagauaccacuu

SEQ ID NO: 1258767 - RNA, 21 nt, Homo sapiens
cuagaugagcccagcccuguu

SEQ ID NO: 1258768 - RNA, 12 nt, Homo sapiens
cuagauguaaca

SEQ ID NO: 1258769 - RNA, 16 nt, Homo sapiens
cuagauuuucuacuuu

SEQ ID NO: 1258770 - RNA, 23 nt, Homo sapiens
cuagcagaaaucuagaagacugu

SEQ ID NO: 1258771 - RNA, 23 nt, Homo sapiens
cuagcaggccuaagacaugugag

SEQ ID NO: 1258772 - RNA, 12 nt, Homo sapiens
cuagcauuguaa

SEQ ID NO: 1258773 - RNA, 16 nt, Homo sapiens
cuagccagaggcucua

SEQ ID NO: 1258774 - RNA, 18 nt, Homo sapiens
cuagccugggccagagaa

SEQ ID NO: 1258775 - RNA, 21 nt, Homo sapiens
cuaggaaacucacacuccccu

SEQ ID NO: 1258776 - RNA, 15 nt, Homo sapiens
cuaggaagaaucagu

SEQ ID NO: 1258777 - RNA, 14 nt, Homo sapiens
cuaggaagcagcug

SEQ ID NO: 1258778 - RNA, 18 nt, Homo sapiens
cuaggccacaccaucucc

SEQ ID NO: 1258779 - RNA, 12 nt, Homo sapiens
cuaggccccaga

SEQ ID NO: 1258780 - RNA, 20 nt, Homo sapiens
cuagggcacuuuaagucagu

SEQ ID NO: 1258781 - RNA, 21 nt, Homo sapiens
cuagggcacuuuaagucagug

SEQ ID NO: 1258782 - RNA, 19 nt, Homo sapiens
cuaggggaacagaccagug

SEQ ID NO: 1258783 - RNA, 18 nt, Homo sapiens
cuaggggucaggcuccau

SEQ ID NO: 1258784 - RNA, 15 nt, Homo sapiens
cuaggguuucuuaaa

SEQ ID NO: 1258785 - RNA, 15 nt, Homo sapiens
cuagguaggggccca

SEQ ID NO: 1258786 - RNA, 22 nt, Homo sapiens
cuagguaucauucaacucucca

SEQ ID NO: 1258787 - RNA, 17 nt, Homo sapiens
cuaggucuccucagggu

SEQ ID NO: 1258788 - RNA, 13 nt, Homo sapiens
cuagguucaggaa

SEQ ID NO: 1258789 - RNA, 15 nt, Homo sapiens
cuagguuucaaagau

SEQ ID NO: 1258790 - RNA, 17 nt, Homo sapiens
cuagguuuuauucauac

SEQ ID NO: 1258791 - RNA, 17 nt, Homo sapiens
cuaguaagaugcacuga

SEQ ID NO: 1258792 - RNA, 18 nt, Homo sapiens
cuaguaagaugcacugaa

SEQ ID NO: 1258793 - RNA, 12 nt, Homo sapiens
cuaguacuguau

SEQ ID NO: 1258794 - RNA, 16 nt, Homo sapiens
cuaguacuuauuacau

SEQ ID NO: 1258795 - RNA, 21 nt, Homo sapiens
cuaguauuucaugcugggaau

SEQ ID NO: 1258796 - RNA, 19 nt, Homo sapiens
cuagucacaaagacuccuu

SEQ ID NO: 1258797 - RNA, 23 nt, Homo sapiens
cuaguccccagccugcucccuag

SEQ ID NO: 1258798 - RNA, 23 nt, Homo sapiens
cuagugagcaaaauaugccccuu

SEQ ID NO: 1258799 - RNA, 12 nt, Homo sapiens
cuagugccuuua

SEQ ID NO: 1258800 - RNA, 18 nt, Homo sapiens
cuaguguaccuccucuca

SEQ ID NO: 1258801 - RNA, 21 nt, Homo sapiens
cuaguuuauuggaaguguuca

SEQ ID NO: 1258802 - RNA, 15 nt, Homo sapiens
cuaguuugaccucau

SEQ ID NO: 1258803 - RNA, 13 nt, Homo sapiens
cuaguuugcacua

SEQ ID NO: 1258804 - RNA, 14 nt, Homo sapiens
cuaguuuucaauca

SEQ ID NO: 1258805 - RNA, 24 nt, Homo sapiens
cuauaaaaugcaguaacauucuac

SEQ ID NO: 1258806 - RNA, 16 nt, Homo sapiens
cuauaaaguaaagcua

SEQ ID NO: 1258807 - RNA, 13 nt, Homo sapiens
cuauaaccucagc

SEQ ID NO: 1258808 - RNA, 17 nt, Homo sapiens
cuauaagcccacuguua

SEQ ID NO: 1258809 - RNA, 19 nt, Homo sapiens
cuauaaucaaaugauuuca

SEQ ID NO: 1258810 - RNA, 19 nt, Homo sapiens
cuauaaucccagcacuuug

SEQ ID NO: 1258811 - RNA, 13 nt, Homo sapiens
cuauaaucuguca

SEQ ID NO: 1258812 - RNA, 23 nt, Homo sapiens
cuauaauuauaaucaaaaucaau

SEQ ID NO: 1258813 - RNA, 17 nt, Homo sapiens
cuauaauuaugcaguac

SEQ ID NO: 1258814 - RNA, 21 nt, Homo sapiens
cuauaauuuaccuaagauuac

SEQ ID NO: 1258815 - RNA, 17 nt, Homo sapiens
cuauaauuuugccuuua

SEQ ID NO: 1258816 - RNA, 16 nt, Homo sapiens
cuauacacaagcaaug

SEQ ID NO: 1258817 - RNA, 23 nt, Homo sapiens
cuauagccuaggugacagaguga

SEQ ID NO: 1258818 - RNA, 16 nt, Homo sapiens
cuauaguuauacauca

SEQ ID NO: 1258819 - RNA, 16 nt, Homo sapiens
cuauauaaauauguca

SEQ ID NO: 1258820 - RNA, 17 nt, Homo sapiens
cuauauacuauaugauu

SEQ ID NO: 1258821 - RNA, 18 nt, Homo sapiens
cuauauacuauaugauuc

SEQ ID NO: 1258822 - RNA, 17 nt, Homo sapiens
cuauauauaauucugua

SEQ ID NO: 1258823 - RNA, 14 nt, Homo sapiens
cuauauauguguau

SEQ ID NO: 1258824 - RNA, 20 nt, Homo sapiens
cuauauucuauacacacccu

SEQ ID NO: 1258825 - RNA, 18 nt, Homo sapiens
cuauauugcuuaccugau

SEQ ID NO: 1258826 - RNA, 21 nt, Homo sapiens
cuauauuugcuuuuugcuaac

SEQ ID NO: 1258827 - RNA, 24 nt, Homo sapiens
cuauauuuuuuguaacauaaugca

SEQ ID NO: 1258828 - RNA, 18 nt, Homo sapiens
cucacuuuuuacccagaa

SEQ ID NO: 1258829 - RNA, 17 nt, Homo sapiens
cucagaaaagugacagu

SEQ ID NO: 1258830 - RNA, 22 nt, Homo sapiens
cucagaaacugcgaggccaguu

SEQ ID NO: 1258831 - RNA, 13 nt, Homo sapiens
cucagaaccugcu

SEQ ID NO: 1258832 - RNA, 16 nt, Homo sapiens
cucagaaccugcuccu

SEQ ID NO: 1258833 - RNA, 21 nt, Homo sapiens
cucagaagugaaaaucuugga

SEQ ID NO: 1258834 - RNA, 22 nt, Homo sapiens
cucagaauauugucugccuuaa

SEQ ID NO: 1258835 - RNA, 17 nt, Homo sapiens
cucagaauucaucugaa

SEQ ID NO: 1258836 - RNA, 23 nt, Homo sapiens
cucagacagaaccccuacaugaa

SEQ ID NO: 1258837 - RNA, 23 nt, Homo sapiens
cucagagaauuucuaccauuuca

SEQ ID NO: 1258838 - RNA, 14 nt, Homo sapiens
cucagaggccugcu

SEQ ID NO: 1258839 - RNA, 18 nt, Homo sapiens
cucagaucaguguaccau

SEQ ID NO: 1258840 - RNA, 13 nt, Homo sapiens
cucagauguugaa

SEQ ID NO: 1258841 - RNA, 13 nt, Homo sapiens
cucagcaacagug

SEQ ID NO: 1258842 - RNA, 21 nt, Homo sapiens
cucagcaguccacaaagcauu

SEQ ID NO: 1258843 - RNA, 14 nt, Homo sapiens
cucagccccuagga

SEQ ID NO: 1258844 - RNA, 22 nt, Homo sapiens
cucagccuaggcccucaugaua

SEQ ID NO: 1258845 - RNA, 18 nt, Homo sapiens
cucagcuguccugcagca

SEQ ID NO: 1258846 - RNA, 19 nt, Homo sapiens
cucagcuuuuuaauuaaau

SEQ ID NO: 1258847 - RNA, 15 nt, Homo sapiens
cucaggagaagggau

SEQ ID NO: 1258848 - RNA, 17 nt, Homo sapiens
cucagggacagagccau

SEQ ID NO: 1258849 - RNA, 22 nt, Homo sapiens
cucagggagcagggaaggccug

SEQ ID NO: 1258850 - RNA, 22 nt, Homo sapiens
cucagggccuggcaggccagug

SEQ ID NO: 1258851 - RNA, 20 nt, Homo sapiens
cucaggggccaacuaggcag

SEQ ID NO: 1258852 - RNA, 15 nt, Homo sapiens
cucagggguuucauu

SEQ ID NO: 1258853 - RNA, 14 nt, Homo sapiens
cucagggugcagag

SEQ ID NO: 1258854 - RNA, 14 nt, Homo sapiens
cucagggugggggg

SEQ ID NO: 1258855 - RNA, 16 nt, Homo sapiens
cucaggguucaucugu

SEQ ID NO: 1258856 - RNA, 16 nt, Homo sapiens
cucagguagauuuugu

SEQ ID NO: 1258857 - RNA, 16 nt, Homo sapiens
cucaggugaucugccc

SEQ ID NO: 1258858 - RNA, 15 nt, Homo sapiens
cucagguguugccaa

SEQ ID NO: 1258859 - RNA, 16 nt, Homo sapiens
cucagguguugccaaa

SEQ ID NO: 1258860 - RNA, 22 nt, Homo sapiens
cucagguuuguuuugugaauuu

SEQ ID NO: 1258861 - RNA, 21 nt, Homo sapiens
cucaguaaacgggaacaugcc

SEQ ID NO: 1258862 - RNA, 22 nt, Homo sapiens
cucaguaaacgggaacaugccc

SEQ ID NO: 1258863 - RNA, 22 nt, Homo sapiens
cucaguaagaagagcuuggaaa

SEQ ID NO: 1258864 - RNA, 15 nt, Homo sapiens
cucagucaugcauaa

SEQ ID NO: 1258865 - RNA, 19 nt, Homo sapiens
cucagucauuuuuaaccuc

SEQ ID NO: 1258866 - RNA, 20 nt, Homo sapiens
cuugagccgggccccugggc

SEQ ID NO: 1258867 - RNA, 12 nt, Homo sapiens
cuugagguggga

SEQ ID NO: 1258868 - RNA, 20 nt, Homo sapiens
cuugaguguaauguuuguua

SEQ ID NO: 1258869 - RNA, 22 nt, Homo sapiens
cuugauauguaaguacuuccac

SEQ ID NO: 1258870 - RNA, 13 nt, Homo sapiens
cuugaugauacaa

SEQ ID NO: 1258871 - RNA, 16 nt, Homo sapiens
cuugaugauuuuuaac

SEQ ID NO: 1258872 - RNA, 19 nt, Homo sapiens
cuugauguugcuuagucac

SEQ ID NO: 1258873 - RNA, 14 nt, Homo sapiens
cuugauugucuccu

SEQ ID NO: 1258874 - RNA, 20 nt, Homo sapiens
cuugauuuagcacuauuuac

SEQ ID NO: 1258875 - RNA, 21 nt, Homo sapiens
cuugcaaagaccuaccuccag

SEQ ID NO: 1258876 - RNA, 21 nt, Homo sapiens
cuugcacaggucccacugccc

SEQ ID NO: 1258877 - RNA, 18 nt, Homo sapiens
cuugcaggugacauuugc

SEQ ID NO: 1258878 - RNA, 24 nt, Homo sapiens
cuugcauaggcucuuaagcagcau

SEQ ID NO: 1258879 - RNA, 14 nt, Homo sapiens
cuugccacccaaau

SEQ ID NO: 1258880 - RNA, 13 nt, Homo sapiens
cuugccaggcucc

SEQ ID NO: 1258881 - RNA, 17 nt, Homo sapiens
cuugcccagacuacagg

SEQ ID NO: 1258882 - RNA, 20 nt, Homo sapiens
cuugccuaaauacaagggcu

SEQ ID NO: 1258883 - RNA, 14 nt, Homo sapiens
cuugccuaagacuu

SEQ ID NO: 1258884 - RNA, 17 nt, Homo sapiens
cuugccucucucaggag

SEQ ID NO: 1258885 - RNA, 16 nt, Homo sapiens
cuugcgaacuagagau

SEQ ID NO: 1258886 - RNA, 21 nt, Homo sapiens
cuugcuaaaagauuauagaag

SEQ ID NO: 1258887 - RNA, 18 nt, Homo sapiens
cuugcuaauuuucucaaa

SEQ ID NO: 1258888 - RNA, 21 nt, Homo sapiens
cuugcuagacagccagguuag

SEQ ID NO: 1258889 - RNA, 20 nt, Homo sapiens
cuugcucaaccauggcugaa

SEQ ID NO: 1258890 - RNA, 18 nt, Homo sapiens
cuugcucauaugcaugua

SEQ ID NO: 1258891 - RNA, 20 nt, Homo sapiens
cuugcuggaaaacccaaagu

SEQ ID NO: 1258892 - RNA, 16 nt, Homo sapiens
cuugcuggacggggac

SEQ ID NO: 1258893 - RNA, 16 nt, Homo sapiens
cuugcuuauucacuga

SEQ ID NO: 1258894 - RNA, 23 nt, Homo sapiens
cuugcuuguugggauuccugacc

SEQ ID NO: 1258895 - RNA, 21 nt, Homo sapiens
cuuggaaauuggaagagcaca

SEQ ID NO: 1258896 - RNA, 16 nt, Homo sapiens
cuuggaacauuggaau

SEQ ID NO: 1258897 - RNA, 20 nt, Homo sapiens
cuuggaaguguuucaaaaaa

SEQ ID NO: 1258898 - RNA, 22 nt, Homo sapiens
cuuggacaggagucagugucug

SEQ ID NO: 1258899 - RNA, 20 nt, Homo sapiens
cuuggagacaaaaucuuaaa

SEQ ID NO: 1258900 - RNA, 17 nt, Homo sapiens
cuuggagcccgugcagu

SEQ ID NO: 1258901 - RNA, 20 nt, Homo sapiens
cuuggagggauaagccagcu

SEQ ID NO: 1258902 - RNA, 14 nt, Homo sapiens
cuuggcaaaagccu

SEQ ID NO: 1258903 - RNA, 13 nt, Homo sapiens
cuuggcaccaaag

SEQ ID NO: 1258904 - RNA, 21 nt, Homo sapiens
cuuggcaguugcagugcugcu

SEQ ID NO: 1258905 - RNA, 23 nt, Homo sapiens
cuuggcccaggauuauugucaaa

SEQ ID NO: 1258906 - RNA, 16 nt, Homo sapiens
cuuggcuucugugaug

SEQ ID NO: 1258907 - RNA, 17 nt, Homo sapiens
cuuggcuucugugauga

SEQ ID NO: 1258908 - RNA, 20 nt, Homo sapiens
cuugggaaaaaaacuuggca

SEQ ID NO: 1258909 - RNA, 20 nt, Homo sapiens
cuugggaaacuauucaugaa

SEQ ID NO: 1258910 - RNA, 16 nt, Homo sapiens
cuugggccuugcugcu

SEQ ID NO: 1258911 - RNA, 16 nt, Homo sapiens
cuugggcuacuggcag

SEQ ID NO: 1258912 - RNA, 17 nt, Homo sapiens
cuuggggaacccaugag

SEQ ID NO: 1258913 - RNA, 20 nt, Homo sapiens
cuuggggagauggaguucuu

SEQ ID NO: 1258914 - RNA, 20 nt, Homo sapiens
cuuggggcggaacucacugc

SEQ ID NO: 1258915 - RNA, 20 nt, Homo sapiens
cuugggggaacgaugugucu

SEQ ID NO: 1258916 - RNA, 15 nt, Homo sapiens
cuugggggucagggg

SEQ ID NO: 1258917 - RNA, 17 nt, Homo sapiens
cuugggguaagccagag

SEQ ID NO: 1258918 - RNA, 18 nt, Homo sapiens
cuugggugggugaaggcc

SEQ ID NO: 1258919 - RNA, 17 nt, Homo sapiens
cuuggucuuuguaucuu

SEQ ID NO: 1258920 - RNA, 17 nt, Homo sapiens
cuugguuuucccuuugc

SEQ ID NO: 1258921 - RNA, 11 nt, Homo sapiens
cuuguaaaaag

SEQ ID NO: 1258922 - RNA, 14 nt, Homo sapiens
cuuguaaagacugu

SEQ ID NO: 1258923 - RNA, 13 nt, Homo sapiens
cuuguaaauuaca

SEQ ID NO: 1258924 - RNA, 20 nt, Homo sapiens
cuuguacccccagguggaag

SEQ ID NO: 1258925 - RNA, 12 nt, Homo sapiens
cuuguaccucaa

SEQ ID NO: 1258926 - RNA, 16 nt, Homo sapiens
cuuguacuacacagaa

SEQ ID NO: 1258927 - RNA, 15 nt, Homo sapiens
cuuguagcuguaaaa

SEQ ID NO: 1258928 - RNA, 21 nt, Homo sapiens
cuuuggaaaaugucacuguga

SEQ ID NO: 1258929 - RNA, 15 nt, Homo sapiens
cuuuggaauggugua

SEQ ID NO: 1258930 - RNA, 16 nt, Homo sapiens
cuuuggacauggcuca

SEQ ID NO: 1258931 - RNA, 19 nt, Homo sapiens
cuuuggaccuaauccaagc

SEQ ID NO: 1258932 - RNA, 21 nt, Homo sapiens
cuuuggagcagcuucugggac

SEQ ID NO: 1258933 - RNA, 15 nt, Homo sapiens
cuuuggccauuccaa

SEQ ID NO: 1258934 - RNA, 15 nt, Homo sapiens
cuuuggcgaccuccu

SEQ ID NO: 1258935 - RNA, 22 nt, Homo sapiens
cuuuggggagcaggaggccaau

SEQ ID NO: 1258936 - RNA, 14 nt, Homo sapiens
cuuugguaaucucu

SEQ ID NO: 1258937 - RNA, 15 nt, Homo sapiens
cuuuggucauuucuc

SEQ ID NO: 1258938 - RNA, 22 nt, Homo sapiens
cuuuggucuauuuucugcagaa

SEQ ID NO: 1258939 - RNA, 21 nt, Homo sapiens
cuuuguaaagaaaguggcuug

SEQ ID NO: 1258940 - RNA, 22 nt, Homo sapiens
cuuugucaccacguggggcuca

SEQ ID NO: 1258941 - RNA, 23 nt, Homo sapiens
cuuugucccggggcuccacugaa

SEQ ID NO: 1258942 - RNA, 19 nt, Homo sapiens
cuuugucgugguucuuaaa

SEQ ID NO: 1258943 - RNA, 15 nt, Homo sapiens
cuuugucucaccuca

SEQ ID NO: 1258944 - RNA, 13 nt, Homo sapiens
cuuugucugaaaa

SEQ ID NO: 1258945 - RNA, 15 nt, Homo sapiens
cuuugugguagcuua

SEQ ID NO: 1258946 - RNA, 18 nt, Homo sapiens
cuuuguggucgacaucaa

SEQ ID NO: 1258947 - RNA, 13 nt, Homo sapiens
cuuuguguagaaa

SEQ ID NO: 1258948 - RNA, 18 nt, Homo sapiens
cuuuguguagaaagccaa

SEQ ID NO: 1258949 - RNA, 14 nt, Homo sapiens
cuuuguuaggauuu

SEQ ID NO: 1258950 - RNA, 17 nt, Homo sapiens
cuuuguuaugacaguga

SEQ ID NO: 1258951 - RNA, 18 nt, Homo sapiens
cuuuguuaugacagugaa

SEQ ID NO: 1258952 - RNA, 17 nt, Homo sapiens
cuuuuaaaagcacguau

SEQ ID NO: 1258953 - RNA, 18 nt, Homo sapiens
cuuuuaaaauacauuugg

SEQ ID NO: 1258954 - RNA, 14 nt, Homo sapiens
cuuuuaacagaaca

SEQ ID NO: 1258955 - RNA, 18 nt, Homo sapiens
cuuuuaagaaacacaggg

SEQ ID NO: 1258956 - RNA, 17 nt, Homo sapiens
cuuuuaaucaacuguag

SEQ ID NO: 1258957 - RNA, 22 nt, Homo sapiens
cuuuuaauggaugguugaauua

SEQ ID NO: 1258958 - RNA, 13 nt, Homo sapiens
cuuuuaauucaaa

SEQ ID NO: 1258959 - RNA, 13 nt, Homo sapiens
cuuuuacauucug

SEQ ID NO: 1258960 - RNA, 20 nt, Homo sapiens
cuuuuaccuacccgugccug

SEQ ID NO: 1258961 - RNA, 17 nt, Homo sapiens
cuuuuauaccuaucuga

SEQ ID NO: 1258962 - RNA, 19 nt, Homo sapiens
cuuuuauggaugauuaaau

SEQ ID NO: 1258963 - RNA, 17 nt, Homo sapiens
cuuuuauugacacagaa

SEQ ID NO: 1258964 - RNA, 22 nt, Homo sapiens
cuuuucaagacuuccucaugaa

SEQ ID NO: 1258965 - RNA, 22 nt, Homo sapiens
cuuuucaaggaaaaaugcugcu

SEQ ID NO: 1258966 - RNA, 23 nt, Homo sapiens
cuuuucacugcuggcugccuuag

SEQ ID NO: 1258967 - RNA, 17 nt, Homo sapiens
cuuuucaucuaauguga

SEQ ID NO: 1258968 - RNA, 21 nt, Homo sapiens
cuuuuccgcacuaccugaaca

SEQ ID NO: 1258969 - RNA, 24 nt, Homo sapiens
cuuuucuagccuauuuaccugcag

SEQ ID NO: 1258970 - RNA, 21 nt, Homo sapiens
cuuuucucaccugucaucuca

SEQ ID NO: 1258971 - RNA, 16 nt, Homo sapiens
cuuuucucacucagau

SEQ ID NO: 1258972 - RNA, 16 nt, Homo sapiens
cuuuucugaucugcag

SEQ ID NO: 1258973 - RNA, 22 nt, Homo sapiens
cuuuucugccacuccauauuaa

SEQ ID NO: 1258974 - RNA, 19 nt, Homo sapiens
cuuuucuggaauguaauca

SEQ ID NO: 1258975 - RNA, 17 nt, Homo sapiens
cuuuugagaaccaagua

SEQ ID NO: 1258976 - RNA, 21 nt, Homo sapiens
cuuuugagacuuuuuggugga

SEQ ID NO: 1258977 - RNA, 19 nt, Homo sapiens
cuuuugccaguauuaugca

SEQ ID NO: 1258978 - RNA, 16 nt, Homo sapiens
cuuuugcuugaauuua

SEQ ID NO: 1258979 - RNA, 19 nt, Homo sapiens
cuuuuggaccuugggauca

SEQ ID NO: 1258980 - RNA, 16 nt, Homo sapiens
cuuuuggauaugcuga

SEQ ID NO: 1258981 - RNA, 22 nt, Homo sapiens
cuuuugguuugggcuguauuga

SEQ ID NO: 1258982 - RNA, 16 nt, Homo sapiens
cuuuuuacaauuaaaa

SEQ ID NO: 1258983 - RNA, 16 nt, Homo sapiens
cuuuuucaaugaauuu

SEQ ID NO: 1258984 - RNA, 12 nt, Homo sapiens
cuuuuucauaua

SEQ ID NO: 1258985 - RNA, 23 nt, Homo sapiens
cuuuuucguguggaucuugccac

SEQ ID NO: 1258986 - RNA, 13 nt, Homo sapiens
cuuuuucuuugag

SEQ ID NO: 1258987 - RNA, 16 nt, Homo sapiens
cuuuuugcaugcuuau

SEQ ID NO: 1258988 - RNA, 13 nt, Homo sapiens
cuuuuuguacuga

SEQ ID NO: 1258989 - RNA, 19 nt, Homo sapiens
cuuuuuguaucacacagua

SEQ ID NO: 1258990 - RNA, 17 nt, Homo sapiens
gaaaaugucacauucua

SEQ ID NO: 1258991 - RNA, 18 nt, Homo sapiens
gaaaaugucacugugaca

SEQ ID NO: 1258992 - RNA, 11 nt, Homo sapiens
gaaaaugucag

SEQ ID NO: 1258993 - RNA, 14 nt, Homo sapiens
gaaaauuauaucuc

SEQ ID NO: 1258994 - RNA, 22 nt, Homo sapiens
gaaaauugggcaugccauuaca

SEQ ID NO: 1258995 - RNA, 15 nt, Homo sapiens
gaaacaaacauggau

SEQ ID NO: 1258996 - RNA, 18 nt, Homo sapiens
gaaacacagcaacaauga

SEQ ID NO: 1258997 - RNA, 23 nt, Homo sapiens
gaaacacauucuuauugacaauu

SEQ ID NO: 1258998 - RNA, 20 nt, Homo sapiens
gaaacaguccaguacuugac

SEQ ID NO: 1258999 - RNA, 17 nt, Homo sapiens
gaaacaguuaauaccau

SEQ ID NO: 1259000 - RNA, 23 nt, Homo sapiens
gaaacauagccucaccaagguga

SEQ ID NO: 1259001 - RNA, 14 nt, Homo sapiens
gaaacaugacacug

SEQ ID NO: 1259002 - RNA, 18 nt, Homo sapiens
gaaacaugacacugaccu

SEQ ID NO: 1259003 - RNA, 16 nt, Homo sapiens
gaaacauuagugaaaa

SEQ ID NO: 1259004 - RNA, 16 nt, Homo sapiens
gaaacauuaugccuua

SEQ ID NO: 1259005 - RNA, 20 nt, Homo sapiens
gaaacauugaacucauaucu

SEQ ID NO: 1259006 - RNA, 21 nt, Homo sapiens
gaaacauuuuguggucauuaa

SEQ ID NO: 1259007 - RNA, 17 nt, Homo sapiens
gaaaccaaaacauaaaa

SEQ ID NO: 1259008 - RNA, 20 nt, Homo sapiens
gaaaccaaggaaagugaaac

SEQ ID NO: 1259009 - RNA, 15 nt, Homo sapiens
gaaaccagagucaaa

SEQ ID NO: 1259010 - RNA, 15 nt, Homo sapiens
gaaaccauuuuccca

SEQ ID NO: 1259011 - RNA, 18 nt, Homo sapiens
gaaaccuacacacuguca

SEQ ID NO: 1259012 - RNA, 16 nt, Homo sapiens
gaaaccuauauuucaa

SEQ ID NO: 1259013 - RNA, 21 nt, Homo sapiens
gaaacgucuucuaaacuuccc

SEQ ID NO: 1259014 - RNA, 21 nt, Homo sapiens
gaaacuaccaggugugccugg

SEQ ID NO: 1259015 - RNA, 16 nt, Homo sapiens
gaaacucaaaaauauu

SEQ ID NO: 1259016 - RNA, 14 nt, Homo sapiens
gaaacucacacucc

SEQ ID NO: 1259017 - RNA, 22 nt, Homo sapiens
gaaacuccaaaguccacacaaa

SEQ ID NO: 1259018 - RNA, 17 nt, Homo sapiens
gaaacugcgaggccagu

SEQ ID NO: 1259019 - RNA, 15 nt, Homo sapiens
gaaacuguacuacau

SEQ ID NO: 1259020 - RNA, 14 nt, Homo sapiens
gaaacuucaguuga

SEQ ID NO: 1259021 - RNA, 18 nt, Homo sapiens
gaaacuugugaaguggaa

SEQ ID NO: 1259022 - RNA, 14 nt, Homo sapiens
gaaacuuucaaaag

SEQ ID NO: 1259023 - RNA, 16 nt, Homo sapiens
gaaagaaaaagcaaua

SEQ ID NO: 1259024 - RNA, 13 nt, Homo sapiens
gaaagaaagggaa

SEQ ID NO: 1259025 - RNA, 13 nt, Homo sapiens
gaaagaaccagag

SEQ ID NO: 1259026 - RNA, 16 nt, Homo sapiens
gaaagaagccacagcu

SEQ ID NO: 1259027 - RNA, 16 nt, Homo sapiens
gaaagaccuaugagca

SEQ ID NO: 1259028 - RNA, 23 nt, Homo sapiens
gaaagacuuggguugaacuauaa

SEQ ID NO: 1259029 - RNA, 17 nt, Homo sapiens
gaaagagagaagccagc

SEQ ID NO: 1259030 - RNA, 21 nt, Homo sapiens
gaaagagagaagccagccaca

SEQ ID NO: 1259031 - RNA, 18 nt, Homo sapiens
gaaagagcaagugacuuu

SEQ ID NO: 1259032 - RNA, 14 nt, Homo sapiens
gaaagaugcagugg

SEQ ID NO: 1259033 - RNA, 14 nt, Homo sapiens
gaaagauggaacuu

SEQ ID NO: 1259034 - RNA, 18 nt, Homo sapiens
gaaagaugggcaaaagac

SEQ ID NO: 1259035 - RNA, 16 nt, Homo sapiens
gaaagaugucuaugua

SEQ ID NO: 1259036 - RNA, 19 nt, Homo sapiens
gaaagcaaaagcaagggac

SEQ ID NO: 1259037 - RNA, 19 nt, Homo sapiens
gaaagcaacaaagauugag

SEQ ID NO: 1259038 - RNA, 10 nt, Homo sapiens
gaaagccagg

SEQ ID NO: 1259039 - RNA, 16 nt, Homo sapiens
gaaagcccucaugugc

SEQ ID NO: 1259040 - RNA, 19 nt, Homo sapiens
gaaagccucugcugccaug

SEQ ID NO: 1259041 - RNA, 13 nt, Homo sapiens
gaaaggagcugcu

SEQ ID NO: 1259042 - RNA, 13 nt, Homo sapiens
gaaaggccaauaa

SEQ ID NO: 1259043 - RNA, 17 nt, Homo sapiens
gaaagggaaaagggaga

SEQ ID NO: 1259044 - RNA, 13 nt, Homo sapiens
gaaagggagcuau

SEQ ID NO: 1259045 - RNA, 18 nt, Homo sapiens
gaaagggauaguccaaag

SEQ ID NO: 1259046 - RNA, 13 nt, Homo sapiens
gaaaggggugcuu

SEQ ID NO: 1259047 - RNA, 17 nt, Homo sapiens
gaaagggguugggguga

SEQ ID NO: 1259048 - RNA, 19 nt, Homo sapiens
gaaagggguuggggugaca

SEQ ID NO: 1259049 - RNA, 16 nt, Homo sapiens
gaaaggguaauuuccu

SEQ ID NO: 1259050 - RNA, 23 nt, Homo sapiens
gaaagguuuuauucuauauugcu

SEQ ID NO: 1259051 - RNA, 16 nt, Homo sapiens
gaaagguuuuccuuau

SEQ ID NO: 1259052 - RNA, 15 nt, Homo sapiens
uuccugacuuacaau

SEQ ID NO: 1259053 - RNA, 16 nt, Homo sapiens
uuccugagaccacaga

SEQ ID NO: 1259054 - RNA, 16 nt, Homo sapiens
uuccugauaacauuau

SEQ ID NO: 1259055 - RNA, 13 nt, Homo sapiens
uuccugccccacc

SEQ ID NO: 1259056 - RNA, 21 nt, Homo sapiens
uuccugcgcgucaucucugac

SEQ ID NO: 1259057 - RNA, 15 nt, Homo sapiens
uuccuggcaauagug

SEQ ID NO: 1259058 - RNA, 18 nt, Homo sapiens
uuccuguauguuguccaa

SEQ ID NO: 1259059 - RNA, 14 nt, Homo sapiens
uuccuucacucauc

SEQ ID NO: 1259060 - RNA, 19 nt, Homo sapiens
uuccuuccagauccugggu

SEQ ID NO: 1259061 - RNA, 13 nt, Homo sapiens
uuccuucuggccu

SEQ ID NO: 1259062 - RNA, 21 nt, Homo sapiens
uuccuugaauguggcuugaga

SEQ ID NO: 1259063 - RNA, 18 nt, Homo sapiens
uuccuugacuucuuugag

SEQ ID NO: 1259064 - RNA, 21 nt, Homo sapiens
uuccuugauggagauauuuac

SEQ ID NO: 1259065 - RNA, 12 nt, Homo sapiens
uuccuugcucuc

SEQ ID NO: 1259066 - RNA, 15 nt, Homo sapiens
uuccuuggcuuuaug

SEQ ID NO: 1259067 - RNA, 17 nt, Homo sapiens
uuccuugggaugaucuu

SEQ ID NO: 1259068 - RNA, 23 nt, Homo sapiens
uuccuuuaaagaugaacucugaa

SEQ ID NO: 1259069 - RNA, 19 nt, Homo sapiens
uuccuuuauacacagugga

SEQ ID NO: 1259070 - RNA, 14 nt, Homo sapiens
uuccuuucuugucu

SEQ ID NO: 1259071 - RNA, 15 nt, Homo sapiens
uuccuuucuugucuu

SEQ ID NO: 1259072 - RNA, 18 nt, Homo sapiens
uuccuuuguguguacuca

SEQ ID NO: 1259073 - RNA, 12 nt, Homo sapiens
ucagaaaugcug

SEQ ID NO: 1259074 - RNA, 14 nt, Homo sapiens
ucagaaaugcuguc

SEQ ID NO: 1259075 - RNA, 14 nt, Homo sapiens
ucagaacacacaga

SEQ ID NO: 1259076 - RNA, 15 nt, Homo sapiens
ucagaaccauccaua

SEQ ID NO: 1259077 - RNA, 23 nt, Homo sapiens
ucagaacccaggacagccacagc

SEQ ID NO: 1259078 - RNA, 19 nt, Homo sapiens
ucagaaccucuuccccaga

SEQ ID NO: 1259079 - RNA, 19 nt, Homo sapiens
ucagaagaccccugacuca

SEQ ID NO: 1259080 - RNA, 15 nt, Homo sapiens
ucagaauaaggcagg

SEQ ID NO: 1259081 - RNA, 13 nt, Homo sapiens
ucagaauagccac

SEQ ID NO: 1259082 - RNA, 17 nt, Homo sapiens
ucagaauccacucuucu

SEQ ID NO: 1259083 - RNA, 17 nt, Homo sapiens
ucagaauggauuuauca

SEQ ID NO: 1259084 - RNA, 15 nt, Homo sapiens
ucagaauucaucuga

SEQ ID NO: 1259085 - RNA, 22 nt, Homo sapiens
ucagaauuuaguguauccauaa

SEQ ID NO: 1259086 - RNA, 14 nt, Homo sapiens
ucagacaagcacua

SEQ ID NO: 1259087 - RNA, 17 nt, Homo sapiens
ucagacaccuguucaca

SEQ ID NO: 1259088 - RNA, 13 nt, Homo sapiens
ucagacacuuugg

SEQ ID NO: 1259089 - RNA, 18 nt, Homo sapiens
ucagacauaaagccaugu

SEQ ID NO: 1259090 - RNA, 19 nt, Homo sapiens
ucagacauuugguauauua

SEQ ID NO: 1259091 - RNA, 13 nt, Homo sapiens
ucagaccacaagg

SEQ ID NO: 1259092 - RNA, 22 nt, Homo sapiens
ucagacugcaugacagucacag

SEQ ID NO: 1259093 - RNA, 15 nt, Homo sapiens
ucagacugucagaaa

SEQ ID NO: 1259094 - RNA, 17 nt, Homo sapiens
ucagagaaauacuuuca

SEQ ID NO: 1259095 - RNA, 20 nt, Homo sapiens
ucagagagcuaaauuacaau

SEQ ID NO: 1259096 - RNA, 17 nt, Homo sapiens
ucagagcacucauuccu

SEQ ID NO: 1259097 - RNA, 15 nt, Homo sapiens
ucagagcacucccua

SEQ ID NO: 1259098 - RNA, 15 nt, Homo sapiens
ucagagccagugaag

SEQ ID NO: 1259099 - RNA, 20 nt, Homo sapiens
ucagagcccucaacuauucu

SEQ ID NO: 1259100 - RNA, 20 nt, Homo sapiens
ucagaggagcggccagaaga

SEQ ID NO: 1259101 - RNA, 18 nt, Homo sapiens
ucagaggccugcugccag

SEQ ID NO: 1259102 - RNA, 19 nt, Homo sapiens
ucagaguccucauuauaaa

SEQ ID NO: 1259103 - RNA, 13 nt, Homo sapiens
ucagagugccacu

SEQ ID NO: 1259104 - RNA, 21 nt, Homo sapiens
ucagaguugcugcaaaccuga

SEQ ID NO: 1259105 - RNA, 16 nt, Homo sapiens
ucagaugaacucuuag

SEQ ID NO: 1259106 - RNA, 18 nt, Homo sapiens
ucagauggacaagauuac

SEQ ID NO: 1259107 - RNA, 14 nt, Homo sapiens
ucagauggggacac

SEQ ID NO: 1259108 - RNA, 15 nt, Homo sapiens
ucagauggugaagca

SEQ ID NO: 1259109 - RNA, 20 nt, Homo sapiens
ucagauuccuuucccuuuag

SEQ ID NO: 1259110 - RNA, 23 nt, Homo sapiens
ucagauugcugggaggacuggac

SEQ ID NO: 1259111 - RNA, 23 nt, Homo sapiens
ucagauuuuaaaaagucuucacu

SEQ ID NO: 1259112 - RNA, 21 nt, Homo sapiens
ucagcaaaaaucucccaguga

SEQ ID NO: 1259113 - RNA, 17 nt, Homo sapiens
ucagcaagaauuugauc

SEQ ID NO: 1259114 - RNA, 21 nt, Homo sapiens
ucagcaaguuagaacuagcca

SEQ ID NO: 1259115 - RNA, 16 nt, Homo sapiens
ucagcacaaagacaca

SEQ ID NO: 1259116 - RNA, 21 nt, Homo sapiens
ucagcacaggccugggaccuc

SEQ ID NO: 1259117 - RNA, 11 nt, Homo sapiens
ucagcacugaa

SEQ ID NO: 1259118 - RNA, 19 nt, Homo sapiens
ucagcacugucccuugccu

SEQ ID NO: 1259119 - RNA, 15 nt, Homo sapiens
ucagcaggcaaagac

SEQ ID NO: 1259120 - RNA, 19 nt, Homo sapiens
ucagcaguccacaaagcau

SEQ ID NO: 1259121 - RNA, 14 nt, Homo sapiens
ucagcagugaugcu

SEQ ID NO: 1259122 - RNA, 22 nt, Homo sapiens
ucagcaucacccgggaacuuuu

SEQ ID NO: 1259123 - RNA, 14 nt, Homo sapiens
ucagcaucugugau

SEQ ID NO: 1259124 - RNA, 21 nt, Homo sapiens
ucagcaugauguguuguguau

SEQ ID NO: 1259125 - RNA, 17 nt, Homo sapiens
ucagcaugcauccuuug

SEQ ID NO: 1259126 - RNA, 22 nt, Homo sapiens
ucagcaugcauccuuugcacug

SEQ ID NO: 1259127 - RNA, 16 nt, Homo sapiens
ucagcauuuggaccaa

SEQ ID NO: 1259128 - RNA, 14 nt, Homo sapiens
ucagccagcaagag

SEQ ID NO: 1259129 - RNA, 20 nt, Homo sapiens
ucagccagcucccagccaca

SEQ ID NO: 1259130 - RNA, 17 nt, Homo sapiens
ucagccaggacagucag

SEQ ID NO: 1259131 - RNA, 21 nt, Homo sapiens
ucagccaguggcuagcgcaag

SEQ ID NO: 1259132 - RNA, 19 nt, Homo sapiens
ucagccauaagaaagcacu

SEQ ID NO: 1259133 - RNA, 20 nt, Homo sapiens
ucagccaucguccugggacu

SEQ ID NO: 1259134 - RNA, 14 nt, Homo sapiens
ucagccccuaggag

SEQ ID NO: 1259135 - RNA, 14 nt, Homo sapiens
ucagcccugccagg

SEQ ID NO: 1259136 - RNA, 17 nt, Homo sapiens
ucagccuuaagaaccau

SEQ ID NO: 1259137 - RNA, 15 nt, Homo sapiens
ucagccuuacauuug

SEQ ID NO: 1259138 - RNA, 14 nt, Homo sapiens
ucagcggcuccagc

SEQ ID NO: 1259139 - RNA, 16 nt, Homo sapiens
ucagcucucuguauaa

SEQ ID NO: 1259140 - RNA, 19 nt, Homo sapiens
ucagcucuggagaacagug

SEQ ID NO: 1259141 - RNA, 22 nt, Homo sapiens
ucagcugccugaaacagccaug

SEQ ID NO: 1259142 - RNA, 13 nt, Homo sapiens
ucagcuggcugua

SEQ ID NO: 1259143 - RNA, 15 nt, Homo sapiens
ucagcuucucaaagu

SEQ ID NO: 1259144 - RNA, 16 nt, Homo sapiens
ucaggaaaaaccagcc

SEQ ID NO: 1259145 - RNA, 20 nt, Homo sapiens
ucaggaacuauggcaaggaa

SEQ ID NO: 1259146 - RNA, 21 nt, Homo sapiens
ucaggacacccuacacaaaau

SEQ ID NO: 1259147 - RNA, 18 nt, Homo sapiens
ucaggagaucgagaccau

SEQ ID NO: 1259148 - RNA, 17 nt, Homo sapiens
ucaggauaaaguuugcu

SEQ ID NO: 1259149 - RNA, 19 nt, Homo sapiens
ucaggaucaagaaaguguu

SEQ ID NO: 1259150 - RNA, 22 nt, Homo sapiens
ucaggauccaagcuaagcacug

SEQ ID NO: 1259151 - RNA, 14 nt, Homo sapiens
ucaggaugcacauu

SEQ ID NO: 1259152 - RNA, 16 nt, Homo sapiens
ucaggaugcacauuuc

SEQ ID NO: 1259153 - RNA, 18 nt, Homo sapiens
ucaggauggaggacccug

SEQ ID NO: 1259154 - RNA, 14 nt, Homo sapiens
ucaggauucuucaa

SEQ ID NO: 1259155 - RNA, 15 nt, Homo sapiens
ucaggcaacgcacaa

SEQ ID NO: 1259156 - RNA, 15 nt, Homo sapiens
ucaggcacacagcua

SEQ ID NO: 1259157 - RNA, 17 nt, Homo sapiens
ucaggcacacagcuacu

SEQ ID NO: 1259158 - RNA, 11 nt, Homo sapiens
ucaggcagcuc

SEQ ID NO: 1259159 - RNA, 18 nt, Homo sapiens
ucaggcaggcaccuagca

SEQ ID NO: 1259160 - RNA, 18 nt, Homo sapiens
ucaggccaacaagccaac

SEQ ID NO: 1259161 - RNA, 18 nt, Homo sapiens
ucaggccaggugcagugg

SEQ ID NO: 1259162 - RNA, 17 nt, Homo sapiens
ucagggaaaaggaguag

SEQ ID NO: 1259163 - RNA, 17 nt, Homo sapiens
ucagggaccagcuuuac

SEQ ID NO: 1259164 - RNA, 23 nt, Homo sapiens
ucagggagaaacuccaaagucca

SEQ ID NO: 1259165 - RNA, 18 nt, Homo sapiens
ucagggcagggcucugau

SEQ ID NO: 1259166 - RNA, 14 nt, Homo sapiens
ucagggccaggaag

SEQ ID NO: 1259167 - RNA, 18 nt, Homo sapiens
ucaggggcugacacuuca

SEQ ID NO: 1259168 - RNA, 21 nt, Homo sapiens
ucaggguuuuuagauuaaaca

SEQ ID NO: 1259169 - RNA, 14 nt, Homo sapiens
ucagguccaauuug

SEQ ID NO: 1259170 - RNA, 17 nt, Homo sapiens
ucaggucccaggccagc

SEQ ID NO: 1259171 - RNA, 16 nt, Homo sapiens
ucaggugaacacuuag

SEQ ID NO: 1259172 - RNA, 21 nt, Homo sapiens
ucaggugauccgccuaccuca

SEQ ID NO: 1259173 - RNA, 21 nt, Homo sapiens
ucaggugccuuugaguucuag

SEQ ID NO: 1259174 - RNA, 16 nt, Homo sapiens
ucagguggggcagcuu

SEQ ID NO: 1259175 - RNA, 12 nt, Homo sapiens
ucagguucucau

SEQ ID NO: 1259176 - RNA, 21 nt, Homo sapiens
ucagguuuguuuugugaauuu

SEQ ID NO: 1259177 - RNA, 21 nt, Homo sapiens
ucagguuuucgaaccuugacc

SEQ ID NO: 1259178 - RNA, 22 nt, Homo sapiens
ucaguaauaaaacaucuuucca

SEQ ID NO: 1259179 - RNA, 22 nt, Homo sapiens
uugcagggaagccccacuugaa

SEQ ID NO: 1259180 - RNA, 14 nt, Homo sapiens
uugcaggugacauu

SEQ ID NO: 1259181 - RNA, 22 nt, Homo sapiens
uugcaggugacauuugcucuga

SEQ ID NO: 1259182 - RNA, 16 nt, Homo sapiens
uugcagugagccauga

SEQ ID NO: 1259183 - RNA, 20 nt, Homo sapiens
uugcagugagccgagaucac

SEQ ID NO: 1259184 - RNA, 20 nt, Homo sapiens
uugcaguucaccugcacuua

SEQ ID NO: 1259185 - RNA, 16 nt, Homo sapiens
uugcauaggaauugca

SEQ ID NO: 1259186 - RNA, 21 nt, Homo sapiens
uugcauaucuuaaaacuaaau

SEQ ID NO: 1259187 - RNA, 12 nt, Homo sapiens
uugcaugaaauu

SEQ ID NO: 1259188 - RNA, 18 nt, Homo sapiens
uugcaugaaauuuugccu

SEQ ID NO: 1259189 - RNA, 15 nt, Homo sapiens
uugcaugaauaggcu

SEQ ID NO: 1259190 - RNA, 22 nt, Homo sapiens
uugcaugauaucuucaagccug

SEQ ID NO: 1259191 - RNA, 18 nt, Homo sapiens
uugcauggcuccagaaau

SEQ ID NO: 1259192 - RNA, 10 nt, Homo sapiens
uugcauuugg

SEQ ID NO: 1259193 - RNA, 24 nt, Homo sapiens
uugccaagacaaaucaacagaagc

SEQ ID NO: 1259194 - RNA, 13 nt, Homo sapiens
uugccacauuucu

SEQ ID NO: 1259195 - RNA, 19 nt, Homo sapiens
uugccacugcugugugauu

SEQ ID NO: 1259196 - RNA, 18 nt, Homo sapiens
uugccagaugcaauacaa

SEQ ID NO: 1259197 - RNA, 22 nt, Homo sapiens
uugccagcgauuuuaguucaau

SEQ ID NO: 1259198 - RNA, 16 nt, Homo sapiens
cuuacuacacugagga

SEQ ID NO: 1259199 - RNA, 16 nt, Homo sapiens
cuuacuagaccuguaa

SEQ ID NO: 1259200 - RNA, 20 nt, Homo sapiens
cuuacucuaagaucuuagau

SEQ ID NO: 1259201 - RNA, 20 nt, Homo sapiens
cuuacucuaggucaguauua

SEQ ID NO: 1259202 - RNA, 18 nt, Homo sapiens
cuuacucuugauuguggg

SEQ ID NO: 1259203 - RNA, 14 nt, Homo sapiens
cuuacuguaacgga

SEQ ID NO: 1259204 - RNA, 16 nt, Homo sapiens
cuuacuuagcaugcac

SEQ ID NO: 1259205 - RNA, 19 nt, Homo sapiens
cuuacuuagcaugcacaaa

SEQ ID NO: 1259206 - RNA, 20 nt, Homo sapiens
cuuacuuagcaugcacaaag

SEQ ID NO: 1259207 - RNA, 13 nt, Homo sapiens
cuuagaaagggaa

SEQ ID NO: 1259208 - RNA, 22 nt, Homo sapiens
cuuagaaaugaaggcagaaaaa

SEQ ID NO: 1259209 - RNA, 14 nt, Homo sapiens
cuuagaaauuguaa

SEQ ID NO: 1259210 - RNA, 14 nt, Homo sapiens
cuuagacauaacaa

SEQ ID NO: 1259211 - RNA, 21 nt, Homo sapiens
cuuagacauaacaaaacacuc

SEQ ID NO: 1259212 - RNA, 22 nt, Homo sapiens
cuuagagaggacaauacugggg

SEQ ID NO: 1259213 - RNA, 15 nt, Homo sapiens
cuuagaguguagcug

SEQ ID NO: 1259214 - RNA, 17 nt, Homo sapiens
cuuagcaugcacaaagu

SEQ ID NO: 1259215 - RNA, 16 nt, Homo sapiens
cuuagcugucugcuca

SEQ ID NO: 1259216 - RNA, 19 nt, Homo sapiens
cuuagcuuucuaggccacu

SEQ ID NO: 1259217 - RNA, 16 nt, Homo sapiens
cuuaggauggggcucc

SEQ ID NO: 1259218 - RNA, 16 nt, Homo sapiens
cuuaggggaagccacu

SEQ ID NO: 1259219 - RNA, 15 nt, Homo sapiens
cuuagggugaaccac

SEQ ID NO: 1259220 - RNA, 12 nt, Homo sapiens
cuuaguaaaauu

SEQ ID NO: 1259221 - RNA, 16 nt, Homo sapiens
cuuagugacaaaauag

SEQ ID NO: 1259222 - RNA, 16 nt, Homo sapiens
cuuaguuauugcugaa

SEQ ID NO: 1259223 - RNA, 18 nt, Homo sapiens
cuuaguuguucaguugcc

SEQ ID NO: 1259224 - RNA, 16 nt, Homo sapiens
cuuauaaaaaucuuaa

SEQ ID NO: 1259225 - RNA, 20 nt, Homo sapiens
cuuauaagaaagaucaaaga

SEQ ID NO: 1259226 - RNA, 15 nt, Homo sapiens
cuuauacauuugaua

SEQ ID NO: 1259227 - RNA, 16 nt, Homo sapiens
cuuauauuucccuaaa

SEQ ID NO: 1259228 - RNA, 13 nt, Homo sapiens
cuuaucaauggca

SEQ ID NO: 1259229 - RNA, 16 nt, Homo sapiens
cuuauccacuuugacu

SEQ ID NO: 1259230 - RNA, 23 nt, Homo sapiens
cuuauccauaggcgcaggugcac

SEQ ID NO: 1259231 - RNA, 15 nt, Homo sapiens
cuuaucccaagagaa

SEQ ID NO: 1259232 - RNA, 22 nt, Homo sapiens
cuuaucucggggagaaaugcaa

SEQ ID NO: 1259233 - RNA, 17 nt, Homo sapiens
cuuaucugugcgugaaa

SEQ ID NO: 1259234 - RNA, 22 nt, Homo sapiens
cuuaucugugcgugaaacacac

SEQ ID NO: 1259235 - RNA, 18 nt, Homo sapiens
cuuaugacuugcuacuuu

SEQ ID NO: 1259236 - RNA, 22 nt, Homo sapiens
cuuaugauacuugagguaccag

SEQ ID NO: 1259237 - RNA, 16 nt, Homo sapiens
cuuaugcaaucuaugu

SEQ ID NO: 1259238 - RNA, 23 nt, Homo sapiens
cuuauggaauugauuugcauuga

SEQ ID NO: 1259239 - RNA, 19 nt, Homo sapiens
cuuauuacaugcugcuaua

SEQ ID NO: 1259240 - RNA, 22 nt, Homo sapiens
cuuauuagggagaaaauucaau

SEQ ID NO: 1259241 - RNA, 14 nt, Homo sapiens
cuuauuaguuacaa

SEQ ID NO: 1259242 - RNA, 21 nt, Homo sapiens
cuuauucacugaaguucuccu

SEQ ID NO: 1259243 - RNA, 12 nt, Homo sapiens
cuuauuccucua

SEQ ID NO: 1259244 - RNA, 14 nt, Homo sapiens
cuuauuguaccucu

SEQ ID NO: 1259245 - RNA, 17 nt, Homo sapiens
cuuauuguuccaagaca

SEQ ID NO: 1259246 - RNA, 16 nt, Homo sapiens
cuuauuuaacuuaaca

SEQ ID NO: 1259247 - RNA, 19 nt, Homo sapiens
cuuauuucuagaagcacau

SEQ ID NO: 1259248 - RNA, 22 nt, Homo sapiens
cuuauuuugucuuauucuuaag

SEQ ID NO: 1259249 - RNA, 15 nt, Homo sapiens
cuucaaagcugaaua

SEQ ID NO: 1259250 - RNA, 15 nt, Homo sapiens
cuucaaauauuuccc

SEQ ID NO: 1259251 - RNA, 14 nt, Homo sapiens
cuucaaaucagaag

SEQ ID NO: 1259252 - RNA, 22 nt, Homo sapiens
cuucaaaugucuaagguaguaa

SEQ ID NO: 1259253 - RNA, 12 nt, Homo sapiens
cuucaacccagu

SEQ ID NO: 1259254 - RNA, 21 nt, Homo sapiens
cuucaacugaccagccuccau

SEQ ID NO: 1259255 - RNA, 16 nt, Homo sapiens
cuucaagagcugagaa

SEQ ID NO: 1259256 - RNA, 14 nt, Homo sapiens
cuucaaggcuucca

SEQ ID NO: 1259257 - RNA, 13 nt, Homo sapiens
cuucaaguaauac

SEQ ID NO: 1259258 - RNA, 21 nt, Homo sapiens
cuucaaucuucauuuuggagg

SEQ ID NO: 1259259 - RNA, 19 nt, Homo sapiens
cuucacaaaaucuguuuag

SEQ ID NO: 1259260 - RNA, 22 nt, Homo sapiens
cuucacaggcagugcaugugaa

SEQ ID NO: 1259261 - RNA, 12 nt, Homo sapiens
cuucacaguacc

SEQ ID NO: 1259262 - RNA, 13 nt, Homo sapiens
cuucacaguguuu

SEQ ID NO: 1259263 - RNA, 14 nt, Homo sapiens
cuucacaucuguca

SEQ ID NO: 1259264 - RNA, 23 nt, Homo sapiens
cuucaccagucugucuacugugg

SEQ ID NO: 1259265 - RNA, 19 nt, Homo sapiens
cuucaccuacauuaucuca

SEQ ID NO: 1259266 - RNA, 12 nt, Homo sapiens
cuucacuacuuu

SEQ ID NO: 1259267 - RNA, 12 nt, Homo sapiens
cuucacucucca

SEQ ID NO: 1259268 - RNA, 14 nt, Homo sapiens
cuucacucuuugaa

SEQ ID NO: 1259269 - RNA, 11 nt, Homo sapiens
cuucacugaag

SEQ ID NO: 1259270 - RNA, 14 nt, Homo sapiens
cuucacugccauga

SEQ ID NO: 1259271 - RNA, 20 nt, Homo sapiens
cuucacugccaugauagcug

SEQ ID NO: 1259272 - RNA, 18 nt, Homo sapiens
cuucacuguggucauccu

SEQ ID NO: 1259273 - RNA, 21 nt, Homo sapiens
cuucacuucaguugcuuugca

SEQ ID NO: 1259274 - RNA, 13 nt, Homo sapiens
cuucacuuuacaa

SEQ ID NO: 1259275 - RNA, 18 nt, Homo sapiens
cuucagaacugcccuugc

SEQ ID NO: 1259276 - RNA, 22 nt, Homo sapiens
cuucagaacugcccuugcugcc

SEQ ID NO: 1259277 - RNA, 17 nt, Homo sapiens
cuucagaagacacugca

SEQ ID NO: 1259278 - RNA, 23 nt, Homo sapiens
cuucagaagacacugcaaaggcg

SEQ ID NO: 1259279 - RNA, 12 nt, Homo sapiens
cuucagacaccc

SEQ ID NO: 1259280 - RNA, 14 nt, Homo sapiens
cuucagacauguaa

SEQ ID NO: 1259281 - RNA, 23 nt, Homo sapiens
cuucagagacuaucugauuuccu

SEQ ID NO: 1259282 - RNA, 23 nt, Homo sapiens
cuucagagacuucguaauuaaag

SEQ ID NO: 1259283 - RNA, 19 nt, Homo sapiens
cuucagaguuuguguguau

SEQ ID NO: 1259284 - RNA, 18 nt, Homo sapiens
cuucagauacaaacugca

SEQ ID NO: 1259285 - RNA, 15 nt, Homo sapiens
cuucagaucugaggu

SEQ ID NO: 1259286 - RNA, 16 nt, Homo sapiens
cuucagauuaaacccu

SEQ ID NO: 1259287 - RNA, 16 nt, Homo sapiens
cuucagauuuguguua

SEQ ID NO: 1259288 - RNA, 20 nt, Homo sapiens
cuucagcacaaagacacaga

SEQ ID NO: 1259289 - RNA, 13 nt, Homo sapiens
cuucagcagucaa

SEQ ID NO: 1259290 - RNA, 12 nt, Homo sapiens
cuucagcuguac

SEQ ID NO: 1259291 - RNA, 19 nt, Homo sapiens
cuucagcuguacauacuca

SEQ ID NO: 1259292 - RNA, 20 nt, Homo sapiens
cuucagcuguacauacucag

SEQ ID NO: 1259293 - RNA, 13 nt, Homo sapiens
cuucagggccaga

SEQ ID NO: 1259294 - RNA, 22 nt, Homo sapiens
cuucagguucuuagugucacuu

SEQ ID NO: 1259295 - RNA, 24 nt, Homo sapiens
cuucaguaauaauuauguauguua

SEQ ID NO: 1259296 - RNA, 23 nt, Homo sapiens
cuucaguacacuugguguacugg

SEQ ID NO: 1259297 - RNA, 22 nt, Homo sapiens
cuucaguauuuuuaaauuguaa

SEQ ID NO: 1259298 - RNA, 20 nt, Homo sapiens
cuucagucuuaauacuuuau

SEQ ID NO: 1259299 - RNA, 19 nt, Homo sapiens
cuucauauaccagcaauau

SEQ ID NO: 1259300 - RNA, 23 nt, Homo sapiens
cuucauccccuuuggcuaccuga

SEQ ID NO: 1259301 - RNA, 15 nt, Homo sapiens
cuucaucugggacaa

SEQ ID NO: 1259302 - RNA, 16 nt, Homo sapiens
cuucaucugggacaaa

SEQ ID NO: 1259303 - RNA, 23 nt, Homo sapiens
cuucaugcuuuugcuugcaaugu

SEQ ID NO: 1259304 - RNA, 23 nt, Homo sapiens
cuucauuccaaucuauugcuuca

SEQ ID NO: 1259305 - RNA, 15 nt, Homo sapiens
cuucauuucaggaag

SEQ ID NO: 1259306 - RNA, 18 nt, Homo sapiens
cuucauuuuauauuuaaa

SEQ ID NO: 1259307 - RNA, 15 nt, Homo sapiens
cuucauuuugagggg

SEQ ID NO: 1259308 - RNA, 20 nt, Homo sapiens
cuuccaaacauuaaugcaau

SEQ ID NO: 1259309 - RNA, 15 nt, Homo sapiens
cuuccacaauggucu

SEQ ID NO: 1259310 - RNA, 19 nt, Homo sapiens
cuuccacagagacaucucc

SEQ ID NO: 1259311 - RNA, 12 nt, Homo sapiens
cuuccacagccc

SEQ ID NO: 1259312 - RNA, 13 nt, Homo sapiens
cuuccacauguac

SEQ ID NO: 1259313 - RNA, 20 nt, Homo sapiens
cuuccacccccaccauccag

SEQ ID NO: 1259314 - RNA, 22 nt, Homo sapiens
cuuccagaccugcuuccugaaa

SEQ ID NO: 1259315 - RNA, 23 nt, Homo sapiens
cuuccagcaagcaaagugcuuug

SEQ ID NO: 1259316 - RNA, 17 nt, Homo sapiens
cuuccagcuucaggcac

SEQ ID NO: 1259317 - RNA, 23 nt, Homo sapiens
cuuccagguguuacuguaauucc

SEQ ID NO: 1259318 - RNA, 21 nt, Homo sapiens
cuuccauaauuaugacaguua

SEQ ID NO: 1259319 - RNA, 21 nt, Homo sapiens
cuuccauaggacauacugcau

SEQ ID NO: 1259320 - RNA, 19 nt, Homo sapiens
cuuccauccucucuggugu

SEQ ID NO: 1259321 - RNA, 22 nt, Homo sapiens
cuuccaugacauaagugcuauu

SEQ ID NO: 1259322 - RNA, 24 nt, Homo sapiens
cuuccauuaacuuagcauguguug

SEQ ID NO: 1259323 - RNA, 14 nt, Homo sapiens
cuugccacugcacu

SEQ ID NO: 1259324 - RNA, 15 nt, Homo sapiens
cuugcccaaguccca

SEQ ID NO: 1259325 - RNA, 18 nt, Homo sapiens
cuugcccaguacauuuaa

SEQ ID NO: 1259326 - RNA, 15 nt, Homo sapiens
cuugccuaggcgauu

SEQ ID NO: 1259327 - RNA, 15 nt, Homo sapiens
cuugccuaucaaaga

SEQ ID NO: 1259328 - RNA, 11 nt, Homo sapiens
cuugccucuuc

SEQ ID NO: 1259329 - RNA, 17 nt, Homo sapiens
cuugcuaccaguauuua

SEQ ID NO: 1259330 - RNA, 12 nt, Homo sapiens
cuugcucagugg

SEQ ID NO: 1259331 - RNA, 17 nt, Homo sapiens
cuugcuccuguguaaaa

SEQ ID NO: 1259332 - RNA, 21 nt, Homo sapiens
cuugcugauggugacauugca

SEQ ID NO: 1259333 - RNA, 23 nt, Homo sapiens
cuugcugcccgcgggagacagcu

SEQ ID NO: 1259334 - RNA, 16 nt, Homo sapiens
cuugcugcugcugcac

SEQ ID NO: 1259335 - RNA, 23 nt, Homo sapiens
cuugcuggacggggacuggggau

SEQ ID NO: 1259336 - RNA, 19 nt, Homo sapiens
cuugcuucucuagcucucu

SEQ ID NO: 1259337 - RNA, 16 nt, Homo sapiens
cuugcuugcaauaggu

SEQ ID NO: 1259338 - RNA, 15 nt, Homo sapiens
cuugcuuuccccggg

SEQ ID NO: 1259339 - RNA, 16 nt, Homo sapiens
cuuggaaaaaaaccac

SEQ ID NO: 1259340 - RNA, 22 nt, Homo sapiens
cuuggaaagcaucaccucaggc

SEQ ID NO: 1259341 - RNA, 18 nt, Homo sapiens
cuuggaaaugguggugcu

SEQ ID NO: 1259342 - RNA, 16 nt, Homo sapiens
cuuggaaccuaagguu

SEQ ID NO: 1259343 - RNA, 13 nt, Homo sapiens
cuuggaagccagg

SEQ ID NO: 1259344 - RNA, 16 nt, Homo sapiens
cuuggacaaaccuaga

SEQ ID NO: 1259345 - RNA, 14 nt, Homo sapiens
cuuggacaagacaa

SEQ ID NO: 1259346 - RNA, 17 nt, Homo sapiens
cuuggacagcaaggugg

SEQ ID NO: 1259347 - RNA, 15 nt, Homo sapiens
cuuggagcaggcaaa

SEQ ID NO: 1259348 - RNA, 19 nt, Homo sapiens
cuuggaguaaaacuguaua

SEQ ID NO: 1259349 - RNA, 18 nt, Homo sapiens
cuuggaucagaugaacuc

SEQ ID NO: 1259350 - RNA, 13 nt, Homo sapiens
cuuggaugugguu

SEQ ID NO: 1259351 - RNA, 22 nt, Homo sapiens
cuuggcaaaagccuuguguaua

SEQ ID NO: 1259352 - RNA, 16 nt, Homo sapiens
cuuggcacacucucca

SEQ ID NO: 1259353 - RNA, 24 nt, Homo sapiens
cuuggccccagacgcauagacuga

SEQ ID NO: 1259354 - RNA, 16 nt, Homo sapiens
cuuggcucgaugcugu

SEQ ID NO: 1259355 - RNA, 16 nt, Homo sapiens
cuuggcuuuucuagcc

SEQ ID NO: 1259356 - RNA, 21 nt, Homo sapiens
cuugggaaacuauucaugaau

SEQ ID NO: 1259357 - RNA, 15 nt, Homo sapiens
cuugggaacuccacu

SEQ ID NO: 1259358 - RNA, 18 nt, Homo sapiens
cuugggagaccuguaauc

SEQ ID NO: 1259359 - RNA, 19 nt, Homo sapiens
cuugggcuacuggcagcuc

SEQ ID NO: 1259360 - RNA, 16 nt, Homo sapiens
cuuggggccaccaaag

SEQ ID NO: 1259361 - RNA, 21 nt, Homo sapiens
cuugguggcgcgcaccuguag

SEQ ID NO: 1259362 - RNA, 15 nt, Homo sapiens
cuugguucaucagug

SEQ ID NO: 1259363 - RNA, 22 nt, Homo sapiens
cuugguucuuaaaagcauucug

SEQ ID NO: 1259364 - RNA, 21 nt, Homo sapiens
cuugguuuuuauaccauucag

SEQ ID NO: 1259365 - RNA, 21 nt, Homo sapiens
cuugguuuuuggcucuuucag

SEQ ID NO: 1259366 - RNA, 18 nt, Homo sapiens
cuuguaauucuaaaugaa

SEQ ID NO: 1259367 - RNA, 19 nt, Homo sapiens
cuuguaggauaagugaaau

SEQ ID NO: 1259368 - RNA, 16 nt, Homo sapiens
cuuguaucaacacugu

SEQ ID NO: 1259369 - RNA, 13 nt, Homo sapiens
cuuguaucaauau

SEQ ID NO: 1259370 - RNA, 17 nt, Homo sapiens
cuuguauuuccaaaccu

SEQ ID NO: 1259371 - RNA, 13 nt, Homo sapiens
cuugucagacaua

SEQ ID NO: 1259372 - RNA, 20 nt, Homo sapiens
cuugucccucucacucccca

SEQ ID NO: 1259373 - RNA, 13 nt, Homo sapiens
cuuguccugaugc

SEQ ID NO: 1259374 - RNA, 15 nt, Homo sapiens
cuuguccugaugcug

SEQ ID NO: 1259375 - RNA, 19 nt, Homo sapiens
cuugugaaacacagcuguu

SEQ ID NO: 1259376 - RNA, 15 nt, Homo sapiens
cuugugaauuauucu

SEQ ID NO: 1259377 - RNA, 18 nt, Homo sapiens
cuugugaauuauucugau

SEQ ID NO: 1259378 - RNA, 22 nt, Homo sapiens
cuugugagagcccauucccacc

SEQ ID NO: 1259379 - RNA, 16 nt, Homo sapiens
cuugugcccaggguuu

SEQ ID NO: 1259380 - RNA, 14 nt, Homo sapiens
cuuguggguccaug

SEQ ID NO: 1259381 - RNA, 12 nt, Homo sapiens
cuugugucuccc

SEQ ID NO: 1259382 - RNA, 15 nt, Homo sapiens
cuuguguguuuugag

SEQ ID NO: 1259383 - RNA, 15 nt, Homo sapiens
cuuguguuaugaagc

SEQ ID NO: 1259384 - RNA, 23 nt, Homo sapiens
cuuguuaucagcuuucagggcca

SEQ ID NO: 1259385 - RNA, 20 nt, Homo sapiens
cuuguucaauaauuacugua

SEQ ID NO: 1259386 - RNA, 21 nt, Homo sapiens
cuuguucauaagauuaugaaa

SEQ ID NO: 1259387 - RNA, 23 nt, Homo sapiens
cuuguuggugacaccucaccuca

SEQ ID NO: 1259388 - RNA, 20 nt, Homo sapiens
cuuguuguuuucccaaagag

SEQ ID NO: 1259389 - RNA, 14 nt, Homo sapiens
cuuguuuacagcac

SEQ ID NO: 1259390 - RNA, 14 nt, Homo sapiens
cuuguuuacucauu

SEQ ID NO: 1259391 - RNA, 10 nt, Homo sapiens
cuuguuucag

SEQ ID NO: 1259392 - RNA, 18 nt, Homo sapiens
cuuguuuggggcacagua

SEQ ID NO: 1259393 - RNA, 15 nt, Homo sapiens
cuuguuugucuucca

SEQ ID NO: 1259394 - RNA, 20 nt, Homo sapiens
cuuguuuuauauaccuggcu

SEQ ID NO: 1259395 - RNA, 14 nt, Homo sapiens
cuuguuuucuugcc

SEQ ID NO: 1259396 - RNA, 16 nt, Homo sapiens
cuuguuuuugcacaug

SEQ ID NO: 1259397 - RNA, 15 nt, Homo sapiens
cuuguuuuuuacuca

SEQ ID NO: 1259398 - RNA, 13 nt, Homo sapiens
cuuuaaacucagg

SEQ ID NO: 1259399 - RNA, 15 nt, Homo sapiens
cuuuaaacucaggga

SEQ ID NO: 1259400 - RNA, 19 nt, Homo sapiens
cuuuaaagucagguccaau

SEQ ID NO: 1259401 - RNA, 15 nt, Homo sapiens
cuuuaaaucaagucc

SEQ ID NO: 1259402 - RNA, 16 nt, Homo sapiens
cuuuaaaucugugaug

SEQ ID NO: 1259403 - RNA, 20 nt, Homo sapiens
cuuuaacuuaguauuuuacc

SEQ ID NO: 1259404 - RNA, 22 nt, Homo sapiens
cuuuaagaagcaguguuuuaga

SEQ ID NO: 1259405 - RNA, 12 nt, Homo sapiens
cuuuaagcacua

SEQ ID NO: 1259406 - RNA, 19 nt, Homo sapiens
cuuuaagcagcgccaguga

SEQ ID NO: 1259407 - RNA, 14 nt, Homo sapiens
cuuuaaugaacuaa

SEQ ID NO: 1259408 - RNA, 15 nt, Homo sapiens
cuuuaaugcuuuuau

SEQ ID NO: 1259409 - RNA, 12 nt, Homo sapiens
cuuuaauuguau

SEQ ID NO: 1259410 - RNA, 19 nt, Homo sapiens
cuuuaauuugcuacuguca

SEQ ID NO: 1259411 - RNA, 16 nt, Homo sapiens
cuuuacaauuucacuu

SEQ ID NO: 1259412 - RNA, 21 nt, Homo sapiens
cuuuacauaagaaauguauuc

SEQ ID NO: 1259413 - RNA, 18 nt, Homo sapiens
cuuuaccugagaccaguu

SEQ ID NO: 1259414 - RNA, 15 nt, Homo sapiens
cuuuacguaucugcu

SEQ ID NO: 1259415 - RNA, 21 nt, Homo sapiens
cuuuacuccaucauggcugcu

SEQ ID NO: 1259416 - RNA, 13 nt, Homo sapiens
cuuuacuucucac

SEQ ID NO: 1259417 - RNA, 11 nt, Homo sapiens
cuuuacuugac

SEQ ID NO: 1259418 - RNA, 19 nt, Homo sapiens
cuuuagagaaguauacaua

SEQ ID NO: 1259419 - RNA, 21 nt, Homo sapiens
cuuuagagaauaccaguguua

SEQ ID NO: 1259420 - RNA, 22 nt, Homo sapiens
cuuuagagccagcccauggcuu

SEQ ID NO: 1259421 - RNA, 18 nt, Homo sapiens
cuuuagauauacauauca

SEQ ID NO: 1259422 - RNA, 13 nt, Homo sapiens
cuuuagcaugcua

SEQ ID NO: 1259423 - RNA, 19 nt, Homo sapiens
cuuuaguaucaguguuuua

SEQ ID NO: 1259424 - RNA, 15 nt, Homo sapiens
cuuuauaaauaucaa

SEQ ID NO: 1259425 - RNA, 19 nt, Homo sapiens
cuuuauaaucuacuccuug

SEQ ID NO: 1259426 - RNA, 19 nt, Homo sapiens
cuuuauacguguagcuaua

SEQ ID NO: 1259427 - RNA, 15 nt, Homo sapiens
cuuuauacucaggca

SEQ ID NO: 1259428 - RNA, 17 nt, Homo sapiens
cuuuaucuugacauuca

SEQ ID NO: 1259429 - RNA, 21 nt, Homo sapiens
cuuuaugcuaguuugaccuca

SEQ ID NO: 1259430 - RNA, 17 nt, Homo sapiens
cuuuaugguuucuccag

SEQ ID NO: 1259431 - RNA, 16 nt, Homo sapiens
cuuuauuaaauacaaa

SEQ ID NO: 1259432 - RNA, 18 nt, Homo sapiens
cuuuauuauggcuuguga

SEQ ID NO: 1259433 - RNA, 18 nt, Homo sapiens
cuuuauucuuuacuauua

SEQ ID NO: 1259434 - RNA, 13 nt, Homo sapiens
cuuuauugcucau

SEQ ID NO: 1259435 - RNA, 17 nt, Homo sapiens
cuuuauuggcugagaua

SEQ ID NO: 1259436 - RNA, 12 nt, Homo sapiens
cuuuauuguggg

SEQ ID NO: 1259437 - RNA, 19 nt, Homo sapiens
cuuuauuguucacacaaag

SEQ ID NO: 1259438 - RNA, 14 nt, Homo sapiens
cuuucaaaagcaag

SEQ ID NO: 1259439 - RNA, 15 nt, Homo sapiens
cuuucaaaagggaag

SEQ ID NO: 1259440 - RNA, 18 nt, Homo sapiens
cuuucaaagcuaaauucc

SEQ ID NO: 1259441 - RNA, 19 nt, Homo sapiens
cuuucaagaagugccaguu

SEQ ID NO: 1259442 - RNA, 20 nt, Homo sapiens
cuuucaagcagucgugccug

SEQ ID NO: 1259443 - RNA, 20 nt, Homo sapiens
cuuucaagucugacucucca

SEQ ID NO: 1259444 - RNA, 20 nt, Homo sapiens
cuuucaaguuugucacuaaa

SEQ ID NO: 1259445 - RNA, 21 nt, Homo sapiens
cuuucaaguuugucacuaaac

SEQ ID NO: 1259446 - RNA, 15 nt, Homo sapiens
cuuucacccucauga

SEQ ID NO: 1259447 - RNA, 18 nt, Homo sapiens
cuuucacggggccgugac

SEQ ID NO: 1259448 - RNA, 14 nt, Homo sapiens
cuuucagcauuagg

SEQ ID NO: 1259449 - RNA, 20 nt, Homo sapiens
cuuuccaaaaggaacucuag

SEQ ID NO: 1259450 - RNA, 22 nt, Homo sapiens
ggaugguuuuaucuucccuuua

SEQ ID NO: 1259451 - RNA, 14 nt, Homo sapiens
ggauguaagccugg

SEQ ID NO: 1259452 - RNA, 12 nt, Homo sapiens
ggaugucuuccu

SEQ ID NO: 1259453 - RNA, 19 nt, Homo sapiens
ggauguugaacuggucauu

SEQ ID NO: 1259454 - RNA, 23 nt, Homo sapiens
ggauuaaagugcccagcacaaag

SEQ ID NO: 1259455 - RNA, 17 nt, Homo sapiens
ggauuacaguguagcua

SEQ ID NO: 1259456 - RNA, 14 nt, Homo sapiens
ggauuagaaugccg

SEQ ID NO: 1259457 - RNA, 13 nt, Homo sapiens
ggauuauuaacua

SEQ ID NO: 1259458 - RNA, 19 nt, Homo sapiens
ggauucagcgaagucucau

SEQ ID NO: 1259459 - RNA, 14 nt, Homo sapiens
ggauuccacuaucu

SEQ ID NO: 1259460 - RNA, 18 nt, Homo sapiens
ggauuccucacagccuug

SEQ ID NO: 1259461 - RNA, 21 nt, Homo sapiens
ggauugcuacuguccuaccca

SEQ ID NO: 1259462 - RNA, 18 nt, Homo sapiens
ggauuggccaaacaucag

SEQ ID NO: 1259463 - RNA, 15 nt, Homo sapiens
ggauuuauucugcca

SEQ ID NO: 1259464 - RNA, 16 nt, Homo sapiens
ggauuucauacuguaa

SEQ ID NO: 1259465 - RNA, 14 nt, Homo sapiens
ggauuugcagguga

SEQ ID NO: 1259466 - RNA, 23 nt, Homo sapiens
ggauuugggcuacccuaaaggga

SEQ ID NO: 1259467 - RNA, 14 nt, Homo sapiens
ggauuuuaccaaag

SEQ ID NO: 1259468 - RNA, 17 nt, Homo sapiens
ggauuuuaccaaagcau

SEQ ID NO: 1259469 - RNA, 14 nt, Homo sapiens
ggauuuuucuuuaa

SEQ ID NO: 1259470 - RNA, 23 nt, Homo sapiens
ggauuuuuuguuauguuugcacu

SEQ ID NO: 1259471 - RNA, 16 nt, Homo sapiens
ggcaaaaaaauuaaau

SEQ ID NO: 1259472 - RNA, 12 nt, Homo sapiens
ggcaaacaggca

SEQ ID NO: 1259473 - RNA, 17 nt, Homo sapiens
ggcaaacuugcaguuua

SEQ ID NO: 1259474 - RNA, 18 nt, Homo sapiens
ggcaaauggcugagaugg

SEQ ID NO: 1259475 - RNA, 20 nt, Homo sapiens
ggcaacaguacuucaaacag

SEQ ID NO: 1259476 - RNA, 20 nt, Homo sapiens
ggcaacauaguaagacccca

SEQ ID NO: 1259477 - RNA, 14 nt, Homo sapiens
ggcaagaagaucac

SEQ ID NO: 1259478 - RNA, 23 nt, Homo sapiens
ggcaagacgcgagugcuggugac

SEQ ID NO: 1259479 - RNA, 16 nt, Homo sapiens
ggcaagucuuccauga

SEQ ID NO: 1259480 - RNA, 20 nt, Homo sapiens
ggcaagugugggggguccuu

SEQ ID NO: 1259481 - RNA, 23 nt, Homo sapiens
ggcaauaaauauuagaagccugc

SEQ ID NO: 1259482 - RNA, 16 nt, Homo sapiens
ggcaauaguguguucu

SEQ ID NO: 1259483 - RNA, 19 nt, Homo sapiens
ggcaaucuuugccuuuauc

SEQ ID NO: 1259484 - RNA, 14 nt, Homo sapiens
ggcacaagugucag

SEQ ID NO: 1259485 - RNA, 15 nt, Homo sapiens
ggcacaccgggcacu

SEQ ID NO: 1259486 - RNA, 19 nt, Homo sapiens
ggcacagaagcucaucuca

SEQ ID NO: 1259487 - RNA, 18 nt, Homo sapiens
ggcacaggacugauucug

SEQ ID NO: 1259488 - RNA, 19 nt, Homo sapiens
ggcacagggucugcucuuu

SEQ ID NO: 1259489 - RNA, 14 nt, Homo sapiens
ggcacaugcugagu

SEQ ID NO: 1259490 - RNA, 23 nt, Homo sapiens
ggcacccacaaauaaaugacaag

SEQ ID NO: 1259491 - RNA, 14 nt, Homo sapiens
ggcaccgggcucca

SEQ ID NO: 1259492 - RNA, 22 nt, Homo sapiens
ggcaccuuaagauuuugcaccu

SEQ ID NO: 1259493 - RNA, 17 nt, Homo sapiens
ggcacuacuucuauuca

SEQ ID NO: 1259494 - RNA, 18 nt, Homo sapiens
ggcacucagaagacacug

SEQ ID NO: 1259495 - RNA, 17 nt, Homo sapiens
ggcacucccauccaucc

SEQ ID NO: 1259496 - RNA, 20 nt, Homo sapiens
ggcacuccuggagauaugaa

SEQ ID NO: 1259497 - RNA, 21 nt, Homo sapiens
ggcacugaauuaaucaucuau

SEQ ID NO: 1259498 - RNA, 21 nt, Homo sapiens
ggcacugacaaugggcacaca

SEQ ID NO: 1259499 - RNA, 22 nt, Homo sapiens
ggcacuggcauugucccugugc

SEQ ID NO: 1259500 - RNA, 21 nt, Homo sapiens
ggcacuguaguucuaagacuc

SEQ ID NO: 1259501 - RNA, 18 nt, Homo sapiens
ggcagacuacacaggaug

SEQ ID NO: 1259502 - RNA, 22 nt, Homo sapiens
ggcagagccaccugacucuugc

SEQ ID NO: 1259503 - RNA, 12 nt, Homo sapiens
ggcagagccaug

SEQ ID NO: 1259504 - RNA, 17 nt, Homo sapiens
ggcagagucuaccuuga

SEQ ID NO: 1259505 - RNA, 15 nt, Homo sapiens
ggcagauggggcacu

SEQ ID NO: 1259506 - RNA, 23 nt, Homo sapiens
ggcagauggggcacugacccagg

SEQ ID NO: 1259507 - RNA, 20 nt, Homo sapiens
ggcagauugaacaagagcuu

SEQ ID NO: 1259508 - RNA, 15 nt, Homo sapiens
ggcagcacagugugu

SEQ ID NO: 1259509 - RNA, 23 nt, Homo sapiens
ggcagcagcucccgcagggcuga

SEQ ID NO: 1259510 - RNA, 14 nt, Homo sapiens
ggcagcaugacuca

SEQ ID NO: 1259511 - RNA, 15 nt, Homo sapiens
ggcagccccagagag

SEQ ID NO: 1259512 - RNA, 19 nt, Homo sapiens
ggcagcuccagugccagca

SEQ ID NO: 1259513 - RNA, 16 nt, Homo sapiens
ggcagcugccucugcu

SEQ ID NO: 1259514 - RNA, 19 nt, Homo sapiens
ggcagcuucaagugccuuu

SEQ ID NO: 1259515 - RNA, 20 nt, Homo sapiens
ggcaggagaaucgcuugaac

SEQ ID NO: 1259516 - RNA, 20 nt, Homo sapiens
ggcaggagaauuacuugaac

SEQ ID NO: 1259517 - RNA, 17 nt, Homo sapiens
ggcaggcgguccccauc

SEQ ID NO: 1259518 - RNA, 17 nt, Homo sapiens
ggcagggcccagugaca

SEQ ID NO: 1259519 - RNA, 18 nt, Homo sapiens
ggcagguagccaggggga

SEQ ID NO: 1259520 - RNA, 15 nt, Homo sapiens
ggcaggucacuuuac

SEQ ID NO: 1259521 - RNA, 17 nt, Homo sapiens
ggcaggugaauaugugg

SEQ ID NO: 1259522 - RNA, 11 nt, Homo sapiens
ggcaguacugu

SEQ ID NO: 1259523 - RNA, 20 nt, Homo sapiens
ggcagucugaacccuugugc

SEQ ID NO: 1259524 - RNA, 22 nt, Homo sapiens
ggcagucugaacccuugugcuu

SEQ ID NO: 1259525 - RNA, 15 nt, Homo sapiens
ggcaguucucacucc

SEQ ID NO: 1259526 - RNA, 10 nt, Homo sapiens
ggcaguuuuu

SEQ ID NO: 1259527 - RNA, 12 nt, Homo sapiens
ggcauacuuucu

SEQ ID NO: 1259528 - RNA, 16 nt, Homo sapiens
ggcauaggccugggug

SEQ ID NO: 1259529 - RNA, 11 nt, Homo sapiens
ggcauaugcac

SEQ ID NO: 1259530 - RNA, 13 nt, Homo sapiens
ggcauaugcacag

SEQ ID NO: 1259531 - RNA, 22 nt, Homo sapiens
ggcaucaaaaaagauagaucua

SEQ ID NO: 1259532 - RNA, 13 nt, Homo sapiens
ggcaucaaacagg

SEQ ID NO: 1259533 - RNA, 15 nt, Homo sapiens
ggcaucucacuuuau

SEQ ID NO: 1259534 - RNA, 20 nt, Homo sapiens
ggcaucucacuuuaugauag

SEQ ID NO: 1259535 - RNA, 19 nt, Homo sapiens
ggcaucuccuguccugggc

SEQ ID NO: 1259536 - RNA, 16 nt, Homo sapiens
ggcaucuccugugcau

SEQ ID NO: 1259537 - RNA, 19 nt, Homo sapiens
ggcaugaagcugcauauga

SEQ ID NO: 1259538 - RNA, 17 nt, Homo sapiens
ggcaugagccacugagc

SEQ ID NO: 1259539 - RNA, 13 nt, Homo sapiens
ggcauggauccag

SEQ ID NO: 1259540 - RNA, 18 nt, Homo sapiens
ggcauggccagguggcca

SEQ ID NO: 1259541 - RNA, 12 nt, Homo sapiens
ggcauguaugca

SEQ ID NO: 1259542 - RNA, 13 nt, Homo sapiens
ggcaugugugccu

SEQ ID NO: 1259543 - RNA, 17 nt, Homo sapiens
ggcauuuaacuccucau

SEQ ID NO: 1259544 - RNA, 21 nt, Homo sapiens
ggccaaagagucuccaguuua

SEQ ID NO: 1259545 - RNA, 14 nt, Homo sapiens
ggccaacagcaccu

SEQ ID NO: 1259546 - RNA, 14 nt, Homo sapiens
ggccaacuaggcag

SEQ ID NO: 1259547 - RNA, 18 nt, Homo sapiens
ggccaagaaaauugccuu

SEQ ID NO: 1259548 - RNA, 16 nt, Homo sapiens
ggccaaggcuccuaug

SEQ ID NO: 1259549 - RNA, 12 nt, Homo sapiens
ggccaaguguac

SEQ ID NO: 1259550 - RNA, 15 nt, Homo sapiens
ggccaaguuccucua

SEQ ID NO: 1259551 - RNA, 18 nt, Homo sapiens
ggccacaccgagacacca

SEQ ID NO: 1259552 - RNA, 21 nt, Homo sapiens
ggccacauagaugcugaugga

SEQ ID NO: 1259553 - RNA, 14 nt, Homo sapiens
ggccaccaggcugg

SEQ ID NO: 1259554 - RNA, 13 nt, Homo sapiens
ggccacccaggaa

SEQ ID NO: 1259555 - RNA, 21 nt, Homo sapiens
ggccaccccuaggaacucagu

SEQ ID NO: 1259556 - RNA, 20 nt, Homo sapiens
ggccacccgcccacagccag

SEQ ID NO: 1259557 - RNA, 17 nt, Homo sapiens
ggccaccgccagagcuc

SEQ ID NO: 1259558 - RNA, 17 nt, Homo sapiens
ggccacuguggccagag

SEQ ID NO: 1259559 - RNA, 18 nt, Homo sapiens
ggccagagggagugacag

SEQ ID NO: 1259560 - RNA, 14 nt, Homo sapiens
ggccagagggcagu

SEQ ID NO: 1259561 - RNA, 17 nt, Homo sapiens
ggccagaugcacauccc

SEQ ID NO: 1259562 - RNA, 13 nt, Homo sapiens
ggccagccagugc

SEQ ID NO: 1259563 - RNA, 16 nt, Homo sapiens
ggccagccagugccau

SEQ ID NO: 1259564 - RNA, 14 nt, Homo sapiens
ggccagcccagcca

SEQ ID NO: 1259565 - RNA, 23 nt, Homo sapiens
ggccagccuccggcggggaccca

SEQ ID NO: 1259566 - RNA, 20 nt, Homo sapiens
ggccaggcacccccaaauca

SEQ ID NO: 1259567 - RNA, 19 nt, Homo sapiens
ggccaggccacccaaagga

SEQ ID NO: 1259568 - RNA, 19 nt, Homo sapiens
ggccagggcugcccugaga

SEQ ID NO: 1259569 - RNA, 18 nt, Homo sapiens
ggccagucaggcugcaga

SEQ ID NO: 1259570 - RNA, 23 nt, Homo sapiens
ggccagucaggcugcagaggcac

SEQ ID NO: 1259571 - RNA, 18 nt, Homo sapiens
ggccagugccagcaccug

SEQ ID NO: 1259572 - RNA, 20 nt, Homo sapiens
ggccaguggaagaaacaccc

SEQ ID NO: 1259573 - RNA, 13 nt, Homo sapiens
ggccaguugccca

SEQ ID NO: 1259574 - RNA, 18 nt, Homo sapiens
ggccauaaagaucaaaca

SEQ ID NO: 1259575 - RNA, 13 nt, Homo sapiens
ggccauauuaccc

SEQ ID NO: 1259576 - RNA, 21 nt, Homo sapiens
uauuuucagccuacaguuaug

SEQ ID NO: 1259577 - RNA, 15 nt, Homo sapiens
uauuuucagcucaau

SEQ ID NO: 1259578 - RNA, 15 nt, Homo sapiens
uauuuucaguauacu

SEQ ID NO: 1259579 - RNA, 13 nt, Homo sapiens
uauuuugaauuca

SEQ ID NO: 1259580 - RNA, 18 nt, Homo sapiens
uauuuugcauaguaccaa

SEQ ID NO: 1259581 - RNA, 22 nt, Homo sapiens
uauuuuguugccuucaucuuca

SEQ ID NO: 1259582 - RNA, 19 nt, Homo sapiens
uauuuuuacaagaaguuua

SEQ ID NO: 1259583 - RNA, 21 nt, Homo sapiens
uauuuuuagacagagucucac

SEQ ID NO: 1259584 - RNA, 22 nt, Homo sapiens
uauuuuuauaaauauaagccuu

SEQ ID NO: 1259585 - RNA, 21 nt, Homo sapiens
uauuuuuauacaaaccuacca

SEQ ID NO: 1259586 - RNA, 12 nt, Homo sapiens
uauuuuugccaa

SEQ ID NO: 1259587 - RNA, 23 nt, Homo sapiens
uauuuuugcccugaguccaagag

SEQ ID NO: 1259588 - RNA, 21 nt, Homo sapiens
uauuuuuguacugaaucucau

SEQ ID NO: 1259589 - RNA, 17 nt, Homo sapiens
uauuuuuuaaguauuua

SEQ ID NO: 1259590 - RNA, 14 nt, Homo sapiens
uauuuuuugcaagu

SEQ ID NO: 1259591 - RNA, 17 nt, Homo sapiens
uauuuuuuuuuugccaa

SEQ ID NO: 1259592 - RNA, 18 nt, Homo sapiens
ucaaaaagggaaugcauu

SEQ ID NO: 1259593 - RNA, 14 nt, Homo sapiens
ucaaaaauaugugu

SEQ ID NO: 1259594 - RNA, 21 nt, Homo sapiens
ucaaaacacacuacuaccucu

SEQ ID NO: 1259595 - RNA, 18 nt, Homo sapiens
ucaaaacauucauaggca

SEQ ID NO: 1259596 - RNA, 13 nt, Homo sapiens
ucaaaaccugugc

SEQ ID NO: 1259597 - RNA, 17 nt, Homo sapiens
ucaaaaccugugccagg

SEQ ID NO: 1259598 - RNA, 14 nt, Homo sapiens
ucaaaaccuuucaa

SEQ ID NO: 1259599 - RNA, 18 nt, Homo sapiens
ucaaaacuaaccaucuga

SEQ ID NO: 1259600 - RNA, 20 nt, Homo sapiens
ucaaaagcugggaaccagca

SEQ ID NO: 1259601 - RNA, 15 nt, Homo sapiens
ucaaaaggaaaccaa

SEQ ID NO: 1259602 - RNA, 16 nt, Homo sapiens
ucaaaaggaaaccaag

SEQ ID NO: 1259603 - RNA, 22 nt, Homo sapiens
ucaaaagguauuauacauguga

SEQ ID NO: 1259604 - RNA, 13 nt, Homo sapiens
ucaaaaggucuaa

SEQ ID NO: 1259605 - RNA, 18 nt, Homo sapiens
ucaaaauauacauucaaa

SEQ ID NO: 1259606 - RNA, 21 nt, Homo sapiens
ucaaaauccuuccaaagaauu

SEQ ID NO: 1259607 - RNA, 14 nt, Homo sapiens
ucaaaauugccuuu

SEQ ID NO: 1259608 - RNA, 22 nt, Homo sapiens
ucaaacaacauuccaccccagc

SEQ ID NO: 1259609 - RNA, 19 nt, Homo sapiens
ucaaacagggcaaaguguu

SEQ ID NO: 1259610 - RNA, 16 nt, Homo sapiens
ucaaacauaauucucu

SEQ ID NO: 1259611 - RNA, 14 nt, Homo sapiens
ucaaaccacaugga

SEQ ID NO: 1259612 - RNA, 18 nt, Homo sapiens
ucaaaccccgaccaccug

SEQ ID NO: 1259613 - RNA, 22 nt, Homo sapiens
ucaaaccccuacugaccuggcu

SEQ ID NO: 1259614 - RNA, 17 nt, Homo sapiens
ucaaacuccugaccuca

SEQ ID NO: 1259615 - RNA, 20 nt, Homo sapiens
ucaaagaagucauucuuuaa

SEQ ID NO: 1259616 - RNA, 17 nt, Homo sapiens
ucaaagacuguauuuag

SEQ ID NO: 1259617 - RNA, 15 nt, Homo sapiens
ucaaagcaaguuuca

SEQ ID NO: 1259618 - RNA, 23 nt, Homo sapiens
ucaaagcucuauuaagauuucca

SEQ ID NO: 1259619 - RNA, 20 nt, Homo sapiens
ucaaaggaaaauaguaaugu

SEQ ID NO: 1259620 - RNA, 22 nt, Homo sapiens
ucaaaggcccucagugagauaa

SEQ ID NO: 1259621 - RNA, 15 nt, Homo sapiens
ucaaagguucuaggu

SEQ ID NO: 1259622 - RNA, 21 nt, Homo sapiens
ucaaaguguuuuucaagccug

SEQ ID NO: 1259623 - RNA, 22 nt, Homo sapiens
ucaaaguguuuuucaagccugu

SEQ ID NO: 1259624 - RNA, 22 nt, Homo sapiens
ucaaaguuuugaaaagcuauua

SEQ ID NO: 1259625 - RNA, 14 nt, Homo sapiens
ucaaauaacuaaaa

SEQ ID NO: 1259626 - RNA, 20 nt, Homo sapiens
ucaaauaagcuaauauacag

SEQ ID NO: 1259627 - RNA, 21 nt, Homo sapiens
ucaaauacacauuugcuacug

SEQ ID NO: 1259628 - RNA, 20 nt, Homo sapiens
ucaaauagaaccacuaugaa

SEQ ID NO: 1259629 - RNA, 23 nt, Homo sapiens
ucaaauauuucugauacugcuga

SEQ ID NO: 1259630 - RNA, 14 nt, Homo sapiens
ucaaauauuugcug

SEQ ID NO: 1259631 - RNA, 21 nt, Homo sapiens
ucaaaucacauggcuuuccac

SEQ ID NO: 1259632 - RNA, 14 nt, Homo sapiens
ucaaauccuuccaa

SEQ ID NO: 1259633 - RNA, 14 nt, Homo sapiens
ucaaaucucuucca

SEQ ID NO: 1259634 - RNA, 21 nt, Homo sapiens
ucaaaugaguaacauuugcug

SEQ ID NO: 1259635 - RNA, 12 nt, Homo sapiens
ucaaaugcacau

SEQ ID NO: 1259636 - RNA, 16 nt, Homo sapiens
ucaaaugcacaucuca

SEQ ID NO: 1259637 - RNA, 17 nt, Homo sapiens
ucaaaugcacaucucau

SEQ ID NO: 1259638 - RNA, 16 nt, Homo sapiens
ucaaauggguuuucca

SEQ ID NO: 1259639 - RNA, 13 nt, Homo sapiens
ucaaaugugcugu

SEQ ID NO: 1259640 - RNA, 18 nt, Homo sapiens
ucaaauuauuaccaguga

SEQ ID NO: 1259641 - RNA, 14 nt, Homo sapiens
ucaaauugcugcuu

SEQ ID NO: 1259642 - RNA, 21 nt, Homo sapiens
ucaaauugggaaauccauucc

SEQ ID NO: 1259643 - RNA, 19 nt, Homo sapiens
ucaaauuggugaacagugu

SEQ ID NO: 1259644 - RNA, 22 nt, Homo sapiens
ucaaauuucuguucucucuucc

SEQ ID NO: 1259645 - RNA, 17 nt, Homo sapiens
ucaaauuuguaaaguua

SEQ ID NO: 1259646 - RNA, 23 nt, Homo sapiens
ucaaauuuugaugccaagaaagu

SEQ ID NO: 1259647 - RNA, 19 nt, Homo sapiens
ucaacaaaauggucaucca

SEQ ID NO: 1259648 - RNA, 21 nt, Homo sapiens
ucaacaaaauggucauccaaa

SEQ ID NO: 1259649 - RNA, 14 nt, Homo sapiens
ucaacaagauuucc

SEQ ID NO: 1259650 - RNA, 15 nt, Homo sapiens
ucaacaaguaccuga

SEQ ID NO: 1259651 - RNA, 16 nt, Homo sapiens
ucaacaccacuaggaa

SEQ ID NO: 1259652 - RNA, 13 nt, Homo sapiens
ucaacacuguuac

SEQ ID NO: 1259653 - RNA, 19 nt, Homo sapiens
ucaacacuuguaucuggcc

SEQ ID NO: 1259654 - RNA, 17 nt, Homo sapiens
ucaacaggcccagggag

SEQ ID NO: 1259655 - RNA, 20 nt, Homo sapiens
ucaacaucuuuuacauucug

SEQ ID NO: 1259656 - RNA, 20 nt, Homo sapiens
ucaacauuaaggcaguauga

SEQ ID NO: 1259657 - RNA, 15 nt, Homo sapiens
ucaacauuacuguua

SEQ ID NO: 1259658 - RNA, 20 nt, Homo sapiens
ucaacgcucccagacgguca

SEQ ID NO: 1259659 - RNA, 16 nt, Homo sapiens
ucaacugaaguucuau

SEQ ID NO: 1259660 - RNA, 17 nt, Homo sapiens
ucaacugaaugagguca

SEQ ID NO: 1259661 - RNA, 11 nt, Homo sapiens
ucaacugccua

SEQ ID NO: 1259662 - RNA, 12 nt, Homo sapiens
ucaacugcugua

SEQ ID NO: 1259663 - RNA, 15 nt, Homo sapiens
ucaacuguauaguuu

SEQ ID NO: 1259664 - RNA, 20 nt, Homo sapiens
ucaacuguugauugcaggaa

SEQ ID NO: 1259665 - RNA, 19 nt, Homo sapiens
ucaacuucuggcuccucaa

SEQ ID NO: 1259666 - RNA, 22 nt, Homo sapiens
ucaacuuuagcuaguaucuuca

SEQ ID NO: 1259667 - RNA, 20 nt, Homo sapiens
ucaacuuuggugaacaguuu

SEQ ID NO: 1259668 - RNA, 20 nt, Homo sapiens
ucaagaccauccuggacuga

SEQ ID NO: 1259669 - RNA, 16 nt, Homo sapiens
ucaagaggcagaguuc

SEQ ID NO: 1259670 - RNA, 14 nt, Homo sapiens
ucaagagugagcua

SEQ ID NO: 1259671 - RNA, 19 nt, Homo sapiens
ucaagauacugcuacugua

SEQ ID NO: 1259672 - RNA, 20 nt, Homo sapiens
ucaagaugccuccugucaga

SEQ ID NO: 1259673 - RNA, 14 nt, Homo sapiens
ucaagauucuacuu

SEQ ID NO: 1259674 - RNA, 22 nt, Homo sapiens
ucaagcaaaaugcuuacagggc

SEQ ID NO: 1259675 - RNA, 22 nt, Homo sapiens
ucaagcaauucuccugccuuag

SEQ ID NO: 1259676 - RNA, 14 nt, Homo sapiens
ucaagcacauguaa

SEQ ID NO: 1259677 - RNA, 19 nt, Homo sapiens
ucaagcagagaaaauaauu

SEQ ID NO: 1259678 - RNA, 16 nt, Homo sapiens
ucaagcagucgugccu

SEQ ID NO: 1259679 - RNA, 15 nt, Homo sapiens
ucaagccccauuucc

SEQ ID NO: 1259680 - RNA, 17 nt, Homo sapiens
ucaagcuauucucaugc

SEQ ID NO: 1259681 - RNA, 23 nt, Homo sapiens
ucaaggaguacuccaagacagag

SEQ ID NO: 1259682 - RNA, 16 nt, Homo sapiens
ucaaggauauacugca

SEQ ID NO: 1259683 - RNA, 19 nt, Homo sapiens
ucaaggcaguagaacucca

SEQ ID NO: 1259684 - RNA, 20 nt, Homo sapiens
ucaaggcaguagaacuccag

SEQ ID NO: 1259685 - RNA, 21 nt, Homo sapiens
ucaaggcccauaucugugaaa

SEQ ID NO: 1259686 - RNA, 18 nt, Homo sapiens
ucaaggcugcagugagcc

SEQ ID NO: 1259687 - RNA, 21 nt, Homo sapiens
ucaaggucagcaugaggacag

SEQ ID NO: 1259688 - RNA, 12 nt, Homo sapiens
ucaaggugacag

SEQ ID NO: 1259689 - RNA, 18 nt, Homo sapiens
ucaaguauaacaacuuug

SEQ ID NO: 1259690 - RNA, 16 nt, Homo sapiens
ucaagucaaucauuuc

SEQ ID NO: 1259691 - RNA, 17 nt, Homo sapiens
ucaagucuccuccaugg

SEQ ID NO: 1259692 - RNA, 21 nt, Homo sapiens
ucaagugccuagacuguuacu

SEQ ID NO: 1259693 - RNA, 18 nt, Homo sapiens
ucaaguggagagaaauca

SEQ ID NO: 1259694 - RNA, 17 nt, Homo sapiens
ucaaguuuacacuucau

SEQ ID NO: 1259695 - RNA, 17 nt, Homo sapiens
ucaauaaaaaucugcuc

SEQ ID NO: 1259696 - RNA, 17 nt, Homo sapiens
ucaauaaacaacagcug

SEQ ID NO: 1259697 - RNA, 22 nt, Homo sapiens
ucaauaaacaacagcugaagca

SEQ ID NO: 1259698 - RNA, 14 nt, Homo sapiens
ucaauaaacauuga

SEQ ID NO: 1259699 - RNA, 17 nt, Homo sapiens
ucaauaauauuagcuua

SEQ ID NO: 1259700 - RNA, 19 nt, Homo sapiens
ucaauacaaccagcccaac

SEQ ID NO: 1259701 - RNA, 20 nt, Homo sapiens
ucaguccacuucugcucugg

SEQ ID NO: 1259702 - RNA, 22 nt, Homo sapiens
ucaguccauugcucuugagucu

SEQ ID NO: 1259703 - RNA, 17 nt, Homo sapiens
ucaguccuguacucugg

SEQ ID NO: 1259704 - RNA, 15 nt, Homo sapiens
ucaguccuuugauca

SEQ ID NO: 1259705 - RNA, 14 nt, Homo sapiens
ucagucuggugcuc

SEQ ID NO: 1259706 - RNA, 14 nt, Homo sapiens
ucagugaaagccag

SEQ ID NO: 1259707 - RNA, 15 nt, Homo sapiens
ucagugaaagccaga

SEQ ID NO: 1259708 - RNA, 20 nt, Homo sapiens
ucagugaagaugccagugaa

SEQ ID NO: 1259709 - RNA, 11 nt, Homo sapiens
ucagugacauc

SEQ ID NO: 1259710 - RNA, 16 nt, Homo sapiens
ucagugacuccugcug

SEQ ID NO: 1259711 - RNA, 16 nt, Homo sapiens
ucagugauuacuguca

SEQ ID NO: 1259712 - RNA, 17 nt, Homo sapiens
ucagugcucugcuuuua

SEQ ID NO: 1259713 - RNA, 17 nt, Homo sapiens
ucagugguuagaagcau

SEQ ID NO: 1259714 - RNA, 15 nt, Homo sapiens
ucaguguacauggaa

SEQ ID NO: 1259715 - RNA, 13 nt, Homo sapiens
ucaguuaacauua

SEQ ID NO: 1259716 - RNA, 22 nt, Homo sapiens
ucaguuugcuagcagaaaucua

SEQ ID NO: 1259717 - RNA, 14 nt, Homo sapiens
ucauaacagucuua

SEQ ID NO: 1259718 - RNA, 21 nt, Homo sapiens
ucauaacuuggccauguucuc

SEQ ID NO: 1259719 - RNA, 21 nt, Homo sapiens
ucauaagaaugaauaauaauu

SEQ ID NO: 1259720 - RNA, 21 nt, Homo sapiens
ucauaagauuaugaaaccaca

SEQ ID NO: 1259721 - RNA, 18 nt, Homo sapiens
ucauaauggaaaaaaaga

SEQ ID NO: 1259722 - RNA, 21 nt, Homo sapiens
ucauaaugugcaaagucauca

SEQ ID NO: 1259723 - RNA, 23 nt, Homo sapiens
ucauaauguggugauggcccuaa

SEQ ID NO: 1259724 - RNA, 17 nt, Homo sapiens
ucauaauucagcacuua

SEQ ID NO: 1259725 - RNA, 20 nt, Homo sapiens
ucauacaaagcgugcacaag

SEQ ID NO: 1259726 - RNA, 13 nt, Homo sapiens
ucauacaugcaua

SEQ ID NO: 1259727 - RNA, 17 nt, Homo sapiens
ucauaccuaaguacugu

SEQ ID NO: 1259728 - RNA, 11 nt, Homo sapiens
ucauaccuuau

SEQ ID NO: 1259729 - RNA, 16 nt, Homo sapiens
ucauacuguucaaugg

SEQ ID NO: 1259730 - RNA, 18 nt, Homo sapiens
ucauagcuaauuuuugca

SEQ ID NO: 1259731 - RNA, 20 nt, Homo sapiens
ucauaggaaaaguacauuua

SEQ ID NO: 1259732 - RNA, 16 nt, Homo sapiens
ucauaggcaguaaugu

SEQ ID NO: 1259733 - RNA, 13 nt, Homo sapiens
ucauauaccagca

SEQ ID NO: 1259734 - RNA, 18 nt, Homo sapiens
ucauauaguaaacacuca

SEQ ID NO: 1259735 - RNA, 20 nt, Homo sapiens
ucauauauuuuuaccaucug

SEQ ID NO: 1259736 - RNA, 15 nt, Homo sapiens
ucauauguugcucag

SEQ ID NO: 1259737 - RNA, 15 nt, Homo sapiens
ucauauucauaugca

SEQ ID NO: 1259738 - RNA, 23 nt, Homo sapiens
ucauauugguauucacuaaucug

SEQ ID NO: 1259739 - RNA, 18 nt, Homo sapiens
ucauauuugaaaaccaua

SEQ ID NO: 1259740 - RNA, 15 nt, Homo sapiens
ucaucaacaauuuga

SEQ ID NO: 1259741 - RNA, 13 nt, Homo sapiens
ucaucaacacagu

SEQ ID NO: 1259742 - RNA, 23 nt, Homo sapiens
ucaucaacgucucagcccuucag

SEQ ID NO: 1259743 - RNA, 15 nt, Homo sapiens
ucaucaaucaaauaa

SEQ ID NO: 1259744 - RNA, 19 nt, Homo sapiens
ucaucaaugugacauuuac

SEQ ID NO: 1259745 - RNA, 15 nt, Homo sapiens
ucaucacacucucca

SEQ ID NO: 1259746 - RNA, 20 nt, Homo sapiens
ucaucaggaaggaaaugaca

SEQ ID NO: 1259747 - RNA, 21 nt, Homo sapiens
ucaucaggaaggaaaugacac

SEQ ID NO: 1259748 - RNA, 15 nt, Homo sapiens
ucaucaggugcauag

SEQ ID NO: 1259749 - RNA, 21 nt, Homo sapiens
ucaucauaaaauaaaguauau

SEQ ID NO: 1259750 - RNA, 16 nt, Homo sapiens
ucaucauucccucuca

SEQ ID NO: 1259751 - RNA, 21 nt, Homo sapiens
ucaucauuuguggcagucccu

SEQ ID NO: 1259752 - RNA, 19 nt, Homo sapiens
ucauccccaggggucccag

SEQ ID NO: 1259753 - RNA, 17 nt, Homo sapiens
ucauccccucguccugu

SEQ ID NO: 1259754 - RNA, 17 nt, Homo sapiens
ucaucccuuaauuuaag

SEQ ID NO: 1259755 - RNA, 18 nt, Homo sapiens
ucaucccuuuuucugcua

SEQ ID NO: 1259756 - RNA, 14 nt, Homo sapiens
ucauccuagcaaau

SEQ ID NO: 1259757 - RNA, 21 nt, Homo sapiens
ucaucgaaaauucauuucaca

SEQ ID NO: 1259758 - RNA, 23 nt, Homo sapiens
ucaucgggaggagcagccugaac

SEQ ID NO: 1259759 - RNA, 18 nt, Homo sapiens
ucaucgggccagaaggcg

SEQ ID NO: 1259760 - RNA, 20 nt, Homo sapiens
ucaucuauaaagaagaacuu

SEQ ID NO: 1259761 - RNA, 20 nt, Homo sapiens
ucaucuccaucauaugccug

SEQ ID NO: 1259762 - RNA, 16 nt, Homo sapiens
ucaucucggaguucca

SEQ ID NO: 1259763 - RNA, 14 nt, Homo sapiens
ucaugaaacugucc

SEQ ID NO: 1259764 - RNA, 21 nt, Homo sapiens
ucaugaaacuguccaccaaga

SEQ ID NO: 1259765 - RNA, 14 nt, Homo sapiens
ucaugaaauaugca

SEQ ID NO: 1259766 - RNA, 15 nt, Homo sapiens
ucaugaaauaugcau

SEQ ID NO: 1259767 - RNA, 13 nt, Homo sapiens
ucaugaacagcuc

SEQ ID NO: 1259768 - RNA, 16 nt, Homo sapiens
ucaugacauguuauau

SEQ ID NO: 1259769 - RNA, 14 nt, Homo sapiens
ucaugagacaaguc

SEQ ID NO: 1259770 - RNA, 14 nt, Homo sapiens
ucaugagcaaguga

SEQ ID NO: 1259771 - RNA, 15 nt, Homo sapiens
ucaugagcuugaaca

SEQ ID NO: 1259772 - RNA, 11 nt, Homo sapiens
ucaugcacuuu

SEQ ID NO: 1259773 - RNA, 23 nt, Homo sapiens
ucaugccaccauggccagccaac

SEQ ID NO: 1259774 - RNA, 19 nt, Homo sapiens
ucaugccucagccucucaa

SEQ ID NO: 1259775 - RNA, 23 nt, Homo sapiens
ucaugccuguaaucucagcacuu

SEQ ID NO: 1259776 - RNA, 16 nt, Homo sapiens
ucaugcggacccucac

SEQ ID NO: 1259777 - RNA, 18 nt, Homo sapiens
ucaugcuuuugcuugcaa

SEQ ID NO: 1259778 - RNA, 19 nt, Homo sapiens
ucauggaaguggcagugaa

SEQ ID NO: 1259779 - RNA, 20 nt, Homo sapiens
ucauggagaaucugcugcau

SEQ ID NO: 1259780 - RNA, 11 nt, Homo sapiens
ucauggcauau

SEQ ID NO: 1259781 - RNA, 15 nt, Homo sapiens
ucauggccaccucca

SEQ ID NO: 1259782 - RNA, 17 nt, Homo sapiens
ucauggcuaauuuaaca

SEQ ID NO: 1259783 - RNA, 23 nt, Homo sapiens
ucaugggaaugauagcccagaac

SEQ ID NO: 1259784 - RNA, 15 nt, Homo sapiens
ucauggguuaugugu

SEQ ID NO: 1259785 - RNA, 21 nt, Homo sapiens
ucauggguuauguguaugugc

SEQ ID NO: 1259786 - RNA, 15 nt, Homo sapiens
ucaugguacauuuau

SEQ ID NO: 1259787 - RNA, 17 nt, Homo sapiens
ucaugguagagaaucuc

SEQ ID NO: 1259788 - RNA, 22 nt, Homo sapiens
ucauguacuuuggcaucuuuug

SEQ ID NO: 1259789 - RNA, 15 nt, Homo sapiens
ucaugugcucagaag

SEQ ID NO: 1259790 - RNA, 17 nt, Homo sapiens
ucauguguggaaauggg

SEQ ID NO: 1259791 - RNA, 14 nt, Homo sapiens
ucauguugcaaaga

SEQ ID NO: 1259792 - RNA, 21 nt, Homo sapiens
ucauguuguugaggcugucac

SEQ ID NO: 1259793 - RNA, 20 nt, Homo sapiens
ucauuacaaaaaaacacgug

SEQ ID NO: 1259794 - RNA, 14 nt, Homo sapiens
ucauuagugacuuc

SEQ ID NO: 1259795 - RNA, 14 nt, Homo sapiens
ucauuauaaaaugg

SEQ ID NO: 1259796 - RNA, 16 nt, Homo sapiens
ucauuaucacagugaa

SEQ ID NO: 1259797 - RNA, 13 nt, Homo sapiens
ucauuauguauga

SEQ ID NO: 1259798 - RNA, 19 nt, Homo sapiens
ucauuauuuugugguucua

SEQ ID NO: 1259799 - RNA, 22 nt, Homo sapiens
ucauuauuuuuguuagcaaaga

SEQ ID NO: 1259800 - RNA, 23 nt, Homo sapiens
ucauucaccaaaugaugccacuu

SEQ ID NO: 1259801 - RNA, 15 nt, Homo sapiens
ucauucagcuaacaa

SEQ ID NO: 1259802 - RNA, 18 nt, Homo sapiens
ucauucuguuagauacua

SEQ ID NO: 1259803 - RNA, 22 nt, Homo sapiens
ucauucuuacaauugcacugcu

SEQ ID NO: 1259804 - RNA, 13 nt, Homo sapiens
ucauucuuuacau

SEQ ID NO: 1259805 - RNA, 21 nt, Homo sapiens
ucauugaaguauuuuccucca

SEQ ID NO: 1259806 - RNA, 18 nt, Homo sapiens
ucauugacaagaacugaa

SEQ ID NO: 1259807 - RNA, 17 nt, Homo sapiens
ucauugaccucucaggg

SEQ ID NO: 1259808 - RNA, 15 nt, Homo sapiens
ucauugcacuuugau

SEQ ID NO: 1259809 - RNA, 17 nt, Homo sapiens
ucauugcuuugaagcag

SEQ ID NO: 1259810 - RNA, 16 nt, Homo sapiens
ucauuggcuccuggau

SEQ ID NO: 1259811 - RNA, 13 nt, Homo sapiens
ucauuguauucag

SEQ ID NO: 1259812 - RNA, 22 nt, Homo sapiens
ucauugucccucuucacucccc

SEQ ID NO: 1259813 - RNA, 23 nt, Homo sapiens
ucauugugagauugcaguucugu

SEQ ID NO: 1259814 - RNA, 14 nt, Homo sapiens
ucauuguguucucu

SEQ ID NO: 1259815 - RNA, 15 nt, Homo sapiens
ucauuguuucugcau

SEQ ID NO: 1259816 - RNA, 13 nt, Homo sapiens
ucauuuaaacuuc

SEQ ID NO: 1259817 - RNA, 14 nt, Homo sapiens
ucauuuagaacuug

SEQ ID NO: 1259818 - RNA, 15 nt, Homo sapiens
ucauuuauucaagua

SEQ ID NO: 1259819 - RNA, 17 nt, Homo sapiens
ucauuucagauaaacaa

SEQ ID NO: 1259820 - RNA, 18 nt, Homo sapiens
ucauuucucagcuguccu

SEQ ID NO: 1259821 - RNA, 13 nt, Homo sapiens
ucauuugaacaac

SEQ ID NO: 1259822 - RNA, 14 nt, Homo sapiens
ucauuugaugcuaa

SEQ ID NO: 1259823 - RNA, 20 nt, Homo sapiens
ucauuugggcuuucuguuga

SEQ ID NO: 1259824 - RNA, 19 nt, Homo sapiens
ucauuuuacacaaagggaa

SEQ ID NO: 1259825 - RNA, 22 nt, Homo sapiens
ucauuuuuaaccucuagaguca

SEQ ID NO: 1259826 - RNA, 21 nt, Homo sapiens
ucauuuuuguacaguuugcug

SEQ ID NO: 1259827 - RNA, 12 nt, Homo sapiens
ucccuaccucag

SEQ ID NO: 1259828 - RNA, 21 nt, Homo sapiens
ucccuagauagcuauuaagau

SEQ ID NO: 1259829 - RNA, 20 nt, Homo sapiens
ucccucagaaaaaggcagug

SEQ ID NO: 1259830 - RNA, 17 nt, Homo sapiens
ucccucagcucucuggg

SEQ ID NO: 1259831 - RNA, 11 nt, Homo sapiens
ucccucaguga

SEQ ID NO: 1259832 - RNA, 13 nt, Homo sapiens
ucccucagugaag

SEQ ID NO: 1259833 - RNA, 23 nt, Homo sapiens
ucccucccagaggagccaccagu

SEQ ID NO: 1259834 - RNA, 22 nt, Homo sapiens
ucccuccccagaaacagugugc

SEQ ID NO: 1259835 - RNA, 17 nt, Homo sapiens
ucccucgggugugcuau

SEQ ID NO: 1259836 - RNA, 14 nt, Homo sapiens
ucccucuaaugaga

SEQ ID NO: 1259837 - RNA, 16 nt, Homo sapiens
ucccucucaugguacc

SEQ ID NO: 1259838 - RNA, 18 nt, Homo sapiens
ucccucugccuucaggcu

SEQ ID NO: 1259839 - RNA, 22 nt, Homo sapiens
ucccucuuuggcuccccuguac

SEQ ID NO: 1259840 - RNA, 12 nt, Homo sapiens
ucccugacagca

SEQ ID NO: 1259841 - RNA, 20 nt, Homo sapiens
ucccugaggaccaccuccua

SEQ ID NO: 1259842 - RNA, 13 nt, Homo sapiens
ucccugaucccau

SEQ ID NO: 1259843 - RNA, 14 nt, Homo sapiens
ucccugcacccaug

SEQ ID NO: 1259844 - RNA, 22 nt, Homo sapiens
ucccugccagaggggaaggagg

SEQ ID NO: 1259845 - RNA, 19 nt, Homo sapiens
ucccugcgccugugaugcu

SEQ ID NO: 1259846 - RNA, 16 nt, Homo sapiens
ucccuggaugacauua

SEQ ID NO: 1259847 - RNA, 18 nt, Homo sapiens
ucccuggaugacauuaaa

SEQ ID NO: 1259848 - RNA, 13 nt, Homo sapiens
ucccugggggccu

SEQ ID NO: 1259849 - RNA, 21 nt, Homo sapiens
ucccuguaaacguuaaaaaca

SEQ ID NO: 1259850 - RNA, 18 nt, Homo sapiens
ucccuguaugucuaccuc

SEQ ID NO: 1259851 - RNA, 16 nt, Homo sapiens
ucccugugucauuuca

SEQ ID NO: 1259852 - RNA, 19 nt, Homo sapiens
ucccuuaauuuaagucauu

SEQ ID NO: 1259853 - RNA, 16 nt, Homo sapiens
ucccuucgacauugag

SEQ ID NO: 1259854 - RNA, 22 nt, Homo sapiens
ucccuucgacauugagccuucg

SEQ ID NO: 1259855 - RNA, 19 nt, Homo sapiens
ucccuucucuuaauuuaau

SEQ ID NO: 1259856 - RNA, 13 nt, Homo sapiens
ucccuugaaauuu

SEQ ID NO: 1259857 - RNA, 15 nt, Homo sapiens
ucccuugcagggguc

SEQ ID NO: 1259858 - RNA, 21 nt, Homo sapiens
ucccuugcuggaaaacccaaa

SEQ ID NO: 1259859 - RNA, 22 nt, Homo sapiens
ucccuuggaauaaaaacauuuc

SEQ ID NO: 1259860 - RNA, 16 nt, Homo sapiens
ucccuuggccucagaa

SEQ ID NO: 1259861 - RNA, 18 nt, Homo sapiens
ucccuugggaagggcagg

SEQ ID NO: 1259862 - RNA, 21 nt, Homo sapiens
ucccuugggaagggcagggaa

SEQ ID NO: 1259863 - RNA, 14 nt, Homo sapiens
ucccuuguccuuga

SEQ ID NO: 1259864 - RNA, 11 nt, Homo sapiens
ucccuuuacaa

SEQ ID NO: 1259865 - RNA, 15 nt, Homo sapiens
ucccuuucacuaaaa

SEQ ID NO: 1259866 - RNA, 18 nt, Homo sapiens
ucccuuuccccagcauca

SEQ ID NO: 1259867 - RNA, 17 nt, Homo sapiens
ucccuuucucccaguga

SEQ ID NO: 1259868 - RNA, 16 nt, Homo sapiens
ucccuuuggagaugcu

SEQ ID NO: 1259869 - RNA, 23 nt, Homo sapiens
ucccuuuggagauuuuuuaaucc

SEQ ID NO: 1259870 - RNA, 19 nt, Homo sapiens
ucccuuuguugcacacuca

SEQ ID NO: 1259871 - RNA, 22 nt, Homo sapiens
ucccuuuugcuagagcugacag

SEQ ID NO: 1259872 - RNA, 19 nt, Homo sapiens
uccgagaggugggccaguc

SEQ ID NO: 1259873 - RNA, 13 nt, Homo sapiens
uccgagcauucca

SEQ ID NO: 1259874 - RNA, 17 nt, Homo sapiens
uccgaggccgugcagug

SEQ ID NO: 1259875 - RNA, 14 nt, Homo sapiens
uccgaggugguuuu

SEQ ID NO: 1259876 - RNA, 17 nt, Homo sapiens
uccgaugguaucugggu

SEQ ID NO: 1259877 - RNA, 17 nt, Homo sapiens
uccgcacccaguuugau

SEQ ID NO: 1259878 - RNA, 23 nt, Homo sapiens
uccgcacccaguuugauaccugc

SEQ ID NO: 1259879 - RNA, 17 nt, Homo sapiens
uccgcacuucagaauuc

SEQ ID NO: 1259880 - RNA, 23 nt, Homo sapiens
uccgcagaagcccugaugugucc

SEQ ID NO: 1259881 - RNA, 17 nt, Homo sapiens
uccgcgcaggugccaac

SEQ ID NO: 1259882 - RNA, 20 nt, Homo sapiens
uccgcgccuugccuccucac

SEQ ID NO: 1259883 - RNA, 17 nt, Homo sapiens
uccgcuagcaguacuaa

SEQ ID NO: 1259884 - RNA, 22 nt, Homo sapiens
uccgcugccaccacgucugcca

SEQ ID NO: 1259885 - RNA, 21 nt, Homo sapiens
uccgcuuucucuugcugccac

SEQ ID NO: 1259886 - RNA, 15 nt, Homo sapiens
uccggcacacugcca

SEQ ID NO: 1259887 - RNA, 14 nt, Homo sapiens
uccggcggggaccc

SEQ ID NO: 1259888 - RNA, 23 nt, Homo sapiens
uccggcugaaggcugaguguccg

SEQ ID NO: 1259889 - RNA, 22 nt, Homo sapiens
uccgggagcggcuguugggcug

SEQ ID NO: 1259890 - RNA, 20 nt, Homo sapiens
uccgucaguccaagucuucu

SEQ ID NO: 1259891 - RNA, 19 nt, Homo sapiens
uccguggucagagugccac

SEQ ID NO: 1259892 - RNA, 15 nt, Homo sapiens
uccuaaacccaauga

SEQ ID NO: 1259893 - RNA, 22 nt, Homo sapiens
uccuaaauauccaaagacugua

SEQ ID NO: 1259894 - RNA, 20 nt, Homo sapiens
uccuaacaaguagcacccug

SEQ ID NO: 1259895 - RNA, 16 nt, Homo sapiens
uccuaagcuauucagu

SEQ ID NO: 1259896 - RNA, 21 nt, Homo sapiens
uccuaagucugucauccucug

SEQ ID NO: 1259897 - RNA, 13 nt, Homo sapiens
uccuaauacuguc

SEQ ID NO: 1259898 - RNA, 18 nt, Homo sapiens
uccuacacuauugaccag

SEQ ID NO: 1259899 - RNA, 16 nt, Homo sapiens
uccuacagggccacaa

SEQ ID NO: 1259900 - RNA, 18 nt, Homo sapiens
uccuacaguacaaucagc

SEQ ID NO: 1259901 - RNA, 23 nt, Homo sapiens
uccuagaaaguucuguguaaaca

SEQ ID NO: 1259902 - RNA, 20 nt, Homo sapiens
uccuagacuugaaaguuuuc

SEQ ID NO: 1259903 - RNA, 22 nt, Homo sapiens
uccuagauguaacauuccugau

SEQ ID NO: 1259904 - RNA, 19 nt, Homo sapiens
uccuaggagagccaaccuc

SEQ ID NO: 1259905 - RNA, 20 nt, Homo sapiens
uccuaguacuuagaaauaca

SEQ ID NO: 1259906 - RNA, 13 nt, Homo sapiens
uccuagucauucu

SEQ ID NO: 1259907 - RNA, 18 nt, Homo sapiens
uccuauaacuugaugcau

SEQ ID NO: 1259908 - RNA, 16 nt, Homo sapiens
uccuauaaucugucaa

SEQ ID NO: 1259909 - RNA, 20 nt, Homo sapiens
uccuauaaucugucaaaaca

SEQ ID NO: 1259910 - RNA, 18 nt, Homo sapiens
uccuaucaccuauuucca

SEQ ID NO: 1259911 - RNA, 17 nt, Homo sapiens
uccuauguuucacugug

SEQ ID NO: 1259912 - RNA, 21 nt, Homo sapiens
uccuauguuucacugugcaaa

SEQ ID NO: 1259913 - RNA, 21 nt, Homo sapiens
uccucacacacccugagguca

SEQ ID NO: 1259914 - RNA, 22 nt, Homo sapiens
uccucacagaguuaaauaugca

SEQ ID NO: 1259915 - RNA, 21 nt, Homo sapiens
uccucacccugauuucuugcu

SEQ ID NO: 1259916 - RNA, 15 nt, Homo sapiens
uccucagauggggca

SEQ ID NO: 1259917 - RNA, 17 nt, Homo sapiens
uccucauccccacaauc

SEQ ID NO: 1259918 - RNA, 19 nt, Homo sapiens
uccucauccccacaaucug

SEQ ID NO: 1259919 - RNA, 14 nt, Homo sapiens
uccucaugcugcuc

SEQ ID NO: 1259920 - RNA, 13 nt, Homo sapiens
uccucauguacau

SEQ ID NO: 1259921 - RNA, 17 nt, Homo sapiens
uccuccacaauagcaga

SEQ ID NO: 1259922 - RNA, 17 nt, Homo sapiens
uccuccacauccugugu

SEQ ID NO: 1259923 - RNA, 21 nt, Homo sapiens
uccuccacauccugugucaga

SEQ ID NO: 1259924 - RNA, 23 nt, Homo sapiens
uccuccauccuauccacugggca

SEQ ID NO: 1259925 - RNA, 14 nt, Homo sapiens
uccuccauggugua

SEQ ID NO: 1259926 - RNA, 14 nt, Homo sapiens
uccucccaccucag

SEQ ID NO: 1259927 - RNA, 15 nt, Homo sapiens
uccucccaccucagc

SEQ ID NO: 1259928 - RNA, 16 nt, Homo sapiens
uccucccugucauaga

SEQ ID NO: 1259929 - RNA, 14 nt, Homo sapiens
uccucccuugggaa

SEQ ID NO: 1259930 - RNA, 23 nt, Homo sapiens
uccuccucuucacuuggccaguu

SEQ ID NO: 1259931 - RNA, 19 nt, Homo sapiens
uccuccuggaacagaagac

SEQ ID NO: 1259932 - RNA, 13 nt, Homo sapiens
uccuccuuucucc

SEQ ID NO: 1259933 - RNA, 13 nt, Homo sapiens
uccucgcugccag

SEQ ID NO: 1259934 - RNA, 13 nt, Homo sapiens
uccucguagccau

SEQ ID NO: 1259935 - RNA, 17 nt, Homo sapiens
uccucguuccuuucucc

SEQ ID NO: 1259936 - RNA, 18 nt, Homo sapiens
uccucuacugugcaucuc

SEQ ID NO: 1259937 - RNA, 23 nt, Homo sapiens
uccucuacugugcaucuccuuga

SEQ ID NO: 1259938 - RNA, 19 nt, Homo sapiens
uccucuagcugugggggug

SEQ ID NO: 1259939 - RNA, 21 nt, Homo sapiens
uccucuaggaggcuccuccuc

SEQ ID NO: 1259940 - RNA, 13 nt, Homo sapiens
uccucuccacugc

SEQ ID NO: 1259941 - RNA, 17 nt, Homo sapiens
uccucugcauuuacaca

SEQ ID NO: 1259942 - RNA, 16 nt, Homo sapiens
uccucuggagcccuaa

SEQ ID NO: 1259943 - RNA, 24 nt, Homo sapiens
uccucuguaccuagaauagucuca

SEQ ID NO: 1259944 - RNA, 12 nt, Homo sapiens
uccucuguucac

SEQ ID NO: 1259945 - RNA, 23 nt, Homo sapiens
uccucuguucacaaacuaccucu

SEQ ID NO: 1259946 - RNA, 15 nt, Homo sapiens
uccucuugaaccaca

SEQ ID NO: 1259947 - RNA, 19 nt, Homo sapiens
uccugaaauaaacacuggu

SEQ ID NO: 1259948 - RNA, 18 nt, Homo sapiens
uccugaaccgcacagcuc

SEQ ID NO: 1259949 - RNA, 22 nt, Homo sapiens
uccugaaggaaaauaaacugac

SEQ ID NO: 1259950 - RNA, 19 nt, Homo sapiens
uccugaauccaaacuaauc

SEQ ID NO: 1259951 - RNA, 14 nt, Homo sapiens
uccugaauccuuuu

SEQ ID NO: 1259952 - RNA, 18 nt, Homo sapiens
uguucuuacuguaacuac

SEQ ID NO: 1259953 - RNA, 13 nt, Homo sapiens
uguucuugcuacc

SEQ ID NO: 1259954 - RNA, 18 nt, Homo sapiens
uguucuuuuuucuuacca

SEQ ID NO: 1259955 - RNA, 17 nt, Homo sapiens
uguugaaaauguucaga

SEQ ID NO: 1259956 - RNA, 15 nt, Homo sapiens
uguugaaacuuugaa

SEQ ID NO: 1259957 - RNA, 18 nt, Homo sapiens
uguugaaucugagcugca

SEQ ID NO: 1259958 - RNA, 16 nt, Homo sapiens
uguugaggcugucaca

SEQ ID NO: 1259959 - RNA, 20 nt, Homo sapiens
uguugauaaauuccacugga

SEQ ID NO: 1259960 - RNA, 11 nt, Homo sapiens
uguugauccca

SEQ ID NO: 1259961 - RNA, 12 nt, Homo sapiens
uguugaucccaa

SEQ ID NO: 1259962 - RNA, 20 nt, Homo sapiens
uguugauugccaaauugaca

SEQ ID NO: 1259963 - RNA, 11 nt, Homo sapiens
uguugcaaugc

SEQ ID NO: 1259964 - RNA, 20 nt, Homo sapiens
uguugcaaugcaugauacua

SEQ ID NO: 1259965 - RNA, 19 nt, Homo sapiens
uguugcaccaggcacugcu

SEQ ID NO: 1259966 - RNA, 21 nt, Homo sapiens
uguugcauuuacuuuuaauaa

SEQ ID NO: 1259967 - RNA, 11 nt, Homo sapiens
uguugccaaau

SEQ ID NO: 1259968 - RNA, 24 nt, Homo sapiens
uguugccacuggcaaauguaacug

SEQ ID NO: 1259969 - RNA, 10 nt, Homo sapiens
uguugccagc

SEQ ID NO: 1259970 - RNA, 17 nt, Homo sapiens
uguugccuucaucuuca

SEQ ID NO: 1259971 - RNA, 21 nt, Homo sapiens
uguugcuggacugucauagaa

SEQ ID NO: 1259972 - RNA, 14 nt, Homo sapiens
uguugggaggacag

SEQ ID NO: 1259973 - RNA, 18 nt, Homo sapiens
uguuggguugaauauauu

SEQ ID NO: 1259974 - RNA, 20 nt, Homo sapiens
uguuguaucaaagugugaua

SEQ ID NO: 1259975 - RNA, 13 nt, Homo sapiens
uguuguaugggga

SEQ ID NO: 1259976 - RNA, 14 nt, Homo sapiens
uguugucaaaaagu

SEQ ID NO: 1259977 - RNA, 20 nt, Homo sapiens
uguuguguauagaugcaaga

SEQ ID NO: 1259978 - RNA, 18 nt, Homo sapiens
uguuguguauuccacuua

SEQ ID NO: 1259979 - RNA, 21 nt, Homo sapiens
uguuguguuuuuaacauguca

SEQ ID NO: 1259980 - RNA, 17 nt, Homo sapiens
uguuguuccguuaaccu

SEQ ID NO: 1259981 - RNA, 15 nt, Homo sapiens
uguuguuuaaucuga

SEQ ID NO: 1259982 - RNA, 19 nt, Homo sapiens
uguuuaagcccagccaagu

SEQ ID NO: 1259983 - RNA, 18 nt, Homo sapiens
uguuuacagacgugugca

SEQ ID NO: 1259984 - RNA, 21 nt, Homo sapiens
uguuuacagggagccuccugc

SEQ ID NO: 1259985 - RNA, 13 nt, Homo sapiens
uguuuacccagua

SEQ ID NO: 1259986 - RNA, 20 nt, Homo sapiens
uguuuaccucuucuaugcaa

SEQ ID NO: 1259987 - RNA, 13 nt, Homo sapiens
uguuuauacugua

SEQ ID NO: 1259988 - RNA, 14 nt, Homo sapiens
uguuuaugagccag

SEQ ID NO: 1259989 - RNA, 14 nt, Homo sapiens
uguuuauuuggacu

SEQ ID NO: 1259990 - RNA, 18 nt, Homo sapiens
uguuucaaaaaaucugac

SEQ ID NO: 1259991 - RNA, 20 nt, Homo sapiens
uguuucaaggcacucuagau

SEQ ID NO: 1259992 - RNA, 15 nt, Homo sapiens
uguuucccagauuuc

SEQ ID NO: 1259993 - RNA, 15 nt, Homo sapiens
uguuuccuguuggag

SEQ ID NO: 1259994 - RNA, 16 nt, Homo sapiens
uguuucuggauuugca

SEQ ID NO: 1259995 - RNA, 21 nt, Homo sapiens
uguuucuuaagggcacacaca

SEQ ID NO: 1259996 - RNA, 16 nt, Homo sapiens
uguuugaaauucuaga

SEQ ID NO: 1259997 - RNA, 22 nt, Homo sapiens
uguuugaggcaaauuaacugua

SEQ ID NO: 1259998 - RNA, 9 nt, Homo sapiens
uguuugaug

SEQ ID NO: 1259999 - RNA, 12 nt, Homo sapiens
uguuugcacuuu

SEQ ID NO: 1260000 - RNA, 13 nt, Homo sapiens
uguuugcacuuug

SEQ ID NO: 1260001 - RNA, 16 nt, Homo sapiens
uguuuggaaaagacag

SEQ ID NO: 1260002 - RNA, 23 nt, Homo sapiens
uguuuggaaauaaacugugcaau

SEQ ID NO: 1260003 - RNA, 20 nt, Homo sapiens
uguuugguguuugucugugu

SEQ ID NO: 1260004 - RNA, 17 nt, Homo sapiens
uguuugucagauaugau

SEQ ID NO: 1260005 - RNA, 16 nt, Homo sapiens
uguuuguuucauauau

SEQ ID NO: 1260006 - RNA, 21 nt, Homo sapiens
uguuuuaaacacaugccuuaa

SEQ ID NO: 1260007 - RNA, 23 nt, Homo sapiens
uguuuuaaagaauaugacuuuuu

SEQ ID NO: 1260008 - RNA, 23 nt, Homo sapiens
uguuuuacucagaggagcugcaa

SEQ ID NO: 1260009 - RNA, 17 nt, Homo sapiens
uguuuucacuuguauug

SEQ ID NO: 1260010 - RNA, 20 nt, Homo sapiens
uguuuucaggacaacacuuc

SEQ ID NO: 1260011 - RNA, 14 nt, Homo sapiens
uguuuuccuauaau

SEQ ID NO: 1260012 - RNA, 20 nt, Homo sapiens
uguuuucgcaccuaccauca

SEQ ID NO: 1260013 - RNA, 21 nt, Homo sapiens
uguuuucucuggaaugguaca

SEQ ID NO: 1260014 - RNA, 20 nt, Homo sapiens
uguuuucuugccaaugaggu

SEQ ID NO: 1260015 - RNA, 14 nt, Homo sapiens
uguuuugcacuuuu

SEQ ID NO: 1260016 - RNA, 20 nt, Homo sapiens
uguuuuguaagugcugcuau

SEQ ID NO: 1260017 - RNA, 21 nt, Homo sapiens
uguuuuguaagugcugcuaua

SEQ ID NO: 1260018 - RNA, 18 nt, Homo sapiens
uguuuuguguaacauauu

SEQ ID NO: 1260019 - RNA, 16 nt, Homo sapiens
uguuuuucaagccugu

SEQ ID NO: 1260020 - RNA, 21 nt, Homo sapiens
uuaaaaaaaaaaaaaacauug

SEQ ID NO: 1260021 - RNA, 13 nt, Homo sapiens
uuaaaaaacagag

SEQ ID NO: 1260022 - RNA, 14 nt, Homo sapiens
uuaaaaaacuucau

SEQ ID NO: 1260023 - RNA, 15 nt, Homo sapiens
uuaaaaaaucuguug

SEQ ID NO: 1260024 - RNA, 11 nt, Homo sapiens
uuaaaaaccac

SEQ ID NO: 1260025 - RNA, 14 nt, Homo sapiens
uuaaaaaguuucac

SEQ ID NO: 1260026 - RNA, 15 nt, Homo sapiens
uuaaaaauacuucuc

SEQ ID NO: 1260027 - RNA, 14 nt, Homo sapiens
uuaaaaccaaagag

SEQ ID NO: 1260028 - RNA, 12 nt, Homo sapiens
uuaaaacuuuaa

SEQ ID NO: 1260029 - RNA, 14 nt, Homo sapiens
uuaaaaggggccca

SEQ ID NO: 1260030 - RNA, 14 nt, Homo sapiens
uuaaaaugagaucg

SEQ ID NO: 1260031 - RNA, 13 nt, Homo sapiens
uuaaaaugccaau

SEQ ID NO: 1260032 - RNA, 19 nt, Homo sapiens
uuaaaauuaucaauaucua

SEQ ID NO: 1260033 - RNA, 13 nt, Homo sapiens
uuaaacagcagau

SEQ ID NO: 1260034 - RNA, 15 nt, Homo sapiens
uuaaaccacuguaua

SEQ ID NO: 1260035 - RNA, 18 nt, Homo sapiens
uuaaaccucucuucuacc

SEQ ID NO: 1260036 - RNA, 12 nt, Homo sapiens
uuaaacucaggg

SEQ ID NO: 1260037 - RNA, 14 nt, Homo sapiens
uuaaacugauucau

SEQ ID NO: 1260038 - RNA, 20 nt, Homo sapiens
uuaaacuguguggacuguga

SEQ ID NO: 1260039 - RNA, 16 nt, Homo sapiens
uuaaacuuuuaauuca

SEQ ID NO: 1260040 - RNA, 20 nt, Homo sapiens
uuaaagaaagucgaauuaau

SEQ ID NO: 1260041 - RNA, 13 nt, Homo sapiens
uuaaagaagcaau

SEQ ID NO: 1260042 - RNA, 15 nt, Homo sapiens
uuaaagaaggguuga

SEQ ID NO: 1260043 - RNA, 15 nt, Homo sapiens
uuaaagacagucaua

SEQ ID NO: 1260044 - RNA, 13 nt, Homo sapiens
uuaaagagucuag

SEQ ID NO: 1260045 - RNA, 15 nt, Homo sapiens
uuaaagcagacaguc

SEQ ID NO: 1260046 - RNA, 19 nt, Homo sapiens
uuaaagcauauuggugcua

SEQ ID NO: 1260047 - RNA, 23 nt, Homo sapiens
uuaaaggaaaaucacaucuccag

SEQ ID NO: 1260048 - RNA, 17 nt, Homo sapiens
uuaaaggaauaaggugu

SEQ ID NO: 1260049 - RNA, 18 nt, Homo sapiens
uuaaaggcaucuacacaa

SEQ ID NO: 1260050 - RNA, 16 nt, Homo sapiens
uuaaagguaaaacaug

SEQ ID NO: 1260051 - RNA, 15 nt, Homo sapiens
uuaaagguucacagg

SEQ ID NO: 1260052 - RNA, 19 nt, Homo sapiens
uuaaaguaaugagcaugau

SEQ ID NO: 1260053 - RNA, 18 nt, Homo sapiens
uuaaauaaaauauuugcu

SEQ ID NO: 1260054 - RNA, 16 nt, Homo sapiens
uuaaauaaagucucuc

SEQ ID NO: 1260055 - RNA, 13 nt, Homo sapiens
uuaaauaagcaaa

SEQ ID NO: 1260056 - RNA, 19 nt, Homo sapiens
uuaaauaaugcuucagaua

SEQ ID NO: 1260057 - RNA, 17 nt, Homo sapiens
uuaaauauauaauguug

SEQ ID NO: 1260058 - RNA, 20 nt, Homo sapiens
uuaaauauauaauguugcca

SEQ ID NO: 1260059 - RNA, 14 nt, Homo sapiens
uuaaauggcuuuau

SEQ ID NO: 1260060 - RNA, 13 nt, Homo sapiens
uuaaauguauuau

SEQ ID NO: 1260061 - RNA, 15 nt, Homo sapiens
uuaaauuaagacuug

SEQ ID NO: 1260062 - RNA, 18 nt, Homo sapiens
uuaaauuuuauaugggcu

SEQ ID NO: 1260063 - RNA, 20 nt, Homo sapiens
uuaacaaaaauauuagcaaa

SEQ ID NO: 1260064 - RNA, 20 nt, Homo sapiens
uuaacaaaucuaaucucuua

SEQ ID NO: 1260065 - RNA, 18 nt, Homo sapiens
uuaacaaccgacacuccu

SEQ ID NO: 1260066 - RNA, 19 nt, Homo sapiens
uuaacaccuucauccagau

SEQ ID NO: 1260067 - RNA, 20 nt, Homo sapiens
uuaacagacucaaaccacau

SEQ ID NO: 1260068 - RNA, 13 nt, Homo sapiens
uuaacaucucaga

SEQ ID NO: 1260069 - RNA, 13 nt, Homo sapiens
uuaacauuugccu

SEQ ID NO: 1260070 - RNA, 22 nt, Homo sapiens
uuaaccaguucugucuucagcu

SEQ ID NO: 1260071 - RNA, 13 nt, Homo sapiens
uuaacgcacuugg

SEQ ID NO: 1260072 - RNA, 21 nt, Homo sapiens
uuaacugguauauacauauau

SEQ ID NO: 1260073 - RNA, 10 nt, Homo sapiens
uuaacuguau

SEQ ID NO: 1260074 - RNA, 21 nt, Homo sapiens
uuaacugugaaauaccacaag

SEQ ID NO: 1260075 - RNA, 22 nt, Homo sapiens
uuaacugugcguuaaauaagca

SEQ ID NO: 1260076 - RNA, 15 nt, Homo sapiens
uuaacuuaacauucu

SEQ ID NO: 1260077 - RNA, 23 nt, Homo sapiens
uuaacuuguaaaugaaaaaauuc

SEQ ID NO: 1260078 - RNA, 15 nt, Homo sapiens
uuaacuuuauuacaa

SEQ ID NO: 1260079 - RNA, 15 nt, Homo sapiens
uucagucuuguagug

SEQ ID NO: 1260080 - RNA, 21 nt, Homo sapiens
uucagugcaaauuguaucuua

SEQ ID NO: 1260081 - RNA, 13 nt, Homo sapiens
uucaguuccaaga

SEQ ID NO: 1260082 - RNA, 19 nt, Homo sapiens
uucaguugaucacuggcaa

SEQ ID NO: 1260083 - RNA, 22 nt, Homo sapiens
uucaguuucuucugcgccucag

SEQ ID NO: 1260084 - RNA, 13 nt, Homo sapiens
uucauacaacaga

SEQ ID NO: 1260085 - RNA, 12 nt, Homo sapiens
uucauaccuaag

SEQ ID NO: 1260086 - RNA, 19 nt, Homo sapiens
uucauaccuaaguacugua

SEQ ID NO: 1260087 - RNA, 22 nt, Homo sapiens
uucauagauagauaaguaucag

SEQ ID NO: 1260088 - RNA, 14 nt, Homo sapiens
uucauaugcagaug

SEQ ID NO: 1260089 - RNA, 14 nt, Homo sapiens
uucaucaaacauug

SEQ ID NO: 1260090 - RNA, 22 nt, Homo sapiens
uucaucaauaucccucuuguaa

SEQ ID NO: 1260091 - RNA, 15 nt, Homo sapiens
uucauccguguaacc

SEQ ID NO: 1260092 - RNA, 15 nt, Homo sapiens
uucauccuugacuaa

SEQ ID NO: 1260093 - RNA, 19 nt, Homo sapiens
uucaucuacccugcugacc

SEQ ID NO: 1260094 - RNA, 11 nt, Homo sapiens
uucaucucuug

SEQ ID NO: 1260095 - RNA, 19 nt, Homo sapiens
uucaucugaaacccacaga

SEQ ID NO: 1260096 - RNA, 22 nt, Homo sapiens
uucaucuggggaugacaaugga

SEQ ID NO: 1260097 - RNA, 16 nt, Homo sapiens
uucaugacaagcauuu

SEQ ID NO: 1260098 - RNA, 18 nt, Homo sapiens
uucaugagcuugaacaag

SEQ ID NO: 1260099 - RNA, 19 nt, Homo sapiens
uucauggcugaagucaccu

SEQ ID NO: 1260100 - RNA, 21 nt, Homo sapiens
uucaugggaaaacagaccugu

SEQ ID NO: 1260101 - RNA, 11 nt, Homo sapiens
uucauggugau

SEQ ID NO: 1260102 - RNA, 19 nt, Homo sapiens
uucauguaauagcaaugca

SEQ ID NO: 1260103 - RNA, 18 nt, Homo sapiens
uucaugugcugccugcaa

SEQ ID NO: 1260104 - RNA, 17 nt, Homo sapiens
uucauguguggaaaugg

SEQ ID NO: 1260105 - RNA, 20 nt, Homo sapiens
uucaugugugugaguuugcu

SEQ ID NO: 1260106 - RNA, 16 nt, Homo sapiens
uucauguucacuguga

SEQ ID NO: 1260107 - RNA, 20 nt, Homo sapiens
uucauguuugcuucauaaau

SEQ ID NO: 1260108 - RNA, 14 nt, Homo sapiens
uucauuaaugauga

SEQ ID NO: 1260109 - RNA, 17 nt, Homo sapiens
uucauuaaugaugaucu

SEQ ID NO: 1260110 - RNA, 17 nt, Homo sapiens
uucauuagcugcucuga

SEQ ID NO: 1260111 - RNA, 15 nt, Homo sapiens
uucauuauaaucuca

SEQ ID NO: 1260112 - RNA, 20 nt, Homo sapiens
uucauuauuggaauuaaccu

SEQ ID NO: 1260113 - RNA, 14 nt, Homo sapiens
uucauucaaacugc

SEQ ID NO: 1260114 - RNA, 19 nt, Homo sapiens
uucauucauuucauuguga

SEQ ID NO: 1260115 - RNA, 16 nt, Homo sapiens
uucauucccccuuccu

SEQ ID NO: 1260116 - RNA, 21 nt, Homo sapiens
uucauuccuaacacagcaugu

SEQ ID NO: 1260117 - RNA, 23 nt, Homo sapiens
uucauuccuaacacagcaugugu

SEQ ID NO: 1260118 - RNA, 13 nt, Homo sapiens
uucauugaugacc

SEQ ID NO: 1260119 - RNA, 16 nt, Homo sapiens
uucauugcacuuugau

SEQ ID NO: 1260120 - RNA, 16 nt, Homo sapiens
uucauugccagugucu

SEQ ID NO: 1260121 - RNA, 22 nt, Homo sapiens
uucauugugagauugcaguucu

SEQ ID NO: 1260122 - RNA, 18 nt, Homo sapiens
uucauuuaaaaugauuag

SEQ ID NO: 1260123 - RNA, 17 nt, Homo sapiens
uucauuuucaugagccu

SEQ ID NO: 1260124 - RNA, 17 nt, Homo sapiens
uucauuuuuuucacugg

SEQ ID NO: 1260125 - RNA, 15 nt, Homo sapiens
uuccaaaagcacaga

SEQ ID NO: 1260126 - RNA, 15 nt, Homo sapiens
uuccaaacacauaca

SEQ ID NO: 1260127 - RNA, 19 nt, Homo sapiens
uuccaaacacauacaggaa

SEQ ID NO: 1260128 - RNA, 16 nt, Homo sapiens
uuccaaauaacaucaa

SEQ ID NO: 1260129 - RNA, 14 nt, Homo sapiens
uuccaacuugucug

SEQ ID NO: 1260130 - RNA, 14 nt, Homo sapiens
uuccaaguguaaaa

SEQ ID NO: 1260131 - RNA, 15 nt, Homo sapiens
uuccaauaaagcagc

SEQ ID NO: 1260132 - RNA, 14 nt, Homo sapiens
uuccaaucaugaaa

SEQ ID NO: 1260133 - RNA, 16 nt, Homo sapiens
uuccacaauucacuag

SEQ ID NO: 1260134 - RNA, 10 nt, Homo sapiens
uuccacagau

SEQ ID NO: 1260135 - RNA, 12 nt, Homo sapiens
uuccacauguac

SEQ ID NO: 1260136 - RNA, 23 nt, Homo sapiens
uuccacguguuuuauuccuguau

SEQ ID NO: 1260137 - RNA, 11 nt, Homo sapiens
uuccacuccac

SEQ ID NO: 1260138 - RNA, 20 nt, Homo sapiens
uuccacucccuuugccagug

SEQ ID NO: 1260139 - RNA, 18 nt, Homo sapiens
uuccacucgaugaugcuu

SEQ ID NO: 1260140 - RNA, 19 nt, Homo sapiens
uuccacugccuccugugac

SEQ ID NO: 1260141 - RNA, 23 nt, Homo sapiens
uuccacuuagaaauugcauuucc

SEQ ID NO: 1260142 - RNA, 13 nt, Homo sapiens
uuccacuucuucc

SEQ ID NO: 1260143 - RNA, 17 nt, Homo sapiens
uuccacuugagugucaa

SEQ ID NO: 1260144 - RNA, 17 nt, Homo sapiens
uuccacuuguguauauu

SEQ ID NO: 1260145 - RNA, 17 nt, Homo sapiens
uuccacuuugcauauga

SEQ ID NO: 1260146 - RNA, 14 nt, Homo sapiens
uuccagagcugaga

SEQ ID NO: 1260147 - RNA, 14 nt, Homo sapiens
uuccagaguaugca

SEQ ID NO: 1260148 - RNA, 17 nt, Homo sapiens
uuccagcagaugccaca

SEQ ID NO: 1260149 - RNA, 19 nt, Homo sapiens
uuccagcccaucuccgggg

SEQ ID NO: 1260150 - RNA, 12 nt, Homo sapiens
uuccagguaaaa

SEQ ID NO: 1260151 - RNA, 14 nt, Homo sapiens
uuccagguguuacu

SEQ ID NO: 1260152 - RNA, 16 nt, Homo sapiens
uuccaguuauaaauau

SEQ ID NO: 1260153 - RNA, 16 nt, Homo sapiens
uuccaguuccacgaaa

SEQ ID NO: 1260154 - RNA, 23 nt, Homo sapiens
uuccaguuuaaugaacuaccauc

SEQ ID NO: 1260155 - RNA, 17 nt, Homo sapiens
uuccauaaugcuacugu

SEQ ID NO: 1260156 - RNA, 22 nt, Homo sapiens
uuccaucauuucugucuuuaag

SEQ ID NO: 1260157 - RNA, 18 nt, Homo sapiens
uuccaugacgacauacau

SEQ ID NO: 1260158 - RNA, 15 nt, Homo sapiens
uuccaugaugguuau

SEQ ID NO: 1260159 - RNA, 20 nt, Homo sapiens
uuccaugggauacaaccucc

SEQ ID NO: 1260160 - RNA, 23 nt, Homo sapiens
uuccaugucgccucugcauucag

SEQ ID NO: 1260161 - RNA, 12 nt, Homo sapiens
uuccauguuaaa

SEQ ID NO: 1260162 - RNA, 16 nt, Homo sapiens
uuccauucacaccagc

SEQ ID NO: 1260163 - RNA, 16 nt, Homo sapiens
uuccauugguccaaga

SEQ ID NO: 1260164 - RNA, 19 nt, Homo sapiens
uucccaagaguauccuacc

SEQ ID NO: 1260165 - RNA, 16 nt, Homo sapiens
uucccaagcccaugag

SEQ ID NO: 1260166 - RNA, 23 nt, Homo sapiens
uucccaauagcaaggcugugcau

SEQ ID NO: 1260167 - RNA, 13 nt, Homo sapiens
uucccacgaggaa

SEQ ID NO: 1260168 - RNA, 14 nt, Homo sapiens
uucccagcuaggaa

SEQ ID NO: 1260169 - RNA, 14 nt, Homo sapiens
uucccaugccuguc

SEQ ID NO: 1260170 - RNA, 14 nt, Homo sapiens
uucccauucuugca

SEQ ID NO: 1260171 - RNA, 16 nt, Homo sapiens
uucccauuugugccag

SEQ ID NO: 1260172 - RNA, 16 nt, Homo sapiens
uuccccaaugcuccau

SEQ ID NO: 1260173 - RNA, 22 nt, Homo sapiens
uuccccaccccagcucaugccc

SEQ ID NO: 1260174 - RNA, 17 nt, Homo sapiens
uuccccacccuugagaa

SEQ ID NO: 1260175 - RNA, 17 nt, Homo sapiens
uuccccacugcucucug

SEQ ID NO: 1260176 - RNA, 19 nt, Homo sapiens
uucccccaccgguccagcu

SEQ ID NO: 1260177 - RNA, 19 nt, Homo sapiens
uucccccacuacugcagca

SEQ ID NO: 1260178 - RNA, 15 nt, Homo sapiens
uucccccaguaccuc

SEQ ID NO: 1260179 - RNA, 15 nt, Homo sapiens
uuccccucucugccc

SEQ ID NO: 1260180 - RNA, 12 nt, Homo sapiens
uuccccucugcu

SEQ ID NO: 1260181 - RNA, 16 nt, Homo sapiens
uuccccuguccuguga

SEQ ID NO: 1260182 - RNA, 13 nt, Homo sapiens
uuccccugucuuc

SEQ ID NO: 1260183 - RNA, 19 nt, Homo sapiens
uucccuacuuccugugacu

SEQ ID NO: 1260184 - RNA, 19 nt, Homo sapiens
uucccucucaugacuugca

SEQ ID NO: 1260185 - RNA, 21 nt, Homo sapiens
uucccucucaugguaccugcu

SEQ ID NO: 1260186 - RNA, 19 nt, Homo sapiens
uucccucuugcucaguggg

SEQ ID NO: 1260187 - RNA, 19 nt, Homo sapiens
uucccugaaaccguuaaaa

SEQ ID NO: 1260188 - RNA, 17 nt, Homo sapiens
uucccugacuugcuuua

SEQ ID NO: 1260189 - RNA, 19 nt, Homo sapiens
uucccuggguuuucugccc

SEQ ID NO: 1260190 - RNA, 17 nt, Homo sapiens
uucccugugucauuuca

SEQ ID NO: 1260191 - RNA, 16 nt, Homo sapiens
uucccuuccacugccu

SEQ ID NO: 1260192 - RNA, 17 nt, Homo sapiens
uucccuuucacuggcau

SEQ ID NO: 1260193 - RNA, 15 nt, Homo sapiens
uucccuuuccccagc

SEQ ID NO: 1260194 - RNA, 15 nt, Homo sapiens
uucccuuugugcaca

SEQ ID NO: 1260195 - RNA, 21 nt, Homo sapiens
uuccgauggaugaaucuccca

SEQ ID NO: 1260196 - RNA, 15 nt, Homo sapiens
uuccguggucagagu

SEQ ID NO: 1260197 - RNA, 12 nt, Homo sapiens
uuccguuuccag

SEQ ID NO: 1260198 - RNA, 16 nt, Homo sapiens
uuccuaaaauggugau

SEQ ID NO: 1260199 - RNA, 11 nt, Homo sapiens
uuccuaaacau

SEQ ID NO: 1260200 - RNA, 15 nt, Homo sapiens
uuccuaaacuuucaa

SEQ ID NO: 1260201 - RNA, 20 nt, Homo sapiens
uuccuaauaaguuugaucaa

SEQ ID NO: 1260202 - RNA, 17 nt, Homo sapiens
uuccuacccaaccacuc

SEQ ID NO: 1260203 - RNA, 12 nt, Homo sapiens
uuccuagcugug

SEQ ID NO: 1260204 - RNA, 12 nt, Homo sapiens
uuccuaggucau

SEQ ID NO: 1260205 - RNA, 24 nt, Homo sapiens
uuccuaugaaguuggcacauuuca

SEQ ID NO: 1260206 - RNA, 13 nt, Homo sapiens
aaaguugaugcua

SEQ ID NO: 1260207 - RNA, 22 nt, Homo sapiens
aaaguugguguagcagcaguug

SEQ ID NO: 1260208 - RNA, 23 nt, Homo sapiens
aaaguuguuguaaccugcuguga

SEQ ID NO: 1260209 - RNA, 17 nt, Homo sapiens
aaaguuucucuuuucaa

SEQ ID NO: 1260210 - RNA, 12 nt, Homo sapiens
aaaguuugcuca

SEQ ID NO: 1260211 - RNA, 15 nt, Homo sapiens
aaaguuugugacauu

SEQ ID NO: 1260212 - RNA, 23 nt, Homo sapiens
aaaguuuuauaacuuguguuauu

SEQ ID NO: 1260213 - RNA, 15 nt, Homo sapiens
aaaguuuugaugaaa

SEQ ID NO: 1260214 - RNA, 20 nt, Homo sapiens
aaauaaaaagccucagugac

SEQ ID NO: 1260215 - RNA, 14 nt, Homo sapiens
aaauaaaacugaau

SEQ ID NO: 1260216 - RNA, 15 nt, Homo sapiens
aaauaaaacuucaca

SEQ ID NO: 1260217 - RNA, 15 nt, Homo sapiens
aaauaaaaugacguc

SEQ ID NO: 1260218 - RNA, 15 nt, Homo sapiens
aaauaaaauguguac

SEQ ID NO: 1260219 - RNA, 15 nt, Homo sapiens
aaauaaacagcuauu

SEQ ID NO: 1260220 - RNA, 13 nt, Homo sapiens
aaauaaaguacca

SEQ ID NO: 1260221 - RNA, 22 nt, Homo sapiens
aaauaaaguauauauagaaucu

SEQ ID NO: 1260222 - RNA, 16 nt, Homo sapiens
aaauaaauaagaucag

SEQ ID NO: 1260223 - RNA, 15 nt, Homo sapiens
aaauaacaaguacca

SEQ ID NO: 1260224 - RNA, 23 nt, Homo sapiens
aaauaacagaaagccugggugac

SEQ ID NO: 1260225 - RNA, 23 nt, Homo sapiens
aaauaacuaaaagguaugcaauc

SEQ ID NO: 1260226 - RNA, 14 nt, Homo sapiens
aaauaagagauuug

SEQ ID NO: 1260227 - RNA, 14 nt, Homo sapiens
aaauaauaacaauc

SEQ ID NO: 1260228 - RNA, 12 nt, Homo sapiens
aaauaauaugca

SEQ ID NO: 1260229 - RNA, 19 nt, Homo sapiens
aaauaaugcaccacuuuua

SEQ ID NO: 1260230 - RNA, 14 nt, Homo sapiens
aaauaauucuuccu

SEQ ID NO: 1260231 - RNA, 23 nt, Homo sapiens
aaauacacuguuaucuucacuuu

SEQ ID NO: 1260232 - RNA, 20 nt, Homo sapiens
aaauacaguauucuguacca

SEQ ID NO: 1260233 - RNA, 19 nt, Homo sapiens
aaauaccacaagccugaga

SEQ ID NO: 1260234 - RNA, 14 nt, Homo sapiens
aaauaccauguaca

SEQ ID NO: 1260235 - RNA, 12 nt, Homo sapiens
aaauaccauuga

SEQ ID NO: 1260236 - RNA, 16 nt, Homo sapiens
aaauacuacuuucuca

SEQ ID NO: 1260237 - RNA, 16 nt, Homo sapiens
aaauacugaauuagua

SEQ ID NO: 1260238 - RNA, 22 nt, Homo sapiens
aaauacugugcagaauaaugga

SEQ ID NO: 1260239 - RNA, 20 nt, Homo sapiens
aaauacuuagagcagugaag

SEQ ID NO: 1260240 - RNA, 19 nt, Homo sapiens
aaauacuucuugaagccga

SEQ ID NO: 1260241 - RNA, 15 nt, Homo sapiens
aaauagacaaaaagu

SEQ ID NO: 1260242 - RNA, 15 nt, Homo sapiens
aaauagagaauccca

SEQ ID NO: 1260243 - RNA, 23 nt, Homo sapiens
aaauagagcuuuuaaaaaugucc

SEQ ID NO: 1260244 - RNA, 20 nt, Homo sapiens
aaauagcacacuuuuccaca

SEQ ID NO: 1260245 - RNA, 19 nt, Homo sapiens
aaauaggcagaauggaauc

SEQ ID NO: 1260246 - RNA, 21 nt, Homo sapiens
aaauaguaccuucaauacuua

SEQ ID NO: 1260247 - RNA, 21 nt, Homo sapiens
aaauaguuuggauuacuuaaa

SEQ ID NO: 1260248 - RNA, 18 nt, Homo sapiens
aaauauaacaucuaugaa

SEQ ID NO: 1260249 - RNA, 21 nt, Homo sapiens
aaauauaauuauccaaauuga

SEQ ID NO: 1260250 - RNA, 18 nt, Homo sapiens
aaauauacaaaacuuuau

SEQ ID NO: 1260251 - RNA, 18 nt, Homo sapiens
aaauauacuugacucuaa

SEQ ID NO: 1260252 - RNA, 14 nt, Homo sapiens
aaauauaguuugag

SEQ ID NO: 1260253 - RNA, 20 nt, Homo sapiens
aaauauauacccccccaugc

SEQ ID NO: 1260254 - RNA, 13 nt, Homo sapiens
aaauauauauaca

SEQ ID NO: 1260255 - RNA, 18 nt, Homo sapiens
aaauauauuuuggaaaac

SEQ ID NO: 1260256 - RNA, 19 nt, Homo sapiens
aaauauccaaagacuguac

SEQ ID NO: 1260257 - RNA, 16 nt, Homo sapiens
aaauaucuugcuuuca

SEQ ID NO: 1260258 - RNA, 18 nt, Homo sapiens
aaauaucuuggccuaaac

SEQ ID NO: 1260259 - RNA, 23 nt, Homo sapiens
aaauaugagccgguuauuacuuc

SEQ ID NO: 1260260 - RNA, 16 nt, Homo sapiens
aaauauguauaugaca

SEQ ID NO: 1260261 - RNA, 19 nt, Homo sapiens
aaauauuagaagccugcag

SEQ ID NO: 1260262 - RNA, 22 nt, Homo sapiens
aaauauuguauaaagcauuugu

SEQ ID NO: 1260263 - RNA, 21 nt, Homo sapiens
aaauauuuauaaaacuucuca

SEQ ID NO: 1260264 - RNA, 23 nt, Homo sapiens
aaauauuuaugagaaaguucuca

SEQ ID NO: 1260265 - RNA, 20 nt, Homo sapiens
aaauauuuauugucuguaaa

SEQ ID NO: 1260266 - RNA, 23 nt, Homo sapiens
aaauauuucccauuugugccaga

SEQ ID NO: 1260267 - RNA, 16 nt, Homo sapiens
aaauauuuccuuaaac

SEQ ID NO: 1260268 - RNA, 16 nt, Homo sapiens
aaauauuucugauacu

SEQ ID NO: 1260269 - RNA, 15 nt, Homo sapiens
aaaucaacagaagca

SEQ ID NO: 1260270 - RNA, 16 nt, Homo sapiens
aaaucaaugcagguuu

SEQ ID NO: 1260271 - RNA, 16 nt, Homo sapiens
aaaucaaugucacuua

SEQ ID NO: 1260272 - RNA, 14 nt, Homo sapiens
aaaucacacuguaa

SEQ ID NO: 1260273 - RNA, 13 nt, Homo sapiens
aaaucacuugcca

SEQ ID NO: 1260274 - RNA, 22 nt, Homo sapiens
aaaucagaagucaucuugcuac

SEQ ID NO: 1260275 - RNA, 21 nt, Homo sapiens
aaaucagcaauuccccagcgu

SEQ ID NO: 1260276 - RNA, 16 nt, Homo sapiens
aaaucagccauaagaa

SEQ ID NO: 1260277 - RNA, 23 nt, Homo sapiens
aaaucauaguuuaaacugcauua

SEQ ID NO: 1260278 - RNA, 20 nt, Homo sapiens
aaaucauccaagacaguuau

SEQ ID NO: 1260279 - RNA, 15 nt, Homo sapiens
aaaucauuaagacaa

SEQ ID NO: 1260280 - RNA, 18 nt, Homo sapiens
aaaucauuucaguaucau

SEQ ID NO: 1260281 - RNA, 20 nt, Homo sapiens
aaaucccuauuuaauuuucc

SEQ ID NO: 1260282 - RNA, 14 nt, Homo sapiens
aaaucccucucaca

SEQ ID NO: 1260283 - RNA, 23 nt, Homo sapiens
aaauccgcauugauggccucaau

SEQ ID NO: 1260284 - RNA, 16 nt, Homo sapiens
aaauccuagacuugaa

SEQ ID NO: 1260285 - RNA, 16 nt, Homo sapiens
aaauccucaggugauu

SEQ ID NO: 1260286 - RNA, 17 nt, Homo sapiens
aaauccuuccaaaaauu

SEQ ID NO: 1260287 - RNA, 13 nt, Homo sapiens
aaauccuuccuaa

SEQ ID NO: 1260288 - RNA, 15 nt, Homo sapiens
aaaucuaccacugua

SEQ ID NO: 1260289 - RNA, 12 nt, Homo sapiens
aaaucuagaaga

SEQ ID NO: 1260290 - RNA, 17 nt, Homo sapiens
aaaucuagaagacuguc

SEQ ID NO: 1260291 - RNA, 15 nt, Homo sapiens
aaaucuaggauuauu

SEQ ID NO: 1260292 - RNA, 22 nt, Homo sapiens
aaaucucaaugaagccagcuca

SEQ ID NO: 1260293 - RNA, 14 nt, Homo sapiens
aaaucuccaucuca

SEQ ID NO: 1260294 - RNA, 15 nt, Homo sapiens
aaaucucuuccacau

SEQ ID NO: 1260295 - RNA, 19 nt, Homo sapiens
aaaucucuuccacaugggu

SEQ ID NO: 1260296 - RNA, 23 nt, Homo sapiens
aaaucugaauaaauaauucuucc

SEQ ID NO: 1260297 - RNA, 23 nt, Homo sapiens
aaaucuggcuccuuuacaaaaga

SEQ ID NO: 1260298 - RNA, 12 nt, Homo sapiens
aaaucugugaug

SEQ ID NO: 1260299 - RNA, 16 nt, Homo sapiens
aaaucuuauaguucua

SEQ ID NO: 1260300 - RNA, 16 nt, Homo sapiens
aaaucuucagcaugau

SEQ ID NO: 1260301 - RNA, 16 nt, Homo sapiens
aaaucuugucuuacca

SEQ ID NO: 1260302 - RNA, 19 nt, Homo sapiens
aaaucuuuuaaaaauucaa

SEQ ID NO: 1260303 - RNA, 22 nt, Homo sapiens
aacacaaaccacaacugacaca

SEQ ID NO: 1260304 - RNA, 16 nt, Homo sapiens
aacacaagagacuuaa

SEQ ID NO: 1260305 - RNA, 22 nt, Homo sapiens
aacacaagagacuuaaaggaca

SEQ ID NO: 1260306 - RNA, 13 nt, Homo sapiens
aacacacacuguu

SEQ ID NO: 1260307 - RNA, 19 nt, Homo sapiens
aacacacacuguucugaaa

SEQ ID NO: 1260308 - RNA, 13 nt, Homo sapiens
aacacacagucac

SEQ ID NO: 1260309 - RNA, 12 nt, Homo sapiens
aacacacaugca

SEQ ID NO: 1260310 - RNA, 19 nt, Homo sapiens
aacacacuuaucugucucu

SEQ ID NO: 1260311 - RNA, 23 nt, Homo sapiens
aacacagagaagcggauuuccag

SEQ ID NO: 1260312 - RNA, 20 nt, Homo sapiens
aacacagcaacaaugacuua

SEQ ID NO: 1260313 - RNA, 17 nt, Homo sapiens
aacacaggcgcugagua

SEQ ID NO: 1260314 - RNA, 21 nt, Homo sapiens
aacacaguuuagugcuuuaca

SEQ ID NO: 1260315 - RNA, 14 nt, Homo sapiens
aacacauacaggaa

SEQ ID NO: 1260316 - RNA, 21 nt, Homo sapiens
aacacaugugcagucacuggu

SEQ ID NO: 1260317 - RNA, 17 nt, Homo sapiens
aacacauucuuauuaau

SEQ ID NO: 1260318 - RNA, 20 nt, Homo sapiens
aacacauucuuauugacaau

SEQ ID NO: 1260319 - RNA, 19 nt, Homo sapiens
aacacccgacuccucaaaa

SEQ ID NO: 1260320 - RNA, 15 nt, Homo sapiens
aacaccuagcuuuau

SEQ ID NO: 1260321 - RNA, 21 nt, Homo sapiens
aacaccuagcuuuauucuuca

SEQ ID NO: 1260322 - RNA, 15 nt, Homo sapiens
aacaccucacuuuug

SEQ ID NO: 1260323 - RNA, 21 nt, Homo sapiens
aacaccuuccuccugcagaca

SEQ ID NO: 1260324 - RNA, 23 nt, Homo sapiens
aacacgcagauccuuugucuaca

SEQ ID NO: 1260325 - RNA, 17 nt, Homo sapiens
aacacguuggcucaguc

SEQ ID NO: 1260326 - RNA, 17 nt, Homo sapiens
aacacucaguuguucaa

SEQ ID NO: 1260327 - RNA, 15 nt, Homo sapiens
aacacucaugaagca

SEQ ID NO: 1260328 - RNA, 18 nt, Homo sapiens
aacacugacuccugugga

SEQ ID NO: 1260329 - RNA, 13 nt, Homo sapiens
aacacugcugcuc

SEQ ID NO: 1260330 - RNA, 11 nt, Homo sapiens
aacacuggcau

SEQ ID NO: 1260331 - RNA, 19 nt, Homo sapiens
aacacugucacuagucuca

SEQ ID NO: 1260332 - RNA, 21 nt, Homo sapiens
aacagaaaccagaaaagcaau

SEQ ID NO: 1260333 - RNA, 14 nt, Homo sapiens
aacagaagcaguug

SEQ ID NO: 1260334 - RNA, 18 nt, Homo sapiens
aacuguuagcacuguuga

SEQ ID NO: 1260335 - RNA, 23 nt, Homo sapiens
aacuguuggagagagauguuccu

SEQ ID NO: 1260336 - RNA, 14 nt, Homo sapiens
aacuguuuccccag

SEQ ID NO: 1260337 - RNA, 16 nt, Homo sapiens
aacuguuucccugcug

SEQ ID NO: 1260338 - RNA, 23 nt, Homo sapiens
aacuguuucccuuugauucucca

SEQ ID NO: 1260339 - RNA, 19 nt, Homo sapiens
aacuuaagaugaauacaug

SEQ ID NO: 1260340 - RNA, 22 nt, Homo sapiens
aacuuaagcugggauaaucaca

SEQ ID NO: 1260341 - RNA, 16 nt, Homo sapiens
aacuuacuauucauua

SEQ ID NO: 1260342 - RNA, 20 nt, Homo sapiens
aacuuagaucaucagucacc

SEQ ID NO: 1260343 - RNA, 13 nt, Homo sapiens
aacuucaagcaaa

SEQ ID NO: 1260344 - RNA, 21 nt, Homo sapiens
aacuucaccuacauuaucuca

SEQ ID NO: 1260345 - RNA, 23 nt, Homo sapiens
aacuucagagcaugaaaaucaca

SEQ ID NO: 1260346 - RNA, 13 nt, Homo sapiens
aacuucauuugau

SEQ ID NO: 1260347 - RNA, 15 nt, Homo sapiens
aacuuccaauuuaca

SEQ ID NO: 1260348 - RNA, 19 nt, Homo sapiens
aacuuccacaagagugaau

SEQ ID NO: 1260349 - RNA, 21 nt, Homo sapiens
aacuuccacaagagugaauuu

SEQ ID NO: 1260350 - RNA, 23 nt, Homo sapiens
aacuucccacacgauuagcuuua

SEQ ID NO: 1260351 - RNA, 22 nt, Homo sapiens
aacuucugccucccaugcuuac

SEQ ID NO: 1260352 - RNA, 13 nt, Homo sapiens
aacuucuugucag

SEQ ID NO: 1260353 - RNA, 19 nt, Homo sapiens
aacuucuugucagacauaa

SEQ ID NO: 1260354 - RNA, 18 nt, Homo sapiens
aacuugaaugugucaggu

SEQ ID NO: 1260355 - RNA, 20 nt, Homo sapiens
aacuugauguguuaucucuu

SEQ ID NO: 1260356 - RNA, 22 nt, Homo sapiens
aacuugcagaauugagagugau

SEQ ID NO: 1260357 - RNA, 18 nt, Homo sapiens
aacuuggguucuucucag

SEQ ID NO: 1260358 - RNA, 12 nt, Homo sapiens
aacuuguaaaua

SEQ ID NO: 1260359 - RNA, 16 nt, Homo sapiens
aacuuuaaacauugac

SEQ ID NO: 1260360 - RNA, 23 nt, Homo sapiens
aacuuuaaacauugacgauuccu

SEQ ID NO: 1260361 - RNA, 18 nt, Homo sapiens
aacuuuccugacuuacaa

SEQ ID NO: 1260362 - RNA, 13 nt, Homo sapiens
aacuuuggcuuau

SEQ ID NO: 1260363 - RNA, 22 nt, Homo sapiens
aacuuuguggaugucuuccuug

SEQ ID NO: 1260364 - RNA, 17 nt, Homo sapiens
aacuuuucgacauauuu

SEQ ID NO: 1260365 - RNA, 16 nt, Homo sapiens
aacuuuucuaccauuu

SEQ ID NO: 1260366 - RNA, 15 nt, Homo sapiens
aagaaaaaaaccaua

SEQ ID NO: 1260367 - RNA, 18 nt, Homo sapiens
aaccaucacccccaggac

SEQ ID NO: 1260368 - RNA, 17 nt, Homo sapiens
aaccauccagugacaaa

SEQ ID NO: 1260369 - RNA, 20 nt, Homo sapiens
aaccauuccaacuucaauuu

SEQ ID NO: 1260370 - RNA, 12 nt, Homo sapiens
aaccauuugcac

SEQ ID NO: 1260371 - RNA, 19 nt, Homo sapiens
aacccaauaaaacugaugu

SEQ ID NO: 1260372 - RNA, 19 nt, Homo sapiens
aacccaccccgcuuucgua

SEQ ID NO: 1260373 - RNA, 16 nt, Homo sapiens
aacccacgaggaccau

SEQ ID NO: 1260374 - RNA, 22 nt, Homo sapiens
aacccagggcucugccccaguc

SEQ ID NO: 1260375 - RNA, 17 nt, Homo sapiens
aacccauucccucucca

SEQ ID NO: 1260376 - RNA, 13 nt, Homo sapiens
aacccauuuugaa

SEQ ID NO: 1260377 - RNA, 16 nt, Homo sapiens
aaccccaagcugccuc

SEQ ID NO: 1260378 - RNA, 16 nt, Homo sapiens
aaccccaucucuacua

SEQ ID NO: 1260379 - RNA, 13 nt, Homo sapiens
aaccccaugggcu

SEQ ID NO: 1260380 - RNA, 17 nt, Homo sapiens
aacccccaguucaagac

SEQ ID NO: 1260381 - RNA, 23 nt, Homo sapiens
aacccccuuccccgcucuugccc

SEQ ID NO: 1260382 - RNA, 23 nt, Homo sapiens
aaccccuuccagaucacugccac

SEQ ID NO: 1260383 - RNA, 14 nt, Homo sapiens
aacccgacaugugu

SEQ ID NO: 1260384 - RNA, 21 nt, Homo sapiens
aacccgacauguguaccucag

SEQ ID NO: 1260385 - RNA, 14 nt, Homo sapiens
aacccggagagugc

SEQ ID NO: 1260386 - RNA, 16 nt, Homo sapiens
aacccggcacugcccu

SEQ ID NO: 1260387 - RNA, 22 nt, Homo sapiens
aacccuacuuugcuuccgccac

SEQ ID NO: 1260388 - RNA, 16 nt, Homo sapiens
aacccuagaccauguc

SEQ ID NO: 1260389 - RNA, 18 nt, Homo sapiens
aacccucuggggagcuca

SEQ ID NO: 1260390 - RNA, 14 nt, Homo sapiens
aacccuuacaguga

SEQ ID NO: 1260391 - RNA, 14 nt, Homo sapiens
aacccuuauuccau

SEQ ID NO: 1260392 - RNA, 12 nt, Homo sapiens
aaccuagaauuu

SEQ ID NO: 1260393 - RNA, 15 nt, Homo sapiens
aaccuagaucugcac

SEQ ID NO: 1260394 - RNA, 12 nt, Homo sapiens
aaccuagugaau

SEQ ID NO: 1260395 - RNA, 18 nt, Homo sapiens
aaccuauguguccucuaa

SEQ ID NO: 1260396 - RNA, 11 nt, Homo sapiens
aaccucagggc

SEQ ID NO: 1260397 - RNA, 22 nt, Homo sapiens
aaccucagggcucccagggguc

SEQ ID NO: 1260398 - RNA, 23 nt, Homo sapiens
aaccucagggcucccaggggucu

SEQ ID NO: 1260399 - RNA, 18 nt, Homo sapiens
aagaaaaaaaucuucucc

SEQ ID NO: 1260400 - RNA, 22 nt, Homo sapiens
aagaaaaaauucccucauuuaa

SEQ ID NO: 1260401 - RNA, 16 nt, Homo sapiens
aagaaaaacaccgcuu

SEQ ID NO: 1260402 - RNA, 12 nt, Homo sapiens
aagaaaaaccac

SEQ ID NO: 1260403 - RNA, 15 nt, Homo sapiens
aagaaaaaggaacua

SEQ ID NO: 1260404 - RNA, 17 nt, Homo sapiens
aagaaaaagguuugcau

SEQ ID NO: 1260405 - RNA, 14 nt, Homo sapiens
aagaaaacaacuuc

SEQ ID NO: 1260406 - RNA, 20 nt, Homo sapiens
aagaaaaggacaaauaucuu

SEQ ID NO: 1260407 - RNA, 22 nt, Homo sapiens
aagaaaaucaaagcugaggaca

SEQ ID NO: 1260408 - RNA, 14 nt, Homo sapiens
aagaaaauccauua

SEQ ID NO: 1260409 - RNA, 17 nt, Homo sapiens
aagaaacacccuuucau

SEQ ID NO: 1260410 - RNA, 22 nt, Homo sapiens
aagaaacagauaccauacucau

SEQ ID NO: 1260411 - RNA, 13 nt, Homo sapiens
aagaaacagucca

SEQ ID NO: 1260412 - RNA, 16 nt, Homo sapiens
aagaaacccucuguca

SEQ ID NO: 1260413 - RNA, 18 nt, Homo sapiens
aagaaacccucugucauu

SEQ ID NO: 1260414 - RNA, 15 nt, Homo sapiens
aagaaacgucuucua

SEQ ID NO: 1260415 - RNA, 12 nt, Homo sapiens
aagaaacuugaa

SEQ ID NO: 1260416 - RNA, 16 nt, Homo sapiens
aagaaagcugagaaga

SEQ ID NO: 1260417 - RNA, 23 nt, Homo sapiens
aagaaaguuuagaagcugagaca

SEQ ID NO: 1260418 - RNA, 13 nt, Homo sapiens
aagaaauacuuuc

SEQ ID NO: 1260419 - RNA, 13 nt, Homo sapiens
aagaaauauuccu

SEQ ID NO: 1260420 - RNA, 23 nt, Homo sapiens
aagaaaucauuuagugacuuaau

SEQ ID NO: 1260421 - RNA, 19 nt, Homo sapiens
aagaaaucuugucuuacca

SEQ ID NO: 1260422 - RNA, 15 nt, Homo sapiens
aagaaaugcauaaaa

SEQ ID NO: 1260423 - RNA, 12 nt, Homo sapiens
aagaacauguga

SEQ ID NO: 1260424 - RNA, 20 nt, Homo sapiens
aagaacccucaggucacaag

SEQ ID NO: 1260425 - RNA, 14 nt, Homo sapiens
aagaaccucuccau

SEQ ID NO: 1260426 - RNA, 12 nt, Homo sapiens
aagaacuaugaa

SEQ ID NO: 1260427 - RNA, 24 nt, Homo sapiens
aagaacugucuauuuucucaguca

SEQ ID NO: 1260428 - RNA, 19 nt, Homo sapiens
aagaacuuggcacacucuc

SEQ ID NO: 1260429 - RNA, 16 nt, Homo sapiens
aagaacuuuagcaugg

SEQ ID NO: 1260430 - RNA, 11 nt, Homo sapiens
aagaagacugg

SEQ ID NO: 1260431 - RNA, 15 nt, Homo sapiens
aagaagagacuggga

SEQ ID NO: 1260432 - RNA, 22 nt, Homo sapiens
aagaagagcgagagaucaaaga

SEQ ID NO: 1260433 - RNA, 15 nt, Homo sapiens
aagaagccacagacc

SEQ ID NO: 1260434 - RNA, 16 nt, Homo sapiens
aagaagccacccuccu

SEQ ID NO: 1260435 - RNA, 18 nt, Homo sapiens
aagaagcguuaugugcag

SEQ ID NO: 1260436 - RNA, 21 nt, Homo sapiens
aagaagcucgccccaccucca

SEQ ID NO: 1260437 - RNA, 13 nt, Homo sapiens
aagaagcugcuuc

SEQ ID NO: 1260438 - RNA, 23 nt, Homo sapiens
aagaagcugguggagcagagugu

SEQ ID NO: 1260439 - RNA, 21 nt, Homo sapiens
aagaaggaauucuaggcaucc

SEQ ID NO: 1260440 - RNA, 13 nt, Homo sapiens
aagaaggcauuug

SEQ ID NO: 1260441 - RNA, 14 nt, Homo sapiens
aagaaggguguuua

SEQ ID NO: 1260442 - RNA, 22 nt, Homo sapiens
aagaagguuggugaauuucaca

SEQ ID NO: 1260443 - RNA, 14 nt, Homo sapiens
aagaagugccaguu

SEQ ID NO: 1260444 - RNA, 23 nt, Homo sapiens
aagaaguuguuugaggcaaauua

SEQ ID NO: 1260445 - RNA, 17 nt, Homo sapiens
aagaauaugacuuuuua

SEQ ID NO: 1260446 - RNA, 13 nt, Homo sapiens
aagaauauuguau

SEQ ID NO: 1260447 - RNA, 23 nt, Homo sapiens
aagaaucuaaaccuuacaugugu

SEQ ID NO: 1260448 - RNA, 17 nt, Homo sapiens
aagaaugaauaauaauu

SEQ ID NO: 1260449 - RNA, 23 nt, Homo sapiens
aagaauucaaacuggggccucca

SEQ ID NO: 1260450 - RNA, 17 nt, Homo sapiens
aagaauuuaaaacgcau

SEQ ID NO: 1260451 - RNA, 16 nt, Homo sapiens
aagaauuuuaccauuc

SEQ ID NO: 1260452 - RNA, 18 nt, Homo sapiens
aagaauuuuaccauucag

SEQ ID NO: 1260453 - RNA, 22 nt, Homo sapiens
aagaauuuuuuuuaacauucca

SEQ ID NO: 1260454 - RNA, 16 nt, Homo sapiens
aagacaacauuucuca

SEQ ID NO: 1260455 - RNA, 15 nt, Homo sapiens
aagacacaaaugcau

SEQ ID NO: 1260456 - RNA, 14 nt, Homo sapiens
aagacacagacugc

SEQ ID NO: 1260457 - RNA, 16 nt, Homo sapiens
aagacaccauuuaucu

SEQ ID NO: 1260458 - RNA, 21 nt, Homo sapiens
aagacagagaagaccaaagca

SEQ ID NO: 1260459 - RNA, 18 nt, Homo sapiens
aagacagcugcuggguca

SEQ ID NO: 1260460 - RNA, 22 nt, Homo sapiens
aagacaggcaaauguacuucuc

SEQ ID NO: 1260461 - RNA, 22 nt, Homo sapiens
aagacaguauuuauuggugggu

SEQ ID NO: 1260462 - RNA, 13 nt, Homo sapiens
aagacaguguaca

SEQ ID NO: 1260463 - RNA, 21 nt, Homo sapiens
aagacauauaacgcagucuaa

SEQ ID NO: 1260464 - RNA, 24 nt, Homo sapiens
aagacauucuaauuccagucauuu

SEQ ID NO: 1260465 - RNA, 15 nt, Homo sapiens
aagacauucuuccaa

SEQ ID NO: 1260466 - RNA, 18 nt, Homo sapiens
aagacauuguguguauua

SEQ ID NO: 1260467 - RNA, 22 nt, Homo sapiens
aagacauuucucuaacuccugc

SEQ ID NO: 1260468 - RNA, 23 nt, Homo sapiens
aagacauuuuuugcuauaaucau

SEQ ID NO: 1260469 - RNA, 13 nt, Homo sapiens
aagaccaaacuuc

SEQ ID NO: 1260470 - RNA, 13 nt, Homo sapiens
aagaccaccacuu

SEQ ID NO: 1260471 - RNA, 24 nt, Homo sapiens
aagaccagucacucccucugccuu

SEQ ID NO: 1260472 - RNA, 18 nt, Homo sapiens
aagacuaaaugcacauuu

SEQ ID NO: 1260473 - RNA, 21 nt, Homo sapiens
aagacuaaucgaaugaacaaa

SEQ ID NO: 1260474 - RNA, 14 nt, Homo sapiens
aagacuauaccuua

SEQ ID NO: 1260475 - RNA, 21 nt, Homo sapiens
aagacucauucccuagaucuu

SEQ ID NO: 1260476 - RNA, 14 nt, Homo sapiens
aagacuccgucuca

SEQ ID NO: 1260477 - RNA, 11 nt, Homo sapiens
aagacucugac

SEQ ID NO: 1260478 - RNA, 16 nt, Homo sapiens
aagacucugccauuaa

SEQ ID NO: 1260479 - RNA, 23 nt, Homo sapiens
aagacugaaucuaccugcccuaa

SEQ ID NO: 1260480 - RNA, 23 nt, Homo sapiens
aagacugauuuuaauagggaaua

SEQ ID NO: 1260481 - RNA, 22 nt, Homo sapiens
aagacuggaagcuaauuugcau

SEQ ID NO: 1260482 - RNA, 20 nt, Homo sapiens
aagacuggaauauaauuuca

SEQ ID NO: 1260483 - RNA, 18 nt, Homo sapiens
aagacugguuuucugcca

SEQ ID NO: 1260484 - RNA, 19 nt, Homo sapiens
aagacugucagcuuccaaa

SEQ ID NO: 1260485 - RNA, 18 nt, Homo sapiens
aagacugugaaguugcca

SEQ ID NO: 1260486 - RNA, 19 nt, Homo sapiens
aagacuguugccacuuaac

SEQ ID NO: 1260487 - RNA, 14 nt, Homo sapiens
aagacuuaacuggu

SEQ ID NO: 1260488 - RNA, 19 nt, Homo sapiens
aagacuuuguccccacuua

SEQ ID NO: 1260489 - RNA, 14 nt, Homo sapiens
aagagaagcaauuu

SEQ ID NO: 1260490 - RNA, 21 nt, Homo sapiens
aagagaaugaaauugcugaaa

SEQ ID NO: 1260491 - RNA, 13 nt, Homo sapiens
aagagacacucca

SEQ ID NO: 1260492 - RNA, 21 nt, Homo sapiens
aagcuauuuuuuuaagcuauc

SEQ ID NO: 1260493 - RNA, 18 nt, Homo sapiens
aagcucacugcugaucgu

SEQ ID NO: 1260494 - RNA, 15 nt, Homo sapiens
aagcucagacuugcc

SEQ ID NO: 1260495 - RNA, 23 nt, Homo sapiens
aagcucaucucagucauccugca

SEQ ID NO: 1260496 - RNA, 17 nt, Homo sapiens
aagcucaugcauuucaa

SEQ ID NO: 1260497 - RNA, 22 nt, Homo sapiens
aagcuccuguccucccaucccc

SEQ ID NO: 1260498 - RNA, 15 nt, Homo sapiens
aagcucgagugaauu

SEQ ID NO: 1260499 - RNA, 19 nt, Homo sapiens
aagcucgccccaccuccac

SEQ ID NO: 1260500 - RNA, 22 nt, Homo sapiens
aagcucgccccaccuccaccug

SEQ ID NO: 1260501 - RNA, 21 nt, Homo sapiens
aagcucuagaaucugcaauuc

SEQ ID NO: 1260502 - RNA, 12 nt, Homo sapiens
aagcucuaguuc

SEQ ID NO: 1260503 - RNA, 17 nt, Homo sapiens
aagcucuauuaagauuu

SEQ ID NO: 1260504 - RNA, 20 nt, Homo sapiens
aagcucugccucccggguuc

SEQ ID NO: 1260505 - RNA, 23 nt, Homo sapiens
aagcucuggcugaacccugugcu

SEQ ID NO: 1260506 - RNA, 13 nt, Homo sapiens
aagcucuguccaa

SEQ ID NO: 1260507 - RNA, 19 nt, Homo sapiens
aagcucuuuaugacuguuu

SEQ ID NO: 1260508 - RNA, 19 nt, Homo sapiens
aagcugaaaggaugauccu

SEQ ID NO: 1260509 - RNA, 13 nt, Homo sapiens
aagcugacuuuau

SEQ ID NO: 1260510 - RNA, 17 nt, Homo sapiens
aagcugagaagaaugaa

SEQ ID NO: 1260511 - RNA, 16 nt, Homo sapiens
aagcugagauugagca

SEQ ID NO: 1260512 - RNA, 21 nt, Homo sapiens
aagcugaucauaagugaauuu

SEQ ID NO: 1260513 - RNA, 19 nt, Homo sapiens
aagcugauuacugucaaua

SEQ ID NO: 1260514 - RNA, 12 nt, Homo sapiens
aagcugcacaug

SEQ ID NO: 1260515 - RNA, 19 nt, Homo sapiens
aagcugggauaaucacauu

SEQ ID NO: 1260516 - RNA, 18 nt, Homo sapiens
aagcuggugcccuuccuc

SEQ ID NO: 1260517 - RNA, 21 nt, Homo sapiens
aagcugucccucacuguugaa

SEQ ID NO: 1260518 - RNA, 17 nt, Homo sapiens
aagcuguuguacauuua

SEQ ID NO: 1260519 - RNA, 15 nt, Homo sapiens
aagcuuaaauugcuu

SEQ ID NO: 1260520 - RNA, 22 nt, Homo sapiens
aagcuuccauuccaagccugac

SEQ ID NO: 1260521 - RNA, 19 nt, Homo sapiens
aaggaaaacuauguauuaa

SEQ ID NO: 1260522 - RNA, 19 nt, Homo sapiens
aaggaaaaucacaucucca

SEQ ID NO: 1260523 - RNA, 14 nt, Homo sapiens
aaggaaacuagaca

SEQ ID NO: 1260524 - RNA, 22 nt, Homo sapiens
aaggaaacuguacuacaucuag

SEQ ID NO: 1260525 - RNA, 12 nt, Homo sapiens
aaggaaagcaca

SEQ ID NO: 1260526 - RNA, 14 nt, Homo sapiens
aaggaaagcacagc

SEQ ID NO: 1260527 - RNA, 15 nt, Homo sapiens
aaggaaaucucaccc

SEQ ID NO: 1260528 - RNA, 18 nt, Homo sapiens
aaggaacaaaaaaaccac

SEQ ID NO: 1260529 - RNA, 19 nt, Homo sapiens
aaggaacaaaaaaaccaca

SEQ ID NO: 1260530 - RNA, 21 nt, Homo sapiens
aaggaacaaaaauuacaaaga

SEQ ID NO: 1260531 - RNA, 14 nt, Homo sapiens
aaggaagacuugaa

SEQ ID NO: 1260532 - RNA, 18 nt, Homo sapiens
aaggacaaaaaaccucag

SEQ ID NO: 1260533 - RNA, 21 nt, Homo sapiens
aaggacacuagccugugcacg

SEQ ID NO: 1260534 - RNA, 19 nt, Homo sapiens
aaggacagaguaugaacac

SEQ ID NO: 1260535 - RNA, 13 nt, Homo sapiens
aaggacaggccac

SEQ ID NO: 1260536 - RNA, 21 nt, Homo sapiens
aaggacauuuaaaauucaauu

SEQ ID NO: 1260537 - RNA, 13 nt, Homo sapiens
aaggaccaauagc

SEQ ID NO: 1260538 - RNA, 17 nt, Homo sapiens
aaggacgguucuuacac

SEQ ID NO: 1260539 - RNA, 15 nt, Homo sapiens
aaggagaacuaucca

SEQ ID NO: 1260540 - RNA, 17 nt, Homo sapiens
aaggagaacuauccaaa

SEQ ID NO: 1260541 - RNA, 19 nt, Homo sapiens
aaggagaacuauccaaaac

SEQ ID NO: 1260542 - RNA, 23 nt, Homo sapiens
aaggagauauggcuaguggcaau

SEQ ID NO: 1260543 - RNA, 13 nt, Homo sapiens
aaggagauuccac

SEQ ID NO: 1260544 - RNA, 17 nt, Homo sapiens
aaggagauuccacacag

SEQ ID NO: 1260545 - RNA, 17 nt, Homo sapiens
aaggagcacaagccaca

SEQ ID NO: 1260546 - RNA, 20 nt, Homo sapiens
aaggaggcaugccucugaua

SEQ ID NO: 1260547 - RNA, 20 nt, Homo sapiens
aaggaguacaaugcccagau

SEQ ID NO: 1260548 - RNA, 21 nt, Homo sapiens
aaggagucccugguucauuga

SEQ ID NO: 1260549 - RNA, 18 nt, Homo sapiens
aaggauaccaaauaccau

SEQ ID NO: 1260550 - RNA, 23 nt, Homo sapiens
aaggauauuuaagaaaauacaau

SEQ ID NO: 1260551 - RNA, 18 nt, Homo sapiens
aaggauccucuccacucc

SEQ ID NO: 1260552 - RNA, 20 nt, Homo sapiens
aaggauccucuccacuccau

SEQ ID NO: 1260553 - RNA, 15 nt, Homo sapiens
aaggauccuucccug

SEQ ID NO: 1260554 - RNA, 13 nt, Homo sapiens
aaggauggaccac

SEQ ID NO: 1260555 - RNA, 12 nt, Homo sapiens
aaggaugugauu

SEQ ID NO: 1260556 - RNA, 12 nt, Homo sapiens
aaggauguugcc

SEQ ID NO: 1260557 - RNA, 22 nt, Homo sapiens
aaggauuacagaaacugaugcc

SEQ ID NO: 1260558 - RNA, 18 nt, Homo sapiens
aaggauuuuaccaaagca

SEQ ID NO: 1260559 - RNA, 23 nt, Homo sapiens
aaggcaauuccugauggaaaaug

SEQ ID NO: 1260560 - RNA, 19 nt, Homo sapiens
aaggcacguucuuuccuua

SEQ ID NO: 1260561 - RNA, 15 nt, Homo sapiens
aaggcagaguacaaa

SEQ ID NO: 1260562 - RNA, 16 nt, Homo sapiens
aaggcagcugccucug

SEQ ID NO: 1260563 - RNA, 23 nt, Homo sapiens
aaggcagcugccucugcucccuc

SEQ ID NO: 1260564 - RNA, 16 nt, Homo sapiens
aaggcaggacagagaa

SEQ ID NO: 1260565 - RNA, 21 nt, Homo sapiens
aaggcauuucuuuucugcaug

SEQ ID NO: 1260566 - RNA, 22 nt, Homo sapiens
aaggccagguguggugacucac

SEQ ID NO: 1260567 - RNA, 16 nt, Homo sapiens
aaggccuucuucccaa

SEQ ID NO: 1260568 - RNA, 20 nt, Homo sapiens
aaggcgggaggauugcuuga

SEQ ID NO: 1260569 - RNA, 22 nt, Homo sapiens
aaggcucugagcaaauguggcu

SEQ ID NO: 1260570 - RNA, 21 nt, Homo sapiens
aaggcuucugugucaaugccu

SEQ ID NO: 1260571 - RNA, 17 nt, Homo sapiens
aaggcuuggcacacagc

SEQ ID NO: 1260572 - RNA, 15 nt, Homo sapiens
aaggcuuuaucucag

SEQ ID NO: 1260573 - RNA, 17 nt, Homo sapiens
aaggcuuuaucucaggg

SEQ ID NO: 1260574 - RNA, 17 nt, Homo sapiens
aagggaauacugugcau

SEQ ID NO: 1260575 - RNA, 22 nt, Homo sapiens
aagggaaucauuuuucacugua

SEQ ID NO: 1260576 - RNA, 14 nt, Homo sapiens
aagggaauccuccu

SEQ ID NO: 1260577 - RNA, 18 nt, Homo sapiens
aagggaauugcucagaga

SEQ ID NO: 1260578 - RNA, 18 nt, Homo sapiens
aagggacggggaagccga

SEQ ID NO: 1260579 - RNA, 16 nt, Homo sapiens
aagggagguggcaaga

SEQ ID NO: 1260580 - RNA, 17 nt, Homo sapiens
aagggauaguccaaaga

SEQ ID NO: 1260581 - RNA, 18 nt, Homo sapiens
aagggauaguccaaagac

SEQ ID NO: 1260582 - RNA, 18 nt, Homo sapiens
acaagauccuuaaugcag

SEQ ID NO: 1260583 - RNA, 20 nt, Homo sapiens
acaagauuaccccaccuugc

SEQ ID NO: 1260584 - RNA, 12 nt, Homo sapiens
acaagauuagaa

SEQ ID NO: 1260585 - RNA, 21 nt, Homo sapiens
acaagcagcuggugcuccaag

SEQ ID NO: 1260586 - RNA, 20 nt, Homo sapiens
acaagccaacgacaaagcca

SEQ ID NO: 1260587 - RNA, 21 nt, Homo sapiens
acaagccagucugccucuucc

SEQ ID NO: 1260588 - RNA, 21 nt, Homo sapiens
acaagcccacagcacagcucc

SEQ ID NO: 1260589 - RNA, 23 nt, Homo sapiens
acaagccuccuguaccucagugg

SEQ ID NO: 1260590 - RNA, 14 nt, Homo sapiens
acaagccugagaac

SEQ ID NO: 1260591 - RNA, 15 nt, Homo sapiens
acaagcugcauuuca

SEQ ID NO: 1260592 - RNA, 15 nt, Homo sapiens
acaaggaaauacccu

SEQ ID NO: 1260593 - RNA, 16 nt, Homo sapiens
acaaggaugacaagaa

SEQ ID NO: 1260594 - RNA, 17 nt, Homo sapiens
acaaggcccugagcuuu

SEQ ID NO: 1260595 - RNA, 18 nt, Homo sapiens
acaaggcugaccaagaga

SEQ ID NO: 1260596 - RNA, 12 nt, Homo sapiens
acaagggagaaa

SEQ ID NO: 1260597 - RNA, 13 nt, Homo sapiens
acaaggugacaaa

SEQ ID NO: 1260598 - RNA, 18 nt, Homo sapiens
acaaguauguugagaguu

SEQ ID NO: 1260599 - RNA, 21 nt, Homo sapiens
acaaguauuauuuuacaauca

SEQ ID NO: 1260600 - RNA, 14 nt, Homo sapiens
acaaguccagcugg

SEQ ID NO: 1260601 - RNA, 14 nt, Homo sapiens
acaagugagacaaa

SEQ ID NO: 1260602 - RNA, 12 nt, Homo sapiens
acaagugccuga

SEQ ID NO: 1260603 - RNA, 18 nt, Homo sapiens
acaagugccugacacgca

SEQ ID NO: 1260604 - RNA, 22 nt, Homo sapiens
acaaguucaauaaaaaucugcu

SEQ ID NO: 1260605 - RNA, 17 nt, Homo sapiens
acaaguuccaugggaua

SEQ ID NO: 1260606 - RNA, 21 nt, Homo sapiens
acaaguugcgacggagagaaa

SEQ ID NO: 1260607 - RNA, 23 nt, Homo sapiens
acaaguuucugauaccacugcac

SEQ ID NO: 1260608 - RNA, 22 nt, Homo sapiens
acaauaaaccuccgccaaugca

SEQ ID NO: 1260609 - RNA, 17 nt, Homo sapiens
acaauaaagcaaugugg

SEQ ID NO: 1260610 - RNA, 23 nt, Homo sapiens
acaauaagccacgaggugcagua

SEQ ID NO: 1260611 - RNA, 23 nt, Homo sapiens
acaauacugggguuggacuguaa

SEQ ID NO: 1260612 - RNA, 15 nt, Homo sapiens
acaaucaaagcacuu

SEQ ID NO: 1260613 - RNA, 16 nt, Homo sapiens
acaaucaacaaaaugg

SEQ ID NO: 1260614 - RNA, 16 nt, Homo sapiens
acaaucaaggccacug

SEQ ID NO: 1260615 - RNA, 16 nt, Homo sapiens
acaauccaucucucaa

SEQ ID NO: 1260616 - RNA, 24 nt, Homo sapiens
acaauccaucucucaaguagugua

SEQ ID NO: 1260617 - RNA, 19 nt, Homo sapiens
acaauccaugaacagcauu

SEQ ID NO: 1260618 - RNA, 20 nt, Homo sapiens
acaauccaugaacagcauua

SEQ ID NO: 1260619 - RNA, 18 nt, Homo sapiens
acaaucccaccuagccca

SEQ ID NO: 1260620 - RNA, 18 nt, Homo sapiens
acaauccugaggcuucau

SEQ ID NO: 1260621 - RNA, 14 nt, Homo sapiens
acaauccuguggau

SEQ ID NO: 1260622 - RNA, 20 nt, Homo sapiens
acaaucuggcuuagugccac

SEQ ID NO: 1260623 - RNA, 19 nt, Homo sapiens
acaaugacuuguacucuga

SEQ ID NO: 1260624 - RNA, 19 nt, Homo sapiens
acaaugcagcaaggcccug

SEQ ID NO: 1260625 - RNA, 21 nt, Homo sapiens
acaaugccuuugaugaacugu

SEQ ID NO: 1260626 - RNA, 12 nt, Homo sapiens
acaaugcugauu

SEQ ID NO: 1260627 - RNA, 22 nt, Homo sapiens
aagaucaaaauaaaaagugaca

SEQ ID NO: 1260628 - RNA, 22 nt, Homo sapiens
aagauccccucuccugcccaag

SEQ ID NO: 1260629 - RNA, 17 nt, Homo sapiens
aagauccuccugcugca

SEQ ID NO: 1260630 - RNA, 18 nt, Homo sapiens
aagaugaccuuugucuca

SEQ ID NO: 1260631 - RNA, 23 nt, Homo sapiens
aagaugagauuugccagcacagg

SEQ ID NO: 1260632 - RNA, 15 nt, Homo sapiens
aagaugcacugaaaa

SEQ ID NO: 1260633 - RNA, 21 nt, Homo sapiens
aagaugccagugaaacuucaa

SEQ ID NO: 1260634 - RNA, 16 nt, Homo sapiens
aagaugcuaguucauu

SEQ ID NO: 1260635 - RNA, 18 nt, Homo sapiens
aagauggggcgagccagg

SEQ ID NO: 1260636 - RNA, 20 nt, Homo sapiens
aagaugugauauucuaagac

SEQ ID NO: 1260637 - RNA, 21 nt, Homo sapiens
aagauucauauuuacuucuua

SEQ ID NO: 1260638 - RNA, 17 nt, Homo sapiens
aagauucuccugugcua

SEQ ID NO: 1260639 - RNA, 15 nt, Homo sapiens
aagauucugucuuau

SEQ ID NO: 1260640 - RNA, 16 nt, Homo sapiens
aagauugagaagccau

SEQ ID NO: 1260641 - RNA, 17 nt, Homo sapiens
aagauugagaagccaug

SEQ ID NO: 1260642 - RNA, 17 nt, Homo sapiens
aagauugcgguuuacag

SEQ ID NO: 1260643 - RNA, 17 nt, Homo sapiens
aagauuggauuuuacag

SEQ ID NO: 1260644 - RNA, 19 nt, Homo sapiens
aagauuguacuuagccagu

SEQ ID NO: 1260645 - RNA, 22 nt, Homo sapiens
aagauuuagaaaaaaguuuaca

SEQ ID NO: 1260646 - RNA, 15 nt, Homo sapiens
aagauuuaugaugca

SEQ ID NO: 1260647 - RNA, 17 nt, Homo sapiens
aagauuuccuacuuucu

SEQ ID NO: 1260648 - RNA, 23 nt, Homo sapiens
aagauuugcccauuuacacuuuu

SEQ ID NO: 1260649 - RNA, 20 nt, Homo sapiens
aagauuuucuccacaguguu

SEQ ID NO: 1260650 - RNA, 19 nt, Homo sapiens
aagauuuugcaccuguaaa

SEQ ID NO: 1260651 - RNA, 18 nt, Homo sapiens
aagauuuuuuuugucaga

SEQ ID NO: 1260652 - RNA, 20 nt, Homo sapiens
aagcaaaaaaugaaugucua

SEQ ID NO: 1260653 - RNA, 14 nt, Homo sapiens
aagcaaaaugucuc

SEQ ID NO: 1260654 - RNA, 14 nt, Homo sapiens
aagcaacacagagc

SEQ ID NO: 1260655 - RNA, 20 nt, Homo sapiens
aagcaacccaguccccaacc

SEQ ID NO: 1260656 - RNA, 22 nt, Homo sapiens
aagcaagacccauaaccauuau

SEQ ID NO: 1260657 - RNA, 17 nt, Homo sapiens
aagcaagcccuggccag

SEQ ID NO: 1260658 - RNA, 16 nt, Homo sapiens
aagcaagggaccuuca

SEQ ID NO: 1260659 - RNA, 20 nt, Homo sapiens
aagcaaguagcuuuccacau

SEQ ID NO: 1260660 - RNA, 17 nt, Homo sapiens
aagcaaguucgucuguu

SEQ ID NO: 1260661 - RNA, 16 nt, Homo sapiens
aagcaauaaccucaaa

SEQ ID NO: 1260662 - RNA, 17 nt, Homo sapiens
aagcaaugcugaugaau

SEQ ID NO: 1260663 - RNA, 19 nt, Homo sapiens
aagcaauucuccugccuua

SEQ ID NO: 1260664 - RNA, 20 nt, Homo sapiens
aagcacaagcagagugcaca

SEQ ID NO: 1260665 - RNA, 17 nt, Homo sapiens
aagcacaaguacuuuug

SEQ ID NO: 1260666 - RNA, 14 nt, Homo sapiens
aagcacaucaauua

SEQ ID NO: 1260667 - RNA, 13 nt, Homo sapiens
aagcacaucugca

SEQ ID NO: 1260668 - RNA, 18 nt, Homo sapiens
aagcaccccagucacuag

SEQ ID NO: 1260669 - RNA, 15 nt, Homo sapiens
aagcaccccaugcca

SEQ ID NO: 1260670 - RNA, 22 nt, Homo sapiens
aagcacgugucucagacugcau

SEQ ID NO: 1260671 - RNA, 18 nt, Homo sapiens
aagcacuacaccuugccu

SEQ ID NO: 1260672 - RNA, 22 nt, Homo sapiens
aagcacucuuaaagcaaaaaau

SEQ ID NO: 1260673 - RNA, 11 nt, Homo sapiens
aagcacugccu

SEQ ID NO: 1260674 - RNA, 14 nt, Homo sapiens
aagcacugugcuaa

SEQ ID NO: 1260675 - RNA, 18 nt, Homo sapiens
aagcacuuggacucuugc

SEQ ID NO: 1260676 - RNA, 16 nt, Homo sapiens
aagcacuuugcacuua

SEQ ID NO: 1260677 - RNA, 21 nt, Homo sapiens
aagcagaauuuaaguugguaa

SEQ ID NO: 1260678 - RNA, 17 nt, Homo sapiens
aagcagagaaaauaauu

SEQ ID NO: 1260679 - RNA, 14 nt, Homo sapiens
aagcagcaagacaa

SEQ ID NO: 1260680 - RNA, 23 nt, Homo sapiens
aagcagcauggaaaaaugguuga

SEQ ID NO: 1260681 - RNA, 13 nt, Homo sapiens
aagcagccauaaa

SEQ ID NO: 1260682 - RNA, 21 nt, Homo sapiens
aagcagccauuggcacugugg

SEQ ID NO: 1260683 - RNA, 20 nt, Homo sapiens
aagcagcucacggaacugga

SEQ ID NO: 1260684 - RNA, 14 nt, Homo sapiens
aagcagcucuugcu

SEQ ID NO: 1260685 - RNA, 11 nt, Homo sapiens
aagcagggaaa

SEQ ID NO: 1260686 - RNA, 16 nt, Homo sapiens
aagcagucaguuugca

SEQ ID NO: 1260687 - RNA, 20 nt, Homo sapiens
aagcagucgugccugugucc

SEQ ID NO: 1260688 - RNA, 11 nt, Homo sapiens
aagcagucuca

SEQ ID NO: 1260689 - RNA, 16 nt, Homo sapiens
aagcagucucacugca

SEQ ID NO: 1260690 - RNA, 19 nt, Homo sapiens
aagcagucuugcucuguua

SEQ ID NO: 1260691 - RNA, 20 nt, Homo sapiens
aagcaguuacuaauaugccu

SEQ ID NO: 1260692 - RNA, 19 nt, Homo sapiens
aagcauacaaagcaguuua

SEQ ID NO: 1260693 - RNA, 13 nt, Homo sapiens
aagcauacuuugu

SEQ ID NO: 1260694 - RNA, 14 nt, Homo sapiens
aagcauacuuugua

SEQ ID NO: 1260695 - RNA, 12 nt, Homo sapiens
aagcaucugcca

SEQ ID NO: 1260696 - RNA, 16 nt, Homo sapiens
aagcauggacuaaccc

SEQ ID NO: 1260697 - RNA, 23 nt, Homo sapiens
aagcaugucucaauaguaaaaga

SEQ ID NO: 1260698 - RNA, 17 nt, Homo sapiens
aagcauuccugcucaag

SEQ ID NO: 1260699 - RNA, 18 nt, Homo sapiens
aagcauucuccccagugu

SEQ ID NO: 1260700 - RNA, 16 nt, Homo sapiens
aagcauuggacauuua

SEQ ID NO: 1260701 - RNA, 18 nt, Homo sapiens
aagcauuucuagcaguga

SEQ ID NO: 1260702 - RNA, 16 nt, Homo sapiens
aagccaaacucugcca

SEQ ID NO: 1260703 - RNA, 13 nt, Homo sapiens
aagccaaccuuca

SEQ ID NO: 1260704 - RNA, 17 nt, Homo sapiens
aagccaauaaaugaacu

SEQ ID NO: 1260705 - RNA, 20 nt, Homo sapiens
aagccacagcagguccucca

SEQ ID NO: 1260706 - RNA, 21 nt, Homo sapiens
aagccacagcagguccuccau

SEQ ID NO: 1260707 - RNA, 18 nt, Homo sapiens
aagccacauggcugggau

SEQ ID NO: 1260708 - RNA, 21 nt, Homo sapiens
aagccacauuauuucuagucc

SEQ ID NO: 1260709 - RNA, 11 nt, Homo sapiens
aagccacugaa

SEQ ID NO: 1260710 - RNA, 23 nt, Homo sapiens
aagccagaugugaaaacaucuca

SEQ ID NO: 1260711 - RNA, 20 nt, Homo sapiens
aagccagccaugcauuguua

SEQ ID NO: 1260712 - RNA, 12 nt, Homo sapiens
aagccagggucu

SEQ ID NO: 1260713 - RNA, 12 nt, Homo sapiens
aagccagguuac

SEQ ID NO: 1260714 - RNA, 22 nt, Homo sapiens
aagccauagagccccuccuggu

SEQ ID NO: 1260715 - RNA, 16 nt, Homo sapiens
aagccauguuuccucu

SEQ ID NO: 1260716 - RNA, 14 nt, Homo sapiens
aagccauuaugaua

SEQ ID NO: 1260717 - RNA, 22 nt, Homo sapiens
aagcccaggguccacugaaggg

SEQ ID NO: 1260718 - RNA, 24 nt, Homo sapiens
acacuaaaacuuuccugacuuaca

SEQ ID NO: 1260719 - RNA, 14 nt, Homo sapiens
acacuaacauauaa

SEQ ID NO: 1260720 - RNA, 20 nt, Homo sapiens
acacuaaccuggguucccuu

SEQ ID NO: 1260721 - RNA, 23 nt, Homo sapiens
acacuaacgauuuguuaaugaua

SEQ ID NO: 1260722 - RNA, 22 nt, Homo sapiens
acacuaagcgaauguguacaaa

SEQ ID NO: 1260723 - RNA, 20 nt, Homo sapiens
acacuacugcuaaauccuca

SEQ ID NO: 1260724 - RNA, 19 nt, Homo sapiens
acacuagucagaaaauugg

SEQ ID NO: 1260725 - RNA, 19 nt, Homo sapiens
acacuauaaagguugacaa

SEQ ID NO: 1260726 - RNA, 20 nt, Homo sapiens
acacuaugaagauguuucaa

SEQ ID NO: 1260727 - RNA, 22 nt, Homo sapiens
acacucaauaaauugcaacaua

SEQ ID NO: 1260728 - RNA, 15 nt, Homo sapiens
acacucacauuuauu

SEQ ID NO: 1260729 - RNA, 14 nt, Homo sapiens
acacucaccaugaa

SEQ ID NO: 1260730 - RNA, 23 nt, Homo sapiens
acacucaccugcacuaacagagu

SEQ ID NO: 1260731 - RNA, 20 nt, Homo sapiens
acacucacuccacaacccaa

SEQ ID NO: 1260732 - RNA, 16 nt, Homo sapiens
acacucagaacccagg

SEQ ID NO: 1260733 - RNA, 12 nt, Homo sapiens
acacuccagugc

SEQ ID NO: 1260734 - RNA, 15 nt, Homo sapiens
acacuccagugccag

SEQ ID NO: 1260735 - RNA, 21 nt, Homo sapiens
acacuccagugccagcaauga

SEQ ID NO: 1260736 - RNA, 13 nt, Homo sapiens
acacucgccagcu

SEQ ID NO: 1260737 - RNA, 15 nt, Homo sapiens
acacucuccaaacag

SEQ ID NO: 1260738 - RNA, 17 nt, Homo sapiens
acacucuccaaacaguc

SEQ ID NO: 1260739 - RNA, 19 nt, Homo sapiens
acacucuccaaacagucac

SEQ ID NO: 1260740 - RNA, 22 nt, Homo sapiens
acacucuggcugcucccugaca

SEQ ID NO: 1260741 - RNA, 13 nt, Homo sapiens
acacugaaaccaa

SEQ ID NO: 1260742 - RNA, 15 nt, Homo sapiens
acacugaagccacag

SEQ ID NO: 1260743 - RNA, 15 nt, Homo sapiens
acacugaaguuaaca

SEQ ID NO: 1260744 - RNA, 21 nt, Homo sapiens
acacugaggagagauucccgc

SEQ ID NO: 1260745 - RNA, 13 nt, Homo sapiens
acacugauacacu

SEQ ID NO: 1260746 - RNA, 16 nt, Homo sapiens
acacugaugcuuagau

SEQ ID NO: 1260747 - RNA, 12 nt, Homo sapiens
acacugcacugu

SEQ ID NO: 1260748 - RNA, 13 nt, Homo sapiens
acacugcacuguu

SEQ ID NO: 1260749 - RNA, 19 nt, Homo sapiens
acacugcagaacagcauca

SEQ ID NO: 1260750 - RNA, 12 nt, Homo sapiens
acacugcugcuc

SEQ ID NO: 1260751 - RNA, 22 nt, Homo sapiens
acacugcugcuccagugcagga

SEQ ID NO: 1260752 - RNA, 13 nt, Homo sapiens
acacugugcuaua

SEQ ID NO: 1260753 - RNA, 14 nt, Homo sapiens
acacugugcuauaa

SEQ ID NO: 1260754 - RNA, 14 nt, Homo sapiens
acacuuaacagaug

SEQ ID NO: 1260755 - RNA, 15 nt, Homo sapiens
acacuuacacuuuau

SEQ ID NO: 1260756 - RNA, 16 nt, Homo sapiens
acacuuacagaauuau

SEQ ID NO: 1260757 - RNA, 22 nt, Homo sapiens
acacuucaaggugacagaagga

SEQ ID NO: 1260758 - RNA, 13 nt, Homo sapiens
acacuucagaucu

SEQ ID NO: 1260759 - RNA, 15 nt, Homo sapiens
acacuucagaucuga

SEQ ID NO: 1260760 - RNA, 14 nt, Homo sapiens
acacuuguauaaau

SEQ ID NO: 1260761 - RNA, 15 nt, Homo sapiens
acacuuugagcauuu

SEQ ID NO: 1260762 - RNA, 20 nt, Homo sapiens
acacuuuggucauuucucaa

SEQ ID NO: 1260763 - RNA, 15 nt, Homo sapiens
acacuuuugcuugaa

SEQ ID NO: 1260764 - RNA, 21 nt, Homo sapiens
acagcuuucaaaagcaagaac

SEQ ID NO: 1260765 - RNA, 14 nt, Homo sapiens
acagcuuucacagu

SEQ ID NO: 1260766 - RNA, 22 nt, Homo sapiens
acagcuuucuugcucccuucag

SEQ ID NO: 1260767 - RNA, 16 nt, Homo sapiens
acaggaaaguuccaga

SEQ ID NO: 1260768 - RNA, 20 nt, Homo sapiens
acaggaagcaccccaugcca

SEQ ID NO: 1260769 - RNA, 22 nt, Homo sapiens
acaggaagccugcaguccugga

SEQ ID NO: 1260770 - RNA, 23 nt, Homo sapiens
acaggaagguagaaauaucugaa

SEQ ID NO: 1260771 - RNA, 18 nt, Homo sapiens
acaggaauacuuaacuca

SEQ ID NO: 1260772 - RNA, 13 nt, Homo sapiens
acaggacucugcc

SEQ ID NO: 1260773 - RNA, 23 nt, Homo sapiens
acaggaguguccucuucccucuc

SEQ ID NO: 1260774 - RNA, 17 nt, Homo sapiens
acaggaugaccuggaua

SEQ ID NO: 1260775 - RNA, 18 nt, Homo sapiens
acaggauuuguaauuccu

SEQ ID NO: 1260776 - RNA, 22 nt, Homo sapiens
acaggcaaauguacuucucacc

SEQ ID NO: 1260777 - RNA, 14 nt, Homo sapiens
acaggcaagcaccu

SEQ ID NO: 1260778 - RNA, 18 nt, Homo sapiens
acaggcacacaggucuca

SEQ ID NO: 1260779 - RNA, 13 nt, Homo sapiens
acaggcacccacc

SEQ ID NO: 1260780 - RNA, 14 nt, Homo sapiens
acaggcaccugcca

SEQ ID NO: 1260781 - RNA, 17 nt, Homo sapiens
acaggcaccugccaaca

SEQ ID NO: 1260782 - RNA, 12 nt, Homo sapiens
acaggcacucca

SEQ ID NO: 1260783 - RNA, 13 nt, Homo sapiens
acaggcacuuuga

SEQ ID NO: 1260784 - RNA, 21 nt, Homo sapiens
acaggcaguggaagcaguuuc

SEQ ID NO: 1260785 - RNA, 15 nt, Homo sapiens
acaggccauacuuua

SEQ ID NO: 1260786 - RNA, 18 nt, Homo sapiens
acaggccauacuuuacaa

SEQ ID NO: 1260787 - RNA, 21 nt, Homo sapiens
acaggcccuggagaagcagcu

SEQ ID NO: 1260788 - RNA, 21 nt, Homo sapiens
acaggcugaaauuucuuguuc

SEQ ID NO: 1260789 - RNA, 22 nt, Homo sapiens
acaggcuggcaguugguacuga

SEQ ID NO: 1260790 - RNA, 21 nt, Homo sapiens
acaggcuguucugcacugaaa

SEQ ID NO: 1260791 - RNA, 19 nt, Homo sapiens
acagggaggacgcucucug

SEQ ID NO: 1260792 - RNA, 15 nt, Homo sapiens
acagggaggugaccc

SEQ ID NO: 1260793 - RNA, 19 nt, Homo sapiens
acagggcaugcauuuugca

SEQ ID NO: 1260794 - RNA, 17 nt, Homo sapiens
acagggccacaacugcc

SEQ ID NO: 1260795 - RNA, 20 nt, Homo sapiens
acagggcgagacuccgucuc

SEQ ID NO: 1260796 - RNA, 23 nt, Homo sapiens
acaggggugcugcagguggcaga

SEQ ID NO: 1260797 - RNA, 18 nt, Homo sapiens
acaggguaacugugcuga

SEQ ID NO: 1260798 - RNA, 24 nt, Homo sapiens
acagggucugcucuuucucugcca

SEQ ID NO: 1260799 - RNA, 18 nt, Homo sapiens
acaggguuugauagcacu

SEQ ID NO: 1260800 - RNA, 20 nt, Homo sapiens
acagguaauuauaaacccac

SEQ ID NO: 1260801 - RNA, 17 nt, Homo sapiens
acaggucccacugcccu

SEQ ID NO: 1260802 - RNA, 14 nt, Homo sapiens
acagguccccagau

SEQ ID NO: 1260803 - RNA, 12 nt, Homo sapiens
acaggugacaug

SEQ ID NO: 1260804 - RNA, 18 nt, Homo sapiens
acaggugucuagacugcc

SEQ ID NO: 1260805 - RNA, 13 nt, Homo sapiens
acaggugugaacc

SEQ ID NO: 1260806 - RNA, 14 nt, Homo sapiens
acaguaaaucucac

SEQ ID NO: 1260807 - RNA, 22 nt, Homo sapiens
acaguaauaaauuaaaccaaca

SEQ ID NO: 1260808 - RNA, 19 nt, Homo sapiens
acaguacacagauaccuug

SEQ ID NO: 1260809 - RNA, 12 nt, Homo sapiens
acaguaccugau

SEQ ID NO: 1260810 - RNA, 13 nt, Homo sapiens
acaguacugauac

SEQ ID NO: 1260811 - RNA, 23 nt, Homo sapiens
accaaguuauaaaucaaugucac

SEQ ID NO: 1260812 - RNA, 19 nt, Homo sapiens
accaauagcaucugugcca

SEQ ID NO: 1260813 - RNA, 21 nt, Homo sapiens
accaaugccaagauaauucac

SEQ ID NO: 1260814 - RNA, 18 nt, Homo sapiens
accaauuucuuccuucca

SEQ ID NO: 1260815 - RNA, 13 nt, Homo sapiens
accacaacugaca

SEQ ID NO: 1260816 - RNA, 21 nt, Homo sapiens
accacaacugacacaggaaac

SEQ ID NO: 1260817 - RNA, 16 nt, Homo sapiens
accacaccucccugaa

SEQ ID NO: 1260818 - RNA, 20 nt, Homo sapiens
accacaccuggcccuugcaa

SEQ ID NO: 1260819 - RNA, 21 nt, Homo sapiens
accacacgcccccacaggcuc

SEQ ID NO: 1260820 - RNA, 15 nt, Homo sapiens
accacacggaucuga

SEQ ID NO: 1260821 - RNA, 23 nt, Homo sapiens
accacagcagagaccaccacauu

SEQ ID NO: 1260822 - RNA, 17 nt, Homo sapiens
accacagugaauccaga

SEQ ID NO: 1260823 - RNA, 18 nt, Homo sapiens
accacaugugcacaugca

SEQ ID NO: 1260824 - RNA, 17 nt, Homo sapiens
accacauuuagaacuuu

SEQ ID NO: 1260825 - RNA, 14 nt, Homo sapiens
accaccaagccaag

SEQ ID NO: 1260826 - RNA, 15 nt, Homo sapiens
accaccuuucacaaa

SEQ ID NO: 1260827 - RNA, 18 nt, Homo sapiens
accacgacuggccagggc

SEQ ID NO: 1260828 - RNA, 14 nt, Homo sapiens
accacgaggaaaag

SEQ ID NO: 1260829 - RNA, 21 nt, Homo sapiens
accacguccuuauuggaauaa

SEQ ID NO: 1260830 - RNA, 18 nt, Homo sapiens
accacuacaugcagccca

SEQ ID NO: 1260831 - RNA, 23 nt, Homo sapiens
accacucaggccaacaagccaac

SEQ ID NO: 1260832 - RNA, 12 nt, Homo sapiens
accacuccacuc

SEQ ID NO: 1260833 - RNA, 16 nt, Homo sapiens
accacucccaccacag

SEQ ID NO: 1260834 - RNA, 16 nt, Homo sapiens
accacugcacuccagc

SEQ ID NO: 1260835 - RNA, 11 nt, Homo sapiens
accacugccug

SEQ ID NO: 1260836 - RNA, 19 nt, Homo sapiens
accacuggccaccaggcug

SEQ ID NO: 1260837 - RNA, 14 nt, Homo sapiens
accacugggugaga

SEQ ID NO: 1260838 - RNA, 16 nt, Homo sapiens
accacuguguauuuaa

SEQ ID NO: 1260839 - RNA, 14 nt, Homo sapiens
accacuuaucacau

SEQ ID NO: 1260840 - RNA, 18 nt, Homo sapiens
accacuuuuaacagaaca

SEQ ID NO: 1260841 - RNA, 15 nt, Homo sapiens
accagaagccaaaga

SEQ ID NO: 1260842 - RNA, 21 nt, Homo sapiens
accagagaccguccucacccc

SEQ ID NO: 1260843 - RNA, 13 nt, Homo sapiens
accagagcauuuc

SEQ ID NO: 1260844 - RNA, 15 nt, Homo sapiens
accagagcauuucca

SEQ ID NO: 1260845 - RNA, 13 nt, Homo sapiens
accagagcugucu

SEQ ID NO: 1260846 - RNA, 11 nt, Homo sapiens
accagaggcag

SEQ ID NO: 1260847 - RNA, 14 nt, Homo sapiens
accagaucucaggc

SEQ ID NO: 1260848 - RNA, 13 nt, Homo sapiens
accagcacugucu

SEQ ID NO: 1260849 - RNA, 23 nt, Homo sapiens
accagccucaucaacacagugaa

SEQ ID NO: 1260850 - RNA, 15 nt, Homo sapiens
accagccugggcaac

SEQ ID NO: 1260851 - RNA, 22 nt, Homo sapiens
accagccuggucaacaugguga

SEQ ID NO: 1260852 - RNA, 17 nt, Homo sapiens
accagccuucccaacau

SEQ ID NO: 1260853 - RNA, 13 nt, Homo sapiens
accagcuacccug

SEQ ID NO: 1260854 - RNA, 14 nt, Homo sapiens
accagcugcucugc

SEQ ID NO: 1260855 - RNA, 15 nt, Homo sapiens
accagcuuugcagug

SEQ ID NO: 1260856 - RNA, 16 nt, Homo sapiens
accaggccaccucccc

SEQ ID NO: 1260857 - RNA, 11 nt, Homo sapiens
accagggacac

SEQ ID NO: 1260858 - RNA, 15 nt, Homo sapiens
accaggggugcucac

SEQ ID NO: 1260859 - RNA, 22 nt, Homo sapiens
accaggguccuuuugacacugc

SEQ ID NO: 1260860 - RNA, 18 nt, Homo sapiens
accagggugguugggacg

SEQ ID NO: 1260861 - RNA, 22 nt, Homo sapiens
accccagugguauccugugaca

SEQ ID NO: 1260862 - RNA, 23 nt, Homo sapiens
accccagugguauccugugacau

SEQ ID NO: 1260863 - RNA, 13 nt, Homo sapiens
acccccaacuccu

SEQ ID NO: 1260864 - RNA, 17 nt, Homo sapiens
acccccaccauccaggu

SEQ ID NO: 1260865 - RNA, 20 nt, Homo sapiens
acccccacccccagcucaau

SEQ ID NO: 1260866 - RNA, 14 nt, Homo sapiens
acccccagccaggc

SEQ ID NO: 1260867 - RNA, 14 nt, Homo sapiens
acccccccaaaaca

SEQ ID NO: 1260868 - RNA, 14 nt, Homo sapiens
accccgggcucucu

SEQ ID NO: 1260869 - RNA, 14 nt, Homo sapiens
accccuaggagcaa

SEQ ID NO: 1260870 - RNA, 20 nt, Homo sapiens
accccuccaggaaugaucuc

SEQ ID NO: 1260871 - RNA, 13 nt, Homo sapiens
accccuccucacu

SEQ ID NO: 1260872 - RNA, 21 nt, Homo sapiens
accccugaaacuggaccugca

SEQ ID NO: 1260873 - RNA, 22 nt, Homo sapiens
accccugaaacuggaccugcau

SEQ ID NO: 1260874 - RNA, 23 nt, Homo sapiens
accccugcccccagccccggggu

SEQ ID NO: 1260875 - RNA, 17 nt, Homo sapiens
accccugcuauauacua

SEQ ID NO: 1260876 - RNA, 13 nt, Homo sapiens
accccugcucagu

SEQ ID NO: 1260877 - RNA, 17 nt, Homo sapiens
accccugcucuacccau

SEQ ID NO: 1260878 - RNA, 22 nt, Homo sapiens
accccuggggggacuucccaaa

SEQ ID NO: 1260879 - RNA, 18 nt, Homo sapiens
accccuguccucacugcu

SEQ ID NO: 1260880 - RNA, 23 nt, Homo sapiens
accccuuacuuagcaugcacaaa

SEQ ID NO: 1260881 - RNA, 14 nt, Homo sapiens
accccuuagccucc

SEQ ID NO: 1260882 - RNA, 18 nt, Homo sapiens
accccuuagccucccuga

SEQ ID NO: 1260883 - RNA, 21 nt, Homo sapiens
accccuuccagaucacugcca

SEQ ID NO: 1260884 - RNA, 18 nt, Homo sapiens
accccuugguacugaaaa

SEQ ID NO: 1260885 - RNA, 14 nt, Homo sapiens
acccgaugcugcuu

SEQ ID NO: 1260886 - RNA, 17 nt, Homo sapiens
acccgccgccucccacg

SEQ ID NO: 1260887 - RNA, 16 nt, Homo sapiens
acccgcuccuacagcu

SEQ ID NO: 1260888 - RNA, 17 nt, Homo sapiens
acccgggggagcccagu

SEQ ID NO: 1260889 - RNA, 15 nt, Homo sapiens
acccguagaugccag

SEQ ID NO: 1260890 - RNA, 14 nt, Homo sapiens
acccguuaccauau

SEQ ID NO: 1260891 - RNA, 13 nt, Homo sapiens
acccuaaagggag

SEQ ID NO: 1260892 - RNA, 20 nt, Homo sapiens
acccuagccaaugucuccuc

SEQ ID NO: 1260893 - RNA, 18 nt, Homo sapiens
acccuagccagagaauag

SEQ ID NO: 1260894 - RNA, 13 nt, Homo sapiens
acccuagucccuu

SEQ ID NO: 1260895 - RNA, 16 nt, Homo sapiens
acccuaucuccugaca

SEQ ID NO: 1260896 - RNA, 20 nt, Homo sapiens
acccuauuuagaaauggauu

SEQ ID NO: 1260897 - RNA, 18 nt, Homo sapiens
acccucaggucacaagag

SEQ ID NO: 1260898 - RNA, 14 nt, Homo sapiens
acccucccaaaaca

SEQ ID NO: 1260899 - RNA, 16 nt, Homo sapiens
acccuccccuagucac

SEQ ID NO: 1260900 - RNA, 18 nt, Homo sapiens
acccuccuuccacaugua

SEQ ID NO: 1260901 - RNA, 22 nt, Homo sapiens
acccuccuuucaccacaugugc

SEQ ID NO: 1260902 - RNA, 19 nt, Homo sapiens
acccucgcaugacuguuac

SEQ ID NO: 1260903 - RNA, 13 nt, Homo sapiens
acccucuccagca

SEQ ID NO: 1260904 - RNA, 17 nt, Homo sapiens
acccucuccuccagugu

SEQ ID NO: 1260905 - RNA, 14 nt, Homo sapiens
acccugaaccuaug

SEQ ID NO: 1260906 - RNA, 21 nt, Homo sapiens
acccugaaugguuccaugccu

SEQ ID NO: 1260907 - RNA, 20 nt, Homo sapiens
acccugccaggcugcuaaag

SEQ ID NO: 1260908 - RNA, 15 nt, Homo sapiens
acccugcgauuuugc

SEQ ID NO: 1260909 - RNA, 16 nt, Homo sapiens
acccugcgauuuugcc

SEQ ID NO: 1260910 - RNA, 21 nt, Homo sapiens
acccugcgcaugaaccuggac

SEQ ID NO: 1260911 - RNA, 18 nt, Homo sapiens
acccugcuuuuugcuucu

SEQ ID NO: 1260912 - RNA, 21 nt, Homo sapiens
acccugggagccaguccucca

SEQ ID NO: 1260913 - RNA, 20 nt, Homo sapiens
acccuguaccucaucccaug

SEQ ID NO: 1260914 - RNA, 22 nt, Homo sapiens
acccugucaaguuaacaaggaa

SEQ ID NO: 1260915 - RNA, 21 nt, Homo sapiens
acccuguccggcccagugcca

SEQ ID NO: 1260916 - RNA, 22 nt, Homo sapiens
acccuguccggcccagugccac

SEQ ID NO: 1260917 - RNA, 18 nt, Homo sapiens
acccuguuuucagcuaaa

SEQ ID NO: 1260918 - RNA, 18 nt, Homo sapiens
acccuuccuucuguaaau

SEQ ID NO: 1260919 - RNA, 12 nt, Homo sapiens
acccuucugccu

SEQ ID NO: 1260920 - RNA, 15 nt, Homo sapiens
acccuugaaccaaua

SEQ ID NO: 1260921 - RNA, 20 nt, Homo sapiens
acccuugagaaggugcuuug

SEQ ID NO: 1260922 - RNA, 18 nt, Homo sapiens
acccuuggacaagacaaa

SEQ ID NO: 1260923 - RNA, 14 nt, Homo sapiens
acccuuugcugacu

SEQ ID NO: 1260924 - RNA, 14 nt, Homo sapiens
accgacuagccagg

SEQ ID NO: 1260925 - RNA, 15 nt, Homo sapiens
accgagggaagggcu

SEQ ID NO: 1260926 - RNA, 19 nt, Homo sapiens
accgaggugcuauccugcc

SEQ ID NO: 1260927 - RNA, 18 nt, Homo sapiens
accgagucuugcucuguu

SEQ ID NO: 1260928 - RNA, 20 nt, Homo sapiens
accgagucuugcucuguuac

SEQ ID NO: 1260929 - RNA, 12 nt, Homo sapiens
accgagugcaau

SEQ ID NO: 1260930 - RNA, 17 nt, Homo sapiens
accgauaagugugcuua

SEQ ID NO: 1260931 - RNA, 16 nt, Homo sapiens
accgcaaggagcaaac

SEQ ID NO: 1260932 - RNA, 23 nt, Homo sapiens
accgccccuugugcucgccucau

SEQ ID NO: 1260933 - RNA, 17 nt, Homo sapiens
accgcugccagcacaga

SEQ ID NO: 1260934 - RNA, 20 nt, Homo sapiens
accggaaggaggccaaccag

SEQ ID NO: 1260935 - RNA, 23 nt, Homo sapiens
accggaguuaugacaagcuuucc

SEQ ID NO: 1260936 - RNA, 18 nt, Homo sapiens
accgucacacucuucagu

SEQ ID NO: 1260937 - RNA, 13 nt, Homo sapiens
accgugaauuuau

SEQ ID NO: 1260938 - RNA, 14 nt, Homo sapiens
accgugaccaucuu

SEQ ID NO: 1260939 - RNA, 18 nt, Homo sapiens
accguguaccucaguucc

SEQ ID NO: 1260940 - RNA, 15 nt, Homo sapiens
accgugucaccuacg

SEQ ID NO: 1260941 - RNA, 22 nt, Homo sapiens
accuaaaaauguaggcuuucau

SEQ ID NO: 1260942 - RNA, 19 nt, Homo sapiens
accuaaaauaauugguucu

SEQ ID NO: 1260943 - RNA, 20 nt, Homo sapiens
accuaaacgguucaguuucu

SEQ ID NO: 1260944 - RNA, 16 nt, Homo sapiens
accuaaauuugguucu

SEQ ID NO: 1260945 - RNA, 19 nt, Homo sapiens
accuaacauuauacuucau

SEQ ID NO: 1260946 - RNA, 14 nt, Homo sapiens
accuaaccacuuag

SEQ ID NO: 1260947 - RNA, 14 nt, Homo sapiens
accuacauuaucuc

SEQ ID NO: 1260948 - RNA, 16 nt, Homo sapiens
accuaccaucagggac

SEQ ID NO: 1260949 - RNA, 20 nt, Homo sapiens
accuacugcuuacuguugcu

SEQ ID NO: 1260950 - RNA, 21 nt, Homo sapiens
accuacuuugacuuuuugcau

SEQ ID NO: 1260951 - RNA, 20 nt, Homo sapiens
accuacuuuucuuuccucag

SEQ ID NO: 1260952 - RNA, 18 nt, Homo sapiens
accuagaacacuaacuca

SEQ ID NO: 1260953 - RNA, 20 nt, Homo sapiens
accuagcuuuauucuucaga

SEQ ID NO: 1260954 - RNA, 15 nt, Homo sapiens
accuagggcacuuua

SEQ ID NO: 1260955 - RNA, 14 nt, Homo sapiens
accuaguuugcacu

SEQ ID NO: 1260956 - RNA, 13 nt, Homo sapiens
accuauaaaucau

SEQ ID NO: 1260957 - RNA, 15 nt, Homo sapiens
accuauacauuauau

SEQ ID NO: 1260958 - RNA, 12 nt, Homo sapiens
accuauaccaau

SEQ ID NO: 1260959 - RNA, 22 nt, Homo sapiens
accucaacauugcauggugcua

SEQ ID NO: 1260960 - RNA, 18 nt, Homo sapiens
accucaagcccugagggg

SEQ ID NO: 1260961 - RNA, 21 nt, Homo sapiens
accucaccccguuacagcucc

SEQ ID NO: 1260962 - RNA, 13 nt, Homo sapiens
accucacugugac

SEQ ID NO: 1260963 - RNA, 16 nt, Homo sapiens
accucagacacucuga

SEQ ID NO: 1260964 - RNA, 16 nt, Homo sapiens
accucagacuuaccag

SEQ ID NO: 1260965 - RNA, 18 nt, Homo sapiens
accucaggcacuagccuu

SEQ ID NO: 1260966 - RNA, 12 nt, Homo sapiens
accucaggugau

SEQ ID NO: 1260967 - RNA, 18 nt, Homo sapiens
accucaguuauuacaugu

SEQ ID NO: 1260968 - RNA, 20 nt, Homo sapiens
accucaguucccucuugcuc

SEQ ID NO: 1260969 - RNA, 23 nt, Homo sapiens
accucauagcuaauuuuugcaaa

SEQ ID NO: 1260970 - RNA, 11 nt, Homo sapiens
accucaucucc

SEQ ID NO: 1260971 - RNA, 18 nt, Homo sapiens
accucauguuuaugaaaa

SEQ ID NO: 1260972 - RNA, 23 nt, Homo sapiens
accucauuggccagcucauaaaa

SEQ ID NO: 1260973 - RNA, 17 nt, Homo sapiens
accucauuuuaguugcc

SEQ ID NO: 1260974 - RNA, 20 nt, Homo sapiens
accuccaacaacgacacauu

SEQ ID NO: 1260975 - RNA, 16 nt, Homo sapiens
accuccaccugugaga

SEQ ID NO: 1260976 - RNA, 14 nt, Homo sapiens
accuccacugcugc

SEQ ID NO: 1260977 - RNA, 17 nt, Homo sapiens
accuccagacaccagug

SEQ ID NO: 1260978 - RNA, 14 nt, Homo sapiens
accuccccacugcc

SEQ ID NO: 1260979 - RNA, 21 nt, Homo sapiens
accucccccaaugucuucaag

SEQ ID NO: 1260980 - RNA, 20 nt, Homo sapiens
accucccugcucagugcuug

SEQ ID NO: 1260981 - RNA, 15 nt, Homo sapiens
accuccgccaaugca

SEQ ID NO: 1260982 - RNA, 18 nt, Homo sapiens
accuccgccagauccugc

SEQ ID NO: 1260983 - RNA, 20 nt, Homo sapiens
accuccgccagauccugcag

SEQ ID NO: 1260984 - RNA, 16 nt, Homo sapiens
accuccuccucuggac

SEQ ID NO: 1260985 - RNA, 13 nt, Homo sapiens
accuccuguggaa

SEQ ID NO: 1260986 - RNA, 15 nt, Homo sapiens
accucggagggaugg

SEQ ID NO: 1260987 - RNA, 17 nt, Homo sapiens
agauguucacuguggca

SEQ ID NO: 1260988 - RNA, 12 nt, Homo sapiens
agauguuuauuu

SEQ ID NO: 1260989 - RNA, 14 nt, Homo sapiens
agauguuuauuuca

SEQ ID NO: 1260990 - RNA, 19 nt, Homo sapiens
agauguuucaacugugcuc

SEQ ID NO: 1260991 - RNA, 16 nt, Homo sapiens
agauuaauggcacuga

SEQ ID NO: 1260992 - RNA, 20 nt, Homo sapiens
agauuagaagacaacaggca

SEQ ID NO: 1260993 - RNA, 14 nt, Homo sapiens
agauuagucucuuc

SEQ ID NO: 1260994 - RNA, 19 nt, Homo sapiens
agauuagucucuucugugu

SEQ ID NO: 1260995 - RNA, 22 nt, Homo sapiens
agauuauagaaguagcaaaaag

SEQ ID NO: 1260996 - RNA, 16 nt, Homo sapiens
agauuauagauucuaa

SEQ ID NO: 1260997 - RNA, 22 nt, Homo sapiens
agauuauuaucuauuaucucaa

SEQ ID NO: 1260998 - RNA, 23 nt, Homo sapiens
agauuauuaucuauuaucucaau

SEQ ID NO: 1260999 - RNA, 15 nt, Homo sapiens
agauuccggauccua

SEQ ID NO: 1261000 - RNA, 16 nt, Homo sapiens
agauuccuaugaugga

SEQ ID NO: 1261001 - RNA, 19 nt, Homo sapiens
agauucuaaugaugaucaa

SEQ ID NO: 1261002 - RNA, 17 nt, Homo sapiens
agauucuagaugauuaa

SEQ ID NO: 1261003 - RNA, 17 nt, Homo sapiens
agauucucugugucuaa

SEQ ID NO: 1261004 - RNA, 21 nt, Homo sapiens
agauucucuuguauaagaucc

SEQ ID NO: 1261005 - RNA, 13 nt, Homo sapiens
agauucuguggaa

SEQ ID NO: 1261006 - RNA, 19 nt, Homo sapiens
agauugcaccacugcacuc

SEQ ID NO: 1261007 - RNA, 20 nt, Homo sapiens
agauuggcaccccuuucuag

SEQ ID NO: 1261008 - RNA, 15 nt, Homo sapiens
agauuuaaagcacau

SEQ ID NO: 1261009 - RNA, 16 nt, Homo sapiens
agauuuaaagcacaug

SEQ ID NO: 1261010 - RNA, 17 nt, Homo sapiens
agauuuaaagcacaugc

SEQ ID NO: 1261011 - RNA, 15 nt, Homo sapiens
agauuuaacacuaaa

SEQ ID NO: 1261012 - RNA, 17 nt, Homo sapiens
agauuuaggagcagaaa

SEQ ID NO: 1261013 - RNA, 14 nt, Homo sapiens
agauuucagaucau

SEQ ID NO: 1261014 - RNA, 16 nt, Homo sapiens
agauuugauauuugca

SEQ ID NO: 1261015 - RNA, 23 nt, Homo sapiens
agauuugcccauuuacacuuuug

SEQ ID NO: 1261016 - RNA, 22 nt, Homo sapiens
agauuuggaugcacucauuuaa

SEQ ID NO: 1261017 - RNA, 15 nt, Homo sapiens
agcaaaaggcagcuc

SEQ ID NO: 1261018 - RNA, 16 nt, Homo sapiens
agcaaaaggcugagaa

SEQ ID NO: 1261019 - RNA, 17 nt, Homo sapiens
agcaaacgggagaaauu

SEQ ID NO: 1261020 - RNA, 19 nt, Homo sapiens
agcaaagauuaaauguguc

SEQ ID NO: 1261021 - RNA, 13 nt, Homo sapiens
agcaaagcaaaag

SEQ ID NO: 1261022 - RNA, 16 nt, Homo sapiens
agcaaagcugaugaca

SEQ ID NO: 1261023 - RNA, 16 nt, Homo sapiens
agcaaaucgugccuug

SEQ ID NO: 1261024 - RNA, 22 nt, Homo sapiens
agcaaaucuacuucaacacuuc

SEQ ID NO: 1261025 - RNA, 16 nt, Homo sapiens
agcaaauguggcuccu

SEQ ID NO: 1261026 - RNA, 21 nt, Homo sapiens
agcaaauguuaaaaguuuuau

SEQ ID NO: 1261027 - RNA, 16 nt, Homo sapiens
agcaaauuugugguug

SEQ ID NO: 1261028 - RNA, 15 nt, Homo sapiens
agcaacaagaccacc

SEQ ID NO: 1261029 - RNA, 16 nt, Homo sapiens
agcaacacaauguuau

SEQ ID NO: 1261030 - RNA, 17 nt, Homo sapiens
agcaacccuaacaguaa

SEQ ID NO: 1261031 - RNA, 21 nt, Homo sapiens
agcaaccuuguaagcuaucug

SEQ ID NO: 1261032 - RNA, 16 nt, Homo sapiens
agcaacucuugauuau

SEQ ID NO: 1261033 - RNA, 14 nt, Homo sapiens
agcaacugucuuau

SEQ ID NO: 1261034 - RNA, 17 nt, Homo sapiens
agcaagacauacuuaau

SEQ ID NO: 1261035 - RNA, 20 nt, Homo sapiens
agcaagacauacuuaaugca

SEQ ID NO: 1261036 - RNA, 16 nt, Homo sapiens
agcaagggggcccaaa

SEQ ID NO: 1261037 - RNA, 15 nt, Homo sapiens
agcaaggucauuucu

SEQ ID NO: 1261038 - RNA, 23 nt, Homo sapiens
agcaaggucauuucuucagucag

SEQ ID NO: 1261039 - RNA, 16 nt, Homo sapiens
agcaaguuuucuucca

SEQ ID NO: 1261040 - RNA, 21 nt, Homo sapiens
agcaauaacauacaugagaua

SEQ ID NO: 1261041 - RNA, 18 nt, Homo sapiens
agcaauaccagcaauuca

SEQ ID NO: 1261042 - RNA, 16 nt, Homo sapiens
agcaauacuaagggaa

SEQ ID NO: 1261043 - RNA, 22 nt, Homo sapiens
agcaauauaucugaagagcuau

SEQ ID NO: 1261044 - RNA, 23 nt, Homo sapiens
agcaauauuuauggaugcaacac

SEQ ID NO: 1261045 - RNA, 18 nt, Homo sapiens
agcaaugacaucucaggg

SEQ ID NO: 1261046 - RNA, 14 nt, Homo sapiens
agcaaugaugucca

SEQ ID NO: 1261047 - RNA, 20 nt, Homo sapiens
agcaaugcaagcagccuagc

SEQ ID NO: 1261048 - RNA, 20 nt, Homo sapiens
agcaaugcugaugaaucacu

SEQ ID NO: 1261049 - RNA, 22 nt, Homo sapiens
agcaaugcugaugaaucacugu

SEQ ID NO: 1261050 - RNA, 22 nt, Homo sapiens
agcaggccggaaccacagggcc

SEQ ID NO: 1261051 - RNA, 18 nt, Homo sapiens
agcagggauuaaccucug

SEQ ID NO: 1261052 - RNA, 19 nt, Homo sapiens
agcagggauuagguguuca

SEQ ID NO: 1261053 - RNA, 16 nt, Homo sapiens
agcaggggcuccagca

SEQ ID NO: 1261054 - RNA, 19 nt, Homo sapiens
agcaggggggcugugccaa

SEQ ID NO: 1261055 - RNA, 13 nt, Homo sapiens
agcaggugguggu

SEQ ID NO: 1261056 - RNA, 13 nt, Homo sapiens
agcaguagcauca

SEQ ID NO: 1261057 - RNA, 16 nt, Homo sapiens
agcagucaauacaaau

SEQ ID NO: 1261058 - RNA, 19 nt, Homo sapiens
agcagucccaguauucuca

SEQ ID NO: 1261059 - RNA, 21 nt, Homo sapiens
agcagucccaguauucucaga

SEQ ID NO: 1261060 - RNA, 19 nt, Homo sapiens
agcagucgaccgcacuuau

SEQ ID NO: 1261061 - RNA, 15 nt, Homo sapiens
agcagucgugccugu

SEQ ID NO: 1261062 - RNA, 13 nt, Homo sapiens
agcagucuugcuc

SEQ ID NO: 1261063 - RNA, 13 nt, Homo sapiens
agcagugccagcu

SEQ ID NO: 1261064 - RNA, 13 nt, Homo sapiens
agcauaacaccaa

SEQ ID NO: 1261065 - RNA, 14 nt, Homo sapiens
agcauaaguauaca

SEQ ID NO: 1261066 - RNA, 15 nt, Homo sapiens
agcauaccacuugaa

SEQ ID NO: 1261067 - RNA, 20 nt, Homo sapiens
agcauagcagaggggccagg

SEQ ID NO: 1261068 - RNA, 22 nt, Homo sapiens
agcauauaggugauguuugcuc

SEQ ID NO: 1261069 - RNA, 18 nt, Homo sapiens
agcauauguguuacuuca

SEQ ID NO: 1261070 - RNA, 19 nt, Homo sapiens
agcauauuuuaaugcaguu

SEQ ID NO: 1261071 - RNA, 13 nt, Homo sapiens
agcaucaauacaa

SEQ ID NO: 1261072 - RNA, 16 nt, Homo sapiens
agcaucaccucaggcc

SEQ ID NO: 1261073 - RNA, 23 nt, Homo sapiens
agcaucacuccccaaggaagagc

SEQ ID NO: 1261074 - RNA, 11 nt, Homo sapiens
agcauccaugu

SEQ ID NO: 1261075 - RNA, 18 nt, Homo sapiens
agcauccucucucacaug

SEQ ID NO: 1261076 - RNA, 20 nt, Homo sapiens
agcauccucucucacaugga

SEQ ID NO: 1261077 - RNA, 18 nt, Homo sapiens
agcaucucccagcaagac

SEQ ID NO: 1261078 - RNA, 14 nt, Homo sapiens
agcaucucugagca

SEQ ID NO: 1261079 - RNA, 21 nt, Homo sapiens
agcaucuguagugacccacug

SEQ ID NO: 1261080 - RNA, 21 nt, Homo sapiens
agcaugaaaaucacacugucu

SEQ ID NO: 1261081 - RNA, 20 nt, Homo sapiens
agcaugaaaguggacaagga

SEQ ID NO: 1261082 - RNA, 17 nt, Homo sapiens
agcaugaggacagacca

SEQ ID NO: 1261083 - RNA, 21 nt, Homo sapiens
agcaugauacaaauuccacag

SEQ ID NO: 1261084 - RNA, 19 nt, Homo sapiens
agcaugaugggaauaggga

SEQ ID NO: 1261085 - RNA, 15 nt, Homo sapiens
agcaugcagcuuugc

SEQ ID NO: 1261086 - RNA, 20 nt, Homo sapiens
agcaugcauccuuugcacug

SEQ ID NO: 1261087 - RNA, 23 nt, Homo sapiens
agcaugcuucccagagggagcag

SEQ ID NO: 1261088 - RNA, 18 nt, Homo sapiens
agcauggaggaggaggga

SEQ ID NO: 1261089 - RNA, 15 nt, Homo sapiens
agcauguacuccccu

SEQ ID NO: 1261090 - RNA, 22 nt, Homo sapiens
agcauguguauuuccagugcaa

SEQ ID NO: 1261091 - RNA, 16 nt, Homo sapiens
agcauuaacugucuua

SEQ ID NO: 1261092 - RNA, 15 nt, Homo sapiens
agcauuacccuccuc

SEQ ID NO: 1261093 - RNA, 21 nt, Homo sapiens
agcauuaguuguuauuauuaa

SEQ ID NO: 1261094 - RNA, 20 nt, Homo sapiens
agcauucaagaaacugauga

SEQ ID NO: 1261095 - RNA, 18 nt, Homo sapiens
agcauucuugucacaaua

SEQ ID NO: 1261096 - RNA, 19 nt, Homo sapiens
agcauucuugucacaauaa

SEQ ID NO: 1261097 - RNA, 18 nt, Homo sapiens
agcauuuccaacaccaca

SEQ ID NO: 1261098 - RNA, 20 nt, Homo sapiens
agcauuuccaacaccacaga

SEQ ID NO: 1261099 - RNA, 22 nt, Homo sapiens
agcauuuccaacaccacagaca

SEQ ID NO: 1261100 - RNA, 22 nt, Homo sapiens
agcauuucuagcagugaugaaa

SEQ ID NO: 1261101 - RNA, 13 nt, Homo sapiens
agcauuugcaaca

SEQ ID NO: 1261102 - RNA, 12 nt, Homo sapiens
agcauuugcacc

SEQ ID NO: 1261103 - RNA, 14 nt, Homo sapiens
agcauuugcaccuc

SEQ ID NO: 1261104 - RNA, 16 nt, Homo sapiens
agccaaacucugccag

SEQ ID NO: 1261105 - RNA, 16 nt, Homo sapiens
agccaaagaacaaaua

SEQ ID NO: 1261106 - RNA, 12 nt, Homo sapiens
agccaaagggac

SEQ ID NO: 1261107 - RNA, 22 nt, Homo sapiens
agccaaagggacuggcagucug

SEQ ID NO: 1261108 - RNA, 23 nt, Homo sapiens
agccaaauaaaaucuauacauac

SEQ ID NO: 1261109 - RNA, 15 nt, Homo sapiens
agccaaaugcaggga

SEQ ID NO: 1261110 - RNA, 20 nt, Homo sapiens
agccaacacccugucuaaaa

SEQ ID NO: 1261111 - RNA, 12 nt, Homo sapiens
agccaaccucau

SEQ ID NO: 1261112 - RNA, 13 nt, Homo sapiens
agccaagggcuga

SEQ ID NO: 1261113 - RNA, 17 nt, Homo sapiens
agccaaguggggugcug

SEQ ID NO: 1261114 - RNA, 13 nt, Homo sapiens
agcccgucucagu

SEQ ID NO: 1261115 - RNA, 20 nt, Homo sapiens
agcccguuagccccagggau

SEQ ID NO: 1261116 - RNA, 19 nt, Homo sapiens
agcccuaauagcagaaaua

SEQ ID NO: 1261117 - RNA, 21 nt, Homo sapiens
agcccuacucggauggggcac

SEQ ID NO: 1261118 - RNA, 18 nt, Homo sapiens
agcccucaacuauucugu

SEQ ID NO: 1261119 - RNA, 18 nt, Homo sapiens
agcccuccaaaagcacuu

SEQ ID NO: 1261120 - RNA, 13 nt, Homo sapiens
agcccugcagcua

SEQ ID NO: 1261121 - RNA, 12 nt, Homo sapiens
agcccugccagg

SEQ ID NO: 1261122 - RNA, 20 nt, Homo sapiens
agcccugggguuugaagcug

SEQ ID NO: 1261123 - RNA, 23 nt, Homo sapiens
agcccugugcagcagcuucccuu

SEQ ID NO: 1261124 - RNA, 17 nt, Homo sapiens
agcccuguuggcagcuc

SEQ ID NO: 1261125 - RNA, 21 nt, Homo sapiens
agcccuguuggcagcucuagc

SEQ ID NO: 1261126 - RNA, 21 nt, Homo sapiens
agcccuugucccuuuuaauau

SEQ ID NO: 1261127 - RNA, 14 nt, Homo sapiens
agccggcacagggu

SEQ ID NO: 1261128 - RNA, 15 nt, Homo sapiens
agccgggaaggggaa

SEQ ID NO: 1261129 - RNA, 12 nt, Homo sapiens
agccuaacacgg

SEQ ID NO: 1261130 - RNA, 21 nt, Homo sapiens
agccuaauaacgugaaacuua

SEQ ID NO: 1261131 - RNA, 22 nt, Homo sapiens
agccuacuuucacacuaagaaa

SEQ ID NO: 1261132 - RNA, 16 nt, Homo sapiens
agccuaggugacagag

SEQ ID NO: 1261133 - RNA, 18 nt, Homo sapiens
agccuaggugacagagug

SEQ ID NO: 1261134 - RNA, 15 nt, Homo sapiens
agccuauauuuacag

SEQ ID NO: 1261135 - RNA, 22 nt, Homo sapiens
agccuaugaggggguuuggcac

SEQ ID NO: 1261136 - RNA, 17 nt, Homo sapiens
agccucaccaaggugac

SEQ ID NO: 1261137 - RNA, 23 nt, Homo sapiens
agccucagaaggacccuguugag

SEQ ID NO: 1261138 - RNA, 18 nt, Homo sapiens
agccucagcggacaagca

SEQ ID NO: 1261139 - RNA, 22 nt, Homo sapiens
agccucagcggacaagcagcug

SEQ ID NO: 1261140 - RNA, 14 nt, Homo sapiens
agccucauucugag

SEQ ID NO: 1261141 - RNA, 14 nt, Homo sapiens
agccuccaacacaa

SEQ ID NO: 1261142 - RNA, 14 nt, Homo sapiens
agccuccagcaccu

SEQ ID NO: 1261143 - RNA, 16 nt, Homo sapiens
agccuccagguuuccu

SEQ ID NO: 1261144 - RNA, 22 nt, Homo sapiens
agccucccaaagugcugagauu

SEQ ID NO: 1261145 - RNA, 19 nt, Homo sapiens
agccuccccgugccaaaaa

SEQ ID NO: 1261146 - RNA, 23 nt, Homo sapiens
agccuccccuuggcggggagaag

SEQ ID NO: 1261147 - RNA, 17 nt, Homo sapiens
agccucccucugaccug

SEQ ID NO: 1261148 - RNA, 18 nt, Homo sapiens
agccucccuucugccuug

SEQ ID NO: 1261149 - RNA, 19 nt, Homo sapiens
agccuccgcgccuugccuc

SEQ ID NO: 1261150 - RNA, 21 nt, Homo sapiens
agccuccuccaccucaccucc

SEQ ID NO: 1261151 - RNA, 17 nt, Homo sapiens
agccucgccaacauggu

SEQ ID NO: 1261152 - RNA, 15 nt, Homo sapiens
agccucucaccugga

SEQ ID NO: 1261153 - RNA, 14 nt, Homo sapiens
agccucuccaggaa

SEQ ID NO: 1261154 - RNA, 11 nt, Homo sapiens
agccucugggg

SEQ ID NO: 1261155 - RNA, 23 nt, Homo sapiens
agccucuugagcugaaguaaugu

SEQ ID NO: 1261156 - RNA, 23 nt, Homo sapiens
agccugaaacucauagacacuga

SEQ ID NO: 1261157 - RNA, 23 nt, Homo sapiens
agccugaaugucuuacugugauc

SEQ ID NO: 1261158 - RNA, 22 nt, Homo sapiens
agccugacagaaggaacacugc

SEQ ID NO: 1261159 - RNA, 14 nt, Homo sapiens
agccugagccuuag

SEQ ID NO: 1261160 - RNA, 17 nt, Homo sapiens
agccugaggcagccacu

SEQ ID NO: 1261161 - RNA, 23 nt, Homo sapiens
agccugcaguuauuaacacuaac

SEQ ID NO: 1261162 - RNA, 19 nt, Homo sapiens
agccuggccccggccuuua

SEQ ID NO: 1261163 - RNA, 14 nt, Homo sapiens
agccugggcaacau

SEQ ID NO: 1261164 - RNA, 15 nt, Homo sapiens
agccugggccugggu

SEQ ID NO: 1261165 - RNA, 22 nt, Homo sapiens
agccugggcguacagagcacau

SEQ ID NO: 1261166 - RNA, 15 nt, Homo sapiens
agccugucccaugga

SEQ ID NO: 1261167 - RNA, 23 nt, Homo sapiens
agccugucccauggacacuccag

SEQ ID NO: 1261168 - RNA, 22 nt, Homo sapiens
agccugugcauguaugucuugg

SEQ ID NO: 1261169 - RNA, 23 nt, Homo sapiens
agccugugcgucccagcugaagg

SEQ ID NO: 1261170 - RNA, 17 nt, Homo sapiens
agccugugcuguggcau

SEQ ID NO: 1261171 - RNA, 14 nt, Homo sapiens
agccuguuauauuc

SEQ ID NO: 1261172 - RNA, 17 nt, Homo sapiens
agccuuaaaaugcauug

SEQ ID NO: 1261173 - RNA, 19 nt, Homo sapiens
agccuuaaaaugcauugaa

SEQ ID NO: 1261174 - RNA, 15 nt, Homo sapiens
agccuuaauuugcac

SEQ ID NO: 1261175 - RNA, 17 nt, Homo sapiens
agccuuaauuugcacag

SEQ ID NO: 1261176 - RNA, 20 nt, Homo sapiens
agccuuaauuugcacagugu

SEQ ID NO: 1261177 - RNA, 14 nt, Homo sapiens
agccuuagaaguca

SEQ ID NO: 1261178 - RNA, 19 nt, Homo sapiens
agccuuagaagucacacag

SEQ ID NO: 1261179 - RNA, 13 nt, Homo sapiens
aggucuccaaaau

SEQ ID NO: 1261180 - RNA, 17 nt, Homo sapiens
aggucuccaaaccagac

SEQ ID NO: 1261181 - RNA, 16 nt, Homo sapiens
aggucugacacgucug

SEQ ID NO: 1261182 - RNA, 20 nt, Homo sapiens
aggucuguacguuaccucuu

SEQ ID NO: 1261183 - RNA, 15 nt, Homo sapiens
aggucuuaguaccag

SEQ ID NO: 1261184 - RNA, 18 nt, Homo sapiens
aggucuucaaucuuaaaa

SEQ ID NO: 1261185 - RNA, 11 nt, Homo sapiens
aggucuuccag

SEQ ID NO: 1261186 - RNA, 14 nt, Homo sapiens
aggucuuccagacc

SEQ ID NO: 1261187 - RNA, 21 nt, Homo sapiens
aggugaauaaacacacagauc

SEQ ID NO: 1261188 - RNA, 21 nt, Homo sapiens
aggugacaugugaaaccuuuu

SEQ ID NO: 1261189 - RNA, 15 nt, Homo sapiens
aggugacauuugcuc

SEQ ID NO: 1261190 - RNA, 16 nt, Homo sapiens
aggugacccugaugaa

SEQ ID NO: 1261191 - RNA, 13 nt, Homo sapiens
aggugaggcccaa

SEQ ID NO: 1261192 - RNA, 14 nt, Homo sapiens
aggugaggcccaag

SEQ ID NO: 1261193 - RNA, 19 nt, Homo sapiens
aggugaguuugagcugccu

SEQ ID NO: 1261194 - RNA, 17 nt, Homo sapiens
aggugauccaccugccu

SEQ ID NO: 1261195 - RNA, 15 nt, Homo sapiens
aggugaucuaccugc

SEQ ID NO: 1261196 - RNA, 15 nt, Homo sapiens
aggugaucucuggga

SEQ ID NO: 1261197 - RNA, 15 nt, Homo sapiens
aggugcagcuccuca

SEQ ID NO: 1261198 - RNA, 18 nt, Homo sapiens
aggugcauagcaagugaa

SEQ ID NO: 1261199 - RNA, 20 nt, Homo sapiens
aggugcccucggagugccac

SEQ ID NO: 1261200 - RNA, 21 nt, Homo sapiens
aggugcccucggagugccaca

SEQ ID NO: 1261201 - RNA, 14 nt, Homo sapiens
aggugccucagacu

SEQ ID NO: 1261202 - RNA, 18 nt, Homo sapiens
aggugcuacaacauguga

SEQ ID NO: 1261203 - RNA, 15 nt, Homo sapiens
aggugcuucuucacu

SEQ ID NO: 1261204 - RNA, 15 nt, Homo sapiens
aggugcuuggaguuu

SEQ ID NO: 1261205 - RNA, 22 nt, Homo sapiens
agguggaaacuccugugucugu

SEQ ID NO: 1261206 - RNA, 20 nt, Homo sapiens
agguggagugucacaucucu

SEQ ID NO: 1261207 - RNA, 11 nt, Homo sapiens
agguggcaagc

SEQ ID NO: 1261208 - RNA, 10 nt, Homo sapiens
agguggcacu

SEQ ID NO: 1261209 - RNA, 15 nt, Homo sapiens
agguggccacuccag

SEQ ID NO: 1261210 - RNA, 15 nt, Homo sapiens
aggugggaggaucac

SEQ ID NO: 1261211 - RNA, 21 nt, Homo sapiens
aggugggcaugccacccucac

SEQ ID NO: 1261212 - RNA, 12 nt, Homo sapiens
aggugggugcug

SEQ ID NO: 1261213 - RNA, 14 nt, Homo sapiens
aggugggugcugcc

SEQ ID NO: 1261214 - RNA, 20 nt, Homo sapiens
agguggguuuguaccuuccu

SEQ ID NO: 1261215 - RNA, 15 nt, Homo sapiens
agguggugaggcaau

SEQ ID NO: 1261216 - RNA, 16 nt, Homo sapiens
aggugguggcacugag

SEQ ID NO: 1261217 - RNA, 17 nt, Homo sapiens
agguguaacacuuguca

SEQ ID NO: 1261218 - RNA, 16 nt, Homo sapiens
aggugucauaugacug

SEQ ID NO: 1261219 - RNA, 21 nt, Homo sapiens
agguguccuuuccccucucug

SEQ ID NO: 1261220 - RNA, 21 nt, Homo sapiens
aggugucuauuuggacucuaa

SEQ ID NO: 1261221 - RNA, 23 nt, Homo sapiens
aggugucugagaugggcccguac

SEQ ID NO: 1261222 - RNA, 20 nt, Homo sapiens
agguuaaaaaaaaaagucac

SEQ ID NO: 1261223 - RNA, 16 nt, Homo sapiens
agguuacaagccugca

SEQ ID NO: 1261224 - RNA, 19 nt, Homo sapiens
agguuacuaaaacagggug

SEQ ID NO: 1261225 - RNA, 18 nt, Homo sapiens
agguuaucgaaauaacaa

SEQ ID NO: 1261226 - RNA, 13 nt, Homo sapiens
agguucacugagc

SEQ ID NO: 1261227 - RNA, 11 nt, Homo sapiens
agguucacuuu

SEQ ID NO: 1261228 - RNA, 20 nt, Homo sapiens
agguucacuuuggauaugau

SEQ ID NO: 1261229 - RNA, 14 nt, Homo sapiens
agguucagccugaa

SEQ ID NO: 1261230 - RNA, 16 nt, Homo sapiens
agguucagcugaagcu

SEQ ID NO: 1261231 - RNA, 19 nt, Homo sapiens
agguuccuuaucugucaca

SEQ ID NO: 1261232 - RNA, 20 nt, Homo sapiens
agguucuagguuucaaagau

SEQ ID NO: 1261233 - RNA, 17 nt, Homo sapiens
agguucugguuccauuu

SEQ ID NO: 1261234 - RNA, 18 nt, Homo sapiens
agguucuucagggccagu

SEQ ID NO: 1261235 - RNA, 19 nt, Homo sapiens
agguucuucuaaaauugaa

SEQ ID NO: 1261236 - RNA, 13 nt, Homo sapiens
agguugcagugag

SEQ ID NO: 1261237 - RNA, 17 nt, Homo sapiens
agguuggugaauuucac

SEQ ID NO: 1261238 - RNA, 22 nt, Homo sapiens
agguuggugaauuucacaagcu

SEQ ID NO: 1261239 - RNA, 22 nt, Homo sapiens
agguuucacccuuaacccaagg

SEQ ID NO: 1261240 - RNA, 20 nt, Homo sapiens
agguuucaccugaucauaua

SEQ ID NO: 1261241 - RNA, 15 nt, Homo sapiens
agguuuuuacuguga

SEQ ID NO: 1261242 - RNA, 16 nt, Homo sapiens
aguaaaagcuacuaug

SEQ ID NO: 1261243 - RNA, 17 nt, Homo sapiens
aguaaaagcuacuaugu

SEQ ID NO: 1261244 - RNA, 13 nt, Homo sapiens
aguaaacaaugaa

SEQ ID NO: 1261245 - RNA, 14 nt, Homo sapiens
aguaaaccaaaaag

SEQ ID NO: 1261246 - RNA, 13 nt, Homo sapiens
aguaaaucucaca

SEQ ID NO: 1261247 - RNA, 17 nt, Homo sapiens
aguaacaggaaaccacu

SEQ ID NO: 1261248 - RNA, 14 nt, Homo sapiens
aguaacauuugccu

SEQ ID NO: 1261249 - RNA, 21 nt, Homo sapiens
aguaaccauggggaagaaauc

SEQ ID NO: 1261250 - RNA, 16 nt, Homo sapiens
aguaaccauuugcacu

SEQ ID NO: 1261251 - RNA, 13 nt, Homo sapiens
aguaaccuaguga

SEQ ID NO: 1261252 - RNA, 17 nt, Homo sapiens
aguaagaugcacugaaa

SEQ ID NO: 1261253 - RNA, 18 nt, Homo sapiens
aucuagugcuagauguau

SEQ ID NO: 1261254 - RNA, 17 nt, Homo sapiens
aucuaguuuacagaaaa

SEQ ID NO: 1261255 - RNA, 19 nt, Homo sapiens
aucuauaaagaagaacuug

SEQ ID NO: 1261256 - RNA, 13 nt, Homo sapiens
aucuauacauacc

SEQ ID NO: 1261257 - RNA, 19 nt, Homo sapiens
aucuaugagcugacaucuc

SEQ ID NO: 1261258 - RNA, 19 nt, Homo sapiens
aucuauguuugugugauuu

SEQ ID NO: 1261259 - RNA, 21 nt, Homo sapiens
aucuauucuguguugcauuau

SEQ ID NO: 1261260 - RNA, 12 nt, Homo sapiens
aucuauugcuca

SEQ ID NO: 1261261 - RNA, 15 nt, Homo sapiens
aucuauugcucauca

SEQ ID NO: 1261262 - RNA, 18 nt, Homo sapiens
aucuauugcucaucagcu

SEQ ID NO: 1261263 - RNA, 21 nt, Homo sapiens
aucuauugcucaucagcuuua

SEQ ID NO: 1261264 - RNA, 22 nt, Homo sapiens
aucucacaaguaggaucaagaa

SEQ ID NO: 1261265 - RNA, 16 nt, Homo sapiens
aucucaccccauccca

SEQ ID NO: 1261266 - RNA, 21 nt, Homo sapiens
aucucacuggaugcaaagaaa

SEQ ID NO: 1261267 - RNA, 21 nt, Homo sapiens
aucucagagguagggcugcca

SEQ ID NO: 1261268 - RNA, 12 nt, Homo sapiens
aucucagcacuu

SEQ ID NO: 1261269 - RNA, 13 nt, Homo sapiens
aucucagcacuuu

SEQ ID NO: 1261270 - RNA, 18 nt, Homo sapiens
aucucagcgugggccaga

SEQ ID NO: 1261271 - RNA, 23 nt, Homo sapiens
aucucaggauaaaguuugcuaag

SEQ ID NO: 1261272 - RNA, 23 nt, Homo sapiens
aucucauucccagagucagagga

SEQ ID NO: 1261273 - RNA, 18 nt, Homo sapiens
aucucauuuuacacaaag

SEQ ID NO: 1261274 - RNA, 23 nt, Homo sapiens
aucuccaguagaaagcauaacaa

SEQ ID NO: 1261275 - RNA, 17 nt, Homo sapiens
aucuccauauguuacac

SEQ ID NO: 1261276 - RNA, 20 nt, Homo sapiens
aucuccaucugucaacaggg

SEQ ID NO: 1261277 - RNA, 20 nt, Homo sapiens
aucucccacccuguaccuca

SEQ ID NO: 1261278 - RNA, 17 nt, Homo sapiens
aucuccccaggccucca

SEQ ID NO: 1261279 - RNA, 18 nt, Homo sapiens
aucuccuauaaucuguca

SEQ ID NO: 1261280 - RNA, 19 nt, Homo sapiens
aucuccuauaaucugucaa

SEQ ID NO: 1261281 - RNA, 17 nt, Homo sapiens
aucuccuguccaucagc

SEQ ID NO: 1261282 - RNA, 20 nt, Homo sapiens
aucuccugugauccuuugau

SEQ ID NO: 1261283 - RNA, 19 nt, Homo sapiens
aucuccugugcauggguga

SEQ ID NO: 1261284 - RNA, 20 nt, Homo sapiens
aucuccuuuuaucuggugcc

SEQ ID NO: 1261285 - RNA, 20 nt, Homo sapiens
aucucggcucacugcaagcu

SEQ ID NO: 1261286 - RNA, 14 nt, Homo sapiens
aucucuaccugggu

SEQ ID NO: 1261287 - RNA, 20 nt, Homo sapiens
aucucuaccugggugugccc

SEQ ID NO: 1261288 - RNA, 19 nt, Homo sapiens
aucucuacugaaaguacaa

SEQ ID NO: 1261289 - RNA, 16 nt, Homo sapiens
aucucuauaacagauc

SEQ ID NO: 1261290 - RNA, 13 nt, Homo sapiens
aucucucuacucc

SEQ ID NO: 1261291 - RNA, 13 nt, Homo sapiens
aucucugacuuaa

SEQ ID NO: 1261292 - RNA, 17 nt, Homo sapiens
aucucuuauuuuacaau

SEQ ID NO: 1261293 - RNA, 19 nt, Homo sapiens
aucucuugcacucaaagcu

SEQ ID NO: 1261294 - RNA, 13 nt, Homo sapiens
aucugaacauucu

SEQ ID NO: 1261295 - RNA, 18 nt, Homo sapiens
aucugaagaaacuuccca

SEQ ID NO: 1261296 - RNA, 19 nt, Homo sapiens
aucugaauaaaguguaaca

SEQ ID NO: 1261297 - RNA, 18 nt, Homo sapiens
aucugaaugaaaauaacu

SEQ ID NO: 1261298 - RNA, 21 nt, Homo sapiens
aucugacacaaaaaaaguuga

SEQ ID NO: 1261299 - RNA, 13 nt, Homo sapiens
aucugaccaaaac

SEQ ID NO: 1261300 - RNA, 16 nt, Homo sapiens
aucugaucaaauguau

SEQ ID NO: 1261301 - RNA, 20 nt, Homo sapiens
aucugauuuccuaaugucag

SEQ ID NO: 1261302 - RNA, 17 nt, Homo sapiens
aucugcacucaccucac

SEQ ID NO: 1261303 - RNA, 13 nt, Homo sapiens
aucugcaguuuaa

SEQ ID NO: 1261304 - RNA, 17 nt, Homo sapiens
aucugcauuuagcacaa

SEQ ID NO: 1261305 - RNA, 11 nt, Homo sapiens
aucugccauug

SEQ ID NO: 1261306 - RNA, 21 nt, Homo sapiens
aucugccuuaaaaccaaagag

SEQ ID NO: 1261307 - RNA, 14 nt, Homo sapiens
aucugcuaugcuau

SEQ ID NO: 1261308 - RNA, 21 nt, Homo sapiens
aucugcucuuaggugcuucuu

SEQ ID NO: 1261309 - RNA, 20 nt, Homo sapiens
aucugcugaaagcucagcug

SEQ ID NO: 1261310 - RNA, 23 nt, Homo sapiens
aucugcugcaccuucacucucca

SEQ ID NO: 1261311 - RNA, 13 nt, Homo sapiens
aucugcuggauau

SEQ ID NO: 1261312 - RNA, 22 nt, Homo sapiens
aucuggcccaggaauuagagaa

SEQ ID NO: 1261313 - RNA, 22 nt, Homo sapiens
aucuggcuuauuuuaaugugau

SEQ ID NO: 1261314 - RNA, 18 nt, Homo sapiens
aucugggcugugggcaag

SEQ ID NO: 1261315 - RNA, 17 nt, Homo sapiens
aucuggguaucuuucca

SEQ ID NO: 1261316 - RNA, 17 nt, Homo sapiens
aucugggugacugagca

SEQ ID NO: 1261317 - RNA, 17 nt, Homo sapiens
aucuggguucacugcaa

SEQ ID NO: 1261318 - RNA, 14 nt, Homo sapiens
aucuguaacagcau

SEQ ID NO: 1261319 - RNA, 13 nt, Homo sapiens
aucuguaagcucu

SEQ ID NO: 1261320 - RNA, 15 nt, Homo sapiens
aucuguaguaauuua

SEQ ID NO: 1261321 - RNA, 22 nt, Homo sapiens
aucugucauuauauucuaauua

SEQ ID NO: 1261322 - RNA, 17 nt, Homo sapiens
aucugugccuucucuau

SEQ ID NO: 1261323 - RNA, 16 nt, Homo sapiens
aucuguuugaacacuu

SEQ ID NO: 1261324 - RNA, 20 nt, Homo sapiens
aucuguuugaucccuguuac

SEQ ID NO: 1261325 - RNA, 21 nt, Homo sapiens
aucuguuugaucccuguuacc

SEQ ID NO: 1261326 - RNA, 14 nt, Homo sapiens
aucuuaaaugccag

SEQ ID NO: 1261327 - RNA, 16 nt, Homo sapiens
aucuuaagauccacaa

SEQ ID NO: 1261328 - RNA, 13 nt, Homo sapiens
aucuuacuugagc

SEQ ID NO: 1261329 - RNA, 20 nt, Homo sapiens
aucuuagacccgguccugcc

SEQ ID NO: 1261330 - RNA, 19 nt, Homo sapiens
aucuuagguaagacauaua

SEQ ID NO: 1261331 - RNA, 13 nt, Homo sapiens
aucuuaugcuauu

SEQ ID NO: 1261332 - RNA, 15 nt, Homo sapiens
aucuucaaacuuuca

SEQ ID NO: 1261333 - RNA, 16 nt, Homo sapiens
aucuucaagaccaaag

SEQ ID NO: 1261334 - RNA, 17 nt, Homo sapiens
aucuucacaaaacacuu

SEQ ID NO: 1261335 - RNA, 18 nt, Homo sapiens
aucuucaggugaacacuu

SEQ ID NO: 1261336 - RNA, 13 nt, Homo sapiens
aucuuccaagggu

SEQ ID NO: 1261337 - RNA, 18 nt, Homo sapiens
aucuuccaaggguacuaa

SEQ ID NO: 1261338 - RNA, 21 nt, Homo sapiens
aucuuccaaggguacuaagga

SEQ ID NO: 1261339 - RNA, 22 nt, Homo sapiens
aucuuccaaggguacuaaggaa

SEQ ID NO: 1261340 - RNA, 18 nt, Homo sapiens
aucuucccuuuauuacaa

SEQ ID NO: 1261341 - RNA, 17 nt, Homo sapiens
aucuuccuuucuugucu

SEQ ID NO: 1261342 - RNA, 23 nt, Homo sapiens
aucuuccuuuguugcacaaauag

SEQ ID NO: 1261343 - RNA, 22 nt, Homo sapiens
aucuucuaaacccaauccaaau

SEQ ID NO: 1261344 - RNA, 16 nt, Homo sapiens
aucuucucaaguucua

SEQ ID NO: 1261345 - RNA, 21 nt, Homo sapiens
aucuucugugcccagcacagu

SEQ ID NO: 1261346 - RNA, 17 nt, Homo sapiens
aucuucuuuggggcccu

SEQ ID NO: 1261347 - RNA, 22 nt, Homo sapiens
aucuugauaucucgaacuuuca

SEQ ID NO: 1261348 - RNA, 18 nt, Homo sapiens
aucuugcaacucuguaaa

SEQ ID NO: 1261349 - RNA, 15 nt, Homo sapiens
aucuugcuaccagua

SEQ ID NO: 1261350 - RNA, 14 nt, Homo sapiens
aucuuggacugaca

SEQ ID NO: 1261351 - RNA, 18 nt, Homo sapiens
aucuugggauaguuccca

SEQ ID NO: 1261352 - RNA, 13 nt, Homo sapiens
aucuuuaacuuag

SEQ ID NO: 1261353 - RNA, 21 nt, Homo sapiens
aucuuuacaaaacuacaugag

SEQ ID NO: 1261354 - RNA, 22 nt, Homo sapiens
aucuuuacucccaagacuucau

SEQ ID NO: 1261355 - RNA, 23 nt, Homo sapiens
aucuuuaggagacuaauggaaau

SEQ ID NO: 1261356 - RNA, 23 nt, Homo sapiens
aucuuuauacuggguuucaagaa

SEQ ID NO: 1261357 - RNA, 20 nt, Homo sapiens
aucuuuaucaugaagcacau

SEQ ID NO: 1261358 - RNA, 23 nt, Homo sapiens
aucuuuaucaugaagcacaucaa

SEQ ID NO: 1261359 - RNA, 21 nt, Homo sapiens
aucuuucaggacucuaccuca

SEQ ID NO: 1261360 - RNA, 14 nt, Homo sapiens
aucuuucauccuug

SEQ ID NO: 1261361 - RNA, 23 nt, Homo sapiens
aucuuucuuuccaaaacauuucu

SEQ ID NO: 1261362 - RNA, 12 nt, Homo sapiens
aucuuugcagac

SEQ ID NO: 1261363 - RNA, 21 nt, Homo sapiens
aucuuugcuguauacuuuuaa

SEQ ID NO: 1261364 - RNA, 15 nt, Homo sapiens
aucuuuggauuugau

SEQ ID NO: 1261365 - RNA, 15 nt, Homo sapiens
aucuuuguaccaaaa

SEQ ID NO: 1261366 - RNA, 19 nt, Homo sapiens
aucuuugucuguucacuuu

SEQ ID NO: 1261367 - RNA, 14 nt, Homo sapiens
aucuuugugacagg

SEQ ID NO: 1261368 - RNA, 16 nt, Homo sapiens
aucuuuucauuaaaga

SEQ ID NO: 1261369 - RNA, 20 nt, Homo sapiens
aucuuuuccagaguaugcaa

SEQ ID NO: 1261370 - RNA, 18 nt, Homo sapiens
augaaaaacaggugacau

SEQ ID NO: 1261371 - RNA, 20 nt, Homo sapiens
augaaaaauaagucacuuau

SEQ ID NO: 1261372 - RNA, 23 nt, Homo sapiens
augaaaacucauuacuuuuccau

SEQ ID NO: 1261373 - RNA, 18 nt, Homo sapiens
augaaaauaaauagcuua

SEQ ID NO: 1261374 - RNA, 21 nt, Homo sapiens
augaaaauaacugaaccaaau

SEQ ID NO: 1261375 - RNA, 19 nt, Homo sapiens
augaaaauaagugaauaau

SEQ ID NO: 1261376 - RNA, 19 nt, Homo sapiens
augaaaaucuccaucucaa

SEQ ID NO: 1261377 - RNA, 14 nt, Homo sapiens
augaaaaugaauau

SEQ ID NO: 1261378 - RNA, 17 nt, Homo sapiens
augaaaaugaaucuuca

SEQ ID NO: 1261379 - RNA, 21 nt, Homo sapiens
augccaugaccuuccuccucc

SEQ ID NO: 1261380 - RNA, 13 nt, Homo sapiens
augccauucuucc

SEQ ID NO: 1261381 - RNA, 21 nt, Homo sapiens
augcccucaggggacuugaau

SEQ ID NO: 1261382 - RNA, 19 nt, Homo sapiens
augccgagguaaaaguucu

SEQ ID NO: 1261383 - RNA, 17 nt, Homo sapiens
augccuaaauauaauua

SEQ ID NO: 1261384 - RNA, 21 nt, Homo sapiens
augccuagacuucccaacagc

SEQ ID NO: 1261385 - RNA, 15 nt, Homo sapiens
augccucagagggua

SEQ ID NO: 1261386 - RNA, 22 nt, Homo sapiens
augccucagaggguagccuuga

SEQ ID NO: 1261387 - RNA, 16 nt, Homo sapiens
augccuccaagccauu

SEQ ID NO: 1261388 - RNA, 18 nt, Homo sapiens
augccuccugcccugcua

SEQ ID NO: 1261389 - RNA, 12 nt, Homo sapiens
augccucuggag

SEQ ID NO: 1261390 - RNA, 23 nt, Homo sapiens
augccucuggaggccucuggccc

SEQ ID NO: 1261391 - RNA, 21 nt, Homo sapiens
augccugggucucugggcaca

SEQ ID NO: 1261392 - RNA, 18 nt, Homo sapiens
augccuguaacccuggca

SEQ ID NO: 1261393 - RNA, 14 nt, Homo sapiens
augccuguaaucuc

SEQ ID NO: 1261394 - RNA, 23 nt, Homo sapiens
augccuguaaucucagcacuuug

SEQ ID NO: 1261395 - RNA, 18 nt, Homo sapiens
augccuguguacugccuu

SEQ ID NO: 1261396 - RNA, 17 nt, Homo sapiens
augccuucacuuuacaa

SEQ ID NO: 1261397 - RNA, 18 nt, Homo sapiens
augccuuggggaggacaa

SEQ ID NO: 1261398 - RNA, 19 nt, Homo sapiens
augcgacuguaaauuggua

SEQ ID NO: 1261399 - RNA, 16 nt, Homo sapiens
augcggugaaguuuaa

SEQ ID NO: 1261400 - RNA, 23 nt, Homo sapiens
augcuacuuuuuuuuaguucaau

SEQ ID NO: 1261401 - RNA, 23 nt, Homo sapiens
augcuagaacaacgccugucaca

SEQ ID NO: 1261402 - RNA, 17 nt, Homo sapiens
augcuaguuugaccuca

SEQ ID NO: 1261403 - RNA, 14 nt, Homo sapiens
augcucagggucaa

SEQ ID NO: 1261404 - RNA, 15 nt, Homo sapiens
augcuccaccgucag

SEQ ID NO: 1261405 - RNA, 19 nt, Homo sapiens
augcuccuccuccaugcuc

SEQ ID NO: 1261406 - RNA, 18 nt, Homo sapiens
augcugaaaaauauagcc

SEQ ID NO: 1261407 - RNA, 18 nt, Homo sapiens
augcugaaaacuacacaa

SEQ ID NO: 1261408 - RNA, 19 nt, Homo sapiens
augcugaauccaccucgga

SEQ ID NO: 1261409 - RNA, 22 nt, Homo sapiens
augcugaauguacacugauucc

SEQ ID NO: 1261410 - RNA, 17 nt, Homo sapiens
augcugagaagaucuga

SEQ ID NO: 1261411 - RNA, 18 nt, Homo sapiens
augcugcaggacuugaga

SEQ ID NO: 1261412 - RNA, 17 nt, Homo sapiens
augcugcucauccaaag

SEQ ID NO: 1261413 - RNA, 19 nt, Homo sapiens
augcuggacugcauucaca

SEQ ID NO: 1261414 - RNA, 17 nt, Homo sapiens
augcugguacuauugug

SEQ ID NO: 1261415 - RNA, 14 nt, Homo sapiens
augcuguaacuuaa

SEQ ID NO: 1261416 - RNA, 22 nt, Homo sapiens
augcuguauauccuuucuaaca

SEQ ID NO: 1261417 - RNA, 15 nt, Homo sapiens
augcugugcuaugaa

SEQ ID NO: 1261418 - RNA, 14 nt, Homo sapiens
augcugugcucaau

SEQ ID NO: 1261419 - RNA, 21 nt, Homo sapiens
augcuguuaguaccuacauca

SEQ ID NO: 1261420 - RNA, 22 nt, Homo sapiens
augcuguucacuggacacuuca

SEQ ID NO: 1261421 - RNA, 20 nt, Homo sapiens
augcuguuugacaaaguuac

SEQ ID NO: 1261422 - RNA, 14 nt, Homo sapiens
augcuuacaaaguc

SEQ ID NO: 1261423 - RNA, 13 nt, Homo sapiens
augcuuacuccac

SEQ ID NO: 1261424 - RNA, 16 nt, Homo sapiens
augcuuacuccacuuc

SEQ ID NO: 1261425 - RNA, 19 nt, Homo sapiens
augcuuagucccucaugca

SEQ ID NO: 1261426 - RNA, 18 nt, Homo sapiens
augcuucaguacuuguga

SEQ ID NO: 1261427 - RNA, 14 nt, Homo sapiens
augcuucaugugcu

SEQ ID NO: 1261428 - RNA, 14 nt, Homo sapiens
augcuugauuccag

SEQ ID NO: 1261429 - RNA, 16 nt, Homo sapiens
auggaaaaaucuugga

SEQ ID NO: 1261430 - RNA, 23 nt, Homo sapiens
auggaaaaccuucaagaucucau

SEQ ID NO: 1261431 - RNA, 13 nt, Homo sapiens
auggaaacacuga

SEQ ID NO: 1261432 - RNA, 20 nt, Homo sapiens
auggaacacacuuggaugca

SEQ ID NO: 1261433 - RNA, 15 nt, Homo sapiens
auggaacagcauuac

SEQ ID NO: 1261434 - RNA, 23 nt, Homo sapiens
auggaaguugcagugagcugaua

SEQ ID NO: 1261435 - RNA, 19 nt, Homo sapiens
auggaauaucaucugucau

SEQ ID NO: 1261436 - RNA, 20 nt, Homo sapiens
auggaauauuccccuaucuc

SEQ ID NO: 1261437 - RNA, 22 nt, Homo sapiens
auggaaucauauagugucuguc

SEQ ID NO: 1261438 - RNA, 18 nt, Homo sapiens
auggaauggcagguguca

SEQ ID NO: 1261439 - RNA, 18 nt, Homo sapiens
auggacacuccagugcca

SEQ ID NO: 1261440 - RNA, 22 nt, Homo sapiens
auggacuaaccccaacgcacag

SEQ ID NO: 1261441 - RNA, 12 nt, Homo sapiens
auggacucugca

SEQ ID NO: 1261442 - RNA, 21 nt, Homo sapiens
auggagacaagggcaucaucu

SEQ ID NO: 1261443 - RNA, 15 nt, Homo sapiens
auggagaggaacaca

SEQ ID NO: 1261444 - RNA, 19 nt, Homo sapiens
auggagaggcggccucgug

SEQ ID NO: 1261445 - RNA, 17 nt, Homo sapiens
auggagcaugaauggua

SEQ ID NO: 1261446 - RNA, 17 nt, Homo sapiens
auggaggaauuucuuga

SEQ ID NO: 1261447 - RNA, 22 nt, Homo sapiens
auggaggccagugccagcaccu

SEQ ID NO: 1261448 - RNA, 18 nt, Homo sapiens
auggagggaaugcucaga

SEQ ID NO: 1261449 - RNA, 21 nt, Homo sapiens
auggaggggagggaucuccug

SEQ ID NO: 1261450 - RNA, 16 nt, Homo sapiens
auggaguggcugccau

SEQ ID NO: 1261451 - RNA, 11 nt, Homo sapiens
auggaucacaa

SEQ ID NO: 1261452 - RNA, 17 nt, Homo sapiens
auggaucuuaaagcauu

SEQ ID NO: 1261453 - RNA, 22 nt, Homo sapiens
auggaugaaucucccacuccag

SEQ ID NO: 1261454 - RNA, 17 nt, Homo sapiens
auggaugguugaauuaa

SEQ ID NO: 1261455 - RNA, 17 nt, Homo sapiens
auggcaauuucacugau

SEQ ID NO: 1261456 - RNA, 16 nt, Homo sapiens
auggcagaaccaaagc

SEQ ID NO: 1261457 - RNA, 14 nt, Homo sapiens
auggcagccuacuc

SEQ ID NO: 1261458 - RNA, 22 nt, Homo sapiens
auggcauaggcugacuuuugca

SEQ ID NO: 1261459 - RNA, 14 nt, Homo sapiens
auggcauugaacug

SEQ ID NO: 1261460 - RNA, 13 nt, Homo sapiens
auggccagccaac

SEQ ID NO: 1261461 - RNA, 23 nt, Homo sapiens
auggcccaugggagccaggccca

SEQ ID NO: 1261462 - RNA, 17 nt, Homo sapiens
auggccucauguggcug

SEQ ID NO: 1261463 - RNA, 14 nt, Homo sapiens
auggccucuggcca

SEQ ID NO: 1261464 - RNA, 23 nt, Homo sapiens
augguguagaacacuaauucaua

SEQ ID NO: 1261465 - RNA, 21 nt, Homo sapiens
augguguguuccuaacauaaa

SEQ ID NO: 1261466 - RNA, 16 nt, Homo sapiens
augguugccaccccaa

SEQ ID NO: 1261467 - RNA, 15 nt, Homo sapiens
augguuuccauuuac

SEQ ID NO: 1261468 - RNA, 15 nt, Homo sapiens
auguaaaaauacacu

SEQ ID NO: 1261469 - RNA, 13 nt, Homo sapiens
auguaaaguaaga

SEQ ID NO: 1261470 - RNA, 12 nt, Homo sapiens
auguaaauacca

SEQ ID NO: 1261471 - RNA, 16 nt, Homo sapiens
auguaagaauucagaa

SEQ ID NO: 1261472 - RNA, 15 nt, Homo sapiens
auguaagcucuacug

SEQ ID NO: 1261473 - RNA, 23 nt, Homo sapiens
auguaauaaguaucacacuguau

SEQ ID NO: 1261474 - RNA, 16 nt, Homo sapiens
auguaauuuaggguac

SEQ ID NO: 1261475 - RNA, 14 nt, Homo sapiens
auguaauuuaugca

SEQ ID NO: 1261476 - RNA, 15 nt, Homo sapiens
auguaauuuaugcaa

SEQ ID NO: 1261477 - RNA, 23 nt, Homo sapiens
auguacaauaaagcaauguggua

SEQ ID NO: 1261478 - RNA, 15 nt, Homo sapiens
auguacagacauaca

SEQ ID NO: 1261479 - RNA, 23 nt, Homo sapiens
auguacagacauacauuuaugca

SEQ ID NO: 1261480 - RNA, 17 nt, Homo sapiens
auguacagggguaguuu

SEQ ID NO: 1261481 - RNA, 11 nt, Homo sapiens
auguacaugag

SEQ ID NO: 1261482 - RNA, 21 nt, Homo sapiens
auguacuguacuaauucuuac

SEQ ID NO: 1261483 - RNA, 19 nt, Homo sapiens
auguacuuaagaguggcau

SEQ ID NO: 1261484 - RNA, 16 nt, Homo sapiens
auguagaaacauuuag

SEQ ID NO: 1261485 - RNA, 19 nt, Homo sapiens
auguagcauuaugcaauua

SEQ ID NO: 1261486 - RNA, 20 nt, Homo sapiens
auguagcugaaacaaaaaug

SEQ ID NO: 1261487 - RNA, 15 nt, Homo sapiens
auguaggacuguaua

SEQ ID NO: 1261488 - RNA, 22 nt, Homo sapiens
auguagggguuaacuuggucag

SEQ ID NO: 1261489 - RNA, 12 nt, Homo sapiens
auguauacaaag

SEQ ID NO: 1261490 - RNA, 16 nt, Homo sapiens
auguauagacuuggcu

SEQ ID NO: 1261491 - RNA, 18 nt, Homo sapiens
auguauauauacacggua

SEQ ID NO: 1261492 - RNA, 14 nt, Homo sapiens
auguauaucauucu

SEQ ID NO: 1261493 - RNA, 23 nt, Homo sapiens
auguaucugaguugccaagacaa

SEQ ID NO: 1261494 - RNA, 15 nt, Homo sapiens
auguaugaguggcuu

SEQ ID NO: 1261495 - RNA, 23 nt, Homo sapiens
auguauguugucuucuucaauac

SEQ ID NO: 1261496 - RNA, 18 nt, Homo sapiens
auguauguuuacauauca

SEQ ID NO: 1261497 - RNA, 19 nt, Homo sapiens
auguauguuuuaaguaguc

SEQ ID NO: 1261498 - RNA, 21 nt, Homo sapiens
auguauuaguaugguucaaga

SEQ ID NO: 1261499 - RNA, 18 nt, Homo sapiens
auguauuguaaacaugug

SEQ ID NO: 1261500 - RNA, 20 nt, Homo sapiens
auguauuuguuugcaauuuu

SEQ ID NO: 1261501 - RNA, 18 nt, Homo sapiens
augucaauaugagauauu

SEQ ID NO: 1261502 - RNA, 22 nt, Homo sapiens
augucacagggccaacuugagg

SEQ ID NO: 1261503 - RNA, 17 nt, Homo sapiens
augucagaaaccaguua

SEQ ID NO: 1261504 - RNA, 18 nt, Homo sapiens
augucagugucacuggau

SEQ ID NO: 1261505 - RNA, 20 nt, Homo sapiens
augucauagguaagaaacac

SEQ ID NO: 1261506 - RNA, 12 nt, Homo sapiens
auguccaaagag

SEQ ID NO: 1261507 - RNA, 22 nt, Homo sapiens
auguccagaagaauauucagga

SEQ ID NO: 1261508 - RNA, 21 nt, Homo sapiens
augucccuuucuuggccaguu

SEQ ID NO: 1261509 - RNA, 20 nt, Homo sapiens
auguccggagagacagugac

SEQ ID NO: 1261510 - RNA, 23 nt, Homo sapiens
auguccggcugaaggcugagugu

SEQ ID NO: 1261511 - RNA, 15 nt, Homo sapiens
auguccugccuuuua

SEQ ID NO: 1261512 - RNA, 23 nt, Homo sapiens
augucuccuuugcucuugccaaa

SEQ ID NO: 1261513 - RNA, 23 nt, Homo sapiens
augucucucuugagcuacaguag

SEQ ID NO: 1261514 - RNA, 19 nt, Homo sapiens
augucucuggggcagaucc

SEQ ID NO: 1261515 - RNA, 16 nt, Homo sapiens
augucucuuguagaag

SEQ ID NO: 1261516 - RNA, 17 nt, Homo sapiens
augucucuuguagaaga

SEQ ID NO: 1261517 - RNA, 20 nt, Homo sapiens
augucucuuuaaugucacag

SEQ ID NO: 1261518 - RNA, 18 nt, Homo sapiens
augucuguagcuccucaa

SEQ ID NO: 1261519 - RNA, 15 nt, Homo sapiens
augucuuaguuauaa

SEQ ID NO: 1261520 - RNA, 20 nt, Homo sapiens
augucuuggacacuguacaa

SEQ ID NO: 1261521 - RNA, 19 nt, Homo sapiens
augucuuuucuuccacugc

SEQ ID NO: 1261522 - RNA, 23 nt, Homo sapiens
augugaagagggagaagcaugaa

SEQ ID NO: 1261523 - RNA, 22 nt, Homo sapiens
augugaauaaauucuauaggaa

SEQ ID NO: 1261524 - RNA, 19 nt, Homo sapiens
augugacccaccagugccu

SEQ ID NO: 1261525 - RNA, 16 nt, Homo sapiens
augugaugcaagccag

SEQ ID NO: 1261526 - RNA, 20 nt, Homo sapiens
augugauggauggcacaaug

SEQ ID NO: 1261527 - RNA, 16 nt, Homo sapiens
augugauuuuucugca

SEQ ID NO: 1261528 - RNA, 20 nt, Homo sapiens
augugcaaagucaucaaaga

SEQ ID NO: 1261529 - RNA, 12 nt, Homo sapiens
augugcacugau

SEQ ID NO: 1261530 - RNA, 14 nt, Homo sapiens
augugcaguacuua

SEQ ID NO: 1261531 - RNA, 15 nt, Homo sapiens
augugcaguacuuaa

SEQ ID NO: 1261532 - RNA, 15 nt, Homo sapiens
augugcagucacugg

SEQ ID NO: 1261533 - RNA, 15 nt, Homo sapiens
augugccauagugca

SEQ ID NO: 1261534 - RNA, 21 nt, Homo sapiens
augugccccagcaggcaugga

SEQ ID NO: 1261535 - RNA, 17 nt, Homo sapiens
augugccgaaugugcag

SEQ ID NO: 1261536 - RNA, 18 nt, Homo sapiens
augugcuauacacacaca

SEQ ID NO: 1261537 - RNA, 20 nt, Homo sapiens
augugcuaugaagcuuucuu

SEQ ID NO: 1261538 - RNA, 14 nt, Homo sapiens
augugcucaggccc

SEQ ID NO: 1261539 - RNA, 13 nt, Homo sapiens
augugcugucacg

SEQ ID NO: 1261540 - RNA, 21 nt, Homo sapiens
auguggaagaacuuaggcauc

SEQ ID NO: 1261541 - RNA, 19 nt, Homo sapiens
auguggagcucagcaacaa

SEQ ID NO: 1261542 - RNA, 18 nt, Homo sapiens
auguggcaaagugcugua

SEQ ID NO: 1261543 - RNA, 18 nt, Homo sapiens
auguggccaagcacaucu

SEQ ID NO: 1261544 - RNA, 20 nt, Homo sapiens
augugggguccccaucaucc

SEQ ID NO: 1261545 - RNA, 17 nt, Homo sapiens
augugggugucagucag

SEQ ID NO: 1261546 - RNA, 20 nt, Homo sapiens
augugggugucagucaggga

SEQ ID NO: 1261547 - RNA, 21 nt, Homo sapiens
augugggugucagucagggac

SEQ ID NO: 1261548 - RNA, 19 nt, Homo sapiens
auguggguguccugcagaa

SEQ ID NO: 1261549 - RNA, 21 nt, Homo sapiens
augugucacuacucacagucu

SEQ ID NO: 1261550 - RNA, 20 nt, Homo sapiens
auguuguugaggcugucaca

SEQ ID NO: 1261551 - RNA, 17 nt, Homo sapiens
auguuguuuuaggggcu

SEQ ID NO: 1261552 - RNA, 14 nt, Homo sapiens
auguuuaaagauca

SEQ ID NO: 1261553 - RNA, 17 nt, Homo sapiens
auguuuacucauugccc

SEQ ID NO: 1261554 - RNA, 13 nt, Homo sapiens
auguuucaaaaaa

SEQ ID NO: 1261555 - RNA, 20 nt, Homo sapiens
auguuucacauaaaaccuca

SEQ ID NO: 1261556 - RNA, 16 nt, Homo sapiens
auguuucacugugcaa

SEQ ID NO: 1261557 - RNA, 13 nt, Homo sapiens
auguuucagacca

SEQ ID NO: 1261558 - RNA, 22 nt, Homo sapiens
auguuucauguuuugugacuau

SEQ ID NO: 1261559 - RNA, 12 nt, Homo sapiens
auguuugcacuu

SEQ ID NO: 1261560 - RNA, 15 nt, Homo sapiens
auguuugcacuuugu

SEQ ID NO: 1261561 - RNA, 22 nt, Homo sapiens
auguuuguaaauuaauacuuca

SEQ ID NO: 1261562 - RNA, 13 nt, Homo sapiens
auguuuuguauac

SEQ ID NO: 1261563 - RNA, 17 nt, Homo sapiens
auguuuuuaugauaucc

SEQ ID NO: 1261564 - RNA, 14 nt, Homo sapiens
auuaaaaaacuuca

SEQ ID NO: 1261565 - RNA, 17 nt, Homo sapiens
auuaaaauaaauguugu

SEQ ID NO: 1261566 - RNA, 22 nt, Homo sapiens
auuaaaauaagcacugugcuaa

SEQ ID NO: 1261567 - RNA, 14 nt, Homo sapiens
auuaaaauggauuu

SEQ ID NO: 1261568 - RNA, 19 nt, Homo sapiens
auuaaaauugccauuuuau

SEQ ID NO: 1261569 - RNA, 18 nt, Homo sapiens
auuaaacagacuuuagcu

SEQ ID NO: 1261570 - RNA, 20 nt, Homo sapiens
auuaaacagacuuuagcuua

SEQ ID NO: 1261571 - RNA, 16 nt, Homo sapiens
auuaaacugugaaugu

SEQ ID NO: 1261572 - RNA, 21 nt, Homo sapiens
auuaaacugugaauguuccaa

SEQ ID NO: 1261573 - RNA, 15 nt, Homo sapiens
auuaaauaaaucauu

SEQ ID NO: 1261574 - RNA, 17 nt, Homo sapiens
auuaaauacagacacua

SEQ ID NO: 1261575 - RNA, 13 nt, Homo sapiens
auuaaaugcauca

SEQ ID NO: 1261576 - RNA, 15 nt, Homo sapiens
auuaaaugcaucaau

SEQ ID NO: 1261577 - RNA, 20 nt, Homo sapiens
auuaaauguuugacacaauu

SEQ ID NO: 1261578 - RNA, 17 nt, Homo sapiens
auuaaauucacuuucaa

SEQ ID NO: 1261579 - RNA, 19 nt, Homo sapiens
auuaacaacaauaacacug

SEQ ID NO: 1261580 - RNA, 17 nt, Homo sapiens
auuaacuaauaugggca

SEQ ID NO: 1261581 - RNA, 21 nt, Homo sapiens
auuaacuuuuuaaaacacaac

SEQ ID NO: 1261582 - RNA, 18 nt, Homo sapiens
auuaagaaagacuaucua

SEQ ID NO: 1261583 - RNA, 19 nt, Homo sapiens
auuaagacgguuaaauacu

SEQ ID NO: 1261584 - RNA, 12 nt, Homo sapiens
auuaagcaugaa

SEQ ID NO: 1261585 - RNA, 14 nt, Homo sapiens
auuaagugacuaua

SEQ ID NO: 1261586 - RNA, 22 nt, Homo sapiens
auuaagugacuauagaaugcaa

SEQ ID NO: 1261587 - RNA, 13 nt, Homo sapiens
auuaaguuaucuu

SEQ ID NO: 1261588 - RNA, 20 nt, Homo sapiens
auuaauaaagauggcacuuu

SEQ ID NO: 1261589 - RNA, 15 nt, Homo sapiens
auuaauaaagcauuc

SEQ ID NO: 1261590 - RNA, 16 nt, Homo sapiens
auuaauaaagcauucu

SEQ ID NO: 1261591 - RNA, 21 nt, Homo sapiens
auuaauaaagcauucuuuaac

SEQ ID NO: 1261592 - RNA, 23 nt, Homo sapiens
auuaauaacgucuuuuuauaucu

SEQ ID NO: 1261593 - RNA, 18 nt, Homo sapiens
auuaauaaucuuauuagg

SEQ ID NO: 1261594 - RNA, 14 nt, Homo sapiens
auuaaucaaaggca

SEQ ID NO: 1261595 - RNA, 14 nt, Homo sapiens
auuaaucaccucuc

SEQ ID NO: 1261596 - RNA, 15 nt, Homo sapiens
auuaauggcacugau

SEQ ID NO: 1261597 - RNA, 15 nt, Homo sapiens
auuaauucuucaccu

SEQ ID NO: 1261598 - RNA, 19 nt, Homo sapiens
auuaauugugugucacaag

SEQ ID NO: 1261599 - RNA, 16 nt, Homo sapiens
auuaauuuauuauuaa

SEQ ID NO: 1261600 - RNA, 18 nt, Homo sapiens
auuaauuuuuaaggaugu

SEQ ID NO: 1261601 - RNA, 22 nt, Homo sapiens
auuacaagcuguagaccaccua

SEQ ID NO: 1261602 - RNA, 20 nt, Homo sapiens
auuacaauguguaauggaaa

SEQ ID NO: 1261603 - RNA, 23 nt, Homo sapiens
auuacaauuuguauuacuuucuc

SEQ ID NO: 1261604 - RNA, 20 nt, Homo sapiens
auuacacauuuguacagaau

SEQ ID NO: 1261605 - RNA, 21 nt, Homo sapiens
auuacagaaacugaugccaag

SEQ ID NO: 1261606 - RNA, 14 nt, Homo sapiens
auuacagacaugaa

SEQ ID NO: 1261607 - RNA, 23 nt, Homo sapiens
auuacaggugugaaccaccacac

SEQ ID NO: 1261608 - RNA, 20 nt, Homo sapiens
auuacaguacacauccccag

SEQ ID NO: 1261609 - RNA, 21 nt, Homo sapiens
auuacaguuaaagaagcaauc

SEQ ID NO: 1261610 - RNA, 23 nt, Homo sapiens
auuacauuccuaacuagaauuag

SEQ ID NO: 1261611 - RNA, 21 nt, Homo sapiens
auuacccccucauuguuuauu

SEQ ID NO: 1261612 - RNA, 22 nt, Homo sapiens
auuacuaaauuacaaaugcaau

SEQ ID NO: 1261613 - RNA, 23 nt, Homo sapiens
auuacuaucauaauucagcacuu

SEQ ID NO: 1261614 - RNA, 18 nt, Homo sapiens
auuacugaaaaugauucc

SEQ ID NO: 1261615 - RNA, 18 nt, Homo sapiens
auuacuguuccagauucc

SEQ ID NO: 1261616 - RNA, 18 nt, Homo sapiens
auuacuguugcauuuacu

SEQ ID NO: 1261617 - RNA, 20 nt, Homo sapiens
auuacuguugcauuuacuuu

SEQ ID NO: 1261618 - RNA, 14 nt, Homo sapiens
auuacuucugcuac

SEQ ID NO: 1261619 - RNA, 22 nt, Homo sapiens
auuagaagccugcagaauccag

SEQ ID NO: 1261620 - RNA, 12 nt, Homo sapiens
auuagacuccau

SEQ ID NO: 1261621 - RNA, 16 nt, Homo sapiens
auuagacuccauguag

SEQ ID NO: 1261622 - RNA, 22 nt, Homo sapiens
auuagagaauuuucugcauuau

SEQ ID NO: 1261623 - RNA, 14 nt, Homo sapiens
auuagcaaagcaaa

SEQ ID NO: 1261624 - RNA, 15 nt, Homo sapiens
auuagcaaagcaaaa

SEQ ID NO: 1261625 - RNA, 17 nt, Homo sapiens
auuagcaaggucauuuc

SEQ ID NO: 1261626 - RNA, 22 nt, Homo sapiens
auuagcaaguuacagugaugcu

SEQ ID NO: 1261627 - RNA, 20 nt, Homo sapiens
auuagccauuucacucucaa

SEQ ID NO: 1261628 - RNA, 18 nt, Homo sapiens
auuagccgggcauggugg

SEQ ID NO: 1261629 - RNA, 16 nt, Homo sapiens
auuaggaaauucugau

SEQ ID NO: 1261630 - RNA, 15 nt, Homo sapiens
auuaggaaguguaac

SEQ ID NO: 1261631 - RNA, 15 nt, Homo sapiens
auuaggacuguauaa

SEQ ID NO: 1261632 - RNA, 19 nt, Homo sapiens
auuagguguucaggccagu

SEQ ID NO: 1261633 - RNA, 18 nt, Homo sapiens
auuaguaugguucaagau

SEQ ID NO: 1261634 - RNA, 16 nt, Homo sapiens
auuauaaauaaauaga

SEQ ID NO: 1261635 - RNA, 14 nt, Homo sapiens
auuauaacuguaaa

SEQ ID NO: 1261636 - RNA, 23 nt, Homo sapiens
auuauacgcuggcaacacagagg

SEQ ID NO: 1261637 - RNA, 14 nt, Homo sapiens
auuauagagacaau

SEQ ID NO: 1261638 - RNA, 20 nt, Homo sapiens
auuauagaguauacuaaaaa

SEQ ID NO: 1261639 - RNA, 15 nt, Homo sapiens
caagucaccaugcug

SEQ ID NO: 1261640 - RNA, 17 nt, Homo sapiens
caagucaccaugcugaa

SEQ ID NO: 1261641 - RNA, 16 nt, Homo sapiens
caagucuguaccucaa

SEQ ID NO: 1261642 - RNA, 17 nt, Homo sapiens
caagucuguaccucaaa

SEQ ID NO: 1261643 - RNA, 13 nt, Homo sapiens
caagucugugagu

SEQ ID NO: 1261644 - RNA, 19 nt, Homo sapiens
caagugauucuccugccuc

SEQ ID NO: 1261645 - RNA, 14 nt, Homo sapiens
caagugggugaaug

SEQ ID NO: 1261646 - RNA, 18 nt, Homo sapiens
caaguguuccuauuuccc

SEQ ID NO: 1261647 - RNA, 23 nt, Homo sapiens
caaguuccaugggauacaaccuc

SEQ ID NO: 1261648 - RNA, 16 nt, Homo sapiens
caaguugcugucacug

SEQ ID NO: 1261649 - RNA, 20 nt, Homo sapiens
caaguuuaaaagccauguau

SEQ ID NO: 1261650 - RNA, 14 nt, Homo sapiens
caaguuucagugaa

SEQ ID NO: 1261651 - RNA, 17 nt, Homo sapiens
caaguuucaucagucaa

SEQ ID NO: 1261652 - RNA, 18 nt, Homo sapiens
caaguuucuagcuagaaa

SEQ ID NO: 1261653 - RNA, 19 nt, Homo sapiens
caaguuucugauaccacug

SEQ ID NO: 1261654 - RNA, 20 nt, Homo sapiens
caaguuucugauaccacugc

SEQ ID NO: 1261655 - RNA, 11 nt, Homo sapiens
caaguuugcac

SEQ ID NO: 1261656 - RNA, 17 nt, Homo sapiens
caaguuuuguggggcuu

SEQ ID NO: 1261657 - RNA, 13 nt, Homo sapiens
caauaaacacuug

SEQ ID NO: 1261658 - RNA, 21 nt, Homo sapiens
caauaaacauuucauuuccca

SEQ ID NO: 1261659 - RNA, 12 nt, Homo sapiens
caauaaaccucc

SEQ ID NO: 1261660 - RNA, 19 nt, Homo sapiens
caauaaacugguaugaaua

SEQ ID NO: 1261661 - RNA, 13 nt, Homo sapiens
caauaaagcaaug

SEQ ID NO: 1261662 - RNA, 14 nt, Homo sapiens
caauaaagcaaugu

SEQ ID NO: 1261663 - RNA, 18 nt, Homo sapiens
caauaaagcaauguggua

SEQ ID NO: 1261664 - RNA, 13 nt, Homo sapiens
caauaacaaacug

SEQ ID NO: 1261665 - RNA, 18 nt, Homo sapiens
caauaacuacuguguucc

SEQ ID NO: 1261666 - RNA, 14 nt, Homo sapiens
caauaacuucugac

SEQ ID NO: 1261667 - RNA, 15 nt, Homo sapiens
caauaauauauugua

SEQ ID NO: 1261668 - RNA, 19 nt, Homo sapiens
caauaauauuguuguauaa

SEQ ID NO: 1261669 - RNA, 13 nt, Homo sapiens
caauaauauuuca

SEQ ID NO: 1261670 - RNA, 14 nt, Homo sapiens
caauacaaauagau

SEQ ID NO: 1261671 - RNA, 14 nt, Homo sapiens
caauacaaccagcc

SEQ ID NO: 1261672 - RNA, 14 nt, Homo sapiens
caauacagcuucau

SEQ ID NO: 1261673 - RNA, 13 nt, Homo sapiens
caauacagugaag

SEQ ID NO: 1261674 - RNA, 21 nt, Homo sapiens
caauacuagucaccccaagua

SEQ ID NO: 1261675 - RNA, 20 nt, Homo sapiens
caauacuguuuccauuuuaa

SEQ ID NO: 1261676 - RNA, 14 nt, Homo sapiens
caauagagacugua

SEQ ID NO: 1261677 - RNA, 20 nt, Homo sapiens
caauaggaacaacaaaaaga

SEQ ID NO: 1261678 - RNA, 15 nt, Homo sapiens
caauaggcauuugau

SEQ ID NO: 1261679 - RNA, 22 nt, Homo sapiens
caauaggucuuucucucaguga

SEQ ID NO: 1261680 - RNA, 13 nt, Homo sapiens
caauaguauuucu

SEQ ID NO: 1261681 - RNA, 21 nt, Homo sapiens
caauagugaaaugccacaccu

SEQ ID NO: 1261682 - RNA, 18 nt, Homo sapiens
caauauccaaaccaaaua

SEQ ID NO: 1261683 - RNA, 18 nt, Homo sapiens
caauaugaugacucccuu

SEQ ID NO: 1261684 - RNA, 14 nt, Homo sapiens
caaucaaagcacuu

SEQ ID NO: 1261685 - RNA, 20 nt, Homo sapiens
caaucaacuuuacuguaaua

SEQ ID NO: 1261686 - RNA, 16 nt, Homo sapiens
caaucagaucaacucu

SEQ ID NO: 1261687 - RNA, 14 nt, Homo sapiens
caaucagcacugaa

SEQ ID NO: 1261688 - RNA, 15 nt, Homo sapiens
caaucagcagucuag

SEQ ID NO: 1261689 - RNA, 17 nt, Homo sapiens
caaucauaauaccugcu

SEQ ID NO: 1261690 - RNA, 21 nt, Homo sapiens
caaucaucaacuaccauucua

SEQ ID NO: 1261691 - RNA, 17 nt, Homo sapiens
caaucaugaaauaugca

SEQ ID NO: 1261692 - RNA, 12 nt, Homo sapiens
caaucccaaaag

SEQ ID NO: 1261693 - RNA, 15 nt, Homo sapiens
caauccccagcccuu

SEQ ID NO: 1261694 - RNA, 19 nt, Homo sapiens
caauccuugccacagugug

SEQ ID NO: 1261695 - RNA, 21 nt, Homo sapiens
caaucuacuuuguugcuaugg

SEQ ID NO: 1261696 - RNA, 14 nt, Homo sapiens
caaucuauucugua

SEQ ID NO: 1261697 - RNA, 18 nt, Homo sapiens
caaucuccccuugcacua

SEQ ID NO: 1261698 - RNA, 22 nt, Homo sapiens
caaucuccuuacuguguuucag

SEQ ID NO: 1261699 - RNA, 18 nt, Homo sapiens
caaucucggcucacugaa

SEQ ID NO: 1261700 - RNA, 19 nt, Homo sapiens
caaucucggcucacugcaa

SEQ ID NO: 1261701 - RNA, 20 nt, Homo sapiens
caaucucuuuucuacauaca

SEQ ID NO: 1261702 - RNA, 18 nt, Homo sapiens
caaucugcaguuuaacaa

SEQ ID NO: 1261703 - RNA, 19 nt, Homo sapiens
caaucugugaugacauucc

SEQ ID NO: 1261704 - RNA, 16 nt, Homo sapiens
caaucuucuacuuuaa

SEQ ID NO: 1261705 - RNA, 15 nt, Homo sapiens
caaucuuugccuuua

SEQ ID NO: 1261706 - RNA, 16 nt, Homo sapiens
caaugaacaucccuuu

SEQ ID NO: 1261707 - RNA, 17 nt, Homo sapiens
caaugaagaauuaugua

SEQ ID NO: 1261708 - RNA, 17 nt, Homo sapiens
caaugacaucucagggg

SEQ ID NO: 1261709 - RNA, 16 nt, Homo sapiens
caaugacgugugccua

SEQ ID NO: 1261710 - RNA, 19 nt, Homo sapiens
caaugacuuaaccauauaa

SEQ ID NO: 1261711 - RNA, 18 nt, Homo sapiens
caaugagauugaauuuca

SEQ ID NO: 1261712 - RNA, 15 nt, Homo sapiens
caaugagcucuucca

SEQ ID NO: 1261713 - RNA, 17 nt, Homo sapiens
caaugaguaacaggaaa

SEQ ID NO: 1261714 - RNA, 17 nt, Homo sapiens
caaugauacagucccua

SEQ ID NO: 1261715 - RNA, 12 nt, Homo sapiens
caaugaugcccu

SEQ ID NO: 1261716 - RNA, 16 nt, Homo sapiens
caaugauggcaauuuu

SEQ ID NO: 1261717 - RNA, 19 nt, Homo sapiens
caaugcacauccauuccca

SEQ ID NO: 1261718 - RNA, 20 nt, Homo sapiens
caaugcaccuagcugugcaa

SEQ ID NO: 1261719 - RNA, 22 nt, Homo sapiens
caaugcaccuagcugugcaaga

SEQ ID NO: 1261720 - RNA, 14 nt, Homo sapiens
caaugccauuucag

SEQ ID NO: 1261721 - RNA, 15 nt, Homo sapiens
caaugcccagaucaa

SEQ ID NO: 1261722 - RNA, 14 nt, Homo sapiens
caaugcucaacucc

SEQ ID NO: 1261723 - RNA, 21 nt, Homo sapiens
caaugcugaugaaucacuguu

SEQ ID NO: 1261724 - RNA, 16 nt, Homo sapiens
caauggaaacaaucuu

SEQ ID NO: 1261725 - RNA, 18 nt, Homo sapiens
caauggaguggcugccau

SEQ ID NO: 1261726 - RNA, 19 nt, Homo sapiens
caauggaguggcugccaug

SEQ ID NO: 1261727 - RNA, 15 nt, Homo sapiens
caauggcacgcuccu

SEQ ID NO: 1261728 - RNA, 18 nt, Homo sapiens
caauggcgcgaucuuggc

SEQ ID NO: 1261729 - RNA, 18 nt, Homo sapiens
caaugguccuagaacuuu

SEQ ID NO: 1261730 - RNA, 17 nt, Homo sapiens
caauggucucagccuag

SEQ ID NO: 1261731 - RNA, 13 nt, Homo sapiens
caaugguggugca

SEQ ID NO: 1261732 - RNA, 16 nt, Homo sapiens
caaugguggugcacca

SEQ ID NO: 1261733 - RNA, 23 nt, Homo sapiens
caauggugucaguauccaggcuu

SEQ ID NO: 1261734 - RNA, 17 nt, Homo sapiens
caaugguuaacaucuuc

SEQ ID NO: 1261735 - RNA, 18 nt, Homo sapiens
caaugucaugucugugau

SEQ ID NO: 1261736 - RNA, 18 nt, Homo sapiens
caaugucuucaagacuuu

SEQ ID NO: 1261737 - RNA, 18 nt, Homo sapiens
caauguguggcucagugc

SEQ ID NO: 1261738 - RNA, 21 nt, Homo sapiens
caauguguggcucagugccug

SEQ ID NO: 1261739 - RNA, 17 nt, Homo sapiens
caauguuccauucuucg

SEQ ID NO: 1261740 - RNA, 13 nt, Homo sapiens
caauguucuauua

SEQ ID NO: 1261741 - RNA, 22 nt, Homo sapiens
caauguugcaacacauucauuu

SEQ ID NO: 1261742 - RNA, 20 nt, Homo sapiens
caauuaaaacuaagcacaaa

SEQ ID NO: 1261743 - RNA, 16 nt, Homo sapiens
caauuaauauuacuca

SEQ ID NO: 1261744 - RNA, 22 nt, Homo sapiens
caauuauagaguaucacuccca

SEQ ID NO: 1261745 - RNA, 23 nt, Homo sapiens
caauucacuagaccagaagugga

SEQ ID NO: 1261746 - RNA, 20 nt, Homo sapiens
caauucagauugucuugcaa

SEQ ID NO: 1261747 - RNA, 19 nt, Homo sapiens
cacaguuuauugauuucaa

SEQ ID NO: 1261748 - RNA, 16 nt, Homo sapiens
cacauagauaccuuca

SEQ ID NO: 1261749 - RNA, 22 nt, Homo sapiens
cacauagauuaauggcacugau

SEQ ID NO: 1261750 - RNA, 21 nt, Homo sapiens
cacauagcgccgugcuguaaa

SEQ ID NO: 1261751 - RNA, 17 nt, Homo sapiens
cacauagguaaaaacug

SEQ ID NO: 1261752 - RNA, 22 nt, Homo sapiens
cacauaguagguacccaauuca

SEQ ID NO: 1261753 - RNA, 22 nt, Homo sapiens
cacauauaucaaagugagaaaa

SEQ ID NO: 1261754 - RNA, 23 nt, Homo sapiens
cacaucccuggaaggacauccau

SEQ ID NO: 1261755 - RNA, 16 nt, Homo sapiens
cacauccugugucaga

SEQ ID NO: 1261756 - RNA, 15 nt, Homo sapiens
cacaucucccagcca

SEQ ID NO: 1261757 - RNA, 19 nt, Homo sapiens
cacaugaccugaucacuag

SEQ ID NO: 1261758 - RNA, 19 nt, Homo sapiens
cacaugagaagugauaaaa

SEQ ID NO: 1261759 - RNA, 18 nt, Homo sapiens
cacaugagggggugcccu

SEQ ID NO: 1261760 - RNA, 15 nt, Homo sapiens
cacaugaugugcaua

SEQ ID NO: 1261761 - RNA, 15 nt, Homo sapiens
cacaugcacacacac

SEQ ID NO: 1261762 - RNA, 23 nt, Homo sapiens
cacaugcacacacacacaucuca

SEQ ID NO: 1261763 - RNA, 14 nt, Homo sapiens
cacaugcacgugug

SEQ ID NO: 1261764 - RNA, 20 nt, Homo sapiens
cacaugccuguaaucccagc

SEQ ID NO: 1261765 - RNA, 13 nt, Homo sapiens
cacaugcugaguc

SEQ ID NO: 1261766 - RNA, 15 nt, Homo sapiens
cacauggccuaugca

SEQ ID NO: 1261767 - RNA, 22 nt, Homo sapiens
cacaugggaguuuagugugaua

SEQ ID NO: 1261768 - RNA, 15 nt, Homo sapiens
cacauggugugaguc

SEQ ID NO: 1261769 - RNA, 18 nt, Homo sapiens
cacauggugugaguccaa

SEQ ID NO: 1261770 - RNA, 13 nt, Homo sapiens
cacauguacauaa

SEQ ID NO: 1261771 - RNA, 19 nt, Homo sapiens
cacaugucuuguacaugug

SEQ ID NO: 1261772 - RNA, 22 nt, Homo sapiens
cacaugucuuguacauguguag

SEQ ID NO: 1261773 - RNA, 18 nt, Homo sapiens
cacaugugacacauaugc

SEQ ID NO: 1261774 - RNA, 16 nt, Homo sapiens
cacaugugcacaugca

SEQ ID NO: 1261775 - RNA, 13 nt, Homo sapiens
cacaugugcaguc

SEQ ID NO: 1261776 - RNA, 15 nt, Homo sapiens
cacauuaauuaauua

SEQ ID NO: 1261777 - RNA, 19 nt, Homo sapiens
cacauucaugugggcauuu

SEQ ID NO: 1261778 - RNA, 17 nt, Homo sapiens
cacauucccaucuguca

SEQ ID NO: 1261779 - RNA, 19 nt, Homo sapiens
cacauuugguuucugaaua

SEQ ID NO: 1261780 - RNA, 14 nt, Homo sapiens
caccaaaaccaaac

SEQ ID NO: 1261781 - RNA, 21 nt, Homo sapiens
caccaaacugcacacacagcu

SEQ ID NO: 1261782 - RNA, 15 nt, Homo sapiens
caccaaagacaguug

SEQ ID NO: 1261783 - RNA, 15 nt, Homo sapiens
caccaaagacaucag

SEQ ID NO: 1261784 - RNA, 18 nt, Homo sapiens
caccaacaacgcuuguga

SEQ ID NO: 1261785 - RNA, 18 nt, Homo sapiens
caccaaccagaccacuca

SEQ ID NO: 1261786 - RNA, 13 nt, Homo sapiens
caccaacuccuaa

SEQ ID NO: 1261787 - RNA, 12 nt, Homo sapiens
caccaacuucac

SEQ ID NO: 1261788 - RNA, 21 nt, Homo sapiens
caccaagcucuguccaaucag

SEQ ID NO: 1261789 - RNA, 23 nt, Homo sapiens
caccaaggcugagacagugaauu

SEQ ID NO: 1261790 - RNA, 17 nt, Homo sapiens
caccaauaucaguccuc

SEQ ID NO: 1261791 - RNA, 23 nt, Homo sapiens
caccacacccagccucaguccuc

SEQ ID NO: 1261792 - RNA, 16 nt, Homo sapiens
caccacaccuggcuaa

SEQ ID NO: 1261793 - RNA, 16 nt, Homo sapiens
caccacagacacacac

SEQ ID NO: 1261794 - RNA, 15 nt, Homo sapiens
caccaccuccagcuu

SEQ ID NO: 1261795 - RNA, 22 nt, Homo sapiens
caccacugaaacccugcacuua

SEQ ID NO: 1261796 - RNA, 14 nt, Homo sapiens
caccacuggccacc

SEQ ID NO: 1261797 - RNA, 20 nt, Homo sapiens
caccagagagagauucuucc

SEQ ID NO: 1261798 - RNA, 17 nt, Homo sapiens
caccagagcaaccucuc

SEQ ID NO: 1261799 - RNA, 18 nt, Homo sapiens
caccagccccacugccag

SEQ ID NO: 1261800 - RNA, 21 nt, Homo sapiens
caccagcccugaccccagugu

SEQ ID NO: 1261801 - RNA, 18 nt, Homo sapiens
caccaggcacugcugcac

SEQ ID NO: 1261802 - RNA, 16 nt, Homo sapiens
caccaggggugcucac

SEQ ID NO: 1261803 - RNA, 21 nt, Homo sapiens
caccaucuacaccagugacgc

SEQ ID NO: 1261804 - RNA, 13 nt, Homo sapiens
caccaugagcuca

SEQ ID NO: 1261805 - RNA, 23 nt, Homo sapiens
caccaugcugaauguacacugau

SEQ ID NO: 1261806 - RNA, 13 nt, Homo sapiens
cacccaaagcaug

SEQ ID NO: 1261807 - RNA, 22 nt, Homo sapiens
cacccaacccuaucuccugaca

SEQ ID NO: 1261808 - RNA, 12 nt, Homo sapiens
cacccacaugug

SEQ ID NO: 1261809 - RNA, 13 nt, Homo sapiens
cacccacauguga

SEQ ID NO: 1261810 - RNA, 19 nt, Homo sapiens
cacccaccauauuguuuga

SEQ ID NO: 1261811 - RNA, 13 nt, Homo sapiens
cacccacucagga

SEQ ID NO: 1261812 - RNA, 18 nt, Homo sapiens
cacccagaccccaggcug

SEQ ID NO: 1261813 - RNA, 23 nt, Homo sapiens
cacccagcucagcauuuccacac

SEQ ID NO: 1261814 - RNA, 22 nt, Homo sapiens
cacccaggcccgcaccgcuggg

SEQ ID NO: 1261815 - RNA, 18 nt, Homo sapiens
cacccaggcuggagugca

SEQ ID NO: 1261816 - RNA, 20 nt, Homo sapiens
cacccaguuugauaccugca

SEQ ID NO: 1261817 - RNA, 15 nt, Homo sapiens
caccccacagacucc

SEQ ID NO: 1261818 - RNA, 16 nt, Homo sapiens
cacccccaccauccag

SEQ ID NO: 1261819 - RNA, 20 nt, Homo sapiens
cacccccuucucugcuccac

SEQ ID NO: 1261820 - RNA, 18 nt, Homo sapiens
caccccgccugcccucau

SEQ ID NO: 1261821 - RNA, 21 nt, Homo sapiens
caccccggggacccugugaca

SEQ ID NO: 1261822 - RNA, 18 nt, Homo sapiens
caccccuaaucugcagug

SEQ ID NO: 1261823 - RNA, 17 nt, Homo sapiens
caccccuauggugcuca

SEQ ID NO: 1261824 - RNA, 16 nt, Homo sapiens
caccccugcacaguug

SEQ ID NO: 1261825 - RNA, 13 nt, Homo sapiens
caccccugcaguu

SEQ ID NO: 1261826 - RNA, 22 nt, Homo sapiens
cacccgaagcgcuucugcacca

SEQ ID NO: 1261827 - RNA, 17 nt, Homo sapiens
cacccgacuccucaaaa

SEQ ID NO: 1261828 - RNA, 18 nt, Homo sapiens
cacccgccgccucccacg

SEQ ID NO: 1261829 - RNA, 13 nt, Homo sapiens
cacccgugagaaa

SEQ ID NO: 1261830 - RNA, 22 nt, Homo sapiens
cacccgugagcgccugugcaca

SEQ ID NO: 1261831 - RNA, 22 nt, Homo sapiens
cacccucacacacacagcuggg

SEQ ID NO: 1261832 - RNA, 18 nt, Homo sapiens
cacccuccaccucuucac

SEQ ID NO: 1261833 - RNA, 18 nt, Homo sapiens
cacccucuuccugugauc

SEQ ID NO: 1261834 - RNA, 21 nt, Homo sapiens
cacccugccaagacuccucag

SEQ ID NO: 1261835 - RNA, 19 nt, Homo sapiens
cacccugccacucuugaca

SEQ ID NO: 1261836 - RNA, 20 nt, Homo sapiens
cacccuguagguucuugaua

SEQ ID NO: 1261837 - RNA, 21 nt, Homo sapiens
cacccuuguccuugagugcuc

SEQ ID NO: 1261838 - RNA, 23 nt, Homo sapiens
cacccuuugugguuacaguuuga

SEQ ID NO: 1261839 - RNA, 14 nt, Homo sapiens
caccgacuagccag

SEQ ID NO: 1261840 - RNA, 20 nt, Homo sapiens
caccgagaauguuguauuca

SEQ ID NO: 1261841 - RNA, 17 nt, Homo sapiens
caccgccgccaccagcc

SEQ ID NO: 1261842 - RNA, 17 nt, Homo sapiens
caccguacaucugcaau

SEQ ID NO: 1261843 - RNA, 22 nt, Homo sapiens
caccuaagaucucgguuugcca

SEQ ID NO: 1261844 - RNA, 12 nt, Homo sapiens
caccuaccacuc

SEQ ID NO: 1261845 - RNA, 16 nt, Homo sapiens
caccuaccgaguucaa

SEQ ID NO: 1261846 - RNA, 23 nt, Homo sapiens
caccuaccuuagaaaacaaguau

SEQ ID NO: 1261847 - RNA, 19 nt, Homo sapiens
caccuacgcgagucuuacu

SEQ ID NO: 1261848 - RNA, 13 nt, Homo sapiens
caccuagacugua

SEQ ID NO: 1261849 - RNA, 12 nt, Homo sapiens
caccuagcuuua

SEQ ID NO: 1261850 - RNA, 21 nt, Homo sapiens
caccuagugcuuccacuucua

SEQ ID NO: 1261851 - RNA, 13 nt, Homo sapiens
caccucacagcca

SEQ ID NO: 1261852 - RNA, 16 nt, Homo sapiens
caccuccaccugugag

SEQ ID NO: 1261853 - RNA, 13 nt, Homo sapiens
caccuccauuaaa

SEQ ID NO: 1261854 - RNA, 13 nt, Homo sapiens
caccuccauuugc

SEQ ID NO: 1261855 - RNA, 17 nt, Homo sapiens
caccucccauuacuuug

SEQ ID NO: 1261856 - RNA, 19 nt, Homo sapiens
caccucccauuacuuugau

SEQ ID NO: 1261857 - RNA, 20 nt, Homo sapiens
caccuccucauguacauacc

SEQ ID NO: 1261858 - RNA, 15 nt, Homo sapiens
caccuccucuaaggu

SEQ ID NO: 1261859 - RNA, 21 nt, Homo sapiens
cugugggucugggagucacac

SEQ ID NO: 1261860 - RNA, 13 nt, Homo sapiens
cugugguccccga

SEQ ID NO: 1261861 - RNA, 19 nt, Homo sapiens
cugugguggccgugccuga

SEQ ID NO: 1261862 - RNA, 17 nt, Homo sapiens
cugugguuaacaucuca

SEQ ID NO: 1261863 - RNA, 14 nt, Homo sapiens
cuguguacugccuu

SEQ ID NO: 1261864 - RNA, 14 nt, Homo sapiens
cuguguacugugga

SEQ ID NO: 1261865 - RNA, 14 nt, Homo sapiens
cuguguaggcauuu

SEQ ID NO: 1261866 - RNA, 19 nt, Homo sapiens
cuguguauguauaagugug

SEQ ID NO: 1261867 - RNA, 17 nt, Homo sapiens
cuguguauuuacaugaa

SEQ ID NO: 1261868 - RNA, 19 nt, Homo sapiens
cuguguccuacuccuugca

SEQ ID NO: 1261869 - RNA, 15 nt, Homo sapiens
cugugucguagccaa

SEQ ID NO: 1261870 - RNA, 15 nt, Homo sapiens
cugugugaaggugaa

SEQ ID NO: 1261871 - RNA, 23 nt, Homo sapiens
cugugugccauuuuaagaguuac

SEQ ID NO: 1261872 - RNA, 15 nt, Homo sapiens
cuguguggacuguga

SEQ ID NO: 1261873 - RNA, 22 nt, Homo sapiens
cuguguggacugugaugccaca

SEQ ID NO: 1261874 - RNA, 16 nt, Homo sapiens
cuguguguccaaaacu

SEQ ID NO: 1261875 - RNA, 13 nt, Homo sapiens
cuguguguguucu

SEQ ID NO: 1261876 - RNA, 13 nt, Homo sapiens
cuguguuaggggu

SEQ ID NO: 1261877 - RNA, 21 nt, Homo sapiens
cuguguugccaagcuccaagc

SEQ ID NO: 1261878 - RNA, 15 nt, Homo sapiens
cuguuaaaugaacuu

SEQ ID NO: 1261879 - RNA, 22 nt, Homo sapiens
cuguuaacuaugacagauauau

SEQ ID NO: 1261880 - RNA, 20 nt, Homo sapiens
cuguuaacuuaauaguauuu

SEQ ID NO: 1261881 - RNA, 13 nt, Homo sapiens
cuguuacccaggc

SEQ ID NO: 1261882 - RNA, 19 nt, Homo sapiens
cuguuacugaaauugguau

SEQ ID NO: 1261883 - RNA, 16 nt, Homo sapiens
cuguuagucauuugcu

SEQ ID NO: 1261884 - RNA, 16 nt, Homo sapiens
cuguuaucuucacuuu

SEQ ID NO: 1261885 - RNA, 18 nt, Homo sapiens
cuguuauggggacuuuau

SEQ ID NO: 1261886 - RNA, 23 nt, Homo sapiens
cuguuauuagcugggaagaccaa

SEQ ID NO: 1261887 - RNA, 21 nt, Homo sapiens
cuguucaaugauuauuuguau

SEQ ID NO: 1261888 - RNA, 15 nt, Homo sapiens
cuguucacuuuucaa

SEQ ID NO: 1261889 - RNA, 17 nt, Homo sapiens
cuguucaucuugccaag

SEQ ID NO: 1261890 - RNA, 14 nt, Homo sapiens
cuguucauuucaca

SEQ ID NO: 1261891 - RNA, 21 nt, Homo sapiens
cuguucauuucacacagugaa

SEQ ID NO: 1261892 - RNA, 21 nt, Homo sapiens
cuguuccacacccaaugcugc

SEQ ID NO: 1261893 - RNA, 21 nt, Homo sapiens
cuguucccccacccuccaugc

SEQ ID NO: 1261894 - RNA, 15 nt, Homo sapiens
cuguucccuugcagg

SEQ ID NO: 1261895 - RNA, 21 nt, Homo sapiens
cuguucuaccaagaacugaag

SEQ ID NO: 1261896 - RNA, 20 nt, Homo sapiens
cuguucucuugggaacugaa

SEQ ID NO: 1261897 - RNA, 19 nt, Homo sapiens
cuguucugggggacagaga

SEQ ID NO: 1261898 - RNA, 20 nt, Homo sapiens
cuguucugggggacagagaa

SEQ ID NO: 1261899 - RNA, 19 nt, Homo sapiens
cuguucuguuggaugacuu

SEQ ID NO: 1261900 - RNA, 23 nt, Homo sapiens
cuguucuguuggaugacuuugag

SEQ ID NO: 1261901 - RNA, 21 nt, Homo sapiens
cuguucuguuuggcacuugua

SEQ ID NO: 1261902 - RNA, 12 nt, Homo sapiens
cuguucuuccuc

SEQ ID NO: 1261903 - RNA, 16 nt, Homo sapiens
cuguucuugcugcuag

SEQ ID NO: 1261904 - RNA, 22 nt, Homo sapiens
cuguugaaaauuauuuuaaaca

SEQ ID NO: 1261905 - RNA, 19 nt, Homo sapiens
cuguugagacugauucaga

SEQ ID NO: 1261906 - RNA, 14 nt, Homo sapiens
cuguugaugccguu

SEQ ID NO: 1261907 - RNA, 18 nt, Homo sapiens
cuguugcaaacucagugc

SEQ ID NO: 1261908 - RNA, 18 nt, Homo sapiens
cuguugcccauugcacuu

SEQ ID NO: 1261909 - RNA, 12 nt, Homo sapiens
cuguugcucaaa

SEQ ID NO: 1261910 - RNA, 16 nt, Homo sapiens
cuguuggccaguguga

SEQ ID NO: 1261911 - RNA, 21 nt, Homo sapiens
cuguuggccagugugacaagg

SEQ ID NO: 1261912 - RNA, 16 nt, Homo sapiens
cuguugguuagauuca

SEQ ID NO: 1261913 - RNA, 15 nt, Homo sapiens
cuguugucaaaaagu

SEQ ID NO: 1261914 - RNA, 20 nt, Homo sapiens
cuguugugaucuugcauuca

SEQ ID NO: 1261915 - RNA, 23 nt, Homo sapiens
cuguuuacaaaagcccaauguaa

SEQ ID NO: 1261916 - RNA, 18 nt, Homo sapiens
cuguuuagcagaacucau

SEQ ID NO: 1261917 - RNA, 17 nt, Homo sapiens
cuguuucaacuguauaa

SEQ ID NO: 1261918 - RNA, 21 nt, Homo sapiens
cuguuucaacuguauaacuau

SEQ ID NO: 1261919 - RNA, 13 nt, Homo sapiens
cuguuucagaaau

SEQ ID NO: 1261920 - RNA, 21 nt, Homo sapiens
cuguuugagaaccauuuacuu

SEQ ID NO: 1261921 - RNA, 21 nt, Homo sapiens
cuguuugaugcuauuuaugca

SEQ ID NO: 1261922 - RNA, 15 nt, Homo sapiens
cuguuugcuguggaa

SEQ ID NO: 1261923 - RNA, 17 nt, Homo sapiens
cuguuuggcacuuguau

SEQ ID NO: 1261924 - RNA, 17 nt, Homo sapiens
cuguuugguguguccca

SEQ ID NO: 1261925 - RNA, 13 nt, Homo sapiens
cuguuuguuaaaa

SEQ ID NO: 1261926 - RNA, 21 nt, Homo sapiens
cuguuuuauaaugaacccauc

SEQ ID NO: 1261927 - RNA, 15 nt, Homo sapiens
cuguuuucucucggc

SEQ ID NO: 1261928 - RNA, 20 nt, Homo sapiens
cuguuuuguaagugcugcua

SEQ ID NO: 1261929 - RNA, 14 nt, Homo sapiens
cuguuuugugagaa

SEQ ID NO: 1261930 - RNA, 15 nt, Homo sapiens
cuuaaaaaaugucca

SEQ ID NO: 1261931 - RNA, 16 nt, Homo sapiens
cuuaaaaaauguccau

SEQ ID NO: 1261932 - RNA, 21 nt, Homo sapiens
cuuaaaaauuagcaugcugcu

SEQ ID NO: 1261933 - RNA, 15 nt, Homo sapiens
cuuaaaacaaauuca

SEQ ID NO: 1261934 - RNA, 13 nt, Homo sapiens
cuuaaaacagcug

SEQ ID NO: 1261935 - RNA, 22 nt, Homo sapiens
cuuaaaagcaaguuucagugaa

SEQ ID NO: 1261936 - RNA, 22 nt, Homo sapiens
cuuaaaauaagcagguggaucu

SEQ ID NO: 1261937 - RNA, 15 nt, Homo sapiens
cuuaaaaucugugaa

SEQ ID NO: 1261938 - RNA, 16 nt, Homo sapiens
cuuaaaauuaccagac

SEQ ID NO: 1261939 - RNA, 14 nt, Homo sapiens
cuuaaacaauguau

SEQ ID NO: 1261940 - RNA, 13 nt, Homo sapiens
cuuaaacaguauu

SEQ ID NO: 1261941 - RNA, 16 nt, Homo sapiens
cuuaaacgaaagaaua

SEQ ID NO: 1261942 - RNA, 23 nt, Homo sapiens
cuuaaacuguguggacugugaug

SEQ ID NO: 1261943 - RNA, 16 nt, Homo sapiens
cuuaaagcauuugcaa

SEQ ID NO: 1261944 - RNA, 21 nt, Homo sapiens
cuuaaaggcaccaucuaauag

SEQ ID NO: 1261945 - RNA, 16 nt, Homo sapiens
cuuaaaggcuguggua

SEQ ID NO: 1261946 - RNA, 19 nt, Homo sapiens
cuuaaaguuuuaacuuuua

SEQ ID NO: 1261947 - RNA, 19 nt, Homo sapiens
cuuaaauaaacucaaugag

SEQ ID NO: 1261948 - RNA, 22 nt, Homo sapiens
cuuaaaugaucugccucuaaaa

SEQ ID NO: 1261949 - RNA, 17 nt, Homo sapiens
cuuaaauguuuauacug

SEQ ID NO: 1261950 - RNA, 18 nt, Homo sapiens
cuuaaauguuuauacugu

SEQ ID NO: 1261951 - RNA, 15 nt, Homo sapiens
cuuaacaaaccaaca

SEQ ID NO: 1261952 - RNA, 15 nt, Homo sapiens
cuuaacauucauaga

SEQ ID NO: 1261953 - RNA, 18 nt, Homo sapiens
cuuaacugcauuuuuaga

SEQ ID NO: 1261954 - RNA, 19 nt, Homo sapiens
cuuaagacuuuugggacau

SEQ ID NO: 1261955 - RNA, 21 nt, Homo sapiens
cuuaagagacacuccaaaccu

SEQ ID NO: 1261956 - RNA, 16 nt, Homo sapiens
cuuaagagacuacaga

SEQ ID NO: 1261957 - RNA, 18 nt, Homo sapiens
cuuaagcuuuggacccaa

SEQ ID NO: 1261958 - RNA, 19 nt, Homo sapiens
cuuaagggaaaaguucucc

SEQ ID NO: 1261959 - RNA, 23 nt, Homo sapiens
cuuaaggggggcagggagugaug

SEQ ID NO: 1261960 - RNA, 20 nt, Homo sapiens
cuuaagggguaucauguaug

SEQ ID NO: 1261961 - RNA, 22 nt, Homo sapiens
cuuaauaaacuguggugcuuuu

SEQ ID NO: 1261962 - RNA, 16 nt, Homo sapiens
cuuaauaaauauuaca

SEQ ID NO: 1261963 - RNA, 20 nt, Homo sapiens
cuuaauaaauauuacaguga

SEQ ID NO: 1261964 - RNA, 21 nt, Homo sapiens
cuuaauaaauauuacagugaa

SEQ ID NO: 1261965 - RNA, 17 nt, Homo sapiens
cuuaauaacaacagauc

SEQ ID NO: 1261966 - RNA, 16 nt, Homo sapiens
cuuaauacuaccuuga

SEQ ID NO: 1261967 - RNA, 17 nt, Homo sapiens
cuuaauacuuuaugaug

SEQ ID NO: 1261968 - RNA, 22 nt, Homo sapiens
cuuaauaguaggguaaguuguu

SEQ ID NO: 1261969 - RNA, 14 nt, Homo sapiens
cuuaauuuaaguca

SEQ ID NO: 1261970 - RNA, 14 nt, Homo sapiens
cuuaauuugcacag

SEQ ID NO: 1261971 - RNA, 17 nt, Homo sapiens
cuuaauuuucaguauaa

SEQ ID NO: 1261972 - RNA, 18 nt, Homo sapiens
cuuaccagaagcuuccau

SEQ ID NO: 1261973 - RNA, 13 nt, Homo sapiens
cuuacuacacuga

SEQ ID NO: 1261974 - RNA, 18 nt, Homo sapiens
cuuacuagaccuguaacu

SEQ ID NO: 1261975 - RNA, 15 nt, Homo sapiens
cuuacuccacuucgc

SEQ ID NO: 1261976 - RNA, 21 nt, Homo sapiens
cuuacuggggccuggggcucu

SEQ ID NO: 1261977 - RNA, 16 nt, Homo sapiens
cuuacuguuucuguca

SEQ ID NO: 1261978 - RNA, 13 nt, Homo sapiens
cuuacuuccagca

SEQ ID NO: 1261979 - RNA, 15 nt, Homo sapiens
cuuacuucuuagcac

SEQ ID NO: 1261980 - RNA, 23 nt, Homo sapiens
cuuacuuuuuuuggaaguuauuu

SEQ ID NO: 1261981 - RNA, 16 nt, Homo sapiens
cuuagaaacacauaaa

SEQ ID NO: 1261982 - RNA, 20 nt, Homo sapiens
cuuagaaaucauuguagaaa

SEQ ID NO: 1261983 - RNA, 18 nt, Homo sapiens
cuuagaaauugcauuucc

SEQ ID NO: 1261984 - RNA, 20 nt, Homo sapiens
cuuagaacauuuuaauucau

SEQ ID NO: 1261985 - RNA, 16 nt, Homo sapiens
cuuagacuucgacuca

SEQ ID NO: 1261986 - RNA, 21 nt, Homo sapiens
cuuagagugggaccaacuucc

SEQ ID NO: 1261987 - RNA, 17 nt, Homo sapiens
cuuagaguguagcugua

SEQ ID NO: 1261988 - RNA, 18 nt, Homo sapiens
cuuagcaacucagagaaa

SEQ ID NO: 1261989 - RNA, 13 nt, Homo sapiens
cuuagcacacuca

SEQ ID NO: 1261990 - RNA, 17 nt, Homo sapiens
cuuagcagcuuccagau

SEQ ID NO: 1261991 - RNA, 18 nt, Homo sapiens
cuuagcccaagaggucug

SEQ ID NO: 1261992 - RNA, 20 nt, Homo sapiens
cuuaggaaggccuucaggag

SEQ ID NO: 1261993 - RNA, 15 nt, Homo sapiens
cuuaggcaugcacag

SEQ ID NO: 1261994 - RNA, 23 nt, Homo sapiens
cuuaggccuuccucucuccagau

SEQ ID NO: 1261995 - RNA, 21 nt, Homo sapiens
cuuagggugcugagugccuga

SEQ ID NO: 1261996 - RNA, 11 nt, Homo sapiens
cuuaguaccag

SEQ ID NO: 1261997 - RNA, 23 nt, Homo sapiens
cuuaguaccagagcuaguuuuca

SEQ ID NO: 1261998 - RNA, 17 nt, Homo sapiens
cuuagucacuuauuuca

SEQ ID NO: 1261999 - RNA, 13 nt, Homo sapiens
cuuagucauuacu

SEQ ID NO: 1262000 - RNA, 16 nt, Homo sapiens
cuuagugaucauuuaa

SEQ ID NO: 1262001 - RNA, 18 nt, Homo sapiens
cuuagugcuucagaguuu

SEQ ID NO: 1262002 - RNA, 12 nt, Homo sapiens
cuuaguucucac

SEQ ID NO: 1262003 - RNA, 19 nt, Homo sapiens
cuuauaaaaauaaagggaa

SEQ ID NO: 1262004 - RNA, 15 nt, Homo sapiens
cuuauagcacuuuga

SEQ ID NO: 1262005 - RNA, 17 nt, Homo sapiens
cuuauagcacuuugaaa

SEQ ID NO: 1262006 - RNA, 16 nt, Homo sapiens
cuuauaggguaaaaaa

SEQ ID NO: 1262007 - RNA, 15 nt, Homo sapiens
cuuauaugugacacu

SEQ ID NO: 1262008 - RNA, 20 nt, Homo sapiens
cuuauauuuaaaacuugccu

SEQ ID NO: 1262009 - RNA, 18 nt, Homo sapiens
cuuaucaacuaaugauuu

SEQ ID NO: 1262010 - RNA, 14 nt, Homo sapiens
cuuauccacuuuga

SEQ ID NO: 1262011 - RNA, 16 nt, Homo sapiens
cuuauccaucuuugaa

SEQ ID NO: 1262012 - RNA, 18 nt, Homo sapiens
cuuaucuuacaauauuga

SEQ ID NO: 1262013 - RNA, 12 nt, Homo sapiens
cuuaucuugcac

SEQ ID NO: 1262014 - RNA, 20 nt, Homo sapiens
cuuaugaaaagaauuugaug

SEQ ID NO: 1262015 - RNA, 17 nt, Homo sapiens
cuuaugacuugcuacuu

SEQ ID NO: 1262016 - RNA, 15 nt, Homo sapiens
cuuaugauacuugag

SEQ ID NO: 1262017 - RNA, 16 nt, Homo sapiens
cuuaugauacuugagg

SEQ ID NO: 1262018 - RNA, 13 nt, Homo sapiens
cuuaugauucaga

SEQ ID NO: 1262019 - RNA, 18 nt, Homo sapiens
cuuauggaauugauuugc

SEQ ID NO: 1262020 - RNA, 18 nt, Homo sapiens
cuuauguacuugauacug

SEQ ID NO: 1262021 - RNA, 18 nt, Homo sapiens
cuuauguagauauuuggc

SEQ ID NO: 1262022 - RNA, 14 nt, Homo sapiens
cuuaugugacaugg

SEQ ID NO: 1262023 - RNA, 21 nt, Homo sapiens
cuuauguggguugccugguga

SEQ ID NO: 1262024 - RNA, 15 nt, Homo sapiens
cuuauguguugugua

SEQ ID NO: 1262025 - RNA, 21 nt, Homo sapiens
cuuauuacaauuuguucaucc

SEQ ID NO: 1262026 - RNA, 16 nt, Homo sapiens
cuuauuuaaugaaaga

SEQ ID NO: 1262027 - RNA, 20 nt, Homo sapiens
cuuauuucuagaagcacaug

SEQ ID NO: 1262028 - RNA, 17 nt, Homo sapiens
cuuauuuuugacagugu

SEQ ID NO: 1262029 - RNA, 21 nt, Homo sapiens
cuucaagacgacagcucugua

SEQ ID NO: 1262030 - RNA, 14 nt, Homo sapiens
cuucaagaucucau

SEQ ID NO: 1262031 - RNA, 22 nt, Homo sapiens
cuucaaggcccauaucugugaa

SEQ ID NO: 1262032 - RNA, 15 nt, Homo sapiens
cuucaagugccaaac

SEQ ID NO: 1262033 - RNA, 22 nt, Homo sapiens
cuucaagugccuuuugcugcgc

SEQ ID NO: 1262034 - RNA, 16 nt, Homo sapiens
cuucaaguuagcucag

SEQ ID NO: 1262035 - RNA, 21 nt, Homo sapiens
cuucaaucucuugcacucaaa

SEQ ID NO: 1262036 - RNA, 16 nt, Homo sapiens
cuucaaucuuaaaaca

SEQ ID NO: 1262037 - RNA, 16 nt, Homo sapiens
cuucaaugcuagaaaa

SEQ ID NO: 1262038 - RNA, 17 nt, Homo sapiens
cuucaauuguauuauau

SEQ ID NO: 1262039 - RNA, 13 nt, Homo sapiens
cuucacaacuagg

SEQ ID NO: 1262040 - RNA, 17 nt, Homo sapiens
cuucacagggaagcaug

SEQ ID NO: 1262041 - RNA, 17 nt, Homo sapiens
cuucacccuggagccca

SEQ ID NO: 1262042 - RNA, 17 nt, Homo sapiens
cuucacgcccuuggcca

SEQ ID NO: 1262043 - RNA, 19 nt, Homo sapiens
cuucacgggcaaucaugag

SEQ ID NO: 1262044 - RNA, 16 nt, Homo sapiens
cuucacucacugucaa

SEQ ID NO: 1262045 - RNA, 19 nt, Homo sapiens
cuucacugaaagacaccau

SEQ ID NO: 1262046 - RNA, 22 nt, Homo sapiens
cuucacuggcuuccaucagugg

SEQ ID NO: 1262047 - RNA, 20 nt, Homo sapiens
cuucacuuggccaguuucag

SEQ ID NO: 1262048 - RNA, 16 nt, Homo sapiens
cuucagaauaucuuaa

SEQ ID NO: 1262049 - RNA, 17 nt, Homo sapiens
cuucagauacaaacugc

SEQ ID NO: 1262050 - RNA, 14 nt, Homo sapiens
cuucagaucucugg

SEQ ID NO: 1262051 - RNA, 13 nt, Homo sapiens
cuucagaucugag

SEQ ID NO: 1262052 - RNA, 13 nt, Homo sapiens
cuucagcaaguua

SEQ ID NO: 1262053 - RNA, 14 nt, Homo sapiens
cuucagcagucaau

SEQ ID NO: 1262054 - RNA, 16 nt, Homo sapiens
gaaaguaacugugaga

SEQ ID NO: 1262055 - RNA, 16 nt, Homo sapiens
gaaaguacauuuggag

SEQ ID NO: 1262056 - RNA, 21 nt, Homo sapiens
gaaaguagaacuuacuauuca

SEQ ID NO: 1262057 - RNA, 16 nt, Homo sapiens
gaaagucaccaggacu

SEQ ID NO: 1262058 - RNA, 17 nt, Homo sapiens
gaaaguccagcacugga

SEQ ID NO: 1262059 - RNA, 22 nt, Homo sapiens
gaaaguucccccaucaguuccc

SEQ ID NO: 1262060 - RNA, 19 nt, Homo sapiens
gaaaguucuugguggugga

SEQ ID NO: 1262061 - RNA, 15 nt, Homo sapiens
gaaaguuugcacugu

SEQ ID NO: 1262062 - RNA, 15 nt, Homo sapiens
gaaauaaacacuggu

SEQ ID NO: 1262063 - RNA, 17 nt, Homo sapiens
gaaauaaacacuggugc

SEQ ID NO: 1262064 - RNA, 16 nt, Homo sapiens
gaaauaaacugugcaa

SEQ ID NO: 1262065 - RNA, 19 nt, Homo sapiens
gaaauaaaggaugugauug

SEQ ID NO: 1262066 - RNA, 17 nt, Homo sapiens
gaaauaauuuaguuucu

SEQ ID NO: 1262067 - RNA, 23 nt, Homo sapiens
gaaauacacuguuaucuucacuu

SEQ ID NO: 1262068 - RNA, 19 nt, Homo sapiens
gaaauaccacaagccugag

SEQ ID NO: 1262069 - RNA, 20 nt, Homo sapiens
gaaauagaagcaaaugacaa

SEQ ID NO: 1262070 - RNA, 22 nt, Homo sapiens
gaaauaguaccuucaauacuua

SEQ ID NO: 1262071 - RNA, 21 nt, Homo sapiens
gaaauauaacaagugggugaa

SEQ ID NO: 1262072 - RNA, 22 nt, Homo sapiens
gaaauauauauguguguguaug

SEQ ID NO: 1262073 - RNA, 19 nt, Homo sapiens
gaaauauccagaacauacu

SEQ ID NO: 1262074 - RNA, 21 nt, Homo sapiens
gaaauaugaugagauucacuu

SEQ ID NO: 1262075 - RNA, 16 nt, Homo sapiens
gaaauauuauuggugu

SEQ ID NO: 1262076 - RNA, 23 nt, Homo sapiens
gaaaucaaaagauaguugauucu

SEQ ID NO: 1262077 - RNA, 18 nt, Homo sapiens
gaaaucaaugaagcaagu

SEQ ID NO: 1262078 - RNA, 22 nt, Homo sapiens
gaaaucauaaaggaucagagau

SEQ ID NO: 1262079 - RNA, 21 nt, Homo sapiens
gaaaucauaguuuaaacugca

SEQ ID NO: 1262080 - RNA, 22 nt, Homo sapiens
gaaauccuuccuaaacccaaug

SEQ ID NO: 1262081 - RNA, 13 nt, Homo sapiens
gaaaucugccaau

SEQ ID NO: 1262082 - RNA, 22 nt, Homo sapiens
gaaaugauccccaaguggugaa

SEQ ID NO: 1262083 - RNA, 22 nt, Homo sapiens
gaaaugcaaaagauacggccca

SEQ ID NO: 1262084 - RNA, 12 nt, Homo sapiens
gaaaugcaaaau

SEQ ID NO: 1262085 - RNA, 16 nt, Homo sapiens
gaaaugccacgugguc

SEQ ID NO: 1262086 - RNA, 21 nt, Homo sapiens
gaaauggugcucaccaugcuu

SEQ ID NO: 1262087 - RNA, 19 nt, Homo sapiens
gaaauguaaaauugaaaau

SEQ ID NO: 1262088 - RNA, 14 nt, Homo sapiens
gaaauguaugugcu

SEQ ID NO: 1262089 - RNA, 16 nt, Homo sapiens
gaaauuaagaaggcaa

SEQ ID NO: 1262090 - RNA, 17 nt, Homo sapiens
gaaauuaagaaggcaaa

SEQ ID NO: 1262091 - RNA, 17 nt, Homo sapiens
gaaauuaagacuuuaug

SEQ ID NO: 1262092 - RNA, 17 nt, Homo sapiens
gaaauuaccagauauaa

SEQ ID NO: 1262093 - RNA, 21 nt, Homo sapiens
gaaauuacuggaaggcuucca

SEQ ID NO: 1262094 - RNA, 21 nt, Homo sapiens
gaaauuaguuucaaauuuacc

SEQ ID NO: 1262095 - RNA, 16 nt, Homo sapiens
gaaauuauuucucuca

SEQ ID NO: 1262096 - RNA, 23 nt, Homo sapiens
gaaauucaccuucaaaagcacug

SEQ ID NO: 1262097 - RNA, 20 nt, Homo sapiens
gaaauucuaaagagcacuua

SEQ ID NO: 1262098 - RNA, 15 nt, Homo sapiens
gaaauucucugcgau

SEQ ID NO: 1262099 - RNA, 14 nt, Homo sapiens
gaaauucugaugag

SEQ ID NO: 1262100 - RNA, 19 nt, Homo sapiens
gaaauugcauuuccugaca

SEQ ID NO: 1262101 - RNA, 15 nt, Homo sapiens
gaaauugucaaagac

SEQ ID NO: 1262102 - RNA, 21 nt, Homo sapiens
gaaauuuaacauaguaauucu

SEQ ID NO: 1262103 - RNA, 11 nt, Homo sapiens
gaaauuuugcc

SEQ ID NO: 1262104 - RNA, 12 nt, Homo sapiens
gaaauuuugccu

SEQ ID NO: 1262105 - RNA, 15 nt, Homo sapiens
gaacaaaaaaaccac

SEQ ID NO: 1262106 - RNA, 21 nt, Homo sapiens
gaacaaaaagaaaucuugucu

SEQ ID NO: 1262107 - RNA, 16 nt, Homo sapiens
gaacaaaauaaagugu

SEQ ID NO: 1262108 - RNA, 13 nt, Homo sapiens
gaacaaacagggc

SEQ ID NO: 1262109 - RNA, 12 nt, Homo sapiens
gaacaacacuuc

SEQ ID NO: 1262110 - RNA, 18 nt, Homo sapiens
gaacaaucuuugcuguau

SEQ ID NO: 1262111 - RNA, 14 nt, Homo sapiens
gaacaauguugcaa

SEQ ID NO: 1262112 - RNA, 15 nt, Homo sapiens
gaacaauugaaguaa

SEQ ID NO: 1262113 - RNA, 12 nt, Homo sapiens
gaacacacuugg

SEQ ID NO: 1262114 - RNA, 15 nt, Homo sapiens
gaacacagcaugugc

SEQ ID NO: 1262115 - RNA, 18 nt, Homo sapiens
gaacacucuuuugcuuua

SEQ ID NO: 1262116 - RNA, 13 nt, Homo sapiens
gaacacugcuuga

SEQ ID NO: 1262117 - RNA, 13 nt, Homo sapiens
gaacagaccagug

SEQ ID NO: 1262118 - RNA, 19 nt, Homo sapiens
gaacagcaauggugucagu

SEQ ID NO: 1262119 - RNA, 15 nt, Homo sapiens
gaacagcacugggga

SEQ ID NO: 1262120 - RNA, 13 nt, Homo sapiens
gaacagguucuua

SEQ ID NO: 1262121 - RNA, 11 nt, Homo sapiens
gaacauaaaaa

SEQ ID NO: 1262122 - RNA, 18 nt, Homo sapiens
gaacaucucgaauacaau

SEQ ID NO: 1262123 - RNA, 16 nt, Homo sapiens
gaacaugaaaugcccu

SEQ ID NO: 1262124 - RNA, 20 nt, Homo sapiens
gaacauucgaccuccauuac

SEQ ID NO: 1262125 - RNA, 12 nt, Homo sapiens
gaaccacauauu

SEQ ID NO: 1262126 - RNA, 18 nt, Homo sapiens
gaaccagcaucucagcgc

SEQ ID NO: 1262127 - RNA, 23 nt, Homo sapiens
gaaccaucauuggaaaugaaacu

SEQ ID NO: 1262128 - RNA, 17 nt, Homo sapiens
gaaccauguguggcaaa

SEQ ID NO: 1262129 - RNA, 19 nt, Homo sapiens
gaacccagcaguucuguua

SEQ ID NO: 1262130 - RNA, 19 nt, Homo sapiens
gaacccaucgguaggcaaa

SEQ ID NO: 1262131 - RNA, 21 nt, Homo sapiens
gaaccccagcuucccuccagc

SEQ ID NO: 1262132 - RNA, 16 nt, Homo sapiens
gaacccuuccugagac

SEQ ID NO: 1262133 - RNA, 22 nt, Homo sapiens
gaacccuuggagccaauggaga

SEQ ID NO: 1262134 - RNA, 21 nt, Homo sapiens
gaaccgagcaauuuucugcua

SEQ ID NO: 1262135 - RNA, 16 nt, Homo sapiens
gaaccgugauaagccu

SEQ ID NO: 1262136 - RNA, 13 nt, Homo sapiens
gaaccguuuugaa

SEQ ID NO: 1262137 - RNA, 15 nt, Homo sapiens
gaaccucacugaaaa

SEQ ID NO: 1262138 - RNA, 21 nt, Homo sapiens
gaaccucuccaucaucuuccg

SEQ ID NO: 1262139 - RNA, 18 nt, Homo sapiens
gaaccugcccugcuccca

SEQ ID NO: 1262140 - RNA, 16 nt, Homo sapiens
gaaccuguccuaagga

SEQ ID NO: 1262141 - RNA, 21 nt, Homo sapiens
gaacgagcacuggccagagag

SEQ ID NO: 1262142 - RNA, 15 nt, Homo sapiens
gaacgcagaagaaag

SEQ ID NO: 1262143 - RNA, 16 nt, Homo sapiens
gaacuaaaauucuguc

SEQ ID NO: 1262144 - RNA, 16 nt, Homo sapiens
gaacuaaauguucuau

SEQ ID NO: 1262145 - RNA, 13 nt, Homo sapiens
gaacuaacaugca

SEQ ID NO: 1262146 - RNA, 19 nt, Homo sapiens
gaacuaaugauaaucccac

SEQ ID NO: 1262147 - RNA, 17 nt, Homo sapiens
gaacuacuuuuggugcu

SEQ ID NO: 1262148 - RNA, 12 nt, Homo sapiens
gaacuaggcucu

SEQ ID NO: 1262149 - RNA, 14 nt, Homo sapiens
gaacuauaugugaa

SEQ ID NO: 1262150 - RNA, 15 nt, Homo sapiens
gaacuaugagucuuu

SEQ ID NO: 1262151 - RNA, 19 nt, Homo sapiens
gaacucagcugaggccuug

SEQ ID NO: 1262152 - RNA, 19 nt, Homo sapiens
gaacucagcuguccagcug

SEQ ID NO: 1262153 - RNA, 16 nt, Homo sapiens
gaacucauaucuguaa

SEQ ID NO: 1262154 - RNA, 11 nt, Homo sapiens
gaacuccacuc

SEQ ID NO: 1262155 - RNA, 17 nt, Homo sapiens
gaacucuacaucuagca

SEQ ID NO: 1262156 - RNA, 14 nt, Homo sapiens
gaacucugguggca

SEQ ID NO: 1262157 - RNA, 19 nt, Homo sapiens
gaacucugguggcacagga

SEQ ID NO: 1262158 - RNA, 18 nt, Homo sapiens
gaacucuguaaaaccuca

SEQ ID NO: 1262159 - RNA, 21 nt, Homo sapiens
gaacucuucaaucucuugcac

SEQ ID NO: 1262160 - RNA, 22 nt, Homo sapiens
gaacugccaggcccggccaaaa

SEQ ID NO: 1262161 - RNA, 17 nt, Homo sapiens
gaacugcguggugcucu

SEQ ID NO: 1262162 - RNA, 19 nt, Homo sapiens
gaacuggaagaaagcaaca

SEQ ID NO: 1262163 - RNA, 16 nt, Homo sapiens
gaacuggcaauugucu

SEQ ID NO: 1262164 - RNA, 16 nt, Homo sapiens
gaacuggguacuugug

SEQ ID NO: 1262165 - RNA, 18 nt, Homo sapiens
gaacuguacacagaauug

SEQ ID NO: 1262166 - RNA, 13 nt, Homo sapiens
gaacugucuguga

SEQ ID NO: 1262167 - RNA, 11 nt, Homo sapiens
gaacuguuaca

SEQ ID NO: 1262168 - RNA, 17 nt, Homo sapiens
gaacuuggcacacucuc

SEQ ID NO: 1262169 - RNA, 22 nt, Homo sapiens
gaacuuuccccaauuacagggu

SEQ ID NO: 1262170 - RNA, 20 nt, Homo sapiens
gaacuuuggagagugagcua

SEQ ID NO: 1262171 - RNA, 22 nt, Homo sapiens
gaacuuuuuuagaaaugcaaaa

SEQ ID NO: 1262172 - RNA, 16 nt, Homo sapiens
gaagaaaagcugccau

SEQ ID NO: 1262173 - RNA, 18 nt, Homo sapiens
gaagaaaagcugccauuu

SEQ ID NO: 1262174 - RNA, 16 nt, Homo sapiens
gaagaaaauagucagu

SEQ ID NO: 1262175 - RNA, 20 nt, Homo sapiens
gaagaaagagcaacaaucca

SEQ ID NO: 1262176 - RNA, 16 nt, Homo sapiens
gaagaaagcaacaaag

SEQ ID NO: 1262177 - RNA, 20 nt, Homo sapiens
gaagaaauuuaugaagcaga

SEQ ID NO: 1262178 - RNA, 13 nt, Homo sapiens
gaagaacauagaa

SEQ ID NO: 1262179 - RNA, 13 nt, Homo sapiens
gaagaacuacagc

SEQ ID NO: 1262180 - RNA, 13 nt, Homo sapiens
gaagaacuugcau

SEQ ID NO: 1262181 - RNA, 19 nt, Homo sapiens
gaagaagaucaacgccuca

SEQ ID NO: 1262182 - RNA, 12 nt, Homo sapiens
gaagaagcuaaa

SEQ ID NO: 1262183 - RNA, 16 nt, Homo sapiens
gaagaagcuaugucaa

SEQ ID NO: 1262184 - RNA, 19 nt, Homo sapiens
gaagaaugucuguaccuug

SEQ ID NO: 1262185 - RNA, 12 nt, Homo sapiens
gaagacacugca

SEQ ID NO: 1262186 - RNA, 15 nt, Homo sapiens
gaagacacugcaaag

SEQ ID NO: 1262187 - RNA, 12 nt, Homo sapiens
gaagacaggaug

SEQ ID NO: 1262188 - RNA, 21 nt, Homo sapiens
gaagacauuaagcagccuuaa

SEQ ID NO: 1262189 - RNA, 22 nt, Homo sapiens
gaagacauuugccuuuuguuaa

SEQ ID NO: 1262190 - RNA, 17 nt, Homo sapiens
gaagaccacacuuggug

SEQ ID NO: 1262191 - RNA, 12 nt, Homo sapiens
gaagacucugac

SEQ ID NO: 1262192 - RNA, 15 nt, Homo sapiens
gaagacuucuaugga

SEQ ID NO: 1262193 - RNA, 14 nt, Homo sapiens
gaagagaaaugcaa

SEQ ID NO: 1262194 - RNA, 14 nt, Homo sapiens
gaagagaauauucc

SEQ ID NO: 1262195 - RNA, 22 nt, Homo sapiens
gaagagggaccagggugggaga

SEQ ID NO: 1262196 - RNA, 14 nt, Homo sapiens
gaagauaauuugca

SEQ ID NO: 1262197 - RNA, 21 nt, Homo sapiens
gaagauagaugcacuuaugca

SEQ ID NO: 1262198 - RNA, 21 nt, Homo sapiens
gaagauccaccuccccacugc

SEQ ID NO: 1262199 - RNA, 17 nt, Homo sapiens
gaagaugaagaagccuu

SEQ ID NO: 1262200 - RNA, 20 nt, Homo sapiens
gaagauguuucaaaaaaucu

SEQ ID NO: 1262201 - RNA, 24 nt, Homo sapiens
gaagauuuuaugcugcuguuuaca

SEQ ID NO: 1262202 - RNA, 20 nt, Homo sapiens
gaagcaaaagaaacgugaga

SEQ ID NO: 1262203 - RNA, 16 nt, Homo sapiens
gaagcacgauccgcca

SEQ ID NO: 1262204 - RNA, 18 nt, Homo sapiens
gaagcagccagcucccca

SEQ ID NO: 1262205 - RNA, 13 nt, Homo sapiens
gaagcaggaccua

SEQ ID NO: 1262206 - RNA, 13 nt, Homo sapiens
gaagcaguauuuu

SEQ ID NO: 1262207 - RNA, 15 nt, Homo sapiens
gaagcagugccuucc

SEQ ID NO: 1262208 - RNA, 19 nt, Homo sapiens
gaagcagugccuuccauaa

SEQ ID NO: 1262209 - RNA, 14 nt, Homo sapiens
gaagcauacaaagc

SEQ ID NO: 1262210 - RNA, 15 nt, Homo sapiens
gaagcauucucccca

SEQ ID NO: 1262211 - RNA, 12 nt, Homo sapiens
gaagcauuuacu

SEQ ID NO: 1262212 - RNA, 22 nt, Homo sapiens
gaagcauuuguauuuuguguga

SEQ ID NO: 1262213 - RNA, 12 nt, Homo sapiens
gaagccaaagaa

SEQ ID NO: 1262214 - RNA, 16 nt, Homo sapiens
gaagccccaacgggaa

SEQ ID NO: 1262215 - RNA, 18 nt, Homo sapiens
gaagcccccagcccuaau

SEQ ID NO: 1262216 - RNA, 20 nt, Homo sapiens
gaagccggaggguguuuaug

SEQ ID NO: 1262217 - RNA, 17 nt, Homo sapiens
gaagccucagcucccac

SEQ ID NO: 1262218 - RNA, 15 nt, Homo sapiens
gaagccuuaagccau

SEQ ID NO: 1262219 - RNA, 15 nt, Homo sapiens
gaagcgagucauuuc

SEQ ID NO: 1262220 - RNA, 14 nt, Homo sapiens
gaagcgcuucugca

SEQ ID NO: 1262221 - RNA, 19 nt, Homo sapiens
gaagcggagcuugcaguga

SEQ ID NO: 1262222 - RNA, 16 nt, Homo sapiens
gaagcugagacacaaa

SEQ ID NO: 1262223 - RNA, 23 nt, Homo sapiens
gaagcugcccuugaagacuuccc

SEQ ID NO: 1262224 - RNA, 16 nt, Homo sapiens
gaagcuggccugagag

SEQ ID NO: 1262225 - RNA, 19 nt, Homo sapiens
gaagcuucuaaauggugcu

SEQ ID NO: 1262226 - RNA, 13 nt, Homo sapiens
gaaggaaacauau

SEQ ID NO: 1262227 - RNA, 17 nt, Homo sapiens
gaaggacacuagccugu

SEQ ID NO: 1262228 - RNA, 15 nt, Homo sapiens
gaaggagaugcugcu

SEQ ID NO: 1262229 - RNA, 14 nt, Homo sapiens
gaaggagauuccac

SEQ ID NO: 1262230 - RNA, 16 nt, Homo sapiens
gaaggagccagugaac

SEQ ID NO: 1262231 - RNA, 23 nt, Homo sapiens
gaaggaugucccggguguguaca

SEQ ID NO: 1262232 - RNA, 13 nt, Homo sapiens
gaaggauuaccug

SEQ ID NO: 1262233 - RNA, 18 nt, Homo sapiens
gaaggauuuucugaccuu

SEQ ID NO: 1262234 - RNA, 13 nt, Homo sapiens
gaaggcagccgcc

SEQ ID NO: 1262235 - RNA, 15 nt, Homo sapiens
gaaggcugagugucc

SEQ ID NO: 1262236 - RNA, 17 nt, Homo sapiens
gaagggaauugcucaga

SEQ ID NO: 1262237 - RNA, 24 nt, Homo sapiens
gaagggaccaaggcaaggcaggug

SEQ ID NO: 1262238 - RNA, 14 nt, Homo sapiens
gaagggaguguucc

SEQ ID NO: 1262239 - RNA, 10 nt, Homo sapiens
gaagggccag

SEQ ID NO: 1262240 - RNA, 20 nt, Homo sapiens
gaagguauuagcaaagcaaa

SEQ ID NO: 1262241 - RNA, 22 nt, Homo sapiens
gaagguauuccuuuuguguaca

SEQ ID NO: 1262242 - RNA, 16 nt, Homo sapiens
gaaggucccucagaca

SEQ ID NO: 1262243 - RNA, 18 nt, Homo sapiens
gaaggugacucugaccuu

SEQ ID NO: 1262244 - RNA, 20 nt, Homo sapiens
gaagguuauggucaauccca

SEQ ID NO: 1262245 - RNA, 19 nt, Homo sapiens
gaagguuuguauauuguca

SEQ ID NO: 1262246 - RNA, 14 nt, Homo sapiens
gaaguaaaacaugc

SEQ ID NO: 1262247 - RNA, 18 nt, Homo sapiens
gaaguaaccauuugcacu

SEQ ID NO: 1262248 - RNA, 19 nt, Homo sapiens
gaaguacuuaaacuuccac

SEQ ID NO: 1262249 - RNA, 21 nt, Homo sapiens
gaaguagauuaagagccauau

SEQ ID NO: 1262250 - RNA, 21 nt, Homo sapiens
gaaguagcucuggugaccuug

SEQ ID NO: 1262251 - RNA, 14 nt, Homo sapiens
gaaguagcucuuuu

SEQ ID NO: 1262252 - RNA, 15 nt, Homo sapiens
gaaguaggcauauau

SEQ ID NO: 1262253 - RNA, 17 nt, Homo sapiens
gaaguaggcauauauca

SEQ ID NO: 1262254 - RNA, 20 nt, Homo sapiens
gaaguaggugugacuugaac

SEQ ID NO: 1262255 - RNA, 22 nt, Homo sapiens
gaaguaguucuguuuggugugu

SEQ ID NO: 1262256 - RNA, 22 nt, Homo sapiens
gaaguaugagggaaaaugagua

SEQ ID NO: 1262257 - RNA, 21 nt, Homo sapiens
gaaguauuuuccuccaggcaa

SEQ ID NO: 1262258 - RNA, 16 nt, Homo sapiens
gaagucacugcacagu

SEQ ID NO: 1262259 - RNA, 16 nt, Homo sapiens
gaagucaucucauucc

SEQ ID NO: 1262260 - RNA, 21 nt, Homo sapiens
gaagucaucucauuccacugu

SEQ ID NO: 1262261 - RNA, 18 nt, Homo sapiens
gaagucuaaaagcagaaa

SEQ ID NO: 1262262 - RNA, 13 nt, Homo sapiens
gaagucuccucaa

SEQ ID NO: 1262263 - RNA, 12 nt, Homo sapiens
gaagugccaguu

SEQ ID NO: 1262264 - RNA, 15 nt, Homo sapiens
gaagugcgugaaugu

SEQ ID NO: 1262265 - RNA, 16 nt, Homo sapiens
gaaguggagucucaug

SEQ ID NO: 1262266 - RNA, 17 nt, Homo sapiens
gaagugguugcauucua

SEQ ID NO: 1262267 - RNA, 13 nt, Homo sapiens
gaagugucaugca

SEQ ID NO: 1262268 - RNA, 17 nt, Homo sapiens
gaagugugagcgccuug

SEQ ID NO: 1262269 - RNA, 15 nt, Homo sapiens
gaaguuacuuuguaa

SEQ ID NO: 1262270 - RNA, 16 nt, Homo sapiens
gaaguuaugcugucau

SEQ ID NO: 1262271 - RNA, 12 nt, Homo sapiens
gaaguuccucaa

SEQ ID NO: 1262272 - RNA, 22 nt, Homo sapiens
gaaguugccauuuugucucauu

SEQ ID NO: 1262273 - RNA, 17 nt, Homo sapiens
gaaguuggcacauuuca

SEQ ID NO: 1262274 - RNA, 15 nt, Homo sapiens
gaaguuucccuuccu

SEQ ID NO: 1262275 - RNA, 19 nt, Homo sapiens
gaaguuucuggugccauuu

SEQ ID NO: 1262276 - RNA, 20 nt, Homo sapiens
gaaguuucuggugccauuuc

SEQ ID NO: 1262277 - RNA, 13 nt, Homo sapiens
gaaguuuggcaau

SEQ ID NO: 1262278 - RNA, 14 nt, Homo sapiens
gaaguuuguguucu

SEQ ID NO: 1262279 - RNA, 20 nt, Homo sapiens
gaaguuuguuuaaaugacag

SEQ ID NO: 1262280 - RNA, 19 nt, Homo sapiens
gaaguuuucuguagucauu

SEQ ID NO: 1262281 - RNA, 21 nt, Homo sapiens
gaaguuuucuguagucauuua

SEQ ID NO: 1262282 - RNA, 17 nt, Homo sapiens
gaauaaaggcaguuuuc

SEQ ID NO: 1262283 - RNA, 22 nt, Homo sapiens
gaauaauccaguauugcugauu

SEQ ID NO: 1262284 - RNA, 22 nt, Homo sapiens
gaauacaguaagcugcucuauu

SEQ ID NO: 1262285 - RNA, 14 nt, Homo sapiens
gaauaccaccuaau

SEQ ID NO: 1262286 - RNA, 23 nt, Homo sapiens
gaauaccaguguuauuaaugaca

SEQ ID NO: 1262287 - RNA, 15 nt, Homo sapiens
gaauacuugaacucu

SEQ ID NO: 1262288 - RNA, 18 nt, Homo sapiens
gaauacuuucuuagauuu

SEQ ID NO: 1262289 - RNA, 18 nt, Homo sapiens
gaauagcaaggugcucac

SEQ ID NO: 1262290 - RNA, 13 nt, Homo sapiens
gaauagcuuccaa

SEQ ID NO: 1262291 - RNA, 19 nt, Homo sapiens
gaauauaaaugggaaauca

SEQ ID NO: 1262292 - RNA, 17 nt, Homo sapiens
gaauaucauugauuuua

SEQ ID NO: 1262293 - RNA, 21 nt, Homo sapiens
gaauauuaauaaaacuuuaug

SEQ ID NO: 1262294 - RNA, 18 nt, Homo sapiens
gaauauugucugccuuaa

SEQ ID NO: 1262295 - RNA, 15 nt, Homo sapiens
gaauauugugcccca

SEQ ID NO: 1262296 - RNA, 18 nt, Homo sapiens
gaauauuuaagaaaagca

SEQ ID NO: 1262297 - RNA, 17 nt, Homo sapiens
gaaucaaaucucuucca

SEQ ID NO: 1262298 - RNA, 13 nt, Homo sapiens
gaaucaacaaacc

SEQ ID NO: 1262299 - RNA, 15 nt, Homo sapiens
gaaucaagacaagac

SEQ ID NO: 1262300 - RNA, 13 nt, Homo sapiens
gaaucaauucaau

SEQ ID NO: 1262301 - RNA, 15 nt, Homo sapiens
gaaucacaguauugu

SEQ ID NO: 1262302 - RNA, 18 nt, Homo sapiens
gaaucacuagguaacuua

SEQ ID NO: 1262303 - RNA, 13 nt, Homo sapiens
gaaucacuggaac

SEQ ID NO: 1262304 - RNA, 22 nt, Homo sapiens
gaaucagcauuuagucuugcca

SEQ ID NO: 1262305 - RNA, 21 nt, Homo sapiens
gaaucagugaagccaaaggga

SEQ ID NO: 1262306 - RNA, 18 nt, Homo sapiens
gaaucauauucauaugca

SEQ ID NO: 1262307 - RNA, 12 nt, Homo sapiens
gaggcugucaca

SEQ ID NO: 1262308 - RNA, 21 nt, Homo sapiens
gaggcuucuccgccagccucc

SEQ ID NO: 1262309 - RNA, 22 nt, Homo sapiens
gaggcuucuccuguuuuauaua

SEQ ID NO: 1262310 - RNA, 12 nt, Homo sapiens
gaggcuuggaaa

SEQ ID NO: 1262311 - RNA, 14 nt, Homo sapiens
gagggaaaaugagu

SEQ ID NO: 1262312 - RNA, 13 nt, Homo sapiens
gagggacugccuc

SEQ ID NO: 1262313 - RNA, 17 nt, Homo sapiens
gagggacuuugcugauu

SEQ ID NO: 1262314 - RNA, 16 nt, Homo sapiens
gagggagguaacgggu

SEQ ID NO: 1262315 - RNA, 14 nt, Homo sapiens
gagggagugacaga

SEQ ID NO: 1262316 - RNA, 17 nt, Homo sapiens
gagggauuuucacagug

SEQ ID NO: 1262317 - RNA, 19 nt, Homo sapiens
gagggcaccuugugaucau

SEQ ID NO: 1262318 - RNA, 13 nt, Homo sapiens
gagggcagcugcu

SEQ ID NO: 1262319 - RNA, 14 nt, Homo sapiens
gagggcagggacca

SEQ ID NO: 1262320 - RNA, 18 nt, Homo sapiens
gagggccccgcccagugc

SEQ ID NO: 1262321 - RNA, 16 nt, Homo sapiens
gagggccccugcgugg

SEQ ID NO: 1262322 - RNA, 14 nt, Homo sapiens
gagggcuaauaucu

SEQ ID NO: 1262323 - RNA, 21 nt, Homo sapiens
gagggcucaccucuugccuuc

SEQ ID NO: 1262324 - RNA, 22 nt, Homo sapiens
gagggcuuccucuagaagccaa

SEQ ID NO: 1262325 - RNA, 20 nt, Homo sapiens
gaggggaggaguuccacaga

SEQ ID NO: 1262326 - RNA, 15 nt, Homo sapiens
gaggggcaacgaaga

SEQ ID NO: 1262327 - RNA, 19 nt, Homo sapiens
gagggggucugggccagug

SEQ ID NO: 1262328 - RNA, 14 nt, Homo sapiens
gaggguccucaguc

SEQ ID NO: 1262329 - RNA, 16 nt, Homo sapiens
gagggugaaaggcagg

SEQ ID NO: 1262330 - RNA, 17 nt, Homo sapiens
gaggguggcugccuccu

SEQ ID NO: 1262331 - RNA, 14 nt, Homo sapiens
gaggucuaaucuag

SEQ ID NO: 1262332 - RNA, 21 nt, Homo sapiens
gaggucuguacguuaccucuu

SEQ ID NO: 1262333 - RNA, 15 nt, Homo sapiens
gaggucuguuucucu

SEQ ID NO: 1262334 - RNA, 15 nt, Homo sapiens
gaggugggauccucc

SEQ ID NO: 1262335 - RNA, 20 nt, Homo sapiens
gaggugggauccucccucau

SEQ ID NO: 1262336 - RNA, 21 nt, Homo sapiens
gagguggguggaucaccugag

SEQ ID NO: 1262337 - RNA, 14 nt, Homo sapiens
gagguuaaggcaua

SEQ ID NO: 1262338 - RNA, 23 nt, Homo sapiens
gagguuaucugucugcauuuuaa

SEQ ID NO: 1262339 - RNA, 14 nt, Homo sapiens
gagguugcagggag

SEQ ID NO: 1262340 - RNA, 16 nt, Homo sapiens
gagguugggcuuccau

SEQ ID NO: 1262341 - RNA, 16 nt, Homo sapiens
gaguaaauacagguag

SEQ ID NO: 1262342 - RNA, 13 nt, Homo sapiens
gaguaacaauaca

SEQ ID NO: 1262343 - RNA, 17 nt, Homo sapiens
gaguaacaggugccuuc

SEQ ID NO: 1262344 - RNA, 19 nt, Homo sapiens
gaguacaaaguaagccaug

SEQ ID NO: 1262345 - RNA, 15 nt, Homo sapiens
gaguaccauaauucu

SEQ ID NO: 1262346 - RNA, 21 nt, Homo sapiens
gaguagagaggcccgcccgcc

SEQ ID NO: 1262347 - RNA, 16 nt, Homo sapiens
gaguagggaguucauc

SEQ ID NO: 1262348 - RNA, 12 nt, Homo sapiens
gaguauaccucc

SEQ ID NO: 1262349 - RNA, 21 nt, Homo sapiens
gaguauauuuccgcacuucag

SEQ ID NO: 1262350 - RNA, 13 nt, Homo sapiens
gaguaucacuccc

SEQ ID NO: 1262351 - RNA, 15 nt, Homo sapiens
gaguaugucugaugg

SEQ ID NO: 1262352 - RNA, 16 nt, Homo sapiens
gagucaaugugcagug

SEQ ID NO: 1262353 - RNA, 13 nt, Homo sapiens
gagucacaccaga

SEQ ID NO: 1262354 - RNA, 17 nt, Homo sapiens
gagucacaguugacaaa

SEQ ID NO: 1262355 - RNA, 17 nt, Homo sapiens
gagucagaaaacagaga

SEQ ID NO: 1262356 - RNA, 20 nt, Homo sapiens
gagucaggccuuaauuuuca

SEQ ID NO: 1262357 - RNA, 16 nt, Homo sapiens
gagucauugacuucau

SEQ ID NO: 1262358 - RNA, 14 nt, Homo sapiens
gaguccaaagaagg

SEQ ID NO: 1262359 - RNA, 18 nt, Homo sapiens
gagucgggagcacagcug

SEQ ID NO: 1262360 - RNA, 13 nt, Homo sapiens
gagucuagauuca

SEQ ID NO: 1262361 - RNA, 19 nt, Homo sapiens
gagucucagaaacuccccu

SEQ ID NO: 1262362 - RNA, 22 nt, Homo sapiens
gauuauuuaauaacauuaccuu

SEQ ID NO: 1262363 - RNA, 20 nt, Homo sapiens
gauucacugcauggcuccca

SEQ ID NO: 1262364 - RNA, 20 nt, Homo sapiens
gauucagaaaauguucuguu

SEQ ID NO: 1262365 - RNA, 23 nt, Homo sapiens
gauucagcauuauuccuccagga

SEQ ID NO: 1262366 - RNA, 21 nt, Homo sapiens
gauucagccaaaugcagggag

SEQ ID NO: 1262367 - RNA, 15 nt, Homo sapiens
gauucaggggucuga

SEQ ID NO: 1262368 - RNA, 21 nt, Homo sapiens
gauucauauuuacuucuuaua

SEQ ID NO: 1262369 - RNA, 13 nt, Homo sapiens
gauuccacuuuua

SEQ ID NO: 1262370 - RNA, 20 nt, Homo sapiens
gauuccagcccacauuggau

SEQ ID NO: 1262371 - RNA, 16 nt, Homo sapiens
gauucccaacugagug

SEQ ID NO: 1262372 - RNA, 16 nt, Homo sapiens
gauuccucuugccucu

SEQ ID NO: 1262373 - RNA, 16 nt, Homo sapiens
gauucgcccaccucag

SEQ ID NO: 1262374 - RNA, 23 nt, Homo sapiens
gauucgcccuccucccugucaua

SEQ ID NO: 1262375 - RNA, 20 nt, Homo sapiens
gauucgugacaacaugcgac

SEQ ID NO: 1262376 - RNA, 23 nt, Homo sapiens
gauucuaaaaugugauguucuaa

SEQ ID NO: 1262377 - RNA, 22 nt, Homo sapiens
gauucuacucuugucauuuuua

SEQ ID NO: 1262378 - RNA, 20 nt, Homo sapiens
gauucuccagccaaccucau

SEQ ID NO: 1262379 - RNA, 20 nt, Homo sapiens
gauucucuacaugcucuuuu

SEQ ID NO: 1262380 - RNA, 23 nt, Homo sapiens
gauucucuuguauaagauccuag

SEQ ID NO: 1262381 - RNA, 18 nt, Homo sapiens
gauucugagccauucaca

SEQ ID NO: 1262382 - RNA, 19 nt, Homo sapiens
gauucugcaguaaaucuuu

SEQ ID NO: 1262383 - RNA, 14 nt, Homo sapiens
gauucuuuguuaca

SEQ ID NO: 1262384 - RNA, 18 nt, Homo sapiens
gauuuaaaaaaagaacau

SEQ ID NO: 1262385 - RNA, 20 nt, Homo sapiens
gauuuaaaaaaagaacauaa

SEQ ID NO: 1262386 - RNA, 17 nt, Homo sapiens
gauuuaaagcacaugcc

SEQ ID NO: 1262387 - RNA, 22 nt, Homo sapiens
gauuuaauuuccaggguugcuu

SEQ ID NO: 1262388 - RNA, 22 nt, Homo sapiens
gauuuacuaaaucaaucugcag

SEQ ID NO: 1262389 - RNA, 21 nt, Homo sapiens
gauuuagaaaaaaguuuacaa

SEQ ID NO: 1262390 - RNA, 17 nt, Homo sapiens
gauuuauucugccaaac

SEQ ID NO: 1262391 - RNA, 15 nt, Homo sapiens
gauuucaugauuuca

SEQ ID NO: 1262392 - RNA, 14 nt, Homo sapiens
gauuucaugccugg

SEQ ID NO: 1262393 - RNA, 23 nt, Homo sapiens
gauuuccugcugccauccucacc

SEQ ID NO: 1262394 - RNA, 23 nt, Homo sapiens
gauuuccuugaauguggcuugag

SEQ ID NO: 1262395 - RNA, 12 nt, Homo sapiens
gauuuccuugac

SEQ ID NO: 1262396 - RNA, 14 nt, Homo sapiens
gauuuccuugacuu

SEQ ID NO: 1262397 - RNA, 16 nt, Homo sapiens
gauuuccuugugcaaa

SEQ ID NO: 1262398 - RNA, 18 nt, Homo sapiens
gauuucuucgcugcucua

SEQ ID NO: 1262399 - RNA, 22 nt, Homo sapiens
gauuucuuucuuugcaccaaag

SEQ ID NO: 1262400 - RNA, 20 nt, Homo sapiens
gauuugcaggugaacagccu

SEQ ID NO: 1262401 - RNA, 16 nt, Homo sapiens
gauuugcauaaaguga

SEQ ID NO: 1262402 - RNA, 13 nt, Homo sapiens
gauuuggugacca

SEQ ID NO: 1262403 - RNA, 19 nt, Homo sapiens
gauuuguagcauaacugua

SEQ ID NO: 1262404 - RNA, 18 nt, Homo sapiens
gauuugugaacuggaaga

SEQ ID NO: 1262405 - RNA, 13 nt, Homo sapiens
gauuuguguuaua

SEQ ID NO: 1262406 - RNA, 20 nt, Homo sapiens
gauuuuaaaaagucuucacu

SEQ ID NO: 1262407 - RNA, 19 nt, Homo sapiens
gauuuuaaguaacauaacu

SEQ ID NO: 1262408 - RNA, 13 nt, Homo sapiens
gauuuuaccaaag

SEQ ID NO: 1262409 - RNA, 19 nt, Homo sapiens
gauuuuaccaaagcaucaa

SEQ ID NO: 1262410 - RNA, 14 nt, Homo sapiens
gauuuuaugcugcu

SEQ ID NO: 1262411 - RNA, 12 nt, Homo sapiens
gauuuugcaauc

SEQ ID NO: 1262412 - RNA, 17 nt, Homo sapiens
gauuuugcaaucugugu

SEQ ID NO: 1262413 - RNA, 17 nt, Homo sapiens
gauuuuuagcuuuacaa

SEQ ID NO: 1262414 - RNA, 20 nt, Homo sapiens
gcuagaaauaagcccaacag

SEQ ID NO: 1262415 - RNA, 23 nt, Homo sapiens
gcuagccaucuugaucuguguuu

SEQ ID NO: 1262416 - RNA, 15 nt, Homo sapiens
gcuaggaacuuggga

SEQ ID NO: 1262417 - RNA, 17 nt, Homo sapiens
gcuaggaaugaaauccu

SEQ ID NO: 1262418 - RNA, 22 nt, Homo sapiens
gcuaggcgcuggggagacugau

SEQ ID NO: 1262419 - RNA, 16 nt, Homo sapiens
gcuaggggacaucaga

SEQ ID NO: 1262420 - RNA, 19 nt, Homo sapiens
gcuaggguggcccuugcag

SEQ ID NO: 1262421 - RNA, 20 nt, Homo sapiens
gcuaguauucgcuguguuca

SEQ ID NO: 1262422 - RNA, 20 nt, Homo sapiens
gcuagugacuugugucccau

SEQ ID NO: 1262423 - RNA, 15 nt, Homo sapiens
gcuaguuugaccuca

SEQ ID NO: 1262424 - RNA, 23 nt, Homo sapiens
gcuaucagacuguaggauuugaa

SEQ ID NO: 1262425 - RNA, 11 nt, Homo sapiens
gcuaucucugu

SEQ ID NO: 1262426 - RNA, 20 nt, Homo sapiens
gcuaugcccggaccuccauc

SEQ ID NO: 1262427 - RNA, 14 nt, Homo sapiens
gcuauguaaggguc

SEQ ID NO: 1262428 - RNA, 20 nt, Homo sapiens
gcuauucccucaaaucugag

SEQ ID NO: 1262429 - RNA, 14 nt, Homo sapiens
gcuauuuaugcaag

SEQ ID NO: 1262430 - RNA, 19 nt, Homo sapiens
gcuauuucuucuacugcua

SEQ ID NO: 1262431 - RNA, 20 nt, Homo sapiens
gcuauuucuucuacugcuau

SEQ ID NO: 1262432 - RNA, 17 nt, Homo sapiens
gcuauuuggacucaggu

SEQ ID NO: 1262433 - RNA, 22 nt, Homo sapiens
gcucaaaguacuacagcaaagc

SEQ ID NO: 1262434 - RNA, 14 nt, Homo sapiens
gcucaaccauggcu

SEQ ID NO: 1262435 - RNA, 15 nt, Homo sapiens
gcucaagaacacaug

SEQ ID NO: 1262436 - RNA, 18 nt, Homo sapiens
gcucacagauugagguaa

SEQ ID NO: 1262437 - RNA, 15 nt, Homo sapiens
gcucagaauaaggca

SEQ ID NO: 1262438 - RNA, 15 nt, Homo sapiens
gcucagcauuuccac

SEQ ID NO: 1262439 - RNA, 14 nt, Homo sapiens
gcucagcgccagcc

SEQ ID NO: 1262440 - RNA, 12 nt, Homo sapiens
gcucaggugccu

SEQ ID NO: 1262441 - RNA, 16 nt, Homo sapiens
gcucaggugguugugg

SEQ ID NO: 1262442 - RNA, 20 nt, Homo sapiens
gcucaggugucccugcacuu

SEQ ID NO: 1262443 - RNA, 16 nt, Homo sapiens
gcucagugccuggaca

SEQ ID NO: 1262444 - RNA, 20 nt, Homo sapiens
gcucauaagcaauaccagca

SEQ ID NO: 1262445 - RNA, 17 nt, Homo sapiens
gcucauagaucagcaaa

SEQ ID NO: 1262446 - RNA, 14 nt, Homo sapiens
gcucaucacuggau

SEQ ID NO: 1262447 - RNA, 15 nt, Homo sapiens
gcucaucugcaaaag

SEQ ID NO: 1262448 - RNA, 20 nt, Homo sapiens
gcucaugucuauaaucccag

SEQ ID NO: 1262449 - RNA, 22 nt, Homo sapiens
gcucauguucuggcagcaacuu

SEQ ID NO: 1262450 - RNA, 21 nt, Homo sapiens
gcuccaacccccgccaccuca

SEQ ID NO: 1262451 - RNA, 17 nt, Homo sapiens
gcuccaaugccuacuga

SEQ ID NO: 1262452 - RNA, 14 nt, Homo sapiens
gcuccacaccucca

SEQ ID NO: 1262453 - RNA, 21 nt, Homo sapiens
gcuccaccuuccaaaggaccu

SEQ ID NO: 1262454 - RNA, 16 nt, Homo sapiens
gcuccacgaagccuua

SEQ ID NO: 1262455 - RNA, 18 nt, Homo sapiens
gcuccacuuggucuguga

SEQ ID NO: 1262456 - RNA, 13 nt, Homo sapiens
gcuccagcaucca

SEQ ID NO: 1262457 - RNA, 11 nt, Homo sapiens
gcuccauacaa

SEQ ID NO: 1262458 - RNA, 18 nt, Homo sapiens
gcuccaucccauucacuu

SEQ ID NO: 1262459 - RNA, 23 nt, Homo sapiens
gcucccacauucugaugagcaac

SEQ ID NO: 1262460 - RNA, 13 nt, Homo sapiens
gcucccccugucc

SEQ ID NO: 1262461 - RNA, 21 nt, Homo sapiens
gcucccucuauuuauguuugc

SEQ ID NO: 1262462 - RNA, 17 nt, Homo sapiens
gcucccugcccugaccu

SEQ ID NO: 1262463 - RNA, 15 nt, Homo sapiens
gcuccgccucugucc

SEQ ID NO: 1262464 - RNA, 16 nt, Homo sapiens
gcuccgcugcuccuug

SEQ ID NO: 1262465 - RNA, 16 nt, Homo sapiens
gcuccuaaaccauuga

SEQ ID NO: 1262466 - RNA, 22 nt, Homo sapiens
gcuccuccccuuccucuugucu

SEQ ID NO: 1262467 - RNA, 13 nt, Homo sapiens
gcuccuccuccau

SEQ ID NO: 1262468 - RNA, 16 nt, Homo sapiens
gcuccuccuccaugcu

SEQ ID NO: 1262469 - RNA, 22 nt, Homo sapiens
gcuccucuaguaagaugcacug

SEQ ID NO: 1262470 - RNA, 15 nt, Homo sapiens
gcuccuucuguccua

SEQ ID NO: 1262471 - RNA, 18 nt, Homo sapiens
gcuccuuggcuuaccuga

SEQ ID NO: 1262472 - RNA, 14 nt, Homo sapiens
gcucgcccaggaag

SEQ ID NO: 1262473 - RNA, 21 nt, Homo sapiens
gcucgcugccaucaccgcugg

SEQ ID NO: 1262474 - RNA, 14 nt, Homo sapiens
gcucuaauguacaa

SEQ ID NO: 1262475 - RNA, 14 nt, Homo sapiens
gcucuacaucuucu

SEQ ID NO: 1262476 - RNA, 18 nt, Homo sapiens
gcucuacguuacaggugg

SEQ ID NO: 1262477 - RNA, 16 nt, Homo sapiens
gcucuagggaaucugg

SEQ ID NO: 1262478 - RNA, 12 nt, Homo sapiens
gcucuagucacu

SEQ ID NO: 1262479 - RNA, 22 nt, Homo sapiens
gcucuauauaugaagugaaaaa

SEQ ID NO: 1262480 - RNA, 14 nt, Homo sapiens
gcucucacaugcac

SEQ ID NO: 1262481 - RNA, 16 nt, Homo sapiens
gcucucauggggucca

SEQ ID NO: 1262482 - RNA, 18 nt, Homo sapiens
gcucucccucucucucau

SEQ ID NO: 1262483 - RNA, 14 nt, Homo sapiens
gcucucgacaguau

SEQ ID NO: 1262484 - RNA, 13 nt, Homo sapiens
gcucucuguggug

SEQ ID NO: 1262485 - RNA, 16 nt, Homo sapiens
gcucucuguggugaga

SEQ ID NO: 1262486 - RNA, 17 nt, Homo sapiens
gcucugauugcagcaca

SEQ ID NO: 1262487 - RNA, 21 nt, Homo sapiens
gcucugcgccgagccucagaa

SEQ ID NO: 1262488 - RNA, 15 nt, Homo sapiens
gcucugcuaugagug

SEQ ID NO: 1262489 - RNA, 16 nt, Homo sapiens
gcucugcugacagaca

SEQ ID NO: 1262490 - RNA, 12 nt, Homo sapiens
gcucuggaagac

SEQ ID NO: 1262491 - RNA, 22 nt, Homo sapiens
gcucugucuacccagugcucca

SEQ ID NO: 1262492 - RNA, 18 nt, Homo sapiens
gcucugugugguccaggu

SEQ ID NO: 1262493 - RNA, 16 nt, Homo sapiens
gcucuuagcagcuucc

SEQ ID NO: 1262494 - RNA, 19 nt, Homo sapiens
gcucuuaggugcuucuuca

SEQ ID NO: 1262495 - RNA, 12 nt, Homo sapiens
gcucuuguuauu

SEQ ID NO: 1262496 - RNA, 23 nt, Homo sapiens
gcucuuucagagaggucucaggu

SEQ ID NO: 1262497 - RNA, 21 nt, Homo sapiens
gcucuuucaucucugcuugga

SEQ ID NO: 1262498 - RNA, 17 nt, Homo sapiens
gcucuuucccuuuauca

SEQ ID NO: 1262499 - RNA, 15 nt, Homo sapiens
gcucuuucucugcca

SEQ ID NO: 1262500 - RNA, 18 nt, Homo sapiens
gcucuuucucugccagug

SEQ ID NO: 1262501 - RNA, 17 nt, Homo sapiens
gcucuuuucaaugaaua

SEQ ID NO: 1262502 - RNA, 17 nt, Homo sapiens
gcugaaaaaucauccaa

SEQ ID NO: 1262503 - RNA, 19 nt, Homo sapiens
gcugaaaaaucauccaaga

SEQ ID NO: 1262504 - RNA, 19 nt, Homo sapiens
gcugaaaaccaucuggccu

SEQ ID NO: 1262505 - RNA, 22 nt, Homo sapiens
gcugaaauuuuagaaauauuca

SEQ ID NO: 1262506 - RNA, 17 nt, Homo sapiens
gcugaacaauaggcugu

SEQ ID NO: 1262507 - RNA, 13 nt, Homo sapiens
gcugaacuggauu

SEQ ID NO: 1262508 - RNA, 14 nt, Homo sapiens
gcugaagugucaca

SEQ ID NO: 1262509 - RNA, 14 nt, Homo sapiens
gcugaauccccuau

SEQ ID NO: 1262510 - RNA, 24 nt, Homo sapiens
gcugacgggaggccccagcucuga

SEQ ID NO: 1262511 - RNA, 18 nt, Homo sapiens
gcugacuagaagggccag

SEQ ID NO: 1262512 - RNA, 12 nt, Homo sapiens
gcugacuggcca

SEQ ID NO: 1262513 - RNA, 16 nt, Homo sapiens
gcugagaauguggaau

SEQ ID NO: 1262514 - RNA, 21 nt, Homo sapiens
gcugagaauguggaauaccua

SEQ ID NO: 1262515 - RNA, 18 nt, Homo sapiens
gcugagacaggccccuga

SEQ ID NO: 1262516 - RNA, 20 nt, Homo sapiens
gcugagaccacugaguacca

SEQ ID NO: 1262517 - RNA, 20 nt, Homo sapiens
gcugagcaaucugacccuau

SEQ ID NO: 1262518 - RNA, 14 nt, Homo sapiens
gcugaggacacuca

SEQ ID NO: 1262519 - RNA, 16 nt, Homo sapiens
gcugaggcaagagaau

SEQ ID NO: 1262520 - RNA, 19 nt, Homo sapiens
gcugagugcaccacuucaa

SEQ ID NO: 1262521 - RNA, 19 nt, Homo sapiens
gcugagugccugauacugc

SEQ ID NO: 1262522 - RNA, 21 nt, Homo sapiens
gcugagugccugauacugccu

SEQ ID NO: 1262523 - RNA, 22 nt, Homo sapiens
gcugaguguccagcacaccugc

SEQ ID NO: 1262524 - RNA, 22 nt, Homo sapiens
gcugaguguuucacaccuuauc

SEQ ID NO: 1262525 - RNA, 21 nt, Homo sapiens
gcugaucgauuucuuuccucc

SEQ ID NO: 1262526 - RNA, 17 nt, Homo sapiens
gcugaugagaaucaugc

SEQ ID NO: 1262527 - RNA, 18 nt, Homo sapiens
gcugaugauuuugcaaaa

SEQ ID NO: 1262528 - RNA, 19 nt, Homo sapiens
gcugauggugacauugcac

SEQ ID NO: 1262529 - RNA, 22 nt, Homo sapiens
gcugauugaagacacacucagc

SEQ ID NO: 1262530 - RNA, 17 nt, Homo sapiens
gcugauugggcaccuga

SEQ ID NO: 1262531 - RNA, 23 nt, Homo sapiens
gcugauuugauaccauggcacug

SEQ ID NO: 1262532 - RNA, 16 nt, Homo sapiens
gcugcacccacccagg

SEQ ID NO: 1262533 - RNA, 16 nt, Homo sapiens
gcugcaccuggucaua

SEQ ID NO: 1262534 - RNA, 21 nt, Homo sapiens
gcugcacugaucacccaaugc

SEQ ID NO: 1262535 - RNA, 17 nt, Homo sapiens
gcugcagagcaccuuug

SEQ ID NO: 1262536 - RNA, 23 nt, Homo sapiens
gcugcagcucccauuucaucagc

SEQ ID NO: 1262537 - RNA, 21 nt, Homo sapiens
gcugcagcucuccaccagcug

SEQ ID NO: 1262538 - RNA, 17 nt, Homo sapiens
gcugcaggacuugagaa

SEQ ID NO: 1262539 - RNA, 22 nt, Homo sapiens
gcugcagguuccuuaucuguca

SEQ ID NO: 1262540 - RNA, 22 nt, Homo sapiens
gcugcagguugcauaggugagg

SEQ ID NO: 1262541 - RNA, 16 nt, Homo sapiens
gcugcagucccuggaa

SEQ ID NO: 1262542 - RNA, 12 nt, Homo sapiens
gcugcaugaccu

SEQ ID NO: 1262543 - RNA, 14 nt, Homo sapiens
gcugccacaaccag

SEQ ID NO: 1262544 - RNA, 19 nt, Homo sapiens
gcugccagaugauuguuca

SEQ ID NO: 1262545 - RNA, 16 nt, Homo sapiens
gcugccagggcuuccu

SEQ ID NO: 1262546 - RNA, 20 nt, Homo sapiens
gcugccagugcuggucacua

SEQ ID NO: 1262547 - RNA, 15 nt, Homo sapiens
gcugccugacacuga

SEQ ID NO: 1262548 - RNA, 20 nt, Homo sapiens
gcugccugguauauccaaaa

SEQ ID NO: 1262549 - RNA, 18 nt, Homo sapiens
gcugcgagagaaagggag

SEQ ID NO: 1262550 - RNA, 23 nt, Homo sapiens
gcugcucuuagugcccgccuagg

SEQ ID NO: 1262551 - RNA, 17 nt, Homo sapiens
gcugcucuuaugccauu

SEQ ID NO: 1262552 - RNA, 17 nt, Homo sapiens
gcugcugaaaaccaucu

SEQ ID NO: 1262553 - RNA, 18 nt, Homo sapiens
gcugcugcugcacccaac

SEQ ID NO: 1262554 - RNA, 15 nt, Homo sapiens
gcugcugcugugcag

SEQ ID NO: 1262555 - RNA, 12 nt, Homo sapiens
gcugcugugcag

SEQ ID NO: 1262556 - RNA, 22 nt, Homo sapiens
gcugcuuccuguaaugcaggac

SEQ ID NO: 1262557 - RNA, 12 nt, Homo sapiens
gcuggaacccga

SEQ ID NO: 1262558 - RNA, 18 nt, Homo sapiens
gcuggacggggacugggg

SEQ ID NO: 1262559 - RNA, 17 nt, Homo sapiens
gcuggacuucuaccugc

SEQ ID NO: 1262560 - RNA, 23 nt, Homo sapiens
gcuggagagagauucuguugcau

SEQ ID NO: 1262561 - RNA, 22 nt, Homo sapiens
gcuggagguggaaaauggugcc

SEQ ID NO: 1262562 - RNA, 20 nt, Homo sapiens
gcuggagugcaauggcgcga

SEQ ID NO: 1262563 - RNA, 13 nt, Homo sapiens
gcuggagugcagu

SEQ ID NO: 1262564 - RNA, 20 nt, Homo sapiens
gcuggagugcaguggugcaa

SEQ ID NO: 1262565 - RNA, 22 nt, Homo sapiens
gcuggagugcaguggugcaauc

SEQ ID NO: 1262566 - RNA, 18 nt, Homo sapiens
gcuggagugcaguggugu

SEQ ID NO: 1262567 - RNA, 17 nt, Homo sapiens
gcuggauaaaaugaggu

SEQ ID NO: 1262568 - RNA, 22 nt, Homo sapiens
gcuggcaagucuuccaugaccc

SEQ ID NO: 1262569 - RNA, 14 nt, Homo sapiens
gcuggcaccucuca

SEQ ID NO: 1262570 - RNA, 22 nt, Homo sapiens
gcuggcagaaagggaacagaaa

SEQ ID NO: 1262571 - RNA, 14 nt, Homo sapiens
gcuggcaguacugu

SEQ ID NO: 1262572 - RNA, 19 nt, Homo sapiens
gcuggccucucuagcacaa

SEQ ID NO: 1262573 - RNA, 18 nt, Homo sapiens
gcuggcucugcacuaaga

SEQ ID NO: 1262574 - RNA, 15 nt, Homo sapiens
gcuggcugcaccccu

SEQ ID NO: 1262575 - RNA, 23 nt, Homo sapiens
gcugggacccuuaggauggggcu

SEQ ID NO: 1262576 - RNA, 13 nt, Homo sapiens
gcugggagacaca

SEQ ID NO: 1262577 - RNA, 14 nt, Homo sapiens
gcugggagcugccu

SEQ ID NO: 1262578 - RNA, 16 nt, Homo sapiens
gcugggauuacaggug

SEQ ID NO: 1262579 - RNA, 15 nt, Homo sapiens
gcugggccagugcau

SEQ ID NO: 1262580 - RNA, 18 nt, Homo sapiens
gcugggccauguccaaag

SEQ ID NO: 1262581 - RNA, 22 nt, Homo sapiens
gcugggucagggccagacugga

SEQ ID NO: 1262582 - RNA, 12 nt, Homo sapiens
gcugggugggcc

SEQ ID NO: 1262583 - RNA, 22 nt, Homo sapiens
gcuggucucaaacuccugaccu

SEQ ID NO: 1262584 - RNA, 22 nt, Homo sapiens
gcuggucuuggugaacacacau

SEQ ID NO: 1262585 - RNA, 20 nt, Homo sapiens
gcuggugaauaacuaugcca

SEQ ID NO: 1262586 - RNA, 13 nt, Homo sapiens
gcuguacccagau

SEQ ID NO: 1262587 - RNA, 20 nt, Homo sapiens
gcuguacccuuccaccuccu

SEQ ID NO: 1262588 - RNA, 22 nt, Homo sapiens
gcuguaggugguaugugacacc

SEQ ID NO: 1262589 - RNA, 17 nt, Homo sapiens
gcuguaguaccccaaga

SEQ ID NO: 1262590 - RNA, 14 nt, Homo sapiens
gcuguauggaaaug

SEQ ID NO: 1262591 - RNA, 18 nt, Homo sapiens
gcuguauuuguucaguga

SEQ ID NO: 1262592 - RNA, 20 nt, Homo sapiens
gcugucaguaugacauuuca

SEQ ID NO: 1262593 - RNA, 16 nt, Homo sapiens
gcugucgacuucauga

SEQ ID NO: 1262594 - RNA, 12 nt, Homo sapiens
gcugucugcuca

SEQ ID NO: 1262595 - RNA, 18 nt, Homo sapiens
gcugucuggggccuuuau

SEQ ID NO: 1262596 - RNA, 15 nt, Homo sapiens
gcugucuucuggucu

SEQ ID NO: 1262597 - RNA, 15 nt, Homo sapiens
gcugugaugguaccu

SEQ ID NO: 1262598 - RNA, 15 nt, Homo sapiens
gcugugcgcuccccc

SEQ ID NO: 1262599 - RNA, 20 nt, Homo sapiens
gcugugcuaucaugauggaa

SEQ ID NO: 1262600 - RNA, 11 nt, Homo sapiens
gcugugcucag

SEQ ID NO: 1262601 - RNA, 11 nt, Homo sapiens
gcugugcucuc

SEQ ID NO: 1262602 - RNA, 17 nt, Homo sapiens
gcuguggaccguggaca

SEQ ID NO: 1262603 - RNA, 23 nt, Homo sapiens
gcuguggccgucuccucccucag

SEQ ID NO: 1262604 - RNA, 18 nt, Homo sapiens
gcuguguauuuacaugaa

SEQ ID NO: 1262605 - RNA, 16 nt, Homo sapiens
ggcuggagugcaaugg

SEQ ID NO: 1262606 - RNA, 20 nt, Homo sapiens
ggcuggagugcaguggcaug

SEQ ID NO: 1262607 - RNA, 19 nt, Homo sapiens
ggcuggagugcaguggcgu

SEQ ID NO: 1262608 - RNA, 13 nt, Homo sapiens
ggcuggcaguugg

SEQ ID NO: 1262609 - RNA, 20 nt, Homo sapiens
ggcugggcgucuaugcugcu

SEQ ID NO: 1262610 - RNA, 22 nt, Homo sapiens
ggcugggggccucagugccacu

SEQ ID NO: 1262611 - RNA, 22 nt, Homo sapiens
ggcugguuuuguaagaugcugg

SEQ ID NO: 1262612 - RNA, 15 nt, Homo sapiens
ggcuguaucccauga

SEQ ID NO: 1262613 - RNA, 18 nt, Homo sapiens
ggcuguauuuaauggcau

SEQ ID NO: 1262614 - RNA, 22 nt, Homo sapiens
ggcugucaggauucuucaagga

SEQ ID NO: 1262615 - RNA, 13 nt, Homo sapiens
ggcugugccaacc

SEQ ID NO: 1262616 - RNA, 16 nt, Homo sapiens
ggcuguggagaggguc

SEQ ID NO: 1262617 - RNA, 14 nt, Homo sapiens
ggcuguggagcaaa

SEQ ID NO: 1262618 - RNA, 18 nt, Homo sapiens
ggcugugggcaagccuaa

SEQ ID NO: 1262619 - RNA, 13 nt, Homo sapiens
ggcuguguguccu

SEQ ID NO: 1262620 - RNA, 19 nt, Homo sapiens
ggcuguguuuccaucucaa

SEQ ID NO: 1262621 - RNA, 15 nt, Homo sapiens
ggcuuaaaagcaagu

SEQ ID NO: 1262622 - RNA, 18 nt, Homo sapiens
ggcuuaauaaaaaugaca

SEQ ID NO: 1262623 - RNA, 15 nt, Homo sapiens
ggcuucacuguauaa

SEQ ID NO: 1262624 - RNA, 18 nt, Homo sapiens
ggcuucacuguauaaaua

SEQ ID NO: 1262625 - RNA, 14 nt, Homo sapiens
ggcuuccaugccug

SEQ ID NO: 1262626 - RNA, 20 nt, Homo sapiens
ggcuucccucuucugugguc

SEQ ID NO: 1262627 - RNA, 14 nt, Homo sapiens
ggcuucucagcccu

SEQ ID NO: 1262628 - RNA, 19 nt, Homo sapiens
ggcuucucuugagucacac

SEQ ID NO: 1262629 - RNA, 14 nt, Homo sapiens
ggcuucugggagau

SEQ ID NO: 1262630 - RNA, 16 nt, Homo sapiens
ggcuugaaaugcauua

SEQ ID NO: 1262631 - RNA, 14 nt, Homo sapiens
ggcuugaagccaaa

SEQ ID NO: 1262632 - RNA, 18 nt, Homo sapiens
ggcuuguguguuucacuu

SEQ ID NO: 1262633 - RNA, 15 nt, Homo sapiens
ggcuuuaucucaggg

SEQ ID NO: 1262634 - RNA, 19 nt, Homo sapiens
ggcuuucugggugugacug

SEQ ID NO: 1262635 - RNA, 15 nt, Homo sapiens
ggcuuuucacacggg

SEQ ID NO: 1262636 - RNA, 21 nt, Homo sapiens
ggcuuuuuuugccuaccauuu

SEQ ID NO: 1262637 - RNA, 13 nt, Homo sapiens
gggaaaaggagua

SEQ ID NO: 1262638 - RNA, 22 nt, Homo sapiens
gggaaaccaguguagccuugcc

SEQ ID NO: 1262639 - RNA, 14 nt, Homo sapiens
gggaaagaaaggga

SEQ ID NO: 1262640 - RNA, 18 nt, Homo sapiens
gggaaaggaaucagagag

SEQ ID NO: 1262641 - RNA, 21 nt, Homo sapiens
gggaaaggauauuuucuucca

SEQ ID NO: 1262642 - RNA, 14 nt, Homo sapiens
gggaaaucaguguu

SEQ ID NO: 1262643 - RNA, 15 nt, Homo sapiens
gggaaauccauucca

SEQ ID NO: 1262644 - RNA, 12 nt, Homo sapiens
gggaaauugcuu

SEQ ID NO: 1262645 - RNA, 16 nt, Homo sapiens
gggaacacgugugcac

SEQ ID NO: 1262646 - RNA, 14 nt, Homo sapiens
gggaacauguccua

SEQ ID NO: 1262647 - RNA, 13 nt, Homo sapiens
gggaacauuucug

SEQ ID NO: 1262648 - RNA, 16 nt, Homo sapiens
gggaacggacugguau

SEQ ID NO: 1262649 - RNA, 15 nt, Homo sapiens
gggaagagugcauuu

SEQ ID NO: 1262650 - RNA, 21 nt, Homo sapiens
gggaagaguggucuugagggg

SEQ ID NO: 1262651 - RNA, 12 nt, Homo sapiens
gggaagccaaaa

SEQ ID NO: 1262652 - RNA, 18 nt, Homo sapiens
gggaaggaggguacagcu

SEQ ID NO: 1262653 - RNA, 19 nt, Homo sapiens
gggaaggcgacugagccau

SEQ ID NO: 1262654 - RNA, 19 nt, Homo sapiens
gggaagugucaugcaagug

SEQ ID NO: 1262655 - RNA, 17 nt, Homo sapiens
gggacaauaaauuuugc

SEQ ID NO: 1262656 - RNA, 21 nt, Homo sapiens
gggacagagccaugcugggaa

SEQ ID NO: 1262657 - RNA, 14 nt, Homo sapiens
gggacagcccacug

SEQ ID NO: 1262658 - RNA, 14 nt, Homo sapiens
gggacaucagggua

SEQ ID NO: 1262659 - RNA, 22 nt, Homo sapiens
gggaccaacugggcccaagaca

SEQ ID NO: 1262660 - RNA, 12 nt, Homo sapiens
gggacuaggacc

SEQ ID NO: 1262661 - RNA, 15 nt, Homo sapiens
gggacuaggaccuga

SEQ ID NO: 1262662 - RNA, 18 nt, Homo sapiens
gggacuggcugggcugcu

SEQ ID NO: 1262663 - RNA, 16 nt, Homo sapiens
gggacugggagucaga

SEQ ID NO: 1262664 - RNA, 13 nt, Homo sapiens
gggacuguuccaa

SEQ ID NO: 1262665 - RNA, 14 nt, Homo sapiens
gggacuguuccaaa

SEQ ID NO: 1262666 - RNA, 23 nt, Homo sapiens
gggacuguuccaaagccagugaa

SEQ ID NO: 1262667 - RNA, 15 nt, Homo sapiens
gggacuugggucuca

SEQ ID NO: 1262668 - RNA, 20 nt, Homo sapiens
gggagacacuggccccucaa

SEQ ID NO: 1262669 - RNA, 12 nt, Homo sapiens
gggagacuggaa

SEQ ID NO: 1262670 - RNA, 21 nt, Homo sapiens
gggagauuuuuuugagucaaa

SEQ ID NO: 1262671 - RNA, 17 nt, Homo sapiens
gggagcccccaccacaa

SEQ ID NO: 1262672 - RNA, 13 nt, Homo sapiens
gggagcugccaag

SEQ ID NO: 1262673 - RNA, 23 nt, Homo sapiens
gggaggauugcuugaacccaaga

SEQ ID NO: 1262674 - RNA, 20 nt, Homo sapiens
gggaggcagagguugcagug

SEQ ID NO: 1262675 - RNA, 20 nt, Homo sapiens
gggaggcagaguuugccuuc

SEQ ID NO: 1262676 - RNA, 12 nt, Homo sapiens
gggaggcccaaa

SEQ ID NO: 1262677 - RNA, 15 nt, Homo sapiens
gguggcgcgcaccug

SEQ ID NO: 1262678 - RNA, 20 nt, Homo sapiens
gguggcgggaauccuauuua

SEQ ID NO: 1262679 - RNA, 15 nt, Homo sapiens
gguggcgggcaccug

SEQ ID NO: 1262680 - RNA, 20 nt, Homo sapiens
gguggcugagcaucggagug

SEQ ID NO: 1262681 - RNA, 22 nt, Homo sapiens
ggugggcccucugaacuugccu

SEQ ID NO: 1262682 - RNA, 18 nt, Homo sapiens
gguggggggcauugagua

SEQ ID NO: 1262683 - RNA, 23 nt, Homo sapiens
gguggguaagacuaaaucuguaa

SEQ ID NO: 1262684 - RNA, 15 nt, Homo sapiens
ggugguaugugacac

SEQ ID NO: 1262685 - RNA, 21 nt, Homo sapiens
ggugguggcgugcauauguaa

SEQ ID NO: 1262686 - RNA, 17 nt, Homo sapiens
gguggugggaaccauga

SEQ ID NO: 1262687 - RNA, 22 nt, Homo sapiens
gguguacagaccaccuuucaca

SEQ ID NO: 1262688 - RNA, 23 nt, Homo sapiens
gguguacuuauauccacacugca

SEQ ID NO: 1262689 - RNA, 24 nt, Homo sapiens
gguguacuuauauccacacugcac

SEQ ID NO: 1262690 - RNA, 24 nt, Homo sapiens
gguguagaugggggaacugugaau

SEQ ID NO: 1262691 - RNA, 14 nt, Homo sapiens
gguguauguaugag

SEQ ID NO: 1262692 - RNA, 16 nt, Homo sapiens
gguguauguaugagua

SEQ ID NO: 1262693 - RNA, 15 nt, Homo sapiens
ggugugauugcacag

SEQ ID NO: 1262694 - RNA, 17 nt, Homo sapiens
ggugugcccuguacaca

SEQ ID NO: 1262695 - RNA, 18 nt, Homo sapiens
ggugugggaagaccaaag

SEQ ID NO: 1262696 - RNA, 20 nt, Homo sapiens
gguguuauuuucugagagac

SEQ ID NO: 1262697 - RNA, 16 nt, Homo sapiens
gguguucuucuuccca

SEQ ID NO: 1262698 - RNA, 17 nt, Homo sapiens
gguguuuuaugggccac

SEQ ID NO: 1262699 - RNA, 19 nt, Homo sapiens
gguuaaaaaaaaaagucac

SEQ ID NO: 1262700 - RNA, 14 nt, Homo sapiens
gguuaaaaaggcca

SEQ ID NO: 1262701 - RNA, 20 nt, Homo sapiens
gguuaaacccacagccaaac

SEQ ID NO: 1262702 - RNA, 23 nt, Homo sapiens
gguuacacuguuagaacacuauu

SEQ ID NO: 1262703 - RNA, 18 nt, Homo sapiens
gguuaucaaaaauuucau

SEQ ID NO: 1262704 - RNA, 14 nt, Homo sapiens
gguuauuucaauuc

SEQ ID NO: 1262705 - RNA, 14 nt, Homo sapiens
gguucacacucaga

SEQ ID NO: 1262706 - RNA, 20 nt, Homo sapiens
gguucagacaccuguucaca

SEQ ID NO: 1262707 - RNA, 14 nt, Homo sapiens
gguuccaacuguau

SEQ ID NO: 1262708 - RNA, 22 nt, Homo sapiens
gguucccaagaguauccuaccc

SEQ ID NO: 1262709 - RNA, 18 nt, Homo sapiens
gguuccuggugacuccug

SEQ ID NO: 1262710 - RNA, 17 nt, Homo sapiens
gguucugucuacaggga

SEQ ID NO: 1262711 - RNA, 23 nt, Homo sapiens
gguugaaaaaauagauccaauca

SEQ ID NO: 1262712 - RNA, 21 nt, Homo sapiens
gguugaacucugguggcacag

SEQ ID NO: 1262713 - RNA, 14 nt, Homo sapiens
gguugcauucuacu

SEQ ID NO: 1262714 - RNA, 18 nt, Homo sapiens
gguuggggugacagucau

SEQ ID NO: 1262715 - RNA, 18 nt, Homo sapiens
gguuuauugaaugugauu

SEQ ID NO: 1262716 - RNA, 19 nt, Homo sapiens
gguuucauguuaguuaccu

SEQ ID NO: 1262717 - RNA, 22 nt, Homo sapiens
gguuuccuuuuggaacauuucu

SEQ ID NO: 1262718 - RNA, 22 nt, Homo sapiens
gguuucucucuacagugccaac

SEQ ID NO: 1262719 - RNA, 14 nt, Homo sapiens
gguuucugauugca

SEQ ID NO: 1262720 - RNA, 14 nt, Homo sapiens
gguuucuucaagag

SEQ ID NO: 1262721 - RNA, 14 nt, Homo sapiens
gguuugaagcugac

SEQ ID NO: 1262722 - RNA, 16 nt, Homo sapiens
gguuugagaugcugua

SEQ ID NO: 1262723 - RNA, 23 nt, Homo sapiens
gguuugucgggcaccagccagcg

SEQ ID NO: 1262724 - RNA, 19 nt, Homo sapiens
gguuuguuauaucagggaa

SEQ ID NO: 1262725 - RNA, 15 nt, Homo sapiens
gguuuuagcauuguc

SEQ ID NO: 1262726 - RNA, 18 nt, Homo sapiens
gguuuuauaaaagccuug

SEQ ID NO: 1262727 - RNA, 15 nt, Homo sapiens
gguuuuguacacugc

SEQ ID NO: 1262728 - RNA, 21 nt, Homo sapiens
gguuuuuccuacuguccucag

SEQ ID NO: 1262729 - RNA, 12 nt, Homo sapiens
guaaaaaacugu

SEQ ID NO: 1262730 - RNA, 21 nt, Homo sapiens
guaaaacaugcugaaaacuac

SEQ ID NO: 1262731 - RNA, 18 nt, Homo sapiens
guaaaacaugcuggugaa

SEQ ID NO: 1262732 - RNA, 17 nt, Homo sapiens
guaaaacuauauucuca

SEQ ID NO: 1262733 - RNA, 17 nt, Homo sapiens
guaaaauggaggccauu

SEQ ID NO: 1262734 - RNA, 20 nt, Homo sapiens
guaaacagauggcacuuuga

SEQ ID NO: 1262735 - RNA, 21 nt, Homo sapiens
guaaacagauggcacuuugaa

SEQ ID NO: 1262736 - RNA, 16 nt, Homo sapiens
guaaacauguguuuua

SEQ ID NO: 1262737 - RNA, 20 nt, Homo sapiens
guaaacuucugcaacaagca

SEQ ID NO: 1262738 - RNA, 19 nt, Homo sapiens
guaaagaaauuuacuauau

SEQ ID NO: 1262739 - RNA, 13 nt, Homo sapiens
guaaagauuuguu

SEQ ID NO: 1262740 - RNA, 16 nt, Homo sapiens
guaaauaaaaguacaa

SEQ ID NO: 1262741 - RNA, 13 nt, Homo sapiens
guaaauacaggua

SEQ ID NO: 1262742 - RNA, 16 nt, Homo sapiens
guaaauaccugucaau

SEQ ID NO: 1262743 - RNA, 13 nt, Homo sapiens
guaaauacugcuu

SEQ ID NO: 1262744 - RNA, 17 nt, Homo sapiens
guaaauagcucaggugu

SEQ ID NO: 1262745 - RNA, 18 nt, Homo sapiens
guaaaucaggacaggugg

SEQ ID NO: 1262746 - RNA, 18 nt, Homo sapiens
guaaauccuagacuugaa

SEQ ID NO: 1262747 - RNA, 11 nt, Homo sapiens
guaaaucucac

SEQ ID NO: 1262748 - RNA, 20 nt, Homo sapiens
guaaaugcuagguuaauucc

SEQ ID NO: 1262749 - RNA, 14 nt, Homo sapiens
guaaaugcuccauu

SEQ ID NO: 1262750 - RNA, 20 nt, Homo sapiens
guaaauuugacagugccaca

SEQ ID NO: 1262751 - RNA, 19 nt, Homo sapiens
guaacaagaaaacauaaga

SEQ ID NO: 1262752 - RNA, 17 nt, Homo sapiens
guaacagacuggcucca

SEQ ID NO: 1262753 - RNA, 22 nt, Homo sapiens
guaacagauuuuguuggcauag

SEQ ID NO: 1262754 - RNA, 20 nt, Homo sapiens
guaacagccaggaguguuaa

SEQ ID NO: 1262755 - RNA, 23 nt, Homo sapiens
guaacauacuggccuggacuguu

SEQ ID NO: 1262756 - RNA, 14 nt, Homo sapiens
guaacauagacaaa

SEQ ID NO: 1262757 - RNA, 16 nt, Homo sapiens
guaacauuugcuguuu

SEQ ID NO: 1262758 - RNA, 14 nt, Homo sapiens
guaacccaaaccuc

SEQ ID NO: 1262759 - RNA, 15 nt, Homo sapiens
guaaccuagugaauu

SEQ ID NO: 1262760 - RNA, 20 nt, Homo sapiens
guaaccuguugcuguguuua

SEQ ID NO: 1262761 - RNA, 18 nt, Homo sapiens
guaacuauagacuggaaa

SEQ ID NO: 1262762 - RNA, 19 nt, Homo sapiens
guaacuauuacaccaaaua

SEQ ID NO: 1262763 - RNA, 23 nt, Homo sapiens
guaacugcucuugaacauugugg

SEQ ID NO: 1262764 - RNA, 12 nt, Homo sapiens
guaagaaaguga

SEQ ID NO: 1262765 - RNA, 16 nt, Homo sapiens
guaagaagaaagcaaa

SEQ ID NO: 1262766 - RNA, 13 nt, Homo sapiens
guaagaagagcca

SEQ ID NO: 1262767 - RNA, 15 nt, Homo sapiens
guaagacucauuccc

SEQ ID NO: 1262768 - RNA, 21 nt, Homo sapiens
guaagagaauguugaauacuu

SEQ ID NO: 1262769 - RNA, 12 nt, Homo sapiens
guaagcaaacaa

SEQ ID NO: 1262770 - RNA, 19 nt, Homo sapiens
guaagcugcucuauuguag

SEQ ID NO: 1262771 - RNA, 17 nt, Homo sapiens
guaaggugcaucuguuu

SEQ ID NO: 1262772 - RNA, 19 nt, Homo sapiens
guaaguacccgacuaaagu

SEQ ID NO: 1262773 - RNA, 22 nt, Homo sapiens
guaaguauuuagaagugugaau

SEQ ID NO: 1262774 - RNA, 12 nt, Homo sapiens
guaagugcugcu

SEQ ID NO: 1262775 - RNA, 13 nt, Homo sapiens
guaagugcugcua

SEQ ID NO: 1262776 - RNA, 22 nt, Homo sapiens
guaaguuacaugaaggcagcag

SEQ ID NO: 1262777 - RNA, 14 nt, Homo sapiens
guaaguuucaggug

SEQ ID NO: 1262778 - RNA, 20 nt, Homo sapiens
guaauaaaccuccuucggga

SEQ ID NO: 1262779 - RNA, 13 nt, Homo sapiens
guaauaauaccuc

SEQ ID NO: 1262780 - RNA, 15 nt, Homo sapiens
guaauaauaccucaa

SEQ ID NO: 1262781 - RNA, 18 nt, Homo sapiens
guaauagugaacauaugg

SEQ ID NO: 1262782 - RNA, 13 nt, Homo sapiens
guaauauaaugga

SEQ ID NO: 1262783 - RNA, 17 nt, Homo sapiens
guaauauuaauuuccac

SEQ ID NO: 1262784 - RNA, 19 nt, Homo sapiens
guaauauuaauuuccacua

SEQ ID NO: 1262785 - RNA, 16 nt, Homo sapiens
guaaucccaacacuuu

SEQ ID NO: 1262786 - RNA, 18 nt, Homo sapiens
guaaucccaacacuuugg

SEQ ID NO: 1262787 - RNA, 18 nt, Homo sapiens
guaaucccagcuacucag

SEQ ID NO: 1262788 - RNA, 20 nt, Homo sapiens
guaaucccagcuacuuggga

SEQ ID NO: 1262789 - RNA, 24 nt, Homo sapiens
guaaucccccaggagaacaucuuu

SEQ ID NO: 1262790 - RNA, 15 nt, Homo sapiens
guaaucucagcacuu

SEQ ID NO: 1262791 - RNA, 11 nt, Homo sapiens
guaaucugcau

SEQ ID NO: 1262792 - RNA, 17 nt, Homo sapiens
guaaucuuuggcuguaa

SEQ ID NO: 1262793 - RNA, 21 nt, Homo sapiens
guaaugacaaauaaguggaaa

SEQ ID NO: 1262794 - RNA, 15 nt, Homo sapiens
guaaugccuuuucuc

SEQ ID NO: 1262795 - RNA, 11 nt, Homo sapiens
guaaugcugca

SEQ ID NO: 1262796 - RNA, 17 nt, Homo sapiens
guaaugcugcacagaaa

SEQ ID NO: 1262797 - RNA, 22 nt, Homo sapiens
guaauguuccugaaaauugcaa

SEQ ID NO: 1262798 - RNA, 18 nt, Homo sapiens
guaauuaaaggaacagag

SEQ ID NO: 1262799 - RNA, 17 nt, Homo sapiens
guaauuagcauggcccc

SEQ ID NO: 1262800 - RNA, 23 nt, Homo sapiens
guaauucuaaaugaauguuuaca

SEQ ID NO: 1262801 - RNA, 21 nt, Homo sapiens
guauaaguuauuuuuguacau

SEQ ID NO: 1262802 - RNA, 20 nt, Homo sapiens
guauaauugaccuacuuugg

SEQ ID NO: 1262803 - RNA, 11 nt, Homo sapiens
guauacugugu

SEQ ID NO: 1262804 - RNA, 19 nt, Homo sapiens
guauacugugugggauacu

SEQ ID NO: 1262805 - RNA, 21 nt, Homo sapiens
guauaggggcaacuguaugaa

SEQ ID NO: 1262806 - RNA, 18 nt, Homo sapiens
guauaguuuuauuuacuu

SEQ ID NO: 1262807 - RNA, 17 nt, Homo sapiens
guauauacacauauacc

SEQ ID NO: 1262808 - RNA, 14 nt, Homo sapiens
guauauugucagau

SEQ ID NO: 1262809 - RNA, 15 nt, Homo sapiens
guaucaaacccacga

SEQ ID NO: 1262810 - RNA, 24 nt, Homo sapiens
guaucacagacuggcaacaagaag

SEQ ID NO: 1262811 - RNA, 13 nt, Homo sapiens
guaucacucccac

SEQ ID NO: 1262812 - RNA, 14 nt, Homo sapiens
guaucacucuaaaa

SEQ ID NO: 1262813 - RNA, 15 nt, Homo sapiens
guaucagaggccuau

SEQ ID NO: 1262814 - RNA, 20 nt, Homo sapiens
guaucagccccaagcaggug

SEQ ID NO: 1262815 - RNA, 14 nt, Homo sapiens
guaucaguguuuua

SEQ ID NO: 1262816 - RNA, 18 nt, Homo sapiens
guaucauguauggugaua

SEQ ID NO: 1262817 - RNA, 12 nt, Homo sapiens
guaucauucaac

SEQ ID NO: 1262818 - RNA, 16 nt, Homo sapiens
guaucauucuuuacau

SEQ ID NO: 1262819 - RNA, 20 nt, Homo sapiens
guauccgacucuaagcugug

SEQ ID NO: 1262820 - RNA, 13 nt, Homo sapiens
guauccugugaca

SEQ ID NO: 1262821 - RNA, 17 nt, Homo sapiens
guauccugugacaugua

SEQ ID NO: 1262822 - RNA, 18 nt, Homo sapiens
guauccugugacauguaa

SEQ ID NO: 1262823 - RNA, 15 nt, Homo sapiens
guaucuauuguauau

SEQ ID NO: 1262824 - RNA, 23 nt, Homo sapiens
guaucuuuugaacuggcaauugu

SEQ ID NO: 1262825 - RNA, 18 nt, Homo sapiens
guaugaauaauugcauca

SEQ ID NO: 1262826 - RNA, 15 nt, Homo sapiens
guaugacugcacaug

SEQ ID NO: 1262827 - RNA, 12 nt, Homo sapiens
guaugccaagug

SEQ ID NO: 1262828 - RNA, 21 nt, Homo sapiens
guaugccuuuaaaucugugau

SEQ ID NO: 1262829 - RNA, 19 nt, Homo sapiens
guauguaaaagaaaaucca

SEQ ID NO: 1262830 - RNA, 15 nt, Homo sapiens
guauguauauauaca

SEQ ID NO: 1262831 - RNA, 16 nt, Homo sapiens
guauguuaugaacaug

SEQ ID NO: 1262832 - RNA, 14 nt, Homo sapiens
guauguugccuuua

SEQ ID NO: 1262833 - RNA, 14 nt, Homo sapiens
guauuaaaagcuaa

SEQ ID NO: 1262834 - RNA, 13 nt, Homo sapiens
guauuaaagacag

SEQ ID NO: 1262835 - RNA, 17 nt, Homo sapiens
guauuaagugugcuuau

SEQ ID NO: 1262836 - RNA, 22 nt, Homo sapiens
guauuaauaaagcauucuuuaa

SEQ ID NO: 1262837 - RNA, 19 nt, Homo sapiens
guauuagugacaccacaca

SEQ ID NO: 1262838 - RNA, 17 nt, Homo sapiens
guauuauuuuacaauca

SEQ ID NO: 1262839 - RNA, 13 nt, Homo sapiens
guauucacaguug

SEQ ID NO: 1262840 - RNA, 12 nt, Homo sapiens
guauuccauuuu

SEQ ID NO: 1262841 - RNA, 18 nt, Homo sapiens
guauuccuuuuguguaca

SEQ ID NO: 1262842 - RNA, 20 nt, Homo sapiens
guauucuacagcagauacuu

SEQ ID NO: 1262843 - RNA, 21 nt, Homo sapiens
guauucuagugaaugaaucuc

SEQ ID NO: 1262844 - RNA, 13 nt, Homo sapiens
guauucucagagc

SEQ ID NO: 1262845 - RNA, 15 nt, Homo sapiens
guauucuucaaccuc

SEQ ID NO: 1262846 - RNA, 13 nt, Homo sapiens
guccaccucccau

SEQ ID NO: 1262847 - RNA, 18 nt, Homo sapiens
guccacucucggggcccu

SEQ ID NO: 1262848 - RNA, 16 nt, Homo sapiens
guccacuuuacucaaa

SEQ ID NO: 1262849 - RNA, 14 nt, Homo sapiens
guccagcacuggaa

SEQ ID NO: 1262850 - RNA, 18 nt, Homo sapiens
guccagggcuagugacuu

SEQ ID NO: 1262851 - RNA, 14 nt, Homo sapiens
guccauugauguau

SEQ ID NO: 1262852 - RNA, 14 nt, Homo sapiens
guccauuuugcccu

SEQ ID NO: 1262853 - RNA, 11 nt, Homo sapiens
gucccaagaca

SEQ ID NO: 1262854 - RNA, 17 nt, Homo sapiens
gucccaaugguccugac

SEQ ID NO: 1262855 - RNA, 14 nt, Homo sapiens
gucccaccugcaca

SEQ ID NO: 1262856 - RNA, 17 nt, Homo sapiens
gucccaguauaccucau

SEQ ID NO: 1262857 - RNA, 19 nt, Homo sapiens
gucccauggacacuccagu

SEQ ID NO: 1262858 - RNA, 18 nt, Homo sapiens
gucccauuugccuugcaa

SEQ ID NO: 1262859 - RNA, 21 nt, Homo sapiens
guccccagcccuucacauuuu

SEQ ID NO: 1262860 - RNA, 14 nt, Homo sapiens
guccccagccugcu

SEQ ID NO: 1262861 - RNA, 20 nt, Homo sapiens
guccccagccugcucccuag

SEQ ID NO: 1262862 - RNA, 18 nt, Homo sapiens
guccccauccccaccagc

SEQ ID NO: 1262863 - RNA, 17 nt, Homo sapiens
guccccucaccuccucu

SEQ ID NO: 1262864 - RNA, 16 nt, Homo sapiens
guccccuccucaguga

SEQ ID NO: 1262865 - RNA, 22 nt, Homo sapiens
guccccuuuucuuuucuacccu

SEQ ID NO: 1262866 - RNA, 20 nt, Homo sapiens
gucccuguaugucuaccucu

SEQ ID NO: 1262867 - RNA, 14 nt, Homo sapiens
guccgcaccagcug

SEQ ID NO: 1262868 - RNA, 23 nt, Homo sapiens
guccucacccaucaaaagcacca

SEQ ID NO: 1262869 - RNA, 20 nt, Homo sapiens
guccucaccccuguccucac

SEQ ID NO: 1262870 - RNA, 17 nt, Homo sapiens
guccucacucccagucc

SEQ ID NO: 1262871 - RNA, 12 nt, Homo sapiens
guccucagucca

SEQ ID NO: 1262872 - RNA, 18 nt, Homo sapiens
guccuccagaccaccagc

SEQ ID NO: 1262873 - RNA, 12 nt, Homo sapiens
guccugaccacc

SEQ ID NO: 1262874 - RNA, 13 nt, Homo sapiens
guccugaugcugu

SEQ ID NO: 1262875 - RNA, 20 nt, Homo sapiens
guccugaugcugugcucaau

SEQ ID NO: 1262876 - RNA, 12 nt, Homo sapiens
guccuggucaag

SEQ ID NO: 1262877 - RNA, 22 nt, Homo sapiens
guccuucaaguuagcucaggag

SEQ ID NO: 1262878 - RNA, 20 nt, Homo sapiens
guccuuuaaucacugcauuu

SEQ ID NO: 1262879 - RNA, 18 nt, Homo sapiens
guccuuucccaccauucc

SEQ ID NO: 1262880 - RNA, 22 nt, Homo sapiens
guccuuucccaccauuccugcc

SEQ ID NO: 1262881 - RNA, 14 nt, Homo sapiens
guccuuuugacacu

SEQ ID NO: 1262882 - RNA, 16 nt, Homo sapiens
guccuuuuguaccaug

SEQ ID NO: 1262883 - RNA, 17 nt, Homo sapiens
gucgaauguuagauucc

SEQ ID NO: 1262884 - RNA, 19 nt, Homo sapiens
gucgaauguuagauuccuc

SEQ ID NO: 1262885 - RNA, 15 nt, Homo sapiens
gucgaccgcacuuau

SEQ ID NO: 1262886 - RNA, 13 nt, Homo sapiens
gucgagacuucac

SEQ ID NO: 1262887 - RNA, 23 nt, Homo sapiens
gucgagacuucacgggcaaucau

SEQ ID NO: 1262888 - RNA, 16 nt, Homo sapiens
gugaugagagaaugga

SEQ ID NO: 1262889 - RNA, 12 nt, Homo sapiens
gugaugaugcug

SEQ ID NO: 1262890 - RNA, 18 nt, Homo sapiens
gugauggauggcacaaug

SEQ ID NO: 1262891 - RNA, 18 nt, Homo sapiens
gugauucgcccaccucag

SEQ ID NO: 1262892 - RNA, 14 nt, Homo sapiens
gugauugcacagaa

SEQ ID NO: 1262893 - RNA, 14 nt, Homo sapiens
gugauuuacauuuc

SEQ ID NO: 1262894 - RNA, 19 nt, Homo sapiens
gugauuucaccccacagac

SEQ ID NO: 1262895 - RNA, 18 nt, Homo sapiens
gugauuucuuucuuugca

SEQ ID NO: 1262896 - RNA, 23 nt, Homo sapiens
gugauuuuucugcacuaauauaa

SEQ ID NO: 1262897 - RNA, 14 nt, Homo sapiens
gugcaaugaaugau

SEQ ID NO: 1262898 - RNA, 18 nt, Homo sapiens
gugcacacacacacacau

SEQ ID NO: 1262899 - RNA, 18 nt, Homo sapiens
gugcacaggcgcauccca

SEQ ID NO: 1262900 - RNA, 13 nt, Homo sapiens
gugcacguugcuu

SEQ ID NO: 1262901 - RNA, 18 nt, Homo sapiens
gugcacugcuuugggauu

SEQ ID NO: 1262902 - RNA, 17 nt, Homo sapiens
gugcacugucacuuugc

SEQ ID NO: 1262903 - RNA, 22 nt, Homo sapiens
gugcacuuuaagaggugggagc

SEQ ID NO: 1262904 - RNA, 21 nt, Homo sapiens
gugcagagaugacuguccaag

SEQ ID NO: 1262905 - RNA, 16 nt, Homo sapiens
gugcagaugggcuguu

SEQ ID NO: 1262906 - RNA, 13 nt, Homo sapiens
gugcaguacuuaa

SEQ ID NO: 1262907 - RNA, 20 nt, Homo sapiens
gugcagugagccgagaucac

SEQ ID NO: 1262908 - RNA, 20 nt, Homo sapiens
gugcaguggcaccaucucag

SEQ ID NO: 1262909 - RNA, 20 nt, Homo sapiens
gugcaguggcaugaugucaa

SEQ ID NO: 1262910 - RNA, 19 nt, Homo sapiens
gugcaguggugugaucuca

SEQ ID NO: 1262911 - RNA, 20 nt, Homo sapiens
gugcauaaugcuuuggaaaa

SEQ ID NO: 1262912 - RNA, 23 nt, Homo sapiens
gugcaugcuuuucucuugcuaau

SEQ ID NO: 1262913 - RNA, 21 nt, Homo sapiens
gugcauuuguuuguauacaua

SEQ ID NO: 1262914 - RNA, 23 nt, Homo sapiens
gugcauuuuuacuauuguuacau

SEQ ID NO: 1262915 - RNA, 16 nt, Homo sapiens
gugccaaguuccacuu

SEQ ID NO: 1262916 - RNA, 20 nt, Homo sapiens
gugccaauauguauuguaaa

SEQ ID NO: 1262917 - RNA, 12 nt, Homo sapiens
gugccacacagu

SEQ ID NO: 1262918 - RNA, 19 nt, Homo sapiens
gugccacauacugcggacc

SEQ ID NO: 1262919 - RNA, 18 nt, Homo sapiens
gugccacuuugacucaga

SEQ ID NO: 1262920 - RNA, 15 nt, Homo sapiens
gugccagcaaugaca

SEQ ID NO: 1262921 - RNA, 17 nt, Homo sapiens
gugccagcaaugacauc

SEQ ID NO: 1262922 - RNA, 21 nt, Homo sapiens
gugccagcaaugacaucucag

SEQ ID NO: 1262923 - RNA, 21 nt, Homo sapiens
gugccaguucuuuccauaaua

SEQ ID NO: 1262924 - RNA, 18 nt, Homo sapiens
gugccauccccaccuuca

SEQ ID NO: 1262925 - RNA, 16 nt, Homo sapiens
gugccccagcaccaac

SEQ ID NO: 1262926 - RNA, 14 nt, Homo sapiens
gugcccuacucauu

SEQ ID NO: 1262927 - RNA, 10 nt, Homo sapiens
gugcccucca

SEQ ID NO: 1262928 - RNA, 15 nt, Homo sapiens
gugcccugagacaga

SEQ ID NO: 1262929 - RNA, 18 nt, Homo sapiens
gugccgugugagugugac

SEQ ID NO: 1262930 - RNA, 20 nt, Homo sapiens
gugccgugugagugugacag

SEQ ID NO: 1262931 - RNA, 19 nt, Homo sapiens
gugccuccucagaggacag

SEQ ID NO: 1262932 - RNA, 23 nt, Homo sapiens
gugccugacacauagaaaacaau

SEQ ID NO: 1262933 - RNA, 18 nt, Homo sapiens
gugccuugugcaauguga

SEQ ID NO: 1262934 - RNA, 14 nt, Homo sapiens
gugccuuuugcaga

SEQ ID NO: 1262935 - RNA, 13 nt, Homo sapiens
gugcggugcauac

SEQ ID NO: 1262936 - RNA, 19 nt, Homo sapiens
gugcguuaaauaagcaaau

SEQ ID NO: 1262937 - RNA, 18 nt, Homo sapiens
gugcuaaacgcacacagu

SEQ ID NO: 1262938 - RNA, 12 nt, Homo sapiens
gugcuacaugac

SEQ ID NO: 1262939 - RNA, 17 nt, Homo sapiens
gugcuaucgcaccacug

SEQ ID NO: 1262940 - RNA, 20 nt, Homo sapiens
gugcuaucgcaccacugugu

SEQ ID NO: 1262941 - RNA, 21 nt, Homo sapiens
gugcuauuaggaaauucugau

SEQ ID NO: 1262942 - RNA, 20 nt, Homo sapiens
gugcucuuugcugcacuauu

SEQ ID NO: 1262943 - RNA, 18 nt, Homo sapiens
gugcugagugagcuggug

SEQ ID NO: 1262944 - RNA, 23 nt, Homo sapiens
gugcugcaucuuauagcacuuug

SEQ ID NO: 1262945 - RNA, 16 nt, Homo sapiens
gugcugggcauuuuua

SEQ ID NO: 1262946 - RNA, 16 nt, Homo sapiens
gugcugggggaaugag

SEQ ID NO: 1262947 - RNA, 21 nt, Homo sapiens
gugcugguccuguugauccca

SEQ ID NO: 1262948 - RNA, 18 nt, Homo sapiens
gugcugucuucuggucug

SEQ ID NO: 1262949 - RNA, 21 nt, Homo sapiens
gugcuguggagagaagcugau

SEQ ID NO: 1262950 - RNA, 15 nt, Homo sapiens
gugcuucacaguaga

SEQ ID NO: 1262951 - RNA, 14 nt, Homo sapiens
gugcuucuucacuu

SEQ ID NO: 1262952 - RNA, 23 nt, Homo sapiens
gugcuuguucuguccucuugccu

SEQ ID NO: 1262953 - RNA, 12 nt, Homo sapiens
guggaaugagug

SEQ ID NO: 1262954 - RNA, 14 nt, Homo sapiens
guggacacaacagc

SEQ ID NO: 1262955 - RNA, 22 nt, Homo sapiens
guggacacagaucccacuggaa

SEQ ID NO: 1262956 - RNA, 21 nt, Homo sapiens
guggaccacugcaugagcuuu

SEQ ID NO: 1262957 - RNA, 17 nt, Homo sapiens
guggacucagcagugac

SEQ ID NO: 1262958 - RNA, 18 nt, Homo sapiens
guggacucucauguggcc

SEQ ID NO: 1262959 - RNA, 18 nt, Homo sapiens
guggagaaagcacugacc

SEQ ID NO: 1262960 - RNA, 14 nt, Homo sapiens
guggagacaguccu

SEQ ID NO: 1262961 - RNA, 13 nt, Homo sapiens
guggagcucagug

SEQ ID NO: 1262962 - RNA, 13 nt, Homo sapiens
guggaggcacuuu

SEQ ID NO: 1262963 - RNA, 12 nt, Homo sapiens
guggagggccac

SEQ ID NO: 1262964 - RNA, 13 nt, Homo sapiens
guggagguugcag

SEQ ID NO: 1262965 - RNA, 13 nt, Homo sapiens
guggagugucaca

SEQ ID NO: 1262966 - RNA, 19 nt, Homo sapiens
guggaucuugccacauuuc

SEQ ID NO: 1262967 - RNA, 12 nt, Homo sapiens
guggaugacccu

SEQ ID NO: 1262968 - RNA, 17 nt, Homo sapiens
guggaugccugcugcau

SEQ ID NO: 1262969 - RNA, 21 nt, Homo sapiens
guggauucuucccacacagaa

SEQ ID NO: 1262970 - RNA, 16 nt, Homo sapiens
guggcagacaucggcc

SEQ ID NO: 1262971 - RNA, 22 nt, Homo sapiens
guggcauaaauugcaucacugu

SEQ ID NO: 1262972 - RNA, 14 nt, Homo sapiens
guggcaugugcugu

SEQ ID NO: 1262973 - RNA, 14 nt, Homo sapiens
guggcccaagacaa

SEQ ID NO: 1262974 - RNA, 18 nt, Homo sapiens
guggcccagggaagccaa

SEQ ID NO: 1262975 - RNA, 15 nt, Homo sapiens
guggccccaacacaa

SEQ ID NO: 1262976 - RNA, 14 nt, Homo sapiens
guggcccucuggau

SEQ ID NO: 1262977 - RNA, 19 nt, Homo sapiens
uaagaauucaaacuggggc

SEQ ID NO: 1262978 - RNA, 13 nt, Homo sapiens
uaagaauucugua

SEQ ID NO: 1262979 - RNA, 13 nt, Homo sapiens
uaagaauuucaca

SEQ ID NO: 1262980 - RNA, 15 nt, Homo sapiens
uaagacacaaaugca

SEQ ID NO: 1262981 - RNA, 12 nt, Homo sapiens
uaagacuaugau

SEQ ID NO: 1262982 - RNA, 19 nt, Homo sapiens
uaagacugugacaacuguc

SEQ ID NO: 1262983 - RNA, 23 nt, Homo sapiens
uaagacuuccccucaacaugcug

SEQ ID NO: 1262984 - RNA, 14 nt, Homo sapiens
uaagagacacucca

SEQ ID NO: 1262985 - RNA, 13 nt, Homo sapiens
uaagagagccuug

SEQ ID NO: 1262986 - RNA, 22 nt, Homo sapiens
uaagaggaucuccuguccauca

SEQ ID NO: 1262987 - RNA, 16 nt, Homo sapiens
uaagagguuuguauau

SEQ ID NO: 1262988 - RNA, 19 nt, Homo sapiens
uaagagugccguaacaacu

SEQ ID NO: 1262989 - RNA, 20 nt, Homo sapiens
uaagauauucagaaguauau

SEQ ID NO: 1262990 - RNA, 14 nt, Homo sapiens
uaagaucagacucu

SEQ ID NO: 1262991 - RNA, 16 nt, Homo sapiens
uaagaugagggggcca

SEQ ID NO: 1262992 - RNA, 17 nt, Homo sapiens
uaagauguucacugugg

SEQ ID NO: 1262993 - RNA, 17 nt, Homo sapiens
uaagauuauagauucua

SEQ ID NO: 1262994 - RNA, 12 nt, Homo sapiens
uaagauuuaccc

SEQ ID NO: 1262995 - RNA, 14 nt, Homo sapiens
uaagauuuugcacc

SEQ ID NO: 1262996 - RNA, 19 nt, Homo sapiens
uaagcaaauugcuuuuuuc

SEQ ID NO: 1262997 - RNA, 14 nt, Homo sapiens
uaagcauacuuugu

SEQ ID NO: 1262998 - RNA, 22 nt, Homo sapiens
uaagccacauggcugggauuua

SEQ ID NO: 1262999 - RNA, 15 nt, Homo sapiens
uaagccuaaaugccu

SEQ ID NO: 1263000 - RNA, 16 nt, Homo sapiens
uaagccugagccuuag

SEQ ID NO: 1263001 - RNA, 21 nt, Homo sapiens
uaagcuaucagcaauacucau

SEQ ID NO: 1263002 - RNA, 17 nt, Homo sapiens
uaagcucgagugaauuu

SEQ ID NO: 1263003 - RNA, 20 nt, Homo sapiens
uaagcucuacugaggugcua

SEQ ID NO: 1263004 - RNA, 20 nt, Homo sapiens
uaagcuuuggacccaaggaa

SEQ ID NO: 1263005 - RNA, 18 nt, Homo sapiens
uaaggacaagacacugag

SEQ ID NO: 1263006 - RNA, 15 nt, Homo sapiens
uaaggacauuuccca

SEQ ID NO: 1263007 - RNA, 16 nt, Homo sapiens
uaaggaccaauagcau

SEQ ID NO: 1263008 - RNA, 21 nt, Homo sapiens
uaaggaccaauagcaucugug

SEQ ID NO: 1263009 - RNA, 17 nt, Homo sapiens
uaaggacguguguaaau

SEQ ID NO: 1263010 - RNA, 16 nt, Homo sapiens
uaaggaggcacugcug

SEQ ID NO: 1263011 - RNA, 14 nt, Homo sapiens
uaaggauguugcca

SEQ ID NO: 1263012 - RNA, 11 nt, Homo sapiens
uaagggaacaa

SEQ ID NO: 1263013 - RNA, 14 nt, Homo sapiens
uaagggacaacauc

SEQ ID NO: 1263014 - RNA, 13 nt, Homo sapiens
uaaggucacagcu

SEQ ID NO: 1263015 - RNA, 20 nt, Homo sapiens
uaaggucacauugugccuuu

SEQ ID NO: 1263016 - RNA, 19 nt, Homo sapiens
uaaggucuccaaaccagac

SEQ ID NO: 1263017 - RNA, 16 nt, Homo sapiens
uaaggugaaccaaaga

SEQ ID NO: 1263018 - RNA, 19 nt, Homo sapiens
uaaggugcaauaagaauuu

SEQ ID NO: 1263019 - RNA, 15 nt, Homo sapiens
uaaguacaugugcca

SEQ ID NO: 1263020 - RNA, 23 nt, Homo sapiens
uaaguacuagaugcaucacuggg

SEQ ID NO: 1263021 - RNA, 12 nt, Homo sapiens
uaaguacuguaa

SEQ ID NO: 1263022 - RNA, 23 nt, Homo sapiens
uaaguacuguaauaauaccucaa

SEQ ID NO: 1263023 - RNA, 22 nt, Homo sapiens
uaaguaggaugaaucauauuca

SEQ ID NO: 1263024 - RNA, 20 nt, Homo sapiens
uaaguaguugguuuccuuca

SEQ ID NO: 1263025 - RNA, 17 nt, Homo sapiens
uaaguauaaacaaaagu

SEQ ID NO: 1263026 - RNA, 19 nt, Homo sapiens
uaaguaucacacuguauau

SEQ ID NO: 1263027 - RNA, 23 nt, Homo sapiens
uaaguauuuagaagugugaauuc

SEQ ID NO: 1263028 - RNA, 14 nt, Homo sapiens
uaagucaguguuaa

SEQ ID NO: 1263029 - RNA, 17 nt, Homo sapiens
uaagucuuaaucauuug

SEQ ID NO: 1263030 - RNA, 15 nt, Homo sapiens
uaagucuuucccaau

SEQ ID NO: 1263031 - RNA, 18 nt, Homo sapiens
uaagugaagugauacuau

SEQ ID NO: 1263032 - RNA, 22 nt, Homo sapiens
uaagugaugagggccucugcau

SEQ ID NO: 1263033 - RNA, 17 nt, Homo sapiens
uaagugcuaagugcuua

SEQ ID NO: 1263034 - RNA, 14 nt, Homo sapiens
uaagugcugcuaua

SEQ ID NO: 1263035 - RNA, 19 nt, Homo sapiens
uaaguuccagcagaugcca

SEQ ID NO: 1263036 - RNA, 14 nt, Homo sapiens
uaaguuuaucuuuc

SEQ ID NO: 1263037 - RNA, 23 nt, Homo sapiens
uaaguuucaggauacaugugccg

SEQ ID NO: 1263038 - RNA, 17 nt, Homo sapiens
uaaguuucaggugacau

SEQ ID NO: 1263039 - RNA, 14 nt, Homo sapiens
uaaguuucugggac

SEQ ID NO: 1263040 - RNA, 21 nt, Homo sapiens
uaauaaaaaauauucuuguca

SEQ ID NO: 1263041 - RNA, 21 nt, Homo sapiens
uaauaaaacagcugucucuaa

SEQ ID NO: 1263042 - RNA, 19 nt, Homo sapiens
uaauaaaacaucuuuccag

SEQ ID NO: 1263043 - RNA, 21 nt, Homo sapiens
uaauaaaagaguuaacauccc

SEQ ID NO: 1263044 - RNA, 14 nt, Homo sapiens
uaauaaagcauucu

SEQ ID NO: 1263045 - RNA, 18 nt, Homo sapiens
uaauaaagcauucuuuaa

SEQ ID NO: 1263046 - RNA, 16 nt, Homo sapiens
uaauaaaugaguucaa

SEQ ID NO: 1263047 - RNA, 20 nt, Homo sapiens
uaauaaauugcuuacugaua

SEQ ID NO: 1263048 - RNA, 21 nt, Homo sapiens
uaauaacugugaaguuuacau

SEQ ID NO: 1263049 - RNA, 12 nt, Homo sapiens
uaauaacuuauc

SEQ ID NO: 1263050 - RNA, 14 nt, Homo sapiens
uaauaacuuaucua

SEQ ID NO: 1263051 - RNA, 15 nt, Homo sapiens
uaauaagcuaaagag

SEQ ID NO: 1263052 - RNA, 20 nt, Homo sapiens
uaauaaguaucacacuguau

SEQ ID NO: 1263053 - RNA, 18 nt, Homo sapiens
uaauaaucuaugaugaag

SEQ ID NO: 1263054 - RNA, 14 nt, Homo sapiens
uaauacagcagugu

SEQ ID NO: 1263055 - RNA, 15 nt, Homo sapiens
uaauacaucaaagag

SEQ ID NO: 1263056 - RNA, 23 nt, Homo sapiens
uaauacauggcuaucaucaaaag

SEQ ID NO: 1263057 - RNA, 20 nt, Homo sapiens
uaauacugaaggacacagca

SEQ ID NO: 1263058 - RNA, 18 nt, Homo sapiens
uaauagaaauaaauuccu

SEQ ID NO: 1263059 - RNA, 14 nt, Homo sapiens
uaauagcagaaaua

SEQ ID NO: 1263060 - RNA, 22 nt, Homo sapiens
uaauagccuaauacaacaugua

SEQ ID NO: 1263061 - RNA, 19 nt, Homo sapiens
uaauagcuuuuauuguaua

SEQ ID NO: 1263062 - RNA, 13 nt, Homo sapiens
uaauagugaacau

SEQ ID NO: 1263063 - RNA, 17 nt, Homo sapiens
uaauauaagcugccaua

SEQ ID NO: 1263064 - RNA, 19 nt, Homo sapiens
uaauauauuguacacuaca

SEQ ID NO: 1263065 - RNA, 17 nt, Homo sapiens
uaauauccaagacuuag

SEQ ID NO: 1263066 - RNA, 17 nt, Homo sapiens
uaauaugccuagcacaa

SEQ ID NO: 1263067 - RNA, 23 nt, Homo sapiens
uaauauguugaguucaguuuacu

SEQ ID NO: 1263068 - RNA, 16 nt, Homo sapiens
uaauauuuuuagcucu

SEQ ID NO: 1263069 - RNA, 23 nt, Homo sapiens
uaaucaaaagaaccagacugugu

SEQ ID NO: 1263070 - RNA, 21 nt, Homo sapiens
uaaucaagaaaaacaucuuug

SEQ ID NO: 1263071 - RNA, 16 nt, Homo sapiens
uaaucacugcauuuca

SEQ ID NO: 1263072 - RNA, 21 nt, Homo sapiens
uaaucagcaagaauuugaucg

SEQ ID NO: 1263073 - RNA, 18 nt, Homo sapiens
uaaucaucuauaaagaag

SEQ ID NO: 1263074 - RNA, 23 nt, Homo sapiens
uaaucauuuguuuacauuugaug

SEQ ID NO: 1263075 - RNA, 12 nt, Homo sapiens
uaaugcuuuuau

SEQ ID NO: 1263076 - RNA, 20 nt, Homo sapiens
uaauggagaggaaaccagau

SEQ ID NO: 1263077 - RNA, 23 nt, Homo sapiens
uaauggaugguugaauuaacuuc

SEQ ID NO: 1263078 - RNA, 19 nt, Homo sapiens
uaauggcagagcagucuaa

SEQ ID NO: 1263079 - RNA, 13 nt, Homo sapiens
uaaugggacacua

SEQ ID NO: 1263080 - RNA, 12 nt, Homo sapiens
uaaugggacccc

SEQ ID NO: 1263081 - RNA, 21 nt, Homo sapiens
uaaugguguagaacacuaauu

SEQ ID NO: 1263082 - RNA, 14 nt, Homo sapiens
uaauguacaauaaa

SEQ ID NO: 1263083 - RNA, 20 nt, Homo sapiens
uaauguacaauaaagcaaug

SEQ ID NO: 1263084 - RNA, 21 nt, Homo sapiens
uaauguacaauaaagcaaugu

SEQ ID NO: 1263085 - RNA, 23 nt, Homo sapiens
uaauguacaauaaagcaaugugg

SEQ ID NO: 1263086 - RNA, 18 nt, Homo sapiens
uaauguacacauugcauu

SEQ ID NO: 1263087 - RNA, 20 nt, Homo sapiens
uaauguacacauugcauuuu

SEQ ID NO: 1263088 - RNA, 17 nt, Homo sapiens
uaauguaggacuguaua

SEQ ID NO: 1263089 - RNA, 21 nt, Homo sapiens
uaauguauuuguuugcaauuu

SEQ ID NO: 1263090 - RNA, 11 nt, Homo sapiens
uaaugugaagg

SEQ ID NO: 1263091 - RNA, 20 nt, Homo sapiens
uaauguuauaucauauguau

SEQ ID NO: 1263092 - RNA, 15 nt, Homo sapiens
uaauguuauuuccac

SEQ ID NO: 1263093 - RNA, 19 nt, Homo sapiens
uaauguuuuauacuguuua

SEQ ID NO: 1263094 - RNA, 23 nt, Homo sapiens
uaauguuuuuugccacagcuuuu

SEQ ID NO: 1263095 - RNA, 15 nt, Homo sapiens
uaauuaauugucauu

SEQ ID NO: 1263096 - RNA, 16 nt, Homo sapiens
uaauuaccaaccuguu

SEQ ID NO: 1263097 - RNA, 12 nt, Homo sapiens
uaauuacuguac

SEQ ID NO: 1263098 - RNA, 15 nt, Homo sapiens
uaauuauuucacuuu

SEQ ID NO: 1263099 - RNA, 16 nt, Homo sapiens
uaauucaaaagaucaa

SEQ ID NO: 1263100 - RNA, 14 nt, Homo sapiens
uaauucaaaagcac

SEQ ID NO: 1263101 - RNA, 19 nt, Homo sapiens
uaauucagcacugauuuca

SEQ ID NO: 1263102 - RNA, 13 nt, Homo sapiens
uaauucagcacuu

SEQ ID NO: 1263103 - RNA, 24 nt, Homo sapiens
uaauucaggggcugacacuucaag

SEQ ID NO: 1263104 - RNA, 13 nt, Homo sapiens
uaauucauggcau

SEQ ID NO: 1263105 - RNA, 17 nt, Homo sapiens
uaauucauugugauuua

SEQ ID NO: 1263106 - RNA, 18 nt, Homo sapiens
uaauuccagucauuuugg

SEQ ID NO: 1263107 - RNA, 17 nt, Homo sapiens
uaauucccgccuuaugc

SEQ ID NO: 1263108 - RNA, 14 nt, Homo sapiens
uaauucucuuucaa

SEQ ID NO: 1263109 - RNA, 20 nt, Homo sapiens
uaauucuuauuuaaguuauu

SEQ ID NO: 1263110 - RNA, 19 nt, Homo sapiens
uaauugaccuacuuuggua

SEQ ID NO: 1263111 - RNA, 13 nt, Homo sapiens
uaauugauuucaa

SEQ ID NO: 1263112 - RNA, 16 nt, Homo sapiens
uaauugcuuugccaaa

SEQ ID NO: 1263113 - RNA, 16 nt, Homo sapiens
uaauuggcccaaguca

SEQ ID NO: 1263114 - RNA, 14 nt, Homo sapiens
uaauuuaaagcuua

SEQ ID NO: 1263115 - RNA, 16 nt, Homo sapiens
uaauuuaacacccuuu

SEQ ID NO: 1263116 - RNA, 21 nt, Homo sapiens
uaauuuaucuugucucugggc

SEQ ID NO: 1263117 - RNA, 13 nt, Homo sapiens
uaauuuaugcaag

SEQ ID NO: 1263118 - RNA, 15 nt, Homo sapiens
uaauuuauuaaucua

SEQ ID NO: 1263119 - RNA, 13 nt, Homo sapiens
uaauuuauuucca

SEQ ID NO: 1263120 - RNA, 16 nt, Homo sapiens
uaauuuauuuugucca

SEQ ID NO: 1263121 - RNA, 17 nt, Homo sapiens
uaauuuauuuuguccau

SEQ ID NO: 1263122 - RNA, 17 nt, Homo sapiens
uaauuuccucugacaug

SEQ ID NO: 1263123 - RNA, 19 nt, Homo sapiens
uaauuuuccaaugcacagu

SEQ ID NO: 1263124 - RNA, 18 nt, Homo sapiens
uaauuuugagggcaugaa

SEQ ID NO: 1263125 - RNA, 16 nt, Homo sapiens
uaauuuugugcauucu

SEQ ID NO: 1263126 - RNA, 14 nt, Homo sapiens
uaauuuuguuguuu

SEQ ID NO: 1263127 - RNA, 23 nt, Homo sapiens
uaauuuuguuuauauuuucccau

SEQ ID NO: 1263128 - RNA, 19 nt, Homo sapiens
uaauuuuuccuauauugca

SEQ ID NO: 1263129 - RNA, 18 nt, Homo sapiens
uacaaaacuacaugagaa

SEQ ID NO: 1263130 - RNA, 19 nt, Homo sapiens
uacaaaauccaacucucug

SEQ ID NO: 1263131 - RNA, 15 nt, Homo sapiens
uacaaaauccagcua

SEQ ID NO: 1263132 - RNA, 14 nt, Homo sapiens
uacaaacugcaaua

SEQ ID NO: 1263133 - RNA, 16 nt, Homo sapiens
uacaaacuucaaagag

SEQ ID NO: 1263134 - RNA, 15 nt, Homo sapiens
uacaaauguaagcaa

SEQ ID NO: 1263135 - RNA, 23 nt, Homo sapiens
uacaaaugucuucaugaccuacu

SEQ ID NO: 1263136 - RNA, 19 nt, Homo sapiens
uacaaauuuaugcauuuca

SEQ ID NO: 1263137 - RNA, 14 nt, Homo sapiens
uacaaccagcccaa

SEQ ID NO: 1263138 - RNA, 20 nt, Homo sapiens
uacaacugcaccugucauca

SEQ ID NO: 1263139 - RNA, 21 nt, Homo sapiens
uacaaggaagggccaccacac

SEQ ID NO: 1263140 - RNA, 14 nt, Homo sapiens
uacaagguaauugu

SEQ ID NO: 1263141 - RNA, 19 nt, Homo sapiens
uacaagucagcuccagcuu

SEQ ID NO: 1263142 - RNA, 16 nt, Homo sapiens
uacaauaaagcaaugu

SEQ ID NO: 1263143 - RNA, 18 nt, Homo sapiens
uacaauaaagcaaugugg

SEQ ID NO: 1263144 - RNA, 21 nt, Homo sapiens
uacaauaaagcaaugugguag

SEQ ID NO: 1263145 - RNA, 18 nt, Homo sapiens
uacaaucagcagucuagu

SEQ ID NO: 1263146 - RNA, 19 nt, Homo sapiens
uacaaucagccacauucua

SEQ ID NO: 1263147 - RNA, 18 nt, Homo sapiens
uacaaucaugaacagcuc

SEQ ID NO: 1263148 - RNA, 19 nt, Homo sapiens
uacaaucaugaacagcucu

SEQ ID NO: 1263149 - RNA, 17 nt, Homo sapiens
uacaauccuguuuauaa

SEQ ID NO: 1263150 - RNA, 16 nt, Homo sapiens
uacaaucuuagugaau

SEQ ID NO: 1263151 - RNA, 22 nt, Homo sapiens
uacaaugaaagcccucaugugc

SEQ ID NO: 1263152 - RNA, 20 nt, Homo sapiens
uacaauuaaaacuaagcaca

SEQ ID NO: 1263153 - RNA, 17 nt, Homo sapiens
uacaauuaauaguuugu

SEQ ID NO: 1263154 - RNA, 19 nt, Homo sapiens
uacaauugugggcauaaac

SEQ ID NO: 1263155 - RNA, 12 nt, Homo sapiens
uacaauuucacu

SEQ ID NO: 1263156 - RNA, 16 nt, Homo sapiens
uacaauuugacauaca

SEQ ID NO: 1263157 - RNA, 23 nt, Homo sapiens
uacaauuuguuaauuccuaugaa

SEQ ID NO: 1263158 - RNA, 20 nt, Homo sapiens
uacaauuuuauaggugaaag

SEQ ID NO: 1263159 - RNA, 18 nt, Homo sapiens
uacaauuuuuuaucaugc

SEQ ID NO: 1263160 - RNA, 19 nt, Homo sapiens
uacacacacacgcacacaa

SEQ ID NO: 1263161 - RNA, 18 nt, Homo sapiens
uacacacuuuuuaagaaa

SEQ ID NO: 1263162 - RNA, 17 nt, Homo sapiens
uacacagaauuguucca

SEQ ID NO: 1263163 - RNA, 20 nt, Homo sapiens
uacacagugggaacucugac

SEQ ID NO: 1263164 - RNA, 18 nt, Homo sapiens
uacaccauuaucuuggaa

SEQ ID NO: 1263165 - RNA, 19 nt, Homo sapiens
uacacccaguucugaauaa

SEQ ID NO: 1263166 - RNA, 15 nt, Homo sapiens
uacacccccaccucc

SEQ ID NO: 1263167 - RNA, 17 nt, Homo sapiens
uacaccuuagugcagcg

SEQ ID NO: 1263168 - RNA, 15 nt, Homo sapiens
uacacguguccugua

SEQ ID NO: 1263169 - RNA, 12 nt, Homo sapiens
uacacuaugaag

SEQ ID NO: 1263170 - RNA, 20 nt, Homo sapiens
uacacuuauuuuacuaguuu

SEQ ID NO: 1263171 - RNA, 17 nt, Homo sapiens
uacacuuuuuuccaaag

SEQ ID NO: 1263172 - RNA, 17 nt, Homo sapiens
uacagaaaagacucuga

SEQ ID NO: 1263173 - RNA, 16 nt, Homo sapiens
uacagaaaucaauggu

SEQ ID NO: 1263174 - RNA, 14 nt, Homo sapiens
uauacuguuuacug

SEQ ID NO: 1263175 - RNA, 18 nt, Homo sapiens
uauacuucaaaagccaua

SEQ ID NO: 1263176 - RNA, 15 nt, Homo sapiens
uauacuugacucuaa

SEQ ID NO: 1263177 - RNA, 17 nt, Homo sapiens
uauacuuuaguagacau

SEQ ID NO: 1263178 - RNA, 21 nt, Homo sapiens
uauacuuuaguagacauuuau

SEQ ID NO: 1263179 - RNA, 14 nt, Homo sapiens
uauacuuuugugaa

SEQ ID NO: 1263180 - RNA, 22 nt, Homo sapiens
uauacuuuuuucuuauuuaacu

SEQ ID NO: 1263181 - RNA, 17 nt, Homo sapiens
uauagacuggaaaaaau

SEQ ID NO: 1263182 - RNA, 15 nt, Homo sapiens
uauagcguucccaac

SEQ ID NO: 1263183 - RNA, 15 nt, Homo sapiens
uauaggaacaauucu

SEQ ID NO: 1263184 - RNA, 14 nt, Homo sapiens
uauaggacucucag

SEQ ID NO: 1263185 - RNA, 20 nt, Homo sapiens
uauaggugauguuugcucuu

SEQ ID NO: 1263186 - RNA, 18 nt, Homo sapiens
uauagguuuugguuccac

SEQ ID NO: 1263187 - RNA, 16 nt, Homo sapiens
uauaguaaguuucuau

SEQ ID NO: 1263188 - RNA, 17 nt, Homo sapiens
uauaguaugaaugcagu

SEQ ID NO: 1263189 - RNA, 15 nt, Homo sapiens
uauagucgcagcuac

SEQ ID NO: 1263190 - RNA, 16 nt, Homo sapiens
uauaguuauacaucaa

SEQ ID NO: 1263191 - RNA, 14 nt, Homo sapiens
uauaguucuaggca

SEQ ID NO: 1263192 - RNA, 15 nt, Homo sapiens
uauauaaaaauccca

SEQ ID NO: 1263193 - RNA, 11 nt, Homo sapiens
uauauaaacuc

SEQ ID NO: 1263194 - RNA, 16 nt, Homo sapiens
uauauaaagacugccu

SEQ ID NO: 1263195 - RNA, 15 nt, Homo sapiens
uauauaaguguacau

SEQ ID NO: 1263196 - RNA, 13 nt, Homo sapiens
uauauaaguugcu

SEQ ID NO: 1263197 - RNA, 16 nt, Homo sapiens
uauauaauucuguaca

SEQ ID NO: 1263198 - RNA, 22 nt, Homo sapiens
uaugcgcuuaaauuaagauuau

SEQ ID NO: 1263199 - RNA, 16 nt, Homo sapiens
uaugcuaccuacugau

SEQ ID NO: 1263200 - RNA, 18 nt, Homo sapiens
uaugcuauuauucuguaa

SEQ ID NO: 1263201 - RNA, 18 nt, Homo sapiens
uaugcucagggucaauuu

SEQ ID NO: 1263202 - RNA, 18 nt, Homo sapiens
uaugcucauugaacuuua

SEQ ID NO: 1263203 - RNA, 16 nt, Homo sapiens
uaugcugacagcucuu

SEQ ID NO: 1263204 - RNA, 16 nt, Homo sapiens
uaugcugcuguuuaca

SEQ ID NO: 1263205 - RNA, 19 nt, Homo sapiens
uaugcuggacugcauucac

SEQ ID NO: 1263206 - RNA, 12 nt, Homo sapiens
uaugcuggccag

SEQ ID NO: 1263207 - RNA, 16 nt, Homo sapiens
uauggaauacaguguu

SEQ ID NO: 1263208 - RNA, 21 nt, Homo sapiens
uauggaauaucaucugucauu

SEQ ID NO: 1263209 - RNA, 19 nt, Homo sapiens
uauggaauugauuugcauu

SEQ ID NO: 1263210 - RNA, 18 nt, Homo sapiens
uauggaggggagggaucu

SEQ ID NO: 1263211 - RNA, 15 nt, Homo sapiens
uauggcuugugaacu

SEQ ID NO: 1263212 - RNA, 14 nt, Homo sapiens
uaugggagaauugc

SEQ ID NO: 1263213 - RNA, 15 nt, Homo sapiens
uaugggggcacugag

SEQ ID NO: 1263214 - RNA, 17 nt, Homo sapiens
uauguaaaacucgcuuu

SEQ ID NO: 1263215 - RNA, 22 nt, Homo sapiens
uauguaaucucaccucaccugg

SEQ ID NO: 1263216 - RNA, 13 nt, Homo sapiens
uauguacuaagca

SEQ ID NO: 1263217 - RNA, 14 nt, Homo sapiens
uauguacugccuua

SEQ ID NO: 1263218 - RNA, 17 nt, Homo sapiens
uauguagaaacauuuag

SEQ ID NO: 1263219 - RNA, 20 nt, Homo sapiens
uaugucaggcaaagugcugc

SEQ ID NO: 1263220 - RNA, 17 nt, Homo sapiens
uauguccgaugguaucu

SEQ ID NO: 1263221 - RNA, 12 nt, Homo sapiens
uauguguaaaau

SEQ ID NO: 1263222 - RNA, 21 nt, Homo sapiens
uaugugugcauguguguauaa

SEQ ID NO: 1263223 - RNA, 20 nt, Homo sapiens
uauguuagagaauuuccuua

SEQ ID NO: 1263224 - RNA, 12 nt, Homo sapiens
uauguugcccag

SEQ ID NO: 1263225 - RNA, 15 nt, Homo sapiens
uauguuuacauauca

SEQ ID NO: 1263226 - RNA, 13 nt, Homo sapiens
uauguuucacugu

SEQ ID NO: 1263227 - RNA, 12 nt, Homo sapiens
uauguuugcaaa

SEQ ID NO: 1263228 - RNA, 13 nt, Homo sapiens
uauguuugcacuu

SEQ ID NO: 1263229 - RNA, 19 nt, Homo sapiens
uauguuuggaauaaaguca

SEQ ID NO: 1263230 - RNA, 17 nt, Homo sapiens
uauuaacuuuaauucuc

SEQ ID NO: 1263231 - RNA, 13 nt, Homo sapiens
uauuaagcacuuu

SEQ ID NO: 1263232 - RNA, 20 nt, Homo sapiens
uauuaagguuuucaaccgga

SEQ ID NO: 1263233 - RNA, 16 nt, Homo sapiens
uauuaagugugcuuau

SEQ ID NO: 1263234 - RNA, 15 nt, Homo sapiens
uauuaauaugcaugc

SEQ ID NO: 1263235 - RNA, 19 nt, Homo sapiens
uauuaaucuggacauucga

SEQ ID NO: 1263236 - RNA, 20 nt, Homo sapiens
uauuaauuguuuugcacuuu

SEQ ID NO: 1263237 - RNA, 21 nt, Homo sapiens
uauuaauuuuccaaugcacag

SEQ ID NO: 1263238 - RNA, 14 nt, Homo sapiens
uauuaauuuugcca

SEQ ID NO: 1263239 - RNA, 18 nt, Homo sapiens
uauuacaagccuacauga

SEQ ID NO: 1263240 - RNA, 17 nt, Homo sapiens
uauuacauuuucaguga

SEQ ID NO: 1263241 - RNA, 22 nt, Homo sapiens
uauuaccagguccauuuugccu

SEQ ID NO: 1263242 - RNA, 11 nt, Homo sapiens
uauuaccuccc

SEQ ID NO: 1263243 - RNA, 20 nt, Homo sapiens
uauuacuuagguuauuuugc

SEQ ID NO: 1263244 - RNA, 11 nt, Homo sapiens
uauuagcaaac

SEQ ID NO: 1263245 - RNA, 15 nt, Homo sapiens
uauuagccaacuguu

SEQ ID NO: 1263246 - RNA, 22 nt, Homo sapiens
uauuaggcuauaaauguccuaa

SEQ ID NO: 1263247 - RNA, 16 nt, Homo sapiens
uauuauaaaaguacua

SEQ ID NO: 1263248 - RNA, 12 nt, Homo sapiens
uauuauaauuca

SEQ ID NO: 1263249 - RNA, 15 nt, Homo sapiens
uauuaucauugaaag

SEQ ID NO: 1263250 - RNA, 19 nt, Homo sapiens
uauuaucugucagcugcaa

SEQ ID NO: 1263251 - RNA, 14 nt, Homo sapiens
uauuaugagcuaca

SEQ ID NO: 1263252 - RNA, 22 nt, Homo sapiens
uauuauugguuguuguauugau

SEQ ID NO: 1263253 - RNA, 20 nt, Homo sapiens
uauuauuuguguuuccuaaa

SEQ ID NO: 1263254 - RNA, 20 nt, Homo sapiens
uauucaauggaaagcugcuu

SEQ ID NO: 1263255 - RNA, 16 nt, Homo sapiens
uauucacauguucuaa

SEQ ID NO: 1263256 - RNA, 23 nt, Homo sapiens
uauucagauauaaaacaguuuug

SEQ ID NO: 1263257 - RNA, 22 nt, Homo sapiens
uauuccauggcuaacuggcgag

SEQ ID NO: 1263258 - RNA, 20 nt, Homo sapiens
uauuccuaggcaacuauuaa

SEQ ID NO: 1263259 - RNA, 13 nt, Homo sapiens
uauuccugcauuu

SEQ ID NO: 1263260 - RNA, 21 nt, Homo sapiens
uauucgugcauuuuuggauca

SEQ ID NO: 1263261 - RNA, 15 nt, Homo sapiens
uauucuaaaaccauu

SEQ ID NO: 1263262 - RNA, 16 nt, Homo sapiens
uauucuaaaaccauuc

SEQ ID NO: 1263263 - RNA, 19 nt, Homo sapiens
uauucuccauacucuguaa

SEQ ID NO: 1263264 - RNA, 21 nt, Homo sapiens
uauucugccaaaccuguguag

SEQ ID NO: 1263265 - RNA, 23 nt, Homo sapiens
uauucuuaagggaacuuccacau

SEQ ID NO: 1263266 - RNA, 14 nt, Homo sapiens
uauugacaucucuu

SEQ ID NO: 1263267 - RNA, 15 nt, Homo sapiens
uauugacuucaauga

SEQ ID NO: 1263268 - RNA, 16 nt, Homo sapiens
uauugagugaagccuu

SEQ ID NO: 1263269 - RNA, 13 nt, Homo sapiens
uauugcaagcauu

SEQ ID NO: 1263270 - RNA, 18 nt, Homo sapiens
uauugcagucaaucucuu

SEQ ID NO: 1263271 - RNA, 16 nt, Homo sapiens
uauugcauaauuuaua

SEQ ID NO: 1263272 - RNA, 20 nt, Homo sapiens
uauugccucugaaaugccuc

SEQ ID NO: 1263273 - RNA, 18 nt, Homo sapiens
uauugcuagccaucuuga

SEQ ID NO: 1263274 - RNA, 11 nt, Homo sapiens
uauugcugcuc

SEQ ID NO: 1263275 - RNA, 15 nt, Homo sapiens
uauugcuguuaauau

SEQ ID NO: 1263276 - RNA, 15 nt, Homo sapiens
uauuguaaacaugug

SEQ ID NO: 1263277 - RNA, 17 nt, Homo sapiens
uauuguaaagauccuau

SEQ ID NO: 1263278 - RNA, 22 nt, Homo sapiens
uauuguauuuauuccauauuca

SEQ ID NO: 1263279 - RNA, 15 nt, Homo sapiens
uauuguuacacauua

SEQ ID NO: 1263280 - RNA, 22 nt, Homo sapiens
uauuuaaaaaauuauggaauau

SEQ ID NO: 1263281 - RNA, 23 nt, Homo sapiens
uauuuaaaggaaaaucacaucuc

SEQ ID NO: 1263282 - RNA, 21 nt, Homo sapiens
uauuuaaauaaaaucauauug

SEQ ID NO: 1263283 - RNA, 20 nt, Homo sapiens
uauuuaaauuguuuuggacg

SEQ ID NO: 1263284 - RNA, 18 nt, Homo sapiens
uauuuacauacaggccau

SEQ ID NO: 1263285 - RNA, 19 nt, Homo sapiens
uauuuacuuuuaccacuau

SEQ ID NO: 1263286 - RNA, 18 nt, Homo sapiens
uauuuagauauaacacua

SEQ ID NO: 1263287 - RNA, 20 nt, Homo sapiens
uauuuagauauaacacuaug

SEQ ID NO: 1263288 - RNA, 13 nt, Homo sapiens
uauuuagaucuca

SEQ ID NO: 1263289 - RNA, 15 nt, Homo sapiens
uauuuagugaacuac

SEQ ID NO: 1263290 - RNA, 18 nt, Homo sapiens
uauuuauaagagugccgu

SEQ ID NO: 1263291 - RNA, 19 nt, Homo sapiens
uauuuaucagugacagagu

SEQ ID NO: 1263292 - RNA, 21 nt, Homo sapiens
uauuuaugagaaaguucucau

SEQ ID NO: 1263293 - RNA, 17 nt, Homo sapiens
uauuuaugccucuguau

SEQ ID NO: 1263294 - RNA, 13 nt, Homo sapiens
uauuuaugcuaua

SEQ ID NO: 1263295 - RNA, 13 nt, Homo sapiens
uauuuauuuacug

SEQ ID NO: 1263296 - RNA, 16 nt, Homo sapiens
uauuuauuuuuugcca

SEQ ID NO: 1263297 - RNA, 20 nt, Homo sapiens
uauuucaaaauauacauuca

SEQ ID NO: 1263298 - RNA, 18 nt, Homo sapiens
uauuucaagucucucacc

SEQ ID NO: 1263299 - RNA, 22 nt, Homo sapiens
uauuucacagcaaggaaauuca

SEQ ID NO: 1263300 - RNA, 15 nt, Homo sapiens
uauuucacuugauga

SEQ ID NO: 1263301 - RNA, 12 nt, Homo sapiens
uauuucaggcau

SEQ ID NO: 1263302 - RNA, 15 nt, Homo sapiens
uauuucuaaguauuu

SEQ ID NO: 1263303 - RNA, 21 nt, Homo sapiens
uccccuuuggcuaccugaugg

SEQ ID NO: 1263304 - RNA, 14 nt, Homo sapiens
ucccgaaacuccac

SEQ ID NO: 1263305 - RNA, 18 nt, Homo sapiens
ucccgaauucgcuguuac

SEQ ID NO: 1263306 - RNA, 18 nt, Homo sapiens
ucccgacccaaaggguga

SEQ ID NO: 1263307 - RNA, 16 nt, Homo sapiens
ucccgaggcuacagca

SEQ ID NO: 1263308 - RNA, 18 nt, Homo sapiens
ucccgaguaacugagauu

SEQ ID NO: 1263309 - RNA, 15 nt, Homo sapiens
ucccgaugcugcuau

SEQ ID NO: 1263310 - RNA, 16 nt, Homo sapiens
ucccgaugcugcuaug

SEQ ID NO: 1263311 - RNA, 19 nt, Homo sapiens
ucccgauucccaacugagu

SEQ ID NO: 1263312 - RNA, 20 nt, Homo sapiens
ucccgccaacgcaucacugg

SEQ ID NO: 1263313 - RNA, 14 nt, Homo sapiens
ucccgccaugcuca

SEQ ID NO: 1263314 - RNA, 22 nt, Homo sapiens
ucccggacgcguccugggaucu

SEQ ID NO: 1263315 - RNA, 17 nt, Homo sapiens
ucccggggccagcacuu

SEQ ID NO: 1263316 - RNA, 16 nt, Homo sapiens
ucccggguguguacac

SEQ ID NO: 1263317 - RNA, 17 nt, Homo sapiens
ucccuaaaauacauuua

SEQ ID NO: 1263318 - RNA, 13 nt, Homo sapiens
ucccuacauguau

SEQ ID NO: 1263319 - RNA, 20 nt, Homo sapiens
ucccuagccagaggcucuaa

SEQ ID NO: 1263320 - RNA, 23 nt, Homo sapiens
ucccuagccagaggcucuaaugu

SEQ ID NO: 1263321 - RNA, 15 nt, Homo sapiens
ucccuaggaaacuca

SEQ ID NO: 1263322 - RNA, 10 nt, Homo sapiens
ucccuaucua

SEQ ID NO: 1263323 - RNA, 21 nt, Homo sapiens
cagcugguugcuccauuugag

SEQ ID NO: 1263324 - RNA, 21 nt, Homo sapiens
uuguauguuaaagcaucagag

SEQ ID NO: 1263325 - RNA, 21 nt, Homo sapiens
uugucaauauuaaauacagac

SEQ ID NO: 1263326 - RNA, 15 nt, Homo sapiens
uugucacacgauaaa

SEQ ID NO: 1263327 - RNA, 21 nt, Homo sapiens
uugucagccaucguccuggga

SEQ ID NO: 1263328 - RNA, 18 nt, Homo sapiens
uugucaguauuuuugccg

SEQ ID NO: 1263329 - RNA, 19 nt, Homo sapiens
uugucaugguuacaaacua

SEQ ID NO: 1263330 - RNA, 22 nt, Homo sapiens
uugucaugguuacaaacuacag

SEQ ID NO: 1263331 - RNA, 18 nt, Homo sapiens
uuguccccacuuacagau

SEQ ID NO: 1263332 - RNA, 18 nt, Homo sapiens
uugucccuaugcauauca

SEQ ID NO: 1263333 - RNA, 18 nt, Homo sapiens
uugucccugugccuaaca

SEQ ID NO: 1263334 - RNA, 17 nt, Homo sapiens
uugucgcucaugugugc

SEQ ID NO: 1263335 - RNA, 19 nt, Homo sapiens
uugucuccuacuccugacu

SEQ ID NO: 1263336 - RNA, 13 nt, Homo sapiens
uugucuguaaaua

SEQ ID NO: 1263337 - RNA, 14 nt, Homo sapiens
uugucuguguugcu

SEQ ID NO: 1263338 - RNA, 13 nt, Homo sapiens
uugucuucaugaa

SEQ ID NO: 1263339 - RNA, 20 nt, Homo sapiens
uugucuuuccuggcacuaac

SEQ ID NO: 1263340 - RNA, 15 nt, Homo sapiens
uugugaccacaggcu

SEQ ID NO: 1263341 - RNA, 16 nt, Homo sapiens
uugugauuucuuuaaa

SEQ ID NO: 1263342 - RNA, 23 nt, Homo sapiens
uugugauuuuuuuaauagugcuu

SEQ ID NO: 1263343 - RNA, 20 nt, Homo sapiens
uugugccauauuugugccau

SEQ ID NO: 1263344 - RNA, 17 nt, Homo sapiens
uuguggguccaugcuaa

SEQ ID NO: 1263345 - RNA, 21 nt, Homo sapiens
uuguguaauauauuguacacu

SEQ ID NO: 1263346 - RNA, 14 nt, Homo sapiens
uuguguacugauaa

SEQ ID NO: 1263347 - RNA, 16 nt, Homo sapiens
uugugucagaaacaug

SEQ ID NO: 1263348 - RNA, 18 nt, Homo sapiens
uugugugaccaacugugu

SEQ ID NO: 1263349 - RNA, 14 nt, Homo sapiens
uuguguugucacua

SEQ ID NO: 1263350 - RNA, 16 nt, Homo sapiens
uuguguuugugccaua

SEQ ID NO: 1263351 - RNA, 18 nt, Homo sapiens
uuguuaccuuuaugguuu

SEQ ID NO: 1263352 - RNA, 16 nt, Homo sapiens
uuguuaucagucaaua

SEQ ID NO: 1263353 - RNA, 19 nt, Homo sapiens
uuguuaucuuccacuggaa

SEQ ID NO: 1263354 - RNA, 14 nt, Homo sapiens
uuguuaugucuaga

SEQ ID NO: 1263355 - RNA, 23 nt, Homo sapiens
uuguucaaacaauaucauaucau

SEQ ID NO: 1263356 - RNA, 14 nt, Homo sapiens
uuguucaaauguuc

SEQ ID NO: 1263357 - RNA, 19 nt, Homo sapiens
uuguucaauaauuacugua

SEQ ID NO: 1263358 - RNA, 20 nt, Homo sapiens
uuguucaauguuccauucuu

SEQ ID NO: 1263359 - RNA, 16 nt, Homo sapiens
uuguucaguaugcaaa

SEQ ID NO: 1263360 - RNA, 19 nt, Homo sapiens
uuguucauccuauuguuga

SEQ ID NO: 1263361 - RNA, 21 nt, Homo sapiens
uuguucguauuuagaauggga

SEQ ID NO: 1263362 - RNA, 20 nt, Homo sapiens
uuguucuuuggaaauacaca

SEQ ID NO: 1263363 - RNA, 11 nt, Homo sapiens
uuguugccaug

SEQ ID NO: 1263364 - RNA, 14 nt, Homo sapiens
uuguuggucagagg

SEQ ID NO: 1263365 - RNA, 13 nt, Homo sapiens
uuguugugcuauu

SEQ ID NO: 1263366 - RNA, 20 nt, Homo sapiens
uuguuguggucugagccaaa

SEQ ID NO: 1263367 - RNA, 13 nt, Homo sapiens
uuguuguuauuaa

SEQ ID NO: 1263368 - RNA, 13 nt, Homo sapiens
uuguuguuugcca

SEQ ID NO: 1263369 - RNA, 19 nt, Homo sapiens
uuguuuaaaucaagagcuu

SEQ ID NO: 1263370 - RNA, 16 nt, Homo sapiens
uuguuuauuguaaaac

SEQ ID NO: 1263371 - RNA, 12 nt, Homo sapiens
uuguuucuuaag

SEQ ID NO: 1263372 - RNA, 19 nt, Homo sapiens
uuguuuguaaaugccucuu

SEQ ID NO: 1263373 - RNA, 14 nt, Homo sapiens
uuguuugucuucca

SEQ ID NO: 1263374 - RNA, 18 nt, Homo sapiens
uuguuuuguguaacauau

SEQ ID NO: 1263375 - RNA, 22 nt, Homo sapiens
uuguuuuuuacucaaauuggga

SEQ ID NO: 1263376 - RNA, 16 nt, Homo sapiens
uuuaaaaaaaagcaua

SEQ ID NO: 1263377 - RNA, 19 nt, Homo sapiens
uuuaaaaaugcaccacuuu

SEQ ID NO: 1263378 - RNA, 20 nt, Homo sapiens
uuuaaaacgcaugugcagcu

SEQ ID NO: 1263379 - RNA, 18 nt, Homo sapiens
uuuaaaagucucacaaag

SEQ ID NO: 1263380 - RNA, 18 nt, Homo sapiens
uuuaaaauauuugaauga

SEQ ID NO: 1263381 - RNA, 16 nt, Homo sapiens
uuuaaaauuuguccua

SEQ ID NO: 1263382 - RNA, 14 nt, Homo sapiens
uuuaaacacaugcc

SEQ ID NO: 1263383 - RNA, 14 nt, Homo sapiens
uuuaaacaguuuag

SEQ ID NO: 1263384 - RNA, 14 nt, Homo sapiens
uuuaaacucaggga

SEQ ID NO: 1263385 - RNA, 12 nt, Homo sapiens
uuuaaacuuuga

SEQ ID NO: 1263386 - RNA, 18 nt, Homo sapiens
uuuaaagccacauuucau

SEQ ID NO: 1263387 - RNA, 16 nt, Homo sapiens
uuuaaagcucaugcau

SEQ ID NO: 1263388 - RNA, 16 nt, Homo sapiens
uuuaaaggaguaggac

SEQ ID NO: 1263389 - RNA, 18 nt, Homo sapiens
uuuaaaguaaaggcaaac

SEQ ID NO: 1263390 - RNA, 20 nt, Homo sapiens
uuuaaaguauguuauugcau

SEQ ID NO: 1263391 - RNA, 18 nt, Homo sapiens
uuuaaauaaaagcacaag

SEQ ID NO: 1263392 - RNA, 13 nt, Homo sapiens
uuuaaaugauaca

SEQ ID NO: 1263393 - RNA, 18 nt, Homo sapiens
uuuaaauggcuacuuugg

SEQ ID NO: 1263394 - RNA, 22 nt, Homo sapiens
uuuaaauuacaauuuuaucugu

SEQ ID NO: 1263395 - RNA, 15 nt, Homo sapiens
uuuaaauuauacugu

SEQ ID NO: 1263396 - RNA, 17 nt, Homo sapiens
uuuaaauuuucaccugu

SEQ ID NO: 1263397 - RNA, 14 nt, Homo sapiens
uuuaacaccagaaa

SEQ ID NO: 1263398 - RNA, 23 nt, Homo sapiens
uuuaacacccuuuagaaccuuaa

SEQ ID NO: 1263399 - RNA, 22 nt, Homo sapiens
uuuaacacuuuguauuacuuag

SEQ ID NO: 1263400 - RNA, 17 nt, Homo sapiens
uuuaacagaaacuuuca

SEQ ID NO: 1263401 - RNA, 12 nt, Homo sapiens
uuuaacauuucc

SEQ ID NO: 1263402 - RNA, 17 nt, Homo sapiens
uuuaacuuaacauucug

SEQ ID NO: 1263403 - RNA, 22 nt, Homo sapiens
uuuaagaauucuguacuuccaa

SEQ ID NO: 1263404 - RNA, 15 nt, Homo sapiens
uuuaagcaacacaga

SEQ ID NO: 1263405 - RNA, 17 nt, Homo sapiens
uuuaagcagcgccagug

SEQ ID NO: 1263406 - RNA, 22 nt, Homo sapiens
uuuaagggcaugccuugugcug

SEQ ID NO: 1263407 - RNA, 23 nt, Homo sapiens
uuuaagggggaaaacuguucucu

SEQ ID NO: 1263408 - RNA, 14 nt, Homo sapiens
uuuaagguaacaaa

SEQ ID NO: 1263409 - RNA, 18 nt, Homo sapiens
uuuaaggugaaccaaaga

SEQ ID NO: 1263410 - RNA, 13 nt, Homo sapiens
uuuaaguaacuua

SEQ ID NO: 1263411 - RNA, 18 nt, Homo sapiens
uuuaagucaacacuauau

SEQ ID NO: 1263412 - RNA, 21 nt, Homo sapiens
uuuaauaaauugcuuacugau

SEQ ID NO: 1263413 - RNA, 14 nt, Homo sapiens
uuuaauacagugag

SEQ ID NO: 1263414 - RNA, 19 nt, Homo sapiens
uuuaauagaaauaaauucc

SEQ ID NO: 1263415 - RNA, 16 nt, Homo sapiens
uuuaauagaauauaau

SEQ ID NO: 1263416 - RNA, 15 nt, Homo sapiens
uuuaauaugcuuaaa

SEQ ID NO: 1263417 - RNA, 19 nt, Homo sapiens
uuuaaucauuuugccucuu

SEQ ID NO: 1263418 - RNA, 16 nt, Homo sapiens
uuuaaugaagugcaau

SEQ ID NO: 1263419 - RNA, 12 nt, Homo sapiens
uuuaaugaguca

SEQ ID NO: 1263420 - RNA, 23 nt, Homo sapiens
uuuaauggcaauaggacauugug

SEQ ID NO: 1263421 - RNA, 15 nt, Homo sapiens
uuuaauggcauguca

SEQ ID NO: 1263422 - RNA, 19 nt, Homo sapiens
uuuaauguaauagggaaaa

SEQ ID NO: 1263423 - RNA, 15 nt, Homo sapiens
uuuaauuuagugauc

SEQ ID NO: 1263424 - RNA, 21 nt, Homo sapiens
uuuacaagaaguuuauucuca

SEQ ID NO: 1263425 - RNA, 15 nt, Homo sapiens
uuuacaaggugacaa

SEQ ID NO: 1263426 - RNA, 20 nt, Homo sapiens
uuuacagaaaagacucugac

SEQ ID NO: 1263427 - RNA, 18 nt, Homo sapiens
uuuacagugcuauuuacu

SEQ ID NO: 1263428 - RNA, 14 nt, Homo sapiens
uuuacauacuuuau

SEQ ID NO: 1263429 - RNA, 13 nt, Homo sapiens
uuuacaugugauu

SEQ ID NO: 1263430 - RNA, 23 nt, Homo sapiens
uuuacauguguagccuauguugu

SEQ ID NO: 1263431 - RNA, 10 nt, Homo sapiens
uuuacauuca

SEQ ID NO: 1263432 - RNA, 11 nt, Homo sapiens
uuuacauucau

SEQ ID NO: 1263433 - RNA, 14 nt, Homo sapiens
uuuacauucaucaa

SEQ ID NO: 1263434 - RNA, 12 nt, Homo sapiens
uuuacauuugau

SEQ ID NO: 1263435 - RNA, 16 nt, Homo sapiens
uuuaccauuuguaaua

SEQ ID NO: 1263436 - RNA, 17 nt, Homo sapiens
uuuaccuaguuugcacu

SEQ ID NO: 1263437 - RNA, 18 nt, Homo sapiens
uuuaccuucaaacuuuag

SEQ ID NO: 1263438 - RNA, 17 nt, Homo sapiens
uuuaccuuuaucuuuca

SEQ ID NO: 1263439 - RNA, 18 nt, Homo sapiens
uuuacucagaaccugcuc

SEQ ID NO: 1263440 - RNA, 20 nt, Homo sapiens
uuuacuuuuaccacuauuua

SEQ ID NO: 1263441 - RNA, 23 nt, Homo sapiens
uuuagaaaaaaguuuacaacaua

SEQ ID NO: 1263442 - RNA, 14 nt, Homo sapiens
uuuagaacagggaa

SEQ ID NO: 1263443 - RNA, 18 nt, Homo sapiens
uuuagaacuugcagcuga

SEQ ID NO: 1263444 - RNA, 22 nt, Homo sapiens
uuuagaacuuuaccuauggaag

SEQ ID NO: 1263445 - RNA, 20 nt, Homo sapiens
uuuagaacuuuggcugccuu

SEQ ID NO: 1263446 - RNA, 16 nt, Homo sapiens
uuuagaagugugaauu

SEQ ID NO: 1263447 - RNA, 21 nt, Homo sapiens
uuuagaccuguguuacuaaaa

SEQ ID NO: 1263448 - RNA, 18 nt, Homo sapiens
uuuagauaugacauuuau

SEQ ID NO: 1263449 - RNA, 14 nt, Homo sapiens
uuuagcacaaaaaa

SEQ ID NO: 1263450 - RNA, 21 nt, Homo sapiens
uuuaggaaaaauaauucuauu

SEQ ID NO: 1263451 - RNA, 16 nt, Homo sapiens
uuuaggagaaagugua

SEQ ID NO: 1263452 - RNA, 13 nt, Homo sapiens
uuuaggaugcuuu

SEQ ID NO: 1263453 - RNA, 16 nt, Homo sapiens
uuuaggcacuguucaa

SEQ ID NO: 1263454 - RNA, 12 nt, Homo sapiens
uuuaguccugua

SEQ ID NO: 1263455 - RNA, 17 nt, Homo sapiens
uuuaguccuguacugua

SEQ ID NO: 1263456 - RNA, 17 nt, Homo sapiens
uuuagugguacucugaa

SEQ ID NO: 1263457 - RNA, 14 nt, Homo sapiens
uuuaguuauaaaca

SEQ ID NO: 1263458 - RNA, 19 nt, Homo sapiens
uuuaguucaauacagugaa

SEQ ID NO: 1263459 - RNA, 20 nt, Homo sapiens
uuuaguuuuagcagcugaaa

SEQ ID NO: 1263460 - RNA, 20 nt, Homo sapiens
uuuaguuuuucccucaguga

SEQ ID NO: 1263461 - RNA, 16 nt, Homo sapiens
uuuauaaaauuuugcu

SEQ ID NO: 1263462 - RNA, 23 nt, Homo sapiens
uuuauacucaggcagaucucagc

SEQ ID NO: 1263463 - RNA, 19 nt, Homo sapiens
uuuauacugauuaugucuu

SEQ ID NO: 1263464 - RNA, 16 nt, Homo sapiens
uuuauagaaagcuuca

SEQ ID NO: 1263465 - RNA, 19 nt, Homo sapiens
uuuauagagugucucaggg

SEQ ID NO: 1263466 - RNA, 19 nt, Homo sapiens
uuuauaggacgaaugccaa

SEQ ID NO: 1263467 - RNA, 17 nt, Homo sapiens
uuuauaucaugcaaaau

SEQ ID NO: 1263468 - RNA, 19 nt, Homo sapiens
uuuauauguugcuauaaua

SEQ ID NO: 1263469 - RNA, 17 nt, Homo sapiens
uuuauccaaaaugugua

SEQ ID NO: 1263470 - RNA, 21 nt, Homo sapiens
uuuaucucacacacauuauga

SEQ ID NO: 1263471 - RNA, 18 nt, Homo sapiens
uuuaucuguuuuguacuu

SEQ ID NO: 1263472 - RNA, 17 nt, Homo sapiens
uuuaucuugucucuggg

SEQ ID NO: 1263473 - RNA, 16 nt, Homo sapiens
uuuaucuuuauaugaa

SEQ ID NO: 1263474 - RNA, 13 nt, Homo sapiens
uuuaugaaaugac

SEQ ID NO: 1263475 - RNA, 19 nt, Homo sapiens
uuuaugaucuuggcuguau

SEQ ID NO: 1263476 - RNA, 23 nt, Homo sapiens
uuuaugaugcuaugguuugccau

SEQ ID NO: 1263477 - RNA, 13 nt, Homo sapiens
uuuauguuguaug

SEQ ID NO: 1263478 - RNA, 14 nt, Homo sapiens
uuuauuaauaguca

SEQ ID NO: 1263479 - RNA, 13 nt, Homo sapiens
uuuauuaccucug

SEQ ID NO: 1263480 - RNA, 16 nt, Homo sapiens
uuuauuaccucugaua

SEQ ID NO: 1263481 - RNA, 21 nt, Homo sapiens
uuuauugcaggauggugucuc

SEQ ID NO: 1263482 - RNA, 20 nt, Homo sapiens
uuuauuggcugagauaugaa

SEQ ID NO: 1263483 - RNA, 16 nt, Homo sapiens
uuuauuuccacuaaaa

SEQ ID NO: 1263484 - RNA, 13 nt, Homo sapiens
uuuauuucuguca

SEQ ID NO: 1263485 - RNA, 12 nt, Homo sapiens
uuucaaaacaca

SEQ ID NO: 1263486 - RNA, 23 nt, Homo sapiens
uuucaaaauucaaaaaaaaaagc

SEQ ID NO: 1263487 - RNA, 19 nt, Homo sapiens
uuucaaagauguguugcua

SEQ ID NO: 1263488 - RNA, 22 nt, Homo sapiens
uuucaaagcuaaaauauauaau

SEQ ID NO: 1263489 - RNA, 22 nt, Homo sapiens
uuucaaaggccacauaccucuc

SEQ ID NO: 1263490 - RNA, 18 nt, Homo sapiens
uuucaaauuaagugugca

SEQ ID NO: 1263491 - RNA, 13 nt, Homo sapiens
uuucaacauauca

SEQ ID NO: 1263492 - RNA, 12 nt, Homo sapiens
uuucaagagauc

SEQ ID NO: 1263493 - RNA, 19 nt, Homo sapiens
uuucaagagugagcuauca

SEQ ID NO: 1263494 - RNA, 21 nt, Homo sapiens
uuucaaggaaaaaugcugcuu

SEQ ID NO: 1263495 - RNA, 13 nt, Homo sapiens
uuucaauuacaaa

SEQ ID NO: 1263496 - RNA, 16 nt, Homo sapiens
uuucacauucuuggcu

SEQ ID NO: 1263497 - RNA, 11 nt, Homo sapiens
uuucaccacau

SEQ ID NO: 1263498 - RNA, 16 nt, Homo sapiens
uuucacccauuuacac

SEQ ID NO: 1263499 - RNA, 20 nt, Homo sapiens
uuucacgccugaggcaauua

SEQ ID NO: 1263500 - RNA, 16 nt, Homo sapiens
uuucacugugcaaaua

SEQ ID NO: 1263501 - RNA, 18 nt, Homo sapiens
uuucaggaccuuaguucc

SEQ ID NO: 1263502 - RNA, 16 nt, Homo sapiens
uuucaguaagucucau

SEQ ID NO: 1263503 - RNA, 18 nt, Homo sapiens
uuucaguauaauuuaacu

SEQ ID NO: 1263504 - RNA, 17 nt, Homo sapiens
uuucagucaaaacuuua

SEQ ID NO: 1263505 - RNA, 12 nt, Homo sapiens
uuucauagcaaa

SEQ ID NO: 1263506 - RNA, 16 nt, Homo sapiens
uuucauaucacacugu

SEQ ID NO: 1263507 - RNA, 17 nt, Homo sapiens
uuucauauguugcucag

SEQ ID NO: 1263508 - RNA, 12 nt, Homo sapiens
uuucauauugau

SEQ ID NO: 1263509 - RNA, 14 nt, Homo sapiens
uuucaucagucaau

SEQ ID NO: 1263510 - RNA, 17 nt, Homo sapiens
uuucaugcccuugccua

SEQ ID NO: 1263511 - RNA, 22 nt, Homo sapiens
uuucauggaaguggcagugaaa

SEQ ID NO: 1263512 - RNA, 20 nt, Homo sapiens
uuucauggguuauguguaug

SEQ ID NO: 1263513 - RNA, 19 nt, Homo sapiens
uuucauggucugcugagua

SEQ ID NO: 1263514 - RNA, 19 nt, Homo sapiens
uuucauguuuugugacuau

SEQ ID NO: 1263515 - RNA, 17 nt, Homo sapiens
uuuccaaauaacaucaa

SEQ ID NO: 1263516 - RNA, 20 nt, Homo sapiens
uuuccaagaccaaccuacaa

SEQ ID NO: 1263517 - RNA, 15 nt, Homo sapiens
uuuccacuccauugu

SEQ ID NO: 1263518 - RNA, 12 nt, Homo sapiens
uuuccaucauuu

SEQ ID NO: 1263519 - RNA, 17 nt, Homo sapiens
uuuccauuuuaaggaua

SEQ ID NO: 1263520 - RNA, 19 nt, Homo sapiens
uuucccagagucaucugau

SEQ ID NO: 1263521 - RNA, 13 nt, Homo sapiens
uuucccauugcca

SEQ ID NO: 1263522 - RNA, 16 nt, Homo sapiens
uuuccccaucugccac

SEQ ID NO: 1263523 - RNA, 20 nt, Homo sapiens
uuuccccuggccucaguucc

SEQ ID NO: 1263524 - RNA, 22 nt, Homo sapiens
uuucccuuccugggucuaccac

SEQ ID NO: 1263525 - RNA, 22 nt, Homo sapiens
uuucccuuugccuucauucugc

SEQ ID NO: 1263526 - RNA, 13 nt, Homo sapiens
uuuccguuuccag

SEQ ID NO: 1263527 - RNA, 15 nt, Homo sapiens
uuuccuaaaagugua

SEQ ID NO: 1263528 - RNA, 18 nt, Homo sapiens
uuuccuacuuucuccuga

SEQ ID NO: 1263529 - RNA, 18 nt, Homo sapiens
uuuccuauuugcaguuac

SEQ ID NO: 1263530 - RNA, 15 nt, Homo sapiens
uuuccuccaggcaaa

SEQ ID NO: 1263531 - RNA, 22 nt, Homo sapiens
uuuccuccagguagaguuuucu

SEQ ID NO: 1263532 - RNA, 21 nt, Homo sapiens
uuuccuccugcuucaugggaa

SEQ ID NO: 1263533 - RNA, 18 nt, Homo sapiens
uuuccucuaguaucacuu

SEQ ID NO: 1263534 - RNA, 21 nt, Homo sapiens
uuuccucuggggcauuaucca

SEQ ID NO: 1263535 - RNA, 14 nt, Homo sapiens
uuuccucuguucac

SEQ ID NO: 1263536 - RNA, 16 nt, Homo sapiens
uuuccugauaacauua

SEQ ID NO: 1263537 - RNA, 12 nt, Homo sapiens
uuuccugccucc

SEQ ID NO: 1263538 - RNA, 21 nt, Homo sapiens
uuuccugcugccauccucacc

SEQ ID NO: 1263539 - RNA, 22 nt, Homo sapiens
uuuccuguucagcauucuuagc

SEQ ID NO: 1263540 - RNA, 16 nt, Homo sapiens
uuuccuuucugccacc

SEQ ID NO: 1263541 - RNA, 22 nt, Homo sapiens
uuucgcaccuaccaucagggac

SEQ ID NO: 1263542 - RNA, 19 nt, Homo sapiens
uuucguuaacauugaccaa

SEQ ID NO: 1263543 - RNA, 16 nt, Homo sapiens
uuucuaaauugcauga

SEQ ID NO: 1263544 - RNA, 17 nt, Homo sapiens
uuucuaagaaaagcauu

SEQ ID NO: 1263545 - RNA, 15 nt, Homo sapiens
uuucuaagacucacu

SEQ ID NO: 1263546 - RNA, 13 nt, Homo sapiens
uuucuaagagaag

SEQ ID NO: 1263547 - RNA, 14 nt, Homo sapiens
uuucuaaugugcau

SEQ ID NO: 1263548 - RNA, 20 nt, Homo sapiens
uuucuacaaugugaacuuua

SEQ ID NO: 1263549 - RNA, 12 nt, Homo sapiens
uuucuacccagc

SEQ ID NO: 1263550 - RNA, 15 nt, Homo sapiens
uuucuagaagcacau

SEQ ID NO: 1263551 - RNA, 15 nt, Homo sapiens
uuucuauaccugucu

SEQ ID NO: 1263552 - RNA, 14 nt, Homo sapiens
uuucuauacuuuac

SEQ ID NO: 1263553 - RNA, 15 nt, Homo sapiens
uuucuauuauggaaa

SEQ ID NO: 1263554 - RNA, 14 nt, Homo sapiens
uuucuauucuguca

SEQ ID NO: 1263555 - RNA, 19 nt, Homo sapiens
uuucuauuuuguuggauga

SEQ ID NO: 1263556 - RNA, 12 nt, Homo sapiens
uuucucacugag

SEQ ID NO: 1263557 - RNA, 21 nt, Homo sapiens
uuucucagcucccaaggcucu

SEQ ID NO: 1263558 - RNA, 20 nt, Homo sapiens
uuucuccucacuguauccag

SEQ ID NO: 1263559 - RNA, 18 nt, Homo sapiens
uuucucuaacuccugcca

SEQ ID NO: 1263560 - RNA, 19 nt, Homo sapiens
uuucucuaguguauuauca

SEQ ID NO: 1263561 - RNA, 18 nt, Homo sapiens
uuucucucacacuuuugc

SEQ ID NO: 1263562 - RNA, 15 nt, Homo sapiens
uuucucugccaguga

SEQ ID NO: 1263563 - RNA, 16 nt, Homo sapiens
uuucucugccagugac

SEQ ID NO: 1263564 - RNA, 16 nt, Homo sapiens
uuucucuguaguuccu

SEQ ID NO: 1263565 - RNA, 17 nt, Homo sapiens
uuucugacucugagcua

SEQ ID NO: 1263566 - RNA, 18 nt, Homo sapiens
uuucugagagagugccau

SEQ ID NO: 1263567 - RNA, 12 nt, Homo sapiens
uuucugagcuuu

SEQ ID NO: 1263568 - RNA, 12 nt, Homo sapiens
uuucugauugca

SEQ ID NO: 1263569 - RNA, 17 nt, Homo sapiens
uuucuggccugccuucg

SEQ ID NO: 1263570 - RNA, 12 nt, Homo sapiens
uuucuggcucuu

SEQ ID NO: 1263571 - RNA, 22 nt, Homo sapiens
uuucuggugaaaaaagccagcc

SEQ ID NO: 1263572 - RNA, 16 nt, Homo sapiens
uuucugugcagagaug

SEQ ID NO: 1263573 - RNA, 19 nt, Homo sapiens
uuucuguuauuaacaaaca

SEQ ID NO: 1263574 - RNA, 19 nt, Homo sapiens
uuucuguucuguuggauga

SEQ ID NO: 1263575 - RNA, 17 nt, Homo sapiens
uuucuguugccacaacc

SEQ ID NO: 1263576 - RNA, 13 nt, Homo sapiens
uuucuuccaugau

SEQ ID NO: 1263577 - RNA, 12 nt, Homo sapiens
uuucuuccugca

SEQ ID NO: 1263578 - RNA, 16 nt, Homo sapiens
uuucuugaagauaaaa

SEQ ID NO: 1263579 - RNA, 19 nt, Homo sapiens
uuucuugcuuggaagccag

SEQ ID NO: 1263580 - RNA, 19 nt, Homo sapiens
uuucuuuaccugagaccag

SEQ ID NO: 1263581 - RNA, 23 nt, Homo sapiens
uuucuuucaaaaguagagcaaaa

SEQ ID NO: 1263582 - RNA, 19 nt, Homo sapiens
uuucuuucaaagaagccag

SEQ ID NO: 1263583 - RNA, 14 nt, Homo sapiens
uuucuuuucacaua

SEQ ID NO: 1263584 - RNA, 17 nt, Homo sapiens
uuucuuuuccuucauuc

SEQ ID NO: 1263585 - RNA, 16 nt, Homo sapiens
uuugaaaacauaaucu

SEQ ID NO: 1263586 - RNA, 23 nt, Homo sapiens
uuugaaaaugggcucaaccagaa

SEQ ID NO: 1263587 - RNA, 13 nt, Homo sapiens
uuugaaacaguug

SEQ ID NO: 1263588 - RNA, 14 nt, Homo sapiens
uuugaaacauacag

SEQ ID NO: 1263589 - RNA, 15 nt, Homo sapiens
uuugaaccugugcaa

SEQ ID NO: 1263590 - RNA, 14 nt, Homo sapiens
uuugaacucaggga

SEQ ID NO: 1263591 - RNA, 18 nt, Homo sapiens
uuugaagaacaugugaga

SEQ ID NO: 1263592 - RNA, 14 nt, Homo sapiens
uuugaagaccaguc

SEQ ID NO: 1263593 - RNA, 16 nt, Homo sapiens
uuugaagagugugagg

SEQ ID NO: 1263594 - RNA, 21 nt, Homo sapiens
uuugaagcacaacucccuuaa

SEQ ID NO: 1263595 - RNA, 17 nt, Homo sapiens
uuugaagcagucuugcu

SEQ ID NO: 1263596 - RNA, 18 nt, Homo sapiens
uuugaagcaucacauaaa

SEQ ID NO: 1263597 - RNA, 21 nt, Homo sapiens
uuugaagcgagcagucagcau

SEQ ID NO: 1263598 - RNA, 22 nt, Homo sapiens
uuugaagcuacuguguguguga

SEQ ID NO: 1263599 - RNA, 12 nt, Homo sapiens
uuugaaguagga

SEQ ID NO: 1263600 - RNA, 14 nt, Homo sapiens
uuugaauaucauua

SEQ ID NO: 1263601 - RNA, 21 nt, Homo sapiens
uuugaauguuaagcagaugga

SEQ ID NO: 1263602 - RNA, 15 nt, Homo sapiens
uuugacucuggcaaa

SEQ ID NO: 1263603 - RNA, 17 nt, Homo sapiens
uuugagacaaagucuca

SEQ ID NO: 1263604 - RNA, 17 nt, Homo sapiens
uuugagagaaauaugaa

SEQ ID NO: 1263605 - RNA, 15 nt, Homo sapiens
uuugagcgcgcugag

SEQ ID NO: 1263606 - RNA, 22 nt, Homo sapiens
uuugaggacaagauaccaaggc

SEQ ID NO: 1263607 - RNA, 20 nt, Homo sapiens
uuugauaccauggcacugac

SEQ ID NO: 1263608 - RNA, 21 nt, Homo sapiens
uuugauaccauggcacugaca

SEQ ID NO: 1263609 - RNA, 22 nt, Homo sapiens
uuugauaccauggcacugacaa

SEQ ID NO: 1263610 - RNA, 13 nt, Homo sapiens
uuugauagcacuu

SEQ ID NO: 1263611 - RNA, 13 nt, Homo sapiens
uuugauauuugca

SEQ ID NO: 1263612 - RNA, 17 nt, Homo sapiens
uuugauccaggugccaa

SEQ ID NO: 1263613 - RNA, 14 nt, Homo sapiens
uuugaucccagaaa

SEQ ID NO: 1263614 - RNA, 17 nt, Homo sapiens
uuugaugguaagacugu

SEQ ID NO: 1263615 - RNA, 21 nt, Homo sapiens
uuugcaauggcuauauggcaa

SEQ ID NO: 1263616 - RNA, 14 nt, Homo sapiens
uuugcaaugucaca

SEQ ID NO: 1263617 - RNA, 14 nt, Homo sapiens
uuugcacacugcac

SEQ ID NO: 1263618 - RNA, 21 nt, Homo sapiens
uuugcacuuaauggcuguuga

SEQ ID NO: 1263619 - RNA, 12 nt, Homo sapiens
uuugcacuuugu

SEQ ID NO: 1263620 - RNA, 19 nt, Homo sapiens
uuugcagcagugagucucu

SEQ ID NO: 1263621 - RNA, 16 nt, Homo sapiens
uuugcauagcucuccu

SEQ ID NO: 1263622 - RNA, 17 nt, Homo sapiens
uuugcauaugagccgug

SEQ ID NO: 1263623 - RNA, 17 nt, Homo sapiens
uuugcaugcaugcaaau

SEQ ID NO: 1263624 - RNA, 17 nt, Homo sapiens
uuugccaaggcaaaaaa

SEQ ID NO: 1263625 - RNA, 14 nt, Homo sapiens
uuugccaguauuau

SEQ ID NO: 1263626 - RNA, 23 nt, Homo sapiens
uuugcccccauucacuuugucag

SEQ ID NO: 1263627 - RNA, 11 nt, Homo sapiens
uuugccuuccu

SEQ ID NO: 1263628 - RNA, 23 nt, Homo sapiens
uuugccuuccuuucuccaggacc

SEQ ID NO: 1263629 - RNA, 18 nt, Homo sapiens
uuugccuuucuucugccc

SEQ ID NO: 1263630 - RNA, 23 nt, Homo sapiens
uuugcuacuaaguucacauuaga

SEQ ID NO: 1263631 - RNA, 15 nt, Homo sapiens
uuugcuagcagaaau

SEQ ID NO: 1263632 - RNA, 18 nt, Homo sapiens
uuugcuagcagaaaucua

SEQ ID NO: 1263633 - RNA, 22 nt, Homo sapiens
uuugcucauugcuguaccacau

SEQ ID NO: 1263634 - RNA, 22 nt, Homo sapiens
uuugcucggauacuugccaaaa

SEQ ID NO: 1263635 - RNA, 11 nt, Homo sapiens
uuugcugucuc

SEQ ID NO: 1263636 - RNA, 22 nt, Homo sapiens
uuuggaacauuucuuucuugcu

SEQ ID NO: 1263637 - RNA, 20 nt, Homo sapiens
uuuggaaguccagagcugga

SEQ ID NO: 1263638 - RNA, 15 nt, Homo sapiens
uuuggaauauuaaaa

SEQ ID NO: 1263639 - RNA, 19 nt, Homo sapiens
uuuggacauggcucacaaa

SEQ ID NO: 1263640 - RNA, 23 nt, Homo sapiens
uuuggagacugggguggccucaa

SEQ ID NO: 1263641 - RNA, 19 nt, Homo sapiens
uuuggaguccccucaccuc

SEQ ID NO: 1263642 - RNA, 15 nt, Homo sapiens
uuuggauuacuuaaa

SEQ ID NO: 1263643 - RNA, 15 nt, Homo sapiens
uuuggcgaaucucaa

SEQ ID NO: 1263644 - RNA, 22 nt, Homo sapiens
uuuggcugccuuuggaagucca

SEQ ID NO: 1263645 - RNA, 13 nt, Homo sapiens
uuugggaugacca

SEQ ID NO: 1263646 - RNA, 19 nt, Homo sapiens
uuuggggacuuguagggau

SEQ ID NO: 1263647 - RNA, 15 nt, Homo sapiens
uuuggggagcagaga

SEQ ID NO: 1263648 - RNA, 21 nt, Homo sapiens
uuuggggagcaggaggccaau

SEQ ID NO: 1263649 - RNA, 11 nt, Homo sapiens
uuugggguccc

SEQ ID NO: 1263650 - RNA, 20 nt, Homo sapiens
uuugggguugaaaauucaaa

SEQ ID NO: 1263651 - RNA, 12 nt, Homo sapiens
uuuggguauuaa

SEQ ID NO: 1263652 - RNA, 17 nt, Homo sapiens
uuuggguuuugggucuu

SEQ ID NO: 1263653 - RNA, 21 nt, Homo sapiens
uuugguagaaggacugaacaa

SEQ ID NO: 1263654 - RNA, 15 nt, Homo sapiens
uuuggucacauauca

SEQ ID NO: 1263655 - RNA, 16 nt, Homo sapiens
uuuggucaguuacaaa

SEQ ID NO: 1263656 - RNA, 20 nt, Homo sapiens
uuuggugagagaaguacaaa

SEQ ID NO: 1263657 - RNA, 12 nt, Homo sapiens
uuuggugcuaau

SEQ ID NO: 1263658 - RNA, 18 nt, Homo sapiens
uuugguguuacacagccc

SEQ ID NO: 1263659 - RNA, 16 nt, Homo sapiens
uuugguuaaacccaug

SEQ ID NO: 1263660 - RNA, 13 nt, Homo sapiens
uuugguuugaccc

SEQ ID NO: 1263661 - RNA, 11 nt, Homo sapiens
uuugguuuugc

SEQ ID NO: 1263662 - RNA, 14 nt, Homo sapiens
uuugguuuuggaca

SEQ ID NO: 1263663 - RNA, 19 nt, Homo sapiens
uuuguaaaaauguccccac

SEQ ID NO: 1263664 - RNA, 15 nt, Homo sapiens
uuuguaaacuucuga

SEQ ID NO: 1263665 - RNA, 23 nt, Homo sapiens
uuuguaaacuucugaagacugag

SEQ ID NO: 1263666 - RNA, 17 nt, Homo sapiens
uuuguaaaucugccaca

SEQ ID NO: 1263667 - RNA, 13 nt, Homo sapiens
uuuguaacauaau

SEQ ID NO: 1263668 - RNA, 13 nt, Homo sapiens
uuuguaacauuca

SEQ ID NO: 1263669 - RNA, 14 nt, Homo sapiens
uuuguaagugcugc

SEQ ID NO: 1263670 - RNA, 15 nt, Homo sapiens
uuuguacacugcugu

SEQ ID NO: 1263671 - RNA, 16 nt, Homo sapiens
uuuguacacugcugua

SEQ ID NO: 1263672 - RNA, 14 nt, Homo sapiens
uuuguacugauaua

SEQ ID NO: 1263673 - RNA, 21 nt, Homo sapiens
uuuguagagccagggucucac

SEQ ID NO: 1263674 - RNA, 13 nt, Homo sapiens
uuuguagcacuga

SEQ ID NO: 1263675 - RNA, 20 nt, Homo sapiens
uuuguauacauccuggguaa

SEQ ID NO: 1263676 - RNA, 22 nt, Homo sapiens
uuuguauagaguucaucccagc

SEQ ID NO: 1263677 - RNA, 19 nt, Homo sapiens
uuugucacuaaacucucau

SEQ ID NO: 1263678 - RNA, 23 nt, Homo sapiens
uuugucagaggcacaaaaggguu

SEQ ID NO: 1263679 - RNA, 13 nt, Homo sapiens
uuugucauaccuu

SEQ ID NO: 1263680 - RNA, 13 nt, Homo sapiens
uuugucucagaag

SEQ ID NO: 1263681 - RNA, 14 nt, Homo sapiens
uuugucuucaugaa

SEQ ID NO: 1263682 - RNA, 13 nt, Homo sapiens
uuugugagccagc

SEQ ID NO: 1263683 - RNA, 11 nt, Homo sapiens
uuugugccaua

SEQ ID NO: 1263684 - RNA, 17 nt, Homo sapiens
uuugugugcgucacugu

SEQ ID NO: 1263685 - RNA, 13 nt, Homo sapiens
uuuguuacuguuc

SEQ ID NO: 1263686 - RNA, 14 nt, Homo sapiens
uuuguuagcaaaga

SEQ ID NO: 1263687 - RNA, 17 nt, Homo sapiens
uuuguuaugacagugaa

SEQ ID NO: 1263688 - RNA, 15 nt, Homo sapiens
uuuguucaacaucua

SEQ ID NO: 1263689 - RNA, 15 nt, Homo sapiens
uuuguucuuacacau

SEQ ID NO: 1263690 - RNA, 14 nt, Homo sapiens
uuuguuugggauca

SEQ ID NO: 1263691 - RNA, 22 nt, Homo sapiens
uuuguuuugauguuuguggccu

SEQ ID NO: 1263692 - RNA, 18 nt, Homo sapiens
uuuguuuuuuaagggagg

SEQ ID NO: 1263693 - RNA, 17 nt, Homo sapiens
uuuuaaaaacucuucag

SEQ ID NO: 1263694 - RNA, 15 nt, Homo sapiens
uuuuaaaaguuucaa

SEQ ID NO: 1263695 - RNA, 21 nt, Homo sapiens
uuuuaaagcauauuggugcua

SEQ ID NO: 1263696 - RNA, 23 nt, Homo sapiens
uuuuaaauaaaaauaaguguaca

SEQ ID NO: 1263697 - RNA, 15 nt, Homo sapiens
uuuuaacacauaacu

SEQ ID NO: 1263698 - RNA, 14 nt, Homo sapiens
uuuuaacaugucaa

SEQ ID NO: 1263699 - RNA, 21 nt, Homo sapiens
uuuuaaccaguucugucuuca

SEQ ID NO: 1263700 - RNA, 13 nt, Homo sapiens
uuuuaagcuauca

SEQ ID NO: 1263701 - RNA, 16 nt, Homo sapiens
uuuuaagcuaucagca

SEQ ID NO: 1263702 - RNA, 15 nt, Homo sapiens
uuuuaagugccuuua

SEQ ID NO: 1263703 - RNA, 13 nt, Homo sapiens
uuuuaauguacaa

SEQ ID NO: 1263704 - RNA, 18 nt, Homo sapiens
uuuuaauuaugggaauaa

SEQ ID NO: 1263705 - RNA, 15 nt, Homo sapiens
uuuuaauuugaugaa

SEQ ID NO: 1263706 - RNA, 14 nt, Homo sapiens
aaaugcaccacuuu

SEQ ID NO: 1263707 - RNA, 16 nt, Homo sapiens
aaaugcagaaccacaa

SEQ ID NO: 1263708 - RNA, 12 nt, Homo sapiens
aaaugcagucau

SEQ ID NO: 1263709 - RNA, 13 nt, Homo sapiens
aaaugccaaugag

SEQ ID NO: 1263710 - RNA, 20 nt, Homo sapiens
aaaugccacguggucacugu

SEQ ID NO: 1263711 - RNA, 21 nt, Homo sapiens
aaaugccacguggucacugug

SEQ ID NO: 1263712 - RNA, 18 nt, Homo sapiens
aaaugcuaugacuguauc

SEQ ID NO: 1263713 - RNA, 19 nt, Homo sapiens
aaaugcuccuccuccaugc

SEQ ID NO: 1263714 - RNA, 20 nt, Homo sapiens
aaaugcugcuucuccuccca

SEQ ID NO: 1263715 - RNA, 20 nt, Homo sapiens
aaaugcugucccuauacacu

SEQ ID NO: 1263716 - RNA, 15 nt, Homo sapiens
aaauggccaaauaua

SEQ ID NO: 1263717 - RNA, 17 nt, Homo sapiens
aaaugggagacagccuc

SEQ ID NO: 1263718 - RNA, 19 nt, Homo sapiens
aaauggugaauggauuucc

SEQ ID NO: 1263719 - RNA, 14 nt, Homo sapiens
aaauggugcugcag

SEQ ID NO: 1263720 - RNA, 22 nt, Homo sapiens
aaauggugcugcagauuugaua

SEQ ID NO: 1263721 - RNA, 18 nt, Homo sapiens
aaauggugcuuaaguucc

SEQ ID NO: 1263722 - RNA, 21 nt, Homo sapiens
aaaugguucagaauuaaacuu

SEQ ID NO: 1263723 - RNA, 19 nt, Homo sapiens
aaaugguuuuguuuugcac

SEQ ID NO: 1263724 - RNA, 18 nt, Homo sapiens
aaauguaacugugccagu

SEQ ID NO: 1263725 - RNA, 22 nt, Homo sapiens
aaauguacaacugcaccuguca

SEQ ID NO: 1263726 - RNA, 13 nt, Homo sapiens
aaauguacauguu

SEQ ID NO: 1263727 - RNA, 23 nt, Homo sapiens
aaauguaccuucuuucacucugu

SEQ ID NO: 1263728 - RNA, 18 nt, Homo sapiens
aaauguagcgacugucaa

SEQ ID NO: 1263729 - RNA, 18 nt, Homo sapiens
aaauguauaaauauacag

SEQ ID NO: 1263730 - RNA, 13 nt, Homo sapiens
aaauguauauaca

SEQ ID NO: 1263731 - RNA, 19 nt, Homo sapiens
aaauguauauacacauaua

SEQ ID NO: 1263732 - RNA, 16 nt, Homo sapiens
aaauguauccagucug

SEQ ID NO: 1263733 - RNA, 12 nt, Homo sapiens
aaauguaugugc

SEQ ID NO: 1263734 - RNA, 16 nt, Homo sapiens
aaauguauuaaugcua

SEQ ID NO: 1263735 - RNA, 17 nt, Homo sapiens
aaaugucuaagguagua

SEQ ID NO: 1263736 - RNA, 16 nt, Homo sapiens
aaaugugaagugaaug

SEQ ID NO: 1263737 - RNA, 19 nt, Homo sapiens
aaaugugguuacacacuuu

SEQ ID NO: 1263738 - RNA, 22 nt, Homo sapiens
aaaugugucauuggaagccauc

SEQ ID NO: 1263739 - RNA, 19 nt, Homo sapiens
aaauguguuccauugccau

SEQ ID NO: 1263740 - RNA, 15 nt, Homo sapiens
aaauguuaacuacau

SEQ ID NO: 1263741 - RNA, 17 nt, Homo sapiens
aaauguuacuucucuca

SEQ ID NO: 1263742 - RNA, 22 nt, Homo sapiens
aaauguucaagucaugccugag

SEQ ID NO: 1263743 - RNA, 19 nt, Homo sapiens
aaauguucagaagguugcu

SEQ ID NO: 1263744 - RNA, 21 nt, Homo sapiens
aaauguucagcuucagacuuu

SEQ ID NO: 1263745 - RNA, 14 nt, Homo sapiens
aaauguuuuacuca

SEQ ID NO: 1263746 - RNA, 18 nt, Homo sapiens
aaauuaaaccaacaacaa

SEQ ID NO: 1263747 - RNA, 18 nt, Homo sapiens
aaauuaagacuugugcau

SEQ ID NO: 1263748 - RNA, 14 nt, Homo sapiens
aaauuaagacuuua

SEQ ID NO: 1263749 - RNA, 20 nt, Homo sapiens
aaauuacacaguuaaugcca

SEQ ID NO: 1263750 - RNA, 19 nt, Homo sapiens
aaauuacagcuucacccug

SEQ ID NO: 1263751 - RNA, 12 nt, Homo sapiens
aaauuacuaauu

SEQ ID NO: 1263752 - RNA, 13 nt, Homo sapiens
aaauuacugugua

SEQ ID NO: 1263753 - RNA, 17 nt, Homo sapiens
aaauuagcaugcugcuu

SEQ ID NO: 1263754 - RNA, 15 nt, Homo sapiens
aaauuaggacuguau

SEQ ID NO: 1263755 - RNA, 14 nt, Homo sapiens
aaauuauaguuuca

SEQ ID NO: 1263756 - RNA, 14 nt, Homo sapiens
aaauuauaucucag

SEQ ID NO: 1263757 - RNA, 18 nt, Homo sapiens
aaauuauggaauaucauc

SEQ ID NO: 1263758 - RNA, 18 nt, Homo sapiens
aaauuauguauguuuaca

SEQ ID NO: 1263759 - RNA, 19 nt, Homo sapiens
aaauuauugcuguauguaa

SEQ ID NO: 1263760 - RNA, 15 nt, Homo sapiens
aaauucaacuuugua

SEQ ID NO: 1263761 - RNA, 13 nt, Homo sapiens
aaauucaaggccu

SEQ ID NO: 1263762 - RNA, 15 nt, Homo sapiens
aaauucacuaaugau

SEQ ID NO: 1263763 - RNA, 17 nt, Homo sapiens
aaauucacuaaugauug

SEQ ID NO: 1263764 - RNA, 13 nt, Homo sapiens
aaauucauuauuc

SEQ ID NO: 1263765 - RNA, 15 nt, Homo sapiens
aaauucauugacuua

SEQ ID NO: 1263766 - RNA, 23 nt, Homo sapiens
aaauucccucauuuaaacccaau

SEQ ID NO: 1263767 - RNA, 16 nt, Homo sapiens
aaauuccuacaacuua

SEQ ID NO: 1263768 - RNA, 17 nt, Homo sapiens
aaauuccucaacagugu

SEQ ID NO: 1263769 - RNA, 18 nt, Homo sapiens
aaauuccucuuacuguaa

SEQ ID NO: 1263770 - RNA, 15 nt, Homo sapiens
aaauuccuugcccca

SEQ ID NO: 1263771 - RNA, 21 nt, Homo sapiens
aaauuccuugccccacaguug

SEQ ID NO: 1263772 - RNA, 19 nt, Homo sapiens
aaauucuagagccagcugu

SEQ ID NO: 1263773 - RNA, 23 nt, Homo sapiens
aaauucuuaaccuggaacuggag

SEQ ID NO: 1263774 - RNA, 23 nt, Homo sapiens
aaauucuuaacuuuuaacauaau

SEQ ID NO: 1263775 - RNA, 17 nt, Homo sapiens
aaauucuucaugaacau

SEQ ID NO: 1263776 - RNA, 12 nt, Homo sapiens
aaauucuuucag

SEQ ID NO: 1263777 - RNA, 20 nt, Homo sapiens
aaauugaacuaaauccaaac

SEQ ID NO: 1263778 - RNA, 23 nt, Homo sapiens
aaauugccugcaaaaaugaaauc

SEQ ID NO: 1263779 - RNA, 12 nt, Homo sapiens
aaauugcugcuu

SEQ ID NO: 1263780 - RNA, 18 nt, Homo sapiens
aaauugggaaaacuccau

SEQ ID NO: 1263781 - RNA, 19 nt, Homo sapiens
aaauugggacaacagugcu

SEQ ID NO: 1263782 - RNA, 17 nt, Homo sapiens
aaauuggugaacagugu

SEQ ID NO: 1263783 - RNA, 20 nt, Homo sapiens
aaauuguaagugaaguaaaa

SEQ ID NO: 1263784 - RNA, 16 nt, Homo sapiens
aaauuguugggaggac

SEQ ID NO: 1263785 - RNA, 15 nt, Homo sapiens
aaauuuaaaauuacg

SEQ ID NO: 1263786 - RNA, 13 nt, Homo sapiens
aaauuuaagcauu

SEQ ID NO: 1263787 - RNA, 14 nt, Homo sapiens
aaauuuaauaccag

SEQ ID NO: 1263788 - RNA, 15 nt, Homo sapiens
aaauuuaaugcugcc

SEQ ID NO: 1263789 - RNA, 19 nt, Homo sapiens
aaauuucuagucaaugugu

SEQ ID NO: 1263790 - RNA, 20 nt, Homo sapiens
aaauuuggcucacuugccuu

SEQ ID NO: 1263791 - RNA, 21 nt, Homo sapiens
aaauuugugcuggguuauuca

SEQ ID NO: 1263792 - RNA, 14 nt, Homo sapiens
aaauuuuaaccuau

SEQ ID NO: 1263793 - RNA, 13 nt, Homo sapiens
aaauuuucaccug

SEQ ID NO: 1263794 - RNA, 23 nt, Homo sapiens
aaauuuugucuuuaacucauaaa

SEQ ID NO: 1263795 - RNA, 23 nt, Homo sapiens
aaauuuuuuuuuuuuacuugaaa

SEQ ID NO: 1263796 - RNA, 15 nt, Homo sapiens
aacaaaaaaaccaca

SEQ ID NO: 1263797 - RNA, 20 nt, Homo sapiens
aacaaaaagaaaucuugucu

SEQ ID NO: 1263798 - RNA, 19 nt, Homo sapiens
aacaaaagcgacccauuca

SEQ ID NO: 1263799 - RNA, 13 nt, Homo sapiens
aacaaaaggacuu

SEQ ID NO: 1263800 - RNA, 13 nt, Homo sapiens
aacaaacagggcu

SEQ ID NO: 1263801 - RNA, 20 nt, Homo sapiens
aacaaacauggauacuuccu

SEQ ID NO: 1263802 - RNA, 20 nt, Homo sapiens
aacaaacauuguguugacau

SEQ ID NO: 1263803 - RNA, 12 nt, Homo sapiens
aacaaaccacaa

SEQ ID NO: 1263804 - RNA, 15 nt, Homo sapiens
aacaaacuacaugua

SEQ ID NO: 1263805 - RNA, 13 nt, Homo sapiens
aacaaauaugcaa

SEQ ID NO: 1263806 - RNA, 15 nt, Homo sapiens
aacaaauuauguuac

SEQ ID NO: 1263807 - RNA, 15 nt, Homo sapiens
aacaaauugaugcaa

SEQ ID NO: 1263808 - RNA, 14 nt, Homo sapiens
aacaacaaauaauu

SEQ ID NO: 1263809 - RNA, 20 nt, Homo sapiens
aacaacauccauguccuaug

SEQ ID NO: 1263810 - RNA, 15 nt, Homo sapiens
aacaaccaagcgcau

SEQ ID NO: 1263811 - RNA, 21 nt, Homo sapiens
aacaaccguuggaaacauaac

SEQ ID NO: 1263812 - RNA, 19 nt, Homo sapiens
aacaaccuggucacaggac

SEQ ID NO: 1263813 - RNA, 21 nt, Homo sapiens
aacaacguguauagugccuaa

SEQ ID NO: 1263814 - RNA, 20 nt, Homo sapiens
aacaacguugacaaguuuug

SEQ ID NO: 1263815 - RNA, 21 nt, Homo sapiens
aacaacuauuuuucacauaau

SEQ ID NO: 1263816 - RNA, 18 nt, Homo sapiens
aacaacucuccagugccu

SEQ ID NO: 1263817 - RNA, 17 nt, Homo sapiens
aacaacuguggucaauc

SEQ ID NO: 1263818 - RNA, 16 nt, Homo sapiens
aacaacuuacacuuau

SEQ ID NO: 1263819 - RNA, 15 nt, Homo sapiens
aacaacuucagucca

SEQ ID NO: 1263820 - RNA, 19 nt, Homo sapiens
aacaacuuucucuuguaaa

SEQ ID NO: 1263821 - RNA, 12 nt, Homo sapiens
aacaacuuugaa

SEQ ID NO: 1263822 - RNA, 22 nt, Homo sapiens
aacaagccaacgacaaagccaa

SEQ ID NO: 1263823 - RNA, 21 nt, Homo sapiens
aacaauacaugcugcuaauuc

SEQ ID NO: 1263824 - RNA, 13 nt, Homo sapiens
aacaauagcacaa

SEQ ID NO: 1263825 - RNA, 21 nt, Homo sapiens
aacaaugacuuguacucugaa

SEQ ID NO: 1263826 - RNA, 21 nt, Homo sapiens
aacaauggaagauuugcccau

SEQ ID NO: 1263827 - RNA, 22 nt, Homo sapiens
aacaauggaagauuugcccauu

SEQ ID NO: 1263828 - RNA, 22 nt, Homo sapiens
aacaauuccaaaggaaucucca

SEQ ID NO: 1263829 - RNA, 24 nt, Homo sapiens
aacaauugguaaaacucacuguga

SEQ ID NO: 1263830 - RNA, 23 nt, Homo sapiens
aacaauuuuaggaggaccagagc

SEQ ID NO: 1263831 - RNA, 21 nt, Homo sapiens
aacacaaggcuccaagaccua

SEQ ID NO: 1263832 - RNA, 19 nt, Homo sapiens
aagacugguuuucugccaa

SEQ ID NO: 1263833 - RNA, 16 nt, Homo sapiens
aagacuuccacucgau

SEQ ID NO: 1263834 - RNA, 16 nt, Homo sapiens
aagacuuuguccccac

SEQ ID NO: 1263835 - RNA, 23 nt, Homo sapiens
aagacuuuuuuuuaacacuuugg

SEQ ID NO: 1263836 - RNA, 16 nt, Homo sapiens
aagagaaccgagcaaa

SEQ ID NO: 1263837 - RNA, 18 nt, Homo sapiens
aagagaaccgagcaaaga

SEQ ID NO: 1263838 - RNA, 18 nt, Homo sapiens
aagagaaggaagagaaaa

SEQ ID NO: 1263839 - RNA, 14 nt, Homo sapiens
aagagaaugccauu

SEQ ID NO: 1263840 - RNA, 23 nt, Homo sapiens
aagagaccuaccucagguugcug

SEQ ID NO: 1263841 - RNA, 14 nt, Homo sapiens
aagagacugggaag

SEQ ID NO: 1263842 - RNA, 15 nt, Homo sapiens
aagagacuucugcuu

SEQ ID NO: 1263843 - RNA, 18 nt, Homo sapiens
aagagagaaaucugaaaa

SEQ ID NO: 1263844 - RNA, 15 nt, Homo sapiens
aagagagaagccagc

SEQ ID NO: 1263845 - RNA, 15 nt, Homo sapiens
aagagagacauggaa

SEQ ID NO: 1263846 - RNA, 16 nt, Homo sapiens
aagagagagccaugaa

SEQ ID NO: 1263847 - RNA, 14 nt, Homo sapiens
aagagagccaguaa

SEQ ID NO: 1263848 - RNA, 23 nt, Homo sapiens
aagagagucgcaucucagugcag

SEQ ID NO: 1263849 - RNA, 17 nt, Homo sapiens
aagagaucuuucuuucc

SEQ ID NO: 1263850 - RNA, 23 nt, Homo sapiens
aagagaucuuucuuuccaaaaca

SEQ ID NO: 1263851 - RNA, 17 nt, Homo sapiens
aagagaugcacuauaug

SEQ ID NO: 1263852 - RNA, 23 nt, Homo sapiens
aagagaugcacuauauguuuaca

SEQ ID NO: 1263853 - RNA, 22 nt, Homo sapiens
aagagcaggacuccaggcccaa

SEQ ID NO: 1263854 - RNA, 13 nt, Homo sapiens
aagagcuaauaaa

SEQ ID NO: 1263855 - RNA, 14 nt, Homo sapiens
aagagcuggaugca

SEQ ID NO: 1263856 - RNA, 18 nt, Homo sapiens
aagaggagcacuuccaaa

SEQ ID NO: 1263857 - RNA, 20 nt, Homo sapiens
aagaggaucuccuguccauc

SEQ ID NO: 1263858 - RNA, 19 nt, Homo sapiens
aagaggcaccacuaaaaga

SEQ ID NO: 1263859 - RNA, 23 nt, Homo sapiens
aagaggcccugucuguaccuaac

SEQ ID NO: 1263860 - RNA, 21 nt, Homo sapiens
aagaggcugccccucucacca

SEQ ID NO: 1263861 - RNA, 18 nt, Homo sapiens
aagagggccugugggagc

SEQ ID NO: 1263862 - RNA, 15 nt, Homo sapiens
aagaguagcauuuca

SEQ ID NO: 1263863 - RNA, 12 nt, Homo sapiens
aagagucaucca

SEQ ID NO: 1263864 - RNA, 18 nt, Homo sapiens
aagagugacuaguacaaa

SEQ ID NO: 1263865 - RNA, 15 nt, Homo sapiens
aagaguggacugaau

SEQ ID NO: 1263866 - RNA, 11 nt, Homo sapiens
aagaguggucu

SEQ ID NO: 1263867 - RNA, 20 nt, Homo sapiens
aagaguugagauuuugcaau

SEQ ID NO: 1263868 - RNA, 21 nt, Homo sapiens
aagaguugagauuuugcaauc

SEQ ID NO: 1263869 - RNA, 14 nt, Homo sapiens
aagaguuuucuucc

SEQ ID NO: 1263870 - RNA, 15 nt, Homo sapiens
aagauaauucacucu

SEQ ID NO: 1263871 - RNA, 17 nt, Homo sapiens
aagauaucagagcucuu

SEQ ID NO: 1263872 - RNA, 12 nt, Homo sapiens
aagaucaaagac

SEQ ID NO: 1263873 - RNA, 22 nt, Homo sapiens
aagaucaaggaguacaaugccc

SEQ ID NO: 1263874 - RNA, 17 nt, Homo sapiens
aagaucacaaagacaga

SEQ ID NO: 1263875 - RNA, 20 nt, Homo sapiens
aagaucagcgacugccacau

SEQ ID NO: 1263876 - RNA, 23 nt, Homo sapiens
aagaucagcgacugccacaucau

SEQ ID NO: 1263877 - RNA, 21 nt, Homo sapiens
aagauccaagaaggccuucau

SEQ ID NO: 1263878 - RNA, 20 nt, Homo sapiens
aagaucgcaccauugcacuc

SEQ ID NO: 1263879 - RNA, 18 nt, Homo sapiens
aagaucucgguuugccaa

SEQ ID NO: 1263880 - RNA, 21 nt, Homo sapiens
aagaucuguaaguaacuucac

SEQ ID NO: 1263881 - RNA, 24 nt, Homo sapiens
aagaucuuucaggacucuaccuca

SEQ ID NO: 1263882 - RNA, 21 nt, Homo sapiens
aagaugacgaguaacuccccu

SEQ ID NO: 1263883 - RNA, 20 nt, Homo sapiens
aagaugauucuggcugaaaa

SEQ ID NO: 1263884 - RNA, 11 nt, Homo sapiens
aagaugcagug

SEQ ID NO: 1263885 - RNA, 12 nt, Homo sapiens
aagaugcagugg

SEQ ID NO: 1263886 - RNA, 21 nt, Homo sapiens
aagauggcauaaccugucuca

SEQ ID NO: 1263887 - RNA, 16 nt, Homo sapiens
aagaugggaacacugg

SEQ ID NO: 1263888 - RNA, 18 nt, Homo sapiens
aagaugguaaaccagauc

SEQ ID NO: 1263889 - RNA, 19 nt, Homo sapiens
aagaugucuauguagcuga

SEQ ID NO: 1263890 - RNA, 22 nt, Homo sapiens
aagauguguugcuauccugaaa

SEQ ID NO: 1263891 - RNA, 16 nt, Homo sapiens
aagauuaaaaagcaca

SEQ ID NO: 1263892 - RNA, 15 nt, Homo sapiens
aagauuaacacuaau

SEQ ID NO: 1263893 - RNA, 16 nt, Homo sapiens
aagauuagaagcugaa

SEQ ID NO: 1263894 - RNA, 21 nt, Homo sapiens
aagauuaugauauuauuugau

SEQ ID NO: 1263895 - RNA, 20 nt, Homo sapiens
aagauucauauuuacuucuu

SEQ ID NO: 1263896 - RNA, 20 nt, Homo sapiens
aagauucuauaguucuagac

SEQ ID NO: 1263897 - RNA, 17 nt, Homo sapiens
aagauugcagcauuuau

SEQ ID NO: 1263898 - RNA, 20 nt, Homo sapiens
aagauuuaccauaagggacu

SEQ ID NO: 1263899 - RNA, 23 nt, Homo sapiens
aagauuuagaaaaaaguuuacaa

SEQ ID NO: 1263900 - RNA, 19 nt, Homo sapiens
aagauuugugaacuggaag

SEQ ID NO: 1263901 - RNA, 15 nt, Homo sapiens
aagauuuucagaaaa

SEQ ID NO: 1263902 - RNA, 17 nt, Homo sapiens
aagauuuuccucuugug

SEQ ID NO: 1263903 - RNA, 10 nt, Homo sapiens
aagcaaaaag

SEQ ID NO: 1263904 - RNA, 16 nt, Homo sapiens
aagcaaaaugcuuaca

SEQ ID NO: 1263905 - RNA, 13 nt, Homo sapiens
aagcaaacacuua

SEQ ID NO: 1263906 - RNA, 17 nt, Homo sapiens
aagcaaacaucaaauaa

SEQ ID NO: 1263907 - RNA, 13 nt, Homo sapiens
aagcaacccaguc

SEQ ID NO: 1263908 - RNA, 13 nt, Homo sapiens
aagcaagcucucu

SEQ ID NO: 1263909 - RNA, 15 nt, Homo sapiens
aagcaaggcuuuaaa

SEQ ID NO: 1263910 - RNA, 18 nt, Homo sapiens
aagcaaggcuuuaaauga

SEQ ID NO: 1263911 - RNA, 15 nt, Homo sapiens
aagcaaguggcuuuc

SEQ ID NO: 1263912 - RNA, 14 nt, Homo sapiens
aagcaaguuuucuu

SEQ ID NO: 1263913 - RNA, 17 nt, Homo sapiens
aagcaaguuuucuucca

SEQ ID NO: 1263914 - RNA, 20 nt, Homo sapiens
aagcaauucuccugccuuag

SEQ ID NO: 1263915 - RNA, 19 nt, Homo sapiens
aagcacagauguucuucaa

SEQ ID NO: 1263916 - RNA, 13 nt, Homo sapiens
aagcacaguuuga

SEQ ID NO: 1263917 - RNA, 14 nt, Homo sapiens
aagcacaugaucau

SEQ ID NO: 1263918 - RNA, 12 nt, Homo sapiens
aagcaccaggac

SEQ ID NO: 1263919 - RNA, 15 nt, Homo sapiens
aagcaccugcucaac

SEQ ID NO: 1263920 - RNA, 21 nt, Homo sapiens
aagcacugauaucuggccuaa

SEQ ID NO: 1263921 - RNA, 21 nt, Homo sapiens
aagcagaagcauuaacuucuc

SEQ ID NO: 1263922 - RNA, 13 nt, Homo sapiens
aagcagaauuuaa

SEQ ID NO: 1263923 - RNA, 17 nt, Homo sapiens
aagcagauuuaacaauu

SEQ ID NO: 1263924 - RNA, 17 nt, Homo sapiens
aagcagccaucacauga

SEQ ID NO: 1263925 - RNA, 22 nt, Homo sapiens
aagcagcgaccgcccccuccuc

SEQ ID NO: 1263926 - RNA, 20 nt, Homo sapiens
aagcagcuggugcuccaagc

SEQ ID NO: 1263927 - RNA, 16 nt, Homo sapiens
aagcaggguacccuuu

SEQ ID NO: 1263928 - RNA, 13 nt, Homo sapiens
aagcaggugcuac

SEQ ID NO: 1263929 - RNA, 22 nt, Homo sapiens
aagcaggugcuacaacauguga

SEQ ID NO: 1263930 - RNA, 20 nt, Homo sapiens
aagcaguaagcuaucuucaa

SEQ ID NO: 1263931 - RNA, 17 nt, Homo sapiens
aagcagucaauuuucac

SEQ ID NO: 1263932 - RNA, 19 nt, Homo sapiens
aagcagucgaccgcacuua

SEQ ID NO: 1263933 - RNA, 14 nt, Homo sapiens
aagcagucgugccu

SEQ ID NO: 1263934 - RNA, 16 nt, Homo sapiens
aagcagucuugcucug

SEQ ID NO: 1263935 - RNA, 16 nt, Homo sapiens
aagcauacaacuggac

SEQ ID NO: 1263936 - RNA, 15 nt, Homo sapiens
aagcaucaccucagg

SEQ ID NO: 1263937 - RNA, 13 nt, Homo sapiens
aagcauccuccac

SEQ ID NO: 1263938 - RNA, 23 nt, Homo sapiens
aagcaucucagccuaccaugaga

SEQ ID NO: 1263939 - RNA, 15 nt, Homo sapiens
aagcaugaaaaagca

SEQ ID NO: 1263940 - RNA, 14 nt, Homo sapiens
aagcaugucucucu

SEQ ID NO: 1263941 - RNA, 17 nt, Homo sapiens
aagcauuaacuucucug

SEQ ID NO: 1263942 - RNA, 11 nt, Homo sapiens
aagcauuguuu

SEQ ID NO: 1263943 - RNA, 22 nt, Homo sapiens
aagcauuucuagcagugaugaa

SEQ ID NO: 1263944 - RNA, 23 nt, Homo sapiens
aagcauuuucuagauaccacuua

SEQ ID NO: 1263945 - RNA, 17 nt, Homo sapiens
aagccaaacucugccag

SEQ ID NO: 1263946 - RNA, 15 nt, Homo sapiens
aagccacucuguccc

SEQ ID NO: 1263947 - RNA, 13 nt, Homo sapiens
aagccacuugaaa

SEQ ID NO: 1263948 - RNA, 16 nt, Homo sapiens
aagccagcaggagcuc

SEQ ID NO: 1263949 - RNA, 16 nt, Homo sapiens
aagccaggaccugcug

SEQ ID NO: 1263950 - RNA, 16 nt, Homo sapiens
aagccaggauuguguu

SEQ ID NO: 1263951 - RNA, 11 nt, Homo sapiens
aagccagugaa

SEQ ID NO: 1263952 - RNA, 15 nt, Homo sapiens
aagccauguaucuca

SEQ ID NO: 1263953 - RNA, 16 nt, Homo sapiens
aagccauucacuuccc

SEQ ID NO: 1263954 - RNA, 20 nt, Homo sapiens
aagccauucuggacaccagg

SEQ ID NO: 1263955 - RNA, 15 nt, Homo sapiens
aagcccaauauuaua

SEQ ID NO: 1263956 - RNA, 17 nt, Homo sapiens
aagcccccacacagacc

SEQ ID NO: 1263957 - RNA, 23 nt, Homo sapiens
aagcccugauguguccucaggga

SEQ ID NO: 1263958 - RNA, 21 nt, Homo sapiens
aaggugggaaggaugguccag

SEQ ID NO: 1263959 - RNA, 22 nt, Homo sapiens
aaggugggccuugcuaccucaa

SEQ ID NO: 1263960 - RNA, 13 nt, Homo sapiens
aagguuaaaccca

SEQ ID NO: 1263961 - RNA, 14 nt, Homo sapiens
aagguucagcugaa

SEQ ID NO: 1263962 - RNA, 20 nt, Homo sapiens
aagguucucagguguugcca

SEQ ID NO: 1263963 - RNA, 17 nt, Homo sapiens
aagguugaacuuugcca

SEQ ID NO: 1263964 - RNA, 23 nt, Homo sapiens
aagguuuggugcaaaguauugua

SEQ ID NO: 1263965 - RNA, 23 nt, Homo sapiens
aagguuuuauaaggcugauguca

SEQ ID NO: 1263966 - RNA, 22 nt, Homo sapiens
aagguuuucucuaacuucucaa

SEQ ID NO: 1263967 - RNA, 18 nt, Homo sapiens
aagguuuucuucauucau

SEQ ID NO: 1263968 - RNA, 15 nt, Homo sapiens
aaguaaauauuucag

SEQ ID NO: 1263969 - RNA, 21 nt, Homo sapiens
aaguaacaugcauacuuuauu

SEQ ID NO: 1263970 - RNA, 15 nt, Homo sapiens
aaguaacauuugccu

SEQ ID NO: 1263971 - RNA, 18 nt, Homo sapiens
aaguaacuuaaggaccuu

SEQ ID NO: 1263972 - RNA, 15 nt, Homo sapiens
aaguaaguaccacuc

SEQ ID NO: 1263973 - RNA, 22 nt, Homo sapiens
aaguaauuccucucacuaaacu

SEQ ID NO: 1263974 - RNA, 16 nt, Homo sapiens
aaguaccaaugcuguu

SEQ ID NO: 1263975 - RNA, 19 nt, Homo sapiens
aaguacuagcuuacuuuug

SEQ ID NO: 1263976 - RNA, 18 nt, Homo sapiens
aaguacuuaaacuuccac

SEQ ID NO: 1263977 - RNA, 12 nt, Homo sapiens
aaguacuuccac

SEQ ID NO: 1263978 - RNA, 14 nt, Homo sapiens
aaguagaauccuaa

SEQ ID NO: 1263979 - RNA, 16 nt, Homo sapiens
aaguagaauccuaaau

SEQ ID NO: 1263980 - RNA, 22 nt, Homo sapiens
aaguagacauuuguaaaucuau

SEQ ID NO: 1263981 - RNA, 19 nt, Homo sapiens
aaguagaggaauccaugua

SEQ ID NO: 1263982 - RNA, 12 nt, Homo sapiens
aaguagcaauuu

SEQ ID NO: 1263983 - RNA, 14 nt, Homo sapiens
aaguagcugggacu

SEQ ID NO: 1263984 - RNA, 22 nt, Homo sapiens
aaguagucucuccccuggccac

SEQ ID NO: 1263985 - RNA, 15 nt, Homo sapiens
aaguauaacaacuuu

SEQ ID NO: 1263986 - RNA, 19 nt, Homo sapiens
aaguauaaucagcacuuug

SEQ ID NO: 1263987 - RNA, 22 nt, Homo sapiens
aaguauaaucagcacuuugcca

SEQ ID NO: 1263988 - RNA, 17 nt, Homo sapiens
aaguaugagggaaaaug

SEQ ID NO: 1263989 - RNA, 18 nt, Homo sapiens
aaguauuauuuauuugaa

SEQ ID NO: 1263990 - RNA, 13 nt, Homo sapiens
aaguauugcuaau

SEQ ID NO: 1263991 - RNA, 19 nt, Homo sapiens
aagucaccacuccauuccc

SEQ ID NO: 1263992 - RNA, 21 nt, Homo sapiens
aagucagaggauggccagugu

SEQ ID NO: 1263993 - RNA, 22 nt, Homo sapiens
aagucagcuccagcuuucugcc

SEQ ID NO: 1263994 - RNA, 21 nt, Homo sapiens
aagucaucuguuuaauuuaca

SEQ ID NO: 1263995 - RNA, 13 nt, Homo sapiens
aagucaucuugcu

SEQ ID NO: 1263996 - RNA, 13 nt, Homo sapiens
aagucauggaauu

SEQ ID NO: 1263997 - RNA, 17 nt, Homo sapiens
aagucaugugcauuucc

SEQ ID NO: 1263998 - RNA, 13 nt, Homo sapiens
aagucauuccuuc

SEQ ID NO: 1263999 - RNA, 21 nt, Homo sapiens
aaguccaauuccaaagccaga

SEQ ID NO: 1264000 - RNA, 12 nt, Homo sapiens
aaguccacuuua

SEQ ID NO: 1264001 - RNA, 18 nt, Homo sapiens
aagucccagagcaccuca

SEQ ID NO: 1264002 - RNA, 18 nt, Homo sapiens
aagucccaguauaccuca

SEQ ID NO: 1264003 - RNA, 20 nt, Homo sapiens
aagucccaguauaccucauu

SEQ ID NO: 1264004 - RNA, 20 nt, Homo sapiens
aagucccugacucucuguga

SEQ ID NO: 1264005 - RNA, 14 nt, Homo sapiens
aagucgcauuccau

SEQ ID NO: 1264006 - RNA, 17 nt, Homo sapiens
aagucuagagucucaga

SEQ ID NO: 1264007 - RNA, 17 nt, Homo sapiens
aagucuauaaugcaauc

SEQ ID NO: 1264008 - RNA, 13 nt, Homo sapiens
aagucuccaguca

SEQ ID NO: 1264009 - RNA, 13 nt, Homo sapiens
aagucucucaccc

SEQ ID NO: 1264010 - RNA, 16 nt, Homo sapiens
aagucugacucuccac

SEQ ID NO: 1264011 - RNA, 23 nt, Homo sapiens
aagucugggauguagaacuucaa

SEQ ID NO: 1264012 - RNA, 20 nt, Homo sapiens
aagucuuaaucauuugugac

SEQ ID NO: 1264013 - RNA, 16 nt, Homo sapiens
aagucuucagggaagg

SEQ ID NO: 1264014 - RNA, 17 nt, Homo sapiens
aagucuugcucugccac

SEQ ID NO: 1264015 - RNA, 21 nt, Homo sapiens
aagucuugcucugccacccag

SEQ ID NO: 1264016 - RNA, 18 nt, Homo sapiens
aagucuuugaagugacuu

SEQ ID NO: 1264017 - RNA, 14 nt, Homo sapiens
aagugaacuaugaa

SEQ ID NO: 1264018 - RNA, 22 nt, Homo sapiens
aagugaagagugacuaguacaa

SEQ ID NO: 1264019 - RNA, 15 nt, Homo sapiens
aagugacuauagaau

SEQ ID NO: 1264020 - RNA, 13 nt, Homo sapiens
aagugacuauuca

SEQ ID NO: 1264021 - RNA, 14 nt, Homo sapiens
aagugacucucaca

SEQ ID NO: 1264022 - RNA, 18 nt, Homo sapiens
aagugacucucacaagau

SEQ ID NO: 1264023 - RNA, 19 nt, Homo sapiens
aagugaggagugccagcuc

SEQ ID NO: 1264024 - RNA, 23 nt, Homo sapiens
aagugaggugugucacaaugaga

SEQ ID NO: 1264025 - RNA, 22 nt, Homo sapiens
aagugauaucccccagccucaa

SEQ ID NO: 1264026 - RNA, 19 nt, Homo sapiens
aagugaucugcccaccuca

SEQ ID NO: 1264027 - RNA, 22 nt, Homo sapiens
aagugauuuuuuuccacaagau

SEQ ID NO: 1264028 - RNA, 13 nt, Homo sapiens
aagugcacuuuaa

SEQ ID NO: 1264029 - RNA, 23 nt, Homo sapiens
aagugcauaugaaauccuugacu

SEQ ID NO: 1264030 - RNA, 17 nt, Homo sapiens
aagugcauauuuaucca

SEQ ID NO: 1264031 - RNA, 11 nt, Homo sapiens
aagugccaaac

SEQ ID NO: 1264032 - RNA, 15 nt, Homo sapiens
aagugccuaccccag

SEQ ID NO: 1264033 - RNA, 18 nt, Homo sapiens
aagugccuagacuguuac

SEQ ID NO: 1264034 - RNA, 16 nt, Homo sapiens
aagugccuuacagggu

SEQ ID NO: 1264035 - RNA, 15 nt, Homo sapiens
aagugcgaguccucc

SEQ ID NO: 1264036 - RNA, 14 nt, Homo sapiens
aagugcgugaaugu

SEQ ID NO: 1264037 - RNA, 23 nt, Homo sapiens
aagugcgugccgugugaguguga

SEQ ID NO: 1264038 - RNA, 20 nt, Homo sapiens
aagugcugggauuacagaca

SEQ ID NO: 1264039 - RNA, 20 nt, Homo sapiens
aagugcugggauuacaggca

SEQ ID NO: 1264040 - RNA, 22 nt, Homo sapiens
aagugcugggauuacaggugug

SEQ ID NO: 1264041 - RNA, 23 nt, Homo sapiens
aagugcugggauuacagguguga

SEQ ID NO: 1264042 - RNA, 23 nt, Homo sapiens
aagugggauuugcauaaagugaa

SEQ ID NO: 1264043 - RNA, 20 nt, Homo sapiens
aaguggucgcuuacuuugag

SEQ ID NO: 1264044 - RNA, 15 nt, Homo sapiens
aaguguaaauccuuu

SEQ ID NO: 1264045 - RNA, 15 nt, Homo sapiens
aagugucaacucuuu

SEQ ID NO: 1264046 - RNA, 21 nt, Homo sapiens
aaguguccccuauggggaugg

SEQ ID NO: 1264047 - RNA, 17 nt, Homo sapiens
aagugucucugccuuga

SEQ ID NO: 1264048 - RNA, 16 nt, Homo sapiens
aagugugcagccauag

SEQ ID NO: 1264049 - RNA, 16 nt, Homo sapiens
aagugugggagaccga

SEQ ID NO: 1264050 - RNA, 23 nt, Homo sapiens
aaguguggguuugguuagaggaa

SEQ ID NO: 1264051 - RNA, 13 nt, Homo sapiens
aagugugucuucc

SEQ ID NO: 1264052 - RNA, 11 nt, Homo sapiens
aaguguuccag

SEQ ID NO: 1264053 - RNA, 15 nt, Homo sapiens
aaguuaacuuccaau

SEQ ID NO: 1264054 - RNA, 20 nt, Homo sapiens
aaguuaauucaccuauguua

SEQ ID NO: 1264055 - RNA, 17 nt, Homo sapiens
aaguuagaaaacauaau

SEQ ID NO: 1264056 - RNA, 14 nt, Homo sapiens
aaguuagccuccac

SEQ ID NO: 1264057 - RNA, 18 nt, Homo sapiens
aaguuauacuguggcuau

SEQ ID NO: 1264058 - RNA, 16 nt, Homo sapiens
aaguuauuuacuuuua

SEQ ID NO: 1264059 - RNA, 16 nt, Homo sapiens
aaguuauuuuuguaca

SEQ ID NO: 1264060 - RNA, 14 nt, Homo sapiens
aaguucauaggguc

SEQ ID NO: 1264061 - RNA, 18 nt, Homo sapiens
aaguuccaaaagcacaga

SEQ ID NO: 1264062 - RNA, 12 nt, Homo sapiens
aaguuccaagag

SEQ ID NO: 1264063 - RNA, 23 nt, Homo sapiens
aaguuccaugaauucuugauuuc

SEQ ID NO: 1264064 - RNA, 22 nt, Homo sapiens
aaguucccuacuuccugugacu

SEQ ID NO: 1264065 - RNA, 22 nt, Homo sapiens
aaguucccuaugaaaaaugugu

SEQ ID NO: 1264066 - RNA, 15 nt, Homo sapiens
aaguuccucuagugc

SEQ ID NO: 1264067 - RNA, 20 nt, Homo sapiens
aaguucuuggugguggauga

SEQ ID NO: 1264068 - RNA, 21 nt, Homo sapiens
aaguugaggagguuucugcau

SEQ ID NO: 1264069 - RNA, 22 nt, Homo sapiens
aaguugcauuccuuugucuuca

SEQ ID NO: 1264070 - RNA, 19 nt, Homo sapiens
aaguugccauuuugucuca

SEQ ID NO: 1264071 - RNA, 11 nt, Homo sapiens
aaguugugauu

SEQ ID NO: 1264072 - RNA, 14 nt, Homo sapiens
aaguuuaucuuuca

SEQ ID NO: 1264073 - RNA, 13 nt, Homo sapiens
aaguuucacccaa

SEQ ID NO: 1264074 - RNA, 18 nt, Homo sapiens
aaguuucaggauacaugu

SEQ ID NO: 1264075 - RNA, 17 nt, Homo sapiens
aaguuucaucagucaau

SEQ ID NO: 1264076 - RNA, 15 nt, Homo sapiens
aaguuugaagcacaa

SEQ ID NO: 1264077 - RNA, 13 nt, Homo sapiens
aaguuuucaggac

SEQ ID NO: 1264078 - RNA, 23 nt, Homo sapiens
aaguuuugaguagauauuacuuu

SEQ ID NO: 1264079 - RNA, 17 nt, Homo sapiens
aauaaaaaguucagagu

SEQ ID NO: 1264080 - RNA, 15 nt, Homo sapiens
aauaaaaaugucuca

SEQ ID NO: 1264081 - RNA, 24 nt, Homo sapiens
aauaaaacccaacagauacuggaa

SEQ ID NO: 1264082 - RNA, 14 nt, Homo sapiens
aauaaaacugagcu

SEQ ID NO: 1264083 - RNA, 21 nt, Homo sapiens
aauuuuauguuuaguugcaca

SEQ ID NO: 1264084 - RNA, 23 nt, Homo sapiens
aauuuuauguuuaguugcacaaa

SEQ ID NO: 1264085 - RNA, 19 nt, Homo sapiens
aauuuuauuaaaugcauca

SEQ ID NO: 1264086 - RNA, 13 nt, Homo sapiens
aauuuucauucau

SEQ ID NO: 1264087 - RNA, 18 nt, Homo sapiens
aauuuucauucauucacu

SEQ ID NO: 1264088 - RNA, 24 nt, Homo sapiens
aauuuucuucaugcaaugacaucu

SEQ ID NO: 1264089 - RNA, 12 nt, Homo sapiens
aauuuugccaaa

SEQ ID NO: 1264090 - RNA, 20 nt, Homo sapiens
aauuuugguuuaugacucuu

SEQ ID NO: 1264091 - RNA, 19 nt, Homo sapiens
aauuuuuaaggauguugcc

SEQ ID NO: 1264092 - RNA, 18 nt, Homo sapiens
aauuuuucugugcucaau

SEQ ID NO: 1264093 - RNA, 21 nt, Homo sapiens
aauuuuuuaaaguuacuuugu

SEQ ID NO: 1264094 - RNA, 14 nt, Homo sapiens
acaaaaaaaccaca

SEQ ID NO: 1264095 - RNA, 22 nt, Homo sapiens
acaaaaaugaaagcaugucuca

SEQ ID NO: 1264096 - RNA, 13 nt, Homo sapiens
acaaaaauugaga

SEQ ID NO: 1264097 - RNA, 14 nt, Homo sapiens
acaaaacacugugu

SEQ ID NO: 1264098 - RNA, 16 nt, Homo sapiens
acaaaacuacaugaga

SEQ ID NO: 1264099 - RNA, 14 nt, Homo sapiens
acaaaagauguauc

SEQ ID NO: 1264100 - RNA, 15 nt, Homo sapiens
acaaaagcccaaugu

SEQ ID NO: 1264101 - RNA, 11 nt, Homo sapiens
acaaaagcuau

SEQ ID NO: 1264102 - RNA, 12 nt, Homo sapiens
acaaaagucugu

SEQ ID NO: 1264103 - RNA, 22 nt, Homo sapiens
acaaaaguuuuuuauuagcauu

SEQ ID NO: 1264104 - RNA, 16 nt, Homo sapiens
acaaaauauauuuugu

SEQ ID NO: 1264105 - RNA, 22 nt, Homo sapiens
acaaaauggucauccaaacuca

SEQ ID NO: 1264106 - RNA, 13 nt, Homo sapiens
acaaaauuaagca

SEQ ID NO: 1264107 - RNA, 20 nt, Homo sapiens
acaaaauuuaguuuuuguuc

SEQ ID NO: 1264108 - RNA, 14 nt, Homo sapiens
acaaacaaguggau

SEQ ID NO: 1264109 - RNA, 12 nt, Homo sapiens
acaaacauggau

SEQ ID NO: 1264110 - RNA, 20 nt, Homo sapiens
acaaacauggauacuuccug

SEQ ID NO: 1264111 - RNA, 18 nt, Homo sapiens
acaaaccacaacugacac

SEQ ID NO: 1264112 - RNA, 11 nt, Homo sapiens
acaaaccacac

SEQ ID NO: 1264113 - RNA, 16 nt, Homo sapiens
acaaaccgagugcaau

SEQ ID NO: 1264114 - RNA, 15 nt, Homo sapiens
acaaaccuagaauuu

SEQ ID NO: 1264115 - RNA, 16 nt, Homo sapiens
acaaaccucacugaga

SEQ ID NO: 1264116 - RNA, 18 nt, Homo sapiens
acaaaccuuaaaacagcu

SEQ ID NO: 1264117 - RNA, 20 nt, Homo sapiens
acaaaccuuaaaacagcugu

SEQ ID NO: 1264118 - RNA, 12 nt, Homo sapiens
acaaacugcaau

SEQ ID NO: 1264119 - RNA, 14 nt, Homo sapiens
acaaacuucaaaga

SEQ ID NO: 1264120 - RNA, 20 nt, Homo sapiens
acaaagauuuucuaaggaau

SEQ ID NO: 1264121 - RNA, 16 nt, Homo sapiens
acaaagcacaguuuga

SEQ ID NO: 1264122 - RNA, 19 nt, Homo sapiens
acaaagcaguuacuaauau

SEQ ID NO: 1264123 - RNA, 14 nt, Homo sapiens
acaaagcaugguau

SEQ ID NO: 1264124 - RNA, 18 nt, Homo sapiens
acaaagcccuuccauguc

SEQ ID NO: 1264125 - RNA, 12 nt, Homo sapiens
acaaagccuuau

SEQ ID NO: 1264126 - RNA, 19 nt, Homo sapiens
acaaaggacagaguaugaa

SEQ ID NO: 1264127 - RNA, 15 nt, Homo sapiens
acaaagguugcagug

SEQ ID NO: 1264128 - RNA, 14 nt, Homo sapiens
acaaaguaagccau

SEQ ID NO: 1264129 - RNA, 20 nt, Homo sapiens
acaaaguagaggaauccaug

SEQ ID NO: 1264130 - RNA, 19 nt, Homo sapiens
acaaaguccacuuuacuca

SEQ ID NO: 1264131 - RNA, 19 nt, Homo sapiens
acaaaguuauauucacagu

SEQ ID NO: 1264132 - RNA, 19 nt, Homo sapiens
acaaauaaagugcaguuua

SEQ ID NO: 1264133 - RNA, 14 nt, Homo sapiens
acaaauaaauaaga

SEQ ID NO: 1264134 - RNA, 18 nt, Homo sapiens
acaaauaaauaagaucag

SEQ ID NO: 1264135 - RNA, 17 nt, Homo sapiens
acaaauaaaugagccca

SEQ ID NO: 1264136 - RNA, 15 nt, Homo sapiens
acaaauaauagcaau

SEQ ID NO: 1264137 - RNA, 19 nt, Homo sapiens
acaaauagugcaacuauga

SEQ ID NO: 1264138 - RNA, 15 nt, Homo sapiens
acaaauaugucaguu

SEQ ID NO: 1264139 - RNA, 21 nt, Homo sapiens
acaaaucagaaauaugacaau

SEQ ID NO: 1264140 - RNA, 19 nt, Homo sapiens
acaaaugaauaaaugcaua

SEQ ID NO: 1264141 - RNA, 22 nt, Homo sapiens
acaaaugcuccuccuccaugcu

SEQ ID NO: 1264142 - RNA, 17 nt, Homo sapiens
acaaauuauguuacauc

SEQ ID NO: 1264143 - RNA, 20 nt, Homo sapiens
acaaauugaaaacacacuca

SEQ ID NO: 1264144 - RNA, 18 nt, Homo sapiens
acaaauugggccaaagaa

SEQ ID NO: 1264145 - RNA, 16 nt, Homo sapiens
acaacaauccuucuau

SEQ ID NO: 1264146 - RNA, 16 nt, Homo sapiens
acaacacuuaauagca

SEQ ID NO: 1264147 - RNA, 23 nt, Homo sapiens
acaacaggcauagcaaaugacau

SEQ ID NO: 1264148 - RNA, 14 nt, Homo sapiens
acaacauuuacuua

SEQ ID NO: 1264149 - RNA, 14 nt, Homo sapiens
acaacauuucucaa

SEQ ID NO: 1264150 - RNA, 20 nt, Homo sapiens
acaacccacaccgucuuccu

SEQ ID NO: 1264151 - RNA, 19 nt, Homo sapiens
acaacccaccccgcuuucg

SEQ ID NO: 1264152 - RNA, 11 nt, Homo sapiens
acaaccugcug

SEQ ID NO: 1264153 - RNA, 12 nt, Homo sapiens
acaacuaccuga

SEQ ID NO: 1264154 - RNA, 22 nt, Homo sapiens
acaacucccuuaaggucuccaa

SEQ ID NO: 1264155 - RNA, 14 nt, Homo sapiens
acaacucuagucag

SEQ ID NO: 1264156 - RNA, 18 nt, Homo sapiens
acaacucuagucagcaca

SEQ ID NO: 1264157 - RNA, 23 nt, Homo sapiens
acaacuggacucauuaucacagu

SEQ ID NO: 1264158 - RNA, 12 nt, Homo sapiens
acaacugugacu

SEQ ID NO: 1264159 - RNA, 16 nt, Homo sapiens
acaacuucaauaucca

SEQ ID NO: 1264160 - RNA, 20 nt, Homo sapiens
acaacuuggguucuucucag

SEQ ID NO: 1264161 - RNA, 19 nt, Homo sapiens
acaacuuguauuuccaaac

SEQ ID NO: 1264162 - RNA, 17 nt, Homo sapiens
acaagaaaaucaaauau

SEQ ID NO: 1264163 - RNA, 14 nt, Homo sapiens
acaagaaccucucc

SEQ ID NO: 1264164 - RNA, 12 nt, Homo sapiens
acaagaagccac

SEQ ID NO: 1264165 - RNA, 14 nt, Homo sapiens
acaagaauugcuaa

SEQ ID NO: 1264166 - RNA, 17 nt, Homo sapiens
acaagagaagcugaugg

SEQ ID NO: 1264167 - RNA, 20 nt, Homo sapiens
acaagauccuuaaugcagag

SEQ ID NO: 1264168 - RNA, 20 nt, Homo sapiens
acaagccacaagucuuccag

SEQ ID NO: 1264169 - RNA, 17 nt, Homo sapiens
acaagcuauucccucaa

SEQ ID NO: 1264170 - RNA, 13 nt, Homo sapiens
acaagcuuuccaa

SEQ ID NO: 1264171 - RNA, 20 nt, Homo sapiens
acaaggaaaaauacugaauu

SEQ ID NO: 1264172 - RNA, 14 nt, Homo sapiens
acaaggaaauaccc

SEQ ID NO: 1264173 - RNA, 16 nt, Homo sapiens
acaaggcccugagcuu

SEQ ID NO: 1264174 - RNA, 17 nt, Homo sapiens
acaaggcuaacauccca

SEQ ID NO: 1264175 - RNA, 17 nt, Homo sapiens
acaaggcuccacaagcg

SEQ ID NO: 1264176 - RNA, 14 nt, Homo sapiens
acaaggcucugcua

SEQ ID NO: 1264177 - RNA, 16 nt, Homo sapiens
acaaggcugaccaaga

SEQ ID NO: 1264178 - RNA, 18 nt, Homo sapiens
acaaggcuuuaucucagg

SEQ ID NO: 1264179 - RNA, 19 nt, Homo sapiens
acaaggcuuuaucucaggg

SEQ ID NO: 1264180 - RNA, 15 nt, Homo sapiens
acaagggcugaccug

SEQ ID NO: 1264181 - RNA, 19 nt, Homo sapiens
acaagguuggcaccccagc

SEQ ID NO: 1264182 - RNA, 15 nt, Homo sapiens
acaaguccuugaccu

SEQ ID NO: 1264183 - RNA, 14 nt, Homo sapiens
acaagucuuccaga

SEQ ID NO: 1264184 - RNA, 17 nt, Homo sapiens
acaagugagacaaaaag

SEQ ID NO: 1264185 - RNA, 15 nt, Homo sapiens
acaagugggugaaug

SEQ ID NO: 1264186 - RNA, 18 nt, Homo sapiens
acaagugggugaaugugg

SEQ ID NO: 1264187 - RNA, 12 nt, Homo sapiens
acaagugucagg

SEQ ID NO: 1264188 - RNA, 19 nt, Homo sapiens
acaaguuagaaaacauaau

SEQ ID NO: 1264189 - RNA, 19 nt, Homo sapiens
acaauaaacaucugagcag

SEQ ID NO: 1264190 - RNA, 14 nt, Homo sapiens
acaauaaaccuccg

SEQ ID NO: 1264191 - RNA, 23 nt, Homo sapiens
acaauaaaccuccgccaaugcac

SEQ ID NO: 1264192 - RNA, 14 nt, Homo sapiens
acaauaacacuaaa

SEQ ID NO: 1264193 - RNA, 15 nt, Homo sapiens
acaauaacacugucu

SEQ ID NO: 1264194 - RNA, 19 nt, Homo sapiens
acaauaacuuggagacaga

SEQ ID NO: 1264195 - RNA, 17 nt, Homo sapiens
acaauacaccuucccca

SEQ ID NO: 1264196 - RNA, 17 nt, Homo sapiens
acaauaccuacaauaaa

SEQ ID NO: 1264197 - RNA, 23 nt, Homo sapiens
acaauaggucuuucucucaguga

SEQ ID NO: 1264198 - RNA, 15 nt, Homo sapiens
acaaucaaaacacac

SEQ ID NO: 1264199 - RNA, 16 nt, Homo sapiens
acaaucaaagcacuug

SEQ ID NO: 1264200 - RNA, 19 nt, Homo sapiens
acaaucaugaaauaugcau

SEQ ID NO: 1264201 - RNA, 23 nt, Homo sapiens
acaauccaucucucaaguagugu

SEQ ID NO: 1264202 - RNA, 12 nt, Homo sapiens
acaauccuccaa

SEQ ID NO: 1264203 - RNA, 22 nt, Homo sapiens
acaauccuccaagaauuugacu

SEQ ID NO: 1264204 - RNA, 20 nt, Homo sapiens
acaaucugaaucccuugcaa

SEQ ID NO: 1264205 - RNA, 21 nt, Homo sapiens
acaaucuuugcuguauacuuu

SEQ ID NO: 1264206 - RNA, 16 nt, Homo sapiens
acaaugcaacuuuuaa

SEQ ID NO: 1264207 - RNA, 15 nt, Homo sapiens
acaauggagugugua

SEQ ID NO: 1264208 - RNA, 20 nt, Homo sapiens
acaaugggcacugauuugau

SEQ ID NO: 1264209 - RNA, 14 nt, Homo sapiens
acaauggucucagc

SEQ ID NO: 1264210 - RNA, 16 nt, Homo sapiens
acagacauacauuucu

SEQ ID NO: 1264211 - RNA, 18 nt, Homo sapiens
acagaccacaucuuuauc

SEQ ID NO: 1264212 - RNA, 18 nt, Homo sapiens
acagaccggagaggacag

SEQ ID NO: 1264213 - RNA, 16 nt, Homo sapiens
acagaccugugugugc

SEQ ID NO: 1264214 - RNA, 14 nt, Homo sapiens
acagacuggcaaua

SEQ ID NO: 1264215 - RNA, 23 nt, Homo sapiens
acagacuggcuccaacacugcaa

SEQ ID NO: 1264216 - RNA, 19 nt, Homo sapiens
acagagaaguuuguagcca

SEQ ID NO: 1264217 - RNA, 14 nt, Homo sapiens
acagagacaucucc

SEQ ID NO: 1264218 - RNA, 22 nt, Homo sapiens
acagagacaucucccuguggga

SEQ ID NO: 1264219 - RNA, 15 nt, Homo sapiens
acagagaugugauaa

SEQ ID NO: 1264220 - RNA, 20 nt, Homo sapiens
acagagcaagacuccaucuc

SEQ ID NO: 1264221 - RNA, 21 nt, Homo sapiens
acagagcaagacuccaucuca

SEQ ID NO: 1264222 - RNA, 20 nt, Homo sapiens
acagagcaagacucugucuc

SEQ ID NO: 1264223 - RNA, 14 nt, Homo sapiens
acagagcacauuug

SEQ ID NO: 1264224 - RNA, 18 nt, Homo sapiens
acagagcaggggcuccag

SEQ ID NO: 1264225 - RNA, 20 nt, Homo sapiens
acagagcgagacuccgucuc

SEQ ID NO: 1264226 - RNA, 15 nt, Homo sapiens
acagagcguccuucc

SEQ ID NO: 1264227 - RNA, 16 nt, Homo sapiens
acagagggcugcauuc

SEQ ID NO: 1264228 - RNA, 20 nt, Homo sapiens
acagagugagacucugucuc

SEQ ID NO: 1264229 - RNA, 21 nt, Homo sapiens
acagaguggucuuucuggaga

SEQ ID NO: 1264230 - RNA, 23 nt, Homo sapiens
acagaguucacaggaggccagug

SEQ ID NO: 1264231 - RNA, 22 nt, Homo sapiens
acagauccuuuuuccaucauuu

SEQ ID NO: 1264232 - RNA, 16 nt, Homo sapiens
acagauggauuugccu

SEQ ID NO: 1264233 - RNA, 13 nt, Homo sapiens
acagaugucucug

SEQ ID NO: 1264234 - RNA, 18 nt, Homo sapiens
acagauucugacauuuau

SEQ ID NO: 1264235 - RNA, 16 nt, Homo sapiens
acagauugucuuauua

SEQ ID NO: 1264236 - RNA, 16 nt, Homo sapiens
acagauuuuauuugua

SEQ ID NO: 1264237 - RNA, 12 nt, Homo sapiens
acagcaaggugg

SEQ ID NO: 1264238 - RNA, 13 nt, Homo sapiens
acagcacagccag

SEQ ID NO: 1264239 - RNA, 23 nt, Homo sapiens
acagcagagaccaccacauugag

SEQ ID NO: 1264240 - RNA, 18 nt, Homo sapiens
acagcagauacuuuguca

SEQ ID NO: 1264241 - RNA, 20 nt, Homo sapiens
acagcagcacuguucugucc

SEQ ID NO: 1264242 - RNA, 17 nt, Homo sapiens
acagcagccccugcaca

SEQ ID NO: 1264243 - RNA, 15 nt, Homo sapiens
acagcaggcuuucaa

SEQ ID NO: 1264244 - RNA, 14 nt, Homo sapiens
acagcagggacaag

SEQ ID NO: 1264245 - RNA, 15 nt, Homo sapiens
acagcagucagggac

SEQ ID NO: 1264246 - RNA, 13 nt, Homo sapiens
acagcaguggagu

SEQ ID NO: 1264247 - RNA, 15 nt, Homo sapiens
acagcauuaacuguc

SEQ ID NO: 1264248 - RNA, 22 nt, Homo sapiens
acagcauuugauaaaauccaaa

SEQ ID NO: 1264249 - RNA, 14 nt, Homo sapiens
acagccaaguguga

SEQ ID NO: 1264250 - RNA, 14 nt, Homo sapiens
acagccaugcccuu

SEQ ID NO: 1264251 - RNA, 15 nt, Homo sapiens
acagcccccucugcc

SEQ ID NO: 1264252 - RNA, 18 nt, Homo sapiens
acagcccuccgacccuca

SEQ ID NO: 1264253 - RNA, 21 nt, Homo sapiens
acagccucccacccccaucuc

SEQ ID NO: 1264254 - RNA, 23 nt, Homo sapiens
acagccucccacccccaucucuc

SEQ ID NO: 1264255 - RNA, 20 nt, Homo sapiens
acagccuccgccaagaucua

SEQ ID NO: 1264256 - RNA, 14 nt, Homo sapiens
acagccuggcacag

SEQ ID NO: 1264257 - RNA, 18 nt, Homo sapiens
acagccuggcacagggca

SEQ ID NO: 1264258 - RNA, 17 nt, Homo sapiens
acagcuacucuccccac

SEQ ID NO: 1264259 - RNA, 20 nt, Homo sapiens
acagcuacuugcaauucaaa

SEQ ID NO: 1264260 - RNA, 19 nt, Homo sapiens
acagcuaucgaacuucaca

SEQ ID NO: 1264261 - RNA, 21 nt, Homo sapiens
acagcucccugccaaacugaa

SEQ ID NO: 1264262 - RNA, 15 nt, Homo sapiens
acagcucuggcuuug

SEQ ID NO: 1264263 - RNA, 18 nt, Homo sapiens
acagcucuucuccaggcu

SEQ ID NO: 1264264 - RNA, 22 nt, Homo sapiens
acagcugagugcccuguccuca

SEQ ID NO: 1264265 - RNA, 18 nt, Homo sapiens
acagcugcugcuggaaau

SEQ ID NO: 1264266 - RNA, 15 nt, Homo sapiens
acagcuguaauaaca

SEQ ID NO: 1264267 - RNA, 15 nt, Homo sapiens
acagcuuaaucaaaa

SEQ ID NO: 1264268 - RNA, 15 nt, Homo sapiens
acagcuucaugccuu

SEQ ID NO: 1264269 - RNA, 21 nt, Homo sapiens
acagcuugaguggguucucug

SEQ ID NO: 1264270 - RNA, 18 nt, Homo sapiens
acagcuuuugcaacuuaa

SEQ ID NO: 1264271 - RNA, 20 nt, Homo sapiens
acaggaauagaugugguccu

SEQ ID NO: 1264272 - RNA, 16 nt, Homo sapiens
acaggacaacuuuaca

SEQ ID NO: 1264273 - RNA, 16 nt, Homo sapiens
acaggacuguaaagau

SEQ ID NO: 1264274 - RNA, 16 nt, Homo sapiens
acaggagaacaugcug

SEQ ID NO: 1264275 - RNA, 23 nt, Homo sapiens
acaggaggcccccaucuaugagc

SEQ ID NO: 1264276 - RNA, 18 nt, Homo sapiens
acaggagggaacauuucc

SEQ ID NO: 1264277 - RNA, 15 nt, Homo sapiens
acaggcaaauguacu

SEQ ID NO: 1264278 - RNA, 20 nt, Homo sapiens
acaggcacccaccaccaugc

SEQ ID NO: 1264279 - RNA, 13 nt, Homo sapiens
acaggcacggguc

SEQ ID NO: 1264280 - RNA, 13 nt, Homo sapiens
acaggcacuccaa

SEQ ID NO: 1264281 - RNA, 15 nt, Homo sapiens
acaggccauggugca

SEQ ID NO: 1264282 - RNA, 22 nt, Homo sapiens
acaggccauggugcacaaaagg

SEQ ID NO: 1264283 - RNA, 14 nt, Homo sapiens
acaggcccaagaga

SEQ ID NO: 1264284 - RNA, 19 nt, Homo sapiens
acaggcccggcuccaggcu

SEQ ID NO: 1264285 - RNA, 21 nt, Homo sapiens
acaggcccuuccucuccacug

SEQ ID NO: 1264286 - RNA, 14 nt, Homo sapiens
acaggcgaggaccc

SEQ ID NO: 1264287 - RNA, 15 nt, Homo sapiens
acaggcgugagccac

SEQ ID NO: 1264288 - RNA, 21 nt, Homo sapiens
acaggcucuuagcagcuucca

SEQ ID NO: 1264289 - RNA, 14 nt, Homo sapiens
acagggagaaaauc

SEQ ID NO: 1264290 - RNA, 22 nt, Homo sapiens
acagggagaagggauaacccua

SEQ ID NO: 1264291 - RNA, 20 nt, Homo sapiens
acagggcgagacucugucuc

SEQ ID NO: 1264292 - RNA, 17 nt, Homo sapiens
acagggucauguuugca

SEQ ID NO: 1264293 - RNA, 18 nt, Homo sapiens
acagggucauguuugcag

SEQ ID NO: 1264294 - RNA, 16 nt, Homo sapiens
acaggguccucagcuc

SEQ ID NO: 1264295 - RNA, 14 nt, Homo sapiens
acagggucucacuc

SEQ ID NO: 1264296 - RNA, 20 nt, Homo sapiens
acagggucucacucugucac

SEQ ID NO: 1264297 - RNA, 20 nt, Homo sapiens
acagggucuuuuuucauuuc

SEQ ID NO: 1264298 - RNA, 9 nt, Homo sapiens
acaggguuu

SEQ ID NO: 1264299 - RNA, 16 nt, Homo sapiens
acagguaaaacagggc

SEQ ID NO: 1264300 - RNA, 23 nt, Homo sapiens
acagguaauauaaaaagcuucca

SEQ ID NO: 1264301 - RNA, 13 nt, Homo sapiens
acagguaugccac

SEQ ID NO: 1264302 - RNA, 14 nt, Homo sapiens
acaggucaacuuca

SEQ ID NO: 1264303 - RNA, 17 nt, Homo sapiens
acaggugccuucccaga

SEQ ID NO: 1264304 - RNA, 20 nt, Homo sapiens
acaggugucuagacugccag

SEQ ID NO: 1264305 - RNA, 18 nt, Homo sapiens
acagguuauaacaguguu

SEQ ID NO: 1264306 - RNA, 18 nt, Homo sapiens
acaguaacccaaaccuca

SEQ ID NO: 1264307 - RNA, 14 nt, Homo sapiens
acaguaaucugcau

SEQ ID NO: 1264308 - RNA, 22 nt, Homo sapiens
acaguaaucugcaucauaagcu

SEQ ID NO: 1264309 - RNA, 22 nt, Homo sapiens
acaguacugauacauaauuuaa

SEQ ID NO: 1264310 - RNA, 18 nt, Homo sapiens
acaguaggauaagccacu

SEQ ID NO: 1264311 - RNA, 14 nt, Homo sapiens
acaguauccacaau

SEQ ID NO: 1264312 - RNA, 16 nt, Homo sapiens
acaguaucccacaucc

SEQ ID NO: 1264313 - RNA, 21 nt, Homo sapiens
acaguaucccacauccaacuc

SEQ ID NO: 1264314 - RNA, 15 nt, Homo sapiens
acaguauuacuucug

SEQ ID NO: 1264315 - RNA, 23 nt, Homo sapiens
acaguauuucauugccuguguau

SEQ ID NO: 1264316 - RNA, 16 nt, Homo sapiens
acaguauuuucccaau

SEQ ID NO: 1264317 - RNA, 16 nt, Homo sapiens
acaguauuuugguucu

SEQ ID NO: 1264318 - RNA, 18 nt, Homo sapiens
acagucaaaauguuugau

SEQ ID NO: 1264319 - RNA, 12 nt, Homo sapiens
acagucagcucu

SEQ ID NO: 1264320 - RNA, 15 nt, Homo sapiens
acagucaucugccac

SEQ ID NO: 1264321 - RNA, 17 nt, Homo sapiens
acagucaucugccacca

SEQ ID NO: 1264322 - RNA, 19 nt, Homo sapiens
acaguccaaacuguucuga

SEQ ID NO: 1264323 - RNA, 22 nt, Homo sapiens
acaguccugggagaaccucagg

SEQ ID NO: 1264324 - RNA, 16 nt, Homo sapiens
acagucucuuucuucc

SEQ ID NO: 1264325 - RNA, 18 nt, Homo sapiens
acagucugagacuccuca

SEQ ID NO: 1264326 - RNA, 23 nt, Homo sapiens
acagugaaaauguaagcuguuua

SEQ ID NO: 1264327 - RNA, 15 nt, Homo sapiens
acagugagaaaccau

SEQ ID NO: 1264328 - RNA, 16 nt, Homo sapiens
acagugagaaaccaua

SEQ ID NO: 1264329 - RNA, 21 nt, Homo sapiens
acagugagucgaggacaggga

SEQ ID NO: 1264330 - RNA, 21 nt, Homo sapiens
acagugaugcugugcuaugaa

SEQ ID NO: 1264331 - RNA, 12 nt, Homo sapiens
acagugcauauu

SEQ ID NO: 1264332 - RNA, 11 nt, Homo sapiens
acagugcauuu

SEQ ID NO: 1264333 - RNA, 22 nt, Homo sapiens
acagugcauuugccuugucacc

SEQ ID NO: 1264334 - RNA, 21 nt, Homo sapiens
acagugcccaugcaauggcuu

SEQ ID NO: 1264335 - RNA, 19 nt, Homo sapiens
acagugccgacagcucucc

SEQ ID NO: 1264336 - RNA, 19 nt, Homo sapiens
agacugcaugacagucaca

SEQ ID NO: 1264337 - RNA, 14 nt, Homo sapiens
agacugccagggag

SEQ ID NO: 1264338 - RNA, 12 nt, Homo sapiens
agacugcuuccc

SEQ ID NO: 1264339 - RNA, 15 nt, Homo sapiens
agacuggaagcacag

SEQ ID NO: 1264340 - RNA, 21 nt, Homo sapiens
agacuggaaguucauaccuaa

SEQ ID NO: 1264341 - RNA, 22 nt, Homo sapiens
agacuggaaguucauaccuaag

SEQ ID NO: 1264342 - RNA, 22 nt, Homo sapiens
agacuggaauauaauuucaaac

SEQ ID NO: 1264343 - RNA, 18 nt, Homo sapiens
agacuggauucgugacaa

SEQ ID NO: 1264344 - RNA, 13 nt, Homo sapiens
agacuggcaauaa

SEQ ID NO: 1264345 - RNA, 21 nt, Homo sapiens
agacuggcaauaaacuccuac

SEQ ID NO: 1264346 - RNA, 20 nt, Homo sapiens
agacuggggacccuggacau

SEQ ID NO: 1264347 - RNA, 19 nt, Homo sapiens
agacuggggcauccugugc

SEQ ID NO: 1264348 - RNA, 21 nt, Homo sapiens
agacuguaggaagaguagcau

SEQ ID NO: 1264349 - RNA, 20 nt, Homo sapiens
agacuguggcuagugacaaa

SEQ ID NO: 1264350 - RNA, 18 nt, Homo sapiens
agacuguuacuuuggcaa

SEQ ID NO: 1264351 - RNA, 23 nt, Homo sapiens
agacuguugugaucuugcauuca

SEQ ID NO: 1264352 - RNA, 21 nt, Homo sapiens
agacuuaaaaaauacuugcau

SEQ ID NO: 1264353 - RNA, 12 nt, Homo sapiens
agacuuacugca

SEQ ID NO: 1264354 - RNA, 18 nt, Homo sapiens
agacuuaggaaccuacca

SEQ ID NO: 1264355 - RNA, 21 nt, Homo sapiens
agacuuccaucuagucacaaa

SEQ ID NO: 1264356 - RNA, 22 nt, Homo sapiens
agacuuccucaugaaucucuca

SEQ ID NO: 1264357 - RNA, 21 nt, Homo sapiens
agacuuggcuccaccacugau

SEQ ID NO: 1264358 - RNA, 22 nt, Homo sapiens
agacuuggcuccaccacugaua

SEQ ID NO: 1264359 - RNA, 23 nt, Homo sapiens
agacuuggcuccaccacugauau

SEQ ID NO: 1264360 - RNA, 15 nt, Homo sapiens
agacuuucuucucua

SEQ ID NO: 1264361 - RNA, 21 nt, Homo sapiens
agagaaaaaaaauuaagacaa

SEQ ID NO: 1264362 - RNA, 23 nt, Homo sapiens
agagaaaccgggagaaggcauga

SEQ ID NO: 1264363 - RNA, 18 nt, Homo sapiens
agagaaaggguaauuucc

SEQ ID NO: 1264364 - RNA, 16 nt, Homo sapiens
agagaaaguacuucuc

SEQ ID NO: 1264365 - RNA, 17 nt, Homo sapiens
agagaaaucaaugaagc

SEQ ID NO: 1264366 - RNA, 18 nt, Homo sapiens
agagaacccagauguugu

SEQ ID NO: 1264367 - RNA, 17 nt, Homo sapiens
agagaaccgagcaaaga

SEQ ID NO: 1264368 - RNA, 20 nt, Homo sapiens
agagaagcggauuuccaggg

SEQ ID NO: 1264369 - RNA, 13 nt, Homo sapiens
agagaagcugaug

SEQ ID NO: 1264370 - RNA, 13 nt, Homo sapiens
agagaaguuugaa

SEQ ID NO: 1264371 - RNA, 14 nt, Homo sapiens
agagaauguauuug

SEQ ID NO: 1264372 - RNA, 15 nt, Homo sapiens
agagaaugugcucau

SEQ ID NO: 1264373 - RNA, 22 nt, Homo sapiens
agagaauuguaucauuugaaca

SEQ ID NO: 1264374 - RNA, 13 nt, Homo sapiens
agagaauuuccuu

SEQ ID NO: 1264375 - RNA, 16 nt, Homo sapiens
agagacaauacaguaa

SEQ ID NO: 1264376 - RNA, 17 nt, Homo sapiens
agagacagaauguaucu

SEQ ID NO: 1264377 - RNA, 11 nt, Homo sapiens
agagaccucca

SEQ ID NO: 1264378 - RNA, 16 nt, Homo sapiens
agagacgcagacaugu

SEQ ID NO: 1264379 - RNA, 18 nt, Homo sapiens
agagacgcagacaugugc

SEQ ID NO: 1264380 - RNA, 19 nt, Homo sapiens
agagacgguguuuugccau

SEQ ID NO: 1264381 - RNA, 21 nt, Homo sapiens
agagacuuggggaaauugcuu

SEQ ID NO: 1264382 - RNA, 15 nt, Homo sapiens
agagagaaagccagg

SEQ ID NO: 1264383 - RNA, 12 nt, Homo sapiens
agagagaacuuu

SEQ ID NO: 1264384 - RNA, 14 nt, Homo sapiens
agagagaagccagc

SEQ ID NO: 1264385 - RNA, 20 nt, Homo sapiens
agagagaaguucauacaaag

SEQ ID NO: 1264386 - RNA, 14 nt, Homo sapiens
agagagagaacuuu

SEQ ID NO: 1264387 - RNA, 21 nt, Homo sapiens
agagagcagcuucagugacaa

SEQ ID NO: 1264388 - RNA, 22 nt, Homo sapiens
agagagccccugacaauccuga

SEQ ID NO: 1264389 - RNA, 19 nt, Homo sapiens
agagagccuggugcugcug

SEQ ID NO: 1264390 - RNA, 17 nt, Homo sapiens
agagaggguggugaccu

SEQ ID NO: 1264391 - RNA, 16 nt, Homo sapiens
agagagucgcaucuca

SEQ ID NO: 1264392 - RNA, 22 nt, Homo sapiens
agagagucgcaucucagugcag

SEQ ID NO: 1264393 - RNA, 13 nt, Homo sapiens
agagaguggcucc

SEQ ID NO: 1264394 - RNA, 20 nt, Homo sapiens
agagauacauguugccucac

SEQ ID NO: 1264395 - RNA, 21 nt, Homo sapiens
agagauauugauauugaagga

SEQ ID NO: 1264396 - RNA, 19 nt, Homo sapiens
agagaucagcgacccugag

SEQ ID NO: 1264397 - RNA, 15 nt, Homo sapiens
agagaugacagggaa

SEQ ID NO: 1264398 - RNA, 23 nt, Homo sapiens
agagaugcgaaccacccaaaaca

SEQ ID NO: 1264399 - RNA, 21 nt, Homo sapiens
agagauucuguugcauagacu

SEQ ID NO: 1264400 - RNA, 17 nt, Homo sapiens
agagauuuggagcacuc

SEQ ID NO: 1264401 - RNA, 21 nt, Homo sapiens
agagcaacaauccaucucuca

SEQ ID NO: 1264402 - RNA, 18 nt, Homo sapiens
agagcaagacuccaucuc

SEQ ID NO: 1264403 - RNA, 20 nt, Homo sapiens
agagcaagacuccaucucaa

SEQ ID NO: 1264404 - RNA, 13 nt, Homo sapiens
agagcacagagca

SEQ ID NO: 1264405 - RNA, 16 nt, Homo sapiens
agagcacucauuccuu

SEQ ID NO: 1264406 - RNA, 10 nt, Homo sapiens
agagcacugg

SEQ ID NO: 1264407 - RNA, 23 nt, Homo sapiens
agagcacuugagaaccagucucc

SEQ ID NO: 1264408 - RNA, 15 nt, Homo sapiens
agagcagaguuuacg

SEQ ID NO: 1264409 - RNA, 13 nt, Homo sapiens
agagcagcuggau

SEQ ID NO: 1264410 - RNA, 13 nt, Homo sapiens
agagcagggauua

SEQ ID NO: 1264411 - RNA, 21 nt, Homo sapiens
agagcaguaccagcgcucuaa

SEQ ID NO: 1264412 - RNA, 18 nt, Homo sapiens
agagcaguggccaggcca

SEQ ID NO: 1264413 - RNA, 16 nt, Homo sapiens
agagccagggcugaug

SEQ ID NO: 1264414 - RNA, 20 nt, Homo sapiens
agagccagucucaccuucaa

SEQ ID NO: 1264415 - RNA, 11 nt, Homo sapiens
agagccaguga

SEQ ID NO: 1264416 - RNA, 18 nt, Homo sapiens
agagccagugaaggagcc

SEQ ID NO: 1264417 - RNA, 23 nt, Homo sapiens
agagcccccaccuugaucccaau

SEQ ID NO: 1264418 - RNA, 15 nt, Homo sapiens
agagcccccuugaca

SEQ ID NO: 1264419 - RNA, 14 nt, Homo sapiens
agagcccuugccuc

SEQ ID NO: 1264420 - RNA, 17 nt, Homo sapiens
agagccgggaaggggaa

SEQ ID NO: 1264421 - RNA, 20 nt, Homo sapiens
agagccuucagaaugcuccu

SEQ ID NO: 1264422 - RNA, 20 nt, Homo sapiens
agagcgagacuccgucucaa

SEQ ID NO: 1264423 - RNA, 17 nt, Homo sapiens
agagcgaggaaaggauu

SEQ ID NO: 1264424 - RNA, 16 nt, Homo sapiens
agagcgcggcuggcuc

SEQ ID NO: 1264425 - RNA, 22 nt, Homo sapiens
agagcggaaggagggagcucug

SEQ ID NO: 1264426 - RNA, 16 nt, Homo sapiens
agagcggucucaggcu

SEQ ID NO: 1264427 - RNA, 15 nt, Homo sapiens
agagcuaaguggcuu

SEQ ID NO: 1264428 - RNA, 15 nt, Homo sapiens
agagcuggaucucuc

SEQ ID NO: 1264429 - RNA, 13 nt, Homo sapiens
agagcuggaugca

SEQ ID NO: 1264430 - RNA, 20 nt, Homo sapiens
agagcuuuuaaaaauguccu

SEQ ID NO: 1264431 - RNA, 15 nt, Homo sapiens
agagcuuuuugcaug

SEQ ID NO: 1264432 - RNA, 14 nt, Homo sapiens
agaggaaaaugccu

SEQ ID NO: 1264433 - RNA, 13 nt, Homo sapiens
agaggaacagcac

SEQ ID NO: 1264434 - RNA, 22 nt, Homo sapiens
agaggacagagcaggggcucca

SEQ ID NO: 1264435 - RNA, 20 nt, Homo sapiens
agaggacuggacgugcucag

SEQ ID NO: 1264436 - RNA, 20 nt, Homo sapiens
agaggacuucuggcagggaa

SEQ ID NO: 1264437 - RNA, 17 nt, Homo sapiens
agaggagccaccaguuc

SEQ ID NO: 1264438 - RNA, 17 nt, Homo sapiens
agaggagccagacagac

SEQ ID NO: 1264439 - RNA, 23 nt, Homo sapiens
agaggagccagacagacccugaa

SEQ ID NO: 1264440 - RNA, 13 nt, Homo sapiens
agaggaugucaca

SEQ ID NO: 1264441 - RNA, 22 nt, Homo sapiens
agaggaugucucaaacuucaga

SEQ ID NO: 1264442 - RNA, 15 nt, Homo sapiens
agaggcccugugguc

SEQ ID NO: 1264443 - RNA, 22 nt, Homo sapiens
agaggcuaagaugagauuugcc

SEQ ID NO: 1264444 - RNA, 21 nt, Homo sapiens
agaggcucagacucacuguua

SEQ ID NO: 1264445 - RNA, 18 nt, Homo sapiens
agaggcucuaauguacaa

SEQ ID NO: 1264446 - RNA, 19 nt, Homo sapiens
agaggcucuaauguacaau

SEQ ID NO: 1264447 - RNA, 15 nt, Homo sapiens
agaggcucugagaaa

SEQ ID NO: 1264448 - RNA, 16 nt, Homo sapiens
agaggcuuucuccagg

SEQ ID NO: 1264449 - RNA, 22 nt, Homo sapiens
agagggaagugucaugcaagug

SEQ ID NO: 1264450 - RNA, 16 nt, Homo sapiens
agagggaggucacugg

SEQ ID NO: 1264451 - RNA, 18 nt, Homo sapiens
agagggaggucacuggaa

SEQ ID NO: 1264452 - RNA, 16 nt, Homo sapiens
agagggcugcugacca

SEQ ID NO: 1264453 - RNA, 13 nt, Homo sapiens
agagggcuuccuc

SEQ ID NO: 1264454 - RNA, 18 nt, Homo sapiens
agaggggaaccucaacug

SEQ ID NO: 1264455 - RNA, 16 nt, Homo sapiens
agaggggaagggccag

SEQ ID NO: 1264456 - RNA, 17 nt, Homo sapiens
agagggggucucagaaa

SEQ ID NO: 1264457 - RNA, 22 nt, Homo sapiens
agagggguggaguuuuaacugu

SEQ ID NO: 1264458 - RNA, 13 nt, Homo sapiens
agagguccagccc

SEQ ID NO: 1264459 - RNA, 19 nt, Homo sapiens
agagguccuggccaucaaa

SEQ ID NO: 1264460 - RNA, 21 nt, Homo sapiens
agaggucucagguucuuucca

SEQ ID NO: 1264461 - RNA, 21 nt, Homo sapiens
agccccagagaugccagcccu

SEQ ID NO: 1264462 - RNA, 18 nt, Homo sapiens
agccccagcagcccucaa

SEQ ID NO: 1264463 - RNA, 19 nt, Homo sapiens
agccccaggccccagcugg

SEQ ID NO: 1264464 - RNA, 16 nt, Homo sapiens
agccccagucuuccuu

SEQ ID NO: 1264465 - RNA, 21 nt, Homo sapiens
agccccucccccaucucccac

SEQ ID NO: 1264466 - RNA, 22 nt, Homo sapiens
agccccugggcccaguaccuag

SEQ ID NO: 1264467 - RNA, 18 nt, Homo sapiens
agcccuaaccccuuccag

SEQ ID NO: 1264468 - RNA, 13 nt, Homo sapiens
agcccuaaucuca

SEQ ID NO: 1264469 - RNA, 15 nt, Homo sapiens
agcccucaacuauuc

SEQ ID NO: 1264470 - RNA, 12 nt, Homo sapiens
agcccugaaccc

SEQ ID NO: 1264471 - RNA, 15 nt, Homo sapiens
agcccugaacgugag

SEQ ID NO: 1264472 - RNA, 18 nt, Homo sapiens
agcccugaccccagugua

SEQ ID NO: 1264473 - RNA, 22 nt, Homo sapiens
agcccugcucuggggugcugag

SEQ ID NO: 1264474 - RNA, 21 nt, Homo sapiens
agcccugggaaccacucccac

SEQ ID NO: 1264475 - RNA, 19 nt, Homo sapiens
agcccugguaaaagggaua

SEQ ID NO: 1264476 - RNA, 20 nt, Homo sapiens
agcccuggugcuacuugcuu

SEQ ID NO: 1264477 - RNA, 18 nt, Homo sapiens
agcccugucgagacacuu

SEQ ID NO: 1264478 - RNA, 14 nt, Homo sapiens
agcccugucugcua

SEQ ID NO: 1264479 - RNA, 22 nt, Homo sapiens
agcccuguucugggugcagcug

SEQ ID NO: 1264480 - RNA, 18 nt, Homo sapiens
agcccuucacugccauga

SEQ ID NO: 1264481 - RNA, 15 nt, Homo sapiens
agcccuucagucuua

SEQ ID NO: 1264482 - RNA, 15 nt, Homo sapiens
agcccuucaguuugg

SEQ ID NO: 1264483 - RNA, 20 nt, Homo sapiens
agcccuuuuuguacugauau

SEQ ID NO: 1264484 - RNA, 13 nt, Homo sapiens
agccgacucuggc

SEQ ID NO: 1264485 - RNA, 21 nt, Homo sapiens
agccgagaucacgccacugca

SEQ ID NO: 1264486 - RNA, 21 nt, Homo sapiens
agccgagauugcaccacugca

SEQ ID NO: 1264487 - RNA, 23 nt, Homo sapiens
agccgagcacgguggugcaugcc

SEQ ID NO: 1264488 - RNA, 18 nt, Homo sapiens
agccgcauuggugacuca

SEQ ID NO: 1264489 - RNA, 16 nt, Homo sapiens
agccgggcacagcccu

SEQ ID NO: 1264490 - RNA, 20 nt, Homo sapiens
agccgguggugcccgugccc

SEQ ID NO: 1264491 - RNA, 15 nt, Homo sapiens
agccguccauggcac

SEQ ID NO: 1264492 - RNA, 13 nt, Homo sapiens
agccgugaacugu

SEQ ID NO: 1264493 - RNA, 17 nt, Homo sapiens
agccuaauaacgugaaa

SEQ ID NO: 1264494 - RNA, 15 nt, Homo sapiens
agccuacagaugaac

SEQ ID NO: 1264495 - RNA, 16 nt, Homo sapiens
agccuaccaauguaga

SEQ ID NO: 1264496 - RNA, 13 nt, Homo sapiens
agccuacuuuuca

SEQ ID NO: 1264497 - RNA, 18 nt, Homo sapiens
agccuagcggagcccagc

SEQ ID NO: 1264498 - RNA, 17 nt, Homo sapiens
agccuaggcccucauga

SEQ ID NO: 1264499 - RNA, 14 nt, Homo sapiens
agccuauuuaccug

SEQ ID NO: 1264500 - RNA, 20 nt, Homo sapiens
agccuauuugaacuacuuaa

SEQ ID NO: 1264501 - RNA, 16 nt, Homo sapiens
agccuauuuuuuuaga

SEQ ID NO: 1264502 - RNA, 12 nt, Homo sapiens
agccucaagucu

SEQ ID NO: 1264503 - RNA, 12 nt, Homo sapiens
agccucaccaag

SEQ ID NO: 1264504 - RNA, 21 nt, Homo sapiens
agccucagcggacaagcagcu

SEQ ID NO: 1264505 - RNA, 12 nt, Homo sapiens
agccuccaacac

SEQ ID NO: 1264506 - RNA, 22 nt, Homo sapiens
agccuccacagcgagggcagcu

SEQ ID NO: 1264507 - RNA, 23 nt, Homo sapiens
agccucccacacugaaaccaaaa

SEQ ID NO: 1264508 - RNA, 21 nt, Homo sapiens
agccucccccucagaugaucu

SEQ ID NO: 1264509 - RNA, 22 nt, Homo sapiens
agccucccccucagaugaucuc

SEQ ID NO: 1264510 - RNA, 15 nt, Homo sapiens
agccuccccgugcca

SEQ ID NO: 1264511 - RNA, 18 nt, Homo sapiens
agccuccccgugccaaaa

SEQ ID NO: 1264512 - RNA, 20 nt, Homo sapiens
agccucccugaagaccaaaa

SEQ ID NO: 1264513 - RNA, 18 nt, Homo sapiens
agccuccggcggggaccc

SEQ ID NO: 1264514 - RNA, 16 nt, Homo sapiens
agccuccuagauguaa

SEQ ID NO: 1264515 - RNA, 15 nt, Homo sapiens
agccuccucucucaa

SEQ ID NO: 1264516 - RNA, 20 nt, Homo sapiens
agccucguuucugcuuucag

SEQ ID NO: 1264517 - RNA, 15 nt, Homo sapiens
agccucugaccccuc

SEQ ID NO: 1264518 - RNA, 21 nt, Homo sapiens
agccucugcuuccguacuaug

SEQ ID NO: 1264519 - RNA, 19 nt, Homo sapiens
agccucuucugccaagaga

SEQ ID NO: 1264520 - RNA, 19 nt, Homo sapiens
agccugaauuuuguugcug

SEQ ID NO: 1264521 - RNA, 21 nt, Homo sapiens
agccugagcaaaaagaccagc

SEQ ID NO: 1264522 - RNA, 18 nt, Homo sapiens
agccugagucaccugcag

SEQ ID NO: 1264523 - RNA, 16 nt, Homo sapiens
agccugccucccaagg

SEQ ID NO: 1264524 - RNA, 20 nt, Homo sapiens
agccugcucuagugggacag

SEQ ID NO: 1264525 - RNA, 14 nt, Homo sapiens
agccugcuucccac

SEQ ID NO: 1264526 - RNA, 14 nt, Homo sapiens
agccuggcaacaca

SEQ ID NO: 1264527 - RNA, 14 nt, Homo sapiens
agccuggcacagga

SEQ ID NO: 1264528 - RNA, 21 nt, Homo sapiens
agccuggcacagggcaguggg

SEQ ID NO: 1264529 - RNA, 19 nt, Homo sapiens
agccuggccccugugcacc

SEQ ID NO: 1264530 - RNA, 13 nt, Homo sapiens
agccuggccuaau

SEQ ID NO: 1264531 - RNA, 22 nt, Homo sapiens
agccuggccucucagccugcau

SEQ ID NO: 1264532 - RNA, 20 nt, Homo sapiens
agccuggcucuaucuuccuc

SEQ ID NO: 1264533 - RNA, 12 nt, Homo sapiens
agccuggcucuu

SEQ ID NO: 1264534 - RNA, 21 nt, Homo sapiens
agccuggcugcccaucaugug

SEQ ID NO: 1264535 - RNA, 18 nt, Homo sapiens
agccugggcaacauacca

SEQ ID NO: 1264536 - RNA, 17 nt, Homo sapiens
agccugggccagagaag

SEQ ID NO: 1264537 - RNA, 17 nt, Homo sapiens
agccuggggcucccucu

SEQ ID NO: 1264538 - RNA, 14 nt, Homo sapiens
agccugggggacag

SEQ ID NO: 1264539 - RNA, 16 nt, Homo sapiens
agccuguacaaccuac

SEQ ID NO: 1264540 - RNA, 14 nt, Homo sapiens
agccugugaagucc

SEQ ID NO: 1264541 - RNA, 16 nt, Homo sapiens
agccugugaaguccua

SEQ ID NO: 1264542 - RNA, 21 nt, Homo sapiens
agccugugguuacagugcaga

SEQ ID NO: 1264543 - RNA, 13 nt, Homo sapiens
agccuuaagccau

SEQ ID NO: 1264544 - RNA, 18 nt, Homo sapiens
agccuuagcucccagcua

SEQ ID NO: 1264545 - RNA, 21 nt, Homo sapiens
agccuuauuucuagaagcaca

SEQ ID NO: 1264546 - RNA, 16 nt, Homo sapiens
agccuucaagugccaa

SEQ ID NO: 1264547 - RNA, 20 nt, Homo sapiens
agccuuccacagugaaugug

SEQ ID NO: 1264548 - RNA, 16 nt, Homo sapiens
agccuucgaguggcca

SEQ ID NO: 1264549 - RNA, 15 nt, Homo sapiens
agccuucuccaggac

SEQ ID NO: 1264550 - RNA, 21 nt, Homo sapiens
agccuucuuccaucccaggac

SEQ ID NO: 1264551 - RNA, 12 nt, Homo sapiens
agccuugcuugu

SEQ ID NO: 1264552 - RNA, 14 nt, Homo sapiens
agccuuugccuccc

SEQ ID NO: 1264553 - RNA, 22 nt, Homo sapiens
agcgacaggaauagaugugguc

SEQ ID NO: 1264554 - RNA, 17 nt, Homo sapiens
agcgagagucugucuca

SEQ ID NO: 1264555 - RNA, 14 nt, Homo sapiens
agcgcagacuggcg

SEQ ID NO: 1264556 - RNA, 22 nt, Homo sapiens
agcgcagguuuaguuuacucaa

SEQ ID NO: 1264557 - RNA, 19 nt, Homo sapiens
agcgccuuuccugccaugu

SEQ ID NO: 1264558 - RNA, 20 nt, Homo sapiens
agcgcuaaacguuggugacg

SEQ ID NO: 1264559 - RNA, 14 nt, Homo sapiens
agcggccgcugccg

SEQ ID NO: 1264560 - RNA, 17 nt, Homo sapiens
agcgguuuaaccacauu

SEQ ID NO: 1264561 - RNA, 24 nt, Homo sapiens
agcgugcauaaguuaacuuccaau

SEQ ID NO: 1264562 - RNA, 19 nt, Homo sapiens
agcguguuuacauguguag

SEQ ID NO: 1264563 - RNA, 16 nt, Homo sapiens
agcguuaugugcagua

SEQ ID NO: 1264564 - RNA, 20 nt, Homo sapiens
agcguuucuuuacuucucac

SEQ ID NO: 1264565 - RNA, 18 nt, Homo sapiens
agcuaaaaugauuuuauc

SEQ ID NO: 1264566 - RNA, 18 nt, Homo sapiens
agcuaaacggauuccaaa

SEQ ID NO: 1264567 - RNA, 19 nt, Homo sapiens
agcuaaccaguuaccacac

SEQ ID NO: 1264568 - RNA, 21 nt, Homo sapiens
agcuaagggugggugcucaga

SEQ ID NO: 1264569 - RNA, 18 nt, Homo sapiens
agcuacagcuuucuugcu

SEQ ID NO: 1264570 - RNA, 15 nt, Homo sapiens
agcuacaggacauuu

SEQ ID NO: 1264571 - RNA, 16 nt, Homo sapiens
agcuacaggacauuuu

SEQ ID NO: 1264572 - RNA, 23 nt, Homo sapiens
agcuaccagguguucuacacuca

SEQ ID NO: 1264573 - RNA, 16 nt, Homo sapiens
agcuacccacuauccu

SEQ ID NO: 1264574 - RNA, 21 nt, Homo sapiens
agcuaccucaaacuuccaguc

SEQ ID NO: 1264575 - RNA, 13 nt, Homo sapiens
agcuacuaaugau

SEQ ID NO: 1264576 - RNA, 18 nt, Homo sapiens
agcuacucgggaggcuga

SEQ ID NO: 1264577 - RNA, 19 nt, Homo sapiens
agcuacuugcaauucaaaa

SEQ ID NO: 1264578 - RNA, 19 nt, Homo sapiens
agcuagaaaacaggcaaau

SEQ ID NO: 1264579 - RNA, 17 nt, Homo sapiens
agcuagaauaccaccua

SEQ ID NO: 1264580 - RNA, 23 nt, Homo sapiens
agcuagagcuucauagguagugc

SEQ ID NO: 1264581 - RNA, 19 nt, Homo sapiens
agcuagaggacuucuggca

SEQ ID NO: 1264582 - RNA, 12 nt, Homo sapiens
agcuagccagag

SEQ ID NO: 1264583 - RNA, 19 nt, Homo sapiens
agcuaggaugguucuguga

SEQ ID NO: 1264584 - RNA, 13 nt, Homo sapiens
agcuagugccuuu

SEQ ID NO: 1264585 - RNA, 14 nt, Homo sapiens
agcuagugccuuua

SEQ ID NO: 1264586 - RNA, 20 nt, Homo sapiens
aggcuuuccaauguagcuca

SEQ ID NO: 1264587 - RNA, 20 nt, Homo sapiens
aggcuuuguacagagugcuu

SEQ ID NO: 1264588 - RNA, 18 nt, Homo sapiens
agggaaaaggaguaggga

SEQ ID NO: 1264589 - RNA, 22 nt, Homo sapiens
agggaaaaggaguagggaguuc

SEQ ID NO: 1264590 - RNA, 14 nt, Homo sapiens
agggaaaaugagua

SEQ ID NO: 1264591 - RNA, 13 nt, Homo sapiens
agggaacaggaaa

SEQ ID NO: 1264592 - RNA, 21 nt, Homo sapiens
agggaaccugguacauccagu

SEQ ID NO: 1264593 - RNA, 17 nt, Homo sapiens
agggaacgguccaugaa

SEQ ID NO: 1264594 - RNA, 19 nt, Homo sapiens
agggaagcuggccgagggu

SEQ ID NO: 1264595 - RNA, 18 nt, Homo sapiens
agggaagcugucccucac

SEQ ID NO: 1264596 - RNA, 19 nt, Homo sapiens
agggaaggucucaggagaa

SEQ ID NO: 1264597 - RNA, 13 nt, Homo sapiens
agggaaugcucag

SEQ ID NO: 1264598 - RNA, 19 nt, Homo sapiens
agggacaaaacacuguguc

SEQ ID NO: 1264599 - RNA, 17 nt, Homo sapiens
agggacaggcacuccaa

SEQ ID NO: 1264600 - RNA, 16 nt, Homo sapiens
agggaccaugugucac

SEQ ID NO: 1264601 - RNA, 16 nt, Homo sapiens
agggacucccacaaca

SEQ ID NO: 1264602 - RNA, 16 nt, Homo sapiens
agggacugccucugcc

SEQ ID NO: 1264603 - RNA, 20 nt, Homo sapiens
agggagaacuugaaacagau

SEQ ID NO: 1264604 - RNA, 15 nt, Homo sapiens
agggagaaggcaggu

SEQ ID NO: 1264605 - RNA, 21 nt, Homo sapiens
agggagacccccaucuuuaca

SEQ ID NO: 1264606 - RNA, 19 nt, Homo sapiens
agggagcaggccggaacca

SEQ ID NO: 1264607 - RNA, 16 nt, Homo sapiens
agggagccgagaucac

SEQ ID NO: 1264608 - RNA, 15 nt, Homo sapiens
agggagcgcucucuu

SEQ ID NO: 1264609 - RNA, 19 nt, Homo sapiens
agggagggguuauagcuuc

SEQ ID NO: 1264610 - RNA, 16 nt, Homo sapiens
agggagguaacgggug

SEQ ID NO: 1264611 - RNA, 12 nt, Homo sapiens
agggagugcaug

SEQ ID NO: 1264612 - RNA, 18 nt, Homo sapiens
agggaguucaaaacauuc

SEQ ID NO: 1264613 - RNA, 20 nt, Homo sapiens
agggauauuuuuuucuauua

SEQ ID NO: 1264614 - RNA, 14 nt, Homo sapiens
agggaucacuggcu

SEQ ID NO: 1264615 - RNA, 15 nt, Homo sapiens
agggaucuguuugaa

SEQ ID NO: 1264616 - RNA, 19 nt, Homo sapiens
agggaugcugccugaguca

SEQ ID NO: 1264617 - RNA, 22 nt, Homo sapiens
agggauggagaaagaaguggag

SEQ ID NO: 1264618 - RNA, 17 nt, Homo sapiens
agggauuagguguucag

SEQ ID NO: 1264619 - RNA, 16 nt, Homo sapiens
agggauuccccuaacc

SEQ ID NO: 1264620 - RNA, 15 nt, Homo sapiens
agggcaagaucucag

SEQ ID NO: 1264621 - RNA, 16 nt, Homo sapiens
agggcacagcccuccg

SEQ ID NO: 1264622 - RNA, 17 nt, Homo sapiens
agggcacuuaauuugua

SEQ ID NO: 1264623 - RNA, 19 nt, Homo sapiens
agggcagaccacauugcuu

SEQ ID NO: 1264624 - RNA, 15 nt, Homo sapiens
agggcagagaauggc

SEQ ID NO: 1264625 - RNA, 18 nt, Homo sapiens
agggcagagaauggcugg

SEQ ID NO: 1264626 - RNA, 16 nt, Homo sapiens
agggcagggcucugau

SEQ ID NO: 1264627 - RNA, 13 nt, Homo sapiens
agggcagguagcu

SEQ ID NO: 1264628 - RNA, 14 nt, Homo sapiens
agggcaucaucuau

SEQ ID NO: 1264629 - RNA, 15 nt, Homo sapiens
agggcauguguaugu

SEQ ID NO: 1264630 - RNA, 23 nt, Homo sapiens
agggcauuugugggucugugugg

SEQ ID NO: 1264631 - RNA, 19 nt, Homo sapiens
agggccagguuagcacagc

SEQ ID NO: 1264632 - RNA, 15 nt, Homo sapiens
agggcccacuuguau

SEQ ID NO: 1264633 - RNA, 17 nt, Homo sapiens
agggcccagcuguagcc

SEQ ID NO: 1264634 - RNA, 17 nt, Homo sapiens
agggccgaggaggugcc

SEQ ID NO: 1264635 - RNA, 20 nt, Homo sapiens
agggccuggcaggccagugu

SEQ ID NO: 1264636 - RNA, 18 nt, Homo sapiens
agggcuagggaaagggau

SEQ ID NO: 1264637 - RNA, 23 nt, Homo sapiens
agggcugagggcuuugccgccau

SEQ ID NO: 1264638 - RNA, 19 nt, Homo sapiens
agggcugccaccaagguga

SEQ ID NO: 1264639 - RNA, 14 nt, Homo sapiens
agggcugcccugag

SEQ ID NO: 1264640 - RNA, 19 nt, Homo sapiens
agggcuggaagcuuucauu

SEQ ID NO: 1264641 - RNA, 20 nt, Homo sapiens
agggcuggcucugcacuaag

SEQ ID NO: 1264642 - RNA, 15 nt, Homo sapiens
agggcuggggacaga

SEQ ID NO: 1264643 - RNA, 16 nt, Homo sapiens
agggcuuccucuuccg

SEQ ID NO: 1264644 - RNA, 18 nt, Homo sapiens
aggggaaagacuuccauc

SEQ ID NO: 1264645 - RNA, 19 nt, Homo sapiens
aggggaagagauuagucuc

SEQ ID NO: 1264646 - RNA, 21 nt, Homo sapiens
aggggaagagauuagucucuu

SEQ ID NO: 1264647 - RNA, 13 nt, Homo sapiens
aggggaauggagg

SEQ ID NO: 1264648 - RNA, 20 nt, Homo sapiens
aggggacucagcccugaggu

SEQ ID NO: 1264649 - RNA, 12 nt, Homo sapiens
aggggacugggg

SEQ ID NO: 1264650 - RNA, 17 nt, Homo sapiens
aggggagggguugccac

SEQ ID NO: 1264651 - RNA, 13 nt, Homo sapiens
aggggaguucagu

SEQ ID NO: 1264652 - RNA, 16 nt, Homo sapiens
aggggauccagccacu

SEQ ID NO: 1264653 - RNA, 17 nt, Homo sapiens
aggggaugguagaccuu

SEQ ID NO: 1264654 - RNA, 18 nt, Homo sapiens
aggggcaacuguaugaaa

SEQ ID NO: 1264655 - RNA, 13 nt, Homo sapiens
aggggcacuggug

SEQ ID NO: 1264656 - RNA, 22 nt, Homo sapiens
aggggcccaaauucuuucagug

SEQ ID NO: 1264657 - RNA, 11 nt, Homo sapiens
aggggcccaag

SEQ ID NO: 1264658 - RNA, 18 nt, Homo sapiens
aggggcccuggccaggac

SEQ ID NO: 1264659 - RNA, 14 nt, Homo sapiens
aggggcuacuguga

SEQ ID NO: 1264660 - RNA, 17 nt, Homo sapiens
aggggcuccagcaccuu

SEQ ID NO: 1264661 - RNA, 12 nt, Homo sapiens
aggggcucucag

SEQ ID NO: 1264662 - RNA, 13 nt, Homo sapiens
aggggcucuggag

SEQ ID NO: 1264663 - RNA, 13 nt, Homo sapiens
aggggcugcauga

SEQ ID NO: 1264664 - RNA, 18 nt, Homo sapiens
aggggcugggagcugccu

SEQ ID NO: 1264665 - RNA, 21 nt, Homo sapiens
aggggcuguggccgucuccuc

SEQ ID NO: 1264666 - RNA, 21 nt, Homo sapiens
agggggaugccacuccucccu

SEQ ID NO: 1264667 - RNA, 18 nt, Homo sapiens
agggggucugggccagug

SEQ ID NO: 1264668 - RNA, 18 nt, Homo sapiens
agggggugugucugcuca

SEQ ID NO: 1264669 - RNA, 20 nt, Homo sapiens
aggggguuacaaacugcaau

SEQ ID NO: 1264670 - RNA, 17 nt, Homo sapiens
aggggucucauguccug

SEQ ID NO: 1264671 - RNA, 23 nt, Homo sapiens
agggguuugagaugcuguaggug

SEQ ID NO: 1264672 - RNA, 12 nt, Homo sapiens
aggguaauuucc

SEQ ID NO: 1264673 - RNA, 17 nt, Homo sapiens
aggguaccgucuucucc

SEQ ID NO: 1264674 - RNA, 15 nt, Homo sapiens
aggguagggcacaaa

SEQ ID NO: 1264675 - RNA, 14 nt, Homo sapiens
aggguagugcuaag

SEQ ID NO: 1264676 - RNA, 21 nt, Homo sapiens
aggguaugucagugucacugg

SEQ ID NO: 1264677 - RNA, 14 nt, Homo sapiens
aggguccaguggau

SEQ ID NO: 1264678 - RNA, 15 nt, Homo sapiens
agggucccucugugu

SEQ ID NO: 1264679 - RNA, 16 nt, Homo sapiens
agggucccucugugua

SEQ ID NO: 1264680 - RNA, 20 nt, Homo sapiens
aggguccuuuaguaccugaa

SEQ ID NO: 1264681 - RNA, 13 nt, Homo sapiens
agggucucuucag

SEQ ID NO: 1264682 - RNA, 23 nt, Homo sapiens
agggucugcucuuucucugccag

SEQ ID NO: 1264683 - RNA, 18 nt, Homo sapiens
agggucuucccuaccuca

SEQ ID NO: 1264684 - RNA, 19 nt, Homo sapiens
agggucuucuuacaugcau

SEQ ID NO: 1264685 - RNA, 23 nt, Homo sapiens
agggugacccugaagugagcaca

SEQ ID NO: 1264686 - RNA, 14 nt, Homo sapiens
agggugauagucaa

SEQ ID NO: 1264687 - RNA, 23 nt, Homo sapiens
agggugcugacugucaagcaucc

SEQ ID NO: 1264688 - RNA, 18 nt, Homo sapiens
agggugcuuuguguaaua

SEQ ID NO: 1264689 - RNA, 17 nt, Homo sapiens
aggguggucuugaucuc

SEQ ID NO: 1264690 - RNA, 20 nt, Homo sapiens
aggguugggcccagaucugg

SEQ ID NO: 1264691 - RNA, 14 nt, Homo sapiens
agguaaaacagggc

SEQ ID NO: 1264692 - RNA, 13 nt, Homo sapiens
agguaaggccuuu

SEQ ID NO: 1264693 - RNA, 19 nt, Homo sapiens
agguaauccggagugagca

SEQ ID NO: 1264694 - RNA, 14 nt, Homo sapiens
agguaaugugaaua

SEQ ID NO: 1264695 - RNA, 20 nt, Homo sapiens
agguaauguuccugaaaauu

SEQ ID NO: 1264696 - RNA, 14 nt, Homo sapiens
agguacaaguggcu

SEQ ID NO: 1264697 - RNA, 20 nt, Homo sapiens
agguaccagcugcgcuugcu

SEQ ID NO: 1264698 - RNA, 17 nt, Homo sapiens
agguacgaugacagugu

SEQ ID NO: 1264699 - RNA, 20 nt, Homo sapiens
agguagccagggggacuagc

SEQ ID NO: 1264700 - RNA, 18 nt, Homo sapiens
agguagcuuuagggcaau

SEQ ID NO: 1264701 - RNA, 16 nt, Homo sapiens
agguaguuaagggaug

SEQ ID NO: 1264702 - RNA, 21 nt, Homo sapiens
agguauaccuguugagacuga

SEQ ID NO: 1264703 - RNA, 18 nt, Homo sapiens
agguauuagcaaagcaaa

SEQ ID NO: 1264704 - RNA, 20 nt, Homo sapiens
agguauuucuccaguuggga

SEQ ID NO: 1264705 - RNA, 16 nt, Homo sapiens
agguauuuuguaauau

SEQ ID NO: 1264706 - RNA, 17 nt, Homo sapiens
aggucaaaaaucugucc

SEQ ID NO: 1264707 - RNA, 21 nt, Homo sapiens
aggucaaagcaaguuucauca

SEQ ID NO: 1264708 - RNA, 16 nt, Homo sapiens
aggucaaggcugcagu

SEQ ID NO: 1264709 - RNA, 22 nt, Homo sapiens
aggucaaggcugcagugagcca

SEQ ID NO: 1264710 - RNA, 14 nt, Homo sapiens
aggucaaguaagaa

SEQ ID NO: 1264711 - RNA, 12 nt, Homo sapiens
aggucacuggaa

SEQ ID NO: 1264712 - RNA, 15 nt, Homo sapiens
auaagcacugugcua

SEQ ID NO: 1264713 - RNA, 12 nt, Homo sapiens
auaagcagagag

SEQ ID NO: 1264714 - RNA, 18 nt, Homo sapiens
auaagcuaaagaggcuga

SEQ ID NO: 1264715 - RNA, 17 nt, Homo sapiens
auaaguaucacacugua

SEQ ID NO: 1264716 - RNA, 16 nt, Homo sapiens
auaagucaguguuaaa

SEQ ID NO: 1264717 - RNA, 17 nt, Homo sapiens
auaagugcuauugcaga

SEQ ID NO: 1264718 - RNA, 23 nt, Homo sapiens
auaagugggucaaguacaccagc

SEQ ID NO: 1264719 - RNA, 16 nt, Homo sapiens
auaaguuccauguuaa

SEQ ID NO: 1264720 - RNA, 12 nt, Homo sapiens
auaaguuucaua

SEQ ID NO: 1264721 - RNA, 17 nt, Homo sapiens
auaauaauuugcacuua

SEQ ID NO: 1264722 - RNA, 18 nt, Homo sapiens
auaauacauggcuaucau

SEQ ID NO: 1264723 - RNA, 10 nt, Homo sapiens
auaauacucu

SEQ ID NO: 1264724 - RNA, 16 nt, Homo sapiens
auaauagagauaaguc

SEQ ID NO: 1264725 - RNA, 17 nt, Homo sapiens
auaauauauuugcagau

SEQ ID NO: 1264726 - RNA, 16 nt, Homo sapiens
auaauauuagugauuc

SEQ ID NO: 1264727 - RNA, 16 nt, Homo sapiens
auaaucagucaugugu

SEQ ID NO: 1264728 - RNA, 13 nt, Homo sapiens
auaaucagugugu

SEQ ID NO: 1264729 - RNA, 16 nt, Homo sapiens
auaaucagugugucua

SEQ ID NO: 1264730 - RNA, 15 nt, Homo sapiens
auaauccuuucugcc

SEQ ID NO: 1264731 - RNA, 12 nt, Homo sapiens
auaaucuacucc

SEQ ID NO: 1264732 - RNA, 16 nt, Homo sapiens
auaaucuaugaugaag

SEQ ID NO: 1264733 - RNA, 17 nt, Homo sapiens
auaaucuuagagacaaa

SEQ ID NO: 1264734 - RNA, 16 nt, Homo sapiens
auaaugaaauaaucag

SEQ ID NO: 1264735 - RNA, 12 nt, Homo sapiens
auaaugaauacu

SEQ ID NO: 1264736 - RNA, 15 nt, Homo sapiens
auaaugacucagaau

SEQ ID NO: 1264737 - RNA, 16 nt, Homo sapiens
auaaugaggaguuuau

SEQ ID NO: 1264738 - RNA, 13 nt, Homo sapiens
auaaugcaauccu

SEQ ID NO: 1264739 - RNA, 19 nt, Homo sapiens
auaaugcaauccuuagucc

SEQ ID NO: 1264740 - RNA, 11 nt, Homo sapiens
auaaugcacca

SEQ ID NO: 1264741 - RNA, 17 nt, Homo sapiens
auaaugcaugaugaacu

SEQ ID NO: 1264742 - RNA, 20 nt, Homo sapiens
auaaugguuuuuaacaccuu

SEQ ID NO: 1264743 - RNA, 22 nt, Homo sapiens
auaauguuaucuguguagcaag

SEQ ID NO: 1264744 - RNA, 16 nt, Homo sapiens
auaauuaaaaaccacu

SEQ ID NO: 1264745 - RNA, 21 nt, Homo sapiens
auaauuaaauuuugaguucua

SEQ ID NO: 1264746 - RNA, 19 nt, Homo sapiens
auaauucagcacuuaacua

SEQ ID NO: 1264747 - RNA, 22 nt, Homo sapiens
auaauucagcacuuaacuauga

SEQ ID NO: 1264748 - RNA, 15 nt, Homo sapiens
auaauucccuaucuu

SEQ ID NO: 1264749 - RNA, 18 nt, Homo sapiens
auaauucuaaucuaacaa

SEQ ID NO: 1264750 - RNA, 23 nt, Homo sapiens
auaauugcuuuuucacagucacu

SEQ ID NO: 1264751 - RNA, 15 nt, Homo sapiens
auaauuggaguagau

SEQ ID NO: 1264752 - RNA, 21 nt, Homo sapiens
auaauuuaacuguguuuuagg

SEQ ID NO: 1264753 - RNA, 15 nt, Homo sapiens
auaauuuaacuucag

SEQ ID NO: 1264754 - RNA, 16 nt, Homo sapiens
auaauuuaccuaagau

SEQ ID NO: 1264755 - RNA, 17 nt, Homo sapiens
auaauuucaaaccacac

SEQ ID NO: 1264756 - RNA, 14 nt, Homo sapiens
auaauuucuaaugu

SEQ ID NO: 1264757 - RNA, 15 nt, Homo sapiens
auaauuuucauucau

SEQ ID NO: 1264758 - RNA, 20 nt, Homo sapiens
auaauuuucauucauucacu

SEQ ID NO: 1264759 - RNA, 17 nt, Homo sapiens
auacaaaccuaccaaaa

SEQ ID NO: 1264760 - RNA, 15 nt, Homo sapiens
auacaaagcaguuua

SEQ ID NO: 1264761 - RNA, 13 nt, Homo sapiens
auacaauuccaaa

SEQ ID NO: 1264762 - RNA, 19 nt, Homo sapiens
auacaauuccaaacacaua

SEQ ID NO: 1264763 - RNA, 22 nt, Homo sapiens
auacacacacacgcgugcacac

SEQ ID NO: 1264764 - RNA, 12 nt, Homo sapiens
auacacacuguu

SEQ ID NO: 1264765 - RNA, 17 nt, Homo sapiens
auacacacuguugucaa

SEQ ID NO: 1264766 - RNA, 14 nt, Homo sapiens
auacacaguacuuu

SEQ ID NO: 1264767 - RNA, 23 nt, Homo sapiens
auacacccccaccuccugcaaua

SEQ ID NO: 1264768 - RNA, 15 nt, Homo sapiens
auacacuaugaagau

SEQ ID NO: 1264769 - RNA, 22 nt, Homo sapiens
auacacugaaguuaacagagac

SEQ ID NO: 1264770 - RNA, 21 nt, Homo sapiens
auacacuuuuuaaaaucucaa

SEQ ID NO: 1264771 - RNA, 14 nt, Homo sapiens
auacagauuuuacc

SEQ ID NO: 1264772 - RNA, 15 nt, Homo sapiens
auacagcacuuugac

SEQ ID NO: 1264773 - RNA, 18 nt, Homo sapiens
auacaguaagcugcucua

SEQ ID NO: 1264774 - RNA, 19 nt, Homo sapiens
auacaguguaggcauuuaa

SEQ ID NO: 1264775 - RNA, 12 nt, Homo sapiens
auacagugucug

SEQ ID NO: 1264776 - RNA, 17 nt, Homo sapiens
auacauaaguuuaggau

SEQ ID NO: 1264777 - RNA, 19 nt, Homo sapiens
auacauacggucagguuua

SEQ ID NO: 1264778 - RNA, 17 nt, Homo sapiens
auacauaucuuuauuaa

SEQ ID NO: 1264779 - RNA, 19 nt, Homo sapiens
auacauauguagacuauau

SEQ ID NO: 1264780 - RNA, 15 nt, Homo sapiens
auacauauuaucuca

SEQ ID NO: 1264781 - RNA, 13 nt, Homo sapiens
auacaugcuacuu

SEQ ID NO: 1264782 - RNA, 18 nt, Homo sapiens
auacaugcugcuaauuca

SEQ ID NO: 1264783 - RNA, 14 nt, Homo sapiens
auacauguguguau

SEQ ID NO: 1264784 - RNA, 15 nt, Homo sapiens
auacauguguguaua

SEQ ID NO: 1264785 - RNA, 20 nt, Homo sapiens
auacauucuuuaucuugaca

SEQ ID NO: 1264786 - RNA, 20 nt, Homo sapiens
auacauuucaauuauacuaa

SEQ ID NO: 1264787 - RNA, 17 nt, Homo sapiens
auacauuugaggggaaa

SEQ ID NO: 1264788 - RNA, 21 nt, Homo sapiens
auacauuuguugguaacuaau

SEQ ID NO: 1264789 - RNA, 22 nt, Homo sapiens
auacauuuucuggugggccuua

SEQ ID NO: 1264790 - RNA, 20 nt, Homo sapiens
auacauuuuuagaaaucaca

SEQ ID NO: 1264791 - RNA, 18 nt, Homo sapiens
auaccaaagccaauaaau

SEQ ID NO: 1264792 - RNA, 10 nt, Homo sapiens
auaccacagc

SEQ ID NO: 1264793 - RNA, 13 nt, Homo sapiens
auaccaccuuuac

SEQ ID NO: 1264794 - RNA, 16 nt, Homo sapiens
auaccaccuuuacugu

SEQ ID NO: 1264795 - RNA, 18 nt, Homo sapiens
auaccauggcacugacaa

SEQ ID NO: 1264796 - RNA, 22 nt, Homo sapiens
auaccauggcacugacaauggg

SEQ ID NO: 1264797 - RNA, 15 nt, Homo sapiens
auaccauuuccucag

SEQ ID NO: 1264798 - RNA, 21 nt, Homo sapiens
auacccuccuuccaccaaguu

SEQ ID NO: 1264799 - RNA, 20 nt, Homo sapiens
auacccuggagcaagaccug

SEQ ID NO: 1264800 - RNA, 13 nt, Homo sapiens
auaccuggcuuuu

SEQ ID NO: 1264801 - RNA, 15 nt, Homo sapiens
auaccuuccccacau

SEQ ID NO: 1264802 - RNA, 13 nt, Homo sapiens
auacgagagacuu

SEQ ID NO: 1264803 - RNA, 17 nt, Homo sapiens
auacgauuugagccuga

SEQ ID NO: 1264804 - RNA, 19 nt, Homo sapiens
auacgcucaggugguugug

SEQ ID NO: 1264805 - RNA, 18 nt, Homo sapiens
auacuaaaccagcauacc

SEQ ID NO: 1264806 - RNA, 12 nt, Homo sapiens
auacuaccucug

SEQ ID NO: 1264807 - RNA, 13 nt, Homo sapiens
auacuagaauuca

SEQ ID NO: 1264808 - RNA, 16 nt, Homo sapiens
auacuagggagccauu

SEQ ID NO: 1264809 - RNA, 16 nt, Homo sapiens
auacuauccaguuacu

SEQ ID NO: 1264810 - RNA, 23 nt, Homo sapiens
auacuauuuaauuauuucacuuu

SEQ ID NO: 1264811 - RNA, 14 nt, Homo sapiens
auacucacugaguc

SEQ ID NO: 1264812 - RNA, 12 nt, Homo sapiens
auacucugcuau

SEQ ID NO: 1264813 - RNA, 19 nt, Homo sapiens
auacugcggaccaagggac

SEQ ID NO: 1264814 - RNA, 15 nt, Homo sapiens
auacugcuacuguaa

SEQ ID NO: 1264815 - RNA, 15 nt, Homo sapiens
auacuggggcuuccu

SEQ ID NO: 1264816 - RNA, 22 nt, Homo sapiens
auacuguaaaugcauuggaaua

SEQ ID NO: 1264817 - RNA, 19 nt, Homo sapiens
auacuguaacauucaggaa

SEQ ID NO: 1264818 - RNA, 23 nt, Homo sapiens
auacuguuuuacuguccaaagac

SEQ ID NO: 1264819 - RNA, 13 nt, Homo sapiens
auacuucauuaaa

SEQ ID NO: 1264820 - RNA, 13 nt, Homo sapiens
auacuuuacaugg

SEQ ID NO: 1264821 - RNA, 16 nt, Homo sapiens
auacuuugcaauccaa

SEQ ID NO: 1264822 - RNA, 18 nt, Homo sapiens
auacuuuggggacuugua

SEQ ID NO: 1264823 - RNA, 19 nt, Homo sapiens
auacuuuuacucugccuac

SEQ ID NO: 1264824 - RNA, 12 nt, Homo sapiens
auacuuuuggcu

SEQ ID NO: 1264825 - RNA, 19 nt, Homo sapiens
auacuuuuggcuccucuag

SEQ ID NO: 1264826 - RNA, 21 nt, Homo sapiens
auacuuuugugaacaaaaauu

SEQ ID NO: 1264827 - RNA, 21 nt, Homo sapiens
auagaaagcuucaauagaacu

SEQ ID NO: 1264828 - RNA, 23 nt, Homo sapiens
auagaaauuguaaaucagagguu

SEQ ID NO: 1264829 - RNA, 19 nt, Homo sapiens
auagaacaggcugaaauuu

SEQ ID NO: 1264830 - RNA, 20 nt, Homo sapiens
auagaacucugggcugccau

SEQ ID NO: 1264831 - RNA, 19 nt, Homo sapiens
auagaagcaaaugacaaaa

SEQ ID NO: 1264832 - RNA, 18 nt, Homo sapiens
auagaauaaaauauaauu

SEQ ID NO: 1264833 - RNA, 18 nt, Homo sapiens
auagacacugaucuggcu

SEQ ID NO: 1264834 - RNA, 12 nt, Homo sapiens
auagacauguag

SEQ ID NO: 1264835 - RNA, 16 nt, Homo sapiens
auagagcccagugagg

SEQ ID NO: 1264836 - RNA, 23 nt, Homo sapiens
auagagcuuuuaaaaauguccug

SEQ ID NO: 1264837 - RNA, 12 nt, Homo sapiens
auagaggcuagc

SEQ ID NO: 1264838 - RNA, 21 nt, Homo sapiens
auagagguucuuuauugcuca

SEQ ID NO: 1264839 - RNA, 22 nt, Homo sapiens
auuuucaagagucuaauagucu

SEQ ID NO: 1264840 - RNA, 19 nt, Homo sapiens
auuuucagugcaucauuac

SEQ ID NO: 1264841 - RNA, 22 nt, Homo sapiens
auuuucccccacuacugcagca

SEQ ID NO: 1264842 - RNA, 18 nt, Homo sapiens
auuuuccccuagcuuucc

SEQ ID NO: 1264843 - RNA, 16 nt, Homo sapiens
auuuuccuccaggcaa

SEQ ID NO: 1264844 - RNA, 17 nt, Homo sapiens
auuuuccuccaggcaaa

SEQ ID NO: 1264845 - RNA, 14 nt, Homo sapiens
auuuucuacaauua

SEQ ID NO: 1264846 - RNA, 19 nt, Homo sapiens
auuuucuagauaccacuua

SEQ ID NO: 1264847 - RNA, 21 nt, Homo sapiens
auuuucuagauuuucuacuuu

SEQ ID NO: 1264848 - RNA, 17 nt, Homo sapiens
auuuucuccccuuggca

SEQ ID NO: 1264849 - RNA, 18 nt, Homo sapiens
auuuucucccuuuaugua

SEQ ID NO: 1264850 - RNA, 22 nt, Homo sapiens
auuuucucuauacauagagcuc

SEQ ID NO: 1264851 - RNA, 14 nt, Homo sapiens
auuuucugcauuau

SEQ ID NO: 1264852 - RNA, 12 nt, Homo sapiens
auuuucugucag

SEQ ID NO: 1264853 - RNA, 15 nt, Homo sapiens
auuuucuuaaaccaa

SEQ ID NO: 1264854 - RNA, 16 nt, Homo sapiens
auuuucuucucugcac

SEQ ID NO: 1264855 - RNA, 20 nt, Homo sapiens
auuuucuucucugcacuuau

SEQ ID NO: 1264856 - RNA, 21 nt, Homo sapiens
auuuugaaauauaguaaacac

SEQ ID NO: 1264857 - RNA, 15 nt, Homo sapiens
auuuugaagugcugu

SEQ ID NO: 1264858 - RNA, 12 nt, Homo sapiens
auuuugacuuaa

SEQ ID NO: 1264859 - RNA, 20 nt, Homo sapiens
auuuugaguucuacauaagu

SEQ ID NO: 1264860 - RNA, 12 nt, Homo sapiens
auuuugcaaaua

SEQ ID NO: 1264861 - RNA, 15 nt, Homo sapiens
auuuugccugcaaca

SEQ ID NO: 1264862 - RNA, 14 nt, Homo sapiens
auuuuggcauugua

SEQ ID NO: 1264863 - RNA, 20 nt, Homo sapiens
auuuugggacuucuacccag

SEQ ID NO: 1264864 - RNA, 15 nt, Homo sapiens
auuuuggggucucuu

SEQ ID NO: 1264865 - RNA, 19 nt, Homo sapiens
auuuugggguuguguuguc

SEQ ID NO: 1264866 - RNA, 14 nt, Homo sapiens
auuuugucuaccau

SEQ ID NO: 1264867 - RNA, 23 nt, Homo sapiens
auuuugugaauugugacauaaua

SEQ ID NO: 1264868 - RNA, 22 nt, Homo sapiens
auuuugugaauuugggacauaa

SEQ ID NO: 1264869 - RNA, 24 nt, Homo sapiens
auuuugugaauuugggacauaaua

SEQ ID NO: 1264870 - RNA, 17 nt, Homo sapiens
auuuugugaugaugcug

SEQ ID NO: 1264871 - RNA, 23 nt, Homo sapiens
auuuuguucuuuuuucuuaccac

SEQ ID NO: 1264872 - RNA, 19 nt, Homo sapiens
auuuuuaaggauguugcca

SEQ ID NO: 1264873 - RNA, 16 nt, Homo sapiens
auuuuuagacagaguc

SEQ ID NO: 1264874 - RNA, 17 nt, Homo sapiens
auuuuuagacucaucaa

SEQ ID NO: 1264875 - RNA, 22 nt, Homo sapiens
auuuuucacugccccagacaca

SEQ ID NO: 1264876 - RNA, 12 nt, Homo sapiens
auuuuucacugu

SEQ ID NO: 1264877 - RNA, 20 nt, Homo sapiens
auuuuucacuguacauuaua

SEQ ID NO: 1264878 - RNA, 23 nt, Homo sapiens
auuuuucacuuugcucucaauua

SEQ ID NO: 1264879 - RNA, 14 nt, Homo sapiens
auuuuuccacuuaa

SEQ ID NO: 1264880 - RNA, 22 nt, Homo sapiens
auuuuuccugcuguauccagaa

SEQ ID NO: 1264881 - RNA, 13 nt, Homo sapiens
auuuuucuaucaa

SEQ ID NO: 1264882 - RNA, 16 nt, Homo sapiens
auuuuucuaucaaaua

SEQ ID NO: 1264883 - RNA, 12 nt, Homo sapiens
auuuuucugcac

SEQ ID NO: 1264884 - RNA, 21 nt, Homo sapiens
auuuuuggggaaaaaagcaca

SEQ ID NO: 1264885 - RNA, 20 nt, Homo sapiens
auuuuuguuucuuccaaagc

SEQ ID NO: 1264886 - RNA, 19 nt, Homo sapiens
auuuuuguuuuauccacaa

SEQ ID NO: 1264887 - RNA, 23 nt, Homo sapiens
auuuuuguuuuuguaaugcacug

SEQ ID NO: 1264888 - RNA, 22 nt, Homo sapiens
auuuuuuaaaucauauuaaaau

SEQ ID NO: 1264889 - RNA, 17 nt, Homo sapiens
auuuuuuaaggaaacaa

SEQ ID NO: 1264890 - RNA, 20 nt, Homo sapiens
auuuuuuaguauaaguacau

SEQ ID NO: 1264891 - RNA, 14 nt, Homo sapiens
auuuuuucccccac

SEQ ID NO: 1264892 - RNA, 19 nt, Homo sapiens
auuuuuucgugcacucugc

SEQ ID NO: 1264893 - RNA, 16 nt, Homo sapiens
auuuuuugaaaguuaa

SEQ ID NO: 1264894 - RNA, 14 nt, Homo sapiens
auuuuuugaacuuu

SEQ ID NO: 1264895 - RNA, 15 nt, Homo sapiens
auuuuuuugagacag

SEQ ID NO: 1264896 - RNA, 14 nt, Homo sapiens
caaaaaaaaaagca

SEQ ID NO: 1264897 - RNA, 16 nt, Homo sapiens
caaaaaaagagaacac

SEQ ID NO: 1264898 - RNA, 24 nt, Homo sapiens
caaaaaacauuguuuuguguaaca

SEQ ID NO: 1264899 - RNA, 16 nt, Homo sapiens
caaaaaauugcuccua

SEQ ID NO: 1264900 - RNA, 13 nt, Homo sapiens
caaaaaauuugag

SEQ ID NO: 1264901 - RNA, 16 nt, Homo sapiens
caaaaacguaucuccu

SEQ ID NO: 1264902 - RNA, 23 nt, Homo sapiens
caaaaagaaaucuugucuuacca

SEQ ID NO: 1264903 - RNA, 22 nt, Homo sapiens
caaaaagaugaccuuugucuca

SEQ ID NO: 1264904 - RNA, 18 nt, Homo sapiens
caaaaagccacaaugaac

SEQ ID NO: 1264905 - RNA, 21 nt, Homo sapiens
caaaaaguuuaucacacagug

SEQ ID NO: 1264906 - RNA, 17 nt, Homo sapiens
caaaaauagacaacugu

SEQ ID NO: 1264907 - RNA, 19 nt, Homo sapiens
caaaaaugaaauccaguga

SEQ ID NO: 1264908 - RNA, 12 nt, Homo sapiens
caaaaaugaacu

SEQ ID NO: 1264909 - RNA, 22 nt, Homo sapiens
caaaaaugaacugaaguuucac

SEQ ID NO: 1264910 - RNA, 13 nt, Homo sapiens
caaaaauguaaug

SEQ ID NO: 1264911 - RNA, 15 nt, Homo sapiens
caaaaauuacaaaga

SEQ ID NO: 1264912 - RNA, 22 nt, Homo sapiens
caaaaauuacaaagaaccaugc

SEQ ID NO: 1264913 - RNA, 17 nt, Homo sapiens
caaaacaaacaugcagu

SEQ ID NO: 1264914 - RNA, 19 nt, Homo sapiens
caaaacacacuacuaccuc

SEQ ID NO: 1264915 - RNA, 11 nt, Homo sapiens
caaaacacagg

SEQ ID NO: 1264916 - RNA, 13 nt, Homo sapiens
caaaacacugugg

SEQ ID NO: 1264917 - RNA, 17 nt, Homo sapiens
caaaacagaaaaugaag

SEQ ID NO: 1264918 - RNA, 17 nt, Homo sapiens
caaaacauuuuacuuua

SEQ ID NO: 1264919 - RNA, 15 nt, Homo sapiens
caaaacccacagaag

SEQ ID NO: 1264920 - RNA, 16 nt, Homo sapiens
caaaacccacagaaga

SEQ ID NO: 1264921 - RNA, 14 nt, Homo sapiens
caaaaccuugcaca

SEQ ID NO: 1264922 - RNA, 18 nt, Homo sapiens
caaaacgcuacugaguca

SEQ ID NO: 1264923 - RNA, 15 nt, Homo sapiens
caaaacuaauuuccu

SEQ ID NO: 1264924 - RNA, 14 nt, Homo sapiens
caaaacuacaaauc

SEQ ID NO: 1264925 - RNA, 15 nt, Homo sapiens
caaaacuacaugaga

SEQ ID NO: 1264926 - RNA, 22 nt, Homo sapiens
caaaacucuccuacacuuccau

SEQ ID NO: 1264927 - RNA, 14 nt, Homo sapiens
caaaacucuuucau

SEQ ID NO: 1264928 - RNA, 15 nt, Homo sapiens
caaaacugacaguaa

SEQ ID NO: 1264929 - RNA, 17 nt, Homo sapiens
caaaacugacaguaaau

SEQ ID NO: 1264930 - RNA, 22 nt, Homo sapiens
caaaacuucuugucagacauaa

SEQ ID NO: 1264931 - RNA, 20 nt, Homo sapiens
caaaagaagacaacauuucu

SEQ ID NO: 1264932 - RNA, 22 nt, Homo sapiens
caaaagaagacaacauuucuca

SEQ ID NO: 1264933 - RNA, 23 nt, Homo sapiens
caaaagagcauggaugcauuuca

SEQ ID NO: 1264934 - RNA, 16 nt, Homo sapiens
caaaagaugccauuca

SEQ ID NO: 1264935 - RNA, 12 nt, Homo sapiens
caaaagauguau

SEQ ID NO: 1264936 - RNA, 22 nt, Homo sapiens
caaaagcaagacuguugcucaa

SEQ ID NO: 1264937 - RNA, 12 nt, Homo sapiens
caaaagcacuua

SEQ ID NO: 1264938 - RNA, 19 nt, Homo sapiens
caaaagcacuuugugcugu

SEQ ID NO: 1264939 - RNA, 20 nt, Homo sapiens
caaaaggaacaaaaauuaca

SEQ ID NO: 1264940 - RNA, 15 nt, Homo sapiens
caaaaggcagcucac

SEQ ID NO: 1264941 - RNA, 16 nt, Homo sapiens
caaaaggcagcucacc

SEQ ID NO: 1264942 - RNA, 14 nt, Homo sapiens
caaaaggcugagaa

SEQ ID NO: 1264943 - RNA, 11 nt, Homo sapiens
caaaaguagag

SEQ ID NO: 1264944 - RNA, 18 nt, Homo sapiens
caaaaguuucuuacucaa

SEQ ID NO: 1264945 - RNA, 13 nt, Homo sapiens
caaaauaaguguu

SEQ ID NO: 1264946 - RNA, 20 nt, Homo sapiens
caaaauaaugcaccacuuuu

SEQ ID NO: 1264947 - RNA, 16 nt, Homo sapiens
caaaauacagcacuuu

SEQ ID NO: 1264948 - RNA, 19 nt, Homo sapiens
caaaauacagcacuuugac

SEQ ID NO: 1264949 - RNA, 15 nt, Homo sapiens
caaaauauacauuca

SEQ ID NO: 1264950 - RNA, 21 nt, Homo sapiens
caaaauauauuuuguuuacaa

SEQ ID NO: 1264951 - RNA, 19 nt, Homo sapiens
caaaauccaagauucugcu

SEQ ID NO: 1264952 - RNA, 17 nt, Homo sapiens
caaaaugaauucuggga

SEQ ID NO: 1264953 - RNA, 17 nt, Homo sapiens
caaaaugcuucugcaca

SEQ ID NO: 1264954 - RNA, 23 nt, Homo sapiens
caaaaugcuucugcacacaaaac

SEQ ID NO: 1264955 - RNA, 13 nt, Homo sapiens
caaaaugucucuu

SEQ ID NO: 1264956 - RNA, 22 nt, Homo sapiens
caaaaugucucuuguggcccau

SEQ ID NO: 1264957 - RNA, 21 nt, Homo sapiens
caaaauuaagcaaauguuaaa

SEQ ID NO: 1264958 - RNA, 14 nt, Homo sapiens
caaaauuaauauga

SEQ ID NO: 1264959 - RNA, 13 nt, Homo sapiens
caaaauugaugug

SEQ ID NO: 1264960 - RNA, 12 nt, Homo sapiens
caaaauugcuaa

SEQ ID NO: 1264961 - RNA, 14 nt, Homo sapiens
caaacaaauaugca

SEQ ID NO: 1264962 - RNA, 19 nt, Homo sapiens
caaacaagaggacuguguu

SEQ ID NO: 1264963 - RNA, 18 nt, Homo sapiens
caaacacaggauuuguaa

SEQ ID NO: 1264964 - RNA, 16 nt, Homo sapiens
caaacacuuacagaau

SEQ ID NO: 1264965 - RNA, 14 nt, Homo sapiens
caauguguucuuaa

SEQ ID NO: 1264966 - RNA, 22 nt, Homo sapiens
caauguugcuuaggaugugugc

SEQ ID NO: 1264967 - RNA, 17 nt, Homo sapiens
caauuaaagguccugcc

SEQ ID NO: 1264968 - RNA, 15 nt, Homo sapiens
caauuaagcagcuug

SEQ ID NO: 1264969 - RNA, 18 nt, Homo sapiens
caauuacaacagugagaa

SEQ ID NO: 1264970 - RNA, 18 nt, Homo sapiens
caauuacagggugacuca

SEQ ID NO: 1264971 - RNA, 15 nt, Homo sapiens
caauuagcauucugu

SEQ ID NO: 1264972 - RNA, 23 nt, Homo sapiens
caauuaggauuuugaugugacaa

SEQ ID NO: 1264973 - RNA, 18 nt, Homo sapiens
caauuauauuuauauuuc

SEQ ID NO: 1264974 - RNA, 17 nt, Homo sapiens
caauuauuuauuucaug

SEQ ID NO: 1264975 - RNA, 17 nt, Homo sapiens
caauucaccaacacagu

SEQ ID NO: 1264976 - RNA, 16 nt, Homo sapiens
caauucauuucucuau

SEQ ID NO: 1264977 - RNA, 16 nt, Homo sapiens
caauuccaacuuucag

SEQ ID NO: 1264978 - RNA, 15 nt, Homo sapiens
caauucccauugcau

SEQ ID NO: 1264979 - RNA, 16 nt, Homo sapiens
caauuccucugaacaa

SEQ ID NO: 1264980 - RNA, 18 nt, Homo sapiens
caauuguccccagggaca

SEQ ID NO: 1264981 - RNA, 20 nt, Homo sapiens
caauugucuauuuaucuuuu

SEQ ID NO: 1264982 - RNA, 19 nt, Homo sapiens
caauuguguauaacuggau

SEQ ID NO: 1264983 - RNA, 17 nt, Homo sapiens
caauuuaaaaagcaaaa

SEQ ID NO: 1264984 - RNA, 23 nt, Homo sapiens
caauuuauaaugaauacuuucuu

SEQ ID NO: 1264985 - RNA, 16 nt, Homo sapiens
caauuucaagguucua

SEQ ID NO: 1264986 - RNA, 13 nt, Homo sapiens
caauuucuuccuu

SEQ ID NO: 1264987 - RNA, 22 nt, Homo sapiens
caauuugagccagagagcaucu

SEQ ID NO: 1264988 - RNA, 21 nt, Homo sapiens
caauuuggacuggugugcucu

SEQ ID NO: 1264989 - RNA, 21 nt, Homo sapiens
caauuugguaaaaaugcugcu

SEQ ID NO: 1264990 - RNA, 19 nt, Homo sapiens
caauuuguuaguuccugua

SEQ ID NO: 1264991 - RNA, 23 nt, Homo sapiens
caauuuuaauugauuauucugau

SEQ ID NO: 1264992 - RNA, 12 nt, Homo sapiens
caauuuuuccau

SEQ ID NO: 1264993 - RNA, 21 nt, Homo sapiens
cacaaaaguccacugaugcaa

SEQ ID NO: 1264994 - RNA, 14 nt, Homo sapiens
cacaaaauucuuau

SEQ ID NO: 1264995 - RNA, 20 nt, Homo sapiens
cacaaaccacaacugacaca

SEQ ID NO: 1264996 - RNA, 15 nt, Homo sapiens
cacaaacuccaucca

SEQ ID NO: 1264997 - RNA, 14 nt, Homo sapiens
cacaaauagaguuu

SEQ ID NO: 1264998 - RNA, 13 nt, Homo sapiens
cacaaaugcauga

SEQ ID NO: 1264999 - RNA, 22 nt, Homo sapiens
cacaaaugguggguacaaaaag

SEQ ID NO: 1265000 - RNA, 13 nt, Homo sapiens
cacaacagugaaa

SEQ ID NO: 1265001 - RNA, 15 nt, Homo sapiens
cacaacguaaaaaua

SEQ ID NO: 1265002 - RNA, 16 nt, Homo sapiens
cacaacugacacagga

SEQ ID NO: 1265003 - RNA, 18 nt, Homo sapiens
cacaacugcaauaacuuc

SEQ ID NO: 1265004 - RNA, 21 nt, Homo sapiens
cacaacuuggguucuucucag

SEQ ID NO: 1265005 - RNA, 16 nt, Homo sapiens
cacaagcaaugcaaga

SEQ ID NO: 1265006 - RNA, 17 nt, Homo sapiens
cacaagcagagugcaca

SEQ ID NO: 1265007 - RNA, 15 nt, Homo sapiens
cacaagcaugaagug

SEQ ID NO: 1265008 - RNA, 22 nt, Homo sapiens
cacaagccacaagucuuccaga

SEQ ID NO: 1265009 - RNA, 16 nt, Homo sapiens
cacaagccugagaacu

SEQ ID NO: 1265010 - RNA, 21 nt, Homo sapiens
cacaaggcugaccaagagaga

SEQ ID NO: 1265011 - RNA, 14 nt, Homo sapiens
cacaaguccuguga

SEQ ID NO: 1265012 - RNA, 12 nt, Homo sapiens
cacaauccucca

SEQ ID NO: 1265013 - RNA, 17 nt, Homo sapiens
cacaauccuccugggga

SEQ ID NO: 1265014 - RNA, 15 nt, Homo sapiens
cacaaugaugaugau

SEQ ID NO: 1265015 - RNA, 20 nt, Homo sapiens
cacaauuuuaauucaaaaga

SEQ ID NO: 1265016 - RNA, 21 nt, Homo sapiens
cacacaaaaagugucucugcc

SEQ ID NO: 1265017 - RNA, 13 nt, Homo sapiens
cacacacacaaac

SEQ ID NO: 1265018 - RNA, 13 nt, Homo sapiens
cacacacaugcac

SEQ ID NO: 1265019 - RNA, 13 nt, Homo sapiens
cacacaccacaca

SEQ ID NO: 1265020 - RNA, 13 nt, Homo sapiens
cacacacgaugca

SEQ ID NO: 1265021 - RNA, 14 nt, Homo sapiens
cacacacgaugcau

SEQ ID NO: 1265022 - RNA, 12 nt, Homo sapiens
cacacacgcacg

SEQ ID NO: 1265023 - RNA, 20 nt, Homo sapiens
cacacaguauuacuucugcu

SEQ ID NO: 1265024 - RNA, 21 nt, Homo sapiens
cacacagugaaacgcaauuuu

SEQ ID NO: 1265025 - RNA, 15 nt, Homo sapiens
cacacaguguuuuaa

SEQ ID NO: 1265026 - RNA, 11 nt, Homo sapiens
cacaccacagc

SEQ ID NO: 1265027 - RNA, 16 nt, Homo sapiens
cacacccgugagaaau

SEQ ID NO: 1265028 - RNA, 15 nt, Homo sapiens
cacaccugggcauuu

SEQ ID NO: 1265029 - RNA, 22 nt, Homo sapiens
cacaccugggcauuuggugaga

SEQ ID NO: 1265030 - RNA, 19 nt, Homo sapiens
cacaccugugccuccucag

SEQ ID NO: 1265031 - RNA, 15 nt, Homo sapiens
cacaccuuccagggc

SEQ ID NO: 1265032 - RNA, 16 nt, Homo sapiens
cacacgaugcauuuaa

SEQ ID NO: 1265033 - RNA, 17 nt, Homo sapiens
cacacgaugcauuuaau

SEQ ID NO: 1265034 - RNA, 16 nt, Homo sapiens
cacacgcgugcacaca

SEQ ID NO: 1265035 - RNA, 22 nt, Homo sapiens
cacacgcuuucuuaugcaaucu

SEQ ID NO: 1265036 - RNA, 14 nt, Homo sapiens
cacacguacuuaaa

SEQ ID NO: 1265037 - RNA, 16 nt, Homo sapiens
cacacguuugugagcu

SEQ ID NO: 1265038 - RNA, 17 nt, Homo sapiens
cacacguuugugagcuc

SEQ ID NO: 1265039 - RNA, 15 nt, Homo sapiens
cacacucacagaugu

SEQ ID NO: 1265040 - RNA, 15 nt, Homo sapiens
cacacucuucaguga

SEQ ID NO: 1265041 - RNA, 16 nt, Homo sapiens
cacacugaaaccaaaa

SEQ ID NO: 1265042 - RNA, 17 nt, Homo sapiens
cacacugaguucuauca

SEQ ID NO: 1265043 - RNA, 14 nt, Homo sapiens
cacacuguauauaa

SEQ ID NO: 1265044 - RNA, 14 nt, Homo sapiens
cacacuuggaugca

SEQ ID NO: 1265045 - RNA, 20 nt, Homo sapiens
cacacuuggaugcaggguuu

SEQ ID NO: 1265046 - RNA, 17 nt, Homo sapiens
cacacuugguccaucca

SEQ ID NO: 1265047 - RNA, 20 nt, Homo sapiens
cacagaaauauauauacaua

SEQ ID NO: 1265048 - RNA, 18 nt, Homo sapiens
cacagacacaauauguau

SEQ ID NO: 1265049 - RNA, 19 nt, Homo sapiens
cacagacacuacauaucua

SEQ ID NO: 1265050 - RNA, 16 nt, Homo sapiens
cacagacccacaagag

SEQ ID NO: 1265051 - RNA, 20 nt, Homo sapiens
cacagacgccuuacuggcaa

SEQ ID NO: 1265052 - RNA, 20 nt, Homo sapiens
cacagagaagcggauuucca

SEQ ID NO: 1265053 - RNA, 13 nt, Homo sapiens
cacagaggcugcc

SEQ ID NO: 1265054 - RNA, 14 nt, Homo sapiens
cacagagugcugga

SEQ ID NO: 1265055 - RNA, 18 nt, Homo sapiens
cacagaugauacuuccaa

SEQ ID NO: 1265056 - RNA, 19 nt, Homo sapiens
cacagaugugaaaugaaug

SEQ ID NO: 1265057 - RNA, 20 nt, Homo sapiens
cacagcaagacuccgucuca

SEQ ID NO: 1265058 - RNA, 20 nt, Homo sapiens
cacagcaaggaaauucaccu

SEQ ID NO: 1265059 - RNA, 13 nt, Homo sapiens
cacagcacagcca

SEQ ID NO: 1265060 - RNA, 17 nt, Homo sapiens
cacagcaggacuccauc

SEQ ID NO: 1265061 - RNA, 18 nt, Homo sapiens
cacagcauguguauuucc

SEQ ID NO: 1265062 - RNA, 16 nt, Homo sapiens
cacagcccccuccuca

SEQ ID NO: 1265063 - RNA, 17 nt, Homo sapiens
cacagcggagucugucc

SEQ ID NO: 1265064 - RNA, 17 nt, Homo sapiens
cacagcucuguguugcc

SEQ ID NO: 1265065 - RNA, 17 nt, Homo sapiens
cacagcucuucauucca

SEQ ID NO: 1265066 - RNA, 23 nt, Homo sapiens
cacagcugagagacuuuuaauca

SEQ ID NO: 1265067 - RNA, 18 nt, Homo sapiens
cacagcuggagcucugag

SEQ ID NO: 1265068 - RNA, 21 nt, Homo sapiens
cacagcuuagaagugcuauaa

SEQ ID NO: 1265069 - RNA, 13 nt, Homo sapiens
cacagcuuucaaa

SEQ ID NO: 1265070 - RNA, 18 nt, Homo sapiens
cacaggacaacuuuacaa

SEQ ID NO: 1265071 - RNA, 19 nt, Homo sapiens
cacaggacugaaaagggaa

SEQ ID NO: 1265072 - RNA, 22 nt, Homo sapiens
cacaggagacacugugcuauaa

SEQ ID NO: 1265073 - RNA, 18 nt, Homo sapiens
cacaggcaaaacucagua

SEQ ID NO: 1265074 - RNA, 19 nt, Homo sapiens
cacaggcagugcaugugaa

SEQ ID NO: 1265075 - RNA, 17 nt, Homo sapiens
cacaggcgaggacccug

SEQ ID NO: 1265076 - RNA, 20 nt, Homo sapiens
cacaggcuaucaacauguua

SEQ ID NO: 1265077 - RNA, 14 nt, Homo sapiens
cacaggcuguaaau

SEQ ID NO: 1265078 - RNA, 20 nt, Homo sapiens
cacaggcuguaaauugaacu

SEQ ID NO: 1265079 - RNA, 15 nt, Homo sapiens
cacagggaacaggaa

SEQ ID NO: 1265080 - RNA, 17 nt, Homo sapiens
cacagggcccgcagugc

SEQ ID NO: 1265081 - RNA, 19 nt, Homo sapiens
cacagggcccgcagugcug

SEQ ID NO: 1265082 - RNA, 16 nt, Homo sapiens
cacagggcggugcuag

SEQ ID NO: 1265083 - RNA, 18 nt, Homo sapiens
cacaggggcccauggacu

SEQ ID NO: 1265084 - RNA, 20 nt, Homo sapiens
cacagucacugauguacaau

SEQ ID NO: 1265085 - RNA, 15 nt, Homo sapiens
cacagugaauccaga

SEQ ID NO: 1265086 - RNA, 17 nt, Homo sapiens
cacaguguaaucucuau

SEQ ID NO: 1265087 - RNA, 11 nt, Homo sapiens
cacagugucug

SEQ ID NO: 1265088 - RNA, 14 nt, Homo sapiens
cacagugugcucca

SEQ ID NO: 1265089 - RNA, 19 nt, Homo sapiens
cacagugugugacuuacag

SEQ ID NO: 1265090 - RNA, 13 nt, Homo sapiens
cacaguguuuuaa

SEQ ID NO: 1265091 - RNA, 14 nt, Homo sapiens
cagacuacacagga

SEQ ID NO: 1265092 - RNA, 21 nt, Homo sapiens
cagacucuacagaggccaugg

SEQ ID NO: 1265093 - RNA, 13 nt, Homo sapiens
cagacuggcaaua

SEQ ID NO: 1265094 - RNA, 20 nt, Homo sapiens
cagacuggcaauaaacuccu

SEQ ID NO: 1265095 - RNA, 22 nt, Homo sapiens
cagacuggcaauaaacuccuac

SEQ ID NO: 1265096 - RNA, 16 nt, Homo sapiens
cagacugugucuuauu

SEQ ID NO: 1265097 - RNA, 19 nt, Homo sapiens
cagacuguucuuacuguaa

SEQ ID NO: 1265098 - RNA, 15 nt, Homo sapiens
cagacuuaacagccc

SEQ ID NO: 1265099 - RNA, 13 nt, Homo sapiens
cagagaaaagagu

SEQ ID NO: 1265100 - RNA, 20 nt, Homo sapiens
cagagaaaggguaauuuccu

SEQ ID NO: 1265101 - RNA, 17 nt, Homo sapiens
cagagaaauacuuucag

SEQ ID NO: 1265102 - RNA, 22 nt, Homo sapiens
cagagaagcggauuuccaggga

SEQ ID NO: 1265103 - RNA, 13 nt, Homo sapiens
cagagaagcugga

SEQ ID NO: 1265104 - RNA, 13 nt, Homo sapiens
cagagaagcugua

SEQ ID NO: 1265105 - RNA, 20 nt, Homo sapiens
cagagacaggcccaagagau

SEQ ID NO: 1265106 - RNA, 22 nt, Homo sapiens
cagagacgcagacaugugcacu

SEQ ID NO: 1265107 - RNA, 18 nt, Homo sapiens
cagagacucagcgcuccu

SEQ ID NO: 1265108 - RNA, 16 nt, Homo sapiens
cagagacugucccuga

SEQ ID NO: 1265109 - RNA, 17 nt, Homo sapiens
cagagagacagacuuga

SEQ ID NO: 1265110 - RNA, 21 nt, Homo sapiens
cagagagacagacuugagaac

SEQ ID NO: 1265111 - RNA, 15 nt, Homo sapiens
cagagagacuggcca

SEQ ID NO: 1265112 - RNA, 20 nt, Homo sapiens
cagagagagagaaggcagca

SEQ ID NO: 1265113 - RNA, 15 nt, Homo sapiens
cagagagaggcauuu

SEQ ID NO: 1265114 - RNA, 21 nt, Homo sapiens
cagagagcugcccuucagcga

SEQ ID NO: 1265115 - RNA, 17 nt, Homo sapiens
cagagagggccuuuccu

SEQ ID NO: 1265116 - RNA, 14 nt, Homo sapiens
cagagaugacuguc

SEQ ID NO: 1265117 - RNA, 21 nt, Homo sapiens
cagagauggucacaugaccca

SEQ ID NO: 1265118 - RNA, 16 nt, Homo sapiens
cagagcaaaugagcuc

SEQ ID NO: 1265119 - RNA, 15 nt, Homo sapiens
cagagcaaccucuca

SEQ ID NO: 1265120 - RNA, 21 nt, Homo sapiens
cagagcaccuuugcacaggau

SEQ ID NO: 1265121 - RNA, 11 nt, Homo sapiens
cagagcacuug

SEQ ID NO: 1265122 - RNA, 16 nt, Homo sapiens
cagagcagagucugaa

SEQ ID NO: 1265123 - RNA, 15 nt, Homo sapiens
cagagcagaugcaga

SEQ ID NO: 1265124 - RNA, 15 nt, Homo sapiens
cagagcaggggcucc

SEQ ID NO: 1265125 - RNA, 13 nt, Homo sapiens
cagagcagggugu

SEQ ID NO: 1265126 - RNA, 19 nt, Homo sapiens
cagagcauuuaagagugaa

SEQ ID NO: 1265127 - RNA, 23 nt, Homo sapiens
cagagcauuuccaacaccacaga

SEQ ID NO: 1265128 - RNA, 15 nt, Homo sapiens
cagagcccaaugcau

SEQ ID NO: 1265129 - RNA, 22 nt, Homo sapiens
cagagccucguuucugcuuuca

SEQ ID NO: 1265130 - RNA, 20 nt, Homo sapiens
cagagccuucaagugccaaa

SEQ ID NO: 1265131 - RNA, 23 nt, Homo sapiens
cagagcggaaggagggagcucug

SEQ ID NO: 1265132 - RNA, 16 nt, Homo sapiens
cagagcuggaaggcag

SEQ ID NO: 1265133 - RNA, 16 nt, Homo sapiens
cagaggaauccuggca

SEQ ID NO: 1265134 - RNA, 23 nt, Homo sapiens
cagaggagcggccagaagaucua

SEQ ID NO: 1265135 - RNA, 22 nt, Homo sapiens
cagaggcagcgaguuguggaaa

SEQ ID NO: 1265136 - RNA, 21 nt, Homo sapiens
cagaggcagcucgugugccug

SEQ ID NO: 1265137 - RNA, 23 nt, Homo sapiens
cagaggcccuggaggucuccagg

SEQ ID NO: 1265138 - RNA, 21 nt, Homo sapiens
cagaggccugcugccagugca

SEQ ID NO: 1265139 - RNA, 20 nt, Homo sapiens
cagaggcucagcacuuugga

SEQ ID NO: 1265140 - RNA, 19 nt, Homo sapiens
cagaggcucuaauguacaa

SEQ ID NO: 1265141 - RNA, 23 nt, Homo sapiens
cagagggaaaguaaauauuucag

SEQ ID NO: 1265142 - RNA, 14 nt, Homo sapiens
cagagggauaaaaa

SEQ ID NO: 1265143 - RNA, 20 nt, Homo sapiens
cagagggauaaaaacaauac

SEQ ID NO: 1265144 - RNA, 21 nt, Homo sapiens
cagagggcaguggcccuccac

SEQ ID NO: 1265145 - RNA, 15 nt, Homo sapiens
cagagggcccaggca

SEQ ID NO: 1265146 - RNA, 23 nt, Homo sapiens
cagagggccccgcccagugcagu

SEQ ID NO: 1265147 - RNA, 22 nt, Homo sapiens
cagagggcggggagaaucucag

SEQ ID NO: 1265148 - RNA, 20 nt, Homo sapiens
cagagggcguguuguuuuac

SEQ ID NO: 1265149 - RNA, 19 nt, Homo sapiens
cagaggggaaagacuucca

SEQ ID NO: 1265150 - RNA, 19 nt, Homo sapiens
cagagggggaguagccaag

SEQ ID NO: 1265151 - RNA, 21 nt, Homo sapiens
cagaggucaggaagcaggggu

SEQ ID NO: 1265152 - RNA, 21 nt, Homo sapiens
cagagguuaucugucugcauu

SEQ ID NO: 1265153 - RNA, 18 nt, Homo sapiens
cagagguuuccucuuagg

SEQ ID NO: 1265154 - RNA, 21 nt, Homo sapiens
cagagguuugcuuccucagua

SEQ ID NO: 1265155 - RNA, 19 nt, Homo sapiens
cagagucaggcuguugcgc

SEQ ID NO: 1265156 - RNA, 13 nt, Homo sapiens
cagagucaucuga

SEQ ID NO: 1265157 - RNA, 20 nt, Homo sapiens
cagaguccuuauucuucuca

SEQ ID NO: 1265158 - RNA, 20 nt, Homo sapiens
cagagucguuggagacugaa

SEQ ID NO: 1265159 - RNA, 19 nt, Homo sapiens
cagagucucacuguugccc

SEQ ID NO: 1265160 - RNA, 16 nt, Homo sapiens
cagagucuguuucagg

SEQ ID NO: 1265161 - RNA, 19 nt, Homo sapiens
cagagucuucagagacuuc

SEQ ID NO: 1265162 - RNA, 14 nt, Homo sapiens
cagagugaacacuc

SEQ ID NO: 1265163 - RNA, 16 nt, Homo sapiens
cagagugagagacauc

SEQ ID NO: 1265164 - RNA, 23 nt, Homo sapiens
cagagugagccagugagggcagu

SEQ ID NO: 1265165 - RNA, 15 nt, Homo sapiens
cagaguugcaaagau

SEQ ID NO: 1265166 - RNA, 23 nt, Homo sapiens
cagaguugcaaagaucuuuucca

SEQ ID NO: 1265167 - RNA, 18 nt, Homo sapiens
cagaguuuguguguauuu

SEQ ID NO: 1265168 - RNA, 12 nt, Homo sapiens
cagaguuuucau

SEQ ID NO: 1265169 - RNA, 21 nt, Homo sapiens
cagauaaaauguucagugcaa

SEQ ID NO: 1265170 - RNA, 20 nt, Homo sapiens
cagauaagacauaucucuaa

SEQ ID NO: 1265171 - RNA, 19 nt, Homo sapiens
cagauacacuaaaguuaca

SEQ ID NO: 1265172 - RNA, 22 nt, Homo sapiens
cagauagagaguuguuguguac

SEQ ID NO: 1265173 - RNA, 14 nt, Homo sapiens
cagauagagcuggg

SEQ ID NO: 1265174 - RNA, 17 nt, Homo sapiens
cagauagaguuccauau

SEQ ID NO: 1265175 - RNA, 15 nt, Homo sapiens
cagauaucugaaugg

SEQ ID NO: 1265176 - RNA, 16 nt, Homo sapiens
cagaucauauuucaca

SEQ ID NO: 1265177 - RNA, 16 nt, Homo sapiens
cagauccagacuguaa

SEQ ID NO: 1265178 - RNA, 15 nt, Homo sapiens
cagauccccacuguc

SEQ ID NO: 1265179 - RNA, 16 nt, Homo sapiens
cagauccccacugucc

SEQ ID NO: 1265180 - RNA, 19 nt, Homo sapiens
cagauccgugcgugaagua

SEQ ID NO: 1265181 - RNA, 17 nt, Homo sapiens
cagauccuuugucuaca

SEQ ID NO: 1265182 - RNA, 22 nt, Homo sapiens
cagaucgauccuggauucacuc

SEQ ID NO: 1265183 - RNA, 16 nt, Homo sapiens
cagaucgcaccacugc

SEQ ID NO: 1265184 - RNA, 16 nt, Homo sapiens
cagaucgcucacuguu

SEQ ID NO: 1265185 - RNA, 17 nt, Homo sapiens
cagaugaccaaagccac

SEQ ID NO: 1265186 - RNA, 14 nt, Homo sapiens
cagaugagaacaaa

SEQ ID NO: 1265187 - RNA, 16 nt, Homo sapiens
cagaugauacuuccaa

SEQ ID NO: 1265188 - RNA, 16 nt, Homo sapiens
cagaugauuguucaaa

SEQ ID NO: 1265189 - RNA, 14 nt, Homo sapiens
cagaugcaccagcc

SEQ ID NO: 1265190 - RNA, 19 nt, Homo sapiens
cagaugccuacaaccaucc

SEQ ID NO: 1265191 - RNA, 20 nt, Homo sapiens
cagauggaaugcuguguuaa

SEQ ID NO: 1265192 - RNA, 17 nt, Homo sapiens
cagauggcaauuucacu

SEQ ID NO: 1265193 - RNA, 16 nt, Homo sapiens
cagauggcacuuugaa

SEQ ID NO: 1265194 - RNA, 23 nt, Homo sapiens
cagaugggcuguuucguguagug

SEQ ID NO: 1265195 - RNA, 14 nt, Homo sapiens
cagauggggcacca

SEQ ID NO: 1265196 - RNA, 20 nt, Homo sapiens
cagauguaauuauguuuuca

SEQ ID NO: 1265197 - RNA, 13 nt, Homo sapiens
cagaugucagcuu

SEQ ID NO: 1265198 - RNA, 23 nt, Homo sapiens
cagauguggaguauuagugacac

SEQ ID NO: 1265199 - RNA, 14 nt, Homo sapiens
cagauuaaacccuu

SEQ ID NO: 1265200 - RNA, 18 nt, Homo sapiens
cagauucuucucucucaa

SEQ ID NO: 1265201 - RNA, 12 nt, Homo sapiens
cagauugcugca

SEQ ID NO: 1265202 - RNA, 13 nt, Homo sapiens
cagauugcugcaa

SEQ ID NO: 1265203 - RNA, 20 nt, Homo sapiens
cagauugucuuauuacagca

SEQ ID NO: 1265204 - RNA, 13 nt, Homo sapiens
cagauuucaggaa

SEQ ID NO: 1265205 - RNA, 18 nt, Homo sapiens
cagauuuggaugcacuca

SEQ ID NO: 1265206 - RNA, 16 nt, Homo sapiens
cagauuuugcuguaua

SEQ ID NO: 1265207 - RNA, 22 nt, Homo sapiens
cagcaaaaaucucccagugaca

SEQ ID NO: 1265208 - RNA, 19 nt, Homo sapiens
cagcaaacccugaugugac

SEQ ID NO: 1265209 - RNA, 14 nt, Homo sapiens
cagcaaaucacgac

SEQ ID NO: 1265210 - RNA, 13 nt, Homo sapiens
cagcaacaaugac

SEQ ID NO: 1265211 - RNA, 16 nt, Homo sapiens
cagcaaccccugcaug

SEQ ID NO: 1265212 - RNA, 16 nt, Homo sapiens
cagcaaccugacucag

SEQ ID NO: 1265213 - RNA, 15 nt, Homo sapiens
cagcaacugucuuau

SEQ ID NO: 1265214 - RNA, 17 nt, Homo sapiens
cagcaagcacugugguc

SEQ ID NO: 1265215 - RNA, 16 nt, Homo sapiens
cagcaaggggacaucu

SEQ ID NO: 1265216 - RNA, 17 nt, Homo sapiens
cccacgaggauggccug

SEQ ID NO: 1265217 - RNA, 18 nt, Homo sapiens
cccacuaaaacugcauuu

SEQ ID NO: 1265218 - RNA, 21 nt, Homo sapiens
cccacuagaagcaacuaggaa

SEQ ID NO: 1265219 - RNA, 16 nt, Homo sapiens
cccacuccagcgcuga

SEQ ID NO: 1265220 - RNA, 20 nt, Homo sapiens
cccacugaagcccauuucuc

SEQ ID NO: 1265221 - RNA, 13 nt, Homo sapiens
cccacugagauuu

SEQ ID NO: 1265222 - RNA, 22 nt, Homo sapiens
cccacugaguuugcuguuugca

SEQ ID NO: 1265223 - RNA, 16 nt, Homo sapiens
cccacugccucagguu

SEQ ID NO: 1265224 - RNA, 16 nt, Homo sapiens
cccacugcucugguua

SEQ ID NO: 1265225 - RNA, 17 nt, Homo sapiens
cccacuguaugauuuau

SEQ ID NO: 1265226 - RNA, 11 nt, Homo sapiens
cccacuugaag

SEQ ID NO: 1265227 - RNA, 16 nt, Homo sapiens
cccagacaaccaaaac

SEQ ID NO: 1265228 - RNA, 20 nt, Homo sapiens
cccagaccuucucacaccca

SEQ ID NO: 1265229 - RNA, 18 nt, Homo sapiens
cccagacuagauguagua

SEQ ID NO: 1265230 - RNA, 13 nt, Homo sapiens
cccagacucugag

SEQ ID NO: 1265231 - RNA, 19 nt, Homo sapiens
cccagacuggaaugcagug

SEQ ID NO: 1265232 - RNA, 20 nt, Homo sapiens
cccagacuggaaugcaguga

SEQ ID NO: 1265233 - RNA, 12 nt, Homo sapiens
cccagacuuuag

SEQ ID NO: 1265234 - RNA, 20 nt, Homo sapiens
cccagagcaggaagcauuca

SEQ ID NO: 1265235 - RNA, 23 nt, Homo sapiens
cccagagcgaggaaaggauuuua

SEQ ID NO: 1265236 - RNA, 21 nt, Homo sapiens
cccagaggaugucacaaagau

SEQ ID NO: 1265237 - RNA, 18 nt, Homo sapiens
cccagagguaacagaaca

SEQ ID NO: 1265238 - RNA, 23 nt, Homo sapiens
cccagagguaacagaacagcuuc

SEQ ID NO: 1265239 - RNA, 20 nt, Homo sapiens
cccagagguuaucugccugg

SEQ ID NO: 1265240 - RNA, 16 nt, Homo sapiens
cccagauacaugguga

SEQ ID NO: 1265241 - RNA, 15 nt, Homo sapiens
cccagauugcugcaa

SEQ ID NO: 1265242 - RNA, 11 nt, Homo sapiens
cccagcacuug

SEQ ID NO: 1265243 - RNA, 13 nt, Homo sapiens
cccagcacuuugg

SEQ ID NO: 1265244 - RNA, 16 nt, Homo sapiens
cccagcagugccuugu

SEQ ID NO: 1265245 - RNA, 21 nt, Homo sapiens
cccagccaaguccaagagggc

SEQ ID NO: 1265246 - RNA, 14 nt, Homo sapiens
cccagccacaccca

SEQ ID NO: 1265247 - RNA, 24 nt, Homo sapiens
cccagccacaguggccaaagaggc

SEQ ID NO: 1265248 - RNA, 18 nt, Homo sapiens
cccagccaggcagggggc

SEQ ID NO: 1265249 - RNA, 21 nt, Homo sapiens
cccagccaggcuaugguugcc

SEQ ID NO: 1265250 - RNA, 23 nt, Homo sapiens
cccagccaucugcccaggggugc

SEQ ID NO: 1265251 - RNA, 15 nt, Homo sapiens
cccagcccaaagggg

SEQ ID NO: 1265252 - RNA, 15 nt, Homo sapiens
cccagcccagagcca

SEQ ID NO: 1265253 - RNA, 18 nt, Homo sapiens
cccagccccuccacguga

SEQ ID NO: 1265254 - RNA, 22 nt, Homo sapiens
cccagccggccaauggaaaccu

SEQ ID NO: 1265255 - RNA, 21 nt, Homo sapiens
cccagcuccuuucuccuguga

SEQ ID NO: 1265256 - RNA, 13 nt, Homo sapiens
cccagcugaccag

SEQ ID NO: 1265257 - RNA, 15 nt, Homo sapiens
cccagcugugcugug

SEQ ID NO: 1265258 - RNA, 16 nt, Homo sapiens
cccaggaacugggcca

SEQ ID NO: 1265259 - RNA, 16 nt, Homo sapiens
cccaggacagccacag

SEQ ID NO: 1265260 - RNA, 17 nt, Homo sapiens
cccaggaccaagccaca

SEQ ID NO: 1265261 - RNA, 23 nt, Homo sapiens
cccaggagacagaccacuugcca

SEQ ID NO: 1265262 - RNA, 23 nt, Homo sapiens
cccaggaggucgaccccaaagcc

SEQ ID NO: 1265263 - RNA, 21 nt, Homo sapiens
cccaggagguggcuauggcca

SEQ ID NO: 1265264 - RNA, 23 nt, Homo sapiens
cccaggagguugagaaugcagug

SEQ ID NO: 1265265 - RNA, 18 nt, Homo sapiens
cccaggcccaccaucacc

SEQ ID NO: 1265266 - RNA, 20 nt, Homo sapiens
cccaggcccgagaugugacc

SEQ ID NO: 1265267 - RNA, 17 nt, Homo sapiens
cccaggccuccagccuc

SEQ ID NO: 1265268 - RNA, 17 nt, Homo sapiens
cccaggcuccagccaca

SEQ ID NO: 1265269 - RNA, 14 nt, Homo sapiens
cccaggcugcacug

SEQ ID NO: 1265270 - RNA, 19 nt, Homo sapiens
cccaggcugcacugcagug

SEQ ID NO: 1265271 - RNA, 18 nt, Homo sapiens
cccaggcuggagugcaau

SEQ ID NO: 1265272 - RNA, 19 nt, Homo sapiens
cccaggcuggagugcaaug

SEQ ID NO: 1265273 - RNA, 20 nt, Homo sapiens
cccaggcuggagugcaaugg

SEQ ID NO: 1265274 - RNA, 17 nt, Homo sapiens
cccaggcuggagugcag

SEQ ID NO: 1265275 - RNA, 19 nt, Homo sapiens
cccaggcuggagugcagug

SEQ ID NO: 1265276 - RNA, 19 nt, Homo sapiens
cccaggcuggcgugcagug

SEQ ID NO: 1265277 - RNA, 14 nt, Homo sapiens
cccagggaaggugg

SEQ ID NO: 1265278 - RNA, 15 nt, Homo sapiens
cccagggaucacugg

SEQ ID NO: 1265279 - RNA, 21 nt, Homo sapiens
cccagggauuaggagcagcuc

SEQ ID NO: 1265280 - RNA, 13 nt, Homo sapiens
cccagggcuaccc

SEQ ID NO: 1265281 - RNA, 15 nt, Homo sapiens
cccaggguuuugccc

SEQ ID NO: 1265282 - RNA, 14 nt, Homo sapiens
cccagguaccagcu

SEQ ID NO: 1265283 - RNA, 17 nt, Homo sapiens
cccaggucagcaucucg

SEQ ID NO: 1265284 - RNA, 13 nt, Homo sapiens
cccaggucuucca

SEQ ID NO: 1265285 - RNA, 17 nt, Homo sapiens
cccagguggagggcaca

SEQ ID NO: 1265286 - RNA, 20 nt, Homo sapiens
cccaguacaggggugcugca

SEQ ID NO: 1265287 - RNA, 19 nt, Homo sapiens
cccagucccagacaauucc

SEQ ID NO: 1265288 - RNA, 15 nt, Homo sapiens
cccagucccauuccu

SEQ ID NO: 1265289 - RNA, 17 nt, Homo sapiens
cccagugcugcuguaaa

SEQ ID NO: 1265290 - RNA, 18 nt, Homo sapiens
cccaguggacucuuccac

SEQ ID NO: 1265291 - RNA, 19 nt, Homo sapiens
cccaguuacuuuuuuacac

SEQ ID NO: 1265292 - RNA, 22 nt, Homo sapiens
cccaguuugauaccugcacugu

SEQ ID NO: 1265293 - RNA, 19 nt, Homo sapiens
cccauaauuauuauuucca

SEQ ID NO: 1265294 - RNA, 17 nt, Homo sapiens
cccauaauuuucuucau

SEQ ID NO: 1265295 - RNA, 12 nt, Homo sapiens
cccauacugguu

SEQ ID NO: 1265296 - RNA, 18 nt, Homo sapiens
cccaucacggagggucca

SEQ ID NO: 1265297 - RNA, 20 nt, Homo sapiens
cccaucagacugucaagaag

SEQ ID NO: 1265298 - RNA, 12 nt, Homo sapiens
cccaucauccca

SEQ ID NO: 1265299 - RNA, 15 nt, Homo sapiens
cccauccccaccagc

SEQ ID NO: 1265300 - RNA, 16 nt, Homo sapiens
cccauccccaccagcu

SEQ ID NO: 1265301 - RNA, 21 nt, Homo sapiens
cccauccuucuccaccaaaga

SEQ ID NO: 1265302 - RNA, 19 nt, Homo sapiens
cccaucgguaggcaaagga

SEQ ID NO: 1265303 - RNA, 21 nt, Homo sapiens
cccaucugacaagaaagccug

SEQ ID NO: 1265304 - RNA, 16 nt, Homo sapiens
cccaucuuacuggaag

SEQ ID NO: 1265305 - RNA, 12 nt, Homo sapiens
cccaugagauuc

SEQ ID NO: 1265306 - RNA, 22 nt, Homo sapiens
cccauggcccccaauaaaggca

SEQ ID NO: 1265307 - RNA, 17 nt, Homo sapiens
cccaugggauugcacag

SEQ ID NO: 1265308 - RNA, 18 nt, Homo sapiens
cccauuccucccuccggc

SEQ ID NO: 1265309 - RNA, 15 nt, Homo sapiens
cccauucuacacaga

SEQ ID NO: 1265310 - RNA, 17 nt, Homo sapiens
cccauugcucuaugaaa

SEQ ID NO: 1265311 - RNA, 14 nt, Homo sapiens
cccauuuugcaaaa

SEQ ID NO: 1265312 - RNA, 16 nt, Homo sapiens
ccccaacaugcacuga

SEQ ID NO: 1265313 - RNA, 17 nt, Homo sapiens
ccccaacuaguagcuaa

SEQ ID NO: 1265314 - RNA, 23 nt, Homo sapiens
ccccaagagaacucgcgcucagu

SEQ ID NO: 1265315 - RNA, 21 nt, Homo sapiens
ccccaagguuuuggagucagu

SEQ ID NO: 1265316 - RNA, 19 nt, Homo sapiens
ccccaaguagucugcucac

SEQ ID NO: 1265317 - RNA, 12 nt, Homo sapiens
ccccaaguccug

SEQ ID NO: 1265318 - RNA, 11 nt, Homo sapiens
ccccaauccaa

SEQ ID NO: 1265319 - RNA, 13 nt, Homo sapiens
ccccacaacuuua

SEQ ID NO: 1265320 - RNA, 22 nt, Homo sapiens
ccccacacagcuacagcuuucu

SEQ ID NO: 1265321 - RNA, 11 nt, Homo sapiens
ccccacacugc

SEQ ID NO: 1265322 - RNA, 18 nt, Homo sapiens
ccccacccuccucuugga

SEQ ID NO: 1265323 - RNA, 18 nt, Homo sapiens
ccccaccuccaccuguga

SEQ ID NO: 1265324 - RNA, 23 nt, Homo sapiens
ccccacgagggucaggacuguga

SEQ ID NO: 1265325 - RNA, 14 nt, Homo sapiens
ccccacugcucucu

SEQ ID NO: 1265326 - RNA, 16 nt, Homo sapiens
ccccagaaacagugug

SEQ ID NO: 1265327 - RNA, 10 nt, Homo sapiens
ccccagagau

SEQ ID NO: 1265328 - RNA, 19 nt, Homo sapiens
ccccagaggcucagcacuu

SEQ ID NO: 1265329 - RNA, 14 nt, Homo sapiens
ccccagcccaaguc

SEQ ID NO: 1265330 - RNA, 14 nt, Homo sapiens
ccccagccugcucc

SEQ ID NO: 1265331 - RNA, 12 nt, Homo sapiens
ccccagcucaau

SEQ ID NO: 1265332 - RNA, 19 nt, Homo sapiens
ccccaggggacaagggauu

SEQ ID NO: 1265333 - RNA, 19 nt, Homo sapiens
ccccagguucuagucaugu

SEQ ID NO: 1265334 - RNA, 13 nt, Homo sapiens
ccccaucccaguu

SEQ ID NO: 1265335 - RNA, 15 nt, Homo sapiens
ccccaucucccugcc

SEQ ID NO: 1265336 - RNA, 14 nt, Homo sapiens
ccccaugcacucaa

SEQ ID NO: 1265337 - RNA, 18 nt, Homo sapiens
ccccaugccuguccagcc

SEQ ID NO: 1265338 - RNA, 23 nt, Homo sapiens
ccccauggguuuugcuuaggcac

SEQ ID NO: 1265339 - RNA, 23 nt, Homo sapiens
ccccauguaucucaguaccccau

SEQ ID NO: 1265340 - RNA, 21 nt, Homo sapiens
ccccauuuccuguacaaucau

SEQ ID NO: 1265341 - RNA, 12 nt, Homo sapiens
cccccaccacaa

SEQ ID NO: 1265342 - RNA, 18 nt, Homo sapiens
ccuguagcgccaguguaa

SEQ ID NO: 1265343 - RNA, 17 nt, Homo sapiens
ccuguagguucuugaua

SEQ ID NO: 1265344 - RNA, 16 nt, Homo sapiens
ccuguagucccagcua

SEQ ID NO: 1265345 - RNA, 12 nt, Homo sapiens
ccuguauuccca

SEQ ID NO: 1265346 - RNA, 20 nt, Homo sapiens
ccugucaagguuuguguuac

SEQ ID NO: 1265347 - RNA, 20 nt, Homo sapiens
ccugucaaguuaacaaggaa

SEQ ID NO: 1265348 - RNA, 17 nt, Homo sapiens
ccugucaccuagcucaa

SEQ ID NO: 1265349 - RNA, 19 nt, Homo sapiens
ccugucacgccgggcucua

SEQ ID NO: 1265350 - RNA, 16 nt, Homo sapiens
ccugucauuguauuca

SEQ ID NO: 1265351 - RNA, 20 nt, Homo sapiens
ccugucauuuuuaacagcau

SEQ ID NO: 1265352 - RNA, 13 nt, Homo sapiens
ccugucccaugca

SEQ ID NO: 1265353 - RNA, 13 nt, Homo sapiens
ccugucccaugga

SEQ ID NO: 1265354 - RNA, 19 nt, Homo sapiens
ccugucccauggacacucc

SEQ ID NO: 1265355 - RNA, 16 nt, Homo sapiens
ccuguccccacccucc

SEQ ID NO: 1265356 - RNA, 16 nt, Homo sapiens
ccuguccuaagcacuu

SEQ ID NO: 1265357 - RNA, 15 nt, Homo sapiens
ccuguccuaucacuc

SEQ ID NO: 1265358 - RNA, 15 nt, Homo sapiens
ccugucucccaaaaa

SEQ ID NO: 1265359 - RNA, 13 nt, Homo sapiens
ccugucuccuuau

SEQ ID NO: 1265360 - RNA, 21 nt, Homo sapiens
ccugucuuggggccacuuuca

SEQ ID NO: 1265361 - RNA, 12 nt, Homo sapiens
ccugugaagcug

SEQ ID NO: 1265362 - RNA, 14 nt, Homo sapiens
ccugugaccagcac

SEQ ID NO: 1265363 - RNA, 11 nt, Homo sapiens
ccugugacugu

SEQ ID NO: 1265364 - RNA, 11 nt, Homo sapiens
ccugugccauc

SEQ ID NO: 1265365 - RNA, 22 nt, Homo sapiens
ccugugcugaauguggacucaa

SEQ ID NO: 1265366 - RNA, 22 nt, Homo sapiens
ccuguggaacccagcaguucug

SEQ ID NO: 1265367 - RNA, 19 nt, Homo sapiens
ccugugguuacagugcaga

SEQ ID NO: 1265368 - RNA, 15 nt, Homo sapiens
ccuguguacugccuu

SEQ ID NO: 1265369 - RNA, 17 nt, Homo sapiens
ccuguguauucuaguga

SEQ ID NO: 1265370 - RNA, 13 nt, Homo sapiens
ccugugugacugg

SEQ ID NO: 1265371 - RNA, 12 nt, Homo sapiens
ccuguuccccaa

SEQ ID NO: 1265372 - RNA, 17 nt, Homo sapiens
ccuguugguuagauuca

SEQ ID NO: 1265373 - RNA, 22 nt, Homo sapiens
ccuguuugacgacagugcauuu

SEQ ID NO: 1265374 - RNA, 15 nt, Homo sapiens
ccuuaaaacaauucu

SEQ ID NO: 1265375 - RNA, 16 nt, Homo sapiens
ccuuaaaaccaaagag

SEQ ID NO: 1265376 - RNA, 23 nt, Homo sapiens
ccuuaagaagucuauaaugcaau

SEQ ID NO: 1265377 - RNA, 21 nt, Homo sapiens
ccuuaagggacaacauccuua

SEQ ID NO: 1265378 - RNA, 21 nt, Homo sapiens
ccuuaauuuaagucauuuuca

SEQ ID NO: 1265379 - RNA, 16 nt, Homo sapiens
ccuuacaaguuagaaa

SEQ ID NO: 1265380 - RNA, 12 nt, Homo sapiens
ccuuacacugaa

SEQ ID NO: 1265381 - RNA, 14 nt, Homo sapiens
ccuuacacugaaaa

SEQ ID NO: 1265382 - RNA, 11 nt, Homo sapiens
ccuuacucuga

SEQ ID NO: 1265383 - RNA, 22 nt, Homo sapiens
ccuuacuggcuuaccuccucau

SEQ ID NO: 1265384 - RNA, 21 nt, Homo sapiens
ccuuagaaauguaaacugcca

SEQ ID NO: 1265385 - RNA, 20 nt, Homo sapiens
ccuuagcagggaaacagcua

SEQ ID NO: 1265386 - RNA, 18 nt, Homo sapiens
ccuuagcccugucugcua

SEQ ID NO: 1265387 - RNA, 22 nt, Homo sapiens
ccuuagcuggcauuacagcugg

SEQ ID NO: 1265388 - RNA, 17 nt, Homo sapiens
ccuuauccuaaugaugc

SEQ ID NO: 1265389 - RNA, 14 nt, Homo sapiens
ccuuaucugucaca

SEQ ID NO: 1265390 - RNA, 18 nt, Homo sapiens
ccuuauguccaccacuuc

SEQ ID NO: 1265391 - RNA, 16 nt, Homo sapiens
ccuuauuguaccucuc

SEQ ID NO: 1265392 - RNA, 21 nt, Homo sapiens
ccuuauuguaccucucuuaua

SEQ ID NO: 1265393 - RNA, 23 nt, Homo sapiens
ccuuauuuugugugcuuucccag

SEQ ID NO: 1265394 - RNA, 15 nt, Homo sapiens
ccuucaaaagcacug

SEQ ID NO: 1265395 - RNA, 15 nt, Homo sapiens
ccuucaagugccaaa

SEQ ID NO: 1265396 - RNA, 13 nt, Homo sapiens
ccuucaccuggau

SEQ ID NO: 1265397 - RNA, 16 nt, Homo sapiens
ccuucagaaugcuccu

SEQ ID NO: 1265398 - RNA, 21 nt, Homo sapiens
ccuucagcaugccugaacuac

SEQ ID NO: 1265399 - RNA, 18 nt, Homo sapiens
ccuucagucuuaauacuu

SEQ ID NO: 1265400 - RNA, 16 nt, Homo sapiens
ccuucaucugggacaa

SEQ ID NO: 1265401 - RNA, 20 nt, Homo sapiens
ccuucaucuucacugcaauu

SEQ ID NO: 1265402 - RNA, 14 nt, Homo sapiens
ccuuccacauguac

SEQ ID NO: 1265403 - RNA, 17 nt, Homo sapiens
ccuuccagcuccuguaa

SEQ ID NO: 1265404 - RNA, 21 nt, Homo sapiens
ccuucccaaucagcacugaaa

SEQ ID NO: 1265405 - RNA, 13 nt, Homo sapiens
ccuucccuuccac

SEQ ID NO: 1265406 - RNA, 23 nt, Homo sapiens
ccuuccggugcgugugaagccac

SEQ ID NO: 1265407 - RNA, 17 nt, Homo sapiens
ccuuccuaaacccaaug

SEQ ID NO: 1265408 - RNA, 18 nt, Homo sapiens
ccuuccuaugcuguucac

SEQ ID NO: 1265409 - RNA, 16 nt, Homo sapiens
ccuuccucucaggcuc

SEQ ID NO: 1265410 - RNA, 21 nt, Homo sapiens
ccuuccuuuaggucugguugu

SEQ ID NO: 1265411 - RNA, 17 nt, Homo sapiens
ccuucgcuucuugccuc

SEQ ID NO: 1265412 - RNA, 15 nt, Homo sapiens
ccuucggcagcuacu

SEQ ID NO: 1265413 - RNA, 17 nt, Homo sapiens
ccuucggcagcuacuca

SEQ ID NO: 1265414 - RNA, 18 nt, Homo sapiens
ccuucggguuggcaaaau

SEQ ID NO: 1265415 - RNA, 17 nt, Homo sapiens
ccuucguuaacugugua

SEQ ID NO: 1265416 - RNA, 22 nt, Homo sapiens
ccuucucagaccugcgcacucc

SEQ ID NO: 1265417 - RNA, 16 nt, Homo sapiens
ccuucuccaccaaaga

SEQ ID NO: 1265418 - RNA, 22 nt, Homo sapiens
ccuucuccaccaaagacaguug

SEQ ID NO: 1265419 - RNA, 19 nt, Homo sapiens
ccuucucuacacucuugua

SEQ ID NO: 1265420 - RNA, 14 nt, Homo sapiens
ccuucugccuuugu

SEQ ID NO: 1265421 - RNA, 21 nt, Homo sapiens
ccuucuggacacugagagggc

SEQ ID NO: 1265422 - RNA, 14 nt, Homo sapiens
ccuucuguggcuca

SEQ ID NO: 1265423 - RNA, 14 nt, Homo sapiens
ccuucuugacauuu

SEQ ID NO: 1265424 - RNA, 20 nt, Homo sapiens
ccuucuuugauaauguuaaa

SEQ ID NO: 1265425 - RNA, 23 nt, Homo sapiens
ccuucuuuuaugagcagaaggaa

SEQ ID NO: 1265426 - RNA, 22 nt, Homo sapiens
ccuucuuuugaaggacuccuua

SEQ ID NO: 1265427 - RNA, 16 nt, Homo sapiens
ccuugagaagugggag

SEQ ID NO: 1265428 - RNA, 22 nt, Homo sapiens
ccuugauaaccauauaaauucu

SEQ ID NO: 1265429 - RNA, 16 nt, Homo sapiens
ccuugcagaacugcca

SEQ ID NO: 1265430 - RNA, 20 nt, Homo sapiens
ccuugcccagacuacagggc

SEQ ID NO: 1265431 - RNA, 22 nt, Homo sapiens
ccuugccuaaauuuaaugcugc

SEQ ID NO: 1265432 - RNA, 20 nt, Homo sapiens
ccuugcucucccucuucuca

SEQ ID NO: 1265433 - RNA, 21 nt, Homo sapiens
ccuugcugcugcugcacccaa

SEQ ID NO: 1265434 - RNA, 23 nt, Homo sapiens
ccuugcuggacggggacugggga

SEQ ID NO: 1265435 - RNA, 18 nt, Homo sapiens
ccuugcuuucggagcucc

SEQ ID NO: 1265436 - RNA, 22 nt, Homo sapiens
ccuuggccaugggucccauucu

SEQ ID NO: 1265437 - RNA, 16 nt, Homo sapiens
ccuuggcugacaugaa

SEQ ID NO: 1265438 - RNA, 16 nt, Homo sapiens
ccuuggcuucgugaau

SEQ ID NO: 1265439 - RNA, 17 nt, Homo sapiens
ccuuggcuucugugaug

SEQ ID NO: 1265440 - RNA, 19 nt, Homo sapiens
ccuuggcuuuucuagccua

SEQ ID NO: 1265441 - RNA, 16 nt, Homo sapiens
ccuuggggagcacuug

SEQ ID NO: 1265442 - RNA, 17 nt, Homo sapiens
ccuuggguagugagcag

SEQ ID NO: 1265443 - RNA, 16 nt, Homo sapiens
ccuuguaaagacugua

SEQ ID NO: 1265444 - RNA, 20 nt, Homo sapiens
ccuuguaaccagugcagaaa

SEQ ID NO: 1265445 - RNA, 21 nt, Homo sapiens
ccuuguaccucaaucuauucu

SEQ ID NO: 1265446 - RNA, 17 nt, Homo sapiens
ccuuguccugccagcug

SEQ ID NO: 1265447 - RNA, 12 nt, Homo sapiens
ccuugugccuug

SEQ ID NO: 1265448 - RNA, 17 nt, Homo sapiens
ccuugugcucgccucau

SEQ ID NO: 1265449 - RNA, 20 nt, Homo sapiens
ccuuguucaauaauuacugu

SEQ ID NO: 1265450 - RNA, 22 nt, Homo sapiens
ccuuguucuauuuuucaaucau

SEQ ID NO: 1265451 - RNA, 15 nt, Homo sapiens
ccuuguuucuacugu

SEQ ID NO: 1265452 - RNA, 18 nt, Homo sapiens
ccuuguuuguacuguaug

SEQ ID NO: 1265453 - RNA, 17 nt, Homo sapiens
ccuuuaaaaaugcacca

SEQ ID NO: 1265454 - RNA, 21 nt, Homo sapiens
ccuuuaaagaugaacucugaa

SEQ ID NO: 1265455 - RNA, 14 nt, Homo sapiens
ccuuuaccccucau

SEQ ID NO: 1265456 - RNA, 12 nt, Homo sapiens
ccuuuacuauca

SEQ ID NO: 1265457 - RNA, 16 nt, Homo sapiens
ccuuuagcacguuuaa

SEQ ID NO: 1265458 - RNA, 16 nt, Homo sapiens
ccuuuaggccaucuca

SEQ ID NO: 1265459 - RNA, 18 nt, Homo sapiens
ccuuuauagagugucuca

SEQ ID NO: 1265460 - RNA, 14 nt, Homo sapiens
ccuuuaucucugag

SEQ ID NO: 1265461 - RNA, 16 nt, Homo sapiens
ccuuucaaauuucaca

SEQ ID NO: 1265462 - RNA, 16 nt, Homo sapiens
ccuuucaccacaugug

SEQ ID NO: 1265463 - RNA, 20 nt, Homo sapiens
ccuuucaccacaugugcaca

SEQ ID NO: 1265464 - RNA, 14 nt, Homo sapiens
ccuuucagggccaa

SEQ ID NO: 1265465 - RNA, 21 nt, Homo sapiens
ccuuucaguggcccuuucaac

SEQ ID NO: 1265466 - RNA, 12 nt, Homo sapiens
ccuuucuaaucc

SEQ ID NO: 1265467 - RNA, 14 nt, Homo sapiens
ccuuucuaguucaa

SEQ ID NO: 1265468 - RNA, 15 nt, Homo sapiens
cuagacagauccccg

SEQ ID NO: 1265469 - RNA, 18 nt, Homo sapiens
cuagacauggagguucua

SEQ ID NO: 1265470 - RNA, 13 nt, Homo sapiens
cuagaccauguca

SEQ ID NO: 1265471 - RNA, 19 nt, Homo sapiens
cuagacuacucaauauuaa

SEQ ID NO: 1265472 - RNA, 12 nt, Homo sapiens
cuagacuugaaa

SEQ ID NO: 1265473 - RNA, 19 nt, Homo sapiens
cuagagaaggacccggagg

SEQ ID NO: 1265474 - RNA, 14 nt, Homo sapiens
cuagaguccucacu

SEQ ID NO: 1265475 - RNA, 15 nt, Homo sapiens
cuagauccacacaca

SEQ ID NO: 1265476 - RNA, 15 nt, Homo sapiens
cuagaugagcccagc

SEQ ID NO: 1265477 - RNA, 22 nt, Homo sapiens
cuagaugccacugcccauagac

SEQ ID NO: 1265478 - RNA, 20 nt, Homo sapiens
cuagaugugcaaaugcaagc

SEQ ID NO: 1265479 - RNA, 16 nt, Homo sapiens
cuagcaccaggacuca

SEQ ID NO: 1265480 - RNA, 19 nt, Homo sapiens
cuagcagaggaaaguguaa

SEQ ID NO: 1265481 - RNA, 18 nt, Homo sapiens
cuagcaggccuaagacau

SEQ ID NO: 1265482 - RNA, 12 nt, Homo sapiens
cuagcaguacua

SEQ ID NO: 1265483 - RNA, 17 nt, Homo sapiens
cuagccagaggcucuaa

SEQ ID NO: 1265484 - RNA, 22 nt, Homo sapiens
cuagccaucuugaucuguguuu

SEQ ID NO: 1265485 - RNA, 18 nt, Homo sapiens
cuagcccagacucugagc

SEQ ID NO: 1265486 - RNA, 13 nt, Homo sapiens
cuagccugugcac

SEQ ID NO: 1265487 - RNA, 22 nt, Homo sapiens
cuagccuuggccucuuuccuca

SEQ ID NO: 1265488 - RNA, 17 nt, Homo sapiens
cuagcgcaagaccaguc

SEQ ID NO: 1265489 - RNA, 17 nt, Homo sapiens
cuagcugccucaaguga

SEQ ID NO: 1265490 - RNA, 21 nt, Homo sapiens
cuaggaaaaucacuugccaaa

SEQ ID NO: 1265491 - RNA, 18 nt, Homo sapiens
cuaggaagagcaggacuc

SEQ ID NO: 1265492 - RNA, 19 nt, Homo sapiens
cuaggaguugaguacagug

SEQ ID NO: 1265493 - RNA, 23 nt, Homo sapiens
cuaggaguuggacggaauggagg

SEQ ID NO: 1265494 - RNA, 22 nt, Homo sapiens
cuaggcaccucagaccaaucau

SEQ ID NO: 1265495 - RNA, 22 nt, Homo sapiens
cuaggcguuuguuauauaaaaa

SEQ ID NO: 1265496 - RNA, 21 nt, Homo sapiens
cuagggacccauuccugugua

SEQ ID NO: 1265497 - RNA, 17 nt, Homo sapiens
cuagggaggaccuuauc

SEQ ID NO: 1265498 - RNA, 22 nt, Homo sapiens
cuagggcacuuuaagucaguga

SEQ ID NO: 1265499 - RNA, 16 nt, Homo sapiens
cuaggggaacagacca

SEQ ID NO: 1265500 - RNA, 20 nt, Homo sapiens
cuagguucuaaaaauuguga

SEQ ID NO: 1265501 - RNA, 14 nt, Homo sapiens
cuaguaaauuuaau

SEQ ID NO: 1265502 - RNA, 22 nt, Homo sapiens
cuaguaaguaauuaugcacuaa

SEQ ID NO: 1265503 - RNA, 13 nt, Homo sapiens
cuaguacuguauu

SEQ ID NO: 1265504 - RNA, 14 nt, Homo sapiens
cuaguaucacuuuu

SEQ ID NO: 1265505 - RNA, 22 nt, Homo sapiens
cuaguauuuauggguggauuua

SEQ ID NO: 1265506 - RNA, 16 nt, Homo sapiens
cuagucauucuucccu

SEQ ID NO: 1265507 - RNA, 15 nt, Homo sapiens
cuagucucaccagcc

SEQ ID NO: 1265508 - RNA, 19 nt, Homo sapiens
cuagucuccuuugcacuga

SEQ ID NO: 1265509 - RNA, 19 nt, Homo sapiens
cuagucugcuagccaggau

SEQ ID NO: 1265510 - RNA, 20 nt, Homo sapiens
cuagucugugugggacugua

SEQ ID NO: 1265511 - RNA, 22 nt, Homo sapiens
cuagugaacauucgaccuccau

SEQ ID NO: 1265512 - RNA, 17 nt, Homo sapiens
cuaguggcucucaguua

SEQ ID NO: 1265513 - RNA, 14 nt, Homo sapiens
cuaguguaccuccu

SEQ ID NO: 1265514 - RNA, 20 nt, Homo sapiens
cuaguucuuuucauuuggaa

SEQ ID NO: 1265515 - RNA, 20 nt, Homo sapiens
cuaguuugaccucacaguga

SEQ ID NO: 1265516 - RNA, 12 nt, Homo sapiens
cuaguuugcacu

SEQ ID NO: 1265517 - RNA, 21 nt, Homo sapiens
cuaguuugcacuauaugauca

SEQ ID NO: 1265518 - RNA, 16 nt, Homo sapiens
cuaguuuuuuugaaau

SEQ ID NO: 1265519 - RNA, 20 nt, Homo sapiens
cuauaaagguugacaauaaa

SEQ ID NO: 1265520 - RNA, 23 nt, Homo sapiens
cuauaacaugucuuucagcauua

SEQ ID NO: 1265521 - RNA, 14 nt, Homo sapiens
cuauaaccuggauu

SEQ ID NO: 1265522 - RNA, 15 nt, Homo sapiens
cuauaacuuuggcca

SEQ ID NO: 1265523 - RNA, 14 nt, Homo sapiens
cuauaaucugucaa

SEQ ID NO: 1265524 - RNA, 18 nt, Homo sapiens
cuauaauuaguuaugaca

SEQ ID NO: 1265525 - RNA, 14 nt, Homo sapiens
cuauaauuuugccu

SEQ ID NO: 1265526 - RNA, 22 nt, Homo sapiens
cuauacaaauauaaaucuuaaa

SEQ ID NO: 1265527 - RNA, 12 nt, Homo sapiens
cuauagucccag

SEQ ID NO: 1265528 - RNA, 21 nt, Homo sapiens
cuauagucccagcuacucaga

SEQ ID NO: 1265529 - RNA, 17 nt, Homo sapiens
cuauaguuauacaucaa

SEQ ID NO: 1265530 - RNA, 15 nt, Homo sapiens
cuauauacaugugug

SEQ ID NO: 1265531 - RNA, 17 nt, Homo sapiens
cuauauacaugugugua

SEQ ID NO: 1265532 - RNA, 13 nt, Homo sapiens
cuauauccaugua

SEQ ID NO: 1265533 - RNA, 22 nt, Homo sapiens
cuauauccugugacugucucac

SEQ ID NO: 1265534 - RNA, 14 nt, Homo sapiens
cuauauguauucac

SEQ ID NO: 1265535 - RNA, 17 nt, Homo sapiens
cuauauucucaguguag

SEQ ID NO: 1265536 - RNA, 16 nt, Homo sapiens
cuauauuuacagugaa

SEQ ID NO: 1265537 - RNA, 15 nt, Homo sapiens
cuaucaaaauugccu

SEQ ID NO: 1265538 - RNA, 14 nt, Homo sapiens
cuaucaagcacuaa

SEQ ID NO: 1265539 - RNA, 13 nt, Homo sapiens
cuaucaguucccu

SEQ ID NO: 1265540 - RNA, 21 nt, Homo sapiens
cuaucauacuacugaaacaga

SEQ ID NO: 1265541 - RNA, 22 nt, Homo sapiens
cuauccaaagaacuugauuugc

SEQ ID NO: 1265542 - RNA, 18 nt, Homo sapiens
cuauccagcagaucauuu

SEQ ID NO: 1265543 - RNA, 22 nt, Homo sapiens
cuaucccccgcagcgcucuccu

SEQ ID NO: 1265544 - RNA, 23 nt, Homo sapiens
cuaucccccgcagcgcucuccuu

SEQ ID NO: 1265545 - RNA, 18 nt, Homo sapiens
cuaucccugcggccucca

SEQ ID NO: 1265546 - RNA, 14 nt, Homo sapiens
cuaucgcaccacug

SEQ ID NO: 1265547 - RNA, 15 nt, Homo sapiens
cuaucgcaccacugu

SEQ ID NO: 1265548 - RNA, 23 nt, Homo sapiens
cuaucuccugacagaaggugcca

SEQ ID NO: 1265549 - RNA, 13 nt, Homo sapiens
cuaucuguucccc

SEQ ID NO: 1265550 - RNA, 22 nt, Homo sapiens
cuaucuuuugguauacuugugu

SEQ ID NO: 1265551 - RNA, 20 nt, Homo sapiens
cuaugaaaaugagcaucaga

SEQ ID NO: 1265552 - RNA, 14 nt, Homo sapiens
cuaugaagcuuucu

SEQ ID NO: 1265553 - RNA, 19 nt, Homo sapiens
cuaugaaguuggcacauuu

SEQ ID NO: 1265554 - RNA, 16 nt, Homo sapiens
cuaugagcacauagga

SEQ ID NO: 1265555 - RNA, 17 nt, Homo sapiens
cuaugagcacauaggac

SEQ ID NO: 1265556 - RNA, 20 nt, Homo sapiens
cuaugauauuccccauuucc

SEQ ID NO: 1265557 - RNA, 19 nt, Homo sapiens
cuaugauauuuucugugcc

SEQ ID NO: 1265558 - RNA, 19 nt, Homo sapiens
cuaugaucuggacuuccua

SEQ ID NO: 1265559 - RNA, 19 nt, Homo sapiens
cuaugcaacagcucucacc

SEQ ID NO: 1265560 - RNA, 15 nt, Homo sapiens
cuaugcaagccuugc

SEQ ID NO: 1265561 - RNA, 11 nt, Homo sapiens
cuaugccuuua

SEQ ID NO: 1265562 - RNA, 14 nt, Homo sapiens
cuauggacagggcu

SEQ ID NO: 1265563 - RNA, 16 nt, Homo sapiens
cuaugggacugcagug

SEQ ID NO: 1265564 - RNA, 15 nt, Homo sapiens
cuaugguuugccauu

SEQ ID NO: 1265565 - RNA, 14 nt, Homo sapiens
cuauguaaaccaca

SEQ ID NO: 1265566 - RNA, 16 nt, Homo sapiens
cuauguacugccuuag

SEQ ID NO: 1265567 - RNA, 13 nt, Homo sapiens
cuauguacuuuaa

SEQ ID NO: 1265568 - RNA, 15 nt, Homo sapiens
cuaugugauuacaag

SEQ ID NO: 1265569 - RNA, 15 nt, Homo sapiens
cuaugugcacugaua

SEQ ID NO: 1265570 - RNA, 14 nt, Homo sapiens
cuauguugcccagg

SEQ ID NO: 1265571 - RNA, 14 nt, Homo sapiens
cuauguuuauuuac

SEQ ID NO: 1265572 - RNA, 23 nt, Homo sapiens
cuauuaacuuuaauucucuuuca

SEQ ID NO: 1265573 - RNA, 22 nt, Homo sapiens
cuauuaagauacuuagauuaga

SEQ ID NO: 1265574 - RNA, 12 nt, Homo sapiens
cuauuaagguga

SEQ ID NO: 1265575 - RNA, 13 nt, Homo sapiens
cuauuaauauuca

SEQ ID NO: 1265576 - RNA, 14 nt, Homo sapiens
cuauuaccaugaga

SEQ ID NO: 1265577 - RNA, 20 nt, Homo sapiens
cuauuauagcaacuuuaaga

SEQ ID NO: 1265578 - RNA, 19 nt, Homo sapiens
cuauuauggaaaacugugu

SEQ ID NO: 1265579 - RNA, 16 nt, Homo sapiens
cuauucagacaagcaa

SEQ ID NO: 1265580 - RNA, 20 nt, Homo sapiens
cuauucccugucacuacaca

SEQ ID NO: 1265581 - RNA, 19 nt, Homo sapiens
cuauucccuuugacuucag

SEQ ID NO: 1265582 - RNA, 20 nt, Homo sapiens
cuauucuaacuaaugacaag

SEQ ID NO: 1265583 - RNA, 17 nt, Homo sapiens
cuauucucaugccucag

SEQ ID NO: 1265584 - RNA, 17 nt, Homo sapiens
cuauucuguaucauuga

SEQ ID NO: 1265585 - RNA, 12 nt, Homo sapiens
cuauugcugcuc

SEQ ID NO: 1265586 - RNA, 21 nt, Homo sapiens
cuauugugggacuuauuacaa

SEQ ID NO: 1265587 - RNA, 21 nt, Homo sapiens
cuauuguuacauuauguggaa

SEQ ID NO: 1265588 - RNA, 23 nt, Homo sapiens
cuauuguugaugggcacuugaga

SEQ ID NO: 1265589 - RNA, 15 nt, Homo sapiens
cuauuuaaguuauca

SEQ ID NO: 1265590 - RNA, 21 nt, Homo sapiens
cuauuuagaaauggauuuauc

SEQ ID NO: 1265591 - RNA, 13 nt, Homo sapiens
cuauuuaucugau

SEQ ID NO: 1265592 - RNA, 14 nt, Homo sapiens
cuauuuaucuguag

SEQ ID NO: 1265593 - RNA, 18 nt, Homo sapiens
cuauuuauugacuuugac

SEQ ID NO: 1265594 - RNA, 16 nt, Homo sapiens
cuccgucucaaaagaa

SEQ ID NO: 1265595 - RNA, 19 nt, Homo sapiens
cuccuaaaccauugagcua

SEQ ID NO: 1265596 - RNA, 15 nt, Homo sapiens
cuccuaaugcuuuau

SEQ ID NO: 1265597 - RNA, 20 nt, Homo sapiens
cuccuacacuauugaccagg

SEQ ID NO: 1265598 - RNA, 18 nt, Homo sapiens
cuccuaccuuuugucucu

SEQ ID NO: 1265599 - RNA, 16 nt, Homo sapiens
cuccuacuaaaucccu

SEQ ID NO: 1265600 - RNA, 20 nt, Homo sapiens
cuccuaucagaagcucccag

SEQ ID NO: 1265601 - RNA, 14 nt, Homo sapiens
cuccuaucuguguu

SEQ ID NO: 1265602 - RNA, 19 nt, Homo sapiens
cuccucaaacccagucuca

SEQ ID NO: 1265603 - RNA, 19 nt, Homo sapiens
cuccucaccucaugcccac

SEQ ID NO: 1265604 - RNA, 20 nt, Homo sapiens
cuccucagcggcuccagcuc

SEQ ID NO: 1265605 - RNA, 19 nt, Homo sapiens
cuccucccaggaacugggc

SEQ ID NO: 1265606 - RNA, 18 nt, Homo sapiens
cuccucgggaaacacaca

SEQ ID NO: 1265607 - RNA, 21 nt, Homo sapiens
cuccucuaguaagaugcacug

SEQ ID NO: 1265608 - RNA, 19 nt, Homo sapiens
cuccucucccauccuugau

SEQ ID NO: 1265609 - RNA, 22 nt, Homo sapiens
cuccucuggacggcaggcucac

SEQ ID NO: 1265610 - RNA, 18 nt, Homo sapiens
cuccucuucacuuggcca

SEQ ID NO: 1265611 - RNA, 12 nt, Homo sapiens
cuccucuugacu

SEQ ID NO: 1265612 - RNA, 14 nt, Homo sapiens
cuccucuugccacu

SEQ ID NO: 1265613 - RNA, 13 nt, Homo sapiens
cuccugacagcaa

SEQ ID NO: 1265614 - RNA, 20 nt, Homo sapiens
cuccugaccucaggugaucc

SEQ ID NO: 1265615 - RNA, 19 nt, Homo sapiens
cuccugaccucaggugauu

SEQ ID NO: 1265616 - RNA, 20 nt, Homo sapiens
cuccugaguagcugggauua

SEQ ID NO: 1265617 - RNA, 21 nt, Homo sapiens
cuccugauaaaacaacagcuc

SEQ ID NO: 1265618 - RNA, 13 nt, Homo sapiens
cuccugauggcca

SEQ ID NO: 1265619 - RNA, 13 nt, Homo sapiens
cuccugccacaac

SEQ ID NO: 1265620 - RNA, 17 nt, Homo sapiens
cuccugccaccagcauc

SEQ ID NO: 1265621 - RNA, 22 nt, Homo sapiens
cuccugccauaggguccugaau

SEQ ID NO: 1265622 - RNA, 17 nt, Homo sapiens
cuccugcccaagcacuu

SEQ ID NO: 1265623 - RNA, 23 nt, Homo sapiens
cuccuggaaaggcucagucucag

SEQ ID NO: 1265624 - RNA, 23 nt, Homo sapiens
cuccuggcaaucaauacagcuuc

SEQ ID NO: 1265625 - RNA, 19 nt, Homo sapiens
cuccuggccucaagugauc

SEQ ID NO: 1265626 - RNA, 22 nt, Homo sapiens
cuccugggaagaugagguucug

SEQ ID NO: 1265627 - RNA, 18 nt, Homo sapiens
cuccugggcuaagugauc

SEQ ID NO: 1265628 - RNA, 16 nt, Homo sapiens
cuccuggggucacuca

SEQ ID NO: 1265629 - RNA, 16 nt, Homo sapiens
cuccugugaauggagg

SEQ ID NO: 1265630 - RNA, 20 nt, Homo sapiens
cuccugugcuagaugugcaa

SEQ ID NO: 1265631 - RNA, 16 nt, Homo sapiens
cuccuguuuugcacag

SEQ ID NO: 1265632 - RNA, 13 nt, Homo sapiens
cuccuuccagugu

SEQ ID NO: 1265633 - RNA, 13 nt, Homo sapiens
cuccuugcacuuu

SEQ ID NO: 1265634 - RNA, 14 nt, Homo sapiens
cuccuugcacuuuc

SEQ ID NO: 1265635 - RNA, 22 nt, Homo sapiens
cuccuuggauguagucaguuag

SEQ ID NO: 1265636 - RNA, 14 nt, Homo sapiens
cuccuugguauuuc

SEQ ID NO: 1265637 - RNA, 14 nt, Homo sapiens
cuccuuggugccug

SEQ ID NO: 1265638 - RNA, 18 nt, Homo sapiens
cuccuuugaaaccugcuc

SEQ ID NO: 1265639 - RNA, 20 nt, Homo sapiens
cuccuuuuuugcaugugcaa

SEQ ID NO: 1265640 - RNA, 21 nt, Homo sapiens
cucgaagucauggccaccucc

SEQ ID NO: 1265641 - RNA, 17 nt, Homo sapiens
cucgaaucucugugccu

SEQ ID NO: 1265642 - RNA, 22 nt, Homo sapiens
cucgagaucauucuucacucag

SEQ ID NO: 1265643 - RNA, 16 nt, Homo sapiens
cucgccaacaugguga

SEQ ID NO: 1265644 - RNA, 22 nt, Homo sapiens
cucgccagcucauucucaccaa

SEQ ID NO: 1265645 - RNA, 21 nt, Homo sapiens
cucgccccaccuccaccugug

SEQ ID NO: 1265646 - RNA, 17 nt, Homo sapiens
cucgcuuuguugcccag

SEQ ID NO: 1265647 - RNA, 23 nt, Homo sapiens
cucggaaauggaaugugccccug

SEQ ID NO: 1265648 - RNA, 22 nt, Homo sapiens
cucggagaaacgggugagcuga

SEQ ID NO: 1265649 - RNA, 12 nt, Homo sapiens
cucggaugacac

SEQ ID NO: 1265650 - RNA, 17 nt, Homo sapiens
cucggcagucacuucca

SEQ ID NO: 1265651 - RNA, 19 nt, Homo sapiens
cucggcagucacuuccacu

SEQ ID NO: 1265652 - RNA, 21 nt, Homo sapiens
cucgggaaacuuagaucauca

SEQ ID NO: 1265653 - RNA, 20 nt, Homo sapiens
cucggggggguuuucaucua

SEQ ID NO: 1265654 - RNA, 22 nt, Homo sapiens
cucggggguggagugagacuga

SEQ ID NO: 1265655 - RNA, 21 nt, Homo sapiens
cucgguucugcgccacuuccu

SEQ ID NO: 1265656 - RNA, 14 nt, Homo sapiens
cucguccacagggg

SEQ ID NO: 1265657 - RNA, 13 nt, Homo sapiens
cucguggucccca

SEQ ID NO: 1265658 - RNA, 13 nt, Homo sapiens
cucgugugccugg

SEQ ID NO: 1265659 - RNA, 17 nt, Homo sapiens
cucguucaaaacauucc

SEQ ID NO: 1265660 - RNA, 16 nt, Homo sapiens
cucuaaaaaagaacuu

SEQ ID NO: 1265661 - RNA, 18 nt, Homo sapiens
cucuaaacugguacaauu

SEQ ID NO: 1265662 - RNA, 14 nt, Homo sapiens
cucuaaagaccaaa

SEQ ID NO: 1265663 - RNA, 23 nt, Homo sapiens
cucuaauguacaauaaagcaaug

SEQ ID NO: 1265664 - RNA, 18 nt, Homo sapiens
cucuaauucacagugcuc

SEQ ID NO: 1265665 - RNA, 14 nt, Homo sapiens
cucuacagugccaa

SEQ ID NO: 1265666 - RNA, 21 nt, Homo sapiens
cucuacugaaaguacaaaaau

SEQ ID NO: 1265667 - RNA, 16 nt, Homo sapiens
cucuacuuaaugagau

SEQ ID NO: 1265668 - RNA, 14 nt, Homo sapiens
cucuagaagccaag

SEQ ID NO: 1265669 - RNA, 14 nt, Homo sapiens
cucuagauugagag

SEQ ID NO: 1265670 - RNA, 12 nt, Homo sapiens
cucuagcucucu

SEQ ID NO: 1265671 - RNA, 19 nt, Homo sapiens
cucuagggaaucuggauua

SEQ ID NO: 1265672 - RNA, 21 nt, Homo sapiens
cucuagguacgaugacagugu

SEQ ID NO: 1265673 - RNA, 16 nt, Homo sapiens
cucuaggucaguauua

SEQ ID NO: 1265674 - RNA, 17 nt, Homo sapiens
cucuaguaagaugcacu

SEQ ID NO: 1265675 - RNA, 14 nt, Homo sapiens
cucuagucagcaca

SEQ ID NO: 1265676 - RNA, 15 nt, Homo sapiens
cucuauaacagaucc

SEQ ID NO: 1265677 - RNA, 21 nt, Homo sapiens
cucuauagacucuaggacaua

SEQ ID NO: 1265678 - RNA, 20 nt, Homo sapiens
cucuaugaaaauuauaucuc

SEQ ID NO: 1265679 - RNA, 14 nt, Homo sapiens
cucuauugcugcuc

SEQ ID NO: 1265680 - RNA, 21 nt, Homo sapiens
cucuauuuguaauugaacuua

SEQ ID NO: 1265681 - RNA, 22 nt, Homo sapiens
cucucaauuaaagucuauucaa

SEQ ID NO: 1265682 - RNA, 13 nt, Homo sapiens
cucucacaugcac

SEQ ID NO: 1265683 - RNA, 14 nt, Homo sapiens
cucucagcugacca

SEQ ID NO: 1265684 - RNA, 16 nt, Homo sapiens
cucucagcugaccauc

SEQ ID NO: 1265685 - RNA, 19 nt, Homo sapiens
cucucaugggguccaaguu

SEQ ID NO: 1265686 - RNA, 21 nt, Homo sapiens
cucucauuucuggaaagugca

SEQ ID NO: 1265687 - RNA, 15 nt, Homo sapiens
cucuccaagugccag

SEQ ID NO: 1265688 - RNA, 16 nt, Homo sapiens
cucuccagcugacuaa

SEQ ID NO: 1265689 - RNA, 13 nt, Homo sapiens
cucuccauauccc

SEQ ID NO: 1265690 - RNA, 14 nt, Homo sapiens
cucucccaacucaa

SEQ ID NO: 1265691 - RNA, 15 nt, Homo sapiens
cucuccccuccagcc

SEQ ID NO: 1265692 - RNA, 19 nt, Homo sapiens
cucuccccuccagccuuug

SEQ ID NO: 1265693 - RNA, 14 nt, Homo sapiens
cucuccucuugcca

SEQ ID NO: 1265694 - RNA, 21 nt, Homo sapiens
cucuccuuauagacacuugcu

SEQ ID NO: 1265695 - RNA, 19 nt, Homo sapiens
cucuccuuuggccauucca

SEQ ID NO: 1265696 - RNA, 12 nt, Homo sapiens
cucucuccuuau

SEQ ID NO: 1265697 - RNA, 15 nt, Homo sapiens
cucucuucugcucca

SEQ ID NO: 1265698 - RNA, 20 nt, Homo sapiens
cucucuuuguucucagcucc

SEQ ID NO: 1265699 - RNA, 18 nt, Homo sapiens
cucugaagcauguuucau

SEQ ID NO: 1265700 - RNA, 15 nt, Homo sapiens
cucugaccugcacug

SEQ ID NO: 1265701 - RNA, 20 nt, Homo sapiens
cucugagcacccaagccagg

SEQ ID NO: 1265702 - RNA, 17 nt, Homo sapiens
cucugagccuuggugua

SEQ ID NO: 1265703 - RNA, 22 nt, Homo sapiens
cucugagcgggaggcagaguuu

SEQ ID NO: 1265704 - RNA, 15 nt, Homo sapiens
cucugaggauguaua

SEQ ID NO: 1265705 - RNA, 15 nt, Homo sapiens
cucugauaugggacu

SEQ ID NO: 1265706 - RNA, 16 nt, Homo sapiens
cucugauaugggacug

SEQ ID NO: 1265707 - RNA, 12 nt, Homo sapiens
cucugaugcaau

SEQ ID NO: 1265708 - RNA, 13 nt, Homo sapiens
cucugaugcaaua

SEQ ID NO: 1265709 - RNA, 11 nt, Homo sapiens
cucugcaaugc

SEQ ID NO: 1265710 - RNA, 13 nt, Homo sapiens
cucugcacauguc

SEQ ID NO: 1265711 - RNA, 22 nt, Homo sapiens
cucugcagacugcuaguguucu

SEQ ID NO: 1265712 - RNA, 16 nt, Homo sapiens
cucugcagacuuccca

SEQ ID NO: 1265713 - RNA, 20 nt, Homo sapiens
cucugcaggccuaggugcag

SEQ ID NO: 1265714 - RNA, 15 nt, Homo sapiens
cucugcauucuagua

SEQ ID NO: 1265715 - RNA, 11 nt, Homo sapiens
cucugccuucc

SEQ ID NO: 1265716 - RNA, 20 nt, Homo sapiens
cucugccuuucuaagacuca

SEQ ID NO: 1265717 - RNA, 18 nt, Homo sapiens
cucugccuuugacauuua

SEQ ID NO: 1265718 - RNA, 21 nt, Homo sapiens
cucugcugcuugagagcuauu

SEQ ID NO: 1265719 - RNA, 16 nt, Homo sapiens
cucugcugguuccuga

SEQ ID NO: 1265720 - RNA, 20 nt, Homo sapiens
gaaaguccaauuccaaagcc

SEQ ID NO: 1265721 - RNA, 23 nt, Homo sapiens
gaaaguccaauuccaaagccaga

SEQ ID NO: 1265722 - RNA, 11 nt, Homo sapiens
gaaagugaaac

SEQ ID NO: 1265723 - RNA, 14 nt, Homo sapiens
gaaagugacuuuaa

SEQ ID NO: 1265724 - RNA, 14 nt, Homo sapiens
gaaagugcauauga

SEQ ID NO: 1265725 - RNA, 14 nt, Homo sapiens
gaaaguuuuggaaa

SEQ ID NO: 1265726 - RNA, 23 nt, Homo sapiens
gaaauaaauaaaccugaauguac

SEQ ID NO: 1265727 - RNA, 15 nt, Homo sapiens
gaaauaaaucagaga

SEQ ID NO: 1265728 - RNA, 15 nt, Homo sapiens
gaaauaaauguaccu

SEQ ID NO: 1265729 - RNA, 22 nt, Homo sapiens
gaaauaaauguaccugauguac

SEQ ID NO: 1265730 - RNA, 15 nt, Homo sapiens
gaaauaacaauguua

SEQ ID NO: 1265731 - RNA, 18 nt, Homo sapiens
gaaauaagcccaacagac

SEQ ID NO: 1265732 - RNA, 13 nt, Homo sapiens
gaaauacuuucag

SEQ ID NO: 1265733 - RNA, 16 nt, Homo sapiens
gaaauaguaccuucaa

SEQ ID NO: 1265734 - RNA, 14 nt, Homo sapiens
gaaauauagccaaa

SEQ ID NO: 1265735 - RNA, 23 nt, Homo sapiens
gaaauauaguaaacacuuggaaa

SEQ ID NO: 1265736 - RNA, 22 nt, Homo sapiens
gaaauauggaacuuacauuguu

SEQ ID NO: 1265737 - RNA, 16 nt, Homo sapiens
gaaaucaguguuuuag

SEQ ID NO: 1265738 - RNA, 15 nt, Homo sapiens
gaaaucauuguagaa

SEQ ID NO: 1265739 - RNA, 17 nt, Homo sapiens
gaaauccauuccauuuu

SEQ ID NO: 1265740 - RNA, 20 nt, Homo sapiens
gaaauccguucuauuuugug

SEQ ID NO: 1265741 - RNA, 15 nt, Homo sapiens
gaaaucuaaauuucu

SEQ ID NO: 1265742 - RNA, 18 nt, Homo sapiens
gaaaucuagaagacuguc

SEQ ID NO: 1265743 - RNA, 12 nt, Homo sapiens
gaaaucugccaa

SEQ ID NO: 1265744 - RNA, 23 nt, Homo sapiens
gaaaucuugucuuaccacagugu

SEQ ID NO: 1265745 - RNA, 16 nt, Homo sapiens
gaaaucuuuaugugau

SEQ ID NO: 1265746 - RNA, 11 nt, Homo sapiens
gaaaugcaaaa

SEQ ID NO: 1265747 - RNA, 12 nt, Homo sapiens
gaaaugcaaaac

SEQ ID NO: 1265748 - RNA, 18 nt, Homo sapiens
gaaaugcuaugacuguau

SEQ ID NO: 1265749 - RNA, 20 nt, Homo sapiens
gaaauggauuuaucaucacc

SEQ ID NO: 1265750 - RNA, 18 nt, Homo sapiens
gaaauguaaacugccaua

SEQ ID NO: 1265751 - RNA, 17 nt, Homo sapiens
gaaauguaccuucuuuc

SEQ ID NO: 1265752 - RNA, 17 nt, Homo sapiens
gaaauguaugugcucuu

SEQ ID NO: 1265753 - RNA, 22 nt, Homo sapiens
gaaauguuaaagguucacaggg

SEQ ID NO: 1265754 - RNA, 11 nt, Homo sapiens
gaaauuaacac

SEQ ID NO: 1265755 - RNA, 14 nt, Homo sapiens
gaaauuauuauuca

SEQ ID NO: 1265756 - RNA, 16 nt, Homo sapiens
gaaauuccuguacugu

SEQ ID NO: 1265757 - RNA, 15 nt, Homo sapiens
gaaauugaccauaca

SEQ ID NO: 1265758 - RNA, 13 nt, Homo sapiens
gaaauuuggcaaa

SEQ ID NO: 1265759 - RNA, 19 nt, Homo sapiens
gaacaaaaauuacaaagaa

SEQ ID NO: 1265760 - RNA, 14 nt, Homo sapiens
gaacaaaaugaauu

SEQ ID NO: 1265761 - RNA, 20 nt, Homo sapiens
gaacaaaauguaaagccagc

SEQ ID NO: 1265762 - RNA, 19 nt, Homo sapiens
gaacaaaguccacaguuua

SEQ ID NO: 1265763 - RNA, 17 nt, Homo sapiens
gaacaacgccugucaca

SEQ ID NO: 1265764 - RNA, 18 nt, Homo sapiens
gaacaacuccaaaaccca

SEQ ID NO: 1265765 - RNA, 18 nt, Homo sapiens
gaacaagcccaacaguaa

SEQ ID NO: 1265766 - RNA, 18 nt, Homo sapiens
gaacaaucaaagcacuug

SEQ ID NO: 1265767 - RNA, 17 nt, Homo sapiens
gaacacaggcagcuuuc

SEQ ID NO: 1265768 - RNA, 21 nt, Homo sapiens
gaacacccgacuccucaaaag

SEQ ID NO: 1265769 - RNA, 15 nt, Homo sapiens
gaacagaccagugac

SEQ ID NO: 1265770 - RNA, 22 nt, Homo sapiens
gaacagcgggagaccugugcua

SEQ ID NO: 1265771 - RNA, 17 nt, Homo sapiens
gaacagcuguaaucuau

SEQ ID NO: 1265772 - RNA, 22 nt, Homo sapiens
gaacauaaaaaauaaaguacca

SEQ ID NO: 1265773 - RNA, 16 nt, Homo sapiens
gaacauagaacucugg

SEQ ID NO: 1265774 - RNA, 20 nt, Homo sapiens
gaacaugcccccugcagaca

SEQ ID NO: 1265775 - RNA, 19 nt, Homo sapiens
gaacauuucuuucuugcug

SEQ ID NO: 1265776 - RNA, 19 nt, Homo sapiens
gaacauuuuaauucauccc

SEQ ID NO: 1265777 - RNA, 10 nt, Homo sapiens
gaaccaaaac

SEQ ID NO: 1265778 - RNA, 19 nt, Homo sapiens
gaaccaaaagaauuugcac

SEQ ID NO: 1265779 - RNA, 17 nt, Homo sapiens
gaaccaaauugcacuga

SEQ ID NO: 1265780 - RNA, 18 nt, Homo sapiens
gaaccaaggcagccucca

SEQ ID NO: 1265781 - RNA, 12 nt, Homo sapiens
gaaccacuccca

SEQ ID NO: 1265782 - RNA, 21 nt, Homo sapiens
gaaccacucccaccacaggca

SEQ ID NO: 1265783 - RNA, 23 nt, Homo sapiens
gaaccagccguauuuuacaugaa

SEQ ID NO: 1265784 - RNA, 13 nt, Homo sapiens
gaaccaugcagga

SEQ ID NO: 1265785 - RNA, 21 nt, Homo sapiens
gaaccauguggauaacuuuac

SEQ ID NO: 1265786 - RNA, 19 nt, Homo sapiens
gaaccauucacagugcaag

SEQ ID NO: 1265787 - RNA, 13 nt, Homo sapiens
gaaccauuuacuu

SEQ ID NO: 1265788 - RNA, 14 nt, Homo sapiens
gaaccccaggagau

SEQ ID NO: 1265789 - RNA, 23 nt, Homo sapiens
gaacccgggagguggagauugca

SEQ ID NO: 1265790 - RNA, 20 nt, Homo sapiens
gaacccucaggucacaagag

SEQ ID NO: 1265791 - RNA, 13 nt, Homo sapiens
gaaccgcacagcu

SEQ ID NO: 1265792 - RNA, 12 nt, Homo sapiens
gaaccucuccau

SEQ ID NO: 1265793 - RNA, 21 nt, Homo sapiens
gaaccugcccugcucccacag

SEQ ID NO: 1265794 - RNA, 22 nt, Homo sapiens
gaaccuguccuaaggaaccuuc

SEQ ID NO: 1265795 - RNA, 14 nt, Homo sapiens
gaacuaaagcaaau

SEQ ID NO: 1265796 - RNA, 23 nt, Homo sapiens
gaacuaauaaauacauacgguca

SEQ ID NO: 1265797 - RNA, 20 nt, Homo sapiens
gaacuaaugauaaucccacc

SEQ ID NO: 1265798 - RNA, 16 nt, Homo sapiens
gaacuacagcucuuaa

SEQ ID NO: 1265799 - RNA, 20 nt, Homo sapiens
gaacuacagguguuugacuu

SEQ ID NO: 1265800 - RNA, 17 nt, Homo sapiens
gaacuaccaucugaugu

SEQ ID NO: 1265801 - RNA, 20 nt, Homo sapiens
gaacuacggggcuuacagga

SEQ ID NO: 1265802 - RNA, 19 nt, Homo sapiens
gaacuacuuuuggugcuua

SEQ ID NO: 1265803 - RNA, 18 nt, Homo sapiens
gaacuagccaaaccagga

SEQ ID NO: 1265804 - RNA, 14 nt, Homo sapiens
gaacuauaacuguu

SEQ ID NO: 1265805 - RNA, 20 nt, Homo sapiens
gaacuauuucuacacagugg

SEQ ID NO: 1265806 - RNA, 22 nt, Homo sapiens
gaacucagagaugaacaucuaa

SEQ ID NO: 1265807 - RNA, 15 nt, Homo sapiens
gaacuccagagucag

SEQ ID NO: 1265808 - RNA, 18 nt, Homo sapiens
gaacugaaggcauaugca

SEQ ID NO: 1265809 - RNA, 18 nt, Homo sapiens
gaacugagaccuccagaa

SEQ ID NO: 1265810 - RNA, 16 nt, Homo sapiens
gaacugcagucagcau

SEQ ID NO: 1265811 - RNA, 23 nt, Homo sapiens
gaacugcuuuuccucaagcaaua

SEQ ID NO: 1265812 - RNA, 16 nt, Homo sapiens
gaacuggauucuuaac

SEQ ID NO: 1265813 - RNA, 21 nt, Homo sapiens
gaacuggauucuuaaccaaga

SEQ ID NO: 1265814 - RNA, 19 nt, Homo sapiens
gaacuggggcuuugccuug

SEQ ID NO: 1265815 - RNA, 15 nt, Homo sapiens
gaacuguagggccag

SEQ ID NO: 1265816 - RNA, 16 nt, Homo sapiens
gaacuguagggccagg

SEQ ID NO: 1265817 - RNA, 15 nt, Homo sapiens
gaacuguccagagag

SEQ ID NO: 1265818 - RNA, 23 nt, Homo sapiens
gaacuguuuuguaagugcugcua

SEQ ID NO: 1265819 - RNA, 17 nt, Homo sapiens
gaacuucugacuacuug

SEQ ID NO: 1265820 - RNA, 21 nt, Homo sapiens
gaacuuuaagaagcaguguuu

SEQ ID NO: 1265821 - RNA, 12 nt, Homo sapiens
gaacuuucuccc

SEQ ID NO: 1265822 - RNA, 20 nt, Homo sapiens
gaacuuuuuuagaaaugcaa

SEQ ID NO: 1265823 - RNA, 21 nt, Homo sapiens
gaacuuuuuuagaaaugcaaa

SEQ ID NO: 1265824 - RNA, 12 nt, Homo sapiens
gaagaaagcaaa

SEQ ID NO: 1265825 - RNA, 16 nt, Homo sapiens
gaagaaauuuaugaag

SEQ ID NO: 1265826 - RNA, 19 nt, Homo sapiens
gaagaacccucaggucaca

SEQ ID NO: 1265827 - RNA, 20 nt, Homo sapiens
gaagaagucuaagagugaag

SEQ ID NO: 1265828 - RNA, 21 nt, Homo sapiens
gaagaagucuaagagugaagu

SEQ ID NO: 1265829 - RNA, 13 nt, Homo sapiens
gaagacacacuca

SEQ ID NO: 1265830 - RNA, 22 nt, Homo sapiens
gaagacacacucagcaaccaca

SEQ ID NO: 1265831 - RNA, 23 nt, Homo sapiens
gaagacacugcagugaccacuua

SEQ ID NO: 1265832 - RNA, 20 nt, Homo sapiens
gaagaccaaagcauugccug

SEQ ID NO: 1265833 - RNA, 11 nt, Homo sapiens
gaagaccagcu

SEQ ID NO: 1265834 - RNA, 20 nt, Homo sapiens
gaagaccagcuuugcaguga

SEQ ID NO: 1265835 - RNA, 16 nt, Homo sapiens
gaagacccacgugcua

SEQ ID NO: 1265836 - RNA, 17 nt, Homo sapiens
gaagacccacgugcuag

SEQ ID NO: 1265837 - RNA, 19 nt, Homo sapiens
gaagacccacgugcuaggg

SEQ ID NO: 1265838 - RNA, 20 nt, Homo sapiens
gaagaccggcugguggagcu

SEQ ID NO: 1265839 - RNA, 19 nt, Homo sapiens
gaagacugugaaguugcca

SEQ ID NO: 1265840 - RNA, 18 nt, Homo sapiens
gaagacuugaagcacaga

SEQ ID NO: 1265841 - RNA, 14 nt, Homo sapiens
gaagagaccaagac

SEQ ID NO: 1265842 - RNA, 18 nt, Homo sapiens
gaagagauuucaacauau

SEQ ID NO: 1265843 - RNA, 15 nt, Homo sapiens
gaagaggcugcugag

SEQ ID NO: 1265844 - RNA, 20 nt, Homo sapiens
gaagauaacuugagcaccgu

SEQ ID NO: 1265845 - RNA, 21 nt, Homo sapiens
gaagauugcgguuuacagcua

SEQ ID NO: 1265846 - RNA, 18 nt, Homo sapiens
gagaggccuuuuggaaug

SEQ ID NO: 1265847 - RNA, 23 nt, Homo sapiens
gagaggucucagguucuuuccau

SEQ ID NO: 1265848 - RNA, 22 nt, Homo sapiens
gagagugaaaccaugacuguga

SEQ ID NO: 1265849 - RNA, 14 nt, Homo sapiens
gagaguuucuguua

SEQ ID NO: 1265850 - RNA, 16 nt, Homo sapiens
gagauaaaccaauaaa

SEQ ID NO: 1265851 - RNA, 19 nt, Homo sapiens
gagauacugaacauuuugc

SEQ ID NO: 1265852 - RNA, 21 nt, Homo sapiens
gagauaggccugugggccaga

SEQ ID NO: 1265853 - RNA, 19 nt, Homo sapiens
gagauauggcauugcacug

SEQ ID NO: 1265854 - RNA, 13 nt, Homo sapiens
gagauauuuacau

SEQ ID NO: 1265855 - RNA, 17 nt, Homo sapiens
gagauauuugguaccau

SEQ ID NO: 1265856 - RNA, 14 nt, Homo sapiens
gagaucacuacuca

SEQ ID NO: 1265857 - RNA, 21 nt, Homo sapiens
gagaucgcaucauugcacucu

SEQ ID NO: 1265858 - RNA, 15 nt, Homo sapiens
gagaugaccagggau

SEQ ID NO: 1265859 - RNA, 20 nt, Homo sapiens
gagaugagugauccugccuc

SEQ ID NO: 1265860 - RNA, 22 nt, Homo sapiens
gagaugcagucacuuauugucc

SEQ ID NO: 1265861 - RNA, 19 nt, Homo sapiens
gagaugcgaaccacccaaa

SEQ ID NO: 1265862 - RNA, 14 nt, Homo sapiens
gagaugcuggagaa

SEQ ID NO: 1265863 - RNA, 13 nt, Homo sapiens
gagauggaguucu

SEQ ID NO: 1265864 - RNA, 15 nt, Homo sapiens
gagaugggaaggcac

SEQ ID NO: 1265865 - RNA, 12 nt, Homo sapiens
gagauggucaca

SEQ ID NO: 1265866 - RNA, 12 nt, Homo sapiens
gagaugucuucu

SEQ ID NO: 1265867 - RNA, 18 nt, Homo sapiens
gagauuacuuugcugccu

SEQ ID NO: 1265868 - RNA, 20 nt, Homo sapiens
gagauuagucucuucugugu

SEQ ID NO: 1265869 - RNA, 13 nt, Homo sapiens
gagauuccacaca

SEQ ID NO: 1265870 - RNA, 13 nt, Homo sapiens
gagauucuucccc

SEQ ID NO: 1265871 - RNA, 14 nt, Homo sapiens
gagauugaacucca

SEQ ID NO: 1265872 - RNA, 20 nt, Homo sapiens
gagauugagcagaagaucaa

SEQ ID NO: 1265873 - RNA, 17 nt, Homo sapiens
gagauuguuguuugcca

SEQ ID NO: 1265874 - RNA, 21 nt, Homo sapiens
gagauuugucuaauugcaucu

SEQ ID NO: 1265875 - RNA, 14 nt, Homo sapiens
gagcaaaaagacca

SEQ ID NO: 1265876 - RNA, 17 nt, Homo sapiens
gagcaaaaggcagcuca

SEQ ID NO: 1265877 - RNA, 23 nt, Homo sapiens
gagcaaacuaacuugacuuuuaa

SEQ ID NO: 1265878 - RNA, 12 nt, Homo sapiens
gagcaaauauca

SEQ ID NO: 1265879 - RNA, 22 nt, Homo sapiens
gagcaaauaucauacuguucaa

SEQ ID NO: 1265880 - RNA, 17 nt, Homo sapiens
gagcaaauggugcugaa

SEQ ID NO: 1265881 - RNA, 22 nt, Homo sapiens
gagcaagacucugucucaaaaa

SEQ ID NO: 1265882 - RNA, 15 nt, Homo sapiens
gagcaagggggccca

SEQ ID NO: 1265883 - RNA, 23 nt, Homo sapiens
gagcacaagccacaagucuucca

SEQ ID NO: 1265884 - RNA, 16 nt, Homo sapiens
gagcacccaagccagg

SEQ ID NO: 1265885 - RNA, 19 nt, Homo sapiens
gagcaccuuugcacaggau

SEQ ID NO: 1265886 - RNA, 13 nt, Homo sapiens
gagcacuuccaaa

SEQ ID NO: 1265887 - RNA, 18 nt, Homo sapiens
gagcacuugcguccugca

SEQ ID NO: 1265888 - RNA, 17 nt, Homo sapiens
gagcagaaagcugugaa

SEQ ID NO: 1265889 - RNA, 23 nt, Homo sapiens
gagcagacaccagcagcccuguc

SEQ ID NO: 1265890 - RNA, 19 nt, Homo sapiens
gagcagccacaaccaaaaa

SEQ ID NO: 1265891 - RNA, 22 nt, Homo sapiens
gagcagcucuucagcacaaaga

SEQ ID NO: 1265892 - RNA, 17 nt, Homo sapiens
gagcagcuucagugaca

SEQ ID NO: 1265893 - RNA, 22 nt, Homo sapiens
gagcagcuucugggaccauaag

SEQ ID NO: 1265894 - RNA, 22 nt, Homo sapiens
gagcagcuuuaaacucagggac

SEQ ID NO: 1265895 - RNA, 18 nt, Homo sapiens
gagcaggaccuacuagga

SEQ ID NO: 1265896 - RNA, 13 nt, Homo sapiens
gagcaggacucac

SEQ ID NO: 1265897 - RNA, 14 nt, Homo sapiens
gagcaggaggccaa

SEQ ID NO: 1265898 - RNA, 18 nt, Homo sapiens
gagcaggaggccaauaaa

SEQ ID NO: 1265899 - RNA, 21 nt, Homo sapiens
gagcaggccggaaccacaggg

SEQ ID NO: 1265900 - RNA, 24 nt, Homo sapiens
gagcaggccggaaccacagggcca

SEQ ID NO: 1265901 - RNA, 22 nt, Homo sapiens
gagcauaucaaaaaguauuaaa

SEQ ID NO: 1265902 - RNA, 22 nt, Homo sapiens
gagcauccucucucacauggaa

SEQ ID NO: 1265903 - RNA, 21 nt, Homo sapiens
gagccaaagcuuaugugacau

SEQ ID NO: 1265904 - RNA, 19 nt, Homo sapiens
gagccaacucuaacaggca

SEQ ID NO: 1265905 - RNA, 15 nt, Homo sapiens
gagccaccaguucuc

SEQ ID NO: 1265906 - RNA, 21 nt, Homo sapiens
gagccagcuuggggccaccaa

SEQ ID NO: 1265907 - RNA, 20 nt, Homo sapiens
gagccauagcugaucauguc

SEQ ID NO: 1265908 - RNA, 15 nt, Homo sapiens
gagccaugcugggaa

SEQ ID NO: 1265909 - RNA, 18 nt, Homo sapiens
gagcccaagcuaagccau

SEQ ID NO: 1265910 - RNA, 14 nt, Homo sapiens
gagcccacuuccau

SEQ ID NO: 1265911 - RNA, 21 nt, Homo sapiens
gagcccagaucgcaccacugc

SEQ ID NO: 1265912 - RNA, 21 nt, Homo sapiens
gagcccaggaguucaagacca

SEQ ID NO: 1265913 - RNA, 16 nt, Homo sapiens
gagcccauacucagcc

SEQ ID NO: 1265914 - RNA, 16 nt, Homo sapiens
gagcccauagccagcu

SEQ ID NO: 1265915 - RNA, 16 nt, Homo sapiens
gagcccccacauucuc

SEQ ID NO: 1265916 - RNA, 15 nt, Homo sapiens
gagcccccaccacaa

SEQ ID NO: 1265917 - RNA, 16 nt, Homo sapiens
gagcccccaccacaaa

SEQ ID NO: 1265918 - RNA, 18 nt, Homo sapiens
gagccccuacagcauugu

SEQ ID NO: 1265919 - RNA, 19 nt, Homo sapiens
gagcccggcaacucuagua

SEQ ID NO: 1265920 - RNA, 16 nt, Homo sapiens
gagcccuggcaggaug

SEQ ID NO: 1265921 - RNA, 17 nt, Homo sapiens
gagccgauggaucugug

SEQ ID NO: 1265922 - RNA, 12 nt, Homo sapiens
gagccgcuguga

SEQ ID NO: 1265923 - RNA, 15 nt, Homo sapiens
gagccugaacaugcc

SEQ ID NO: 1265924 - RNA, 15 nt, Homo sapiens
gagccuggcacagga

SEQ ID NO: 1265925 - RNA, 16 nt, Homo sapiens
gagccuggcacaggac

SEQ ID NO: 1265926 - RNA, 18 nt, Homo sapiens
gagccuucaagugccaaa

SEQ ID NO: 1265927 - RNA, 20 nt, Homo sapiens
gagccuuggcuguuggcagu

SEQ ID NO: 1265928 - RNA, 16 nt, Homo sapiens
gagccuuuggccagaa

SEQ ID NO: 1265929 - RNA, 16 nt, Homo sapiens
gagcguucucuguccu

SEQ ID NO: 1265930 - RNA, 16 nt, Homo sapiens
gagcuaaucuucauuu

SEQ ID NO: 1265931 - RNA, 17 nt, Homo sapiens
gagcucagcugggccag

SEQ ID NO: 1265932 - RNA, 13 nt, Homo sapiens
gagcucagugugu

SEQ ID NO: 1265933 - RNA, 18 nt, Homo sapiens
gagcuccaaauugaauca

SEQ ID NO: 1265934 - RNA, 17 nt, Homo sapiens
gagcuccccagaucucc

SEQ ID NO: 1265935 - RNA, 19 nt, Homo sapiens
gagcuccugcugcggagga

SEQ ID NO: 1265936 - RNA, 13 nt, Homo sapiens
gagcucuuggccu

SEQ ID NO: 1265937 - RNA, 20 nt, Homo sapiens
gagcugacccagaguggagu

SEQ ID NO: 1265938 - RNA, 21 nt, Homo sapiens
gagcugaguggccagccagug

SEQ ID NO: 1265939 - RNA, 20 nt, Homo sapiens
gagcugaugaaacucacaaa

SEQ ID NO: 1265940 - RNA, 15 nt, Homo sapiens
gagcugcacugauca

SEQ ID NO: 1265941 - RNA, 19 nt, Homo sapiens
gagcugcagaaugacucca

SEQ ID NO: 1265942 - RNA, 15 nt, Homo sapiens
gagcugcagguuccu

SEQ ID NO: 1265943 - RNA, 22 nt, Homo sapiens
gagcugccaagagugaagggaa

SEQ ID NO: 1265944 - RNA, 16 nt, Homo sapiens
gagcugcucuccuauc

SEQ ID NO: 1265945 - RNA, 14 nt, Homo sapiens
gagcuggaggugga

SEQ ID NO: 1265946 - RNA, 19 nt, Homo sapiens
gagcugucccaccugcaca

SEQ ID NO: 1265947 - RNA, 22 nt, Homo sapiens
gagcuguccccguguugcauga

SEQ ID NO: 1265948 - RNA, 16 nt, Homo sapiens
gagcuuggcagcugaa

SEQ ID NO: 1265949 - RNA, 15 nt, Homo sapiens
gagcuuucuuugcac

SEQ ID NO: 1265950 - RNA, 23 nt, Homo sapiens
gaggaaaagagaaggaaagugau

SEQ ID NO: 1265951 - RNA, 22 nt, Homo sapiens
gaggaaaaggaaaaaaagcaaa

SEQ ID NO: 1265952 - RNA, 21 nt, Homo sapiens
gaggaaaaguaaggugcaguu

SEQ ID NO: 1265953 - RNA, 14 nt, Homo sapiens
gaggaaaccuagca

SEQ ID NO: 1265954 - RNA, 20 nt, Homo sapiens
gaggaaauugcagaagcagg

SEQ ID NO: 1265955 - RNA, 23 nt, Homo sapiens
gaggaauaagaauggagcaguac

SEQ ID NO: 1265956 - RNA, 19 nt, Homo sapiens
gaggaaucuaaacaaacag

SEQ ID NO: 1265957 - RNA, 23 nt, Homo sapiens
gaggaauuucuugauuaauguug

SEQ ID NO: 1265958 - RNA, 18 nt, Homo sapiens
gaggacacuaaccacgcu

SEQ ID NO: 1265959 - RNA, 22 nt, Homo sapiens
gaggacauucuggaaaagcaaa

SEQ ID NO: 1265960 - RNA, 17 nt, Homo sapiens
gaggacuuuucuuugug

SEQ ID NO: 1265961 - RNA, 14 nt, Homo sapiens
gaggagacagccuc

SEQ ID NO: 1265962 - RNA, 16 nt, Homo sapiens
gaggagccaccaguuc

SEQ ID NO: 1265963 - RNA, 22 nt, Homo sapiens
gaggagggaugcugccugaguc

SEQ ID NO: 1265964 - RNA, 13 nt, Homo sapiens
gaggaggggcccg

SEQ ID NO: 1265965 - RNA, 15 nt, Homo sapiens
gaggaguaaaauuca

SEQ ID NO: 1265966 - RNA, 22 nt, Homo sapiens
gaggaugacuaacaagauuugu

SEQ ID NO: 1265967 - RNA, 20 nt, Homo sapiens
gaggcaagaaaaggacaaau

SEQ ID NO: 1265968 - RNA, 20 nt, Homo sapiens
gaggcaagagaauugcuuga

SEQ ID NO: 1265969 - RNA, 13 nt, Homo sapiens
gaggcacugcuga

SEQ ID NO: 1265970 - RNA, 20 nt, Homo sapiens
gaggcagcagaauugcuuga

SEQ ID NO: 1265971 - RNA, 12 nt, Homo sapiens
gcaaaauugcaa

SEQ ID NO: 1265972 - RNA, 14 nt, Homo sapiens
gcaaaccauuuuua

SEQ ID NO: 1265973 - RNA, 18 nt, Homo sapiens
gcaaagcaaaaggcugag

SEQ ID NO: 1265974 - RNA, 11 nt, Homo sapiens
gcaaagccaaa

SEQ ID NO: 1265975 - RNA, 21 nt, Homo sapiens
gcaaagucaucaaagauugag

SEQ ID NO: 1265976 - RNA, 13 nt, Homo sapiens
gcaaagugcugua

SEQ ID NO: 1265977 - RNA, 15 nt, Homo sapiens
gcaaaguguauguga

SEQ ID NO: 1265978 - RNA, 15 nt, Homo sapiens
gcaaauaaagccuuu

SEQ ID NO: 1265979 - RNA, 13 nt, Homo sapiens
gcaaauacuguau

SEQ ID NO: 1265980 - RNA, 14 nt, Homo sapiens
gcaaaucaucugca

SEQ ID NO: 1265981 - RNA, 23 nt, Homo sapiens
gcaaauccagucccaaugguccu

SEQ ID NO: 1265982 - RNA, 15 nt, Homo sapiens
gcaaaucgugccuug

SEQ ID NO: 1265983 - RNA, 16 nt, Homo sapiens
gcaaaucgugccuugu

SEQ ID NO: 1265984 - RNA, 19 nt, Homo sapiens
gcaaaucuaugagauuuug

SEQ ID NO: 1265985 - RNA, 21 nt, Homo sapiens
gcaaaugacaugcacugaccc

SEQ ID NO: 1265986 - RNA, 19 nt, Homo sapiens
gcaaaugccuccaagccau

SEQ ID NO: 1265987 - RNA, 16 nt, Homo sapiens
gcaaauguaacugugc

SEQ ID NO: 1265988 - RNA, 23 nt, Homo sapiens
gcaaaugugcuggucacccuuca

SEQ ID NO: 1265989 - RNA, 20 nt, Homo sapiens
gcaaauuaaaacauauuuca

SEQ ID NO: 1265990 - RNA, 15 nt, Homo sapiens
gcaaauuaacuguau

SEQ ID NO: 1265991 - RNA, 19 nt, Homo sapiens
gcaaauuuucagcauuaag

SEQ ID NO: 1265992 - RNA, 17 nt, Homo sapiens
gcaacaaaaauuacucu

SEQ ID NO: 1265993 - RNA, 18 nt, Homo sapiens
gcaacaagaccaccacuu

SEQ ID NO: 1265994 - RNA, 12 nt, Homo sapiens
gcaacaguuuuu

SEQ ID NO: 1265995 - RNA, 11 nt, Homo sapiens
gcaacaucucu

SEQ ID NO: 1265996 - RNA, 14 nt, Homo sapiens
gcaaccacuaagaa

SEQ ID NO: 1265997 - RNA, 13 nt, Homo sapiens
gcaaccugacuca

SEQ ID NO: 1265998 - RNA, 16 nt, Homo sapiens
gcaacucugagaucua

SEQ ID NO: 1265999 - RNA, 23 nt, Homo sapiens
gcaacugggucugacaugaacac

SEQ ID NO: 1266000 - RNA, 22 nt, Homo sapiens
gcaacuuaagcugggauaauca

SEQ ID NO: 1266001 - RNA, 14 nt, Homo sapiens
gcaacuuaauacuc

SEQ ID NO: 1266002 - RNA, 14 nt, Homo sapiens
gcaagaaacaguuu

SEQ ID NO: 1266003 - RNA, 18 nt, Homo sapiens
gcaagaaaucagccauaa

SEQ ID NO: 1266004 - RNA, 15 nt, Homo sapiens
gcaagaacagugggc

SEQ ID NO: 1266005 - RNA, 16 nt, Homo sapiens
gcaagacuccaucuca

SEQ ID NO: 1266006 - RNA, 18 nt, Homo sapiens
gcaagagaggaugacaca

SEQ ID NO: 1266007 - RNA, 14 nt, Homo sapiens
gcaagagcaccugg

SEQ ID NO: 1266008 - RNA, 22 nt, Homo sapiens
gcaagagcaccuggccaagcga

SEQ ID NO: 1266009 - RNA, 15 nt, Homo sapiens
gcaagcacaucugca

SEQ ID NO: 1266010 - RNA, 15 nt, Homo sapiens
gcaagcacugugguc

SEQ ID NO: 1266011 - RNA, 17 nt, Homo sapiens
gcaagcguugugcagag

SEQ ID NO: 1266012 - RNA, 15 nt, Homo sapiens
gcaagcuauucaaug

SEQ ID NO: 1266013 - RNA, 17 nt, Homo sapiens
gcaaggacggccuucaa

SEQ ID NO: 1266014 - RNA, 21 nt, Homo sapiens
gcaaggacggccuucaacuga

SEQ ID NO: 1266015 - RNA, 22 nt, Homo sapiens
gcaaggacugcagggacugcca

SEQ ID NO: 1266016 - RNA, 13 nt, Homo sapiens
gcaaggugcucac

SEQ ID NO: 1266017 - RNA, 16 nt, Homo sapiens
gcaagucccugacucu

SEQ ID NO: 1266018 - RNA, 14 nt, Homo sapiens
gcaagucugugagu

SEQ ID NO: 1266019 - RNA, 16 nt, Homo sapiens
gcaagucuuccaugac

SEQ ID NO: 1266020 - RNA, 18 nt, Homo sapiens
gcaagucuuccaugaccc

SEQ ID NO: 1266021 - RNA, 15 nt, Homo sapiens
gcaagugaaagcaag

SEQ ID NO: 1266022 - RNA, 15 nt, Homo sapiens
gcaaguggcuuucaa

SEQ ID NO: 1266023 - RNA, 15 nt, Homo sapiens
gcaaguguaucuccu

SEQ ID NO: 1266024 - RNA, 19 nt, Homo sapiens
gcaauaaacuccuacuaaa

SEQ ID NO: 1266025 - RNA, 14 nt, Homo sapiens
gcaauaaauauuag

SEQ ID NO: 1266026 - RNA, 19 nt, Homo sapiens
gcaauaaccucaaagugac

SEQ ID NO: 1266027 - RNA, 15 nt, Homo sapiens
gcaauaccuaguucu

SEQ ID NO: 1266028 - RNA, 11 nt, Homo sapiens
gcaauauuugg

SEQ ID NO: 1266029 - RNA, 23 nt, Homo sapiens
gcaaucaaguccuacaagcuaaa

SEQ ID NO: 1266030 - RNA, 23 nt, Homo sapiens
gcaaucucucucugugucuuucu

SEQ ID NO: 1266031 - RNA, 17 nt, Homo sapiens
gcaaucuucuacuuuaa

SEQ ID NO: 1266032 - RNA, 13 nt, Homo sapiens
gcaaugccauuuc

SEQ ID NO: 1266033 - RNA, 19 nt, Homo sapiens
gcaaugccuagacuuccca

SEQ ID NO: 1266034 - RNA, 15 nt, Homo sapiens
gcaaugcugaugaau

SEQ ID NO: 1266035 - RNA, 17 nt, Homo sapiens
gcaaugggcacugggau

SEQ ID NO: 1266036 - RNA, 14 nt, Homo sapiens
gcaaugguggugca

SEQ ID NO: 1266037 - RNA, 23 nt, Homo sapiens
gcaauggugucaguauccaggcu

SEQ ID NO: 1266038 - RNA, 12 nt, Homo sapiens
gcaaugucacaa

SEQ ID NO: 1266039 - RNA, 18 nt, Homo sapiens
gcaauuccucugaacaaa

SEQ ID NO: 1266040 - RNA, 21 nt, Homo sapiens
gcaauugaauuaaauuaggaa

SEQ ID NO: 1266041 - RNA, 12 nt, Homo sapiens
gcaauugcucau

SEQ ID NO: 1266042 - RNA, 13 nt, Homo sapiens
gcaauuguggaag

SEQ ID NO: 1266043 - RNA, 16 nt, Homo sapiens
gcaauuucacugaugu

SEQ ID NO: 1266044 - RNA, 17 nt, Homo sapiens
gcaauuuucgaacauuc

SEQ ID NO: 1266045 - RNA, 17 nt, Homo sapiens
gcaauuuuguguaaauu

SEQ ID NO: 1266046 - RNA, 20 nt, Homo sapiens
gcaauuuuucaagagcuccu

SEQ ID NO: 1266047 - RNA, 14 nt, Homo sapiens
gcacaaaagggacu

SEQ ID NO: 1266048 - RNA, 20 nt, Homo sapiens
gcacaaagauggauguaaug

SEQ ID NO: 1266049 - RNA, 19 nt, Homo sapiens
gcacaaaguguauucacgu

SEQ ID NO: 1266050 - RNA, 13 nt, Homo sapiens
gcacaacucccuu

SEQ ID NO: 1266051 - RNA, 16 nt, Homo sapiens
gcacaagggcacguga

SEQ ID NO: 1266052 - RNA, 17 nt, Homo sapiens
gcacacacacaaacaca

SEQ ID NO: 1266053 - RNA, 17 nt, Homo sapiens
gcacacaccuccgagac

SEQ ID NO: 1266054 - RNA, 14 nt, Homo sapiens
gcacacagucaccu

SEQ ID NO: 1266055 - RNA, 17 nt, Homo sapiens
gcacacccuccagagac

SEQ ID NO: 1266056 - RNA, 21 nt, Homo sapiens
gcacacuagccucuccaggaa

SEQ ID NO: 1266057 - RNA, 14 nt, Homo sapiens
gcacacugcacugu

SEQ ID NO: 1266058 - RNA, 15 nt, Homo sapiens
gcacacuggccucca

SEQ ID NO: 1266059 - RNA, 19 nt, Homo sapiens
gcacacuuuuccacauucc

SEQ ID NO: 1266060 - RNA, 11 nt, Homo sapiens
gcacagaauuu

SEQ ID NO: 1266061 - RNA, 16 nt, Homo sapiens
gcacagaucugcuuga

SEQ ID NO: 1266062 - RNA, 21 nt, Homo sapiens
gcacagaucugcuugaucaau

SEQ ID NO: 1266063 - RNA, 15 nt, Homo sapiens
gcacagcacagccag

SEQ ID NO: 1266064 - RNA, 21 nt, Homo sapiens
gcacagggagugcacauaucc

SEQ ID NO: 1266065 - RNA, 18 nt, Homo sapiens
gcacagggggaggccaua

SEQ ID NO: 1266066 - RNA, 22 nt, Homo sapiens
gcacaggguccccgagugccua

SEQ ID NO: 1266067 - RNA, 18 nt, Homo sapiens
gcacaguaggaauuggaa

SEQ ID NO: 1266068 - RNA, 20 nt, Homo sapiens
gcacaguaucuuuucuuuca

SEQ ID NO: 1266069 - RNA, 14 nt, Homo sapiens
gcacagucacccau

SEQ ID NO: 1266070 - RNA, 18 nt, Homo sapiens
gcacaguugccacauuua

SEQ ID NO: 1266071 - RNA, 17 nt, Homo sapiens
gcacaucacaacauuua

SEQ ID NO: 1266072 - RNA, 20 nt, Homo sapiens
gcacauccauucccaagaaa

SEQ ID NO: 1266073 - RNA, 22 nt, Homo sapiens
gcacaucugcauuuucacccca

SEQ ID NO: 1266074 - RNA, 18 nt, Homo sapiens
gcacauuuaaggcgccau

SEQ ID NO: 1266075 - RNA, 10 nt, Homo sapiens
gcaccaaaga

SEQ ID NO: 1266076 - RNA, 11 nt, Homo sapiens
gcaccaaagac

SEQ ID NO: 1266077 - RNA, 17 nt, Homo sapiens
gcaccaaagacaucagu

SEQ ID NO: 1266078 - RNA, 14 nt, Homo sapiens
gcaccagugugaca

SEQ ID NO: 1266079 - RNA, 13 nt, Homo sapiens
gcaccaucucuga

SEQ ID NO: 1266080 - RNA, 16 nt, Homo sapiens
gcaccaucuggaagga

SEQ ID NO: 1266081 - RNA, 19 nt, Homo sapiens
gcaccauugcacuccagcu

SEQ ID NO: 1266082 - RNA, 22 nt, Homo sapiens
gcacccaccaccaugcccagcu

SEQ ID NO: 1266083 - RNA, 17 nt, Homo sapiens
gcaccccaaagcuuucc

SEQ ID NO: 1266084 - RNA, 13 nt, Homo sapiens
gcaccccacugca

SEQ ID NO: 1266085 - RNA, 13 nt, Homo sapiens
gcaccccggccuc

SEQ ID NO: 1266086 - RNA, 17 nt, Homo sapiens
gcacccuccacccuguc

SEQ ID NO: 1266087 - RNA, 21 nt, Homo sapiens
gcacccuguaucacagacugg

SEQ ID NO: 1266088 - RNA, 14 nt, Homo sapiens
gcaccgagaccaaa

SEQ ID NO: 1266089 - RNA, 18 nt, Homo sapiens
gcaccgggccacagagaa

SEQ ID NO: 1266090 - RNA, 12 nt, Homo sapiens
gcaccuaccuca

SEQ ID NO: 1266091 - RNA, 15 nt, Homo sapiens
gcaccuagcugugca

SEQ ID NO: 1266092 - RNA, 14 nt, Homo sapiens
gcaccucuguucau

SEQ ID NO: 1266093 - RNA, 15 nt, Homo sapiens
gcaccucuguucauu

SEQ ID NO: 1266094 - RNA, 13 nt, Homo sapiens
gcaccucuuccuu

SEQ ID NO: 1266095 - RNA, 16 nt, Homo sapiens
gcaccuggauguacua

SEQ ID NO: 1266096 - RNA, 18 nt, Homo sapiens
gcaccuuaagauuuugca

SEQ ID NO: 1266097 - RNA, 14 nt, Homo sapiens
gcaccuucagacuu

SEQ ID NO: 1266098 - RNA, 13 nt, Homo sapiens
gcaccuuuuugca

SEQ ID NO: 1266099 - RNA, 19 nt, Homo sapiens
gcccucucauucucacucc

SEQ ID NO: 1266100 - RNA, 11 nt, Homo sapiens
gcccugaccuc

SEQ ID NO: 1266101 - RNA, 23 nt, Homo sapiens
gcccugaccuuggcugacugggg

SEQ ID NO: 1266102 - RNA, 17 nt, Homo sapiens
gcccugaggccuagacu

SEQ ID NO: 1266103 - RNA, 20 nt, Homo sapiens
gcccugcccuccuuugccuu

SEQ ID NO: 1266104 - RNA, 21 nt, Homo sapiens
gcccuggagaagcagcuaaca

SEQ ID NO: 1266105 - RNA, 17 nt, Homo sapiens
gcccugguguguuucca

SEQ ID NO: 1266106 - RNA, 19 nt, Homo sapiens
gcccuguccuaagcacuuu

SEQ ID NO: 1266107 - RNA, 23 nt, Homo sapiens
gcccuguggccgacucugcacuc

SEQ ID NO: 1266108 - RNA, 18 nt, Homo sapiens
gcccuguucugggugcag

SEQ ID NO: 1266109 - RNA, 16 nt, Homo sapiens
gcccuuaaggacaaaa

SEQ ID NO: 1266110 - RNA, 22 nt, Homo sapiens
gcccuucagucuuaauacuuua

SEQ ID NO: 1266111 - RNA, 18 nt, Homo sapiens
gcccuuccucuccacugc

SEQ ID NO: 1266112 - RNA, 17 nt, Homo sapiens
gcccuugaagacuuccc

SEQ ID NO: 1266113 - RNA, 19 nt, Homo sapiens
gcccuugcccugaccuccc

SEQ ID NO: 1266114 - RNA, 19 nt, Homo sapiens
gcccuuggcuucugugaug

SEQ ID NO: 1266115 - RNA, 14 nt, Homo sapiens
gcccuugucacugg

SEQ ID NO: 1266116 - RNA, 14 nt, Homo sapiens
gcccuuguccugcc

SEQ ID NO: 1266117 - RNA, 14 nt, Homo sapiens
gcccuugucugaga

SEQ ID NO: 1266118 - RNA, 17 nt, Homo sapiens
gcccuuguucgccuccc

SEQ ID NO: 1266119 - RNA, 18 nt, Homo sapiens
gcccuuuccccccauguu

SEQ ID NO: 1266120 - RNA, 18 nt, Homo sapiens
gcccuuuggaaagccauu

SEQ ID NO: 1266121 - RNA, 19 nt, Homo sapiens
gccgaaaaggauaugcagu

SEQ ID NO: 1266122 - RNA, 20 nt, Homo sapiens
gccgaaaaggauaugcagua

SEQ ID NO: 1266123 - RNA, 15 nt, Homo sapiens
gccgaagcucuggcu

SEQ ID NO: 1266124 - RNA, 13 nt, Homo sapiens
gccgaaugugcag

SEQ ID NO: 1266125 - RNA, 19 nt, Homo sapiens
gccgagagcagacaccagc

SEQ ID NO: 1266126 - RNA, 21 nt, Homo sapiens
gccgagaucacgccacugcac

SEQ ID NO: 1266127 - RNA, 21 nt, Homo sapiens
gccgagauugcaccacugcac

SEQ ID NO: 1266128 - RNA, 20 nt, Homo sapiens
gccgauauuuucuugcugga

SEQ ID NO: 1266129 - RNA, 14 nt, Homo sapiens
gccgcagacgggca

SEQ ID NO: 1266130 - RNA, 17 nt, Homo sapiens
gccgcagacgggcacag

SEQ ID NO: 1266131 - RNA, 13 nt, Homo sapiens
gccgcccaaagag

SEQ ID NO: 1266132 - RNA, 21 nt, Homo sapiens
gccgccucccaccacuccacu

SEQ ID NO: 1266133 - RNA, 13 nt, Homo sapiens
gccgggaaccaag

SEQ ID NO: 1266134 - RNA, 23 nt, Homo sapiens
gccgggccuagaccuggugcuga

SEQ ID NO: 1266135 - RNA, 16 nt, Homo sapiens
gccggugcucuggaag

SEQ ID NO: 1266136 - RNA, 17 nt, Homo sapiens
gccgugccugagcugca

SEQ ID NO: 1266137 - RNA, 15 nt, Homo sapiens
gccuaaaaguuacuu

SEQ ID NO: 1266138 - RNA, 15 nt, Homo sapiens
gccuaaaugccuuag

SEQ ID NO: 1266139 - RNA, 22 nt, Homo sapiens
gccuaaauuuaaugcugccuuu

SEQ ID NO: 1266140 - RNA, 16 nt, Homo sapiens
gccuaacuaacuggca

SEQ ID NO: 1266141 - RNA, 16 nt, Homo sapiens
gccuaaggugucugag

SEQ ID NO: 1266142 - RNA, 19 nt, Homo sapiens
gccuacuuaagagugcugu

SEQ ID NO: 1266143 - RNA, 21 nt, Homo sapiens
gccuagacucuguaacaucac

SEQ ID NO: 1266144 - RNA, 19 nt, Homo sapiens
gccuaugcacauauggacu

SEQ ID NO: 1266145 - RNA, 20 nt, Homo sapiens
gccucaccuccucugugauu

SEQ ID NO: 1266146 - RNA, 17 nt, Homo sapiens
gccucacucaccaucug

SEQ ID NO: 1266147 - RNA, 19 nt, Homo sapiens
gccucacugaaacauggcu

SEQ ID NO: 1266148 - RNA, 23 nt, Homo sapiens
gccucagccucccaaagugcugg

SEQ ID NO: 1266149 - RNA, 16 nt, Homo sapiens
gccucagccuccugag

SEQ ID NO: 1266150 - RNA, 19 nt, Homo sapiens
gccucagggcgcucagacg

SEQ ID NO: 1266151 - RNA, 17 nt, Homo sapiens
gccucagugaaggacua

SEQ ID NO: 1266152 - RNA, 13 nt, Homo sapiens
gccucagugccac

SEQ ID NO: 1266153 - RNA, 13 nt, Homo sapiens
gccucauuucacu

SEQ ID NO: 1266154 - RNA, 17 nt, Homo sapiens
gccuccaagccauucac

SEQ ID NO: 1266155 - RNA, 10 nt, Homo sapiens
gccuccacuc

SEQ ID NO: 1266156 - RNA, 23 nt, Homo sapiens
gccuccacuucuccccucaagaa

SEQ ID NO: 1266157 - RNA, 13 nt, Homo sapiens
gccuccaugaccu

SEQ ID NO: 1266158 - RNA, 14 nt, Homo sapiens
gccucccaccacuc

SEQ ID NO: 1266159 - RNA, 19 nt, Homo sapiens
gccucccacccccaucucu

SEQ ID NO: 1266160 - RNA, 13 nt, Homo sapiens
gccucccccaugg

SEQ ID NO: 1266161 - RNA, 18 nt, Homo sapiens
gccuccccgugccaaaaa

SEQ ID NO: 1266162 - RNA, 14 nt, Homo sapiens
gccuccucacccac

SEQ ID NO: 1266163 - RNA, 21 nt, Homo sapiens
gccuccucucucaaacugggg

SEQ ID NO: 1266164 - RNA, 16 nt, Homo sapiens
gccucgaaacacagaa

SEQ ID NO: 1266165 - RNA, 9 nt, Homo sapiens
gccucggga

SEQ ID NO: 1266166 - RNA, 17 nt, Homo sapiens
gccucgugccaugaucu

SEQ ID NO: 1266167 - RNA, 15 nt, Homo sapiens
gccucuccaucugua

SEQ ID NO: 1266168 - RNA, 18 nt, Homo sapiens
gccucuccuacuaugcaa

SEQ ID NO: 1266169 - RNA, 19 nt, Homo sapiens
gccucugaccccuccucac

SEQ ID NO: 1266170 - RNA, 23 nt, Homo sapiens
gccucuuugugugcgucacugug

SEQ ID NO: 1266171 - RNA, 18 nt, Homo sapiens
gccugaaagcaacuacag

SEQ ID NO: 1266172 - RNA, 13 nt, Homo sapiens
gccugacaaccac

SEQ ID NO: 1266173 - RNA, 16 nt, Homo sapiens
gccugacaaccacugg

SEQ ID NO: 1266174 - RNA, 12 nt, Homo sapiens
gccugacagaaa

SEQ ID NO: 1266175 - RNA, 12 nt, Homo sapiens
gccugacauuca

SEQ ID NO: 1266176 - RNA, 13 nt, Homo sapiens
gccugagacaccc

SEQ ID NO: 1266177 - RNA, 20 nt, Homo sapiens
gccugagcaacucuugauua

SEQ ID NO: 1266178 - RNA, 22 nt, Homo sapiens
gccugagcuggccuccuaugcc

SEQ ID NO: 1266179 - RNA, 16 nt, Homo sapiens
gccugaguccuggucc

SEQ ID NO: 1266180 - RNA, 18 nt, Homo sapiens
gccugagucuccugugcc

SEQ ID NO: 1266181 - RNA, 19 nt, Homo sapiens
gccugaguuuagggucaag

SEQ ID NO: 1266182 - RNA, 21 nt, Homo sapiens
gccugcacagugaagugcugg

SEQ ID NO: 1266183 - RNA, 16 nt, Homo sapiens
gccugccaugggccag

SEQ ID NO: 1266184 - RNA, 17 nt, Homo sapiens
gccugccaugggccagc

SEQ ID NO: 1266185 - RNA, 16 nt, Homo sapiens
gccugcucccuagcca

SEQ ID NO: 1266186 - RNA, 19 nt, Homo sapiens
gccugcuggcugcggcccc

SEQ ID NO: 1266187 - RNA, 16 nt, Homo sapiens
gccuggacaacauagu

SEQ ID NO: 1266188 - RNA, 22 nt, Homo sapiens
gccuggacgccacggccucuca

SEQ ID NO: 1266189 - RNA, 22 nt, Homo sapiens
gccuggacuguuuucucucggc

SEQ ID NO: 1266190 - RNA, 15 nt, Homo sapiens
gccuggacuuuccug

SEQ ID NO: 1266191 - RNA, 20 nt, Homo sapiens
gccuggaguguaugacugca

SEQ ID NO: 1266192 - RNA, 18 nt, Homo sapiens
gccuggcacaggacugau

SEQ ID NO: 1266193 - RNA, 16 nt, Homo sapiens
gccuggcacauuucag

SEQ ID NO: 1266194 - RNA, 20 nt, Homo sapiens
gccuggcagccgugccuuca

SEQ ID NO: 1266195 - RNA, 15 nt, Homo sapiens
gccuggcccaaagca

SEQ ID NO: 1266196 - RNA, 22 nt, Homo sapiens
gccuggcuggaagagggugaaa

SEQ ID NO: 1266197 - RNA, 15 nt, Homo sapiens
gccugggacccagcu

SEQ ID NO: 1266198 - RNA, 18 nt, Homo sapiens
gccugggcuguggacaga

SEQ ID NO: 1266199 - RNA, 21 nt, Homo sapiens
gccuggggcaggucacuuuac

SEQ ID NO: 1266200 - RNA, 16 nt, Homo sapiens
gccugggggcagugac

SEQ ID NO: 1266201 - RNA, 19 nt, Homo sapiens
gccugggggcuuuugccac

SEQ ID NO: 1266202 - RNA, 23 nt, Homo sapiens
gccugggucccacucaggugaaa

SEQ ID NO: 1266203 - RNA, 16 nt, Homo sapiens
gccugggugacauuug

SEQ ID NO: 1266204 - RNA, 23 nt, Homo sapiens
gccuggguugggggcacucagcc

SEQ ID NO: 1266205 - RNA, 14 nt, Homo sapiens
gccugguggcagcu

SEQ ID NO: 1266206 - RNA, 21 nt, Homo sapiens
gccuguaaucccaacuacuca

SEQ ID NO: 1266207 - RNA, 19 nt, Homo sapiens
gccuguaaucccagcacuu

SEQ ID NO: 1266208 - RNA, 20 nt, Homo sapiens
gccuguaaucccagcacuuu

SEQ ID NO: 1266209 - RNA, 19 nt, Homo sapiens
gccuguaaucccagcuacu

SEQ ID NO: 1266210 - RNA, 10 nt, Homo sapiens
gccugucauu

SEQ ID NO: 1266211 - RNA, 13 nt, Homo sapiens
gccugugcaugua

SEQ ID NO: 1266212 - RNA, 15 nt, Homo sapiens
gccugugccuaucac

SEQ ID NO: 1266213 - RNA, 20 nt, Homo sapiens
gccugugguuacagugcaga

SEQ ID NO: 1266214 - RNA, 18 nt, Homo sapiens
gccuguguacugccuuaa

SEQ ID NO: 1266215 - RNA, 13 nt, Homo sapiens
gccuguugccucg

SEQ ID NO: 1266216 - RNA, 22 nt, Homo sapiens
gccuuaaaaggggcccaagccc

SEQ ID NO: 1266217 - RNA, 15 nt, Homo sapiens
gccuuaaugcuucau

SEQ ID NO: 1266218 - RNA, 16 nt, Homo sapiens
gccuuaaugcuucaua

SEQ ID NO: 1266219 - RNA, 13 nt, Homo sapiens
gccuuacacugaa

SEQ ID NO: 1266220 - RNA, 20 nt, Homo sapiens
gccuuagaaauguaaacugc

SEQ ID NO: 1266221 - RNA, 18 nt, Homo sapiens
gccuuagggacagaauua

SEQ ID NO: 1266222 - RNA, 22 nt, Homo sapiens
gccuuagggugcugagugccug

SEQ ID NO: 1266223 - RNA, 17 nt, Homo sapiens
gccuuauuaauauccaa

SEQ ID NO: 1266224 - RNA, 14 nt, Homo sapiens
gccuucacugacag

SEQ ID NO: 1266225 - RNA, 17 nt, Homo sapiens
gucaccuacgugccacu

SEQ ID NO: 1266226 - RNA, 13 nt, Homo sapiens
gucaccugcagcc

SEQ ID NO: 1266227 - RNA, 15 nt, Homo sapiens
gucaccuuccaggac

SEQ ID NO: 1266228 - RNA, 16 nt, Homo sapiens
gucacggccaagugua

SEQ ID NO: 1266229 - RNA, 15 nt, Homo sapiens
gucacuagucucacc

SEQ ID NO: 1266230 - RNA, 21 nt, Homo sapiens
gucacugacucaagacacuga

SEQ ID NO: 1266231 - RNA, 16 nt, Homo sapiens
gucacugauacacaga

SEQ ID NO: 1266232 - RNA, 10 nt, Homo sapiens
gucacuggaa

SEQ ID NO: 1266233 - RNA, 23 nt, Homo sapiens
gucacuuacuguuucugucagga

SEQ ID NO: 1266234 - RNA, 15 nt, Homo sapiens
gucacuucucacaau

SEQ ID NO: 1266235 - RNA, 21 nt, Homo sapiens
gucagaauccuuuacauucaa

SEQ ID NO: 1266236 - RNA, 15 nt, Homo sapiens
gucagagccacucua

SEQ ID NO: 1266237 - RNA, 17 nt, Homo sapiens
gucagaguucugcucua

SEQ ID NO: 1266238 - RNA, 21 nt, Homo sapiens
gucagcacaggccauggugca

SEQ ID NO: 1266239 - RNA, 12 nt, Homo sapiens
gucagcauguac

SEQ ID NO: 1266240 - RNA, 18 nt, Homo sapiens
gucagcauguacuccccu

SEQ ID NO: 1266241 - RNA, 17 nt, Homo sapiens
gucagcccaugugcacc

SEQ ID NO: 1266242 - RNA, 21 nt, Homo sapiens
gucagcucucuccuuucaggg

SEQ ID NO: 1266243 - RNA, 14 nt, Homo sapiens
gucagcugcucccu

SEQ ID NO: 1266244 - RNA, 14 nt, Homo sapiens
gucaggacugugac

SEQ ID NO: 1266245 - RNA, 16 nt, Homo sapiens
gucaguauuuuugccg

SEQ ID NO: 1266246 - RNA, 12 nt, Homo sapiens
gucagucaggga

SEQ ID NO: 1266247 - RNA, 16 nt, Homo sapiens
gucagucucucaccac

SEQ ID NO: 1266248 - RNA, 22 nt, Homo sapiens
gucaguggaagccccaacggga

SEQ ID NO: 1266249 - RNA, 20 nt, Homo sapiens
gucauaaugguuuuuaacac

SEQ ID NO: 1266250 - RNA, 17 nt, Homo sapiens
gucauagagcccaguga

SEQ ID NO: 1266251 - RNA, 21 nt, Homo sapiens
gucauaguggguggauuuguu

SEQ ID NO: 1266252 - RNA, 23 nt, Homo sapiens
gucauauuauuauuaauuuugcc

SEQ ID NO: 1266253 - RNA, 17 nt, Homo sapiens
gucaucaucacauucag

SEQ ID NO: 1266254 - RNA, 22 nt, Homo sapiens
gucauccaaacucaaacuugag

SEQ ID NO: 1266255 - RNA, 20 nt, Homo sapiens
gucaucuccaucagcuguaa

SEQ ID NO: 1266256 - RNA, 20 nt, Homo sapiens
gucaucuuucuuuucuuuga

SEQ ID NO: 1266257 - RNA, 16 nt, Homo sapiens
gucaugaauagaaaaa

SEQ ID NO: 1266258 - RNA, 19 nt, Homo sapiens
gucauggcuaauuuaacac

SEQ ID NO: 1266259 - RNA, 13 nt, Homo sapiens
gucauguuugcag

SEQ ID NO: 1266260 - RNA, 21 nt, Homo sapiens
gucauuauuuuuguuagcaaa

SEQ ID NO: 1266261 - RNA, 21 nt, Homo sapiens
gucauucuuuauucuuuacua

SEQ ID NO: 1266262 - RNA, 21 nt, Homo sapiens
gucauucuuuuaacaaaagga

SEQ ID NO: 1266263 - RNA, 19 nt, Homo sapiens
gucauuggccgacaucaca

SEQ ID NO: 1266264 - RNA, 20 nt, Homo sapiens
guccaaaacugccucaggag

SEQ ID NO: 1266265 - RNA, 16 nt, Homo sapiens
guccaacaaaccacac

SEQ ID NO: 1266266 - RNA, 20 nt, Homo sapiens
guccaacugucaaccuagaa

SEQ ID NO: 1266267 - RNA, 13 nt, Homo sapiens
guccaagggccau

SEQ ID NO: 1266268 - RNA, 11 nt, Homo sapiens
guccacagggc

SEQ ID NO: 1266269 - RNA, 19 nt, Homo sapiens
guccacccaggcugcacug

SEQ ID NO: 1266270 - RNA, 22 nt, Homo sapiens
guccaccucccauuacuuugau

SEQ ID NO: 1266271 - RNA, 14 nt, Homo sapiens
guccacugucaggg

SEQ ID NO: 1266272 - RNA, 15 nt, Homo sapiens
guccacuguggcacu

SEQ ID NO: 1266273 - RNA, 18 nt, Homo sapiens
guccagaagaauauucag

SEQ ID NO: 1266274 - RNA, 15 nt, Homo sapiens
guccagaauucacuu

SEQ ID NO: 1266275 - RNA, 17 nt, Homo sapiens
guccagauauuucacau

SEQ ID NO: 1266276 - RNA, 13 nt, Homo sapiens
guccagcacugga

SEQ ID NO: 1266277 - RNA, 12 nt, Homo sapiens
guccagcccauc

SEQ ID NO: 1266278 - RNA, 17 nt, Homo sapiens
guccagggcuagugacu

SEQ ID NO: 1266279 - RNA, 14 nt, Homo sapiens
guccaguauucuac

SEQ ID NO: 1266280 - RNA, 23 nt, Homo sapiens
guccaugaaaucuuuaugugaua

SEQ ID NO: 1266281 - RNA, 15 nt, Homo sapiens
guccaugcugaugau

SEQ ID NO: 1266282 - RNA, 13 nt, Homo sapiens
guccauuuugccu

SEQ ID NO: 1266283 - RNA, 21 nt, Homo sapiens
gucccaaaacccuuacaguga

SEQ ID NO: 1266284 - RNA, 21 nt, Homo sapiens
gucccaaguuggaaauauuca

SEQ ID NO: 1266285 - RNA, 15 nt, Homo sapiens
gucccaccugcacac

SEQ ID NO: 1266286 - RNA, 20 nt, Homo sapiens
gucccacgugucuuccacuu

SEQ ID NO: 1266287 - RNA, 20 nt, Homo sapiens
gucccagagguuaucugccu

SEQ ID NO: 1266288 - RNA, 17 nt, Homo sapiens
gucccagcuacucagaa

SEQ ID NO: 1266289 - RNA, 23 nt, Homo sapiens
gucccagggcccuggaugguccu

SEQ ID NO: 1266290 - RNA, 13 nt, Homo sapiens
gucccaucaggac

SEQ ID NO: 1266291 - RNA, 18 nt, Homo sapiens
gucccauccccacauccc

SEQ ID NO: 1266292 - RNA, 21 nt, Homo sapiens
gucccaugaccuugggguaca

SEQ ID NO: 1266293 - RNA, 17 nt, Homo sapiens
gucccauggacacucca

SEQ ID NO: 1266294 - RNA, 23 nt, Homo sapiens
guccccaccccagcgcagcagcc

SEQ ID NO: 1266295 - RNA, 14 nt, Homo sapiens
guccccaccuggga

SEQ ID NO: 1266296 - RNA, 16 nt, Homo sapiens
guccccagacucagcu

SEQ ID NO: 1266297 - RNA, 13 nt, Homo sapiens
guccccagggaca

SEQ ID NO: 1266298 - RNA, 23 nt, Homo sapiens
gucccccagauuccaacauuucu

SEQ ID NO: 1266299 - RNA, 15 nt, Homo sapiens
guccccuccacuguc

SEQ ID NO: 1266300 - RNA, 16 nt, Homo sapiens
guccccugcccaugcu

SEQ ID NO: 1266301 - RNA, 19 nt, Homo sapiens
gucccggggccagcacuuc

SEQ ID NO: 1266302 - RNA, 20 nt, Homo sapiens
gucccggggcuccacugaac

SEQ ID NO: 1266303 - RNA, 14 nt, Homo sapiens
gucccgggguccug

SEQ ID NO: 1266304 - RNA, 11 nt, Homo sapiens
gucccuaccuc

SEQ ID NO: 1266305 - RNA, 18 nt, Homo sapiens
gucccuccaccccacaga

SEQ ID NO: 1266306 - RNA, 22 nt, Homo sapiens
gucccugaaaccuaguacugcc

SEQ ID NO: 1266307 - RNA, 13 nt, Homo sapiens
gucccuuggagac

SEQ ID NO: 1266308 - RNA, 17 nt, Homo sapiens
gucccuuucccuaccuu

SEQ ID NO: 1266309 - RNA, 15 nt, Homo sapiens
guccgaucuuugacu

SEQ ID NO: 1266310 - RNA, 14 nt, Homo sapiens
guccggacccaccu

SEQ ID NO: 1266311 - RNA, 18 nt, Homo sapiens
guccuaaagaugcugacu

SEQ ID NO: 1266312 - RNA, 18 nt, Homo sapiens
guccuaaggacacacuaa

SEQ ID NO: 1266313 - RNA, 18 nt, Homo sapiens
guccuacucugugucagg

SEQ ID NO: 1266314 - RNA, 14 nt, Homo sapiens
guccucaccacagu

SEQ ID NO: 1266315 - RNA, 19 nt, Homo sapiens
guccucacgcagacacacc

SEQ ID NO: 1266316 - RNA, 19 nt, Homo sapiens
guccucacugcucccugaa

SEQ ID NO: 1266317 - RNA, 16 nt, Homo sapiens
guccucaguccacugc

SEQ ID NO: 1266318 - RNA, 19 nt, Homo sapiens
guccucaguccacugcuga

SEQ ID NO: 1266319 - RNA, 20 nt, Homo sapiens
guccucaguccacugcugag

SEQ ID NO: 1266320 - RNA, 20 nt, Homo sapiens
guccucauccuuuccugcca

SEQ ID NO: 1266321 - RNA, 19 nt, Homo sapiens
guccuccagaccaccagcc

SEQ ID NO: 1266322 - RNA, 21 nt, Homo sapiens
guccucuccccuccagccuuu

SEQ ID NO: 1266323 - RNA, 17 nt, Homo sapiens
guccucucccugccaag

SEQ ID NO: 1266324 - RNA, 17 nt, Homo sapiens
guccugccucagccucc

SEQ ID NO: 1266325 - RNA, 19 nt, Homo sapiens
guccuggaaaucgagguga

SEQ ID NO: 1266326 - RNA, 19 nt, Homo sapiens
guccuggaaucacauucuu

SEQ ID NO: 1266327 - RNA, 14 nt, Homo sapiens
guccugggcaaagg

SEQ ID NO: 1266328 - RNA, 14 nt, Homo sapiens
guccuggggaccau

SEQ ID NO: 1266329 - RNA, 23 nt, Homo sapiens
guccugggguauaaaacuuuccu

SEQ ID NO: 1266330 - RNA, 15 nt, Homo sapiens
guccuguacauugug

SEQ ID NO: 1266331 - RNA, 22 nt, Homo sapiens
guccugugaauggaagcaaagu

SEQ ID NO: 1266332 - RNA, 13 nt, Homo sapiens
guccuguuugcag

SEQ ID NO: 1266333 - RNA, 23 nt, Homo sapiens
guccuuaaaaaucacacuguaaa

SEQ ID NO: 1266334 - RNA, 21 nt, Homo sapiens
guccuuccuaccucuguggug

SEQ ID NO: 1266335 - RNA, 23 nt, Homo sapiens
guccuuucccuucaguacccucu

SEQ ID NO: 1266336 - RNA, 18 nt, Homo sapiens
guccuuucuaaguauuuu

SEQ ID NO: 1266337 - RNA, 16 nt, Homo sapiens
gucgacuucaugacaa

SEQ ID NO: 1266338 - RNA, 14 nt, Homo sapiens
gucgcacagucucu

SEQ ID NO: 1266339 - RNA, 20 nt, Homo sapiens
gucggaacccaagcuuagaa

SEQ ID NO: 1266340 - RNA, 19 nt, Homo sapiens
gucggucuccuuauccccc

SEQ ID NO: 1266341 - RNA, 19 nt, Homo sapiens
gucuaacuuuagaagugca

SEQ ID NO: 1266342 - RNA, 19 nt, Homo sapiens
gucuaauagucuuugccag

SEQ ID NO: 1266343 - RNA, 21 nt, Homo sapiens
gucuaccugcuggacagccuc

SEQ ID NO: 1266344 - RNA, 14 nt, Homo sapiens
gucuagacugccag

SEQ ID NO: 1266345 - RNA, 14 nt, Homo sapiens
gucuagauucucug

SEQ ID NO: 1266346 - RNA, 21 nt, Homo sapiens
gucuauuuucucagucauuuu

SEQ ID NO: 1266347 - RNA, 17 nt, Homo sapiens
gucucacaguguugccc

SEQ ID NO: 1266348 - RNA, 23 nt, Homo sapiens
gucucaccuggacuuaagcaucu

SEQ ID NO: 1266349 - RNA, 22 nt, Homo sapiens
gucucacugugggaaggccagc

SEQ ID NO: 1266350 - RNA, 19 nt, Homo sapiens
guucucagguguugccaaa

SEQ ID NO: 1266351 - RNA, 20 nt, Homo sapiens
guucucagguguugccaaau

SEQ ID NO: 1266352 - RNA, 17 nt, Homo sapiens
guucucuauugcugcuc

SEQ ID NO: 1266353 - RNA, 15 nt, Homo sapiens
guucugagaccagug

SEQ ID NO: 1266354 - RNA, 17 nt, Homo sapiens
guucugaugccaauacu

SEQ ID NO: 1266355 - RNA, 22 nt, Homo sapiens
guucugaugccaauacuaguca

SEQ ID NO: 1266356 - RNA, 15 nt, Homo sapiens
guucugcacugaaaa

SEQ ID NO: 1266357 - RNA, 19 nt, Homo sapiens
guucugcauggauucagca

SEQ ID NO: 1266358 - RNA, 21 nt, Homo sapiens
guucugcugaaucaaaucucu

SEQ ID NO: 1266359 - RNA, 20 nt, Homo sapiens
guucugguuuuuaaccauug

SEQ ID NO: 1266360 - RNA, 15 nt, Homo sapiens
guucugucugugucu

SEQ ID NO: 1266361 - RNA, 12 nt, Homo sapiens
guucuuacacau

SEQ ID NO: 1266362 - RNA, 13 nt, Homo sapiens
guucuuagagugu

SEQ ID NO: 1266363 - RNA, 18 nt, Homo sapiens
guucuucaccuccugcca

SEQ ID NO: 1266364 - RNA, 15 nt, Homo sapiens
guucuucagggccag

SEQ ID NO: 1266365 - RNA, 19 nt, Homo sapiens
guucuucuguucugcagac

SEQ ID NO: 1266366 - RNA, 15 nt, Homo sapiens
guucuuggugaugcu

SEQ ID NO: 1266367 - RNA, 12 nt, Homo sapiens
guucuuuccucc

SEQ ID NO: 1266368 - RNA, 20 nt, Homo sapiens
guucuuugagggacugccuc

SEQ ID NO: 1266369 - RNA, 21 nt, Homo sapiens
guugaaaauguguuugcugcc

SEQ ID NO: 1266370 - RNA, 14 nt, Homo sapiens
guugaaacuguuau

SEQ ID NO: 1266371 - RNA, 16 nt, Homo sapiens
guugaauuucccacau

SEQ ID NO: 1266372 - RNA, 23 nt, Homo sapiens
guugacgccuaacugaauuugaa

SEQ ID NO: 1266373 - RNA, 16 nt, Homo sapiens
guugagcuauugcugu

SEQ ID NO: 1266374 - RNA, 22 nt, Homo sapiens
guugaugggggugugauuugug

SEQ ID NO: 1266375 - RNA, 16 nt, Homo sapiens
guugauuacuuuucag

SEQ ID NO: 1266376 - RNA, 18 nt, Homo sapiens
guugauuuuaaugaaugc

SEQ ID NO: 1266377 - RNA, 11 nt, Homo sapiens
guugauuuucu

SEQ ID NO: 1266378 - RNA, 13 nt, Homo sapiens
guugcacugauau

SEQ ID NO: 1266379 - RNA, 22 nt, Homo sapiens
guugccugggggcuuuugccac

SEQ ID NO: 1266380 - RNA, 16 nt, Homo sapiens
guugcgcgccugcucc

SEQ ID NO: 1266381 - RNA, 21 nt, Homo sapiens
guugcuaaaaaaagugcauga

SEQ ID NO: 1266382 - RNA, 12 nt, Homo sapiens
guugcuauaaua

SEQ ID NO: 1266383 - RNA, 16 nt, Homo sapiens
guugcuggacugucau

SEQ ID NO: 1266384 - RNA, 17 nt, Homo sapiens
guugcugugugguuugg

SEQ ID NO: 1266385 - RNA, 15 nt, Homo sapiens
guugcuuuagucacu

SEQ ID NO: 1266386 - RNA, 17 nt, Homo sapiens
guugcuuuagucacuaa

SEQ ID NO: 1266387 - RNA, 14 nt, Homo sapiens
guuggaaauauuca

SEQ ID NO: 1266388 - RNA, 23 nt, Homo sapiens
guuggacuucagucuugccuagg

SEQ ID NO: 1266389 - RNA, 22 nt, Homo sapiens
guuggagagagauguuccucuu

SEQ ID NO: 1266390 - RNA, 14 nt, Homo sapiens
guuggcacaugccu

SEQ ID NO: 1266391 - RNA, 13 nt, Homo sapiens
guugggcuuccau

SEQ ID NO: 1266392 - RNA, 19 nt, Homo sapiens
guuggggaaaccuucaucu

SEQ ID NO: 1266393 - RNA, 12 nt, Homo sapiens
guugguguuccu

SEQ ID NO: 1266394 - RNA, 21 nt, Homo sapiens
guuguaaaaagaaaaaccacu

SEQ ID NO: 1266395 - RNA, 14 nt, Homo sapiens
guuguguagucaag

SEQ ID NO: 1266396 - RNA, 20 nt, Homo sapiens
guuguuaaugaaaaugucag

SEQ ID NO: 1266397 - RNA, 15 nt, Homo sapiens
guuguucacauauau

SEQ ID NO: 1266398 - RNA, 14 nt, Homo sapiens
guuguuuguuugau

SEQ ID NO: 1266399 - RNA, 18 nt, Homo sapiens
guuuaaaugauacaguau

SEQ ID NO: 1266400 - RNA, 16 nt, Homo sapiens
guuuaagggugauagu

SEQ ID NO: 1266401 - RNA, 17 nt, Homo sapiens
guuuacagcacuacucu

SEQ ID NO: 1266402 - RNA, 22 nt, Homo sapiens
guuuacaggcccugcuccugca

SEQ ID NO: 1266403 - RNA, 24 nt, Homo sapiens
guuuaccuagaagaagcuauguca

SEQ ID NO: 1266404 - RNA, 19 nt, Homo sapiens
guuuacuuaucuuaugcca

SEQ ID NO: 1266405 - RNA, 19 nt, Homo sapiens
guuuagaccaaggaacaaa

SEQ ID NO: 1266406 - RNA, 23 nt, Homo sapiens
guuuagccaaaggauaagugucc

SEQ ID NO: 1266407 - RNA, 20 nt, Homo sapiens
guuuagugaaaaacugcugu

SEQ ID NO: 1266408 - RNA, 15 nt, Homo sapiens
guuuauaauuuucug

SEQ ID NO: 1266409 - RNA, 18 nt, Homo sapiens
guuuauccuuagcucaca

SEQ ID NO: 1266410 - RNA, 15 nt, Homo sapiens
guuuauuugcacuau

SEQ ID NO: 1266411 - RNA, 17 nt, Homo sapiens
guuucaaaaaaucugac

SEQ ID NO: 1266412 - RNA, 14 nt, Homo sapiens
guuucaacugugcu

SEQ ID NO: 1266413 - RNA, 17 nt, Homo sapiens
guuucaaguuauucaaa

SEQ ID NO: 1266414 - RNA, 14 nt, Homo sapiens
guuucaaucacugu

SEQ ID NO: 1266415 - RNA, 18 nt, Homo sapiens
guuucacacuagucacau

SEQ ID NO: 1266416 - RNA, 14 nt, Homo sapiens
guuucacugugcaa

SEQ ID NO: 1266417 - RNA, 20 nt, Homo sapiens
guuucagcucacuuccucca

SEQ ID NO: 1266418 - RNA, 21 nt, Homo sapiens
guuucagcucacuuccuccag

SEQ ID NO: 1266419 - RNA, 16 nt, Homo sapiens
guuucaguucugugua

SEQ ID NO: 1266420 - RNA, 13 nt, Homo sapiens
guuuccauuuaug

SEQ ID NO: 1266421 - RNA, 21 nt, Homo sapiens
guuucccaucagacugucaag

SEQ ID NO: 1266422 - RNA, 17 nt, Homo sapiens
guuucccguauugacag

SEQ ID NO: 1266423 - RNA, 15 nt, Homo sapiens
guuucccuuccucca

SEQ ID NO: 1266424 - RNA, 23 nt, Homo sapiens
guuuccuauguuucacugugcaa

SEQ ID NO: 1266425 - RNA, 17 nt, Homo sapiens
guuucucugggagguag

SEQ ID NO: 1266426 - RNA, 12 nt, Homo sapiens
guuucugagaaa

SEQ ID NO: 1266427 - RNA, 22 nt, Homo sapiens
guuucugagagagugccaugau

SEQ ID NO: 1266428 - RNA, 20 nt, Homo sapiens
guuucugauaccacugcacu

SEQ ID NO: 1266429 - RNA, 23 nt, Homo sapiens
guuucuggauuucauacuguaac

SEQ ID NO: 1266430 - RNA, 22 nt, Homo sapiens
guuucuguauacaacccuggca

SEQ ID NO: 1266431 - RNA, 14 nt, Homo sapiens
guuucuuccuguua

SEQ ID NO: 1266432 - RNA, 15 nt, Homo sapiens
guuucuuccuuuccu

SEQ ID NO: 1266433 - RNA, 21 nt, Homo sapiens
guuucuugcucccagaccaag

SEQ ID NO: 1266434 - RNA, 18 nt, Homo sapiens
guuugacacgaagccuua

SEQ ID NO: 1266435 - RNA, 23 nt, Homo sapiens
guuugacgacagugcauuugccu

SEQ ID NO: 1266436 - RNA, 22 nt, Homo sapiens
guuugauguccccaaaguacca

SEQ ID NO: 1266437 - RNA, 16 nt, Homo sapiens
guuugcaauuuuucca

SEQ ID NO: 1266438 - RNA, 12 nt, Homo sapiens
guuugcacuuug

SEQ ID NO: 1266439 - RNA, 20 nt, Homo sapiens
guuugcaguuggcuaagaga

SEQ ID NO: 1266440 - RNA, 14 nt, Homo sapiens
guuugcucuuuuaa

SEQ ID NO: 1266441 - RNA, 15 nt, Homo sapiens
guuugcuguuugcaa

SEQ ID NO: 1266442 - RNA, 21 nt, Homo sapiens
guuugggagacugugcucucu

SEQ ID NO: 1266443 - RNA, 14 nt, Homo sapiens
guuuguaaauaaga

SEQ ID NO: 1266444 - RNA, 17 nt, Homo sapiens
guuuguaagguggucac

SEQ ID NO: 1266445 - RNA, 20 nt, Homo sapiens
guuuguggccucagaauuga

SEQ ID NO: 1266446 - RNA, 20 nt, Homo sapiens
guuuguuccuacagccccuu

SEQ ID NO: 1266447 - RNA, 23 nt, Homo sapiens
guuuguucuguucugggggacag

SEQ ID NO: 1266448 - RNA, 12 nt, Homo sapiens
guuuguuucauu

SEQ ID NO: 1266449 - RNA, 14 nt, Homo sapiens
guuuuaaaguucau

SEQ ID NO: 1266450 - RNA, 17 nt, Homo sapiens
guuuuaacuguggauau

SEQ ID NO: 1266451 - RNA, 10 nt, Homo sapiens
guuuuacuaa

SEQ ID NO: 1266452 - RNA, 23 nt, Homo sapiens
guuuuagacgaggccacagcugc

SEQ ID NO: 1266453 - RNA, 20 nt, Homo sapiens
guuuuagagacuauggagcc

SEQ ID NO: 1266454 - RNA, 13 nt, Homo sapiens
guuuuauauguua

SEQ ID NO: 1266455 - RNA, 16 nt, Homo sapiens
guuuuauauguugcua

SEQ ID NO: 1266456 - RNA, 14 nt, Homo sapiens
guuuucacuuguau

SEQ ID NO: 1266457 - RNA, 14 nt, Homo sapiens
guuuucaguguaca

SEQ ID NO: 1266458 - RNA, 17 nt, Homo sapiens
guuuuccaguucaucga

SEQ ID NO: 1266459 - RNA, 17 nt, Homo sapiens
guuuuccuaaaugcagu

SEQ ID NO: 1266460 - RNA, 15 nt, Homo sapiens
guuuucuagaauuua

SEQ ID NO: 1266461 - RNA, 16 nt, Homo sapiens
guuuucugggugucca

SEQ ID NO: 1266462 - RNA, 14 nt, Homo sapiens
guuuucuucauuca

SEQ ID NO: 1266463 - RNA, 16 nt, Homo sapiens
guuuucuugccaauga

SEQ ID NO: 1266464 - RNA, 23 nt, Homo sapiens
guuuugaguagauauuacuuuau

SEQ ID NO: 1266465 - RNA, 15 nt, Homo sapiens
guuuugcuacauucu

SEQ ID NO: 1266466 - RNA, 19 nt, Homo sapiens
guuuuggggacucauuuca

SEQ ID NO: 1266467 - RNA, 22 nt, Homo sapiens
guuuuggguugaccccaaucca

SEQ ID NO: 1266468 - RNA, 17 nt, Homo sapiens
guuuuguaagaugcugg

SEQ ID NO: 1266469 - RNA, 15 nt, Homo sapiens
guuuuguaccaacac

SEQ ID NO: 1266470 - RNA, 23 nt, Homo sapiens
guuuuguagagauggggucucac

SEQ ID NO: 1266471 - RNA, 13 nt, Homo sapiens
guuuugucuuucc

SEQ ID NO: 1266472 - RNA, 17 nt, Homo sapiens
guuuugugagaacuaau

SEQ ID NO: 1266473 - RNA, 14 nt, Homo sapiens
guuuugugccuuug

SEQ ID NO: 1266474 - RNA, 17 nt, Homo sapiens
guuuuguguaacauauu

SEQ ID NO: 1266475 - RNA, 13 nt, Homo sapiens
guuuuguuucauc

SEQ ID NO: 1266476 - RNA, 15 nt, Homo sapiens
uaaccuagugaauuu

SEQ ID NO: 1266477 - RNA, 17 nt, Homo sapiens
uaaccucaaagugacua

SEQ ID NO: 1266478 - RNA, 14 nt, Homo sapiens
uaaccucaguguca

SEQ ID NO: 1266479 - RNA, 22 nt, Homo sapiens
uaaccuugaaaaaaaacagugg

SEQ ID NO: 1266480 - RNA, 15 nt, Homo sapiens
uaaccuugugccuug

SEQ ID NO: 1266481 - RNA, 23 nt, Homo sapiens
uaaccuuuucaccuccaacugga

SEQ ID NO: 1266482 - RNA, 21 nt, Homo sapiens
uaacuaaaagguaugcaauca

SEQ ID NO: 1266483 - RNA, 12 nt, Homo sapiens
uaacuacugugu

SEQ ID NO: 1266484 - RNA, 15 nt, Homo sapiens
uaacuacuuccugau

SEQ ID NO: 1266485 - RNA, 12 nt, Homo sapiens
uaacuagaauuu

SEQ ID NO: 1266486 - RNA, 15 nt, Homo sapiens
uaacuauauuugcuu

SEQ ID NO: 1266487 - RNA, 18 nt, Homo sapiens
uaacuauauuugcuuuuu

SEQ ID NO: 1266488 - RNA, 14 nt, Homo sapiens
uaacuaugacagau

SEQ ID NO: 1266489 - RNA, 15 nt, Homo sapiens
uaacuaugacagaua

SEQ ID NO: 1266490 - RNA, 13 nt, Homo sapiens
uaacuauuuacua

SEQ ID NO: 1266491 - RNA, 20 nt, Homo sapiens
uaacucaccagccccacugc

SEQ ID NO: 1266492 - RNA, 22 nt, Homo sapiens
uaacucaccagccccacugcca

SEQ ID NO: 1266493 - RNA, 18 nt, Homo sapiens
uaacuccccuguuucaau

SEQ ID NO: 1266494 - RNA, 15 nt, Homo sapiens
uaacucggauuccag

SEQ ID NO: 1266495 - RNA, 18 nt, Homo sapiens
uaacucguguuuggagcu

SEQ ID NO: 1266496 - RNA, 17 nt, Homo sapiens
uaacucugcacuacucc

SEQ ID NO: 1266497 - RNA, 18 nt, Homo sapiens
uaacucuguauuacagcu

SEQ ID NO: 1266498 - RNA, 20 nt, Homo sapiens
uaacucuuuauuuuuugcca

SEQ ID NO: 1266499 - RNA, 22 nt, Homo sapiens
uaacugaaccauuccaacuuca

SEQ ID NO: 1266500 - RNA, 19 nt, Homo sapiens
uaacugauuaccugccaau

SEQ ID NO: 1266501 - RNA, 17 nt, Homo sapiens
uaacugauuucuauggc

SEQ ID NO: 1266502 - RNA, 22 nt, Homo sapiens
uaacugugaaauaccacaagcc

SEQ ID NO: 1266503 - RNA, 14 nt, Homo sapiens
uaacugugaaguuu

SEQ ID NO: 1266504 - RNA, 16 nt, Homo sapiens
uaacugugcugaaugc

SEQ ID NO: 1266505 - RNA, 20 nt, Homo sapiens
uaacuguuaacuaugacaga

SEQ ID NO: 1266506 - RNA, 19 nt, Homo sapiens
uaacuguuucauagcaaac

SEQ ID NO: 1266507 - RNA, 20 nt, Homo sapiens
uaacuucaaggcccauaucu

SEQ ID NO: 1266508 - RNA, 14 nt, Homo sapiens
uaacuucacauuaa

SEQ ID NO: 1266509 - RNA, 17 nt, Homo sapiens
uaacuuggucagagcca

SEQ ID NO: 1266510 - RNA, 15 nt, Homo sapiens
uaacuuuauguguaa

SEQ ID NO: 1266511 - RNA, 18 nt, Homo sapiens
uaacuuucagaggcaaua

SEQ ID NO: 1266512 - RNA, 19 nt, Homo sapiens
uaacuuuuuaaaacacaac

SEQ ID NO: 1266513 - RNA, 18 nt, Homo sapiens
uaagaaaaaaacuugucu

SEQ ID NO: 1266514 - RNA, 18 nt, Homo sapiens
uaagaaaaagaagaacua

SEQ ID NO: 1266515 - RNA, 22 nt, Homo sapiens
uaagaaaacaaaaucuaaaaca

SEQ ID NO: 1266516 - RNA, 21 nt, Homo sapiens
uaagaaacauucuuuuccacu

SEQ ID NO: 1266517 - RNA, 16 nt, Homo sapiens
uaagaaagaucaaaga

SEQ ID NO: 1266518 - RNA, 14 nt, Homo sapiens
uaagaaagugcgag

SEQ ID NO: 1266519 - RNA, 19 nt, Homo sapiens
uaagaaaucaaguaaugaa

SEQ ID NO: 1266520 - RNA, 15 nt, Homo sapiens
uaagaaaugaucuuu

SEQ ID NO: 1266521 - RNA, 18 nt, Homo sapiens
uaagaagagacugggaag

SEQ ID NO: 1266522 - RNA, 17 nt, Homo sapiens
uaagaagagccauagcu

SEQ ID NO: 1266523 - RNA, 22 nt, Homo sapiens
uaagaagccuuaauuugcacag

SEQ ID NO: 1266524 - RNA, 17 nt, Homo sapiens
uaagaagcuucuaauaa

SEQ ID NO: 1266525 - RNA, 23 nt, Homo sapiens
uaagaauggagcaguacauggga

SEQ ID NO: 1266526 - RNA, 22 nt, Homo sapiens
uaagaauguugguuuacuuuca

SEQ ID NO: 1266527 - RNA, 17 nt, Homo sapiens
uaagaauucuguacuuc

SEQ ID NO: 1266528 - RNA, 20 nt, Homo sapiens
uaagaauuucacaagcuauu

SEQ ID NO: 1266529 - RNA, 16 nt, Homo sapiens
uaagacauaucucuaa

SEQ ID NO: 1266530 - RNA, 21 nt, Homo sapiens
uaagacaugauuuccuugaau

SEQ ID NO: 1266531 - RNA, 21 nt, Homo sapiens
uaagacgguuaaauacugugu

SEQ ID NO: 1266532 - RNA, 13 nt, Homo sapiens
uaagacucugcca

SEQ ID NO: 1266533 - RNA, 15 nt, Homo sapiens
uaagagacacuccaa

SEQ ID NO: 1266534 - RNA, 19 nt, Homo sapiens
uaagagacacuccaaaccu

SEQ ID NO: 1266535 - RNA, 15 nt, Homo sapiens
uaagagaucccuuaa

SEQ ID NO: 1266536 - RNA, 17 nt, Homo sapiens
uaagaggaucuccuguc

SEQ ID NO: 1266537 - RNA, 17 nt, Homo sapiens
uaagaggcuuucuccag

SEQ ID NO: 1266538 - RNA, 17 nt, Homo sapiens
uaagagucauccagcuc

SEQ ID NO: 1266539 - RNA, 13 nt, Homo sapiens
uaagaguuacuua

SEQ ID NO: 1266540 - RNA, 15 nt, Homo sapiens
uaagaucagacucug

SEQ ID NO: 1266541 - RNA, 14 nt, Homo sapiens
uaagauccacaaau

SEQ ID NO: 1266542 - RNA, 19 nt, Homo sapiens
uaagaucuuagauucucug

SEQ ID NO: 1266543 - RNA, 14 nt, Homo sapiens
uaagaugcacugaa

SEQ ID NO: 1266544 - RNA, 15 nt, Homo sapiens
uaagaugcacugaaa

SEQ ID NO: 1266545 - RNA, 17 nt, Homo sapiens
uaagauuuugugaauug

SEQ ID NO: 1266546 - RNA, 20 nt, Homo sapiens
uaagcaaacgggagaaauuu

SEQ ID NO: 1266547 - RNA, 15 nt, Homo sapiens
uaagcacuugcuuag

SEQ ID NO: 1266548 - RNA, 17 nt, Homo sapiens
uaagcauacaacuggac

SEQ ID NO: 1266549 - RNA, 22 nt, Homo sapiens
uaagcaucaaauauuugugcaa

SEQ ID NO: 1266550 - RNA, 21 nt, Homo sapiens
uaagcaucugccaucugcuuu

SEQ ID NO: 1266551 - RNA, 23 nt, Homo sapiens
uaagccaaagaaacaagcugugc

SEQ ID NO: 1266552 - RNA, 22 nt, Homo sapiens
uaagccaacuuuaauugcuuaa

SEQ ID NO: 1266553 - RNA, 19 nt, Homo sapiens
uaagccacgaggugcagua

SEQ ID NO: 1266554 - RNA, 19 nt, Homo sapiens
uaagccauaggcccaggau

SEQ ID NO: 1266555 - RNA, 17 nt, Homo sapiens
uaagcccacaguaggca

SEQ ID NO: 1266556 - RNA, 20 nt, Homo sapiens
uaagcccagugcugcuguaa

SEQ ID NO: 1266557 - RNA, 14 nt, Homo sapiens
uaagcucgagugaa

SEQ ID NO: 1266558 - RNA, 17 nt, Homo sapiens
uaagcucuuuaugacug

SEQ ID NO: 1266559 - RNA, 12 nt, Homo sapiens
uaagcugggaua

SEQ ID NO: 1266560 - RNA, 20 nt, Homo sapiens
uaagcugggauaaucacauu

SEQ ID NO: 1266561 - RNA, 20 nt, Homo sapiens
uaagcuguggcuggaauuga

SEQ ID NO: 1266562 - RNA, 16 nt, Homo sapiens
uaagcuuucucucaga

SEQ ID NO: 1266563 - RNA, 19 nt, Homo sapiens
uaagcuuuggacccaagga

SEQ ID NO: 1266564 - RNA, 13 nt, Homo sapiens
uaaggaacaacgu

SEQ ID NO: 1266565 - RNA, 14 nt, Homo sapiens
uaaggacauuuccc

SEQ ID NO: 1266566 - RNA, 22 nt, Homo sapiens
uaaggacgggaccauuuuuaca

SEQ ID NO: 1266567 - RNA, 16 nt, Homo sapiens
uaaggacuucugcagc

SEQ ID NO: 1266568 - RNA, 13 nt, Homo sapiens
uaaggaugaaggu

SEQ ID NO: 1266569 - RNA, 16 nt, Homo sapiens
uaaggaugucacaggg

SEQ ID NO: 1266570 - RNA, 18 nt, Homo sapiens
uaaggaugucacagggcc

SEQ ID NO: 1266571 - RNA, 15 nt, Homo sapiens
uaaggauugugauau

SEQ ID NO: 1266572 - RNA, 14 nt, Homo sapiens
uaaggauuuuucaa

SEQ ID NO: 1266573 - RNA, 18 nt, Homo sapiens
uaaggcugugugaauuuu

SEQ ID NO: 1266574 - RNA, 17 nt, Homo sapiens
uaagggaaaaguucucc

SEQ ID NO: 1266575 - RNA, 18 nt, Homo sapiens
uaagggacucccacaaca

SEQ ID NO: 1266576 - RNA, 23 nt, Homo sapiens
uaagggaguggccucauuucacu

SEQ ID NO: 1266577 - RNA, 21 nt, Homo sapiens
uaagggcuggucucugcugaa

SEQ ID NO: 1266578 - RNA, 18 nt, Homo sapiens
uaaggggccugcccucau

SEQ ID NO: 1266579 - RNA, 22 nt, Homo sapiens
uaaggggggcagggagugauga

SEQ ID NO: 1266580 - RNA, 15 nt, Homo sapiens
uaagggguuugccau

SEQ ID NO: 1266581 - RNA, 17 nt, Homo sapiens
uaagggugggugcucag

SEQ ID NO: 1266582 - RNA, 17 nt, Homo sapiens
uaagguaauucauggca

SEQ ID NO: 1266583 - RNA, 19 nt, Homo sapiens
uaaggugcaguucccccaa

SEQ ID NO: 1266584 - RNA, 16 nt, Homo sapiens
uaagguggguccagga

SEQ ID NO: 1266585 - RNA, 20 nt, Homo sapiens
uaaguaaaagcuacuaugua

SEQ ID NO: 1266586 - RNA, 16 nt, Homo sapiens
uaaguaaaccaaaaag

SEQ ID NO: 1266587 - RNA, 17 nt, Homo sapiens
uaaguaucacacuguau

SEQ ID NO: 1266588 - RNA, 18 nt, Homo sapiens
uaaguaucacacuguaua

SEQ ID NO: 1266589 - RNA, 14 nt, Homo sapiens
uaaguaucagggga

SEQ ID NO: 1266590 - RNA, 18 nt, Homo sapiens
uaaguauuuuccuaagca

SEQ ID NO: 1266591 - RNA, 14 nt, Homo sapiens
uaagucauggaauu

SEQ ID NO: 1266592 - RNA, 20 nt, Homo sapiens
uaagugauauaaaucagauu

SEQ ID NO: 1266593 - RNA, 19 nt, Homo sapiens
uaagugcuuuguaauggga

SEQ ID NO: 1266594 - RNA, 20 nt, Homo sapiens
uaagugggguugcaaccacu

SEQ ID NO: 1266595 - RNA, 15 nt, Homo sapiens
uaagugguuugauca

SEQ ID NO: 1266596 - RNA, 14 nt, Homo sapiens
uaaguuauuuacuu

SEQ ID NO: 1266597 - RNA, 13 nt, Homo sapiens
uaaguucuucaaa

SEQ ID NO: 1266598 - RNA, 15 nt, Homo sapiens
uaaguuugauuucau

SEQ ID NO: 1266599 - RNA, 18 nt, Homo sapiens
uaauaaaacaucuuucca

SEQ ID NO: 1266600 - RNA, 19 nt, Homo sapiens
uaauaaaacuaaacuuuca

SEQ ID NO: 1266601 - RNA, 15 nt, Homo sapiens
uaauaaaacugcaca

SEQ ID NO: 1266602 - RNA, 17 nt, Homo sapiens
uagaaaaaucucauucc

SEQ ID NO: 1266603 - RNA, 12 nt, Homo sapiens
uagaaaacuggg

SEQ ID NO: 1266604 - RNA, 15 nt, Homo sapiens
uagaaaagugaauug

SEQ ID NO: 1266605 - RNA, 19 nt, Homo sapiens
uagaaaauuagacugugau

SEQ ID NO: 1266606 - RNA, 12 nt, Homo sapiens
uagaaacaaaca

SEQ ID NO: 1266607 - RNA, 12 nt, Homo sapiens
uagaaacacagu

SEQ ID NO: 1266608 - RNA, 17 nt, Homo sapiens
uagaaagagaaacaguu

SEQ ID NO: 1266609 - RNA, 18 nt, Homo sapiens
uagaaagcaacuuaucag

SEQ ID NO: 1266610 - RNA, 18 nt, Homo sapiens
uagaaaggaagacagauu

SEQ ID NO: 1266611 - RNA, 14 nt, Homo sapiens
uagaaagggccuug

SEQ ID NO: 1266612 - RNA, 14 nt, Homo sapiens
uagaaagggucccu

SEQ ID NO: 1266613 - RNA, 12 nt, Homo sapiens
uagaaauaagcc

SEQ ID NO: 1266614 - RNA, 16 nt, Homo sapiens
uagaaauaauaugcau

SEQ ID NO: 1266615 - RNA, 15 nt, Homo sapiens
uagaaauauagccaa

SEQ ID NO: 1266616 - RNA, 12 nt, Homo sapiens
uagaaaugcuac

SEQ ID NO: 1266617 - RNA, 13 nt, Homo sapiens
uagaaauggauuu

SEQ ID NO: 1266618 - RNA, 19 nt, Homo sapiens
uagaaauguaaacugccau

SEQ ID NO: 1266619 - RNA, 22 nt, Homo sapiens
uagaaauguuuagguuacuaaa

SEQ ID NO: 1266620 - RNA, 22 nt, Homo sapiens
uagaacaaaggacagaguauga

SEQ ID NO: 1266621 - RNA, 17 nt, Homo sapiens
uagaacaacgccuguca

SEQ ID NO: 1266622 - RNA, 18 nt, Homo sapiens
uagaaccacuuccugcua

SEQ ID NO: 1266623 - RNA, 16 nt, Homo sapiens
uagaacugucugugaa

SEQ ID NO: 1266624 - RNA, 17 nt, Homo sapiens
uagaacugucugugaac

SEQ ID NO: 1266625 - RNA, 12 nt, Homo sapiens
uagaacuguuuc

SEQ ID NO: 1266626 - RNA, 19 nt, Homo sapiens
uagaacuuacuauucauua

SEQ ID NO: 1266627 - RNA, 22 nt, Homo sapiens
uagaagaaaagcccauuuucaa

SEQ ID NO: 1266628 - RNA, 18 nt, Homo sapiens
uagaagaagcuaugucaa

SEQ ID NO: 1266629 - RNA, 14 nt, Homo sapiens
uagaagacugucag

SEQ ID NO: 1266630 - RNA, 20 nt, Homo sapiens
uagaagauuuuaugcugcug

SEQ ID NO: 1266631 - RNA, 14 nt, Homo sapiens
uagaagcacuacac

SEQ ID NO: 1266632 - RNA, 18 nt, Homo sapiens
uagaagcuguaacagaau

SEQ ID NO: 1266633 - RNA, 12 nt, Homo sapiens
uagaagucacac

SEQ ID NO: 1266634 - RNA, 16 nt, Homo sapiens
uagaagucacacagua

SEQ ID NO: 1266635 - RNA, 17 nt, Homo sapiens
uagaauaggcuguguau

SEQ ID NO: 1266636 - RNA, 18 nt, Homo sapiens
uagaauaggcuguguauu

SEQ ID NO: 1266637 - RNA, 21 nt, Homo sapiens
uagaauauauuuccuuauuca

SEQ ID NO: 1266638 - RNA, 20 nt, Homo sapiens
uagaauauuauguuccucaa

SEQ ID NO: 1266639 - RNA, 15 nt, Homo sapiens
uagaaugaaagacug

SEQ ID NO: 1266640 - RNA, 18 nt, Homo sapiens
uagaauuauaacuguaaa

SEQ ID NO: 1266641 - RNA, 23 nt, Homo sapiens
uagacacccauuuucacauuccc

SEQ ID NO: 1266642 - RNA, 16 nt, Homo sapiens
uagacacuuacuugau

SEQ ID NO: 1266643 - RNA, 12 nt, Homo sapiens
uagacaucagaa

SEQ ID NO: 1266644 - RNA, 18 nt, Homo sapiens
uagaccaccuaauaucaa

SEQ ID NO: 1266645 - RNA, 22 nt, Homo sapiens
uagacgaggccacagcugccau

SEQ ID NO: 1266646 - RNA, 18 nt, Homo sapiens
uagacgccuuccagguca

SEQ ID NO: 1266647 - RNA, 15 nt, Homo sapiens
uagacuacaguucug

SEQ ID NO: 1266648 - RNA, 13 nt, Homo sapiens
uagacuacauuua

SEQ ID NO: 1266649 - RNA, 23 nt, Homo sapiens
uagacugacuuguuugucuucca

SEQ ID NO: 1266650 - RNA, 12 nt, Homo sapiens
uagacugaggua

SEQ ID NO: 1266651 - RNA, 17 nt, Homo sapiens
uagacuggaaguucaua

SEQ ID NO: 1266652 - RNA, 17 nt, Homo sapiens
uagacuuaaacagcaga

SEQ ID NO: 1266653 - RNA, 19 nt, Homo sapiens
uagacuuaucugcauauug

SEQ ID NO: 1266654 - RNA, 15 nt, Homo sapiens
uagagaauuuccuua

SEQ ID NO: 1266655 - RNA, 16 nt, Homo sapiens
uagagacgggauuucc

SEQ ID NO: 1266656 - RNA, 14 nt, Homo sapiens
uagagacuguagau

SEQ ID NO: 1266657 - RNA, 21 nt, Homo sapiens
uagagagccccugacaauccu

SEQ ID NO: 1266658 - RNA, 20 nt, Homo sapiens
uagagagcuuuucacuguga

SEQ ID NO: 1266659 - RNA, 18 nt, Homo sapiens
uagagaggacaauacugg

SEQ ID NO: 1266660 - RNA, 19 nt, Homo sapiens
uagagaggacaauacuggg

SEQ ID NO: 1266661 - RNA, 20 nt, Homo sapiens
uagagauagcuacaguguaa

SEQ ID NO: 1266662 - RNA, 21 nt, Homo sapiens
uagagccagcccauggcuuua

SEQ ID NO: 1266663 - RNA, 20 nt, Homo sapiens
uagagcccuggccagcccuu

SEQ ID NO: 1266664 - RNA, 16 nt, Homo sapiens
uagagcucgccacgaa

SEQ ID NO: 1266665 - RNA, 13 nt, Homo sapiens
uagagcugggaau

SEQ ID NO: 1266666 - RNA, 23 nt, Homo sapiens
uagaggaauccauguaaauugca

SEQ ID NO: 1266667 - RNA, 21 nt, Homo sapiens
uagaggacuucuggcagggaa

SEQ ID NO: 1266668 - RNA, 16 nt, Homo sapiens
uagaggagaaccugga

SEQ ID NO: 1266669 - RNA, 21 nt, Homo sapiens
uagaggcuccccagggcuccc

SEQ ID NO: 1266670 - RNA, 22 nt, Homo sapiens
uagagguccucaugggucccuu

SEQ ID NO: 1266671 - RNA, 21 nt, Homo sapiens
uagagguuuuaaagugauuaa

SEQ ID NO: 1266672 - RNA, 15 nt, Homo sapiens
uagaguaggugcaga

SEQ ID NO: 1266673 - RNA, 14 nt, Homo sapiens
uagaguauaugcac

SEQ ID NO: 1266674 - RNA, 16 nt, Homo sapiens
uagaguaucacuccca

SEQ ID NO: 1266675 - RNA, 18 nt, Homo sapiens
uagaguguagacuguggc

SEQ ID NO: 1266676 - RNA, 14 nt, Homo sapiens
uagaguguagccua

SEQ ID NO: 1266677 - RNA, 22 nt, Homo sapiens
uagaguguagccuaaagggcag

SEQ ID NO: 1266678 - RNA, 15 nt, Homo sapiens
uagaguguagcugua

SEQ ID NO: 1266679 - RNA, 17 nt, Homo sapiens
uagaguuuccacuaucc

SEQ ID NO: 1266680 - RNA, 23 nt, Homo sapiens
uagauaaaagaaccgagcaauuu

SEQ ID NO: 1266681 - RNA, 23 nt, Homo sapiens
uagauaaccuguacuucaaguua

SEQ ID NO: 1266682 - RNA, 21 nt, Homo sapiens
uagauauugugaaguacauau

SEQ ID NO: 1266683 - RNA, 17 nt, Homo sapiens
uagaugcaugacuugug

SEQ ID NO: 1266684 - RNA, 14 nt, Homo sapiens
uagaugcugugaca

SEQ ID NO: 1266685 - RNA, 15 nt, Homo sapiens
uagaugguuacacug

SEQ ID NO: 1266686 - RNA, 23 nt, Homo sapiens
uagaugucaagcugaaaacaaac

SEQ ID NO: 1266687 - RNA, 21 nt, Homo sapiens
uagauguuuauucuucuagag

SEQ ID NO: 1266688 - RNA, 17 nt, Homo sapiens
uagauguuucaacugug

SEQ ID NO: 1266689 - RNA, 15 nt, Homo sapiens
uagauuaaacaaaca

SEQ ID NO: 1266690 - RNA, 15 nt, Homo sapiens
uagauuaauacucua

SEQ ID NO: 1266691 - RNA, 14 nt, Homo sapiens
uagauuaggauuaa

SEQ ID NO: 1266692 - RNA, 23 nt, Homo sapiens
uagauugcuuucuucuuaaccua

SEQ ID NO: 1266693 - RNA, 17 nt, Homo sapiens
uagauuucuucucuuua

SEQ ID NO: 1266694 - RNA, 17 nt, Homo sapiens
uagauuuguacaggagu

SEQ ID NO: 1266695 - RNA, 13 nt, Homo sapiens
uagcaaacacugg

SEQ ID NO: 1266696 - RNA, 19 nt, Homo sapiens
uagcaaauggcagaaccaa

SEQ ID NO: 1266697 - RNA, 20 nt, Homo sapiens
uagcaaauggcagaaccaaa

SEQ ID NO: 1266698 - RNA, 14 nt, Homo sapiens
uagcaacaaaagga

SEQ ID NO: 1266699 - RNA, 20 nt, Homo sapiens
uagcaagcugccgaaccaaa

SEQ ID NO: 1266700 - RNA, 14 nt, Homo sapiens
uagcaagugugcac

SEQ ID NO: 1266701 - RNA, 21 nt, Homo sapiens
uagcaaguugguaaauucaca

SEQ ID NO: 1266702 - RNA, 16 nt, Homo sapiens
uagcaauugacuguca

SEQ ID NO: 1266703 - RNA, 18 nt, Homo sapiens
uagcacacuuuuccacau

SEQ ID NO: 1266704 - RNA, 15 nt, Homo sapiens
uagcaccauugcacu

SEQ ID NO: 1266705 - RNA, 15 nt, Homo sapiens
uagcacuacaaacac

SEQ ID NO: 1266706 - RNA, 17 nt, Homo sapiens
uagcacuauuuacauac

SEQ ID NO: 1266707 - RNA, 10 nt, Homo sapiens
uagcacugag

SEQ ID NO: 1266708 - RNA, 22 nt, Homo sapiens
uagcacugaggguggcacucaa

SEQ ID NO: 1266709 - RNA, 20 nt, Homo sapiens
uagcacuuucuacaauguga

SEQ ID NO: 1266710 - RNA, 21 nt, Homo sapiens
uagcacuuugaaauaccucau

SEQ ID NO: 1266711 - RNA, 13 nt, Homo sapiens
uagcagaaaucua

SEQ ID NO: 1266712 - RNA, 19 nt, Homo sapiens
uagcagaguuaaaucucaa

SEQ ID NO: 1266713 - RNA, 21 nt, Homo sapiens
uagcagcagauguaguuucag

SEQ ID NO: 1266714 - RNA, 13 nt, Homo sapiens
uagcagcugugau

SEQ ID NO: 1266715 - RNA, 17 nt, Homo sapiens
uagcaggcaaugcugua

SEQ ID NO: 1266716 - RNA, 12 nt, Homo sapiens
uagcaucagagg

SEQ ID NO: 1266717 - RNA, 12 nt, Homo sapiens
uagcaucucagg

SEQ ID NO: 1266718 - RNA, 13 nt, Homo sapiens
uagcaucucagga

SEQ ID NO: 1266719 - RNA, 17 nt, Homo sapiens
uagcaucuuccuugaua

SEQ ID NO: 1266720 - RNA, 13 nt, Homo sapiens
uagcauugcacuu

SEQ ID NO: 1266721 - RNA, 20 nt, Homo sapiens
uagccaaaccaggacccugu

SEQ ID NO: 1266722 - RNA, 15 nt, Homo sapiens
uagccaaugucuccu

SEQ ID NO: 1266723 - RNA, 17 nt, Homo sapiens
uagccagaggcucuaau

SEQ ID NO: 1266724 - RNA, 22 nt, Homo sapiens
uagccagccccucuuccccaau

SEQ ID NO: 1266725 - RNA, 19 nt, Homo sapiens
uagccaggaaguacuucca

SEQ ID NO: 1266726 - RNA, 15 nt, Homo sapiens
uagccagggggacua

SEQ ID NO: 1266727 - RNA, 16 nt, Homo sapiens
uagccaucuaaugcuu

SEQ ID NO: 1266728 - RNA, 16 nt, Homo sapiens
uccugaaucugugcaa

SEQ ID NO: 1266729 - RNA, 16 nt, Homo sapiens
uccugaccucagguga

SEQ ID NO: 1266730 - RNA, 13 nt, Homo sapiens
uccugacugaaag

SEQ ID NO: 1266731 - RNA, 18 nt, Homo sapiens
uccugaggcaaaguagug

SEQ ID NO: 1266732 - RNA, 20 nt, Homo sapiens
uccugaguaguugggauuac

SEQ ID NO: 1266733 - RNA, 22 nt, Homo sapiens
uccugagugugggcuucugaaa

SEQ ID NO: 1266734 - RNA, 21 nt, Homo sapiens
uccugaucaagguacaauucu

SEQ ID NO: 1266735 - RNA, 13 nt, Homo sapiens
uccugaucuguga

SEQ ID NO: 1266736 - RNA, 16 nt, Homo sapiens
uccugcaacucaagga

SEQ ID NO: 1266737 - RNA, 12 nt, Homo sapiens
uccugcagacac

SEQ ID NO: 1266738 - RNA, 17 nt, Homo sapiens
uccugccaguguggaac

SEQ ID NO: 1266739 - RNA, 14 nt, Homo sapiens
uccugccaguugaa

SEQ ID NO: 1266740 - RNA, 14 nt, Homo sapiens
uccugccauguuua

SEQ ID NO: 1266741 - RNA, 18 nt, Homo sapiens
uccugccauucuucuggu

SEQ ID NO: 1266742 - RNA, 14 nt, Homo sapiens
uccugccuacccag

SEQ ID NO: 1266743 - RNA, 16 nt, Homo sapiens
uccugccuuaacugau

SEQ ID NO: 1266744 - RNA, 15 nt, Homo sapiens
uccugccuucugucc

SEQ ID NO: 1266745 - RNA, 23 nt, Homo sapiens
uccugcucucuggaggacgguca

SEQ ID NO: 1266746 - RNA, 17 nt, Homo sapiens
uccugcugccauccuca

SEQ ID NO: 1266747 - RNA, 22 nt, Homo sapiens
uccugcugcggaggagcugccu

SEQ ID NO: 1266748 - RNA, 15 nt, Homo sapiens
uccuggauucacuca

SEQ ID NO: 1266749 - RNA, 21 nt, Homo sapiens
uccuggauuccucacuuugaa

SEQ ID NO: 1266750 - RNA, 19 nt, Homo sapiens
uccuggcaaucaauacagc

SEQ ID NO: 1266751 - RNA, 15 nt, Homo sapiens
uccuggcagcccugu

SEQ ID NO: 1266752 - RNA, 23 nt, Homo sapiens
uccuggcaucaguagcaucugua

SEQ ID NO: 1266753 - RNA, 16 nt, Homo sapiens
uccuggcuaacacgug

SEQ ID NO: 1266754 - RNA, 18 nt, Homo sapiens
uccuggcuaacacgugaa

SEQ ID NO: 1266755 - RNA, 19 nt, Homo sapiens
uccuggcuaacauggugaa

SEQ ID NO: 1266756 - RNA, 21 nt, Homo sapiens
uccugggagcccccaccacaa

SEQ ID NO: 1266757 - RNA, 16 nt, Homo sapiens
uccugggagugagcug

SEQ ID NO: 1266758 - RNA, 17 nt, Homo sapiens
uccugggccuccugaca

SEQ ID NO: 1266759 - RNA, 18 nt, Homo sapiens
uccuggggcagcacuccc

SEQ ID NO: 1266760 - RNA, 15 nt, Homo sapiens
uccuggggucacuca

SEQ ID NO: 1266761 - RNA, 18 nt, Homo sapiens
uccugggucuaccacuca

SEQ ID NO: 1266762 - RNA, 18 nt, Homo sapiens
uccuggugccaauuucaa

SEQ ID NO: 1266763 - RNA, 17 nt, Homo sapiens
uccugguuccuuccuau

SEQ ID NO: 1266764 - RNA, 15 nt, Homo sapiens
uccuguacucugggg

SEQ ID NO: 1266765 - RNA, 13 nt, Homo sapiens
uccuguauaagca

SEQ ID NO: 1266766 - RNA, 19 nt, Homo sapiens
uccuguauucuacagcaga

SEQ ID NO: 1266767 - RNA, 22 nt, Homo sapiens
uccuguauucuacagcagauac

SEQ ID NO: 1266768 - RNA, 17 nt, Homo sapiens
uccuguccuaucacucu

SEQ ID NO: 1266769 - RNA, 13 nt, Homo sapiens
uccugugauccac

SEQ ID NO: 1266770 - RNA, 16 nt, Homo sapiens
uccugugccagaggaa

SEQ ID NO: 1266771 - RNA, 16 nt, Homo sapiens
uccuguucagcauucu

SEQ ID NO: 1266772 - RNA, 18 nt, Homo sapiens
uccuuaacgcuagagauu

SEQ ID NO: 1266773 - RNA, 23 nt, Homo sapiens
uccuuaauaacaacagaucugca

SEQ ID NO: 1266774 - RNA, 12 nt, Homo sapiens
uccuuacauuuu

SEQ ID NO: 1266775 - RNA, 13 nt, Homo sapiens
uccuuaccgcaca

SEQ ID NO: 1266776 - RNA, 14 nt, Homo sapiens
uccuuacucuugau

SEQ ID NO: 1266777 - RNA, 22 nt, Homo sapiens
uccuuagcuuucccugugccac

SEQ ID NO: 1266778 - RNA, 17 nt, Homo sapiens
uccuuaggccucugaga

SEQ ID NO: 1266779 - RNA, 16 nt, Homo sapiens
uccuuauucagaauuu

SEQ ID NO: 1266780 - RNA, 23 nt, Homo sapiens
uccuucacaggcagugcauguga

SEQ ID NO: 1266781 - RNA, 21 nt, Homo sapiens
uccuucauuaaugaugaucuu

SEQ ID NO: 1266782 - RNA, 18 nt, Homo sapiens
uccuuccacaacugcugc

SEQ ID NO: 1266783 - RNA, 18 nt, Homo sapiens
uccuuccacaaugacugc

SEQ ID NO: 1266784 - RNA, 14 nt, Homo sapiens
uccuuccuucaggg

SEQ ID NO: 1266785 - RNA, 13 nt, Homo sapiens
uccuucgcuggaa

SEQ ID NO: 1266786 - RNA, 15 nt, Homo sapiens
uccuucuccauaaag

SEQ ID NO: 1266787 - RNA, 21 nt, Homo sapiens
uccuucucugaacacaggcag

SEQ ID NO: 1266788 - RNA, 13 nt, Homo sapiens
uccuucuuugaua

SEQ ID NO: 1266789 - RNA, 20 nt, Homo sapiens
uccuugacccugcuuuuugc

SEQ ID NO: 1266790 - RNA, 23 nt, Homo sapiens
uccuugagaagugggagcacccu

SEQ ID NO: 1266791 - RNA, 18 nt, Homo sapiens
uccuugcacaaauggagg

SEQ ID NO: 1266792 - RNA, 20 nt, Homo sapiens
uccuugcaggugacauuugc

SEQ ID NO: 1266793 - RNA, 20 nt, Homo sapiens
uccuuggagggacaugacua

SEQ ID NO: 1266794 - RNA, 15 nt, Homo sapiens
uccuuggauguaguc

SEQ ID NO: 1266795 - RNA, 22 nt, Homo sapiens
uccuugggcccugaggcugcug

SEQ ID NO: 1266796 - RNA, 17 nt, Homo sapiens
uccuuggggagcacuug

SEQ ID NO: 1266797 - RNA, 17 nt, Homo sapiens
uccuuguaaagacugua

SEQ ID NO: 1266798 - RNA, 14 nt, Homo sapiens
uccuuuaaaccauc

SEQ ID NO: 1266799 - RNA, 22 nt, Homo sapiens
uccuuuaaagaugaacucugaa

SEQ ID NO: 1266800 - RNA, 17 nt, Homo sapiens
uccuuuagaguugcaug

SEQ ID NO: 1266801 - RNA, 17 nt, Homo sapiens
uccuuuagcgcccaguu

SEQ ID NO: 1266802 - RNA, 20 nt, Homo sapiens
uccuuuaugaugacugcuua

SEQ ID NO: 1266803 - RNA, 15 nt, Homo sapiens
uccuuucacaaccuu

SEQ ID NO: 1266804 - RNA, 16 nt, Homo sapiens
uccuuucuccagccag

SEQ ID NO: 1266805 - RNA, 14 nt, Homo sapiens
uccuuucugccgac

SEQ ID NO: 1266806 - RNA, 15 nt, Homo sapiens
uccuuugaucccaga

SEQ ID NO: 1266807 - RNA, 12 nt, Homo sapiens
uccuuugcacug

SEQ ID NO: 1266808 - RNA, 16 nt, Homo sapiens
uccuuuggccauucca

SEQ ID NO: 1266809 - RNA, 19 nt, Homo sapiens
uccuuuuacaauuguugaa

SEQ ID NO: 1266810 - RNA, 17 nt, Homo sapiens
uccuuuuuaaaugacuu

SEQ ID NO: 1266811 - RNA, 18 nt, Homo sapiens
uccuuuuuugcaugugca

SEQ ID NO: 1266812 - RNA, 18 nt, Homo sapiens
ucgaaaccugggauucag

SEQ ID NO: 1266813 - RNA, 17 nt, Homo sapiens
ucgaaauacaagccauu

SEQ ID NO: 1266814 - RNA, 20 nt, Homo sapiens
ucgaaccaaggcagccucca

SEQ ID NO: 1266815 - RNA, 13 nt, Homo sapiens
ucgaaccacugag

SEQ ID NO: 1266816 - RNA, 17 nt, Homo sapiens
ucgaaucucugugccuu

SEQ ID NO: 1266817 - RNA, 17 nt, Homo sapiens
ucgaauucucacaagga

SEQ ID NO: 1266818 - RNA, 19 nt, Homo sapiens
ucgaauucucacaaggaaa

SEQ ID NO: 1266819 - RNA, 19 nt, Homo sapiens
ucgacuguauucgugcauu

SEQ ID NO: 1266820 - RNA, 20 nt, Homo sapiens
ucgacuuuucuuaacaaccu

SEQ ID NO: 1266821 - RNA, 15 nt, Homo sapiens
ucgaggggcucucag

SEQ ID NO: 1266822 - RNA, 22 nt, Homo sapiens
ucgauauguauaucauucuaca

SEQ ID NO: 1266823 - RNA, 17 nt, Homo sapiens
ucgaugcagugcuucca

SEQ ID NO: 1266824 - RNA, 18 nt, Homo sapiens
ucgaugcguucacuccaa

SEQ ID NO: 1266825 - RNA, 18 nt, Homo sapiens
ucgauggcucaaucuauc

SEQ ID NO: 1266826 - RNA, 13 nt, Homo sapiens
ucgauuauauucc

SEQ ID NO: 1266827 - RNA, 15 nt, Homo sapiens
ucgcagcuacuaggg

SEQ ID NO: 1266828 - RNA, 14 nt, Homo sapiens
ucgcaggagucucu

SEQ ID NO: 1266829 - RNA, 17 nt, Homo sapiens
ucgcaugacuguuacag

SEQ ID NO: 1266830 - RNA, 21 nt, Homo sapiens
ucgccccaggcccucccugac

SEQ ID NO: 1266831 - RNA, 13 nt, Homo sapiens
ucgccggccuugu

SEQ ID NO: 1266832 - RNA, 23 nt, Homo sapiens
ucgccguguuacuguugcacuga

SEQ ID NO: 1266833 - RNA, 18 nt, Homo sapiens
ucgccuuagcauguuugc

SEQ ID NO: 1266834 - RNA, 21 nt, Homo sapiens
ucgcggcucuccagggcuccc

SEQ ID NO: 1266835 - RNA, 14 nt, Homo sapiens
ucgcugccaucacc

SEQ ID NO: 1266836 - RNA, 17 nt, Homo sapiens
ucgcuggggauggaauu

SEQ ID NO: 1266837 - RNA, 13 nt, Homo sapiens
ucgcuucuugccu

SEQ ID NO: 1266838 - RNA, 20 nt, Homo sapiens
ucggagaaacgggugagcug

SEQ ID NO: 1266839 - RNA, 20 nt, Homo sapiens
ucggagacagugacuggugc

SEQ ID NO: 1266840 - RNA, 18 nt, Homo sapiens
ucggagacagugaucucc

SEQ ID NO: 1266841 - RNA, 21 nt, Homo sapiens
ucggauacccuggagcaagac

SEQ ID NO: 1266842 - RNA, 20 nt, Homo sapiens
ucggauuugccauagccuug

SEQ ID NO: 1266843 - RNA, 19 nt, Homo sapiens
ucggcagcuacucagagga

SEQ ID NO: 1266844 - RNA, 14 nt, Homo sapiens
ucggccccaucucu

SEQ ID NO: 1266845 - RNA, 17 nt, Homo sapiens
ucgggaggcugaggcag

SEQ ID NO: 1266846 - RNA, 18 nt, Homo sapiens
ucgggaguuugagaccag

SEQ ID NO: 1266847 - RNA, 15 nt, Homo sapiens
ucgggccacagggcg

SEQ ID NO: 1266848 - RNA, 14 nt, Homo sapiens
ucggggacccugcg

SEQ ID NO: 1266849 - RNA, 11 nt, Homo sapiens
ucggggcucca

SEQ ID NO: 1266850 - RNA, 21 nt, Homo sapiens
ucgguauccccccaucuugcu

SEQ ID NO: 1266851 - RNA, 20 nt, Homo sapiens
ucggucaccuguuggcuaca

SEQ ID NO: 1266852 - RNA, 13 nt, Homo sapiens
ucggucacuccaa

SEQ ID NO: 1266853 - RNA, 14 nt, Homo sapiens
ucgguguucugucc

SEQ ID NO: 1266854 - RNA, 22 nt, Homo sapiens
ucuuaguguaugauuacuggcc

SEQ ID NO: 1266855 - RNA, 14 nt, Homo sapiens
ucuuagugugccaa

SEQ ID NO: 1266856 - RNA, 14 nt, Homo sapiens
ucuuaguuugcagu

SEQ ID NO: 1266857 - RNA, 16 nt, Homo sapiens
ucuuaucucagucaug

SEQ ID NO: 1266858 - RNA, 20 nt, Homo sapiens
ucuuaucuuugcucccugca

SEQ ID NO: 1266859 - RNA, 17 nt, Homo sapiens
ucuuaugauuacuauca

SEQ ID NO: 1266860 - RNA, 13 nt, Homo sapiens
ucuuaugccauuu

SEQ ID NO: 1266861 - RNA, 15 nt, Homo sapiens
ucuuauguuugcuuu

SEQ ID NO: 1266862 - RNA, 18 nt, Homo sapiens
ucuuauuaguuccccaaa

SEQ ID NO: 1266863 - RNA, 23 nt, Homo sapiens
ucuuauucuggcggcagcgccuu

SEQ ID NO: 1266864 - RNA, 13 nt, Homo sapiens
ucuuauugacaau

SEQ ID NO: 1266865 - RNA, 21 nt, Homo sapiens
ucuuauuuauaccucaguuug

SEQ ID NO: 1266866 - RNA, 14 nt, Homo sapiens
ucuucaaacuguga

SEQ ID NO: 1266867 - RNA, 12 nt, Homo sapiens
ucuucaacaucc

SEQ ID NO: 1266868 - RNA, 18 nt, Homo sapiens
ucuucaacgccaucucca

SEQ ID NO: 1266869 - RNA, 18 nt, Homo sapiens
ucuucaagacgacagcuc

SEQ ID NO: 1266870 - RNA, 17 nt, Homo sapiens
ucuucacaaaacacuuc

SEQ ID NO: 1266871 - RNA, 12 nt, Homo sapiens
ucuucacaggca

SEQ ID NO: 1266872 - RNA, 18 nt, Homo sapiens
ucuucacaggcacuccug

SEQ ID NO: 1266873 - RNA, 20 nt, Homo sapiens
ucuucaccucuauccaaaga

SEQ ID NO: 1266874 - RNA, 15 nt, Homo sapiens
ucuucacucucugaa

SEQ ID NO: 1266875 - RNA, 12 nt, Homo sapiens
ucuucacucuga

SEQ ID NO: 1266876 - RNA, 18 nt, Homo sapiens
ucuucacuucuaaaugca

SEQ ID NO: 1266877 - RNA, 16 nt, Homo sapiens
ucuucaggccucccuc

SEQ ID NO: 1266878 - RNA, 21 nt, Homo sapiens
ucuucauauucuaaaaccauu

SEQ ID NO: 1266879 - RNA, 17 nt, Homo sapiens
ucuucaucaugagacaa

SEQ ID NO: 1266880 - RNA, 13 nt, Homo sapiens
ucuucaugagcuu

SEQ ID NO: 1266881 - RNA, 12 nt, Homo sapiens
ucuucaugcaau

SEQ ID NO: 1266882 - RNA, 13 nt, Homo sapiens
ucuucauuuuggu

SEQ ID NO: 1266883 - RNA, 13 nt, Homo sapiens
ucuuccaaaaaga

SEQ ID NO: 1266884 - RNA, 18 nt, Homo sapiens
ucuuccaacccacuggcc

SEQ ID NO: 1266885 - RNA, 13 nt, Homo sapiens
ucuuccagcccau

SEQ ID NO: 1266886 - RNA, 22 nt, Homo sapiens
ucuuccagcccaucuccgggga

SEQ ID NO: 1266887 - RNA, 13 nt, Homo sapiens
ucuucccaugacu

SEQ ID NO: 1266888 - RNA, 14 nt, Homo sapiens
ucuucccaugcauu

SEQ ID NO: 1266889 - RNA, 14 nt, Homo sapiens
ucuucccuaccuca

SEQ ID NO: 1266890 - RNA, 15 nt, Homo sapiens
ucuucccucucugca

SEQ ID NO: 1266891 - RNA, 23 nt, Homo sapiens
ucuuccguggucagagugccacu

SEQ ID NO: 1266892 - RNA, 19 nt, Homo sapiens
ucuuccuauuuuaaugaau

SEQ ID NO: 1266893 - RNA, 19 nt, Homo sapiens
ucuuccuccucgcugccag

SEQ ID NO: 1266894 - RNA, 23 nt, Homo sapiens
ucuuccuccucgcugccagauga

SEQ ID NO: 1266895 - RNA, 15 nt, Homo sapiens
ucuuccuuagacuua

SEQ ID NO: 1266896 - RNA, 21 nt, Homo sapiens
ucuuccuuggaggggggagcc

SEQ ID NO: 1266897 - RNA, 17 nt, Homo sapiens
ucuucgggagacauguu

SEQ ID NO: 1266898 - RNA, 15 nt, Homo sapiens
ucuucuaaacuuccc

SEQ ID NO: 1266899 - RNA, 13 nt, Homo sapiens
ucuucuaacacaa

SEQ ID NO: 1266900 - RNA, 12 nt, Homo sapiens
ucuucuaugcaa

SEQ ID NO: 1266901 - RNA, 15 nt, Homo sapiens
ucuucucugcacuua

SEQ ID NO: 1266902 - RNA, 20 nt, Homo sapiens
ucuucugaacucaaacugag

SEQ ID NO: 1266903 - RNA, 18 nt, Homo sapiens
ucuucugauuugucccua

SEQ ID NO: 1266904 - RNA, 20 nt, Homo sapiens
ucuucugggaacuuccucag

SEQ ID NO: 1266905 - RNA, 13 nt, Homo sapiens
ucuucuggucugu

SEQ ID NO: 1266906 - RNA, 14 nt, Homo sapiens
ucuucuuacaugca

SEQ ID NO: 1266907 - RNA, 18 nt, Homo sapiens
ucuucuugggcuuugcua

SEQ ID NO: 1266908 - RNA, 13 nt, Homo sapiens
ucuugaaagcugu

SEQ ID NO: 1266909 - RNA, 17 nt, Homo sapiens
ucuugaaaucugaaugc

SEQ ID NO: 1266910 - RNA, 20 nt, Homo sapiens
ucuugaacucauagauuauu

SEQ ID NO: 1266911 - RNA, 16 nt, Homo sapiens
ucuugacauuccacug

SEQ ID NO: 1266912 - RNA, 15 nt, Homo sapiens
ucuugagggaguuca

SEQ ID NO: 1266913 - RNA, 20 nt, Homo sapiens
ucuugauaucucgaacuuuc

SEQ ID NO: 1266914 - RNA, 11 nt, Homo sapiens
ucuugaucucc

SEQ ID NO: 1266915 - RNA, 15 nt, Homo sapiens
ucuugccacauuucu

SEQ ID NO: 1266916 - RNA, 21 nt, Homo sapiens
ucuugcggcugaagugucaca

SEQ ID NO: 1266917 - RNA, 14 nt, Homo sapiens
ucuugcuaccagua

SEQ ID NO: 1266918 - RNA, 13 nt, Homo sapiens
ucuugcuaugaaa

SEQ ID NO: 1266919 - RNA, 21 nt, Homo sapiens
ucuugcucuaaugaucaaaac

SEQ ID NO: 1266920 - RNA, 19 nt, Homo sapiens
ucuugcucugccacccagg

SEQ ID NO: 1266921 - RNA, 17 nt, Homo sapiens
ucuuggaaguacaugaa

SEQ ID NO: 1266922 - RNA, 16 nt, Homo sapiens
ucuuggcaaaagccuu

SEQ ID NO: 1266923 - RNA, 16 nt, Homo sapiens
ucuuggccuaaaccuc

SEQ ID NO: 1266924 - RNA, 17 nt, Homo sapiens
ucuuggccuaaaccuca

SEQ ID NO: 1266925 - RNA, 14 nt, Homo sapiens
ucuuggcuuaucca

SEQ ID NO: 1266926 - RNA, 15 nt, Homo sapiens
ucuuggcuuugccac

SEQ ID NO: 1266927 - RNA, 17 nt, Homo sapiens
ucuugggauaguuccca

SEQ ID NO: 1266928 - RNA, 13 nt, Homo sapiens
ucuuggggccacu

SEQ ID NO: 1266929 - RNA, 15 nt, Homo sapiens
ucuugguacuacuag

SEQ ID NO: 1266930 - RNA, 12 nt, Homo sapiens
ucuugguauuau

SEQ ID NO: 1266931 - RNA, 14 nt, Homo sapiens
ucuuguauacacau

SEQ ID NO: 1266932 - RNA, 20 nt, Homo sapiens
ucuuguauacacauauauac

SEQ ID NO: 1266933 - RNA, 17 nt, Homo sapiens
ucuugucauugccagcu

SEQ ID NO: 1266934 - RNA, 12 nt, Homo sapiens
ucuuguggucau

SEQ ID NO: 1266935 - RNA, 18 nt, Homo sapiens
ucuuguuuuaagugccuu

SEQ ID NO: 1266936 - RNA, 20 nt, Homo sapiens
ucuuuaaaaguauccagaga

SEQ ID NO: 1266937 - RNA, 19 nt, Homo sapiens
ucuuuaacagcuuacacug

SEQ ID NO: 1266938 - RNA, 20 nt, Homo sapiens
ucuuuaagagacucacuggu

SEQ ID NO: 1266939 - RNA, 13 nt, Homo sapiens
ucuuuaaguauug

SEQ ID NO: 1266940 - RNA, 23 nt, Homo sapiens
ucuuuaauaaauugcuuacugau

SEQ ID NO: 1266941 - RNA, 20 nt, Homo sapiens
ucuuuacaaaaaaauacaaa

SEQ ID NO: 1266942 - RNA, 20 nt, Homo sapiens
ucuuuacaaaacuacaugag

SEQ ID NO: 1266943 - RNA, 17 nt, Homo sapiens
ucuuuacaaagaaaaaa

SEQ ID NO: 1266944 - RNA, 20 nt, Homo sapiens
ucuuuauauuuuuagccuaa

SEQ ID NO: 1266945 - RNA, 16 nt, Homo sapiens
ucuuuauuuuuugcca

SEQ ID NO: 1266946 - RNA, 18 nt, Homo sapiens
ucuuucaggacucuaccu

SEQ ID NO: 1266947 - RNA, 18 nt, Homo sapiens
ucuuucauaaaaacacuc

SEQ ID NO: 1266948 - RNA, 20 nt, Homo sapiens
ucuuucccuuuaucaguuug

SEQ ID NO: 1266949 - RNA, 17 nt, Homo sapiens
ucuuuccugauauauca

SEQ ID NO: 1266950 - RNA, 18 nt, Homo sapiens
ucuuucuaaaauauuuca

SEQ ID NO: 1266951 - RNA, 17 nt, Homo sapiens
ucuuucuuuaccugaga

SEQ ID NO: 1266952 - RNA, 17 nt, Homo sapiens
ucuuugaagagauuuca

SEQ ID NO: 1266953 - RNA, 23 nt, Homo sapiens
ucuuugaagcgagcagucagcau

SEQ ID NO: 1266954 - RNA, 20 nt, Homo sapiens
ucuuugaagcugaaaauaua

SEQ ID NO: 1266955 - RNA, 18 nt, Homo sapiens
ucuuugaucuggacagaa

SEQ ID NO: 1266956 - RNA, 15 nt, Homo sapiens
ucuuugcaccaaaga

SEQ ID NO: 1266957 - RNA, 17 nt, Homo sapiens
ucuuugcaccaaagaca

SEQ ID NO: 1266958 - RNA, 20 nt, Homo sapiens
ucuuugcagacaggcaagca

SEQ ID NO: 1266959 - RNA, 21 nt, Homo sapiens
ucuuugccggaggaaaagcag

SEQ ID NO: 1266960 - RNA, 22 nt, Homo sapiens
ucuuugcucauggcaacaguua

SEQ ID NO: 1266961 - RNA, 15 nt, Homo sapiens
ucuuugcugcaguca

SEQ ID NO: 1266962 - RNA, 16 nt, Homo sapiens
ucuuuggacaaccaug

SEQ ID NO: 1266963 - RNA, 17 nt, Homo sapiens
ucuuuggaggcuuuuaa

SEQ ID NO: 1266964 - RNA, 19 nt, Homo sapiens
ucuuugucagcaguucccu

SEQ ID NO: 1266965 - RNA, 21 nt, Homo sapiens
ucuuuguggggaagaggggcu

SEQ ID NO: 1266966 - RNA, 14 nt, Homo sapiens
ucuuuuaacagccu

SEQ ID NO: 1266967 - RNA, 16 nt, Homo sapiens
ucuuuuaagcuaucca

SEQ ID NO: 1266968 - RNA, 23 nt, Homo sapiens
ucuuuuaggaggcacaacaguuc

SEQ ID NO: 1266969 - RNA, 14 nt, Homo sapiens
ucuuuucauucuca

SEQ ID NO: 1266970 - RNA, 19 nt, Homo sapiens
ucuuuuccugaccaaucuu

SEQ ID NO: 1266971 - RNA, 23 nt, Homo sapiens
ucuuuucugcaucaucuguagau

SEQ ID NO: 1266972 - RNA, 19 nt, Homo sapiens
ucuuuugagcuaaucuuca

SEQ ID NO: 1266973 - RNA, 12 nt, Homo sapiens
ucuuuugcagcu

SEQ ID NO: 1266974 - RNA, 13 nt, Homo sapiens
ucuuuugccauua

SEQ ID NO: 1266975 - RNA, 23 nt, Homo sapiens
ucuuuuggcaguucugauaagcu

SEQ ID NO: 1266976 - RNA, 14 nt, Homo sapiens
ucuuuuuaucauga

SEQ ID NO: 1266977 - RNA, 18 nt, Homo sapiens
ucuuuuuucccaagagca

SEQ ID NO: 1266978 - RNA, 19 nt, Homo sapiens
ugaaaaaaaguacauguau

SEQ ID NO: 1266979 - RNA, 18 nt, Homo sapiens
ugaaaaaacaccuagcuu

SEQ ID NO: 1266980 - RNA, 12 nt, Homo sapiens
ugaaaaaagcca

SEQ ID NO: 1266981 - RNA, 19 nt, Homo sapiens
ugaggacgcaccgccgcca

SEQ ID NO: 1266982 - RNA, 16 nt, Homo sapiens
ugaggagcugcacuga

SEQ ID NO: 1266983 - RNA, 19 nt, Homo sapiens
ugaggaggagacagccuca

SEQ ID NO: 1266984 - RNA, 16 nt, Homo sapiens
ugaggaggaugucccu

SEQ ID NO: 1266985 - RNA, 19 nt, Homo sapiens
ugaggaggucccacuugca

SEQ ID NO: 1266986 - RNA, 18 nt, Homo sapiens
ugaggagugccagcucaa

SEQ ID NO: 1266987 - RNA, 19 nt, Homo sapiens
ugaggcaaauuaacuguau

SEQ ID NO: 1266988 - RNA, 20 nt, Homo sapiens
ugaggcaaauuaacuguaug

SEQ ID NO: 1266989 - RNA, 17 nt, Homo sapiens
ugaggcaagagaauuac

SEQ ID NO: 1266990 - RNA, 16 nt, Homo sapiens
ugaggcauuuccagac

SEQ ID NO: 1266991 - RNA, 19 nt, Homo sapiens
ugaggcauuuccagacuug

SEQ ID NO: 1266992 - RNA, 16 nt, Homo sapiens
ugaggccaucucagga

SEQ ID NO: 1266993 - RNA, 14 nt, Homo sapiens
ugaggcuccacuug

SEQ ID NO: 1266994 - RNA, 13 nt, Homo sapiens
ugaggcuccgccc

SEQ ID NO: 1266995 - RNA, 14 nt, Homo sapiens
ugaggcugcagcga

SEQ ID NO: 1266996 - RNA, 23 nt, Homo sapiens
ugaggcugucgugagcuaugauu

SEQ ID NO: 1266997 - RNA, 14 nt, Homo sapiens
ugaggcuucucagc

SEQ ID NO: 1266998 - RNA, 15 nt, Homo sapiens
ugagggaaaaugagu

SEQ ID NO: 1266999 - RNA, 16 nt, Homo sapiens
ugagggcccagagcag

SEQ ID NO: 1267000 - RNA, 16 nt, Homo sapiens
ugaggggcuccuggaa

SEQ ID NO: 1267001 - RNA, 22 nt, Homo sapiens
ugaggggcuccuggaaaggcuc

SEQ ID NO: 1267002 - RNA, 14 nt, Homo sapiens
ugaggggucucgga

SEQ ID NO: 1267003 - RNA, 20 nt, Homo sapiens
ugaggguaucugacaaugcu

SEQ ID NO: 1267004 - RNA, 21 nt, Homo sapiens
ugaggguccucaguccacugc

SEQ ID NO: 1267005 - RNA, 21 nt, Homo sapiens
ugagguaccaguuguauuuaa

SEQ ID NO: 1267006 - RNA, 12 nt, Homo sapiens
ugaggucaggga

SEQ ID NO: 1267007 - RNA, 14 nt, Homo sapiens
ugaggucccugugu

SEQ ID NO: 1267008 - RNA, 18 nt, Homo sapiens
ugagguuugcuuguuacc

SEQ ID NO: 1267009 - RNA, 17 nt, Homo sapiens
ugaguaauacaucaaag

SEQ ID NO: 1267010 - RNA, 19 nt, Homo sapiens
ugaguaaugguguagaaca

SEQ ID NO: 1267011 - RNA, 19 nt, Homo sapiens
ugaguaucuguauguauau

SEQ ID NO: 1267012 - RNA, 15 nt, Homo sapiens
ugagucaaagacuua

SEQ ID NO: 1267013 - RNA, 20 nt, Homo sapiens
ugagucaccaagcccaguua

SEQ ID NO: 1267014 - RNA, 22 nt, Homo sapiens
ugaguccaagaggguccuuuag

SEQ ID NO: 1267015 - RNA, 15 nt, Homo sapiens
ugaguccccuacucc

SEQ ID NO: 1267016 - RNA, 16 nt, Homo sapiens
ugaguggcagccaugc

SEQ ID NO: 1267017 - RNA, 22 nt, Homo sapiens
ugagugggagaaggcagugauu

SEQ ID NO: 1267018 - RNA, 14 nt, Homo sapiens
ugaguggucuucaa

SEQ ID NO: 1267019 - RNA, 13 nt, Homo sapiens
ugaguggugccaa

SEQ ID NO: 1267020 - RNA, 15 nt, Homo sapiens
ugaguggugccaaac

SEQ ID NO: 1267021 - RNA, 21 nt, Homo sapiens
ugaguuaacucacugagggua

SEQ ID NO: 1267022 - RNA, 17 nt, Homo sapiens
ugaguuaauuuuaccaa

SEQ ID NO: 1267023 - RNA, 16 nt, Homo sapiens
ugaguuacagccuguu

SEQ ID NO: 1267024 - RNA, 13 nt, Homo sapiens
ugaguuacccugg

SEQ ID NO: 1267025 - RNA, 19 nt, Homo sapiens
ugaguuaugaguuauucau

SEQ ID NO: 1267026 - RNA, 17 nt, Homo sapiens
ugaguucuauaauauaa

SEQ ID NO: 1267027 - RNA, 14 nt, Homo sapiens
ugaguugugaugaa

SEQ ID NO: 1267028 - RNA, 16 nt, Homo sapiens
ugaguuuauauucuga

SEQ ID NO: 1267029 - RNA, 20 nt, Homo sapiens
ugaguuuuugauagcuuuau

SEQ ID NO: 1267030 - RNA, 15 nt, Homo sapiens
ugauaaagcacagcu

SEQ ID NO: 1267031 - RNA, 16 nt, Homo sapiens
ugauaauaauugauca

SEQ ID NO: 1267032 - RNA, 16 nt, Homo sapiens
ugauaaugcagacuuc

SEQ ID NO: 1267033 - RNA, 15 nt, Homo sapiens
ugauacauaacuaaa

SEQ ID NO: 1267034 - RNA, 22 nt, Homo sapiens
ugauaccaccuuuacugugcuu

SEQ ID NO: 1267035 - RNA, 12 nt, Homo sapiens
ugauaccacugc

SEQ ID NO: 1267036 - RNA, 14 nt, Homo sapiens
ugauaccauggcac

SEQ ID NO: 1267037 - RNA, 19 nt, Homo sapiens
ugauaccauggcacugaca

SEQ ID NO: 1267038 - RNA, 18 nt, Homo sapiens
ugauacuuguuccagaug

SEQ ID NO: 1267039 - RNA, 12 nt, Homo sapiens
ugauacuuugac

SEQ ID NO: 1267040 - RNA, 14 nt, Homo sapiens
ugauagcccagaac

SEQ ID NO: 1267041 - RNA, 19 nt, Homo sapiens
ugauagcguggaggcugca

SEQ ID NO: 1267042 - RNA, 13 nt, Homo sapiens
ugauauaaauucu

SEQ ID NO: 1267043 - RNA, 19 nt, Homo sapiens
ugauauaucaugagugaau

SEQ ID NO: 1267044 - RNA, 14 nt, Homo sapiens
ugauauauugcugu

SEQ ID NO: 1267045 - RNA, 18 nt, Homo sapiens
ugauaucccccagccuca

SEQ ID NO: 1267046 - RNA, 14 nt, Homo sapiens
ugauaucugaucaa

SEQ ID NO: 1267047 - RNA, 17 nt, Homo sapiens
ugauaucuggccuaaaa

SEQ ID NO: 1267048 - RNA, 15 nt, Homo sapiens
ugauauguccucaga

SEQ ID NO: 1267049 - RNA, 15 nt, Homo sapiens
ugauauuuuccaaau

SEQ ID NO: 1267050 - RNA, 12 nt, Homo sapiens
ugaucaacuguu

SEQ ID NO: 1267051 - RNA, 17 nt, Homo sapiens
ugaucaagaacauguca

SEQ ID NO: 1267052 - RNA, 11 nt, Homo sapiens
ugaucaaguca

SEQ ID NO: 1267053 - RNA, 12 nt, Homo sapiens
ugaucaauccuu

SEQ ID NO: 1267054 - RNA, 17 nt, Homo sapiens
ugaucaauccuucuuau

SEQ ID NO: 1267055 - RNA, 18 nt, Homo sapiens
ugaucacggcucacugca

SEQ ID NO: 1267056 - RNA, 19 nt, Homo sapiens
ugaucacggcucacugcag

SEQ ID NO: 1267057 - RNA, 16 nt, Homo sapiens
ugaucagcaucuguga

SEQ ID NO: 1267058 - RNA, 23 nt, Homo sapiens
ugaucauuuuccccccacucucc

SEQ ID NO: 1267059 - RNA, 15 nt, Homo sapiens
ugaucccaauccuua

SEQ ID NO: 1267060 - RNA, 23 nt, Homo sapiens
ugauccucuacugugcaucuccu

SEQ ID NO: 1267061 - RNA, 21 nt, Homo sapiens
ugaucgcgccacuacacucca

SEQ ID NO: 1267062 - RNA, 21 nt, Homo sapiens
ugaucuagugcaguaaaggga

SEQ ID NO: 1267063 - RNA, 15 nt, Homo sapiens
ugaucuauacaaauu

SEQ ID NO: 1267064 - RNA, 20 nt, Homo sapiens
ugaucucccaagcuaucuaa

SEQ ID NO: 1267065 - RNA, 19 nt, Homo sapiens
ugaucucggaugaccaaac

SEQ ID NO: 1267066 - RNA, 23 nt, Homo sapiens
ugaucucuucuuuuggcuuccau

SEQ ID NO: 1267067 - RNA, 16 nt, Homo sapiens
ugaucuggacagaaca

SEQ ID NO: 1267068 - RNA, 12 nt, Homo sapiens
ugaucuguguuu

SEQ ID NO: 1267069 - RNA, 19 nt, Homo sapiens
ugaucuuucucaaucuuga

SEQ ID NO: 1267070 - RNA, 14 nt, Homo sapiens
ugaucuuugcagac

SEQ ID NO: 1267071 - RNA, 12 nt, Homo sapiens
ugaugaaugaga

SEQ ID NO: 1267072 - RNA, 13 nt, Homo sapiens
ugaugacauuccc

SEQ ID NO: 1267073 - RNA, 14 nt, Homo sapiens
ugaugacuuacuau

SEQ ID NO: 1267074 - RNA, 16 nt, Homo sapiens
ugaugagauucacuua

SEQ ID NO: 1267075 - RNA, 14 nt, Homo sapiens
ugaugagcacgguu

SEQ ID NO: 1267076 - RNA, 16 nt, Homo sapiens
ugaugauaacacuuaa

SEQ ID NO: 1267077 - RNA, 13 nt, Homo sapiens
ugaugauuuugca

SEQ ID NO: 1267078 - RNA, 13 nt, Homo sapiens
ugaugccaagaaa

SEQ ID NO: 1267079 - RNA, 14 nt, Homo sapiens
ugaugccauggcag

SEQ ID NO: 1267080 - RNA, 17 nt, Homo sapiens
ugaugccuguguacugc

SEQ ID NO: 1267081 - RNA, 19 nt, Homo sapiens
ugaugccuguguacugccu

SEQ ID NO: 1267082 - RNA, 16 nt, Homo sapiens
ugaugcuauuuaugca

SEQ ID NO: 1267083 - RNA, 17 nt, Homo sapiens
ugaugcuauuuaugcaa

SEQ ID NO: 1267084 - RNA, 15 nt, Homo sapiens
ugaugcugggacccu

SEQ ID NO: 1267085 - RNA, 19 nt, Homo sapiens
ugaugcuuagauguuccag

SEQ ID NO: 1267086 - RNA, 21 nt, Homo sapiens
ugauggaaaauaaacaucagu

SEQ ID NO: 1267087 - RNA, 18 nt, Homo sapiens
ugauggagaggacagagc

SEQ ID NO: 1267088 - RNA, 21 nt, Homo sapiens
ugauggagauauuuacaugaa

SEQ ID NO: 1267089 - RNA, 13 nt, Homo sapiens
ugauggaugucuu

SEQ ID NO: 1267090 - RNA, 22 nt, Homo sapiens
ugauggcccuaaguuaagcaaa

SEQ ID NO: 1267091 - RNA, 17 nt, Homo sapiens
ugauggcuugacaugug

SEQ ID NO: 1267092 - RNA, 21 nt, Homo sapiens
ugauggucucaagcuaugauc

SEQ ID NO: 1267093 - RNA, 19 nt, Homo sapiens
ugauggugacauugcaccu

SEQ ID NO: 1267094 - RNA, 17 nt, Homo sapiens
ugaugguggacuaagca

SEQ ID NO: 1267095 - RNA, 14 nt, Homo sapiens
ugaugguugcaaaa

SEQ ID NO: 1267096 - RNA, 19 nt, Homo sapiens
ugauguacagucugucaug

SEQ ID NO: 1267097 - RNA, 21 nt, Homo sapiens
ugauguauuucaagucucuca

SEQ ID NO: 1267098 - RNA, 20 nt, Homo sapiens
ugaugucagaauagcuucca

SEQ ID NO: 1267099 - RNA, 15 nt, Homo sapiens
ugaugucagauuugg

SEQ ID NO: 1267100 - RNA, 13 nt, Homo sapiens
ugauguccccaaa

SEQ ID NO: 1267101 - RNA, 20 nt, Homo sapiens
ugaugugaaacacuuugccu

SEQ ID NO: 1267102 - RNA, 18 nt, Homo sapiens
ugauguguccucagggag

SEQ ID NO: 1267103 - RNA, 17 nt, Homo sapiens
ugaugugugagcuaugc

SEQ ID NO: 1267104 - RNA, 19 nt, Homo sapiens
ugaugugugagcuaugcaa

SEQ ID NO: 1267105 - RNA, 13 nt, Homo sapiens
ugauguuacuagc

SEQ ID NO: 1267106 - RNA, 17 nt, Homo sapiens
ugauguuucacauaaaa

SEQ ID NO: 1267107 - RNA, 12 nt, Homo sapiens
ugauguuucaua

SEQ ID NO: 1267108 - RNA, 14 nt, Homo sapiens
ugcugaugaucaaa

SEQ ID NO: 1267109 - RNA, 16 nt, Homo sapiens
ugcugauggcuugaca

SEQ ID NO: 1267110 - RNA, 14 nt, Homo sapiens
ugcugaugggccag

SEQ ID NO: 1267111 - RNA, 23 nt, Homo sapiens
ugcugaugggccagcaggagcca

SEQ ID NO: 1267112 - RNA, 23 nt, Homo sapiens
ugcugcacagaaauuuucaauuu

SEQ ID NO: 1267113 - RNA, 20 nt, Homo sapiens
ugcugcagguggcagaguga

SEQ ID NO: 1267114 - RNA, 14 nt, Homo sapiens
ugcugcgcaccaau

SEQ ID NO: 1267115 - RNA, 16 nt, Homo sapiens
ugcugcuccagugcag

SEQ ID NO: 1267116 - RNA, 19 nt, Homo sapiens
ugcugcugagugcaccacu

SEQ ID NO: 1267117 - RNA, 23 nt, Homo sapiens
ugcugcugagugcaccacuucaa

SEQ ID NO: 1267118 - RNA, 17 nt, Homo sapiens
ugcugcuggaaguagaa

SEQ ID NO: 1267119 - RNA, 12 nt, Homo sapiens
ugcugcuguaaa

SEQ ID NO: 1267120 - RNA, 19 nt, Homo sapiens
ugcugcuuuugagccucag

SEQ ID NO: 1267121 - RNA, 13 nt, Homo sapiens
ugcuggaaaaagc

SEQ ID NO: 1267122 - RNA, 16 nt, Homo sapiens
ugcuggaaaugcugac

SEQ ID NO: 1267123 - RNA, 22 nt, Homo sapiens
ugcuggaaguagaauuugucca

SEQ ID NO: 1267124 - RNA, 19 nt, Homo sapiens
ugcuggaauuacaggcgug

SEQ ID NO: 1267125 - RNA, 20 nt, Homo sapiens
ugcuggacgccgagaaggcc

SEQ ID NO: 1267126 - RNA, 21 nt, Homo sapiens
ugcuggacgccgagaaggccu

SEQ ID NO: 1267127 - RNA, 13 nt, Homo sapiens
ugcuggacucugg

SEQ ID NO: 1267128 - RNA, 14 nt, Homo sapiens
ugcuggcaguacug

SEQ ID NO: 1267129 - RNA, 15 nt, Homo sapiens
ugcuggcauuugcac

SEQ ID NO: 1267130 - RNA, 19 nt, Homo sapiens
ugcuggcccauaaacaccc

SEQ ID NO: 1267131 - RNA, 14 nt, Homo sapiens
ugcuggcucugaga

SEQ ID NO: 1267132 - RNA, 19 nt, Homo sapiens
ugcuggcucugagaaucac

SEQ ID NO: 1267133 - RNA, 15 nt, Homo sapiens
ugcugggaccagagc

SEQ ID NO: 1267134 - RNA, 20 nt, Homo sapiens
ugcuggggcccuaccagcag

SEQ ID NO: 1267135 - RNA, 16 nt, Homo sapiens
ugcuggggccucagac

SEQ ID NO: 1267136 - RNA, 14 nt, Homo sapiens
ugcugguagcacuu

SEQ ID NO: 1267137 - RNA, 23 nt, Homo sapiens
ugcugguccccuccucagugaca

SEQ ID NO: 1267138 - RNA, 20 nt, Homo sapiens
ugcuggugaauaacuaugcc

SEQ ID NO: 1267139 - RNA, 13 nt, Homo sapiens
ugcuguacccaga

SEQ ID NO: 1267140 - RNA, 14 nt, Homo sapiens
ugcugucaaaacaa

SEQ ID NO: 1267141 - RNA, 13 nt, Homo sapiens
ugcugucacuguu

SEQ ID NO: 1267142 - RNA, 17 nt, Homo sapiens
ugcuguccaugcuucuc

SEQ ID NO: 1267143 - RNA, 15 nt, Homo sapiens
ugcuguccugaucug

SEQ ID NO: 1267144 - RNA, 16 nt, Homo sapiens
ugcuguccugcccugg

SEQ ID NO: 1267145 - RNA, 13 nt, Homo sapiens
ugcugucuuccaa

SEQ ID NO: 1267146 - RNA, 11 nt, Homo sapiens
ugcugugacaa

SEQ ID NO: 1267147 - RNA, 14 nt, Homo sapiens
ugcugugauuccac

SEQ ID NO: 1267148 - RNA, 16 nt, Homo sapiens
ugcuguuaacuguuaa

SEQ ID NO: 1267149 - RNA, 14 nt, Homo sapiens
ugcuguucagugcc

SEQ ID NO: 1267150 - RNA, 20 nt, Homo sapiens
ugcuuaacuccccacugccu

SEQ ID NO: 1267151 - RNA, 19 nt, Homo sapiens
ugcuuaggaugugugcaug

SEQ ID NO: 1267152 - RNA, 16 nt, Homo sapiens
ugcuuaugguugauca

SEQ ID NO: 1267153 - RNA, 22 nt, Homo sapiens
ugcuucaaauaaaguccugaca

SEQ ID NO: 1267154 - RNA, 15 nt, Homo sapiens
ugcuucagaguuugu

SEQ ID NO: 1267155 - RNA, 20 nt, Homo sapiens
ugcuucagaguuugugugua

SEQ ID NO: 1267156 - RNA, 23 nt, Homo sapiens
ugcuucagaguuuguguguauuu

SEQ ID NO: 1267157 - RNA, 12 nt, Homo sapiens
ugcuucagccug

SEQ ID NO: 1267158 - RNA, 16 nt, Homo sapiens
ugcuucaguacuugug

SEQ ID NO: 1267159 - RNA, 17 nt, Homo sapiens
ugcuucaguacuuguga

SEQ ID NO: 1267160 - RNA, 16 nt, Homo sapiens
ugcuucaguugcauau

SEQ ID NO: 1267161 - RNA, 18 nt, Homo sapiens
ugcuucaugugaacaucc

SEQ ID NO: 1267162 - RNA, 17 nt, Homo sapiens
ugcuuccuggucuggca

SEQ ID NO: 1267163 - RNA, 13 nt, Homo sapiens
ugcuucuccauga

SEQ ID NO: 1267164 - RNA, 14 nt, Homo sapiens
ugcuucuccuccca

SEQ ID NO: 1267165 - RNA, 18 nt, Homo sapiens
ugcuucucuagcucucua

SEQ ID NO: 1267166 - RNA, 13 nt, Homo sapiens
ugcuucugcacac

SEQ ID NO: 1267167 - RNA, 18 nt, Homo sapiens
ugcuucugcacacaaaac

SEQ ID NO: 1267168 - RNA, 17 nt, Homo sapiens
ugcuucuuaauucaguu

SEQ ID NO: 1267169 - RNA, 19 nt, Homo sapiens
ugcuugaucauuauaucau

SEQ ID NO: 1267170 - RNA, 13 nt, Homo sapiens
ugcuugauuccag

SEQ ID NO: 1267171 - RNA, 12 nt, Homo sapiens
ugcuuggaugua

SEQ ID NO: 1267172 - RNA, 12 nt, Homo sapiens
ugcuugugccac

SEQ ID NO: 1267173 - RNA, 18 nt, Homo sapiens
ugcuuguuuacagcacua

SEQ ID NO: 1267174 - RNA, 21 nt, Homo sapiens
ugcuuuagucacuaauugcuu

SEQ ID NO: 1267175 - RNA, 14 nt, Homo sapiens
ugcuuucagcacuc

SEQ ID NO: 1267176 - RNA, 15 nt, Homo sapiens
ugcuuucuguuccaa

SEQ ID NO: 1267177 - RNA, 21 nt, Homo sapiens
ugcuuugaaacuugccugggg

SEQ ID NO: 1267178 - RNA, 13 nt, Homo sapiens
ugcuuugcaggaa

SEQ ID NO: 1267179 - RNA, 17 nt, Homo sapiens
ugcuuuguaugcacuuu

SEQ ID NO: 1267180 - RNA, 22 nt, Homo sapiens
ugcuuuguuuuaauaaacagua

SEQ ID NO: 1267181 - RNA, 14 nt, Homo sapiens
ugcuuuuaaaugca

SEQ ID NO: 1267182 - RNA, 19 nt, Homo sapiens
ugcuuuucugccacuccau

SEQ ID NO: 1267183 - RNA, 21 nt, Homo sapiens
ugcuuuucugcggcuguguag

SEQ ID NO: 1267184 - RNA, 18 nt, Homo sapiens
ugcuuuuguuccaauguc

SEQ ID NO: 1267185 - RNA, 18 nt, Homo sapiens
ugcuuuuuggaaagucag

SEQ ID NO: 1267186 - RNA, 16 nt, Homo sapiens
uggaaaaagucacauu

SEQ ID NO: 1267187 - RNA, 15 nt, Homo sapiens
uggaaacagcaugaa

SEQ ID NO: 1267188 - RNA, 17 nt, Homo sapiens
uggaaacagcaugaaua

SEQ ID NO: 1267189 - RNA, 22 nt, Homo sapiens
uggaaaccaaggaaagugaaac

SEQ ID NO: 1267190 - RNA, 17 nt, Homo sapiens
uggaaagacauagccaa

SEQ ID NO: 1267191 - RNA, 14 nt, Homo sapiens
uggaaagcugcuuc

SEQ ID NO: 1267192 - RNA, 16 nt, Homo sapiens
uggaaaguaacuguga

SEQ ID NO: 1267193 - RNA, 15 nt, Homo sapiens
uggaaagugauguca

SEQ ID NO: 1267194 - RNA, 14 nt, Homo sapiens
uggaaauaaaguca

SEQ ID NO: 1267195 - RNA, 18 nt, Homo sapiens
uggaaaucugaacauucu

SEQ ID NO: 1267196 - RNA, 20 nt, Homo sapiens
uggaaaugucaucuaaccau

SEQ ID NO: 1267197 - RNA, 19 nt, Homo sapiens
uggaaauuacccacuguca

SEQ ID NO: 1267198 - RNA, 14 nt, Homo sapiens
uggaacaagcacag

SEQ ID NO: 1267199 - RNA, 18 nt, Homo sapiens
uggaacagaagacagcug

SEQ ID NO: 1267200 - RNA, 21 nt, Homo sapiens
uggaacagcgggagaccugug

SEQ ID NO: 1267201 - RNA, 13 nt, Homo sapiens
uggaacagugucu

SEQ ID NO: 1267202 - RNA, 16 nt, Homo sapiens
uggaacauuugauauu

SEQ ID NO: 1267203 - RNA, 14 nt, Homo sapiens
uggaaccuugcugu

SEQ ID NO: 1267204 - RNA, 15 nt, Homo sapiens
uggaacuaaagcaaa

SEQ ID NO: 1267205 - RNA, 14 nt, Homo sapiens
uggaacuacuguac

SEQ ID NO: 1267206 - RNA, 12 nt, Homo sapiens
uggaacuggagu

SEQ ID NO: 1267207 - RNA, 15 nt, Homo sapiens
uggaacuguugaaag

SEQ ID NO: 1267208 - RNA, 15 nt, Homo sapiens
uggaacuucuaauau

SEQ ID NO: 1267209 - RNA, 20 nt, Homo sapiens
uggaagaaagcaacaaagau

SEQ ID NO: 1267210 - RNA, 20 nt, Homo sapiens
uggaagagaguuccgggaaa

SEQ ID NO: 1267211 - RNA, 14 nt, Homo sapiens
uggaagaguaguaa

SEQ ID NO: 1267212 - RNA, 15 nt, Homo sapiens
uggaagauggcauaa

SEQ ID NO: 1267213 - RNA, 15 nt, Homo sapiens
uggaagggguccagc

SEQ ID NO: 1267214 - RNA, 20 nt, Homo sapiens
uggaagucaucucauuccac

SEQ ID NO: 1267215 - RNA, 19 nt, Homo sapiens
uggaaguguucaagaaaua

SEQ ID NO: 1267216 - RNA, 20 nt, Homo sapiens
uggaaguuauuaacuuuaau

SEQ ID NO: 1267217 - RNA, 17 nt, Homo sapiens
uggaaguucauaccuaa

SEQ ID NO: 1267218 - RNA, 18 nt, Homo sapiens
uggaaguucauaccuaag

SEQ ID NO: 1267219 - RNA, 20 nt, Homo sapiens
uggaaguuucuggugccauu

SEQ ID NO: 1267220 - RNA, 13 nt, Homo sapiens
uggaauaaaguca

SEQ ID NO: 1267221 - RNA, 14 nt, Homo sapiens
uggaauaacaugua

SEQ ID NO: 1267222 - RNA, 14 nt, Homo sapiens
uggaauaggaauaa

SEQ ID NO: 1267223 - RNA, 20 nt, Homo sapiens
uggaauauuaaaaaacuuca

SEQ ID NO: 1267224 - RNA, 15 nt, Homo sapiens
uggaaucuagccgau

SEQ ID NO: 1267225 - RNA, 19 nt, Homo sapiens
uggaaucuuuguaccaaaa

SEQ ID NO: 1267226 - RNA, 22 nt, Homo sapiens
uggaauggcaggugucauauga

SEQ ID NO: 1267227 - RNA, 17 nt, Homo sapiens
uggacaaaugaugccau

SEQ ID NO: 1267228 - RNA, 22 nt, Homo sapiens
uggacaagggcaggucuucaua

SEQ ID NO: 1267229 - RNA, 22 nt, Homo sapiens
uggacaaucaugaaauaugcau

SEQ ID NO: 1267230 - RNA, 11 nt, Homo sapiens
uggacacagau

SEQ ID NO: 1267231 - RNA, 19 nt, Homo sapiens
uggacaccccugcuauaua

SEQ ID NO: 1267232 - RNA, 22 nt, Homo sapiens
uggacacgguaacuguugcagu

SEQ ID NO: 1267233 - RNA, 23 nt, Homo sapiens
uggacagacccaggucuuccaga

SEQ ID NO: 1267234 - RNA, 16 nt, Homo sapiens
uggacagcuuugcucc

SEQ ID NO: 1267235 - RNA, 17 nt, Homo sapiens
uggggaaaaaacugugc

SEQ ID NO: 1267236 - RNA, 20 nt, Homo sapiens
uggggaaacagaugccucag

SEQ ID NO: 1267237 - RNA, 22 nt, Homo sapiens
uggggaccucugggcagcuccu

SEQ ID NO: 1267238 - RNA, 13 nt, Homo sapiens
uggggacggugua

SEQ ID NO: 1267239 - RNA, 15 nt, Homo sapiens
uggggagauggaguu

SEQ ID NO: 1267240 - RNA, 16 nt, Homo sapiens
uggggagcacuugucc

SEQ ID NO: 1267241 - RNA, 13 nt, Homo sapiens
uggggaggacaaa

SEQ ID NO: 1267242 - RNA, 22 nt, Homo sapiens
uggggaggacaaaacuucuugu

SEQ ID NO: 1267243 - RNA, 16 nt, Homo sapiens
uggggaggagggggcc

SEQ ID NO: 1267244 - RNA, 20 nt, Homo sapiens
uggggauagaggaaagggau

SEQ ID NO: 1267245 - RNA, 15 nt, Homo sapiens
uggggaucagacaga

SEQ ID NO: 1267246 - RNA, 17 nt, Homo sapiens
uggggaugguccacugu

SEQ ID NO: 1267247 - RNA, 17 nt, Homo sapiens
uggggcaggcugcuuca

SEQ ID NO: 1267248 - RNA, 19 nt, Homo sapiens
uggggcaggcugggccaug

SEQ ID NO: 1267249 - RNA, 12 nt, Homo sapiens
uggggccaccaa

SEQ ID NO: 1267250 - RNA, 22 nt, Homo sapiens
uggggccaccaaagcugcccac

SEQ ID NO: 1267251 - RNA, 11 nt, Homo sapiens
uggggccugug

SEQ ID NO: 1267252 - RNA, 20 nt, Homo sapiens
uggggcggguggggccauaa

SEQ ID NO: 1267253 - RNA, 19 nt, Homo sapiens
uggggcuccucacauagcu

SEQ ID NO: 1267254 - RNA, 15 nt, Homo sapiens
uggggcuggccugca

SEQ ID NO: 1267255 - RNA, 15 nt, Homo sapiens
ugggggaacugugaa

SEQ ID NO: 1267256 - RNA, 18 nt, Homo sapiens
ugggggacgugggcauuu

SEQ ID NO: 1267257 - RNA, 13 nt, Homo sapiens
ugggggucagggg

SEQ ID NO: 1267258 - RNA, 21 nt, Homo sapiens
ugggguacccacugcucuggu

SEQ ID NO: 1267259 - RNA, 12 nt, Homo sapiens
uggggucacuca

SEQ ID NO: 1267260 - RNA, 18 nt, Homo sapiens
ugggguuugaagcugacu

SEQ ID NO: 1267261 - RNA, 21 nt, Homo sapiens
uggguacugaaagccuuaggg

SEQ ID NO: 1267262 - RNA, 15 nt, Homo sapiens
uggguccaugcuaac

SEQ ID NO: 1267263 - RNA, 16 nt, Homo sapiens
ugggucccauucuugg

SEQ ID NO: 1267264 - RNA, 20 nt, Homo sapiens
uggguccuaauuaccagucu

SEQ ID NO: 1267265 - RNA, 22 nt, Homo sapiens
uggguccuaauuaccagucuuu

SEQ ID NO: 1267266 - RNA, 19 nt, Homo sapiens
ugggucuaccacucagaga

SEQ ID NO: 1267267 - RNA, 17 nt, Homo sapiens
ugggucuaggacacagu

SEQ ID NO: 1267268 - RNA, 14 nt, Homo sapiens
ugggucuauguucc

SEQ ID NO: 1267269 - RNA, 17 nt, Homo sapiens
ugggucuucacucugac

SEQ ID NO: 1267270 - RNA, 15 nt, Homo sapiens
ugggucuucccugua

SEQ ID NO: 1267271 - RNA, 14 nt, Homo sapiens
ugggugcucagaau

SEQ ID NO: 1267272 - RNA, 16 nt, Homo sapiens
uggguggaaaggugug

SEQ ID NO: 1267273 - RNA, 16 nt, Homo sapiens
ugggugggacagccuc

SEQ ID NO: 1267274 - RNA, 22 nt, Homo sapiens
ugggugugcccacgaagacaac

SEQ ID NO: 1267275 - RNA, 20 nt, Homo sapiens
uggguuauguguaugugcca

SEQ ID NO: 1267276 - RNA, 22 nt, Homo sapiens
uggguugaacuauaacuguugg

SEQ ID NO: 1267277 - RNA, 23 nt, Homo sapiens
uggguuucccuugcccuuuccau

SEQ ID NO: 1267278 - RNA, 17 nt, Homo sapiens
uggguuuugugccuuug

SEQ ID NO: 1267279 - RNA, 21 nt, Homo sapiens
ugguaaaaugcaucaaaagac

SEQ ID NO: 1267280 - RNA, 23 nt, Homo sapiens
ugguaaacaguuuggaaaagugg

SEQ ID NO: 1267281 - RNA, 19 nt, Homo sapiens
ugguaaaccaagccuccca

SEQ ID NO: 1267282 - RNA, 22 nt, Homo sapiens
ugguaaaccagaucugucucca

SEQ ID NO: 1267283 - RNA, 22 nt, Homo sapiens
ugguaaagauggcauuucacca

SEQ ID NO: 1267284 - RNA, 14 nt, Homo sapiens
ugguaaaugaucac

SEQ ID NO: 1267285 - RNA, 19 nt, Homo sapiens
ugguaacugcuuucuguuc

SEQ ID NO: 1267286 - RNA, 22 nt, Homo sapiens
ugguaacugcuuucuguuccaa

SEQ ID NO: 1267287 - RNA, 21 nt, Homo sapiens
ugguaauauaguuauugcaca

SEQ ID NO: 1267288 - RNA, 20 nt, Homo sapiens
ugguaaucauaugugucuuu

SEQ ID NO: 1267289 - RNA, 18 nt, Homo sapiens
ugguacuuuauucuugcu

SEQ ID NO: 1267290 - RNA, 18 nt, Homo sapiens
ugguacuuuuaugaugua

SEQ ID NO: 1267291 - RNA, 13 nt, Homo sapiens
ugguagagauuca

SEQ ID NO: 1267292 - RNA, 22 nt, Homo sapiens
ugguagcaaauuaacuuuacau

SEQ ID NO: 1267293 - RNA, 12 nt, Homo sapiens
ugguagccuuag

SEQ ID NO: 1267294 - RNA, 17 nt, Homo sapiens
ugguaggauaucuuggc

SEQ ID NO: 1267295 - RNA, 19 nt, Homo sapiens
ugguaguggaauagugaau

SEQ ID NO: 1267296 - RNA, 23 nt, Homo sapiens
ugguauccuacugagcauuugca

SEQ ID NO: 1267297 - RNA, 22 nt, Homo sapiens
ugguauccugugacauguaaca

SEQ ID NO: 1267298 - RNA, 12 nt, Homo sapiens
ugguaugaucac

SEQ ID NO: 1267299 - RNA, 20 nt, Homo sapiens
ugguaugcuggccagcaccc

SEQ ID NO: 1267300 - RNA, 19 nt, Homo sapiens
ugguaugugacaccaaagc

SEQ ID NO: 1267301 - RNA, 21 nt, Homo sapiens
uggucaagauuuugaaugcuu

SEQ ID NO: 1267302 - RNA, 23 nt, Homo sapiens
uggucaagggcugucauugcaca

SEQ ID NO: 1267303 - RNA, 19 nt, Homo sapiens
uggucacagccaugaaguc

SEQ ID NO: 1267304 - RNA, 12 nt, Homo sapiens
uggucagaugau

SEQ ID NO: 1267305 - RNA, 16 nt, Homo sapiens
uggucagaugcagguu

SEQ ID NO: 1267306 - RNA, 19 nt, Homo sapiens
uggucagguuauacuccuc

SEQ ID NO: 1267307 - RNA, 15 nt, Homo sapiens
uggucauugugaaua

SEQ ID NO: 1267308 - RNA, 18 nt, Homo sapiens
uggucccucugugucugc

SEQ ID NO: 1267309 - RNA, 15 nt, Homo sapiens
ugguccuagaacuuu

SEQ ID NO: 1267310 - RNA, 16 nt, Homo sapiens
ugguccuagaacuuug

SEQ ID NO: 1267311 - RNA, 20 nt, Homo sapiens
ugguccugacucaacauguu

SEQ ID NO: 1267312 - RNA, 19 nt, Homo sapiens
ugguccuggggaccauuca

SEQ ID NO: 1267313 - RNA, 15 nt, Homo sapiens
uggucgggaagggag

SEQ ID NO: 1267314 - RNA, 11 nt, Homo sapiens
uggucucagcc

SEQ ID NO: 1267315 - RNA, 16 nt, Homo sapiens
uggucuccuugcacuu

SEQ ID NO: 1267316 - RNA, 20 nt, Homo sapiens
uggucuuguggaauugggag

SEQ ID NO: 1267317 - RNA, 22 nt, Homo sapiens
uggucuuuguaagaguguagaa

SEQ ID NO: 1267318 - RNA, 22 nt, Homo sapiens
uggucuuuguaucuuccauauu

SEQ ID NO: 1267319 - RNA, 20 nt, Homo sapiens
uggugaaaccccgucucuac

SEQ ID NO: 1267320 - RNA, 16 nt, Homo sapiens
uggugaaagcugagaa

SEQ ID NO: 1267321 - RNA, 14 nt, Homo sapiens
uggugaaugacacg

SEQ ID NO: 1267322 - RNA, 14 nt, Homo sapiens
uggugaauuucaca

SEQ ID NO: 1267323 - RNA, 14 nt, Homo sapiens
uggugacauugcac

SEQ ID NO: 1267324 - RNA, 12 nt, Homo sapiens
uggugaccaccc

SEQ ID NO: 1267325 - RNA, 17 nt, Homo sapiens
uggugacugaaacauuc

SEQ ID NO: 1267326 - RNA, 14 nt, Homo sapiens
uggugaucagugca

SEQ ID NO: 1267327 - RNA, 20 nt, Homo sapiens
uggugcauagaacuggguaa

SEQ ID NO: 1267328 - RNA, 17 nt, Homo sapiens
uggugccaaacaaaaag

SEQ ID NO: 1267329 - RNA, 15 nt, Homo sapiens
uggugccccacagcu

SEQ ID NO: 1267330 - RNA, 16 nt, Homo sapiens
uggugccccacagcua

SEQ ID NO: 1267331 - RNA, 16 nt, Homo sapiens
uggugccccucgccag

SEQ ID NO: 1267332 - RNA, 20 nt, Homo sapiens
uggugcgcccugucucugug

SEQ ID NO: 1267333 - RNA, 18 nt, Homo sapiens
uggugcgucuaagaugag

SEQ ID NO: 1267334 - RNA, 13 nt, Homo sapiens
uggugcuggauau

SEQ ID NO: 1267335 - RNA, 21 nt, Homo sapiens
ugguggaacccccaucucuac

SEQ ID NO: 1267336 - RNA, 15 nt, Homo sapiens
ugguggagcagagug

SEQ ID NO: 1267337 - RNA, 24 nt, Homo sapiens
ugguggcacaggaguguccucuuc

SEQ ID NO: 1267338 - RNA, 17 nt, Homo sapiens
ugguggcauuguuuaca

SEQ ID NO: 1267339 - RNA, 18 nt, Homo sapiens
ugguggcauuguuuacag

SEQ ID NO: 1267340 - RNA, 16 nt, Homo sapiens
ugguggccaccgccag

SEQ ID NO: 1267341 - RNA, 18 nt, Homo sapiens
ugguguagcgugcaucag

SEQ ID NO: 1267342 - RNA, 15 nt, Homo sapiens
ugguguauguaugag

SEQ ID NO: 1267343 - RNA, 13 nt, Homo sapiens
ugguguauuguca

SEQ ID NO: 1267344 - RNA, 19 nt, Homo sapiens
ugguguucaaaaaaacacu
